United States Patent 10,058,623 (COMPOSITIONS AND METHODS FOR MODULATING UTRN EXPRESSION) - sequence listing, part 11

SEQ ID NO: 385888 - DNA, 15 bp, Homo sapiens
tgtaaggtatatggg

SEQ ID NO: 385889 - DNA, 15 bp, Homo sapiens
gtaaggtatatgggg

SEQ ID NO: 385890 - DNA, 15 bp, Homo sapiens
taaggtatatggggc

SEQ ID NO: 385891 - DNA, 15 bp, Homo sapiens
aaggtatatggggca

SEQ ID NO: 385892 - DNA, 15 bp, Homo sapiens
aggtatatggggcaa

SEQ ID NO: 385893 - DNA, 15 bp, Homo sapiens
ggtatatggggcaat

SEQ ID NO: 385894 - DNA, 15 bp, Homo sapiens
gtatatggggcaatc

SEQ ID NO: 385895 - DNA, 15 bp, Homo sapiens
tatatggggcaatcc

SEQ ID NO: 385896 - DNA, 15 bp, Homo sapiens
atatggggcaatcct

SEQ ID NO: 385897 - DNA, 15 bp, Homo sapiens
tatggggcaatcctt

SEQ ID NO: 385898 - DNA, 15 bp, Homo sapiens
atggggcaatccttg

SEQ ID NO: 385899 - DNA, 15 bp, Homo sapiens
tggggcaatccttgg

SEQ ID NO: 385900 - DNA, 15 bp, Homo sapiens
ggggcaatccttggt

SEQ ID NO: 385901 - DNA, 15 bp, Homo sapiens
gggcaatccttggtt

SEQ ID NO: 385902 - DNA, 15 bp, Homo sapiens
ggcaatccttggtta

SEQ ID NO: 385903 - DNA, 15 bp, Homo sapiens
gcaatccttggttaa

SEQ ID NO: 385904 - DNA, 15 bp, Homo sapiens
caatccttggttaaa

SEQ ID NO: 385905 - DNA, 15 bp, Homo sapiens
aatccttggttaaaa

SEQ ID NO: 385906 - DNA, 15 bp, Homo sapiens
atccttggttaaaag

SEQ ID NO: 385907 - DNA, 15 bp, Homo sapiens
tccttggttaaaagc

SEQ ID NO: 385908 - DNA, 15 bp, Homo sapiens
ccttggttaaaagcc

SEQ ID NO: 385909 - DNA, 15 bp, Homo sapiens
cttggttaaaagccc

SEQ ID NO: 385910 - DNA, 15 bp, Homo sapiens
ttggttaaaagccca

SEQ ID NO: 385911 - DNA, 15 bp, Homo sapiens
tggttaaaagcccat

SEQ ID NO: 385912 - DNA, 15 bp, Homo sapiens
ggttaaaagcccatc

SEQ ID NO: 385913 - DNA, 15 bp, Homo sapiens
gttaaaagcccatct

SEQ ID NO: 385914 - DNA, 15 bp, Homo sapiens
ttaaaagcccatctt

SEQ ID NO: 385915 - DNA, 15 bp, Homo sapiens
taaaagcccatctta

SEQ ID NO: 385916 - DNA, 15 bp, Homo sapiens
aaaagcccatcttag

SEQ ID NO: 385917 - DNA, 15 bp, Homo sapiens
aaagcccatcttagg

SEQ ID NO: 385918 - DNA, 15 bp, Homo sapiens
aagcccatcttaggc

SEQ ID NO: 385919 - DNA, 15 bp, Homo sapiens
agcccatcttaggca

SEQ ID NO: 385920 - DNA, 15 bp, Homo sapiens
gcccatcttaggcac

SEQ ID NO: 385921 - DNA, 15 bp, Homo sapiens
cccatcttaggcact

SEQ ID NO: 385922 - DNA, 15 bp, Homo sapiens
ccatcttaggcactt

SEQ ID NO: 385923 - DNA, 15 bp, Homo sapiens
catcttaggcacttg

SEQ ID NO: 385924 - DNA, 15 bp, Homo sapiens
atcttaggcacttgc

SEQ ID NO: 385925 - DNA, 15 bp, Homo sapiens
tcttaggcacttgcc

SEQ ID NO: 385926 - DNA, 15 bp, Homo sapiens
cttaggcacttgcct

SEQ ID NO: 385927 - DNA, 15 bp, Homo sapiens
ttaggcacttgcctt

SEQ ID NO: 385928 - DNA, 15 bp, Homo sapiens
taggcacttgccttc

SEQ ID NO: 385929 - DNA, 15 bp, Homo sapiens
aggcacttgccttct

SEQ ID NO: 385930 - DNA, 15 bp, Homo sapiens
ggcacttgccttctg

SEQ ID NO: 385931 - DNA, 15 bp, Homo sapiens
gcacttgccttctgt

SEQ ID NO: 385932 - DNA, 15 bp, Homo sapiens
cacttgccttctgtg

SEQ ID NO: 385933 - DNA, 15 bp, Homo sapiens
acttgccttctgtgc

SEQ ID NO: 385934 - DNA, 15 bp, Homo sapiens
cttgccttctgtgct

SEQ ID NO: 385935 - DNA, 15 bp, Homo sapiens
ttgccttctgtgcta

SEQ ID NO: 385936 - DNA, 15 bp, Homo sapiens
tgccttctgtgctaa

SEQ ID NO: 385937 - DNA, 15 bp, Homo sapiens
gccttctgtgctaac

SEQ ID NO: 385938 - DNA, 15 bp, Homo sapiens
ccttctgtgctaacc

SEQ ID NO: 385939 - DNA, 15 bp, Homo sapiens
cttctgtgctaacct

SEQ ID NO: 385940 - DNA, 15 bp, Homo sapiens
ttctgtgctaaccta

SEQ ID NO: 385941 - DNA, 15 bp, Homo sapiens
tctgtgctaacctat

SEQ ID NO: 385942 - DNA, 15 bp, Homo sapiens
ctgtgctaacctata

SEQ ID NO: 385943 - DNA, 15 bp, Homo sapiens
tgtgctaacctatag

SEQ ID NO: 385944 - DNA, 15 bp, Homo sapiens
gtgctaacctatagg

SEQ ID NO: 385945 - DNA, 15 bp, Homo sapiens
tgctaacctatagga

SEQ ID NO: 385946 - DNA, 15 bp, Homo sapiens
gctaacctataggaa

SEQ ID NO: 385947 - DNA, 15 bp, Homo sapiens
ctaacctataggaag

SEQ ID NO: 385948 - DNA, 15 bp, Homo sapiens
taacctataggaagt

SEQ ID NO: 385949 - DNA, 15 bp, Homo sapiens
aacctataggaagtt

SEQ ID NO: 385950 - DNA, 15 bp, Homo sapiens
acctataggaagtta

SEQ ID NO: 385951 - DNA, 15 bp, Homo sapiens
cctataggaagttat

SEQ ID NO: 385952 - DNA, 15 bp, Homo sapiens
ctataggaagttatt

SEQ ID NO: 385953 - DNA, 15 bp, Homo sapiens
tataggaagttattt

SEQ ID NO: 385954 - DNA, 15 bp, Homo sapiens
ataggaagttatttc

SEQ ID NO: 385955 - DNA, 15 bp, Homo sapiens
taggaagttatttca

SEQ ID NO: 385956 - DNA, 15 bp, Homo sapiens
aggaagttatttcaa

SEQ ID NO: 385957 - DNA, 15 bp, Homo sapiens
ggaagttatttcaac

SEQ ID NO: 385958 - DNA, 15 bp, Homo sapiens
gaagttatttcaact

SEQ ID NO: 385959 - DNA, 15 bp, Homo sapiens
aagttatttcaactc

SEQ ID NO: 385960 - DNA, 15 bp, Homo sapiens
agttatttcaactca

SEQ ID NO: 385961 - DNA, 15 bp, Homo sapiens
gttatttcaactcac

SEQ ID NO: 385962 - DNA, 15 bp, Homo sapiens
ttatttcaactcacc

SEQ ID NO: 385963 - DNA, 15 bp, Homo sapiens
tatttcaactcaccg

SEQ ID NO: 385964 - DNA, 15 bp, Homo sapiens
atttcaactcaccga

SEQ ID NO: 385965 - DNA, 15 bp, Homo sapiens
tttcaactcaccgag

SEQ ID NO: 385966 - DNA, 15 bp, Homo sapiens
ttcaactcaccgagt

SEQ ID NO: 385967 - DNA, 15 bp, Homo sapiens
tcaactcaccgagtc

SEQ ID NO: 385968 - DNA, 15 bp, Homo sapiens
caactcaccgagtca

SEQ ID NO: 385969 - DNA, 15 bp, Homo sapiens
aactcaccgagtcac

SEQ ID NO: 385970 - DNA, 15 bp, Homo sapiens
actcaccgagtcacc

SEQ ID NO: 385971 - DNA, 15 bp, Homo sapiens
ctcaccgagtcacca

SEQ ID NO: 385972 - DNA, 15 bp, Homo sapiens
tcaccgagtcaccat

SEQ ID NO: 385973 - DNA, 15 bp, Homo sapiens
caccgagtcaccatt

SEQ ID NO: 385974 - DNA, 15 bp, Homo sapiens
accgagtcaccattt

SEQ ID NO: 385975 - DNA, 15 bp, Homo sapiens
ccgagtcaccatttc

SEQ ID NO: 385976 - DNA, 15 bp, Homo sapiens
cgagtcaccatttcc

SEQ ID NO: 385977 - DNA, 15 bp, Homo sapiens
gagtcaccatttcct

SEQ ID NO: 385978 - DNA, 15 bp, Homo sapiens
agtcaccatttcctt

SEQ ID NO: 385979 - DNA, 15 bp, Homo sapiens
gtcaccatttccttg

SEQ ID NO: 385980 - DNA, 15 bp, Homo sapiens
tcaccatttccttga

SEQ ID NO: 385981 - DNA, 15 bp, Homo sapiens
caccatttccttgat

SEQ ID NO: 385982 - DNA, 15 bp, Homo sapiens
accatttccttgatt

SEQ ID NO: 385983 - DNA, 15 bp, Homo sapiens
ccatttccttgattc

SEQ ID NO: 385984 - DNA, 15 bp, Homo sapiens
catttccttgattct

SEQ ID NO: 385985 - DNA, 15 bp, Homo sapiens
atttccttgattcta

SEQ ID NO: 385986 - DNA, 15 bp, Homo sapiens
tttccttgattctaa

SEQ ID NO: 385987 - DNA, 15 bp, Homo sapiens
ttccttgattctaaa

SEQ ID NO: 385988 - DNA, 15 bp, Homo sapiens
tccttgattctaaag

SEQ ID NO: 385989 - DNA, 15 bp, Homo sapiens
ccttgattctaaagt

SEQ ID NO: 385990 - DNA, 15 bp, Homo sapiens
cttgattctaaagtg

SEQ ID NO: 385991 - DNA, 15 bp, Homo sapiens
ttgattctaaagtgg

SEQ ID NO: 385992 - DNA, 15 bp, Homo sapiens
tgattctaaagtgga

SEQ ID NO: 385993 - DNA, 15 bp, Homo sapiens
gattctaaagtggag

SEQ ID NO: 385994 - DNA, 15 bp, Homo sapiens
attctaaagtggaga

SEQ ID NO: 385995 - DNA, 15 bp, Homo sapiens
ttctaaagtggagaa

SEQ ID NO: 385996 - DNA, 15 bp, Homo sapiens
tctaaagtggagaac

SEQ ID NO: 385997 - DNA, 15 bp, Homo sapiens
ctaaagtggagaaca

SEQ ID NO: 385998 - DNA, 15 bp, Homo sapiens
taaagtggagaacat

SEQ ID NO: 385999 - DNA, 15 bp, Homo sapiens
aaagtggagaacatg

SEQ ID NO: 386000 - DNA, 15 bp, Homo sapiens
aagtggagaacatgt

SEQ ID NO: 386001 - DNA, 15 bp, Homo sapiens
agtggagaacatgtc

SEQ ID NO: 386002 - DNA, 15 bp, Homo sapiens
gtggagaacatgtct

SEQ ID NO: 386003 - DNA, 15 bp, Homo sapiens
tggagaacatgtcta

SEQ ID NO: 386004 - DNA, 15 bp, Homo sapiens
ggagaacatgtctaa

SEQ ID NO: 386005 - DNA, 15 bp, Homo sapiens
gagaacatgtctaat

SEQ ID NO: 386006 - DNA, 15 bp, Homo sapiens
agaacatgtctaata

SEQ ID NO: 386007 - DNA, 15 bp, Homo sapiens
gaacatgtctaatat

SEQ ID NO: 386008 - DNA, 15 bp, Homo sapiens
aacatgtctaatatg

SEQ ID NO: 386009 - DNA, 15 bp, Homo sapiens
acatgtctaatatgt

SEQ ID NO: 386010 - DNA, 15 bp, Homo sapiens
catgtctaatatgtg

SEQ ID NO: 386011 - DNA, 15 bp, Homo sapiens
atgtctaatatgtgg

SEQ ID NO: 386012 - DNA, 15 bp, Homo sapiens
tgtctaatatgtggg

SEQ ID NO: 386013 - DNA, 15 bp, Homo sapiens
gtctaatatgtgggg

SEQ ID NO: 386014 - DNA, 15 bp, Homo sapiens
tctaatatgtggggt

SEQ ID NO: 386015 - DNA, 15 bp, Homo sapiens
ctaatatgtggggtt

SEQ ID NO: 386016 - DNA, 15 bp, Homo sapiens
taatatgtggggtta

SEQ ID NO: 386017 - DNA, 15 bp, Homo sapiens
aatatgtggggttat

SEQ ID NO: 386018 - DNA, 15 bp, Homo sapiens
atatgtggggttatt

SEQ ID NO: 386019 - DNA, 15 bp, Homo sapiens
tatgtggggttattg

SEQ ID NO: 386020 - DNA, 15 bp, Homo sapiens
atgtggggttattgt

SEQ ID NO: 386021 - DNA, 15 bp, Homo sapiens
tgtggggttattgtg

SEQ ID NO: 386022 - DNA, 15 bp, Homo sapiens
gtggggttattgtga

SEQ ID NO: 386023 - DNA, 15 bp, Homo sapiens
tggggttattgtgat

SEQ ID NO: 386024 - DNA, 15 bp, Homo sapiens
ggggttattgtgata

SEQ ID NO: 386025 - DNA, 15 bp, Homo sapiens
gggttattgtgatat

SEQ ID NO: 386026 - DNA, 15 bp, Homo sapiens
ggttattgtgatatc

SEQ ID NO: 386027 - DNA, 15 bp, Homo sapiens
gttattgtgatatca

SEQ ID NO: 386028 - DNA, 15 bp, Homo sapiens
ttattgtgatatcaa

SEQ ID NO: 386029 - DNA, 15 bp, Homo sapiens
tattgtgatatcaaa

SEQ ID NO: 386030 - DNA, 15 bp, Homo sapiens
attgtgatatcaaaa

SEQ ID NO: 386031 - DNA, 15 bp, Homo sapiens
ttgtgatatcaaaag

SEQ ID NO: 386032 - DNA, 15 bp, Homo sapiens
tgtgatatcaaaagt

SEQ ID NO: 386033 - DNA, 15 bp, Homo sapiens
gtgatatcaaaagtt

SEQ ID NO: 386034 - DNA, 15 bp, Homo sapiens
tgatatcaaaagtta

SEQ ID NO: 386035 - DNA, 15 bp, Homo sapiens
gatatcaaaagttat

SEQ ID NO: 386036 - DNA, 15 bp, Homo sapiens
atatcaaaagttatg

SEQ ID NO: 386037 - DNA, 15 bp, Homo sapiens
tatcaaaagttatgt

SEQ ID NO: 386038 - DNA, 15 bp, Homo sapiens
atcaaaagttatgtg

SEQ ID NO: 386039 - DNA, 15 bp, Homo sapiens
tcaaaagttatgtgt

SEQ ID NO: 386040 - DNA, 15 bp, Homo sapiens
caaaagttatgtgta

SEQ ID NO: 386041 - DNA, 15 bp, Homo sapiens
aaaagttatgtgtaa

SEQ ID NO: 386042 - DNA, 15 bp, Homo sapiens
aaagttatgtgtaaa

SEQ ID NO: 386043 - DNA, 15 bp, Homo sapiens
aagttatgtgtaaaa

SEQ ID NO: 386044 - DNA, 15 bp, Homo sapiens
agttatgtgtaaaag

SEQ ID NO: 386045 - DNA, 15 bp, Homo sapiens
gttatgtgtaaaagt

SEQ ID NO: 386046 - DNA, 15 bp, Homo sapiens
ttatgtgtaaaagtt

SEQ ID NO: 386047 - DNA, 15 bp, Homo sapiens
tatgtgtaaaagttc

SEQ ID NO: 386048 - DNA, 15 bp, Homo sapiens
atgtgtaaaagttct

SEQ ID NO: 386049 - DNA, 15 bp, Homo sapiens
tgtgtaaaagttctt

SEQ ID NO: 386050 - DNA, 15 bp, Homo sapiens
gtgtaaaagttcttg

SEQ ID NO: 386051 - DNA, 15 bp, Homo sapiens
tgtaaaagttcttgg

SEQ ID NO: 386052 - DNA, 15 bp, Homo sapiens
gtaaaagttcttggt

SEQ ID NO: 386053 - DNA, 15 bp, Homo sapiens
taaaagttcttggta

SEQ ID NO: 386054 - DNA, 15 bp, Homo sapiens
aaaagttcttggtag

SEQ ID NO: 386055 - DNA, 15 bp, Homo sapiens
aaagttcttggtagg

SEQ ID NO: 386056 - DNA, 15 bp, Homo sapiens
aagttcttggtaggt

SEQ ID NO: 386057 - DNA, 15 bp, Homo sapiens
agttcttggtaggta

SEQ ID NO: 386058 - DNA, 15 bp, Homo sapiens
gttcttggtaggtag

SEQ ID NO: 386059 - DNA, 15 bp, Homo sapiens
ttcttggtaggtagt

SEQ ID NO: 386060 - DNA, 15 bp, Homo sapiens
tcttggtaggtagta

SEQ ID NO: 386061 - DNA, 15 bp, Homo sapiens
cttggtaggtagtat

SEQ ID NO: 386062 - DNA, 15 bp, Homo sapiens
ttggtaggtagtata

SEQ ID NO: 386063 - DNA, 15 bp, Homo sapiens
tggtaggtagtatat

SEQ ID NO: 386064 - DNA, 15 bp, Homo sapiens
ggtaggtagtatatg

SEQ ID NO: 386065 - DNA, 15 bp, Homo sapiens
gtaggtagtatatgc

SEQ ID NO: 386066 - DNA, 15 bp, Homo sapiens
taggtagtatatgct

SEQ ID NO: 386067 - DNA, 15 bp, Homo sapiens
aggtagtatatgctt

SEQ ID NO: 386068 - DNA, 15 bp, Homo sapiens
ggtagtatatgctta

SEQ ID NO: 386069 - DNA, 15 bp, Homo sapiens
gtagtatatgcttaa

SEQ ID NO: 386070 - DNA, 15 bp, Homo sapiens
tagtatatgcttaag

SEQ ID NO: 386071 - DNA, 15 bp, Homo sapiens
agtatatgcttaaga

SEQ ID NO: 386072 - DNA, 15 bp, Homo sapiens
gtatatgcttaagaa

SEQ ID NO: 386073 - DNA, 15 bp, Homo sapiens
tatatgcttaagaaa

SEQ ID NO: 386074 - DNA, 15 bp, Homo sapiens
atatgcttaagaaaa

SEQ ID NO: 386075 - DNA, 15 bp, Homo sapiens
tatgcttaagaaaaa

SEQ ID NO: 386076 - DNA, 15 bp, Homo sapiens
atgcttaagaaaaag

SEQ ID NO: 386077 - DNA, 15 bp, Homo sapiens
tgcttaagaaaaaga

SEQ ID NO: 386078 - DNA, 15 bp, Homo sapiens
gcttaagaaaaagat

SEQ ID NO: 386079 - DNA, 15 bp, Homo sapiens
cttaagaaaaagatg

SEQ ID NO: 386080 - DNA, 15 bp, Homo sapiens
ttaagaaaaagatgc

SEQ ID NO: 386081 - DNA, 15 bp, Homo sapiens
taagaaaaagatgcc

SEQ ID NO: 386082 - DNA, 15 bp, Homo sapiens
aagaaaaagatgccc

SEQ ID NO: 386083 - DNA, 15 bp, Homo sapiens
agaaaaagatgccca

SEQ ID NO: 386084 - DNA, 15 bp, Homo sapiens
gaaaaagatgcccaa

SEQ ID NO: 386085 - DNA, 15 bp, Homo sapiens
aaaaagatgcccaaa

SEQ ID NO: 386086 - DNA, 15 bp, Homo sapiens
aaaagatgcccaaag

SEQ ID NO: 386087 - DNA, 15 bp, Homo sapiens
aaagatgcccaaagt

SEQ ID NO: 386088 - DNA, 15 bp, Homo sapiens
aagatgcccaaagtg

SEQ ID NO: 386089 - DNA, 15 bp, Homo sapiens
agatgcccaaagtgt

SEQ ID NO: 386090 - DNA, 15 bp, Homo sapiens
gatgcccaaagtgtc

SEQ ID NO: 386091 - DNA, 15 bp, Homo sapiens
atgcccaaagtgtca

SEQ ID NO: 386092 - DNA, 15 bp, Homo sapiens
tgcccaaagtgtcat

SEQ ID NO: 386093 - DNA, 15 bp, Homo sapiens
gcccaaagtgtcatc

SEQ ID NO: 386094 - DNA, 15 bp, Homo sapiens
cccaaagtgtcatca

SEQ ID NO: 386095 - DNA, 15 bp, Homo sapiens
ccaaagtgtcatcat

SEQ ID NO: 386096 - DNA, 15 bp, Homo sapiens
caaagtgtcatcata

SEQ ID NO: 386097 - DNA, 15 bp, Homo sapiens
aaagtgtcatcatat

SEQ ID NO: 386098 - DNA, 15 bp, Homo sapiens
aagtgtcatcatatg

SEQ ID NO: 386099 - DNA, 15 bp, Homo sapiens
agtgtcatcatatgc

SEQ ID NO: 386100 - DNA, 15 bp, Homo sapiens
gtgtcatcatatgct

SEQ ID NO: 386101 - DNA, 15 bp, Homo sapiens
tgtcatcatatgctc

SEQ ID NO: 386102 - DNA, 15 bp, Homo sapiens
gtcatcatatgctct

SEQ ID NO: 386103 - DNA, 15 bp, Homo sapiens
tcatcatatgctctt

SEQ ID NO: 386104 - DNA, 15 bp, Homo sapiens
catcatatgctcttt

SEQ ID NO: 386105 - DNA, 15 bp, Homo sapiens
atcatatgctctttc

SEQ ID NO: 386106 - DNA, 15 bp, Homo sapiens
tcatatgctctttca

SEQ ID NO: 386107 - DNA, 15 bp, Homo sapiens
catatgctctttcat

SEQ ID NO: 386108 - DNA, 15 bp, Homo sapiens
atatgctctttcata

SEQ ID NO: 386109 - DNA, 15 bp, Homo sapiens
tatgctctttcatat

SEQ ID NO: 386110 - DNA, 15 bp, Homo sapiens
atgctctttcatata

SEQ ID NO: 386111 - DNA, 15 bp, Homo sapiens
tgctctttcatataa

SEQ ID NO: 386112 - DNA, 15 bp, Homo sapiens
gctctttcatataat

SEQ ID NO: 386113 - DNA, 15 bp, Homo sapiens
ctctttcatataatg

SEQ ID NO: 386114 - DNA, 15 bp, Homo sapiens
tctttcatataatgt

SEQ ID NO: 386115 - DNA, 15 bp, Homo sapiens
ctttcatataatgtc

SEQ ID NO: 386116 - DNA, 15 bp, Homo sapiens
tttcatataatgtct

SEQ ID NO: 386117 - DNA, 15 bp, Homo sapiens
ttcatataatgtctt

SEQ ID NO: 386118 - DNA, 15 bp, Homo sapiens
tcatataatgtcttt

SEQ ID NO: 386119 - DNA, 15 bp, Homo sapiens
catataatgtctttc

SEQ ID NO: 386120 - DNA, 15 bp, Homo sapiens
atataatgtctttct

SEQ ID NO: 386121 - DNA, 15 bp, Homo sapiens
tataatgtctttctg

SEQ ID NO: 386122 - DNA, 15 bp, Homo sapiens
ataatgtctttctga

SEQ ID NO: 386123 - DNA, 15 bp, Homo sapiens
taatgtctttctgat

SEQ ID NO: 386124 - DNA, 15 bp, Homo sapiens
aatgtctttctgata

SEQ ID NO: 386125 - DNA, 15 bp, Homo sapiens
atgtctttctgataa

SEQ ID NO: 386126 - DNA, 15 bp, Homo sapiens
tgtctttctgataag

SEQ ID NO: 386127 - DNA, 15 bp, Homo sapiens
gtctttctgataagt

SEQ ID NO: 386128 - DNA, 15 bp, Homo sapiens
tctttctgataagtc

SEQ ID NO: 386129 - DNA, 15 bp, Homo sapiens
ctttctgataagtcc

SEQ ID NO: 386130 - DNA, 15 bp, Homo sapiens
tttctgataagtcca

SEQ ID NO: 386131 - DNA, 15 bp, Homo sapiens
ttctgataagtccac

SEQ ID NO: 386132 - DNA, 15 bp, Homo sapiens
tctgataagtccact

SEQ ID NO: 386133 - DNA, 15 bp, Homo sapiens
ctgataagtccactt

SEQ ID NO: 386134 - DNA, 15 bp, Homo sapiens
tgataagtccacttc

SEQ ID NO: 386135 - DNA, 15 bp, Homo sapiens
gataagtccacttcc

SEQ ID NO: 386136 - DNA, 15 bp, Homo sapiens
ataagtccacttcct

SEQ ID NO: 386137 - DNA, 15 bp, Homo sapiens
taagtccacttcctt

SEQ ID NO: 386138 - DNA, 15 bp, Homo sapiens
aagtccacttccttt

SEQ ID NO: 386139 - DNA, 15 bp, Homo sapiens
agtccacttccttta

SEQ ID NO: 386140 - DNA, 15 bp, Homo sapiens
gtccacttcctttag

SEQ ID NO: 386141 - DNA, 15 bp, Homo sapiens
tccacttcctttagt

SEQ ID NO: 386142 - DNA, 15 bp, Homo sapiens
ccacttcctttagtc

SEQ ID NO: 386143 - DNA, 15 bp, Homo sapiens
cacttcctttagtca

SEQ ID NO: 386144 - DNA, 15 bp, Homo sapiens
acttcctttagtcaa

SEQ ID NO: 386145 - DNA, 15 bp, Homo sapiens
cttcctttagtcaaa

SEQ ID NO: 386146 - DNA, 15 bp, Homo sapiens
ttcctttagtcaaat

SEQ ID NO: 386147 - DNA, 15 bp, Homo sapiens
tcctttagtcaaatg

SEQ ID NO: 386148 - DNA, 15 bp, Homo sapiens
cctttagtcaaatgc

SEQ ID NO: 386149 - DNA, 15 bp, Homo sapiens
ctttagtcaaatgca

SEQ ID NO: 386150 - DNA, 15 bp, Homo sapiens
tttagtcaaatgcac

SEQ ID NO: 386151 - DNA, 15 bp, Homo sapiens
ttagtcaaatgcaca

SEQ ID NO: 386152 - DNA, 15 bp, Homo sapiens
tagtcaaatgcacag

SEQ ID NO: 386153 - DNA, 15 bp, Homo sapiens
agtcaaatgcacagt

SEQ ID NO: 386154 - DNA, 15 bp, Homo sapiens
gtcaaatgcacagta

SEQ ID NO: 386155 - DNA, 15 bp, Homo sapiens
tcaaatgcacagtac

SEQ ID NO: 386156 - DNA, 15 bp, Homo sapiens
caaatgcacagtact

SEQ ID NO: 386157 - DNA, 15 bp, Homo sapiens
aaatgcacagtactt

SEQ ID NO: 386158 - DNA, 15 bp, Homo sapiens
aatgcacagtacttt

SEQ ID NO: 386159 - DNA, 15 bp, Homo sapiens
atgcacagtactttc

SEQ ID NO: 386160 - DNA, 15 bp, Homo sapiens
tgcacagtactttct

SEQ ID NO: 386161 - DNA, 15 bp, Homo sapiens
gcacagtactttctg

SEQ ID NO: 386162 - DNA, 15 bp, Homo sapiens
cacagtactttctgg

SEQ ID NO: 386163 - DNA, 15 bp, Homo sapiens
acagtactttctggg

SEQ ID NO: 386164 - DNA, 15 bp, Homo sapiens
cagtactttctgggg

SEQ ID NO: 386165 - DNA, 15 bp, Homo sapiens
agtactttctggggt

SEQ ID NO: 386166 - DNA, 15 bp, Homo sapiens
gtactttctggggtt

SEQ ID NO: 386167 - DNA, 15 bp, Homo sapiens
tactttctggggtta

SEQ ID NO: 386168 - DNA, 15 bp, Homo sapiens
actttctggggttaa

SEQ ID NO: 386169 - DNA, 15 bp, Homo sapiens
ctttctggggttaaa

SEQ ID NO: 386170 - DNA, 15 bp, Homo sapiens
tttctggggttaaat

SEQ ID NO: 386171 - DNA, 15 bp, Homo sapiens
ttctggggttaaatt

SEQ ID NO: 386172 - DNA, 15 bp, Homo sapiens
tctggggttaaatta

SEQ ID NO: 386173 - DNA, 15 bp, Homo sapiens
ctggggttaaattag

SEQ ID NO: 386174 - DNA, 15 bp, Homo sapiens
tggggttaaattagc

SEQ ID NO: 386175 - DNA, 15 bp, Homo sapiens
ggggttaaattagca

SEQ ID NO: 386176 - DNA, 15 bp, Homo sapiens
gggttaaattagcag

SEQ ID NO: 386177 - DNA, 15 bp, Homo sapiens
ggttaaattagcaga

SEQ ID NO: 386178 - DNA, 15 bp, Homo sapiens
gttaaattagcagaa

SEQ ID NO: 386179 - DNA, 15 bp, Homo sapiens
ttaaattagcagaag

SEQ ID NO: 386180 - DNA, 15 bp, Homo sapiens
taaattagcagaagg

SEQ ID NO: 386181 - DNA, 15 bp, Homo sapiens
aaattagcagaaggt

SEQ ID NO: 386182 - DNA, 15 bp, Homo sapiens
aattagcagaaggtt

SEQ ID NO: 386183 - DNA, 15 bp, Homo sapiens
attagcagaaggttg

SEQ ID NO: 386184 - DNA, 15 bp, Homo sapiens
ttagcagaaggttga

SEQ ID NO: 386185 - DNA, 15 bp, Homo sapiens
tagcagaaggttgag

SEQ ID NO: 386186 - DNA, 15 bp, Homo sapiens
agcagaaggttgagt

SEQ ID NO: 386187 - DNA, 15 bp, Homo sapiens
gcagaaggttgagtc

SEQ ID NO: 386188 - DNA, 15 bp, Homo sapiens
cagaaggttgagtca

SEQ ID NO: 386189 - DNA, 15 bp, Homo sapiens
agaaggttgagtcat

SEQ ID NO: 386190 - DNA, 15 bp, Homo sapiens
gaaggttgagtcatt

SEQ ID NO: 386191 - DNA, 15 bp, Homo sapiens
aaggttgagtcatta

SEQ ID NO: 386192 - DNA, 15 bp, Homo sapiens
aggttgagtcattat

SEQ ID NO: 386193 - DNA, 15 bp, Homo sapiens
ggttgagtcattatc

SEQ ID NO: 386194 - DNA, 15 bp, Homo sapiens
gttgagtcattatca

SEQ ID NO: 386195 - DNA, 15 bp, Homo sapiens
ttgagtcattatcag

SEQ ID NO: 386196 - DNA, 15 bp, Homo sapiens
tgagtcattatcagt

SEQ ID NO: 386197 - DNA, 15 bp, Homo sapiens
gagtcattatcagtt

SEQ ID NO: 386198 - DNA, 15 bp, Homo sapiens
agtcattatcagttg

SEQ ID NO: 386199 - DNA, 15 bp, Homo sapiens
gtcattatcagttgt

SEQ ID NO: 386200 - DNA, 15 bp, Homo sapiens
tcattatcagttgtt

SEQ ID NO: 386201 - DNA, 15 bp, Homo sapiens
cattatcagttgttt

SEQ ID NO: 386202 - DNA, 15 bp, Homo sapiens
attatcagttgtttg

SEQ ID NO: 386203 - DNA, 15 bp, Homo sapiens
ttatcagttgtttgt

SEQ ID NO: 386204 - DNA, 15 bp, Homo sapiens
tatcagttgtttgtc

SEQ ID NO: 386205 - DNA, 15 bp, Homo sapiens
atcagttgtttgtcc

SEQ ID NO: 386206 - DNA, 15 bp, Homo sapiens
tcagttgtttgtcca

SEQ ID NO: 386207 - DNA, 15 bp, Homo sapiens
cagttgtttgtccat

SEQ ID NO: 386208 - DNA, 15 bp, Homo sapiens
agttgtttgtccata

SEQ ID NO: 386209 - DNA, 15 bp, Homo sapiens
gttgtttgtccatag

SEQ ID NO: 386210 - DNA, 15 bp, Homo sapiens
ttgtttgtccatagt

SEQ ID NO: 386211 - DNA, 15 bp, Homo sapiens
tgtttgtccatagtc

SEQ ID NO: 386212 - DNA, 15 bp, Homo sapiens
gtttgtccatagtca

SEQ ID NO: 386213 - DNA, 15 bp, Homo sapiens
tttgtccatagtcat

SEQ ID NO: 386214 - DNA, 15 bp, Homo sapiens
ttgtccatagtcatt

SEQ ID NO: 386215 - DNA, 15 bp, Homo sapiens
tgtccatagtcattt

SEQ ID NO: 386216 - DNA, 15 bp, Homo sapiens
gtccatagtcatttc

SEQ ID NO: 386217 - DNA, 15 bp, Homo sapiens
tccatagtcatttct

SEQ ID NO: 386218 - DNA, 15 bp, Homo sapiens
ccatagtcatttcta

SEQ ID NO: 386219 - DNA, 15 bp, Homo sapiens
catagtcatttctaa

SEQ ID NO: 386220 - DNA, 15 bp, Homo sapiens
atagtcatttctaac

SEQ ID NO: 386221 - DNA, 15 bp, Homo sapiens
tagtcatttctaact

SEQ ID NO: 386222 - DNA, 15 bp, Homo sapiens
agtcatttctaactc

SEQ ID NO: 386223 - DNA, 15 bp, Homo sapiens
gtcatttctaactct

SEQ ID NO: 386224 - DNA, 15 bp, Homo sapiens
tcatttctaactctt

SEQ ID NO: 386225 - DNA, 15 bp, Homo sapiens
catttctaactcttt

SEQ ID NO: 386226 - DNA, 15 bp, Homo sapiens
atttctaactctttc

SEQ ID NO: 386227 - DNA, 15 bp, Homo sapiens
tttctaactctttct

SEQ ID NO: 386228 - DNA, 15 bp, Homo sapiens
ttctaactctttcta

SEQ ID NO: 386229 - DNA, 15 bp, Homo sapiens
tctaactctttctac

SEQ ID NO: 386230 - DNA, 15 bp, Homo sapiens
ctaactctttctact

SEQ ID NO: 386231 - DNA, 15 bp, Homo sapiens
taactctttctactt

SEQ ID NO: 386232 - DNA, 15 bp, Homo sapiens
aactctttctacttt

SEQ ID NO: 386233 - DNA, 15 bp, Homo sapiens
ctctttctactttaa

SEQ ID NO: 386234 - DNA, 15 bp, Homo sapiens
tctttctactttaat

SEQ ID NO: 386235 - DNA, 15 bp, Homo sapiens
ctttctactttaatt

SEQ ID NO: 386236 - DNA, 15 bp, Homo sapiens
tttctactttaatta

SEQ ID NO: 386237 - DNA, 15 bp, Homo sapiens
ttctactttaattaa

SEQ ID NO: 386238 - DNA, 15 bp, Homo sapiens
tctactttaattaat

SEQ ID NO: 386239 - DNA, 15 bp, Homo sapiens
ctactttaattaatg

SEQ ID NO: 386240 - DNA, 15 bp, Homo sapiens
tactttaattaatga

SEQ ID NO: 386241 - DNA, 15 bp, Homo sapiens
actttaattaatgat

SEQ ID NO: 386242 - DNA, 15 bp, Homo sapiens
ctttaattaatgata

SEQ ID NO: 386243 - DNA, 15 bp, Homo sapiens
tttaattaatgataa

SEQ ID NO: 386244 - DNA, 15 bp, Homo sapiens
ttaattaatgataaa

SEQ ID NO: 386245 - DNA, 15 bp, Homo sapiens
taattaatgataaaa

SEQ ID NO: 386246 - DNA, 15 bp, Homo sapiens
aattaatgataaaat

SEQ ID NO: 386247 - DNA, 15 bp, Homo sapiens
attaatgataaaata

SEQ ID NO: 386248 - DNA, 15 bp, Homo sapiens
ttaatgataaaatac

SEQ ID NO: 386249 - DNA, 15 bp, Homo sapiens
taatgataaaatact

SEQ ID NO: 386250 - DNA, 15 bp, Homo sapiens
aatgataaaatactt

SEQ ID NO: 386251 - DNA, 15 bp, Homo sapiens
atgataaaatacttc

SEQ ID NO: 386252 - DNA, 15 bp, Homo sapiens
tgataaaatacttct

SEQ ID NO: 386253 - DNA, 15 bp, Homo sapiens
gataaaatacttctt

SEQ ID NO: 386254 - DNA, 15 bp, Homo sapiens
ataaaatacttcttt

SEQ ID NO: 386255 - DNA, 15 bp, Homo sapiens
taaaatacttctttg

SEQ ID NO: 386256 - DNA, 15 bp, Homo sapiens
aaaatacttctttgt

SEQ ID NO: 386257 - DNA, 15 bp, Homo sapiens
aaatacttctttgtc

SEQ ID NO: 386258 - DNA, 15 bp, Homo sapiens
aatacttctttgtct

SEQ ID NO: 386259 - DNA, 15 bp, Homo sapiens
atacttctttgtctg

SEQ ID NO: 386260 - DNA, 15 bp, Homo sapiens
tacttctttgtctgc

SEQ ID NO: 386261 - DNA, 15 bp, Homo sapiens
acttctttgtctgct

SEQ ID NO: 386262 - DNA, 15 bp, Homo sapiens
cttctttgtctgctt

SEQ ID NO: 386263 - DNA, 15 bp, Homo sapiens
ttctttgtctgcttt

SEQ ID NO: 386264 - DNA, 15 bp, Homo sapiens
tctttgtctgctttt

SEQ ID NO: 386265 - DNA, 15 bp, Homo sapiens
ctttgtctgcttttc

SEQ ID NO: 386266 - DNA, 15 bp, Homo sapiens
tttgtctgcttttct

SEQ ID NO: 386267 - DNA, 15 bp, Homo sapiens
ttgtctgcttttctg

SEQ ID NO: 386268 - DNA, 15 bp, Homo sapiens
tgtctgcttttctga

SEQ ID NO: 386269 - DNA, 15 bp, Homo sapiens
gtctgcttttctgag

SEQ ID NO: 386270 - DNA, 15 bp, Homo sapiens
tctgcttttctgagt

SEQ ID NO: 386271 - DNA, 15 bp, Homo sapiens
ctgcttttctgagtg

SEQ ID NO: 386272 - DNA, 15 bp, Homo sapiens
tgcttttctgagtgc

SEQ ID NO: 386273 - DNA, 15 bp, Homo sapiens
gcttttctgagtgca

SEQ ID NO: 386274 - DNA, 15 bp, Homo sapiens
cttttctgagtgcag

SEQ ID NO: 386275 - DNA, 15 bp, Homo sapiens
ttttctgagtgcagt

SEQ ID NO: 386276 - DNA, 15 bp, Homo sapiens
tttctgagtgcagta

SEQ ID NO: 386277 - DNA, 15 bp, Homo sapiens
ttctgagtgcagtat

SEQ ID NO: 386278 - DNA, 15 bp, Homo sapiens
tctgagtgcagtata

SEQ ID NO: 386279 - DNA, 15 bp, Homo sapiens
ctgagtgcagtatag

SEQ ID NO: 386280 - DNA, 15 bp, Homo sapiens
tgagtgcagtataga

SEQ ID NO: 386281 - DNA, 15 bp, Homo sapiens
gagtgcagtatagat

SEQ ID NO: 386282 - DNA, 15 bp, Homo sapiens
agtgcagtatagata

SEQ ID NO: 386283 - DNA, 15 bp, Homo sapiens
gtgcagtatagatat

SEQ ID NO: 386284 - DNA, 15 bp, Homo sapiens
tgcagtatagatatt

SEQ ID NO: 386285 - DNA, 15 bp, Homo sapiens
gcagtatagatattc

SEQ ID NO: 386286 - DNA, 15 bp, Homo sapiens
cagtatagatattct

SEQ ID NO: 386287 - DNA, 15 bp, Homo sapiens
agtatagatattcta

SEQ ID NO: 386288 - DNA, 15 bp, Homo sapiens
gtatagatattctaa

SEQ ID NO: 386289 - DNA, 15 bp, Homo sapiens
tatagatattctaaa

SEQ ID NO: 386290 - DNA, 15 bp, Homo sapiens
atagatattctaaaa

SEQ ID NO: 386291 - DNA, 15 bp, Homo sapiens
tagatattctaaaat

SEQ ID NO: 386292 - DNA, 15 bp, Homo sapiens
agatattctaaaatt

SEQ ID NO: 386293 - DNA, 15 bp, Homo sapiens
gatattctaaaattt

SEQ ID NO: 386294 - DNA, 15 bp, Homo sapiens
atattctaaaatttt

SEQ ID NO: 386295 - DNA, 15 bp, Homo sapiens
tattctaaaatttta

SEQ ID NO: 386296 - DNA, 15 bp, Homo sapiens
attctaaaattttat

SEQ ID NO: 386297 - DNA, 15 bp, Homo sapiens
ttctaaaattttatt

SEQ ID NO: 386298 - DNA, 15 bp, Homo sapiens
tctaaaattttatta

SEQ ID NO: 386299 - DNA, 15 bp, Homo sapiens
ctaaaattttattaa

SEQ ID NO: 386300 - DNA, 15 bp, Homo sapiens
taaaattttattaac

SEQ ID NO: 386301 - DNA, 15 bp, Homo sapiens
aaaattttattaaca

SEQ ID NO: 386302 - DNA, 15 bp, Homo sapiens
aaattttattaacag

SEQ ID NO: 386303 - DNA, 15 bp, Homo sapiens
aattttattaacaga

SEQ ID NO: 386304 - DNA, 15 bp, Homo sapiens
attttattaacagat

SEQ ID NO: 386305 - DNA, 15 bp, Homo sapiens
ttttattaacagatg

SEQ ID NO: 386306 - DNA, 15 bp, Homo sapiens
tttattaacagatga

SEQ ID NO: 386307 - DNA, 15 bp, Homo sapiens
ttattaacagatgaa

SEQ ID NO: 386308 - DNA, 15 bp, Homo sapiens
tattaacagatgaaa

SEQ ID NO: 386309 - DNA, 15 bp, Homo sapiens
attaacagatgaaat

SEQ ID NO: 386310 - DNA, 15 bp, Homo sapiens
ttaacagatgaaatt

SEQ ID NO: 386311 - DNA, 15 bp, Homo sapiens
taacagatgaaattt

SEQ ID NO: 386312 - DNA, 15 bp, Homo sapiens
aacagatgaaatttc

SEQ ID NO: 386313 - DNA, 15 bp, Homo sapiens
acagatgaaatttct

SEQ ID NO: 386314 - DNA, 15 bp, Homo sapiens
cagatgaaatttctt

SEQ ID NO: 386315 - DNA, 15 bp, Homo sapiens
agatgaaatttctta

SEQ ID NO: 386316 - DNA, 15 bp, Homo sapiens
gatgaaatttcttaa

SEQ ID NO: 386317 - DNA, 15 bp, Homo sapiens
atgaaatttcttaaa

SEQ ID NO: 386318 - DNA, 15 bp, Homo sapiens
tgaaatttcttaaaa

SEQ ID NO: 386319 - DNA, 15 bp, Homo sapiens
gaaatttcttaaaaa

SEQ ID NO: 386320 - DNA, 15 bp, Homo sapiens
aaatttcttaaaaaa

SEQ ID NO: 386321 - DNA, 15 bp, Homo sapiens
aatttcttaaaaaat

SEQ ID NO: 386322 - DNA, 15 bp, Homo sapiens
atttcttaaaaaatg

SEQ ID NO: 386323 - DNA, 15 bp, Homo sapiens
tttcttaaaaaatgc

SEQ ID NO: 386324 - DNA, 15 bp, Homo sapiens
ttcttaaaaaatgca

SEQ ID NO: 386325 - DNA, 15 bp, Homo sapiens
tcttaaaaaatgcag

SEQ ID NO: 386326 - DNA, 15 bp, Homo sapiens
cttaaaaaatgcagt

SEQ ID NO: 386327 - DNA, 15 bp, Homo sapiens
ttaaaaaatgcagtt

SEQ ID NO: 386328 - DNA, 15 bp, Homo sapiens
taaaaaatgcagttt

SEQ ID NO: 386329 - DNA, 15 bp, Homo sapiens
aaaaaatgcagtttc

SEQ ID NO: 386330 - DNA, 15 bp, Homo sapiens
aaaaatgcagtttcc

SEQ ID NO: 386331 - DNA, 15 bp, Homo sapiens
aaaatgcagtttcct

SEQ ID NO: 386332 - DNA, 15 bp, Homo sapiens
aaatgcagtttcctt

SEQ ID NO: 386333 - DNA, 15 bp, Homo sapiens
aatgcagtttccttg

SEQ ID NO: 386334 - DNA, 15 bp, Homo sapiens
tgcagtttccttggt

SEQ ID NO: 386335 - DNA, 15 bp, Homo sapiens
gcagtttccttggtt

SEQ ID NO: 386336 - DNA, 15 bp, Homo sapiens
cagtttccttggttt

SEQ ID NO: 386337 - DNA, 15 bp, Homo sapiens
agtttccttggtttg

SEQ ID NO: 386338 - DNA, 15 bp, Homo sapiens
gtttccttggtttgc

SEQ ID NO: 386339 - DNA, 15 bp, Homo sapiens
tttccttggtttgca

SEQ ID NO: 386340 - DNA, 15 bp, Homo sapiens
ttccttggtttgcag

SEQ ID NO: 386341 - DNA, 15 bp, Homo sapiens
tccttggtttgcaga

SEQ ID NO: 386342 - DNA, 15 bp, Homo sapiens
ccttggtttgcagaa

SEQ ID NO: 386343 - DNA, 15 bp, Homo sapiens
cttggtttgcagaat

SEQ ID NO: 386344 - DNA, 15 bp, Homo sapiens
ttggtttgcagaatt

SEQ ID NO: 386345 - DNA, 15 bp, Homo sapiens
tggtttgcagaatta

SEQ ID NO: 386346 - DNA, 15 bp, Homo sapiens
ggtttgcagaattat

SEQ ID NO: 386347 - DNA, 15 bp, Homo sapiens
gtttgcagaattatc

SEQ ID NO: 386348 - DNA, 15 bp, Homo sapiens
tttgcagaattatca

SEQ ID NO: 386349 - DNA, 15 bp, Homo sapiens
ttgcagaattatcac

SEQ ID NO: 386350 - DNA, 15 bp, Homo sapiens
tgcagaattatcaca

SEQ ID NO: 386351 - DNA, 15 bp, Homo sapiens
gcagaattatcacag

SEQ ID NO: 386352 - DNA, 15 bp, Homo sapiens
cagaattatcacagt

SEQ ID NO: 386353 - DNA, 15 bp, Homo sapiens
agaattatcacagtt

SEQ ID NO: 386354 - DNA, 15 bp, Homo sapiens
gaattatcacagttg

SEQ ID NO: 386355 - DNA, 15 bp, Homo sapiens
aattatcacagttgc

SEQ ID NO: 386356 - DNA, 15 bp, Homo sapiens
attatcacagttgct

SEQ ID NO: 386357 - DNA, 15 bp, Homo sapiens
ttatcacagttgctg

SEQ ID NO: 386358 - DNA, 15 bp, Homo sapiens
tatcacagttgctga

SEQ ID NO: 386359 - DNA, 15 bp, Homo sapiens
atcacagttgctgaa

SEQ ID NO: 386360 - DNA, 15 bp, Homo sapiens
tcacagttgctgaat

SEQ ID NO: 386361 - DNA, 15 bp, Homo sapiens
cacagttgctgaatt

SEQ ID NO: 386362 - DNA, 15 bp, Homo sapiens
acagttgctgaattt

SEQ ID NO: 386363 - DNA, 15 bp, Homo sapiens
cagttgctgaattta

SEQ ID NO: 386364 - DNA, 15 bp, Homo sapiens
agttgctgaatttac

SEQ ID NO: 386365 - DNA, 15 bp, Homo sapiens
gttgctgaatttacc

SEQ ID NO: 386366 - DNA, 15 bp, Homo sapiens
ttgctgaatttacct

SEQ ID NO: 386367 - DNA, 15 bp, Homo sapiens
tgctgaatttacctt

SEQ ID NO: 386368 - DNA, 15 bp, Homo sapiens
gctgaatttaccttg

SEQ ID NO: 386369 - DNA, 15 bp, Homo sapiens
ctgaatttaccttgc

SEQ ID NO: 386370 - DNA, 15 bp, Homo sapiens
tgaatttaccttgca

SEQ ID NO: 386371 - DNA, 15 bp, Homo sapiens
gaatttaccttgcaa

SEQ ID NO: 386372 - DNA, 15 bp, Homo sapiens
aatttaccttgcaat

SEQ ID NO: 386373 - DNA, 15 bp, Homo sapiens
atttaccttgcaatt

SEQ ID NO: 386374 - DNA, 15 bp, Homo sapiens
tttaccttgcaatta

SEQ ID NO: 386375 - DNA, 15 bp, Homo sapiens
ttaccttgcaattaa

SEQ ID NO: 386376 - DNA, 15 bp, Homo sapiens
taccttgcaattaag

SEQ ID NO: 386377 - DNA, 15 bp, Homo sapiens
accttgcaattaagc

SEQ ID NO: 386378 - DNA, 15 bp, Homo sapiens
ccttgcaattaagca

SEQ ID NO: 386379 - DNA, 15 bp, Homo sapiens
cttgcaattaagcat

SEQ ID NO: 386380 - DNA, 15 bp, Homo sapiens
ttgcaattaagcatt

SEQ ID NO: 386381 - DNA, 15 bp, Homo sapiens
tgcaattaagcattt

SEQ ID NO: 386382 - DNA, 15 bp, Homo sapiens
gcaattaagcatttt

SEQ ID NO: 386383 - DNA, 15 bp, Homo sapiens
caattaagcattttc

SEQ ID NO: 386384 - DNA, 15 bp, Homo sapiens
aattaagcattttct

SEQ ID NO: 386385 - DNA, 15 bp, Homo sapiens
attaagcattttctg

SEQ ID NO: 386386 - DNA, 15 bp, Homo sapiens
ttaagcattttctgc

SEQ ID NO: 386387 - DNA, 15 bp, Homo sapiens
taagcattttctgcc

SEQ ID NO: 386388 - DNA, 15 bp, Homo sapiens
aagcattttctgcca

SEQ ID NO: 386389 - DNA, 15 bp, Homo sapiens
agcattttctgccaa

SEQ ID NO: 386390 - DNA, 15 bp, Homo sapiens
gcattttctgccaaa

SEQ ID NO: 386391 - DNA, 15 bp, Homo sapiens
cattttctgccaaag

SEQ ID NO: 386392 - DNA, 15 bp, Homo sapiens
attttctgccaaagc

SEQ ID NO: 386393 - DNA, 15 bp, Homo sapiens
ttttctgccaaagca

SEQ ID NO: 386394 - DNA, 15 bp, Homo sapiens
tttctgccaaagcaa

SEQ ID NO: 386395 - DNA, 15 bp, Homo sapiens
ttctgccaaagcaaa

SEQ ID NO: 386396 - DNA, 15 bp, Homo sapiens
tctgccaaagcaaaa

SEQ ID NO: 386397 - DNA, 15 bp, Homo sapiens
ctgccaaagcaaaag

SEQ ID NO: 386398 - DNA, 15 bp, Homo sapiens
tgccaaagcaaaagt

SEQ ID NO: 386399 - DNA, 15 bp, Homo sapiens
gccaaagcaaaagtc

SEQ ID NO: 386400 - DNA, 15 bp, Homo sapiens
ccaaagcaaaagtcc

SEQ ID NO: 386401 - DNA, 15 bp, Homo sapiens
caaagcaaaagtcca

SEQ ID NO: 386402 - DNA, 15 bp, Homo sapiens
aaagcaaaagtccaa

SEQ ID NO: 386403 - DNA, 15 bp, Homo sapiens
aagcaaaagtccaac

SEQ ID NO: 386404 - DNA, 15 bp, Homo sapiens
agcaaaagtccaacc

SEQ ID NO: 386405 - DNA, 15 bp, Homo sapiens
gcaaaagtccaacca

SEQ ID NO: 386406 - DNA, 15 bp, Homo sapiens
caaaagtccaaccat

SEQ ID NO: 386407 - DNA, 15 bp, Homo sapiens
aaaagtccaaccatc

SEQ ID NO: 386408 - DNA, 15 bp, Homo sapiens
aaagtccaaccatcc

SEQ ID NO: 386409 - DNA, 15 bp, Homo sapiens
aagtccaaccatcct

SEQ ID NO: 386410 - DNA, 15 bp, Homo sapiens
agtccaaccatcctg

SEQ ID NO: 386411 - DNA, 15 bp, Homo sapiens
gtccaaccatcctgg

SEQ ID NO: 386412 - DNA, 15 bp, Homo sapiens
tccaaccatcctggg

SEQ ID NO: 386413 - DNA, 15 bp, Homo sapiens
ccaaccatcctggga

SEQ ID NO: 386414 - DNA, 15 bp, Homo sapiens
caaccatcctgggaa

SEQ ID NO: 386415 - DNA, 15 bp, Homo sapiens
aaccatcctgggaag

SEQ ID NO: 386416 - DNA, 15 bp, Homo sapiens
accatcctgggaaga

SEQ ID NO: 386417 - DNA, 15 bp, Homo sapiens
ccatcctgggaagaa

SEQ ID NO: 386418 - DNA, 15 bp, Homo sapiens
catcctgggaagaaa

SEQ ID NO: 386419 - DNA, 15 bp, Homo sapiens
atcctgggaagaaaa

SEQ ID NO: 386420 - DNA, 15 bp, Homo sapiens
tcctgggaagaaaag

SEQ ID NO: 386421 - DNA, 15 bp, Homo sapiens
cctgggaagaaaaga

SEQ ID NO: 386422 - DNA, 15 bp, Homo sapiens
ctgggaagaaaagat

SEQ ID NO: 386423 - DNA, 15 bp, Homo sapiens
tgggaagaaaagata

SEQ ID NO: 386424 - DNA, 15 bp, Homo sapiens
gggaagaaaagatac

SEQ ID NO: 386425 - DNA, 15 bp, Homo sapiens
ggaagaaaagatacg

SEQ ID NO: 386426 - DNA, 15 bp, Homo sapiens
gaagaaaagatacgg

SEQ ID NO: 386427 - DNA, 15 bp, Homo sapiens
aagaaaagatacgga

SEQ ID NO: 386428 - DNA, 15 bp, Homo sapiens
agaaaagatacggaa

SEQ ID NO: 386429 - DNA, 15 bp, Homo sapiens
gaaaagatacggaat

SEQ ID NO: 386430 - DNA, 15 bp, Homo sapiens
aaaagatacggaatt

SEQ ID NO: 386431 - DNA, 15 bp, Homo sapiens
aaagatacggaattt

SEQ ID NO: 386432 - DNA, 15 bp, Homo sapiens
aagatacggaattta

SEQ ID NO: 386433 - DNA, 15 bp, Homo sapiens
agatacggaatttaa

SEQ ID NO: 386434 - DNA, 15 bp, Homo sapiens
gatacggaatttaaa

SEQ ID NO: 386435 - DNA, 15 bp, Homo sapiens
atacggaatttaaaa

SEQ ID NO: 386436 - DNA, 15 bp, Homo sapiens
tacggaatttaaaaa

SEQ ID NO: 386437 - DNA, 15 bp, Homo sapiens
acggaatttaaaaag

SEQ ID NO: 386438 - DNA, 15 bp, Homo sapiens
cggaatttaaaaaga

SEQ ID NO: 386439 - DNA, 15 bp, Homo sapiens
ggaatttaaaaagac

SEQ ID NO: 386440 - DNA, 15 bp, Homo sapiens
gaatttaaaaagaca

SEQ ID NO: 386441 - DNA, 15 bp, Homo sapiens
aatttaaaaagacac

SEQ ID NO: 386442 - DNA, 15 bp, Homo sapiens
atttaaaaagacaca

SEQ ID NO: 386443 - DNA, 15 bp, Homo sapiens
tttaaaaagacacaa

SEQ ID NO: 386444 - DNA, 15 bp, Homo sapiens
ttaaaaagacacaat

SEQ ID NO: 386445 - DNA, 15 bp, Homo sapiens
taaaaagacacaatt

SEQ ID NO: 386446 - DNA, 15 bp, Homo sapiens
aaaaagacacaatta

SEQ ID NO: 386447 - DNA, 15 bp, Homo sapiens
aaaagacacaattat

SEQ ID NO: 386448 - DNA, 15 bp, Homo sapiens
aaagacacaattatt

SEQ ID NO: 386449 - DNA, 15 bp, Homo sapiens
aagacacaattattt

SEQ ID NO: 386450 - DNA, 15 bp, Homo sapiens
agacacaattattta

SEQ ID NO: 386451 - DNA, 15 bp, Homo sapiens
gacacaattatttat

SEQ ID NO: 386452 - DNA, 15 bp, Homo sapiens
acacaattatttatt

SEQ ID NO: 386453 - DNA, 15 bp, Homo sapiens
cacaattatttattt

SEQ ID NO: 386454 - DNA, 15 bp, Homo sapiens
acaattatttattta

SEQ ID NO: 386455 - DNA, 15 bp, Homo sapiens
caattatttatttaa

SEQ ID NO: 386456 - DNA, 15 bp, Homo sapiens
aattatttatttaaa

SEQ ID NO: 386457 - DNA, 15 bp, Homo sapiens
attatttatttaaaa

SEQ ID NO: 386458 - DNA, 15 bp, Homo sapiens
ttatttatttaaaaa

SEQ ID NO: 386459 - DNA, 15 bp, Homo sapiens
atttatttaaaaaaa

SEQ ID NO: 386460 - DNA, 15 bp, Homo sapiens
tttatttaaaaaaat

SEQ ID NO: 386461 - DNA, 15 bp, Homo sapiens
ttatttaaaaaaata

SEQ ID NO: 386462 - DNA, 15 bp, Homo sapiens
tatttaaaaaaatat

SEQ ID NO: 386463 - DNA, 15 bp, Homo sapiens
atttaaaaaaatatt

SEQ ID NO: 386464 - DNA, 15 bp, Homo sapiens
taaaaaaatatttta

SEQ ID NO: 386465 - DNA, 15 bp, Homo sapiens
aaaaaaatattttat

SEQ ID NO: 386466 - DNA, 15 bp, Homo sapiens
aaaaaatattttatt

SEQ ID NO: 386467 - DNA, 15 bp, Homo sapiens
aaaatattttatttt

SEQ ID NO: 386468 - DNA, 15 bp, Homo sapiens
aaatattttatttta

SEQ ID NO: 386469 - DNA, 15 bp, Homo sapiens
aatattttattttat

SEQ ID NO: 386470 - DNA, 15 bp, Homo sapiens
atattttattttatt

SEQ ID NO: 386471 - DNA, 15 bp, Homo sapiens
ttattttattttatg

SEQ ID NO: 386472 - DNA, 15 bp, Homo sapiens
tattttattttatgt

SEQ ID NO: 386473 - DNA, 15 bp, Homo sapiens
attttattttatgtt

SEQ ID NO: 386474 - DNA, 15 bp, Homo sapiens
ttttattttatgttc

SEQ ID NO: 386475 - DNA, 15 bp, Homo sapiens
tttattttatgttcc

SEQ ID NO: 386476 - DNA, 15 bp, Homo sapiens
ttattttatgttcca

SEQ ID NO: 386477 - DNA, 15 bp, Homo sapiens
tattttatgttccag

SEQ ID NO: 386478 - DNA, 15 bp, Homo sapiens
attttatgttccagg

SEQ ID NO: 386479 - DNA, 15 bp, Homo sapiens
ttttatgttccagga

SEQ ID NO: 386480 - DNA, 15 bp, Homo sapiens
tttatgttccaggat

SEQ ID NO: 386481 - DNA, 15 bp, Homo sapiens
ttatgttccaggata

SEQ ID NO: 386482 - DNA, 15 bp, Homo sapiens
tatgttccaggatac

SEQ ID NO: 386483 - DNA, 15 bp, Homo sapiens
atgttccaggataca

SEQ ID NO: 386484 - DNA, 15 bp, Homo sapiens
tgttccaggatacat

SEQ ID NO: 386485 - DNA, 15 bp, Homo sapiens
gttccaggatacatg

SEQ ID NO: 386486 - DNA, 15 bp, Homo sapiens
ttccaggatacatgt

SEQ ID NO: 386487 - DNA, 15 bp, Homo sapiens
tccaggatacatgtg

SEQ ID NO: 386488 - DNA, 15 bp, Homo sapiens
ccaggatacatgtgc

SEQ ID NO: 386489 - DNA, 15 bp, Homo sapiens
caggatacatgtgca

SEQ ID NO: 386490 - DNA, 15 bp, Homo sapiens
aggatacatgtgcag

SEQ ID NO: 386491 - DNA, 15 bp, Homo sapiens
ggatacatgtgcagg

SEQ ID NO: 386492 - DNA, 15 bp, Homo sapiens
gatacatgtgcagga

SEQ ID NO: 386493 - DNA, 15 bp, Homo sapiens
atacatgtgcaggac

SEQ ID NO: 386494 - DNA, 15 bp, Homo sapiens
tacatgtgcaggaca

SEQ ID NO: 386495 - DNA, 15 bp, Homo sapiens
acatgtgcaggacat

SEQ ID NO: 386496 - DNA, 15 bp, Homo sapiens
catgtgcaggacatg

SEQ ID NO: 386497 - DNA, 15 bp, Homo sapiens
atgtgcaggacatgc

SEQ ID NO: 386498 - DNA, 15 bp, Homo sapiens
tgtgcaggacatgca

SEQ ID NO: 386499 - DNA, 15 bp, Homo sapiens
gtgcaggacatgcag

SEQ ID NO: 386500 - DNA, 15 bp, Homo sapiens
tgcaggacatgcagg

SEQ ID NO: 386501 - DNA, 15 bp, Homo sapiens
gcaggacatgcaggt

SEQ ID NO: 386502 - DNA, 15 bp, Homo sapiens
caggacatgcaggtt

SEQ ID NO: 386503 - DNA, 15 bp, Homo sapiens
aggacatgcaggttt

SEQ ID NO: 386504 - DNA, 15 bp, Homo sapiens
ggacatgcaggttta

SEQ ID NO: 386505 - DNA, 15 bp, Homo sapiens
gacatgcaggtttat

SEQ ID NO: 386506 - DNA, 15 bp, Homo sapiens
acatgcaggtttatg

SEQ ID NO: 386507 - DNA, 15 bp, Homo sapiens
catgcaggtttatga

SEQ ID NO: 386508 - DNA, 15 bp, Homo sapiens
atgcaggtttatgac

SEQ ID NO: 386509 - DNA, 15 bp, Homo sapiens
tgcaggtttatgaca

SEQ ID NO: 386510 - DNA, 15 bp, Homo sapiens
gcaggtttatgacat

SEQ ID NO: 386511 - DNA, 15 bp, Homo sapiens
caggtttatgacata

SEQ ID NO: 386512 - DNA, 15 bp, Homo sapiens
aggtttatgacatag

SEQ ID NO: 386513 - DNA, 15 bp, Homo sapiens
ggtttatgacatagg

SEQ ID NO: 386514 - DNA, 15 bp, Homo sapiens
gtttatgacataggt

SEQ ID NO: 386515 - DNA, 15 bp, Homo sapiens
tttatgacataggta

SEQ ID NO: 386516 - DNA, 15 bp, Homo sapiens
ttatgacataggtaa

SEQ ID NO: 386517 - DNA, 15 bp, Homo sapiens
tatgacataggtaaa

SEQ ID NO: 386518 - DNA, 15 bp, Homo sapiens
atgacataggtaaat

SEQ ID NO: 386519 - DNA, 15 bp, Homo sapiens
tgacataggtaaatg

SEQ ID NO: 386520 - DNA, 15 bp, Homo sapiens
gacataggtaaatgt

SEQ ID NO: 386521 - DNA, 15 bp, Homo sapiens
acataggtaaatgtg

SEQ ID NO: 386522 - DNA, 15 bp, Homo sapiens
cataggtaaatgtgg

SEQ ID NO: 386523 - DNA, 15 bp, Homo sapiens
ataggtaaatgtggt

SEQ ID NO: 386524 - DNA, 15 bp, Homo sapiens
taggtaaatgtggtg

SEQ ID NO: 386525 - DNA, 15 bp, Homo sapiens
aggtaaatgtggtgg

SEQ ID NO: 386526 - DNA, 15 bp, Homo sapiens
ggtaaatgtggtggt

SEQ ID NO: 386527 - DNA, 15 bp, Homo sapiens
gtaaatgtggtggtt

SEQ ID NO: 386528 - DNA, 15 bp, Homo sapiens
taaatgtggtggttt

SEQ ID NO: 386529 - DNA, 15 bp, Homo sapiens
aaatgtggtggtttg

SEQ ID NO: 386530 - DNA, 15 bp, Homo sapiens
aatgtggtggtttgc

SEQ ID NO: 386531 - DNA, 15 bp, Homo sapiens
atgtggtggtttgct

SEQ ID NO: 386532 - DNA, 15 bp, Homo sapiens
tgtggtggtttgctg

SEQ ID NO: 386533 - DNA, 15 bp, Homo sapiens
gtggtggtttgctgc

SEQ ID NO: 386534 - DNA, 15 bp, Homo sapiens
tggtggtttgctgca

SEQ ID NO: 386535 - DNA, 15 bp, Homo sapiens
ggtggtttgctgcat

SEQ ID NO: 386536 - DNA, 15 bp, Homo sapiens
gtggtttgctgcatc

SEQ ID NO: 386537 - DNA, 15 bp, Homo sapiens
tggtttgctgcatct

SEQ ID NO: 386538 - DNA, 15 bp, Homo sapiens
ggtttgctgcatcta

SEQ ID NO: 386539 - DNA, 15 bp, Homo sapiens
gtttgctgcatctat

SEQ ID NO: 386540 - DNA, 15 bp, Homo sapiens
tttgctgcatctatc

SEQ ID NO: 386541 - DNA, 15 bp, Homo sapiens
ttgctgcatctatca

SEQ ID NO: 386542 - DNA, 15 bp, Homo sapiens
tgctgcatctatcaa

SEQ ID NO: 386543 - DNA, 15 bp, Homo sapiens
gctgcatctatcaac

SEQ ID NO: 386544 - DNA, 15 bp, Homo sapiens
ctgcatctatcaacc

SEQ ID NO: 386545 - DNA, 15 bp, Homo sapiens
tgcatctatcaaccc

SEQ ID NO: 386546 - DNA, 15 bp, Homo sapiens
gcatctatcaaccca

SEQ ID NO: 386547 - DNA, 15 bp, Homo sapiens
catctatcaacccat

SEQ ID NO: 386548 - DNA, 15 bp, Homo sapiens
atctatcaacccatt

SEQ ID NO: 386549 - DNA, 15 bp, Homo sapiens
tctatcaacccatta

SEQ ID NO: 386550 - DNA, 15 bp, Homo sapiens
ctatcaacccattac

SEQ ID NO: 386551 - DNA, 15 bp, Homo sapiens
tatcaacccattacc

SEQ ID NO: 386552 - DNA, 15 bp, Homo sapiens
atcaacccattacct

SEQ ID NO: 386553 - DNA, 15 bp, Homo sapiens
tcaacccattaccta

SEQ ID NO: 386554 - DNA, 15 bp, Homo sapiens
gataaatatgtacat

SEQ ID NO: 386555 - DNA, 15 bp, Homo sapiens
ataaatatgtacatt

SEQ ID NO: 386556 - DNA, 15 bp, Homo sapiens
taaatatgtacattt

SEQ ID NO: 386557 - DNA, 15 bp, Homo sapiens
aaatatgtacattta

SEQ ID NO: 386558 - DNA, 15 bp, Homo sapiens
aatatgtacatttat

SEQ ID NO: 386559 - DNA, 15 bp, Homo sapiens
atatgtacatttatg

SEQ ID NO: 386560 - DNA, 15 bp, Homo sapiens
tatgtacatttatgt

SEQ ID NO: 386561 - DNA, 15 bp, Homo sapiens
atgtacatttatgtt

SEQ ID NO: 386562 - DNA, 15 bp, Homo sapiens
tgtacatttatgttt

SEQ ID NO: 386563 - DNA, 15 bp, Homo sapiens
gtacatttatgttta

SEQ ID NO: 386564 - DNA, 15 bp, Homo sapiens
tacatttatgtttag

SEQ ID NO: 386565 - DNA, 15 bp, Homo sapiens
acatttatgtttaga

SEQ ID NO: 386566 - DNA, 15 bp, Homo sapiens
catttatgtttagaa

SEQ ID NO: 386567 - DNA, 15 bp, Homo sapiens
atttatgtttagaat

SEQ ID NO: 386568 - DNA, 15 bp, Homo sapiens
tttatgtttagaatg

SEQ ID NO: 386569 - DNA, 15 bp, Homo sapiens
ttatgtttagaatgt

SEQ ID NO: 386570 - DNA, 15 bp, Homo sapiens
tatgtttagaatgtt

SEQ ID NO: 386571 - DNA, 15 bp, Homo sapiens
atgtttagaatgttt

SEQ ID NO: 386572 - DNA, 15 bp, Homo sapiens
tgtttagaatgtttc

SEQ ID NO: 386573 - DNA, 15 bp, Homo sapiens
gtttagaatgtttca

SEQ ID NO: 386574 - DNA, 15 bp, Homo sapiens
tttagaatgtttcac

SEQ ID NO: 386575 - DNA, 15 bp, Homo sapiens
ttagaatgtttcaca

SEQ ID NO: 386576 - DNA, 15 bp, Homo sapiens
tagaatgtttcacat

SEQ ID NO: 386577 - DNA, 15 bp, Homo sapiens
agaatgtttcacatt

SEQ ID NO: 386578 - DNA, 15 bp, Homo sapiens
gaatgtttcacatta

SEQ ID NO: 386579 - DNA, 15 bp, Homo sapiens
aatgtttcacattac

SEQ ID NO: 386580 - DNA, 15 bp, Homo sapiens
atgtttcacattacg

SEQ ID NO: 386581 - DNA, 15 bp, Homo sapiens
tgtttcacattacgg

SEQ ID NO: 386582 - DNA, 15 bp, Homo sapiens
gtttcacattacggt

SEQ ID NO: 386583 - DNA, 15 bp, Homo sapiens
tttcacattacggta

SEQ ID NO: 386584 - DNA, 15 bp, Homo sapiens
ttcacattacggtaa

SEQ ID NO: 386585 - DNA, 15 bp, Homo sapiens
tcacattacggtaat

SEQ ID NO: 386586 - DNA, 15 bp, Homo sapiens
cacattacggtaatt

SEQ ID NO: 386587 - DNA, 15 bp, Homo sapiens
acattacggtaattc

SEQ ID NO: 386588 - DNA, 15 bp, Homo sapiens
cattacggtaattcg

SEQ ID NO: 386589 - DNA, 15 bp, Homo sapiens
attacggtaattcgc

SEQ ID NO: 386590 - DNA, 15 bp, Homo sapiens
ttacggtaattcgca

SEQ ID NO: 386591 - DNA, 15 bp, Homo sapiens
tacggtaattcgcat

SEQ ID NO: 386592 - DNA, 15 bp, Homo sapiens
acggtaattcgcatg

SEQ ID NO: 386593 - DNA, 15 bp, Homo sapiens
cggtaattcgcatga

SEQ ID NO: 386594 - DNA, 15 bp, Homo sapiens
ggtaattcgcatgat

SEQ ID NO: 386595 - DNA, 15 bp, Homo sapiens
gtaattcgcatgatt

SEQ ID NO: 386596 - DNA, 15 bp, Homo sapiens
taattcgcatgattt

SEQ ID NO: 386597 - DNA, 15 bp, Homo sapiens
aattcgcatgatttt

SEQ ID NO: 386598 - DNA, 15 bp, Homo sapiens
attcgcatgattttt

SEQ ID NO: 386599 - DNA, 15 bp, Homo sapiens
ttcgcatgatttttc

SEQ ID NO: 386600 - DNA, 15 bp, Homo sapiens
tcgcatgatttttca

SEQ ID NO: 386601 - DNA, 15 bp, Homo sapiens
cgcatgatttttcac

SEQ ID NO: 386602 - DNA, 15 bp, Homo sapiens
gcatgatttttcact

SEQ ID NO: 386603 - DNA, 15 bp, Homo sapiens
catgatttttcactc

SEQ ID NO: 386604 - DNA, 15 bp, Homo sapiens
atgatttttcactcc

SEQ ID NO: 386605 - DNA, 15 bp, Homo sapiens
tgatttttcactccc

SEQ ID NO: 386606 - DNA, 15 bp, Homo sapiens
gatttttcactccct

SEQ ID NO: 386607 - DNA, 15 bp, Homo sapiens
ttttcactcccttgc

SEQ ID NO: 386608 - DNA, 15 bp, Homo sapiens
tttcactcccttgct

SEQ ID NO: 386609 - DNA, 15 bp, Homo sapiens
ttcactcccttgctt

SEQ ID NO: 386610 - DNA, 15 bp, Homo sapiens
tcactcccttgcttt

SEQ ID NO: 386611 - DNA, 15 bp, Homo sapiens
cactcccttgctttg

SEQ ID NO: 386612 - DNA, 15 bp, Homo sapiens
actcccttgctttgt

SEQ ID NO: 386613 - DNA, 15 bp, Homo sapiens
ctcccttgctttgtt

SEQ ID NO: 386614 - DNA, 15 bp, Homo sapiens
tcccttgctttgtta

SEQ ID NO: 386615 - DNA, 15 bp, Homo sapiens
cccttgctttgttat

SEQ ID NO: 386616 - DNA, 15 bp, Homo sapiens
ccttgctttgttatt

SEQ ID NO: 386617 - DNA, 15 bp, Homo sapiens
cttgctttgttatta

SEQ ID NO: 386618 - DNA, 15 bp, Homo sapiens
gctttgttattaaat

SEQ ID NO: 386619 - DNA, 15 bp, Homo sapiens
ctttgttattaaatg

SEQ ID NO: 386620 - DNA, 15 bp, Homo sapiens
tttgttattaaatgc

SEQ ID NO: 386621 - DNA, 15 bp, Homo sapiens
ttgttattaaatgct

SEQ ID NO: 386622 - DNA, 15 bp, Homo sapiens
tgttattaaatgctc

SEQ ID NO: 386623 - DNA, 15 bp, Homo sapiens
gttattaaatgctct

SEQ ID NO: 386624 - DNA, 15 bp, Homo sapiens
ttattaaatgctctt

SEQ ID NO: 386625 - DNA, 15 bp, Homo sapiens
tattaaatgctctta

SEQ ID NO: 386626 - DNA, 15 bp, Homo sapiens
attaaatgctcttaa

SEQ ID NO: 386627 - DNA, 15 bp, Homo sapiens
ttaaatgctcttaat

SEQ ID NO: 386628 - DNA, 15 bp, Homo sapiens
taaatgctcttaatt

SEQ ID NO: 386629 - DNA, 15 bp, Homo sapiens
aaatgctcttaattt

SEQ ID NO: 386630 - DNA, 15 bp, Homo sapiens
aatgctcttaatttt

SEQ ID NO: 386631 - DNA, 15 bp, Homo sapiens
atgctcttaatttta

SEQ ID NO: 386632 - DNA, 15 bp, Homo sapiens
tgctcttaattttaa

SEQ ID NO: 386633 - DNA, 15 bp, Homo sapiens
gctcttaattttaaa

SEQ ID NO: 386634 - DNA, 15 bp, Homo sapiens
ctcttaattttaaag

SEQ ID NO: 386635 - DNA, 15 bp, Homo sapiens
tcttaattttaaagt

SEQ ID NO: 386636 - DNA, 15 bp, Homo sapiens
cttaattttaaagtg

SEQ ID NO: 386637 - DNA, 15 bp, Homo sapiens
ttaattttaaagtgt

SEQ ID NO: 386638 - DNA, 15 bp, Homo sapiens
taattttaaagtgtt

SEQ ID NO: 386639 - DNA, 15 bp, Homo sapiens
aattttaaagtgttc

SEQ ID NO: 386640 - DNA, 15 bp, Homo sapiens
attttaaagtgttct

SEQ ID NO: 386641 - DNA, 15 bp, Homo sapiens
ttttaaagtgttctc

SEQ ID NO: 386642 - DNA, 15 bp, Homo sapiens
tttaaagtgttctct

SEQ ID NO: 386643 - DNA, 15 bp, Homo sapiens
ttaaagtgttctctc

SEQ ID NO: 386644 - DNA, 15 bp, Homo sapiens
taaagtgttctctcc

SEQ ID NO: 386645 - DNA, 15 bp, Homo sapiens
aaagtgttctctcca

SEQ ID NO: 386646 - DNA, 15 bp, Homo sapiens
aagtgttctctccat

SEQ ID NO: 386647 - DNA, 15 bp, Homo sapiens
agtgttctctccatt

SEQ ID NO: 386648 - DNA, 15 bp, Homo sapiens
gtgttctctccattc

SEQ ID NO: 386649 - DNA, 15 bp, Homo sapiens
tgttctctccattct

SEQ ID NO: 386650 - DNA, 15 bp, Homo sapiens
gttctctccattcta

SEQ ID NO: 386651 - DNA, 15 bp, Homo sapiens
ttctctccattctat

SEQ ID NO: 386652 - DNA, 15 bp, Homo sapiens
tctctccattctatt

SEQ ID NO: 386653 - DNA, 15 bp, Homo sapiens
ctctccattctattt

SEQ ID NO: 386654 - DNA, 15 bp, Homo sapiens
tctccattctatttt

SEQ ID NO: 386655 - DNA, 15 bp, Homo sapiens
ctccattctattttt

SEQ ID NO: 386656 - DNA, 15 bp, Homo sapiens
tccattctattttta

SEQ ID NO: 386657 - DNA, 15 bp, Homo sapiens
ccattctatttttaa

SEQ ID NO: 386658 - DNA, 15 bp, Homo sapiens
cattctatttttaaa

SEQ ID NO: 386659 - DNA, 15 bp, Homo sapiens
ttctatttttaaaaa

SEQ ID NO: 386660 - DNA, 15 bp, Homo sapiens
tctatttttaaaaaa

SEQ ID NO: 386661 - DNA, 15 bp, Homo sapiens
ctatttttaaaaaag

SEQ ID NO: 386662 - DNA, 15 bp, Homo sapiens
tatttttaaaaaagt

SEQ ID NO: 386663 - DNA, 15 bp, Homo sapiens
atttttaaaaaagtt

SEQ ID NO: 386664 - DNA, 15 bp, Homo sapiens
tttttaaaaaagttc

SEQ ID NO: 386665 - DNA, 15 bp, Homo sapiens
ttttaaaaaagttcc

SEQ ID NO: 386666 - DNA, 15 bp, Homo sapiens
tttaaaaaagttcca

SEQ ID NO: 386667 - DNA, 15 bp, Homo sapiens
ttaaaaaagttccat

SEQ ID NO: 386668 - DNA, 15 bp, Homo sapiens
taaaaaagttccatg

SEQ ID NO: 386669 - DNA, 15 bp, Homo sapiens
aaaaaagttccatgg

SEQ ID NO: 386670 - DNA, 15 bp, Homo sapiens
aaaaagttccatggt

SEQ ID NO: 386671 - DNA, 15 bp, Homo sapiens
aaaagttccatggtt

SEQ ID NO: 386672 - DNA, 15 bp, Homo sapiens
aaagttccatggttt

SEQ ID NO: 386673 - DNA, 15 bp, Homo sapiens
aagttccatggtttt

SEQ ID NO: 386674 - DNA, 15 bp, Homo sapiens
agttccatggtttta

SEQ ID NO: 386675 - DNA, 15 bp, Homo sapiens
gttccatggttttat

SEQ ID NO: 386676 - DNA, 15 bp, Homo sapiens
ttccatggttttatt

SEQ ID NO: 386677 - DNA, 15 bp, Homo sapiens
tccatggttttattt

SEQ ID NO: 386678 - DNA, 15 bp, Homo sapiens
ccatggttttatttt

SEQ ID NO: 386679 - DNA, 15 bp, Homo sapiens
catggttttattttc

SEQ ID NO: 386680 - DNA, 15 bp, Homo sapiens
atggttttattttca

SEQ ID NO: 386681 - DNA, 15 bp, Homo sapiens
tggttttattttcag

SEQ ID NO: 386682 - DNA, 15 bp, Homo sapiens
ggttttattttcagc

SEQ ID NO: 386683 - DNA, 15 bp, Homo sapiens
gttttattttcagca

SEQ ID NO: 386684 - DNA, 15 bp, Homo sapiens
ttttattttcagcac

SEQ ID NO: 386685 - DNA, 15 bp, Homo sapiens
tttattttcagcacc

SEQ ID NO: 386686 - DNA, 15 bp, Homo sapiens
ttattttcagcacct

SEQ ID NO: 386687 - DNA, 15 bp, Homo sapiens
tattttcagcacctt

SEQ ID NO: 386688 - DNA, 15 bp, Homo sapiens
attttcagcacctta

SEQ ID NO: 386689 - DNA, 15 bp, Homo sapiens
ttttcagcaccttat

SEQ ID NO: 386690 - DNA, 15 bp, Homo sapiens
tttcagcaccttata

SEQ ID NO: 386691 - DNA, 15 bp, Homo sapiens
ttcagcaccttatag

SEQ ID NO: 386692 - DNA, 15 bp, Homo sapiens
tcagcaccttataga

SEQ ID NO: 386693 - DNA, 15 bp, Homo sapiens
cagcaccttatagat

SEQ ID NO: 386694 - DNA, 15 bp, Homo sapiens
agcaccttatagata

SEQ ID NO: 386695 - DNA, 15 bp, Homo sapiens
gcaccttatagatag

SEQ ID NO: 386696 - DNA, 15 bp, Homo sapiens
caccttatagataga

SEQ ID NO: 386697 - DNA, 15 bp, Homo sapiens
accttatagatagaa

SEQ ID NO: 386698 - DNA, 15 bp, Homo sapiens
ccttatagatagaag

SEQ ID NO: 386699 - DNA, 15 bp, Homo sapiens
cttatagatagaaga

SEQ ID NO: 386700 - DNA, 15 bp, Homo sapiens
ttatagatagaagat

SEQ ID NO: 386701 - DNA, 15 bp, Homo sapiens
tatagatagaagatt

SEQ ID NO: 386702 - DNA, 15 bp, Homo sapiens
atagatagaagattg

SEQ ID NO: 386703 - DNA, 15 bp, Homo sapiens
tagatagaagattgt

SEQ ID NO: 386704 - DNA, 15 bp, Homo sapiens
agatagaagattgtt

SEQ ID NO: 386705 - DNA, 15 bp, Homo sapiens
gatagaagattgtta

SEQ ID NO: 386706 - DNA, 15 bp, Homo sapiens
atagaagattgttag

SEQ ID NO: 386707 - DNA, 15 bp, Homo sapiens
tagaagattgttaga

SEQ ID NO: 386708 - DNA, 15 bp, Homo sapiens
agaagattgttagag

SEQ ID NO: 386709 - DNA, 15 bp, Homo sapiens
gaagattgttagaga

SEQ ID NO: 386710 - DNA, 15 bp, Homo sapiens
aagattgttagagat

SEQ ID NO: 386711 - DNA, 15 bp, Homo sapiens
agattgttagagatt

SEQ ID NO: 386712 - DNA, 15 bp, Homo sapiens
gattgttagagattt

SEQ ID NO: 386713 - DNA, 15 bp, Homo sapiens
attgttagagattta

SEQ ID NO: 386714 - DNA, 15 bp, Homo sapiens
ttgttagagatttag

SEQ ID NO: 386715 - DNA, 15 bp, Homo sapiens
tgttagagatttagt

SEQ ID NO: 386716 - DNA, 15 bp, Homo sapiens
gttagagatttagta

SEQ ID NO: 386717 - DNA, 15 bp, Homo sapiens
ttagagatttagtac

SEQ ID NO: 386718 - DNA, 15 bp, Homo sapiens
tagagatttagtacc

SEQ ID NO: 386719 - DNA, 15 bp, Homo sapiens
agagatttagtacct

SEQ ID NO: 386720 - DNA, 15 bp, Homo sapiens
gagatttagtacctt

SEQ ID NO: 386721 - DNA, 15 bp, Homo sapiens
agatttagtaccttt

SEQ ID NO: 386722 - DNA, 15 bp, Homo sapiens
gatttagtacctttt

SEQ ID NO: 386723 - DNA, 15 bp, Homo sapiens
atttagtacctttta

SEQ ID NO: 386724 - DNA, 15 bp, Homo sapiens
tttagtaccttttac

SEQ ID NO: 386725 - DNA, 15 bp, Homo sapiens
ttagtaccttttact

SEQ ID NO: 386726 - DNA, 15 bp, Homo sapiens
tagtaccttttactg

SEQ ID NO: 386727 - DNA, 15 bp, Homo sapiens
agtaccttttactga

SEQ ID NO: 386728 - DNA, 15 bp, Homo sapiens
gtaccttttactgag

SEQ ID NO: 386729 - DNA, 15 bp, Homo sapiens
taccttttactgagt

SEQ ID NO: 386730 - DNA, 15 bp, Homo sapiens
accttttactgagtt

SEQ ID NO: 386731 - DNA, 15 bp, Homo sapiens
ccttttactgagttt

SEQ ID NO: 386732 - DNA, 15 bp, Homo sapiens
cttttactgagtttt

SEQ ID NO: 386733 - DNA, 15 bp, Homo sapiens
ttttactgagttttt

SEQ ID NO: 386734 - DNA, 15 bp, Homo sapiens
tttactgagtttttc

SEQ ID NO: 386735 - DNA, 15 bp, Homo sapiens
ttactgagtttttct

SEQ ID NO: 386736 - DNA, 15 bp, Homo sapiens
tactgagtttttctg

SEQ ID NO: 386737 - DNA, 15 bp, Homo sapiens
actgagtttttctga

SEQ ID NO: 386738 - DNA, 15 bp, Homo sapiens
ctgagtttttctgag

SEQ ID NO: 386739 - DNA, 15 bp, Homo sapiens
tgagtttttctgagg

SEQ ID NO: 386740 - DNA, 15 bp, Homo sapiens
gagtttttctgaggc

SEQ ID NO: 386741 - DNA, 15 bp, Homo sapiens
agtttttctgaggca

SEQ ID NO: 386742 - DNA, 15 bp, Homo sapiens
gtttttctgaggcaa

SEQ ID NO: 386743 - DNA, 15 bp, Homo sapiens
tttttctgaggcaag

SEQ ID NO: 386744 - DNA, 15 bp, Homo sapiens
ttttctgaggcaaga

SEQ ID NO: 386745 - DNA, 15 bp, Homo sapiens
tttctgaggcaagag

SEQ ID NO: 386746 - DNA, 15 bp, Homo sapiens
ttctgaggcaagaga

SEQ ID NO: 386747 - DNA, 15 bp, Homo sapiens
tctgaggcaagagaa

SEQ ID NO: 386748 - DNA, 15 bp, Homo sapiens
tgaggcaagagaatt

SEQ ID NO: 386749 - DNA, 15 bp, Homo sapiens
gaggcaagagaattt

SEQ ID NO: 386750 - DNA, 15 bp, Homo sapiens
aggcaagagaatttt

SEQ ID NO: 386751 - DNA, 15 bp, Homo sapiens
ggcaagagaatttta

SEQ ID NO: 386752 - DNA, 15 bp, Homo sapiens
gcaagagaattttaa

SEQ ID NO: 386753 - DNA, 15 bp, Homo sapiens
caagagaattttaat

SEQ ID NO: 386754 - DNA, 15 bp, Homo sapiens
aagagaattttaatt

SEQ ID NO: 386755 - DNA, 15 bp, Homo sapiens
agagaattttaattt

SEQ ID NO: 386756 - DNA, 15 bp, Homo sapiens
gagaattttaatttt

SEQ ID NO: 386757 - DNA, 15 bp, Homo sapiens
agaattttaattttt

SEQ ID NO: 386758 - DNA, 15 bp, Homo sapiens
gaattttaatttttt

SEQ ID NO: 386759 - DNA, 15 bp, Homo sapiens
aattttaattttttt

SEQ ID NO: 386760 - DNA, 15 bp, Homo sapiens
attttaattttttta

SEQ ID NO: 386761 - DNA, 15 bp, Homo sapiens
ttttaatttttttat

SEQ ID NO: 386762 - DNA, 15 bp, Homo sapiens
tttaatttttttatg

SEQ ID NO: 386763 - DNA, 15 bp, Homo sapiens
ttaatttttttatgg

SEQ ID NO: 386764 - DNA, 15 bp, Homo sapiens
taatttttttatggt

SEQ ID NO: 386765 - DNA, 15 bp, Homo sapiens
aatttttttatggtg

SEQ ID NO: 386766 - DNA, 15 bp, Homo sapiens
atttttttatggtgt

SEQ ID NO: 386767 - DNA, 15 bp, Homo sapiens
tttttttatggtgtt

SEQ ID NO: 386768 - DNA, 15 bp, Homo sapiens
ttttttatggtgttg

SEQ ID NO: 386769 - DNA, 15 bp, Homo sapiens
tttttatggtgttgt

SEQ ID NO: 386770 - DNA, 15 bp, Homo sapiens
ttttatggtgttgta

SEQ ID NO: 386771 - DNA, 15 bp, Homo sapiens
tttatggtgttgtat

SEQ ID NO: 386772 - DNA, 15 bp, Homo sapiens
ttatggtgttgtata

SEQ ID NO: 386773 - DNA, 15 bp, Homo sapiens
tatggtgttgtatat

SEQ ID NO: 386774 - DNA, 15 bp, Homo sapiens
atggtgttgtatatt

SEQ ID NO: 386775 - DNA, 15 bp, Homo sapiens
tggtgttgtatatta

SEQ ID NO: 386776 - DNA, 15 bp, Homo sapiens
ggtgttgtatattaa

SEQ ID NO: 386777 - DNA, 15 bp, Homo sapiens
gtgttgtatattaat

SEQ ID NO: 386778 - DNA, 15 bp, Homo sapiens
tgttgtatattaatg

SEQ ID NO: 386779 - DNA, 15 bp, Homo sapiens
gttgtatattaatga

SEQ ID NO: 386780 - DNA, 15 bp, Homo sapiens
ttgtatattaatgat

SEQ ID NO: 386781 - DNA, 15 bp, Homo sapiens
tgtatattaatgatt

SEQ ID NO: 386782 - DNA, 15 bp, Homo sapiens
gtatattaatgattc

SEQ ID NO: 386783 - DNA, 15 bp, Homo sapiens
tatattaatgattct

SEQ ID NO: 386784 - DNA, 15 bp, Homo sapiens
atattaatgattctc

SEQ ID NO: 386785 - DNA, 15 bp, Homo sapiens
tattaatgattctcc

SEQ ID NO: 386786 - DNA, 15 bp, Homo sapiens
attaatgattctcct

SEQ ID NO: 386787 - DNA, 15 bp, Homo sapiens
ttaatgattctcctt

SEQ ID NO: 386788 - DNA, 15 bp, Homo sapiens
taatgattctccttt

SEQ ID NO: 386789 - DNA, 15 bp, Homo sapiens
aatgattctcctttt

SEQ ID NO: 386790 - DNA, 15 bp, Homo sapiens
atgattctccttttg

SEQ ID NO: 386791 - DNA, 15 bp, Homo sapiens
tgattctccttttgt

SEQ ID NO: 386792 - DNA, 15 bp, Homo sapiens
gattctccttttgta

SEQ ID NO: 386793 - DNA, 15 bp, Homo sapiens
attctccttttgtat

SEQ ID NO: 386794 - DNA, 15 bp, Homo sapiens
ttctccttttgtatg

SEQ ID NO: 386795 - DNA, 15 bp, Homo sapiens
tctccttttgtatga

SEQ ID NO: 386796 - DNA, 15 bp, Homo sapiens
ctccttttgtatgag

SEQ ID NO: 386797 - DNA, 15 bp, Homo sapiens
tccttttgtatgagt

SEQ ID NO: 386798 - DNA, 15 bp, Homo sapiens
ccttttgtatgagta

SEQ ID NO: 386799 - DNA, 15 bp, Homo sapiens
cttttgtatgagtaa

SEQ ID NO: 386800 - DNA, 15 bp, Homo sapiens
ttttgtatgagtaaa

SEQ ID NO: 386801 - DNA, 15 bp, Homo sapiens
tttgtatgagtaaac

SEQ ID NO: 386802 - DNA, 15 bp, Homo sapiens
ttgtatgagtaaaca

SEQ ID NO: 386803 - DNA, 15 bp, Homo sapiens
tgtatgagtaaacag

SEQ ID NO: 386804 - DNA, 15 bp, Homo sapiens
gtatgagtaaacaga

SEQ ID NO: 386805 - DNA, 15 bp, Homo sapiens
tatgagtaaacagac

SEQ ID NO: 386806 - DNA, 15 bp, Homo sapiens
atgagtaaacagaca

SEQ ID NO: 386807 - DNA, 15 bp, Homo sapiens
tgagtaaacagacat

SEQ ID NO: 386808 - DNA, 15 bp, Homo sapiens
gagtaaacagacatt

SEQ ID NO: 386809 - DNA, 15 bp, Homo sapiens
agtaaacagacattt

SEQ ID NO: 386810 - DNA, 15 bp, Homo sapiens
gtaaacagacattta

SEQ ID NO: 386811 - DNA, 15 bp, Homo sapiens
taaacagacatttaa

SEQ ID NO: 386812 - DNA, 15 bp, Homo sapiens
aaacagacatttaaa

SEQ ID NO: 386813 - DNA, 15 bp, Homo sapiens
aacagacatttaaaa

SEQ ID NO: 386814 - DNA, 15 bp, Homo sapiens
acagacatttaaaat

SEQ ID NO: 386815 - DNA, 15 bp, Homo sapiens
cagacatttaaaata

SEQ ID NO: 386816 - DNA, 15 bp, Homo sapiens
agacatttaaaatag

SEQ ID NO: 386817 - DNA, 15 bp, Homo sapiens
gacatttaaaataga

SEQ ID NO: 386818 - DNA, 15 bp, Homo sapiens
acatttaaaatagaa

SEQ ID NO: 386819 - DNA, 15 bp, Homo sapiens
catttaaaatagaaa

SEQ ID NO: 386820 - DNA, 15 bp, Homo sapiens
atttaaaatagaaac

SEQ ID NO: 386821 - DNA, 15 bp, Homo sapiens
tttaaaatagaaact

SEQ ID NO: 386822 - DNA, 15 bp, Homo sapiens
ttaaaatagaaactt

SEQ ID NO: 386823 - DNA, 15 bp, Homo sapiens
taaaatagaaacttg

SEQ ID NO: 386824 - DNA, 15 bp, Homo sapiens
aaaatagaaacttgt

SEQ ID NO: 386825 - DNA, 15 bp, Homo sapiens
aaatagaaacttgtt

SEQ ID NO: 386826 - DNA, 15 bp, Homo sapiens
aatagaaacttgttt

SEQ ID NO: 386827 - DNA, 15 bp, Homo sapiens
atagaaacttgtttg

SEQ ID NO: 386828 - DNA, 15 bp, Homo sapiens
tagaaacttgtttgg

SEQ ID NO: 386829 - DNA, 15 bp, Homo sapiens
agaaacttgtttgga

SEQ ID NO: 386830 - DNA, 15 bp, Homo sapiens
gaaacttgtttggaa

SEQ ID NO: 386831 - DNA, 15 bp, Homo sapiens
aaacttgtttggaaa

SEQ ID NO: 386832 - DNA, 15 bp, Homo sapiens
aacttgtttggaaat

SEQ ID NO: 386833 - DNA, 15 bp, Homo sapiens
acttgtttggaaatg

SEQ ID NO: 386834 - DNA, 15 bp, Homo sapiens
cttgtttggaaatgg

SEQ ID NO: 386835 - DNA, 15 bp, Homo sapiens
ttgtttggaaatgga

SEQ ID NO: 386836 - DNA, 15 bp, Homo sapiens
tgtttggaaatggag

SEQ ID NO: 386837 - DNA, 15 bp, Homo sapiens
gtttggaaatggaga

SEQ ID NO: 386838 - DNA, 15 bp, Homo sapiens
tttggaaatggagag

SEQ ID NO: 386839 - DNA, 15 bp, Homo sapiens
ttggaaatggagaga

SEQ ID NO: 386840 - DNA, 15 bp, Homo sapiens
tggaaatggagagac

SEQ ID NO: 386841 - DNA, 15 bp, Homo sapiens
ggaaatggagagacg

SEQ ID NO: 386842 - DNA, 15 bp, Homo sapiens
gaaatggagagacgt

SEQ ID NO: 386843 - DNA, 15 bp, Homo sapiens
aaatggagagacgtt

SEQ ID NO: 386844 - DNA, 15 bp, Homo sapiens
aatggagagacgttt

SEQ ID NO: 386845 - DNA, 15 bp, Homo sapiens
atggagagacgtttg

SEQ ID NO: 386846 - DNA, 15 bp, Homo sapiens
tggagagacgtttgt

SEQ ID NO: 386847 - DNA, 15 bp, Homo sapiens
ggagagacgtttgtt

SEQ ID NO: 386848 - DNA, 15 bp, Homo sapiens
gagagacgtttgttg

SEQ ID NO: 386849 - DNA, 15 bp, Homo sapiens
agagacgtttgttgg

SEQ ID NO: 386850 - DNA, 15 bp, Homo sapiens
gagacgtttgttgga

SEQ ID NO: 386851 - DNA, 15 bp, Homo sapiens
agacgtttgttggag

SEQ ID NO: 386852 - DNA, 15 bp, Homo sapiens
gacgtttgttggaga

SEQ ID NO: 386853 - DNA, 15 bp, Homo sapiens
acgtttgttggagaa

SEQ ID NO: 386854 - DNA, 15 bp, Homo sapiens
cgtttgttggagaaa

SEQ ID NO: 386855 - DNA, 15 bp, Homo sapiens
gtttgttggagaaaa

SEQ ID NO: 386856 - DNA, 15 bp, Homo sapiens
tttgttggagaaaat

SEQ ID NO: 386857 - DNA, 15 bp, Homo sapiens
ttgttggagaaaatg

SEQ ID NO: 386858 - DNA, 15 bp, Homo sapiens
tgttggagaaaatga

SEQ ID NO: 386859 - DNA, 15 bp, Homo sapiens
gttggagaaaatgac

SEQ ID NO: 386860 - DNA, 15 bp, Homo sapiens
ttggagaaaatgact

SEQ ID NO: 386861 - DNA, 15 bp, Homo sapiens
tggagaaaatgactg

SEQ ID NO: 386862 - DNA, 15 bp, Homo sapiens
ggagaaaatgactgt

SEQ ID NO: 386863 - DNA, 15 bp, Homo sapiens
gagaaaatgactgta

SEQ ID NO: 386864 - DNA, 15 bp, Homo sapiens
agaaaatgactgtac

SEQ ID NO: 386865 - DNA, 15 bp, Homo sapiens
gaaaatgactgtaca

SEQ ID NO: 386866 - DNA, 15 bp, Homo sapiens
aaaatgactgtacag

SEQ ID NO: 386867 - DNA, 15 bp, Homo sapiens
aaatgactgtacaga

SEQ ID NO: 386868 - DNA, 15 bp, Homo sapiens
aatgactgtacagaa

SEQ ID NO: 386869 - DNA, 15 bp, Homo sapiens
atgactgtacagaag

SEQ ID NO: 386870 - DNA, 15 bp, Homo sapiens
tgactgtacagaagc

SEQ ID NO: 386871 - DNA, 15 bp, Homo sapiens
gactgtacagaagca

SEQ ID NO: 386872 - DNA, 15 bp, Homo sapiens
actgtacagaagcat

SEQ ID NO: 386873 - DNA, 15 bp, Homo sapiens
ctgtacagaagcatg

SEQ ID NO: 386874 - DNA, 15 bp, Homo sapiens
tgtacagaagcatgg

SEQ ID NO: 386875 - DNA, 15 bp, Homo sapiens
gtacagaagcatggc

SEQ ID NO: 386876 - DNA, 15 bp, Homo sapiens
tacagaagcatggca

SEQ ID NO: 386877 - DNA, 15 bp, Homo sapiens
acagaagcatggcaa

SEQ ID NO: 386878 - DNA, 15 bp, Homo sapiens
cagaagcatggcaaa

SEQ ID NO: 386879 - DNA, 15 bp, Homo sapiens
agaagcatggcaaat

SEQ ID NO: 386880 - DNA, 15 bp, Homo sapiens
gaagcatggcaaatc

SEQ ID NO: 386881 - DNA, 15 bp, Homo sapiens
aagcatggcaaatca

SEQ ID NO: 386882 - DNA, 15 bp, Homo sapiens
agcatggcaaatcat

SEQ ID NO: 386883 - DNA, 15 bp, Homo sapiens
gcatggcaaatcata

SEQ ID NO: 386884 - DNA, 15 bp, Homo sapiens
catggcaaatcataa

SEQ ID NO: 386885 - DNA, 15 bp, Homo sapiens
atggcaaatcataac

SEQ ID NO: 386886 - DNA, 15 bp, Homo sapiens
tggcaaatcataaca

SEQ ID NO: 386887 - DNA, 15 bp, Homo sapiens
ggcaaatcataacag

SEQ ID NO: 386888 - DNA, 15 bp, Homo sapiens
gcaaatcataacaga

SEQ ID NO: 386889 - DNA, 15 bp, Homo sapiens
caaatcataacagaa

SEQ ID NO: 386890 - DNA, 15 bp, Homo sapiens
aaatcataacagaaa

SEQ ID NO: 386891 - DNA, 15 bp, Homo sapiens
aatcataacagaaaa

SEQ ID NO: 386892 - DNA, 15 bp, Homo sapiens
atcataacagaaaag

SEQ ID NO: 386893 - DNA, 15 bp, Homo sapiens
tcataacagaaaagt

SEQ ID NO: 386894 - DNA, 15 bp, Homo sapiens
cataacagaaaagtt

SEQ ID NO: 386895 - DNA, 15 bp, Homo sapiens
ataacagaaaagttc

SEQ ID NO: 386896 - DNA, 15 bp, Homo sapiens
taacagaaaagttct

SEQ ID NO: 386897 - DNA, 15 bp, Homo sapiens
aacagaaaagttctg

SEQ ID NO: 386898 - DNA, 15 bp, Homo sapiens
acagaaaagttctgg

SEQ ID NO: 386899 - DNA, 15 bp, Homo sapiens
cagaaaagttctggt

SEQ ID NO: 386900 - DNA, 15 bp, Homo sapiens
agaaaagttctggtg

SEQ ID NO: 386901 - DNA, 15 bp, Homo sapiens
gaaaagttctggtgg

SEQ ID NO: 386902 - DNA, 15 bp, Homo sapiens
aaaagttctggtggc

SEQ ID NO: 386903 - DNA, 15 bp, Homo sapiens
aaagttctggtggca

SEQ ID NO: 386904 - DNA, 15 bp, Homo sapiens
aagttctggtggcat

SEQ ID NO: 386905 - DNA, 15 bp, Homo sapiens
agttctggtggcatg

SEQ ID NO: 386906 - DNA, 15 bp, Homo sapiens
gttctggtggcatgg

SEQ ID NO: 386907 - DNA, 15 bp, Homo sapiens
ttctggtggcatggt

SEQ ID NO: 386908 - DNA, 15 bp, Homo sapiens
tctggtggcatggtg

SEQ ID NO: 386909 - DNA, 15 bp, Homo sapiens
ctggtggcatggtgg

SEQ ID NO: 386910 - DNA, 15 bp, Homo sapiens
tggtggcatggtggt

SEQ ID NO: 386911 - DNA, 15 bp, Homo sapiens
ggtggcatggtggtg

SEQ ID NO: 386912 - DNA, 15 bp, Homo sapiens
gtggcatggtggtgg

SEQ ID NO: 386913 - DNA, 15 bp, Homo sapiens
tggcatggtggtggc

SEQ ID NO: 386914 - DNA, 15 bp, Homo sapiens
ggcatggtggtggca

SEQ ID NO: 386915 - DNA, 15 bp, Homo sapiens
gcatggtggtggcag

SEQ ID NO: 386916 - DNA, 15 bp, Homo sapiens
catggtggtggcagt

SEQ ID NO: 386917 - DNA, 15 bp, Homo sapiens
atggtggtggcagtg

SEQ ID NO: 386918 - DNA, 15 bp, Homo sapiens
tggtggtggcagtgg

SEQ ID NO: 386919 - DNA, 15 bp, Homo sapiens
ggtggtggcagtggt

SEQ ID NO: 386920 - DNA, 15 bp, Homo sapiens
gtggtggcagtggtg

SEQ ID NO: 386921 - DNA, 15 bp, Homo sapiens
tggtggcagtggtgg

SEQ ID NO: 386922 - DNA, 15 bp, Homo sapiens
ggtggcagtggtggt

SEQ ID NO: 386923 - DNA, 15 bp, Homo sapiens
gtggcagtggtggtg

SEQ ID NO: 386924 - DNA, 15 bp, Homo sapiens
tggcagtggtggtgg

SEQ ID NO: 386925 - DNA, 15 bp, Homo sapiens
ggcagtggtggtggt

SEQ ID NO: 386926 - DNA, 15 bp, Homo sapiens
gcagtggtggtggtg

SEQ ID NO: 386927 - DNA, 15 bp, Homo sapiens
cagtggtggtggtgg

SEQ ID NO: 386928 - DNA, 15 bp, Homo sapiens
agtggtggtggtggt

SEQ ID NO: 386929 - DNA, 15 bp, Homo sapiens
gtggtggtggtggtg

SEQ ID NO: 386930 - DNA, 15 bp, Homo sapiens
tggtggtggtggtgc

SEQ ID NO: 386931 - DNA, 15 bp, Homo sapiens
ggtggtggtggtgct

SEQ ID NO: 386932 - DNA, 15 bp, Homo sapiens
gtggtggtggtgctg

SEQ ID NO: 386933 - DNA, 15 bp, Homo sapiens
tggtggtggtgctgg

SEQ ID NO: 386934 - DNA, 15 bp, Homo sapiens
ggtggtggtgctggt

SEQ ID NO: 386935 - DNA, 15 bp, Homo sapiens
gtggtggtgctggtg

SEQ ID NO: 386936 - DNA, 15 bp, Homo sapiens
tggtggtgctggtgg

SEQ ID NO: 386937 - DNA, 15 bp, Homo sapiens
ggtggtgctggtggt

SEQ ID NO: 386938 - DNA, 15 bp, Homo sapiens
gtggtgctggtggtg

SEQ ID NO: 386939 - DNA, 15 bp, Homo sapiens
tggtgctggtggtgc

SEQ ID NO: 386940 - DNA, 15 bp, Homo sapiens
ggtgctggtggtgca

SEQ ID NO: 386941 - DNA, 15 bp, Homo sapiens
gtgctggtggtgcac

SEQ ID NO: 386942 - DNA, 15 bp, Homo sapiens
tgctggtggtgcaca

SEQ ID NO: 386943 - DNA, 15 bp, Homo sapiens
gctggtggtgcacag

SEQ ID NO: 386944 - DNA, 15 bp, Homo sapiens
ctggtggtgcacagt

SEQ ID NO: 386945 - DNA, 15 bp, Homo sapiens
tggtggtgcacagtc

SEQ ID NO: 386946 - DNA, 15 bp, Homo sapiens
ggtggtgcacagtct

SEQ ID NO: 386947 - DNA, 15 bp, Homo sapiens
gtggtgcacagtctt

SEQ ID NO: 386948 - DNA, 15 bp, Homo sapiens
tggtgcacagtcttt

SEQ ID NO: 386949 - DNA, 15 bp, Homo sapiens
ggtgcacagtctttg

SEQ ID NO: 386950 - DNA, 15 bp, Homo sapiens
gtgcacagtctttgt

SEQ ID NO: 386951 - DNA, 15 bp, Homo sapiens
tgcacagtctttgtg

SEQ ID NO: 386952 - DNA, 15 bp, Homo sapiens
gcacagtctttgtgc

SEQ ID NO: 386953 - DNA, 15 bp, Homo sapiens
cacagtctttgtgca

SEQ ID NO: 386954 - DNA, 15 bp, Homo sapiens
acagtctttgtgcac

SEQ ID NO: 386955 - DNA, 15 bp, Homo sapiens
cagtctttgtgcact

SEQ ID NO: 386956 - DNA, 15 bp, Homo sapiens
agtctttgtgcacta

SEQ ID NO: 386957 - DNA, 15 bp, Homo sapiens
gtctttgtgcactaa

SEQ ID NO: 386958 - DNA, 15 bp, Homo sapiens
tctttgtgcactaag

SEQ ID NO: 386959 - DNA, 15 bp, Homo sapiens
ctttgtgcactaagg

SEQ ID NO: 386960 - DNA, 15 bp, Homo sapiens
tttgtgcactaagga

SEQ ID NO: 386961 - DNA, 15 bp, Homo sapiens
ttgtgcactaaggaa

SEQ ID NO: 386962 - DNA, 15 bp, Homo sapiens
tgtgcactaaggaag

SEQ ID NO: 386963 - DNA, 15 bp, Homo sapiens
gtgcactaaggaaga

SEQ ID NO: 386964 - DNA, 15 bp, Homo sapiens
tgcactaaggaagat

SEQ ID NO: 386965 - DNA, 15 bp, Homo sapiens
gcactaaggaagatg

SEQ ID NO: 386966 - DNA, 15 bp, Homo sapiens
cactaaggaagatgg

SEQ ID NO: 386967 - DNA, 15 bp, Homo sapiens
actaaggaagatgga

SEQ ID NO: 386968 - DNA, 15 bp, Homo sapiens
ctaaggaagatggaa

SEQ ID NO: 386969 - DNA, 15 bp, Homo sapiens
taaggaagatggaat

SEQ ID NO: 386970 - DNA, 15 bp, Homo sapiens
aaggaagatggaata

SEQ ID NO: 386971 - DNA, 15 bp, Homo sapiens
aggaagatggaataa

SEQ ID NO: 386972 - DNA, 15 bp, Homo sapiens
ggaagatggaataag

SEQ ID NO: 386973 - DNA, 15 bp, Homo sapiens
gaagatggaataagg

SEQ ID NO: 386974 - DNA, 15 bp, Homo sapiens
aagatggaataagga

SEQ ID NO: 386975 - DNA, 15 bp, Homo sapiens
agatggaataaggag

SEQ ID NO: 386976 - DNA, 15 bp, Homo sapiens
gatggaataaggagc

SEQ ID NO: 386977 - DNA, 15 bp, Homo sapiens
atggaataaggagct

SEQ ID NO: 386978 - DNA, 15 bp, Homo sapiens
tggaataaggagctc

SEQ ID NO: 386979 - DNA, 15 bp, Homo sapiens
ggaataaggagctcc

SEQ ID NO: 386980 - DNA, 15 bp, Homo sapiens
gaataaggagctccg

SEQ ID NO: 386981 - DNA, 15 bp, Homo sapiens
aataaggagctccgt

SEQ ID NO: 386982 - DNA, 15 bp, Homo sapiens
ataaggagctccgtg

SEQ ID NO: 386983 - DNA, 15 bp, Homo sapiens
taaggagctccgtgt

SEQ ID NO: 386984 - DNA, 15 bp, Homo sapiens
aaggagctccgtgta

SEQ ID NO: 386985 - DNA, 15 bp, Homo sapiens
aggagctccgtgtat

SEQ ID NO: 386986 - DNA, 15 bp, Homo sapiens
ggagctccgtgtatc

SEQ ID NO: 386987 - DNA, 15 bp, Homo sapiens
gagctccgtgtatct

SEQ ID NO: 386988 - DNA, 15 bp, Homo sapiens
agctccgtgtatctt

SEQ ID NO: 386989 - DNA, 15 bp, Homo sapiens
gctccgtgtatcttt

SEQ ID NO: 386990 - DNA, 15 bp, Homo sapiens
ctccgtgtatctttg

SEQ ID NO: 386991 - DNA, 15 bp, Homo sapiens
tccgtgtatctttgc

SEQ ID NO: 386992 - DNA, 15 bp, Homo sapiens
ccgtgtatctttgct

SEQ ID NO: 386993 - DNA, 15 bp, Homo sapiens
cgtgtatctttgctg

SEQ ID NO: 386994 - DNA, 15 bp, Homo sapiens
gtgtatctttgctgc

SEQ ID NO: 386995 - DNA, 15 bp, Homo sapiens
tgtatctttgctgca

SEQ ID NO: 386996 - DNA, 15 bp, Homo sapiens
gtatctttgctgcat

SEQ ID NO: 386997 - DNA, 15 bp, Homo sapiens
tatctttgctgcatg

SEQ ID NO: 386998 - DNA, 15 bp, Homo sapiens
atctttgctgcatgc

SEQ ID NO: 386999 - DNA, 15 bp, Homo sapiens
tctttgctgcatgca

SEQ ID NO: 387000 - DNA, 15 bp, Homo sapiens
ctttgctgcatgcac

SEQ ID NO: 387001 - DNA, 15 bp, Homo sapiens
tttgctgcatgcaca

SEQ ID NO: 387002 - DNA, 15 bp, Homo sapiens
ttgctgcatgcacag

SEQ ID NO: 387003 - DNA, 15 bp, Homo sapiens
tgctgcatgcacagg

SEQ ID NO: 387004 - DNA, 15 bp, Homo sapiens
gctgcatgcacagga

SEQ ID NO: 387005 - DNA, 15 bp, Homo sapiens
ctgcatgcacaggat

SEQ ID NO: 387006 - DNA, 15 bp, Homo sapiens
tgcatgcacaggatg

SEQ ID NO: 387007 - DNA, 15 bp, Homo sapiens
gcatgcacaggatgt

SEQ ID NO: 387008 - DNA, 15 bp, Homo sapiens
catgcacaggatgtg

SEQ ID NO: 387009 - DNA, 15 bp, Homo sapiens
atgcacaggatgtgt

SEQ ID NO: 387010 - DNA, 15 bp, Homo sapiens
tgcacaggatgtgta

SEQ ID NO: 387011 - DNA, 15 bp, Homo sapiens
gcacaggatgtgtat

SEQ ID NO: 387012 - DNA, 15 bp, Homo sapiens
cacaggatgtgtatg

SEQ ID NO: 387013 - DNA, 15 bp, Homo sapiens
acaggatgtgtatgt

SEQ ID NO: 387014 - DNA, 15 bp, Homo sapiens
caggatgtgtatgta

SEQ ID NO: 387015 - DNA, 15 bp, Homo sapiens
aggatgtgtatgtag

SEQ ID NO: 387016 - DNA, 15 bp, Homo sapiens
ggatgtgtatgtaga

SEQ ID NO: 387017 - DNA, 15 bp, Homo sapiens
gatgtgtatgtagaa

SEQ ID NO: 387018 - DNA, 15 bp, Homo sapiens
atgtgtatgtagaac

SEQ ID NO: 387019 - DNA, 15 bp, Homo sapiens
tgtgtatgtagaact

SEQ ID NO: 387020 - DNA, 15 bp, Homo sapiens
gtgtatgtagaacta

SEQ ID NO: 387021 - DNA, 15 bp, Homo sapiens
tgtatgtagaactac

SEQ ID NO: 387022 - DNA, 15 bp, Homo sapiens
gtatgtagaactact

SEQ ID NO: 387023 - DNA, 15 bp, Homo sapiens
tatgtagaactactt

SEQ ID NO: 387024 - DNA, 15 bp, Homo sapiens
atgtagaactactta

SEQ ID NO: 387025 - DNA, 15 bp, Homo sapiens
tgtagaactacttag

SEQ ID NO: 387026 - DNA, 15 bp, Homo sapiens
gtagaactacttagc

SEQ ID NO: 387027 - DNA, 15 bp, Homo sapiens
tagaactacttagct

SEQ ID NO: 387028 - DNA, 15 bp, Homo sapiens
agaactacttagctg

SEQ ID NO: 387029 - DNA, 15 bp, Homo sapiens
gaactacttagctga

SEQ ID NO: 387030 - DNA, 15 bp, Homo sapiens
aactacttagctgac

SEQ ID NO: 387031 - DNA, 15 bp, Homo sapiens
actacttagctgaca

SEQ ID NO: 387032 - DNA, 15 bp, Homo sapiens
ctacttagctgacac

SEQ ID NO: 387033 - DNA, 15 bp, Homo sapiens
tacttagctgacaca

SEQ ID NO: 387034 - DNA, 15 bp, Homo sapiens
acttagctgacacat

SEQ ID NO: 387035 - DNA, 15 bp, Homo sapiens
cttagctgacacatt

SEQ ID NO: 387036 - DNA, 15 bp, Homo sapiens
ttagctgacacattc

SEQ ID NO: 387037 - DNA, 15 bp, Homo sapiens
tagctgacacattcg

SEQ ID NO: 387038 - DNA, 15 bp, Homo sapiens
agctgacacattcgc

SEQ ID NO: 387039 - DNA, 15 bp, Homo sapiens
gctgacacattcgct

SEQ ID NO: 387040 - DNA, 15 bp, Homo sapiens
ctgacacattcgctg

SEQ ID NO: 387041 - DNA, 15 bp, Homo sapiens
tgacacattcgctgt

SEQ ID NO: 387042 - DNA, 15 bp, Homo sapiens
gacacattcgctgtt

SEQ ID NO: 387043 - DNA, 15 bp, Homo sapiens
acacattcgctgttt

SEQ ID NO: 387044 - DNA, 15 bp, Homo sapiens
cacattcgctgttta

SEQ ID NO: 387045 - DNA, 15 bp, Homo sapiens
acattcgctgtttat

SEQ ID NO: 387046 - DNA, 15 bp, Homo sapiens
cattcgctgtttata

SEQ ID NO: 387047 - DNA, 15 bp, Homo sapiens
attcgctgtttatac

SEQ ID NO: 387048 - DNA, 15 bp, Homo sapiens
ttcgctgtttatact

SEQ ID NO: 387049 - DNA, 15 bp, Homo sapiens
tcgctgtttatactt

SEQ ID NO: 387050 - DNA, 15 bp, Homo sapiens
cgctgtttatacttg

SEQ ID NO: 387051 - DNA, 15 bp, Homo sapiens
gctgtttatacttgc

SEQ ID NO: 387052 - DNA, 15 bp, Homo sapiens
ctgtttatacttgct

SEQ ID NO: 387053 - DNA, 15 bp, Homo sapiens
tgtttatacttgctt

SEQ ID NO: 387054 - DNA, 15 bp, Homo sapiens
gtttatacttgcttc

SEQ ID NO: 387055 - DNA, 15 bp, Homo sapiens
tttatacttgcttca

SEQ ID NO: 387056 - DNA, 15 bp, Homo sapiens
ttatacttgcttcat

SEQ ID NO: 387057 - DNA, 15 bp, Homo sapiens
tatacttgcttcatg

SEQ ID NO: 387058 - DNA, 15 bp, Homo sapiens
atacttgcttcatgt

SEQ ID NO: 387059 - DNA, 15 bp, Homo sapiens
tacttgcttcatgtc

SEQ ID NO: 387060 - DNA, 15 bp, Homo sapiens
acttgcttcatgtct

SEQ ID NO: 387061 - DNA, 15 bp, Homo sapiens
cttgcttcatgtctt

SEQ ID NO: 387062 - DNA, 15 bp, Homo sapiens
ttgcttcatgtctta

SEQ ID NO: 387063 - DNA, 15 bp, Homo sapiens
tgcttcatgtcttat

SEQ ID NO: 387064 - DNA, 15 bp, Homo sapiens
gcttcatgtcttatg

SEQ ID NO: 387065 - DNA, 15 bp, Homo sapiens
cttcatgtcttatga

SEQ ID NO: 387066 - DNA, 15 bp, Homo sapiens
ttcatgtcttatgac

SEQ ID NO: 387067 - DNA, 15 bp, Homo sapiens
tcatgtcttatgaca

SEQ ID NO: 387068 - DNA, 15 bp, Homo sapiens
catgtcttatgacaa

SEQ ID NO: 387069 - DNA, 15 bp, Homo sapiens
atgtcttatgacaac

SEQ ID NO: 387070 - DNA, 15 bp, Homo sapiens
tgtcttatgacaacc

SEQ ID NO: 387071 - DNA, 15 bp, Homo sapiens
gtcttatgacaacca

SEQ ID NO: 387072 - DNA, 15 bp, Homo sapiens
tcttatgacaaccag

SEQ ID NO: 387073 - DNA, 15 bp, Homo sapiens
cttatgacaaccaga

SEQ ID NO: 387074 - DNA, 15 bp, Homo sapiens
ttatgacaaccagat

SEQ ID NO: 387075 - DNA, 15 bp, Homo sapiens
tatgacaaccagatc

SEQ ID NO: 387076 - DNA, 15 bp, Homo sapiens
atgacaaccagatcc

SEQ ID NO: 387077 - DNA, 15 bp, Homo sapiens
tgacaaccagatcca

SEQ ID NO: 387078 - DNA, 15 bp, Homo sapiens
gacaaccagatccaa

SEQ ID NO: 387079 - DNA, 15 bp, Homo sapiens
acaaccagatccaag

SEQ ID NO: 387080 - DNA, 15 bp, Homo sapiens
caaccagatccaagg

SEQ ID NO: 387081 - DNA, 15 bp, Homo sapiens
aaccagatccaaggc

SEQ ID NO: 387082 - DNA, 15 bp, Homo sapiens
accagatccaaggcc

SEQ ID NO: 387083 - DNA, 15 bp, Homo sapiens
ccagatccaaggcca

SEQ ID NO: 387084 - DNA, 15 bp, Homo sapiens
cagatccaaggccat

SEQ ID NO: 387085 - DNA, 15 bp, Homo sapiens
agatccaaggccatg

SEQ ID NO: 387086 - DNA, 15 bp, Homo sapiens
gatccaaggccatgg

SEQ ID NO: 387087 - DNA, 15 bp, Homo sapiens
atccaaggccatggg

SEQ ID NO: 387088 - DNA, 15 bp, Homo sapiens
tccaaggccatggga

SEQ ID NO: 387089 - DNA, 15 bp, Homo sapiens
ccaaggccatgggag

SEQ ID NO: 387090 - DNA, 15 bp, Homo sapiens
caaggccatgggagt

SEQ ID NO: 387091 - DNA, 15 bp, Homo sapiens
aaggccatgggagta

SEQ ID NO: 387092 - DNA, 15 bp, Homo sapiens
aggccatgggagtat

SEQ ID NO: 387093 - DNA, 15 bp, Homo sapiens
ggccatgggagtatt

SEQ ID NO: 387094 - DNA, 15 bp, Homo sapiens
gccatgggagtattt

SEQ ID NO: 387095 - DNA, 15 bp, Homo sapiens
ccatgggagtatttc

SEQ ID NO: 387096 - DNA, 15 bp, Homo sapiens
catgggagtatttca

SEQ ID NO: 387097 - DNA, 15 bp, Homo sapiens
atgggagtatttcag

SEQ ID NO: 387098 - DNA, 15 bp, Homo sapiens
tgggagtatttcagg

SEQ ID NO: 387099 - DNA, 15 bp, Homo sapiens
gggagtatttcagga

SEQ ID NO: 387100 - DNA, 15 bp, Homo sapiens
ggagtatttcaggaa

SEQ ID NO: 387101 - DNA, 15 bp, Homo sapiens
gagtatttcaggaag

SEQ ID NO: 387102 - DNA, 15 bp, Homo sapiens
agtatttcaggaaga

SEQ ID NO: 387103 - DNA, 15 bp, Homo sapiens
gtatttcaggaagat

SEQ ID NO: 387104 - DNA, 15 bp, Homo sapiens
tatttcaggaagata

SEQ ID NO: 387105 - DNA, 15 bp, Homo sapiens
atttcaggaagataa

SEQ ID NO: 387106 - DNA, 15 bp, Homo sapiens
tttcaggaagataaa

SEQ ID NO: 387107 - DNA, 15 bp, Homo sapiens
ttcaggaagataaag

SEQ ID NO: 387108 - DNA, 15 bp, Homo sapiens
tcaggaagataaagc

SEQ ID NO: 387109 - DNA, 15 bp, Homo sapiens
caggaagataaagca

SEQ ID NO: 387110 - DNA, 15 bp, Homo sapiens
aggaagataaagcag

SEQ ID NO: 387111 - DNA, 15 bp, Homo sapiens
ggaagataaagcagt

SEQ ID NO: 387112 - DNA, 15 bp, Homo sapiens
gaagataaagcagtt

SEQ ID NO: 387113 - DNA, 15 bp, Homo sapiens
aagataaagcagttt

SEQ ID NO: 387114 - DNA, 15 bp, Homo sapiens
agataaagcagttta

SEQ ID NO: 387115 - DNA, 15 bp, Homo sapiens
gataaagcagtttat

SEQ ID NO: 387116 - DNA, 15 bp, Homo sapiens
ataaagcagtttatt

SEQ ID NO: 387117 - DNA, 15 bp, Homo sapiens
taaagcagtttattc

SEQ ID NO: 387118 - DNA, 15 bp, Homo sapiens
aaagcagtttattct

SEQ ID NO: 387119 - DNA, 15 bp, Homo sapiens
aagcagtttattcta

SEQ ID NO: 387120 - DNA, 15 bp, Homo sapiens
agcagtttattctat

SEQ ID NO: 387121 - DNA, 15 bp, Homo sapiens
gcagtttattctatg

SEQ ID NO: 387122 - DNA, 15 bp, Homo sapiens
cagtttattctatgc

SEQ ID NO: 387123 - DNA, 15 bp, Homo sapiens
agtttattctatgct

SEQ ID NO: 387124 - DNA, 15 bp, Homo sapiens
gtttattctatgctc

SEQ ID NO: 387125 - DNA, 15 bp, Homo sapiens
tttattctatgctca

SEQ ID NO: 387126 - DNA, 15 bp, Homo sapiens
ttattctatgctcag

SEQ ID NO: 387127 - DNA, 15 bp, Homo sapiens
tattctatgctcagt

SEQ ID NO: 387128 - DNA, 15 bp, Homo sapiens
attctatgctcagtt

SEQ ID NO: 387129 - DNA, 15 bp, Homo sapiens
ttctatgctcagttt

SEQ ID NO: 387130 - DNA, 15 bp, Homo sapiens
tctatgctcagttta

SEQ ID NO: 387131 - DNA, 15 bp, Homo sapiens
ctatgctcagtttaa

SEQ ID NO: 387132 - DNA, 15 bp, Homo sapiens
tatgctcagtttaag

SEQ ID NO: 387133 - DNA, 15 bp, Homo sapiens
atgctcagtttaagg

SEQ ID NO: 387134 - DNA, 15 bp, Homo sapiens
tgctcagtttaaggt

SEQ ID NO: 387135 - DNA, 15 bp, Homo sapiens
gctcagtttaaggtg

SEQ ID NO: 387136 - DNA, 15 bp, Homo sapiens
ctcagtttaaggtga

SEQ ID NO: 387137 - DNA, 15 bp, Homo sapiens
tcagtttaaggtgaa

SEQ ID NO: 387138 - DNA, 15 bp, Homo sapiens
cagtttaaggtgaat

SEQ ID NO: 387139 - DNA, 15 bp, Homo sapiens
agtttaaggtgaatc

SEQ ID NO: 387140 - DNA, 15 bp, Homo sapiens
gtttaaggtgaatct

SEQ ID NO: 387141 - DNA, 15 bp, Homo sapiens
tttaaggtgaatctt

SEQ ID NO: 387142 - DNA, 15 bp, Homo sapiens
ttaaggtgaatcttg

SEQ ID NO: 387143 - DNA, 15 bp, Homo sapiens
taaggtgaatcttgg

SEQ ID NO: 387144 - DNA, 15 bp, Homo sapiens
aaggtgaatcttggg

SEQ ID NO: 387145 - DNA, 15 bp, Homo sapiens
aggtgaatcttgggt

SEQ ID NO: 387146 - DNA, 15 bp, Homo sapiens
ggtgaatcttgggtg

SEQ ID NO: 387147 - DNA, 15 bp, Homo sapiens
gtgaatcttgggtga

SEQ ID NO: 387148 - DNA, 15 bp, Homo sapiens
tgaatcttgggtgaa

SEQ ID NO: 387149 - DNA, 15 bp, Homo sapiens
gaatcttgggtgaat

SEQ ID NO: 387150 - DNA, 15 bp, Homo sapiens
aatcttgggtgaatt

SEQ ID NO: 387151 - DNA, 15 bp, Homo sapiens
atcttgggtgaattt

SEQ ID NO: 387152 - DNA, 15 bp, Homo sapiens
tcttgggtgaatttt

SEQ ID NO: 387153 - DNA, 15 bp, Homo sapiens
cttgggtgaattttg

SEQ ID NO: 387154 - DNA, 15 bp, Homo sapiens
ttgggtgaattttga

SEQ ID NO: 387155 - DNA, 15 bp, Homo sapiens
tgggtgaattttgat

SEQ ID NO: 387156 - DNA, 15 bp, Homo sapiens
gggtgaattttgata

SEQ ID NO: 387157 - DNA, 15 bp, Homo sapiens
ggtgaattttgataa

SEQ ID NO: 387158 - DNA, 15 bp, Homo sapiens
gtgaattttgataag

SEQ ID NO: 387159 - DNA, 15 bp, Homo sapiens
tgaattttgataagg

SEQ ID NO: 387160 - DNA, 15 bp, Homo sapiens
gaattttgataagga

SEQ ID NO: 387161 - DNA, 15 bp, Homo sapiens
aattttgataaggat

SEQ ID NO: 387162 - DNA, 15 bp, Homo sapiens
attttgataaggata

SEQ ID NO: 387163 - DNA, 15 bp, Homo sapiens
ttttgataaggatag

SEQ ID NO: 387164 - DNA, 15 bp, Homo sapiens
tttgataaggatagg

SEQ ID NO: 387165 - DNA, 15 bp, Homo sapiens
ttgataaggataggt

SEQ ID NO: 387166 - DNA, 15 bp, Homo sapiens
tgataaggataggtc

SEQ ID NO: 387167 - DNA, 15 bp, Homo sapiens
gataaggataggtct

SEQ ID NO: 387168 - DNA, 15 bp, Homo sapiens
ataaggataggtcta

SEQ ID NO: 387169 - DNA, 15 bp, Homo sapiens
taaggataggtctaa

SEQ ID NO: 387170 - DNA, 15 bp, Homo sapiens
aaggataggtctaaa

SEQ ID NO: 387171 - DNA, 15 bp, Homo sapiens
aggataggtctaaag

SEQ ID NO: 387172 - DNA, 15 bp, Homo sapiens
ggataggtctaaagc

SEQ ID NO: 387173 - DNA, 15 bp, Homo sapiens
gataggtctaaagca

SEQ ID NO: 387174 - DNA, 15 bp, Homo sapiens
ataggtctaaagcac

SEQ ID NO: 387175 - DNA, 15 bp, Homo sapiens
taggtctaaagcaca

SEQ ID NO: 387176 - DNA, 15 bp, Homo sapiens
aggtctaaagcacat

SEQ ID NO: 387177 - DNA, 15 bp, Homo sapiens
ggtctaaagcacatg

SEQ ID NO: 387178 - DNA, 15 bp, Homo sapiens
gtctaaagcacatgg

SEQ ID NO: 387179 - DNA, 15 bp, Homo sapiens
tctaaagcacatgga

SEQ ID NO: 387180 - DNA, 15 bp, Homo sapiens
ctaaagcacatggaa

SEQ ID NO: 387181 - DNA, 15 bp, Homo sapiens
taaagcacatggaag

SEQ ID NO: 387182 - DNA, 15 bp, Homo sapiens
aaagcacatggaaga

SEQ ID NO: 387183 - DNA, 15 bp, Homo sapiens
aagcacatggaagat

SEQ ID NO: 387184 - DNA, 15 bp, Homo sapiens
agcacatggaagatg

SEQ ID NO: 387185 - DNA, 15 bp, Homo sapiens
gcacatggaagatga

SEQ ID NO: 387186 - DNA, 15 bp, Homo sapiens
cacatggaagatgat

SEQ ID NO: 387187 - DNA, 15 bp, Homo sapiens
acatggaagatgatt

SEQ ID NO: 387188 - DNA, 15 bp, Homo sapiens
catggaagatgatta

SEQ ID NO: 387189 - DNA, 15 bp, Homo sapiens
atggaagatgattaa

SEQ ID NO: 387190 - DNA, 15 bp, Homo sapiens
tggaagatgattaac

SEQ ID NO: 387191 - DNA, 15 bp, Homo sapiens
ggaagatgattaact

SEQ ID NO: 387192 - DNA, 15 bp, Homo sapiens
gaagatgattaactt

SEQ ID NO: 387193 - DNA, 15 bp, Homo sapiens
aagatgattaacttt

SEQ ID NO: 387194 - DNA, 15 bp, Homo sapiens
agatgattaactttt

SEQ ID NO: 387195 - DNA, 15 bp, Homo sapiens
gatgattaacttttg

SEQ ID NO: 387196 - DNA, 15 bp, Homo sapiens
tgattaacttttggg

SEQ ID NO: 387197 - DNA, 15 bp, Homo sapiens
gattaacttttggga

SEQ ID NO: 387198 - DNA, 15 bp, Homo sapiens
attaacttttgggag

SEQ ID NO: 387199 - DNA, 15 bp, Homo sapiens
ttaacttttgggagt

SEQ ID NO: 387200 - DNA, 15 bp, Homo sapiens
taacttttgggagta

SEQ ID NO: 387201 - DNA, 15 bp, Homo sapiens
aacttttgggagtat

SEQ ID NO: 387202 - DNA, 15 bp, Homo sapiens
acttttgggagtatg

SEQ ID NO: 387203 - DNA, 15 bp, Homo sapiens
cttttgggagtatgc

SEQ ID NO: 387204 - DNA, 15 bp, Homo sapiens
ttttgggagtatgct

SEQ ID NO: 387205 - DNA, 15 bp, Homo sapiens
tttgggagtatgcta

SEQ ID NO: 387206 - DNA, 15 bp, Homo sapiens
ttgggagtatgctat

SEQ ID NO: 387207 - DNA, 15 bp, Homo sapiens
tgggagtatgctatg

SEQ ID NO: 387208 - DNA, 15 bp, Homo sapiens
gggagtatgctatga

SEQ ID NO: 387209 - DNA, 15 bp, Homo sapiens
ggagtatgctatgat

SEQ ID NO: 387210 - DNA, 15 bp, Homo sapiens
gagtatgctatgata

SEQ ID NO: 387211 - DNA, 15 bp, Homo sapiens
agtatgctatgatac

SEQ ID NO: 387212 - DNA, 15 bp, Homo sapiens
gtatgctatgataca

SEQ ID NO: 387213 - DNA, 15 bp, Homo sapiens
tatgctatgatacat

SEQ ID NO: 387214 - DNA, 15 bp, Homo sapiens
atgctatgatacatg

SEQ ID NO: 387215 - DNA, 15 bp, Homo sapiens
tgctatgatacatgc

SEQ ID NO: 387216 - DNA, 15 bp, Homo sapiens
gctatgatacatgcc

SEQ ID NO: 387217 - DNA, 15 bp, Homo sapiens
ctatgatacatgcca

SEQ ID NO: 387218 - DNA, 15 bp, Homo sapiens
tatgatacatgccat

SEQ ID NO: 387219 - DNA, 15 bp, Homo sapiens
atgatacatgccatt

SEQ ID NO: 387220 - DNA, 15 bp, Homo sapiens
tgatacatgccattc

SEQ ID NO: 387221 - DNA, 15 bp, Homo sapiens
gatacatgccattct

SEQ ID NO: 387222 - DNA, 15 bp, Homo sapiens
atacatgccattctt

SEQ ID NO: 387223 - DNA, 15 bp, Homo sapiens
tacatgccattcttt

SEQ ID NO: 387224 - DNA, 15 bp, Homo sapiens
acatgccattctttt

SEQ ID NO: 387225 - DNA, 15 bp, Homo sapiens
catgccattctttta

SEQ ID NO: 387226 - DNA, 15 bp, Homo sapiens
atgccattcttttaa

SEQ ID NO: 387227 - DNA, 15 bp, Homo sapiens
tgccattcttttaag

SEQ ID NO: 387228 - DNA, 15 bp, Homo sapiens
gccattcttttaagg

SEQ ID NO: 387229 - DNA, 15 bp, Homo sapiens
ccattcttttaagga

SEQ ID NO: 387230 - DNA, 15 bp, Homo sapiens
cattcttttaaggat

SEQ ID NO: 387231 - DNA, 15 bp, Homo sapiens
attcttttaaggatg

SEQ ID NO: 387232 - DNA, 15 bp, Homo sapiens
ttcttttaaggatgg

SEQ ID NO: 387233 - DNA, 15 bp, Homo sapiens
tcttttaaggatgga

SEQ ID NO: 387234 - DNA, 15 bp, Homo sapiens
cttttaaggatggat

SEQ ID NO: 387235 - DNA, 15 bp, Homo sapiens
ttttaaggatggatg

SEQ ID NO: 387236 - DNA, 15 bp, Homo sapiens
tttaaggatggatga

SEQ ID NO: 387237 - DNA, 15 bp, Homo sapiens
ttaaggatggatgat

SEQ ID NO: 387238 - DNA, 15 bp, Homo sapiens
taaggatggatgatg

SEQ ID NO: 387239 - DNA, 15 bp, Homo sapiens
aaggatggatgatga

SEQ ID NO: 387240 - DNA, 15 bp, Homo sapiens
aggatggatgatgat

SEQ ID NO: 387241 - DNA, 15 bp, Homo sapiens
ggatggatgatgatt

SEQ ID NO: 387242 - DNA, 15 bp, Homo sapiens
gatggatgatgattt

SEQ ID NO: 387243 - DNA, 15 bp, Homo sapiens
atggatgatgatttg

SEQ ID NO: 387244 - DNA, 15 bp, Homo sapiens
tggatgatgatttgg

SEQ ID NO: 387245 - DNA, 15 bp, Homo sapiens
ggatgatgatttgga

SEQ ID NO: 387246 - DNA, 15 bp, Homo sapiens
gatgatgatttggat

SEQ ID NO: 387247 - DNA, 15 bp, Homo sapiens
atgatgatttggatt

SEQ ID NO: 387248 - DNA, 15 bp, Homo sapiens
tgatgatttggattt

SEQ ID NO: 387249 - DNA, 15 bp, Homo sapiens
gatgatttggattta

SEQ ID NO: 387250 - DNA, 15 bp, Homo sapiens
atgatttggatttat

SEQ ID NO: 387251 - DNA, 15 bp, Homo sapiens
tgatttggatttatg

SEQ ID NO: 387252 - DNA, 15 bp, Homo sapiens
gatttggatttatgt

SEQ ID NO: 387253 - DNA, 15 bp, Homo sapiens
atttggatttatgta

SEQ ID NO: 387254 - DNA, 15 bp, Homo sapiens
tttggatttatgtat

SEQ ID NO: 387255 - DNA, 15 bp, Homo sapiens
ttggatttatgtatc

SEQ ID NO: 387256 - DNA, 15 bp, Homo sapiens
tggatttatgtatct

SEQ ID NO: 387257 - DNA, 15 bp, Homo sapiens
ggatttatgtatcta

SEQ ID NO: 387258 - DNA, 15 bp, Homo sapiens
gatttatgtatctat

SEQ ID NO: 387259 - DNA, 15 bp, Homo sapiens
atttatgtatctatg

SEQ ID NO: 387260 - DNA, 15 bp, Homo sapiens
tttatgtatctatgt

SEQ ID NO: 387261 - DNA, 15 bp, Homo sapiens
ttatgtatctatgtt

SEQ ID NO: 387262 - DNA, 15 bp, Homo sapiens
tatgtatctatgttt

SEQ ID NO: 387263 - DNA, 15 bp, Homo sapiens
atgtatctatgtttc

SEQ ID NO: 387264 - DNA, 15 bp, Homo sapiens
tgtatctatgtttca

SEQ ID NO: 387265 - DNA, 15 bp, Homo sapiens
gtatctatgtttcat

SEQ ID NO: 387266 - DNA, 15 bp, Homo sapiens
tatctatgtttcatt

SEQ ID NO: 387267 - DNA, 15 bp, Homo sapiens
atctatgtttcattg

SEQ ID NO: 387268 - DNA, 15 bp, Homo sapiens
tctatgtttcattgc

SEQ ID NO: 387269 - DNA, 15 bp, Homo sapiens
ctatgtttcattgcc

SEQ ID NO: 387270 - DNA, 15 bp, Homo sapiens
tatgtttcattgccc

SEQ ID NO: 387271 - DNA, 15 bp, Homo sapiens
atgtttcattgccct

SEQ ID NO: 387272 - DNA, 15 bp, Homo sapiens
tgtttcattgccctg

SEQ ID NO: 387273 - DNA, 15 bp, Homo sapiens
gtttcattgccctgc

SEQ ID NO: 387274 - DNA, 15 bp, Homo sapiens
tttcattgccctgct

SEQ ID NO: 387275 - DNA, 15 bp, Homo sapiens
ttcattgccctgctg

SEQ ID NO: 387276 - DNA, 15 bp, Homo sapiens
tcattgccctgctgc

SEQ ID NO: 387277 - DNA, 15 bp, Homo sapiens
cattgccctgctgca

SEQ ID NO: 387278 - DNA, 15 bp, Homo sapiens
attgccctgctgcaa

SEQ ID NO: 387279 - DNA, 15 bp, Homo sapiens
ttgccctgctgcaag

SEQ ID NO: 387280 - DNA, 15 bp, Homo sapiens
tgccctgctgcaagg

SEQ ID NO: 387281 - DNA, 15 bp, Homo sapiens
gccctgctgcaaggc

SEQ ID NO: 387282 - DNA, 15 bp, Homo sapiens
ccctgctgcaaggct

SEQ ID NO: 387283 - DNA, 15 bp, Homo sapiens
cctgctgcaaggctg

SEQ ID NO: 387284 - DNA, 15 bp, Homo sapiens
ctgctgcaaggctgt

SEQ ID NO: 387285 - DNA, 15 bp, Homo sapiens
tgctgcaaggctgtt

SEQ ID NO: 387286 - DNA, 15 bp, Homo sapiens
gctgcaaggctgtta

SEQ ID NO: 387287 - DNA, 15 bp, Homo sapiens
ctgcaaggctgttag

SEQ ID NO: 387288 - DNA, 15 bp, Homo sapiens
tgcaaggctgttagg

SEQ ID NO: 387289 - DNA, 15 bp, Homo sapiens
gcaaggctgttagga

SEQ ID NO: 387290 - DNA, 15 bp, Homo sapiens
caaggctgttaggat

SEQ ID NO: 387291 - DNA, 15 bp, Homo sapiens
aaggctgttaggatt

SEQ ID NO: 387292 - DNA, 15 bp, Homo sapiens
aggctgttaggattt

SEQ ID NO: 387293 - DNA, 15 bp, Homo sapiens
ggctgttaggattta

SEQ ID NO: 387294 - DNA, 15 bp, Homo sapiens
gctgttaggatttat

SEQ ID NO: 387295 - DNA, 15 bp, Homo sapiens
ctgttaggatttatt

SEQ ID NO: 387296 - DNA, 15 bp, Homo sapiens
tgttaggatttattc

SEQ ID NO: 387297 - DNA, 15 bp, Homo sapiens
gttaggatttattcc

SEQ ID NO: 387298 - DNA, 15 bp, Homo sapiens
ttaggatttattccc

SEQ ID NO: 387299 - DNA, 15 bp, Homo sapiens
taggatttattcccc

SEQ ID NO: 387300 - DNA, 15 bp, Homo sapiens
aggatttattcccca

SEQ ID NO: 387301 - DNA, 15 bp, Homo sapiens
ggatttattccccag

SEQ ID NO: 387302 - DNA, 15 bp, Homo sapiens
gatttattccccagc

SEQ ID NO: 387303 - DNA, 15 bp, Homo sapiens
atttattccccagca

SEQ ID NO: 387304 - DNA, 15 bp, Homo sapiens
tttattccccagcag

SEQ ID NO: 387305 - DNA, 15 bp, Homo sapiens
ttattccccagcaga

SEQ ID NO: 387306 - DNA, 15 bp, Homo sapiens
tattccccagcagaa

SEQ ID NO: 387307 - DNA, 15 bp, Homo sapiens
attccccagcagaag

SEQ ID NO: 387308 - DNA, 15 bp, Homo sapiens
ttccccagcagaagc

SEQ ID NO: 387309 - DNA, 15 bp, Homo sapiens
tccccagcagaagcc

SEQ ID NO: 387310 - DNA, 15 bp, Homo sapiens
ccccagcagaagcct

SEQ ID NO: 387311 - DNA, 15 bp, Homo sapiens
cccagcagaagcctt

SEQ ID NO: 387312 - DNA, 15 bp, Homo sapiens
ccagcagaagccttt

SEQ ID NO: 387313 - DNA, 15 bp, Homo sapiens
cagcagaagcctttt

SEQ ID NO: 387314 - DNA, 15 bp, Homo sapiens
agcagaagccttttg

SEQ ID NO: 387315 - DNA, 15 bp, Homo sapiens
gcagaagccttttgg

SEQ ID NO: 387316 - DNA, 15 bp, Homo sapiens
cagaagccttttggc

SEQ ID NO: 387317 - DNA, 15 bp, Homo sapiens
agaagccttttggca

SEQ ID NO: 387318 - DNA, 15 bp, Homo sapiens
gaagccttttggcaa

SEQ ID NO: 387319 - DNA, 15 bp, Homo sapiens
aagccttttggcaag

SEQ ID NO: 387320 - DNA, 15 bp, Homo sapiens
agccttttggcaaga

SEQ ID NO: 387321 - DNA, 15 bp, Homo sapiens
gccttttggcaagag

SEQ ID NO: 387322 - DNA, 15 bp, Homo sapiens
ccttttggcaagaga

SEQ ID NO: 387323 - DNA, 15 bp, Homo sapiens
cttttggcaagagaa

SEQ ID NO: 387324 - DNA, 15 bp, Homo sapiens
ttttggcaagagaaa

SEQ ID NO: 387325 - DNA, 15 bp, Homo sapiens
tttggcaagagaaaa

SEQ ID NO: 387326 - DNA, 15 bp, Homo sapiens
ttggcaagagaaaag

SEQ ID NO: 387327 - DNA, 15 bp, Homo sapiens
tggcaagagaaaagc

SEQ ID NO: 387328 - DNA, 15 bp, Homo sapiens
ggcaagagaaaagcc

SEQ ID NO: 387329 - DNA, 15 bp, Homo sapiens
gcaagagaaaagccg

SEQ ID NO: 387330 - DNA, 15 bp, Homo sapiens
caagagaaaagccga

SEQ ID NO: 387331 - DNA, 15 bp, Homo sapiens
aagagaaaagccgat

SEQ ID NO: 387332 - DNA, 15 bp, Homo sapiens
agagaaaagccgatt

SEQ ID NO: 387333 - DNA, 15 bp, Homo sapiens
gagaaaagccgattc

SEQ ID NO: 387334 - DNA, 15 bp, Homo sapiens
agaaaagccgattct

SEQ ID NO: 387335 - DNA, 15 bp, Homo sapiens
gaaaagccgattctt

SEQ ID NO: 387336 - DNA, 15 bp, Homo sapiens
aaaagccgattcttt

SEQ ID NO: 387337 - DNA, 15 bp, Homo sapiens
aaagccgattctttg

SEQ ID NO: 387338 - DNA, 15 bp, Homo sapiens
aagccgattctttgg

SEQ ID NO: 387339 - DNA, 15 bp, Homo sapiens
agccgattctttgga

SEQ ID NO: 387340 - DNA, 15 bp, Homo sapiens
gccgattctttggag

SEQ ID NO: 387341 - DNA, 15 bp, Homo sapiens
ccgattctttggagc

SEQ ID NO: 387342 - DNA, 15 bp, Homo sapiens
cgattctttggagcc

SEQ ID NO: 387343 - DNA, 15 bp, Homo sapiens
gattctttggagccc

SEQ ID NO: 387344 - DNA, 15 bp, Homo sapiens
attctttggagccct

SEQ ID NO: 387345 - DNA, 15 bp, Homo sapiens
ttctttggagccctg

SEQ ID NO: 387346 - DNA, 15 bp, Homo sapiens
tctttggagccctgc

SEQ ID NO: 387347 - DNA, 15 bp, Homo sapiens
ctttggagccctgca

SEQ ID NO: 387348 - DNA, 15 bp, Homo sapiens
tttggagccctgcag

SEQ ID NO: 387349 - DNA, 15 bp, Homo sapiens
ttggagccctgcagg

SEQ ID NO: 387350 - DNA, 15 bp, Homo sapiens
tggagccctgcagga

SEQ ID NO: 387351 - DNA, 15 bp, Homo sapiens
ggagccctgcaggag

SEQ ID NO: 387352 - DNA, 15 bp, Homo sapiens
gagccctgcaggaga

SEQ ID NO: 387353 - DNA, 15 bp, Homo sapiens
agccctgcaggagag

SEQ ID NO: 387354 - DNA, 15 bp, Homo sapiens
gccctgcaggagaga

SEQ ID NO: 387355 - DNA, 15 bp, Homo sapiens
ccctgcaggagagac

SEQ ID NO: 387356 - DNA, 15 bp, Homo sapiens
cctgcaggagagaca

SEQ ID NO: 387357 - DNA, 15 bp, Homo sapiens
ctgcaggagagacaa

SEQ ID NO: 387358 - DNA, 15 bp, Homo sapiens
tgcaggagagacaag

SEQ ID NO: 387359 - DNA, 15 bp, Homo sapiens
gcaggagagacaagc

SEQ ID NO: 387360 - DNA, 15 bp, Homo sapiens
caggagagacaagct

SEQ ID NO: 387361 - DNA, 15 bp, Homo sapiens
aggagagacaagctc

SEQ ID NO: 387362 - DNA, 15 bp, Homo sapiens
ggagagacaagctcc

SEQ ID NO: 387363 - DNA, 15 bp, Homo sapiens
gagagacaagctcct

SEQ ID NO: 387364 - DNA, 15 bp, Homo sapiens
agagacaagctcctt

SEQ ID NO: 387365 - DNA, 15 bp, Homo sapiens
gagacaagctccttg

SEQ ID NO: 387366 - DNA, 15 bp, Homo sapiens
agacaagctccttga

SEQ ID NO: 387367 - DNA, 15 bp, Homo sapiens
gacaagctccttgag

SEQ ID NO: 387368 - DNA, 15 bp, Homo sapiens
acaagctccttgaga

SEQ ID NO: 387369 - DNA, 15 bp, Homo sapiens
caagctccttgagaa

SEQ ID NO: 387370 - DNA, 15 bp, Homo sapiens
aagctccttgagaac

SEQ ID NO: 387371 - DNA, 15 bp, Homo sapiens
agctccttgagaact

SEQ ID NO: 387372 - DNA, 15 bp, Homo sapiens
gctccttgagaactg

SEQ ID NO: 387373 - DNA, 15 bp, Homo sapiens
ctccttgagaactga

SEQ ID NO: 387374 - DNA, 15 bp, Homo sapiens
tccttgagaactgag

SEQ ID NO: 387375 - DNA, 15 bp, Homo sapiens
ccttgagaactgagc

SEQ ID NO: 387376 - DNA, 15 bp, Homo sapiens
cttgagaactgagca

SEQ ID NO: 387377 - DNA, 15 bp, Homo sapiens
ttgagaactgagcag

SEQ ID NO: 387378 - DNA, 15 bp, Homo sapiens
tgagaactgagcagt

SEQ ID NO: 387379 - DNA, 15 bp, Homo sapiens
gagaactgagcagtc

SEQ ID NO: 387380 - DNA, 15 bp, Homo sapiens
agaactgagcagtcc

SEQ ID NO: 387381 - DNA, 15 bp, Homo sapiens
gaactgagcagtcca

SEQ ID NO: 387382 - DNA, 15 bp, Homo sapiens
aactgagcagtccag

SEQ ID NO: 387383 - DNA, 15 bp, Homo sapiens
actgagcagtccagc

SEQ ID NO: 387384 - DNA, 15 bp, Homo sapiens
ctgagcagtccagct

SEQ ID NO: 387385 - DNA, 15 bp, Homo sapiens
tgagcagtccagctc

SEQ ID NO: 387386 - DNA, 15 bp, Homo sapiens
gagcagtccagctca

SEQ ID NO: 387387 - DNA, 15 bp, Homo sapiens
agcagtccagctcat

SEQ ID NO: 387388 - DNA, 15 bp, Homo sapiens
gcagtccagctcata

SEQ ID NO: 387389 - DNA, 15 bp, Homo sapiens
cagtccagctcatag

SEQ ID NO: 387390 - DNA, 15 bp, Homo sapiens
agtccagctcataga

SEQ ID NO: 387391 - DNA, 15 bp, Homo sapiens
gtccagctcatagag

SEQ ID NO: 387392 - DNA, 15 bp, Homo sapiens
tccagctcatagagg

SEQ ID NO: 387393 - DNA, 15 bp, Homo sapiens
ccagctcatagaggg

SEQ ID NO: 387394 - DNA, 15 bp, Homo sapiens
cagctcatagagggt

SEQ ID NO: 387395 - DNA, 15 bp, Homo sapiens
agctcatagagggtc

SEQ ID NO: 387396 - DNA, 15 bp, Homo sapiens
gctcatagagggtct

SEQ ID NO: 387397 - DNA, 15 bp, Homo sapiens
ctcatagagggtctt

SEQ ID NO: 387398 - DNA, 15 bp, Homo sapiens
tcatagagggtctta

SEQ ID NO: 387399 - DNA, 15 bp, Homo sapiens
catagagggtcttaa

SEQ ID NO: 387400 - DNA, 15 bp, Homo sapiens
atagagggtcttaaa

SEQ ID NO: 387401 - DNA, 15 bp, Homo sapiens
tagagggtcttaaat

SEQ ID NO: 387402 - DNA, 15 bp, Homo sapiens
agagggtcttaaatg

SEQ ID NO: 387403 - DNA, 15 bp, Homo sapiens
gagggtcttaaatgc

SEQ ID NO: 387404 - DNA, 15 bp, Homo sapiens
agggtcttaaatgcc

SEQ ID NO: 387405 - DNA, 15 bp, Homo sapiens
gggtcttaaatgcca

SEQ ID NO: 387406 - DNA, 15 bp, Homo sapiens
ggtcttaaatgccat

SEQ ID NO: 387407 - DNA, 15 bp, Homo sapiens
gtcttaaatgccatg

SEQ ID NO: 387408 - DNA, 15 bp, Homo sapiens
tcttaaatgccatgc

SEQ ID NO: 387409 - DNA, 15 bp, Homo sapiens
cttaaatgccatgca

SEQ ID NO: 387410 - DNA, 15 bp, Homo sapiens
ttaaatgccatgcaa

SEQ ID NO: 387411 - DNA, 15 bp, Homo sapiens
taaatgccatgcaag

SEQ ID NO: 387412 - DNA, 15 bp, Homo sapiens
aaatgccatgcaagt

SEQ ID NO: 387413 - DNA, 15 bp, Homo sapiens
aatgccatgcaagta

SEQ ID NO: 387414 - DNA, 15 bp, Homo sapiens
atgccatgcaagtat

SEQ ID NO: 387415 - DNA, 15 bp, Homo sapiens
tgccatgcaagtatt

SEQ ID NO: 387416 - DNA, 15 bp, Homo sapiens
gccatgcaagtattt

SEQ ID NO: 387417 - DNA, 15 bp, Homo sapiens
ccatgcaagtattta

SEQ ID NO: 387418 - DNA, 15 bp, Homo sapiens
catgcaagtatttat

SEQ ID NO: 387419 - DNA, 15 bp, Homo sapiens
atgcaagtatttata

SEQ ID NO: 387420 - DNA, 15 bp, Homo sapiens
tgcaagtatttatat

SEQ ID NO: 387421 - DNA, 15 bp, Homo sapiens
gcaagtatttatatt

SEQ ID NO: 387422 - DNA, 15 bp, Homo sapiens
caagtatttatattt

SEQ ID NO: 387423 - DNA, 15 bp, Homo sapiens
aagtatttatatttt

SEQ ID NO: 387424 - DNA, 15 bp, Homo sapiens
agtatttatatttta

SEQ ID NO: 387425 - DNA, 15 bp, Homo sapiens
gtatttatattttaa

SEQ ID NO: 387426 - DNA, 15 bp, Homo sapiens
tatttatattttaat

SEQ ID NO: 387427 - DNA, 15 bp, Homo sapiens
atttatattttaatc

SEQ ID NO: 387428 - DNA, 15 bp, Homo sapiens
tttatattttaatcc

SEQ ID NO: 387429 - DNA, 15 bp, Homo sapiens
ttatattttaatcca

SEQ ID NO: 387430 - DNA, 15 bp, Homo sapiens
tatattttaatccag

SEQ ID NO: 387431 - DNA, 15 bp, Homo sapiens
atattttaatccagt

SEQ ID NO: 387432 - DNA, 15 bp, Homo sapiens
tattttaatccagtg

SEQ ID NO: 387433 - DNA, 15 bp, Homo sapiens
attttaatccagtgg

SEQ ID NO: 387434 - DNA, 15 bp, Homo sapiens
ttttaatccagtggc

SEQ ID NO: 387435 - DNA, 15 bp, Homo sapiens
tttaatccagtggca

SEQ ID NO: 387436 - DNA, 15 bp, Homo sapiens
ttaatccagtggcaa

SEQ ID NO: 387437 - DNA, 15 bp, Homo sapiens
taatccagtggcaat

SEQ ID NO: 387438 - DNA, 15 bp, Homo sapiens
aatccagtggcaatg

SEQ ID NO: 387439 - DNA, 15 bp, Homo sapiens
atccagtggcaatga

SEQ ID NO: 387440 - DNA, 15 bp, Homo sapiens
tccagtggcaatgaa

SEQ ID NO: 387441 - DNA, 15 bp, Homo sapiens
ccagtggcaatgaag

SEQ ID NO: 387442 - DNA, 15 bp, Homo sapiens
cagtggcaatgaaga

SEQ ID NO: 387443 - DNA, 15 bp, Homo sapiens
agtggcaatgaagag

SEQ ID NO: 387444 - DNA, 15 bp, Homo sapiens
gtggcaatgaagaga

SEQ ID NO: 387445 - DNA, 15 bp, Homo sapiens
tggcaatgaagagaa

SEQ ID NO: 387446 - DNA, 15 bp, Homo sapiens
ggcaatgaagagaag

SEQ ID NO: 387447 - DNA, 15 bp, Homo sapiens
gcaatgaagagaagt

SEQ ID NO: 387448 - DNA, 15 bp, Homo sapiens
caatgaagagaagtc

SEQ ID NO: 387449 - DNA, 15 bp, Homo sapiens
aatgaagagaagtca

SEQ ID NO: 387450 - DNA, 15 bp, Homo sapiens
atgaagagaagtcat

SEQ ID NO: 387451 - DNA, 15 bp, Homo sapiens
tgaagagaagtcata

SEQ ID NO: 387452 - DNA, 15 bp, Homo sapiens
gaagagaagtcataa

SEQ ID NO: 387453 - DNA, 15 bp, Homo sapiens
aagagaagtcataaa

SEQ ID NO: 387454 - DNA, 15 bp, Homo sapiens
agagaagtcataaag

SEQ ID NO: 387455 - DNA, 15 bp, Homo sapiens
gagaagtcataaagg

SEQ ID NO: 387456 - DNA, 15 bp, Homo sapiens
agaagtcataaagga

SEQ ID NO: 387457 - DNA, 15 bp, Homo sapiens
gaagtcataaaggat

SEQ ID NO: 387458 - DNA, 15 bp, Homo sapiens
aagtcataaaggata

SEQ ID NO: 387459 - DNA, 15 bp, Homo sapiens
agtcataaaggatag

SEQ ID NO: 387460 - DNA, 15 bp, Homo sapiens
gtcataaaggatagt

SEQ ID NO: 387461 - DNA, 15 bp, Homo sapiens
tcataaaggatagta

SEQ ID NO: 387462 - DNA, 15 bp, Homo sapiens
cataaaggatagtaa

SEQ ID NO: 387463 - DNA, 15 bp, Homo sapiens
ataaaggatagtaac

SEQ ID NO: 387464 - DNA, 15 bp, Homo sapiens
taaaggatagtaaca

SEQ ID NO: 387465 - DNA, 15 bp, Homo sapiens
aaaggatagtaacaa

SEQ ID NO: 387466 - DNA, 15 bp, Homo sapiens
aaggatagtaacaag

SEQ ID NO: 387467 - DNA, 15 bp, Homo sapiens
aggatagtaacaaga

SEQ ID NO: 387468 - DNA, 15 bp, Homo sapiens
ggatagtaacaagag

SEQ ID NO: 387469 - DNA, 15 bp, Homo sapiens
gatagtaacaagagt

SEQ ID NO: 387470 - DNA, 15 bp, Homo sapiens
atagtaacaagagtg

SEQ ID NO: 387471 - DNA, 15 bp, Homo sapiens
tagtaacaagagtga

SEQ ID NO: 387472 - DNA, 15 bp, Homo sapiens
agtaacaagagtgat

SEQ ID NO: 387473 - DNA, 15 bp, Homo sapiens
gtaacaagagtgatg

SEQ ID NO: 387474 - DNA, 15 bp, Homo sapiens
taacaagagtgatgc

SEQ ID NO: 387475 - DNA, 15 bp, Homo sapiens
aacaagagtgatgca

SEQ ID NO: 387476 - DNA, 15 bp, Homo sapiens
acaagagtgatgcaa

SEQ ID NO: 387477 - DNA, 15 bp, Homo sapiens
agagtgatgcaatgg

SEQ ID NO: 387478 - DNA, 15 bp, Homo sapiens
gagtgatgcaatggg

SEQ ID NO: 387479 - DNA, 15 bp, Homo sapiens
agtgatgcaatggga

SEQ ID NO: 387480 - DNA, 15 bp, Homo sapiens
gtgatgcaatgggat

SEQ ID NO: 387481 - DNA, 15 bp, Homo sapiens
tgatgcaatgggatt

SEQ ID NO: 387482 - DNA, 15 bp, Homo sapiens
gatgcaatgggattt

SEQ ID NO: 387483 - DNA, 15 bp, Homo sapiens
atgcaatgggatttt

SEQ ID NO: 387484 - DNA, 15 bp, Homo sapiens
tgcaatgggattttt

SEQ ID NO: 387485 - DNA, 15 bp, Homo sapiens
gcaatgggatttttg

SEQ ID NO: 387486 - DNA, 15 bp, Homo sapiens
caatgggatttttgc

SEQ ID NO: 387487 - DNA, 15 bp, Homo sapiens
aatgggatttttgct

SEQ ID NO: 387488 - DNA, 15 bp, Homo sapiens
atgggatttttgctt

SEQ ID NO: 387489 - DNA, 15 bp, Homo sapiens
tgggatttttgcttt

SEQ ID NO: 387490 - DNA, 15 bp, Homo sapiens
gggatttttgcttta

SEQ ID NO: 387491 - DNA, 15 bp, Homo sapiens
ggatttttgctttat

SEQ ID NO: 387492 - DNA, 15 bp, Homo sapiens
gatttttgctttata

SEQ ID NO: 387493 - DNA, 15 bp, Homo sapiens
atttttgctttatag

SEQ ID NO: 387494 - DNA, 15 bp, Homo sapiens
tttttgctttatagg

SEQ ID NO: 387495 - DNA, 15 bp, Homo sapiens
ttttgctttatagga

SEQ ID NO: 387496 - DNA, 15 bp, Homo sapiens
tttgctttataggaa

SEQ ID NO: 387497 - DNA, 15 bp, Homo sapiens
ttgctttataggaat

SEQ ID NO: 387498 - DNA, 15 bp, Homo sapiens
tgctttataggaatt

SEQ ID NO: 387499 - DNA, 15 bp, Homo sapiens
gctttataggaattt

SEQ ID NO: 387500 - DNA, 15 bp, Homo sapiens
ctttataggaattta

SEQ ID NO: 387501 - DNA, 15 bp, Homo sapiens
tttataggaatttag

SEQ ID NO: 387502 - DNA, 15 bp, Homo sapiens
ttataggaatttagc

SEQ ID NO: 387503 - DNA, 15 bp, Homo sapiens
tataggaatttagct

SEQ ID NO: 387504 - DNA, 15 bp, Homo sapiens
ataggaatttagctg

SEQ ID NO: 387505 - DNA, 15 bp, Homo sapiens
taggaatttagctga

SEQ ID NO: 387506 - DNA, 15 bp, Homo sapiens
aggaatttagctgat

SEQ ID NO: 387507 - DNA, 15 bp, Homo sapiens
ggaatttagctgatg

SEQ ID NO: 387508 - DNA, 15 bp, Homo sapiens
gaatttagctgatgg

SEQ ID NO: 387509 - DNA, 15 bp, Homo sapiens
aatttagctgatggt

SEQ ID NO: 387510 - DNA, 15 bp, Homo sapiens
atttagctgatggta

SEQ ID NO: 387511 - DNA, 15 bp, Homo sapiens
tttagctgatggtat

SEQ ID NO: 387512 - DNA, 15 bp, Homo sapiens
ttagctgatggtatg

SEQ ID NO: 387513 - DNA, 15 bp, Homo sapiens
tagctgatggtatga

SEQ ID NO: 387514 - DNA, 15 bp, Homo sapiens
agctgatggtatgag

SEQ ID NO: 387515 - DNA, 15 bp, Homo sapiens
gctgatggtatgagg

SEQ ID NO: 387516 - DNA, 15 bp, Homo sapiens
ctgatggtatgagga

SEQ ID NO: 387517 - DNA, 15 bp, Homo sapiens
tgatggtatgaggaa

SEQ ID NO: 387518 - DNA, 15 bp, Homo sapiens
gatggtatgaggaat

SEQ ID NO: 387519 - DNA, 15 bp, Homo sapiens
atggtatgaggaatg

SEQ ID NO: 387520 - DNA, 15 bp, Homo sapiens
tggtatgaggaatgg

SEQ ID NO: 387521 - DNA, 15 bp, Homo sapiens
ggtatgaggaatgga

SEQ ID NO: 387522 - DNA, 15 bp, Homo sapiens
gtatgaggaatggac

SEQ ID NO: 387523 - DNA, 15 bp, Homo sapiens
tatgaggaatggact

SEQ ID NO: 387524 - DNA, 15 bp, Homo sapiens
atgaggaatggactt

SEQ ID NO: 387525 - DNA, 15 bp, Homo sapiens
tgaggaatggacttg

SEQ ID NO: 387526 - DNA, 15 bp, Homo sapiens
gaggaatggacttga

SEQ ID NO: 387527 - DNA, 15 bp, Homo sapiens
aggaatggacttgaa

SEQ ID NO: 387528 - DNA, 15 bp, Homo sapiens
ggaatggacttgaac

SEQ ID NO: 387529 - DNA, 15 bp, Homo sapiens
gaatggacttgaact

SEQ ID NO: 387530 - DNA, 15 bp, Homo sapiens
aatggacttgaacta

SEQ ID NO: 387531 - DNA, 15 bp, Homo sapiens
atggacttgaactag

SEQ ID NO: 387532 - DNA, 15 bp, Homo sapiens
tggacttgaactaga

SEQ ID NO: 387533 - DNA, 15 bp, Homo sapiens
ggacttgaactagac

SEQ ID NO: 387534 - DNA, 15 bp, Homo sapiens
gacttgaactagaca

SEQ ID NO: 387535 - DNA, 15 bp, Homo sapiens
acttgaactagacaa

SEQ ID NO: 387536 - DNA, 15 bp, Homo sapiens
cttgaactagacaag

SEQ ID NO: 387537 - DNA, 15 bp, Homo sapiens
ttgaactagacaaga

SEQ ID NO: 387538 - DNA, 15 bp, Homo sapiens
tgaactagacaagag

SEQ ID NO: 387539 - DNA, 15 bp, Homo sapiens
gaactagacaagagt

SEQ ID NO: 387540 - DNA, 15 bp, Homo sapiens
aactagacaagagtg

SEQ ID NO: 387541 - DNA, 15 bp, Homo sapiens
actagacaagagtga

SEQ ID NO: 387542 - DNA, 15 bp, Homo sapiens
ctagacaagagtgac

SEQ ID NO: 387543 - DNA, 15 bp, Homo sapiens
tagacaagagtgaca

SEQ ID NO: 387544 - DNA, 15 bp, Homo sapiens
agacaagagtgacag

SEQ ID NO: 387545 - DNA, 15 bp, Homo sapiens
gacaagagtgacaga

SEQ ID NO: 387546 - DNA, 15 bp, Homo sapiens
acaagagtgacagaa

SEQ ID NO: 387547 - DNA, 15 bp, Homo sapiens
caagagtgacagaag

SEQ ID NO: 387548 - DNA, 15 bp, Homo sapiens
aagagtgacagaaga

SEQ ID NO: 387549 - DNA, 15 bp, Homo sapiens
agagtgacagaagag

SEQ ID NO: 387550 - DNA, 15 bp, Homo sapiens
gagtgacagaagaga

SEQ ID NO: 387551 - DNA, 15 bp, Homo sapiens
agtgacagaagagag

SEQ ID NO: 387552 - DNA, 15 bp, Homo sapiens
gtgacagaagagagg

SEQ ID NO: 387553 - DNA, 15 bp, Homo sapiens
tgacagaagagaggc

SEQ ID NO: 387554 - DNA, 15 bp, Homo sapiens
gacagaagagaggcc

SEQ ID NO: 387555 - DNA, 15 bp, Homo sapiens
acagaagagaggcct

SEQ ID NO: 387556 - DNA, 15 bp, Homo sapiens
cagaagagaggcctg

SEQ ID NO: 387557 - DNA, 15 bp, Homo sapiens
agaagagaggcctgt

SEQ ID NO: 387558 - DNA, 15 bp, Homo sapiens
gaagagaggcctgtt

SEQ ID NO: 387559 - DNA, 15 bp, Homo sapiens
aagagaggcctgtta

SEQ ID NO: 387560 - DNA, 15 bp, Homo sapiens
agagaggcctgttag

SEQ ID NO: 387561 - DNA, 15 bp, Homo sapiens
gagaggcctgttagg

SEQ ID NO: 387562 - DNA, 15 bp, Homo sapiens
agaggcctgttagga

SEQ ID NO: 387563 - DNA, 15 bp, Homo sapiens
gaggcctgttaggat

SEQ ID NO: 387564 - DNA, 15 bp, Homo sapiens
aggcctgttaggata

SEQ ID NO: 387565 - DNA, 15 bp, Homo sapiens
ggcctgttaggatac

SEQ ID NO: 387566 - DNA, 15 bp, Homo sapiens
gcctgttaggatact

SEQ ID NO: 387567 - DNA, 15 bp, Homo sapiens
cctgttaggatactc

SEQ ID NO: 387568 - DNA, 15 bp, Homo sapiens
ctgttaggatactca

SEQ ID NO: 387569 - DNA, 15 bp, Homo sapiens
tgttaggatactcat

SEQ ID NO: 387570 - DNA, 15 bp, Homo sapiens
gttaggatactcatg

SEQ ID NO: 387571 - DNA, 15 bp, Homo sapiens
ttaggatactcatgt

SEQ ID NO: 387572 - DNA, 15 bp, Homo sapiens
taggatactcatgta

SEQ ID NO: 387573 - DNA, 15 bp, Homo sapiens
aggatactcatgtag

SEQ ID NO: 387574 - DNA, 15 bp, Homo sapiens
ggatactcatgtagc

SEQ ID NO: 387575 - DNA, 15 bp, Homo sapiens
gatactcatgtagcc

SEQ ID NO: 387576 - DNA, 15 bp, Homo sapiens
atactcatgtagcca

SEQ ID NO: 387577 - DNA, 15 bp, Homo sapiens
tactcatgtagccat

SEQ ID NO: 387578 - DNA, 15 bp, Homo sapiens
actcatgtagccatc

SEQ ID NO: 387579 - DNA, 15 bp, Homo sapiens
ctcatgtagccatcc

SEQ ID NO: 387580 - DNA, 15 bp, Homo sapiens
tcatgtagccatcca

SEQ ID NO: 387581 - DNA, 15 bp, Homo sapiens
catgtagccatccag

SEQ ID NO: 387582 - DNA, 15 bp, Homo sapiens
atgtagccatccagg

SEQ ID NO: 387583 - DNA, 15 bp, Homo sapiens
tgtagccatccaggc

SEQ ID NO: 387584 - DNA, 15 bp, Homo sapiens
gtagccatccaggct

SEQ ID NO: 387585 - DNA, 15 bp, Homo sapiens
tagccatccaggcta

SEQ ID NO: 387586 - DNA, 15 bp, Homo sapiens
agccatccaggctac

SEQ ID NO: 387587 - DNA, 15 bp, Homo sapiens
gccatccaggctaca

SEQ ID NO: 387588 - DNA, 15 bp, Homo sapiens
ccatccaggctacag

SEQ ID NO: 387589 - DNA, 15 bp, Homo sapiens
catccaggctacagg

SEQ ID NO: 387590 - DNA, 15 bp, Homo sapiens
atccaggctacaggt

SEQ ID NO: 387591 - DNA, 15 bp, Homo sapiens
tccaggctacaggta

SEQ ID NO: 387592 - DNA, 15 bp, Homo sapiens
ccaggctacaggtaa

SEQ ID NO: 387593 - DNA, 15 bp, Homo sapiens
caggctacaggtaat

SEQ ID NO: 387594 - DNA, 15 bp, Homo sapiens
aggctacaggtaata

SEQ ID NO: 387595 - DNA, 15 bp, Homo sapiens
ggctacaggtaataa

SEQ ID NO: 387596 - DNA, 15 bp, Homo sapiens
gctacaggtaataat

SEQ ID NO: 387597 - DNA, 15 bp, Homo sapiens
ctacaggtaataatt

SEQ ID NO: 387598 - DNA, 15 bp, Homo sapiens
tacaggtaataatta

SEQ ID NO: 387599 - DNA, 15 bp, Homo sapiens
acaggtaataattac

SEQ ID NO: 387600 - DNA, 15 bp, Homo sapiens
caggtaataattacc

SEQ ID NO: 387601 - DNA, 15 bp, Homo sapiens
aggtaataattacca

SEQ ID NO: 387602 - DNA, 15 bp, Homo sapiens
ggtaataattaccag

SEQ ID NO: 387603 - DNA, 15 bp, Homo sapiens
gtaataattaccaga

SEQ ID NO: 387604 - DNA, 15 bp, Homo sapiens
taataattaccagaa

SEQ ID NO: 387605 - DNA, 15 bp, Homo sapiens
aataattaccagaaa

SEQ ID NO: 387606 - DNA, 15 bp, Homo sapiens
ataattaccagaaag

SEQ ID NO: 387607 - DNA, 15 bp, Homo sapiens
taattaccagaaagg

SEQ ID NO: 387608 - DNA, 15 bp, Homo sapiens
aattaccagaaagga

SEQ ID NO: 387609 - DNA, 15 bp, Homo sapiens
attaccagaaaggag

SEQ ID NO: 387610 - DNA, 15 bp, Homo sapiens
ttaccagaaaggaga

SEQ ID NO: 387611 - DNA, 15 bp, Homo sapiens
taccagaaaggagac

SEQ ID NO: 387612 - DNA, 15 bp, Homo sapiens
accagaaaggagaca

SEQ ID NO: 387613 - DNA, 15 bp, Homo sapiens
ccagaaaggagacaa

SEQ ID NO: 387614 - DNA, 15 bp, Homo sapiens
cagaaaggagacaat

SEQ ID NO: 387615 - DNA, 15 bp, Homo sapiens
agaaaggagacaatg

SEQ ID NO: 387616 - DNA, 15 bp, Homo sapiens
gaaaggagacaatgg

SEQ ID NO: 387617 - DNA, 15 bp, Homo sapiens
aaaggagacaatggc

SEQ ID NO: 387618 - DNA, 15 bp, Homo sapiens
aaggagacaatggca

SEQ ID NO: 387619 - DNA, 15 bp, Homo sapiens
aggagacaatggcag

SEQ ID NO: 387620 - DNA, 15 bp, Homo sapiens
ggagacaatggcagg

SEQ ID NO: 387621 - DNA, 15 bp, Homo sapiens
gagacaatggcaggg

SEQ ID NO: 387622 - DNA, 15 bp, Homo sapiens
agacaatggcagggg

SEQ ID NO: 387623 - DNA, 15 bp, Homo sapiens
gacaatggcaggggt

SEQ ID NO: 387624 - DNA, 15 bp, Homo sapiens
acaatggcaggggta

SEQ ID NO: 387625 - DNA, 15 bp, Homo sapiens
caatggcaggggtag

SEQ ID NO: 387626 - DNA, 15 bp, Homo sapiens
aatggcaggggtagt

SEQ ID NO: 387627 - DNA, 15 bp, Homo sapiens
atggcaggggtagta

SEQ ID NO: 387628 - DNA, 15 bp, Homo sapiens
tggcaggggtagtag

SEQ ID NO: 387629 - DNA, 15 bp, Homo sapiens
ggcaggggtagtaga

SEQ ID NO: 387630 - DNA, 15 bp, Homo sapiens
gcaggggtagtagat

SEQ ID NO: 387631 - DNA, 15 bp, Homo sapiens
caggggtagtagatc

SEQ ID NO: 387632 - DNA, 15 bp, Homo sapiens
aggggtagtagatct

SEQ ID NO: 387633 - DNA, 15 bp, Homo sapiens
ggggtagtagatcta

SEQ ID NO: 387634 - DNA, 15 bp, Homo sapiens
gggtagtagatctaa

SEQ ID NO: 387635 - DNA, 15 bp, Homo sapiens
ggtagtagatctaat

SEQ ID NO: 387636 - DNA, 15 bp, Homo sapiens
gtagtagatctaatg

SEQ ID NO: 387637 - DNA, 15 bp, Homo sapiens
tagtagatctaatga

SEQ ID NO: 387638 - DNA, 15 bp, Homo sapiens
agtagatctaatgac

SEQ ID NO: 387639 - DNA, 15 bp, Homo sapiens
gtagatctaatgact

SEQ ID NO: 387640 - DNA, 15 bp, Homo sapiens
tagatctaatgactc

SEQ ID NO: 387641 - DNA, 15 bp, Homo sapiens
agatctaatgactca

SEQ ID NO: 387642 - DNA, 15 bp, Homo sapiens
gatctaatgactcaa

SEQ ID NO: 387643 - DNA, 15 bp, Homo sapiens
atctaatgactcaat

SEQ ID NO: 387644 - DNA, 15 bp, Homo sapiens
tctaatgactcaata

SEQ ID NO: 387645 - DNA, 15 bp, Homo sapiens
ctaatgactcaatag

SEQ ID NO: 387646 - DNA, 15 bp, Homo sapiens
taatgactcaatagt

SEQ ID NO: 387647 - DNA, 15 bp, Homo sapiens
aatgactcaatagta

SEQ ID NO: 387648 - DNA, 15 bp, Homo sapiens
atgactcaatagtat

SEQ ID NO: 387649 - DNA, 15 bp, Homo sapiens
tgactcaatagtata

SEQ ID NO: 387650 - DNA, 15 bp, Homo sapiens
gactcaatagtatac

SEQ ID NO: 387651 - DNA, 15 bp, Homo sapiens
actcaatagtataca

SEQ ID NO: 387652 - DNA, 15 bp, Homo sapiens
ctcaatagtatacat

SEQ ID NO: 387653 - DNA, 15 bp, Homo sapiens
tcaatagtatacata

SEQ ID NO: 387654 - DNA, 15 bp, Homo sapiens
caatagtatacatag

SEQ ID NO: 387655 - DNA, 15 bp, Homo sapiens
aatagtatacataga

SEQ ID NO: 387656 - DNA, 15 bp, Homo sapiens
atagtatacatagac

SEQ ID NO: 387657 - DNA, 15 bp, Homo sapiens
tagtatacatagact

SEQ ID NO: 387658 - DNA, 15 bp, Homo sapiens
agtatacatagactg

SEQ ID NO: 387659 - DNA, 15 bp, Homo sapiens
gtatacatagactga

SEQ ID NO: 387660 - DNA, 15 bp, Homo sapiens
tatacatagactgag

SEQ ID NO: 387661 - DNA, 15 bp, Homo sapiens
atacatagactgagg

SEQ ID NO: 387662 - DNA, 15 bp, Homo sapiens
tacatagactgagga

SEQ ID NO: 387663 - DNA, 15 bp, Homo sapiens
acatagactgaggaa

SEQ ID NO: 387664 - DNA, 15 bp, Homo sapiens
catagactgaggaag

SEQ ID NO: 387665 - DNA, 15 bp, Homo sapiens
atagactgaggaagg

SEQ ID NO: 387666 - DNA, 15 bp, Homo sapiens
tagactgaggaaggg

SEQ ID NO: 387667 - DNA, 15 bp, Homo sapiens
agactgaggaagggg

SEQ ID NO: 387668 - DNA, 15 bp, Homo sapiens
gactgaggaagggga

SEQ ID NO: 387669 - DNA, 15 bp, Homo sapiens
actgaggaaggggaa

SEQ ID NO: 387670 - DNA, 15 bp, Homo sapiens
ctgaggaaggggaaa

SEQ ID NO: 387671 - DNA, 15 bp, Homo sapiens
tgaggaaggggaaag

SEQ ID NO: 387672 - DNA, 15 bp, Homo sapiens
gaggaaggggaaagg

SEQ ID NO: 387673 - DNA, 15 bp, Homo sapiens
aggaaggggaaaggc

SEQ ID NO: 387674 - DNA, 15 bp, Homo sapiens
ggaaggggaaaggca

SEQ ID NO: 387675 - DNA, 15 bp, Homo sapiens
gaaggggaaaggcag

SEQ ID NO: 387676 - DNA, 15 bp, Homo sapiens
aaggggaaaggcaga

SEQ ID NO: 387677 - DNA, 15 bp, Homo sapiens
aggggaaaggcagat

SEQ ID NO: 387678 - DNA, 15 bp, Homo sapiens
ggggaaaggcagatt

SEQ ID NO: 387679 - DNA, 15 bp, Homo sapiens
gggaaaggcagattg

SEQ ID NO: 387680 - DNA, 15 bp, Homo sapiens
ggaaaggcagattgc

SEQ ID NO: 387681 - DNA, 15 bp, Homo sapiens
gaaaggcagattgcc

SEQ ID NO: 387682 - DNA, 15 bp, Homo sapiens
aaaggcagattgcca

SEQ ID NO: 387683 - DNA, 15 bp, Homo sapiens
aaggcagattgccaa

SEQ ID NO: 387684 - DNA, 15 bp, Homo sapiens
aggcagattgccaag

SEQ ID NO: 387685 - DNA, 15 bp, Homo sapiens
ggcagattgccaagt

SEQ ID NO: 387686 - DNA, 15 bp, Homo sapiens
gcagattgccaagtg

SEQ ID NO: 387687 - DNA, 15 bp, Homo sapiens
cagattgccaagtgg

SEQ ID NO: 387688 - DNA, 15 bp, Homo sapiens
agattgccaagtggt

SEQ ID NO: 387689 - DNA, 15 bp, Homo sapiens
gattgccaagtggtg

SEQ ID NO: 387690 - DNA, 15 bp, Homo sapiens
attgccaagtggtgt

SEQ ID NO: 387691 - DNA, 15 bp, Homo sapiens
ttgccaagtggtgtt

SEQ ID NO: 387692 - DNA, 15 bp, Homo sapiens
tgccaagtggtgtta

SEQ ID NO: 387693 - DNA, 15 bp, Homo sapiens
gccaagtggtgttag

SEQ ID NO: 387694 - DNA, 15 bp, Homo sapiens
ccaagtggtgttaga

SEQ ID NO: 387695 - DNA, 15 bp, Homo sapiens
caagtggtgttagag

SEQ ID NO: 387696 - DNA, 15 bp, Homo sapiens
aagtggtgttagagc

SEQ ID NO: 387697 - DNA, 15 bp, Homo sapiens
agtggtgttagagcc

SEQ ID NO: 387698 - DNA, 15 bp, Homo sapiens
gtggtgttagagcct

SEQ ID NO: 387699 - DNA, 15 bp, Homo sapiens
tggtgttagagccta

SEQ ID NO: 387700 - DNA, 15 bp, Homo sapiens
ggtgttagagcctaa

SEQ ID NO: 387701 - DNA, 15 bp, Homo sapiens
gtgttagagcctaag

SEQ ID NO: 387702 - DNA, 15 bp, Homo sapiens
tgttagagcctaaga

SEQ ID NO: 387703 - DNA, 15 bp, Homo sapiens
gttagagcctaagac

SEQ ID NO: 387704 - DNA, 15 bp, Homo sapiens
ttagagcctaagact

SEQ ID NO: 387705 - DNA, 15 bp, Homo sapiens
tagagcctaagactg

SEQ ID NO: 387706 - DNA, 15 bp, Homo sapiens
agagcctaagactgg

SEQ ID NO: 387707 - DNA, 15 bp, Homo sapiens
gagcctaagactggg

SEQ ID NO: 387708 - DNA, 15 bp, Homo sapiens
agcctaagactggga

SEQ ID NO: 387709 - DNA, 15 bp, Homo sapiens
gcctaagactgggaa

SEQ ID NO: 387710 - DNA, 15 bp, Homo sapiens
cctaagactgggaac

SEQ ID NO: 387711 - DNA, 15 bp, Homo sapiens
ctaagactgggaaca

SEQ ID NO: 387712 - DNA, 15 bp, Homo sapiens
taagactgggaacat

SEQ ID NO: 387713 - DNA, 15 bp, Homo sapiens
aagactgggaacata

SEQ ID NO: 387714 - DNA, 15 bp, Homo sapiens
agactgggaacatag

SEQ ID NO: 387715 - DNA, 15 bp, Homo sapiens
gactgggaacataga

SEQ ID NO: 387716 - DNA, 15 bp, Homo sapiens
actgggaacatagaa

SEQ ID NO: 387717 - DNA, 15 bp, Homo sapiens
ctgggaacatagaag

SEQ ID NO: 387718 - DNA, 15 bp, Homo sapiens
tgggaacatagaaga

SEQ ID NO: 387719 - DNA, 15 bp, Homo sapiens
gggaacatagaagaa

SEQ ID NO: 387720 - DNA, 15 bp, Homo sapiens
ggaacatagaagaaa

SEQ ID NO: 387721 - DNA, 15 bp, Homo sapiens
gaacatagaagaaaa

SEQ ID NO: 387722 - DNA, 15 bp, Homo sapiens
aacatagaagaaaat

SEQ ID NO: 387723 - DNA, 15 bp, Homo sapiens
acatagaagaaaatg

SEQ ID NO: 387724 - DNA, 15 bp, Homo sapiens
catagaagaaaatgt

SEQ ID NO: 387725 - DNA, 15 bp, Homo sapiens
atagaagaaaatgtc

SEQ ID NO: 387726 - DNA, 15 bp, Homo sapiens
tagaagaaaatgtca

SEQ ID NO: 387727 - DNA, 15 bp, Homo sapiens
agaagaaaatgtcag

SEQ ID NO: 387728 - DNA, 15 bp, Homo sapiens
gaagaaaatgtcaga

SEQ ID NO: 387729 - DNA, 15 bp, Homo sapiens
aagaaaatgtcagag

SEQ ID NO: 387730 - DNA, 15 bp, Homo sapiens
agaaaatgtcagagc

SEQ ID NO: 387731 - DNA, 15 bp, Homo sapiens
gaaaatgtcagagca

SEQ ID NO: 387732 - DNA, 15 bp, Homo sapiens
aaaatgtcagagcag

SEQ ID NO: 387733 - DNA, 15 bp, Homo sapiens
aaatgtcagagcagg

SEQ ID NO: 387734 - DNA, 15 bp, Homo sapiens
aatgtcagagcaggg

SEQ ID NO: 387735 - DNA, 15 bp, Homo sapiens
atgtcagagcagggt

SEQ ID NO: 387736 - DNA, 15 bp, Homo sapiens
tgtcagagcagggtt

SEQ ID NO: 387737 - DNA, 15 bp, Homo sapiens
gtcagagcagggttg

SEQ ID NO: 387738 - DNA, 15 bp, Homo sapiens
tcagagcagggttgc

SEQ ID NO: 387739 - DNA, 15 bp, Homo sapiens
cagagcagggttgca

SEQ ID NO: 387740 - DNA, 15 bp, Homo sapiens
agagcagggttgcaa

SEQ ID NO: 387741 - DNA, 15 bp, Homo sapiens
gagcagggttgcaag

SEQ ID NO: 387742 - DNA, 15 bp, Homo sapiens
agcagggttgcaagt

SEQ ID NO: 387743 - DNA, 15 bp, Homo sapiens
gcagggttgcaagtt

SEQ ID NO: 387744 - DNA, 15 bp, Homo sapiens
cagggttgcaagtta

SEQ ID NO: 387745 - DNA, 15 bp, Homo sapiens
agggttgcaagttag

SEQ ID NO: 387746 - DNA, 15 bp, Homo sapiens
gggttgcaagttagc

SEQ ID NO: 387747 - DNA, 15 bp, Homo sapiens
ggttgcaagttagcg

SEQ ID NO: 387748 - DNA, 15 bp, Homo sapiens
gttgcaagttagcgg

SEQ ID NO: 387749 - DNA, 15 bp, Homo sapiens
ttgcaagttagcggg

SEQ ID NO: 387750 - DNA, 15 bp, Homo sapiens
tgcaagttagcggga

SEQ ID NO: 387751 - DNA, 15 bp, Homo sapiens
gcaagttagcgggaa

SEQ ID NO: 387752 - DNA, 15 bp, Homo sapiens
caagttagcgggaaa

SEQ ID NO: 387753 - DNA, 15 bp, Homo sapiens
aagttagcgggaaat

SEQ ID NO: 387754 - DNA, 15 bp, Homo sapiens
agttagcgggaaatg

SEQ ID NO: 387755 - DNA, 15 bp, Homo sapiens
gttagcgggaaatgt

SEQ ID NO: 387756 - DNA, 15 bp, Homo sapiens
ttagcgggaaatgtg

SEQ ID NO: 387757 - DNA, 15 bp, Homo sapiens
tagcgggaaatgtgt

SEQ ID NO: 387758 - DNA, 15 bp, Homo sapiens
agcgggaaatgtgtg

SEQ ID NO: 387759 - DNA, 15 bp, Homo sapiens
gcgggaaatgtgtgg

SEQ ID NO: 387760 - DNA, 15 bp, Homo sapiens
cgggaaatgtgtggg

SEQ ID NO: 387761 - DNA, 15 bp, Homo sapiens
gggaaatgtgtgggg

SEQ ID NO: 387762 - DNA, 15 bp, Homo sapiens
ggaaatgtgtgggga

SEQ ID NO: 387763 - DNA, 15 bp, Homo sapiens
gaaatgtgtggggat

SEQ ID NO: 387764 - DNA, 15 bp, Homo sapiens
aaatgtgtggggatg

SEQ ID NO: 387765 - DNA, 15 bp, Homo sapiens
aatgtgtggggatgg

SEQ ID NO: 387766 - DNA, 15 bp, Homo sapiens
atgtgtggggatggc

SEQ ID NO: 387767 - DNA, 15 bp, Homo sapiens
tgtgtggggatggca

SEQ ID NO: 387768 - DNA, 15 bp, Homo sapiens
gtgtggggatggcaa

SEQ ID NO: 387769 - DNA, 15 bp, Homo sapiens
tgtggggatggcaaa

SEQ ID NO: 387770 - DNA, 15 bp, Homo sapiens
gtggggatggcaaat

SEQ ID NO: 387771 - DNA, 15 bp, Homo sapiens
tggggatggcaaatt

SEQ ID NO: 387772 - DNA, 15 bp, Homo sapiens
ggggatggcaaattt

SEQ ID NO: 387773 - DNA, 15 bp, Homo sapiens
gggatggcaaatttc

SEQ ID NO: 387774 - DNA, 15 bp, Homo sapiens
ggatggcaaatttca

SEQ ID NO: 387775 - DNA, 15 bp, Homo sapiens
gatggcaaatttcat

SEQ ID NO: 387776 - DNA, 15 bp, Homo sapiens
atggcaaatttcatc

SEQ ID NO: 387777 - DNA, 15 bp, Homo sapiens
tggcaaatttcatct

SEQ ID NO: 387778 - DNA, 15 bp, Homo sapiens
ggcaaatttcatctg

SEQ ID NO: 387779 - DNA, 15 bp, Homo sapiens
gcaaatttcatctgt

SEQ ID NO: 387780 - DNA, 15 bp, Homo sapiens
caaatttcatctgtt

SEQ ID NO: 387781 - DNA, 15 bp, Homo sapiens
aaatttcatctgttt

SEQ ID NO: 387782 - DNA, 15 bp, Homo sapiens
aatttcatctgtttt

SEQ ID NO: 387783 - DNA, 15 bp, Homo sapiens
atttcatctgttttg

SEQ ID NO: 387784 - DNA, 15 bp, Homo sapiens
tttcatctgttttga

SEQ ID NO: 387785 - DNA, 15 bp, Homo sapiens
ttcatctgttttgac

SEQ ID NO: 387786 - DNA, 15 bp, Homo sapiens
tcatctgttttgact

SEQ ID NO: 387787 - DNA, 15 bp, Homo sapiens
catctgttttgactt

SEQ ID NO: 387788 - DNA, 15 bp, Homo sapiens
atctgttttgacttt

SEQ ID NO: 387789 - DNA, 15 bp, Homo sapiens
tctgttttgactttg

SEQ ID NO: 387790 - DNA, 15 bp, Homo sapiens
ctgttttgactttgt

SEQ ID NO: 387791 - DNA, 15 bp, Homo sapiens
tgttttgactttgtt

SEQ ID NO: 387792 - DNA, 15 bp, Homo sapiens
gttttgactttgttg

SEQ ID NO: 387793 - DNA, 15 bp, Homo sapiens
ttttgactttgttga

SEQ ID NO: 387794 - DNA, 15 bp, Homo sapiens
tttgactttgttgaa

SEQ ID NO: 387795 - DNA, 15 bp, Homo sapiens
ttgactttgttgaaa

SEQ ID NO: 387796 - DNA, 15 bp, Homo sapiens
tgactttgttgaaat

SEQ ID NO: 387797 - DNA, 15 bp, Homo sapiens
gactttgttgaaatg

SEQ ID NO: 387798 - DNA, 15 bp, Homo sapiens
actttgttgaaatga

SEQ ID NO: 387799 - DNA, 15 bp, Homo sapiens
ctttgttgaaatgaa

SEQ ID NO: 387800 - DNA, 15 bp, Homo sapiens
tttgttgaaatgaag

SEQ ID NO: 387801 - DNA, 15 bp, Homo sapiens
ttgttgaaatgaagc

SEQ ID NO: 387802 - DNA, 15 bp, Homo sapiens
tgttgaaatgaagca

SEQ ID NO: 387803 - DNA, 15 bp, Homo sapiens
gttgaaatgaagcat

SEQ ID NO: 387804 - DNA, 15 bp, Homo sapiens
ttgaaatgaagcatt

SEQ ID NO: 387805 - DNA, 15 bp, Homo sapiens
tgaaatgaagcattg

SEQ ID NO: 387806 - DNA, 15 bp, Homo sapiens
gaaatgaagcattgg

SEQ ID NO: 387807 - DNA, 15 bp, Homo sapiens
aaatgaagcattgga

SEQ ID NO: 387808 - DNA, 15 bp, Homo sapiens
aatgaagcattggag

SEQ ID NO: 387809 - DNA, 15 bp, Homo sapiens
atgaagcattggagt

SEQ ID NO: 387810 - DNA, 15 bp, Homo sapiens
tgaagcattggagta

SEQ ID NO: 387811 - DNA, 15 bp, Homo sapiens
gaagcattggagtaa

SEQ ID NO: 387812 - DNA, 15 bp, Homo sapiens
aagcattggagtaac

SEQ ID NO: 387813 - DNA, 15 bp, Homo sapiens
agcattggagtaaca

SEQ ID NO: 387814 - DNA, 15 bp, Homo sapiens
gcattggagtaacat

SEQ ID NO: 387815 - DNA, 15 bp, Homo sapiens
cattggagtaacatc

SEQ ID NO: 387816 - DNA, 15 bp, Homo sapiens
attggagtaacatcc

SEQ ID NO: 387817 - DNA, 15 bp, Homo sapiens
ttggagtaacatcca

SEQ ID NO: 387818 - DNA, 15 bp, Homo sapiens
tggagtaacatccag

SEQ ID NO: 387819 - DNA, 15 bp, Homo sapiens
ggagtaacatccagg

SEQ ID NO: 387820 - DNA, 15 bp, Homo sapiens
gagtaacatccagga

SEQ ID NO: 387821 - DNA, 15 bp, Homo sapiens
agtaacatccaggag

SEQ ID NO: 387822 - DNA, 15 bp, Homo sapiens
gtaacatccaggagg

SEQ ID NO: 387823 - DNA, 15 bp, Homo sapiens
taacatccaggagga

SEQ ID NO: 387824 - DNA, 15 bp, Homo sapiens
aacatccaggaggaa

SEQ ID NO: 387825 - DNA, 15 bp, Homo sapiens
acatccaggaggaat

SEQ ID NO: 387826 - DNA, 15 bp, Homo sapiens
catccaggaggaatt

SEQ ID NO: 387827 - DNA, 15 bp, Homo sapiens
atccaggaggaattg

SEQ ID NO: 387828 - DNA, 15 bp, Homo sapiens
tccaggaggaattgc

SEQ ID NO: 387829 - DNA, 15 bp, Homo sapiens
ccaggaggaattgcc

SEQ ID NO: 387830 - DNA, 15 bp, Homo sapiens
caggaggaattgcct

SEQ ID NO: 387831 - DNA, 15 bp, Homo sapiens
aggaggaattgcctg

SEQ ID NO: 387832 - DNA, 15 bp, Homo sapiens
ggaggaattgcctgg

SEQ ID NO: 387833 - DNA, 15 bp, Homo sapiens
gaggaattgcctggt

SEQ ID NO: 387834 - DNA, 15 bp, Homo sapiens
aggaattgcctggta

SEQ ID NO: 387835 - DNA, 15 bp, Homo sapiens
ggaattgcctggtat

SEQ ID NO: 387836 - DNA, 15 bp, Homo sapiens
gaattgcctggtatg

SEQ ID NO: 387837 - DNA, 15 bp, Homo sapiens
aattgcctggtatgc

SEQ ID NO: 387838 - DNA, 15 bp, Homo sapiens
attgcctggtatgca

SEQ ID NO: 387839 - DNA, 15 bp, Homo sapiens
ttgcctggtatgcag

SEQ ID NO: 387840 - DNA, 15 bp, Homo sapiens
tgcctggtatgcagt

SEQ ID NO: 387841 - DNA, 15 bp, Homo sapiens
gcctggtatgcagtt

SEQ ID NO: 387842 - DNA, 15 bp, Homo sapiens
cctggtatgcagttg

SEQ ID NO: 387843 - DNA, 15 bp, Homo sapiens
ctggtatgcagttgt

SEQ ID NO: 387844 - DNA, 15 bp, Homo sapiens
tggtatgcagttgtc

SEQ ID NO: 387845 - DNA, 15 bp, Homo sapiens
ggtatgcagttgtca

SEQ ID NO: 387846 - DNA, 15 bp, Homo sapiens
gtatgcagttgtcac

SEQ ID NO: 387847 - DNA, 15 bp, Homo sapiens
tatgcagttgtcact

SEQ ID NO: 387848 - DNA, 15 bp, Homo sapiens
atgcagttgtcactg

SEQ ID NO: 387849 - DNA, 15 bp, Homo sapiens
tgcagttgtcactgt

SEQ ID NO: 387850 - DNA, 15 bp, Homo sapiens
gcagttgtcactgtg

SEQ ID NO: 387851 - DNA, 15 bp, Homo sapiens
cagttgtcactgtga

SEQ ID NO: 387852 - DNA, 15 bp, Homo sapiens
agttgtcactgtgaa

SEQ ID NO: 387853 - DNA, 15 bp, Homo sapiens
gttgtcactgtgaat

SEQ ID NO: 387854 - DNA, 15 bp, Homo sapiens
ttgtcactgtgaatc

SEQ ID NO: 387855 - DNA, 15 bp, Homo sapiens
tgtcactgtgaatct

SEQ ID NO: 387856 - DNA, 15 bp, Homo sapiens
gtcactgtgaatcta

SEQ ID NO: 387857 - DNA, 15 bp, Homo sapiens
tcactgtgaatctat

SEQ ID NO: 387858 - DNA, 15 bp, Homo sapiens
cactgtgaatctata

SEQ ID NO: 387859 - DNA, 15 bp, Homo sapiens
actgtgaatctatat

SEQ ID NO: 387860 - DNA, 15 bp, Homo sapiens
ctgtgaatctatatt

SEQ ID NO: 387861 - DNA, 15 bp, Homo sapiens
tgtgaatctatattc

SEQ ID NO: 387862 - DNA, 15 bp, Homo sapiens
gtgaatctatattca

SEQ ID NO: 387863 - DNA, 15 bp, Homo sapiens
tgaatctatattcag

SEQ ID NO: 387864 - DNA, 15 bp, Homo sapiens
gaatctatattcaga

SEQ ID NO: 387865 - DNA, 15 bp, Homo sapiens
aatctatattcagat

SEQ ID NO: 387866 - DNA, 15 bp, Homo sapiens
atctatattcagata

SEQ ID NO: 387867 - DNA, 15 bp, Homo sapiens
tctatattcagataa

SEQ ID NO: 387868 - DNA, 15 bp, Homo sapiens
ctatattcagataag

SEQ ID NO: 387869 - DNA, 15 bp, Homo sapiens
tatattcagataaga

SEQ ID NO: 387870 - DNA, 15 bp, Homo sapiens
atattcagataagag

SEQ ID NO: 387871 - DNA, 15 bp, Homo sapiens
tattcagataagagt

SEQ ID NO: 387872 - DNA, 15 bp, Homo sapiens
attcagataagagta

SEQ ID NO: 387873 - DNA, 15 bp, Homo sapiens
ttcagataagagtat

SEQ ID NO: 387874 - DNA, 15 bp, Homo sapiens
tcagataagagtatt

SEQ ID NO: 387875 - DNA, 15 bp, Homo sapiens
cagataagagtattt

SEQ ID NO: 387876 - DNA, 15 bp, Homo sapiens
agataagagtatttg

SEQ ID NO: 387877 - DNA, 15 bp, Homo sapiens
gataagagtatttgg

SEQ ID NO: 387878 - DNA, 15 bp, Homo sapiens
ataagagtatttggc

SEQ ID NO: 387879 - DNA, 15 bp, Homo sapiens
taagagtatttggcc

SEQ ID NO: 387880 - DNA, 15 bp, Homo sapiens
aagagtatttggcca

SEQ ID NO: 387881 - DNA, 15 bp, Homo sapiens
agagtatttggccaa

SEQ ID NO: 387882 - DNA, 15 bp, Homo sapiens
gagtatttggccaaa

SEQ ID NO: 387883 - DNA, 15 bp, Homo sapiens
agtatttggccaaag

SEQ ID NO: 387884 - DNA, 15 bp, Homo sapiens
gtatttggccaaaga

SEQ ID NO: 387885 - DNA, 15 bp, Homo sapiens
tatttggccaaagat

SEQ ID NO: 387886 - DNA, 15 bp, Homo sapiens
atttggccaaagatg

SEQ ID NO: 387887 - DNA, 15 bp, Homo sapiens
tttggccaaagatgc

SEQ ID NO: 387888 - DNA, 15 bp, Homo sapiens
ttggccaaagatgca

SEQ ID NO: 387889 - DNA, 15 bp, Homo sapiens
tggccaaagatgcag

SEQ ID NO: 387890 - DNA, 15 bp, Homo sapiens
ggccaaagatgcaga

SEQ ID NO: 387891 - DNA, 15 bp, Homo sapiens
gccaaagatgcagaa

SEQ ID NO: 387892 - DNA, 15 bp, Homo sapiens
ccaaagatgcagaaa

SEQ ID NO: 387893 - DNA, 15 bp, Homo sapiens
caaagatgcagaaac

SEQ ID NO: 387894 - DNA, 15 bp, Homo sapiens
aaagatgcagaaact

SEQ ID NO: 387895 - DNA, 15 bp, Homo sapiens
aagatgcagaaactt

SEQ ID NO: 387896 - DNA, 15 bp, Homo sapiens
agatgcagaaacttt

SEQ ID NO: 387897 - DNA, 15 bp, Homo sapiens
gatgcagaaacttta

SEQ ID NO: 387898 - DNA, 15 bp, Homo sapiens
atgcagaaactttat

SEQ ID NO: 387899 - DNA, 15 bp, Homo sapiens
tgcagaaactttatt

SEQ ID NO: 387900 - DNA, 15 bp, Homo sapiens
gcagaaactttattt

SEQ ID NO: 387901 - DNA, 15 bp, Homo sapiens
cagaaactttatttt

SEQ ID NO: 387902 - DNA, 15 bp, Homo sapiens
agaaactttattttt

SEQ ID NO: 387903 - DNA, 15 bp, Homo sapiens
gaaactttatttttt

SEQ ID NO: 387904 - DNA, 15 bp, Homo sapiens
aaactttattttttg

SEQ ID NO: 387905 - DNA, 15 bp, Homo sapiens
aactttattttttgc

SEQ ID NO: 387906 - DNA, 15 bp, Homo sapiens
actttattttttgct

SEQ ID NO: 387907 - DNA, 15 bp, Homo sapiens
ctttattttttgctt

SEQ ID NO: 387908 - DNA, 15 bp, Homo sapiens
tttattttttgcttt

SEQ ID NO: 387909 - DNA, 15 bp, Homo sapiens
ttattttttgctttt

SEQ ID NO: 387910 - DNA, 15 bp, Homo sapiens
tattttttgcttttg

SEQ ID NO: 387911 - DNA, 15 bp, Homo sapiens
attttttgcttttgt

SEQ ID NO: 387912 - DNA, 15 bp, Homo sapiens
ttttttgcttttgta

SEQ ID NO: 387913 - DNA, 15 bp, Homo sapiens
tttttgcttttgtat

SEQ ID NO: 387914 - DNA, 15 bp, Homo sapiens
ttttgcttttgtatg

SEQ ID NO: 387915 - DNA, 15 bp, Homo sapiens
tttgcttttgtatga

SEQ ID NO: 387916 - DNA, 15 bp, Homo sapiens
ttgcttttgtatgaa

SEQ ID NO: 387917 - DNA, 15 bp, Homo sapiens
tgcttttgtatgaaa

SEQ ID NO: 387918 - DNA, 15 bp, Homo sapiens
gcttttgtatgaaag

SEQ ID NO: 387919 - DNA, 15 bp, Homo sapiens
cttttgtatgaaagc

SEQ ID NO: 387920 - DNA, 15 bp, Homo sapiens
ttttgtatgaaagcc

SEQ ID NO: 387921 - DNA, 15 bp, Homo sapiens
tttgtatgaaagccc

SEQ ID NO: 387922 - DNA, 15 bp, Homo sapiens
ttgtatgaaagccca

SEQ ID NO: 387923 - DNA, 15 bp, Homo sapiens
tgtatgaaagcccat

SEQ ID NO: 387924 - DNA, 15 bp, Homo sapiens
gtatgaaagcccatt

SEQ ID NO: 387925 - DNA, 15 bp, Homo sapiens
tatgaaagcccatta

SEQ ID NO: 387926 - DNA, 15 bp, Homo sapiens
atgaaagcccattat

SEQ ID NO: 387927 - DNA, 15 bp, Homo sapiens
tgaaagcccattatt

SEQ ID NO: 387928 - DNA, 15 bp, Homo sapiens
gaaagcccattattg

SEQ ID NO: 387929 - DNA, 15 bp, Homo sapiens
aaagcccattattga

SEQ ID NO: 387930 - DNA, 15 bp, Homo sapiens
aagcccattattgac

SEQ ID NO: 387931 - DNA, 15 bp, Homo sapiens
agcccattattgact

SEQ ID NO: 387932 - DNA, 15 bp, Homo sapiens
gcccattattgactt

SEQ ID NO: 387933 - DNA, 15 bp, Homo sapiens
cccattattgacttc

SEQ ID NO: 387934 - DNA, 15 bp, Homo sapiens
ccattattgacttcc

SEQ ID NO: 387935 - DNA, 15 bp, Homo sapiens
cattattgacttcca

SEQ ID NO: 387936 - DNA, 15 bp, Homo sapiens
attattgacttccaa

SEQ ID NO: 387937 - DNA, 15 bp, Homo sapiens
ttattgacttccaac

SEQ ID NO: 387938 - DNA, 15 bp, Homo sapiens
tattgacttccaact

SEQ ID NO: 387939 - DNA, 15 bp, Homo sapiens
attgacttccaacta

SEQ ID NO: 387940 - DNA, 15 bp, Homo sapiens
ttgacttccaactag

SEQ ID NO: 387941 - DNA, 15 bp, Homo sapiens
tgacttccaactagt

SEQ ID NO: 387942 - DNA, 15 bp, Homo sapiens
gacttccaactagtt

SEQ ID NO: 387943 - DNA, 15 bp, Homo sapiens
acttccaactagttt

SEQ ID NO: 387944 - DNA, 15 bp, Homo sapiens
cttccaactagttta

SEQ ID NO: 387945 - DNA, 15 bp, Homo sapiens
ttccaactagtttat

SEQ ID NO: 387946 - DNA, 15 bp, Homo sapiens
tccaactagtttatt

SEQ ID NO: 387947 - DNA, 15 bp, Homo sapiens
ccaactagtttatta

SEQ ID NO: 387948 - DNA, 15 bp, Homo sapiens
caactagtttattag

SEQ ID NO: 387949 - DNA, 15 bp, Homo sapiens
aactagtttattagt

SEQ ID NO: 387950 - DNA, 15 bp, Homo sapiens
actagtttattagtt

SEQ ID NO: 387951 - DNA, 15 bp, Homo sapiens
ctagtttattagttc

SEQ ID NO: 387952 - DNA, 15 bp, Homo sapiens
tagtttattagttca

SEQ ID NO: 387953 - DNA, 15 bp, Homo sapiens
agtttattagttcaa

SEQ ID NO: 387954 - DNA, 15 bp, Homo sapiens
gtttattagttcaag

SEQ ID NO: 387955 - DNA, 15 bp, Homo sapiens
tttattagttcaagt

SEQ ID NO: 387956 - DNA, 15 bp, Homo sapiens
ttattagttcaagtg

SEQ ID NO: 387957 - DNA, 15 bp, Homo sapiens
tattagttcaagtgc

SEQ ID NO: 387958 - DNA, 15 bp, Homo sapiens
attagttcaagtgca

SEQ ID NO: 387959 - DNA, 15 bp, Homo sapiens
ttagttcaagtgcat

SEQ ID NO: 387960 - DNA, 15 bp, Homo sapiens
tagttcaagtgcatt

SEQ ID NO: 387961 - DNA, 15 bp, Homo sapiens
agttcaagtgcattt

SEQ ID NO: 387962 - DNA, 15 bp, Homo sapiens
gttcaagtgcattta

SEQ ID NO: 387963 - DNA, 15 bp, Homo sapiens
ttcaagtgcatttat

SEQ ID NO: 387964 - DNA, 15 bp, Homo sapiens
tcaagtgcatttatt

SEQ ID NO: 387965 - DNA, 15 bp, Homo sapiens
caagtgcatttattc

SEQ ID NO: 387966 - DNA, 15 bp, Homo sapiens
aagtgcatttattct

SEQ ID NO: 387967 - DNA, 15 bp, Homo sapiens
agtgcatttattctt

SEQ ID NO: 387968 - DNA, 15 bp, Homo sapiens
gtgcatttattctta

SEQ ID NO: 387969 - DNA, 15 bp, Homo sapiens
tgcatttattcttaa

SEQ ID NO: 387970 - DNA, 15 bp, Homo sapiens
gcatttattcttaat

SEQ ID NO: 387971 - DNA, 15 bp, Homo sapiens
catttattcttaatg

SEQ ID NO: 387972 - DNA, 15 bp, Homo sapiens
atttattcttaatgt

SEQ ID NO: 387973 - DNA, 15 bp, Homo sapiens
tttattcttaatgtg

SEQ ID NO: 387974 - DNA, 15 bp, Homo sapiens
ttattcttaatgtgc

SEQ ID NO: 387975 - DNA, 15 bp, Homo sapiens
tattcttaatgtgca

SEQ ID NO: 387976 - DNA, 15 bp, Homo sapiens
attcttaatgtgcat

SEQ ID NO: 387977 - DNA, 15 bp, Homo sapiens
ttcttaatgtgcatg

SEQ ID NO: 387978 - DNA, 15 bp, Homo sapiens
tcttaatgtgcatgt

SEQ ID NO: 387979 - DNA, 15 bp, Homo sapiens
cttaatgtgcatgtt

SEQ ID NO: 387980 - DNA, 15 bp, Homo sapiens
ttaatgtgcatgttc

SEQ ID NO: 387981 - DNA, 15 bp, Homo sapiens
taatgtgcatgttca

SEQ ID NO: 387982 - DNA, 15 bp, Homo sapiens
aatgtgcatgttcat

SEQ ID NO: 387983 - DNA, 15 bp, Homo sapiens
atgtgcatgttcata

SEQ ID NO: 387984 - DNA, 15 bp, Homo sapiens
tgtgcatgttcatat

SEQ ID NO: 387985 - DNA, 15 bp, Homo sapiens
gtgcatgttcatatt

SEQ ID NO: 387986 - DNA, 15 bp, Homo sapiens
tgcatgttcatattc

SEQ ID NO: 387987 - DNA, 15 bp, Homo sapiens
gcatgttcatattct

SEQ ID NO: 387988 - DNA, 15 bp, Homo sapiens
catgttcatattcta

SEQ ID NO: 387989 - DNA, 15 bp, Homo sapiens
atgttcatattctaa

SEQ ID NO: 387990 - DNA, 15 bp, Homo sapiens
tgttcatattctaaa

SEQ ID NO: 387991 - DNA, 15 bp, Homo sapiens
gttcatattctaaaa

SEQ ID NO: 387992 - DNA, 15 bp, Homo sapiens
ttcatattctaaaag

SEQ ID NO: 387993 - DNA, 15 bp, Homo sapiens
tcatattctaaaaga

SEQ ID NO: 387994 - DNA, 15 bp, Homo sapiens
catattctaaaagat

SEQ ID NO: 387995 - DNA, 15 bp, Homo sapiens
atattctaaaagatt

SEQ ID NO: 387996 - DNA, 15 bp, Homo sapiens
tattctaaaagattg

SEQ ID NO: 387997 - DNA, 15 bp, Homo sapiens
attctaaaagattgt

SEQ ID NO: 387998 - DNA, 15 bp, Homo sapiens
ttctaaaagattgtt

SEQ ID NO: 387999 - DNA, 15 bp, Homo sapiens
tctaaaagattgtta

SEQ ID NO: 388000 - DNA, 15 bp, Homo sapiens
ctaaaagattgttat

SEQ ID NO: 388001 - DNA, 15 bp, Homo sapiens
taaaagattgttatt

SEQ ID NO: 388002 - DNA, 15 bp, Homo sapiens
aaaagattgttattc

SEQ ID NO: 388003 - DNA, 15 bp, Homo sapiens
aaagattgttattct

SEQ ID NO: 388004 - DNA, 15 bp, Homo sapiens
aagattgttattctt

SEQ ID NO: 388005 - DNA, 15 bp, Homo sapiens
agattgttattcttt

SEQ ID NO: 388006 - DNA, 15 bp, Homo sapiens
gattgttattctttt

SEQ ID NO: 388007 - DNA, 15 bp, Homo sapiens
attgttattctttta

SEQ ID NO: 388008 - DNA, 15 bp, Homo sapiens
ttgttattcttttaa

SEQ ID NO: 388009 - DNA, 15 bp, Homo sapiens
tgttattcttttaat

SEQ ID NO: 388010 - DNA, 15 bp, Homo sapiens
gttattcttttaatt

SEQ ID NO: 388011 - DNA, 15 bp, Homo sapiens
ttattcttttaatta

SEQ ID NO: 388012 - DNA, 15 bp, Homo sapiens
tattcttttaattat

SEQ ID NO: 388013 - DNA, 15 bp, Homo sapiens
attcttttaattata

SEQ ID NO: 388014 - DNA, 15 bp, Homo sapiens
ttcttttaattatat

SEQ ID NO: 388015 - DNA, 15 bp, Homo sapiens
tcttttaattatatt

SEQ ID NO: 388016 - DNA, 15 bp, Homo sapiens
cttttaattatattt

SEQ ID NO: 388017 - DNA, 15 bp, Homo sapiens
ttttaattatattta

SEQ ID NO: 388018 - DNA, 15 bp, Homo sapiens
tttaattatatttaa

SEQ ID NO: 388019 - DNA, 15 bp, Homo sapiens
ttaattatatttaaa

SEQ ID NO: 388020 - DNA, 15 bp, Homo sapiens
taattatatttaaaa

SEQ ID NO: 388021 - DNA, 15 bp, Homo sapiens
aattatatttaaaaa

SEQ ID NO: 388022 - DNA, 15 bp, Homo sapiens
attatatttaaaaat

SEQ ID NO: 388023 - DNA, 15 bp, Homo sapiens
ttatatttaaaaatt

SEQ ID NO: 388024 - DNA, 15 bp, Homo sapiens
atatttaaaaatttc

SEQ ID NO: 388025 - DNA, 15 bp, Homo sapiens
tatttaaaaatttca

SEQ ID NO: 388026 - DNA, 15 bp, Homo sapiens
atttaaaaatttcag

SEQ ID NO: 388027 - DNA, 15 bp, Homo sapiens
tttaaaaatttcagc

SEQ ID NO: 388028 - DNA, 15 bp, Homo sapiens
ttaaaaatttcagct

SEQ ID NO: 388029 - DNA, 15 bp, Homo sapiens
taaaaatttcagctt

SEQ ID NO: 388030 - DNA, 15 bp, Homo sapiens
aaaaatttcagcttt

SEQ ID NO: 388031 - DNA, 15 bp, Homo sapiens
aaaatttcagcttta

SEQ ID NO: 388032 - DNA, 15 bp, Homo sapiens
aaatttcagctttac

SEQ ID NO: 388033 - DNA, 15 bp, Homo sapiens
aatttcagctttaca

SEQ ID NO: 388034 - DNA, 15 bp, Homo sapiens
atttcagctttacat

SEQ ID NO: 388035 - DNA, 15 bp, Homo sapiens
tttcagctttacatt

SEQ ID NO: 388036 - DNA, 15 bp, Homo sapiens
ttcagctttacattt

SEQ ID NO: 388037 - DNA, 15 bp, Homo sapiens
tcagctttacatttg

SEQ ID NO: 388038 - DNA, 15 bp, Homo sapiens
cagctttacatttgg

SEQ ID NO: 388039 - DNA, 15 bp, Homo sapiens
agctttacatttggc

SEQ ID NO: 388040 - DNA, 15 bp, Homo sapiens
gctttacatttggca

SEQ ID NO: 388041 - DNA, 15 bp, Homo sapiens
ctttacatttggcat

SEQ ID NO: 388042 - DNA, 15 bp, Homo sapiens
tttacatttggcatt

SEQ ID NO: 388043 - DNA, 15 bp, Homo sapiens
ttacatttggcatta

SEQ ID NO: 388044 - DNA, 15 bp, Homo sapiens
tacatttggcattac

SEQ ID NO: 388045 - DNA, 15 bp, Homo sapiens
acatttggcattacc

SEQ ID NO: 388046 - DNA, 15 bp, Homo sapiens
catttggcattacca

SEQ ID NO: 388047 - DNA, 15 bp, Homo sapiens
atttggcattaccaa

SEQ ID NO: 388048 - DNA, 15 bp, Homo sapiens
tttggcattaccaat

SEQ ID NO: 388049 - DNA, 15 bp, Homo sapiens
ttggcattaccaatt

SEQ ID NO: 388050 - DNA, 15 bp, Homo sapiens
tggcattaccaatta

SEQ ID NO: 388051 - DNA, 15 bp, Homo sapiens
ggcattaccaattaa

SEQ ID NO: 388052 - DNA, 15 bp, Homo sapiens
gcattaccaattaat

SEQ ID NO: 388053 - DNA, 15 bp, Homo sapiens
cattaccaattaatt

SEQ ID NO: 388054 - DNA, 15 bp, Homo sapiens
attaccaattaattg

SEQ ID NO: 388055 - DNA, 15 bp, Homo sapiens
ttaccaattaattga

SEQ ID NO: 388056 - DNA, 15 bp, Homo sapiens
taccaattaattgaa

SEQ ID NO: 388057 - DNA, 15 bp, Homo sapiens
accaattaattgaaa

SEQ ID NO: 388058 - DNA, 15 bp, Homo sapiens
ccaattaattgaaat

SEQ ID NO: 388059 - DNA, 15 bp, Homo sapiens
caattaattgaaatg

SEQ ID NO: 388060 - DNA, 15 bp, Homo sapiens
aattaattgaaatgc

SEQ ID NO: 388061 - DNA, 15 bp, Homo sapiens
attaattgaaatgct

SEQ ID NO: 388062 - DNA, 15 bp, Homo sapiens
ttaattgaaatgctc

SEQ ID NO: 388063 - DNA, 15 bp, Homo sapiens
taattgaaatgctct

SEQ ID NO: 388064 - DNA, 15 bp, Homo sapiens
aattgaaatgctctg

SEQ ID NO: 388065 - DNA, 15 bp, Homo sapiens
attgaaatgctctga

SEQ ID NO: 388066 - DNA, 15 bp, Homo sapiens
ttgaaatgctctgat

SEQ ID NO: 388067 - DNA, 15 bp, Homo sapiens
tgaaatgctctgatt

SEQ ID NO: 388068 - DNA, 15 bp, Homo sapiens
gaaatgctctgattc

SEQ ID NO: 388069 - DNA, 15 bp, Homo sapiens
aaatgctctgattct

SEQ ID NO: 388070 - DNA, 15 bp, Homo sapiens
aatgctctgattctt

SEQ ID NO: 388071 - DNA, 15 bp, Homo sapiens
atgctctgattcttt

SEQ ID NO: 388072 - DNA, 15 bp, Homo sapiens
tgctctgattctttg

SEQ ID NO: 388073 - DNA, 15 bp, Homo sapiens
gctctgattctttgc

SEQ ID NO: 388074 - DNA, 15 bp, Homo sapiens
ctctgattctttgct

SEQ ID NO: 388075 - DNA, 15 bp, Homo sapiens
tctgattctttgctg

SEQ ID NO: 388076 - DNA, 15 bp, Homo sapiens
ctgattctttgctgg

SEQ ID NO: 388077 - DNA, 15 bp, Homo sapiens
tgattctttgctggg

SEQ ID NO: 388078 - DNA, 15 bp, Homo sapiens
gattctttgctgggt

SEQ ID NO: 388079 - DNA, 15 bp, Homo sapiens
attctttgctgggta

SEQ ID NO: 388080 - DNA, 15 bp, Homo sapiens
ttctttgctgggtaa

SEQ ID NO: 388081 - DNA, 15 bp, Homo sapiens
tctttgctgggtaaa

SEQ ID NO: 388082 - DNA, 15 bp, Homo sapiens
ctttgctgggtaaaa

SEQ ID NO: 388083 - DNA, 15 bp, Homo sapiens
tttgctgggtaaaat

SEQ ID NO: 388084 - DNA, 15 bp, Homo sapiens
ttgctgggtaaaatc

SEQ ID NO: 388085 - DNA, 15 bp, Homo sapiens
tgctgggtaaaatcc

SEQ ID NO: 388086 - DNA, 15 bp, Homo sapiens
gctgggtaaaatcct

SEQ ID NO: 388087 - DNA, 15 bp, Homo sapiens
ctgggtaaaatcctg

SEQ ID NO: 388088 - DNA, 15 bp, Homo sapiens
tgggtaaaatcctga

SEQ ID NO: 388089 - DNA, 15 bp, Homo sapiens
gggtaaaatcctgag

SEQ ID NO: 388090 - DNA, 15 bp, Homo sapiens
ggtaaaatcctgagt

SEQ ID NO: 388091 - DNA, 15 bp, Homo sapiens
gtaaaatcctgagtt

SEQ ID NO: 388092 - DNA, 15 bp, Homo sapiens
taaaatcctgagttc

SEQ ID NO: 388093 - DNA, 15 bp, Homo sapiens
aaaatcctgagttct

SEQ ID NO: 388094 - DNA, 15 bp, Homo sapiens
aaatcctgagttctg

SEQ ID NO: 388095 - DNA, 15 bp, Homo sapiens
aatcctgagttctgc

SEQ ID NO: 388096 - DNA, 15 bp, Homo sapiens
atcctgagttctgct

SEQ ID NO: 388097 - DNA, 15 bp, Homo sapiens
tcctgagttctgctg

SEQ ID NO: 388098 - DNA, 15 bp, Homo sapiens
cctgagttctgctgc

SEQ ID NO: 388099 - DNA, 15 bp, Homo sapiens
ctgagttctgctgcc

SEQ ID NO: 388100 - DNA, 15 bp, Homo sapiens
tgagttctgctgcct

SEQ ID NO: 388101 - DNA, 15 bp, Homo sapiens
gagttctgctgcctt

SEQ ID NO: 388102 - DNA, 15 bp, Homo sapiens
agttctgctgccttt

SEQ ID NO: 388103 - DNA, 15 bp, Homo sapiens
gttctgctgcctttc

SEQ ID NO: 388104 - DNA, 15 bp, Homo sapiens
ttctgctgcctttct

SEQ ID NO: 388105 - DNA, 15 bp, Homo sapiens
tctgctgcctttctg

SEQ ID NO: 388106 - DNA, 15 bp, Homo sapiens
ctgctgcctttctgg

SEQ ID NO: 388107 - DNA, 15 bp, Homo sapiens
tgctgcctttctgga

SEQ ID NO: 388108 - DNA, 15 bp, Homo sapiens
gctgcctttctggag

SEQ ID NO: 388109 - DNA, 15 bp, Homo sapiens
ctgcctttctggagt

SEQ ID NO: 388110 - DNA, 15 bp, Homo sapiens
tgcctttctggagtg

SEQ ID NO: 388111 - DNA, 15 bp, Homo sapiens
gcctttctggagtgg

SEQ ID NO: 388112 - DNA, 15 bp, Homo sapiens
cctttctggagtggt

SEQ ID NO: 388113 - DNA, 15 bp, Homo sapiens
ctttctggagtggtg

SEQ ID NO: 388114 - DNA, 15 bp, Homo sapiens
tttctggagtggtgt

SEQ ID NO: 388115 - DNA, 15 bp, Homo sapiens
ttctggagtggtgtt

SEQ ID NO: 388116 - DNA, 15 bp, Homo sapiens
tctggagtggtgttg

SEQ ID NO: 388117 - DNA, 15 bp, Homo sapiens
ctggagtggtgttgt

SEQ ID NO: 388118 - DNA, 15 bp, Homo sapiens
tggagtggtgttgtc

SEQ ID NO: 388119 - DNA, 15 bp, Homo sapiens
ggagtggtgttgtca

SEQ ID NO: 388120 - DNA, 15 bp, Homo sapiens
gagtggtgttgtcat

SEQ ID NO: 388121 - DNA, 15 bp, Homo sapiens
agtggtgttgtcatg

SEQ ID NO: 388122 - DNA, 15 bp, Homo sapiens
gtggtgttgtcatgg

SEQ ID NO: 388123 - DNA, 15 bp, Homo sapiens
tggtgttgtcatggg

SEQ ID NO: 388124 - DNA, 15 bp, Homo sapiens
ggtgttgtcatgggt

SEQ ID NO: 388125 - DNA, 15 bp, Homo sapiens
gtgttgtcatgggtg

SEQ ID NO: 388126 - DNA, 15 bp, Homo sapiens
tgttgtcatgggtgg

SEQ ID NO: 388127 - DNA, 15 bp, Homo sapiens
gttgtcatgggtggc

SEQ ID NO: 388128 - DNA, 15 bp, Homo sapiens
ttgtcatgggtggct

SEQ ID NO: 388129 - DNA, 15 bp, Homo sapiens
tgtcatgggtggctg

SEQ ID NO: 388130 - DNA, 15 bp, Homo sapiens
gtcatgggtggctgg

SEQ ID NO: 388131 - DNA, 15 bp, Homo sapiens
tcatgggtggctggt

SEQ ID NO: 388132 - DNA, 15 bp, Homo sapiens
catgggtggctggtt

SEQ ID NO: 388133 - DNA, 15 bp, Homo sapiens
atgggtggctggttt

SEQ ID NO: 388134 - DNA, 15 bp, Homo sapiens
tgggtggctggtttt

SEQ ID NO: 388135 - DNA, 15 bp, Homo sapiens
gggtggctggttttg

SEQ ID NO: 388136 - DNA, 15 bp, Homo sapiens
ggtggctggttttgc

SEQ ID NO: 388137 - DNA, 15 bp, Homo sapiens
gtggctggttttgct

SEQ ID NO: 388138 - DNA, 15 bp, Homo sapiens
tggctggttttgctc

SEQ ID NO: 388139 - DNA, 15 bp, Homo sapiens
ggctggttttgctct

SEQ ID NO: 388140 - DNA, 15 bp, Homo sapiens
gctggttttgctctc

SEQ ID NO: 388141 - DNA, 15 bp, Homo sapiens
ctggttttgctctct

SEQ ID NO: 388142 - DNA, 15 bp, Homo sapiens
tggttttgctctcta

SEQ ID NO: 388143 - DNA, 15 bp, Homo sapiens
ggttttgctctctaa

SEQ ID NO: 388144 - DNA, 15 bp, Homo sapiens
gttttgctctctaat

SEQ ID NO: 388145 - DNA, 15 bp, Homo sapiens
ttttgctctctaata

SEQ ID NO: 388146 - DNA, 15 bp, Homo sapiens
tttgctctctaataa

SEQ ID NO: 388147 - DNA, 15 bp, Homo sapiens
ttgctctctaataat

SEQ ID NO: 388148 - DNA, 15 bp, Homo sapiens
tgctctctaataatt

SEQ ID NO: 388149 - DNA, 15 bp, Homo sapiens
gctctctaataattt

SEQ ID NO: 388150 - DNA, 15 bp, Homo sapiens
ctctctaataattta

SEQ ID NO: 388151 - DNA, 15 bp, Homo sapiens
tctctaataatttac

SEQ ID NO: 388152 - DNA, 15 bp, Homo sapiens
ctctaataatttacg

SEQ ID NO: 388153 - DNA, 15 bp, Homo sapiens
tctaataatttacgt

SEQ ID NO: 388154 - DNA, 15 bp, Homo sapiens
ctaataatttacgtt

SEQ ID NO: 388155 - DNA, 15 bp, Homo sapiens
taataatttacgttt

SEQ ID NO: 388156 - DNA, 15 bp, Homo sapiens
aataatttacgtttt

SEQ ID NO: 388157 - DNA, 15 bp, Homo sapiens
ataatttacgtttta

SEQ ID NO: 388158 - DNA, 15 bp, Homo sapiens
taatttacgttttag

SEQ ID NO: 388159 - DNA, 15 bp, Homo sapiens
aatttacgttttagg

SEQ ID NO: 388160 - DNA, 15 bp, Homo sapiens
atttacgttttagga

SEQ ID NO: 388161 - DNA, 15 bp, Homo sapiens
tttacgttttaggat

SEQ ID NO: 388162 - DNA, 15 bp, Homo sapiens
ttacgttttaggatt

SEQ ID NO: 388163 - DNA, 15 bp, Homo sapiens
tacgttttaggatta

SEQ ID NO: 388164 - DNA, 15 bp, Homo sapiens
acgttttaggattat

SEQ ID NO: 388165 - DNA, 15 bp, Homo sapiens
cgttttaggattatt

SEQ ID NO: 388166 - DNA, 15 bp, Homo sapiens
gttttaggattatta

SEQ ID NO: 388167 - DNA, 15 bp, Homo sapiens
ttttaggattattac

SEQ ID NO: 388168 - DNA, 15 bp, Homo sapiens
tttaggattattaca

SEQ ID NO: 388169 - DNA, 15 bp, Homo sapiens
ttaggattattacac

SEQ ID NO: 388170 - DNA, 15 bp, Homo sapiens
taggattattacact

SEQ ID NO: 388171 - DNA, 15 bp, Homo sapiens
aggattattacactt

SEQ ID NO: 388172 - DNA, 15 bp, Homo sapiens
ggattattacacttt

SEQ ID NO: 388173 - DNA, 15 bp, Homo sapiens
gattattacactttt

SEQ ID NO: 388174 - DNA, 15 bp, Homo sapiens
attattacactttta

SEQ ID NO: 388175 - DNA, 15 bp, Homo sapiens
ttattacacttttat

SEQ ID NO: 388176 - DNA, 15 bp, Homo sapiens
tattacacttttatc

SEQ ID NO: 388177 - DNA, 15 bp, Homo sapiens
attacacttttatct

SEQ ID NO: 388178 - DNA, 15 bp, Homo sapiens
ttacacttttatctc

SEQ ID NO: 388179 - DNA, 15 bp, Homo sapiens
tacacttttatctcc

SEQ ID NO: 388180 - DNA, 15 bp, Homo sapiens
acacttttatctcct

SEQ ID NO: 388181 - DNA, 15 bp, Homo sapiens
cacttttatctccta

SEQ ID NO: 388182 - DNA, 15 bp, Homo sapiens
acttttatctcctat

SEQ ID NO: 388183 - DNA, 15 bp, Homo sapiens
cttttatctcctatg

SEQ ID NO: 388184 - DNA, 15 bp, Homo sapiens
ttttatctcctatgt

SEQ ID NO: 388185 - DNA, 15 bp, Homo sapiens
tttatctcctatgtt

SEQ ID NO: 388186 - DNA, 15 bp, Homo sapiens
ttatctcctatgttt

SEQ ID NO: 388187 - DNA, 15 bp, Homo sapiens
tatctcctatgtttg

SEQ ID NO: 388188 - DNA, 15 bp, Homo sapiens
atctcctatgtttgc

SEQ ID NO: 388189 - DNA, 15 bp, Homo sapiens
tctcctatgtttgct

SEQ ID NO: 388190 - DNA, 15 bp, Homo sapiens
ctcctatgtttgctt

SEQ ID NO: 388191 - DNA, 15 bp, Homo sapiens
tcctatgtttgcttt

SEQ ID NO: 388192 - DNA, 15 bp, Homo sapiens
cctatgtttgctttt

SEQ ID NO: 388193 - DNA, 15 bp, Homo sapiens
ctatgtttgctttta

SEQ ID NO: 388194 - DNA, 15 bp, Homo sapiens
tatgtttgcttttag

SEQ ID NO: 388195 - DNA, 15 bp, Homo sapiens
atgtttgcttttagc

SEQ ID NO: 388196 - DNA, 15 bp, Homo sapiens
tgtttgcttttagcc

SEQ ID NO: 388197 - DNA, 15 bp, Homo sapiens
gtttgcttttagcct

SEQ ID NO: 388198 - DNA, 15 bp, Homo sapiens
tttgcttttagcctc

SEQ ID NO: 388199 - DNA, 15 bp, Homo sapiens
ttgcttttagcctca

SEQ ID NO: 388200 - DNA, 15 bp, Homo sapiens
tgcttttagcctcat

SEQ ID NO: 388201 - DNA, 15 bp, Homo sapiens
gcttttagcctcatt

SEQ ID NO: 388202 - DNA, 15 bp, Homo sapiens
cttttagcctcattt

SEQ ID NO: 388203 - DNA, 15 bp, Homo sapiens
ttttagcctcatttt

SEQ ID NO: 388204 - DNA, 15 bp, Homo sapiens
tttagcctcattttc

SEQ ID NO: 388205 - DNA, 15 bp, Homo sapiens
ttagcctcattttca

SEQ ID NO: 388206 - DNA, 15 bp, Homo sapiens
tagcctcattttcat

SEQ ID NO: 388207 - DNA, 15 bp, Homo sapiens
agcctcattttcatc

SEQ ID NO: 388208 - DNA, 15 bp, Homo sapiens
gcctcattttcatcg

SEQ ID NO: 388209 - DNA, 15 bp, Homo sapiens
cctcattttcatcgt

SEQ ID NO: 388210 - DNA, 15 bp, Homo sapiens
ctcattttcatcgtc

SEQ ID NO: 388211 - DNA, 15 bp, Homo sapiens
tcattttcatcgtct

SEQ ID NO: 388212 - DNA, 15 bp, Homo sapiens
cattttcatcgtctt

SEQ ID NO: 388213 - DNA, 15 bp, Homo sapiens
attttcatcgtcttg

SEQ ID NO: 388214 - DNA, 15 bp, Homo sapiens
ttttcatcgtcttgt

SEQ ID NO: 388215 - DNA, 15 bp, Homo sapiens
tttcatcgtcttgtt

SEQ ID NO: 388216 - DNA, 15 bp, Homo sapiens
ttcatcgtcttgttc

SEQ ID NO: 388217 - DNA, 15 bp, Homo sapiens
tcatcgtcttgttcc

SEQ ID NO: 388218 - DNA, 15 bp, Homo sapiens
catcgtcttgttcca

SEQ ID NO: 388219 - DNA, 15 bp, Homo sapiens
atcgtcttgttccat

SEQ ID NO: 388220 - DNA, 15 bp, Homo sapiens
tcgtcttgttccata

SEQ ID NO: 388221 - DNA, 15 bp, Homo sapiens
cgtcttgttccatag

SEQ ID NO: 388222 - DNA, 15 bp, Homo sapiens
gtcttgttccataga

SEQ ID NO: 388223 - DNA, 15 bp, Homo sapiens
tcttgttccatagat

SEQ ID NO: 388224 - DNA, 15 bp, Homo sapiens
cttgttccatagatg

SEQ ID NO: 388225 - DNA, 15 bp, Homo sapiens
ttgttccatagatgc

SEQ ID NO: 388226 - DNA, 15 bp, Homo sapiens
tgttccatagatgca

SEQ ID NO: 388227 - DNA, 15 bp, Homo sapiens
gttccatagatgcag

SEQ ID NO: 388228 - DNA, 15 bp, Homo sapiens
ttccatagatgcaga

SEQ ID NO: 388229 - DNA, 15 bp, Homo sapiens
tccatagatgcagac

SEQ ID NO: 388230 - DNA, 15 bp, Homo sapiens
ccatagatgcagact

SEQ ID NO: 388231 - DNA, 15 bp, Homo sapiens
catagatgcagactt

SEQ ID NO: 388232 - DNA, 15 bp, Homo sapiens
atagatgcagacttt

SEQ ID NO: 388233 - DNA, 15 bp, Homo sapiens
tagatgcagactttg

SEQ ID NO: 388234 - DNA, 15 bp, Homo sapiens
agatgcagactttga

SEQ ID NO: 388235 - DNA, 15 bp, Homo sapiens
gatgcagactttgat

SEQ ID NO: 388236 - DNA, 15 bp, Homo sapiens
atgcagactttgatt

SEQ ID NO: 388237 - DNA, 15 bp, Homo sapiens
tgcagactttgatta

SEQ ID NO: 388238 - DNA, 15 bp, Homo sapiens
gcagactttgattat

SEQ ID NO: 388239 - DNA, 15 bp, Homo sapiens
cagactttgattata

SEQ ID NO: 388240 - DNA, 15 bp, Homo sapiens
agactttgattatag

SEQ ID NO: 388241 - DNA, 15 bp, Homo sapiens
gactttgattataga

SEQ ID NO: 388242 - DNA, 15 bp, Homo sapiens
actttgattatagat

SEQ ID NO: 388243 - DNA, 15 bp, Homo sapiens
ctttgattatagatt

SEQ ID NO: 388244 - DNA, 15 bp, Homo sapiens
tttgattatagattg

SEQ ID NO: 388245 - DNA, 15 bp, Homo sapiens
ttgattatagattgt

SEQ ID NO: 388246 - DNA, 15 bp, Homo sapiens
tgattatagattgtt

SEQ ID NO: 388247 - DNA, 15 bp, Homo sapiens
gattatagattgttt

SEQ ID NO: 388248 - DNA, 15 bp, Homo sapiens
attatagattgtttt

SEQ ID NO: 388249 - DNA, 15 bp, Homo sapiens
ttatagattgtttta

SEQ ID NO: 388250 - DNA, 15 bp, Homo sapiens
tatagattgttttag

SEQ ID NO: 388251 - DNA, 15 bp, Homo sapiens
atagattgttttaga

SEQ ID NO: 388252 - DNA, 15 bp, Homo sapiens
tagattgttttagat

SEQ ID NO: 388253 - DNA, 15 bp, Homo sapiens
agattgttttagatt

SEQ ID NO: 388254 - DNA, 15 bp, Homo sapiens
gattgttttagattt

SEQ ID NO: 388255 - DNA, 15 bp, Homo sapiens
attgttttagatttt

SEQ ID NO: 388256 - DNA, 15 bp, Homo sapiens
ttgttttagattttc

SEQ ID NO: 388257 - DNA, 15 bp, Homo sapiens
tgttttagattttct

SEQ ID NO: 388258 - DNA, 15 bp, Homo sapiens
gttttagattttctc

SEQ ID NO: 388259 - DNA, 15 bp, Homo sapiens
ttttagattttctcc

SEQ ID NO: 388260 - DNA, 15 bp, Homo sapiens
tttagattttctcct

SEQ ID NO: 388261 - DNA, 15 bp, Homo sapiens
ttagattttctcctg

SEQ ID NO: 388262 - DNA, 15 bp, Homo sapiens
tagattttctcctgt

SEQ ID NO: 388263 - DNA, 15 bp, Homo sapiens
agattttctcctgtg

SEQ ID NO: 388264 - DNA, 15 bp, Homo sapiens
gattttctcctgtgc

SEQ ID NO: 388265 - DNA, 15 bp, Homo sapiens
attttctcctgtgcc

SEQ ID NO: 388266 - DNA, 15 bp, Homo sapiens
ttttctcctgtgccc

SEQ ID NO: 388267 - DNA, 15 bp, Homo sapiens
tttctcctgtgccca

SEQ ID NO: 388268 - DNA, 15 bp, Homo sapiens
ttctcctgtgcccag

SEQ ID NO: 388269 - DNA, 15 bp, Homo sapiens
tctcctgtgcccagc

SEQ ID NO: 388270 - DNA, 15 bp, Homo sapiens
ctcctgtgcccagct

SEQ ID NO: 388271 - DNA, 15 bp, Homo sapiens
tcctgtgcccagctg

SEQ ID NO: 388272 - DNA, 15 bp, Homo sapiens
cctgtgcccagctgc

SEQ ID NO: 388273 - DNA, 15 bp, Homo sapiens
ctgtgcccagctgca

SEQ ID NO: 388274 - DNA, 15 bp, Homo sapiens
tgtgcccagctgcat

SEQ ID NO: 388275 - DNA, 15 bp, Homo sapiens
gtgcccagctgcatg

SEQ ID NO: 388276 - DNA, 15 bp, Homo sapiens
tgcccagctgcatgc

SEQ ID NO: 388277 - DNA, 15 bp, Homo sapiens
gcccagctgcatgct

SEQ ID NO: 388278 - DNA, 15 bp, Homo sapiens
cccagctgcatgctt

SEQ ID NO: 388279 - DNA, 15 bp, Homo sapiens
ccagctgcatgctta

SEQ ID NO: 388280 - DNA, 15 bp, Homo sapiens
cagctgcatgcttag

SEQ ID NO: 388281 - DNA, 15 bp, Homo sapiens
agctgcatgcttagc

SEQ ID NO: 388282 - DNA, 15 bp, Homo sapiens
gctgcatgcttagca

SEQ ID NO: 388283 - DNA, 15 bp, Homo sapiens
ctgcatgcttagcac

SEQ ID NO: 388284 - DNA, 15 bp, Homo sapiens
tgcatgcttagcact

SEQ ID NO: 388285 - DNA, 15 bp, Homo sapiens
gcatgcttagcactg

SEQ ID NO: 388286 - DNA, 15 bp, Homo sapiens
catgcttagcactgt

SEQ ID NO: 388287 - DNA, 15 bp, Homo sapiens
atgcttagcactgtg

SEQ ID NO: 388288 - DNA, 15 bp, Homo sapiens
tgcttagcactgtgt

SEQ ID NO: 388289 - DNA, 15 bp, Homo sapiens
gcttagcactgtgtt

SEQ ID NO: 388290 - DNA, 15 bp, Homo sapiens
cttagcactgtgttt

SEQ ID NO: 388291 - DNA, 15 bp, Homo sapiens
ttagcactgtgtttg

SEQ ID NO: 388292 - DNA, 15 bp, Homo sapiens
tagcactgtgtttga

SEQ ID NO: 388293 - DNA, 15 bp, Homo sapiens
agcactgtgtttgag

SEQ ID NO: 388294 - DNA, 15 bp, Homo sapiens
gcactgtgtttgagg

SEQ ID NO: 388295 - DNA, 15 bp, Homo sapiens
cactgtgtttgaggg

SEQ ID NO: 388296 - DNA, 15 bp, Homo sapiens
actgtgtttgagggg

SEQ ID NO: 388297 - DNA, 15 bp, Homo sapiens
ctgtgtttgaggggt

SEQ ID NO: 388298 - DNA, 15 bp, Homo sapiens
tgtgtttgaggggtg

SEQ ID NO: 388299 - DNA, 15 bp, Homo sapiens
gtgtttgaggggtga

SEQ ID NO: 388300 - DNA, 15 bp, Homo sapiens
tgtttgaggggtgaa

SEQ ID NO: 388301 - DNA, 15 bp, Homo sapiens
gtttgaggggtgaat

SEQ ID NO: 388302 - DNA, 15 bp, Homo sapiens
tttgaggggtgaatg

SEQ ID NO: 388303 - DNA, 15 bp, Homo sapiens
ttgaggggtgaatgc

SEQ ID NO: 388304 - DNA, 15 bp, Homo sapiens
tgaggggtgaatgcc

SEQ ID NO: 388305 - DNA, 15 bp, Homo sapiens
gaggggtgaatgcct

SEQ ID NO: 388306 - DNA, 15 bp, Homo sapiens
aggggtgaatgccta

SEQ ID NO: 388307 - DNA, 15 bp, Homo sapiens
ggggtgaatgcctat

SEQ ID NO: 388308 - DNA, 15 bp, Homo sapiens
gggtgaatgcctatc

SEQ ID NO: 388309 - DNA, 15 bp, Homo sapiens
ggtgaatgcctatct

SEQ ID NO: 388310 - DNA, 15 bp, Homo sapiens
gtgaatgcctatctc

SEQ ID NO: 388311 - DNA, 15 bp, Homo sapiens
tgaatgcctatctca

SEQ ID NO: 388312 - DNA, 15 bp, Homo sapiens
gaatgcctatctcat

SEQ ID NO: 388313 - DNA, 15 bp, Homo sapiens
aatgcctatctcatg

SEQ ID NO: 388314 - DNA, 15 bp, Homo sapiens
atgcctatctcatgg

SEQ ID NO: 388315 - DNA, 15 bp, Homo sapiens
tgcctatctcatggg

SEQ ID NO: 388316 - DNA, 15 bp, Homo sapiens
gcctatctcatgggg

SEQ ID NO: 388317 - DNA, 15 bp, Homo sapiens
cctatctcatgggga

SEQ ID NO: 388318 - DNA, 15 bp, Homo sapiens
ctatctcatggggac

SEQ ID NO: 388319 - DNA, 15 bp, Homo sapiens
tatctcatggggact

SEQ ID NO: 388320 - DNA, 15 bp, Homo sapiens
atctcatggggactt

SEQ ID NO: 388321 - DNA, 15 bp, Homo sapiens
tctcatggggacttc

SEQ ID NO: 388322 - DNA, 15 bp, Homo sapiens
ctcatggggacttca

SEQ ID NO: 388323 - DNA, 15 bp, Homo sapiens
tcatggggacttcat

SEQ ID NO: 388324 - DNA, 15 bp, Homo sapiens
catggggacttcatc

SEQ ID NO: 388325 - DNA, 15 bp, Homo sapiens
atggggacttcatct

SEQ ID NO: 388326 - DNA, 15 bp, Homo sapiens
tggggacttcatctg

SEQ ID NO: 388327 - DNA, 15 bp, Homo sapiens
ggggacttcatctgc

SEQ ID NO: 388328 - DNA, 15 bp, Homo sapiens
gggacttcatctgct

SEQ ID NO: 388329 - DNA, 15 bp, Homo sapiens
ggacttcatctgctg

SEQ ID NO: 388330 - DNA, 15 bp, Homo sapiens
gacttcatctgctgg

SEQ ID NO: 388331 - DNA, 15 bp, Homo sapiens
acttcatctgctggt

SEQ ID NO: 388332 - DNA, 15 bp, Homo sapiens
cttcatctgctggtt

SEQ ID NO: 388333 - DNA, 15 bp, Homo sapiens
ttcatctgctggttc

SEQ ID NO: 388334 - DNA, 15 bp, Homo sapiens
tcatctgctggttct

SEQ ID NO: 388335 - DNA, 15 bp, Homo sapiens
catctgctggttcta

SEQ ID NO: 388336 - DNA, 15 bp, Homo sapiens
atctgctggttctag

SEQ ID NO: 388337 - DNA, 15 bp, Homo sapiens
tctgctggttctagg

SEQ ID NO: 388338 - DNA, 15 bp, Homo sapiens
ctgctggttctagga

SEQ ID NO: 388339 - DNA, 15 bp, Homo sapiens
tgctggttctaggac

SEQ ID NO: 388340 - DNA, 15 bp, Homo sapiens
gctggttctaggaca

SEQ ID NO: 388341 - DNA, 15 bp, Homo sapiens
ctggttctaggacag

SEQ ID NO: 388342 - DNA, 15 bp, Homo sapiens
tggttctaggacagg

SEQ ID NO: 388343 - DNA, 15 bp, Homo sapiens
ggttctaggacagga

SEQ ID NO: 388344 - DNA, 15 bp, Homo sapiens
gttctaggacaggaa

SEQ ID NO: 388345 - DNA, 15 bp, Homo sapiens
ttctaggacaggaat

SEQ ID NO: 388346 - DNA, 15 bp, Homo sapiens
tctaggacaggaatt

SEQ ID NO: 388347 - DNA, 15 bp, Homo sapiens
ctaggacaggaatta

SEQ ID NO: 388348 - DNA, 15 bp, Homo sapiens
taggacaggaattat

SEQ ID NO: 388349 - DNA, 15 bp, Homo sapiens
aggacaggaattata

SEQ ID NO: 388350 - DNA, 15 bp, Homo sapiens
ggacaggaattatag

SEQ ID NO: 388351 - DNA, 15 bp, Homo sapiens
gacaggaattatagc

SEQ ID NO: 388352 - DNA, 15 bp, Homo sapiens
acaggaattatagct

SEQ ID NO: 388353 - DNA, 15 bp, Homo sapiens
caggaattatagctt

SEQ ID NO: 388354 - DNA, 15 bp, Homo sapiens
aggaattatagcttc

SEQ ID NO: 388355 - DNA, 15 bp, Homo sapiens
ggaattatagcttca

SEQ ID NO: 388356 - DNA, 15 bp, Homo sapiens
gaattatagcttcat

SEQ ID NO: 388357 - DNA, 15 bp, Homo sapiens
aattatagcttcata

SEQ ID NO: 388358 - DNA, 15 bp, Homo sapiens
attatagcttcatac

SEQ ID NO: 388359 - DNA, 15 bp, Homo sapiens
ttatagcttcatact

SEQ ID NO: 388360 - DNA, 15 bp, Homo sapiens
tatagcttcatactt

SEQ ID NO: 388361 - DNA, 15 bp, Homo sapiens
atagcttcatactta

SEQ ID NO: 388362 - DNA, 15 bp, Homo sapiens
tagcttcatacttat

SEQ ID NO: 388363 - DNA, 15 bp, Homo sapiens
agcttcatacttatt

SEQ ID NO: 388364 - DNA, 15 bp, Homo sapiens
gcttcatacttattt

SEQ ID NO: 388365 - DNA, 15 bp, Homo sapiens
cttcatacttattta

SEQ ID NO: 388366 - DNA, 15 bp, Homo sapiens
ttcatacttatttaa

SEQ ID NO: 388367 - DNA, 15 bp, Homo sapiens
tcatacttatttaat

SEQ ID NO: 388368 - DNA, 15 bp, Homo sapiens
catacttatttaata

SEQ ID NO: 388369 - DNA, 15 bp, Homo sapiens
atacttatttaataa

SEQ ID NO: 388370 - DNA, 15 bp, Homo sapiens
tacttatttaataac

SEQ ID NO: 388371 - DNA, 15 bp, Homo sapiens
acttatttaataaca

SEQ ID NO: 388372 - DNA, 15 bp, Homo sapiens
cttatttaataacaa

SEQ ID NO: 388373 - DNA, 15 bp, Homo sapiens
ttatttaataacaac

SEQ ID NO: 388374 - DNA, 15 bp, Homo sapiens
tatttaataacaact

SEQ ID NO: 388375 - DNA, 15 bp, Homo sapiens
atttaataacaactt

SEQ ID NO: 388376 - DNA, 15 bp, Homo sapiens
tttaataacaacttt

SEQ ID NO: 388377 - DNA, 15 bp, Homo sapiens
ttaataacaactttc

SEQ ID NO: 388378 - DNA, 15 bp, Homo sapiens
taataacaactttct

SEQ ID NO: 388379 - DNA, 15 bp, Homo sapiens
aataacaactttctt

SEQ ID NO: 388380 - DNA, 15 bp, Homo sapiens
ataacaactttcttg

SEQ ID NO: 388381 - DNA, 15 bp, Homo sapiens
taacaactttcttgg

SEQ ID NO: 388382 - DNA, 15 bp, Homo sapiens
aacaactttcttggc

SEQ ID NO: 388383 - DNA, 15 bp, Homo sapiens
acaactttcttggca

SEQ ID NO: 388384 - DNA, 15 bp, Homo sapiens
caactttcttggcat

SEQ ID NO: 388385 - DNA, 15 bp, Homo sapiens
aactttcttggcata

SEQ ID NO: 388386 - DNA, 15 bp, Homo sapiens
actttcttggcatat

SEQ ID NO: 388387 - DNA, 15 bp, Homo sapiens
ctttcttggcatata

SEQ ID NO: 388388 - DNA, 15 bp, Homo sapiens
tttcttggcatataa

SEQ ID NO: 388389 - DNA, 15 bp, Homo sapiens
ttcttggcatataat

SEQ ID NO: 388390 - DNA, 15 bp, Homo sapiens
tcttggcatataatt

SEQ ID NO: 388391 - DNA, 15 bp, Homo sapiens
cttggcatataattc

SEQ ID NO: 388392 - DNA, 15 bp, Homo sapiens
ttggcatataattca

SEQ ID NO: 388393 - DNA, 15 bp, Homo sapiens
tggcatataattcac

SEQ ID NO: 388394 - DNA, 15 bp, Homo sapiens
ggcatataattcaca

SEQ ID NO: 388395 - DNA, 15 bp, Homo sapiens
gcatataattcacat

SEQ ID NO: 388396 - DNA, 15 bp, Homo sapiens
catataattcacata

SEQ ID NO: 388397 - DNA, 15 bp, Homo sapiens
atataattcacatac

SEQ ID NO: 388398 - DNA, 15 bp, Homo sapiens
tataattcacatact

SEQ ID NO: 388399 - DNA, 15 bp, Homo sapiens
ataattcacatactg

SEQ ID NO: 388400 - DNA, 15 bp, Homo sapiens
taattcacatactgt

SEQ ID NO: 388401 - DNA, 15 bp, Homo sapiens
aattcacatactgta

SEQ ID NO: 388402 - DNA, 15 bp, Homo sapiens
attcacatactgtac

SEQ ID NO: 388403 - DNA, 15 bp, Homo sapiens
ttcacatactgtaca

SEQ ID NO: 388404 - DNA, 15 bp, Homo sapiens
tcacatactgtacag

SEQ ID NO: 388405 - DNA, 15 bp, Homo sapiens
cacatactgtacagt

SEQ ID NO: 388406 - DNA, 15 bp, Homo sapiens
acatactgtacagtt

SEQ ID NO: 388407 - DNA, 15 bp, Homo sapiens
catactgtacagttc

SEQ ID NO: 388408 - DNA, 15 bp, Homo sapiens
atactgtacagttca

SEQ ID NO: 388409 - DNA, 15 bp, Homo sapiens
tactgtacagttcat

SEQ ID NO: 388410 - DNA, 15 bp, Homo sapiens
actgtacagttcatt

SEQ ID NO: 388411 - DNA, 15 bp, Homo sapiens
ctgtacagttcattc

SEQ ID NO: 388412 - DNA, 15 bp, Homo sapiens
tgtacagttcattca

SEQ ID NO: 388413 - DNA, 15 bp, Homo sapiens
gtacagttcattcat

SEQ ID NO: 388414 - DNA, 15 bp, Homo sapiens
tacagttcattcatt

SEQ ID NO: 388415 - DNA, 15 bp, Homo sapiens
acagttcattcattt

SEQ ID NO: 388416 - DNA, 15 bp, Homo sapiens
cagttcattcattta

SEQ ID NO: 388417 - DNA, 15 bp, Homo sapiens
agttcattcatttaa

SEQ ID NO: 388418 - DNA, 15 bp, Homo sapiens
gttcattcatttaaa

SEQ ID NO: 388419 - DNA, 15 bp, Homo sapiens
ttcattcatttaaat

SEQ ID NO: 388420 - DNA, 15 bp, Homo sapiens
tcattcatttaaatt

SEQ ID NO: 388421 - DNA, 15 bp, Homo sapiens
cattcatttaaattt

SEQ ID NO: 388422 - DNA, 15 bp, Homo sapiens
attcatttaaatttt

SEQ ID NO: 388423 - DNA, 15 bp, Homo sapiens
ttcatttaaatttta

SEQ ID NO: 388424 - DNA, 15 bp, Homo sapiens
tcatttaaattttac

SEQ ID NO: 388425 - DNA, 15 bp, Homo sapiens
catttaaattttaca

SEQ ID NO: 388426 - DNA, 15 bp, Homo sapiens
atttaaattttacaa

SEQ ID NO: 388427 - DNA, 15 bp, Homo sapiens
tttaaattttacaat

SEQ ID NO: 388428 - DNA, 15 bp, Homo sapiens
ttaaattttacaatt

SEQ ID NO: 388429 - DNA, 15 bp, Homo sapiens
taaattttacaattc

SEQ ID NO: 388430 - DNA, 15 bp, Homo sapiens
aaattttacaattca

SEQ ID NO: 388431 - DNA, 15 bp, Homo sapiens
aattttacaattcat

SEQ ID NO: 388432 - DNA, 15 bp, Homo sapiens
attttacaattcatt

SEQ ID NO: 388433 - DNA, 15 bp, Homo sapiens
ttttacaattcattt

SEQ ID NO: 388434 - DNA, 15 bp, Homo sapiens
tttacaattcatttg

SEQ ID NO: 388435 - DNA, 15 bp, Homo sapiens
ttacaattcatttgt

SEQ ID NO: 388436 - DNA, 15 bp, Homo sapiens
tacaattcatttgtt

SEQ ID NO: 388437 - DNA, 15 bp, Homo sapiens
acaattcatttgttt

SEQ ID NO: 388438 - DNA, 15 bp, Homo sapiens
caattcatttgtttc

SEQ ID NO: 388439 - DNA, 15 bp, Homo sapiens
aattcatttgtttct

SEQ ID NO: 388440 - DNA, 15 bp, Homo sapiens
attcatttgtttcta

SEQ ID NO: 388441 - DNA, 15 bp, Homo sapiens
ttcatttgtttctag

SEQ ID NO: 388442 - DNA, 15 bp, Homo sapiens
tcatttgtttctagt

SEQ ID NO: 388443 - DNA, 15 bp, Homo sapiens
catttgtttctagtc

SEQ ID NO: 388444 - DNA, 15 bp, Homo sapiens
atttgtttctagtct

SEQ ID NO: 388445 - DNA, 15 bp, Homo sapiens
tttgtttctagtcta

SEQ ID NO: 388446 - DNA, 15 bp, Homo sapiens
ttgtttctagtctat

SEQ ID NO: 388447 - DNA, 15 bp, Homo sapiens
tgtttctagtctatt

SEQ ID NO: 388448 - DNA, 15 bp, Homo sapiens
gtttctagtctattc

SEQ ID NO: 388449 - DNA, 15 bp, Homo sapiens
tttctagtctattca

SEQ ID NO: 388450 - DNA, 15 bp, Homo sapiens
ttctagtctattcac

SEQ ID NO: 388451 - DNA, 15 bp, Homo sapiens
tctagtctattcacg

SEQ ID NO: 388452 - DNA, 15 bp, Homo sapiens
ctagtctattcacga

SEQ ID NO: 388453 - DNA, 15 bp, Homo sapiens
tagtctattcacgat

SEQ ID NO: 388454 - DNA, 15 bp, Homo sapiens
agtctattcacgatt

SEQ ID NO: 388455 - DNA, 15 bp, Homo sapiens
gtctattcacgattg

SEQ ID NO: 388456 - DNA, 15 bp, Homo sapiens
tctattcacgattgt

SEQ ID NO: 388457 - DNA, 15 bp, Homo sapiens
ctattcacgattgta

SEQ ID NO: 388458 - DNA, 15 bp, Homo sapiens
tattcacgattgtac

SEQ ID NO: 388459 - DNA, 15 bp, Homo sapiens
attcacgattgtacg

SEQ ID NO: 388460 - DNA, 15 bp, Homo sapiens
ttcacgattgtacga

SEQ ID NO: 388461 - DNA, 15 bp, Homo sapiens
tcacgattgtacgac

SEQ ID NO: 388462 - DNA, 15 bp, Homo sapiens
cacgattgtacgacc

SEQ ID NO: 388463 - DNA, 15 bp, Homo sapiens
acgattgtacgacca

SEQ ID NO: 388464 - DNA, 15 bp, Homo sapiens
cgattgtacgaccat

SEQ ID NO: 388465 - DNA, 15 bp, Homo sapiens
gattgtacgaccatc

SEQ ID NO: 388466 - DNA, 15 bp, Homo sapiens
attgtacgaccatca

SEQ ID NO: 388467 - DNA, 15 bp, Homo sapiens
ttgtacgaccatcac

SEQ ID NO: 388468 - DNA, 15 bp, Homo sapiens
tgtacgaccatcacc

SEQ ID NO: 388469 - DNA, 15 bp, Homo sapiens
gtacgaccatcacca

SEQ ID NO: 388470 - DNA, 15 bp, Homo sapiens
tacgaccatcaccac

SEQ ID NO: 388471 - DNA, 15 bp, Homo sapiens
acgaccatcaccaca

SEQ ID NO: 388472 - DNA, 15 bp, Homo sapiens
cgaccatcaccacaa

SEQ ID NO: 388473 - DNA, 15 bp, Homo sapiens
gaccatcaccacaat

SEQ ID NO: 388474 - DNA, 15 bp, Homo sapiens
accatcaccacaatc

SEQ ID NO: 388475 - DNA, 15 bp, Homo sapiens
ccatcaccacaatca

SEQ ID NO: 388476 - DNA, 15 bp, Homo sapiens
catcaccacaatcaa

SEQ ID NO: 388477 - DNA, 15 bp, Homo sapiens
atcaccacaatcaag

SEQ ID NO: 388478 - DNA, 15 bp, Homo sapiens
tcaccacaatcaagt

SEQ ID NO: 388479 - DNA, 15 bp, Homo sapiens
caccacaatcaagtt

SEQ ID NO: 388480 - DNA, 15 bp, Homo sapiens
accacaatcaagtta

SEQ ID NO: 388481 - DNA, 15 bp, Homo sapiens
ccacaatcaagttag

SEQ ID NO: 388482 - DNA, 15 bp, Homo sapiens
cacaatcaagttaga

SEQ ID NO: 388483 - DNA, 15 bp, Homo sapiens
acaatcaagttagaa

SEQ ID NO: 388484 - DNA, 15 bp, Homo sapiens
caatcaagttagaac

SEQ ID NO: 388485 - DNA, 15 bp, Homo sapiens
aatcaagttagaaca

SEQ ID NO: 388486 - DNA, 15 bp, Homo sapiens
atcaagttagaacat

SEQ ID NO: 388487 - DNA, 15 bp, Homo sapiens
tcaagttagaacatt

SEQ ID NO: 388488 - DNA, 15 bp, Homo sapiens
caagttagaacattt

SEQ ID NO: 388489 - DNA, 15 bp, Homo sapiens
aagttagaacatttt

SEQ ID NO: 388490 - DNA, 15 bp, Homo sapiens
agttagaacattttc

SEQ ID NO: 388491 - DNA, 15 bp, Homo sapiens
gttagaacattttca

SEQ ID NO: 388492 - DNA, 15 bp, Homo sapiens
ttagaacattttcat

SEQ ID NO: 388493 - DNA, 15 bp, Homo sapiens
tagaacattttcatt

SEQ ID NO: 388494 - DNA, 15 bp, Homo sapiens
agaacattttcatta

SEQ ID NO: 388495 - DNA, 15 bp, Homo sapiens
gaacattttcattac

SEQ ID NO: 388496 - DNA, 15 bp, Homo sapiens
aacattttcattacc

SEQ ID NO: 388497 - DNA, 15 bp, Homo sapiens
acattttcattacct

SEQ ID NO: 388498 - DNA, 15 bp, Homo sapiens
cattttcattacctc

SEQ ID NO: 388499 - DNA, 15 bp, Homo sapiens
attttcattacctca

SEQ ID NO: 388500 - DNA, 15 bp, Homo sapiens
ttttcattacctcag

SEQ ID NO: 388501 - DNA, 15 bp, Homo sapiens
tttcattacctcaga

SEQ ID NO: 388502 - DNA, 15 bp, Homo sapiens
ttcattacctcagaa

SEQ ID NO: 388503 - DNA, 15 bp, Homo sapiens
tcattacctcagaaa

SEQ ID NO: 388504 - DNA, 15 bp, Homo sapiens
cattacctcagaaag

SEQ ID NO: 388505 - DNA, 15 bp, Homo sapiens
attacctcagaaaga

SEQ ID NO: 388506 - DNA, 15 bp, Homo sapiens
ttacctcagaaagaa

SEQ ID NO: 388507 - DNA, 15 bp, Homo sapiens
tacctcagaaagaaa

SEQ ID NO: 388508 - DNA, 15 bp, Homo sapiens
acctcagaaagaaac

SEQ ID NO: 388509 - DNA, 15 bp, Homo sapiens
cctcagaaagaaacc

SEQ ID NO: 388510 - DNA, 15 bp, Homo sapiens
ctcagaaagaaaccc

SEQ ID NO: 388511 - DNA, 15 bp, Homo sapiens
tcagaaagaaacccc

SEQ ID NO: 388512 - DNA, 15 bp, Homo sapiens
cagaaagaaacccct

SEQ ID NO: 388513 - DNA, 15 bp, Homo sapiens
agaaagaaacccctt

SEQ ID NO: 388514 - DNA, 15 bp, Homo sapiens
gaaagaaaccccttc

SEQ ID NO: 388515 - DNA, 15 bp, Homo sapiens
aaagaaaccccttcc

SEQ ID NO: 388516 - DNA, 15 bp, Homo sapiens
aagaaaccccttccc

SEQ ID NO: 388517 - DNA, 15 bp, Homo sapiens
agaaaccccttccct

SEQ ID NO: 388518 - DNA, 15 bp, Homo sapiens
gaaaccccttccctt

SEQ ID NO: 388519 - DNA, 15 bp, Homo sapiens
aaaccccttcccttt

SEQ ID NO: 388520 - DNA, 15 bp, Homo sapiens
aaccccttcccttta

SEQ ID NO: 388521 - DNA, 15 bp, Homo sapiens
accccttccctttac

SEQ ID NO: 388522 - DNA, 15 bp, Homo sapiens
ccccttccctttact

SEQ ID NO: 388523 - DNA, 15 bp, Homo sapiens
cccttccctttacta

SEQ ID NO: 388524 - DNA, 15 bp, Homo sapiens
ccttccctttactag

SEQ ID NO: 388525 - DNA, 15 bp, Homo sapiens
cttccctttactagc

SEQ ID NO: 388526 - DNA, 15 bp, Homo sapiens
ttccctttactagca

SEQ ID NO: 388527 - DNA, 15 bp, Homo sapiens
tccctttactagcaa

SEQ ID NO: 388528 - DNA, 15 bp, Homo sapiens
ccctttactagcaat

SEQ ID NO: 388529 - DNA, 15 bp, Homo sapiens
cctttactagcaatt

SEQ ID NO: 388530 - DNA, 15 bp, Homo sapiens
ctttactagcaattt

SEQ ID NO: 388531 - DNA, 15 bp, Homo sapiens
tttactagcaatttc

SEQ ID NO: 388532 - DNA, 15 bp, Homo sapiens
ttactagcaatttcc

SEQ ID NO: 388533 - DNA, 15 bp, Homo sapiens
tactagcaatttccc

SEQ ID NO: 388534 - DNA, 15 bp, Homo sapiens
actagcaatttccca

SEQ ID NO: 388535 - DNA, 15 bp, Homo sapiens
ctagcaatttcccat

SEQ ID NO: 388536 - DNA, 15 bp, Homo sapiens
tagcaatttcccatt

SEQ ID NO: 388537 - DNA, 15 bp, Homo sapiens
agcaatttcccattc

SEQ ID NO: 388538 - DNA, 15 bp, Homo sapiens
gcaatttcccattcc

SEQ ID NO: 388539 - DNA, 15 bp, Homo sapiens
caatttcccattcct

SEQ ID NO: 388540 - DNA, 15 bp, Homo sapiens
aatttcccattcctc

SEQ ID NO: 388541 - DNA, 15 bp, Homo sapiens
atttcccattcctcc

SEQ ID NO: 388542 - DNA, 15 bp, Homo sapiens
tttcccattcctccc

SEQ ID NO: 388543 - DNA, 15 bp, Homo sapiens
ttcccattcctcccc

SEQ ID NO: 388544 - DNA, 15 bp, Homo sapiens
tcccattcctccccg

SEQ ID NO: 388545 - DNA, 15 bp, Homo sapiens
cccattcctccccgc

SEQ ID NO: 388546 - DNA, 15 bp, Homo sapiens
ccattcctccccgcc

SEQ ID NO: 388547 - DNA, 15 bp, Homo sapiens
cattcctccccgcca

SEQ ID NO: 388548 - DNA, 15 bp, Homo sapiens
attcctccccgccaa

SEQ ID NO: 388549 - DNA, 15 bp, Homo sapiens
ttcctccccgccaat

SEQ ID NO: 388550 - DNA, 15 bp, Homo sapiens
tcctccccgccaatt

SEQ ID NO: 388551 - DNA, 15 bp, Homo sapiens
cctccccgccaattc

SEQ ID NO: 388552 - DNA, 15 bp, Homo sapiens
ctccccgccaattcc

SEQ ID NO: 388553 - DNA, 15 bp, Homo sapiens
tccccgccaattccc

SEQ ID NO: 388554 - DNA, 15 bp, Homo sapiens
ccccgccaattccct

SEQ ID NO: 388555 - DNA, 15 bp, Homo sapiens
cccgccaattccctc

SEQ ID NO: 388556 - DNA, 15 bp, Homo sapiens
ccgccaattccctcc

SEQ ID NO: 388557 - DNA, 15 bp, Homo sapiens
cgccaattccctccc

SEQ ID NO: 388558 - DNA, 15 bp, Homo sapiens
gccaattccctcccc

SEQ ID NO: 388559 - DNA, 15 bp, Homo sapiens
ccaattccctcccct

SEQ ID NO: 388560 - DNA, 15 bp, Homo sapiens
caattccctcccctc

SEQ ID NO: 388561 - DNA, 15 bp, Homo sapiens
aattccctcccctct

SEQ ID NO: 388562 - DNA, 15 bp, Homo sapiens
attccctcccctctg

SEQ ID NO: 388563 - DNA, 15 bp, Homo sapiens
ttccctcccctctga

SEQ ID NO: 388564 - DNA, 15 bp, Homo sapiens
tccctcccctctgaa

SEQ ID NO: 388565 - DNA, 15 bp, Homo sapiens
ccctcccctctgaac

SEQ ID NO: 388566 - DNA, 15 bp, Homo sapiens
cctcccctctgaaca

SEQ ID NO: 388567 - DNA, 15 bp, Homo sapiens
ctcccctctgaacaa

SEQ ID NO: 388568 - DNA, 15 bp, Homo sapiens
tcccctctgaacaat

SEQ ID NO: 388569 - DNA, 15 bp, Homo sapiens
cccctctgaacaatc

SEQ ID NO: 388570 - DNA, 15 bp, Homo sapiens
ccctctgaacaatca

SEQ ID NO: 388571 - DNA, 15 bp, Homo sapiens
cctctgaacaatcac

SEQ ID NO: 388572 - DNA, 15 bp, Homo sapiens
ctctgaacaatcact

SEQ ID NO: 388573 - DNA, 15 bp, Homo sapiens
tctgaacaatcacta

SEQ ID NO: 388574 - DNA, 15 bp, Homo sapiens
ctgaacaatcactaa

SEQ ID NO: 388575 - DNA, 15 bp, Homo sapiens
tgaacaatcactaat

SEQ ID NO: 388576 - DNA, 15 bp, Homo sapiens
gaacaatcactaatc

SEQ ID NO: 388577 - DNA, 15 bp, Homo sapiens
aacaatcactaatct

SEQ ID NO: 388578 - DNA, 15 bp, Homo sapiens
acaatcactaatcta

SEQ ID NO: 388579 - DNA, 15 bp, Homo sapiens
caatcactaatctat

SEQ ID NO: 388580 - DNA, 15 bp, Homo sapiens
aatcactaatctatt

SEQ ID NO: 388581 - DNA, 15 bp, Homo sapiens
atcactaatctattt

SEQ ID NO: 388582 - DNA, 15 bp, Homo sapiens
tcactaatctatttc

SEQ ID NO: 388583 - DNA, 15 bp, Homo sapiens
cactaatctatttct

SEQ ID NO: 388584 - DNA, 15 bp, Homo sapiens
actaatctatttcta

SEQ ID NO: 388585 - DNA, 15 bp, Homo sapiens
ctaatctatttctat

SEQ ID NO: 388586 - DNA, 15 bp, Homo sapiens
taatctatttctatc

SEQ ID NO: 388587 - DNA, 15 bp, Homo sapiens
aatctatttctatct

SEQ ID NO: 388588 - DNA, 15 bp, Homo sapiens
atctatttctatcta

SEQ ID NO: 388589 - DNA, 15 bp, Homo sapiens
tctatttctatctat

SEQ ID NO: 388590 - DNA, 15 bp, Homo sapiens
ctatttctatctatt

SEQ ID NO: 388591 - DNA, 15 bp, Homo sapiens
tatttctatctattt

SEQ ID NO: 388592 - DNA, 15 bp, Homo sapiens
atttctatctatttg

SEQ ID NO: 388593 - DNA, 15 bp, Homo sapiens
tttctatctatttgc

SEQ ID NO: 388594 - DNA, 15 bp, Homo sapiens
ttctatctatttgcc

SEQ ID NO: 388595 - DNA, 15 bp, Homo sapiens
tctatctatttgcca

SEQ ID NO: 388596 - DNA, 15 bp, Homo sapiens
ctatctatttgccaa

SEQ ID NO: 388597 - DNA, 15 bp, Homo sapiens
tatctatttgccaaa

SEQ ID NO: 388598 - DNA, 15 bp, Homo sapiens
atctatttgccaaat

SEQ ID NO: 388599 - DNA, 15 bp, Homo sapiens
tctatttgccaaata

SEQ ID NO: 388600 - DNA, 15 bp, Homo sapiens
ctatttgccaaatac

SEQ ID NO: 388601 - DNA, 15 bp, Homo sapiens
tatttgccaaatacc

SEQ ID NO: 388602 - DNA, 15 bp, Homo sapiens
atttgccaaatacct

SEQ ID NO: 388603 - DNA, 15 bp, Homo sapiens
tttgccaaatacctt

SEQ ID NO: 388604 - DNA, 15 bp, Homo sapiens
ttgccaaatacctta

SEQ ID NO: 388605 - DNA, 15 bp, Homo sapiens
tgccaaataccttaa

SEQ ID NO: 388606 - DNA, 15 bp, Homo sapiens
gccaaataccttaac

SEQ ID NO: 388607 - DNA, 15 bp, Homo sapiens
ccaaataccttaaca

SEQ ID NO: 388608 - DNA, 15 bp, Homo sapiens
caaataccttaacat

SEQ ID NO: 388609 - DNA, 15 bp, Homo sapiens
aaataccttaacatt

SEQ ID NO: 388610 - DNA, 15 bp, Homo sapiens
aataccttaacattt

SEQ ID NO: 388611 - DNA, 15 bp, Homo sapiens
ataccttaacatttt

SEQ ID NO: 388612 - DNA, 15 bp, Homo sapiens
taccttaacatttta

SEQ ID NO: 388613 - DNA, 15 bp, Homo sapiens
accttaacattttat

SEQ ID NO: 388614 - DNA, 15 bp, Homo sapiens
ccttaacattttata

SEQ ID NO: 388615 - DNA, 15 bp, Homo sapiens
cttaacattttatac

SEQ ID NO: 388616 - DNA, 15 bp, Homo sapiens
ttaacattttatact

SEQ ID NO: 388617 - DNA, 15 bp, Homo sapiens
taacattttatactc

SEQ ID NO: 388618 - DNA, 15 bp, Homo sapiens
aacattttatactct

SEQ ID NO: 388619 - DNA, 15 bp, Homo sapiens
acattttatactcta

SEQ ID NO: 388620 - DNA, 15 bp, Homo sapiens
cattttatactctat

SEQ ID NO: 388621 - DNA, 15 bp, Homo sapiens
attttatactctatc

SEQ ID NO: 388622 - DNA, 15 bp, Homo sapiens
ttttatactctatcc

SEQ ID NO: 388623 - DNA, 15 bp, Homo sapiens
tttatactctatcct

SEQ ID NO: 388624 - DNA, 15 bp, Homo sapiens
ttatactctatcctt

SEQ ID NO: 388625 - DNA, 15 bp, Homo sapiens
tatactctatccttt

SEQ ID NO: 388626 - DNA, 15 bp, Homo sapiens
atactctatcctttg

SEQ ID NO: 388627 - DNA, 15 bp, Homo sapiens
tactctatcctttga

SEQ ID NO: 388628 - DNA, 15 bp, Homo sapiens
actctatcctttgaa

SEQ ID NO: 388629 - DNA, 15 bp, Homo sapiens
ctctatcctttgaat

SEQ ID NO: 388630 - DNA, 15 bp, Homo sapiens
tctatcctttgaata

SEQ ID NO: 388631 - DNA, 15 bp, Homo sapiens
ctatcctttgaatat

SEQ ID NO: 388632 - DNA, 15 bp, Homo sapiens
tatcctttgaatatg

SEQ ID NO: 388633 - DNA, 15 bp, Homo sapiens
atcctttgaatatgt

SEQ ID NO: 388634 - DNA, 15 bp, Homo sapiens
tcctttgaatatgtt

SEQ ID NO: 388635 - DNA, 15 bp, Homo sapiens
cctttgaatatgttc

SEQ ID NO: 388636 - DNA, 15 bp, Homo sapiens
ctttgaatatgttct

SEQ ID NO: 388637 - DNA, 15 bp, Homo sapiens
tttgaatatgttctc

SEQ ID NO: 388638 - DNA, 15 bp, Homo sapiens
ttgaatatgttctcc

SEQ ID NO: 388639 - DNA, 15 bp, Homo sapiens
tgaatatgttctcca

SEQ ID NO: 388640 - DNA, 15 bp, Homo sapiens
gaatatgttctccac

SEQ ID NO: 388641 - DNA, 15 bp, Homo sapiens
aatatgttctccact

SEQ ID NO: 388642 - DNA, 15 bp, Homo sapiens
atatgttctccactt

SEQ ID NO: 388643 - DNA, 15 bp, Homo sapiens
tatgttctccacttt

SEQ ID NO: 388644 - DNA, 15 bp, Homo sapiens
atgttctccactttt

SEQ ID NO: 388645 - DNA, 15 bp, Homo sapiens
tgttctccacttttg

SEQ ID NO: 388646 - DNA, 15 bp, Homo sapiens
gttctccacttttgg

SEQ ID NO: 388647 - DNA, 15 bp, Homo sapiens
ttctccacttttggc

SEQ ID NO: 388648 - DNA, 15 bp, Homo sapiens
tctccacttttggct

SEQ ID NO: 388649 - DNA, 15 bp, Homo sapiens
ctccacttttggctt

SEQ ID NO: 388650 - DNA, 15 bp, Homo sapiens
tccacttttggcttt

SEQ ID NO: 388651 - DNA, 15 bp, Homo sapiens
ccacttttggcttta

SEQ ID NO: 388652 - DNA, 15 bp, Homo sapiens
cacttttggctttac

SEQ ID NO: 388653 - DNA, 15 bp, Homo sapiens
acttttggctttaca

SEQ ID NO: 388654 - DNA, 15 bp, Homo sapiens
cttttggctttacac

SEQ ID NO: 388655 - DNA, 15 bp, Homo sapiens
ttttggctttacaca

SEQ ID NO: 388656 - DNA, 15 bp, Homo sapiens
tttggctttacacag

SEQ ID NO: 388657 - DNA, 15 bp, Homo sapiens
ttggctttacacaga

SEQ ID NO: 388658 - DNA, 15 bp, Homo sapiens
tggctttacacagat

SEQ ID NO: 388659 - DNA, 15 bp, Homo sapiens
ggctttacacagata

SEQ ID NO: 388660 - DNA, 15 bp, Homo sapiens
gctttacacagatat

SEQ ID NO: 388661 - DNA, 15 bp, Homo sapiens
ctttacacagatatg

SEQ ID NO: 388662 - DNA, 15 bp, Homo sapiens
tttacacagatatgg

SEQ ID NO: 388663 - DNA, 15 bp, Homo sapiens
ttacacagatatggt

SEQ ID NO: 388664 - DNA, 15 bp, Homo sapiens
tacacagatatggtg

SEQ ID NO: 388665 - DNA, 15 bp, Homo sapiens
acacagatatggtga

SEQ ID NO: 388666 - DNA, 15 bp, Homo sapiens
cacagatatggtgac

SEQ ID NO: 388667 - DNA, 15 bp, Homo sapiens
acagatatggtgaca

SEQ ID NO: 388668 - DNA, 15 bp, Homo sapiens
cagatatggtgacat

SEQ ID NO: 388669 - DNA, 15 bp, Homo sapiens
agatatggtgacatt

SEQ ID NO: 388670 - DNA, 15 bp, Homo sapiens
gatatggtgacattg

SEQ ID NO: 388671 - DNA, 15 bp, Homo sapiens
atatggtgacattgt

SEQ ID NO: 388672 - DNA, 15 bp, Homo sapiens
tatggtgacattgtt

SEQ ID NO: 388673 - DNA, 15 bp, Homo sapiens
atggtgacattgtta

SEQ ID NO: 388674 - DNA, 15 bp, Homo sapiens
tggtgacattgttag

SEQ ID NO: 388675 - DNA, 15 bp, Homo sapiens
ggtgacattgttagc

SEQ ID NO: 388676 - DNA, 15 bp, Homo sapiens
gtgacattgttagcc

SEQ ID NO: 388677 - DNA, 15 bp, Homo sapiens
tgacattgttagcct

SEQ ID NO: 388678 - DNA, 15 bp, Homo sapiens
gacattgttagcctc

SEQ ID NO: 388679 - DNA, 15 bp, Homo sapiens
acattgttagcctca

SEQ ID NO: 388680 - DNA, 15 bp, Homo sapiens
cattgttagcctcac

SEQ ID NO: 388681 - DNA, 15 bp, Homo sapiens
attgttagcctcacc

SEQ ID NO: 388682 - DNA, 15 bp, Homo sapiens
ttgttagcctcacca

SEQ ID NO: 388683 - DNA, 15 bp, Homo sapiens
tgttagcctcaccag

SEQ ID NO: 388684 - DNA, 15 bp, Homo sapiens
gttagcctcaccaga

SEQ ID NO: 388685 - DNA, 15 bp, Homo sapiens
ttagcctcaccagag

SEQ ID NO: 388686 - DNA, 15 bp, Homo sapiens
tagcctcaccagagg

SEQ ID NO: 388687 - DNA, 15 bp, Homo sapiens
agcctcaccagaggg

SEQ ID NO: 388688 - DNA, 15 bp, Homo sapiens
gcctcaccagaggga

SEQ ID NO: 388689 - DNA, 15 bp, Homo sapiens
cctcaccagagggag

SEQ ID NO: 388690 - DNA, 15 bp, Homo sapiens
ctcaccagagggagg

SEQ ID NO: 388691 - DNA, 15 bp, Homo sapiens
tcaccagagggaggc

SEQ ID NO: 388692 - DNA, 15 bp, Homo sapiens
caccagagggaggca

SEQ ID NO: 388693 - DNA, 15 bp, Homo sapiens
accagagggaggcag

SEQ ID NO: 388694 - DNA, 15 bp, Homo sapiens
ccagagggaggcagt

SEQ ID NO: 388695 - DNA, 15 bp, Homo sapiens
cagagggaggcagtg

SEQ ID NO: 388696 - DNA, 15 bp, Homo sapiens
agagggaggcagtgt

SEQ ID NO: 388697 - DNA, 15 bp, Homo sapiens
gagggaggcagtgta

SEQ ID NO: 388698 - DNA, 15 bp, Homo sapiens
agggaggcagtgtag

SEQ ID NO: 388699 - DNA, 15 bp, Homo sapiens
gggaggcagtgtaga

SEQ ID NO: 388700 - DNA, 15 bp, Homo sapiens
ggaggcagtgtagat

SEQ ID NO: 388701 - DNA, 15 bp, Homo sapiens
gaggcagtgtagatt

SEQ ID NO: 388702 - DNA, 15 bp, Homo sapiens
aggcagtgtagattc

SEQ ID NO: 388703 - DNA, 15 bp, Homo sapiens
ggcagtgtagattct

SEQ ID NO: 388704 - DNA, 15 bp, Homo sapiens
gcagtgtagattctc

SEQ ID NO: 388705 - DNA, 15 bp, Homo sapiens
cagtgtagattctca

SEQ ID NO: 388706 - DNA, 15 bp, Homo sapiens
agtgtagattctcag

SEQ ID NO: 388707 - DNA, 15 bp, Homo sapiens
gtgtagattctcagt

SEQ ID NO: 388708 - DNA, 15 bp, Homo sapiens
tgtagattctcagta

SEQ ID NO: 388709 - DNA, 15 bp, Homo sapiens
gtagattctcagtat

SEQ ID NO: 388710 - DNA, 15 bp, Homo sapiens
tagattctcagtatg

SEQ ID NO: 388711 - DNA, 15 bp, Homo sapiens
agattctcagtatgg

SEQ ID NO: 388712 - DNA, 15 bp, Homo sapiens
gattctcagtatgga

SEQ ID NO: 388713 - DNA, 15 bp, Homo sapiens
attctcagtatggac

SEQ ID NO: 388714 - DNA, 15 bp, Homo sapiens
ttctcagtatggacc

SEQ ID NO: 388715 - DNA, 15 bp, Homo sapiens
tctcagtatggacct

SEQ ID NO: 388716 - DNA, 15 bp, Homo sapiens
ctcagtatggacctg

SEQ ID NO: 388717 - DNA, 15 bp, Homo sapiens
tcagtatggacctgc

SEQ ID NO: 388718 - DNA, 15 bp, Homo sapiens
cagtatggacctgca

SEQ ID NO: 388719 - DNA, 15 bp, Homo sapiens
agtatggacctgcag

SEQ ID NO: 388720 - DNA, 15 bp, Homo sapiens
gtatggacctgcagg

SEQ ID NO: 388721 - DNA, 15 bp, Homo sapiens
tatggacctgcaggg

SEQ ID NO: 388722 - DNA, 15 bp, Homo sapiens
atggacctgcaggga

SEQ ID NO: 388723 - DNA, 15 bp, Homo sapiens
tggacctgcagggaa

SEQ ID NO: 388724 - DNA, 15 bp, Homo sapiens
ggacctgcagggaaa

SEQ ID NO: 388725 - DNA, 15 bp, Homo sapiens
gacctgcagggaaaa

SEQ ID NO: 388726 - DNA, 15 bp, Homo sapiens
acctgcagggaaaaa

SEQ ID NO: 388727 - DNA, 15 bp, Homo sapiens
cctgcagggaaaaaa

SEQ ID NO: 388728 - DNA, 15 bp, Homo sapiens
ctgcagggaaaaaag

SEQ ID NO: 388729 - DNA, 15 bp, Homo sapiens
tgcagggaaaaaaga

SEQ ID NO: 388730 - DNA, 15 bp, Homo sapiens
gcagggaaaaaagat

SEQ ID NO: 388731 - DNA, 15 bp, Homo sapiens
cagggaaaaaagata

SEQ ID NO: 388732 - DNA, 15 bp, Homo sapiens
agggaaaaaagatac

SEQ ID NO: 388733 - DNA, 15 bp, Homo sapiens
gggaaaaaagataca

SEQ ID NO: 388734 - DNA, 15 bp, Homo sapiens
ggaaaaaagatacag

SEQ ID NO: 388735 - DNA, 15 bp, Homo sapiens
gaaaaaagatacagg

SEQ ID NO: 388736 - DNA, 15 bp, Homo sapiens
aaaaaagatacaggc

SEQ ID NO: 388737 - DNA, 15 bp, Homo sapiens
aaaaagatacaggca

SEQ ID NO: 388738 - DNA, 15 bp, Homo sapiens
aaaagatacaggcag

SEQ ID NO: 388739 - DNA, 15 bp, Homo sapiens
aaagatacaggcaga

SEQ ID NO: 388740 - DNA, 15 bp, Homo sapiens
aagatacaggcagaa

SEQ ID NO: 388741 - DNA, 15 bp, Homo sapiens
agatacaggcagaag

SEQ ID NO: 388742 - DNA, 15 bp, Homo sapiens
gatacaggcagaagt

SEQ ID NO: 388743 - DNA, 15 bp, Homo sapiens
atacaggcagaagtc

SEQ ID NO: 388744 - DNA, 15 bp, Homo sapiens
tacaggcagaagtcc

SEQ ID NO: 388745 - DNA, 15 bp, Homo sapiens
acaggcagaagtcca

SEQ ID NO: 388746 - DNA, 15 bp, Homo sapiens
caggcagaagtccac

SEQ ID NO: 388747 - DNA, 15 bp, Homo sapiens
aggcagaagtccaca

SEQ ID NO: 388748 - DNA, 15 bp, Homo sapiens
ggcagaagtccacag

SEQ ID NO: 388749 - DNA, 15 bp, Homo sapiens
gcagaagtccacaga

SEQ ID NO: 388750 - DNA, 15 bp, Homo sapiens
cagaagtccacagaa

SEQ ID NO: 388751 - DNA, 15 bp, Homo sapiens
agaagtccacagaac

SEQ ID NO: 388752 - DNA, 15 bp, Homo sapiens
gaagtccacagaaca

SEQ ID NO: 388753 - DNA, 15 bp, Homo sapiens
aagtccacagaacac

SEQ ID NO: 388754 - DNA, 15 bp, Homo sapiens
agtccacagaacact

SEQ ID NO: 388755 - DNA, 15 bp, Homo sapiens
gtccacagaacactg

SEQ ID NO: 388756 - DNA, 15 bp, Homo sapiens
tccacagaacactgc

SEQ ID NO: 388757 - DNA, 15 bp, Homo sapiens
ccacagaacactgcc

SEQ ID NO: 388758 - DNA, 15 bp, Homo sapiens
cacagaacactgcct

SEQ ID NO: 388759 - DNA, 15 bp, Homo sapiens
acagaacactgcctg

SEQ ID NO: 388760 - DNA, 15 bp, Homo sapiens
cagaacactgcctga

SEQ ID NO: 388761 - DNA, 15 bp, Homo sapiens
agaacactgcctgat

SEQ ID NO: 388762 - DNA, 15 bp, Homo sapiens
gaacactgcctgatg

SEQ ID NO: 388763 - DNA, 15 bp, Homo sapiens
aacactgcctgatga

SEQ ID NO: 388764 - DNA, 15 bp, Homo sapiens
acactgcctgatgaa

SEQ ID NO: 388765 - DNA, 15 bp, Homo sapiens
cactgcctgatgaac

SEQ ID NO: 388766 - DNA, 15 bp, Homo sapiens
actgcctgatgaaca

SEQ ID NO: 388767 - DNA, 15 bp, Homo sapiens
ctgcctgatgaacac

SEQ ID NO: 388768 - DNA, 15 bp, Homo sapiens
tgcctgatgaacaca

SEQ ID NO: 388769 - DNA, 15 bp, Homo sapiens
gcctgatgaacacag

SEQ ID NO: 388770 - DNA, 15 bp, Homo sapiens
cctgatgaacacagt

SEQ ID NO: 388771 - DNA, 15 bp, Homo sapiens
ctgatgaacacagtt

SEQ ID NO: 388772 - DNA, 15 bp, Homo sapiens
tgatgaacacagttc

SEQ ID NO: 388773 - DNA, 15 bp, Homo sapiens
gatgaacacagttct

SEQ ID NO: 388774 - DNA, 15 bp, Homo sapiens
atgaacacagttcta

SEQ ID NO: 388775 - DNA, 15 bp, Homo sapiens
tgaacacagttctat

SEQ ID NO: 388776 - DNA, 15 bp, Homo sapiens
gaacacagttctata

SEQ ID NO: 388777 - DNA, 15 bp, Homo sapiens
aacacagttctataa

SEQ ID NO: 388778 - DNA, 15 bp, Homo sapiens
acacagttctataag

SEQ ID NO: 388779 - DNA, 15 bp, Homo sapiens
cacagttctataaga

SEQ ID NO: 388780 - DNA, 15 bp, Homo sapiens
acagttctataagac

SEQ ID NO: 388781 - DNA, 15 bp, Homo sapiens
cagttctataagacc

SEQ ID NO: 388782 - DNA, 15 bp, Homo sapiens
agttctataagaccc

SEQ ID NO: 388783 - DNA, 15 bp, Homo sapiens
gttctataagaccca

SEQ ID NO: 388784 - DNA, 15 bp, Homo sapiens
ttctataagacccaa

SEQ ID NO: 388785 - DNA, 15 bp, Homo sapiens
tctataagacccaat

SEQ ID NO: 388786 - DNA, 15 bp, Homo sapiens
ctataagacccaata

SEQ ID NO: 388787 - DNA, 15 bp, Homo sapiens
tataagacccaataa

SEQ ID NO: 388788 - DNA, 15 bp, Homo sapiens
ataagacccaataaa

SEQ ID NO: 388789 - DNA, 15 bp, Homo sapiens
taagacccaataaag

SEQ ID NO: 388790 - DNA, 15 bp, Homo sapiens
aagacccaataaagt

SEQ ID NO: 388791 - DNA, 15 bp, Homo sapiens
agacccaataaagtc

SEQ ID NO: 388792 - DNA, 15 bp, Homo sapiens
gacccaataaagtcg

SEQ ID NO: 388793 - DNA, 15 bp, Homo sapiens
acccaataaagtcgg

SEQ ID NO: 388794 - DNA, 15 bp, Homo sapiens
cccaataaagtcggc

SEQ ID NO: 388795 - DNA, 15 bp, Homo sapiens
ccaataaagtcggca

SEQ ID NO: 388796 - DNA, 15 bp, Homo sapiens
caataaagtcggcaa

SEQ ID NO: 388797 - DNA, 15 bp, Homo sapiens
aataaagtcggcaaa

SEQ ID NO: 388798 - DNA, 15 bp, Homo sapiens
ataaagtcggcaaag

SEQ ID NO: 388799 - DNA, 15 bp, Homo sapiens
taaagtcggcaaagc

SEQ ID NO: 388800 - DNA, 15 bp, Homo sapiens
aaagtcggcaaagca

SEQ ID NO: 388801 - DNA, 15 bp, Homo sapiens
aagtcggcaaagcac

SEQ ID NO: 388802 - DNA, 15 bp, Homo sapiens
agtcggcaaagcact

SEQ ID NO: 388803 - DNA, 15 bp, Homo sapiens
gtcggcaaagcactg

SEQ ID NO: 388804 - DNA, 15 bp, Homo sapiens
tcggcaaagcactgc

SEQ ID NO: 388805 - DNA, 15 bp, Homo sapiens
cggcaaagcactgct

SEQ ID NO: 388806 - DNA, 15 bp, Homo sapiens
ggcaaagcactgctt

SEQ ID NO: 388807 - DNA, 15 bp, Homo sapiens
gcaaagcactgcttg

SEQ ID NO: 388808 - DNA, 15 bp, Homo sapiens
caaagcactgcttga

SEQ ID NO: 388809 - DNA, 15 bp, Homo sapiens
aaagcactgcttgat

SEQ ID NO: 388810 - DNA, 15 bp, Homo sapiens
aagcactgcttgata

SEQ ID NO: 388811 - DNA, 15 bp, Homo sapiens
agcactgcttgataa

SEQ ID NO: 388812 - DNA, 15 bp, Homo sapiens
gcactgcttgataaa

SEQ ID NO: 388813 - DNA, 15 bp, Homo sapiens
cactgcttgataaac

SEQ ID NO: 388814 - DNA, 15 bp, Homo sapiens
actgcttgataaaca

SEQ ID NO: 388815 - DNA, 15 bp, Homo sapiens
ctgcttgataaacac

SEQ ID NO: 388816 - DNA, 15 bp, Homo sapiens
tgcttgataaacacc

SEQ ID NO: 388817 - DNA, 15 bp, Homo sapiens
gcttgataaacaccg

SEQ ID NO: 388818 - DNA, 15 bp, Homo sapiens
cttgataaacaccgt

SEQ ID NO: 388819 - DNA, 15 bp, Homo sapiens
ttgataaacaccgtt

SEQ ID NO: 388820 - DNA, 15 bp, Homo sapiens
tgataaacaccgttc

SEQ ID NO: 388821 - DNA, 15 bp, Homo sapiens
gataaacaccgttct

SEQ ID NO: 388822 - DNA, 15 bp, Homo sapiens
ataaacaccgttctg

SEQ ID NO: 388823 - DNA, 15 bp, Homo sapiens
taaacaccgttctgt

SEQ ID NO: 388824 - DNA, 15 bp, Homo sapiens
aaacaccgttctgta

SEQ ID NO: 388825 - DNA, 15 bp, Homo sapiens
aacaccgttctgtaa

SEQ ID NO: 388826 - DNA, 15 bp, Homo sapiens
acaccgttctgtaag

SEQ ID NO: 388827 - DNA, 15 bp, Homo sapiens
caccgttctgtaaga

SEQ ID NO: 388828 - DNA, 15 bp, Homo sapiens
accgttctgtaagac

SEQ ID NO: 388829 - DNA, 15 bp, Homo sapiens
ccgttctgtaagaca

SEQ ID NO: 388830 - DNA, 15 bp, Homo sapiens
cgttctgtaagacac

SEQ ID NO: 388831 - DNA, 15 bp, Homo sapiens
gttctgtaagacaca

SEQ ID NO: 388832 - DNA, 15 bp, Homo sapiens
ttctgtaagacacaa

SEQ ID NO: 388833 - DNA, 15 bp, Homo sapiens
tctgtaagacacaat

SEQ ID NO: 388834 - DNA, 15 bp, Homo sapiens
ctgtaagacacaata

SEQ ID NO: 388835 - DNA, 15 bp, Homo sapiens
tgtaagacacaatat

SEQ ID NO: 388836 - DNA, 15 bp, Homo sapiens
gtaagacacaatata

SEQ ID NO: 388837 - DNA, 15 bp, Homo sapiens
taagacacaatatag

SEQ ID NO: 388838 - DNA, 15 bp, Homo sapiens
aagacacaatatagg

SEQ ID NO: 388839 - DNA, 15 bp, Homo sapiens
agacacaatatagga

SEQ ID NO: 388840 - DNA, 15 bp, Homo sapiens
gacacaatataggac

SEQ ID NO: 388841 - DNA, 15 bp, Homo sapiens
acacaatataggact

SEQ ID NO: 388842 - DNA, 15 bp, Homo sapiens
cacaatataggactt

SEQ ID NO: 388843 - DNA, 15 bp, Homo sapiens
acaatataggacttt

SEQ ID NO: 388844 - DNA, 15 bp, Homo sapiens
caatataggacttta

SEQ ID NO: 388845 - DNA, 15 bp, Homo sapiens
aatataggactttaa

SEQ ID NO: 388846 - DNA, 15 bp, Homo sapiens
atataggactttaaa

SEQ ID NO: 388847 - DNA, 15 bp, Homo sapiens
tataggactttaaat

SEQ ID NO: 388848 - DNA, 15 bp, Homo sapiens
ataggactttaaatc

SEQ ID NO: 388849 - DNA, 15 bp, Homo sapiens
taggactttaaatcg

SEQ ID NO: 388850 - DNA, 15 bp, Homo sapiens
aggactttaaatcgt

SEQ ID NO: 388851 - DNA, 15 bp, Homo sapiens
ggactttaaatcgtt

SEQ ID NO: 388852 - DNA, 15 bp, Homo sapiens
gactttaaatcgttg

SEQ ID NO: 388853 - DNA, 15 bp, Homo sapiens
actttaaatcgttgt

SEQ ID NO: 388854 - DNA, 15 bp, Homo sapiens
ctttaaatcgttgta

SEQ ID NO: 388855 - DNA, 15 bp, Homo sapiens
tttaaatcgttgtaa

SEQ ID NO: 388856 - DNA, 15 bp, Homo sapiens
ttaaatcgttgtaac

SEQ ID NO: 388857 - DNA, 15 bp, Homo sapiens
taaatcgttgtaaca

SEQ ID NO: 388858 - DNA, 15 bp, Homo sapiens
aaatcgttgtaacat

SEQ ID NO: 388859 - DNA, 15 bp, Homo sapiens
aatcgttgtaacatg

SEQ ID NO: 388860 - DNA, 15 bp, Homo sapiens
atcgttgtaacatga

SEQ ID NO: 388861 - DNA, 15 bp, Homo sapiens
tcgttgtaacatgaa

SEQ ID NO: 388862 - DNA, 15 bp, Homo sapiens
cgttgtaacatgaag

SEQ ID NO: 388863 - DNA, 15 bp, Homo sapiens
gttgtaacatgaagg

SEQ ID NO: 388864 - DNA, 15 bp, Homo sapiens
ttgtaacatgaagga

SEQ ID NO: 388865 - DNA, 15 bp, Homo sapiens
tgtaacatgaaggac

SEQ ID NO: 388866 - DNA, 15 bp, Homo sapiens
gtaacatgaaggact

SEQ ID NO: 388867 - DNA, 15 bp, Homo sapiens
taacatgaaggacta

SEQ ID NO: 388868 - DNA, 15 bp, Homo sapiens
aacatgaaggactaa

SEQ ID NO: 388869 - DNA, 15 bp, Homo sapiens
acatgaaggactaag

SEQ ID NO: 388870 - DNA, 15 bp, Homo sapiens
catgaaggactaaga

SEQ ID NO: 388871 - DNA, 15 bp, Homo sapiens
atgaaggactaagaa

SEQ ID NO: 388872 - DNA, 15 bp, Homo sapiens
tgaaggactaagaaa

SEQ ID NO: 388873 - DNA, 15 bp, Homo sapiens
gaaggactaagaaag

SEQ ID NO: 388874 - DNA, 15 bp, Homo sapiens
aaggactaagaaagg

SEQ ID NO: 388875 - DNA, 15 bp, Homo sapiens
aggactaagaaaggc

SEQ ID NO: 388876 - DNA, 15 bp, Homo sapiens
ggactaagaaaggca

SEQ ID NO: 388877 - DNA, 15 bp, Homo sapiens
gactaagaaaggcaa

SEQ ID NO: 388878 - DNA, 15 bp, Homo sapiens
actaagaaaggcaaa

SEQ ID NO: 388879 - DNA, 15 bp, Homo sapiens
ctaagaaaggcaaat

SEQ ID NO: 388880 - DNA, 15 bp, Homo sapiens
taagaaaggcaaatg

SEQ ID NO: 388881 - DNA, 15 bp, Homo sapiens
aagaaaggcaaatga

SEQ ID NO: 388882 - DNA, 15 bp, Homo sapiens
agaaaggcaaatgaa

SEQ ID NO: 388883 - DNA, 15 bp, Homo sapiens
gaaaggcaaatgaag

SEQ ID NO: 388884 - DNA, 15 bp, Homo sapiens
aaaggcaaatgaagt

SEQ ID NO: 388885 - DNA, 15 bp, Homo sapiens
aaggcaaatgaagta

SEQ ID NO: 388886 - DNA, 15 bp, Homo sapiens
aggcaaatgaagtaa

SEQ ID NO: 388887 - DNA, 15 bp, Homo sapiens
ggcaaatgaagtaaa

SEQ ID NO: 388888 - DNA, 15 bp, Homo sapiens
gcaaatgaagtaaag

SEQ ID NO: 388889 - DNA, 15 bp, Homo sapiens
caaatgaagtaaagg

SEQ ID NO: 388890 - DNA, 15 bp, Homo sapiens
aaatgaagtaaagga

SEQ ID NO: 388891 - DNA, 15 bp, Homo sapiens
aatgaagtaaaggag

SEQ ID NO: 388892 - DNA, 15 bp, Homo sapiens
atgaagtaaaggagg

SEQ ID NO: 388893 - DNA, 15 bp, Homo sapiens
tgaagtaaaggagga

SEQ ID NO: 388894 - DNA, 15 bp, Homo sapiens
gaagtaaaggaggaa

SEQ ID NO: 388895 - DNA, 15 bp, Homo sapiens
aagtaaaggaggaaa

SEQ ID NO: 388896 - DNA, 15 bp, Homo sapiens
agtaaaggaggaaaa

SEQ ID NO: 388897 - DNA, 15 bp, Homo sapiens
gtaaaggaggaaaaa

SEQ ID NO: 388898 - DNA, 15 bp, Homo sapiens
taaaggaggaaaaac

SEQ ID NO: 388899 - DNA, 15 bp, Homo sapiens
aaaggaggaaaaaca

SEQ ID NO: 388900 - DNA, 15 bp, Homo sapiens
aaggaggaaaaacaa

SEQ ID NO: 388901 - DNA, 15 bp, Homo sapiens
aggaggaaaaacaaa

SEQ ID NO: 388902 - DNA, 15 bp, Homo sapiens
ggaggaaaaacaaat

SEQ ID NO: 388903 - DNA, 15 bp, Homo sapiens
gaggaaaaacaaata

SEQ ID NO: 388904 - DNA, 15 bp, Homo sapiens
aggaaaaacaaatac

SEQ ID NO: 388905 - DNA, 15 bp, Homo sapiens
ggaaaaacaaatact

SEQ ID NO: 388906 - DNA, 15 bp, Homo sapiens
gaaaaacaaatactt

SEQ ID NO: 388907 - DNA, 15 bp, Homo sapiens
aaaaacaaatacttg

SEQ ID NO: 388908 - DNA, 15 bp, Homo sapiens
aaaacaaatacttga

SEQ ID NO: 388909 - DNA, 15 bp, Homo sapiens
aaacaaatacttgaa

SEQ ID NO: 388910 - DNA, 15 bp, Homo sapiens
aacaaatacttgaaa

SEQ ID NO: 388911 - DNA, 15 bp, Homo sapiens
acaaatacttgaaaa

SEQ ID NO: 388912 - DNA, 15 bp, Homo sapiens
caaatacttgaaaat

SEQ ID NO: 388913 - DNA, 15 bp, Homo sapiens
aaatacttgaaaata

SEQ ID NO: 388914 - DNA, 15 bp, Homo sapiens
aatacttgaaaatac

SEQ ID NO: 388915 - DNA, 15 bp, Homo sapiens
atacttgaaaatact

SEQ ID NO: 388916 - DNA, 15 bp, Homo sapiens
tacttgaaaatactg

SEQ ID NO: 388917 - DNA, 15 bp, Homo sapiens
acttgaaaatactgc

SEQ ID NO: 388918 - DNA, 15 bp, Homo sapiens
cttgaaaatactgca

SEQ ID NO: 388919 - DNA, 15 bp, Homo sapiens
ttgaaaatactgcat

SEQ ID NO: 388920 - DNA, 15 bp, Homo sapiens
tgaaaatactgcatt

SEQ ID NO: 388921 - DNA, 15 bp, Homo sapiens
gaaaatactgcattt

SEQ ID NO: 388922 - DNA, 15 bp, Homo sapiens
aaaatactgcatttc

SEQ ID NO: 388923 - DNA, 15 bp, Homo sapiens
aaatactgcatttct

SEQ ID NO: 388924 - DNA, 15 bp, Homo sapiens
aatactgcatttctt

SEQ ID NO: 388925 - DNA, 15 bp, Homo sapiens
atactgcatttcttt

SEQ ID NO: 388926 - DNA, 15 bp, Homo sapiens
tactgcatttctttt

SEQ ID NO: 388927 - DNA, 15 bp, Homo sapiens
actgcatttctttta

SEQ ID NO: 388928 - DNA, 15 bp, Homo sapiens
ctgcatttcttttaa

SEQ ID NO: 388929 - DNA, 15 bp, Homo sapiens
tgcatttcttttaaa

SEQ ID NO: 388930 - DNA, 15 bp, Homo sapiens
gcatttcttttaaag

SEQ ID NO: 388931 - DNA, 15 bp, Homo sapiens
catttcttttaaaga

SEQ ID NO: 388932 - DNA, 15 bp, Homo sapiens
atttcttttaaagaa

SEQ ID NO: 388933 - DNA, 15 bp, Homo sapiens
tttcttttaaagaat

SEQ ID NO: 388934 - DNA, 15 bp, Homo sapiens
ttcttttaaagaatc

SEQ ID NO: 388935 - DNA, 15 bp, Homo sapiens
tcttttaaagaatca

SEQ ID NO: 388936 - DNA, 15 bp, Homo sapiens
cttttaaagaatcat

SEQ ID NO: 388937 - DNA, 15 bp, Homo sapiens
ttttaaagaatcatg

SEQ ID NO: 388938 - DNA, 15 bp, Homo sapiens
tttaaagaatcatga

SEQ ID NO: 388939 - DNA, 15 bp, Homo sapiens
ttaaagaatcatgac

SEQ ID NO: 388940 - DNA, 15 bp, Homo sapiens
taaagaatcatgaca

SEQ ID NO: 388941 - DNA, 15 bp, Homo sapiens
aaagaatcatgacaa

SEQ ID NO: 388942 - DNA, 15 bp, Homo sapiens
aagaatcatgacaac

SEQ ID NO: 388943 - DNA, 15 bp, Homo sapiens
agaatcatgacaaca

SEQ ID NO: 388944 - DNA, 15 bp, Homo sapiens
gaatcatgacaacat

SEQ ID NO: 388945 - DNA, 15 bp, Homo sapiens
aatcatgacaacatt

SEQ ID NO: 388946 - DNA, 15 bp, Homo sapiens
atcatgacaacatta

SEQ ID NO: 388947 - DNA, 15 bp, Homo sapiens
tcatgacaacattag

SEQ ID NO: 388948 - DNA, 15 bp, Homo sapiens
catgacaacattaga

SEQ ID NO: 388949 - DNA, 15 bp, Homo sapiens
atgacaacattagac

SEQ ID NO: 388950 - DNA, 15 bp, Homo sapiens
tgacaacattagaca

SEQ ID NO: 388951 - DNA, 15 bp, Homo sapiens
gacaacattagacag

SEQ ID NO: 388952 - DNA, 15 bp, Homo sapiens
acaacattagacaga

SEQ ID NO: 388953 - DNA, 15 bp, Homo sapiens
caacattagacagag

SEQ ID NO: 388954 - DNA, 15 bp, Homo sapiens
aacattagacagagg

SEQ ID NO: 388955 - DNA, 15 bp, Homo sapiens
acattagacagaggt

SEQ ID NO: 388956 - DNA, 15 bp, Homo sapiens
cattagacagaggtg

SEQ ID NO: 388957 - DNA, 15 bp, Homo sapiens
attagacagaggtga

SEQ ID NO: 388958 - DNA, 15 bp, Homo sapiens
ttagacagaggtgaa

SEQ ID NO: 388959 - DNA, 15 bp, Homo sapiens
tagacagaggtgaaa

SEQ ID NO: 388960 - DNA, 15 bp, Homo sapiens
agacagaggtgaaat

SEQ ID NO: 388961 - DNA, 15 bp, Homo sapiens
gacagaggtgaaatt

SEQ ID NO: 388962 - DNA, 15 bp, Homo sapiens
acagaggtgaaattg

SEQ ID NO: 388963 - DNA, 15 bp, Homo sapiens
cagaggtgaaattgc

SEQ ID NO: 388964 - DNA, 15 bp, Homo sapiens
agaggtgaaattgca

SEQ ID NO: 388965 - DNA, 15 bp, Homo sapiens
gaggtgaaattgcag

SEQ ID NO: 388966 - DNA, 15 bp, Homo sapiens
aggtgaaattgcagc

SEQ ID NO: 388967 - DNA, 15 bp, Homo sapiens
ggtgaaattgcagca

SEQ ID NO: 388968 - DNA, 15 bp, Homo sapiens
gtgaaattgcagcat

SEQ ID NO: 388969 - DNA, 15 bp, Homo sapiens
tgaaattgcagcatt

SEQ ID NO: 388970 - DNA, 15 bp, Homo sapiens
gaaattgcagcatta

SEQ ID NO: 388971 - DNA, 15 bp, Homo sapiens
aaattgcagcattag

SEQ ID NO: 388972 - DNA, 15 bp, Homo sapiens
aattgcagcattagc

SEQ ID NO: 388973 - DNA, 15 bp, Homo sapiens
attgcagcattagcc

SEQ ID NO: 388974 - DNA, 15 bp, Homo sapiens
ttgcagcattagccc

SEQ ID NO: 388975 - DNA, 15 bp, Homo sapiens
tgcagcattagcccg

SEQ ID NO: 388976 - DNA, 15 bp, Homo sapiens
gcagcattagcccgg

SEQ ID NO: 388977 - DNA, 15 bp, Homo sapiens
cagcattagcccggt

SEQ ID NO: 388978 - DNA, 15 bp, Homo sapiens
agcattagcccggtt

SEQ ID NO: 388979 - DNA, 15 bp, Homo sapiens
gcattagcccggtta

SEQ ID NO: 388980 - DNA, 15 bp, Homo sapiens
cattagcccggttac

SEQ ID NO: 388981 - DNA, 15 bp, Homo sapiens
attagcccggttacc

SEQ ID NO: 388982 - DNA, 15 bp, Homo sapiens
ttagcccggttacca

SEQ ID NO: 388983 - DNA, 15 bp, Homo sapiens
tagcccggttaccag

SEQ ID NO: 388984 - DNA, 15 bp, Homo sapiens
agcccggttaccagt

SEQ ID NO: 388985 - DNA, 15 bp, Homo sapiens
gcccggttaccagtt

SEQ ID NO: 388986 - DNA, 15 bp, Homo sapiens
cccggttaccagttt

SEQ ID NO: 388987 - DNA, 15 bp, Homo sapiens
ccggttaccagtttg

SEQ ID NO: 388988 - DNA, 15 bp, Homo sapiens
cggttaccagtttga

SEQ ID NO: 388989 - DNA, 15 bp, Homo sapiens
ggttaccagtttgag

SEQ ID NO: 388990 - DNA, 15 bp, Homo sapiens
gttaccagtttgagc

SEQ ID NO: 388991 - DNA, 15 bp, Homo sapiens
ttaccagtttgagca

SEQ ID NO: 388992 - DNA, 15 bp, Homo sapiens
taccagtttgagcag

SEQ ID NO: 388993 - DNA, 15 bp, Homo sapiens
accagtttgagcagg

SEQ ID NO: 388994 - DNA, 15 bp, Homo sapiens
ccagtttgagcagga

SEQ ID NO: 388995 - DNA, 15 bp, Homo sapiens
cagtttgagcaggac

SEQ ID NO: 388996 - DNA, 15 bp, Homo sapiens
agtttgagcaggaca

SEQ ID NO: 388997 - DNA, 15 bp, Homo sapiens
gtttgagcaggacac

SEQ ID NO: 388998 - DNA, 15 bp, Homo sapiens
tttgagcaggacact

SEQ ID NO: 388999 - DNA, 15 bp, Homo sapiens
ttgagcaggacactg

SEQ ID NO: 389000 - DNA, 15 bp, Homo sapiens
tgagcaggacactga

SEQ ID NO: 389001 - DNA, 15 bp, Homo sapiens
gagcaggacactgat

SEQ ID NO: 389002 - DNA, 15 bp, Homo sapiens
agcaggacactgata

SEQ ID NO: 389003 - DNA, 15 bp, Homo sapiens
gcaggacactgataa

SEQ ID NO: 389004 - DNA, 15 bp, Homo sapiens
caggacactgataat

SEQ ID NO: 389005 - DNA, 15 bp, Homo sapiens
aggacactgataatg

SEQ ID NO: 389006 - DNA, 15 bp, Homo sapiens
ggacactgataatga

SEQ ID NO: 389007 - DNA, 15 bp, Homo sapiens
gacactgataatgag

SEQ ID NO: 389008 - DNA, 15 bp, Homo sapiens
acactgataatgagc

SEQ ID NO: 389009 - DNA, 15 bp, Homo sapiens
cactgataatgagca

SEQ ID NO: 389010 - DNA, 15 bp, Homo sapiens
actgataatgagcaa

SEQ ID NO: 389011 - DNA, 15 bp, Homo sapiens
ctgataatgagcaac

SEQ ID NO: 389012 - DNA, 15 bp, Homo sapiens
tgataatgagcaaca

SEQ ID NO: 389013 - DNA, 15 bp, Homo sapiens
gataatgagcaacat

SEQ ID NO: 389014 - DNA, 15 bp, Homo sapiens
ataatgagcaacatc

SEQ ID NO: 389015 - DNA, 15 bp, Homo sapiens
taatgagcaacatct

SEQ ID NO: 389016 - DNA, 15 bp, Homo sapiens
aatgagcaacatctg

SEQ ID NO: 389017 - DNA, 15 bp, Homo sapiens
atgagcaacatctgg

SEQ ID NO: 389018 - DNA, 15 bp, Homo sapiens
tgagcaacatctggg

SEQ ID NO: 389019 - DNA, 15 bp, Homo sapiens
gagcaacatctgggt

SEQ ID NO: 389020 - DNA, 15 bp, Homo sapiens
agcaacatctgggtt

SEQ ID NO: 389021 - DNA, 15 bp, Homo sapiens
gcaacatctgggttc

SEQ ID NO: 389022 - DNA, 15 bp, Homo sapiens
caacatctgggttct

SEQ ID NO: 389023 - DNA, 15 bp, Homo sapiens
aacatctgggttcta

SEQ ID NO: 389024 - DNA, 15 bp, Homo sapiens
acatctgggttctat

SEQ ID NO: 389025 - DNA, 15 bp, Homo sapiens
catctgggttctatt

SEQ ID NO: 389026 - DNA, 15 bp, Homo sapiens
atctgggttctattt

SEQ ID NO: 389027 - DNA, 15 bp, Homo sapiens
tctgggttctatttc

SEQ ID NO: 389028 - DNA, 15 bp, Homo sapiens
ctgggttctatttct

SEQ ID NO: 389029 - DNA, 15 bp, Homo sapiens
tgggttctatttctg

SEQ ID NO: 389030 - DNA, 15 bp, Homo sapiens
gggttctatttctgg

SEQ ID NO: 389031 - DNA, 15 bp, Homo sapiens
ggttctatttctggc

SEQ ID NO: 389032 - DNA, 15 bp, Homo sapiens
gttctatttctggct

SEQ ID NO: 389033 - DNA, 15 bp, Homo sapiens
ttctatttctggctg

SEQ ID NO: 389034 - DNA, 15 bp, Homo sapiens
tctatttctggctgt

SEQ ID NO: 389035 - DNA, 15 bp, Homo sapiens
ctatttctggctgtg

SEQ ID NO: 389036 - DNA, 15 bp, Homo sapiens
tatttctggctgtgc

SEQ ID NO: 389037 - DNA, 15 bp, Homo sapiens
atttctggctgtgct

SEQ ID NO: 389038 - DNA, 15 bp, Homo sapiens
tttctggctgtgctc

SEQ ID NO: 389039 - DNA, 15 bp, Homo sapiens
ttctggctgtgctct

SEQ ID NO: 389040 - DNA, 15 bp, Homo sapiens
tctggctgtgctctt

SEQ ID NO: 389041 - DNA, 15 bp, Homo sapiens
ctggctgtgctcttt

SEQ ID NO: 389042 - DNA, 15 bp, Homo sapiens
tggctgtgctctttg

SEQ ID NO: 389043 - DNA, 15 bp, Homo sapiens
ggctgtgctctttga

SEQ ID NO: 389044 - DNA, 15 bp, Homo sapiens
gctgtgctctttgac

SEQ ID NO: 389045 - DNA, 15 bp, Homo sapiens
ctgtgctctttgacc

SEQ ID NO: 389046 - DNA, 15 bp, Homo sapiens
tgtgctctttgaccc

SEQ ID NO: 389047 - DNA, 15 bp, Homo sapiens
gtgctctttgaccca

SEQ ID NO: 389048 - DNA, 15 bp, Homo sapiens
tgctctttgacccag

SEQ ID NO: 389049 - DNA, 15 bp, Homo sapiens
gctctttgacccagt

SEQ ID NO: 389050 - DNA, 15 bp, Homo sapiens
ctctttgacccagtc

SEQ ID NO: 389051 - DNA, 15 bp, Homo sapiens
tctttgacccagtca

SEQ ID NO: 389052 - DNA, 15 bp, Homo sapiens
ctttgacccagtcat

SEQ ID NO: 389053 - DNA, 15 bp, Homo sapiens
tttgacccagtcatt

SEQ ID NO: 389054 - DNA, 15 bp, Homo sapiens
ttgacccagtcattt

SEQ ID NO: 389055 - DNA, 15 bp, Homo sapiens
tgacccagtcattta

SEQ ID NO: 389056 - DNA, 15 bp, Homo sapiens
gacccagtcatttaa

SEQ ID NO: 389057 - DNA, 15 bp, Homo sapiens
acccagtcatttaat

SEQ ID NO: 389058 - DNA, 15 bp, Homo sapiens
cccagtcatttaatc

SEQ ID NO: 389059 - DNA, 15 bp, Homo sapiens
ccagtcatttaatca

SEQ ID NO: 389060 - DNA, 15 bp, Homo sapiens
cagtcatttaatcat

SEQ ID NO: 389061 - DNA, 15 bp, Homo sapiens
agtcatttaatcatc

SEQ ID NO: 389062 - DNA, 15 bp, Homo sapiens
gtcatttaatcatcc

SEQ ID NO: 389063 - DNA, 15 bp, Homo sapiens
tcatttaatcatcca

SEQ ID NO: 389064 - DNA, 15 bp, Homo sapiens
catttaatcatccag

SEQ ID NO: 389065 - DNA, 15 bp, Homo sapiens
atttaatcatccagg

SEQ ID NO: 389066 - DNA, 15 bp, Homo sapiens
tttaatcatccaggg

SEQ ID NO: 389067 - DNA, 15 bp, Homo sapiens
ttaatcatccagggt

SEQ ID NO: 389068 - DNA, 15 bp, Homo sapiens
taatcatccagggtt

SEQ ID NO: 389069 - DNA, 15 bp, Homo sapiens
aatcatccagggtta

SEQ ID NO: 389070 - DNA, 15 bp, Homo sapiens
atcatccagggttat

SEQ ID NO: 389071 - DNA, 15 bp, Homo sapiens
tcatccagggttatt

SEQ ID NO: 389072 - DNA, 15 bp, Homo sapiens
catccagggttattt

SEQ ID NO: 389073 - DNA, 15 bp, Homo sapiens
atccagggttatttt

SEQ ID NO: 389074 - DNA, 15 bp, Homo sapiens
tccagggttattttg

SEQ ID NO: 389075 - DNA, 15 bp, Homo sapiens
ccagggttattttgc

SEQ ID NO: 389076 - DNA, 15 bp, Homo sapiens
cagggttattttgca

SEQ ID NO: 389077 - DNA, 15 bp, Homo sapiens
agggttattttgcac

SEQ ID NO: 389078 - DNA, 15 bp, Homo sapiens
gggttattttgcaca

SEQ ID NO: 389079 - DNA, 15 bp, Homo sapiens
ggttattttgcacat

SEQ ID NO: 389080 - DNA, 15 bp, Homo sapiens
gttattttgcacatc

SEQ ID NO: 389081 - DNA, 15 bp, Homo sapiens
ttattttgcacatct

SEQ ID NO: 389082 - DNA, 15 bp, Homo sapiens
tattttgcacatctc

SEQ ID NO: 389083 - DNA, 15 bp, Homo sapiens
attttgcacatctcc

SEQ ID NO: 389084 - DNA, 15 bp, Homo sapiens
ttttgcacatctcct

SEQ ID NO: 389085 - DNA, 15 bp, Homo sapiens
tttgcacatctcctg

SEQ ID NO: 389086 - DNA, 15 bp, Homo sapiens
ttgcacatctcctga

SEQ ID NO: 389087 - DNA, 15 bp, Homo sapiens
tgcacatctcctgat

SEQ ID NO: 389088 - DNA, 15 bp, Homo sapiens
gcacatctcctgata

SEQ ID NO: 389089 - DNA, 15 bp, Homo sapiens
cacatctcctgatag

SEQ ID NO: 389090 - DNA, 15 bp, Homo sapiens
acatctcctgatagt

SEQ ID NO: 389091 - DNA, 15 bp, Homo sapiens
catctcctgatagta

SEQ ID NO: 389092 - DNA, 15 bp, Homo sapiens
atctcctgatagtac

SEQ ID NO: 389093 - DNA, 15 bp, Homo sapiens
tctcctgatagtact

SEQ ID NO: 389094 - DNA, 15 bp, Homo sapiens
ctcctgatagtactt

SEQ ID NO: 389095 - DNA, 15 bp, Homo sapiens
tcctgatagtacttt

SEQ ID NO: 389096 - DNA, 15 bp, Homo sapiens
cctgatagtacttta

SEQ ID NO: 389097 - DNA, 15 bp, Homo sapiens
ctgatagtactttac

SEQ ID NO: 389098 - DNA, 15 bp, Homo sapiens
tgatagtactttacc

SEQ ID NO: 389099 - DNA, 15 bp, Homo sapiens
gatagtactttaccc

SEQ ID NO: 389100 - DNA, 15 bp, Homo sapiens
atagtactttacccc

SEQ ID NO: 389101 - DNA, 15 bp, Homo sapiens
tagtactttacccca

SEQ ID NO: 389102 - DNA, 15 bp, Homo sapiens
agtactttaccccag

SEQ ID NO: 389103 - DNA, 15 bp, Homo sapiens
gtactttaccccagt

SEQ ID NO: 389104 - DNA, 15 bp, Homo sapiens
tactttaccccagtt

SEQ ID NO: 389105 - DNA, 15 bp, Homo sapiens
actttaccccagttg

SEQ ID NO: 389106 - DNA, 15 bp, Homo sapiens
ctttaccccagttga

SEQ ID NO: 389107 - DNA, 15 bp, Homo sapiens
tttaccccagttgat

SEQ ID NO: 389108 - DNA, 15 bp, Homo sapiens
ttaccccagttgata

SEQ ID NO: 389109 - DNA, 15 bp, Homo sapiens
taccccagttgatat

SEQ ID NO: 389110 - DNA, 15 bp, Homo sapiens
accccagttgatatt

SEQ ID NO: 389111 - DNA, 15 bp, Homo sapiens
ccccagttgatattt

SEQ ID NO: 389112 - DNA, 15 bp, Homo sapiens
cccagttgatatttg

SEQ ID NO: 389113 - DNA, 15 bp, Homo sapiens
ccagttgatatttgc

SEQ ID NO: 389114 - DNA, 15 bp, Homo sapiens
cagttgatatttgca

SEQ ID NO: 389115 - DNA, 15 bp, Homo sapiens
agttgatatttgcaa

SEQ ID NO: 389116 - DNA, 15 bp, Homo sapiens
gttgatatttgcaat

SEQ ID NO: 389117 - DNA, 15 bp, Homo sapiens
ttgatatttgcaatg

SEQ ID NO: 389118 - DNA, 15 bp, Homo sapiens
tgatatttgcaatga

SEQ ID NO: 389119 - DNA, 15 bp, Homo sapiens
gatatttgcaatgat

SEQ ID NO: 389120 - DNA, 15 bp, Homo sapiens
atatttgcaatgatg

SEQ ID NO: 389121 - DNA, 15 bp, Homo sapiens
tatttgcaatgatgt

SEQ ID NO: 389122 - DNA, 15 bp, Homo sapiens
atttgcaatgatgtt

SEQ ID NO: 389123 - DNA, 15 bp, Homo sapiens
tttgcaatgatgttc

SEQ ID NO: 389124 - DNA, 15 bp, Homo sapiens
ttgcaatgatgttca

SEQ ID NO: 389125 - DNA, 15 bp, Homo sapiens
tgcaatgatgttcag

SEQ ID NO: 389126 - DNA, 15 bp, Homo sapiens
gcaatgatgttcagg

SEQ ID NO: 389127 - DNA, 15 bp, Homo sapiens
caatgatgttcaggc

SEQ ID NO: 389128 - DNA, 15 bp, Homo sapiens
aatgatgttcaggct

SEQ ID NO: 389129 - DNA, 15 bp, Homo sapiens
atgatgttcaggctg

SEQ ID NO: 389130 - DNA, 15 bp, Homo sapiens
tgatgttcaggctgc

SEQ ID NO: 389131 - DNA, 15 bp, Homo sapiens
gatgttcaggctgca

SEQ ID NO: 389132 - DNA, 15 bp, Homo sapiens
atgttcaggctgcag

SEQ ID NO: 389133 - DNA, 15 bp, Homo sapiens
tgttcaggctgcagt

SEQ ID NO: 389134 - DNA, 15 bp, Homo sapiens
gttcaggctgcagta

SEQ ID NO: 389135 - DNA, 15 bp, Homo sapiens
ttcaggctgcagtag

SEQ ID NO: 389136 - DNA, 15 bp, Homo sapiens
tcaggctgcagtaga

SEQ ID NO: 389137 - DNA, 15 bp, Homo sapiens
caggctgcagtagag

SEQ ID NO: 389138 - DNA, 15 bp, Homo sapiens
aggctgcagtagaga

SEQ ID NO: 389139 - DNA, 15 bp, Homo sapiens
ggctgcagtagagaa

SEQ ID NO: 389140 - DNA, 15 bp, Homo sapiens
gctgcagtagagaat

SEQ ID NO: 389141 - DNA, 15 bp, Homo sapiens
ctgcagtagagaata

SEQ ID NO: 389142 - DNA, 15 bp, Homo sapiens
tgcagtagagaatat

SEQ ID NO: 389143 - DNA, 15 bp, Homo sapiens
gcagtagagaatatg

SEQ ID NO: 389144 - DNA, 15 bp, Homo sapiens
cagtagagaatatgt

SEQ ID NO: 389145 - DNA, 15 bp, Homo sapiens
agtagagaatatgtc

SEQ ID NO: 389146 - DNA, 15 bp, Homo sapiens
gtagagaatatgtct

SEQ ID NO: 389147 - DNA, 15 bp, Homo sapiens
tagagaatatgtctc

SEQ ID NO: 389148 - DNA, 15 bp, Homo sapiens
agagaatatgtctca

SEQ ID NO: 389149 - DNA, 15 bp, Homo sapiens
gagaatatgtctcaa

SEQ ID NO: 389150 - DNA, 15 bp, Homo sapiens
agaatatgtctcaag

SEQ ID NO: 389151 - DNA, 15 bp, Homo sapiens
gaatatgtctcaagt

SEQ ID NO: 389152 - DNA, 15 bp, Homo sapiens
aatatgtctcaagtg

SEQ ID NO: 389153 - DNA, 15 bp, Homo sapiens
atatgtctcaagtgt

SEQ ID NO: 389154 - DNA, 15 bp, Homo sapiens
tatgtctcaagtgtg

SEQ ID NO: 389155 - DNA, 15 bp, Homo sapiens
atgtctcaagtgtgt

SEQ ID NO: 389156 - DNA, 15 bp, Homo sapiens
tgtctcaagtgtgtg

SEQ ID NO: 389157 - DNA, 15 bp, Homo sapiens
gtctcaagtgtgtgt

SEQ ID NO: 389158 - DNA, 15 bp, Homo sapiens
tctcaagtgtgtgta

SEQ ID NO: 389159 - DNA, 15 bp, Homo sapiens
ctcaagtgtgtgtat

SEQ ID NO: 389160 - DNA, 15 bp, Homo sapiens
tcaagtgtgtgtata

SEQ ID NO: 389161 - DNA, 15 bp, Homo sapiens
caagtgtgtgtatat

SEQ ID NO: 389162 - DNA, 15 bp, Homo sapiens
aagtgtgtgtatata

SEQ ID NO: 389163 - DNA, 15 bp, Homo sapiens
agtgtgtgtatatat

SEQ ID NO: 389164 - DNA, 15 bp, Homo sapiens
tatatatatacacat

SEQ ID NO: 389165 - DNA, 15 bp, Homo sapiens
atatatatacacata

SEQ ID NO: 389166 - DNA, 15 bp, Homo sapiens
tatatatacacatag

SEQ ID NO: 389167 - DNA, 15 bp, Homo sapiens
atatatacacataga

SEQ ID NO: 389168 - DNA, 15 bp, Homo sapiens
tatatacacatagaa

SEQ ID NO: 389169 - DNA, 15 bp, Homo sapiens
atatacacatagaac

SEQ ID NO: 389170 - DNA, 15 bp, Homo sapiens
tatacacatagaacc

SEQ ID NO: 389171 - DNA, 15 bp, Homo sapiens
atacacatagaaccc

SEQ ID NO: 389172 - DNA, 15 bp, Homo sapiens
tacacatagaacccc

SEQ ID NO: 389173 - DNA, 15 bp, Homo sapiens
acacatagaacccca

SEQ ID NO: 389174 - DNA, 15 bp, Homo sapiens
cacatagaaccccaa

SEQ ID NO: 389175 - DNA, 15 bp, Homo sapiens
acatagaaccccaaa

SEQ ID NO: 389176 - DNA, 15 bp, Homo sapiens
catagaaccccaaaa

SEQ ID NO: 389177 - DNA, 15 bp, Homo sapiens
atagaaccccaaaat

SEQ ID NO: 389178 - DNA, 15 bp, Homo sapiens
tagaaccccaaaatt

SEQ ID NO: 389179 - DNA, 15 bp, Homo sapiens
agaaccccaaaatta

SEQ ID NO: 389180 - DNA, 15 bp, Homo sapiens
gaaccccaaaattat

SEQ ID NO: 389181 - DNA, 15 bp, Homo sapiens
aaccccaaaattatg

SEQ ID NO: 389182 - DNA, 15 bp, Homo sapiens
accccaaaattatgt

SEQ ID NO: 389183 - DNA, 15 bp, Homo sapiens
ccccaaaattatgta

SEQ ID NO: 389184 - DNA, 15 bp, Homo sapiens
cccaaaattatgtac

SEQ ID NO: 389185 - DNA, 15 bp, Homo sapiens
ccaaaattatgtact

SEQ ID NO: 389186 - DNA, 15 bp, Homo sapiens
caaaattatgtactg

SEQ ID NO: 389187 - DNA, 15 bp, Homo sapiens
aaaattatgtactgg

SEQ ID NO: 389188 - DNA, 15 bp, Homo sapiens
aaattatgtactgga

SEQ ID NO: 389189 - DNA, 15 bp, Homo sapiens
aattatgtactggat

SEQ ID NO: 389190 - DNA, 15 bp, Homo sapiens
attatgtactggatt

SEQ ID NO: 389191 - DNA, 15 bp, Homo sapiens
ttatgtactggattt

SEQ ID NO: 389192 - DNA, 15 bp, Homo sapiens
tatgtactggatttt

SEQ ID NO: 389193 - DNA, 15 bp, Homo sapiens
atgtactggattttt

SEQ ID NO: 389194 - DNA, 15 bp, Homo sapiens
tgtactggattttta

SEQ ID NO: 389195 - DNA, 15 bp, Homo sapiens
gtactggatttttat

SEQ ID NO: 389196 - DNA, 15 bp, Homo sapiens
tactggatttttata

SEQ ID NO: 389197 - DNA, 15 bp, Homo sapiens
actggatttttatat

SEQ ID NO: 389198 - DNA, 15 bp, Homo sapiens
ctggatttttatatg

SEQ ID NO: 389199 - DNA, 15 bp, Homo sapiens
tggatttttatatga

SEQ ID NO: 389200 - DNA, 15 bp, Homo sapiens
ggatttttatatgat

SEQ ID NO: 389201 - DNA, 15 bp, Homo sapiens
gatttttatatgata

SEQ ID NO: 389202 - DNA, 15 bp, Homo sapiens
atttttatatgatat

SEQ ID NO: 389203 - DNA, 15 bp, Homo sapiens
tttttatatgatata

SEQ ID NO: 389204 - DNA, 15 bp, Homo sapiens
ttttatatgatataa

SEQ ID NO: 389205 - DNA, 15 bp, Homo sapiens
tttatatgatataat

SEQ ID NO: 389206 - DNA, 15 bp, Homo sapiens
ttatatgatataatt

SEQ ID NO: 389207 - DNA, 15 bp, Homo sapiens
tatatgatataatta

SEQ ID NO: 389208 - DNA, 15 bp, Homo sapiens
atatgatataattat

SEQ ID NO: 389209 - DNA, 15 bp, Homo sapiens
tatgatataattatg

SEQ ID NO: 389210 - DNA, 15 bp, Homo sapiens
atgatataattatgg

SEQ ID NO: 389211 - DNA, 15 bp, Homo sapiens
tgatataattatggc

SEQ ID NO: 389212 - DNA, 15 bp, Homo sapiens
gatataattatggcc

SEQ ID NO: 389213 - DNA, 15 bp, Homo sapiens
atataattatggcct

SEQ ID NO: 389214 - DNA, 15 bp, Homo sapiens
tataattatggcctc

SEQ ID NO: 389215 - DNA, 15 bp, Homo sapiens
ataattatggcctca

SEQ ID NO: 389216 - DNA, 15 bp, Homo sapiens
taattatggcctcat

SEQ ID NO: 389217 - DNA, 15 bp, Homo sapiens
aattatggcctcata

SEQ ID NO: 389218 - DNA, 15 bp, Homo sapiens
attatggcctcatat

SEQ ID NO: 389219 - DNA, 15 bp, Homo sapiens
ttatggcctcatatt

SEQ ID NO: 389220 - DNA, 15 bp, Homo sapiens
tatggcctcatattt

SEQ ID NO: 389221 - DNA, 15 bp, Homo sapiens
atggcctcatatttc

SEQ ID NO: 389222 - DNA, 15 bp, Homo sapiens
tggcctcatatttcc

SEQ ID NO: 389223 - DNA, 15 bp, Homo sapiens
ggcctcatatttcct

SEQ ID NO: 389224 - DNA, 15 bp, Homo sapiens
gcctcatatttccta

SEQ ID NO: 389225 - DNA, 15 bp, Homo sapiens
cctcatatttcctat

SEQ ID NO: 389226 - DNA, 15 bp, Homo sapiens
ctcatatttcctatt

SEQ ID NO: 389227 - DNA, 15 bp, Homo sapiens
tcatatttcctattc

SEQ ID NO: 389228 - DNA, 15 bp, Homo sapiens
catatttcctattca

SEQ ID NO: 389229 - DNA, 15 bp, Homo sapiens
atatttcctattcat

SEQ ID NO: 389230 - DNA, 15 bp, Homo sapiens
tatttcctattcata

SEQ ID NO: 389231 - DNA, 15 bp, Homo sapiens
atttcctattcataa

SEQ ID NO: 389232 - DNA, 15 bp, Homo sapiens
tttcctattcataaa

SEQ ID NO: 389233 - DNA, 15 bp, Homo sapiens
ttcctattcataaaa

SEQ ID NO: 389234 - DNA, 15 bp, Homo sapiens
tcctattcataaaat

SEQ ID NO: 389235 - DNA, 15 bp, Homo sapiens
cctattcataaaatt

SEQ ID NO: 389236 - DNA, 15 bp, Homo sapiens
ctattcataaaatta

SEQ ID NO: 389237 - DNA, 15 bp, Homo sapiens
tattcataaaattaa

SEQ ID NO: 389238 - DNA, 15 bp, Homo sapiens
attcataaaattaaa

SEQ ID NO: 389239 - DNA, 15 bp, Homo sapiens
ttcataaaattaaaa

SEQ ID NO: 389240 - DNA, 15 bp, Homo sapiens
tcataaaattaaaac

SEQ ID NO: 389241 - DNA, 15 bp, Homo sapiens
cataaaattaaaaca

SEQ ID NO: 389242 - DNA, 15 bp, Homo sapiens
ataaaattaaaacag

SEQ ID NO: 389243 - DNA, 15 bp, Homo sapiens
taaaattaaaacagc

SEQ ID NO: 389244 - DNA, 15 bp, Homo sapiens
aaaattaaaacagct

SEQ ID NO: 389245 - DNA, 15 bp, Homo sapiens
aaattaaaacagctt

SEQ ID NO: 389246 - DNA, 15 bp, Homo sapiens
aattaaaacagcttt

SEQ ID NO: 389247 - DNA, 15 bp, Homo sapiens
attaaaacagcttta

SEQ ID NO: 389248 - DNA, 15 bp, Homo sapiens
ttaaaacagctttat

SEQ ID NO: 389249 - DNA, 15 bp, Homo sapiens
taaaacagctttatg

SEQ ID NO: 389250 - DNA, 15 bp, Homo sapiens
aaaacagctttatgg

SEQ ID NO: 389251 - DNA, 15 bp, Homo sapiens
aaacagctttatggc

SEQ ID NO: 389252 - DNA, 15 bp, Homo sapiens
aacagctttatggca

SEQ ID NO: 389253 - DNA, 15 bp, Homo sapiens
acagctttatggcaa

SEQ ID NO: 389254 - DNA, 15 bp, Homo sapiens
cagctttatggcaaa

SEQ ID NO: 389255 - DNA, 15 bp, Homo sapiens
agctttatggcaaat

SEQ ID NO: 389256 - DNA, 15 bp, Homo sapiens
gctttatggcaaata

SEQ ID NO: 389257 - DNA, 15 bp, Homo sapiens
ctttatggcaaatac

SEQ ID NO: 389258 - DNA, 15 bp, Homo sapiens
tttatggcaaataca

SEQ ID NO: 389259 - DNA, 15 bp, Homo sapiens
ttatggcaaatacaa

SEQ ID NO: 389260 - DNA, 15 bp, Homo sapiens
tatggcaaatacaat

SEQ ID NO: 389261 - DNA, 15 bp, Homo sapiens
atggcaaatacaatg

SEQ ID NO: 389262 - DNA, 15 bp, Homo sapiens
tggcaaatacaatga

SEQ ID NO: 389263 - DNA, 15 bp, Homo sapiens
ggcaaatacaatgag

SEQ ID NO: 389264 - DNA, 15 bp, Homo sapiens
gcaaatacaatgaga

SEQ ID NO: 389265 - DNA, 15 bp, Homo sapiens
caaatacaatgagat

SEQ ID NO: 389266 - DNA, 15 bp, Homo sapiens
aaatacaatgagatc

SEQ ID NO: 389267 - DNA, 15 bp, Homo sapiens
aatacaatgagatca

SEQ ID NO: 389268 - DNA, 15 bp, Homo sapiens
atacaatgagatcat

SEQ ID NO: 389269 - DNA, 15 bp, Homo sapiens
tacaatgagatcatg

SEQ ID NO: 389270 - DNA, 15 bp, Homo sapiens
acaatgagatcatga

SEQ ID NO: 389271 - DNA, 15 bp, Homo sapiens
caatgagatcatgaa

SEQ ID NO: 389272 - DNA, 15 bp, Homo sapiens
aatgagatcatgaag

SEQ ID NO: 389273 - DNA, 15 bp, Homo sapiens
atgagatcatgaaga

SEQ ID NO: 389274 - DNA, 15 bp, Homo sapiens
tgagatcatgaagat

SEQ ID NO: 389275 - DNA, 15 bp, Homo sapiens
gagatcatgaagatg

SEQ ID NO: 389276 - DNA, 15 bp, Homo sapiens
agatcatgaagatgc

SEQ ID NO: 389277 - DNA, 15 bp, Homo sapiens
gatcatgaagatgct

SEQ ID NO: 389278 - DNA, 15 bp, Homo sapiens
atcatgaagatgctg

SEQ ID NO: 389279 - DNA, 15 bp, Homo sapiens
tcatgaagatgctgt

SEQ ID NO: 389280 - DNA, 15 bp, Homo sapiens
catgaagatgctgtc

SEQ ID NO: 389281 - DNA, 15 bp, Homo sapiens
atgaagatgctgtct

SEQ ID NO: 389282 - DNA, 15 bp, Homo sapiens
tgaagatgctgtcta

SEQ ID NO: 389283 - DNA, 15 bp, Homo sapiens
gaagatgctgtctaa

SEQ ID NO: 389284 - DNA, 15 bp, Homo sapiens
aagatgctgtctaag

SEQ ID NO: 389285 - DNA, 15 bp, Homo sapiens
agatgctgtctaagg

SEQ ID NO: 389286 - DNA, 15 bp, Homo sapiens
gatgctgtctaaggg

SEQ ID NO: 389287 - DNA, 15 bp, Homo sapiens
atgctgtctaagggg

SEQ ID NO: 389288 - DNA, 15 bp, Homo sapiens
tgctgtctaagggga

SEQ ID NO: 389289 - DNA, 15 bp, Homo sapiens
gctgtctaaggggaa

SEQ ID NO: 389290 - DNA, 15 bp, Homo sapiens
ctgtctaaggggaaa

SEQ ID NO: 389291 - DNA, 15 bp, Homo sapiens
tgtctaaggggaaat

SEQ ID NO: 389292 - DNA, 15 bp, Homo sapiens
gtctaaggggaaatg

SEQ ID NO: 389293 - DNA, 15 bp, Homo sapiens
tctaaggggaaatgt

SEQ ID NO: 389294 - DNA, 15 bp, Homo sapiens
ctaaggggaaatgtg

SEQ ID NO: 389295 - DNA, 15 bp, Homo sapiens
taaggggaaatgtgg

SEQ ID NO: 389296 - DNA, 15 bp, Homo sapiens
aaggggaaatgtggc

SEQ ID NO: 389297 - DNA, 15 bp, Homo sapiens
aggggaaatgtggca

SEQ ID NO: 389298 - DNA, 15 bp, Homo sapiens
ggggaaatgtggcaa

SEQ ID NO: 389299 - DNA, 15 bp, Homo sapiens
gggaaatgtggcaat

SEQ ID NO: 389300 - DNA, 15 bp, Homo sapiens
ggaaatgtggcaatt

SEQ ID NO: 389301 - DNA, 15 bp, Homo sapiens
gaaatgtggcaattt

SEQ ID NO: 389302 - DNA, 15 bp, Homo sapiens
aaatgtggcaatttg

SEQ ID NO: 389303 - DNA, 15 bp, Homo sapiens
aatgtggcaatttgg

SEQ ID NO: 389304 - DNA, 15 bp, Homo sapiens
atgtggcaatttgga

SEQ ID NO: 389305 - DNA, 15 bp, Homo sapiens
tgtggcaatttggaa

SEQ ID NO: 389306 - DNA, 15 bp, Homo sapiens
gtggcaatttggaat

SEQ ID NO: 389307 - DNA, 15 bp, Homo sapiens
tggcaatttggaatg

SEQ ID NO: 389308 - DNA, 15 bp, Homo sapiens
ggcaatttggaatgt

SEQ ID NO: 389309 - DNA, 15 bp, Homo sapiens
gcaatttggaatgtt

SEQ ID NO: 389310 - DNA, 15 bp, Homo sapiens
caatttggaatgttc

SEQ ID NO: 389311 - DNA, 15 bp, Homo sapiens
aatttggaatgttca

SEQ ID NO: 389312 - DNA, 15 bp, Homo sapiens
atttggaatgttcag

SEQ ID NO: 389313 - DNA, 15 bp, Homo sapiens
tttggaatgttcagt

SEQ ID NO: 389314 - DNA, 15 bp, Homo sapiens
ttggaatgttcagta

SEQ ID NO: 389315 - DNA, 15 bp, Homo sapiens
tggaatgttcagtag

SEQ ID NO: 389316 - DNA, 15 bp, Homo sapiens
ggaatgttcagtagt

SEQ ID NO: 389317 - DNA, 15 bp, Homo sapiens
gaatgttcagtagtc

SEQ ID NO: 389318 - DNA, 15 bp, Homo sapiens
aatgttcagtagtca

SEQ ID NO: 389319 - DNA, 15 bp, Homo sapiens
atgttcagtagtcaa

SEQ ID NO: 389320 - DNA, 15 bp, Homo sapiens
tgttcagtagtcaat

SEQ ID NO: 389321 - DNA, 15 bp, Homo sapiens
gttcagtagtcaatt

SEQ ID NO: 389322 - DNA, 15 bp, Homo sapiens
ttcagtagtcaatta

SEQ ID NO: 389323 - DNA, 15 bp, Homo sapiens
tcagtagtcaattac

SEQ ID NO: 389324 - DNA, 15 bp, Homo sapiens
cagtagtcaattaca

SEQ ID NO: 389325 - DNA, 15 bp, Homo sapiens
agtagtcaattacag

SEQ ID NO: 389326 - DNA, 15 bp, Homo sapiens
gtagtcaattacaga

SEQ ID NO: 389327 - DNA, 15 bp, Homo sapiens
tagtcaattacagac

SEQ ID NO: 389328 - DNA, 15 bp, Homo sapiens
agtcaattacagact

SEQ ID NO: 389329 - DNA, 15 bp, Homo sapiens
gtcaattacagactt

SEQ ID NO: 389330 - DNA, 15 bp, Homo sapiens
tcaattacagacttt

SEQ ID NO: 389331 - DNA, 15 bp, Homo sapiens
caattacagactttt

SEQ ID NO: 389332 - DNA, 15 bp, Homo sapiens
aattacagactttta

SEQ ID NO: 389333 - DNA, 15 bp, Homo sapiens
attacagacttttaa

SEQ ID NO: 389334 - DNA, 15 bp, Homo sapiens
ttacagacttttaat

SEQ ID NO: 389335 - DNA, 15 bp, Homo sapiens
tacagacttttaatt

SEQ ID NO: 389336 - DNA, 15 bp, Homo sapiens
acagacttttaattt

SEQ ID NO: 389337 - DNA, 15 bp, Homo sapiens
cagacttttaatttt

SEQ ID NO: 389338 - DNA, 15 bp, Homo sapiens
agacttttaattttt

SEQ ID NO: 389339 - DNA, 15 bp, Homo sapiens
gacttttaatttttt

SEQ ID NO: 389340 - DNA, 15 bp, Homo sapiens
acttttaatttttta

SEQ ID NO: 389341 - DNA, 15 bp, Homo sapiens
cttttaattttttat

SEQ ID NO: 389342 - DNA, 15 bp, Homo sapiens
ttttaattttttatt

SEQ ID NO: 389343 - DNA, 15 bp, Homo sapiens
tttaattttttattc

SEQ ID NO: 389344 - DNA, 15 bp, Homo sapiens
ttaattttttattca

SEQ ID NO: 389345 - DNA, 15 bp, Homo sapiens
taattttttattcac

SEQ ID NO: 389346 - DNA, 15 bp, Homo sapiens
aattttttattcact

SEQ ID NO: 389347 - DNA, 15 bp, Homo sapiens
attttttattcactt

SEQ ID NO: 389348 - DNA, 15 bp, Homo sapiens
ttttttattcactta

SEQ ID NO: 389349 - DNA, 15 bp, Homo sapiens
tttttattcacttag

SEQ ID NO: 389350 - DNA, 15 bp, Homo sapiens
ttttattcacttagc

SEQ ID NO: 389351 - DNA, 15 bp, Homo sapiens
tttattcacttagct

SEQ ID NO: 389352 - DNA, 15 bp, Homo sapiens
ttattcacttagctg

SEQ ID NO: 389353 - DNA, 15 bp, Homo sapiens
tattcacttagctgt

SEQ ID NO: 389354 - DNA, 15 bp, Homo sapiens
attcacttagctgtt

SEQ ID NO: 389355 - DNA, 15 bp, Homo sapiens
ttcacttagctgttt

SEQ ID NO: 389356 - DNA, 15 bp, Homo sapiens
tcacttagctgttta

SEQ ID NO: 389357 - DNA, 15 bp, Homo sapiens
cacttagctgtttaa

SEQ ID NO: 389358 - DNA, 15 bp, Homo sapiens
acttagctgtttaat

SEQ ID NO: 389359 - DNA, 15 bp, Homo sapiens
cttagctgtttaatt

SEQ ID NO: 389360 - DNA, 15 bp, Homo sapiens
ttagctgtttaatta

SEQ ID NO: 389361 - DNA, 15 bp, Homo sapiens
tagctgtttaattag

SEQ ID NO: 389362 - DNA, 15 bp, Homo sapiens
agctgtttaattaga

SEQ ID NO: 389363 - DNA, 15 bp, Homo sapiens
gctgtttaattagac

SEQ ID NO: 389364 - DNA, 15 bp, Homo sapiens
ctgtttaattagaca

SEQ ID NO: 389365 - DNA, 15 bp, Homo sapiens
tgtttaattagacaa

SEQ ID NO: 389366 - DNA, 15 bp, Homo sapiens
gtttaattagacaaa

SEQ ID NO: 389367 - DNA, 15 bp, Homo sapiens
tttaattagacaaat

SEQ ID NO: 389368 - DNA, 15 bp, Homo sapiens
ttaattagacaaatc

SEQ ID NO: 389369 - DNA, 15 bp, Homo sapiens
taattagacaaatcc

SEQ ID NO: 389370 - DNA, 15 bp, Homo sapiens
aattagacaaatcct

SEQ ID NO: 389371 - DNA, 15 bp, Homo sapiens
attagacaaatccta

SEQ ID NO: 389372 - DNA, 15 bp, Homo sapiens
ttagacaaatcctaa

SEQ ID NO: 389373 - DNA, 15 bp, Homo sapiens
tagacaaatcctaac

SEQ ID NO: 389374 - DNA, 15 bp, Homo sapiens
agacaaatcctaacc

SEQ ID NO: 389375 - DNA, 15 bp, Homo sapiens
gacaaatcctaacct

SEQ ID NO: 389376 - DNA, 15 bp, Homo sapiens
acaaatcctaaccta

SEQ ID NO: 389377 - DNA, 15 bp, Homo sapiens
caaatcctaacctat

SEQ ID NO: 389378 - DNA, 15 bp, Homo sapiens
aaatcctaacctatt

SEQ ID NO: 389379 - DNA, 15 bp, Homo sapiens
aatcctaacctattc

SEQ ID NO: 389380 - DNA, 15 bp, Homo sapiens
atcctaacctattcc

SEQ ID NO: 389381 - DNA, 15 bp, Homo sapiens
tcctaacctattcca

SEQ ID NO: 389382 - DNA, 15 bp, Homo sapiens
cctaacctattccat

SEQ ID NO: 389383 - DNA, 15 bp, Homo sapiens
ctaacctattccatt

SEQ ID NO: 389384 - DNA, 15 bp, Homo sapiens
taacctattccattt

SEQ ID NO: 389385 - DNA, 15 bp, Homo sapiens
aacctattccatttc

SEQ ID NO: 389386 - DNA, 15 bp, Homo sapiens
acctattccatttct

SEQ ID NO: 389387 - DNA, 15 bp, Homo sapiens
cctattccatttcta

SEQ ID NO: 389388 - DNA, 15 bp, Homo sapiens
ctattccatttctaa

SEQ ID NO: 389389 - DNA, 15 bp, Homo sapiens
tattccatttctaat

SEQ ID NO: 389390 - DNA, 15 bp, Homo sapiens
attccatttctaatg

SEQ ID NO: 389391 - DNA, 15 bp, Homo sapiens
ttccatttctaatgg

SEQ ID NO: 389392 - DNA, 15 bp, Homo sapiens
tccatttctaatggc

SEQ ID NO: 389393 - DNA, 15 bp, Homo sapiens
ccatttctaatggct

SEQ ID NO: 389394 - DNA, 15 bp, Homo sapiens
catttctaatggctt

SEQ ID NO: 389395 - DNA, 15 bp, Homo sapiens
atttctaatggcttt

SEQ ID NO: 389396 - DNA, 15 bp, Homo sapiens
tttctaatggctttc

SEQ ID NO: 389397 - DNA, 15 bp, Homo sapiens
ttctaatggctttcc

SEQ ID NO: 389398 - DNA, 15 bp, Homo sapiens
tctaatggctttcct

SEQ ID NO: 389399 - DNA, 15 bp, Homo sapiens
ctaatggctttcctt

SEQ ID NO: 389400 - DNA, 15 bp, Homo sapiens
taatggctttccttc

SEQ ID NO: 389401 - DNA, 15 bp, Homo sapiens
aatggctttccttct

SEQ ID NO: 389402 - DNA, 15 bp, Homo sapiens
atggctttccttcta

SEQ ID NO: 389403 - DNA, 15 bp, Homo sapiens
tggctttccttctag

SEQ ID NO: 389404 - DNA, 15 bp, Homo sapiens
ggctttccttctagg

SEQ ID NO: 389405 - DNA, 15 bp, Homo sapiens
gctttccttctaggc

SEQ ID NO: 389406 - DNA, 15 bp, Homo sapiens
ctttccttctaggca

SEQ ID NO: 389407 - DNA, 15 bp, Homo sapiens
tttccttctaggcag

SEQ ID NO: 389408 - DNA, 15 bp, Homo sapiens
ttccttctaggcagg

SEQ ID NO: 389409 - DNA, 15 bp, Homo sapiens
tccttctaggcaggc

SEQ ID NO: 389410 - DNA, 15 bp, Homo sapiens
ccttctaggcaggca

SEQ ID NO: 389411 - DNA, 15 bp, Homo sapiens
cttctaggcaggcag

SEQ ID NO: 389412 - DNA, 15 bp, Homo sapiens
ttctaggcaggcaga

SEQ ID NO: 389413 - DNA, 15 bp, Homo sapiens
tctaggcaggcagat

SEQ ID NO: 389414 - DNA, 15 bp, Homo sapiens
ctaggcaggcagatg

SEQ ID NO: 389415 - DNA, 15 bp, Homo sapiens
taggcaggcagatga

SEQ ID NO: 389416 - DNA, 15 bp, Homo sapiens
aggcaggcagatgag

SEQ ID NO: 389417 - DNA, 15 bp, Homo sapiens
ggcaggcagatgaga

SEQ ID NO: 389418 - DNA, 15 bp, Homo sapiens
gcaggcagatgagaa

SEQ ID NO: 389419 - DNA, 15 bp, Homo sapiens
caggcagatgagaat

SEQ ID NO: 389420 - DNA, 15 bp, Homo sapiens
aggcagatgagaatc

SEQ ID NO: 389421 - DNA, 15 bp, Homo sapiens
ggcagatgagaatcc

SEQ ID NO: 389422 - DNA, 15 bp, Homo sapiens
gcagatgagaatcca

SEQ ID NO: 389423 - DNA, 15 bp, Homo sapiens
cagatgagaatccac

SEQ ID NO: 389424 - DNA, 15 bp, Homo sapiens
agatgagaatccact

SEQ ID NO: 389425 - DNA, 15 bp, Homo sapiens
gatgagaatccactg

SEQ ID NO: 389426 - DNA, 15 bp, Homo sapiens
atgagaatccactgg

SEQ ID NO: 389427 - DNA, 15 bp, Homo sapiens
tgagaatccactgga

SEQ ID NO: 389428 - DNA, 15 bp, Homo sapiens
gagaatccactggat

SEQ ID NO: 389429 - DNA, 15 bp, Homo sapiens
agaatccactggatc

SEQ ID NO: 389430 - DNA, 15 bp, Homo sapiens
gaatccactggatcg

SEQ ID NO: 389431 - DNA, 15 bp, Homo sapiens
aatccactggatcgc

SEQ ID NO: 389432 - DNA, 15 bp, Homo sapiens
atccactggatcgct

SEQ ID NO: 389433 - DNA, 15 bp, Homo sapiens
tccactggatcgctc

SEQ ID NO: 389434 - DNA, 15 bp, Homo sapiens
ccactggatcgctct

SEQ ID NO: 389435 - DNA, 15 bp, Homo sapiens
cactggatcgctctg

SEQ ID NO: 389436 - DNA, 15 bp, Homo sapiens
actggatcgctctgc

SEQ ID NO: 389437 - DNA, 15 bp, Homo sapiens
ctggatcgctctgct

SEQ ID NO: 389438 - DNA, 15 bp, Homo sapiens
tggatcgctctgctt

SEQ ID NO: 389439 - DNA, 15 bp, Homo sapiens
ggatcgctctgcttt

SEQ ID NO: 389440 - DNA, 15 bp, Homo sapiens
gatcgctctgctttt

SEQ ID NO: 389441 - DNA, 15 bp, Homo sapiens
atcgctctgctttta

SEQ ID NO: 389442 - DNA, 15 bp, Homo sapiens
tcgctctgcttttag

SEQ ID NO: 389443 - DNA, 15 bp, Homo sapiens
cgctctgcttttagg

SEQ ID NO: 389444 - DNA, 15 bp, Homo sapiens
gctctgcttttaggg

SEQ ID NO: 389445 - DNA, 15 bp, Homo sapiens
ctctgcttttagggt

SEQ ID NO: 389446 - DNA, 15 bp, Homo sapiens
tctgcttttagggtg

SEQ ID NO: 389447 - DNA, 15 bp, Homo sapiens
ctgcttttagggtgt

SEQ ID NO: 389448 - DNA, 15 bp, Homo sapiens
tgcttttagggtgtc

SEQ ID NO: 389449 - DNA, 15 bp, Homo sapiens
gcttttagggtgtct

SEQ ID NO: 389450 - DNA, 15 bp, Homo sapiens
cttttagggtgtctt

SEQ ID NO: 389451 - DNA, 15 bp, Homo sapiens
ttttagggtgtctta

SEQ ID NO: 389452 - DNA, 15 bp, Homo sapiens
tttagggtgtcttag

SEQ ID NO: 389453 - DNA, 15 bp, Homo sapiens
ttagggtgtcttagt

SEQ ID NO: 389454 - DNA, 15 bp, Homo sapiens
tagggtgtcttagtc

SEQ ID NO: 389455 - DNA, 15 bp, Homo sapiens
agggtgtcttagtca

SEQ ID NO: 389456 - DNA, 15 bp, Homo sapiens
gggtgtcttagtcat

SEQ ID NO: 389457 - DNA, 15 bp, Homo sapiens
ggtgtcttagtcata

SEQ ID NO: 389458 - DNA, 15 bp, Homo sapiens
gtgtcttagtcatat

SEQ ID NO: 389459 - DNA, 15 bp, Homo sapiens
tgtcttagtcatata

SEQ ID NO: 389460 - DNA, 15 bp, Homo sapiens
gtcttagtcatataa

SEQ ID NO: 389461 - DNA, 15 bp, Homo sapiens
tcttagtcatataac

SEQ ID NO: 389462 - DNA, 15 bp, Homo sapiens
cttagtcatataacc

SEQ ID NO: 389463 - DNA, 15 bp, Homo sapiens
ttagtcatataaccc

SEQ ID NO: 389464 - DNA, 15 bp, Homo sapiens
tagtcatataacccc

SEQ ID NO: 389465 - DNA, 15 bp, Homo sapiens
agtcatataacccct

SEQ ID NO: 389466 - DNA, 15 bp, Homo sapiens
gtcatataacccctg

SEQ ID NO: 389467 - DNA, 15 bp, Homo sapiens
tcatataacccctgc

SEQ ID NO: 389468 - DNA, 15 bp, Homo sapiens
catataacccctgca

SEQ ID NO: 389469 - DNA, 15 bp, Homo sapiens
atataacccctgcaa

SEQ ID NO: 389470 - DNA, 15 bp, Homo sapiens
tataacccctgcaag

SEQ ID NO: 389471 - DNA, 15 bp, Homo sapiens
ataacccctgcaagt

SEQ ID NO: 389472 - DNA, 15 bp, Homo sapiens
taacccctgcaagta

SEQ ID NO: 389473 - DNA, 15 bp, Homo sapiens
aacccctgcaagtat

SEQ ID NO: 389474 - DNA, 15 bp, Homo sapiens
acccctgcaagtatt

SEQ ID NO: 389475 - DNA, 15 bp, Homo sapiens
cccctgcaagtattt

SEQ ID NO: 389476 - DNA, 15 bp, Homo sapiens
ccctgcaagtatttt

SEQ ID NO: 389477 - DNA, 15 bp, Homo sapiens
cctgcaagtattttt

SEQ ID NO: 389478 - DNA, 15 bp, Homo sapiens
ctgcaagtatttttt

SEQ ID NO: 389479 - DNA, 15 bp, Homo sapiens
tgcaagtattttttg

SEQ ID NO: 389480 - DNA, 15 bp, Homo sapiens
gcaagtattttttgt

SEQ ID NO: 389481 - DNA, 15 bp, Homo sapiens
caagtattttttgtt

SEQ ID NO: 389482 - DNA, 15 bp, Homo sapiens
aagtattttttgttt

SEQ ID NO: 389483 - DNA, 15 bp, Homo sapiens
agtattttttgtttt

SEQ ID NO: 389484 - DNA, 15 bp, Homo sapiens
gtattttttgttttg

SEQ ID NO: 389485 - DNA, 15 bp, Homo sapiens
tattttttgttttgc

SEQ ID NO: 389486 - DNA, 15 bp, Homo sapiens
attttttgttttgct

SEQ ID NO: 389487 - DNA, 15 bp, Homo sapiens
ttttttgttttgctt

SEQ ID NO: 389488 - DNA, 15 bp, Homo sapiens
tttttgttttgcttt

SEQ ID NO: 389489 - DNA, 15 bp, Homo sapiens
ttttgttttgcttta

SEQ ID NO: 389490 - DNA, 15 bp, Homo sapiens
tttgttttgctttat

SEQ ID NO: 389491 - DNA, 15 bp, Homo sapiens
ttgttttgctttatt

SEQ ID NO: 389492 - DNA, 15 bp, Homo sapiens
tgttttgctttattt

SEQ ID NO: 389493 - DNA, 15 bp, Homo sapiens
gttttgctttatttt

SEQ ID NO: 389494 - DNA, 15 bp, Homo sapiens
ttttgctttattttt

SEQ ID NO: 389495 - DNA, 15 bp, Homo sapiens
tttgctttatttttg

SEQ ID NO: 389496 - DNA, 15 bp, Homo sapiens
ttgctttatttttgt

SEQ ID NO: 389497 - DNA, 15 bp, Homo sapiens
tgctttatttttgtt

SEQ ID NO: 389498 - DNA, 15 bp, Homo sapiens
gctttatttttgttg

SEQ ID NO: 389499 - DNA, 15 bp, Homo sapiens
ctttatttttgttgt

SEQ ID NO: 389500 - DNA, 15 bp, Homo sapiens
tttatttttgttgtt

SEQ ID NO: 389501 - DNA, 15 bp, Homo sapiens
ttatttttgttgttt

SEQ ID NO: 389502 - DNA, 15 bp, Homo sapiens
tatttttgttgtttt

SEQ ID NO: 389503 - DNA, 15 bp, Homo sapiens
atttttgttgttttg

SEQ ID NO: 389504 - DNA, 15 bp, Homo sapiens
tttttgttgttttgt

SEQ ID NO: 389505 - DNA, 15 bp, Homo sapiens
ttttgttgttttgtt

SEQ ID NO: 389506 - DNA, 15 bp, Homo sapiens
tttgttgttttgttt

SEQ ID NO: 389507 - DNA, 15 bp, Homo sapiens
ttgttgttttgtttt

SEQ ID NO: 389508 - DNA, 15 bp, Homo sapiens
tgttgttttgttttg

SEQ ID NO: 389509 - DNA, 15 bp, Homo sapiens
gttgttttgttttgt

SEQ ID NO: 389510 - DNA, 15 bp, Homo sapiens
ttttgttttgtttta

SEQ ID NO: 389511 - DNA, 15 bp, Homo sapiens
tttgttttgttttag

SEQ ID NO: 389512 - DNA, 15 bp, Homo sapiens
ttgttttgttttagg

SEQ ID NO: 389513 - DNA, 15 bp, Homo sapiens
tgttttgttttaggt

SEQ ID NO: 389514 - DNA, 15 bp, Homo sapiens
gttttgttttaggtg

SEQ ID NO: 389515 - DNA, 15 bp, Homo sapiens
ttttgttttaggtga

SEQ ID NO: 389516 - DNA, 15 bp, Homo sapiens
tttgttttaggtgat

SEQ ID NO: 389517 - DNA, 15 bp, Homo sapiens
ttgttttaggtgatt

SEQ ID NO: 389518 - DNA, 15 bp, Homo sapiens
tgttttaggtgattt

SEQ ID NO: 389519 - DNA, 15 bp, Homo sapiens
gttttaggtgatttt

SEQ ID NO: 389520 - DNA, 15 bp, Homo sapiens
ttttaggtgattttg

SEQ ID NO: 389521 - DNA, 15 bp, Homo sapiens
tttaggtgattttgg

SEQ ID NO: 389522 - DNA, 15 bp, Homo sapiens
ttaggtgattttggg

SEQ ID NO: 389523 - DNA, 15 bp, Homo sapiens
taggtgattttgggc

SEQ ID NO: 389524 - DNA, 15 bp, Homo sapiens
aggtgattttgggct

SEQ ID NO: 389525 - DNA, 15 bp, Homo sapiens
ggtgattttgggctg

SEQ ID NO: 389526 - DNA, 15 bp, Homo sapiens
gtgattttgggctga

SEQ ID NO: 389527 - DNA, 15 bp, Homo sapiens
tgattttgggctgag

SEQ ID NO: 389528 - DNA, 15 bp, Homo sapiens
gattttgggctgaga

SEQ ID NO: 389529 - DNA, 15 bp, Homo sapiens
attttgggctgagat

SEQ ID NO: 389530 - DNA, 15 bp, Homo sapiens
ttttgggctgagatc

SEQ ID NO: 389531 - DNA, 15 bp, Homo sapiens
tttgggctgagatct

SEQ ID NO: 389532 - DNA, 15 bp, Homo sapiens
ttgggctgagatctg

SEQ ID NO: 389533 - DNA, 15 bp, Homo sapiens
tgggctgagatctgt

SEQ ID NO: 389534 - DNA, 15 bp, Homo sapiens
gggctgagatctgtc

SEQ ID NO: 389535 - DNA, 15 bp, Homo sapiens
ggctgagatctgtct

SEQ ID NO: 389536 - DNA, 15 bp, Homo sapiens
gctgagatctgtctg

SEQ ID NO: 389537 - DNA, 15 bp, Homo sapiens
ctgagatctgtctgg

SEQ ID NO: 389538 - DNA, 15 bp, Homo sapiens
tgagatctgtctggg

SEQ ID NO: 389539 - DNA, 15 bp, Homo sapiens
gagatctgtctgggg

SEQ ID NO: 389540 - DNA, 15 bp, Homo sapiens
agatctgtctggggg

SEQ ID NO: 389541 - DNA, 15 bp, Homo sapiens
gatctgtctgggggt

SEQ ID NO: 389542 - DNA, 15 bp, Homo sapiens
atctgtctgggggtg

SEQ ID NO: 389543 - DNA, 15 bp, Homo sapiens
tctgtctgggggtga

SEQ ID NO: 389544 - DNA, 15 bp, Homo sapiens
ctgtctgggggtgat

SEQ ID NO: 389545 - DNA, 15 bp, Homo sapiens
tgtctgggggtgatt

SEQ ID NO: 389546 - DNA, 15 bp, Homo sapiens
gtctgggggtgattt

SEQ ID NO: 389547 - DNA, 15 bp, Homo sapiens
tctgggggtgatttt

SEQ ID NO: 389548 - DNA, 15 bp, Homo sapiens
ctgggggtgattttt

SEQ ID NO: 389549 - DNA, 15 bp, Homo sapiens
tgggggtgatttttt

SEQ ID NO: 389550 - DNA, 15 bp, Homo sapiens
gggggtgatttttta

SEQ ID NO: 389551 - DNA, 15 bp, Homo sapiens
ggggtgattttttag

SEQ ID NO: 389552 - DNA, 15 bp, Homo sapiens
gggtgattttttagc

SEQ ID NO: 389553 - DNA, 15 bp, Homo sapiens
ggtgattttttagca

SEQ ID NO: 389554 - DNA, 15 bp, Homo sapiens
gtgattttttagcac

SEQ ID NO: 389555 - DNA, 15 bp, Homo sapiens
tgattttttagcact

SEQ ID NO: 389556 - DNA, 15 bp, Homo sapiens
gattttttagcactt

SEQ ID NO: 389557 - DNA, 15 bp, Homo sapiens
attttttagcactta

SEQ ID NO: 389558 - DNA, 15 bp, Homo sapiens
ttttttagcacttaa

SEQ ID NO: 389559 - DNA, 15 bp, Homo sapiens
tttttagcacttaat

SEQ ID NO: 389560 - DNA, 15 bp, Homo sapiens
ttttagcacttaatg

SEQ ID NO: 389561 - DNA, 15 bp, Homo sapiens
tttagcacttaatgt

SEQ ID NO: 389562 - DNA, 15 bp, Homo sapiens
ttagcacttaatgta

SEQ ID NO: 389563 - DNA, 15 bp, Homo sapiens
tagcacttaatgtat

SEQ ID NO: 389564 - DNA, 15 bp, Homo sapiens
agcacttaatgtatg

SEQ ID NO: 389565 - DNA, 15 bp, Homo sapiens
gcacttaatgtatgg

SEQ ID NO: 389566 - DNA, 15 bp, Homo sapiens
cacttaatgtatggg

SEQ ID NO: 389567 - DNA, 15 bp, Homo sapiens
acttaatgtatgggc

SEQ ID NO: 389568 - DNA, 15 bp, Homo sapiens
cttaatgtatgggct

SEQ ID NO: 389569 - DNA, 15 bp, Homo sapiens
ttaatgtatgggctg

SEQ ID NO: 389570 - DNA, 15 bp, Homo sapiens
taatgtatgggctgt

SEQ ID NO: 389571 - DNA, 15 bp, Homo sapiens
aatgtatgggctgtt

SEQ ID NO: 389572 - DNA, 15 bp, Homo sapiens
atgtatgggctgttg

SEQ ID NO: 389573 - DNA, 15 bp, Homo sapiens
tgtatgggctgttgt

SEQ ID NO: 389574 - DNA, 15 bp, Homo sapiens
gtatgggctgttgtc

SEQ ID NO: 389575 - DNA, 15 bp, Homo sapiens
tatgggctgttgtca

SEQ ID NO: 389576 - DNA, 15 bp, Homo sapiens
atgggctgttgtcat

SEQ ID NO: 389577 - DNA, 15 bp, Homo sapiens
tgggctgttgtcatc

SEQ ID NO: 389578 - DNA, 15 bp, Homo sapiens
gggctgttgtcatca

SEQ ID NO: 389579 - DNA, 15 bp, Homo sapiens
ggctgttgtcatcag

SEQ ID NO: 389580 - DNA, 15 bp, Homo sapiens
gctgttgtcatcaga

SEQ ID NO: 389581 - DNA, 15 bp, Homo sapiens
ctgttgtcatcagag

SEQ ID NO: 389582 - DNA, 15 bp, Homo sapiens
tgttgtcatcagagt

SEQ ID NO: 389583 - DNA, 15 bp, Homo sapiens
gttgtcatcagagtc

SEQ ID NO: 389584 - DNA, 15 bp, Homo sapiens
ttgtcatcagagtca

SEQ ID NO: 389585 - DNA, 15 bp, Homo sapiens
tgtcatcagagtcag

SEQ ID NO: 389586 - DNA, 15 bp, Homo sapiens
gtcatcagagtcagg

SEQ ID NO: 389587 - DNA, 15 bp, Homo sapiens
tcatcagagtcaggt

SEQ ID NO: 389588 - DNA, 15 bp, Homo sapiens
catcagagtcaggtg

SEQ ID NO: 389589 - DNA, 15 bp, Homo sapiens
atcagagtcaggtgt

SEQ ID NO: 389590 - DNA, 15 bp, Homo sapiens
tcagagtcaggtgta

SEQ ID NO: 389591 - DNA, 15 bp, Homo sapiens
cagagtcaggtgtac

SEQ ID NO: 389592 - DNA, 15 bp, Homo sapiens
agagtcaggtgtacc

SEQ ID NO: 389593 - DNA, 15 bp, Homo sapiens
gagtcaggtgtaccc

SEQ ID NO: 389594 - DNA, 15 bp, Homo sapiens
agtcaggtgtaccct

SEQ ID NO: 389595 - DNA, 15 bp, Homo sapiens
gtcaggtgtaccctt

SEQ ID NO: 389596 - DNA, 15 bp, Homo sapiens
tcaggtgtacccttc

SEQ ID NO: 389597 - DNA, 15 bp, Homo sapiens
caggtgtacccttct

SEQ ID NO: 389598 - DNA, 15 bp, Homo sapiens
aggtgtacccttctg

SEQ ID NO: 389599 - DNA, 15 bp, Homo sapiens
ggtgtacccttctgc

SEQ ID NO: 389600 - DNA, 15 bp, Homo sapiens
gtgtacccttctgct

SEQ ID NO: 389601 - DNA, 15 bp, Homo sapiens
tgtacccttctgctc

SEQ ID NO: 389602 - DNA, 15 bp, Homo sapiens
gtacccttctgctct

SEQ ID NO: 389603 - DNA, 15 bp, Homo sapiens
tacccttctgctctt

SEQ ID NO: 389604 - DNA, 15 bp, Homo sapiens
acccttctgctcttc

SEQ ID NO: 389605 - DNA, 15 bp, Homo sapiens
cccttctgctcttct

SEQ ID NO: 389606 - DNA, 15 bp, Homo sapiens
cttctgctcttctca

SEQ ID NO: 389607 - DNA, 15 bp, Homo sapiens
ttctgctcttctcaa

SEQ ID NO: 389608 - DNA, 15 bp, Homo sapiens
tctgctcttctcaag

SEQ ID NO: 389609 - DNA, 15 bp, Homo sapiens
ctgctcttctcaaga

SEQ ID NO: 389610 - DNA, 15 bp, Homo sapiens
tgctcttctcaagat

SEQ ID NO: 389611 - DNA, 15 bp, Homo sapiens
gctcttctcaagatt

SEQ ID NO: 389612 - DNA, 15 bp, Homo sapiens
ctcttctcaagattt

SEQ ID NO: 389613 - DNA, 15 bp, Homo sapiens
tcttctcaagattta

SEQ ID NO: 389614 - DNA, 15 bp, Homo sapiens
cttctcaagatttat

SEQ ID NO: 389615 - DNA, 15 bp, Homo sapiens
ttctcaagatttata

SEQ ID NO: 389616 - DNA, 15 bp, Homo sapiens
tctcaagatttataa

SEQ ID NO: 389617 - DNA, 15 bp, Homo sapiens
ctcaagatttataac

SEQ ID NO: 389618 - DNA, 15 bp, Homo sapiens
tcaagatttataaca

SEQ ID NO: 389619 - DNA, 15 bp, Homo sapiens
caagatttataacag

SEQ ID NO: 389620 - DNA, 15 bp, Homo sapiens
aagatttataacagg

SEQ ID NO: 389621 - DNA, 15 bp, Homo sapiens
agatttataacaggg

SEQ ID NO: 389622 - DNA, 15 bp, Homo sapiens
gatttataacagggt

SEQ ID NO: 389623 - DNA, 15 bp, Homo sapiens
atttataacagggtc

SEQ ID NO: 389624 - DNA, 15 bp, Homo sapiens
tttataacagggtct

SEQ ID NO: 389625 - DNA, 15 bp, Homo sapiens
ttataacagggtctc

SEQ ID NO: 389626 - DNA, 15 bp, Homo sapiens
tataacagggtctcc

SEQ ID NO: 389627 - DNA, 15 bp, Homo sapiens
ataacagggtctcct

SEQ ID NO: 389628 - DNA, 15 bp, Homo sapiens
taacagggtctcctg

SEQ ID NO: 389629 - DNA, 15 bp, Homo sapiens
aacagggtctcctgt

SEQ ID NO: 389630 - DNA, 15 bp, Homo sapiens
acagggtctcctgtt

SEQ ID NO: 389631 - DNA, 15 bp, Homo sapiens
cagggtctcctgttc

SEQ ID NO: 389632 - DNA, 15 bp, Homo sapiens
agggtctcctgttca

SEQ ID NO: 389633 - DNA, 15 bp, Homo sapiens
gggtctcctgttcac

SEQ ID NO: 389634 - DNA, 15 bp, Homo sapiens
ggtctcctgttcact

SEQ ID NO: 389635 - DNA, 15 bp, Homo sapiens
gtctcctgttcacta

SEQ ID NO: 389636 - DNA, 15 bp, Homo sapiens
tctcctgttcactaa

SEQ ID NO: 389637 - DNA, 15 bp, Homo sapiens
ctcctgttcactaat

SEQ ID NO: 389638 - DNA, 15 bp, Homo sapiens
tcctgttcactaatt

SEQ ID NO: 389639 - DNA, 15 bp, Homo sapiens
cctgttcactaattc

SEQ ID NO: 389640 - DNA, 15 bp, Homo sapiens
ctgttcactaattca

SEQ ID NO: 389641 - DNA, 15 bp, Homo sapiens
tgttcactaattcac

SEQ ID NO: 389642 - DNA, 15 bp, Homo sapiens
gttcactaattcaca

SEQ ID NO: 389643 - DNA, 15 bp, Homo sapiens
ttcactaattcacag

SEQ ID NO: 389644 - DNA, 15 bp, Homo sapiens
tcactaattcacaga

SEQ ID NO: 389645 - DNA, 15 bp, Homo sapiens
cactaattcacagag

SEQ ID NO: 389646 - DNA, 15 bp, Homo sapiens
actaattcacagagc

SEQ ID NO: 389647 - DNA, 15 bp, Homo sapiens
ctaattcacagagca

SEQ ID NO: 389648 - DNA, 15 bp, Homo sapiens
taattcacagagcac

SEQ ID NO: 389649 - DNA, 15 bp, Homo sapiens
aattcacagagcaca

SEQ ID NO: 389650 - DNA, 15 bp, Homo sapiens
attcacagagcacag

SEQ ID NO: 389651 - DNA, 15 bp, Homo sapiens
ttcacagagcacagc

SEQ ID NO: 389652 - DNA, 15 bp, Homo sapiens
tcacagagcacagct

SEQ ID NO: 389653 - DNA, 15 bp, Homo sapiens
cacagagcacagcta

SEQ ID NO: 389654 - DNA, 15 bp, Homo sapiens
acagagcacagctag

SEQ ID NO: 389655 - DNA, 15 bp, Homo sapiens
cagagcacagctaga

SEQ ID NO: 389656 - DNA, 15 bp, Homo sapiens
agagcacagctagag

SEQ ID NO: 389657 - DNA, 15 bp, Homo sapiens
gagcacagctagagc

SEQ ID NO: 389658 - DNA, 15 bp, Homo sapiens
agcacagctagagct

SEQ ID NO: 389659 - DNA, 15 bp, Homo sapiens
gcacagctagagctg

SEQ ID NO: 389660 - DNA, 15 bp, Homo sapiens
cacagctagagctgc

SEQ ID NO: 389661 - DNA, 15 bp, Homo sapiens
acagctagagctgca

SEQ ID NO: 389662 - DNA, 15 bp, Homo sapiens
cagctagagctgcat

SEQ ID NO: 389663 - DNA, 15 bp, Homo sapiens
agctagagctgcatt

SEQ ID NO: 389664 - DNA, 15 bp, Homo sapiens
gctagagctgcattt

SEQ ID NO: 389665 - DNA, 15 bp, Homo sapiens
ctagagctgcattta

SEQ ID NO: 389666 - DNA, 15 bp, Homo sapiens
tagagctgcatttat

SEQ ID NO: 389667 - DNA, 15 bp, Homo sapiens
agagctgcatttatt

SEQ ID NO: 389668 - DNA, 15 bp, Homo sapiens
gagctgcatttattg

SEQ ID NO: 389669 - DNA, 15 bp, Homo sapiens
agctgcatttattgg

SEQ ID NO: 389670 - DNA, 15 bp, Homo sapiens
gctgcatttattggg

SEQ ID NO: 389671 - DNA, 15 bp, Homo sapiens
ctgcatttattgggt

SEQ ID NO: 389672 - DNA, 15 bp, Homo sapiens
tgcatttattgggta

SEQ ID NO: 389673 - DNA, 15 bp, Homo sapiens
gcatttattgggtag

SEQ ID NO: 389674 - DNA, 15 bp, Homo sapiens
catttattgggtagt

SEQ ID NO: 389675 - DNA, 15 bp, Homo sapiens
atttattgggtagtg

SEQ ID NO: 389676 - DNA, 15 bp, Homo sapiens
tttattgggtagtga

SEQ ID NO: 389677 - DNA, 15 bp, Homo sapiens
ttattgggtagtgaa

SEQ ID NO: 389678 - DNA, 15 bp, Homo sapiens
tattgggtagtgaac

SEQ ID NO: 389679 - DNA, 15 bp, Homo sapiens
attgggtagtgaaca

SEQ ID NO: 389680 - DNA, 15 bp, Homo sapiens
ttgggtagtgaacat

SEQ ID NO: 389681 - DNA, 15 bp, Homo sapiens
tgggtagtgaacata

SEQ ID NO: 389682 - DNA, 15 bp, Homo sapiens
gggtagtgaacatat

SEQ ID NO: 389683 - DNA, 15 bp, Homo sapiens
ggtagtgaacatatc

SEQ ID NO: 389684 - DNA, 15 bp, Homo sapiens
gtagtgaacatatcc

SEQ ID NO: 389685 - DNA, 15 bp, Homo sapiens
tagtgaacatatccc

SEQ ID NO: 389686 - DNA, 15 bp, Homo sapiens
agtgaacatatccct

SEQ ID NO: 389687 - DNA, 15 bp, Homo sapiens
gtgaacatatccctc

SEQ ID NO: 389688 - DNA, 15 bp, Homo sapiens
tgaacatatccctct

SEQ ID NO: 389689 - DNA, 15 bp, Homo sapiens
gaacatatccctctt

SEQ ID NO: 389690 - DNA, 15 bp, Homo sapiens
aacatatccctcttt

SEQ ID NO: 389691 - DNA, 15 bp, Homo sapiens
acatatccctcttta

SEQ ID NO: 389692 - DNA, 15 bp, Homo sapiens
catatccctctttag

SEQ ID NO: 389693 - DNA, 15 bp, Homo sapiens
atatccctctttaga

SEQ ID NO: 389694 - DNA, 15 bp, Homo sapiens
tatccctctttagag

SEQ ID NO: 389695 - DNA, 15 bp, Homo sapiens
atccctctttagaga

SEQ ID NO: 389696 - DNA, 15 bp, Homo sapiens
tccctctttagagac

SEQ ID NO: 389697 - DNA, 15 bp, Homo sapiens
ccctctttagagacg

SEQ ID NO: 389698 - DNA, 15 bp, Homo sapiens
cctctttagagacgg

SEQ ID NO: 389699 - DNA, 15 bp, Homo sapiens
ctctttagagacggt

SEQ ID NO: 389700 - DNA, 15 bp, Homo sapiens
tctttagagacggtg

SEQ ID NO: 389701 - DNA, 15 bp, Homo sapiens
ctttagagacggtga

SEQ ID NO: 389702 - DNA, 15 bp, Homo sapiens
tttagagacggtgaa

SEQ ID NO: 389703 - DNA, 15 bp, Homo sapiens
ttagagacggtgaat

SEQ ID NO: 389704 - DNA, 15 bp, Homo sapiens
tagagacggtgaatg

SEQ ID NO: 389705 - DNA, 15 bp, Homo sapiens
agagacggtgaatgc

SEQ ID NO: 389706 - DNA, 15 bp, Homo sapiens
gagacggtgaatgct

SEQ ID NO: 389707 - DNA, 15 bp, Homo sapiens
agacggtgaatgctc

SEQ ID NO: 389708 - DNA, 15 bp, Homo sapiens
gacggtgaatgctct

SEQ ID NO: 389709 - DNA, 15 bp, Homo sapiens
acggtgaatgctctg

SEQ ID NO: 389710 - DNA, 15 bp, Homo sapiens
cggtgaatgctctgt

SEQ ID NO: 389711 - DNA, 15 bp, Homo sapiens
ggtgaatgctctgtt

SEQ ID NO: 389712 - DNA, 15 bp, Homo sapiens
gtgaatgctctgttc

SEQ ID NO: 389713 - DNA, 15 bp, Homo sapiens
tgaatgctctgttct

SEQ ID NO: 389714 - DNA, 15 bp, Homo sapiens
gaatgctctgttctc

SEQ ID NO: 389715 - DNA, 15 bp, Homo sapiens
aatgctctgttctct

SEQ ID NO: 389716 - DNA, 15 bp, Homo sapiens
atgctctgttctctc

SEQ ID NO: 389717 - DNA, 15 bp, Homo sapiens
tgctctgttctctct

SEQ ID NO: 389718 - DNA, 15 bp, Homo sapiens
gctctgttctctctt

SEQ ID NO: 389719 - DNA, 15 bp, Homo sapiens
ctctgttctctctta

SEQ ID NO: 389720 - DNA, 15 bp, Homo sapiens
tctgttctctcttaa

SEQ ID NO: 389721 - DNA, 15 bp, Homo sapiens
ctgttctctcttaat

SEQ ID NO: 389722 - DNA, 15 bp, Homo sapiens
tgttctctcttaata

SEQ ID NO: 389723 - DNA, 15 bp, Homo sapiens
gttctctcttaatag

SEQ ID NO: 389724 - DNA, 15 bp, Homo sapiens
ttctctcttaataga

SEQ ID NO: 389725 - DNA, 15 bp, Homo sapiens
tctctcttaatagaa

SEQ ID NO: 389726 - DNA, 15 bp, Homo sapiens
ctctcttaatagaaa

SEQ ID NO: 389727 - DNA, 15 bp, Homo sapiens
tctcttaatagaaac

SEQ ID NO: 389728 - DNA, 15 bp, Homo sapiens
ctcttaatagaaacc

SEQ ID NO: 389729 - DNA, 15 bp, Homo sapiens
tcttaatagaaacca

SEQ ID NO: 389730 - DNA, 15 bp, Homo sapiens
cttaatagaaaccag

SEQ ID NO: 389731 - DNA, 15 bp, Homo sapiens
ttaatagaaaccagc

SEQ ID NO: 389732 - DNA, 15 bp, Homo sapiens
taatagaaaccagct

SEQ ID NO: 389733 - DNA, 15 bp, Homo sapiens
aatagaaaccagcta

SEQ ID NO: 389734 - DNA, 15 bp, Homo sapiens
atagaaaccagctac

SEQ ID NO: 389735 - DNA, 15 bp, Homo sapiens
tagaaaccagctaca

SEQ ID NO: 389736 - DNA, 15 bp, Homo sapiens
agaaaccagctacag

SEQ ID NO: 389737 - DNA, 15 bp, Homo sapiens
gaaaccagctacagg

SEQ ID NO: 389738 - DNA, 15 bp, Homo sapiens
aaaccagctacaggg

SEQ ID NO: 389739 - DNA, 15 bp, Homo sapiens
aaccagctacagggc

SEQ ID NO: 389740 - DNA, 15 bp, Homo sapiens
accagctacagggca

SEQ ID NO: 389741 - DNA, 15 bp, Homo sapiens
ccagctacagggcat

SEQ ID NO: 389742 - DNA, 15 bp, Homo sapiens
cagctacagggcatg

SEQ ID NO: 389743 - DNA, 15 bp, Homo sapiens
agctacagggcatgc

SEQ ID NO: 389744 - DNA, 15 bp, Homo sapiens
gctacagggcatgca

SEQ ID NO: 389745 - DNA, 15 bp, Homo sapiens
ctacagggcatgcac

SEQ ID NO: 389746 - DNA, 15 bp, Homo sapiens
tacagggcatgcacc

SEQ ID NO: 389747 - DNA, 15 bp, Homo sapiens
acagggcatgcaccg

SEQ ID NO: 389748 - DNA, 15 bp, Homo sapiens
cagggcatgcaccgt

SEQ ID NO: 389749 - DNA, 15 bp, Homo sapiens
agggcatgcaccgtg

SEQ ID NO: 389750 - DNA, 15 bp, Homo sapiens
gggcatgcaccgtgg

SEQ ID NO: 389751 - DNA, 15 bp, Homo sapiens
ggcatgcaccgtggt

SEQ ID NO: 389752 - DNA, 15 bp, Homo sapiens
gcatgcaccgtggtg

SEQ ID NO: 389753 - DNA, 15 bp, Homo sapiens
catgcaccgtggtgg

SEQ ID NO: 389754 - DNA, 15 bp, Homo sapiens
atgcaccgtggtggt

SEQ ID NO: 389755 - DNA, 15 bp, Homo sapiens
tgcaccgtggtggtg

SEQ ID NO: 389756 - DNA, 15 bp, Homo sapiens
gcaccgtggtggtgg

SEQ ID NO: 389757 - DNA, 15 bp, Homo sapiens
caccgtggtggtggc

SEQ ID NO: 389758 - DNA, 15 bp, Homo sapiens
accgtggtggtggca

SEQ ID NO: 389759 - DNA, 15 bp, Homo sapiens
ccgtggtggtggcag

SEQ ID NO: 389760 - DNA, 15 bp, Homo sapiens
cgtggtggtggcagt

SEQ ID NO: 389761 - DNA, 15 bp, Homo sapiens
gtggtggtggcagtg

SEQ ID NO: 389762 - DNA, 15 bp, Homo sapiens
tggtggtggcagtga

SEQ ID NO: 389763 - DNA, 15 bp, Homo sapiens
ggtggtggcagtgat

SEQ ID NO: 389764 - DNA, 15 bp, Homo sapiens
gtggtggcagtgata

SEQ ID NO: 389765 - DNA, 15 bp, Homo sapiens
tggtggcagtgatat

SEQ ID NO: 389766 - DNA, 15 bp, Homo sapiens
ggtggcagtgatatg

SEQ ID NO: 389767 - DNA, 15 bp, Homo sapiens
gtggcagtgatatgt

SEQ ID NO: 389768 - DNA, 15 bp, Homo sapiens
tggcagtgatatgtt

SEQ ID NO: 389769 - DNA, 15 bp, Homo sapiens
ggcagtgatatgttg

SEQ ID NO: 389770 - DNA, 15 bp, Homo sapiens
gcagtgatatgttga

SEQ ID NO: 389771 - DNA, 15 bp, Homo sapiens
cagtgatatgttgaa

SEQ ID NO: 389772 - DNA, 15 bp, Homo sapiens
agtgatatgttgaat

SEQ ID NO: 389773 - DNA, 15 bp, Homo sapiens
gtgatatgttgaatc

SEQ ID NO: 389774 - DNA, 15 bp, Homo sapiens
tgatatgttgaatcc

SEQ ID NO: 389775 - DNA, 15 bp, Homo sapiens
gatatgttgaatccc

SEQ ID NO: 389776 - DNA, 15 bp, Homo sapiens
atatgttgaatccct

SEQ ID NO: 389777 - DNA, 15 bp, Homo sapiens
tatgttgaatccctg

SEQ ID NO: 389778 - DNA, 15 bp, Homo sapiens
atgttgaatccctgt

SEQ ID NO: 389779 - DNA, 15 bp, Homo sapiens
tgttgaatccctgtt

SEQ ID NO: 389780 - DNA, 15 bp, Homo sapiens
gttgaatccctgttc

SEQ ID NO: 389781 - DNA, 15 bp, Homo sapiens
ttgaatccctgttcc

SEQ ID NO: 389782 - DNA, 15 bp, Homo sapiens
tgaatccctgttccc

SEQ ID NO: 389783 - DNA, 15 bp, Homo sapiens
gaatccctgttccca

SEQ ID NO: 389784 - DNA, 15 bp, Homo sapiens
aatccctgttcccag

SEQ ID NO: 389785 - DNA, 15 bp, Homo sapiens
atccctgttcccagg

SEQ ID NO: 389786 - DNA, 15 bp, Homo sapiens
tccctgttcccaggg

SEQ ID NO: 389787 - DNA, 15 bp, Homo sapiens
ccctgttcccagggg

SEQ ID NO: 389788 - DNA, 15 bp, Homo sapiens
cctgttcccagggga

SEQ ID NO: 389789 - DNA, 15 bp, Homo sapiens
ctgttcccaggggat

SEQ ID NO: 389790 - DNA, 15 bp, Homo sapiens
tgttcccaggggatg

SEQ ID NO: 389791 - DNA, 15 bp, Homo sapiens
gttcccaggggatgt

SEQ ID NO: 389792 - DNA, 15 bp, Homo sapiens
ttcccaggggatgtc

SEQ ID NO: 389793 - DNA, 15 bp, Homo sapiens
tcccaggggatgtcc

SEQ ID NO: 389794 - DNA, 15 bp, Homo sapiens
cccaggggatgtccg

SEQ ID NO: 389795 - DNA, 15 bp, Homo sapiens
ccaggggatgtccgc

SEQ ID NO: 389796 - DNA, 15 bp, Homo sapiens
caggggatgtccgct

SEQ ID NO: 389797 - DNA, 15 bp, Homo sapiens
aggggatgtccgctt

SEQ ID NO: 389798 - DNA, 15 bp, Homo sapiens
ggggatgtccgcttt

SEQ ID NO: 389799 - DNA, 15 bp, Homo sapiens
gggatgtccgctttc

SEQ ID NO: 389800 - DNA, 15 bp, Homo sapiens
ggatgtccgctttct

SEQ ID NO: 389801 - DNA, 15 bp, Homo sapiens
gatgtccgctttcta

SEQ ID NO: 389802 - DNA, 15 bp, Homo sapiens
atgtccgctttctat

SEQ ID NO: 389803 - DNA, 15 bp, Homo sapiens
tgtccgctttctatc

SEQ ID NO: 389804 - DNA, 15 bp, Homo sapiens
gtccgctttctatct

SEQ ID NO: 389805 - DNA, 15 bp, Homo sapiens
tccgctttctatctg

SEQ ID NO: 389806 - DNA, 15 bp, Homo sapiens
ccgctttctatctgc

SEQ ID NO: 389807 - DNA, 15 bp, Homo sapiens
cgctttctatctgca

SEQ ID NO: 389808 - DNA, 15 bp, Homo sapiens
gctttctatctgcag

SEQ ID NO: 389809 - DNA, 15 bp, Homo sapiens
ctttctatctgcagc

SEQ ID NO: 389810 - DNA, 15 bp, Homo sapiens
tttctatctgcagct

SEQ ID NO: 389811 - DNA, 15 bp, Homo sapiens
ttctatctgcagctt

SEQ ID NO: 389812 - DNA, 15 bp, Homo sapiens
tctatctgcagcttt

SEQ ID NO: 389813 - DNA, 15 bp, Homo sapiens
ctatctgcagcttta

SEQ ID NO: 389814 - DNA, 15 bp, Homo sapiens
tatctgcagctttaa

SEQ ID NO: 389815 - DNA, 15 bp, Homo sapiens
atctgcagctttaat

SEQ ID NO: 389816 - DNA, 15 bp, Homo sapiens
tctgcagctttaatg

SEQ ID NO: 389817 - DNA, 15 bp, Homo sapiens
ctgcagctttaatgt

SEQ ID NO: 389818 - DNA, 15 bp, Homo sapiens
tgcagctttaatgtt

SEQ ID NO: 389819 - DNA, 15 bp, Homo sapiens
gcagctttaatgttt

SEQ ID NO: 389820 - DNA, 15 bp, Homo sapiens
cagctttaatgtttc

SEQ ID NO: 389821 - DNA, 15 bp, Homo sapiens
agctttaatgtttca

SEQ ID NO: 389822 - DNA, 15 bp, Homo sapiens
gctttaatgtttcac

SEQ ID NO: 389823 - DNA, 15 bp, Homo sapiens
ctttaatgtttcact

SEQ ID NO: 389824 - DNA, 15 bp, Homo sapiens
tttaatgtttcactt

SEQ ID NO: 389825 - DNA, 15 bp, Homo sapiens
ttaatgtttcactta

SEQ ID NO: 389826 - DNA, 15 bp, Homo sapiens
taatgtttcacttaa

SEQ ID NO: 389827 - DNA, 15 bp, Homo sapiens
aatgtttcacttaat

SEQ ID NO: 389828 - DNA, 15 bp, Homo sapiens
atgtttcacttaata

SEQ ID NO: 389829 - DNA, 15 bp, Homo sapiens
tgtttcacttaatat

SEQ ID NO: 389830 - DNA, 15 bp, Homo sapiens
gtttcacttaatatc

SEQ ID NO: 389831 - DNA, 15 bp, Homo sapiens
tttcacttaatatcc

SEQ ID NO: 389832 - DNA, 15 bp, Homo sapiens
ttcacttaatatcct

SEQ ID NO: 389833 - DNA, 15 bp, Homo sapiens
tcacttaatatcctc

SEQ ID NO: 389834 - DNA, 15 bp, Homo sapiens
cacttaatatcctct

SEQ ID NO: 389835 - DNA, 15 bp, Homo sapiens
acttaatatcctctt

SEQ ID NO: 389836 - DNA, 15 bp, Homo sapiens
cttaatatcctcttt

SEQ ID NO: 389837 - DNA, 15 bp, Homo sapiens
ttaatatcctctttg

SEQ ID NO: 389838 - DNA, 15 bp, Homo sapiens
taatatcctctttgg

SEQ ID NO: 389839 - DNA, 15 bp, Homo sapiens
aatatcctctttggc

SEQ ID NO: 389840 - DNA, 15 bp, Homo sapiens
atatcctctttggct

SEQ ID NO: 389841 - DNA, 15 bp, Homo sapiens
tatcctctttggcta

SEQ ID NO: 389842 - DNA, 15 bp, Homo sapiens
atcctctttggctac

SEQ ID NO: 389843 - DNA, 15 bp, Homo sapiens
tcctctttggctact

SEQ ID NO: 389844 - DNA, 15 bp, Homo sapiens
cctctttggctactg

SEQ ID NO: 389845 - DNA, 15 bp, Homo sapiens
ctctttggctactga

SEQ ID NO: 389846 - DNA, 15 bp, Homo sapiens
tctttggctactgag

SEQ ID NO: 389847 - DNA, 15 bp, Homo sapiens
ctttggctactgagc

SEQ ID NO: 389848 - DNA, 15 bp, Homo sapiens
tttggctactgagcg

SEQ ID NO: 389849 - DNA, 15 bp, Homo sapiens
ttggctactgagcgc

SEQ ID NO: 389850 - DNA, 15 bp, Homo sapiens
tggctactgagcgca

SEQ ID NO: 389851 - DNA, 15 bp, Homo sapiens
ggctactgagcgcac

SEQ ID NO: 389852 - DNA, 15 bp, Homo sapiens
gctactgagcgcact

SEQ ID NO: 389853 - DNA, 15 bp, Homo sapiens
ctactgagcgcactc

SEQ ID NO: 389854 - DNA, 15 bp, Homo sapiens
tactgagcgcactcc

SEQ ID NO: 389855 - DNA, 15 bp, Homo sapiens
actgagcgcactcct

SEQ ID NO: 389856 - DNA, 15 bp, Homo sapiens
ctgagcgcactcctc

SEQ ID NO: 389857 - DNA, 15 bp, Homo sapiens
tgagcgcactcctct

SEQ ID NO: 389858 - DNA, 15 bp, Homo sapiens
gagcgcactcctctc

SEQ ID NO: 389859 - DNA, 15 bp, Homo sapiens
agcgcactcctctcc

SEQ ID NO: 389860 - DNA, 15 bp, Homo sapiens
gcgcactcctctccc

SEQ ID NO: 389861 - DNA, 15 bp, Homo sapiens
cgcactcctctcccg

SEQ ID NO: 389862 - DNA, 15 bp, Homo sapiens
gcactcctctcccgc

SEQ ID NO: 389863 - DNA, 15 bp, Homo sapiens
cactcctctcccgca

SEQ ID NO: 389864 - DNA, 15 bp, Homo sapiens
actcctctcccgcag

SEQ ID NO: 389865 - DNA, 15 bp, Homo sapiens
ctcctctcccgcagc

SEQ ID NO: 389866 - DNA, 15 bp, Homo sapiens
tcctctcccgcagcc

SEQ ID NO: 389867 - DNA, 15 bp, Homo sapiens
cctctcccgcagccg

SEQ ID NO: 389868 - DNA, 15 bp, Homo sapiens
ctctcccgcagccgg

SEQ ID NO: 389869 - DNA, 15 bp, Homo sapiens
tctcccgcagccggc

SEQ ID NO: 389870 - DNA, 15 bp, Homo sapiens
ctcccgcagccggca

SEQ ID NO: 389871 - DNA, 15 bp, Homo sapiens
tcccgcagccggcag

SEQ ID NO: 389872 - DNA, 15 bp, Homo sapiens
cccgcagccggcagc

SEQ ID NO: 389873 - DNA, 15 bp, Homo sapiens
ccgcagccggcagcg

SEQ ID NO: 389874 - DNA, 15 bp, Homo sapiens
cgcagccggcagcgc

SEQ ID NO: 389875 - DNA, 15 bp, Homo sapiens
gcagccggcagcgct

SEQ ID NO: 389876 - DNA, 15 bp, Homo sapiens
cagccggcagcgctt

SEQ ID NO: 389877 - DNA, 15 bp, Homo sapiens
agccggcagcgcttg

SEQ ID NO: 389878 - DNA, 15 bp, Homo sapiens
gccggcagcgcttgg

SEQ ID NO: 389879 - DNA, 15 bp, Homo sapiens
ccggcagcgcttggc

SEQ ID NO: 389880 - DNA, 15 bp, Homo sapiens
cggcagcgcttggct

SEQ ID NO: 389881 - DNA, 15 bp, Homo sapiens
ggcagcgcttggctg

SEQ ID NO: 389882 - DNA, 15 bp, Homo sapiens
gcagcgcttggctgc

SEQ ID NO: 389883 - DNA, 15 bp, Homo sapiens
cagcgcttggctgct

SEQ ID NO: 389884 - DNA, 15 bp, Homo sapiens
agcgcttggctgctc

SEQ ID NO: 389885 - DNA, 15 bp, Homo sapiens
gcgcttggctgctcg

SEQ ID NO: 389886 - DNA, 15 bp, Homo sapiens
cgcttggctgctcga

SEQ ID NO: 389887 - DNA, 15 bp, Homo sapiens
gcttggctgctcgac

SEQ ID NO: 389888 - DNA, 15 bp, Homo sapiens
cttggctgctcgaca

SEQ ID NO: 389889 - DNA, 15 bp, Homo sapiens
ttggctgctcgacaa

SEQ ID NO: 389890 - DNA, 15 bp, Homo sapiens
tggctgctcgacaac

SEQ ID NO: 389891 - DNA, 15 bp, Homo sapiens
ggctgctcgacaact

SEQ ID NO: 389892 - DNA, 15 bp, Homo sapiens
gctgctcgacaactt

SEQ ID NO: 389893 - DNA, 15 bp, Homo sapiens
ctgctcgacaacttc

SEQ ID NO: 389894 - DNA, 15 bp, Homo sapiens
tgctcgacaacttcc

SEQ ID NO: 389895 - DNA, 15 bp, Homo sapiens
gctcgacaacttcct

SEQ ID NO: 389896 - DNA, 15 bp, Homo sapiens
ctcgacaacttcctt

SEQ ID NO: 389897 - DNA, 15 bp, Homo sapiens
tcgacaacttccttc

SEQ ID NO: 389898 - DNA, 15 bp, Homo sapiens
cgacaacttccttca

SEQ ID NO: 389899 - DNA, 15 bp, Homo sapiens
gacaacttccttcat

SEQ ID NO: 389900 - DNA, 15 bp, Homo sapiens
acaacttccttcatt

SEQ ID NO: 389901 - DNA, 15 bp, Homo sapiens
caacttccttcattt

SEQ ID NO: 389902 - DNA, 15 bp, Homo sapiens
aacttccttcatttc

SEQ ID NO: 389903 - DNA, 15 bp, Homo sapiens
acttccttcatttct

SEQ ID NO: 389904 - DNA, 15 bp, Homo sapiens
cttccttcatttctg

SEQ ID NO: 389905 - DNA, 15 bp, Homo sapiens
ttccttcatttctgg

SEQ ID NO: 389906 - DNA, 15 bp, Homo sapiens
tccttcatttctggc

SEQ ID NO: 389907 - DNA, 15 bp, Homo sapiens
ccttcatttctggcc

SEQ ID NO: 389908 - DNA, 15 bp, Homo sapiens
cttcatttctggcca

SEQ ID NO: 389909 - DNA, 15 bp, Homo sapiens
ttcatttctggccat

SEQ ID NO: 389910 - DNA, 15 bp, Homo sapiens
tcatttctggccatg

SEQ ID NO: 389911 - DNA, 15 bp, Homo sapiens
catttctggccatgc

SEQ ID NO: 389912 - DNA, 15 bp, Homo sapiens
atttctggccatgcc

SEQ ID NO: 389913 - DNA, 15 bp, Homo sapiens
tttctggccatgccg

SEQ ID NO: 389914 - DNA, 15 bp, Homo sapiens
ttctggccatgccgg

SEQ ID NO: 389915 - DNA, 15 bp, Homo sapiens
tctggccatgccggg

SEQ ID NO: 389916 - DNA, 15 bp, Homo sapiens
ctggccatgccgggc

SEQ ID NO: 389917 - DNA, 15 bp, Homo sapiens
tggccatgccgggct

SEQ ID NO: 389918 - DNA, 15 bp, Homo sapiens
ggccatgccgggctg

SEQ ID NO: 389919 - DNA, 15 bp, Homo sapiens
gccatgccgggctga

SEQ ID NO: 389920 - DNA, 15 bp, Homo sapiens
ccatgccgggctgag

SEQ ID NO: 389921 - DNA, 15 bp, Homo sapiens
catgccgggctgagc

SEQ ID NO: 389922 - DNA, 15 bp, Homo sapiens
atgccgggctgagca

SEQ ID NO: 389923 - DNA, 15 bp, Homo sapiens
tgccgggctgagcaa

SEQ ID NO: 389924 - DNA, 15 bp, Homo sapiens
gccgggctgagcaag

SEQ ID NO: 389925 - DNA, 15 bp, Homo sapiens
ccgggctgagcaagt

SEQ ID NO: 389926 - DNA, 15 bp, Homo sapiens
cgggctgagcaagtg

SEQ ID NO: 389927 - DNA, 15 bp, Homo sapiens
gggctgagcaagtgc

SEQ ID NO: 389928 - DNA, 15 bp, Homo sapiens
ggctgagcaagtgct

SEQ ID NO: 389929 - DNA, 15 bp, Homo sapiens
gctgagcaagtgctg

SEQ ID NO: 389930 - DNA, 15 bp, Homo sapiens
ctgagcaagtgctgc

SEQ ID NO: 389931 - DNA, 15 bp, Homo sapiens
tgagcaagtgctgcc

SEQ ID NO: 389932 - DNA, 15 bp, Homo sapiens
gagcaagtgctgcct

SEQ ID NO: 389933 - DNA, 15 bp, Homo sapiens
agcaagtgctgcctg

SEQ ID NO: 389934 - DNA, 15 bp, Homo sapiens
gcaagtgctgcctgt

SEQ ID NO: 389935 - DNA, 15 bp, Homo sapiens
caagtgctgcctgtg

SEQ ID NO: 389936 - DNA, 15 bp, Homo sapiens
aagtgctgcctgtga

SEQ ID NO: 389937 - DNA, 15 bp, Homo sapiens
agtgctgcctgtgag

SEQ ID NO: 389938 - DNA, 15 bp, Homo sapiens
gtgctgcctgtgagc

SEQ ID NO: 389939 - DNA, 15 bp, Homo sapiens
tgctgcctgtgagca

SEQ ID NO: 389940 - DNA, 15 bp, Homo sapiens
gctgcctgtgagcat

SEQ ID NO: 389941 - DNA, 15 bp, Homo sapiens
ctgcctgtgagcatc

SEQ ID NO: 389942 - DNA, 15 bp, Homo sapiens
tgcctgtgagcatct

SEQ ID NO: 389943 - DNA, 15 bp, Homo sapiens
gcctgtgagcatctg

SEQ ID NO: 389944 - DNA, 15 bp, Homo sapiens
cctgtgagcatctgc

SEQ ID NO: 389945 - DNA, 15 bp, Homo sapiens
ctgtgagcatctgct

SEQ ID NO: 389946 - DNA, 15 bp, Homo sapiens
tgtgagcatctgctg

SEQ ID NO: 389947 - DNA, 15 bp, Homo sapiens
gtgagcatctgctgg

SEQ ID NO: 389948 - DNA, 15 bp, Homo sapiens
tgagcatctgctggg

SEQ ID NO: 389949 - DNA, 15 bp, Homo sapiens
gagcatctgctgggg

SEQ ID NO: 389950 - DNA, 15 bp, Homo sapiens
agcatctgctggggg

SEQ ID NO: 389951 - DNA, 15 bp, Homo sapiens
gcatctgctgggggg

SEQ ID NO: 389952 - DNA, 15 bp, Homo sapiens
catctgctggggggc

SEQ ID NO: 389953 - DNA, 15 bp, Homo sapiens
atctgctggggggct

SEQ ID NO: 389954 - DNA, 15 bp, Homo sapiens
tctgctggggggctt

SEQ ID NO: 389955 - DNA, 15 bp, Homo sapiens
ctgctggggggcttt

SEQ ID NO: 389956 - DNA, 15 bp, Homo sapiens
tgctggggggctttc

SEQ ID NO: 389957 - DNA, 15 bp, Homo sapiens
gctggggggctttct

SEQ ID NO: 389958 - DNA, 15 bp, Homo sapiens
ctggggggctttctc

SEQ ID NO: 389959 - DNA, 15 bp, Homo sapiens
tggggggctttctct

SEQ ID NO: 389960 - DNA, 15 bp, Homo sapiens
ggggggctttctctg

SEQ ID NO: 389961 - DNA, 15 bp, Homo sapiens
gggggctttctctgt

SEQ ID NO: 389962 - DNA, 15 bp, Homo sapiens
ggggctttctctgtg

SEQ ID NO: 389963 - DNA, 15 bp, Homo sapiens
gggctttctctgtgg

SEQ ID NO: 389964 - DNA, 15 bp, Homo sapiens
ggctttctctgtggc

SEQ ID NO: 389965 - DNA, 15 bp, Homo sapiens
gctttctctgtggcg

SEQ ID NO: 389966 - DNA, 15 bp, Homo sapiens
ctttctctgtggcgt

SEQ ID NO: 389967 - DNA, 15 bp, Homo sapiens
tttctctgtggcgtt

SEQ ID NO: 389968 - DNA, 15 bp, Homo sapiens
ttctctgtggcgttt

SEQ ID NO: 389969 - DNA, 15 bp, Homo sapiens
tctctgtggcgtttg

SEQ ID NO: 389970 - DNA, 15 bp, Homo sapiens
ctctgtggcgtttgt

SEQ ID NO: 389971 - DNA, 15 bp, Homo sapiens
tctgtggcgtttgtc

SEQ ID NO: 389972 - DNA, 15 bp, Homo sapiens
ctgtggcgtttgtct

SEQ ID NO: 389973 - DNA, 15 bp, Homo sapiens
tgtggcgtttgtctg

SEQ ID NO: 389974 - DNA, 15 bp, Homo sapiens
gtggcgtttgtctgt

SEQ ID NO: 389975 - DNA, 15 bp, Homo sapiens
tggcgtttgtctgtg

SEQ ID NO: 389976 - DNA, 15 bp, Homo sapiens
ggcgtttgtctgtgt

SEQ ID NO: 389977 - DNA, 15 bp, Homo sapiens
gcgtttgtctgtgtt

SEQ ID NO: 389978 - DNA, 15 bp, Homo sapiens
cgtttgtctgtgttt

SEQ ID NO: 389979 - DNA, 15 bp, Homo sapiens
gtttgtctgtgtttt

SEQ ID NO: 389980 - DNA, 15 bp, Homo sapiens
tttgtctgtgttttt

SEQ ID NO: 389981 - DNA, 15 bp, Homo sapiens
ttgtctgtgtttttt

SEQ ID NO: 389982 - DNA, 15 bp, Homo sapiens
tgtctgtgtttttta

SEQ ID NO: 389983 - DNA, 15 bp, Homo sapiens
gtctgtgttttttaa

SEQ ID NO: 389984 - DNA, 15 bp, Homo sapiens
tctgtgttttttaaa

SEQ ID NO: 389985 - DNA, 15 bp, Homo sapiens
ctgtgttttttaaat

SEQ ID NO: 389986 - DNA, 15 bp, Homo sapiens
tgtgttttttaaatt

SEQ ID NO: 389987 - DNA, 15 bp, Homo sapiens
gtgttttttaaattg

SEQ ID NO: 389988 - DNA, 15 bp, Homo sapiens
tgttttttaaattga

SEQ ID NO: 389989 - DNA, 15 bp, Homo sapiens
gttttttaaattgag

SEQ ID NO: 389990 - DNA, 15 bp, Homo sapiens
ttttttaaattgaga

SEQ ID NO: 389991 - DNA, 15 bp, Homo sapiens
tttttaaattgagaa

SEQ ID NO: 389992 - DNA, 15 bp, Homo sapiens
ttttaaattgagaag

SEQ ID NO: 389993 - DNA, 15 bp, Homo sapiens
tttaaattgagaagt

SEQ ID NO: 389994 - DNA, 15 bp, Homo sapiens
ttaaattgagaagtt

SEQ ID NO: 389995 - DNA, 15 bp, Homo sapiens
taaattgagaagttg

SEQ ID NO: 389996 - DNA, 15 bp, Homo sapiens
aaattgagaagttga

SEQ ID NO: 389997 - DNA, 15 bp, Homo sapiens
aattgagaagttgaa

SEQ ID NO: 389998 - DNA, 15 bp, Homo sapiens
attgagaagttgaag

SEQ ID NO: 389999 - DNA, 15 bp, Homo sapiens
ttgagaagttgaagg

SEQ ID NO: 390000 - DNA, 15 bp, Homo sapiens
tgagaagttgaagga

SEQ ID NO: 390001 - DNA, 15 bp, Homo sapiens
gagaagttgaaggaa

SEQ ID NO: 390002 - DNA, 15 bp, Homo sapiens
agaagttgaaggaat

SEQ ID NO: 390003 - DNA, 15 bp, Homo sapiens
gaagttgaaggaata

SEQ ID NO: 390004 - DNA, 15 bp, Homo sapiens
aagttgaaggaatac

SEQ ID NO: 390005 - DNA, 15 bp, Homo sapiens
agttgaaggaatacc

SEQ ID NO: 390006 - DNA, 15 bp, Homo sapiens
gttgaaggaatacca

SEQ ID NO: 390007 - DNA, 15 bp, Homo sapiens
ttgaaggaataccag

SEQ ID NO: 390008 - DNA, 15 bp, Homo sapiens
tgaaggaataccagc

SEQ ID NO: 390009 - DNA, 15 bp, Homo sapiens
gaaggaataccagcc

SEQ ID NO: 390010 - DNA, 15 bp, Homo sapiens
aaggaataccagcct

SEQ ID NO: 390011 - DNA, 15 bp, Homo sapiens
aggaataccagcctc

SEQ ID NO: 390012 - DNA, 15 bp, Homo sapiens
ggaataccagcctcc

SEQ ID NO: 390013 - DNA, 15 bp, Homo sapiens
gaataccagcctcct

SEQ ID NO: 390014 - DNA, 15 bp, Homo sapiens
aataccagcctcctt

SEQ ID NO: 390015 - DNA, 15 bp, Homo sapiens
ataccagcctccttt

SEQ ID NO: 390016 - DNA, 15 bp, Homo sapiens
taccagcctcctttt

SEQ ID NO: 390017 - DNA, 15 bp, Homo sapiens
accagcctccttttt

SEQ ID NO: 390018 - DNA, 15 bp, Homo sapiens
ccagcctcctttttc

SEQ ID NO: 390019 - DNA, 15 bp, Homo sapiens
cagcctcctttttcc

SEQ ID NO: 390020 - DNA, 15 bp, Homo sapiens
agcctcctttttcct

SEQ ID NO: 390021 - DNA, 15 bp, Homo sapiens
gcctcctttttccta

SEQ ID NO: 390022 - DNA, 15 bp, Homo sapiens
cctcctttttcctag

SEQ ID NO: 390023 - DNA, 15 bp, Homo sapiens
ctcctttttcctaga

SEQ ID NO: 390024 - DNA, 15 bp, Homo sapiens
tcctttttcctagaa

SEQ ID NO: 390025 - DNA, 15 bp, Homo sapiens
cctttttcctagaac

SEQ ID NO: 390026 - DNA, 15 bp, Homo sapiens
ctttttcctagaacc

SEQ ID NO: 390027 - DNA, 15 bp, Homo sapiens
tttttcctagaacct

SEQ ID NO: 390028 - DNA, 15 bp, Homo sapiens
ttttcctagaaccta

SEQ ID NO: 390029 - DNA, 15 bp, Homo sapiens
tttcctagaacctaa

SEQ ID NO: 390030 - DNA, 15 bp, Homo sapiens
ttcctagaacctaac

SEQ ID NO: 390031 - DNA, 15 bp, Homo sapiens
tcctagaacctaacc

SEQ ID NO: 390032 - DNA, 15 bp, Homo sapiens
cctagaacctaaccc

SEQ ID NO: 390033 - DNA, 15 bp, Homo sapiens
ctagaacctaacccc

SEQ ID NO: 390034 - DNA, 15 bp, Homo sapiens
tagaacctaaccccc

SEQ ID NO: 390035 - DNA, 15 bp, Homo sapiens
agaacctaaccccct

SEQ ID NO: 390036 - DNA, 15 bp, Homo sapiens
gaacctaaccccctg

SEQ ID NO: 390037 - DNA, 15 bp, Homo sapiens
aacctaaccccctgt

SEQ ID NO: 390038 - DNA, 15 bp, Homo sapiens
acctaaccccctgta

SEQ ID NO: 390039 - DNA, 15 bp, Homo sapiens
cctaaccccctgtat

SEQ ID NO: 390040 - DNA, 15 bp, Homo sapiens
ctaaccccctgtatc

SEQ ID NO: 390041 - DNA, 15 bp, Homo sapiens
taaccccctgtatct

SEQ ID NO: 390042 - DNA, 15 bp, Homo sapiens
aaccccctgtatctt

SEQ ID NO: 390043 - DNA, 15 bp, Homo sapiens
accccctgtatcttt

SEQ ID NO: 390044 - DNA, 15 bp, Homo sapiens
ccccctgtatctttc

SEQ ID NO: 390045 - DNA, 15 bp, Homo sapiens
cccctgtatctttca

SEQ ID NO: 390046 - DNA, 15 bp, Homo sapiens
ccctgtatctttcaa

SEQ ID NO: 390047 - DNA, 15 bp, Homo sapiens
cctgtatctttcaaa

SEQ ID NO: 390048 - DNA, 15 bp, Homo sapiens
ctgtatctttcaaat

SEQ ID NO: 390049 - DNA, 15 bp, Homo sapiens
tgtatctttcaaatg

SEQ ID NO: 390050 - DNA, 15 bp, Homo sapiens
gtatctttcaaatgc

SEQ ID NO: 390051 - DNA, 15 bp, Homo sapiens
tatctttcaaatgct

SEQ ID NO: 390052 - DNA, 15 bp, Homo sapiens
atctttcaaatgctt

SEQ ID NO: 390053 - DNA, 15 bp, Homo sapiens
tctttcaaatgcttt

SEQ ID NO: 390054 - DNA, 15 bp, Homo sapiens
ctttcaaatgctttc

SEQ ID NO: 390055 - DNA, 15 bp, Homo sapiens
tttcaaatgctttcc

SEQ ID NO: 390056 - DNA, 15 bp, Homo sapiens
ttcaaatgctttcct

SEQ ID NO: 390057 - DNA, 15 bp, Homo sapiens
tcaaatgctttcctg

SEQ ID NO: 390058 - DNA, 15 bp, Homo sapiens
caaatgctttcctgg

SEQ ID NO: 390059 - DNA, 15 bp, Homo sapiens
aaatgctttcctgga

SEQ ID NO: 390060 - DNA, 15 bp, Homo sapiens
aatgctttcctggaa

SEQ ID NO: 390061 - DNA, 15 bp, Homo sapiens
atgctttcctggaaa

SEQ ID NO: 390062 - DNA, 15 bp, Homo sapiens
tgctttcctggaaac

SEQ ID NO: 390063 - DNA, 15 bp, Homo sapiens
gctttcctggaaacg

SEQ ID NO: 390064 - DNA, 15 bp, Homo sapiens
ctttcctggaaacga

SEQ ID NO: 390065 - DNA, 15 bp, Homo sapiens
tttcctggaaacgag

SEQ ID NO: 390066 - DNA, 15 bp, Homo sapiens
ttcctggaaacgagc

SEQ ID NO: 390067 - DNA, 15 bp, Homo sapiens
tcctggaaacgagca

SEQ ID NO: 390068 - DNA, 15 bp, Homo sapiens
cctggaaacgagcat

SEQ ID NO: 390069 - DNA, 15 bp, Homo sapiens
ctggaaacgagcatg

SEQ ID NO: 390070 - DNA, 15 bp, Homo sapiens
tggaaacgagcatgc

SEQ ID NO: 390071 - DNA, 15 bp, Homo sapiens
ggaaacgagcatgct

SEQ ID NO: 390072 - DNA, 15 bp, Homo sapiens
gaaacgagcatgctc

SEQ ID NO: 390073 - DNA, 15 bp, Homo sapiens
aaacgagcatgctca

SEQ ID NO: 390074 - DNA, 15 bp, Homo sapiens
aacgagcatgctcag

SEQ ID NO: 390075 - DNA, 15 bp, Homo sapiens
acgagcatgctcaga

SEQ ID NO: 390076 - DNA, 15 bp, Homo sapiens
cgagcatgctcagag

SEQ ID NO: 390077 - DNA, 15 bp, Homo sapiens
gagcatgctcagaga

SEQ ID NO: 390078 - DNA, 15 bp, Homo sapiens
agcatgctcagagaa

SEQ ID NO: 390079 - DNA, 15 bp, Homo sapiens
gcatgctcagagaac

SEQ ID NO: 390080 - DNA, 15 bp, Homo sapiens
catgctcagagaact

SEQ ID NO: 390081 - DNA, 15 bp, Homo sapiens
atgctcagagaactg

SEQ ID NO: 390082 - DNA, 15 bp, Homo sapiens
tgctcagagaactga

SEQ ID NO: 390083 - DNA, 15 bp, Homo sapiens
gctcagagaactgac

SEQ ID NO: 390084 - DNA, 15 bp, Homo sapiens
ctcagagaactgaca

SEQ ID NO: 390085 - DNA, 15 bp, Homo sapiens
tcagagaactgacaa

SEQ ID NO: 390086 - DNA, 15 bp, Homo sapiens
cagagaactgacaaa

SEQ ID NO: 390087 - DNA, 15 bp, Homo sapiens
agagaactgacaaat

SEQ ID NO: 390088 - DNA, 15 bp, Homo sapiens
gagaactgacaaatc

SEQ ID NO: 390089 - DNA, 15 bp, Homo sapiens
agaactgacaaatca

SEQ ID NO: 390090 - DNA, 15 bp, Homo sapiens
gaactgacaaatcat

SEQ ID NO: 390091 - DNA, 15 bp, Homo sapiens
aactgacaaatcatt

SEQ ID NO: 390092 - DNA, 15 bp, Homo sapiens
actgacaaatcattg

SEQ ID NO: 390093 - DNA, 15 bp, Homo sapiens
ctgacaaatcattgt

SEQ ID NO: 390094 - DNA, 15 bp, Homo sapiens
tgacaaatcattgtc

SEQ ID NO: 390095 - DNA, 15 bp, Homo sapiens
gacaaatcattgtcc

SEQ ID NO: 390096 - DNA, 15 bp, Homo sapiens
acaaatcattgtcca

SEQ ID NO: 390097 - DNA, 15 bp, Homo sapiens
caaatcattgtccag

SEQ ID NO: 390098 - DNA, 15 bp, Homo sapiens
aaatcattgtccagt

SEQ ID NO: 390099 - DNA, 15 bp, Homo sapiens
aatcattgtccagtg

SEQ ID NO: 390100 - DNA, 15 bp, Homo sapiens
atcattgtccagtga

SEQ ID NO: 390101 - DNA, 15 bp, Homo sapiens
tcattgtccagtgac

SEQ ID NO: 390102 - DNA, 15 bp, Homo sapiens
cattgtccagtgacc

SEQ ID NO: 390103 - DNA, 15 bp, Homo sapiens
attgtccagtgaccg

SEQ ID NO: 390104 - DNA, 15 bp, Homo sapiens
ttgtccagtgaccgg

SEQ ID NO: 390105 - DNA, 15 bp, Homo sapiens
tgtccagtgaccggg

SEQ ID NO: 390106 - DNA, 15 bp, Homo sapiens
gtccagtgaccggga

SEQ ID NO: 390107 - DNA, 15 bp, Homo sapiens
tccagtgaccgggag

SEQ ID NO: 390108 - DNA, 15 bp, Homo sapiens
ccagtgaccgggagg

SEQ ID NO: 390109 - DNA, 15 bp, Homo sapiens
cagtgaccgggagga

SEQ ID NO: 390110 - DNA, 15 bp, Homo sapiens
agtgaccgggaggaa

SEQ ID NO: 390111 - DNA, 15 bp, Homo sapiens
gtgaccgggaggaaa

SEQ ID NO: 390112 - DNA, 15 bp, Homo sapiens
tgaccgggaggaaat

SEQ ID NO: 390113 - DNA, 15 bp, Homo sapiens
gaccgggaggaaatg

SEQ ID NO: 390114 - DNA, 15 bp, Homo sapiens
accgggaggaaatga

SEQ ID NO: 390115 - DNA, 15 bp, Homo sapiens
ccgggaggaaatgat

SEQ ID NO: 390116 - DNA, 15 bp, Homo sapiens
cgggaggaaatgatc

SEQ ID NO: 390117 - DNA, 15 bp, Homo sapiens
gggaggaaatgatcg

SEQ ID NO: 390118 - DNA, 15 bp, Homo sapiens
ggaggaaatgatcgt

SEQ ID NO: 390119 - DNA, 15 bp, Homo sapiens
gaggaaatgatcgtt

SEQ ID NO: 390120 - DNA, 15 bp, Homo sapiens
aggaaatgatcgttg

SEQ ID NO: 390121 - DNA, 15 bp, Homo sapiens
ggaaatgatcgttgc

SEQ ID NO: 390122 - DNA, 15 bp, Homo sapiens
gaaatgatcgttgct

SEQ ID NO: 390123 - DNA, 15 bp, Homo sapiens
aaatgatcgttgctc

SEQ ID NO: 390124 - DNA, 15 bp, Homo sapiens
aatgatcgttgctct

SEQ ID NO: 390125 - DNA, 15 bp, Homo sapiens
atgatcgttgctctt

SEQ ID NO: 390126 - DNA, 15 bp, Homo sapiens
tgatcgttgctcttc

SEQ ID NO: 390127 - DNA, 15 bp, Homo sapiens
gatcgttgctcttca

SEQ ID NO: 390128 - DNA, 15 bp, Homo sapiens
atcgttgctcttcat

SEQ ID NO: 390129 - DNA, 15 bp, Homo sapiens
tcgttgctcttcatt

SEQ ID NO: 390130 - DNA, 15 bp, Homo sapiens
cgttgctcttcattt

SEQ ID NO: 390131 - DNA, 15 bp, Homo sapiens
gttgctcttcattta

SEQ ID NO: 390132 - DNA, 15 bp, Homo sapiens
ttgctcttcatttat

SEQ ID NO: 390133 - DNA, 15 bp, Homo sapiens
tgctcttcatttata

SEQ ID NO: 390134 - DNA, 15 bp, Homo sapiens
gctcttcatttataa

SEQ ID NO: 390135 - DNA, 15 bp, Homo sapiens
ctcttcatttataat

SEQ ID NO: 390136 - DNA, 15 bp, Homo sapiens
tcttcatttataatg

SEQ ID NO: 390137 - DNA, 15 bp, Homo sapiens
cttcatttataatgc

SEQ ID NO: 390138 - DNA, 15 bp, Homo sapiens
ttcatttataatgca

SEQ ID NO: 390139 - DNA, 15 bp, Homo sapiens
tcatttataatgcaa

SEQ ID NO: 390140 - DNA, 15 bp, Homo sapiens
catttataatgcaaa

SEQ ID NO: 390141 - DNA, 15 bp, Homo sapiens
atttataatgcaaat

SEQ ID NO: 390142 - DNA, 15 bp, Homo sapiens
tttataatgcaaatt

SEQ ID NO: 390143 - DNA, 15 bp, Homo sapiens
ttataatgcaaattc

SEQ ID NO: 390144 - DNA, 15 bp, Homo sapiens
tataatgcaaattct

SEQ ID NO: 390145 - DNA, 15 bp, Homo sapiens
ataatgcaaattctg

SEQ ID NO: 390146 - DNA, 15 bp, Homo sapiens
taatgcaaattctga

SEQ ID NO: 390147 - DNA, 15 bp, Homo sapiens
aatgcaaattctgag

SEQ ID NO: 390148 - DNA, 15 bp, Homo sapiens
atgcaaattctgagg

SEQ ID NO: 390149 - DNA, 15 bp, Homo sapiens
tgcaaattctgaggt

SEQ ID NO: 390150 - DNA, 15 bp, Homo sapiens
gcaaattctgaggtg

SEQ ID NO: 390151 - DNA, 15 bp, Homo sapiens
caaattctgaggtgt

SEQ ID NO: 390152 - DNA, 15 bp, Homo sapiens
aaattctgaggtgtc

SEQ ID NO: 390153 - DNA, 15 bp, Homo sapiens
aattctgaggtgtct

SEQ ID NO: 390154 - DNA, 15 bp, Homo sapiens
attctgaggtgtctc

SEQ ID NO: 390155 - DNA, 15 bp, Homo sapiens
ttctgaggtgtctcc

SEQ ID NO: 390156 - DNA, 15 bp, Homo sapiens
tctgaggtgtctcca

SEQ ID NO: 390157 - DNA, 15 bp, Homo sapiens
ctgaggtgtctccag

SEQ ID NO: 390158 - DNA, 15 bp, Homo sapiens
tgaggtgtctccaga

SEQ ID NO: 390159 - DNA, 15 bp, Homo sapiens
gaggtgtctccagaa

SEQ ID NO: 390160 - DNA, 15 bp, Homo sapiens
aggtgtctccagaag

SEQ ID NO: 390161 - DNA, 15 bp, Homo sapiens
ggtgtctccagaagt

SEQ ID NO: 390162 - DNA, 15 bp, Homo sapiens
gtgtctccagaagtg

SEQ ID NO: 390163 - DNA, 15 bp, Homo sapiens
tgtctccagaagtgt

SEQ ID NO: 390164 - DNA, 15 bp, Homo sapiens
gtctccagaagtgtg

SEQ ID NO: 390165 - DNA, 15 bp, Homo sapiens
tctccagaagtgtgg

SEQ ID NO: 390166 - DNA, 15 bp, Homo sapiens
ctccagaagtgtggt

SEQ ID NO: 390167 - DNA, 15 bp, Homo sapiens
tccagaagtgtggta

SEQ ID NO: 390168 - DNA, 15 bp, Homo sapiens
ccagaagtgtggtaa

SEQ ID NO: 390169 - DNA, 15 bp, Homo sapiens
cagaagtgtggtaaa

SEQ ID NO: 390170 - DNA, 15 bp, Homo sapiens
agaagtgtggtaaac

SEQ ID NO: 390171 - DNA, 15 bp, Homo sapiens
gaagtgtggtaaact

SEQ ID NO: 390172 - DNA, 15 bp, Homo sapiens
aagtgtggtaaactt

SEQ ID NO: 390173 - DNA, 15 bp, Homo sapiens
agtgtggtaaactta

SEQ ID NO: 390174 - DNA, 15 bp, Homo sapiens
gtgtggtaaacttaa

SEQ ID NO: 390175 - DNA, 15 bp, Homo sapiens
tgtggtaaacttaaa

SEQ ID NO: 390176 - DNA, 15 bp, Homo sapiens
gtggtaaacttaaaa

SEQ ID NO: 390177 - DNA, 15 bp, Homo sapiens
tggtaaacttaaaat

SEQ ID NO: 390178 - DNA, 15 bp, Homo sapiens
ggtaaacttaaaatg

SEQ ID NO: 390179 - DNA, 15 bp, Homo sapiens
gtaaacttaaaatga

SEQ ID NO: 390180 - DNA, 15 bp, Homo sapiens
taaacttaaaatgat

SEQ ID NO: 390181 - DNA, 15 bp, Homo sapiens
aaacttaaaatgatg

SEQ ID NO: 390182 - DNA, 15 bp, Homo sapiens
aacttaaaatgatgg

SEQ ID NO: 390183 - DNA, 15 bp, Homo sapiens
acttaaaatgatggc

SEQ ID NO: 390184 - DNA, 15 bp, Homo sapiens
cttaaaatgatggct

SEQ ID NO: 390185 - DNA, 15 bp, Homo sapiens
ttaaaatgatggctg

SEQ ID NO: 390186 - DNA, 15 bp, Homo sapiens
taaaatgatggctgt

SEQ ID NO: 390187 - DNA, 15 bp, Homo sapiens
aaaatgatggctgtg

SEQ ID NO: 390188 - DNA, 15 bp, Homo sapiens
aaatgatggctgtgg

SEQ ID NO: 390189 - DNA, 15 bp, Homo sapiens
aatgatggctgtggt

SEQ ID NO: 390190 - DNA, 15 bp, Homo sapiens
atgatggctgtggtg

SEQ ID NO: 390191 - DNA, 15 bp, Homo sapiens
tgatggctgtggtga

SEQ ID NO: 390192 - DNA, 15 bp, Homo sapiens
gatggctgtggtgag

SEQ ID NO: 390193 - DNA, 15 bp, Homo sapiens
atggctgtggtgaga

SEQ ID NO: 390194 - DNA, 15 bp, Homo sapiens
tggctgtggtgagaa

SEQ ID NO: 390195 - DNA, 15 bp, Homo sapiens
ggctgtggtgagaac

SEQ ID NO: 390196 - DNA, 15 bp, Homo sapiens
gctgtggtgagaacg

SEQ ID NO: 390197 - DNA, 15 bp, Homo sapiens
ctgtggtgagaacgt

SEQ ID NO: 390198 - DNA, 15 bp, Homo sapiens
tgtggtgagaacgtc

SEQ ID NO: 390199 - DNA, 15 bp, Homo sapiens
gtggtgagaacgtct

SEQ ID NO: 390200 - DNA, 15 bp, Homo sapiens
tggtgagaacgtctc

SEQ ID NO: 390201 - DNA, 15 bp, Homo sapiens
ggtgagaacgtctct

SEQ ID NO: 390202 - DNA, 15 bp, Homo sapiens
gtgagaacgtctctg

SEQ ID NO: 390203 - DNA, 15 bp, Homo sapiens
tgagaacgtctctgc

SEQ ID NO: 390204 - DNA, 15 bp, Homo sapiens
gagaacgtctctgca

SEQ ID NO: 390205 - DNA, 15 bp, Homo sapiens
agaacgtctctgcag

SEQ ID NO: 390206 - DNA, 15 bp, Homo sapiens
gaacgtctctgcaga

SEQ ID NO: 390207 - DNA, 15 bp, Homo sapiens
aacgtctctgcagaa

SEQ ID NO: 390208 - DNA, 15 bp, Homo sapiens
acgtctctgcagaaa

SEQ ID NO: 390209 - DNA, 15 bp, Homo sapiens
cgtctctgcagaaag

SEQ ID NO: 390210 - DNA, 15 bp, Homo sapiens
gtctctgcagaaagt

SEQ ID NO: 390211 - DNA, 15 bp, Homo sapiens
tctctgcagaaagtt

SEQ ID NO: 390212 - DNA, 15 bp, Homo sapiens
ctctgcagaaagttg

SEQ ID NO: 390213 - DNA, 15 bp, Homo sapiens
tctgcagaaagttgt

SEQ ID NO: 390214 - DNA, 15 bp, Homo sapiens
ctgcagaaagttgtg

SEQ ID NO: 390215 - DNA, 15 bp, Homo sapiens
tgcagaaagttgtgg

SEQ ID NO: 390216 - DNA, 15 bp, Homo sapiens
gcagaaagttgtggt

SEQ ID NO: 390217 - DNA, 15 bp, Homo sapiens
cagaaagttgtggtt

SEQ ID NO: 390218 - DNA, 15 bp, Homo sapiens
agaaagttgtggttt

SEQ ID NO: 390219 - DNA, 15 bp, Homo sapiens
gaaagttgtggtttt

SEQ ID NO: 390220 - DNA, 15 bp, Homo sapiens
aaagttgtggttttg

SEQ ID NO: 390221 - DNA, 15 bp, Homo sapiens
aagttgtggttttgt

SEQ ID NO: 390222 - DNA, 15 bp, Homo sapiens
agttgtggttttgtt

SEQ ID NO: 390223 - DNA, 15 bp, Homo sapiens
gttgtggttttgttg

SEQ ID NO: 390224 - DNA, 15 bp, Homo sapiens
ttgtggttttgttgc

SEQ ID NO: 390225 - DNA, 15 bp, Homo sapiens
tgtggttttgttgca

SEQ ID NO: 390226 - DNA, 15 bp, Homo sapiens
gtggttttgttgcat

SEQ ID NO: 390227 - DNA, 15 bp, Homo sapiens
tggttttgttgcatc

SEQ ID NO: 390228 - DNA, 15 bp, Homo sapiens
ggttttgttgcatcg

SEQ ID NO: 390229 - DNA, 15 bp, Homo sapiens
gttttgttgcatcgc

SEQ ID NO: 390230 - DNA, 15 bp, Homo sapiens
ttttgttgcatcgct

SEQ ID NO: 390231 - DNA, 15 bp, Homo sapiens
tttgttgcatcgctt

SEQ ID NO: 390232 - DNA, 15 bp, Homo sapiens
ttgttgcatcgctta

SEQ ID NO: 390233 - DNA, 15 bp, Homo sapiens
tgttgcatcgcttac

SEQ ID NO: 390234 - DNA, 15 bp, Homo sapiens
gttgcatcgcttaca

SEQ ID NO: 390235 - DNA, 15 bp, Homo sapiens
ttgcatcgcttacaa

SEQ ID NO: 390236 - DNA, 15 bp, Homo sapiens
tgcatcgcttacaaa

SEQ ID NO: 390237 - DNA, 15 bp, Homo sapiens
gcatcgcttacaaag

SEQ ID NO: 390238 - DNA, 15 bp, Homo sapiens
catcgcttacaaagg

SEQ ID NO: 390239 - DNA, 15 bp, Homo sapiens
atcgcttacaaagga

SEQ ID NO: 390240 - DNA, 15 bp, Homo sapiens
tcgcttacaaaggat

SEQ ID NO: 390241 - DNA, 15 bp, Homo sapiens
cgcttacaaaggatg

SEQ ID NO: 390242 - DNA, 15 bp, Homo sapiens
gcttacaaaggatgg

SEQ ID NO: 390243 - DNA, 15 bp, Homo sapiens
cttacaaaggatggc

SEQ ID NO: 390244 - DNA, 15 bp, Homo sapiens
ttacaaaggatggca

SEQ ID NO: 390245 - DNA, 15 bp, Homo sapiens
tacaaaggatggcag

SEQ ID NO: 390246 - DNA, 15 bp, Homo sapiens
acaaaggatggcagt

SEQ ID NO: 390247 - DNA, 15 bp, Homo sapiens
caaaggatggcagtt

SEQ ID NO: 390248 - DNA, 15 bp, Homo sapiens
aaaggatggcagttt

SEQ ID NO: 390249 - DNA, 15 bp, Homo sapiens
aaggatggcagtttc

SEQ ID NO: 390250 - DNA, 15 bp, Homo sapiens
aggatggcagtttct

SEQ ID NO: 390251 - DNA, 15 bp, Homo sapiens
ggatggcagtttctt

SEQ ID NO: 390252 - DNA, 15 bp, Homo sapiens
gatggcagtttcttc

SEQ ID NO: 390253 - DNA, 15 bp, Homo sapiens
atggcagtttcttct

SEQ ID NO: 390254 - DNA, 15 bp, Homo sapiens
tggcagtttcttctc

SEQ ID NO: 390255 - DNA, 15 bp, Homo sapiens
ggcagtttcttctcc

SEQ ID NO: 390256 - DNA, 15 bp, Homo sapiens
gcagtttcttctcct

SEQ ID NO: 390257 - DNA, 15 bp, Homo sapiens
cagtttcttctcctc

SEQ ID NO: 390258 - DNA, 15 bp, Homo sapiens
agtttcttctcctcg

SEQ ID NO: 390259 - DNA, 15 bp, Homo sapiens
gtttcttctcctcgg

SEQ ID NO: 390260 - DNA, 15 bp, Homo sapiens
tttcttctcctcggt

SEQ ID NO: 390261 - DNA, 15 bp, Homo sapiens
ttcttctcctcggta

SEQ ID NO: 390262 - DNA, 15 bp, Homo sapiens
tcttctcctcggtat

SEQ ID NO: 390263 - DNA, 15 bp, Homo sapiens
cttctcctcggtatc

SEQ ID NO: 390264 - DNA, 15 bp, Homo sapiens
ttctcctcggtatca

SEQ ID NO: 390265 - DNA, 15 bp, Homo sapiens
tctcctcggtatcag

SEQ ID NO: 390266 - DNA, 15 bp, Homo sapiens
ctcctcggtatcaga

SEQ ID NO: 390267 - DNA, 15 bp, Homo sapiens
tcctcggtatcagaa

SEQ ID NO: 390268 - DNA, 15 bp, Homo sapiens
cctcggtatcagaag

SEQ ID NO: 390269 - DNA, 15 bp, Homo sapiens
ctcggtatcagaagc

SEQ ID NO: 390270 - DNA, 15 bp, Homo sapiens
tcggtatcagaagct

SEQ ID NO: 390271 - DNA, 15 bp, Homo sapiens
cggtatcagaagctc

SEQ ID NO: 390272 - DNA, 15 bp, Homo sapiens
ggtatcagaagctct

SEQ ID NO: 390273 - DNA, 15 bp, Homo sapiens
gtatcagaagctctg

SEQ ID NO: 390274 - DNA, 15 bp, Homo sapiens
tatcagaagctctgt

SEQ ID NO: 390275 - DNA, 15 bp, Homo sapiens
atcagaagctctgta

SEQ ID NO: 390276 - DNA, 15 bp, Homo sapiens
tcagaagctctgtaa

SEQ ID NO: 390277 - DNA, 15 bp, Homo sapiens
cagaagctctgtaag

SEQ ID NO: 390278 - DNA, 15 bp, Homo sapiens
agaagctctgtaagg

SEQ ID NO: 390279 - DNA, 15 bp, Homo sapiens
gaagctctgtaaggt

SEQ ID NO: 390280 - DNA, 15 bp, Homo sapiens
aagctctgtaaggta

SEQ ID NO: 390281 - DNA, 15 bp, Homo sapiens
agctctgtaaggtaa

SEQ ID NO: 390282 - DNA, 15 bp, Homo sapiens
gctctgtaaggtaac

SEQ ID NO: 390283 - DNA, 15 bp, Homo sapiens
ctctgtaaggtaact

SEQ ID NO: 390284 - DNA, 15 bp, Homo sapiens
tctgtaaggtaactg

SEQ ID NO: 390285 - DNA, 15 bp, Homo sapiens
ctgtaaggtaactga

SEQ ID NO: 390286 - DNA, 15 bp, Homo sapiens
tgtaaggtaactgag

SEQ ID NO: 390287 - DNA, 15 bp, Homo sapiens
gtaaggtaactgagt

SEQ ID NO: 390288 - DNA, 15 bp, Homo sapiens
taaggtaactgagtg

SEQ ID NO: 390289 - DNA, 15 bp, Homo sapiens
aaggtaactgagtga

SEQ ID NO: 390290 - DNA, 15 bp, Homo sapiens
aggtaactgagtgat

SEQ ID NO: 390291 - DNA, 15 bp, Homo sapiens
ggtaactgagtgatt

SEQ ID NO: 390292 - DNA, 15 bp, Homo sapiens
gtaactgagtgattg

SEQ ID NO: 390293 - DNA, 15 bp, Homo sapiens
taactgagtgattga

SEQ ID NO: 390294 - DNA, 15 bp, Homo sapiens
aactgagtgattgaa

SEQ ID NO: 390295 - DNA, 15 bp, Homo sapiens
actgagtgattgaaa

SEQ ID NO: 390296 - DNA, 15 bp, Homo sapiens
ctgagtgattgaaaa

SEQ ID NO: 390297 - DNA, 15 bp, Homo sapiens
tgagtgattgaaaat

SEQ ID NO: 390298 - DNA, 15 bp, Homo sapiens
gagtgattgaaaata

SEQ ID NO: 390299 - DNA, 15 bp, Homo sapiens
agtgattgaaaataa

SEQ ID NO: 390300 - DNA, 15 bp, Homo sapiens
gtgattgaaaataag

SEQ ID NO: 390301 - DNA, 15 bp, Homo sapiens
tgattgaaaataagg

SEQ ID NO: 390302 - DNA, 15 bp, Homo sapiens
gattgaaaataagga

SEQ ID NO: 390303 - DNA, 15 bp, Homo sapiens
attgaaaataaggat

SEQ ID NO: 390304 - DNA, 15 bp, Homo sapiens
ttgaaaataaggatc

SEQ ID NO: 390305 - DNA, 15 bp, Homo sapiens
tgaaaataaggatct

SEQ ID NO: 390306 - DNA, 15 bp, Homo sapiens
gaaaataaggatctc

SEQ ID NO: 390307 - DNA, 15 bp, Homo sapiens
aaaataaggatctcg

SEQ ID NO: 390308 - DNA, 15 bp, Homo sapiens
aaataaggatctcgg

SEQ ID NO: 390309 - DNA, 15 bp, Homo sapiens
aataaggatctcggg

SEQ ID NO: 390310 - DNA, 15 bp, Homo sapiens
ataaggatctcgggt

SEQ ID NO: 390311 - DNA, 15 bp, Homo sapiens
taaggatctcgggtg

SEQ ID NO: 390312 - DNA, 15 bp, Homo sapiens
aaggatctcgggtgt

SEQ ID NO: 390313 - DNA, 15 bp, Homo sapiens
aggatctcgggtgtc

SEQ ID NO: 390314 - DNA, 15 bp, Homo sapiens
ggatctcgggtgtct

SEQ ID NO: 390315 - DNA, 15 bp, Homo sapiens
gatctcgggtgtctg

SEQ ID NO: 390316 - DNA, 15 bp, Homo sapiens
atctcgggtgtctga

SEQ ID NO: 390317 - DNA, 15 bp, Homo sapiens
tctcgggtgtctgac

SEQ ID NO: 390318 - DNA, 15 bp, Homo sapiens
ctcgggtgtctgaca

SEQ ID NO: 390319 - DNA, 15 bp, Homo sapiens
tcgggtgtctgacag

SEQ ID NO: 390320 - DNA, 15 bp, Homo sapiens
cgggtgtctgacagt

SEQ ID NO: 390321 - DNA, 15 bp, Homo sapiens
gggtgtctgacagtt

SEQ ID NO: 390322 - DNA, 15 bp, Homo sapiens
ggtgtctgacagttc

SEQ ID NO: 390323 - DNA, 15 bp, Homo sapiens
gtgtctgacagttct

SEQ ID NO: 390324 - DNA, 15 bp, Homo sapiens
tgtctgacagttcta

SEQ ID NO: 390325 - DNA, 15 bp, Homo sapiens
gtctgacagttctac

SEQ ID NO: 390326 - DNA, 15 bp, Homo sapiens
tctgacagttctact

SEQ ID NO: 390327 - DNA, 15 bp, Homo sapiens
ctgacagttctactg

SEQ ID NO: 390328 - DNA, 15 bp, Homo sapiens
tgacagttctactgt

SEQ ID NO: 390329 - DNA, 15 bp, Homo sapiens
gacagttctactgtt

SEQ ID NO: 390330 - DNA, 15 bp, Homo sapiens
acagttctactgttt

SEQ ID NO: 390331 - DNA, 15 bp, Homo sapiens
cagttctactgtttc

SEQ ID NO: 390332 - DNA, 15 bp, Homo sapiens
agttctactgtttct

SEQ ID NO: 390333 - DNA, 15 bp, Homo sapiens
gttctactgtttctc

SEQ ID NO: 390334 - DNA, 15 bp, Homo sapiens
ttctactgtttctca

SEQ ID NO: 390335 - DNA, 15 bp, Homo sapiens
tctactgtttctcag

SEQ ID NO: 390336 - DNA, 15 bp, Homo sapiens
ctactgtttctcagg

SEQ ID NO: 390337 - DNA, 15 bp, Homo sapiens
tactgtttctcaggc

SEQ ID NO: 390338 - DNA, 15 bp, Homo sapiens
actgtttctcaggct

SEQ ID NO: 390339 - DNA, 15 bp, Homo sapiens
ctgtttctcaggctc

SEQ ID NO: 390340 - DNA, 15 bp, Homo sapiens
tgtttctcaggctct

SEQ ID NO: 390341 - DNA, 15 bp, Homo sapiens
gtttctcaggctcta

SEQ ID NO: 390342 - DNA, 15 bp, Homo sapiens
tttctcaggctctaa

SEQ ID NO: 390343 - DNA, 15 bp, Homo sapiens
ttctcaggctctaaa

SEQ ID NO: 390344 - DNA, 15 bp, Homo sapiens
tctcaggctctaaaa

SEQ ID NO: 390345 - DNA, 15 bp, Homo sapiens
ctcaggctctaaaaa

SEQ ID NO: 390346 - DNA, 15 bp, Homo sapiens
tcaggctctaaaaac

SEQ ID NO: 390347 - DNA, 15 bp, Homo sapiens
caggctctaaaaact

SEQ ID NO: 390348 - DNA, 15 bp, Homo sapiens
aggctctaaaaacta

SEQ ID NO: 390349 - DNA, 15 bp, Homo sapiens
ggctctaaaaactaa

SEQ ID NO: 390350 - DNA, 15 bp, Homo sapiens
gctctaaaaactaat

SEQ ID NO: 390351 - DNA, 15 bp, Homo sapiens
ctctaaaaactaatc

SEQ ID NO: 390352 - DNA, 15 bp, Homo sapiens
tctaaaaactaatct

SEQ ID NO: 390353 - DNA, 15 bp, Homo sapiens
ctaaaaactaatctt

SEQ ID NO: 390354 - DNA, 15 bp, Homo sapiens
taaaaactaatcttt

SEQ ID NO: 390355 - DNA, 15 bp, Homo sapiens
aaaaactaatctttc

SEQ ID NO: 390356 - DNA, 15 bp, Homo sapiens
aaaactaatctttca

SEQ ID NO: 390357 - DNA, 15 bp, Homo sapiens
aaactaatctttcag

SEQ ID NO: 390358 - DNA, 15 bp, Homo sapiens
aactaatctttcagg

SEQ ID NO: 390359 - DNA, 15 bp, Homo sapiens
actaatctttcaggt

SEQ ID NO: 390360 - DNA, 15 bp, Homo sapiens
ctaatctttcaggtt

SEQ ID NO: 390361 - DNA, 15 bp, Homo sapiens
taatctttcaggttc

SEQ ID NO: 390362 - DNA, 15 bp, Homo sapiens
aatctttcaggttct

SEQ ID NO: 390363 - DNA, 15 bp, Homo sapiens
atctttcaggttctt

SEQ ID NO: 390364 - DNA, 15 bp, Homo sapiens
tctttcaggttctta

SEQ ID NO: 390365 - DNA, 15 bp, Homo sapiens
ctttcaggttcttat

SEQ ID NO: 390366 - DNA, 15 bp, Homo sapiens
tttcaggttcttatc

SEQ ID NO: 390367 - DNA, 15 bp, Homo sapiens
ttcaggttcttatca

SEQ ID NO: 390368 - DNA, 15 bp, Homo sapiens
tcaggttcttatcaa

SEQ ID NO: 390369 - DNA, 15 bp, Homo sapiens
caggttcttatcaag

SEQ ID NO: 390370 - DNA, 15 bp, Homo sapiens
aggttcttatcaagg

SEQ ID NO: 390371 - DNA, 15 bp, Homo sapiens
ggttcttatcaagga

SEQ ID NO: 390372 - DNA, 15 bp, Homo sapiens
gttcttatcaaggaa

SEQ ID NO: 390373 - DNA, 15 bp, Homo sapiens
ttcttatcaaggaaa

SEQ ID NO: 390374 - DNA, 15 bp, Homo sapiens
tcttatcaaggaaag

SEQ ID NO: 390375 - DNA, 15 bp, Homo sapiens
cttatcaaggaaaga

SEQ ID NO: 390376 - DNA, 15 bp, Homo sapiens
ttatcaaggaaagat

SEQ ID NO: 390377 - DNA, 15 bp, Homo sapiens
tatcaaggaaagatt

SEQ ID NO: 390378 - DNA, 15 bp, Homo sapiens
atcaaggaaagattc

SEQ ID NO: 390379 - DNA, 15 bp, Homo sapiens
tcaaggaaagattcc

SEQ ID NO: 390380 - DNA, 15 bp, Homo sapiens
caaggaaagattccc

SEQ ID NO: 390381 - DNA, 15 bp, Homo sapiens
aaggaaagattccct

SEQ ID NO: 390382 - DNA, 15 bp, Homo sapiens
aggaaagattccctt

SEQ ID NO: 390383 - DNA, 15 bp, Homo sapiens
ggaaagattcccttt

SEQ ID NO: 390384 - DNA, 15 bp, Homo sapiens
gaaagattccctttc

SEQ ID NO: 390385 - DNA, 15 bp, Homo sapiens
aaagattccctttct

SEQ ID NO: 390386 - DNA, 15 bp, Homo sapiens
aagattccctttctt

SEQ ID NO: 390387 - DNA, 15 bp, Homo sapiens
agattccctttctta

SEQ ID NO: 390388 - DNA, 15 bp, Homo sapiens
gattccctttcttag

SEQ ID NO: 390389 - DNA, 15 bp, Homo sapiens
attccctttcttagt

SEQ ID NO: 390390 - DNA, 15 bp, Homo sapiens
ttccctttcttagta

SEQ ID NO: 390391 - DNA, 15 bp, Homo sapiens
tccctttcttagtaa

SEQ ID NO: 390392 - DNA, 15 bp, Homo sapiens
ccctttcttagtaac

SEQ ID NO: 390393 - DNA, 15 bp, Homo sapiens
cctttcttagtaact

SEQ ID NO: 390394 - DNA, 15 bp, Homo sapiens
ctttcttagtaactg

SEQ ID NO: 390395 - DNA, 15 bp, Homo sapiens
tttcttagtaactga

SEQ ID NO: 390396 - DNA, 15 bp, Homo sapiens
ttcttagtaactgat

SEQ ID NO: 390397 - DNA, 15 bp, Homo sapiens
tcttagtaactgatt

SEQ ID NO: 390398 - DNA, 15 bp, Homo sapiens
cttagtaactgattg

SEQ ID NO: 390399 - DNA, 15 bp, Homo sapiens
ttagtaactgattgt

SEQ ID NO: 390400 - DNA, 15 bp, Homo sapiens
tagtaactgattgtg

SEQ ID NO: 390401 - DNA, 15 bp, Homo sapiens
agtaactgattgtga

SEQ ID NO: 390402 - DNA, 15 bp, Homo sapiens
gtaactgattgtgaa

SEQ ID NO: 390403 - DNA, 15 bp, Homo sapiens
taactgattgtgaaa

SEQ ID NO: 390404 - DNA, 15 bp, Homo sapiens
aactgattgtgaaag

SEQ ID NO: 390405 - DNA, 15 bp, Homo sapiens
actgattgtgaaagc

SEQ ID NO: 390406 - DNA, 15 bp, Homo sapiens
ctgattgtgaaagct

SEQ ID NO: 390407 - DNA, 15 bp, Homo sapiens
tgattgtgaaagctg

SEQ ID NO: 390408 - DNA, 15 bp, Homo sapiens
gattgtgaaagctgt

SEQ ID NO: 390409 - DNA, 15 bp, Homo sapiens
attgtgaaagctgtt

SEQ ID NO: 390410 - DNA, 15 bp, Homo sapiens
ttgtgaaagctgtta

SEQ ID NO: 390411 - DNA, 15 bp, Homo sapiens
tgtgaaagctgttaa

SEQ ID NO: 390412 - DNA, 15 bp, Homo sapiens
gtgaaagctgttaaa

SEQ ID NO: 390413 - DNA, 15 bp, Homo sapiens
tgaaagctgttaaag

SEQ ID NO: 390414 - DNA, 15 bp, Homo sapiens
gaaagctgttaaagt

SEQ ID NO: 390415 - DNA, 15 bp, Homo sapiens
aaagctgttaaagtg

SEQ ID NO: 390416 - DNA, 15 bp, Homo sapiens
aagctgttaaagtga

SEQ ID NO: 390417 - DNA, 15 bp, Homo sapiens
agctgttaaagtgaa

SEQ ID NO: 390418 - DNA, 15 bp, Homo sapiens
gctgttaaagtgaat

SEQ ID NO: 390419 - DNA, 15 bp, Homo sapiens
ctgttaaagtgaatt

SEQ ID NO: 390420 - DNA, 15 bp, Homo sapiens
tgttaaagtgaattg

SEQ ID NO: 390421 - DNA, 15 bp, Homo sapiens
gttaaagtgaattgc

SEQ ID NO: 390422 - DNA, 15 bp, Homo sapiens
ttaaagtgaattgca

SEQ ID NO: 390423 - DNA, 15 bp, Homo sapiens
taaagtgaattgcat

SEQ ID NO: 390424 - DNA, 15 bp, Homo sapiens
aaagtgaattgcata

SEQ ID NO: 390425 - DNA, 15 bp, Homo sapiens
aagtgaattgcataa

SEQ ID NO: 390426 - DNA, 15 bp, Homo sapiens
agtgaattgcataat

SEQ ID NO: 390427 - DNA, 15 bp, Homo sapiens
gtgaattgcataatt

SEQ ID NO: 390428 - DNA, 15 bp, Homo sapiens
tgaattgcataatta

SEQ ID NO: 390429 - DNA, 15 bp, Homo sapiens
gaattgcataattac

SEQ ID NO: 390430 - DNA, 15 bp, Homo sapiens
aattgcataattaca

SEQ ID NO: 390431 - DNA, 15 bp, Homo sapiens
attgcataattacat

SEQ ID NO: 390432 - DNA, 15 bp, Homo sapiens
ttgcataattacatt

SEQ ID NO: 390433 - DNA, 15 bp, Homo sapiens
tgcataattacattt

SEQ ID NO: 390434 - DNA, 15 bp, Homo sapiens
gcataattacatttt

SEQ ID NO: 390435 - DNA, 15 bp, Homo sapiens
cataattacattttg

SEQ ID NO: 390436 - DNA, 15 bp, Homo sapiens
ataattacattttgt

SEQ ID NO: 390437 - DNA, 15 bp, Homo sapiens
taattacattttgtt

SEQ ID NO: 390438 - DNA, 15 bp, Homo sapiens
aattacattttgttt

SEQ ID NO: 390439 - DNA, 15 bp, Homo sapiens
attacattttgttta

SEQ ID NO: 390440 - DNA, 15 bp, Homo sapiens
ttacattttgtttaa

SEQ ID NO: 390441 - DNA, 15 bp, Homo sapiens
tacattttgtttaaa

SEQ ID NO: 390442 - DNA, 15 bp, Homo sapiens
acattttgtttaaaa

SEQ ID NO: 390443 - DNA, 15 bp, Homo sapiens
cattttgtttaaaaa

SEQ ID NO: 390444 - DNA, 15 bp, Homo sapiens
attttgtttaaaaat

SEQ ID NO: 390445 - DNA, 15 bp, Homo sapiens
ttttgtttaaaaatc

SEQ ID NO: 390446 - DNA, 15 bp, Homo sapiens
tttgtttaaaaatct

SEQ ID NO: 390447 - DNA, 15 bp, Homo sapiens
ttgtttaaaaatcta

SEQ ID NO: 390448 - DNA, 15 bp, Homo sapiens
tgtttaaaaatctaa

SEQ ID NO: 390449 - DNA, 15 bp, Homo sapiens
gtttaaaaatctaaa

SEQ ID NO: 390450 - DNA, 15 bp, Homo sapiens
tttaaaaatctaaaa

SEQ ID NO: 390451 - DNA, 15 bp, Homo sapiens
ttaaaaatctaaaac

SEQ ID NO: 390452 - DNA, 15 bp, Homo sapiens
taaaaatctaaaaca

SEQ ID NO: 390453 - DNA, 15 bp, Homo sapiens
aaaaatctaaaacag

SEQ ID NO: 390454 - DNA, 15 bp, Homo sapiens
aaaatctaaaacagg

SEQ ID NO: 390455 - DNA, 15 bp, Homo sapiens
aaatctaaaacaggt

SEQ ID NO: 390456 - DNA, 15 bp, Homo sapiens
aatctaaaacaggtt

SEQ ID NO: 390457 - DNA, 15 bp, Homo sapiens
atctaaaacaggttt

SEQ ID NO: 390458 - DNA, 15 bp, Homo sapiens
tctaaaacaggtttt

SEQ ID NO: 390459 - DNA, 15 bp, Homo sapiens
ctaaaacaggtttta

SEQ ID NO: 390460 - DNA, 15 bp, Homo sapiens
taaaacaggttttag

SEQ ID NO: 390461 - DNA, 15 bp, Homo sapiens
aaaacaggttttagt

SEQ ID NO: 390462 - DNA, 15 bp, Homo sapiens
aaacaggttttagtt

SEQ ID NO: 390463 - DNA, 15 bp, Homo sapiens
aacaggttttagttt

SEQ ID NO: 390464 - DNA, 15 bp, Homo sapiens
acaggttttagtttt

SEQ ID NO: 390465 - DNA, 15 bp, Homo sapiens
caggttttagtttta

SEQ ID NO: 390466 - DNA, 15 bp, Homo sapiens
aggttttagttttag

SEQ ID NO: 390467 - DNA, 15 bp, Homo sapiens
ggttttagttttagt

SEQ ID NO: 390468 - DNA, 15 bp, Homo sapiens
gttttagttttagta

SEQ ID NO: 390469 - DNA, 15 bp, Homo sapiens
ttttagttttagtac

SEQ ID NO: 390470 - DNA, 15 bp, Homo sapiens
tttagttttagtaca

SEQ ID NO: 390471 - DNA, 15 bp, Homo sapiens
ttagttttagtacat

SEQ ID NO: 390472 - DNA, 15 bp, Homo sapiens
tagttttagtacata

SEQ ID NO: 390473 - DNA, 15 bp, Homo sapiens
agttttagtacatag

SEQ ID NO: 390474 - DNA, 15 bp, Homo sapiens
gttttagtacatagt

SEQ ID NO: 390475 - DNA, 15 bp, Homo sapiens
ttttagtacatagtt

SEQ ID NO: 390476 - DNA, 15 bp, Homo sapiens
tttagtacatagttt

SEQ ID NO: 390477 - DNA, 15 bp, Homo sapiens
ttagtacatagtttc

SEQ ID NO: 390478 - DNA, 15 bp, Homo sapiens
tagtacatagtttct

SEQ ID NO: 390479 - DNA, 15 bp, Homo sapiens
agtacatagtttctt

SEQ ID NO: 390480 - DNA, 15 bp, Homo sapiens
gtacatagtttcttt

SEQ ID NO: 390481 - DNA, 15 bp, Homo sapiens
tacatagtttctttt

SEQ ID NO: 390482 - DNA, 15 bp, Homo sapiens
acatagtttcttttg

SEQ ID NO: 390483 - DNA, 15 bp, Homo sapiens
catagtttcttttgc

SEQ ID NO: 390484 - DNA, 15 bp, Homo sapiens
atagtttcttttgca

SEQ ID NO: 390485 - DNA, 15 bp, Homo sapiens
agtttcttttgcaat

SEQ ID NO: 390486 - DNA, 15 bp, Homo sapiens
gtttcttttgcaatt

SEQ ID NO: 390487 - DNA, 15 bp, Homo sapiens
tttcttttgcaattg

SEQ ID NO: 390488 - DNA, 15 bp, Homo sapiens
ttcttttgcaattga

SEQ ID NO: 390489 - DNA, 15 bp, Homo sapiens
tcttttgcaattgac

SEQ ID NO: 390490 - DNA, 15 bp, Homo sapiens
cttttgcaattgaca

SEQ ID NO: 390491 - DNA, 15 bp, Homo sapiens
ttttgcaattgacac

SEQ ID NO: 390492 - DNA, 15 bp, Homo sapiens
tttgcaattgacaca

SEQ ID NO: 390493 - DNA, 15 bp, Homo sapiens
ttgcaattgacacaa

SEQ ID NO: 390494 - DNA, 15 bp, Homo sapiens
tgcaattgacacaat

SEQ ID NO: 390495 - DNA, 15 bp, Homo sapiens
gcaattgacacaatc

SEQ ID NO: 390496 - DNA, 15 bp, Homo sapiens
caattgacacaatct

SEQ ID NO: 390497 - DNA, 15 bp, Homo sapiens
aattgacacaatctt

SEQ ID NO: 390498 - DNA, 15 bp, Homo sapiens
attgacacaatcttg

SEQ ID NO: 390499 - DNA, 15 bp, Homo sapiens
ttgacacaatcttgt

SEQ ID NO: 390500 - DNA, 15 bp, Homo sapiens
tgacacaatcttgtc

SEQ ID NO: 390501 - DNA, 15 bp, Homo sapiens
gacacaatcttgtct

SEQ ID NO: 390502 - DNA, 15 bp, Homo sapiens
acacaatcttgtctt

SEQ ID NO: 390503 - DNA, 15 bp, Homo sapiens
cacaatcttgtcttc

SEQ ID NO: 390504 - DNA, 15 bp, Homo sapiens
acaatcttgtcttct

SEQ ID NO: 390505 - DNA, 15 bp, Homo sapiens
caatcttgtcttctg

SEQ ID NO: 390506 - DNA, 15 bp, Homo sapiens
aatcttgtcttctga

SEQ ID NO: 390507 - DNA, 15 bp, Homo sapiens
atcttgtcttctgag

SEQ ID NO: 390508 - DNA, 15 bp, Homo sapiens
tcttgtcttctgaga

SEQ ID NO: 390509 - DNA, 15 bp, Homo sapiens
cttgtcttctgagat

SEQ ID NO: 390510 - DNA, 15 bp, Homo sapiens
ttgtcttctgagatg

SEQ ID NO: 390511 - DNA, 15 bp, Homo sapiens
tgtcttctgagatgg

SEQ ID NO: 390512 - DNA, 15 bp, Homo sapiens
gtcttctgagatggg

SEQ ID NO: 390513 - DNA, 15 bp, Homo sapiens
tcttctgagatgggc

SEQ ID NO: 390514 - DNA, 15 bp, Homo sapiens
cttctgagatgggct

SEQ ID NO: 390515 - DNA, 15 bp, Homo sapiens
ttctgagatgggcta

SEQ ID NO: 390516 - DNA, 15 bp, Homo sapiens
tctgagatgggctag

SEQ ID NO: 390517 - DNA, 15 bp, Homo sapiens
ctgagatgggctagt

SEQ ID NO: 390518 - DNA, 15 bp, Homo sapiens
tgagatgggctagtg

SEQ ID NO: 390519 - DNA, 15 bp, Homo sapiens
gagatgggctagtga

SEQ ID NO: 390520 - DNA, 15 bp, Homo sapiens
agatgggctagtgaa

SEQ ID NO: 390521 - DNA, 15 bp, Homo sapiens
gatgggctagtgaaa

SEQ ID NO: 390522 - DNA, 15 bp, Homo sapiens
atgggctagtgaaat

SEQ ID NO: 390523 - DNA, 15 bp, Homo sapiens
tgggctagtgaaatg

SEQ ID NO: 390524 - DNA, 15 bp, Homo sapiens
gggctagtgaaatgt

SEQ ID NO: 390525 - DNA, 15 bp, Homo sapiens
ggctagtgaaatgtt

SEQ ID NO: 390526 - DNA, 15 bp, Homo sapiens
gctagtgaaatgttt

SEQ ID NO: 390527 - DNA, 15 bp, Homo sapiens
ctagtgaaatgtttg

SEQ ID NO: 390528 - DNA, 15 bp, Homo sapiens
tagtgaaatgtttgg

SEQ ID NO: 390529 - DNA, 15 bp, Homo sapiens
agtgaaatgtttgga

SEQ ID NO: 390530 - DNA, 15 bp, Homo sapiens
gtgaaatgtttggag

SEQ ID NO: 390531 - DNA, 15 bp, Homo sapiens
tgaaatgtttggaga

SEQ ID NO: 390532 - DNA, 15 bp, Homo sapiens
gaaatgtttggagaa

SEQ ID NO: 390533 - DNA, 15 bp, Homo sapiens
aaatgtttggagaaa

SEQ ID NO: 390534 - DNA, 15 bp, Homo sapiens
aatgtttggagaaaa

SEQ ID NO: 390535 - DNA, 15 bp, Homo sapiens
atgtttggagaaaat

SEQ ID NO: 390536 - DNA, 15 bp, Homo sapiens
tgtttggagaaaata

SEQ ID NO: 390537 - DNA, 15 bp, Homo sapiens
gtttggagaaaatat

SEQ ID NO: 390538 - DNA, 15 bp, Homo sapiens
tttggagaaaatatg

SEQ ID NO: 390539 - DNA, 15 bp, Homo sapiens
ttggagaaaatatga

SEQ ID NO: 390540 - DNA, 15 bp, Homo sapiens
tggagaaaatatgat

SEQ ID NO: 390541 - DNA, 15 bp, Homo sapiens
ggagaaaatatgatg

SEQ ID NO: 390542 - DNA, 15 bp, Homo sapiens
gagaaaatatgatgc

SEQ ID NO: 390543 - DNA, 15 bp, Homo sapiens
agaaaatatgatgca

SEQ ID NO: 390544 - DNA, 15 bp, Homo sapiens
gaaaatatgatgcaa

SEQ ID NO: 390545 - DNA, 15 bp, Homo sapiens
aaaatatgatgcaaa

SEQ ID NO: 390546 - DNA, 15 bp, Homo sapiens
aaatatgatgcaaaa

SEQ ID NO: 390547 - DNA, 15 bp, Homo sapiens
aatatgatgcaaaac

SEQ ID NO: 390548 - DNA, 15 bp, Homo sapiens
atatgatgcaaaact

SEQ ID NO: 390549 - DNA, 15 bp, Homo sapiens
tatgatgcaaaacta

SEQ ID NO: 390550 - DNA, 15 bp, Homo sapiens
atgatgcaaaactac

SEQ ID NO: 390551 - DNA, 15 bp, Homo sapiens
tgatgcaaaactact

SEQ ID NO: 390552 - DNA, 15 bp, Homo sapiens
gatgcaaaactacta

SEQ ID NO: 390553 - DNA, 15 bp, Homo sapiens
atgcaaaactactac

SEQ ID NO: 390554 - DNA, 15 bp, Homo sapiens
tgcaaaactactaca

SEQ ID NO: 390555 - DNA, 15 bp, Homo sapiens
gcaaaactactacat

SEQ ID NO: 390556 - DNA, 15 bp, Homo sapiens
caaaactactacatt

SEQ ID NO: 390557 - DNA, 15 bp, Homo sapiens
aaaactactacattc

SEQ ID NO: 390558 - DNA, 15 bp, Homo sapiens
aaactactacattca

SEQ ID NO: 390559 - DNA, 15 bp, Homo sapiens
aactactacattcat

SEQ ID NO: 390560 - DNA, 15 bp, Homo sapiens
actactacattcatt

SEQ ID NO: 390561 - DNA, 15 bp, Homo sapiens
ctactacattcatta

SEQ ID NO: 390562 - DNA, 15 bp, Homo sapiens
tactacattcattaa

SEQ ID NO: 390563 - DNA, 15 bp, Homo sapiens
actacattcattaag

SEQ ID NO: 390564 - DNA, 15 bp, Homo sapiens
ctacattcattaaga

SEQ ID NO: 390565 - DNA, 15 bp, Homo sapiens
tacattcattaagac

SEQ ID NO: 390566 - DNA, 15 bp, Homo sapiens
acattcattaagacc

SEQ ID NO: 390567 - DNA, 15 bp, Homo sapiens
cattcattaagacct

SEQ ID NO: 390568 - DNA, 15 bp, Homo sapiens
attcattaagacctg

SEQ ID NO: 390569 - DNA, 15 bp, Homo sapiens
ttcattaagacctgt

SEQ ID NO: 390570 - DNA, 15 bp, Homo sapiens
tcattaagacctgtt

SEQ ID NO: 390571 - DNA, 15 bp, Homo sapiens
cattaagacctgtta

SEQ ID NO: 390572 - DNA, 15 bp, Homo sapiens
attaagacctgttac

SEQ ID NO: 390573 - DNA, 15 bp, Homo sapiens
ttaagacctgttacc

SEQ ID NO: 390574 - DNA, 15 bp, Homo sapiens
taagacctgttacct

SEQ ID NO: 390575 - DNA, 15 bp, Homo sapiens
aagacctgttacctc

SEQ ID NO: 390576 - DNA, 15 bp, Homo sapiens
agacctgttacctct

SEQ ID NO: 390577 - DNA, 15 bp, Homo sapiens
gacctgttacctctc

SEQ ID NO: 390578 - DNA, 15 bp, Homo sapiens
acctgttacctctct

SEQ ID NO: 390579 - DNA, 15 bp, Homo sapiens
cctgttacctctctg

SEQ ID NO: 390580 - DNA, 15 bp, Homo sapiens
ctgttacctctctgg

SEQ ID NO: 390581 - DNA, 15 bp, Homo sapiens
tgttacctctctggt

SEQ ID NO: 390582 - DNA, 15 bp, Homo sapiens
gttacctctctggta

SEQ ID NO: 390583 - DNA, 15 bp, Homo sapiens
ttacctctctggtac

SEQ ID NO: 390584 - DNA, 15 bp, Homo sapiens
tacctctctggtact

SEQ ID NO: 390585 - DNA, 15 bp, Homo sapiens
acctctctggtactt

SEQ ID NO: 390586 - DNA, 15 bp, Homo sapiens
cctctctggtacttt

SEQ ID NO: 390587 - DNA, 15 bp, Homo sapiens
ctctctggtactttg

SEQ ID NO: 390588 - DNA, 15 bp, Homo sapiens
tctctggtactttgc

SEQ ID NO: 390589 - DNA, 15 bp, Homo sapiens
ctctggtactttgca

SEQ ID NO: 390590 - DNA, 15 bp, Homo sapiens
tctggtactttgcag

SEQ ID NO: 390591 - DNA, 15 bp, Homo sapiens
ctggtactttgcagt

SEQ ID NO: 390592 - DNA, 15 bp, Homo sapiens
tggtactttgcagta

SEQ ID NO: 390593 - DNA, 15 bp, Homo sapiens
ggtactttgcagtat

SEQ ID NO: 390594 - DNA, 15 bp, Homo sapiens
gtactttgcagtatc

SEQ ID NO: 390595 - DNA, 15 bp, Homo sapiens
tactttgcagtatct

SEQ ID NO: 390596 - DNA, 15 bp, Homo sapiens
actttgcagtatctt

SEQ ID NO: 390597 - DNA, 15 bp, Homo sapiens
ctttgcagtatctta

SEQ ID NO: 390598 - DNA, 15 bp, Homo sapiens
tttgcagtatcttaa

SEQ ID NO: 390599 - DNA, 15 bp, Homo sapiens
ttgcagtatcttaat

SEQ ID NO: 390600 - DNA, 15 bp, Homo sapiens
tgcagtatcttaata

SEQ ID NO: 390601 - DNA, 15 bp, Homo sapiens
gcagtatcttaatag

SEQ ID NO: 390602 - DNA, 15 bp, Homo sapiens
cagtatcttaatagt

SEQ ID NO: 390603 - DNA, 15 bp, Homo sapiens
agtatcttaatagtg

SEQ ID NO: 390604 - DNA, 15 bp, Homo sapiens
gtatcttaatagtga

SEQ ID NO: 390605 - DNA, 15 bp, Homo sapiens
tatcttaatagtgaa

SEQ ID NO: 390606 - DNA, 15 bp, Homo sapiens
atcttaatagtgaat

SEQ ID NO: 390607 - DNA, 15 bp, Homo sapiens
tcttaatagtgaatg

SEQ ID NO: 390608 - DNA, 15 bp, Homo sapiens
cttaatagtgaatgg

SEQ ID NO: 390609 - DNA, 15 bp, Homo sapiens
ttaatagtgaatggc

SEQ ID NO: 390610 - DNA, 15 bp, Homo sapiens
taatagtgaatggca

SEQ ID NO: 390611 - DNA, 15 bp, Homo sapiens
aatagtgaatggcac

SEQ ID NO: 390612 - DNA, 15 bp, Homo sapiens
atagtgaatggcaca

SEQ ID NO: 390613 - DNA, 15 bp, Homo sapiens
tagtgaatggcacat

SEQ ID NO: 390614 - DNA, 15 bp, Homo sapiens
agtgaatggcacatt

SEQ ID NO: 390615 - DNA, 15 bp, Homo sapiens
gtgaatggcacatta

SEQ ID NO: 390616 - DNA, 15 bp, Homo sapiens
tgaatggcacattaa

SEQ ID NO: 390617 - DNA, 15 bp, Homo sapiens
gaatggcacattaat

SEQ ID NO: 390618 - DNA, 15 bp, Homo sapiens
aatggcacattaatc

SEQ ID NO: 390619 - DNA, 15 bp, Homo sapiens
atggcacattaatct

SEQ ID NO: 390620 - DNA, 15 bp, Homo sapiens
tggcacattaatctt

SEQ ID NO: 390621 - DNA, 15 bp, Homo sapiens
ggcacattaatctta

SEQ ID NO: 390622 - DNA, 15 bp, Homo sapiens
gcacattaatcttat

SEQ ID NO: 390623 - DNA, 15 bp, Homo sapiens
cacattaatcttatg

SEQ ID NO: 390624 - DNA, 15 bp, Homo sapiens
acattaatcttatgt

SEQ ID NO: 390625 - DNA, 15 bp, Homo sapiens
cattaatcttatgta

SEQ ID NO: 390626 - DNA, 15 bp, Homo sapiens
attaatcttatgtaa

SEQ ID NO: 390627 - DNA, 15 bp, Homo sapiens
ttaatcttatgtaaa

SEQ ID NO: 390628 - DNA, 15 bp, Homo sapiens
taatcttatgtaaat

SEQ ID NO: 390629 - DNA, 15 bp, Homo sapiens
aatcttatgtaaatt

SEQ ID NO: 390630 - DNA, 15 bp, Homo sapiens
atcttatgtaaattt

SEQ ID NO: 390631 - DNA, 15 bp, Homo sapiens
tcttatgtaaatttt

SEQ ID NO: 390632 - DNA, 15 bp, Homo sapiens
cttatgtaaatttta

SEQ ID NO: 390633 - DNA, 15 bp, Homo sapiens
ttatgtaaattttag

SEQ ID NO: 390634 - DNA, 15 bp, Homo sapiens
tatgtaaattttagt

SEQ ID NO: 390635 - DNA, 15 bp, Homo sapiens
atgtaaattttagta

SEQ ID NO: 390636 - DNA, 15 bp, Homo sapiens
tgtaaattttagtaa

SEQ ID NO: 390637 - DNA, 15 bp, Homo sapiens
gtaaattttagtaaa

SEQ ID NO: 390638 - DNA, 15 bp, Homo sapiens
taaattttagtaaaa

SEQ ID NO: 390639 - DNA, 15 bp, Homo sapiens
aaattttagtaaaat

SEQ ID NO: 390640 - DNA, 15 bp, Homo sapiens
aattttagtaaaatt

SEQ ID NO: 390641 - DNA, 15 bp, Homo sapiens
attttagtaaaatta

SEQ ID NO: 390642 - DNA, 15 bp, Homo sapiens
ttttagtaaaattaa

SEQ ID NO: 390643 - DNA, 15 bp, Homo sapiens
tttagtaaaattaaa

SEQ ID NO: 390644 - DNA, 15 bp, Homo sapiens
ttagtaaaattaaaa

SEQ ID NO: 390645 - DNA, 15 bp, Homo sapiens
tagtaaaattaaaag

SEQ ID NO: 390646 - DNA, 15 bp, Homo sapiens
agtaaaattaaaaga

SEQ ID NO: 390647 - DNA, 15 bp, Homo sapiens
gtaaaattaaaagaa

SEQ ID NO: 390648 - DNA, 15 bp, Homo sapiens
ctcaagcaatctgcc

SEQ ID NO: 390649 - DNA, 15 bp, Homo sapiens
tcaagcaatctgcct

SEQ ID NO: 390650 - DNA, 15 bp, Homo sapiens
caagcaatctgcctg

SEQ ID NO: 390651 - DNA, 15 bp, Homo sapiens
aagcaatctgcctgc

SEQ ID NO: 390652 - DNA, 15 bp, Homo sapiens
agcaatctgcctgcc

SEQ ID NO: 390653 - DNA, 15 bp, Homo sapiens
gcaatctgcctgcct

SEQ ID NO: 390654 - DNA, 15 bp, Homo sapiens
caatctgcctgcctc

SEQ ID NO: 390655 - DNA, 15 bp, Homo sapiens
aatctgcctgcctcg

SEQ ID NO: 390656 - DNA, 15 bp, Homo sapiens
gcctgcctcggcctt

SEQ ID NO: 390657 - DNA, 15 bp, Homo sapiens
cctgcctcggccttc

SEQ ID NO: 390658 - DNA, 15 bp, Homo sapiens
ctgcctcggccttcc

SEQ ID NO: 390659 - DNA, 15 bp, Homo sapiens
tgcctcggccttcca

SEQ ID NO: 390660 - DNA, 15 bp, Homo sapiens
gcctcggccttccaa

SEQ ID NO: 390661 - DNA, 15 bp, Homo sapiens
cctcggccttccaaa

SEQ ID NO: 390662 - DNA, 15 bp, Homo sapiens
ctcggccttccaaag

SEQ ID NO: 390663 - DNA, 15 bp, Homo sapiens
tcggccttccaaagt

SEQ ID NO: 390664 - DNA, 15 bp, Homo sapiens
cggccttccaaagtt

SEQ ID NO: 390665 - DNA, 15 bp, Homo sapiens
ggccttccaaagttc

SEQ ID NO: 390666 - DNA, 15 bp, Homo sapiens
gccttccaaagttcc

SEQ ID NO: 390667 - DNA, 15 bp, Homo sapiens
ccttccaaagttcct

SEQ ID NO: 390668 - DNA, 15 bp, Homo sapiens
cttccaaagttcctg

SEQ ID NO: 390669 - DNA, 15 bp, Homo sapiens
ttccaaagttcctga

SEQ ID NO: 390670 - DNA, 15 bp, Homo sapiens
tccaaagttcctgac

SEQ ID NO: 390671 - DNA, 15 bp, Homo sapiens
ccaaagttcctgaca

SEQ ID NO: 390672 - DNA, 15 bp, Homo sapiens
caaagttcctgacag

SEQ ID NO: 390673 - DNA, 15 bp, Homo sapiens
aaagttcctgacagt

SEQ ID NO: 390674 - DNA, 15 bp, Homo sapiens
aagttcctgacagtt

SEQ ID NO: 390675 - DNA, 15 bp, Homo sapiens
agttcctgacagttt

SEQ ID NO: 390676 - DNA, 15 bp, Homo sapiens
gttcctgacagtttt

SEQ ID NO: 390677 - DNA, 15 bp, Homo sapiens
ttcctgacagttttg

SEQ ID NO: 390678 - DNA, 15 bp, Homo sapiens
tcctgacagttttga

SEQ ID NO: 390679 - DNA, 15 bp, Homo sapiens
cctgacagttttgag

SEQ ID NO: 390680 - DNA, 15 bp, Homo sapiens
ctgacagttttgagc

SEQ ID NO: 390681 - DNA, 15 bp, Homo sapiens
tgacagttttgagca

SEQ ID NO: 390682 - DNA, 15 bp, Homo sapiens
gacagttttgagcag

SEQ ID NO: 390683 - DNA, 15 bp, Homo sapiens
acagttttgagcagg

SEQ ID NO: 390684 - DNA, 15 bp, Homo sapiens
cagttttgagcaggt

SEQ ID NO: 390685 - DNA, 15 bp, Homo sapiens
agttttgagcaggtg

SEQ ID NO: 390686 - DNA, 15 bp, Homo sapiens
gttttgagcaggtgg

SEQ ID NO: 390687 - DNA, 15 bp, Homo sapiens
ttttgagcaggtggc

SEQ ID NO: 390688 - DNA, 15 bp, Homo sapiens
tttgagcaggtggct

SEQ ID NO: 390689 - DNA, 15 bp, Homo sapiens
ttgagcaggtggcta

SEQ ID NO: 390690 - DNA, 15 bp, Homo sapiens
tgagcaggtggctat

SEQ ID NO: 390691 - DNA, 15 bp, Homo sapiens
gagcaggtggctatg

SEQ ID NO: 390692 - DNA, 15 bp, Homo sapiens
agcaggtggctatgt

SEQ ID NO: 390693 - DNA, 15 bp, Homo sapiens
gcaggtggctatgta

SEQ ID NO: 390694 - DNA, 15 bp, Homo sapiens
caggtggctatgtac

SEQ ID NO: 390695 - DNA, 15 bp, Homo sapiens
aggtggctatgtact

SEQ ID NO: 390696 - DNA, 15 bp, Homo sapiens
ggtggctatgtactt

SEQ ID NO: 390697 - DNA, 15 bp, Homo sapiens
gtggctatgtacttg

SEQ ID NO: 390698 - DNA, 15 bp, Homo sapiens
tggctatgtacttgt

SEQ ID NO: 390699 - DNA, 15 bp, Homo sapiens
ggctatgtacttgtt

SEQ ID NO: 390700 - DNA, 15 bp, Homo sapiens
gctatgtacttgttt

SEQ ID NO: 390701 - DNA, 15 bp, Homo sapiens
ctatgtacttgtttt

SEQ ID NO: 390702 - DNA, 15 bp, Homo sapiens
tatgtacttgttttc

SEQ ID NO: 390703 - DNA, 15 bp, Homo sapiens
atgtacttgttttcc

SEQ ID NO: 390704 - DNA, 15 bp, Homo sapiens
tgtacttgttttcct

SEQ ID NO: 390705 - DNA, 15 bp, Homo sapiens
gtacttgttttccta

SEQ ID NO: 390706 - DNA, 15 bp, Homo sapiens
tacttgttttcctag

SEQ ID NO: 390707 - DNA, 15 bp, Homo sapiens
acttgttttcctaga

SEQ ID NO: 390708 - DNA, 15 bp, Homo sapiens
cttgttttcctagaa

SEQ ID NO: 390709 - DNA, 15 bp, Homo sapiens
ttgttttcctagaag

SEQ ID NO: 390710 - DNA, 15 bp, Homo sapiens
tgttttcctagaagt

SEQ ID NO: 390711 - DNA, 15 bp, Homo sapiens
gttttcctagaagtt

SEQ ID NO: 390712 - DNA, 15 bp, Homo sapiens
ttttcctagaagttt

SEQ ID NO: 390713 - DNA, 15 bp, Homo sapiens
tttcctagaagttta

SEQ ID NO: 390714 - DNA, 15 bp, Homo sapiens
ttcctagaagtttaa

SEQ ID NO: 390715 - DNA, 15 bp, Homo sapiens
tcctagaagtttaaa

SEQ ID NO: 390716 - DNA, 15 bp, Homo sapiens
cctagaagtttaaaa

SEQ ID NO: 390717 - DNA, 15 bp, Homo sapiens
ctagaagtttaaaag

SEQ ID NO: 390718 - DNA, 15 bp, Homo sapiens
tagaagtttaaaagt

SEQ ID NO: 390719 - DNA, 15 bp, Homo sapiens
agaagtttaaaagta

SEQ ID NO: 390720 - DNA, 15 bp, Homo sapiens
gaagtttaaaagtaa

SEQ ID NO: 390721 - DNA, 15 bp, Homo sapiens
aagtttaaaagtaag

SEQ ID NO: 390722 - DNA, 15 bp, Homo sapiens
agtttaaaagtaagg

SEQ ID NO: 390723 - DNA, 15 bp, Homo sapiens
gtttaaaagtaagga

SEQ ID NO: 390724 - DNA, 15 bp, Homo sapiens
tttaaaagtaaggaa

SEQ ID NO: 390725 - DNA, 15 bp, Homo sapiens
ttaaaagtaaggaaa

SEQ ID NO: 390726 - DNA, 15 bp, Homo sapiens
taaaagtaaggaaat

SEQ ID NO: 390727 - DNA, 15 bp, Homo sapiens
aaaagtaaggaaata

SEQ ID NO: 390728 - DNA, 15 bp, Homo sapiens
aaagtaaggaaatat

SEQ ID NO: 390729 - DNA, 15 bp, Homo sapiens
aagtaaggaaatata

SEQ ID NO: 390730 - DNA, 15 bp, Homo sapiens
agtaaggaaatatat

SEQ ID NO: 390731 - DNA, 15 bp, Homo sapiens
gtaaggaaatatatt

SEQ ID NO: 390732 - DNA, 15 bp, Homo sapiens
taaggaaatatattc

SEQ ID NO: 390733 - DNA, 15 bp, Homo sapiens
aaggaaatatattct

SEQ ID NO: 390734 - DNA, 15 bp, Homo sapiens
aggaaatatattctt

SEQ ID NO: 390735 - DNA, 15 bp, Homo sapiens
ggaaatatattcttt

SEQ ID NO: 390736 - DNA, 15 bp, Homo sapiens
gaaatatattctttt

SEQ ID NO: 390737 - DNA, 15 bp, Homo sapiens
aaatatattcttttc

SEQ ID NO: 390738 - DNA, 15 bp, Homo sapiens
aatatattcttttca

SEQ ID NO: 390739 - DNA, 15 bp, Homo sapiens
atatattcttttcaa

SEQ ID NO: 390740 - DNA, 15 bp, Homo sapiens
tatattcttttcaaa

SEQ ID NO: 390741 - DNA, 15 bp, Homo sapiens
atattcttttcaaaa

SEQ ID NO: 390742 - DNA, 15 bp, Homo sapiens
tattcttttcaaaac

SEQ ID NO: 390743 - DNA, 15 bp, Homo sapiens
attcttttcaaaact

SEQ ID NO: 390744 - DNA, 15 bp, Homo sapiens
ttcttttcaaaacta

SEQ ID NO: 390745 - DNA, 15 bp, Homo sapiens
tcttttcaaaactat

SEQ ID NO: 390746 - DNA, 15 bp, Homo sapiens
cttttcaaaactatt

SEQ ID NO: 390747 - DNA, 15 bp, Homo sapiens
ttttcaaaactattt

SEQ ID NO: 390748 - DNA, 15 bp, Homo sapiens
tttcaaaactatttc

SEQ ID NO: 390749 - DNA, 15 bp, Homo sapiens
ttcaaaactatttcg

SEQ ID NO: 390750 - DNA, 15 bp, Homo sapiens
tcaaaactatttcga

SEQ ID NO: 390751 - DNA, 15 bp, Homo sapiens
caaaactatttcgat

SEQ ID NO: 390752 - DNA, 15 bp, Homo sapiens
aaaactatttcgatg

SEQ ID NO: 390753 - DNA, 15 bp, Homo sapiens
aaactatttcgatgt

SEQ ID NO: 390754 - DNA, 15 bp, Homo sapiens
aactatttcgatgtt

SEQ ID NO: 390755 - DNA, 15 bp, Homo sapiens
actatttcgatgttc

SEQ ID NO: 390756 - DNA, 15 bp, Homo sapiens
ctatttcgatgttcg

SEQ ID NO: 390757 - DNA, 15 bp, Homo sapiens
tatttcgatgttcga

SEQ ID NO: 390758 - DNA, 15 bp, Homo sapiens
atttcgatgttcgat

SEQ ID NO: 390759 - DNA, 15 bp, Homo sapiens
tttcgatgttcgatg

SEQ ID NO: 390760 - DNA, 15 bp, Homo sapiens
ttcgatgttcgatgt

SEQ ID NO: 390761 - DNA, 15 bp, Homo sapiens
tcgatgttcgatgtt

SEQ ID NO: 390762 - DNA, 15 bp, Homo sapiens
cgatgttcgatgttc

SEQ ID NO: 390763 - DNA, 15 bp, Homo sapiens
gatgttcgatgttca

SEQ ID NO: 390764 - DNA, 15 bp, Homo sapiens
atgttcgatgttcaa

SEQ ID NO: 390765 - DNA, 15 bp, Homo sapiens
tgttcgatgttcaag

SEQ ID NO: 390766 - DNA, 15 bp, Homo sapiens
gttcgatgttcaagt

SEQ ID NO: 390767 - DNA, 15 bp, Homo sapiens
ttcgatgttcaagta

SEQ ID NO: 390768 - DNA, 15 bp, Homo sapiens
tcgatgttcaagtat

SEQ ID NO: 390769 - DNA, 15 bp, Homo sapiens
cgatgttcaagtatt

SEQ ID NO: 390770 - DNA, 15 bp, Homo sapiens
gatgttcaagtattg

SEQ ID NO: 390771 - DNA, 15 bp, Homo sapiens
atgttcaagtattgg

SEQ ID NO: 390772 - DNA, 15 bp, Homo sapiens
tgttcaagtattggc

SEQ ID NO: 390773 - DNA, 15 bp, Homo sapiens
gttcaagtattggct

SEQ ID NO: 390774 - DNA, 15 bp, Homo sapiens
ttcaagtattggcta

SEQ ID NO: 390775 - DNA, 15 bp, Homo sapiens
tcaagtattggctat

SEQ ID NO: 390776 - DNA, 15 bp, Homo sapiens
caagtattggctata

SEQ ID NO: 390777 - DNA, 15 bp, Homo sapiens
aagtattggctatat

SEQ ID NO: 390778 - DNA, 15 bp, Homo sapiens
agtattggctatata

SEQ ID NO: 390779 - DNA, 15 bp, Homo sapiens
gtattggctatataa

SEQ ID NO: 390780 - DNA, 15 bp, Homo sapiens
tattggctatataat

SEQ ID NO: 390781 - DNA, 15 bp, Homo sapiens
attggctatataatg

SEQ ID NO: 390782 - DNA, 15 bp, Homo sapiens
ttggctatataatgt

SEQ ID NO: 390783 - DNA, 15 bp, Homo sapiens
tggctatataatgtt

SEQ ID NO: 390784 - DNA, 15 bp, Homo sapiens
ggctatataatgtta

SEQ ID NO: 390785 - DNA, 15 bp, Homo sapiens
gctatataatgttaa

SEQ ID NO: 390786 - DNA, 15 bp, Homo sapiens
ctatataatgttaag

SEQ ID NO: 390787 - DNA, 15 bp, Homo sapiens
tatataatgttaagg

SEQ ID NO: 390788 - DNA, 15 bp, Homo sapiens
atataatgttaagga

SEQ ID NO: 390789 - DNA, 15 bp, Homo sapiens
tataatgttaaggaa

SEQ ID NO: 390790 - DNA, 15 bp, Homo sapiens
ataatgttaaggaaa

SEQ ID NO: 390791 - DNA, 15 bp, Homo sapiens
taatgttaaggaaat

SEQ ID NO: 390792 - DNA, 15 bp, Homo sapiens
aatgttaaggaaata

SEQ ID NO: 390793 - DNA, 15 bp, Homo sapiens
atgttaaggaaataa

SEQ ID NO: 390794 - DNA, 15 bp, Homo sapiens
tgttaaggaaataaa

SEQ ID NO: 390795 - DNA, 15 bp, Homo sapiens
gttaaggaaataaag

SEQ ID NO: 390796 - DNA, 15 bp, Homo sapiens
ttaaggaaataaaga

SEQ ID NO: 390797 - DNA, 15 bp, Homo sapiens
taaggaaataaagat

SEQ ID NO: 390798 - DNA, 15 bp, Homo sapiens
aaggaaataaagatt

SEQ ID NO: 390799 - DNA, 15 bp, Homo sapiens
aggaaataaagattt

SEQ ID NO: 390800 - DNA, 15 bp, Homo sapiens
ggaaataaagatttt

SEQ ID NO: 390801 - DNA, 15 bp, Homo sapiens
gaaataaagattttt

SEQ ID NO: 390802 - DNA, 15 bp, Homo sapiens
aaataaagattttta

SEQ ID NO: 390803 - DNA, 15 bp, Homo sapiens
aataaagatttttaa

SEQ ID NO: 390804 - DNA, 15 bp, Homo sapiens
ataaagatttttaaa

SEQ ID NO: 390805 - DNA, 15 bp, Homo sapiens
taaagatttttaaaa

SEQ ID NO: 390806 - DNA, 15 bp, Homo sapiens
aaagatttttaaaaa

SEQ ID NO: 390807 - DNA, 15 bp, Homo sapiens
aagatttttaaaaat

SEQ ID NO: 390808 - DNA, 15 bp, Homo sapiens
agatttttaaaaatg

SEQ ID NO: 390809 - DNA, 15 bp, Homo sapiens
atttttaaaaatgag

SEQ ID NO: 390810 - DNA, 15 bp, Homo sapiens
tttttaaaaatgagt

SEQ ID NO: 390811 - DNA, 15 bp, Homo sapiens
ttttaaaaatgagtt

SEQ ID NO: 390812 - DNA, 15 bp, Homo sapiens
tttaaaaatgagttc

SEQ ID NO: 390813 - DNA, 15 bp, Homo sapiens
ttaaaaatgagttca

SEQ ID NO: 390814 - DNA, 15 bp, Homo sapiens
taaaaatgagttcat

SEQ ID NO: 390815 - DNA, 15 bp, Homo sapiens
aaaaatgagttcatt

SEQ ID NO: 390816 - DNA, 15 bp, Homo sapiens
aaaatgagttcattt

SEQ ID NO: 390817 - DNA, 15 bp, Homo sapiens
aaatgagttcatttt

SEQ ID NO: 390818 - DNA, 15 bp, Homo sapiens
aatgagttcattttg

SEQ ID NO: 390819 - DNA, 15 bp, Homo sapiens
atgagttcattttgc

SEQ ID NO: 390820 - DNA, 15 bp, Homo sapiens
tgagttcattttgca

SEQ ID NO: 390821 - DNA, 15 bp, Homo sapiens
gagttcattttgcac

SEQ ID NO: 390822 - DNA, 15 bp, Homo sapiens
agttcattttgcact

SEQ ID NO: 390823 - DNA, 15 bp, Homo sapiens
gttcattttgcactt

SEQ ID NO: 390824 - DNA, 15 bp, Homo sapiens
ttcattttgcacttt

SEQ ID NO: 390825 - DNA, 15 bp, Homo sapiens
tcattttgcactttg

SEQ ID NO: 390826 - DNA, 15 bp, Homo sapiens
cattttgcactttga

SEQ ID NO: 390827 - DNA, 15 bp, Homo sapiens
attttgcactttgat

SEQ ID NO: 390828 - DNA, 15 bp, Homo sapiens
ttttgcactttgata

SEQ ID NO: 390829 - DNA, 15 bp, Homo sapiens
tttgcactttgataa

SEQ ID NO: 390830 - DNA, 15 bp, Homo sapiens
ttgcactttgataag

SEQ ID NO: 390831 - DNA, 15 bp, Homo sapiens
tgcactttgataaga

SEQ ID NO: 390832 - DNA, 15 bp, Homo sapiens
gcactttgataagaa

SEQ ID NO: 390833 - DNA, 15 bp, Homo sapiens
cactttgataagaaa

SEQ ID NO: 390834 - DNA, 15 bp, Homo sapiens
actttgataagaaag

SEQ ID NO: 390835 - DNA, 15 bp, Homo sapiens
ctttgataagaaaga

SEQ ID NO: 390836 - DNA, 15 bp, Homo sapiens
tttgataagaaagat

SEQ ID NO: 390837 - DNA, 15 bp, Homo sapiens
ttgataagaaagatg

SEQ ID NO: 390838 - DNA, 15 bp, Homo sapiens
tgataagaaagatgg

SEQ ID NO: 390839 - DNA, 15 bp, Homo sapiens
gataagaaagatgga

SEQ ID NO: 390840 - DNA, 15 bp, Homo sapiens
ataagaaagatggat

SEQ ID NO: 390841 - DNA, 15 bp, Homo sapiens
taagaaagatggatt

SEQ ID NO: 390842 - DNA, 15 bp, Homo sapiens
aagaaagatggattg

SEQ ID NO: 390843 - DNA, 15 bp, Homo sapiens
agaaagatggattgg

SEQ ID NO: 390844 - DNA, 15 bp, Homo sapiens
gaaagatggattggg

SEQ ID NO: 390845 - DNA, 15 bp, Homo sapiens
aaagatggattgggt

SEQ ID NO: 390846 - DNA, 15 bp, Homo sapiens
aagatggattgggtc

SEQ ID NO: 390847 - DNA, 15 bp, Homo sapiens
agatggattgggtca

SEQ ID NO: 390848 - DNA, 15 bp, Homo sapiens
gatggattgggtcat

SEQ ID NO: 390849 - DNA, 15 bp, Homo sapiens
atggattgggtcatt

SEQ ID NO: 390850 - DNA, 15 bp, Homo sapiens
tggattgggtcattt

SEQ ID NO: 390851 - DNA, 15 bp, Homo sapiens
ggattgggtcatttc

SEQ ID NO: 390852 - DNA, 15 bp, Homo sapiens
gattgggtcatttcc

SEQ ID NO: 390853 - DNA, 15 bp, Homo sapiens
attgggtcatttcca

SEQ ID NO: 390854 - DNA, 15 bp, Homo sapiens
ttgggtcatttccat

SEQ ID NO: 390855 - DNA, 15 bp, Homo sapiens
tgggtcatttccatc

SEQ ID NO: 390856 - DNA, 15 bp, Homo sapiens
gggtcatttccatcc

SEQ ID NO: 390857 - DNA, 15 bp, Homo sapiens
ggtcatttccatcca

SEQ ID NO: 390858 - DNA, 15 bp, Homo sapiens
gtcatttccatccat

SEQ ID NO: 390859 - DNA, 15 bp, Homo sapiens
tcatttccatccata

SEQ ID NO: 390860 - DNA, 15 bp, Homo sapiens
catttccatccatat

SEQ ID NO: 390861 - DNA, 15 bp, Homo sapiens
atttccatccatatt

SEQ ID NO: 390862 - DNA, 15 bp, Homo sapiens
tttccatccatatta

SEQ ID NO: 390863 - DNA, 15 bp, Homo sapiens
ttccatccatattaa

SEQ ID NO: 390864 - DNA, 15 bp, Homo sapiens
tccatccatattaaa

SEQ ID NO: 390865 - DNA, 15 bp, Homo sapiens
ccatccatattaaaa

SEQ ID NO: 390866 - DNA, 15 bp, Homo sapiens
catccatattaaaat

SEQ ID NO: 390867 - DNA, 15 bp, Homo sapiens
atccatattaaaata

SEQ ID NO: 390868 - DNA, 15 bp, Homo sapiens
tccatattaaaatag

SEQ ID NO: 390869 - DNA, 15 bp, Homo sapiens
ccatattaaaatagt

SEQ ID NO: 390870 - DNA, 15 bp, Homo sapiens
catattaaaatagtt

SEQ ID NO: 390871 - DNA, 15 bp, Homo sapiens
atattaaaatagttg

SEQ ID NO: 390872 - DNA, 15 bp, Homo sapiens
tattaaaatagttgg

SEQ ID NO: 390873 - DNA, 15 bp, Homo sapiens
attaaaatagttggt

SEQ ID NO: 390874 - DNA, 15 bp, Homo sapiens
ttaaaatagttggtt

SEQ ID NO: 390875 - DNA, 15 bp, Homo sapiens
taaaatagttggttc

SEQ ID NO: 390876 - DNA, 15 bp, Homo sapiens
aaaatagttggttct

SEQ ID NO: 390877 - DNA, 15 bp, Homo sapiens
aaatagttggttctg

SEQ ID NO: 390878 - DNA, 15 bp, Homo sapiens
atagttggttctggt

SEQ ID NO: 390879 - DNA, 15 bp, Homo sapiens
tagttggttctggtt

SEQ ID NO: 390880 - DNA, 15 bp, Homo sapiens
agttggttctggttt

SEQ ID NO: 390881 - DNA, 15 bp, Homo sapiens
gttggttctggtttt

SEQ ID NO: 390882 - DNA, 15 bp, Homo sapiens
ttggttctggttttt

SEQ ID NO: 390883 - DNA, 15 bp, Homo sapiens
tggttctggtttttg

SEQ ID NO: 390884 - DNA, 15 bp, Homo sapiens
ggttctggtttttga

SEQ ID NO: 390885 - DNA, 15 bp, Homo sapiens
gttctggtttttgat

SEQ ID NO: 390886 - DNA, 15 bp, Homo sapiens
ttctggtttttgatt

SEQ ID NO: 390887 - DNA, 15 bp, Homo sapiens
tctggtttttgattt

SEQ ID NO: 390888 - DNA, 15 bp, Homo sapiens
ctggtttttgattta

SEQ ID NO: 390889 - DNA, 15 bp, Homo sapiens
tggtttttgatttat

SEQ ID NO: 390890 - DNA, 15 bp, Homo sapiens
ggtttttgatttata

SEQ ID NO: 390891 - DNA, 15 bp, Homo sapiens
gtttttgatttataa

SEQ ID NO: 390892 - DNA, 15 bp, Homo sapiens
tttttgatttataac

SEQ ID NO: 390893 - DNA, 15 bp, Homo sapiens
ttttgatttataact

SEQ ID NO: 390894 - DNA, 15 bp, Homo sapiens
tttgatttataactt

SEQ ID NO: 390895 - DNA, 15 bp, Homo sapiens
ttgatttataactta

SEQ ID NO: 390896 - DNA, 15 bp, Homo sapiens
tgatttataacttaa

SEQ ID NO: 390897 - DNA, 15 bp, Homo sapiens
gatttataacttaat

SEQ ID NO: 390898 - DNA, 15 bp, Homo sapiens
atttataacttaatt

SEQ ID NO: 390899 - DNA, 15 bp, Homo sapiens
tttataacttaattt

SEQ ID NO: 390900 - DNA, 15 bp, Homo sapiens
ttataacttaatttg

SEQ ID NO: 390901 - DNA, 15 bp, Homo sapiens
tataacttaatttgg

SEQ ID NO: 390902 - DNA, 15 bp, Homo sapiens
ataacttaatttggt

SEQ ID NO: 390903 - DNA, 15 bp, Homo sapiens
taacttaatttggtt

SEQ ID NO: 390904 - DNA, 15 bp, Homo sapiens
aacttaatttggttt

SEQ ID NO: 390905 - DNA, 15 bp, Homo sapiens
acttaatttggtttg

SEQ ID NO: 390906 - DNA, 15 bp, Homo sapiens
cttaatttggtttga

SEQ ID NO: 390907 - DNA, 15 bp, Homo sapiens
ttaatttggtttgat

SEQ ID NO: 390908 - DNA, 15 bp, Homo sapiens
taatttggtttgatt

SEQ ID NO: 390909 - DNA, 15 bp, Homo sapiens
aatttggtttgattc

SEQ ID NO: 390910 - DNA, 15 bp, Homo sapiens
atttggtttgattct

SEQ ID NO: 390911 - DNA, 15 bp, Homo sapiens
tttggtttgattctt

SEQ ID NO: 390912 - DNA, 15 bp, Homo sapiens
ttggtttgattctta

SEQ ID NO: 390913 - DNA, 15 bp, Homo sapiens
tggtttgattcttaa

SEQ ID NO: 390914 - DNA, 15 bp, Homo sapiens
ggtttgattcttaac

SEQ ID NO: 390915 - DNA, 15 bp, Homo sapiens
gtttgattcttaaca

SEQ ID NO: 390916 - DNA, 15 bp, Homo sapiens
tttgattcttaacag

SEQ ID NO: 390917 - DNA, 15 bp, Homo sapiens
ttgattcttaacagt

SEQ ID NO: 390918 - DNA, 15 bp, Homo sapiens
tgattcttaacagta

SEQ ID NO: 390919 - DNA, 15 bp, Homo sapiens
gattcttaacagtac

SEQ ID NO: 390920 - DNA, 15 bp, Homo sapiens
attcttaacagtaca

SEQ ID NO: 390921 - DNA, 15 bp, Homo sapiens
ttcttaacagtacaa

SEQ ID NO: 390922 - DNA, 15 bp, Homo sapiens
tcttaacagtacaaa

SEQ ID NO: 390923 - DNA, 15 bp, Homo sapiens
cttaacagtacaaac

SEQ ID NO: 390924 - DNA, 15 bp, Homo sapiens
ttaacagtacaaacg

SEQ ID NO: 390925 - DNA, 15 bp, Homo sapiens
taacagtacaaacgt

SEQ ID NO: 390926 - DNA, 15 bp, Homo sapiens
aacagtacaaacgtt

SEQ ID NO: 390927 - DNA, 15 bp, Homo sapiens
acagtacaaacgtta

SEQ ID NO: 390928 - DNA, 15 bp, Homo sapiens
cagtacaaacgttaa

SEQ ID NO: 390929 - DNA, 15 bp, Homo sapiens
agtacaaacgttaaa

SEQ ID NO: 390930 - DNA, 15 bp, Homo sapiens
gtacaaacgttaaat

SEQ ID NO: 390931 - DNA, 15 bp, Homo sapiens
tacaaacgttaaatt

SEQ ID NO: 390932 - DNA, 15 bp, Homo sapiens
acaaacgttaaatta

SEQ ID NO: 390933 - DNA, 15 bp, Homo sapiens
caaacgttaaattat

SEQ ID NO: 390934 - DNA, 15 bp, Homo sapiens
aaacgttaaattatg

SEQ ID NO: 390935 - DNA, 15 bp, Homo sapiens
aacgttaaattatgt

SEQ ID NO: 390936 - DNA, 15 bp, Homo sapiens
acgttaaattatgtg

SEQ ID NO: 390937 - DNA, 15 bp, Homo sapiens
cgttaaattatgtgt

SEQ ID NO: 390938 - DNA, 15 bp, Homo sapiens
gttaaattatgtgtt

SEQ ID NO: 390939 - DNA, 15 bp, Homo sapiens
ttaaattatgtgttc

SEQ ID NO: 390940 - DNA, 15 bp, Homo sapiens
taaattatgtgttca

SEQ ID NO: 390941 - DNA, 15 bp, Homo sapiens
aaattatgtgttcat

SEQ ID NO: 390942 - DNA, 15 bp, Homo sapiens
aattatgtgttcatt

SEQ ID NO: 390943 - DNA, 15 bp, Homo sapiens
attatgtgttcattg

SEQ ID NO: 390944 - DNA, 15 bp, Homo sapiens
ttatgtgttcattga

SEQ ID NO: 390945 - DNA, 15 bp, Homo sapiens
tatgtgttcattgaa

SEQ ID NO: 390946 - DNA, 15 bp, Homo sapiens
atgtgttcattgaac

SEQ ID NO: 390947 - DNA, 15 bp, Homo sapiens
tgtgttcattgaacc

SEQ ID NO: 390948 - DNA, 15 bp, Homo sapiens
gtgttcattgaaccc

SEQ ID NO: 390949 - DNA, 15 bp, Homo sapiens
tgttcattgaaccca

SEQ ID NO: 390950 - DNA, 15 bp, Homo sapiens
gttcattgaacccag

SEQ ID NO: 390951 - DNA, 15 bp, Homo sapiens
ttcattgaacccagt

SEQ ID NO: 390952 - DNA, 15 bp, Homo sapiens
tcattgaacccagtt

SEQ ID NO: 390953 - DNA, 15 bp, Homo sapiens
cattgaacccagttc

SEQ ID NO: 390954 - DNA, 15 bp, Homo sapiens
attgaacccagttct

SEQ ID NO: 390955 - DNA, 15 bp, Homo sapiens
ttgaacccagttctc

SEQ ID NO: 390956 - DNA, 15 bp, Homo sapiens
tgaacccagttctcc

SEQ ID NO: 390957 - DNA, 15 bp, Homo sapiens
gaacccagttctcca

SEQ ID NO: 390958 - DNA, 15 bp, Homo sapiens
aacccagttctccat

SEQ ID NO: 390959 - DNA, 15 bp, Homo sapiens
acccagttctccata

SEQ ID NO: 390960 - DNA, 15 bp, Homo sapiens
cccagttctccatac

SEQ ID NO: 390961 - DNA, 15 bp, Homo sapiens
ccagttctccatacc

SEQ ID NO: 390962 - DNA, 15 bp, Homo sapiens
cagttctccataccc

SEQ ID NO: 390963 - DNA, 15 bp, Homo sapiens
agttctccataccca

SEQ ID NO: 390964 - DNA, 15 bp, Homo sapiens
gttctccatacccac

SEQ ID NO: 390965 - DNA, 15 bp, Homo sapiens
ttctccatacccaca

SEQ ID NO: 390966 - DNA, 15 bp, Homo sapiens
tctccatacccacat

SEQ ID NO: 390967 - DNA, 15 bp, Homo sapiens
ctccatacccacatg

SEQ ID NO: 390968 - DNA, 15 bp, Homo sapiens
tccatacccacatgt

SEQ ID NO: 390969 - DNA, 15 bp, Homo sapiens
ccatacccacatgta

SEQ ID NO: 390970 - DNA, 15 bp, Homo sapiens
catacccacatgtag

SEQ ID NO: 390971 - DNA, 15 bp, Homo sapiens
atacccacatgtagt

SEQ ID NO: 390972 - DNA, 15 bp, Homo sapiens
tacccacatgtagtt

SEQ ID NO: 390973 - DNA, 15 bp, Homo sapiens
acccacatgtagttt

SEQ ID NO: 390974 - DNA, 15 bp, Homo sapiens
cccacatgtagtttt

SEQ ID NO: 390975 - DNA, 15 bp, Homo sapiens
ccacatgtagttttt

SEQ ID NO: 390976 - DNA, 15 bp, Homo sapiens
cacatgtagtttttt

SEQ ID NO: 390977 - DNA, 15 bp, Homo sapiens
acatgtagtttttta

SEQ ID NO: 390978 - DNA, 15 bp, Homo sapiens
catgtagttttttat

SEQ ID NO: 390979 - DNA, 15 bp, Homo sapiens
atgtagttttttatc

SEQ ID NO: 390980 - DNA, 15 bp, Homo sapiens
tgtagttttttatca

SEQ ID NO: 390981 - DNA, 15 bp, Homo sapiens
gtagttttttatcat

SEQ ID NO: 390982 - DNA, 15 bp, Homo sapiens
tagttttttatcatt

SEQ ID NO: 390983 - DNA, 15 bp, Homo sapiens
agttttttatcatta

SEQ ID NO: 390984 - DNA, 15 bp, Homo sapiens
gttttttatcattat

SEQ ID NO: 390985 - DNA, 15 bp, Homo sapiens
ttttttatcattata

SEQ ID NO: 390986 - DNA, 15 bp, Homo sapiens
ttttatcattatatt

SEQ ID NO: 390987 - DNA, 15 bp, Homo sapiens
tttatcattatattt

SEQ ID NO: 390988 - DNA, 15 bp, Homo sapiens
ttatcattatattta

SEQ ID NO: 390989 - DNA, 15 bp, Homo sapiens
tatcattatatttaa

SEQ ID NO: 390990 - DNA, 15 bp, Homo sapiens
atcattatatttaaa

SEQ ID NO: 390991 - DNA, 15 bp, Homo sapiens
tcattatatttaaaa

SEQ ID NO: 390992 - DNA, 15 bp, Homo sapiens
cattatatttaaaag

SEQ ID NO: 390993 - DNA, 15 bp, Homo sapiens
attatatttaaaagg

SEQ ID NO: 390994 - DNA, 15 bp, Homo sapiens
ttatatttaaaagga

SEQ ID NO: 390995 - DNA, 15 bp, Homo sapiens
tatatttaaaaggac

SEQ ID NO: 390996 - DNA, 15 bp, Homo sapiens
atatttaaaaggaca

SEQ ID NO: 390997 - DNA, 15 bp, Homo sapiens
tatttaaaaggacat

SEQ ID NO: 390998 - DNA, 15 bp, Homo sapiens
atttaaaaggacata

SEQ ID NO: 390999 - DNA, 15 bp, Homo sapiens
tttaaaaggacataa

SEQ ID NO: 391000 - DNA, 15 bp, Homo sapiens
ttaaaaggacataat

SEQ ID NO: 391001 - DNA, 15 bp, Homo sapiens
taaaaggacataata

SEQ ID NO: 391002 - DNA, 15 bp, Homo sapiens
aaaaggacataatag

SEQ ID NO: 391003 - DNA, 15 bp, Homo sapiens
aaaggacataatagc

SEQ ID NO: 391004 - DNA, 15 bp, Homo sapiens
aaggacataatagct

SEQ ID NO: 391005 - DNA, 15 bp, Homo sapiens
aggacataatagctc

SEQ ID NO: 391006 - DNA, 15 bp, Homo sapiens
ggacataatagctcc

SEQ ID NO: 391007 - DNA, 15 bp, Homo sapiens
gacataatagctccc

SEQ ID NO: 391008 - DNA, 15 bp, Homo sapiens
acataatagctccct

SEQ ID NO: 391009 - DNA, 15 bp, Homo sapiens
cataatagctcccta

SEQ ID NO: 391010 - DNA, 15 bp, Homo sapiens
ataatagctccctaa

SEQ ID NO: 391011 - DNA, 15 bp, Homo sapiens
taatagctccctaag

SEQ ID NO: 391012 - DNA, 15 bp, Homo sapiens
aatagctccctaaga

SEQ ID NO: 391013 - DNA, 15 bp, Homo sapiens
atagctccctaagaa

SEQ ID NO: 391014 - DNA, 15 bp, Homo sapiens
tagctccctaagaaa

SEQ ID NO: 391015 - DNA, 15 bp, Homo sapiens
agctccctaagaaag

SEQ ID NO: 391016 - DNA, 15 bp, Homo sapiens
gctccctaagaaaga

SEQ ID NO: 391017 - DNA, 15 bp, Homo sapiens
ctccctaagaaagaa

SEQ ID NO: 391018 - DNA, 15 bp, Homo sapiens
tccctaagaaagaaa

SEQ ID NO: 391019 - DNA, 15 bp, Homo sapiens
ccctaagaaagaaac

SEQ ID NO: 391020 - DNA, 15 bp, Homo sapiens
cctaagaaagaaact

SEQ ID NO: 391021 - DNA, 15 bp, Homo sapiens
ctaagaaagaaactg

SEQ ID NO: 391022 - DNA, 15 bp, Homo sapiens
taagaaagaaactga

SEQ ID NO: 391023 - DNA, 15 bp, Homo sapiens
aagaaagaaactgaa

SEQ ID NO: 391024 - DNA, 15 bp, Homo sapiens
agaaagaaactgaaa

SEQ ID NO: 391025 - DNA, 15 bp, Homo sapiens
gaaagaaactgaaag

SEQ ID NO: 391026 - DNA, 15 bp, Homo sapiens
aaagaaactgaaagg

SEQ ID NO: 391027 - DNA, 15 bp, Homo sapiens
aagaaactgaaagga

SEQ ID NO: 391028 - DNA, 15 bp, Homo sapiens
agaaactgaaaggag

SEQ ID NO: 391029 - DNA, 15 bp, Homo sapiens
gaaactgaaaggagt

SEQ ID NO: 391030 - DNA, 15 bp, Homo sapiens
aaactgaaaggagtc

SEQ ID NO: 391031 - DNA, 15 bp, Homo sapiens
aactgaaaggagtca

SEQ ID NO: 391032 - DNA, 15 bp, Homo sapiens
actgaaaggagtcaa

SEQ ID NO: 391033 - DNA, 15 bp, Homo sapiens
ctgaaaggagtcaac

SEQ ID NO: 391034 - DNA, 15 bp, Homo sapiens
tgaaaggagtcaact

SEQ ID NO: 391035 - DNA, 15 bp, Homo sapiens
gaaaggagtcaacta

SEQ ID NO: 391036 - DNA, 15 bp, Homo sapiens
aaaggagtcaactaa

SEQ ID NO: 391037 - DNA, 15 bp, Homo sapiens
aaggagtcaactaac

SEQ ID NO: 391038 - DNA, 15 bp, Homo sapiens
aggagtcaactaact

SEQ ID NO: 391039 - DNA, 15 bp, Homo sapiens
ggagtcaactaactt

SEQ ID NO: 391040 - DNA, 15 bp, Homo sapiens
gagtcaactaactta

SEQ ID NO: 391041 - DNA, 15 bp, Homo sapiens
agtcaactaacttaa

SEQ ID NO: 391042 - DNA, 15 bp, Homo sapiens
gtcaactaacttaac

SEQ ID NO: 391043 - DNA, 15 bp, Homo sapiens
tcaactaacttaaca

SEQ ID NO: 391044 - DNA, 15 bp, Homo sapiens
caactaacttaacag

SEQ ID NO: 391045 - DNA, 15 bp, Homo sapiens
aactaacttaacaga

SEQ ID NO: 391046 - DNA, 15 bp, Homo sapiens
actaacttaacagac

SEQ ID NO: 391047 - DNA, 15 bp, Homo sapiens
ctaacttaacagact

SEQ ID NO: 391048 - DNA, 15 bp, Homo sapiens
taacttaacagactg

SEQ ID NO: 391049 - DNA, 15 bp, Homo sapiens
aacttaacagactga

SEQ ID NO: 391050 - DNA, 15 bp, Homo sapiens
acttaacagactgag

SEQ ID NO: 391051 - DNA, 15 bp, Homo sapiens
cttaacagactgagt

SEQ ID NO: 391052 - DNA, 15 bp, Homo sapiens
ttaacagactgagtt

SEQ ID NO: 391053 - DNA, 15 bp, Homo sapiens
taacagactgagttg

SEQ ID NO: 391054 - DNA, 15 bp, Homo sapiens
aacagactgagttgt

SEQ ID NO: 391055 - DNA, 15 bp, Homo sapiens
acagactgagttgtt

SEQ ID NO: 391056 - DNA, 15 bp, Homo sapiens
cagactgagttgttt

SEQ ID NO: 391057 - DNA, 15 bp, Homo sapiens
agactgagttgttta

SEQ ID NO: 391058 - DNA, 15 bp, Homo sapiens
gactgagttgtttaa

SEQ ID NO: 391059 - DNA, 15 bp, Homo sapiens
actgagttgtttaaa

SEQ ID NO: 391060 - DNA, 15 bp, Homo sapiens
ctgagttgtttaaaa

SEQ ID NO: 391061 - DNA, 15 bp, Homo sapiens
tgagttgtttaaaat

SEQ ID NO: 391062 - DNA, 15 bp, Homo sapiens
gagttgtttaaaata

SEQ ID NO: 391063 - DNA, 15 bp, Homo sapiens
agttgtttaaaataa

SEQ ID NO: 391064 - DNA, 15 bp, Homo sapiens
gttgtttaaaataag

SEQ ID NO: 391065 - DNA, 15 bp, Homo sapiens
ttgtttaaaataaga

SEQ ID NO: 391066 - DNA, 15 bp, Homo sapiens
tgtttaaaataagaa

SEQ ID NO: 391067 - DNA, 15 bp, Homo sapiens
gtttaaaataagaaa

SEQ ID NO: 391068 - DNA, 15 bp, Homo sapiens
tttaaaataagaaat

SEQ ID NO: 391069 - DNA, 15 bp, Homo sapiens
ttaaaataagaaata

SEQ ID NO: 391070 - DNA, 15 bp, Homo sapiens
taaaataagaaatat

SEQ ID NO: 391071 - DNA, 15 bp, Homo sapiens
aaaataagaaatatg

SEQ ID NO: 391072 - DNA, 15 bp, Homo sapiens
aaataagaaatatgt

SEQ ID NO: 391073 - DNA, 15 bp, Homo sapiens
aataagaaatatgta

SEQ ID NO: 391074 - DNA, 15 bp, Homo sapiens
ataagaaatatgtat

SEQ ID NO: 391075 - DNA, 15 bp, Homo sapiens
taagaaatatgtata

SEQ ID NO: 391076 - DNA, 15 bp, Homo sapiens
aagaaatatgtatat

SEQ ID NO: 391077 - DNA, 15 bp, Homo sapiens
agaaatatgtatata

SEQ ID NO: 391078 - DNA, 15 bp, Homo sapiens
gaaatatgtatatat

SEQ ID NO: 391079 - DNA, 15 bp, Homo sapiens
aaatatgtatatatt

SEQ ID NO: 391080 - DNA, 15 bp, Homo sapiens
aatatgtatatattt

SEQ ID NO: 391081 - DNA, 15 bp, Homo sapiens
atgtatatattttta

SEQ ID NO: 391082 - DNA, 15 bp, Homo sapiens
tgtatatatttttaa

SEQ ID NO: 391083 - DNA, 15 bp, Homo sapiens
gtatatatttttaaa

SEQ ID NO: 391084 - DNA, 15 bp, Homo sapiens
tatatatttttaaaa

SEQ ID NO: 391085 - DNA, 15 bp, Homo sapiens
atatatttttaaaaa

SEQ ID NO: 391086 - DNA, 15 bp, Homo sapiens
tatatttttaaaaaa

SEQ ID NO: 391087 - DNA, 15 bp, Homo sapiens
atatttttaaaaaat

SEQ ID NO: 391088 - DNA, 15 bp, Homo sapiens
tatttttaaaaaatt

SEQ ID NO: 391089 - DNA, 15 bp, Homo sapiens
atttttaaaaaattt

SEQ ID NO: 391090 - DNA, 15 bp, Homo sapiens
tttttaaaaaattta

SEQ ID NO: 391091 - DNA, 15 bp, Homo sapiens
ttttaaaaaatttaa

SEQ ID NO: 391092 - DNA, 15 bp, Homo sapiens
tttaaaaaatttaat

SEQ ID NO: 391093 - DNA, 15 bp, Homo sapiens
ttaaaaaatttaatt

SEQ ID NO: 391094 - DNA, 15 bp, Homo sapiens
taaaaaatttaattc

SEQ ID NO: 391095 - DNA, 15 bp, Homo sapiens
aaaaaatttaattca

SEQ ID NO: 391096 - DNA, 15 bp, Homo sapiens
aaaaatttaattcaa

SEQ ID NO: 391097 - DNA, 15 bp, Homo sapiens
aaaatttaattcaaa

SEQ ID NO: 391098 - DNA, 15 bp, Homo sapiens
aaatttaattcaaag

SEQ ID NO: 391099 - DNA, 15 bp, Homo sapiens
aatttaattcaaaga

SEQ ID NO: 391100 - DNA, 15 bp, Homo sapiens
atttaattcaaagaa

SEQ ID NO: 391101 - DNA, 15 bp, Homo sapiens
tttaattcaaagaac

SEQ ID NO: 391102 - DNA, 15 bp, Homo sapiens
ttaattcaaagaaca

SEQ ID NO: 391103 - DNA, 15 bp, Homo sapiens
taattcaaagaacat

SEQ ID NO: 391104 - DNA, 15 bp, Homo sapiens
aattcaaagaacatg

SEQ ID NO: 391105 - DNA, 15 bp, Homo sapiens
attcaaagaacatgt

SEQ ID NO: 391106 - DNA, 15 bp, Homo sapiens
ttcaaagaacatgta

SEQ ID NO: 391107 - DNA, 15 bp, Homo sapiens
tcaaagaacatgtat

SEQ ID NO: 391108 - DNA, 15 bp, Homo sapiens
caaagaacatgtatt

SEQ ID NO: 391109 - DNA, 15 bp, Homo sapiens
aaagaacatgtattg

SEQ ID NO: 391110 - DNA, 15 bp, Homo sapiens
aagaacatgtattga

SEQ ID NO: 391111 - DNA, 15 bp, Homo sapiens
agaacatgtattgaa

SEQ ID NO: 391112 - DNA, 15 bp, Homo sapiens
gaacatgtattgaat

SEQ ID NO: 391113 - DNA, 15 bp, Homo sapiens
aacatgtattgaatg

SEQ ID NO: 391114 - DNA, 15 bp, Homo sapiens
acatgtattgaatgg

SEQ ID NO: 391115 - DNA, 15 bp, Homo sapiens
catgtattgaatggc

SEQ ID NO: 391116 - DNA, 15 bp, Homo sapiens
atgtattgaatggct

SEQ ID NO: 391117 - DNA, 15 bp, Homo sapiens
tgtattgaatggctg

SEQ ID NO: 391118 - DNA, 15 bp, Homo sapiens
gtattgaatggctgt

SEQ ID NO: 391119 - DNA, 15 bp, Homo sapiens
tattgaatggctgtc

SEQ ID NO: 391120 - DNA, 15 bp, Homo sapiens
attgaatggctgtca

SEQ ID NO: 391121 - DNA, 15 bp, Homo sapiens
ttgaatggctgtcat

SEQ ID NO: 391122 - DNA, 15 bp, Homo sapiens
tgaatggctgtcatg

SEQ ID NO: 391123 - DNA, 15 bp, Homo sapiens
gaatggctgtcatgc

SEQ ID NO: 391124 - DNA, 15 bp, Homo sapiens
aatggctgtcatgca

SEQ ID NO: 391125 - DNA, 15 bp, Homo sapiens
atggctgtcatgcat

SEQ ID NO: 391126 - DNA, 15 bp, Homo sapiens
tggctgtcatgcatc

SEQ ID NO: 391127 - DNA, 15 bp, Homo sapiens
ggctgtcatgcatca

SEQ ID NO: 391128 - DNA, 15 bp, Homo sapiens
gctgtcatgcatcag

SEQ ID NO: 391129 - DNA, 15 bp, Homo sapiens
ctgtcatgcatcaga

SEQ ID NO: 391130 - DNA, 15 bp, Homo sapiens
tgtcatgcatcagag

SEQ ID NO: 391131 - DNA, 15 bp, Homo sapiens
gtcatgcatcagaga

SEQ ID NO: 391132 - DNA, 15 bp, Homo sapiens
tcatgcatcagagat

SEQ ID NO: 391133 - DNA, 15 bp, Homo sapiens
catgcatcagagata

SEQ ID NO: 391134 - DNA, 15 bp, Homo sapiens
atgcatcagagatat

SEQ ID NO: 391135 - DNA, 15 bp, Homo sapiens
tgcatcagagatatg

SEQ ID NO: 391136 - DNA, 15 bp, Homo sapiens
gcatcagagatatgt

SEQ ID NO: 391137 - DNA, 15 bp, Homo sapiens
catcagagatatgtg

SEQ ID NO: 391138 - DNA, 15 bp, Homo sapiens
atcagagatatgtgc

SEQ ID NO: 391139 - DNA, 15 bp, Homo sapiens
tcagagatatgtgct

SEQ ID NO: 391140 - DNA, 15 bp, Homo sapiens
cagagatatgtgcta

SEQ ID NO: 391141 - DNA, 15 bp, Homo sapiens
agagatatgtgctaa

SEQ ID NO: 391142 - DNA, 15 bp, Homo sapiens
gagatatgtgctaag

SEQ ID NO: 391143 - DNA, 15 bp, Homo sapiens
agatatgtgctaagc

SEQ ID NO: 391144 - DNA, 15 bp, Homo sapiens
gatatgtgctaagca

SEQ ID NO: 391145 - DNA, 15 bp, Homo sapiens
atatgtgctaagcag

SEQ ID NO: 391146 - DNA, 15 bp, Homo sapiens
tatgtgctaagcagc

SEQ ID NO: 391147 - DNA, 15 bp, Homo sapiens
atgtgctaagcagca

SEQ ID NO: 391148 - DNA, 15 bp, Homo sapiens
tgtgctaagcagcat

SEQ ID NO: 391149 - DNA, 15 bp, Homo sapiens
gtgctaagcagcata

SEQ ID NO: 391150 - DNA, 15 bp, Homo sapiens
tgctaagcagcataa

SEQ ID NO: 391151 - DNA, 15 bp, Homo sapiens
gctaagcagcataaa

SEQ ID NO: 391152 - DNA, 15 bp, Homo sapiens
ctaagcagcataaat

SEQ ID NO: 391153 - DNA, 15 bp, Homo sapiens
taagcagcataaatg

SEQ ID NO: 391154 - DNA, 15 bp, Homo sapiens
aagcagcataaatgt

SEQ ID NO: 391155 - DNA, 15 bp, Homo sapiens
agcagcataaatgta

SEQ ID NO: 391156 - DNA, 15 bp, Homo sapiens
gcagcataaatgtaa

SEQ ID NO: 391157 - DNA, 15 bp, Homo sapiens
cagcataaatgtaaa

SEQ ID NO: 391158 - DNA, 15 bp, Homo sapiens
agcataaatgtaaaa

SEQ ID NO: 391159 - DNA, 15 bp, Homo sapiens
gcataaatgtaaaat

SEQ ID NO: 391160 - DNA, 15 bp, Homo sapiens
cataaatgtaaaatg

SEQ ID NO: 391161 - DNA, 15 bp, Homo sapiens
ataaatgtaaaatgc

SEQ ID NO: 391162 - DNA, 15 bp, Homo sapiens
taaatgtaaaatgca

SEQ ID NO: 391163 - DNA, 15 bp, Homo sapiens
aaatgtaaaatgcag

SEQ ID NO: 391164 - DNA, 15 bp, Homo sapiens
aatgtaaaatgcagt

SEQ ID NO: 391165 - DNA, 15 bp, Homo sapiens
atgtaaaatgcagtg

SEQ ID NO: 391166 - DNA, 15 bp, Homo sapiens
tgtaaaatgcagtgt

SEQ ID NO: 391167 - DNA, 15 bp, Homo sapiens
gtaaaatgcagtgtt

SEQ ID NO: 391168 - DNA, 15 bp, Homo sapiens
taaaatgcagtgttg

SEQ ID NO: 391169 - DNA, 15 bp, Homo sapiens
aaaatgcagtgttgc

SEQ ID NO: 391170 - DNA, 15 bp, Homo sapiens
aaatgcagtgttgca

SEQ ID NO: 391171 - DNA, 15 bp, Homo sapiens
aatgcagtgttgcat

SEQ ID NO: 391172 - DNA, 15 bp, Homo sapiens
atgcagtgttgcatt

SEQ ID NO: 391173 - DNA, 15 bp, Homo sapiens
tgcagtgttgcattt

SEQ ID NO: 391174 - DNA, 15 bp, Homo sapiens
gcagtgttgcatttt

SEQ ID NO: 391175 - DNA, 15 bp, Homo sapiens
cagtgttgcattttc

SEQ ID NO: 391176 - DNA, 15 bp, Homo sapiens
agtgttgcattttcc

SEQ ID NO: 391177 - DNA, 15 bp, Homo sapiens
gtgttgcattttcca

SEQ ID NO: 391178 - DNA, 15 bp, Homo sapiens
tgttgcattttccat

SEQ ID NO: 391179 - DNA, 15 bp, Homo sapiens
gttgcattttccatg

SEQ ID NO: 391180 - DNA, 15 bp, Homo sapiens
ttgcattttccatgg

SEQ ID NO: 391181 - DNA, 15 bp, Homo sapiens
tgcattttccatggg

SEQ ID NO: 391182 - DNA, 15 bp, Homo sapiens
gcattttccatggga

SEQ ID NO: 391183 - DNA, 15 bp, Homo sapiens
cattttccatgggaa

SEQ ID NO: 391184 - DNA, 15 bp, Homo sapiens
attttccatgggaaa

SEQ ID NO: 391185 - DNA, 15 bp, Homo sapiens
ttttccatgggaaac

SEQ ID NO: 391186 - DNA, 15 bp, Homo sapiens
tttccatgggaaaca

SEQ ID NO: 391187 - DNA, 15 bp, Homo sapiens
ttccatgggaaacaa

SEQ ID NO: 391188 - DNA, 15 bp, Homo sapiens
tccatgggaaacaag

SEQ ID NO: 391189 - DNA, 15 bp, Homo sapiens
ccatgggaaacaagg

SEQ ID NO: 391190 - DNA, 15 bp, Homo sapiens
catgggaaacaagga

SEQ ID NO: 391191 - DNA, 15 bp, Homo sapiens
atgggaaacaaggaa

SEQ ID NO: 391192 - DNA, 15 bp, Homo sapiens
tgggaaacaaggaag

SEQ ID NO: 391193 - DNA, 15 bp, Homo sapiens
gggaaacaaggaagt

SEQ ID NO: 391194 - DNA, 15 bp, Homo sapiens
ggaaacaaggaagta

SEQ ID NO: 391195 - DNA, 15 bp, Homo sapiens
gaaacaaggaagtac

SEQ ID NO: 391196 - DNA, 15 bp, Homo sapiens
aaacaaggaagtaca

SEQ ID NO: 391197 - DNA, 15 bp, Homo sapiens
aacaaggaagtacaa

SEQ ID NO: 391198 - DNA, 15 bp, Homo sapiens
acaaggaagtacaaa

SEQ ID NO: 391199 - DNA, 15 bp, Homo sapiens
caaggaagtacaaat

SEQ ID NO: 391200 - DNA, 15 bp, Homo sapiens
aaggaagtacaaata

SEQ ID NO: 391201 - DNA, 15 bp, Homo sapiens
aggaagtacaaatat

SEQ ID NO: 391202 - DNA, 15 bp, Homo sapiens
ggaagtacaaatatg

SEQ ID NO: 391203 - DNA, 15 bp, Homo sapiens
gaagtacaaatatgt

SEQ ID NO: 391204 - DNA, 15 bp, Homo sapiens
aagtacaaatatgtt

SEQ ID NO: 391205 - DNA, 15 bp, Homo sapiens
agtacaaatatgttg

SEQ ID NO: 391206 - DNA, 15 bp, Homo sapiens
gtacaaatatgttgt

SEQ ID NO: 391207 - DNA, 15 bp, Homo sapiens
tacaaatatgttgtt

SEQ ID NO: 391208 - DNA, 15 bp, Homo sapiens
acaaatatgttgttc

SEQ ID NO: 391209 - DNA, 15 bp, Homo sapiens
caaatatgttgttct

SEQ ID NO: 391210 - DNA, 15 bp, Homo sapiens
aaatatgttgttctg

SEQ ID NO: 391211 - DNA, 15 bp, Homo sapiens
aatatgttgttctga

SEQ ID NO: 391212 - DNA, 15 bp, Homo sapiens
atatgttgttctgag

SEQ ID NO: 391213 - DNA, 15 bp, Homo sapiens
tatgttgttctgagg

SEQ ID NO: 391214 - DNA, 15 bp, Homo sapiens
atgttgttctgagga

SEQ ID NO: 391215 - DNA, 15 bp, Homo sapiens
tgttgttctgaggaa

SEQ ID NO: 391216 - DNA, 15 bp, Homo sapiens
gttgttctgaggaat

SEQ ID NO: 391217 - DNA, 15 bp, Homo sapiens
ttgttctgaggaatt

SEQ ID NO: 391218 - DNA, 15 bp, Homo sapiens
tgttctgaggaattt

SEQ ID NO: 391219 - DNA, 15 bp, Homo sapiens
gttctgaggaatttt

SEQ ID NO: 391220 - DNA, 15 bp, Homo sapiens
ttctgaggaatttta

SEQ ID NO: 391221 - DNA, 15 bp, Homo sapiens
tctgaggaattttag

SEQ ID NO: 391222 - DNA, 15 bp, Homo sapiens
ctgaggaattttagt

SEQ ID NO: 391223 - DNA, 15 bp, Homo sapiens
tgaggaattttagtc

SEQ ID NO: 391224 - DNA, 15 bp, Homo sapiens
gaggaattttagtcg

SEQ ID NO: 391225 - DNA, 15 bp, Homo sapiens
aggaattttagtcgt

SEQ ID NO: 391226 - DNA, 15 bp, Homo sapiens
ggaattttagtcgtt

SEQ ID NO: 391227 - DNA, 15 bp, Homo sapiens
gaattttagtcgttc

SEQ ID NO: 391228 - DNA, 15 bp, Homo sapiens
aattttagtcgttca

SEQ ID NO: 391229 - DNA, 15 bp, Homo sapiens
attttagtcgttcac

SEQ ID NO: 391230 - DNA, 15 bp, Homo sapiens
ttttagtcgttcaca

SEQ ID NO: 391231 - DNA, 15 bp, Homo sapiens
tttagtcgttcacac

SEQ ID NO: 391232 - DNA, 15 bp, Homo sapiens
ttagtcgttcacacg

SEQ ID NO: 391233 - DNA, 15 bp, Homo sapiens
tagtcgttcacacga

SEQ ID NO: 391234 - DNA, 15 bp, Homo sapiens
agtcgttcacacgag

SEQ ID NO: 391235 - DNA, 15 bp, Homo sapiens
gtcgttcacacgagt

SEQ ID NO: 391236 - DNA, 15 bp, Homo sapiens
tcgttcacacgagtc

SEQ ID NO: 391237 - DNA, 15 bp, Homo sapiens
cgttcacacgagtct

SEQ ID NO: 391238 - DNA, 15 bp, Homo sapiens
gttcacacgagtcta

SEQ ID NO: 391239 - DNA, 15 bp, Homo sapiens
ttcacacgagtctag

SEQ ID NO: 391240 - DNA, 15 bp, Homo sapiens
tcacacgagtctagc

SEQ ID NO: 391241 - DNA, 15 bp, Homo sapiens
cacacgagtctagcg

SEQ ID NO: 391242 - DNA, 15 bp, Homo sapiens
acacgagtctagcgt

SEQ ID NO: 391243 - DNA, 15 bp, Homo sapiens
cacgagtctagcgtg

SEQ ID NO: 391244 - DNA, 15 bp, Homo sapiens
acgagtctagcgtga

SEQ ID NO: 391245 - DNA, 15 bp, Homo sapiens
cgagtctagcgtgag

SEQ ID NO: 391246 - DNA, 15 bp, Homo sapiens
gagtctagcgtgaga

SEQ ID NO: 391247 - DNA, 15 bp, Homo sapiens
agtctagcgtgagac

SEQ ID NO: 391248 - DNA, 15 bp, Homo sapiens
gtctagcgtgagact

SEQ ID NO: 391249 - DNA, 15 bp, Homo sapiens
tctagcgtgagacta

SEQ ID NO: 391250 - DNA, 15 bp, Homo sapiens
ctagcgtgagactaa

SEQ ID NO: 391251 - DNA, 15 bp, Homo sapiens
tagcgtgagactaaa

SEQ ID NO: 391252 - DNA, 15 bp, Homo sapiens
agcgtgagactaaat

SEQ ID NO: 391253 - DNA, 15 bp, Homo sapiens
gcgtgagactaaatt

SEQ ID NO: 391254 - DNA, 15 bp, Homo sapiens
cgtgagactaaattc

SEQ ID NO: 391255 - DNA, 15 bp, Homo sapiens
gtgagactaaattca

SEQ ID NO: 391256 - DNA, 15 bp, Homo sapiens
tgagactaaattcaa

SEQ ID NO: 391257 - DNA, 15 bp, Homo sapiens
gagactaaattcaaa

SEQ ID NO: 391258 - DNA, 15 bp, Homo sapiens
agactaaattcaaac

SEQ ID NO: 391259 - DNA, 15 bp, Homo sapiens
gactaaattcaaaca

SEQ ID NO: 391260 - DNA, 15 bp, Homo sapiens
actaaattcaaacag

SEQ ID NO: 391261 - DNA, 15 bp, Homo sapiens
ctaaattcaaacagt

SEQ ID NO: 391262 - DNA, 15 bp, Homo sapiens
taaattcaaacagtt

SEQ ID NO: 391263 - DNA, 15 bp, Homo sapiens
aaattcaaacagttc

SEQ ID NO: 391264 - DNA, 15 bp, Homo sapiens
aattcaaacagttct

SEQ ID NO: 391265 - DNA, 15 bp, Homo sapiens
attcaaacagttctg

SEQ ID NO: 391266 - DNA, 15 bp, Homo sapiens
ttcaaacagttctgg

SEQ ID NO: 391267 - DNA, 15 bp, Homo sapiens
tcaaacagttctggc

SEQ ID NO: 391268 - DNA, 15 bp, Homo sapiens
caaacagttctggct

SEQ ID NO: 391269 - DNA, 15 bp, Homo sapiens
aaacagttctggctt

SEQ ID NO: 391270 - DNA, 15 bp, Homo sapiens
aacagttctggcttt

SEQ ID NO: 391271 - DNA, 15 bp, Homo sapiens
acagttctggctttg

SEQ ID NO: 391272 - DNA, 15 bp, Homo sapiens
cagttctggctttgc

SEQ ID NO: 391273 - DNA, 15 bp, Homo sapiens
agttctggctttgcc

SEQ ID NO: 391274 - DNA, 15 bp, Homo sapiens
gttctggctttgcca

SEQ ID NO: 391275 - DNA, 15 bp, Homo sapiens
ttctggctttgccac

SEQ ID NO: 391276 - DNA, 15 bp, Homo sapiens
tctggctttgccact

SEQ ID NO: 391277 - DNA, 15 bp, Homo sapiens
ctggctttgccactt

SEQ ID NO: 391278 - DNA, 15 bp, Homo sapiens
tggctttgccactta

SEQ ID NO: 391279 - DNA, 15 bp, Homo sapiens
ggctttgccacttac

SEQ ID NO: 391280 - DNA, 15 bp, Homo sapiens
gctttgccacttacc

SEQ ID NO: 391281 - DNA, 15 bp, Homo sapiens
ctttgccacttacca

SEQ ID NO: 391282 - DNA, 15 bp, Homo sapiens
tttgccacttaccag

SEQ ID NO: 391283 - DNA, 15 bp, Homo sapiens
ttgccacttaccagt

SEQ ID NO: 391284 - DNA, 15 bp, Homo sapiens
tgccacttaccagtt

SEQ ID NO: 391285 - DNA, 15 bp, Homo sapiens
gccacttaccagtta

SEQ ID NO: 391286 - DNA, 15 bp, Homo sapiens
ccacttaccagttat

SEQ ID NO: 391287 - DNA, 15 bp, Homo sapiens
cacttaccagttatg

SEQ ID NO: 391288 - DNA, 15 bp, Homo sapiens
acttaccagttatgt

SEQ ID NO: 391289 - DNA, 15 bp, Homo sapiens
cttaccagttatgta

SEQ ID NO: 391290 - DNA, 15 bp, Homo sapiens
ttaccagttatgtaa

SEQ ID NO: 391291 - DNA, 15 bp, Homo sapiens
taccagttatgtaac

SEQ ID NO: 391292 - DNA, 15 bp, Homo sapiens
accagttatgtaacc

SEQ ID NO: 391293 - DNA, 15 bp, Homo sapiens
ccagttatgtaacct

SEQ ID NO: 391294 - DNA, 15 bp, Homo sapiens
cagttatgtaacctt

SEQ ID NO: 391295 - DNA, 15 bp, Homo sapiens
agttatgtaaccttg

SEQ ID NO: 391296 - DNA, 15 bp, Homo sapiens
gttatgtaaccttgg

SEQ ID NO: 391297 - DNA, 15 bp, Homo sapiens
ttatgtaaccttggc

SEQ ID NO: 391298 - DNA, 15 bp, Homo sapiens
tatgtaaccttggca

SEQ ID NO: 391299 - DNA, 15 bp, Homo sapiens
atgtaaccttggcaa

SEQ ID NO: 391300 - DNA, 15 bp, Homo sapiens
tgtaaccttggcaaa

SEQ ID NO: 391301 - DNA, 15 bp, Homo sapiens
gtaaccttggcaaat

SEQ ID NO: 391302 - DNA, 15 bp, Homo sapiens
taaccttggcaaatc

SEQ ID NO: 391303 - DNA, 15 bp, Homo sapiens
aaccttggcaaatcc

SEQ ID NO: 391304 - DNA, 15 bp, Homo sapiens
accttggcaaatcct

SEQ ID NO: 391305 - DNA, 15 bp, Homo sapiens
ccttggcaaatcctt

SEQ ID NO: 391306 - DNA, 15 bp, Homo sapiens
cttggcaaatccttc

SEQ ID NO: 391307 - DNA, 15 bp, Homo sapiens
ttggcaaatccttcc

SEQ ID NO: 391308 - DNA, 15 bp, Homo sapiens
tggcaaatccttcca

SEQ ID NO: 391309 - DNA, 15 bp, Homo sapiens
ggcaaatccttccac

SEQ ID NO: 391310 - DNA, 15 bp, Homo sapiens
gcaaatccttccaca

SEQ ID NO: 391311 - DNA, 15 bp, Homo sapiens
caaatccttccacat

SEQ ID NO: 391312 - DNA, 15 bp, Homo sapiens
aaatccttccacatc

SEQ ID NO: 391313 - DNA, 15 bp, Homo sapiens
aatccttccacatct

SEQ ID NO: 391314 - DNA, 15 bp, Homo sapiens
atccttccacatctc

SEQ ID NO: 391315 - DNA, 15 bp, Homo sapiens
tccttccacatctct

SEQ ID NO: 391316 - DNA, 15 bp, Homo sapiens
ccttccacatctctg

SEQ ID NO: 391317 - DNA, 15 bp, Homo sapiens
cttccacatctctgt

SEQ ID NO: 391318 - DNA, 15 bp, Homo sapiens
ttccacatctctgtg

SEQ ID NO: 391319 - DNA, 15 bp, Homo sapiens
tccacatctctgtgt

SEQ ID NO: 391320 - DNA, 15 bp, Homo sapiens
ccacatctctgtgtt

SEQ ID NO: 391321 - DNA, 15 bp, Homo sapiens
cacatctctgtgttt

SEQ ID NO: 391322 - DNA, 15 bp, Homo sapiens
acatctctgtgtttc

SEQ ID NO: 391323 - DNA, 15 bp, Homo sapiens
catctctgtgtttca

SEQ ID NO: 391324 - DNA, 15 bp, Homo sapiens
atctctgtgtttcag

SEQ ID NO: 391325 - DNA, 15 bp, Homo sapiens
tctctgtgtttcagt

SEQ ID NO: 391326 - DNA, 15 bp, Homo sapiens
ctctgtgtttcagtt

SEQ ID NO: 391327 - DNA, 15 bp, Homo sapiens
tctgtgtttcagttc

SEQ ID NO: 391328 - DNA, 15 bp, Homo sapiens
ctgtgtttcagttcc

SEQ ID NO: 391329 - DNA, 15 bp, Homo sapiens
tgtgtttcagttccc

SEQ ID NO: 391330 - DNA, 15 bp, Homo sapiens
gtgtttcagttccct

SEQ ID NO: 391331 - DNA, 15 bp, Homo sapiens
tgtttcagttccctt

SEQ ID NO: 391332 - DNA, 15 bp, Homo sapiens
gtttcagttcccttt

SEQ ID NO: 391333 - DNA, 15 bp, Homo sapiens
tttcagttccctttt

SEQ ID NO: 391334 - DNA, 15 bp, Homo sapiens
ttcagttcccttttc

SEQ ID NO: 391335 - DNA, 15 bp, Homo sapiens
tcagttcccttttca

SEQ ID NO: 391336 - DNA, 15 bp, Homo sapiens
cagttcccttttcag

SEQ ID NO: 391337 - DNA, 15 bp, Homo sapiens
agttcccttttcaga

SEQ ID NO: 391338 - DNA, 15 bp, Homo sapiens
gttcccttttcagaa

SEQ ID NO: 391339 - DNA, 15 bp, Homo sapiens
ttcccttttcagaag

SEQ ID NO: 391340 - DNA, 15 bp, Homo sapiens
tcccttttcagaaga

SEQ ID NO: 391341 - DNA, 15 bp, Homo sapiens
cccttttcagaagat

SEQ ID NO: 391342 - DNA, 15 bp, Homo sapiens
ccttttcagaagata

SEQ ID NO: 391343 - DNA, 15 bp, Homo sapiens
cttttcagaagatag

SEQ ID NO: 391344 - DNA, 15 bp, Homo sapiens
ttttcagaagatagg

SEQ ID NO: 391345 - DNA, 15 bp, Homo sapiens
tttcagaagataggg

SEQ ID NO: 391346 - DNA, 15 bp, Homo sapiens
ttcagaagatagggt

SEQ ID NO: 391347 - DNA, 15 bp, Homo sapiens
tcagaagatagggtt

SEQ ID NO: 391348 - DNA, 15 bp, Homo sapiens
cagaagatagggttg

SEQ ID NO: 391349 - DNA, 15 bp, Homo sapiens
agaagatagggttgg

SEQ ID NO: 391350 - DNA, 15 bp, Homo sapiens
gaagatagggttgga

SEQ ID NO: 391351 - DNA, 15 bp, Homo sapiens
aagatagggttggaa

SEQ ID NO: 391352 - DNA, 15 bp, Homo sapiens
agatagggttggaat

SEQ ID NO: 391353 - DNA, 15 bp, Homo sapiens
gatagggttggaatt

SEQ ID NO: 391354 - DNA, 15 bp, Homo sapiens
atagggttggaatta

SEQ ID NO: 391355 - DNA, 15 bp, Homo sapiens
tagggttggaattag

SEQ ID NO: 391356 - DNA, 15 bp, Homo sapiens
agggttggaattagt

SEQ ID NO: 391357 - DNA, 15 bp, Homo sapiens
gggttggaattagtc

SEQ ID NO: 391358 - DNA, 15 bp, Homo sapiens
ggttggaattagtct

SEQ ID NO: 391359 - DNA, 15 bp, Homo sapiens
gttggaattagtctc

SEQ ID NO: 391360 - DNA, 15 bp, Homo sapiens
ttggaattagtctct

SEQ ID NO: 391361 - DNA, 15 bp, Homo sapiens
tggaattagtctctc

SEQ ID NO: 391362 - DNA, 15 bp, Homo sapiens
ggaattagtctctct

SEQ ID NO: 391363 - DNA, 15 bp, Homo sapiens
gaattagtctctctc

SEQ ID NO: 391364 - DNA, 15 bp, Homo sapiens
aattagtctctctct

SEQ ID NO: 391365 - DNA, 15 bp, Homo sapiens
attagtctctctctc

SEQ ID NO: 391366 - DNA, 15 bp, Homo sapiens
ttagtctctctctct

SEQ ID NO: 391367 - DNA, 15 bp, Homo sapiens
tagtctctctctctc

SEQ ID NO: 391368 - DNA, 15 bp, Homo sapiens
agtctctctctctct

SEQ ID NO: 391369 - DNA, 15 bp, Homo sapiens
ctctctctcaatcta

SEQ ID NO: 391370 - DNA, 15 bp, Homo sapiens
tctctctcaatctac

SEQ ID NO: 391371 - DNA, 15 bp, Homo sapiens
ctctctcaatctaca

SEQ ID NO: 391372 - DNA, 15 bp, Homo sapiens
tctctcaatctacac

SEQ ID NO: 391373 - DNA, 15 bp, Homo sapiens
ctctcaatctacaca

SEQ ID NO: 391374 - DNA, 15 bp, Homo sapiens
tctcaatctacacac

SEQ ID NO: 391375 - DNA, 15 bp, Homo sapiens
ctcaatctacacaca

SEQ ID NO: 391376 - DNA, 15 bp, Homo sapiens
tcaatctacacacac

SEQ ID NO: 391377 - DNA, 15 bp, Homo sapiens
caatctacacacaca

SEQ ID NO: 391378 - DNA, 15 bp, Homo sapiens
aatctacacacacac

SEQ ID NO: 391379 - DNA, 15 bp, Homo sapiens
atctacacacacaca

SEQ ID NO: 391380 - DNA, 15 bp, Homo sapiens
tctacacacacacac

SEQ ID NO: 391381 - DNA, 15 bp, Homo sapiens
ctacacacacacaca

SEQ ID NO: 391382 - DNA, 15 bp, Homo sapiens
cacacacacgcacat

SEQ ID NO: 391383 - DNA, 15 bp, Homo sapiens
acacacacgcacatg

SEQ ID NO: 391384 - DNA, 15 bp, Homo sapiens
cacacacgcacatgc

SEQ ID NO: 391385 - DNA, 15 bp, Homo sapiens
acacacgcacatgca

SEQ ID NO: 391386 - DNA, 15 bp, Homo sapiens
cacacgcacatgcac

SEQ ID NO: 391387 - DNA, 15 bp, Homo sapiens
acacgcacatgcaca

SEQ ID NO: 391388 - DNA, 15 bp, Homo sapiens
cacgcacatgcacac

SEQ ID NO: 391389 - DNA, 15 bp, Homo sapiens
acgcacatgcacaca

SEQ ID NO: 391390 - DNA, 15 bp, Homo sapiens
cgcacatgcacacac

SEQ ID NO: 391391 - DNA, 15 bp, Homo sapiens
gcacatgcacacaca

SEQ ID NO: 391392 - DNA, 15 bp, Homo sapiens
cacatgcacacacac

SEQ ID NO: 391393 - DNA, 15 bp, Homo sapiens
catgcacacacacac

SEQ ID NO: 391394 - DNA, 15 bp, Homo sapiens
atgcacacacacaca

SEQ ID NO: 391395 - DNA, 15 bp, Homo sapiens
tgcacacacacacac

SEQ ID NO: 391396 - DNA, 15 bp, Homo sapiens
gcacacacacacaca

SEQ ID NO: 391397 - DNA, 15 bp, Homo sapiens
acacacacacacata

SEQ ID NO: 391398 - DNA, 15 bp, Homo sapiens
cacacacacacataa

SEQ ID NO: 391399 - DNA, 15 bp, Homo sapiens
acacacacacataag

SEQ ID NO: 391400 - DNA, 15 bp, Homo sapiens
cacacacacataagg

SEQ ID NO: 391401 - DNA, 15 bp, Homo sapiens
acacacacataaggt

SEQ ID NO: 391402 - DNA, 15 bp, Homo sapiens
cacacacataaggtt

SEQ ID NO: 391403 - DNA, 15 bp, Homo sapiens
acacacataaggttg

SEQ ID NO: 391404 - DNA, 15 bp, Homo sapiens
cacacataaggttgt

SEQ ID NO: 391405 - DNA, 15 bp, Homo sapiens
acacataaggttgtt

SEQ ID NO: 391406 - DNA, 15 bp, Homo sapiens
cacataaggttgttg

SEQ ID NO: 391407 - DNA, 15 bp, Homo sapiens
acataaggttgttgt

SEQ ID NO: 391408 - DNA, 15 bp, Homo sapiens
cataaggttgttgta

SEQ ID NO: 391409 - DNA, 15 bp, Homo sapiens
ataaggttgttgtag

SEQ ID NO: 391410 - DNA, 15 bp, Homo sapiens
taaggttgttgtagg

SEQ ID NO: 391411 - DNA, 15 bp, Homo sapiens
aaggttgttgtagga

SEQ ID NO: 391412 - DNA, 15 bp, Homo sapiens
aggttgttgtaggag

SEQ ID NO: 391413 - DNA, 15 bp, Homo sapiens
ggttgttgtaggagt

SEQ ID NO: 391414 - DNA, 15 bp, Homo sapiens
gttgttgtaggagtt

SEQ ID NO: 391415 - DNA, 15 bp, Homo sapiens
ttgttgtaggagtta

SEQ ID NO: 391416 - DNA, 15 bp, Homo sapiens
tgttgtaggagttaa

SEQ ID NO: 391417 - DNA, 15 bp, Homo sapiens
gttgtaggagttaaa

SEQ ID NO: 391418 - DNA, 15 bp, Homo sapiens
ttgtaggagttaaat

SEQ ID NO: 391419 - DNA, 15 bp, Homo sapiens
tgtaggagttaaata

SEQ ID NO: 391420 - DNA, 15 bp, Homo sapiens
gtaggagttaaataa

SEQ ID NO: 391421 - DNA, 15 bp, Homo sapiens
taggagttaaataag

SEQ ID NO: 391422 - DNA, 15 bp, Homo sapiens
aggagttaaataagt

SEQ ID NO: 391423 - DNA, 15 bp, Homo sapiens
ggagttaaataagtt

SEQ ID NO: 391424 - DNA, 15 bp, Homo sapiens
gagttaaataagtta

SEQ ID NO: 391425 - DNA, 15 bp, Homo sapiens
agttaaataagttaa

SEQ ID NO: 391426 - DNA, 15 bp, Homo sapiens
gttaaataagttaat

SEQ ID NO: 391427 - DNA, 15 bp, Homo sapiens
ttaaataagttaata

SEQ ID NO: 391428 - DNA, 15 bp, Homo sapiens
taaataagttaatat

SEQ ID NO: 391429 - DNA, 15 bp, Homo sapiens
aaataagttaatatt

SEQ ID NO: 391430 - DNA, 15 bp, Homo sapiens
aataagttaatattg

SEQ ID NO: 391431 - DNA, 15 bp, Homo sapiens
ataagttaatattga

SEQ ID NO: 391432 - DNA, 15 bp, Homo sapiens
taagttaatattgat

SEQ ID NO: 391433 - DNA, 15 bp, Homo sapiens
aagttaatattgata

SEQ ID NO: 391434 - DNA, 15 bp, Homo sapiens
agttaatattgataa

SEQ ID NO: 391435 - DNA, 15 bp, Homo sapiens
gttaatattgataaa

SEQ ID NO: 391436 - DNA, 15 bp, Homo sapiens
ttaatattgataaaa

SEQ ID NO: 391437 - DNA, 15 bp, Homo sapiens
taatattgataaaat

SEQ ID NO: 391438 - DNA, 15 bp, Homo sapiens
aatattgataaaatg

SEQ ID NO: 391439 - DNA, 15 bp, Homo sapiens
atattgataaaatgg

SEQ ID NO: 391440 - DNA, 15 bp, Homo sapiens
tattgataaaatggt

SEQ ID NO: 391441 - DNA, 15 bp, Homo sapiens
attgataaaatggta

SEQ ID NO: 391442 - DNA, 15 bp, Homo sapiens
ttgataaaatggtaa

SEQ ID NO: 391443 - DNA, 15 bp, Homo sapiens
tgataaaatggtaaa

SEQ ID NO: 391444 - DNA, 15 bp, Homo sapiens
gataaaatggtaaaa

SEQ ID NO: 391445 - DNA, 15 bp, Homo sapiens
ataaaatggtaaaaa

SEQ ID NO: 391446 - DNA, 15 bp, Homo sapiens
taaaatggtaaaaac

SEQ ID NO: 391447 - DNA, 15 bp, Homo sapiens
aaaatggtaaaaaca

SEQ ID NO: 391448 - DNA, 15 bp, Homo sapiens
aaatggtaaaaacaa

SEQ ID NO: 391449 - DNA, 15 bp, Homo sapiens
aatggtaaaaacaaa

SEQ ID NO: 391450 - DNA, 15 bp, Homo sapiens
atggtaaaaacaaag

SEQ ID NO: 391451 - DNA, 15 bp, Homo sapiens
tggtaaaaacaaagc

SEQ ID NO: 391452 - DNA, 15 bp, Homo sapiens
ggtaaaaacaaagcc

SEQ ID NO: 391453 - DNA, 15 bp, Homo sapiens
gtaaaaacaaagcct

SEQ ID NO: 391454 - DNA, 15 bp, Homo sapiens
taaaaacaaagcctg

SEQ ID NO: 391455 - DNA, 15 bp, Homo sapiens
aaaaacaaagcctgg

SEQ ID NO: 391456 - DNA, 15 bp, Homo sapiens
aaaacaaagcctggc

SEQ ID NO: 391457 - DNA, 15 bp, Homo sapiens
aaacaaagcctggca

SEQ ID NO: 391458 - DNA, 15 bp, Homo sapiens
aacaaagcctggcac

SEQ ID NO: 391459 - DNA, 15 bp, Homo sapiens
acaaagcctggcaca

SEQ ID NO: 391460 - DNA, 15 bp, Homo sapiens
caaagcctggcacat

SEQ ID NO: 391461 - DNA, 15 bp, Homo sapiens
aaagcctggcacata

SEQ ID NO: 391462 - DNA, 15 bp, Homo sapiens
aagcctggcacatat

SEQ ID NO: 391463 - DNA, 15 bp, Homo sapiens
agcctggcacatatc

SEQ ID NO: 391464 - DNA, 15 bp, Homo sapiens
gcctggcacatatct

SEQ ID NO: 391465 - DNA, 15 bp, Homo sapiens
cctggcacatatctg

SEQ ID NO: 391466 - DNA, 15 bp, Homo sapiens
ctggcacatatctgc

SEQ ID NO: 391467 - DNA, 15 bp, Homo sapiens
tggcacatatctgct

SEQ ID NO: 391468 - DNA, 15 bp, Homo sapiens
ggcacatatctgcta

SEQ ID NO: 391469 - DNA, 15 bp, Homo sapiens
gcacatatctgctat

SEQ ID NO: 391470 - DNA, 15 bp, Homo sapiens
cacatatctgctatg

SEQ ID NO: 391471 - DNA, 15 bp, Homo sapiens
acatatctgctatgt

SEQ ID NO: 391472 - DNA, 15 bp, Homo sapiens
catatctgctatgtg

SEQ ID NO: 391473 - DNA, 15 bp, Homo sapiens
atatctgctatgtgg

SEQ ID NO: 391474 - DNA, 15 bp, Homo sapiens
tatctgctatgtggg

SEQ ID NO: 391475 - DNA, 15 bp, Homo sapiens
atctgctatgtgggt

SEQ ID NO: 391476 - DNA, 15 bp, Homo sapiens
tctgctatgtgggtt

SEQ ID NO: 391477 - DNA, 15 bp, Homo sapiens
ctgctatgtgggttg

SEQ ID NO: 391478 - DNA, 15 bp, Homo sapiens
tgctatgtgggttgg

SEQ ID NO: 391479 - DNA, 15 bp, Homo sapiens
gctatgtgggttggc

SEQ ID NO: 391480 - DNA, 15 bp, Homo sapiens
ctatgtgggttggct

SEQ ID NO: 391481 - DNA, 15 bp, Homo sapiens
tatgtgggttggcta

SEQ ID NO: 391482 - DNA, 15 bp, Homo sapiens
atgtgggttggctac

SEQ ID NO: 391483 - DNA, 15 bp, Homo sapiens
tgtgggttggctact

SEQ ID NO: 391484 - DNA, 15 bp, Homo sapiens
gtgggttggctactg

SEQ ID NO: 391485 - DNA, 15 bp, Homo sapiens
tgggttggctactgt

SEQ ID NO: 391486 - DNA, 15 bp, Homo sapiens
gggttggctactgtt

SEQ ID NO: 391487 - DNA, 15 bp, Homo sapiens
ggttggctactgttg

SEQ ID NO: 391488 - DNA, 15 bp, Homo sapiens
gttggctactgttgt

SEQ ID NO: 391489 - DNA, 15 bp, Homo sapiens
ttggctactgttgtt

SEQ ID NO: 391490 - DNA, 15 bp, Homo sapiens
tggctactgttgtta

SEQ ID NO: 391491 - DNA, 15 bp, Homo sapiens
ggctactgttgttac

SEQ ID NO: 391492 - DNA, 15 bp, Homo sapiens
gctactgttgttacc

SEQ ID NO: 391493 - DNA, 15 bp, Homo sapiens
ctactgttgttaccg

SEQ ID NO: 391494 - DNA, 15 bp, Homo sapiens
tactgttgttaccgt

SEQ ID NO: 391495 - DNA, 15 bp, Homo sapiens
actgttgttaccgtt

SEQ ID NO: 391496 - DNA, 15 bp, Homo sapiens
ctgttgttaccgtta

SEQ ID NO: 391497 - DNA, 15 bp, Homo sapiens
tgttgttaccgttac

SEQ ID NO: 391498 - DNA, 15 bp, Homo sapiens
gttgttaccgttacc

SEQ ID NO: 391499 - DNA, 15 bp, Homo sapiens
ttgttaccgttacca

SEQ ID NO: 391500 - DNA, 15 bp, Homo sapiens
tgttaccgttaccac

SEQ ID NO: 391501 - DNA, 15 bp, Homo sapiens
gttaccgttaccact

SEQ ID NO: 391502 - DNA, 15 bp, Homo sapiens
ttaccgttaccacta

SEQ ID NO: 391503 - DNA, 15 bp, Homo sapiens
taccgttaccactat

SEQ ID NO: 391504 - DNA, 15 bp, Homo sapiens
accgttaccactatt

SEQ ID NO: 391505 - DNA, 15 bp, Homo sapiens
ccgttaccactattg

SEQ ID NO: 391506 - DNA, 15 bp, Homo sapiens
cgttaccactattgg

SEQ ID NO: 391507 - DNA, 15 bp, Homo sapiens
gttaccactattggt

SEQ ID NO: 391508 - DNA, 15 bp, Homo sapiens
ttaccactattggta

SEQ ID NO: 391509 - DNA, 15 bp, Homo sapiens
taccactattggtag

SEQ ID NO: 391510 - DNA, 15 bp, Homo sapiens
accactattggtagg

SEQ ID NO: 391511 - DNA, 15 bp, Homo sapiens
ccactattggtagga

SEQ ID NO: 391512 - DNA, 15 bp, Homo sapiens
cactattggtaggat

SEQ ID NO: 391513 - DNA, 15 bp, Homo sapiens
actattggtaggatt

SEQ ID NO: 391514 - DNA, 15 bp, Homo sapiens
ctattggtaggatta

SEQ ID NO: 391515 - DNA, 15 bp, Homo sapiens
tattggtaggattat

SEQ ID NO: 391516 - DNA, 15 bp, Homo sapiens
attggtaggattatt

SEQ ID NO: 391517 - DNA, 15 bp, Homo sapiens
ttggtaggattattc

SEQ ID NO: 391518 - DNA, 15 bp, Homo sapiens
tggtaggattattct

SEQ ID NO: 391519 - DNA, 15 bp, Homo sapiens
ggtaggattattctc

SEQ ID NO: 391520 - DNA, 15 bp, Homo sapiens
gtaggattattctcc

SEQ ID NO: 391521 - DNA, 15 bp, Homo sapiens
taggattattctccc

SEQ ID NO: 391522 - DNA, 15 bp, Homo sapiens
aggattattctccca

SEQ ID NO: 391523 - DNA, 15 bp, Homo sapiens
ggattattctcccac

SEQ ID NO: 391524 - DNA, 15 bp, Homo sapiens
gattattctcccacc

SEQ ID NO: 391525 - DNA, 15 bp, Homo sapiens
attattctcccacct

SEQ ID NO: 391526 - DNA, 15 bp, Homo sapiens
ttattctcccacctt

SEQ ID NO: 391527 - DNA, 15 bp, Homo sapiens
tattctcccaccttg

SEQ ID NO: 391528 - DNA, 15 bp, Homo sapiens
attctcccaccttga

SEQ ID NO: 391529 - DNA, 15 bp, Homo sapiens
ttctcccaccttgat

SEQ ID NO: 391530 - DNA, 15 bp, Homo sapiens
tctcccaccttgatt

SEQ ID NO: 391531 - DNA, 15 bp, Homo sapiens
ctcccaccttgattg

SEQ ID NO: 391532 - DNA, 15 bp, Homo sapiens
tcccaccttgattga

SEQ ID NO: 391533 - DNA, 15 bp, Homo sapiens
cccaccttgattgag

SEQ ID NO: 391534 - DNA, 15 bp, Homo sapiens
ccaccttgattgagt

SEQ ID NO: 391535 - DNA, 15 bp, Homo sapiens
caccttgattgagtg

SEQ ID NO: 391536 - DNA, 15 bp, Homo sapiens
accttgattgagtgt

SEQ ID NO: 391537 - DNA, 15 bp, Homo sapiens
ccttgattgagtgtg

SEQ ID NO: 391538 - DNA, 15 bp, Homo sapiens
cttgattgagtgtgg

SEQ ID NO: 391539 - DNA, 15 bp, Homo sapiens
ttgattgagtgtgga

SEQ ID NO: 391540 - DNA, 15 bp, Homo sapiens
tgattgagtgtggat

SEQ ID NO: 391541 - DNA, 15 bp, Homo sapiens
gattgagtgtggatc

SEQ ID NO: 391542 - DNA, 15 bp, Homo sapiens
attgagtgtggatca

SEQ ID NO: 391543 - DNA, 15 bp, Homo sapiens
ttgagtgtggatcaa

SEQ ID NO: 391544 - DNA, 15 bp, Homo sapiens
tgagtgtggatcaaa

SEQ ID NO: 391545 - DNA, 15 bp, Homo sapiens
gagtgtggatcaaat

SEQ ID NO: 391546 - DNA, 15 bp, Homo sapiens
agtgtggatcaaatg

SEQ ID NO: 391547 - DNA, 15 bp, Homo sapiens
gtgtggatcaaatga

SEQ ID NO: 391548 - DNA, 15 bp, Homo sapiens
tgtggatcaaatgag

SEQ ID NO: 391549 - DNA, 15 bp, Homo sapiens
gtggatcaaatgaga

SEQ ID NO: 391550 - DNA, 15 bp, Homo sapiens
tggatcaaatgagat

SEQ ID NO: 391551 - DNA, 15 bp, Homo sapiens
ggatcaaatgagatg

SEQ ID NO: 391552 - DNA, 15 bp, Homo sapiens
gatcaaatgagatga

SEQ ID NO: 391553 - DNA, 15 bp, Homo sapiens
atcaaatgagatgat

SEQ ID NO: 391554 - DNA, 15 bp, Homo sapiens
tcaaatgagatgatc

SEQ ID NO: 391555 - DNA, 15 bp, Homo sapiens
caaatgagatgatcc

SEQ ID NO: 391556 - DNA, 15 bp, Homo sapiens
aaatgagatgatcca

SEQ ID NO: 391557 - DNA, 15 bp, Homo sapiens
aatgagatgatccac

SEQ ID NO: 391558 - DNA, 15 bp, Homo sapiens
atgagatgatccacc

SEQ ID NO: 391559 - DNA, 15 bp, Homo sapiens
tgagatgatccacct

SEQ ID NO: 391560 - DNA, 15 bp, Homo sapiens
gagatgatccacctg

SEQ ID NO: 391561 - DNA, 15 bp, Homo sapiens
agatgatccacctga

SEQ ID NO: 391562 - DNA, 15 bp, Homo sapiens
gatgatccacctgac

SEQ ID NO: 391563 - DNA, 15 bp, Homo sapiens
atgatccacctgaca

SEQ ID NO: 391564 - DNA, 15 bp, Homo sapiens
tgatccacctgacat

SEQ ID NO: 391565 - DNA, 15 bp, Homo sapiens
gatccacctgacatg

SEQ ID NO: 391566 - DNA, 15 bp, Homo sapiens
atccacctgacatgc

SEQ ID NO: 391567 - DNA, 15 bp, Homo sapiens
tccacctgacatgcc

SEQ ID NO: 391568 - DNA, 15 bp, Homo sapiens
ccacctgacatgcct

SEQ ID NO: 391569 - DNA, 15 bp, Homo sapiens
cacctgacatgccta

SEQ ID NO: 391570 - DNA, 15 bp, Homo sapiens
acctgacatgcctag

SEQ ID NO: 391571 - DNA, 15 bp, Homo sapiens
cctgacatgcctagc

SEQ ID NO: 391572 - DNA, 15 bp, Homo sapiens
ctgacatgcctagca

SEQ ID NO: 391573 - DNA, 15 bp, Homo sapiens
tgacatgcctagcac

SEQ ID NO: 391574 - DNA, 15 bp, Homo sapiens
gacatgcctagcaca

SEQ ID NO: 391575 - DNA, 15 bp, Homo sapiens
acatgcctagcacag

SEQ ID NO: 391576 - DNA, 15 bp, Homo sapiens
catgcctagcacagt

SEQ ID NO: 391577 - DNA, 15 bp, Homo sapiens
atgcctagcacagtc

SEQ ID NO: 391578 - DNA, 15 bp, Homo sapiens
tgcctagcacagtct

SEQ ID NO: 391579 - DNA, 15 bp, Homo sapiens
gcctagcacagtctc

SEQ ID NO: 391580 - DNA, 15 bp, Homo sapiens
cctagcacagtctca

SEQ ID NO: 391581 - DNA, 15 bp, Homo sapiens
ctagcacagtctcat

SEQ ID NO: 391582 - DNA, 15 bp, Homo sapiens
tagcacagtctcatg

SEQ ID NO: 391583 - DNA, 15 bp, Homo sapiens
agcacagtctcatgt

SEQ ID NO: 391584 - DNA, 15 bp, Homo sapiens
gcacagtctcatgtc

SEQ ID NO: 391585 - DNA, 15 bp, Homo sapiens
cacagtctcatgtct

SEQ ID NO: 391586 - DNA, 15 bp, Homo sapiens
acagtctcatgtctc

SEQ ID NO: 391587 - DNA, 15 bp, Homo sapiens
cagtctcatgtctct

SEQ ID NO: 391588 - DNA, 15 bp, Homo sapiens
agtctcatgtctctt

SEQ ID NO: 391589 - DNA, 15 bp, Homo sapiens
gtctcatgtctcttg

SEQ ID NO: 391590 - DNA, 15 bp, Homo sapiens
tctcatgtctcttgg

SEQ ID NO: 391591 - DNA, 15 bp, Homo sapiens
ctcatgtctcttggt

SEQ ID NO: 391592 - DNA, 15 bp, Homo sapiens
tcatgtctcttggtt

SEQ ID NO: 391593 - DNA, 15 bp, Homo sapiens
catgtctcttggttg

SEQ ID NO: 391594 - DNA, 15 bp, Homo sapiens
atgtctcttggttgt

SEQ ID NO: 391595 - DNA, 15 bp, Homo sapiens
tgtctcttggttgtg

SEQ ID NO: 391596 - DNA, 15 bp, Homo sapiens
gtctcttggttgtgg

SEQ ID NO: 391597 - DNA, 15 bp, Homo sapiens
tctcttggttgtggt

SEQ ID NO: 391598 - DNA, 15 bp, Homo sapiens
ctcttggttgtggtg

SEQ ID NO: 391599 - DNA, 15 bp, Homo sapiens
tcttggttgtggtga

SEQ ID NO: 391600 - DNA, 15 bp, Homo sapiens
cttggttgtggtgat

SEQ ID NO: 391601 - DNA, 15 bp, Homo sapiens
ttggttgtggtgatg

SEQ ID NO: 391602 - DNA, 15 bp, Homo sapiens
tggttgtggtgatgg

SEQ ID NO: 391603 - DNA, 15 bp, Homo sapiens
ggttgtggtgatggc

SEQ ID NO: 391604 - DNA, 15 bp, Homo sapiens
gttgtggtgatggca

SEQ ID NO: 391605 - DNA, 15 bp, Homo sapiens
ttgtggtgatggcat

SEQ ID NO: 391606 - DNA, 15 bp, Homo sapiens
tgtggtgatggcatc

SEQ ID NO: 391607 - DNA, 15 bp, Homo sapiens
gtggtgatggcatca

SEQ ID NO: 391608 - DNA, 15 bp, Homo sapiens
tggtgatggcatcat

SEQ ID NO: 391609 - DNA, 15 bp, Homo sapiens
ggtgatggcatcata

SEQ ID NO: 391610 - DNA, 15 bp, Homo sapiens
gtgatggcatcataa

SEQ ID NO: 391611 - DNA, 15 bp, Homo sapiens
tgatggcatcataat

SEQ ID NO: 391612 - DNA, 15 bp, Homo sapiens
gatggcatcataatc

SEQ ID NO: 391613 - DNA, 15 bp, Homo sapiens
atggcatcataatct

SEQ ID NO: 391614 - DNA, 15 bp, Homo sapiens
tggcatcataatctt

SEQ ID NO: 391615 - DNA, 15 bp, Homo sapiens
ggcatcataatcttc

SEQ ID NO: 391616 - DNA, 15 bp, Homo sapiens
gcatcataatcttca

SEQ ID NO: 391617 - DNA, 15 bp, Homo sapiens
catcataatcttcat

SEQ ID NO: 391618 - DNA, 15 bp, Homo sapiens
atcataatcttcatt

SEQ ID NO: 391619 - DNA, 15 bp, Homo sapiens
tcataatcttcatta

SEQ ID NO: 391620 - DNA, 15 bp, Homo sapiens
cataatcttcattat

SEQ ID NO: 391621 - DNA, 15 bp, Homo sapiens
ataatcttcattatc

SEQ ID NO: 391622 - DNA, 15 bp, Homo sapiens
taatcttcattatct

SEQ ID NO: 391623 - DNA, 15 bp, Homo sapiens
aatcttcattatctt

SEQ ID NO: 391624 - DNA, 15 bp, Homo sapiens
atcttcattatcttt

SEQ ID NO: 391625 - DNA, 15 bp, Homo sapiens
tcttcattatcttta

SEQ ID NO: 391626 - DNA, 15 bp, Homo sapiens
cttcattatctttat

SEQ ID NO: 391627 - DNA, 15 bp, Homo sapiens
ttcattatctttatc

SEQ ID NO: 391628 - DNA, 15 bp, Homo sapiens
tcattatctttatct

SEQ ID NO: 391629 - DNA, 15 bp, Homo sapiens
cattatctttatctc

SEQ ID NO: 391630 - DNA, 15 bp, Homo sapiens
attatctttatctct

SEQ ID NO: 391631 - DNA, 15 bp, Homo sapiens
ttatctttatctctg

SEQ ID NO: 391632 - DNA, 15 bp, Homo sapiens
tatctttatctctga

SEQ ID NO: 391633 - DNA, 15 bp, Homo sapiens
atctttatctctgaa

SEQ ID NO: 391634 - DNA, 15 bp, Homo sapiens
tctttatctctgaag

SEQ ID NO: 391635 - DNA, 15 bp, Homo sapiens
ctttatctctgaagt

SEQ ID NO: 391636 - DNA, 15 bp, Homo sapiens
tttatctctgaagta

SEQ ID NO: 391637 - DNA, 15 bp, Homo sapiens
ttatctctgaagtaa

SEQ ID NO: 391638 - DNA, 15 bp, Homo sapiens
tatctctgaagtaac

SEQ ID NO: 391639 - DNA, 15 bp, Homo sapiens
atctctgaagtaacc

SEQ ID NO: 391640 - DNA, 15 bp, Homo sapiens
tctctgaagtaaccc

SEQ ID NO: 391641 - DNA, 15 bp, Homo sapiens
ctctgaagtaaccct

SEQ ID NO: 391642 - DNA, 15 bp, Homo sapiens
tctgaagtaaccctt

SEQ ID NO: 391643 - DNA, 15 bp, Homo sapiens
ctgaagtaaccctta

SEQ ID NO: 391644 - DNA, 15 bp, Homo sapiens
tgaagtaacccttac

SEQ ID NO: 391645 - DNA, 15 bp, Homo sapiens
gaagtaacccttaca

SEQ ID NO: 391646 - DNA, 15 bp, Homo sapiens
aagtaacccttacat

SEQ ID NO: 391647 - DNA, 15 bp, Homo sapiens
agtaacccttacatc

SEQ ID NO: 391648 - DNA, 15 bp, Homo sapiens
gtaacccttacatct

SEQ ID NO: 391649 - DNA, 15 bp, Homo sapiens
taacccttacatctt

SEQ ID NO: 391650 - DNA, 15 bp, Homo sapiens
aacccttacatctta

SEQ ID NO: 391651 - DNA, 15 bp, Homo sapiens
acccttacatcttaa

SEQ ID NO: 391652 - DNA, 15 bp, Homo sapiens
cccttacatcttaac

SEQ ID NO: 391653 - DNA, 15 bp, Homo sapiens
ccttacatcttaaca

SEQ ID NO: 391654 - DNA, 15 bp, Homo sapiens
cttacatcttaacaa

SEQ ID NO: 391655 - DNA, 15 bp, Homo sapiens
ttacatcttaacaag

SEQ ID NO: 391656 - DNA, 15 bp, Homo sapiens
tacatcttaacaagg

SEQ ID NO: 391657 - DNA, 15 bp, Homo sapiens
acatcttaacaagga

SEQ ID NO: 391658 - DNA, 15 bp, Homo sapiens
catcttaacaaggat

SEQ ID NO: 391659 - DNA, 15 bp, Homo sapiens
atcttaacaaggatg

SEQ ID NO: 391660 - DNA, 15 bp, Homo sapiens
tcttaacaaggatgt

SEQ ID NO: 391661 - DNA, 15 bp, Homo sapiens
cttaacaaggatgtt

SEQ ID NO: 391662 - DNA, 15 bp, Homo sapiens
ttaacaaggatgttc

SEQ ID NO: 391663 - DNA, 15 bp, Homo sapiens
taacaaggatgttca

SEQ ID NO: 391664 - DNA, 15 bp, Homo sapiens
aacaaggatgttcac

SEQ ID NO: 391665 - DNA, 15 bp, Homo sapiens
acaaggatgttcaca

SEQ ID NO: 391666 - DNA, 15 bp, Homo sapiens
caaggatgttcacat

SEQ ID NO: 391667 - DNA, 15 bp, Homo sapiens
aaggatgttcacatt

SEQ ID NO: 391668 - DNA, 15 bp, Homo sapiens
aggatgttcacatta

SEQ ID NO: 391669 - DNA, 15 bp, Homo sapiens
ggatgttcacattac

SEQ ID NO: 391670 - DNA, 15 bp, Homo sapiens
gatgttcacattaca

SEQ ID NO: 391671 - DNA, 15 bp, Homo sapiens
atgttcacattacag

SEQ ID NO: 391672 - DNA, 15 bp, Homo sapiens
tgttcacattacagt

SEQ ID NO: 391673 - DNA, 15 bp, Homo sapiens
gttcacattacagtc

SEQ ID NO: 391674 - DNA, 15 bp, Homo sapiens
ttcacattacagtcg

SEQ ID NO: 391675 - DNA, 15 bp, Homo sapiens
tcacattacagtcgc

SEQ ID NO: 391676 - DNA, 15 bp, Homo sapiens
cacattacagtcgcc

SEQ ID NO: 391677 - DNA, 15 bp, Homo sapiens
acattacagtcgccc

SEQ ID NO: 391678 - DNA, 15 bp, Homo sapiens
cattacagtcgccca

SEQ ID NO: 391679 - DNA, 15 bp, Homo sapiens
attacagtcgcccag

SEQ ID NO: 391680 - DNA, 15 bp, Homo sapiens
ttacagtcgcccaga

SEQ ID NO: 391681 - DNA, 15 bp, Homo sapiens
tacagtcgcccagag

SEQ ID NO: 391682 - DNA, 15 bp, Homo sapiens
acagtcgcccagaga

SEQ ID NO: 391683 - DNA, 15 bp, Homo sapiens
cagtcgcccagagaa

SEQ ID NO: 391684 - DNA, 15 bp, Homo sapiens
agtcgcccagagaat

SEQ ID NO: 391685 - DNA, 15 bp, Homo sapiens
gtcgcccagagaatt

SEQ ID NO: 391686 - DNA, 15 bp, Homo sapiens
tcgcccagagaattt

SEQ ID NO: 391687 - DNA, 15 bp, Homo sapiens
cgcccagagaatttt

SEQ ID NO: 391688 - DNA, 15 bp, Homo sapiens
gcccagagaattttt

SEQ ID NO: 391689 - DNA, 15 bp, Homo sapiens
cccagagaatttttc

SEQ ID NO: 391690 - DNA, 15 bp, Homo sapiens
ccagagaatttttcc

SEQ ID NO: 391691 - DNA, 15 bp, Homo sapiens
cagagaatttttcca

SEQ ID NO: 391692 - DNA, 15 bp, Homo sapiens
agagaatttttccaa

SEQ ID NO: 391693 - DNA, 15 bp, Homo sapiens
gagaatttttccaaa

SEQ ID NO: 391694 - DNA, 15 bp, Homo sapiens
agaatttttccaaag

SEQ ID NO: 391695 - DNA, 15 bp, Homo sapiens
gaatttttccaaagg

SEQ ID NO: 391696 - DNA, 15 bp, Homo sapiens
aatttttccaaagga

SEQ ID NO: 391697 - DNA, 15 bp, Homo sapiens
atttttccaaaggat

SEQ ID NO: 391698 - DNA, 15 bp, Homo sapiens
tttttccaaaggatt

SEQ ID NO: 391699 - DNA, 15 bp, Homo sapiens
ttttccaaaggattc

SEQ ID NO: 391700 - DNA, 15 bp, Homo sapiens
tttccaaaggattca

SEQ ID NO: 391701 - DNA, 15 bp, Homo sapiens
ttccaaaggattcat

SEQ ID NO: 391702 - DNA, 15 bp, Homo sapiens
tccaaaggattcatg

SEQ ID NO: 391703 - DNA, 15 bp, Homo sapiens
ccaaaggattcatgc

SEQ ID NO: 391704 - DNA, 15 bp, Homo sapiens
caaaggattcatgcc

SEQ ID NO: 391705 - DNA, 15 bp, Homo sapiens
aaaggattcatgccc

SEQ ID NO: 391706 - DNA, 15 bp, Homo sapiens
aaggattcatgcccc

SEQ ID NO: 391707 - DNA, 15 bp, Homo sapiens
aggattcatgcccct

SEQ ID NO: 391708 - DNA, 15 bp, Homo sapiens
ggattcatgcccctg

SEQ ID NO: 391709 - DNA, 15 bp, Homo sapiens
gattcatgcccctgc

SEQ ID NO: 391710 - DNA, 15 bp, Homo sapiens
attcatgcccctgca

SEQ ID NO: 391711 - DNA, 15 bp, Homo sapiens
ttcatgcccctgcag

SEQ ID NO: 391712 - DNA, 15 bp, Homo sapiens
tcatgcccctgcaga

SEQ ID NO: 391713 - DNA, 15 bp, Homo sapiens
catgcccctgcagac

SEQ ID NO: 391714 - DNA, 15 bp, Homo sapiens
atgcccctgcagact

SEQ ID NO: 391715 - DNA, 15 bp, Homo sapiens
tgcccctgcagactt

SEQ ID NO: 391716 - DNA, 15 bp, Homo sapiens
gcccctgcagacttt

SEQ ID NO: 391717 - DNA, 15 bp, Homo sapiens
cccctgcagactttg

SEQ ID NO: 391718 - DNA, 15 bp, Homo sapiens
ccctgcagactttga

SEQ ID NO: 391719 - DNA, 15 bp, Homo sapiens
cctgcagactttgac

SEQ ID NO: 391720 - DNA, 15 bp, Homo sapiens
ctgcagactttgact

SEQ ID NO: 391721 - DNA, 15 bp, Homo sapiens
tgcagactttgactc

SEQ ID NO: 391722 - DNA, 15 bp, Homo sapiens
gcagactttgactca

SEQ ID NO: 391723 - DNA, 15 bp, Homo sapiens
cagactttgactcac

SEQ ID NO: 391724 - DNA, 15 bp, Homo sapiens
agactttgactcact

SEQ ID NO: 391725 - DNA, 15 bp, Homo sapiens
gactttgactcactg

SEQ ID NO: 391726 - DNA, 15 bp, Homo sapiens
actttgactcactgg

SEQ ID NO: 391727 - DNA, 15 bp, Homo sapiens
ctttgactcactggg

SEQ ID NO: 391728 - DNA, 15 bp, Homo sapiens
tttgactcactgggg

SEQ ID NO: 391729 - DNA, 15 bp, Homo sapiens
ttgactcactggggt

SEQ ID NO: 391730 - DNA, 15 bp, Homo sapiens
tgactcactggggtt

SEQ ID NO: 391731 - DNA, 15 bp, Homo sapiens
gactcactggggttc

SEQ ID NO: 391732 - DNA, 15 bp, Homo sapiens
actcactggggttca

SEQ ID NO: 391733 - DNA, 15 bp, Homo sapiens
ctcactggggttcag

SEQ ID NO: 391734 - DNA, 15 bp, Homo sapiens
tcactggggttcaga

SEQ ID NO: 391735 - DNA, 15 bp, Homo sapiens
cactggggttcagat

SEQ ID NO: 391736 - DNA, 15 bp, Homo sapiens
actggggttcagatg

SEQ ID NO: 391737 - DNA, 15 bp, Homo sapiens
ctggggttcagatgc

SEQ ID NO: 391738 - DNA, 15 bp, Homo sapiens
tggggttcagatgca

SEQ ID NO: 391739 - DNA, 15 bp, Homo sapiens
ggggttcagatgcac

SEQ ID NO: 391740 - DNA, 15 bp, Homo sapiens
gggttcagatgcacc

SEQ ID NO: 391741 - DNA, 15 bp, Homo sapiens
ggttcagatgcaccc

SEQ ID NO: 391742 - DNA, 15 bp, Homo sapiens
gttcagatgcaccct

SEQ ID NO: 391743 - DNA, 15 bp, Homo sapiens
ttcagatgcaccctg

SEQ ID NO: 391744 - DNA, 15 bp, Homo sapiens
tcagatgcaccctgg

SEQ ID NO: 391745 - DNA, 15 bp, Homo sapiens
cagatgcaccctggt

SEQ ID NO: 391746 - DNA, 15 bp, Homo sapiens
agatgcaccctggtc

SEQ ID NO: 391747 - DNA, 15 bp, Homo sapiens
gatgcaccctggtca

SEQ ID NO: 391748 - DNA, 15 bp, Homo sapiens
atgcaccctggtcac

SEQ ID NO: 391749 - DNA, 15 bp, Homo sapiens
tgcaccctggtcacc

SEQ ID NO: 391750 - DNA, 15 bp, Homo sapiens
gcaccctggtcaccc

SEQ ID NO: 391751 - DNA, 15 bp, Homo sapiens
caccctggtcacccc

SEQ ID NO: 391752 - DNA, 15 bp, Homo sapiens
accctggtcacccca

SEQ ID NO: 391753 - DNA, 15 bp, Homo sapiens
ccctggtcaccccac

SEQ ID NO: 391754 - DNA, 15 bp, Homo sapiens
cctggtcaccccact

SEQ ID NO: 391755 - DNA, 15 bp, Homo sapiens
ctggtcaccccactg

SEQ ID NO: 391756 - DNA, 15 bp, Homo sapiens
tggtcaccccactgc

SEQ ID NO: 391757 - DNA, 15 bp, Homo sapiens
ggtcaccccactgcg

SEQ ID NO: 391758 - DNA, 15 bp, Homo sapiens
gtcaccccactgcga

SEQ ID NO: 391759 - DNA, 15 bp, Homo sapiens
tcaccccactgcgaa

SEQ ID NO: 391760 - DNA, 15 bp, Homo sapiens
caccccactgcgaag

SEQ ID NO: 391761 - DNA, 15 bp, Homo sapiens
accccactgcgaaga

SEQ ID NO: 391762 - DNA, 15 bp, Homo sapiens
ccccactgcgaagat

SEQ ID NO: 391763 - DNA, 15 bp, Homo sapiens
cccactgcgaagatg

SEQ ID NO: 391764 - DNA, 15 bp, Homo sapiens
ccactgcgaagatgc

SEQ ID NO: 391765 - DNA, 15 bp, Homo sapiens
cactgcgaagatgcc

SEQ ID NO: 391766 - DNA, 15 bp, Homo sapiens
actgcgaagatgcca

SEQ ID NO: 391767 - DNA, 15 bp, Homo sapiens
ctgcgaagatgccat

SEQ ID NO: 391768 - DNA, 15 bp, Homo sapiens
tgcgaagatgccata

SEQ ID NO: 391769 - DNA, 15 bp, Homo sapiens
gcgaagatgccataa

SEQ ID NO: 391770 - DNA, 15 bp, Homo sapiens
cgaagatgccataaa

SEQ ID NO: 391771 - DNA, 15 bp, Homo sapiens
gaagatgccataaac

SEQ ID NO: 391772 - DNA, 15 bp, Homo sapiens
aagatgccataaact

SEQ ID NO: 391773 - DNA, 15 bp, Homo sapiens
agatgccataaactc

SEQ ID NO: 391774 - DNA, 15 bp, Homo sapiens
gatgccataaactcc

SEQ ID NO: 391775 - DNA, 15 bp, Homo sapiens
atgccataaactcct

SEQ ID NO: 391776 - DNA, 15 bp, Homo sapiens
tgccataaactcctg

SEQ ID NO: 391777 - DNA, 15 bp, Homo sapiens
gccataaactcctgc

SEQ ID NO: 391778 - DNA, 15 bp, Homo sapiens
ccataaactcctgct

SEQ ID NO: 391779 - DNA, 15 bp, Homo sapiens
cataaactcctgctt

SEQ ID NO: 391780 - DNA, 15 bp, Homo sapiens
ataaactcctgcttt

SEQ ID NO: 391781 - DNA, 15 bp, Homo sapiens
taaactcctgctttc

SEQ ID NO: 391782 - DNA, 15 bp, Homo sapiens
aaactcctgctttca

SEQ ID NO: 391783 - DNA, 15 bp, Homo sapiens
aactcctgctttcaa

SEQ ID NO: 391784 - DNA, 15 bp, Homo sapiens
actcctgctttcaac

SEQ ID NO: 391785 - DNA, 15 bp, Homo sapiens
ctcctgctttcaaca

SEQ ID NO: 391786 - DNA, 15 bp, Homo sapiens
tcctgctttcaacag

SEQ ID NO: 391787 - DNA, 15 bp, Homo sapiens
cctgctttcaacagt

SEQ ID NO: 391788 - DNA, 15 bp, Homo sapiens
ctgctttcaacagtg

SEQ ID NO: 391789 - DNA, 15 bp, Homo sapiens
tgctttcaacagtga

SEQ ID NO: 391790 - DNA, 15 bp, Homo sapiens
gctttcaacagtgaa

SEQ ID NO: 391791 - DNA, 15 bp, Homo sapiens
ctttcaacagtgaag

SEQ ID NO: 391792 - DNA, 15 bp, Homo sapiens
tttcaacagtgaagg

SEQ ID NO: 391793 - DNA, 15 bp, Homo sapiens
ttcaacagtgaagga

SEQ ID NO: 391794 - DNA, 15 bp, Homo sapiens
tcaacagtgaaggag

SEQ ID NO: 391795 - DNA, 15 bp, Homo sapiens
caacagtgaaggaga

SEQ ID NO: 391796 - DNA, 15 bp, Homo sapiens
aacagtgaaggagaa

SEQ ID NO: 391797 - DNA, 15 bp, Homo sapiens
acagtgaaggagaaa

SEQ ID NO: 391798 - DNA, 15 bp, Homo sapiens
cagtgaaggagaaaa

SEQ ID NO: 391799 - DNA, 15 bp, Homo sapiens
agtgaaggagaaaat

SEQ ID NO: 391800 - DNA, 15 bp, Homo sapiens
gtgaaggagaaaata

SEQ ID NO: 391801 - DNA, 15 bp, Homo sapiens
tgaaggagaaaataa

SEQ ID NO: 391802 - DNA, 15 bp, Homo sapiens
gaaggagaaaataaa

SEQ ID NO: 391803 - DNA, 15 bp, Homo sapiens
aaggagaaaataaat

SEQ ID NO: 391804 - DNA, 15 bp, Homo sapiens
aggagaaaataaatc

SEQ ID NO: 391805 - DNA, 15 bp, Homo sapiens
ggagaaaataaatct

SEQ ID NO: 391806 - DNA, 15 bp, Homo sapiens
gagaaaataaatctt

SEQ ID NO: 391807 - DNA, 15 bp, Homo sapiens
agaaaataaatcttt

SEQ ID NO: 391808 - DNA, 15 bp, Homo sapiens
gaaaataaatctttg

SEQ ID NO: 391809 - DNA, 15 bp, Homo sapiens
aaaataaatctttga

SEQ ID NO: 391810 - DNA, 15 bp, Homo sapiens
aaataaatctttgaa

SEQ ID NO: 391811 - DNA, 15 bp, Homo sapiens
aataaatctttgaaa

SEQ ID NO: 391812 - DNA, 15 bp, Homo sapiens
ataaatctttgaaat

SEQ ID NO: 391813 - DNA, 15 bp, Homo sapiens
taaatctttgaaatt

SEQ ID NO: 391814 - DNA, 15 bp, Homo sapiens
aaatctttgaaattt

SEQ ID NO: 391815 - DNA, 15 bp, Homo sapiens
aatctttgaaatttt

SEQ ID NO: 391816 - DNA, 15 bp, Homo sapiens
atctttgaaattttc

SEQ ID NO: 391817 - DNA, 15 bp, Homo sapiens
tctttgaaattttcc

SEQ ID NO: 391818 - DNA, 15 bp, Homo sapiens
ctttgaaattttccc

SEQ ID NO: 391819 - DNA, 15 bp, Homo sapiens
tttgaaattttccct

SEQ ID NO: 391820 - DNA, 15 bp, Homo sapiens
ttgaaattttccctg

SEQ ID NO: 391821 - DNA, 15 bp, Homo sapiens
tgaaattttccctgg

SEQ ID NO: 391822 - DNA, 15 bp, Homo sapiens
gaaattttccctggg

SEQ ID NO: 391823 - DNA, 15 bp, Homo sapiens
aaattttccctgggg

SEQ ID NO: 391824 - DNA, 15 bp, Homo sapiens
aattttccctggggt

SEQ ID NO: 391825 - DNA, 15 bp, Homo sapiens
attttccctggggtt

SEQ ID NO: 391826 - DNA, 15 bp, Homo sapiens
ttttccctggggttg

SEQ ID NO: 391827 - DNA, 15 bp, Homo sapiens
tttccctggggttgt

SEQ ID NO: 391828 - DNA, 15 bp, Homo sapiens
ttccctggggttgtt

SEQ ID NO: 391829 - DNA, 15 bp, Homo sapiens
tccctggggttgtta

SEQ ID NO: 391830 - DNA, 15 bp, Homo sapiens
ccctggggttgttat

SEQ ID NO: 391831 - DNA, 15 bp, Homo sapiens
cctggggttgttatt

SEQ ID NO: 391832 - DNA, 15 bp, Homo sapiens
ctggggttgttattt

SEQ ID NO: 391833 - DNA, 15 bp, Homo sapiens
tggggttgttatttt

SEQ ID NO: 391834 - DNA, 15 bp, Homo sapiens
ggggttgttattttc

SEQ ID NO: 391835 - DNA, 15 bp, Homo sapiens
gggttgttattttct

SEQ ID NO: 391836 - DNA, 15 bp, Homo sapiens
ggttgttattttctc

SEQ ID NO: 391837 - DNA, 15 bp, Homo sapiens
gttgttattttctct

SEQ ID NO: 391838 - DNA, 15 bp, Homo sapiens
ttgttattttctctg

SEQ ID NO: 391839 - DNA, 15 bp, Homo sapiens
tgttattttctctga

SEQ ID NO: 391840 - DNA, 15 bp, Homo sapiens
gttattttctctgag

SEQ ID NO: 391841 - DNA, 15 bp, Homo sapiens
ttattttctctgagt

SEQ ID NO: 391842 - DNA, 15 bp, Homo sapiens
tattttctctgagtc

SEQ ID NO: 391843 - DNA, 15 bp, Homo sapiens
attttctctgagtct

SEQ ID NO: 391844 - DNA, 15 bp, Homo sapiens
ttttctctgagtctc

SEQ ID NO: 391845 - DNA, 15 bp, Homo sapiens
tttctctgagtctca

SEQ ID NO: 391846 - DNA, 15 bp, Homo sapiens
ttctctgagtctcag

SEQ ID NO: 391847 - DNA, 15 bp, Homo sapiens
tctctgagtctcagc

SEQ ID NO: 391848 - DNA, 15 bp, Homo sapiens
ctctgagtctcagct

SEQ ID NO: 391849 - DNA, 15 bp, Homo sapiens
tctgagtctcagctt

SEQ ID NO: 391850 - DNA, 15 bp, Homo sapiens
ctgagtctcagcttg

SEQ ID NO: 391851 - DNA, 15 bp, Homo sapiens
tgagtctcagcttga

SEQ ID NO: 391852 - DNA, 15 bp, Homo sapiens
gagtctcagcttgag

SEQ ID NO: 391853 - DNA, 15 bp, Homo sapiens
agtctcagcttgagg

SEQ ID NO: 391854 - DNA, 15 bp, Homo sapiens
gtctcagcttgagga

SEQ ID NO: 391855 - DNA, 15 bp, Homo sapiens
tctcagcttgaggaa

SEQ ID NO: 391856 - DNA, 15 bp, Homo sapiens
ctcagcttgaggaaa

SEQ ID NO: 391857 - DNA, 15 bp, Homo sapiens
tcagcttgaggaaat

SEQ ID NO: 391858 - DNA, 15 bp, Homo sapiens
cagcttgaggaaatg

SEQ ID NO: 391859 - DNA, 15 bp, Homo sapiens
agcttgaggaaatgc

SEQ ID NO: 391860 - DNA, 15 bp, Homo sapiens
gcttgaggaaatgca

SEQ ID NO: 391861 - DNA, 15 bp, Homo sapiens
cttgaggaaatgcaa

SEQ ID NO: 391862 - DNA, 15 bp, Homo sapiens
ttgaggaaatgcaag

SEQ ID NO: 391863 - DNA, 15 bp, Homo sapiens
tgaggaaatgcaaga

SEQ ID NO: 391864 - DNA, 15 bp, Homo sapiens
gaggaaatgcaagaa

SEQ ID NO: 391865 - DNA, 15 bp, Homo sapiens
aggaaatgcaagaaa

SEQ ID NO: 391866 - DNA, 15 bp, Homo sapiens
ggaaatgcaagaaaa

SEQ ID NO: 391867 - DNA, 15 bp, Homo sapiens
gaaatgcaagaaaaa

SEQ ID NO: 391868 - DNA, 15 bp, Homo sapiens
aaatgcaagaaaaaa

SEQ ID NO: 391869 - DNA, 15 bp, Homo sapiens
aatgcaagaaaaaac

SEQ ID NO: 391870 - DNA, 15 bp, Homo sapiens
atgcaagaaaaaact

SEQ ID NO: 391871 - DNA, 15 bp, Homo sapiens
tgcaagaaaaaactt

SEQ ID NO: 391872 - DNA, 15 bp, Homo sapiens
gcaagaaaaaacttc

SEQ ID NO: 391873 - DNA, 15 bp, Homo sapiens
caagaaaaaacttcc

SEQ ID NO: 391874 - DNA, 15 bp, Homo sapiens
aagaaaaaacttccc

SEQ ID NO: 391875 - DNA, 15 bp, Homo sapiens
agaaaaaacttccct

SEQ ID NO: 391876 - DNA, 15 bp, Homo sapiens
gaaaaaacttccctt

SEQ ID NO: 391877 - DNA, 15 bp, Homo sapiens
aaaaaacttcccttg

SEQ ID NO: 391878 - DNA, 15 bp, Homo sapiens
aaaaacttcccttga

SEQ ID NO: 391879 - DNA, 15 bp, Homo sapiens
aaaacttcccttgac

SEQ ID NO: 391880 - DNA, 15 bp, Homo sapiens
aaacttcccttgacc

SEQ ID NO: 391881 - DNA, 15 bp, Homo sapiens
aacttcccttgacca

SEQ ID NO: 391882 - DNA, 15 bp, Homo sapiens
acttcccttgaccag

SEQ ID NO: 391883 - DNA, 15 bp, Homo sapiens
cttcccttgaccagt

SEQ ID NO: 391884 - DNA, 15 bp, Homo sapiens
ttcccttgaccagtg

SEQ ID NO: 391885 - DNA, 15 bp, Homo sapiens
tcccttgaccagtgg

SEQ ID NO: 391886 - DNA, 15 bp, Homo sapiens
cccttgaccagtggg

SEQ ID NO: 391887 - DNA, 15 bp, Homo sapiens
ccttgaccagtgggg

SEQ ID NO: 391888 - DNA, 15 bp, Homo sapiens
cttgaccagtggggc

SEQ ID NO: 391889 - DNA, 15 bp, Homo sapiens
ttgaccagtggggct

SEQ ID NO: 391890 - DNA, 15 bp, Homo sapiens
tgaccagtggggctt

SEQ ID NO: 391891 - DNA, 15 bp, Homo sapiens
gaccagtggggcttg

SEQ ID NO: 391892 - DNA, 15 bp, Homo sapiens
accagtggggcttgt

SEQ ID NO: 391893 - DNA, 15 bp, Homo sapiens
ccagtggggcttgtg

SEQ ID NO: 391894 - DNA, 15 bp, Homo sapiens
cagtggggcttgtga

SEQ ID NO: 391895 - DNA, 15 bp, Homo sapiens
agtggggcttgtgat

SEQ ID NO: 391896 - DNA, 15 bp, Homo sapiens
gtggggcttgtgata

SEQ ID NO: 391897 - DNA, 15 bp, Homo sapiens
tggggcttgtgatag

SEQ ID NO: 391898 - DNA, 15 bp, Homo sapiens
ggggcttgtgataga

SEQ ID NO: 391899 - DNA, 15 bp, Homo sapiens
gggcttgtgatagaa

SEQ ID NO: 391900 - DNA, 15 bp, Homo sapiens
ggcttgtgatagaag

SEQ ID NO: 391901 - DNA, 15 bp, Homo sapiens
gcttgtgatagaaga

SEQ ID NO: 391902 - DNA, 15 bp, Homo sapiens
cttgtgatagaagat

SEQ ID NO: 391903 - DNA, 15 bp, Homo sapiens
ttgtgatagaagatc

SEQ ID NO: 391904 - DNA, 15 bp, Homo sapiens
tgtgatagaagatcc

SEQ ID NO: 391905 - DNA, 15 bp, Homo sapiens
gtgatagaagatcct

SEQ ID NO: 391906 - DNA, 15 bp, Homo sapiens
tgatagaagatcctg

SEQ ID NO: 391907 - DNA, 15 bp, Homo sapiens
gatagaagatcctgt

SEQ ID NO: 391908 - DNA, 15 bp, Homo sapiens
atagaagatcctgta

SEQ ID NO: 391909 - DNA, 15 bp, Homo sapiens
tagaagatcctgtag

SEQ ID NO: 391910 - DNA, 15 bp, Homo sapiens
agaagatcctgtagg

SEQ ID NO: 391911 - DNA, 15 bp, Homo sapiens
gaagatcctgtagga

SEQ ID NO: 391912 - DNA, 15 bp, Homo sapiens
aagatcctgtaggat

SEQ ID NO: 391913 - DNA, 15 bp, Homo sapiens
agatcctgtaggatg

SEQ ID NO: 391914 - DNA, 15 bp, Homo sapiens
gatcctgtaggatgc

SEQ ID NO: 391915 - DNA, 15 bp, Homo sapiens
atcctgtaggatgct

SEQ ID NO: 391916 - DNA, 15 bp, Homo sapiens
tcctgtaggatgctc

SEQ ID NO: 391917 - DNA, 15 bp, Homo sapiens
cctgtaggatgctcc

SEQ ID NO: 391918 - DNA, 15 bp, Homo sapiens
ctgtaggatgctcct

SEQ ID NO: 391919 - DNA, 15 bp, Homo sapiens
tgtaggatgctcctc

SEQ ID NO: 391920 - DNA, 15 bp, Homo sapiens
gtaggatgctcctca

SEQ ID NO: 391921 - DNA, 15 bp, Homo sapiens
taggatgctcctcaa

SEQ ID NO: 391922 - DNA, 15 bp, Homo sapiens
aggatgctcctcaat

SEQ ID NO: 391923 - DNA, 15 bp, Homo sapiens
ggatgctcctcaatt

SEQ ID NO: 391924 - DNA, 15 bp, Homo sapiens
gatgctcctcaattt

SEQ ID NO: 391925 - DNA, 15 bp, Homo sapiens
atgctcctcaattta

SEQ ID NO: 391926 - DNA, 15 bp, Homo sapiens
tgctcctcaatttat

SEQ ID NO: 391927 - DNA, 15 bp, Homo sapiens
gctcctcaatttatg

SEQ ID NO: 391928 - DNA, 15 bp, Homo sapiens
ctcctcaatttatga

SEQ ID NO: 391929 - DNA, 15 bp, Homo sapiens
tcctcaatttatgaa

SEQ ID NO: 391930 - DNA, 15 bp, Homo sapiens
cctcaatttatgaag

SEQ ID NO: 391931 - DNA, 15 bp, Homo sapiens
ctcaatttatgaagc

SEQ ID NO: 391932 - DNA, 15 bp, Homo sapiens
tcaatttatgaagcc

SEQ ID NO: 391933 - DNA, 15 bp, Homo sapiens
caatttatgaagcct

SEQ ID NO: 391934 - DNA, 15 bp, Homo sapiens
aatttatgaagcctt

SEQ ID NO: 391935 - DNA, 15 bp, Homo sapiens
atttatgaagccttt

SEQ ID NO: 391936 - DNA, 15 bp, Homo sapiens
tttatgaagcctttt

SEQ ID NO: 391937 - DNA, 15 bp, Homo sapiens
ttatgaagccttttc

SEQ ID NO: 391938 - DNA, 15 bp, Homo sapiens
tatgaagccttttct

SEQ ID NO: 391939 - DNA, 15 bp, Homo sapiens
atgaagccttttctg

SEQ ID NO: 391940 - DNA, 15 bp, Homo sapiens
tgaagccttttctgg

SEQ ID NO: 391941 - DNA, 15 bp, Homo sapiens
gaagccttttctgga

SEQ ID NO: 391942 - DNA, 15 bp, Homo sapiens
aagccttttctggat

SEQ ID NO: 391943 - DNA, 15 bp, Homo sapiens
agccttttctggatt

SEQ ID NO: 391944 - DNA, 15 bp, Homo sapiens
gccttttctggatta

SEQ ID NO: 391945 - DNA, 15 bp, Homo sapiens
ccttttctggattat

SEQ ID NO: 391946 - DNA, 15 bp, Homo sapiens
cttttctggattata

SEQ ID NO: 391947 - DNA, 15 bp, Homo sapiens
ttttctggattatag

SEQ ID NO: 391948 - DNA, 15 bp, Homo sapiens
tttctggattataga

SEQ ID NO: 391949 - DNA, 15 bp, Homo sapiens
ttctggattatagat

SEQ ID NO: 391950 - DNA, 15 bp, Homo sapiens
tctggattatagatt

SEQ ID NO: 391951 - DNA, 15 bp, Homo sapiens
ctggattatagatta

SEQ ID NO: 391952 - DNA, 15 bp, Homo sapiens
tggattatagattag

SEQ ID NO: 391953 - DNA, 15 bp, Homo sapiens
ggattatagattagg

SEQ ID NO: 391954 - DNA, 15 bp, Homo sapiens
gattatagattaggc

SEQ ID NO: 391955 - DNA, 15 bp, Homo sapiens
attatagattaggct

SEQ ID NO: 391956 - DNA, 15 bp, Homo sapiens
ttatagattaggctc

SEQ ID NO: 391957 - DNA, 15 bp, Homo sapiens
tatagattaggctct

SEQ ID NO: 391958 - DNA, 15 bp, Homo sapiens
atagattaggctctg

SEQ ID NO: 391959 - DNA, 15 bp, Homo sapiens
tagattaggctctga

SEQ ID NO: 391960 - DNA, 15 bp, Homo sapiens
agattaggctctgag

SEQ ID NO: 391961 - DNA, 15 bp, Homo sapiens
gattaggctctgaga

SEQ ID NO: 391962 - DNA, 15 bp, Homo sapiens
attaggctctgagat

SEQ ID NO: 391963 - DNA, 15 bp, Homo sapiens
ttaggctctgagatg

SEQ ID NO: 391964 - DNA, 15 bp, Homo sapiens
taggctctgagatgg

SEQ ID NO: 391965 - DNA, 15 bp, Homo sapiens
aggctctgagatggc

SEQ ID NO: 391966 - DNA, 15 bp, Homo sapiens
ggctctgagatggcc

SEQ ID NO: 391967 - DNA, 15 bp, Homo sapiens
gctctgagatggccc

SEQ ID NO: 391968 - DNA, 15 bp, Homo sapiens
ctctgagatggcccc

SEQ ID NO: 391969 - DNA, 15 bp, Homo sapiens
tctgagatggcccct

SEQ ID NO: 391970 - DNA, 15 bp, Homo sapiens
ctgagatggccccta

SEQ ID NO: 391971 - DNA, 15 bp, Homo sapiens
tgagatggcccctaa

SEQ ID NO: 391972 - DNA, 15 bp, Homo sapiens
gagatggcccctaaa

SEQ ID NO: 391973 - DNA, 15 bp, Homo sapiens
agatggcccctaaaa

SEQ ID NO: 391974 - DNA, 15 bp, Homo sapiens
gatggcccctaaaaa

SEQ ID NO: 391975 - DNA, 15 bp, Homo sapiens
atggcccctaaaaat

SEQ ID NO: 391976 - DNA, 15 bp, Homo sapiens
tggcccctaaaaatc

SEQ ID NO: 391977 - DNA, 15 bp, Homo sapiens
ggcccctaaaaatct

SEQ ID NO: 391978 - DNA, 15 bp, Homo sapiens
gcccctaaaaatcta

SEQ ID NO: 391979 - DNA, 15 bp, Homo sapiens
cccctaaaaatctag

SEQ ID NO: 391980 - DNA, 15 bp, Homo sapiens
ccctaaaaatctagt

SEQ ID NO: 391981 - DNA, 15 bp, Homo sapiens
cctaaaaatctagtt

SEQ ID NO: 391982 - DNA, 15 bp, Homo sapiens
ctaaaaatctagtta

SEQ ID NO: 391983 - DNA, 15 bp, Homo sapiens
taaaaatctagttaa

SEQ ID NO: 391984 - DNA, 15 bp, Homo sapiens
aaaaatctagttaac

SEQ ID NO: 391985 - DNA, 15 bp, Homo sapiens
aaaatctagttaacc

SEQ ID NO: 391986 - DNA, 15 bp, Homo sapiens
aaatctagttaaccc

SEQ ID NO: 391987 - DNA, 15 bp, Homo sapiens
aatctagttaaccca

SEQ ID NO: 391988 - DNA, 15 bp, Homo sapiens
atctagttaacccac

SEQ ID NO: 391989 - DNA, 15 bp, Homo sapiens
tctagttaacccaca

SEQ ID NO: 391990 - DNA, 15 bp, Homo sapiens
ctagttaacccacaa

SEQ ID NO: 391991 - DNA, 15 bp, Homo sapiens
tagttaacccacaaa

SEQ ID NO: 391992 - DNA, 15 bp, Homo sapiens
agttaacccacaaag

SEQ ID NO: 391993 - DNA, 15 bp, Homo sapiens
gttaacccacaaaga

SEQ ID NO: 391994 - DNA, 15 bp, Homo sapiens
ttaacccacaaagaa

SEQ ID NO: 391995 - DNA, 15 bp, Homo sapiens
taacccacaaagaaa

SEQ ID NO: 391996 - DNA, 15 bp, Homo sapiens
aacccacaaagaaac

SEQ ID NO: 391997 - DNA, 15 bp, Homo sapiens
acccacaaagaaact

SEQ ID NO: 391998 - DNA, 15 bp, Homo sapiens
cccacaaagaaactg

SEQ ID NO: 391999 - DNA, 15 bp, Homo sapiens
ccacaaagaaactga

SEQ ID NO: 392000 - DNA, 15 bp, Homo sapiens
cacaaagaaactgat

SEQ ID NO: 392001 - DNA, 15 bp, Homo sapiens
acaaagaaactgata

SEQ ID NO: 392002 - DNA, 15 bp, Homo sapiens
caaagaaactgatat

SEQ ID NO: 392003 - DNA, 15 bp, Homo sapiens
aaagaaactgatata

SEQ ID NO: 392004 - DNA, 15 bp, Homo sapiens
aagaaactgatataa

SEQ ID NO: 392005 - DNA, 15 bp, Homo sapiens
agaaactgatataat

SEQ ID NO: 392006 - DNA, 15 bp, Homo sapiens
gaaactgatataatg

SEQ ID NO: 392007 - DNA, 15 bp, Homo sapiens
aaactgatataatgc

SEQ ID NO: 392008 - DNA, 15 bp, Homo sapiens
aactgatataatgct

SEQ ID NO: 392009 - DNA, 15 bp, Homo sapiens
actgatataatgctg

SEQ ID NO: 392010 - DNA, 15 bp, Homo sapiens
ctgatataatgctga

SEQ ID NO: 392011 - DNA, 15 bp, Homo sapiens
tgatataatgctgat

SEQ ID NO: 392012 - DNA, 15 bp, Homo sapiens
gatataatgctgatt

SEQ ID NO: 392013 - DNA, 15 bp, Homo sapiens
atataatgctgattg

SEQ ID NO: 392014 - DNA, 15 bp, Homo sapiens
tataatgctgattga

SEQ ID NO: 392015 - DNA, 15 bp, Homo sapiens
ataatgctgattgac

SEQ ID NO: 392016 - DNA, 15 bp, Homo sapiens
taatgctgattgaca

SEQ ID NO: 392017 - DNA, 15 bp, Homo sapiens
aatgctgattgacat

SEQ ID NO: 392018 - DNA, 15 bp, Homo sapiens
atgctgattgacata

SEQ ID NO: 392019 - DNA, 15 bp, Homo sapiens
tgctgattgacataa

SEQ ID NO: 392020 - DNA, 15 bp, Homo sapiens
gctgattgacataaa

SEQ ID NO: 392021 - DNA, 15 bp, Homo sapiens
ctgattgacataaaa

SEQ ID NO: 392022 - DNA, 15 bp, Homo sapiens
tgattgacataaaac

SEQ ID NO: 392023 - DNA, 15 bp, Homo sapiens
gattgacataaaacc

SEQ ID NO: 392024 - DNA, 15 bp, Homo sapiens
attgacataaaacct

SEQ ID NO: 392025 - DNA, 15 bp, Homo sapiens
ttgacataaaacctc

SEQ ID NO: 392026 - DNA, 15 bp, Homo sapiens
tgacataaaacctca

SEQ ID NO: 392027 - DNA, 15 bp, Homo sapiens
gacataaaacctcat

SEQ ID NO: 392028 - DNA, 15 bp, Homo sapiens
acataaaacctcata

SEQ ID NO: 392029 - DNA, 15 bp, Homo sapiens
cataaaacctcatat

SEQ ID NO: 392030 - DNA, 15 bp, Homo sapiens
ataaaacctcatatt

SEQ ID NO: 392031 - DNA, 15 bp, Homo sapiens
taaaacctcatatta

SEQ ID NO: 392032 - DNA, 15 bp, Homo sapiens
aaaacctcatattaa

SEQ ID NO: 392033 - DNA, 15 bp, Homo sapiens
aaacctcatattaaa

SEQ ID NO: 392034 - DNA, 15 bp, Homo sapiens
aacctcatattaaaa

SEQ ID NO: 392035 - DNA, 15 bp, Homo sapiens
acctcatattaaaaa

SEQ ID NO: 392036 - DNA, 15 bp, Homo sapiens
cctcatattaaaaag

SEQ ID NO: 392037 - DNA, 15 bp, Homo sapiens
ctcatattaaaaaga

SEQ ID NO: 392038 - DNA, 15 bp, Homo sapiens
tcatattaaaaagaa

SEQ ID NO: 392039 - DNA, 15 bp, Homo sapiens
catattaaaaagaat

SEQ ID NO: 392040 - DNA, 15 bp, Homo sapiens
atattaaaaagaatc

SEQ ID NO: 392041 - DNA, 15 bp, Homo sapiens
tattaaaaagaatcc

SEQ ID NO: 392042 - DNA, 15 bp, Homo sapiens
attaaaaagaatcct

SEQ ID NO: 392043 - DNA, 15 bp, Homo sapiens
ttaaaaagaatccta

SEQ ID NO: 392044 - DNA, 15 bp, Homo sapiens
taaaaagaatcctat

SEQ ID NO: 392045 - DNA, 15 bp, Homo sapiens
aaaaagaatcctatt

SEQ ID NO: 392046 - DNA, 15 bp, Homo sapiens
aaaagaatcctattc

SEQ ID NO: 392047 - DNA, 15 bp, Homo sapiens
aaagaatcctattcc

SEQ ID NO: 392048 - DNA, 15 bp, Homo sapiens
aagaatcctattcca

SEQ ID NO: 392049 - DNA, 15 bp, Homo sapiens
agaatcctattccat

SEQ ID NO: 392050 - DNA, 15 bp, Homo sapiens
gaatcctattccatt

SEQ ID NO: 392051 - DNA, 15 bp, Homo sapiens
aatcctattccattg

SEQ ID NO: 392052 - DNA, 15 bp, Homo sapiens
atcctattccattgc

SEQ ID NO: 392053 - DNA, 15 bp, Homo sapiens
tcctattccattgcc

SEQ ID NO: 392054 - DNA, 15 bp, Homo sapiens
cctattccattgcca

SEQ ID NO: 392055 - DNA, 15 bp, Homo sapiens
ctattccattgccag

SEQ ID NO: 392056 - DNA, 15 bp, Homo sapiens
tattccattgccaga

SEQ ID NO: 392057 - DNA, 15 bp, Homo sapiens
attccattgccagaa

SEQ ID NO: 392058 - DNA, 15 bp, Homo sapiens
ttccattgccagaaa

SEQ ID NO: 392059 - DNA, 15 bp, Homo sapiens
tccattgccagaaac

SEQ ID NO: 392060 - DNA, 15 bp, Homo sapiens
ccattgccagaaact

SEQ ID NO: 392061 - DNA, 15 bp, Homo sapiens
cattgccagaaacta

SEQ ID NO: 392062 - DNA, 15 bp, Homo sapiens
attgccagaaactaa

SEQ ID NO: 392063 - DNA, 15 bp, Homo sapiens
ttgccagaaactaaa

SEQ ID NO: 392064 - DNA, 15 bp, Homo sapiens
tgccagaaactaaac

SEQ ID NO: 392065 - DNA, 15 bp, Homo sapiens
gccagaaactaaaca

SEQ ID NO: 392066 - DNA, 15 bp, Homo sapiens
ccagaaactaaacaa

SEQ ID NO: 392067 - DNA, 15 bp, Homo sapiens
cagaaactaaacaaa

SEQ ID NO: 392068 - DNA, 15 bp, Homo sapiens
agaaactaaacaaag

SEQ ID NO: 392069 - DNA, 15 bp, Homo sapiens
gaaactaaacaaagc

SEQ ID NO: 392070 - DNA, 15 bp, Homo sapiens
aaactaaacaaagca

SEQ ID NO: 392071 - DNA, 15 bp, Homo sapiens
aactaaacaaagcaa

SEQ ID NO: 392072 - DNA, 15 bp, Homo sapiens
actaaacaaagcaaa

SEQ ID NO: 392073 - DNA, 15 bp, Homo sapiens
ctaaacaaagcaaag

SEQ ID NO: 392074 - DNA, 15 bp, Homo sapiens
taaacaaagcaaagg

SEQ ID NO: 392075 - DNA, 15 bp, Homo sapiens
aaacaaagcaaagga

SEQ ID NO: 392076 - DNA, 15 bp, Homo sapiens
aacaaagcaaaggaa

SEQ ID NO: 392077 - DNA, 15 bp, Homo sapiens
acaaagcaaaggaaa

SEQ ID NO: 392078 - DNA, 15 bp, Homo sapiens
caaagcaaaggaaag

SEQ ID NO: 392079 - DNA, 15 bp, Homo sapiens
aaagcaaaggaaaga

SEQ ID NO: 392080 - DNA, 15 bp, Homo sapiens
aagcaaaggaaagaa

SEQ ID NO: 392081 - DNA, 15 bp, Homo sapiens
agcaaaggaaagaag

SEQ ID NO: 392082 - DNA, 15 bp, Homo sapiens
gcaaaggaaagaagt

SEQ ID NO: 392083 - DNA, 15 bp, Homo sapiens
caaaggaaagaagtc

SEQ ID NO: 392084 - DNA, 15 bp, Homo sapiens
aaaggaaagaagtcg

SEQ ID NO: 392085 - DNA, 15 bp, Homo sapiens
aaggaaagaagtcgt

SEQ ID NO: 392086 - DNA, 15 bp, Homo sapiens
aggaaagaagtcgtc

SEQ ID NO: 392087 - DNA, 15 bp, Homo sapiens
ggaaagaagtcgtct

SEQ ID NO: 392088 - DNA, 15 bp, Homo sapiens
gaaagaagtcgtctt

SEQ ID NO: 392089 - DNA, 15 bp, Homo sapiens
aaagaagtcgtcttt

SEQ ID NO: 392090 - DNA, 15 bp, Homo sapiens
aagaagtcgtcttta

SEQ ID NO: 392091 - DNA, 15 bp, Homo sapiens
agaagtcgtctttac

SEQ ID NO: 392092 - DNA, 15 bp, Homo sapiens
gaagtcgtctttact

SEQ ID NO: 392093 - DNA, 15 bp, Homo sapiens
aagtcgtctttactg

SEQ ID NO: 392094 - DNA, 15 bp, Homo sapiens
agtcgtctttactgt

SEQ ID NO: 392095 - DNA, 15 bp, Homo sapiens
gtcgtctttactgtg

SEQ ID NO: 392096 - DNA, 15 bp, Homo sapiens
tcgtctttactgtga

SEQ ID NO: 392097 - DNA, 15 bp, Homo sapiens
cgtctttactgtgag

SEQ ID NO: 392098 - DNA, 15 bp, Homo sapiens
gtctttactgtgagt

SEQ ID NO: 392099 - DNA, 15 bp, Homo sapiens
tctttactgtgagtg

SEQ ID NO: 392100 - DNA, 15 bp, Homo sapiens
ctttactgtgagtga

SEQ ID NO: 392101 - DNA, 15 bp, Homo sapiens
tttactgtgagtgat

SEQ ID NO: 392102 - DNA, 15 bp, Homo sapiens
ttactgtgagtgata

SEQ ID NO: 392103 - DNA, 15 bp, Homo sapiens
tactgtgagtgatac

SEQ ID NO: 392104 - DNA, 15 bp, Homo sapiens
actgtgagtgataca

SEQ ID NO: 392105 - DNA, 15 bp, Homo sapiens
ctgtgagtgatacag

SEQ ID NO: 392106 - DNA, 15 bp, Homo sapiens
tgtgagtgatacagg

SEQ ID NO: 392107 - DNA, 15 bp, Homo sapiens
gtgagtgatacagga

SEQ ID NO: 392108 - DNA, 15 bp, Homo sapiens
tgagtgatacaggag

SEQ ID NO: 392109 - DNA, 15 bp, Homo sapiens
gagtgatacaggagg

SEQ ID NO: 392110 - DNA, 15 bp, Homo sapiens
agtgatacaggagga

SEQ ID NO: 392111 - DNA, 15 bp, Homo sapiens
gtgatacaggaggaa

SEQ ID NO: 392112 - DNA, 15 bp, Homo sapiens
tgatacaggaggaaa

SEQ ID NO: 392113 - DNA, 15 bp, Homo sapiens
gatacaggaggaaaa

SEQ ID NO: 392114 - DNA, 15 bp, Homo sapiens
atacaggaggaaaaa

SEQ ID NO: 392115 - DNA, 15 bp, Homo sapiens
tacaggaggaaaaac

SEQ ID NO: 392116 - DNA, 15 bp, Homo sapiens
acaggaggaaaaaca

SEQ ID NO: 392117 - DNA, 15 bp, Homo sapiens
caggaggaaaaacaa

SEQ ID NO: 392118 - DNA, 15 bp, Homo sapiens
ggaggaaaaacaaac

SEQ ID NO: 392119 - DNA, 15 bp, Homo sapiens
gaggaaaaacaaaca

SEQ ID NO: 392120 - DNA, 15 bp, Homo sapiens
aggaaaaacaaacat

SEQ ID NO: 392121 - DNA, 15 bp, Homo sapiens
ggaaaaacaaacatg

SEQ ID NO: 392122 - DNA, 15 bp, Homo sapiens
gaaaaacaaacatgg

SEQ ID NO: 392123 - DNA, 15 bp, Homo sapiens
aaaaacaaacatggt

SEQ ID NO: 392124 - DNA, 15 bp, Homo sapiens
aaaacaaacatggtt

SEQ ID NO: 392125 - DNA, 15 bp, Homo sapiens
aaacaaacatggttg

SEQ ID NO: 392126 - DNA, 15 bp, Homo sapiens
aacaaacatggttgc

SEQ ID NO: 392127 - DNA, 15 bp, Homo sapiens
acaaacatggttgct

SEQ ID NO: 392128 - DNA, 15 bp, Homo sapiens
caaacatggttgctt

SEQ ID NO: 392129 - DNA, 15 bp, Homo sapiens
aaacatggttgctta

SEQ ID NO: 392130 - DNA, 15 bp, Homo sapiens
aacatggttgcttag

SEQ ID NO: 392131 - DNA, 15 bp, Homo sapiens
acatggttgcttagt

SEQ ID NO: 392132 - DNA, 15 bp, Homo sapiens
catggttgcttagta

SEQ ID NO: 392133 - DNA, 15 bp, Homo sapiens
atggttgcttagtag

SEQ ID NO: 392134 - DNA, 15 bp, Homo sapiens
tggttgcttagtaga

SEQ ID NO: 392135 - DNA, 15 bp, Homo sapiens
ggttgcttagtagag

SEQ ID NO: 392136 - DNA, 15 bp, Homo sapiens
gttgcttagtagagg

SEQ ID NO: 392137 - DNA, 15 bp, Homo sapiens
ttgcttagtagagga

SEQ ID NO: 392138 - DNA, 15 bp, Homo sapiens
tgcttagtagaggat

SEQ ID NO: 392139 - DNA, 15 bp, Homo sapiens
gcttagtagaggatg

SEQ ID NO: 392140 - DNA, 15 bp, Homo sapiens
cttagtagaggatgg

SEQ ID NO: 392141 - DNA, 15 bp, Homo sapiens
ttagtagaggatgga

SEQ ID NO: 392142 - DNA, 15 bp, Homo sapiens
tagtagaggatggaa

SEQ ID NO: 392143 - DNA, 15 bp, Homo sapiens
agtagaggatggaaa

SEQ ID NO: 392144 - DNA, 15 bp, Homo sapiens
gtagaggatggaaag

SEQ ID NO: 392145 - DNA, 15 bp, Homo sapiens
tagaggatggaaaga

SEQ ID NO: 392146 - DNA, 15 bp, Homo sapiens
agaggatggaaagaa

SEQ ID NO: 392147 - DNA, 15 bp, Homo sapiens
gaggatggaaagaaa

SEQ ID NO: 392148 - DNA, 15 bp, Homo sapiens
aggatggaaagaaat

SEQ ID NO: 392149 - DNA, 15 bp, Homo sapiens
ggatggaaagaaata

SEQ ID NO: 392150 - DNA, 15 bp, Homo sapiens
gatggaaagaaatac

SEQ ID NO: 392151 - DNA, 15 bp, Homo sapiens
atggaaagaaatact

SEQ ID NO: 392152 - DNA, 15 bp, Homo sapiens
tggaaagaaatactg

SEQ ID NO: 392153 - DNA, 15 bp, Homo sapiens
ggaaagaaatactga

SEQ ID NO: 392154 - DNA, 15 bp, Homo sapiens
gaaagaaatactgag

SEQ ID NO: 392155 - DNA, 15 bp, Homo sapiens
aaagaaatactgaga

SEQ ID NO: 392156 - DNA, 15 bp, Homo sapiens
aagaaatactgagaa

SEQ ID NO: 392157 - DNA, 15 bp, Homo sapiens
agaaatactgagaat

SEQ ID NO: 392158 - DNA, 15 bp, Homo sapiens
gaaatactgagaatt

SEQ ID NO: 392159 - DNA, 15 bp, Homo sapiens
aaatactgagaattt

SEQ ID NO: 392160 - DNA, 15 bp, Homo sapiens
aatactgagaatttt

SEQ ID NO: 392161 - DNA, 15 bp, Homo sapiens
atactgagaatttta

SEQ ID NO: 392162 - DNA, 15 bp, Homo sapiens
tactgagaattttaa

SEQ ID NO: 392163 - DNA, 15 bp, Homo sapiens
actgagaattttaaa

SEQ ID NO: 392164 - DNA, 15 bp, Homo sapiens
ctgagaattttaaat

SEQ ID NO: 392165 - DNA, 15 bp, Homo sapiens
tgagaattttaaatg

SEQ ID NO: 392166 - DNA, 15 bp, Homo sapiens
gagaattttaaatgt

SEQ ID NO: 392167 - DNA, 15 bp, Homo sapiens
agaattttaaatgta

SEQ ID NO: 392168 - DNA, 15 bp, Homo sapiens
gaattttaaatgtac

SEQ ID NO: 392169 - DNA, 15 bp, Homo sapiens
aattttaaatgtact

SEQ ID NO: 392170 - DNA, 15 bp, Homo sapiens
attttaaatgtactt

SEQ ID NO: 392171 - DNA, 15 bp, Homo sapiens
ttttaaatgtacttc

SEQ ID NO: 392172 - DNA, 15 bp, Homo sapiens
tttaaatgtacttct

SEQ ID NO: 392173 - DNA, 15 bp, Homo sapiens
ttaaatgtacttctg

SEQ ID NO: 392174 - DNA, 15 bp, Homo sapiens
taaatgtacttctgg

SEQ ID NO: 392175 - DNA, 15 bp, Homo sapiens
aaatgtacttctgga

SEQ ID NO: 392176 - DNA, 15 bp, Homo sapiens
aatgtacttctggaa

SEQ ID NO: 392177 - DNA, 15 bp, Homo sapiens
atgtacttctggaaa

SEQ ID NO: 392178 - DNA, 15 bp, Homo sapiens
tgtacttctggaaag

SEQ ID NO: 392179 - DNA, 15 bp, Homo sapiens
gtacttctggaaagt

SEQ ID NO: 392180 - DNA, 15 bp, Homo sapiens
tacttctggaaagta

SEQ ID NO: 392181 - DNA, 15 bp, Homo sapiens
acttctggaaagtat

SEQ ID NO: 392182 - DNA, 15 bp, Homo sapiens
cttctggaaagtata

SEQ ID NO: 392183 - DNA, 15 bp, Homo sapiens
ttctggaaagtatac

SEQ ID NO: 392184 - DNA, 15 bp, Homo sapiens
tctggaaagtataca

SEQ ID NO: 392185 - DNA, 15 bp, Homo sapiens
ctggaaagtatacat

SEQ ID NO: 392186 - DNA, 15 bp, Homo sapiens
tggaaagtatacatt

SEQ ID NO: 392187 - DNA, 15 bp, Homo sapiens
ggaaagtatacattt

SEQ ID NO: 392188 - DNA, 15 bp, Homo sapiens
gaaagtatacatttt

SEQ ID NO: 392189 - DNA, 15 bp, Homo sapiens
aaagtatacatttta

SEQ ID NO: 392190 - DNA, 15 bp, Homo sapiens
aagtatacattttaa

SEQ ID NO: 392191 - DNA, 15 bp, Homo sapiens
agtatacattttaag

SEQ ID NO: 392192 - DNA, 15 bp, Homo sapiens
gtatacattttaaga

SEQ ID NO: 392193 - DNA, 15 bp, Homo sapiens
tatacattttaagaa

SEQ ID NO: 392194 - DNA, 15 bp, Homo sapiens
atacattttaagaat

SEQ ID NO: 392195 - DNA, 15 bp, Homo sapiens
tacattttaagaatt

SEQ ID NO: 392196 - DNA, 15 bp, Homo sapiens
acattttaagaatta

SEQ ID NO: 392197 - DNA, 15 bp, Homo sapiens
cattttaagaattat

SEQ ID NO: 392198 - DNA, 15 bp, Homo sapiens
attttaagaattatg

SEQ ID NO: 392199 - DNA, 15 bp, Homo sapiens
ttttaagaattatgc

SEQ ID NO: 392200 - DNA, 15 bp, Homo sapiens
tttaagaattatgct

SEQ ID NO: 392201 - DNA, 15 bp, Homo sapiens
ttaagaattatgctt

SEQ ID NO: 392202 - DNA, 15 bp, Homo sapiens
taagaattatgcttt

SEQ ID NO: 392203 - DNA, 15 bp, Homo sapiens
aagaattatgctttt

SEQ ID NO: 392204 - DNA, 15 bp, Homo sapiens
gaattatgctttttg

SEQ ID NO: 392205 - DNA, 15 bp, Homo sapiens
aattatgctttttgg

SEQ ID NO: 392206 - DNA, 15 bp, Homo sapiens
attatgctttttggt

SEQ ID NO: 392207 - DNA, 15 bp, Homo sapiens
ttatgctttttggtg

SEQ ID NO: 392208 - DNA, 15 bp, Homo sapiens
tatgctttttggtgc

SEQ ID NO: 392209 - DNA, 15 bp, Homo sapiens
atgctttttggtgcc

SEQ ID NO: 392210 - DNA, 15 bp, Homo sapiens
tgctttttggtgcca

SEQ ID NO: 392211 - DNA, 15 bp, Homo sapiens
gctttttggtgccat

SEQ ID NO: 392212 - DNA, 15 bp, Homo sapiens
ctttttggtgccatc

SEQ ID NO: 392213 - DNA, 15 bp, Homo sapiens
tttttggtgccatca

SEQ ID NO: 392214 - DNA, 15 bp, Homo sapiens
ttttggtgccatcag

SEQ ID NO: 392215 - DNA, 15 bp, Homo sapiens
tttggtgccatcagt

SEQ ID NO: 392216 - DNA, 15 bp, Homo sapiens
ttggtgccatcagtt

SEQ ID NO: 392217 - DNA, 15 bp, Homo sapiens
tggtgccatcagttt

SEQ ID NO: 392218 - DNA, 15 bp, Homo sapiens
ggtgccatcagtttt

SEQ ID NO: 392219 - DNA, 15 bp, Homo sapiens
gtgccatcagttttg

SEQ ID NO: 392220 - DNA, 15 bp, Homo sapiens
tgccatcagttttga

SEQ ID NO: 392221 - DNA, 15 bp, Homo sapiens
gccatcagttttgag

SEQ ID NO: 392222 - DNA, 15 bp, Homo sapiens
ccatcagttttgagt

SEQ ID NO: 392223 - DNA, 15 bp, Homo sapiens
catcagttttgagtc

SEQ ID NO: 392224 - DNA, 15 bp, Homo sapiens
atcagttttgagtct

SEQ ID NO: 392225 - DNA, 15 bp, Homo sapiens
tcagttttgagtcta

SEQ ID NO: 392226 - DNA, 15 bp, Homo sapiens
cagttttgagtctaa

SEQ ID NO: 392227 - DNA, 15 bp, Homo sapiens
agttttgagtctaaa

SEQ ID NO: 392228 - DNA, 15 bp, Homo sapiens
gttttgagtctaaac

SEQ ID NO: 392229 - DNA, 15 bp, Homo sapiens
ttttgagtctaaact

SEQ ID NO: 392230 - DNA, 15 bp, Homo sapiens
tttgagtctaaactc

SEQ ID NO: 392231 - DNA, 15 bp, Homo sapiens
ttgagtctaaactca

SEQ ID NO: 392232 - DNA, 15 bp, Homo sapiens
tgagtctaaactcac

SEQ ID NO: 392233 - DNA, 15 bp, Homo sapiens
gagtctaaactcacc

SEQ ID NO: 392234 - DNA, 15 bp, Homo sapiens
agtctaaactcaccc

SEQ ID NO: 392235 - DNA, 15 bp, Homo sapiens
gtctaaactcacccc

SEQ ID NO: 392236 - DNA, 15 bp, Homo sapiens
tctaaactcaccccc

SEQ ID NO: 392237 - DNA, 15 bp, Homo sapiens
ctaaactcacccccc

SEQ ID NO: 392238 - DNA, 15 bp, Homo sapiens
taaactcacccccca

SEQ ID NO: 392239 - DNA, 15 bp, Homo sapiens
aaactcaccccccaa

SEQ ID NO: 392240 - DNA, 15 bp, Homo sapiens
aactcaccccccaaa

SEQ ID NO: 392241 - DNA, 15 bp, Homo sapiens
actcaccccccaaaa

SEQ ID NO: 392242 - DNA, 15 bp, Homo sapiens
ctcaccccccaaaat

SEQ ID NO: 392243 - DNA, 15 bp, Homo sapiens
tcaccccccaaaatc

SEQ ID NO: 392244 - DNA, 15 bp, Homo sapiens
caccccccaaaatcc

SEQ ID NO: 392245 - DNA, 15 bp, Homo sapiens
accccccaaaatccg

SEQ ID NO: 392246 - DNA, 15 bp, Homo sapiens
ccccccaaaatccga

SEQ ID NO: 392247 - DNA, 15 bp, Homo sapiens
cccccaaaatccgaa

SEQ ID NO: 392248 - DNA, 15 bp, Homo sapiens
ccccaaaatccgaat

SEQ ID NO: 392249 - DNA, 15 bp, Homo sapiens
cccaaaatccgaatt

SEQ ID NO: 392250 - DNA, 15 bp, Homo sapiens
ccaaaatccgaattt

SEQ ID NO: 392251 - DNA, 15 bp, Homo sapiens
caaaatccgaattta

SEQ ID NO: 392252 - DNA, 15 bp, Homo sapiens
aaaatccgaatttag

SEQ ID NO: 392253 - DNA, 15 bp, Homo sapiens
aaatccgaatttagt

SEQ ID NO: 392254 - DNA, 15 bp, Homo sapiens
aatccgaatttagta

SEQ ID NO: 392255 - DNA, 15 bp, Homo sapiens
atccgaatttagtat

SEQ ID NO: 392256 - DNA, 15 bp, Homo sapiens
tccgaatttagtatt

SEQ ID NO: 392257 - DNA, 15 bp, Homo sapiens
ccgaatttagtattc

SEQ ID NO: 392258 - DNA, 15 bp, Homo sapiens
cgaatttagtattct

SEQ ID NO: 392259 - DNA, 15 bp, Homo sapiens
gaatttagtattctt

SEQ ID NO: 392260 - DNA, 15 bp, Homo sapiens
aatttagtattcttg

SEQ ID NO: 392261 - DNA, 15 bp, Homo sapiens
atttagtattcttgg

SEQ ID NO: 392262 - DNA, 15 bp, Homo sapiens
tttagtattcttggt

SEQ ID NO: 392263 - DNA, 15 bp, Homo sapiens
ttagtattcttggta

SEQ ID NO: 392264 - DNA, 15 bp, Homo sapiens
tagtattcttggtat

SEQ ID NO: 392265 - DNA, 15 bp, Homo sapiens
agtattcttggtata

SEQ ID NO: 392266 - DNA, 15 bp, Homo sapiens
gtattcttggtataa

SEQ ID NO: 392267 - DNA, 15 bp, Homo sapiens
tattcttggtataaa

SEQ ID NO: 392268 - DNA, 15 bp, Homo sapiens
attcttggtataaat

SEQ ID NO: 392269 - DNA, 15 bp, Homo sapiens
ttcttggtataaatc

SEQ ID NO: 392270 - DNA, 15 bp, Homo sapiens
tcttggtataaatct

SEQ ID NO: 392271 - DNA, 15 bp, Homo sapiens
cttggtataaatcta

SEQ ID NO: 392272 - DNA, 15 bp, Homo sapiens
ttggtataaatctag

SEQ ID NO: 392273 - DNA, 15 bp, Homo sapiens
tggtataaatctagt

SEQ ID NO: 392274 - DNA, 15 bp, Homo sapiens
ggtataaatctagta

SEQ ID NO: 392275 - DNA, 15 bp, Homo sapiens
gtataaatctagtat

SEQ ID NO: 392276 - DNA, 15 bp, Homo sapiens
tataaatctagtatt

SEQ ID NO: 392277 - DNA, 15 bp, Homo sapiens
ataaatctagtatta

SEQ ID NO: 392278 - DNA, 15 bp, Homo sapiens
taaatctagtattaa

SEQ ID NO: 392279 - DNA, 15 bp, Homo sapiens
aaatctagtattaat

SEQ ID NO: 392280 - DNA, 15 bp, Homo sapiens
aatctagtattaatt

SEQ ID NO: 392281 - DNA, 15 bp, Homo sapiens
atctagtattaatta

SEQ ID NO: 392282 - DNA, 15 bp, Homo sapiens
tctagtattaattat

SEQ ID NO: 392283 - DNA, 15 bp, Homo sapiens
ctagtattaattata

SEQ ID NO: 392284 - DNA, 15 bp, Homo sapiens
tagtattaattatag

SEQ ID NO: 392285 - DNA, 15 bp, Homo sapiens
agtattaattatagc

SEQ ID NO: 392286 - DNA, 15 bp, Homo sapiens
gtattaattatagcc

SEQ ID NO: 392287 - DNA, 15 bp, Homo sapiens
tattaattatagccg

SEQ ID NO: 392288 - DNA, 15 bp, Homo sapiens
attaattatagccgg

SEQ ID NO: 392289 - DNA, 15 bp, Homo sapiens
ttaattatagccgga

SEQ ID NO: 392290 - DNA, 15 bp, Homo sapiens
taattatagccggaa

SEQ ID NO: 392291 - DNA, 15 bp, Homo sapiens
aattatagccggaaa

SEQ ID NO: 392292 - DNA, 15 bp, Homo sapiens
attatagccggaaaa

SEQ ID NO: 392293 - DNA, 15 bp, Homo sapiens
ttatagccggaaaaa

SEQ ID NO: 392294 - DNA, 15 bp, Homo sapiens
tatagccggaaaaaa

SEQ ID NO: 392295 - DNA, 15 bp, Homo sapiens
atagccggaaaaaaa

SEQ ID NO: 392296 - DNA, 15 bp, Homo sapiens
tagccggaaaaaaaa

SEQ ID NO: 392297 - DNA, 15 bp, Homo sapiens
agccggaaaaaaaaa

SEQ ID NO: 392298 - DNA, 15 bp, Homo sapiens
gccggaaaaaaaaag

SEQ ID NO: 392299 - DNA, 15 bp, Homo sapiens
ccggaaaaaaaaagt

SEQ ID NO: 392300 - DNA, 15 bp, Homo sapiens
cggaaaaaaaaagtt

SEQ ID NO: 392301 - DNA, 15 bp, Homo sapiens
ggaaaaaaaaagttc

SEQ ID NO: 392302 - DNA, 15 bp, Homo sapiens
gaaaaaaaaagttct

SEQ ID NO: 392303 - DNA, 15 bp, Homo sapiens
aaaaaaaaagttctt

SEQ ID NO: 392304 - DNA, 15 bp, Homo sapiens
aaaaaaaagttcttg

SEQ ID NO: 392305 - DNA, 15 bp, Homo sapiens
aaaaaaagttcttga

SEQ ID NO: 392306 - DNA, 15 bp, Homo sapiens
aaaaaagttcttgat

SEQ ID NO: 392307 - DNA, 15 bp, Homo sapiens
aaaaagttcttgatt

SEQ ID NO: 392308 - DNA, 15 bp, Homo sapiens
aaaagttcttgattc

SEQ ID NO: 392309 - DNA, 15 bp, Homo sapiens
aaagttcttgattct

SEQ ID NO: 392310 - DNA, 15 bp, Homo sapiens
aagttcttgattctt

SEQ ID NO: 392311 - DNA, 15 bp, Homo sapiens
agttcttgattcttg

SEQ ID NO: 392312 - DNA, 15 bp, Homo sapiens
gttcttgattcttgg

SEQ ID NO: 392313 - DNA, 15 bp, Homo sapiens
ttcttgattcttggc

SEQ ID NO: 392314 - DNA, 15 bp, Homo sapiens
tcttgattcttggct

SEQ ID NO: 392315 - DNA, 15 bp, Homo sapiens
cttgattcttggctc

SEQ ID NO: 392316 - DNA, 15 bp, Homo sapiens
ttgattcttggctca

SEQ ID NO: 392317 - DNA, 15 bp, Homo sapiens
tgattcttggctcaa

SEQ ID NO: 392318 - DNA, 15 bp, Homo sapiens
gattcttggctcaaa

SEQ ID NO: 392319 - DNA, 15 bp, Homo sapiens
attcttggctcaaaa

SEQ ID NO: 392320 - DNA, 15 bp, Homo sapiens
ttcttggctcaaaaa

SEQ ID NO: 392321 - DNA, 15 bp, Homo sapiens
tcttggctcaaaaat

SEQ ID NO: 392322 - DNA, 15 bp, Homo sapiens
cttggctcaaaaatt

SEQ ID NO: 392323 - DNA, 15 bp, Homo sapiens
ttggctcaaaaattt

SEQ ID NO: 392324 - DNA, 15 bp, Homo sapiens
tggctcaaaaatttt

SEQ ID NO: 392325 - DNA, 15 bp, Homo sapiens
ggctcaaaaatttta

SEQ ID NO: 392326 - DNA, 15 bp, Homo sapiens
gctcaaaaattttat

SEQ ID NO: 392327 - DNA, 15 bp, Homo sapiens
ctcaaaaattttata

SEQ ID NO: 392328 - DNA, 15 bp, Homo sapiens
tcaaaaattttataa

SEQ ID NO: 392329 - DNA, 15 bp, Homo sapiens
caaaaattttataaa

SEQ ID NO: 392330 - DNA, 15 bp, Homo sapiens
aaaaattttataaaa

SEQ ID NO: 392331 - DNA, 15 bp, Homo sapiens
aaaattttataaaat

SEQ ID NO: 392332 - DNA, 15 bp, Homo sapiens
aaattttataaaatg

SEQ ID NO: 392333 - DNA, 15 bp, Homo sapiens
aattttataaaatga

SEQ ID NO: 392334 - DNA, 15 bp, Homo sapiens
attttataaaatgaa

SEQ ID NO: 392335 - DNA, 15 bp, Homo sapiens
ttttataaaatgaag

SEQ ID NO: 392336 - DNA, 15 bp, Homo sapiens
tttataaaatgaaga

SEQ ID NO: 392337 - DNA, 15 bp, Homo sapiens
ttataaaatgaagaa

SEQ ID NO: 392338 - DNA, 15 bp, Homo sapiens
tataaaatgaagaat

SEQ ID NO: 392339 - DNA, 15 bp, Homo sapiens
ataaaatgaagaatt

SEQ ID NO: 392340 - DNA, 15 bp, Homo sapiens
taaaatgaagaattt

SEQ ID NO: 392341 - DNA, 15 bp, Homo sapiens
aaaatgaagaatttt

SEQ ID NO: 392342 - DNA, 15 bp, Homo sapiens
aaatgaagaattttc

SEQ ID NO: 392343 - DNA, 15 bp, Homo sapiens
aatgaagaattttcc

SEQ ID NO: 392344 - DNA, 15 bp, Homo sapiens
atgaagaattttcct

SEQ ID NO: 392345 - DNA, 15 bp, Homo sapiens
tgaagaattttcctt

SEQ ID NO: 392346 - DNA, 15 bp, Homo sapiens
gaagaattttccttt

SEQ ID NO: 392347 - DNA, 15 bp, Homo sapiens
aagaattttcctttt

SEQ ID NO: 392348 - DNA, 15 bp, Homo sapiens
agaattttccttttt

SEQ ID NO: 392349 - DNA, 15 bp, Homo sapiens
gaattttcctttttc

SEQ ID NO: 392350 - DNA, 15 bp, Homo sapiens
aattttcctttttct

SEQ ID NO: 392351 - DNA, 15 bp, Homo sapiens
attttcctttttctt

SEQ ID NO: 392352 - DNA, 15 bp, Homo sapiens
ttttcctttttcttc

SEQ ID NO: 392353 - DNA, 15 bp, Homo sapiens
tttcctttttcttca

SEQ ID NO: 392354 - DNA, 15 bp, Homo sapiens
ttcctttttcttcag

SEQ ID NO: 392355 - DNA, 15 bp, Homo sapiens
tcctttttcttcagg

SEQ ID NO: 392356 - DNA, 15 bp, Homo sapiens
cctttttcttcaggg

SEQ ID NO: 392357 - DNA, 15 bp, Homo sapiens
ctttttcttcagggt

SEQ ID NO: 392358 - DNA, 15 bp, Homo sapiens
tttttcttcagggta

SEQ ID NO: 392359 - DNA, 15 bp, Homo sapiens
ttttcttcagggtaa

SEQ ID NO: 392360 - DNA, 15 bp, Homo sapiens
tttcttcagggtaaa

SEQ ID NO: 392361 - DNA, 15 bp, Homo sapiens
ttcttcagggtaaat

SEQ ID NO: 392362 - DNA, 15 bp, Homo sapiens
tcttcagggtaaatg

SEQ ID NO: 392363 - DNA, 15 bp, Homo sapiens
cttcagggtaaatgt

SEQ ID NO: 392364 - DNA, 15 bp, Homo sapiens
ttcagggtaaatgtt

SEQ ID NO: 392365 - DNA, 15 bp, Homo sapiens
tcagggtaaatgttg

SEQ ID NO: 392366 - DNA, 15 bp, Homo sapiens
cagggtaaatgttgc

SEQ ID NO: 392367 - DNA, 15 bp, Homo sapiens
agggtaaatgttgca

SEQ ID NO: 392368 - DNA, 15 bp, Homo sapiens
gggtaaatgttgcaa

SEQ ID NO: 392369 - DNA, 15 bp, Homo sapiens
ggtaaatgttgcaag

SEQ ID NO: 392370 - DNA, 15 bp, Homo sapiens
gtaaatgttgcaaga

SEQ ID NO: 392371 - DNA, 15 bp, Homo sapiens
taaatgttgcaagag

SEQ ID NO: 392372 - DNA, 15 bp, Homo sapiens
aaatgttgcaagagt

SEQ ID NO: 392373 - DNA, 15 bp, Homo sapiens
aatgttgcaagagtt

SEQ ID NO: 392374 - DNA, 15 bp, Homo sapiens
atgttgcaagagtta

SEQ ID NO: 392375 - DNA, 15 bp, Homo sapiens
tgttgcaagagttaa

SEQ ID NO: 392376 - DNA, 15 bp, Homo sapiens
gttgcaagagttaaa

SEQ ID NO: 392377 - DNA, 15 bp, Homo sapiens
ttgcaagagttaaag

SEQ ID NO: 392378 - DNA, 15 bp, Homo sapiens
tgcaagagttaaaga

SEQ ID NO: 392379 - DNA, 15 bp, Homo sapiens
gcaagagttaaagag

SEQ ID NO: 392380 - DNA, 15 bp, Homo sapiens
caagagttaaagagg

SEQ ID NO: 392381 - DNA, 15 bp, Homo sapiens
aagagttaaagaggt

SEQ ID NO: 392382 - DNA, 15 bp, Homo sapiens
agagttaaagaggta

SEQ ID NO: 392383 - DNA, 15 bp, Homo sapiens
gagttaaagaggtag

SEQ ID NO: 392384 - DNA, 15 bp, Homo sapiens
agttaaagaggtaga

SEQ ID NO: 392385 - DNA, 15 bp, Homo sapiens
gttaaagaggtagag

SEQ ID NO: 392386 - DNA, 15 bp, Homo sapiens
ttaaagaggtagaga

SEQ ID NO: 392387 - DNA, 15 bp, Homo sapiens
taaagaggtagagaa

SEQ ID NO: 392388 - DNA, 15 bp, Homo sapiens
aaagaggtagagaaa

SEQ ID NO: 392389 - DNA, 15 bp, Homo sapiens
aagaggtagagaaaa

SEQ ID NO: 392390 - DNA, 15 bp, Homo sapiens
agaggtagagaaaag

SEQ ID NO: 392391 - DNA, 15 bp, Homo sapiens
gaggtagagaaaagg

SEQ ID NO: 392392 - DNA, 15 bp, Homo sapiens
aggtagagaaaaggg

SEQ ID NO: 392393 - DNA, 15 bp, Homo sapiens
ggtagagaaaagggg

SEQ ID NO: 392394 - DNA, 15 bp, Homo sapiens
gtagagaaaaggggg

SEQ ID NO: 392395 - DNA, 15 bp, Homo sapiens
tagagaaaaggggga

SEQ ID NO: 392396 - DNA, 15 bp, Homo sapiens
agagaaaagggggaa

SEQ ID NO: 392397 - DNA, 15 bp, Homo sapiens
gagaaaagggggaac

SEQ ID NO: 392398 - DNA, 15 bp, Homo sapiens
agaaaagggggaact

SEQ ID NO: 392399 - DNA, 15 bp, Homo sapiens
gaaaagggggaactt

SEQ ID NO: 392400 - DNA, 15 bp, Homo sapiens
aaaagggggaacttt

SEQ ID NO: 392401 - DNA, 15 bp, Homo sapiens
aaagggggaactttt

SEQ ID NO: 392402 - DNA, 15 bp, Homo sapiens
aagggggaacttttt

SEQ ID NO: 392403 - DNA, 15 bp, Homo sapiens
agggggaactttttt

SEQ ID NO: 392404 - DNA, 15 bp, Homo sapiens
gggggaactttttta

SEQ ID NO: 392405 - DNA, 15 bp, Homo sapiens
ggggaacttttttag

SEQ ID NO: 392406 - DNA, 15 bp, Homo sapiens
gggaacttttttagt

SEQ ID NO: 392407 - DNA, 15 bp, Homo sapiens
ggaacttttttagtt

SEQ ID NO: 392408 - DNA, 15 bp, Homo sapiens
gaacttttttagttg

SEQ ID NO: 392409 - DNA, 15 bp, Homo sapiens
aacttttttagttga

SEQ ID NO: 392410 - DNA, 15 bp, Homo sapiens
acttttttagttgaa

SEQ ID NO: 392411 - DNA, 15 bp, Homo sapiens
cttttttagttgaaa

SEQ ID NO: 392412 - DNA, 15 bp, Homo sapiens
ttttttagttgaaaa

SEQ ID NO: 392413 - DNA, 15 bp, Homo sapiens
tttttagttgaaaac

SEQ ID NO: 392414 - DNA, 15 bp, Homo sapiens
ttttagttgaaaaca

SEQ ID NO: 392415 - DNA, 15 bp, Homo sapiens
tttagttgaaaacat

SEQ ID NO: 392416 - DNA, 15 bp, Homo sapiens
ttagttgaaaacatt

SEQ ID NO: 392417 - DNA, 15 bp, Homo sapiens
tagttgaaaacatta

SEQ ID NO: 392418 - DNA, 15 bp, Homo sapiens
agttgaaaacattat

SEQ ID NO: 392419 - DNA, 15 bp, Homo sapiens
gttgaaaacattatc

SEQ ID NO: 392420 - DNA, 15 bp, Homo sapiens
ttgaaaacattatct

SEQ ID NO: 392421 - DNA, 15 bp, Homo sapiens
tgaaaacattatctg

SEQ ID NO: 392422 - DNA, 15 bp, Homo sapiens
gaaaacattatctga

SEQ ID NO: 392423 - DNA, 15 bp, Homo sapiens
aaaacattatctgat

SEQ ID NO: 392424 - DNA, 15 bp, Homo sapiens
aaacattatctgatt

SEQ ID NO: 392425 - DNA, 15 bp, Homo sapiens
aacattatctgattg

SEQ ID NO: 392426 - DNA, 15 bp, Homo sapiens
acattatctgattgt

SEQ ID NO: 392427 - DNA, 15 bp, Homo sapiens
cattatctgattgtg

SEQ ID NO: 392428 - DNA, 15 bp, Homo sapiens
attatctgattgtgt

SEQ ID NO: 392429 - DNA, 15 bp, Homo sapiens
ttatctgattgtgta

SEQ ID NO: 392430 - DNA, 15 bp, Homo sapiens
tatctgattgtgtat

SEQ ID NO: 392431 - DNA, 15 bp, Homo sapiens
atctgattgtgtatt

SEQ ID NO: 392432 - DNA, 15 bp, Homo sapiens
tctgattgtgtattt

SEQ ID NO: 392433 - DNA, 15 bp, Homo sapiens
ctgattgtgtattta

SEQ ID NO: 392434 - DNA, 15 bp, Homo sapiens
tgattgtgtatttac

SEQ ID NO: 392435 - DNA, 15 bp, Homo sapiens
gattgtgtatttact

SEQ ID NO: 392436 - DNA, 15 bp, Homo sapiens
attgtgtatttactc

SEQ ID NO: 392437 - DNA, 15 bp, Homo sapiens
ttgtgtatttactct

SEQ ID NO: 392438 - DNA, 15 bp, Homo sapiens
tgtgtatttactctg

SEQ ID NO: 392439 - DNA, 15 bp, Homo sapiens
gtgtatttactctgg

SEQ ID NO: 392440 - DNA, 15 bp, Homo sapiens
tgtatttactctggg

SEQ ID NO: 392441 - DNA, 15 bp, Homo sapiens
gtatttactctgggt

SEQ ID NO: 392442 - DNA, 15 bp, Homo sapiens
tatttactctgggtt

SEQ ID NO: 392443 - DNA, 15 bp, Homo sapiens
atttactctgggttc

SEQ ID NO: 392444 - DNA, 15 bp, Homo sapiens
tttactctgggttca

SEQ ID NO: 392445 - DNA, 15 bp, Homo sapiens
ttactctgggttcag

SEQ ID NO: 392446 - DNA, 15 bp, Homo sapiens
tactctgggttcaga

SEQ ID NO: 392447 - DNA, 15 bp, Homo sapiens
actctgggttcagaa

SEQ ID NO: 392448 - DNA, 15 bp, Homo sapiens
ctctgggttcagaat

SEQ ID NO: 392449 - DNA, 15 bp, Homo sapiens
tctgggttcagaatt

SEQ ID NO: 392450 - DNA, 15 bp, Homo sapiens
ctgggttcagaattt

SEQ ID NO: 392451 - DNA, 15 bp, Homo sapiens
tgggttcagaatttt

SEQ ID NO: 392452 - DNA, 15 bp, Homo sapiens
gggttcagaatttta

SEQ ID NO: 392453 - DNA, 15 bp, Homo sapiens
ggttcagaattttaa

SEQ ID NO: 392454 - DNA, 15 bp, Homo sapiens
gttcagaattttaaa

SEQ ID NO: 392455 - DNA, 15 bp, Homo sapiens
tcagaattttaaaag

SEQ ID NO: 392456 - DNA, 15 bp, Homo sapiens
cagaattttaaaagt

SEQ ID NO: 392457 - DNA, 15 bp, Homo sapiens
agaattttaaaagtc

SEQ ID NO: 392458 - DNA, 15 bp, Homo sapiens
gaattttaaaagtct

SEQ ID NO: 392459 - DNA, 15 bp, Homo sapiens
aattttaaaagtcta

SEQ ID NO: 392460 - DNA, 15 bp, Homo sapiens
attttaaaagtctag

SEQ ID NO: 392461 - DNA, 15 bp, Homo sapiens
ttttaaaagtctaga

SEQ ID NO: 392462 - DNA, 15 bp, Homo sapiens
tttaaaagtctagag

SEQ ID NO: 392463 - DNA, 15 bp, Homo sapiens
ttaaaagtctagagt

SEQ ID NO: 392464 - DNA, 15 bp, Homo sapiens
taaaagtctagagtg

SEQ ID NO: 392465 - DNA, 15 bp, Homo sapiens
aaaagtctagagtgt

SEQ ID NO: 392466 - DNA, 15 bp, Homo sapiens
aaagtctagagtgta

SEQ ID NO: 392467 - DNA, 15 bp, Homo sapiens
aagtctagagtgtag

SEQ ID NO: 392468 - DNA, 15 bp, Homo sapiens
agtctagagtgtagc

SEQ ID NO: 392469 - DNA, 15 bp, Homo sapiens
gtctagagtgtagct

SEQ ID NO: 392470 - DNA, 15 bp, Homo sapiens
tctagagtgtagctg

SEQ ID NO: 392471 - DNA, 15 bp, Homo sapiens
ctagagtgtagctgc

SEQ ID NO: 392472 - DNA, 15 bp, Homo sapiens
tagagtgtagctgca

SEQ ID NO: 392473 - DNA, 15 bp, Homo sapiens
agagtgtagctgcac

SEQ ID NO: 392474 - DNA, 15 bp, Homo sapiens
gagtgtagctgcacc

SEQ ID NO: 392475 - DNA, 15 bp, Homo sapiens
agtgtagctgcacct

SEQ ID NO: 392476 - DNA, 15 bp, Homo sapiens
gtgtagctgcaccta

SEQ ID NO: 392477 - DNA, 15 bp, Homo sapiens
tgtagctgcacctac

SEQ ID NO: 392478 - DNA, 15 bp, Homo sapiens
gtagctgcacctacc

SEQ ID NO: 392479 - DNA, 15 bp, Homo sapiens
tagctgcacctaccc

SEQ ID NO: 392480 - DNA, 15 bp, Homo sapiens
agctgcacctaccct

SEQ ID NO: 392481 - DNA, 15 bp, Homo sapiens
gctgcacctaccctg

SEQ ID NO: 392482 - DNA, 15 bp, Homo sapiens
ctgcacctaccctgg

SEQ ID NO: 392483 - DNA, 15 bp, Homo sapiens
tgcacctaccctggc

SEQ ID NO: 392484 - DNA, 15 bp, Homo sapiens
gcacctaccctggca

SEQ ID NO: 392485 - DNA, 15 bp, Homo sapiens
cacctaccctggcat

SEQ ID NO: 392486 - DNA, 15 bp, Homo sapiens
acctaccctggcatc

SEQ ID NO: 392487 - DNA, 15 bp, Homo sapiens
cctaccctggcatcc

SEQ ID NO: 392488 - DNA, 15 bp, Homo sapiens
ctaccctggcatcct

SEQ ID NO: 392489 - DNA, 15 bp, Homo sapiens
taccctggcatcctg

SEQ ID NO: 392490 - DNA, 15 bp, Homo sapiens
accctggcatcctgc

SEQ ID NO: 392491 - DNA, 15 bp, Homo sapiens
ccctggcatcctgca

SEQ ID NO: 392492 - DNA, 15 bp, Homo sapiens
cctggcatcctgcag

SEQ ID NO: 392493 - DNA, 15 bp, Homo sapiens
ctggcatcctgcagg

SEQ ID NO: 392494 - DNA, 15 bp, Homo sapiens
tggcatcctgcaggc

SEQ ID NO: 392495 - DNA, 15 bp, Homo sapiens
ggcatcctgcaggct

SEQ ID NO: 392496 - DNA, 15 bp, Homo sapiens
gcatcctgcaggcta

SEQ ID NO: 392497 - DNA, 15 bp, Homo sapiens
catcctgcaggctag

SEQ ID NO: 392498 - DNA, 15 bp, Homo sapiens
atcctgcaggctagg

SEQ ID NO: 392499 - DNA, 15 bp, Homo sapiens
tcctgcaggctaggg

SEQ ID NO: 392500 - DNA, 15 bp, Homo sapiens
cctgcaggctagggt

SEQ ID NO: 392501 - DNA, 15 bp, Homo sapiens
ctgcaggctagggtg

SEQ ID NO: 392502 - DNA, 15 bp, Homo sapiens
tgcaggctagggtgg

SEQ ID NO: 392503 - DNA, 15 bp, Homo sapiens
gcaggctagggtggt

SEQ ID NO: 392504 - DNA, 15 bp, Homo sapiens
caggctagggtggtt

SEQ ID NO: 392505 - DNA, 15 bp, Homo sapiens
aggctagggtggttg

SEQ ID NO: 392506 - DNA, 15 bp, Homo sapiens
ggctagggtggttgt

SEQ ID NO: 392507 - DNA, 15 bp, Homo sapiens
gctagggtggttgta

SEQ ID NO: 392508 - DNA, 15 bp, Homo sapiens
ctagggtggttgtaa

SEQ ID NO: 392509 - DNA, 15 bp, Homo sapiens
tagggtggttgtaat

SEQ ID NO: 392510 - DNA, 15 bp, Homo sapiens
agggtggttgtaata

SEQ ID NO: 392511 - DNA, 15 bp, Homo sapiens
gggtggttgtaatat

SEQ ID NO: 392512 - DNA, 15 bp, Homo sapiens
ggtggttgtaatata

SEQ ID NO: 392513 - DNA, 15 bp, Homo sapiens
gtggttgtaatatag

SEQ ID NO: 392514 - DNA, 15 bp, Homo sapiens
tggttgtaatataga

SEQ ID NO: 392515 - DNA, 15 bp, Homo sapiens
ggttgtaatatagaa

SEQ ID NO: 392516 - DNA, 15 bp, Homo sapiens
gttgtaatatagaag

SEQ ID NO: 392517 - DNA, 15 bp, Homo sapiens
ttgtaatatagaagt

SEQ ID NO: 392518 - DNA, 15 bp, Homo sapiens
tgtaatatagaagta

SEQ ID NO: 392519 - DNA, 15 bp, Homo sapiens
gtaatatagaagtac

SEQ ID NO: 392520 - DNA, 15 bp, Homo sapiens
taatatagaagtacg

SEQ ID NO: 392521 - DNA, 15 bp, Homo sapiens
aatatagaagtacgg

SEQ ID NO: 392522 - DNA, 15 bp, Homo sapiens
atatagaagtacggg

SEQ ID NO: 392523 - DNA, 15 bp, Homo sapiens
tatagaagtacggga

SEQ ID NO: 392524 - DNA, 15 bp, Homo sapiens
atagaagtacgggaa

SEQ ID NO: 392525 - DNA, 15 bp, Homo sapiens
tagaagtacgggaaa

SEQ ID NO: 392526 - DNA, 15 bp, Homo sapiens
agaagtacgggaaat

SEQ ID NO: 392527 - DNA, 15 bp, Homo sapiens
gaagtacgggaaatg

SEQ ID NO: 392528 - DNA, 15 bp, Homo sapiens
aagtacgggaaatgc

SEQ ID NO: 392529 - DNA, 15 bp, Homo sapiens
agtacgggaaatgca

SEQ ID NO: 392530 - DNA, 15 bp, Homo sapiens
gtacgggaaatgcaa

SEQ ID NO: 392531 - DNA, 15 bp, Homo sapiens
tacgggaaatgcaat

SEQ ID NO: 392532 - DNA, 15 bp, Homo sapiens
acgggaaatgcaatt

SEQ ID NO: 392533 - DNA, 15 bp, Homo sapiens
cgggaaatgcaattt

SEQ ID NO: 392534 - DNA, 15 bp, Homo sapiens
gggaaatgcaatttg

SEQ ID NO: 392535 - DNA, 15 bp, Homo sapiens
ggaaatgcaatttgc

SEQ ID NO: 392536 - DNA, 15 bp, Homo sapiens
gaaatgcaatttgct

SEQ ID NO: 392537 - DNA, 15 bp, Homo sapiens
aaatgcaatttgctc

SEQ ID NO: 392538 - DNA, 15 bp, Homo sapiens
aatgcaatttgctct

SEQ ID NO: 392539 - DNA, 15 bp, Homo sapiens
atgcaatttgctctg

SEQ ID NO: 392540 - DNA, 15 bp, Homo sapiens
tgcaatttgctctgt

SEQ ID NO: 392541 - DNA, 15 bp, Homo sapiens
gcaatttgctctgta

SEQ ID NO: 392542 - DNA, 15 bp, Homo sapiens
caatttgctctgtag

SEQ ID NO: 392543 - DNA, 15 bp, Homo sapiens
aatttgctctgtagc

SEQ ID NO: 392544 - DNA, 15 bp, Homo sapiens
atttgctctgtagct

SEQ ID NO: 392545 - DNA, 15 bp, Homo sapiens
tttgctctgtagctt

SEQ ID NO: 392546 - DNA, 15 bp, Homo sapiens
ttgctctgtagcttt

SEQ ID NO: 392547 - DNA, 15 bp, Homo sapiens
tgctctgtagcttta

SEQ ID NO: 392548 - DNA, 15 bp, Homo sapiens
gctctgtagctttat

SEQ ID NO: 392549 - DNA, 15 bp, Homo sapiens
ctctgtagctttatt

SEQ ID NO: 392550 - DNA, 15 bp, Homo sapiens
tctgtagctttattc

SEQ ID NO: 392551 - DNA, 15 bp, Homo sapiens
ctgtagctttattct

SEQ ID NO: 392552 - DNA, 15 bp, Homo sapiens
tgtagctttattcta

SEQ ID NO: 392553 - DNA, 15 bp, Homo sapiens
gtagctttattctag

SEQ ID NO: 392554 - DNA, 15 bp, Homo sapiens
tagctttattctagg

SEQ ID NO: 392555 - DNA, 15 bp, Homo sapiens
agctttattctagga

SEQ ID NO: 392556 - DNA, 15 bp, Homo sapiens
gctttattctaggat

SEQ ID NO: 392557 - DNA, 15 bp, Homo sapiens
ctttattctaggatt

SEQ ID NO: 392558 - DNA, 15 bp, Homo sapiens
tttattctaggattt

SEQ ID NO: 392559 - DNA, 15 bp, Homo sapiens
ttattctaggatttt

SEQ ID NO: 392560 - DNA, 15 bp, Homo sapiens
tattctaggatttta

SEQ ID NO: 392561 - DNA, 15 bp, Homo sapiens
attctaggattttat

SEQ ID NO: 392562 - DNA, 15 bp, Homo sapiens
ttctaggattttata

SEQ ID NO: 392563 - DNA, 15 bp, Homo sapiens
tctaggattttatag

SEQ ID NO: 392564 - DNA, 15 bp, Homo sapiens
ctaggattttatagc

SEQ ID NO: 392565 - DNA, 15 bp, Homo sapiens
taggattttatagcc

SEQ ID NO: 392566 - DNA, 15 bp, Homo sapiens
aggattttatagcct

SEQ ID NO: 392567 - DNA, 15 bp, Homo sapiens
ggattttatagcctt

SEQ ID NO: 392568 - DNA, 15 bp, Homo sapiens
gattttatagccttc

SEQ ID NO: 392569 - DNA, 15 bp, Homo sapiens
attttatagccttcc

SEQ ID NO: 392570 - DNA, 15 bp, Homo sapiens
ttttatagccttcct

SEQ ID NO: 392571 - DNA, 15 bp, Homo sapiens
tttatagccttcctt

SEQ ID NO: 392572 - DNA, 15 bp, Homo sapiens
ttatagccttccttt

SEQ ID NO: 392573 - DNA, 15 bp, Homo sapiens
tatagccttcctttt

SEQ ID NO: 392574 - DNA, 15 bp, Homo sapiens
atagccttcctttta

SEQ ID NO: 392575 - DNA, 15 bp, Homo sapiens
tagccttccttttac

SEQ ID NO: 392576 - DNA, 15 bp, Homo sapiens
agccttccttttaca

SEQ ID NO: 392577 - DNA, 15 bp, Homo sapiens
gccttccttttacac

SEQ ID NO: 392578 - DNA, 15 bp, Homo sapiens
ccttccttttacact

SEQ ID NO: 392579 - DNA, 15 bp, Homo sapiens
cttccttttacactt

SEQ ID NO: 392580 - DNA, 15 bp, Homo sapiens
ttccttttacacttt

SEQ ID NO: 392581 - DNA, 15 bp, Homo sapiens
tccttttacacttta

SEQ ID NO: 392582 - DNA, 15 bp, Homo sapiens
ccttttacactttac

SEQ ID NO: 392583 - DNA, 15 bp, Homo sapiens
cttttacactttaca

SEQ ID NO: 392584 - DNA, 15 bp, Homo sapiens
ttttacactttacac

SEQ ID NO: 392585 - DNA, 15 bp, Homo sapiens
tttacactttacaca

SEQ ID NO: 392586 - DNA, 15 bp, Homo sapiens
ttacactttacacat

SEQ ID NO: 392587 - DNA, 15 bp, Homo sapiens
tacactttacacatc

SEQ ID NO: 392588 - DNA, 15 bp, Homo sapiens
acactttacacatcg

SEQ ID NO: 392589 - DNA, 15 bp, Homo sapiens
cactttacacatcgt

SEQ ID NO: 392590 - DNA, 15 bp, Homo sapiens
actttacacatcgtg

SEQ ID NO: 392591 - DNA, 15 bp, Homo sapiens
ctttacacatcgtga

SEQ ID NO: 392592 - DNA, 15 bp, Homo sapiens
tttacacatcgtgaa

SEQ ID NO: 392593 - DNA, 15 bp, Homo sapiens
ttacacatcgtgaat

SEQ ID NO: 392594 - DNA, 15 bp, Homo sapiens
tacacatcgtgaatg

SEQ ID NO: 392595 - DNA, 15 bp, Homo sapiens
acacatcgtgaatgc

SEQ ID NO: 392596 - DNA, 15 bp, Homo sapiens
cacatcgtgaatgct

SEQ ID NO: 392597 - DNA, 15 bp, Homo sapiens
acatcgtgaatgctt

SEQ ID NO: 392598 - DNA, 15 bp, Homo sapiens
catcgtgaatgcttt

SEQ ID NO: 392599 - DNA, 15 bp, Homo sapiens
atcgtgaatgctttg

SEQ ID NO: 392600 - DNA, 15 bp, Homo sapiens
tcgtgaatgctttgt

SEQ ID NO: 392601 - DNA, 15 bp, Homo sapiens
cgtgaatgctttgta

SEQ ID NO: 392602 - DNA, 15 bp, Homo sapiens
gtgaatgctttgtag

SEQ ID NO: 392603 - DNA, 15 bp, Homo sapiens
tgaatgctttgtagg

SEQ ID NO: 392604 - DNA, 15 bp, Homo sapiens
gaatgctttgtaggt

SEQ ID NO: 392605 - DNA, 15 bp, Homo sapiens
aatgctttgtaggtc

SEQ ID NO: 392606 - DNA, 15 bp, Homo sapiens
atgctttgtaggtca

SEQ ID NO: 392607 - DNA, 15 bp, Homo sapiens
tgctttgtaggtcat

SEQ ID NO: 392608 - DNA, 15 bp, Homo sapiens
gctttgtaggtcatg

SEQ ID NO: 392609 - DNA, 15 bp, Homo sapiens
ctttgtaggtcatga

SEQ ID NO: 392610 - DNA, 15 bp, Homo sapiens
tttgtaggtcatgaa

SEQ ID NO: 392611 - DNA, 15 bp, Homo sapiens
ttgtaggtcatgaat

SEQ ID NO: 392612 - DNA, 15 bp, Homo sapiens
tgtaggtcatgaatg

SEQ ID NO: 392613 - DNA, 15 bp, Homo sapiens
gtaggtcatgaatgc

SEQ ID NO: 392614 - DNA, 15 bp, Homo sapiens
taggtcatgaatgct

SEQ ID NO: 392615 - DNA, 15 bp, Homo sapiens
aggtcatgaatgctt

SEQ ID NO: 392616 - DNA, 15 bp, Homo sapiens
ggtcatgaatgcttt

SEQ ID NO: 392617 - DNA, 15 bp, Homo sapiens
gtcatgaatgctttt

SEQ ID NO: 392618 - DNA, 15 bp, Homo sapiens
tcatgaatgcttttt

SEQ ID NO: 392619 - DNA, 15 bp, Homo sapiens
catgaatgctttttt

SEQ ID NO: 392620 - DNA, 15 bp, Homo sapiens
atgaatgcttttttt

SEQ ID NO: 392621 - DNA, 15 bp, Homo sapiens
tgaatgcttttttta

SEQ ID NO: 392622 - DNA, 15 bp, Homo sapiens
gaatgctttttttat

SEQ ID NO: 392623 - DNA, 15 bp, Homo sapiens
aatgctttttttatg

SEQ ID NO: 392624 - DNA, 15 bp, Homo sapiens
atgctttttttatgt

SEQ ID NO: 392625 - DNA, 15 bp, Homo sapiens
tgctttttttatgtc

SEQ ID NO: 392626 - DNA, 15 bp, Homo sapiens
gctttttttatgtct

SEQ ID NO: 392627 - DNA, 15 bp, Homo sapiens
ctttttttatgtctt

SEQ ID NO: 392628 - DNA, 15 bp, Homo sapiens
tttttttatgtctta

SEQ ID NO: 392629 - DNA, 15 bp, Homo sapiens
ttttttatgtcttat

SEQ ID NO: 392630 - DNA, 15 bp, Homo sapiens
tttttatgtcttata

SEQ ID NO: 392631 - DNA, 15 bp, Homo sapiens
ttttatgtcttatat

SEQ ID NO: 392632 - DNA, 15 bp, Homo sapiens
tttatgtcttatatt

SEQ ID NO: 392633 - DNA, 15 bp, Homo sapiens
ttatgtcttatattg

SEQ ID NO: 392634 - DNA, 15 bp, Homo sapiens
tatgtcttatattgt

SEQ ID NO: 392635 - DNA, 15 bp, Homo sapiens
atgtcttatattgtg

SEQ ID NO: 392636 - DNA, 15 bp, Homo sapiens
tgtcttatattgtga

SEQ ID NO: 392637 - DNA, 15 bp, Homo sapiens
gtcttatattgtgac

SEQ ID NO: 392638 - DNA, 15 bp, Homo sapiens
tcttatattgtgact

SEQ ID NO: 392639 - DNA, 15 bp, Homo sapiens
cttatattgtgactt

SEQ ID NO: 392640 - DNA, 15 bp, Homo sapiens
ttatattgtgacttt

SEQ ID NO: 392641 - DNA, 15 bp, Homo sapiens
tatattgtgactttt

SEQ ID NO: 392642 - DNA, 15 bp, Homo sapiens
atattgtgacttttt

SEQ ID NO: 392643 - DNA, 15 bp, Homo sapiens
tattgtgactttttt

SEQ ID NO: 392644 - DNA, 15 bp, Homo sapiens
attgtgactttttta

SEQ ID NO: 392645 - DNA, 15 bp, Homo sapiens
ttgtgacttttttaa

SEQ ID NO: 392646 - DNA, 15 bp, Homo sapiens
tgtgacttttttaaa

SEQ ID NO: 392647 - DNA, 15 bp, Homo sapiens
gtgacttttttaaaa

SEQ ID NO: 392648 - DNA, 15 bp, Homo sapiens
tgacttttttaaaac

SEQ ID NO: 392649 - DNA, 15 bp, Homo sapiens
gacttttttaaaaca

SEQ ID NO: 392650 - DNA, 15 bp, Homo sapiens
acttttttaaaacaa

SEQ ID NO: 392651 - DNA, 15 bp, Homo sapiens
cttttttaaaacaat

SEQ ID NO: 392652 - DNA, 15 bp, Homo sapiens
ttttttaaaacaatg

SEQ ID NO: 392653 - DNA, 15 bp, Homo sapiens
tttttaaaacaatgt

SEQ ID NO: 392654 - DNA, 15 bp, Homo sapiens
ttaaaacaatgtaaa

SEQ ID NO: 392655 - DNA, 15 bp, Homo sapiens
taaaacaatgtaaat

SEQ ID NO: 392656 - DNA, 15 bp, Homo sapiens
aaaacaatgtaaata

SEQ ID NO: 392657 - DNA, 15 bp, Homo sapiens
aaacaatgtaaataa

SEQ ID NO: 392658 - DNA, 15 bp, Homo sapiens
aacaatgtaaataaa

SEQ ID NO: 392659 - DNA, 15 bp, Homo sapiens
acaatgtaaataaaa

SEQ ID NO: 392660 - DNA, 15 bp, Homo sapiens
caatgtaaataaaat

SEQ ID NO: 392661 - DNA, 15 bp, Homo sapiens
aatgtaaataaaatt

SEQ ID NO: 392662 - DNA, 15 bp, Homo sapiens
atgtaaataaaattc

SEQ ID NO: 392663 - DNA, 15 bp, Homo sapiens
tgtaaataaaattct

SEQ ID NO: 392664 - DNA, 15 bp, Homo sapiens
gtaaataaaattcta

SEQ ID NO: 392665 - DNA, 15 bp, Homo sapiens
taaataaaattctat

SEQ ID NO: 392666 - DNA, 15 bp, Homo sapiens
aaataaaattctatt

SEQ ID NO: 392667 - DNA, 15 bp, Homo sapiens
aataaaattctattg

SEQ ID NO: 392668 - DNA, 15 bp, Homo sapiens
ataaaattctattga

SEQ ID NO: 392669 - DNA, 15 bp, Homo sapiens
taaaattctattgag

SEQ ID NO: 392670 - DNA, 15 bp, Homo sapiens
aaaattctattgagt

SEQ ID NO: 392671 - DNA, 15 bp, Homo sapiens
aaattctattgagtg

SEQ ID NO: 392672 - DNA, 15 bp, Homo sapiens
aattctattgagtgg

SEQ ID NO: 392673 - DNA, 15 bp, Homo sapiens
attctattgagtggc

SEQ ID NO: 392674 - DNA, 15 bp, Homo sapiens
ttctattgagtggct

SEQ ID NO: 392675 - DNA, 15 bp, Homo sapiens
tctattgagtggctg

SEQ ID NO: 392676 - DNA, 15 bp, Homo sapiens
ctattgagtggctgc

SEQ ID NO: 392677 - DNA, 15 bp, Homo sapiens
tattgagtggctgca

SEQ ID NO: 392678 - DNA, 15 bp, Homo sapiens
attgagtggctgcac

SEQ ID NO: 392679 - DNA, 15 bp, Homo sapiens
ttgagtggctgcacc

SEQ ID NO: 392680 - DNA, 15 bp, Homo sapiens
tgagtggctgcacca

SEQ ID NO: 392681 - DNA, 15 bp, Homo sapiens
gagtggctgcaccat

SEQ ID NO: 392682 - DNA, 15 bp, Homo sapiens
agtggctgcaccata

SEQ ID NO: 392683 - DNA, 15 bp, Homo sapiens
gtggctgcaccataa

SEQ ID NO: 392684 - DNA, 15 bp, Homo sapiens
tggctgcaccataat

SEQ ID NO: 392685 - DNA, 15 bp, Homo sapiens
ggctgcaccataatt

SEQ ID NO: 392686 - DNA, 15 bp, Homo sapiens
gctgcaccataattt

SEQ ID NO: 392687 - DNA, 15 bp, Homo sapiens
ctgcaccataattta

SEQ ID NO: 392688 - DNA, 15 bp, Homo sapiens
tgcaccataatttat

SEQ ID NO: 392689 - DNA, 15 bp, Homo sapiens
gcaccataatttatt

SEQ ID NO: 392690 - DNA, 15 bp, Homo sapiens
caccataatttattc

SEQ ID NO: 392691 - DNA, 15 bp, Homo sapiens
accataatttattca

SEQ ID NO: 392692 - DNA, 15 bp, Homo sapiens
ccataatttattcag

SEQ ID NO: 392693 - DNA, 15 bp, Homo sapiens
cataatttattcagg

SEQ ID NO: 392694 - DNA, 15 bp, Homo sapiens
ataatttattcaggg

SEQ ID NO: 392695 - DNA, 15 bp, Homo sapiens
taatttattcaggga

SEQ ID NO: 392696 - DNA, 15 bp, Homo sapiens
aatttattcagggaa

SEQ ID NO: 392697 - DNA, 15 bp, Homo sapiens
atttattcagggaac

SEQ ID NO: 392698 - DNA, 15 bp, Homo sapiens
tttattcagggaacc

SEQ ID NO: 392699 - DNA, 15 bp, Homo sapiens
ttattcagggaaccc

SEQ ID NO: 392700 - DNA, 15 bp, Homo sapiens
tattcagggaaccca

SEQ ID NO: 392701 - DNA, 15 bp, Homo sapiens
attcagggaacccac

SEQ ID NO: 392702 - DNA, 15 bp, Homo sapiens
ttcagggaacccact

SEQ ID NO: 392703 - DNA, 15 bp, Homo sapiens
tcagggaacccacta

SEQ ID NO: 392704 - DNA, 15 bp, Homo sapiens
cagggaacccactat

SEQ ID NO: 392705 - DNA, 15 bp, Homo sapiens
agggaacccactatg

SEQ ID NO: 392706 - DNA, 15 bp, Homo sapiens
gggaacccactatgg

SEQ ID NO: 392707 - DNA, 15 bp, Homo sapiens
ggaacccactatggt

SEQ ID NO: 392708 - DNA, 15 bp, Homo sapiens
gaacccactatggtt

SEQ ID NO: 392709 - DNA, 15 bp, Homo sapiens
aacccactatggtta

SEQ ID NO: 392710 - DNA, 15 bp, Homo sapiens
acccactatggttag

SEQ ID NO: 392711 - DNA, 15 bp, Homo sapiens
cccactatggttagg

SEQ ID NO: 392712 - DNA, 15 bp, Homo sapiens
ccactatggttaggt

SEQ ID NO: 392713 - DNA, 15 bp, Homo sapiens
cactatggttaggta

SEQ ID NO: 392714 - DNA, 15 bp, Homo sapiens
actatggttaggtaa

SEQ ID NO: 392715 - DNA, 15 bp, Homo sapiens
ctatggttaggtaac

SEQ ID NO: 392716 - DNA, 15 bp, Homo sapiens
tatggttaggtaact

SEQ ID NO: 392717 - DNA, 15 bp, Homo sapiens
atggttaggtaacta

SEQ ID NO: 392718 - DNA, 15 bp, Homo sapiens
tggttaggtaactag

SEQ ID NO: 392719 - DNA, 15 bp, Homo sapiens
ggttaggtaactagg

SEQ ID NO: 392720 - DNA, 15 bp, Homo sapiens
gttaggtaactaggt

SEQ ID NO: 392721 - DNA, 15 bp, Homo sapiens
ttaggtaactaggtt

SEQ ID NO: 392722 - DNA, 15 bp, Homo sapiens
taggtaactaggttg

SEQ ID NO: 392723 - DNA, 15 bp, Homo sapiens
aggtaactaggttgt

SEQ ID NO: 392724 - DNA, 15 bp, Homo sapiens
ggtaactaggttgtt

SEQ ID NO: 392725 - DNA, 15 bp, Homo sapiens
gtaactaggttgtta

SEQ ID NO: 392726 - DNA, 15 bp, Homo sapiens
taactaggttgttac

SEQ ID NO: 392727 - DNA, 15 bp, Homo sapiens
aactaggttgttacc

SEQ ID NO: 392728 - DNA, 15 bp, Homo sapiens
actaggttgttacca

SEQ ID NO: 392729 - DNA, 15 bp, Homo sapiens
ctaggttgttaccaa

SEQ ID NO: 392730 - DNA, 15 bp, Homo sapiens
taggttgttaccaat

SEQ ID NO: 392731 - DNA, 15 bp, Homo sapiens
aggttgttaccaatg

SEQ ID NO: 392732 - DNA, 15 bp, Homo sapiens
ggttgttaccaatgt

SEQ ID NO: 392733 - DNA, 15 bp, Homo sapiens
gttgttaccaatgtt

SEQ ID NO: 392734 - DNA, 15 bp, Homo sapiens
ttgttaccaatgttc

SEQ ID NO: 392735 - DNA, 15 bp, Homo sapiens
tgttaccaatgttct

SEQ ID NO: 392736 - DNA, 15 bp, Homo sapiens
gttaccaatgttctc

SEQ ID NO: 392737 - DNA, 15 bp, Homo sapiens
ttaccaatgttctca

SEQ ID NO: 392738 - DNA, 15 bp, Homo sapiens
taccaatgttctcat

SEQ ID NO: 392739 - DNA, 15 bp, Homo sapiens
accaatgttctcatg

SEQ ID NO: 392740 - DNA, 15 bp, Homo sapiens
ccaatgttctcatga

SEQ ID NO: 392741 - DNA, 15 bp, Homo sapiens
caatgttctcatgat

SEQ ID NO: 392742 - DNA, 15 bp, Homo sapiens
aatgttctcatgata

SEQ ID NO: 392743 - DNA, 15 bp, Homo sapiens
atgttctcatgataa

SEQ ID NO: 392744 - DNA, 15 bp, Homo sapiens
tgttctcatgataaa

SEQ ID NO: 392745 - DNA, 15 bp, Homo sapiens
gttctcatgataaat

SEQ ID NO: 392746 - DNA, 15 bp, Homo sapiens
ttctcatgataaata

SEQ ID NO: 392747 - DNA, 15 bp, Homo sapiens
tctcatgataaataa

SEQ ID NO: 392748 - DNA, 15 bp, Homo sapiens
ctcatgataaataat

SEQ ID NO: 392749 - DNA, 15 bp, Homo sapiens
tcatgataaataatt

SEQ ID NO: 392750 - DNA, 15 bp, Homo sapiens
catgataaataattc

SEQ ID NO: 392751 - DNA, 15 bp, Homo sapiens
atgataaataattct

SEQ ID NO: 392752 - DNA, 15 bp, Homo sapiens
tgataaataattcta

SEQ ID NO: 392753 - DNA, 15 bp, Homo sapiens
gataaataattctat

SEQ ID NO: 392754 - DNA, 15 bp, Homo sapiens
ataaataattctatg

SEQ ID NO: 392755 - DNA, 15 bp, Homo sapiens
taaataattctatga

SEQ ID NO: 392756 - DNA, 15 bp, Homo sapiens
aaataattctatgat

SEQ ID NO: 392757 - DNA, 15 bp, Homo sapiens
aataattctatgatc

SEQ ID NO: 392758 - DNA, 15 bp, Homo sapiens
ataattctatgatcc

SEQ ID NO: 392759 - DNA, 15 bp, Homo sapiens
taattctatgatcct

SEQ ID NO: 392760 - DNA, 15 bp, Homo sapiens
aattctatgatcctt

SEQ ID NO: 392761 - DNA, 15 bp, Homo sapiens
attctatgatcctta

SEQ ID NO: 392762 - DNA, 15 bp, Homo sapiens
ttctatgatccttat

SEQ ID NO: 392763 - DNA, 15 bp, Homo sapiens
tctatgatccttata

SEQ ID NO: 392764 - DNA, 15 bp, Homo sapiens
ctatgatccttatac

SEQ ID NO: 392765 - DNA, 15 bp, Homo sapiens
tatgatccttataca

SEQ ID NO: 392766 - DNA, 15 bp, Homo sapiens
atgatccttatacat

SEQ ID NO: 392767 - DNA, 15 bp, Homo sapiens
tgatccttatacatc

SEQ ID NO: 392768 - DNA, 15 bp, Homo sapiens
gatccttatacatca

SEQ ID NO: 392769 - DNA, 15 bp, Homo sapiens
atccttatacatcat

SEQ ID NO: 392770 - DNA, 15 bp, Homo sapiens
tccttatacatcatt

SEQ ID NO: 392771 - DNA, 15 bp, Homo sapiens
ccttatacatcatta

SEQ ID NO: 392772 - DNA, 15 bp, Homo sapiens
cttatacatcattaa

SEQ ID NO: 392773 - DNA, 15 bp, Homo sapiens
ttatacatcattaag

SEQ ID NO: 392774 - DNA, 15 bp, Homo sapiens
tatacatcattaagt

SEQ ID NO: 392775 - DNA, 15 bp, Homo sapiens
atacatcattaagtg

SEQ ID NO: 392776 - DNA, 15 bp, Homo sapiens
tacatcattaagtgc

SEQ ID NO: 392777 - DNA, 15 bp, Homo sapiens
acatcattaagtgca

SEQ ID NO: 392778 - DNA, 15 bp, Homo sapiens
catcattaagtgcat

SEQ ID NO: 392779 - DNA, 15 bp, Homo sapiens
atcattaagtgcatc

SEQ ID NO: 392780 - DNA, 15 bp, Homo sapiens
tcattaagtgcatcc

SEQ ID NO: 392781 - DNA, 15 bp, Homo sapiens
cattaagtgcatcct

SEQ ID NO: 392782 - DNA, 15 bp, Homo sapiens
attaagtgcatcctg

SEQ ID NO: 392783 - DNA, 15 bp, Homo sapiens
ttaagtgcatcctga

SEQ ID NO: 392784 - DNA, 15 bp, Homo sapiens
taagtgcatcctgat

SEQ ID NO: 392785 - DNA, 15 bp, Homo sapiens
aagtgcatcctgatt

SEQ ID NO: 392786 - DNA, 15 bp, Homo sapiens
agtgcatcctgatta

SEQ ID NO: 392787 - DNA, 15 bp, Homo sapiens
gtgcatcctgattat

SEQ ID NO: 392788 - DNA, 15 bp, Homo sapiens
tgcatcctgattatg

SEQ ID NO: 392789 - DNA, 15 bp, Homo sapiens
gcatcctgattatgt

SEQ ID NO: 392790 - DNA, 15 bp, Homo sapiens
catcctgattatgtc

SEQ ID NO: 392791 - DNA, 15 bp, Homo sapiens
atcctgattatgtcc

SEQ ID NO: 392792 - DNA, 15 bp, Homo sapiens
tcctgattatgtcca

SEQ ID NO: 392793 - DNA, 15 bp, Homo sapiens
cctgattatgtccag

SEQ ID NO: 392794 - DNA, 15 bp, Homo sapiens
ctgattatgtccagg

SEQ ID NO: 392795 - DNA, 15 bp, Homo sapiens
tgattatgtccaggg

SEQ ID NO: 392796 - DNA, 15 bp, Homo sapiens
gattatgtccagggt

SEQ ID NO: 392797 - DNA, 15 bp, Homo sapiens
attatgtccagggta

SEQ ID NO: 392798 - DNA, 15 bp, Homo sapiens
ttatgtccagggtac

SEQ ID NO: 392799 - DNA, 15 bp, Homo sapiens
tatgtccagggtacg

SEQ ID NO: 392800 - DNA, 15 bp, Homo sapiens
atgtccagggtacgt

SEQ ID NO: 392801 - DNA, 15 bp, Homo sapiens
tgtccagggtacgtt

SEQ ID NO: 392802 - DNA, 15 bp, Homo sapiens
gtccagggtacgtta

SEQ ID NO: 392803 - DNA, 15 bp, Homo sapiens
tccagggtacgttat

SEQ ID NO: 392804 - DNA, 15 bp, Homo sapiens
ccagggtacgttatt

SEQ ID NO: 392805 - DNA, 15 bp, Homo sapiens
cagggtacgttatta

SEQ ID NO: 392806 - DNA, 15 bp, Homo sapiens
agggtacgttattag

SEQ ID NO: 392807 - DNA, 15 bp, Homo sapiens
gggtacgttattaga

SEQ ID NO: 392808 - DNA, 15 bp, Homo sapiens
ggtacgttattagaa

SEQ ID NO: 392809 - DNA, 15 bp, Homo sapiens
gtacgttattagaat

SEQ ID NO: 392810 - DNA, 15 bp, Homo sapiens
tacgttattagaata

SEQ ID NO: 392811 - DNA, 15 bp, Homo sapiens
acgttattagaatag

SEQ ID NO: 392812 - DNA, 15 bp, Homo sapiens
cgttattagaatagc

SEQ ID NO: 392813 - DNA, 15 bp, Homo sapiens
gttattagaatagca

SEQ ID NO: 392814 - DNA, 15 bp, Homo sapiens
ttattagaatagcat

SEQ ID NO: 392815 - DNA, 15 bp, Homo sapiens
tattagaatagcata

SEQ ID NO: 392816 - DNA, 15 bp, Homo sapiens
attagaatagcataa

SEQ ID NO: 392817 - DNA, 15 bp, Homo sapiens
ttagaatagcataac

SEQ ID NO: 392818 - DNA, 15 bp, Homo sapiens
tagaatagcataact

SEQ ID NO: 392819 - DNA, 15 bp, Homo sapiens
agaatagcataactg

SEQ ID NO: 392820 - DNA, 15 bp, Homo sapiens
gaatagcataactgg

SEQ ID NO: 392821 - DNA, 15 bp, Homo sapiens
aatagcataactgga

SEQ ID NO: 392822 - DNA, 15 bp, Homo sapiens
atagcataactggac

SEQ ID NO: 392823 - DNA, 15 bp, Homo sapiens
tagcataactggacc

SEQ ID NO: 392824 - DNA, 15 bp, Homo sapiens
agcataactggacca

SEQ ID NO: 392825 - DNA, 15 bp, Homo sapiens
gcataactggaccaa

SEQ ID NO: 392826 - DNA, 15 bp, Homo sapiens
cataactggaccaaa

SEQ ID NO: 392827 - DNA, 15 bp, Homo sapiens
ataactggaccaaaa

SEQ ID NO: 392828 - DNA, 15 bp, Homo sapiens
taactggaccaaaag

SEQ ID NO: 392829 - DNA, 15 bp, Homo sapiens
aactggaccaaaagg

SEQ ID NO: 392830 - DNA, 15 bp, Homo sapiens
actggaccaaaagga

SEQ ID NO: 392831 - DNA, 15 bp, Homo sapiens
ctggaccaaaaggac

SEQ ID NO: 392832 - DNA, 15 bp, Homo sapiens
tggaccaaaaggacc

SEQ ID NO: 392833 - DNA, 15 bp, Homo sapiens
ggaccaaaaggacca

SEQ ID NO: 392834 - DNA, 15 bp, Homo sapiens
gaccaaaaggaccag

SEQ ID NO: 392835 - DNA, 15 bp, Homo sapiens
accaaaaggaccaga

SEQ ID NO: 392836 - DNA, 15 bp, Homo sapiens
ccaaaaggaccagaa

SEQ ID NO: 392837 - DNA, 15 bp, Homo sapiens
caaaaggaccagaac

SEQ ID NO: 392838 - DNA, 15 bp, Homo sapiens
aaaaggaccagaaca

SEQ ID NO: 392839 - DNA, 15 bp, Homo sapiens
aaaggaccagaacaa

SEQ ID NO: 392840 - DNA, 15 bp, Homo sapiens
aaggaccagaacaat

SEQ ID NO: 392841 - DNA, 15 bp, Homo sapiens
aggaccagaacaatg

SEQ ID NO: 392842 - DNA, 15 bp, Homo sapiens
ggaccagaacaatga

SEQ ID NO: 392843 - DNA, 15 bp, Homo sapiens
gaccagaacaatgaa

SEQ ID NO: 392844 - DNA, 15 bp, Homo sapiens
accagaacaatgaaa

SEQ ID NO: 392845 - DNA, 15 bp, Homo sapiens
ccagaacaatgaaaa

SEQ ID NO: 392846 - DNA, 15 bp, Homo sapiens
cagaacaatgaaaag

SEQ ID NO: 392847 - DNA, 15 bp, Homo sapiens
agaacaatgaaaagc

SEQ ID NO: 392848 - DNA, 15 bp, Homo sapiens
gaacaatgaaaagct

SEQ ID NO: 392849 - DNA, 15 bp, Homo sapiens
aacaatgaaaagctt

SEQ ID NO: 392850 - DNA, 15 bp, Homo sapiens
acaatgaaaagcttt

SEQ ID NO: 392851 - DNA, 15 bp, Homo sapiens
caatgaaaagctttt

SEQ ID NO: 392852 - DNA, 15 bp, Homo sapiens
aatgaaaagcttttt

SEQ ID NO: 392853 - DNA, 15 bp, Homo sapiens
atgaaaagcttttta

SEQ ID NO: 392854 - DNA, 15 bp, Homo sapiens
tgaaaagctttttaa

SEQ ID NO: 392855 - DNA, 15 bp, Homo sapiens
gaaaagctttttaaa

SEQ ID NO: 392856 - DNA, 15 bp, Homo sapiens
aaaagctttttaaat

SEQ ID NO: 392857 - DNA, 15 bp, Homo sapiens
aaagctttttaaatt

SEQ ID NO: 392858 - DNA, 15 bp, Homo sapiens
aagctttttaaattt

SEQ ID NO: 392859 - DNA, 15 bp, Homo sapiens
agctttttaaatttt

SEQ ID NO: 392860 - DNA, 15 bp, Homo sapiens
gctttttaaattttt

SEQ ID NO: 392861 - DNA, 15 bp, Homo sapiens
ctttttaaattttta

SEQ ID NO: 392862 - DNA, 15 bp, Homo sapiens
tttttaaatttttaa

SEQ ID NO: 392863 - DNA, 15 bp, Homo sapiens
ttttaaatttttaaa

SEQ ID NO: 392864 - DNA, 15 bp, Homo sapiens
tttaaatttttaaat

SEQ ID NO: 392865 - DNA, 15 bp, Homo sapiens
ttaaatttttaaatt

SEQ ID NO: 392866 - DNA, 15 bp, Homo sapiens
taaatttttaaattt

SEQ ID NO: 392867 - DNA, 15 bp, Homo sapiens
aaatttttaaatttt

SEQ ID NO: 392868 - DNA, 15 bp, Homo sapiens
aatttttaaattttt

SEQ ID NO: 392869 - DNA, 15 bp, Homo sapiens
tttaaattttttttt

SEQ ID NO: 392870 - DNA, 15 bp, Homo sapiens
ttaaatttttttttt

SEQ ID NO: 392871 - DNA, 15 bp, Homo sapiens
taaattttttttttt

SEQ ID NO: 392872 - DNA, 15 bp, Homo sapiens
aaattttttttttta

SEQ ID NO: 392873 - DNA, 15 bp, Homo sapiens
aatttttttttttat

SEQ ID NO: 392874 - DNA, 15 bp, Homo sapiens
atttttttttttatt

SEQ ID NO: 392875 - DNA, 15 bp, Homo sapiens
tttttttttttattt

SEQ ID NO: 392876 - DNA, 15 bp, Homo sapiens
ttttttttttatttt

SEQ ID NO: 392877 - DNA, 15 bp, Homo sapiens
tttttttttattttt

SEQ ID NO: 392878 - DNA, 15 bp, Homo sapiens
ttttttttatttttt

SEQ ID NO: 392879 - DNA, 15 bp, Homo sapiens
tttttttatttttta

SEQ ID NO: 392880 - DNA, 15 bp, Homo sapiens
ttttttattttttag

SEQ ID NO: 392881 - DNA, 15 bp, Homo sapiens
tttttattttttaga

SEQ ID NO: 392882 - DNA, 15 bp, Homo sapiens
ttttattttttagac

SEQ ID NO: 392883 - DNA, 15 bp, Homo sapiens
tttattttttagaca

SEQ ID NO: 392884 - DNA, 15 bp, Homo sapiens
ttattttttagacaa

SEQ ID NO: 392885 - DNA, 15 bp, Homo sapiens
tattttttagacaag

SEQ ID NO: 392886 - DNA, 15 bp, Homo sapiens
attttttagacaaga

SEQ ID NO: 392887 - DNA, 15 bp, Homo sapiens
ttttttagacaagag

SEQ ID NO: 392888 - DNA, 15 bp, Homo sapiens
tttttagacaagagt

SEQ ID NO: 392889 - DNA, 15 bp, Homo sapiens
ttttagacaagagtc

SEQ ID NO: 392890 - DNA, 15 bp, Homo sapiens
tttagacaagagtct

SEQ ID NO: 392891 - DNA, 15 bp, Homo sapiens
ttagacaagagtctt

SEQ ID NO: 392892 - DNA, 15 bp, Homo sapiens
tagacaagagtcttg

SEQ ID NO: 392893 - DNA, 15 bp, Homo sapiens
agacaagagtcttgc

SEQ ID NO: 392894 - DNA, 15 bp, Homo sapiens
gacaagagtcttgct

SEQ ID NO: 392895 - DNA, 15 bp, Homo sapiens
acaagagtcttgctg

SEQ ID NO: 392896 - DNA, 15 bp, Homo sapiens
caagagtcttgctgt

SEQ ID NO: 392897 - DNA, 15 bp, Homo sapiens
aagagtcttgctgtc

SEQ ID NO: 392898 - DNA, 15 bp, Homo sapiens
agagtcttgctgtca

SEQ ID NO: 392899 - DNA, 15 bp, Homo sapiens
gagtcttgctgtcac

SEQ ID NO: 392900 - DNA, 15 bp, Homo sapiens
agtcttgctgtcacc

SEQ ID NO: 392901 - DNA, 15 bp, Homo sapiens
gtcttgctgtcacca

SEQ ID NO: 392902 - DNA, 15 bp, Homo sapiens
tcttgctgtcaccag

SEQ ID NO: 392903 - DNA, 15 bp, Homo sapiens
cttgctgtcaccagg

SEQ ID NO: 392904 - DNA, 15 bp, Homo sapiens
ttgctgtcaccaggc

SEQ ID NO: 392905 - DNA, 15 bp, Homo sapiens
tgctgtcaccaggct

SEQ ID NO: 392906 - DNA, 15 bp, Homo sapiens
gctgtcaccaggctg

SEQ ID NO: 392907 - DNA, 15 bp, Homo sapiens
ctggagtgcagtgga

SEQ ID NO: 392908 - DNA, 15 bp, Homo sapiens
tggagtgcagtggag

SEQ ID NO: 392909 - DNA, 15 bp, Homo sapiens
ggagtgcagtggagt

SEQ ID NO: 392910 - DNA, 15 bp, Homo sapiens
gagtgcagtggagta

SEQ ID NO: 392911 - DNA, 15 bp, Homo sapiens
agtgcagtggagtaa

SEQ ID NO: 392912 - DNA, 15 bp, Homo sapiens
gtgcagtggagtaat

SEQ ID NO: 392913 - DNA, 15 bp, Homo sapiens
tgcagtggagtaatc

SEQ ID NO: 392914 - DNA, 15 bp, Homo sapiens
gcagtggagtaatct

SEQ ID NO: 392915 - DNA, 15 bp, Homo sapiens
cagtggagtaatctc

SEQ ID NO: 392916 - DNA, 15 bp, Homo sapiens
agtggagtaatctca

SEQ ID NO: 392917 - DNA, 15 bp, Homo sapiens
gtggagtaatctcag

SEQ ID NO: 392918 - DNA, 15 bp, Homo sapiens
tggagtaatctcagc

SEQ ID NO: 392919 - DNA, 15 bp, Homo sapiens
ggagtaatctcagct

SEQ ID NO: 392920 - DNA, 15 bp, Homo sapiens
gagtaatctcagctc

SEQ ID NO: 392921 - DNA, 15 bp, Homo sapiens
agtaatctcagctca

SEQ ID NO: 392922 - DNA, 15 bp, Homo sapiens
gtaatctcagctcac

SEQ ID NO: 392923 - DNA, 15 bp, Homo sapiens
taatctcagctcact

SEQ ID NO: 392924 - DNA, 15 bp, Homo sapiens
tctcagctcactgct

SEQ ID NO: 392925 - DNA, 15 bp, Homo sapiens
ctcagctcactgcta

SEQ ID NO: 392926 - DNA, 15 bp, Homo sapiens
tcagctcactgctac

SEQ ID NO: 392927 - DNA, 15 bp, Homo sapiens
cagctcactgctact

SEQ ID NO: 392928 - DNA, 15 bp, Homo sapiens
agctcactgctactt

SEQ ID NO: 392929 - DNA, 15 bp, Homo sapiens
gctcactgctacttc

SEQ ID NO: 392930 - DNA, 15 bp, Homo sapiens
ctcactgctacttcc

SEQ ID NO: 392931 - DNA, 15 bp, Homo sapiens
tcactgctacttcca

SEQ ID NO: 392932 - DNA, 15 bp, Homo sapiens
cactgctacttccac

SEQ ID NO: 392933 - DNA, 15 bp, Homo sapiens
actgctacttccacc

SEQ ID NO: 392934 - DNA, 15 bp, Homo sapiens
ctgctacttccacct

SEQ ID NO: 392935 - DNA, 15 bp, Homo sapiens
tgctacttccacctc

SEQ ID NO: 392936 - DNA, 15 bp, Homo sapiens
gctacttccacctcc

SEQ ID NO: 392937 - DNA, 15 bp, Homo sapiens
ctacttccacctccc

SEQ ID NO: 392938 - DNA, 15 bp, Homo sapiens
tacttccacctccca

SEQ ID NO: 392939 - DNA, 15 bp, Homo sapiens
ggactacaggcgtgc

SEQ ID NO: 392940 - DNA, 15 bp, Homo sapiens
gactacaggcgtgca

SEQ ID NO: 392941 - DNA, 15 bp, Homo sapiens
actacaggcgtgcac

SEQ ID NO: 392942 - DNA, 15 bp, Homo sapiens
ctacaggcgtgcacc

SEQ ID NO: 392943 - DNA, 15 bp, Homo sapiens
tacaggcgtgcacca

SEQ ID NO: 392944 - DNA, 15 bp, Homo sapiens
ggcgtgcaccaccac

SEQ ID NO: 392945 - DNA, 15 bp, Homo sapiens
gcgtgcaccaccact

SEQ ID NO: 392946 - DNA, 15 bp, Homo sapiens
cgtgcaccaccactt

SEQ ID NO: 392947 - DNA, 15 bp, Homo sapiens
gtgcaccaccacttc

SEQ ID NO: 392948 - DNA, 15 bp, Homo sapiens
tgcaccaccacttcc

SEQ ID NO: 392949 - DNA, 15 bp, Homo sapiens
gcaccaccacttcca

SEQ ID NO: 392950 - DNA, 15 bp, Homo sapiens
caccaccacttccag

SEQ ID NO: 392951 - DNA, 15 bp, Homo sapiens
accaccacttccagc

SEQ ID NO: 392952 - DNA, 15 bp, Homo sapiens
ccaccacttccagct

SEQ ID NO: 392953 - DNA, 15 bp, Homo sapiens
caccacttccagcta

SEQ ID NO: 392954 - DNA, 15 bp, Homo sapiens
accacttccagctaa

SEQ ID NO: 392955 - DNA, 15 bp, Homo sapiens
ccacttccagctaat

SEQ ID NO: 392956 - DNA, 15 bp, Homo sapiens
cacttccagctaatt

SEQ ID NO: 392957 - DNA, 15 bp, Homo sapiens
acttccagctaattt

SEQ ID NO: 392958 - DNA, 15 bp, Homo sapiens
cttccagctaatttt

SEQ ID NO: 392959 - DNA, 15 bp, Homo sapiens
ttccagctaattttt

SEQ ID NO: 392960 - DNA, 15 bp, Homo sapiens
tccagctaatttttg

SEQ ID NO: 392961 - DNA, 15 bp, Homo sapiens
agagacggagtttca

SEQ ID NO: 392962 - DNA, 15 bp, Homo sapiens
agacggagtttcacc

SEQ ID NO: 392963 - DNA, 15 bp, Homo sapiens
gacggagtttcacca

SEQ ID NO: 392964 - DNA, 15 bp, Homo sapiens
acggagtttcaccat

SEQ ID NO: 392965 - DNA, 15 bp, Homo sapiens
cggagtttcaccatg

SEQ ID NO: 392966 - DNA, 15 bp, Homo sapiens
ggagtttcaccatgt

SEQ ID NO: 392967 - DNA, 15 bp, Homo sapiens
gagtttcaccatgtt

SEQ ID NO: 392968 - DNA, 15 bp, Homo sapiens
agtttcaccatgttg

SEQ ID NO: 392969 - DNA, 15 bp, Homo sapiens
caccatgttggccat

SEQ ID NO: 392970 - DNA, 15 bp, Homo sapiens
ccatgttggccatga

SEQ ID NO: 392971 - DNA, 15 bp, Homo sapiens
catgttggccatgat

SEQ ID NO: 392972 - DNA, 15 bp, Homo sapiens
atgttggccatgata

SEQ ID NO: 392973 - DNA, 15 bp, Homo sapiens
tgttggccatgatag

SEQ ID NO: 392974 - DNA, 15 bp, Homo sapiens
gttggccatgatagt

SEQ ID NO: 392975 - DNA, 15 bp, Homo sapiens
ttggccatgatagtc

SEQ ID NO: 392976 - DNA, 15 bp, Homo sapiens
tggccatgatagtct

SEQ ID NO: 392977 - DNA, 15 bp, Homo sapiens
ggccatgatagtctc

SEQ ID NO: 392978 - DNA, 15 bp, Homo sapiens
gccatgatagtctcg

SEQ ID NO: 392979 - DNA, 15 bp, Homo sapiens
ccatgatagtctcga

SEQ ID NO: 392980 - DNA, 15 bp, Homo sapiens
catgatagtctcgat

SEQ ID NO: 392981 - DNA, 15 bp, Homo sapiens
atgatagtctcgatc

SEQ ID NO: 392982 - DNA, 15 bp, Homo sapiens
tgatagtctcgatct

SEQ ID NO: 392983 - DNA, 15 bp, Homo sapiens
gatagtctcgatctc

SEQ ID NO: 392984 - DNA, 15 bp, Homo sapiens
atagtctcgatctct

SEQ ID NO: 392985 - DNA, 15 bp, Homo sapiens
tagtctcgatctctt

SEQ ID NO: 392986 - DNA, 15 bp, Homo sapiens
agtctcgatctcttg

SEQ ID NO: 392987 - DNA, 15 bp, Homo sapiens
cgatctcttgacctc

SEQ ID NO: 392988 - DNA, 15 bp, Homo sapiens
tgacctcgtgatccc

SEQ ID NO: 392989 - DNA, 15 bp, Homo sapiens
gacctcgtgatcccc

SEQ ID NO: 392990 - DNA, 15 bp, Homo sapiens
acctcgtgatccccc

SEQ ID NO: 392991 - DNA, 15 bp, Homo sapiens
cctcgtgatccccct

SEQ ID NO: 392992 - DNA, 15 bp, Homo sapiens
ctcgtgatccccctg

SEQ ID NO: 392993 - DNA, 15 bp, Homo sapiens
tcgtgatccccctgc

SEQ ID NO: 392994 - DNA, 15 bp, Homo sapiens
cgtgatccccctgcc

SEQ ID NO: 392995 - DNA, 15 bp, Homo sapiens
gtgatccccctgcct

SEQ ID NO: 392996 - DNA, 15 bp, Homo sapiens
tgatccccctgcctc

SEQ ID NO: 392997 - DNA, 15 bp, Homo sapiens
gatccccctgcctca

SEQ ID NO: 392998 - DNA, 15 bp, Homo sapiens
atccccctgcctcag

SEQ ID NO: 392999 - DNA, 15 bp, Homo sapiens
tccccctgcctcagc

SEQ ID NO: 393000 - DNA, 15 bp, Homo sapiens
ccccctgcctcagcc

SEQ ID NO: 393001 - DNA, 15 bp, Homo sapiens
tgcctcagcctccta

SEQ ID NO: 393002 - DNA, 15 bp, Homo sapiens
gcctcagcctcctaa

SEQ ID NO: 393003 - DNA, 15 bp, Homo sapiens
cctcagcctcctaaa

SEQ ID NO: 393004 - DNA, 15 bp, Homo sapiens
ctcagcctcctaaag

SEQ ID NO: 393005 - DNA, 15 bp, Homo sapiens
tcagcctcctaaagt

SEQ ID NO: 393006 - DNA, 15 bp, Homo sapiens
cagcctcctaaagtg

SEQ ID NO: 393007 - DNA, 15 bp, Homo sapiens
agcctcctaaagtgc

SEQ ID NO: 393008 - DNA, 15 bp, Homo sapiens
ggtgtgagccaccgt

SEQ ID NO: 393009 - DNA, 15 bp, Homo sapiens
gtgtgagccaccgtg

SEQ ID NO: 393010 - DNA, 15 bp, Homo sapiens
tgtgagccaccgtgc

SEQ ID NO: 393011 - DNA, 15 bp, Homo sapiens
gtgagccaccgtgcc

SEQ ID NO: 393012 - DNA, 15 bp, Homo sapiens
accgtgcccagccaa

SEQ ID NO: 393013 - DNA, 15 bp, Homo sapiens
ccgtgcccagccaat

SEQ ID NO: 393014 - DNA, 15 bp, Homo sapiens
cgtgcccagccaatg

SEQ ID NO: 393015 - DNA, 15 bp, Homo sapiens
gtgcccagccaatga

SEQ ID NO: 393016 - DNA, 15 bp, Homo sapiens
tgcccagccaatgaa

SEQ ID NO: 393017 - DNA, 15 bp, Homo sapiens
gcccagccaatgaaa

SEQ ID NO: 393018 - DNA, 15 bp, Homo sapiens
cccagccaatgaaaa

SEQ ID NO: 393019 - DNA, 15 bp, Homo sapiens
ccagccaatgaaaag

SEQ ID NO: 393020 - DNA, 15 bp, Homo sapiens
cagccaatgaaaagc

SEQ ID NO: 393021 - DNA, 15 bp, Homo sapiens
agccaatgaaaagct

SEQ ID NO: 393022 - DNA, 15 bp, Homo sapiens
gccaatgaaaagctt

SEQ ID NO: 393023 - DNA, 15 bp, Homo sapiens
ccaatgaaaagcttt

SEQ ID NO: 393024 - DNA, 15 bp, Homo sapiens
aatgaaaagcttttg

SEQ ID NO: 393025 - DNA, 15 bp, Homo sapiens
atgaaaagcttttga

SEQ ID NO: 393026 - DNA, 15 bp, Homo sapiens
tgaaaagcttttgat

SEQ ID NO: 393027 - DNA, 15 bp, Homo sapiens
gaaaagcttttgata

SEQ ID NO: 393028 - DNA, 15 bp, Homo sapiens
aaaagcttttgatat

SEQ ID NO: 393029 - DNA, 15 bp, Homo sapiens
aaagcttttgatatt

SEQ ID NO: 393030 - DNA, 15 bp, Homo sapiens
aagcttttgatattt

SEQ ID NO: 393031 - DNA, 15 bp, Homo sapiens
agcttttgatattta

SEQ ID NO: 393032 - DNA, 15 bp, Homo sapiens
gcttttgatatttat

SEQ ID NO: 393033 - DNA, 15 bp, Homo sapiens
cttttgatatttatt

SEQ ID NO: 393034 - DNA, 15 bp, Homo sapiens
ttttgatatttattg

SEQ ID NO: 393035 - DNA, 15 bp, Homo sapiens
tttgatatttattgc

SEQ ID NO: 393036 - DNA, 15 bp, Homo sapiens
ttgatatttattgcc

SEQ ID NO: 393037 - DNA, 15 bp, Homo sapiens
tgatatttattgccg

SEQ ID NO: 393038 - DNA, 15 bp, Homo sapiens
gatatttattgccgg

SEQ ID NO: 393039 - DNA, 15 bp, Homo sapiens
atatttattgccgga

SEQ ID NO: 393040 - DNA, 15 bp, Homo sapiens
tatttattgccggat

SEQ ID NO: 393041 - DNA, 15 bp, Homo sapiens
atttattgccggatt

SEQ ID NO: 393042 - DNA, 15 bp, Homo sapiens
tttattgccggattt

SEQ ID NO: 393043 - DNA, 15 bp, Homo sapiens
ttattgccggatttc

SEQ ID NO: 393044 - DNA, 15 bp, Homo sapiens
tattgccggatttcc

SEQ ID NO: 393045 - DNA, 15 bp, Homo sapiens
attgccggatttcca

SEQ ID NO: 393046 - DNA, 15 bp, Homo sapiens
ttgccggatttccat

SEQ ID NO: 393047 - DNA, 15 bp, Homo sapiens
tgccggatttccatc

SEQ ID NO: 393048 - DNA, 15 bp, Homo sapiens
gccggatttccatct

SEQ ID NO: 393049 - DNA, 15 bp, Homo sapiens
ccggatttccatctt

SEQ ID NO: 393050 - DNA, 15 bp, Homo sapiens
cggatttccatcttg

SEQ ID NO: 393051 - DNA, 15 bp, Homo sapiens
ggatttccatcttgc

SEQ ID NO: 393052 - DNA, 15 bp, Homo sapiens
gatttccatcttgca

SEQ ID NO: 393053 - DNA, 15 bp, Homo sapiens
atttccatcttgcaa

SEQ ID NO: 393054 - DNA, 15 bp, Homo sapiens
tttccatcttgcaag

SEQ ID NO: 393055 - DNA, 15 bp, Homo sapiens
ttccatcttgcaagg

SEQ ID NO: 393056 - DNA, 15 bp, Homo sapiens
tccatcttgcaaggt

SEQ ID NO: 393057 - DNA, 15 bp, Homo sapiens
ccatcttgcaaggta

SEQ ID NO: 393058 - DNA, 15 bp, Homo sapiens
catcttgcaaggtag

SEQ ID NO: 393059 - DNA, 15 bp, Homo sapiens
atcttgcaaggtagc

SEQ ID NO: 393060 - DNA, 15 bp, Homo sapiens
tcttgcaaggtagca

SEQ ID NO: 393061 - DNA, 15 bp, Homo sapiens
cttgcaaggtagcac

SEQ ID NO: 393062 - DNA, 15 bp, Homo sapiens
ttgcaaggtagcacc

SEQ ID NO: 393063 - DNA, 15 bp, Homo sapiens
tgcaaggtagcacct

SEQ ID NO: 393064 - DNA, 15 bp, Homo sapiens
gcaaggtagcacctg

SEQ ID NO: 393065 - DNA, 15 bp, Homo sapiens
caaggtagcacctgt

SEQ ID NO: 393066 - DNA, 15 bp, Homo sapiens
aaggtagcacctgtt

SEQ ID NO: 393067 - DNA, 15 bp, Homo sapiens
aggtagcacctgttt

SEQ ID NO: 393068 - DNA, 15 bp, Homo sapiens
ggtagcacctgttta

SEQ ID NO: 393069 - DNA, 15 bp, Homo sapiens
gtagcacctgtttac

SEQ ID NO: 393070 - DNA, 15 bp, Homo sapiens
tagcacctgtttaca

SEQ ID NO: 393071 - DNA, 15 bp, Homo sapiens
agcacctgtttacat

SEQ ID NO: 393072 - DNA, 15 bp, Homo sapiens
gcacctgtttacata

SEQ ID NO: 393073 - DNA, 15 bp, Homo sapiens
cacctgtttacataa

SEQ ID NO: 393074 - DNA, 15 bp, Homo sapiens
acctgtttacataac

SEQ ID NO: 393075 - DNA, 15 bp, Homo sapiens
cctgtttacataacc

SEQ ID NO: 393076 - DNA, 15 bp, Homo sapiens
ctgtttacataacca

SEQ ID NO: 393077 - DNA, 15 bp, Homo sapiens
tgtttacataaccac

SEQ ID NO: 393078 - DNA, 15 bp, Homo sapiens
gtttacataaccact

SEQ ID NO: 393079 - DNA, 15 bp, Homo sapiens
tttacataaccacta

SEQ ID NO: 393080 - DNA, 15 bp, Homo sapiens
ttacataaccactac

SEQ ID NO: 393081 - DNA, 15 bp, Homo sapiens
tacataaccactacc

SEQ ID NO: 393082 - DNA, 15 bp, Homo sapiens
acataaccactacca

SEQ ID NO: 393083 - DNA, 15 bp, Homo sapiens
cataaccactaccag

SEQ ID NO: 393084 - DNA, 15 bp, Homo sapiens
ataaccactaccagc

SEQ ID NO: 393085 - DNA, 15 bp, Homo sapiens
taaccactaccagct

SEQ ID NO: 393086 - DNA, 15 bp, Homo sapiens
aaccactaccagctt

SEQ ID NO: 393087 - DNA, 15 bp, Homo sapiens
accactaccagcttg

SEQ ID NO: 393088 - DNA, 15 bp, Homo sapiens
ccactaccagcttga

SEQ ID NO: 393089 - DNA, 15 bp, Homo sapiens
cactaccagcttgaa

SEQ ID NO: 393090 - DNA, 15 bp, Homo sapiens
actaccagcttgaat

SEQ ID NO: 393091 - DNA, 15 bp, Homo sapiens
ctaccagcttgaatg

SEQ ID NO: 393092 - DNA, 15 bp, Homo sapiens
taccagcttgaatgc

SEQ ID NO: 393093 - DNA, 15 bp, Homo sapiens
accagcttgaatgcc

SEQ ID NO: 393094 - DNA, 15 bp, Homo sapiens
ccagcttgaatgcct

SEQ ID NO: 393095 - DNA, 15 bp, Homo sapiens
cagcttgaatgcctg

SEQ ID NO: 393096 - DNA, 15 bp, Homo sapiens
agcttgaatgcctga

SEQ ID NO: 393097 - DNA, 15 bp, Homo sapiens
gcttgaatgcctgat

SEQ ID NO: 393098 - DNA, 15 bp, Homo sapiens
cttgaatgcctgatt

SEQ ID NO: 393099 - DNA, 15 bp, Homo sapiens
ttgaatgcctgattt

SEQ ID NO: 393100 - DNA, 15 bp, Homo sapiens
tgaatgcctgatttc

SEQ ID NO: 393101 - DNA, 15 bp, Homo sapiens
gaatgcctgatttct

SEQ ID NO: 393102 - DNA, 15 bp, Homo sapiens
aatgcctgatttctt

SEQ ID NO: 393103 - DNA, 15 bp, Homo sapiens
atgcctgatttcttg

SEQ ID NO: 393104 - DNA, 15 bp, Homo sapiens
tgcctgatttcttgt

SEQ ID NO: 393105 - DNA, 15 bp, Homo sapiens
gcctgatttcttgta

SEQ ID NO: 393106 - DNA, 15 bp, Homo sapiens
cctgatttcttgtat

SEQ ID NO: 393107 - DNA, 15 bp, Homo sapiens
ctgatttcttgtatc

SEQ ID NO: 393108 - DNA, 15 bp, Homo sapiens
tgatttcttgtatcc

SEQ ID NO: 393109 - DNA, 15 bp, Homo sapiens
gatttcttgtatcct

SEQ ID NO: 393110 - DNA, 15 bp, Homo sapiens
atttcttgtatcctc

SEQ ID NO: 393111 - DNA, 15 bp, Homo sapiens
tttcttgtatcctca

SEQ ID NO: 393112 - DNA, 15 bp, Homo sapiens
ttcttgtatcctcac

SEQ ID NO: 393113 - DNA, 15 bp, Homo sapiens
tcttgtatcctcaca

SEQ ID NO: 393114 - DNA, 15 bp, Homo sapiens
cttgtatcctcacag

SEQ ID NO: 393115 - DNA, 15 bp, Homo sapiens
ttgtatcctcacaga

SEQ ID NO: 393116 - DNA, 15 bp, Homo sapiens
tgtatcctcacagac

SEQ ID NO: 393117 - DNA, 15 bp, Homo sapiens
gtatcctcacagaca

SEQ ID NO: 393118 - DNA, 15 bp, Homo sapiens
tatcctcacagacaa

SEQ ID NO: 393119 - DNA, 15 bp, Homo sapiens
atcctcacagacaat

SEQ ID NO: 393120 - DNA, 15 bp, Homo sapiens
tcctcacagacaata

SEQ ID NO: 393121 - DNA, 15 bp, Homo sapiens
cctcacagacaatag

SEQ ID NO: 393122 - DNA, 15 bp, Homo sapiens
ctcacagacaatagg

SEQ ID NO: 393123 - DNA, 15 bp, Homo sapiens
tcacagacaataggc

SEQ ID NO: 393124 - DNA, 15 bp, Homo sapiens
cacagacaataggca

SEQ ID NO: 393125 - DNA, 15 bp, Homo sapiens
acagacaataggcaa

SEQ ID NO: 393126 - DNA, 15 bp, Homo sapiens
cagacaataggcaat

SEQ ID NO: 393127 - DNA, 15 bp, Homo sapiens
agacaataggcaata

SEQ ID NO: 393128 - DNA, 15 bp, Homo sapiens
gacaataggcaatac

SEQ ID NO: 393129 - DNA, 15 bp, Homo sapiens
acaataggcaatacc

SEQ ID NO: 393130 - DNA, 15 bp, Homo sapiens
caataggcaatacca

SEQ ID NO: 393131 - DNA, 15 bp, Homo sapiens
aataggcaataccaa

SEQ ID NO: 393132 - DNA, 15 bp, Homo sapiens
ataggcaataccaat

SEQ ID NO: 393133 - DNA, 15 bp, Homo sapiens
taggcaataccaatt

SEQ ID NO: 393134 - DNA, 15 bp, Homo sapiens
aggcaataccaatta

SEQ ID NO: 393135 - DNA, 15 bp, Homo sapiens
ggcaataccaattaa

SEQ ID NO: 393136 - DNA, 15 bp, Homo sapiens
gcaataccaattaaa

SEQ ID NO: 393137 - DNA, 15 bp, Homo sapiens
caataccaattaaaa

SEQ ID NO: 393138 - DNA, 15 bp, Homo sapiens
aataccaattaaaaa

SEQ ID NO: 393139 - DNA, 15 bp, Homo sapiens
ataccaattaaaaat

SEQ ID NO: 393140 - DNA, 15 bp, Homo sapiens
taccaattaaaaata

SEQ ID NO: 393141 - DNA, 15 bp, Homo sapiens
accaattaaaaatat

SEQ ID NO: 393142 - DNA, 15 bp, Homo sapiens
ccaattaaaaatatt

SEQ ID NO: 393143 - DNA, 15 bp, Homo sapiens
caattaaaaatattt

SEQ ID NO: 393144 - DNA, 15 bp, Homo sapiens
attaaaaatatttta

SEQ ID NO: 393145 - DNA, 15 bp, Homo sapiens
ttaaaaatattttat

SEQ ID NO: 393146 - DNA, 15 bp, Homo sapiens
taaaaatattttatg

SEQ ID NO: 393147 - DNA, 15 bp, Homo sapiens
aaaaatattttatga

SEQ ID NO: 393148 - DNA, 15 bp, Homo sapiens
aaaatattttatgaa

SEQ ID NO: 393149 - DNA, 15 bp, Homo sapiens
aaatattttatgaag

SEQ ID NO: 393150 - DNA, 15 bp, Homo sapiens
aatattttatgaagt

SEQ ID NO: 393151 - DNA, 15 bp, Homo sapiens
atattttatgaagtt

SEQ ID NO: 393152 - DNA, 15 bp, Homo sapiens
tattttatgaagttg

SEQ ID NO: 393153 - DNA, 15 bp, Homo sapiens
attttatgaagttgt

SEQ ID NO: 393154 - DNA, 15 bp, Homo sapiens
ttttatgaagttgtt

SEQ ID NO: 393155 - DNA, 15 bp, Homo sapiens
tttatgaagttgtta

SEQ ID NO: 393156 - DNA, 15 bp, Homo sapiens
ttatgaagttgttag

SEQ ID NO: 393157 - DNA, 15 bp, Homo sapiens
tatgaagttgttaga

SEQ ID NO: 393158 - DNA, 15 bp, Homo sapiens
atgaagttgttagat

SEQ ID NO: 393159 - DNA, 15 bp, Homo sapiens
tgaagttgttagatg

SEQ ID NO: 393160 - DNA, 15 bp, Homo sapiens
gaagttgttagatga

SEQ ID NO: 393161 - DNA, 15 bp, Homo sapiens
aagttgttagatgaa

SEQ ID NO: 393162 - DNA, 15 bp, Homo sapiens
agttgttagatgaaa

SEQ ID NO: 393163 - DNA, 15 bp, Homo sapiens
gttgttagatgaaaa

SEQ ID NO: 393164 - DNA, 15 bp, Homo sapiens
ttgttagatgaaaat

SEQ ID NO: 393165 - DNA, 15 bp, Homo sapiens
tgttagatgaaaatc

SEQ ID NO: 393166 - DNA, 15 bp, Homo sapiens
gttagatgaaaatca

SEQ ID NO: 393167 - DNA, 15 bp, Homo sapiens
ttagatgaaaatcat

SEQ ID NO: 393168 - DNA, 15 bp, Homo sapiens
tagatgaaaatcata

SEQ ID NO: 393169 - DNA, 15 bp, Homo sapiens
agatgaaaatcataa

SEQ ID NO: 393170 - DNA, 15 bp, Homo sapiens
gatgaaaatcataac

SEQ ID NO: 393171 - DNA, 15 bp, Homo sapiens
atgaaaatcataacc

SEQ ID NO: 393172 - DNA, 15 bp, Homo sapiens
tgaaaatcataaccc

SEQ ID NO: 393173 - DNA, 15 bp, Homo sapiens
gaaaatcataaccct

SEQ ID NO: 393174 - DNA, 15 bp, Homo sapiens
aaaatcataaccctg

SEQ ID NO: 393175 - DNA, 15 bp, Homo sapiens
aaatcataaccctgt

SEQ ID NO: 393176 - DNA, 15 bp, Homo sapiens
aatcataaccctgtt

SEQ ID NO: 393177 - DNA, 15 bp, Homo sapiens
atcataaccctgtta

SEQ ID NO: 393178 - DNA, 15 bp, Homo sapiens
tcataaccctgttat

SEQ ID NO: 393179 - DNA, 15 bp, Homo sapiens
cataaccctgttata

SEQ ID NO: 393180 - DNA, 15 bp, Homo sapiens
ataaccctgttatag

SEQ ID NO: 393181 - DNA, 15 bp, Homo sapiens
taaccctgttataga

SEQ ID NO: 393182 - DNA, 15 bp, Homo sapiens
aaccctgttatagaa

SEQ ID NO: 393183 - DNA, 15 bp, Homo sapiens
accctgttatagaat

SEQ ID NO: 393184 - DNA, 15 bp, Homo sapiens
ccctgttatagaata

SEQ ID NO: 393185 - DNA, 15 bp, Homo sapiens
cctgttatagaatat

SEQ ID NO: 393186 - DNA, 15 bp, Homo sapiens
ctgttatagaatata

SEQ ID NO: 393187 - DNA, 15 bp, Homo sapiens
tgttatagaatataa

SEQ ID NO: 393188 - DNA, 15 bp, Homo sapiens
gttatagaatataaa

SEQ ID NO: 393189 - DNA, 15 bp, Homo sapiens
ttatagaatataaac

SEQ ID NO: 393190 - DNA, 15 bp, Homo sapiens
tatagaatataaacg

SEQ ID NO: 393191 - DNA, 15 bp, Homo sapiens
atagaatataaacgg

SEQ ID NO: 393192 - DNA, 15 bp, Homo sapiens
tagaatataaacgga

SEQ ID NO: 393193 - DNA, 15 bp, Homo sapiens
agaatataaacggaa

SEQ ID NO: 393194 - DNA, 15 bp, Homo sapiens
gaatataaacggaaa

SEQ ID NO: 393195 - DNA, 15 bp, Homo sapiens
aatataaacggaaac

SEQ ID NO: 393196 - DNA, 15 bp, Homo sapiens
atataaacggaaacc

SEQ ID NO: 393197 - DNA, 15 bp, Homo sapiens
tataaacggaaacct

SEQ ID NO: 393198 - DNA, 15 bp, Homo sapiens
ataaacggaaaccta

SEQ ID NO: 393199 - DNA, 15 bp, Homo sapiens
taaacggaaacctag

SEQ ID NO: 393200 - DNA, 15 bp, Homo sapiens
aaacggaaacctagt

SEQ ID NO: 393201 - DNA, 15 bp, Homo sapiens
aacggaaacctagtc

SEQ ID NO: 393202 - DNA, 15 bp, Homo sapiens
acggaaacctagtca

SEQ ID NO: 393203 - DNA, 15 bp, Homo sapiens
cggaaacctagtcaa

SEQ ID NO: 393204 - DNA, 15 bp, Homo sapiens
ggaaacctagtcaag

SEQ ID NO: 393205 - DNA, 15 bp, Homo sapiens
gaaacctagtcaagt

SEQ ID NO: 393206 - DNA, 15 bp, Homo sapiens
aaacctagtcaagtt

SEQ ID NO: 393207 - DNA, 15 bp, Homo sapiens
aacctagtcaagttg

SEQ ID NO: 393208 - DNA, 15 bp, Homo sapiens
acctagtcaagttga

SEQ ID NO: 393209 - DNA, 15 bp, Homo sapiens
cctagtcaagttgaa

SEQ ID NO: 393210 - DNA, 15 bp, Homo sapiens
ctagtcaagttgaat

SEQ ID NO: 393211 - DNA, 15 bp, Homo sapiens
tagtcaagttgaatg

SEQ ID NO: 393212 - DNA, 15 bp, Homo sapiens
agtcaagttgaatga

SEQ ID NO: 393213 - DNA, 15 bp, Homo sapiens
gtcaagttgaatgat

SEQ ID NO: 393214 - DNA, 15 bp, Homo sapiens
tcaagttgaatgatt

SEQ ID NO: 393215 - DNA, 15 bp, Homo sapiens
caagttgaatgattt

SEQ ID NO: 393216 - DNA, 15 bp, Homo sapiens
aagttgaatgattta

SEQ ID NO: 393217 - DNA, 15 bp, Homo sapiens
agttgaatgatttac

SEQ ID NO: 393218 - DNA, 15 bp, Homo sapiens
gttgaatgatttacc

SEQ ID NO: 393219 - DNA, 15 bp, Homo sapiens
ttgaatgatttacct

SEQ ID NO: 393220 - DNA, 15 bp, Homo sapiens
tgaatgatttacctg

SEQ ID NO: 393221 - DNA, 15 bp, Homo sapiens
gaatgatttacctgt

SEQ ID NO: 393222 - DNA, 15 bp, Homo sapiens
aatgatttacctgtg

SEQ ID NO: 393223 - DNA, 15 bp, Homo sapiens
atgatttacctgtgt

SEQ ID NO: 393224 - DNA, 15 bp, Homo sapiens
tgatttacctgtgtg

SEQ ID NO: 393225 - DNA, 15 bp, Homo sapiens
gatttacctgtgtgg

SEQ ID NO: 393226 - DNA, 15 bp, Homo sapiens
atttacctgtgtggg

SEQ ID NO: 393227 - DNA, 15 bp, Homo sapiens
tttacctgtgtggga

SEQ ID NO: 393228 - DNA, 15 bp, Homo sapiens
ttacctgtgtgggat

SEQ ID NO: 393229 - DNA, 15 bp, Homo sapiens
tacctgtgtgggatc

SEQ ID NO: 393230 - DNA, 15 bp, Homo sapiens
acctgtgtgggatca

SEQ ID NO: 393231 - DNA, 15 bp, Homo sapiens
cctgtgtgggatcaa

SEQ ID NO: 393232 - DNA, 15 bp, Homo sapiens
ctgtgtgggatcaaa

SEQ ID NO: 393233 - DNA, 15 bp, Homo sapiens
tgtgtgggatcaaat

SEQ ID NO: 393234 - DNA, 15 bp, Homo sapiens
gtgtgggatcaaata

SEQ ID NO: 393235 - DNA, 15 bp, Homo sapiens
tgtgggatcaaatat

SEQ ID NO: 393236 - DNA, 15 bp, Homo sapiens
gtgggatcaaatatt

SEQ ID NO: 393237 - DNA, 15 bp, Homo sapiens
tgggatcaaatattc

SEQ ID NO: 393238 - DNA, 15 bp, Homo sapiens
gggatcaaatattct

SEQ ID NO: 393239 - DNA, 15 bp, Homo sapiens
ggatcaaatattcta

SEQ ID NO: 393240 - DNA, 15 bp, Homo sapiens
gatcaaatattctat

SEQ ID NO: 393241 - DNA, 15 bp, Homo sapiens
atcaaatattctatc

SEQ ID NO: 393242 - DNA, 15 bp, Homo sapiens
tcaaatattctatcc

SEQ ID NO: 393243 - DNA, 15 bp, Homo sapiens
caaatattctatccc

SEQ ID NO: 393244 - DNA, 15 bp, Homo sapiens
aaatattctatccca

SEQ ID NO: 393245 - DNA, 15 bp, Homo sapiens
aatattctatcccag

SEQ ID NO: 393246 - DNA, 15 bp, Homo sapiens
atattctatcccaga

SEQ ID NO: 393247 - DNA, 15 bp, Homo sapiens
tattctatcccagaa

SEQ ID NO: 393248 - DNA, 15 bp, Homo sapiens
attctatcccagaac

SEQ ID NO: 393249 - DNA, 15 bp, Homo sapiens
ttctatcccagaact

SEQ ID NO: 393250 - DNA, 15 bp, Homo sapiens
tctatcccagaactg

SEQ ID NO: 393251 - DNA, 15 bp, Homo sapiens
ctatcccagaactgt

SEQ ID NO: 393252 - DNA, 15 bp, Homo sapiens
tatcccagaactgtc

SEQ ID NO: 393253 - DNA, 15 bp, Homo sapiens
atcccagaactgtct

SEQ ID NO: 393254 - DNA, 15 bp, Homo sapiens
tcccagaactgtctg

SEQ ID NO: 393255 - DNA, 15 bp, Homo sapiens
cccagaactgtctga

SEQ ID NO: 393256 - DNA, 15 bp, Homo sapiens
ccagaactgtctgaa

SEQ ID NO: 393257 - DNA, 15 bp, Homo sapiens
cagaactgtctgaat

SEQ ID NO: 393258 - DNA, 15 bp, Homo sapiens
agaactgtctgaatt

SEQ ID NO: 393259 - DNA, 15 bp, Homo sapiens
gaactgtctgaattt

SEQ ID NO: 393260 - DNA, 15 bp, Homo sapiens
aactgtctgaatttc

SEQ ID NO: 393261 - DNA, 15 bp, Homo sapiens
actgtctgaatttca

SEQ ID NO: 393262 - DNA, 15 bp, Homo sapiens
ctgtctgaatttcag

SEQ ID NO: 393263 - DNA, 15 bp, Homo sapiens
tgtctgaatttcaga

SEQ ID NO: 393264 - DNA, 15 bp, Homo sapiens
gtctgaatttcagat

SEQ ID NO: 393265 - DNA, 15 bp, Homo sapiens
tctgaatttcagata

SEQ ID NO: 393266 - DNA, 15 bp, Homo sapiens
ctgaatttcagatac

SEQ ID NO: 393267 - DNA, 15 bp, Homo sapiens
tgaatttcagatact

SEQ ID NO: 393268 - DNA, 15 bp, Homo sapiens
gaatttcagatactg

SEQ ID NO: 393269 - DNA, 15 bp, Homo sapiens
aatttcagatactga

SEQ ID NO: 393270 - DNA, 15 bp, Homo sapiens
atttcagatactgag

SEQ ID NO: 393271 - DNA, 15 bp, Homo sapiens
tttcagatactgaga

SEQ ID NO: 393272 - DNA, 15 bp, Homo sapiens
ttcagatactgagaa

SEQ ID NO: 393273 - DNA, 15 bp, Homo sapiens
tcagatactgagaac

SEQ ID NO: 393274 - DNA, 15 bp, Homo sapiens
cagatactgagaacc

SEQ ID NO: 393275 - DNA, 15 bp, Homo sapiens
agatactgagaaccc

SEQ ID NO: 393276 - DNA, 15 bp, Homo sapiens
gatactgagaaccca

SEQ ID NO: 393277 - DNA, 15 bp, Homo sapiens
atactgagaacccag

SEQ ID NO: 393278 - DNA, 15 bp, Homo sapiens
tactgagaacccagt

SEQ ID NO: 393279 - DNA, 15 bp, Homo sapiens
actgagaacccagtc

SEQ ID NO: 393280 - DNA, 15 bp, Homo sapiens
ctgagaacccagtca

SEQ ID NO: 393281 - DNA, 15 bp, Homo sapiens
tgagaacccagtcac

SEQ ID NO: 393282 - DNA, 15 bp, Homo sapiens
gagaacccagtcact

SEQ ID NO: 393283 - DNA, 15 bp, Homo sapiens
agaacccagtcactg

SEQ ID NO: 393284 - DNA, 15 bp, Homo sapiens
gaacccagtcactgt

SEQ ID NO: 393285 - DNA, 15 bp, Homo sapiens
aacccagtcactgta

SEQ ID NO: 393286 - DNA, 15 bp, Homo sapiens
acccagtcactgtag

SEQ ID NO: 393287 - DNA, 15 bp, Homo sapiens
cccagtcactgtagt

SEQ ID NO: 393288 - DNA, 15 bp, Homo sapiens
ccagtcactgtagtt

SEQ ID NO: 393289 - DNA, 15 bp, Homo sapiens
cagtcactgtagttt

SEQ ID NO: 393290 - DNA, 15 bp, Homo sapiens
agtcactgtagtttc

SEQ ID NO: 393291 - DNA, 15 bp, Homo sapiens
gtcactgtagtttct

SEQ ID NO: 393292 - DNA, 15 bp, Homo sapiens
tcactgtagtttcta

SEQ ID NO: 393293 - DNA, 15 bp, Homo sapiens
cactgtagtttctaa

SEQ ID NO: 393294 - DNA, 15 bp, Homo sapiens
actgtagtttctaaa

SEQ ID NO: 393295 - DNA, 15 bp, Homo sapiens
ctgtagtttctaaaa

SEQ ID NO: 393296 - DNA, 15 bp, Homo sapiens
tgtagtttctaaaat

SEQ ID NO: 393297 - DNA, 15 bp, Homo sapiens
gtagtttctaaaatg

SEQ ID NO: 393298 - DNA, 15 bp, Homo sapiens
tagtttctaaaatgg

SEQ ID NO: 393299 - DNA, 15 bp, Homo sapiens
agtttctaaaatggg

SEQ ID NO: 393300 - DNA, 15 bp, Homo sapiens
gtttctaaaatggga

SEQ ID NO: 393301 - DNA, 15 bp, Homo sapiens
tttctaaaatgggat

SEQ ID NO: 393302 - DNA, 15 bp, Homo sapiens
ttctaaaatgggatg

SEQ ID NO: 393303 - DNA, 15 bp, Homo sapiens
tctaaaatgggatgc

SEQ ID NO: 393304 - DNA, 15 bp, Homo sapiens
ctaaaatgggatgca

SEQ ID NO: 393305 - DNA, 15 bp, Homo sapiens
taaaatgggatgcaa

SEQ ID NO: 393306 - DNA, 15 bp, Homo sapiens
aaaatgggatgcaac

SEQ ID NO: 393307 - DNA, 15 bp, Homo sapiens
aaatgggatgcaaca

SEQ ID NO: 393308 - DNA, 15 bp, Homo sapiens
aatgggatgcaacaa

SEQ ID NO: 393309 - DNA, 15 bp, Homo sapiens
atgggatgcaacaaa

SEQ ID NO: 393310 - DNA, 15 bp, Homo sapiens
tgggatgcaacaaat

SEQ ID NO: 393311 - DNA, 15 bp, Homo sapiens
gggatgcaacaaata

SEQ ID NO: 393312 - DNA, 15 bp, Homo sapiens
ggatgcaacaaatac

SEQ ID NO: 393313 - DNA, 15 bp, Homo sapiens
gatgcaacaaataca

SEQ ID NO: 393314 - DNA, 15 bp, Homo sapiens
atgcaacaaatacag

SEQ ID NO: 393315 - DNA, 15 bp, Homo sapiens
tgcaacaaatacagt

SEQ ID NO: 393316 - DNA, 15 bp, Homo sapiens
gcaacaaatacagta

SEQ ID NO: 393317 - DNA, 15 bp, Homo sapiens
caacaaatacagtat

SEQ ID NO: 393318 - DNA, 15 bp, Homo sapiens
aacaaatacagtata

SEQ ID NO: 393319 - DNA, 15 bp, Homo sapiens
acaaatacagtataa

SEQ ID NO: 393320 - DNA, 15 bp, Homo sapiens
caaatacagtataat

SEQ ID NO: 393321 - DNA, 15 bp, Homo sapiens
aaatacagtataata

SEQ ID NO: 393322 - DNA, 15 bp, Homo sapiens
aatacagtataataa

SEQ ID NO: 393323 - DNA, 15 bp, Homo sapiens
atacagtataataaa

SEQ ID NO: 393324 - DNA, 15 bp, Homo sapiens
tacagtataataaaa

SEQ ID NO: 393325 - DNA, 15 bp, Homo sapiens
acagtataataaaac

SEQ ID NO: 393326 - DNA, 15 bp, Homo sapiens
cagtataataaaact

SEQ ID NO: 393327 - DNA, 15 bp, Homo sapiens
agtataataaaacta

SEQ ID NO: 393328 - DNA, 15 bp, Homo sapiens
gtataataaaactag

SEQ ID NO: 393329 - DNA, 15 bp, Homo sapiens
tataataaaactaga

SEQ ID NO: 393330 - DNA, 15 bp, Homo sapiens
ataataaaactagaa

SEQ ID NO: 393331 - DNA, 15 bp, Homo sapiens
taataaaactagaag

SEQ ID NO: 393332 - DNA, 15 bp, Homo sapiens
aataaaactagaagt

SEQ ID NO: 393333 - DNA, 15 bp, Homo sapiens
ataaaactagaagtt

SEQ ID NO: 393334 - DNA, 15 bp, Homo sapiens
taaaactagaagttg

SEQ ID NO: 393335 - DNA, 15 bp, Homo sapiens
aaaactagaagttgt

SEQ ID NO: 393336 - DNA, 15 bp, Homo sapiens
aaactagaagttgtt

SEQ ID NO: 393337 - DNA, 15 bp, Homo sapiens
aactagaagttgttt

SEQ ID NO: 393338 - DNA, 15 bp, Homo sapiens
actagaagttgtttg

SEQ ID NO: 393339 - DNA, 15 bp, Homo sapiens
ctagaagttgtttga

SEQ ID NO: 393340 - DNA, 15 bp, Homo sapiens
tagaagttgtttgaa

SEQ ID NO: 393341 - DNA, 15 bp, Homo sapiens
agaagttgtttgaac

SEQ ID NO: 393342 - DNA, 15 bp, Homo sapiens
gaagttgtttgaaca

SEQ ID NO: 393343 - DNA, 15 bp, Homo sapiens
aagttgtttgaacac

SEQ ID NO: 393344 - DNA, 15 bp, Homo sapiens
agttgtttgaacaca

SEQ ID NO: 393345 - DNA, 15 bp, Homo sapiens
gttgtttgaacacag

SEQ ID NO: 393346 - DNA, 15 bp, Homo sapiens
ttgtttgaacacaga

SEQ ID NO: 393347 - DNA, 15 bp, Homo sapiens
tgtttgaacacagaa

SEQ ID NO: 393348 - DNA, 15 bp, Homo sapiens
gtttgaacacagaag

SEQ ID NO: 393349 - DNA, 15 bp, Homo sapiens
tttgaacacagaaga

SEQ ID NO: 393350 - DNA, 15 bp, Homo sapiens
ttgaacacagaagaa

SEQ ID NO: 393351 - DNA, 15 bp, Homo sapiens
tgaacacagaagaag

SEQ ID NO: 393352 - DNA, 15 bp, Homo sapiens
gaacacagaagaagg

SEQ ID NO: 393353 - DNA, 15 bp, Homo sapiens
aacacagaagaaggg

SEQ ID NO: 393354 - DNA, 15 bp, Homo sapiens
acacagaagaagggg

SEQ ID NO: 393355 - DNA, 15 bp, Homo sapiens
cacagaagaaggggc

SEQ ID NO: 393356 - DNA, 15 bp, Homo sapiens
acagaagaaggggca

SEQ ID NO: 393357 - DNA, 15 bp, Homo sapiens
cagaagaaggggcag

SEQ ID NO: 393358 - DNA, 15 bp, Homo sapiens
agaagaaggggcagt

SEQ ID NO: 393359 - DNA, 15 bp, Homo sapiens
gaagaaggggcagta

SEQ ID NO: 393360 - DNA, 15 bp, Homo sapiens
aagaaggggcagtaa

SEQ ID NO: 393361 - DNA, 15 bp, Homo sapiens
agaaggggcagtaaa

SEQ ID NO: 393362 - DNA, 15 bp, Homo sapiens
gaaggggcagtaaaa

SEQ ID NO: 393363 - DNA, 15 bp, Homo sapiens
aaggggcagtaaaat

SEQ ID NO: 393364 - DNA, 15 bp, Homo sapiens
aggggcagtaaaatc

SEQ ID NO: 393365 - DNA, 15 bp, Homo sapiens
ggggcagtaaaatct

SEQ ID NO: 393366 - DNA, 15 bp, Homo sapiens
gggcagtaaaatctg

SEQ ID NO: 393367 - DNA, 15 bp, Homo sapiens
ggcagtaaaatctga

SEQ ID NO: 393368 - DNA, 15 bp, Homo sapiens
gcagtaaaatctgaa

SEQ ID NO: 393369 - DNA, 15 bp, Homo sapiens
cagtaaaatctgaat

SEQ ID NO: 393370 - DNA, 15 bp, Homo sapiens
agtaaaatctgaatt

SEQ ID NO: 393371 - DNA, 15 bp, Homo sapiens
gtaaaatctgaattt

SEQ ID NO: 393372 - DNA, 15 bp, Homo sapiens
taaaatctgaattta

SEQ ID NO: 393373 - DNA, 15 bp, Homo sapiens
aaaatctgaatttaa

SEQ ID NO: 393374 - DNA, 15 bp, Homo sapiens
aaatctgaatttaaa

SEQ ID NO: 393375 - DNA, 15 bp, Homo sapiens
tctgaatttaaaatg

SEQ ID NO: 393376 - DNA, 15 bp, Homo sapiens
ctgaatttaaaatgt

SEQ ID NO: 393377 - DNA, 15 bp, Homo sapiens
tgaatttaaaatgtc

SEQ ID NO: 393378 - DNA, 15 bp, Homo sapiens
gaatttaaaatgtca

SEQ ID NO: 393379 - DNA, 15 bp, Homo sapiens
aatttaaaatgtcag

SEQ ID NO: 393380 - DNA, 15 bp, Homo sapiens
atttaaaatgtcaga

SEQ ID NO: 393381 - DNA, 15 bp, Homo sapiens
taaaatgtcagagaa

SEQ ID NO: 393382 - DNA, 15 bp, Homo sapiens
aaaatgtcagagaag

SEQ ID NO: 393383 - DNA, 15 bp, Homo sapiens
aaatgtcagagaagt

SEQ ID NO: 393384 - DNA, 15 bp, Homo sapiens
aatgtcagagaagtg

SEQ ID NO: 393385 - DNA, 15 bp, Homo sapiens
atgtcagagaagtgt

SEQ ID NO: 393386 - DNA, 15 bp, Homo sapiens
tgtcagagaagtgtt

SEQ ID NO: 393387 - DNA, 15 bp, Homo sapiens
gtcagagaagtgtta

SEQ ID NO: 393388 - DNA, 15 bp, Homo sapiens
tcagagaagtgttag

SEQ ID NO: 393389 - DNA, 15 bp, Homo sapiens
cagagaagtgttagt

SEQ ID NO: 393390 - DNA, 15 bp, Homo sapiens
agagaagtgttagta

SEQ ID NO: 393391 - DNA, 15 bp, Homo sapiens
gagaagtgttagtac

SEQ ID NO: 393392 - DNA, 15 bp, Homo sapiens
agaagtgttagtact

SEQ ID NO: 393393 - DNA, 15 bp, Homo sapiens
gaagtgttagtacta

SEQ ID NO: 393394 - DNA, 15 bp, Homo sapiens
aagtgttagtactaa

SEQ ID NO: 393395 - DNA, 15 bp, Homo sapiens
agtgttagtactaat

SEQ ID NO: 393396 - DNA, 15 bp, Homo sapiens
gtgttagtactaata

SEQ ID NO: 393397 - DNA, 15 bp, Homo sapiens
tgttagtactaatat

SEQ ID NO: 393398 - DNA, 15 bp, Homo sapiens
gttagtactaatatg

SEQ ID NO: 393399 - DNA, 15 bp, Homo sapiens
ttagtactaatatgg

SEQ ID NO: 393400 - DNA, 15 bp, Homo sapiens
tagtactaatatgga

SEQ ID NO: 393401 - DNA, 15 bp, Homo sapiens
agtactaatatggat

SEQ ID NO: 393402 - DNA, 15 bp, Homo sapiens
gtactaatatggatc

SEQ ID NO: 393403 - DNA, 15 bp, Homo sapiens
tactaatatggatct

SEQ ID NO: 393404 - DNA, 15 bp, Homo sapiens
actaatatggatctt

SEQ ID NO: 393405 - DNA, 15 bp, Homo sapiens
ctaatatggatcttg

SEQ ID NO: 393406 - DNA, 15 bp, Homo sapiens
taatatggatcttga

SEQ ID NO: 393407 - DNA, 15 bp, Homo sapiens
aatatggatcttgag

SEQ ID NO: 393408 - DNA, 15 bp, Homo sapiens
atatggatcttgagg

SEQ ID NO: 393409 - DNA, 15 bp, Homo sapiens
tatggatcttgagga

SEQ ID NO: 393410 - DNA, 15 bp, Homo sapiens
atggatcttgaggag

SEQ ID NO: 393411 - DNA, 15 bp, Homo sapiens
tggatcttgaggagt

SEQ ID NO: 393412 - DNA, 15 bp, Homo sapiens
ggatcttgaggagta

SEQ ID NO: 393413 - DNA, 15 bp, Homo sapiens
gatcttgaggagtag

SEQ ID NO: 393414 - DNA, 15 bp, Homo sapiens
atcttgaggagtaga

SEQ ID NO: 393415 - DNA, 15 bp, Homo sapiens
tcttgaggagtagat

SEQ ID NO: 393416 - DNA, 15 bp, Homo sapiens
cttgaggagtagata

SEQ ID NO: 393417 - DNA, 15 bp, Homo sapiens
ttgaggagtagatag

SEQ ID NO: 393418 - DNA, 15 bp, Homo sapiens
tgaggagtagataga

SEQ ID NO: 393419 - DNA, 15 bp, Homo sapiens
gaggagtagatagaa

SEQ ID NO: 393420 - DNA, 15 bp, Homo sapiens
aggagtagatagaat

SEQ ID NO: 393421 - DNA, 15 bp, Homo sapiens
ggagtagatagaatt

SEQ ID NO: 393422 - DNA, 15 bp, Homo sapiens
gagtagatagaattt

SEQ ID NO: 393423 - DNA, 15 bp, Homo sapiens
agtagatagaatttt

SEQ ID NO: 393424 - DNA, 15 bp, Homo sapiens
gtagatagaatttta

SEQ ID NO: 393425 - DNA, 15 bp, Homo sapiens
tagatagaattttag

SEQ ID NO: 393426 - DNA, 15 bp, Homo sapiens
agatagaattttagt

SEQ ID NO: 393427 - DNA, 15 bp, Homo sapiens
gatagaattttagta

SEQ ID NO: 393428 - DNA, 15 bp, Homo sapiens
atagaattttagtag

SEQ ID NO: 393429 - DNA, 15 bp, Homo sapiens
tagaattttagtaga

SEQ ID NO: 393430 - DNA, 15 bp, Homo sapiens
agaattttagtagag

SEQ ID NO: 393431 - DNA, 15 bp, Homo sapiens
gaattttagtagagc

SEQ ID NO: 393432 - DNA, 15 bp, Homo sapiens
aattttagtagagca

SEQ ID NO: 393433 - DNA, 15 bp, Homo sapiens
attttagtagagcag

SEQ ID NO: 393434 - DNA, 15 bp, Homo sapiens
ttttagtagagcaga

SEQ ID NO: 393435 - DNA, 15 bp, Homo sapiens
tttagtagagcagaa

SEQ ID NO: 393436 - DNA, 15 bp, Homo sapiens
ttagtagagcagaaa

SEQ ID NO: 393437 - DNA, 15 bp, Homo sapiens
tagtagagcagaaaa

SEQ ID NO: 393438 - DNA, 15 bp, Homo sapiens
agtagagcagaaaac

SEQ ID NO: 393439 - DNA, 15 bp, Homo sapiens
gtagagcagaaaact

SEQ ID NO: 393440 - DNA, 15 bp, Homo sapiens
tagagcagaaaactc

SEQ ID NO: 393441 - DNA, 15 bp, Homo sapiens
agagcagaaaactct

SEQ ID NO: 393442 - DNA, 15 bp, Homo sapiens
gagcagaaaactctg

SEQ ID NO: 393443 - DNA, 15 bp, Homo sapiens
agcagaaaactctgc

SEQ ID NO: 393444 - DNA, 15 bp, Homo sapiens
gcagaaaactctgcg

SEQ ID NO: 393445 - DNA, 15 bp, Homo sapiens
cagaaaactctgcga

SEQ ID NO: 393446 - DNA, 15 bp, Homo sapiens
agaaaactctgcgaa

SEQ ID NO: 393447 - DNA, 15 bp, Homo sapiens
gaaaactctgcgaat

SEQ ID NO: 393448 - DNA, 15 bp, Homo sapiens
aaaactctgcgaata

SEQ ID NO: 393449 - DNA, 15 bp, Homo sapiens
aaactctgcgaatag

SEQ ID NO: 393450 - DNA, 15 bp, Homo sapiens
aactctgcgaataga

SEQ ID NO: 393451 - DNA, 15 bp, Homo sapiens
actctgcgaatagac

SEQ ID NO: 393452 - DNA, 15 bp, Homo sapiens
ctctgcgaatagact

SEQ ID NO: 393453 - DNA, 15 bp, Homo sapiens
tctgcgaatagactg

SEQ ID NO: 393454 - DNA, 15 bp, Homo sapiens
ctgcgaatagactga

SEQ ID NO: 393455 - DNA, 15 bp, Homo sapiens
tgcgaatagactgaa

SEQ ID NO: 393456 - DNA, 15 bp, Homo sapiens
gcgaatagactgaat

SEQ ID NO: 393457 - DNA, 15 bp, Homo sapiens
cgaatagactgaatg

SEQ ID NO: 393458 - DNA, 15 bp, Homo sapiens
gaatagactgaatga

SEQ ID NO: 393459 - DNA, 15 bp, Homo sapiens
aatagactgaatgag

SEQ ID NO: 393460 - DNA, 15 bp, Homo sapiens
atagactgaatgagt

SEQ ID NO: 393461 - DNA, 15 bp, Homo sapiens
tagactgaatgagta

SEQ ID NO: 393462 - DNA, 15 bp, Homo sapiens
agactgaatgagtaa

SEQ ID NO: 393463 - DNA, 15 bp, Homo sapiens
gactgaatgagtaaa

SEQ ID NO: 393464 - DNA, 15 bp, Homo sapiens
actgaatgagtaaac

SEQ ID NO: 393465 - DNA, 15 bp, Homo sapiens
ctgaatgagtaaact

SEQ ID NO: 393466 - DNA, 15 bp, Homo sapiens
tgaatgagtaaactt

SEQ ID NO: 393467 - DNA, 15 bp, Homo sapiens
gaatgagtaaacttg

SEQ ID NO: 393468 - DNA, 15 bp, Homo sapiens
aatgagtaaacttgt

SEQ ID NO: 393469 - DNA, 15 bp, Homo sapiens
atgagtaaacttgtt

SEQ ID NO: 393470 - DNA, 15 bp, Homo sapiens
tgagtaaacttgtta

SEQ ID NO: 393471 - DNA, 15 bp, Homo sapiens
gagtaaacttgttac

SEQ ID NO: 393472 - DNA, 15 bp, Homo sapiens
agtaaacttgttacc

SEQ ID NO: 393473 - DNA, 15 bp, Homo sapiens
gtaaacttgttacca

SEQ ID NO: 393474 - DNA, 15 bp, Homo sapiens
taaacttgttaccag

SEQ ID NO: 393475 - DNA, 15 bp, Homo sapiens
aaacttgttaccaga

SEQ ID NO: 393476 - DNA, 15 bp, Homo sapiens
aacttgttaccagaa

SEQ ID NO: 393477 - DNA, 15 bp, Homo sapiens
acttgttaccagaat

SEQ ID NO: 393478 - DNA, 15 bp, Homo sapiens
cttgttaccagaatg

SEQ ID NO: 393479 - DNA, 15 bp, Homo sapiens
ttgttaccagaatgc

SEQ ID NO: 393480 - DNA, 15 bp, Homo sapiens
tgttaccagaatgca

SEQ ID NO: 393481 - DNA, 15 bp, Homo sapiens
gttaccagaatgcaa

SEQ ID NO: 393482 - DNA, 15 bp, Homo sapiens
ttaccagaatgcaaa

SEQ ID NO: 393483 - DNA, 15 bp, Homo sapiens
taccagaatgcaaag

SEQ ID NO: 393484 - DNA, 15 bp, Homo sapiens
accagaatgcaaagt

SEQ ID NO: 393485 - DNA, 15 bp, Homo sapiens
ccagaatgcaaagtc

SEQ ID NO: 393486 - DNA, 15 bp, Homo sapiens
cagaatgcaaagtct

SEQ ID NO: 393487 - DNA, 15 bp, Homo sapiens
agaatgcaaagtctt

SEQ ID NO: 393488 - DNA, 15 bp, Homo sapiens
gaatgcaaagtcttg

SEQ ID NO: 393489 - DNA, 15 bp, Homo sapiens
aatgcaaagtcttga

SEQ ID NO: 393490 - DNA, 15 bp, Homo sapiens
atgcaaagtcttgac

SEQ ID NO: 393491 - DNA, 15 bp, Homo sapiens
tgcaaagtcttgact

SEQ ID NO: 393492 - DNA, 15 bp, Homo sapiens
gcaaagtcttgactg

SEQ ID NO: 393493 - DNA, 15 bp, Homo sapiens
caaagtcttgactgg

SEQ ID NO: 393494 - DNA, 15 bp, Homo sapiens
aaagtcttgactggg

SEQ ID NO: 393495 - DNA, 15 bp, Homo sapiens
aagtcttgactggga

SEQ ID NO: 393496 - DNA, 15 bp, Homo sapiens
agtcttgactgggag

SEQ ID NO: 393497 - DNA, 15 bp, Homo sapiens
gtcttgactgggagc

SEQ ID NO: 393498 - DNA, 15 bp, Homo sapiens
tcttgactgggagct

SEQ ID NO: 393499 - DNA, 15 bp, Homo sapiens
cttgactgggagctg

SEQ ID NO: 393500 - DNA, 15 bp, Homo sapiens
ttgactgggagctgt

SEQ ID NO: 393501 - DNA, 15 bp, Homo sapiens
tgactgggagctgtc

SEQ ID NO: 393502 - DNA, 15 bp, Homo sapiens
gactgggagctgtcc

SEQ ID NO: 393503 - DNA, 15 bp, Homo sapiens
actgggagctgtcca

SEQ ID NO: 393504 - DNA, 15 bp, Homo sapiens
ctgggagctgtccac

SEQ ID NO: 393505 - DNA, 15 bp, Homo sapiens
tgggagctgtccacg

SEQ ID NO: 393506 - DNA, 15 bp, Homo sapiens
gggagctgtccacgt

SEQ ID NO: 393507 - DNA, 15 bp, Homo sapiens
ggagctgtccacgtt

SEQ ID NO: 393508 - DNA, 15 bp, Homo sapiens
gagctgtccacgttc

SEQ ID NO: 393509 - DNA, 15 bp, Homo sapiens
agctgtccacgttct

SEQ ID NO: 393510 - DNA, 15 bp, Homo sapiens
gctgtccacgttctt

SEQ ID NO: 393511 - DNA, 15 bp, Homo sapiens
ctgtccacgttcttg

SEQ ID NO: 393512 - DNA, 15 bp, Homo sapiens
tgtccacgttcttgg

SEQ ID NO: 393513 - DNA, 15 bp, Homo sapiens
gtccacgttcttggc

SEQ ID NO: 393514 - DNA, 15 bp, Homo sapiens
tccacgttcttggcg

SEQ ID NO: 393515 - DNA, 15 bp, Homo sapiens
ccacgttcttggcgc

SEQ ID NO: 393516 - DNA, 15 bp, Homo sapiens
cacgttcttggcgca

SEQ ID NO: 393517 - DNA, 15 bp, Homo sapiens
acgttcttggcgcaa

SEQ ID NO: 393518 - DNA, 15 bp, Homo sapiens
cgttcttggcgcaat

SEQ ID NO: 393519 - DNA, 15 bp, Homo sapiens
gttcttggcgcaatg

SEQ ID NO: 393520 - DNA, 15 bp, Homo sapiens
ttcttggcgcaatga

SEQ ID NO: 393521 - DNA, 15 bp, Homo sapiens
tcttggcgcaatgaa

SEQ ID NO: 393522 - DNA, 15 bp, Homo sapiens
cttggcgcaatgaac

SEQ ID NO: 393523 - DNA, 15 bp, Homo sapiens
ttggcgcaatgaaca

SEQ ID NO: 393524 - DNA, 15 bp, Homo sapiens
tggcgcaatgaacaa

SEQ ID NO: 393525 - DNA, 15 bp, Homo sapiens
ggcgcaatgaacaaa

SEQ ID NO: 393526 - DNA, 15 bp, Homo sapiens
gcgcaatgaacaaag

SEQ ID NO: 393527 - DNA, 15 bp, Homo sapiens
cgcaatgaacaaaga

SEQ ID NO: 393528 - DNA, 15 bp, Homo sapiens
gcaatgaacaaagaa

SEQ ID NO: 393529 - DNA, 15 bp, Homo sapiens
caatgaacaaagaat

SEQ ID NO: 393530 - DNA, 15 bp, Homo sapiens
aatgaacaaagaatt

SEQ ID NO: 393531 - DNA, 15 bp, Homo sapiens
atgaacaaagaattg

SEQ ID NO: 393532 - DNA, 15 bp, Homo sapiens
tgaacaaagaattga

SEQ ID NO: 393533 - DNA, 15 bp, Homo sapiens
gaacaaagaattgaa

SEQ ID NO: 393534 - DNA, 15 bp, Homo sapiens
aacaaagaattgaac

SEQ ID NO: 393535 - DNA, 15 bp, Homo sapiens
acaaagaattgaaca

SEQ ID NO: 393536 - DNA, 15 bp, Homo sapiens
caaagaattgaacaa

SEQ ID NO: 393537 - DNA, 15 bp, Homo sapiens
aaagaattgaacaaa

SEQ ID NO: 393538 - DNA, 15 bp, Homo sapiens
aagaattgaacaaaa

SEQ ID NO: 393539 - DNA, 15 bp, Homo sapiens
agaattgaacaaaat

SEQ ID NO: 393540 - DNA, 15 bp, Homo sapiens
gaattgaacaaaatg

SEQ ID NO: 393541 - DNA, 15 bp, Homo sapiens
aattgaacaaaatgc

SEQ ID NO: 393542 - DNA, 15 bp, Homo sapiens
attgaacaaaatgca

SEQ ID NO: 393543 - DNA, 15 bp, Homo sapiens
ttgaacaaaatgcac

SEQ ID NO: 393544 - DNA, 15 bp, Homo sapiens
tgaacaaaatgcaca

SEQ ID NO: 393545 - DNA, 15 bp, Homo sapiens
gaacaaaatgcacaa

SEQ ID NO: 393546 - DNA, 15 bp, Homo sapiens
aacaaaatgcacaaa

SEQ ID NO: 393547 - DNA, 15 bp, Homo sapiens
acaaaatgcacaaac

SEQ ID NO: 393548 - DNA, 15 bp, Homo sapiens
caaaatgcacaaaca

SEQ ID NO: 393549 - DNA, 15 bp, Homo sapiens
aaaatgcacaaacaa

SEQ ID NO: 393550 - DNA, 15 bp, Homo sapiens
aaatgcacaaacaaa

SEQ ID NO: 393551 - DNA, 15 bp, Homo sapiens
aatgcacaaacaaag

SEQ ID NO: 393552 - DNA, 15 bp, Homo sapiens
atgcacaaacaaagc

SEQ ID NO: 393553 - DNA, 15 bp, Homo sapiens
tgcacaaacaaagca

SEQ ID NO: 393554 - DNA, 15 bp, Homo sapiens
gcacaaacaaagcaa

SEQ ID NO: 393555 - DNA, 15 bp, Homo sapiens
cacaaacaaagcaac

SEQ ID NO: 393556 - DNA, 15 bp, Homo sapiens
acaaacaaagcaaca

SEQ ID NO: 393557 - DNA, 15 bp, Homo sapiens
caaacaaagcaacaa

SEQ ID NO: 393558 - DNA, 15 bp, Homo sapiens
aaacaaagcaacaaa

SEQ ID NO: 393559 - DNA, 15 bp, Homo sapiens
aacaaagcaacaaaa

SEQ ID NO: 393560 - DNA, 15 bp, Homo sapiens
acaaagcaacaaaag

SEQ ID NO: 393561 - DNA, 15 bp, Homo sapiens
caaagcaacaaaaga

SEQ ID NO: 393562 - DNA, 15 bp, Homo sapiens
aaagcaacaaaagaa

SEQ ID NO: 393563 - DNA, 15 bp, Homo sapiens
aagcaacaaaagaat

SEQ ID NO: 393564 - DNA, 15 bp, Homo sapiens
agcaacaaaagaatg

SEQ ID NO: 393565 - DNA, 15 bp, Homo sapiens
gcaacaaaagaatga

SEQ ID NO: 393566 - DNA, 15 bp, Homo sapiens
caacaaaagaatgaa

SEQ ID NO: 393567 - DNA, 15 bp, Homo sapiens
aacaaaagaatgaag

SEQ ID NO: 393568 - DNA, 15 bp, Homo sapiens
acaaaagaatgaagc

SEQ ID NO: 393569 - DNA, 15 bp, Homo sapiens
caaaagaatgaagca

SEQ ID NO: 393570 - DNA, 15 bp, Homo sapiens
aaaagaatgaagcaa

SEQ ID NO: 393571 - DNA, 15 bp, Homo sapiens
aaagaatgaagcaat

SEQ ID NO: 393572 - DNA, 15 bp, Homo sapiens
aagaatgaagcaatg

SEQ ID NO: 393573 - DNA, 15 bp, Homo sapiens
agaatgaagcaatga

SEQ ID NO: 393574 - DNA, 15 bp, Homo sapiens
gaatgaagcaatgaa

SEQ ID NO: 393575 - DNA, 15 bp, Homo sapiens
aatgaagcaatgaaa

SEQ ID NO: 393576 - DNA, 15 bp, Homo sapiens
atgaagcaatgaaag

SEQ ID NO: 393577 - DNA, 15 bp, Homo sapiens
tgaagcaatgaaagc

SEQ ID NO: 393578 - DNA, 15 bp, Homo sapiens
gaagcaatgaaagca

SEQ ID NO: 393579 - DNA, 15 bp, Homo sapiens
aagcaatgaaagcac

SEQ ID NO: 393580 - DNA, 15 bp, Homo sapiens
agcaatgaaagcaca

SEQ ID NO: 393581 - DNA, 15 bp, Homo sapiens
gcaatgaaagcacag

SEQ ID NO: 393582 - DNA, 15 bp, Homo sapiens
caatgaaagcacaga

SEQ ID NO: 393583 - DNA, 15 bp, Homo sapiens
aatgaaagcacagat

SEQ ID NO: 393584 - DNA, 15 bp, Homo sapiens
atgaaagcacagatt

SEQ ID NO: 393585 - DNA, 15 bp, Homo sapiens
tgaaagcacagattt

SEQ ID NO: 393586 - DNA, 15 bp, Homo sapiens
gaaagcacagatttt

SEQ ID NO: 393587 - DNA, 15 bp, Homo sapiens
aaagcacagattttt

SEQ ID NO: 393588 - DNA, 15 bp, Homo sapiens
aagcacagatttttt

SEQ ID NO: 393589 - DNA, 15 bp, Homo sapiens
agcacagattttttg

SEQ ID NO: 393590 - DNA, 15 bp, Homo sapiens
gcacagattttttga

SEQ ID NO: 393591 - DNA, 15 bp, Homo sapiens
cacagattttttgaa

SEQ ID NO: 393592 - DNA, 15 bp, Homo sapiens
acagattttttgaaa

SEQ ID NO: 393593 - DNA, 15 bp, Homo sapiens
cagattttttgaaag

SEQ ID NO: 393594 - DNA, 15 bp, Homo sapiens
agattttttgaaaga

SEQ ID NO: 393595 - DNA, 15 bp, Homo sapiens
gattttttgaaagaa

SEQ ID NO: 393596 - DNA, 15 bp, Homo sapiens
attttttgaaagaaa

SEQ ID NO: 393597 - DNA, 15 bp, Homo sapiens
ttttttgaaagaaaa

SEQ ID NO: 393598 - DNA, 15 bp, Homo sapiens
tttttgaaagaaaag

SEQ ID NO: 393599 - DNA, 15 bp, Homo sapiens
ttttgaaagaaaagt

SEQ ID NO: 393600 - DNA, 15 bp, Homo sapiens
tttgaaagaaaagta

SEQ ID NO: 393601 - DNA, 15 bp, Homo sapiens
ttgaaagaaaagtac

SEQ ID NO: 393602 - DNA, 15 bp, Homo sapiens
tgaaagaaaagtaca

SEQ ID NO: 393603 - DNA, 15 bp, Homo sapiens
gaaagaaaagtacac

SEQ ID NO: 393604 - DNA, 15 bp, Homo sapiens
aaagaaaagtacact

SEQ ID NO: 393605 - DNA, 15 bp, Homo sapiens
aagaaaagtacactc

SEQ ID NO: 393606 - DNA, 15 bp, Homo sapiens
agaaaagtacactcc

SEQ ID NO: 393607 - DNA, 15 bp, Homo sapiens
gaaaagtacactcca

SEQ ID NO: 393608 - DNA, 15 bp, Homo sapiens
aaaagtacactccac

SEQ ID NO: 393609 - DNA, 15 bp, Homo sapiens
aaagtacactccaca

SEQ ID NO: 393610 - DNA, 15 bp, Homo sapiens
aagtacactccacag

SEQ ID NO: 393611 - DNA, 15 bp, Homo sapiens
agtacactccacaga

SEQ ID NO: 393612 - DNA, 15 bp, Homo sapiens
gtacactccacagag

SEQ ID NO: 393613 - DNA, 15 bp, Homo sapiens
tacactccacagagt

SEQ ID NO: 393614 - DNA, 15 bp, Homo sapiens
acactccacagagtg

SEQ ID NO: 393615 - DNA, 15 bp, Homo sapiens
cactccacagagtgg

SEQ ID NO: 393616 - DNA, 15 bp, Homo sapiens
actccacagagtggg

SEQ ID NO: 393617 - DNA, 15 bp, Homo sapiens
ctccacagagtggga

SEQ ID NO: 393618 - DNA, 15 bp, Homo sapiens
tccacagagtgggaa

SEQ ID NO: 393619 - DNA, 15 bp, Homo sapiens
ccacagagtgggaat

SEQ ID NO: 393620 - DNA, 15 bp, Homo sapiens
cacagagtgggaatg

SEQ ID NO: 393621 - DNA, 15 bp, Homo sapiens
acagagtgggaatgg

SEQ ID NO: 393622 - DNA, 15 bp, Homo sapiens
cagagtgggaatggg

SEQ ID NO: 393623 - DNA, 15 bp, Homo sapiens
agagtgggaatgggc

SEQ ID NO: 393624 - DNA, 15 bp, Homo sapiens
gagtgggaatgggct

SEQ ID NO: 393625 - DNA, 15 bp, Homo sapiens
agtgggaatgggctt

SEQ ID NO: 393626 - DNA, 15 bp, Homo sapiens
gtgggaatgggcttg

SEQ ID NO: 393627 - DNA, 15 bp, Homo sapiens
tgggaatgggcttga

SEQ ID NO: 393628 - DNA, 15 bp, Homo sapiens
gggaatgggcttgag

SEQ ID NO: 393629 - DNA, 15 bp, Homo sapiens
ggaatgggcttgagc

SEQ ID NO: 393630 - DNA, 15 bp, Homo sapiens
gaatgggcttgagca

SEQ ID NO: 393631 - DNA, 15 bp, Homo sapiens
aatgggcttgagcag

SEQ ID NO: 393632 - DNA, 15 bp, Homo sapiens
atgggcttgagcagg

SEQ ID NO: 393633 - DNA, 15 bp, Homo sapiens
tgggcttgagcaggt

SEQ ID NO: 393634 - DNA, 15 bp, Homo sapiens
gggcttgagcaggtg

SEQ ID NO: 393635 - DNA, 15 bp, Homo sapiens
ggcttgagcaggtgg

SEQ ID NO: 393636 - DNA, 15 bp, Homo sapiens
gcttgagcaggtggc

SEQ ID NO: 393637 - DNA, 15 bp, Homo sapiens
cttgagcaggtggcc

SEQ ID NO: 393638 - DNA, 15 bp, Homo sapiens
ttgagcaggtggccc

SEQ ID NO: 393639 - DNA, 15 bp, Homo sapiens
tgagcaggtggccca

SEQ ID NO: 393640 - DNA, 15 bp, Homo sapiens
gagcaggtggcccaa

SEQ ID NO: 393641 - DNA, 15 bp, Homo sapiens
agcaggtggcccaaa

SEQ ID NO: 393642 - DNA, 15 bp, Homo sapiens
gcaggtggcccaaaa

SEQ ID NO: 393643 - DNA, 15 bp, Homo sapiens
caggtggcccaaaag

SEQ ID NO: 393644 - DNA, 15 bp, Homo sapiens
aggtggcccaaaagc

SEQ ID NO: 393645 - DNA, 15 bp, Homo sapiens
ggtggcccaaaagcc

SEQ ID NO: 393646 - DNA, 15 bp, Homo sapiens
gtggcccaaaagccc

SEQ ID NO: 393647 - DNA, 15 bp, Homo sapiens
tggcccaaaagccct

SEQ ID NO: 393648 - DNA, 15 bp, Homo sapiens
ggcccaaaagccctg

SEQ ID NO: 393649 - DNA, 15 bp, Homo sapiens
gcccaaaagccctga

SEQ ID NO: 393650 - DNA, 15 bp, Homo sapiens
cccaaaagccctgat

SEQ ID NO: 393651 - DNA, 15 bp, Homo sapiens
ccaaaagccctgatt

SEQ ID NO: 393652 - DNA, 15 bp, Homo sapiens
caaaagccctgattg

SEQ ID NO: 393653 - DNA, 15 bp, Homo sapiens
aaaagccctgattgc

SEQ ID NO: 393654 - DNA, 15 bp, Homo sapiens
aaagccctgattgca

SEQ ID NO: 393655 - DNA, 15 bp, Homo sapiens
aagccctgattgcaa

SEQ ID NO: 393656 - DNA, 15 bp, Homo sapiens
agccctgattgcaat

SEQ ID NO: 393657 - DNA, 15 bp, Homo sapiens
gccctgattgcaatt

SEQ ID NO: 393658 - DNA, 15 bp, Homo sapiens
ccctgattgcaattt

SEQ ID NO: 393659 - DNA, 15 bp, Homo sapiens
cctgattgcaatttg

SEQ ID NO: 393660 - DNA, 15 bp, Homo sapiens
ctgattgcaatttgc

SEQ ID NO: 393661 - DNA, 15 bp, Homo sapiens
tgattgcaatttgct

SEQ ID NO: 393662 - DNA, 15 bp, Homo sapiens
gattgcaatttgctt

SEQ ID NO: 393663 - DNA, 15 bp, Homo sapiens
attgcaatttgcttt

SEQ ID NO: 393664 - DNA, 15 bp, Homo sapiens
ttgcaatttgcttta

SEQ ID NO: 393665 - DNA, 15 bp, Homo sapiens
tgcaatttgctttag

SEQ ID NO: 393666 - DNA, 15 bp, Homo sapiens
gcaatttgctttagg

SEQ ID NO: 393667 - DNA, 15 bp, Homo sapiens
caatttgctttaggg

SEQ ID NO: 393668 - DNA, 15 bp, Homo sapiens
aatttgctttaggga

SEQ ID NO: 393669 - DNA, 15 bp, Homo sapiens
atttgctttagggat

SEQ ID NO: 393670 - DNA, 15 bp, Homo sapiens
tttgctttagggatt

SEQ ID NO: 393671 - DNA, 15 bp, Homo sapiens
ttgctttagggattt

SEQ ID NO: 393672 - DNA, 15 bp, Homo sapiens
tgctttagggatttt

SEQ ID NO: 393673 - DNA, 15 bp, Homo sapiens
gctttagggatttta

SEQ ID NO: 393674 - DNA, 15 bp, Homo sapiens
ctttagggattttat

SEQ ID NO: 393675 - DNA, 15 bp, Homo sapiens
tttagggattttatt

SEQ ID NO: 393676 - DNA, 15 bp, Homo sapiens
ttagggattttatta

SEQ ID NO: 393677 - DNA, 15 bp, Homo sapiens
tagggattttattaa

SEQ ID NO: 393678 - DNA, 15 bp, Homo sapiens
agggattttattaaa

SEQ ID NO: 393679 - DNA, 15 bp, Homo sapiens
gggattttattaaac

SEQ ID NO: 393680 - DNA, 15 bp, Homo sapiens
ggattttattaaact

SEQ ID NO: 393681 - DNA, 15 bp, Homo sapiens
gattttattaaacta

SEQ ID NO: 393682 - DNA, 15 bp, Homo sapiens
attttattaaactaa

SEQ ID NO: 393683 - DNA, 15 bp, Homo sapiens
ttttattaaactaaa

SEQ ID NO: 393684 - DNA, 15 bp, Homo sapiens
tttattaaactaaaa

SEQ ID NO: 393685 - DNA, 15 bp, Homo sapiens
ttattaaactaaaaa

SEQ ID NO: 393686 - DNA, 15 bp, Homo sapiens
tattaaactaaaaaa

SEQ ID NO: 393687 - DNA, 15 bp, Homo sapiens
attaaactaaaaaaa

SEQ ID NO: 393688 - DNA, 15 bp, Homo sapiens
ttaaactaaaaaaat

SEQ ID NO: 393689 - DNA, 15 bp, Homo sapiens
taaactaaaaaaatt

SEQ ID NO: 393690 - DNA, 15 bp, Homo sapiens
aaactaaaaaaattt

SEQ ID NO: 393691 - DNA, 15 bp, Homo sapiens
aactaaaaaaatttg

SEQ ID NO: 393692 - DNA, 15 bp, Homo sapiens
actaaaaaaatttgg

SEQ ID NO: 393693 - DNA, 15 bp, Homo sapiens
ctaaaaaaatttggt

SEQ ID NO: 393694 - DNA, 15 bp, Homo sapiens
taaaaaaatttggtg

SEQ ID NO: 393695 - DNA, 15 bp, Homo sapiens
aaaaaaatttggtga

SEQ ID NO: 393696 - DNA, 15 bp, Homo sapiens
aaaaaatttggtgac

SEQ ID NO: 393697 - DNA, 15 bp, Homo sapiens
aaaaatttggtgaca

SEQ ID NO: 393698 - DNA, 15 bp, Homo sapiens
aaaatttggtgacac

SEQ ID NO: 393699 - DNA, 15 bp, Homo sapiens
aaatttggtgacacc

SEQ ID NO: 393700 - DNA, 15 bp, Homo sapiens
aatttggtgacaccc

SEQ ID NO: 393701 - DNA, 15 bp, Homo sapiens
atttggtgacacccc

SEQ ID NO: 393702 - DNA, 15 bp, Homo sapiens
tttggtgacacccct

SEQ ID NO: 393703 - DNA, 15 bp, Homo sapiens
ttggtgacaccccta

SEQ ID NO: 393704 - DNA, 15 bp, Homo sapiens
tggtgacacccctag

SEQ ID NO: 393705 - DNA, 15 bp, Homo sapiens
ggtgacacccctagg

SEQ ID NO: 393706 - DNA, 15 bp, Homo sapiens
gtgacacccctaggt

SEQ ID NO: 393707 - DNA, 15 bp, Homo sapiens
tgacacccctaggta

SEQ ID NO: 393708 - DNA, 15 bp, Homo sapiens
gacacccctaggtac

SEQ ID NO: 393709 - DNA, 15 bp, Homo sapiens
acacccctaggtacc

SEQ ID NO: 393710 - DNA, 15 bp, Homo sapiens
cacccctaggtaccc

SEQ ID NO: 393711 - DNA, 15 bp, Homo sapiens
acccctaggtaccct

SEQ ID NO: 393712 - DNA, 15 bp, Homo sapiens
cccctaggtaccctt

SEQ ID NO: 393713 - DNA, 15 bp, Homo sapiens
ccctaggtaccctta

SEQ ID NO: 393714 - DNA, 15 bp, Homo sapiens
cctaggtacccttag

SEQ ID NO: 393715 - DNA, 15 bp, Homo sapiens
ctaggtacccttaga

SEQ ID NO: 393716 - DNA, 15 bp, Homo sapiens
taggtacccttagag

SEQ ID NO: 393717 - DNA, 15 bp, Homo sapiens
aggtacccttagagg

SEQ ID NO: 393718 - DNA, 15 bp, Homo sapiens
ggtacccttagaggc

SEQ ID NO: 393719 - DNA, 15 bp, Homo sapiens
gtacccttagaggcc

SEQ ID NO: 393720 - DNA, 15 bp, Homo sapiens
tacccttagaggcct

SEQ ID NO: 393721 - DNA, 15 bp, Homo sapiens
acccttagaggcctc

SEQ ID NO: 393722 - DNA, 15 bp, Homo sapiens
cccttagaggcctcc

SEQ ID NO: 393723 - DNA, 15 bp, Homo sapiens
ccttagaggcctcca

SEQ ID NO: 393724 - DNA, 15 bp, Homo sapiens
cttagaggcctccaa

SEQ ID NO: 393725 - DNA, 15 bp, Homo sapiens
ttagaggcctccaat

SEQ ID NO: 393726 - DNA, 15 bp, Homo sapiens
tagaggcctccaatt

SEQ ID NO: 393727 - DNA, 15 bp, Homo sapiens
agaggcctccaattg

SEQ ID NO: 393728 - DNA, 15 bp, Homo sapiens
gaggcctccaattgg

SEQ ID NO: 393729 - DNA, 15 bp, Homo sapiens
aggcctccaattggt

SEQ ID NO: 393730 - DNA, 15 bp, Homo sapiens
ggcctccaattggtt

SEQ ID NO: 393731 - DNA, 15 bp, Homo sapiens
gcctccaattggtta

SEQ ID NO: 393732 - DNA, 15 bp, Homo sapiens
cctccaattggttac

SEQ ID NO: 393733 - DNA, 15 bp, Homo sapiens
ctccaattggttaca

SEQ ID NO: 393734 - DNA, 15 bp, Homo sapiens
tccaattggttacaa

SEQ ID NO: 393735 - DNA, 15 bp, Homo sapiens
ccaattggttacaac

SEQ ID NO: 393736 - DNA, 15 bp, Homo sapiens
caattggttacaaca

SEQ ID NO: 393737 - DNA, 15 bp, Homo sapiens
aattggttacaacac

SEQ ID NO: 393738 - DNA, 15 bp, Homo sapiens
attggttacaacacc

SEQ ID NO: 393739 - DNA, 15 bp, Homo sapiens
ttggttacaacaccc

SEQ ID NO: 393740 - DNA, 15 bp, Homo sapiens
tggttacaacaccct

SEQ ID NO: 393741 - DNA, 15 bp, Homo sapiens
ggttacaacacccta

SEQ ID NO: 393742 - DNA, 15 bp, Homo sapiens
gttacaacaccctat

SEQ ID NO: 393743 - DNA, 15 bp, Homo sapiens
ttacaacaccctata

SEQ ID NO: 393744 - DNA, 15 bp, Homo sapiens
tacaacaccctatat

SEQ ID NO: 393745 - DNA, 15 bp, Homo sapiens
acaacaccctatatg

SEQ ID NO: 393746 - DNA, 15 bp, Homo sapiens
caacaccctatatga

SEQ ID NO: 393747 - DNA, 15 bp, Homo sapiens
aacaccctatatgaa

SEQ ID NO: 393748 - DNA, 15 bp, Homo sapiens
acaccctatatgaaa

SEQ ID NO: 393749 - DNA, 15 bp, Homo sapiens
caccctatatgaaag

SEQ ID NO: 393750 - DNA, 15 bp, Homo sapiens
accctatatgaaaga

SEQ ID NO: 393751 - DNA, 15 bp, Homo sapiens
ccctatatgaaagaa

SEQ ID NO: 393752 - DNA, 15 bp, Homo sapiens
cctatatgaaagaag

SEQ ID NO: 393753 - DNA, 15 bp, Homo sapiens
ctatatgaaagaagg

SEQ ID NO: 393754 - DNA, 15 bp, Homo sapiens
tatatgaaagaagga

SEQ ID NO: 393755 - DNA, 15 bp, Homo sapiens
atatgaaagaaggat

SEQ ID NO: 393756 - DNA, 15 bp, Homo sapiens
tatgaaagaaggatt

SEQ ID NO: 393757 - DNA, 15 bp, Homo sapiens
atgaaagaaggattg

SEQ ID NO: 393758 - DNA, 15 bp, Homo sapiens
tgaaagaaggattgg

SEQ ID NO: 393759 - DNA, 15 bp, Homo sapiens
gaaagaaggattggc

SEQ ID NO: 393760 - DNA, 15 bp, Homo sapiens
aaagaaggattggcc

SEQ ID NO: 393761 - DNA, 15 bp, Homo sapiens
aagaaggattggcct

SEQ ID NO: 393762 - DNA, 15 bp, Homo sapiens
agaaggattggcctg

SEQ ID NO: 393763 - DNA, 15 bp, Homo sapiens
gaaggattggcctgt

SEQ ID NO: 393764 - DNA, 15 bp, Homo sapiens
aaggattggcctgtg

SEQ ID NO: 393765 - DNA, 15 bp, Homo sapiens
aggattggcctgtga

SEQ ID NO: 393766 - DNA, 15 bp, Homo sapiens
ggattggcctgtgac

SEQ ID NO: 393767 - DNA, 15 bp, Homo sapiens
gattggcctgtgacc

SEQ ID NO: 393768 - DNA, 15 bp, Homo sapiens
attggcctgtgacca

SEQ ID NO: 393769 - DNA, 15 bp, Homo sapiens
ttggcctgtgaccaa

SEQ ID NO: 393770 - DNA, 15 bp, Homo sapiens
tggcctgtgaccaat

SEQ ID NO: 393771 - DNA, 15 bp, Homo sapiens
ggcctgtgaccaatc

SEQ ID NO: 393772 - DNA, 15 bp, Homo sapiens
gcctgtgaccaatca

SEQ ID NO: 393773 - DNA, 15 bp, Homo sapiens
cctgtgaccaatcat

SEQ ID NO: 393774 - DNA, 15 bp, Homo sapiens
ctgtgaccaatcata

SEQ ID NO: 393775 - DNA, 15 bp, Homo sapiens
tgtgaccaatcatag

SEQ ID NO: 393776 - DNA, 15 bp, Homo sapiens
gtgaccaatcatagg

SEQ ID NO: 393777 - DNA, 15 bp, Homo sapiens
tgaccaatcataggc

SEQ ID NO: 393778 - DNA, 15 bp, Homo sapiens
gaccaatcataggct

SEQ ID NO: 393779 - DNA, 15 bp, Homo sapiens
accaatcataggctg

SEQ ID NO: 393780 - DNA, 15 bp, Homo sapiens
ccaatcataggctga

SEQ ID NO: 393781 - DNA, 15 bp, Homo sapiens
caatcataggctgaa

SEQ ID NO: 393782 - DNA, 15 bp, Homo sapiens
aatcataggctgaag

SEQ ID NO: 393783 - DNA, 15 bp, Homo sapiens
atcataggctgaagt

SEQ ID NO: 393784 - DNA, 15 bp, Homo sapiens
tcataggctgaagtg

SEQ ID NO: 393785 - DNA, 15 bp, Homo sapiens
cataggctgaagtga

SEQ ID NO: 393786 - DNA, 15 bp, Homo sapiens
ataggctgaagtgaa

SEQ ID NO: 393787 - DNA, 15 bp, Homo sapiens
taggctgaagtgaag

SEQ ID NO: 393788 - DNA, 15 bp, Homo sapiens
aggctgaagtgaagc

SEQ ID NO: 393789 - DNA, 15 bp, Homo sapiens
ggctgaagtgaagcc

SEQ ID NO: 393790 - DNA, 15 bp, Homo sapiens
gctgaagtgaagcct

SEQ ID NO: 393791 - DNA, 15 bp, Homo sapiens
ctgaagtgaagcctt

SEQ ID NO: 393792 - DNA, 15 bp, Homo sapiens
tgaagtgaagccttg

SEQ ID NO: 393793 - DNA, 15 bp, Homo sapiens
gaagtgaagccttgg

SEQ ID NO: 393794 - DNA, 15 bp, Homo sapiens
aagtgaagccttggc

SEQ ID NO: 393795 - DNA, 15 bp, Homo sapiens
agtgaagccttggct

SEQ ID NO: 393796 - DNA, 15 bp, Homo sapiens
gtgaagccttggctt

SEQ ID NO: 393797 - DNA, 15 bp, Homo sapiens
tgaagccttggcttg

SEQ ID NO: 393798 - DNA, 15 bp, Homo sapiens
gaagccttggcttgc

SEQ ID NO: 393799 - DNA, 15 bp, Homo sapiens
aagccttggcttgcg

SEQ ID NO: 393800 - DNA, 15 bp, Homo sapiens
agccttggcttgcga

SEQ ID NO: 393801 - DNA, 15 bp, Homo sapiens
gccttggcttgcgac

SEQ ID NO: 393802 - DNA, 15 bp, Homo sapiens
ccttggcttgcgacc

SEQ ID NO: 393803 - DNA, 15 bp, Homo sapiens
cttggcttgcgacca

SEQ ID NO: 393804 - DNA, 15 bp, Homo sapiens
ttggcttgcgaccaa

SEQ ID NO: 393805 - DNA, 15 bp, Homo sapiens
tggcttgcgaccaat

SEQ ID NO: 393806 - DNA, 15 bp, Homo sapiens
ggcttgcgaccaatc

SEQ ID NO: 393807 - DNA, 15 bp, Homo sapiens
gcttgcgaccaatca

SEQ ID NO: 393808 - DNA, 15 bp, Homo sapiens
cttgcgaccaatcag

SEQ ID NO: 393809 - DNA, 15 bp, Homo sapiens
ttgcgaccaatcaga

SEQ ID NO: 393810 - DNA, 15 bp, Homo sapiens
tgcgaccaatcagag

SEQ ID NO: 393811 - DNA, 15 bp, Homo sapiens
gcgaccaatcagagg

SEQ ID NO: 393812 - DNA, 15 bp, Homo sapiens
cgaccaatcagaggc

SEQ ID NO: 393813 - DNA, 15 bp, Homo sapiens
gaccaatcagaggct

SEQ ID NO: 393814 - DNA, 15 bp, Homo sapiens
accaatcagaggctg

SEQ ID NO: 393815 - DNA, 15 bp, Homo sapiens
ccaatcagaggctga

SEQ ID NO: 393816 - DNA, 15 bp, Homo sapiens
caatcagaggctgaa

SEQ ID NO: 393817 - DNA, 15 bp, Homo sapiens
aatcagaggctgaag

SEQ ID NO: 393818 - DNA, 15 bp, Homo sapiens
atcagaggctgaagg

SEQ ID NO: 393819 - DNA, 15 bp, Homo sapiens
tcagaggctgaaggt

SEQ ID NO: 393820 - DNA, 15 bp, Homo sapiens
cagaggctgaaggta

SEQ ID NO: 393821 - DNA, 15 bp, Homo sapiens
agaggctgaaggtaa

SEQ ID NO: 393822 - DNA, 15 bp, Homo sapiens
gaggctgaaggtaag

SEQ ID NO: 393823 - DNA, 15 bp, Homo sapiens
aggctgaaggtaagc

SEQ ID NO: 393824 - DNA, 15 bp, Homo sapiens
ggctgaaggtaagct

SEQ ID NO: 393825 - DNA, 15 bp, Homo sapiens
gctgaaggtaagctt

SEQ ID NO: 393826 - DNA, 15 bp, Homo sapiens
ctgaaggtaagcttt

SEQ ID NO: 393827 - DNA, 15 bp, Homo sapiens
tgaaggtaagctttg

SEQ ID NO: 393828 - DNA, 15 bp, Homo sapiens
gaaggtaagctttgg

SEQ ID NO: 393829 - DNA, 15 bp, Homo sapiens
aaggtaagctttggc

SEQ ID NO: 393830 - DNA, 15 bp, Homo sapiens
aggtaagctttggcc

SEQ ID NO: 393831 - DNA, 15 bp, Homo sapiens
ggtaagctttggcct

SEQ ID NO: 393832 - DNA, 15 bp, Homo sapiens
gtaagctttggcctg

SEQ ID NO: 393833 - DNA, 15 bp, Homo sapiens
taagctttggcctgc

SEQ ID NO: 393834 - DNA, 15 bp, Homo sapiens
aagctttggcctgca

SEQ ID NO: 393835 - DNA, 15 bp, Homo sapiens
agctttggcctgcaa

SEQ ID NO: 393836 - DNA, 15 bp, Homo sapiens
gctttggcctgcaac

SEQ ID NO: 393837 - DNA, 15 bp, Homo sapiens
ctttggcctgcaacc

SEQ ID NO: 393838 - DNA, 15 bp, Homo sapiens
tttggcctgcaacca

SEQ ID NO: 393839 - DNA, 15 bp, Homo sapiens
ttggcctgcaaccaa

SEQ ID NO: 393840 - DNA, 15 bp, Homo sapiens
tggcctgcaaccaat

SEQ ID NO: 393841 - DNA, 15 bp, Homo sapiens
ggcctgcaaccaatc

SEQ ID NO: 393842 - DNA, 15 bp, Homo sapiens
gcctgcaaccaatca

SEQ ID NO: 393843 - DNA, 15 bp, Homo sapiens
cctgcaaccaatcag

SEQ ID NO: 393844 - DNA, 15 bp, Homo sapiens
ctgcaaccaatcaga

SEQ ID NO: 393845 - DNA, 15 bp, Homo sapiens
tgcaaccaatcagag

SEQ ID NO: 393846 - DNA, 15 bp, Homo sapiens
gcaaccaatcagagg

SEQ ID NO: 393847 - DNA, 15 bp, Homo sapiens
caaccaatcagaggc

SEQ ID NO: 393848 - DNA, 15 bp, Homo sapiens
aaccaatcagaggca

SEQ ID NO: 393849 - DNA, 15 bp, Homo sapiens
accaatcagaggcat

SEQ ID NO: 393850 - DNA, 15 bp, Homo sapiens
ccaatcagaggcatt

SEQ ID NO: 393851 - DNA, 15 bp, Homo sapiens
caatcagaggcattt

SEQ ID NO: 393852 - DNA, 15 bp, Homo sapiens
aatcagaggcatttc

SEQ ID NO: 393853 - DNA, 15 bp, Homo sapiens
atcagaggcatttcc

SEQ ID NO: 393854 - DNA, 15 bp, Homo sapiens
tcagaggcatttccc

SEQ ID NO: 393855 - DNA, 15 bp, Homo sapiens
cagaggcatttccca

SEQ ID NO: 393856 - DNA, 15 bp, Homo sapiens
agaggcatttcccat

SEQ ID NO: 393857 - DNA, 15 bp, Homo sapiens
gaggcatttcccatt

SEQ ID NO: 393858 - DNA, 15 bp, Homo sapiens
aggcatttcccattt

SEQ ID NO: 393859 - DNA, 15 bp, Homo sapiens
ggcatttcccatttg

SEQ ID NO: 393860 - DNA, 15 bp, Homo sapiens
gcatttcccatttgt

SEQ ID NO: 393861 - DNA, 15 bp, Homo sapiens
catttcccatttgta

SEQ ID NO: 393862 - DNA, 15 bp, Homo sapiens
atttcccatttgtag

SEQ ID NO: 393863 - DNA, 15 bp, Homo sapiens
tttcccatttgtagg

SEQ ID NO: 393864 - DNA, 15 bp, Homo sapiens
ttcccatttgtaggc

SEQ ID NO: 393865 - DNA, 15 bp, Homo sapiens
tcccatttgtaggct

SEQ ID NO: 393866 - DNA, 15 bp, Homo sapiens
cccatttgtaggcta

SEQ ID NO: 393867 - DNA, 15 bp, Homo sapiens
ccatttgtaggctag

SEQ ID NO: 393868 - DNA, 15 bp, Homo sapiens
catttgtaggctagg

SEQ ID NO: 393869 - DNA, 15 bp, Homo sapiens
atttgtaggctaggg

SEQ ID NO: 393870 - DNA, 15 bp, Homo sapiens
tttgtaggctagggt

SEQ ID NO: 393871 - DNA, 15 bp, Homo sapiens
ttgtaggctagggta

SEQ ID NO: 393872 - DNA, 15 bp, Homo sapiens
tgtaggctagggtag

SEQ ID NO: 393873 - DNA, 15 bp, Homo sapiens
gtaggctagggtaga

SEQ ID NO: 393874 - DNA, 15 bp, Homo sapiens
taggctagggtagag

SEQ ID NO: 393875 - DNA, 15 bp, Homo sapiens
aggctagggtagagg

SEQ ID NO: 393876 - DNA, 15 bp, Homo sapiens
ggctagggtagaggg

SEQ ID NO: 393877 - DNA, 15 bp, Homo sapiens
gctagggtagaggga

SEQ ID NO: 393878 - DNA, 15 bp, Homo sapiens
ctagggtagagggat

SEQ ID NO: 393879 - DNA, 15 bp, Homo sapiens
tagggtagagggatt

SEQ ID NO: 393880 - DNA, 15 bp, Homo sapiens
agggtagagggattt

SEQ ID NO: 393881 - DNA, 15 bp, Homo sapiens
gggtagagggatttt

SEQ ID NO: 393882 - DNA, 15 bp, Homo sapiens
ggtagagggattttg

SEQ ID NO: 393883 - DNA, 15 bp, Homo sapiens
gtagagggattttgt

SEQ ID NO: 393884 - DNA, 15 bp, Homo sapiens
tagagggattttgta

SEQ ID NO: 393885 - DNA, 15 bp, Homo sapiens
agagggattttgtaa

SEQ ID NO: 393886 - DNA, 15 bp, Homo sapiens
gagggattttgtaaa

SEQ ID NO: 393887 - DNA, 15 bp, Homo sapiens
agggattttgtaaag

SEQ ID NO: 393888 - DNA, 15 bp, Homo sapiens
gggattttgtaaaga

SEQ ID NO: 393889 - DNA, 15 bp, Homo sapiens
ggattttgtaaagag

SEQ ID NO: 393890 - DNA, 15 bp, Homo sapiens
gattttgtaaagagg

SEQ ID NO: 393891 - DNA, 15 bp, Homo sapiens
attttgtaaagaggg

SEQ ID NO: 393892 - DNA, 15 bp, Homo sapiens
ttttgtaaagagggg

SEQ ID NO: 393893 - DNA, 15 bp, Homo sapiens
tttgtaaagagggga

SEQ ID NO: 393894 - DNA, 15 bp, Homo sapiens
ttgtaaagaggggag

SEQ ID NO: 393895 - DNA, 15 bp, Homo sapiens
tgtaaagaggggagt

SEQ ID NO: 393896 - DNA, 15 bp, Homo sapiens
gtaaagaggggagtc

SEQ ID NO: 393897 - DNA, 15 bp, Homo sapiens
taaagaggggagtct

SEQ ID NO: 393898 - DNA, 15 bp, Homo sapiens
aaagaggggagtctc

SEQ ID NO: 393899 - DNA, 15 bp, Homo sapiens
aagaggggagtctct

SEQ ID NO: 393900 - DNA, 15 bp, Homo sapiens
agaggggagtctctg

SEQ ID NO: 393901 - DNA, 15 bp, Homo sapiens
gaggggagtctctgg

SEQ ID NO: 393902 - DNA, 15 bp, Homo sapiens
aggggagtctctggc

SEQ ID NO: 393903 - DNA, 15 bp, Homo sapiens
ggggagtctctggcc

SEQ ID NO: 393904 - DNA, 15 bp, Homo sapiens
gggagtctctggcct

SEQ ID NO: 393905 - DNA, 15 bp, Homo sapiens
ggagtctctggcctc

SEQ ID NO: 393906 - DNA, 15 bp, Homo sapiens
gagtctctggcctct

SEQ ID NO: 393907 - DNA, 15 bp, Homo sapiens
agtctctggcctctt

SEQ ID NO: 393908 - DNA, 15 bp, Homo sapiens
gtctctggcctcttc

SEQ ID NO: 393909 - DNA, 15 bp, Homo sapiens
tctctggcctcttct

SEQ ID NO: 393910 - DNA, 15 bp, Homo sapiens
ctctggcctcttctc

SEQ ID NO: 393911 - DNA, 15 bp, Homo sapiens
tctggcctcttctca

SEQ ID NO: 393912 - DNA, 15 bp, Homo sapiens
ctggcctcttctcac

SEQ ID NO: 393913 - DNA, 15 bp, Homo sapiens
tggcctcttctcact

SEQ ID NO: 393914 - DNA, 15 bp, Homo sapiens
ggcctcttctcactt

SEQ ID NO: 393915 - DNA, 15 bp, Homo sapiens
gcctcttctcacttg

SEQ ID NO: 393916 - DNA, 15 bp, Homo sapiens
cctcttctcacttgg

SEQ ID NO: 393917 - DNA, 15 bp, Homo sapiens
ctcttctcacttggg

SEQ ID NO: 393918 - DNA, 15 bp, Homo sapiens
tcttctcacttgggc

SEQ ID NO: 393919 - DNA, 15 bp, Homo sapiens
cttctcacttgggca

SEQ ID NO: 393920 - DNA, 15 bp, Homo sapiens
ttctcacttgggcat

SEQ ID NO: 393921 - DNA, 15 bp, Homo sapiens
tctcacttgggcatg

SEQ ID NO: 393922 - DNA, 15 bp, Homo sapiens
ctcacttgggcatgg

SEQ ID NO: 393923 - DNA, 15 bp, Homo sapiens
tcacttgggcatgga

SEQ ID NO: 393924 - DNA, 15 bp, Homo sapiens
cacttgggcatggag

SEQ ID NO: 393925 - DNA, 15 bp, Homo sapiens
acttgggcatggaga

SEQ ID NO: 393926 - DNA, 15 bp, Homo sapiens
cttgggcatggagag

SEQ ID NO: 393927 - DNA, 15 bp, Homo sapiens
ttgggcatggagaga

SEQ ID NO: 393928 - DNA, 15 bp, Homo sapiens
tgggcatggagagat

SEQ ID NO: 393929 - DNA, 15 bp, Homo sapiens
gggcatggagagatg

SEQ ID NO: 393930 - DNA, 15 bp, Homo sapiens
ggcatggagagatgg

SEQ ID NO: 393931 - DNA, 15 bp, Homo sapiens
gcatggagagatggg

SEQ ID NO: 393932 - DNA, 15 bp, Homo sapiens
catggagagatgggg

SEQ ID NO: 393933 - DNA, 15 bp, Homo sapiens
atggagagatggggt

SEQ ID NO: 393934 - DNA, 15 bp, Homo sapiens
tggagagatggggtt

SEQ ID NO: 393935 - DNA, 15 bp, Homo sapiens
ggagagatggggttt

SEQ ID NO: 393936 - DNA, 15 bp, Homo sapiens
gagagatggggtttt

SEQ ID NO: 393937 - DNA, 15 bp, Homo sapiens
agagatggggttttc

SEQ ID NO: 393938 - DNA, 15 bp, Homo sapiens
gagatggggttttcc

SEQ ID NO: 393939 - DNA, 15 bp, Homo sapiens
agatggggttttcct

SEQ ID NO: 393940 - DNA, 15 bp, Homo sapiens
gatggggttttcctt

SEQ ID NO: 393941 - DNA, 15 bp, Homo sapiens
atggggttttccttt

SEQ ID NO: 393942 - DNA, 15 bp, Homo sapiens
tggggttttcctttt

SEQ ID NO: 393943 - DNA, 15 bp, Homo sapiens
ggggttttccttttg

SEQ ID NO: 393944 - DNA, 15 bp, Homo sapiens
gggttttccttttgg

SEQ ID NO: 393945 - DNA, 15 bp, Homo sapiens
ggttttccttttggc

SEQ ID NO: 393946 - DNA, 15 bp, Homo sapiens
gttttccttttggcc

SEQ ID NO: 393947 - DNA, 15 bp, Homo sapiens
ttttccttttggccc

SEQ ID NO: 393948 - DNA, 15 bp, Homo sapiens
tttccttttggccca

SEQ ID NO: 393949 - DNA, 15 bp, Homo sapiens
ttccttttggcccaa

SEQ ID NO: 393950 - DNA, 15 bp, Homo sapiens
tccttttggcccaat

SEQ ID NO: 393951 - DNA, 15 bp, Homo sapiens
ccttttggcccaatt

SEQ ID NO: 393952 - DNA, 15 bp, Homo sapiens
cttttggcccaattc

SEQ ID NO: 393953 - DNA, 15 bp, Homo sapiens
ttttggcccaattcc

SEQ ID NO: 393954 - DNA, 15 bp, Homo sapiens
tttggcccaattcca

SEQ ID NO: 393955 - DNA, 15 bp, Homo sapiens
ttggcccaattccaa

SEQ ID NO: 393956 - DNA, 15 bp, Homo sapiens
tggcccaattccaag

SEQ ID NO: 393957 - DNA, 15 bp, Homo sapiens
ggcccaattccaaga

SEQ ID NO: 393958 - DNA, 15 bp, Homo sapiens
gcccaattccaagaa

SEQ ID NO: 393959 - DNA, 15 bp, Homo sapiens
cccaattccaagaac

SEQ ID NO: 393960 - DNA, 15 bp, Homo sapiens
ccaattccaagaact

SEQ ID NO: 393961 - DNA, 15 bp, Homo sapiens
caattccaagaactc

SEQ ID NO: 393962 - DNA, 15 bp, Homo sapiens
aattccaagaactca

SEQ ID NO: 393963 - DNA, 15 bp, Homo sapiens
attccaagaactcag

SEQ ID NO: 393964 - DNA, 15 bp, Homo sapiens
ttccaagaactcagc

SEQ ID NO: 393965 - DNA, 15 bp, Homo sapiens
tccaagaactcagcc

SEQ ID NO: 393966 - DNA, 15 bp, Homo sapiens
ccaagaactcagcca

SEQ ID NO: 393967 - DNA, 15 bp, Homo sapiens
caagaactcagccat

SEQ ID NO: 393968 - DNA, 15 bp, Homo sapiens
aagaactcagccatg

SEQ ID NO: 393969 - DNA, 15 bp, Homo sapiens
agaactcagccatga

SEQ ID NO: 393970 - DNA, 15 bp, Homo sapiens
gaactcagccatgac

SEQ ID NO: 393971 - DNA, 15 bp, Homo sapiens
aactcagccatgact

SEQ ID NO: 393972 - DNA, 15 bp, Homo sapiens
actcagccatgactt

SEQ ID NO: 393973 - DNA, 15 bp, Homo sapiens
ctcagccatgacttg

SEQ ID NO: 393974 - DNA, 15 bp, Homo sapiens
tcagccatgacttgg

SEQ ID NO: 393975 - DNA, 15 bp, Homo sapiens
cagccatgacttggc

SEQ ID NO: 393976 - DNA, 15 bp, Homo sapiens
agccatgacttggcc

SEQ ID NO: 393977 - DNA, 15 bp, Homo sapiens
gccatgacttggcct

SEQ ID NO: 393978 - DNA, 15 bp, Homo sapiens
ccatgacttggcctt

SEQ ID NO: 393979 - DNA, 15 bp, Homo sapiens
catgacttggcctta

SEQ ID NO: 393980 - DNA, 15 bp, Homo sapiens
atgacttggccttag

SEQ ID NO: 393981 - DNA, 15 bp, Homo sapiens
tgacttggccttagg

SEQ ID NO: 393982 - DNA, 15 bp, Homo sapiens
gacttggccttaggc

SEQ ID NO: 393983 - DNA, 15 bp, Homo sapiens
acttggccttaggct

SEQ ID NO: 393984 - DNA, 15 bp, Homo sapiens
cttggccttaggctg

SEQ ID NO: 393985 - DNA, 15 bp, Homo sapiens
ttggccttaggctgc

SEQ ID NO: 393986 - DNA, 15 bp, Homo sapiens
tggccttaggctgcc

SEQ ID NO: 393987 - DNA, 15 bp, Homo sapiens
ggccttaggctgcct

SEQ ID NO: 393988 - DNA, 15 bp, Homo sapiens
gccttaggctgcctg

SEQ ID NO: 393989 - DNA, 15 bp, Homo sapiens
ccttaggctgcctgt

SEQ ID NO: 393990 - DNA, 15 bp, Homo sapiens
cttaggctgcctgtc

SEQ ID NO: 393991 - DNA, 15 bp, Homo sapiens
ttaggctgcctgtct

SEQ ID NO: 393992 - DNA, 15 bp, Homo sapiens
taggctgcctgtctc

SEQ ID NO: 393993 - DNA, 15 bp, Homo sapiens
aggctgcctgtctcc

SEQ ID NO: 393994 - DNA, 15 bp, Homo sapiens
ggctgcctgtctcca

SEQ ID NO: 393995 - DNA, 15 bp, Homo sapiens
gctgcctgtctccag

SEQ ID NO: 393996 - DNA, 15 bp, Homo sapiens
ctgcctgtctccaga

SEQ ID NO: 393997 - DNA, 15 bp, Homo sapiens
tgcctgtctccagac

SEQ ID NO: 393998 - DNA, 15 bp, Homo sapiens
gcctgtctccagacc

SEQ ID NO: 393999 - DNA, 15 bp, Homo sapiens
cctgtctccagaccc

SEQ ID NO: 394000 - DNA, 15 bp, Homo sapiens
ctgtctccagaccct

SEQ ID NO: 394001 - DNA, 15 bp, Homo sapiens
tgtctccagacccta

SEQ ID NO: 394002 - DNA, 15 bp, Homo sapiens
gtctccagaccctat

SEQ ID NO: 394003 - DNA, 15 bp, Homo sapiens
tctccagaccctatt

SEQ ID NO: 394004 - DNA, 15 bp, Homo sapiens
ctccagaccctattc

SEQ ID NO: 394005 - DNA, 15 bp, Homo sapiens
tccagaccctattct

SEQ ID NO: 394006 - DNA, 15 bp, Homo sapiens
ccagaccctattctt

SEQ ID NO: 394007 - DNA, 15 bp, Homo sapiens
cagaccctattcttc

SEQ ID NO: 394008 - DNA, 15 bp, Homo sapiens
agaccctattcttct

SEQ ID NO: 394009 - DNA, 15 bp, Homo sapiens
gaccctattcttctg

SEQ ID NO: 394010 - DNA, 15 bp, Homo sapiens
accctattcttctgc

SEQ ID NO: 394011 - DNA, 15 bp, Homo sapiens
ccctattcttctgcc

SEQ ID NO: 394012 - DNA, 15 bp, Homo sapiens
cctattcttctgcct

SEQ ID NO: 394013 - DNA, 15 bp, Homo sapiens
ctattcttctgcctc

SEQ ID NO: 394014 - DNA, 15 bp, Homo sapiens
tattcttctgcctca

SEQ ID NO: 394015 - DNA, 15 bp, Homo sapiens
ttcttctgcctcaga

SEQ ID NO: 394016 - DNA, 15 bp, Homo sapiens
tcttctgcctcagac

SEQ ID NO: 394017 - DNA, 15 bp, Homo sapiens
cttctgcctcagaca

SEQ ID NO: 394018 - DNA, 15 bp, Homo sapiens
ttctgcctcagacat

SEQ ID NO: 394019 - DNA, 15 bp, Homo sapiens
tctgcctcagacatg

SEQ ID NO: 394020 - DNA, 15 bp, Homo sapiens
ctgcctcagacatgg

SEQ ID NO: 394021 - DNA, 15 bp, Homo sapiens
tgcctcagacatgga

SEQ ID NO: 394022 - DNA, 15 bp, Homo sapiens
gcctcagacatggag

SEQ ID NO: 394023 - DNA, 15 bp, Homo sapiens
cctcagacatggagc

SEQ ID NO: 394024 - DNA, 15 bp, Homo sapiens
ctcagacatggagca

SEQ ID NO: 394025 - DNA, 15 bp, Homo sapiens
tcagacatggagcac

SEQ ID NO: 394026 - DNA, 15 bp, Homo sapiens
cagacatggagcaca

SEQ ID NO: 394027 - DNA, 15 bp, Homo sapiens
agacatggagcacaa

SEQ ID NO: 394028 - DNA, 15 bp, Homo sapiens
gacatggagcacaaa

SEQ ID NO: 394029 - DNA, 15 bp, Homo sapiens
acatggagcacaaaa

SEQ ID NO: 394030 - DNA, 15 bp, Homo sapiens
catggagcacaaaag

SEQ ID NO: 394031 - DNA, 15 bp, Homo sapiens
atggagcacaaaagt

SEQ ID NO: 394032 - DNA, 15 bp, Homo sapiens
tggagcacaaaagta

SEQ ID NO: 394033 - DNA, 15 bp, Homo sapiens
ggagcacaaaagtat

SEQ ID NO: 394034 - DNA, 15 bp, Homo sapiens
gagcacaaaagtatg

SEQ ID NO: 394035 - DNA, 15 bp, Homo sapiens
agcacaaaagtatgc

SEQ ID NO: 394036 - DNA, 15 bp, Homo sapiens
gcacaaaagtatgct

SEQ ID NO: 394037 - DNA, 15 bp, Homo sapiens
cacaaaagtatgctg

SEQ ID NO: 394038 - DNA, 15 bp, Homo sapiens
acaaaagtatgctga

SEQ ID NO: 394039 - DNA, 15 bp, Homo sapiens
caaaagtatgctgat

SEQ ID NO: 394040 - DNA, 15 bp, Homo sapiens
aaaagtatgctgatt

SEQ ID NO: 394041 - DNA, 15 bp, Homo sapiens
aaagtatgctgattg

SEQ ID NO: 394042 - DNA, 15 bp, Homo sapiens
aagtatgctgattgt

SEQ ID NO: 394043 - DNA, 15 bp, Homo sapiens
agtatgctgattgta

SEQ ID NO: 394044 - DNA, 15 bp, Homo sapiens
gtatgctgattgtat

SEQ ID NO: 394045 - DNA, 15 bp, Homo sapiens
tatgctgattgtatt

SEQ ID NO: 394046 - DNA, 15 bp, Homo sapiens
atgctgattgtattc

SEQ ID NO: 394047 - DNA, 15 bp, Homo sapiens
tgctgattgtattca

SEQ ID NO: 394048 - DNA, 15 bp, Homo sapiens
gctgattgtattcag

SEQ ID NO: 394049 - DNA, 15 bp, Homo sapiens
ctgattgtattcaga

SEQ ID NO: 394050 - DNA, 15 bp, Homo sapiens
tgattgtattcagag

SEQ ID NO: 394051 - DNA, 15 bp, Homo sapiens
gattgtattcagaga

SEQ ID NO: 394052 - DNA, 15 bp, Homo sapiens
attgtattcagagaa

SEQ ID NO: 394053 - DNA, 15 bp, Homo sapiens
ttgtattcagagaac

SEQ ID NO: 394054 - DNA, 15 bp, Homo sapiens
tgtattcagagaaca

SEQ ID NO: 394055 - DNA, 15 bp, Homo sapiens
gtattcagagaacat

SEQ ID NO: 394056 - DNA, 15 bp, Homo sapiens
tattcagagaacatt

SEQ ID NO: 394057 - DNA, 15 bp, Homo sapiens
attcagagaacattg

SEQ ID NO: 394058 - DNA, 15 bp, Homo sapiens
ttcagagaacattgg

SEQ ID NO: 394059 - DNA, 15 bp, Homo sapiens
tcagagaacattggg

SEQ ID NO: 394060 - DNA, 15 bp, Homo sapiens
cagagaacattgggt

SEQ ID NO: 394061 - DNA, 15 bp, Homo sapiens
agagaacattgggta

SEQ ID NO: 394062 - DNA, 15 bp, Homo sapiens
gagaacattgggtac

SEQ ID NO: 394063 - DNA, 15 bp, Homo sapiens
agaacattgggtact

SEQ ID NO: 394064 - DNA, 15 bp, Homo sapiens
gaacattgggtactt

SEQ ID NO: 394065 - DNA, 15 bp, Homo sapiens
aacattgggtacttg

SEQ ID NO: 394066 - DNA, 15 bp, Homo sapiens
acattgggtacttgt

SEQ ID NO: 394067 - DNA, 15 bp, Homo sapiens
cattgggtacttgtc

SEQ ID NO: 394068 - DNA, 15 bp, Homo sapiens
attgggtacttgtcc

SEQ ID NO: 394069 - DNA, 15 bp, Homo sapiens
ttgggtacttgtcca

SEQ ID NO: 394070 - DNA, 15 bp, Homo sapiens
tgggtacttgtccat

SEQ ID NO: 394071 - DNA, 15 bp, Homo sapiens
gggtacttgtccatc

SEQ ID NO: 394072 - DNA, 15 bp, Homo sapiens
ggtacttgtccatca

SEQ ID NO: 394073 - DNA, 15 bp, Homo sapiens
gtacttgtccatcat

SEQ ID NO: 394074 - DNA, 15 bp, Homo sapiens
tacttgtccatcata

SEQ ID NO: 394075 - DNA, 15 bp, Homo sapiens
acttgtccatcataa

SEQ ID NO: 394076 - DNA, 15 bp, Homo sapiens
cttgtccatcataaa

SEQ ID NO: 394077 - DNA, 15 bp, Homo sapiens
ttgtccatcataaat

SEQ ID NO: 394078 - DNA, 15 bp, Homo sapiens
tgtccatcataaatg

SEQ ID NO: 394079 - DNA, 15 bp, Homo sapiens
gtccatcataaatgt

SEQ ID NO: 394080 - DNA, 15 bp, Homo sapiens
tccatcataaatgtc

SEQ ID NO: 394081 - DNA, 15 bp, Homo sapiens
ccatcataaatgtct

SEQ ID NO: 394082 - DNA, 15 bp, Homo sapiens
catcataaatgtcta

SEQ ID NO: 394083 - DNA, 15 bp, Homo sapiens
atcataaatgtctac

SEQ ID NO: 394084 - DNA, 15 bp, Homo sapiens
tcataaatgtctaca

SEQ ID NO: 394085 - DNA, 15 bp, Homo sapiens
cataaatgtctacaa

SEQ ID NO: 394086 - DNA, 15 bp, Homo sapiens
ataaatgtctacaaa

SEQ ID NO: 394087 - DNA, 15 bp, Homo sapiens
taaatgtctacaaag

SEQ ID NO: 394088 - DNA, 15 bp, Homo sapiens
aaatgtctacaaagt

SEQ ID NO: 394089 - DNA, 15 bp, Homo sapiens
aatgtctacaaagtt

SEQ ID NO: 394090 - DNA, 15 bp, Homo sapiens
atgtctacaaagttc

SEQ ID NO: 394091 - DNA, 15 bp, Homo sapiens
tgtctacaaagttca

SEQ ID NO: 394092 - DNA, 15 bp, Homo sapiens
gtctacaaagttcat

SEQ ID NO: 394093 - DNA, 15 bp, Homo sapiens
tctacaaagttcatt

SEQ ID NO: 394094 - DNA, 15 bp, Homo sapiens
ctacaaagttcattc

SEQ ID NO: 394095 - DNA, 15 bp, Homo sapiens
tacaaagttcattca

SEQ ID NO: 394096 - DNA, 15 bp, Homo sapiens
acaaagttcattcat

SEQ ID NO: 394097 - DNA, 15 bp, Homo sapiens
caaagttcattcatt

SEQ ID NO: 394098 - DNA, 15 bp, Homo sapiens
aaagttcattcattt

SEQ ID NO: 394099 - DNA, 15 bp, Homo sapiens
aagttcattcattta

SEQ ID NO: 394100 - DNA, 15 bp, Homo sapiens
agttcattcatttac

SEQ ID NO: 394101 - DNA, 15 bp, Homo sapiens
gttcattcatttaca

SEQ ID NO: 394102 - DNA, 15 bp, Homo sapiens
ttcattcatttacat

SEQ ID NO: 394103 - DNA, 15 bp, Homo sapiens
tcattcatttacatt

SEQ ID NO: 394104 - DNA, 15 bp, Homo sapiens
cattcatttacattt

SEQ ID NO: 394105 - DNA, 15 bp, Homo sapiens
attcatttacatttt

SEQ ID NO: 394106 - DNA, 15 bp, Homo sapiens
ttcatttacattttt

SEQ ID NO: 394107 - DNA, 15 bp, Homo sapiens
catttacatttttat

SEQ ID NO: 394108 - DNA, 15 bp, Homo sapiens
atttacatttttata

SEQ ID NO: 394109 - DNA, 15 bp, Homo sapiens
tttacatttttatat

SEQ ID NO: 394110 - DNA, 15 bp, Homo sapiens
ttacatttttatatt

SEQ ID NO: 394111 - DNA, 15 bp, Homo sapiens
tacatttttatatta

SEQ ID NO: 394112 - DNA, 15 bp, Homo sapiens
acatttttatattaa

SEQ ID NO: 394113 - DNA, 15 bp, Homo sapiens
catttttatattaat

SEQ ID NO: 394114 - DNA, 15 bp, Homo sapiens
atttttatattaata

SEQ ID NO: 394115 - DNA, 15 bp, Homo sapiens
tttttatattaataa

SEQ ID NO: 394116 - DNA, 15 bp, Homo sapiens
ttttatattaataaa

SEQ ID NO: 394117 - DNA, 15 bp, Homo sapiens
tttatattaataaaa

SEQ ID NO: 394118 - DNA, 15 bp, Homo sapiens
ttatattaataaaaa

SEQ ID NO: 394119 - DNA, 15 bp, Homo sapiens
tatattaataaaaaa

SEQ ID NO: 394120 - DNA, 15 bp, Homo sapiens
atattaataaaaaag

SEQ ID NO: 394121 - DNA, 15 bp, Homo sapiens
tattaataaaaaagt

SEQ ID NO: 394122 - DNA, 15 bp, Homo sapiens
attaataaaaaagtt

SEQ ID NO: 394123 - DNA, 15 bp, Homo sapiens
ttaataaaaaagttg

SEQ ID NO: 394124 - DNA, 15 bp, Homo sapiens
taataaaaaagttgc

SEQ ID NO: 394125 - DNA, 15 bp, Homo sapiens
aataaaaaagttgcc

SEQ ID NO: 394126 - DNA, 15 bp, Homo sapiens
ataaaaaagttgccc

SEQ ID NO: 394127 - DNA, 15 bp, Homo sapiens
taaaaaagttgccct

SEQ ID NO: 394128 - DNA, 15 bp, Homo sapiens
aaaaaagttgccctt

SEQ ID NO: 394129 - DNA, 15 bp, Homo sapiens
aaaaagttgcccttt

SEQ ID NO: 394130 - DNA, 15 bp, Homo sapiens
aaaagttgccctttt

SEQ ID NO: 394131 - DNA, 15 bp, Homo sapiens
aaagttgcccttttg

SEQ ID NO: 394132 - DNA, 15 bp, Homo sapiens
aagttgcccttttga

SEQ ID NO: 394133 - DNA, 15 bp, Homo sapiens
agttgcccttttgat

SEQ ID NO: 394134 - DNA, 15 bp, Homo sapiens
gttgcccttttgatt

SEQ ID NO: 394135 - DNA, 15 bp, Homo sapiens
ttgcccttttgattg

SEQ ID NO: 394136 - DNA, 15 bp, Homo sapiens
tgcccttttgattgc

SEQ ID NO: 394137 - DNA, 15 bp, Homo sapiens
gcccttttgattgcc

SEQ ID NO: 394138 - DNA, 15 bp, Homo sapiens
cccttttgattgcca

SEQ ID NO: 394139 - DNA, 15 bp, Homo sapiens
ccttttgattgccag

SEQ ID NO: 394140 - DNA, 15 bp, Homo sapiens
cttttgattgccagc

SEQ ID NO: 394141 - DNA, 15 bp, Homo sapiens
ttttgattgccagct

SEQ ID NO: 394142 - DNA, 15 bp, Homo sapiens
tttgattgccagcta

SEQ ID NO: 394143 - DNA, 15 bp, Homo sapiens
ttgattgccagctat

SEQ ID NO: 394144 - DNA, 15 bp, Homo sapiens
tgattgccagctatg

SEQ ID NO: 394145 - DNA, 15 bp, Homo sapiens
gattgccagctatgt

SEQ ID NO: 394146 - DNA, 15 bp, Homo sapiens
attgccagctatgta

SEQ ID NO: 394147 - DNA, 15 bp, Homo sapiens
ttgccagctatgtat

SEQ ID NO: 394148 - DNA, 15 bp, Homo sapiens
tgccagctatgtatg

SEQ ID NO: 394149 - DNA, 15 bp, Homo sapiens
gccagctatgtatgc

SEQ ID NO: 394150 - DNA, 15 bp, Homo sapiens
ccagctatgtatgcc

SEQ ID NO: 394151 - DNA, 15 bp, Homo sapiens
cagctatgtatgcca

SEQ ID NO: 394152 - DNA, 15 bp, Homo sapiens
agctatgtatgccag

SEQ ID NO: 394153 - DNA, 15 bp, Homo sapiens
gctatgtatgccaga

SEQ ID NO: 394154 - DNA, 15 bp, Homo sapiens
ctatgtatgccagat

SEQ ID NO: 394155 - DNA, 15 bp, Homo sapiens
tatgtatgccagatc

SEQ ID NO: 394156 - DNA, 15 bp, Homo sapiens
atgtatgccagatct

SEQ ID NO: 394157 - DNA, 15 bp, Homo sapiens
tgtatgccagatctt

SEQ ID NO: 394158 - DNA, 15 bp, Homo sapiens
gtatgccagatcttt

SEQ ID NO: 394159 - DNA, 15 bp, Homo sapiens
tatgccagatctttt

SEQ ID NO: 394160 - DNA, 15 bp, Homo sapiens
atgccagatcttttt

SEQ ID NO: 394161 - DNA, 15 bp, Homo sapiens
tgccagatctttttg

SEQ ID NO: 394162 - DNA, 15 bp, Homo sapiens
gccagatctttttga

SEQ ID NO: 394163 - DNA, 15 bp, Homo sapiens
ccagatctttttgac

SEQ ID NO: 394164 - DNA, 15 bp, Homo sapiens
cagatctttttgact

SEQ ID NO: 394165 - DNA, 15 bp, Homo sapiens
agatctttttgactg

SEQ ID NO: 394166 - DNA, 15 bp, Homo sapiens
gatctttttgactgt

SEQ ID NO: 394167 - DNA, 15 bp, Homo sapiens
atctttttgactgtt

SEQ ID NO: 394168 - DNA, 15 bp, Homo sapiens
tctttttgactgttt

SEQ ID NO: 394169 - DNA, 15 bp, Homo sapiens
ctttttgactgtttc

SEQ ID NO: 394170 - DNA, 15 bp, Homo sapiens
tttttgactgtttcc

SEQ ID NO: 394171 - DNA, 15 bp, Homo sapiens
ttttgactgtttcca

SEQ ID NO: 394172 - DNA, 15 bp, Homo sapiens
tttgactgtttccaa

SEQ ID NO: 394173 - DNA, 15 bp, Homo sapiens
ttgactgtttccaaa

SEQ ID NO: 394174 - DNA, 15 bp, Homo sapiens
tgactgtttccaaaa

SEQ ID NO: 394175 - DNA, 15 bp, Homo sapiens
gactgtttccaaaat

SEQ ID NO: 394176 - DNA, 15 bp, Homo sapiens
actgtttccaaaatt

SEQ ID NO: 394177 - DNA, 15 bp, Homo sapiens
ctgtttccaaaattt

SEQ ID NO: 394178 - DNA, 15 bp, Homo sapiens
tgtttccaaaattta

SEQ ID NO: 394179 - DNA, 15 bp, Homo sapiens
gtttccaaaatttag

SEQ ID NO: 394180 - DNA, 15 bp, Homo sapiens
tttccaaaatttagt

SEQ ID NO: 394181 - DNA, 15 bp, Homo sapiens
ttccaaaatttagtt

SEQ ID NO: 394182 - DNA, 15 bp, Homo sapiens
tccaaaatttagttc

SEQ ID NO: 394183 - DNA, 15 bp, Homo sapiens
ccaaaatttagttca

SEQ ID NO: 394184 - DNA, 15 bp, Homo sapiens
caaaatttagttcat

SEQ ID NO: 394185 - DNA, 15 bp, Homo sapiens
aaaatttagttcatt

SEQ ID NO: 394186 - DNA, 15 bp, Homo sapiens
aaatttagttcattt

SEQ ID NO: 394187 - DNA, 15 bp, Homo sapiens
aatttagttcatttt

SEQ ID NO: 394188 - DNA, 15 bp, Homo sapiens
atttagttcattttc

SEQ ID NO: 394189 - DNA, 15 bp, Homo sapiens
tttagttcattttca

SEQ ID NO: 394190 - DNA, 15 bp, Homo sapiens
ttagttcattttcaa

SEQ ID NO: 394191 - DNA, 15 bp, Homo sapiens
tagttcattttcaaa

SEQ ID NO: 394192 - DNA, 15 bp, Homo sapiens
agttcattttcaaag

SEQ ID NO: 394193 - DNA, 15 bp, Homo sapiens
gttcattttcaaagg

SEQ ID NO: 394194 - DNA, 15 bp, Homo sapiens
ttcattttcaaagga

SEQ ID NO: 394195 - DNA, 15 bp, Homo sapiens
tcattttcaaaggaa

SEQ ID NO: 394196 - DNA, 15 bp, Homo sapiens
cattttcaaaggaaa

SEQ ID NO: 394197 - DNA, 15 bp, Homo sapiens
attttcaaaggaaaa

SEQ ID NO: 394198 - DNA, 15 bp, Homo sapiens
ttttcaaaggaaaaa

SEQ ID NO: 394199 - DNA, 15 bp, Homo sapiens
tttcaaaggaaaaat

SEQ ID NO: 394200 - DNA, 15 bp, Homo sapiens
ttcaaaggaaaaata

SEQ ID NO: 394201 - DNA, 15 bp, Homo sapiens
tcaaaggaaaaatat

SEQ ID NO: 394202 - DNA, 15 bp, Homo sapiens
caaaggaaaaatatt

SEQ ID NO: 394203 - DNA, 15 bp, Homo sapiens
aaaggaaaaatattt

SEQ ID NO: 394204 - DNA, 15 bp, Homo sapiens
aaggaaaaatatttg

SEQ ID NO: 394205 - DNA, 15 bp, Homo sapiens
aggaaaaatatttgt

SEQ ID NO: 394206 - DNA, 15 bp, Homo sapiens
ggaaaaatatttgtg

SEQ ID NO: 394207 - DNA, 15 bp, Homo sapiens
gaaaaatatttgtga

SEQ ID NO: 394208 - DNA, 15 bp, Homo sapiens
aaaaatatttgtgaa

SEQ ID NO: 394209 - DNA, 15 bp, Homo sapiens
aaaatatttgtgaat

SEQ ID NO: 394210 - DNA, 15 bp, Homo sapiens
aaatatttgtgaata

SEQ ID NO: 394211 - DNA, 15 bp, Homo sapiens
aatatttgtgaatat

SEQ ID NO: 394212 - DNA, 15 bp, Homo sapiens
atatttgtgaatatt

SEQ ID NO: 394213 - DNA, 15 bp, Homo sapiens
tatttgtgaatattg

SEQ ID NO: 394214 - DNA, 15 bp, Homo sapiens
atttgtgaatattgg

SEQ ID NO: 394215 - DNA, 15 bp, Homo sapiens
tttgtgaatattgga

SEQ ID NO: 394216 - DNA, 15 bp, Homo sapiens
ttgtgaatattggag

SEQ ID NO: 394217 - DNA, 15 bp, Homo sapiens
tgtgaatattggaga

SEQ ID NO: 394218 - DNA, 15 bp, Homo sapiens
gtgaatattggagat

SEQ ID NO: 394219 - DNA, 15 bp, Homo sapiens
tgaatattggagata

SEQ ID NO: 394220 - DNA, 15 bp, Homo sapiens
gaatattggagatac

SEQ ID NO: 394221 - DNA, 15 bp, Homo sapiens
aatattggagatact

SEQ ID NO: 394222 - DNA, 15 bp, Homo sapiens
atattggagatactc

SEQ ID NO: 394223 - DNA, 15 bp, Homo sapiens
tattggagatactca

SEQ ID NO: 394224 - DNA, 15 bp, Homo sapiens
attggagatactcaa

SEQ ID NO: 394225 - DNA, 15 bp, Homo sapiens
ttggagatactcaaa

SEQ ID NO: 394226 - DNA, 15 bp, Homo sapiens
tggagatactcaaac

SEQ ID NO: 394227 - DNA, 15 bp, Homo sapiens
ggagatactcaaaca

SEQ ID NO: 394228 - DNA, 15 bp, Homo sapiens
gagatactcaaacac

SEQ ID NO: 394229 - DNA, 15 bp, Homo sapiens
agatactcaaacaca

SEQ ID NO: 394230 - DNA, 15 bp, Homo sapiens
gatactcaaacacag

SEQ ID NO: 394231 - DNA, 15 bp, Homo sapiens
atactcaaacacaga

SEQ ID NO: 394232 - DNA, 15 bp, Homo sapiens
tactcaaacacagac

SEQ ID NO: 394233 - DNA, 15 bp, Homo sapiens
actcaaacacagaca

SEQ ID NO: 394234 - DNA, 15 bp, Homo sapiens
ctcaaacacagacag

SEQ ID NO: 394235 - DNA, 15 bp, Homo sapiens
tcaaacacagacagc

SEQ ID NO: 394236 - DNA, 15 bp, Homo sapiens
caaacacagacagca

SEQ ID NO: 394237 - DNA, 15 bp, Homo sapiens
aaacacagacagcat

SEQ ID NO: 394238 - DNA, 15 bp, Homo sapiens
aacacagacagcatt

SEQ ID NO: 394239 - DNA, 15 bp, Homo sapiens
acacagacagcattt

SEQ ID NO: 394240 - DNA, 15 bp, Homo sapiens
cacagacagcatttc

SEQ ID NO: 394241 - DNA, 15 bp, Homo sapiens
acagacagcatttcc

SEQ ID NO: 394242 - DNA, 15 bp, Homo sapiens
cagacagcatttcca

SEQ ID NO: 394243 - DNA, 15 bp, Homo sapiens
agacagcatttccaa

SEQ ID NO: 394244 - DNA, 15 bp, Homo sapiens
gacagcatttccaaa

SEQ ID NO: 394245 - DNA, 15 bp, Homo sapiens
acagcatttccaaaa

SEQ ID NO: 394246 - DNA, 15 bp, Homo sapiens
cagcatttccaaaaa

SEQ ID NO: 394247 - DNA, 15 bp, Homo sapiens
agcatttccaaaaag

SEQ ID NO: 394248 - DNA, 15 bp, Homo sapiens
gcatttccaaaaagg

SEQ ID NO: 394249 - DNA, 15 bp, Homo sapiens
catttccaaaaagga

SEQ ID NO: 394250 - DNA, 15 bp, Homo sapiens
atttccaaaaaggaa

SEQ ID NO: 394251 - DNA, 15 bp, Homo sapiens
tttccaaaaaggaat

SEQ ID NO: 394252 - DNA, 15 bp, Homo sapiens
ttccaaaaaggaatt

SEQ ID NO: 394253 - DNA, 15 bp, Homo sapiens
tccaaaaaggaattc

SEQ ID NO: 394254 - DNA, 15 bp, Homo sapiens
ccaaaaaggaattct

SEQ ID NO: 394255 - DNA, 15 bp, Homo sapiens
caaaaaggaattcta

SEQ ID NO: 394256 - DNA, 15 bp, Homo sapiens
aaaaaggaattctaa

SEQ ID NO: 394257 - DNA, 15 bp, Homo sapiens
aaaaggaattctaaa

SEQ ID NO: 394258 - DNA, 15 bp, Homo sapiens
aaaggaattctaaaa

SEQ ID NO: 394259 - DNA, 15 bp, Homo sapiens
aaggaattctaaaaa

SEQ ID NO: 394260 - DNA, 15 bp, Homo sapiens
aggaattctaaaaaa

SEQ ID NO: 394261 - DNA, 15 bp, Homo sapiens
ggaattctaaaaaag

SEQ ID NO: 394262 - DNA, 15 bp, Homo sapiens
gaattctaaaaaaga

SEQ ID NO: 394263 - DNA, 15 bp, Homo sapiens
aattctaaaaaagaa

SEQ ID NO: 394264 - DNA, 15 bp, Homo sapiens
attctaaaaaagaaa

SEQ ID NO: 394265 - DNA, 15 bp, Homo sapiens
ttctaaaaaagaaat

SEQ ID NO: 394266 - DNA, 15 bp, Homo sapiens
tctaaaaaagaaatt

SEQ ID NO: 394267 - DNA, 15 bp, Homo sapiens
ctaaaaaagaaattg

SEQ ID NO: 394268 - DNA, 15 bp, Homo sapiens
taaaaaagaaattgc

SEQ ID NO: 394269 - DNA, 15 bp, Homo sapiens
aaaaaagaaattgca

SEQ ID NO: 394270 - DNA, 15 bp, Homo sapiens
aaaaagaaattgcat

SEQ ID NO: 394271 - DNA, 15 bp, Homo sapiens
aaaagaaattgcata

SEQ ID NO: 394272 - DNA, 15 bp, Homo sapiens
aaagaaattgcataa

SEQ ID NO: 394273 - DNA, 15 bp, Homo sapiens
aagaaattgcataat

SEQ ID NO: 394274 - DNA, 15 bp, Homo sapiens
agaaattgcataata

SEQ ID NO: 394275 - DNA, 15 bp, Homo sapiens
gaaattgcataatat

SEQ ID NO: 394276 - DNA, 15 bp, Homo sapiens
aaattgcataatatt

SEQ ID NO: 394277 - DNA, 15 bp, Homo sapiens
aattgcataatattt

SEQ ID NO: 394278 - DNA, 15 bp, Homo sapiens
attgcataatatttg

SEQ ID NO: 394279 - DNA, 15 bp, Homo sapiens
ttgcataatatttgt

SEQ ID NO: 394280 - DNA, 15 bp, Homo sapiens
tgcataatatttgta

SEQ ID NO: 394281 - DNA, 15 bp, Homo sapiens
gcataatatttgtat

SEQ ID NO: 394282 - DNA, 15 bp, Homo sapiens
cataatatttgtatc

SEQ ID NO: 394283 - DNA, 15 bp, Homo sapiens
ataatatttgtatct

SEQ ID NO: 394284 - DNA, 15 bp, Homo sapiens
taatatttgtatctt

SEQ ID NO: 394285 - DNA, 15 bp, Homo sapiens
aatatttgtatcttt

SEQ ID NO: 394286 - DNA, 15 bp, Homo sapiens
atatttgtatcttta

SEQ ID NO: 394287 - DNA, 15 bp, Homo sapiens
tatttgtatctttaa

SEQ ID NO: 394288 - DNA, 15 bp, Homo sapiens
atttgtatctttaaa

SEQ ID NO: 394289 - DNA, 15 bp, Homo sapiens
tttgtatctttaaaa

SEQ ID NO: 394290 - DNA, 15 bp, Homo sapiens
ttgtatctttaaaat

SEQ ID NO: 394291 - DNA, 15 bp, Homo sapiens
tgtatctttaaaata

SEQ ID NO: 394292 - DNA, 15 bp, Homo sapiens
gtatctttaaaataa

SEQ ID NO: 394293 - DNA, 15 bp, Homo sapiens
tatctttaaaataag

SEQ ID NO: 394294 - DNA, 15 bp, Homo sapiens
atctttaaaataagg

SEQ ID NO: 394295 - DNA, 15 bp, Homo sapiens
tctttaaaataagga

SEQ ID NO: 394296 - DNA, 15 bp, Homo sapiens
ctttaaaataaggac

SEQ ID NO: 394297 - DNA, 15 bp, Homo sapiens
tttaaaataaggaca

SEQ ID NO: 394298 - DNA, 15 bp, Homo sapiens
ttaaaataaggacat

SEQ ID NO: 394299 - DNA, 15 bp, Homo sapiens
taaaataaggacata

SEQ ID NO: 394300 - DNA, 15 bp, Homo sapiens
aaaataaggacataa

SEQ ID NO: 394301 - DNA, 15 bp, Homo sapiens
aaataaggacataat

SEQ ID NO: 394302 - DNA, 15 bp, Homo sapiens
aataaggacataatt

SEQ ID NO: 394303 - DNA, 15 bp, Homo sapiens
ataaggacataattc

SEQ ID NO: 394304 - DNA, 15 bp, Homo sapiens
taaggacataattct

SEQ ID NO: 394305 - DNA, 15 bp, Homo sapiens
aaggacataattctt

SEQ ID NO: 394306 - DNA, 15 bp, Homo sapiens
aggacataattcttc

SEQ ID NO: 394307 - DNA, 15 bp, Homo sapiens
ggacataattcttca

SEQ ID NO: 394308 - DNA, 15 bp, Homo sapiens
gacataattcttcag

SEQ ID NO: 394309 - DNA, 15 bp, Homo sapiens
acataattcttcaga

SEQ ID NO: 394310 - DNA, 15 bp, Homo sapiens
cataattcttcagaa

SEQ ID NO: 394311 - DNA, 15 bp, Homo sapiens
ataattcttcagaat

SEQ ID NO: 394312 - DNA, 15 bp, Homo sapiens
taattcttcagaatg

SEQ ID NO: 394313 - DNA, 15 bp, Homo sapiens
aattcttcagaatgc

SEQ ID NO: 394314 - DNA, 15 bp, Homo sapiens
attcttcagaatgcc

SEQ ID NO: 394315 - DNA, 15 bp, Homo sapiens
ttcttcagaatgcct

SEQ ID NO: 394316 - DNA, 15 bp, Homo sapiens
tcttcagaatgcctc

SEQ ID NO: 394317 - DNA, 15 bp, Homo sapiens
cttcagaatgcctct

SEQ ID NO: 394318 - DNA, 15 bp, Homo sapiens
ttcagaatgcctctt

SEQ ID NO: 394319 - DNA, 15 bp, Homo sapiens
tcagaatgcctcttt

SEQ ID NO: 394320 - DNA, 15 bp, Homo sapiens
cagaatgcctctttt

SEQ ID NO: 394321 - DNA, 15 bp, Homo sapiens
agaatgcctctttta

SEQ ID NO: 394322 - DNA, 15 bp, Homo sapiens
gaatgcctcttttaa

SEQ ID NO: 394323 - DNA, 15 bp, Homo sapiens
aatgcctcttttaaa

SEQ ID NO: 394324 - DNA, 15 bp, Homo sapiens
atgcctcttttaaag

SEQ ID NO: 394325 - DNA, 15 bp, Homo sapiens
tgcctcttttaaagg

SEQ ID NO: 394326 - DNA, 15 bp, Homo sapiens
gcctcttttaaagga

SEQ ID NO: 394327 - DNA, 15 bp, Homo sapiens
cctcttttaaaggaa

SEQ ID NO: 394328 - DNA, 15 bp, Homo sapiens
ctcttttaaaggaaa

SEQ ID NO: 394329 - DNA, 15 bp, Homo sapiens
tcttttaaaggaaac

SEQ ID NO: 394330 - DNA, 15 bp, Homo sapiens
cttttaaaggaaaca

SEQ ID NO: 394331 - DNA, 15 bp, Homo sapiens
ttttaaaggaaacag

SEQ ID NO: 394332 - DNA, 15 bp, Homo sapiens
tttaaaggaaacagc

SEQ ID NO: 394333 - DNA, 15 bp, Homo sapiens
ttaaaggaaacagcc

SEQ ID NO: 394334 - DNA, 15 bp, Homo sapiens
taaaggaaacagcct

SEQ ID NO: 394335 - DNA, 15 bp, Homo sapiens
aaaggaaacagcctt

SEQ ID NO: 394336 - DNA, 15 bp, Homo sapiens
aaggaaacagccttc

SEQ ID NO: 394337 - DNA, 15 bp, Homo sapiens
aggaaacagccttct

SEQ ID NO: 394338 - DNA, 15 bp, Homo sapiens
ggaaacagccttctt

SEQ ID NO: 394339 - DNA, 15 bp, Homo sapiens
gaaacagccttcttt

SEQ ID NO: 394340 - DNA, 15 bp, Homo sapiens
aaacagccttctttt

SEQ ID NO: 394341 - DNA, 15 bp, Homo sapiens
aacagccttcttttg

SEQ ID NO: 394342 - DNA, 15 bp, Homo sapiens
acagccttcttttgg

SEQ ID NO: 394343 - DNA, 15 bp, Homo sapiens
cagccttcttttgga

SEQ ID NO: 394344 - DNA, 15 bp, Homo sapiens
agccttcttttggat

SEQ ID NO: 394345 - DNA, 15 bp, Homo sapiens
gccttcttttggatg

SEQ ID NO: 394346 - DNA, 15 bp, Homo sapiens
ccttcttttggatgt

SEQ ID NO: 394347 - DNA, 15 bp, Homo sapiens
cttcttttggatgta

SEQ ID NO: 394348 - DNA, 15 bp, Homo sapiens
ttcttttggatgtaa

SEQ ID NO: 394349 - DNA, 15 bp, Homo sapiens
tcttttggatgtaag

SEQ ID NO: 394350 - DNA, 15 bp, Homo sapiens
cttttggatgtaagt

SEQ ID NO: 394351 - DNA, 15 bp, Homo sapiens
ttttggatgtaagtc

SEQ ID NO: 394352 - DNA, 15 bp, Homo sapiens
tttggatgtaagtca

SEQ ID NO: 394353 - DNA, 15 bp, Homo sapiens
ttggatgtaagtcag

SEQ ID NO: 394354 - DNA, 15 bp, Homo sapiens
tggatgtaagtcagt

SEQ ID NO: 394355 - DNA, 15 bp, Homo sapiens
ggatgtaagtcagtt

SEQ ID NO: 394356 - DNA, 15 bp, Homo sapiens
gatgtaagtcagttt

SEQ ID NO: 394357 - DNA, 15 bp, Homo sapiens
atgtaagtcagtttg

SEQ ID NO: 394358 - DNA, 15 bp, Homo sapiens
tgtaagtcagtttgg

SEQ ID NO: 394359 - DNA, 15 bp, Homo sapiens
gtaagtcagtttggt

SEQ ID NO: 394360 - DNA, 15 bp, Homo sapiens
taagtcagtttggta

SEQ ID NO: 394361 - DNA, 15 bp, Homo sapiens
aagtcagtttggtat

SEQ ID NO: 394362 - DNA, 15 bp, Homo sapiens
agtcagtttggtatg

SEQ ID NO: 394363 - DNA, 15 bp, Homo sapiens
gtcagtttggtatgg

SEQ ID NO: 394364 - DNA, 15 bp, Homo sapiens
tcagtttggtatggg

SEQ ID NO: 394365 - DNA, 15 bp, Homo sapiens
cagtttggtatggga

SEQ ID NO: 394366 - DNA, 15 bp, Homo sapiens
agtttggtatgggag

SEQ ID NO: 394367 - DNA, 15 bp, Homo sapiens
gtttggtatgggagt

SEQ ID NO: 394368 - DNA, 15 bp, Homo sapiens
tttggtatgggagtg

SEQ ID NO: 394369 - DNA, 15 bp, Homo sapiens
ttggtatgggagtga

SEQ ID NO: 394370 - DNA, 15 bp, Homo sapiens
tggtatgggagtgac

SEQ ID NO: 394371 - DNA, 15 bp, Homo sapiens
ggtatgggagtgaca

SEQ ID NO: 394372 - DNA, 15 bp, Homo sapiens
gtatgggagtgacaa

SEQ ID NO: 394373 - DNA, 15 bp, Homo sapiens
tatgggagtgacaaa

SEQ ID NO: 394374 - DNA, 15 bp, Homo sapiens
atgggagtgacaaaa

SEQ ID NO: 394375 - DNA, 15 bp, Homo sapiens
tgggagtgacaaaaa

SEQ ID NO: 394376 - DNA, 15 bp, Homo sapiens
gggagtgacaaaaat

SEQ ID NO: 394377 - DNA, 15 bp, Homo sapiens
gagtgacaaaaatgt

SEQ ID NO: 394378 - DNA, 15 bp, Homo sapiens
agtgacaaaaatgtt

SEQ ID NO: 394379 - DNA, 15 bp, Homo sapiens
gtgacaaaaatgtta

SEQ ID NO: 394380 - DNA, 15 bp, Homo sapiens
tgacaaaaatgttat

SEQ ID NO: 394381 - DNA, 15 bp, Homo sapiens
gacaaaaatgttata

SEQ ID NO: 394382 - DNA, 15 bp, Homo sapiens
acaaaaatgttatac

SEQ ID NO: 394383 - DNA, 15 bp, Homo sapiens
caaaaatgttatact

SEQ ID NO: 394384 - DNA, 15 bp, Homo sapiens
aaaaatgttatactt

SEQ ID NO: 394385 - DNA, 15 bp, Homo sapiens
aaaatgttatacttt

SEQ ID NO: 394386 - DNA, 15 bp, Homo sapiens
aaatgttatactttt

SEQ ID NO: 394387 - DNA, 15 bp, Homo sapiens
aatgttatactttta

SEQ ID NO: 394388 - DNA, 15 bp, Homo sapiens
atgttatacttttat

SEQ ID NO: 394389 - DNA, 15 bp, Homo sapiens
tgttatacttttatg

SEQ ID NO: 394390 - DNA, 15 bp, Homo sapiens
gttatacttttatgt

SEQ ID NO: 394391 - DNA, 15 bp, Homo sapiens
ttatacttttatgtt

SEQ ID NO: 394392 - DNA, 15 bp, Homo sapiens
tatacttttatgtta

SEQ ID NO: 394393 - DNA, 15 bp, Homo sapiens
atacttttatgttat

SEQ ID NO: 394394 - DNA, 15 bp, Homo sapiens
tacttttatgttatg

SEQ ID NO: 394395 - DNA, 15 bp, Homo sapiens
acttttatgttatga

SEQ ID NO: 394396 - DNA, 15 bp, Homo sapiens
cttttatgttatgac

SEQ ID NO: 394397 - DNA, 15 bp, Homo sapiens
ttttatgttatgact

SEQ ID NO: 394398 - DNA, 15 bp, Homo sapiens
tttatgttatgactt

SEQ ID NO: 394399 - DNA, 15 bp, Homo sapiens
ttatgttatgactta

SEQ ID NO: 394400 - DNA, 15 bp, Homo sapiens
tatgttatgacttag

SEQ ID NO: 394401 - DNA, 15 bp, Homo sapiens
atgttatgacttagt

SEQ ID NO: 394402 - DNA, 15 bp, Homo sapiens
tgttatgacttagtt

SEQ ID NO: 394403 - DNA, 15 bp, Homo sapiens
gttatgacttagttg

SEQ ID NO: 394404 - DNA, 15 bp, Homo sapiens
ttatgacttagttga

SEQ ID NO: 394405 - DNA, 15 bp, Homo sapiens
tatgacttagttgat

SEQ ID NO: 394406 - DNA, 15 bp, Homo sapiens
atgacttagttgatg

SEQ ID NO: 394407 - DNA, 15 bp, Homo sapiens
tgacttagttgatga

SEQ ID NO: 394408 - DNA, 15 bp, Homo sapiens
gacttagttgatgag

SEQ ID NO: 394409 - DNA, 15 bp, Homo sapiens
acttagttgatgagg

SEQ ID NO: 394410 - DNA, 15 bp, Homo sapiens
cttagttgatgaggg

SEQ ID NO: 394411 - DNA, 15 bp, Homo sapiens
ttagttgatgaggga

SEQ ID NO: 394412 - DNA, 15 bp, Homo sapiens
tagttgatgagggaa

SEQ ID NO: 394413 - DNA, 15 bp, Homo sapiens
agttgatgagggaat

SEQ ID NO: 394414 - DNA, 15 bp, Homo sapiens
gttgatgagggaatt

SEQ ID NO: 394415 - DNA, 15 bp, Homo sapiens
ttgatgagggaatta

SEQ ID NO: 394416 - DNA, 15 bp, Homo sapiens
tgatgagggaattac

SEQ ID NO: 394417 - DNA, 15 bp, Homo sapiens
gatgagggaattaca

SEQ ID NO: 394418 - DNA, 15 bp, Homo sapiens
atgagggaattacac

SEQ ID NO: 394419 - DNA, 15 bp, Homo sapiens
tgagggaattacaca

SEQ ID NO: 394420 - DNA, 15 bp, Homo sapiens
gagggaattacacaa

SEQ ID NO: 394421 - DNA, 15 bp, Homo sapiens
agggaattacacaat

SEQ ID NO: 394422 - DNA, 15 bp, Homo sapiens
gggaattacacaata

SEQ ID NO: 394423 - DNA, 15 bp, Homo sapiens
ggaattacacaatat

SEQ ID NO: 394424 - DNA, 15 bp, Homo sapiens
gaattacacaatatt

SEQ ID NO: 394425 - DNA, 15 bp, Homo sapiens
aattacacaatattt

SEQ ID NO: 394426 - DNA, 15 bp, Homo sapiens
attacacaatatttc

SEQ ID NO: 394427 - DNA, 15 bp, Homo sapiens
ttacacaatatttca

SEQ ID NO: 394428 - DNA, 15 bp, Homo sapiens
tacacaatatttcaa

SEQ ID NO: 394429 - DNA, 15 bp, Homo sapiens
acacaatatttcaag

SEQ ID NO: 394430 - DNA, 15 bp, Homo sapiens
cacaatatttcaagc

SEQ ID NO: 394431 - DNA, 15 bp, Homo sapiens
acaatatttcaagca

SEQ ID NO: 394432 - DNA, 15 bp, Homo sapiens
caatatttcaagcaa

SEQ ID NO: 394433 - DNA, 15 bp, Homo sapiens
aatatttcaagcaaa

SEQ ID NO: 394434 - DNA, 15 bp, Homo sapiens
atatttcaagcaaaa

SEQ ID NO: 394435 - DNA, 15 bp, Homo sapiens
tatttcaagcaaaaa

SEQ ID NO: 394436 - DNA, 15 bp, Homo sapiens
atttcaagcaaaaat

SEQ ID NO: 394437 - DNA, 15 bp, Homo sapiens
tttcaagcaaaaatg

SEQ ID NO: 394438 - DNA, 15 bp, Homo sapiens
ttcaagcaaaaatga

SEQ ID NO: 394439 - DNA, 15 bp, Homo sapiens
tcaagcaaaaatgaa

SEQ ID NO: 394440 - DNA, 15 bp, Homo sapiens
caagcaaaaatgaaa

SEQ ID NO: 394441 - DNA, 15 bp, Homo sapiens
aagcaaaaatgaaaa

SEQ ID NO: 394442 - DNA, 15 bp, Homo sapiens
agcaaaaatgaaaaa

SEQ ID NO: 394443 - DNA, 15 bp, Homo sapiens
gcaaaaatgaaaaat

SEQ ID NO: 394444 - DNA, 15 bp, Homo sapiens
caaaaatgaaaaata

SEQ ID NO: 394445 - DNA, 15 bp, Homo sapiens
aaaaatgaaaaataa

SEQ ID NO: 394446 - DNA, 15 bp, Homo sapiens
aaaatgaaaaataat

SEQ ID NO: 394447 - DNA, 15 bp, Homo sapiens
aaatgaaaaataatt

SEQ ID NO: 394448 - DNA, 15 bp, Homo sapiens
aatgaaaaataattc

SEQ ID NO: 394449 - DNA, 15 bp, Homo sapiens
atgaaaaataattca

SEQ ID NO: 394450 - DNA, 15 bp, Homo sapiens
tgaaaaataattcac

SEQ ID NO: 394451 - DNA, 15 bp, Homo sapiens
gaaaaataattcaca

SEQ ID NO: 394452 - DNA, 15 bp, Homo sapiens
aaaaataattcacag

SEQ ID NO: 394453 - DNA, 15 bp, Homo sapiens
aaaataattcacagt

SEQ ID NO: 394454 - DNA, 15 bp, Homo sapiens
aaataattcacagta

SEQ ID NO: 394455 - DNA, 15 bp, Homo sapiens
aataattcacagtag

SEQ ID NO: 394456 - DNA, 15 bp, Homo sapiens
ataattcacagtaga

SEQ ID NO: 394457 - DNA, 15 bp, Homo sapiens
taattcacagtagaa

SEQ ID NO: 394458 - DNA, 15 bp, Homo sapiens
aattcacagtagaag

SEQ ID NO: 394459 - DNA, 15 bp, Homo sapiens
attcacagtagaagt

SEQ ID NO: 394460 - DNA, 15 bp, Homo sapiens
ttcacagtagaagtc

SEQ ID NO: 394461 - DNA, 15 bp, Homo sapiens
cagtagaagtcagtc

SEQ ID NO: 394462 - DNA, 15 bp, Homo sapiens
agtagaagtcagtct

SEQ ID NO: 394463 - DNA, 15 bp, Homo sapiens
gtagaagtcagtctg

SEQ ID NO: 394464 - DNA, 15 bp, Homo sapiens
tagaagtcagtctgt

SEQ ID NO: 394465 - DNA, 15 bp, Homo sapiens
agaagtcagtctgtc

SEQ ID NO: 394466 - DNA, 15 bp, Homo sapiens
gaagtcagtctgtct

SEQ ID NO: 394467 - DNA, 15 bp, Homo sapiens
aagtcagtctgtcta

SEQ ID NO: 394468 - DNA, 15 bp, Homo sapiens
agtcagtctgtctag

SEQ ID NO: 394469 - DNA, 15 bp, Homo sapiens
gtcagtctgtctaga

SEQ ID NO: 394470 - DNA, 15 bp, Homo sapiens
tcagtctgtctagaa

SEQ ID NO: 394471 - DNA, 15 bp, Homo sapiens
cagtctgtctagaat

SEQ ID NO: 394472 - DNA, 15 bp, Homo sapiens
agtctgtctagaatt

SEQ ID NO: 394473 - DNA, 15 bp, Homo sapiens
gtctgtctagaatta

SEQ ID NO: 394474 - DNA, 15 bp, Homo sapiens
tctgtctagaattaa

SEQ ID NO: 394475 - DNA, 15 bp, Homo sapiens
ctgtctagaattaaa

SEQ ID NO: 394476 - DNA, 15 bp, Homo sapiens
tgtctagaattaaat

SEQ ID NO: 394477 - DNA, 15 bp, Homo sapiens
gtctagaattaaatt

SEQ ID NO: 394478 - DNA, 15 bp, Homo sapiens
tctagaattaaatta

SEQ ID NO: 394479 - DNA, 15 bp, Homo sapiens
ctagaattaaattat

SEQ ID NO: 394480 - DNA, 15 bp, Homo sapiens
tagaattaaattata

SEQ ID NO: 394481 - DNA, 15 bp, Homo sapiens
agaattaaattatag

SEQ ID NO: 394482 - DNA, 15 bp, Homo sapiens
gaattaaattataga

SEQ ID NO: 394483 - DNA, 15 bp, Homo sapiens
aattaaattatagat

SEQ ID NO: 394484 - DNA, 15 bp, Homo sapiens
attaaattatagatt

SEQ ID NO: 394485 - DNA, 15 bp, Homo sapiens
ttaaattatagattt

SEQ ID NO: 394486 - DNA, 15 bp, Homo sapiens
taaattatagatttg

SEQ ID NO: 394487 - DNA, 15 bp, Homo sapiens
aaattatagatttgt

SEQ ID NO: 394488 - DNA, 15 bp, Homo sapiens
aattatagatttgta

SEQ ID NO: 394489 - DNA, 15 bp, Homo sapiens
attatagatttgtag

SEQ ID NO: 394490 - DNA, 15 bp, Homo sapiens
ttatagatttgtaga

SEQ ID NO: 394491 - DNA, 15 bp, Homo sapiens
tatagatttgtagaa

SEQ ID NO: 394492 - DNA, 15 bp, Homo sapiens
atagatttgtagaac

SEQ ID NO: 394493 - DNA, 15 bp, Homo sapiens
tagatttgtagaaca

SEQ ID NO: 394494 - DNA, 15 bp, Homo sapiens
agatttgtagaacat

SEQ ID NO: 394495 - DNA, 15 bp, Homo sapiens
gatttgtagaacatt

SEQ ID NO: 394496 - DNA, 15 bp, Homo sapiens
atttgtagaacatta

SEQ ID NO: 394497 - DNA, 15 bp, Homo sapiens
tttgtagaacattag

SEQ ID NO: 394498 - DNA, 15 bp, Homo sapiens
ttgtagaacattaga

SEQ ID NO: 394499 - DNA, 15 bp, Homo sapiens
tgtagaacattagag

SEQ ID NO: 394500 - DNA, 15 bp, Homo sapiens
gtagaacattagagt

SEQ ID NO: 394501 - DNA, 15 bp, Homo sapiens
tagaacattagagtt

SEQ ID NO: 394502 - DNA, 15 bp, Homo sapiens
agaacattagagttt

SEQ ID NO: 394503 - DNA, 15 bp, Homo sapiens
gaacattagagttta

SEQ ID NO: 394504 - DNA, 15 bp, Homo sapiens
aacattagagtttat

SEQ ID NO: 394505 - DNA, 15 bp, Homo sapiens
acattagagtttatg

SEQ ID NO: 394506 - DNA, 15 bp, Homo sapiens
cattagagtttatgg

SEQ ID NO: 394507 - DNA, 15 bp, Homo sapiens
attagagtttatgga

SEQ ID NO: 394508 - DNA, 15 bp, Homo sapiens
ttagagtttatggaa

SEQ ID NO: 394509 - DNA, 15 bp, Homo sapiens
tagagtttatggaaa

SEQ ID NO: 394510 - DNA, 15 bp, Homo sapiens
agagtttatggaaat

SEQ ID NO: 394511 - DNA, 15 bp, Homo sapiens
gagtttatggaaatt

SEQ ID NO: 394512 - DNA, 15 bp, Homo sapiens
agtttatggaaattg

SEQ ID NO: 394513 - DNA, 15 bp, Homo sapiens
gtttatggaaattgt

SEQ ID NO: 394514 - DNA, 15 bp, Homo sapiens
tttatggaaattgta

SEQ ID NO: 394515 - DNA, 15 bp, Homo sapiens
ttatggaaattgtag

SEQ ID NO: 394516 - DNA, 15 bp, Homo sapiens
tatggaaattgtaga

SEQ ID NO: 394517 - DNA, 15 bp, Homo sapiens
atggaaattgtagaa

SEQ ID NO: 394518 - DNA, 15 bp, Homo sapiens
tggaaattgtagaaa

SEQ ID NO: 394519 - DNA, 15 bp, Homo sapiens
ggaaattgtagaaat

SEQ ID NO: 394520 - DNA, 15 bp, Homo sapiens
gaaattgtagaaatg

SEQ ID NO: 394521 - DNA, 15 bp, Homo sapiens
aaattgtagaaatga

SEQ ID NO: 394522 - DNA, 15 bp, Homo sapiens
aattgtagaaatgac

SEQ ID NO: 394523 - DNA, 15 bp, Homo sapiens
attgtagaaatgacc

SEQ ID NO: 394524 - DNA, 15 bp, Homo sapiens
ttgtagaaatgacca

SEQ ID NO: 394525 - DNA, 15 bp, Homo sapiens
tgtagaaatgaccaa

SEQ ID NO: 394526 - DNA, 15 bp, Homo sapiens
gtagaaatgaccaat

SEQ ID NO: 394527 - DNA, 15 bp, Homo sapiens
tagaaatgaccaatt

SEQ ID NO: 394528 - DNA, 15 bp, Homo sapiens
agaaatgaccaattt

SEQ ID NO: 394529 - DNA, 15 bp, Homo sapiens
gaaatgaccaatttc

SEQ ID NO: 394530 - DNA, 15 bp, Homo sapiens
aaatgaccaatttcc

SEQ ID NO: 394531 - DNA, 15 bp, Homo sapiens
aatgaccaatttcct

SEQ ID NO: 394532 - DNA, 15 bp, Homo sapiens
atgaccaatttcctt

SEQ ID NO: 394533 - DNA, 15 bp, Homo sapiens
tgaccaatttcctta

SEQ ID NO: 394534 - DNA, 15 bp, Homo sapiens
gaccaatttccttat

SEQ ID NO: 394535 - DNA, 15 bp, Homo sapiens
accaatttccttatt

SEQ ID NO: 394536 - DNA, 15 bp, Homo sapiens
ccaatttccttattt

SEQ ID NO: 394537 - DNA, 15 bp, Homo sapiens
caatttccttatttt

SEQ ID NO: 394538 - DNA, 15 bp, Homo sapiens
aatttccttatttta

SEQ ID NO: 394539 - DNA, 15 bp, Homo sapiens
atttccttattttat

SEQ ID NO: 394540 - DNA, 15 bp, Homo sapiens
tttccttattttata

SEQ ID NO: 394541 - DNA, 15 bp, Homo sapiens
ttccttattttataa

SEQ ID NO: 394542 - DNA, 15 bp, Homo sapiens
tccttattttataaa

SEQ ID NO: 394543 - DNA, 15 bp, Homo sapiens
ccttattttataaat

SEQ ID NO: 394544 - DNA, 15 bp, Homo sapiens
cttattttataaata

SEQ ID NO: 394545 - DNA, 15 bp, Homo sapiens
ttattttataaatag

SEQ ID NO: 394546 - DNA, 15 bp, Homo sapiens
tattttataaatagg

SEQ ID NO: 394547 - DNA, 15 bp, Homo sapiens
attttataaataggg

SEQ ID NO: 394548 - DNA, 15 bp, Homo sapiens
ttttataaataggga

SEQ ID NO: 394549 - DNA, 15 bp, Homo sapiens
tttataaatagggaa

SEQ ID NO: 394550 - DNA, 15 bp, Homo sapiens
ttataaatagggaag

SEQ ID NO: 394551 - DNA, 15 bp, Homo sapiens
tataaatagggaagc

SEQ ID NO: 394552 - DNA, 15 bp, Homo sapiens
ataaatagggaagca

SEQ ID NO: 394553 - DNA, 15 bp, Homo sapiens
taaatagggaagcag

SEQ ID NO: 394554 - DNA, 15 bp, Homo sapiens
aaatagggaagcagt

SEQ ID NO: 394555 - DNA, 15 bp, Homo sapiens
aatagggaagcagtg

SEQ ID NO: 394556 - DNA, 15 bp, Homo sapiens
atagggaagcagtgc

SEQ ID NO: 394557 - DNA, 15 bp, Homo sapiens
tagggaagcagtgcc

SEQ ID NO: 394558 - DNA, 15 bp, Homo sapiens
agggaagcagtgcct

SEQ ID NO: 394559 - DNA, 15 bp, Homo sapiens
gggaagcagtgcctt

SEQ ID NO: 394560 - DNA, 15 bp, Homo sapiens
ggaagcagtgcctta

SEQ ID NO: 394561 - DNA, 15 bp, Homo sapiens
gaagcagtgccttaa

SEQ ID NO: 394562 - DNA, 15 bp, Homo sapiens
aagcagtgccttaac

SEQ ID NO: 394563 - DNA, 15 bp, Homo sapiens
agcagtgccttaaca

SEQ ID NO: 394564 - DNA, 15 bp, Homo sapiens
gcagtgccttaacat

SEQ ID NO: 394565 - DNA, 15 bp, Homo sapiens
cagtgccttaacatc

SEQ ID NO: 394566 - DNA, 15 bp, Homo sapiens
agtgccttaacatct

SEQ ID NO: 394567 - DNA, 15 bp, Homo sapiens
gtgccttaacatcta

SEQ ID NO: 394568 - DNA, 15 bp, Homo sapiens
tgccttaacatctat

SEQ ID NO: 394569 - DNA, 15 bp, Homo sapiens
gccttaacatctatg

SEQ ID NO: 394570 - DNA, 15 bp, Homo sapiens
ccttaacatctatgt

SEQ ID NO: 394571 - DNA, 15 bp, Homo sapiens
cttaacatctatgta

SEQ ID NO: 394572 - DNA, 15 bp, Homo sapiens
ttaacatctatgtag

SEQ ID NO: 394573 - DNA, 15 bp, Homo sapiens
taacatctatgtaga

SEQ ID NO: 394574 - DNA, 15 bp, Homo sapiens
aacatctatgtagag

SEQ ID NO: 394575 - DNA, 15 bp, Homo sapiens
acatctatgtagagc

SEQ ID NO: 394576 - DNA, 15 bp, Homo sapiens
catctatgtagagct

SEQ ID NO: 394577 - DNA, 15 bp, Homo sapiens
atctatgtagagctt

SEQ ID NO: 394578 - DNA, 15 bp, Homo sapiens
tctatgtagagcttt

SEQ ID NO: 394579 - DNA, 15 bp, Homo sapiens
ctatgtagagctttg

SEQ ID NO: 394580 - DNA, 15 bp, Homo sapiens
tatgtagagctttgc

SEQ ID NO: 394581 - DNA, 15 bp, Homo sapiens
atgtagagctttgct

SEQ ID NO: 394582 - DNA, 15 bp, Homo sapiens
tgtagagctttgctc

SEQ ID NO: 394583 - DNA, 15 bp, Homo sapiens
gtagagctttgctct

SEQ ID NO: 394584 - DNA, 15 bp, Homo sapiens
tagagctttgctctt

SEQ ID NO: 394585 - DNA, 15 bp, Homo sapiens
agagctttgctctta

SEQ ID NO: 394586 - DNA, 15 bp, Homo sapiens
gagctttgctcttaa

SEQ ID NO: 394587 - DNA, 15 bp, Homo sapiens
agctttgctcttaaa

SEQ ID NO: 394588 - DNA, 15 bp, Homo sapiens
gctttgctcttaaag

SEQ ID NO: 394589 - DNA, 15 bp, Homo sapiens
ctttgctcttaaagt

SEQ ID NO: 394590 - DNA, 15 bp, Homo sapiens
tttgctcttaaagtg

SEQ ID NO: 394591 - DNA, 15 bp, Homo sapiens
ttgctcttaaagtgc

SEQ ID NO: 394592 - DNA, 15 bp, Homo sapiens
tgctcttaaagtgct

SEQ ID NO: 394593 - DNA, 15 bp, Homo sapiens
gctcttaaagtgctt

SEQ ID NO: 394594 - DNA, 15 bp, Homo sapiens
ctcttaaagtgcttt

SEQ ID NO: 394595 - DNA, 15 bp, Homo sapiens
tcttaaagtgcttta

SEQ ID NO: 394596 - DNA, 15 bp, Homo sapiens
cttaaagtgctttaa

SEQ ID NO: 394597 - DNA, 15 bp, Homo sapiens
ttaaagtgctttaat

SEQ ID NO: 394598 - DNA, 15 bp, Homo sapiens
taaagtgctttaata

SEQ ID NO: 394599 - DNA, 15 bp, Homo sapiens
aaagtgctttaatat

SEQ ID NO: 394600 - DNA, 15 bp, Homo sapiens
aagtgctttaatata

SEQ ID NO: 394601 - DNA, 15 bp, Homo sapiens
agtgctttaatatat

SEQ ID NO: 394602 - DNA, 15 bp, Homo sapiens
gtgctttaatatatt

SEQ ID NO: 394603 - DNA, 15 bp, Homo sapiens
tgctttaatatattt

SEQ ID NO: 394604 - DNA, 15 bp, Homo sapiens
gctttaatatatttt

SEQ ID NO: 394605 - DNA, 15 bp, Homo sapiens
ctttaatatattttt

SEQ ID NO: 394606 - DNA, 15 bp, Homo sapiens
tttaatatatttttt

SEQ ID NO: 394607 - DNA, 15 bp, Homo sapiens
ttaatatattttttt

SEQ ID NO: 394608 - DNA, 15 bp, Homo sapiens
taatatatttttttt

SEQ ID NO: 394609 - DNA, 15 bp, Homo sapiens
aatatattttttttg

SEQ ID NO: 394610 - DNA, 15 bp, Homo sapiens
atatattttttttgt

SEQ ID NO: 394611 - DNA, 15 bp, Homo sapiens
tatattttttttgtg

SEQ ID NO: 394612 - DNA, 15 bp, Homo sapiens
atattttttttgtgc

SEQ ID NO: 394613 - DNA, 15 bp, Homo sapiens
tattttttttgtgct

SEQ ID NO: 394614 - DNA, 15 bp, Homo sapiens
attttttttgtgctg

SEQ ID NO: 394615 - DNA, 15 bp, Homo sapiens
ttttttttgtgctgc

SEQ ID NO: 394616 - DNA, 15 bp, Homo sapiens
tttttttgtgctgcc

SEQ ID NO: 394617 - DNA, 15 bp, Homo sapiens
ttttttgtgctgccc

SEQ ID NO: 394618 - DNA, 15 bp, Homo sapiens
tttttgtgctgccca

SEQ ID NO: 394619 - DNA, 15 bp, Homo sapiens
ttttgtgctgcccaa

SEQ ID NO: 394620 - DNA, 15 bp, Homo sapiens
tttgtgctgcccaag

SEQ ID NO: 394621 - DNA, 15 bp, Homo sapiens
ttgtgctgcccaagg

SEQ ID NO: 394622 - DNA, 15 bp, Homo sapiens
tgtgctgcccaaggt

SEQ ID NO: 394623 - DNA, 15 bp, Homo sapiens
gtgctgcccaaggtc

SEQ ID NO: 394624 - DNA, 15 bp, Homo sapiens
tgctgcccaaggtca

SEQ ID NO: 394625 - DNA, 15 bp, Homo sapiens
gctgcccaaggtcac

SEQ ID NO: 394626 - DNA, 15 bp, Homo sapiens
ctgcccaaggtcaca

SEQ ID NO: 394627 - DNA, 15 bp, Homo sapiens
tgcccaaggtcacac

SEQ ID NO: 394628 - DNA, 15 bp, Homo sapiens
gcccaaggtcacaca

SEQ ID NO: 394629 - DNA, 15 bp, Homo sapiens
ccaaggtcacacaac

SEQ ID NO: 394630 - DNA, 15 bp, Homo sapiens
caaggtcacacaacc

SEQ ID NO: 394631 - DNA, 15 bp, Homo sapiens
aaggtcacacaaccc

SEQ ID NO: 394632 - DNA, 15 bp, Homo sapiens
aggtcacacaaccca

SEQ ID NO: 394633 - DNA, 15 bp, Homo sapiens
ggtcacacaacccac

SEQ ID NO: 394634 - DNA, 15 bp, Homo sapiens
gtcacacaacccact

SEQ ID NO: 394635 - DNA, 15 bp, Homo sapiens
tcacacaacccactg

SEQ ID NO: 394636 - DNA, 15 bp, Homo sapiens
cacacaacccactgg

SEQ ID NO: 394637 - DNA, 15 bp, Homo sapiens
acacaacccactggt

SEQ ID NO: 394638 - DNA, 15 bp, Homo sapiens
cacaacccactggta

SEQ ID NO: 394639 - DNA, 15 bp, Homo sapiens
acaacccactggtac

SEQ ID NO: 394640 - DNA, 15 bp, Homo sapiens
caacccactggtact

SEQ ID NO: 394641 - DNA, 15 bp, Homo sapiens
aacccactggtactc

SEQ ID NO: 394642 - DNA, 15 bp, Homo sapiens
acccactggtactcc

SEQ ID NO: 394643 - DNA, 15 bp, Homo sapiens
cccactggtactcca

SEQ ID NO: 394644 - DNA, 15 bp, Homo sapiens
ccactggtactccat

SEQ ID NO: 394645 - DNA, 15 bp, Homo sapiens
cactggtactccata

SEQ ID NO: 394646 - DNA, 15 bp, Homo sapiens
actggtactccatat

SEQ ID NO: 394647 - DNA, 15 bp, Homo sapiens
ctggtactccatatt

SEQ ID NO: 394648 - DNA, 15 bp, Homo sapiens
tggtactccatattt

SEQ ID NO: 394649 - DNA, 15 bp, Homo sapiens
ggtactccatattta

SEQ ID NO: 394650 - DNA, 15 bp, Homo sapiens
gtactccatatttaa

SEQ ID NO: 394651 - DNA, 15 bp, Homo sapiens
tactccatatttaag

SEQ ID NO: 394652 - DNA, 15 bp, Homo sapiens
actccatatttaagc

SEQ ID NO: 394653 - DNA, 15 bp, Homo sapiens
ctccatatttaagct

SEQ ID NO: 394654 - DNA, 15 bp, Homo sapiens
tccatatttaagctc

SEQ ID NO: 394655 - DNA, 15 bp, Homo sapiens
ccatatttaagctcc

SEQ ID NO: 394656 - DNA, 15 bp, Homo sapiens
catatttaagctccc

SEQ ID NO: 394657 - DNA, 15 bp, Homo sapiens
atatttaagctccca

SEQ ID NO: 394658 - DNA, 15 bp, Homo sapiens
tatttaagctcccag

SEQ ID NO: 394659 - DNA, 15 bp, Homo sapiens
atttaagctcccagg

SEQ ID NO: 394660 - DNA, 15 bp, Homo sapiens
tttaagctcccagga

SEQ ID NO: 394661 - DNA, 15 bp, Homo sapiens
ttaagctcccaggag

SEQ ID NO: 394662 - DNA, 15 bp, Homo sapiens
taagctcccaggaga

SEQ ID NO: 394663 - DNA, 15 bp, Homo sapiens
aagctcccaggagat

SEQ ID NO: 394664 - DNA, 15 bp, Homo sapiens
agctcccaggagatt

SEQ ID NO: 394665 - DNA, 15 bp, Homo sapiens
gctcccaggagatta

SEQ ID NO: 394666 - DNA, 15 bp, Homo sapiens
ctcccaggagattac

SEQ ID NO: 394667 - DNA, 15 bp, Homo sapiens
tcccaggagattact

SEQ ID NO: 394668 - DNA, 15 bp, Homo sapiens
cccaggagattactg

SEQ ID NO: 394669 - DNA, 15 bp, Homo sapiens
ccaggagattactgt

SEQ ID NO: 394670 - DNA, 15 bp, Homo sapiens
caggagattactgta

SEQ ID NO: 394671 - DNA, 15 bp, Homo sapiens
aggagattactgtag

SEQ ID NO: 394672 - DNA, 15 bp, Homo sapiens
ggagattactgtagt

SEQ ID NO: 394673 - DNA, 15 bp, Homo sapiens
gagattactgtagta

SEQ ID NO: 394674 - DNA, 15 bp, Homo sapiens
agattactgtagtat

SEQ ID NO: 394675 - DNA, 15 bp, Homo sapiens
gattactgtagtatc

SEQ ID NO: 394676 - DNA, 15 bp, Homo sapiens
attactgtagtatct

SEQ ID NO: 394677 - DNA, 15 bp, Homo sapiens
ttactgtagtatctt

SEQ ID NO: 394678 - DNA, 15 bp, Homo sapiens
tactgtagtatcttt

SEQ ID NO: 394679 - DNA, 15 bp, Homo sapiens
actgtagtatctttc

SEQ ID NO: 394680 - DNA, 15 bp, Homo sapiens
ctgtagtatctttca

SEQ ID NO: 394681 - DNA, 15 bp, Homo sapiens
tgtagtatctttcac

SEQ ID NO: 394682 - DNA, 15 bp, Homo sapiens
gtagtatctttcact

SEQ ID NO: 394683 - DNA, 15 bp, Homo sapiens
tagtatctttcacta

SEQ ID NO: 394684 - DNA, 15 bp, Homo sapiens
agtatctttcactac

SEQ ID NO: 394685 - DNA, 15 bp, Homo sapiens
gtatctttcactaca

SEQ ID NO: 394686 - DNA, 15 bp, Homo sapiens
tatctttcactacat

SEQ ID NO: 394687 - DNA, 15 bp, Homo sapiens
atctttcactacatc

SEQ ID NO: 394688 - DNA, 15 bp, Homo sapiens
tctttcactacatct

SEQ ID NO: 394689 - DNA, 15 bp, Homo sapiens
ctttcactacatctt

SEQ ID NO: 394690 - DNA, 15 bp, Homo sapiens
tttcactacatctta

SEQ ID NO: 394691 - DNA, 15 bp, Homo sapiens
ttcactacatcttat

SEQ ID NO: 394692 - DNA, 15 bp, Homo sapiens
tcactacatcttatg

SEQ ID NO: 394693 - DNA, 15 bp, Homo sapiens
cactacatcttatgt

SEQ ID NO: 394694 - DNA, 15 bp, Homo sapiens
actacatcttatgtg

SEQ ID NO: 394695 - DNA, 15 bp, Homo sapiens
ctacatcttatgtgc

SEQ ID NO: 394696 - DNA, 15 bp, Homo sapiens
tacatcttatgtgca

SEQ ID NO: 394697 - DNA, 15 bp, Homo sapiens
acatcttatgtgcat

SEQ ID NO: 394698 - DNA, 15 bp, Homo sapiens
catcttatgtgcatt

SEQ ID NO: 394699 - DNA, 15 bp, Homo sapiens
atcttatgtgcattt

SEQ ID NO: 394700 - DNA, 15 bp, Homo sapiens
tcttatgtgcattta

SEQ ID NO: 394701 - DNA, 15 bp, Homo sapiens
cttatgtgcatttat

SEQ ID NO: 394702 - DNA, 15 bp, Homo sapiens
ttatgtgcatttatt

SEQ ID NO: 394703 - DNA, 15 bp, Homo sapiens
tatgtgcatttattt

SEQ ID NO: 394704 - DNA, 15 bp, Homo sapiens
atgtgcatttatttt

SEQ ID NO: 394705 - DNA, 15 bp, Homo sapiens
tgtgcatttattttt

SEQ ID NO: 394706 - DNA, 15 bp, Homo sapiens
gtgcatttatttttg

SEQ ID NO: 394707 - DNA, 15 bp, Homo sapiens
tgcatttatttttgt

SEQ ID NO: 394708 - DNA, 15 bp, Homo sapiens
gcatttatttttgtg

SEQ ID NO: 394709 - DNA, 15 bp, Homo sapiens
catttatttttgtgg

SEQ ID NO: 394710 - DNA, 15 bp, Homo sapiens
atttatttttgtgga

SEQ ID NO: 394711 - DNA, 15 bp, Homo sapiens
tttatttttgtggaa

SEQ ID NO: 394712 - DNA, 15 bp, Homo sapiens
ttatttttgtggaac

SEQ ID NO: 394713 - DNA, 15 bp, Homo sapiens
tatttttgtggaact

SEQ ID NO: 394714 - DNA, 15 bp, Homo sapiens
atttttgtggaactt

SEQ ID NO: 394715 - DNA, 15 bp, Homo sapiens
tttttgtggaacttg

SEQ ID NO: 394716 - DNA, 15 bp, Homo sapiens
ttttgtggaacttgt

SEQ ID NO: 394717 - DNA, 15 bp, Homo sapiens
tttgtggaacttgta

SEQ ID NO: 394718 - DNA, 15 bp, Homo sapiens
ttgtggaacttgtat

SEQ ID NO: 394719 - DNA, 15 bp, Homo sapiens
tgtggaacttgtatt

SEQ ID NO: 394720 - DNA, 15 bp, Homo sapiens
gtggaacttgtattt

SEQ ID NO: 394721 - DNA, 15 bp, Homo sapiens
tggaacttgtattta

SEQ ID NO: 394722 - DNA, 15 bp, Homo sapiens
ggaacttgtatttaa

SEQ ID NO: 394723 - DNA, 15 bp, Homo sapiens
gaacttgtatttaac

SEQ ID NO: 394724 - DNA, 15 bp, Homo sapiens
aacttgtatttaact

SEQ ID NO: 394725 - DNA, 15 bp, Homo sapiens
acttgtatttaactt

SEQ ID NO: 394726 - DNA, 15 bp, Homo sapiens
cttgtatttaacttt

SEQ ID NO: 394727 - DNA, 15 bp, Homo sapiens
ttgtatttaactttg

SEQ ID NO: 394728 - DNA, 15 bp, Homo sapiens
tgtatttaactttgc

SEQ ID NO: 394729 - DNA, 15 bp, Homo sapiens
gtatttaactttgcc

SEQ ID NO: 394730 - DNA, 15 bp, Homo sapiens
tatttaactttgcct

SEQ ID NO: 394731 - DNA, 15 bp, Homo sapiens
atttaactttgcctg

SEQ ID NO: 394732 - DNA, 15 bp, Homo sapiens
tttaactttgcctgg

SEQ ID NO: 394733 - DNA, 15 bp, Homo sapiens
ttaactttgcctggt

SEQ ID NO: 394734 - DNA, 15 bp, Homo sapiens
taactttgcctggta

SEQ ID NO: 394735 - DNA, 15 bp, Homo sapiens
aactttgcctggtac

SEQ ID NO: 394736 - DNA, 15 bp, Homo sapiens
actttgcctggtact

SEQ ID NO: 394737 - DNA, 15 bp, Homo sapiens
ctttgcctggtacta

SEQ ID NO: 394738 - DNA, 15 bp, Homo sapiens
tttgcctggtactat

SEQ ID NO: 394739 - DNA, 15 bp, Homo sapiens
ttgcctggtactata

SEQ ID NO: 394740 - DNA, 15 bp, Homo sapiens
tgcctggtactataa

SEQ ID NO: 394741 - DNA, 15 bp, Homo sapiens
gcctggtactataat

SEQ ID NO: 394742 - DNA, 15 bp, Homo sapiens
cctggtactataatt

SEQ ID NO: 394743 - DNA, 15 bp, Homo sapiens
ctggtactataatta

SEQ ID NO: 394744 - DNA, 15 bp, Homo sapiens
tggtactataattag

SEQ ID NO: 394745 - DNA, 15 bp, Homo sapiens
ggtactataattagc

SEQ ID NO: 394746 - DNA, 15 bp, Homo sapiens
gtactataattagct

SEQ ID NO: 394747 - DNA, 15 bp, Homo sapiens
tactataattagcta

SEQ ID NO: 394748 - DNA, 15 bp, Homo sapiens
actataattagctat

SEQ ID NO: 394749 - DNA, 15 bp, Homo sapiens
ctataattagctatt

SEQ ID NO: 394750 - DNA, 15 bp, Homo sapiens
tataattagctattt

SEQ ID NO: 394751 - DNA, 15 bp, Homo sapiens
ataattagctattta

SEQ ID NO: 394752 - DNA, 15 bp, Homo sapiens
taattagctatttat

SEQ ID NO: 394753 - DNA, 15 bp, Homo sapiens
aattagctatttatt

SEQ ID NO: 394754 - DNA, 15 bp, Homo sapiens
attagctatttattt

SEQ ID NO: 394755 - DNA, 15 bp, Homo sapiens
ttagctatttatttc

SEQ ID NO: 394756 - DNA, 15 bp, Homo sapiens
tagctatttatttct

SEQ ID NO: 394757 - DNA, 15 bp, Homo sapiens
agctatttatttctt

SEQ ID NO: 394758 - DNA, 15 bp, Homo sapiens
gctatttatttcttt

SEQ ID NO: 394759 - DNA, 15 bp, Homo sapiens
ctatttatttctttt

SEQ ID NO: 394760 - DNA, 15 bp, Homo sapiens
tatttatttcttttt

SEQ ID NO: 394761 - DNA, 15 bp, Homo sapiens
atttatttctttttg

SEQ ID NO: 394762 - DNA, 15 bp, Homo sapiens
tttatttctttttga

SEQ ID NO: 394763 - DNA, 15 bp, Homo sapiens
ttatttctttttgac

SEQ ID NO: 394764 - DNA, 15 bp, Homo sapiens
tatttctttttgacc

SEQ ID NO: 394765 - DNA, 15 bp, Homo sapiens
atttctttttgacct

SEQ ID NO: 394766 - DNA, 15 bp, Homo sapiens
tttctttttgacctt

SEQ ID NO: 394767 - DNA, 15 bp, Homo sapiens
ttctttttgaccttc

SEQ ID NO: 394768 - DNA, 15 bp, Homo sapiens
tctttttgaccttct

SEQ ID NO: 394769 - DNA, 15 bp, Homo sapiens
ctttttgaccttctg

SEQ ID NO: 394770 - DNA, 15 bp, Homo sapiens
tttttgaccttctga

SEQ ID NO: 394771 - DNA, 15 bp, Homo sapiens
ttttgaccttctgaa

SEQ ID NO: 394772 - DNA, 15 bp, Homo sapiens
tttgaccttctgaat

SEQ ID NO: 394773 - DNA, 15 bp, Homo sapiens
ttgaccttctgaatt

SEQ ID NO: 394774 - DNA, 15 bp, Homo sapiens
tgaccttctgaattg

SEQ ID NO: 394775 - DNA, 15 bp, Homo sapiens
gaccttctgaattgt

SEQ ID NO: 394776 - DNA, 15 bp, Homo sapiens
accttctgaattgta

SEQ ID NO: 394777 - DNA, 15 bp, Homo sapiens
ccttctgaattgtaa

SEQ ID NO: 394778 - DNA, 15 bp, Homo sapiens
cttctgaattgtaaa

SEQ ID NO: 394779 - DNA, 15 bp, Homo sapiens
ttctgaattgtaaac

SEQ ID NO: 394780 - DNA, 15 bp, Homo sapiens
tctgaattgtaaact

SEQ ID NO: 394781 - DNA, 15 bp, Homo sapiens
ctgaattgtaaactc

SEQ ID NO: 394782 - DNA, 15 bp, Homo sapiens
tgaattgtaaactct

SEQ ID NO: 394783 - DNA, 15 bp, Homo sapiens
gaattgtaaactctt

SEQ ID NO: 394784 - DNA, 15 bp, Homo sapiens
aattgtaaactcttg

SEQ ID NO: 394785 - DNA, 15 bp, Homo sapiens
attgtaaactcttga

SEQ ID NO: 394786 - DNA, 15 bp, Homo sapiens
ttgtaaactcttgaa

SEQ ID NO: 394787 - DNA, 15 bp, Homo sapiens
tgtaaactcttgaat

SEQ ID NO: 394788 - DNA, 15 bp, Homo sapiens
gtaaactcttgaatt

SEQ ID NO: 394789 - DNA, 15 bp, Homo sapiens
taaactcttgaattt

SEQ ID NO: 394790 - DNA, 15 bp, Homo sapiens
aaactcttgaatttg

SEQ ID NO: 394791 - DNA, 15 bp, Homo sapiens
aactcttgaatttgg

SEQ ID NO: 394792 - DNA, 15 bp, Homo sapiens
actcttgaatttggg

SEQ ID NO: 394793 - DNA, 15 bp, Homo sapiens
ctcttgaatttggga

SEQ ID NO: 394794 - DNA, 15 bp, Homo sapiens
tcttgaatttgggac

SEQ ID NO: 394795 - DNA, 15 bp, Homo sapiens
cttgaatttgggact

SEQ ID NO: 394796 - DNA, 15 bp, Homo sapiens
ttgaatttgggacta

SEQ ID NO: 394797 - DNA, 15 bp, Homo sapiens
tgaatttgggactat

SEQ ID NO: 394798 - DNA, 15 bp, Homo sapiens
gaatttgggactata

SEQ ID NO: 394799 - DNA, 15 bp, Homo sapiens
aatttgggactatac

SEQ ID NO: 394800 - DNA, 15 bp, Homo sapiens
atttgggactatacc

SEQ ID NO: 394801 - DNA, 15 bp, Homo sapiens
tttgggactatacct

SEQ ID NO: 394802 - DNA, 15 bp, Homo sapiens
ttgggactatacctt

SEQ ID NO: 394803 - DNA, 15 bp, Homo sapiens
tgggactataccttg

SEQ ID NO: 394804 - DNA, 15 bp, Homo sapiens
gggactataccttgt

SEQ ID NO: 394805 - DNA, 15 bp, Homo sapiens
ggactataccttgtt

SEQ ID NO: 394806 - DNA, 15 bp, Homo sapiens
gactataccttgttt

SEQ ID NO: 394807 - DNA, 15 bp, Homo sapiens
actataccttgtttt

SEQ ID NO: 394808 - DNA, 15 bp, Homo sapiens
ctataccttgttttc

SEQ ID NO: 394809 - DNA, 15 bp, Homo sapiens
tataccttgttttct

SEQ ID NO: 394810 - DNA, 15 bp, Homo sapiens
ataccttgttttcta

SEQ ID NO: 394811 - DNA, 15 bp, Homo sapiens
taccttgttttctag

SEQ ID NO: 394812 - DNA, 15 bp, Homo sapiens
accttgttttctagt

SEQ ID NO: 394813 - DNA, 15 bp, Homo sapiens
ccttgttttctagtt

SEQ ID NO: 394814 - DNA, 15 bp, Homo sapiens
cttgttttctagttc

SEQ ID NO: 394815 - DNA, 15 bp, Homo sapiens
ttgttttctagttct

SEQ ID NO: 394816 - DNA, 15 bp, Homo sapiens
tgttttctagttctg

SEQ ID NO: 394817 - DNA, 15 bp, Homo sapiens
gttttctagttctgt

SEQ ID NO: 394818 - DNA, 15 bp, Homo sapiens
ttttctagttctgtg

SEQ ID NO: 394819 - DNA, 15 bp, Homo sapiens
tttctagttctgtgg

SEQ ID NO: 394820 - DNA, 15 bp, Homo sapiens
ttctagttctgtgga

SEQ ID NO: 394821 - DNA, 15 bp, Homo sapiens
tctagttctgtggac

SEQ ID NO: 394822 - DNA, 15 bp, Homo sapiens
ctagttctgtggaca

SEQ ID NO: 394823 - DNA, 15 bp, Homo sapiens
tagttctgtggacaa

SEQ ID NO: 394824 - DNA, 15 bp, Homo sapiens
agttctgtggacaaa

SEQ ID NO: 394825 - DNA, 15 bp, Homo sapiens
gttctgtggacaaaa

SEQ ID NO: 394826 - DNA, 15 bp, Homo sapiens
ttctgtggacaaaac

SEQ ID NO: 394827 - DNA, 15 bp, Homo sapiens
tctgtggacaaaaca

SEQ ID NO: 394828 - DNA, 15 bp, Homo sapiens
ctgtggacaaaacag

SEQ ID NO: 394829 - DNA, 15 bp, Homo sapiens
tgtggacaaaacagt

SEQ ID NO: 394830 - DNA, 15 bp, Homo sapiens
gtggacaaaacagta

SEQ ID NO: 394831 - DNA, 15 bp, Homo sapiens
tggacaaaacagtat

SEQ ID NO: 394832 - DNA, 15 bp, Homo sapiens
ggacaaaacagtatt

SEQ ID NO: 394833 - DNA, 15 bp, Homo sapiens
gacaaaacagtattt

SEQ ID NO: 394834 - DNA, 15 bp, Homo sapiens
acaaaacagtatttg

SEQ ID NO: 394835 - DNA, 15 bp, Homo sapiens
caaaacagtatttgt

SEQ ID NO: 394836 - DNA, 15 bp, Homo sapiens
aaaacagtatttgta

SEQ ID NO: 394837 - DNA, 15 bp, Homo sapiens
aaacagtatttgtaa

SEQ ID NO: 394838 - DNA, 15 bp, Homo sapiens
acagtatttgtaaat

SEQ ID NO: 394839 - DNA, 15 bp, Homo sapiens
cagtatttgtaaata

SEQ ID NO: 394840 - DNA, 15 bp, Homo sapiens
agtatttgtaaatat

SEQ ID NO: 394841 - DNA, 15 bp, Homo sapiens
gtatttgtaaatatt

SEQ ID NO: 394842 - DNA, 15 bp, Homo sapiens
tatttgtaaatattg

SEQ ID NO: 394843 - DNA, 15 bp, Homo sapiens
atttgtaaatattga

SEQ ID NO: 394844 - DNA, 15 bp, Homo sapiens
tttgtaaatattgaa

SEQ ID NO: 394845 - DNA, 15 bp, Homo sapiens
ttgtaaatattgaat

SEQ ID NO: 394846 - DNA, 15 bp, Homo sapiens
tgtaaatattgaata

SEQ ID NO: 394847 - DNA, 15 bp, Homo sapiens
gtaaatattgaataa

SEQ ID NO: 394848 - DNA, 15 bp, Homo sapiens
taaatattgaataaa

SEQ ID NO: 394849 - DNA, 15 bp, Homo sapiens
aaatattgaataaat

SEQ ID NO: 394850 - DNA, 15 bp, Homo sapiens
aatattgaataaata

SEQ ID NO: 394851 - DNA, 15 bp, Homo sapiens
atattgaataaataa

SEQ ID NO: 394852 - DNA, 15 bp, Homo sapiens
tattgaataaataaa

SEQ ID NO: 394853 - DNA, 15 bp, Homo sapiens
attgaataaataaac

SEQ ID NO: 394854 - DNA, 15 bp, Homo sapiens
ttgaataaataaacc

SEQ ID NO: 394855 - DNA, 15 bp, Homo sapiens
tgaataaataaacca

SEQ ID NO: 394856 - DNA, 15 bp, Homo sapiens
gaataaataaaccaa

SEQ ID NO: 394857 - DNA, 15 bp, Homo sapiens
aataaataaaccaaa

SEQ ID NO: 394858 - DNA, 15 bp, Homo sapiens
ataaataaaccaaat

SEQ ID NO: 394859 - DNA, 15 bp, Homo sapiens
taaataaaccaaatt

SEQ ID NO: 394860 - DNA, 15 bp, Homo sapiens
aaataaaccaaattt

SEQ ID NO: 394861 - DNA, 15 bp, Homo sapiens
aataaaccaaatttc

SEQ ID NO: 394862 - DNA, 15 bp, Homo sapiens
ataaaccaaatttca

SEQ ID NO: 394863 - DNA, 15 bp, Homo sapiens
taaaccaaatttcaa

SEQ ID NO: 394864 - DNA, 15 bp, Homo sapiens
aaaccaaatttcaat

SEQ ID NO: 394865 - DNA, 15 bp, Homo sapiens
aaccaaatttcaatt

SEQ ID NO: 394866 - DNA, 15 bp, Homo sapiens
accaaatttcaattt

SEQ ID NO: 394867 - DNA, 15 bp, Homo sapiens
ccaaatttcaatttt

SEQ ID NO: 394868 - DNA, 15 bp, Homo sapiens
caaatttcaattttt

SEQ ID NO: 394869 - DNA, 15 bp, Homo sapiens
aaatttcaatttttc

SEQ ID NO: 394870 - DNA, 15 bp, Homo sapiens
aatttcaatttttcc

SEQ ID NO: 394871 - DNA, 15 bp, Homo sapiens
atttcaatttttcct

SEQ ID NO: 394872 - DNA, 15 bp, Homo sapiens
tttcaatttttcctt

SEQ ID NO: 394873 - DNA, 15 bp, Homo sapiens
ttcaatttttcctta

SEQ ID NO: 394874 - DNA, 15 bp, Homo sapiens
tcaatttttccttag

SEQ ID NO: 394875 - DNA, 15 bp, Homo sapiens
caatttttccttaga

SEQ ID NO: 394876 - DNA, 15 bp, Homo sapiens
aatttttccttagat

SEQ ID NO: 394877 - DNA, 15 bp, Homo sapiens
atttttccttagatt

SEQ ID NO: 394878 - DNA, 15 bp, Homo sapiens
tttttccttagattt

SEQ ID NO: 394879 - DNA, 15 bp, Homo sapiens
ttttccttagattta

SEQ ID NO: 394880 - DNA, 15 bp, Homo sapiens
tttccttagatttaa

SEQ ID NO: 394881 - DNA, 15 bp, Homo sapiens
ttccttagatttaaa

SEQ ID NO: 394882 - DNA, 15 bp, Homo sapiens
tccttagatttaaaa

SEQ ID NO: 394883 - DNA, 15 bp, Homo sapiens
ccttagatttaaaaa

SEQ ID NO: 394884 - DNA, 15 bp, Homo sapiens
cttagatttaaaaat

SEQ ID NO: 394885 - DNA, 15 bp, Homo sapiens
ttagatttaaaaatt

SEQ ID NO: 394886 - DNA, 15 bp, Homo sapiens
tagatttaaaaatta

SEQ ID NO: 394887 - DNA, 15 bp, Homo sapiens
agatttaaaaattag

SEQ ID NO: 394888 - DNA, 15 bp, Homo sapiens
gatttaaaaattagt

SEQ ID NO: 394889 - DNA, 15 bp, Homo sapiens
atttaaaaattagta

SEQ ID NO: 394890 - DNA, 15 bp, Homo sapiens
tttaaaaattagtac

SEQ ID NO: 394891 - DNA, 15 bp, Homo sapiens
ttaaaaattagtaca

SEQ ID NO: 394892 - DNA, 15 bp, Homo sapiens
taaaaattagtacag

SEQ ID NO: 394893 - DNA, 15 bp, Homo sapiens
aaaaattagtacagt

SEQ ID NO: 394894 - DNA, 15 bp, Homo sapiens
aaaattagtacagta

SEQ ID NO: 394895 - DNA, 15 bp, Homo sapiens
aaattagtacagtaa

SEQ ID NO: 394896 - DNA, 15 bp, Homo sapiens
aattagtacagtaaa

SEQ ID NO: 394897 - DNA, 15 bp, Homo sapiens
attagtacagtaaag

SEQ ID NO: 394898 - DNA, 15 bp, Homo sapiens
ttagtacagtaaagc

SEQ ID NO: 394899 - DNA, 15 bp, Homo sapiens
tagtacagtaaagca

SEQ ID NO: 394900 - DNA, 15 bp, Homo sapiens
agtacagtaaagcag

SEQ ID NO: 394901 - DNA, 15 bp, Homo sapiens
gtacagtaaagcaga

SEQ ID NO: 394902 - DNA, 15 bp, Homo sapiens
tacagtaaagcagaa

SEQ ID NO: 394903 - DNA, 15 bp, Homo sapiens
acagtaaagcagaag

SEQ ID NO: 394904 - DNA, 15 bp, Homo sapiens
cagtaaagcagaagt

SEQ ID NO: 394905 - DNA, 15 bp, Homo sapiens
agtaaagcagaagtt

SEQ ID NO: 394906 - DNA, 15 bp, Homo sapiens
gtaaagcagaagttc

SEQ ID NO: 394907 - DNA, 15 bp, Homo sapiens
taaagcagaagttct

SEQ ID NO: 394908 - DNA, 15 bp, Homo sapiens
aaagcagaagttcta

SEQ ID NO: 394909 - DNA, 15 bp, Homo sapiens
aagcagaagttctat

SEQ ID NO: 394910 - DNA, 15 bp, Homo sapiens
agcagaagttctata

SEQ ID NO: 394911 - DNA, 15 bp, Homo sapiens
gcagaagttctatat

SEQ ID NO: 394912 - DNA, 15 bp, Homo sapiens
cagaagttctatata

SEQ ID NO: 394913 - DNA, 15 bp, Homo sapiens
agaagttctatatac

SEQ ID NO: 394914 - DNA, 15 bp, Homo sapiens
gaagttctatatact

SEQ ID NO: 394915 - DNA, 15 bp, Homo sapiens
aagttctatatactt

SEQ ID NO: 394916 - DNA, 15 bp, Homo sapiens
agttctatatacttt

SEQ ID NO: 394917 - DNA, 15 bp, Homo sapiens
gttctatatactttg

SEQ ID NO: 394918 - DNA, 15 bp, Homo sapiens
ttctatatactttga

SEQ ID NO: 394919 - DNA, 15 bp, Homo sapiens
tctatatactttgac

SEQ ID NO: 394920 - DNA, 15 bp, Homo sapiens
ctatatactttgact

SEQ ID NO: 394921 - DNA, 15 bp, Homo sapiens
tatatactttgactt

SEQ ID NO: 394922 - DNA, 15 bp, Homo sapiens
atatactttgacttt

SEQ ID NO: 394923 - DNA, 15 bp, Homo sapiens
tatactttgacttta

SEQ ID NO: 394924 - DNA, 15 bp, Homo sapiens
atactttgactttag

SEQ ID NO: 394925 - DNA, 15 bp, Homo sapiens
tactttgactttagt

SEQ ID NO: 394926 - DNA, 15 bp, Homo sapiens
actttgactttagtt

SEQ ID NO: 394927 - DNA, 15 bp, Homo sapiens
ctttgactttagttt

SEQ ID NO: 394928 - DNA, 15 bp, Homo sapiens
tttgactttagtttt

SEQ ID NO: 394929 - DNA, 15 bp, Homo sapiens
ttgactttagttttt

SEQ ID NO: 394930 - DNA, 15 bp, Homo sapiens
tgactttagtttttt

SEQ ID NO: 394931 - DNA, 15 bp, Homo sapiens
gactttagttttttt

SEQ ID NO: 394932 - DNA, 15 bp, Homo sapiens
actttagtttttttc

SEQ ID NO: 394933 - DNA, 15 bp, Homo sapiens
ctttagtttttttct

SEQ ID NO: 394934 - DNA, 15 bp, Homo sapiens
tttagtttttttctt

SEQ ID NO: 394935 - DNA, 15 bp, Homo sapiens
ttagtttttttcttt

SEQ ID NO: 394936 - DNA, 15 bp, Homo sapiens
tagtttttttctttt

SEQ ID NO: 394937 - DNA, 15 bp, Homo sapiens
agtttttttcttttc

SEQ ID NO: 394938 - DNA, 15 bp, Homo sapiens
gtttttttcttttca

SEQ ID NO: 394939 - DNA, 15 bp, Homo sapiens
tttttttcttttcaa

SEQ ID NO: 394940 - DNA, 15 bp, Homo sapiens
ttttttcttttcaaa

SEQ ID NO: 394941 - DNA, 15 bp, Homo sapiens
tttttcttttcaaaa

SEQ ID NO: 394942 - DNA, 15 bp, Homo sapiens
ttttcttttcaaaat

SEQ ID NO: 394943 - DNA, 15 bp, Homo sapiens
tttcttttcaaaata

SEQ ID NO: 394944 - DNA, 15 bp, Homo sapiens
ttcttttcaaaatag

SEQ ID NO: 394945 - DNA, 15 bp, Homo sapiens
tcttttcaaaatagt

SEQ ID NO: 394946 - DNA, 15 bp, Homo sapiens
cttttcaaaatagtc

SEQ ID NO: 394947 - DNA, 15 bp, Homo sapiens
ttttcaaaatagtct

SEQ ID NO: 394948 - DNA, 15 bp, Homo sapiens
tttcaaaatagtctt

SEQ ID NO: 394949 - DNA, 15 bp, Homo sapiens
ttcaaaatagtctta

SEQ ID NO: 394950 - DNA, 15 bp, Homo sapiens
tcaaaatagtcttat

SEQ ID NO: 394951 - DNA, 15 bp, Homo sapiens
caaaatagtcttatt

SEQ ID NO: 394952 - DNA, 15 bp, Homo sapiens
aaaatagtcttattg

SEQ ID NO: 394953 - DNA, 15 bp, Homo sapiens
aaatagtcttattga

SEQ ID NO: 394954 - DNA, 15 bp, Homo sapiens
aatagtcttattgat

SEQ ID NO: 394955 - DNA, 15 bp, Homo sapiens
atagtcttattgata

SEQ ID NO: 394956 - DNA, 15 bp, Homo sapiens
tagtcttattgatat

SEQ ID NO: 394957 - DNA, 15 bp, Homo sapiens
agtcttattgatata

SEQ ID NO: 394958 - DNA, 15 bp, Homo sapiens
gtcttattgatatat

SEQ ID NO: 394959 - DNA, 15 bp, Homo sapiens
tcttattgatatata

SEQ ID NO: 394960 - DNA, 15 bp, Homo sapiens
cttattgatatataa

SEQ ID NO: 394961 - DNA, 15 bp, Homo sapiens
ttattgatatataat

SEQ ID NO: 394962 - DNA, 15 bp, Homo sapiens
tattgatatataatt

SEQ ID NO: 394963 - DNA, 15 bp, Homo sapiens
attgatatataattc

SEQ ID NO: 394964 - DNA, 15 bp, Homo sapiens
ttgatatataattca

SEQ ID NO: 394965 - DNA, 15 bp, Homo sapiens
tgatatataattcat

SEQ ID NO: 394966 - DNA, 15 bp, Homo sapiens
gatatataattcatg

SEQ ID NO: 394967 - DNA, 15 bp, Homo sapiens
atatataattcatgt

SEQ ID NO: 394968 - DNA, 15 bp, Homo sapiens
tatataattcatgta

SEQ ID NO: 394969 - DNA, 15 bp, Homo sapiens
atataattcatgtaa

SEQ ID NO: 394970 - DNA, 15 bp, Homo sapiens
tataattcatgtaaa

SEQ ID NO: 394971 - DNA, 15 bp, Homo sapiens
ataattcatgtaaaa

SEQ ID NO: 394972 - DNA, 15 bp, Homo sapiens
taattcatgtaaaag

SEQ ID NO: 394973 - DNA, 15 bp, Homo sapiens
aattcatgtaaaagt

SEQ ID NO: 394974 - DNA, 15 bp, Homo sapiens
attcatgtaaaagtc

SEQ ID NO: 394975 - DNA, 15 bp, Homo sapiens
ttcatgtaaaagtca

SEQ ID NO: 394976 - DNA, 15 bp, Homo sapiens
tcatgtaaaagtcac

SEQ ID NO: 394977 - DNA, 15 bp, Homo sapiens
catgtaaaagtcact

SEQ ID NO: 394978 - DNA, 15 bp, Homo sapiens
atgtaaaagtcactt

SEQ ID NO: 394979 - DNA, 15 bp, Homo sapiens
tgtaaaagtcacttt

SEQ ID NO: 394980 - DNA, 15 bp, Homo sapiens
gtaaaagtcactttt

SEQ ID NO: 394981 - DNA, 15 bp, Homo sapiens
taaaagtcactttta

SEQ ID NO: 394982 - DNA, 15 bp, Homo sapiens
aaaagtcacttttaa

SEQ ID NO: 394983 - DNA, 15 bp, Homo sapiens
aaagtcacttttaaa

SEQ ID NO: 394984 - DNA, 15 bp, Homo sapiens
aagtcacttttaaaa

SEQ ID NO: 394985 - DNA, 15 bp, Homo sapiens
agtcacttttaaaat

SEQ ID NO: 394986 - DNA, 15 bp, Homo sapiens
gtcacttttaaaatg

SEQ ID NO: 394987 - DNA, 15 bp, Homo sapiens
tcacttttaaaatgt

SEQ ID NO: 394988 - DNA, 15 bp, Homo sapiens
cacttttaaaatgta

SEQ ID NO: 394989 - DNA, 15 bp, Homo sapiens
acttttaaaatgtac

SEQ ID NO: 394990 - DNA, 15 bp, Homo sapiens
cttttaaaatgtaca

SEQ ID NO: 394991 - DNA, 15 bp, Homo sapiens
ttttaaaatgtacaa

SEQ ID NO: 394992 - DNA, 15 bp, Homo sapiens
tttaaaatgtacaat

SEQ ID NO: 394993 - DNA, 15 bp, Homo sapiens
ttaaaatgtacaatt

SEQ ID NO: 394994 - DNA, 15 bp, Homo sapiens
taaaatgtacaattc

SEQ ID NO: 394995 - DNA, 15 bp, Homo sapiens
aaaatgtacaattca

SEQ ID NO: 394996 - DNA, 15 bp, Homo sapiens
aaatgtacaattcag

SEQ ID NO: 394997 - DNA, 15 bp, Homo sapiens
aatgtacaattcagt

SEQ ID NO: 394998 - DNA, 15 bp, Homo sapiens
atgtacaattcagtg

SEQ ID NO: 394999 - DNA, 15 bp, Homo sapiens
tgtacaattcagtgc

SEQ ID NO: 395000 - DNA, 15 bp, Homo sapiens
gtacaattcagtgct

SEQ ID NO: 395001 - DNA, 15 bp, Homo sapiens
tacaattcagtgctt

SEQ ID NO: 395002 - DNA, 15 bp, Homo sapiens
acaattcagtgcttt

SEQ ID NO: 395003 - DNA, 15 bp, Homo sapiens
caattcagtgctttt

SEQ ID NO: 395004 - DNA, 15 bp, Homo sapiens
aattcagtgcttttg

SEQ ID NO: 395005 - DNA, 15 bp, Homo sapiens
attcagtgcttttgg

SEQ ID NO: 395006 - DNA, 15 bp, Homo sapiens
ttcagtgcttttggc

SEQ ID NO: 395007 - DNA, 15 bp, Homo sapiens
tcagtgcttttggca

SEQ ID NO: 395008 - DNA, 15 bp, Homo sapiens
cagtgcttttggcat

SEQ ID NO: 395009 - DNA, 15 bp, Homo sapiens
agtgcttttggcatg

SEQ ID NO: 395010 - DNA, 15 bp, Homo sapiens
gtgcttttggcatgt

SEQ ID NO: 395011 - DNA, 15 bp, Homo sapiens
tgcttttggcatgtt

SEQ ID NO: 395012 - DNA, 15 bp, Homo sapiens
gcttttggcatgttc

SEQ ID NO: 395013 - DNA, 15 bp, Homo sapiens
cttttggcatgttca

SEQ ID NO: 395014 - DNA, 15 bp, Homo sapiens
ttttggcatgttcac

SEQ ID NO: 395015 - DNA, 15 bp, Homo sapiens
tttggcatgttcaca

SEQ ID NO: 395016 - DNA, 15 bp, Homo sapiens
ttggcatgttcacag

SEQ ID NO: 395017 - DNA, 15 bp, Homo sapiens
tggcatgttcacagg

SEQ ID NO: 395018 - DNA, 15 bp, Homo sapiens
ggcatgttcacaggg

SEQ ID NO: 395019 - DNA, 15 bp, Homo sapiens
gcatgttcacagggt

SEQ ID NO: 395020 - DNA, 15 bp, Homo sapiens
catgttcacagggtt

SEQ ID NO: 395021 - DNA, 15 bp, Homo sapiens
atgttcacagggttg

SEQ ID NO: 395022 - DNA, 15 bp, Homo sapiens
tgttcacagggttgt

SEQ ID NO: 395023 - DNA, 15 bp, Homo sapiens
gttcacagggttgtg

SEQ ID NO: 395024 - DNA, 15 bp, Homo sapiens
ttcacagggttgtgc

SEQ ID NO: 395025 - DNA, 15 bp, Homo sapiens
tcacagggttgtgca

SEQ ID NO: 395026 - DNA, 15 bp, Homo sapiens
cacagggttgtgcag

SEQ ID NO: 395027 - DNA, 15 bp, Homo sapiens
acagggttgtgcagc

SEQ ID NO: 395028 - DNA, 15 bp, Homo sapiens
cagggttgtgcagcc

SEQ ID NO: 395029 - DNA, 15 bp, Homo sapiens
agggttgtgcagcca

SEQ ID NO: 395030 - DNA, 15 bp, Homo sapiens
gggttgtgcagccat

SEQ ID NO: 395031 - DNA, 15 bp, Homo sapiens
ggttgtgcagccatc

SEQ ID NO: 395032 - DNA, 15 bp, Homo sapiens
gttgtgcagccatca

SEQ ID NO: 395033 - DNA, 15 bp, Homo sapiens
ttgtgcagccatcac

SEQ ID NO: 395034 - DNA, 15 bp, Homo sapiens
tgtgcagccatcact

SEQ ID NO: 395035 - DNA, 15 bp, Homo sapiens
gtgcagccatcacta

SEQ ID NO: 395036 - DNA, 15 bp, Homo sapiens
tgcagccatcactat

SEQ ID NO: 395037 - DNA, 15 bp, Homo sapiens
gcagccatcactata

SEQ ID NO: 395038 - DNA, 15 bp, Homo sapiens
cagccatcactataa

SEQ ID NO: 395039 - DNA, 15 bp, Homo sapiens
agccatcactataat

SEQ ID NO: 395040 - DNA, 15 bp, Homo sapiens
gccatcactataatc

SEQ ID NO: 395041 - DNA, 15 bp, Homo sapiens
ccatcactataatct

SEQ ID NO: 395042 - DNA, 15 bp, Homo sapiens
catcactataatcta

SEQ ID NO: 395043 - DNA, 15 bp, Homo sapiens
atcactataatctaa

SEQ ID NO: 395044 - DNA, 15 bp, Homo sapiens
tcactataatctaat

SEQ ID NO: 395045 - DNA, 15 bp, Homo sapiens
cactataatctaatt

SEQ ID NO: 395046 - DNA, 15 bp, Homo sapiens
actataatctaattt

SEQ ID NO: 395047 - DNA, 15 bp, Homo sapiens
ctataatctaatttt

SEQ ID NO: 395048 - DNA, 15 bp, Homo sapiens
tataatctaatttta

SEQ ID NO: 395049 - DNA, 15 bp, Homo sapiens
ataatctaattttag

SEQ ID NO: 395050 - DNA, 15 bp, Homo sapiens
taatctaattttaga

SEQ ID NO: 395051 - DNA, 15 bp, Homo sapiens
aatctaattttagag

SEQ ID NO: 395052 - DNA, 15 bp, Homo sapiens
atctaattttagagc

SEQ ID NO: 395053 - DNA, 15 bp, Homo sapiens
tctaattttagagca

SEQ ID NO: 395054 - DNA, 15 bp, Homo sapiens
ctaattttagagcac

SEQ ID NO: 395055 - DNA, 15 bp, Homo sapiens
taattttagagcact

SEQ ID NO: 395056 - DNA, 15 bp, Homo sapiens
aattttagagcactt

SEQ ID NO: 395057 - DNA, 15 bp, Homo sapiens
attttagagcacttt

SEQ ID NO: 395058 - DNA, 15 bp, Homo sapiens
ttttagagcactttt

SEQ ID NO: 395059 - DNA, 15 bp, Homo sapiens
tttagagcacttttg

SEQ ID NO: 395060 - DNA, 15 bp, Homo sapiens
ttagagcacttttgt

SEQ ID NO: 395061 - DNA, 15 bp, Homo sapiens
tagagcacttttgtc

SEQ ID NO: 395062 - DNA, 15 bp, Homo sapiens
agagcacttttgtct

SEQ ID NO: 395063 - DNA, 15 bp, Homo sapiens
gagcacttttgtctc

SEQ ID NO: 395064 - DNA, 15 bp, Homo sapiens
agcacttttgtctct

SEQ ID NO: 395065 - DNA, 15 bp, Homo sapiens
gcacttttgtctctt

SEQ ID NO: 395066 - DNA, 15 bp, Homo sapiens
cacttttgtctcttc

SEQ ID NO: 395067 - DNA, 15 bp, Homo sapiens
acttttgtctcttct

SEQ ID NO: 395068 - DNA, 15 bp, Homo sapiens
cttttgtctcttctt

SEQ ID NO: 395069 - DNA, 15 bp, Homo sapiens
ttttgtctcttctta

SEQ ID NO: 395070 - DNA, 15 bp, Homo sapiens
tttgtctcttcttaa

SEQ ID NO: 395071 - DNA, 15 bp, Homo sapiens
ttgtctcttcttaaa

SEQ ID NO: 395072 - DNA, 15 bp, Homo sapiens
tgtctcttcttaaaa

SEQ ID NO: 395073 - DNA, 15 bp, Homo sapiens
gtctcttcttaaaaa

SEQ ID NO: 395074 - DNA, 15 bp, Homo sapiens
tctcttcttaaaaag

SEQ ID NO: 395075 - DNA, 15 bp, Homo sapiens
ctcttcttaaaaaga

SEQ ID NO: 395076 - DNA, 15 bp, Homo sapiens
tcttcttaaaaagaa

SEQ ID NO: 395077 - DNA, 15 bp, Homo sapiens
cttcttaaaaagaaa

SEQ ID NO: 395078 - DNA, 15 bp, Homo sapiens
ttcttaaaaagaaat

SEQ ID NO: 395079 - DNA, 15 bp, Homo sapiens
tcttaaaaagaaatc

SEQ ID NO: 395080 - DNA, 15 bp, Homo sapiens
cttaaaaagaaatcc

SEQ ID NO: 395081 - DNA, 15 bp, Homo sapiens
ttaaaaagaaatccc

SEQ ID NO: 395082 - DNA, 15 bp, Homo sapiens
taaaaagaaatccct

SEQ ID NO: 395083 - DNA, 15 bp, Homo sapiens
aaaaagaaatccctc

SEQ ID NO: 395084 - DNA, 15 bp, Homo sapiens
aaaagaaatccctca

SEQ ID NO: 395085 - DNA, 15 bp, Homo sapiens
aaagaaatccctcac

SEQ ID NO: 395086 - DNA, 15 bp, Homo sapiens
aagaaatccctcaca

SEQ ID NO: 395087 - DNA, 15 bp, Homo sapiens
agaaatccctcacac

SEQ ID NO: 395088 - DNA, 15 bp, Homo sapiens
gaaatccctcacact

SEQ ID NO: 395089 - DNA, 15 bp, Homo sapiens
aaatccctcacactc

SEQ ID NO: 395090 - DNA, 15 bp, Homo sapiens
aatccctcacactca

SEQ ID NO: 395091 - DNA, 15 bp, Homo sapiens
atccctcacactcat

SEQ ID NO: 395092 - DNA, 15 bp, Homo sapiens
tccctcacactcatg

SEQ ID NO: 395093 - DNA, 15 bp, Homo sapiens
ccctcacactcatga

SEQ ID NO: 395094 - DNA, 15 bp, Homo sapiens
cctcacactcatgag

SEQ ID NO: 395095 - DNA, 15 bp, Homo sapiens
ctcacactcatgagc

SEQ ID NO: 395096 - DNA, 15 bp, Homo sapiens
tcacactcatgagca

SEQ ID NO: 395097 - DNA, 15 bp, Homo sapiens
cacactcatgagcag

SEQ ID NO: 395098 - DNA, 15 bp, Homo sapiens
acactcatgagcagt

SEQ ID NO: 395099 - DNA, 15 bp, Homo sapiens
cactcatgagcagtc

SEQ ID NO: 395100 - DNA, 15 bp, Homo sapiens
actcatgagcagtca

SEQ ID NO: 395101 - DNA, 15 bp, Homo sapiens
ctcatgagcagtcat

SEQ ID NO: 395102 - DNA, 15 bp, Homo sapiens
tcatgagcagtcatt

SEQ ID NO: 395103 - DNA, 15 bp, Homo sapiens
catgagcagtcattt

SEQ ID NO: 395104 - DNA, 15 bp, Homo sapiens
atgagcagtcatttc

SEQ ID NO: 395105 - DNA, 15 bp, Homo sapiens
tgagcagtcatttcc

SEQ ID NO: 395106 - DNA, 15 bp, Homo sapiens
gagcagtcatttcct

SEQ ID NO: 395107 - DNA, 15 bp, Homo sapiens
agcagtcatttccta

SEQ ID NO: 395108 - DNA, 15 bp, Homo sapiens
gcagtcatttcctat

SEQ ID NO: 395109 - DNA, 15 bp, Homo sapiens
cagtcatttcctatt

SEQ ID NO: 395110 - DNA, 15 bp, Homo sapiens
agtcatttcctattt

SEQ ID NO: 395111 - DNA, 15 bp, Homo sapiens
gtcatttcctatttc

SEQ ID NO: 395112 - DNA, 15 bp, Homo sapiens
tcatttcctatttct

SEQ ID NO: 395113 - DNA, 15 bp, Homo sapiens
catttcctatttctt

SEQ ID NO: 395114 - DNA, 15 bp, Homo sapiens
atttcctatttcttc

SEQ ID NO: 395115 - DNA, 15 bp, Homo sapiens
tttcctatttcttcc

SEQ ID NO: 395116 - DNA, 15 bp, Homo sapiens
ttcctatttcttccc

SEQ ID NO: 395117 - DNA, 15 bp, Homo sapiens
tcctatttcttccca

SEQ ID NO: 395118 - DNA, 15 bp, Homo sapiens
cctatttcttcccac

SEQ ID NO: 395119 - DNA, 15 bp, Homo sapiens
ctatttcttcccacc

SEQ ID NO: 395120 - DNA, 15 bp, Homo sapiens
tatttcttcccaccg

SEQ ID NO: 395121 - DNA, 15 bp, Homo sapiens
atttcttcccaccgc

SEQ ID NO: 395122 - DNA, 15 bp, Homo sapiens
tttcttcccaccgca

SEQ ID NO: 395123 - DNA, 15 bp, Homo sapiens
ttcttcccaccgcac

SEQ ID NO: 395124 - DNA, 15 bp, Homo sapiens
tcttcccaccgcact

SEQ ID NO: 395125 - DNA, 15 bp, Homo sapiens
cttcccaccgcactg

SEQ ID NO: 395126 - DNA, 15 bp, Homo sapiens
ttcccaccgcactgc

SEQ ID NO: 395127 - DNA, 15 bp, Homo sapiens
tcccaccgcactgcc

SEQ ID NO: 395128 - DNA, 15 bp, Homo sapiens
cccaccgcactgccc

SEQ ID NO: 395129 - DNA, 15 bp, Homo sapiens
ccaccgcactgcccc

SEQ ID NO: 395130 - DNA, 15 bp, Homo sapiens
caccgcactgcccca

SEQ ID NO: 395131 - DNA, 15 bp, Homo sapiens
accgcactgccccag

SEQ ID NO: 395132 - DNA, 15 bp, Homo sapiens
ccgcactgccccagc

SEQ ID NO: 395133 - DNA, 15 bp, Homo sapiens
cgcactgccccagcc

SEQ ID NO: 395134 - DNA, 15 bp, Homo sapiens
gcactgccccagccc

SEQ ID NO: 395135 - DNA, 15 bp, Homo sapiens
cactgccccagccct

SEQ ID NO: 395136 - DNA, 15 bp, Homo sapiens
actgccccagcccta

SEQ ID NO: 395137 - DNA, 15 bp, Homo sapiens
ctgccccagccctag

SEQ ID NO: 395138 - DNA, 15 bp, Homo sapiens
tgccccagccctagg

SEQ ID NO: 395139 - DNA, 15 bp, Homo sapiens
gccccagccctaggc

SEQ ID NO: 395140 - DNA, 15 bp, Homo sapiens
ccccagccctaggca

SEQ ID NO: 395141 - DNA, 15 bp, Homo sapiens
cccagccctaggcaa

SEQ ID NO: 395142 - DNA, 15 bp, Homo sapiens
ccagccctaggcaac

SEQ ID NO: 395143 - DNA, 15 bp, Homo sapiens
cagccctaggcaacc

SEQ ID NO: 395144 - DNA, 15 bp, Homo sapiens
agccctaggcaaccc

SEQ ID NO: 395145 - DNA, 15 bp, Homo sapiens
gccctaggcaaccct

SEQ ID NO: 395146 - DNA, 15 bp, Homo sapiens
ccctaggcaaccctg

SEQ ID NO: 395147 - DNA, 15 bp, Homo sapiens
cctaggcaaccctga

SEQ ID NO: 395148 - DNA, 15 bp, Homo sapiens
ctaggcaaccctgaa

SEQ ID NO: 395149 - DNA, 15 bp, Homo sapiens
taggcaaccctgaac

SEQ ID NO: 395150 - DNA, 15 bp, Homo sapiens
aggcaaccctgaaca

SEQ ID NO: 395151 - DNA, 15 bp, Homo sapiens
ggcaaccctgaacac

SEQ ID NO: 395152 - DNA, 15 bp, Homo sapiens
gcaaccctgaacact

SEQ ID NO: 395153 - DNA, 15 bp, Homo sapiens
caaccctgaacactt

SEQ ID NO: 395154 - DNA, 15 bp, Homo sapiens
aaccctgaacacttt

SEQ ID NO: 395155 - DNA, 15 bp, Homo sapiens
accctgaacactttc

SEQ ID NO: 395156 - DNA, 15 bp, Homo sapiens
ccctgaacactttct

SEQ ID NO: 395157 - DNA, 15 bp, Homo sapiens
cctgaacactttctc

SEQ ID NO: 395158 - DNA, 15 bp, Homo sapiens
ctgaacactttctct

SEQ ID NO: 395159 - DNA, 15 bp, Homo sapiens
tgaacactttctctt

SEQ ID NO: 395160 - DNA, 15 bp, Homo sapiens
gaacactttctcttt

SEQ ID NO: 395161 - DNA, 15 bp, Homo sapiens
aacactttctctttt

SEQ ID NO: 395162 - DNA, 15 bp, Homo sapiens
acactttctcttttt

SEQ ID NO: 395163 - DNA, 15 bp, Homo sapiens
cactttctcttttta

SEQ ID NO: 395164 - DNA, 15 bp, Homo sapiens
actttctctttttaa

SEQ ID NO: 395165 - DNA, 15 bp, Homo sapiens
ctttctctttttaat

SEQ ID NO: 395166 - DNA, 15 bp, Homo sapiens
tttctctttttaata

SEQ ID NO: 395167 - DNA, 15 bp, Homo sapiens
ttctctttttaatat

SEQ ID NO: 395168 - DNA, 15 bp, Homo sapiens
tctctttttaatatt

SEQ ID NO: 395169 - DNA, 15 bp, Homo sapiens
ctctttttaatatta

SEQ ID NO: 395170 - DNA, 15 bp, Homo sapiens
tctttttaatattag

SEQ ID NO: 395171 - DNA, 15 bp, Homo sapiens
ctttttaatattaga

SEQ ID NO: 395172 - DNA, 15 bp, Homo sapiens
tttttaatattagat

SEQ ID NO: 395173 - DNA, 15 bp, Homo sapiens
ttttaatattagatt

SEQ ID NO: 395174 - DNA, 15 bp, Homo sapiens
tttaatattagattg

SEQ ID NO: 395175 - DNA, 15 bp, Homo sapiens
ttaatattagattga

SEQ ID NO: 395176 - DNA, 15 bp, Homo sapiens
taatattagattgac

SEQ ID NO: 395177 - DNA, 15 bp, Homo sapiens
aatattagattgaca

SEQ ID NO: 395178 - DNA, 15 bp, Homo sapiens
atattagattgacag

SEQ ID NO: 395179 - DNA, 15 bp, Homo sapiens
tattagattgacagt

SEQ ID NO: 395180 - DNA, 15 bp, Homo sapiens
attagattgacagta

SEQ ID NO: 395181 - DNA, 15 bp, Homo sapiens
ttagattgacagtaa

SEQ ID NO: 395182 - DNA, 15 bp, Homo sapiens
tagattgacagtaag

SEQ ID NO: 395183 - DNA, 15 bp, Homo sapiens
agattgacagtaaga

SEQ ID NO: 395184 - DNA, 15 bp, Homo sapiens
gattgacagtaagat

SEQ ID NO: 395185 - DNA, 15 bp, Homo sapiens
attgacagtaagatt

SEQ ID NO: 395186 - DNA, 15 bp, Homo sapiens
ttgacagtaagattt

SEQ ID NO: 395187 - DNA, 15 bp, Homo sapiens
tgacagtaagatttt

SEQ ID NO: 395188 - DNA, 15 bp, Homo sapiens
gacagtaagattttg

SEQ ID NO: 395189 - DNA, 15 bp, Homo sapiens
acagtaagattttga

SEQ ID NO: 395190 - DNA, 15 bp, Homo sapiens
cagtaagattttgaa

SEQ ID NO: 395191 - DNA, 15 bp, Homo sapiens
agtaagattttgaaa

SEQ ID NO: 395192 - DNA, 15 bp, Homo sapiens
gtaagattttgaaac

SEQ ID NO: 395193 - DNA, 15 bp, Homo sapiens
taagattttgaaacc

SEQ ID NO: 395194 - DNA, 15 bp, Homo sapiens
aagattttgaaacca

SEQ ID NO: 395195 - DNA, 15 bp, Homo sapiens
agattttgaaaccat

SEQ ID NO: 395196 - DNA, 15 bp, Homo sapiens
gattttgaaaccatg

SEQ ID NO: 395197 - DNA, 15 bp, Homo sapiens
attttgaaaccatgg

SEQ ID NO: 395198 - DNA, 15 bp, Homo sapiens
ttttgaaaccatggg

SEQ ID NO: 395199 - DNA, 15 bp, Homo sapiens
tttgaaaccatggga

SEQ ID NO: 395200 - DNA, 15 bp, Homo sapiens
ttgaaaccatgggat

SEQ ID NO: 395201 - DNA, 15 bp, Homo sapiens
tgaaaccatgggatt

SEQ ID NO: 395202 - DNA, 15 bp, Homo sapiens
gaaaccatgggatta

SEQ ID NO: 395203 - DNA, 15 bp, Homo sapiens
aaaccatgggattag

SEQ ID NO: 395204 - DNA, 15 bp, Homo sapiens
aaccatgggattagg

SEQ ID NO: 395205 - DNA, 15 bp, Homo sapiens
accatgggattaggt

SEQ ID NO: 395206 - DNA, 15 bp, Homo sapiens
ccatgggattaggta

SEQ ID NO: 395207 - DNA, 15 bp, Homo sapiens
catgggattaggtaa

SEQ ID NO: 395208 - DNA, 15 bp, Homo sapiens
atgggattaggtaaa

SEQ ID NO: 395209 - DNA, 15 bp, Homo sapiens
tgggattaggtaaaa

SEQ ID NO: 395210 - DNA, 15 bp, Homo sapiens
gggattaggtaaaag

SEQ ID NO: 395211 - DNA, 15 bp, Homo sapiens
ggattaggtaaaagt

SEQ ID NO: 395212 - DNA, 15 bp, Homo sapiens
gattaggtaaaagtc

SEQ ID NO: 395213 - DNA, 15 bp, Homo sapiens
attaggtaaaagtca

SEQ ID NO: 395214 - DNA, 15 bp, Homo sapiens
ttaggtaaaagtcat

SEQ ID NO: 395215 - DNA, 15 bp, Homo sapiens
taggtaaaagtcatg

SEQ ID NO: 395216 - DNA, 15 bp, Homo sapiens
aggtaaaagtcatgg

SEQ ID NO: 395217 - DNA, 15 bp, Homo sapiens
ggtaaaagtcatgga

SEQ ID NO: 395218 - DNA, 15 bp, Homo sapiens
gtaaaagtcatggaa

SEQ ID NO: 395219 - DNA, 15 bp, Homo sapiens
taaaagtcatggaaa

SEQ ID NO: 395220 - DNA, 15 bp, Homo sapiens
aaaagtcatggaaat

SEQ ID NO: 395221 - DNA, 15 bp, Homo sapiens
aaagtcatggaaata

SEQ ID NO: 395222 - DNA, 15 bp, Homo sapiens
aagtcatggaaatat

SEQ ID NO: 395223 - DNA, 15 bp, Homo sapiens
agtcatggaaatata

SEQ ID NO: 395224 - DNA, 15 bp, Homo sapiens
gtcatggaaatataa

SEQ ID NO: 395225 - DNA, 15 bp, Homo sapiens
tcatggaaatataat

SEQ ID NO: 395226 - DNA, 15 bp, Homo sapiens
catggaaatataatt

SEQ ID NO: 395227 - DNA, 15 bp, Homo sapiens
atggaaatataattc

SEQ ID NO: 395228 - DNA, 15 bp, Homo sapiens
tggaaatataattct

SEQ ID NO: 395229 - DNA, 15 bp, Homo sapiens
ggaaatataattcta

SEQ ID NO: 395230 - DNA, 15 bp, Homo sapiens
gaaatataattctaa

SEQ ID NO: 395231 - DNA, 15 bp, Homo sapiens
aaatataattctaat

SEQ ID NO: 395232 - DNA, 15 bp, Homo sapiens
aatataattctaatt

SEQ ID NO: 395233 - DNA, 15 bp, Homo sapiens
atataattctaattc

SEQ ID NO: 395234 - DNA, 15 bp, Homo sapiens
tataattctaattca

SEQ ID NO: 395235 - DNA, 15 bp, Homo sapiens
ataattctaattcat

SEQ ID NO: 395236 - DNA, 15 bp, Homo sapiens
taattctaattcatt

SEQ ID NO: 395237 - DNA, 15 bp, Homo sapiens
aattctaattcattg

SEQ ID NO: 395238 - DNA, 15 bp, Homo sapiens
attctaattcattgt

SEQ ID NO: 395239 - DNA, 15 bp, Homo sapiens
ttctaattcattgtg

SEQ ID NO: 395240 - DNA, 15 bp, Homo sapiens
tctaattcattgtga

SEQ ID NO: 395241 - DNA, 15 bp, Homo sapiens
ctaattcattgtgat

SEQ ID NO: 395242 - DNA, 15 bp, Homo sapiens
taattcattgtgata

SEQ ID NO: 395243 - DNA, 15 bp, Homo sapiens
aattcattgtgataa

SEQ ID NO: 395244 - DNA, 15 bp, Homo sapiens
attcattgtgataaa

SEQ ID NO: 395245 - DNA, 15 bp, Homo sapiens
ttcattgtgataaat

SEQ ID NO: 395246 - DNA, 15 bp, Homo sapiens
tcattgtgataaatt

SEQ ID NO: 395247 - DNA, 15 bp, Homo sapiens
cattgtgataaattt

SEQ ID NO: 395248 - DNA, 15 bp, Homo sapiens
attgtgataaattta

SEQ ID NO: 395249 - DNA, 15 bp, Homo sapiens
ttgtgataaatttac

SEQ ID NO: 395250 - DNA, 15 bp, Homo sapiens
tgtgataaatttact

SEQ ID NO: 395251 - DNA, 15 bp, Homo sapiens
gtgataaatttacta

SEQ ID NO: 395252 - DNA, 15 bp, Homo sapiens
tgataaatttactac

SEQ ID NO: 395253 - DNA, 15 bp, Homo sapiens
gataaatttactact

SEQ ID NO: 395254 - DNA, 15 bp, Homo sapiens
ataaatttactactt

SEQ ID NO: 395255 - DNA, 15 bp, Homo sapiens
taaatttactacttt

SEQ ID NO: 395256 - DNA, 15 bp, Homo sapiens
aaatttactacttta

SEQ ID NO: 395257 - DNA, 15 bp, Homo sapiens
aatttactactttat

SEQ ID NO: 395258 - DNA, 15 bp, Homo sapiens
atttactactttatc

SEQ ID NO: 395259 - DNA, 15 bp, Homo sapiens
tttactactttatct

SEQ ID NO: 395260 - DNA, 15 bp, Homo sapiens
ttactactttatctt

SEQ ID NO: 395261 - DNA, 15 bp, Homo sapiens
tactactttatctta

SEQ ID NO: 395262 - DNA, 15 bp, Homo sapiens
actactttatcttag

SEQ ID NO: 395263 - DNA, 15 bp, Homo sapiens
ctactttatcttaga

SEQ ID NO: 395264 - DNA, 15 bp, Homo sapiens
tactttatcttagag

SEQ ID NO: 395265 - DNA, 15 bp, Homo sapiens
actttatcttagaga

SEQ ID NO: 395266 - DNA, 15 bp, Homo sapiens
ctttatcttagagaa

SEQ ID NO: 395267 - DNA, 15 bp, Homo sapiens
tttatcttagagaat

SEQ ID NO: 395268 - DNA, 15 bp, Homo sapiens
ttatcttagagaatt

SEQ ID NO: 395269 - DNA, 15 bp, Homo sapiens
tatcttagagaattt

SEQ ID NO: 395270 - DNA, 15 bp, Homo sapiens
atcttagagaatttg

SEQ ID NO: 395271 - DNA, 15 bp, Homo sapiens
tcttagagaatttga

SEQ ID NO: 395272 - DNA, 15 bp, Homo sapiens
cttagagaatttgat

SEQ ID NO: 395273 - DNA, 15 bp, Homo sapiens
ttagagaatttgata

SEQ ID NO: 395274 - DNA, 15 bp, Homo sapiens
tagagaatttgatag

SEQ ID NO: 395275 - DNA, 15 bp, Homo sapiens
agagaatttgatagt

SEQ ID NO: 395276 - DNA, 15 bp, Homo sapiens
gagaatttgatagtt

SEQ ID NO: 395277 - DNA, 15 bp, Homo sapiens
agaatttgatagttt

SEQ ID NO: 395278 - DNA, 15 bp, Homo sapiens
gaatttgatagtttt

SEQ ID NO: 395279 - DNA, 15 bp, Homo sapiens
aatttgatagttttg

SEQ ID NO: 395280 - DNA, 15 bp, Homo sapiens
atttgatagttttga

SEQ ID NO: 395281 - DNA, 15 bp, Homo sapiens
tttgatagttttgag

SEQ ID NO: 395282 - DNA, 15 bp, Homo sapiens
ttgatagttttgagt

SEQ ID NO: 395283 - DNA, 15 bp, Homo sapiens
tgatagttttgagtt

SEQ ID NO: 395284 - DNA, 15 bp, Homo sapiens
gatagttttgagttt

SEQ ID NO: 395285 - DNA, 15 bp, Homo sapiens
atagttttgagtttt

SEQ ID NO: 395286 - DNA, 15 bp, Homo sapiens
tagttttgagttttc

SEQ ID NO: 395287 - DNA, 15 bp, Homo sapiens
agttttgagttttct

SEQ ID NO: 395288 - DNA, 15 bp, Homo sapiens
gttttgagttttctt

SEQ ID NO: 395289 - DNA, 15 bp, Homo sapiens
ttttgagttttctta

SEQ ID NO: 395290 - DNA, 15 bp, Homo sapiens
tttgagttttcttag

SEQ ID NO: 395291 - DNA, 15 bp, Homo sapiens
ttgagttttcttagt

SEQ ID NO: 395292 - DNA, 15 bp, Homo sapiens
tgagttttcttagta

SEQ ID NO: 395293 - DNA, 15 bp, Homo sapiens
gagttttcttagtac

SEQ ID NO: 395294 - DNA, 15 bp, Homo sapiens
agttttcttagtact

SEQ ID NO: 395295 - DNA, 15 bp, Homo sapiens
gttttcttagtacta

SEQ ID NO: 395296 - DNA, 15 bp, Homo sapiens
ttttcttagtactat

SEQ ID NO: 395297 - DNA, 15 bp, Homo sapiens
tttcttagtactatc

SEQ ID NO: 395298 - DNA, 15 bp, Homo sapiens
ttcttagtactatct

SEQ ID NO: 395299 - DNA, 15 bp, Homo sapiens
tcttagtactatcta

SEQ ID NO: 395300 - DNA, 15 bp, Homo sapiens
cttagtactatctag

SEQ ID NO: 395301 - DNA, 15 bp, Homo sapiens
ttagtactatctagg

SEQ ID NO: 395302 - DNA, 15 bp, Homo sapiens
tagtactatctaggg

SEQ ID NO: 395303 - DNA, 15 bp, Homo sapiens
agtactatctagggc

SEQ ID NO: 395304 - DNA, 15 bp, Homo sapiens
gtactatctagggca

SEQ ID NO: 395305 - DNA, 15 bp, Homo sapiens
tactatctagggcag

SEQ ID NO: 395306 - DNA, 15 bp, Homo sapiens
actatctagggcagc

SEQ ID NO: 395307 - DNA, 15 bp, Homo sapiens
ctatctagggcagct

SEQ ID NO: 395308 - DNA, 15 bp, Homo sapiens
tatctagggcagctt

SEQ ID NO: 395309 - DNA, 15 bp, Homo sapiens
atctagggcagctta

SEQ ID NO: 395310 - DNA, 15 bp, Homo sapiens
tctagggcagcttat

SEQ ID NO: 395311 - DNA, 15 bp, Homo sapiens
ctagggcagcttatg

SEQ ID NO: 395312 - DNA, 15 bp, Homo sapiens
tagggcagcttatgt

SEQ ID NO: 395313 - DNA, 15 bp, Homo sapiens
agggcagcttatgtt

SEQ ID NO: 395314 - DNA, 15 bp, Homo sapiens
gggcagcttatgtta

SEQ ID NO: 395315 - DNA, 15 bp, Homo sapiens
ggcagcttatgttaa

SEQ ID NO: 395316 - DNA, 15 bp, Homo sapiens
gcagcttatgttaaa

SEQ ID NO: 395317 - DNA, 15 bp, Homo sapiens
cagcttatgttaaat

SEQ ID NO: 395318 - DNA, 15 bp, Homo sapiens
agcttatgttaaatg

SEQ ID NO: 395319 - DNA, 15 bp, Homo sapiens
gcttatgttaaatgc

SEQ ID NO: 395320 - DNA, 15 bp, Homo sapiens
cttatgttaaatgct

SEQ ID NO: 395321 - DNA, 15 bp, Homo sapiens
ttatgttaaatgcta

SEQ ID NO: 395322 - DNA, 15 bp, Homo sapiens
tatgttaaatgctat

SEQ ID NO: 395323 - DNA, 15 bp, Homo sapiens
atgttaaatgctatg

SEQ ID NO: 395324 - DNA, 15 bp, Homo sapiens
tgttaaatgctatgt

SEQ ID NO: 395325 - DNA, 15 bp, Homo sapiens
gttaaatgctatgta

SEQ ID NO: 395326 - DNA, 15 bp, Homo sapiens
ttaaatgctatgtaa

SEQ ID NO: 395327 - DNA, 15 bp, Homo sapiens
taaatgctatgtaaa

SEQ ID NO: 395328 - DNA, 15 bp, Homo sapiens
aaatgctatgtaaat

SEQ ID NO: 395329 - DNA, 15 bp, Homo sapiens
aatgctatgtaaatc

SEQ ID NO: 395330 - DNA, 15 bp, Homo sapiens
atgctatgtaaatca

SEQ ID NO: 395331 - DNA, 15 bp, Homo sapiens
tgctatgtaaatcat

SEQ ID NO: 395332 - DNA, 15 bp, Homo sapiens
gctatgtaaatcata

SEQ ID NO: 395333 - DNA, 15 bp, Homo sapiens
ctatgtaaatcatat

SEQ ID NO: 395334 - DNA, 15 bp, Homo sapiens
tatgtaaatcatatc

SEQ ID NO: 395335 - DNA, 15 bp, Homo sapiens
atgtaaatcatatct

SEQ ID NO: 395336 - DNA, 15 bp, Homo sapiens
tgtaaatcatatcta

SEQ ID NO: 395337 - DNA, 15 bp, Homo sapiens
gtaaatcatatctat

SEQ ID NO: 395338 - DNA, 15 bp, Homo sapiens
taaatcatatctata

SEQ ID NO: 395339 - DNA, 15 bp, Homo sapiens
aaatcatatctataa

SEQ ID NO: 395340 - DNA, 15 bp, Homo sapiens
aatcatatctataaa

SEQ ID NO: 395341 - DNA, 15 bp, Homo sapiens
atcatatctataaaa

SEQ ID NO: 395342 - DNA, 15 bp, Homo sapiens
tcatatctataaaat

SEQ ID NO: 395343 - DNA, 15 bp, Homo sapiens
catatctataaaata

SEQ ID NO: 395344 - DNA, 15 bp, Homo sapiens
atatctataaaatat

SEQ ID NO: 395345 - DNA, 15 bp, Homo sapiens
tatctataaaatatg

SEQ ID NO: 395346 - DNA, 15 bp, Homo sapiens
atctataaaatatgc

SEQ ID NO: 395347 - DNA, 15 bp, Homo sapiens
tctataaaatatgca

SEQ ID NO: 395348 - DNA, 15 bp, Homo sapiens
ctataaaatatgcac

SEQ ID NO: 395349 - DNA, 15 bp, Homo sapiens
tataaaatatgcaca

SEQ ID NO: 395350 - DNA, 15 bp, Homo sapiens
ataaaatatgcacag

SEQ ID NO: 395351 - DNA, 15 bp, Homo sapiens
taaaatatgcacagt

SEQ ID NO: 395352 - DNA, 15 bp, Homo sapiens
aaaatatgcacagta

SEQ ID NO: 395353 - DNA, 15 bp, Homo sapiens
aaatatgcacagtaa

SEQ ID NO: 395354 - DNA, 15 bp, Homo sapiens
aatatgcacagtaat

SEQ ID NO: 395355 - DNA, 15 bp, Homo sapiens
atatgcacagtaatg

SEQ ID NO: 395356 - DNA, 15 bp, Homo sapiens
tatgcacagtaatgt

SEQ ID NO: 395357 - DNA, 15 bp, Homo sapiens
atgcacagtaatgta

SEQ ID NO: 395358 - DNA, 15 bp, Homo sapiens
tgcacagtaatgtac

SEQ ID NO: 395359 - DNA, 15 bp, Homo sapiens
gcacagtaatgtact

SEQ ID NO: 395360 - DNA, 15 bp, Homo sapiens
cacagtaatgtactt

SEQ ID NO: 395361 - DNA, 15 bp, Homo sapiens
acagtaatgtacttt

SEQ ID NO: 395362 - DNA, 15 bp, Homo sapiens
cagtaatgtactttt

SEQ ID NO: 395363 - DNA, 15 bp, Homo sapiens
agtaatgtactttta

SEQ ID NO: 395364 - DNA, 15 bp, Homo sapiens
gtaatgtacttttaa

SEQ ID NO: 395365 - DNA, 15 bp, Homo sapiens
taatgtacttttaat

SEQ ID NO: 395366 - DNA, 15 bp, Homo sapiens
aatgtacttttaata

SEQ ID NO: 395367 - DNA, 15 bp, Homo sapiens
atgtacttttaatag

SEQ ID NO: 395368 - DNA, 15 bp, Homo sapiens
tgtacttttaataga

SEQ ID NO: 395369 - DNA, 15 bp, Homo sapiens
gtacttttaatagaa

SEQ ID NO: 395370 - DNA, 15 bp, Homo sapiens
tacttttaatagaaa

SEQ ID NO: 395371 - DNA, 15 bp, Homo sapiens
acttttaatagaaat

SEQ ID NO: 395372 - DNA, 15 bp, Homo sapiens
cttttaatagaaatt

SEQ ID NO: 395373 - DNA, 15 bp, Homo sapiens
ttttaatagaaatta

SEQ ID NO: 395374 - DNA, 15 bp, Homo sapiens
tttaatagaaattat

SEQ ID NO: 395375 - DNA, 15 bp, Homo sapiens
ttaatagaaattatt

SEQ ID NO: 395376 - DNA, 15 bp, Homo sapiens
taatagaaattattt

SEQ ID NO: 395377 - DNA, 15 bp, Homo sapiens
aatagaaattattta

SEQ ID NO: 395378 - DNA, 15 bp, Homo sapiens
atagaaattatttag

SEQ ID NO: 395379 - DNA, 15 bp, Homo sapiens
tagaaattatttaga

SEQ ID NO: 395380 - DNA, 15 bp, Homo sapiens
agaaattatttagaa

SEQ ID NO: 395381 - DNA, 15 bp, Homo sapiens
gaaattatttagaat

SEQ ID NO: 395382 - DNA, 15 bp, Homo sapiens
aattatttagaatac

SEQ ID NO: 395383 - DNA, 15 bp, Homo sapiens
ttatttagaatacag

SEQ ID NO: 395384 - DNA, 15 bp, Homo sapiens
tatttagaatacagt

SEQ ID NO: 395385 - DNA, 15 bp, Homo sapiens
atttagaatacagta

SEQ ID NO: 395386 - DNA, 15 bp, Homo sapiens
tttagaatacagtac

SEQ ID NO: 395387 - DNA, 15 bp, Homo sapiens
ttagaatacagtaca

SEQ ID NO: 395388 - DNA, 15 bp, Homo sapiens
tagaatacagtacaa

SEQ ID NO: 395389 - DNA, 15 bp, Homo sapiens
agaatacagtacaag

SEQ ID NO: 395390 - DNA, 15 bp, Homo sapiens
gaatacagtacaagt

SEQ ID NO: 395391 - DNA, 15 bp, Homo sapiens
aatacagtacaagta

SEQ ID NO: 395392 - DNA, 15 bp, Homo sapiens
atacagtacaagtaa

SEQ ID NO: 395393 - DNA, 15 bp, Homo sapiens
tacagtacaagtaaa

SEQ ID NO: 395394 - DNA, 15 bp, Homo sapiens
acagtacaagtaaag

SEQ ID NO: 395395 - DNA, 15 bp, Homo sapiens
cagtacaagtaaagt

SEQ ID NO: 395396 - DNA, 15 bp, Homo sapiens
agtacaagtaaagta

SEQ ID NO: 395397 - DNA, 15 bp, Homo sapiens
gtacaagtaaagtat

SEQ ID NO: 395398 - DNA, 15 bp, Homo sapiens
tacaagtaaagtata

SEQ ID NO: 395399 - DNA, 15 bp, Homo sapiens
acaagtaaagtataa

SEQ ID NO: 395400 - DNA, 15 bp, Homo sapiens
caagtaaagtataat

SEQ ID NO: 395401 - DNA, 15 bp, Homo sapiens
aagtaaagtataatg

SEQ ID NO: 395402 - DNA, 15 bp, Homo sapiens
agtaaagtataatgg

SEQ ID NO: 395403 - DNA, 15 bp, Homo sapiens
gtaaagtataatggg

SEQ ID NO: 395404 - DNA, 15 bp, Homo sapiens
taaagtataatggga

SEQ ID NO: 395405 - DNA, 15 bp, Homo sapiens
aaagtataatgggaa

SEQ ID NO: 395406 - DNA, 15 bp, Homo sapiens
aagtataatgggaaa

SEQ ID NO: 395407 - DNA, 15 bp, Homo sapiens
agtataatgggaaaa

SEQ ID NO: 395408 - DNA, 15 bp, Homo sapiens
gtataatgggaaaaa

SEQ ID NO: 395409 - DNA, 15 bp, Homo sapiens
tataatgggaaaaat

SEQ ID NO: 395410 - DNA, 15 bp, Homo sapiens
ataatgggaaaaatg

SEQ ID NO: 395411 - DNA, 15 bp, Homo sapiens
taatgggaaaaatgc

SEQ ID NO: 395412 - DNA, 15 bp, Homo sapiens
aatgggaaaaatgct

SEQ ID NO: 395413 - DNA, 15 bp, Homo sapiens
atgggaaaaatgctg

SEQ ID NO: 395414 - DNA, 15 bp, Homo sapiens
tgggaaaaatgctga

SEQ ID NO: 395415 - DNA, 15 bp, Homo sapiens
gggaaaaatgctgaa

SEQ ID NO: 395416 - DNA, 15 bp, Homo sapiens
ggaaaaatgctgaat

SEQ ID NO: 395417 - DNA, 15 bp, Homo sapiens
gaaaaatgctgaatt

SEQ ID NO: 395418 - DNA, 15 bp, Homo sapiens
aaaaatgctgaattt

SEQ ID NO: 395419 - DNA, 15 bp, Homo sapiens
aaaatgctgaatttg

SEQ ID NO: 395420 - DNA, 15 bp, Homo sapiens
aaatgctgaatttgg

SEQ ID NO: 395421 - DNA, 15 bp, Homo sapiens
aatgctgaatttgga

SEQ ID NO: 395422 - DNA, 15 bp, Homo sapiens
atgctgaatttggaa

SEQ ID NO: 395423 - DNA, 15 bp, Homo sapiens
tgctgaatttggaat

SEQ ID NO: 395424 - DNA, 15 bp, Homo sapiens
gctgaatttggaatc

SEQ ID NO: 395425 - DNA, 15 bp, Homo sapiens
ctgaatttggaatca

SEQ ID NO: 395426 - DNA, 15 bp, Homo sapiens
tgaatttggaatcac

SEQ ID NO: 395427 - DNA, 15 bp, Homo sapiens
gaatttggaatcaca

SEQ ID NO: 395428 - DNA, 15 bp, Homo sapiens
aatttggaatcacaa

SEQ ID NO: 395429 - DNA, 15 bp, Homo sapiens
atttggaatcacaag

SEQ ID NO: 395430 - DNA, 15 bp, Homo sapiens
tttggaatcacaaga

SEQ ID NO: 395431 - DNA, 15 bp, Homo sapiens
ttggaatcacaagat

SEQ ID NO: 395432 - DNA, 15 bp, Homo sapiens
tggaatcacaagatc

SEQ ID NO: 395433 - DNA, 15 bp, Homo sapiens
ggaatcacaagatct

SEQ ID NO: 395434 - DNA, 15 bp, Homo sapiens
gaatcacaagatcta

SEQ ID NO: 395435 - DNA, 15 bp, Homo sapiens
aatcacaagatctag

SEQ ID NO: 395436 - DNA, 15 bp, Homo sapiens
atcacaagatctaga

SEQ ID NO: 395437 - DNA, 15 bp, Homo sapiens
tcacaagatctagat

SEQ ID NO: 395438 - DNA, 15 bp, Homo sapiens
cacaagatctagatt

SEQ ID NO: 395439 - DNA, 15 bp, Homo sapiens
acaagatctagattt

SEQ ID NO: 395440 - DNA, 15 bp, Homo sapiens
caagatctagatttg

SEQ ID NO: 395441 - DNA, 15 bp, Homo sapiens
aagatctagatttga

SEQ ID NO: 395442 - DNA, 15 bp, Homo sapiens
agatctagatttgat

SEQ ID NO: 395443 - DNA, 15 bp, Homo sapiens
gatctagatttgatt

SEQ ID NO: 395444 - DNA, 15 bp, Homo sapiens
atctagatttgattc

SEQ ID NO: 395445 - DNA, 15 bp, Homo sapiens
tctagatttgattcc

SEQ ID NO: 395446 - DNA, 15 bp, Homo sapiens
ctagatttgattcct

SEQ ID NO: 395447 - DNA, 15 bp, Homo sapiens
tagatttgattcctt

SEQ ID NO: 395448 - DNA, 15 bp, Homo sapiens
agatttgattcctta

SEQ ID NO: 395449 - DNA, 15 bp, Homo sapiens
gatttgattccttac

SEQ ID NO: 395450 - DNA, 15 bp, Homo sapiens
atttgattccttact

SEQ ID NO: 395451 - DNA, 15 bp, Homo sapiens
tttgattccttactt

SEQ ID NO: 395452 - DNA, 15 bp, Homo sapiens
ttgattccttacttg

SEQ ID NO: 395453 - DNA, 15 bp, Homo sapiens
tgattccttacttgt

SEQ ID NO: 395454 - DNA, 15 bp, Homo sapiens
gattccttacttgtt

SEQ ID NO: 395455 - DNA, 15 bp, Homo sapiens
attccttacttgttt

SEQ ID NO: 395456 - DNA, 15 bp, Homo sapiens
ttccttacttgtttg

SEQ ID NO: 395457 - DNA, 15 bp, Homo sapiens
tccttacttgtttga

SEQ ID NO: 395458 - DNA, 15 bp, Homo sapiens
ccttacttgtttgat

SEQ ID NO: 395459 - DNA, 15 bp, Homo sapiens
cttacttgtttgatc

SEQ ID NO: 395460 - DNA, 15 bp, Homo sapiens
ttacttgtttgatct

SEQ ID NO: 395461 - DNA, 15 bp, Homo sapiens
tacttgtttgatctt

SEQ ID NO: 395462 - DNA, 15 bp, Homo sapiens
acttgtttgatctta

SEQ ID NO: 395463 - DNA, 15 bp, Homo sapiens
cttgtttgatcttat

SEQ ID NO: 395464 - DNA, 15 bp, Homo sapiens
ttgtttgatcttatg

SEQ ID NO: 395465 - DNA, 15 bp, Homo sapiens
tgtttgatcttatgt

SEQ ID NO: 395466 - DNA, 15 bp, Homo sapiens
gtttgatcttatgta

SEQ ID NO: 395467 - DNA, 15 bp, Homo sapiens
tttgatcttatgtaa

SEQ ID NO: 395468 - DNA, 15 bp, Homo sapiens
ttgatcttatgtaat

SEQ ID NO: 395469 - DNA, 15 bp, Homo sapiens
tgatcttatgtaata

SEQ ID NO: 395470 - DNA, 15 bp, Homo sapiens
gatcttatgtaatac

SEQ ID NO: 395471 - DNA, 15 bp, Homo sapiens
atcttatgtaatacc

SEQ ID NO: 395472 - DNA, 15 bp, Homo sapiens
tcttatgtaataccc

SEQ ID NO: 395473 - DNA, 15 bp, Homo sapiens
cttatgtaataccca

SEQ ID NO: 395474 - DNA, 15 bp, Homo sapiens
ttatgtaatacccaa

SEQ ID NO: 395475 - DNA, 15 bp, Homo sapiens
tatgtaatacccaag

SEQ ID NO: 395476 - DNA, 15 bp, Homo sapiens
atgtaatacccaagt

SEQ ID NO: 395477 - DNA, 15 bp, Homo sapiens
tgtaatacccaagtg

SEQ ID NO: 395478 - DNA, 15 bp, Homo sapiens
gtaatacccaagtga

SEQ ID NO: 395479 - DNA, 15 bp, Homo sapiens
taatacccaagtgac

SEQ ID NO: 395480 - DNA, 15 bp, Homo sapiens
aatacccaagtgaca

SEQ ID NO: 395481 - DNA, 15 bp, Homo sapiens
atacccaagtgacat

SEQ ID NO: 395482 - DNA, 15 bp, Homo sapiens
tacccaagtgacata

SEQ ID NO: 395483 - DNA, 15 bp, Homo sapiens
acccaagtgacatat

SEQ ID NO: 395484 - DNA, 15 bp, Homo sapiens
cccaagtgacatatc

SEQ ID NO: 395485 - DNA, 15 bp, Homo sapiens
ccaagtgacatatca

SEQ ID NO: 395486 - DNA, 15 bp, Homo sapiens
caagtgacatatcag

SEQ ID NO: 395487 - DNA, 15 bp, Homo sapiens
aagtgacatatcagt

SEQ ID NO: 395488 - DNA, 15 bp, Homo sapiens
agtgacatatcagtc

SEQ ID NO: 395489 - DNA, 15 bp, Homo sapiens
gtgacatatcagtcc

SEQ ID NO: 395490 - DNA, 15 bp, Homo sapiens
tgacatatcagtcct

SEQ ID NO: 395491 - DNA, 15 bp, Homo sapiens
gacatatcagtcctc

SEQ ID NO: 395492 - DNA, 15 bp, Homo sapiens
acatatcagtcctca

SEQ ID NO: 395493 - DNA, 15 bp, Homo sapiens
catatcagtcctcag

SEQ ID NO: 395494 - DNA, 15 bp, Homo sapiens
atatcagtcctcagt

SEQ ID NO: 395495 - DNA, 15 bp, Homo sapiens
tatcagtcctcagtt

SEQ ID NO: 395496 - DNA, 15 bp, Homo sapiens
atcagtcctcagttt

SEQ ID NO: 395497 - DNA, 15 bp, Homo sapiens
tcagtcctcagtttt

SEQ ID NO: 395498 - DNA, 15 bp, Homo sapiens
cagtcctcagttttg

SEQ ID NO: 395499 - DNA, 15 bp, Homo sapiens
agtcctcagttttgt

SEQ ID NO: 395500 - DNA, 15 bp, Homo sapiens
gtcctcagttttgtc

SEQ ID NO: 395501 - DNA, 15 bp, Homo sapiens
tcctcagttttgtct

SEQ ID NO: 395502 - DNA, 15 bp, Homo sapiens
cctcagttttgtctt

SEQ ID NO: 395503 - DNA, 15 bp, Homo sapiens
ctcagttttgtcttc

SEQ ID NO: 395504 - DNA, 15 bp, Homo sapiens
tcagttttgtcttct

SEQ ID NO: 395505 - DNA, 15 bp, Homo sapiens
cagttttgtcttcta

SEQ ID NO: 395506 - DNA, 15 bp, Homo sapiens
agttttgtcttctag

SEQ ID NO: 395507 - DNA, 15 bp, Homo sapiens
gttttgtcttctaga

SEQ ID NO: 395508 - DNA, 15 bp, Homo sapiens
ttttgtcttctagac

SEQ ID NO: 395509 - DNA, 15 bp, Homo sapiens
tttgtcttctagaca

SEQ ID NO: 395510 - DNA, 15 bp, Homo sapiens
ttgtcttctagacag

SEQ ID NO: 395511 - DNA, 15 bp, Homo sapiens
tgtcttctagacagt

SEQ ID NO: 395512 - DNA, 15 bp, Homo sapiens
gtcttctagacagtg

SEQ ID NO: 395513 - DNA, 15 bp, Homo sapiens
tcttctagacagtgg

SEQ ID NO: 395514 - DNA, 15 bp, Homo sapiens
cttctagacagtggg

SEQ ID NO: 395515 - DNA, 15 bp, Homo sapiens
ttctagacagtggga

SEQ ID NO: 395516 - DNA, 15 bp, Homo sapiens
tctagacagtgggaa

SEQ ID NO: 395517 - DNA, 15 bp, Homo sapiens
ctagacagtgggaat

SEQ ID NO: 395518 - DNA, 15 bp, Homo sapiens
tagacagtgggaata

SEQ ID NO: 395519 - DNA, 15 bp, Homo sapiens
agacagtgggaataa

SEQ ID NO: 395520 - DNA, 15 bp, Homo sapiens
gacagtgggaataat

SEQ ID NO: 395521 - DNA, 15 bp, Homo sapiens
acagtgggaataatt

SEQ ID NO: 395522 - DNA, 15 bp, Homo sapiens
cagtgggaataattt

SEQ ID NO: 395523 - DNA, 15 bp, Homo sapiens
agtgggaataattta

SEQ ID NO: 395524 - DNA, 15 bp, Homo sapiens
gtgggaataatttac

SEQ ID NO: 395525 - DNA, 15 bp, Homo sapiens
tgggaataatttaca

SEQ ID NO: 395526 - DNA, 15 bp, Homo sapiens
gggaataatttacat

SEQ ID NO: 395527 - DNA, 15 bp, Homo sapiens
ggaataatttacatt

SEQ ID NO: 395528 - DNA, 15 bp, Homo sapiens
gaataatttacattc

SEQ ID NO: 395529 - DNA, 15 bp, Homo sapiens
aataatttacattcc

SEQ ID NO: 395530 - DNA, 15 bp, Homo sapiens
ataatttacattcca

SEQ ID NO: 395531 - DNA, 15 bp, Homo sapiens
taatttacattccac

SEQ ID NO: 395532 - DNA, 15 bp, Homo sapiens
aatttacattccaca

SEQ ID NO: 395533 - DNA, 15 bp, Homo sapiens
atttacattccacat

SEQ ID NO: 395534 - DNA, 15 bp, Homo sapiens
tttacattccacata

SEQ ID NO: 395535 - DNA, 15 bp, Homo sapiens
ttacattccacatat

SEQ ID NO: 395536 - DNA, 15 bp, Homo sapiens
tacattccacatatt

SEQ ID NO: 395537 - DNA, 15 bp, Homo sapiens
acattccacatattt

SEQ ID NO: 395538 - DNA, 15 bp, Homo sapiens
cattccacatatttt

SEQ ID NO: 395539 - DNA, 15 bp, Homo sapiens
attccacatatttta

SEQ ID NO: 395540 - DNA, 15 bp, Homo sapiens
ttccacatattttag

SEQ ID NO: 395541 - DNA, 15 bp, Homo sapiens
tccacatattttaga

SEQ ID NO: 395542 - DNA, 15 bp, Homo sapiens
ccacatattttagaa

SEQ ID NO: 395543 - DNA, 15 bp, Homo sapiens
cacatattttagaaa

SEQ ID NO: 395544 - DNA, 15 bp, Homo sapiens
acatattttagaaag

SEQ ID NO: 395545 - DNA, 15 bp, Homo sapiens
catattttagaaagc

SEQ ID NO: 395546 - DNA, 15 bp, Homo sapiens
atattttagaaagct

SEQ ID NO: 395547 - DNA, 15 bp, Homo sapiens
tattttagaaagctg

SEQ ID NO: 395548 - DNA, 15 bp, Homo sapiens
attttagaaagctgt

SEQ ID NO: 395549 - DNA, 15 bp, Homo sapiens
ttttagaaagctgtt

SEQ ID NO: 395550 - DNA, 15 bp, Homo sapiens
tttagaaagctgtta

SEQ ID NO: 395551 - DNA, 15 bp, Homo sapiens
ttagaaagctgttat

SEQ ID NO: 395552 - DNA, 15 bp, Homo sapiens
tagaaagctgttata

SEQ ID NO: 395553 - DNA, 15 bp, Homo sapiens
agaaagctgttatag

SEQ ID NO: 395554 - DNA, 15 bp, Homo sapiens
gaaagctgttatagg

SEQ ID NO: 395555 - DNA, 15 bp, Homo sapiens
aaagctgttatagga

SEQ ID NO: 395556 - DNA, 15 bp, Homo sapiens
aagctgttataggac

SEQ ID NO: 395557 - DNA, 15 bp, Homo sapiens
agctgttataggacc

SEQ ID NO: 395558 - DNA, 15 bp, Homo sapiens
gctgttataggacca

SEQ ID NO: 395559 - DNA, 15 bp, Homo sapiens
ctgttataggaccag

SEQ ID NO: 395560 - DNA, 15 bp, Homo sapiens
tgttataggaccagt

SEQ ID NO: 395561 - DNA, 15 bp, Homo sapiens
gttataggaccagtg

SEQ ID NO: 395562 - DNA, 15 bp, Homo sapiens
ttataggaccagtgt

SEQ ID NO: 395563 - DNA, 15 bp, Homo sapiens
tataggaccagtgta

SEQ ID NO: 395564 - DNA, 15 bp, Homo sapiens
ataggaccagtgtat

SEQ ID NO: 395565 - DNA, 15 bp, Homo sapiens
taggaccagtgtatt

SEQ ID NO: 395566 - DNA, 15 bp, Homo sapiens
aggaccagtgtatta

SEQ ID NO: 395567 - DNA, 15 bp, Homo sapiens
ggaccagtgtattaa

SEQ ID NO: 395568 - DNA, 15 bp, Homo sapiens
gaccagtgtattaat

SEQ ID NO: 395569 - DNA, 15 bp, Homo sapiens
accagtgtattaatg

SEQ ID NO: 395570 - DNA, 15 bp, Homo sapiens
ccagtgtattaatgt

SEQ ID NO: 395571 - DNA, 15 bp, Homo sapiens
cagtgtattaatgtt

SEQ ID NO: 395572 - DNA, 15 bp, Homo sapiens
agtgtattaatgttt

SEQ ID NO: 395573 - DNA, 15 bp, Homo sapiens
gtgtattaatgttta

SEQ ID NO: 395574 - DNA, 15 bp, Homo sapiens
tgtattaatgtttat

SEQ ID NO: 395575 - DNA, 15 bp, Homo sapiens
gtattaatgtttatg

SEQ ID NO: 395576 - DNA, 15 bp, Homo sapiens
tattaatgtttatga

SEQ ID NO: 395577 - DNA, 15 bp, Homo sapiens
attaatgtttatgaa

SEQ ID NO: 395578 - DNA, 15 bp, Homo sapiens
ttaatgtttatgaat

SEQ ID NO: 395579 - DNA, 15 bp, Homo sapiens
taatgtttatgaatt

SEQ ID NO: 395580 - DNA, 15 bp, Homo sapiens
aatgtttatgaattt

SEQ ID NO: 395581 - DNA, 15 bp, Homo sapiens
atgtttatgaatttg

SEQ ID NO: 395582 - DNA, 15 bp, Homo sapiens
tgtttatgaatttgc

SEQ ID NO: 395583 - DNA, 15 bp, Homo sapiens
gtttatgaatttgct

SEQ ID NO: 395584 - DNA, 15 bp, Homo sapiens
tttatgaatttgcta

SEQ ID NO: 395585 - DNA, 15 bp, Homo sapiens
ttatgaatttgctat

SEQ ID NO: 395586 - DNA, 15 bp, Homo sapiens
tatgaatttgctatg

SEQ ID NO: 395587 - DNA, 15 bp, Homo sapiens
atgaatttgctatgc

SEQ ID NO: 395588 - DNA, 15 bp, Homo sapiens
tgaatttgctatgca

SEQ ID NO: 395589 - DNA, 15 bp, Homo sapiens
gaatttgctatgcag

SEQ ID NO: 395590 - DNA, 15 bp, Homo sapiens
aatttgctatgcaga

SEQ ID NO: 395591 - DNA, 15 bp, Homo sapiens
atttgctatgcagag

SEQ ID NO: 395592 - DNA, 15 bp, Homo sapiens
tttgctatgcagagc

SEQ ID NO: 395593 - DNA, 15 bp, Homo sapiens
ttgctatgcagagct

SEQ ID NO: 395594 - DNA, 15 bp, Homo sapiens
tgctatgcagagctg

SEQ ID NO: 395595 - DNA, 15 bp, Homo sapiens
gctatgcagagctgg

SEQ ID NO: 395596 - DNA, 15 bp, Homo sapiens
ctatgcagagctgga

SEQ ID NO: 395597 - DNA, 15 bp, Homo sapiens
tatgcagagctggag

SEQ ID NO: 395598 - DNA, 15 bp, Homo sapiens
atgcagagctggagt

SEQ ID NO: 395599 - DNA, 15 bp, Homo sapiens
tgcagagctggagta

SEQ ID NO: 395600 - DNA, 15 bp, Homo sapiens
gcagagctggagtat

SEQ ID NO: 395601 - DNA, 15 bp, Homo sapiens
cagagctggagtatt

SEQ ID NO: 395602 - DNA, 15 bp, Homo sapiens
agagctggagtatta

SEQ ID NO: 395603 - DNA, 15 bp, Homo sapiens
gagctggagtattat

SEQ ID NO: 395604 - DNA, 15 bp, Homo sapiens
agctggagtattatg

SEQ ID NO: 395605 - DNA, 15 bp, Homo sapiens
gctggagtattatgg

SEQ ID NO: 395606 - DNA, 15 bp, Homo sapiens
ctggagtattatgga

SEQ ID NO: 395607 - DNA, 15 bp, Homo sapiens
tggagtattatggaa

SEQ ID NO: 395608 - DNA, 15 bp, Homo sapiens
ggagtattatggaaa

SEQ ID NO: 395609 - DNA, 15 bp, Homo sapiens
gagtattatggaaat

SEQ ID NO: 395610 - DNA, 15 bp, Homo sapiens
agtattatggaaatc

SEQ ID NO: 395611 - DNA, 15 bp, Homo sapiens
gtattatggaaatcg

SEQ ID NO: 395612 - DNA, 15 bp, Homo sapiens
tattatggaaatcga

SEQ ID NO: 395613 - DNA, 15 bp, Homo sapiens
attatggaaatcgaa

SEQ ID NO: 395614 - DNA, 15 bp, Homo sapiens
ttatggaaatcgaaa

SEQ ID NO: 395615 - DNA, 15 bp, Homo sapiens
tatggaaatcgaaat

SEQ ID NO: 395616 - DNA, 15 bp, Homo sapiens
atggaaatcgaaata

SEQ ID NO: 395617 - DNA, 15 bp, Homo sapiens
tggaaatcgaaatat

SEQ ID NO: 395618 - DNA, 15 bp, Homo sapiens
ggaaatcgaaatatt

SEQ ID NO: 395619 - DNA, 15 bp, Homo sapiens
gaaatcgaaatatta

SEQ ID NO: 395620 - DNA, 15 bp, Homo sapiens
aaatcgaaatattaa

SEQ ID NO: 395621 - DNA, 15 bp, Homo sapiens
aatcgaaatattaaa

SEQ ID NO: 395622 - DNA, 15 bp, Homo sapiens
atcgaaatattaaat

SEQ ID NO: 395623 - DNA, 15 bp, Homo sapiens
tcgaaatattaaatt

SEQ ID NO: 395624 - DNA, 15 bp, Homo sapiens
cgaaatattaaattt

SEQ ID NO: 395625 - DNA, 15 bp, Homo sapiens
gaaatattaaatttc

SEQ ID NO: 395626 - DNA, 15 bp, Homo sapiens
aaatattaaatttcc

SEQ ID NO: 395627 - DNA, 15 bp, Homo sapiens
aatattaaatttcct

SEQ ID NO: 395628 - DNA, 15 bp, Homo sapiens
atattaaatttccta

SEQ ID NO: 395629 - DNA, 15 bp, Homo sapiens
tattaaatttcctat

SEQ ID NO: 395630 - DNA, 15 bp, Homo sapiens
attaaatttcctatg

SEQ ID NO: 395631 - DNA, 15 bp, Homo sapiens
ttaaatttcctatga

SEQ ID NO: 395632 - DNA, 15 bp, Homo sapiens
taaatttcctatgaa

SEQ ID NO: 395633 - DNA, 15 bp, Homo sapiens
aaatttcctatgaat

SEQ ID NO: 395634 - DNA, 15 bp, Homo sapiens
aatttcctatgaata

SEQ ID NO: 395635 - DNA, 15 bp, Homo sapiens
atttcctatgaataa

SEQ ID NO: 395636 - DNA, 15 bp, Homo sapiens
tttcctatgaataaa

SEQ ID NO: 395637 - DNA, 15 bp, Homo sapiens
ttcctatgaataaaa

SEQ ID NO: 395638 - DNA, 15 bp, Homo sapiens
tcctatgaataaaaa

SEQ ID NO: 395639 - DNA, 15 bp, Homo sapiens
cctatgaataaaaac

SEQ ID NO: 395640 - DNA, 15 bp, Homo sapiens
ctatgaataaaaaca

SEQ ID NO: 395641 - DNA, 15 bp, Homo sapiens
tatgaataaaaacaa

SEQ ID NO: 395642 - DNA, 15 bp, Homo sapiens
atgaataaaaacaac

SEQ ID NO: 395643 - DNA, 15 bp, Homo sapiens
tgaataaaaacaaca

SEQ ID NO: 395644 - DNA, 15 bp, Homo sapiens
gaataaaaacaacaa

SEQ ID NO: 395645 - DNA, 15 bp, Homo sapiens
aataaaaacaacaaa

SEQ ID NO: 395646 - DNA, 15 bp, Homo sapiens
ataaaaacaacaaat

SEQ ID NO: 395647 - DNA, 15 bp, Homo sapiens
taaaaacaacaaata

SEQ ID NO: 395648 - DNA, 15 bp, Homo sapiens
aaaaacaacaaataa

SEQ ID NO: 395649 - DNA, 15 bp, Homo sapiens
aaaacaacaaataac

SEQ ID NO: 395650 - DNA, 15 bp, Homo sapiens
aaacaacaaataaca

SEQ ID NO: 395651 - DNA, 15 bp, Homo sapiens
aacaacaaataacaa

SEQ ID NO: 395652 - DNA, 15 bp, Homo sapiens
acaacaaataacaat

SEQ ID NO: 395653 - DNA, 15 bp, Homo sapiens
caacaaataacaatc

SEQ ID NO: 395654 - DNA, 15 bp, Homo sapiens
aacaaataacaatca

SEQ ID NO: 395655 - DNA, 15 bp, Homo sapiens
acaaataacaatcaa

SEQ ID NO: 395656 - DNA, 15 bp, Homo sapiens
caaataacaatcaat

SEQ ID NO: 395657 - DNA, 15 bp, Homo sapiens
aaataacaatcaatg

SEQ ID NO: 395658 - DNA, 15 bp, Homo sapiens
aataacaatcaatga

SEQ ID NO: 395659 - DNA, 15 bp, Homo sapiens
ataacaatcaatgac

SEQ ID NO: 395660 - DNA, 15 bp, Homo sapiens
taacaatcaatgaca

SEQ ID NO: 395661 - DNA, 15 bp, Homo sapiens
aacaatcaatgacaa

SEQ ID NO: 395662 - DNA, 15 bp, Homo sapiens
acaatcaatgacaat

SEQ ID NO: 395663 - DNA, 15 bp, Homo sapiens
caatcaatgacaata

SEQ ID NO: 395664 - DNA, 15 bp, Homo sapiens
aatcaatgacaatat

SEQ ID NO: 395665 - DNA, 15 bp, Homo sapiens
atcaatgacaatatt

SEQ ID NO: 395666 - DNA, 15 bp, Homo sapiens
tcaatgacaatattt

SEQ ID NO: 395667 - DNA, 15 bp, Homo sapiens
caatgacaatattta

SEQ ID NO: 395668 - DNA, 15 bp, Homo sapiens
aatgacaatatttac

SEQ ID NO: 395669 - DNA, 15 bp, Homo sapiens
atgacaatatttacc

SEQ ID NO: 395670 - DNA, 15 bp, Homo sapiens
tgacaatatttacct

SEQ ID NO: 395671 - DNA, 15 bp, Homo sapiens
gacaatatttaccta

SEQ ID NO: 395672 - DNA, 15 bp, Homo sapiens
acaatatttacctac

SEQ ID NO: 395673 - DNA, 15 bp, Homo sapiens
caatatttacctaca

SEQ ID NO: 395674 - DNA, 15 bp, Homo sapiens
aatatttacctacat

SEQ ID NO: 395675 - DNA, 15 bp, Homo sapiens
atatttacctacatt

SEQ ID NO: 395676 - DNA, 15 bp, Homo sapiens
tatttacctacattt

SEQ ID NO: 395677 - DNA, 15 bp, Homo sapiens
atttacctacatttg

SEQ ID NO: 395678 - DNA, 15 bp, Homo sapiens
tttacctacatttga

SEQ ID NO: 395679 - DNA, 15 bp, Homo sapiens
ttacctacatttgag

SEQ ID NO: 395680 - DNA, 15 bp, Homo sapiens
tacctacatttgagt

SEQ ID NO: 395681 - DNA, 15 bp, Homo sapiens
acctacatttgagtt

SEQ ID NO: 395682 - DNA, 15 bp, Homo sapiens
cctacatttgagttt

SEQ ID NO: 395683 - DNA, 15 bp, Homo sapiens
ctacatttgagtttc

SEQ ID NO: 395684 - DNA, 15 bp, Homo sapiens
tacatttgagtttct

SEQ ID NO: 395685 - DNA, 15 bp, Homo sapiens
acatttgagtttctc

SEQ ID NO: 395686 - DNA, 15 bp, Homo sapiens
catttgagtttctca

SEQ ID NO: 395687 - DNA, 15 bp, Homo sapiens
atttgagtttctcac

SEQ ID NO: 395688 - DNA, 15 bp, Homo sapiens
tttgagtttctcacc

SEQ ID NO: 395689 - DNA, 15 bp, Homo sapiens
ttgagtttctcacca

SEQ ID NO: 395690 - DNA, 15 bp, Homo sapiens
tgagtttctcaccat

SEQ ID NO: 395691 - DNA, 15 bp, Homo sapiens
gagtttctcaccatg

SEQ ID NO: 395692 - DNA, 15 bp, Homo sapiens
agtttctcaccatgc

SEQ ID NO: 395693 - DNA, 15 bp, Homo sapiens
gtttctcaccatgca

SEQ ID NO: 395694 - DNA, 15 bp, Homo sapiens
tttctcaccatgcac

SEQ ID NO: 395695 - DNA, 15 bp, Homo sapiens
ttctcaccatgcact

SEQ ID NO: 395696 - DNA, 15 bp, Homo sapiens
tctcaccatgcactg

SEQ ID NO: 395697 - DNA, 15 bp, Homo sapiens
ctcaccatgcactgc

SEQ ID NO: 395698 - DNA, 15 bp, Homo sapiens
tcaccatgcactgct

SEQ ID NO: 395699 - DNA, 15 bp, Homo sapiens
caccatgcactgctg

SEQ ID NO: 395700 - DNA, 15 bp, Homo sapiens
accatgcactgctga

SEQ ID NO: 395701 - DNA, 15 bp, Homo sapiens
ccatgcactgctgaa

SEQ ID NO: 395702 - DNA, 15 bp, Homo sapiens
catgcactgctgaaa

SEQ ID NO: 395703 - DNA, 15 bp, Homo sapiens
atgcactgctgaaat

SEQ ID NO: 395704 - DNA, 15 bp, Homo sapiens
tgcactgctgaaatg

SEQ ID NO: 395705 - DNA, 15 bp, Homo sapiens
gcactgctgaaatgc

SEQ ID NO: 395706 - DNA, 15 bp, Homo sapiens
cactgctgaaatgcg

SEQ ID NO: 395707 - DNA, 15 bp, Homo sapiens
actgctgaaatgcgt

SEQ ID NO: 395708 - DNA, 15 bp, Homo sapiens
ctgctgaaatgcgtt

SEQ ID NO: 395709 - DNA, 15 bp, Homo sapiens
tgctgaaatgcgttt

SEQ ID NO: 395710 - DNA, 15 bp, Homo sapiens
gctgaaatgcgtttt

SEQ ID NO: 395711 - DNA, 15 bp, Homo sapiens
ctgaaatgcgttttg

SEQ ID NO: 395712 - DNA, 15 bp, Homo sapiens
tgaaatgcgttttga

SEQ ID NO: 395713 - DNA, 15 bp, Homo sapiens
gaaatgcgttttgaa

SEQ ID NO: 395714 - DNA, 15 bp, Homo sapiens
aaatgcgttttgaaa

SEQ ID NO: 395715 - DNA, 15 bp, Homo sapiens
aatgcgttttgaaaa

SEQ ID NO: 395716 - DNA, 15 bp, Homo sapiens
atgcgttttgaaaac

SEQ ID NO: 395717 - DNA, 15 bp, Homo sapiens
tgcgttttgaaaaca

SEQ ID NO: 395718 - DNA, 15 bp, Homo sapiens
gcgttttgaaaacag

SEQ ID NO: 395719 - DNA, 15 bp, Homo sapiens
cgttttgaaaacagt

SEQ ID NO: 395720 - DNA, 15 bp, Homo sapiens
gttttgaaaacagtg

SEQ ID NO: 395721 - DNA, 15 bp, Homo sapiens
ttttgaaaacagtga

SEQ ID NO: 395722 - DNA, 15 bp, Homo sapiens
tttgaaaacagtgac

SEQ ID NO: 395723 - DNA, 15 bp, Homo sapiens
ttgaaaacagtgact

SEQ ID NO: 395724 - DNA, 15 bp, Homo sapiens
tgaaaacagtgacta

SEQ ID NO: 395725 - DNA, 15 bp, Homo sapiens
gaaaacagtgactaa

SEQ ID NO: 395726 - DNA, 15 bp, Homo sapiens
aaaacagtgactaac

SEQ ID NO: 395727 - DNA, 15 bp, Homo sapiens
aaacagtgactaact

SEQ ID NO: 395728 - DNA, 15 bp, Homo sapiens
aacagtgactaactc

SEQ ID NO: 395729 - DNA, 15 bp, Homo sapiens
acagtgactaactca

SEQ ID NO: 395730 - DNA, 15 bp, Homo sapiens
cagtgactaactcaa

SEQ ID NO: 395731 - DNA, 15 bp, Homo sapiens
agtgactaactcaaa

SEQ ID NO: 395732 - DNA, 15 bp, Homo sapiens
gtgactaactcaaac

SEQ ID NO: 395733 - DNA, 15 bp, Homo sapiens
tgactaactcaaact

SEQ ID NO: 395734 - DNA, 15 bp, Homo sapiens
gactaactcaaactt

SEQ ID NO: 395735 - DNA, 15 bp, Homo sapiens
actaactcaaacttc

SEQ ID NO: 395736 - DNA, 15 bp, Homo sapiens
ctaactcaaacttct

SEQ ID NO: 395737 - DNA, 15 bp, Homo sapiens
taactcaaacttctg

SEQ ID NO: 395738 - DNA, 15 bp, Homo sapiens
aactcaaacttctgt

SEQ ID NO: 395739 - DNA, 15 bp, Homo sapiens
actcaaacttctgtg

SEQ ID NO: 395740 - DNA, 15 bp, Homo sapiens
ctcaaacttctgtgt

SEQ ID NO: 395741 - DNA, 15 bp, Homo sapiens
tcaaacttctgtgtg

SEQ ID NO: 395742 - DNA, 15 bp, Homo sapiens
caaacttctgtgtgt

SEQ ID NO: 395743 - DNA, 15 bp, Homo sapiens
aaacttctgtgtgtc

SEQ ID NO: 395744 - DNA, 15 bp, Homo sapiens
aacttctgtgtgtct

SEQ ID NO: 395745 - DNA, 15 bp, Homo sapiens
acttctgtgtgtctc

SEQ ID NO: 395746 - DNA, 15 bp, Homo sapiens
cttctgtgtgtctca

SEQ ID NO: 395747 - DNA, 15 bp, Homo sapiens
ttctgtgtgtctcaa

SEQ ID NO: 395748 - DNA, 15 bp, Homo sapiens
tctgtgtgtctcaac

SEQ ID NO: 395749 - DNA, 15 bp, Homo sapiens
ctgtgtgtctcaact

SEQ ID NO: 395750 - DNA, 15 bp, Homo sapiens
tgtgtgtctcaactg

SEQ ID NO: 395751 - DNA, 15 bp, Homo sapiens
gtgtgtctcaactga

SEQ ID NO: 395752 - DNA, 15 bp, Homo sapiens
tgtgtctcaactgag

SEQ ID NO: 395753 - DNA, 15 bp, Homo sapiens
gtgtctcaactgagg

SEQ ID NO: 395754 - DNA, 15 bp, Homo sapiens
tgtctcaactgaggc

SEQ ID NO: 395755 - DNA, 15 bp, Homo sapiens
gtctcaactgaggcg

SEQ ID NO: 395756 - DNA, 15 bp, Homo sapiens
tctcaactgaggcgg

SEQ ID NO: 395757 - DNA, 15 bp, Homo sapiens
ctcaactgaggcgga

SEQ ID NO: 395758 - DNA, 15 bp, Homo sapiens
tcaactgaggcggaa

SEQ ID NO: 395759 - DNA, 15 bp, Homo sapiens
caactgaggcggaag

SEQ ID NO: 395760 - DNA, 15 bp, Homo sapiens
aactgaggcggaaga

SEQ ID NO: 395761 - DNA, 15 bp, Homo sapiens
actgaggcggaagaa

SEQ ID NO: 395762 - DNA, 15 bp, Homo sapiens
ctgaggcggaagaat

SEQ ID NO: 395763 - DNA, 15 bp, Homo sapiens
tgaggcggaagaatg

SEQ ID NO: 395764 - DNA, 15 bp, Homo sapiens
gaggcggaagaatgt

SEQ ID NO: 395765 - DNA, 15 bp, Homo sapiens
aggcggaagaatgtt

SEQ ID NO: 395766 - DNA, 15 bp, Homo sapiens
ggcggaagaatgttg

SEQ ID NO: 395767 - DNA, 15 bp, Homo sapiens
gcggaagaatgttga

SEQ ID NO: 395768 - DNA, 15 bp, Homo sapiens
cggaagaatgttgaa

SEQ ID NO: 395769 - DNA, 15 bp, Homo sapiens
ggaagaatgttgaat

SEQ ID NO: 395770 - DNA, 15 bp, Homo sapiens
gaagaatgttgaata

SEQ ID NO: 395771 - DNA, 15 bp, Homo sapiens
aagaatgttgaatac

SEQ ID NO: 395772 - DNA, 15 bp, Homo sapiens
agaatgttgaatact

SEQ ID NO: 395773 - DNA, 15 bp, Homo sapiens
gaatgttgaatacta

SEQ ID NO: 395774 - DNA, 15 bp, Homo sapiens
aatgttgaatactaa

SEQ ID NO: 395775 - DNA, 15 bp, Homo sapiens
atgttgaatactaac

SEQ ID NO: 395776 - DNA, 15 bp, Homo sapiens
tgttgaatactaacc

SEQ ID NO: 395777 - DNA, 15 bp, Homo sapiens
gttgaatactaacca

SEQ ID NO: 395778 - DNA, 15 bp, Homo sapiens
ttgaatactaaccac

SEQ ID NO: 395779 - DNA, 15 bp, Homo sapiens
tgaatactaaccacc

SEQ ID NO: 395780 - DNA, 15 bp, Homo sapiens
gaatactaaccacct

SEQ ID NO: 395781 - DNA, 15 bp, Homo sapiens
aatactaaccacctt

SEQ ID NO: 395782 - DNA, 15 bp, Homo sapiens
atactaaccacctta

SEQ ID NO: 395783 - DNA, 15 bp, Homo sapiens
tactaaccaccttag

SEQ ID NO: 395784 - DNA, 15 bp, Homo sapiens
actaaccaccttagg

SEQ ID NO: 395785 - DNA, 15 bp, Homo sapiens
ctaaccaccttaggt

SEQ ID NO: 395786 - DNA, 15 bp, Homo sapiens
taaccaccttaggtc

SEQ ID NO: 395787 - DNA, 15 bp, Homo sapiens
aaccaccttaggtct

SEQ ID NO: 395788 - DNA, 15 bp, Homo sapiens
accaccttaggtctt

SEQ ID NO: 395789 - DNA, 15 bp, Homo sapiens
ccaccttaggtcttt

SEQ ID NO: 395790 - DNA, 15 bp, Homo sapiens
caccttaggtctttc

SEQ ID NO: 395791 - DNA, 15 bp, Homo sapiens
accttaggtctttct

SEQ ID NO: 395792 - DNA, 15 bp, Homo sapiens
ccttaggtctttctg

SEQ ID NO: 395793 - DNA, 15 bp, Homo sapiens
cttaggtctttctgc

SEQ ID NO: 395794 - DNA, 15 bp, Homo sapiens
ttaggtctttctgca

SEQ ID NO: 395795 - DNA, 15 bp, Homo sapiens
taggtctttctgcaa

SEQ ID NO: 395796 - DNA, 15 bp, Homo sapiens
aggtctttctgcaat

SEQ ID NO: 395797 - DNA, 15 bp, Homo sapiens
ggtctttctgcaatg

SEQ ID NO: 395798 - DNA, 15 bp, Homo sapiens
gtctttctgcaatgc

SEQ ID NO: 395799 - DNA, 15 bp, Homo sapiens
tctttctgcaatgca

SEQ ID NO: 395800 - DNA, 15 bp, Homo sapiens
ctttctgcaatgcag

SEQ ID NO: 395801 - DNA, 15 bp, Homo sapiens
tttctgcaatgcagg

SEQ ID NO: 395802 - DNA, 15 bp, Homo sapiens
ttctgcaatgcaggg

SEQ ID NO: 395803 - DNA, 15 bp, Homo sapiens
tctgcaatgcagggt

SEQ ID NO: 395804 - DNA, 15 bp, Homo sapiens
ctgcaatgcagggtc

SEQ ID NO: 395805 - DNA, 15 bp, Homo sapiens
tgcaatgcagggtca

SEQ ID NO: 395806 - DNA, 15 bp, Homo sapiens
gcaatgcagggtcag

SEQ ID NO: 395807 - DNA, 15 bp, Homo sapiens
caatgcagggtcagt

SEQ ID NO: 395808 - DNA, 15 bp, Homo sapiens
aatgcagggtcagtt

SEQ ID NO: 395809 - DNA, 15 bp, Homo sapiens
atgcagggtcagttc

SEQ ID NO: 395810 - DNA, 15 bp, Homo sapiens
tgcagggtcagttca

SEQ ID NO: 395811 - DNA, 15 bp, Homo sapiens
gcagggtcagttcat

SEQ ID NO: 395812 - DNA, 15 bp, Homo sapiens
cagggtcagttcatt

SEQ ID NO: 395813 - DNA, 15 bp, Homo sapiens
agggtcagttcattt

SEQ ID NO: 395814 - DNA, 15 bp, Homo sapiens
gggtcagttcatttt

SEQ ID NO: 395815 - DNA, 15 bp, Homo sapiens
ggtcagttcattttt

SEQ ID NO: 395816 - DNA, 15 bp, Homo sapiens
gtcagttcatttttc

SEQ ID NO: 395817 - DNA, 15 bp, Homo sapiens
tcagttcatttttct

SEQ ID NO: 395818 - DNA, 15 bp, Homo sapiens
cagttcatttttctt

SEQ ID NO: 395819 - DNA, 15 bp, Homo sapiens
agttcatttttcttc

SEQ ID NO: 395820 - DNA, 15 bp, Homo sapiens
gttcatttttcttct

SEQ ID NO: 395821 - DNA, 15 bp, Homo sapiens
ttcatttttcttctt

SEQ ID NO: 395822 - DNA, 15 bp, Homo sapiens
tcatttttcttcttt

SEQ ID NO: 395823 - DNA, 15 bp, Homo sapiens
catttttcttctttc

SEQ ID NO: 395824 - DNA, 15 bp, Homo sapiens
atttttcttctttcc

SEQ ID NO: 395825 - DNA, 15 bp, Homo sapiens
tttttcttctttcct

SEQ ID NO: 395826 - DNA, 15 bp, Homo sapiens
ttttcttctttcctg

SEQ ID NO: 395827 - DNA, 15 bp, Homo sapiens
tttcttctttcctgg

SEQ ID NO: 395828 - DNA, 15 bp, Homo sapiens
ttcttctttcctggg

SEQ ID NO: 395829 - DNA, 15 bp, Homo sapiens
tcttctttcctgggg

SEQ ID NO: 395830 - DNA, 15 bp, Homo sapiens
cttctttcctggggc

SEQ ID NO: 395831 - DNA, 15 bp, Homo sapiens
ttctttcctggggca

SEQ ID NO: 395832 - DNA, 15 bp, Homo sapiens
tctttcctggggcac

SEQ ID NO: 395833 - DNA, 15 bp, Homo sapiens
ctttcctggggcaca

SEQ ID NO: 395834 - DNA, 15 bp, Homo sapiens
tttcctggggcacac

SEQ ID NO: 395835 - DNA, 15 bp, Homo sapiens
ttcctggggcacaca

SEQ ID NO: 395836 - DNA, 15 bp, Homo sapiens
tcctggggcacacag

SEQ ID NO: 395837 - DNA, 15 bp, Homo sapiens
ctggggcacacagcc

SEQ ID NO: 395838 - DNA, 15 bp, Homo sapiens
tggggcacacagcca

SEQ ID NO: 395839 - DNA, 15 bp, Homo sapiens
ggggcacacagccag

SEQ ID NO: 395840 - DNA, 15 bp, Homo sapiens
gggcacacagccagc

SEQ ID NO: 395841 - DNA, 15 bp, Homo sapiens
ggcacacagccagct

SEQ ID NO: 395842 - DNA, 15 bp, Homo sapiens
gcacacagccagctt

SEQ ID NO: 395843 - DNA, 15 bp, Homo sapiens
cacacagccagcttc

SEQ ID NO: 395844 - DNA, 15 bp, Homo sapiens
acacagccagcttcc

SEQ ID NO: 395845 - DNA, 15 bp, Homo sapiens
cacagccagcttcca

SEQ ID NO: 395846 - DNA, 15 bp, Homo sapiens
acagccagcttccat

SEQ ID NO: 395847 - DNA, 15 bp, Homo sapiens
cagccagcttccata

SEQ ID NO: 395848 - DNA, 15 bp, Homo sapiens
agccagcttccatat

SEQ ID NO: 395849 - DNA, 15 bp, Homo sapiens
gccagcttccatatt

SEQ ID NO: 395850 - DNA, 15 bp, Homo sapiens
ccagcttccatattg

SEQ ID NO: 395851 - DNA, 15 bp, Homo sapiens
cagcttccatattga

SEQ ID NO: 395852 - DNA, 15 bp, Homo sapiens
agcttccatattgag

SEQ ID NO: 395853 - DNA, 15 bp, Homo sapiens
gcttccatattgagg

SEQ ID NO: 395854 - DNA, 15 bp, Homo sapiens
cttccatattgaggt

SEQ ID NO: 395855 - DNA, 15 bp, Homo sapiens
ttccatattgaggta

SEQ ID NO: 395856 - DNA, 15 bp, Homo sapiens
tccatattgaggtac

SEQ ID NO: 395857 - DNA, 15 bp, Homo sapiens
ccatattgaggtaca

SEQ ID NO: 395858 - DNA, 15 bp, Homo sapiens
catattgaggtacat

SEQ ID NO: 395859 - DNA, 15 bp, Homo sapiens
atattgaggtacatt

SEQ ID NO: 395860 - DNA, 15 bp, Homo sapiens
tattgaggtacattc

SEQ ID NO: 395861 - DNA, 15 bp, Homo sapiens
attgaggtacattct

SEQ ID NO: 395862 - DNA, 15 bp, Homo sapiens
ttgaggtacattctc

SEQ ID NO: 395863 - DNA, 15 bp, Homo sapiens
tgaggtacattctct

SEQ ID NO: 395864 - DNA, 15 bp, Homo sapiens
gaggtacattctctg

SEQ ID NO: 395865 - DNA, 15 bp, Homo sapiens
aggtacattctctgc

SEQ ID NO: 395866 - DNA, 15 bp, Homo sapiens
ggtacattctctgcc

SEQ ID NO: 395867 - DNA, 15 bp, Homo sapiens
gtacattctctgcca

SEQ ID NO: 395868 - DNA, 15 bp, Homo sapiens
tacattctctgccag

SEQ ID NO: 395869 - DNA, 15 bp, Homo sapiens
acattctctgccagt

SEQ ID NO: 395870 - DNA, 15 bp, Homo sapiens
cattctctgccagta

SEQ ID NO: 395871 - DNA, 15 bp, Homo sapiens
attctctgccagtaa

SEQ ID NO: 395872 - DNA, 15 bp, Homo sapiens
ttctctgccagtaaa

SEQ ID NO: 395873 - DNA, 15 bp, Homo sapiens
tctctgccagtaaaa

SEQ ID NO: 395874 - DNA, 15 bp, Homo sapiens
ctctgccagtaaaat

SEQ ID NO: 395875 - DNA, 15 bp, Homo sapiens
tctgccagtaaaatc

SEQ ID NO: 395876 - DNA, 15 bp, Homo sapiens
ctgccagtaaaatca

SEQ ID NO: 395877 - DNA, 15 bp, Homo sapiens
tgccagtaaaatcat

SEQ ID NO: 395878 - DNA, 15 bp, Homo sapiens
gccagtaaaatcata

SEQ ID NO: 395879 - DNA, 15 bp, Homo sapiens
ccagtaaaatcatac

SEQ ID NO: 395880 - DNA, 15 bp, Homo sapiens
cagtaaaatcatact

SEQ ID NO: 395881 - DNA, 15 bp, Homo sapiens
agtaaaatcatacta

SEQ ID NO: 395882 - DNA, 15 bp, Homo sapiens
gtaaaatcatactat

SEQ ID NO: 395883 - DNA, 15 bp, Homo sapiens
taaaatcatactatt

SEQ ID NO: 395884 - DNA, 15 bp, Homo sapiens
aaaatcatactattt

SEQ ID NO: 395885 - DNA, 15 bp, Homo sapiens
aaatcatactatttc

SEQ ID NO: 395886 - DNA, 15 bp, Homo sapiens
aatcatactatttcc

SEQ ID NO: 395887 - DNA, 15 bp, Homo sapiens
atcatactatttcca

SEQ ID NO: 395888 - DNA, 15 bp, Homo sapiens
tcatactatttccaa

SEQ ID NO: 395889 - DNA, 15 bp, Homo sapiens
catactatttccaaa

SEQ ID NO: 395890 - DNA, 15 bp, Homo sapiens
atactatttccaaac

SEQ ID NO: 395891 - DNA, 15 bp, Homo sapiens
tactatttccaaaca

SEQ ID NO: 395892 - DNA, 15 bp, Homo sapiens
actatttccaaacaa

SEQ ID NO: 395893 - DNA, 15 bp, Homo sapiens
ctatttccaaacaac

SEQ ID NO: 395894 - DNA, 15 bp, Homo sapiens
tatttccaaacaact

SEQ ID NO: 395895 - DNA, 15 bp, Homo sapiens
atttccaaacaactt

SEQ ID NO: 395896 - DNA, 15 bp, Homo sapiens
tttccaaacaactta

SEQ ID NO: 395897 - DNA, 15 bp, Homo sapiens
ttccaaacaacttag

SEQ ID NO: 395898 - DNA, 15 bp, Homo sapiens
tccaaacaacttaga

SEQ ID NO: 395899 - DNA, 15 bp, Homo sapiens
ccaaacaacttagat

SEQ ID NO: 395900 - DNA, 15 bp, Homo sapiens
caaacaacttagatt

SEQ ID NO: 395901 - DNA, 15 bp, Homo sapiens
aaacaacttagattc

SEQ ID NO: 395902 - DNA, 15 bp, Homo sapiens
aacaacttagattca

SEQ ID NO: 395903 - DNA, 15 bp, Homo sapiens
acaacttagattcaa

SEQ ID NO: 395904 - DNA, 15 bp, Homo sapiens
caacttagattcaaa

SEQ ID NO: 395905 - DNA, 15 bp, Homo sapiens
aacttagattcaaac

SEQ ID NO: 395906 - DNA, 15 bp, Homo sapiens
acttagattcaaact

SEQ ID NO: 395907 - DNA, 15 bp, Homo sapiens
cttagattcaaactg

SEQ ID NO: 395908 - DNA, 15 bp, Homo sapiens
ttagattcaaactgg

SEQ ID NO: 395909 - DNA, 15 bp, Homo sapiens
tagattcaaactggg

SEQ ID NO: 395910 - DNA, 15 bp, Homo sapiens
agattcaaactgggg

SEQ ID NO: 395911 - DNA, 15 bp, Homo sapiens
gattcaaactggggc

SEQ ID NO: 395912 - DNA, 15 bp, Homo sapiens
attcaaactggggct

SEQ ID NO: 395913 - DNA, 15 bp, Homo sapiens
ttcaaactggggcta

SEQ ID NO: 395914 - DNA, 15 bp, Homo sapiens
tcaaactggggctac

SEQ ID NO: 395915 - DNA, 15 bp, Homo sapiens
caaactggggctaca

SEQ ID NO: 395916 - DNA, 15 bp, Homo sapiens
aaactggggctacat

SEQ ID NO: 395917 - DNA, 15 bp, Homo sapiens
aactggggctacata

SEQ ID NO: 395918 - DNA, 15 bp, Homo sapiens
actggggctacataa

SEQ ID NO: 395919 - DNA, 15 bp, Homo sapiens
ctggggctacataaa

SEQ ID NO: 395920 - DNA, 15 bp, Homo sapiens
tggggctacataaaa

SEQ ID NO: 395921 - DNA, 15 bp, Homo sapiens
ggggctacataaaag

SEQ ID NO: 395922 - DNA, 15 bp, Homo sapiens
gggctacataaaagg

SEQ ID NO: 395923 - DNA, 15 bp, Homo sapiens
ggctacataaaaggg

SEQ ID NO: 395924 - DNA, 15 bp, Homo sapiens
gctacataaaagggt

SEQ ID NO: 395925 - DNA, 15 bp, Homo sapiens
ctacataaaagggtc

SEQ ID NO: 395926 - DNA, 15 bp, Homo sapiens
tacataaaagggtcc

SEQ ID NO: 395927 - DNA, 15 bp, Homo sapiens
acataaaagggtcca

SEQ ID NO: 395928 - DNA, 15 bp, Homo sapiens
cataaaagggtccat

SEQ ID NO: 395929 - DNA, 15 bp, Homo sapiens
ataaaagggtccatg

SEQ ID NO: 395930 - DNA, 15 bp, Homo sapiens
taaaagggtccatgt

SEQ ID NO: 395931 - DNA, 15 bp, Homo sapiens
aaaagggtccatgtc

SEQ ID NO: 395932 - DNA, 15 bp, Homo sapiens
aaagggtccatgtct

SEQ ID NO: 395933 - DNA, 15 bp, Homo sapiens
aagggtccatgtctt

SEQ ID NO: 395934 - DNA, 15 bp, Homo sapiens
agggtccatgtcttc

SEQ ID NO: 395935 - DNA, 15 bp, Homo sapiens
gggtccatgtcttca

SEQ ID NO: 395936 - DNA, 15 bp, Homo sapiens
ggtccatgtcttcag

SEQ ID NO: 395937 - DNA, 15 bp, Homo sapiens
gtccatgtcttcaga

SEQ ID NO: 395938 - DNA, 15 bp, Homo sapiens
tccatgtcttcagag

SEQ ID NO: 395939 - DNA, 15 bp, Homo sapiens
ccatgtcttcagagc

SEQ ID NO: 395940 - DNA, 15 bp, Homo sapiens
catgtcttcagagca

SEQ ID NO: 395941 - DNA, 15 bp, Homo sapiens
atgtcttcagagcag

SEQ ID NO: 395942 - DNA, 15 bp, Homo sapiens
tgtcttcagagcagg

SEQ ID NO: 395943 - DNA, 15 bp, Homo sapiens
gtcttcagagcagga

SEQ ID NO: 395944 - DNA, 15 bp, Homo sapiens
tcttcagagcaggac

SEQ ID NO: 395945 - DNA, 15 bp, Homo sapiens
cttcagagcaggact

SEQ ID NO: 395946 - DNA, 15 bp, Homo sapiens
ttcagagcaggacta

SEQ ID NO: 395947 - DNA, 15 bp, Homo sapiens
tcagagcaggactaa

SEQ ID NO: 395948 - DNA, 15 bp, Homo sapiens
cagagcaggactaat

SEQ ID NO: 395949 - DNA, 15 bp, Homo sapiens
agagcaggactaata

SEQ ID NO: 395950 - DNA, 15 bp, Homo sapiens
gagcaggactaatag

SEQ ID NO: 395951 - DNA, 15 bp, Homo sapiens
agcaggactaatagc

SEQ ID NO: 395952 - DNA, 15 bp, Homo sapiens
gcaggactaatagcc

SEQ ID NO: 395953 - DNA, 15 bp, Homo sapiens
caggactaatagccc

SEQ ID NO: 395954 - DNA, 15 bp, Homo sapiens
aggactaatagcccc

SEQ ID NO: 395955 - DNA, 15 bp, Homo sapiens
ggactaatagcccct

SEQ ID NO: 395956 - DNA, 15 bp, Homo sapiens
gactaatagcccctg

SEQ ID NO: 395957 - DNA, 15 bp, Homo sapiens
actaatagcccctga

SEQ ID NO: 395958 - DNA, 15 bp, Homo sapiens
ctaatagcccctgag

SEQ ID NO: 395959 - DNA, 15 bp, Homo sapiens
taatagcccctgagt

SEQ ID NO: 395960 - DNA, 15 bp, Homo sapiens
aatagcccctgagtc

SEQ ID NO: 395961 - DNA, 15 bp, Homo sapiens
atagcccctgagtct

SEQ ID NO: 395962 - DNA, 15 bp, Homo sapiens
tagcccctgagtctg

SEQ ID NO: 395963 - DNA, 15 bp, Homo sapiens
agcccctgagtctgc

SEQ ID NO: 395964 - DNA, 15 bp, Homo sapiens
gcccctgagtctgca

SEQ ID NO: 395965 - DNA, 15 bp, Homo sapiens
cccctgagtctgcag

SEQ ID NO: 395966 - DNA, 15 bp, Homo sapiens
ccctgagtctgcagc

SEQ ID NO: 395967 - DNA, 15 bp, Homo sapiens
cctgagtctgcagca

SEQ ID NO: 395968 - DNA, 15 bp, Homo sapiens
ctgagtctgcagcat

SEQ ID NO: 395969 - DNA, 15 bp, Homo sapiens
tgagtctgcagcatc

SEQ ID NO: 395970 - DNA, 15 bp, Homo sapiens
gagtctgcagcatct

SEQ ID NO: 395971 - DNA, 15 bp, Homo sapiens
agtctgcagcatcta

SEQ ID NO: 395972 - DNA, 15 bp, Homo sapiens
gtctgcagcatctag

SEQ ID NO: 395973 - DNA, 15 bp, Homo sapiens
tctgcagcatctagt

SEQ ID NO: 395974 - DNA, 15 bp, Homo sapiens
ctgcagcatctagtc

SEQ ID NO: 395975 - DNA, 15 bp, Homo sapiens
tgcagcatctagtca

SEQ ID NO: 395976 - DNA, 15 bp, Homo sapiens
gcagcatctagtcaa

SEQ ID NO: 395977 - DNA, 15 bp, Homo sapiens
cagcatctagtcaaa

SEQ ID NO: 395978 - DNA, 15 bp, Homo sapiens
agcatctagtcaaat

SEQ ID NO: 395979 - DNA, 15 bp, Homo sapiens
gcatctagtcaaatg

SEQ ID NO: 395980 - DNA, 15 bp, Homo sapiens
catctagtcaaatga

SEQ ID NO: 395981 - DNA, 15 bp, Homo sapiens
atctagtcaaatgaa

SEQ ID NO: 395982 - DNA, 15 bp, Homo sapiens
tctagtcaaatgaag

SEQ ID NO: 395983 - DNA, 15 bp, Homo sapiens
ctagtcaaatgaagt

SEQ ID NO: 395984 - DNA, 15 bp, Homo sapiens
tagtcaaatgaagta

SEQ ID NO: 395985 - DNA, 15 bp, Homo sapiens
agtcaaatgaagtat

SEQ ID NO: 395986 - DNA, 15 bp, Homo sapiens
gtcaaatgaagtatt

SEQ ID NO: 395987 - DNA, 15 bp, Homo sapiens
tcaaatgaagtattt

SEQ ID NO: 395988 - DNA, 15 bp, Homo sapiens
caaatgaagtatttt

SEQ ID NO: 395989 - DNA, 15 bp, Homo sapiens
aaatgaagtattttg

SEQ ID NO: 395990 - DNA, 15 bp, Homo sapiens
aatgaagtattttga

SEQ ID NO: 395991 - DNA, 15 bp, Homo sapiens
atgaagtattttgaa

SEQ ID NO: 395992 - DNA, 15 bp, Homo sapiens
tgaagtattttgaag

SEQ ID NO: 395993 - DNA, 15 bp, Homo sapiens
gaagtattttgaagt

SEQ ID NO: 395994 - DNA, 15 bp, Homo sapiens
aagtattttgaagtc

SEQ ID NO: 395995 - DNA, 15 bp, Homo sapiens
agtattttgaagtct

SEQ ID NO: 395996 - DNA, 15 bp, Homo sapiens
gtattttgaagtctt

SEQ ID NO: 395997 - DNA, 15 bp, Homo sapiens
tattttgaagtcttt

SEQ ID NO: 395998 - DNA, 15 bp, Homo sapiens
attttgaagtcttta

SEQ ID NO: 395999 - DNA, 15 bp, Homo sapiens
ttttgaagtctttat

SEQ ID NO: 396000 - DNA, 15 bp, Homo sapiens
tttgaagtctttatt

SEQ ID NO: 396001 - DNA, 15 bp, Homo sapiens
ttgaagtctttattc

SEQ ID NO: 396002 - DNA, 15 bp, Homo sapiens
tgaagtctttattca

SEQ ID NO: 396003 - DNA, 15 bp, Homo sapiens
gaagtctttattcaa

SEQ ID NO: 396004 - DNA, 15 bp, Homo sapiens
aagtctttattcaat

SEQ ID NO: 396005 - DNA, 15 bp, Homo sapiens
agtctttattcaatc

SEQ ID NO: 396006 - DNA, 15 bp, Homo sapiens
gtctttattcaatcc

SEQ ID NO: 396007 - DNA, 15 bp, Homo sapiens
tctttattcaatcca

SEQ ID NO: 396008 - DNA, 15 bp, Homo sapiens
ctttattcaatccag

SEQ ID NO: 396009 - DNA, 15 bp, Homo sapiens
tttattcaatccaga

SEQ ID NO: 396010 - DNA, 15 bp, Homo sapiens
ttattcaatccagaa

SEQ ID NO: 396011 - DNA, 15 bp, Homo sapiens
tattcaatccagaat

SEQ ID NO: 396012 - DNA, 15 bp, Homo sapiens
attcaatccagaatt

SEQ ID NO: 396013 - DNA, 15 bp, Homo sapiens
ttcaatccagaatta

SEQ ID NO: 396014 - DNA, 15 bp, Homo sapiens
tcaatccagaattag

SEQ ID NO: 396015 - DNA, 15 bp, Homo sapiens
caatccagaattagg

SEQ ID NO: 396016 - DNA, 15 bp, Homo sapiens
aatccagaattaggg

SEQ ID NO: 396017 - DNA, 15 bp, Homo sapiens
atccagaattagggc

SEQ ID NO: 396018 - DNA, 15 bp, Homo sapiens
tccagaattagggca

SEQ ID NO: 396019 - DNA, 15 bp, Homo sapiens
ccagaattagggcag

SEQ ID NO: 396020 - DNA, 15 bp, Homo sapiens
cagaattagggcagc

SEQ ID NO: 396021 - DNA, 15 bp, Homo sapiens
agaattagggcagcc

SEQ ID NO: 396022 - DNA, 15 bp, Homo sapiens
gaattagggcagcca

SEQ ID NO: 396023 - DNA, 15 bp, Homo sapiens
aattagggcagccat

SEQ ID NO: 396024 - DNA, 15 bp, Homo sapiens
attagggcagccata

SEQ ID NO: 396025 - DNA, 15 bp, Homo sapiens
ttagggcagccataa

SEQ ID NO: 396026 - DNA, 15 bp, Homo sapiens
tagggcagccataat

SEQ ID NO: 396027 - DNA, 15 bp, Homo sapiens
agggcagccataatt

SEQ ID NO: 396028 - DNA, 15 bp, Homo sapiens
gggcagccataattt

SEQ ID NO: 396029 - DNA, 15 bp, Homo sapiens
ggcagccataatttt

SEQ ID NO: 396030 - DNA, 15 bp, Homo sapiens
gcagccataatttta

SEQ ID NO: 396031 - DNA, 15 bp, Homo sapiens
cagccataattttaa

SEQ ID NO: 396032 - DNA, 15 bp, Homo sapiens
agccataattttaaa

SEQ ID NO: 396033 - DNA, 15 bp, Homo sapiens
gccataattttaaaa

SEQ ID NO: 396034 - DNA, 15 bp, Homo sapiens
ccataattttaaaaa

SEQ ID NO: 396035 - DNA, 15 bp, Homo sapiens
cataattttaaaaat

SEQ ID NO: 396036 - DNA, 15 bp, Homo sapiens
ataattttaaaaatc

SEQ ID NO: 396037 - DNA, 15 bp, Homo sapiens
taattttaaaaatct

SEQ ID NO: 396038 - DNA, 15 bp, Homo sapiens
aattttaaaaatcta

SEQ ID NO: 396039 - DNA, 15 bp, Homo sapiens
attttaaaaatctat

SEQ ID NO: 396040 - DNA, 15 bp, Homo sapiens
ttttaaaaatctata

SEQ ID NO: 396041 - DNA, 15 bp, Homo sapiens
tttaaaaatctatac

SEQ ID NO: 396042 - DNA, 15 bp, Homo sapiens
ttaaaaatctataca

SEQ ID NO: 396043 - DNA, 15 bp, Homo sapiens
taaaaatctatacat

SEQ ID NO: 396044 - DNA, 15 bp, Homo sapiens
aaaaatctatacatt

SEQ ID NO: 396045 - DNA, 15 bp, Homo sapiens
aaaatctatacatta

SEQ ID NO: 396046 - DNA, 15 bp, Homo sapiens
aaatctatacattag

SEQ ID NO: 396047 - DNA, 15 bp, Homo sapiens
aatctatacattagt

SEQ ID NO: 396048 - DNA, 15 bp, Homo sapiens
atctatacattagta

SEQ ID NO: 396049 - DNA, 15 bp, Homo sapiens
tctatacattagtaa

SEQ ID NO: 396050 - DNA, 15 bp, Homo sapiens
ctatacattagtaat

SEQ ID NO: 396051 - DNA, 15 bp, Homo sapiens
tatacattagtaatc

SEQ ID NO: 396052 - DNA, 15 bp, Homo sapiens
atacattagtaatct

SEQ ID NO: 396053 - DNA, 15 bp, Homo sapiens
tacattagtaatctt

SEQ ID NO: 396054 - DNA, 15 bp, Homo sapiens
acattagtaatctta

SEQ ID NO: 396055 - DNA, 15 bp, Homo sapiens
cattagtaatcttag

SEQ ID NO: 396056 - DNA, 15 bp, Homo sapiens
attagtaatcttaga

SEQ ID NO: 396057 - DNA, 15 bp, Homo sapiens
ttagtaatcttagat

SEQ ID NO: 396058 - DNA, 15 bp, Homo sapiens
tagtaatcttagatg

SEQ ID NO: 396059 - DNA, 15 bp, Homo sapiens
agtaatcttagatgc

SEQ ID NO: 396060 - DNA, 15 bp, Homo sapiens
gtaatcttagatgct

SEQ ID NO: 396061 - DNA, 15 bp, Homo sapiens
taatcttagatgctg

SEQ ID NO: 396062 - DNA, 15 bp, Homo sapiens
aatcttagatgctgg

SEQ ID NO: 396063 - DNA, 15 bp, Homo sapiens
atcttagatgctggg

SEQ ID NO: 396064 - DNA, 15 bp, Homo sapiens
tcttagatgctggga

SEQ ID NO: 396065 - DNA, 15 bp, Homo sapiens
cttagatgctgggaa

SEQ ID NO: 396066 - DNA, 15 bp, Homo sapiens
ttagatgctgggaag

SEQ ID NO: 396067 - DNA, 15 bp, Homo sapiens
tagatgctgggaagg

SEQ ID NO: 396068 - DNA, 15 bp, Homo sapiens
agatgctgggaaggc

SEQ ID NO: 396069 - DNA, 15 bp, Homo sapiens
gatgctgggaaggct

SEQ ID NO: 396070 - DNA, 15 bp, Homo sapiens
atgctgggaaggctt

SEQ ID NO: 396071 - DNA, 15 bp, Homo sapiens
tgctgggaaggcttg

SEQ ID NO: 396072 - DNA, 15 bp, Homo sapiens
gctgggaaggcttga

SEQ ID NO: 396073 - DNA, 15 bp, Homo sapiens
ctgggaaggcttgaa

SEQ ID NO: 396074 - DNA, 15 bp, Homo sapiens
tgggaaggcttgaag

SEQ ID NO: 396075 - DNA, 15 bp, Homo sapiens
gggaaggcttgaaga

SEQ ID NO: 396076 - DNA, 15 bp, Homo sapiens
ggaaggcttgaagaa

SEQ ID NO: 396077 - DNA, 15 bp, Homo sapiens
gaaggcttgaagaag

SEQ ID NO: 396078 - DNA, 15 bp, Homo sapiens
aaggcttgaagaagg

SEQ ID NO: 396079 - DNA, 15 bp, Homo sapiens
aggcttgaagaagga

SEQ ID NO: 396080 - DNA, 15 bp, Homo sapiens
ggcttgaagaaggaa

SEQ ID NO: 396081 - DNA, 15 bp, Homo sapiens
gcttgaagaaggaag

SEQ ID NO: 396082 - DNA, 15 bp, Homo sapiens
cttgaagaaggaaga

SEQ ID NO: 396083 - DNA, 15 bp, Homo sapiens
ttgaagaaggaagat

SEQ ID NO: 396084 - DNA, 15 bp, Homo sapiens
tgaagaaggaagatc

SEQ ID NO: 396085 - DNA, 15 bp, Homo sapiens
gaagaaggaagatct

SEQ ID NO: 396086 - DNA, 15 bp, Homo sapiens
aagaaggaagatctt

SEQ ID NO: 396087 - DNA, 15 bp, Homo sapiens
agaaggaagatcttt

SEQ ID NO: 396088 - DNA, 15 bp, Homo sapiens
gaaggaagatctttc

SEQ ID NO: 396089 - DNA, 15 bp, Homo sapiens
aaggaagatctttct

SEQ ID NO: 396090 - DNA, 15 bp, Homo sapiens
aggaagatctttctt

SEQ ID NO: 396091 - DNA, 15 bp, Homo sapiens
ggaagatctttcttg

SEQ ID NO: 396092 - DNA, 15 bp, Homo sapiens
gaagatctttcttga

SEQ ID NO: 396093 - DNA, 15 bp, Homo sapiens
aagatctttcttgaa

SEQ ID NO: 396094 - DNA, 15 bp, Homo sapiens
agatctttcttgaat

SEQ ID NO: 396095 - DNA, 15 bp, Homo sapiens
gatctttcttgaatt

SEQ ID NO: 396096 - DNA, 15 bp, Homo sapiens
atctttcttgaattt

SEQ ID NO: 396097 - DNA, 15 bp, Homo sapiens
tctttcttgaatttc

SEQ ID NO: 396098 - DNA, 15 bp, Homo sapiens
ctttcttgaatttca

SEQ ID NO: 396099 - DNA, 15 bp, Homo sapiens
tttcttgaatttcaa

SEQ ID NO: 396100 - DNA, 15 bp, Homo sapiens
ttcttgaatttcaat

SEQ ID NO: 396101 - DNA, 15 bp, Homo sapiens
tcttgaatttcaata

SEQ ID NO: 396102 - DNA, 15 bp, Homo sapiens
cttgaatttcaataa

SEQ ID NO: 396103 - DNA, 15 bp, Homo sapiens
ttgaatttcaataat

SEQ ID NO: 396104 - DNA, 15 bp, Homo sapiens
tgaatttcaataata

SEQ ID NO: 396105 - DNA, 15 bp, Homo sapiens
gaatttcaataataa

SEQ ID NO: 396106 - DNA, 15 bp, Homo sapiens
aatttcaataataat

SEQ ID NO: 396107 - DNA, 15 bp, Homo sapiens
atttcaataataatt

SEQ ID NO: 396108 - DNA, 15 bp, Homo sapiens
tttcaataataatta

SEQ ID NO: 396109 - DNA, 15 bp, Homo sapiens
ttcaataataattaa

SEQ ID NO: 396110 - DNA, 15 bp, Homo sapiens
tcaataataattaaa

SEQ ID NO: 396111 - DNA, 15 bp, Homo sapiens
caataataattaaac

SEQ ID NO: 396112 - DNA, 15 bp, Homo sapiens
aataataattaaaca

SEQ ID NO: 396113 - DNA, 15 bp, Homo sapiens
ataataattaaacat

SEQ ID NO: 396114 - DNA, 15 bp, Homo sapiens
taataattaaacatt

SEQ ID NO: 396115 - DNA, 15 bp, Homo sapiens
aataattaaacattc

SEQ ID NO: 396116 - DNA, 15 bp, Homo sapiens
ataattaaacattct

SEQ ID NO: 396117 - DNA, 15 bp, Homo sapiens
taattaaacattctg

SEQ ID NO: 396118 - DNA, 15 bp, Homo sapiens
aattaaacattctgg

SEQ ID NO: 396119 - DNA, 15 bp, Homo sapiens
attaaacattctggt

SEQ ID NO: 396120 - DNA, 15 bp, Homo sapiens
ttaaacattctggta

SEQ ID NO: 396121 - DNA, 15 bp, Homo sapiens
taaacattctggtaa

SEQ ID NO: 396122 - DNA, 15 bp, Homo sapiens
aaacattctggtaaa

SEQ ID NO: 396123 - DNA, 15 bp, Homo sapiens
aacattctggtaaat

SEQ ID NO: 396124 - DNA, 15 bp, Homo sapiens
acattctggtaaatc

SEQ ID NO: 396125 - DNA, 15 bp, Homo sapiens
cattctggtaaatct

SEQ ID NO: 396126 - DNA, 15 bp, Homo sapiens
attctggtaaatctc

SEQ ID NO: 396127 - DNA, 15 bp, Homo sapiens
ttctggtaaatctca

SEQ ID NO: 396128 - DNA, 15 bp, Homo sapiens
tctggtaaatctcaa

SEQ ID NO: 396129 - DNA, 15 bp, Homo sapiens
ctggtaaatctcaag

SEQ ID NO: 396130 - DNA, 15 bp, Homo sapiens
tggtaaatctcaagt

SEQ ID NO: 396131 - DNA, 15 bp, Homo sapiens
ggtaaatctcaagtg

SEQ ID NO: 396132 - DNA, 15 bp, Homo sapiens
gtaaatctcaagtgg

SEQ ID NO: 396133 - DNA, 15 bp, Homo sapiens
taaatctcaagtggc

SEQ ID NO: 396134 - DNA, 15 bp, Homo sapiens
aaatctcaagtggct

SEQ ID NO: 396135 - DNA, 15 bp, Homo sapiens
aatctcaagtggctt

SEQ ID NO: 396136 - DNA, 15 bp, Homo sapiens
atctcaagtggcttt

SEQ ID NO: 396137 - DNA, 15 bp, Homo sapiens
tctcaagtggctttg

SEQ ID NO: 396138 - DNA, 15 bp, Homo sapiens
ctcaagtggctttgc

SEQ ID NO: 396139 - DNA, 15 bp, Homo sapiens
tcaagtggctttgca

SEQ ID NO: 396140 - DNA, 15 bp, Homo sapiens
caagtggctttgcat

SEQ ID NO: 396141 - DNA, 15 bp, Homo sapiens
aagtggctttgcata

SEQ ID NO: 396142 - DNA, 15 bp, Homo sapiens
agtggctttgcataa

SEQ ID NO: 396143 - DNA, 15 bp, Homo sapiens
gtggctttgcataat

SEQ ID NO: 396144 - DNA, 15 bp, Homo sapiens
tggctttgcataata

SEQ ID NO: 396145 - DNA, 15 bp, Homo sapiens
ggctttgcataatat

SEQ ID NO: 396146 - DNA, 15 bp, Homo sapiens
gctttgcataatatg

SEQ ID NO: 396147 - DNA, 15 bp, Homo sapiens
ctttgcataatatgt

SEQ ID NO: 396148 - DNA, 15 bp, Homo sapiens
tttgcataatatgtt

SEQ ID NO: 396149 - DNA, 15 bp, Homo sapiens
ttgcataatatgttt

SEQ ID NO: 396150 - DNA, 15 bp, Homo sapiens
tgcataatatgtttt

SEQ ID NO: 396151 - DNA, 15 bp, Homo sapiens
gcataatatgttttt

SEQ ID NO: 396152 - DNA, 15 bp, Homo sapiens
cataatatgtttttt

SEQ ID NO: 396153 - DNA, 15 bp, Homo sapiens
ataatatgttttttg

SEQ ID NO: 396154 - DNA, 15 bp, Homo sapiens
taatatgttttttga

SEQ ID NO: 396155 - DNA, 15 bp, Homo sapiens
aatatgttttttgag

SEQ ID NO: 396156 - DNA, 15 bp, Homo sapiens
atatgttttttgaga

SEQ ID NO: 396157 - DNA, 15 bp, Homo sapiens
tatgttttttgagag

SEQ ID NO: 396158 - DNA, 15 bp, Homo sapiens
atgttttttgagagt

SEQ ID NO: 396159 - DNA, 15 bp, Homo sapiens
tgttttttgagagtg

SEQ ID NO: 396160 - DNA, 15 bp, Homo sapiens
gttttttgagagtgt

SEQ ID NO: 396161 - DNA, 15 bp, Homo sapiens
ttttttgagagtgtg

SEQ ID NO: 396162 - DNA, 15 bp, Homo sapiens
tttttgagagtgtga

SEQ ID NO: 396163 - DNA, 15 bp, Homo sapiens
ttttgagagtgtgat

SEQ ID NO: 396164 - DNA, 15 bp, Homo sapiens
tttgagagtgtgatt

SEQ ID NO: 396165 - DNA, 15 bp, Homo sapiens
ttgagagtgtgattt

SEQ ID NO: 396166 - DNA, 15 bp, Homo sapiens
tgagagtgtgatttt

SEQ ID NO: 396167 - DNA, 15 bp, Homo sapiens
gagagtgtgattttg

SEQ ID NO: 396168 - DNA, 15 bp, Homo sapiens
agagtgtgattttga

SEQ ID NO: 396169 - DNA, 15 bp, Homo sapiens
gagtgtgattttgat

SEQ ID NO: 396170 - DNA, 15 bp, Homo sapiens
agtgtgattttgata

SEQ ID NO: 396171 - DNA, 15 bp, Homo sapiens
gtgtgattttgatag

SEQ ID NO: 396172 - DNA, 15 bp, Homo sapiens
tgtgattttgatagg

SEQ ID NO: 396173 - DNA, 15 bp, Homo sapiens
gtgattttgataggt

SEQ ID NO: 396174 - DNA, 15 bp, Homo sapiens
tgattttgataggta

SEQ ID NO: 396175 - DNA, 15 bp, Homo sapiens
gattttgataggtag

SEQ ID NO: 396176 - DNA, 15 bp, Homo sapiens
attttgataggtagt

SEQ ID NO: 396177 - DNA, 15 bp, Homo sapiens
ttttgataggtagtg

SEQ ID NO: 396178 - DNA, 15 bp, Homo sapiens
tttgataggtagtga

SEQ ID NO: 396179 - DNA, 15 bp, Homo sapiens
ttgataggtagtgaa

SEQ ID NO: 396180 - DNA, 15 bp, Homo sapiens
tgataggtagtgaat

SEQ ID NO: 396181 - DNA, 15 bp, Homo sapiens
gataggtagtgaata

SEQ ID NO: 396182 - DNA, 15 bp, Homo sapiens
ataggtagtgaataa

SEQ ID NO: 396183 - DNA, 15 bp, Homo sapiens
taggtagtgaataac

SEQ ID NO: 396184 - DNA, 15 bp, Homo sapiens
aggtagtgaataacc

SEQ ID NO: 396185 - DNA, 15 bp, Homo sapiens
ggtagtgaataacct

SEQ ID NO: 396186 - DNA, 15 bp, Homo sapiens
gtagtgaataacctg

SEQ ID NO: 396187 - DNA, 15 bp, Homo sapiens
tagtgaataacctga

SEQ ID NO: 396188 - DNA, 15 bp, Homo sapiens
agtgaataacctgaa

SEQ ID NO: 396189 - DNA, 15 bp, Homo sapiens
gtgaataacctgaat

SEQ ID NO: 396190 - DNA, 15 bp, Homo sapiens
tgaataacctgaatt

SEQ ID NO: 396191 - DNA, 15 bp, Homo sapiens
gaataacctgaatta

SEQ ID NO: 396192 - DNA, 15 bp, Homo sapiens
aataacctgaattaa

SEQ ID NO: 396193 - DNA, 15 bp, Homo sapiens
ataacctgaattaat

SEQ ID NO: 396194 - DNA, 15 bp, Homo sapiens
taacctgaattaatg

SEQ ID NO: 396195 - DNA, 15 bp, Homo sapiens
aacctgaattaatga

SEQ ID NO: 396196 - DNA, 15 bp, Homo sapiens
acctgaattaatgac

SEQ ID NO: 396197 - DNA, 15 bp, Homo sapiens
cctgaattaatgacc

SEQ ID NO: 396198 - DNA, 15 bp, Homo sapiens
ctgaattaatgacca

SEQ ID NO: 396199 - DNA, 15 bp, Homo sapiens
tgaattaatgaccat

SEQ ID NO: 396200 - DNA, 15 bp, Homo sapiens
gaattaatgaccata

SEQ ID NO: 396201 - DNA, 15 bp, Homo sapiens
aattaatgaccataa

SEQ ID NO: 396202 - DNA, 15 bp, Homo sapiens
attaatgaccataat

SEQ ID NO: 396203 - DNA, 15 bp, Homo sapiens
ttaatgaccataatg

SEQ ID NO: 396204 - DNA, 15 bp, Homo sapiens
taatgaccataatga

SEQ ID NO: 396205 - DNA, 15 bp, Homo sapiens
aatgaccataatgac

SEQ ID NO: 396206 - DNA, 15 bp, Homo sapiens
atgaccataatgact

SEQ ID NO: 396207 - DNA, 15 bp, Homo sapiens
tgaccataatgactg

SEQ ID NO: 396208 - DNA, 15 bp, Homo sapiens
gaccataatgactga

SEQ ID NO: 396209 - DNA, 15 bp, Homo sapiens
accataatgactgag

SEQ ID NO: 396210 - DNA, 15 bp, Homo sapiens
ccataatgactgagt

SEQ ID NO: 396211 - DNA, 15 bp, Homo sapiens
cataatgactgagtg

SEQ ID NO: 396212 - DNA, 15 bp, Homo sapiens
ataatgactgagtgc

SEQ ID NO: 396213 - DNA, 15 bp, Homo sapiens
taatgactgagtgct

SEQ ID NO: 396214 - DNA, 15 bp, Homo sapiens
aatgactgagtgctg

SEQ ID NO: 396215 - DNA, 15 bp, Homo sapiens
atgactgagtgctgt

SEQ ID NO: 396216 - DNA, 15 bp, Homo sapiens
tgactgagtgctgtt

SEQ ID NO: 396217 - DNA, 15 bp, Homo sapiens
gactgagtgctgttt

SEQ ID NO: 396218 - DNA, 15 bp, Homo sapiens
actgagtgctgtttt

SEQ ID NO: 396219 - DNA, 15 bp, Homo sapiens
ctgagtgctgttttg

SEQ ID NO: 396220 - DNA, 15 bp, Homo sapiens
tgagtgctgttttgc

SEQ ID NO: 396221 - DNA, 15 bp, Homo sapiens
gagtgctgttttgca

SEQ ID NO: 396222 - DNA, 15 bp, Homo sapiens
agtgctgttttgcat

SEQ ID NO: 396223 - DNA, 15 bp, Homo sapiens
gtgctgttttgcatt

SEQ ID NO: 396224 - DNA, 15 bp, Homo sapiens
tgctgttttgcatta

SEQ ID NO: 396225 - DNA, 15 bp, Homo sapiens
gctgttttgcattaa

SEQ ID NO: 396226 - DNA, 15 bp, Homo sapiens
ctgttttgcattaat

SEQ ID NO: 396227 - DNA, 15 bp, Homo sapiens
tgttttgcattaatt

SEQ ID NO: 396228 - DNA, 15 bp, Homo sapiens
gttttgcattaattc

SEQ ID NO: 396229 - DNA, 15 bp, Homo sapiens
ttttgcattaattct

SEQ ID NO: 396230 - DNA, 15 bp, Homo sapiens
tttgcattaattctt

SEQ ID NO: 396231 - DNA, 15 bp, Homo sapiens
ttgcattaattcttg

SEQ ID NO: 396232 - DNA, 15 bp, Homo sapiens
tgcattaattcttga

SEQ ID NO: 396233 - DNA, 15 bp, Homo sapiens
gcattaattcttgaa

SEQ ID NO: 396234 - DNA, 15 bp, Homo sapiens
cattaattcttgaaa

SEQ ID NO: 396235 - DNA, 15 bp, Homo sapiens
attaattcttgaaac

SEQ ID NO: 396236 - DNA, 15 bp, Homo sapiens
ttaattcttgaaaca

SEQ ID NO: 396237 - DNA, 15 bp, Homo sapiens
taattcttgaaacaa

SEQ ID NO: 396238 - DNA, 15 bp, Homo sapiens
aattcttgaaacaaa

SEQ ID NO: 396239 - DNA, 15 bp, Homo sapiens
attcttgaaacaaaa

SEQ ID NO: 396240 - DNA, 15 bp, Homo sapiens
ttcttgaaacaaaac

SEQ ID NO: 396241 - DNA, 15 bp, Homo sapiens
tcttgaaacaaaacc

SEQ ID NO: 396242 - DNA, 15 bp, Homo sapiens
cttgaaacaaaacct

SEQ ID NO: 396243 - DNA, 15 bp, Homo sapiens
ttgaaacaaaaccta

SEQ ID NO: 396244 - DNA, 15 bp, Homo sapiens
tgaaacaaaacctag

SEQ ID NO: 396245 - DNA, 15 bp, Homo sapiens
gaaacaaaacctaga

SEQ ID NO: 396246 - DNA, 15 bp, Homo sapiens
aaacaaaacctagat

SEQ ID NO: 396247 - DNA, 15 bp, Homo sapiens
aacaaaacctagatt

SEQ ID NO: 396248 - DNA, 15 bp, Homo sapiens
acaaaacctagattg

SEQ ID NO: 396249 - DNA, 15 bp, Homo sapiens
caaaacctagattgc

SEQ ID NO: 396250 - DNA, 15 bp, Homo sapiens
aaaacctagattgct

SEQ ID NO: 396251 - DNA, 15 bp, Homo sapiens
aaacctagattgctt

SEQ ID NO: 396252 - DNA, 15 bp, Homo sapiens
aacctagattgcttc

SEQ ID NO: 396253 - DNA, 15 bp, Homo sapiens
acctagattgcttca

SEQ ID NO: 396254 - DNA, 15 bp, Homo sapiens
cctagattgcttcat

SEQ ID NO: 396255 - DNA, 15 bp, Homo sapiens
ctagattgcttcatt

SEQ ID NO: 396256 - DNA, 15 bp, Homo sapiens
tagattgcttcatta

SEQ ID NO: 396257 - DNA, 15 bp, Homo sapiens
agattgcttcattac

SEQ ID NO: 396258 - DNA, 15 bp, Homo sapiens
gattgcttcattaca

SEQ ID NO: 396259 - DNA, 15 bp, Homo sapiens
attgcttcattacat

SEQ ID NO: 396260 - DNA, 15 bp, Homo sapiens
ttgcttcattacatg

SEQ ID NO: 396261 - DNA, 15 bp, Homo sapiens
tgcttcattacatgg

SEQ ID NO: 396262 - DNA, 15 bp, Homo sapiens
gcttcattacatggc

SEQ ID NO: 396263 - DNA, 15 bp, Homo sapiens
cttcattacatggcc

SEQ ID NO: 396264 - DNA, 15 bp, Homo sapiens
ttcattacatggcct

SEQ ID NO: 396265 - DNA, 15 bp, Homo sapiens
tcattacatggcctg

SEQ ID NO: 396266 - DNA, 15 bp, Homo sapiens
cattacatggcctgt

SEQ ID NO: 396267 - DNA, 15 bp, Homo sapiens
attacatggcctgtc

SEQ ID NO: 396268 - DNA, 15 bp, Homo sapiens
ttacatggcctgtct

SEQ ID NO: 396269 - DNA, 15 bp, Homo sapiens
tacatggcctgtctt

SEQ ID NO: 396270 - DNA, 15 bp, Homo sapiens
acatggcctgtcttt

SEQ ID NO: 396271 - DNA, 15 bp, Homo sapiens
catggcctgtctttg

SEQ ID NO: 396272 - DNA, 15 bp, Homo sapiens
atggcctgtctttgt

SEQ ID NO: 396273 - DNA, 15 bp, Homo sapiens
tggcctgtctttgtg

SEQ ID NO: 396274 - DNA, 15 bp, Homo sapiens
ggcctgtctttgtgg

SEQ ID NO: 396275 - DNA, 15 bp, Homo sapiens
gcctgtctttgtgga

SEQ ID NO: 396276 - DNA, 15 bp, Homo sapiens
cctgtctttgtggaa

SEQ ID NO: 396277 - DNA, 15 bp, Homo sapiens
ctgtctttgtggaag

SEQ ID NO: 396278 - DNA, 15 bp, Homo sapiens
tgtctttgtggaaga

SEQ ID NO: 396279 - DNA, 15 bp, Homo sapiens
gtctttgtggaagat

SEQ ID NO: 396280 - DNA, 15 bp, Homo sapiens
tctttgtggaagatc

SEQ ID NO: 396281 - DNA, 15 bp, Homo sapiens
ctttgtggaagatcc

SEQ ID NO: 396282 - DNA, 15 bp, Homo sapiens
tttgtggaagatcct

SEQ ID NO: 396283 - DNA, 15 bp, Homo sapiens
ttgtggaagatcctt

SEQ ID NO: 396284 - DNA, 15 bp, Homo sapiens
tgtggaagatcctta

SEQ ID NO: 396285 - DNA, 15 bp, Homo sapiens
gtggaagatccttat

SEQ ID NO: 396286 - DNA, 15 bp, Homo sapiens
tggaagatccttata

SEQ ID NO: 396287 - DNA, 15 bp, Homo sapiens
ggaagatccttatac

SEQ ID NO: 396288 - DNA, 15 bp, Homo sapiens
gaagatccttatacg

SEQ ID NO: 396289 - DNA, 15 bp, Homo sapiens
aagatccttatacgg

SEQ ID NO: 396290 - DNA, 15 bp, Homo sapiens
agatccttatacggt

SEQ ID NO: 396291 - DNA, 15 bp, Homo sapiens
gatccttatacggtg

SEQ ID NO: 396292 - DNA, 15 bp, Homo sapiens
atccttatacggtgt

SEQ ID NO: 396293 - DNA, 15 bp, Homo sapiens
tccttatacggtgtg

SEQ ID NO: 396294 - DNA, 15 bp, Homo sapiens
ccttatacggtgtgg

SEQ ID NO: 396295 - DNA, 15 bp, Homo sapiens
cttatacggtgtggt

SEQ ID NO: 396296 - DNA, 15 bp, Homo sapiens
ttatacggtgtggtg

SEQ ID NO: 396297 - DNA, 15 bp, Homo sapiens
tatacggtgtggtgg

SEQ ID NO: 396298 - DNA, 15 bp, Homo sapiens
atacggtgtggtggt

SEQ ID NO: 396299 - DNA, 15 bp, Homo sapiens
tacggtgtggtggta

SEQ ID NO: 396300 - DNA, 15 bp, Homo sapiens
acggtgtggtggtaa

SEQ ID NO: 396301 - DNA, 15 bp, Homo sapiens
cggtgtggtggtaaa

SEQ ID NO: 396302 - DNA, 15 bp, Homo sapiens
ggtgtggtggtaaag

SEQ ID NO: 396303 - DNA, 15 bp, Homo sapiens
gtgtggtggtaaaga

SEQ ID NO: 396304 - DNA, 15 bp, Homo sapiens
tgtggtggtaaagaa

SEQ ID NO: 396305 - DNA, 15 bp, Homo sapiens
gtggtggtaaagaaa

SEQ ID NO: 396306 - DNA, 15 bp, Homo sapiens
tggtggtaaagaaag

SEQ ID NO: 396307 - DNA, 15 bp, Homo sapiens
ggtggtaaagaaagg

SEQ ID NO: 396308 - DNA, 15 bp, Homo sapiens
gtggtaaagaaaggg

SEQ ID NO: 396309 - DNA, 15 bp, Homo sapiens
tggtaaagaaagggg

SEQ ID NO: 396310 - DNA, 15 bp, Homo sapiens
ggtaaagaaagggga

SEQ ID NO: 396311 - DNA, 15 bp, Homo sapiens
gtaaagaaaggggaa

SEQ ID NO: 396312 - DNA, 15 bp, Homo sapiens
taaagaaaggggaac

SEQ ID NO: 396313 - DNA, 15 bp, Homo sapiens
aaagaaaggggaaca

SEQ ID NO: 396314 - DNA, 15 bp, Homo sapiens
aagaaaggggaacat

SEQ ID NO: 396315 - DNA, 15 bp, Homo sapiens
agaaaggggaacatt

SEQ ID NO: 396316 - DNA, 15 bp, Homo sapiens
gaaaggggaacattt

SEQ ID NO: 396317 - DNA, 15 bp, Homo sapiens
aaaggggaacatttg

SEQ ID NO: 396318 - DNA, 15 bp, Homo sapiens
aaggggaacatttgc

SEQ ID NO: 396319 - DNA, 15 bp, Homo sapiens
aggggaacatttgct

SEQ ID NO: 396320 - DNA, 15 bp, Homo sapiens
ggggaacatttgctc

SEQ ID NO: 396321 - DNA, 15 bp, Homo sapiens
gggaacatttgctct

SEQ ID NO: 396322 - DNA, 15 bp, Homo sapiens
ggaacatttgctcta

SEQ ID NO: 396323 - DNA, 15 bp, Homo sapiens
gaacatttgctctat

SEQ ID NO: 396324 - DNA, 15 bp, Homo sapiens
aacatttgctctatt

SEQ ID NO: 396325 - DNA, 15 bp, Homo sapiens
acatttgctctattt

SEQ ID NO: 396326 - DNA, 15 bp, Homo sapiens
catttgctctatttt

SEQ ID NO: 396327 - DNA, 15 bp, Homo sapiens
atttgctctattttg

SEQ ID NO: 396328 - DNA, 15 bp, Homo sapiens
tttgctctattttga

SEQ ID NO: 396329 - DNA, 15 bp, Homo sapiens
ttgctctattttgaa

SEQ ID NO: 396330 - DNA, 15 bp, Homo sapiens
tgctctattttgaag

SEQ ID NO: 396331 - DNA, 15 bp, Homo sapiens
gctctattttgaagt

SEQ ID NO: 396332 - DNA, 15 bp, Homo sapiens
ctctattttgaagta

SEQ ID NO: 396333 - DNA, 15 bp, Homo sapiens
tctattttgaagtaa

SEQ ID NO: 396334 - DNA, 15 bp, Homo sapiens
ctattttgaagtaat

SEQ ID NO: 396335 - DNA, 15 bp, Homo sapiens
tattttgaagtaatt

SEQ ID NO: 396336 - DNA, 15 bp, Homo sapiens
attttgaagtaattg

SEQ ID NO: 396337 - DNA, 15 bp, Homo sapiens
ttttgaagtaattgc

SEQ ID NO: 396338 - DNA, 15 bp, Homo sapiens
tttgaagtaattgct

SEQ ID NO: 396339 - DNA, 15 bp, Homo sapiens
ttgaagtaattgctt

SEQ ID NO: 396340 - DNA, 15 bp, Homo sapiens
tgaagtaattgcttc

SEQ ID NO: 396341 - DNA, 15 bp, Homo sapiens
gaagtaattgcttct

SEQ ID NO: 396342 - DNA, 15 bp, Homo sapiens
aagtaattgcttcta

SEQ ID NO: 396343 - DNA, 15 bp, Homo sapiens
agtaattgcttctaa

SEQ ID NO: 396344 - DNA, 15 bp, Homo sapiens
gtaattgcttctaat

SEQ ID NO: 396345 - DNA, 15 bp, Homo sapiens
taattgcttctaatg

SEQ ID NO: 396346 - DNA, 15 bp, Homo sapiens
aattgcttctaatgg

SEQ ID NO: 396347 - DNA, 15 bp, Homo sapiens
attgcttctaatgga

SEQ ID NO: 396348 - DNA, 15 bp, Homo sapiens
ttgcttctaatggaa

SEQ ID NO: 396349 - DNA, 15 bp, Homo sapiens
tgcttctaatggaag

SEQ ID NO: 396350 - DNA, 15 bp, Homo sapiens
gcttctaatggaagc

SEQ ID NO: 396351 - DNA, 15 bp, Homo sapiens
cttctaatggaagcc

SEQ ID NO: 396352 - DNA, 15 bp, Homo sapiens
ttctaatggaagcct

SEQ ID NO: 396353 - DNA, 15 bp, Homo sapiens
tctaatggaagccta

SEQ ID NO: 396354 - DNA, 15 bp, Homo sapiens
ctaatggaagcctaa

SEQ ID NO: 396355 - DNA, 15 bp, Homo sapiens
taatggaagcctaat

SEQ ID NO: 396356 - DNA, 15 bp, Homo sapiens
aatggaagcctaatg

SEQ ID NO: 396357 - DNA, 15 bp, Homo sapiens
atggaagcctaatga

SEQ ID NO: 396358 - DNA, 15 bp, Homo sapiens
tggaagcctaatgac

SEQ ID NO: 396359 - DNA, 15 bp, Homo sapiens
ggaagcctaatgacc

SEQ ID NO: 396360 - DNA, 15 bp, Homo sapiens
gaagcctaatgacct

SEQ ID NO: 396361 - DNA, 15 bp, Homo sapiens
aagcctaatgaccta

SEQ ID NO: 396362 - DNA, 15 bp, Homo sapiens
agcctaatgacctat

SEQ ID NO: 396363 - DNA, 15 bp, Homo sapiens
gcctaatgacctatt

SEQ ID NO: 396364 - DNA, 15 bp, Homo sapiens
cctaatgacctatta

SEQ ID NO: 396365 - DNA, 15 bp, Homo sapiens
ctaatgacctattat

SEQ ID NO: 396366 - DNA, 15 bp, Homo sapiens
taatgacctattatg

SEQ ID NO: 396367 - DNA, 15 bp, Homo sapiens
aatgacctattatgc

SEQ ID NO: 396368 - DNA, 15 bp, Homo sapiens
atgacctattatgct

SEQ ID NO: 396369 - DNA, 15 bp, Homo sapiens
tgacctattatgctt

SEQ ID NO: 396370 - DNA, 15 bp, Homo sapiens
gacctattatgctta

SEQ ID NO: 396371 - DNA, 15 bp, Homo sapiens
acctattatgcttat

SEQ ID NO: 396372 - DNA, 15 bp, Homo sapiens
cctattatgcttatt

SEQ ID NO: 396373 - DNA, 15 bp, Homo sapiens
ctattatgcttattt

SEQ ID NO: 396374 - DNA, 15 bp, Homo sapiens
tattatgcttatttc

SEQ ID NO: 396375 - DNA, 15 bp, Homo sapiens
attatgcttatttct

SEQ ID NO: 396376 - DNA, 15 bp, Homo sapiens
ttatgcttatttcta

SEQ ID NO: 396377 - DNA, 15 bp, Homo sapiens
tatgcttatttctaa

SEQ ID NO: 396378 - DNA, 15 bp, Homo sapiens
atgcttatttctaaa

SEQ ID NO: 396379 - DNA, 15 bp, Homo sapiens
tgcttatttctaaaa

SEQ ID NO: 396380 - DNA, 15 bp, Homo sapiens
gcttatttctaaaag

SEQ ID NO: 396381 - DNA, 15 bp, Homo sapiens
cttatttctaaaagc

SEQ ID NO: 396382 - DNA, 15 bp, Homo sapiens
ttatttctaaaagct

SEQ ID NO: 396383 - DNA, 15 bp, Homo sapiens
tatttctaaaagctg

SEQ ID NO: 396384 - DNA, 15 bp, Homo sapiens
atttctaaaagctga

SEQ ID NO: 396385 - DNA, 15 bp, Homo sapiens
tttctaaaagctgag

SEQ ID NO: 396386 - DNA, 15 bp, Homo sapiens
ttctaaaagctgagc

SEQ ID NO: 396387 - DNA, 15 bp, Homo sapiens
tctaaaagctgagca

SEQ ID NO: 396388 - DNA, 15 bp, Homo sapiens
ctaaaagctgagcag

SEQ ID NO: 396389 - DNA, 15 bp, Homo sapiens
taaaagctgagcagt

SEQ ID NO: 396390 - DNA, 15 bp, Homo sapiens
aaaagctgagcagta

SEQ ID NO: 396391 - DNA, 15 bp, Homo sapiens
aaagctgagcagtaa

SEQ ID NO: 396392 - DNA, 15 bp, Homo sapiens
aagctgagcagtaag

SEQ ID NO: 396393 - DNA, 15 bp, Homo sapiens
agctgagcagtaagc

SEQ ID NO: 396394 - DNA, 15 bp, Homo sapiens
gctgagcagtaagct

SEQ ID NO: 396395 - DNA, 15 bp, Homo sapiens
ctgagcagtaagctt

SEQ ID NO: 396396 - DNA, 15 bp, Homo sapiens
tgagcagtaagcttg

SEQ ID NO: 396397 - DNA, 15 bp, Homo sapiens
gagcagtaagcttga

SEQ ID NO: 396398 - DNA, 15 bp, Homo sapiens
agcagtaagcttgat

SEQ ID NO: 396399 - DNA, 15 bp, Homo sapiens
gcagtaagcttgata

SEQ ID NO: 396400 - DNA, 15 bp, Homo sapiens
cagtaagcttgatag

SEQ ID NO: 396401 - DNA, 15 bp, Homo sapiens
agtaagcttgatagg

SEQ ID NO: 396402 - DNA, 15 bp, Homo sapiens
gtaagcttgatagga

SEQ ID NO: 396403 - DNA, 15 bp, Homo sapiens
taagcttgataggaa

SEQ ID NO: 396404 - DNA, 15 bp, Homo sapiens
aagcttgataggaag

SEQ ID NO: 396405 - DNA, 15 bp, Homo sapiens
agcttgataggaagc

SEQ ID NO: 396406 - DNA, 15 bp, Homo sapiens
gcttgataggaagct

SEQ ID NO: 396407 - DNA, 15 bp, Homo sapiens
cttgataggaagcta

SEQ ID NO: 396408 - DNA, 15 bp, Homo sapiens
ttgataggaagctag

SEQ ID NO: 396409 - DNA, 15 bp, Homo sapiens
tgataggaagctaga

SEQ ID NO: 396410 - DNA, 15 bp, Homo sapiens
gataggaagctagag

SEQ ID NO: 396411 - DNA, 15 bp, Homo sapiens
ataggaagctagaga

SEQ ID NO: 396412 - DNA, 15 bp, Homo sapiens
taggaagctagagaa

SEQ ID NO: 396413 - DNA, 15 bp, Homo sapiens
aggaagctagagaaa

SEQ ID NO: 396414 - DNA, 15 bp, Homo sapiens
ggaagctagagaaag

SEQ ID NO: 396415 - DNA, 15 bp, Homo sapiens
gaagctagagaaaga

SEQ ID NO: 396416 - DNA, 15 bp, Homo sapiens
aagctagagaaagat

SEQ ID NO: 396417 - DNA, 15 bp, Homo sapiens
agctagagaaagatt

SEQ ID NO: 396418 - DNA, 15 bp, Homo sapiens
gctagagaaagattg

SEQ ID NO: 396419 - DNA, 15 bp, Homo sapiens
ctagagaaagattgg

SEQ ID NO: 396420 - DNA, 15 bp, Homo sapiens
tagagaaagattgga

SEQ ID NO: 396421 - DNA, 15 bp, Homo sapiens
agagaaagattggag

SEQ ID NO: 396422 - DNA, 15 bp, Homo sapiens
gagaaagattggaga

SEQ ID NO: 396423 - DNA, 15 bp, Homo sapiens
agaaagattggagaa

SEQ ID NO: 396424 - DNA, 15 bp, Homo sapiens
gaaagattggagaaa

SEQ ID NO: 396425 - DNA, 15 bp, Homo sapiens
aaagattggagaaat

SEQ ID NO: 396426 - DNA, 15 bp, Homo sapiens
aagattggagaaatt

SEQ ID NO: 396427 - DNA, 15 bp, Homo sapiens
agattggagaaatta

SEQ ID NO: 396428 - DNA, 15 bp, Homo sapiens
gattggagaaattat

SEQ ID NO: 396429 - DNA, 15 bp, Homo sapiens
attggagaaattatg

SEQ ID NO: 396430 - DNA, 15 bp, Homo sapiens
ttggagaaattatgt

SEQ ID NO: 396431 - DNA, 15 bp, Homo sapiens
tggagaaattatgtc

SEQ ID NO: 396432 - DNA, 15 bp, Homo sapiens
ggagaaattatgtca

SEQ ID NO: 396433 - DNA, 15 bp, Homo sapiens
gagaaattatgtcat

SEQ ID NO: 396434 - DNA, 15 bp, Homo sapiens
agaaattatgtcata

SEQ ID NO: 396435 - DNA, 15 bp, Homo sapiens
gaaattatgtcatat

SEQ ID NO: 396436 - DNA, 15 bp, Homo sapiens
aaattatgtcatata

SEQ ID NO: 396437 - DNA, 15 bp, Homo sapiens
aattatgtcatataa

SEQ ID NO: 396438 - DNA, 15 bp, Homo sapiens
attatgtcatataaa

SEQ ID NO: 396439 - DNA, 15 bp, Homo sapiens
ttatgtcatataaac

SEQ ID NO: 396440 - DNA, 15 bp, Homo sapiens
tatgtcatataaacc

SEQ ID NO: 396441 - DNA, 15 bp, Homo sapiens
atgtcatataaacca

SEQ ID NO: 396442 - DNA, 15 bp, Homo sapiens
tgtcatataaaccaa

SEQ ID NO: 396443 - DNA, 15 bp, Homo sapiens
gtcatataaaccaaa

SEQ ID NO: 396444 - DNA, 15 bp, Homo sapiens
tcatataaaccaaaa

SEQ ID NO: 396445 - DNA, 15 bp, Homo sapiens
catataaaccaaaat

SEQ ID NO: 396446 - DNA, 15 bp, Homo sapiens
atataaaccaaaatt

SEQ ID NO: 396447 - DNA, 15 bp, Homo sapiens
tataaaccaaaattt

SEQ ID NO: 396448 - DNA, 15 bp, Homo sapiens
ataaaccaaaatttc

SEQ ID NO: 396449 - DNA, 15 bp, Homo sapiens
taaaccaaaatttca

SEQ ID NO: 396450 - DNA, 15 bp, Homo sapiens
aaaccaaaatttcag

SEQ ID NO: 396451 - DNA, 15 bp, Homo sapiens
aaccaaaatttcagg

SEQ ID NO: 396452 - DNA, 15 bp, Homo sapiens
accaaaatttcagga

SEQ ID NO: 396453 - DNA, 15 bp, Homo sapiens
ccaaaatttcaggaa

SEQ ID NO: 396454 - DNA, 15 bp, Homo sapiens
caaaatttcaggaag

SEQ ID NO: 396455 - DNA, 15 bp, Homo sapiens
aaaatttcaggaagt

SEQ ID NO: 396456 - DNA, 15 bp, Homo sapiens
aaatttcaggaagtt

SEQ ID NO: 396457 - DNA, 15 bp, Homo sapiens
aatttcaggaagttg

SEQ ID NO: 396458 - DNA, 15 bp, Homo sapiens
atttcaggaagttgc

SEQ ID NO: 396459 - DNA, 15 bp, Homo sapiens
tttcaggaagttgca

SEQ ID NO: 396460 - DNA, 15 bp, Homo sapiens
ttcaggaagttgcat

SEQ ID NO: 396461 - DNA, 15 bp, Homo sapiens
tcaggaagttgcatg

SEQ ID NO: 396462 - DNA, 15 bp, Homo sapiens
caggaagttgcatgt

SEQ ID NO: 396463 - DNA, 15 bp, Homo sapiens
aggaagttgcatgtg

SEQ ID NO: 396464 - DNA, 15 bp, Homo sapiens
ggaagttgcatgtgg

SEQ ID NO: 396465 - DNA, 15 bp, Homo sapiens
gaagttgcatgtggt

SEQ ID NO: 396466 - DNA, 15 bp, Homo sapiens
aagttgcatgtggtt

SEQ ID NO: 396467 - DNA, 15 bp, Homo sapiens
agttgcatgtggttg

SEQ ID NO: 396468 - DNA, 15 bp, Homo sapiens
gttgcatgtggttga

SEQ ID NO: 396469 - DNA, 15 bp, Homo sapiens
ttgcatgtggttgag

SEQ ID NO: 396470 - DNA, 15 bp, Homo sapiens
tgcatgtggttgaga

SEQ ID NO: 396471 - DNA, 15 bp, Homo sapiens
gcatgtggttgagaa

SEQ ID NO: 396472 - DNA, 15 bp, Homo sapiens
catgtggttgagaat

SEQ ID NO: 396473 - DNA, 15 bp, Homo sapiens
atgtggttgagaatc

SEQ ID NO: 396474 - DNA, 15 bp, Homo sapiens
tgtggttgagaatca

SEQ ID NO: 396475 - DNA, 15 bp, Homo sapiens
gtggttgagaatcag

SEQ ID NO: 396476 - DNA, 15 bp, Homo sapiens
tggttgagaatcagt

SEQ ID NO: 396477 - DNA, 15 bp, Homo sapiens
ggttgagaatcagta

SEQ ID NO: 396478 - DNA, 15 bp, Homo sapiens
gttgagaatcagtac

SEQ ID NO: 396479 - DNA, 15 bp, Homo sapiens
ttgagaatcagtacc

SEQ ID NO: 396480 - DNA, 15 bp, Homo sapiens
tgagaatcagtacct

SEQ ID NO: 396481 - DNA, 15 bp, Homo sapiens
gagaatcagtacctc

SEQ ID NO: 396482 - DNA, 15 bp, Homo sapiens
agaatcagtacctca

SEQ ID NO: 396483 - DNA, 15 bp, Homo sapiens
gaatcagtacctcat

SEQ ID NO: 396484 - DNA, 15 bp, Homo sapiens
aatcagtacctcatt

SEQ ID NO: 396485 - DNA, 15 bp, Homo sapiens
atcagtacctcatta

SEQ ID NO: 396486 - DNA, 15 bp, Homo sapiens
tcagtacctcattag

SEQ ID NO: 396487 - DNA, 15 bp, Homo sapiens
cagtacctcattaga

SEQ ID NO: 396488 - DNA, 15 bp, Homo sapiens
agtacctcattagac

SEQ ID NO: 396489 - DNA, 15 bp, Homo sapiens
gtacctcattagaca

SEQ ID NO: 396490 - DNA, 15 bp, Homo sapiens
tacctcattagacaa

SEQ ID NO: 396491 - DNA, 15 bp, Homo sapiens
acctcattagacaac

SEQ ID NO: 396492 - DNA, 15 bp, Homo sapiens
cctcattagacaact

SEQ ID NO: 396493 - DNA, 15 bp, Homo sapiens
ctcattagacaactt

SEQ ID NO: 396494 - DNA, 15 bp, Homo sapiens
tcattagacaactta

SEQ ID NO: 396495 - DNA, 15 bp, Homo sapiens
cattagacaacttaa

SEQ ID NO: 396496 - DNA, 15 bp, Homo sapiens
attagacaacttaat

SEQ ID NO: 396497 - DNA, 15 bp, Homo sapiens
ttagacaacttaata

SEQ ID NO: 396498 - DNA, 15 bp, Homo sapiens
tagacaacttaataa

SEQ ID NO: 396499 - DNA, 15 bp, Homo sapiens
agacaacttaataat

SEQ ID NO: 396500 - DNA, 15 bp, Homo sapiens
gacaacttaataatt

SEQ ID NO: 396501 - DNA, 15 bp, Homo sapiens
acaacttaataattc

SEQ ID NO: 396502 - DNA, 15 bp, Homo sapiens
caacttaataattca

SEQ ID NO: 396503 - DNA, 15 bp, Homo sapiens
aacttaataattcaa

SEQ ID NO: 396504 - DNA, 15 bp, Homo sapiens
acttaataattcaat

SEQ ID NO: 396505 - DNA, 15 bp, Homo sapiens
cttaataattcaata

SEQ ID NO: 396506 - DNA, 15 bp, Homo sapiens
ttaataattcaatag

SEQ ID NO: 396507 - DNA, 15 bp, Homo sapiens
taataattcaatagt

SEQ ID NO: 396508 - DNA, 15 bp, Homo sapiens
aataattcaatagtt

SEQ ID NO: 396509 - DNA, 15 bp, Homo sapiens
ataattcaatagttt

SEQ ID NO: 396510 - DNA, 15 bp, Homo sapiens
taattcaatagttta

SEQ ID NO: 396511 - DNA, 15 bp, Homo sapiens
aattcaatagtttac

SEQ ID NO: 396512 - DNA, 15 bp, Homo sapiens
attcaatagtttact

SEQ ID NO: 396513 - DNA, 15 bp, Homo sapiens
ttcaatagtttactt

SEQ ID NO: 396514 - DNA, 15 bp, Homo sapiens
tcaatagtttactta

SEQ ID NO: 396515 - DNA, 15 bp, Homo sapiens
caatagtttacttat

SEQ ID NO: 396516 - DNA, 15 bp, Homo sapiens
aatagtttacttatg

SEQ ID NO: 396517 - DNA, 15 bp, Homo sapiens
atagtttacttatgc

SEQ ID NO: 396518 - DNA, 15 bp, Homo sapiens
tagtttacttatgcc

SEQ ID NO: 396519 - DNA, 15 bp, Homo sapiens
agtttacttatgcca

SEQ ID NO: 396520 - DNA, 15 bp, Homo sapiens
gtttacttatgccaa

SEQ ID NO: 396521 - DNA, 15 bp, Homo sapiens
tttacttatgccaaa

SEQ ID NO: 396522 - DNA, 15 bp, Homo sapiens
ttacttatgccaaat

SEQ ID NO: 396523 - DNA, 15 bp, Homo sapiens
tacttatgccaaatg

SEQ ID NO: 396524 - DNA, 15 bp, Homo sapiens
acttatgccaaatgt

SEQ ID NO: 396525 - DNA, 15 bp, Homo sapiens
cttatgccaaatgtc

SEQ ID NO: 396526 - DNA, 15 bp, Homo sapiens
ttatgccaaatgtca

SEQ ID NO: 396527 - DNA, 15 bp, Homo sapiens
tatgccaaatgtcat

SEQ ID NO: 396528 - DNA, 15 bp, Homo sapiens
atgccaaatgtcatc

SEQ ID NO: 396529 - DNA, 15 bp, Homo sapiens
tgccaaatgtcatcc

SEQ ID NO: 396530 - DNA, 15 bp, Homo sapiens
gccaaatgtcatcct

SEQ ID NO: 396531 - DNA, 15 bp, Homo sapiens
ccaaatgtcatcctt

SEQ ID NO: 396532 - DNA, 15 bp, Homo sapiens
caaatgtcatcctta

SEQ ID NO: 396533 - DNA, 15 bp, Homo sapiens
aaatgtcatccttac

SEQ ID NO: 396534 - DNA, 15 bp, Homo sapiens
aatgtcatccttact

SEQ ID NO: 396535 - DNA, 15 bp, Homo sapiens
atgtcatccttactt

SEQ ID NO: 396536 - DNA, 15 bp, Homo sapiens
tgtcatccttacttt

SEQ ID NO: 396537 - DNA, 15 bp, Homo sapiens
gtcatccttacttta

SEQ ID NO: 396538 - DNA, 15 bp, Homo sapiens
tcatccttactttaa

SEQ ID NO: 396539 - DNA, 15 bp, Homo sapiens
catccttactttaaa

SEQ ID NO: 396540 - DNA, 15 bp, Homo sapiens
atccttactttaaaa

SEQ ID NO: 396541 - DNA, 15 bp, Homo sapiens
tccttactttaaaag

SEQ ID NO: 396542 - DNA, 15 bp, Homo sapiens
ccttactttaaaagc

SEQ ID NO: 396543 - DNA, 15 bp, Homo sapiens
cttactttaaaagct

SEQ ID NO: 396544 - DNA, 15 bp, Homo sapiens
ttactttaaaagctg

SEQ ID NO: 396545 - DNA, 15 bp, Homo sapiens
tactttaaaagctgg

SEQ ID NO: 396546 - DNA, 15 bp, Homo sapiens
actttaaaagctgga

SEQ ID NO: 396547 - DNA, 15 bp, Homo sapiens
ctttaaaagctggag

SEQ ID NO: 396548 - DNA, 15 bp, Homo sapiens
tttaaaagctggagt

SEQ ID NO: 396549 - DNA, 15 bp, Homo sapiens
ttaaaagctggagtg

SEQ ID NO: 396550 - DNA, 15 bp, Homo sapiens
taaaagctggagtga

SEQ ID NO: 396551 - DNA, 15 bp, Homo sapiens
aaaagctggagtgat

SEQ ID NO: 396552 - DNA, 15 bp, Homo sapiens
aaagctggagtgatt

SEQ ID NO: 396553 - DNA, 15 bp, Homo sapiens
aagctggagtgattt

SEQ ID NO: 396554 - DNA, 15 bp, Homo sapiens
agctggagtgatttc

SEQ ID NO: 396555 - DNA, 15 bp, Homo sapiens
gctggagtgatttct

SEQ ID NO: 396556 - DNA, 15 bp, Homo sapiens
ctggagtgatttcta

SEQ ID NO: 396557 - DNA, 15 bp, Homo sapiens
tggagtgatttctag

SEQ ID NO: 396558 - DNA, 15 bp, Homo sapiens
ggagtgatttctaga

SEQ ID NO: 396559 - DNA, 15 bp, Homo sapiens
gagtgatttctagaa

SEQ ID NO: 396560 - DNA, 15 bp, Homo sapiens
agtgatttctagaaa

SEQ ID NO: 396561 - DNA, 15 bp, Homo sapiens
gtgatttctagaaat

SEQ ID NO: 396562 - DNA, 15 bp, Homo sapiens
tgatttctagaaatg

SEQ ID NO: 396563 - DNA, 15 bp, Homo sapiens
gatttctagaaatgt

SEQ ID NO: 396564 - DNA, 15 bp, Homo sapiens
atttctagaaatgtg

SEQ ID NO: 396565 - DNA, 15 bp, Homo sapiens
tttctagaaatgtgt

SEQ ID NO: 396566 - DNA, 15 bp, Homo sapiens
ttctagaaatgtgtc

SEQ ID NO: 396567 - DNA, 15 bp, Homo sapiens
tctagaaatgtgtcc

SEQ ID NO: 396568 - DNA, 15 bp, Homo sapiens
ctagaaatgtgtcca

SEQ ID NO: 396569 - DNA, 15 bp, Homo sapiens
tagaaatgtgtccac

SEQ ID NO: 396570 - DNA, 15 bp, Homo sapiens
agaaatgtgtccaca

SEQ ID NO: 396571 - DNA, 15 bp, Homo sapiens
gaaatgtgtccacat

SEQ ID NO: 396572 - DNA, 15 bp, Homo sapiens
aaatgtgtccacatc

SEQ ID NO: 396573 - DNA, 15 bp, Homo sapiens
aatgtgtccacatcc

SEQ ID NO: 396574 - DNA, 15 bp, Homo sapiens
atgtgtccacatcct

SEQ ID NO: 396575 - DNA, 15 bp, Homo sapiens
tgtgtccacatcctt

SEQ ID NO: 396576 - DNA, 15 bp, Homo sapiens
gtgtccacatccttg

SEQ ID NO: 396577 - DNA, 15 bp, Homo sapiens
tgtccacatccttgc

SEQ ID NO: 396578 - DNA, 15 bp, Homo sapiens
gtccacatccttgcg

SEQ ID NO: 396579 - DNA, 15 bp, Homo sapiens
tccacatccttgcgg

SEQ ID NO: 396580 - DNA, 15 bp, Homo sapiens
ccacatccttgcggg

SEQ ID NO: 396581 - DNA, 15 bp, Homo sapiens
cacatccttgcgggt

SEQ ID NO: 396582 - DNA, 15 bp, Homo sapiens
acatccttgcgggtt

SEQ ID NO: 396583 - DNA, 15 bp, Homo sapiens
catccttgcgggtta

SEQ ID NO: 396584 - DNA, 15 bp, Homo sapiens
atccttgcgggttag

SEQ ID NO: 396585 - DNA, 15 bp, Homo sapiens
tccttgcgggttagg

SEQ ID NO: 396586 - DNA, 15 bp, Homo sapiens
ccttgcgggttaggg

SEQ ID NO: 396587 - DNA, 15 bp, Homo sapiens
cttgcgggttagggt

SEQ ID NO: 396588 - DNA, 15 bp, Homo sapiens
ttgcgggttagggta

SEQ ID NO: 396589 - DNA, 15 bp, Homo sapiens
tgcgggttagggtac

SEQ ID NO: 396590 - DNA, 15 bp, Homo sapiens
gcgggttagggtacg

SEQ ID NO: 396591 - DNA, 15 bp, Homo sapiens
cgggttagggtacgg

SEQ ID NO: 396592 - DNA, 15 bp, Homo sapiens
gggttagggtacggg

SEQ ID NO: 396593 - DNA, 15 bp, Homo sapiens
ggttagggtacgggg

SEQ ID NO: 396594 - DNA, 15 bp, Homo sapiens
gttagggtacggggc

SEQ ID NO: 396595 - DNA, 15 bp, Homo sapiens
ttagggtacggggca

SEQ ID NO: 396596 - DNA, 15 bp, Homo sapiens
tagggtacggggcag

SEQ ID NO: 396597 - DNA, 15 bp, Homo sapiens
agggtacggggcagc

SEQ ID NO: 396598 - DNA, 15 bp, Homo sapiens
gggtacggggcagct

SEQ ID NO: 396599 - DNA, 15 bp, Homo sapiens
ggtacggggcagctt

SEQ ID NO: 396600 - DNA, 15 bp, Homo sapiens
gtacggggcagcttc

SEQ ID NO: 396601 - DNA, 15 bp, Homo sapiens
tacggggcagcttct

SEQ ID NO: 396602 - DNA, 15 bp, Homo sapiens
acggggcagcttctg

SEQ ID NO: 396603 - DNA, 15 bp, Homo sapiens
cggggcagcttctgg

SEQ ID NO: 396604 - DNA, 15 bp, Homo sapiens
ggggcagcttctggc

SEQ ID NO: 396605 - DNA, 15 bp, Homo sapiens
gggcagcttctggcc

SEQ ID NO: 396606 - DNA, 15 bp, Homo sapiens
ggcagcttctggcca

SEQ ID NO: 396607 - DNA, 15 bp, Homo sapiens
gcagcttctggccag

SEQ ID NO: 396608 - DNA, 15 bp, Homo sapiens
cagcttctggccagc

SEQ ID NO: 396609 - DNA, 15 bp, Homo sapiens
agcttctggccagct

SEQ ID NO: 396610 - DNA, 15 bp, Homo sapiens
gcttctggccagctg

SEQ ID NO: 396611 - DNA, 15 bp, Homo sapiens
cttctggccagctgt

SEQ ID NO: 396612 - DNA, 15 bp, Homo sapiens
ttctggccagctgtc

SEQ ID NO: 396613 - DNA, 15 bp, Homo sapiens
tctggccagctgtcg

SEQ ID NO: 396614 - DNA, 15 bp, Homo sapiens
ctggccagctgtcgt

SEQ ID NO: 396615 - DNA, 15 bp, Homo sapiens
tggccagctgtcgtc

SEQ ID NO: 396616 - DNA, 15 bp, Homo sapiens
ggccagctgtcgtcc

SEQ ID NO: 396617 - DNA, 15 bp, Homo sapiens
gccagctgtcgtcca

SEQ ID NO: 396618 - DNA, 15 bp, Homo sapiens
ccagctgtcgtccag

SEQ ID NO: 396619 - DNA, 15 bp, Homo sapiens
cagctgtcgtccagg

SEQ ID NO: 396620 - DNA, 15 bp, Homo sapiens
agctgtcgtccaggt

SEQ ID NO: 396621 - DNA, 15 bp, Homo sapiens
gctgtcgtccaggtg

SEQ ID NO: 396622 - DNA, 15 bp, Homo sapiens
ctgtcgtccaggtgt

SEQ ID NO: 396623 - DNA, 15 bp, Homo sapiens
tgtcgtccaggtgtc

SEQ ID NO: 396624 - DNA, 15 bp, Homo sapiens
gtcgtccaggtgtct

SEQ ID NO: 396625 - DNA, 15 bp, Homo sapiens
tcgtccaggtgtctt

SEQ ID NO: 396626 - DNA, 15 bp, Homo sapiens
cgtccaggtgtctta

SEQ ID NO: 396627 - DNA, 15 bp, Homo sapiens
gtccaggtgtcttat

SEQ ID NO: 396628 - DNA, 15 bp, Homo sapiens
tccaggtgtcttatg

SEQ ID NO: 396629 - DNA, 15 bp, Homo sapiens
ccaggtgtcttatgg

SEQ ID NO: 396630 - DNA, 15 bp, Homo sapiens
caggtgtcttatggt

SEQ ID NO: 396631 - DNA, 15 bp, Homo sapiens
aggtgtcttatggtt

SEQ ID NO: 396632 - DNA, 15 bp, Homo sapiens
ggtgtcttatggttt

SEQ ID NO: 396633 - DNA, 15 bp, Homo sapiens
gtgtcttatggtttt

SEQ ID NO: 396634 - DNA, 15 bp, Homo sapiens
tgtcttatggttttt

SEQ ID NO: 396635 - DNA, 15 bp, Homo sapiens
gtcttatggtttttc

SEQ ID NO: 396636 - DNA, 15 bp, Homo sapiens
tcttatggtttttcc

SEQ ID NO: 396637 - DNA, 15 bp, Homo sapiens
cttatggtttttccg

SEQ ID NO: 396638 - DNA, 15 bp, Homo sapiens
ttatggtttttccga

SEQ ID NO: 396639 - DNA, 15 bp, Homo sapiens
tatggtttttccgag

SEQ ID NO: 396640 - DNA, 15 bp, Homo sapiens
atggtttttccgagt

SEQ ID NO: 396641 - DNA, 15 bp, Homo sapiens
tggtttttccgagtt

SEQ ID NO: 396642 - DNA, 15 bp, Homo sapiens
ggtttttccgagttt

SEQ ID NO: 396643 - DNA, 15 bp, Homo sapiens
gtttttccgagtttc

SEQ ID NO: 396644 - DNA, 15 bp, Homo sapiens
tttttccgagtttca

SEQ ID NO: 396645 - DNA, 15 bp, Homo sapiens
ttttccgagtttcat

SEQ ID NO: 396646 - DNA, 15 bp, Homo sapiens
tttccgagtttcata

SEQ ID NO: 396647 - DNA, 15 bp, Homo sapiens
ttccgagtttcatat

SEQ ID NO: 396648 - DNA, 15 bp, Homo sapiens
tccgagtttcatatg

SEQ ID NO: 396649 - DNA, 15 bp, Homo sapiens
ccgagtttcatatgc

SEQ ID NO: 396650 - DNA, 15 bp, Homo sapiens
cgagtttcatatgca

SEQ ID NO: 396651 - DNA, 15 bp, Homo sapiens
gagtttcatatgcag

SEQ ID NO: 396652 - DNA, 15 bp, Homo sapiens
agtttcatatgcaga

SEQ ID NO: 396653 - DNA, 15 bp, Homo sapiens
gtttcatatgcagat

SEQ ID NO: 396654 - DNA, 15 bp, Homo sapiens
tttcatatgcagatc

SEQ ID NO: 396655 - DNA, 15 bp, Homo sapiens
ttcatatgcagatca

SEQ ID NO: 396656 - DNA, 15 bp, Homo sapiens
tcatatgcagatcaa

SEQ ID NO: 396657 - DNA, 15 bp, Homo sapiens
catatgcagatcaaa

SEQ ID NO: 396658 - DNA, 15 bp, Homo sapiens
atatgcagatcaaac

SEQ ID NO: 396659 - DNA, 15 bp, Homo sapiens
tatgcagatcaaaca

SEQ ID NO: 396660 - DNA, 15 bp, Homo sapiens
atgcagatcaaacag

SEQ ID NO: 396661 - DNA, 15 bp, Homo sapiens
tgcagatcaaacagg

SEQ ID NO: 396662 - DNA, 15 bp, Homo sapiens
gcagatcaaacaggg

SEQ ID NO: 396663 - DNA, 15 bp, Homo sapiens
cagatcaaacagggc

SEQ ID NO: 396664 - DNA, 15 bp, Homo sapiens
agatcaaacagggca

SEQ ID NO: 396665 - DNA, 15 bp, Homo sapiens
gatcaaacagggcag

SEQ ID NO: 396666 - DNA, 15 bp, Homo sapiens
atcaaacagggcagt

SEQ ID NO: 396667 - DNA, 15 bp, Homo sapiens
tcaaacagggcagtg

SEQ ID NO: 396668 - DNA, 15 bp, Homo sapiens
caaacagggcagtga

SEQ ID NO: 396669 - DNA, 15 bp, Homo sapiens
aaacagggcagtgag

SEQ ID NO: 396670 - DNA, 15 bp, Homo sapiens
aacagggcagtgaga

SEQ ID NO: 396671 - DNA, 15 bp, Homo sapiens
acagggcagtgagag

SEQ ID NO: 396672 - DNA, 15 bp, Homo sapiens
cagggcagtgagagt

SEQ ID NO: 396673 - DNA, 15 bp, Homo sapiens
agggcagtgagagta

SEQ ID NO: 396674 - DNA, 15 bp, Homo sapiens
gggcagtgagagtag

SEQ ID NO: 396675 - DNA, 15 bp, Homo sapiens
ggcagtgagagtaga

SEQ ID NO: 396676 - DNA, 15 bp, Homo sapiens
gcagtgagagtagag

SEQ ID NO: 396677 - DNA, 15 bp, Homo sapiens
cagtgagagtagagt

SEQ ID NO: 396678 - DNA, 15 bp, Homo sapiens
agtgagagtagagtt

SEQ ID NO: 396679 - DNA, 15 bp, Homo sapiens
gtgagagtagagttt

SEQ ID NO: 396680 - DNA, 15 bp, Homo sapiens
tgagagtagagtttt

SEQ ID NO: 396681 - DNA, 15 bp, Homo sapiens
gagagtagagttttc

SEQ ID NO: 396682 - DNA, 15 bp, Homo sapiens
agagtagagttttcc

SEQ ID NO: 396683 - DNA, 15 bp, Homo sapiens
gagtagagttttcct

SEQ ID NO: 396684 - DNA, 15 bp, Homo sapiens
agtagagttttcctg

SEQ ID NO: 396685 - DNA, 15 bp, Homo sapiens
gtagagttttcctgt

SEQ ID NO: 396686 - DNA, 15 bp, Homo sapiens
tagagttttcctgtg

SEQ ID NO: 396687 - DNA, 15 bp, Homo sapiens
agagttttcctgtgg

SEQ ID NO: 396688 - DNA, 15 bp, Homo sapiens
gagttttcctgtggg

SEQ ID NO: 396689 - DNA, 15 bp, Homo sapiens
agttttcctgtgggt

SEQ ID NO: 396690 - DNA, 15 bp, Homo sapiens
gttttcctgtgggta

SEQ ID NO: 396691 - DNA, 15 bp, Homo sapiens
ttttcctgtgggtat

SEQ ID NO: 396692 - DNA, 15 bp, Homo sapiens
tttcctgtgggtatt

SEQ ID NO: 396693 - DNA, 15 bp, Homo sapiens
ttcctgtgggtattg

SEQ ID NO: 396694 - DNA, 15 bp, Homo sapiens
tcctgtgggtattga

SEQ ID NO: 396695 - DNA, 15 bp, Homo sapiens
cctgtgggtattgaa

SEQ ID NO: 396696 - DNA, 15 bp, Homo sapiens
ctgtgggtattgaaa

SEQ ID NO: 396697 - DNA, 15 bp, Homo sapiens
tgtgggtattgaaat

SEQ ID NO: 396698 - DNA, 15 bp, Homo sapiens
gtgggtattgaaatg

SEQ ID NO: 396699 - DNA, 15 bp, Homo sapiens
tgggtattgaaatgg

SEQ ID NO: 396700 - DNA, 15 bp, Homo sapiens
gggtattgaaatggt

SEQ ID NO: 396701 - DNA, 15 bp, Homo sapiens
ggtattgaaatggta

SEQ ID NO: 396702 - DNA, 15 bp, Homo sapiens
gtattgaaatggtaa

SEQ ID NO: 396703 - DNA, 15 bp, Homo sapiens
tattgaaatggtaac

SEQ ID NO: 396704 - DNA, 15 bp, Homo sapiens
attgaaatggtaaca

SEQ ID NO: 396705 - DNA, 15 bp, Homo sapiens
ttgaaatggtaacat

SEQ ID NO: 396706 - DNA, 15 bp, Homo sapiens
tgaaatggtaacatt

SEQ ID NO: 396707 - DNA, 15 bp, Homo sapiens
gaaatggtaacattt

SEQ ID NO: 396708 - DNA, 15 bp, Homo sapiens
aaatggtaacattta

SEQ ID NO: 396709 - DNA, 15 bp, Homo sapiens
aatggtaacatttaa

SEQ ID NO: 396710 - DNA, 15 bp, Homo sapiens
atggtaacatttaat

SEQ ID NO: 396711 - DNA, 15 bp, Homo sapiens
tggtaacatttaata

SEQ ID NO: 396712 - DNA, 15 bp, Homo sapiens
ggtaacatttaataa

SEQ ID NO: 396713 - DNA, 15 bp, Homo sapiens
gtaacatttaataac

SEQ ID NO: 396714 - DNA, 15 bp, Homo sapiens
taacatttaataacc

SEQ ID NO: 396715 - DNA, 15 bp, Homo sapiens
aacatttaataacct

SEQ ID NO: 396716 - DNA, 15 bp, Homo sapiens
acatttaataaccta

SEQ ID NO: 396717 - DNA, 15 bp, Homo sapiens
catttaataacctat

SEQ ID NO: 396718 - DNA, 15 bp, Homo sapiens
atttaataacctatg

SEQ ID NO: 396719 - DNA, 15 bp, Homo sapiens
tttaataacctatgg

SEQ ID NO: 396720 - DNA, 15 bp, Homo sapiens
ttaataacctatggt

SEQ ID NO: 396721 - DNA, 15 bp, Homo sapiens
taataacctatggtg

SEQ ID NO: 396722 - DNA, 15 bp, Homo sapiens
aataacctatggtga

SEQ ID NO: 396723 - DNA, 15 bp, Homo sapiens
ataacctatggtgac

SEQ ID NO: 396724 - DNA, 15 bp, Homo sapiens
taacctatggtgact

SEQ ID NO: 396725 - DNA, 15 bp, Homo sapiens
aacctatggtgactt

SEQ ID NO: 396726 - DNA, 15 bp, Homo sapiens
acctatggtgacttt

SEQ ID NO: 396727 - DNA, 15 bp, Homo sapiens
cctatggtgactttg

SEQ ID NO: 396728 - DNA, 15 bp, Homo sapiens
ctatggtgactttgg

SEQ ID NO: 396729 - DNA, 15 bp, Homo sapiens
tatggtgactttgga

SEQ ID NO: 396730 - DNA, 15 bp, Homo sapiens
atggtgactttggat

SEQ ID NO: 396731 - DNA, 15 bp, Homo sapiens
tggtgactttggata

SEQ ID NO: 396732 - DNA, 15 bp, Homo sapiens
ggtgactttggatat

SEQ ID NO: 396733 - DNA, 15 bp, Homo sapiens
gtgactttggatatt

SEQ ID NO: 396734 - DNA, 15 bp, Homo sapiens
tgactttggatattc

SEQ ID NO: 396735 - DNA, 15 bp, Homo sapiens
gactttggatattct

SEQ ID NO: 396736 - DNA, 15 bp, Homo sapiens
actttggatattctc

SEQ ID NO: 396737 - DNA, 15 bp, Homo sapiens
ctttggatattctca

SEQ ID NO: 396738 - DNA, 15 bp, Homo sapiens
tttggatattctcaa

SEQ ID NO: 396739 - DNA, 15 bp, Homo sapiens
ttggatattctcaag

SEQ ID NO: 396740 - DNA, 15 bp, Homo sapiens
tggatattctcaagt

SEQ ID NO: 396741 - DNA, 15 bp, Homo sapiens
ggatattctcaagtt

SEQ ID NO: 396742 - DNA, 15 bp, Homo sapiens
gatattctcaagttt

SEQ ID NO: 396743 - DNA, 15 bp, Homo sapiens
atattctcaagttta

SEQ ID NO: 396744 - DNA, 15 bp, Homo sapiens
tattctcaagtttag

SEQ ID NO: 396745 - DNA, 15 bp, Homo sapiens
attctcaagtttagc

SEQ ID NO: 396746 - DNA, 15 bp, Homo sapiens
ttctcaagtttagct

SEQ ID NO: 396747 - DNA, 15 bp, Homo sapiens
tctcaagtttagctt

SEQ ID NO: 396748 - DNA, 15 bp, Homo sapiens
ctcaagtttagcttc

SEQ ID NO: 396749 - DNA, 15 bp, Homo sapiens
tcaagtttagcttcc

SEQ ID NO: 396750 - DNA, 15 bp, Homo sapiens
caagtttagcttcct

SEQ ID NO: 396751 - DNA, 15 bp, Homo sapiens
aagtttagcttcctg

SEQ ID NO: 396752 - DNA, 15 bp, Homo sapiens
agtttagcttcctga

SEQ ID NO: 396753 - DNA, 15 bp, Homo sapiens
gtttagcttcctgat

SEQ ID NO: 396754 - DNA, 15 bp, Homo sapiens
tttagcttcctgatt

SEQ ID NO: 396755 - DNA, 15 bp, Homo sapiens
ttagcttcctgattt

SEQ ID NO: 396756 - DNA, 15 bp, Homo sapiens
tagcttcctgatttt

SEQ ID NO: 396757 - DNA, 15 bp, Homo sapiens
agcttcctgattttt

SEQ ID NO: 396758 - DNA, 15 bp, Homo sapiens
gcttcctgatttttt

SEQ ID NO: 396759 - DNA, 15 bp, Homo sapiens
cttcctgattttttc

SEQ ID NO: 396760 - DNA, 15 bp, Homo sapiens
ttcctgattttttca

SEQ ID NO: 396761 - DNA, 15 bp, Homo sapiens
tcctgattttttcaa

SEQ ID NO: 396762 - DNA, 15 bp, Homo sapiens
cctgattttttcaag

SEQ ID NO: 396763 - DNA, 15 bp, Homo sapiens
ctgattttttcaaga

SEQ ID NO: 396764 - DNA, 15 bp, Homo sapiens
tgattttttcaagat

SEQ ID NO: 396765 - DNA, 15 bp, Homo sapiens
gattttttcaagatc

SEQ ID NO: 396766 - DNA, 15 bp, Homo sapiens
attttttcaagatca

SEQ ID NO: 396767 - DNA, 15 bp, Homo sapiens
ttttttcaagatcag

SEQ ID NO: 396768 - DNA, 15 bp, Homo sapiens
tttttcaagatcagg

SEQ ID NO: 396769 - DNA, 15 bp, Homo sapiens
ttttcaagatcagga

SEQ ID NO: 396770 - DNA, 15 bp, Homo sapiens
tttcaagatcaggag

SEQ ID NO: 396771 - DNA, 15 bp, Homo sapiens
ttcaagatcaggaga

SEQ ID NO: 396772 - DNA, 15 bp, Homo sapiens
tcaagatcaggagac

SEQ ID NO: 396773 - DNA, 15 bp, Homo sapiens
caagatcaggagaca

SEQ ID NO: 396774 - DNA, 15 bp, Homo sapiens
aagatcaggagacag

SEQ ID NO: 396775 - DNA, 15 bp, Homo sapiens
agatcaggagacaga

SEQ ID NO: 396776 - DNA, 15 bp, Homo sapiens
gatcaggagacagaa

SEQ ID NO: 396777 - DNA, 15 bp, Homo sapiens
atcaggagacagaag

SEQ ID NO: 396778 - DNA, 15 bp, Homo sapiens
tcaggagacagaagc

SEQ ID NO: 396779 - DNA, 15 bp, Homo sapiens
caggagacagaagct

SEQ ID NO: 396780 - DNA, 15 bp, Homo sapiens
aggagacagaagctt

SEQ ID NO: 396781 - DNA, 15 bp, Homo sapiens
ggagacagaagctta

SEQ ID NO: 396782 - DNA, 15 bp, Homo sapiens
gagacagaagcttaa

SEQ ID NO: 396783 - DNA, 15 bp, Homo sapiens
agacagaagcttaaa

SEQ ID NO: 396784 - DNA, 15 bp, Homo sapiens
gacagaagcttaaaa

SEQ ID NO: 396785 - DNA, 15 bp, Homo sapiens
acagaagcttaaaag

SEQ ID NO: 396786 - DNA, 15 bp, Homo sapiens
cagaagcttaaaaga

SEQ ID NO: 396787 - DNA, 15 bp, Homo sapiens
agaagcttaaaagag

SEQ ID NO: 396788 - DNA, 15 bp, Homo sapiens
gaagcttaaaagagt

SEQ ID NO: 396789 - DNA, 15 bp, Homo sapiens
aagcttaaaagagtt

SEQ ID NO: 396790 - DNA, 15 bp, Homo sapiens
agcttaaaagagtta

SEQ ID NO: 396791 - DNA, 15 bp, Homo sapiens
gcttaaaagagttaa

SEQ ID NO: 396792 - DNA, 15 bp, Homo sapiens
cttaaaagagttaat

SEQ ID NO: 396793 - DNA, 15 bp, Homo sapiens
ttaaaagagttaatc

SEQ ID NO: 396794 - DNA, 15 bp, Homo sapiens
taaaagagttaatcc

SEQ ID NO: 396795 - DNA, 15 bp, Homo sapiens
aaaagagttaatcct

SEQ ID NO: 396796 - DNA, 15 bp, Homo sapiens
aaagagttaatccta

SEQ ID NO: 396797 - DNA, 15 bp, Homo sapiens
aagagttaatcctat

SEQ ID NO: 396798 - DNA, 15 bp, Homo sapiens
agagttaatcctata

SEQ ID NO: 396799 - DNA, 15 bp, Homo sapiens
gagttaatcctatag

SEQ ID NO: 396800 - DNA, 15 bp, Homo sapiens
agttaatcctatagg

SEQ ID NO: 396801 - DNA, 15 bp, Homo sapiens
gttaatcctatagga

SEQ ID NO: 396802 - DNA, 15 bp, Homo sapiens
tcctataggattaat

SEQ ID NO: 396803 - DNA, 15 bp, Homo sapiens
cctataggattaatt

SEQ ID NO: 396804 - DNA, 15 bp, Homo sapiens
ctataggattaatta

SEQ ID NO: 396805 - DNA, 15 bp, Homo sapiens
tataggattaattag

SEQ ID NO: 396806 - DNA, 15 bp, Homo sapiens
ataggattaattagt

SEQ ID NO: 396807 - DNA, 15 bp, Homo sapiens
taggattaattagta

SEQ ID NO: 396808 - DNA, 15 bp, Homo sapiens
aggattaattagtag

SEQ ID NO: 396809 - DNA, 15 bp, Homo sapiens
ggattaattagtagt

SEQ ID NO: 396810 - DNA, 15 bp, Homo sapiens
gattaattagtagtg

SEQ ID NO: 396811 - DNA, 15 bp, Homo sapiens
attaattagtagtgg

SEQ ID NO: 396812 - DNA, 15 bp, Homo sapiens
ttaattagtagtggc

SEQ ID NO: 396813 - DNA, 15 bp, Homo sapiens
taattagtagtggca

SEQ ID NO: 396814 - DNA, 15 bp, Homo sapiens
aattagtagtggcaa

SEQ ID NO: 396815 - DNA, 15 bp, Homo sapiens
attagtagtggcaat

SEQ ID NO: 396816 - DNA, 15 bp, Homo sapiens
ttagtagtggcaatg

SEQ ID NO: 396817 - DNA, 15 bp, Homo sapiens
tagtagtggcaatga

SEQ ID NO: 396818 - DNA, 15 bp, Homo sapiens
agtagtggcaatgac

SEQ ID NO: 396819 - DNA, 15 bp, Homo sapiens
gtagtggcaatgacc

SEQ ID NO: 396820 - DNA, 15 bp, Homo sapiens
tagtggcaatgacca

SEQ ID NO: 396821 - DNA, 15 bp, Homo sapiens
agtggcaatgaccaa

SEQ ID NO: 396822 - DNA, 15 bp, Homo sapiens
gtggcaatgaccaaa

SEQ ID NO: 396823 - DNA, 15 bp, Homo sapiens
tggcaatgaccaaac

SEQ ID NO: 396824 - DNA, 15 bp, Homo sapiens
ggcaatgaccaaact

SEQ ID NO: 396825 - DNA, 15 bp, Homo sapiens
gcaatgaccaaactg

SEQ ID NO: 396826 - DNA, 15 bp, Homo sapiens
caatgaccaaactgc

SEQ ID NO: 396827 - DNA, 15 bp, Homo sapiens
aatgaccaaactgcg

SEQ ID NO: 396828 - DNA, 15 bp, Homo sapiens
atgaccaaactgcga

SEQ ID NO: 396829 - DNA, 15 bp, Homo sapiens
tgaccaaactgcgat

SEQ ID NO: 396830 - DNA, 15 bp, Homo sapiens
gaccaaactgcgatg

SEQ ID NO: 396831 - DNA, 15 bp, Homo sapiens
accaaactgcgatga

SEQ ID NO: 396832 - DNA, 15 bp, Homo sapiens
ccaaactgcgatgat

SEQ ID NO: 396833 - DNA, 15 bp, Homo sapiens
caaactgcgatgata

SEQ ID NO: 396834 - DNA, 15 bp, Homo sapiens
aaactgcgatgatat

SEQ ID NO: 396835 - DNA, 15 bp, Homo sapiens
aactgcgatgatatg

SEQ ID NO: 396836 - DNA, 15 bp, Homo sapiens
actgcgatgatatgg

SEQ ID NO: 396837 - DNA, 15 bp, Homo sapiens
ctgcgatgatatgga

SEQ ID NO: 396838 - DNA, 15 bp, Homo sapiens
tgcgatgatatggat

SEQ ID NO: 396839 - DNA, 15 bp, Homo sapiens
gcgatgatatggata

SEQ ID NO: 396840 - DNA, 15 bp, Homo sapiens
cgatgatatggatat

SEQ ID NO: 396841 - DNA, 15 bp, Homo sapiens
gatgatatggatata

SEQ ID NO: 396842 - DNA, 15 bp, Homo sapiens
atgatatggatatat

SEQ ID NO: 396843 - DNA, 15 bp, Homo sapiens
tgatatggatatatt

SEQ ID NO: 396844 - DNA, 15 bp, Homo sapiens
gatatggatatattc

SEQ ID NO: 396845 - DNA, 15 bp, Homo sapiens
atatggatatattcc

SEQ ID NO: 396846 - DNA, 15 bp, Homo sapiens
tatggatatattcca

SEQ ID NO: 396847 - DNA, 15 bp, Homo sapiens
atggatatattccat

SEQ ID NO: 396848 - DNA, 15 bp, Homo sapiens
tggatatattccatt

SEQ ID NO: 396849 - DNA, 15 bp, Homo sapiens
ggatatattccattt

SEQ ID NO: 396850 - DNA, 15 bp, Homo sapiens
gatatattccatttt

SEQ ID NO: 396851 - DNA, 15 bp, Homo sapiens
atatattccattttt

SEQ ID NO: 396852 - DNA, 15 bp, Homo sapiens
tatattccatttttg

SEQ ID NO: 396853 - DNA, 15 bp, Homo sapiens
atattccatttttgg

SEQ ID NO: 396854 - DNA, 15 bp, Homo sapiens
tattccatttttggg

SEQ ID NO: 396855 - DNA, 15 bp, Homo sapiens
attccatttttgggt

SEQ ID NO: 396856 - DNA, 15 bp, Homo sapiens
ttccatttttgggtt

SEQ ID NO: 396857 - DNA, 15 bp, Homo sapiens
tccatttttgggttt

SEQ ID NO: 396858 - DNA, 15 bp, Homo sapiens
ccatttttgggtttc

SEQ ID NO: 396859 - DNA, 15 bp, Homo sapiens
catttttgggtttca

SEQ ID NO: 396860 - DNA, 15 bp, Homo sapiens
atttttgggtttcat

SEQ ID NO: 396861 - DNA, 15 bp, Homo sapiens
tttttgggtttcatg

SEQ ID NO: 396862 - DNA, 15 bp, Homo sapiens
ttttgggtttcatgg

SEQ ID NO: 396863 - DNA, 15 bp, Homo sapiens
tttgggtttcatggg

SEQ ID NO: 396864 - DNA, 15 bp, Homo sapiens
ttgggtttcatggga

SEQ ID NO: 396865 - DNA, 15 bp, Homo sapiens
tgggtttcatgggac

SEQ ID NO: 396866 - DNA, 15 bp, Homo sapiens
gggtttcatgggact

SEQ ID NO: 396867 - DNA, 15 bp, Homo sapiens
ggtttcatgggactg

SEQ ID NO: 396868 - DNA, 15 bp, Homo sapiens
gtttcatgggactgt

SEQ ID NO: 396869 - DNA, 15 bp, Homo sapiens
tttcatgggactgta

SEQ ID NO: 396870 - DNA, 15 bp, Homo sapiens
ttcatgggactgtac

SEQ ID NO: 396871 - DNA, 15 bp, Homo sapiens
tcatgggactgtact

SEQ ID NO: 396872 - DNA, 15 bp, Homo sapiens
catgggactgtacta

SEQ ID NO: 396873 - DNA, 15 bp, Homo sapiens
atgggactgtactac

SEQ ID NO: 396874 - DNA, 15 bp, Homo sapiens
tgggactgtactacc

SEQ ID NO: 396875 - DNA, 15 bp, Homo sapiens
gggactgtactacca

SEQ ID NO: 396876 - DNA, 15 bp, Homo sapiens
ggactgtactaccaa

SEQ ID NO: 396877 - DNA, 15 bp, Homo sapiens
gactgtactaccaaa

SEQ ID NO: 396878 - DNA, 15 bp, Homo sapiens
actgtactaccaaag

SEQ ID NO: 396879 - DNA, 15 bp, Homo sapiens
ctgtactaccaaagt

SEQ ID NO: 396880 - DNA, 15 bp, Homo sapiens
tgtactaccaaagtg

SEQ ID NO: 396881 - DNA, 15 bp, Homo sapiens
gtactaccaaagtgt

SEQ ID NO: 396882 - DNA, 15 bp, Homo sapiens
tactaccaaagtgta

SEQ ID NO: 396883 - DNA, 15 bp, Homo sapiens
actaccaaagtgtat

SEQ ID NO: 396884 - DNA, 15 bp, Homo sapiens
ctaccaaagtgtatt

SEQ ID NO: 396885 - DNA, 15 bp, Homo sapiens
taccaaagtgtattt

SEQ ID NO: 396886 - DNA, 15 bp, Homo sapiens
accaaagtgtatttt

SEQ ID NO: 396887 - DNA, 15 bp, Homo sapiens
ccaaagtgtatttta

SEQ ID NO: 396888 - DNA, 15 bp, Homo sapiens
caaagtgtattttat

SEQ ID NO: 396889 - DNA, 15 bp, Homo sapiens
aaagtgtattttata

SEQ ID NO: 396890 - DNA, 15 bp, Homo sapiens
aagtgtattttatat

SEQ ID NO: 396891 - DNA, 15 bp, Homo sapiens
agtgtattttatatg

SEQ ID NO: 396892 - DNA, 15 bp, Homo sapiens
gtgtattttatatgt

SEQ ID NO: 396893 - DNA, 15 bp, Homo sapiens
tgtattttatatgtt

SEQ ID NO: 396894 - DNA, 15 bp, Homo sapiens
gtattttatatgttt

SEQ ID NO: 396895 - DNA, 15 bp, Homo sapiens
tattttatatgtttc

SEQ ID NO: 396896 - DNA, 15 bp, Homo sapiens
attttatatgtttct

SEQ ID NO: 396897 - DNA, 15 bp, Homo sapiens
ttttatatgtttcta

SEQ ID NO: 396898 - DNA, 15 bp, Homo sapiens
tttatatgtttctaa

SEQ ID NO: 396899 - DNA, 15 bp, Homo sapiens
ttatatgtttctaat

SEQ ID NO: 396900 - DNA, 15 bp, Homo sapiens
tatatgtttctaatt

SEQ ID NO: 396901 - DNA, 15 bp, Homo sapiens
atatgtttctaattt

SEQ ID NO: 396902 - DNA, 15 bp, Homo sapiens
tatgtttctaatttg

SEQ ID NO: 396903 - DNA, 15 bp, Homo sapiens
atgtttctaatttgg

SEQ ID NO: 396904 - DNA, 15 bp, Homo sapiens
tgtttctaatttgga

SEQ ID NO: 396905 - DNA, 15 bp, Homo sapiens
gtttctaatttggac

SEQ ID NO: 396906 - DNA, 15 bp, Homo sapiens
tttctaatttggact

SEQ ID NO: 396907 - DNA, 15 bp, Homo sapiens
ttctaatttggacta

SEQ ID NO: 396908 - DNA, 15 bp, Homo sapiens
tctaatttggactat

SEQ ID NO: 396909 - DNA, 15 bp, Homo sapiens
ctaatttggactatt

SEQ ID NO: 396910 - DNA, 15 bp, Homo sapiens
taatttggactattg

SEQ ID NO: 396911 - DNA, 15 bp, Homo sapiens
aatttggactattga

SEQ ID NO: 396912 - DNA, 15 bp, Homo sapiens
atttggactattgac

SEQ ID NO: 396913 - DNA, 15 bp, Homo sapiens
tttggactattgaca

SEQ ID NO: 396914 - DNA, 15 bp, Homo sapiens
ttggactattgacat

SEQ ID NO: 396915 - DNA, 15 bp, Homo sapiens
tggactattgacatc

SEQ ID NO: 396916 - DNA, 15 bp, Homo sapiens
ggactattgacatca

SEQ ID NO: 396917 - DNA, 15 bp, Homo sapiens
gactattgacatcaa

SEQ ID NO: 396918 - DNA, 15 bp, Homo sapiens
actattgacatcaaa

SEQ ID NO: 396919 - DNA, 15 bp, Homo sapiens
ctattgacatcaaat

SEQ ID NO: 396920 - DNA, 15 bp, Homo sapiens
tattgacatcaaatg

SEQ ID NO: 396921 - DNA, 15 bp, Homo sapiens
attgacatcaaatga

SEQ ID NO: 396922 - DNA, 15 bp, Homo sapiens
ttgacatcaaatgaa

SEQ ID NO: 396923 - DNA, 15 bp, Homo sapiens
tgacatcaaatgaat

SEQ ID NO: 396924 - DNA, 15 bp, Homo sapiens
gacatcaaatgaatc

SEQ ID NO: 396925 - DNA, 15 bp, Homo sapiens
acatcaaatgaatca

SEQ ID NO: 396926 - DNA, 15 bp, Homo sapiens
catcaaatgaatcaa

SEQ ID NO: 396927 - DNA, 15 bp, Homo sapiens
atcaaatgaatcaaa

SEQ ID NO: 396928 - DNA, 15 bp, Homo sapiens
tcaaatgaatcaaat

SEQ ID NO: 396929 - DNA, 15 bp, Homo sapiens
caaatgaatcaaata

SEQ ID NO: 396930 - DNA, 15 bp, Homo sapiens
aaatgaatcaaatag

SEQ ID NO: 396931 - DNA, 15 bp, Homo sapiens
aatgaatcaaatagt

SEQ ID NO: 396932 - DNA, 15 bp, Homo sapiens
atgaatcaaatagtt

SEQ ID NO: 396933 - DNA, 15 bp, Homo sapiens
tgaatcaaatagttg

SEQ ID NO: 396934 - DNA, 15 bp, Homo sapiens
gaatcaaatagttgg

SEQ ID NO: 396935 - DNA, 15 bp, Homo sapiens
aatcaaatagttgga

SEQ ID NO: 396936 - DNA, 15 bp, Homo sapiens
atcaaatagttggag

SEQ ID NO: 396937 - DNA, 15 bp, Homo sapiens
tcaaatagttggagt

SEQ ID NO: 396938 - DNA, 15 bp, Homo sapiens
caaatagttggagta

SEQ ID NO: 396939 - DNA, 15 bp, Homo sapiens
aaatagttggagtaa

SEQ ID NO: 396940 - DNA, 15 bp, Homo sapiens
aatagttggagtaaa

SEQ ID NO: 396941 - DNA, 15 bp, Homo sapiens
atagttggagtaaat

SEQ ID NO: 396942 - DNA, 15 bp, Homo sapiens
tagttggagtaaatg

SEQ ID NO: 396943 - DNA, 15 bp, Homo sapiens
agttggagtaaatga

SEQ ID NO: 396944 - DNA, 15 bp, Homo sapiens
gttggagtaaatgat

SEQ ID NO: 396945 - DNA, 15 bp, Homo sapiens
ttggagtaaatgatt

SEQ ID NO: 396946 - DNA, 15 bp, Homo sapiens
tggagtaaatgattt

SEQ ID NO: 396947 - DNA, 15 bp, Homo sapiens
ggagtaaatgattta

SEQ ID NO: 396948 - DNA, 15 bp, Homo sapiens
gagtaaatgatttac

SEQ ID NO: 396949 - DNA, 15 bp, Homo sapiens
agtaaatgatttact

SEQ ID NO: 396950 - DNA, 15 bp, Homo sapiens
gtaaatgatttactt

SEQ ID NO: 396951 - DNA, 15 bp, Homo sapiens
taaatgatttacttg

SEQ ID NO: 396952 - DNA, 15 bp, Homo sapiens
aaatgatttacttga

SEQ ID NO: 396953 - DNA, 15 bp, Homo sapiens
aatgatttacttgaa

SEQ ID NO: 396954 - DNA, 15 bp, Homo sapiens
atgatttacttgaag

SEQ ID NO: 396955 - DNA, 15 bp, Homo sapiens
tgatttacttgaagg

SEQ ID NO: 396956 - DNA, 15 bp, Homo sapiens
gatttacttgaaggt

SEQ ID NO: 396957 - DNA, 15 bp, Homo sapiens
atttacttgaaggtg

SEQ ID NO: 396958 - DNA, 15 bp, Homo sapiens
tttacttgaaggtgg

SEQ ID NO: 396959 - DNA, 15 bp, Homo sapiens
ttacttgaaggtggt

SEQ ID NO: 396960 - DNA, 15 bp, Homo sapiens
tacttgaaggtggtt

SEQ ID NO: 396961 - DNA, 15 bp, Homo sapiens
acttgaaggtggttc

SEQ ID NO: 396962 - DNA, 15 bp, Homo sapiens
cttgaaggtggttcc

SEQ ID NO: 396963 - DNA, 15 bp, Homo sapiens
ttgaaggtggttcca

SEQ ID NO: 396964 - DNA, 15 bp, Homo sapiens
tgaaggtggttccaa

SEQ ID NO: 396965 - DNA, 15 bp, Homo sapiens
gaaggtggttccaaa

SEQ ID NO: 396966 - DNA, 15 bp, Homo sapiens
aaggtggttccaaaa

SEQ ID NO: 396967 - DNA, 15 bp, Homo sapiens
aggtggttccaaaaa

SEQ ID NO: 396968 - DNA, 15 bp, Homo sapiens
ggtggttccaaaaat

SEQ ID NO: 396969 - DNA, 15 bp, Homo sapiens
gtggttccaaaaatt

SEQ ID NO: 396970 - DNA, 15 bp, Homo sapiens
tggttccaaaaatta

SEQ ID NO: 396971 - DNA, 15 bp, Homo sapiens
ggttccaaaaattaa

SEQ ID NO: 396972 - DNA, 15 bp, Homo sapiens
gttccaaaaattaat

SEQ ID NO: 396973 - DNA, 15 bp, Homo sapiens
ttccaaaaattaatt

SEQ ID NO: 396974 - DNA, 15 bp, Homo sapiens
tccaaaaattaatta

SEQ ID NO: 396975 - DNA, 15 bp, Homo sapiens
ccaaaaattaattaa

SEQ ID NO: 396976 - DNA, 15 bp, Homo sapiens
caaaaattaattaat

SEQ ID NO: 396977 - DNA, 15 bp, Homo sapiens
aaaaattaattaatg

SEQ ID NO: 396978 - DNA, 15 bp, Homo sapiens
aaaattaattaatga

SEQ ID NO: 396979 - DNA, 15 bp, Homo sapiens
aaattaattaatgaa

SEQ ID NO: 396980 - DNA, 15 bp, Homo sapiens
aattaattaatgaaa

SEQ ID NO: 396981 - DNA, 15 bp, Homo sapiens
attaattaatgaaat

SEQ ID NO: 396982 - DNA, 15 bp, Homo sapiens
ttaattaatgaaatg

SEQ ID NO: 396983 - DNA, 15 bp, Homo sapiens
taattaatgaaatgt

SEQ ID NO: 396984 - DNA, 15 bp, Homo sapiens
aattaatgaaatgta

SEQ ID NO: 396985 - DNA, 15 bp, Homo sapiens
attaatgaaatgtat

SEQ ID NO: 396986 - DNA, 15 bp, Homo sapiens
ttaatgaaatgtatc

SEQ ID NO: 396987 - DNA, 15 bp, Homo sapiens
taatgaaatgtatct

SEQ ID NO: 396988 - DNA, 15 bp, Homo sapiens
aatgaaatgtatctc

SEQ ID NO: 396989 - DNA, 15 bp, Homo sapiens
atgaaatgtatctct

SEQ ID NO: 396990 - DNA, 15 bp, Homo sapiens
tgaaatgtatctctt

SEQ ID NO: 396991 - DNA, 15 bp, Homo sapiens
gaaatgtatctcttt

SEQ ID NO: 396992 - DNA, 15 bp, Homo sapiens
aaatgtatctcttta

SEQ ID NO: 396993 - DNA, 15 bp, Homo sapiens
aatgtatctctttag

SEQ ID NO: 396994 - DNA, 15 bp, Homo sapiens
atgtatctctttaga

SEQ ID NO: 396995 - DNA, 15 bp, Homo sapiens
tgtatctctttagat

SEQ ID NO: 396996 - DNA, 15 bp, Homo sapiens
gtatctctttagata

SEQ ID NO: 396997 - DNA, 15 bp, Homo sapiens
tatctctttagataa

SEQ ID NO: 396998 - DNA, 15 bp, Homo sapiens
atctctttagataaa

SEQ ID NO: 396999 - DNA, 15 bp, Homo sapiens
tctctttagataaaa

SEQ ID NO: 397000 - DNA, 15 bp, Homo sapiens
ctctttagataaaac

SEQ ID NO: 397001 - DNA, 15 bp, Homo sapiens
tctttagataaaaca

SEQ ID NO: 397002 - DNA, 15 bp, Homo sapiens
ctttagataaaacac

SEQ ID NO: 397003 - DNA, 15 bp, Homo sapiens
tttagataaaacaca

SEQ ID NO: 397004 - DNA, 15 bp, Homo sapiens
ttagataaaacacat

SEQ ID NO: 397005 - DNA, 15 bp, Homo sapiens
tagataaaacacata

SEQ ID NO: 397006 - DNA, 15 bp, Homo sapiens
agataaaacacatat

SEQ ID NO: 397007 - DNA, 15 bp, Homo sapiens
gataaaacacatatg

SEQ ID NO: 397008 - DNA, 15 bp, Homo sapiens
ataaaacacatatgg

SEQ ID NO: 397009 - DNA, 15 bp, Homo sapiens
taaaacacatatggt

SEQ ID NO: 397010 - DNA, 15 bp, Homo sapiens
aaaacacatatggta

SEQ ID NO: 397011 - DNA, 15 bp, Homo sapiens
aaacacatatggtaa

SEQ ID NO: 397012 - DNA, 15 bp, Homo sapiens
aacacatatggtaac

SEQ ID NO: 397013 - DNA, 15 bp, Homo sapiens
acacatatggtaaca

SEQ ID NO: 397014 - DNA, 15 bp, Homo sapiens
cacatatggtaacat

SEQ ID NO: 397015 - DNA, 15 bp, Homo sapiens
acatatggtaacatc

SEQ ID NO: 397016 - DNA, 15 bp, Homo sapiens
catatggtaacatct

SEQ ID NO: 397017 - DNA, 15 bp, Homo sapiens
atatggtaacatctt

SEQ ID NO: 397018 - DNA, 15 bp, Homo sapiens
tatggtaacatctta

SEQ ID NO: 397019 - DNA, 15 bp, Homo sapiens
atggtaacatcttaa

SEQ ID NO: 397020 - DNA, 15 bp, Homo sapiens
tggtaacatcttaac

SEQ ID NO: 397021 - DNA, 15 bp, Homo sapiens
ggtaacatcttaaca

SEQ ID NO: 397022 - DNA, 15 bp, Homo sapiens
gtaacatcttaacag

SEQ ID NO: 397023 - DNA, 15 bp, Homo sapiens
taacatcttaacagc

SEQ ID NO: 397024 - DNA, 15 bp, Homo sapiens
aacatcttaacagct

SEQ ID NO: 397025 - DNA, 15 bp, Homo sapiens
acatcttaacagctg

SEQ ID NO: 397026 - DNA, 15 bp, Homo sapiens
catcttaacagctgt

SEQ ID NO: 397027 - DNA, 15 bp, Homo sapiens
atcttaacagctgtt

SEQ ID NO: 397028 - DNA, 15 bp, Homo sapiens
tcttaacagctgttg

SEQ ID NO: 397029 - DNA, 15 bp, Homo sapiens
cttaacagctgttga

SEQ ID NO: 397030 - DNA, 15 bp, Homo sapiens
ttaacagctgttgag

SEQ ID NO: 397031 - DNA, 15 bp, Homo sapiens
taacagctgttgagt

SEQ ID NO: 397032 - DNA, 15 bp, Homo sapiens
aacagctgttgagtc

SEQ ID NO: 397033 - DNA, 15 bp, Homo sapiens
acagctgttgagtct

SEQ ID NO: 397034 - DNA, 15 bp, Homo sapiens
cagctgttgagtctg

SEQ ID NO: 397035 - DNA, 15 bp, Homo sapiens
agctgttgagtctgg

SEQ ID NO: 397036 - DNA, 15 bp, Homo sapiens
gctgttgagtctggt

SEQ ID NO: 397037 - DNA, 15 bp, Homo sapiens
ctgttgagtctggtt

SEQ ID NO: 397038 - DNA, 15 bp, Homo sapiens
tgttgagtctggttg

SEQ ID NO: 397039 - DNA, 15 bp, Homo sapiens
gttgagtctggttgt

SEQ ID NO: 397040 - DNA, 15 bp, Homo sapiens
ttgagtctggttgtc

SEQ ID NO: 397041 - DNA, 15 bp, Homo sapiens
tgagtctggttgtca

SEQ ID NO: 397042 - DNA, 15 bp, Homo sapiens
gagtctggttgtcag

SEQ ID NO: 397043 - DNA, 15 bp, Homo sapiens
agtctggttgtcagt

SEQ ID NO: 397044 - DNA, 15 bp, Homo sapiens
gtctggttgtcagta

SEQ ID NO: 397045 - DNA, 15 bp, Homo sapiens
tctggttgtcagtat

SEQ ID NO: 397046 - DNA, 15 bp, Homo sapiens
ctggttgtcagtata

SEQ ID NO: 397047 - DNA, 15 bp, Homo sapiens
tggttgtcagtatat

SEQ ID NO: 397048 - DNA, 15 bp, Homo sapiens
ggttgtcagtatatg

SEQ ID NO: 397049 - DNA, 15 bp, Homo sapiens
gttgtcagtatatgg

SEQ ID NO: 397050 - DNA, 15 bp, Homo sapiens
ttgtcagtatatggg

SEQ ID NO: 397051 - DNA, 15 bp, Homo sapiens
tgtcagtatatgggt

SEQ ID NO: 397052 - DNA, 15 bp, Homo sapiens
gtcagtatatgggta

SEQ ID NO: 397053 - DNA, 15 bp, Homo sapiens
tcagtatatgggtat

SEQ ID NO: 397054 - DNA, 15 bp, Homo sapiens
cagtatatgggtatt

SEQ ID NO: 397055 - DNA, 15 bp, Homo sapiens
agtatatgggtattt

SEQ ID NO: 397056 - DNA, 15 bp, Homo sapiens
gtatatgggtattta

SEQ ID NO: 397057 - DNA, 15 bp, Homo sapiens
tatatgggtatttat

SEQ ID NO: 397058 - DNA, 15 bp, Homo sapiens
atatgggtatttatt

SEQ ID NO: 397059 - DNA, 15 bp, Homo sapiens
tatgggtatttattt

SEQ ID NO: 397060 - DNA, 15 bp, Homo sapiens
atgggtatttatttt

SEQ ID NO: 397061 - DNA, 15 bp, Homo sapiens
tgggtatttatttta

SEQ ID NO: 397062 - DNA, 15 bp, Homo sapiens
gggtatttattttac

SEQ ID NO: 397063 - DNA, 15 bp, Homo sapiens
ggtatttattttact

SEQ ID NO: 397064 - DNA, 15 bp, Homo sapiens
gtatttattttactc

SEQ ID NO: 397065 - DNA, 15 bp, Homo sapiens
tatttattttactct

SEQ ID NO: 397066 - DNA, 15 bp, Homo sapiens
atttattttactctt

SEQ ID NO: 397067 - DNA, 15 bp, Homo sapiens
tttattttactcttt

SEQ ID NO: 397068 - DNA, 15 bp, Homo sapiens
ttattttactctttt

SEQ ID NO: 397069 - DNA, 15 bp, Homo sapiens
tattttactcttttt

SEQ ID NO: 397070 - DNA, 15 bp, Homo sapiens
attttactctttttt

SEQ ID NO: 397071 - DNA, 15 bp, Homo sapiens
ttttactcttttttc

SEQ ID NO: 397072 - DNA, 15 bp, Homo sapiens
tttactcttttttca

SEQ ID NO: 397073 - DNA, 15 bp, Homo sapiens
ttactcttttttcaa

SEQ ID NO: 397074 - DNA, 15 bp, Homo sapiens
tactcttttttcaat

SEQ ID NO: 397075 - DNA, 15 bp, Homo sapiens
actcttttttcaatt

SEQ ID NO: 397076 - DNA, 15 bp, Homo sapiens
ctcttttttcaatta

SEQ ID NO: 397077 - DNA, 15 bp, Homo sapiens
tcttttttcaattat

SEQ ID NO: 397078 - DNA, 15 bp, Homo sapiens
cttttttcaattatt

SEQ ID NO: 397079 - DNA, 15 bp, Homo sapiens
ttttttcaattattc

SEQ ID NO: 397080 - DNA, 15 bp, Homo sapiens
tttttcaattattct

SEQ ID NO: 397081 - DNA, 15 bp, Homo sapiens
ttcaattattctgta

SEQ ID NO: 397082 - DNA, 15 bp, Homo sapiens
tcaattattctgtat

SEQ ID NO: 397083 - DNA, 15 bp, Homo sapiens
caattattctgtatg

SEQ ID NO: 397084 - DNA, 15 bp, Homo sapiens
aattattctgtatgc

SEQ ID NO: 397085 - DNA, 15 bp, Homo sapiens
attattctgtatgct

SEQ ID NO: 397086 - DNA, 15 bp, Homo sapiens
ttattctgtatgctt

SEQ ID NO: 397087 - DNA, 15 bp, Homo sapiens
tattctgtatgcttg

SEQ ID NO: 397088 - DNA, 15 bp, Homo sapiens
attctgtatgcttga

SEQ ID NO: 397089 - DNA, 15 bp, Homo sapiens
ttctgtatgcttgaa

SEQ ID NO: 397090 - DNA, 15 bp, Homo sapiens
tctgtatgcttgaat

SEQ ID NO: 397091 - DNA, 15 bp, Homo sapiens
ctgtatgcttgaata

SEQ ID NO: 397092 - DNA, 15 bp, Homo sapiens
tgtatgcttgaatat

SEQ ID NO: 397093 - DNA, 15 bp, Homo sapiens
gtatgcttgaatatt

SEQ ID NO: 397094 - DNA, 15 bp, Homo sapiens
tatgcttgaatattt

SEQ ID NO: 397095 - DNA, 15 bp, Homo sapiens
atgcttgaatatttt

SEQ ID NO: 397096 - DNA, 15 bp, Homo sapiens
tgcttgaatattttt

SEQ ID NO: 397097 - DNA, 15 bp, Homo sapiens
gcttgaatattttta

SEQ ID NO: 397098 - DNA, 15 bp, Homo sapiens
cttgaatatttttat

SEQ ID NO: 397099 - DNA, 15 bp, Homo sapiens
ttgaatatttttatg

SEQ ID NO: 397100 - DNA, 15 bp, Homo sapiens
tgaatatttttatga

SEQ ID NO: 397101 - DNA, 15 bp, Homo sapiens
gaatatttttatgat

SEQ ID NO: 397102 - DNA, 15 bp, Homo sapiens
aatatttttatgata

SEQ ID NO: 397103 - DNA, 15 bp, Homo sapiens
atatttttatgataa

SEQ ID NO: 397104 - DNA, 15 bp, Homo sapiens
tatttttatgataaa

SEQ ID NO: 397105 - DNA, 15 bp, Homo sapiens
atttttatgataaaa

SEQ ID NO: 397106 - DNA, 15 bp, Homo sapiens
tttttatgataaaat

SEQ ID NO: 397107 - DNA, 15 bp, Homo sapiens
ttttatgataaaatg

SEQ ID NO: 397108 - DNA, 15 bp, Homo sapiens
tttatgataaaatgt

SEQ ID NO: 397109 - DNA, 15 bp, Homo sapiens
ttatgataaaatgtc

SEQ ID NO: 397110 - DNA, 15 bp, Homo sapiens
tatgataaaatgtct

SEQ ID NO: 397111 - DNA, 15 bp, Homo sapiens
atgataaaatgtctt

SEQ ID NO: 397112 - DNA, 15 bp, Homo sapiens
tgataaaatgtctta

SEQ ID NO: 397113 - DNA, 15 bp, Homo sapiens
gataaaatgtcttat

SEQ ID NO: 397114 - DNA, 15 bp, Homo sapiens
ataaaatgtcttata

SEQ ID NO: 397115 - DNA, 15 bp, Homo sapiens
taaaatgtcttatag

SEQ ID NO: 397116 - DNA, 15 bp, Homo sapiens
aaaatgtcttatagg

SEQ ID NO: 397117 - DNA, 15 bp, Homo sapiens
aaatgtcttataggt

SEQ ID NO: 397118 - DNA, 15 bp, Homo sapiens
aatgtcttataggta

SEQ ID NO: 397119 - DNA, 15 bp, Homo sapiens
atgtcttataggtaa

SEQ ID NO: 397120 - DNA, 15 bp, Homo sapiens
tgtcttataggtaac

SEQ ID NO: 397121 - DNA, 15 bp, Homo sapiens
gtcttataggtaaca

SEQ ID NO: 397122 - DNA, 15 bp, Homo sapiens
tcttataggtaacaa

SEQ ID NO: 397123 - DNA, 15 bp, Homo sapiens
cttataggtaacaac

SEQ ID NO: 397124 - DNA, 15 bp, Homo sapiens
ttataggtaacaaca

SEQ ID NO: 397125 - DNA, 15 bp, Homo sapiens
tataggtaacaacaa

SEQ ID NO: 397126 - DNA, 15 bp, Homo sapiens
ataggtaacaacaac

SEQ ID NO: 397127 - DNA, 15 bp, Homo sapiens
taggtaacaacaacc

SEQ ID NO: 397128 - DNA, 15 bp, Homo sapiens
aggtaacaacaaccc

SEQ ID NO: 397129 - DNA, 15 bp, Homo sapiens
ggtaacaacaaccct

SEQ ID NO: 397130 - DNA, 15 bp, Homo sapiens
gtaacaacaacccta

SEQ ID NO: 397131 - DNA, 15 bp, Homo sapiens
taacaacaaccctat

SEQ ID NO: 397132 - DNA, 15 bp, Homo sapiens
aacaacaaccctatt

SEQ ID NO: 397133 - DNA, 15 bp, Homo sapiens
acaacaaccctattc

SEQ ID NO: 397134 - DNA, 15 bp, Homo sapiens
caacaaccctattct

SEQ ID NO: 397135 - DNA, 15 bp, Homo sapiens
aacaaccctattcta

SEQ ID NO: 397136 - DNA, 15 bp, Homo sapiens
acaaccctattctaa

SEQ ID NO: 397137 - DNA, 15 bp, Homo sapiens
caaccctattctaat

SEQ ID NO: 397138 - DNA, 15 bp, Homo sapiens
aaccctattctaata

SEQ ID NO: 397139 - DNA, 15 bp, Homo sapiens
accctattctaataa

SEQ ID NO: 397140 - DNA, 15 bp, Homo sapiens
ccctattctaataaa

SEQ ID NO: 397141 - DNA, 15 bp, Homo sapiens
cctattctaataaaa

SEQ ID NO: 397142 - DNA, 15 bp, Homo sapiens
ctattctaataaaag

SEQ ID NO: 397143 - DNA, 15 bp, Homo sapiens
tattctaataaaagc

SEQ ID NO: 397144 - DNA, 15 bp, Homo sapiens
attctaataaaagct

SEQ ID NO: 397145 - DNA, 15 bp, Homo sapiens
ttctaataaaagctt

SEQ ID NO: 397146 - DNA, 15 bp, Homo sapiens
tctaataaaagcttg

SEQ ID NO: 397147 - DNA, 15 bp, Homo sapiens
ctaataaaagcttgt

SEQ ID NO: 397148 - DNA, 15 bp, Homo sapiens
taataaaagcttgtc

SEQ ID NO: 397149 - DNA, 15 bp, Homo sapiens
aataaaagcttgtca

SEQ ID NO: 397150 - DNA, 15 bp, Homo sapiens
ataaaagcttgtcag

SEQ ID NO: 397151 - DNA, 15 bp, Homo sapiens
taaaagcttgtcaga

SEQ ID NO: 397152 - DNA, 15 bp, Homo sapiens
aaaagcttgtcagat

SEQ ID NO: 397153 - DNA, 15 bp, Homo sapiens
aaagcttgtcagatt

SEQ ID NO: 397154 - DNA, 15 bp, Homo sapiens
aagcttgtcagatta

SEQ ID NO: 397155 - DNA, 15 bp, Homo sapiens
agcttgtcagattac

SEQ ID NO: 397156 - DNA, 15 bp, Homo sapiens
gcttgtcagattact

SEQ ID NO: 397157 - DNA, 15 bp, Homo sapiens
cttgtcagattactt

SEQ ID NO: 397158 - DNA, 15 bp, Homo sapiens
ttgtcagattacttg

SEQ ID NO: 397159 - DNA, 15 bp, Homo sapiens
tgtcagattacttga

SEQ ID NO: 397160 - DNA, 15 bp, Homo sapiens
gtcagattacttgag

SEQ ID NO: 397161 - DNA, 15 bp, Homo sapiens
tcagattacttgagc

SEQ ID NO: 397162 - DNA, 15 bp, Homo sapiens
cagattacttgagcc

SEQ ID NO: 397163 - DNA, 15 bp, Homo sapiens
agattacttgagccc

SEQ ID NO: 397164 - DNA, 15 bp, Homo sapiens
gattacttgagccct

SEQ ID NO: 397165 - DNA, 15 bp, Homo sapiens
attacttgagccctt

SEQ ID NO: 397166 - DNA, 15 bp, Homo sapiens
ttacttgagcccttg

SEQ ID NO: 397167 - DNA, 15 bp, Homo sapiens
tacttgagcccttgc

SEQ ID NO: 397168 - DNA, 15 bp, Homo sapiens
acttgagcccttgca

SEQ ID NO: 397169 - DNA, 15 bp, Homo sapiens
cttgagcccttgcat

SEQ ID NO: 397170 - DNA, 15 bp, Homo sapiens
ttgagcccttgcata

SEQ ID NO: 397171 - DNA, 15 bp, Homo sapiens
tgagcccttgcatac

SEQ ID NO: 397172 - DNA, 15 bp, Homo sapiens
gagcccttgcatact

SEQ ID NO: 397173 - DNA, 15 bp, Homo sapiens
agcccttgcatactt

SEQ ID NO: 397174 - DNA, 15 bp, Homo sapiens
gcccttgcatacttt

SEQ ID NO: 397175 - DNA, 15 bp, Homo sapiens
cccttgcatacttta

SEQ ID NO: 397176 - DNA, 15 bp, Homo sapiens
ccttgcatactttac

SEQ ID NO: 397177 - DNA, 15 bp, Homo sapiens
cttgcatactttact

SEQ ID NO: 397178 - DNA, 15 bp, Homo sapiens
ttgcatactttactg

SEQ ID NO: 397179 - DNA, 15 bp, Homo sapiens
tgcatactttactgt

SEQ ID NO: 397180 - DNA, 15 bp, Homo sapiens
gcatactttactgtt

SEQ ID NO: 397181 - DNA, 15 bp, Homo sapiens
catactttactgttg

SEQ ID NO: 397182 - DNA, 15 bp, Homo sapiens
atactttactgttga

SEQ ID NO: 397183 - DNA, 15 bp, Homo sapiens
tactttactgttgag

SEQ ID NO: 397184 - DNA, 15 bp, Homo sapiens
actttactgttgagc

SEQ ID NO: 397185 - DNA, 15 bp, Homo sapiens
ctttactgttgagca

SEQ ID NO: 397186 - DNA, 15 bp, Homo sapiens
tttactgttgagcat

SEQ ID NO: 397187 - DNA, 15 bp, Homo sapiens
ttactgttgagcatc

SEQ ID NO: 397188 - DNA, 15 bp, Homo sapiens
tactgttgagcatca

SEQ ID NO: 397189 - DNA, 15 bp, Homo sapiens
actgttgagcatcat

SEQ ID NO: 397190 - DNA, 15 bp, Homo sapiens
ctgttgagcatcata

SEQ ID NO: 397191 - DNA, 15 bp, Homo sapiens
tgttgagcatcataa

SEQ ID NO: 397192 - DNA, 15 bp, Homo sapiens
gttgagcatcataaa

SEQ ID NO: 397193 - DNA, 15 bp, Homo sapiens
ttgagcatcataaaa

SEQ ID NO: 397194 - DNA, 15 bp, Homo sapiens
tgagcatcataaaag

SEQ ID NO: 397195 - DNA, 15 bp, Homo sapiens
gagcatcataaaaga

SEQ ID NO: 397196 - DNA, 15 bp, Homo sapiens
agcatcataaaagaa

SEQ ID NO: 397197 - DNA, 15 bp, Homo sapiens
gcatcataaaagaac

SEQ ID NO: 397198 - DNA, 15 bp, Homo sapiens
catcataaaagaact

SEQ ID NO: 397199 - DNA, 15 bp, Homo sapiens
atcataaaagaactt

SEQ ID NO: 397200 - DNA, 15 bp, Homo sapiens
tcataaaagaacttg

SEQ ID NO: 397201 - DNA, 15 bp, Homo sapiens
cataaaagaacttga

SEQ ID NO: 397202 - DNA, 15 bp, Homo sapiens
ataaaagaacttgaa

SEQ ID NO: 397203 - DNA, 15 bp, Homo sapiens
taaaagaacttgaaa

SEQ ID NO: 397204 - DNA, 15 bp, Homo sapiens
aaaagaacttgaaat

SEQ ID NO: 397205 - DNA, 15 bp, Homo sapiens
aaagaacttgaaatg

SEQ ID NO: 397206 - DNA, 15 bp, Homo sapiens
aagaacttgaaatgc

SEQ ID NO: 397207 - DNA, 15 bp, Homo sapiens
agaacttgaaatgct

SEQ ID NO: 397208 - DNA, 15 bp, Homo sapiens
gaacttgaaatgctt

SEQ ID NO: 397209 - DNA, 15 bp, Homo sapiens
aacttgaaatgcttt

SEQ ID NO: 397210 - DNA, 15 bp, Homo sapiens
acttgaaatgctttt

SEQ ID NO: 397211 - DNA, 15 bp, Homo sapiens
cttgaaatgcttttg

SEQ ID NO: 397212 - DNA, 15 bp, Homo sapiens
ttgaaatgcttttgt

SEQ ID NO: 397213 - DNA, 15 bp, Homo sapiens
gaaatgcttttgttt

SEQ ID NO: 397214 - DNA, 15 bp, Homo sapiens
aaatgcttttgtttt

SEQ ID NO: 397215 - DNA, 15 bp, Homo sapiens
aatgcttttgttttt

SEQ ID NO: 397216 - DNA, 15 bp, Homo sapiens
atgcttttgtttttg

SEQ ID NO: 397217 - DNA, 15 bp, Homo sapiens
tgcttttgtttttgg

SEQ ID NO: 397218 - DNA, 15 bp, Homo sapiens
gcttttgtttttgga

SEQ ID NO: 397219 - DNA, 15 bp, Homo sapiens
cttttgtttttggat

SEQ ID NO: 397220 - DNA, 15 bp, Homo sapiens
ttttgtttttggatt

SEQ ID NO: 397221 - DNA, 15 bp, Homo sapiens
tttgtttttggattc

SEQ ID NO: 397222 - DNA, 15 bp, Homo sapiens
ttgtttttggattct

SEQ ID NO: 397223 - DNA, 15 bp, Homo sapiens
tgtttttggattctt

SEQ ID NO: 397224 - DNA, 15 bp, Homo sapiens
gtttttggattcttc

SEQ ID NO: 397225 - DNA, 15 bp, Homo sapiens
tttttggattcttca

SEQ ID NO: 397226 - DNA, 15 bp, Homo sapiens
ttttggattcttcat

SEQ ID NO: 397227 - DNA, 15 bp, Homo sapiens
tttggattcttcatg

SEQ ID NO: 397228 - DNA, 15 bp, Homo sapiens
ttggattcttcatgt

SEQ ID NO: 397229 - DNA, 15 bp, Homo sapiens
tggattcttcatgtt

SEQ ID NO: 397230 - DNA, 15 bp, Homo sapiens
ggattcttcatgttt

SEQ ID NO: 397231 - DNA, 15 bp, Homo sapiens
gattcttcatgtttc

SEQ ID NO: 397232 - DNA, 15 bp, Homo sapiens
attcttcatgtttca

SEQ ID NO: 397233 - DNA, 15 bp, Homo sapiens
ttcttcatgtttcaa

SEQ ID NO: 397234 - DNA, 15 bp, Homo sapiens
tcttcatgtttcaac

SEQ ID NO: 397235 - DNA, 15 bp, Homo sapiens
cttcatgtttcaact

SEQ ID NO: 397236 - DNA, 15 bp, Homo sapiens
ttcatgtttcaactt

SEQ ID NO: 397237 - DNA, 15 bp, Homo sapiens
tcatgtttcaacttc

SEQ ID NO: 397238 - DNA, 15 bp, Homo sapiens
catgtttcaacttca

SEQ ID NO: 397239 - DNA, 15 bp, Homo sapiens
atgtttcaacttcag

SEQ ID NO: 397240 - DNA, 15 bp, Homo sapiens
tgtttcaacttcaga

SEQ ID NO: 397241 - DNA, 15 bp, Homo sapiens
gtttcaacttcagat

SEQ ID NO: 397242 - DNA, 15 bp, Homo sapiens
tttcaacttcagatg

SEQ ID NO: 397243 - DNA, 15 bp, Homo sapiens
ttcaacttcagatgg

SEQ ID NO: 397244 - DNA, 15 bp, Homo sapiens
tcaacttcagatggt

SEQ ID NO: 397245 - DNA, 15 bp, Homo sapiens
caacttcagatggtg

SEQ ID NO: 397246 - DNA, 15 bp, Homo sapiens
aacttcagatggtga

SEQ ID NO: 397247 - DNA, 15 bp, Homo sapiens
acttcagatggtgac

SEQ ID NO: 397248 - DNA, 15 bp, Homo sapiens
cttcagatggtgaca

SEQ ID NO: 397249 - DNA, 15 bp, Homo sapiens
ttcagatggtgacaa

SEQ ID NO: 397250 - DNA, 15 bp, Homo sapiens
tcagatggtgacaag

SEQ ID NO: 397251 - DNA, 15 bp, Homo sapiens
cagatggtgacaagt

SEQ ID NO: 397252 - DNA, 15 bp, Homo sapiens
agatggtgacaagtg

SEQ ID NO: 397253 - DNA, 15 bp, Homo sapiens
gatggtgacaagtgc

SEQ ID NO: 397254 - DNA, 15 bp, Homo sapiens
atggtgacaagtgca

SEQ ID NO: 397255 - DNA, 15 bp, Homo sapiens
tggtgacaagtgcaa

SEQ ID NO: 397256 - DNA, 15 bp, Homo sapiens
ggtgacaagtgcaaa

SEQ ID NO: 397257 - DNA, 15 bp, Homo sapiens
gtgacaagtgcaaaa

SEQ ID NO: 397258 - DNA, 15 bp, Homo sapiens
tgacaagtgcaaaat

SEQ ID NO: 397259 - DNA, 15 bp, Homo sapiens
gacaagtgcaaaatg

SEQ ID NO: 397260 - DNA, 15 bp, Homo sapiens
acaagtgcaaaatgg

SEQ ID NO: 397261 - DNA, 15 bp, Homo sapiens
caagtgcaaaatggc

SEQ ID NO: 397262 - DNA, 15 bp, Homo sapiens
aagtgcaaaatggct

SEQ ID NO: 397263 - DNA, 15 bp, Homo sapiens
agtgcaaaatggctt

SEQ ID NO: 397264 - DNA, 15 bp, Homo sapiens
gtgcaaaatggctta

SEQ ID NO: 397265 - DNA, 15 bp, Homo sapiens
tgcaaaatggcttaa

SEQ ID NO: 397266 - DNA, 15 bp, Homo sapiens
gcaaaatggcttaaa

SEQ ID NO: 397267 - DNA, 15 bp, Homo sapiens
caaaatggcttaaaa

SEQ ID NO: 397268 - DNA, 15 bp, Homo sapiens
aaaatggcttaaaag

SEQ ID NO: 397269 - DNA, 15 bp, Homo sapiens
aaatggcttaaaagt

SEQ ID NO: 397270 - DNA, 15 bp, Homo sapiens
aatggcttaaaagtg

SEQ ID NO: 397271 - DNA, 15 bp, Homo sapiens
atggcttaaaagtgc

SEQ ID NO: 397272 - DNA, 15 bp, Homo sapiens
tggcttaaaagtgcc

SEQ ID NO: 397273 - DNA, 15 bp, Homo sapiens
ggcttaaaagtgcct

SEQ ID NO: 397274 - DNA, 15 bp, Homo sapiens
gcttaaaagtgcctt

SEQ ID NO: 397275 - DNA, 15 bp, Homo sapiens
cttaaaagtgccttg

SEQ ID NO: 397276 - DNA, 15 bp, Homo sapiens
ttaaaagtgccttgg

SEQ ID NO: 397277 - DNA, 15 bp, Homo sapiens
taaaagtgccttggc

SEQ ID NO: 397278 - DNA, 15 bp, Homo sapiens
aaaagtgccttggct

SEQ ID NO: 397279 - DNA, 15 bp, Homo sapiens
aaagtgccttggcta

SEQ ID NO: 397280 - DNA, 15 bp, Homo sapiens
aagtgccttggctag

SEQ ID NO: 397281 - DNA, 15 bp, Homo sapiens
agtgccttggctagg

SEQ ID NO: 397282 - DNA, 15 bp, Homo sapiens
gtgccttggctaggc

SEQ ID NO: 397283 - DNA, 15 bp, Homo sapiens
tgccttggctaggca

SEQ ID NO: 397284 - DNA, 15 bp, Homo sapiens
gccttggctaggcac

SEQ ID NO: 397285 - DNA, 15 bp, Homo sapiens
ccttggctaggcaca

SEQ ID NO: 397286 - DNA, 15 bp, Homo sapiens
cttggctaggcacag

SEQ ID NO: 397287 - DNA, 15 bp, Homo sapiens
gcacagtggctcaca

SEQ ID NO: 397288 - DNA, 15 bp, Homo sapiens
cacagtggctcacac

SEQ ID NO: 397289 - DNA, 15 bp, Homo sapiens
acagtggctcacacc

SEQ ID NO: 397290 - DNA, 15 bp, Homo sapiens
aaggtggacagatca

SEQ ID NO: 397291 - DNA, 15 bp, Homo sapiens
aggtggacagatcat

SEQ ID NO: 397292 - DNA, 15 bp, Homo sapiens
ggtggacagatcatg

SEQ ID NO: 397293 - DNA, 15 bp, Homo sapiens
gtggacagatcatga

SEQ ID NO: 397294 - DNA, 15 bp, Homo sapiens
tggacagatcatgag

SEQ ID NO: 397295 - DNA, 15 bp, Homo sapiens
ggacagatcatgagg

SEQ ID NO: 397296 - DNA, 15 bp, Homo sapiens
gacagatcatgaggt

SEQ ID NO: 397297 - DNA, 15 bp, Homo sapiens
acagatcatgaggtc

SEQ ID NO: 397298 - DNA, 15 bp, Homo sapiens
cagatcatgaggtca

SEQ ID NO: 397299 - DNA, 15 bp, Homo sapiens
agatcatgaggtcag

SEQ ID NO: 397300 - DNA, 15 bp, Homo sapiens
caggagattgagact

SEQ ID NO: 397301 - DNA, 15 bp, Homo sapiens
aggagattgagacta

SEQ ID NO: 397302 - DNA, 15 bp, Homo sapiens
ggagattgagactat

SEQ ID NO: 397303 - DNA, 15 bp, Homo sapiens
gagattgagactatc

SEQ ID NO: 397304 - DNA, 15 bp, Homo sapiens
agattgagactatcc

SEQ ID NO: 397305 - DNA, 15 bp, Homo sapiens
gattgagactatcct

SEQ ID NO: 397306 - DNA, 15 bp, Homo sapiens
attgagactatcctg

SEQ ID NO: 397307 - DNA, 15 bp, Homo sapiens
ttgagactatcctgg

SEQ ID NO: 397308 - DNA, 15 bp, Homo sapiens
tgagactatcctggc

SEQ ID NO: 397309 - DNA, 15 bp, Homo sapiens
gagactatcctggct

SEQ ID NO: 397310 - DNA, 15 bp, Homo sapiens
agactatcctggcta

SEQ ID NO: 397311 - DNA, 15 bp, Homo sapiens
gactatcctggctaa

SEQ ID NO: 397312 - DNA, 15 bp, Homo sapiens
actatcctggctaac

SEQ ID NO: 397313 - DNA, 15 bp, Homo sapiens
ctatcctggctaaca

SEQ ID NO: 397314 - DNA, 15 bp, Homo sapiens
tatcctggctaacat

SEQ ID NO: 397315 - DNA, 15 bp, Homo sapiens
acatggtgaaacctt

SEQ ID NO: 397316 - DNA, 15 bp, Homo sapiens
catggtgaaaccttg

SEQ ID NO: 397317 - DNA, 15 bp, Homo sapiens
atggtgaaaccttgt

SEQ ID NO: 397318 - DNA, 15 bp, Homo sapiens
tggtgaaaccttgtc

SEQ ID NO: 397319 - DNA, 15 bp, Homo sapiens
ggtgaaaccttgtct

SEQ ID NO: 397320 - DNA, 15 bp, Homo sapiens
gtgaaaccttgtctc

SEQ ID NO: 397321 - DNA, 15 bp, Homo sapiens
accttgtctctactg

SEQ ID NO: 397322 - DNA, 15 bp, Homo sapiens
ccttgtctctactga

SEQ ID NO: 397323 - DNA, 15 bp, Homo sapiens
cttgtctctactgaa

SEQ ID NO: 397324 - DNA, 15 bp, Homo sapiens
ttgtctctactgaaa

SEQ ID NO: 397325 - DNA, 15 bp, Homo sapiens
tgtctctactgaaag

SEQ ID NO: 397326 - DNA, 15 bp, Homo sapiens
gtctctactgaaagt

SEQ ID NO: 397327 - DNA, 15 bp, Homo sapiens
tctctactgaaagtg

SEQ ID NO: 397328 - DNA, 15 bp, Homo sapiens
ctctactgaaagtgc

SEQ ID NO: 397329 - DNA, 15 bp, Homo sapiens
tctactgaaagtgca

SEQ ID NO: 397330 - DNA, 15 bp, Homo sapiens
ctactgaaagtgcaa

SEQ ID NO: 397331 - DNA, 15 bp, Homo sapiens
tactgaaagtgcaaa

SEQ ID NO: 397332 - DNA, 15 bp, Homo sapiens
actgaaagtgcaaaa

SEQ ID NO: 397333 - DNA, 15 bp, Homo sapiens
ctgaaagtgcaaaaa

SEQ ID NO: 397334 - DNA, 15 bp, Homo sapiens
tgaaagtgcaaaaaa

SEQ ID NO: 397335 - DNA, 15 bp, Homo sapiens
gaaagtgcaaaaaat

SEQ ID NO: 397336 - DNA, 15 bp, Homo sapiens
aaagtgcaaaaaatt

SEQ ID NO: 397337 - DNA, 15 bp, Homo sapiens
aagtgcaaaaaatta

SEQ ID NO: 397338 - DNA, 15 bp, Homo sapiens
agtgcaaaaaattag

SEQ ID NO: 397339 - DNA, 15 bp, Homo sapiens
gtgcaaaaaattagc

SEQ ID NO: 397340 - DNA, 15 bp, Homo sapiens
gcaaaaaattagccg

SEQ ID NO: 397341 - DNA, 15 bp, Homo sapiens
aaaaaattagccgga

SEQ ID NO: 397342 - DNA, 15 bp, Homo sapiens
aaaaattagccggat

SEQ ID NO: 397343 - DNA, 15 bp, Homo sapiens
aaaattagccggatg

SEQ ID NO: 397344 - DNA, 15 bp, Homo sapiens
aaattagccggatgt

SEQ ID NO: 397345 - DNA, 15 bp, Homo sapiens
aattagccggatgtg

SEQ ID NO: 397346 - DNA, 15 bp, Homo sapiens
attagccggatgtgg

SEQ ID NO: 397347 - DNA, 15 bp, Homo sapiens
ttagccggatgtggt

SEQ ID NO: 397348 - DNA, 15 bp, Homo sapiens
tagccggatgtggtg

SEQ ID NO: 397349 - DNA, 15 bp, Homo sapiens
agccggatgtggtgg

SEQ ID NO: 397350 - DNA, 15 bp, Homo sapiens
gccggatgtggtggc

SEQ ID NO: 397351 - DNA, 15 bp, Homo sapiens
ccggatgtggtggca

SEQ ID NO: 397352 - DNA, 15 bp, Homo sapiens
cggatgtggtggcac

SEQ ID NO: 397353 - DNA, 15 bp, Homo sapiens
ggatgtggtggcaca

SEQ ID NO: 397354 - DNA, 15 bp, Homo sapiens
gatgtggtggcacat

SEQ ID NO: 397355 - DNA, 15 bp, Homo sapiens
atgtggtggcacatg

SEQ ID NO: 397356 - DNA, 15 bp, Homo sapiens
tgtggtggcacatgc

SEQ ID NO: 397357 - DNA, 15 bp, Homo sapiens
gtggtggcacatgcc

SEQ ID NO: 397358 - DNA, 15 bp, Homo sapiens
ggcacatgcctgtag

SEQ ID NO: 397359 - DNA, 15 bp, Homo sapiens
gcacatgcctgtagt

SEQ ID NO: 397360 - DNA, 15 bp, Homo sapiens
cacatgcctgtagtc

SEQ ID NO: 397361 - DNA, 15 bp, Homo sapiens
acatgcctgtagtcc

SEQ ID NO: 397362 - DNA, 15 bp, Homo sapiens
tcccagctactgggg

SEQ ID NO: 397363 - DNA, 15 bp, Homo sapiens
cccagctactgggga

SEQ ID NO: 397364 - DNA, 15 bp, Homo sapiens
ccagctactggggag

SEQ ID NO: 397365 - DNA, 15 bp, Homo sapiens
gaacctgggaggcga

SEQ ID NO: 397366 - DNA, 15 bp, Homo sapiens
aacctgggaggcgaa

SEQ ID NO: 397367 - DNA, 15 bp, Homo sapiens
acctgggaggcgaag

SEQ ID NO: 397368 - DNA, 15 bp, Homo sapiens
cctgggaggcgaagg

SEQ ID NO: 397369 - DNA, 15 bp, Homo sapiens
ctgggaggcgaaggt

SEQ ID NO: 397370 - DNA, 15 bp, Homo sapiens
tgggaggcgaaggtt

SEQ ID NO: 397371 - DNA, 15 bp, Homo sapiens
gggaggcgaaggttg

SEQ ID NO: 397372 - DNA, 15 bp, Homo sapiens
ggaggcgaaggttgc

SEQ ID NO: 397373 - DNA, 15 bp, Homo sapiens
gaggcgaaggttgca

SEQ ID NO: 397374 - DNA, 15 bp, Homo sapiens
aggcgaaggttgcag

SEQ ID NO: 397375 - DNA, 15 bp, Homo sapiens
ggcgaaggttgcagt

SEQ ID NO: 397376 - DNA, 15 bp, Homo sapiens
gcgaaggttgcagtg

SEQ ID NO: 397377 - DNA, 15 bp, Homo sapiens
cgaaggttgcagtga

SEQ ID NO: 397378 - DNA, 15 bp, Homo sapiens
gaaggttgcagtgaa

SEQ ID NO: 397379 - DNA, 15 bp, Homo sapiens
aaggttgcagtgaac

SEQ ID NO: 397380 - DNA, 15 bp, Homo sapiens
aggttgcagtgaacc

SEQ ID NO: 397381 - DNA, 15 bp, Homo sapiens
ggttgcagtgaaccg

SEQ ID NO: 397382 - DNA, 15 bp, Homo sapiens
gttgcagtgaaccga

SEQ ID NO: 397383 - DNA, 15 bp, Homo sapiens
ttgcagtgaaccgag

SEQ ID NO: 397384 - DNA, 15 bp, Homo sapiens
tgcagtgaaccgaga

SEQ ID NO: 397385 - DNA, 15 bp, Homo sapiens
gcagtgaaccgagat

SEQ ID NO: 397386 - DNA, 15 bp, Homo sapiens
cagtgaaccgagatt

SEQ ID NO: 397387 - DNA, 15 bp, Homo sapiens
agtgaaccgagattg

SEQ ID NO: 397388 - DNA, 15 bp, Homo sapiens
gtgaaccgagattgt

SEQ ID NO: 397389 - DNA, 15 bp, Homo sapiens
tgaaccgagattgta

SEQ ID NO: 397390 - DNA, 15 bp, Homo sapiens
gaaccgagattgtac

SEQ ID NO: 397391 - DNA, 15 bp, Homo sapiens
aaccgagattgtacc

SEQ ID NO: 397392 - DNA, 15 bp, Homo sapiens
accgagattgtacca

SEQ ID NO: 397393 - DNA, 15 bp, Homo sapiens
ccgagattgtaccac

SEQ ID NO: 397394 - DNA, 15 bp, Homo sapiens
cgagattgtaccact

SEQ ID NO: 397395 - DNA, 15 bp, Homo sapiens
gagattgtaccactg

SEQ ID NO: 397396 - DNA, 15 bp, Homo sapiens
agattgtaccactgc

SEQ ID NO: 397397 - DNA, 15 bp, Homo sapiens
gattgtaccactgca

SEQ ID NO: 397398 - DNA, 15 bp, Homo sapiens
attgtaccactgcac

SEQ ID NO: 397399 - DNA, 15 bp, Homo sapiens
ttgtaccactgcact

SEQ ID NO: 397400 - DNA, 15 bp, Homo sapiens
tgtaccactgcactc

SEQ ID NO: 397401 - DNA, 15 bp, Homo sapiens
aacagagtgagactg

SEQ ID NO: 397402 - DNA, 15 bp, Homo sapiens
acagagtgagactgt

SEQ ID NO: 397403 - DNA, 15 bp, Homo sapiens
cagagtgagactgtc

SEQ ID NO: 397404 - DNA, 15 bp, Homo sapiens
agagtgagactgtct

SEQ ID NO: 397405 - DNA, 15 bp, Homo sapiens
gagtgagactgtctc

SEQ ID NO: 397406 - DNA, 15 bp, Homo sapiens
agtgagactgtctca

SEQ ID NO: 397407 - DNA, 15 bp, Homo sapiens
gtgagactgtctcaa

SEQ ID NO: 397408 - DNA, 15 bp, Homo sapiens
tgagactgtctcaaa

SEQ ID NO: 397409 - DNA, 15 bp, Homo sapiens
gagactgtctcaaaa

SEQ ID NO: 397410 - DNA, 15 bp, Homo sapiens
agactgtctcaaaaa

SEQ ID NO: 397411 - DNA, 15 bp, Homo sapiens
gactgtctcaaaaaa

SEQ ID NO: 397412 - DNA, 15 bp, Homo sapiens
aaaaaaaaaaagtgc

SEQ ID NO: 397413 - DNA, 15 bp, Homo sapiens
aaaaaaaaaagtgcc

SEQ ID NO: 397414 - DNA, 15 bp, Homo sapiens
aaaaaaaaagtgcct

SEQ ID NO: 397415 - DNA, 15 bp, Homo sapiens
aaaaaaaagtgcctt

SEQ ID NO: 397416 - DNA, 15 bp, Homo sapiens
aaaaaaagtgcctta

SEQ ID NO: 397417 - DNA, 15 bp, Homo sapiens
aaaaaagtgccttaa

SEQ ID NO: 397418 - DNA, 15 bp, Homo sapiens
aaaaagtgccttaac

SEQ ID NO: 397419 - DNA, 15 bp, Homo sapiens
aaaagtgccttaact

SEQ ID NO: 397420 - DNA, 15 bp, Homo sapiens
aaagtgccttaactt

SEQ ID NO: 397421 - DNA, 15 bp, Homo sapiens
aagtgccttaactta

SEQ ID NO: 397422 - DNA, 15 bp, Homo sapiens
agtgccttaacttac

SEQ ID NO: 397423 - DNA, 15 bp, Homo sapiens
gtgccttaacttacc

SEQ ID NO: 397424 - DNA, 15 bp, Homo sapiens
tgccttaacttacct

SEQ ID NO: 397425 - DNA, 15 bp, Homo sapiens
gccttaacttacctg

SEQ ID NO: 397426 - DNA, 15 bp, Homo sapiens
ccttaacttacctgg

SEQ ID NO: 397427 - DNA, 15 bp, Homo sapiens
cttaacttacctggc

SEQ ID NO: 397428 - DNA, 15 bp, Homo sapiens
ttaacttacctggca

SEQ ID NO: 397429 - DNA, 15 bp, Homo sapiens
taacttacctggcaa

SEQ ID NO: 397430 - DNA, 15 bp, Homo sapiens
aacttacctggcaat

SEQ ID NO: 397431 - DNA, 15 bp, Homo sapiens
acttacctggcaata

SEQ ID NO: 397432 - DNA, 15 bp, Homo sapiens
cttacctggcaataa

SEQ ID NO: 397433 - DNA, 15 bp, Homo sapiens
ttacctggcaataaa

SEQ ID NO: 397434 - DNA, 15 bp, Homo sapiens
tacctggcaataaac

SEQ ID NO: 397435 - DNA, 15 bp, Homo sapiens
acctggcaataaaca

SEQ ID NO: 397436 - DNA, 15 bp, Homo sapiens
cctggcaataaacat

SEQ ID NO: 397437 - DNA, 15 bp, Homo sapiens
ctggcaataaacatt

SEQ ID NO: 397438 - DNA, 15 bp, Homo sapiens
tggcaataaacattt

SEQ ID NO: 397439 - DNA, 15 bp, Homo sapiens
ggcaataaacattta

SEQ ID NO: 397440 - DNA, 15 bp, Homo sapiens
gcaataaacatttat

SEQ ID NO: 397441 - DNA, 15 bp, Homo sapiens
caataaacatttatt

SEQ ID NO: 397442 - DNA, 15 bp, Homo sapiens
ataaacatttattga

SEQ ID NO: 397443 - DNA, 15 bp, Homo sapiens
taaacatttattgag

SEQ ID NO: 397444 - DNA, 15 bp, Homo sapiens
aaacatttattgagt

SEQ ID NO: 397445 - DNA, 15 bp, Homo sapiens
aacatttattgagtc

SEQ ID NO: 397446 - DNA, 15 bp, Homo sapiens
acatttattgagtct

SEQ ID NO: 397447 - DNA, 15 bp, Homo sapiens
catttattgagtctg

SEQ ID NO: 397448 - DNA, 15 bp, Homo sapiens
atttattgagtctgc

SEQ ID NO: 397449 - DNA, 15 bp, Homo sapiens
tttattgagtctgca

SEQ ID NO: 397450 - DNA, 15 bp, Homo sapiens
ttattgagtctgcag

SEQ ID NO: 397451 - DNA, 15 bp, Homo sapiens
tattgagtctgcagc

SEQ ID NO: 397452 - DNA, 15 bp, Homo sapiens
attgagtctgcagct

SEQ ID NO: 397453 - DNA, 15 bp, Homo sapiens
ttgagtctgcagctt

SEQ ID NO: 397454 - DNA, 15 bp, Homo sapiens
tgagtctgcagcttt

SEQ ID NO: 397455 - DNA, 15 bp, Homo sapiens
gagtctgcagctttc

SEQ ID NO: 397456 - DNA, 15 bp, Homo sapiens
agtctgcagctttca

SEQ ID NO: 397457 - DNA, 15 bp, Homo sapiens
gtctgcagctttcat

SEQ ID NO: 397458 - DNA, 15 bp, Homo sapiens
tctgcagctttcatt

SEQ ID NO: 397459 - DNA, 15 bp, Homo sapiens
ctgcagctttcattc

SEQ ID NO: 397460 - DNA, 15 bp, Homo sapiens
tgcagctttcattca

SEQ ID NO: 397461 - DNA, 15 bp, Homo sapiens
gcagctttcattcat

SEQ ID NO: 397462 - DNA, 15 bp, Homo sapiens
cagctttcattcatt

SEQ ID NO: 397463 - DNA, 15 bp, Homo sapiens
agctttcattcattt

SEQ ID NO: 397464 - DNA, 15 bp, Homo sapiens
gctttcattcattta

SEQ ID NO: 397465 - DNA, 15 bp, Homo sapiens
ctttcattcatttag

SEQ ID NO: 397466 - DNA, 15 bp, Homo sapiens
tttcattcatttagc

SEQ ID NO: 397467 - DNA, 15 bp, Homo sapiens
ttcattcatttagct

SEQ ID NO: 397468 - DNA, 15 bp, Homo sapiens
tcattcatttagctc

SEQ ID NO: 397469 - DNA, 15 bp, Homo sapiens
cattcatttagctca

SEQ ID NO: 397470 - DNA, 15 bp, Homo sapiens
attcatttagctcat

SEQ ID NO: 397471 - DNA, 15 bp, Homo sapiens
ttcatttagctcatt

SEQ ID NO: 397472 - DNA, 15 bp, Homo sapiens
tcatttagctcattt

SEQ ID NO: 397473 - DNA, 15 bp, Homo sapiens
catttagctcattta

SEQ ID NO: 397474 - DNA, 15 bp, Homo sapiens
atttagctcatttac

SEQ ID NO: 397475 - DNA, 15 bp, Homo sapiens
tttagctcatttaca

SEQ ID NO: 397476 - DNA, 15 bp, Homo sapiens
ttagctcatttacat

SEQ ID NO: 397477 - DNA, 15 bp, Homo sapiens
tagctcatttacatt

SEQ ID NO: 397478 - DNA, 15 bp, Homo sapiens
agctcatttacattt

SEQ ID NO: 397479 - DNA, 15 bp, Homo sapiens
gctcatttacattta

SEQ ID NO: 397480 - DNA, 15 bp, Homo sapiens
ctcatttacatttaa

SEQ ID NO: 397481 - DNA, 15 bp, Homo sapiens
tcatttacatttaac

SEQ ID NO: 397482 - DNA, 15 bp, Homo sapiens
catttacatttaact

SEQ ID NO: 397483 - DNA, 15 bp, Homo sapiens
atttacatttaactg

SEQ ID NO: 397484 - DNA, 15 bp, Homo sapiens
tttacatttaactga

SEQ ID NO: 397485 - DNA, 15 bp, Homo sapiens
ttacatttaactgaa

SEQ ID NO: 397486 - DNA, 15 bp, Homo sapiens
tacatttaactgaaa

SEQ ID NO: 397487 - DNA, 15 bp, Homo sapiens
acatttaactgaaac

SEQ ID NO: 397488 - DNA, 15 bp, Homo sapiens
catttaactgaaaca

SEQ ID NO: 397489 - DNA, 15 bp, Homo sapiens
atttaactgaaacac

SEQ ID NO: 397490 - DNA, 15 bp, Homo sapiens
tttaactgaaacaca

SEQ ID NO: 397491 - DNA, 15 bp, Homo sapiens
ttaactgaaacacat

SEQ ID NO: 397492 - DNA, 15 bp, Homo sapiens
taactgaaacacatt

SEQ ID NO: 397493 - DNA, 15 bp, Homo sapiens
aactgaaacacattt

SEQ ID NO: 397494 - DNA, 15 bp, Homo sapiens
actgaaacacattta

SEQ ID NO: 397495 - DNA, 15 bp, Homo sapiens
ctgaaacacatttaa

SEQ ID NO: 397496 - DNA, 15 bp, Homo sapiens
tgaaacacatttaaa

SEQ ID NO: 397497 - DNA, 15 bp, Homo sapiens
gaaacacatttaaaa

SEQ ID NO: 397498 - DNA, 15 bp, Homo sapiens
aaacacatttaaaaa

SEQ ID NO: 397499 - DNA, 15 bp, Homo sapiens
aacacatttaaaaat

SEQ ID NO: 397500 - DNA, 15 bp, Homo sapiens
acacatttaaaaatt

SEQ ID NO: 397501 - DNA, 15 bp, Homo sapiens
cacatttaaaaattc

SEQ ID NO: 397502 - DNA, 15 bp, Homo sapiens
acatttaaaaattca

SEQ ID NO: 397503 - DNA, 15 bp, Homo sapiens
catttaaaaattcat

SEQ ID NO: 397504 - DNA, 15 bp, Homo sapiens
atttaaaaattcatt

SEQ ID NO: 397505 - DNA, 15 bp, Homo sapiens
ttaaaaattcatttt

SEQ ID NO: 397506 - DNA, 15 bp, Homo sapiens
taaaaattcattttt

SEQ ID NO: 397507 - DNA, 15 bp, Homo sapiens
aaaaattcatttttt

SEQ ID NO: 397508 - DNA, 15 bp, Homo sapiens
aaaattcattttttc

SEQ ID NO: 397509 - DNA, 15 bp, Homo sapiens
aaattcattttttcc

SEQ ID NO: 397510 - DNA, 15 bp, Homo sapiens
aattcattttttcct

SEQ ID NO: 397511 - DNA, 15 bp, Homo sapiens
attcattttttcctt

SEQ ID NO: 397512 - DNA, 15 bp, Homo sapiens
ttcattttttccttt

SEQ ID NO: 397513 - DNA, 15 bp, Homo sapiens
tcattttttcctttt

SEQ ID NO: 397514 - DNA, 15 bp, Homo sapiens
cattttttccttttg

SEQ ID NO: 397515 - DNA, 15 bp, Homo sapiens
attttttccttttgc

SEQ ID NO: 397516 - DNA, 15 bp, Homo sapiens
ttttttccttttgca

SEQ ID NO: 397517 - DNA, 15 bp, Homo sapiens
tttttccttttgcaa

SEQ ID NO: 397518 - DNA, 15 bp, Homo sapiens
ttttccttttgcaaa

SEQ ID NO: 397519 - DNA, 15 bp, Homo sapiens
tttccttttgcaaaa

SEQ ID NO: 397520 - DNA, 15 bp, Homo sapiens
ttccttttgcaaaag

SEQ ID NO: 397521 - DNA, 15 bp, Homo sapiens
tccttttgcaaaagc

SEQ ID NO: 397522 - DNA, 15 bp, Homo sapiens
ccttttgcaaaagct

SEQ ID NO: 397523 - DNA, 15 bp, Homo sapiens
cttttgcaaaagcta

SEQ ID NO: 397524 - DNA, 15 bp, Homo sapiens
ttttgcaaaagctag

SEQ ID NO: 397525 - DNA, 15 bp, Homo sapiens
tttgcaaaagctagg

SEQ ID NO: 397526 - DNA, 15 bp, Homo sapiens
ttgcaaaagctaggc

SEQ ID NO: 397527 - DNA, 15 bp, Homo sapiens
tgcaaaagctaggca

SEQ ID NO: 397528 - DNA, 15 bp, Homo sapiens
gcaaaagctaggcat

SEQ ID NO: 397529 - DNA, 15 bp, Homo sapiens
caaaagctaggcatg

SEQ ID NO: 397530 - DNA, 15 bp, Homo sapiens
aaaagctaggcatgc

SEQ ID NO: 397531 - DNA, 15 bp, Homo sapiens
aaagctaggcatgcc

SEQ ID NO: 397532 - DNA, 15 bp, Homo sapiens
aagctaggcatgcct

SEQ ID NO: 397533 - DNA, 15 bp, Homo sapiens
agctaggcatgccta

SEQ ID NO: 397534 - DNA, 15 bp, Homo sapiens
gctaggcatgcctac

SEQ ID NO: 397535 - DNA, 15 bp, Homo sapiens
ctaggcatgcctact

SEQ ID NO: 397536 - DNA, 15 bp, Homo sapiens
taggcatgcctacta

SEQ ID NO: 397537 - DNA, 15 bp, Homo sapiens
aggcatgcctactat

SEQ ID NO: 397538 - DNA, 15 bp, Homo sapiens
ggcatgcctactata

SEQ ID NO: 397539 - DNA, 15 bp, Homo sapiens
gcatgcctactataa

SEQ ID NO: 397540 - DNA, 15 bp, Homo sapiens
catgcctactataaa

SEQ ID NO: 397541 - DNA, 15 bp, Homo sapiens
atgcctactataaaa

SEQ ID NO: 397542 - DNA, 15 bp, Homo sapiens
tgcctactataaaag

SEQ ID NO: 397543 - DNA, 15 bp, Homo sapiens
gcctactataaaagt

SEQ ID NO: 397544 - DNA, 15 bp, Homo sapiens
cctactataaaagtt

SEQ ID NO: 397545 - DNA, 15 bp, Homo sapiens
ctactataaaagttt

SEQ ID NO: 397546 - DNA, 15 bp, Homo sapiens
tactataaaagtttg

SEQ ID NO: 397547 - DNA, 15 bp, Homo sapiens
actataaaagtttgc

SEQ ID NO: 397548 - DNA, 15 bp, Homo sapiens
ctataaaagtttgca

SEQ ID NO: 397549 - DNA, 15 bp, Homo sapiens
tataaaagtttgcaa

SEQ ID NO: 397550 - DNA, 15 bp, Homo sapiens
ataaaagtttgcaac

SEQ ID NO: 397551 - DNA, 15 bp, Homo sapiens
taaaagtttgcaact

SEQ ID NO: 397552 - DNA, 15 bp, Homo sapiens
aaaagtttgcaactt

SEQ ID NO: 397553 - DNA, 15 bp, Homo sapiens
aaagtttgcaacttt

SEQ ID NO: 397554 - DNA, 15 bp, Homo sapiens
aagtttgcaactttt

SEQ ID NO: 397555 - DNA, 15 bp, Homo sapiens
agtttgcaacttttc

SEQ ID NO: 397556 - DNA, 15 bp, Homo sapiens
gtttgcaacttttca

SEQ ID NO: 397557 - DNA, 15 bp, Homo sapiens
tttgcaacttttcaa

SEQ ID NO: 397558 - DNA, 15 bp, Homo sapiens
ttgcaacttttcaaa

SEQ ID NO: 397559 - DNA, 15 bp, Homo sapiens
tgcaacttttcaaag

SEQ ID NO: 397560 - DNA, 15 bp, Homo sapiens
gcaacttttcaaagc

SEQ ID NO: 397561 - DNA, 15 bp, Homo sapiens
caacttttcaaagca

SEQ ID NO: 397562 - DNA, 15 bp, Homo sapiens
aacttttcaaagcat

SEQ ID NO: 397563 - DNA, 15 bp, Homo sapiens
acttttcaaagcatg

SEQ ID NO: 397564 - DNA, 15 bp, Homo sapiens
cttttcaaagcatga

SEQ ID NO: 397565 - DNA, 15 bp, Homo sapiens
ttttcaaagcatgaa

SEQ ID NO: 397566 - DNA, 15 bp, Homo sapiens
tttcaaagcatgaaa

SEQ ID NO: 397567 - DNA, 15 bp, Homo sapiens
ttcaaagcatgaaat

SEQ ID NO: 397568 - DNA, 15 bp, Homo sapiens
tcaaagcatgaaata

SEQ ID NO: 397569 - DNA, 15 bp, Homo sapiens
caaagcatgaaatat

SEQ ID NO: 397570 - DNA, 15 bp, Homo sapiens
aaagcatgaaatatg

SEQ ID NO: 397571 - DNA, 15 bp, Homo sapiens
aagcatgaaatatgt

SEQ ID NO: 397572 - DNA, 15 bp, Homo sapiens
agcatgaaatatgta

SEQ ID NO: 397573 - DNA, 15 bp, Homo sapiens
gcatgaaatatgtag

SEQ ID NO: 397574 - DNA, 15 bp, Homo sapiens
catgaaatatgtaga

SEQ ID NO: 397575 - DNA, 15 bp, Homo sapiens
atgaaatatgtagag

SEQ ID NO: 397576 - DNA, 15 bp, Homo sapiens
tgaaatatgtagagt

SEQ ID NO: 397577 - DNA, 15 bp, Homo sapiens
gaaatatgtagagtt

SEQ ID NO: 397578 - DNA, 15 bp, Homo sapiens
aaatatgtagagttg

SEQ ID NO: 397579 - DNA, 15 bp, Homo sapiens
aatatgtagagttga

SEQ ID NO: 397580 - DNA, 15 bp, Homo sapiens
atatgtagagttgat

SEQ ID NO: 397581 - DNA, 15 bp, Homo sapiens
tatgtagagttgata

SEQ ID NO: 397582 - DNA, 15 bp, Homo sapiens
atgtagagttgatac

SEQ ID NO: 397583 - DNA, 15 bp, Homo sapiens
tgtagagttgatacc

SEQ ID NO: 397584 - DNA, 15 bp, Homo sapiens
gtagagttgataccc

SEQ ID NO: 397585 - DNA, 15 bp, Homo sapiens
tagagttgataccct

SEQ ID NO: 397586 - DNA, 15 bp, Homo sapiens
agagttgataccctc

SEQ ID NO: 397587 - DNA, 15 bp, Homo sapiens
gagttgataccctca

SEQ ID NO: 397588 - DNA, 15 bp, Homo sapiens
agttgataccctcat

SEQ ID NO: 397589 - DNA, 15 bp, Homo sapiens
gttgataccctcatt

SEQ ID NO: 397590 - DNA, 15 bp, Homo sapiens
ttgataccctcattt

SEQ ID NO: 397591 - DNA, 15 bp, Homo sapiens
tgataccctcattta

SEQ ID NO: 397592 - DNA, 15 bp, Homo sapiens
gataccctcatttat

SEQ ID NO: 397593 - DNA, 15 bp, Homo sapiens
ataccctcatttatt

SEQ ID NO: 397594 - DNA, 15 bp, Homo sapiens
taccctcatttatta

SEQ ID NO: 397595 - DNA, 15 bp, Homo sapiens
accctcatttattat

SEQ ID NO: 397596 - DNA, 15 bp, Homo sapiens
ccctcatttattata

SEQ ID NO: 397597 - DNA, 15 bp, Homo sapiens
cctcatttattatat

SEQ ID NO: 397598 - DNA, 15 bp, Homo sapiens
ctcatttattatatt

SEQ ID NO: 397599 - DNA, 15 bp, Homo sapiens
tcatttattatattt

SEQ ID NO: 397600 - DNA, 15 bp, Homo sapiens
catttattatatttt

SEQ ID NO: 397601 - DNA, 15 bp, Homo sapiens
tttattatattttac

SEQ ID NO: 397602 - DNA, 15 bp, Homo sapiens
ttattatattttact

SEQ ID NO: 397603 - DNA, 15 bp, Homo sapiens
tattatattttacta

SEQ ID NO: 397604 - DNA, 15 bp, Homo sapiens
attatattttactaa

SEQ ID NO: 397605 - DNA, 15 bp, Homo sapiens
ttatattttactaat

SEQ ID NO: 397606 - DNA, 15 bp, Homo sapiens
tatattttactaatt

SEQ ID NO: 397607 - DNA, 15 bp, Homo sapiens
atattttactaattc

SEQ ID NO: 397608 - DNA, 15 bp, Homo sapiens
tattttactaattcc

SEQ ID NO: 397609 - DNA, 15 bp, Homo sapiens
attttactaattcct

SEQ ID NO: 397610 - DNA, 15 bp, Homo sapiens
ttttactaattcctg

SEQ ID NO: 397611 - DNA, 15 bp, Homo sapiens
tttactaattcctgt

SEQ ID NO: 397612 - DNA, 15 bp, Homo sapiens
ttactaattcctgta

SEQ ID NO: 397613 - DNA, 15 bp, Homo sapiens
tactaattcctgtag

SEQ ID NO: 397614 - DNA, 15 bp, Homo sapiens
actaattcctgtaga

SEQ ID NO: 397615 - DNA, 15 bp, Homo sapiens
ctaattcctgtagag

SEQ ID NO: 397616 - DNA, 15 bp, Homo sapiens
taattcctgtagaga

SEQ ID NO: 397617 - DNA, 15 bp, Homo sapiens
aattcctgtagagat

SEQ ID NO: 397618 - DNA, 15 bp, Homo sapiens
attcctgtagagatg

SEQ ID NO: 397619 - DNA, 15 bp, Homo sapiens
ttcctgtagagatga

SEQ ID NO: 397620 - DNA, 15 bp, Homo sapiens
tcctgtagagatgag

SEQ ID NO: 397621 - DNA, 15 bp, Homo sapiens
cctgtagagatgagc

SEQ ID NO: 397622 - DNA, 15 bp, Homo sapiens
ctgtagagatgagca

SEQ ID NO: 397623 - DNA, 15 bp, Homo sapiens
tgtagagatgagcaa

SEQ ID NO: 397624 - DNA, 15 bp, Homo sapiens
gtagagatgagcaac

SEQ ID NO: 397625 - DNA, 15 bp, Homo sapiens
tagagatgagcaaca

SEQ ID NO: 397626 - DNA, 15 bp, Homo sapiens
agagatgagcaacaa

SEQ ID NO: 397627 - DNA, 15 bp, Homo sapiens
gagatgagcaacaaa

SEQ ID NO: 397628 - DNA, 15 bp, Homo sapiens
agatgagcaacaaaa

SEQ ID NO: 397629 - DNA, 15 bp, Homo sapiens
gatgagcaacaaaat

SEQ ID NO: 397630 - DNA, 15 bp, Homo sapiens
atgagcaacaaaatt

SEQ ID NO: 397631 - DNA, 15 bp, Homo sapiens
tgagcaacaaaattg

SEQ ID NO: 397632 - DNA, 15 bp, Homo sapiens
gagcaacaaaattgt

SEQ ID NO: 397633 - DNA, 15 bp, Homo sapiens
agcaacaaaattgtc

SEQ ID NO: 397634 - DNA, 15 bp, Homo sapiens
gcaacaaaattgtcc

SEQ ID NO: 397635 - DNA, 15 bp, Homo sapiens
caacaaaattgtcct

SEQ ID NO: 397636 - DNA, 15 bp, Homo sapiens
aacaaaattgtcctt

SEQ ID NO: 397637 - DNA, 15 bp, Homo sapiens
acaaaattgtccttt

SEQ ID NO: 397638 - DNA, 15 bp, Homo sapiens
caaaattgtccttta

SEQ ID NO: 397639 - DNA, 15 bp, Homo sapiens
aaaattgtcctttat

SEQ ID NO: 397640 - DNA, 15 bp, Homo sapiens
aaattgtcctttatg

SEQ ID NO: 397641 - DNA, 15 bp, Homo sapiens
aattgtcctttatga

SEQ ID NO: 397642 - DNA, 15 bp, Homo sapiens
attgtcctttatgaa

SEQ ID NO: 397643 - DNA, 15 bp, Homo sapiens
ttgtcctttatgaaa

SEQ ID NO: 397644 - DNA, 15 bp, Homo sapiens
tgtcctttatgaaag

SEQ ID NO: 397645 - DNA, 15 bp, Homo sapiens
gtcctttatgaaagc

SEQ ID NO: 397646 - DNA, 15 bp, Homo sapiens
tcctttatgaaagct

SEQ ID NO: 397647 - DNA, 15 bp, Homo sapiens
cctttatgaaagctg

SEQ ID NO: 397648 - DNA, 15 bp, Homo sapiens
ctttatgaaagctgt

SEQ ID NO: 397649 - DNA, 15 bp, Homo sapiens
tttatgaaagctgtc

SEQ ID NO: 397650 - DNA, 15 bp, Homo sapiens
ttatgaaagctgtca

SEQ ID NO: 397651 - DNA, 15 bp, Homo sapiens
tatgaaagctgtcat

SEQ ID NO: 397652 - DNA, 15 bp, Homo sapiens
atgaaagctgtcatt

SEQ ID NO: 397653 - DNA, 15 bp, Homo sapiens
tgaaagctgtcattc

SEQ ID NO: 397654 - DNA, 15 bp, Homo sapiens
gaaagctgtcattct

SEQ ID NO: 397655 - DNA, 15 bp, Homo sapiens
aaagctgtcattctc

SEQ ID NO: 397656 - DNA, 15 bp, Homo sapiens
aagctgtcattctct

SEQ ID NO: 397657 - DNA, 15 bp, Homo sapiens
agctgtcattctcta

SEQ ID NO: 397658 - DNA, 15 bp, Homo sapiens
gctgtcattctctaa

SEQ ID NO: 397659 - DNA, 15 bp, Homo sapiens
ctgtcattctctaaa

SEQ ID NO: 397660 - DNA, 15 bp, Homo sapiens
tgtcattctctaaaa

SEQ ID NO: 397661 - DNA, 15 bp, Homo sapiens
agcattcaaatgtgg

SEQ ID NO: 397662 - DNA, 15 bp, Homo sapiens
gcattcaaatgtggc

SEQ ID NO: 397663 - DNA, 15 bp, Homo sapiens
cattcaaatgtggca

SEQ ID NO: 397664 - DNA, 15 bp, Homo sapiens
attcaaatgtggcat

SEQ ID NO: 397665 - DNA, 15 bp, Homo sapiens
ttcaaatgtggcatt

SEQ ID NO: 397666 - DNA, 15 bp, Homo sapiens
tcaaatgtggcattc

SEQ ID NO: 397667 - DNA, 15 bp, Homo sapiens
caaatgtggcattct

SEQ ID NO: 397668 - DNA, 15 bp, Homo sapiens
aaatgtggcattctg

SEQ ID NO: 397669 - DNA, 15 bp, Homo sapiens
aatgtggcattctgg

SEQ ID NO: 397670 - DNA, 15 bp, Homo sapiens
atgtggcattctggc

SEQ ID NO: 397671 - DNA, 15 bp, Homo sapiens
tgtggcattctggcc

SEQ ID NO: 397672 - DNA, 15 bp, Homo sapiens
gtggcattctggccg

SEQ ID NO: 397673 - DNA, 15 bp, Homo sapiens
tggcattctggccgg

SEQ ID NO: 397674 - DNA, 15 bp, Homo sapiens
ggcattctggccggg

SEQ ID NO: 397675 - DNA, 15 bp, Homo sapiens
gcattctggccgggc

SEQ ID NO: 397676 - DNA, 15 bp, Homo sapiens
cattctggccgggcg

SEQ ID NO: 397677 - DNA, 15 bp, Homo sapiens
attctggccgggcgt

SEQ ID NO: 397678 - DNA, 15 bp, Homo sapiens
ttctggccgggcgta

SEQ ID NO: 397679 - DNA, 15 bp, Homo sapiens
tctggccgggcgtag

SEQ ID NO: 397680 - DNA, 15 bp, Homo sapiens
ctggccgggcgtagt

SEQ ID NO: 397681 - DNA, 15 bp, Homo sapiens
tggccgggcgtagtg

SEQ ID NO: 397682 - DNA, 15 bp, Homo sapiens
ggccgggcgtagtgg

SEQ ID NO: 397683 - DNA, 15 bp, Homo sapiens
gccgggcgtagtggc

SEQ ID NO: 397684 - DNA, 15 bp, Homo sapiens
ccgggcgtagtggct

SEQ ID NO: 397685 - DNA, 15 bp, Homo sapiens
cgggcgtagtggctc

SEQ ID NO: 397686 - DNA, 15 bp, Homo sapiens
gggcgtagtggctca

SEQ ID NO: 397687 - DNA, 15 bp, Homo sapiens
ggcgtagtggctcac

SEQ ID NO: 397688 - DNA, 15 bp, Homo sapiens
gcgtagtggctcacg

SEQ ID NO: 397689 - DNA, 15 bp, Homo sapiens
cgtagtggctcacgc

SEQ ID NO: 397690 - DNA, 15 bp, Homo sapiens
gtagtggctcacgcc

SEQ ID NO: 397691 - DNA, 15 bp, Homo sapiens
tagtggctcacgcct

SEQ ID NO: 397692 - DNA, 15 bp, Homo sapiens
aggctgaagcaggcg

SEQ ID NO: 397693 - DNA, 15 bp, Homo sapiens
ggctgaagcaggcgg

SEQ ID NO: 397694 - DNA, 15 bp, Homo sapiens
gctgaagcaggcgga

SEQ ID NO: 397695 - DNA, 15 bp, Homo sapiens
ctgaagcaggcggat

SEQ ID NO: 397696 - DNA, 15 bp, Homo sapiens
tgaagcaggcggatc

SEQ ID NO: 397697 - DNA, 15 bp, Homo sapiens
gaagcaggcggatca

SEQ ID NO: 397698 - DNA, 15 bp, Homo sapiens
aagcaggcggatcat

SEQ ID NO: 397699 - DNA, 15 bp, Homo sapiens
agcaggcggatcatg

SEQ ID NO: 397700 - DNA, 15 bp, Homo sapiens
gcaggcggatcatga

SEQ ID NO: 397701 - DNA, 15 bp, Homo sapiens
caggcggatcatgag

SEQ ID NO: 397702 - DNA, 15 bp, Homo sapiens
aggcggatcatgagg

SEQ ID NO: 397703 - DNA, 15 bp, Homo sapiens
caggagattgagacc

SEQ ID NO: 397704 - DNA, 15 bp, Homo sapiens
aggagattgagacca

SEQ ID NO: 397705 - DNA, 15 bp, Homo sapiens
ggagattgagaccat

SEQ ID NO: 397706 - DNA, 15 bp, Homo sapiens
gagattgagaccatc

SEQ ID NO: 397707 - DNA, 15 bp, Homo sapiens
agattgagaccatcc

SEQ ID NO: 397708 - DNA, 15 bp, Homo sapiens
gattgagaccatcct

SEQ ID NO: 397709 - DNA, 15 bp, Homo sapiens
attgagaccatcctg

SEQ ID NO: 397710 - DNA, 15 bp, Homo sapiens
ttgagaccatcctgg

SEQ ID NO: 397711 - DNA, 15 bp, Homo sapiens
tgagaccatcctggc

SEQ ID NO: 397712 - DNA, 15 bp, Homo sapiens
caggcgtggtggtgg

SEQ ID NO: 397713 - DNA, 15 bp, Homo sapiens
aggcgtggtggtggg

SEQ ID NO: 397714 - DNA, 15 bp, Homo sapiens
ggcgtggtggtgggt

SEQ ID NO: 397715 - DNA, 15 bp, Homo sapiens
gcgtggtggtgggtg

SEQ ID NO: 397716 - DNA, 15 bp, Homo sapiens
cgtggtggtgggtgc

SEQ ID NO: 397717 - DNA, 15 bp, Homo sapiens
gggtgcctgtagtcc

SEQ ID NO: 397718 - DNA, 15 bp, Homo sapiens
ggcaggagaatggca

SEQ ID NO: 397719 - DNA, 15 bp, Homo sapiens
agtgagccgagatct

SEQ ID NO: 397720 - DNA, 15 bp, Homo sapiens
gtgagccgagatctc

SEQ ID NO: 397721 - DNA, 15 bp, Homo sapiens
tgagccgagatctcg

SEQ ID NO: 397722 - DNA, 15 bp, Homo sapiens
gagccgagatctcgc

SEQ ID NO: 397723 - DNA, 15 bp, Homo sapiens
agccgagatctcgcc

SEQ ID NO: 397724 - DNA, 15 bp, Homo sapiens
gccgagatctcgcca

SEQ ID NO: 397725 - DNA, 15 bp, Homo sapiens
ccgagatctcgccac

SEQ ID NO: 397726 - DNA, 15 bp, Homo sapiens
cgagatctcgccact

SEQ ID NO: 397727 - DNA, 15 bp, Homo sapiens
gagatctcgccactg

SEQ ID NO: 397728 - DNA, 15 bp, Homo sapiens
agatctcgccactgc

SEQ ID NO: 397729 - DNA, 15 bp, Homo sapiens
gatctcgccactgca

SEQ ID NO: 397730 - DNA, 15 bp, Homo sapiens
atctcgccactgcac

SEQ ID NO: 397731 - DNA, 15 bp, Homo sapiens
tctcgccactgcact

SEQ ID NO: 397732 - DNA, 15 bp, Homo sapiens
ctcgccactgcactc

SEQ ID NO: 397733 - DNA, 15 bp, Homo sapiens
tcgccactgcactcc

SEQ ID NO: 397734 - DNA, 15 bp, Homo sapiens
ctgggtgacagagcg

SEQ ID NO: 397735 - DNA, 15 bp, Homo sapiens
tgggtgacagagcga

SEQ ID NO: 397736 - DNA, 15 bp, Homo sapiens
gggtgacagagcgag

SEQ ID NO: 397737 - DNA, 15 bp, Homo sapiens
ggtgacagagcgaga

SEQ ID NO: 397738 - DNA, 15 bp, Homo sapiens
gtgacagagcgagac

SEQ ID NO: 397739 - DNA, 15 bp, Homo sapiens
cagagcgagactcca

SEQ ID NO: 397740 - DNA, 15 bp, Homo sapiens
agagcgagactccat

SEQ ID NO: 397741 - DNA, 15 bp, Homo sapiens
gagcgagactccatc

SEQ ID NO: 397742 - DNA, 15 bp, Homo sapiens
agcgagactccatct

SEQ ID NO: 397743 - DNA, 15 bp, Homo sapiens
cgagactccatctca

SEQ ID NO: 397744 - DNA, 15 bp, Homo sapiens
tccatctcaaaaaat

SEQ ID NO: 397745 - DNA, 15 bp, Homo sapiens
ccatctcaaaaaata

SEQ ID NO: 397746 - DNA, 15 bp, Homo sapiens
catctcaaaaaataa

SEQ ID NO: 397747 - DNA, 15 bp, Homo sapiens
atctcaaaaaataaa

SEQ ID NO: 397748 - DNA, 15 bp, Homo sapiens
tctcaaaaaataaat

SEQ ID NO: 397749 - DNA, 15 bp, Homo sapiens
ctcaaaaaataaata

SEQ ID NO: 397750 - DNA, 15 bp, Homo sapiens
tcaaaaaataaataa

SEQ ID NO: 397751 - DNA, 15 bp, Homo sapiens
caaaaaataaataaa

SEQ ID NO: 397752 - DNA, 15 bp, Homo sapiens
aaaaaataaataaaa

SEQ ID NO: 397753 - DNA, 15 bp, Homo sapiens
aaaaataaataaaaa

SEQ ID NO: 397754 - DNA, 15 bp, Homo sapiens
aaaataaataaaaaa

SEQ ID NO: 397755 - DNA, 15 bp, Homo sapiens
aaataaataaaaaat

SEQ ID NO: 397756 - DNA, 15 bp, Homo sapiens
aataaataaaaaatg

SEQ ID NO: 397757 - DNA, 15 bp, Homo sapiens
ataaataaaaaatga

SEQ ID NO: 397758 - DNA, 15 bp, Homo sapiens
taaataaaaaatgaa

SEQ ID NO: 397759 - DNA, 15 bp, Homo sapiens
aaataaaaaatgaag

SEQ ID NO: 397760 - DNA, 15 bp, Homo sapiens
aataaaaaatgaagt

SEQ ID NO: 397761 - DNA, 15 bp, Homo sapiens
ataaaaaatgaagtg

SEQ ID NO: 397762 - DNA, 15 bp, Homo sapiens
taaaaaatgaagtgg

SEQ ID NO: 397763 - DNA, 15 bp, Homo sapiens
aaaaaatgaagtggc

SEQ ID NO: 397764 - DNA, 15 bp, Homo sapiens
aaaaatgaagtggca

SEQ ID NO: 397765 - DNA, 15 bp, Homo sapiens
aaaatgaagtggcat

SEQ ID NO: 397766 - DNA, 15 bp, Homo sapiens
aaatgaagtggcatt

SEQ ID NO: 397767 - DNA, 15 bp, Homo sapiens
aatgaagtggcattc

SEQ ID NO: 397768 - DNA, 15 bp, Homo sapiens
atgaagtggcattct

SEQ ID NO: 397769 - DNA, 15 bp, Homo sapiens
tgaagtggcattctg

SEQ ID NO: 397770 - DNA, 15 bp, Homo sapiens
gaagtggcattctga

SEQ ID NO: 397771 - DNA, 15 bp, Homo sapiens
aagtggcattctgat

SEQ ID NO: 397772 - DNA, 15 bp, Homo sapiens
agtggcattctgatt

SEQ ID NO: 397773 - DNA, 15 bp, Homo sapiens
gtggcattctgattg

SEQ ID NO: 397774 - DNA, 15 bp, Homo sapiens
tggcattctgattgg

SEQ ID NO: 397775 - DNA, 15 bp, Homo sapiens
ggcattctgattggg

SEQ ID NO: 397776 - DNA, 15 bp, Homo sapiens
gcattctgattggga

SEQ ID NO: 397777 - DNA, 15 bp, Homo sapiens
cattctgattgggag

SEQ ID NO: 397778 - DNA, 15 bp, Homo sapiens
attctgattgggagt

SEQ ID NO: 397779 - DNA, 15 bp, Homo sapiens
ttctgattgggagtt

SEQ ID NO: 397780 - DNA, 15 bp, Homo sapiens
tctgattgggagtta

SEQ ID NO: 397781 - DNA, 15 bp, Homo sapiens
ctgattgggagttac

SEQ ID NO: 397782 - DNA, 15 bp, Homo sapiens
tgattgggagttact

SEQ ID NO: 397783 - DNA, 15 bp, Homo sapiens
gattgggagttacta

SEQ ID NO: 397784 - DNA, 15 bp, Homo sapiens
attgggagttactaa

SEQ ID NO: 397785 - DNA, 15 bp, Homo sapiens
ttgggagttactaag

SEQ ID NO: 397786 - DNA, 15 bp, Homo sapiens
tgggagttactaagc

SEQ ID NO: 397787 - DNA, 15 bp, Homo sapiens
gggagttactaagca

SEQ ID NO: 397788 - DNA, 15 bp, Homo sapiens
ggagttactaagcat

SEQ ID NO: 397789 - DNA, 15 bp, Homo sapiens
gagttactaagcata

SEQ ID NO: 397790 - DNA, 15 bp, Homo sapiens
agttactaagcatat

SEQ ID NO: 397791 - DNA, 15 bp, Homo sapiens
gttactaagcatata

SEQ ID NO: 397792 - DNA, 15 bp, Homo sapiens
ttactaagcatatat

SEQ ID NO: 397793 - DNA, 15 bp, Homo sapiens
tactaagcatatata

SEQ ID NO: 397794 - DNA, 15 bp, Homo sapiens
actaagcatatatat

SEQ ID NO: 397795 - DNA, 15 bp, Homo sapiens
ctaagcatatatatt

SEQ ID NO: 397796 - DNA, 15 bp, Homo sapiens
taagcatatatatta

SEQ ID NO: 397797 - DNA, 15 bp, Homo sapiens
aagcatatatattat

SEQ ID NO: 397798 - DNA, 15 bp, Homo sapiens
agcatatatattata

SEQ ID NO: 397799 - DNA, 15 bp, Homo sapiens
gcatatatattatag

SEQ ID NO: 397800 - DNA, 15 bp, Homo sapiens
catatatattatagg

SEQ ID NO: 397801 - DNA, 15 bp, Homo sapiens
atatatattatagga

SEQ ID NO: 397802 - DNA, 15 bp, Homo sapiens
tatatattataggaa

SEQ ID NO: 397803 - DNA, 15 bp, Homo sapiens
atatattataggaag

SEQ ID NO: 397804 - DNA, 15 bp, Homo sapiens
tatattataggaagg

SEQ ID NO: 397805 - DNA, 15 bp, Homo sapiens
atattataggaagga

SEQ ID NO: 397806 - DNA, 15 bp, Homo sapiens
tattataggaaggat

SEQ ID NO: 397807 - DNA, 15 bp, Homo sapiens
attataggaaggatt

SEQ ID NO: 397808 - DNA, 15 bp, Homo sapiens
ttataggaaggatta

SEQ ID NO: 397809 - DNA, 15 bp, Homo sapiens
tataggaaggattaa

SEQ ID NO: 397810 - DNA, 15 bp, Homo sapiens
ataggaaggattaac

SEQ ID NO: 397811 - DNA, 15 bp, Homo sapiens
taggaaggattaaca

SEQ ID NO: 397812 - DNA, 15 bp, Homo sapiens
aggaaggattaacac

SEQ ID NO: 397813 - DNA, 15 bp, Homo sapiens
ggaaggattaacact

SEQ ID NO: 397814 - DNA, 15 bp, Homo sapiens
gaaggattaacactc

SEQ ID NO: 397815 - DNA, 15 bp, Homo sapiens
aaggattaacactca

SEQ ID NO: 397816 - DNA, 15 bp, Homo sapiens
aggattaacactcaa

SEQ ID NO: 397817 - DNA, 15 bp, Homo sapiens
ggattaacactcaaa

SEQ ID NO: 397818 - DNA, 15 bp, Homo sapiens
gattaacactcaaaa

SEQ ID NO: 397819 - DNA, 15 bp, Homo sapiens
attaacactcaaaag

SEQ ID NO: 397820 - DNA, 15 bp, Homo sapiens
ttaacactcaaaagg

SEQ ID NO: 397821 - DNA, 15 bp, Homo sapiens
taacactcaaaagga

SEQ ID NO: 397822 - DNA, 15 bp, Homo sapiens
aacactcaaaaggag

SEQ ID NO: 397823 - DNA, 15 bp, Homo sapiens
acactcaaaaggaga

SEQ ID NO: 397824 - DNA, 15 bp, Homo sapiens
cactcaaaaggagag

SEQ ID NO: 397825 - DNA, 15 bp, Homo sapiens
actcaaaaggagagc

SEQ ID NO: 397826 - DNA, 15 bp, Homo sapiens
ctcaaaaggagagct

SEQ ID NO: 397827 - DNA, 15 bp, Homo sapiens
tcaaaaggagagctt

SEQ ID NO: 397828 - DNA, 15 bp, Homo sapiens
caaaaggagagctta

SEQ ID NO: 397829 - DNA, 15 bp, Homo sapiens
aaaaggagagcttag

SEQ ID NO: 397830 - DNA, 15 bp, Homo sapiens
aaaggagagcttagt

SEQ ID NO: 397831 - DNA, 15 bp, Homo sapiens
aaggagagcttagtc

SEQ ID NO: 397832 - DNA, 15 bp, Homo sapiens
aggagagcttagtct

SEQ ID NO: 397833 - DNA, 15 bp, Homo sapiens
ggagagcttagtctt

SEQ ID NO: 397834 - DNA, 15 bp, Homo sapiens
gagagcttagtcttg

SEQ ID NO: 397835 - DNA, 15 bp, Homo sapiens
agagcttagtcttgt

SEQ ID NO: 397836 - DNA, 15 bp, Homo sapiens
gagcttagtcttgtt

SEQ ID NO: 397837 - DNA, 15 bp, Homo sapiens
agcttagtcttgtta

SEQ ID NO: 397838 - DNA, 15 bp, Homo sapiens
gcttagtcttgttaa

SEQ ID NO: 397839 - DNA, 15 bp, Homo sapiens
cttagtcttgttaat

SEQ ID NO: 397840 - DNA, 15 bp, Homo sapiens
ttagtcttgttaatt

SEQ ID NO: 397841 - DNA, 15 bp, Homo sapiens
tagtcttgttaattt

SEQ ID NO: 397842 - DNA, 15 bp, Homo sapiens
agtcttgttaatttt

SEQ ID NO: 397843 - DNA, 15 bp, Homo sapiens
gtcttgttaattttc

SEQ ID NO: 397844 - DNA, 15 bp, Homo sapiens
tcttgttaattttca

SEQ ID NO: 397845 - DNA, 15 bp, Homo sapiens
cttgttaattttcat

SEQ ID NO: 397846 - DNA, 15 bp, Homo sapiens
ttgttaattttcatg

SEQ ID NO: 397847 - DNA, 15 bp, Homo sapiens
tgttaattttcatgc

SEQ ID NO: 397848 - DNA, 15 bp, Homo sapiens
gttaattttcatgct

SEQ ID NO: 397849 - DNA, 15 bp, Homo sapiens
ttaattttcatgctt

SEQ ID NO: 397850 - DNA, 15 bp, Homo sapiens
taattttcatgcttt

SEQ ID NO: 397851 - DNA, 15 bp, Homo sapiens
aattttcatgctttg

SEQ ID NO: 397852 - DNA, 15 bp, Homo sapiens
attttcatgctttgc

SEQ ID NO: 397853 - DNA, 15 bp, Homo sapiens
ttttcatgctttgct

SEQ ID NO: 397854 - DNA, 15 bp, Homo sapiens
tttcatgctttgctg

SEQ ID NO: 397855 - DNA, 15 bp, Homo sapiens
ttcatgctttgctga

SEQ ID NO: 397856 - DNA, 15 bp, Homo sapiens
tcatgctttgctgag

SEQ ID NO: 397857 - DNA, 15 bp, Homo sapiens
catgctttgctgagg

SEQ ID NO: 397858 - DNA, 15 bp, Homo sapiens
atgctttgctgaggg

SEQ ID NO: 397859 - DNA, 15 bp, Homo sapiens
tgctttgctgagggc

SEQ ID NO: 397860 - DNA, 15 bp, Homo sapiens
gctttgctgagggcc

SEQ ID NO: 397861 - DNA, 15 bp, Homo sapiens
ctttgctgagggcct

SEQ ID NO: 397862 - DNA, 15 bp, Homo sapiens
tttgctgagggcctg

SEQ ID NO: 397863 - DNA, 15 bp, Homo sapiens
ttgctgagggcctgt

SEQ ID NO: 397864 - DNA, 15 bp, Homo sapiens
tgctgagggcctgtg

SEQ ID NO: 397865 - DNA, 15 bp, Homo sapiens
gctgagggcctgtgt

SEQ ID NO: 397866 - DNA, 15 bp, Homo sapiens
ctgagggcctgtgta

SEQ ID NO: 397867 - DNA, 15 bp, Homo sapiens
tgagggcctgtgtat

SEQ ID NO: 397868 - DNA, 15 bp, Homo sapiens
gagggcctgtgtatt

SEQ ID NO: 397869 - DNA, 15 bp, Homo sapiens
agggcctgtgtatta

SEQ ID NO: 397870 - DNA, 15 bp, Homo sapiens
gggcctgtgtattag

SEQ ID NO: 397871 - DNA, 15 bp, Homo sapiens
ggcctgtgtattagc

SEQ ID NO: 397872 - DNA, 15 bp, Homo sapiens
gcctgtgtattagcc

SEQ ID NO: 397873 - DNA, 15 bp, Homo sapiens
cctgtgtattagcct

SEQ ID NO: 397874 - DNA, 15 bp, Homo sapiens
ctgtgtattagcctg

SEQ ID NO: 397875 - DNA, 15 bp, Homo sapiens
tgtgtattagcctgt

SEQ ID NO: 397876 - DNA, 15 bp, Homo sapiens
gtgtattagcctgtt

SEQ ID NO: 397877 - DNA, 15 bp, Homo sapiens
tgtattagcctgttc

SEQ ID NO: 397878 - DNA, 15 bp, Homo sapiens
gtattagcctgttct

SEQ ID NO: 397879 - DNA, 15 bp, Homo sapiens
tattagcctgttctc

SEQ ID NO: 397880 - DNA, 15 bp, Homo sapiens
attagcctgttctca

SEQ ID NO: 397881 - DNA, 15 bp, Homo sapiens
ttagcctgttctcac

SEQ ID NO: 397882 - DNA, 15 bp, Homo sapiens
tagcctgttctcacc

SEQ ID NO: 397883 - DNA, 15 bp, Homo sapiens
agcctgttctcaccc

SEQ ID NO: 397884 - DNA, 15 bp, Homo sapiens
gcctgttctcaccct

SEQ ID NO: 397885 - DNA, 15 bp, Homo sapiens
cctgttctcaccctg

SEQ ID NO: 397886 - DNA, 15 bp, Homo sapiens
ctgttctcaccctgc

SEQ ID NO: 397887 - DNA, 15 bp, Homo sapiens
tgttctcaccctgct

SEQ ID NO: 397888 - DNA, 15 bp, Homo sapiens
gttctcaccctgcta

SEQ ID NO: 397889 - DNA, 15 bp, Homo sapiens
ttctcaccctgctaa

SEQ ID NO: 397890 - DNA, 15 bp, Homo sapiens
tctcaccctgctaat

SEQ ID NO: 397891 - DNA, 15 bp, Homo sapiens
ctcaccctgctaata

SEQ ID NO: 397892 - DNA, 15 bp, Homo sapiens
tcaccctgctaataa

SEQ ID NO: 397893 - DNA, 15 bp, Homo sapiens
caccctgctaataaa

SEQ ID NO: 397894 - DNA, 15 bp, Homo sapiens
accctgctaataaag

SEQ ID NO: 397895 - DNA, 15 bp, Homo sapiens
ccctgctaataaaga

SEQ ID NO: 397896 - DNA, 15 bp, Homo sapiens
cctgctaataaagac

SEQ ID NO: 397897 - DNA, 15 bp, Homo sapiens
aaagacatacctgac

SEQ ID NO: 397898 - DNA, 15 bp, Homo sapiens
aagacatacctgaca

SEQ ID NO: 397899 - DNA, 15 bp, Homo sapiens
agacatacctgacac

SEQ ID NO: 397900 - DNA, 15 bp, Homo sapiens
gacatacctgacact

SEQ ID NO: 397901 - DNA, 15 bp, Homo sapiens
acatacctgacactg

SEQ ID NO: 397902 - DNA, 15 bp, Homo sapiens
catacctgacactgg

SEQ ID NO: 397903 - DNA, 15 bp, Homo sapiens
atacctgacactggg

SEQ ID NO: 397904 - DNA, 15 bp, Homo sapiens
tacctgacactgggt

SEQ ID NO: 397905 - DNA, 15 bp, Homo sapiens
acctgacactgggtg

SEQ ID NO: 397906 - DNA, 15 bp, Homo sapiens
cctgacactgggtga

SEQ ID NO: 397907 - DNA, 15 bp, Homo sapiens
ctgacactgggtgat

SEQ ID NO: 397908 - DNA, 15 bp, Homo sapiens
tgacactgggtgatt

SEQ ID NO: 397909 - DNA, 15 bp, Homo sapiens
gacactgggtgattt

SEQ ID NO: 397910 - DNA, 15 bp, Homo sapiens
acactgggtgattta

SEQ ID NO: 397911 - DNA, 15 bp, Homo sapiens
cactgggtgatttat

SEQ ID NO: 397912 - DNA, 15 bp, Homo sapiens
actgggtgatttata

SEQ ID NO: 397913 - DNA, 15 bp, Homo sapiens
ctgggtgatttataa

SEQ ID NO: 397914 - DNA, 15 bp, Homo sapiens
tgggtgatttataaa

SEQ ID NO: 397915 - DNA, 15 bp, Homo sapiens
gggtgatttataaag

SEQ ID NO: 397916 - DNA, 15 bp, Homo sapiens
ggtgatttataaagg

SEQ ID NO: 397917 - DNA, 15 bp, Homo sapiens
gtgatttataaagga

SEQ ID NO: 397918 - DNA, 15 bp, Homo sapiens
tgatttataaaggaa

SEQ ID NO: 397919 - DNA, 15 bp, Homo sapiens
gatttataaaggaaa

SEQ ID NO: 397920 - DNA, 15 bp, Homo sapiens
aaagaggtttaatta

SEQ ID NO: 397921 - DNA, 15 bp, Homo sapiens
aagaggtttaattaa

SEQ ID NO: 397922 - DNA, 15 bp, Homo sapiens
agaggtttaattaac

SEQ ID NO: 397923 - DNA, 15 bp, Homo sapiens
gaggtttaattaact

SEQ ID NO: 397924 - DNA, 15 bp, Homo sapiens
aggtttaattaactc

SEQ ID NO: 397925 - DNA, 15 bp, Homo sapiens
ggtttaattaactca

SEQ ID NO: 397926 - DNA, 15 bp, Homo sapiens
gtttaattaactcac

SEQ ID NO: 397927 - DNA, 15 bp, Homo sapiens
tttaattaactcaca

SEQ ID NO: 397928 - DNA, 15 bp, Homo sapiens
ttaattaactcacag

SEQ ID NO: 397929 - DNA, 15 bp, Homo sapiens
taattaactcacagt

SEQ ID NO: 397930 - DNA, 15 bp, Homo sapiens
aattaactcacagtt

SEQ ID NO: 397931 - DNA, 15 bp, Homo sapiens
attaactcacagttc

SEQ ID NO: 397932 - DNA, 15 bp, Homo sapiens
ttaactcacagttcc

SEQ ID NO: 397933 - DNA, 15 bp, Homo sapiens
taactcacagttcca

SEQ ID NO: 397934 - DNA, 15 bp, Homo sapiens
aactcacagttccac

SEQ ID NO: 397935 - DNA, 15 bp, Homo sapiens
actcacagttccaca

SEQ ID NO: 397936 - DNA, 15 bp, Homo sapiens
ctcacagttccacat

SEQ ID NO: 397937 - DNA, 15 bp, Homo sapiens
tcacagttccacatg

SEQ ID NO: 397938 - DNA, 15 bp, Homo sapiens
tccacatggctgggg

SEQ ID NO: 397939 - DNA, 15 bp, Homo sapiens
ccacatggctgggga

SEQ ID NO: 397940 - DNA, 15 bp, Homo sapiens
cacatggctggggag

SEQ ID NO: 397941 - DNA, 15 bp, Homo sapiens
acatggctggggagg

SEQ ID NO: 397942 - DNA, 15 bp, Homo sapiens
catggctggggaggc

SEQ ID NO: 397943 - DNA, 15 bp, Homo sapiens
atggctggggaggcc

SEQ ID NO: 397944 - DNA, 15 bp, Homo sapiens
tggctggggaggcct

SEQ ID NO: 397945 - DNA, 15 bp, Homo sapiens
gaggcctcacaatcg

SEQ ID NO: 397946 - DNA, 15 bp, Homo sapiens
aggcctcacaatcgt

SEQ ID NO: 397947 - DNA, 15 bp, Homo sapiens
ggcctcacaatcgtg

SEQ ID NO: 397948 - DNA, 15 bp, Homo sapiens
gcctcacaatcgtgg

SEQ ID NO: 397949 - DNA, 15 bp, Homo sapiens
cctcacaatcgtggt

SEQ ID NO: 397950 - DNA, 15 bp, Homo sapiens
ctcacaatcgtggtg

SEQ ID NO: 397951 - DNA, 15 bp, Homo sapiens
tcacaatcgtggtgg

SEQ ID NO: 397952 - DNA, 15 bp, Homo sapiens
cacaatcgtggtgga

SEQ ID NO: 397953 - DNA, 15 bp, Homo sapiens
acaatcgtggtggaa

SEQ ID NO: 397954 - DNA, 15 bp, Homo sapiens
caatcgtggtggaag

SEQ ID NO: 397955 - DNA, 15 bp, Homo sapiens
aatcgtggtggaagg

SEQ ID NO: 397956 - DNA, 15 bp, Homo sapiens
atcgtggtggaaggc

SEQ ID NO: 397957 - DNA, 15 bp, Homo sapiens
tcgtggtggaaggca

SEQ ID NO: 397958 - DNA, 15 bp, Homo sapiens
cgtggtggaaggcaa

SEQ ID NO: 397959 - DNA, 15 bp, Homo sapiens
gtggtggaaggcaaa

SEQ ID NO: 397960 - DNA, 15 bp, Homo sapiens
gtggaaggcaaagga

SEQ ID NO: 397961 - DNA, 15 bp, Homo sapiens
tggaaggcaaaggag

SEQ ID NO: 397962 - DNA, 15 bp, Homo sapiens
ggaaggcaaaggagg

SEQ ID NO: 397963 - DNA, 15 bp, Homo sapiens
gaaggcaaaggagga

SEQ ID NO: 397964 - DNA, 15 bp, Homo sapiens
aaggcaaaggaggag

SEQ ID NO: 397965 - DNA, 15 bp, Homo sapiens
aggcaaaggaggagc

SEQ ID NO: 397966 - DNA, 15 bp, Homo sapiens
ggcaaaggaggagca

SEQ ID NO: 397967 - DNA, 15 bp, Homo sapiens
cgtcttgcatggcgg

SEQ ID NO: 397968 - DNA, 15 bp, Homo sapiens
gtcttgcatggcggt

SEQ ID NO: 397969 - DNA, 15 bp, Homo sapiens
tcttgcatggcggtg

SEQ ID NO: 397970 - DNA, 15 bp, Homo sapiens
cttgcatggcggtgg

SEQ ID NO: 397971 - DNA, 15 bp, Homo sapiens
ttgcatggcggtggg

SEQ ID NO: 397972 - DNA, 15 bp, Homo sapiens
tgcatggcggtgggc

SEQ ID NO: 397973 - DNA, 15 bp, Homo sapiens
gcatggcggtgggcc

SEQ ID NO: 397974 - DNA, 15 bp, Homo sapiens
catggcggtgggcca

SEQ ID NO: 397975 - DNA, 15 bp, Homo sapiens
atggcggtgggccag

SEQ ID NO: 397976 - DNA, 15 bp, Homo sapiens
tggcggtgggccaga

SEQ ID NO: 397977 - DNA, 15 bp, Homo sapiens
ggcggtgggccagag

SEQ ID NO: 397978 - DNA, 15 bp, Homo sapiens
gcggtgggccagaga

SEQ ID NO: 397979 - DNA, 15 bp, Homo sapiens
cggtgggccagagag

SEQ ID NO: 397980 - DNA, 15 bp, Homo sapiens
ggtgggccagagagt

SEQ ID NO: 397981 - DNA, 15 bp, Homo sapiens
gtgggccagagagtg

SEQ ID NO: 397982 - DNA, 15 bp, Homo sapiens
tgggccagagagtgt

SEQ ID NO: 397983 - DNA, 15 bp, Homo sapiens
gggccagagagtgtg

SEQ ID NO: 397984 - DNA, 15 bp, Homo sapiens
ggccagagagtgtgt

SEQ ID NO: 397985 - DNA, 15 bp, Homo sapiens
gccagagagtgtgtg

SEQ ID NO: 397986 - DNA, 15 bp, Homo sapiens
ccagagagtgtgtga

SEQ ID NO: 397987 - DNA, 15 bp, Homo sapiens
cagagagtgtgtgag

SEQ ID NO: 397988 - DNA, 15 bp, Homo sapiens
agagagtgtgtgagg

SEQ ID NO: 397989 - DNA, 15 bp, Homo sapiens
gagagtgtgtgaggg

SEQ ID NO: 397990 - DNA, 15 bp, Homo sapiens
agagtgtgtgagggg

SEQ ID NO: 397991 - DNA, 15 bp, Homo sapiens
gagtgtgtgagggga

SEQ ID NO: 397992 - DNA, 15 bp, Homo sapiens
agtgtgtgaggggaa

SEQ ID NO: 397993 - DNA, 15 bp, Homo sapiens
gtgtgtgaggggaac

SEQ ID NO: 397994 - DNA, 15 bp, Homo sapiens
tgtgtgaggggaact

SEQ ID NO: 397995 - DNA, 15 bp, Homo sapiens
gtgtgaggggaactc

SEQ ID NO: 397996 - DNA, 15 bp, Homo sapiens
tgtgaggggaactcc

SEQ ID NO: 397997 - DNA, 15 bp, Homo sapiens
gtgaggggaactccc

SEQ ID NO: 397998 - DNA, 15 bp, Homo sapiens
tgaggggaactcccc

SEQ ID NO: 397999 - DNA, 15 bp, Homo sapiens
gaggggaactcccct

SEQ ID NO: 398000 - DNA, 15 bp, Homo sapiens
aggggaactcccctt

SEQ ID NO: 398001 - DNA, 15 bp, Homo sapiens
ggggaactccccttc

SEQ ID NO: 398002 - DNA, 15 bp, Homo sapiens
gggaactccccttca

SEQ ID NO: 398003 - DNA, 15 bp, Homo sapiens
ggaactccccttcat

SEQ ID NO: 398004 - DNA, 15 bp, Homo sapiens
gaactccccttcata

SEQ ID NO: 398005 - DNA, 15 bp, Homo sapiens
aactccccttcataa

SEQ ID NO: 398006 - DNA, 15 bp, Homo sapiens
actccccttcataaa

SEQ ID NO: 398007 - DNA, 15 bp, Homo sapiens
ctccccttcataaaa

SEQ ID NO: 398008 - DNA, 15 bp, Homo sapiens
tccccttcataaaac

SEQ ID NO: 398009 - DNA, 15 bp, Homo sapiens
ccccttcataaaacc

SEQ ID NO: 398010 - DNA, 15 bp, Homo sapiens
cccttcataaaacca

SEQ ID NO: 398011 - DNA, 15 bp, Homo sapiens
ccttcataaaaccat

SEQ ID NO: 398012 - DNA, 15 bp, Homo sapiens
cttcataaaaccatc

SEQ ID NO: 398013 - DNA, 15 bp, Homo sapiens
ttcataaaaccatca

SEQ ID NO: 398014 - DNA, 15 bp, Homo sapiens
tcataaaaccatcag

SEQ ID NO: 398015 - DNA, 15 bp, Homo sapiens
cataaaaccatcaga

SEQ ID NO: 398016 - DNA, 15 bp, Homo sapiens
gacttattcactatt

SEQ ID NO: 398017 - DNA, 15 bp, Homo sapiens
acttattcactatta

SEQ ID NO: 398018 - DNA, 15 bp, Homo sapiens
cttattcactattat

SEQ ID NO: 398019 - DNA, 15 bp, Homo sapiens
ttattcactattatg

SEQ ID NO: 398020 - DNA, 15 bp, Homo sapiens
tattcactattatga

SEQ ID NO: 398021 - DNA, 15 bp, Homo sapiens
attcactattatgag

SEQ ID NO: 398022 - DNA, 15 bp, Homo sapiens
ttcactattatgaga

SEQ ID NO: 398023 - DNA, 15 bp, Homo sapiens
tcactattatgagag

SEQ ID NO: 398024 - DNA, 15 bp, Homo sapiens
cactattatgagagc

SEQ ID NO: 398025 - DNA, 15 bp, Homo sapiens
actattatgagagca

SEQ ID NO: 398026 - DNA, 15 bp, Homo sapiens
ctattatgagagcag

SEQ ID NO: 398027 - DNA, 15 bp, Homo sapiens
tattatgagagcagc

SEQ ID NO: 398028 - DNA, 15 bp, Homo sapiens
attatgagagcagca

SEQ ID NO: 398029 - DNA, 15 bp, Homo sapiens
ttatgagagcagcat

SEQ ID NO: 398030 - DNA, 15 bp, Homo sapiens
tatgagagcagcatg

SEQ ID NO: 398031 - DNA, 15 bp, Homo sapiens
atgagagcagcatgg

SEQ ID NO: 398032 - DNA, 15 bp, Homo sapiens
tgagagcagcatggg

SEQ ID NO: 398033 - DNA, 15 bp, Homo sapiens
gagagcagcatggga

SEQ ID NO: 398034 - DNA, 15 bp, Homo sapiens
agagcagcatgggaa

SEQ ID NO: 398035 - DNA, 15 bp, Homo sapiens
gagcagcatgggaaa

SEQ ID NO: 398036 - DNA, 15 bp, Homo sapiens
agcagcatgggaaaa

SEQ ID NO: 398037 - DNA, 15 bp, Homo sapiens
gcagcatgggaaaaa

SEQ ID NO: 398038 - DNA, 15 bp, Homo sapiens
catgggaaaaacctt

SEQ ID NO: 398039 - DNA, 15 bp, Homo sapiens
atgggaaaaaccttt

SEQ ID NO: 398040 - DNA, 15 bp, Homo sapiens
tgggaaaaacctttc

SEQ ID NO: 398041 - DNA, 15 bp, Homo sapiens
gggaaaaacctttcc

SEQ ID NO: 398042 - DNA, 15 bp, Homo sapiens
ggaaaaacctttccc

SEQ ID NO: 398043 - DNA, 15 bp, Homo sapiens
gaaaaacctttcccc

SEQ ID NO: 398044 - DNA, 15 bp, Homo sapiens
aaaaacctttccccc

SEQ ID NO: 398045 - DNA, 15 bp, Homo sapiens
aaaacctttccccct

SEQ ID NO: 398046 - DNA, 15 bp, Homo sapiens
aaacctttccccctg

SEQ ID NO: 398047 - DNA, 15 bp, Homo sapiens
aacctttccccctga

SEQ ID NO: 398048 - DNA, 15 bp, Homo sapiens
acctttccccctgat

SEQ ID NO: 398049 - DNA, 15 bp, Homo sapiens
cctttccccctgatt

SEQ ID NO: 398050 - DNA, 15 bp, Homo sapiens
ctttccccctgattc

SEQ ID NO: 398051 - DNA, 15 bp, Homo sapiens
tttccccctgattca

SEQ ID NO: 398052 - DNA, 15 bp, Homo sapiens
ttccccctgattcag

SEQ ID NO: 398053 - DNA, 15 bp, Homo sapiens
tccccctgattcagt

SEQ ID NO: 398054 - DNA, 15 bp, Homo sapiens
ccccctgattcagtt

SEQ ID NO: 398055 - DNA, 15 bp, Homo sapiens
cccctgattcagtta

SEQ ID NO: 398056 - DNA, 15 bp, Homo sapiens
ccctgattcagttac

SEQ ID NO: 398057 - DNA, 15 bp, Homo sapiens
cctgattcagttacc

SEQ ID NO: 398058 - DNA, 15 bp, Homo sapiens
ctgattcagttacct

SEQ ID NO: 398059 - DNA, 15 bp, Homo sapiens
cagttacctcccaca

SEQ ID NO: 398060 - DNA, 15 bp, Homo sapiens
agttacctcccacaa

SEQ ID NO: 398061 - DNA, 15 bp, Homo sapiens
gttacctcccacaat

SEQ ID NO: 398062 - DNA, 15 bp, Homo sapiens
ttacctcccacaata

SEQ ID NO: 398063 - DNA, 15 bp, Homo sapiens
tacctcccacaatac

SEQ ID NO: 398064 - DNA, 15 bp, Homo sapiens
acctcccacaatacg

SEQ ID NO: 398065 - DNA, 15 bp, Homo sapiens
cctcccacaatacgt

SEQ ID NO: 398066 - DNA, 15 bp, Homo sapiens
ctcccacaatacgtg

SEQ ID NO: 398067 - DNA, 15 bp, Homo sapiens
tcccacaatacgtgg

SEQ ID NO: 398068 - DNA, 15 bp, Homo sapiens
cccacaatacgtggg

SEQ ID NO: 398069 - DNA, 15 bp, Homo sapiens
ccacaatacgtgggg

SEQ ID NO: 398070 - DNA, 15 bp, Homo sapiens
cacaatacgtgggga

SEQ ID NO: 398071 - DNA, 15 bp, Homo sapiens
acaatacgtggggat

SEQ ID NO: 398072 - DNA, 15 bp, Homo sapiens
caatacgtggggatt

SEQ ID NO: 398073 - DNA, 15 bp, Homo sapiens
aatacgtggggatta

SEQ ID NO: 398074 - DNA, 15 bp, Homo sapiens
atacgtggggattat

SEQ ID NO: 398075 - DNA, 15 bp, Homo sapiens
tacgtggggattatt

SEQ ID NO: 398076 - DNA, 15 bp, Homo sapiens
acgtggggattatta

SEQ ID NO: 398077 - DNA, 15 bp, Homo sapiens
cgtggggattattac

SEQ ID NO: 398078 - DNA, 15 bp, Homo sapiens
gtggggattattaca

SEQ ID NO: 398079 - DNA, 15 bp, Homo sapiens
tggggattattacaa

SEQ ID NO: 398080 - DNA, 15 bp, Homo sapiens
attattacaattcaa

SEQ ID NO: 398081 - DNA, 15 bp, Homo sapiens
ttattacaattcaag

SEQ ID NO: 398082 - DNA, 15 bp, Homo sapiens
tattacaattcaagg

SEQ ID NO: 398083 - DNA, 15 bp, Homo sapiens
attacaattcaaggt

SEQ ID NO: 398084 - DNA, 15 bp, Homo sapiens
ttacaattcaaggtg

SEQ ID NO: 398085 - DNA, 15 bp, Homo sapiens
tacaattcaaggtga

SEQ ID NO: 398086 - DNA, 15 bp, Homo sapiens
acaattcaaggtgag

SEQ ID NO: 398087 - DNA, 15 bp, Homo sapiens
caattcaaggtgaga

SEQ ID NO: 398088 - DNA, 15 bp, Homo sapiens
aaggtgagatttgga

SEQ ID NO: 398089 - DNA, 15 bp, Homo sapiens
aggtgagatttggat

SEQ ID NO: 398090 - DNA, 15 bp, Homo sapiens
ggtgagatttggatg

SEQ ID NO: 398091 - DNA, 15 bp, Homo sapiens
gtgagatttggatgg

SEQ ID NO: 398092 - DNA, 15 bp, Homo sapiens
tgagatttggatggg

SEQ ID NO: 398093 - DNA, 15 bp, Homo sapiens
gagatttggatgggg

SEQ ID NO: 398094 - DNA, 15 bp, Homo sapiens
agatttggatgggga

SEQ ID NO: 398095 - DNA, 15 bp, Homo sapiens
gatttggatggggac

SEQ ID NO: 398096 - DNA, 15 bp, Homo sapiens
atttggatggggaca

SEQ ID NO: 398097 - DNA, 15 bp, Homo sapiens
tttggatggggacac

SEQ ID NO: 398098 - DNA, 15 bp, Homo sapiens
tggatggggacacag

SEQ ID NO: 398099 - DNA, 15 bp, Homo sapiens
ggatggggacacaga

SEQ ID NO: 398100 - DNA, 15 bp, Homo sapiens
gatggggacacagag

SEQ ID NO: 398101 - DNA, 15 bp, Homo sapiens
atggggacacagagc

SEQ ID NO: 398102 - DNA, 15 bp, Homo sapiens
gccaaaccatatcat

SEQ ID NO: 398103 - DNA, 15 bp, Homo sapiens
ccaaaccatatcatc

SEQ ID NO: 398104 - DNA, 15 bp, Homo sapiens
caaaccatatcatcc

SEQ ID NO: 398105 - DNA, 15 bp, Homo sapiens
aaaccatatcatcct

SEQ ID NO: 398106 - DNA, 15 bp, Homo sapiens
aaccatatcatcctg

SEQ ID NO: 398107 - DNA, 15 bp, Homo sapiens
accatatcatcctga

SEQ ID NO: 398108 - DNA, 15 bp, Homo sapiens
ccatatcatcctgat

SEQ ID NO: 398109 - DNA, 15 bp, Homo sapiens
catatcatcctgata

SEQ ID NO: 398110 - DNA, 15 bp, Homo sapiens
atatcatcctgatac

SEQ ID NO: 398111 - DNA, 15 bp, Homo sapiens
tatcatcctgataca

SEQ ID NO: 398112 - DNA, 15 bp, Homo sapiens
atcatcctgatacaa

SEQ ID NO: 398113 - DNA, 15 bp, Homo sapiens
tcatcctgatacaaa

SEQ ID NO: 398114 - DNA, 15 bp, Homo sapiens
catcctgatacaaaa

SEQ ID NO: 398115 - DNA, 15 bp, Homo sapiens
atcctgatacaaaac

SEQ ID NO: 398116 - DNA, 15 bp, Homo sapiens
tcctgatacaaaaca

SEQ ID NO: 398117 - DNA, 15 bp, Homo sapiens
cctgatacaaaacag

SEQ ID NO: 398118 - DNA, 15 bp, Homo sapiens
ctgatacaaaacagg

SEQ ID NO: 398119 - DNA, 15 bp, Homo sapiens
tgatacaaaacaggt

SEQ ID NO: 398120 - DNA, 15 bp, Homo sapiens
gatacaaaacaggtc

SEQ ID NO: 398121 - DNA, 15 bp, Homo sapiens
atacaaaacaggtca

SEQ ID NO: 398122 - DNA, 15 bp, Homo sapiens
tacaaaacaggtcat

SEQ ID NO: 398123 - DNA, 15 bp, Homo sapiens
acaaaacaggtcatt

SEQ ID NO: 398124 - DNA, 15 bp, Homo sapiens
caaaacaggtcatta

SEQ ID NO: 398125 - DNA, 15 bp, Homo sapiens
aaaacaggtcattaa

SEQ ID NO: 398126 - DNA, 15 bp, Homo sapiens
aaacaggtcattaat

SEQ ID NO: 398127 - DNA, 15 bp, Homo sapiens
aacaggtcattaata

SEQ ID NO: 398128 - DNA, 15 bp, Homo sapiens
acaggtcattaataa

SEQ ID NO: 398129 - DNA, 15 bp, Homo sapiens
caggtcattaataaa

SEQ ID NO: 398130 - DNA, 15 bp, Homo sapiens
aggtcattaataaat

SEQ ID NO: 398131 - DNA, 15 bp, Homo sapiens
ggtcattaataaata

SEQ ID NO: 398132 - DNA, 15 bp, Homo sapiens
gtcattaataaatat

SEQ ID NO: 398133 - DNA, 15 bp, Homo sapiens
tcattaataaatatt

SEQ ID NO: 398134 - DNA, 15 bp, Homo sapiens
cattaataaatattt

SEQ ID NO: 398135 - DNA, 15 bp, Homo sapiens
attaataaatattta

SEQ ID NO: 398136 - DNA, 15 bp, Homo sapiens
ttaataaatatttat

SEQ ID NO: 398137 - DNA, 15 bp, Homo sapiens
aataaatatttattg

SEQ ID NO: 398138 - DNA, 15 bp, Homo sapiens
ataaatatttattga

SEQ ID NO: 398139 - DNA, 15 bp, Homo sapiens
taaatatttattgaa

SEQ ID NO: 398140 - DNA, 15 bp, Homo sapiens
aaatatttattgaat

SEQ ID NO: 398141 - DNA, 15 bp, Homo sapiens
aatatttattgaata

SEQ ID NO: 398142 - DNA, 15 bp, Homo sapiens
atatttattgaatag

SEQ ID NO: 398143 - DNA, 15 bp, Homo sapiens
tatttattgaataga

SEQ ID NO: 398144 - DNA, 15 bp, Homo sapiens
atttattgaatagaa

SEQ ID NO: 398145 - DNA, 15 bp, Homo sapiens
tttattgaatagaat

SEQ ID NO: 398146 - DNA, 15 bp, Homo sapiens
ttattgaatagaatt

SEQ ID NO: 398147 - DNA, 15 bp, Homo sapiens
tattgaatagaattg

SEQ ID NO: 398148 - DNA, 15 bp, Homo sapiens
attgaatagaattga

SEQ ID NO: 398149 - DNA, 15 bp, Homo sapiens
ttgaatagaattgag

SEQ ID NO: 398150 - DNA, 15 bp, Homo sapiens
tgaatagaattgagc

SEQ ID NO: 398151 - DNA, 15 bp, Homo sapiens
gaatagaattgagct

SEQ ID NO: 398152 - DNA, 15 bp, Homo sapiens
aatagaattgagctg

SEQ ID NO: 398153 - DNA, 15 bp, Homo sapiens
atagaattgagctgg

SEQ ID NO: 398154 - DNA, 15 bp, Homo sapiens
tagaattgagctgga

SEQ ID NO: 398155 - DNA, 15 bp, Homo sapiens
agaattgagctggag

SEQ ID NO: 398156 - DNA, 15 bp, Homo sapiens
gaattgagctggaga

SEQ ID NO: 398157 - DNA, 15 bp, Homo sapiens
aattgagctggagag

SEQ ID NO: 398158 - DNA, 15 bp, Homo sapiens
attgagctggagagt

SEQ ID NO: 398159 - DNA, 15 bp, Homo sapiens
ttgagctggagagtt

SEQ ID NO: 398160 - DNA, 15 bp, Homo sapiens
tgagctggagagttt

SEQ ID NO: 398161 - DNA, 15 bp, Homo sapiens
gagctggagagtttg

SEQ ID NO: 398162 - DNA, 15 bp, Homo sapiens
agctggagagtttgt

SEQ ID NO: 398163 - DNA, 15 bp, Homo sapiens
gctggagagtttgtt

SEQ ID NO: 398164 - DNA, 15 bp, Homo sapiens
ctggagagtttgtta

SEQ ID NO: 398165 - DNA, 15 bp, Homo sapiens
tggagagtttgttat

SEQ ID NO: 398166 - DNA, 15 bp, Homo sapiens
ggagagtttgttata

SEQ ID NO: 398167 - DNA, 15 bp, Homo sapiens
gagagtttgttatat

SEQ ID NO: 398168 - DNA, 15 bp, Homo sapiens
agagtttgttatatg

SEQ ID NO: 398169 - DNA, 15 bp, Homo sapiens
gagtttgttatatgc

SEQ ID NO: 398170 - DNA, 15 bp, Homo sapiens
agtttgttatatgca

SEQ ID NO: 398171 - DNA, 15 bp, Homo sapiens
gtttgttatatgcat

SEQ ID NO: 398172 - DNA, 15 bp, Homo sapiens
tttgttatatgcata

SEQ ID NO: 398173 - DNA, 15 bp, Homo sapiens
ttgttatatgcatat

SEQ ID NO: 398174 - DNA, 15 bp, Homo sapiens
tgttatatgcatatt

SEQ ID NO: 398175 - DNA, 15 bp, Homo sapiens
gttatatgcatattt

SEQ ID NO: 398176 - DNA, 15 bp, Homo sapiens
ttatatgcatattta

SEQ ID NO: 398177 - DNA, 15 bp, Homo sapiens
tatatgcatatttaa

SEQ ID NO: 398178 - DNA, 15 bp, Homo sapiens
atatgcatatttaag

SEQ ID NO: 398179 - DNA, 15 bp, Homo sapiens
tatgcatatttaagt

SEQ ID NO: 398180 - DNA, 15 bp, Homo sapiens
atgcatatttaagtt

SEQ ID NO: 398181 - DNA, 15 bp, Homo sapiens
tgcatatttaagtta

SEQ ID NO: 398182 - DNA, 15 bp, Homo sapiens
gcatatttaagttac

SEQ ID NO: 398183 - DNA, 15 bp, Homo sapiens
catatttaagttact

SEQ ID NO: 398184 - DNA, 15 bp, Homo sapiens
atatttaagttactc

SEQ ID NO: 398185 - DNA, 15 bp, Homo sapiens
tatttaagttactct

SEQ ID NO: 398186 - DNA, 15 bp, Homo sapiens
atttaagttactctg

SEQ ID NO: 398187 - DNA, 15 bp, Homo sapiens
tttaagttactctgc

SEQ ID NO: 398188 - DNA, 15 bp, Homo sapiens
ttaagttactctgca

SEQ ID NO: 398189 - DNA, 15 bp, Homo sapiens
taagttactctgcat

SEQ ID NO: 398190 - DNA, 15 bp, Homo sapiens
aagttactctgcata

SEQ ID NO: 398191 - DNA, 15 bp, Homo sapiens
agttactctgcatac

SEQ ID NO: 398192 - DNA, 15 bp, Homo sapiens
gttactctgcatacc

SEQ ID NO: 398193 - DNA, 15 bp, Homo sapiens
ttactctgcatacca

SEQ ID NO: 398194 - DNA, 15 bp, Homo sapiens
tactctgcataccat

SEQ ID NO: 398195 - DNA, 15 bp, Homo sapiens
actctgcataccatt

SEQ ID NO: 398196 - DNA, 15 bp, Homo sapiens
ctctgcataccatta

SEQ ID NO: 398197 - DNA, 15 bp, Homo sapiens
tctgcataccattaa

SEQ ID NO: 398198 - DNA, 15 bp, Homo sapiens
ctgcataccattaat

SEQ ID NO: 398199 - DNA, 15 bp, Homo sapiens
tgcataccattaata

SEQ ID NO: 398200 - DNA, 15 bp, Homo sapiens
gcataccattaatat

SEQ ID NO: 398201 - DNA, 15 bp, Homo sapiens
cataccattaatatg

SEQ ID NO: 398202 - DNA, 15 bp, Homo sapiens
ataccattaatatgt

SEQ ID NO: 398203 - DNA, 15 bp, Homo sapiens
taccattaatatgtt

SEQ ID NO: 398204 - DNA, 15 bp, Homo sapiens
accattaatatgttt

SEQ ID NO: 398205 - DNA, 15 bp, Homo sapiens
ccattaatatgtttc

SEQ ID NO: 398206 - DNA, 15 bp, Homo sapiens
cattaatatgtttcc

SEQ ID NO: 398207 - DNA, 15 bp, Homo sapiens
attaatatgtttcct

SEQ ID NO: 398208 - DNA, 15 bp, Homo sapiens
ttaatatgtttcctc

SEQ ID NO: 398209 - DNA, 15 bp, Homo sapiens
taatatgtttcctcg

SEQ ID NO: 398210 - DNA, 15 bp, Homo sapiens
aatatgtttcctcgg

SEQ ID NO: 398211 - DNA, 15 bp, Homo sapiens
atatgtttcctcggt

SEQ ID NO: 398212 - DNA, 15 bp, Homo sapiens
tatgtttcctcggtt

SEQ ID NO: 398213 - DNA, 15 bp, Homo sapiens
atgtttcctcggttt

SEQ ID NO: 398214 - DNA, 15 bp, Homo sapiens
tgtttcctcggtttg

SEQ ID NO: 398215 - DNA, 15 bp, Homo sapiens
gtttcctcggtttgt

SEQ ID NO: 398216 - DNA, 15 bp, Homo sapiens
tttcctcggtttgta

SEQ ID NO: 398217 - DNA, 15 bp, Homo sapiens
ttcctcggtttgtag

SEQ ID NO: 398218 - DNA, 15 bp, Homo sapiens
tcctcggtttgtagt

SEQ ID NO: 398219 - DNA, 15 bp, Homo sapiens
cctcggtttgtagtc

SEQ ID NO: 398220 - DNA, 15 bp, Homo sapiens
ctcggtttgtagtcc

SEQ ID NO: 398221 - DNA, 15 bp, Homo sapiens
tcggtttgtagtcct

SEQ ID NO: 398222 - DNA, 15 bp, Homo sapiens
cggtttgtagtcctg

SEQ ID NO: 398223 - DNA, 15 bp, Homo sapiens
ggtttgtagtcctga

SEQ ID NO: 398224 - DNA, 15 bp, Homo sapiens
gtttgtagtcctgaa

SEQ ID NO: 398225 - DNA, 15 bp, Homo sapiens
tttgtagtcctgaag

SEQ ID NO: 398226 - DNA, 15 bp, Homo sapiens
ttgtagtcctgaaga

SEQ ID NO: 398227 - DNA, 15 bp, Homo sapiens
tgtagtcctgaagat

SEQ ID NO: 398228 - DNA, 15 bp, Homo sapiens
gtagtcctgaagatt

SEQ ID NO: 398229 - DNA, 15 bp, Homo sapiens
tagtcctgaagatta

SEQ ID NO: 398230 - DNA, 15 bp, Homo sapiens
agtcctgaagattag

SEQ ID NO: 398231 - DNA, 15 bp, Homo sapiens
gtcctgaagattagg

SEQ ID NO: 398232 - DNA, 15 bp, Homo sapiens
tcctgaagattaggc

SEQ ID NO: 398233 - DNA, 15 bp, Homo sapiens
cctgaagattaggct

SEQ ID NO: 398234 - DNA, 15 bp, Homo sapiens
ctgaagattaggctt

SEQ ID NO: 398235 - DNA, 15 bp, Homo sapiens
tgaagattaggcttg

SEQ ID NO: 398236 - DNA, 15 bp, Homo sapiens
gaagattaggcttga

SEQ ID NO: 398237 - DNA, 15 bp, Homo sapiens
aagattaggcttgag

SEQ ID NO: 398238 - DNA, 15 bp, Homo sapiens
agattaggcttgagt

SEQ ID NO: 398239 - DNA, 15 bp, Homo sapiens
gattaggcttgagtt

SEQ ID NO: 398240 - DNA, 15 bp, Homo sapiens
attaggcttgagttc

SEQ ID NO: 398241 - DNA, 15 bp, Homo sapiens
ttaggcttgagttca

SEQ ID NO: 398242 - DNA, 15 bp, Homo sapiens
taggcttgagttcag

SEQ ID NO: 398243 - DNA, 15 bp, Homo sapiens
aggcttgagttcagt

SEQ ID NO: 398244 - DNA, 15 bp, Homo sapiens
ggcttgagttcagta

SEQ ID NO: 398245 - DNA, 15 bp, Homo sapiens
gcttgagttcagtat

SEQ ID NO: 398246 - DNA, 15 bp, Homo sapiens
cttgagttcagtatt

SEQ ID NO: 398247 - DNA, 15 bp, Homo sapiens
ttgagttcagtattt

SEQ ID NO: 398248 - DNA, 15 bp, Homo sapiens
tgagttcagtattta

SEQ ID NO: 398249 - DNA, 15 bp, Homo sapiens
gagttcagtatttat

SEQ ID NO: 398250 - DNA, 15 bp, Homo sapiens
agttcagtatttatc

SEQ ID NO: 398251 - DNA, 15 bp, Homo sapiens
gttcagtatttatct

SEQ ID NO: 398252 - DNA, 15 bp, Homo sapiens
ttcagtatttatctg

SEQ ID NO: 398253 - DNA, 15 bp, Homo sapiens
tcagtatttatctgc

SEQ ID NO: 398254 - DNA, 15 bp, Homo sapiens
cagtatttatctgct

SEQ ID NO: 398255 - DNA, 15 bp, Homo sapiens
agtatttatctgctt

SEQ ID NO: 398256 - DNA, 15 bp, Homo sapiens
gtatttatctgctta

SEQ ID NO: 398257 - DNA, 15 bp, Homo sapiens
tatttatctgcttat

SEQ ID NO: 398258 - DNA, 15 bp, Homo sapiens
atttatctgcttatg

SEQ ID NO: 398259 - DNA, 15 bp, Homo sapiens
tttatctgcttatgt

SEQ ID NO: 398260 - DNA, 15 bp, Homo sapiens
ttatctgcttatgtg

SEQ ID NO: 398261 - DNA, 15 bp, Homo sapiens
tatctgcttatgtgt

SEQ ID NO: 398262 - DNA, 15 bp, Homo sapiens
atctgcttatgtgtc

SEQ ID NO: 398263 - DNA, 15 bp, Homo sapiens
tctgcttatgtgtcc

SEQ ID NO: 398264 - DNA, 15 bp, Homo sapiens
ctgcttatgtgtcct

SEQ ID NO: 398265 - DNA, 15 bp, Homo sapiens
tgcttatgtgtcctg

SEQ ID NO: 398266 - DNA, 15 bp, Homo sapiens
gcttatgtgtcctgt

SEQ ID NO: 398267 - DNA, 15 bp, Homo sapiens
cttatgtgtcctgtg

SEQ ID NO: 398268 - DNA, 15 bp, Homo sapiens
ttatgtgtcctgtgc

SEQ ID NO: 398269 - DNA, 15 bp, Homo sapiens
tatgtgtcctgtgct

SEQ ID NO: 398270 - DNA, 15 bp, Homo sapiens
atgtgtcctgtgctg

SEQ ID NO: 398271 - DNA, 15 bp, Homo sapiens
tgtgtcctgtgctgc

SEQ ID NO: 398272 - DNA, 15 bp, Homo sapiens
gtgtcctgtgctgca

SEQ ID NO: 398273 - DNA, 15 bp, Homo sapiens
tgtcctgtgctgcaa

SEQ ID NO: 398274 - DNA, 15 bp, Homo sapiens
gtcctgtgctgcaac

SEQ ID NO: 398275 - DNA, 15 bp, Homo sapiens
tcctgtgctgcaact

SEQ ID NO: 398276 - DNA, 15 bp, Homo sapiens
cctgtgctgcaactg

SEQ ID NO: 398277 - DNA, 15 bp, Homo sapiens
ctgtgctgcaactgt

SEQ ID NO: 398278 - DNA, 15 bp, Homo sapiens
tgtgctgcaactgtc

SEQ ID NO: 398279 - DNA, 15 bp, Homo sapiens
gtgctgcaactgtca

SEQ ID NO: 398280 - DNA, 15 bp, Homo sapiens
tgctgcaactgtcac

SEQ ID NO: 398281 - DNA, 15 bp, Homo sapiens
gctgcaactgtcacc

SEQ ID NO: 398282 - DNA, 15 bp, Homo sapiens
ctgcaactgtcaccc

SEQ ID NO: 398283 - DNA, 15 bp, Homo sapiens
tgcaactgtcaccct

SEQ ID NO: 398284 - DNA, 15 bp, Homo sapiens
gcaactgtcaccctc

SEQ ID NO: 398285 - DNA, 15 bp, Homo sapiens
caactgtcaccctcc

SEQ ID NO: 398286 - DNA, 15 bp, Homo sapiens
aactgtcaccctcct

SEQ ID NO: 398287 - DNA, 15 bp, Homo sapiens
actgtcaccctcctt

SEQ ID NO: 398288 - DNA, 15 bp, Homo sapiens
ctgtcaccctccttg

SEQ ID NO: 398289 - DNA, 15 bp, Homo sapiens
tgtcaccctccttgt

SEQ ID NO: 398290 - DNA, 15 bp, Homo sapiens
gtcaccctccttgtc

SEQ ID NO: 398291 - DNA, 15 bp, Homo sapiens
tcaccctccttgtcc

SEQ ID NO: 398292 - DNA, 15 bp, Homo sapiens
caccctccttgtccc

SEQ ID NO: 398293 - DNA, 15 bp, Homo sapiens
accctccttgtccct

SEQ ID NO: 398294 - DNA, 15 bp, Homo sapiens
ccctccttgtccctc

SEQ ID NO: 398295 - DNA, 15 bp, Homo sapiens
cctccttgtccctca

SEQ ID NO: 398296 - DNA, 15 bp, Homo sapiens
ctccttgtccctcat

SEQ ID NO: 398297 - DNA, 15 bp, Homo sapiens
tccttgtccctcatt

SEQ ID NO: 398298 - DNA, 15 bp, Homo sapiens
ccttgtccctcattc

SEQ ID NO: 398299 - DNA, 15 bp, Homo sapiens
cttgtccctcattca

SEQ ID NO: 398300 - DNA, 15 bp, Homo sapiens
ttgtccctcattcag

SEQ ID NO: 398301 - DNA, 15 bp, Homo sapiens
tgtccctcattcagc

SEQ ID NO: 398302 - DNA, 15 bp, Homo sapiens
gtccctcattcagcc

SEQ ID NO: 398303 - DNA, 15 bp, Homo sapiens
tccctcattcagccc

SEQ ID NO: 398304 - DNA, 15 bp, Homo sapiens
ccctcattcagccct

SEQ ID NO: 398305 - DNA, 15 bp, Homo sapiens
cctcattcagccctg

SEQ ID NO: 398306 - DNA, 15 bp, Homo sapiens
ctcattcagccctgc

SEQ ID NO: 398307 - DNA, 15 bp, Homo sapiens
tcattcagccctgct

SEQ ID NO: 398308 - DNA, 15 bp, Homo sapiens
cattcagccctgctc

SEQ ID NO: 398309 - DNA, 15 bp, Homo sapiens
attcagccctgctct

SEQ ID NO: 398310 - DNA, 15 bp, Homo sapiens
ttcagccctgctctt

SEQ ID NO: 398311 - DNA, 15 bp, Homo sapiens
tcagccctgctcttt

SEQ ID NO: 398312 - DNA, 15 bp, Homo sapiens
cagccctgctctttc

SEQ ID NO: 398313 - DNA, 15 bp, Homo sapiens
agccctgctctttca

SEQ ID NO: 398314 - DNA, 15 bp, Homo sapiens
gccctgctctttcac

SEQ ID NO: 398315 - DNA, 15 bp, Homo sapiens
ccctgctctttcaca

SEQ ID NO: 398316 - DNA, 15 bp, Homo sapiens
cctgctctttcacaa

SEQ ID NO: 398317 - DNA, 15 bp, Homo sapiens
ctgctctttcacaat

SEQ ID NO: 398318 - DNA, 15 bp, Homo sapiens
tgctctttcacaata

SEQ ID NO: 398319 - DNA, 15 bp, Homo sapiens
gctctttcacaataa

SEQ ID NO: 398320 - DNA, 15 bp, Homo sapiens
ctctttcacaataac

SEQ ID NO: 398321 - DNA, 15 bp, Homo sapiens
tctttcacaataacc

SEQ ID NO: 398322 - DNA, 15 bp, Homo sapiens
ctttcacaataacca

SEQ ID NO: 398323 - DNA, 15 bp, Homo sapiens
tttcacaataaccac

SEQ ID NO: 398324 - DNA, 15 bp, Homo sapiens
ttcacaataaccacc

SEQ ID NO: 398325 - DNA, 15 bp, Homo sapiens
tcacaataaccaccc

SEQ ID NO: 398326 - DNA, 15 bp, Homo sapiens
cacaataaccacccc

SEQ ID NO: 398327 - DNA, 15 bp, Homo sapiens
acaataaccacccca

SEQ ID NO: 398328 - DNA, 15 bp, Homo sapiens
caataaccaccccaa

SEQ ID NO: 398329 - DNA, 15 bp, Homo sapiens
aataaccaccccaag

SEQ ID NO: 398330 - DNA, 15 bp, Homo sapiens
ataaccaccccaaga

SEQ ID NO: 398331 - DNA, 15 bp, Homo sapiens
taaccaccccaagaa

SEQ ID NO: 398332 - DNA, 15 bp, Homo sapiens
aaccaccccaagaag

SEQ ID NO: 398333 - DNA, 15 bp, Homo sapiens
accaccccaagaaga

SEQ ID NO: 398334 - DNA, 15 bp, Homo sapiens
ccaccccaagaagac

SEQ ID NO: 398335 - DNA, 15 bp, Homo sapiens
caccccaagaagact

SEQ ID NO: 398336 - DNA, 15 bp, Homo sapiens
accccaagaagactt

SEQ ID NO: 398337 - DNA, 15 bp, Homo sapiens
ccccaagaagacttt

SEQ ID NO: 398338 - DNA, 15 bp, Homo sapiens
cccaagaagactttt

SEQ ID NO: 398339 - DNA, 15 bp, Homo sapiens
ccaagaagacttttc

SEQ ID NO: 398340 - DNA, 15 bp, Homo sapiens
caagaagacttttca

SEQ ID NO: 398341 - DNA, 15 bp, Homo sapiens
aagaagacttttcag

SEQ ID NO: 398342 - DNA, 15 bp, Homo sapiens
agaagacttttcaga

SEQ ID NO: 398343 - DNA, 15 bp, Homo sapiens
gaagacttttcagat

SEQ ID NO: 398344 - DNA, 15 bp, Homo sapiens
aagacttttcagatt

SEQ ID NO: 398345 - DNA, 15 bp, Homo sapiens
agacttttcagattt

SEQ ID NO: 398346 - DNA, 15 bp, Homo sapiens
gacttttcagatttt

SEQ ID NO: 398347 - DNA, 15 bp, Homo sapiens
acttttcagattttt

SEQ ID NO: 398348 - DNA, 15 bp, Homo sapiens
cttttcagatttttt

SEQ ID NO: 398349 - DNA, 15 bp, Homo sapiens
ttttcagattttttt

SEQ ID NO: 398350 - DNA, 15 bp, Homo sapiens
tttcagatttttttt

SEQ ID NO: 398351 - DNA, 15 bp, Homo sapiens
ttcagattttttttt

SEQ ID NO: 398352 - DNA, 15 bp, Homo sapiens
tcagatttttttttc

SEQ ID NO: 398353 - DNA, 15 bp, Homo sapiens
cagatttttttttca

SEQ ID NO: 398354 - DNA, 15 bp, Homo sapiens
agatttttttttcat

SEQ ID NO: 398355 - DNA, 15 bp, Homo sapiens
gatttttttttcatc

SEQ ID NO: 398356 - DNA, 15 bp, Homo sapiens
atttttttttcatct

SEQ ID NO: 398357 - DNA, 15 bp, Homo sapiens
tttttttttcatctg

SEQ ID NO: 398358 - DNA, 15 bp, Homo sapiens
ttttttttcatctgc

SEQ ID NO: 398359 - DNA, 15 bp, Homo sapiens
tttttttcatctgca

SEQ ID NO: 398360 - DNA, 15 bp, Homo sapiens
ttttttcatctgcat

SEQ ID NO: 398361 - DNA, 15 bp, Homo sapiens
tttttcatctgcatg

SEQ ID NO: 398362 - DNA, 15 bp, Homo sapiens
ttttcatctgcatgt

SEQ ID NO: 398363 - DNA, 15 bp, Homo sapiens
tttcatctgcatgta

SEQ ID NO: 398364 - DNA, 15 bp, Homo sapiens
ttcatctgcatgtaa

SEQ ID NO: 398365 - DNA, 15 bp, Homo sapiens
tcatctgcatgtaaa

SEQ ID NO: 398366 - DNA, 15 bp, Homo sapiens
catctgcatgtaaaa

SEQ ID NO: 398367 - DNA, 15 bp, Homo sapiens
atctgcatgtaaaaa

SEQ ID NO: 398368 - DNA, 15 bp, Homo sapiens
tctgcatgtaaaaaa

SEQ ID NO: 398369 - DNA, 15 bp, Homo sapiens
ctgcatgtaaaaaaa

SEQ ID NO: 398370 - DNA, 15 bp, Homo sapiens
tgcatgtaaaaaaaa

SEQ ID NO: 398371 - DNA, 15 bp, Homo sapiens
gcatgtaaaaaaaag

SEQ ID NO: 398372 - DNA, 15 bp, Homo sapiens
catgtaaaaaaaaga

SEQ ID NO: 398373 - DNA, 15 bp, Homo sapiens
atgtaaaaaaaagaa

SEQ ID NO: 398374 - DNA, 15 bp, Homo sapiens
tgtaaaaaaaagaag

SEQ ID NO: 398375 - DNA, 15 bp, Homo sapiens
gtaaaaaaaagaaga

SEQ ID NO: 398376 - DNA, 15 bp, Homo sapiens
taaaaaaaagaagaa

SEQ ID NO: 398377 - DNA, 15 bp, Homo sapiens
aaaaaaaagaagaag

SEQ ID NO: 398378 - DNA, 15 bp, Homo sapiens
aaaaaaagaagaaga

SEQ ID NO: 398379 - DNA, 15 bp, Homo sapiens
aaaaaagaagaagaa

SEQ ID NO: 398380 - DNA, 15 bp, Homo sapiens
aaaaagaagaagaaa

SEQ ID NO: 398381 - DNA, 15 bp, Homo sapiens
aaaagaagaagaaag

SEQ ID NO: 398382 - DNA, 15 bp, Homo sapiens
aaagaagaagaaaga

SEQ ID NO: 398383 - DNA, 15 bp, Homo sapiens
aagaagaagaaagaa

SEQ ID NO: 398384 - DNA, 15 bp, Homo sapiens
agaagaagaaagaag

SEQ ID NO: 398385 - DNA, 15 bp, Homo sapiens
gaagaagaaagaaga

SEQ ID NO: 398386 - DNA, 15 bp, Homo sapiens
aagaagaaagaagat

SEQ ID NO: 398387 - DNA, 15 bp, Homo sapiens
agaagaaagaagata

SEQ ID NO: 398388 - DNA, 15 bp, Homo sapiens
gaagaaagaagatac

SEQ ID NO: 398389 - DNA, 15 bp, Homo sapiens
aagaaagaagatact

SEQ ID NO: 398390 - DNA, 15 bp, Homo sapiens
agaaagaagatactt

SEQ ID NO: 398391 - DNA, 15 bp, Homo sapiens
gaaagaagatacttt

SEQ ID NO: 398392 - DNA, 15 bp, Homo sapiens
aaagaagatactttt

SEQ ID NO: 398393 - DNA, 15 bp, Homo sapiens
aagaagatactttta

SEQ ID NO: 398394 - DNA, 15 bp, Homo sapiens
agaagatacttttat

SEQ ID NO: 398395 - DNA, 15 bp, Homo sapiens
gaagatacttttatt

SEQ ID NO: 398396 - DNA, 15 bp, Homo sapiens
aagatacttttatta

SEQ ID NO: 398397 - DNA, 15 bp, Homo sapiens
agatacttttattat

SEQ ID NO: 398398 - DNA, 15 bp, Homo sapiens
gatacttttattatt

SEQ ID NO: 398399 - DNA, 15 bp, Homo sapiens
atacttttattattt

SEQ ID NO: 398400 - DNA, 15 bp, Homo sapiens
tacttttattatttt

SEQ ID NO: 398401 - DNA, 15 bp, Homo sapiens
acttttattattttg

SEQ ID NO: 398402 - DNA, 15 bp, Homo sapiens
cttttattattttgg

SEQ ID NO: 398403 - DNA, 15 bp, Homo sapiens
ttttattattttggt

SEQ ID NO: 398404 - DNA, 15 bp, Homo sapiens
tttattattttggtt

SEQ ID NO: 398405 - DNA, 15 bp, Homo sapiens
ttattattttggttt

SEQ ID NO: 398406 - DNA, 15 bp, Homo sapiens
tattattttggtttt

SEQ ID NO: 398407 - DNA, 15 bp, Homo sapiens
attattttggttttg

SEQ ID NO: 398408 - DNA, 15 bp, Homo sapiens
ttattttggttttgg

SEQ ID NO: 398409 - DNA, 15 bp, Homo sapiens
tattttggttttggt

SEQ ID NO: 398410 - DNA, 15 bp, Homo sapiens
attttggttttggtt

SEQ ID NO: 398411 - DNA, 15 bp, Homo sapiens
ttttggttttggttc

SEQ ID NO: 398412 - DNA, 15 bp, Homo sapiens
tttggttttggttct

SEQ ID NO: 398413 - DNA, 15 bp, Homo sapiens
ttggttttggttctt

SEQ ID NO: 398414 - DNA, 15 bp, Homo sapiens
tggttttggttcttc

SEQ ID NO: 398415 - DNA, 15 bp, Homo sapiens
ggttttggttcttct

SEQ ID NO: 398416 - DNA, 15 bp, Homo sapiens
gttttggttcttctc

SEQ ID NO: 398417 - DNA, 15 bp, Homo sapiens
ttttggttcttctct

SEQ ID NO: 398418 - DNA, 15 bp, Homo sapiens
tttggttcttctctc

SEQ ID NO: 398419 - DNA, 15 bp, Homo sapiens
ttggttcttctctct

SEQ ID NO: 398420 - DNA, 15 bp, Homo sapiens
tggttcttctctctt

SEQ ID NO: 398421 - DNA, 15 bp, Homo sapiens
ggttcttctctcttc

SEQ ID NO: 398422 - DNA, 15 bp, Homo sapiens
gttcttctctcttcc

SEQ ID NO: 398423 - DNA, 15 bp, Homo sapiens
ttcttctctcttccc

SEQ ID NO: 398424 - DNA, 15 bp, Homo sapiens
tcttctctcttccct

SEQ ID NO: 398425 - DNA, 15 bp, Homo sapiens
cttctctcttccctg

SEQ ID NO: 398426 - DNA, 15 bp, Homo sapiens
ttctctcttccctgc

SEQ ID NO: 398427 - DNA, 15 bp, Homo sapiens
tctctcttccctgct

SEQ ID NO: 398428 - DNA, 15 bp, Homo sapiens
ctctcttccctgctt

SEQ ID NO: 398429 - DNA, 15 bp, Homo sapiens
tctcttccctgcttt

SEQ ID NO: 398430 - DNA, 15 bp, Homo sapiens
ctcttccctgctttg

SEQ ID NO: 398431 - DNA, 15 bp, Homo sapiens
tcttccctgctttgc

SEQ ID NO: 398432 - DNA, 15 bp, Homo sapiens
cttccctgctttgcc

SEQ ID NO: 398433 - DNA, 15 bp, Homo sapiens
ttccctgctttgcct

SEQ ID NO: 398434 - DNA, 15 bp, Homo sapiens
tccctgctttgcctt

SEQ ID NO: 398435 - DNA, 15 bp, Homo sapiens
ccctgctttgccttc

SEQ ID NO: 398436 - DNA, 15 bp, Homo sapiens
cctgctttgccttcc

SEQ ID NO: 398437 - DNA, 15 bp, Homo sapiens
ctgctttgccttccc

SEQ ID NO: 398438 - DNA, 15 bp, Homo sapiens
tgctttgccttccct

SEQ ID NO: 398439 - DNA, 15 bp, Homo sapiens
gctttgccttccctt

SEQ ID NO: 398440 - DNA, 15 bp, Homo sapiens
ctttgccttcccttc

SEQ ID NO: 398441 - DNA, 15 bp, Homo sapiens
tttgccttcccttca

SEQ ID NO: 398442 - DNA, 15 bp, Homo sapiens
ttgccttcccttcat

SEQ ID NO: 398443 - DNA, 15 bp, Homo sapiens
tgccttcccttcata

SEQ ID NO: 398444 - DNA, 15 bp, Homo sapiens
gccttcccttcatac

SEQ ID NO: 398445 - DNA, 15 bp, Homo sapiens
ccttcccttcataca

SEQ ID NO: 398446 - DNA, 15 bp, Homo sapiens
cttcccttcatacat

SEQ ID NO: 398447 - DNA, 15 bp, Homo sapiens
ttcccttcatacatg

SEQ ID NO: 398448 - DNA, 15 bp, Homo sapiens
tcccttcatacatgc

SEQ ID NO: 398449 - DNA, 15 bp, Homo sapiens
cccttcatacatgca

SEQ ID NO: 398450 - DNA, 15 bp, Homo sapiens
ccttcatacatgcag

SEQ ID NO: 398451 - DNA, 15 bp, Homo sapiens
cttcatacatgcagt

SEQ ID NO: 398452 - DNA, 15 bp, Homo sapiens
ttcatacatgcagtg

SEQ ID NO: 398453 - DNA, 15 bp, Homo sapiens
tcatacatgcagtgg

SEQ ID NO: 398454 - DNA, 15 bp, Homo sapiens
catacatgcagtggt

SEQ ID NO: 398455 - DNA, 15 bp, Homo sapiens
atacatgcagtggta

SEQ ID NO: 398456 - DNA, 15 bp, Homo sapiens
tacatgcagtggtat

SEQ ID NO: 398457 - DNA, 15 bp, Homo sapiens
acatgcagtggtatt

SEQ ID NO: 398458 - DNA, 15 bp, Homo sapiens
catgcagtggtatta

SEQ ID NO: 398459 - DNA, 15 bp, Homo sapiens
atgcagtggtattag

SEQ ID NO: 398460 - DNA, 15 bp, Homo sapiens
tgcagtggtattagc

SEQ ID NO: 398461 - DNA, 15 bp, Homo sapiens
gcagtggtattagcg

SEQ ID NO: 398462 - DNA, 15 bp, Homo sapiens
cagtggtattagcgg

SEQ ID NO: 398463 - DNA, 15 bp, Homo sapiens
agtggtattagcggt

SEQ ID NO: 398464 - DNA, 15 bp, Homo sapiens
gtggtattagcggtc

SEQ ID NO: 398465 - DNA, 15 bp, Homo sapiens
tggtattagcggtca

SEQ ID NO: 398466 - DNA, 15 bp, Homo sapiens
ggtattagcggtcat

SEQ ID NO: 398467 - DNA, 15 bp, Homo sapiens
gtattagcggtcatg

SEQ ID NO: 398468 - DNA, 15 bp, Homo sapiens
tattagcggtcatgt

SEQ ID NO: 398469 - DNA, 15 bp, Homo sapiens
attagcggtcatgtc

SEQ ID NO: 398470 - DNA, 15 bp, Homo sapiens
ttagcggtcatgtcc

SEQ ID NO: 398471 - DNA, 15 bp, Homo sapiens
tagcggtcatgtccc

SEQ ID NO: 398472 - DNA, 15 bp, Homo sapiens
agcggtcatgtcccc

SEQ ID NO: 398473 - DNA, 15 bp, Homo sapiens
gcggtcatgtcccct

SEQ ID NO: 398474 - DNA, 15 bp, Homo sapiens
cggtcatgtcccctg

SEQ ID NO: 398475 - DNA, 15 bp, Homo sapiens
ggtcatgtcccctga

SEQ ID NO: 398476 - DNA, 15 bp, Homo sapiens
gtcatgtcccctgac

SEQ ID NO: 398477 - DNA, 15 bp, Homo sapiens
tcatgtcccctgacc

SEQ ID NO: 398478 - DNA, 15 bp, Homo sapiens
catgtcccctgacct

SEQ ID NO: 398479 - DNA, 15 bp, Homo sapiens
atgtcccctgacctt

SEQ ID NO: 398480 - DNA, 15 bp, Homo sapiens
tgtcccctgaccttg

SEQ ID NO: 398481 - DNA, 15 bp, Homo sapiens
gtcccctgaccttgg

SEQ ID NO: 398482 - DNA, 15 bp, Homo sapiens
tcccctgaccttggt

SEQ ID NO: 398483 - DNA, 15 bp, Homo sapiens
cccctgaccttggtt

SEQ ID NO: 398484 - DNA, 15 bp, Homo sapiens
ccctgaccttggttg

SEQ ID NO: 398485 - DNA, 15 bp, Homo sapiens
cctgaccttggttga

SEQ ID NO: 398486 - DNA, 15 bp, Homo sapiens
ctgaccttggttgag

SEQ ID NO: 398487 - DNA, 15 bp, Homo sapiens
tgaccttggttgagg

SEQ ID NO: 398488 - DNA, 15 bp, Homo sapiens
gaccttggttgaggc

SEQ ID NO: 398489 - DNA, 15 bp, Homo sapiens
accttggttgaggca

SEQ ID NO: 398490 - DNA, 15 bp, Homo sapiens
ccttggttgaggcaa

SEQ ID NO: 398491 - DNA, 15 bp, Homo sapiens
cttggttgaggcaaa

SEQ ID NO: 398492 - DNA, 15 bp, Homo sapiens
ttggttgaggcaaag

SEQ ID NO: 398493 - DNA, 15 bp, Homo sapiens
tggttgaggcaaagc

SEQ ID NO: 398494 - DNA, 15 bp, Homo sapiens
ggttgaggcaaagca

SEQ ID NO: 398495 - DNA, 15 bp, Homo sapiens
gttgaggcaaagcag

SEQ ID NO: 398496 - DNA, 15 bp, Homo sapiens
ttgaggcaaagcaga

SEQ ID NO: 398497 - DNA, 15 bp, Homo sapiens
tgaggcaaagcagag

SEQ ID NO: 398498 - DNA, 15 bp, Homo sapiens
gaggcaaagcagagg

SEQ ID NO: 398499 - DNA, 15 bp, Homo sapiens
aggcaaagcagaggg

SEQ ID NO: 398500 - DNA, 15 bp, Homo sapiens
ggcaaagcagagggt

SEQ ID NO: 398501 - DNA, 15 bp, Homo sapiens
gcaaagcagagggtg

SEQ ID NO: 398502 - DNA, 15 bp, Homo sapiens
caaagcagagggtgt

SEQ ID NO: 398503 - DNA, 15 bp, Homo sapiens
aaagcagagggtgtc

SEQ ID NO: 398504 - DNA, 15 bp, Homo sapiens
aagcagagggtgtca

SEQ ID NO: 398505 - DNA, 15 bp, Homo sapiens
agcagagggtgtcat

SEQ ID NO: 398506 - DNA, 15 bp, Homo sapiens
gcagagggtgtcata

SEQ ID NO: 398507 - DNA, 15 bp, Homo sapiens
cagagggtgtcatat

SEQ ID NO: 398508 - DNA, 15 bp, Homo sapiens
agagggtgtcatatc

SEQ ID NO: 398509 - DNA, 15 bp, Homo sapiens
gagggtgtcatatca

SEQ ID NO: 398510 - DNA, 15 bp, Homo sapiens
agggtgtcatatcag

SEQ ID NO: 398511 - DNA, 15 bp, Homo sapiens
gggtgtcatatcagt

SEQ ID NO: 398512 - DNA, 15 bp, Homo sapiens
ggtgtcatatcagtt

SEQ ID NO: 398513 - DNA, 15 bp, Homo sapiens
gtgtcatatcagttg

SEQ ID NO: 398514 - DNA, 15 bp, Homo sapiens
tgtcatatcagttgc

SEQ ID NO: 398515 - DNA, 15 bp, Homo sapiens
gtcatatcagttgca

SEQ ID NO: 398516 - DNA, 15 bp, Homo sapiens
tcatatcagttgcag

SEQ ID NO: 398517 - DNA, 15 bp, Homo sapiens
catatcagttgcagt

SEQ ID NO: 398518 - DNA, 15 bp, Homo sapiens
atatcagttgcagtg

SEQ ID NO: 398519 - DNA, 15 bp, Homo sapiens
tatcagttgcagtgg

SEQ ID NO: 398520 - DNA, 15 bp, Homo sapiens
atcagttgcagtgga

SEQ ID NO: 398521 - DNA, 15 bp, Homo sapiens
tcagttgcagtggaa

SEQ ID NO: 398522 - DNA, 15 bp, Homo sapiens
cagttgcagtggaaa

SEQ ID NO: 398523 - DNA, 15 bp, Homo sapiens
agttgcagtggaaag

SEQ ID NO: 398524 - DNA, 15 bp, Homo sapiens
gttgcagtggaaaga

SEQ ID NO: 398525 - DNA, 15 bp, Homo sapiens
ttgcagtggaaagat

SEQ ID NO: 398526 - DNA, 15 bp, Homo sapiens
tgcagtggaaagatc

SEQ ID NO: 398527 - DNA, 15 bp, Homo sapiens
gcagtggaaagatcc

SEQ ID NO: 398528 - DNA, 15 bp, Homo sapiens
cagtggaaagatcct

SEQ ID NO: 398529 - DNA, 15 bp, Homo sapiens
agtggaaagatcctt

SEQ ID NO: 398530 - DNA, 15 bp, Homo sapiens
gtggaaagatccttc

SEQ ID NO: 398531 - DNA, 15 bp, Homo sapiens
tggaaagatccttct

SEQ ID NO: 398532 - DNA, 15 bp, Homo sapiens
ggaaagatccttctc

SEQ ID NO: 398533 - DNA, 15 bp, Homo sapiens
gaaagatccttctct

SEQ ID NO: 398534 - DNA, 15 bp, Homo sapiens
aaagatccttctctg

SEQ ID NO: 398535 - DNA, 15 bp, Homo sapiens
aagatccttctctgt

SEQ ID NO: 398536 - DNA, 15 bp, Homo sapiens
agatccttctctgtc

SEQ ID NO: 398537 - DNA, 15 bp, Homo sapiens
gatccttctctgtcc

SEQ ID NO: 398538 - DNA, 15 bp, Homo sapiens
atccttctctgtcct

SEQ ID NO: 398539 - DNA, 15 bp, Homo sapiens
tccttctctgtcctt

SEQ ID NO: 398540 - DNA, 15 bp, Homo sapiens
ccttctctgtccttg

SEQ ID NO: 398541 - DNA, 15 bp, Homo sapiens
cttctctgtccttgt

SEQ ID NO: 398542 - DNA, 15 bp, Homo sapiens
ttctctgtccttgtc

SEQ ID NO: 398543 - DNA, 15 bp, Homo sapiens
tctctgtccttgtct

SEQ ID NO: 398544 - DNA, 15 bp, Homo sapiens
ctctgtccttgtctg

SEQ ID NO: 398545 - DNA, 15 bp, Homo sapiens
tctgtccttgtctgt

SEQ ID NO: 398546 - DNA, 15 bp, Homo sapiens
ctgtccttgtctgta

SEQ ID NO: 398547 - DNA, 15 bp, Homo sapiens
tgtccttgtctgtag

SEQ ID NO: 398548 - DNA, 15 bp, Homo sapiens
gtccttgtctgtagc

SEQ ID NO: 398549 - DNA, 15 bp, Homo sapiens
tccttgtctgtagct

SEQ ID NO: 398550 - DNA, 15 bp, Homo sapiens
ccttgtctgtagctg

SEQ ID NO: 398551 - DNA, 15 bp, Homo sapiens
cttgtctgtagctga

SEQ ID NO: 398552 - DNA, 15 bp, Homo sapiens
ttgtctgtagctgaa

SEQ ID NO: 398553 - DNA, 15 bp, Homo sapiens
tgtctgtagctgaac

SEQ ID NO: 398554 - DNA, 15 bp, Homo sapiens
gtctgtagctgaacc

SEQ ID NO: 398555 - DNA, 15 bp, Homo sapiens
tctgtagctgaacct

SEQ ID NO: 398556 - DNA, 15 bp, Homo sapiens
ctgtagctgaacctg

SEQ ID NO: 398557 - DNA, 15 bp, Homo sapiens
tgtagctgaacctgc

SEQ ID NO: 398558 - DNA, 15 bp, Homo sapiens
gtagctgaacctgct

SEQ ID NO: 398559 - DNA, 15 bp, Homo sapiens
tagctgaacctgcta

SEQ ID NO: 398560 - DNA, 15 bp, Homo sapiens
agctgaacctgctaa

SEQ ID NO: 398561 - DNA, 15 bp, Homo sapiens
gctgaacctgctaag

SEQ ID NO: 398562 - DNA, 15 bp, Homo sapiens
ctgaacctgctaagt

SEQ ID NO: 398563 - DNA, 15 bp, Homo sapiens
tgaacctgctaagtg

SEQ ID NO: 398564 - DNA, 15 bp, Homo sapiens
gaacctgctaagtga

SEQ ID NO: 398565 - DNA, 15 bp, Homo sapiens
aacctgctaagtgat

SEQ ID NO: 398566 - DNA, 15 bp, Homo sapiens
acctgctaagtgata

SEQ ID NO: 398567 - DNA, 15 bp, Homo sapiens
cctgctaagtgatat

SEQ ID NO: 398568 - DNA, 15 bp, Homo sapiens
ctgctaagtgatatt

SEQ ID NO: 398569 - DNA, 15 bp, Homo sapiens
tgctaagtgatattc

SEQ ID NO: 398570 - DNA, 15 bp, Homo sapiens
gctaagtgatattcc

SEQ ID NO: 398571 - DNA, 15 bp, Homo sapiens
ctaagtgatattccc

SEQ ID NO: 398572 - DNA, 15 bp, Homo sapiens
taagtgatattccct

SEQ ID NO: 398573 - DNA, 15 bp, Homo sapiens
aagtgatattccctt

SEQ ID NO: 398574 - DNA, 15 bp, Homo sapiens
agtgatattcccttc

SEQ ID NO: 398575 - DNA, 15 bp, Homo sapiens
gtgatattcccttct

SEQ ID NO: 398576 - DNA, 15 bp, Homo sapiens
tgatattcccttcta

SEQ ID NO: 398577 - DNA, 15 bp, Homo sapiens
gatattcccttctag

SEQ ID NO: 398578 - DNA, 15 bp, Homo sapiens
atattcccttctagt

SEQ ID NO: 398579 - DNA, 15 bp, Homo sapiens
tattcccttctagta

SEQ ID NO: 398580 - DNA, 15 bp, Homo sapiens
attcccttctagtat

SEQ ID NO: 398581 - DNA, 15 bp, Homo sapiens
ttcccttctagtatg

SEQ ID NO: 398582 - DNA, 15 bp, Homo sapiens
tcccttctagtatga

SEQ ID NO: 398583 - DNA, 15 bp, Homo sapiens
cccttctagtatgag

SEQ ID NO: 398584 - DNA, 15 bp, Homo sapiens
ccttctagtatgagg

SEQ ID NO: 398585 - DNA, 15 bp, Homo sapiens
cttctagtatgagga

SEQ ID NO: 398586 - DNA, 15 bp, Homo sapiens
ttctagtatgaggat

SEQ ID NO: 398587 - DNA, 15 bp, Homo sapiens
tctagtatgaggatg

SEQ ID NO: 398588 - DNA, 15 bp, Homo sapiens
ctagtatgaggatgg

SEQ ID NO: 398589 - DNA, 15 bp, Homo sapiens
tagtatgaggatgga

SEQ ID NO: 398590 - DNA, 15 bp, Homo sapiens
agtatgaggatggag

SEQ ID NO: 398591 - DNA, 15 bp, Homo sapiens
gtatgaggatggagt

SEQ ID NO: 398592 - DNA, 15 bp, Homo sapiens
tatgaggatggagta

SEQ ID NO: 398593 - DNA, 15 bp, Homo sapiens
atgaggatggagtac

SEQ ID NO: 398594 - DNA, 15 bp, Homo sapiens
tgaggatggagtaca

SEQ ID NO: 398595 - DNA, 15 bp, Homo sapiens
gaggatggagtacaa

SEQ ID NO: 398596 - DNA, 15 bp, Homo sapiens
aggatggagtacaag

SEQ ID NO: 398597 - DNA, 15 bp, Homo sapiens
ggatggagtacaagt

SEQ ID NO: 398598 - DNA, 15 bp, Homo sapiens
gatggagtacaagtt

SEQ ID NO: 398599 - DNA, 15 bp, Homo sapiens
atggagtacaagttt

SEQ ID NO: 398600 - DNA, 15 bp, Homo sapiens
tggagtacaagtttt

SEQ ID NO: 398601 - DNA, 15 bp, Homo sapiens
ggagtacaagttttt

SEQ ID NO: 398602 - DNA, 15 bp, Homo sapiens
gagtacaagtttttg

SEQ ID NO: 398603 - DNA, 15 bp, Homo sapiens
agtacaagtttttga

SEQ ID NO: 398604 - DNA, 15 bp, Homo sapiens
gtacaagtttttgag

SEQ ID NO: 398605 - DNA, 15 bp, Homo sapiens
tacaagtttttgagg

SEQ ID NO: 398606 - DNA, 15 bp, Homo sapiens
acaagtttttgaggt

SEQ ID NO: 398607 - DNA, 15 bp, Homo sapiens
caagtttttgaggtt

SEQ ID NO: 398608 - DNA, 15 bp, Homo sapiens
aagtttttgaggttg

SEQ ID NO: 398609 - DNA, 15 bp, Homo sapiens
agtttttgaggttgc

SEQ ID NO: 398610 - DNA, 15 bp, Homo sapiens
gtttttgaggttgca

SEQ ID NO: 398611 - DNA, 15 bp, Homo sapiens
ttgaggttgcattgc

SEQ ID NO: 398612 - DNA, 15 bp, Homo sapiens
tgaggttgcattgct

SEQ ID NO: 398613 - DNA, 15 bp, Homo sapiens
gaggttgcattgctg

SEQ ID NO: 398614 - DNA, 15 bp, Homo sapiens
aggttgcattgctga

SEQ ID NO: 398615 - DNA, 15 bp, Homo sapiens
ggttgcattgctgaa

SEQ ID NO: 398616 - DNA, 15 bp, Homo sapiens
gttgcattgctgaag

SEQ ID NO: 398617 - DNA, 15 bp, Homo sapiens
ttgcattgctgaagg

SEQ ID NO: 398618 - DNA, 15 bp, Homo sapiens
tgcattgctgaaggt

SEQ ID NO: 398619 - DNA, 15 bp, Homo sapiens
gcattgctgaaggta

SEQ ID NO: 398620 - DNA, 15 bp, Homo sapiens
cattgctgaaggtaa

SEQ ID NO: 398621 - DNA, 15 bp, Homo sapiens
attgctgaaggtaaa

SEQ ID NO: 398622 - DNA, 15 bp, Homo sapiens
ttgctgaaggtaaaa

SEQ ID NO: 398623 - DNA, 15 bp, Homo sapiens
tgctgaaggtaaaac

SEQ ID NO: 398624 - DNA, 15 bp, Homo sapiens
gctgaaggtaaaacc

SEQ ID NO: 398625 - DNA, 15 bp, Homo sapiens
ctgaaggtaaaacca

SEQ ID NO: 398626 - DNA, 15 bp, Homo sapiens
tgaaggtaaaaccaa

SEQ ID NO: 398627 - DNA, 15 bp, Homo sapiens
gaaggtaaaaccaaa

SEQ ID NO: 398628 - DNA, 15 bp, Homo sapiens
aaggtaaaaccaaaa

SEQ ID NO: 398629 - DNA, 15 bp, Homo sapiens
aggtaaaaccaaaag

SEQ ID NO: 398630 - DNA, 15 bp, Homo sapiens
ggtaaaaccaaaaga

SEQ ID NO: 398631 - DNA, 15 bp, Homo sapiens
gtaaaaccaaaagag

SEQ ID NO: 398632 - DNA, 15 bp, Homo sapiens
taaaaccaaaagaga

SEQ ID NO: 398633 - DNA, 15 bp, Homo sapiens
aaaaccaaaagagag

SEQ ID NO: 398634 - DNA, 15 bp, Homo sapiens
accaaaagagagaga

SEQ ID NO: 398635 - DNA, 15 bp, Homo sapiens
ccaaaagagagagag

SEQ ID NO: 398636 - DNA, 15 bp, Homo sapiens
caaaagagagagaga

SEQ ID NO: 398637 - DNA, 15 bp, Homo sapiens
gagagagagagagaa

SEQ ID NO: 398638 - DNA, 15 bp, Homo sapiens
agagagagagagaaa

SEQ ID NO: 398639 - DNA, 15 bp, Homo sapiens
gagagagagagaaag

SEQ ID NO: 398640 - DNA, 15 bp, Homo sapiens
agagagagagaaaga

SEQ ID NO: 398641 - DNA, 15 bp, Homo sapiens
gagagagagaaagag

SEQ ID NO: 398642 - DNA, 15 bp, Homo sapiens
agagagagaaagaga

SEQ ID NO: 398643 - DNA, 15 bp, Homo sapiens
gagagagaaagagag

SEQ ID NO: 398644 - DNA, 15 bp, Homo sapiens
agagagaaagagaga

SEQ ID NO: 398645 - DNA, 15 bp, Homo sapiens
gagagaaagagagag

SEQ ID NO: 398646 - DNA, 15 bp, Homo sapiens
agagaaagagagagt

SEQ ID NO: 398647 - DNA, 15 bp, Homo sapiens
gagaaagagagagtg

SEQ ID NO: 398648 - DNA, 15 bp, Homo sapiens
agaaagagagagtga

SEQ ID NO: 398649 - DNA, 15 bp, Homo sapiens
gaaagagagagtgag

SEQ ID NO: 398650 - DNA, 15 bp, Homo sapiens
aaagagagagtgagt

SEQ ID NO: 398651 - DNA, 15 bp, Homo sapiens
aagagagagtgagtg

SEQ ID NO: 398652 - DNA, 15 bp, Homo sapiens
agagagagtgagtgt

SEQ ID NO: 398653 - DNA, 15 bp, Homo sapiens
gagagagtgagtgtg

SEQ ID NO: 398654 - DNA, 15 bp, Homo sapiens
agagagtgagtgtgt

SEQ ID NO: 398655 - DNA, 15 bp, Homo sapiens
gagagtgagtgtgtg

SEQ ID NO: 398656 - DNA, 15 bp, Homo sapiens
agagtgagtgtgtgt

SEQ ID NO: 398657 - DNA, 15 bp, Homo sapiens
gagtgagtgtgtgtg

SEQ ID NO: 398658 - DNA, 15 bp, Homo sapiens
agtgagtgtgtgtgt

SEQ ID NO: 398659 - DNA, 15 bp, Homo sapiens
gtgagtgtgtgtgtg

SEQ ID NO: 398660 - DNA, 15 bp, Homo sapiens
gtgtgtgtgtgtgag

SEQ ID NO: 398661 - DNA, 15 bp, Homo sapiens
tgtgtgtgtgtgaga

SEQ ID NO: 398662 - DNA, 15 bp, Homo sapiens
gtgtgtgtgtgagag

SEQ ID NO: 398663 - DNA, 15 bp, Homo sapiens
tgtgtgtgtgagaga

SEQ ID NO: 398664 - DNA, 15 bp, Homo sapiens
gtgtgtgtgagagag

SEQ ID NO: 398665 - DNA, 15 bp, Homo sapiens
tgtgtgtgagagaga

SEQ ID NO: 398666 - DNA, 15 bp, Homo sapiens
gtgtgtgagagagag

SEQ ID NO: 398667 - DNA, 15 bp, Homo sapiens
tgtgtgagagagaga

SEQ ID NO: 398668 - DNA, 15 bp, Homo sapiens
gtgtgagagagagag

SEQ ID NO: 398669 - DNA, 15 bp, Homo sapiens
tgtgagagagagagg

SEQ ID NO: 398670 - DNA, 15 bp, Homo sapiens
gtgagagagagaggt

SEQ ID NO: 398671 - DNA, 15 bp, Homo sapiens
tgagagagagaggtg

SEQ ID NO: 398672 - DNA, 15 bp, Homo sapiens
gagagagagaggtgt

SEQ ID NO: 398673 - DNA, 15 bp, Homo sapiens
agagagagaggtgtg

SEQ ID NO: 398674 - DNA, 15 bp, Homo sapiens
gagagagaggtgtgt

SEQ ID NO: 398675 - DNA, 15 bp, Homo sapiens
agagagaggtgtgtg

SEQ ID NO: 398676 - DNA, 15 bp, Homo sapiens
gagagaggtgtgtgt

SEQ ID NO: 398677 - DNA, 15 bp, Homo sapiens
agagaggtgtgtgtg

SEQ ID NO: 398678 - DNA, 15 bp, Homo sapiens
gagaggtgtgtgtgt

SEQ ID NO: 398679 - DNA, 15 bp, Homo sapiens
agaggtgtgtgtgtg

SEQ ID NO: 398680 - DNA, 15 bp, Homo sapiens
gaggtgtgtgtgtgt

SEQ ID NO: 398681 - DNA, 15 bp, Homo sapiens
aggtgtgtgtgtgtg

SEQ ID NO: 398682 - DNA, 15 bp, Homo sapiens
tgtgtgtgtgtgtaa

SEQ ID NO: 398683 - DNA, 15 bp, Homo sapiens
gtgtgtgtgtgtaac

SEQ ID NO: 398684 - DNA, 15 bp, Homo sapiens
tgtgtgtgtgtaact

SEQ ID NO: 398685 - DNA, 15 bp, Homo sapiens
gtgtgtgtgtaacta

SEQ ID NO: 398686 - DNA, 15 bp, Homo sapiens
tgtgtgtgtaactat

SEQ ID NO: 398687 - DNA, 15 bp, Homo sapiens
gtgtgtgtaactatt

SEQ ID NO: 398688 - DNA, 15 bp, Homo sapiens
tgtgtgtaactattc

SEQ ID NO: 398689 - DNA, 15 bp, Homo sapiens
gtgtgtaactattct

SEQ ID NO: 398690 - DNA, 15 bp, Homo sapiens
tgtgtaactattctt

SEQ ID NO: 398691 - DNA, 15 bp, Homo sapiens
gtgtaactattcttt

SEQ ID NO: 398692 - DNA, 15 bp, Homo sapiens
tgtaactattctttt

SEQ ID NO: 398693 - DNA, 15 bp, Homo sapiens
gtaactattcttttg

SEQ ID NO: 398694 - DNA, 15 bp, Homo sapiens
taactattcttttga

SEQ ID NO: 398695 - DNA, 15 bp, Homo sapiens
aactattcttttgaa

SEQ ID NO: 398696 - DNA, 15 bp, Homo sapiens
actattcttttgaag

SEQ ID NO: 398697 - DNA, 15 bp, Homo sapiens
ctattcttttgaaga

SEQ ID NO: 398698 - DNA, 15 bp, Homo sapiens
tattcttttgaagat

SEQ ID NO: 398699 - DNA, 15 bp, Homo sapiens
attcttttgaagatg

SEQ ID NO: 398700 - DNA, 15 bp, Homo sapiens
ttcttttgaagatga

SEQ ID NO: 398701 - DNA, 15 bp, Homo sapiens
tcttttgaagatgac

SEQ ID NO: 398702 - DNA, 15 bp, Homo sapiens
cttttgaagatgact

SEQ ID NO: 398703 - DNA, 15 bp, Homo sapiens
ttttgaagatgactt

SEQ ID NO: 398704 - DNA, 15 bp, Homo sapiens
tttgaagatgacttg

SEQ ID NO: 398705 - DNA, 15 bp, Homo sapiens
ttgaagatgacttgg

SEQ ID NO: 398706 - DNA, 15 bp, Homo sapiens
tgaagatgacttgga

SEQ ID NO: 398707 - DNA, 15 bp, Homo sapiens
gaagatgacttggaa

SEQ ID NO: 398708 - DNA, 15 bp, Homo sapiens
aagatgacttggaac

SEQ ID NO: 398709 - DNA, 15 bp, Homo sapiens
agatgacttggaact

SEQ ID NO: 398710 - DNA, 15 bp, Homo sapiens
gatgacttggaacta

SEQ ID NO: 398711 - DNA, 15 bp, Homo sapiens
atgacttggaactat

SEQ ID NO: 398712 - DNA, 15 bp, Homo sapiens
tgacttggaactatt

SEQ ID NO: 398713 - DNA, 15 bp, Homo sapiens
gacttggaactattc

SEQ ID NO: 398714 - DNA, 15 bp, Homo sapiens
acttggaactattcc

SEQ ID NO: 398715 - DNA, 15 bp, Homo sapiens
cttggaactattcct

SEQ ID NO: 398716 - DNA, 15 bp, Homo sapiens
ttggaactattccta

SEQ ID NO: 398717 - DNA, 15 bp, Homo sapiens
tggaactattcctaa

SEQ ID NO: 398718 - DNA, 15 bp, Homo sapiens
ggaactattcctaag

SEQ ID NO: 398719 - DNA, 15 bp, Homo sapiens
gaactattcctaagt

SEQ ID NO: 398720 - DNA, 15 bp, Homo sapiens
aactattcctaagta

SEQ ID NO: 398721 - DNA, 15 bp, Homo sapiens
actattcctaagtaa

SEQ ID NO: 398722 - DNA, 15 bp, Homo sapiens
ctattcctaagtaac

SEQ ID NO: 398723 - DNA, 15 bp, Homo sapiens
tattcctaagtaacc

SEQ ID NO: 398724 - DNA, 15 bp, Homo sapiens
attcctaagtaacct

SEQ ID NO: 398725 - DNA, 15 bp, Homo sapiens
ttcctaagtaacctc

SEQ ID NO: 398726 - DNA, 15 bp, Homo sapiens
tcctaagtaacctcc

SEQ ID NO: 398727 - DNA, 15 bp, Homo sapiens
cctaagtaacctcct

SEQ ID NO: 398728 - DNA, 15 bp, Homo sapiens
ctaagtaacctcctg

SEQ ID NO: 398729 - DNA, 15 bp, Homo sapiens
taagtaacctcctgt

SEQ ID NO: 398730 - DNA, 15 bp, Homo sapiens
aagtaacctcctgtc

SEQ ID NO: 398731 - DNA, 15 bp, Homo sapiens
agtaacctcctgtct

SEQ ID NO: 398732 - DNA, 15 bp, Homo sapiens
gtaacctcctgtctg

SEQ ID NO: 398733 - DNA, 15 bp, Homo sapiens
taacctcctgtctgg

SEQ ID NO: 398734 - DNA, 15 bp, Homo sapiens
aacctcctgtctggc

SEQ ID NO: 398735 - DNA, 15 bp, Homo sapiens
acctcctgtctggca

SEQ ID NO: 398736 - DNA, 15 bp, Homo sapiens
cctcctgtctggcat

SEQ ID NO: 398737 - DNA, 15 bp, Homo sapiens
ctcctgtctggcatt

SEQ ID NO: 398738 - DNA, 15 bp, Homo sapiens
tcctgtctggcattc

SEQ ID NO: 398739 - DNA, 15 bp, Homo sapiens
cctgtctggcattca

SEQ ID NO: 398740 - DNA, 15 bp, Homo sapiens
ctgtctggcattcac

SEQ ID NO: 398741 - DNA, 15 bp, Homo sapiens
tgtctggcattcact

SEQ ID NO: 398742 - DNA, 15 bp, Homo sapiens
gtctggcattcacta

SEQ ID NO: 398743 - DNA, 15 bp, Homo sapiens
tctggcattcactaa

SEQ ID NO: 398744 - DNA, 15 bp, Homo sapiens
ctggcattcactaat

SEQ ID NO: 398745 - DNA, 15 bp, Homo sapiens
tggcattcactaatt

SEQ ID NO: 398746 - DNA, 15 bp, Homo sapiens
ggcattcactaattt

SEQ ID NO: 398747 - DNA, 15 bp, Homo sapiens
gcattcactaatttc

SEQ ID NO: 398748 - DNA, 15 bp, Homo sapiens
cattcactaatttca

SEQ ID NO: 398749 - DNA, 15 bp, Homo sapiens
attcactaatttcac

SEQ ID NO: 398750 - DNA, 15 bp, Homo sapiens
ttcactaatttcacc

SEQ ID NO: 398751 - DNA, 15 bp, Homo sapiens
tcactaatttcacct

SEQ ID NO: 398752 - DNA, 15 bp, Homo sapiens
cactaatttcacctg

SEQ ID NO: 398753 - DNA, 15 bp, Homo sapiens
actaatttcacctgg

SEQ ID NO: 398754 - DNA, 15 bp, Homo sapiens
ctaatttcacctggc

SEQ ID NO: 398755 - DNA, 15 bp, Homo sapiens
taatttcacctggcc

SEQ ID NO: 398756 - DNA, 15 bp, Homo sapiens
aatttcacctggcca

SEQ ID NO: 398757 - DNA, 15 bp, Homo sapiens
atttcacctggccaa

SEQ ID NO: 398758 - DNA, 15 bp, Homo sapiens
tttcacctggccaac

SEQ ID NO: 398759 - DNA, 15 bp, Homo sapiens
ttcacctggccaact

SEQ ID NO: 398760 - DNA, 15 bp, Homo sapiens
tcacctggccaactc

SEQ ID NO: 398761 - DNA, 15 bp, Homo sapiens
cacctggccaactcc

SEQ ID NO: 398762 - DNA, 15 bp, Homo sapiens
acctggccaactcca

SEQ ID NO: 398763 - DNA, 15 bp, Homo sapiens
cctggccaactccag

SEQ ID NO: 398764 - DNA, 15 bp, Homo sapiens
ctggccaactccagc

SEQ ID NO: 398765 - DNA, 15 bp, Homo sapiens
tggccaactccagca

SEQ ID NO: 398766 - DNA, 15 bp, Homo sapiens
ggccaactccagcaa

SEQ ID NO: 398767 - DNA, 15 bp, Homo sapiens
gccaactccagcaat

SEQ ID NO: 398768 - DNA, 15 bp, Homo sapiens
ccaactccagcaatg

SEQ ID NO: 398769 - DNA, 15 bp, Homo sapiens
caactccagcaatgc

SEQ ID NO: 398770 - DNA, 15 bp, Homo sapiens
aactccagcaatgct

SEQ ID NO: 398771 - DNA, 15 bp, Homo sapiens
actccagcaatgctg

SEQ ID NO: 398772 - DNA, 15 bp, Homo sapiens
ctccagcaatgctga

SEQ ID NO: 398773 - DNA, 15 bp, Homo sapiens
tccagcaatgctgat

SEQ ID NO: 398774 - DNA, 15 bp, Homo sapiens
ccagcaatgctgatc

SEQ ID NO: 398775 - DNA, 15 bp, Homo sapiens
cagcaatgctgatct

SEQ ID NO: 398776 - DNA, 15 bp, Homo sapiens
agcaatgctgatctt

SEQ ID NO: 398777 - DNA, 15 bp, Homo sapiens
gcaatgctgatctta

SEQ ID NO: 398778 - DNA, 15 bp, Homo sapiens
caatgctgatcttag

SEQ ID NO: 398779 - DNA, 15 bp, Homo sapiens
aatgctgatcttagg

SEQ ID NO: 398780 - DNA, 15 bp, Homo sapiens
atgctgatcttagga

SEQ ID NO: 398781 - DNA, 15 bp, Homo sapiens
tgctgatcttaggat

SEQ ID NO: 398782 - DNA, 15 bp, Homo sapiens
gctgatcttaggata

SEQ ID NO: 398783 - DNA, 15 bp, Homo sapiens
ctgatcttaggatat

SEQ ID NO: 398784 - DNA, 15 bp, Homo sapiens
tgatcttaggatatc

SEQ ID NO: 398785 - DNA, 15 bp, Homo sapiens
gatcttaggatatct

SEQ ID NO: 398786 - DNA, 15 bp, Homo sapiens
atcttaggatatctt

SEQ ID NO: 398787 - DNA, 15 bp, Homo sapiens
tcttaggatatctta

SEQ ID NO: 398788 - DNA, 15 bp, Homo sapiens
cttaggatatcttat

SEQ ID NO: 398789 - DNA, 15 bp, Homo sapiens
ttaggatatcttatt

SEQ ID NO: 398790 - DNA, 15 bp, Homo sapiens
taggatatcttattg

SEQ ID NO: 398791 - DNA, 15 bp, Homo sapiens
aggatatcttattgt

SEQ ID NO: 398792 - DNA, 15 bp, Homo sapiens
ggatatcttattgta

SEQ ID NO: 398793 - DNA, 15 bp, Homo sapiens
gatatcttattgtat

SEQ ID NO: 398794 - DNA, 15 bp, Homo sapiens
atatcttattgtata

SEQ ID NO: 398795 - DNA, 15 bp, Homo sapiens
tatcttattgtatag

SEQ ID NO: 398796 - DNA, 15 bp, Homo sapiens
atcttattgtatagc

SEQ ID NO: 398797 - DNA, 15 bp, Homo sapiens
tcttattgtatagct

SEQ ID NO: 398798 - DNA, 15 bp, Homo sapiens
cttattgtatagctt

SEQ ID NO: 398799 - DNA, 15 bp, Homo sapiens
ttattgtatagctta

SEQ ID NO: 398800 - DNA, 15 bp, Homo sapiens
tattgtatagcttat

SEQ ID NO: 398801 - DNA, 15 bp, Homo sapiens
attgtatagcttata

SEQ ID NO: 398802 - DNA, 15 bp, Homo sapiens
ttgtatagcttatat

SEQ ID NO: 398803 - DNA, 15 bp, Homo sapiens
tgtatagcttatatt

SEQ ID NO: 398804 - DNA, 15 bp, Homo sapiens
gtatagcttatattc

SEQ ID NO: 398805 - DNA, 15 bp, Homo sapiens
tatagcttatattcc

SEQ ID NO: 398806 - DNA, 15 bp, Homo sapiens
atagcttatattcca

SEQ ID NO: 398807 - DNA, 15 bp, Homo sapiens
tagcttatattccaa

SEQ ID NO: 398808 - DNA, 15 bp, Homo sapiens
agcttatattccaaa

SEQ ID NO: 398809 - DNA, 15 bp, Homo sapiens
gcttatattccaaat

SEQ ID NO: 398810 - DNA, 15 bp, Homo sapiens
cttatattccaaata

SEQ ID NO: 398811 - DNA, 15 bp, Homo sapiens
ttatattccaaatat

SEQ ID NO: 398812 - DNA, 15 bp, Homo sapiens
tatattccaaatatt

SEQ ID NO: 398813 - DNA, 15 bp, Homo sapiens
atattccaaatattg

SEQ ID NO: 398814 - DNA, 15 bp, Homo sapiens
tattccaaatattgg

SEQ ID NO: 398815 - DNA, 15 bp, Homo sapiens
attccaaatattgga

SEQ ID NO: 398816 - DNA, 15 bp, Homo sapiens
ttccaaatattggag

SEQ ID NO: 398817 - DNA, 15 bp, Homo sapiens
tccaaatattggagg

SEQ ID NO: 398818 - DNA, 15 bp, Homo sapiens
ccaaatattggagga

SEQ ID NO: 398819 - DNA, 15 bp, Homo sapiens
caaatattggaggaa

SEQ ID NO: 398820 - DNA, 15 bp, Homo sapiens
aaatattggaggaaa

SEQ ID NO: 398821 - DNA, 15 bp, Homo sapiens
aatattggaggaaag

SEQ ID NO: 398822 - DNA, 15 bp, Homo sapiens
atattggaggaaaga

SEQ ID NO: 398823 - DNA, 15 bp, Homo sapiens
tattggaggaaagag

SEQ ID NO: 398824 - DNA, 15 bp, Homo sapiens
attggaggaaagaga

SEQ ID NO: 398825 - DNA, 15 bp, Homo sapiens
ttggaggaaagagag

SEQ ID NO: 398826 - DNA, 15 bp, Homo sapiens
tggaggaaagagagg

SEQ ID NO: 398827 - DNA, 15 bp, Homo sapiens
ggaggaaagagaggg

SEQ ID NO: 398828 - DNA, 15 bp, Homo sapiens
gaggaaagagaggga

SEQ ID NO: 398829 - DNA, 15 bp, Homo sapiens
aggaaagagagggag

SEQ ID NO: 398830 - DNA, 15 bp, Homo sapiens
ggaaagagagggagt

SEQ ID NO: 398831 - DNA, 15 bp, Homo sapiens
gaaagagagggagtt

SEQ ID NO: 398832 - DNA, 15 bp, Homo sapiens
aaagagagggagttt

SEQ ID NO: 398833 - DNA, 15 bp, Homo sapiens
aagagagggagtttg

SEQ ID NO: 398834 - DNA, 15 bp, Homo sapiens
agagagggagtttgg

SEQ ID NO: 398835 - DNA, 15 bp, Homo sapiens
gagagggagtttgga

SEQ ID NO: 398836 - DNA, 15 bp, Homo sapiens
agagggagtttggaa

SEQ ID NO: 398837 - DNA, 15 bp, Homo sapiens
gagggagtttggaaa

SEQ ID NO: 398838 - DNA, 15 bp, Homo sapiens
agggagtttggaaag

SEQ ID NO: 398839 - DNA, 15 bp, Homo sapiens
gggagtttggaaaga

SEQ ID NO: 398840 - DNA, 15 bp, Homo sapiens
ggagtttggaaagaa

SEQ ID NO: 398841 - DNA, 15 bp, Homo sapiens
gagtttggaaagaag

SEQ ID NO: 398842 - DNA, 15 bp, Homo sapiens
agtttggaaagaagt

SEQ ID NO: 398843 - DNA, 15 bp, Homo sapiens
gtttggaaagaagtt

SEQ ID NO: 398844 - DNA, 15 bp, Homo sapiens
tttggaaagaagttt

SEQ ID NO: 398845 - DNA, 15 bp, Homo sapiens
ttggaaagaagtttt

SEQ ID NO: 398846 - DNA, 15 bp, Homo sapiens
tggaaagaagtttta

SEQ ID NO: 398847 - DNA, 15 bp, Homo sapiens
ggaaagaagttttag

SEQ ID NO: 398848 - DNA, 15 bp, Homo sapiens
gaaagaagttttagt

SEQ ID NO: 398849 - DNA, 15 bp, Homo sapiens
aaagaagttttagtt

SEQ ID NO: 398850 - DNA, 15 bp, Homo sapiens
aagaagttttagttt

SEQ ID NO: 398851 - DNA, 15 bp, Homo sapiens
agaagttttagttta

SEQ ID NO: 398852 - DNA, 15 bp, Homo sapiens
gaagttttagtttag

SEQ ID NO: 398853 - DNA, 15 bp, Homo sapiens
aagttttagtttaga

SEQ ID NO: 398854 - DNA, 15 bp, Homo sapiens
agttttagtttagag

SEQ ID NO: 398855 - DNA, 15 bp, Homo sapiens
gttttagtttagaga

SEQ ID NO: 398856 - DNA, 15 bp, Homo sapiens
ttttagtttagagag

SEQ ID NO: 398857 - DNA, 15 bp, Homo sapiens
tttagtttagagagc

SEQ ID NO: 398858 - DNA, 15 bp, Homo sapiens
ttagtttagagagct

SEQ ID NO: 398859 - DNA, 15 bp, Homo sapiens
tagtttagagagctc

SEQ ID NO: 398860 - DNA, 15 bp, Homo sapiens
agtttagagagctct

SEQ ID NO: 398861 - DNA, 15 bp, Homo sapiens
gtttagagagctctt

SEQ ID NO: 398862 - DNA, 15 bp, Homo sapiens
tttagagagctctta

SEQ ID NO: 398863 - DNA, 15 bp, Homo sapiens
ttagagagctcttaa

SEQ ID NO: 398864 - DNA, 15 bp, Homo sapiens
tagagagctcttaaa

SEQ ID NO: 398865 - DNA, 15 bp, Homo sapiens
agagagctcttaaag

SEQ ID NO: 398866 - DNA, 15 bp, Homo sapiens
gagagctcttaaagt

SEQ ID NO: 398867 - DNA, 15 bp, Homo sapiens
agagctcttaaagta

SEQ ID NO: 398868 - DNA, 15 bp, Homo sapiens
gagctcttaaagtac

SEQ ID NO: 398869 - DNA, 15 bp, Homo sapiens
agctcttaaagtact

SEQ ID NO: 398870 - DNA, 15 bp, Homo sapiens
gctcttaaagtactc

SEQ ID NO: 398871 - DNA, 15 bp, Homo sapiens
ctcttaaagtactct

SEQ ID NO: 398872 - DNA, 15 bp, Homo sapiens
tcttaaagtactctt

SEQ ID NO: 398873 - DNA, 15 bp, Homo sapiens
cttaaagtactcttg

SEQ ID NO: 398874 - DNA, 15 bp, Homo sapiens
ttaaagtactcttgg

SEQ ID NO: 398875 - DNA, 15 bp, Homo sapiens
taaagtactcttggc

SEQ ID NO: 398876 - DNA, 15 bp, Homo sapiens
aaagtactcttggct

SEQ ID NO: 398877 - DNA, 15 bp, Homo sapiens
aagtactcttggctc

SEQ ID NO: 398878 - DNA, 15 bp, Homo sapiens
agtactcttggctca

SEQ ID NO: 398879 - DNA, 15 bp, Homo sapiens
gtactcttggctcat

SEQ ID NO: 398880 - DNA, 15 bp, Homo sapiens
tactcttggctcatc

SEQ ID NO: 398881 - DNA, 15 bp, Homo sapiens
actcttggctcatca

SEQ ID NO: 398882 - DNA, 15 bp, Homo sapiens
ctcttggctcatcat

SEQ ID NO: 398883 - DNA, 15 bp, Homo sapiens
tcttggctcatcatt

SEQ ID NO: 398884 - DNA, 15 bp, Homo sapiens
cttggctcatcattc

SEQ ID NO: 398885 - DNA, 15 bp, Homo sapiens
ttggctcatcattct

SEQ ID NO: 398886 - DNA, 15 bp, Homo sapiens
tggctcatcattctt

SEQ ID NO: 398887 - DNA, 15 bp, Homo sapiens
ggctcatcattcttt

SEQ ID NO: 398888 - DNA, 15 bp, Homo sapiens
gctcatcattcttta

SEQ ID NO: 398889 - DNA, 15 bp, Homo sapiens
ctcatcattctttaa

SEQ ID NO: 398890 - DNA, 15 bp, Homo sapiens
catcattctttaaat

SEQ ID NO: 398891 - DNA, 15 bp, Homo sapiens
atcattctttaaatt

SEQ ID NO: 398892 - DNA, 15 bp, Homo sapiens
tcattctttaaattc

SEQ ID NO: 398893 - DNA, 15 bp, Homo sapiens
cattctttaaattcc

SEQ ID NO: 398894 - DNA, 15 bp, Homo sapiens
attctttaaattcca

SEQ ID NO: 398895 - DNA, 15 bp, Homo sapiens
ttctttaaattccaa

SEQ ID NO: 398896 - DNA, 15 bp, Homo sapiens
tctttaaattccaaa

SEQ ID NO: 398897 - DNA, 15 bp, Homo sapiens
ctttaaattccaaaa

SEQ ID NO: 398898 - DNA, 15 bp, Homo sapiens
tttaaattccaaaaa

SEQ ID NO: 398899 - DNA, 15 bp, Homo sapiens
ttaaattccaaaaat

SEQ ID NO: 398900 - DNA, 15 bp, Homo sapiens
taaattccaaaaatg

SEQ ID NO: 398901 - DNA, 15 bp, Homo sapiens
aaattccaaaaatga

SEQ ID NO: 398902 - DNA, 15 bp, Homo sapiens
aattccaaaaatgac

SEQ ID NO: 398903 - DNA, 15 bp, Homo sapiens
attccaaaaatgact

SEQ ID NO: 398904 - DNA, 15 bp, Homo sapiens
ttccaaaaatgacta

SEQ ID NO: 398905 - DNA, 15 bp, Homo sapiens
tccaaaaatgactaa

SEQ ID NO: 398906 - DNA, 15 bp, Homo sapiens
ccaaaaatgactaat

SEQ ID NO: 398907 - DNA, 15 bp, Homo sapiens
caaaaatgactaatt

SEQ ID NO: 398908 - DNA, 15 bp, Homo sapiens
aaaaatgactaattt

SEQ ID NO: 398909 - DNA, 15 bp, Homo sapiens
aaaatgactaatttg

SEQ ID NO: 398910 - DNA, 15 bp, Homo sapiens
aaatgactaatttgt

SEQ ID NO: 398911 - DNA, 15 bp, Homo sapiens
aatgactaatttgtg

SEQ ID NO: 398912 - DNA, 15 bp, Homo sapiens
atgactaatttgtgg

SEQ ID NO: 398913 - DNA, 15 bp, Homo sapiens
tgactaatttgtggg

SEQ ID NO: 398914 - DNA, 15 bp, Homo sapiens
gactaatttgtgggg

SEQ ID NO: 398915 - DNA, 15 bp, Homo sapiens
actaatttgtgggga

SEQ ID NO: 398916 - DNA, 15 bp, Homo sapiens
ctaatttgtggggat

SEQ ID NO: 398917 - DNA, 15 bp, Homo sapiens
taatttgtggggata

SEQ ID NO: 398918 - DNA, 15 bp, Homo sapiens
aatttgtggggatac

SEQ ID NO: 398919 - DNA, 15 bp, Homo sapiens
atttgtggggataca

SEQ ID NO: 398920 - DNA, 15 bp, Homo sapiens
tttgtggggatacat

SEQ ID NO: 398921 - DNA, 15 bp, Homo sapiens
ttgtggggatacata

SEQ ID NO: 398922 - DNA, 15 bp, Homo sapiens
tgtggggatacataa

SEQ ID NO: 398923 - DNA, 15 bp, Homo sapiens
gtggggatacataat

SEQ ID NO: 398924 - DNA, 15 bp, Homo sapiens
tggggatacataatt

SEQ ID NO: 398925 - DNA, 15 bp, Homo sapiens
ggggatacataatta

SEQ ID NO: 398926 - DNA, 15 bp, Homo sapiens
gggatacataattaa

SEQ ID NO: 398927 - DNA, 15 bp, Homo sapiens
ggatacataattaag

SEQ ID NO: 398928 - DNA, 15 bp, Homo sapiens
gatacataattaagg

SEQ ID NO: 398929 - DNA, 15 bp, Homo sapiens
atacataattaagga

SEQ ID NO: 398930 - DNA, 15 bp, Homo sapiens
tacataattaaggaa

SEQ ID NO: 398931 - DNA, 15 bp, Homo sapiens
acataattaaggaag

SEQ ID NO: 398932 - DNA, 15 bp, Homo sapiens
cataattaaggaaga

SEQ ID NO: 398933 - DNA, 15 bp, Homo sapiens
ataattaaggaagaa

SEQ ID NO: 398934 - DNA, 15 bp, Homo sapiens
taattaaggaagaaa

SEQ ID NO: 398935 - DNA, 15 bp, Homo sapiens
aattaaggaagaaaa

SEQ ID NO: 398936 - DNA, 15 bp, Homo sapiens
attaaggaagaaaag

SEQ ID NO: 398937 - DNA, 15 bp, Homo sapiens
ttaaggaagaaaagg

SEQ ID NO: 398938 - DNA, 15 bp, Homo sapiens
taaggaagaaaaggt

SEQ ID NO: 398939 - DNA, 15 bp, Homo sapiens
aaggaagaaaaggtt

SEQ ID NO: 398940 - DNA, 15 bp, Homo sapiens
aggaagaaaaggttt

SEQ ID NO: 398941 - DNA, 15 bp, Homo sapiens
ggaagaaaaggtttt

SEQ ID NO: 398942 - DNA, 15 bp, Homo sapiens
gaagaaaaggttttg

SEQ ID NO: 398943 - DNA, 15 bp, Homo sapiens
aagaaaaggttttgt

SEQ ID NO: 398944 - DNA, 15 bp, Homo sapiens
agaaaaggttttgtg

SEQ ID NO: 398945 - DNA, 15 bp, Homo sapiens
gaaaaggttttgtga

SEQ ID NO: 398946 - DNA, 15 bp, Homo sapiens
aaaaggttttgtgag

SEQ ID NO: 398947 - DNA, 15 bp, Homo sapiens
aaaggttttgtgagg

SEQ ID NO: 398948 - DNA, 15 bp, Homo sapiens
aaggttttgtgaggg

SEQ ID NO: 398949 - DNA, 15 bp, Homo sapiens
aggttttgtgaggga

SEQ ID NO: 398950 - DNA, 15 bp, Homo sapiens
ggttttgtgagggaa

SEQ ID NO: 398951 - DNA, 15 bp, Homo sapiens
gttttgtgagggaaa

SEQ ID NO: 398952 - DNA, 15 bp, Homo sapiens
ttttgtgagggaaag

SEQ ID NO: 398953 - DNA, 15 bp, Homo sapiens
tttgtgagggaaagg

SEQ ID NO: 398954 - DNA, 15 bp, Homo sapiens
ttgtgagggaaagga

SEQ ID NO: 398955 - DNA, 15 bp, Homo sapiens
tgtgagggaaaggag

SEQ ID NO: 398956 - DNA, 15 bp, Homo sapiens
gtgagggaaaggagt

SEQ ID NO: 398957 - DNA, 15 bp, Homo sapiens
tgagggaaaggagta

SEQ ID NO: 398958 - DNA, 15 bp, Homo sapiens
gagggaaaggagtag

SEQ ID NO: 398959 - DNA, 15 bp, Homo sapiens
agggaaaggagtagc

SEQ ID NO: 398960 - DNA, 15 bp, Homo sapiens
gggaaaggagtagca

SEQ ID NO: 398961 - DNA, 15 bp, Homo sapiens
ggaaaggagtagcag

SEQ ID NO: 398962 - DNA, 15 bp, Homo sapiens
gaaaggagtagcagg

SEQ ID NO: 398963 - DNA, 15 bp, Homo sapiens
aaaggagtagcaggg

SEQ ID NO: 398964 - DNA, 15 bp, Homo sapiens
aaggagtagcaggga

SEQ ID NO: 398965 - DNA, 15 bp, Homo sapiens
aggagtagcagggag

SEQ ID NO: 398966 - DNA, 15 bp, Homo sapiens
ggagtagcagggagt

SEQ ID NO: 398967 - DNA, 15 bp, Homo sapiens
gagtagcagggagtg

SEQ ID NO: 398968 - DNA, 15 bp, Homo sapiens
agtagcagggagtgc

SEQ ID NO: 398969 - DNA, 15 bp, Homo sapiens
gtagcagggagtgct

SEQ ID NO: 398970 - DNA, 15 bp, Homo sapiens
tagcagggagtgctg

SEQ ID NO: 398971 - DNA, 15 bp, Homo sapiens
agcagggagtgctga

SEQ ID NO: 398972 - DNA, 15 bp, Homo sapiens
gcagggagtgctgag

SEQ ID NO: 398973 - DNA, 15 bp, Homo sapiens
cagggagtgctgaga

SEQ ID NO: 398974 - DNA, 15 bp, Homo sapiens
agggagtgctgagag

SEQ ID NO: 398975 - DNA, 15 bp, Homo sapiens
gggagtgctgagagc

SEQ ID NO: 398976 - DNA, 15 bp, Homo sapiens
ggagtgctgagagct

SEQ ID NO: 398977 - DNA, 15 bp, Homo sapiens
gagtgctgagagctt

SEQ ID NO: 398978 - DNA, 15 bp, Homo sapiens
agtgctgagagcttg

SEQ ID NO: 398979 - DNA, 15 bp, Homo sapiens
gtgctgagagcttgg

SEQ ID NO: 398980 - DNA, 15 bp, Homo sapiens
tgctgagagcttggc

SEQ ID NO: 398981 - DNA, 15 bp, Homo sapiens
gctgagagcttggcg

SEQ ID NO: 398982 - DNA, 15 bp, Homo sapiens
ctgagagcttggcgt

SEQ ID NO: 398983 - DNA, 15 bp, Homo sapiens
tgagagcttggcgta

SEQ ID NO: 398984 - DNA, 15 bp, Homo sapiens
gagagcttggcgtat

SEQ ID NO: 398985 - DNA, 15 bp, Homo sapiens
agagcttggcgtatg

SEQ ID NO: 398986 - DNA, 15 bp, Homo sapiens
gagcttggcgtatgt

SEQ ID NO: 398987 - DNA, 15 bp, Homo sapiens
agcttggcgtatgta

SEQ ID NO: 398988 - DNA, 15 bp, Homo sapiens
gcttggcgtatgtat

SEQ ID NO: 398989 - DNA, 15 bp, Homo sapiens
cttggcgtatgtatt

SEQ ID NO: 398990 - DNA, 15 bp, Homo sapiens
ttggcgtatgtattg

SEQ ID NO: 398991 - DNA, 15 bp, Homo sapiens
tggcgtatgtattgg

SEQ ID NO: 398992 - DNA, 15 bp, Homo sapiens
ggcgtatgtattgga

SEQ ID NO: 398993 - DNA, 15 bp, Homo sapiens
gcgtatgtattggaa

SEQ ID NO: 398994 - DNA, 15 bp, Homo sapiens
cgtatgtattggaaa

SEQ ID NO: 398995 - DNA, 15 bp, Homo sapiens
gtatgtattggaaaa

SEQ ID NO: 398996 - DNA, 15 bp, Homo sapiens
tatgtattggaaaat

SEQ ID NO: 398997 - DNA, 15 bp, Homo sapiens
atgtattggaaaatt

SEQ ID NO: 398998 - DNA, 15 bp, Homo sapiens
tgtattggaaaattg

SEQ ID NO: 398999 - DNA, 15 bp, Homo sapiens
gtattggaaaattgt

SEQ ID NO: 399000 - DNA, 15 bp, Homo sapiens
tattggaaaattgtg

SEQ ID NO: 399001 - DNA, 15 bp, Homo sapiens
attggaaaattgtgg

SEQ ID NO: 399002 - DNA, 15 bp, Homo sapiens
ttggaaaattgtggt

SEQ ID NO: 399003 - DNA, 15 bp, Homo sapiens
tggaaaattgtggta

SEQ ID NO: 399004 - DNA, 15 bp, Homo sapiens
ggaaaattgtggtaa

SEQ ID NO: 399005 - DNA, 15 bp, Homo sapiens
gaaaattgtggtaac

SEQ ID NO: 399006 - DNA, 15 bp, Homo sapiens
aaaattgtggtaact

SEQ ID NO: 399007 - DNA, 15 bp, Homo sapiens
aaattgtggtaactt

SEQ ID NO: 399008 - DNA, 15 bp, Homo sapiens
aattgtggtaactta

SEQ ID NO: 399009 - DNA, 15 bp, Homo sapiens
attgtggtaacttaa

SEQ ID NO: 399010 - DNA, 15 bp, Homo sapiens
ttgtggtaacttaac

SEQ ID NO: 399011 - DNA, 15 bp, Homo sapiens
tgtggtaacttaaca

SEQ ID NO: 399012 - DNA, 15 bp, Homo sapiens
gtggtaacttaacag

SEQ ID NO: 399013 - DNA, 15 bp, Homo sapiens
tggtaacttaacagg

SEQ ID NO: 399014 - DNA, 15 bp, Homo sapiens
ggtaacttaacaggt

SEQ ID NO: 399015 - DNA, 15 bp, Homo sapiens
gtaacttaacaggta

SEQ ID NO: 399016 - DNA, 15 bp, Homo sapiens
taacttaacaggtaa

SEQ ID NO: 399017 - DNA, 15 bp, Homo sapiens
aacttaacaggtaat

SEQ ID NO: 399018 - DNA, 15 bp, Homo sapiens
acttaacaggtaatc

SEQ ID NO: 399019 - DNA, 15 bp, Homo sapiens
cttaacaggtaatca

SEQ ID NO: 399020 - DNA, 15 bp, Homo sapiens
ttaacaggtaatcaa

SEQ ID NO: 399021 - DNA, 15 bp, Homo sapiens
taacaggtaatcaag

SEQ ID NO: 399022 - DNA, 15 bp, Homo sapiens
aacaggtaatcaagg

SEQ ID NO: 399023 - DNA, 15 bp, Homo sapiens
acaggtaatcaagga

SEQ ID NO: 399024 - DNA, 15 bp, Homo sapiens
caggtaatcaaggat

SEQ ID NO: 399025 - DNA, 15 bp, Homo sapiens
aggtaatcaaggatg

SEQ ID NO: 399026 - DNA, 15 bp, Homo sapiens
ggtaatcaaggatgt

SEQ ID NO: 399027 - DNA, 15 bp, Homo sapiens
gtaatcaaggatgtt

SEQ ID NO: 399028 - DNA, 15 bp, Homo sapiens
taatcaaggatgttg

SEQ ID NO: 399029 - DNA, 15 bp, Homo sapiens
aatcaaggatgttga

SEQ ID NO: 399030 - DNA, 15 bp, Homo sapiens
atcaaggatgttgag

SEQ ID NO: 399031 - DNA, 15 bp, Homo sapiens
tcaaggatgttgaga

SEQ ID NO: 399032 - DNA, 15 bp, Homo sapiens
caaggatgttgagag

SEQ ID NO: 399033 - DNA, 15 bp, Homo sapiens
aaggatgttgagaga

SEQ ID NO: 399034 - DNA, 15 bp, Homo sapiens
aggatgttgagagag

SEQ ID NO: 399035 - DNA, 15 bp, Homo sapiens
ggatgttgagagagg

SEQ ID NO: 399036 - DNA, 15 bp, Homo sapiens
gatgttgagagaggt

SEQ ID NO: 399037 - DNA, 15 bp, Homo sapiens
atgttgagagaggtg

SEQ ID NO: 399038 - DNA, 15 bp, Homo sapiens
tgttgagagaggtgc

SEQ ID NO: 399039 - DNA, 15 bp, Homo sapiens
gttgagagaggtgct

SEQ ID NO: 399040 - DNA, 15 bp, Homo sapiens
ttgagagaggtgctt

SEQ ID NO: 399041 - DNA, 15 bp, Homo sapiens
tgagagaggtgcttg

SEQ ID NO: 399042 - DNA, 15 bp, Homo sapiens
gagagaggtgcttgt

SEQ ID NO: 399043 - DNA, 15 bp, Homo sapiens
agagaggtgcttgtc

SEQ ID NO: 399044 - DNA, 15 bp, Homo sapiens
gagaggtgcttgtca

SEQ ID NO: 399045 - DNA, 15 bp, Homo sapiens
agaggtgcttgtcat

SEQ ID NO: 399046 - DNA, 15 bp, Homo sapiens
gaggtgcttgtcatc

SEQ ID NO: 399047 - DNA, 15 bp, Homo sapiens
aggtgcttgtcatca

SEQ ID NO: 399048 - DNA, 15 bp, Homo sapiens
ggtgcttgtcatcat

SEQ ID NO: 399049 - DNA, 15 bp, Homo sapiens
gtgcttgtcatcatt

SEQ ID NO: 399050 - DNA, 15 bp, Homo sapiens
tgcttgtcatcattt

SEQ ID NO: 399051 - DNA, 15 bp, Homo sapiens
gcttgtcatcatttc

SEQ ID NO: 399052 - DNA, 15 bp, Homo sapiens
cttgtcatcatttca

SEQ ID NO: 399053 - DNA, 15 bp, Homo sapiens
ttgtcatcatttcaa

SEQ ID NO: 399054 - DNA, 15 bp, Homo sapiens
tgtcatcatttcaaa

SEQ ID NO: 399055 - DNA, 15 bp, Homo sapiens
gtcatcatttcaaaa

SEQ ID NO: 399056 - DNA, 15 bp, Homo sapiens
tcatcatttcaaaag

SEQ ID NO: 399057 - DNA, 15 bp, Homo sapiens
catcatttcaaaaga

SEQ ID NO: 399058 - DNA, 15 bp, Homo sapiens
atcatttcaaaagag

SEQ ID NO: 399059 - DNA, 15 bp, Homo sapiens
tcatttcaaaagagc

SEQ ID NO: 399060 - DNA, 15 bp, Homo sapiens
catttcaaaagagcg

SEQ ID NO: 399061 - DNA, 15 bp, Homo sapiens
atttcaaaagagcgt

SEQ ID NO: 399062 - DNA, 15 bp, Homo sapiens
tttcaaaagagcgta

SEQ ID NO: 399063 - DNA, 15 bp, Homo sapiens
ttcaaaagagcgtag

SEQ ID NO: 399064 - DNA, 15 bp, Homo sapiens
tcaaaagagcgtaga

SEQ ID NO: 399065 - DNA, 15 bp, Homo sapiens
caaaagagcgtagaa

SEQ ID NO: 399066 - DNA, 15 bp, Homo sapiens
aaaagagcgtagaat

SEQ ID NO: 399067 - DNA, 15 bp, Homo sapiens
aaagagcgtagaata

SEQ ID NO: 399068 - DNA, 15 bp, Homo sapiens
aagagcgtagaatat

SEQ ID NO: 399069 - DNA, 15 bp, Homo sapiens
agagcgtagaatatt

SEQ ID NO: 399070 - DNA, 15 bp, Homo sapiens
gagcgtagaatattt

SEQ ID NO: 399071 - DNA, 15 bp, Homo sapiens
agcgtagaatatttt

SEQ ID NO: 399072 - DNA, 15 bp, Homo sapiens
gcgtagaatatttta

SEQ ID NO: 399073 - DNA, 15 bp, Homo sapiens
cgtagaatattttat

SEQ ID NO: 399074 - DNA, 15 bp, Homo sapiens
gtagaatattttatt

SEQ ID NO: 399075 - DNA, 15 bp, Homo sapiens
tagaatattttattt

SEQ ID NO: 399076 - DNA, 15 bp, Homo sapiens
agaatattttatttc

SEQ ID NO: 399077 - DNA, 15 bp, Homo sapiens
gaatattttatttca

SEQ ID NO: 399078 - DNA, 15 bp, Homo sapiens
aatattttatttcat

SEQ ID NO: 399079 - DNA, 15 bp, Homo sapiens
atattttatttcatt

SEQ ID NO: 399080 - DNA, 15 bp, Homo sapiens
tattttatttcattt

SEQ ID NO: 399081 - DNA, 15 bp, Homo sapiens
attttatttcatttt

SEQ ID NO: 399082 - DNA, 15 bp, Homo sapiens
ttttatttcattttg

SEQ ID NO: 399083 - DNA, 15 bp, Homo sapiens
tttatttcattttgt

SEQ ID NO: 399084 - DNA, 15 bp, Homo sapiens
ttatttcattttgtc

SEQ ID NO: 399085 - DNA, 15 bp, Homo sapiens
tatttcattttgtct

SEQ ID NO: 399086 - DNA, 15 bp, Homo sapiens
atttcattttgtcta

SEQ ID NO: 399087 - DNA, 15 bp, Homo sapiens
tttcattttgtctac

SEQ ID NO: 399088 - DNA, 15 bp, Homo sapiens
ttcattttgtctact

SEQ ID NO: 399089 - DNA, 15 bp, Homo sapiens
tcattttgtctactg

SEQ ID NO: 399090 - DNA, 15 bp, Homo sapiens
cattttgtctactgt

SEQ ID NO: 399091 - DNA, 15 bp, Homo sapiens
attttgtctactgtg

SEQ ID NO: 399092 - DNA, 15 bp, Homo sapiens
ttttgtctactgtgg

SEQ ID NO: 399093 - DNA, 15 bp, Homo sapiens
tttgtctactgtgga

SEQ ID NO: 399094 - DNA, 15 bp, Homo sapiens
ttgtctactgtggat

SEQ ID NO: 399095 - DNA, 15 bp, Homo sapiens
tgtctactgtggatc

SEQ ID NO: 399096 - DNA, 15 bp, Homo sapiens
gtctactgtggatcg

SEQ ID NO: 399097 - DNA, 15 bp, Homo sapiens
tctactgtggatcgg

SEQ ID NO: 399098 - DNA, 15 bp, Homo sapiens
ctactgtggatcggt

SEQ ID NO: 399099 - DNA, 15 bp, Homo sapiens
tactgtggatcggtt

SEQ ID NO: 399100 - DNA, 15 bp, Homo sapiens
actgtggatcggttc

SEQ ID NO: 399101 - DNA, 15 bp, Homo sapiens
ctgtggatcggttct

SEQ ID NO: 399102 - DNA, 15 bp, Homo sapiens
tgtggatcggttctc

SEQ ID NO: 399103 - DNA, 15 bp, Homo sapiens
gtggatcggttctcc

SEQ ID NO: 399104 - DNA, 15 bp, Homo sapiens
tggatcggttctcct

SEQ ID NO: 399105 - DNA, 15 bp, Homo sapiens
ggatcggttctcctc

SEQ ID NO: 399106 - DNA, 15 bp, Homo sapiens
gatcggttctcctct

SEQ ID NO: 399107 - DNA, 15 bp, Homo sapiens
atcggttctcctctc

SEQ ID NO: 399108 - DNA, 15 bp, Homo sapiens
tcggttctcctctca

SEQ ID NO: 399109 - DNA, 15 bp, Homo sapiens
cggttctcctctcat

SEQ ID NO: 399110 - DNA, 15 bp, Homo sapiens
ggttctcctctcatt

SEQ ID NO: 399111 - DNA, 15 bp, Homo sapiens
ttctcctctcattta

SEQ ID NO: 399112 - DNA, 15 bp, Homo sapiens
tctcctctcatttac

SEQ ID NO: 399113 - DNA, 15 bp, Homo sapiens
ctcctctcatttact

SEQ ID NO: 399114 - DNA, 15 bp, Homo sapiens
tcctctcatttactt

SEQ ID NO: 399115 - DNA, 15 bp, Homo sapiens
cctctcatttacttc

SEQ ID NO: 399116 - DNA, 15 bp, Homo sapiens
ctctcatttacttct

SEQ ID NO: 399117 - DNA, 15 bp, Homo sapiens
tctcatttacttctt

SEQ ID NO: 399118 - DNA, 15 bp, Homo sapiens
ctcatttacttcttt

SEQ ID NO: 399119 - DNA, 15 bp, Homo sapiens
tcatttacttctttt

SEQ ID NO: 399120 - DNA, 15 bp, Homo sapiens
catttacttcttttc

SEQ ID NO: 399121 - DNA, 15 bp, Homo sapiens
atttacttcttttca

SEQ ID NO: 399122 - DNA, 15 bp, Homo sapiens
tttacttcttttcac

SEQ ID NO: 399123 - DNA, 15 bp, Homo sapiens
ttacttcttttcaca

SEQ ID NO: 399124 - DNA, 15 bp, Homo sapiens
tacttcttttcacat

SEQ ID NO: 399125 - DNA, 15 bp, Homo sapiens
acttcttttcacatt

SEQ ID NO: 399126 - DNA, 15 bp, Homo sapiens
cttcttttcacattt

SEQ ID NO: 399127 - DNA, 15 bp, Homo sapiens
ttcttttcacatttc

SEQ ID NO: 399128 - DNA, 15 bp, Homo sapiens
tcttttcacatttca

SEQ ID NO: 399129 - DNA, 15 bp, Homo sapiens
cttttcacatttcat

SEQ ID NO: 399130 - DNA, 15 bp, Homo sapiens
ttttcacatttcata

SEQ ID NO: 399131 - DNA, 15 bp, Homo sapiens
tttcacatttcatat

SEQ ID NO: 399132 - DNA, 15 bp, Homo sapiens
ttcacatttcatatt

SEQ ID NO: 399133 - DNA, 15 bp, Homo sapiens
tcacatttcatattt

SEQ ID NO: 399134 - DNA, 15 bp, Homo sapiens
cacatttcatatttg

SEQ ID NO: 399135 - DNA, 15 bp, Homo sapiens
acatttcatatttgg

SEQ ID NO: 399136 - DNA, 15 bp, Homo sapiens
catttcatatttggg

SEQ ID NO: 399137 - DNA, 15 bp, Homo sapiens
atttcatatttggga

SEQ ID NO: 399138 - DNA, 15 bp, Homo sapiens
tttcatatttgggag

SEQ ID NO: 399139 - DNA, 15 bp, Homo sapiens
ttcatatttgggagg

SEQ ID NO: 399140 - DNA, 15 bp, Homo sapiens
tcatatttgggaggg

SEQ ID NO: 399141 - DNA, 15 bp, Homo sapiens
catatttgggagggc

SEQ ID NO: 399142 - DNA, 15 bp, Homo sapiens
atatttgggagggct

SEQ ID NO: 399143 - DNA, 15 bp, Homo sapiens
tatttgggagggctt

SEQ ID NO: 399144 - DNA, 15 bp, Homo sapiens
atttgggagggcttt

SEQ ID NO: 399145 - DNA, 15 bp, Homo sapiens
tttgggagggctttg

SEQ ID NO: 399146 - DNA, 15 bp, Homo sapiens
ttgggagggctttgg

SEQ ID NO: 399147 - DNA, 15 bp, Homo sapiens
tgggagggctttggg

SEQ ID NO: 399148 - DNA, 15 bp, Homo sapiens
gggagggctttgggc

SEQ ID NO: 399149 - DNA, 15 bp, Homo sapiens
ggagggctttgggct

SEQ ID NO: 399150 - DNA, 15 bp, Homo sapiens
gagggctttgggctc

SEQ ID NO: 399151 - DNA, 15 bp, Homo sapiens
agggctttgggctct

SEQ ID NO: 399152 - DNA, 15 bp, Homo sapiens
gggctttgggctcta

SEQ ID NO: 399153 - DNA, 15 bp, Homo sapiens
ggctttgggctctat

SEQ ID NO: 399154 - DNA, 15 bp, Homo sapiens
gctttgggctctatc

SEQ ID NO: 399155 - DNA, 15 bp, Homo sapiens
ctttgggctctatct

SEQ ID NO: 399156 - DNA, 15 bp, Homo sapiens
tttgggctctatctt

SEQ ID NO: 399157 - DNA, 15 bp, Homo sapiens
ttgggctctatcttc

SEQ ID NO: 399158 - DNA, 15 bp, Homo sapiens
tgggctctatcttct

SEQ ID NO: 399159 - DNA, 15 bp, Homo sapiens
gggctctatcttcta

SEQ ID NO: 399160 - DNA, 15 bp, Homo sapiens
ggctctatcttctat

SEQ ID NO: 399161 - DNA, 15 bp, Homo sapiens
gctctatcttctatt

SEQ ID NO: 399162 - DNA, 15 bp, Homo sapiens
ctctatcttctattt

SEQ ID NO: 399163 - DNA, 15 bp, Homo sapiens
tctatcttctatttc

SEQ ID NO: 399164 - DNA, 15 bp, Homo sapiens
ctatcttctatttcc

SEQ ID NO: 399165 - DNA, 15 bp, Homo sapiens
tatcttctatttcct

SEQ ID NO: 399166 - DNA, 15 bp, Homo sapiens
atcttctatttcctt

SEQ ID NO: 399167 - DNA, 15 bp, Homo sapiens
tcttctatttccttc

SEQ ID NO: 399168 - DNA, 15 bp, Homo sapiens
cttctatttccttct

SEQ ID NO: 399169 - DNA, 15 bp, Homo sapiens
ttctatttccttcta

SEQ ID NO: 399170 - DNA, 15 bp, Homo sapiens
tctatttccttctat

SEQ ID NO: 399171 - DNA, 15 bp, Homo sapiens
ctatttccttctatt

SEQ ID NO: 399172 - DNA, 15 bp, Homo sapiens
tatttccttctatta

SEQ ID NO: 399173 - DNA, 15 bp, Homo sapiens
atttccttctattaa

SEQ ID NO: 399174 - DNA, 15 bp, Homo sapiens
tttccttctattaaa

SEQ ID NO: 399175 - DNA, 15 bp, Homo sapiens
ttccttctattaaaa

SEQ ID NO: 399176 - DNA, 15 bp, Homo sapiens
tccttctattaaaaa

SEQ ID NO: 399177 - DNA, 15 bp, Homo sapiens
ccttctattaaaaaa

SEQ ID NO: 399178 - DNA, 15 bp, Homo sapiens
cttctattaaaaaaa

SEQ ID NO: 399179 - DNA, 15 bp, Homo sapiens
ttctattaaaaaaag

SEQ ID NO: 399180 - DNA, 15 bp, Homo sapiens
tctattaaaaaaagt

SEQ ID NO: 399181 - DNA, 15 bp, Homo sapiens
ctattaaaaaaagtt

SEQ ID NO: 399182 - DNA, 15 bp, Homo sapiens
tattaaaaaaagttt

SEQ ID NO: 399183 - DNA, 15 bp, Homo sapiens
attaaaaaaagtttt

SEQ ID NO: 399184 - DNA, 15 bp, Homo sapiens
ttaaaaaaagtttta

SEQ ID NO: 399185 - DNA, 15 bp, Homo sapiens
taaaaaaagttttat

SEQ ID NO: 399186 - DNA, 15 bp, Homo sapiens
aaaaaaagttttata

SEQ ID NO: 399187 - DNA, 15 bp, Homo sapiens
aaaaaagttttataa

SEQ ID NO: 399188 - DNA, 15 bp, Homo sapiens
aaaaagttttataag

SEQ ID NO: 399189 - DNA, 15 bp, Homo sapiens
aaaagttttataagt

SEQ ID NO: 399190 - DNA, 15 bp, Homo sapiens
aaagttttataagtt

SEQ ID NO: 399191 - DNA, 15 bp, Homo sapiens
aagttttataagtta

SEQ ID NO: 399192 - DNA, 15 bp, Homo sapiens
agttttataagttat

SEQ ID NO: 399193 - DNA, 15 bp, Homo sapiens
gttttataagttatt

SEQ ID NO: 399194 - DNA, 15 bp, Homo sapiens
ttttataagttattc

SEQ ID NO: 399195 - DNA, 15 bp, Homo sapiens
tttataagttattcc

SEQ ID NO: 399196 - DNA, 15 bp, Homo sapiens
ttataagttattcca

SEQ ID NO: 399197 - DNA, 15 bp, Homo sapiens
tataagttattccac

SEQ ID NO: 399198 - DNA, 15 bp, Homo sapiens
ataagttattccact

SEQ ID NO: 399199 - DNA, 15 bp, Homo sapiens
taagttattccactt

SEQ ID NO: 399200 - DNA, 15 bp, Homo sapiens
aagttattccacttg

SEQ ID NO: 399201 - DNA, 15 bp, Homo sapiens
agttattccacttgg

SEQ ID NO: 399202 - DNA, 15 bp, Homo sapiens
gttattccacttggc

SEQ ID NO: 399203 - DNA, 15 bp, Homo sapiens
ttattccacttggca

SEQ ID NO: 399204 - DNA, 15 bp, Homo sapiens
tattccacttggcat

SEQ ID NO: 399205 - DNA, 15 bp, Homo sapiens
attccacttggcatt

SEQ ID NO: 399206 - DNA, 15 bp, Homo sapiens
ttccacttggcattc

SEQ ID NO: 399207 - DNA, 15 bp, Homo sapiens
tccacttggcattcg

SEQ ID NO: 399208 - DNA, 15 bp, Homo sapiens
ccacttggcattcgg

SEQ ID NO: 399209 - DNA, 15 bp, Homo sapiens
cacttggcattcgga

SEQ ID NO: 399210 - DNA, 15 bp, Homo sapiens
acttggcattcggaa

SEQ ID NO: 399211 - DNA, 15 bp, Homo sapiens
cttggcattcggaac

SEQ ID NO: 399212 - DNA, 15 bp, Homo sapiens
ttggcattcggaaca

SEQ ID NO: 399213 - DNA, 15 bp, Homo sapiens
tggcattcggaacac

SEQ ID NO: 399214 - DNA, 15 bp, Homo sapiens
ggcattcggaacaca

SEQ ID NO: 399215 - DNA, 15 bp, Homo sapiens
gcattcggaacacaa

SEQ ID NO: 399216 - DNA, 15 bp, Homo sapiens
cattcggaacacaat

SEQ ID NO: 399217 - DNA, 15 bp, Homo sapiens
attcggaacacaata

SEQ ID NO: 399218 - DNA, 15 bp, Homo sapiens
ttcggaacacaataa

SEQ ID NO: 399219 - DNA, 15 bp, Homo sapiens
tcggaacacaataat

SEQ ID NO: 399220 - DNA, 15 bp, Homo sapiens
cggaacacaataatg

SEQ ID NO: 399221 - DNA, 15 bp, Homo sapiens
ggaacacaataatgt

SEQ ID NO: 399222 - DNA, 15 bp, Homo sapiens
gaacacaataatgtc

SEQ ID NO: 399223 - DNA, 15 bp, Homo sapiens
aacacaataatgtca

SEQ ID NO: 399224 - DNA, 15 bp, Homo sapiens
acacaataatgtcat

SEQ ID NO: 399225 - DNA, 15 bp, Homo sapiens
cacaataatgtcata

SEQ ID NO: 399226 - DNA, 15 bp, Homo sapiens
acaataatgtcatac

SEQ ID NO: 399227 - DNA, 15 bp, Homo sapiens
caataatgtcatact

SEQ ID NO: 399228 - DNA, 15 bp, Homo sapiens
aataatgtcatactt

SEQ ID NO: 399229 - DNA, 15 bp, Homo sapiens
ataatgtcatacttc

SEQ ID NO: 399230 - DNA, 15 bp, Homo sapiens
taatgtcatacttca

SEQ ID NO: 399231 - DNA, 15 bp, Homo sapiens
aatgtcatacttcac

SEQ ID NO: 399232 - DNA, 15 bp, Homo sapiens
atgtcatacttcact

SEQ ID NO: 399233 - DNA, 15 bp, Homo sapiens
tgtcatacttcactg

SEQ ID NO: 399234 - DNA, 15 bp, Homo sapiens
gtcatacttcactga

SEQ ID NO: 399235 - DNA, 15 bp, Homo sapiens
tcatacttcactgag

SEQ ID NO: 399236 - DNA, 15 bp, Homo sapiens
catacttcactgagg

SEQ ID NO: 399237 - DNA, 15 bp, Homo sapiens
atacttcactgaggc

SEQ ID NO: 399238 - DNA, 15 bp, Homo sapiens
tacttcactgaggca

SEQ ID NO: 399239 - DNA, 15 bp, Homo sapiens
acttcactgaggcat

SEQ ID NO: 399240 - DNA, 15 bp, Homo sapiens
cttcactgaggcata

SEQ ID NO: 399241 - DNA, 15 bp, Homo sapiens
ttcactgaggcatac

SEQ ID NO: 399242 - DNA, 15 bp, Homo sapiens
tcactgaggcatact

SEQ ID NO: 399243 - DNA, 15 bp, Homo sapiens
cactgaggcatacta

SEQ ID NO: 399244 - DNA, 15 bp, Homo sapiens
actgaggcatactaa

SEQ ID NO: 399245 - DNA, 15 bp, Homo sapiens
ctgaggcatactaat

SEQ ID NO: 399246 - DNA, 15 bp, Homo sapiens
tgaggcatactaatg

SEQ ID NO: 399247 - DNA, 15 bp, Homo sapiens
gaggcatactaatgc

SEQ ID NO: 399248 - DNA, 15 bp, Homo sapiens
aggcatactaatgct

SEQ ID NO: 399249 - DNA, 15 bp, Homo sapiens
ggcatactaatgctc

SEQ ID NO: 399250 - DNA, 15 bp, Homo sapiens
gcatactaatgctct

SEQ ID NO: 399251 - DNA, 15 bp, Homo sapiens
catactaatgctctg

SEQ ID NO: 399252 - DNA, 15 bp, Homo sapiens
atactaatgctctgg

SEQ ID NO: 399253 - DNA, 15 bp, Homo sapiens
tactaatgctctgga

SEQ ID NO: 399254 - DNA, 15 bp, Homo sapiens
actaatgctctggaa

SEQ ID NO: 399255 - DNA, 15 bp, Homo sapiens
ctaatgctctggaaa

SEQ ID NO: 399256 - DNA, 15 bp, Homo sapiens
taatgctctggaaag

SEQ ID NO: 399257 - DNA, 15 bp, Homo sapiens
aatgctctggaaaga

SEQ ID NO: 399258 - DNA, 15 bp, Homo sapiens
atgctctggaaagaa

SEQ ID NO: 399259 - DNA, 15 bp, Homo sapiens
tgctctggaaagaaa

SEQ ID NO: 399260 - DNA, 15 bp, Homo sapiens
gctctggaaagaaag

SEQ ID NO: 399261 - DNA, 15 bp, Homo sapiens
ctctggaaagaaaga

SEQ ID NO: 399262 - DNA, 15 bp, Homo sapiens
tctggaaagaaagaa

SEQ ID NO: 399263 - DNA, 15 bp, Homo sapiens
ctggaaagaaagaaa

SEQ ID NO: 399264 - DNA, 15 bp, Homo sapiens
tggaaagaaagaaaa

SEQ ID NO: 399265 - DNA, 15 bp, Homo sapiens
ggaaagaaagaaaaa

SEQ ID NO: 399266 - DNA, 15 bp, Homo sapiens
gaaagaaagaaaaag

SEQ ID NO: 399267 - DNA, 15 bp, Homo sapiens
aaagaaagaaaaaga

SEQ ID NO: 399268 - DNA, 15 bp, Homo sapiens
aagaaagaaaaagaa

SEQ ID NO: 399269 - DNA, 15 bp, Homo sapiens
agaaagaaaaagaag

SEQ ID NO: 399270 - DNA, 15 bp, Homo sapiens
gaaagaaaaagaagg

SEQ ID NO: 399271 - DNA, 15 bp, Homo sapiens
aaagaaaaagaagga

SEQ ID NO: 399272 - DNA, 15 bp, Homo sapiens
aagaaaaagaaggaa

SEQ ID NO: 399273 - DNA, 15 bp, Homo sapiens
agaaaaagaaggaaa

SEQ ID NO: 399274 - DNA, 15 bp, Homo sapiens
gaaaaagaaggaaaa

SEQ ID NO: 399275 - DNA, 15 bp, Homo sapiens
aaaaagaaggaaaat

SEQ ID NO: 399276 - DNA, 15 bp, Homo sapiens
aaaagaaggaaaatt

SEQ ID NO: 399277 - DNA, 15 bp, Homo sapiens
aaagaaggaaaatta

SEQ ID NO: 399278 - DNA, 15 bp, Homo sapiens
aagaaggaaaattaa

SEQ ID NO: 399279 - DNA, 15 bp, Homo sapiens
agaaggaaaattaat

SEQ ID NO: 399280 - DNA, 15 bp, Homo sapiens
gaaggaaaattaatt

SEQ ID NO: 399281 - DNA, 15 bp, Homo sapiens
aaggaaaattaattt

SEQ ID NO: 399282 - DNA, 15 bp, Homo sapiens
aggaaaattaattta

SEQ ID NO: 399283 - DNA, 15 bp, Homo sapiens
ggaaaattaatttag

SEQ ID NO: 399284 - DNA, 15 bp, Homo sapiens
gaaaattaatttaga

SEQ ID NO: 399285 - DNA, 15 bp, Homo sapiens
aaaattaatttagag

SEQ ID NO: 399286 - DNA, 15 bp, Homo sapiens
aaattaatttagagg

SEQ ID NO: 399287 - DNA, 15 bp, Homo sapiens
aattaatttagaggg

SEQ ID NO: 399288 - DNA, 15 bp, Homo sapiens
attaatttagaggga

SEQ ID NO: 399289 - DNA, 15 bp, Homo sapiens
ttaatttagagggaa

SEQ ID NO: 399290 - DNA, 15 bp, Homo sapiens
taatttagagggaat

SEQ ID NO: 399291 - DNA, 15 bp, Homo sapiens
aatttagagggaatg

SEQ ID NO: 399292 - DNA, 15 bp, Homo sapiens
atttagagggaatgg

SEQ ID NO: 399293 - DNA, 15 bp, Homo sapiens
tttagagggaatgga

SEQ ID NO: 399294 - DNA, 15 bp, Homo sapiens
ttagagggaatggag

SEQ ID NO: 399295 - DNA, 15 bp, Homo sapiens
tagagggaatggagg

SEQ ID NO: 399296 - DNA, 15 bp, Homo sapiens
agagggaatggaggc

SEQ ID NO: 399297 - DNA, 15 bp, Homo sapiens
gagggaatggaggct

SEQ ID NO: 399298 - DNA, 15 bp, Homo sapiens
agggaatggaggcta

SEQ ID NO: 399299 - DNA, 15 bp, Homo sapiens
gggaatggaggctaa

SEQ ID NO: 399300 - DNA, 15 bp, Homo sapiens
ggaatggaggctaaa

SEQ ID NO: 399301 - DNA, 15 bp, Homo sapiens
gaatggaggctaaat

SEQ ID NO: 399302 - DNA, 15 bp, Homo sapiens
aatggaggctaaatt

SEQ ID NO: 399303 - DNA, 15 bp, Homo sapiens
atggaggctaaattt

SEQ ID NO: 399304 - DNA, 15 bp, Homo sapiens
tggaggctaaatttt

SEQ ID NO: 399305 - DNA, 15 bp, Homo sapiens
ggaggctaaattttc

SEQ ID NO: 399306 - DNA, 15 bp, Homo sapiens
gaggctaaattttcc

SEQ ID NO: 399307 - DNA, 15 bp, Homo sapiens
aggctaaattttcca

SEQ ID NO: 399308 - DNA, 15 bp, Homo sapiens
ggctaaattttccat

SEQ ID NO: 399309 - DNA, 15 bp, Homo sapiens
gctaaattttccatg

SEQ ID NO: 399310 - DNA, 15 bp, Homo sapiens
ctaaattttccatgg

SEQ ID NO: 399311 - DNA, 15 bp, Homo sapiens
taaattttccatggt

SEQ ID NO: 399312 - DNA, 15 bp, Homo sapiens
aaattttccatggtg

SEQ ID NO: 399313 - DNA, 15 bp, Homo sapiens
aattttccatggtga

SEQ ID NO: 399314 - DNA, 15 bp, Homo sapiens
attttccatggtgaa

SEQ ID NO: 399315 - DNA, 15 bp, Homo sapiens
ttttccatggtgaag

SEQ ID NO: 399316 - DNA, 15 bp, Homo sapiens
tttccatggtgaaga

SEQ ID NO: 399317 - DNA, 15 bp, Homo sapiens
ttccatggtgaagaa

SEQ ID NO: 399318 - DNA, 15 bp, Homo sapiens
tccatggtgaagaaa

SEQ ID NO: 399319 - DNA, 15 bp, Homo sapiens
ccatggtgaagaaat

SEQ ID NO: 399320 - DNA, 15 bp, Homo sapiens
catggtgaagaaatt

SEQ ID NO: 399321 - DNA, 15 bp, Homo sapiens
atggtgaagaaattc

SEQ ID NO: 399322 - DNA, 15 bp, Homo sapiens
tggtgaagaaattct

SEQ ID NO: 399323 - DNA, 15 bp, Homo sapiens
ggtgaagaaattctg

SEQ ID NO: 399324 - DNA, 15 bp, Homo sapiens
gtgaagaaattctga

SEQ ID NO: 399325 - DNA, 15 bp, Homo sapiens
tgaagaaattctgac

SEQ ID NO: 399326 - DNA, 15 bp, Homo sapiens
gaagaaattctgacc

SEQ ID NO: 399327 - DNA, 15 bp, Homo sapiens
aagaaattctgacct

SEQ ID NO: 399328 - DNA, 15 bp, Homo sapiens
agaaattctgacctt

SEQ ID NO: 399329 - DNA, 15 bp, Homo sapiens
gaaattctgaccttt

SEQ ID NO: 399330 - DNA, 15 bp, Homo sapiens
aaattctgacctttt

SEQ ID NO: 399331 - DNA, 15 bp, Homo sapiens
aattctgaccttttc

SEQ ID NO: 399332 - DNA, 15 bp, Homo sapiens
attctgaccttttct

SEQ ID NO: 399333 - DNA, 15 bp, Homo sapiens
ttctgaccttttctg

SEQ ID NO: 399334 - DNA, 15 bp, Homo sapiens
tctgaccttttctga

SEQ ID NO: 399335 - DNA, 15 bp, Homo sapiens
ctgaccttttctgag

SEQ ID NO: 399336 - DNA, 15 bp, Homo sapiens
tgaccttttctgagt

SEQ ID NO: 399337 - DNA, 15 bp, Homo sapiens
gaccttttctgagtt

SEQ ID NO: 399338 - DNA, 15 bp, Homo sapiens
accttttctgagtta

SEQ ID NO: 399339 - DNA, 15 bp, Homo sapiens
ccttttctgagttat

SEQ ID NO: 399340 - DNA, 15 bp, Homo sapiens
cttttctgagttatc

SEQ ID NO: 399341 - DNA, 15 bp, Homo sapiens
ttttctgagttatcg

SEQ ID NO: 399342 - DNA, 15 bp, Homo sapiens
tttctgagttatcgt

SEQ ID NO: 399343 - DNA, 15 bp, Homo sapiens
ttctgagttatcgta

SEQ ID NO: 399344 - DNA, 15 bp, Homo sapiens
tctgagttatcgtaa

SEQ ID NO: 399345 - DNA, 15 bp, Homo sapiens
ctgagttatcgtaaa

SEQ ID NO: 399346 - DNA, 15 bp, Homo sapiens
tgagttatcgtaaaa

SEQ ID NO: 399347 - DNA, 15 bp, Homo sapiens
gagttatcgtaaaag

SEQ ID NO: 399348 - DNA, 15 bp, Homo sapiens
agttatcgtaaaaga

SEQ ID NO: 399349 - DNA, 15 bp, Homo sapiens
gttatcgtaaaagac

SEQ ID NO: 399350 - DNA, 15 bp, Homo sapiens
ttatcgtaaaagact

SEQ ID NO: 399351 - DNA, 15 bp, Homo sapiens
tatcgtaaaagactg

SEQ ID NO: 399352 - DNA, 15 bp, Homo sapiens
atcgtaaaagactga

SEQ ID NO: 399353 - DNA, 15 bp, Homo sapiens
tcgtaaaagactgac

SEQ ID NO: 399354 - DNA, 15 bp, Homo sapiens
cgtaaaagactgaca

SEQ ID NO: 399355 - DNA, 15 bp, Homo sapiens
gtaaaagactgacat

SEQ ID NO: 399356 - DNA, 15 bp, Homo sapiens
taaaagactgacatt

SEQ ID NO: 399357 - DNA, 15 bp, Homo sapiens
aaaagactgacattg

SEQ ID NO: 399358 - DNA, 15 bp, Homo sapiens
aaagactgacattgc

SEQ ID NO: 399359 - DNA, 15 bp, Homo sapiens
aagactgacattgct

SEQ ID NO: 399360 - DNA, 15 bp, Homo sapiens
agactgacattgcta

SEQ ID NO: 399361 - DNA, 15 bp, Homo sapiens
gactgacattgctac

SEQ ID NO: 399362 - DNA, 15 bp, Homo sapiens
actgacattgctacc

SEQ ID NO: 399363 - DNA, 15 bp, Homo sapiens
ctgacattgctaccc

SEQ ID NO: 399364 - DNA, 15 bp, Homo sapiens
tgacattgctaccct

SEQ ID NO: 399365 - DNA, 15 bp, Homo sapiens
gacattgctaccctt

SEQ ID NO: 399366 - DNA, 15 bp, Homo sapiens
acattgctacccttt

SEQ ID NO: 399367 - DNA, 15 bp, Homo sapiens
cattgctaccctttg

SEQ ID NO: 399368 - DNA, 15 bp, Homo sapiens
attgctaccctttgg

SEQ ID NO: 399369 - DNA, 15 bp, Homo sapiens
ttgctaccctttgga

SEQ ID NO: 399370 - DNA, 15 bp, Homo sapiens
tgctaccctttggat

SEQ ID NO: 399371 - DNA, 15 bp, Homo sapiens
gctaccctttggatg

SEQ ID NO: 399372 - DNA, 15 bp, Homo sapiens
ctaccctttggatgt

SEQ ID NO: 399373 - DNA, 15 bp, Homo sapiens
taccctttggatgtt

SEQ ID NO: 399374 - DNA, 15 bp, Homo sapiens
accctttggatgtta

SEQ ID NO: 399375 - DNA, 15 bp, Homo sapiens
ccctttggatgttaa

SEQ ID NO: 399376 - DNA, 15 bp, Homo sapiens
cctttggatgttaag

SEQ ID NO: 399377 - DNA, 15 bp, Homo sapiens
ctttggatgttaaga

SEQ ID NO: 399378 - DNA, 15 bp, Homo sapiens
tttggatgttaagaa

SEQ ID NO: 399379 - DNA, 15 bp, Homo sapiens
ttggatgttaagaaa

SEQ ID NO: 399380 - DNA, 15 bp, Homo sapiens
tggatgttaagaaaa

SEQ ID NO: 399381 - DNA, 15 bp, Homo sapiens
ggatgttaagaaaaa

SEQ ID NO: 399382 - DNA, 15 bp, Homo sapiens
gatgttaagaaaaag

SEQ ID NO: 399383 - DNA, 15 bp, Homo sapiens
atgttaagaaaaagt

SEQ ID NO: 399384 - DNA, 15 bp, Homo sapiens
tgttaagaaaaagtc

SEQ ID NO: 399385 - DNA, 15 bp, Homo sapiens
gttaagaaaaagtct

SEQ ID NO: 399386 - DNA, 15 bp, Homo sapiens
ttaagaaaaagtctt

SEQ ID NO: 399387 - DNA, 15 bp, Homo sapiens
taagaaaaagtcttt

SEQ ID NO: 399388 - DNA, 15 bp, Homo sapiens
aagaaaaagtctttc

SEQ ID NO: 399389 - DNA, 15 bp, Homo sapiens
agaaaaagtctttca

SEQ ID NO: 399390 - DNA, 15 bp, Homo sapiens
gaaaaagtctttcag

SEQ ID NO: 399391 - DNA, 15 bp, Homo sapiens
aaaaagtctttcaga

SEQ ID NO: 399392 - DNA, 15 bp, Homo sapiens
aaaagtctttcagat

SEQ ID NO: 399393 - DNA, 15 bp, Homo sapiens
aaagtctttcagata

SEQ ID NO: 399394 - DNA, 15 bp, Homo sapiens
aagtctttcagatac

SEQ ID NO: 399395 - DNA, 15 bp, Homo sapiens
agtctttcagatacc

SEQ ID NO: 399396 - DNA, 15 bp, Homo sapiens
gtctttcagatacct

SEQ ID NO: 399397 - DNA, 15 bp, Homo sapiens
tctttcagatacctt

SEQ ID NO: 399398 - DNA, 15 bp, Homo sapiens
ctttcagataccttg

SEQ ID NO: 399399 - DNA, 15 bp, Homo sapiens
tttcagataccttgg

SEQ ID NO: 399400 - DNA, 15 bp, Homo sapiens
ttcagataccttggc

SEQ ID NO: 399401 - DNA, 15 bp, Homo sapiens
tcagataccttggct

SEQ ID NO: 399402 - DNA, 15 bp, Homo sapiens
cagataccttggctt

SEQ ID NO: 399403 - DNA, 15 bp, Homo sapiens
agataccttggcttg

SEQ ID NO: 399404 - DNA, 15 bp, Homo sapiens
gataccttggcttgt

SEQ ID NO: 399405 - DNA, 15 bp, Homo sapiens
ataccttggcttgta

SEQ ID NO: 399406 - DNA, 15 bp, Homo sapiens
taccttggcttgtaa

SEQ ID NO: 399407 - DNA, 15 bp, Homo sapiens
accttggcttgtaag

SEQ ID NO: 399408 - DNA, 15 bp, Homo sapiens
ccttggcttgtaagg

SEQ ID NO: 399409 - DNA, 15 bp, Homo sapiens
cttggcttgtaaggg

SEQ ID NO: 399410 - DNA, 15 bp, Homo sapiens
ttggcttgtaaggga

SEQ ID NO: 399411 - DNA, 15 bp, Homo sapiens
tggcttgtaagggac

SEQ ID NO: 399412 - DNA, 15 bp, Homo sapiens
ggcttgtaagggacc

SEQ ID NO: 399413 - DNA, 15 bp, Homo sapiens
gcttgtaagggacct

SEQ ID NO: 399414 - DNA, 15 bp, Homo sapiens
cttgtaagggacctg

SEQ ID NO: 399415 - DNA, 15 bp, Homo sapiens
ttgtaagggacctgg

SEQ ID NO: 399416 - DNA, 15 bp, Homo sapiens
tgtaagggacctggg

SEQ ID NO: 399417 - DNA, 15 bp, Homo sapiens
gtaagggacctggga

SEQ ID NO: 399418 - DNA, 15 bp, Homo sapiens
taagggacctgggaa

SEQ ID NO: 399419 - DNA, 15 bp, Homo sapiens
aagggacctgggaag

SEQ ID NO: 399420 - DNA, 15 bp, Homo sapiens
agggacctgggaagc

SEQ ID NO: 399421 - DNA, 15 bp, Homo sapiens
gggacctgggaagcg

SEQ ID NO: 399422 - DNA, 15 bp, Homo sapiens
ggacctgggaagcgc

SEQ ID NO: 399423 - DNA, 15 bp, Homo sapiens
gacctgggaagcgcc

SEQ ID NO: 399424 - DNA, 15 bp, Homo sapiens
acctgggaagcgcca

SEQ ID NO: 399425 - DNA, 15 bp, Homo sapiens
cctgggaagcgccag

SEQ ID NO: 399426 - DNA, 15 bp, Homo sapiens
ctgggaagcgccagg

SEQ ID NO: 399427 - DNA, 15 bp, Homo sapiens
tgggaagcgccaggg

SEQ ID NO: 399428 - DNA, 15 bp, Homo sapiens
gggaagcgccagggt

SEQ ID NO: 399429 - DNA, 15 bp, Homo sapiens
ggaagcgccagggtc

SEQ ID NO: 399430 - DNA, 15 bp, Homo sapiens
gaagcgccagggtcc

SEQ ID NO: 399431 - DNA, 15 bp, Homo sapiens
aagcgccagggtcca

SEQ ID NO: 399432 - DNA, 15 bp, Homo sapiens
agcgccagggtccat

SEQ ID NO: 399433 - DNA, 15 bp, Homo sapiens
gcgccagggtccatc

SEQ ID NO: 399434 - DNA, 15 bp, Homo sapiens
cgccagggtccatca

SEQ ID NO: 399435 - DNA, 15 bp, Homo sapiens
gccagggtccatcaa

SEQ ID NO: 399436 - DNA, 15 bp, Homo sapiens
ccagggtccatcaaa

SEQ ID NO: 399437 - DNA, 15 bp, Homo sapiens
cagggtccatcaaaa

SEQ ID NO: 399438 - DNA, 15 bp, Homo sapiens
agggtccatcaaaaa

SEQ ID NO: 399439 - DNA, 15 bp, Homo sapiens
gggtccatcaaaaat

SEQ ID NO: 399440 - DNA, 15 bp, Homo sapiens
ggtccatcaaaaatg

SEQ ID NO: 399441 - DNA, 15 bp, Homo sapiens
gtccatcaaaaatgt

SEQ ID NO: 399442 - DNA, 15 bp, Homo sapiens
tccatcaaaaatgta

SEQ ID NO: 399443 - DNA, 15 bp, Homo sapiens
ccatcaaaaatgtaa

SEQ ID NO: 399444 - DNA, 15 bp, Homo sapiens
catcaaaaatgtaaa

SEQ ID NO: 399445 - DNA, 15 bp, Homo sapiens
atcaaaaatgtaaag

SEQ ID NO: 399446 - DNA, 15 bp, Homo sapiens
tcaaaaatgtaaaga

SEQ ID NO: 399447 - DNA, 15 bp, Homo sapiens
caaaaatgtaaagac

SEQ ID NO: 399448 - DNA, 15 bp, Homo sapiens
aaaaatgtaaagaca

SEQ ID NO: 399449 - DNA, 15 bp, Homo sapiens
aaaatgtaaagacat

SEQ ID NO: 399450 - DNA, 15 bp, Homo sapiens
aaatgtaaagacatt

SEQ ID NO: 399451 - DNA, 15 bp, Homo sapiens
aatgtaaagacattt

SEQ ID NO: 399452 - DNA, 15 bp, Homo sapiens
atgtaaagacattta

SEQ ID NO: 399453 - DNA, 15 bp, Homo sapiens
tgtaaagacatttat

SEQ ID NO: 399454 - DNA, 15 bp, Homo sapiens
gtaaagacatttatt

SEQ ID NO: 399455 - DNA, 15 bp, Homo sapiens
taaagacatttatta

SEQ ID NO: 399456 - DNA, 15 bp, Homo sapiens
aaagacatttattag

SEQ ID NO: 399457 - DNA, 15 bp, Homo sapiens
aagacatttattaga

SEQ ID NO: 399458 - DNA, 15 bp, Homo sapiens
agacatttattagaa

SEQ ID NO: 399459 - DNA, 15 bp, Homo sapiens
gacatttattagaac

SEQ ID NO: 399460 - DNA, 15 bp, Homo sapiens
acatttattagaaca

SEQ ID NO: 399461 - DNA, 15 bp, Homo sapiens
catttattagaacat

SEQ ID NO: 399462 - DNA, 15 bp, Homo sapiens
atttattagaacatg

SEQ ID NO: 399463 - DNA, 15 bp, Homo sapiens
tttattagaacatgc

SEQ ID NO: 399464 - DNA, 15 bp, Homo sapiens
ttattagaacatgca

SEQ ID NO: 399465 - DNA, 15 bp, Homo sapiens
tattagaacatgcat

SEQ ID NO: 399466 - DNA, 15 bp, Homo sapiens
attagaacatgcata

SEQ ID NO: 399467 - DNA, 15 bp, Homo sapiens
ttagaacatgcatat

SEQ ID NO: 399468 - DNA, 15 bp, Homo sapiens
tagaacatgcatatc

SEQ ID NO: 399469 - DNA, 15 bp, Homo sapiens
agaacatgcatatcc

SEQ ID NO: 399470 - DNA, 15 bp, Homo sapiens
gaacatgcatatccg

SEQ ID NO: 399471 - DNA, 15 bp, Homo sapiens
aacatgcatatccga

SEQ ID NO: 399472 - DNA, 15 bp, Homo sapiens
acatgcatatccgaa

SEQ ID NO: 399473 - DNA, 15 bp, Homo sapiens
catgcatatccgaaa

SEQ ID NO: 399474 - DNA, 15 bp, Homo sapiens
atgcatatccgaaag

SEQ ID NO: 399475 - DNA, 15 bp, Homo sapiens
tgcatatccgaaagc

SEQ ID NO: 399476 - DNA, 15 bp, Homo sapiens
gcatatccgaaagct

SEQ ID NO: 399477 - DNA, 15 bp, Homo sapiens
catatccgaaagctt

SEQ ID NO: 399478 - DNA, 15 bp, Homo sapiens
atatccgaaagcttt

SEQ ID NO: 399479 - DNA, 15 bp, Homo sapiens
tatccgaaagctttc

SEQ ID NO: 399480 - DNA, 15 bp, Homo sapiens
atccgaaagctttct

SEQ ID NO: 399481 - DNA, 15 bp, Homo sapiens
tccgaaagctttctg

SEQ ID NO: 399482 - DNA, 15 bp, Homo sapiens
ccgaaagctttctga

SEQ ID NO: 399483 - DNA, 15 bp, Homo sapiens
cgaaagctttctgaa

SEQ ID NO: 399484 - DNA, 15 bp, Homo sapiens
gaaagctttctgaat

SEQ ID NO: 399485 - DNA, 15 bp, Homo sapiens
aaagctttctgaatt

SEQ ID NO: 399486 - DNA, 15 bp, Homo sapiens
aagctttctgaattc

SEQ ID NO: 399487 - DNA, 15 bp, Homo sapiens
agctttctgaattct

SEQ ID NO: 399488 - DNA, 15 bp, Homo sapiens
gctttctgaattctg

SEQ ID NO: 399489 - DNA, 15 bp, Homo sapiens
ctttctgaattctgt

SEQ ID NO: 399490 - DNA, 15 bp, Homo sapiens
tttctgaattctgtg

SEQ ID NO: 399491 - DNA, 15 bp, Homo sapiens
ttctgaattctgtgg

SEQ ID NO: 399492 - DNA, 15 bp, Homo sapiens
tctgaattctgtggg

SEQ ID NO: 399493 - DNA, 15 bp, Homo sapiens
ctgaattctgtgggg

SEQ ID NO: 399494 - DNA, 15 bp, Homo sapiens
tgaattctgtgggga

SEQ ID NO: 399495 - DNA, 15 bp, Homo sapiens
gaattctgtggggac

SEQ ID NO: 399496 - DNA, 15 bp, Homo sapiens
aattctgtggggacc

SEQ ID NO: 399497 - DNA, 15 bp, Homo sapiens
attctgtggggacca

SEQ ID NO: 399498 - DNA, 15 bp, Homo sapiens
ttctgtggggaccat

SEQ ID NO: 399499 - DNA, 15 bp, Homo sapiens
tctgtggggaccatc

SEQ ID NO: 399500 - DNA, 15 bp, Homo sapiens
ctgtggggaccatct

SEQ ID NO: 399501 - DNA, 15 bp, Homo sapiens
tgtggggaccatcta

SEQ ID NO: 399502 - DNA, 15 bp, Homo sapiens
gtggggaccatctag

SEQ ID NO: 399503 - DNA, 15 bp, Homo sapiens
tggggaccatctagc

SEQ ID NO: 399504 - DNA, 15 bp, Homo sapiens
ggggaccatctagct

SEQ ID NO: 399505 - DNA, 15 bp, Homo sapiens
gggaccatctagctt

SEQ ID NO: 399506 - DNA, 15 bp, Homo sapiens
ggaccatctagcttt

SEQ ID NO: 399507 - DNA, 15 bp, Homo sapiens
gaccatctagctttt

SEQ ID NO: 399508 - DNA, 15 bp, Homo sapiens
accatctagctttta

SEQ ID NO: 399509 - DNA, 15 bp, Homo sapiens
ccatctagcttttac

SEQ ID NO: 399510 - DNA, 15 bp, Homo sapiens
catctagcttttaca

SEQ ID NO: 399511 - DNA, 15 bp, Homo sapiens
atctagcttttacat

SEQ ID NO: 399512 - DNA, 15 bp, Homo sapiens
tctagcttttacatg

SEQ ID NO: 399513 - DNA, 15 bp, Homo sapiens
ctagcttttacatga

SEQ ID NO: 399514 - DNA, 15 bp, Homo sapiens
tagcttttacatgat

SEQ ID NO: 399515 - DNA, 15 bp, Homo sapiens
agcttttacatgatc

SEQ ID NO: 399516 - DNA, 15 bp, Homo sapiens
gcttttacatgatct

SEQ ID NO: 399517 - DNA, 15 bp, Homo sapiens
cttttacatgatctt

SEQ ID NO: 399518 - DNA, 15 bp, Homo sapiens
ttttacatgatcttg

SEQ ID NO: 399519 - DNA, 15 bp, Homo sapiens
tttacatgatcttga

SEQ ID NO: 399520 - DNA, 15 bp, Homo sapiens
ttacatgatcttgag

SEQ ID NO: 399521 - DNA, 15 bp, Homo sapiens
tacatgatcttgagg

SEQ ID NO: 399522 - DNA, 15 bp, Homo sapiens
acatgatcttgaggg

SEQ ID NO: 399523 - DNA, 15 bp, Homo sapiens
catgatcttgaggga

SEQ ID NO: 399524 - DNA, 15 bp, Homo sapiens
atgatcttgagggaa

SEQ ID NO: 399525 - DNA, 15 bp, Homo sapiens
tgatcttgagggaac

SEQ ID NO: 399526 - DNA, 15 bp, Homo sapiens
gatcttgagggaacc

SEQ ID NO: 399527 - DNA, 15 bp, Homo sapiens
atcttgagggaacca

SEQ ID NO: 399528 - DNA, 15 bp, Homo sapiens
tcttgagggaaccaa

SEQ ID NO: 399529 - DNA, 15 bp, Homo sapiens
cttgagggaaccaaa

SEQ ID NO: 399530 - DNA, 15 bp, Homo sapiens
ttgagggaaccaaag

SEQ ID NO: 399531 - DNA, 15 bp, Homo sapiens
tgagggaaccaaagt

SEQ ID NO: 399532 - DNA, 15 bp, Homo sapiens
gagggaaccaaagtt

SEQ ID NO: 399533 - DNA, 15 bp, Homo sapiens
agggaaccaaagttg

SEQ ID NO: 399534 - DNA, 15 bp, Homo sapiens
gggaaccaaagttgt

SEQ ID NO: 399535 - DNA, 15 bp, Homo sapiens
ggaaccaaagttgta

SEQ ID NO: 399536 - DNA, 15 bp, Homo sapiens
gaaccaaagttgtac

SEQ ID NO: 399537 - DNA, 15 bp, Homo sapiens
aaccaaagttgtact

SEQ ID NO: 399538 - DNA, 15 bp, Homo sapiens
accaaagttgtactg

SEQ ID NO: 399539 - DNA, 15 bp, Homo sapiens
ccaaagttgtactga

SEQ ID NO: 399540 - DNA, 15 bp, Homo sapiens
caaagttgtactgag

SEQ ID NO: 399541 - DNA, 15 bp, Homo sapiens
aaagttgtactgaga

SEQ ID NO: 399542 - DNA, 15 bp, Homo sapiens
aagttgtactgagaa

SEQ ID NO: 399543 - DNA, 15 bp, Homo sapiens
agttgtactgagaaa

SEQ ID NO: 399544 - DNA, 15 bp, Homo sapiens
gttgtactgagaaaa

SEQ ID NO: 399545 - DNA, 15 bp, Homo sapiens
ttgtactgagaaaac

SEQ ID NO: 399546 - DNA, 15 bp, Homo sapiens
tgtactgagaaaacc

SEQ ID NO: 399547 - DNA, 15 bp, Homo sapiens
gtactgagaaaaccc

SEQ ID NO: 399548 - DNA, 15 bp, Homo sapiens
tactgagaaaaccca

SEQ ID NO: 399549 - DNA, 15 bp, Homo sapiens
actgagaaaacccag

SEQ ID NO: 399550 - DNA, 15 bp, Homo sapiens
ctgagaaaacccagt

SEQ ID NO: 399551 - DNA, 15 bp, Homo sapiens
tgagaaaacccagtt

SEQ ID NO: 399552 - DNA, 15 bp, Homo sapiens
gagaaaacccagttt

SEQ ID NO: 399553 - DNA, 15 bp, Homo sapiens
agaaaacccagtttc

SEQ ID NO: 399554 - DNA, 15 bp, Homo sapiens
gaaaacccagtttcc

SEQ ID NO: 399555 - DNA, 15 bp, Homo sapiens
aaaacccagtttcct

SEQ ID NO: 399556 - DNA, 15 bp, Homo sapiens
aaacccagtttcctc

SEQ ID NO: 399557 - DNA, 15 bp, Homo sapiens
aacccagtttcctct

SEQ ID NO: 399558 - DNA, 15 bp, Homo sapiens
acccagtttcctctt

SEQ ID NO: 399559 - DNA, 15 bp, Homo sapiens
cccagtttcctctta

SEQ ID NO: 399560 - DNA, 15 bp, Homo sapiens
ccagtttcctcttaa

SEQ ID NO: 399561 - DNA, 15 bp, Homo sapiens
cagtttcctcttaat

SEQ ID NO: 399562 - DNA, 15 bp, Homo sapiens
agtttcctcttaatt

SEQ ID NO: 399563 - DNA, 15 bp, Homo sapiens
gtttcctcttaattc

SEQ ID NO: 399564 - DNA, 15 bp, Homo sapiens
tttcctcttaattcc

SEQ ID NO: 399565 - DNA, 15 bp, Homo sapiens
ttcctcttaattcca

SEQ ID NO: 399566 - DNA, 15 bp, Homo sapiens
tcctcttaattccat

SEQ ID NO: 399567 - DNA, 15 bp, Homo sapiens
cctcttaattccatc

SEQ ID NO: 399568 - DNA, 15 bp, Homo sapiens
ctcttaattccatcc

SEQ ID NO: 399569 - DNA, 15 bp, Homo sapiens
tcttaattccatcct

SEQ ID NO: 399570 - DNA, 15 bp, Homo sapiens
cttaattccatccta

SEQ ID NO: 399571 - DNA, 15 bp, Homo sapiens
ttaattccatcctat

SEQ ID NO: 399572 - DNA, 15 bp, Homo sapiens
taattccatcctatg

SEQ ID NO: 399573 - DNA, 15 bp, Homo sapiens
aattccatcctatgt

SEQ ID NO: 399574 - DNA, 15 bp, Homo sapiens
attccatcctatgtg

SEQ ID NO: 399575 - DNA, 15 bp, Homo sapiens
ttccatcctatgtga

SEQ ID NO: 399576 - DNA, 15 bp, Homo sapiens
tccatcctatgtgaa

SEQ ID NO: 399577 - DNA, 15 bp, Homo sapiens
ccatcctatgtgaaa

SEQ ID NO: 399578 - DNA, 15 bp, Homo sapiens
catcctatgtgaaaa

SEQ ID NO: 399579 - DNA, 15 bp, Homo sapiens
atcctatgtgaaaac

SEQ ID NO: 399580 - DNA, 15 bp, Homo sapiens
tcctatgtgaaaaca

SEQ ID NO: 399581 - DNA, 15 bp, Homo sapiens
cctatgtgaaaacaa

SEQ ID NO: 399582 - DNA, 15 bp, Homo sapiens
ctatgtgaaaacaac

SEQ ID NO: 399583 - DNA, 15 bp, Homo sapiens
tatgtgaaaacaact

SEQ ID NO: 399584 - DNA, 15 bp, Homo sapiens
atgtgaaaacaactt

SEQ ID NO: 399585 - DNA, 15 bp, Homo sapiens
tgtgaaaacaactta

SEQ ID NO: 399586 - DNA, 15 bp, Homo sapiens
gtgaaaacaacttaa

SEQ ID NO: 399587 - DNA, 15 bp, Homo sapiens
tgaaaacaacttaag

SEQ ID NO: 399588 - DNA, 15 bp, Homo sapiens
gaaaacaacttaagt

SEQ ID NO: 399589 - DNA, 15 bp, Homo sapiens
aaaacaacttaagtc

SEQ ID NO: 399590 - DNA, 15 bp, Homo sapiens
aaacaacttaagtct

SEQ ID NO: 399591 - DNA, 15 bp, Homo sapiens
aacaacttaagtctc

SEQ ID NO: 399592 - DNA, 15 bp, Homo sapiens
acaacttaagtctca

SEQ ID NO: 399593 - DNA, 15 bp, Homo sapiens
caacttaagtctcaa

SEQ ID NO: 399594 - DNA, 15 bp, Homo sapiens
aacttaagtctcaac

SEQ ID NO: 399595 - DNA, 15 bp, Homo sapiens
acttaagtctcaact

SEQ ID NO: 399596 - DNA, 15 bp, Homo sapiens
cttaagtctcaactg

SEQ ID NO: 399597 - DNA, 15 bp, Homo sapiens
ttaagtctcaactgc

SEQ ID NO: 399598 - DNA, 15 bp, Homo sapiens
taagtctcaactgca

SEQ ID NO: 399599 - DNA, 15 bp, Homo sapiens
aagtctcaactgcac

SEQ ID NO: 399600 - DNA, 15 bp, Homo sapiens
agtctcaactgcact

SEQ ID NO: 399601 - DNA, 15 bp, Homo sapiens
gtctcaactgcacta

SEQ ID NO: 399602 - DNA, 15 bp, Homo sapiens
tctcaactgcactaa

SEQ ID NO: 399603 - DNA, 15 bp, Homo sapiens
ctcaactgcactaag

SEQ ID NO: 399604 - DNA, 15 bp, Homo sapiens
tcaactgcactaagt

SEQ ID NO: 399605 - DNA, 15 bp, Homo sapiens
caactgcactaagtt

SEQ ID NO: 399606 - DNA, 15 bp, Homo sapiens
aactgcactaagtta

SEQ ID NO: 399607 - DNA, 15 bp, Homo sapiens
actgcactaagttat

SEQ ID NO: 399608 - DNA, 15 bp, Homo sapiens
ctgcactaagttatg

SEQ ID NO: 399609 - DNA, 15 bp, Homo sapiens
tgcactaagttatga

SEQ ID NO: 399610 - DNA, 15 bp, Homo sapiens
gcactaagttatgaa

SEQ ID NO: 399611 - DNA, 15 bp, Homo sapiens
cactaagttatgaaa

SEQ ID NO: 399612 - DNA, 15 bp, Homo sapiens
actaagttatgaaaa

SEQ ID NO: 399613 - DNA, 15 bp, Homo sapiens
ctaagttatgaaaat

SEQ ID NO: 399614 - DNA, 15 bp, Homo sapiens
taagttatgaaaatg

SEQ ID NO: 399615 - DNA, 15 bp, Homo sapiens
aagttatgaaaatgg

SEQ ID NO: 399616 - DNA, 15 bp, Homo sapiens
agttatgaaaatgga

SEQ ID NO: 399617 - DNA, 15 bp, Homo sapiens
gttatgaaaatggat

SEQ ID NO: 399618 - DNA, 15 bp, Homo sapiens
ttatgaaaatggatc

SEQ ID NO: 399619 - DNA, 15 bp, Homo sapiens
tatgaaaatggatcc

SEQ ID NO: 399620 - DNA, 15 bp, Homo sapiens
atgaaaatggatcct

SEQ ID NO: 399621 - DNA, 15 bp, Homo sapiens
tgaaaatggatcctc

SEQ ID NO: 399622 - DNA, 15 bp, Homo sapiens
gaaaatggatcctct

SEQ ID NO: 399623 - DNA, 15 bp, Homo sapiens
aaaatggatcctctt

SEQ ID NO: 399624 - DNA, 15 bp, Homo sapiens
aaatggatcctcttt

SEQ ID NO: 399625 - DNA, 15 bp, Homo sapiens
aatggatcctctttt

SEQ ID NO: 399626 - DNA, 15 bp, Homo sapiens
atggatcctcttttt

SEQ ID NO: 399627 - DNA, 15 bp, Homo sapiens
tggatcctctttttt

SEQ ID NO: 399628 - DNA, 15 bp, Homo sapiens
ggatcctcttttttt

SEQ ID NO: 399629 - DNA, 15 bp, Homo sapiens
gatcctcttttttta

SEQ ID NO: 399630 - DNA, 15 bp, Homo sapiens
atcctctttttttaa

SEQ ID NO: 399631 - DNA, 15 bp, Homo sapiens
tcctctttttttaac

SEQ ID NO: 399632 - DNA, 15 bp, Homo sapiens
cctctttttttaaca

SEQ ID NO: 399633 - DNA, 15 bp, Homo sapiens
ctctttttttaacat

SEQ ID NO: 399634 - DNA, 15 bp, Homo sapiens
tctttttttaacatt

SEQ ID NO: 399635 - DNA, 15 bp, Homo sapiens
ctttttttaacattt

SEQ ID NO: 399636 - DNA, 15 bp, Homo sapiens
tttttttaacatttg

SEQ ID NO: 399637 - DNA, 15 bp, Homo sapiens
ttttttaacatttgg

SEQ ID NO: 399638 - DNA, 15 bp, Homo sapiens
tttttaacatttggt

SEQ ID NO: 399639 - DNA, 15 bp, Homo sapiens
ttttaacatttggtt

SEQ ID NO: 399640 - DNA, 15 bp, Homo sapiens
tttaacatttggttt

SEQ ID NO: 399641 - DNA, 15 bp, Homo sapiens
ttaacatttggtttt

SEQ ID NO: 399642 - DNA, 15 bp, Homo sapiens
taacatttggttttt

SEQ ID NO: 399643 - DNA, 15 bp, Homo sapiens
aacatttggtttttg

SEQ ID NO: 399644 - DNA, 15 bp, Homo sapiens
acatttggtttttgg

SEQ ID NO: 399645 - DNA, 15 bp, Homo sapiens
catttggtttttggt

SEQ ID NO: 399646 - DNA, 15 bp, Homo sapiens
atttggtttttggtt

SEQ ID NO: 399647 - DNA, 15 bp, Homo sapiens
tttggtttttggtta

SEQ ID NO: 399648 - DNA, 15 bp, Homo sapiens
ttggtttttggttat

SEQ ID NO: 399649 - DNA, 15 bp, Homo sapiens
tggtttttggttatt

SEQ ID NO: 399650 - DNA, 15 bp, Homo sapiens
ggtttttggttattc

SEQ ID NO: 399651 - DNA, 15 bp, Homo sapiens
gtttttggttattca

SEQ ID NO: 399652 - DNA, 15 bp, Homo sapiens
tttttggttattcat

SEQ ID NO: 399653 - DNA, 15 bp, Homo sapiens
ttttggttattcata

SEQ ID NO: 399654 - DNA, 15 bp, Homo sapiens
tttggttattcatat

SEQ ID NO: 399655 - DNA, 15 bp, Homo sapiens
ttggttattcatatt

SEQ ID NO: 399656 - DNA, 15 bp, Homo sapiens
tggttattcatattg

SEQ ID NO: 399657 - DNA, 15 bp, Homo sapiens
ggttattcatattgt

SEQ ID NO: 399658 - DNA, 15 bp, Homo sapiens
gttattcatattgtc

SEQ ID NO: 399659 - DNA, 15 bp, Homo sapiens
ttattcatattgtct

SEQ ID NO: 399660 - DNA, 15 bp, Homo sapiens
tattcatattgtcta

SEQ ID NO: 399661 - DNA, 15 bp, Homo sapiens
attcatattgtctat

SEQ ID NO: 399662 - DNA, 15 bp, Homo sapiens
ttcatattgtctata

SEQ ID NO: 399663 - DNA, 15 bp, Homo sapiens
tcatattgtctatat

SEQ ID NO: 399664 - DNA, 15 bp, Homo sapiens
catattgtctatatt

SEQ ID NO: 399665 - DNA, 15 bp, Homo sapiens
atattgtctatattc

SEQ ID NO: 399666 - DNA, 15 bp, Homo sapiens
tattgtctatattct

SEQ ID NO: 399667 - DNA, 15 bp, Homo sapiens
attgtctatattctg

SEQ ID NO: 399668 - DNA, 15 bp, Homo sapiens
ttgtctatattctgt

SEQ ID NO: 399669 - DNA, 15 bp, Homo sapiens
tgtctatattctgtt

SEQ ID NO: 399670 - DNA, 15 bp, Homo sapiens
gtctatattctgttc

SEQ ID NO: 399671 - DNA, 15 bp, Homo sapiens
tctatattctgttct

SEQ ID NO: 399672 - DNA, 15 bp, Homo sapiens
ctatattctgttcta

SEQ ID NO: 399673 - DNA, 15 bp, Homo sapiens
tatattctgttctat

SEQ ID NO: 399674 - DNA, 15 bp, Homo sapiens
atattctgttctata

SEQ ID NO: 399675 - DNA, 15 bp, Homo sapiens
tattctgttctataa

SEQ ID NO: 399676 - DNA, 15 bp, Homo sapiens
attctgttctataat

SEQ ID NO: 399677 - DNA, 15 bp, Homo sapiens
ttctgttctataatt

SEQ ID NO: 399678 - DNA, 15 bp, Homo sapiens
tctgttctataattg

SEQ ID NO: 399679 - DNA, 15 bp, Homo sapiens
ctgttctataattgt

SEQ ID NO: 399680 - DNA, 15 bp, Homo sapiens
tgttctataattgta

SEQ ID NO: 399681 - DNA, 15 bp, Homo sapiens
gttctataattgtat

SEQ ID NO: 399682 - DNA, 15 bp, Homo sapiens
ttctataattgtatc

SEQ ID NO: 399683 - DNA, 15 bp, Homo sapiens
tctataattgtatcc

SEQ ID NO: 399684 - DNA, 15 bp, Homo sapiens
ctataattgtatcca

SEQ ID NO: 399685 - DNA, 15 bp, Homo sapiens
tataattgtatccaa

SEQ ID NO: 399686 - DNA, 15 bp, Homo sapiens
ataattgtatccaag

SEQ ID NO: 399687 - DNA, 15 bp, Homo sapiens
taattgtatccaagt

SEQ ID NO: 399688 - DNA, 15 bp, Homo sapiens
aattgtatccaagtg

SEQ ID NO: 399689 - DNA, 15 bp, Homo sapiens
attgtatccaagtgt

SEQ ID NO: 399690 - DNA, 15 bp, Homo sapiens
ttgtatccaagtgtt

SEQ ID NO: 399691 - DNA, 15 bp, Homo sapiens
tgtatccaagtgtta

SEQ ID NO: 399692 - DNA, 15 bp, Homo sapiens
gtatccaagtgttaa

SEQ ID NO: 399693 - DNA, 15 bp, Homo sapiens
tatccaagtgttaaa

SEQ ID NO: 399694 - DNA, 15 bp, Homo sapiens
atccaagtgttaaaa

SEQ ID NO: 399695 - DNA, 15 bp, Homo sapiens
tccaagtgttaaaat

SEQ ID NO: 399696 - DNA, 15 bp, Homo sapiens
ccaagtgttaaaata

SEQ ID NO: 399697 - DNA, 15 bp, Homo sapiens
caagtgttaaaatat

SEQ ID NO: 399698 - DNA, 15 bp, Homo sapiens
aagtgttaaaatata

SEQ ID NO: 399699 - DNA, 15 bp, Homo sapiens
agtgttaaaatatat

SEQ ID NO: 399700 - DNA, 15 bp, Homo sapiens
gtgttaaaatatatt

SEQ ID NO: 399701 - DNA, 15 bp, Homo sapiens
tgttaaaatatattt

SEQ ID NO: 399702 - DNA, 15 bp, Homo sapiens
gttaaaatatatttt

SEQ ID NO: 399703 - DNA, 15 bp, Homo sapiens
ttaaaatatatttta

SEQ ID NO: 399704 - DNA, 15 bp, Homo sapiens
taaaatatattttat

SEQ ID NO: 399705 - DNA, 15 bp, Homo sapiens
aaaatatattttata

SEQ ID NO: 399706 - DNA, 15 bp, Homo sapiens
aaatatattttataa

SEQ ID NO: 399707 - DNA, 15 bp, Homo sapiens
aatatattttataaa

SEQ ID NO: 399708 - DNA, 15 bp, Homo sapiens
atatattttataaat

SEQ ID NO: 399709 - DNA, 15 bp, Homo sapiens
tatattttataaata

SEQ ID NO: 399710 - DNA, 15 bp, Homo sapiens
atattttataaatat

SEQ ID NO: 399711 - DNA, 15 bp, Homo sapiens
tattttataaatata

SEQ ID NO: 399712 - DNA, 15 bp, Homo sapiens
attttataaatatac

SEQ ID NO: 399713 - DNA, 15 bp, Homo sapiens
ttttataaatatact

SEQ ID NO: 399714 - DNA, 15 bp, Homo sapiens
tttataaatatactg

SEQ ID NO: 399715 - DNA, 15 bp, Homo sapiens
ttataaatatactga

SEQ ID NO: 399716 - DNA, 15 bp, Homo sapiens
tataaatatactgac

SEQ ID NO: 399717 - DNA, 15 bp, Homo sapiens
ataaatatactgaca

SEQ ID NO: 399718 - DNA, 15 bp, Homo sapiens
taaatatactgacac

SEQ ID NO: 399719 - DNA, 15 bp, Homo sapiens
aaatatactgacact

SEQ ID NO: 399720 - DNA, 15 bp, Homo sapiens
aatatactgacactg

SEQ ID NO: 399721 - DNA, 15 bp, Homo sapiens
atatactgacactga

SEQ ID NO: 399722 - DNA, 15 bp, Homo sapiens
tatactgacactgaa

SEQ ID NO: 399723 - DNA, 15 bp, Homo sapiens
atactgacactgaaa

SEQ ID NO: 399724 - DNA, 15 bp, Homo sapiens
tactgacactgaaaa

SEQ ID NO: 399725 - DNA, 15 bp, Homo sapiens
actgacactgaaaaa

SEQ ID NO: 399726 - DNA, 15 bp, Homo sapiens
ctgacactgaaaaag

SEQ ID NO: 399727 - DNA, 15 bp, Homo sapiens
tgacactgaaaaaga

SEQ ID NO: 399728 - DNA, 15 bp, Homo sapiens
gacactgaaaaagaa

SEQ ID NO: 399729 - DNA, 15 bp, Homo sapiens
acactgaaaaagaaa

SEQ ID NO: 399730 - DNA, 15 bp, Homo sapiens
cactgaaaaagaaat

SEQ ID NO: 399731 - DNA, 15 bp, Homo sapiens
actgaaaaagaaatc

SEQ ID NO: 399732 - DNA, 15 bp, Homo sapiens
ctgaaaaagaaatca

SEQ ID NO: 399733 - DNA, 15 bp, Homo sapiens
tgaaaaagaaatcaa

SEQ ID NO: 399734 - DNA, 15 bp, Homo sapiens
gaaaaagaaatcaaa

SEQ ID NO: 399735 - DNA, 15 bp, Homo sapiens
aaaaagaaatcaaaa

SEQ ID NO: 399736 - DNA, 15 bp, Homo sapiens
aaaagaaatcaaaag

SEQ ID NO: 399737 - DNA, 15 bp, Homo sapiens
aaagaaatcaaaagc

SEQ ID NO: 399738 - DNA, 15 bp, Homo sapiens
aagaaatcaaaagct

SEQ ID NO: 399739 - DNA, 15 bp, Homo sapiens
agaaatcaaaagctg

SEQ ID NO: 399740 - DNA, 15 bp, Homo sapiens
gaaatcaaaagctga

SEQ ID NO: 399741 - DNA, 15 bp, Homo sapiens
aaatcaaaagctgag

SEQ ID NO: 399742 - DNA, 15 bp, Homo sapiens
aatcaaaagctgaga

SEQ ID NO: 399743 - DNA, 15 bp, Homo sapiens
atcaaaagctgagaa

SEQ ID NO: 399744 - DNA, 15 bp, Homo sapiens
tcaaaagctgagaaa

SEQ ID NO: 399745 - DNA, 15 bp, Homo sapiens
caaaagctgagaaac

SEQ ID NO: 399746 - DNA, 15 bp, Homo sapiens
aaaagctgagaaacg

SEQ ID NO: 399747 - DNA, 15 bp, Homo sapiens
aaagctgagaaacgt

SEQ ID NO: 399748 - DNA, 15 bp, Homo sapiens
aagctgagaaacgtt

SEQ ID NO: 399749 - DNA, 15 bp, Homo sapiens
agctgagaaacgttt

SEQ ID NO: 399750 - DNA, 15 bp, Homo sapiens
gctgagaaacgtttg

SEQ ID NO: 399751 - DNA, 15 bp, Homo sapiens
ctgagaaacgtttgt

SEQ ID NO: 399752 - DNA, 15 bp, Homo sapiens
tgagaaacgtttgtg

SEQ ID NO: 399753 - DNA, 15 bp, Homo sapiens
gagaaacgtttgtga

SEQ ID NO: 399754 - DNA, 15 bp, Homo sapiens
agaaacgtttgtgaa

SEQ ID NO: 399755 - DNA, 15 bp, Homo sapiens
gaaacgtttgtgaat

SEQ ID NO: 399756 - DNA, 15 bp, Homo sapiens
aaacgtttgtgaata

SEQ ID NO: 399757 - DNA, 15 bp, Homo sapiens
aacgtttgtgaatat

SEQ ID NO: 399758 - DNA, 15 bp, Homo sapiens
acgtttgtgaatatg

SEQ ID NO: 399759 - DNA, 15 bp, Homo sapiens
cgtttgtgaatatgg

SEQ ID NO: 399760 - DNA, 15 bp, Homo sapiens
gtttgtgaatatggc

SEQ ID NO: 399761 - DNA, 15 bp, Homo sapiens
tttgtgaatatggct

SEQ ID NO: 399762 - DNA, 15 bp, Homo sapiens
ttgtgaatatggctg

SEQ ID NO: 399763 - DNA, 15 bp, Homo sapiens
tgtgaatatggctgg

SEQ ID NO: 399764 - DNA, 15 bp, Homo sapiens
gtgaatatggctgga

SEQ ID NO: 399765 - DNA, 15 bp, Homo sapiens
tgaatatggctggag

SEQ ID NO: 399766 - DNA, 15 bp, Homo sapiens
gaatatggctggaga

SEQ ID NO: 399767 - DNA, 15 bp, Homo sapiens
aatatggctggagag

SEQ ID NO: 399768 - DNA, 15 bp, Homo sapiens
atatggctggagagt

SEQ ID NO: 399769 - DNA, 15 bp, Homo sapiens
tatggctggagagtc

SEQ ID NO: 399770 - DNA, 15 bp, Homo sapiens
atggctggagagtct

SEQ ID NO: 399771 - DNA, 15 bp, Homo sapiens
tggctggagagtctc

SEQ ID NO: 399772 - DNA, 15 bp, Homo sapiens
ggctggagagtctca

SEQ ID NO: 399773 - DNA, 15 bp, Homo sapiens
gctggagagtctcag

SEQ ID NO: 399774 - DNA, 15 bp, Homo sapiens
ctggagagtctcagt

SEQ ID NO: 399775 - DNA, 15 bp, Homo sapiens
tggagagtctcagta

SEQ ID NO: 399776 - DNA, 15 bp, Homo sapiens
ggagagtctcagtaa

SEQ ID NO: 399777 - DNA, 15 bp, Homo sapiens
gagagtctcagtaag

SEQ ID NO: 399778 - DNA, 15 bp, Homo sapiens
agagtctcagtaaga

SEQ ID NO: 399779 - DNA, 15 bp, Homo sapiens
gagtctcagtaagat

SEQ ID NO: 399780 - DNA, 15 bp, Homo sapiens
agtctcagtaagatg

SEQ ID NO: 399781 - DNA, 15 bp, Homo sapiens
gtctcagtaagatgg

SEQ ID NO: 399782 - DNA, 15 bp, Homo sapiens
tctcagtaagatggg

SEQ ID NO: 399783 - DNA, 15 bp, Homo sapiens
ctcagtaagatgggg

SEQ ID NO: 399784 - DNA, 15 bp, Homo sapiens
tcagtaagatggggg

SEQ ID NO: 399785 - DNA, 15 bp, Homo sapiens
cagtaagatggggga

SEQ ID NO: 399786 - DNA, 15 bp, Homo sapiens
agtaagatgggggac

SEQ ID NO: 399787 - DNA, 15 bp, Homo sapiens
gtaagatgggggaca

SEQ ID NO: 399788 - DNA, 15 bp, Homo sapiens
taagatgggggacat

SEQ ID NO: 399789 - DNA, 15 bp, Homo sapiens
aagatgggggacatc

SEQ ID NO: 399790 - DNA, 15 bp, Homo sapiens
agatgggggacatct

SEQ ID NO: 399791 - DNA, 15 bp, Homo sapiens
gatgggggacatctc

SEQ ID NO: 399792 - DNA, 15 bp, Homo sapiens
atgggggacatctcc

SEQ ID NO: 399793 - DNA, 15 bp, Homo sapiens
tgggggacatctcct

SEQ ID NO: 399794 - DNA, 15 bp, Homo sapiens
gggggacatctcctc

SEQ ID NO: 399795 - DNA, 15 bp, Homo sapiens
ggggacatctcctca

SEQ ID NO: 399796 - DNA, 15 bp, Homo sapiens
gggacatctcctcaa

SEQ ID NO: 399797 - DNA, 15 bp, Homo sapiens
ggacatctcctcaaa

SEQ ID NO: 399798 - DNA, 15 bp, Homo sapiens
gacatctcctcaaat

SEQ ID NO: 399799 - DNA, 15 bp, Homo sapiens
acatctcctcaaatt

SEQ ID NO: 399800 - DNA, 15 bp, Homo sapiens
catctcctcaaattg

SEQ ID NO: 399801 - DNA, 15 bp, Homo sapiens
atctcctcaaattga

SEQ ID NO: 399802 - DNA, 15 bp, Homo sapiens
tctcctcaaattgaa

SEQ ID NO: 399803 - DNA, 15 bp, Homo sapiens
ctcctcaaattgaag

SEQ ID NO: 399804 - DNA, 15 bp, Homo sapiens
tcctcaaattgaaga

SEQ ID NO: 399805 - DNA, 15 bp, Homo sapiens
cctcaaattgaagat

SEQ ID NO: 399806 - DNA, 15 bp, Homo sapiens
ctcaaattgaagatc

SEQ ID NO: 399807 - DNA, 15 bp, Homo sapiens
tcaaattgaagatct

SEQ ID NO: 399808 - DNA, 15 bp, Homo sapiens
caaattgaagatctg

SEQ ID NO: 399809 - DNA, 15 bp, Homo sapiens
aaattgaagatctgg

SEQ ID NO: 399810 - DNA, 15 bp, Homo sapiens
aattgaagatctggg

SEQ ID NO: 399811 - DNA, 15 bp, Homo sapiens
attgaagatctggga

SEQ ID NO: 399812 - DNA, 15 bp, Homo sapiens
ttgaagatctgggaa

SEQ ID NO: 399813 - DNA, 15 bp, Homo sapiens
tgaagatctgggaag

SEQ ID NO: 399814 - DNA, 15 bp, Homo sapiens
gaagatctgggaagt

SEQ ID NO: 399815 - DNA, 15 bp, Homo sapiens
aagatctgggaagta

SEQ ID NO: 399816 - DNA, 15 bp, Homo sapiens
agatctgggaagtaa

SEQ ID NO: 399817 - DNA, 15 bp, Homo sapiens
gatctgggaagtaag

SEQ ID NO: 399818 - DNA, 15 bp, Homo sapiens
atctgggaagtaagt

SEQ ID NO: 399819 - DNA, 15 bp, Homo sapiens
tctgggaagtaagta

SEQ ID NO: 399820 - DNA, 15 bp, Homo sapiens
ctgggaagtaagtaa

SEQ ID NO: 399821 - DNA, 15 bp, Homo sapiens
tgggaagtaagtaat

SEQ ID NO: 399822 - DNA, 15 bp, Homo sapiens
gggaagtaagtaata

SEQ ID NO: 399823 - DNA, 15 bp, Homo sapiens
ggaagtaagtaatag

SEQ ID NO: 399824 - DNA, 15 bp, Homo sapiens
gaagtaagtaataga

SEQ ID NO: 399825 - DNA, 15 bp, Homo sapiens
aagtaagtaatagaa

SEQ ID NO: 399826 - DNA, 15 bp, Homo sapiens
gtaagtaatagaaac

SEQ ID NO: 399827 - DNA, 15 bp, Homo sapiens
taagtaatagaaact

SEQ ID NO: 399828 - DNA, 15 bp, Homo sapiens
aagtaatagaaactt

SEQ ID NO: 399829 - DNA, 15 bp, Homo sapiens
agtaatagaaactta

SEQ ID NO: 399830 - DNA, 15 bp, Homo sapiens
gtaatagaaacttac

SEQ ID NO: 399831 - DNA, 15 bp, Homo sapiens
taatagaaacttaca

SEQ ID NO: 399832 - DNA, 15 bp, Homo sapiens
aatagaaacttacag

SEQ ID NO: 399833 - DNA, 15 bp, Homo sapiens
atagaaacttacaga

SEQ ID NO: 399834 - DNA, 15 bp, Homo sapiens
tagaaacttacagac

SEQ ID NO: 399835 - DNA, 15 bp, Homo sapiens
agaaacttacagaca

SEQ ID NO: 399836 - DNA, 15 bp, Homo sapiens
gaaacttacagacag

SEQ ID NO: 399837 - DNA, 15 bp, Homo sapiens
aaacttacagacaga

SEQ ID NO: 399838 - DNA, 15 bp, Homo sapiens
aacttacagacagat

SEQ ID NO: 399839 - DNA, 15 bp, Homo sapiens
acttacagacagatt

SEQ ID NO: 399840 - DNA, 15 bp, Homo sapiens
cttacagacagattg

SEQ ID NO: 399841 - DNA, 15 bp, Homo sapiens
ttacagacagattga

SEQ ID NO: 399842 - DNA, 15 bp, Homo sapiens
tacagacagattgag

SEQ ID NO: 399843 - DNA, 15 bp, Homo sapiens
acagacagattgagg

SEQ ID NO: 399844 - DNA, 15 bp, Homo sapiens
cagacagattgaggt

SEQ ID NO: 399845 - DNA, 15 bp, Homo sapiens
agacagattgaggtg

SEQ ID NO: 399846 - DNA, 15 bp, Homo sapiens
gacagattgaggtgc

SEQ ID NO: 399847 - DNA, 15 bp, Homo sapiens
acagattgaggtgca

SEQ ID NO: 399848 - DNA, 15 bp, Homo sapiens
cagattgaggtgcag

SEQ ID NO: 399849 - DNA, 15 bp, Homo sapiens
agattgaggtgcagt

SEQ ID NO: 399850 - DNA, 15 bp, Homo sapiens
gattgaggtgcagtt

SEQ ID NO: 399851 - DNA, 15 bp, Homo sapiens
attgaggtgcagttt

SEQ ID NO: 399852 - DNA, 15 bp, Homo sapiens
ttgaggtgcagtttt

SEQ ID NO: 399853 - DNA, 15 bp, Homo sapiens
tgaggtgcagttttt

SEQ ID NO: 399854 - DNA, 15 bp, Homo sapiens
gaggtgcagtttttt

SEQ ID NO: 399855 - DNA, 15 bp, Homo sapiens
aggtgcagttttttt

SEQ ID NO: 399856 - DNA, 15 bp, Homo sapiens
ggtgcagtttttttt

SEQ ID NO: 399857 - DNA, 15 bp, Homo sapiens
gtgcagttttttttc

SEQ ID NO: 399858 - DNA, 15 bp, Homo sapiens
tgcagttttttttct

SEQ ID NO: 399859 - DNA, 15 bp, Homo sapiens
gcagttttttttcta

SEQ ID NO: 399860 - DNA, 15 bp, Homo sapiens
cagttttttttctac

SEQ ID NO: 399861 - DNA, 15 bp, Homo sapiens
agttttttttctact

SEQ ID NO: 399862 - DNA, 15 bp, Homo sapiens
gttttttttctactt

SEQ ID NO: 399863 - DNA, 15 bp, Homo sapiens
ttttttttctacttt

SEQ ID NO: 399864 - DNA, 15 bp, Homo sapiens
tttttttctactttt

SEQ ID NO: 399865 - DNA, 15 bp, Homo sapiens
ttttttctacttttt

SEQ ID NO: 399866 - DNA, 15 bp, Homo sapiens
tttttctactttttt

SEQ ID NO: 399867 - DNA, 15 bp, Homo sapiens
ttttctacttttttt

SEQ ID NO: 399868 - DNA, 15 bp, Homo sapiens
tttctactttttttt

SEQ ID NO: 399869 - DNA, 15 bp, Homo sapiens
ttctacttttttttc

SEQ ID NO: 399870 - DNA, 15 bp, Homo sapiens
tctacttttttttcc

SEQ ID NO: 399871 - DNA, 15 bp, Homo sapiens
ctacttttttttcct

SEQ ID NO: 399872 - DNA, 15 bp, Homo sapiens
tacttttttttcctg

SEQ ID NO: 399873 - DNA, 15 bp, Homo sapiens
acttttttttcctga

SEQ ID NO: 399874 - DNA, 15 bp, Homo sapiens
cttttttttcctgaa

SEQ ID NO: 399875 - DNA, 15 bp, Homo sapiens
ttttttttcctgaaa

SEQ ID NO: 399876 - DNA, 15 bp, Homo sapiens
tttttttcctgaaaa

SEQ ID NO: 399877 - DNA, 15 bp, Homo sapiens
ttttttcctgaaaat

SEQ ID NO: 399878 - DNA, 15 bp, Homo sapiens
tttttcctgaaaatt

SEQ ID NO: 399879 - DNA, 15 bp, Homo sapiens
ttttcctgaaaattt

SEQ ID NO: 399880 - DNA, 15 bp, Homo sapiens
tttcctgaaaatttc

SEQ ID NO: 399881 - DNA, 15 bp, Homo sapiens
ttcctgaaaatttca

SEQ ID NO: 399882 - DNA, 15 bp, Homo sapiens
tcctgaaaatttcag

SEQ ID NO: 399883 - DNA, 15 bp, Homo sapiens
cctgaaaatttcaga

SEQ ID NO: 399884 - DNA, 15 bp, Homo sapiens
ctgaaaatttcagaa

SEQ ID NO: 399885 - DNA, 15 bp, Homo sapiens
tgaaaatttcagaaa

SEQ ID NO: 399886 - DNA, 15 bp, Homo sapiens
gaaaatttcagaaat

SEQ ID NO: 399887 - DNA, 15 bp, Homo sapiens
aaaatttcagaaata

SEQ ID NO: 399888 - DNA, 15 bp, Homo sapiens
aaatttcagaaatat

SEQ ID NO: 399889 - DNA, 15 bp, Homo sapiens
aatttcagaaatatg

SEQ ID NO: 399890 - DNA, 15 bp, Homo sapiens
atttcagaaatatga

SEQ ID NO: 399891 - DNA, 15 bp, Homo sapiens
tttcagaaatatgag

SEQ ID NO: 399892 - DNA, 15 bp, Homo sapiens
ttcagaaatatgaga

SEQ ID NO: 399893 - DNA, 15 bp, Homo sapiens
tcagaaatatgagaa

SEQ ID NO: 399894 - DNA, 15 bp, Homo sapiens
cagaaatatgagaag

SEQ ID NO: 399895 - DNA, 15 bp, Homo sapiens
agaaatatgagaagt

SEQ ID NO: 399896 - DNA, 15 bp, Homo sapiens
gaaatatgagaagtg

SEQ ID NO: 399897 - DNA, 15 bp, Homo sapiens
aaatatgagaagtga

SEQ ID NO: 399898 - DNA, 15 bp, Homo sapiens
aatatgagaagtgaa

SEQ ID NO: 399899 - DNA, 15 bp, Homo sapiens
atatgagaagtgaaa

SEQ ID NO: 399900 - DNA, 15 bp, Homo sapiens
tatgagaagtgaaat

SEQ ID NO: 399901 - DNA, 15 bp, Homo sapiens
atgagaagtgaaata

SEQ ID NO: 399902 - DNA, 15 bp, Homo sapiens
tgagaagtgaaataa

SEQ ID NO: 399903 - DNA, 15 bp, Homo sapiens
gagaagtgaaataat

SEQ ID NO: 399904 - DNA, 15 bp, Homo sapiens
agaagtgaaataata

SEQ ID NO: 399905 - DNA, 15 bp, Homo sapiens
gaagtgaaataatag

SEQ ID NO: 399906 - DNA, 15 bp, Homo sapiens
aagtgaaataatagc

SEQ ID NO: 399907 - DNA, 15 bp, Homo sapiens
agtgaaataatagca

SEQ ID NO: 399908 - DNA, 15 bp, Homo sapiens
gtgaaataatagcaa

SEQ ID NO: 399909 - DNA, 15 bp, Homo sapiens
tgaaataatagcaaa

SEQ ID NO: 399910 - DNA, 15 bp, Homo sapiens
gaaataatagcaaac

SEQ ID NO: 399911 - DNA, 15 bp, Homo sapiens
aaataatagcaaaca

SEQ ID NO: 399912 - DNA, 15 bp, Homo sapiens
aataatagcaaacat

SEQ ID NO: 399913 - DNA, 15 bp, Homo sapiens
ataatagcaaacatg

SEQ ID NO: 399914 - DNA, 15 bp, Homo sapiens
taatagcaaacatga

SEQ ID NO: 399915 - DNA, 15 bp, Homo sapiens
aatagcaaacatgac

SEQ ID NO: 399916 - DNA, 15 bp, Homo sapiens
atagcaaacatgact

SEQ ID NO: 399917 - DNA, 15 bp, Homo sapiens
tagcaaacatgactc

SEQ ID NO: 399918 - DNA, 15 bp, Homo sapiens
agcaaacatgactca

SEQ ID NO: 399919 - DNA, 15 bp, Homo sapiens
gcaaacatgactcag

SEQ ID NO: 399920 - DNA, 15 bp, Homo sapiens
caaacatgactcaga

SEQ ID NO: 399921 - DNA, 15 bp, Homo sapiens
aaacatgactcagac

SEQ ID NO: 399922 - DNA, 15 bp, Homo sapiens
aacatgactcagacc

SEQ ID NO: 399923 - DNA, 15 bp, Homo sapiens
acatgactcagacct

SEQ ID NO: 399924 - DNA, 15 bp, Homo sapiens
catgactcagacctt

SEQ ID NO: 399925 - DNA, 15 bp, Homo sapiens
atgactcagaccttt

SEQ ID NO: 399926 - DNA, 15 bp, Homo sapiens
tgactcagaccttta

SEQ ID NO: 399927 - DNA, 15 bp, Homo sapiens
gactcagacctttat

SEQ ID NO: 399928 - DNA, 15 bp, Homo sapiens
actcagacctttata

SEQ ID NO: 399929 - DNA, 15 bp, Homo sapiens
ctcagacctttataa

SEQ ID NO: 399930 - DNA, 15 bp, Homo sapiens
tcagacctttataaa

SEQ ID NO: 399931 - DNA, 15 bp, Homo sapiens
cagacctttataaat

SEQ ID NO: 399932 - DNA, 15 bp, Homo sapiens
agacctttataaatt

SEQ ID NO: 399933 - DNA, 15 bp, Homo sapiens
gacctttataaattg

SEQ ID NO: 399934 - DNA, 15 bp, Homo sapiens
acctttataaattgt

SEQ ID NO: 399935 - DNA, 15 bp, Homo sapiens
cctttataaattgtc

SEQ ID NO: 399936 - DNA, 15 bp, Homo sapiens
ctttataaattgtct

SEQ ID NO: 399937 - DNA, 15 bp, Homo sapiens
tttataaattgtctt

SEQ ID NO: 399938 - DNA, 15 bp, Homo sapiens
ttataaattgtcttt

SEQ ID NO: 399939 - DNA, 15 bp, Homo sapiens
tataaattgtctttc

SEQ ID NO: 399940 - DNA, 15 bp, Homo sapiens
ataaattgtctttct

SEQ ID NO: 399941 - DNA, 15 bp, Homo sapiens
taaattgtctttctt

SEQ ID NO: 399942 - DNA, 15 bp, Homo sapiens
aaattgtctttcttg

SEQ ID NO: 399943 - DNA, 15 bp, Homo sapiens
aattgtctttcttga

SEQ ID NO: 399944 - DNA, 15 bp, Homo sapiens
attgtctttcttgac

SEQ ID NO: 399945 - DNA, 15 bp, Homo sapiens
ttgtctttcttgaca

SEQ ID NO: 399946 - DNA, 15 bp, Homo sapiens
tgtctttcttgacag

SEQ ID NO: 399947 - DNA, 15 bp, Homo sapiens
gtctttcttgacagc

SEQ ID NO: 399948 - DNA, 15 bp, Homo sapiens
tctttcttgacagca

SEQ ID NO: 399949 - DNA, 15 bp, Homo sapiens
ctttcttgacagcag

SEQ ID NO: 399950 - DNA, 15 bp, Homo sapiens
tttcttgacagcaga

SEQ ID NO: 399951 - DNA, 15 bp, Homo sapiens
ttcttgacagcagag

SEQ ID NO: 399952 - DNA, 15 bp, Homo sapiens
tcttgacagcagaga

SEQ ID NO: 399953 - DNA, 15 bp, Homo sapiens
cttgacagcagagat

SEQ ID NO: 399954 - DNA, 15 bp, Homo sapiens
ttgacagcagagatg

SEQ ID NO: 399955 - DNA, 15 bp, Homo sapiens
tgacagcagagatgt

SEQ ID NO: 399956 - DNA, 15 bp, Homo sapiens
gacagcagagatgta

SEQ ID NO: 399957 - DNA, 15 bp, Homo sapiens
acagcagagatgtac

SEQ ID NO: 399958 - DNA, 15 bp, Homo sapiens
cagcagagatgtaca

SEQ ID NO: 399959 - DNA, 15 bp, Homo sapiens
agcagagatgtacaa

SEQ ID NO: 399960 - DNA, 15 bp, Homo sapiens
gcagagatgtacaat

SEQ ID NO: 399961 - DNA, 15 bp, Homo sapiens
cagagatgtacaatt

SEQ ID NO: 399962 - DNA, 15 bp, Homo sapiens
agagatgtacaattt

SEQ ID NO: 399963 - DNA, 15 bp, Homo sapiens
gagatgtacaatttt

SEQ ID NO: 399964 - DNA, 15 bp, Homo sapiens
agatgtacaattttg

SEQ ID NO: 399965 - DNA, 15 bp, Homo sapiens
gatgtacaattttgt

SEQ ID NO: 399966 - DNA, 15 bp, Homo sapiens
atgtacaattttgta

SEQ ID NO: 399967 - DNA, 15 bp, Homo sapiens
tgtacaattttgtaa

SEQ ID NO: 399968 - DNA, 15 bp, Homo sapiens
gtacaattttgtaaa

SEQ ID NO: 399969 - DNA, 15 bp, Homo sapiens
tacaattttgtaaaa

SEQ ID NO: 399970 - DNA, 15 bp, Homo sapiens
acaattttgtaaaat

SEQ ID NO: 399971 - DNA, 15 bp, Homo sapiens
caattttgtaaaata

SEQ ID NO: 399972 - DNA, 15 bp, Homo sapiens
aattttgtaaaatat

SEQ ID NO: 399973 - DNA, 15 bp, Homo sapiens
attttgtaaaatatt

SEQ ID NO: 399974 - DNA, 15 bp, Homo sapiens
ttttgtaaaatattg

SEQ ID NO: 399975 - DNA, 15 bp, Homo sapiens
tttgtaaaatattgt

SEQ ID NO: 399976 - DNA, 15 bp, Homo sapiens
ttgtaaaatattgtc

SEQ ID NO: 399977 - DNA, 15 bp, Homo sapiens
tgtaaaatattgtcc

SEQ ID NO: 399978 - DNA, 15 bp, Homo sapiens
gtaaaatattgtcct

SEQ ID NO: 399979 - DNA, 15 bp, Homo sapiens
taaaatattgtcctc

SEQ ID NO: 399980 - DNA, 15 bp, Homo sapiens
aaaatattgtcctca

SEQ ID NO: 399981 - DNA, 15 bp, Homo sapiens
aaatattgtcctcag

SEQ ID NO: 399982 - DNA, 15 bp, Homo sapiens
aatattgtcctcagt

SEQ ID NO: 399983 - DNA, 15 bp, Homo sapiens
atattgtcctcagtc

SEQ ID NO: 399984 - DNA, 15 bp, Homo sapiens
tattgtcctcagtct

SEQ ID NO: 399985 - DNA, 15 bp, Homo sapiens
attgtcctcagtctt

SEQ ID NO: 399986 - DNA, 15 bp, Homo sapiens
ttgtcctcagtcttg

SEQ ID NO: 399987 - DNA, 15 bp, Homo sapiens
tgtcctcagtcttga

SEQ ID NO: 399988 - DNA, 15 bp, Homo sapiens
gtcctcagtcttgaa

SEQ ID NO: 399989 - DNA, 15 bp, Homo sapiens
tcctcagtcttgaac

SEQ ID NO: 399990 - DNA, 15 bp, Homo sapiens
cctcagtcttgaact

SEQ ID NO: 399991 - DNA, 15 bp, Homo sapiens
ctcagtcttgaactg

SEQ ID NO: 399992 - DNA, 15 bp, Homo sapiens
tcagtcttgaactgc

SEQ ID NO: 399993 - DNA, 15 bp, Homo sapiens
cagtcttgaactgca

SEQ ID NO: 399994 - DNA, 15 bp, Homo sapiens
agtcttgaactgcag

SEQ ID NO: 399995 - DNA, 15 bp, Homo sapiens
gtcttgaactgcaga

SEQ ID NO: 399996 - DNA, 15 bp, Homo sapiens
tcttgaactgcagaa

SEQ ID NO: 399997 - DNA, 15 bp, Homo sapiens
cttgaactgcagaaa

SEQ ID NO: 399998 - DNA, 15 bp, Homo sapiens
ttgaactgcagaaac

SEQ ID NO: 399999 - DNA, 15 bp, Homo sapiens
tgaactgcagaaact

SEQ ID NO: 400000 - DNA, 15 bp, Homo sapiens
gaactgcagaaactc

SEQ ID NO: 400001 - DNA, 15 bp, Homo sapiens
aactgcagaaactcc

SEQ ID NO: 400002 - DNA, 15 bp, Homo sapiens
actgcagaaactcct

SEQ ID NO: 400003 - DNA, 15 bp, Homo sapiens
ctgcagaaactcctt

SEQ ID NO: 400004 - DNA, 15 bp, Homo sapiens
tgcagaaactccttt

SEQ ID NO: 400005 - DNA, 15 bp, Homo sapiens
gcagaaactcctttc

SEQ ID NO: 400006 - DNA, 15 bp, Homo sapiens
cagaaactcctttct

SEQ ID NO: 400007 - DNA, 15 bp, Homo sapiens
agaaactcctttctc

SEQ ID NO: 400008 - DNA, 15 bp, Homo sapiens
gaaactcctttctct

SEQ ID NO: 400009 - DNA, 15 bp, Homo sapiens
aaactcctttctctg

SEQ ID NO: 400010 - DNA, 15 bp, Homo sapiens
aactcctttctctga

SEQ ID NO: 400011 - DNA, 15 bp, Homo sapiens
actcctttctctgat

SEQ ID NO: 400012 - DNA, 15 bp, Homo sapiens
ctcctttctctgata

SEQ ID NO: 400013 - DNA, 15 bp, Homo sapiens
tcctttctctgatac

SEQ ID NO: 400014 - DNA, 15 bp, Homo sapiens
cctttctctgatacc

SEQ ID NO: 400015 - DNA, 15 bp, Homo sapiens
ctttctctgatacct

SEQ ID NO: 400016 - DNA, 15 bp, Homo sapiens
tttctctgatacctg

SEQ ID NO: 400017 - DNA, 15 bp, Homo sapiens
ttctctgatacctgc

SEQ ID NO: 400018 - DNA, 15 bp, Homo sapiens
tctctgatacctgcg

SEQ ID NO: 400019 - DNA, 15 bp, Homo sapiens
ctctgatacctgcgg

SEQ ID NO: 400020 - DNA, 15 bp, Homo sapiens
tctgatacctgcggt

SEQ ID NO: 400021 - DNA, 15 bp, Homo sapiens
ctgatacctgcggtc

SEQ ID NO: 400022 - DNA, 15 bp, Homo sapiens
tgatacctgcggtct

SEQ ID NO: 400023 - DNA, 15 bp, Homo sapiens
gatacctgcggtctt

SEQ ID NO: 400024 - DNA, 15 bp, Homo sapiens
atacctgcggtctta

SEQ ID NO: 400025 - DNA, 15 bp, Homo sapiens
tacctgcggtcttat

SEQ ID NO: 400026 - DNA, 15 bp, Homo sapiens
acctgcggtcttatt

SEQ ID NO: 400027 - DNA, 15 bp, Homo sapiens
cctgcggtcttattt

SEQ ID NO: 400028 - DNA, 15 bp, Homo sapiens
ctgcggtcttattta

SEQ ID NO: 400029 - DNA, 15 bp, Homo sapiens
tgcggtcttatttaa

SEQ ID NO: 400030 - DNA, 15 bp, Homo sapiens
gcggtcttatttaat

SEQ ID NO: 400031 - DNA, 15 bp, Homo sapiens
cggtcttatttaatt

SEQ ID NO: 400032 - DNA, 15 bp, Homo sapiens
ggtcttatttaattt

SEQ ID NO: 400033 - DNA, 15 bp, Homo sapiens
gtcttatttaatttt

SEQ ID NO: 400034 - DNA, 15 bp, Homo sapiens
tcttatttaattttt

SEQ ID NO: 400035 - DNA, 15 bp, Homo sapiens
cttatttaattttta

SEQ ID NO: 400036 - DNA, 15 bp, Homo sapiens
ttatttaatttttac

SEQ ID NO: 400037 - DNA, 15 bp, Homo sapiens
tatttaatttttaca

SEQ ID NO: 400038 - DNA, 15 bp, Homo sapiens
atttaatttttacat

SEQ ID NO: 400039 - DNA, 15 bp, Homo sapiens
tttaatttttacatc

SEQ ID NO: 400040 - DNA, 15 bp, Homo sapiens
ttaatttttacatct

SEQ ID NO: 400041 - DNA, 15 bp, Homo sapiens
taatttttacatctt

SEQ ID NO: 400042 - DNA, 15 bp, Homo sapiens
aatttttacatctta

SEQ ID NO: 400043 - DNA, 15 bp, Homo sapiens
atttttacatcttaa

SEQ ID NO: 400044 - DNA, 15 bp, Homo sapiens
tttttacatcttaac

SEQ ID NO: 400045 - DNA, 15 bp, Homo sapiens
ttttacatcttaaca

SEQ ID NO: 400046 - DNA, 15 bp, Homo sapiens
tttacatcttaacag

SEQ ID NO: 400047 - DNA, 15 bp, Homo sapiens
ttacatcttaacagc

SEQ ID NO: 400048 - DNA, 15 bp, Homo sapiens
tacatcttaacagca

SEQ ID NO: 400049 - DNA, 15 bp, Homo sapiens
acatcttaacagcaa

SEQ ID NO: 400050 - DNA, 15 bp, Homo sapiens
catcttaacagcaag

SEQ ID NO: 400051 - DNA, 15 bp, Homo sapiens
atcttaacagcaaga

SEQ ID NO: 400052 - DNA, 15 bp, Homo sapiens
tcttaacagcaagag

SEQ ID NO: 400053 - DNA, 15 bp, Homo sapiens
cttaacagcaagagc

SEQ ID NO: 400054 - DNA, 15 bp, Homo sapiens
ttaacagcaagagca

SEQ ID NO: 400055 - DNA, 15 bp, Homo sapiens
taacagcaagagcat

SEQ ID NO: 400056 - DNA, 15 bp, Homo sapiens
aacagcaagagcata

SEQ ID NO: 400057 - DNA, 15 bp, Homo sapiens
acagcaagagcatac

SEQ ID NO: 400058 - DNA, 15 bp, Homo sapiens
cagcaagagcatacc

SEQ ID NO: 400059 - DNA, 15 bp, Homo sapiens
agcaagagcataccc

SEQ ID NO: 400060 - DNA, 15 bp, Homo sapiens
gcaagagcatacccg

SEQ ID NO: 400061 - DNA, 15 bp, Homo sapiens
caagagcatacccgt

SEQ ID NO: 400062 - DNA, 15 bp, Homo sapiens
aagagcatacccgtg

SEQ ID NO: 400063 - DNA, 15 bp, Homo sapiens
agagcatacccgtga

SEQ ID NO: 400064 - DNA, 15 bp, Homo sapiens
gagcatacccgtgat

SEQ ID NO: 400065 - DNA, 15 bp, Homo sapiens
agcatacccgtgatt

SEQ ID NO: 400066 - DNA, 15 bp, Homo sapiens
gcatacccgtgattt

SEQ ID NO: 400067 - DNA, 15 bp, Homo sapiens
catacccgtgatttg

SEQ ID NO: 400068 - DNA, 15 bp, Homo sapiens
atacccgtgatttgt

SEQ ID NO: 400069 - DNA, 15 bp, Homo sapiens
tacccgtgatttgtt

SEQ ID NO: 400070 - DNA, 15 bp, Homo sapiens
acccgtgatttgttt

SEQ ID NO: 400071 - DNA, 15 bp, Homo sapiens
cccgtgatttgtttt

SEQ ID NO: 400072 - DNA, 15 bp, Homo sapiens
ccgtgatttgttttc

SEQ ID NO: 400073 - DNA, 15 bp, Homo sapiens
cgtgatttgttttca

SEQ ID NO: 400074 - DNA, 15 bp, Homo sapiens
gtgatttgttttcac

SEQ ID NO: 400075 - DNA, 15 bp, Homo sapiens
tgatttgttttcaca

SEQ ID NO: 400076 - DNA, 15 bp, Homo sapiens
gatttgttttcacaa

SEQ ID NO: 400077 - DNA, 15 bp, Homo sapiens
atttgttttcacaaa

SEQ ID NO: 400078 - DNA, 15 bp, Homo sapiens
tttgttttcacaaat

SEQ ID NO: 400079 - DNA, 15 bp, Homo sapiens
ttgttttcacaaatg

SEQ ID NO: 400080 - DNA, 15 bp, Homo sapiens
tgttttcacaaatgt

SEQ ID NO: 400081 - DNA, 15 bp, Homo sapiens
gttttcacaaatgtt

SEQ ID NO: 400082 - DNA, 15 bp, Homo sapiens
ttttcacaaatgtta

SEQ ID NO: 400083 - DNA, 15 bp, Homo sapiens
tttcacaaatgttag

SEQ ID NO: 400084 - DNA, 15 bp, Homo sapiens
ttcacaaatgttaga

SEQ ID NO: 400085 - DNA, 15 bp, Homo sapiens
tcacaaatgttagaa

SEQ ID NO: 400086 - DNA, 15 bp, Homo sapiens
cacaaatgttagaaa

SEQ ID NO: 400087 - DNA, 15 bp, Homo sapiens
acaaatgttagaaat

SEQ ID NO: 400088 - DNA, 15 bp, Homo sapiens
caaatgttagaaata

SEQ ID NO: 400089 - DNA, 15 bp, Homo sapiens
aaatgttagaaatac

SEQ ID NO: 400090 - DNA, 15 bp, Homo sapiens
aatgttagaaatact

SEQ ID NO: 400091 - DNA, 15 bp, Homo sapiens
atgttagaaatactg

SEQ ID NO: 400092 - DNA, 15 bp, Homo sapiens
tgttagaaatactgt

SEQ ID NO: 400093 - DNA, 15 bp, Homo sapiens
gttagaaatactgtg

SEQ ID NO: 400094 - DNA, 15 bp, Homo sapiens
ttagaaatactgtgt

SEQ ID NO: 400095 - DNA, 15 bp, Homo sapiens
tagaaatactgtgta

SEQ ID NO: 400096 - DNA, 15 bp, Homo sapiens
agaaatactgtgtaa

SEQ ID NO: 400097 - DNA, 15 bp, Homo sapiens
gaaatactgtgtaag

SEQ ID NO: 400098 - DNA, 15 bp, Homo sapiens
aaatactgtgtaaga

SEQ ID NO: 400099 - DNA, 15 bp, Homo sapiens
aatactgtgtaagaa

SEQ ID NO: 400100 - DNA, 15 bp, Homo sapiens
atactgtgtaagaat

SEQ ID NO: 400101 - DNA, 15 bp, Homo sapiens
tactgtgtaagaata

SEQ ID NO: 400102 - DNA, 15 bp, Homo sapiens
actgtgtaagaatag

SEQ ID NO: 400103 - DNA, 15 bp, Homo sapiens
ctgtgtaagaataga

SEQ ID NO: 400104 - DNA, 15 bp, Homo sapiens
tgtgtaagaatagac

SEQ ID NO: 400105 - DNA, 15 bp, Homo sapiens
gtgtaagaatagact

SEQ ID NO: 400106 - DNA, 15 bp, Homo sapiens
tgtaagaatagactt

SEQ ID NO: 400107 - DNA, 15 bp, Homo sapiens
gtaagaatagactta

SEQ ID NO: 400108 - DNA, 15 bp, Homo sapiens
taagaatagacttat

SEQ ID NO: 400109 - DNA, 15 bp, Homo sapiens
aagaatagacttatt

SEQ ID NO: 400110 - DNA, 15 bp, Homo sapiens
agaatagacttattt

SEQ ID NO: 400111 - DNA, 15 bp, Homo sapiens
gaatagacttatttt

SEQ ID NO: 400112 - DNA, 15 bp, Homo sapiens
aatagacttattttt

SEQ ID NO: 400113 - DNA, 15 bp, Homo sapiens
atagacttattttta

SEQ ID NO: 400114 - DNA, 15 bp, Homo sapiens
tagacttatttttat

SEQ ID NO: 400115 - DNA, 15 bp, Homo sapiens
agacttatttttata

SEQ ID NO: 400116 - DNA, 15 bp, Homo sapiens
gacttatttttatat

SEQ ID NO: 400117 - DNA, 15 bp, Homo sapiens
acttatttttatatt

SEQ ID NO: 400118 - DNA, 15 bp, Homo sapiens
cttatttttatattg

SEQ ID NO: 400119 - DNA, 15 bp, Homo sapiens
tatttttatattgta

SEQ ID NO: 400120 - DNA, 15 bp, Homo sapiens
atttttatattgtaa

SEQ ID NO: 400121 - DNA, 15 bp, Homo sapiens
tttttatattgtaaa

SEQ ID NO: 400122 - DNA, 15 bp, Homo sapiens
ttttatattgtaaac

SEQ ID NO: 400123 - DNA, 15 bp, Homo sapiens
tttatattgtaaact

SEQ ID NO: 400124 - DNA, 15 bp, Homo sapiens
ttatattgtaaactt

SEQ ID NO: 400125 - DNA, 15 bp, Homo sapiens
tatattgtaaacttt

SEQ ID NO: 400126 - DNA, 15 bp, Homo sapiens
atattgtaaactttt

SEQ ID NO: 400127 - DNA, 15 bp, Homo sapiens
tattgtaaactttta

SEQ ID NO: 400128 - DNA, 15 bp, Homo sapiens
attgtaaacttttac

SEQ ID NO: 400129 - DNA, 15 bp, Homo sapiens
ttgtaaacttttact

SEQ ID NO: 400130 - DNA, 15 bp, Homo sapiens
tgtaaacttttactt

SEQ ID NO: 400131 - DNA, 15 bp, Homo sapiens
gtaaacttttacttt

SEQ ID NO: 400132 - DNA, 15 bp, Homo sapiens
taaacttttactttt

SEQ ID NO: 400133 - DNA, 15 bp, Homo sapiens
aaacttttacttttt

SEQ ID NO: 400134 - DNA, 15 bp, Homo sapiens
aacttttactttttt

SEQ ID NO: 400135 - DNA, 15 bp, Homo sapiens
acttttacttttttt

SEQ ID NO: 400136 - DNA, 15 bp, Homo sapiens
cttttactttttttt

SEQ ID NO: 400137 - DNA, 15 bp, Homo sapiens
ttttacttttttttt

SEQ ID NO: 400138 - DNA, 15 bp, Homo sapiens
ttttttttgagactg

SEQ ID NO: 400139 - DNA, 15 bp, Homo sapiens
tttttttgagactga

SEQ ID NO: 400140 - DNA, 15 bp, Homo sapiens
ttttttgagactgag

SEQ ID NO: 400141 - DNA, 15 bp, Homo sapiens
tttttgagactgagt

SEQ ID NO: 400142 - DNA, 15 bp, Homo sapiens
ttgagactgagtttt

SEQ ID NO: 400143 - DNA, 15 bp, Homo sapiens
tgagactgagttttg

SEQ ID NO: 400144 - DNA, 15 bp, Homo sapiens
gagactgagttttgc

SEQ ID NO: 400145 - DNA, 15 bp, Homo sapiens
agactgagttttgct

SEQ ID NO: 400146 - DNA, 15 bp, Homo sapiens
gactgagttttgctc

SEQ ID NO: 400147 - DNA, 15 bp, Homo sapiens
actgagttttgctct

SEQ ID NO: 400148 - DNA, 15 bp, Homo sapiens
ctgagttttgctctt

SEQ ID NO: 400149 - DNA, 15 bp, Homo sapiens
tgagttttgctcttg

SEQ ID NO: 400150 - DNA, 15 bp, Homo sapiens
gagttttgctcttgt

SEQ ID NO: 400151 - DNA, 15 bp, Homo sapiens
agttttgctcttgtt

SEQ ID NO: 400152 - DNA, 15 bp, Homo sapiens
gttttgctcttgttg

SEQ ID NO: 400153 - DNA, 15 bp, Homo sapiens
ttttgctcttgttgc

SEQ ID NO: 400154 - DNA, 15 bp, Homo sapiens
tttgctcttgttgcc

SEQ ID NO: 400155 - DNA, 15 bp, Homo sapiens
ttgctcttgttgcct

SEQ ID NO: 400156 - DNA, 15 bp, Homo sapiens
tgctcttgttgccta

SEQ ID NO: 400157 - DNA, 15 bp, Homo sapiens
gctcttgttgcctag

SEQ ID NO: 400158 - DNA, 15 bp, Homo sapiens
ctcttgttgcctagg

SEQ ID NO: 400159 - DNA, 15 bp, Homo sapiens
tcttgttgcctaggc

SEQ ID NO: 400160 - DNA, 15 bp, Homo sapiens
cttgttgcctaggct

SEQ ID NO: 400161 - DNA, 15 bp, Homo sapiens
ttgttgcctaggctg

SEQ ID NO: 400162 - DNA, 15 bp, Homo sapiens
tgttgcctaggctgg

SEQ ID NO: 400163 - DNA, 15 bp, Homo sapiens
gttgcctaggctgga

SEQ ID NO: 400164 - DNA, 15 bp, Homo sapiens
ttgcctaggctggag

SEQ ID NO: 400165 - DNA, 15 bp, Homo sapiens
tgcctaggctggagt

SEQ ID NO: 400166 - DNA, 15 bp, Homo sapiens
gcctaggctggagtg

SEQ ID NO: 400167 - DNA, 15 bp, Homo sapiens
cctaggctggagtgc

SEQ ID NO: 400168 - DNA, 15 bp, Homo sapiens
ctaggctggagtgca

SEQ ID NO: 400169 - DNA, 15 bp, Homo sapiens
taggctggagtgcaa

SEQ ID NO: 400170 - DNA, 15 bp, Homo sapiens
ggagtgcaatggcaa

SEQ ID NO: 400171 - DNA, 15 bp, Homo sapiens
gagtgcaatggcaag

SEQ ID NO: 400172 - DNA, 15 bp, Homo sapiens
agtgcaatggcaaga

SEQ ID NO: 400173 - DNA, 15 bp, Homo sapiens
gtgcaatggcaagat

SEQ ID NO: 400174 - DNA, 15 bp, Homo sapiens
tgcaatggcaagatc

SEQ ID NO: 400175 - DNA, 15 bp, Homo sapiens
gcaatggcaagatct

SEQ ID NO: 400176 - DNA, 15 bp, Homo sapiens
caatggcaagatctt

SEQ ID NO: 400177 - DNA, 15 bp, Homo sapiens
aatggcaagatcttg

SEQ ID NO: 400178 - DNA, 15 bp, Homo sapiens
atggcaagatcttgg

SEQ ID NO: 400179 - DNA, 15 bp, Homo sapiens
tggcaagatcttggc

SEQ ID NO: 400180 - DNA, 15 bp, Homo sapiens
ggcaagatcttggct

SEQ ID NO: 400181 - DNA, 15 bp, Homo sapiens
gcaagatcttggctc

SEQ ID NO: 400182 - DNA, 15 bp, Homo sapiens
caagatcttggctca

SEQ ID NO: 400183 - DNA, 15 bp, Homo sapiens
aagatcttggctcac

SEQ ID NO: 400184 - DNA, 15 bp, Homo sapiens
agatcttggctcact

SEQ ID NO: 400185 - DNA, 15 bp, Homo sapiens
attctcctgcctcat

SEQ ID NO: 400186 - DNA, 15 bp, Homo sapiens
ttctcctgcctcatt

SEQ ID NO: 400187 - DNA, 15 bp, Homo sapiens
tctcctgcctcattc

SEQ ID NO: 400188 - DNA, 15 bp, Homo sapiens
ctcctgcctcattct

SEQ ID NO: 400189 - DNA, 15 bp, Homo sapiens
tcctgcctcattctc

SEQ ID NO: 400190 - DNA, 15 bp, Homo sapiens
cctgcctcattctct

SEQ ID NO: 400191 - DNA, 15 bp, Homo sapiens
ctgcctcattctctc

SEQ ID NO: 400192 - DNA, 15 bp, Homo sapiens
tgcctcattctctca

SEQ ID NO: 400193 - DNA, 15 bp, Homo sapiens
gcctcattctctcaa

SEQ ID NO: 400194 - DNA, 15 bp, Homo sapiens
cctcattctctcaag

SEQ ID NO: 400195 - DNA, 15 bp, Homo sapiens
ctcattctctcaagt

SEQ ID NO: 400196 - DNA, 15 bp, Homo sapiens
tcattctctcaagta

SEQ ID NO: 400197 - DNA, 15 bp, Homo sapiens
cattctctcaagtag

SEQ ID NO: 400198 - DNA, 15 bp, Homo sapiens
attctctcaagtagc

SEQ ID NO: 400199 - DNA, 15 bp, Homo sapiens
ttctctcaagtagct

SEQ ID NO: 400200 - DNA, 15 bp, Homo sapiens
tctctcaagtagctg

SEQ ID NO: 400201 - DNA, 15 bp, Homo sapiens
ctctcaagtagctgg

SEQ ID NO: 400202 - DNA, 15 bp, Homo sapiens
tctcaagtagctggg

SEQ ID NO: 400203 - DNA, 15 bp, Homo sapiens
ctcaagtagctggga

SEQ ID NO: 400204 - DNA, 15 bp, Homo sapiens
tcaagtagctgggat

SEQ ID NO: 400205 - DNA, 15 bp, Homo sapiens
ggattataggcatgc

SEQ ID NO: 400206 - DNA, 15 bp, Homo sapiens
gattataggcatgca

SEQ ID NO: 400207 - DNA, 15 bp, Homo sapiens
attataggcatgcac

SEQ ID NO: 400208 - DNA, 15 bp, Homo sapiens
ttataggcatgcacc

SEQ ID NO: 400209 - DNA, 15 bp, Homo sapiens
agagacagggtttct

SEQ ID NO: 400210 - DNA, 15 bp, Homo sapiens
gagacagggtttctc

SEQ ID NO: 400211 - DNA, 15 bp, Homo sapiens
agacagggtttctcc

SEQ ID NO: 400212 - DNA, 15 bp, Homo sapiens
gacagggtttctcca

SEQ ID NO: 400213 - DNA, 15 bp, Homo sapiens
acagggtttctccat

SEQ ID NO: 400214 - DNA, 15 bp, Homo sapiens
cagggtttctccatg

SEQ ID NO: 400215 - DNA, 15 bp, Homo sapiens
agggtttctccatgt

SEQ ID NO: 400216 - DNA, 15 bp, Homo sapiens
tttctccatgttggt

SEQ ID NO: 400217 - DNA, 15 bp, Homo sapiens
ttctccatgttggtc

SEQ ID NO: 400218 - DNA, 15 bp, Homo sapiens
tctccatgttggtca

SEQ ID NO: 400219 - DNA, 15 bp, Homo sapiens
ctccatgttggtcag

SEQ ID NO: 400220 - DNA, 15 bp, Homo sapiens
tccatgttggtcagg

SEQ ID NO: 400221 - DNA, 15 bp, Homo sapiens
gtcaggctggtcttg

SEQ ID NO: 400222 - DNA, 15 bp, Homo sapiens
tcaggctggtcttga

SEQ ID NO: 400223 - DNA, 15 bp, Homo sapiens
tggtcttgaactctc

SEQ ID NO: 400224 - DNA, 15 bp, Homo sapiens
ggtcttgaactctca

SEQ ID NO: 400225 - DNA, 15 bp, Homo sapiens
gtcttgaactctcaa

SEQ ID NO: 400226 - DNA, 15 bp, Homo sapiens
tcttgaactctcaac

SEQ ID NO: 400227 - DNA, 15 bp, Homo sapiens
cttgaactctcaacc

SEQ ID NO: 400228 - DNA, 15 bp, Homo sapiens
ttgaactctcaacct

SEQ ID NO: 400229 - DNA, 15 bp, Homo sapiens
tgaactctcaacctc

SEQ ID NO: 400230 - DNA, 15 bp, Homo sapiens
gaactctcaacctca

SEQ ID NO: 400231 - DNA, 15 bp, Homo sapiens
aactctcaacctcag

SEQ ID NO: 400232 - DNA, 15 bp, Homo sapiens
actctcaacctcagg

SEQ ID NO: 400233 - DNA, 15 bp, Homo sapiens
ctctcaacctcaggt

SEQ ID NO: 400234 - DNA, 15 bp, Homo sapiens
tctcaacctcaggtg

SEQ ID NO: 400235 - DNA, 15 bp, Homo sapiens
ctcaacctcaggtga

SEQ ID NO: 400236 - DNA, 15 bp, Homo sapiens
tcaacctcaggtgat

SEQ ID NO: 400237 - DNA, 15 bp, Homo sapiens
aacctcaggtgatct

SEQ ID NO: 400238 - DNA, 15 bp, Homo sapiens
tcaggtgatctgccc

SEQ ID NO: 400239 - DNA, 15 bp, Homo sapiens
caggtgatctgcccg

SEQ ID NO: 400240 - DNA, 15 bp, Homo sapiens
aggtgatctgcccgc

SEQ ID NO: 400241 - DNA, 15 bp, Homo sapiens
ggtgatctgcccgct

SEQ ID NO: 400242 - DNA, 15 bp, Homo sapiens
gtgatctgcccgctt

SEQ ID NO: 400243 - DNA, 15 bp, Homo sapiens
tgatctgcccgcttt

SEQ ID NO: 400244 - DNA, 15 bp, Homo sapiens
gatctgcccgctttg

SEQ ID NO: 400245 - DNA, 15 bp, Homo sapiens
atctgcccgctttgg

SEQ ID NO: 400246 - DNA, 15 bp, Homo sapiens
tctgcccgctttggc

SEQ ID NO: 400247 - DNA, 15 bp, Homo sapiens
ctgcccgctttggcc

SEQ ID NO: 400248 - DNA, 15 bp, Homo sapiens
tgcccgctttggcct

SEQ ID NO: 400249 - DNA, 15 bp, Homo sapiens
gcccgctttggcctc

SEQ ID NO: 400250 - DNA, 15 bp, Homo sapiens
cccgctttggcctcc

SEQ ID NO: 400251 - DNA, 15 bp, Homo sapiens
ccgctttggcctccc

SEQ ID NO: 400252 - DNA, 15 bp, Homo sapiens
cgctttggcctccca

SEQ ID NO: 400253 - DNA, 15 bp, Homo sapiens
gctttggcctcccaa

SEQ ID NO: 400254 - DNA, 15 bp, Homo sapiens
ctttggcctcccaaa

SEQ ID NO: 400255 - DNA, 15 bp, Homo sapiens
tttggcctcccaaag

SEQ ID NO: 400256 - DNA, 15 bp, Homo sapiens
ccatgcctggcccaa

SEQ ID NO: 400257 - DNA, 15 bp, Homo sapiens
catgcctggcccaac

SEQ ID NO: 400258 - DNA, 15 bp, Homo sapiens
atgcctggcccaact

SEQ ID NO: 400259 - DNA, 15 bp, Homo sapiens
tgcctggcccaactt

SEQ ID NO: 400260 - DNA, 15 bp, Homo sapiens
gcctggcccaacttt

SEQ ID NO: 400261 - DNA, 15 bp, Homo sapiens
cctggcccaactttt

SEQ ID NO: 400262 - DNA, 15 bp, Homo sapiens
ctggcccaactttta

SEQ ID NO: 400263 - DNA, 15 bp, Homo sapiens
tggcccaacttttac

SEQ ID NO: 400264 - DNA, 15 bp, Homo sapiens
ggcccaacttttacc

SEQ ID NO: 400265 - DNA, 15 bp, Homo sapiens
gcccaacttttacct

SEQ ID NO: 400266 - DNA, 15 bp, Homo sapiens
cccaacttttacctt

SEQ ID NO: 400267 - DNA, 15 bp, Homo sapiens
ccaacttttaccttt

SEQ ID NO: 400268 - DNA, 15 bp, Homo sapiens
caacttttacctttt

SEQ ID NO: 400269 - DNA, 15 bp, Homo sapiens
aacttttaccttttt

SEQ ID NO: 400270 - DNA, 15 bp, Homo sapiens
acttttaccttttta

SEQ ID NO: 400271 - DNA, 15 bp, Homo sapiens
cttttacctttttaa

SEQ ID NO: 400272 - DNA, 15 bp, Homo sapiens
ttttacctttttaaa

SEQ ID NO: 400273 - DNA, 15 bp, Homo sapiens
tttacctttttaaag

SEQ ID NO: 400274 - DNA, 15 bp, Homo sapiens
ttacctttttaaagt

SEQ ID NO: 400275 - DNA, 15 bp, Homo sapiens
tacctttttaaagta

SEQ ID NO: 400276 - DNA, 15 bp, Homo sapiens
acctttttaaagtat

SEQ ID NO: 400277 - DNA, 15 bp, Homo sapiens
cctttttaaagtatg

SEQ ID NO: 400278 - DNA, 15 bp, Homo sapiens
ctttttaaagtatgt

SEQ ID NO: 400279 - DNA, 15 bp, Homo sapiens
tttttaaagtatgtt

SEQ ID NO: 400280 - DNA, 15 bp, Homo sapiens
ttttaaagtatgttt

SEQ ID NO: 400281 - DNA, 15 bp, Homo sapiens
tttaaagtatgtttt

SEQ ID NO: 400282 - DNA, 15 bp, Homo sapiens
ttaaagtatgttttt

SEQ ID NO: 400283 - DNA, 15 bp, Homo sapiens
taaagtatgttttta

SEQ ID NO: 400284 - DNA, 15 bp, Homo sapiens
aaagtatgtttttaa

SEQ ID NO: 400285 - DNA, 15 bp, Homo sapiens
aagtatgtttttaaa

SEQ ID NO: 400286 - DNA, 15 bp, Homo sapiens
agtatgtttttaaac

SEQ ID NO: 400287 - DNA, 15 bp, Homo sapiens
gtatgtttttaaaca

SEQ ID NO: 400288 - DNA, 15 bp, Homo sapiens
tatgtttttaaacaa

SEQ ID NO: 400289 - DNA, 15 bp, Homo sapiens
atgtttttaaacaac

SEQ ID NO: 400290 - DNA, 15 bp, Homo sapiens
tgtttttaaacaacc

SEQ ID NO: 400291 - DNA, 15 bp, Homo sapiens
gtttttaaacaacca

SEQ ID NO: 400292 - DNA, 15 bp, Homo sapiens
tttttaaacaaccaa

SEQ ID NO: 400293 - DNA, 15 bp, Homo sapiens
ttttaaacaaccaat

SEQ ID NO: 400294 - DNA, 15 bp, Homo sapiens
tttaaacaaccaata

SEQ ID NO: 400295 - DNA, 15 bp, Homo sapiens
ttaaacaaccaataa

SEQ ID NO: 400296 - DNA, 15 bp, Homo sapiens
taaacaaccaataat

SEQ ID NO: 400297 - DNA, 15 bp, Homo sapiens
aaacaaccaataata

SEQ ID NO: 400298 - DNA, 15 bp, Homo sapiens
aacaaccaataatat

SEQ ID NO: 400299 - DNA, 15 bp, Homo sapiens
acaaccaataatatt

SEQ ID NO: 400300 - DNA, 15 bp, Homo sapiens
caaccaataatattt

SEQ ID NO: 400301 - DNA, 15 bp, Homo sapiens
aaccaataatatttg

SEQ ID NO: 400302 - DNA, 15 bp, Homo sapiens
accaataatatttgg

SEQ ID NO: 400303 - DNA, 15 bp, Homo sapiens
ccaataatatttggc

SEQ ID NO: 400304 - DNA, 15 bp, Homo sapiens
caataatatttggca

SEQ ID NO: 400305 - DNA, 15 bp, Homo sapiens
aataatatttggcat

SEQ ID NO: 400306 - DNA, 15 bp, Homo sapiens
ataatatttggcata

SEQ ID NO: 400307 - DNA, 15 bp, Homo sapiens
taatatttggcataa

SEQ ID NO: 400308 - DNA, 15 bp, Homo sapiens
aatatttggcataat

SEQ ID NO: 400309 - DNA, 15 bp, Homo sapiens
atatttggcataatt

SEQ ID NO: 400310 - DNA, 15 bp, Homo sapiens
tatttggcataattt

SEQ ID NO: 400311 - DNA, 15 bp, Homo sapiens
atttggcataattta

SEQ ID NO: 400312 - DNA, 15 bp, Homo sapiens
tttggcataatttag

SEQ ID NO: 400313 - DNA, 15 bp, Homo sapiens
ttggcataatttagt

SEQ ID NO: 400314 - DNA, 15 bp, Homo sapiens
tggcataatttagta

SEQ ID NO: 400315 - DNA, 15 bp, Homo sapiens
ggcataatttagtat

SEQ ID NO: 400316 - DNA, 15 bp, Homo sapiens
gcataatttagtatt

SEQ ID NO: 400317 - DNA, 15 bp, Homo sapiens
cataatttagtattt

SEQ ID NO: 400318 - DNA, 15 bp, Homo sapiens
ataatttagtatttt

SEQ ID NO: 400319 - DNA, 15 bp, Homo sapiens
taatttagtattttg

SEQ ID NO: 400320 - DNA, 15 bp, Homo sapiens
aatttagtattttgc

SEQ ID NO: 400321 - DNA, 15 bp, Homo sapiens
atttagtattttgcc

SEQ ID NO: 400322 - DNA, 15 bp, Homo sapiens
tttagtattttgcca

SEQ ID NO: 400323 - DNA, 15 bp, Homo sapiens
ttagtattttgccag

SEQ ID NO: 400324 - DNA, 15 bp, Homo sapiens
tagtattttgccagt

SEQ ID NO: 400325 - DNA, 15 bp, Homo sapiens
agtattttgccagtg

SEQ ID NO: 400326 - DNA, 15 bp, Homo sapiens
gtattttgccagtgc

SEQ ID NO: 400327 - DNA, 15 bp, Homo sapiens
tattttgccagtgct

SEQ ID NO: 400328 - DNA, 15 bp, Homo sapiens
attttgccagtgctt

SEQ ID NO: 400329 - DNA, 15 bp, Homo sapiens
ttttgccagtgcttc

SEQ ID NO: 400330 - DNA, 15 bp, Homo sapiens
tttgccagtgcttca

SEQ ID NO: 400331 - DNA, 15 bp, Homo sapiens
ttgccagtgcttcat

SEQ ID NO: 400332 - DNA, 15 bp, Homo sapiens
tgccagtgcttcatt

SEQ ID NO: 400333 - DNA, 15 bp, Homo sapiens
gccagtgcttcattg

SEQ ID NO: 400334 - DNA, 15 bp, Homo sapiens
ccagtgcttcattgc

SEQ ID NO: 400335 - DNA, 15 bp, Homo sapiens
cagtgcttcattgct

SEQ ID NO: 400336 - DNA, 15 bp, Homo sapiens
agtgcttcattgctt

SEQ ID NO: 400337 - DNA, 15 bp, Homo sapiens
gtgcttcattgctta

SEQ ID NO: 400338 - DNA, 15 bp, Homo sapiens
tgcttcattgcttat

SEQ ID NO: 400339 - DNA, 15 bp, Homo sapiens
gcttcattgcttatg

SEQ ID NO: 400340 - DNA, 15 bp, Homo sapiens
cttcattgcttatgt

SEQ ID NO: 400341 - DNA, 15 bp, Homo sapiens
ttcattgcttatgtg

SEQ ID NO: 400342 - DNA, 15 bp, Homo sapiens
tcattgcttatgtgc

SEQ ID NO: 400343 - DNA, 15 bp, Homo sapiens
cattgcttatgtgca

SEQ ID NO: 400344 - DNA, 15 bp, Homo sapiens
attgcttatgtgcaa

SEQ ID NO: 400345 - DNA, 15 bp, Homo sapiens
ttgcttatgtgcaat

SEQ ID NO: 400346 - DNA, 15 bp, Homo sapiens
tgcttatgtgcaatg

SEQ ID NO: 400347 - DNA, 15 bp, Homo sapiens
gcttatgtgcaatga

SEQ ID NO: 400348 - DNA, 15 bp, Homo sapiens
cttatgtgcaatgag

SEQ ID NO: 400349 - DNA, 15 bp, Homo sapiens
ttatgtgcaatgagg

SEQ ID NO: 400350 - DNA, 15 bp, Homo sapiens
tatgtgcaatgaggc

SEQ ID NO: 400351 - DNA, 15 bp, Homo sapiens
atgtgcaatgaggca

SEQ ID NO: 400352 - DNA, 15 bp, Homo sapiens
tgtgcaatgaggcat

SEQ ID NO: 400353 - DNA, 15 bp, Homo sapiens
gtgcaatgaggcatt

SEQ ID NO: 400354 - DNA, 15 bp, Homo sapiens
tgcaatgaggcattt

SEQ ID NO: 400355 - DNA, 15 bp, Homo sapiens
gcaatgaggcattta

SEQ ID NO: 400356 - DNA, 15 bp, Homo sapiens
caatgaggcatttaa

SEQ ID NO: 400357 - DNA, 15 bp, Homo sapiens
aatgaggcatttaac

SEQ ID NO: 400358 - DNA, 15 bp, Homo sapiens
atgaggcatttaaca

SEQ ID NO: 400359 - DNA, 15 bp, Homo sapiens
tgaggcatttaacaa

SEQ ID NO: 400360 - DNA, 15 bp, Homo sapiens
gaggcatttaacaaa

SEQ ID NO: 400361 - DNA, 15 bp, Homo sapiens
aggcatttaacaaaa

SEQ ID NO: 400362 - DNA, 15 bp, Homo sapiens
ggcatttaacaaaat

SEQ ID NO: 400363 - DNA, 15 bp, Homo sapiens
gcatttaacaaaata

SEQ ID NO: 400364 - DNA, 15 bp, Homo sapiens
catttaacaaaataa

SEQ ID NO: 400365 - DNA, 15 bp, Homo sapiens
atttaacaaaataaa

SEQ ID NO: 400366 - DNA, 15 bp, Homo sapiens
tttaacaaaataaat

SEQ ID NO: 400367 - DNA, 15 bp, Homo sapiens
ttaacaaaataaatt

SEQ ID NO: 400368 - DNA, 15 bp, Homo sapiens
taacaaaataaattg

SEQ ID NO: 400369 - DNA, 15 bp, Homo sapiens
aacaaaataaattgg

SEQ ID NO: 400370 - DNA, 15 bp, Homo sapiens
acaaaataaattgga

SEQ ID NO: 400371 - DNA, 15 bp, Homo sapiens
caaaataaattggac

SEQ ID NO: 400372 - DNA, 15 bp, Homo sapiens
aaaataaattggaca

SEQ ID NO: 400373 - DNA, 15 bp, Homo sapiens
aaataaattggacat

SEQ ID NO: 400374 - DNA, 15 bp, Homo sapiens
aataaattggacata

SEQ ID NO: 400375 - DNA, 15 bp, Homo sapiens
ataaattggacatat

SEQ ID NO: 400376 - DNA, 15 bp, Homo sapiens
taaattggacatata

SEQ ID NO: 400377 - DNA, 15 bp, Homo sapiens
aaattggacatatat

SEQ ID NO: 400378 - DNA, 15 bp, Homo sapiens
aattggacatatata

SEQ ID NO: 400379 - DNA, 15 bp, Homo sapiens
attggacatatatat

SEQ ID NO: 400380 - DNA, 15 bp, Homo sapiens
ttggacatatatatt

SEQ ID NO: 400381 - DNA, 15 bp, Homo sapiens
tggacatatatattt

SEQ ID NO: 400382 - DNA, 15 bp, Homo sapiens
ggacatatatattta

SEQ ID NO: 400383 - DNA, 15 bp, Homo sapiens
gacatatatatttat

SEQ ID NO: 400384 - DNA, 15 bp, Homo sapiens
atatatttataatta

SEQ ID NO: 400385 - DNA, 15 bp, Homo sapiens
tatatttataattat

SEQ ID NO: 400386 - DNA, 15 bp, Homo sapiens
atatttataattatt

SEQ ID NO: 400387 - DNA, 15 bp, Homo sapiens
tatttataattattt

SEQ ID NO: 400388 - DNA, 15 bp, Homo sapiens
atttataattatttt

SEQ ID NO: 400389 - DNA, 15 bp, Homo sapiens
tttataattatttta

SEQ ID NO: 400390 - DNA, 15 bp, Homo sapiens
ttataattattttac

SEQ ID NO: 400391 - DNA, 15 bp, Homo sapiens
taattattttaccta

SEQ ID NO: 400392 - DNA, 15 bp, Homo sapiens
aattattttacctat

SEQ ID NO: 400393 - DNA, 15 bp, Homo sapiens
attattttacctatt

SEQ ID NO: 400394 - DNA, 15 bp, Homo sapiens
ttattttacctattc

SEQ ID NO: 400395 - DNA, 15 bp, Homo sapiens
tattttacctattcc

SEQ ID NO: 400396 - DNA, 15 bp, Homo sapiens
attttacctattccg

SEQ ID NO: 400397 - DNA, 15 bp, Homo sapiens
ttttacctattccgt

SEQ ID NO: 400398 - DNA, 15 bp, Homo sapiens
tttacctattccgtc

SEQ ID NO: 400399 - DNA, 15 bp, Homo sapiens
ttacctattccgtca

SEQ ID NO: 400400 - DNA, 15 bp, Homo sapiens
tacctattccgtcag

SEQ ID NO: 400401 - DNA, 15 bp, Homo sapiens
acctattccgtcaga

SEQ ID NO: 400402 - DNA, 15 bp, Homo sapiens
cctattccgtcagat

SEQ ID NO: 400403 - DNA, 15 bp, Homo sapiens
ctattccgtcagata

SEQ ID NO: 400404 - DNA, 15 bp, Homo sapiens
tattccgtcagatag

SEQ ID NO: 400405 - DNA, 15 bp, Homo sapiens
attccgtcagatagt

SEQ ID NO: 400406 - DNA, 15 bp, Homo sapiens
ttccgtcagatagta

SEQ ID NO: 400407 - DNA, 15 bp, Homo sapiens
tccgtcagatagtac

SEQ ID NO: 400408 - DNA, 15 bp, Homo sapiens
ccgtcagatagtaca

SEQ ID NO: 400409 - DNA, 15 bp, Homo sapiens
cgtcagatagtacat

SEQ ID NO: 400410 - DNA, 15 bp, Homo sapiens
gtcagatagtacatt

SEQ ID NO: 400411 - DNA, 15 bp, Homo sapiens
tcagatagtacattt

SEQ ID NO: 400412 - DNA, 15 bp, Homo sapiens
cagatagtacatttc

SEQ ID NO: 400413 - DNA, 15 bp, Homo sapiens
agatagtacatttct

SEQ ID NO: 400414 - DNA, 15 bp, Homo sapiens
gatagtacatttctt

SEQ ID NO: 400415 - DNA, 15 bp, Homo sapiens
atagtacatttctta

SEQ ID NO: 400416 - DNA, 15 bp, Homo sapiens
tagtacatttcttaa

SEQ ID NO: 400417 - DNA, 15 bp, Homo sapiens
agtacatttcttaag

SEQ ID NO: 400418 - DNA, 15 bp, Homo sapiens
gtacatttcttaagg

SEQ ID NO: 400419 - DNA, 15 bp, Homo sapiens
tacatttcttaagga

SEQ ID NO: 400420 - DNA, 15 bp, Homo sapiens
acatttcttaaggag

SEQ ID NO: 400421 - DNA, 15 bp, Homo sapiens
catttcttaaggagt

SEQ ID NO: 400422 - DNA, 15 bp, Homo sapiens
atttcttaaggagta

SEQ ID NO: 400423 - DNA, 15 bp, Homo sapiens
tttcttaaggagtaa

SEQ ID NO: 400424 - DNA, 15 bp, Homo sapiens
ttcttaaggagtaag

SEQ ID NO: 400425 - DNA, 15 bp, Homo sapiens
tcttaaggagtaagg

SEQ ID NO: 400426 - DNA, 15 bp, Homo sapiens
cttaaggagtaagga

SEQ ID NO: 400427 - DNA, 15 bp, Homo sapiens
ttaaggagtaaggaa

SEQ ID NO: 400428 - DNA, 15 bp, Homo sapiens
taaggagtaaggaaa

SEQ ID NO: 400429 - DNA, 15 bp, Homo sapiens
aaggagtaaggaaac

SEQ ID NO: 400430 - DNA, 15 bp, Homo sapiens
aggagtaaggaaact

SEQ ID NO: 400431 - DNA, 15 bp, Homo sapiens
ggagtaaggaaactt

SEQ ID NO: 400432 - DNA, 15 bp, Homo sapiens
gagtaaggaaacttg

SEQ ID NO: 400433 - DNA, 15 bp, Homo sapiens
agtaaggaaacttga

SEQ ID NO: 400434 - DNA, 15 bp, Homo sapiens
gtaaggaaacttgaa

SEQ ID NO: 400435 - DNA, 15 bp, Homo sapiens
taaggaaacttgaaa

SEQ ID NO: 400436 - DNA, 15 bp, Homo sapiens
aaggaaacttgaaat

SEQ ID NO: 400437 - DNA, 15 bp, Homo sapiens
aggaaacttgaaata

SEQ ID NO: 400438 - DNA, 15 bp, Homo sapiens
ggaaacttgaaatat

SEQ ID NO: 400439 - DNA, 15 bp, Homo sapiens
gaaacttgaaatata

SEQ ID NO: 400440 - DNA, 15 bp, Homo sapiens
aaacttgaaatataa

SEQ ID NO: 400441 - DNA, 15 bp, Homo sapiens
aacttgaaatataac

SEQ ID NO: 400442 - DNA, 15 bp, Homo sapiens
acttgaaatataact

SEQ ID NO: 400443 - DNA, 15 bp, Homo sapiens
cttgaaatataactc

SEQ ID NO: 400444 - DNA, 15 bp, Homo sapiens
ttgaaatataactca

SEQ ID NO: 400445 - DNA, 15 bp, Homo sapiens
tgaaatataactcac

SEQ ID NO: 400446 - DNA, 15 bp, Homo sapiens
gaaatataactcact

SEQ ID NO: 400447 - DNA, 15 bp, Homo sapiens
aaatataactcacta

SEQ ID NO: 400448 - DNA, 15 bp, Homo sapiens
aatataactcactac

SEQ ID NO: 400449 - DNA, 15 bp, Homo sapiens
atataactcactact

SEQ ID NO: 400450 - DNA, 15 bp, Homo sapiens
tataactcactactt

SEQ ID NO: 400451 - DNA, 15 bp, Homo sapiens
ataactcactacttc

SEQ ID NO: 400452 - DNA, 15 bp, Homo sapiens
taactcactacttct

SEQ ID NO: 400453 - DNA, 15 bp, Homo sapiens
aactcactacttctc

SEQ ID NO: 400454 - DNA, 15 bp, Homo sapiens
actcactacttctcc

SEQ ID NO: 400455 - DNA, 15 bp, Homo sapiens
ctcactacttctcct

SEQ ID NO: 400456 - DNA, 15 bp, Homo sapiens
tcactacttctcctt

SEQ ID NO: 400457 - DNA, 15 bp, Homo sapiens
cactacttctccttt

SEQ ID NO: 400458 - DNA, 15 bp, Homo sapiens
actacttctcctttt

SEQ ID NO: 400459 - DNA, 15 bp, Homo sapiens
ctacttctccttttt

SEQ ID NO: 400460 - DNA, 15 bp, Homo sapiens
tacttctcctttttt

SEQ ID NO: 400461 - DNA, 15 bp, Homo sapiens
acttctccttttttt

SEQ ID NO: 400462 - DNA, 15 bp, Homo sapiens
cttctcctttttttt

SEQ ID NO: 400463 - DNA, 15 bp, Homo sapiens
ttctccttttttttt

SEQ ID NO: 400464 - DNA, 15 bp, Homo sapiens
tctcctttttttttt

SEQ ID NO: 400465 - DNA, 15 bp, Homo sapiens
ctccttttttttttt

SEQ ID NO: 400466 - DNA, 15 bp, Homo sapiens
ttttttttttttcct

SEQ ID NO: 400467 - DNA, 15 bp, Homo sapiens
tttttttttttcctg

SEQ ID NO: 400468 - DNA, 15 bp, Homo sapiens
ttttttttttcctga

SEQ ID NO: 400469 - DNA, 15 bp, Homo sapiens
tttttttttcctgag

SEQ ID NO: 400470 - DNA, 15 bp, Homo sapiens
ttttttttcctgaga

SEQ ID NO: 400471 - DNA, 15 bp, Homo sapiens
tttttttcctgagac

SEQ ID NO: 400472 - DNA, 15 bp, Homo sapiens
ttttttcctgagacg

SEQ ID NO: 400473 - DNA, 15 bp, Homo sapiens
tttttcctgagacgg

SEQ ID NO: 400474 - DNA, 15 bp, Homo sapiens
ttttcctgagacgga

SEQ ID NO: 400475 - DNA, 15 bp, Homo sapiens
tttcctgagacggag

SEQ ID NO: 400476 - DNA, 15 bp, Homo sapiens
ttcctgagacggagt

SEQ ID NO: 400477 - DNA, 15 bp, Homo sapiens
tcctgagacggagtc

SEQ ID NO: 400478 - DNA, 15 bp, Homo sapiens
cctgagacggagtct

SEQ ID NO: 400479 - DNA, 15 bp, Homo sapiens
ctgagacggagtctt

SEQ ID NO: 400480 - DNA, 15 bp, Homo sapiens
cggagtcttgctctg

SEQ ID NO: 400481 - DNA, 15 bp, Homo sapiens
tcacccaggctgaag

SEQ ID NO: 400482 - DNA, 15 bp, Homo sapiens
cacccaggctgaagt

SEQ ID NO: 400483 - DNA, 15 bp, Homo sapiens
acccaggctgaagtg

SEQ ID NO: 400484 - DNA, 15 bp, Homo sapiens
caggctgaagtgcaa

SEQ ID NO: 400485 - DNA, 15 bp, Homo sapiens
aggctgaagtgcaat

SEQ ID NO: 400486 - DNA, 15 bp, Homo sapiens
ggctgaagtgcaatg

SEQ ID NO: 400487 - DNA, 15 bp, Homo sapiens
gctgaagtgcaatgg

SEQ ID NO: 400488 - DNA, 15 bp, Homo sapiens
ctgaagtgcaatggc

SEQ ID NO: 400489 - DNA, 15 bp, Homo sapiens
tgaagtgcaatggcg

SEQ ID NO: 400490 - DNA, 15 bp, Homo sapiens
gaagtgcaatggcgc

SEQ ID NO: 400491 - DNA, 15 bp, Homo sapiens
aagtgcaatggcgcg

SEQ ID NO: 400492 - DNA, 15 bp, Homo sapiens
ggcgcgatctcggcg

SEQ ID NO: 400493 - DNA, 15 bp, Homo sapiens
gcgcgatctcggcgc

SEQ ID NO: 400494 - DNA, 15 bp, Homo sapiens
cgcgatctcggcgca

SEQ ID NO: 400495 - DNA, 15 bp, Homo sapiens
gcgatctcggcgcac

SEQ ID NO: 400496 - DNA, 15 bp, Homo sapiens
cgatctcggcgcact

SEQ ID NO: 400497 - DNA, 15 bp, Homo sapiens
gatctcggcgcactg

SEQ ID NO: 400498 - DNA, 15 bp, Homo sapiens
atctcggcgcactgc

SEQ ID NO: 400499 - DNA, 15 bp, Homo sapiens
tctcggcgcactgca

SEQ ID NO: 400500 - DNA, 15 bp, Homo sapiens
ctcggcgcactgcaa

SEQ ID NO: 400501 - DNA, 15 bp, Homo sapiens
tcggcgcactgcaag

SEQ ID NO: 400502 - DNA, 15 bp, Homo sapiens
cggcgcactgcaagc

SEQ ID NO: 400503 - DNA, 15 bp, Homo sapiens
ggcgcactgcaagct

SEQ ID NO: 400504 - DNA, 15 bp, Homo sapiens
gcgcactgcaagctc

SEQ ID NO: 400505 - DNA, 15 bp, Homo sapiens
cgcactgcaagctcc

SEQ ID NO: 400506 - DNA, 15 bp, Homo sapiens
gcactgcaagctccg

SEQ ID NO: 400507 - DNA, 15 bp, Homo sapiens
caagctccgcctccc

SEQ ID NO: 400508 - DNA, 15 bp, Homo sapiens
aagctccgcctcccg

SEQ ID NO: 400509 - DNA, 15 bp, Homo sapiens
agctccgcctcccgg

SEQ ID NO: 400510 - DNA, 15 bp, Homo sapiens
gctccgcctcccggg

SEQ ID NO: 400511 - DNA, 15 bp, Homo sapiens
ggactacaggcacct

SEQ ID NO: 400512 - DNA, 15 bp, Homo sapiens
gactacaggcacctg

SEQ ID NO: 400513 - DNA, 15 bp, Homo sapiens
actacaggcacctgc

SEQ ID NO: 400514 - DNA, 15 bp, Homo sapiens
ctacaggcacctgca

SEQ ID NO: 400515 - DNA, 15 bp, Homo sapiens
tacaggcacctgcaa

SEQ ID NO: 400516 - DNA, 15 bp, Homo sapiens
acaggcacctgcaac

SEQ ID NO: 400517 - DNA, 15 bp, Homo sapiens
caggcacctgcaacc

SEQ ID NO: 400518 - DNA, 15 bp, Homo sapiens
aggcacctgcaacca

SEQ ID NO: 400519 - DNA, 15 bp, Homo sapiens
ggcacctgcaaccac

SEQ ID NO: 400520 - DNA, 15 bp, Homo sapiens
gcacctgcaaccacg

SEQ ID NO: 400521 - DNA, 15 bp, Homo sapiens
cacctgcaaccacgc

SEQ ID NO: 400522 - DNA, 15 bp, Homo sapiens
acctgcaaccacgcc

SEQ ID NO: 400523 - DNA, 15 bp, Homo sapiens
cctgcaaccacgccc

SEQ ID NO: 400524 - DNA, 15 bp, Homo sapiens
ctgcaaccacgcccg

SEQ ID NO: 400525 - DNA, 15 bp, Homo sapiens
tgcaaccacgcccgg

SEQ ID NO: 400526 - DNA, 15 bp, Homo sapiens
gcaaccacgcccggc

SEQ ID NO: 400527 - DNA, 15 bp, Homo sapiens
caaccacgcccggct

SEQ ID NO: 400528 - DNA, 15 bp, Homo sapiens
aaccacgcccggcta

SEQ ID NO: 400529 - DNA, 15 bp, Homo sapiens
cacgcccggctaata

SEQ ID NO: 400530 - DNA, 15 bp, Homo sapiens
acgcccggctaatat

SEQ ID NO: 400531 - DNA, 15 bp, Homo sapiens
cgcccggctaatatt

SEQ ID NO: 400532 - DNA, 15 bp, Homo sapiens
gcccggctaatattt

SEQ ID NO: 400533 - DNA, 15 bp, Homo sapiens
ccggctaatattttg

SEQ ID NO: 400534 - DNA, 15 bp, Homo sapiens
cggctaatattttgt

SEQ ID NO: 400535 - DNA, 15 bp, Homo sapiens
ggctaatattttgta

SEQ ID NO: 400536 - DNA, 15 bp, Homo sapiens
gctaatattttgtat

SEQ ID NO: 400537 - DNA, 15 bp, Homo sapiens
ctaatattttgtatt

SEQ ID NO: 400538 - DNA, 15 bp, Homo sapiens
taatattttgtattt

SEQ ID NO: 400539 - DNA, 15 bp, Homo sapiens
aatattttgtatttt

SEQ ID NO: 400540 - DNA, 15 bp, Homo sapiens
atattttgtattttt

SEQ ID NO: 400541 - DNA, 15 bp, Homo sapiens
tattttgtatttttt

SEQ ID NO: 400542 - DNA, 15 bp, Homo sapiens
attttgtattttttt

SEQ ID NO: 400543 - DNA, 15 bp, Homo sapiens
tttgtatttttttta

SEQ ID NO: 400544 - DNA, 15 bp, Homo sapiens
ttgtattttttttag

SEQ ID NO: 400545 - DNA, 15 bp, Homo sapiens
tgtattttttttagt

SEQ ID NO: 400546 - DNA, 15 bp, Homo sapiens
gtattttttttagta

SEQ ID NO: 400547 - DNA, 15 bp, Homo sapiens
tattttttttagtaa

SEQ ID NO: 400548 - DNA, 15 bp, Homo sapiens
attttttttagtaaa

SEQ ID NO: 400549 - DNA, 15 bp, Homo sapiens
ttttttttagtaaag

SEQ ID NO: 400550 - DNA, 15 bp, Homo sapiens
tttttttagtaaaga

SEQ ID NO: 400551 - DNA, 15 bp, Homo sapiens
ttttttagtaaagac

SEQ ID NO: 400552 - DNA, 15 bp, Homo sapiens
tttttagtaaagacg

SEQ ID NO: 400553 - DNA, 15 bp, Homo sapiens
ttttagtaaagacgg

SEQ ID NO: 400554 - DNA, 15 bp, Homo sapiens
tttagtaaagacggc

SEQ ID NO: 400555 - DNA, 15 bp, Homo sapiens
ttagtaaagacggcg

SEQ ID NO: 400556 - DNA, 15 bp, Homo sapiens
tagtaaagacggcgt

SEQ ID NO: 400557 - DNA, 15 bp, Homo sapiens
agtaaagacggcgtt

SEQ ID NO: 400558 - DNA, 15 bp, Homo sapiens
gtaaagacggcgttt

SEQ ID NO: 400559 - DNA, 15 bp, Homo sapiens
taaagacggcgtttc

SEQ ID NO: 400560 - DNA, 15 bp, Homo sapiens
aaagacggcgtttca

SEQ ID NO: 400561 - DNA, 15 bp, Homo sapiens
aagacggcgtttcac

SEQ ID NO: 400562 - DNA, 15 bp, Homo sapiens
agacggcgtttcacc

SEQ ID NO: 400563 - DNA, 15 bp, Homo sapiens
gacggcgtttcaccg

SEQ ID NO: 400564 - DNA, 15 bp, Homo sapiens
acggcgtttcaccgt

SEQ ID NO: 400565 - DNA, 15 bp, Homo sapiens
cggcgtttcaccgtt

SEQ ID NO: 400566 - DNA, 15 bp, Homo sapiens
ggcgtttcaccgttt

SEQ ID NO: 400567 - DNA, 15 bp, Homo sapiens
gcgtttcaccgtttt

SEQ ID NO: 400568 - DNA, 15 bp, Homo sapiens
cgtttcaccgtttta

SEQ ID NO: 400569 - DNA, 15 bp, Homo sapiens
gtttcaccgttttag

SEQ ID NO: 400570 - DNA, 15 bp, Homo sapiens
tttcaccgttttagc

SEQ ID NO: 400571 - DNA, 15 bp, Homo sapiens
ttcaccgttttagcc

SEQ ID NO: 400572 - DNA, 15 bp, Homo sapiens
tcaccgttttagcca

SEQ ID NO: 400573 - DNA, 15 bp, Homo sapiens
caccgttttagccag

SEQ ID NO: 400574 - DNA, 15 bp, Homo sapiens
accgttttagccaga

SEQ ID NO: 400575 - DNA, 15 bp, Homo sapiens
ccgttttagccagaa

SEQ ID NO: 400576 - DNA, 15 bp, Homo sapiens
cgttttagccagaat

SEQ ID NO: 400577 - DNA, 15 bp, Homo sapiens
gttttagccagaatg

SEQ ID NO: 400578 - DNA, 15 bp, Homo sapiens
ttttagccagaatga

SEQ ID NO: 400579 - DNA, 15 bp, Homo sapiens
tttagccagaatgat

SEQ ID NO: 400580 - DNA, 15 bp, Homo sapiens
ttagccagaatgatc

SEQ ID NO: 400581 - DNA, 15 bp, Homo sapiens
tagccagaatgatct

SEQ ID NO: 400582 - DNA, 15 bp, Homo sapiens
agccagaatgatctc

SEQ ID NO: 400583 - DNA, 15 bp, Homo sapiens
gccagaatgatctcg

SEQ ID NO: 400584 - DNA, 15 bp, Homo sapiens
ccagaatgatctcga

SEQ ID NO: 400585 - DNA, 15 bp, Homo sapiens
cagaatgatctcgat

SEQ ID NO: 400586 - DNA, 15 bp, Homo sapiens
agaatgatctcgatc

SEQ ID NO: 400587 - DNA, 15 bp, Homo sapiens
gaatgatctcgatct

SEQ ID NO: 400588 - DNA, 15 bp, Homo sapiens
aatgatctcgatctc

SEQ ID NO: 400589 - DNA, 15 bp, Homo sapiens
atgatctcgatctcc

SEQ ID NO: 400590 - DNA, 15 bp, Homo sapiens
tgatctcgatctcct

SEQ ID NO: 400591 - DNA, 15 bp, Homo sapiens
gatctcgatctcctg

SEQ ID NO: 400592 - DNA, 15 bp, Homo sapiens
atctcgatctcctga

SEQ ID NO: 400593 - DNA, 15 bp, Homo sapiens
ctcgatctcctgacg

SEQ ID NO: 400594 - DNA, 15 bp, Homo sapiens
tcgatctcctgacgt

SEQ ID NO: 400595 - DNA, 15 bp, Homo sapiens
cgatctcctgacgtc

SEQ ID NO: 400596 - DNA, 15 bp, Homo sapiens
gatctcctgacgtcg

SEQ ID NO: 400597 - DNA, 15 bp, Homo sapiens
atctcctgacgtcgt

SEQ ID NO: 400598 - DNA, 15 bp, Homo sapiens
tctcctgacgtcgtg

SEQ ID NO: 400599 - DNA, 15 bp, Homo sapiens
ctcctgacgtcgtga

SEQ ID NO: 400600 - DNA, 15 bp, Homo sapiens
tcctgacgtcgtgat

SEQ ID NO: 400601 - DNA, 15 bp, Homo sapiens
cctgacgtcgtgatc

SEQ ID NO: 400602 - DNA, 15 bp, Homo sapiens
ctgacgtcgtgatcc

SEQ ID NO: 400603 - DNA, 15 bp, Homo sapiens
tgacgtcgtgatccg

SEQ ID NO: 400604 - DNA, 15 bp, Homo sapiens
gacgtcgtgatccgc

SEQ ID NO: 400605 - DNA, 15 bp, Homo sapiens
acgtcgtgatccgcc

SEQ ID NO: 400606 - DNA, 15 bp, Homo sapiens
cgtcgtgatccgccc

SEQ ID NO: 400607 - DNA, 15 bp, Homo sapiens
gtcgtgatccgcccg

SEQ ID NO: 400608 - DNA, 15 bp, Homo sapiens
gcgtgagccaccgcg

SEQ ID NO: 400609 - DNA, 15 bp, Homo sapiens
cgtgagccaccgcgc

SEQ ID NO: 400610 - DNA, 15 bp, Homo sapiens
gtgagccaccgcgcc

SEQ ID NO: 400611 - DNA, 15 bp, Homo sapiens
gagccaccgcgcccg

SEQ ID NO: 400612 - DNA, 15 bp, Homo sapiens
agccaccgcgcccgg

SEQ ID NO: 400613 - DNA, 15 bp, Homo sapiens
gccaccgcgcccggc

SEQ ID NO: 400614 - DNA, 15 bp, Homo sapiens
ccaccgcgcccggcc

SEQ ID NO: 400615 - DNA, 15 bp, Homo sapiens
caccgcgcccggcct

SEQ ID NO: 400616 - DNA, 15 bp, Homo sapiens
accgcgcccggcctg

SEQ ID NO: 400617 - DNA, 15 bp, Homo sapiens
ccgcgcccggcctgc

SEQ ID NO: 400618 - DNA, 15 bp, Homo sapiens
cgcgcccggcctgct

SEQ ID NO: 400619 - DNA, 15 bp, Homo sapiens
gcgcccggcctgctt

SEQ ID NO: 400620 - DNA, 15 bp, Homo sapiens
cgcccggcctgcttc

SEQ ID NO: 400621 - DNA, 15 bp, Homo sapiens
gcccggcctgcttct

SEQ ID NO: 400622 - DNA, 15 bp, Homo sapiens
cccggcctgcttctc

SEQ ID NO: 400623 - DNA, 15 bp, Homo sapiens
ccggcctgcttctcc

SEQ ID NO: 400624 - DNA, 15 bp, Homo sapiens
cggcctgcttctcca

SEQ ID NO: 400625 - DNA, 15 bp, Homo sapiens
ggcctgcttctccat

SEQ ID NO: 400626 - DNA, 15 bp, Homo sapiens
gcctgcttctccatt

SEQ ID NO: 400627 - DNA, 15 bp, Homo sapiens
cctgcttctccattt

SEQ ID NO: 400628 - DNA, 15 bp, Homo sapiens
ctgcttctccatttt

SEQ ID NO: 400629 - DNA, 15 bp, Homo sapiens
gcttctccattttgt

SEQ ID NO: 400630 - DNA, 15 bp, Homo sapiens
cttctccattttgtt

SEQ ID NO: 400631 - DNA, 15 bp, Homo sapiens
ttctccattttgttc

SEQ ID NO: 400632 - DNA, 15 bp, Homo sapiens
tctccattttgttca

SEQ ID NO: 400633 - DNA, 15 bp, Homo sapiens
ctccattttgttcac

SEQ ID NO: 400634 - DNA, 15 bp, Homo sapiens
tccattttgttcaca

SEQ ID NO: 400635 - DNA, 15 bp, Homo sapiens
ccattttgttcacaa

SEQ ID NO: 400636 - DNA, 15 bp, Homo sapiens
cattttgttcacaaa

SEQ ID NO: 400637 - DNA, 15 bp, Homo sapiens
attttgttcacaaaa

SEQ ID NO: 400638 - DNA, 15 bp, Homo sapiens
ttttgttcacaaaat

SEQ ID NO: 400639 - DNA, 15 bp, Homo sapiens
tttgttcacaaaata

SEQ ID NO: 400640 - DNA, 15 bp, Homo sapiens
ttgttcacaaaatat

SEQ ID NO: 400641 - DNA, 15 bp, Homo sapiens
tgttcacaaaatatt

SEQ ID NO: 400642 - DNA, 15 bp, Homo sapiens
gttcacaaaatattt

SEQ ID NO: 400643 - DNA, 15 bp, Homo sapiens
ttcacaaaatatttt

SEQ ID NO: 400644 - DNA, 15 bp, Homo sapiens
tcacaaaatattttt

SEQ ID NO: 400645 - DNA, 15 bp, Homo sapiens
cacaaaatatttttt

SEQ ID NO: 400646 - DNA, 15 bp, Homo sapiens
acaaaatattttttc

SEQ ID NO: 400647 - DNA, 15 bp, Homo sapiens
caaaatattttttcc

SEQ ID NO: 400648 - DNA, 15 bp, Homo sapiens
aaaatattttttcct

SEQ ID NO: 400649 - DNA, 15 bp, Homo sapiens
aaatattttttcctc

SEQ ID NO: 400650 - DNA, 15 bp, Homo sapiens
aatattttttcctca

SEQ ID NO: 400651 - DNA, 15 bp, Homo sapiens
atattttttcctcag

SEQ ID NO: 400652 - DNA, 15 bp, Homo sapiens
tattttttcctcaga

SEQ ID NO: 400653 - DNA, 15 bp, Homo sapiens
attttttcctcagaa

SEQ ID NO: 400654 - DNA, 15 bp, Homo sapiens
ttttttcctcagaag

SEQ ID NO: 400655 - DNA, 15 bp, Homo sapiens
tttttcctcagaagt

SEQ ID NO: 400656 - DNA, 15 bp, Homo sapiens
ttttcctcagaagtg

SEQ ID NO: 400657 - DNA, 15 bp, Homo sapiens
tttcctcagaagtgt

SEQ ID NO: 400658 - DNA, 15 bp, Homo sapiens
ttcctcagaagtgtg

SEQ ID NO: 400659 - DNA, 15 bp, Homo sapiens
tcctcagaagtgtgg

SEQ ID NO: 400660 - DNA, 15 bp, Homo sapiens
cctcagaagtgtggc

SEQ ID NO: 400661 - DNA, 15 bp, Homo sapiens
ctcagaagtgtggca

SEQ ID NO: 400662 - DNA, 15 bp, Homo sapiens
tcagaagtgtggcat

SEQ ID NO: 400663 - DNA, 15 bp, Homo sapiens
cagaagtgtggcatt

SEQ ID NO: 400664 - DNA, 15 bp, Homo sapiens
agaagtgtggcattg

SEQ ID NO: 400665 - DNA, 15 bp, Homo sapiens
gaagtgtggcattga

SEQ ID NO: 400666 - DNA, 15 bp, Homo sapiens
aagtgtggcattgaa

SEQ ID NO: 400667 - DNA, 15 bp, Homo sapiens
agtgtggcattgaat

SEQ ID NO: 400668 - DNA, 15 bp, Homo sapiens
gtgtggcattgaatg

SEQ ID NO: 400669 - DNA, 15 bp, Homo sapiens
tgtggcattgaatga

SEQ ID NO: 400670 - DNA, 15 bp, Homo sapiens
gtggcattgaatgat

SEQ ID NO: 400671 - DNA, 15 bp, Homo sapiens
tggcattgaatgatg

SEQ ID NO: 400672 - DNA, 15 bp, Homo sapiens
ggcattgaatgatgt

SEQ ID NO: 400673 - DNA, 15 bp, Homo sapiens
gcattgaatgatgta

SEQ ID NO: 400674 - DNA, 15 bp, Homo sapiens
cattgaatgatgtat

SEQ ID NO: 400675 - DNA, 15 bp, Homo sapiens
attgaatgatgtatt

SEQ ID NO: 400676 - DNA, 15 bp, Homo sapiens
ttgaatgatgtattg

SEQ ID NO: 400677 - DNA, 15 bp, Homo sapiens
tgaatgatgtattgt

SEQ ID NO: 400678 - DNA, 15 bp, Homo sapiens
gaatgatgtattgtt

SEQ ID NO: 400679 - DNA, 15 bp, Homo sapiens
aatgatgtattgttt

SEQ ID NO: 400680 - DNA, 15 bp, Homo sapiens
atgatgtattgtttt

SEQ ID NO: 400681 - DNA, 15 bp, Homo sapiens
tgatgtattgttttg

SEQ ID NO: 400682 - DNA, 15 bp, Homo sapiens
gatgtattgttttgt

SEQ ID NO: 400683 - DNA, 15 bp, Homo sapiens
atgtattgttttgta

SEQ ID NO: 400684 - DNA, 15 bp, Homo sapiens
tgtattgttttgtag

SEQ ID NO: 400685 - DNA, 15 bp, Homo sapiens
gtattgttttgtagt

SEQ ID NO: 400686 - DNA, 15 bp, Homo sapiens
tattgttttgtagtg

SEQ ID NO: 400687 - DNA, 15 bp, Homo sapiens
attgttttgtagtga

SEQ ID NO: 400688 - DNA, 15 bp, Homo sapiens
ttgttttgtagtgag

SEQ ID NO: 400689 - DNA, 15 bp, Homo sapiens
tgttttgtagtgagt

SEQ ID NO: 400690 - DNA, 15 bp, Homo sapiens
gttttgtagtgagta

SEQ ID NO: 400691 - DNA, 15 bp, Homo sapiens
ttttgtagtgagtac

SEQ ID NO: 400692 - DNA, 15 bp, Homo sapiens
tttgtagtgagtaca

SEQ ID NO: 400693 - DNA, 15 bp, Homo sapiens
ttgtagtgagtacat

SEQ ID NO: 400694 - DNA, 15 bp, Homo sapiens
tgtagtgagtacatt

SEQ ID NO: 400695 - DNA, 15 bp, Homo sapiens
gtagtgagtacatta

SEQ ID NO: 400696 - DNA, 15 bp, Homo sapiens
tagtgagtacattat

SEQ ID NO: 400697 - DNA, 15 bp, Homo sapiens
agtgagtacattatc

SEQ ID NO: 400698 - DNA, 15 bp, Homo sapiens
gtgagtacattatct

SEQ ID NO: 400699 - DNA, 15 bp, Homo sapiens
tgagtacattatctc

SEQ ID NO: 400700 - DNA, 15 bp, Homo sapiens
gagtacattatctca

SEQ ID NO: 400701 - DNA, 15 bp, Homo sapiens
agtacattatctcag

SEQ ID NO: 400702 - DNA, 15 bp, Homo sapiens
gtacattatctcagt

SEQ ID NO: 400703 - DNA, 15 bp, Homo sapiens
tacattatctcagtg

SEQ ID NO: 400704 - DNA, 15 bp, Homo sapiens
acattatctcagtga

SEQ ID NO: 400705 - DNA, 15 bp, Homo sapiens
cattatctcagtgaa

SEQ ID NO: 400706 - DNA, 15 bp, Homo sapiens
attatctcagtgaac

SEQ ID NO: 400707 - DNA, 15 bp, Homo sapiens
ttatctcagtgaaca

SEQ ID NO: 400708 - DNA, 15 bp, Homo sapiens
tatctcagtgaacac

SEQ ID NO: 400709 - DNA, 15 bp, Homo sapiens
atctcagtgaacaca

SEQ ID NO: 400710 - DNA, 15 bp, Homo sapiens
tctcagtgaacacac

SEQ ID NO: 400711 - DNA, 15 bp, Homo sapiens
ctcagtgaacacaca

SEQ ID NO: 400712 - DNA, 15 bp, Homo sapiens
tcagtgaacacacaa

SEQ ID NO: 400713 - DNA, 15 bp, Homo sapiens
cagtgaacacacaat

SEQ ID NO: 400714 - DNA, 15 bp, Homo sapiens
agtgaacacacaatt

SEQ ID NO: 400715 - DNA, 15 bp, Homo sapiens
gtgaacacacaattt

SEQ ID NO: 400716 - DNA, 15 bp, Homo sapiens
tgaacacacaatttc

SEQ ID NO: 400717 - DNA, 15 bp, Homo sapiens
gaacacacaatttct

SEQ ID NO: 400718 - DNA, 15 bp, Homo sapiens
aacacacaatttctt

SEQ ID NO: 400719 - DNA, 15 bp, Homo sapiens
acacacaatttcttt

SEQ ID NO: 400720 - DNA, 15 bp, Homo sapiens
cacacaatttctttc

SEQ ID NO: 400721 - DNA, 15 bp, Homo sapiens
acacaatttctttca

SEQ ID NO: 400722 - DNA, 15 bp, Homo sapiens
cacaatttctttcag

SEQ ID NO: 400723 - DNA, 15 bp, Homo sapiens
acaatttctttcaga

SEQ ID NO: 400724 - DNA, 15 bp, Homo sapiens
caatttctttcagat

SEQ ID NO: 400725 - DNA, 15 bp, Homo sapiens
aatttctttcagata

SEQ ID NO: 400726 - DNA, 15 bp, Homo sapiens
atttctttcagatag

SEQ ID NO: 400727 - DNA, 15 bp, Homo sapiens
tttctttcagatagt

SEQ ID NO: 400728 - DNA, 15 bp, Homo sapiens
ttctttcagatagtc

SEQ ID NO: 400729 - DNA, 15 bp, Homo sapiens
tctttcagatagtca

SEQ ID NO: 400730 - DNA, 15 bp, Homo sapiens
ctttcagatagtcac

SEQ ID NO: 400731 - DNA, 15 bp, Homo sapiens
tttcagatagtcacc

SEQ ID NO: 400732 - DNA, 15 bp, Homo sapiens
ttcagatagtcacca

SEQ ID NO: 400733 - DNA, 15 bp, Homo sapiens
tcagatagtcaccag

SEQ ID NO: 400734 - DNA, 15 bp, Homo sapiens
cagatagtcaccaga

SEQ ID NO: 400735 - DNA, 15 bp, Homo sapiens
agatagtcaccagag

SEQ ID NO: 400736 - DNA, 15 bp, Homo sapiens
gatagtcaccagagt

SEQ ID NO: 400737 - DNA, 15 bp, Homo sapiens
atagtcaccagagta

SEQ ID NO: 400738 - DNA, 15 bp, Homo sapiens
tagtcaccagagtag

SEQ ID NO: 400739 - DNA, 15 bp, Homo sapiens
agtcaccagagtagt

SEQ ID NO: 400740 - DNA, 15 bp, Homo sapiens
gtcaccagagtagtc

SEQ ID NO: 400741 - DNA, 15 bp, Homo sapiens
tcaccagagtagtca

SEQ ID NO: 400742 - DNA, 15 bp, Homo sapiens
caccagagtagtcat

SEQ ID NO: 400743 - DNA, 15 bp, Homo sapiens
accagagtagtcatc

SEQ ID NO: 400744 - DNA, 15 bp, Homo sapiens
ccagagtagtcatca

SEQ ID NO: 400745 - DNA, 15 bp, Homo sapiens
cagagtagtcatcaa

SEQ ID NO: 400746 - DNA, 15 bp, Homo sapiens
agagtagtcatcaaa

SEQ ID NO: 400747 - DNA, 15 bp, Homo sapiens
gagtagtcatcaaaa

SEQ ID NO: 400748 - DNA, 15 bp, Homo sapiens
agtagtcatcaaaag

SEQ ID NO: 400749 - DNA, 15 bp, Homo sapiens
gtagtcatcaaaagg

SEQ ID NO: 400750 - DNA, 15 bp, Homo sapiens
tagtcatcaaaagga

SEQ ID NO: 400751 - DNA, 15 bp, Homo sapiens
agtcatcaaaaggaa

SEQ ID NO: 400752 - DNA, 15 bp, Homo sapiens
gtcatcaaaaggaaa

SEQ ID NO: 400753 - DNA, 15 bp, Homo sapiens
tcatcaaaaggaaaa

SEQ ID NO: 400754 - DNA, 15 bp, Homo sapiens
catcaaaaggaaaag

SEQ ID NO: 400755 - DNA, 15 bp, Homo sapiens
atcaaaaggaaaagc

SEQ ID NO: 400756 - DNA, 15 bp, Homo sapiens
tcaaaaggaaaagca

SEQ ID NO: 400757 - DNA, 15 bp, Homo sapiens
caaaaggaaaagcaa

SEQ ID NO: 400758 - DNA, 15 bp, Homo sapiens
aaaaggaaaagcaat

SEQ ID NO: 400759 - DNA, 15 bp, Homo sapiens
aaaggaaaagcaatc

SEQ ID NO: 400760 - DNA, 15 bp, Homo sapiens
aaggaaaagcaatct

SEQ ID NO: 400761 - DNA, 15 bp, Homo sapiens
aggaaaagcaatcta

SEQ ID NO: 400762 - DNA, 15 bp, Homo sapiens
ggaaaagcaatctaa

SEQ ID NO: 400763 - DNA, 15 bp, Homo sapiens
gaaaagcaatctaag

SEQ ID NO: 400764 - DNA, 15 bp, Homo sapiens
aaaagcaatctaagt

SEQ ID NO: 400765 - DNA, 15 bp, Homo sapiens
aaagcaatctaagta

SEQ ID NO: 400766 - DNA, 15 bp, Homo sapiens
aagcaatctaagtac

SEQ ID NO: 400767 - DNA, 15 bp, Homo sapiens
agcaatctaagtacc

SEQ ID NO: 400768 - DNA, 15 bp, Homo sapiens
gcaatctaagtacca

SEQ ID NO: 400769 - DNA, 15 bp, Homo sapiens
caatctaagtaccat

SEQ ID NO: 400770 - DNA, 15 bp, Homo sapiens
aatctaagtaccatt

SEQ ID NO: 400771 - DNA, 15 bp, Homo sapiens
atctaagtaccattt

SEQ ID NO: 400772 - DNA, 15 bp, Homo sapiens
tctaagtaccattta

SEQ ID NO: 400773 - DNA, 15 bp, Homo sapiens
ctaagtaccatttaa

SEQ ID NO: 400774 - DNA, 15 bp, Homo sapiens
taagtaccatttaat

SEQ ID NO: 400775 - DNA, 15 bp, Homo sapiens
aagtaccatttaatg

SEQ ID NO: 400776 - DNA, 15 bp, Homo sapiens
agtaccatttaatgg

SEQ ID NO: 400777 - DNA, 15 bp, Homo sapiens
gtaccatttaatggg

SEQ ID NO: 400778 - DNA, 15 bp, Homo sapiens
taccatttaatgggc

SEQ ID NO: 400779 - DNA, 15 bp, Homo sapiens
accatttaatgggct

SEQ ID NO: 400780 - DNA, 15 bp, Homo sapiens
ccatttaatgggctg

SEQ ID NO: 400781 - DNA, 15 bp, Homo sapiens
catttaatgggctgc

SEQ ID NO: 400782 - DNA, 15 bp, Homo sapiens
atttaatgggctgca

SEQ ID NO: 400783 - DNA, 15 bp, Homo sapiens
tttaatgggctgcac

SEQ ID NO: 400784 - DNA, 15 bp, Homo sapiens
ttaatgggctgcact

SEQ ID NO: 400785 - DNA, 15 bp, Homo sapiens
taatgggctgcacta

SEQ ID NO: 400786 - DNA, 15 bp, Homo sapiens
aatgggctgcactac

SEQ ID NO: 400787 - DNA, 15 bp, Homo sapiens
atgggctgcactaca

SEQ ID NO: 400788 - DNA, 15 bp, Homo sapiens
tgggctgcactacac

SEQ ID NO: 400789 - DNA, 15 bp, Homo sapiens
gggctgcactacact

SEQ ID NO: 400790 - DNA, 15 bp, Homo sapiens
ggctgcactacacta

SEQ ID NO: 400791 - DNA, 15 bp, Homo sapiens
gctgcactacactaa

SEQ ID NO: 400792 - DNA, 15 bp, Homo sapiens
ctgcactacactaat

SEQ ID NO: 400793 - DNA, 15 bp, Homo sapiens
tgcactacactaata

SEQ ID NO: 400794 - DNA, 15 bp, Homo sapiens
gcactacactaatat

SEQ ID NO: 400795 - DNA, 15 bp, Homo sapiens
cactacactaatatt

SEQ ID NO: 400796 - DNA, 15 bp, Homo sapiens
actacactaatattc

SEQ ID NO: 400797 - DNA, 15 bp, Homo sapiens
ctacactaatattct

SEQ ID NO: 400798 - DNA, 15 bp, Homo sapiens
tacactaatattcta

SEQ ID NO: 400799 - DNA, 15 bp, Homo sapiens
acactaatattctat

SEQ ID NO: 400800 - DNA, 15 bp, Homo sapiens
cactaatattctatt

SEQ ID NO: 400801 - DNA, 15 bp, Homo sapiens
actaatattctattt

SEQ ID NO: 400802 - DNA, 15 bp, Homo sapiens
ctaatattctatttg

SEQ ID NO: 400803 - DNA, 15 bp, Homo sapiens
taatattctatttga

SEQ ID NO: 400804 - DNA, 15 bp, Homo sapiens
aatattctatttgat

SEQ ID NO: 400805 - DNA, 15 bp, Homo sapiens
atattctatttgatg

SEQ ID NO: 400806 - DNA, 15 bp, Homo sapiens
tattctatttgatga

SEQ ID NO: 400807 - DNA, 15 bp, Homo sapiens
attctatttgatgaa

SEQ ID NO: 400808 - DNA, 15 bp, Homo sapiens
ttctatttgatgaat

SEQ ID NO: 400809 - DNA, 15 bp, Homo sapiens
tctatttgatgaatt

SEQ ID NO: 400810 - DNA, 15 bp, Homo sapiens
ctatttgatgaatta

SEQ ID NO: 400811 - DNA, 15 bp, Homo sapiens
atttgatgaattaac

SEQ ID NO: 400812 - DNA, 15 bp, Homo sapiens
tttgatgaattaact

SEQ ID NO: 400813 - DNA, 15 bp, Homo sapiens
ttgatgaattaactg

SEQ ID NO: 400814 - DNA, 15 bp, Homo sapiens
tgatgaattaactgc

SEQ ID NO: 400815 - DNA, 15 bp, Homo sapiens
gatgaattaactgca

SEQ ID NO: 400816 - DNA, 15 bp, Homo sapiens
atgaattaactgcat

SEQ ID NO: 400817 - DNA, 15 bp, Homo sapiens
tgaattaactgcatg

SEQ ID NO: 400818 - DNA, 15 bp, Homo sapiens
gaattaactgcatgt

SEQ ID NO: 400819 - DNA, 15 bp, Homo sapiens
aattaactgcatgtt

SEQ ID NO: 400820 - DNA, 15 bp, Homo sapiens
attaactgcatgttt

SEQ ID NO: 400821 - DNA, 15 bp, Homo sapiens
ttaactgcatgtttt

SEQ ID NO: 400822 - DNA, 15 bp, Homo sapiens
taactgcatgttttt

SEQ ID NO: 400823 - DNA, 15 bp, Homo sapiens
aactgcatgttttta

SEQ ID NO: 400824 - DNA, 15 bp, Homo sapiens
actgcatgtttttag

SEQ ID NO: 400825 - DNA, 15 bp, Homo sapiens
ctgcatgtttttagt

SEQ ID NO: 400826 - DNA, 15 bp, Homo sapiens
tgcatgtttttagtt

SEQ ID NO: 400827 - DNA, 15 bp, Homo sapiens
gcatgtttttagtta

SEQ ID NO: 400828 - DNA, 15 bp, Homo sapiens
catgtttttagttat

SEQ ID NO: 400829 - DNA, 15 bp, Homo sapiens
atgtttttagttatc

SEQ ID NO: 400830 - DNA, 15 bp, Homo sapiens
tgtttttagttatct

SEQ ID NO: 400831 - DNA, 15 bp, Homo sapiens
gtttttagttatctg

SEQ ID NO: 400832 - DNA, 15 bp, Homo sapiens
tttttagttatctgt

SEQ ID NO: 400833 - DNA, 15 bp, Homo sapiens
ttttagttatctgtt

SEQ ID NO: 400834 - DNA, 15 bp, Homo sapiens
tttagttatctgtta

SEQ ID NO: 400835 - DNA, 15 bp, Homo sapiens
ttagttatctgttag

SEQ ID NO: 400836 - DNA, 15 bp, Homo sapiens
tagttatctgttaga

SEQ ID NO: 400837 - DNA, 15 bp, Homo sapiens
agttatctgttagac

SEQ ID NO: 400838 - DNA, 15 bp, Homo sapiens
gttatctgttagact

SEQ ID NO: 400839 - DNA, 15 bp, Homo sapiens
ttatctgttagacta

SEQ ID NO: 400840 - DNA, 15 bp, Homo sapiens
tatctgttagactag

SEQ ID NO: 400841 - DNA, 15 bp, Homo sapiens
atctgttagactagt

SEQ ID NO: 400842 - DNA, 15 bp, Homo sapiens
tctgttagactagtt

SEQ ID NO: 400843 - DNA, 15 bp, Homo sapiens
ctgttagactagttt

SEQ ID NO: 400844 - DNA, 15 bp, Homo sapiens
tgttagactagtttt

SEQ ID NO: 400845 - DNA, 15 bp, Homo sapiens
gttagactagttttc

SEQ ID NO: 400846 - DNA, 15 bp, Homo sapiens
ttagactagttttca

SEQ ID NO: 400847 - DNA, 15 bp, Homo sapiens
tagactagttttcat

SEQ ID NO: 400848 - DNA, 15 bp, Homo sapiens
agactagttttcatt

SEQ ID NO: 400849 - DNA, 15 bp, Homo sapiens
gactagttttcattc

SEQ ID NO: 400850 - DNA, 15 bp, Homo sapiens
actagttttcattct

SEQ ID NO: 400851 - DNA, 15 bp, Homo sapiens
ctagttttcattctt

SEQ ID NO: 400852 - DNA, 15 bp, Homo sapiens
tagttttcattcttt

SEQ ID NO: 400853 - DNA, 15 bp, Homo sapiens
agttttcattctttt

SEQ ID NO: 400854 - DNA, 15 bp, Homo sapiens
gttttcattcttttc

SEQ ID NO: 400855 - DNA, 15 bp, Homo sapiens
ttttcattcttttcc

SEQ ID NO: 400856 - DNA, 15 bp, Homo sapiens
tttcattcttttcct

SEQ ID NO: 400857 - DNA, 15 bp, Homo sapiens
ttcattcttttcctt

SEQ ID NO: 400858 - DNA, 15 bp, Homo sapiens
tcattcttttccttc

SEQ ID NO: 400859 - DNA, 15 bp, Homo sapiens
cattcttttccttcc

SEQ ID NO: 400860 - DNA, 15 bp, Homo sapiens
attcttttccttccc

SEQ ID NO: 400861 - DNA, 15 bp, Homo sapiens
ttcttttccttccct

SEQ ID NO: 400862 - DNA, 15 bp, Homo sapiens
tcttttccttccctt

SEQ ID NO: 400863 - DNA, 15 bp, Homo sapiens
cttttccttcccttc

SEQ ID NO: 400864 - DNA, 15 bp, Homo sapiens
ttttccttcccttcg

SEQ ID NO: 400865 - DNA, 15 bp, Homo sapiens
tttccttcccttcgg

SEQ ID NO: 400866 - DNA, 15 bp, Homo sapiens
ttccttcccttcggt

SEQ ID NO: 400867 - DNA, 15 bp, Homo sapiens
tccttcccttcggta

SEQ ID NO: 400868 - DNA, 15 bp, Homo sapiens
ccttcccttcggtat

SEQ ID NO: 400869 - DNA, 15 bp, Homo sapiens
cttcccttcggtatg

SEQ ID NO: 400870 - DNA, 15 bp, Homo sapiens
ttcccttcggtatga

SEQ ID NO: 400871 - DNA, 15 bp, Homo sapiens
tcccttcggtatgat

SEQ ID NO: 400872 - DNA, 15 bp, Homo sapiens
cccttcggtatgata

SEQ ID NO: 400873 - DNA, 15 bp, Homo sapiens
ccttcggtatgataa

SEQ ID NO: 400874 - DNA, 15 bp, Homo sapiens
cttcggtatgataaa

SEQ ID NO: 400875 - DNA, 15 bp, Homo sapiens
ttcggtatgataaat

SEQ ID NO: 400876 - DNA, 15 bp, Homo sapiens
tcggtatgataaatt

SEQ ID NO: 400877 - DNA, 15 bp, Homo sapiens
cggtatgataaattc

SEQ ID NO: 400878 - DNA, 15 bp, Homo sapiens
ggtatgataaattct

SEQ ID NO: 400879 - DNA, 15 bp, Homo sapiens
gtatgataaattctt

SEQ ID NO: 400880 - DNA, 15 bp, Homo sapiens
tatgataaattcttt

SEQ ID NO: 400881 - DNA, 15 bp, Homo sapiens
atgataaattctttt

SEQ ID NO: 400882 - DNA, 15 bp, Homo sapiens
tgataaattctttta

SEQ ID NO: 400883 - DNA, 15 bp, Homo sapiens
gataaattcttttaa

SEQ ID NO: 400884 - DNA, 15 bp, Homo sapiens
ataaattcttttaaa

SEQ ID NO: 400885 - DNA, 15 bp, Homo sapiens
taaattcttttaaaa

SEQ ID NO: 400886 - DNA, 15 bp, Homo sapiens
aaattcttttaaaat

SEQ ID NO: 400887 - DNA, 15 bp, Homo sapiens
aattcttttaaaatg

SEQ ID NO: 400888 - DNA, 15 bp, Homo sapiens
attcttttaaaatgg

SEQ ID NO: 400889 - DNA, 15 bp, Homo sapiens
ttcttttaaaatggt

SEQ ID NO: 400890 - DNA, 15 bp, Homo sapiens
tcttttaaaatggtt

SEQ ID NO: 400891 - DNA, 15 bp, Homo sapiens
cttttaaaatggttt

SEQ ID NO: 400892 - DNA, 15 bp, Homo sapiens
ttttaaaatggtttt

SEQ ID NO: 400893 - DNA, 15 bp, Homo sapiens
tttaaaatggtttta

SEQ ID NO: 400894 - DNA, 15 bp, Homo sapiens
ttaaaatggttttat

SEQ ID NO: 400895 - DNA, 15 bp, Homo sapiens
taaaatggttttatt

SEQ ID NO: 400896 - DNA, 15 bp, Homo sapiens
aaaatggttttattc

SEQ ID NO: 400897 - DNA, 15 bp, Homo sapiens
aaatggttttattca

SEQ ID NO: 400898 - DNA, 15 bp, Homo sapiens
aatggttttattcaa

SEQ ID NO: 400899 - DNA, 15 bp, Homo sapiens
atggttttattcaat

SEQ ID NO: 400900 - DNA, 15 bp, Homo sapiens
tggttttattcaatc

SEQ ID NO: 400901 - DNA, 15 bp, Homo sapiens
ggttttattcaatcc

SEQ ID NO: 400902 - DNA, 15 bp, Homo sapiens
gttttattcaatccc

SEQ ID NO: 400903 - DNA, 15 bp, Homo sapiens
ttttattcaatccca

SEQ ID NO: 400904 - DNA, 15 bp, Homo sapiens
tttattcaatcccag

SEQ ID NO: 400905 - DNA, 15 bp, Homo sapiens
ttattcaatcccagg

SEQ ID NO: 400906 - DNA, 15 bp, Homo sapiens
tattcaatcccagga

SEQ ID NO: 400907 - DNA, 15 bp, Homo sapiens
attcaatcccaggaa

SEQ ID NO: 400908 - DNA, 15 bp, Homo sapiens
ttcaatcccaggaaa

SEQ ID NO: 400909 - DNA, 15 bp, Homo sapiens
tcaatcccaggaaac

SEQ ID NO: 400910 - DNA, 15 bp, Homo sapiens
caatcccaggaaact

SEQ ID NO: 400911 - DNA, 15 bp, Homo sapiens
aatcccaggaaactg

SEQ ID NO: 400912 - DNA, 15 bp, Homo sapiens
atcccaggaaactga

SEQ ID NO: 400913 - DNA, 15 bp, Homo sapiens
tcccaggaaactgaa

SEQ ID NO: 400914 - DNA, 15 bp, Homo sapiens
cccaggaaactgaaa

SEQ ID NO: 400915 - DNA, 15 bp, Homo sapiens
ccaggaaactgaaaa

SEQ ID NO: 400916 - DNA, 15 bp, Homo sapiens
caggaaactgaaaat

SEQ ID NO: 400917 - DNA, 15 bp, Homo sapiens
aggaaactgaaaata

SEQ ID NO: 400918 - DNA, 15 bp, Homo sapiens
ggaaactgaaaatac

SEQ ID NO: 400919 - DNA, 15 bp, Homo sapiens
gaaactgaaaatact

SEQ ID NO: 400920 - DNA, 15 bp, Homo sapiens
aaactgaaaatactt

SEQ ID NO: 400921 - DNA, 15 bp, Homo sapiens
aactgaaaatacttg

SEQ ID NO: 400922 - DNA, 15 bp, Homo sapiens
actgaaaatacttga

SEQ ID NO: 400923 - DNA, 15 bp, Homo sapiens
ctgaaaatacttgaa

SEQ ID NO: 400924 - DNA, 15 bp, Homo sapiens
tgaaaatacttgaaa

SEQ ID NO: 400925 - DNA, 15 bp, Homo sapiens
gaaaatacttgaaaa

SEQ ID NO: 400926 - DNA, 15 bp, Homo sapiens
aaaatacttgaaaaa

SEQ ID NO: 400927 - DNA, 15 bp, Homo sapiens
aaatacttgaaaaaa

SEQ ID NO: 400928 - DNA, 15 bp, Homo sapiens
aatacttgaaaaaat

SEQ ID NO: 400929 - DNA, 15 bp, Homo sapiens
atacttgaaaaaata

SEQ ID NO: 400930 - DNA, 15 bp, Homo sapiens
tacttgaaaaaataa

SEQ ID NO: 400931 - DNA, 15 bp, Homo sapiens
acttgaaaaaataat

SEQ ID NO: 400932 - DNA, 15 bp, Homo sapiens
cttgaaaaaataata

SEQ ID NO: 400933 - DNA, 15 bp, Homo sapiens
ttgaaaaaataatat

SEQ ID NO: 400934 - DNA, 15 bp, Homo sapiens
tgaaaaaataatatt

SEQ ID NO: 400935 - DNA, 15 bp, Homo sapiens
gaaaaaataatattt

SEQ ID NO: 400936 - DNA, 15 bp, Homo sapiens
aaaaaataatatttt

SEQ ID NO: 400937 - DNA, 15 bp, Homo sapiens
aaaaataatattttg

SEQ ID NO: 400938 - DNA, 15 bp, Homo sapiens
aaaataatattttgc

SEQ ID NO: 400939 - DNA, 15 bp, Homo sapiens
aaataatattttgca

SEQ ID NO: 400940 - DNA, 15 bp, Homo sapiens
aataatattttgcaa

SEQ ID NO: 400941 - DNA, 15 bp, Homo sapiens
ataatattttgcaat

SEQ ID NO: 400942 - DNA, 15 bp, Homo sapiens
taatattttgcaatt

SEQ ID NO: 400943 - DNA, 15 bp, Homo sapiens
aatattttgcaattt

SEQ ID NO: 400944 - DNA, 15 bp, Homo sapiens
atattttgcaatttg

SEQ ID NO: 400945 - DNA, 15 bp, Homo sapiens
tattttgcaatttgt

SEQ ID NO: 400946 - DNA, 15 bp, Homo sapiens
attttgcaatttgtc

SEQ ID NO: 400947 - DNA, 15 bp, Homo sapiens
ttttgcaatttgtca

SEQ ID NO: 400948 - DNA, 15 bp, Homo sapiens
tttgcaatttgtcag

SEQ ID NO: 400949 - DNA, 15 bp, Homo sapiens
ttgcaatttgtcaga

SEQ ID NO: 400950 - DNA, 15 bp, Homo sapiens
tgcaatttgtcagaa

SEQ ID NO: 400951 - DNA, 15 bp, Homo sapiens
gcaatttgtcagaaa

SEQ ID NO: 400952 - DNA, 15 bp, Homo sapiens
caatttgtcagaaaa

SEQ ID NO: 400953 - DNA, 15 bp, Homo sapiens
aatttgtcagaaaat

SEQ ID NO: 400954 - DNA, 15 bp, Homo sapiens
atttgtcagaaaata

SEQ ID NO: 400955 - DNA, 15 bp, Homo sapiens
tttgtcagaaaatat

SEQ ID NO: 400956 - DNA, 15 bp, Homo sapiens
ttgtcagaaaatatt

SEQ ID NO: 400957 - DNA, 15 bp, Homo sapiens
tgtcagaaaatattt

SEQ ID NO: 400958 - DNA, 15 bp, Homo sapiens
gtcagaaaatatttc

SEQ ID NO: 400959 - DNA, 15 bp, Homo sapiens
tcagaaaatatttcc

SEQ ID NO: 400960 - DNA, 15 bp, Homo sapiens
cagaaaatatttcct

SEQ ID NO: 400961 - DNA, 15 bp, Homo sapiens
agaaaatatttcctc

SEQ ID NO: 400962 - DNA, 15 bp, Homo sapiens
gaaaatatttcctca

SEQ ID NO: 400963 - DNA, 15 bp, Homo sapiens
aaatatttcctcact

SEQ ID NO: 400964 - DNA, 15 bp, Homo sapiens
aatatttcctcacta

SEQ ID NO: 400965 - DNA, 15 bp, Homo sapiens
atatttcctcactac

SEQ ID NO: 400966 - DNA, 15 bp, Homo sapiens
tatttcctcactact

SEQ ID NO: 400967 - DNA, 15 bp, Homo sapiens
atttcctcactactt

SEQ ID NO: 400968 - DNA, 15 bp, Homo sapiens
tttcctcactacttg

SEQ ID NO: 400969 - DNA, 15 bp, Homo sapiens
ttcctcactacttga

SEQ ID NO: 400970 - DNA, 15 bp, Homo sapiens
tcctcactacttgac

SEQ ID NO: 400971 - DNA, 15 bp, Homo sapiens
cctcactacttgact

SEQ ID NO: 400972 - DNA, 15 bp, Homo sapiens
ctcactacttgactg

SEQ ID NO: 400973 - DNA, 15 bp, Homo sapiens
tcactacttgactgg

SEQ ID NO: 400974 - DNA, 15 bp, Homo sapiens
cactacttgactggt

SEQ ID NO: 400975 - DNA, 15 bp, Homo sapiens
actacttgactggta

SEQ ID NO: 400976 - DNA, 15 bp, Homo sapiens
ctacttgactggtaa

SEQ ID NO: 400977 - DNA, 15 bp, Homo sapiens
tacttgactggtaat

SEQ ID NO: 400978 - DNA, 15 bp, Homo sapiens
acttgactggtaatc

SEQ ID NO: 400979 - DNA, 15 bp, Homo sapiens
cttgactggtaatct

SEQ ID NO: 400980 - DNA, 15 bp, Homo sapiens
ttgactggtaatctc

SEQ ID NO: 400981 - DNA, 15 bp, Homo sapiens
tgactggtaatctca

SEQ ID NO: 400982 - DNA, 15 bp, Homo sapiens
gactggtaatctcaa

SEQ ID NO: 400983 - DNA, 15 bp, Homo sapiens
actggtaatctcaag

SEQ ID NO: 400984 - DNA, 15 bp, Homo sapiens
ctggtaatctcaagc

SEQ ID NO: 400985 - DNA, 15 bp, Homo sapiens
tggtaatctcaagca

SEQ ID NO: 400986 - DNA, 15 bp, Homo sapiens
ggtaatctcaagcat

SEQ ID NO: 400987 - DNA, 15 bp, Homo sapiens
gtaatctcaagcatg

SEQ ID NO: 400988 - DNA, 15 bp, Homo sapiens
taatctcaagcatga

SEQ ID NO: 400989 - DNA, 15 bp, Homo sapiens
aatctcaagcatgat

SEQ ID NO: 400990 - DNA, 15 bp, Homo sapiens
atctcaagcatgatt

SEQ ID NO: 400991 - DNA, 15 bp, Homo sapiens
tctcaagcatgatta

SEQ ID NO: 400992 - DNA, 15 bp, Homo sapiens
ctcaagcatgattag

SEQ ID NO: 400993 - DNA, 15 bp, Homo sapiens
tcaagcatgattagt

SEQ ID NO: 400994 - DNA, 15 bp, Homo sapiens
caagcatgattagta

SEQ ID NO: 400995 - DNA, 15 bp, Homo sapiens
aagcatgattagtat

SEQ ID NO: 400996 - DNA, 15 bp, Homo sapiens
agcatgattagtata

SEQ ID NO: 400997 - DNA, 15 bp, Homo sapiens
gcatgattagtatag

SEQ ID NO: 400998 - DNA, 15 bp, Homo sapiens
catgattagtatagt

SEQ ID NO: 400999 - DNA, 15 bp, Homo sapiens
atgattagtatagtg

SEQ ID NO: 401000 - DNA, 15 bp, Homo sapiens
tgattagtatagtgt

SEQ ID NO: 401001 - DNA, 15 bp, Homo sapiens
gattagtatagtgtt

SEQ ID NO: 401002 - DNA, 15 bp, Homo sapiens
attagtatagtgttt

SEQ ID NO: 401003 - DNA, 15 bp, Homo sapiens
ttagtatagtgtttc

SEQ ID NO: 401004 - DNA, 15 bp, Homo sapiens
tagtatagtgtttcc

SEQ ID NO: 401005 - DNA, 15 bp, Homo sapiens
agtatagtgtttcct

SEQ ID NO: 401006 - DNA, 15 bp, Homo sapiens
gtatagtgtttccta

SEQ ID NO: 401007 - DNA, 15 bp, Homo sapiens
tatagtgtttcctat

SEQ ID NO: 401008 - DNA, 15 bp, Homo sapiens
atagtgtttcctatg

SEQ ID NO: 401009 - DNA, 15 bp, Homo sapiens
tagtgtttcctatga

SEQ ID NO: 401010 - DNA, 15 bp, Homo sapiens
agtgtttcctatgag

SEQ ID NO: 401011 - DNA, 15 bp, Homo sapiens
gtgtttcctatgagc

SEQ ID NO: 401012 - DNA, 15 bp, Homo sapiens
tgtttcctatgagct

SEQ ID NO: 401013 - DNA, 15 bp, Homo sapiens
gtttcctatgagcta

SEQ ID NO: 401014 - DNA, 15 bp, Homo sapiens
tttcctatgagctag

SEQ ID NO: 401015 - DNA, 15 bp, Homo sapiens
ttcctatgagctaga

SEQ ID NO: 401016 - DNA, 15 bp, Homo sapiens
tcctatgagctagaa

SEQ ID NO: 401017 - DNA, 15 bp, Homo sapiens
cctatgagctagaag

SEQ ID NO: 401018 - DNA, 15 bp, Homo sapiens
ctatgagctagaagg

SEQ ID NO: 401019 - DNA, 15 bp, Homo sapiens
tatgagctagaaggt

SEQ ID NO: 401020 - DNA, 15 bp, Homo sapiens
atgagctagaaggtt

SEQ ID NO: 401021 - DNA, 15 bp, Homo sapiens
tgagctagaaggttt

SEQ ID NO: 401022 - DNA, 15 bp, Homo sapiens
gagctagaaggtttt

SEQ ID NO: 401023 - DNA, 15 bp, Homo sapiens
agctagaaggttttt

SEQ ID NO: 401024 - DNA, 15 bp, Homo sapiens
gctagaaggtttttg

SEQ ID NO: 401025 - DNA, 15 bp, Homo sapiens
ctagaaggtttttgg

SEQ ID NO: 401026 - DNA, 15 bp, Homo sapiens
tagaaggtttttgga

SEQ ID NO: 401027 - DNA, 15 bp, Homo sapiens
agaaggtttttggat

SEQ ID NO: 401028 - DNA, 15 bp, Homo sapiens
gaaggtttttggatt

SEQ ID NO: 401029 - DNA, 15 bp, Homo sapiens
aaggtttttggatta

SEQ ID NO: 401030 - DNA, 15 bp, Homo sapiens
aggtttttggattag

SEQ ID NO: 401031 - DNA, 15 bp, Homo sapiens
ggtttttggattaga

SEQ ID NO: 401032 - DNA, 15 bp, Homo sapiens
gtttttggattagat

SEQ ID NO: 401033 - DNA, 15 bp, Homo sapiens
tttttggattagatg

SEQ ID NO: 401034 - DNA, 15 bp, Homo sapiens
tcttttttcacttag

SEQ ID NO: 401035 - DNA, 15 bp, Homo sapiens
cttttttcacttagg

SEQ ID NO: 401036 - DNA, 15 bp, Homo sapiens
ttttttcacttagga

SEQ ID NO: 401037 - DNA, 15 bp, Homo sapiens
tttttcacttaggat

SEQ ID NO: 401038 - DNA, 15 bp, Homo sapiens
ttttcacttaggatc

SEQ ID NO: 401039 - DNA, 15 bp, Homo sapiens
tttcacttaggatca

SEQ ID NO: 401040 - DNA, 15 bp, Homo sapiens
ttcacttaggatcat

SEQ ID NO: 401041 - DNA, 15 bp, Homo sapiens
tcacttaggatcatg

SEQ ID NO: 401042 - DNA, 15 bp, Homo sapiens
cacttaggatcatgt

SEQ ID NO: 401043 - DNA, 15 bp, Homo sapiens
acttaggatcatgtg

SEQ ID NO: 401044 - DNA, 15 bp, Homo sapiens
cttaggatcatgtgt

SEQ ID NO: 401045 - DNA, 15 bp, Homo sapiens
ttaggatcatgtgtt

SEQ ID NO: 401046 - DNA, 15 bp, Homo sapiens
taggatcatgtgttt

SEQ ID NO: 401047 - DNA, 15 bp, Homo sapiens
aggatcatgtgttta

SEQ ID NO: 401048 - DNA, 15 bp, Homo sapiens
ggatcatgtgtttaa

SEQ ID NO: 401049 - DNA, 15 bp, Homo sapiens
gatcatgtgtttaag

SEQ ID NO: 401050 - DNA, 15 bp, Homo sapiens
atcatgtgtttaagg

SEQ ID NO: 401051 - DNA, 15 bp, Homo sapiens
tcatgtgtttaaggt

SEQ ID NO: 401052 - DNA, 15 bp, Homo sapiens
catgtgtttaaggtt

SEQ ID NO: 401053 - DNA, 15 bp, Homo sapiens
atgtgtttaaggttt

SEQ ID NO: 401054 - DNA, 15 bp, Homo sapiens
tgtgtttaaggtttg

SEQ ID NO: 401055 - DNA, 15 bp, Homo sapiens
gtgtttaaggtttgt

SEQ ID NO: 401056 - DNA, 15 bp, Homo sapiens
tgtttaaggtttgtt

SEQ ID NO: 401057 - DNA, 15 bp, Homo sapiens
gtttaaggtttgttc

SEQ ID NO: 401058 - DNA, 15 bp, Homo sapiens
tttaaggtttgttca

SEQ ID NO: 401059 - DNA, 15 bp, Homo sapiens
ttaaggtttgttcat

SEQ ID NO: 401060 - DNA, 15 bp, Homo sapiens
taaggtttgttcatg

SEQ ID NO: 401061 - DNA, 15 bp, Homo sapiens
aaggtttgttcatgt

SEQ ID NO: 401062 - DNA, 15 bp, Homo sapiens
aggtttgttcatgtt

SEQ ID NO: 401063 - DNA, 15 bp, Homo sapiens
ggtttgttcatgttg

SEQ ID NO: 401064 - DNA, 15 bp, Homo sapiens
gtttgttcatgttgt

SEQ ID NO: 401065 - DNA, 15 bp, Homo sapiens
tttgttcatgttgta

SEQ ID NO: 401066 - DNA, 15 bp, Homo sapiens
ttgttcatgttgtag

SEQ ID NO: 401067 - DNA, 15 bp, Homo sapiens
tgttcatgttgtagc

SEQ ID NO: 401068 - DNA, 15 bp, Homo sapiens
gttcatgttgtagct

SEQ ID NO: 401069 - DNA, 15 bp, Homo sapiens
ttcatgttgtagctt

SEQ ID NO: 401070 - DNA, 15 bp, Homo sapiens
tcatgttgtagcttt

SEQ ID NO: 401071 - DNA, 15 bp, Homo sapiens
catgttgtagctttt

SEQ ID NO: 401072 - DNA, 15 bp, Homo sapiens
atgttgtagcttttg

SEQ ID NO: 401073 - DNA, 15 bp, Homo sapiens
tgttgtagcttttgt

SEQ ID NO: 401074 - DNA, 15 bp, Homo sapiens
gttgtagcttttgtg

SEQ ID NO: 401075 - DNA, 15 bp, Homo sapiens
ttgtagcttttgtgg

SEQ ID NO: 401076 - DNA, 15 bp, Homo sapiens
tgtagcttttgtggt

SEQ ID NO: 401077 - DNA, 15 bp, Homo sapiens
gtagcttttgtggta

SEQ ID NO: 401078 - DNA, 15 bp, Homo sapiens
tagcttttgtggtac

SEQ ID NO: 401079 - DNA, 15 bp, Homo sapiens
agcttttgtggtact

SEQ ID NO: 401080 - DNA, 15 bp, Homo sapiens
gcttttgtggtactt

SEQ ID NO: 401081 - DNA, 15 bp, Homo sapiens
cttttgtggtacttt

SEQ ID NO: 401082 - DNA, 15 bp, Homo sapiens
ttttgtggtactttc

SEQ ID NO: 401083 - DNA, 15 bp, Homo sapiens
tttgtggtactttcc

SEQ ID NO: 401084 - DNA, 15 bp, Homo sapiens
ttgtggtactttcct

SEQ ID NO: 401085 - DNA, 15 bp, Homo sapiens
tgtggtactttcctt

SEQ ID NO: 401086 - DNA, 15 bp, Homo sapiens
gtggtactttccttt

SEQ ID NO: 401087 - DNA, 15 bp, Homo sapiens
tggtactttcctttc

SEQ ID NO: 401088 - DNA, 15 bp, Homo sapiens
ggtactttcctttct

SEQ ID NO: 401089 - DNA, 15 bp, Homo sapiens
gtactttcctttctc

SEQ ID NO: 401090 - DNA, 15 bp, Homo sapiens
tactttcctttctct

SEQ ID NO: 401091 - DNA, 15 bp, Homo sapiens
actttcctttctctt

SEQ ID NO: 401092 - DNA, 15 bp, Homo sapiens
ctttcctttctcttc

SEQ ID NO: 401093 - DNA, 15 bp, Homo sapiens
ttcctttctcttcat

SEQ ID NO: 401094 - DNA, 15 bp, Homo sapiens
tcctttctcttcatt

SEQ ID NO: 401095 - DNA, 15 bp, Homo sapiens
cctttctcttcattg

SEQ ID NO: 401096 - DNA, 15 bp, Homo sapiens
ctttctcttcattga

SEQ ID NO: 401097 - DNA, 15 bp, Homo sapiens
tttctcttcattgat

SEQ ID NO: 401098 - DNA, 15 bp, Homo sapiens
ttctcttcattgata

SEQ ID NO: 401099 - DNA, 15 bp, Homo sapiens
tctcttcattgataa

SEQ ID NO: 401100 - DNA, 15 bp, Homo sapiens
ctcttcattgataaa

SEQ ID NO: 401101 - DNA, 15 bp, Homo sapiens
tcttcattgataaat

SEQ ID NO: 401102 - DNA, 15 bp, Homo sapiens
cttcattgataaata

SEQ ID NO: 401103 - DNA, 15 bp, Homo sapiens
ttcattgataaataa

SEQ ID NO: 401104 - DNA, 15 bp, Homo sapiens
tcattgataaataat

SEQ ID NO: 401105 - DNA, 15 bp, Homo sapiens
cattgataaataata

SEQ ID NO: 401106 - DNA, 15 bp, Homo sapiens
attgataaataatat

SEQ ID NO: 401107 - DNA, 15 bp, Homo sapiens
ttgataaataatatt

SEQ ID NO: 401108 - DNA, 15 bp, Homo sapiens
tgataaataatattc

SEQ ID NO: 401109 - DNA, 15 bp, Homo sapiens
gataaataatattcc

SEQ ID NO: 401110 - DNA, 15 bp, Homo sapiens
ataaataatattcca

SEQ ID NO: 401111 - DNA, 15 bp, Homo sapiens
taaataatattccac

SEQ ID NO: 401112 - DNA, 15 bp, Homo sapiens
aaataatattccact

SEQ ID NO: 401113 - DNA, 15 bp, Homo sapiens
aataatattccactg

SEQ ID NO: 401114 - DNA, 15 bp, Homo sapiens
ataatattccactgt

SEQ ID NO: 401115 - DNA, 15 bp, Homo sapiens
taatattccactgtg

SEQ ID NO: 401116 - DNA, 15 bp, Homo sapiens
aatattccactgtgt

SEQ ID NO: 401117 - DNA, 15 bp, Homo sapiens
atattccactgtgtg

SEQ ID NO: 401118 - DNA, 15 bp, Homo sapiens
tattccactgtgtgg

SEQ ID NO: 401119 - DNA, 15 bp, Homo sapiens
attccactgtgtgga

SEQ ID NO: 401120 - DNA, 15 bp, Homo sapiens
ttccactgtgtggat

SEQ ID NO: 401121 - DNA, 15 bp, Homo sapiens
tccactgtgtggata

SEQ ID NO: 401122 - DNA, 15 bp, Homo sapiens
ccactgtgtggatag

SEQ ID NO: 401123 - DNA, 15 bp, Homo sapiens
cactgtgtggatagg

SEQ ID NO: 401124 - DNA, 15 bp, Homo sapiens
actgtgtggataggc

SEQ ID NO: 401125 - DNA, 15 bp, Homo sapiens
ctgtgtggataggct

SEQ ID NO: 401126 - DNA, 15 bp, Homo sapiens
tgtgtggataggcta

SEQ ID NO: 401127 - DNA, 15 bp, Homo sapiens
gtgtggataggctac

SEQ ID NO: 401128 - DNA, 15 bp, Homo sapiens
tgtggataggctaca

SEQ ID NO: 401129 - DNA, 15 bp, Homo sapiens
gtggataggctacat

SEQ ID NO: 401130 - DNA, 15 bp, Homo sapiens
tggataggctacatt

SEQ ID NO: 401131 - DNA, 15 bp, Homo sapiens
ggataggctacattt

SEQ ID NO: 401132 - DNA, 15 bp, Homo sapiens
gataggctacatttt

SEQ ID NO: 401133 - DNA, 15 bp, Homo sapiens
ataggctacattttg

SEQ ID NO: 401134 - DNA, 15 bp, Homo sapiens
taggctacattttgt

SEQ ID NO: 401135 - DNA, 15 bp, Homo sapiens
aggctacattttgtt

SEQ ID NO: 401136 - DNA, 15 bp, Homo sapiens
ggctacattttgttt

SEQ ID NO: 401137 - DNA, 15 bp, Homo sapiens
gctacattttgtttg

SEQ ID NO: 401138 - DNA, 15 bp, Homo sapiens
ctacattttgtttgt

SEQ ID NO: 401139 - DNA, 15 bp, Homo sapiens
tacattttgtttgtc

SEQ ID NO: 401140 - DNA, 15 bp, Homo sapiens
acattttgtttgtcc

SEQ ID NO: 401141 - DNA, 15 bp, Homo sapiens
cattttgtttgtcca

SEQ ID NO: 401142 - DNA, 15 bp, Homo sapiens
attttgtttgtccac

SEQ ID NO: 401143 - DNA, 15 bp, Homo sapiens
ttttgtttgtccact

SEQ ID NO: 401144 - DNA, 15 bp, Homo sapiens
tttgtttgtccactc

SEQ ID NO: 401145 - DNA, 15 bp, Homo sapiens
ttgtttgtccactca

SEQ ID NO: 401146 - DNA, 15 bp, Homo sapiens
tgtttgtccactcat

SEQ ID NO: 401147 - DNA, 15 bp, Homo sapiens
gtttgtccactcatc

SEQ ID NO: 401148 - DNA, 15 bp, Homo sapiens
tttgtccactcatca

SEQ ID NO: 401149 - DNA, 15 bp, Homo sapiens
ttgtccactcatcag

SEQ ID NO: 401150 - DNA, 15 bp, Homo sapiens
tgtccactcatcagt

SEQ ID NO: 401151 - DNA, 15 bp, Homo sapiens
gtccactcatcagtc

SEQ ID NO: 401152 - DNA, 15 bp, Homo sapiens
tccactcatcagtcg

SEQ ID NO: 401153 - DNA, 15 bp, Homo sapiens
ccactcatcagtcga

SEQ ID NO: 401154 - DNA, 15 bp, Homo sapiens
cactcatcagtcgat

SEQ ID NO: 401155 - DNA, 15 bp, Homo sapiens
actcatcagtcgatg

SEQ ID NO: 401156 - DNA, 15 bp, Homo sapiens
ctcatcagtcgatgg

SEQ ID NO: 401157 - DNA, 15 bp, Homo sapiens
tcatcagtcgatggg

SEQ ID NO: 401158 - DNA, 15 bp, Homo sapiens
catcagtcgatgggc

SEQ ID NO: 401159 - DNA, 15 bp, Homo sapiens
atcagtcgatgggca

SEQ ID NO: 401160 - DNA, 15 bp, Homo sapiens
tcagtcgatgggcat

SEQ ID NO: 401161 - DNA, 15 bp, Homo sapiens
cagtcgatgggcatt

SEQ ID NO: 401162 - DNA, 15 bp, Homo sapiens
agtcgatgggcattt

SEQ ID NO: 401163 - DNA, 15 bp, Homo sapiens
gtcgatgggcatttg

SEQ ID NO: 401164 - DNA, 15 bp, Homo sapiens
gggcatttgggttgt

SEQ ID NO: 401165 - DNA, 15 bp, Homo sapiens
ggcatttgggttgtt

SEQ ID NO: 401166 - DNA, 15 bp, Homo sapiens
gcatttgggttgttt

SEQ ID NO: 401167 - DNA, 15 bp, Homo sapiens
catttgggttgtttc

SEQ ID NO: 401168 - DNA, 15 bp, Homo sapiens
atttgggttgtttcc

SEQ ID NO: 401169 - DNA, 15 bp, Homo sapiens
tttgggttgtttcca

SEQ ID NO: 401170 - DNA, 15 bp, Homo sapiens
ttgggttgtttccat

SEQ ID NO: 401171 - DNA, 15 bp, Homo sapiens
tgggttgtttccata

SEQ ID NO: 401172 - DNA, 15 bp, Homo sapiens
gggttgtttccatat

SEQ ID NO: 401173 - DNA, 15 bp, Homo sapiens
ggttgtttccatatt

SEQ ID NO: 401174 - DNA, 15 bp, Homo sapiens
gttgtttccatattt

SEQ ID NO: 401175 - DNA, 15 bp, Homo sapiens
ttgtttccatatttt

SEQ ID NO: 401176 - DNA, 15 bp, Homo sapiens
tgtttccatattttg

SEQ ID NO: 401177 - DNA, 15 bp, Homo sapiens
gtttccatattttgg

SEQ ID NO: 401178 - DNA, 15 bp, Homo sapiens
tttccatattttggc

SEQ ID NO: 401179 - DNA, 15 bp, Homo sapiens
ttccatattttggct

SEQ ID NO: 401180 - DNA, 15 bp, Homo sapiens
tccatattttggcta

SEQ ID NO: 401181 - DNA, 15 bp, Homo sapiens
ccatattttggctat

SEQ ID NO: 401182 - DNA, 15 bp, Homo sapiens
catattttggctatt

SEQ ID NO: 401183 - DNA, 15 bp, Homo sapiens
atattttggctattc

SEQ ID NO: 401184 - DNA, 15 bp, Homo sapiens
tattttggctattcc

SEQ ID NO: 401185 - DNA, 15 bp, Homo sapiens
attttggctattccg

SEQ ID NO: 401186 - DNA, 15 bp, Homo sapiens
ttttggctattccga

SEQ ID NO: 401187 - DNA, 15 bp, Homo sapiens
tttggctattccgaa

SEQ ID NO: 401188 - DNA, 15 bp, Homo sapiens
ttggctattccgaat

SEQ ID NO: 401189 - DNA, 15 bp, Homo sapiens
tggctattccgaata

SEQ ID NO: 401190 - DNA, 15 bp, Homo sapiens
ggctattccgaataa

SEQ ID NO: 401191 - DNA, 15 bp, Homo sapiens
gctattccgaataat

SEQ ID NO: 401192 - DNA, 15 bp, Homo sapiens
ctattccgaataatg

SEQ ID NO: 401193 - DNA, 15 bp, Homo sapiens
tattccgaataatgc

SEQ ID NO: 401194 - DNA, 15 bp, Homo sapiens
attccgaataatgct

SEQ ID NO: 401195 - DNA, 15 bp, Homo sapiens
ttccgaataatgctg

SEQ ID NO: 401196 - DNA, 15 bp, Homo sapiens
tccgaataatgctgc

SEQ ID NO: 401197 - DNA, 15 bp, Homo sapiens
ccgaataatgctgct

SEQ ID NO: 401198 - DNA, 15 bp, Homo sapiens
cgaataatgctgcta

SEQ ID NO: 401199 - DNA, 15 bp, Homo sapiens
ctgctatgaacattt

SEQ ID NO: 401200 - DNA, 15 bp, Homo sapiens
tgctatgaacattta

SEQ ID NO: 401201 - DNA, 15 bp, Homo sapiens
gctatgaacatttat

SEQ ID NO: 401202 - DNA, 15 bp, Homo sapiens
ctatgaacatttatg

SEQ ID NO: 401203 - DNA, 15 bp, Homo sapiens
tatgaacatttatgt

SEQ ID NO: 401204 - DNA, 15 bp, Homo sapiens
atgaacatttatgtg

SEQ ID NO: 401205 - DNA, 15 bp, Homo sapiens
tgaacatttatgtgc

SEQ ID NO: 401206 - DNA, 15 bp, Homo sapiens
gaacatttatgtgca

SEQ ID NO: 401207 - DNA, 15 bp, Homo sapiens
aacatttatgtgcaa

SEQ ID NO: 401208 - DNA, 15 bp, Homo sapiens
acatttatgtgcaag

SEQ ID NO: 401209 - DNA, 15 bp, Homo sapiens
catttatgtgcaagt

SEQ ID NO: 401210 - DNA, 15 bp, Homo sapiens
atttatgtgcaagtt

SEQ ID NO: 401211 - DNA, 15 bp, Homo sapiens
tttatgtgcaagttt

SEQ ID NO: 401212 - DNA, 15 bp, Homo sapiens
ttatgtgcaagtttt

SEQ ID NO: 401213 - DNA, 15 bp, Homo sapiens
tatgtgcaagttttt

SEQ ID NO: 401214 - DNA, 15 bp, Homo sapiens
atgtgcaagtttttg

SEQ ID NO: 401215 - DNA, 15 bp, Homo sapiens
tgtgcaagtttttgt

SEQ ID NO: 401216 - DNA, 15 bp, Homo sapiens
gtgcaagtttttgtg

SEQ ID NO: 401217 - DNA, 15 bp, Homo sapiens
tgcaagtttttgtgt

SEQ ID NO: 401218 - DNA, 15 bp, Homo sapiens
gcaagtttttgtgtg

SEQ ID NO: 401219 - DNA, 15 bp, Homo sapiens
caagtttttgtgtgg

SEQ ID NO: 401220 - DNA, 15 bp, Homo sapiens
aagtttttgtgtggt

SEQ ID NO: 401221 - DNA, 15 bp, Homo sapiens
agtttttgtgtggtt

SEQ ID NO: 401222 - DNA, 15 bp, Homo sapiens
gtttttgtgtggttt

SEQ ID NO: 401223 - DNA, 15 bp, Homo sapiens
tttttgtgtggtttt

SEQ ID NO: 401224 - DNA, 15 bp, Homo sapiens
ttttgtgtggtttta

SEQ ID NO: 401225 - DNA, 15 bp, Homo sapiens
tttgtgtggttttat

SEQ ID NO: 401226 - DNA, 15 bp, Homo sapiens
ttgtgtggttttatt

SEQ ID NO: 401227 - DNA, 15 bp, Homo sapiens
tgtgtggttttattc

SEQ ID NO: 401228 - DNA, 15 bp, Homo sapiens
gtgtggttttattcc

SEQ ID NO: 401229 - DNA, 15 bp, Homo sapiens
tgtggttttattcct

SEQ ID NO: 401230 - DNA, 15 bp, Homo sapiens
gtggttttattcctc

SEQ ID NO: 401231 - DNA, 15 bp, Homo sapiens
tggttttattcctct

SEQ ID NO: 401232 - DNA, 15 bp, Homo sapiens
ggttttattcctctt

SEQ ID NO: 401233 - DNA, 15 bp, Homo sapiens
gttttattcctcttg

SEQ ID NO: 401234 - DNA, 15 bp, Homo sapiens
ttttattcctcttga

SEQ ID NO: 401235 - DNA, 15 bp, Homo sapiens
tttattcctcttgag

SEQ ID NO: 401236 - DNA, 15 bp, Homo sapiens
ttattcctcttgagt

SEQ ID NO: 401237 - DNA, 15 bp, Homo sapiens
tattcctcttgagta

SEQ ID NO: 401238 - DNA, 15 bp, Homo sapiens
attcctcttgagtag

SEQ ID NO: 401239 - DNA, 15 bp, Homo sapiens
ttcctcttgagtaga

SEQ ID NO: 401240 - DNA, 15 bp, Homo sapiens
tcctcttgagtagaa

SEQ ID NO: 401241 - DNA, 15 bp, Homo sapiens
cctcttgagtagaac

SEQ ID NO: 401242 - DNA, 15 bp, Homo sapiens
ctcttgagtagaact

SEQ ID NO: 401243 - DNA, 15 bp, Homo sapiens
tcttgagtagaactg

SEQ ID NO: 401244 - DNA, 15 bp, Homo sapiens
cttgagtagaactgc

SEQ ID NO: 401245 - DNA, 15 bp, Homo sapiens
ttgagtagaactgct

SEQ ID NO: 401246 - DNA, 15 bp, Homo sapiens
tgagtagaactgcta

SEQ ID NO: 401247 - DNA, 15 bp, Homo sapiens
gagtagaactgctag

SEQ ID NO: 401248 - DNA, 15 bp, Homo sapiens
agtagaactgctagg

SEQ ID NO: 401249 - DNA, 15 bp, Homo sapiens
gtagaactgctaggc

SEQ ID NO: 401250 - DNA, 15 bp, Homo sapiens
tagaactgctaggcc

SEQ ID NO: 401251 - DNA, 15 bp, Homo sapiens
agaactgctaggcct

SEQ ID NO: 401252 - DNA, 15 bp, Homo sapiens
gaactgctaggcctg

SEQ ID NO: 401253 - DNA, 15 bp, Homo sapiens
aactgctaggcctgt

SEQ ID NO: 401254 - DNA, 15 bp, Homo sapiens
actgctaggcctgtt

SEQ ID NO: 401255 - DNA, 15 bp, Homo sapiens
ctgctaggcctgtta

SEQ ID NO: 401256 - DNA, 15 bp, Homo sapiens
tgctaggcctgttaa

SEQ ID NO: 401257 - DNA, 15 bp, Homo sapiens
gctaggcctgttaat

SEQ ID NO: 401258 - DNA, 15 bp, Homo sapiens
ctaggcctgttaata

SEQ ID NO: 401259 - DNA, 15 bp, Homo sapiens
taggcctgttaatat

SEQ ID NO: 401260 - DNA, 15 bp, Homo sapiens
aggcctgttaatatg

SEQ ID NO: 401261 - DNA, 15 bp, Homo sapiens
ggcctgttaatatgt

SEQ ID NO: 401262 - DNA, 15 bp, Homo sapiens
gcctgttaatatgtt

SEQ ID NO: 401263 - DNA, 15 bp, Homo sapiens
cctgttaatatgttt

SEQ ID NO: 401264 - DNA, 15 bp, Homo sapiens
ctgttaatatgtttt

SEQ ID NO: 401265 - DNA, 15 bp, Homo sapiens
tgttaatatgttttt

SEQ ID NO: 401266 - DNA, 15 bp, Homo sapiens
gttaatatgttttta

SEQ ID NO: 401267 - DNA, 15 bp, Homo sapiens
ttaatatgtttttag

SEQ ID NO: 401268 - DNA, 15 bp, Homo sapiens
taatatgtttttagt

SEQ ID NO: 401269 - DNA, 15 bp, Homo sapiens
aatatgtttttagtc

SEQ ID NO: 401270 - DNA, 15 bp, Homo sapiens
atatgtttttagtct

SEQ ID NO: 401271 - DNA, 15 bp, Homo sapiens
tatgtttttagtctt

SEQ ID NO: 401272 - DNA, 15 bp, Homo sapiens
atgtttttagtcttt

SEQ ID NO: 401273 - DNA, 15 bp, Homo sapiens
tgtttttagtctttt

SEQ ID NO: 401274 - DNA, 15 bp, Homo sapiens
gtttttagtcttttg

SEQ ID NO: 401275 - DNA, 15 bp, Homo sapiens
tttttagtcttttgt

SEQ ID NO: 401276 - DNA, 15 bp, Homo sapiens
ttttagtcttttgtg

SEQ ID NO: 401277 - DNA, 15 bp, Homo sapiens
tttagtcttttgtgt

SEQ ID NO: 401278 - DNA, 15 bp, Homo sapiens
ttagtcttttgtgta

SEQ ID NO: 401279 - DNA, 15 bp, Homo sapiens
tagtcttttgtgtat

SEQ ID NO: 401280 - DNA, 15 bp, Homo sapiens
agtcttttgtgtata

SEQ ID NO: 401281 - DNA, 15 bp, Homo sapiens
gtcttttgtgtatat

SEQ ID NO: 401282 - DNA, 15 bp, Homo sapiens
tcttttgtgtatata

SEQ ID NO: 401283 - DNA, 15 bp, Homo sapiens
cttttgtgtatatat

SEQ ID NO: 401284 - DNA, 15 bp, Homo sapiens
ttttgtgtatatatg

SEQ ID NO: 401285 - DNA, 15 bp, Homo sapiens
tttgtgtatatatgg

SEQ ID NO: 401286 - DNA, 15 bp, Homo sapiens
ttgtgtatatatggg

SEQ ID NO: 401287 - DNA, 15 bp, Homo sapiens
tgtgtatatatggga

SEQ ID NO: 401288 - DNA, 15 bp, Homo sapiens
gtgtatatatgggaa

SEQ ID NO: 401289 - DNA, 15 bp, Homo sapiens
tgtatatatgggaat

SEQ ID NO: 401290 - DNA, 15 bp, Homo sapiens
gtatatatgggaata

SEQ ID NO: 401291 - DNA, 15 bp, Homo sapiens
tatatatgggaatat

SEQ ID NO: 401292 - DNA, 15 bp, Homo sapiens
atatatgggaatatt

SEQ ID NO: 401293 - DNA, 15 bp, Homo sapiens
tatatgggaatattg

SEQ ID NO: 401294 - DNA, 15 bp, Homo sapiens
atatgggaatattgt

SEQ ID NO: 401295 - DNA, 15 bp, Homo sapiens
tatgggaatattgtc

SEQ ID NO: 401296 - DNA, 15 bp, Homo sapiens
atgggaatattgtca

SEQ ID NO: 401297 - DNA, 15 bp, Homo sapiens
tgggaatattgtcac

SEQ ID NO: 401298 - DNA, 15 bp, Homo sapiens
gggaatattgtcacc

SEQ ID NO: 401299 - DNA, 15 bp, Homo sapiens
ggaatattgtcacct

SEQ ID NO: 401300 - DNA, 15 bp, Homo sapiens
gaatattgtcaccta

SEQ ID NO: 401301 - DNA, 15 bp, Homo sapiens
aatattgtcacctag

SEQ ID NO: 401302 - DNA, 15 bp, Homo sapiens
atattgtcacctagt

SEQ ID NO: 401303 - DNA, 15 bp, Homo sapiens
tattgtcacctagta

SEQ ID NO: 401304 - DNA, 15 bp, Homo sapiens
attgtcacctagtat

SEQ ID NO: 401305 - DNA, 15 bp, Homo sapiens
ttgtcacctagtatg

SEQ ID NO: 401306 - DNA, 15 bp, Homo sapiens
tgtcacctagtatga

SEQ ID NO: 401307 - DNA, 15 bp, Homo sapiens
gtcacctagtatgaa

SEQ ID NO: 401308 - DNA, 15 bp, Homo sapiens
tcacctagtatgaaa

SEQ ID NO: 401309 - DNA, 15 bp, Homo sapiens
cacctagtatgaaat

SEQ ID NO: 401310 - DNA, 15 bp, Homo sapiens
acctagtatgaaatg

SEQ ID NO: 401311 - DNA, 15 bp, Homo sapiens
cctagtatgaaatgg

SEQ ID NO: 401312 - DNA, 15 bp, Homo sapiens
ctagtatgaaatggt

SEQ ID NO: 401313 - DNA, 15 bp, Homo sapiens
tagtatgaaatggtt

SEQ ID NO: 401314 - DNA, 15 bp, Homo sapiens
agtatgaaatggttt

SEQ ID NO: 401315 - DNA, 15 bp, Homo sapiens
gtatgaaatggtttt

SEQ ID NO: 401316 - DNA, 15 bp, Homo sapiens
tatgaaatggttttt

SEQ ID NO: 401317 - DNA, 15 bp, Homo sapiens
atgaaatggttttta

SEQ ID NO: 401318 - DNA, 15 bp, Homo sapiens
tgaaatggtttttaa

SEQ ID NO: 401319 - DNA, 15 bp, Homo sapiens
gaaatggtttttaaa

SEQ ID NO: 401320 - DNA, 15 bp, Homo sapiens
aaatggtttttaaag

SEQ ID NO: 401321 - DNA, 15 bp, Homo sapiens
aatggtttttaaagg

SEQ ID NO: 401322 - DNA, 15 bp, Homo sapiens
atggtttttaaaggc

SEQ ID NO: 401323 - DNA, 15 bp, Homo sapiens
tggtttttaaaggca

SEQ ID NO: 401324 - DNA, 15 bp, Homo sapiens
ggtttttaaaggcaa

SEQ ID NO: 401325 - DNA, 15 bp, Homo sapiens
gtttttaaaggcaat

SEQ ID NO: 401326 - DNA, 15 bp, Homo sapiens
tttttaaaggcaatc

SEQ ID NO: 401327 - DNA, 15 bp, Homo sapiens
ttttaaaggcaatca

SEQ ID NO: 401328 - DNA, 15 bp, Homo sapiens
tttaaaggcaatcaa

SEQ ID NO: 401329 - DNA, 15 bp, Homo sapiens
ttaaaggcaatcaac

SEQ ID NO: 401330 - DNA, 15 bp, Homo sapiens
taaaggcaatcaaca

SEQ ID NO: 401331 - DNA, 15 bp, Homo sapiens
aaaggcaatcaacaa

SEQ ID NO: 401332 - DNA, 15 bp, Homo sapiens
aaggcaatcaacaat

SEQ ID NO: 401333 - DNA, 15 bp, Homo sapiens
aggcaatcaacaatc

SEQ ID NO: 401334 - DNA, 15 bp, Homo sapiens
ggcaatcaacaatct

SEQ ID NO: 401335 - DNA, 15 bp, Homo sapiens
gcaatcaacaatcta

SEQ ID NO: 401336 - DNA, 15 bp, Homo sapiens
caatcaacaatctaa

SEQ ID NO: 401337 - DNA, 15 bp, Homo sapiens
aatcaacaatctaaa

SEQ ID NO: 401338 - DNA, 15 bp, Homo sapiens
atcaacaatctaaaa

SEQ ID NO: 401339 - DNA, 15 bp, Homo sapiens
tcaacaatctaaaac

SEQ ID NO: 401340 - DNA, 15 bp, Homo sapiens
caacaatctaaaacc

SEQ ID NO: 401341 - DNA, 15 bp, Homo sapiens
aacaatctaaaacct

SEQ ID NO: 401342 - DNA, 15 bp, Homo sapiens
acaatctaaaacctc

SEQ ID NO: 401343 - DNA, 15 bp, Homo sapiens
caatctaaaacctcc

SEQ ID NO: 401344 - DNA, 15 bp, Homo sapiens
aatctaaaacctcca

SEQ ID NO: 401345 - DNA, 15 bp, Homo sapiens
atctaaaacctccag

SEQ ID NO: 401346 - DNA, 15 bp, Homo sapiens
tctaaaacctccagt

SEQ ID NO: 401347 - DNA, 15 bp, Homo sapiens
ctaaaacctccagtt

SEQ ID NO: 401348 - DNA, 15 bp, Homo sapiens
taaaacctccagtta

SEQ ID NO: 401349 - DNA, 15 bp, Homo sapiens
aaaacctccagttat

SEQ ID NO: 401350 - DNA, 15 bp, Homo sapiens
aaacctccagttatt

SEQ ID NO: 401351 - DNA, 15 bp, Homo sapiens
aacctccagttattt

SEQ ID NO: 401352 - DNA, 15 bp, Homo sapiens
acctccagttatttg

SEQ ID NO: 401353 - DNA, 15 bp, Homo sapiens
cctccagttatttgt

SEQ ID NO: 401354 - DNA, 15 bp, Homo sapiens
ctccagttatttgtg

SEQ ID NO: 401355 - DNA, 15 bp, Homo sapiens
tccagttatttgtgt

SEQ ID NO: 401356 - DNA, 15 bp, Homo sapiens
ccagttatttgtgtg

SEQ ID NO: 401357 - DNA, 15 bp, Homo sapiens
cagttatttgtgtgt

SEQ ID NO: 401358 - DNA, 15 bp, Homo sapiens
agttatttgtgtgtt

SEQ ID NO: 401359 - DNA, 15 bp, Homo sapiens
gttatttgtgtgttt

SEQ ID NO: 401360 - DNA, 15 bp, Homo sapiens
ttatttgtgtgtttt

SEQ ID NO: 401361 - DNA, 15 bp, Homo sapiens
tatttgtgtgttttt

SEQ ID NO: 401362 - DNA, 15 bp, Homo sapiens
atttgtgtgtttttt

SEQ ID NO: 401363 - DNA, 15 bp, Homo sapiens
tttgtgtgttttttt

SEQ ID NO: 401364 - DNA, 15 bp, Homo sapiens
ttgtgtgtttttttt

SEQ ID NO: 401365 - DNA, 15 bp, Homo sapiens
tgtgtgttttttttt

SEQ ID NO: 401366 - DNA, 15 bp, Homo sapiens
gtgtgtttttttttt

SEQ ID NO: 401367 - DNA, 15 bp, Homo sapiens
ttttttttggagaca

SEQ ID NO: 401368 - DNA, 15 bp, Homo sapiens
tttttttggagacat

SEQ ID NO: 401369 - DNA, 15 bp, Homo sapiens
ttttttggagacatg

SEQ ID NO: 401370 - DNA, 15 bp, Homo sapiens
tttttggagacatga

SEQ ID NO: 401371 - DNA, 15 bp, Homo sapiens
ttttggagacatgag

SEQ ID NO: 401372 - DNA, 15 bp, Homo sapiens
tttggagacatgaga

SEQ ID NO: 401373 - DNA, 15 bp, Homo sapiens
ttggagacatgagac

SEQ ID NO: 401374 - DNA, 15 bp, Homo sapiens
tggagacatgagaca

SEQ ID NO: 401375 - DNA, 15 bp, Homo sapiens
ggagacatgagacag

SEQ ID NO: 401376 - DNA, 15 bp, Homo sapiens
gagacatgagacagg

SEQ ID NO: 401377 - DNA, 15 bp, Homo sapiens
agacatgagacaggg

SEQ ID NO: 401378 - DNA, 15 bp, Homo sapiens
gacatgagacagggt

SEQ ID NO: 401379 - DNA, 15 bp, Homo sapiens
acatgagacagggtt

SEQ ID NO: 401380 - DNA, 15 bp, Homo sapiens
catgagacagggttt

SEQ ID NO: 401381 - DNA, 15 bp, Homo sapiens
atgagacagggtttt

SEQ ID NO: 401382 - DNA, 15 bp, Homo sapiens
tgagacagggtttta

SEQ ID NO: 401383 - DNA, 15 bp, Homo sapiens
agacagggttttact

SEQ ID NO: 401384 - DNA, 15 bp, Homo sapiens
gacagggttttactg

SEQ ID NO: 401385 - DNA, 15 bp, Homo sapiens
acagggttttactgt

SEQ ID NO: 401386 - DNA, 15 bp, Homo sapiens
cagggttttactgtg

SEQ ID NO: 401387 - DNA, 15 bp, Homo sapiens
agggttttactgtgt

SEQ ID NO: 401388 - DNA, 15 bp, Homo sapiens
gggttttactgtgtc

SEQ ID NO: 401389 - DNA, 15 bp, Homo sapiens
ggttttactgtgtca

SEQ ID NO: 401390 - DNA, 15 bp, Homo sapiens
gttttactgtgtcac

SEQ ID NO: 401391 - DNA, 15 bp, Homo sapiens
ttttactgtgtcacc

SEQ ID NO: 401392 - DNA, 15 bp, Homo sapiens
tttactgtgtcaccc

SEQ ID NO: 401393 - DNA, 15 bp, Homo sapiens
ttactgtgtcaccca

SEQ ID NO: 401394 - DNA, 15 bp, Homo sapiens
tactgtgtcacccag

SEQ ID NO: 401395 - DNA, 15 bp, Homo sapiens
actgtgtcacccagg

SEQ ID NO: 401396 - DNA, 15 bp, Homo sapiens
ctgtgtcacccaggc

SEQ ID NO: 401397 - DNA, 15 bp, Homo sapiens
tgtgtcacccaggct

SEQ ID NO: 401398 - DNA, 15 bp, Homo sapiens
gtgtcacccaggcta

SEQ ID NO: 401399 - DNA, 15 bp, Homo sapiens
acccaggctagagtc

SEQ ID NO: 401400 - DNA, 15 bp, Homo sapiens
cccaggctagagtcc

SEQ ID NO: 401401 - DNA, 15 bp, Homo sapiens
ccaggctagagtcca

SEQ ID NO: 401402 - DNA, 15 bp, Homo sapiens
caggctagagtccaa

SEQ ID NO: 401403 - DNA, 15 bp, Homo sapiens
aggctagagtccaag

SEQ ID NO: 401404 - DNA, 15 bp, Homo sapiens
ggctagagtccaagt

SEQ ID NO: 401405 - DNA, 15 bp, Homo sapiens
gctagagtccaagta

SEQ ID NO: 401406 - DNA, 15 bp, Homo sapiens
ctagagtccaagtag

SEQ ID NO: 401407 - DNA, 15 bp, Homo sapiens
tagagtccaagtagt

SEQ ID NO: 401408 - DNA, 15 bp, Homo sapiens
agagtccaagtagta

SEQ ID NO: 401409 - DNA, 15 bp, Homo sapiens
gagtccaagtagtat

SEQ ID NO: 401410 - DNA, 15 bp, Homo sapiens
agtccaagtagtatg

SEQ ID NO: 401411 - DNA, 15 bp, Homo sapiens
gtccaagtagtatga

SEQ ID NO: 401412 - DNA, 15 bp, Homo sapiens
tccaagtagtatgat

SEQ ID NO: 401413 - DNA, 15 bp, Homo sapiens
ccaagtagtatgatc

SEQ ID NO: 401414 - DNA, 15 bp, Homo sapiens
caagtagtatgatct

SEQ ID NO: 401415 - DNA, 15 bp, Homo sapiens
aagtagtatgatctg

SEQ ID NO: 401416 - DNA, 15 bp, Homo sapiens
agtagtatgatctgg

SEQ ID NO: 401417 - DNA, 15 bp, Homo sapiens
gtagtatgatctggg

SEQ ID NO: 401418 - DNA, 15 bp, Homo sapiens
tagtatgatctgggc

SEQ ID NO: 401419 - DNA, 15 bp, Homo sapiens
agtatgatctgggct

SEQ ID NO: 401420 - DNA, 15 bp, Homo sapiens
gtatgatctgggctc

SEQ ID NO: 401421 - DNA, 15 bp, Homo sapiens
tatgatctgggctca

SEQ ID NO: 401422 - DNA, 15 bp, Homo sapiens
atgatctgggctcac

SEQ ID NO: 401423 - DNA, 15 bp, Homo sapiens
tgatctgggctcact

SEQ ID NO: 401424 - DNA, 15 bp, Homo sapiens
gatctgggctcacta

SEQ ID NO: 401425 - DNA, 15 bp, Homo sapiens
atctgggctcactac

SEQ ID NO: 401426 - DNA, 15 bp, Homo sapiens
tctgggctcactaca

SEQ ID NO: 401427 - DNA, 15 bp, Homo sapiens
ctgggctcactacag

SEQ ID NO: 401428 - DNA, 15 bp, Homo sapiens
tgggctcactacagc

SEQ ID NO: 401429 - DNA, 15 bp, Homo sapiens
gggctcactacagcc

SEQ ID NO: 401430 - DNA, 15 bp, Homo sapiens
ggctcactacagcct

SEQ ID NO: 401431 - DNA, 15 bp, Homo sapiens
gctcactacagcctt

SEQ ID NO: 401432 - DNA, 15 bp, Homo sapiens
ctcactacagccttg

SEQ ID NO: 401433 - DNA, 15 bp, Homo sapiens
tcactacagccttga

SEQ ID NO: 401434 - DNA, 15 bp, Homo sapiens
cactacagccttgac

SEQ ID NO: 401435 - DNA, 15 bp, Homo sapiens
actacagccttgacc

SEQ ID NO: 401436 - DNA, 15 bp, Homo sapiens
ctacagccttgacct

SEQ ID NO: 401437 - DNA, 15 bp, Homo sapiens
tacagccttgacctc

SEQ ID NO: 401438 - DNA, 15 bp, Homo sapiens
acagccttgacctcc

SEQ ID NO: 401439 - DNA, 15 bp, Homo sapiens
tcctgggctcaagcg

SEQ ID NO: 401440 - DNA, 15 bp, Homo sapiens
cctgggctcaagcga

SEQ ID NO: 401441 - DNA, 15 bp, Homo sapiens
ctgggctcaagcgat

SEQ ID NO: 401442 - DNA, 15 bp, Homo sapiens
tgggctcaagcgatc

SEQ ID NO: 401443 - DNA, 15 bp, Homo sapiens
gggctcaagcgatcc

SEQ ID NO: 401444 - DNA, 15 bp, Homo sapiens
ggctcaagcgatcct

SEQ ID NO: 401445 - DNA, 15 bp, Homo sapiens
gctcaagcgatcctc

SEQ ID NO: 401446 - DNA, 15 bp, Homo sapiens
gatcctcccacctct

SEQ ID NO: 401447 - DNA, 15 bp, Homo sapiens
atcctcccacctctg

SEQ ID NO: 401448 - DNA, 15 bp, Homo sapiens
tcctcccacctctgc

SEQ ID NO: 401449 - DNA, 15 bp, Homo sapiens
cctcccacctctgcc

SEQ ID NO: 401450 - DNA, 15 bp, Homo sapiens
tcccacctctgccta

SEQ ID NO: 401451 - DNA, 15 bp, Homo sapiens
cccacctctgcctac

SEQ ID NO: 401452 - DNA, 15 bp, Homo sapiens
ccacctctgcctact

SEQ ID NO: 401453 - DNA, 15 bp, Homo sapiens
cacctctgcctacta

SEQ ID NO: 401454 - DNA, 15 bp, Homo sapiens
acctctgcctactaa

SEQ ID NO: 401455 - DNA, 15 bp, Homo sapiens
cctctgcctactaag

SEQ ID NO: 401456 - DNA, 15 bp, Homo sapiens
ctctgcctactaagt

SEQ ID NO: 401457 - DNA, 15 bp, Homo sapiens
tctgcctactaagta

SEQ ID NO: 401458 - DNA, 15 bp, Homo sapiens
ctgcctactaagtag

SEQ ID NO: 401459 - DNA, 15 bp, Homo sapiens
tgcctactaagtagc

SEQ ID NO: 401460 - DNA, 15 bp, Homo sapiens
gcctactaagtagct

SEQ ID NO: 401461 - DNA, 15 bp, Homo sapiens
cctactaagtagctg

SEQ ID NO: 401462 - DNA, 15 bp, Homo sapiens
ctactaagtagctgg

SEQ ID NO: 401463 - DNA, 15 bp, Homo sapiens
tactaagtagctggg

SEQ ID NO: 401464 - DNA, 15 bp, Homo sapiens
actaagtagctggga

SEQ ID NO: 401465 - DNA, 15 bp, Homo sapiens
ctaagtagctgggac

SEQ ID NO: 401466 - DNA, 15 bp, Homo sapiens
taagtagctgggacc

SEQ ID NO: 401467 - DNA, 15 bp, Homo sapiens
ggaccacaggcacac

SEQ ID NO: 401468 - DNA, 15 bp, Homo sapiens
gaccacaggcacaca

SEQ ID NO: 401469 - DNA, 15 bp, Homo sapiens
accacaggcacacac

SEQ ID NO: 401470 - DNA, 15 bp, Homo sapiens
ccacaggcacacacc

SEQ ID NO: 401471 - DNA, 15 bp, Homo sapiens
cacaggcacacacca

SEQ ID NO: 401472 - DNA, 15 bp, Homo sapiens
acaggcacacaccac

SEQ ID NO: 401473 - DNA, 15 bp, Homo sapiens
caggcacacaccacc

SEQ ID NO: 401474 - DNA, 15 bp, Homo sapiens
aggcacacaccacca

SEQ ID NO: 401475 - DNA, 15 bp, Homo sapiens
ggcacacaccaccac

SEQ ID NO: 401476 - DNA, 15 bp, Homo sapiens
gcacacaccaccacc

SEQ ID NO: 401477 - DNA, 15 bp, Homo sapiens
cacacaccaccacct

SEQ ID NO: 401478 - DNA, 15 bp, Homo sapiens
acacaccaccacctc

SEQ ID NO: 401479 - DNA, 15 bp, Homo sapiens
cacaccaccacctct

SEQ ID NO: 401480 - DNA, 15 bp, Homo sapiens
acaccaccacctctg

SEQ ID NO: 401481 - DNA, 15 bp, Homo sapiens
caccaccacctctgg

SEQ ID NO: 401482 - DNA, 15 bp, Homo sapiens
accaccacctctggc

SEQ ID NO: 401483 - DNA, 15 bp, Homo sapiens
ccaccacctctggct

SEQ ID NO: 401484 - DNA, 15 bp, Homo sapiens
caccacctctggcta

SEQ ID NO: 401485 - DNA, 15 bp, Homo sapiens
accacctctggctaa

SEQ ID NO: 401486 - DNA, 15 bp, Homo sapiens
ccacctctggctaat

SEQ ID NO: 401487 - DNA, 15 bp, Homo sapiens
cacctctggctaatt

SEQ ID NO: 401488 - DNA, 15 bp, Homo sapiens
acctctggctaattt

SEQ ID NO: 401489 - DNA, 15 bp, Homo sapiens
cctctggctaatttt

SEQ ID NO: 401490 - DNA, 15 bp, Homo sapiens
ctctggctaattttc

SEQ ID NO: 401491 - DNA, 15 bp, Homo sapiens
tctggctaattttcc

SEQ ID NO: 401492 - DNA, 15 bp, Homo sapiens
ctggctaattttcct

SEQ ID NO: 401493 - DNA, 15 bp, Homo sapiens
tggctaattttccta

SEQ ID NO: 401494 - DNA, 15 bp, Homo sapiens
ggctaattttcctat

SEQ ID NO: 401495 - DNA, 15 bp, Homo sapiens
gctaattttcctatt

SEQ ID NO: 401496 - DNA, 15 bp, Homo sapiens
ctaattttcctatta

SEQ ID NO: 401497 - DNA, 15 bp, Homo sapiens
taattttcctattat

SEQ ID NO: 401498 - DNA, 15 bp, Homo sapiens
aattttcctattatt

SEQ ID NO: 401499 - DNA, 15 bp, Homo sapiens
attttcctattattt

SEQ ID NO: 401500 - DNA, 15 bp, Homo sapiens
ttttcctattatttg

SEQ ID NO: 401501 - DNA, 15 bp, Homo sapiens
tttcctattatttgt

SEQ ID NO: 401502 - DNA, 15 bp, Homo sapiens
ttcctattatttgta

SEQ ID NO: 401503 - DNA, 15 bp, Homo sapiens
tcctattatttgtag

SEQ ID NO: 401504 - DNA, 15 bp, Homo sapiens
cctattatttgtaga

SEQ ID NO: 401505 - DNA, 15 bp, Homo sapiens
ctattatttgtagat

SEQ ID NO: 401506 - DNA, 15 bp, Homo sapiens
tattatttgtagata

SEQ ID NO: 401507 - DNA, 15 bp, Homo sapiens
attatttgtagatac

SEQ ID NO: 401508 - DNA, 15 bp, Homo sapiens
ttatttgtagataca

SEQ ID NO: 401509 - DNA, 15 bp, Homo sapiens
tatttgtagatacag

SEQ ID NO: 401510 - DNA, 15 bp, Homo sapiens
atttgtagatacagg

SEQ ID NO: 401511 - DNA, 15 bp, Homo sapiens
tttgtagatacaggg

SEQ ID NO: 401512 - DNA, 15 bp, Homo sapiens
ttgtagatacagggt

SEQ ID NO: 401513 - DNA, 15 bp, Homo sapiens
tgtagatacagggtt

SEQ ID NO: 401514 - DNA, 15 bp, Homo sapiens
gtagatacagggttt

SEQ ID NO: 401515 - DNA, 15 bp, Homo sapiens
tagatacagggtttc

SEQ ID NO: 401516 - DNA, 15 bp, Homo sapiens
agatacagggtttcg

SEQ ID NO: 401517 - DNA, 15 bp, Homo sapiens
gatacagggtttcgc

SEQ ID NO: 401518 - DNA, 15 bp, Homo sapiens
atacagggtttcgcc

SEQ ID NO: 401519 - DNA, 15 bp, Homo sapiens
tacagggtttcgcca

SEQ ID NO: 401520 - DNA, 15 bp, Homo sapiens
acagggtttcgccac

SEQ ID NO: 401521 - DNA, 15 bp, Homo sapiens
cagggtttcgccaca

SEQ ID NO: 401522 - DNA, 15 bp, Homo sapiens
agggtttcgccacat

SEQ ID NO: 401523 - DNA, 15 bp, Homo sapiens
gggtttcgccacatt

SEQ ID NO: 401524 - DNA, 15 bp, Homo sapiens
ggtttcgccacatta

SEQ ID NO: 401525 - DNA, 15 bp, Homo sapiens
gtttcgccacattac

SEQ ID NO: 401526 - DNA, 15 bp, Homo sapiens
tttcgccacattacc

SEQ ID NO: 401527 - DNA, 15 bp, Homo sapiens
ttcgccacattacca

SEQ ID NO: 401528 - DNA, 15 bp, Homo sapiens
tcgccacattaccaa

SEQ ID NO: 401529 - DNA, 15 bp, Homo sapiens
cgccacattaccaag

SEQ ID NO: 401530 - DNA, 15 bp, Homo sapiens
gccacattaccaagg

SEQ ID NO: 401531 - DNA, 15 bp, Homo sapiens
ccacattaccaaggc

SEQ ID NO: 401532 - DNA, 15 bp, Homo sapiens
cacattaccaaggct

SEQ ID NO: 401533 - DNA, 15 bp, Homo sapiens
acattaccaaggctg

SEQ ID NO: 401534 - DNA, 15 bp, Homo sapiens
cattaccaaggctgc

SEQ ID NO: 401535 - DNA, 15 bp, Homo sapiens
attaccaaggctgct

SEQ ID NO: 401536 - DNA, 15 bp, Homo sapiens
ttaccaaggctgctc

SEQ ID NO: 401537 - DNA, 15 bp, Homo sapiens
taccaaggctgctct

SEQ ID NO: 401538 - DNA, 15 bp, Homo sapiens
accaaggctgctctc

SEQ ID NO: 401539 - DNA, 15 bp, Homo sapiens
ccaaggctgctctcc

SEQ ID NO: 401540 - DNA, 15 bp, Homo sapiens
caaggctgctctcca

SEQ ID NO: 401541 - DNA, 15 bp, Homo sapiens
aaggctgctctccaa

SEQ ID NO: 401542 - DNA, 15 bp, Homo sapiens
aggctgctctccaac

SEQ ID NO: 401543 - DNA, 15 bp, Homo sapiens
ggctgctctccaact

SEQ ID NO: 401544 - DNA, 15 bp, Homo sapiens
gctgctctccaactc

SEQ ID NO: 401545 - DNA, 15 bp, Homo sapiens
ctgctctccaactct

SEQ ID NO: 401546 - DNA, 15 bp, Homo sapiens
tgctctccaactctg

SEQ ID NO: 401547 - DNA, 15 bp, Homo sapiens
gctctccaactctga

SEQ ID NO: 401548 - DNA, 15 bp, Homo sapiens
ctctccaactctgag

SEQ ID NO: 401549 - DNA, 15 bp, Homo sapiens
tctccaactctgagg

SEQ ID NO: 401550 - DNA, 15 bp, Homo sapiens
ctccaactctgaggc

SEQ ID NO: 401551 - DNA, 15 bp, Homo sapiens
tccaactctgaggct

SEQ ID NO: 401552 - DNA, 15 bp, Homo sapiens
ccaactctgaggctt

SEQ ID NO: 401553 - DNA, 15 bp, Homo sapiens
caactctgaggcttc

SEQ ID NO: 401554 - DNA, 15 bp, Homo sapiens
aactctgaggcttca

SEQ ID NO: 401555 - DNA, 15 bp, Homo sapiens
actctgaggcttcag

SEQ ID NO: 401556 - DNA, 15 bp, Homo sapiens
ctctgaggcttcagt

SEQ ID NO: 401557 - DNA, 15 bp, Homo sapiens
tctgaggcttcagtg

SEQ ID NO: 401558 - DNA, 15 bp, Homo sapiens
ctgaggcttcagtga

SEQ ID NO: 401559 - DNA, 15 bp, Homo sapiens
tgaggcttcagtgat

SEQ ID NO: 401560 - DNA, 15 bp, Homo sapiens
gaggcttcagtgatt

SEQ ID NO: 401561 - DNA, 15 bp, Homo sapiens
aggcttcagtgattt

SEQ ID NO: 401562 - DNA, 15 bp, Homo sapiens
ggcttcagtgatttg

SEQ ID NO: 401563 - DNA, 15 bp, Homo sapiens
gcttcagtgatttgc

SEQ ID NO: 401564 - DNA, 15 bp, Homo sapiens
cttcagtgatttgcc

SEQ ID NO: 401565 - DNA, 15 bp, Homo sapiens
ttcagtgatttgccc

SEQ ID NO: 401566 - DNA, 15 bp, Homo sapiens
tcagtgatttgccca

SEQ ID NO: 401567 - DNA, 15 bp, Homo sapiens
cagtgatttgcccac

SEQ ID NO: 401568 - DNA, 15 bp, Homo sapiens
agtgatttgcccacc

SEQ ID NO: 401569 - DNA, 15 bp, Homo sapiens
gtgatttgcccacct

SEQ ID NO: 401570 - DNA, 15 bp, Homo sapiens
tgatttgcccacctt

SEQ ID NO: 401571 - DNA, 15 bp, Homo sapiens
gatttgcccaccttg

SEQ ID NO: 401572 - DNA, 15 bp, Homo sapiens
atttgcccaccttgg

SEQ ID NO: 401573 - DNA, 15 bp, Homo sapiens
tttgcccaccttggc

SEQ ID NO: 401574 - DNA, 15 bp, Homo sapiens
ttgcccaccttggcc

SEQ ID NO: 401575 - DNA, 15 bp, Homo sapiens
tgcccaccttggcct

SEQ ID NO: 401576 - DNA, 15 bp, Homo sapiens
gcccaccttggcctc

SEQ ID NO: 401577 - DNA, 15 bp, Homo sapiens
ccaccttggcctccc

SEQ ID NO: 401578 - DNA, 15 bp, Homo sapiens
caccttggcctccca

SEQ ID NO: 401579 - DNA, 15 bp, Homo sapiens
accttggcctcccaa

SEQ ID NO: 401580 - DNA, 15 bp, Homo sapiens
tcccaaagtgctaga

SEQ ID NO: 401581 - DNA, 15 bp, Homo sapiens
cccaaagtgctagaa

SEQ ID NO: 401582 - DNA, 15 bp, Homo sapiens
ccaaagtgctagaat

SEQ ID NO: 401583 - DNA, 15 bp, Homo sapiens
caaagtgctagaatt

SEQ ID NO: 401584 - DNA, 15 bp, Homo sapiens
aaagtgctagaatta

SEQ ID NO: 401585 - DNA, 15 bp, Homo sapiens
aagtgctagaattaa

SEQ ID NO: 401586 - DNA, 15 bp, Homo sapiens
agtgctagaattaag

SEQ ID NO: 401587 - DNA, 15 bp, Homo sapiens
gtgctagaattaagg

SEQ ID NO: 401588 - DNA, 15 bp, Homo sapiens
tgctagaattaaggg

SEQ ID NO: 401589 - DNA, 15 bp, Homo sapiens
gctagaattaagggc

SEQ ID NO: 401590 - DNA, 15 bp, Homo sapiens
ctagaattaagggcg

SEQ ID NO: 401591 - DNA, 15 bp, Homo sapiens
tagaattaagggcgt

SEQ ID NO: 401592 - DNA, 15 bp, Homo sapiens
agaattaagggcgtg

SEQ ID NO: 401593 - DNA, 15 bp, Homo sapiens
gaattaagggcgtga

SEQ ID NO: 401594 - DNA, 15 bp, Homo sapiens
aattaagggcgtgag

SEQ ID NO: 401595 - DNA, 15 bp, Homo sapiens
attaagggcgtgagc

SEQ ID NO: 401596 - DNA, 15 bp, Homo sapiens
ttaagggcgtgagcc

SEQ ID NO: 401597 - DNA, 15 bp, Homo sapiens
taagggcgtgagcca

SEQ ID NO: 401598 - DNA, 15 bp, Homo sapiens
aagggcgtgagccac

SEQ ID NO: 401599 - DNA, 15 bp, Homo sapiens
agggcgtgagccacc

SEQ ID NO: 401600 - DNA, 15 bp, Homo sapiens
gggcgtgagccacca

SEQ ID NO: 401601 - DNA, 15 bp, Homo sapiens
ggcgtgagccaccat

SEQ ID NO: 401602 - DNA, 15 bp, Homo sapiens
gcgtgagccaccatg

SEQ ID NO: 401603 - DNA, 15 bp, Homo sapiens
accatgcccagcctg

SEQ ID NO: 401604 - DNA, 15 bp, Homo sapiens
ccatgcccagcctgc

SEQ ID NO: 401605 - DNA, 15 bp, Homo sapiens
catgcccagcctgca

SEQ ID NO: 401606 - DNA, 15 bp, Homo sapiens
atgcccagcctgcaa

SEQ ID NO: 401607 - DNA, 15 bp, Homo sapiens
tgcccagcctgcaat

SEQ ID NO: 401608 - DNA, 15 bp, Homo sapiens
gcccagcctgcaatg

SEQ ID NO: 401609 - DNA, 15 bp, Homo sapiens
cccagcctgcaatgt

SEQ ID NO: 401610 - DNA, 15 bp, Homo sapiens
ccagcctgcaatgtc

SEQ ID NO: 401611 - DNA, 15 bp, Homo sapiens
cagcctgcaatgtcc

SEQ ID NO: 401612 - DNA, 15 bp, Homo sapiens
agcctgcaatgtcct

SEQ ID NO: 401613 - DNA, 15 bp, Homo sapiens
gcctgcaatgtcctt

SEQ ID NO: 401614 - DNA, 15 bp, Homo sapiens
cctgcaatgtccttt

SEQ ID NO: 401615 - DNA, 15 bp, Homo sapiens
ctgcaatgtcctttt

SEQ ID NO: 401616 - DNA, 15 bp, Homo sapiens
tgcaatgtccttttc

SEQ ID NO: 401617 - DNA, 15 bp, Homo sapiens
gcaatgtccttttct

SEQ ID NO: 401618 - DNA, 15 bp, Homo sapiens
caatgtccttttctg

SEQ ID NO: 401619 - DNA, 15 bp, Homo sapiens
aatgtccttttctga

SEQ ID NO: 401620 - DNA, 15 bp, Homo sapiens
atgtccttttctgaa

SEQ ID NO: 401621 - DNA, 15 bp, Homo sapiens
tgtccttttctgaat

SEQ ID NO: 401622 - DNA, 15 bp, Homo sapiens
gtccttttctgaatt

SEQ ID NO: 401623 - DNA, 15 bp, Homo sapiens
tccttttctgaattc

SEQ ID NO: 401624 - DNA, 15 bp, Homo sapiens
ccttttctgaattca

SEQ ID NO: 401625 - DNA, 15 bp, Homo sapiens
cttttctgaattcat

SEQ ID NO: 401626 - DNA, 15 bp, Homo sapiens
ttttctgaattcata

SEQ ID NO: 401627 - DNA, 15 bp, Homo sapiens
tttctgaattcatag

SEQ ID NO: 401628 - DNA, 15 bp, Homo sapiens
ttctgaattcataga

SEQ ID NO: 401629 - DNA, 15 bp, Homo sapiens
tctgaattcatagac

SEQ ID NO: 401630 - DNA, 15 bp, Homo sapiens
ctgaattcatagact

SEQ ID NO: 401631 - DNA, 15 bp, Homo sapiens
tgaattcatagactt

SEQ ID NO: 401632 - DNA, 15 bp, Homo sapiens
gaattcatagacttc

SEQ ID NO: 401633 - DNA, 15 bp, Homo sapiens
aattcatagacttct

SEQ ID NO: 401634 - DNA, 15 bp, Homo sapiens
attcatagacttctc

SEQ ID NO: 401635 - DNA, 15 bp, Homo sapiens
ttcatagacttctca

SEQ ID NO: 401636 - DNA, 15 bp, Homo sapiens
tcatagacttctcag

SEQ ID NO: 401637 - DNA, 15 bp, Homo sapiens
catagacttctcagt

SEQ ID NO: 401638 - DNA, 15 bp, Homo sapiens
atagacttctcagta

SEQ ID NO: 401639 - DNA, 15 bp, Homo sapiens
tagacttctcagtat

SEQ ID NO: 401640 - DNA, 15 bp, Homo sapiens
agacttctcagtatt

SEQ ID NO: 401641 - DNA, 15 bp, Homo sapiens
gacttctcagtatta

SEQ ID NO: 401642 - DNA, 15 bp, Homo sapiens
acttctcagtattac

SEQ ID NO: 401643 - DNA, 15 bp, Homo sapiens
cttctcagtattact

SEQ ID NO: 401644 - DNA, 15 bp, Homo sapiens
ttctcagtattactt

SEQ ID NO: 401645 - DNA, 15 bp, Homo sapiens
tctcagtattactta

SEQ ID NO: 401646 - DNA, 15 bp, Homo sapiens
ctcagtattacttag

SEQ ID NO: 401647 - DNA, 15 bp, Homo sapiens
tcagtattacttagc

SEQ ID NO: 401648 - DNA, 15 bp, Homo sapiens
cagtattacttagca

SEQ ID NO: 401649 - DNA, 15 bp, Homo sapiens
agtattacttagcag

SEQ ID NO: 401650 - DNA, 15 bp, Homo sapiens
gtattacttagcagc

SEQ ID NO: 401651 - DNA, 15 bp, Homo sapiens
tattacttagcagct

SEQ ID NO: 401652 - DNA, 15 bp, Homo sapiens
attacttagcagcta

SEQ ID NO: 401653 - DNA, 15 bp, Homo sapiens
ttacttagcagctag

SEQ ID NO: 401654 - DNA, 15 bp, Homo sapiens
tacttagcagctagc

SEQ ID NO: 401655 - DNA, 15 bp, Homo sapiens
acttagcagctagcc

SEQ ID NO: 401656 - DNA, 15 bp, Homo sapiens
cttagcagctagcct

SEQ ID NO: 401657 - DNA, 15 bp, Homo sapiens
ttagcagctagcctt

SEQ ID NO: 401658 - DNA, 15 bp, Homo sapiens
tagcagctagccttt

SEQ ID NO: 401659 - DNA, 15 bp, Homo sapiens
agcagctagcctttt

SEQ ID NO: 401660 - DNA, 15 bp, Homo sapiens
gcagctagccttttt

SEQ ID NO: 401661 - DNA, 15 bp, Homo sapiens
cagctagcctttttt

SEQ ID NO: 401662 - DNA, 15 bp, Homo sapiens
agctagccttttttt

SEQ ID NO: 401663 - DNA, 15 bp, Homo sapiens
gctagcctttttttt

SEQ ID NO: 401664 - DNA, 15 bp, Homo sapiens
ctagccttttttttt

SEQ ID NO: 401665 - DNA, 15 bp, Homo sapiens
tagcctttttttttc

SEQ ID NO: 401666 - DNA, 15 bp, Homo sapiens
agcctttttttttct

SEQ ID NO: 401667 - DNA, 15 bp, Homo sapiens
gcctttttttttctt

SEQ ID NO: 401668 - DNA, 15 bp, Homo sapiens
ttttttctttttttt

SEQ ID NO: 401669 - DNA, 15 bp, Homo sapiens
ttgagagggagtctt

SEQ ID NO: 401670 - DNA, 15 bp, Homo sapiens
tgagagggagtctta

SEQ ID NO: 401671 - DNA, 15 bp, Homo sapiens
gagagggagtcttac

SEQ ID NO: 401672 - DNA, 15 bp, Homo sapiens
agagggagtcttact

SEQ ID NO: 401673 - DNA, 15 bp, Homo sapiens
gagggagtcttactt

SEQ ID NO: 401674 - DNA, 15 bp, Homo sapiens
agggagtcttacttt

SEQ ID NO: 401675 - DNA, 15 bp, Homo sapiens
gggagtcttactttg

SEQ ID NO: 401676 - DNA, 15 bp, Homo sapiens
ggagtcttactttgt

SEQ ID NO: 401677 - DNA, 15 bp, Homo sapiens
gagtcttactttgtt

SEQ ID NO: 401678 - DNA, 15 bp, Homo sapiens
agtcttactttgtta

SEQ ID NO: 401679 - DNA, 15 bp, Homo sapiens
gtcttactttgttac

SEQ ID NO: 401680 - DNA, 15 bp, Homo sapiens
tcttactttgttacc

SEQ ID NO: 401681 - DNA, 15 bp, Homo sapiens
cttactttgttaccc

SEQ ID NO: 401682 - DNA, 15 bp, Homo sapiens
ttactttgttaccca

SEQ ID NO: 401683 - DNA, 15 bp, Homo sapiens
tactttgttacccag

SEQ ID NO: 401684 - DNA, 15 bp, Homo sapiens
gagtgcagtgacacg

SEQ ID NO: 401685 - DNA, 15 bp, Homo sapiens
agtgcagtgacacga

SEQ ID NO: 401686 - DNA, 15 bp, Homo sapiens
gtgcagtgacacgat

SEQ ID NO: 401687 - DNA, 15 bp, Homo sapiens
tgcagtgacacgata

SEQ ID NO: 401688 - DNA, 15 bp, Homo sapiens
gcagtgacacgatat

SEQ ID NO: 401689 - DNA, 15 bp, Homo sapiens
cagtgacacgatatc

SEQ ID NO: 401690 - DNA, 15 bp, Homo sapiens
agtgacacgatatca

SEQ ID NO: 401691 - DNA, 15 bp, Homo sapiens
gtgacacgatatcag

SEQ ID NO: 401692 - DNA, 15 bp, Homo sapiens
tgacacgatatcagc

SEQ ID NO: 401693 - DNA, 15 bp, Homo sapiens
gacacgatatcagct

SEQ ID NO: 401694 - DNA, 15 bp, Homo sapiens
acacgatatcagctc

SEQ ID NO: 401695 - DNA, 15 bp, Homo sapiens
cacgatatcagctca

SEQ ID NO: 401696 - DNA, 15 bp, Homo sapiens
acgatatcagctcac

SEQ ID NO: 401697 - DNA, 15 bp, Homo sapiens
cgatatcagctcact

SEQ ID NO: 401698 - DNA, 15 bp, Homo sapiens
gatatcagctcactg

SEQ ID NO: 401699 - DNA, 15 bp, Homo sapiens
atatcagctcactgc

SEQ ID NO: 401700 - DNA, 15 bp, Homo sapiens
tatcagctcactgca

SEQ ID NO: 401701 - DNA, 15 bp, Homo sapiens
atcagctcactgcaa

SEQ ID NO: 401702 - DNA, 15 bp, Homo sapiens
tcactgcaacttctg

SEQ ID NO: 401703 - DNA, 15 bp, Homo sapiens
cactgcaacttctgc

SEQ ID NO: 401704 - DNA, 15 bp, Homo sapiens
actgcaacttctgcc

SEQ ID NO: 401705 - DNA, 15 bp, Homo sapiens
ctgcaacttctgcct

SEQ ID NO: 401706 - DNA, 15 bp, Homo sapiens
tgcaacttctgcctc

SEQ ID NO: 401707 - DNA, 15 bp, Homo sapiens
gcaacttctgcctct

SEQ ID NO: 401708 - DNA, 15 bp, Homo sapiens
caacttctgcctctc

SEQ ID NO: 401709 - DNA, 15 bp, Homo sapiens
aacttctgcctctcg

SEQ ID NO: 401710 - DNA, 15 bp, Homo sapiens
acttctgcctctcgg

SEQ ID NO: 401711 - DNA, 15 bp, Homo sapiens
cttctgcctctcggg

SEQ ID NO: 401712 - DNA, 15 bp, Homo sapiens
ttctgcctctcgggt

SEQ ID NO: 401713 - DNA, 15 bp, Homo sapiens
gcctctcgggttcat

SEQ ID NO: 401714 - DNA, 15 bp, Homo sapiens
cctctcgggttcatg

SEQ ID NO: 401715 - DNA, 15 bp, Homo sapiens
ctctcgggttcatga

SEQ ID NO: 401716 - DNA, 15 bp, Homo sapiens
tctcgggttcatgag

SEQ ID NO: 401717 - DNA, 15 bp, Homo sapiens
ctcgggttcatgaga

SEQ ID NO: 401718 - DNA, 15 bp, Homo sapiens
tcgggttcatgagat

SEQ ID NO: 401719 - DNA, 15 bp, Homo sapiens
cgggttcatgagatc

SEQ ID NO: 401720 - DNA, 15 bp, Homo sapiens
gggttcatgagatcc

SEQ ID NO: 401721 - DNA, 15 bp, Homo sapiens
ggttcatgagatcct

SEQ ID NO: 401722 - DNA, 15 bp, Homo sapiens
gttcatgagatcctc

SEQ ID NO: 401723 - DNA, 15 bp, Homo sapiens
ttcatgagatcctcc

SEQ ID NO: 401724 - DNA, 15 bp, Homo sapiens
tcatgagatcctccc

SEQ ID NO: 401725 - DNA, 15 bp, Homo sapiens
catgagatcctccca

SEQ ID NO: 401726 - DNA, 15 bp, Homo sapiens
atgagatcctcccac

SEQ ID NO: 401727 - DNA, 15 bp, Homo sapiens
tgagatcctcccacc

SEQ ID NO: 401728 - DNA, 15 bp, Homo sapiens
gagatcctcccacct

SEQ ID NO: 401729 - DNA, 15 bp, Homo sapiens
agatcctcccacctc

SEQ ID NO: 401730 - DNA, 15 bp, Homo sapiens
tgggactataggtgc

SEQ ID NO: 401731 - DNA, 15 bp, Homo sapiens
gggactataggtgca

SEQ ID NO: 401732 - DNA, 15 bp, Homo sapiens
ggactataggtgcat

SEQ ID NO: 401733 - DNA, 15 bp, Homo sapiens
gactataggtgcatg

SEQ ID NO: 401734 - DNA, 15 bp, Homo sapiens
actataggtgcatgc

SEQ ID NO: 401735 - DNA, 15 bp, Homo sapiens
ctataggtgcatgcc

SEQ ID NO: 401736 - DNA, 15 bp, Homo sapiens
tataggtgcatgcca

SEQ ID NO: 401737 - DNA, 15 bp, Homo sapiens
ataggtgcatgccac

SEQ ID NO: 401738 - DNA, 15 bp, Homo sapiens
taggtgcatgccacc

SEQ ID NO: 401739 - DNA, 15 bp, Homo sapiens
aggtgcatgccacca

SEQ ID NO: 401740 - DNA, 15 bp, Homo sapiens
ggtgcatgccaccac

SEQ ID NO: 401741 - DNA, 15 bp, Homo sapiens
gtgcatgccaccacg

SEQ ID NO: 401742 - DNA, 15 bp, Homo sapiens
tgcatgccaccacgc

SEQ ID NO: 401743 - DNA, 15 bp, Homo sapiens
gcatgccaccacgcc

SEQ ID NO: 401744 - DNA, 15 bp, Homo sapiens
catgccaccacgcct

SEQ ID NO: 401745 - DNA, 15 bp, Homo sapiens
atgccaccacgcctg

SEQ ID NO: 401746 - DNA, 15 bp, Homo sapiens
cgcctggctaatttc

SEQ ID NO: 401747 - DNA, 15 bp, Homo sapiens
gcctggctaatttct

SEQ ID NO: 401748 - DNA, 15 bp, Homo sapiens
cctggctaatttctg

SEQ ID NO: 401749 - DNA, 15 bp, Homo sapiens
ctggctaatttctgt

SEQ ID NO: 401750 - DNA, 15 bp, Homo sapiens
tggctaatttctgta

SEQ ID NO: 401751 - DNA, 15 bp, Homo sapiens
ggctaatttctgtat

SEQ ID NO: 401752 - DNA, 15 bp, Homo sapiens
tttctgtatttttag

SEQ ID NO: 401753 - DNA, 15 bp, Homo sapiens
ttctgtatttttagt

SEQ ID NO: 401754 - DNA, 15 bp, Homo sapiens
tctgtatttttagta

SEQ ID NO: 401755 - DNA, 15 bp, Homo sapiens
ctgtatttttagtag

SEQ ID NO: 401756 - DNA, 15 bp, Homo sapiens
tttagtagagatgac

SEQ ID NO: 401757 - DNA, 15 bp, Homo sapiens
ttagtagagatgacg

SEQ ID NO: 401758 - DNA, 15 bp, Homo sapiens
tagtagagatgacgt

SEQ ID NO: 401759 - DNA, 15 bp, Homo sapiens
agtagagatgacgtt

SEQ ID NO: 401760 - DNA, 15 bp, Homo sapiens
gtagagatgacgtta

SEQ ID NO: 401761 - DNA, 15 bp, Homo sapiens
tagagatgacgttat

SEQ ID NO: 401762 - DNA, 15 bp, Homo sapiens
agagatgacgttatg

SEQ ID NO: 401763 - DNA, 15 bp, Homo sapiens
gagatgacgttatgc

SEQ ID NO: 401764 - DNA, 15 bp, Homo sapiens
agatgacgttatgcc

SEQ ID NO: 401765 - DNA, 15 bp, Homo sapiens
gatgacgttatgcca

SEQ ID NO: 401766 - DNA, 15 bp, Homo sapiens
atgacgttatgccat

SEQ ID NO: 401767 - DNA, 15 bp, Homo sapiens
tgacgttatgccatt

SEQ ID NO: 401768 - DNA, 15 bp, Homo sapiens
gacgttatgccattt

SEQ ID NO: 401769 - DNA, 15 bp, Homo sapiens
acgttatgccatttg

SEQ ID NO: 401770 - DNA, 15 bp, Homo sapiens
cgttatgccatttgg

SEQ ID NO: 401771 - DNA, 15 bp, Homo sapiens
gttatgccatttggc

SEQ ID NO: 401772 - DNA, 15 bp, Homo sapiens
ttatgccatttggcc

SEQ ID NO: 401773 - DNA, 15 bp, Homo sapiens
tatgccatttggcca

SEQ ID NO: 401774 - DNA, 15 bp, Homo sapiens
atgccatttggccag

SEQ ID NO: 401775 - DNA, 15 bp, Homo sapiens
tgccatttggccagg

SEQ ID NO: 401776 - DNA, 15 bp, Homo sapiens
gccatttggccaggc

SEQ ID NO: 401777 - DNA, 15 bp, Homo sapiens
ccatttggccaggct

SEQ ID NO: 401778 - DNA, 15 bp, Homo sapiens
catttggccaggctg

SEQ ID NO: 401779 - DNA, 15 bp, Homo sapiens
atttggccaggctgg

SEQ ID NO: 401780 - DNA, 15 bp, Homo sapiens
tttggccaggctggt

SEQ ID NO: 401781 - DNA, 15 bp, Homo sapiens
tcttgaattcctgac

SEQ ID NO: 401782 - DNA, 15 bp, Homo sapiens
cttgaattcctgact

SEQ ID NO: 401783 - DNA, 15 bp, Homo sapiens
ttgaattcctgactt

SEQ ID NO: 401784 - DNA, 15 bp, Homo sapiens
tgaattcctgacttc

SEQ ID NO: 401785 - DNA, 15 bp, Homo sapiens
gaattcctgacttca

SEQ ID NO: 401786 - DNA, 15 bp, Homo sapiens
aattcctgacttcaa

SEQ ID NO: 401787 - DNA, 15 bp, Homo sapiens
attcctgacttcaag

SEQ ID NO: 401788 - DNA, 15 bp, Homo sapiens
ttcctgacttcaagt

SEQ ID NO: 401789 - DNA, 15 bp, Homo sapiens
tggcctcccaaagtt

SEQ ID NO: 401790 - DNA, 15 bp, Homo sapiens
ggcctcccaaagttc

SEQ ID NO: 401791 - DNA, 15 bp, Homo sapiens
gcctcccaaagttct

SEQ ID NO: 401792 - DNA, 15 bp, Homo sapiens
cctcccaaagttctg

SEQ ID NO: 401793 - DNA, 15 bp, Homo sapiens
ctcccaaagttctgg

SEQ ID NO: 401794 - DNA, 15 bp, Homo sapiens
tcccaaagttctggg

SEQ ID NO: 401795 - DNA, 15 bp, Homo sapiens
cccaaagttctggga

SEQ ID NO: 401796 - DNA, 15 bp, Homo sapiens
ccaaagttctgggag

SEQ ID NO: 401797 - DNA, 15 bp, Homo sapiens
caaagttctgggagt

SEQ ID NO: 401798 - DNA, 15 bp, Homo sapiens
aaagttctgggagta

SEQ ID NO: 401799 - DNA, 15 bp, Homo sapiens
aagttctgggagtac

SEQ ID NO: 401800 - DNA, 15 bp, Homo sapiens
agttctgggagtaca

SEQ ID NO: 401801 - DNA, 15 bp, Homo sapiens
gttctgggagtacag

SEQ ID NO: 401802 - DNA, 15 bp, Homo sapiens
ttctgggagtacagg

SEQ ID NO: 401803 - DNA, 15 bp, Homo sapiens
tctgggagtacaggt

SEQ ID NO: 401804 - DNA, 15 bp, Homo sapiens
ctgggagtacaggtg

SEQ ID NO: 401805 - DNA, 15 bp, Homo sapiens
tgggagtacaggtgt

SEQ ID NO: 401806 - DNA, 15 bp, Homo sapiens
gggagtacaggtgtg

SEQ ID NO: 401807 - DNA, 15 bp, Homo sapiens
ggagtacaggtgtga

SEQ ID NO: 401808 - DNA, 15 bp, Homo sapiens
gagtacaggtgtgag

SEQ ID NO: 401809 - DNA, 15 bp, Homo sapiens
agtacaggtgtgagc

SEQ ID NO: 401810 - DNA, 15 bp, Homo sapiens
gtacaggtgtgagcc

SEQ ID NO: 401811 - DNA, 15 bp, Homo sapiens
acaggtgtgagccat

SEQ ID NO: 401812 - DNA, 15 bp, Homo sapiens
caggtgtgagccatc

SEQ ID NO: 401813 - DNA, 15 bp, Homo sapiens
ggtgtgagccatcgt

SEQ ID NO: 401814 - DNA, 15 bp, Homo sapiens
gtgtgagccatcgtg

SEQ ID NO: 401815 - DNA, 15 bp, Homo sapiens
tgtgagccatcgtgc

SEQ ID NO: 401816 - DNA, 15 bp, Homo sapiens
tgagccatcgtgccc

SEQ ID NO: 401817 - DNA, 15 bp, Homo sapiens
gagccatcgtgccca

SEQ ID NO: 401818 - DNA, 15 bp, Homo sapiens
agccatcgtgcccag

SEQ ID NO: 401819 - DNA, 15 bp, Homo sapiens
gccatcgtgcccagc

SEQ ID NO: 401820 - DNA, 15 bp, Homo sapiens
ccatcgtgcccagcc

SEQ ID NO: 401821 - DNA, 15 bp, Homo sapiens
catcgtgcccagcct

SEQ ID NO: 401822 - DNA, 15 bp, Homo sapiens
atcgtgcccagccta

SEQ ID NO: 401823 - DNA, 15 bp, Homo sapiens
tcgtgcccagcctag

SEQ ID NO: 401824 - DNA, 15 bp, Homo sapiens
cgtgcccagcctagg

SEQ ID NO: 401825 - DNA, 15 bp, Homo sapiens
gtgcccagcctaggc

SEQ ID NO: 401826 - DNA, 15 bp, Homo sapiens
tgcccagcctaggcc

SEQ ID NO: 401827 - DNA, 15 bp, Homo sapiens
gcccagcctaggccc

SEQ ID NO: 401828 - DNA, 15 bp, Homo sapiens
cccagcctaggcccc

SEQ ID NO: 401829 - DNA, 15 bp, Homo sapiens
ccagcctaggccccc

SEQ ID NO: 401830 - DNA, 15 bp, Homo sapiens
cagcctaggcccccc

SEQ ID NO: 401831 - DNA, 15 bp, Homo sapiens
agcctaggcccccct

SEQ ID NO: 401832 - DNA, 15 bp, Homo sapiens
gcctaggcccccctg

SEQ ID NO: 401833 - DNA, 15 bp, Homo sapiens
cctaggcccccctgc

SEQ ID NO: 401834 - DNA, 15 bp, Homo sapiens
ctaggcccccctgct

SEQ ID NO: 401835 - DNA, 15 bp, Homo sapiens
taggcccccctgctg

SEQ ID NO: 401836 - DNA, 15 bp, Homo sapiens
aggcccccctgctgc

SEQ ID NO: 401837 - DNA, 15 bp, Homo sapiens
ggcccccctgctgcc

SEQ ID NO: 401838 - DNA, 15 bp, Homo sapiens
gcccccctgctgcct

SEQ ID NO: 401839 - DNA, 15 bp, Homo sapiens
cccccctgctgcctt

SEQ ID NO: 401840 - DNA, 15 bp, Homo sapiens
ccccctgctgccttt

SEQ ID NO: 401841 - DNA, 15 bp, Homo sapiens
cccctgctgccttta

SEQ ID NO: 401842 - DNA, 15 bp, Homo sapiens
ccctgctgcctttaa

SEQ ID NO: 401843 - DNA, 15 bp, Homo sapiens
cctgctgcctttaaa

SEQ ID NO: 401844 - DNA, 15 bp, Homo sapiens
ctgctgcctttaaaa

SEQ ID NO: 401845 - DNA, 15 bp, Homo sapiens
tgctgcctttaaaaa

SEQ ID NO: 401846 - DNA, 15 bp, Homo sapiens
gctgcctttaaaaaa

SEQ ID NO: 401847 - DNA, 15 bp, Homo sapiens
ctgcctttaaaaaaa

SEQ ID NO: 401848 - DNA, 15 bp, Homo sapiens
tgcctttaaaaaaaa

SEQ ID NO: 401849 - DNA, 15 bp, Homo sapiens
gcctttaaaaaaaat

SEQ ID NO: 401850 - DNA, 15 bp, Homo sapiens
cctttaaaaaaaatt

SEQ ID NO: 401851 - DNA, 15 bp, Homo sapiens
ctttaaaaaaaattt

SEQ ID NO: 401852 - DNA, 15 bp, Homo sapiens
ttaaaaaaaatttaa

SEQ ID NO: 401853 - DNA, 15 bp, Homo sapiens
taaaaaaaatttaat

SEQ ID NO: 401854 - DNA, 15 bp, Homo sapiens
aaaaaaaatttaata

SEQ ID NO: 401855 - DNA, 15 bp, Homo sapiens
aaaaaaatttaataa

SEQ ID NO: 401856 - DNA, 15 bp, Homo sapiens
aaaaaatttaataat

SEQ ID NO: 401857 - DNA, 15 bp, Homo sapiens
aaaaatttaataatt

SEQ ID NO: 401858 - DNA, 15 bp, Homo sapiens
aaaatttaataattc

SEQ ID NO: 401859 - DNA, 15 bp, Homo sapiens
aaatttaataattca

SEQ ID NO: 401860 - DNA, 15 bp, Homo sapiens
aatttaataattcac

SEQ ID NO: 401861 - DNA, 15 bp, Homo sapiens
atttaataattcaca

SEQ ID NO: 401862 - DNA, 15 bp, Homo sapiens
tttaataattcacat

SEQ ID NO: 401863 - DNA, 15 bp, Homo sapiens
ttaataattcacatt

SEQ ID NO: 401864 - DNA, 15 bp, Homo sapiens
taataattcacatta

SEQ ID NO: 401865 - DNA, 15 bp, Homo sapiens
aataattcacattat

SEQ ID NO: 401866 - DNA, 15 bp, Homo sapiens
ataattcacattatt

SEQ ID NO: 401867 - DNA, 15 bp, Homo sapiens
taattcacattattg

SEQ ID NO: 401868 - DNA, 15 bp, Homo sapiens
aattcacattattga

SEQ ID NO: 401869 - DNA, 15 bp, Homo sapiens
attcacattattgaa

SEQ ID NO: 401870 - DNA, 15 bp, Homo sapiens
ttcacattattgaaa

SEQ ID NO: 401871 - DNA, 15 bp, Homo sapiens
tcacattattgaaat

SEQ ID NO: 401872 - DNA, 15 bp, Homo sapiens
cacattattgaaata

SEQ ID NO: 401873 - DNA, 15 bp, Homo sapiens
acattattgaaatat

SEQ ID NO: 401874 - DNA, 15 bp, Homo sapiens
cattattgaaatatt

SEQ ID NO: 401875 - DNA, 15 bp, Homo sapiens
attattgaaatattt

SEQ ID NO: 401876 - DNA, 15 bp, Homo sapiens
ttattgaaatattta

SEQ ID NO: 401877 - DNA, 15 bp, Homo sapiens
tattgaaatatttaa

SEQ ID NO: 401878 - DNA, 15 bp, Homo sapiens
attgaaatatttaaa

SEQ ID NO: 401879 - DNA, 15 bp, Homo sapiens
ttgaaatatttaaac

SEQ ID NO: 401880 - DNA, 15 bp, Homo sapiens
tgaaatatttaaacc

SEQ ID NO: 401881 - DNA, 15 bp, Homo sapiens
gaaatatttaaacct

SEQ ID NO: 401882 - DNA, 15 bp, Homo sapiens
aaatatttaaaccta

SEQ ID NO: 401883 - DNA, 15 bp, Homo sapiens
aatatttaaacctag

SEQ ID NO: 401884 - DNA, 15 bp, Homo sapiens
atatttaaacctagt

SEQ ID NO: 401885 - DNA, 15 bp, Homo sapiens
tatttaaacctagtc

SEQ ID NO: 401886 - DNA, 15 bp, Homo sapiens
atttaaacctagtca

SEQ ID NO: 401887 - DNA, 15 bp, Homo sapiens
tttaaacctagtcat

SEQ ID NO: 401888 - DNA, 15 bp, Homo sapiens
ttaaacctagtcatt

SEQ ID NO: 401889 - DNA, 15 bp, Homo sapiens
taaacctagtcattc

SEQ ID NO: 401890 - DNA, 15 bp, Homo sapiens
aaacctagtcattct

SEQ ID NO: 401891 - DNA, 15 bp, Homo sapiens
aacctagtcattctt

SEQ ID NO: 401892 - DNA, 15 bp, Homo sapiens
acctagtcattcttt

SEQ ID NO: 401893 - DNA, 15 bp, Homo sapiens
cctagtcattctttc

SEQ ID NO: 401894 - DNA, 15 bp, Homo sapiens
ctagtcattctttcc

SEQ ID NO: 401895 - DNA, 15 bp, Homo sapiens
tagtcattctttcct

SEQ ID NO: 401896 - DNA, 15 bp, Homo sapiens
agtcattctttcctt

SEQ ID NO: 401897 - DNA, 15 bp, Homo sapiens
gtcattctttccttt

SEQ ID NO: 401898 - DNA, 15 bp, Homo sapiens
tcattctttcctttg

SEQ ID NO: 401899 - DNA, 15 bp, Homo sapiens
cattctttcctttgg

SEQ ID NO: 401900 - DNA, 15 bp, Homo sapiens
attctttcctttggc

SEQ ID NO: 401901 - DNA, 15 bp, Homo sapiens
ttctttcctttggct

SEQ ID NO: 401902 - DNA, 15 bp, Homo sapiens
tctttcctttggctg

SEQ ID NO: 401903 - DNA, 15 bp, Homo sapiens
ctttcctttggctgt

SEQ ID NO: 401904 - DNA, 15 bp, Homo sapiens
tttcctttggctgtg

SEQ ID NO: 401905 - DNA, 15 bp, Homo sapiens
ttcctttggctgtga

SEQ ID NO: 401906 - DNA, 15 bp, Homo sapiens
tcctttggctgtgac

SEQ ID NO: 401907 - DNA, 15 bp, Homo sapiens
cctttggctgtgact

SEQ ID NO: 401908 - DNA, 15 bp, Homo sapiens
ctttggctgtgactt

SEQ ID NO: 401909 - DNA, 15 bp, Homo sapiens
tttggctgtgacttc

SEQ ID NO: 401910 - DNA, 15 bp, Homo sapiens
ttggctgtgacttct

SEQ ID NO: 401911 - DNA, 15 bp, Homo sapiens
tggctgtgacttctt

SEQ ID NO: 401912 - DNA, 15 bp, Homo sapiens
ggctgtgacttctta

SEQ ID NO: 401913 - DNA, 15 bp, Homo sapiens
gctgtgacttcttag

SEQ ID NO: 401914 - DNA, 15 bp, Homo sapiens
ctgtgacttcttaga

SEQ ID NO: 401915 - DNA, 15 bp, Homo sapiens
tgtgacttcttagaa

SEQ ID NO: 401916 - DNA, 15 bp, Homo sapiens
gtgacttcttagaaa

SEQ ID NO: 401917 - DNA, 15 bp, Homo sapiens
tgacttcttagaaaa

SEQ ID NO: 401918 - DNA, 15 bp, Homo sapiens
gacttcttagaaaat

SEQ ID NO: 401919 - DNA, 15 bp, Homo sapiens
acttcttagaaaatt

SEQ ID NO: 401920 - DNA, 15 bp, Homo sapiens
cttcttagaaaatta

SEQ ID NO: 401921 - DNA, 15 bp, Homo sapiens
ttcttagaaaattat

SEQ ID NO: 401922 - DNA, 15 bp, Homo sapiens
tcttagaaaattatt

SEQ ID NO: 401923 - DNA, 15 bp, Homo sapiens
cttagaaaattatta

SEQ ID NO: 401924 - DNA, 15 bp, Homo sapiens
ttagaaaattattat

SEQ ID NO: 401925 - DNA, 15 bp, Homo sapiens
tagaaaattattatt

SEQ ID NO: 401926 - DNA, 15 bp, Homo sapiens
agaaaattattattt

SEQ ID NO: 401927 - DNA, 15 bp, Homo sapiens
gaaaattattatttt

SEQ ID NO: 401928 - DNA, 15 bp, Homo sapiens
aaaattattattttt

SEQ ID NO: 401929 - DNA, 15 bp, Homo sapiens
ttattatttttttta

SEQ ID NO: 401930 - DNA, 15 bp, Homo sapiens
tattattttttttaa

SEQ ID NO: 401931 - DNA, 15 bp, Homo sapiens
attattttttttaaa

SEQ ID NO: 401932 - DNA, 15 bp, Homo sapiens
ttattttttttaaat

SEQ ID NO: 401933 - DNA, 15 bp, Homo sapiens
tattttttttaaata

SEQ ID NO: 401934 - DNA, 15 bp, Homo sapiens
attttttttaaatat

SEQ ID NO: 401935 - DNA, 15 bp, Homo sapiens
ttttttaaatatatg

SEQ ID NO: 401936 - DNA, 15 bp, Homo sapiens
tttttaaatatatga

SEQ ID NO: 401937 - DNA, 15 bp, Homo sapiens
ttttaaatatatgaa

SEQ ID NO: 401938 - DNA, 15 bp, Homo sapiens
tttaaatatatgaat

SEQ ID NO: 401939 - DNA, 15 bp, Homo sapiens
ttaaatatatgaatg

SEQ ID NO: 401940 - DNA, 15 bp, Homo sapiens
taaatatatgaatgt

SEQ ID NO: 401941 - DNA, 15 bp, Homo sapiens
aaatatatgaatgtg

SEQ ID NO: 401942 - DNA, 15 bp, Homo sapiens
aatatatgaatgtgg

SEQ ID NO: 401943 - DNA, 15 bp, Homo sapiens
atatatgaatgtggt

SEQ ID NO: 401944 - DNA, 15 bp, Homo sapiens
tatatgaatgtggtg

SEQ ID NO: 401945 - DNA, 15 bp, Homo sapiens
atatgaatgtggtga

SEQ ID NO: 401946 - DNA, 15 bp, Homo sapiens
tatgaatgtggtgac

SEQ ID NO: 401947 - DNA, 15 bp, Homo sapiens
atgaatgtggtgact

SEQ ID NO: 401948 - DNA, 15 bp, Homo sapiens
tgaatgtggtgactt

SEQ ID NO: 401949 - DNA, 15 bp, Homo sapiens
gaatgtggtgacttt

SEQ ID NO: 401950 - DNA, 15 bp, Homo sapiens
aatgtggtgactttt

SEQ ID NO: 401951 - DNA, 15 bp, Homo sapiens
atgtggtgacttttg

SEQ ID NO: 401952 - DNA, 15 bp, Homo sapiens
tgtggtgacttttga

SEQ ID NO: 401953 - DNA, 15 bp, Homo sapiens
gtggtgacttttgac

SEQ ID NO: 401954 - DNA, 15 bp, Homo sapiens
tggtgacttttgaca

SEQ ID NO: 401955 - DNA, 15 bp, Homo sapiens
ggtgacttttgacac

SEQ ID NO: 401956 - DNA, 15 bp, Homo sapiens
gtgacttttgacact

SEQ ID NO: 401957 - DNA, 15 bp, Homo sapiens
tgacttttgacactg

SEQ ID NO: 401958 - DNA, 15 bp, Homo sapiens
gacttttgacactgt

SEQ ID NO: 401959 - DNA, 15 bp, Homo sapiens
acttttgacactgta

SEQ ID NO: 401960 - DNA, 15 bp, Homo sapiens
cttttgacactgtat

SEQ ID NO: 401961 - DNA, 15 bp, Homo sapiens
ttttgacactgtatt

SEQ ID NO: 401962 - DNA, 15 bp, Homo sapiens
tttgacactgtattt

SEQ ID NO: 401963 - DNA, 15 bp, Homo sapiens
ttgacactgtatttg

SEQ ID NO: 401964 - DNA, 15 bp, Homo sapiens
tgacactgtatttgg

SEQ ID NO: 401965 - DNA, 15 bp, Homo sapiens
gacactgtatttggg

SEQ ID NO: 401966 - DNA, 15 bp, Homo sapiens
acactgtatttgggt

SEQ ID NO: 401967 - DNA, 15 bp, Homo sapiens
cactgtatttgggtg

SEQ ID NO: 401968 - DNA, 15 bp, Homo sapiens
actgtatttgggtgt

SEQ ID NO: 401969 - DNA, 15 bp, Homo sapiens
ctgtatttgggtgtt

SEQ ID NO: 401970 - DNA, 15 bp, Homo sapiens
tgtatttgggtgttt

SEQ ID NO: 401971 - DNA, 15 bp, Homo sapiens
gtatttgggtgttta

SEQ ID NO: 401972 - DNA, 15 bp, Homo sapiens
tatttgggtgtttat

SEQ ID NO: 401973 - DNA, 15 bp, Homo sapiens
atttgggtgtttatt

SEQ ID NO: 401974 - DNA, 15 bp, Homo sapiens
tttgggtgtttattt

SEQ ID NO: 401975 - DNA, 15 bp, Homo sapiens
ttgggtgtttattta

SEQ ID NO: 401976 - DNA, 15 bp, Homo sapiens
tgggtgtttatttat

SEQ ID NO: 401977 - DNA, 15 bp, Homo sapiens
gggtgtttatttata

SEQ ID NO: 401978 - DNA, 15 bp, Homo sapiens
ggtgtttatttataa

SEQ ID NO: 401979 - DNA, 15 bp, Homo sapiens
gtgtttatttataat

SEQ ID NO: 401980 - DNA, 15 bp, Homo sapiens
tgtttatttataatt

SEQ ID NO: 401981 - DNA, 15 bp, Homo sapiens
gtttatttataattt

SEQ ID NO: 401982 - DNA, 15 bp, Homo sapiens
tttatttataattta

SEQ ID NO: 401983 - DNA, 15 bp, Homo sapiens
ttatttataatttat

SEQ ID NO: 401984 - DNA, 15 bp, Homo sapiens
tatttataatttata

SEQ ID NO: 401985 - DNA, 15 bp, Homo sapiens
atttataatttatat

SEQ ID NO: 401986 - DNA, 15 bp, Homo sapiens
tttataatttatatg

SEQ ID NO: 401987 - DNA, 15 bp, Homo sapiens
ttataatttatatgt

SEQ ID NO: 401988 - DNA, 15 bp, Homo sapiens
tataatttatatgta

SEQ ID NO: 401989 - DNA, 15 bp, Homo sapiens
ataatttatatgtat

SEQ ID NO: 401990 - DNA, 15 bp, Homo sapiens
taatttatatgtatg

SEQ ID NO: 401991 - DNA, 15 bp, Homo sapiens
aatttatatgtatga

SEQ ID NO: 401992 - DNA, 15 bp, Homo sapiens
atttatatgtatgaa

SEQ ID NO: 401993 - DNA, 15 bp, Homo sapiens
tttatatgtatgaat

SEQ ID NO: 401994 - DNA, 15 bp, Homo sapiens
ttatatgtatgaatt

SEQ ID NO: 401995 - DNA, 15 bp, Homo sapiens
tatgtatgaatttta

SEQ ID NO: 401996 - DNA, 15 bp, Homo sapiens
atgtatgaattttaa

SEQ ID NO: 401997 - DNA, 15 bp, Homo sapiens
tgtatgaattttaag

SEQ ID NO: 401998 - DNA, 15 bp, Homo sapiens
gtatgaattttaagt

SEQ ID NO: 401999 - DNA, 15 bp, Homo sapiens
tatgaattttaagta

SEQ ID NO: 402000 - DNA, 15 bp, Homo sapiens
atgaattttaagtac

SEQ ID NO: 402001 - DNA, 15 bp, Homo sapiens
tgaattttaagtacc

SEQ ID NO: 402002 - DNA, 15 bp, Homo sapiens
gaattttaagtaccc

SEQ ID NO: 402003 - DNA, 15 bp, Homo sapiens
aattttaagtaccct

SEQ ID NO: 402004 - DNA, 15 bp, Homo sapiens
attttaagtacccta

SEQ ID NO: 402005 - DNA, 15 bp, Homo sapiens
ttttaagtaccctag

SEQ ID NO: 402006 - DNA, 15 bp, Homo sapiens
tttaagtaccctaga

SEQ ID NO: 402007 - DNA, 15 bp, Homo sapiens
ttaagtaccctagaa

SEQ ID NO: 402008 - DNA, 15 bp, Homo sapiens
taagtaccctagaat

SEQ ID NO: 402009 - DNA, 15 bp, Homo sapiens
aagtaccctagaatt

SEQ ID NO: 402010 - DNA, 15 bp, Homo sapiens
agtaccctagaattg

SEQ ID NO: 402011 - DNA, 15 bp, Homo sapiens
gtaccctagaattga

SEQ ID NO: 402012 - DNA, 15 bp, Homo sapiens
taccctagaattgag

SEQ ID NO: 402013 - DNA, 15 bp, Homo sapiens
accctagaattgagt

SEQ ID NO: 402014 - DNA, 15 bp, Homo sapiens
ccctagaattgagtg

SEQ ID NO: 402015 - DNA, 15 bp, Homo sapiens
cctagaattgagtgt

SEQ ID NO: 402016 - DNA, 15 bp, Homo sapiens
ctagaattgagtgta

SEQ ID NO: 402017 - DNA, 15 bp, Homo sapiens
tagaattgagtgtaa

SEQ ID NO: 402018 - DNA, 15 bp, Homo sapiens
agaattgagtgtaat

SEQ ID NO: 402019 - DNA, 15 bp, Homo sapiens
gaattgagtgtaata

SEQ ID NO: 402020 - DNA, 15 bp, Homo sapiens
aattgagtgtaatag

SEQ ID NO: 402021 - DNA, 15 bp, Homo sapiens
attgagtgtaatagt

SEQ ID NO: 402022 - DNA, 15 bp, Homo sapiens
ttgagtgtaatagtg

SEQ ID NO: 402023 - DNA, 15 bp, Homo sapiens
tgagtgtaatagtga

SEQ ID NO: 402024 - DNA, 15 bp, Homo sapiens
gagtgtaatagtgat

SEQ ID NO: 402025 - DNA, 15 bp, Homo sapiens
agtgtaatagtgata

SEQ ID NO: 402026 - DNA, 15 bp, Homo sapiens
gtgtaatagtgatag

SEQ ID NO: 402027 - DNA, 15 bp, Homo sapiens
tgtaatagtgatagt

SEQ ID NO: 402028 - DNA, 15 bp, Homo sapiens
gtaatagtgatagta

SEQ ID NO: 402029 - DNA, 15 bp, Homo sapiens
taatagtgatagtat

SEQ ID NO: 402030 - DNA, 15 bp, Homo sapiens
aatagtgatagtatt

SEQ ID NO: 402031 - DNA, 15 bp, Homo sapiens
atagtgatagtattt

SEQ ID NO: 402032 - DNA, 15 bp, Homo sapiens
tagtgatagtatttt

SEQ ID NO: 402033 - DNA, 15 bp, Homo sapiens
agtgatagtattttt

SEQ ID NO: 402034 - DNA, 15 bp, Homo sapiens
gtgatagtattttta

SEQ ID NO: 402035 - DNA, 15 bp, Homo sapiens
tgatagtatttttaa

SEQ ID NO: 402036 - DNA, 15 bp, Homo sapiens
gatagtatttttaaa

SEQ ID NO: 402037 - DNA, 15 bp, Homo sapiens
atagtatttttaaaa

SEQ ID NO: 402038 - DNA, 15 bp, Homo sapiens
tagtatttttaaaag

SEQ ID NO: 402039 - DNA, 15 bp, Homo sapiens
agtatttttaaaagt

SEQ ID NO: 402040 - DNA, 15 bp, Homo sapiens
tatttttaaaagtgg

SEQ ID NO: 402041 - DNA, 15 bp, Homo sapiens
atttttaaaagtgga

SEQ ID NO: 402042 - DNA, 15 bp, Homo sapiens
tttttaaaagtggaa

SEQ ID NO: 402043 - DNA, 15 bp, Homo sapiens
ttttaaaagtggaaa

SEQ ID NO: 402044 - DNA, 15 bp, Homo sapiens
tttaaaagtggaaat

SEQ ID NO: 402045 - DNA, 15 bp, Homo sapiens
ttaaaagtggaaatt

SEQ ID NO: 402046 - DNA, 15 bp, Homo sapiens
taaaagtggaaattt

SEQ ID NO: 402047 - DNA, 15 bp, Homo sapiens
aaaagtggaaatttt

SEQ ID NO: 402048 - DNA, 15 bp, Homo sapiens
aaagtggaaattttt

SEQ ID NO: 402049 - DNA, 15 bp, Homo sapiens
aagtggaaattttta

SEQ ID NO: 402050 - DNA, 15 bp, Homo sapiens
agtggaaatttttaa

SEQ ID NO: 402051 - DNA, 15 bp, Homo sapiens
gtggaaatttttaag

SEQ ID NO: 402052 - DNA, 15 bp, Homo sapiens
tggaaatttttaagg

SEQ ID NO: 402053 - DNA, 15 bp, Homo sapiens
ggaaatttttaaggt

SEQ ID NO: 402054 - DNA, 15 bp, Homo sapiens
gaaatttttaaggta

SEQ ID NO: 402055 - DNA, 15 bp, Homo sapiens
aaatttttaaggtat

SEQ ID NO: 402056 - DNA, 15 bp, Homo sapiens
aatttttaaggtata

SEQ ID NO: 402057 - DNA, 15 bp, Homo sapiens
atttttaaggtatag

SEQ ID NO: 402058 - DNA, 15 bp, Homo sapiens
tttttaaggtatagt

SEQ ID NO: 402059 - DNA, 15 bp, Homo sapiens
ttttaaggtatagta

SEQ ID NO: 402060 - DNA, 15 bp, Homo sapiens
tttaaggtatagtat

SEQ ID NO: 402061 - DNA, 15 bp, Homo sapiens
ttaaggtatagtatg

SEQ ID NO: 402062 - DNA, 15 bp, Homo sapiens
taaggtatagtatgt

SEQ ID NO: 402063 - DNA, 15 bp, Homo sapiens
aaggtatagtatgtt

SEQ ID NO: 402064 - DNA, 15 bp, Homo sapiens
aggtatagtatgttg

SEQ ID NO: 402065 - DNA, 15 bp, Homo sapiens
ggtatagtatgttgc

SEQ ID NO: 402066 - DNA, 15 bp, Homo sapiens
gtatagtatgttgca

SEQ ID NO: 402067 - DNA, 15 bp, Homo sapiens
tatagtatgttgcaa

SEQ ID NO: 402068 - DNA, 15 bp, Homo sapiens
atagtatgttgcaaa

SEQ ID NO: 402069 - DNA, 15 bp, Homo sapiens
tagtatgttgcaaat

SEQ ID NO: 402070 - DNA, 15 bp, Homo sapiens
agtatgttgcaaatt

SEQ ID NO: 402071 - DNA, 15 bp, Homo sapiens
gtatgttgcaaattt

SEQ ID NO: 402072 - DNA, 15 bp, Homo sapiens
tatgttgcaaatttt

SEQ ID NO: 402073 - DNA, 15 bp, Homo sapiens
atgttgcaaattttt

SEQ ID NO: 402074 - DNA, 15 bp, Homo sapiens
tgttgcaaattttta

SEQ ID NO: 402075 - DNA, 15 bp, Homo sapiens
gttgcaaatttttaa

SEQ ID NO: 402076 - DNA, 15 bp, Homo sapiens
ttgcaaatttttaat

SEQ ID NO: 402077 - DNA, 15 bp, Homo sapiens
tgcaaatttttaata

SEQ ID NO: 402078 - DNA, 15 bp, Homo sapiens
gcaaatttttaataa

SEQ ID NO: 402079 - DNA, 15 bp, Homo sapiens
caaatttttaataaa

SEQ ID NO: 402080 - DNA, 15 bp, Homo sapiens
aatttttaataaaag

SEQ ID NO: 402081 - DNA, 15 bp, Homo sapiens
atttttaataaaagt

SEQ ID NO: 402082 - DNA, 15 bp, Homo sapiens
tttttaataaaagtt

SEQ ID NO: 402083 - DNA, 15 bp, Homo sapiens
ttttaataaaagttt

SEQ ID NO: 402084 - DNA, 15 bp, Homo sapiens
tttaataaaagtttc

SEQ ID NO: 402085 - DNA, 15 bp, Homo sapiens
ttaataaaagtttct

SEQ ID NO: 402086 - DNA, 15 bp, Homo sapiens
taataaaagtttcta

SEQ ID NO: 402087 - DNA, 15 bp, Homo sapiens
aataaaagtttctat

SEQ ID NO: 402088 - DNA, 15 bp, Homo sapiens
ataaaagtttctatt

SEQ ID NO: 402089 - DNA, 15 bp, Homo sapiens
taaaagtttctattc

SEQ ID NO: 402090 - DNA, 15 bp, Homo sapiens
aaaagtttctattcc

SEQ ID NO: 402091 - DNA, 15 bp, Homo sapiens
aaagtttctattcca

SEQ ID NO: 402092 - DNA, 15 bp, Homo sapiens
aagtttctattccat

SEQ ID NO: 402093 - DNA, 15 bp, Homo sapiens
agtttctattccatc

SEQ ID NO: 402094 - DNA, 15 bp, Homo sapiens
gtttctattccatcg

SEQ ID NO: 402095 - DNA, 15 bp, Homo sapiens
tttctattccatcga

SEQ ID NO: 402096 - DNA, 15 bp, Homo sapiens
ttctattccatcgaa

SEQ ID NO: 402097 - DNA, 15 bp, Homo sapiens
tctattccatcgaag

SEQ ID NO: 402098 - DNA, 15 bp, Homo sapiens
ctattccatcgaagt

SEQ ID NO: 402099 - DNA, 15 bp, Homo sapiens
tattccatcgaagtg

SEQ ID NO: 402100 - DNA, 15 bp, Homo sapiens
attccatcgaagtgt

SEQ ID NO: 402101 - DNA, 15 bp, Homo sapiens
ttccatcgaagtgta

SEQ ID NO: 402102 - DNA, 15 bp, Homo sapiens
tccatcgaagtgtaa

SEQ ID NO: 402103 - DNA, 15 bp, Homo sapiens
ccatcgaagtgtaag

SEQ ID NO: 402104 - DNA, 15 bp, Homo sapiens
catcgaagtgtaagc

SEQ ID NO: 402105 - DNA, 15 bp, Homo sapiens
atcgaagtgtaagcc

SEQ ID NO: 402106 - DNA, 15 bp, Homo sapiens
tcgaagtgtaagccg

SEQ ID NO: 402107 - DNA, 15 bp, Homo sapiens
cgaagtgtaagccgt

SEQ ID NO: 402108 - DNA, 15 bp, Homo sapiens
gaagtgtaagccgtc

SEQ ID NO: 402109 - DNA, 15 bp, Homo sapiens
aagtgtaagccgtca

SEQ ID NO: 402110 - DNA, 15 bp, Homo sapiens
agtgtaagccgtcat

SEQ ID NO: 402111 - DNA, 15 bp, Homo sapiens
gtgtaagccgtcatg

SEQ ID NO: 402112 - DNA, 15 bp, Homo sapiens
tgtaagccgtcatga

SEQ ID NO: 402113 - DNA, 15 bp, Homo sapiens
gtaagccgtcatgat

SEQ ID NO: 402114 - DNA, 15 bp, Homo sapiens
taagccgtcatgatt

SEQ ID NO: 402115 - DNA, 15 bp, Homo sapiens
aagccgtcatgattt

SEQ ID NO: 402116 - DNA, 15 bp, Homo sapiens
agccgtcatgatttg

SEQ ID NO: 402117 - DNA, 15 bp, Homo sapiens
gccgtcatgatttgt

SEQ ID NO: 402118 - DNA, 15 bp, Homo sapiens
ccgtcatgatttgtt

SEQ ID NO: 402119 - DNA, 15 bp, Homo sapiens
cgtcatgatttgttt

SEQ ID NO: 402120 - DNA, 15 bp, Homo sapiens
gtcatgatttgtttc

SEQ ID NO: 402121 - DNA, 15 bp, Homo sapiens
tcatgatttgtttca

SEQ ID NO: 402122 - DNA, 15 bp, Homo sapiens
catgatttgtttcat

SEQ ID NO: 402123 - DNA, 15 bp, Homo sapiens
atgatttgtttcata

SEQ ID NO: 402124 - DNA, 15 bp, Homo sapiens
tgatttgtttcatac

SEQ ID NO: 402125 - DNA, 15 bp, Homo sapiens
gatttgtttcatact

SEQ ID NO: 402126 - DNA, 15 bp, Homo sapiens
atttgtttcatactt

SEQ ID NO: 402127 - DNA, 15 bp, Homo sapiens
tttgtttcatacttt

SEQ ID NO: 402128 - DNA, 15 bp, Homo sapiens
ttgtttcatactttc

SEQ ID NO: 402129 - DNA, 15 bp, Homo sapiens
tgtttcatactttct

SEQ ID NO: 402130 - DNA, 15 bp, Homo sapiens
gtttcatactttctt

SEQ ID NO: 402131 - DNA, 15 bp, Homo sapiens
tttcatactttctta

SEQ ID NO: 402132 - DNA, 15 bp, Homo sapiens
ttcatactttcttat

SEQ ID NO: 402133 - DNA, 15 bp, Homo sapiens
tcatactttcttatg

SEQ ID NO: 402134 - DNA, 15 bp, Homo sapiens
catactttcttatgc

SEQ ID NO: 402135 - DNA, 15 bp, Homo sapiens
atactttcttatgct

SEQ ID NO: 402136 - DNA, 15 bp, Homo sapiens
tactttcttatgctt

SEQ ID NO: 402137 - DNA, 15 bp, Homo sapiens
actttcttatgcttg

SEQ ID NO: 402138 - DNA, 15 bp, Homo sapiens
ctttcttatgcttgt

SEQ ID NO: 402139 - DNA, 15 bp, Homo sapiens
tttcttatgcttgta

SEQ ID NO: 402140 - DNA, 15 bp, Homo sapiens
ttcttatgcttgtaa

SEQ ID NO: 402141 - DNA, 15 bp, Homo sapiens
tcttatgcttgtaat

SEQ ID NO: 402142 - DNA, 15 bp, Homo sapiens
cttatgcttgtaatt

SEQ ID NO: 402143 - DNA, 15 bp, Homo sapiens
ttatgcttgtaatta

SEQ ID NO: 402144 - DNA, 15 bp, Homo sapiens
tatgcttgtaattag

SEQ ID NO: 402145 - DNA, 15 bp, Homo sapiens
atgcttgtaattaga

SEQ ID NO: 402146 - DNA, 15 bp, Homo sapiens
tgcttgtaattagag

SEQ ID NO: 402147 - DNA, 15 bp, Homo sapiens
gcttgtaattagaga

SEQ ID NO: 402148 - DNA, 15 bp, Homo sapiens
cttgtaattagagaa

SEQ ID NO: 402149 - DNA, 15 bp, Homo sapiens
ttgtaattagagaaa

SEQ ID NO: 402150 - DNA, 15 bp, Homo sapiens
tgtaattagagaaaa

SEQ ID NO: 402151 - DNA, 15 bp, Homo sapiens
gtaattagagaaaat

SEQ ID NO: 402152 - DNA, 15 bp, Homo sapiens
taattagagaaaatg

SEQ ID NO: 402153 - DNA, 15 bp, Homo sapiens
aattagagaaaatgt

SEQ ID NO: 402154 - DNA, 15 bp, Homo sapiens
attagagaaaatgtg

SEQ ID NO: 402155 - DNA, 15 bp, Homo sapiens
ttagagaaaatgtgg

SEQ ID NO: 402156 - DNA, 15 bp, Homo sapiens
tagagaaaatgtggc

SEQ ID NO: 402157 - DNA, 15 bp, Homo sapiens
agagaaaatgtggca

SEQ ID NO: 402158 - DNA, 15 bp, Homo sapiens
gagaaaatgtggcac

SEQ ID NO: 402159 - DNA, 15 bp, Homo sapiens
agaaaatgtggcaca

SEQ ID NO: 402160 - DNA, 15 bp, Homo sapiens
gaaaatgtggcacat

SEQ ID NO: 402161 - DNA, 15 bp, Homo sapiens
aaaatgtggcacata

SEQ ID NO: 402162 - DNA, 15 bp, Homo sapiens
aaatgtggcacatat

SEQ ID NO: 402163 - DNA, 15 bp, Homo sapiens
aatgtggcacatata

SEQ ID NO: 402164 - DNA, 15 bp, Homo sapiens
atgtggcacatatac

SEQ ID NO: 402165 - DNA, 15 bp, Homo sapiens
tgtggcacatataca

SEQ ID NO: 402166 - DNA, 15 bp, Homo sapiens
acaccatggagtact

SEQ ID NO: 402167 - DNA, 15 bp, Homo sapiens
caccatggagtacta

SEQ ID NO: 402168 - DNA, 15 bp, Homo sapiens
accatggagtactat

SEQ ID NO: 402169 - DNA, 15 bp, Homo sapiens
ccatggagtactatg

SEQ ID NO: 402170 - DNA, 15 bp, Homo sapiens
catggagtactatgc

SEQ ID NO: 402171 - DNA, 15 bp, Homo sapiens
atggagtactatgca

SEQ ID NO: 402172 - DNA, 15 bp, Homo sapiens
tggagtactatgcag

SEQ ID NO: 402173 - DNA, 15 bp, Homo sapiens
ggagtactatgcagc

SEQ ID NO: 402174 - DNA, 15 bp, Homo sapiens
gagtactatgcagcc

SEQ ID NO: 402175 - DNA, 15 bp, Homo sapiens
agtactatgcagcca

SEQ ID NO: 402176 - DNA, 15 bp, Homo sapiens
gtactatgcagccat

SEQ ID NO: 402177 - DNA, 15 bp, Homo sapiens
tgcagccataaaaaa

SEQ ID NO: 402178 - DNA, 15 bp, Homo sapiens
gcagccataaaaaat

SEQ ID NO: 402179 - DNA, 15 bp, Homo sapiens
gccataaaaaatgag

SEQ ID NO: 402180 - DNA, 15 bp, Homo sapiens
ccataaaaaatgagt

SEQ ID NO: 402181 - DNA, 15 bp, Homo sapiens
cataaaaaatgagtt

SEQ ID NO: 402182 - DNA, 15 bp, Homo sapiens
ataaaaaatgagttc

SEQ ID NO: 402183 - DNA, 15 bp, Homo sapiens
taaaaaatgagttca

SEQ ID NO: 402184 - DNA, 15 bp, Homo sapiens
aaaaaatgagttcac

SEQ ID NO: 402185 - DNA, 15 bp, Homo sapiens
aaaaatgagttcacg

SEQ ID NO: 402186 - DNA, 15 bp, Homo sapiens
aaaatgagttcacgt

SEQ ID NO: 402187 - DNA, 15 bp, Homo sapiens
aaatgagttcacgtc

SEQ ID NO: 402188 - DNA, 15 bp, Homo sapiens
aatgagttcacgtcc

SEQ ID NO: 402189 - DNA, 15 bp, Homo sapiens
atgagttcacgtccc

SEQ ID NO: 402190 - DNA, 15 bp, Homo sapiens
tgagttcacgtccct

SEQ ID NO: 402191 - DNA, 15 bp, Homo sapiens
gagttcacgtccctt

SEQ ID NO: 402192 - DNA, 15 bp, Homo sapiens
agttcacgtcccttg

SEQ ID NO: 402193 - DNA, 15 bp, Homo sapiens
gttcacgtcccttgc

SEQ ID NO: 402194 - DNA, 15 bp, Homo sapiens
ttcacgtcccttgca

SEQ ID NO: 402195 - DNA, 15 bp, Homo sapiens
tcacgtcccttgcaa

SEQ ID NO: 402196 - DNA, 15 bp, Homo sapiens
cacgtcccttgcaag

SEQ ID NO: 402197 - DNA, 15 bp, Homo sapiens
acgtcccttgcaagg

SEQ ID NO: 402198 - DNA, 15 bp, Homo sapiens
cgtcccttgcaagga

SEQ ID NO: 402199 - DNA, 15 bp, Homo sapiens
gtcccttgcaaggac

SEQ ID NO: 402200 - DNA, 15 bp, Homo sapiens
tcccttgcaaggaca

SEQ ID NO: 402201 - DNA, 15 bp, Homo sapiens
cccttgcaaggacat

SEQ ID NO: 402202 - DNA, 15 bp, Homo sapiens
ccttgcaaggacata

SEQ ID NO: 402203 - DNA, 15 bp, Homo sapiens
cttgcaaggacatag

SEQ ID NO: 402204 - DNA, 15 bp, Homo sapiens
ttgcaaggacataga

SEQ ID NO: 402205 - DNA, 15 bp, Homo sapiens
tgcaaggacatagat

SEQ ID NO: 402206 - DNA, 15 bp, Homo sapiens
gcaaggacatagatg

SEQ ID NO: 402207 - DNA, 15 bp, Homo sapiens
caaggacatagatga

SEQ ID NO: 402208 - DNA, 15 bp, Homo sapiens
aaggacatagatgaa

SEQ ID NO: 402209 - DNA, 15 bp, Homo sapiens
aggacatagatgaag

SEQ ID NO: 402210 - DNA, 15 bp, Homo sapiens
ggacatagatgaagc

SEQ ID NO: 402211 - DNA, 15 bp, Homo sapiens
gacatagatgaagct

SEQ ID NO: 402212 - DNA, 15 bp, Homo sapiens
acatagatgaagctg

SEQ ID NO: 402213 - DNA, 15 bp, Homo sapiens
catagatgaagctgg

SEQ ID NO: 402214 - DNA, 15 bp, Homo sapiens
atagatgaagctgga

SEQ ID NO: 402215 - DNA, 15 bp, Homo sapiens
tagatgaagctggaa

SEQ ID NO: 402216 - DNA, 15 bp, Homo sapiens
agatgaagctggaaa

SEQ ID NO: 402217 - DNA, 15 bp, Homo sapiens
gatgaagctggaaac

SEQ ID NO: 402218 - DNA, 15 bp, Homo sapiens
atgaagctggaaacc

SEQ ID NO: 402219 - DNA, 15 bp, Homo sapiens
tgaagctggaaacca

SEQ ID NO: 402220 - DNA, 15 bp, Homo sapiens
gaagctggaaaccat

SEQ ID NO: 402221 - DNA, 15 bp, Homo sapiens
aagctggaaaccatc

SEQ ID NO: 402222 - DNA, 15 bp, Homo sapiens
agctggaaaccatca

SEQ ID NO: 402223 - DNA, 15 bp, Homo sapiens
gctggaaaccatcat

SEQ ID NO: 402224 - DNA, 15 bp, Homo sapiens
ctggaaaccatcatt

SEQ ID NO: 402225 - DNA, 15 bp, Homo sapiens
tggaaaccatcattc

SEQ ID NO: 402226 - DNA, 15 bp, Homo sapiens
ggaaaccatcattct

SEQ ID NO: 402227 - DNA, 15 bp, Homo sapiens
gaaaccatcattctc

SEQ ID NO: 402228 - DNA, 15 bp, Homo sapiens
aaaccatcattctca

SEQ ID NO: 402229 - DNA, 15 bp, Homo sapiens
aaccatcattctcag

SEQ ID NO: 402230 - DNA, 15 bp, Homo sapiens
accatcattctcagc

SEQ ID NO: 402231 - DNA, 15 bp, Homo sapiens
ccatcattctcagca

SEQ ID NO: 402232 - DNA, 15 bp, Homo sapiens
catcattctcagcaa

SEQ ID NO: 402233 - DNA, 15 bp, Homo sapiens
atcattctcagcaaa

SEQ ID NO: 402234 - DNA, 15 bp, Homo sapiens
tcattctcagcaaac

SEQ ID NO: 402235 - DNA, 15 bp, Homo sapiens
cattctcagcaaact

SEQ ID NO: 402236 - DNA, 15 bp, Homo sapiens
attctcagcaaactc

SEQ ID NO: 402237 - DNA, 15 bp, Homo sapiens
ttctcagcaaactca

SEQ ID NO: 402238 - DNA, 15 bp, Homo sapiens
tctcagcaaactcac

SEQ ID NO: 402239 - DNA, 15 bp, Homo sapiens
ctcagcaaactcaca

SEQ ID NO: 402240 - DNA, 15 bp, Homo sapiens
cagcaaactcacaca

SEQ ID NO: 402241 - DNA, 15 bp, Homo sapiens
agcaaactcacacag

SEQ ID NO: 402242 - DNA, 15 bp, Homo sapiens
gcaaactcacacagg

SEQ ID NO: 402243 - DNA, 15 bp, Homo sapiens
caaactcacacagga

SEQ ID NO: 402244 - DNA, 15 bp, Homo sapiens
aaactcacacaggaa

SEQ ID NO: 402245 - DNA, 15 bp, Homo sapiens
aactcacacaggaac

SEQ ID NO: 402246 - DNA, 15 bp, Homo sapiens
actcacacaggaaca

SEQ ID NO: 402247 - DNA, 15 bp, Homo sapiens
ctcacacaggaacag

SEQ ID NO: 402248 - DNA, 15 bp, Homo sapiens
tcacacaggaacaga

SEQ ID NO: 402249 - DNA, 15 bp, Homo sapiens
cacacaggaacagaa

SEQ ID NO: 402250 - DNA, 15 bp, Homo sapiens
acacaggaacagaaa

SEQ ID NO: 402251 - DNA, 15 bp, Homo sapiens
cacaggaacagaaaa

SEQ ID NO: 402252 - DNA, 15 bp, Homo sapiens
acaggaacagaaaac

SEQ ID NO: 402253 - DNA, 15 bp, Homo sapiens
aacagaaaaccaaac

SEQ ID NO: 402254 - DNA, 15 bp, Homo sapiens
acagaaaaccaaacc

SEQ ID NO: 402255 - DNA, 15 bp, Homo sapiens
cagaaaaccaaaccc

SEQ ID NO: 402256 - DNA, 15 bp, Homo sapiens
agaaaaccaaaccct

SEQ ID NO: 402257 - DNA, 15 bp, Homo sapiens
gaaaaccaaaccctg

SEQ ID NO: 402258 - DNA, 15 bp, Homo sapiens
aaaaccaaaccctgc

SEQ ID NO: 402259 - DNA, 15 bp, Homo sapiens
aaaccaaaccctgca

SEQ ID NO: 402260 - DNA, 15 bp, Homo sapiens
aaccaaaccctgcat

SEQ ID NO: 402261 - DNA, 15 bp, Homo sapiens
accaaaccctgcatg

SEQ ID NO: 402262 - DNA, 15 bp, Homo sapiens
ccaaaccctgcatgt

SEQ ID NO: 402263 - DNA, 15 bp, Homo sapiens
caaaccctgcatgtt

SEQ ID NO: 402264 - DNA, 15 bp, Homo sapiens
aaaccctgcatgttc

SEQ ID NO: 402265 - DNA, 15 bp, Homo sapiens
aaccctgcatgttct

SEQ ID NO: 402266 - DNA, 15 bp, Homo sapiens
accctgcatgttctc

SEQ ID NO: 402267 - DNA, 15 bp, Homo sapiens
ccctgcatgttctca

SEQ ID NO: 402268 - DNA, 15 bp, Homo sapiens
cctgcatgttctcac

SEQ ID NO: 402269 - DNA, 15 bp, Homo sapiens
ctgcatgttctcact

SEQ ID NO: 402270 - DNA, 15 bp, Homo sapiens
tgcatgttctcactc

SEQ ID NO: 402271 - DNA, 15 bp, Homo sapiens
ttctcactcataagt

SEQ ID NO: 402272 - DNA, 15 bp, Homo sapiens
tctcactcataagtg

SEQ ID NO: 402273 - DNA, 15 bp, Homo sapiens
ctcactcataagtgg

SEQ ID NO: 402274 - DNA, 15 bp, Homo sapiens
tcactcataagtggg

SEQ ID NO: 402275 - DNA, 15 bp, Homo sapiens
cactcataagtggga

SEQ ID NO: 402276 - DNA, 15 bp, Homo sapiens
actcataagtgggag

SEQ ID NO: 402277 - DNA, 15 bp, Homo sapiens
ctcataagtgggagt

SEQ ID NO: 402278 - DNA, 15 bp, Homo sapiens
tcataagtgggagtt

SEQ ID NO: 402279 - DNA, 15 bp, Homo sapiens
cataagtgggagttg

SEQ ID NO: 402280 - DNA, 15 bp, Homo sapiens
ataagtgggagttga

SEQ ID NO: 402281 - DNA, 15 bp, Homo sapiens
taagtgggagttgaa

SEQ ID NO: 402282 - DNA, 15 bp, Homo sapiens
aagtgggagttgaac

SEQ ID NO: 402283 - DNA, 15 bp, Homo sapiens
agtgggagttgaaca

SEQ ID NO: 402284 - DNA, 15 bp, Homo sapiens
gtgggagttgaacaa

SEQ ID NO: 402285 - DNA, 15 bp, Homo sapiens
tgggagttgaacaat

SEQ ID NO: 402286 - DNA, 15 bp, Homo sapiens
gggagttgaacaatg

SEQ ID NO: 402287 - DNA, 15 bp, Homo sapiens
ggagttgaacaatga

SEQ ID NO: 402288 - DNA, 15 bp, Homo sapiens
gagttgaacaatgag

SEQ ID NO: 402289 - DNA, 15 bp, Homo sapiens
agttgaacaatgaga

SEQ ID NO: 402290 - DNA, 15 bp, Homo sapiens
gttgaacaatgagaa

SEQ ID NO: 402291 - DNA, 15 bp, Homo sapiens
ttgaacaatgagaac

SEQ ID NO: 402292 - DNA, 15 bp, Homo sapiens
tgaacaatgagaaca

SEQ ID NO: 402293 - DNA, 15 bp, Homo sapiens
gaacaatgagaacac

SEQ ID NO: 402294 - DNA, 15 bp, Homo sapiens
aacaatgagaacaca

SEQ ID NO: 402295 - DNA, 15 bp, Homo sapiens
acaatgagaacacat

SEQ ID NO: 402296 - DNA, 15 bp, Homo sapiens
caatgagaacacatg

SEQ ID NO: 402297 - DNA, 15 bp, Homo sapiens
aatgagaacacatgg

SEQ ID NO: 402298 - DNA, 15 bp, Homo sapiens
atgagaacacatgga

SEQ ID NO: 402299 - DNA, 15 bp, Homo sapiens
tgagaacacatggac

SEQ ID NO: 402300 - DNA, 15 bp, Homo sapiens
gagaacacatggaca

SEQ ID NO: 402301 - DNA, 15 bp, Homo sapiens
agaacacatggacac

SEQ ID NO: 402302 - DNA, 15 bp, Homo sapiens
gaacacatggacaca

SEQ ID NO: 402303 - DNA, 15 bp, Homo sapiens
aacacatggacacag

SEQ ID NO: 402304 - DNA, 15 bp, Homo sapiens
acacatggacacagg

SEQ ID NO: 402305 - DNA, 15 bp, Homo sapiens
cacatggacacaggg

SEQ ID NO: 402306 - DNA, 15 bp, Homo sapiens
acatggacacaggga

SEQ ID NO: 402307 - DNA, 15 bp, Homo sapiens
catggacacagggag

SEQ ID NO: 402308 - DNA, 15 bp, Homo sapiens
atggacacagggaga

SEQ ID NO: 402309 - DNA, 15 bp, Homo sapiens
tggacacagggagag

SEQ ID NO: 402310 - DNA, 15 bp, Homo sapiens
ggacacagggagagg

SEQ ID NO: 402311 - DNA, 15 bp, Homo sapiens
gacacagggagagga

SEQ ID NO: 402312 - DNA, 15 bp, Homo sapiens
acacagggagaggaa

SEQ ID NO: 402313 - DNA, 15 bp, Homo sapiens
cacagggagaggaac

SEQ ID NO: 402314 - DNA, 15 bp, Homo sapiens
acagggagaggaaca

SEQ ID NO: 402315 - DNA, 15 bp, Homo sapiens
cagggagaggaacat

SEQ ID NO: 402316 - DNA, 15 bp, Homo sapiens
agggagaggaacatc

SEQ ID NO: 402317 - DNA, 15 bp, Homo sapiens
gggagaggaacatca

SEQ ID NO: 402318 - DNA, 15 bp, Homo sapiens
ggagaggaacatcac

SEQ ID NO: 402319 - DNA, 15 bp, Homo sapiens
gagaggaacatcaca

SEQ ID NO: 402320 - DNA, 15 bp, Homo sapiens
agaggaacatcacac

SEQ ID NO: 402321 - DNA, 15 bp, Homo sapiens
gaggaacatcacaca

SEQ ID NO: 402322 - DNA, 15 bp, Homo sapiens
aggaacatcacacac

SEQ ID NO: 402323 - DNA, 15 bp, Homo sapiens
ggaacatcacacact

SEQ ID NO: 402324 - DNA, 15 bp, Homo sapiens
gaacatcacacactg

SEQ ID NO: 402325 - DNA, 15 bp, Homo sapiens
aacatcacacactgg

SEQ ID NO: 402326 - DNA, 15 bp, Homo sapiens
acatcacacactggg

SEQ ID NO: 402327 - DNA, 15 bp, Homo sapiens
catcacacactgggg

SEQ ID NO: 402328 - DNA, 15 bp, Homo sapiens
atcacacactggggc

SEQ ID NO: 402329 - DNA, 15 bp, Homo sapiens
tcacacactggggcc

SEQ ID NO: 402330 - DNA, 15 bp, Homo sapiens
cacacactggggcct

SEQ ID NO: 402331 - DNA, 15 bp, Homo sapiens
acacactggggcctg

SEQ ID NO: 402332 - DNA, 15 bp, Homo sapiens
cacactggggcctgt

SEQ ID NO: 402333 - DNA, 15 bp, Homo sapiens
acactggggcctgtc

SEQ ID NO: 402334 - DNA, 15 bp, Homo sapiens
cactggggcctgtca

SEQ ID NO: 402335 - DNA, 15 bp, Homo sapiens
actggggcctgtcag

SEQ ID NO: 402336 - DNA, 15 bp, Homo sapiens
ctggggcctgtcagg

SEQ ID NO: 402337 - DNA, 15 bp, Homo sapiens
tggggcctgtcaggg

SEQ ID NO: 402338 - DNA, 15 bp, Homo sapiens
ggggcctgtcagggg

SEQ ID NO: 402339 - DNA, 15 bp, Homo sapiens
gggcctgtcaggggg

SEQ ID NO: 402340 - DNA, 15 bp, Homo sapiens
ggcctgtcagggggt

SEQ ID NO: 402341 - DNA, 15 bp, Homo sapiens
gcctgtcagggggtg

SEQ ID NO: 402342 - DNA, 15 bp, Homo sapiens
cctgtcagggggtgg

SEQ ID NO: 402343 - DNA, 15 bp, Homo sapiens
ctgtcagggggtggg

SEQ ID NO: 402344 - DNA, 15 bp, Homo sapiens
tgtcagggggtgggg

SEQ ID NO: 402345 - DNA, 15 bp, Homo sapiens
gtcagggggtggggg

SEQ ID NO: 402346 - DNA, 15 bp, Homo sapiens
tcagggggtgggggg

SEQ ID NO: 402347 - DNA, 15 bp, Homo sapiens
cagggggtggggggc

SEQ ID NO: 402348 - DNA, 15 bp, Homo sapiens
agggggtggggggct

SEQ ID NO: 402349 - DNA, 15 bp, Homo sapiens
gggggtggggggcta

SEQ ID NO: 402350 - DNA, 15 bp, Homo sapiens
ggggtggggggctag

SEQ ID NO: 402351 - DNA, 15 bp, Homo sapiens
gggtggggggctagg

SEQ ID NO: 402352 - DNA, 15 bp, Homo sapiens
ggtggggggctaggg

SEQ ID NO: 402353 - DNA, 15 bp, Homo sapiens
gtggggggctagggg

SEQ ID NO: 402354 - DNA, 15 bp, Homo sapiens
tggggggctagggga

SEQ ID NO: 402355 - DNA, 15 bp, Homo sapiens
ggggggctaggggag

SEQ ID NO: 402356 - DNA, 15 bp, Homo sapiens
gggggctaggggagg

SEQ ID NO: 402357 - DNA, 15 bp, Homo sapiens
ggggctaggggaggg

SEQ ID NO: 402358 - DNA, 15 bp, Homo sapiens
gggctaggggaggga

SEQ ID NO: 402359 - DNA, 15 bp, Homo sapiens
gctaggggagggaga

SEQ ID NO: 402360 - DNA, 15 bp, Homo sapiens
ctaggggagggagag

SEQ ID NO: 402361 - DNA, 15 bp, Homo sapiens
taggggagggagagc

SEQ ID NO: 402362 - DNA, 15 bp, Homo sapiens
aggggagggagagca

SEQ ID NO: 402363 - DNA, 15 bp, Homo sapiens
ggggagggagagcat

SEQ ID NO: 402364 - DNA, 15 bp, Homo sapiens
gggagggagagcatt

SEQ ID NO: 402365 - DNA, 15 bp, Homo sapiens
ggagggagagcatta

SEQ ID NO: 402366 - DNA, 15 bp, Homo sapiens
gagggagagcattag

SEQ ID NO: 402367 - DNA, 15 bp, Homo sapiens
agggagagcattagg

SEQ ID NO: 402368 - DNA, 15 bp, Homo sapiens
gggagagcattagga

SEQ ID NO: 402369 - DNA, 15 bp, Homo sapiens
ggagagcattaggag

SEQ ID NO: 402370 - DNA, 15 bp, Homo sapiens
gagagcattaggaga

SEQ ID NO: 402371 - DNA, 15 bp, Homo sapiens
agagcattaggagaa

SEQ ID NO: 402372 - DNA, 15 bp, Homo sapiens
gagcattaggagaaa

SEQ ID NO: 402373 - DNA, 15 bp, Homo sapiens
agcattaggagaaat

SEQ ID NO: 402374 - DNA, 15 bp, Homo sapiens
gcattaggagaaata

SEQ ID NO: 402375 - DNA, 15 bp, Homo sapiens
cattaggagaaatac

SEQ ID NO: 402376 - DNA, 15 bp, Homo sapiens
attaggagaaatacc

SEQ ID NO: 402377 - DNA, 15 bp, Homo sapiens
ttaggagaaatacct

SEQ ID NO: 402378 - DNA, 15 bp, Homo sapiens
taggagaaataccta

SEQ ID NO: 402379 - DNA, 15 bp, Homo sapiens
aggagaaatacctac

SEQ ID NO: 402380 - DNA, 15 bp, Homo sapiens
ggagaaatacctact

SEQ ID NO: 402381 - DNA, 15 bp, Homo sapiens
gagaaatacctacta

SEQ ID NO: 402382 - DNA, 15 bp, Homo sapiens
agaaatacctactaa

SEQ ID NO: 402383 - DNA, 15 bp, Homo sapiens
gaaatacctactaat

SEQ ID NO: 402384 - DNA, 15 bp, Homo sapiens
aaatacctactaatg

SEQ ID NO: 402385 - DNA, 15 bp, Homo sapiens
aatacctactaatgt

SEQ ID NO: 402386 - DNA, 15 bp, Homo sapiens
atacctactaatgta

SEQ ID NO: 402387 - DNA, 15 bp, Homo sapiens
tacctactaatgtag

SEQ ID NO: 402388 - DNA, 15 bp, Homo sapiens
acctactaatgtaga

SEQ ID NO: 402389 - DNA, 15 bp, Homo sapiens
cctactaatgtagat

SEQ ID NO: 402390 - DNA, 15 bp, Homo sapiens
ctactaatgtagatg

SEQ ID NO: 402391 - DNA, 15 bp, Homo sapiens
tactaatgtagatga

SEQ ID NO: 402392 - DNA, 15 bp, Homo sapiens
actaatgtagatgat

SEQ ID NO: 402393 - DNA, 15 bp, Homo sapiens
ctaatgtagatgatg

SEQ ID NO: 402394 - DNA, 15 bp, Homo sapiens
taatgtagatgatgg

SEQ ID NO: 402395 - DNA, 15 bp, Homo sapiens
aatgtagatgatggg

SEQ ID NO: 402396 - DNA, 15 bp, Homo sapiens
atgtagatgatgggt

SEQ ID NO: 402397 - DNA, 15 bp, Homo sapiens
tgtagatgatgggtt

SEQ ID NO: 402398 - DNA, 15 bp, Homo sapiens
gtagatgatgggttg

SEQ ID NO: 402399 - DNA, 15 bp, Homo sapiens
gatgggttgataggc

SEQ ID NO: 402400 - DNA, 15 bp, Homo sapiens
atgggttgataggcg

SEQ ID NO: 402401 - DNA, 15 bp, Homo sapiens
tgggttgataggcgc

SEQ ID NO: 402402 - DNA, 15 bp, Homo sapiens
gggttgataggcgca

SEQ ID NO: 402403 - DNA, 15 bp, Homo sapiens
ggttgataggcgcag

SEQ ID NO: 402404 - DNA, 15 bp, Homo sapiens
gttgataggcgcagc

SEQ ID NO: 402405 - DNA, 15 bp, Homo sapiens
ttgataggcgcagca

SEQ ID NO: 402406 - DNA, 15 bp, Homo sapiens
tgataggcgcagcaa

SEQ ID NO: 402407 - DNA, 15 bp, Homo sapiens
gataggcgcagcaaa

SEQ ID NO: 402408 - DNA, 15 bp, Homo sapiens
ataggcgcagcaaac

SEQ ID NO: 402409 - DNA, 15 bp, Homo sapiens
taggcgcagcaaacc

SEQ ID NO: 402410 - DNA, 15 bp, Homo sapiens
aggcgcagcaaaccg

SEQ ID NO: 402411 - DNA, 15 bp, Homo sapiens
ggcgcagcaaaccgc

SEQ ID NO: 402412 - DNA, 15 bp, Homo sapiens
gcgcagcaaaccgcc

SEQ ID NO: 402413 - DNA, 15 bp, Homo sapiens
cgcagcaaaccgcca

SEQ ID NO: 402414 - DNA, 15 bp, Homo sapiens
gcagcaaaccgccat

SEQ ID NO: 402415 - DNA, 15 bp, Homo sapiens
cagcaaaccgccatg

SEQ ID NO: 402416 - DNA, 15 bp, Homo sapiens
agcaaaccgccatga

SEQ ID NO: 402417 - DNA, 15 bp, Homo sapiens
gcaaaccgccatgac

SEQ ID NO: 402418 - DNA, 15 bp, Homo sapiens
caaaccgccatgaca

SEQ ID NO: 402419 - DNA, 15 bp, Homo sapiens
aaaccgccatgacat

SEQ ID NO: 402420 - DNA, 15 bp, Homo sapiens
aaccgccatgacatg

SEQ ID NO: 402421 - DNA, 15 bp, Homo sapiens
accgccatgacatgt

SEQ ID NO: 402422 - DNA, 15 bp, Homo sapiens
ccgccatgacatgtg

SEQ ID NO: 402423 - DNA, 15 bp, Homo sapiens
cgccatgacatgtgt

SEQ ID NO: 402424 - DNA, 15 bp, Homo sapiens
gccatgacatgtgta

SEQ ID NO: 402425 - DNA, 15 bp, Homo sapiens
ccatgacatgtgtat

SEQ ID NO: 402426 - DNA, 15 bp, Homo sapiens
catgacatgtgtata

SEQ ID NO: 402427 - DNA, 15 bp, Homo sapiens
atgacatgtgtatac

SEQ ID NO: 402428 - DNA, 15 bp, Homo sapiens
tgacatgtgtatacc

SEQ ID NO: 402429 - DNA, 15 bp, Homo sapiens
gacatgtgtatacct

SEQ ID NO: 402430 - DNA, 15 bp, Homo sapiens
acatgtgtataccta

SEQ ID NO: 402431 - DNA, 15 bp, Homo sapiens
catgtgtatacctat

SEQ ID NO: 402432 - DNA, 15 bp, Homo sapiens
atgtgtatacctatg

SEQ ID NO: 402433 - DNA, 15 bp, Homo sapiens
tgtgtatacctatgt

SEQ ID NO: 402434 - DNA, 15 bp, Homo sapiens
gtgtatacctatgta

SEQ ID NO: 402435 - DNA, 15 bp, Homo sapiens
tgtatacctatgtaa

SEQ ID NO: 402436 - DNA, 15 bp, Homo sapiens
gtatacctatgtaac

SEQ ID NO: 402437 - DNA, 15 bp, Homo sapiens
tatacctatgtaaca

SEQ ID NO: 402438 - DNA, 15 bp, Homo sapiens
atacctatgtaacaa

SEQ ID NO: 402439 - DNA, 15 bp, Homo sapiens
tacctatgtaacaat

SEQ ID NO: 402440 - DNA, 15 bp, Homo sapiens
acctatgtaacaatc

SEQ ID NO: 402441 - DNA, 15 bp, Homo sapiens
cctatgtaacaatcc

SEQ ID NO: 402442 - DNA, 15 bp, Homo sapiens
ctatgtaacaatcct

SEQ ID NO: 402443 - DNA, 15 bp, Homo sapiens
tatgtaacaatcctg

SEQ ID NO: 402444 - DNA, 15 bp, Homo sapiens
atgtaacaatcctgc

SEQ ID NO: 402445 - DNA, 15 bp, Homo sapiens
tgtaacaatcctgca

SEQ ID NO: 402446 - DNA, 15 bp, Homo sapiens
gtaacaatcctgcac

SEQ ID NO: 402447 - DNA, 15 bp, Homo sapiens
taacaatcctgcacg

SEQ ID NO: 402448 - DNA, 15 bp, Homo sapiens
aacaatcctgcacgt

SEQ ID NO: 402449 - DNA, 15 bp, Homo sapiens
acaatcctgcacgtt

SEQ ID NO: 402450 - DNA, 15 bp, Homo sapiens
caatcctgcacgttc

SEQ ID NO: 402451 - DNA, 15 bp, Homo sapiens
aatcctgcacgttct

SEQ ID NO: 402452 - DNA, 15 bp, Homo sapiens
atcctgcacgttctg

SEQ ID NO: 402453 - DNA, 15 bp, Homo sapiens
tcctgcacgttctgc

SEQ ID NO: 402454 - DNA, 15 bp, Homo sapiens
cctgcacgttctgca

SEQ ID NO: 402455 - DNA, 15 bp, Homo sapiens
ctgcacgttctgcac

SEQ ID NO: 402456 - DNA, 15 bp, Homo sapiens
tgcacgttctgcaca

SEQ ID NO: 402457 - DNA, 15 bp, Homo sapiens
gcacgttctgcacat

SEQ ID NO: 402458 - DNA, 15 bp, Homo sapiens
cacgttctgcacatg

SEQ ID NO: 402459 - DNA, 15 bp, Homo sapiens
acgttctgcacatgt

SEQ ID NO: 402460 - DNA, 15 bp, Homo sapiens
cgttctgcacatgta

SEQ ID NO: 402461 - DNA, 15 bp, Homo sapiens
gttctgcacatgtat

SEQ ID NO: 402462 - DNA, 15 bp, Homo sapiens
ttctgcacatgtatc

SEQ ID NO: 402463 - DNA, 15 bp, Homo sapiens
tctgcacatgtatcc

SEQ ID NO: 402464 - DNA, 15 bp, Homo sapiens
ctgcacatgtatccc

SEQ ID NO: 402465 - DNA, 15 bp, Homo sapiens
tgcacatgtatccca

SEQ ID NO: 402466 - DNA, 15 bp, Homo sapiens
gcacatgtatcccag

SEQ ID NO: 402467 - DNA, 15 bp, Homo sapiens
cacatgtatcccagg

SEQ ID NO: 402468 - DNA, 15 bp, Homo sapiens
acatgtatcccagga

SEQ ID NO: 402469 - DNA, 15 bp, Homo sapiens
catgtatcccaggac

SEQ ID NO: 402470 - DNA, 15 bp, Homo sapiens
atgtatcccaggact

SEQ ID NO: 402471 - DNA, 15 bp, Homo sapiens
tgtatcccaggactt

SEQ ID NO: 402472 - DNA, 15 bp, Homo sapiens
gtatcccaggactta

SEQ ID NO: 402473 - DNA, 15 bp, Homo sapiens
tatcccaggacttaa

SEQ ID NO: 402474 - DNA, 15 bp, Homo sapiens
atcccaggacttaaa

SEQ ID NO: 402475 - DNA, 15 bp, Homo sapiens
tcccaggacttaaag

SEQ ID NO: 402476 - DNA, 15 bp, Homo sapiens
cccaggacttaaagt

SEQ ID NO: 402477 - DNA, 15 bp, Homo sapiens
ccaggacttaaagta

SEQ ID NO: 402478 - DNA, 15 bp, Homo sapiens
caggacttaaagtat

SEQ ID NO: 402479 - DNA, 15 bp, Homo sapiens
aggacttaaagtata

SEQ ID NO: 402480 - DNA, 15 bp, Homo sapiens
ggacttaaagtataa

SEQ ID NO: 402481 - DNA, 15 bp, Homo sapiens
gacttaaagtataat

SEQ ID NO: 402482 - DNA, 15 bp, Homo sapiens
ttaaagtataataaa

SEQ ID NO: 402483 - DNA, 15 bp, Homo sapiens
taaagtataataaaa

SEQ ID NO: 402484 - DNA, 15 bp, Homo sapiens
aaagtataataaaaa

SEQ ID NO: 402485 - DNA, 15 bp, Homo sapiens
aagtataataaaaaa

SEQ ID NO: 402486 - DNA, 15 bp, Homo sapiens
agtataataaaaaaa

SEQ ID NO: 402487 - DNA, 15 bp, Homo sapiens
gtataataaaaaaaa

SEQ ID NO: 402488 - DNA, 15 bp, Homo sapiens
tataataaaaaaaaa

SEQ ID NO: 402489 - DNA, 15 bp, Homo sapiens
taataaaaaaaaaat

SEQ ID NO: 402490 - DNA, 15 bp, Homo sapiens
aataaaaaaaaaata

SEQ ID NO: 402491 - DNA, 15 bp, Homo sapiens
ataaaaaaaaaatag

SEQ ID NO: 402492 - DNA, 15 bp, Homo sapiens
taaaaaaaaaatagt

SEQ ID NO: 402493 - DNA, 15 bp, Homo sapiens
aaaaaaaaaatagtt

SEQ ID NO: 402494 - DNA, 15 bp, Homo sapiens
aaaaaaaaatagttt

SEQ ID NO: 402495 - DNA, 15 bp, Homo sapiens
aaaaaaaatagtttt

SEQ ID NO: 402496 - DNA, 15 bp, Homo sapiens
aaaaaaatagtttta

SEQ ID NO: 402497 - DNA, 15 bp, Homo sapiens
aaaaaatagttttaa

SEQ ID NO: 402498 - DNA, 15 bp, Homo sapiens
aaaaatagttttaag

SEQ ID NO: 402499 - DNA, 15 bp, Homo sapiens
aaaatagttttaagc

SEQ ID NO: 402500 - DNA, 15 bp, Homo sapiens
aaatagttttaagct

SEQ ID NO: 402501 - DNA, 15 bp, Homo sapiens
aatagttttaagctg

SEQ ID NO: 402502 - DNA, 15 bp, Homo sapiens
atagttttaagctgg

SEQ ID NO: 402503 - DNA, 15 bp, Homo sapiens
tagttttaagctggt

SEQ ID NO: 402504 - DNA, 15 bp, Homo sapiens
agttttaagctggtt

SEQ ID NO: 402505 - DNA, 15 bp, Homo sapiens
gttttaagctggttt

SEQ ID NO: 402506 - DNA, 15 bp, Homo sapiens
ttttaagctggtttc

SEQ ID NO: 402507 - DNA, 15 bp, Homo sapiens
tttaagctggtttct

SEQ ID NO: 402508 - DNA, 15 bp, Homo sapiens
ttaagctggtttctc

SEQ ID NO: 402509 - DNA, 15 bp, Homo sapiens
taagctggtttctct

SEQ ID NO: 402510 - DNA, 15 bp, Homo sapiens
aagctggtttctcta

SEQ ID NO: 402511 - DNA, 15 bp, Homo sapiens
agctggtttctctaa

SEQ ID NO: 402512 - DNA, 15 bp, Homo sapiens
gctggtttctctaag

SEQ ID NO: 402513 - DNA, 15 bp, Homo sapiens
ctggtttctctaaga

SEQ ID NO: 402514 - DNA, 15 bp, Homo sapiens
tggtttctctaagaa

SEQ ID NO: 402515 - DNA, 15 bp, Homo sapiens
ggtttctctaagaaa

SEQ ID NO: 402516 - DNA, 15 bp, Homo sapiens
gtttctctaagaaag

SEQ ID NO: 402517 - DNA, 15 bp, Homo sapiens
tttctctaagaaagt

SEQ ID NO: 402518 - DNA, 15 bp, Homo sapiens
ttctctaagaaagtt

SEQ ID NO: 402519 - DNA, 15 bp, Homo sapiens
tctctaagaaagttt

SEQ ID NO: 402520 - DNA, 15 bp, Homo sapiens
ctctaagaaagtttt

SEQ ID NO: 402521 - DNA, 15 bp, Homo sapiens
tctaagaaagttttc

SEQ ID NO: 402522 - DNA, 15 bp, Homo sapiens
ctaagaaagttttcc

SEQ ID NO: 402523 - DNA, 15 bp, Homo sapiens
taagaaagttttcct

SEQ ID NO: 402524 - DNA, 15 bp, Homo sapiens
aagaaagttttcctt

SEQ ID NO: 402525 - DNA, 15 bp, Homo sapiens
agaaagttttccttt

SEQ ID NO: 402526 - DNA, 15 bp, Homo sapiens
gaaagttttcctttg

SEQ ID NO: 402527 - DNA, 15 bp, Homo sapiens
aaagttttcctttga

SEQ ID NO: 402528 - DNA, 15 bp, Homo sapiens
aagttttcctttgat

SEQ ID NO: 402529 - DNA, 15 bp, Homo sapiens
agttttcctttgata

SEQ ID NO: 402530 - DNA, 15 bp, Homo sapiens
gttttcctttgataa

SEQ ID NO: 402531 - DNA, 15 bp, Homo sapiens
ttttcctttgataat

SEQ ID NO: 402532 - DNA, 15 bp, Homo sapiens
tttcctttgataatg

SEQ ID NO: 402533 - DNA, 15 bp, Homo sapiens
ttcctttgataatga

SEQ ID NO: 402534 - DNA, 15 bp, Homo sapiens
tcctttgataatgaa

SEQ ID NO: 402535 - DNA, 15 bp, Homo sapiens
cctttgataatgaag

SEQ ID NO: 402536 - DNA, 15 bp, Homo sapiens
ctttgataatgaaga

SEQ ID NO: 402537 - DNA, 15 bp, Homo sapiens
tttgataatgaagat

SEQ ID NO: 402538 - DNA, 15 bp, Homo sapiens
ttgataatgaagata

SEQ ID NO: 402539 - DNA, 15 bp, Homo sapiens
tgataatgaagataa

SEQ ID NO: 402540 - DNA, 15 bp, Homo sapiens
gataatgaagataac

SEQ ID NO: 402541 - DNA, 15 bp, Homo sapiens
ataatgaagataaca

SEQ ID NO: 402542 - DNA, 15 bp, Homo sapiens
taatgaagataacaa

SEQ ID NO: 402543 - DNA, 15 bp, Homo sapiens
aatgaagataacaaa

SEQ ID NO: 402544 - DNA, 15 bp, Homo sapiens
atgaagataacaaag

SEQ ID NO: 402545 - DNA, 15 bp, Homo sapiens
tgaagataacaaaga

SEQ ID NO: 402546 - DNA, 15 bp, Homo sapiens
gaagataacaaagaa

SEQ ID NO: 402547 - DNA, 15 bp, Homo sapiens
aagataacaaagaag

SEQ ID NO: 402548 - DNA, 15 bp, Homo sapiens
agataacaaagaaga

SEQ ID NO: 402549 - DNA, 15 bp, Homo sapiens
gataacaaagaagat

SEQ ID NO: 402550 - DNA, 15 bp, Homo sapiens
ataacaaagaagata

SEQ ID NO: 402551 - DNA, 15 bp, Homo sapiens
taacaaagaagatag

SEQ ID NO: 402552 - DNA, 15 bp, Homo sapiens
aacaaagaagataga

SEQ ID NO: 402553 - DNA, 15 bp, Homo sapiens
acaaagaagatagat

SEQ ID NO: 402554 - DNA, 15 bp, Homo sapiens
caaagaagatagatt

SEQ ID NO: 402555 - DNA, 15 bp, Homo sapiens
aaagaagatagattt

SEQ ID NO: 402556 - DNA, 15 bp, Homo sapiens
aagaagatagatttt

SEQ ID NO: 402557 - DNA, 15 bp, Homo sapiens
agaagatagatttta

SEQ ID NO: 402558 - DNA, 15 bp, Homo sapiens
gaagatagattttag

SEQ ID NO: 402559 - DNA, 15 bp, Homo sapiens
aagatagattttagc

SEQ ID NO: 402560 - DNA, 15 bp, Homo sapiens
agatagattttagca

SEQ ID NO: 402561 - DNA, 15 bp, Homo sapiens
gatagattttagcag

SEQ ID NO: 402562 - DNA, 15 bp, Homo sapiens
atagattttagcagc

SEQ ID NO: 402563 - DNA, 15 bp, Homo sapiens
tagattttagcagca

SEQ ID NO: 402564 - DNA, 15 bp, Homo sapiens
agattttagcagcag

SEQ ID NO: 402565 - DNA, 15 bp, Homo sapiens
gattttagcagcaga

SEQ ID NO: 402566 - DNA, 15 bp, Homo sapiens
attttagcagcagaa

SEQ ID NO: 402567 - DNA, 15 bp, Homo sapiens
ttttagcagcagaag

SEQ ID NO: 402568 - DNA, 15 bp, Homo sapiens
tttagcagcagaagt

SEQ ID NO: 402569 - DNA, 15 bp, Homo sapiens
ttagcagcagaagta

SEQ ID NO: 402570 - DNA, 15 bp, Homo sapiens
tagcagcagaagtat

SEQ ID NO: 402571 - DNA, 15 bp, Homo sapiens
agcagcagaagtatt

SEQ ID NO: 402572 - DNA, 15 bp, Homo sapiens
gcagcagaagtattc

SEQ ID NO: 402573 - DNA, 15 bp, Homo sapiens
cagcagaagtattct

SEQ ID NO: 402574 - DNA, 15 bp, Homo sapiens
agcagaagtattctt

SEQ ID NO: 402575 - DNA, 15 bp, Homo sapiens
gcagaagtattcttt

SEQ ID NO: 402576 - DNA, 15 bp, Homo sapiens
cagaagtattctttt

SEQ ID NO: 402577 - DNA, 15 bp, Homo sapiens
agaagtattcttttc

SEQ ID NO: 402578 - DNA, 15 bp, Homo sapiens
gaagtattcttttcc

SEQ ID NO: 402579 - DNA, 15 bp, Homo sapiens
aagtattcttttcct

SEQ ID NO: 402580 - DNA, 15 bp, Homo sapiens
agtattcttttcctc

SEQ ID NO: 402581 - DNA, 15 bp, Homo sapiens
gtattcttttcctca

SEQ ID NO: 402582 - DNA, 15 bp, Homo sapiens
tattcttttcctcat

SEQ ID NO: 402583 - DNA, 15 bp, Homo sapiens
attcttttcctcata

SEQ ID NO: 402584 - DNA, 15 bp, Homo sapiens
ttcttttcctcatat

SEQ ID NO: 402585 - DNA, 15 bp, Homo sapiens
tcttttcctcatatt

SEQ ID NO: 402586 - DNA, 15 bp, Homo sapiens
cttttcctcatattt

SEQ ID NO: 402587 - DNA, 15 bp, Homo sapiens
ttttcctcatatttc

SEQ ID NO: 402588 - DNA, 15 bp, Homo sapiens
tttcctcatatttcc

SEQ ID NO: 402589 - DNA, 15 bp, Homo sapiens
ttcctcatatttcca

SEQ ID NO: 402590 - DNA, 15 bp, Homo sapiens
tcctcatatttccag

SEQ ID NO: 402591 - DNA, 15 bp, Homo sapiens
cctcatatttccaga

SEQ ID NO: 402592 - DNA, 15 bp, Homo sapiens
ctcatatttccagac

SEQ ID NO: 402593 - DNA, 15 bp, Homo sapiens
tcatatttccagaca

SEQ ID NO: 402594 - DNA, 15 bp, Homo sapiens
catatttccagacat

SEQ ID NO: 402595 - DNA, 15 bp, Homo sapiens
atatttccagacatt

SEQ ID NO: 402596 - DNA, 15 bp, Homo sapiens
tatttccagacattt

SEQ ID NO: 402597 - DNA, 15 bp, Homo sapiens
atttccagacatttt

SEQ ID NO: 402598 - DNA, 15 bp, Homo sapiens
tttccagacatttta

SEQ ID NO: 402599 - DNA, 15 bp, Homo sapiens
ttccagacattttaa

SEQ ID NO: 402600 - DNA, 15 bp, Homo sapiens
tccagacattttaat

SEQ ID NO: 402601 - DNA, 15 bp, Homo sapiens
ccagacattttaata

SEQ ID NO: 402602 - DNA, 15 bp, Homo sapiens
cagacattttaatac

SEQ ID NO: 402603 - DNA, 15 bp, Homo sapiens
agacattttaataca

SEQ ID NO: 402604 - DNA, 15 bp, Homo sapiens
gacattttaatacat

SEQ ID NO: 402605 - DNA, 15 bp, Homo sapiens
acattttaatacata

SEQ ID NO: 402606 - DNA, 15 bp, Homo sapiens
cattttaatacatat

SEQ ID NO: 402607 - DNA, 15 bp, Homo sapiens
attttaatacatatt

SEQ ID NO: 402608 - DNA, 15 bp, Homo sapiens
ttttaatacatattt

SEQ ID NO: 402609 - DNA, 15 bp, Homo sapiens
tttaatacatatttg

SEQ ID NO: 402610 - DNA, 15 bp, Homo sapiens
ttaatacatatttgc

SEQ ID NO: 402611 - DNA, 15 bp, Homo sapiens
taatacatatttgca

SEQ ID NO: 402612 - DNA, 15 bp, Homo sapiens
aatacatatttgcag

SEQ ID NO: 402613 - DNA, 15 bp, Homo sapiens
atacatatttgcaga

SEQ ID NO: 402614 - DNA, 15 bp, Homo sapiens
tacatatttgcagac

SEQ ID NO: 402615 - DNA, 15 bp, Homo sapiens
acatatttgcagaca

SEQ ID NO: 402616 - DNA, 15 bp, Homo sapiens
catatttgcagacat

SEQ ID NO: 402617 - DNA, 15 bp, Homo sapiens
atatttgcagacatt

SEQ ID NO: 402618 - DNA, 15 bp, Homo sapiens
tatttgcagacattg

SEQ ID NO: 402619 - DNA, 15 bp, Homo sapiens
atttgcagacattgt

SEQ ID NO: 402620 - DNA, 15 bp, Homo sapiens
tttgcagacattgta

SEQ ID NO: 402621 - DNA, 15 bp, Homo sapiens
ttgcagacattgtaa

SEQ ID NO: 402622 - DNA, 15 bp, Homo sapiens
tgcagacattgtaat

SEQ ID NO: 402623 - DNA, 15 bp, Homo sapiens
gcagacattgtaata

SEQ ID NO: 402624 - DNA, 15 bp, Homo sapiens
cagacattgtaatag

SEQ ID NO: 402625 - DNA, 15 bp, Homo sapiens
agacattgtaatagt

SEQ ID NO: 402626 - DNA, 15 bp, Homo sapiens
gacattgtaatagtc

SEQ ID NO: 402627 - DNA, 15 bp, Homo sapiens
acattgtaatagtca

SEQ ID NO: 402628 - DNA, 15 bp, Homo sapiens
cattgtaatagtcat

SEQ ID NO: 402629 - DNA, 15 bp, Homo sapiens
attgtaatagtcatc

SEQ ID NO: 402630 - DNA, 15 bp, Homo sapiens
ttgtaatagtcatct

SEQ ID NO: 402631 - DNA, 15 bp, Homo sapiens
tgtaatagtcatctt

SEQ ID NO: 402632 - DNA, 15 bp, Homo sapiens
gtaatagtcatcttt

SEQ ID NO: 402633 - DNA, 15 bp, Homo sapiens
taatagtcatcttta

SEQ ID NO: 402634 - DNA, 15 bp, Homo sapiens
aatagtcatctttat

SEQ ID NO: 402635 - DNA, 15 bp, Homo sapiens
atagtcatctttata

SEQ ID NO: 402636 - DNA, 15 bp, Homo sapiens
tagtcatctttatag

SEQ ID NO: 402637 - DNA, 15 bp, Homo sapiens
agtcatctttatagc

SEQ ID NO: 402638 - DNA, 15 bp, Homo sapiens
gtcatctttatagct

SEQ ID NO: 402639 - DNA, 15 bp, Homo sapiens
tcatctttatagctc

SEQ ID NO: 402640 - DNA, 15 bp, Homo sapiens
catctttatagctca

SEQ ID NO: 402641 - DNA, 15 bp, Homo sapiens
atctttatagctcac

SEQ ID NO: 402642 - DNA, 15 bp, Homo sapiens
tctttatagctcact

SEQ ID NO: 402643 - DNA, 15 bp, Homo sapiens
ctttatagctcactc

SEQ ID NO: 402644 - DNA, 15 bp, Homo sapiens
tttatagctcactcc

SEQ ID NO: 402645 - DNA, 15 bp, Homo sapiens
ttatagctcactcca

SEQ ID NO: 402646 - DNA, 15 bp, Homo sapiens
tatagctcactccag

SEQ ID NO: 402647 - DNA, 15 bp, Homo sapiens
atagctcactccagt

SEQ ID NO: 402648 - DNA, 15 bp, Homo sapiens
tagctcactccagtg

SEQ ID NO: 402649 - DNA, 15 bp, Homo sapiens
agctcactccagtgc

SEQ ID NO: 402650 - DNA, 15 bp, Homo sapiens
gctcactccagtgct

SEQ ID NO: 402651 - DNA, 15 bp, Homo sapiens
ctcactccagtgcta

SEQ ID NO: 402652 - DNA, 15 bp, Homo sapiens
tcactccagtgctat

SEQ ID NO: 402653 - DNA, 15 bp, Homo sapiens
cactccagtgctata

SEQ ID NO: 402654 - DNA, 15 bp, Homo sapiens
actccagtgctatac

SEQ ID NO: 402655 - DNA, 15 bp, Homo sapiens
ctccagtgctataca

SEQ ID NO: 402656 - DNA, 15 bp, Homo sapiens
tccagtgctatacat

SEQ ID NO: 402657 - DNA, 15 bp, Homo sapiens
ccagtgctatacatt

SEQ ID NO: 402658 - DNA, 15 bp, Homo sapiens
cagtgctatacattg

SEQ ID NO: 402659 - DNA, 15 bp, Homo sapiens
agtgctatacattgg

SEQ ID NO: 402660 - DNA, 15 bp, Homo sapiens
gtgctatacattggg

SEQ ID NO: 402661 - DNA, 15 bp, Homo sapiens
tgctatacattggga

SEQ ID NO: 402662 - DNA, 15 bp, Homo sapiens
gctatacattgggat

SEQ ID NO: 402663 - DNA, 15 bp, Homo sapiens
ctatacattgggatt

SEQ ID NO: 402664 - DNA, 15 bp, Homo sapiens
tatacattgggatta

SEQ ID NO: 402665 - DNA, 15 bp, Homo sapiens
atacattgggattat

SEQ ID NO: 402666 - DNA, 15 bp, Homo sapiens
tacattgggattata

SEQ ID NO: 402667 - DNA, 15 bp, Homo sapiens
acattgggattatag

SEQ ID NO: 402668 - DNA, 15 bp, Homo sapiens
cattgggattatagt

SEQ ID NO: 402669 - DNA, 15 bp, Homo sapiens
attgggattatagtt

SEQ ID NO: 402670 - DNA, 15 bp, Homo sapiens
ttgggattatagttg

SEQ ID NO: 402671 - DNA, 15 bp, Homo sapiens
tgggattatagttgc

SEQ ID NO: 402672 - DNA, 15 bp, Homo sapiens
gggattatagttgct

SEQ ID NO: 402673 - DNA, 15 bp, Homo sapiens
ggattatagttgctt

SEQ ID NO: 402674 - DNA, 15 bp, Homo sapiens
gattatagttgcttg

SEQ ID NO: 402675 - DNA, 15 bp, Homo sapiens
attatagttgcttgc

SEQ ID NO: 402676 - DNA, 15 bp, Homo sapiens
ttatagttgcttgca

SEQ ID NO: 402677 - DNA, 15 bp, Homo sapiens
tatagttgcttgcag

SEQ ID NO: 402678 - DNA, 15 bp, Homo sapiens
atagttgcttgcagt

SEQ ID NO: 402679 - DNA, 15 bp, Homo sapiens
tagttgcttgcagta

SEQ ID NO: 402680 - DNA, 15 bp, Homo sapiens
agttgcttgcagtat

SEQ ID NO: 402681 - DNA, 15 bp, Homo sapiens
gttgcttgcagtata

SEQ ID NO: 402682 - DNA, 15 bp, Homo sapiens
ttgcttgcagtatag

SEQ ID NO: 402683 - DNA, 15 bp, Homo sapiens
tgcttgcagtatagc

SEQ ID NO: 402684 - DNA, 15 bp, Homo sapiens
gcttgcagtatagca

SEQ ID NO: 402685 - DNA, 15 bp, Homo sapiens
cttgcagtatagcat

SEQ ID NO: 402686 - DNA, 15 bp, Homo sapiens
ttgcagtatagcatt

SEQ ID NO: 402687 - DNA, 15 bp, Homo sapiens
tgcagtatagcattt

SEQ ID NO: 402688 - DNA, 15 bp, Homo sapiens
gcagtatagcattta

SEQ ID NO: 402689 - DNA, 15 bp, Homo sapiens
cagtatagcatttac

SEQ ID NO: 402690 - DNA, 15 bp, Homo sapiens
agtatagcatttaca

SEQ ID NO: 402691 - DNA, 15 bp, Homo sapiens
gtatagcatttacat

SEQ ID NO: 402692 - DNA, 15 bp, Homo sapiens
tatagcatttacatc

SEQ ID NO: 402693 - DNA, 15 bp, Homo sapiens
atagcatttacatct

SEQ ID NO: 402694 - DNA, 15 bp, Homo sapiens
tagcatttacatctt

SEQ ID NO: 402695 - DNA, 15 bp, Homo sapiens
agcatttacatcttc

SEQ ID NO: 402696 - DNA, 15 bp, Homo sapiens
gcatttacatcttcc

SEQ ID NO: 402697 - DNA, 15 bp, Homo sapiens
catttacatcttcct

SEQ ID NO: 402698 - DNA, 15 bp, Homo sapiens
atttacatcttcctt

SEQ ID NO: 402699 - DNA, 15 bp, Homo sapiens
tttacatcttcctta

SEQ ID NO: 402700 - DNA, 15 bp, Homo sapiens
ttacatcttccttat

SEQ ID NO: 402701 - DNA, 15 bp, Homo sapiens
tacatcttccttatt

SEQ ID NO: 402702 - DNA, 15 bp, Homo sapiens
acatcttccttattc

SEQ ID NO: 402703 - DNA, 15 bp, Homo sapiens
catcttccttattct

SEQ ID NO: 402704 - DNA, 15 bp, Homo sapiens
atcttccttattctt

SEQ ID NO: 402705 - DNA, 15 bp, Homo sapiens
tcttccttattcttt

SEQ ID NO: 402706 - DNA, 15 bp, Homo sapiens
cttccttattctttt

SEQ ID NO: 402707 - DNA, 15 bp, Homo sapiens
ttccttattcttttt

SEQ ID NO: 402708 - DNA, 15 bp, Homo sapiens
tccttattctttttt

SEQ ID NO: 402709 - DNA, 15 bp, Homo sapiens
ccttattcttttttc

SEQ ID NO: 402710 - DNA, 15 bp, Homo sapiens
cttattcttttttct

SEQ ID NO: 402711 - DNA, 15 bp, Homo sapiens
ttattcttttttctt

SEQ ID NO: 402712 - DNA, 15 bp, Homo sapiens
tattcttttttcttc

SEQ ID NO: 402713 - DNA, 15 bp, Homo sapiens
attcttttttcttcg

SEQ ID NO: 402714 - DNA, 15 bp, Homo sapiens
ttcttttttcttcgt

SEQ ID NO: 402715 - DNA, 15 bp, Homo sapiens
tcttttttcttcgtt

SEQ ID NO: 402716 - DNA, 15 bp, Homo sapiens
cttttttcttcgttc

SEQ ID NO: 402717 - DNA, 15 bp, Homo sapiens
ttttttcttcgttca

SEQ ID NO: 402718 - DNA, 15 bp, Homo sapiens
tttttcttcgttcat

SEQ ID NO: 402719 - DNA, 15 bp, Homo sapiens
ttttcttcgttcatt

SEQ ID NO: 402720 - DNA, 15 bp, Homo sapiens
tttcttcgttcattc

SEQ ID NO: 402721 - DNA, 15 bp, Homo sapiens
ttcttcgttcattct

SEQ ID NO: 402722 - DNA, 15 bp, Homo sapiens
tcttcgttcattctc

SEQ ID NO: 402723 - DNA, 15 bp, Homo sapiens
cttcgttcattctct

SEQ ID NO: 402724 - DNA, 15 bp, Homo sapiens
ttcgttcattctctc

SEQ ID NO: 402725 - DNA, 15 bp, Homo sapiens
tcgttcattctctct

SEQ ID NO: 402726 - DNA, 15 bp, Homo sapiens
cgttcattctctctt

SEQ ID NO: 402727 - DNA, 15 bp, Homo sapiens
gttcattctctcttt

SEQ ID NO: 402728 - DNA, 15 bp, Homo sapiens
ttcattctctctttc

SEQ ID NO: 402729 - DNA, 15 bp, Homo sapiens
tcattctctctttct

SEQ ID NO: 402730 - DNA, 15 bp, Homo sapiens
cattctctctttctt

SEQ ID NO: 402731 - DNA, 15 bp, Homo sapiens
attctctctttcttg

SEQ ID NO: 402732 - DNA, 15 bp, Homo sapiens
ttctctctttcttga

SEQ ID NO: 402733 - DNA, 15 bp, Homo sapiens
tctctctttcttgaa

SEQ ID NO: 402734 - DNA, 15 bp, Homo sapiens
ctctctttcttgaac

SEQ ID NO: 402735 - DNA, 15 bp, Homo sapiens
tctctttcttgaact

SEQ ID NO: 402736 - DNA, 15 bp, Homo sapiens
ctctttcttgaactc

SEQ ID NO: 402737 - DNA, 15 bp, Homo sapiens
tctttcttgaactct

SEQ ID NO: 402738 - DNA, 15 bp, Homo sapiens
ctttcttgaactctc

SEQ ID NO: 402739 - DNA, 15 bp, Homo sapiens
tttcttgaactctca

SEQ ID NO: 402740 - DNA, 15 bp, Homo sapiens
ttcttgaactctcat

SEQ ID NO: 402741 - DNA, 15 bp, Homo sapiens
tcttgaactctcatt

SEQ ID NO: 402742 - DNA, 15 bp, Homo sapiens
cttgaactctcattc

SEQ ID NO: 402743 - DNA, 15 bp, Homo sapiens
ttgaactctcattct

SEQ ID NO: 402744 - DNA, 15 bp, Homo sapiens
tgaactctcattctc

SEQ ID NO: 402745 - DNA, 15 bp, Homo sapiens
gaactctcattctct

SEQ ID NO: 402746 - DNA, 15 bp, Homo sapiens
aactctcattctctc

SEQ ID NO: 402747 - DNA, 15 bp, Homo sapiens
actctcattctctct

SEQ ID NO: 402748 - DNA, 15 bp, Homo sapiens
ctctcattctctctc

SEQ ID NO: 402749 - DNA, 15 bp, Homo sapiens
tctcattctctctct

SEQ ID NO: 402750 - DNA, 15 bp, Homo sapiens
ctcattctctctctc

SEQ ID NO: 402751 - DNA, 15 bp, Homo sapiens
tcattctctctctca

SEQ ID NO: 402752 - DNA, 15 bp, Homo sapiens
cattctctctctcac

SEQ ID NO: 402753 - DNA, 15 bp, Homo sapiens
attctctctctcact

SEQ ID NO: 402754 - DNA, 15 bp, Homo sapiens
ttctctctctcactg

SEQ ID NO: 402755 - DNA, 15 bp, Homo sapiens
tctctctctcactgg

SEQ ID NO: 402756 - DNA, 15 bp, Homo sapiens
ctctctctcactggt

SEQ ID NO: 402757 - DNA, 15 bp, Homo sapiens
tctctctcactggtc

SEQ ID NO: 402758 - DNA, 15 bp, Homo sapiens
ctctctcactggtct

SEQ ID NO: 402759 - DNA, 15 bp, Homo sapiens
tctctcactggtctt

SEQ ID NO: 402760 - DNA, 15 bp, Homo sapiens
ctctcactggtcttg

SEQ ID NO: 402761 - DNA, 15 bp, Homo sapiens
tctcactggtcttgt

SEQ ID NO: 402762 - DNA, 15 bp, Homo sapiens
ctcactggtcttgtg

SEQ ID NO: 402763 - DNA, 15 bp, Homo sapiens
tcactggtcttgtga

SEQ ID NO: 402764 - DNA, 15 bp, Homo sapiens
cactggtcttgtgaa

SEQ ID NO: 402765 - DNA, 15 bp, Homo sapiens
actggtcttgtgaaa

SEQ ID NO: 402766 - DNA, 15 bp, Homo sapiens
ctggtcttgtgaaag

SEQ ID NO: 402767 - DNA, 15 bp, Homo sapiens
tggtcttgtgaaaga

SEQ ID NO: 402768 - DNA, 15 bp, Homo sapiens
ggtcttgtgaaagaa

SEQ ID NO: 402769 - DNA, 15 bp, Homo sapiens
gtcttgtgaaagaac

SEQ ID NO: 402770 - DNA, 15 bp, Homo sapiens
tcttgtgaaagaaca

SEQ ID NO: 402771 - DNA, 15 bp, Homo sapiens
cttgtgaaagaacat

SEQ ID NO: 402772 - DNA, 15 bp, Homo sapiens
ttgtgaaagaacatg

SEQ ID NO: 402773 - DNA, 15 bp, Homo sapiens
tgtgaaagaacatga

SEQ ID NO: 402774 - DNA, 15 bp, Homo sapiens
gtgaaagaacatgat

SEQ ID NO: 402775 - DNA, 15 bp, Homo sapiens
tgaaagaacatgatt

SEQ ID NO: 402776 - DNA, 15 bp, Homo sapiens
gaaagaacatgattg

SEQ ID NO: 402777 - DNA, 15 bp, Homo sapiens
aaagaacatgattgg

SEQ ID NO: 402778 - DNA, 15 bp, Homo sapiens
aagaacatgattgga

SEQ ID NO: 402779 - DNA, 15 bp, Homo sapiens
agaacatgattggat

SEQ ID NO: 402780 - DNA, 15 bp, Homo sapiens
gaacatgattggatt

SEQ ID NO: 402781 - DNA, 15 bp, Homo sapiens
aacatgattggattt

SEQ ID NO: 402782 - DNA, 15 bp, Homo sapiens
acatgattggatttc

SEQ ID NO: 402783 - DNA, 15 bp, Homo sapiens
catgattggatttct

SEQ ID NO: 402784 - DNA, 15 bp, Homo sapiens
atgattggatttctg

SEQ ID NO: 402785 - DNA, 15 bp, Homo sapiens
tgattggatttctgc

SEQ ID NO: 402786 - DNA, 15 bp, Homo sapiens
gattggatttctgct

SEQ ID NO: 402787 - DNA, 15 bp, Homo sapiens
attggatttctgctt

SEQ ID NO: 402788 - DNA, 15 bp, Homo sapiens
ttggatttctgcttt

SEQ ID NO: 402789 - DNA, 15 bp, Homo sapiens
tggatttctgctttg

SEQ ID NO: 402790 - DNA, 15 bp, Homo sapiens
ggatttctgctttga

SEQ ID NO: 402791 - DNA, 15 bp, Homo sapiens
gatttctgctttgag

SEQ ID NO: 402792 - DNA, 15 bp, Homo sapiens
atttctgctttgagc

SEQ ID NO: 402793 - DNA, 15 bp, Homo sapiens
tttctgctttgagct

SEQ ID NO: 402794 - DNA, 15 bp, Homo sapiens
ttctgctttgagcta

SEQ ID NO: 402795 - DNA, 15 bp, Homo sapiens
tctgctttgagctat

SEQ ID NO: 402796 - DNA, 15 bp, Homo sapiens
ctgctttgagctatc

SEQ ID NO: 402797 - DNA, 15 bp, Homo sapiens
tgctttgagctatct

SEQ ID NO: 402798 - DNA, 15 bp, Homo sapiens
gctttgagctatctt

SEQ ID NO: 402799 - DNA, 15 bp, Homo sapiens
ctttgagctatcttt

SEQ ID NO: 402800 - DNA, 15 bp, Homo sapiens
tttgagctatcttta

SEQ ID NO: 402801 - DNA, 15 bp, Homo sapiens
ttgagctatctttaa

SEQ ID NO: 402802 - DNA, 15 bp, Homo sapiens
tgagctatctttaag

SEQ ID NO: 402803 - DNA, 15 bp, Homo sapiens
gagctatctttaagt

SEQ ID NO: 402804 - DNA, 15 bp, Homo sapiens
agctatctttaagtt

SEQ ID NO: 402805 - DNA, 15 bp, Homo sapiens
gctatctttaagttt

SEQ ID NO: 402806 - DNA, 15 bp, Homo sapiens
ctatctttaagtttg

SEQ ID NO: 402807 - DNA, 15 bp, Homo sapiens
tatctttaagtttga

SEQ ID NO: 402808 - DNA, 15 bp, Homo sapiens
atctttaagtttgat

SEQ ID NO: 402809 - DNA, 15 bp, Homo sapiens
tctttaagtttgatt

SEQ ID NO: 402810 - DNA, 15 bp, Homo sapiens
ctttaagtttgatta

SEQ ID NO: 402811 - DNA, 15 bp, Homo sapiens
tttaagtttgattac

SEQ ID NO: 402812 - DNA, 15 bp, Homo sapiens
ttaagtttgattaca

SEQ ID NO: 402813 - DNA, 15 bp, Homo sapiens
taagtttgattacaa

SEQ ID NO: 402814 - DNA, 15 bp, Homo sapiens
aagtttgattacaaa

SEQ ID NO: 402815 - DNA, 15 bp, Homo sapiens
agtttgattacaaac

SEQ ID NO: 402816 - DNA, 15 bp, Homo sapiens
gtttgattacaaact

SEQ ID NO: 402817 - DNA, 15 bp, Homo sapiens
tttgattacaaactg

SEQ ID NO: 402818 - DNA, 15 bp, Homo sapiens
ttgattacaaactgt

SEQ ID NO: 402819 - DNA, 15 bp, Homo sapiens
tgattacaaactgta

SEQ ID NO: 402820 - DNA, 15 bp, Homo sapiens
gattacaaactgtaa

SEQ ID NO: 402821 - DNA, 15 bp, Homo sapiens
attacaaactgtaac

SEQ ID NO: 402822 - DNA, 15 bp, Homo sapiens
ttacaaactgtaaca

SEQ ID NO: 402823 - DNA, 15 bp, Homo sapiens
tacaaactgtaacag

SEQ ID NO: 402824 - DNA, 15 bp, Homo sapiens
acaaactgtaacaga

SEQ ID NO: 402825 - DNA, 15 bp, Homo sapiens
caaactgtaacagag

SEQ ID NO: 402826 - DNA, 15 bp, Homo sapiens
aaactgtaacagagt

SEQ ID NO: 402827 - DNA, 15 bp, Homo sapiens
aactgtaacagagta

SEQ ID NO: 402828 - DNA, 15 bp, Homo sapiens
actgtaacagagtag

SEQ ID NO: 402829 - DNA, 15 bp, Homo sapiens
ctgtaacagagtagc

SEQ ID NO: 402830 - DNA, 15 bp, Homo sapiens
tgtaacagagtagcc

SEQ ID NO: 402831 - DNA, 15 bp, Homo sapiens
gtaacagagtagcct

SEQ ID NO: 402832 - DNA, 15 bp, Homo sapiens
taacagagtagcctt

SEQ ID NO: 402833 - DNA, 15 bp, Homo sapiens
aacagagtagccttg

SEQ ID NO: 402834 - DNA, 15 bp, Homo sapiens
acagagtagccttga

SEQ ID NO: 402835 - DNA, 15 bp, Homo sapiens
cagagtagccttgag

SEQ ID NO: 402836 - DNA, 15 bp, Homo sapiens
agagtagccttgagg

SEQ ID NO: 402837 - DNA, 15 bp, Homo sapiens
gagtagccttgaggt

SEQ ID NO: 402838 - DNA, 15 bp, Homo sapiens
agtagccttgaggtt

SEQ ID NO: 402839 - DNA, 15 bp, Homo sapiens
gtagccttgaggttt

SEQ ID NO: 402840 - DNA, 15 bp, Homo sapiens
tagccttgaggtttt

SEQ ID NO: 402841 - DNA, 15 bp, Homo sapiens
agccttgaggttttt

SEQ ID NO: 402842 - DNA, 15 bp, Homo sapiens
gccttgaggtttttt

SEQ ID NO: 402843 - DNA, 15 bp, Homo sapiens
ccttgaggttttttt

SEQ ID NO: 402844 - DNA, 15 bp, Homo sapiens
cttgaggtttttttt

SEQ ID NO: 402845 - DNA, 15 bp, Homo sapiens
ttgaggtttttttta

SEQ ID NO: 402846 - DNA, 15 bp, Homo sapiens
tgaggttttttttat

SEQ ID NO: 402847 - DNA, 15 bp, Homo sapiens
gaggttttttttatt

SEQ ID NO: 402848 - DNA, 15 bp, Homo sapiens
aggttttttttattg

SEQ ID NO: 402849 - DNA, 15 bp, Homo sapiens
ggttttttttattgg

SEQ ID NO: 402850 - DNA, 15 bp, Homo sapiens
gttttttttattggt

SEQ ID NO: 402851 - DNA, 15 bp, Homo sapiens
ttttttttattggta

SEQ ID NO: 402852 - DNA, 15 bp, Homo sapiens
tttttttattggtaa

SEQ ID NO: 402853 - DNA, 15 bp, Homo sapiens
ttttttattggtaac

SEQ ID NO: 402854 - DNA, 15 bp, Homo sapiens
tttttattggtaact

SEQ ID NO: 402855 - DNA, 15 bp, Homo sapiens
ttttattggtaacta

SEQ ID NO: 402856 - DNA, 15 bp, Homo sapiens
tttattggtaactat

SEQ ID NO: 402857 - DNA, 15 bp, Homo sapiens
ttattggtaactatt

SEQ ID NO: 402858 - DNA, 15 bp, Homo sapiens
tattggtaactattt

SEQ ID NO: 402859 - DNA, 15 bp, Homo sapiens
attggtaactatttt

SEQ ID NO: 402860 - DNA, 15 bp, Homo sapiens
ttggtaactattttg

SEQ ID NO: 402861 - DNA, 15 bp, Homo sapiens
tggtaactattttgt

SEQ ID NO: 402862 - DNA, 15 bp, Homo sapiens
ggtaactattttgtg

SEQ ID NO: 402863 - DNA, 15 bp, Homo sapiens
gtaactattttgtga

SEQ ID NO: 402864 - DNA, 15 bp, Homo sapiens
taactattttgtgat

SEQ ID NO: 402865 - DNA, 15 bp, Homo sapiens
aactattttgtgatg

SEQ ID NO: 402866 - DNA, 15 bp, Homo sapiens
actattttgtgatga

SEQ ID NO: 402867 - DNA, 15 bp, Homo sapiens
ctattttgtgatgag

SEQ ID NO: 402868 - DNA, 15 bp, Homo sapiens
tattttgtgatgagg

SEQ ID NO: 402869 - DNA, 15 bp, Homo sapiens
attttgtgatgaggt

SEQ ID NO: 402870 - DNA, 15 bp, Homo sapiens
ttttgtgatgaggtg

SEQ ID NO: 402871 - DNA, 15 bp, Homo sapiens
tttgtgatgaggtgg

SEQ ID NO: 402872 - DNA, 15 bp, Homo sapiens
ttgtgatgaggtggt

SEQ ID NO: 402873 - DNA, 15 bp, Homo sapiens
tgtgatgaggtggtt

SEQ ID NO: 402874 - DNA, 15 bp, Homo sapiens
gtgatgaggtggttg

SEQ ID NO: 402875 - DNA, 15 bp, Homo sapiens
tgatgaggtggttga

SEQ ID NO: 402876 - DNA, 15 bp, Homo sapiens
gatgaggtggttgaa

SEQ ID NO: 402877 - DNA, 15 bp, Homo sapiens
atgaggtggttgaaa

SEQ ID NO: 402878 - DNA, 15 bp, Homo sapiens
tgaggtggttgaaat

SEQ ID NO: 402879 - DNA, 15 bp, Homo sapiens
gaggtggttgaaatc

SEQ ID NO: 402880 - DNA, 15 bp, Homo sapiens
aggtggttgaaatcg

SEQ ID NO: 402881 - DNA, 15 bp, Homo sapiens
ggtggttgaaatcgt

SEQ ID NO: 402882 - DNA, 15 bp, Homo sapiens
gtggttgaaatcgtg

SEQ ID NO: 402883 - DNA, 15 bp, Homo sapiens
tggttgaaatcgtgc

SEQ ID NO: 402884 - DNA, 15 bp, Homo sapiens
ggttgaaatcgtgct

SEQ ID NO: 402885 - DNA, 15 bp, Homo sapiens
gttgaaatcgtgctt

SEQ ID NO: 402886 - DNA, 15 bp, Homo sapiens
ttgaaatcgtgcttc

SEQ ID NO: 402887 - DNA, 15 bp, Homo sapiens
tgaaatcgtgcttct

SEQ ID NO: 402888 - DNA, 15 bp, Homo sapiens
gaaatcgtgcttctt

SEQ ID NO: 402889 - DNA, 15 bp, Homo sapiens
aaatcgtgcttcttt

SEQ ID NO: 402890 - DNA, 15 bp, Homo sapiens
aatcgtgcttctttc

SEQ ID NO: 402891 - DNA, 15 bp, Homo sapiens
atcgtgcttctttct

SEQ ID NO: 402892 - DNA, 15 bp, Homo sapiens
tcgtgcttctttctt

SEQ ID NO: 402893 - DNA, 15 bp, Homo sapiens
cgtgcttctttcttg

SEQ ID NO: 402894 - DNA, 15 bp, Homo sapiens
gtgcttctttcttga

SEQ ID NO: 402895 - DNA, 15 bp, Homo sapiens
tgcttctttcttgat

SEQ ID NO: 402896 - DNA, 15 bp, Homo sapiens
gcttctttcttgatt

SEQ ID NO: 402897 - DNA, 15 bp, Homo sapiens
cttctttcttgattt

SEQ ID NO: 402898 - DNA, 15 bp, Homo sapiens
ttctttcttgatttt

SEQ ID NO: 402899 - DNA, 15 bp, Homo sapiens
tctttcttgattttt

SEQ ID NO: 402900 - DNA, 15 bp, Homo sapiens
tttcttgatttttgt

SEQ ID NO: 402901 - DNA, 15 bp, Homo sapiens
ttcttgatttttgtt

SEQ ID NO: 402902 - DNA, 15 bp, Homo sapiens
tcttgatttttgttt

SEQ ID NO: 402903 - DNA, 15 bp, Homo sapiens
cttgatttttgtttg

SEQ ID NO: 402904 - DNA, 15 bp, Homo sapiens
ttgatttttgtttgt

SEQ ID NO: 402905 - DNA, 15 bp, Homo sapiens
tgatttttgtttgtt

SEQ ID NO: 402906 - DNA, 15 bp, Homo sapiens
gatttttgtttgttt

SEQ ID NO: 402907 - DNA, 15 bp, Homo sapiens
atttttgtttgtttg

SEQ ID NO: 402908 - DNA, 15 bp, Homo sapiens
tttgtttgttttttg

SEQ ID NO: 402909 - DNA, 15 bp, Homo sapiens
ttgtttgttttttga

SEQ ID NO: 402910 - DNA, 15 bp, Homo sapiens
tgtttgttttttgag

SEQ ID NO: 402911 - DNA, 15 bp, Homo sapiens
gtttgttttttgaga

SEQ ID NO: 402912 - DNA, 15 bp, Homo sapiens
ttgttttttgagacg

SEQ ID NO: 402913 - DNA, 15 bp, Homo sapiens
tgttttttgagacgg

SEQ ID NO: 402914 - DNA, 15 bp, Homo sapiens
gttttttgagacgga

SEQ ID NO: 402915 - DNA, 15 bp, Homo sapiens
tgagacggagtcttc

SEQ ID NO: 402916 - DNA, 15 bp, Homo sapiens
gagacggagtcttca

SEQ ID NO: 402917 - DNA, 15 bp, Homo sapiens
agacggagtcttcat

SEQ ID NO: 402918 - DNA, 15 bp, Homo sapiens
gacggagtcttcatt

SEQ ID NO: 402919 - DNA, 15 bp, Homo sapiens
acggagtcttcattg

SEQ ID NO: 402920 - DNA, 15 bp, Homo sapiens
cggagtcttcattga

SEQ ID NO: 402921 - DNA, 15 bp, Homo sapiens
ggagtcttcattgac

SEQ ID NO: 402922 - DNA, 15 bp, Homo sapiens
gagtcttcattgaca

SEQ ID NO: 402923 - DNA, 15 bp, Homo sapiens
agtcttcattgacac

SEQ ID NO: 402924 - DNA, 15 bp, Homo sapiens
gtcttcattgacacc

SEQ ID NO: 402925 - DNA, 15 bp, Homo sapiens
tcttcattgacaccc

SEQ ID NO: 402926 - DNA, 15 bp, Homo sapiens
cttcattgacaccca

SEQ ID NO: 402927 - DNA, 15 bp, Homo sapiens
ttcattgacacccag

SEQ ID NO: 402928 - DNA, 15 bp, Homo sapiens
tcattgacacccagc

SEQ ID NO: 402929 - DNA, 15 bp, Homo sapiens
cattgacacccagcc

SEQ ID NO: 402930 - DNA, 15 bp, Homo sapiens
attgacacccagcct

SEQ ID NO: 402931 - DNA, 15 bp, Homo sapiens
ttgacacccagcctg

SEQ ID NO: 402932 - DNA, 15 bp, Homo sapiens
tgacacccagcctga

SEQ ID NO: 402933 - DNA, 15 bp, Homo sapiens
gacacccagcctgaa

SEQ ID NO: 402934 - DNA, 15 bp, Homo sapiens
acacccagcctgaag

SEQ ID NO: 402935 - DNA, 15 bp, Homo sapiens
cacccagcctgaagt

SEQ ID NO: 402936 - DNA, 15 bp, Homo sapiens
acccagcctgaagtg

SEQ ID NO: 402937 - DNA, 15 bp, Homo sapiens
cccagcctgaagtgc

SEQ ID NO: 402938 - DNA, 15 bp, Homo sapiens
ccagcctgaagtgca

SEQ ID NO: 402939 - DNA, 15 bp, Homo sapiens
cagcctgaagtgcag

SEQ ID NO: 402940 - DNA, 15 bp, Homo sapiens
agcctgaagtgcagt

SEQ ID NO: 402941 - DNA, 15 bp, Homo sapiens
gcctgaagtgcagtg

SEQ ID NO: 402942 - DNA, 15 bp, Homo sapiens
cctgaagtgcagtga

SEQ ID NO: 402943 - DNA, 15 bp, Homo sapiens
ctgaagtgcagtgat

SEQ ID NO: 402944 - DNA, 15 bp, Homo sapiens
tgaagtgcagtgatg

SEQ ID NO: 402945 - DNA, 15 bp, Homo sapiens
gaagtgcagtgatgt

SEQ ID NO: 402946 - DNA, 15 bp, Homo sapiens
aagtgcagtgatgtg

SEQ ID NO: 402947 - DNA, 15 bp, Homo sapiens
tgcagtgatgtgatc

SEQ ID NO: 402948 - DNA, 15 bp, Homo sapiens
gcagtgatgtgatct

SEQ ID NO: 402949 - DNA, 15 bp, Homo sapiens
cagtgatgtgatctt

SEQ ID NO: 402950 - DNA, 15 bp, Homo sapiens
agtgatgtgatcttg

SEQ ID NO: 402951 - DNA, 15 bp, Homo sapiens
gtgatgtgatcttgg

SEQ ID NO: 402952 - DNA, 15 bp, Homo sapiens
tgatgtgatcttggc

SEQ ID NO: 402953 - DNA, 15 bp, Homo sapiens
gatgtgatcttggct

SEQ ID NO: 402954 - DNA, 15 bp, Homo sapiens
atgtgatcttggctc

SEQ ID NO: 402955 - DNA, 15 bp, Homo sapiens
ctgcaacctctgctg

SEQ ID NO: 402956 - DNA, 15 bp, Homo sapiens
tgcaacctctgctgc

SEQ ID NO: 402957 - DNA, 15 bp, Homo sapiens
gcaacctctgctgcc

SEQ ID NO: 402958 - DNA, 15 bp, Homo sapiens
caacctctgctgcct

SEQ ID NO: 402959 - DNA, 15 bp, Homo sapiens
aacctctgctgcctg

SEQ ID NO: 402960 - DNA, 15 bp, Homo sapiens
acctctgctgcctgg

SEQ ID NO: 402961 - DNA, 15 bp, Homo sapiens
cctctgctgcctggg

SEQ ID NO: 402962 - DNA, 15 bp, Homo sapiens
ctctgctgcctgggc

SEQ ID NO: 402963 - DNA, 15 bp, Homo sapiens
tctgctgcctgggct

SEQ ID NO: 402964 - DNA, 15 bp, Homo sapiens
ctgctgcctgggctc

SEQ ID NO: 402965 - DNA, 15 bp, Homo sapiens
tgctgcctgggctca

SEQ ID NO: 402966 - DNA, 15 bp, Homo sapiens
gctgcctgggctcag

SEQ ID NO: 402967 - DNA, 15 bp, Homo sapiens
ctgcctgggctcagg

SEQ ID NO: 402968 - DNA, 15 bp, Homo sapiens
tgcctgggctcagga

SEQ ID NO: 402969 - DNA, 15 bp, Homo sapiens
gcctgggctcaggaa

SEQ ID NO: 402970 - DNA, 15 bp, Homo sapiens
cctgggctcaggaaa

SEQ ID NO: 402971 - DNA, 15 bp, Homo sapiens
ctgggctcaggaaat

SEQ ID NO: 402972 - DNA, 15 bp, Homo sapiens
tgggctcaggaaatc

SEQ ID NO: 402973 - DNA, 15 bp, Homo sapiens
gggctcaggaaatcc

SEQ ID NO: 402974 - DNA, 15 bp, Homo sapiens
ggctcaggaaatcct

SEQ ID NO: 402975 - DNA, 15 bp, Homo sapiens
gctcaggaaatcctc

SEQ ID NO: 402976 - DNA, 15 bp, Homo sapiens
ctcaggaaatcctcc

SEQ ID NO: 402977 - DNA, 15 bp, Homo sapiens
tcaggaaatcctcct

SEQ ID NO: 402978 - DNA, 15 bp, Homo sapiens
caggaaatcctcctg

SEQ ID NO: 402979 - DNA, 15 bp, Homo sapiens
aggaaatcctcctgc

SEQ ID NO: 402980 - DNA, 15 bp, Homo sapiens
ggaaatcctcctgcc

SEQ ID NO: 402981 - DNA, 15 bp, Homo sapiens
gaaatcctcctgcct

SEQ ID NO: 402982 - DNA, 15 bp, Homo sapiens
aaatcctcctgcctc

SEQ ID NO: 402983 - DNA, 15 bp, Homo sapiens
atcctcctgcctcat

SEQ ID NO: 402984 - DNA, 15 bp, Homo sapiens
tcctcctgcctcatt

SEQ ID NO: 402985 - DNA, 15 bp, Homo sapiens
cctcctgcctcattc

SEQ ID NO: 402986 - DNA, 15 bp, Homo sapiens
cctgcctcattctcc

SEQ ID NO: 402987 - DNA, 15 bp, Homo sapiens
ctgcctcattctccc

SEQ ID NO: 402988 - DNA, 15 bp, Homo sapiens
tgcctcattctccca

SEQ ID NO: 402989 - DNA, 15 bp, Homo sapiens
gcctcattctcccaa

SEQ ID NO: 402990 - DNA, 15 bp, Homo sapiens
cctcattctcccaag

SEQ ID NO: 402991 - DNA, 15 bp, Homo sapiens
ctcattctcccaagt

SEQ ID NO: 402992 - DNA, 15 bp, Homo sapiens
tcattctcccaagta

SEQ ID NO: 402993 - DNA, 15 bp, Homo sapiens
cattctcccaagtag

SEQ ID NO: 402994 - DNA, 15 bp, Homo sapiens
attctcccaagtagc

SEQ ID NO: 402995 - DNA, 15 bp, Homo sapiens
ttctcccaagtagct

SEQ ID NO: 402996 - DNA, 15 bp, Homo sapiens
tgggaccacaggtgc

SEQ ID NO: 402997 - DNA, 15 bp, Homo sapiens
gggaccacaggtgca

SEQ ID NO: 402998 - DNA, 15 bp, Homo sapiens
ggaccacaggtgcat

SEQ ID NO: 402999 - DNA, 15 bp, Homo sapiens
gaccacaggtgcatg

SEQ ID NO: 403000 - DNA, 15 bp, Homo sapiens
accacaggtgcatgc

SEQ ID NO: 403001 - DNA, 15 bp, Homo sapiens
ccacaggtgcatgcc

SEQ ID NO: 403002 - DNA, 15 bp, Homo sapiens
cacaggtgcatgcca

SEQ ID NO: 403003 - DNA, 15 bp, Homo sapiens
acaggtgcatgccac

SEQ ID NO: 403004 - DNA, 15 bp, Homo sapiens
caggtgcatgccacc

SEQ ID NO: 403005 - DNA, 15 bp, Homo sapiens
catgccaccacaccc

SEQ ID NO: 403006 - DNA, 15 bp, Homo sapiens
atgccaccacacccg

SEQ ID NO: 403007 - DNA, 15 bp, Homo sapiens
accacacccggctag

SEQ ID NO: 403008 - DNA, 15 bp, Homo sapiens
ccacacccggctagt

SEQ ID NO: 403009 - DNA, 15 bp, Homo sapiens
cacacccggctagtt

SEQ ID NO: 403010 - DNA, 15 bp, Homo sapiens
acacccggctagttt

SEQ ID NO: 403011 - DNA, 15 bp, Homo sapiens
cacccggctagtttt

SEQ ID NO: 403012 - DNA, 15 bp, Homo sapiens
acccggctagttttt

SEQ ID NO: 403013 - DNA, 15 bp, Homo sapiens
cccggctagtttttt

SEQ ID NO: 403014 - DNA, 15 bp, Homo sapiens
ccggctagttttttg

SEQ ID NO: 403015 - DNA, 15 bp, Homo sapiens
cggctagttttttgt

SEQ ID NO: 403016 - DNA, 15 bp, Homo sapiens
ggctagttttttgta

SEQ ID NO: 403017 - DNA, 15 bp, Homo sapiens
gctagttttttgtat

SEQ ID NO: 403018 - DNA, 15 bp, Homo sapiens
ctagttttttgtatt

SEQ ID NO: 403019 - DNA, 15 bp, Homo sapiens
tagttttttgtattt

SEQ ID NO: 403020 - DNA, 15 bp, Homo sapiens
agttttttgtatttt

SEQ ID NO: 403021 - DNA, 15 bp, Homo sapiens
gttttttgtattttt

SEQ ID NO: 403022 - DNA, 15 bp, Homo sapiens
ttttggtagagacag

SEQ ID NO: 403023 - DNA, 15 bp, Homo sapiens
tttggtagagacagg

SEQ ID NO: 403024 - DNA, 15 bp, Homo sapiens
ttggtagagacaggg

SEQ ID NO: 403025 - DNA, 15 bp, Homo sapiens
tggtagagacagggt

SEQ ID NO: 403026 - DNA, 15 bp, Homo sapiens
ggtagagacagggtc

SEQ ID NO: 403027 - DNA, 15 bp, Homo sapiens
gtagagacagggtct

SEQ ID NO: 403028 - DNA, 15 bp, Homo sapiens
agagacagggtcttg

SEQ ID NO: 403029 - DNA, 15 bp, Homo sapiens
agacagggtcttgcc

SEQ ID NO: 403030 - DNA, 15 bp, Homo sapiens
gacagggtcttgcca

SEQ ID NO: 403031 - DNA, 15 bp, Homo sapiens
acagggtcttgccat

SEQ ID NO: 403032 - DNA, 15 bp, Homo sapiens
cagggtcttgccatg

SEQ ID NO: 403033 - DNA, 15 bp, Homo sapiens
agggtcttgccatgt

SEQ ID NO: 403034 - DNA, 15 bp, Homo sapiens
gggtcttgccatgtg

SEQ ID NO: 403035 - DNA, 15 bp, Homo sapiens
ggtcttgccatgtgg

SEQ ID NO: 403036 - DNA, 15 bp, Homo sapiens
gtcttgccatgtggc

SEQ ID NO: 403037 - DNA, 15 bp, Homo sapiens
tcttgccatgtggcc

SEQ ID NO: 403038 - DNA, 15 bp, Homo sapiens
cttgccatgtggccc

SEQ ID NO: 403039 - DNA, 15 bp, Homo sapiens
ttgccatgtggccca

SEQ ID NO: 403040 - DNA, 15 bp, Homo sapiens
tgccatgtggcccag

SEQ ID NO: 403041 - DNA, 15 bp, Homo sapiens
gccatgtggcccagg

SEQ ID NO: 403042 - DNA, 15 bp, Homo sapiens
ccatgtggcccaggc

SEQ ID NO: 403043 - DNA, 15 bp, Homo sapiens
catgtggcccaggct

SEQ ID NO: 403044 - DNA, 15 bp, Homo sapiens
atgtggcccaggctg

SEQ ID NO: 403045 - DNA, 15 bp, Homo sapiens
tgtggcccaggctgc

SEQ ID NO: 403046 - DNA, 15 bp, Homo sapiens
gtggcccaggctgct

SEQ ID NO: 403047 - DNA, 15 bp, Homo sapiens
tggcccaggctgctc

SEQ ID NO: 403048 - DNA, 15 bp, Homo sapiens
ggcccaggctgctcc

SEQ ID NO: 403049 - DNA, 15 bp, Homo sapiens
gcccaggctgctccc

SEQ ID NO: 403050 - DNA, 15 bp, Homo sapiens
cccaggctgctccca

SEQ ID NO: 403051 - DNA, 15 bp, Homo sapiens
ccaggctgctcccaa

SEQ ID NO: 403052 - DNA, 15 bp, Homo sapiens
caggctgctcccaaa

SEQ ID NO: 403053 - DNA, 15 bp, Homo sapiens
aggctgctcccaaac

SEQ ID NO: 403054 - DNA, 15 bp, Homo sapiens
ggctgctcccaaact

SEQ ID NO: 403055 - DNA, 15 bp, Homo sapiens
gctgctcccaaactc

SEQ ID NO: 403056 - DNA, 15 bp, Homo sapiens
ctgctcccaaactcc

SEQ ID NO: 403057 - DNA, 15 bp, Homo sapiens
tgctcccaaactcct

SEQ ID NO: 403058 - DNA, 15 bp, Homo sapiens
gctcccaaactcctg

SEQ ID NO: 403059 - DNA, 15 bp, Homo sapiens
ctcccaaactcctga

SEQ ID NO: 403060 - DNA, 15 bp, Homo sapiens
tcccaaactcctgag

SEQ ID NO: 403061 - DNA, 15 bp, Homo sapiens
cccaaactcctgagc

SEQ ID NO: 403062 - DNA, 15 bp, Homo sapiens
ccaaactcctgagct

SEQ ID NO: 403063 - DNA, 15 bp, Homo sapiens
agctcaagcaatcta

SEQ ID NO: 403064 - DNA, 15 bp, Homo sapiens
gctcaagcaatctaa

SEQ ID NO: 403065 - DNA, 15 bp, Homo sapiens
ctcaagcaatctaac

SEQ ID NO: 403066 - DNA, 15 bp, Homo sapiens
tcaagcaatctaact

SEQ ID NO: 403067 - DNA, 15 bp, Homo sapiens
caagcaatctaactg

SEQ ID NO: 403068 - DNA, 15 bp, Homo sapiens
aagcaatctaactgc

SEQ ID NO: 403069 - DNA, 15 bp, Homo sapiens
agcaatctaactgcc

SEQ ID NO: 403070 - DNA, 15 bp, Homo sapiens
gcaatctaactgcct

SEQ ID NO: 403071 - DNA, 15 bp, Homo sapiens
caatctaactgcctc

SEQ ID NO: 403072 - DNA, 15 bp, Homo sapiens
aatctaactgcctcg

SEQ ID NO: 403073 - DNA, 15 bp, Homo sapiens
atctaactgcctcgt

SEQ ID NO: 403074 - DNA, 15 bp, Homo sapiens
tctaactgcctcgtc

SEQ ID NO: 403075 - DNA, 15 bp, Homo sapiens
ctaactgcctcgtcc

SEQ ID NO: 403076 - DNA, 15 bp, Homo sapiens
taactgcctcgtccc

SEQ ID NO: 403077 - DNA, 15 bp, Homo sapiens
aactgcctcgtccct

SEQ ID NO: 403078 - DNA, 15 bp, Homo sapiens
actgcctcgtccctc

SEQ ID NO: 403079 - DNA, 15 bp, Homo sapiens
ctgcctcgtccctcc

SEQ ID NO: 403080 - DNA, 15 bp, Homo sapiens
tgcctcgtccctcca

SEQ ID NO: 403081 - DNA, 15 bp, Homo sapiens
gcctcgtccctccaa

SEQ ID NO: 403082 - DNA, 15 bp, Homo sapiens
cctcgtccctccaaa

SEQ ID NO: 403083 - DNA, 15 bp, Homo sapiens
ctcgtccctccaaag

SEQ ID NO: 403084 - DNA, 15 bp, Homo sapiens
tcgtccctccaaagt

SEQ ID NO: 403085 - DNA, 15 bp, Homo sapiens
cgtccctccaaagtg

SEQ ID NO: 403086 - DNA, 15 bp, Homo sapiens
gtccctccaaagtgc

SEQ ID NO: 403087 - DNA, 15 bp, Homo sapiens
tccctccaaagtgct

SEQ ID NO: 403088 - DNA, 15 bp, Homo sapiens
ccctccaaagtgctg

SEQ ID NO: 403089 - DNA, 15 bp, Homo sapiens
cctccaaagtgctgg

SEQ ID NO: 403090 - DNA, 15 bp, Homo sapiens
ctccaaagtgctggg

SEQ ID NO: 403091 - DNA, 15 bp, Homo sapiens
tccaaagtgctggga

SEQ ID NO: 403092 - DNA, 15 bp, Homo sapiens
gcgtgagccactgcg

SEQ ID NO: 403093 - DNA, 15 bp, Homo sapiens
cgtgagccactgcgc

SEQ ID NO: 403094 - DNA, 15 bp, Homo sapiens
gtgagccactgcgcc

SEQ ID NO: 403095 - DNA, 15 bp, Homo sapiens
tgagccactgcgccc

SEQ ID NO: 403096 - DNA, 15 bp, Homo sapiens
gagccactgcgccca

SEQ ID NO: 403097 - DNA, 15 bp, Homo sapiens
agccactgcgcccag

SEQ ID NO: 403098 - DNA, 15 bp, Homo sapiens
gccactgcgcccagc

SEQ ID NO: 403099 - DNA, 15 bp, Homo sapiens
ccactgcgcccagcc

SEQ ID NO: 403100 - DNA, 15 bp, Homo sapiens
cactgcgcccagcca

SEQ ID NO: 403101 - DNA, 15 bp, Homo sapiens
actgcgcccagccaa

SEQ ID NO: 403102 - DNA, 15 bp, Homo sapiens
ctgcgcccagccaag

SEQ ID NO: 403103 - DNA, 15 bp, Homo sapiens
tgcgcccagccaagt

SEQ ID NO: 403104 - DNA, 15 bp, Homo sapiens
gcgcccagccaagtg

SEQ ID NO: 403105 - DNA, 15 bp, Homo sapiens
cgcccagccaagtgc

SEQ ID NO: 403106 - DNA, 15 bp, Homo sapiens
gcccagccaagtgct

SEQ ID NO: 403107 - DNA, 15 bp, Homo sapiens
cccagccaagtgctt

SEQ ID NO: 403108 - DNA, 15 bp, Homo sapiens
ccagccaagtgcttc

SEQ ID NO: 403109 - DNA, 15 bp, Homo sapiens
cagccaagtgcttct

SEQ ID NO: 403110 - DNA, 15 bp, Homo sapiens
agccaagtgcttctt

SEQ ID NO: 403111 - DNA, 15 bp, Homo sapiens
gccaagtgcttcttg

SEQ ID NO: 403112 - DNA, 15 bp, Homo sapiens
ccaagtgcttcttga

SEQ ID NO: 403113 - DNA, 15 bp, Homo sapiens
caagtgcttcttgat

SEQ ID NO: 403114 - DNA, 15 bp, Homo sapiens
aagtgcttcttgatt

SEQ ID NO: 403115 - DNA, 15 bp, Homo sapiens
agtgcttcttgattt

SEQ ID NO: 403116 - DNA, 15 bp, Homo sapiens
gtgcttcttgatttc

SEQ ID NO: 403117 - DNA, 15 bp, Homo sapiens
tgcttcttgatttct

SEQ ID NO: 403118 - DNA, 15 bp, Homo sapiens
gcttcttgatttcta

SEQ ID NO: 403119 - DNA, 15 bp, Homo sapiens
cttcttgatttctat

SEQ ID NO: 403120 - DNA, 15 bp, Homo sapiens
ttcttgatttctatc

SEQ ID NO: 403121 - DNA, 15 bp, Homo sapiens
tcttgatttctatca

SEQ ID NO: 403122 - DNA, 15 bp, Homo sapiens
cttgatttctatcat

SEQ ID NO: 403123 - DNA, 15 bp, Homo sapiens
ttgatttctatcata

SEQ ID NO: 403124 - DNA, 15 bp, Homo sapiens
tgatttctatcatat

SEQ ID NO: 403125 - DNA, 15 bp, Homo sapiens
gatttctatcatatt

SEQ ID NO: 403126 - DNA, 15 bp, Homo sapiens
atttctatcatattg

SEQ ID NO: 403127 - DNA, 15 bp, Homo sapiens
tttctatcatattgt

SEQ ID NO: 403128 - DNA, 15 bp, Homo sapiens
ttctatcatattgtg

SEQ ID NO: 403129 - DNA, 15 bp, Homo sapiens
tctatcatattgtga

SEQ ID NO: 403130 - DNA, 15 bp, Homo sapiens
ctatcatattgtgat

SEQ ID NO: 403131 - DNA, 15 bp, Homo sapiens
tatcatattgtgatg

SEQ ID NO: 403132 - DNA, 15 bp, Homo sapiens
atcatattgtgatgt

SEQ ID NO: 403133 - DNA, 15 bp, Homo sapiens
tcatattgtgatgtt

SEQ ID NO: 403134 - DNA, 15 bp, Homo sapiens
catattgtgatgttc

SEQ ID NO: 403135 - DNA, 15 bp, Homo sapiens
atattgtgatgttca

SEQ ID NO: 403136 - DNA, 15 bp, Homo sapiens
tattgtgatgttcag

SEQ ID NO: 403137 - DNA, 15 bp, Homo sapiens
attgtgatgttcaga

SEQ ID NO: 403138 - DNA, 15 bp, Homo sapiens
ttgtgatgttcagaa

SEQ ID NO: 403139 - DNA, 15 bp, Homo sapiens
tgtgatgttcagaat

SEQ ID NO: 403140 - DNA, 15 bp, Homo sapiens
gtgatgttcagaatc

SEQ ID NO: 403141 - DNA, 15 bp, Homo sapiens
tgatgttcagaatct

SEQ ID NO: 403142 - DNA, 15 bp, Homo sapiens
gatgttcagaatcta

SEQ ID NO: 403143 - DNA, 15 bp, Homo sapiens
atgttcagaatctaa

SEQ ID NO: 403144 - DNA, 15 bp, Homo sapiens
tgttcagaatctaat

SEQ ID NO: 403145 - DNA, 15 bp, Homo sapiens
gttcagaatctaatg

SEQ ID NO: 403146 - DNA, 15 bp, Homo sapiens
ttcagaatctaatgt

SEQ ID NO: 403147 - DNA, 15 bp, Homo sapiens
tcagaatctaatgta

SEQ ID NO: 403148 - DNA, 15 bp, Homo sapiens
cagaatctaatgtag

SEQ ID NO: 403149 - DNA, 15 bp, Homo sapiens
agaatctaatgtagt

SEQ ID NO: 403150 - DNA, 15 bp, Homo sapiens
gaatctaatgtagtt

SEQ ID NO: 403151 - DNA, 15 bp, Homo sapiens
aatctaatgtagtta

SEQ ID NO: 403152 - DNA, 15 bp, Homo sapiens
atctaatgtagttat

SEQ ID NO: 403153 - DNA, 15 bp, Homo sapiens
tctaatgtagttatg

SEQ ID NO: 403154 - DNA, 15 bp, Homo sapiens
ctaatgtagttatgt

SEQ ID NO: 403155 - DNA, 15 bp, Homo sapiens
taatgtagttatgtg

SEQ ID NO: 403156 - DNA, 15 bp, Homo sapiens
aatgtagttatgtgg

SEQ ID NO: 403157 - DNA, 15 bp, Homo sapiens
atgtagttatgtggc

SEQ ID NO: 403158 - DNA, 15 bp, Homo sapiens
tgtagttatgtggcc

SEQ ID NO: 403159 - DNA, 15 bp, Homo sapiens
gtagttatgtggccc

SEQ ID NO: 403160 - DNA, 15 bp, Homo sapiens
tagttatgtggccct

SEQ ID NO: 403161 - DNA, 15 bp, Homo sapiens
agttatgtggccctt

SEQ ID NO: 403162 - DNA, 15 bp, Homo sapiens
gttatgtggccctta

SEQ ID NO: 403163 - DNA, 15 bp, Homo sapiens
ttatgtggcccttac

SEQ ID NO: 403164 - DNA, 15 bp, Homo sapiens
tatgtggcccttacg

SEQ ID NO: 403165 - DNA, 15 bp, Homo sapiens
atgtggcccttacgt

SEQ ID NO: 403166 - DNA, 15 bp, Homo sapiens
tgtggcccttacgtt

SEQ ID NO: 403167 - DNA, 15 bp, Homo sapiens
gtggcccttacgtta

SEQ ID NO: 403168 - DNA, 15 bp, Homo sapiens
tggcccttacgttac

SEQ ID NO: 403169 - DNA, 15 bp, Homo sapiens
ggcccttacgttact

SEQ ID NO: 403170 - DNA, 15 bp, Homo sapiens
gcccttacgttactc

SEQ ID NO: 403171 - DNA, 15 bp, Homo sapiens
cccttacgttactct

SEQ ID NO: 403172 - DNA, 15 bp, Homo sapiens
ccttacgttactctg

SEQ ID NO: 403173 - DNA, 15 bp, Homo sapiens
cttacgttactctgc

SEQ ID NO: 403174 - DNA, 15 bp, Homo sapiens
ttacgttactctgcc

SEQ ID NO: 403175 - DNA, 15 bp, Homo sapiens
tacgttactctgccc

SEQ ID NO: 403176 - DNA, 15 bp, Homo sapiens
acgttactctgccct

SEQ ID NO: 403177 - DNA, 15 bp, Homo sapiens
cgttactctgccctg

SEQ ID NO: 403178 - DNA, 15 bp, Homo sapiens
gttactctgccctgt

SEQ ID NO: 403179 - DNA, 15 bp, Homo sapiens
ttactctgccctgta

SEQ ID NO: 403180 - DNA, 15 bp, Homo sapiens
tactctgccctgtac

SEQ ID NO: 403181 - DNA, 15 bp, Homo sapiens
actctgccctgtact

SEQ ID NO: 403182 - DNA, 15 bp, Homo sapiens
ctctgccctgtacta

SEQ ID NO: 403183 - DNA, 15 bp, Homo sapiens
tctgccctgtactat

SEQ ID NO: 403184 - DNA, 15 bp, Homo sapiens
ctgccctgtactatc

SEQ ID NO: 403185 - DNA, 15 bp, Homo sapiens
tgccctgtactatct

SEQ ID NO: 403186 - DNA, 15 bp, Homo sapiens
gccctgtactatctt

SEQ ID NO: 403187 - DNA, 15 bp, Homo sapiens
ccctgtactatcttc

SEQ ID NO: 403188 - DNA, 15 bp, Homo sapiens
cctgtactatcttct

SEQ ID NO: 403189 - DNA, 15 bp, Homo sapiens
ctgtactatcttctt

SEQ ID NO: 403190 - DNA, 15 bp, Homo sapiens
tgtactatcttcttt

SEQ ID NO: 403191 - DNA, 15 bp, Homo sapiens
gtactatcttcttta

SEQ ID NO: 403192 - DNA, 15 bp, Homo sapiens
tactatcttctttat

SEQ ID NO: 403193 - DNA, 15 bp, Homo sapiens
actatcttctttatt

SEQ ID NO: 403194 - DNA, 15 bp, Homo sapiens
ctatcttctttatta

SEQ ID NO: 403195 - DNA, 15 bp, Homo sapiens
tatcttctttattat

SEQ ID NO: 403196 - DNA, 15 bp, Homo sapiens
atcttctttattatt

SEQ ID NO: 403197 - DNA, 15 bp, Homo sapiens
tcttctttattattt

SEQ ID NO: 403198 - DNA, 15 bp, Homo sapiens
cttctttattatttt

SEQ ID NO: 403199 - DNA, 15 bp, Homo sapiens
ttctttattatttta

SEQ ID NO: 403200 - DNA, 15 bp, Homo sapiens
tctttattattttac

SEQ ID NO: 403201 - DNA, 15 bp, Homo sapiens
ctttattattttaca

SEQ ID NO: 403202 - DNA, 15 bp, Homo sapiens
tttattattttacat

SEQ ID NO: 403203 - DNA, 15 bp, Homo sapiens
ttattattttacatt

SEQ ID NO: 403204 - DNA, 15 bp, Homo sapiens
tattattttacattc

SEQ ID NO: 403205 - DNA, 15 bp, Homo sapiens
attattttacattca

SEQ ID NO: 403206 - DNA, 15 bp, Homo sapiens
ttattttacattcat

SEQ ID NO: 403207 - DNA, 15 bp, Homo sapiens
tattttacattcatt

SEQ ID NO: 403208 - DNA, 15 bp, Homo sapiens
attttacattcattt

SEQ ID NO: 403209 - DNA, 15 bp, Homo sapiens
ttttacattcattta

SEQ ID NO: 403210 - DNA, 15 bp, Homo sapiens
tttacattcatttat

SEQ ID NO: 403211 - DNA, 15 bp, Homo sapiens
ttacattcatttata

SEQ ID NO: 403212 - DNA, 15 bp, Homo sapiens
tacattcatttatat

SEQ ID NO: 403213 - DNA, 15 bp, Homo sapiens
acattcatttatatt

SEQ ID NO: 403214 - DNA, 15 bp, Homo sapiens
cattcatttatatta

SEQ ID NO: 403215 - DNA, 15 bp, Homo sapiens
attcatttatattat

SEQ ID NO: 403216 - DNA, 15 bp, Homo sapiens
ttcatttatattata

SEQ ID NO: 403217 - DNA, 15 bp, Homo sapiens
tcatttatattatac

SEQ ID NO: 403218 - DNA, 15 bp, Homo sapiens
catttatattatact

SEQ ID NO: 403219 - DNA, 15 bp, Homo sapiens
atttatattatactt

SEQ ID NO: 403220 - DNA, 15 bp, Homo sapiens
tttatattatacttc

SEQ ID NO: 403221 - DNA, 15 bp, Homo sapiens
ttatattatacttct

SEQ ID NO: 403222 - DNA, 15 bp, Homo sapiens
tatattatacttcta

SEQ ID NO: 403223 - DNA, 15 bp, Homo sapiens
atattatacttctaa

SEQ ID NO: 403224 - DNA, 15 bp, Homo sapiens
tattatacttctaaa

SEQ ID NO: 403225 - DNA, 15 bp, Homo sapiens
attatacttctaaat

SEQ ID NO: 403226 - DNA, 15 bp, Homo sapiens
ttatacttctaaatt

SEQ ID NO: 403227 - DNA, 15 bp, Homo sapiens
tatacttctaaatta

SEQ ID NO: 403228 - DNA, 15 bp, Homo sapiens
atacttctaaattat

SEQ ID NO: 403229 - DNA, 15 bp, Homo sapiens
tacttctaaattata

SEQ ID NO: 403230 - DNA, 15 bp, Homo sapiens
acttctaaattataa

SEQ ID NO: 403231 - DNA, 15 bp, Homo sapiens
cttctaaattataaa

SEQ ID NO: 403232 - DNA, 15 bp, Homo sapiens
ttctaaattataaaa

SEQ ID NO: 403233 - DNA, 15 bp, Homo sapiens
tctaaattataaaat

SEQ ID NO: 403234 - DNA, 15 bp, Homo sapiens
ctaaattataaaata

SEQ ID NO: 403235 - DNA, 15 bp, Homo sapiens
taaattataaaataa

SEQ ID NO: 403236 - DNA, 15 bp, Homo sapiens
aaattataaaataaa

SEQ ID NO: 403237 - DNA, 15 bp, Homo sapiens
aattataaaataaaa

SEQ ID NO: 403238 - DNA, 15 bp, Homo sapiens
attataaaataaaat

SEQ ID NO: 403239 - DNA, 15 bp, Homo sapiens
ttataaaataaaatt

SEQ ID NO: 403240 - DNA, 15 bp, Homo sapiens
tataaaataaaatta

SEQ ID NO: 403241 - DNA, 15 bp, Homo sapiens
ataaaataaaattat

SEQ ID NO: 403242 - DNA, 15 bp, Homo sapiens
taaaataaaattata

SEQ ID NO: 403243 - DNA, 15 bp, Homo sapiens
aaaataaaattatag

SEQ ID NO: 403244 - DNA, 15 bp, Homo sapiens
aaataaaattatagt

SEQ ID NO: 403245 - DNA, 15 bp, Homo sapiens
aataaaattatagtt

SEQ ID NO: 403246 - DNA, 15 bp, Homo sapiens
ataaaattatagttt

SEQ ID NO: 403247 - DNA, 15 bp, Homo sapiens
taaaattatagttta

SEQ ID NO: 403248 - DNA, 15 bp, Homo sapiens
aaaattatagtttaa

SEQ ID NO: 403249 - DNA, 15 bp, Homo sapiens
aaattatagtttaat

SEQ ID NO: 403250 - DNA, 15 bp, Homo sapiens
aattatagtttaata

SEQ ID NO: 403251 - DNA, 15 bp, Homo sapiens
attatagtttaatat

SEQ ID NO: 403252 - DNA, 15 bp, Homo sapiens
ttatagtttaatata

SEQ ID NO: 403253 - DNA, 15 bp, Homo sapiens
tatagtttaatataa

SEQ ID NO: 403254 - DNA, 15 bp, Homo sapiens
atagtttaatataaa

SEQ ID NO: 403255 - DNA, 15 bp, Homo sapiens
tagtttaatataaac

SEQ ID NO: 403256 - DNA, 15 bp, Homo sapiens
agtttaatataaact

SEQ ID NO: 403257 - DNA, 15 bp, Homo sapiens
gtttaatataaacta

SEQ ID NO: 403258 - DNA, 15 bp, Homo sapiens
tttaatataaactat

SEQ ID NO: 403259 - DNA, 15 bp, Homo sapiens
ttaatataaactata

SEQ ID NO: 403260 - DNA, 15 bp, Homo sapiens
taatataaactatat

SEQ ID NO: 403261 - DNA, 15 bp, Homo sapiens
aatataaactatata

SEQ ID NO: 403262 - DNA, 15 bp, Homo sapiens
atataaactatatat

SEQ ID NO: 403263 - DNA, 15 bp, Homo sapiens
tataaactatatata

SEQ ID NO: 403264 - DNA, 15 bp, Homo sapiens
ataaactatatataa

SEQ ID NO: 403265 - DNA, 15 bp, Homo sapiens
taaactatatataaa

SEQ ID NO: 403266 - DNA, 15 bp, Homo sapiens
aaactatatataaat

SEQ ID NO: 403267 - DNA, 15 bp, Homo sapiens
aactatatataaatc

SEQ ID NO: 403268 - DNA, 15 bp, Homo sapiens
actatatataaatct

SEQ ID NO: 403269 - DNA, 15 bp, Homo sapiens
ctatatataaatcta

SEQ ID NO: 403270 - DNA, 15 bp, Homo sapiens
tatatataaatctaa

SEQ ID NO: 403271 - DNA, 15 bp, Homo sapiens
atatataaatctaat

SEQ ID NO: 403272 - DNA, 15 bp, Homo sapiens
tatataaatctaata

SEQ ID NO: 403273 - DNA, 15 bp, Homo sapiens
atataaatctaatat

SEQ ID NO: 403274 - DNA, 15 bp, Homo sapiens
tataaatctaatata

SEQ ID NO: 403275 - DNA, 15 bp, Homo sapiens
ataaatctaatatag

SEQ ID NO: 403276 - DNA, 15 bp, Homo sapiens
taaatctaatataga

SEQ ID NO: 403277 - DNA, 15 bp, Homo sapiens
aaatctaatatagat

SEQ ID NO: 403278 - DNA, 15 bp, Homo sapiens
aatctaatatagatt

SEQ ID NO: 403279 - DNA, 15 bp, Homo sapiens
atctaatatagattt

SEQ ID NO: 403280 - DNA, 15 bp, Homo sapiens
tctaatatagatttt

SEQ ID NO: 403281 - DNA, 15 bp, Homo sapiens
ctaatatagattttt

SEQ ID NO: 403282 - DNA, 15 bp, Homo sapiens
taatatagattttta

SEQ ID NO: 403283 - DNA, 15 bp, Homo sapiens
aatatagatttttac

SEQ ID NO: 403284 - DNA, 15 bp, Homo sapiens
atatagatttttaca

SEQ ID NO: 403285 - DNA, 15 bp, Homo sapiens
tatagatttttacac

SEQ ID NO: 403286 - DNA, 15 bp, Homo sapiens
atagatttttacact

SEQ ID NO: 403287 - DNA, 15 bp, Homo sapiens
tagatttttacacta

SEQ ID NO: 403288 - DNA, 15 bp, Homo sapiens
agatttttacactat

SEQ ID NO: 403289 - DNA, 15 bp, Homo sapiens
gatttttacactatg

SEQ ID NO: 403290 - DNA, 15 bp, Homo sapiens
atttttacactatga

SEQ ID NO: 403291 - DNA, 15 bp, Homo sapiens
tttttacactatgaa

SEQ ID NO: 403292 - DNA, 15 bp, Homo sapiens
ttttacactatgaaa

SEQ ID NO: 403293 - DNA, 15 bp, Homo sapiens
tttacactatgaaat

SEQ ID NO: 403294 - DNA, 15 bp, Homo sapiens
ttacactatgaaata

SEQ ID NO: 403295 - DNA, 15 bp, Homo sapiens
tacactatgaaataa

SEQ ID NO: 403296 - DNA, 15 bp, Homo sapiens
acactatgaaataat

SEQ ID NO: 403297 - DNA, 15 bp, Homo sapiens
cactatgaaataatg

SEQ ID NO: 403298 - DNA, 15 bp, Homo sapiens
actatgaaataatgc

SEQ ID NO: 403299 - DNA, 15 bp, Homo sapiens
ctatgaaataatgca

SEQ ID NO: 403300 - DNA, 15 bp, Homo sapiens
tatgaaataatgcac

SEQ ID NO: 403301 - DNA, 15 bp, Homo sapiens
atgaaataatgcacg

SEQ ID NO: 403302 - DNA, 15 bp, Homo sapiens
tgaaataatgcacgt

SEQ ID NO: 403303 - DNA, 15 bp, Homo sapiens
gaaataatgcacgtt

SEQ ID NO: 403304 - DNA, 15 bp, Homo sapiens
aaataatgcacgttt

SEQ ID NO: 403305 - DNA, 15 bp, Homo sapiens
aataatgcacgtttc

SEQ ID NO: 403306 - DNA, 15 bp, Homo sapiens
ataatgcacgtttct

SEQ ID NO: 403307 - DNA, 15 bp, Homo sapiens
taatgcacgtttctt

SEQ ID NO: 403308 - DNA, 15 bp, Homo sapiens
aatgcacgtttcttg

SEQ ID NO: 403309 - DNA, 15 bp, Homo sapiens
atgcacgtttcttga

SEQ ID NO: 403310 - DNA, 15 bp, Homo sapiens
tgcacgtttcttgaa

SEQ ID NO: 403311 - DNA, 15 bp, Homo sapiens
gcacgtttcttgaaa

SEQ ID NO: 403312 - DNA, 15 bp, Homo sapiens
cacgtttcttgaaag

SEQ ID NO: 403313 - DNA, 15 bp, Homo sapiens
acgtttcttgaaaga

SEQ ID NO: 403314 - DNA, 15 bp, Homo sapiens
cgtttcttgaaagag

SEQ ID NO: 403315 - DNA, 15 bp, Homo sapiens
gtttcttgaaagagc

SEQ ID NO: 403316 - DNA, 15 bp, Homo sapiens
tttcttgaaagagca

SEQ ID NO: 403317 - DNA, 15 bp, Homo sapiens
ttcttgaaagagcaa

SEQ ID NO: 403318 - DNA, 15 bp, Homo sapiens
tcttgaaagagcaac

SEQ ID NO: 403319 - DNA, 15 bp, Homo sapiens
cttgaaagagcaact

SEQ ID NO: 403320 - DNA, 15 bp, Homo sapiens
ttgaaagagcaacta

SEQ ID NO: 403321 - DNA, 15 bp, Homo sapiens
tgaaagagcaactat

SEQ ID NO: 403322 - DNA, 15 bp, Homo sapiens
gaaagagcaactata

SEQ ID NO: 403323 - DNA, 15 bp, Homo sapiens
aaagagcaactatag

SEQ ID NO: 403324 - DNA, 15 bp, Homo sapiens
aagagcaactatagt

SEQ ID NO: 403325 - DNA, 15 bp, Homo sapiens
agagcaactatagta

SEQ ID NO: 403326 - DNA, 15 bp, Homo sapiens
gagcaactatagtag

SEQ ID NO: 403327 - DNA, 15 bp, Homo sapiens
agcaactatagtagt

SEQ ID NO: 403328 - DNA, 15 bp, Homo sapiens
gcaactatagtagta

SEQ ID NO: 403329 - DNA, 15 bp, Homo sapiens
caactatagtagtag

SEQ ID NO: 403330 - DNA, 15 bp, Homo sapiens
aactatagtagtaga

SEQ ID NO: 403331 - DNA, 15 bp, Homo sapiens
actatagtagtagat

SEQ ID NO: 403332 - DNA, 15 bp, Homo sapiens
ctatagtagtagata

SEQ ID NO: 403333 - DNA, 15 bp, Homo sapiens
tatagtagtagatac

SEQ ID NO: 403334 - DNA, 15 bp, Homo sapiens
atagtagtagataca

SEQ ID NO: 403335 - DNA, 15 bp, Homo sapiens
tagtagtagatacat

SEQ ID NO: 403336 - DNA, 15 bp, Homo sapiens
agtagtagatacatg

SEQ ID NO: 403337 - DNA, 15 bp, Homo sapiens
gtagtagatacatgt

SEQ ID NO: 403338 - DNA, 15 bp, Homo sapiens
tagtagatacatgtt

SEQ ID NO: 403339 - DNA, 15 bp, Homo sapiens
agtagatacatgtta

SEQ ID NO: 403340 - DNA, 15 bp, Homo sapiens
gtagatacatgttat

SEQ ID NO: 403341 - DNA, 15 bp, Homo sapiens
tagatacatgttata

SEQ ID NO: 403342 - DNA, 15 bp, Homo sapiens
agatacatgttataa

SEQ ID NO: 403343 - DNA, 15 bp, Homo sapiens
gatacatgttataac

SEQ ID NO: 403344 - DNA, 15 bp, Homo sapiens
atacatgttataacg

SEQ ID NO: 403345 - DNA, 15 bp, Homo sapiens
tacatgttataacgt

SEQ ID NO: 403346 - DNA, 15 bp, Homo sapiens
acatgttataacgtg

SEQ ID NO: 403347 - DNA, 15 bp, Homo sapiens
catgttataacgtgc

SEQ ID NO: 403348 - DNA, 15 bp, Homo sapiens
atgttataacgtgca

SEQ ID NO: 403349 - DNA, 15 bp, Homo sapiens
tgttataacgtgcaa

SEQ ID NO: 403350 - DNA, 15 bp, Homo sapiens
gttataacgtgcaac

SEQ ID NO: 403351 - DNA, 15 bp, Homo sapiens
ttataacgtgcaacg

SEQ ID NO: 403352 - DNA, 15 bp, Homo sapiens
tataacgtgcaacgt

SEQ ID NO: 403353 - DNA, 15 bp, Homo sapiens
ataacgtgcaacgtc

SEQ ID NO: 403354 - DNA, 15 bp, Homo sapiens
taacgtgcaacgtct

SEQ ID NO: 403355 - DNA, 15 bp, Homo sapiens
aacgtgcaacgtctc

SEQ ID NO: 403356 - DNA, 15 bp, Homo sapiens
acgtgcaacgtctcc

SEQ ID NO: 403357 - DNA, 15 bp, Homo sapiens
cgtgcaacgtctcct

SEQ ID NO: 403358 - DNA, 15 bp, Homo sapiens
gtgcaacgtctcctg

SEQ ID NO: 403359 - DNA, 15 bp, Homo sapiens
tgcaacgtctcctgc

SEQ ID NO: 403360 - DNA, 15 bp, Homo sapiens
gcaacgtctcctgcc

SEQ ID NO: 403361 - DNA, 15 bp, Homo sapiens
caacgtctcctgccc

SEQ ID NO: 403362 - DNA, 15 bp, Homo sapiens
aacgtctcctgccct

SEQ ID NO: 403363 - DNA, 15 bp, Homo sapiens
acgtctcctgccctg

SEQ ID NO: 403364 - DNA, 15 bp, Homo sapiens
cgtctcctgccctgg

SEQ ID NO: 403365 - DNA, 15 bp, Homo sapiens
gtctcctgccctggg

SEQ ID NO: 403366 - DNA, 15 bp, Homo sapiens
tctcctgccctggga

SEQ ID NO: 403367 - DNA, 15 bp, Homo sapiens
ctcctgccctgggat

SEQ ID NO: 403368 - DNA, 15 bp, Homo sapiens
tcctgccctgggatt

SEQ ID NO: 403369 - DNA, 15 bp, Homo sapiens
cctgccctgggattc

SEQ ID NO: 403370 - DNA, 15 bp, Homo sapiens
ctgccctgggattct

SEQ ID NO: 403371 - DNA, 15 bp, Homo sapiens
tgccctgggattctt

SEQ ID NO: 403372 - DNA, 15 bp, Homo sapiens
gccctgggattcttc

SEQ ID NO: 403373 - DNA, 15 bp, Homo sapiens
ccctgggattcttcc

SEQ ID NO: 403374 - DNA, 15 bp, Homo sapiens
cctgggattcttcct

SEQ ID NO: 403375 - DNA, 15 bp, Homo sapiens
ctgggattcttccta

SEQ ID NO: 403376 - DNA, 15 bp, Homo sapiens
tgggattcttcctaa

SEQ ID NO: 403377 - DNA, 15 bp, Homo sapiens
gggattcttcctaag

SEQ ID NO: 403378 - DNA, 15 bp, Homo sapiens
ggattcttcctaagt

SEQ ID NO: 403379 - DNA, 15 bp, Homo sapiens
gattcttcctaagta

SEQ ID NO: 403380 - DNA, 15 bp, Homo sapiens
attcttcctaagtac

SEQ ID NO: 403381 - DNA, 15 bp, Homo sapiens
ttcttcctaagtacc

SEQ ID NO: 403382 - DNA, 15 bp, Homo sapiens
tcttcctaagtacca

SEQ ID NO: 403383 - DNA, 15 bp, Homo sapiens
cttcctaagtaccac

SEQ ID NO: 403384 - DNA, 15 bp, Homo sapiens
ttcctaagtaccaca

SEQ ID NO: 403385 - DNA, 15 bp, Homo sapiens
tcctaagtaccacac

SEQ ID NO: 403386 - DNA, 15 bp, Homo sapiens
cctaagtaccacacc

SEQ ID NO: 403387 - DNA, 15 bp, Homo sapiens
ctaagtaccacaccc

SEQ ID NO: 403388 - DNA, 15 bp, Homo sapiens
taagtaccacaccca

SEQ ID NO: 403389 - DNA, 15 bp, Homo sapiens
aagtaccacacccag

SEQ ID NO: 403390 - DNA, 15 bp, Homo sapiens
agtaccacacccaga

SEQ ID NO: 403391 - DNA, 15 bp, Homo sapiens
gtaccacacccagaa

SEQ ID NO: 403392 - DNA, 15 bp, Homo sapiens
taccacacccagaat

SEQ ID NO: 403393 - DNA, 15 bp, Homo sapiens
accacacccagaata

SEQ ID NO: 403394 - DNA, 15 bp, Homo sapiens
ccacacccagaataa

SEQ ID NO: 403395 - DNA, 15 bp, Homo sapiens
cacacccagaataac

SEQ ID NO: 403396 - DNA, 15 bp, Homo sapiens
acacccagaataacc

SEQ ID NO: 403397 - DNA, 15 bp, Homo sapiens
cacccagaataacca

SEQ ID NO: 403398 - DNA, 15 bp, Homo sapiens
acccagaataaccac

SEQ ID NO: 403399 - DNA, 15 bp, Homo sapiens
cccagaataaccact

SEQ ID NO: 403400 - DNA, 15 bp, Homo sapiens
ccagaataaccactg

SEQ ID NO: 403401 - DNA, 15 bp, Homo sapiens
cagaataaccactgt

SEQ ID NO: 403402 - DNA, 15 bp, Homo sapiens
agaataaccactgtt

SEQ ID NO: 403403 - DNA, 15 bp, Homo sapiens
gaataaccactgttt

SEQ ID NO: 403404 - DNA, 15 bp, Homo sapiens
aataaccactgtttc

SEQ ID NO: 403405 - DNA, 15 bp, Homo sapiens
ataaccactgtttct

SEQ ID NO: 403406 - DNA, 15 bp, Homo sapiens
taaccactgtttctt

SEQ ID NO: 403407 - DNA, 15 bp, Homo sapiens
aaccactgtttctta

SEQ ID NO: 403408 - DNA, 15 bp, Homo sapiens
accactgtttcttat

SEQ ID NO: 403409 - DNA, 15 bp, Homo sapiens
ccactgtttcttata

SEQ ID NO: 403410 - DNA, 15 bp, Homo sapiens
cactgtttcttatac

SEQ ID NO: 403411 - DNA, 15 bp, Homo sapiens
actgtttcttataca

SEQ ID NO: 403412 - DNA, 15 bp, Homo sapiens
ctgtttcttatacag

SEQ ID NO: 403413 - DNA, 15 bp, Homo sapiens
tgtttcttatacagc

SEQ ID NO: 403414 - DNA, 15 bp, Homo sapiens
gtttcttatacagct

SEQ ID NO: 403415 - DNA, 15 bp, Homo sapiens
tttcttatacagctt

SEQ ID NO: 403416 - DNA, 15 bp, Homo sapiens
ttcttatacagcttt

SEQ ID NO: 403417 - DNA, 15 bp, Homo sapiens
tcttatacagctttc

SEQ ID NO: 403418 - DNA, 15 bp, Homo sapiens
cttatacagctttcc

SEQ ID NO: 403419 - DNA, 15 bp, Homo sapiens
ttatacagctttcca

SEQ ID NO: 403420 - DNA, 15 bp, Homo sapiens
tatacagctttccag

SEQ ID NO: 403421 - DNA, 15 bp, Homo sapiens
atacagctttccaga

SEQ ID NO: 403422 - DNA, 15 bp, Homo sapiens
tacagctttccagaa

SEQ ID NO: 403423 - DNA, 15 bp, Homo sapiens
acagctttccagaaa

SEQ ID NO: 403424 - DNA, 15 bp, Homo sapiens
cagctttccagaaaa

SEQ ID NO: 403425 - DNA, 15 bp, Homo sapiens
agctttccagaaaat

SEQ ID NO: 403426 - DNA, 15 bp, Homo sapiens
gctttccagaaaatt

SEQ ID NO: 403427 - DNA, 15 bp, Homo sapiens
ctttccagaaaattt

SEQ ID NO: 403428 - DNA, 15 bp, Homo sapiens
tttccagaaaatttt

SEQ ID NO: 403429 - DNA, 15 bp, Homo sapiens
ttccagaaaatttta

SEQ ID NO: 403430 - DNA, 15 bp, Homo sapiens
tccagaaaattttat

SEQ ID NO: 403431 - DNA, 15 bp, Homo sapiens
ccagaaaattttatg

SEQ ID NO: 403432 - DNA, 15 bp, Homo sapiens
cagaaaattttatgt

SEQ ID NO: 403433 - DNA, 15 bp, Homo sapiens
agaaaattttatgta

SEQ ID NO: 403434 - DNA, 15 bp, Homo sapiens
gaaaattttatgtat

SEQ ID NO: 403435 - DNA, 15 bp, Homo sapiens
aaaattttatgtatt

SEQ ID NO: 403436 - DNA, 15 bp, Homo sapiens
aaattttatgtattt

SEQ ID NO: 403437 - DNA, 15 bp, Homo sapiens
aattttatgtatttt

SEQ ID NO: 403438 - DNA, 15 bp, Homo sapiens
attttatgtattttt

SEQ ID NO: 403439 - DNA, 15 bp, Homo sapiens
tttatgtatttttat

SEQ ID NO: 403440 - DNA, 15 bp, Homo sapiens
atgtatttttataca

SEQ ID NO: 403441 - DNA, 15 bp, Homo sapiens
tgtatttttatacaa

SEQ ID NO: 403442 - DNA, 15 bp, Homo sapiens
gtatttttatacaag

SEQ ID NO: 403443 - DNA, 15 bp, Homo sapiens
tatttttatacaagc

SEQ ID NO: 403444 - DNA, 15 bp, Homo sapiens
atttttatacaagca

SEQ ID NO: 403445 - DNA, 15 bp, Homo sapiens
tttttatacaagcac

SEQ ID NO: 403446 - DNA, 15 bp, Homo sapiens
ttttatacaagcact

SEQ ID NO: 403447 - DNA, 15 bp, Homo sapiens
tttatacaagcactt

SEQ ID NO: 403448 - DNA, 15 bp, Homo sapiens
ttatacaagcacttg

SEQ ID NO: 403449 - DNA, 15 bp, Homo sapiens
tatacaagcacttgt

SEQ ID NO: 403450 - DNA, 15 bp, Homo sapiens
atacaagcacttgta

SEQ ID NO: 403451 - DNA, 15 bp, Homo sapiens
tacaagcacttgtat

SEQ ID NO: 403452 - DNA, 15 bp, Homo sapiens
acaagcacttgtatt

SEQ ID NO: 403453 - DNA, 15 bp, Homo sapiens
caagcacttgtattc

SEQ ID NO: 403454 - DNA, 15 bp, Homo sapiens
aagcacttgtattca

SEQ ID NO: 403455 - DNA, 15 bp, Homo sapiens
agcacttgtattcac

SEQ ID NO: 403456 - DNA, 15 bp, Homo sapiens
gcacttgtattcaca

SEQ ID NO: 403457 - DNA, 15 bp, Homo sapiens
cacttgtattcacat

SEQ ID NO: 403458 - DNA, 15 bp, Homo sapiens
acttgtattcacata

SEQ ID NO: 403459 - DNA, 15 bp, Homo sapiens
cttgtattcacatac

SEQ ID NO: 403460 - DNA, 15 bp, Homo sapiens
ttgtattcacataca

SEQ ID NO: 403461 - DNA, 15 bp, Homo sapiens
tgtattcacatacac

SEQ ID NO: 403462 - DNA, 15 bp, Homo sapiens
gtattcacatacacg

SEQ ID NO: 403463 - DNA, 15 bp, Homo sapiens
tattcacatacacgt

SEQ ID NO: 403464 - DNA, 15 bp, Homo sapiens
attcacatacacgtt

SEQ ID NO: 403465 - DNA, 15 bp, Homo sapiens
ttcacatacacgttg

SEQ ID NO: 403466 - DNA, 15 bp, Homo sapiens
tcacatacacgttgt

SEQ ID NO: 403467 - DNA, 15 bp, Homo sapiens
cacatacacgttgtt

SEQ ID NO: 403468 - DNA, 15 bp, Homo sapiens
acatacacgttgttt

SEQ ID NO: 403469 - DNA, 15 bp, Homo sapiens
catacacgttgttta

SEQ ID NO: 403470 - DNA, 15 bp, Homo sapiens
atacacgttgtttaa

SEQ ID NO: 403471 - DNA, 15 bp, Homo sapiens
tacacgttgtttaaa

SEQ ID NO: 403472 - DNA, 15 bp, Homo sapiens
acacgttgtttaaaa

SEQ ID NO: 403473 - DNA, 15 bp, Homo sapiens
cacgttgtttaaaaa

SEQ ID NO: 403474 - DNA, 15 bp, Homo sapiens
acgttgtttaaaaaa

SEQ ID NO: 403475 - DNA, 15 bp, Homo sapiens
cgttgtttaaaaaaa

SEQ ID NO: 403476 - DNA, 15 bp, Homo sapiens
gttgtttaaaaaaaa

SEQ ID NO: 403477 - DNA, 15 bp, Homo sapiens
ttgtttaaaaaaaaa

SEQ ID NO: 403478 - DNA, 15 bp, Homo sapiens
tttaaaaaaaaaaaa

SEQ ID NO: 403479 - DNA, 15 bp, Homo sapiens
aaaaaaaaagaaatg

SEQ ID NO: 403480 - DNA, 15 bp, Homo sapiens
aaaaaaaagaaatgg

SEQ ID NO: 403481 - DNA, 15 bp, Homo sapiens
aaaaaaagaaatggt

SEQ ID NO: 403482 - DNA, 15 bp, Homo sapiens
aaaaaagaaatggtg

SEQ ID NO: 403483 - DNA, 15 bp, Homo sapiens
aaaaagaaatggtgt

SEQ ID NO: 403484 - DNA, 15 bp, Homo sapiens
aaaagaaatggtgtt

SEQ ID NO: 403485 - DNA, 15 bp, Homo sapiens
aaagaaatggtgttt

SEQ ID NO: 403486 - DNA, 15 bp, Homo sapiens
aagaaatggtgtttt

SEQ ID NO: 403487 - DNA, 15 bp, Homo sapiens
agaaatggtgttttt

SEQ ID NO: 403488 - DNA, 15 bp, Homo sapiens
gaaatggtgtttttc

SEQ ID NO: 403489 - DNA, 15 bp, Homo sapiens
aaatggtgtttttct

SEQ ID NO: 403490 - DNA, 15 bp, Homo sapiens
aatggtgtttttctg

SEQ ID NO: 403491 - DNA, 15 bp, Homo sapiens
atggtgtttttctgt

SEQ ID NO: 403492 - DNA, 15 bp, Homo sapiens
tggtgtttttctgta

SEQ ID NO: 403493 - DNA, 15 bp, Homo sapiens
ggtgtttttctgtac

SEQ ID NO: 403494 - DNA, 15 bp, Homo sapiens
gtgtttttctgtacg

SEQ ID NO: 403495 - DNA, 15 bp, Homo sapiens
tgtttttctgtacgt

SEQ ID NO: 403496 - DNA, 15 bp, Homo sapiens
gtttttctgtacgtg

SEQ ID NO: 403497 - DNA, 15 bp, Homo sapiens
tttttctgtacgtgg

SEQ ID NO: 403498 - DNA, 15 bp, Homo sapiens
ttttctgtacgtggc

SEQ ID NO: 403499 - DNA, 15 bp, Homo sapiens
tttctgtacgtggca

SEQ ID NO: 403500 - DNA, 15 bp, Homo sapiens
ttctgtacgtggcat

SEQ ID NO: 403501 - DNA, 15 bp, Homo sapiens
tctgtacgtggcata

SEQ ID NO: 403502 - DNA, 15 bp, Homo sapiens
ctgtacgtggcatat

SEQ ID NO: 403503 - DNA, 15 bp, Homo sapiens
tgtacgtggcatatg

SEQ ID NO: 403504 - DNA, 15 bp, Homo sapiens
gtacgtggcatatgt

SEQ ID NO: 403505 - DNA, 15 bp, Homo sapiens
tacgtggcatatgtt

SEQ ID NO: 403506 - DNA, 15 bp, Homo sapiens
acgtggcatatgttt

SEQ ID NO: 403507 - DNA, 15 bp, Homo sapiens
cgtggcatatgtttc

SEQ ID NO: 403508 - DNA, 15 bp, Homo sapiens
gtggcatatgtttca

SEQ ID NO: 403509 - DNA, 15 bp, Homo sapiens
tggcatatgtttcaa

SEQ ID NO: 403510 - DNA, 15 bp, Homo sapiens
ggcatatgtttcaac

SEQ ID NO: 403511 - DNA, 15 bp, Homo sapiens
gcatatgtttcaaca

SEQ ID NO: 403512 - DNA, 15 bp, Homo sapiens
catatgtttcaacat

SEQ ID NO: 403513 - DNA, 15 bp, Homo sapiens
atatgtttcaacatc

SEQ ID NO: 403514 - DNA, 15 bp, Homo sapiens
tatgtttcaacatct

SEQ ID NO: 403515 - DNA, 15 bp, Homo sapiens
atgtttcaacatctt

SEQ ID NO: 403516 - DNA, 15 bp, Homo sapiens
tgtttcaacatcttg

SEQ ID NO: 403517 - DNA, 15 bp, Homo sapiens
gtttcaacatcttgc

SEQ ID NO: 403518 - DNA, 15 bp, Homo sapiens
tttcaacatcttgcc

SEQ ID NO: 403519 - DNA, 15 bp, Homo sapiens
ttcaacatcttgcct

SEQ ID NO: 403520 - DNA, 15 bp, Homo sapiens
tcaacatcttgcctt

SEQ ID NO: 403521 - DNA, 15 bp, Homo sapiens
caacatcttgccttt

SEQ ID NO: 403522 - DNA, 15 bp, Homo sapiens
aacatcttgcctttt

SEQ ID NO: 403523 - DNA, 15 bp, Homo sapiens
acatcttgccttttc

SEQ ID NO: 403524 - DNA, 15 bp, Homo sapiens
catcttgccttttcc

SEQ ID NO: 403525 - DNA, 15 bp, Homo sapiens
atcttgccttttccc

SEQ ID NO: 403526 - DNA, 15 bp, Homo sapiens
tcttgccttttcccc

SEQ ID NO: 403527 - DNA, 15 bp, Homo sapiens
cttgccttttcccct

SEQ ID NO: 403528 - DNA, 15 bp, Homo sapiens
ttgccttttcccctc

SEQ ID NO: 403529 - DNA, 15 bp, Homo sapiens
tgccttttcccctcc

SEQ ID NO: 403530 - DNA, 15 bp, Homo sapiens
gccttttcccctcca

SEQ ID NO: 403531 - DNA, 15 bp, Homo sapiens
ccttttcccctccac

SEQ ID NO: 403532 - DNA, 15 bp, Homo sapiens
cttttcccctccacc

SEQ ID NO: 403533 - DNA, 15 bp, Homo sapiens
ttttcccctccaccc

SEQ ID NO: 403534 - DNA, 15 bp, Homo sapiens
tttcccctccaccct

SEQ ID NO: 403535 - DNA, 15 bp, Homo sapiens
ttcccctccacccta

SEQ ID NO: 403536 - DNA, 15 bp, Homo sapiens
tcccctccaccctaa

SEQ ID NO: 403537 - DNA, 15 bp, Homo sapiens
cccctccaccctaat

SEQ ID NO: 403538 - DNA, 15 bp, Homo sapiens
ccctccaccctaatg

SEQ ID NO: 403539 - DNA, 15 bp, Homo sapiens
cctccaccctaatgg

SEQ ID NO: 403540 - DNA, 15 bp, Homo sapiens
ctccaccctaatgga

SEQ ID NO: 403541 - DNA, 15 bp, Homo sapiens
tccaccctaatggac

SEQ ID NO: 403542 - DNA, 15 bp, Homo sapiens
ccaccctaatggaca

SEQ ID NO: 403543 - DNA, 15 bp, Homo sapiens
caccctaatggacat

SEQ ID NO: 403544 - DNA, 15 bp, Homo sapiens
accctaatggacatt

SEQ ID NO: 403545 - DNA, 15 bp, Homo sapiens
ccctaatggacattg

SEQ ID NO: 403546 - DNA, 15 bp, Homo sapiens
cctaatggacattgg

SEQ ID NO: 403547 - DNA, 15 bp, Homo sapiens
ctaatggacattggg

SEQ ID NO: 403548 - DNA, 15 bp, Homo sapiens
taatggacattgggt

SEQ ID NO: 403549 - DNA, 15 bp, Homo sapiens
aatggacattgggta

SEQ ID NO: 403550 - DNA, 15 bp, Homo sapiens
atggacattgggtaa

SEQ ID NO: 403551 - DNA, 15 bp, Homo sapiens
tggacattgggtaat

SEQ ID NO: 403552 - DNA, 15 bp, Homo sapiens
ggacattgggtaatg

SEQ ID NO: 403553 - DNA, 15 bp, Homo sapiens
gacattgggtaatga

SEQ ID NO: 403554 - DNA, 15 bp, Homo sapiens
acattgggtaatgat

SEQ ID NO: 403555 - DNA, 15 bp, Homo sapiens
cattgggtaatgatg

SEQ ID NO: 403556 - DNA, 15 bp, Homo sapiens
attgggtaatgatgt

SEQ ID NO: 403557 - DNA, 15 bp, Homo sapiens
ttgggtaatgatgta

SEQ ID NO: 403558 - DNA, 15 bp, Homo sapiens
tgggtaatgatgtaa

SEQ ID NO: 403559 - DNA, 15 bp, Homo sapiens
gggtaatgatgtaac

SEQ ID NO: 403560 - DNA, 15 bp, Homo sapiens
ggtaatgatgtaact

SEQ ID NO: 403561 - DNA, 15 bp, Homo sapiens
gtaatgatgtaacta

SEQ ID NO: 403562 - DNA, 15 bp, Homo sapiens
taatgatgtaactaa

SEQ ID NO: 403563 - DNA, 15 bp, Homo sapiens
aatgatgtaactaat

SEQ ID NO: 403564 - DNA, 15 bp, Homo sapiens
atgatgtaactaatt

SEQ ID NO: 403565 - DNA, 15 bp, Homo sapiens
tgatgtaactaattt

SEQ ID NO: 403566 - DNA, 15 bp, Homo sapiens
gatgtaactaatttc

SEQ ID NO: 403567 - DNA, 15 bp, Homo sapiens
atgtaactaatttct

SEQ ID NO: 403568 - DNA, 15 bp, Homo sapiens
tgtaactaatttctg

SEQ ID NO: 403569 - DNA, 15 bp, Homo sapiens
gtaactaatttctgc

SEQ ID NO: 403570 - DNA, 15 bp, Homo sapiens
taactaatttctgct

SEQ ID NO: 403571 - DNA, 15 bp, Homo sapiens
aactaatttctgctt

SEQ ID NO: 403572 - DNA, 15 bp, Homo sapiens
actaatttctgcttt

SEQ ID NO: 403573 - DNA, 15 bp, Homo sapiens
ctaatttctgctttt

SEQ ID NO: 403574 - DNA, 15 bp, Homo sapiens
taatttctgcttttc

SEQ ID NO: 403575 - DNA, 15 bp, Homo sapiens
aatttctgcttttct

SEQ ID NO: 403576 - DNA, 15 bp, Homo sapiens
atttctgcttttctg

SEQ ID NO: 403577 - DNA, 15 bp, Homo sapiens
tttctgcttttctgt

SEQ ID NO: 403578 - DNA, 15 bp, Homo sapiens
ttctgcttttctgtt

SEQ ID NO: 403579 - DNA, 15 bp, Homo sapiens
tctgcttttctgtta

SEQ ID NO: 403580 - DNA, 15 bp, Homo sapiens
ctgcttttctgttag

SEQ ID NO: 403581 - DNA, 15 bp, Homo sapiens
tgcttttctgttagc

SEQ ID NO: 403582 - DNA, 15 bp, Homo sapiens
gcttttctgttagct

SEQ ID NO: 403583 - DNA, 15 bp, Homo sapiens
cttttctgttagctt

SEQ ID NO: 403584 - DNA, 15 bp, Homo sapiens
ttttctgttagcttt

SEQ ID NO: 403585 - DNA, 15 bp, Homo sapiens
tttctgttagctttg

SEQ ID NO: 403586 - DNA, 15 bp, Homo sapiens
ttctgttagctttgg

SEQ ID NO: 403587 - DNA, 15 bp, Homo sapiens
tctgttagctttggc

SEQ ID NO: 403588 - DNA, 15 bp, Homo sapiens
ctgttagctttggca

SEQ ID NO: 403589 - DNA, 15 bp, Homo sapiens
tgttagctttggcag

SEQ ID NO: 403590 - DNA, 15 bp, Homo sapiens
gttagctttggcagc

SEQ ID NO: 403591 - DNA, 15 bp, Homo sapiens
ttagctttggcagcc

SEQ ID NO: 403592 - DNA, 15 bp, Homo sapiens
tagctttggcagcca

SEQ ID NO: 403593 - DNA, 15 bp, Homo sapiens
agctttggcagccag

SEQ ID NO: 403594 - DNA, 15 bp, Homo sapiens
gctttggcagccagg

SEQ ID NO: 403595 - DNA, 15 bp, Homo sapiens
ctttggcagccaggg

SEQ ID NO: 403596 - DNA, 15 bp, Homo sapiens
tttggcagccaggga

SEQ ID NO: 403597 - DNA, 15 bp, Homo sapiens
ttggcagccagggag

SEQ ID NO: 403598 - DNA, 15 bp, Homo sapiens
tggcagccagggagc

SEQ ID NO: 403599 - DNA, 15 bp, Homo sapiens
ggcagccagggagct

SEQ ID NO: 403600 - DNA, 15 bp, Homo sapiens
gcagccagggagctc

SEQ ID NO: 403601 - DNA, 15 bp, Homo sapiens
cagccagggagctcc

SEQ ID NO: 403602 - DNA, 15 bp, Homo sapiens
agccagggagctcca

SEQ ID NO: 403603 - DNA, 15 bp, Homo sapiens
gccagggagctccag

SEQ ID NO: 403604 - DNA, 15 bp, Homo sapiens
ccagggagctccagg

SEQ ID NO: 403605 - DNA, 15 bp, Homo sapiens
cagggagctccaggc

SEQ ID NO: 403606 - DNA, 15 bp, Homo sapiens
agggagctccaggct

SEQ ID NO: 403607 - DNA, 15 bp, Homo sapiens
gggagctccaggctc

SEQ ID NO: 403608 - DNA, 15 bp, Homo sapiens
ggagctccaggctca

SEQ ID NO: 403609 - DNA, 15 bp, Homo sapiens
gagctccaggctcat

SEQ ID NO: 403610 - DNA, 15 bp, Homo sapiens
agctccaggctcatt

SEQ ID NO: 403611 - DNA, 15 bp, Homo sapiens
gctccaggctcattt

SEQ ID NO: 403612 - DNA, 15 bp, Homo sapiens
ctccaggctcattta

SEQ ID NO: 403613 - DNA, 15 bp, Homo sapiens
tccaggctcatttac

SEQ ID NO: 403614 - DNA, 15 bp, Homo sapiens
ccaggctcatttaca

SEQ ID NO: 403615 - DNA, 15 bp, Homo sapiens
caggctcatttacac

SEQ ID NO: 403616 - DNA, 15 bp, Homo sapiens
aggctcatttacact

SEQ ID NO: 403617 - DNA, 15 bp, Homo sapiens
ggctcatttacactt

SEQ ID NO: 403618 - DNA, 15 bp, Homo sapiens
gctcatttacacttg

SEQ ID NO: 403619 - DNA, 15 bp, Homo sapiens
ctcatttacacttgc

SEQ ID NO: 403620 - DNA, 15 bp, Homo sapiens
tcatttacacttgct

SEQ ID NO: 403621 - DNA, 15 bp, Homo sapiens
catttacacttgctg

SEQ ID NO: 403622 - DNA, 15 bp, Homo sapiens
atttacacttgctgg

SEQ ID NO: 403623 - DNA, 15 bp, Homo sapiens
tttacacttgctggg

SEQ ID NO: 403624 - DNA, 15 bp, Homo sapiens
ttacacttgctggga

SEQ ID NO: 403625 - DNA, 15 bp, Homo sapiens
tacacttgctgggag

SEQ ID NO: 403626 - DNA, 15 bp, Homo sapiens
acacttgctgggagc

SEQ ID NO: 403627 - DNA, 15 bp, Homo sapiens
cacttgctgggagcc

SEQ ID NO: 403628 - DNA, 15 bp, Homo sapiens
acttgctgggagccc

SEQ ID NO: 403629 - DNA, 15 bp, Homo sapiens
cttgctgggagccct

SEQ ID NO: 403630 - DNA, 15 bp, Homo sapiens
ttgctgggagccctg

SEQ ID NO: 403631 - DNA, 15 bp, Homo sapiens
tgctgggagccctgt

SEQ ID NO: 403632 - DNA, 15 bp, Homo sapiens
gctgggagccctgtg

SEQ ID NO: 403633 - DNA, 15 bp, Homo sapiens
ctgggagccctgtgc

SEQ ID NO: 403634 - DNA, 15 bp, Homo sapiens
tgggagccctgtgct

SEQ ID NO: 403635 - DNA, 15 bp, Homo sapiens
gggagccctgtgctc

SEQ ID NO: 403636 - DNA, 15 bp, Homo sapiens
ggagccctgtgctca

SEQ ID NO: 403637 - DNA, 15 bp, Homo sapiens
gagccctgtgctcaa

SEQ ID NO: 403638 - DNA, 15 bp, Homo sapiens
agccctgtgctcaat

SEQ ID NO: 403639 - DNA, 15 bp, Homo sapiens
gccctgtgctcaatt

SEQ ID NO: 403640 - DNA, 15 bp, Homo sapiens
ccctgtgctcaatta

SEQ ID NO: 403641 - DNA, 15 bp, Homo sapiens
cctgtgctcaattat

SEQ ID NO: 403642 - DNA, 15 bp, Homo sapiens
ctgtgctcaattata

SEQ ID NO: 403643 - DNA, 15 bp, Homo sapiens
tgtgctcaattataa

SEQ ID NO: 403644 - DNA, 15 bp, Homo sapiens
gtgctcaattataat

SEQ ID NO: 403645 - DNA, 15 bp, Homo sapiens
tgctcaattataatt

SEQ ID NO: 403646 - DNA, 15 bp, Homo sapiens
gctcaattataattg

SEQ ID NO: 403647 - DNA, 15 bp, Homo sapiens
ctcaattataattgc

SEQ ID NO: 403648 - DNA, 15 bp, Homo sapiens
tcaattataattgcc

SEQ ID NO: 403649 - DNA, 15 bp, Homo sapiens
caattataattgcct

SEQ ID NO: 403650 - DNA, 15 bp, Homo sapiens
aattataattgccta

SEQ ID NO: 403651 - DNA, 15 bp, Homo sapiens
attataattgcctac

SEQ ID NO: 403652 - DNA, 15 bp, Homo sapiens
ttataattgcctacg

SEQ ID NO: 403653 - DNA, 15 bp, Homo sapiens
tataattgcctacga

SEQ ID NO: 403654 - DNA, 15 bp, Homo sapiens
ataattgcctacgat

SEQ ID NO: 403655 - DNA, 15 bp, Homo sapiens
taattgcctacgata

SEQ ID NO: 403656 - DNA, 15 bp, Homo sapiens
aattgcctacgatag

SEQ ID NO: 403657 - DNA, 15 bp, Homo sapiens
attgcctacgatagc

SEQ ID NO: 403658 - DNA, 15 bp, Homo sapiens
ttgcctacgatagcc

SEQ ID NO: 403659 - DNA, 15 bp, Homo sapiens
tgcctacgatagcct

SEQ ID NO: 403660 - DNA, 15 bp, Homo sapiens
gcctacgatagcctc

SEQ ID NO: 403661 - DNA, 15 bp, Homo sapiens
cctacgatagcctcc

SEQ ID NO: 403662 - DNA, 15 bp, Homo sapiens
ctacgatagcctcca

SEQ ID NO: 403663 - DNA, 15 bp, Homo sapiens
tacgatagcctccac

SEQ ID NO: 403664 - DNA, 15 bp, Homo sapiens
acgatagcctccact

SEQ ID NO: 403665 - DNA, 15 bp, Homo sapiens
cgatagcctccactt

SEQ ID NO: 403666 - DNA, 15 bp, Homo sapiens
gatagcctccacttt

SEQ ID NO: 403667 - DNA, 15 bp, Homo sapiens
atagcctccactttc

SEQ ID NO: 403668 - DNA, 15 bp, Homo sapiens
tagcctccactttct

SEQ ID NO: 403669 - DNA, 15 bp, Homo sapiens
agcctccactttctg

SEQ ID NO: 403670 - DNA, 15 bp, Homo sapiens
gcctccactttctga

SEQ ID NO: 403671 - DNA, 15 bp, Homo sapiens
cctccactttctgat

SEQ ID NO: 403672 - DNA, 15 bp, Homo sapiens
ctccactttctgatt

SEQ ID NO: 403673 - DNA, 15 bp, Homo sapiens
tccactttctgattt

SEQ ID NO: 403674 - DNA, 15 bp, Homo sapiens
ccactttctgattta

SEQ ID NO: 403675 - DNA, 15 bp, Homo sapiens
cactttctgatttaa

SEQ ID NO: 403676 - DNA, 15 bp, Homo sapiens
actttctgatttaat

SEQ ID NO: 403677 - DNA, 15 bp, Homo sapiens
ctttctgatttaatg

SEQ ID NO: 403678 - DNA, 15 bp, Homo sapiens
tttctgatttaatgt

SEQ ID NO: 403679 - DNA, 15 bp, Homo sapiens
ttctgatttaatgtt

SEQ ID NO: 403680 - DNA, 15 bp, Homo sapiens
tctgatttaatgttc

SEQ ID NO: 403681 - DNA, 15 bp, Homo sapiens
ctgatttaatgttct

SEQ ID NO: 403682 - DNA, 15 bp, Homo sapiens
tgatttaatgttctt

SEQ ID NO: 403683 - DNA, 15 bp, Homo sapiens
gatttaatgttcttc

SEQ ID NO: 403684 - DNA, 15 bp, Homo sapiens
atttaatgttcttct

SEQ ID NO: 403685 - DNA, 15 bp, Homo sapiens
tttaatgttcttctt

SEQ ID NO: 403686 - DNA, 15 bp, Homo sapiens
ttaatgttcttcttt

SEQ ID NO: 403687 - DNA, 15 bp, Homo sapiens
taatgttcttctttt

SEQ ID NO: 403688 - DNA, 15 bp, Homo sapiens
aatgttcttcttttt

SEQ ID NO: 403689 - DNA, 15 bp, Homo sapiens
atgttcttctttttc

SEQ ID NO: 403690 - DNA, 15 bp, Homo sapiens
tgttcttctttttct

SEQ ID NO: 403691 - DNA, 15 bp, Homo sapiens
gttcttctttttctg

SEQ ID NO: 403692 - DNA, 15 bp, Homo sapiens
ttcttctttttctga

SEQ ID NO: 403693 - DNA, 15 bp, Homo sapiens
tcttctttttctgaa

SEQ ID NO: 403694 - DNA, 15 bp, Homo sapiens
cttctttttctgaat

SEQ ID NO: 403695 - DNA, 15 bp, Homo sapiens
ttctttttctgaatt

SEQ ID NO: 403696 - DNA, 15 bp, Homo sapiens
tctttttctgaattt

SEQ ID NO: 403697 - DNA, 15 bp, Homo sapiens
ctttttctgaatttt

SEQ ID NO: 403698 - DNA, 15 bp, Homo sapiens
tttttctgaattttt

SEQ ID NO: 403699 - DNA, 15 bp, Homo sapiens
ttttctgaattttta

SEQ ID NO: 403700 - DNA, 15 bp, Homo sapiens
tttctgaatttttaa

SEQ ID NO: 403701 - DNA, 15 bp, Homo sapiens
ttctgaatttttaaa

SEQ ID NO: 403702 - DNA, 15 bp, Homo sapiens
tctgaatttttaaaa

SEQ ID NO: 403703 - DNA, 15 bp, Homo sapiens
ctgaatttttaaaaa

SEQ ID NO: 403704 - DNA, 15 bp, Homo sapiens
tgaatttttaaaaaa

SEQ ID NO: 403705 - DNA, 15 bp, Homo sapiens
gaatttttaaaaaaa

SEQ ID NO: 403706 - DNA, 15 bp, Homo sapiens
aatttttaaaaaaat

SEQ ID NO: 403707 - DNA, 15 bp, Homo sapiens
tttttaaaaaaatct

SEQ ID NO: 403708 - DNA, 15 bp, Homo sapiens
ttttaaaaaaatctt

SEQ ID NO: 403709 - DNA, 15 bp, Homo sapiens
tttaaaaaaatcttt

SEQ ID NO: 403710 - DNA, 15 bp, Homo sapiens
ttaaaaaaatctttt

SEQ ID NO: 403711 - DNA, 15 bp, Homo sapiens
taaaaaaatcttttt

SEQ ID NO: 403712 - DNA, 15 bp, Homo sapiens
aaaaaaatcttttta

SEQ ID NO: 403713 - DNA, 15 bp, Homo sapiens
aaaaaatctttttaa

SEQ ID NO: 403714 - DNA, 15 bp, Homo sapiens
aaaaatctttttaaa

SEQ ID NO: 403715 - DNA, 15 bp, Homo sapiens
aaaatctttttaaaa

SEQ ID NO: 403716 - DNA, 15 bp, Homo sapiens
aaatctttttaaaaa

SEQ ID NO: 403717 - DNA, 15 bp, Homo sapiens
aatctttttaaaaag

SEQ ID NO: 403718 - DNA, 15 bp, Homo sapiens
atctttttaaaaagt

SEQ ID NO: 403719 - DNA, 15 bp, Homo sapiens
tctttttaaaaagtt

SEQ ID NO: 403720 - DNA, 15 bp, Homo sapiens
ctttttaaaaagttt

SEQ ID NO: 403721 - DNA, 15 bp, Homo sapiens
tttttaaaaagtttt

SEQ ID NO: 403722 - DNA, 15 bp, Homo sapiens
ttttaaaaagtttta

SEQ ID NO: 403723 - DNA, 15 bp, Homo sapiens
tttaaaaagttttat

SEQ ID NO: 403724 - DNA, 15 bp, Homo sapiens
ttaaaaagttttatt

SEQ ID NO: 403725 - DNA, 15 bp, Homo sapiens
taaaaagttttatta

SEQ ID NO: 403726 - DNA, 15 bp, Homo sapiens
aaaaagttttattat

SEQ ID NO: 403727 - DNA, 15 bp, Homo sapiens
aaaagttttattatg

SEQ ID NO: 403728 - DNA, 15 bp, Homo sapiens
aaagttttattatgg

SEQ ID NO: 403729 - DNA, 15 bp, Homo sapiens
aagttttattatggc

SEQ ID NO: 403730 - DNA, 15 bp, Homo sapiens
agttttattatggct

SEQ ID NO: 403731 - DNA, 15 bp, Homo sapiens
gttttattatggctt

SEQ ID NO: 403732 - DNA, 15 bp, Homo sapiens
ttttattatggcttc

SEQ ID NO: 403733 - DNA, 15 bp, Homo sapiens
tttattatggcttct

SEQ ID NO: 403734 - DNA, 15 bp, Homo sapiens
ttattatggcttctt

SEQ ID NO: 403735 - DNA, 15 bp, Homo sapiens
tattatggcttcttt

SEQ ID NO: 403736 - DNA, 15 bp, Homo sapiens
attatggcttcttta

SEQ ID NO: 403737 - DNA, 15 bp, Homo sapiens
ttatggcttctttac

SEQ ID NO: 403738 - DNA, 15 bp, Homo sapiens
tatggcttctttacg

SEQ ID NO: 403739 - DNA, 15 bp, Homo sapiens
atggcttctttacgt

SEQ ID NO: 403740 - DNA, 15 bp, Homo sapiens
tggcttctttacgtg

SEQ ID NO: 403741 - DNA, 15 bp, Homo sapiens
ggcttctttacgtga

SEQ ID NO: 403742 - DNA, 15 bp, Homo sapiens
gcttctttacgtgag

SEQ ID NO: 403743 - DNA, 15 bp, Homo sapiens
cttctttacgtgagc

SEQ ID NO: 403744 - DNA, 15 bp, Homo sapiens
ttctttacgtgagcc

SEQ ID NO: 403745 - DNA, 15 bp, Homo sapiens
tctttacgtgagcct

SEQ ID NO: 403746 - DNA, 15 bp, Homo sapiens
ctttacgtgagcctt

SEQ ID NO: 403747 - DNA, 15 bp, Homo sapiens
tttacgtgagccttt

SEQ ID NO: 403748 - DNA, 15 bp, Homo sapiens
ttacgtgagcctttt

SEQ ID NO: 403749 - DNA, 15 bp, Homo sapiens
tacgtgagcctttta

SEQ ID NO: 403750 - DNA, 15 bp, Homo sapiens
acgtgagccttttaa

SEQ ID NO: 403751 - DNA, 15 bp, Homo sapiens
cgtgagccttttaaa

SEQ ID NO: 403752 - DNA, 15 bp, Homo sapiens
gtgagccttttaaac

SEQ ID NO: 403753 - DNA, 15 bp, Homo sapiens
tgagccttttaaaca

SEQ ID NO: 403754 - DNA, 15 bp, Homo sapiens
gagccttttaaacaa

SEQ ID NO: 403755 - DNA, 15 bp, Homo sapiens
agccttttaaacaac

SEQ ID NO: 403756 - DNA, 15 bp, Homo sapiens
gccttttaaacaact

SEQ ID NO: 403757 - DNA, 15 bp, Homo sapiens
ccttttaaacaactt

SEQ ID NO: 403758 - DNA, 15 bp, Homo sapiens
cttttaaacaacttg

SEQ ID NO: 403759 - DNA, 15 bp, Homo sapiens
ttttaaacaacttga

SEQ ID NO: 403760 - DNA, 15 bp, Homo sapiens
tttaaacaacttgag

SEQ ID NO: 403761 - DNA, 15 bp, Homo sapiens
ttaaacaacttgagt

SEQ ID NO: 403762 - DNA, 15 bp, Homo sapiens
taaacaacttgagtg

SEQ ID NO: 403763 - DNA, 15 bp, Homo sapiens
aaacaacttgagtga

SEQ ID NO: 403764 - DNA, 15 bp, Homo sapiens
aacaacttgagtgaa

SEQ ID NO: 403765 - DNA, 15 bp, Homo sapiens
acaacttgagtgaat

SEQ ID NO: 403766 - DNA, 15 bp, Homo sapiens
caacttgagtgaata

SEQ ID NO: 403767 - DNA, 15 bp, Homo sapiens
aacttgagtgaatag

SEQ ID NO: 403768 - DNA, 15 bp, Homo sapiens
acttgagtgaatagg

SEQ ID NO: 403769 - DNA, 15 bp, Homo sapiens
cttgagtgaatagga

SEQ ID NO: 403770 - DNA, 15 bp, Homo sapiens
ttgagtgaataggag

SEQ ID NO: 403771 - DNA, 15 bp, Homo sapiens
tgagtgaataggagg

SEQ ID NO: 403772 - DNA, 15 bp, Homo sapiens
gagtgaataggagga

SEQ ID NO: 403773 - DNA, 15 bp, Homo sapiens
agtgaataggaggat

SEQ ID NO: 403774 - DNA, 15 bp, Homo sapiens
gtgaataggaggatt

SEQ ID NO: 403775 - DNA, 15 bp, Homo sapiens
tgaataggaggattc

SEQ ID NO: 403776 - DNA, 15 bp, Homo sapiens
gaataggaggattca

SEQ ID NO: 403777 - DNA, 15 bp, Homo sapiens
aataggaggattcag

SEQ ID NO: 403778 - DNA, 15 bp, Homo sapiens
ataggaggattcagg

SEQ ID NO: 403779 - DNA, 15 bp, Homo sapiens
taggaggattcagga

SEQ ID NO: 403780 - DNA, 15 bp, Homo sapiens
aggaggattcaggaa

SEQ ID NO: 403781 - DNA, 15 bp, Homo sapiens
ggaggattcaggaat

SEQ ID NO: 403782 - DNA, 15 bp, Homo sapiens
gaggattcaggaatt

SEQ ID NO: 403783 - DNA, 15 bp, Homo sapiens
aggattcaggaatta

SEQ ID NO: 403784 - DNA, 15 bp, Homo sapiens
ggattcaggaattat

SEQ ID NO: 403785 - DNA, 15 bp, Homo sapiens
gattcaggaattatg

SEQ ID NO: 403786 - DNA, 15 bp, Homo sapiens
attcaggaattatgg

SEQ ID NO: 403787 - DNA, 15 bp, Homo sapiens
ttcaggaattatggc

SEQ ID NO: 403788 - DNA, 15 bp, Homo sapiens
tcaggaattatggct

SEQ ID NO: 403789 - DNA, 15 bp, Homo sapiens
caggaattatggctc

SEQ ID NO: 403790 - DNA, 15 bp, Homo sapiens
aggaattatggctca

SEQ ID NO: 403791 - DNA, 15 bp, Homo sapiens
ggaattatggctcat

SEQ ID NO: 403792 - DNA, 15 bp, Homo sapiens
gaattatggctcata

SEQ ID NO: 403793 - DNA, 15 bp, Homo sapiens
aattatggctcatag

SEQ ID NO: 403794 - DNA, 15 bp, Homo sapiens
attatggctcataga

SEQ ID NO: 403795 - DNA, 15 bp, Homo sapiens
ttatggctcatagaa

SEQ ID NO: 403796 - DNA, 15 bp, Homo sapiens
tatggctcatagaag

SEQ ID NO: 403797 - DNA, 15 bp, Homo sapiens
atggctcatagaaga

SEQ ID NO: 403798 - DNA, 15 bp, Homo sapiens
tggctcatagaagag

SEQ ID NO: 403799 - DNA, 15 bp, Homo sapiens
ggctcatagaagaga

SEQ ID NO: 403800 - DNA, 15 bp, Homo sapiens
gctcatagaagagac

SEQ ID NO: 403801 - DNA, 15 bp, Homo sapiens
ctcatagaagagaca

SEQ ID NO: 403802 - DNA, 15 bp, Homo sapiens
tcatagaagagacat

SEQ ID NO: 403803 - DNA, 15 bp, Homo sapiens
catagaagagacata

SEQ ID NO: 403804 - DNA, 15 bp, Homo sapiens
atagaagagacatat

SEQ ID NO: 403805 - DNA, 15 bp, Homo sapiens
tagaagagacatatt

SEQ ID NO: 403806 - DNA, 15 bp, Homo sapiens
agaagagacatattt

SEQ ID NO: 403807 - DNA, 15 bp, Homo sapiens
gaagagacatattta

SEQ ID NO: 403808 - DNA, 15 bp, Homo sapiens
aagagacatatttaa

SEQ ID NO: 403809 - DNA, 15 bp, Homo sapiens
agagacatatttaac

SEQ ID NO: 403810 - DNA, 15 bp, Homo sapiens
gagacatatttaacc

SEQ ID NO: 403811 - DNA, 15 bp, Homo sapiens
agacatatttaacct

SEQ ID NO: 403812 - DNA, 15 bp, Homo sapiens
gacatatttaacctt

SEQ ID NO: 403813 - DNA, 15 bp, Homo sapiens
acatatttaacctta

SEQ ID NO: 403814 - DNA, 15 bp, Homo sapiens
catatttaaccttat

SEQ ID NO: 403815 - DNA, 15 bp, Homo sapiens
atatttaaccttatg

SEQ ID NO: 403816 - DNA, 15 bp, Homo sapiens
tatttaaccttatgc

SEQ ID NO: 403817 - DNA, 15 bp, Homo sapiens
atttaaccttatgca

SEQ ID NO: 403818 - DNA, 15 bp, Homo sapiens
tttaaccttatgcat

SEQ ID NO: 403819 - DNA, 15 bp, Homo sapiens
ttaaccttatgcatc

SEQ ID NO: 403820 - DNA, 15 bp, Homo sapiens
taaccttatgcatca

SEQ ID NO: 403821 - DNA, 15 bp, Homo sapiens
aaccttatgcatcag

SEQ ID NO: 403822 - DNA, 15 bp, Homo sapiens
accttatgcatcaga

SEQ ID NO: 403823 - DNA, 15 bp, Homo sapiens
ccttatgcatcagac

SEQ ID NO: 403824 - DNA, 15 bp, Homo sapiens
cttatgcatcagaca

SEQ ID NO: 403825 - DNA, 15 bp, Homo sapiens
ttatgcatcagacat

SEQ ID NO: 403826 - DNA, 15 bp, Homo sapiens
tatgcatcagacatt

SEQ ID NO: 403827 - DNA, 15 bp, Homo sapiens
atgcatcagacattg

SEQ ID NO: 403828 - DNA, 15 bp, Homo sapiens
tgcatcagacattgt

SEQ ID NO: 403829 - DNA, 15 bp, Homo sapiens
gcatcagacattgtt

SEQ ID NO: 403830 - DNA, 15 bp, Homo sapiens
catcagacattgtta

SEQ ID NO: 403831 - DNA, 15 bp, Homo sapiens
atcagacattgttag

SEQ ID NO: 403832 - DNA, 15 bp, Homo sapiens
tcagacattgttaga

SEQ ID NO: 403833 - DNA, 15 bp, Homo sapiens
cagacattgttagac

SEQ ID NO: 403834 - DNA, 15 bp, Homo sapiens
agacattgttagaca

SEQ ID NO: 403835 - DNA, 15 bp, Homo sapiens
gacattgttagacac

SEQ ID NO: 403836 - DNA, 15 bp, Homo sapiens
acattgttagacact

SEQ ID NO: 403837 - DNA, 15 bp, Homo sapiens
cattgttagacacta

SEQ ID NO: 403838 - DNA, 15 bp, Homo sapiens
attgttagacactac

SEQ ID NO: 403839 - DNA, 15 bp, Homo sapiens
ttgttagacactacg

SEQ ID NO: 403840 - DNA, 15 bp, Homo sapiens
tgttagacactacgc

SEQ ID NO: 403841 - DNA, 15 bp, Homo sapiens
gttagacactacgct

SEQ ID NO: 403842 - DNA, 15 bp, Homo sapiens
ttagacactacgctg

SEQ ID NO: 403843 - DNA, 15 bp, Homo sapiens
tagacactacgctgt

SEQ ID NO: 403844 - DNA, 15 bp, Homo sapiens
agacactacgctgta

SEQ ID NO: 403845 - DNA, 15 bp, Homo sapiens
gacactacgctgtat

SEQ ID NO: 403846 - DNA, 15 bp, Homo sapiens
acactacgctgtatt

SEQ ID NO: 403847 - DNA, 15 bp, Homo sapiens
cactacgctgtattt

SEQ ID NO: 403848 - DNA, 15 bp, Homo sapiens
actacgctgtatttg

SEQ ID NO: 403849 - DNA, 15 bp, Homo sapiens
ctacgctgtatttgt

SEQ ID NO: 403850 - DNA, 15 bp, Homo sapiens
tacgctgtatttgta

SEQ ID NO: 403851 - DNA, 15 bp, Homo sapiens
acgctgtatttgtat

SEQ ID NO: 403852 - DNA, 15 bp, Homo sapiens
cgctgtatttgtata

SEQ ID NO: 403853 - DNA, 15 bp, Homo sapiens
gctgtatttgtatag

SEQ ID NO: 403854 - DNA, 15 bp, Homo sapiens
ctgtatttgtatagc

SEQ ID NO: 403855 - DNA, 15 bp, Homo sapiens
tgtatttgtatagct

SEQ ID NO: 403856 - DNA, 15 bp, Homo sapiens
gtatttgtatagctt

SEQ ID NO: 403857 - DNA, 15 bp, Homo sapiens
tatttgtatagcttc

SEQ ID NO: 403858 - DNA, 15 bp, Homo sapiens
atttgtatagcttca

SEQ ID NO: 403859 - DNA, 15 bp, Homo sapiens
tttgtatagcttcag

SEQ ID NO: 403860 - DNA, 15 bp, Homo sapiens
ttgtatagcttcagt

SEQ ID NO: 403861 - DNA, 15 bp, Homo sapiens
tgtatagcttcagtg

SEQ ID NO: 403862 - DNA, 15 bp, Homo sapiens
gtatagcttcagtgt

SEQ ID NO: 403863 - DNA, 15 bp, Homo sapiens
tatagcttcagtgtt

SEQ ID NO: 403864 - DNA, 15 bp, Homo sapiens
atagcttcagtgttt

SEQ ID NO: 403865 - DNA, 15 bp, Homo sapiens
tagcttcagtgtttg

SEQ ID NO: 403866 - DNA, 15 bp, Homo sapiens
agcttcagtgtttgg

SEQ ID NO: 403867 - DNA, 15 bp, Homo sapiens
gcttcagtgtttggt

SEQ ID NO: 403868 - DNA, 15 bp, Homo sapiens
cttcagtgtttggta

SEQ ID NO: 403869 - DNA, 15 bp, Homo sapiens
ttcagtgtttggtag

SEQ ID NO: 403870 - DNA, 15 bp, Homo sapiens
tcagtgtttggtagc

SEQ ID NO: 403871 - DNA, 15 bp, Homo sapiens
cagtgtttggtagct

SEQ ID NO: 403872 - DNA, 15 bp, Homo sapiens
agtgtttggtagctc

SEQ ID NO: 403873 - DNA, 15 bp, Homo sapiens
gtgtttggtagctct

SEQ ID NO: 403874 - DNA, 15 bp, Homo sapiens
tgtttggtagctcta

SEQ ID NO: 403875 - DNA, 15 bp, Homo sapiens
gtttggtagctctag

SEQ ID NO: 403876 - DNA, 15 bp, Homo sapiens
tttggtagctctaga

SEQ ID NO: 403877 - DNA, 15 bp, Homo sapiens
ttggtagctctagat

SEQ ID NO: 403878 - DNA, 15 bp, Homo sapiens
tggtagctctagata

SEQ ID NO: 403879 - DNA, 15 bp, Homo sapiens
ggtagctctagatat

SEQ ID NO: 403880 - DNA, 15 bp, Homo sapiens
gtagctctagatatc

SEQ ID NO: 403881 - DNA, 15 bp, Homo sapiens
tagctctagatatca

SEQ ID NO: 403882 - DNA, 15 bp, Homo sapiens
agctctagatatcaa

SEQ ID NO: 403883 - DNA, 15 bp, Homo sapiens
gctctagatatcaag

SEQ ID NO: 403884 - DNA, 15 bp, Homo sapiens
ctctagatatcaaga

SEQ ID NO: 403885 - DNA, 15 bp, Homo sapiens
tctagatatcaagat

SEQ ID NO: 403886 - DNA, 15 bp, Homo sapiens
ctagatatcaagata

SEQ ID NO: 403887 - DNA, 15 bp, Homo sapiens
tagatatcaagatag

SEQ ID NO: 403888 - DNA, 15 bp, Homo sapiens
agatatcaagatagt

SEQ ID NO: 403889 - DNA, 15 bp, Homo sapiens
gatatcaagatagta

SEQ ID NO: 403890 - DNA, 15 bp, Homo sapiens
atatcaagatagtat

SEQ ID NO: 403891 - DNA, 15 bp, Homo sapiens
tatcaagatagtatt

SEQ ID NO: 403892 - DNA, 15 bp, Homo sapiens
atcaagatagtattt

SEQ ID NO: 403893 - DNA, 15 bp, Homo sapiens
tcaagatagtattta

SEQ ID NO: 403894 - DNA, 15 bp, Homo sapiens
caagatagtatttag

SEQ ID NO: 403895 - DNA, 15 bp, Homo sapiens
aagatagtatttagg

SEQ ID NO: 403896 - DNA, 15 bp, Homo sapiens
agatagtatttagga

SEQ ID NO: 403897 - DNA, 15 bp, Homo sapiens
gatagtatttaggaa

SEQ ID NO: 403898 - DNA, 15 bp, Homo sapiens
atagtatttaggaaa

SEQ ID NO: 403899 - DNA, 15 bp, Homo sapiens
tagtatttaggaaat

SEQ ID NO: 403900 - DNA, 15 bp, Homo sapiens
agtatttaggaaatt

SEQ ID NO: 403901 - DNA, 15 bp, Homo sapiens
gtatttaggaaattt

SEQ ID NO: 403902 - DNA, 15 bp, Homo sapiens
tatttaggaaatttt

SEQ ID NO: 403903 - DNA, 15 bp, Homo sapiens
atttaggaaattttc

SEQ ID NO: 403904 - DNA, 15 bp, Homo sapiens
tttaggaaattttct

SEQ ID NO: 403905 - DNA, 15 bp, Homo sapiens
ttaggaaattttctt

SEQ ID NO: 403906 - DNA, 15 bp, Homo sapiens
taggaaattttcttt

SEQ ID NO: 403907 - DNA, 15 bp, Homo sapiens
aggaaattttctttt

SEQ ID NO: 403908 - DNA, 15 bp, Homo sapiens
ggaaattttcttttc

SEQ ID NO: 403909 - DNA, 15 bp, Homo sapiens
gaaattttcttttcc

SEQ ID NO: 403910 - DNA, 15 bp, Homo sapiens
aaattttcttttcca

SEQ ID NO: 403911 - DNA, 15 bp, Homo sapiens
aattttcttttccaa

SEQ ID NO: 403912 - DNA, 15 bp, Homo sapiens
attttcttttccaac

SEQ ID NO: 403913 - DNA, 15 bp, Homo sapiens
ttttcttttccaaca

SEQ ID NO: 403914 - DNA, 15 bp, Homo sapiens
tttcttttccaacat

SEQ ID NO: 403915 - DNA, 15 bp, Homo sapiens
ttcttttccaacatg

SEQ ID NO: 403916 - DNA, 15 bp, Homo sapiens
tcttttccaacatgt

SEQ ID NO: 403917 - DNA, 15 bp, Homo sapiens
cttttccaacatgtt

SEQ ID NO: 403918 - DNA, 15 bp, Homo sapiens
ttttccaacatgtta

SEQ ID NO: 403919 - DNA, 15 bp, Homo sapiens
tttccaacatgttag

SEQ ID NO: 403920 - DNA, 15 bp, Homo sapiens
ttccaacatgttagt

SEQ ID NO: 403921 - DNA, 15 bp, Homo sapiens
tccaacatgttagtt

SEQ ID NO: 403922 - DNA, 15 bp, Homo sapiens
ccaacatgttagtta

SEQ ID NO: 403923 - DNA, 15 bp, Homo sapiens
caacatgttagttag

SEQ ID NO: 403924 - DNA, 15 bp, Homo sapiens
aacatgttagttagt

SEQ ID NO: 403925 - DNA, 15 bp, Homo sapiens
acatgttagttagtt

SEQ ID NO: 403926 - DNA, 15 bp, Homo sapiens
catgttagttagttc

SEQ ID NO: 403927 - DNA, 15 bp, Homo sapiens
atgttagttagttct

SEQ ID NO: 403928 - DNA, 15 bp, Homo sapiens
tgttagttagttctg

SEQ ID NO: 403929 - DNA, 15 bp, Homo sapiens
gttagttagttctga

SEQ ID NO: 403930 - DNA, 15 bp, Homo sapiens
ttagttagttctgaa

SEQ ID NO: 403931 - DNA, 15 bp, Homo sapiens
tagttagttctgaaa

SEQ ID NO: 403932 - DNA, 15 bp, Homo sapiens
agttagttctgaaat

SEQ ID NO: 403933 - DNA, 15 bp, Homo sapiens
gttagttctgaaata

SEQ ID NO: 403934 - DNA, 15 bp, Homo sapiens
ttagttctgaaatac

SEQ ID NO: 403935 - DNA, 15 bp, Homo sapiens
tagttctgaaatacc

SEQ ID NO: 403936 - DNA, 15 bp, Homo sapiens
agttctgaaataccc

SEQ ID NO: 403937 - DNA, 15 bp, Homo sapiens
gttctgaaatacccc

SEQ ID NO: 403938 - DNA, 15 bp, Homo sapiens
ttctgaaatacccca

SEQ ID NO: 403939 - DNA, 15 bp, Homo sapiens
tctgaaataccccaa

SEQ ID NO: 403940 - DNA, 15 bp, Homo sapiens
ctgaaataccccaaa

SEQ ID NO: 403941 - DNA, 15 bp, Homo sapiens
tgaaataccccaaat

SEQ ID NO: 403942 - DNA, 15 bp, Homo sapiens
gaaataccccaaatg

SEQ ID NO: 403943 - DNA, 15 bp, Homo sapiens
aaataccccaaatgg

SEQ ID NO: 403944 - DNA, 15 bp, Homo sapiens
aataccccaaatggt

SEQ ID NO: 403945 - DNA, 15 bp, Homo sapiens
ataccccaaatggtt

SEQ ID NO: 403946 - DNA, 15 bp, Homo sapiens
taccccaaatggtta

SEQ ID NO: 403947 - DNA, 15 bp, Homo sapiens
accccaaatggttaa

SEQ ID NO: 403948 - DNA, 15 bp, Homo sapiens
ccccaaatggttaat

SEQ ID NO: 403949 - DNA, 15 bp, Homo sapiens
cccaaatggttaatg

SEQ ID NO: 403950 - DNA, 15 bp, Homo sapiens
ccaaatggttaatgt

SEQ ID NO: 403951 - DNA, 15 bp, Homo sapiens
caaatggttaatgta

SEQ ID NO: 403952 - DNA, 15 bp, Homo sapiens
aaatggttaatgtag

SEQ ID NO: 403953 - DNA, 15 bp, Homo sapiens
aatggttaatgtagt

SEQ ID NO: 403954 - DNA, 15 bp, Homo sapiens
atggttaatgtagtt

SEQ ID NO: 403955 - DNA, 15 bp, Homo sapiens
tggttaatgtagttt

SEQ ID NO: 403956 - DNA, 15 bp, Homo sapiens
ggttaatgtagttta

SEQ ID NO: 403957 - DNA, 15 bp, Homo sapiens
gttaatgtagtttat

SEQ ID NO: 403958 - DNA, 15 bp, Homo sapiens
ttaatgtagtttata

SEQ ID NO: 403959 - DNA, 15 bp, Homo sapiens
taatgtagtttataa

SEQ ID NO: 403960 - DNA, 15 bp, Homo sapiens
aatgtagtttataaa

SEQ ID NO: 403961 - DNA, 15 bp, Homo sapiens
atgtagtttataaac

SEQ ID NO: 403962 - DNA, 15 bp, Homo sapiens
tgtagtttataaact

SEQ ID NO: 403963 - DNA, 15 bp, Homo sapiens
gtagtttataaactc

SEQ ID NO: 403964 - DNA, 15 bp, Homo sapiens
tagtttataaactcc

SEQ ID NO: 403965 - DNA, 15 bp, Homo sapiens
agtttataaactccg

SEQ ID NO: 403966 - DNA, 15 bp, Homo sapiens
gtttataaactccga

SEQ ID NO: 403967 - DNA, 15 bp, Homo sapiens
tttataaactccgaa

SEQ ID NO: 403968 - DNA, 15 bp, Homo sapiens
ttataaactccgaaa

SEQ ID NO: 403969 - DNA, 15 bp, Homo sapiens
tataaactccgaaaa

SEQ ID NO: 403970 - DNA, 15 bp, Homo sapiens
ataaactccgaaaag

SEQ ID NO: 403971 - DNA, 15 bp, Homo sapiens
taaactccgaaaagc

SEQ ID NO: 403972 - DNA, 15 bp, Homo sapiens
aaactccgaaaagct

SEQ ID NO: 403973 - DNA, 15 bp, Homo sapiens
aactccgaaaagctt

SEQ ID NO: 403974 - DNA, 15 bp, Homo sapiens
actccgaaaagcttt

SEQ ID NO: 403975 - DNA, 15 bp, Homo sapiens
ctccgaaaagctttt

SEQ ID NO: 403976 - DNA, 15 bp, Homo sapiens
tccgaaaagcttttt

SEQ ID NO: 403977 - DNA, 15 bp, Homo sapiens
ccgaaaagcttttta

SEQ ID NO: 403978 - DNA, 15 bp, Homo sapiens
cgaaaagctttttat

SEQ ID NO: 403979 - DNA, 15 bp, Homo sapiens
gaaaagctttttatc

SEQ ID NO: 403980 - DNA, 15 bp, Homo sapiens
aaaagctttttatct

SEQ ID NO: 403981 - DNA, 15 bp, Homo sapiens
aaagctttttatcta

SEQ ID NO: 403982 - DNA, 15 bp, Homo sapiens
aagctttttatctaa

SEQ ID NO: 403983 - DNA, 15 bp, Homo sapiens
agctttttatctaat

SEQ ID NO: 403984 - DNA, 15 bp, Homo sapiens
gctttttatctaatg

SEQ ID NO: 403985 - DNA, 15 bp, Homo sapiens
ctttttatctaatga

SEQ ID NO: 403986 - DNA, 15 bp, Homo sapiens
tttttatctaatgag

SEQ ID NO: 403987 - DNA, 15 bp, Homo sapiens
ttttatctaatgaga

SEQ ID NO: 403988 - DNA, 15 bp, Homo sapiens
tttatctaatgagag

SEQ ID NO: 403989 - DNA, 15 bp, Homo sapiens
ttatctaatgagagc

SEQ ID NO: 403990 - DNA, 15 bp, Homo sapiens
tatctaatgagagca

SEQ ID NO: 403991 - DNA, 15 bp, Homo sapiens
atctaatgagagcac

SEQ ID NO: 403992 - DNA, 15 bp, Homo sapiens
tctaatgagagcact

SEQ ID NO: 403993 - DNA, 15 bp, Homo sapiens
ctaatgagagcactg

SEQ ID NO: 403994 - DNA, 15 bp, Homo sapiens
taatgagagcactgt

SEQ ID NO: 403995 - DNA, 15 bp, Homo sapiens
aatgagagcactgtt

SEQ ID NO: 403996 - DNA, 15 bp, Homo sapiens
atgagagcactgttt

SEQ ID NO: 403997 - DNA, 15 bp, Homo sapiens
tgagagcactgtttt

SEQ ID NO: 403998 - DNA, 15 bp, Homo sapiens
gagagcactgtttta

SEQ ID NO: 403999 - DNA, 15 bp, Homo sapiens
agagcactgttttaa

SEQ ID NO: 404000 - DNA, 15 bp, Homo sapiens
agcactgttttaaaa

SEQ ID NO: 404001 - DNA, 15 bp, Homo sapiens
gcactgttttaaaaa

SEQ ID NO: 404002 - DNA, 15 bp, Homo sapiens
cactgttttaaaaaa

SEQ ID NO: 404003 - DNA, 15 bp, Homo sapiens
actgttttaaaaaaa

SEQ ID NO: 404004 - DNA, 15 bp, Homo sapiens
ctgttttaaaaaaac

SEQ ID NO: 404005 - DNA, 15 bp, Homo sapiens
tgttttaaaaaaacc

SEQ ID NO: 404006 - DNA, 15 bp, Homo sapiens
gttttaaaaaaacca

SEQ ID NO: 404007 - DNA, 15 bp, Homo sapiens
ttttaaaaaaaccac

SEQ ID NO: 404008 - DNA, 15 bp, Homo sapiens
tttaaaaaaaccact

SEQ ID NO: 404009 - DNA, 15 bp, Homo sapiens
ttaaaaaaaccacta

SEQ ID NO: 404010 - DNA, 15 bp, Homo sapiens
taaaaaaaccactaa

SEQ ID NO: 404011 - DNA, 15 bp, Homo sapiens
aaaaaaaccactaat

SEQ ID NO: 404012 - DNA, 15 bp, Homo sapiens
aaaaaaccactaatg

SEQ ID NO: 404013 - DNA, 15 bp, Homo sapiens
aaaaaccactaatga

SEQ ID NO: 404014 - DNA, 15 bp, Homo sapiens
aaaaccactaatgat

SEQ ID NO: 404015 - DNA, 15 bp, Homo sapiens
aaaccactaatgatt

SEQ ID NO: 404016 - DNA, 15 bp, Homo sapiens
aaccactaatgattt

SEQ ID NO: 404017 - DNA, 15 bp, Homo sapiens
accactaatgatttt

SEQ ID NO: 404018 - DNA, 15 bp, Homo sapiens
ccactaatgattttc

SEQ ID NO: 404019 - DNA, 15 bp, Homo sapiens
cactaatgattttct

SEQ ID NO: 404020 - DNA, 15 bp, Homo sapiens
actaatgattttcta

SEQ ID NO: 404021 - DNA, 15 bp, Homo sapiens
ctaatgattttctag

SEQ ID NO: 404022 - DNA, 15 bp, Homo sapiens
taatgattttctagt

SEQ ID NO: 404023 - DNA, 15 bp, Homo sapiens
aatgattttctagtt

SEQ ID NO: 404024 - DNA, 15 bp, Homo sapiens
atgattttctagttg

SEQ ID NO: 404025 - DNA, 15 bp, Homo sapiens
tgattttctagttga

SEQ ID NO: 404026 - DNA, 15 bp, Homo sapiens
gattttctagttgaa

SEQ ID NO: 404027 - DNA, 15 bp, Homo sapiens
attttctagttgaaa

SEQ ID NO: 404028 - DNA, 15 bp, Homo sapiens
ttttctagttgaaac

SEQ ID NO: 404029 - DNA, 15 bp, Homo sapiens
tttctagttgaaaca

SEQ ID NO: 404030 - DNA, 15 bp, Homo sapiens
ttctagttgaaacat

SEQ ID NO: 404031 - DNA, 15 bp, Homo sapiens
tctagttgaaacatt

SEQ ID NO: 404032 - DNA, 15 bp, Homo sapiens
ctagttgaaacattt

SEQ ID NO: 404033 - DNA, 15 bp, Homo sapiens
tagttgaaacatttg

SEQ ID NO: 404034 - DNA, 15 bp, Homo sapiens
agttgaaacatttga

SEQ ID NO: 404035 - DNA, 15 bp, Homo sapiens
gttgaaacatttgaa

SEQ ID NO: 404036 - DNA, 15 bp, Homo sapiens
ttgaaacatttgaaa

SEQ ID NO: 404037 - DNA, 15 bp, Homo sapiens
gaaacatttgaaaca

SEQ ID NO: 404038 - DNA, 15 bp, Homo sapiens
aaacatttgaaacaa

SEQ ID NO: 404039 - DNA, 15 bp, Homo sapiens
aacatttgaaacaat

SEQ ID NO: 404040 - DNA, 15 bp, Homo sapiens
acatttgaaacaatt

SEQ ID NO: 404041 - DNA, 15 bp, Homo sapiens
catttgaaacaattt

SEQ ID NO: 404042 - DNA, 15 bp, Homo sapiens
atttgaaacaatttt

SEQ ID NO: 404043 - DNA, 15 bp, Homo sapiens
tttgaaacaattttg

SEQ ID NO: 404044 - DNA, 15 bp, Homo sapiens
ttgaaacaattttga

SEQ ID NO: 404045 - DNA, 15 bp, Homo sapiens
tgaaacaattttgaa

SEQ ID NO: 404046 - DNA, 15 bp, Homo sapiens
gaaacaattttgaag

SEQ ID NO: 404047 - DNA, 15 bp, Homo sapiens
aaacaattttgaagt

SEQ ID NO: 404048 - DNA, 15 bp, Homo sapiens
aacaattttgaagta

SEQ ID NO: 404049 - DNA, 15 bp, Homo sapiens
acaattttgaagtac

SEQ ID NO: 404050 - DNA, 15 bp, Homo sapiens
caattttgaagtaca

SEQ ID NO: 404051 - DNA, 15 bp, Homo sapiens
aattttgaagtacag

SEQ ID NO: 404052 - DNA, 15 bp, Homo sapiens
attttgaagtacagg

SEQ ID NO: 404053 - DNA, 15 bp, Homo sapiens
ttttgaagtacaggg

SEQ ID NO: 404054 - DNA, 15 bp, Homo sapiens
tttgaagtacagggg

SEQ ID NO: 404055 - DNA, 15 bp, Homo sapiens
ttgaagtacagggga

SEQ ID NO: 404056 - DNA, 15 bp, Homo sapiens
tgaagtacaggggac

SEQ ID NO: 404057 - DNA, 15 bp, Homo sapiens
gaagtacaggggact

SEQ ID NO: 404058 - DNA, 15 bp, Homo sapiens
aagtacaggggactt

SEQ ID NO: 404059 - DNA, 15 bp, Homo sapiens
agtacaggggacttt

SEQ ID NO: 404060 - DNA, 15 bp, Homo sapiens
gtacaggggactttt

SEQ ID NO: 404061 - DNA, 15 bp, Homo sapiens
tacaggggacttttc

SEQ ID NO: 404062 - DNA, 15 bp, Homo sapiens
acaggggacttttct

SEQ ID NO: 404063 - DNA, 15 bp, Homo sapiens
caggggacttttctt

SEQ ID NO: 404064 - DNA, 15 bp, Homo sapiens
aggggacttttcttt

SEQ ID NO: 404065 - DNA, 15 bp, Homo sapiens
ggggacttttcttta

SEQ ID NO: 404066 - DNA, 15 bp, Homo sapiens
gggacttttctttaa

SEQ ID NO: 404067 - DNA, 15 bp, Homo sapiens
ggacttttctttaaa

SEQ ID NO: 404068 - DNA, 15 bp, Homo sapiens
gacttttctttaaaa

SEQ ID NO: 404069 - DNA, 15 bp, Homo sapiens
acttttctttaaaac

SEQ ID NO: 404070 - DNA, 15 bp, Homo sapiens
cttttctttaaaaca

SEQ ID NO: 404071 - DNA, 15 bp, Homo sapiens
ttttctttaaaacag

SEQ ID NO: 404072 - DNA, 15 bp, Homo sapiens
tttctttaaaacagt

SEQ ID NO: 404073 - DNA, 15 bp, Homo sapiens
ttctttaaaacagtg

SEQ ID NO: 404074 - DNA, 15 bp, Homo sapiens
tctttaaaacagtgc

SEQ ID NO: 404075 - DNA, 15 bp, Homo sapiens
ctttaaaacagtgct

SEQ ID NO: 404076 - DNA, 15 bp, Homo sapiens
ttaaaacagtgctca

SEQ ID NO: 404077 - DNA, 15 bp, Homo sapiens
taaaacagtgctcat

SEQ ID NO: 404078 - DNA, 15 bp, Homo sapiens
aaaacagtgctcatt

SEQ ID NO: 404079 - DNA, 15 bp, Homo sapiens
aaacagtgctcatta

SEQ ID NO: 404080 - DNA, 15 bp, Homo sapiens
aacagtgctcattat

SEQ ID NO: 404081 - DNA, 15 bp, Homo sapiens
acagtgctcattata

SEQ ID NO: 404082 - DNA, 15 bp, Homo sapiens
cagtgctcattatac

SEQ ID NO: 404083 - DNA, 15 bp, Homo sapiens
agtgctcattatact

SEQ ID NO: 404084 - DNA, 15 bp, Homo sapiens
gtgctcattatactc

SEQ ID NO: 404085 - DNA, 15 bp, Homo sapiens
tgctcattatactcg

SEQ ID NO: 404086 - DNA, 15 bp, Homo sapiens
gctcattatactcgg

SEQ ID NO: 404087 - DNA, 15 bp, Homo sapiens
ctcattatactcgga

SEQ ID NO: 404088 - DNA, 15 bp, Homo sapiens
tcattatactcggaa

SEQ ID NO: 404089 - DNA, 15 bp, Homo sapiens
cattatactcggaag

SEQ ID NO: 404090 - DNA, 15 bp, Homo sapiens
attatactcggaaga

SEQ ID NO: 404091 - DNA, 15 bp, Homo sapiens
ttatactcggaagat

SEQ ID NO: 404092 - DNA, 15 bp, Homo sapiens
tatactcggaagata

SEQ ID NO: 404093 - DNA, 15 bp, Homo sapiens
atactcggaagataa

SEQ ID NO: 404094 - DNA, 15 bp, Homo sapiens
tactcggaagataag

SEQ ID NO: 404095 - DNA, 15 bp, Homo sapiens
actcggaagataagc

SEQ ID NO: 404096 - DNA, 15 bp, Homo sapiens
ctcggaagataagct

SEQ ID NO: 404097 - DNA, 15 bp, Homo sapiens
tcggaagataagctc

SEQ ID NO: 404098 - DNA, 15 bp, Homo sapiens
cggaagataagctct

SEQ ID NO: 404099 - DNA, 15 bp, Homo sapiens
ggaagataagctctt

SEQ ID NO: 404100 - DNA, 15 bp, Homo sapiens
gaagataagctcttg

SEQ ID NO: 404101 - DNA, 15 bp, Homo sapiens
aagataagctcttga

SEQ ID NO: 404102 - DNA, 15 bp, Homo sapiens
agataagctcttgag

SEQ ID NO: 404103 - DNA, 15 bp, Homo sapiens
gataagctcttgagc

SEQ ID NO: 404104 - DNA, 15 bp, Homo sapiens
ataagctcttgagca

SEQ ID NO: 404105 - DNA, 15 bp, Homo sapiens
taagctcttgagcat

SEQ ID NO: 404106 - DNA, 15 bp, Homo sapiens
aagctcttgagcatc

SEQ ID NO: 404107 - DNA, 15 bp, Homo sapiens
agctcttgagcatct

SEQ ID NO: 404108 - DNA, 15 bp, Homo sapiens
gctcttgagcatctg

SEQ ID NO: 404109 - DNA, 15 bp, Homo sapiens
ctcttgagcatctgt

SEQ ID NO: 404110 - DNA, 15 bp, Homo sapiens
tcttgagcatctgtc

SEQ ID NO: 404111 - DNA, 15 bp, Homo sapiens
cttgagcatctgtca

SEQ ID NO: 404112 - DNA, 15 bp, Homo sapiens
ttgagcatctgtcat

SEQ ID NO: 404113 - DNA, 15 bp, Homo sapiens
tgagcatctgtcatc

SEQ ID NO: 404114 - DNA, 15 bp, Homo sapiens
gagcatctgtcatcc

SEQ ID NO: 404115 - DNA, 15 bp, Homo sapiens
agcatctgtcatcct

SEQ ID NO: 404116 - DNA, 15 bp, Homo sapiens
gcatctgtcatcctt

SEQ ID NO: 404117 - DNA, 15 bp, Homo sapiens
catctgtcatccttg

SEQ ID NO: 404118 - DNA, 15 bp, Homo sapiens
atctgtcatccttgt

SEQ ID NO: 404119 - DNA, 15 bp, Homo sapiens
tctgtcatccttgtt

SEQ ID NO: 404120 - DNA, 15 bp, Homo sapiens
ctgtcatccttgttg

SEQ ID NO: 404121 - DNA, 15 bp, Homo sapiens
tgtcatccttgttga

SEQ ID NO: 404122 - DNA, 15 bp, Homo sapiens
gtcatccttgttgat

SEQ ID NO: 404123 - DNA, 15 bp, Homo sapiens
tcatccttgttgatg

SEQ ID NO: 404124 - DNA, 15 bp, Homo sapiens
catccttgttgatgt

SEQ ID NO: 404125 - DNA, 15 bp, Homo sapiens
atccttgttgatgta

SEQ ID NO: 404126 - DNA, 15 bp, Homo sapiens
tccttgttgatgtat

SEQ ID NO: 404127 - DNA, 15 bp, Homo sapiens
ccttgttgatgtatt

SEQ ID NO: 404128 - DNA, 15 bp, Homo sapiens
cttgttgatgtattc

SEQ ID NO: 404129 - DNA, 15 bp, Homo sapiens
ttgttgatgtattca

SEQ ID NO: 404130 - DNA, 15 bp, Homo sapiens
tgttgatgtattcat

SEQ ID NO: 404131 - DNA, 15 bp, Homo sapiens
gttgatgtattcata

SEQ ID NO: 404132 - DNA, 15 bp, Homo sapiens
ttgatgtattcatac

SEQ ID NO: 404133 - DNA, 15 bp, Homo sapiens
tgatgtattcatact

SEQ ID NO: 404134 - DNA, 15 bp, Homo sapiens
gatgtattcatactg

SEQ ID NO: 404135 - DNA, 15 bp, Homo sapiens
atgtattcatactgt

SEQ ID NO: 404136 - DNA, 15 bp, Homo sapiens
tgtattcatactgtt

SEQ ID NO: 404137 - DNA, 15 bp, Homo sapiens
gtattcatactgttt

SEQ ID NO: 404138 - DNA, 15 bp, Homo sapiens
tattcatactgtttt

SEQ ID NO: 404139 - DNA, 15 bp, Homo sapiens
attcatactgttttt

SEQ ID NO: 404140 - DNA, 15 bp, Homo sapiens
ttcatactgttttta

SEQ ID NO: 404141 - DNA, 15 bp, Homo sapiens
tcatactgtttttat

SEQ ID NO: 404142 - DNA, 15 bp, Homo sapiens
catactgtttttatt

SEQ ID NO: 404143 - DNA, 15 bp, Homo sapiens
tactgtttttattct

SEQ ID NO: 404144 - DNA, 15 bp, Homo sapiens
actgtttttattctt

SEQ ID NO: 404145 - DNA, 15 bp, Homo sapiens
ctgtttttattcttt

SEQ ID NO: 404146 - DNA, 15 bp, Homo sapiens
tgtttttattctttg

SEQ ID NO: 404147 - DNA, 15 bp, Homo sapiens
gtttttattctttga

SEQ ID NO: 404148 - DNA, 15 bp, Homo sapiens
tttttattctttgaa

SEQ ID NO: 404149 - DNA, 15 bp, Homo sapiens
ttttattctttgaaa

SEQ ID NO: 404150 - DNA, 15 bp, Homo sapiens
ttattctttgaaatg

SEQ ID NO: 404151 - DNA, 15 bp, Homo sapiens
tattctttgaaatgt

SEQ ID NO: 404152 - DNA, 15 bp, Homo sapiens
attctttgaaatgta

SEQ ID NO: 404153 - DNA, 15 bp, Homo sapiens
ttctttgaaatgtat

SEQ ID NO: 404154 - DNA, 15 bp, Homo sapiens
tctttgaaatgtatt

SEQ ID NO: 404155 - DNA, 15 bp, Homo sapiens
ctttgaaatgtattt

SEQ ID NO: 404156 - DNA, 15 bp, Homo sapiens
tttgaaatgtattta

SEQ ID NO: 404157 - DNA, 15 bp, Homo sapiens
ttgaaatgtatttaa

SEQ ID NO: 404158 - DNA, 15 bp, Homo sapiens
tgaaatgtatttaaa

SEQ ID NO: 404159 - DNA, 15 bp, Homo sapiens
gaaatgtatttaaat

SEQ ID NO: 404160 - DNA, 15 bp, Homo sapiens
aatgtatttaaatag

SEQ ID NO: 404161 - DNA, 15 bp, Homo sapiens
atgtatttaaataga

SEQ ID NO: 404162 - DNA, 15 bp, Homo sapiens
tgtatttaaatagaa

SEQ ID NO: 404163 - DNA, 15 bp, Homo sapiens
gtatttaaatagaaa

SEQ ID NO: 404164 - DNA, 15 bp, Homo sapiens
tatttaaatagaaaa

SEQ ID NO: 404165 - DNA, 15 bp, Homo sapiens
atttaaatagaaaaa

SEQ ID NO: 404166 - DNA, 15 bp, Homo sapiens
tttaaatagaaaaaa

SEQ ID NO: 404167 - DNA, 15 bp, Homo sapiens
ttaaatagaaaaaat

SEQ ID NO: 404168 - DNA, 15 bp, Homo sapiens
taaatagaaaaaata

SEQ ID NO: 404169 - DNA, 15 bp, Homo sapiens
aaatagaaaaaatag

SEQ ID NO: 404170 - DNA, 15 bp, Homo sapiens
aatagaaaaaatagt

SEQ ID NO: 404171 - DNA, 15 bp, Homo sapiens
atagaaaaaatagtt

SEQ ID NO: 404172 - DNA, 15 bp, Homo sapiens
tagaaaaaatagttc

SEQ ID NO: 404173 - DNA, 15 bp, Homo sapiens
agaaaaaatagttca

SEQ ID NO: 404174 - DNA, 15 bp, Homo sapiens
aaaaaatagttcatg

SEQ ID NO: 404175 - DNA, 15 bp, Homo sapiens
aaaaatagttcatgt

SEQ ID NO: 404176 - DNA, 15 bp, Homo sapiens
aaaatagttcatgtt

SEQ ID NO: 404177 - DNA, 15 bp, Homo sapiens
aaatagttcatgttt

SEQ ID NO: 404178 - DNA, 15 bp, Homo sapiens
aatagttcatgtttt

SEQ ID NO: 404179 - DNA, 15 bp, Homo sapiens
atagttcatgttttt

SEQ ID NO: 404180 - DNA, 15 bp, Homo sapiens
tagttcatgtttttt

SEQ ID NO: 404181 - DNA, 15 bp, Homo sapiens
agttcatgttttttg

SEQ ID NO: 404182 - DNA, 15 bp, Homo sapiens
gttcatgttttttgt

SEQ ID NO: 404183 - DNA, 15 bp, Homo sapiens
ttcatgttttttgtc

SEQ ID NO: 404184 - DNA, 15 bp, Homo sapiens
tcatgttttttgtca

SEQ ID NO: 404185 - DNA, 15 bp, Homo sapiens
catgttttttgtcat

SEQ ID NO: 404186 - DNA, 15 bp, Homo sapiens
atgttttttgtcatt

SEQ ID NO: 404187 - DNA, 15 bp, Homo sapiens
tgttttttgtcattc

SEQ ID NO: 404188 - DNA, 15 bp, Homo sapiens
gttttttgtcattct

SEQ ID NO: 404189 - DNA, 15 bp, Homo sapiens
ttttttgtcattctt

SEQ ID NO: 404190 - DNA, 15 bp, Homo sapiens
tttttgtcattcttt

SEQ ID NO: 404191 - DNA, 15 bp, Homo sapiens
ttttgtcattctttc

SEQ ID NO: 404192 - DNA, 15 bp, Homo sapiens
tttgtcattctttca

SEQ ID NO: 404193 - DNA, 15 bp, Homo sapiens
ttgtcattctttcag

SEQ ID NO: 404194 - DNA, 15 bp, Homo sapiens
tgtcattctttcaga

SEQ ID NO: 404195 - DNA, 15 bp, Homo sapiens
gtcattctttcagac

SEQ ID NO: 404196 - DNA, 15 bp, Homo sapiens
tcattctttcagact

SEQ ID NO: 404197 - DNA, 15 bp, Homo sapiens
cattctttcagactg

SEQ ID NO: 404198 - DNA, 15 bp, Homo sapiens
attctttcagactgc

SEQ ID NO: 404199 - DNA, 15 bp, Homo sapiens
ttctttcagactgca

SEQ ID NO: 404200 - DNA, 15 bp, Homo sapiens
tctttcagactgcag

SEQ ID NO: 404201 - DNA, 15 bp, Homo sapiens
ctttcagactgcagt

SEQ ID NO: 404202 - DNA, 15 bp, Homo sapiens
tttcagactgcagtg

SEQ ID NO: 404203 - DNA, 15 bp, Homo sapiens
ttcagactgcagtgt

SEQ ID NO: 404204 - DNA, 15 bp, Homo sapiens
tcagactgcagtgtt

SEQ ID NO: 404205 - DNA, 15 bp, Homo sapiens
cagactgcagtgttt

SEQ ID NO: 404206 - DNA, 15 bp, Homo sapiens
agactgcagtgtttt

SEQ ID NO: 404207 - DNA, 15 bp, Homo sapiens
gactgcagtgttttg

SEQ ID NO: 404208 - DNA, 15 bp, Homo sapiens
actgcagtgttttgt

SEQ ID NO: 404209 - DNA, 15 bp, Homo sapiens
ctgcagtgttttgtt

SEQ ID NO: 404210 - DNA, 15 bp, Homo sapiens
tgcagtgttttgttt

SEQ ID NO: 404211 - DNA, 15 bp, Homo sapiens
gcagtgttttgtttt

SEQ ID NO: 404212 - DNA, 15 bp, Homo sapiens
cagtgttttgttttg

SEQ ID NO: 404213 - DNA, 15 bp, Homo sapiens
agtgttttgttttga

SEQ ID NO: 404214 - DNA, 15 bp, Homo sapiens
gtgttttgttttgaa

SEQ ID NO: 404215 - DNA, 15 bp, Homo sapiens
tgttttgttttgaat

SEQ ID NO: 404216 - DNA, 15 bp, Homo sapiens
gttttgttttgaatg

SEQ ID NO: 404217 - DNA, 15 bp, Homo sapiens
ttttgttttgaatgt

SEQ ID NO: 404218 - DNA, 15 bp, Homo sapiens
tttgttttgaatgtg

SEQ ID NO: 404219 - DNA, 15 bp, Homo sapiens
ttgttttgaatgtgg

SEQ ID NO: 404220 - DNA, 15 bp, Homo sapiens
tgttttgaatgtggt

SEQ ID NO: 404221 - DNA, 15 bp, Homo sapiens
gttttgaatgtggtg

SEQ ID NO: 404222 - DNA, 15 bp, Homo sapiens
ttttgaatgtggtga

SEQ ID NO: 404223 - DNA, 15 bp, Homo sapiens
tttgaatgtggtgaa

SEQ ID NO: 404224 - DNA, 15 bp, Homo sapiens
ttgaatgtggtgaaa

SEQ ID NO: 404225 - DNA, 15 bp, Homo sapiens
tgaatgtggtgaaat

SEQ ID NO: 404226 - DNA, 15 bp, Homo sapiens
gaatgtggtgaaatt

SEQ ID NO: 404227 - DNA, 15 bp, Homo sapiens
aatgtggtgaaattg

SEQ ID NO: 404228 - DNA, 15 bp, Homo sapiens
tgtggtgaaattggt

SEQ ID NO: 404229 - DNA, 15 bp, Homo sapiens
gtggtgaaattggtt

SEQ ID NO: 404230 - DNA, 15 bp, Homo sapiens
tggtgaaattggttt

SEQ ID NO: 404231 - DNA, 15 bp, Homo sapiens
ggtgaaattggtttt

SEQ ID NO: 404232 - DNA, 15 bp, Homo sapiens
gtgaaattggtttta

SEQ ID NO: 404233 - DNA, 15 bp, Homo sapiens
tgaaattggttttat

SEQ ID NO: 404234 - DNA, 15 bp, Homo sapiens
gaaattggttttatt

SEQ ID NO: 404235 - DNA, 15 bp, Homo sapiens
aaattggttttattc

SEQ ID NO: 404236 - DNA, 15 bp, Homo sapiens
aattggttttattcc

SEQ ID NO: 404237 - DNA, 15 bp, Homo sapiens
attggttttattcct

SEQ ID NO: 404238 - DNA, 15 bp, Homo sapiens
ttggttttattcctc

SEQ ID NO: 404239 - DNA, 15 bp, Homo sapiens
ttttattcctcttgg

SEQ ID NO: 404240 - DNA, 15 bp, Homo sapiens
tttattcctcttggg

SEQ ID NO: 404241 - DNA, 15 bp, Homo sapiens
ttattcctcttggga

SEQ ID NO: 404242 - DNA, 15 bp, Homo sapiens
tattcctcttgggac

SEQ ID NO: 404243 - DNA, 15 bp, Homo sapiens
attcctcttgggact

SEQ ID NO: 404244 - DNA, 15 bp, Homo sapiens
ttcctcttgggactg

SEQ ID NO: 404245 - DNA, 15 bp, Homo sapiens
tcctcttgggactgc

SEQ ID NO: 404246 - DNA, 15 bp, Homo sapiens
cctcttgggactgct

SEQ ID NO: 404247 - DNA, 15 bp, Homo sapiens
ctcttgggactgctt

SEQ ID NO: 404248 - DNA, 15 bp, Homo sapiens
tcttgggactgctta

SEQ ID NO: 404249 - DNA, 15 bp, Homo sapiens
cttgggactgcttat

SEQ ID NO: 404250 - DNA, 15 bp, Homo sapiens
ttgggactgcttatc

SEQ ID NO: 404251 - DNA, 15 bp, Homo sapiens
tgggactgcttatct

SEQ ID NO: 404252 - DNA, 15 bp, Homo sapiens
gggactgcttatctc

SEQ ID NO: 404253 - DNA, 15 bp, Homo sapiens
ggactgcttatctct

SEQ ID NO: 404254 - DNA, 15 bp, Homo sapiens
gactgcttatctcta

SEQ ID NO: 404255 - DNA, 15 bp, Homo sapiens
actgcttatctctag

SEQ ID NO: 404256 - DNA, 15 bp, Homo sapiens
ctgcttatctctagg

SEQ ID NO: 404257 - DNA, 15 bp, Homo sapiens
tgcttatctctaggg

SEQ ID NO: 404258 - DNA, 15 bp, Homo sapiens
gcttatctctagggc

SEQ ID NO: 404259 - DNA, 15 bp, Homo sapiens
cttatctctagggcc

SEQ ID NO: 404260 - DNA, 15 bp, Homo sapiens
ttatctctagggcct

SEQ ID NO: 404261 - DNA, 15 bp, Homo sapiens
tatctctagggcctg

SEQ ID NO: 404262 - DNA, 15 bp, Homo sapiens
atctctagggcctgg

SEQ ID NO: 404263 - DNA, 15 bp, Homo sapiens
tctctagggcctgga

SEQ ID NO: 404264 - DNA, 15 bp, Homo sapiens
ctctagggcctggat

SEQ ID NO: 404265 - DNA, 15 bp, Homo sapiens
tctagggcctggatg

SEQ ID NO: 404266 - DNA, 15 bp, Homo sapiens
ctagggcctggatgc

SEQ ID NO: 404267 - DNA, 15 bp, Homo sapiens
tagggcctggatgct

SEQ ID NO: 404268 - DNA, 15 bp, Homo sapiens
agggcctggatgctt

SEQ ID NO: 404269 - DNA, 15 bp, Homo sapiens
gggcctggatgcttc

SEQ ID NO: 404270 - DNA, 15 bp, Homo sapiens
ggcctggatgcttcc

SEQ ID NO: 404271 - DNA, 15 bp, Homo sapiens
gcctggatgcttcct

SEQ ID NO: 404272 - DNA, 15 bp, Homo sapiens
cctggatgcttcctt

SEQ ID NO: 404273 - DNA, 15 bp, Homo sapiens
ctggatgcttccttt

SEQ ID NO: 404274 - DNA, 15 bp, Homo sapiens
tggatgcttccttta

SEQ ID NO: 404275 - DNA, 15 bp, Homo sapiens
ggatgcttcctttaa

SEQ ID NO: 404276 - DNA, 15 bp, Homo sapiens
gatgcttcctttaaa

SEQ ID NO: 404277 - DNA, 15 bp, Homo sapiens
atgcttcctttaaat

SEQ ID NO: 404278 - DNA, 15 bp, Homo sapiens
tgcttcctttaaata

SEQ ID NO: 404279 - DNA, 15 bp, Homo sapiens
gcttcctttaaatag

SEQ ID NO: 404280 - DNA, 15 bp, Homo sapiens
cttcctttaaatagg

SEQ ID NO: 404281 - DNA, 15 bp, Homo sapiens
ttcctttaaataggg

SEQ ID NO: 404282 - DNA, 15 bp, Homo sapiens
tcctttaaataggga

SEQ ID NO: 404283 - DNA, 15 bp, Homo sapiens
cctttaaatagggat

SEQ ID NO: 404284 - DNA, 15 bp, Homo sapiens
ctttaaatagggatt

SEQ ID NO: 404285 - DNA, 15 bp, Homo sapiens
tttaaatagggattc

SEQ ID NO: 404286 - DNA, 15 bp, Homo sapiens
ttaaatagggattca

SEQ ID NO: 404287 - DNA, 15 bp, Homo sapiens
taaatagggattcac

SEQ ID NO: 404288 - DNA, 15 bp, Homo sapiens
aaatagggattcaca

SEQ ID NO: 404289 - DNA, 15 bp, Homo sapiens
aatagggattcacag

SEQ ID NO: 404290 - DNA, 15 bp, Homo sapiens
atagggattcacagg

SEQ ID NO: 404291 - DNA, 15 bp, Homo sapiens
tagggattcacaggt

SEQ ID NO: 404292 - DNA, 15 bp, Homo sapiens
agggattcacaggta

SEQ ID NO: 404293 - DNA, 15 bp, Homo sapiens
gggattcacaggtag

SEQ ID NO: 404294 - DNA, 15 bp, Homo sapiens
ggattcacaggtagt

SEQ ID NO: 404295 - DNA, 15 bp, Homo sapiens
gattcacaggtagta

SEQ ID NO: 404296 - DNA, 15 bp, Homo sapiens
attcacaggtagtaa

SEQ ID NO: 404297 - DNA, 15 bp, Homo sapiens
ttcacaggtagtaaa

SEQ ID NO: 404298 - DNA, 15 bp, Homo sapiens
tcacaggtagtaaat

SEQ ID NO: 404299 - DNA, 15 bp, Homo sapiens
cacaggtagtaaatc

SEQ ID NO: 404300 - DNA, 15 bp, Homo sapiens
acaggtagtaaatca

SEQ ID NO: 404301 - DNA, 15 bp, Homo sapiens
caggtagtaaatcat

SEQ ID NO: 404302 - DNA, 15 bp, Homo sapiens
aggtagtaaatcatt

SEQ ID NO: 404303 - DNA, 15 bp, Homo sapiens
ggtagtaaatcatta

SEQ ID NO: 404304 - DNA, 15 bp, Homo sapiens
gtagtaaatcattag

SEQ ID NO: 404305 - DNA, 15 bp, Homo sapiens
tagtaaatcattaga

SEQ ID NO: 404306 - DNA, 15 bp, Homo sapiens
agtaaatcattagaa

SEQ ID NO: 404307 - DNA, 15 bp, Homo sapiens
gtaaatcattagaat

SEQ ID NO: 404308 - DNA, 15 bp, Homo sapiens
taaatcattagaatt

SEQ ID NO: 404309 - DNA, 15 bp, Homo sapiens
aaatcattagaattt

SEQ ID NO: 404310 - DNA, 15 bp, Homo sapiens
aatcattagaatttt

SEQ ID NO: 404311 - DNA, 15 bp, Homo sapiens
atcattagaattttt

SEQ ID NO: 404312 - DNA, 15 bp, Homo sapiens
tcattagaatttttg

SEQ ID NO: 404313 - DNA, 15 bp, Homo sapiens
cattagaatttttgt

SEQ ID NO: 404314 - DNA, 15 bp, Homo sapiens
attagaatttttgtt

SEQ ID NO: 404315 - DNA, 15 bp, Homo sapiens
ttagaatttttgttt

SEQ ID NO: 404316 - DNA, 15 bp, Homo sapiens
tagaatttttgttta

SEQ ID NO: 404317 - DNA, 15 bp, Homo sapiens
agaatttttgtttaa

SEQ ID NO: 404318 - DNA, 15 bp, Homo sapiens
gaatttttgtttaac

SEQ ID NO: 404319 - DNA, 15 bp, Homo sapiens
aatttttgtttaaca

SEQ ID NO: 404320 - DNA, 15 bp, Homo sapiens
atttttgtttaacag

SEQ ID NO: 404321 - DNA, 15 bp, Homo sapiens
tttttgtttaacagt

SEQ ID NO: 404322 - DNA, 15 bp, Homo sapiens
ttttgtttaacagtg

SEQ ID NO: 404323 - DNA, 15 bp, Homo sapiens
tttgtttaacagtga

SEQ ID NO: 404324 - DNA, 15 bp, Homo sapiens
ttgtttaacagtgaa

SEQ ID NO: 404325 - DNA, 15 bp, Homo sapiens
tgtttaacagtgaaa

SEQ ID NO: 404326 - DNA, 15 bp, Homo sapiens
gtttaacagtgaaag

SEQ ID NO: 404327 - DNA, 15 bp, Homo sapiens
tttaacagtgaaaga

SEQ ID NO: 404328 - DNA, 15 bp, Homo sapiens
ttaacagtgaaagaa

SEQ ID NO: 404329 - DNA, 15 bp, Homo sapiens
taacagtgaaagaag

SEQ ID NO: 404330 - DNA, 15 bp, Homo sapiens
aacagtgaaagaagt

SEQ ID NO: 404331 - DNA, 15 bp, Homo sapiens
acagtgaaagaagtc

SEQ ID NO: 404332 - DNA, 15 bp, Homo sapiens
cagtgaaagaagtca

SEQ ID NO: 404333 - DNA, 15 bp, Homo sapiens
agtgaaagaagtcac

SEQ ID NO: 404334 - DNA, 15 bp, Homo sapiens
gtgaaagaagtcact

SEQ ID NO: 404335 - DNA, 15 bp, Homo sapiens
tgaaagaagtcactt

SEQ ID NO: 404336 - DNA, 15 bp, Homo sapiens
gaaagaagtcactta

SEQ ID NO: 404337 - DNA, 15 bp, Homo sapiens
aaagaagtcacttaa

SEQ ID NO: 404338 - DNA, 15 bp, Homo sapiens
aagaagtcacttaac

SEQ ID NO: 404339 - DNA, 15 bp, Homo sapiens
agaagtcacttaaca

SEQ ID NO: 404340 - DNA, 15 bp, Homo sapiens
gaagtcacttaacat

SEQ ID NO: 404341 - DNA, 15 bp, Homo sapiens
aagtcacttaacata

SEQ ID NO: 404342 - DNA, 15 bp, Homo sapiens
agtcacttaacatag

SEQ ID NO: 404343 - DNA, 15 bp, Homo sapiens
gtcacttaacatagg

SEQ ID NO: 404344 - DNA, 15 bp, Homo sapiens
tcacttaacataggt

SEQ ID NO: 404345 - DNA, 15 bp, Homo sapiens
cacttaacataggtc

SEQ ID NO: 404346 - DNA, 15 bp, Homo sapiens
acttaacataggtct

SEQ ID NO: 404347 - DNA, 15 bp, Homo sapiens
cttaacataggtctg

SEQ ID NO: 404348 - DNA, 15 bp, Homo sapiens
ttaacataggtctgt

SEQ ID NO: 404349 - DNA, 15 bp, Homo sapiens
taacataggtctgtc

SEQ ID NO: 404350 - DNA, 15 bp, Homo sapiens
aacataggtctgtca

SEQ ID NO: 404351 - DNA, 15 bp, Homo sapiens
acataggtctgtcat

SEQ ID NO: 404352 - DNA, 15 bp, Homo sapiens
cataggtctgtcata

SEQ ID NO: 404353 - DNA, 15 bp, Homo sapiens
ataggtctgtcatag

SEQ ID NO: 404354 - DNA, 15 bp, Homo sapiens
taggtctgtcatagt

SEQ ID NO: 404355 - DNA, 15 bp, Homo sapiens
aggtctgtcatagtt

SEQ ID NO: 404356 - DNA, 15 bp, Homo sapiens
ggtctgtcatagttc

SEQ ID NO: 404357 - DNA, 15 bp, Homo sapiens
gtctgtcatagttct

SEQ ID NO: 404358 - DNA, 15 bp, Homo sapiens
tctgtcatagttctg

SEQ ID NO: 404359 - DNA, 15 bp, Homo sapiens
ctgtcatagttctgt

SEQ ID NO: 404360 - DNA, 15 bp, Homo sapiens
tgtcatagttctgtc

SEQ ID NO: 404361 - DNA, 15 bp, Homo sapiens
gtcatagttctgtct

SEQ ID NO: 404362 - DNA, 15 bp, Homo sapiens
tcatagttctgtctt

SEQ ID NO: 404363 - DNA, 15 bp, Homo sapiens
catagttctgtcttt

SEQ ID NO: 404364 - DNA, 15 bp, Homo sapiens
atagttctgtctttg

SEQ ID NO: 404365 - DNA, 15 bp, Homo sapiens
tagttctgtctttgt

SEQ ID NO: 404366 - DNA, 15 bp, Homo sapiens
agttctgtctttgtc

SEQ ID NO: 404367 - DNA, 15 bp, Homo sapiens
gttctgtctttgtca

SEQ ID NO: 404368 - DNA, 15 bp, Homo sapiens
ttctgtctttgtcac

SEQ ID NO: 404369 - DNA, 15 bp, Homo sapiens
tctgtctttgtcact

SEQ ID NO: 404370 - DNA, 15 bp, Homo sapiens
ctgtctttgtcactg

SEQ ID NO: 404371 - DNA, 15 bp, Homo sapiens
tgtctttgtcactgt

SEQ ID NO: 404372 - DNA, 15 bp, Homo sapiens
gtctttgtcactgta

SEQ ID NO: 404373 - DNA, 15 bp, Homo sapiens
tctttgtcactgtat

SEQ ID NO: 404374 - DNA, 15 bp, Homo sapiens
ctttgtcactgtatg

SEQ ID NO: 404375 - DNA, 15 bp, Homo sapiens
tttgtcactgtatgt

SEQ ID NO: 404376 - DNA, 15 bp, Homo sapiens
ttgtcactgtatgta

SEQ ID NO: 404377 - DNA, 15 bp, Homo sapiens
tgtcactgtatgtag

SEQ ID NO: 404378 - DNA, 15 bp, Homo sapiens
gtcactgtatgtaga

SEQ ID NO: 404379 - DNA, 15 bp, Homo sapiens
tcactgtatgtagaa

SEQ ID NO: 404380 - DNA, 15 bp, Homo sapiens
cactgtatgtagaat

SEQ ID NO: 404381 - DNA, 15 bp, Homo sapiens
actgtatgtagaatt

SEQ ID NO: 404382 - DNA, 15 bp, Homo sapiens
ctgtatgtagaattt

SEQ ID NO: 404383 - DNA, 15 bp, Homo sapiens
tgtatgtagaatttc

SEQ ID NO: 404384 - DNA, 15 bp, Homo sapiens
gtatgtagaatttca

SEQ ID NO: 404385 - DNA, 15 bp, Homo sapiens
tatgtagaatttcat

SEQ ID NO: 404386 - DNA, 15 bp, Homo sapiens
atgtagaatttcata

SEQ ID NO: 404387 - DNA, 15 bp, Homo sapiens
tgtagaatttcatag

SEQ ID NO: 404388 - DNA, 15 bp, Homo sapiens
gtagaatttcatagt

SEQ ID NO: 404389 - DNA, 15 bp, Homo sapiens
tagaatttcatagtg

SEQ ID NO: 404390 - DNA, 15 bp, Homo sapiens
agaatttcatagtga

SEQ ID NO: 404391 - DNA, 15 bp, Homo sapiens
gaatttcatagtgat

SEQ ID NO: 404392 - DNA, 15 bp, Homo sapiens
aatttcatagtgata

SEQ ID NO: 404393 - DNA, 15 bp, Homo sapiens
atttcatagtgatac

SEQ ID NO: 404394 - DNA, 15 bp, Homo sapiens
tttcatagtgataca

SEQ ID NO: 404395 - DNA, 15 bp, Homo sapiens
ttcatagtgatacaa

SEQ ID NO: 404396 - DNA, 15 bp, Homo sapiens
tcatagtgatacaac

SEQ ID NO: 404397 - DNA, 15 bp, Homo sapiens
catagtgatacaaca

SEQ ID NO: 404398 - DNA, 15 bp, Homo sapiens
atagtgatacaacat

SEQ ID NO: 404399 - DNA, 15 bp, Homo sapiens
tagtgatacaacatc

SEQ ID NO: 404400 - DNA, 15 bp, Homo sapiens
agtgatacaacatcc

SEQ ID NO: 404401 - DNA, 15 bp, Homo sapiens
gtgatacaacatcca

SEQ ID NO: 404402 - DNA, 15 bp, Homo sapiens
tgatacaacatccat

SEQ ID NO: 404403 - DNA, 15 bp, Homo sapiens
gatacaacatccatt

SEQ ID NO: 404404 - DNA, 15 bp, Homo sapiens
atacaacatccattt

SEQ ID NO: 404405 - DNA, 15 bp, Homo sapiens
tacaacatccatttt

SEQ ID NO: 404406 - DNA, 15 bp, Homo sapiens
acaacatccattttc

SEQ ID NO: 404407 - DNA, 15 bp, Homo sapiens
caacatccattttct

SEQ ID NO: 404408 - DNA, 15 bp, Homo sapiens
aacatccattttctt

SEQ ID NO: 404409 - DNA, 15 bp, Homo sapiens
acatccattttctta

SEQ ID NO: 404410 - DNA, 15 bp, Homo sapiens
catccattttcttag

SEQ ID NO: 404411 - DNA, 15 bp, Homo sapiens
atccattttcttagc

SEQ ID NO: 404412 - DNA, 15 bp, Homo sapiens
tccattttcttagca

SEQ ID NO: 404413 - DNA, 15 bp, Homo sapiens
ccattttcttagcaa

SEQ ID NO: 404414 - DNA, 15 bp, Homo sapiens
cattttcttagcaaa

SEQ ID NO: 404415 - DNA, 15 bp, Homo sapiens
attttcttagcaaaa

SEQ ID NO: 404416 - DNA, 15 bp, Homo sapiens
ttttcttagcaaaaa

SEQ ID NO: 404417 - DNA, 15 bp, Homo sapiens
tttcttagcaaaaag

SEQ ID NO: 404418 - DNA, 15 bp, Homo sapiens
ttcttagcaaaaagt

SEQ ID NO: 404419 - DNA, 15 bp, Homo sapiens
tcttagcaaaaagtt

SEQ ID NO: 404420 - DNA, 15 bp, Homo sapiens
cttagcaaaaagtta

SEQ ID NO: 404421 - DNA, 15 bp, Homo sapiens
ttagcaaaaagttag

SEQ ID NO: 404422 - DNA, 15 bp, Homo sapiens
tagcaaaaagttagg

SEQ ID NO: 404423 - DNA, 15 bp, Homo sapiens
agcaaaaagttaggt

SEQ ID NO: 404424 - DNA, 15 bp, Homo sapiens
gcaaaaagttaggtc

SEQ ID NO: 404425 - DNA, 15 bp, Homo sapiens
caaaaagttaggtct

SEQ ID NO: 404426 - DNA, 15 bp, Homo sapiens
aaaaagttaggtcta

SEQ ID NO: 404427 - DNA, 15 bp, Homo sapiens
aaaagttaggtctag

SEQ ID NO: 404428 - DNA, 15 bp, Homo sapiens
aaagttaggtctagg

SEQ ID NO: 404429 - DNA, 15 bp, Homo sapiens
aagttaggtctaggg

SEQ ID NO: 404430 - DNA, 15 bp, Homo sapiens
agttaggtctagggt

SEQ ID NO: 404431 - DNA, 15 bp, Homo sapiens
gttaggtctagggta

SEQ ID NO: 404432 - DNA, 15 bp, Homo sapiens
ttaggtctagggtat

SEQ ID NO: 404433 - DNA, 15 bp, Homo sapiens
taggtctagggtata

SEQ ID NO: 404434 - DNA, 15 bp, Homo sapiens
aggtctagggtatat

SEQ ID NO: 404435 - DNA, 15 bp, Homo sapiens
ggtctagggtatatc

SEQ ID NO: 404436 - DNA, 15 bp, Homo sapiens
gtctagggtatatct

SEQ ID NO: 404437 - DNA, 15 bp, Homo sapiens
tctagggtatatctg

SEQ ID NO: 404438 - DNA, 15 bp, Homo sapiens
ctagggtatatctgt

SEQ ID NO: 404439 - DNA, 15 bp, Homo sapiens
tagggtatatctgtt

SEQ ID NO: 404440 - DNA, 15 bp, Homo sapiens
agggtatatctgttt

SEQ ID NO: 404441 - DNA, 15 bp, Homo sapiens
gggtatatctgtttg

SEQ ID NO: 404442 - DNA, 15 bp, Homo sapiens
ggtatatctgtttgg

SEQ ID NO: 404443 - DNA, 15 bp, Homo sapiens
gtatatctgtttgga

SEQ ID NO: 404444 - DNA, 15 bp, Homo sapiens
tatatctgtttggaa

SEQ ID NO: 404445 - DNA, 15 bp, Homo sapiens
atatctgtttggaaa

SEQ ID NO: 404446 - DNA, 15 bp, Homo sapiens
tatctgtttggaaaa

SEQ ID NO: 404447 - DNA, 15 bp, Homo sapiens
atctgtttggaaaat

SEQ ID NO: 404448 - DNA, 15 bp, Homo sapiens
tctgtttggaaaatt

SEQ ID NO: 404449 - DNA, 15 bp, Homo sapiens
ctgtttggaaaatta

SEQ ID NO: 404450 - DNA, 15 bp, Homo sapiens
tgtttggaaaattac

SEQ ID NO: 404451 - DNA, 15 bp, Homo sapiens
gtttggaaaattaca

SEQ ID NO: 404452 - DNA, 15 bp, Homo sapiens
tttggaaaattacat

SEQ ID NO: 404453 - DNA, 15 bp, Homo sapiens
ttggaaaattacatc

SEQ ID NO: 404454 - DNA, 15 bp, Homo sapiens
tggaaaattacatca

SEQ ID NO: 404455 - DNA, 15 bp, Homo sapiens
ggaaaattacatcag

SEQ ID NO: 404456 - DNA, 15 bp, Homo sapiens
gaaaattacatcaga

SEQ ID NO: 404457 - DNA, 15 bp, Homo sapiens
aaaattacatcagaa

SEQ ID NO: 404458 - DNA, 15 bp, Homo sapiens
aaattacatcagaat

SEQ ID NO: 404459 - DNA, 15 bp, Homo sapiens
aattacatcagaatt

SEQ ID NO: 404460 - DNA, 15 bp, Homo sapiens
attacatcagaattg

SEQ ID NO: 404461 - DNA, 15 bp, Homo sapiens
ttacatcagaattga

SEQ ID NO: 404462 - DNA, 15 bp, Homo sapiens
tacatcagaattgat

SEQ ID NO: 404463 - DNA, 15 bp, Homo sapiens
acatcagaattgatt

SEQ ID NO: 404464 - DNA, 15 bp, Homo sapiens
catcagaattgattt

SEQ ID NO: 404465 - DNA, 15 bp, Homo sapiens
atcagaattgatttt

SEQ ID NO: 404466 - DNA, 15 bp, Homo sapiens
tcagaattgattttc

SEQ ID NO: 404467 - DNA, 15 bp, Homo sapiens
cagaattgattttca

SEQ ID NO: 404468 - DNA, 15 bp, Homo sapiens
agaattgattttcaa

SEQ ID NO: 404469 - DNA, 15 bp, Homo sapiens
gaattgattttcaat

SEQ ID NO: 404470 - DNA, 15 bp, Homo sapiens
aattgattttcaatt

SEQ ID NO: 404471 - DNA, 15 bp, Homo sapiens
attgattttcaatta

SEQ ID NO: 404472 - DNA, 15 bp, Homo sapiens
ttgattttcaattaa

SEQ ID NO: 404473 - DNA, 15 bp, Homo sapiens
tgattttcaattaat

SEQ ID NO: 404474 - DNA, 15 bp, Homo sapiens
gattttcaattaatc

SEQ ID NO: 404475 - DNA, 15 bp, Homo sapiens
attttcaattaatca

SEQ ID NO: 404476 - DNA, 15 bp, Homo sapiens
ttttcaattaatcaa

SEQ ID NO: 404477 - DNA, 15 bp, Homo sapiens
tttcaattaatcaaa

SEQ ID NO: 404478 - DNA, 15 bp, Homo sapiens
ttcaattaatcaaag

SEQ ID NO: 404479 - DNA, 15 bp, Homo sapiens
tcaattaatcaaagt

SEQ ID NO: 404480 - DNA, 15 bp, Homo sapiens
caattaatcaaagtt

SEQ ID NO: 404481 - DNA, 15 bp, Homo sapiens
aattaatcaaagtta

SEQ ID NO: 404482 - DNA, 15 bp, Homo sapiens
attaatcaaagttac

SEQ ID NO: 404483 - DNA, 15 bp, Homo sapiens
ttaatcaaagttact

SEQ ID NO: 404484 - DNA, 15 bp, Homo sapiens
taatcaaagttacta

SEQ ID NO: 404485 - DNA, 15 bp, Homo sapiens
aatcaaagttactaa

SEQ ID NO: 404486 - DNA, 15 bp, Homo sapiens
atcaaagttactaaa

SEQ ID NO: 404487 - DNA, 15 bp, Homo sapiens
tcaaagttactaaat

SEQ ID NO: 404488 - DNA, 15 bp, Homo sapiens
caaagttactaaata

SEQ ID NO: 404489 - DNA, 15 bp, Homo sapiens
aaagttactaaatag

SEQ ID NO: 404490 - DNA, 15 bp, Homo sapiens
aagttactaaatagt

SEQ ID NO: 404491 - DNA, 15 bp, Homo sapiens
agttactaaatagtg

SEQ ID NO: 404492 - DNA, 15 bp, Homo sapiens
gttactaaatagtgc

SEQ ID NO: 404493 - DNA, 15 bp, Homo sapiens
ttactaaatagtgct

SEQ ID NO: 404494 - DNA, 15 bp, Homo sapiens
tactaaatagtgctc

SEQ ID NO: 404495 - DNA, 15 bp, Homo sapiens
actaaatagtgctct

SEQ ID NO: 404496 - DNA, 15 bp, Homo sapiens
ctaaatagtgctctg

SEQ ID NO: 404497 - DNA, 15 bp, Homo sapiens
taaatagtgctctga

SEQ ID NO: 404498 - DNA, 15 bp, Homo sapiens
aaatagtgctctgag

SEQ ID NO: 404499 - DNA, 15 bp, Homo sapiens
aatagtgctctgagt

SEQ ID NO: 404500 - DNA, 15 bp, Homo sapiens
atagtgctctgagtt

SEQ ID NO: 404501 - DNA, 15 bp, Homo sapiens
tagtgctctgagtta

SEQ ID NO: 404502 - DNA, 15 bp, Homo sapiens
agtgctctgagttac

SEQ ID NO: 404503 - DNA, 15 bp, Homo sapiens
gtgctctgagttacc

SEQ ID NO: 404504 - DNA, 15 bp, Homo sapiens
tgctctgagttacca

SEQ ID NO: 404505 - DNA, 15 bp, Homo sapiens
gctctgagttaccag

SEQ ID NO: 404506 - DNA, 15 bp, Homo sapiens
ctctgagttaccagt

SEQ ID NO: 404507 - DNA, 15 bp, Homo sapiens
tctgagttaccagtg

SEQ ID NO: 404508 - DNA, 15 bp, Homo sapiens
ctgagttaccagtgg

SEQ ID NO: 404509 - DNA, 15 bp, Homo sapiens
tgagttaccagtggt

SEQ ID NO: 404510 - DNA, 15 bp, Homo sapiens
gagttaccagtggta

SEQ ID NO: 404511 - DNA, 15 bp, Homo sapiens
agttaccagtggtat

SEQ ID NO: 404512 - DNA, 15 bp, Homo sapiens
gttaccagtggtatt

SEQ ID NO: 404513 - DNA, 15 bp, Homo sapiens
ttaccagtggtattt

SEQ ID NO: 404514 - DNA, 15 bp, Homo sapiens
taccagtggtattta

SEQ ID NO: 404515 - DNA, 15 bp, Homo sapiens
accagtggtatttaa

SEQ ID NO: 404516 - DNA, 15 bp, Homo sapiens
ccagtggtatttaaa

SEQ ID NO: 404517 - DNA, 15 bp, Homo sapiens
cagtggtatttaaaa

SEQ ID NO: 404518 - DNA, 15 bp, Homo sapiens
agtggtatttaaaat

SEQ ID NO: 404519 - DNA, 15 bp, Homo sapiens
gtggtatttaaaatt

SEQ ID NO: 404520 - DNA, 15 bp, Homo sapiens
tggtatttaaaatta

SEQ ID NO: 404521 - DNA, 15 bp, Homo sapiens
ggtatttaaaattaa

SEQ ID NO: 404522 - DNA, 15 bp, Homo sapiens
gtatttaaaattaat

SEQ ID NO: 404523 - DNA, 15 bp, Homo sapiens
tatttaaaattaatt

SEQ ID NO: 404524 - DNA, 15 bp, Homo sapiens
atttaaaattaattt

SEQ ID NO: 404525 - DNA, 15 bp, Homo sapiens
tttaaaattaatttt

SEQ ID NO: 404526 - DNA, 15 bp, Homo sapiens
ttaaaattaattttg

SEQ ID NO: 404527 - DNA, 15 bp, Homo sapiens
taaaattaattttgg

SEQ ID NO: 404528 - DNA, 15 bp, Homo sapiens
aaaattaattttgga

SEQ ID NO: 404529 - DNA, 15 bp, Homo sapiens
aaattaattttggaa

SEQ ID NO: 404530 - DNA, 15 bp, Homo sapiens
aattaattttggaag

SEQ ID NO: 404531 - DNA, 15 bp, Homo sapiens
attaattttggaagt

SEQ ID NO: 404532 - DNA, 15 bp, Homo sapiens
ttaattttggaagtt

SEQ ID NO: 404533 - DNA, 15 bp, Homo sapiens
taattttggaagttg

SEQ ID NO: 404534 - DNA, 15 bp, Homo sapiens
aattttggaagttgc

SEQ ID NO: 404535 - DNA, 15 bp, Homo sapiens
attttggaagttgca

SEQ ID NO: 404536 - DNA, 15 bp, Homo sapiens
ttttggaagttgcac

SEQ ID NO: 404537 - DNA, 15 bp, Homo sapiens
tttggaagttgcaca

SEQ ID NO: 404538 - DNA, 15 bp, Homo sapiens
ttggaagttgcacac

SEQ ID NO: 404539 - DNA, 15 bp, Homo sapiens
tggaagttgcacaca

SEQ ID NO: 404540 - DNA, 15 bp, Homo sapiens
ggaagttgcacacat

SEQ ID NO: 404541 - DNA, 15 bp, Homo sapiens
gaagttgcacacata

SEQ ID NO: 404542 - DNA, 15 bp, Homo sapiens
aagttgcacacatac

SEQ ID NO: 404543 - DNA, 15 bp, Homo sapiens
agttgcacacatact

SEQ ID NO: 404544 - DNA, 15 bp, Homo sapiens
gttgcacacatactt

SEQ ID NO: 404545 - DNA, 15 bp, Homo sapiens
ttgcacacatacttt

SEQ ID NO: 404546 - DNA, 15 bp, Homo sapiens
tgcacacatacttta

SEQ ID NO: 404547 - DNA, 15 bp, Homo sapiens
gcacacatactttat

SEQ ID NO: 404548 - DNA, 15 bp, Homo sapiens
cacacatactttatg

SEQ ID NO: 404549 - DNA, 15 bp, Homo sapiens
acacatactttatgt

SEQ ID NO: 404550 - DNA, 15 bp, Homo sapiens
cacatactttatgtg

SEQ ID NO: 404551 - DNA, 15 bp, Homo sapiens
acatactttatgtgt

SEQ ID NO: 404552 - DNA, 15 bp, Homo sapiens
catactttatgtgta

SEQ ID NO: 404553 - DNA, 15 bp, Homo sapiens
atactttatgtgtat

SEQ ID NO: 404554 - DNA, 15 bp, Homo sapiens
tactttatgtgtatt

SEQ ID NO: 404555 - DNA, 15 bp, Homo sapiens
actttatgtgtattt

SEQ ID NO: 404556 - DNA, 15 bp, Homo sapiens
ctttatgtgtatttt

SEQ ID NO: 404557 - DNA, 15 bp, Homo sapiens
tttatgtgtattttc

SEQ ID NO: 404558 - DNA, 15 bp, Homo sapiens
ttatgtgtattttct

SEQ ID NO: 404559 - DNA, 15 bp, Homo sapiens
tatgtgtattttctt

SEQ ID NO: 404560 - DNA, 15 bp, Homo sapiens
atgtgtattttcttt

SEQ ID NO: 404561 - DNA, 15 bp, Homo sapiens
tgtgtattttctttt

SEQ ID NO: 404562 - DNA, 15 bp, Homo sapiens
gtgtattttcttttt

SEQ ID NO: 404563 - DNA, 15 bp, Homo sapiens
tgtattttctttttc

SEQ ID NO: 404564 - DNA, 15 bp, Homo sapiens
gtattttctttttct

SEQ ID NO: 404565 - DNA, 15 bp, Homo sapiens
tattttctttttctt

SEQ ID NO: 404566 - DNA, 15 bp, Homo sapiens
attttctttttcttg

SEQ ID NO: 404567 - DNA, 15 bp, Homo sapiens
ttttctttttcttgt

SEQ ID NO: 404568 - DNA, 15 bp, Homo sapiens
tttctttttcttgta

SEQ ID NO: 404569 - DNA, 15 bp, Homo sapiens
ttctttttcttgtat

SEQ ID NO: 404570 - DNA, 15 bp, Homo sapiens
tctttttcttgtatg

SEQ ID NO: 404571 - DNA, 15 bp, Homo sapiens
ctttttcttgtatga

SEQ ID NO: 404572 - DNA, 15 bp, Homo sapiens
tttttcttgtatgag

SEQ ID NO: 404573 - DNA, 15 bp, Homo sapiens
ttttcttgtatgaga

SEQ ID NO: 404574 - DNA, 15 bp, Homo sapiens
tttcttgtatgagag

SEQ ID NO: 404575 - DNA, 15 bp, Homo sapiens
ttcttgtatgagaga

SEQ ID NO: 404576 - DNA, 15 bp, Homo sapiens
tcttgtatgagagaa

SEQ ID NO: 404577 - DNA, 15 bp, Homo sapiens
cttgtatgagagaat

SEQ ID NO: 404578 - DNA, 15 bp, Homo sapiens
ttgtatgagagaatg

SEQ ID NO: 404579 - DNA, 15 bp, Homo sapiens
tgtatgagagaatga

SEQ ID NO: 404580 - DNA, 15 bp, Homo sapiens
gtatgagagaatgat

SEQ ID NO: 404581 - DNA, 15 bp, Homo sapiens
tatgagagaatgata

SEQ ID NO: 404582 - DNA, 15 bp, Homo sapiens
atgagagaatgatat

SEQ ID NO: 404583 - DNA, 15 bp, Homo sapiens
tgagagaatgatata

SEQ ID NO: 404584 - DNA, 15 bp, Homo sapiens
gagagaatgatatat

SEQ ID NO: 404585 - DNA, 15 bp, Homo sapiens
agagaatgatatata

SEQ ID NO: 404586 - DNA, 15 bp, Homo sapiens
gagaatgatatatat

SEQ ID NO: 404587 - DNA, 15 bp, Homo sapiens
agaatgatatatatt

SEQ ID NO: 404588 - DNA, 15 bp, Homo sapiens
gaatgatatatatta

SEQ ID NO: 404589 - DNA, 15 bp, Homo sapiens
aatgatatatattaa

SEQ ID NO: 404590 - DNA, 15 bp, Homo sapiens
atgatatatattaaa

SEQ ID NO: 404591 - DNA, 15 bp, Homo sapiens
tgatatatattaaat

SEQ ID NO: 404592 - DNA, 15 bp, Homo sapiens
gatatatattaaatt

SEQ ID NO: 404593 - DNA, 15 bp, Homo sapiens
atatatattaaattg

SEQ ID NO: 404594 - DNA, 15 bp, Homo sapiens
tatatattaaattgt

SEQ ID NO: 404595 - DNA, 15 bp, Homo sapiens
atatattaaattgta

SEQ ID NO: 404596 - DNA, 15 bp, Homo sapiens
tatattaaattgtag

SEQ ID NO: 404597 - DNA, 15 bp, Homo sapiens
atattaaattgtagt

SEQ ID NO: 404598 - DNA, 15 bp, Homo sapiens
tattaaattgtagtt

SEQ ID NO: 404599 - DNA, 15 bp, Homo sapiens
attaaattgtagtta

SEQ ID NO: 404600 - DNA, 15 bp, Homo sapiens
ttaaattgtagttat

SEQ ID NO: 404601 - DNA, 15 bp, Homo sapiens
taaattgtagttatt

SEQ ID NO: 404602 - DNA, 15 bp, Homo sapiens
aaattgtagttattg

SEQ ID NO: 404603 - DNA, 15 bp, Homo sapiens
aattgtagttattgc

SEQ ID NO: 404604 - DNA, 15 bp, Homo sapiens
attgtagttattgct

SEQ ID NO: 404605 - DNA, 15 bp, Homo sapiens
ttgtagttattgctt

SEQ ID NO: 404606 - DNA, 15 bp, Homo sapiens
tgtagttattgctta

SEQ ID NO: 404607 - DNA, 15 bp, Homo sapiens
gtagttattgcttat

SEQ ID NO: 404608 - DNA, 15 bp, Homo sapiens
tagttattgcttata

SEQ ID NO: 404609 - DNA, 15 bp, Homo sapiens
agttattgcttataa

SEQ ID NO: 404610 - DNA, 15 bp, Homo sapiens
gttattgcttataat

SEQ ID NO: 404611 - DNA, 15 bp, Homo sapiens
ttattgcttataatc

SEQ ID NO: 404612 - DNA, 15 bp, Homo sapiens
tattgcttataatcc

SEQ ID NO: 404613 - DNA, 15 bp, Homo sapiens
attgcttataatcct

SEQ ID NO: 404614 - DNA, 15 bp, Homo sapiens
ttgcttataatcctt

SEQ ID NO: 404615 - DNA, 15 bp, Homo sapiens
tgcttataatccttt

SEQ ID NO: 404616 - DNA, 15 bp, Homo sapiens
gcttataatcctttt

SEQ ID NO: 404617 - DNA, 15 bp, Homo sapiens
cttataatcctttta

SEQ ID NO: 404618 - DNA, 15 bp, Homo sapiens
ttataatccttttag

SEQ ID NO: 404619 - DNA, 15 bp, Homo sapiens
tataatccttttaga

SEQ ID NO: 404620 - DNA, 15 bp, Homo sapiens
ataatccttttagaa

SEQ ID NO: 404621 - DNA, 15 bp, Homo sapiens
taatccttttagaag

SEQ ID NO: 404622 - DNA, 15 bp, Homo sapiens
aatccttttagaagg

SEQ ID NO: 404623 - DNA, 15 bp, Homo sapiens
atccttttagaaggc

SEQ ID NO: 404624 - DNA, 15 bp, Homo sapiens
tccttttagaaggca

SEQ ID NO: 404625 - DNA, 15 bp, Homo sapiens
ccttttagaaggcaa

SEQ ID NO: 404626 - DNA, 15 bp, Homo sapiens
cttttagaaggcaat

SEQ ID NO: 404627 - DNA, 15 bp, Homo sapiens
ttttagaaggcaatg

SEQ ID NO: 404628 - DNA, 15 bp, Homo sapiens
tttagaaggcaatgg

SEQ ID NO: 404629 - DNA, 15 bp, Homo sapiens
ttagaaggcaatggg

SEQ ID NO: 404630 - DNA, 15 bp, Homo sapiens
tagaaggcaatgggg

SEQ ID NO: 404631 - DNA, 15 bp, Homo sapiens
agaaggcaatggggc

SEQ ID NO: 404632 - DNA, 15 bp, Homo sapiens
gaaggcaatggggct

SEQ ID NO: 404633 - DNA, 15 bp, Homo sapiens
aaggcaatggggcta

SEQ ID NO: 404634 - DNA, 15 bp, Homo sapiens
aggcaatggggctac

SEQ ID NO: 404635 - DNA, 15 bp, Homo sapiens
ggcaatggggctact

SEQ ID NO: 404636 - DNA, 15 bp, Homo sapiens
gcaatggggctactc

SEQ ID NO: 404637 - DNA, 15 bp, Homo sapiens
caatggggctactca

SEQ ID NO: 404638 - DNA, 15 bp, Homo sapiens
aatggggctactcaa

SEQ ID NO: 404639 - DNA, 15 bp, Homo sapiens
atggggctactcaag

SEQ ID NO: 404640 - DNA, 15 bp, Homo sapiens
tggggctactcaagg

SEQ ID NO: 404641 - DNA, 15 bp, Homo sapiens
ggggctactcaagga

SEQ ID NO: 404642 - DNA, 15 bp, Homo sapiens
gggctactcaaggag

SEQ ID NO: 404643 - DNA, 15 bp, Homo sapiens
ggctactcaaggagg

SEQ ID NO: 404644 - DNA, 15 bp, Homo sapiens
gctactcaaggaggc

SEQ ID NO: 404645 - DNA, 15 bp, Homo sapiens
ctactcaaggaggct

SEQ ID NO: 404646 - DNA, 15 bp, Homo sapiens
tactcaaggaggctg

SEQ ID NO: 404647 - DNA, 15 bp, Homo sapiens
actcaaggaggctga

SEQ ID NO: 404648 - DNA, 15 bp, Homo sapiens
ctcaaggaggctgag

SEQ ID NO: 404649 - DNA, 15 bp, Homo sapiens
tcaaggaggctgagg

SEQ ID NO: 404650 - DNA, 15 bp, Homo sapiens
caaggaggctgaggt

SEQ ID NO: 404651 - DNA, 15 bp, Homo sapiens
aaggaggctgaggtg

SEQ ID NO: 404652 - DNA, 15 bp, Homo sapiens
tgaggtgggaggatc

SEQ ID NO: 404653 - DNA, 15 bp, Homo sapiens
gaggatcgcttgagg

SEQ ID NO: 404654 - DNA, 15 bp, Homo sapiens
aggatcgcttgaggc

SEQ ID NO: 404655 - DNA, 15 bp, Homo sapiens
ggatcgcttgaggcc

SEQ ID NO: 404656 - DNA, 15 bp, Homo sapiens
gatcgcttgaggcca

SEQ ID NO: 404657 - DNA, 15 bp, Homo sapiens
atcgcttgaggccag

SEQ ID NO: 404658 - DNA, 15 bp, Homo sapiens
tcgcttgaggccagg

SEQ ID NO: 404659 - DNA, 15 bp, Homo sapiens
cgcttgaggccagga

SEQ ID NO: 404660 - DNA, 15 bp, Homo sapiens
gcttgaggccaggaa

SEQ ID NO: 404661 - DNA, 15 bp, Homo sapiens
cttgaggccaggaat

SEQ ID NO: 404662 - DNA, 15 bp, Homo sapiens
ttgaggccaggaatt

SEQ ID NO: 404663 - DNA, 15 bp, Homo sapiens
tgaggccaggaattc

SEQ ID NO: 404664 - DNA, 15 bp, Homo sapiens
gaggccaggaattca

SEQ ID NO: 404665 - DNA, 15 bp, Homo sapiens
aggccaggaattcaa

SEQ ID NO: 404666 - DNA, 15 bp, Homo sapiens
ggccaggaattcaag

SEQ ID NO: 404667 - DNA, 15 bp, Homo sapiens
gccaggaattcaaga

SEQ ID NO: 404668 - DNA, 15 bp, Homo sapiens
ccaggaattcaagac

SEQ ID NO: 404669 - DNA, 15 bp, Homo sapiens
aattcaagaccagca

SEQ ID NO: 404670 - DNA, 15 bp, Homo sapiens
attcaagaccagcat

SEQ ID NO: 404671 - DNA, 15 bp, Homo sapiens
ttcaagaccagcatg

SEQ ID NO: 404672 - DNA, 15 bp, Homo sapiens
tcaagaccagcatga

SEQ ID NO: 404673 - DNA, 15 bp, Homo sapiens
caagaccagcatgag

SEQ ID NO: 404674 - DNA, 15 bp, Homo sapiens
aagaccagcatgagc

SEQ ID NO: 404675 - DNA, 15 bp, Homo sapiens
agaccagcatgagca

SEQ ID NO: 404676 - DNA, 15 bp, Homo sapiens
gaccagcatgagcaa

SEQ ID NO: 404677 - DNA, 15 bp, Homo sapiens
accagcatgagcaac

SEQ ID NO: 404678 - DNA, 15 bp, Homo sapiens
ccagcatgagcaaca

SEQ ID NO: 404679 - DNA, 15 bp, Homo sapiens
cagcatgagcaacat

SEQ ID NO: 404680 - DNA, 15 bp, Homo sapiens
agcatgagcaacata

SEQ ID NO: 404681 - DNA, 15 bp, Homo sapiens
gcatgagcaacataa

SEQ ID NO: 404682 - DNA, 15 bp, Homo sapiens
catgagcaacataac

SEQ ID NO: 404683 - DNA, 15 bp, Homo sapiens
atgagcaacataacg

SEQ ID NO: 404684 - DNA, 15 bp, Homo sapiens
tgagcaacataacga

SEQ ID NO: 404685 - DNA, 15 bp, Homo sapiens
gagcaacataacgag

SEQ ID NO: 404686 - DNA, 15 bp, Homo sapiens
agcaacataacgaga

SEQ ID NO: 404687 - DNA, 15 bp, Homo sapiens
gcaacataacgagac

SEQ ID NO: 404688 - DNA, 15 bp, Homo sapiens
caacataacgagacc

SEQ ID NO: 404689 - DNA, 15 bp, Homo sapiens
aacataacgagaccc

SEQ ID NO: 404690 - DNA, 15 bp, Homo sapiens
acataacgagacccc

SEQ ID NO: 404691 - DNA, 15 bp, Homo sapiens
cataacgagaccccg

SEQ ID NO: 404692 - DNA, 15 bp, Homo sapiens
ataacgagaccccga

SEQ ID NO: 404693 - DNA, 15 bp, Homo sapiens
taacgagaccccgat

SEQ ID NO: 404694 - DNA, 15 bp, Homo sapiens
aacgagaccccgatc

SEQ ID NO: 404695 - DNA, 15 bp, Homo sapiens
acgagaccccgatct

SEQ ID NO: 404696 - DNA, 15 bp, Homo sapiens
cgagaccccgatctc

SEQ ID NO: 404697 - DNA, 15 bp, Homo sapiens
gagaccccgatctct

SEQ ID NO: 404698 - DNA, 15 bp, Homo sapiens
agaccccgatctcta

SEQ ID NO: 404699 - DNA, 15 bp, Homo sapiens
gaccccgatctctaa

SEQ ID NO: 404700 - DNA, 15 bp, Homo sapiens
accccgatctctaag

SEQ ID NO: 404701 - DNA, 15 bp, Homo sapiens
ccccgatctctaaga

SEQ ID NO: 404702 - DNA, 15 bp, Homo sapiens
cccgatctctaagaa

SEQ ID NO: 404703 - DNA, 15 bp, Homo sapiens
ccgatctctaagaaa

SEQ ID NO: 404704 - DNA, 15 bp, Homo sapiens
cgatctctaagaaat

SEQ ID NO: 404705 - DNA, 15 bp, Homo sapiens
gatctctaagaaatt

SEQ ID NO: 404706 - DNA, 15 bp, Homo sapiens
atctctaagaaattt

SEQ ID NO: 404707 - DNA, 15 bp, Homo sapiens
tctctaagaaatttt

SEQ ID NO: 404708 - DNA, 15 bp, Homo sapiens
ctctaagaaattttt

SEQ ID NO: 404709 - DNA, 15 bp, Homo sapiens
tctaagaaatttttt

SEQ ID NO: 404710 - DNA, 15 bp, Homo sapiens
ctaagaaatttttta

SEQ ID NO: 404711 - DNA, 15 bp, Homo sapiens
taagaaattttttaa

SEQ ID NO: 404712 - DNA, 15 bp, Homo sapiens
aagaaattttttaaa

SEQ ID NO: 404713 - DNA, 15 bp, Homo sapiens
agaaattttttaaaa

SEQ ID NO: 404714 - DNA, 15 bp, Homo sapiens
gaaattttttaaaaa

SEQ ID NO: 404715 - DNA, 15 bp, Homo sapiens
aaattttttaaaaaa

SEQ ID NO: 404716 - DNA, 15 bp, Homo sapiens
aattttttaaaaaaa

SEQ ID NO: 404717 - DNA, 15 bp, Homo sapiens
attttttaaaaaaag

SEQ ID NO: 404718 - DNA, 15 bp, Homo sapiens
tttaaaaaaagttag

SEQ ID NO: 404719 - DNA, 15 bp, Homo sapiens
ttaaaaaaagttagt

SEQ ID NO: 404720 - DNA, 15 bp, Homo sapiens
taaaaaaagttagtc

SEQ ID NO: 404721 - DNA, 15 bp, Homo sapiens
aaaaaaagttagtca

SEQ ID NO: 404722 - DNA, 15 bp, Homo sapiens
aaaaaagttagtcag

SEQ ID NO: 404723 - DNA, 15 bp, Homo sapiens
aaaaagttagtcagg

SEQ ID NO: 404724 - DNA, 15 bp, Homo sapiens
aaaagttagtcagga

SEQ ID NO: 404725 - DNA, 15 bp, Homo sapiens
aaagttagtcaggaa

SEQ ID NO: 404726 - DNA, 15 bp, Homo sapiens
aagttagtcaggaat

SEQ ID NO: 404727 - DNA, 15 bp, Homo sapiens
agttagtcaggaatg

SEQ ID NO: 404728 - DNA, 15 bp, Homo sapiens
gttagtcaggaatgg

SEQ ID NO: 404729 - DNA, 15 bp, Homo sapiens
ttagtcaggaatggc

SEQ ID NO: 404730 - DNA, 15 bp, Homo sapiens
tagtcaggaatggct

SEQ ID NO: 404731 - DNA, 15 bp, Homo sapiens
agtcaggaatggctc

SEQ ID NO: 404732 - DNA, 15 bp, Homo sapiens
gtcaggaatggctca

SEQ ID NO: 404733 - DNA, 15 bp, Homo sapiens
tcaggaatggctcat

SEQ ID NO: 404734 - DNA, 15 bp, Homo sapiens
caggaatggctcatg

SEQ ID NO: 404735 - DNA, 15 bp, Homo sapiens
aggaatggctcatgc

SEQ ID NO: 404736 - DNA, 15 bp, Homo sapiens
ggaatggctcatgcc

SEQ ID NO: 404737 - DNA, 15 bp, Homo sapiens
gaatggctcatgcct

SEQ ID NO: 404738 - DNA, 15 bp, Homo sapiens
aatggctcatgcctg

SEQ ID NO: 404739 - DNA, 15 bp, Homo sapiens
tcatgcctgtagtcc

SEQ ID NO: 404740 - DNA, 15 bp, Homo sapiens
catgcctgtagtcct

SEQ ID NO: 404741 - DNA, 15 bp, Homo sapiens
atgcctgtagtccta

SEQ ID NO: 404742 - DNA, 15 bp, Homo sapiens
cctagctacctgggt

SEQ ID NO: 404743 - DNA, 15 bp, Homo sapiens
ctagctacctgggtg

SEQ ID NO: 404744 - DNA, 15 bp, Homo sapiens
tagctacctgggtgg

SEQ ID NO: 404745 - DNA, 15 bp, Homo sapiens
agctacctgggtggc

SEQ ID NO: 404746 - DNA, 15 bp, Homo sapiens
gctacctgggtggct

SEQ ID NO: 404747 - DNA, 15 bp, Homo sapiens
ctacctgggtggctg

SEQ ID NO: 404748 - DNA, 15 bp, Homo sapiens
tacctgggtggctga

SEQ ID NO: 404749 - DNA, 15 bp, Homo sapiens
acctgggtggctgag

SEQ ID NO: 404750 - DNA, 15 bp, Homo sapiens
cctgggtggctgagg

SEQ ID NO: 404751 - DNA, 15 bp, Homo sapiens
ctgggtggctgaggt

SEQ ID NO: 404752 - DNA, 15 bp, Homo sapiens
tgggtggctgaggtg

SEQ ID NO: 404753 - DNA, 15 bp, Homo sapiens
gggtggctgaggtgg

SEQ ID NO: 404754 - DNA, 15 bp, Homo sapiens
ggtggctgaggtggg

SEQ ID NO: 404755 - DNA, 15 bp, Homo sapiens
gtggctgaggtggga

SEQ ID NO: 404756 - DNA, 15 bp, Homo sapiens
tggctgaggtgggag

SEQ ID NO: 404757 - DNA, 15 bp, Homo sapiens
ggtgggaggattgcc

SEQ ID NO: 404758 - DNA, 15 bp, Homo sapiens
gtgggaggattgccc

SEQ ID NO: 404759 - DNA, 15 bp, Homo sapiens
tgggaggattgccca

SEQ ID NO: 404760 - DNA, 15 bp, Homo sapiens
gggaggattgcccag

SEQ ID NO: 404761 - DNA, 15 bp, Homo sapiens
ggaggattgcccagg

SEQ ID NO: 404762 - DNA, 15 bp, Homo sapiens
gaggattgcccagga

SEQ ID NO: 404763 - DNA, 15 bp, Homo sapiens
aggattgcccaggac

SEQ ID NO: 404764 - DNA, 15 bp, Homo sapiens
ggattgcccaggact

SEQ ID NO: 404765 - DNA, 15 bp, Homo sapiens
gattgcccaggactt

SEQ ID NO: 404766 - DNA, 15 bp, Homo sapiens
attgcccaggacttc

SEQ ID NO: 404767 - DNA, 15 bp, Homo sapiens
ttgcccaggacttca

SEQ ID NO: 404768 - DNA, 15 bp, Homo sapiens
tgcccaggacttcaa

SEQ ID NO: 404769 - DNA, 15 bp, Homo sapiens
gcccaggacttcaag

SEQ ID NO: 404770 - DNA, 15 bp, Homo sapiens
cccaggacttcaagg

SEQ ID NO: 404771 - DNA, 15 bp, Homo sapiens
ccaggacttcaaggc

SEQ ID NO: 404772 - DNA, 15 bp, Homo sapiens
caggacttcaaggct

SEQ ID NO: 404773 - DNA, 15 bp, Homo sapiens
aggacttcaaggctg

SEQ ID NO: 404774 - DNA, 15 bp, Homo sapiens
ggacttcaaggctgc

SEQ ID NO: 404775 - DNA, 15 bp, Homo sapiens
gacttcaaggctgca

SEQ ID NO: 404776 - DNA, 15 bp, Homo sapiens
acttcaaggctgcag

SEQ ID NO: 404777 - DNA, 15 bp, Homo sapiens
cttcaaggctgcagt

SEQ ID NO: 404778 - DNA, 15 bp, Homo sapiens
caaggctgcagtgaa

SEQ ID NO: 404779 - DNA, 15 bp, Homo sapiens
aaggctgcagtgaac

SEQ ID NO: 404780 - DNA, 15 bp, Homo sapiens
tgcagtgaactatga

SEQ ID NO: 404781 - DNA, 15 bp, Homo sapiens
gcagtgaactatgat

SEQ ID NO: 404782 - DNA, 15 bp, Homo sapiens
cagtgaactatgatc

SEQ ID NO: 404783 - DNA, 15 bp, Homo sapiens
agtgaactatgatct

SEQ ID NO: 404784 - DNA, 15 bp, Homo sapiens
gtgaactatgatctt

SEQ ID NO: 404785 - DNA, 15 bp, Homo sapiens
tgaactatgatcttg

SEQ ID NO: 404786 - DNA, 15 bp, Homo sapiens
gaactatgatcttgc

SEQ ID NO: 404787 - DNA, 15 bp, Homo sapiens
aactatgatcttgcc

SEQ ID NO: 404788 - DNA, 15 bp, Homo sapiens
actatgatcttgcca

SEQ ID NO: 404789 - DNA, 15 bp, Homo sapiens
ctatgatcttgccac

SEQ ID NO: 404790 - DNA, 15 bp, Homo sapiens
tatgatcttgccact

SEQ ID NO: 404791 - DNA, 15 bp, Homo sapiens
atgatcttgccactg

SEQ ID NO: 404792 - DNA, 15 bp, Homo sapiens
tgatcttgccactgc

SEQ ID NO: 404793 - DNA, 15 bp, Homo sapiens
gatcttgccactgca

SEQ ID NO: 404794 - DNA, 15 bp, Homo sapiens
atcttgccactgcac

SEQ ID NO: 404795 - DNA, 15 bp, Homo sapiens
tcttgccactgcact

SEQ ID NO: 404796 - DNA, 15 bp, Homo sapiens
cttgccactgcactc

SEQ ID NO: 404797 - DNA, 15 bp, Homo sapiens
ttgccactgcactcc

SEQ ID NO: 404798 - DNA, 15 bp, Homo sapiens
ctgcactccagccta

SEQ ID NO: 404799 - DNA, 15 bp, Homo sapiens
tgcactccagcctaa

SEQ ID NO: 404800 - DNA, 15 bp, Homo sapiens
gcactccagcctaag

SEQ ID NO: 404801 - DNA, 15 bp, Homo sapiens
cactccagcctaagg

SEQ ID NO: 404802 - DNA, 15 bp, Homo sapiens
actccagcctaaggg

SEQ ID NO: 404803 - DNA, 15 bp, Homo sapiens
ctccagcctaaggga

SEQ ID NO: 404804 - DNA, 15 bp, Homo sapiens
tccagcctaagggac

SEQ ID NO: 404805 - DNA, 15 bp, Homo sapiens
ccagcctaagggaca

SEQ ID NO: 404806 - DNA, 15 bp, Homo sapiens
cagcctaagggacag

SEQ ID NO: 404807 - DNA, 15 bp, Homo sapiens
agcctaagggacaga

SEQ ID NO: 404808 - DNA, 15 bp, Homo sapiens
gcctaagggacagaa

SEQ ID NO: 404809 - DNA, 15 bp, Homo sapiens
cctaagggacagaat

SEQ ID NO: 404810 - DNA, 15 bp, Homo sapiens
ctaagggacagaatg

SEQ ID NO: 404811 - DNA, 15 bp, Homo sapiens
taagggacagaatga

SEQ ID NO: 404812 - DNA, 15 bp, Homo sapiens
aagggacagaatgag

SEQ ID NO: 404813 - DNA, 15 bp, Homo sapiens
agggacagaatgaga

SEQ ID NO: 404814 - DNA, 15 bp, Homo sapiens
gggacagaatgagac

SEQ ID NO: 404815 - DNA, 15 bp, Homo sapiens
ggacagaatgagact

SEQ ID NO: 404816 - DNA, 15 bp, Homo sapiens
gacagaatgagactt

SEQ ID NO: 404817 - DNA, 15 bp, Homo sapiens
acagaatgagacttt

SEQ ID NO: 404818 - DNA, 15 bp, Homo sapiens
cagaatgagactttg

SEQ ID NO: 404819 - DNA, 15 bp, Homo sapiens
agaatgagactttgt

SEQ ID NO: 404820 - DNA, 15 bp, Homo sapiens
gaatgagactttgtt

SEQ ID NO: 404821 - DNA, 15 bp, Homo sapiens
aatgagactttgttt

SEQ ID NO: 404822 - DNA, 15 bp, Homo sapiens
atgagactttgtttc

SEQ ID NO: 404823 - DNA, 15 bp, Homo sapiens
tgagactttgtttct

SEQ ID NO: 404824 - DNA, 15 bp, Homo sapiens
gagactttgtttcta

SEQ ID NO: 404825 - DNA, 15 bp, Homo sapiens
agactttgtttctaa

SEQ ID NO: 404826 - DNA, 15 bp, Homo sapiens
gactttgtttctaaa

SEQ ID NO: 404827 - DNA, 15 bp, Homo sapiens
actttgtttctaaaa

SEQ ID NO: 404828 - DNA, 15 bp, Homo sapiens
ttgtttctaaaaaat

SEQ ID NO: 404829 - DNA, 15 bp, Homo sapiens
tgtttctaaaaaata

SEQ ID NO: 404830 - DNA, 15 bp, Homo sapiens
gtttctaaaaaataa

SEQ ID NO: 404831 - DNA, 15 bp, Homo sapiens
tttctaaaaaataaa

SEQ ID NO: 404832 - DNA, 15 bp, Homo sapiens
ttctaaaaaataaaa

SEQ ID NO: 404833 - DNA, 15 bp, Homo sapiens
tctaaaaaataaaat

SEQ ID NO: 404834 - DNA, 15 bp, Homo sapiens
ctaaaaaataaaata

SEQ ID NO: 404835 - DNA, 15 bp, Homo sapiens
taaaataaaataata

SEQ ID NO: 404836 - DNA, 15 bp, Homo sapiens
aaaataaaataataa

SEQ ID NO: 404837 - DNA, 15 bp, Homo sapiens
aaataaaataataaa

SEQ ID NO: 404838 - DNA, 15 bp, Homo sapiens
aataaaataataaaa

SEQ ID NO: 404839 - DNA, 15 bp, Homo sapiens
ataaaataataaaaa

SEQ ID NO: 404840 - DNA, 15 bp, Homo sapiens
taaaataataaaaat

SEQ ID NO: 404841 - DNA, 15 bp, Homo sapiens
aaaataataaaaata

SEQ ID NO: 404842 - DNA, 15 bp, Homo sapiens
aaataataaaaataa

SEQ ID NO: 404843 - DNA, 15 bp, Homo sapiens
aataataaaaataaa

SEQ ID NO: 404844 - DNA, 15 bp, Homo sapiens
ataataaaaataaaa

SEQ ID NO: 404845 - DNA, 15 bp, Homo sapiens
taataaaaataaaag

SEQ ID NO: 404846 - DNA, 15 bp, Homo sapiens
aataaaaataaaaga

SEQ ID NO: 404847 - DNA, 15 bp, Homo sapiens
ataaaaataaaagaa

SEQ ID NO: 404848 - DNA, 15 bp, Homo sapiens
taaaaataaaagaaa

SEQ ID NO: 404849 - DNA, 15 bp, Homo sapiens
aaaataaaagaaaag

SEQ ID NO: 404850 - DNA, 15 bp, Homo sapiens
aaataaaagaaaagg

SEQ ID NO: 404851 - DNA, 15 bp, Homo sapiens
aataaaagaaaagga

SEQ ID NO: 404852 - DNA, 15 bp, Homo sapiens
ataaaagaaaaggaa

SEQ ID NO: 404853 - DNA, 15 bp, Homo sapiens
taaaagaaaaggaag

SEQ ID NO: 404854 - DNA, 15 bp, Homo sapiens
aaaagaaaaggaagg

SEQ ID NO: 404855 - DNA, 15 bp, Homo sapiens
aaagaaaaggaaggc

SEQ ID NO: 404856 - DNA, 15 bp, Homo sapiens
aagaaaaggaaggca

SEQ ID NO: 404857 - DNA, 15 bp, Homo sapiens
agaaaaggaaggcaa

SEQ ID NO: 404858 - DNA, 15 bp, Homo sapiens
gaaaaggaaggcaat

SEQ ID NO: 404859 - DNA, 15 bp, Homo sapiens
aaaaggaaggcaatg

SEQ ID NO: 404860 - DNA, 15 bp, Homo sapiens
aaaggaaggcaatga

SEQ ID NO: 404861 - DNA, 15 bp, Homo sapiens
aaggaaggcaatgat

SEQ ID NO: 404862 - DNA, 15 bp, Homo sapiens
aggaaggcaatgatg

SEQ ID NO: 404863 - DNA, 15 bp, Homo sapiens
ggaaggcaatgatgt

SEQ ID NO: 404864 - DNA, 15 bp, Homo sapiens
gaaggcaatgatgtt

SEQ ID NO: 404865 - DNA, 15 bp, Homo sapiens
aaggcaatgatgttc

SEQ ID NO: 404866 - DNA, 15 bp, Homo sapiens
aggcaatgatgttct

SEQ ID NO: 404867 - DNA, 15 bp, Homo sapiens
ggcaatgatgttctg

SEQ ID NO: 404868 - DNA, 15 bp, Homo sapiens
gcaatgatgttctgc

SEQ ID NO: 404869 - DNA, 15 bp, Homo sapiens
caatgatgttctgca

SEQ ID NO: 404870 - DNA, 15 bp, Homo sapiens
aatgatgttctgcat

SEQ ID NO: 404871 - DNA, 15 bp, Homo sapiens
atgatgttctgcatc

SEQ ID NO: 404872 - DNA, 15 bp, Homo sapiens
tgatgttctgcatca

SEQ ID NO: 404873 - DNA, 15 bp, Homo sapiens
gatgttctgcatcag

SEQ ID NO: 404874 - DNA, 15 bp, Homo sapiens
atgttctgcatcagt

SEQ ID NO: 404875 - DNA, 15 bp, Homo sapiens
tgttctgcatcagtg

SEQ ID NO: 404876 - DNA, 15 bp, Homo sapiens
gttctgcatcagtga

SEQ ID NO: 404877 - DNA, 15 bp, Homo sapiens
ttctgcatcagtgac

SEQ ID NO: 404878 - DNA, 15 bp, Homo sapiens
tctgcatcagtgaca

SEQ ID NO: 404879 - DNA, 15 bp, Homo sapiens
ctgcatcagtgacaa

SEQ ID NO: 404880 - DNA, 15 bp, Homo sapiens
tgcatcagtgacaac

SEQ ID NO: 404881 - DNA, 15 bp, Homo sapiens
catcagtgacaacag

SEQ ID NO: 404882 - DNA, 15 bp, Homo sapiens
atcagtgacaacagc

SEQ ID NO: 404883 - DNA, 15 bp, Homo sapiens
tcagtgacaacagca

SEQ ID NO: 404884 - DNA, 15 bp, Homo sapiens
cagtgacaacagcat

SEQ ID NO: 404885 - DNA, 15 bp, Homo sapiens
agtgacaacagcatg

SEQ ID NO: 404886 - DNA, 15 bp, Homo sapiens
gtgacaacagcatgg

SEQ ID NO: 404887 - DNA, 15 bp, Homo sapiens
tgacaacagcatggg

SEQ ID NO: 404888 - DNA, 15 bp, Homo sapiens
gacaacagcatgggc

SEQ ID NO: 404889 - DNA, 15 bp, Homo sapiens
acaacagcatgggca

SEQ ID NO: 404890 - DNA, 15 bp, Homo sapiens
caacagcatgggcat

SEQ ID NO: 404891 - DNA, 15 bp, Homo sapiens
aacagcatgggcatt

SEQ ID NO: 404892 - DNA, 15 bp, Homo sapiens
acagcatgggcattg

SEQ ID NO: 404893 - DNA, 15 bp, Homo sapiens
cagcatgggcattgc

SEQ ID NO: 404894 - DNA, 15 bp, Homo sapiens
agcatgggcattgcc

SEQ ID NO: 404895 - DNA, 15 bp, Homo sapiens
gcatgggcattgcca

SEQ ID NO: 404896 - DNA, 15 bp, Homo sapiens
catgggcattgccaa

SEQ ID NO: 404897 - DNA, 15 bp, Homo sapiens
atgggcattgccaag

SEQ ID NO: 404898 - DNA, 15 bp, Homo sapiens
tgggcattgccaaga

SEQ ID NO: 404899 - DNA, 15 bp, Homo sapiens
gggcattgccaagat

SEQ ID NO: 404900 - DNA, 15 bp, Homo sapiens
ggcattgccaagatc

SEQ ID NO: 404901 - DNA, 15 bp, Homo sapiens
gcattgccaagatct

SEQ ID NO: 404902 - DNA, 15 bp, Homo sapiens
cattgccaagatctt

SEQ ID NO: 404903 - DNA, 15 bp, Homo sapiens
attgccaagatcttt

SEQ ID NO: 404904 - DNA, 15 bp, Homo sapiens
ttgccaagatctttg

SEQ ID NO: 404905 - DNA, 15 bp, Homo sapiens
tgccaagatctttga

SEQ ID NO: 404906 - DNA, 15 bp, Homo sapiens
gccaagatctttgat

SEQ ID NO: 404907 - DNA, 15 bp, Homo sapiens
ccaagatctttgatg

SEQ ID NO: 404908 - DNA, 15 bp, Homo sapiens
caagatctttgatga

SEQ ID NO: 404909 - DNA, 15 bp, Homo sapiens
aagatctttgatgac

SEQ ID NO: 404910 - DNA, 15 bp, Homo sapiens
agatctttgatgacc

SEQ ID NO: 404911 - DNA, 15 bp, Homo sapiens
gatctttgatgacct

SEQ ID NO: 404912 - DNA, 15 bp, Homo sapiens
atctttgatgacctt

SEQ ID NO: 404913 - DNA, 15 bp, Homo sapiens
tctttgatgacctta

SEQ ID NO: 404914 - DNA, 15 bp, Homo sapiens
ctttgatgaccttac

SEQ ID NO: 404915 - DNA, 15 bp, Homo sapiens
tttgatgaccttact

SEQ ID NO: 404916 - DNA, 15 bp, Homo sapiens
ttgatgaccttactg

SEQ ID NO: 404917 - DNA, 15 bp, Homo sapiens
tgatgaccttactgc

SEQ ID NO: 404918 - DNA, 15 bp, Homo sapiens
gatgaccttactgct

SEQ ID NO: 404919 - DNA, 15 bp, Homo sapiens
atgaccttactgctt

SEQ ID NO: 404920 - DNA, 15 bp, Homo sapiens
tgaccttactgctta

SEQ ID NO: 404921 - DNA, 15 bp, Homo sapiens
gaccttactgcttac

SEQ ID NO: 404922 - DNA, 15 bp, Homo sapiens
accttactgcttacc

SEQ ID NO: 404923 - DNA, 15 bp, Homo sapiens
ccttactgcttacct

SEQ ID NO: 404924 - DNA, 15 bp, Homo sapiens
cttactgcttacctc

SEQ ID NO: 404925 - DNA, 15 bp, Homo sapiens
ttactgcttacctct

SEQ ID NO: 404926 - DNA, 15 bp, Homo sapiens
tactgcttacctctc

SEQ ID NO: 404927 - DNA, 15 bp, Homo sapiens
actgcttacctctcc

SEQ ID NO: 404928 - DNA, 15 bp, Homo sapiens
ctgcttacctctccc

SEQ ID NO: 404929 - DNA, 15 bp, Homo sapiens
tgcttacctctcccc

SEQ ID NO: 404930 - DNA, 15 bp, Homo sapiens
gcttacctctcccca

SEQ ID NO: 404931 - DNA, 15 bp, Homo sapiens
cttacctctccccag

SEQ ID NO: 404932 - DNA, 15 bp, Homo sapiens
ttacctctccccaga

SEQ ID NO: 404933 - DNA, 15 bp, Homo sapiens
tacctctccccagat

SEQ ID NO: 404934 - DNA, 15 bp, Homo sapiens
acctctccccagatt

SEQ ID NO: 404935 - DNA, 15 bp, Homo sapiens
cctctccccagattt

SEQ ID NO: 404936 - DNA, 15 bp, Homo sapiens
ctctccccagatttt

SEQ ID NO: 404937 - DNA, 15 bp, Homo sapiens
tctccccagatttta

SEQ ID NO: 404938 - DNA, 15 bp, Homo sapiens
ctccccagattttac

SEQ ID NO: 404939 - DNA, 15 bp, Homo sapiens
tccccagattttaca

SEQ ID NO: 404940 - DNA, 15 bp, Homo sapiens
ccccagattttacat

SEQ ID NO: 404941 - DNA, 15 bp, Homo sapiens
cccagattttacata

SEQ ID NO: 404942 - DNA, 15 bp, Homo sapiens
ccagattttacataa

SEQ ID NO: 404943 - DNA, 15 bp, Homo sapiens
cagattttacataat

SEQ ID NO: 404944 - DNA, 15 bp, Homo sapiens
agattttacataatt

SEQ ID NO: 404945 - DNA, 15 bp, Homo sapiens
gattttacataattt

SEQ ID NO: 404946 - DNA, 15 bp, Homo sapiens
attttacataatttt

SEQ ID NO: 404947 - DNA, 15 bp, Homo sapiens
ttttacataatttta

SEQ ID NO: 404948 - DNA, 15 bp, Homo sapiens
tttacataattttat

SEQ ID NO: 404949 - DNA, 15 bp, Homo sapiens
ttacataattttatc

SEQ ID NO: 404950 - DNA, 15 bp, Homo sapiens
tacataattttatct

SEQ ID NO: 404951 - DNA, 15 bp, Homo sapiens
acataattttatctt

SEQ ID NO: 404952 - DNA, 15 bp, Homo sapiens
cataattttatcttc

SEQ ID NO: 404953 - DNA, 15 bp, Homo sapiens
ataattttatcttcc

SEQ ID NO: 404954 - DNA, 15 bp, Homo sapiens
taattttatcttcct

SEQ ID NO: 404955 - DNA, 15 bp, Homo sapiens
aattttatcttcctg

SEQ ID NO: 404956 - DNA, 15 bp, Homo sapiens
attttatcttcctgt

SEQ ID NO: 404957 - DNA, 15 bp, Homo sapiens
ttttatcttcctgtc

SEQ ID NO: 404958 - DNA, 15 bp, Homo sapiens
tttatcttcctgtcc

SEQ ID NO: 404959 - DNA, 15 bp, Homo sapiens
ttatcttcctgtccc

SEQ ID NO: 404960 - DNA, 15 bp, Homo sapiens
tatcttcctgtccca

SEQ ID NO: 404961 - DNA, 15 bp, Homo sapiens
atcttcctgtcccat

SEQ ID NO: 404962 - DNA, 15 bp, Homo sapiens
tcttcctgtcccatt

SEQ ID NO: 404963 - DNA, 15 bp, Homo sapiens
cttcctgtcccattg

SEQ ID NO: 404964 - DNA, 15 bp, Homo sapiens
ttcctgtcccattgt

SEQ ID NO: 404965 - DNA, 15 bp, Homo sapiens
tcctgtcccattgta

SEQ ID NO: 404966 - DNA, 15 bp, Homo sapiens
cctgtcccattgtac

SEQ ID NO: 404967 - DNA, 15 bp, Homo sapiens
ctgtcccattgtaca

SEQ ID NO: 404968 - DNA, 15 bp, Homo sapiens
tgtcccattgtacac

SEQ ID NO: 404969 - DNA, 15 bp, Homo sapiens
gtcccattgtacact

SEQ ID NO: 404970 - DNA, 15 bp, Homo sapiens
tcccattgtacactg

SEQ ID NO: 404971 - DNA, 15 bp, Homo sapiens
cccattgtacactga

SEQ ID NO: 404972 - DNA, 15 bp, Homo sapiens
ccattgtacactgac

SEQ ID NO: 404973 - DNA, 15 bp, Homo sapiens
cattgtacactgaca

SEQ ID NO: 404974 - DNA, 15 bp, Homo sapiens
attgtacactgacaa

SEQ ID NO: 404975 - DNA, 15 bp, Homo sapiens
ttgtacactgacaat

SEQ ID NO: 404976 - DNA, 15 bp, Homo sapiens
tgtacactgacaata

SEQ ID NO: 404977 - DNA, 15 bp, Homo sapiens
gtacactgacaatac

SEQ ID NO: 404978 - DNA, 15 bp, Homo sapiens
tacactgacaatact

SEQ ID NO: 404979 - DNA, 15 bp, Homo sapiens
acactgacaatactc

SEQ ID NO: 404980 - DNA, 15 bp, Homo sapiens
cactgacaatactct

SEQ ID NO: 404981 - DNA, 15 bp, Homo sapiens
actgacaatactctc

SEQ ID NO: 404982 - DNA, 15 bp, Homo sapiens
ctgacaatactctcc

SEQ ID NO: 404983 - DNA, 15 bp, Homo sapiens
tgacaatactctcct

SEQ ID NO: 404984 - DNA, 15 bp, Homo sapiens
gacaatactctcctt

SEQ ID NO: 404985 - DNA, 15 bp, Homo sapiens
acaatactctccttc

SEQ ID NO: 404986 - DNA, 15 bp, Homo sapiens
caatactctccttca

SEQ ID NO: 404987 - DNA, 15 bp, Homo sapiens
aatactctccttcaa

SEQ ID NO: 404988 - DNA, 15 bp, Homo sapiens
atactctccttcaag

SEQ ID NO: 404989 - DNA, 15 bp, Homo sapiens
tactctccttcaagt

SEQ ID NO: 404990 - DNA, 15 bp, Homo sapiens
actctccttcaagtg

SEQ ID NO: 404991 - DNA, 15 bp, Homo sapiens
ctctccttcaagtgt

SEQ ID NO: 404992 - DNA, 15 bp, Homo sapiens
tctccttcaagtgtc

SEQ ID NO: 404993 - DNA, 15 bp, Homo sapiens
ctccttcaagtgtcc

SEQ ID NO: 404994 - DNA, 15 bp, Homo sapiens
tccttcaagtgtcct

SEQ ID NO: 404995 - DNA, 15 bp, Homo sapiens
ccttcaagtgtcctc

SEQ ID NO: 404996 - DNA, 15 bp, Homo sapiens
cttcaagtgtcctca

SEQ ID NO: 404997 - DNA, 15 bp, Homo sapiens
ttcaagtgtcctcac

SEQ ID NO: 404998 - DNA, 15 bp, Homo sapiens
tcaagtgtcctcacc

SEQ ID NO: 404999 - DNA, 15 bp, Homo sapiens
caagtgtcctcacct

SEQ ID NO: 405000 - DNA, 15 bp, Homo sapiens
aagtgtcctcacctc

SEQ ID NO: 405001 - DNA, 15 bp, Homo sapiens
agtgtcctcacctct

SEQ ID NO: 405002 - DNA, 15 bp, Homo sapiens
gtgtcctcacctctt

SEQ ID NO: 405003 - DNA, 15 bp, Homo sapiens
tgtcctcacctcttg

SEQ ID NO: 405004 - DNA, 15 bp, Homo sapiens
gtcctcacctcttga

SEQ ID NO: 405005 - DNA, 15 bp, Homo sapiens
tcctcacctcttgat

SEQ ID NO: 405006 - DNA, 15 bp, Homo sapiens
cctcacctcttgatt

SEQ ID NO: 405007 - DNA, 15 bp, Homo sapiens
ctcacctcttgattt

SEQ ID NO: 405008 - DNA, 15 bp, Homo sapiens
tcacctcttgatttg

SEQ ID NO: 405009 - DNA, 15 bp, Homo sapiens
cacctcttgatttgt

SEQ ID NO: 405010 - DNA, 15 bp, Homo sapiens
acctcttgatttgtc

SEQ ID NO: 405011 - DNA, 15 bp, Homo sapiens
cctcttgatttgtca

SEQ ID NO: 405012 - DNA, 15 bp, Homo sapiens
ctcttgatttgtcat

SEQ ID NO: 405013 - DNA, 15 bp, Homo sapiens
tcttgatttgtcata

SEQ ID NO: 405014 - DNA, 15 bp, Homo sapiens
cttgatttgtcatat

SEQ ID NO: 405015 - DNA, 15 bp, Homo sapiens
ttgatttgtcatata

SEQ ID NO: 405016 - DNA, 15 bp, Homo sapiens
tgatttgtcatatac

SEQ ID NO: 405017 - DNA, 15 bp, Homo sapiens
gatttgtcatatact

SEQ ID NO: 405018 - DNA, 15 bp, Homo sapiens
atttgtcatatactc

SEQ ID NO: 405019 - DNA, 15 bp, Homo sapiens
tttgtcatatactct

SEQ ID NO: 405020 - DNA, 15 bp, Homo sapiens
ttgtcatatactctt

SEQ ID NO: 405021 - DNA, 15 bp, Homo sapiens
tgtcatatactctta

SEQ ID NO: 405022 - DNA, 15 bp, Homo sapiens
gtcatatactcttaa

SEQ ID NO: 405023 - DNA, 15 bp, Homo sapiens
tcatatactcttaat

SEQ ID NO: 405024 - DNA, 15 bp, Homo sapiens
catatactcttaatt

SEQ ID NO: 405025 - DNA, 15 bp, Homo sapiens
atatactcttaattt

SEQ ID NO: 405026 - DNA, 15 bp, Homo sapiens
tatactcttaatttt

SEQ ID NO: 405027 - DNA, 15 bp, Homo sapiens
atactcttaatttta

SEQ ID NO: 405028 - DNA, 15 bp, Homo sapiens
tactcttaattttat

SEQ ID NO: 405029 - DNA, 15 bp, Homo sapiens
actcttaattttatt

SEQ ID NO: 405030 - DNA, 15 bp, Homo sapiens
ctcttaattttattg

SEQ ID NO: 405031 - DNA, 15 bp, Homo sapiens
tcttaattttattgc

SEQ ID NO: 405032 - DNA, 15 bp, Homo sapiens
cttaattttattgct

SEQ ID NO: 405033 - DNA, 15 bp, Homo sapiens
ttaattttattgcta

SEQ ID NO: 405034 - DNA, 15 bp, Homo sapiens
taattttattgctac

SEQ ID NO: 405035 - DNA, 15 bp, Homo sapiens
aattttattgctaca

SEQ ID NO: 405036 - DNA, 15 bp, Homo sapiens
attttattgctacat

SEQ ID NO: 405037 - DNA, 15 bp, Homo sapiens
ttttattgctacatt

SEQ ID NO: 405038 - DNA, 15 bp, Homo sapiens
tttattgctacattt

SEQ ID NO: 405039 - DNA, 15 bp, Homo sapiens
ttattgctacatttg

SEQ ID NO: 405040 - DNA, 15 bp, Homo sapiens
tattgctacatttgg

SEQ ID NO: 405041 - DNA, 15 bp, Homo sapiens
attgctacatttggc

SEQ ID NO: 405042 - DNA, 15 bp, Homo sapiens
ttgctacatttggcc

SEQ ID NO: 405043 - DNA, 15 bp, Homo sapiens
tgctacatttggcca

SEQ ID NO: 405044 - DNA, 15 bp, Homo sapiens
gctacatttggccat

SEQ ID NO: 405045 - DNA, 15 bp, Homo sapiens
ctacatttggccatt

SEQ ID NO: 405046 - DNA, 15 bp, Homo sapiens
tacatttggccattt

SEQ ID NO: 405047 - DNA, 15 bp, Homo sapiens
acatttggccatttt

SEQ ID NO: 405048 - DNA, 15 bp, Homo sapiens
catttggccattttt

SEQ ID NO: 405049 - DNA, 15 bp, Homo sapiens
atttggccatttttt

SEQ ID NO: 405050 - DNA, 15 bp, Homo sapiens
tttggccattttttt

SEQ ID NO: 405051 - DNA, 15 bp, Homo sapiens
ttggccatttttttc

SEQ ID NO: 405052 - DNA, 15 bp, Homo sapiens
tggccatttttttca

SEQ ID NO: 405053 - DNA, 15 bp, Homo sapiens
ggccatttttttcac

SEQ ID NO: 405054 - DNA, 15 bp, Homo sapiens
gccatttttttcact

SEQ ID NO: 405055 - DNA, 15 bp, Homo sapiens
ccatttttttcactt

SEQ ID NO: 405056 - DNA, 15 bp, Homo sapiens
catttttttcacttt

SEQ ID NO: 405057 - DNA, 15 bp, Homo sapiens
atttttttcactttt

SEQ ID NO: 405058 - DNA, 15 bp, Homo sapiens
tttttttcacttttt

SEQ ID NO: 405059 - DNA, 15 bp, Homo sapiens
ttttttcactttttt

SEQ ID NO: 405060 - DNA, 15 bp, Homo sapiens
tttttcacttttttt

SEQ ID NO: 405061 - DNA, 15 bp, Homo sapiens
ttttcactttttttc

SEQ ID NO: 405062 - DNA, 15 bp, Homo sapiens
tttcactttttttct

SEQ ID NO: 405063 - DNA, 15 bp, Homo sapiens
ttcactttttttctt

SEQ ID NO: 405064 - DNA, 15 bp, Homo sapiens
tcactttttttcttt

SEQ ID NO: 405065 - DNA, 15 bp, Homo sapiens
cactttttttctttg

SEQ ID NO: 405066 - DNA, 15 bp, Homo sapiens
actttttttctttgt

SEQ ID NO: 405067 - DNA, 15 bp, Homo sapiens
ctttttttctttgtt

SEQ ID NO: 405068 - DNA, 15 bp, Homo sapiens
ttttttctttgttca

SEQ ID NO: 405069 - DNA, 15 bp, Homo sapiens
tttttctttgttcac

SEQ ID NO: 405070 - DNA, 15 bp, Homo sapiens
ttttctttgttcact

SEQ ID NO: 405071 - DNA, 15 bp, Homo sapiens
tttctttgttcactt

SEQ ID NO: 405072 - DNA, 15 bp, Homo sapiens
ttctttgttcacttt

SEQ ID NO: 405073 - DNA, 15 bp, Homo sapiens
tctttgttcactttc

SEQ ID NO: 405074 - DNA, 15 bp, Homo sapiens
ctttgttcactttcc

SEQ ID NO: 405075 - DNA, 15 bp, Homo sapiens
tttgttcactttcct

SEQ ID NO: 405076 - DNA, 15 bp, Homo sapiens
ttgttcactttcctt

SEQ ID NO: 405077 - DNA, 15 bp, Homo sapiens
tgttcactttccttt

SEQ ID NO: 405078 - DNA, 15 bp, Homo sapiens
gttcactttcctttg

SEQ ID NO: 405079 - DNA, 15 bp, Homo sapiens
ttcactttcctttgc

SEQ ID NO: 405080 - DNA, 15 bp, Homo sapiens
tcactttcctttgct

SEQ ID NO: 405081 - DNA, 15 bp, Homo sapiens
cactttcctttgctc

SEQ ID NO: 405082 - DNA, 15 bp, Homo sapiens
actttcctttgctcc

SEQ ID NO: 405083 - DNA, 15 bp, Homo sapiens
ctttcctttgctcca

SEQ ID NO: 405084 - DNA, 15 bp, Homo sapiens
tttcctttgctccat

SEQ ID NO: 405085 - DNA, 15 bp, Homo sapiens
ttcctttgctccata

SEQ ID NO: 405086 - DNA, 15 bp, Homo sapiens
tcctttgctccatac

SEQ ID NO: 405087 - DNA, 15 bp, Homo sapiens
cctttgctccatact

SEQ ID NO: 405088 - DNA, 15 bp, Homo sapiens
ctttgctccatactt

SEQ ID NO: 405089 - DNA, 15 bp, Homo sapiens
tttgctccatactta

SEQ ID NO: 405090 - DNA, 15 bp, Homo sapiens
ttgctccatacttaa

SEQ ID NO: 405091 - DNA, 15 bp, Homo sapiens
tgctccatacttaac

SEQ ID NO: 405092 - DNA, 15 bp, Homo sapiens
gctccatacttaact

SEQ ID NO: 405093 - DNA, 15 bp, Homo sapiens
ctccatacttaacta

SEQ ID NO: 405094 - DNA, 15 bp, Homo sapiens
tccatacttaactaa

SEQ ID NO: 405095 - DNA, 15 bp, Homo sapiens
ccatacttaactaat

SEQ ID NO: 405096 - DNA, 15 bp, Homo sapiens
catacttaactaatt

SEQ ID NO: 405097 - DNA, 15 bp, Homo sapiens
atacttaactaattt

SEQ ID NO: 405098 - DNA, 15 bp, Homo sapiens
tacttaactaatttt

SEQ ID NO: 405099 - DNA, 15 bp, Homo sapiens
acttaactaattttc

SEQ ID NO: 405100 - DNA, 15 bp, Homo sapiens
cttaactaattttcc

SEQ ID NO: 405101 - DNA, 15 bp, Homo sapiens
ttaactaattttcca

SEQ ID NO: 405102 - DNA, 15 bp, Homo sapiens
taactaattttccag

SEQ ID NO: 405103 - DNA, 15 bp, Homo sapiens
aactaattttccaga

SEQ ID NO: 405104 - DNA, 15 bp, Homo sapiens
actaattttccagat

SEQ ID NO: 405105 - DNA, 15 bp, Homo sapiens
ctaattttccagatt

SEQ ID NO: 405106 - DNA, 15 bp, Homo sapiens
taattttccagattt

SEQ ID NO: 405107 - DNA, 15 bp, Homo sapiens
aattttccagatttc

SEQ ID NO: 405108 - DNA, 15 bp, Homo sapiens
attttccagatttct

SEQ ID NO: 405109 - DNA, 15 bp, Homo sapiens
ttttccagatttctg

SEQ ID NO: 405110 - DNA, 15 bp, Homo sapiens
tttccagatttctgt

SEQ ID NO: 405111 - DNA, 15 bp, Homo sapiens
ttccagatttctgtc

SEQ ID NO: 405112 - DNA, 15 bp, Homo sapiens
tccagatttctgtcc

SEQ ID NO: 405113 - DNA, 15 bp, Homo sapiens
ccagatttctgtcct

SEQ ID NO: 405114 - DNA, 15 bp, Homo sapiens
cagatttctgtcctt

SEQ ID NO: 405115 - DNA, 15 bp, Homo sapiens
agatttctgtcctta

SEQ ID NO: 405116 - DNA, 15 bp, Homo sapiens
gatttctgtccttaa

SEQ ID NO: 405117 - DNA, 15 bp, Homo sapiens
atttctgtccttaaa

SEQ ID NO: 405118 - DNA, 15 bp, Homo sapiens
tttctgtccttaaat

SEQ ID NO: 405119 - DNA, 15 bp, Homo sapiens
ttctgtccttaaatc

SEQ ID NO: 405120 - DNA, 15 bp, Homo sapiens
tctgtccttaaatct

SEQ ID NO: 405121 - DNA, 15 bp, Homo sapiens
ctgtccttaaatctc

SEQ ID NO: 405122 - DNA, 15 bp, Homo sapiens
tgtccttaaatctct

SEQ ID NO: 405123 - DNA, 15 bp, Homo sapiens
gtccttaaatctctt

SEQ ID NO: 405124 - DNA, 15 bp, Homo sapiens
tccttaaatctcttt

SEQ ID NO: 405125 - DNA, 15 bp, Homo sapiens
ccttaaatctctttc

SEQ ID NO: 405126 - DNA, 15 bp, Homo sapiens
cttaaatctctttca

SEQ ID NO: 405127 - DNA, 15 bp, Homo sapiens
ttaaatctctttcat

SEQ ID NO: 405128 - DNA, 15 bp, Homo sapiens
taaatctctttcatt

SEQ ID NO: 405129 - DNA, 15 bp, Homo sapiens
aaatctctttcattt

SEQ ID NO: 405130 - DNA, 15 bp, Homo sapiens
aatctctttcatttt

SEQ ID NO: 405131 - DNA, 15 bp, Homo sapiens
atctctttcattttc

SEQ ID NO: 405132 - DNA, 15 bp, Homo sapiens
tctctttcattttca

SEQ ID NO: 405133 - DNA, 15 bp, Homo sapiens
ctctttcattttcac

SEQ ID NO: 405134 - DNA, 15 bp, Homo sapiens
tctttcattttcact

SEQ ID NO: 405135 - DNA, 15 bp, Homo sapiens
ctttcattttcactg

SEQ ID NO: 405136 - DNA, 15 bp, Homo sapiens
tttcattttcactgg

SEQ ID NO: 405137 - DNA, 15 bp, Homo sapiens
ttcattttcactgga

SEQ ID NO: 405138 - DNA, 15 bp, Homo sapiens
tcattttcactggat

SEQ ID NO: 405139 - DNA, 15 bp, Homo sapiens
cattttcactggata

SEQ ID NO: 405140 - DNA, 15 bp, Homo sapiens
attttcactggatat

SEQ ID NO: 405141 - DNA, 15 bp, Homo sapiens
ttttcactggatata

SEQ ID NO: 405142 - DNA, 15 bp, Homo sapiens
tttcactggatatac

SEQ ID NO: 405143 - DNA, 15 bp, Homo sapiens
ttcactggatatact

SEQ ID NO: 405144 - DNA, 15 bp, Homo sapiens
tcactggatatactc

SEQ ID NO: 405145 - DNA, 15 bp, Homo sapiens
cactggatatactct

SEQ ID NO: 405146 - DNA, 15 bp, Homo sapiens
actggatatactctt

SEQ ID NO: 405147 - DNA, 15 bp, Homo sapiens
ctggatatactcttc

SEQ ID NO: 405148 - DNA, 15 bp, Homo sapiens
tggatatactcttcc

SEQ ID NO: 405149 - DNA, 15 bp, Homo sapiens
ggatatactcttccc

SEQ ID NO: 405150 - DNA, 15 bp, Homo sapiens
gatatactcttccca

SEQ ID NO: 405151 - DNA, 15 bp, Homo sapiens
atatactcttcccag

SEQ ID NO: 405152 - DNA, 15 bp, Homo sapiens
tatactcttcccagg

SEQ ID NO: 405153 - DNA, 15 bp, Homo sapiens
atactcttcccaggc

SEQ ID NO: 405154 - DNA, 15 bp, Homo sapiens
tactcttcccaggct

SEQ ID NO: 405155 - DNA, 15 bp, Homo sapiens
actcttcccaggctt

SEQ ID NO: 405156 - DNA, 15 bp, Homo sapiens
ctcttcccaggcttc

SEQ ID NO: 405157 - DNA, 15 bp, Homo sapiens
tcttcccaggcttcc

SEQ ID NO: 405158 - DNA, 15 bp, Homo sapiens
cttcccaggcttccc

SEQ ID NO: 405159 - DNA, 15 bp, Homo sapiens
ttcccaggcttccca

SEQ ID NO: 405160 - DNA, 15 bp, Homo sapiens
tcccaggcttcccag

SEQ ID NO: 405161 - DNA, 15 bp, Homo sapiens
cccaggcttcccagg

SEQ ID NO: 405162 - DNA, 15 bp, Homo sapiens
ccaggcttcccaggc

SEQ ID NO: 405163 - DNA, 15 bp, Homo sapiens
caggcttcccaggct

SEQ ID NO: 405164 - DNA, 15 bp, Homo sapiens
aggcttcccaggctt

SEQ ID NO: 405165 - DNA, 15 bp, Homo sapiens
ggcttcccaggcttc

SEQ ID NO: 405166 - DNA, 15 bp, Homo sapiens
gcttcccaggcttct

SEQ ID NO: 405167 - DNA, 15 bp, Homo sapiens
cttcccaggcttctg

SEQ ID NO: 405168 - DNA, 15 bp, Homo sapiens
ttcccaggcttctgt

SEQ ID NO: 405169 - DNA, 15 bp, Homo sapiens
tcccaggcttctgta

SEQ ID NO: 405170 - DNA, 15 bp, Homo sapiens
cccaggcttctgtaa

SEQ ID NO: 405171 - DNA, 15 bp, Homo sapiens
ccaggcttctgtaac

SEQ ID NO: 405172 - DNA, 15 bp, Homo sapiens
caggcttctgtaaca

SEQ ID NO: 405173 - DNA, 15 bp, Homo sapiens
aggcttctgtaacaa

SEQ ID NO: 405174 - DNA, 15 bp, Homo sapiens
ggcttctgtaacaat

SEQ ID NO: 405175 - DNA, 15 bp, Homo sapiens
gcttctgtaacaatc

SEQ ID NO: 405176 - DNA, 15 bp, Homo sapiens
cttctgtaacaatct

SEQ ID NO: 405177 - DNA, 15 bp, Homo sapiens
ttctgtaacaatcta

SEQ ID NO: 405178 - DNA, 15 bp, Homo sapiens
tctgtaacaatctat

SEQ ID NO: 405179 - DNA, 15 bp, Homo sapiens
ctgtaacaatctatt

SEQ ID NO: 405180 - DNA, 15 bp, Homo sapiens
tgtaacaatctattt

SEQ ID NO: 405181 - DNA, 15 bp, Homo sapiens
gtaacaatctatttg

SEQ ID NO: 405182 - DNA, 15 bp, Homo sapiens
taacaatctatttgc

SEQ ID NO: 405183 - DNA, 15 bp, Homo sapiens
aacaatctatttgct

SEQ ID NO: 405184 - DNA, 15 bp, Homo sapiens
acaatctatttgctt

SEQ ID NO: 405185 - DNA, 15 bp, Homo sapiens
caatctatttgcttt

SEQ ID NO: 405186 - DNA, 15 bp, Homo sapiens
aatctatttgctttg

SEQ ID NO: 405187 - DNA, 15 bp, Homo sapiens
atctatttgctttgt

SEQ ID NO: 405188 - DNA, 15 bp, Homo sapiens
tctatttgctttgtc

SEQ ID NO: 405189 - DNA, 15 bp, Homo sapiens
ctatttgctttgtct

SEQ ID NO: 405190 - DNA, 15 bp, Homo sapiens
tatttgctttgtctc

SEQ ID NO: 405191 - DNA, 15 bp, Homo sapiens
atttgctttgtctcc

SEQ ID NO: 405192 - DNA, 15 bp, Homo sapiens
tttgctttgtctcca

SEQ ID NO: 405193 - DNA, 15 bp, Homo sapiens
ttgctttgtctccat

SEQ ID NO: 405194 - DNA, 15 bp, Homo sapiens
tgctttgtctccatc

SEQ ID NO: 405195 - DNA, 15 bp, Homo sapiens
gctttgtctccatcc

SEQ ID NO: 405196 - DNA, 15 bp, Homo sapiens
ctttgtctccatccc

SEQ ID NO: 405197 - DNA, 15 bp, Homo sapiens
tttgtctccatccca

SEQ ID NO: 405198 - DNA, 15 bp, Homo sapiens
ttgtctccatcccat

SEQ ID NO: 405199 - DNA, 15 bp, Homo sapiens
tgtctccatcccata

SEQ ID NO: 405200 - DNA, 15 bp, Homo sapiens
gtctccatcccataa

SEQ ID NO: 405201 - DNA, 15 bp, Homo sapiens
tctccatcccataac

SEQ ID NO: 405202 - DNA, 15 bp, Homo sapiens
ctccatcccataact

SEQ ID NO: 405203 - DNA, 15 bp, Homo sapiens
tccatcccataactc

SEQ ID NO: 405204 - DNA, 15 bp, Homo sapiens
ccatcccataactct

SEQ ID NO: 405205 - DNA, 15 bp, Homo sapiens
catcccataactctc

SEQ ID NO: 405206 - DNA, 15 bp, Homo sapiens
atcccataactctcc

SEQ ID NO: 405207 - DNA, 15 bp, Homo sapiens
tcccataactctccc

SEQ ID NO: 405208 - DNA, 15 bp, Homo sapiens
cccataactctccct

SEQ ID NO: 405209 - DNA, 15 bp, Homo sapiens
ccataactctccctg

SEQ ID NO: 405210 - DNA, 15 bp, Homo sapiens
cataactctccctga

SEQ ID NO: 405211 - DNA, 15 bp, Homo sapiens
ataactctccctgag

SEQ ID NO: 405212 - DNA, 15 bp, Homo sapiens
taactctccctgagc

SEQ ID NO: 405213 - DNA, 15 bp, Homo sapiens
aactctccctgagct

SEQ ID NO: 405214 - DNA, 15 bp, Homo sapiens
actctccctgagctc

SEQ ID NO: 405215 - DNA, 15 bp, Homo sapiens
ctctccctgagctct

SEQ ID NO: 405216 - DNA, 15 bp, Homo sapiens
tctccctgagctcta

SEQ ID NO: 405217 - DNA, 15 bp, Homo sapiens
ctccctgagctctaa

SEQ ID NO: 405218 - DNA, 15 bp, Homo sapiens
tccctgagctctaaa

SEQ ID NO: 405219 - DNA, 15 bp, Homo sapiens
ccctgagctctaaat

SEQ ID NO: 405220 - DNA, 15 bp, Homo sapiens
cctgagctctaaatt

SEQ ID NO: 405221 - DNA, 15 bp, Homo sapiens
ctgagctctaaatta

SEQ ID NO: 405222 - DNA, 15 bp, Homo sapiens
tgagctctaaattat

SEQ ID NO: 405223 - DNA, 15 bp, Homo sapiens
gagctctaaattatt

SEQ ID NO: 405224 - DNA, 15 bp, Homo sapiens
agctctaaattatta

SEQ ID NO: 405225 - DNA, 15 bp, Homo sapiens
gctctaaattattat

SEQ ID NO: 405226 - DNA, 15 bp, Homo sapiens
ctctaaattattata

SEQ ID NO: 405227 - DNA, 15 bp, Homo sapiens
tctaaattattatat

SEQ ID NO: 405228 - DNA, 15 bp, Homo sapiens
ctaaattattatatg

SEQ ID NO: 405229 - DNA, 15 bp, Homo sapiens
taaattattatatgc

SEQ ID NO: 405230 - DNA, 15 bp, Homo sapiens
aaattattatatgca

SEQ ID NO: 405231 - DNA, 15 bp, Homo sapiens
aattattatatgcaa

SEQ ID NO: 405232 - DNA, 15 bp, Homo sapiens
attattatatgcaac

SEQ ID NO: 405233 - DNA, 15 bp, Homo sapiens
ttattatatgcaact

SEQ ID NO: 405234 - DNA, 15 bp, Homo sapiens
tattatatgcaactg

SEQ ID NO: 405235 - DNA, 15 bp, Homo sapiens
attatatgcaactgc

SEQ ID NO: 405236 - DNA, 15 bp, Homo sapiens
ttatatgcaactgct

SEQ ID NO: 405237 - DNA, 15 bp, Homo sapiens
tatatgcaactgctc

SEQ ID NO: 405238 - DNA, 15 bp, Homo sapiens
atatgcaactgctca

SEQ ID NO: 405239 - DNA, 15 bp, Homo sapiens
tatgcaactgctcac

SEQ ID NO: 405240 - DNA, 15 bp, Homo sapiens
atgcaactgctcact

SEQ ID NO: 405241 - DNA, 15 bp, Homo sapiens
tgcaactgctcactg

SEQ ID NO: 405242 - DNA, 15 bp, Homo sapiens
gcaactgctcactgg

SEQ ID NO: 405243 - DNA, 15 bp, Homo sapiens
caactgctcactgga

SEQ ID NO: 405244 - DNA, 15 bp, Homo sapiens
aactgctcactggac

SEQ ID NO: 405245 - DNA, 15 bp, Homo sapiens
actgctcactggaca

SEQ ID NO: 405246 - DNA, 15 bp, Homo sapiens
ctgctcactggacat

SEQ ID NO: 405247 - DNA, 15 bp, Homo sapiens
tgctcactggacata

SEQ ID NO: 405248 - DNA, 15 bp, Homo sapiens
gctcactggacatac

SEQ ID NO: 405249 - DNA, 15 bp, Homo sapiens
ctcactggacataca

SEQ ID NO: 405250 - DNA, 15 bp, Homo sapiens
tcactggacatacaa

SEQ ID NO: 405251 - DNA, 15 bp, Homo sapiens
cactggacatacaag

SEQ ID NO: 405252 - DNA, 15 bp, Homo sapiens
actggacatacaagt

SEQ ID NO: 405253 - DNA, 15 bp, Homo sapiens
ctggacatacaagtt

SEQ ID NO: 405254 - DNA, 15 bp, Homo sapiens
tggacatacaagttc

SEQ ID NO: 405255 - DNA, 15 bp, Homo sapiens
ggacatacaagttcg

SEQ ID NO: 405256 - DNA, 15 bp, Homo sapiens
gacatacaagttcgt

SEQ ID NO: 405257 - DNA, 15 bp, Homo sapiens
acatacaagttcgtg

SEQ ID NO: 405258 - DNA, 15 bp, Homo sapiens
catacaagttcgtga

SEQ ID NO: 405259 - DNA, 15 bp, Homo sapiens
atacaagttcgtgat

SEQ ID NO: 405260 - DNA, 15 bp, Homo sapiens
tacaagttcgtgatt

SEQ ID NO: 405261 - DNA, 15 bp, Homo sapiens
acaagttcgtgattc

SEQ ID NO: 405262 - DNA, 15 bp, Homo sapiens
caagttcgtgattca

SEQ ID NO: 405263 - DNA, 15 bp, Homo sapiens
aagttcgtgattcaa

SEQ ID NO: 405264 - DNA, 15 bp, Homo sapiens
agttcgtgattcaac

SEQ ID NO: 405265 - DNA, 15 bp, Homo sapiens
gttcgtgattcaaca

SEQ ID NO: 405266 - DNA, 15 bp, Homo sapiens
ttcgtgattcaacag

SEQ ID NO: 405267 - DNA, 15 bp, Homo sapiens
tcgtgattcaacaga

SEQ ID NO: 405268 - DNA, 15 bp, Homo sapiens
cgtgattcaacagac

SEQ ID NO: 405269 - DNA, 15 bp, Homo sapiens
gtgattcaacagacc

SEQ ID NO: 405270 - DNA, 15 bp, Homo sapiens
tgattcaacagaccc

SEQ ID NO: 405271 - DNA, 15 bp, Homo sapiens
gattcaacagaccct

SEQ ID NO: 405272 - DNA, 15 bp, Homo sapiens
attcaacagaccctt

SEQ ID NO: 405273 - DNA, 15 bp, Homo sapiens
ttcaacagacccttt

SEQ ID NO: 405274 - DNA, 15 bp, Homo sapiens
tcaacagacccttta

SEQ ID NO: 405275 - DNA, 15 bp, Homo sapiens
caacagaccctttaa

SEQ ID NO: 405276 - DNA, 15 bp, Homo sapiens
aacagaccctttaaa

SEQ ID NO: 405277 - DNA, 15 bp, Homo sapiens
acagaccctttaaaa

SEQ ID NO: 405278 - DNA, 15 bp, Homo sapiens
cagaccctttaaaac

SEQ ID NO: 405279 - DNA, 15 bp, Homo sapiens
agaccctttaaaact

SEQ ID NO: 405280 - DNA, 15 bp, Homo sapiens
gaccctttaaaactc

SEQ ID NO: 405281 - DNA, 15 bp, Homo sapiens
accctttaaaactca

SEQ ID NO: 405282 - DNA, 15 bp, Homo sapiens
ccctttaaaactcaa

SEQ ID NO: 405283 - DNA, 15 bp, Homo sapiens
cctttaaaactcaaa

SEQ ID NO: 405284 - DNA, 15 bp, Homo sapiens
ctttaaaactcaaat

SEQ ID NO: 405285 - DNA, 15 bp, Homo sapiens
tttaaaactcaaatc

SEQ ID NO: 405286 - DNA, 15 bp, Homo sapiens
ttaaaactcaaatct

SEQ ID NO: 405287 - DNA, 15 bp, Homo sapiens
taaaactcaaatctg

SEQ ID NO: 405288 - DNA, 15 bp, Homo sapiens
aaaactcaaatctgt

SEQ ID NO: 405289 - DNA, 15 bp, Homo sapiens
aaactcaaatctgtt

SEQ ID NO: 405290 - DNA, 15 bp, Homo sapiens
aactcaaatctgttt

SEQ ID NO: 405291 - DNA, 15 bp, Homo sapiens
actcaaatctgtttc

SEQ ID NO: 405292 - DNA, 15 bp, Homo sapiens
ctcaaatctgtttcc

SEQ ID NO: 405293 - DNA, 15 bp, Homo sapiens
tcaaatctgtttccc

SEQ ID NO: 405294 - DNA, 15 bp, Homo sapiens
caaatctgtttccct

SEQ ID NO: 405295 - DNA, 15 bp, Homo sapiens
aaatctgtttccctt

SEQ ID NO: 405296 - DNA, 15 bp, Homo sapiens
aatctgtttccctta

SEQ ID NO: 405297 - DNA, 15 bp, Homo sapiens
atctgtttcccttag

SEQ ID NO: 405298 - DNA, 15 bp, Homo sapiens
tctgtttcccttagt

SEQ ID NO: 405299 - DNA, 15 bp, Homo sapiens
ctgtttcccttagta

SEQ ID NO: 405300 - DNA, 15 bp, Homo sapiens
tgtttcccttagtat

SEQ ID NO: 405301 - DNA, 15 bp, Homo sapiens
gtttcccttagtata

SEQ ID NO: 405302 - DNA, 15 bp, Homo sapiens
tttcccttagtatat

SEQ ID NO: 405303 - DNA, 15 bp, Homo sapiens
ttcccttagtatatt

SEQ ID NO: 405304 - DNA, 15 bp, Homo sapiens
tcccttagtatattc

SEQ ID NO: 405305 - DNA, 15 bp, Homo sapiens
cccttagtatattcc

SEQ ID NO: 405306 - DNA, 15 bp, Homo sapiens
ccttagtatattccc

SEQ ID NO: 405307 - DNA, 15 bp, Homo sapiens
cttagtatattccct

SEQ ID NO: 405308 - DNA, 15 bp, Homo sapiens
ttagtatattccctt

SEQ ID NO: 405309 - DNA, 15 bp, Homo sapiens
tagtatattcccttg

SEQ ID NO: 405310 - DNA, 15 bp, Homo sapiens
agtatattcccttgt

SEQ ID NO: 405311 - DNA, 15 bp, Homo sapiens
gtatattcccttgtt

SEQ ID NO: 405312 - DNA, 15 bp, Homo sapiens
tatattcccttgttt

SEQ ID NO: 405313 - DNA, 15 bp, Homo sapiens
atattcccttgtttg

SEQ ID NO: 405314 - DNA, 15 bp, Homo sapiens
tattcccttgtttgt

SEQ ID NO: 405315 - DNA, 15 bp, Homo sapiens
attcccttgtttgtt

SEQ ID NO: 405316 - DNA, 15 bp, Homo sapiens
ttcccttgtttgtta

SEQ ID NO: 405317 - DNA, 15 bp, Homo sapiens
tcccttgtttgttaa

SEQ ID NO: 405318 - DNA, 15 bp, Homo sapiens
cccttgtttgttaat

SEQ ID NO: 405319 - DNA, 15 bp, Homo sapiens
ccttgtttgttaatc

SEQ ID NO: 405320 - DNA, 15 bp, Homo sapiens
cttgtttgttaatct

SEQ ID NO: 405321 - DNA, 15 bp, Homo sapiens
ttgtttgttaatctt

SEQ ID NO: 405322 - DNA, 15 bp, Homo sapiens
tgtttgttaatcttg

SEQ ID NO: 405323 - DNA, 15 bp, Homo sapiens
gtttgttaatcttgc

SEQ ID NO: 405324 - DNA, 15 bp, Homo sapiens
tttgttaatcttgct

SEQ ID NO: 405325 - DNA, 15 bp, Homo sapiens
ttgttaatcttgctc

SEQ ID NO: 405326 - DNA, 15 bp, Homo sapiens
tgttaatcttgctca

SEQ ID NO: 405327 - DNA, 15 bp, Homo sapiens
gttaatcttgctcag

SEQ ID NO: 405328 - DNA, 15 bp, Homo sapiens
ttaatcttgctcagt

SEQ ID NO: 405329 - DNA, 15 bp, Homo sapiens
taatcttgctcagtt

SEQ ID NO: 405330 - DNA, 15 bp, Homo sapiens
aatcttgctcagtta

SEQ ID NO: 405331 - DNA, 15 bp, Homo sapiens
atcttgctcagttac

SEQ ID NO: 405332 - DNA, 15 bp, Homo sapiens
tcttgctcagttacc

SEQ ID NO: 405333 - DNA, 15 bp, Homo sapiens
cttgctcagttaccc

SEQ ID NO: 405334 - DNA, 15 bp, Homo sapiens
ttgctcagttaccca

SEQ ID NO: 405335 - DNA, 15 bp, Homo sapiens
tgctcagttacccaa

SEQ ID NO: 405336 - DNA, 15 bp, Homo sapiens
gctcagttacccaag

SEQ ID NO: 405337 - DNA, 15 bp, Homo sapiens
ctcagttacccaagc

SEQ ID NO: 405338 - DNA, 15 bp, Homo sapiens
tcagttacccaagcc

SEQ ID NO: 405339 - DNA, 15 bp, Homo sapiens
cagttacccaagcca

SEQ ID NO: 405340 - DNA, 15 bp, Homo sapiens
agttacccaagccag

SEQ ID NO: 405341 - DNA, 15 bp, Homo sapiens
gttacccaagccaga

SEQ ID NO: 405342 - DNA, 15 bp, Homo sapiens
ttacccaagccagaa

SEQ ID NO: 405343 - DNA, 15 bp, Homo sapiens
tacccaagccagaaa

SEQ ID NO: 405344 - DNA, 15 bp, Homo sapiens
acccaagccagaaat

SEQ ID NO: 405345 - DNA, 15 bp, Homo sapiens
cccaagccagaaatt

SEQ ID NO: 405346 - DNA, 15 bp, Homo sapiens
ccaagccagaaattt

SEQ ID NO: 405347 - DNA, 15 bp, Homo sapiens
caagccagaaattta

SEQ ID NO: 405348 - DNA, 15 bp, Homo sapiens
aagccagaaatttag

SEQ ID NO: 405349 - DNA, 15 bp, Homo sapiens
agccagaaatttagg

SEQ ID NO: 405350 - DNA, 15 bp, Homo sapiens
gccagaaatttaggt

SEQ ID NO: 405351 - DNA, 15 bp, Homo sapiens
ccagaaatttaggta

SEQ ID NO: 405352 - DNA, 15 bp, Homo sapiens
cagaaatttaggtat

SEQ ID NO: 405353 - DNA, 15 bp, Homo sapiens
agaaatttaggtatc

SEQ ID NO: 405354 - DNA, 15 bp, Homo sapiens
gaaatttaggtatca

SEQ ID NO: 405355 - DNA, 15 bp, Homo sapiens
aaatttaggtatcat

SEQ ID NO: 405356 - DNA, 15 bp, Homo sapiens
aatttaggtatcatt

SEQ ID NO: 405357 - DNA, 15 bp, Homo sapiens
atttaggtatcattc

SEQ ID NO: 405358 - DNA, 15 bp, Homo sapiens
tttaggtatcattct

SEQ ID NO: 405359 - DNA, 15 bp, Homo sapiens
ttaggtatcattctt

SEQ ID NO: 405360 - DNA, 15 bp, Homo sapiens
taggtatcattcttg

SEQ ID NO: 405361 - DNA, 15 bp, Homo sapiens
aggtatcattcttga

SEQ ID NO: 405362 - DNA, 15 bp, Homo sapiens
ggtatcattcttgaa

SEQ ID NO: 405363 - DNA, 15 bp, Homo sapiens
gtatcattcttgaat

SEQ ID NO: 405364 - DNA, 15 bp, Homo sapiens
tatcattcttgaata

SEQ ID NO: 405365 - DNA, 15 bp, Homo sapiens
atcattcttgaatac

SEQ ID NO: 405366 - DNA, 15 bp, Homo sapiens
tcattcttgaataca

SEQ ID NO: 405367 - DNA, 15 bp, Homo sapiens
cattcttgaatacat

SEQ ID NO: 405368 - DNA, 15 bp, Homo sapiens
attcttgaatacatt

SEQ ID NO: 405369 - DNA, 15 bp, Homo sapiens
ttcttgaatacattg

SEQ ID NO: 405370 - DNA, 15 bp, Homo sapiens
tcttgaatacattgt

SEQ ID NO: 405371 - DNA, 15 bp, Homo sapiens
cttgaatacattgtt

SEQ ID NO: 405372 - DNA, 15 bp, Homo sapiens
ttgaatacattgttt

SEQ ID NO: 405373 - DNA, 15 bp, Homo sapiens
tgaatacattgtttc

SEQ ID NO: 405374 - DNA, 15 bp, Homo sapiens
gaatacattgtttct

SEQ ID NO: 405375 - DNA, 15 bp, Homo sapiens
aatacattgtttctc

SEQ ID NO: 405376 - DNA, 15 bp, Homo sapiens
atacattgtttctct

SEQ ID NO: 405377 - DNA, 15 bp, Homo sapiens
tacattgtttctctt

SEQ ID NO: 405378 - DNA, 15 bp, Homo sapiens
acattgtttctcttc

SEQ ID NO: 405379 - DNA, 15 bp, Homo sapiens
cattgtttctcttcc

SEQ ID NO: 405380 - DNA, 15 bp, Homo sapiens
attgtttctcttcct

SEQ ID NO: 405381 - DNA, 15 bp, Homo sapiens
ttgtttctcttcctt

SEQ ID NO: 405382 - DNA, 15 bp, Homo sapiens
tgtttctcttccttt

SEQ ID NO: 405383 - DNA, 15 bp, Homo sapiens
gtttctcttcctttc

SEQ ID NO: 405384 - DNA, 15 bp, Homo sapiens
tttctcttcctttcc

SEQ ID NO: 405385 - DNA, 15 bp, Homo sapiens
ttctcttcctttcca

SEQ ID NO: 405386 - DNA, 15 bp, Homo sapiens
tctcttcctttccac

SEQ ID NO: 405387 - DNA, 15 bp, Homo sapiens
ctcttcctttccaca

SEQ ID NO: 405388 - DNA, 15 bp, Homo sapiens
tcttcctttccacac

SEQ ID NO: 405389 - DNA, 15 bp, Homo sapiens
cttcctttccacacc

SEQ ID NO: 405390 - DNA, 15 bp, Homo sapiens
ttcctttccacaccc

SEQ ID NO: 405391 - DNA, 15 bp, Homo sapiens
tcctttccacacccg

SEQ ID NO: 405392 - DNA, 15 bp, Homo sapiens
cctttccacacccga

SEQ ID NO: 405393 - DNA, 15 bp, Homo sapiens
ctttccacacccgat

SEQ ID NO: 405394 - DNA, 15 bp, Homo sapiens
tttccacacccgatc

SEQ ID NO: 405395 - DNA, 15 bp, Homo sapiens
ttccacacccgatca

SEQ ID NO: 405396 - DNA, 15 bp, Homo sapiens
tccacacccgatcaa

SEQ ID NO: 405397 - DNA, 15 bp, Homo sapiens
ccacacccgatcaat

SEQ ID NO: 405398 - DNA, 15 bp, Homo sapiens
cacacccgatcaatc

SEQ ID NO: 405399 - DNA, 15 bp, Homo sapiens
acacccgatcaatca

SEQ ID NO: 405400 - DNA, 15 bp, Homo sapiens
cacccgatcaatcaa

SEQ ID NO: 405401 - DNA, 15 bp, Homo sapiens
acccgatcaatcaaa

SEQ ID NO: 405402 - DNA, 15 bp, Homo sapiens
cccgatcaatcaaat

SEQ ID NO: 405403 - DNA, 15 bp, Homo sapiens
ccgatcaatcaaata

SEQ ID NO: 405404 - DNA, 15 bp, Homo sapiens
cgatcaatcaaatac

SEQ ID NO: 405405 - DNA, 15 bp, Homo sapiens
gatcaatcaaataca

SEQ ID NO: 405406 - DNA, 15 bp, Homo sapiens
atcaatcaaatacac

SEQ ID NO: 405407 - DNA, 15 bp, Homo sapiens
tcaatcaaatacaca

SEQ ID NO: 405408 - DNA, 15 bp, Homo sapiens
caatcaaatacacag

SEQ ID NO: 405409 - DNA, 15 bp, Homo sapiens
aatcaaatacacagt

SEQ ID NO: 405410 - DNA, 15 bp, Homo sapiens
atcaaatacacagtc

SEQ ID NO: 405411 - DNA, 15 bp, Homo sapiens
tcaaatacacagtct

SEQ ID NO: 405412 - DNA, 15 bp, Homo sapiens
caaatacacagtctt

SEQ ID NO: 405413 - DNA, 15 bp, Homo sapiens
aaatacacagtctta

SEQ ID NO: 405414 - DNA, 15 bp, Homo sapiens
aatacacagtcttat

SEQ ID NO: 405415 - DNA, 15 bp, Homo sapiens
atacacagtcttatt

SEQ ID NO: 405416 - DNA, 15 bp, Homo sapiens
tacacagtcttattg

SEQ ID NO: 405417 - DNA, 15 bp, Homo sapiens
acacagtcttattgc

SEQ ID NO: 405418 - DNA, 15 bp, Homo sapiens
cacagtcttattgct

SEQ ID NO: 405419 - DNA, 15 bp, Homo sapiens
acagtcttattgctt

SEQ ID NO: 405420 - DNA, 15 bp, Homo sapiens
cagtcttattgcttc

SEQ ID NO: 405421 - DNA, 15 bp, Homo sapiens
agtcttattgcttct

SEQ ID NO: 405422 - DNA, 15 bp, Homo sapiens
gtcttattgcttctt

SEQ ID NO: 405423 - DNA, 15 bp, Homo sapiens
tcttattgcttctta

SEQ ID NO: 405424 - DNA, 15 bp, Homo sapiens
cttattgcttcttac

SEQ ID NO: 405425 - DNA, 15 bp, Homo sapiens
ttattgcttcttact

SEQ ID NO: 405426 - DNA, 15 bp, Homo sapiens
tattgcttcttactt

SEQ ID NO: 405427 - DNA, 15 bp, Homo sapiens
attgcttcttacttt

SEQ ID NO: 405428 - DNA, 15 bp, Homo sapiens
ttgcttcttactttt

SEQ ID NO: 405429 - DNA, 15 bp, Homo sapiens
tgcttcttacttttt

SEQ ID NO: 405430 - DNA, 15 bp, Homo sapiens
gcttcttactttttt

SEQ ID NO: 405431 - DNA, 15 bp, Homo sapiens
cttcttacttttttt

SEQ ID NO: 405432 - DNA, 15 bp, Homo sapiens
ttcttactttttttt

SEQ ID NO: 405433 - DNA, 15 bp, Homo sapiens
tcttacttttttttt

SEQ ID NO: 405434 - DNA, 15 bp, Homo sapiens
cttactttttttttt

SEQ ID NO: 405435 - DNA, 15 bp, Homo sapiens
tactttttttttttc

SEQ ID NO: 405436 - DNA, 15 bp, Homo sapiens
actttttttttttct

SEQ ID NO: 405437 - DNA, 15 bp, Homo sapiens
tttttttttttctta

SEQ ID NO: 405438 - DNA, 15 bp, Homo sapiens
ttttttttttcttat

SEQ ID NO: 405439 - DNA, 15 bp, Homo sapiens
tttttttttcttatc

SEQ ID NO: 405440 - DNA, 15 bp, Homo sapiens
ttttttttcttatct

SEQ ID NO: 405441 - DNA, 15 bp, Homo sapiens
tttttttcttatctt

SEQ ID NO: 405442 - DNA, 15 bp, Homo sapiens
ttttttcttatctta

SEQ ID NO: 405443 - DNA, 15 bp, Homo sapiens
tttttcttatcttat

SEQ ID NO: 405444 - DNA, 15 bp, Homo sapiens
ttttcttatcttatt

SEQ ID NO: 405445 - DNA, 15 bp, Homo sapiens
tttcttatcttattg

SEQ ID NO: 405446 - DNA, 15 bp, Homo sapiens
ttcttatcttattgc

SEQ ID NO: 405447 - DNA, 15 bp, Homo sapiens
tcttatcttattgct

SEQ ID NO: 405448 - DNA, 15 bp, Homo sapiens
cttatcttattgctt

SEQ ID NO: 405449 - DNA, 15 bp, Homo sapiens
ttatcttattgcttt

SEQ ID NO: 405450 - DNA, 15 bp, Homo sapiens
tatcttattgctttt

SEQ ID NO: 405451 - DNA, 15 bp, Homo sapiens
atcttattgctttta

SEQ ID NO: 405452 - DNA, 15 bp, Homo sapiens
tcttattgcttttat

SEQ ID NO: 405453 - DNA, 15 bp, Homo sapiens
cttattgcttttatt

SEQ ID NO: 405454 - DNA, 15 bp, Homo sapiens
ttattgcttttattt

SEQ ID NO: 405455 - DNA, 15 bp, Homo sapiens
tattgcttttatttt

SEQ ID NO: 405456 - DNA, 15 bp, Homo sapiens
attgcttttattttc

SEQ ID NO: 405457 - DNA, 15 bp, Homo sapiens
ttgcttttattttca

SEQ ID NO: 405458 - DNA, 15 bp, Homo sapiens
tgcttttattttcag

SEQ ID NO: 405459 - DNA, 15 bp, Homo sapiens
gcttttattttcagt

SEQ ID NO: 405460 - DNA, 15 bp, Homo sapiens
cttttattttcagta

SEQ ID NO: 405461 - DNA, 15 bp, Homo sapiens
ttttattttcagtat

SEQ ID NO: 405462 - DNA, 15 bp, Homo sapiens
tttattttcagtatt

SEQ ID NO: 405463 - DNA, 15 bp, Homo sapiens
ttattttcagtattt

SEQ ID NO: 405464 - DNA, 15 bp, Homo sapiens
tattttcagtatttt

SEQ ID NO: 405465 - DNA, 15 bp, Homo sapiens
attttcagtattttt

SEQ ID NO: 405466 - DNA, 15 bp, Homo sapiens
ttttcagtatttttt

SEQ ID NO: 405467 - DNA, 15 bp, Homo sapiens
tttcagtattttttt

SEQ ID NO: 405468 - DNA, 15 bp, Homo sapiens
ttcagtatttttttg

SEQ ID NO: 405469 - DNA, 15 bp, Homo sapiens
tcagtatttttttga

SEQ ID NO: 405470 - DNA, 15 bp, Homo sapiens
cagtatttttttgaa

SEQ ID NO: 405471 - DNA, 15 bp, Homo sapiens
agtatttttttgaat

SEQ ID NO: 405472 - DNA, 15 bp, Homo sapiens
gtatttttttgaatc

SEQ ID NO: 405473 - DNA, 15 bp, Homo sapiens
tatttttttgaatca

SEQ ID NO: 405474 - DNA, 15 bp, Homo sapiens
atttttttgaatcat

SEQ ID NO: 405475 - DNA, 15 bp, Homo sapiens
tttttttgaatcatg

SEQ ID NO: 405476 - DNA, 15 bp, Homo sapiens
ttttttgaatcatga

SEQ ID NO: 405477 - DNA, 15 bp, Homo sapiens
tttttgaatcatgaa

SEQ ID NO: 405478 - DNA, 15 bp, Homo sapiens
ttttgaatcatgaag

SEQ ID NO: 405479 - DNA, 15 bp, Homo sapiens
tttgaatcatgaagc

SEQ ID NO: 405480 - DNA, 15 bp, Homo sapiens
ttgaatcatgaagct

SEQ ID NO: 405481 - DNA, 15 bp, Homo sapiens
tgaatcatgaagctg

SEQ ID NO: 405482 - DNA, 15 bp, Homo sapiens
gaatcatgaagctgt

SEQ ID NO: 405483 - DNA, 15 bp, Homo sapiens
aatcatgaagctgta

SEQ ID NO: 405484 - DNA, 15 bp, Homo sapiens
atcatgaagctgtat

SEQ ID NO: 405485 - DNA, 15 bp, Homo sapiens
tcatgaagctgtata

SEQ ID NO: 405486 - DNA, 15 bp, Homo sapiens
catgaagctgtataa

SEQ ID NO: 405487 - DNA, 15 bp, Homo sapiens
atgaagctgtataaa

SEQ ID NO: 405488 - DNA, 15 bp, Homo sapiens
tgaagctgtataaac

SEQ ID NO: 405489 - DNA, 15 bp, Homo sapiens
gaagctgtataaaca

SEQ ID NO: 405490 - DNA, 15 bp, Homo sapiens
aagctgtataaacag

SEQ ID NO: 405491 - DNA, 15 bp, Homo sapiens
agctgtataaacaga

SEQ ID NO: 405492 - DNA, 15 bp, Homo sapiens
gctgtataaacagac

SEQ ID NO: 405493 - DNA, 15 bp, Homo sapiens
ctgtataaacagaca

SEQ ID NO: 405494 - DNA, 15 bp, Homo sapiens
tgtataaacagacaa

SEQ ID NO: 405495 - DNA, 15 bp, Homo sapiens
gtataaacagacaag

SEQ ID NO: 405496 - DNA, 15 bp, Homo sapiens
tataaacagacaagg

SEQ ID NO: 405497 - DNA, 15 bp, Homo sapiens
ataaacagacaaggt

SEQ ID NO: 405498 - DNA, 15 bp, Homo sapiens
taaacagacaaggtg

SEQ ID NO: 405499 - DNA, 15 bp, Homo sapiens
aaacagacaaggtga

SEQ ID NO: 405500 - DNA, 15 bp, Homo sapiens
aacagacaaggtgat

SEQ ID NO: 405501 - DNA, 15 bp, Homo sapiens
acagacaaggtgatc

SEQ ID NO: 405502 - DNA, 15 bp, Homo sapiens
cagacaaggtgatct

SEQ ID NO: 405503 - DNA, 15 bp, Homo sapiens
agacaaggtgatctg

SEQ ID NO: 405504 - DNA, 15 bp, Homo sapiens
gacaaggtgatctgt

SEQ ID NO: 405505 - DNA, 15 bp, Homo sapiens
acaaggtgatctgtg

SEQ ID NO: 405506 - DNA, 15 bp, Homo sapiens
caaggtgatctgtgt

SEQ ID NO: 405507 - DNA, 15 bp, Homo sapiens
aaggtgatctgtgtt

SEQ ID NO: 405508 - DNA, 15 bp, Homo sapiens
aggtgatctgtgttg

SEQ ID NO: 405509 - DNA, 15 bp, Homo sapiens
ggtgatctgtgttgt

SEQ ID NO: 405510 - DNA, 15 bp, Homo sapiens
gtgatctgtgttgtg

SEQ ID NO: 405511 - DNA, 15 bp, Homo sapiens
tgatctgtgttgtgt

SEQ ID NO: 405512 - DNA, 15 bp, Homo sapiens
gatctgtgttgtgtt

SEQ ID NO: 405513 - DNA, 15 bp, Homo sapiens
atctgtgttgtgtta

SEQ ID NO: 405514 - DNA, 15 bp, Homo sapiens
tctgtgttgtgttag

SEQ ID NO: 405515 - DNA, 15 bp, Homo sapiens
ctgtgttgtgttagg

SEQ ID NO: 405516 - DNA, 15 bp, Homo sapiens
tgtgttgtgttaggg

SEQ ID NO: 405517 - DNA, 15 bp, Homo sapiens
gtgttgtgttagggc

SEQ ID NO: 405518 - DNA, 15 bp, Homo sapiens
tgttgtgttagggct

SEQ ID NO: 405519 - DNA, 15 bp, Homo sapiens
gttgtgttagggctg

SEQ ID NO: 405520 - DNA, 15 bp, Homo sapiens
ttgtgttagggctgt

SEQ ID NO: 405521 - DNA, 15 bp, Homo sapiens
tgtgttagggctgtc

SEQ ID NO: 405522 - DNA, 15 bp, Homo sapiens
gtgttagggctgtct

SEQ ID NO: 405523 - DNA, 15 bp, Homo sapiens
tgttagggctgtctg

SEQ ID NO: 405524 - DNA, 15 bp, Homo sapiens
gttagggctgtctgt

SEQ ID NO: 405525 - DNA, 15 bp, Homo sapiens
ttagggctgtctgtg

SEQ ID NO: 405526 - DNA, 15 bp, Homo sapiens
tagggctgtctgtgc

SEQ ID NO: 405527 - DNA, 15 bp, Homo sapiens
agggctgtctgtgcc

SEQ ID NO: 405528 - DNA, 15 bp, Homo sapiens
gggctgtctgtgcca

SEQ ID NO: 405529 - DNA, 15 bp, Homo sapiens
ggctgtctgtgccat

SEQ ID NO: 405530 - DNA, 15 bp, Homo sapiens
gctgtctgtgccatg

SEQ ID NO: 405531 - DNA, 15 bp, Homo sapiens
ctgtctgtgccatgt

SEQ ID NO: 405532 - DNA, 15 bp, Homo sapiens
tgtctgtgccatgtt

SEQ ID NO: 405533 - DNA, 15 bp, Homo sapiens
gtctgtgccatgttg

SEQ ID NO: 405534 - DNA, 15 bp, Homo sapiens
tctgtgccatgttgc

SEQ ID NO: 405535 - DNA, 15 bp, Homo sapiens
ctgtgccatgttgct

SEQ ID NO: 405536 - DNA, 15 bp, Homo sapiens
tgtgccatgttgctg

SEQ ID NO: 405537 - DNA, 15 bp, Homo sapiens
gtgccatgttgctgt

SEQ ID NO: 405538 - DNA, 15 bp, Homo sapiens
tgccatgttgctgtg

SEQ ID NO: 405539 - DNA, 15 bp, Homo sapiens
gccatgttgctgtgg

SEQ ID NO: 405540 - DNA, 15 bp, Homo sapiens
ccatgttgctgtggg

SEQ ID NO: 405541 - DNA, 15 bp, Homo sapiens
catgttgctgtggga

SEQ ID NO: 405542 - DNA, 15 bp, Homo sapiens
atgttgctgtgggag

SEQ ID NO: 405543 - DNA, 15 bp, Homo sapiens
tgttgctgtgggagt

SEQ ID NO: 405544 - DNA, 15 bp, Homo sapiens
gttgctgtgggagtt

SEQ ID NO: 405545 - DNA, 15 bp, Homo sapiens
ttgctgtgggagttt

SEQ ID NO: 405546 - DNA, 15 bp, Homo sapiens
tgctgtgggagtttc

SEQ ID NO: 405547 - DNA, 15 bp, Homo sapiens
gctgtgggagtttct

SEQ ID NO: 405548 - DNA, 15 bp, Homo sapiens
ctgtgggagtttcta

SEQ ID NO: 405549 - DNA, 15 bp, Homo sapiens
tgtgggagtttctat

SEQ ID NO: 405550 - DNA, 15 bp, Homo sapiens
gtgggagtttctata

SEQ ID NO: 405551 - DNA, 15 bp, Homo sapiens
tgggagtttctatat

SEQ ID NO: 405552 - DNA, 15 bp, Homo sapiens
gggagtttctatatg

SEQ ID NO: 405553 - DNA, 15 bp, Homo sapiens
ggagtttctatatgg

SEQ ID NO: 405554 - DNA, 15 bp, Homo sapiens
gagtttctatatgga

SEQ ID NO: 405555 - DNA, 15 bp, Homo sapiens
agtttctatatggaa

SEQ ID NO: 405556 - DNA, 15 bp, Homo sapiens
gtttctatatggaag

SEQ ID NO: 405557 - DNA, 15 bp, Homo sapiens
tttctatatggaaga

SEQ ID NO: 405558 - DNA, 15 bp, Homo sapiens
ttctatatggaagag

SEQ ID NO: 405559 - DNA, 15 bp, Homo sapiens
tctatatggaagagg

SEQ ID NO: 405560 - DNA, 15 bp, Homo sapiens
ctatatggaagaggg

SEQ ID NO: 405561 - DNA, 15 bp, Homo sapiens
tatatggaagagggg

SEQ ID NO: 405562 - DNA, 15 bp, Homo sapiens
atatggaagaggggc

SEQ ID NO: 405563 - DNA, 15 bp, Homo sapiens
tatggaagaggggca

SEQ ID NO: 405564 - DNA, 15 bp, Homo sapiens
atggaagaggggcat

SEQ ID NO: 405565 - DNA, 15 bp, Homo sapiens
tggaagaggggcatt

SEQ ID NO: 405566 - DNA, 15 bp, Homo sapiens
ggaagaggggcatta

SEQ ID NO: 405567 - DNA, 15 bp, Homo sapiens
gaagaggggcattaa

SEQ ID NO: 405568 - DNA, 15 bp, Homo sapiens
aagaggggcattaac

SEQ ID NO: 405569 - DNA, 15 bp, Homo sapiens
agaggggcattaaca

SEQ ID NO: 405570 - DNA, 15 bp, Homo sapiens
gaggggcattaacaa

SEQ ID NO: 405571 - DNA, 15 bp, Homo sapiens
aggggcattaacaaa

SEQ ID NO: 405572 - DNA, 15 bp, Homo sapiens
ggggcattaacaaag

SEQ ID NO: 405573 - DNA, 15 bp, Homo sapiens
gggcattaacaaagc

SEQ ID NO: 405574 - DNA, 15 bp, Homo sapiens
ggcattaacaaagct

SEQ ID NO: 405575 - DNA, 15 bp, Homo sapiens
gcattaacaaagctt

SEQ ID NO: 405576 - DNA, 15 bp, Homo sapiens
cattaacaaagcttt

SEQ ID NO: 405577 - DNA, 15 bp, Homo sapiens
attaacaaagctttg

SEQ ID NO: 405578 - DNA, 15 bp, Homo sapiens
ttaacaaagctttga

SEQ ID NO: 405579 - DNA, 15 bp, Homo sapiens
taacaaagctttgaa

SEQ ID NO: 405580 - DNA, 15 bp, Homo sapiens
aacaaagctttgaaa

SEQ ID NO: 405581 - DNA, 15 bp, Homo sapiens
acaaagctttgaaat

SEQ ID NO: 405582 - DNA, 15 bp, Homo sapiens
caaagctttgaaatg

SEQ ID NO: 405583 - DNA, 15 bp, Homo sapiens
aaagctttgaaatgc

SEQ ID NO: 405584 - DNA, 15 bp, Homo sapiens
aagctttgaaatgcc

SEQ ID NO: 405585 - DNA, 15 bp, Homo sapiens
agctttgaaatgcca

SEQ ID NO: 405586 - DNA, 15 bp, Homo sapiens
gctttgaaatgccaa

SEQ ID NO: 405587 - DNA, 15 bp, Homo sapiens
ctttgaaatgccaaa

SEQ ID NO: 405588 - DNA, 15 bp, Homo sapiens
tttgaaatgccaaag

SEQ ID NO: 405589 - DNA, 15 bp, Homo sapiens
ttgaaatgccaaagc

SEQ ID NO: 405590 - DNA, 15 bp, Homo sapiens
tgaaatgccaaagca

SEQ ID NO: 405591 - DNA, 15 bp, Homo sapiens
gaaatgccaaagcag

SEQ ID NO: 405592 - DNA, 15 bp, Homo sapiens
aaatgccaaagcaga

SEQ ID NO: 405593 - DNA, 15 bp, Homo sapiens
aatgccaaagcagac

SEQ ID NO: 405594 - DNA, 15 bp, Homo sapiens
atgccaaagcagact

SEQ ID NO: 405595 - DNA, 15 bp, Homo sapiens
tgccaaagcagactt

SEQ ID NO: 405596 - DNA, 15 bp, Homo sapiens
gccaaagcagacttt

SEQ ID NO: 405597 - DNA, 15 bp, Homo sapiens
ccaaagcagactttc

SEQ ID NO: 405598 - DNA, 15 bp, Homo sapiens
caaagcagactttcc

SEQ ID NO: 405599 - DNA, 15 bp, Homo sapiens
aaagcagactttcca

SEQ ID NO: 405600 - DNA, 15 bp, Homo sapiens
aagcagactttccag

SEQ ID NO: 405601 - DNA, 15 bp, Homo sapiens
agcagactttccagg

SEQ ID NO: 405602 - DNA, 15 bp, Homo sapiens
gcagactttccaggg

SEQ ID NO: 405603 - DNA, 15 bp, Homo sapiens
cagactttccaggga

SEQ ID NO: 405604 - DNA, 15 bp, Homo sapiens
agactttccagggaa

SEQ ID NO: 405605 - DNA, 15 bp, Homo sapiens
gactttccagggaag

SEQ ID NO: 405606 - DNA, 15 bp, Homo sapiens
actttccagggaaga

SEQ ID NO: 405607 - DNA, 15 bp, Homo sapiens
ctttccagggaagag

SEQ ID NO: 405608 - DNA, 15 bp, Homo sapiens
tttccagggaagagc

SEQ ID NO: 405609 - DNA, 15 bp, Homo sapiens
ttccagggaagagcg

SEQ ID NO: 405610 - DNA, 15 bp, Homo sapiens
tccagggaagagcgt

SEQ ID NO: 405611 - DNA, 15 bp, Homo sapiens
ccagggaagagcgtc

SEQ ID NO: 405612 - DNA, 15 bp, Homo sapiens
cagggaagagcgtct

SEQ ID NO: 405613 - DNA, 15 bp, Homo sapiens
agggaagagcgtctg

SEQ ID NO: 405614 - DNA, 15 bp, Homo sapiens
gggaagagcgtctgc

SEQ ID NO: 405615 - DNA, 15 bp, Homo sapiens
ggaagagcgtctgca

SEQ ID NO: 405616 - DNA, 15 bp, Homo sapiens
gaagagcgtctgcag

SEQ ID NO: 405617 - DNA, 15 bp, Homo sapiens
aagagcgtctgcaga

SEQ ID NO: 405618 - DNA, 15 bp, Homo sapiens
agagcgtctgcagat

SEQ ID NO: 405619 - DNA, 15 bp, Homo sapiens
gagcgtctgcagata

SEQ ID NO: 405620 - DNA, 15 bp, Homo sapiens
agcgtctgcagataa

SEQ ID NO: 405621 - DNA, 15 bp, Homo sapiens
gcgtctgcagataat

SEQ ID NO: 405622 - DNA, 15 bp, Homo sapiens
cgtctgcagataatt

SEQ ID NO: 405623 - DNA, 15 bp, Homo sapiens
gtctgcagataattc

SEQ ID NO: 405624 - DNA, 15 bp, Homo sapiens
tctgcagataattct

SEQ ID NO: 405625 - DNA, 15 bp, Homo sapiens
ctgcagataattctg

SEQ ID NO: 405626 - DNA, 15 bp, Homo sapiens
tgcagataattctga

SEQ ID NO: 405627 - DNA, 15 bp, Homo sapiens
gcagataattctgaa

SEQ ID NO: 405628 - DNA, 15 bp, Homo sapiens
cagataattctgaag

SEQ ID NO: 405629 - DNA, 15 bp, Homo sapiens
agataattctgaaga

SEQ ID NO: 405630 - DNA, 15 bp, Homo sapiens
gataattctgaagaa

SEQ ID NO: 405631 - DNA, 15 bp, Homo sapiens
ataattctgaagaat

SEQ ID NO: 405632 - DNA, 15 bp, Homo sapiens
taattctgaagaatg

SEQ ID NO: 405633 - DNA, 15 bp, Homo sapiens
aattctgaagaatgt

SEQ ID NO: 405634 - DNA, 15 bp, Homo sapiens
attctgaagaatgtg

SEQ ID NO: 405635 - DNA, 15 bp, Homo sapiens
ttctgaagaatgtgt

SEQ ID NO: 405636 - DNA, 15 bp, Homo sapiens
tctgaagaatgtgtt

SEQ ID NO: 405637 - DNA, 15 bp, Homo sapiens
ctgaagaatgtgttg

SEQ ID NO: 405638 - DNA, 15 bp, Homo sapiens
tgaagaatgtgttga

SEQ ID NO: 405639 - DNA, 15 bp, Homo sapiens
gaagaatgtgttgat

SEQ ID NO: 405640 - DNA, 15 bp, Homo sapiens
aagaatgtgttgata

SEQ ID NO: 405641 - DNA, 15 bp, Homo sapiens
agaatgtgttgatag

SEQ ID NO: 405642 - DNA, 15 bp, Homo sapiens
gaatgtgttgatagt

SEQ ID NO: 405643 - DNA, 15 bp, Homo sapiens
aatgtgttgatagta

SEQ ID NO: 405644 - DNA, 15 bp, Homo sapiens
atgtgttgatagtat

SEQ ID NO: 405645 - DNA, 15 bp, Homo sapiens
tgtgttgatagtatc

SEQ ID NO: 405646 - DNA, 15 bp, Homo sapiens
gtgttgatagtatct

SEQ ID NO: 405647 - DNA, 15 bp, Homo sapiens
tgttgatagtatctt

SEQ ID NO: 405648 - DNA, 15 bp, Homo sapiens
gttgatagtatcttg

SEQ ID NO: 405649 - DNA, 15 bp, Homo sapiens
ttgatagtatcttgg

SEQ ID NO: 405650 - DNA, 15 bp, Homo sapiens
tgatagtatcttggc

SEQ ID NO: 405651 - DNA, 15 bp, Homo sapiens
tagtatcttggccac

SEQ ID NO: 405652 - DNA, 15 bp, Homo sapiens
agtatcttggccaca

SEQ ID NO: 405653 - DNA, 15 bp, Homo sapiens
gtatcttggccacag

SEQ ID NO: 405654 - DNA, 15 bp, Homo sapiens
tatcttggccacagg

SEQ ID NO: 405655 - DNA, 15 bp, Homo sapiens
atcttggccacaggg

SEQ ID NO: 405656 - DNA, 15 bp, Homo sapiens
tcttggccacagggc

SEQ ID NO: 405657 - DNA, 15 bp, Homo sapiens
cttggccacagggcc

SEQ ID NO: 405658 - DNA, 15 bp, Homo sapiens
ttggccacagggcca

SEQ ID NO: 405659 - DNA, 15 bp, Homo sapiens
tggccacagggccat

SEQ ID NO: 405660 - DNA, 15 bp, Homo sapiens
ggccacagggccatg

SEQ ID NO: 405661 - DNA, 15 bp, Homo sapiens
gccacagggccatga

SEQ ID NO: 405662 - DNA, 15 bp, Homo sapiens
ccacagggccatgag

SEQ ID NO: 405663 - DNA, 15 bp, Homo sapiens
cacagggccatgagg

SEQ ID NO: 405664 - DNA, 15 bp, Homo sapiens
acagggccatgaggc

SEQ ID NO: 405665 - DNA, 15 bp, Homo sapiens
cagggccatgaggca

SEQ ID NO: 405666 - DNA, 15 bp, Homo sapiens
agggccatgaggcat

SEQ ID NO: 405667 - DNA, 15 bp, Homo sapiens
gggccatgaggcatt

SEQ ID NO: 405668 - DNA, 15 bp, Homo sapiens
ggccatgaggcatta

SEQ ID NO: 405669 - DNA, 15 bp, Homo sapiens
gccatgaggcattat

SEQ ID NO: 405670 - DNA, 15 bp, Homo sapiens
ccatgaggcattatc

SEQ ID NO: 405671 - DNA, 15 bp, Homo sapiens
catgaggcattatca

SEQ ID NO: 405672 - DNA, 15 bp, Homo sapiens
atgaggcattatcag

SEQ ID NO: 405673 - DNA, 15 bp, Homo sapiens
tgaggcattatcagg

SEQ ID NO: 405674 - DNA, 15 bp, Homo sapiens
gaggcattatcaggg

SEQ ID NO: 405675 - DNA, 15 bp, Homo sapiens
aggcattatcagggg

SEQ ID NO: 405676 - DNA, 15 bp, Homo sapiens
ggcattatcaggggc

SEQ ID NO: 405677 - DNA, 15 bp, Homo sapiens
gcattatcaggggca

SEQ ID NO: 405678 - DNA, 15 bp, Homo sapiens
cattatcaggggcag

SEQ ID NO: 405679 - DNA, 15 bp, Homo sapiens
attatcaggggcagg

SEQ ID NO: 405680 - DNA, 15 bp, Homo sapiens
ttatcaggggcagga

SEQ ID NO: 405681 - DNA, 15 bp, Homo sapiens
tatcaggggcaggag

SEQ ID NO: 405682 - DNA, 15 bp, Homo sapiens
atcaggggcaggaga

SEQ ID NO: 405683 - DNA, 15 bp, Homo sapiens
tcaggggcaggagag

SEQ ID NO: 405684 - DNA, 15 bp, Homo sapiens
caggggcaggagaga

SEQ ID NO: 405685 - DNA, 15 bp, Homo sapiens
aggggcaggagagag

SEQ ID NO: 405686 - DNA, 15 bp, Homo sapiens
ggggcaggagagagg

SEQ ID NO: 405687 - DNA, 15 bp, Homo sapiens
gggcaggagagaggg

SEQ ID NO: 405688 - DNA, 15 bp, Homo sapiens
ggcaggagagaggga

SEQ ID NO: 405689 - DNA, 15 bp, Homo sapiens
gcaggagagagggag

SEQ ID NO: 405690 - DNA, 15 bp, Homo sapiens
caggagagagggagg

SEQ ID NO: 405691 - DNA, 15 bp, Homo sapiens
aggagagagggaggc

SEQ ID NO: 405692 - DNA, 15 bp, Homo sapiens
ggagagagggaggct

SEQ ID NO: 405693 - DNA, 15 bp, Homo sapiens
gagagagggaggcta

SEQ ID NO: 405694 - DNA, 15 bp, Homo sapiens
agagagggaggctat

SEQ ID NO: 405695 - DNA, 15 bp, Homo sapiens
gagagggaggctatt

SEQ ID NO: 405696 - DNA, 15 bp, Homo sapiens
agagggaggctattc

SEQ ID NO: 405697 - DNA, 15 bp, Homo sapiens
gagggaggctattcc

SEQ ID NO: 405698 - DNA, 15 bp, Homo sapiens
agggaggctattccc

SEQ ID NO: 405699 - DNA, 15 bp, Homo sapiens
gggaggctattccca

SEQ ID NO: 405700 - DNA, 15 bp, Homo sapiens
ggaggctattcccag

SEQ ID NO: 405701 - DNA, 15 bp, Homo sapiens
gaggctattcccagg

SEQ ID NO: 405702 - DNA, 15 bp, Homo sapiens
aggctattcccagga

SEQ ID NO: 405703 - DNA, 15 bp, Homo sapiens
ggctattcccaggaa

SEQ ID NO: 405704 - DNA, 15 bp, Homo sapiens
gctattcccaggaaa

SEQ ID NO: 405705 - DNA, 15 bp, Homo sapiens
ctattcccaggaaag

SEQ ID NO: 405706 - DNA, 15 bp, Homo sapiens
tattcccaggaaagg

SEQ ID NO: 405707 - DNA, 15 bp, Homo sapiens
attcccaggaaaggc

SEQ ID NO: 405708 - DNA, 15 bp, Homo sapiens
ttcccaggaaaggct

SEQ ID NO: 405709 - DNA, 15 bp, Homo sapiens
tcccaggaaaggctc

SEQ ID NO: 405710 - DNA, 15 bp, Homo sapiens
cccaggaaaggctcc

SEQ ID NO: 405711 - DNA, 15 bp, Homo sapiens
ccaggaaaggctcca

SEQ ID NO: 405712 - DNA, 15 bp, Homo sapiens
caggaaaggctccag

SEQ ID NO: 405713 - DNA, 15 bp, Homo sapiens
aggaaaggctccagc

SEQ ID NO: 405714 - DNA, 15 bp, Homo sapiens
ggaaaggctccagca

SEQ ID NO: 405715 - DNA, 15 bp, Homo sapiens
gaaaggctccagcat

SEQ ID NO: 405716 - DNA, 15 bp, Homo sapiens
aaaggctccagcatg

SEQ ID NO: 405717 - DNA, 15 bp, Homo sapiens
aaggctccagcatgt

SEQ ID NO: 405718 - DNA, 15 bp, Homo sapiens
aggctccagcatgtg

SEQ ID NO: 405719 - DNA, 15 bp, Homo sapiens
ggctccagcatgtgc

SEQ ID NO: 405720 - DNA, 15 bp, Homo sapiens
gctccagcatgtgcc

SEQ ID NO: 405721 - DNA, 15 bp, Homo sapiens
ctccagcatgtgcca

SEQ ID NO: 405722 - DNA, 15 bp, Homo sapiens
tccagcatgtgccag

SEQ ID NO: 405723 - DNA, 15 bp, Homo sapiens
ccagcatgtgccaga

SEQ ID NO: 405724 - DNA, 15 bp, Homo sapiens
cagcatgtgccagag

SEQ ID NO: 405725 - DNA, 15 bp, Homo sapiens
agcatgtgccagaga

SEQ ID NO: 405726 - DNA, 15 bp, Homo sapiens
gcatgtgccagagat

SEQ ID NO: 405727 - DNA, 15 bp, Homo sapiens
catgtgccagagatg

SEQ ID NO: 405728 - DNA, 15 bp, Homo sapiens
atgtgccagagatga

SEQ ID NO: 405729 - DNA, 15 bp, Homo sapiens
tgtgccagagatgat

SEQ ID NO: 405730 - DNA, 15 bp, Homo sapiens
gtgccagagatgatg

SEQ ID NO: 405731 - DNA, 15 bp, Homo sapiens
tgccagagatgatgc

SEQ ID NO: 405732 - DNA, 15 bp, Homo sapiens
gccagagatgatgca

SEQ ID NO: 405733 - DNA, 15 bp, Homo sapiens
ccagagatgatgcag

SEQ ID NO: 405734 - DNA, 15 bp, Homo sapiens
cagagatgatgcaga

SEQ ID NO: 405735 - DNA, 15 bp, Homo sapiens
agagatgatgcagac

SEQ ID NO: 405736 - DNA, 15 bp, Homo sapiens
gagatgatgcagaca

SEQ ID NO: 405737 - DNA, 15 bp, Homo sapiens
agatgatgcagacaa

SEQ ID NO: 405738 - DNA, 15 bp, Homo sapiens
gatgatgcagacaac

SEQ ID NO: 405739 - DNA, 15 bp, Homo sapiens
atgatgcagacaaca

SEQ ID NO: 405740 - DNA, 15 bp, Homo sapiens
tgatgcagacaacat

SEQ ID NO: 405741 - DNA, 15 bp, Homo sapiens
gatgcagacaacatt

SEQ ID NO: 405742 - DNA, 15 bp, Homo sapiens
atgcagacaacatta

SEQ ID NO: 405743 - DNA, 15 bp, Homo sapiens
tgcagacaacattaa

SEQ ID NO: 405744 - DNA, 15 bp, Homo sapiens
gcagacaacattaag

SEQ ID NO: 405745 - DNA, 15 bp, Homo sapiens
cagacaacattaaga

SEQ ID NO: 405746 - DNA, 15 bp, Homo sapiens
agacaacattaagat

SEQ ID NO: 405747 - DNA, 15 bp, Homo sapiens
gacaacattaagatt

SEQ ID NO: 405748 - DNA, 15 bp, Homo sapiens
acaacattaagattt

SEQ ID NO: 405749 - DNA, 15 bp, Homo sapiens
caacattaagatttg

SEQ ID NO: 405750 - DNA, 15 bp, Homo sapiens
aacattaagatttga

SEQ ID NO: 405751 - DNA, 15 bp, Homo sapiens
acattaagatttgaa

SEQ ID NO: 405752 - DNA, 15 bp, Homo sapiens
cattaagatttgaaa

SEQ ID NO: 405753 - DNA, 15 bp, Homo sapiens
attaagatttgaaaa

SEQ ID NO: 405754 - DNA, 15 bp, Homo sapiens
ttaagatttgaaaaa

SEQ ID NO: 405755 - DNA, 15 bp, Homo sapiens
taagatttgaaaaaa

SEQ ID NO: 405756 - DNA, 15 bp, Homo sapiens
aagatttgaaaaaat

SEQ ID NO: 405757 - DNA, 15 bp, Homo sapiens
agatttgaaaaaatg

SEQ ID NO: 405758 - DNA, 15 bp, Homo sapiens
gatttgaaaaaatgg

SEQ ID NO: 405759 - DNA, 15 bp, Homo sapiens
atttgaaaaaatggc

SEQ ID NO: 405760 - DNA, 15 bp, Homo sapiens
tttgaaaaaatggcc

SEQ ID NO: 405761 - DNA, 15 bp, Homo sapiens
ttgaaaaaatggccc

SEQ ID NO: 405762 - DNA, 15 bp, Homo sapiens
tgaaaaaatggccca

SEQ ID NO: 405763 - DNA, 15 bp, Homo sapiens
gaaaaaatggcccag

SEQ ID NO: 405764 - DNA, 15 bp, Homo sapiens
aaaaaatggcccagt

SEQ ID NO: 405765 - DNA, 15 bp, Homo sapiens
aaaaatggcccagtg

SEQ ID NO: 405766 - DNA, 15 bp, Homo sapiens
aaaatggcccagtga

SEQ ID NO: 405767 - DNA, 15 bp, Homo sapiens
aaatggcccagtgaa

SEQ ID NO: 405768 - DNA, 15 bp, Homo sapiens
aatggcccagtgaac

SEQ ID NO: 405769 - DNA, 15 bp, Homo sapiens
atggcccagtgaaca

SEQ ID NO: 405770 - DNA, 15 bp, Homo sapiens
tggcccagtgaacaa

SEQ ID NO: 405771 - DNA, 15 bp, Homo sapiens
ggcccagtgaacaaa

SEQ ID NO: 405772 - DNA, 15 bp, Homo sapiens
gcccagtgaacaaag

SEQ ID NO: 405773 - DNA, 15 bp, Homo sapiens
cccagtgaacaaagt

SEQ ID NO: 405774 - DNA, 15 bp, Homo sapiens
ccagtgaacaaagtg

SEQ ID NO: 405775 - DNA, 15 bp, Homo sapiens
cagtgaacaaagtgt

SEQ ID NO: 405776 - DNA, 15 bp, Homo sapiens
agtgaacaaagtgtt

SEQ ID NO: 405777 - DNA, 15 bp, Homo sapiens
gtgaacaaagtgttt

SEQ ID NO: 405778 - DNA, 15 bp, Homo sapiens
tgaacaaagtgtttt

SEQ ID NO: 405779 - DNA, 15 bp, Homo sapiens
gaacaaagtgttttt

SEQ ID NO: 405780 - DNA, 15 bp, Homo sapiens
aacaaagtgtttttg

SEQ ID NO: 405781 - DNA, 15 bp, Homo sapiens
acaaagtgtttttgg

SEQ ID NO: 405782 - DNA, 15 bp, Homo sapiens
caaagtgtttttggt

SEQ ID NO: 405783 - DNA, 15 bp, Homo sapiens
aaagtgtttttggtt

SEQ ID NO: 405784 - DNA, 15 bp, Homo sapiens
aagtgtttttggttt

SEQ ID NO: 405785 - DNA, 15 bp, Homo sapiens
agtgtttttggtttt

SEQ ID NO: 405786 - DNA, 15 bp, Homo sapiens
gtgtttttggttttg

SEQ ID NO: 405787 - DNA, 15 bp, Homo sapiens
tgtttttggttttga

SEQ ID NO: 405788 - DNA, 15 bp, Homo sapiens
gtttttggttttgag

SEQ ID NO: 405789 - DNA, 15 bp, Homo sapiens
tttttggttttgaga

SEQ ID NO: 405790 - DNA, 15 bp, Homo sapiens
ttttggttttgagag

SEQ ID NO: 405791 - DNA, 15 bp, Homo sapiens
tttggttttgagaga

SEQ ID NO: 405792 - DNA, 15 bp, Homo sapiens
ttggttttgagagag

SEQ ID NO: 405793 - DNA, 15 bp, Homo sapiens
tggttttgagagaga

SEQ ID NO: 405794 - DNA, 15 bp, Homo sapiens
ggttttgagagagag

SEQ ID NO: 405795 - DNA, 15 bp, Homo sapiens
gttttgagagagaga

SEQ ID NO: 405796 - DNA, 15 bp, Homo sapiens
ttttgagagagagag

SEQ ID NO: 405797 - DNA, 15 bp, Homo sapiens
tttgagagagagaga

SEQ ID NO: 405798 - DNA, 15 bp, Homo sapiens
gagagattgagagac

SEQ ID NO: 405799 - DNA, 15 bp, Homo sapiens
agagattgagagaca

SEQ ID NO: 405800 - DNA, 15 bp, Homo sapiens
gagattgagagacag

SEQ ID NO: 405801 - DNA, 15 bp, Homo sapiens
agattgagagacaga

SEQ ID NO: 405802 - DNA, 15 bp, Homo sapiens
gattgagagacagag

SEQ ID NO: 405803 - DNA, 15 bp, Homo sapiens
attgagagacagaga

SEQ ID NO: 405804 - DNA, 15 bp, Homo sapiens
ttgagagacagagag

SEQ ID NO: 405805 - DNA, 15 bp, Homo sapiens
tgagagacagagaga

SEQ ID NO: 405806 - DNA, 15 bp, Homo sapiens
gagagacagagagag

SEQ ID NO: 405807 - DNA, 15 bp, Homo sapiens
agagacagagagaga

SEQ ID NO: 405808 - DNA, 15 bp, Homo sapiens
gagacagagagagag

SEQ ID NO: 405809 - DNA, 15 bp, Homo sapiens
agacagagagagaga

SEQ ID NO: 405810 - DNA, 15 bp, Homo sapiens
gacagagagagagag

SEQ ID NO: 405811 - DNA, 15 bp, Homo sapiens
acagagagagagaga

SEQ ID NO: 405812 - DNA, 15 bp, Homo sapiens
cagagagagagagag

SEQ ID NO: 405813 - DNA, 15 bp, Homo sapiens
gagagagagagaaac

SEQ ID NO: 405814 - DNA, 15 bp, Homo sapiens
agagagagagaaacc

SEQ ID NO: 405815 - DNA, 15 bp, Homo sapiens
gagagagagaaacca

SEQ ID NO: 405816 - DNA, 15 bp, Homo sapiens
agagagagaaaccaa

SEQ ID NO: 405817 - DNA, 15 bp, Homo sapiens
gagagagaaaccaag

SEQ ID NO: 405818 - DNA, 15 bp, Homo sapiens
agagagaaaccaagg

SEQ ID NO: 405819 - DNA, 15 bp, Homo sapiens
gagagaaaccaaggg

SEQ ID NO: 405820 - DNA, 15 bp, Homo sapiens
agagaaaccaaggga

SEQ ID NO: 405821 - DNA, 15 bp, Homo sapiens
gagaaaccaagggat

SEQ ID NO: 405822 - DNA, 15 bp, Homo sapiens
agaaaccaagggatc

SEQ ID NO: 405823 - DNA, 15 bp, Homo sapiens
gaaaccaagggatca

SEQ ID NO: 405824 - DNA, 15 bp, Homo sapiens
aaaccaagggatcat

SEQ ID NO: 405825 - DNA, 15 bp, Homo sapiens
aaccaagggatcatg

SEQ ID NO: 405826 - DNA, 15 bp, Homo sapiens
accaagggatcatga

SEQ ID NO: 405827 - DNA, 15 bp, Homo sapiens
ccaagggatcatgat

SEQ ID NO: 405828 - DNA, 15 bp, Homo sapiens
caagggatcatgata

SEQ ID NO: 405829 - DNA, 15 bp, Homo sapiens
aagggatcatgatag

SEQ ID NO: 405830 - DNA, 15 bp, Homo sapiens
agggatcatgatagt

SEQ ID NO: 405831 - DNA, 15 bp, Homo sapiens
gggatcatgatagtt

SEQ ID NO: 405832 - DNA, 15 bp, Homo sapiens
ggatcatgatagtta

SEQ ID NO: 405833 - DNA, 15 bp, Homo sapiens
gatcatgatagttat

SEQ ID NO: 405834 - DNA, 15 bp, Homo sapiens
atcatgatagttata

SEQ ID NO: 405835 - DNA, 15 bp, Homo sapiens
tcatgatagttatag

SEQ ID NO: 405836 - DNA, 15 bp, Homo sapiens
catgatagttatagt

SEQ ID NO: 405837 - DNA, 15 bp, Homo sapiens
atgatagttatagtc

SEQ ID NO: 405838 - DNA, 15 bp, Homo sapiens
tgatagttatagtca

SEQ ID NO: 405839 - DNA, 15 bp, Homo sapiens
gatagttatagtcaa

SEQ ID NO: 405840 - DNA, 15 bp, Homo sapiens
atagttatagtcaaa

SEQ ID NO: 405841 - DNA, 15 bp, Homo sapiens
tagttatagtcaaat

SEQ ID NO: 405842 - DNA, 15 bp, Homo sapiens
agttatagtcaaata

SEQ ID NO: 405843 - DNA, 15 bp, Homo sapiens
gttatagtcaaatag

SEQ ID NO: 405844 - DNA, 15 bp, Homo sapiens
ttatagtcaaataga

SEQ ID NO: 405845 - DNA, 15 bp, Homo sapiens
tatagtcaaatagag

SEQ ID NO: 405846 - DNA, 15 bp, Homo sapiens
atagtcaaatagagg

SEQ ID NO: 405847 - DNA, 15 bp, Homo sapiens
tagtcaaatagagga

SEQ ID NO: 405848 - DNA, 15 bp, Homo sapiens
agtcaaatagaggaa

SEQ ID NO: 405849 - DNA, 15 bp, Homo sapiens
gtcaaatagaggaag

SEQ ID NO: 405850 - DNA, 15 bp, Homo sapiens
tcaaatagaggaagg

SEQ ID NO: 405851 - DNA, 15 bp, Homo sapiens
caaatagaggaagga

SEQ ID NO: 405852 - DNA, 15 bp, Homo sapiens
aaatagaggaaggat

SEQ ID NO: 405853 - DNA, 15 bp, Homo sapiens
aatagaggaaggatt

SEQ ID NO: 405854 - DNA, 15 bp, Homo sapiens
atagaggaaggatta

SEQ ID NO: 405855 - DNA, 15 bp, Homo sapiens
tagaggaaggattat

SEQ ID NO: 405856 - DNA, 15 bp, Homo sapiens
agaggaaggattatc

SEQ ID NO: 405857 - DNA, 15 bp, Homo sapiens
gaggaaggattatct

SEQ ID NO: 405858 - DNA, 15 bp, Homo sapiens
aggaaggattatctt

SEQ ID NO: 405859 - DNA, 15 bp, Homo sapiens
ggaaggattatcttt

SEQ ID NO: 405860 - DNA, 15 bp, Homo sapiens
gaaggattatctttt

SEQ ID NO: 405861 - DNA, 15 bp, Homo sapiens
aaggattatcttttg

SEQ ID NO: 405862 - DNA, 15 bp, Homo sapiens
aggattatcttttga

SEQ ID NO: 405863 - DNA, 15 bp, Homo sapiens
ggattatcttttgaa

SEQ ID NO: 405864 - DNA, 15 bp, Homo sapiens
gattatcttttgaaa

SEQ ID NO: 405865 - DNA, 15 bp, Homo sapiens
attatcttttgaaaa

SEQ ID NO: 405866 - DNA, 15 bp, Homo sapiens
ttatcttttgaaaat

SEQ ID NO: 405867 - DNA, 15 bp, Homo sapiens
tatcttttgaaaatg

SEQ ID NO: 405868 - DNA, 15 bp, Homo sapiens
atcttttgaaaatgt

SEQ ID NO: 405869 - DNA, 15 bp, Homo sapiens
tcttttgaaaatgtg

SEQ ID NO: 405870 - DNA, 15 bp, Homo sapiens
cttttgaaaatgtgt

SEQ ID NO: 405871 - DNA, 15 bp, Homo sapiens
ttttgaaaatgtgtt

SEQ ID NO: 405872 - DNA, 15 bp, Homo sapiens
tttgaaaatgtgttg

SEQ ID NO: 405873 - DNA, 15 bp, Homo sapiens
ttgaaaatgtgttgg

SEQ ID NO: 405874 - DNA, 15 bp, Homo sapiens
tgaaaatgtgttggt

SEQ ID NO: 405875 - DNA, 15 bp, Homo sapiens
gaaaatgtgttggtt

SEQ ID NO: 405876 - DNA, 15 bp, Homo sapiens
aaaatgtgttggttc

SEQ ID NO: 405877 - DNA, 15 bp, Homo sapiens
aaatgtgttggttct

SEQ ID NO: 405878 - DNA, 15 bp, Homo sapiens
aatgtgttggttctg

SEQ ID NO: 405879 - DNA, 15 bp, Homo sapiens
atgtgttggttctgt

SEQ ID NO: 405880 - DNA, 15 bp, Homo sapiens
tgtgttggttctgtg

SEQ ID NO: 405881 - DNA, 15 bp, Homo sapiens
gtgttggttctgtga

SEQ ID NO: 405882 - DNA, 15 bp, Homo sapiens
tgttggttctgtgat

SEQ ID NO: 405883 - DNA, 15 bp, Homo sapiens
gttggttctgtgata

SEQ ID NO: 405884 - DNA, 15 bp, Homo sapiens
ttggttctgtgatac

SEQ ID NO: 405885 - DNA, 15 bp, Homo sapiens
tggttctgtgataca

SEQ ID NO: 405886 - DNA, 15 bp, Homo sapiens
ggttctgtgatacaa

SEQ ID NO: 405887 - DNA, 15 bp, Homo sapiens
gttctgtgatacaag

SEQ ID NO: 405888 - DNA, 15 bp, Homo sapiens
ttctgtgatacaaga

SEQ ID NO: 405889 - DNA, 15 bp, Homo sapiens
tctgtgatacaagag

SEQ ID NO: 405890 - DNA, 15 bp, Homo sapiens
ctgtgatacaagagg

SEQ ID NO: 405891 - DNA, 15 bp, Homo sapiens
tgtgatacaagagga

SEQ ID NO: 405892 - DNA, 15 bp, Homo sapiens
gtgatacaagaggaa

SEQ ID NO: 405893 - DNA, 15 bp, Homo sapiens
tgatacaagaggaag

SEQ ID NO: 405894 - DNA, 15 bp, Homo sapiens
gatacaagaggaagc

SEQ ID NO: 405895 - DNA, 15 bp, Homo sapiens
atacaagaggaagct

SEQ ID NO: 405896 - DNA, 15 bp, Homo sapiens
tacaagaggaagcta

SEQ ID NO: 405897 - DNA, 15 bp, Homo sapiens
acaagaggaagctaa

SEQ ID NO: 405898 - DNA, 15 bp, Homo sapiens
caagaggaagctaag

SEQ ID NO: 405899 - DNA, 15 bp, Homo sapiens
aagaggaagctaaga

SEQ ID NO: 405900 - DNA, 15 bp, Homo sapiens
agaggaagctaagac

SEQ ID NO: 405901 - DNA, 15 bp, Homo sapiens
gaggaagctaagaca

SEQ ID NO: 405902 - DNA, 15 bp, Homo sapiens
aggaagctaagacat

SEQ ID NO: 405903 - DNA, 15 bp, Homo sapiens
ggaagctaagacata

SEQ ID NO: 405904 - DNA, 15 bp, Homo sapiens
gaagctaagacatat

SEQ ID NO: 405905 - DNA, 15 bp, Homo sapiens
aagctaagacatatc

SEQ ID NO: 405906 - DNA, 15 bp, Homo sapiens
agctaagacatatcg

SEQ ID NO: 405907 - DNA, 15 bp, Homo sapiens
gctaagacatatcgt

SEQ ID NO: 405908 - DNA, 15 bp, Homo sapiens
ctaagacatatcgtg

SEQ ID NO: 405909 - DNA, 15 bp, Homo sapiens
taagacatatcgtgg

SEQ ID NO: 405910 - DNA, 15 bp, Homo sapiens
aagacatatcgtgga

SEQ ID NO: 405911 - DNA, 15 bp, Homo sapiens
agacatatcgtggaa

SEQ ID NO: 405912 - DNA, 15 bp, Homo sapiens
gacatatcgtggaaa

SEQ ID NO: 405913 - DNA, 15 bp, Homo sapiens
acatatcgtggaaac

SEQ ID NO: 405914 - DNA, 15 bp, Homo sapiens
catatcgtggaaaca

SEQ ID NO: 405915 - DNA, 15 bp, Homo sapiens
atatcgtggaaacat

SEQ ID NO: 405916 - DNA, 15 bp, Homo sapiens
tatcgtggaaacatc

SEQ ID NO: 405917 - DNA, 15 bp, Homo sapiens
atcgtggaaacatct

SEQ ID NO: 405918 - DNA, 15 bp, Homo sapiens
tcgtggaaacatctc

SEQ ID NO: 405919 - DNA, 15 bp, Homo sapiens
cgtggaaacatctcc

SEQ ID NO: 405920 - DNA, 15 bp, Homo sapiens
gtggaaacatctccc

SEQ ID NO: 405921 - DNA, 15 bp, Homo sapiens
tggaaacatctcccc

SEQ ID NO: 405922 - DNA, 15 bp, Homo sapiens
ggaaacatctccccc

SEQ ID NO: 405923 - DNA, 15 bp, Homo sapiens
gaaacatctcccccc

SEQ ID NO: 405924 - DNA, 15 bp, Homo sapiens
aaacatctcccccct

SEQ ID NO: 405925 - DNA, 15 bp, Homo sapiens
aacatctcccccctc

SEQ ID NO: 405926 - DNA, 15 bp, Homo sapiens
acatctcccccctcc

SEQ ID NO: 405927 - DNA, 15 bp, Homo sapiens
catctcccccctcca

SEQ ID NO: 405928 - DNA, 15 bp, Homo sapiens
atctcccccctccac

SEQ ID NO: 405929 - DNA, 15 bp, Homo sapiens
tctcccccctccacc

SEQ ID NO: 405930 - DNA, 15 bp, Homo sapiens
ctcccccctccacct

SEQ ID NO: 405931 - DNA, 15 bp, Homo sapiens
tcccccctccacctt

SEQ ID NO: 405932 - DNA, 15 bp, Homo sapiens
cccccctccacctta

SEQ ID NO: 405933 - DNA, 15 bp, Homo sapiens
ccccctccaccttaa

SEQ ID NO: 405934 - DNA, 15 bp, Homo sapiens
cccctccaccttaat

SEQ ID NO: 405935 - DNA, 15 bp, Homo sapiens
ccctccaccttaata

SEQ ID NO: 405936 - DNA, 15 bp, Homo sapiens
cctccaccttaatat

SEQ ID NO: 405937 - DNA, 15 bp, Homo sapiens
ctccaccttaatatc

SEQ ID NO: 405938 - DNA, 15 bp, Homo sapiens
tccaccttaatatca

SEQ ID NO: 405939 - DNA, 15 bp, Homo sapiens
ccaccttaatatcaa

SEQ ID NO: 405940 - DNA, 15 bp, Homo sapiens
caccttaatatcaag

SEQ ID NO: 405941 - DNA, 15 bp, Homo sapiens
accttaatatcaaga

SEQ ID NO: 405942 - DNA, 15 bp, Homo sapiens
ccttaatatcaagaa

SEQ ID NO: 405943 - DNA, 15 bp, Homo sapiens
cttaatatcaagaac

SEQ ID NO: 405944 - DNA, 15 bp, Homo sapiens
ttaatatcaagaaca

SEQ ID NO: 405945 - DNA, 15 bp, Homo sapiens
taatatcaagaacaa

SEQ ID NO: 405946 - DNA, 15 bp, Homo sapiens
aatatcaagaacaaa

SEQ ID NO: 405947 - DNA, 15 bp, Homo sapiens
atatcaagaacaaat

SEQ ID NO: 405948 - DNA, 15 bp, Homo sapiens
tatcaagaacaaatt

SEQ ID NO: 405949 - DNA, 15 bp, Homo sapiens
atcaagaacaaattg

SEQ ID NO: 405950 - DNA, 15 bp, Homo sapiens
tcaagaacaaattgt

SEQ ID NO: 405951 - DNA, 15 bp, Homo sapiens
caagaacaaattgtg

SEQ ID NO: 405952 - DNA, 15 bp, Homo sapiens
aagaacaaattgtgg

SEQ ID NO: 405953 - DNA, 15 bp, Homo sapiens
agaacaaattgtgga

SEQ ID NO: 405954 - DNA, 15 bp, Homo sapiens
gaacaaattgtggaa

SEQ ID NO: 405955 - DNA, 15 bp, Homo sapiens
aacaaattgtggaat

SEQ ID NO: 405956 - DNA, 15 bp, Homo sapiens
acaaattgtggaatc

SEQ ID NO: 405957 - DNA, 15 bp, Homo sapiens
caaattgtggaatct

SEQ ID NO: 405958 - DNA, 15 bp, Homo sapiens
aaattgtggaatcta

SEQ ID NO: 405959 - DNA, 15 bp, Homo sapiens
aattgtggaatctaa

SEQ ID NO: 405960 - DNA, 15 bp, Homo sapiens
attgtggaatctaat

SEQ ID NO: 405961 - DNA, 15 bp, Homo sapiens
ttgtggaatctaatg

SEQ ID NO: 405962 - DNA, 15 bp, Homo sapiens
tgtggaatctaatgt

SEQ ID NO: 405963 - DNA, 15 bp, Homo sapiens
gtggaatctaatgtt

SEQ ID NO: 405964 - DNA, 15 bp, Homo sapiens
tggaatctaatgtta

SEQ ID NO: 405965 - DNA, 15 bp, Homo sapiens
ggaatctaatgttaa

SEQ ID NO: 405966 - DNA, 15 bp, Homo sapiens
gaatctaatgttaat

SEQ ID NO: 405967 - DNA, 15 bp, Homo sapiens
aatctaatgttaatg

SEQ ID NO: 405968 - DNA, 15 bp, Homo sapiens
atctaatgttaatga

SEQ ID NO: 405969 - DNA, 15 bp, Homo sapiens
tctaatgttaatgag

SEQ ID NO: 405970 - DNA, 15 bp, Homo sapiens
ctaatgttaatgaga

SEQ ID NO: 405971 - DNA, 15 bp, Homo sapiens
taatgttaatgagaa

SEQ ID NO: 405972 - DNA, 15 bp, Homo sapiens
aatgttaatgagaag

SEQ ID NO: 405973 - DNA, 15 bp, Homo sapiens
atgttaatgagaagt

SEQ ID NO: 405974 - DNA, 15 bp, Homo sapiens
tgttaatgagaagta

SEQ ID NO: 405975 - DNA, 15 bp, Homo sapiens
gttaatgagaagtag

SEQ ID NO: 405976 - DNA, 15 bp, Homo sapiens
ttaatgagaagtagt

SEQ ID NO: 405977 - DNA, 15 bp, Homo sapiens
taatgagaagtagtt

SEQ ID NO: 405978 - DNA, 15 bp, Homo sapiens
aatgagaagtagttc

SEQ ID NO: 405979 - DNA, 15 bp, Homo sapiens
atgagaagtagttcc

SEQ ID NO: 405980 - DNA, 15 bp, Homo sapiens
tgagaagtagttccc

SEQ ID NO: 405981 - DNA, 15 bp, Homo sapiens
gagaagtagttcccc

SEQ ID NO: 405982 - DNA, 15 bp, Homo sapiens
agaagtagttcccca

SEQ ID NO: 405983 - DNA, 15 bp, Homo sapiens
gaagtagttccccac

SEQ ID NO: 405984 - DNA, 15 bp, Homo sapiens
aagtagttccccact

SEQ ID NO: 405985 - DNA, 15 bp, Homo sapiens
agtagttccccactg

SEQ ID NO: 405986 - DNA, 15 bp, Homo sapiens
gtagttccccactgt

SEQ ID NO: 405987 - DNA, 15 bp, Homo sapiens
tagttccccactgtg

SEQ ID NO: 405988 - DNA, 15 bp, Homo sapiens
agttccccactgtgt

SEQ ID NO: 405989 - DNA, 15 bp, Homo sapiens
gttccccactgtgtc

SEQ ID NO: 405990 - DNA, 15 bp, Homo sapiens
ttccccactgtgtca

SEQ ID NO: 405991 - DNA, 15 bp, Homo sapiens
tccccactgtgtcag

SEQ ID NO: 405992 - DNA, 15 bp, Homo sapiens
ccccactgtgtcaga

SEQ ID NO: 405993 - DNA, 15 bp, Homo sapiens
cccactgtgtcagat

SEQ ID NO: 405994 - DNA, 15 bp, Homo sapiens
ccactgtgtcagatg

SEQ ID NO: 405995 - DNA, 15 bp, Homo sapiens
cactgtgtcagatgc

SEQ ID NO: 405996 - DNA, 15 bp, Homo sapiens
actgtgtcagatgcg

SEQ ID NO: 405997 - DNA, 15 bp, Homo sapiens
ctgtgtcagatgcgc

SEQ ID NO: 405998 - DNA, 15 bp, Homo sapiens
tgtgtcagatgcgca

SEQ ID NO: 405999 - DNA, 15 bp, Homo sapiens
gtgtcagatgcgcaa

SEQ ID NO: 406000 - DNA, 15 bp, Homo sapiens
tgtcagatgcgcaaa

SEQ ID NO: 406001 - DNA, 15 bp, Homo sapiens
gtcagatgcgcaaag

SEQ ID NO: 406002 - DNA, 15 bp, Homo sapiens
tcagatgcgcaaaga

SEQ ID NO: 406003 - DNA, 15 bp, Homo sapiens
cagatgcgcaaagag

SEQ ID NO: 406004 - DNA, 15 bp, Homo sapiens
agatgcgcaaagaga

SEQ ID NO: 406005 - DNA, 15 bp, Homo sapiens
gatgcgcaaagagaa

SEQ ID NO: 406006 - DNA, 15 bp, Homo sapiens
atgcgcaaagagaaa

SEQ ID NO: 406007 - DNA, 15 bp, Homo sapiens
tgcgcaaagagaaat

SEQ ID NO: 406008 - DNA, 15 bp, Homo sapiens
gcgcaaagagaaatt

SEQ ID NO: 406009 - DNA, 15 bp, Homo sapiens
cgcaaagagaaattg

SEQ ID NO: 406010 - DNA, 15 bp, Homo sapiens
gcaaagagaaattgg

SEQ ID NO: 406011 - DNA, 15 bp, Homo sapiens
caaagagaaattgga

SEQ ID NO: 406012 - DNA, 15 bp, Homo sapiens
aaagagaaattggaa

SEQ ID NO: 406013 - DNA, 15 bp, Homo sapiens
aagagaaattggaat

SEQ ID NO: 406014 - DNA, 15 bp, Homo sapiens
agagaaattggaata

SEQ ID NO: 406015 - DNA, 15 bp, Homo sapiens
gagaaattggaatat

SEQ ID NO: 406016 - DNA, 15 bp, Homo sapiens
agaaattggaatata

SEQ ID NO: 406017 - DNA, 15 bp, Homo sapiens
gaaattggaatatac

SEQ ID NO: 406018 - DNA, 15 bp, Homo sapiens
aaattggaatatact

SEQ ID NO: 406019 - DNA, 15 bp, Homo sapiens
aattggaatatactt

SEQ ID NO: 406020 - DNA, 15 bp, Homo sapiens
attggaatatactta

SEQ ID NO: 406021 - DNA, 15 bp, Homo sapiens
ttggaatatacttat

SEQ ID NO: 406022 - DNA, 15 bp, Homo sapiens
tggaatatacttatc

SEQ ID NO: 406023 - DNA, 15 bp, Homo sapiens
ggaatatacttatca

SEQ ID NO: 406024 - DNA, 15 bp, Homo sapiens
gaatatacttatcaa

SEQ ID NO: 406025 - DNA, 15 bp, Homo sapiens
aatatacttatcaag

SEQ ID NO: 406026 - DNA, 15 bp, Homo sapiens
atatacttatcaagt

SEQ ID NO: 406027 - DNA, 15 bp, Homo sapiens
tatacttatcaagta

SEQ ID NO: 406028 - DNA, 15 bp, Homo sapiens
atacttatcaagtat

SEQ ID NO: 406029 - DNA, 15 bp, Homo sapiens
tacttatcaagtata

SEQ ID NO: 406030 - DNA, 15 bp, Homo sapiens
acttatcaagtatat

SEQ ID NO: 406031 - DNA, 15 bp, Homo sapiens
cttatcaagtatatt

SEQ ID NO: 406032 - DNA, 15 bp, Homo sapiens
ttatcaagtatatta

SEQ ID NO: 406033 - DNA, 15 bp, Homo sapiens
tatcaagtatattat

SEQ ID NO: 406034 - DNA, 15 bp, Homo sapiens
atcaagtatattata

SEQ ID NO: 406035 - DNA, 15 bp, Homo sapiens
tcaagtatattatag

SEQ ID NO: 406036 - DNA, 15 bp, Homo sapiens
caagtatattataga

SEQ ID NO: 406037 - DNA, 15 bp, Homo sapiens
aagtatattatagat

SEQ ID NO: 406038 - DNA, 15 bp, Homo sapiens
agtatattatagatg

SEQ ID NO: 406039 - DNA, 15 bp, Homo sapiens
gtatattatagatgg

SEQ ID NO: 406040 - DNA, 15 bp, Homo sapiens
tatattatagatgga

SEQ ID NO: 406041 - DNA, 15 bp, Homo sapiens
atattatagatggaa

SEQ ID NO: 406042 - DNA, 15 bp, Homo sapiens
tattatagatggaat

SEQ ID NO: 406043 - DNA, 15 bp, Homo sapiens
attatagatggaatt

SEQ ID NO: 406044 - DNA, 15 bp, Homo sapiens
ttatagatggaattg

SEQ ID NO: 406045 - DNA, 15 bp, Homo sapiens
tatagatggaattga

SEQ ID NO: 406046 - DNA, 15 bp, Homo sapiens
atagatggaattgaa

SEQ ID NO: 406047 - DNA, 15 bp, Homo sapiens
tagatggaattgaat

SEQ ID NO: 406048 - DNA, 15 bp, Homo sapiens
agatggaattgaatt

SEQ ID NO: 406049 - DNA, 15 bp, Homo sapiens
gatggaattgaatta

SEQ ID NO: 406050 - DNA, 15 bp, Homo sapiens
atggaattgaattat

SEQ ID NO: 406051 - DNA, 15 bp, Homo sapiens
tggaattgaattatt

SEQ ID NO: 406052 - DNA, 15 bp, Homo sapiens
ggaattgaattattg

SEQ ID NO: 406053 - DNA, 15 bp, Homo sapiens
gaattgaattattgt

SEQ ID NO: 406054 - DNA, 15 bp, Homo sapiens
aattgaattattgta

SEQ ID NO: 406055 - DNA, 15 bp, Homo sapiens
attgaattattgtaa

SEQ ID NO: 406056 - DNA, 15 bp, Homo sapiens
ttgaattattgtaaa

SEQ ID NO: 406057 - DNA, 15 bp, Homo sapiens
tgaattattgtaaag

SEQ ID NO: 406058 - DNA, 15 bp, Homo sapiens
gaattattgtaaaga

SEQ ID NO: 406059 - DNA, 15 bp, Homo sapiens
aattattgtaaagag

SEQ ID NO: 406060 - DNA, 15 bp, Homo sapiens
attattgtaaagagt

SEQ ID NO: 406061 - DNA, 15 bp, Homo sapiens
ttattgtaaagagta

SEQ ID NO: 406062 - DNA, 15 bp, Homo sapiens
tattgtaaagagtag

SEQ ID NO: 406063 - DNA, 15 bp, Homo sapiens
attgtaaagagtaga

SEQ ID NO: 406064 - DNA, 15 bp, Homo sapiens
ttgtaaagagtagat

SEQ ID NO: 406065 - DNA, 15 bp, Homo sapiens
tgtaaagagtagatt

SEQ ID NO: 406066 - DNA, 15 bp, Homo sapiens
gtaaagagtagatta

SEQ ID NO: 406067 - DNA, 15 bp, Homo sapiens
taaagagtagattag

SEQ ID NO: 406068 - DNA, 15 bp, Homo sapiens
aaagagtagattaga

SEQ ID NO: 406069 - DNA, 15 bp, Homo sapiens
aagagtagattagag

SEQ ID NO: 406070 - DNA, 15 bp, Homo sapiens
agagtagattagaga

SEQ ID NO: 406071 - DNA, 15 bp, Homo sapiens
gagtagattagagag

SEQ ID NO: 406072 - DNA, 15 bp, Homo sapiens
agtagattagagagg

SEQ ID NO: 406073 - DNA, 15 bp, Homo sapiens
gtagattagagagga

SEQ ID NO: 406074 - DNA, 15 bp, Homo sapiens
tagattagagaggac

SEQ ID NO: 406075 - DNA, 15 bp, Homo sapiens
agattagagaggacc

SEQ ID NO: 406076 - DNA, 15 bp, Homo sapiens
gattagagaggaccg

SEQ ID NO: 406077 - DNA, 15 bp, Homo sapiens
attagagaggaccgc

SEQ ID NO: 406078 - DNA, 15 bp, Homo sapiens
ttagagaggaccgcc

SEQ ID NO: 406079 - DNA, 15 bp, Homo sapiens
tagagaggaccgcca

SEQ ID NO: 406080 - DNA, 15 bp, Homo sapiens
agagaggaccgccaa

SEQ ID NO: 406081 - DNA, 15 bp, Homo sapiens
gagaggaccgccaaa

SEQ ID NO: 406082 - DNA, 15 bp, Homo sapiens
agaggaccgccaaag

SEQ ID NO: 406083 - DNA, 15 bp, Homo sapiens
gaggaccgccaaagt

SEQ ID NO: 406084 - DNA, 15 bp, Homo sapiens
aggaccgccaaagtc

SEQ ID NO: 406085 - DNA, 15 bp, Homo sapiens
ggaccgccaaagtcc

SEQ ID NO: 406086 - DNA, 15 bp, Homo sapiens
gaccgccaaagtcca

SEQ ID NO: 406087 - DNA, 15 bp, Homo sapiens
accgccaaagtccag

SEQ ID NO: 406088 - DNA, 15 bp, Homo sapiens
ccgccaaagtccagt

SEQ ID NO: 406089 - DNA, 15 bp, Homo sapiens
cgccaaagtccagtc

SEQ ID NO: 406090 - DNA, 15 bp, Homo sapiens
gccaaagtccagtcc

SEQ ID NO: 406091 - DNA, 15 bp, Homo sapiens
ccaaagtccagtccc

SEQ ID NO: 406092 - DNA, 15 bp, Homo sapiens
caaagtccagtccca

SEQ ID NO: 406093 - DNA, 15 bp, Homo sapiens
aaagtccagtcccaa

SEQ ID NO: 406094 - DNA, 15 bp, Homo sapiens
aagtccagtcccaaa

SEQ ID NO: 406095 - DNA, 15 bp, Homo sapiens
agtccagtcccaaac

SEQ ID NO: 406096 - DNA, 15 bp, Homo sapiens
gtccagtcccaaaca

SEQ ID NO: 406097 - DNA, 15 bp, Homo sapiens
tccagtcccaaacat

SEQ ID NO: 406098 - DNA, 15 bp, Homo sapiens
ccagtcccaaacatg

SEQ ID NO: 406099 - DNA, 15 bp, Homo sapiens
cagtcccaaacatga

SEQ ID NO: 406100 - DNA, 15 bp, Homo sapiens
agtcccaaacatgat

SEQ ID NO: 406101 - DNA, 15 bp, Homo sapiens
gtcccaaacatgata

SEQ ID NO: 406102 - DNA, 15 bp, Homo sapiens
tcccaaacatgatac

SEQ ID NO: 406103 - DNA, 15 bp, Homo sapiens
cccaaacatgataca

SEQ ID NO: 406104 - DNA, 15 bp, Homo sapiens
ccaaacatgatacat

SEQ ID NO: 406105 - DNA, 15 bp, Homo sapiens
caaacatgatacatt

SEQ ID NO: 406106 - DNA, 15 bp, Homo sapiens
aaacatgatacatta

SEQ ID NO: 406107 - DNA, 15 bp, Homo sapiens
aacatgatacattaa

SEQ ID NO: 406108 - DNA, 15 bp, Homo sapiens
acatgatacattaag

SEQ ID NO: 406109 - DNA, 15 bp, Homo sapiens
catgatacattaagt

SEQ ID NO: 406110 - DNA, 15 bp, Homo sapiens
atgatacattaagtg

SEQ ID NO: 406111 - DNA, 15 bp, Homo sapiens
tgatacattaagtgt

SEQ ID NO: 406112 - DNA, 15 bp, Homo sapiens
gatacattaagtgta

SEQ ID NO: 406113 - DNA, 15 bp, Homo sapiens
atacattaagtgtat

SEQ ID NO: 406114 - DNA, 15 bp, Homo sapiens
tacattaagtgtatc

SEQ ID NO: 406115 - DNA, 15 bp, Homo sapiens
acattaagtgtatcc

SEQ ID NO: 406116 - DNA, 15 bp, Homo sapiens
cattaagtgtatccc

SEQ ID NO: 406117 - DNA, 15 bp, Homo sapiens
attaagtgtatccct

SEQ ID NO: 406118 - DNA, 15 bp, Homo sapiens
ttaagtgtatccctt

SEQ ID NO: 406119 - DNA, 15 bp, Homo sapiens
taagtgtatccctta

SEQ ID NO: 406120 - DNA, 15 bp, Homo sapiens
aagtgtatcccttag

SEQ ID NO: 406121 - DNA, 15 bp, Homo sapiens
agtgtatcccttagt

SEQ ID NO: 406122 - DNA, 15 bp, Homo sapiens
gtgtatcccttagta

SEQ ID NO: 406123 - DNA, 15 bp, Homo sapiens
tgtatcccttagtat

SEQ ID NO: 406124 - DNA, 15 bp, Homo sapiens
gtatcccttagtata

SEQ ID NO: 406125 - DNA, 15 bp, Homo sapiens
tatcccttagtataa

SEQ ID NO: 406126 - DNA, 15 bp, Homo sapiens
atcccttagtataat

SEQ ID NO: 406127 - DNA, 15 bp, Homo sapiens
tcccttagtataata

SEQ ID NO: 406128 - DNA, 15 bp, Homo sapiens
cccttagtataatac

SEQ ID NO: 406129 - DNA, 15 bp, Homo sapiens
ccttagtataatacc

SEQ ID NO: 406130 - DNA, 15 bp, Homo sapiens
cttagtataatacca

SEQ ID NO: 406131 - DNA, 15 bp, Homo sapiens
ttagtataataccaa

SEQ ID NO: 406132 - DNA, 15 bp, Homo sapiens
tagtataataccaag

SEQ ID NO: 406133 - DNA, 15 bp, Homo sapiens
agtataataccaagg

SEQ ID NO: 406134 - DNA, 15 bp, Homo sapiens
gtataataccaagga

SEQ ID NO: 406135 - DNA, 15 bp, Homo sapiens
tataataccaaggaa

SEQ ID NO: 406136 - DNA, 15 bp, Homo sapiens
ataataccaaggaac

SEQ ID NO: 406137 - DNA, 15 bp, Homo sapiens
taataccaaggaacc

SEQ ID NO: 406138 - DNA, 15 bp, Homo sapiens
aataccaaggaaccc

SEQ ID NO: 406139 - DNA, 15 bp, Homo sapiens
ataccaaggaacccc

SEQ ID NO: 406140 - DNA, 15 bp, Homo sapiens
taccaaggaacccca

SEQ ID NO: 406141 - DNA, 15 bp, Homo sapiens
accaaggaaccccaa

SEQ ID NO: 406142 - DNA, 15 bp, Homo sapiens
ccaaggaaccccaaa

SEQ ID NO: 406143 - DNA, 15 bp, Homo sapiens
caaggaaccccaaaa

SEQ ID NO: 406144 - DNA, 15 bp, Homo sapiens
aaggaaccccaaaag

SEQ ID NO: 406145 - DNA, 15 bp, Homo sapiens
aggaaccccaaaagc

SEQ ID NO: 406146 - DNA, 15 bp, Homo sapiens
ggaaccccaaaagct

SEQ ID NO: 406147 - DNA, 15 bp, Homo sapiens
gaaccccaaaagctt

SEQ ID NO: 406148 - DNA, 15 bp, Homo sapiens
aaccccaaaagcttt

SEQ ID NO: 406149 - DNA, 15 bp, Homo sapiens
accccaaaagcttta

SEQ ID NO: 406150 - DNA, 15 bp, Homo sapiens
ccccaaaagctttac

SEQ ID NO: 406151 - DNA, 15 bp, Homo sapiens
cccaaaagctttaca

SEQ ID NO: 406152 - DNA, 15 bp, Homo sapiens
ccaaaagctttacag

SEQ ID NO: 406153 - DNA, 15 bp, Homo sapiens
caaaagctttacagt

SEQ ID NO: 406154 - DNA, 15 bp, Homo sapiens
aaaagctttacagtg

SEQ ID NO: 406155 - DNA, 15 bp, Homo sapiens
aaagctttacagtgt

SEQ ID NO: 406156 - DNA, 15 bp, Homo sapiens
aagctttacagtgtc

SEQ ID NO: 406157 - DNA, 15 bp, Homo sapiens
agctttacagtgtct

SEQ ID NO: 406158 - DNA, 15 bp, Homo sapiens
gctttacagtgtcta

SEQ ID NO: 406159 - DNA, 15 bp, Homo sapiens
ctttacagtgtctaa

SEQ ID NO: 406160 - DNA, 15 bp, Homo sapiens
tttacagtgtctaaa

SEQ ID NO: 406161 - DNA, 15 bp, Homo sapiens
ttacagtgtctaaac

SEQ ID NO: 406162 - DNA, 15 bp, Homo sapiens
tacagtgtctaaact

SEQ ID NO: 406163 - DNA, 15 bp, Homo sapiens
acagtgtctaaactc

SEQ ID NO: 406164 - DNA, 15 bp, Homo sapiens
cagtgtctaaactct

SEQ ID NO: 406165 - DNA, 15 bp, Homo sapiens
agtgtctaaactcta

SEQ ID NO: 406166 - DNA, 15 bp, Homo sapiens
gtgtctaaactctat

SEQ ID NO: 406167 - DNA, 15 bp, Homo sapiens
tgtctaaactctatt

SEQ ID NO: 406168 - DNA, 15 bp, Homo sapiens
gtctaaactctattt

SEQ ID NO: 406169 - DNA, 15 bp, Homo sapiens
tctaaactctatttt

SEQ ID NO: 406170 - DNA, 15 bp, Homo sapiens
ctaaactctatttta

SEQ ID NO: 406171 - DNA, 15 bp, Homo sapiens
taaactctattttac

SEQ ID NO: 406172 - DNA, 15 bp, Homo sapiens
aaactctattttacg

SEQ ID NO: 406173 - DNA, 15 bp, Homo sapiens
aactctattttacgt

SEQ ID NO: 406174 - DNA, 15 bp, Homo sapiens
actctattttacgtc

SEQ ID NO: 406175 - DNA, 15 bp, Homo sapiens
ctctattttacgtct

SEQ ID NO: 406176 - DNA, 15 bp, Homo sapiens
tctattttacgtctt

SEQ ID NO: 406177 - DNA, 15 bp, Homo sapiens
ctattttacgtcttc

SEQ ID NO: 406178 - DNA, 15 bp, Homo sapiens
tattttacgtcttcc

SEQ ID NO: 406179 - DNA, 15 bp, Homo sapiens
attttacgtcttcct

SEQ ID NO: 406180 - DNA, 15 bp, Homo sapiens
ttttacgtcttccta

SEQ ID NO: 406181 - DNA, 15 bp, Homo sapiens
tttacgtcttcctaa

SEQ ID NO: 406182 - DNA, 15 bp, Homo sapiens
ttacgtcttcctaaa

SEQ ID NO: 406183 - DNA, 15 bp, Homo sapiens
tacgtcttcctaaac

SEQ ID NO: 406184 - DNA, 15 bp, Homo sapiens
acgtcttcctaaact

SEQ ID NO: 406185 - DNA, 15 bp, Homo sapiens
cgtcttcctaaactg

SEQ ID NO: 406186 - DNA, 15 bp, Homo sapiens
gtcttcctaaactga

SEQ ID NO: 406187 - DNA, 15 bp, Homo sapiens
tcttcctaaactgat

SEQ ID NO: 406188 - DNA, 15 bp, Homo sapiens
cttcctaaactgata

SEQ ID NO: 406189 - DNA, 15 bp, Homo sapiens
ttcctaaactgatat

SEQ ID NO: 406190 - DNA, 15 bp, Homo sapiens
tcctaaactgatatc

SEQ ID NO: 406191 - DNA, 15 bp, Homo sapiens
cctaaactgatatcg

SEQ ID NO: 406192 - DNA, 15 bp, Homo sapiens
ctaaactgatatcgt

SEQ ID NO: 406193 - DNA, 15 bp, Homo sapiens
taaactgatatcgta

SEQ ID NO: 406194 - DNA, 15 bp, Homo sapiens
aaactgatatcgtac

SEQ ID NO: 406195 - DNA, 15 bp, Homo sapiens
aactgatatcgtaca

SEQ ID NO: 406196 - DNA, 15 bp, Homo sapiens
actgatatcgtacat

SEQ ID NO: 406197 - DNA, 15 bp, Homo sapiens
ctgatatcgtacatt

SEQ ID NO: 406198 - DNA, 15 bp, Homo sapiens
tgatatcgtacattc

SEQ ID NO: 406199 - DNA, 15 bp, Homo sapiens
gatatcgtacattca

SEQ ID NO: 406200 - DNA, 15 bp, Homo sapiens
atatcgtacattcaa

SEQ ID NO: 406201 - DNA, 15 bp, Homo sapiens
tatcgtacattcaat

SEQ ID NO: 406202 - DNA, 15 bp, Homo sapiens
atcgtacattcaatt

SEQ ID NO: 406203 - DNA, 15 bp, Homo sapiens
tcgtacattcaattt

SEQ ID NO: 406204 - DNA, 15 bp, Homo sapiens
cgtacattcaattta

SEQ ID NO: 406205 - DNA, 15 bp, Homo sapiens
gtacattcaatttat

SEQ ID NO: 406206 - DNA, 15 bp, Homo sapiens
tacattcaatttata

SEQ ID NO: 406207 - DNA, 15 bp, Homo sapiens
acattcaatttatat

SEQ ID NO: 406208 - DNA, 15 bp, Homo sapiens
cattcaatttatata

SEQ ID NO: 406209 - DNA, 15 bp, Homo sapiens
attcaatttatatat

SEQ ID NO: 406210 - DNA, 15 bp, Homo sapiens
ttcaatttatatatt

SEQ ID NO: 406211 - DNA, 15 bp, Homo sapiens
tcaatttatatattt

SEQ ID NO: 406212 - DNA, 15 bp, Homo sapiens
caatttatatatttc

SEQ ID NO: 406213 - DNA, 15 bp, Homo sapiens
aatttatatatttct

SEQ ID NO: 406214 - DNA, 15 bp, Homo sapiens
atttatatatttctg

SEQ ID NO: 406215 - DNA, 15 bp, Homo sapiens
tttatatatttctgt

SEQ ID NO: 406216 - DNA, 15 bp, Homo sapiens
ttatatatttctgta

SEQ ID NO: 406217 - DNA, 15 bp, Homo sapiens
tatatatttctgtac

SEQ ID NO: 406218 - DNA, 15 bp, Homo sapiens
atatatttctgtact

SEQ ID NO: 406219 - DNA, 15 bp, Homo sapiens
tatatttctgtacta

SEQ ID NO: 406220 - DNA, 15 bp, Homo sapiens
atatttctgtactaa

SEQ ID NO: 406221 - DNA, 15 bp, Homo sapiens
tatttctgtactaag

SEQ ID NO: 406222 - DNA, 15 bp, Homo sapiens
atttctgtactaaga

SEQ ID NO: 406223 - DNA, 15 bp, Homo sapiens
tttctgtactaagat

SEQ ID NO: 406224 - DNA, 15 bp, Homo sapiens
ttctgtactaagatc

SEQ ID NO: 406225 - DNA, 15 bp, Homo sapiens
tctgtactaagatca

SEQ ID NO: 406226 - DNA, 15 bp, Homo sapiens
ctgtactaagatcat

SEQ ID NO: 406227 - DNA, 15 bp, Homo sapiens
tgtactaagatcatg

SEQ ID NO: 406228 - DNA, 15 bp, Homo sapiens
gtactaagatcatga

SEQ ID NO: 406229 - DNA, 15 bp, Homo sapiens
tactaagatcatgaa

SEQ ID NO: 406230 - DNA, 15 bp, Homo sapiens
actaagatcatgaat

SEQ ID NO: 406231 - DNA, 15 bp, Homo sapiens
ctaagatcatgaatt

SEQ ID NO: 406232 - DNA, 15 bp, Homo sapiens
taagatcatgaattt

SEQ ID NO: 406233 - DNA, 15 bp, Homo sapiens
aagatcatgaattta

SEQ ID NO: 406234 - DNA, 15 bp, Homo sapiens
agatcatgaatttag

SEQ ID NO: 406235 - DNA, 15 bp, Homo sapiens
gatcatgaatttaga

SEQ ID NO: 406236 - DNA, 15 bp, Homo sapiens
atcatgaatttagag

SEQ ID NO: 406237 - DNA, 15 bp, Homo sapiens
tcatgaatttagagt

SEQ ID NO: 406238 - DNA, 15 bp, Homo sapiens
catgaatttagagtt

SEQ ID NO: 406239 - DNA, 15 bp, Homo sapiens
atgaatttagagttt

SEQ ID NO: 406240 - DNA, 15 bp, Homo sapiens
tgaatttagagttta

SEQ ID NO: 406241 - DNA, 15 bp, Homo sapiens
gaatttagagtttat

SEQ ID NO: 406242 - DNA, 15 bp, Homo sapiens
aatttagagtttatt

SEQ ID NO: 406243 - DNA, 15 bp, Homo sapiens
atttagagtttattg

SEQ ID NO: 406244 - DNA, 15 bp, Homo sapiens
tttagagtttattga

SEQ ID NO: 406245 - DNA, 15 bp, Homo sapiens
ttagagtttattgag

SEQ ID NO: 406246 - DNA, 15 bp, Homo sapiens
tagagtttattgaga

SEQ ID NO: 406247 - DNA, 15 bp, Homo sapiens
agagtttattgagaa

SEQ ID NO: 406248 - DNA, 15 bp, Homo sapiens
gagtttattgagaaa

SEQ ID NO: 406249 - DNA, 15 bp, Homo sapiens
agtttattgagaaat

SEQ ID NO: 406250 - DNA, 15 bp, Homo sapiens
gtttattgagaaatt

SEQ ID NO: 406251 - DNA, 15 bp, Homo sapiens
tttattgagaaattg

SEQ ID NO: 406252 - DNA, 15 bp, Homo sapiens
ttattgagaaattgc

SEQ ID NO: 406253 - DNA, 15 bp, Homo sapiens
tattgagaaattgcc

SEQ ID NO: 406254 - DNA, 15 bp, Homo sapiens
attgagaaattgcca

SEQ ID NO: 406255 - DNA, 15 bp, Homo sapiens
ttgagaaattgccag

SEQ ID NO: 406256 - DNA, 15 bp, Homo sapiens
tgagaaattgccaga

SEQ ID NO: 406257 - DNA, 15 bp, Homo sapiens
gagaaattgccagaa

SEQ ID NO: 406258 - DNA, 15 bp, Homo sapiens
agaaattgccagaaa

SEQ ID NO: 406259 - DNA, 15 bp, Homo sapiens
gaaattgccagaaaa

SEQ ID NO: 406260 - DNA, 15 bp, Homo sapiens
aaattgccagaaaaa

SEQ ID NO: 406261 - DNA, 15 bp, Homo sapiens
aattgccagaaaaaa

SEQ ID NO: 406262 - DNA, 15 bp, Homo sapiens
attgccagaaaaaaa

SEQ ID NO: 406263 - DNA, 15 bp, Homo sapiens
ttgccagaaaaaaat

SEQ ID NO: 406264 - DNA, 15 bp, Homo sapiens
tgccagaaaaaaatg

SEQ ID NO: 406265 - DNA, 15 bp, Homo sapiens
gccagaaaaaaatgt

SEQ ID NO: 406266 - DNA, 15 bp, Homo sapiens
ccagaaaaaaatgtg

SEQ ID NO: 406267 - DNA, 15 bp, Homo sapiens
cagaaaaaaatgtgt

SEQ ID NO: 406268 - DNA, 15 bp, Homo sapiens
agaaaaaaatgtgtt

SEQ ID NO: 406269 - DNA, 15 bp, Homo sapiens
gaaaaaaatgtgtta

SEQ ID NO: 406270 - DNA, 15 bp, Homo sapiens
aaaaaaatgtgttaa

SEQ ID NO: 406271 - DNA, 15 bp, Homo sapiens
aaaaaatgtgttaag

SEQ ID NO: 406272 - DNA, 15 bp, Homo sapiens
aaaaatgtgttaagt

SEQ ID NO: 406273 - DNA, 15 bp, Homo sapiens
aaaatgtgttaagtt

SEQ ID NO: 406274 - DNA, 15 bp, Homo sapiens
aaatgtgttaagttt

SEQ ID NO: 406275 - DNA, 15 bp, Homo sapiens
aatgtgttaagtttt

SEQ ID NO: 406276 - DNA, 15 bp, Homo sapiens
atgtgttaagttttt

SEQ ID NO: 406277 - DNA, 15 bp, Homo sapiens
tgtgttaagttttta

SEQ ID NO: 406278 - DNA, 15 bp, Homo sapiens
gtgttaagtttttat

SEQ ID NO: 406279 - DNA, 15 bp, Homo sapiens
tgttaagtttttatc

SEQ ID NO: 406280 - DNA, 15 bp, Homo sapiens
gttaagtttttatcc

SEQ ID NO: 406281 - DNA, 15 bp, Homo sapiens
ttaagtttttatccc

SEQ ID NO: 406282 - DNA, 15 bp, Homo sapiens
taagtttttatccct

SEQ ID NO: 406283 - DNA, 15 bp, Homo sapiens
aagtttttatccctt

SEQ ID NO: 406284 - DNA, 15 bp, Homo sapiens
agtttttatccctta

SEQ ID NO: 406285 - DNA, 15 bp, Homo sapiens
gtttttatcccttaa

SEQ ID NO: 406286 - DNA, 15 bp, Homo sapiens
tttttatcccttaaa

SEQ ID NO: 406287 - DNA, 15 bp, Homo sapiens
ttttatcccttaaag

SEQ ID NO: 406288 - DNA, 15 bp, Homo sapiens
tttatcccttaaaga

SEQ ID NO: 406289 - DNA, 15 bp, Homo sapiens
ttatcccttaaagag

SEQ ID NO: 406290 - DNA, 15 bp, Homo sapiens
tatcccttaaagagt

SEQ ID NO: 406291 - DNA, 15 bp, Homo sapiens
atcccttaaagagta

SEQ ID NO: 406292 - DNA, 15 bp, Homo sapiens
tcccttaaagagtat

SEQ ID NO: 406293 - DNA, 15 bp, Homo sapiens
cccttaaagagtatc

SEQ ID NO: 406294 - DNA, 15 bp, Homo sapiens
ccttaaagagtatct

SEQ ID NO: 406295 - DNA, 15 bp, Homo sapiens
cttaaagagtatctc

SEQ ID NO: 406296 - DNA, 15 bp, Homo sapiens
ttaaagagtatctca

SEQ ID NO: 406297 - DNA, 15 bp, Homo sapiens
taaagagtatctcat

SEQ ID NO: 406298 - DNA, 15 bp, Homo sapiens
aaagagtatctcata

SEQ ID NO: 406299 - DNA, 15 bp, Homo sapiens
aagagtatctcataa

SEQ ID NO: 406300 - DNA, 15 bp, Homo sapiens
agagtatctcataac

SEQ ID NO: 406301 - DNA, 15 bp, Homo sapiens
gagtatctcataact

SEQ ID NO: 406302 - DNA, 15 bp, Homo sapiens
agtatctcataactt

SEQ ID NO: 406303 - DNA, 15 bp, Homo sapiens
gtatctcataactta

SEQ ID NO: 406304 - DNA, 15 bp, Homo sapiens
tatctcataacttac

SEQ ID NO: 406305 - DNA, 15 bp, Homo sapiens
atctcataacttaca

SEQ ID NO: 406306 - DNA, 15 bp, Homo sapiens
tctcataacttacag

SEQ ID NO: 406307 - DNA, 15 bp, Homo sapiens
ctcataacttacaga

SEQ ID NO: 406308 - DNA, 15 bp, Homo sapiens
tcataacttacagat

SEQ ID NO: 406309 - DNA, 15 bp, Homo sapiens
cataacttacagatt

SEQ ID NO: 406310 - DNA, 15 bp, Homo sapiens
ataacttacagattt

SEQ ID NO: 406311 - DNA, 15 bp, Homo sapiens
taacttacagatttg

SEQ ID NO: 406312 - DNA, 15 bp, Homo sapiens
aacttacagatttga

SEQ ID NO: 406313 - DNA, 15 bp, Homo sapiens
acttacagatttgag

SEQ ID NO: 406314 - DNA, 15 bp, Homo sapiens
cttacagatttgagc

SEQ ID NO: 406315 - DNA, 15 bp, Homo sapiens
ttacagatttgagca

SEQ ID NO: 406316 - DNA, 15 bp, Homo sapiens
tacagatttgagcag

SEQ ID NO: 406317 - DNA, 15 bp, Homo sapiens
acagatttgagcagg

SEQ ID NO: 406318 - DNA, 15 bp, Homo sapiens
cagatttgagcaggg

SEQ ID NO: 406319 - DNA, 15 bp, Homo sapiens
agatttgagcaggga

SEQ ID NO: 406320 - DNA, 15 bp, Homo sapiens
gatttgagcagggag

SEQ ID NO: 406321 - DNA, 15 bp, Homo sapiens
atttgagcagggagg

SEQ ID NO: 406322 - DNA, 15 bp, Homo sapiens
tttgagcagggaggt

SEQ ID NO: 406323 - DNA, 15 bp, Homo sapiens
ttgagcagggaggta

SEQ ID NO: 406324 - DNA, 15 bp, Homo sapiens
tgagcagggaggtat

SEQ ID NO: 406325 - DNA, 15 bp, Homo sapiens
gagcagggaggtata

SEQ ID NO: 406326 - DNA, 15 bp, Homo sapiens
agcagggaggtatat

SEQ ID NO: 406327 - DNA, 15 bp, Homo sapiens
gcagggaggtatata

SEQ ID NO: 406328 - DNA, 15 bp, Homo sapiens
cagggaggtatataa

SEQ ID NO: 406329 - DNA, 15 bp, Homo sapiens
agggaggtatataat

SEQ ID NO: 406330 - DNA, 15 bp, Homo sapiens
gggaggtatataatc

SEQ ID NO: 406331 - DNA, 15 bp, Homo sapiens
ggaggtatataatca

SEQ ID NO: 406332 - DNA, 15 bp, Homo sapiens
gaggtatataatcag

SEQ ID NO: 406333 - DNA, 15 bp, Homo sapiens
aggtatataatcagg

SEQ ID NO: 406334 - DNA, 15 bp, Homo sapiens
ggtatataatcagga

SEQ ID NO: 406335 - DNA, 15 bp, Homo sapiens
gtatataatcaggag

SEQ ID NO: 406336 - DNA, 15 bp, Homo sapiens
tatataatcaggagt

SEQ ID NO: 406337 - DNA, 15 bp, Homo sapiens
atataatcaggagta

SEQ ID NO: 406338 - DNA, 15 bp, Homo sapiens
tataatcaggagtac

SEQ ID NO: 406339 - DNA, 15 bp, Homo sapiens
ataatcaggagtaca

SEQ ID NO: 406340 - DNA, 15 bp, Homo sapiens
taatcaggagtacag

SEQ ID NO: 406341 - DNA, 15 bp, Homo sapiens
aatcaggagtacagt

SEQ ID NO: 406342 - DNA, 15 bp, Homo sapiens
atcaggagtacagtt

SEQ ID NO: 406343 - DNA, 15 bp, Homo sapiens
tcaggagtacagttt

SEQ ID NO: 406344 - DNA, 15 bp, Homo sapiens
caggagtacagttta

SEQ ID NO: 406345 - DNA, 15 bp, Homo sapiens
aggagtacagtttat

SEQ ID NO: 406346 - DNA, 15 bp, Homo sapiens
ggagtacagtttatg

SEQ ID NO: 406347 - DNA, 15 bp, Homo sapiens
gagtacagtttatgt

SEQ ID NO: 406348 - DNA, 15 bp, Homo sapiens
agtacagtttatgtt

SEQ ID NO: 406349 - DNA, 15 bp, Homo sapiens
gtacagtttatgttt

SEQ ID NO: 406350 - DNA, 15 bp, Homo sapiens
tacagtttatgtttg

SEQ ID NO: 406351 - DNA, 15 bp, Homo sapiens
acagtttatgtttgt

SEQ ID NO: 406352 - DNA, 15 bp, Homo sapiens
cagtttatgtttgtt

SEQ ID NO: 406353 - DNA, 15 bp, Homo sapiens
agtttatgtttgttt

SEQ ID NO: 406354 - DNA, 15 bp, Homo sapiens
gtttatgtttgttta

SEQ ID NO: 406355 - DNA, 15 bp, Homo sapiens
tttatgtttgtttat

SEQ ID NO: 406356 - DNA, 15 bp, Homo sapiens
ttatgtttgtttatt

SEQ ID NO: 406357 - DNA, 15 bp, Homo sapiens
tatgtttgtttattc

SEQ ID NO: 406358 - DNA, 15 bp, Homo sapiens
atgtttgtttattca

SEQ ID NO: 406359 - DNA, 15 bp, Homo sapiens
tgtttgtttattcaa

SEQ ID NO: 406360 - DNA, 15 bp, Homo sapiens
gtttgtttattcaaa

SEQ ID NO: 406361 - DNA, 15 bp, Homo sapiens
tttgtttattcaaag

SEQ ID NO: 406362 - DNA, 15 bp, Homo sapiens
ttgtttattcaaagc

SEQ ID NO: 406363 - DNA, 15 bp, Homo sapiens
tgtttattcaaagct

SEQ ID NO: 406364 - DNA, 15 bp, Homo sapiens
gtttattcaaagctc

SEQ ID NO: 406365 - DNA, 15 bp, Homo sapiens
tttattcaaagctct

SEQ ID NO: 406366 - DNA, 15 bp, Homo sapiens
ttattcaaagctctg

SEQ ID NO: 406367 - DNA, 15 bp, Homo sapiens
tattcaaagctctga

SEQ ID NO: 406368 - DNA, 15 bp, Homo sapiens
attcaaagctctgat

SEQ ID NO: 406369 - DNA, 15 bp, Homo sapiens
ttcaaagctctgatc

SEQ ID NO: 406370 - DNA, 15 bp, Homo sapiens
tcaaagctctgatct

SEQ ID NO: 406371 - DNA, 15 bp, Homo sapiens
caaagctctgatctc

SEQ ID NO: 406372 - DNA, 15 bp, Homo sapiens
aaagctctgatctca

SEQ ID NO: 406373 - DNA, 15 bp, Homo sapiens
aagctctgatctcat

SEQ ID NO: 406374 - DNA, 15 bp, Homo sapiens
agctctgatctcatg

SEQ ID NO: 406375 - DNA, 15 bp, Homo sapiens
gctctgatctcatga

SEQ ID NO: 406376 - DNA, 15 bp, Homo sapiens
ctctgatctcatgaa

SEQ ID NO: 406377 - DNA, 15 bp, Homo sapiens
tctgatctcatgaaa

SEQ ID NO: 406378 - DNA, 15 bp, Homo sapiens
ctgatctcatgaaaa

SEQ ID NO: 406379 - DNA, 15 bp, Homo sapiens
tgatctcatgaaaat

SEQ ID NO: 406380 - DNA, 15 bp, Homo sapiens
gatctcatgaaaatt

SEQ ID NO: 406381 - DNA, 15 bp, Homo sapiens
atctcatgaaaattg

SEQ ID NO: 406382 - DNA, 15 bp, Homo sapiens
tctcatgaaaattgc

SEQ ID NO: 406383 - DNA, 15 bp, Homo sapiens
ctcatgaaaattgct

SEQ ID NO: 406384 - DNA, 15 bp, Homo sapiens
tcatgaaaattgcta

SEQ ID NO: 406385 - DNA, 15 bp, Homo sapiens
catgaaaattgctat

SEQ ID NO: 406386 - DNA, 15 bp, Homo sapiens
atgaaaattgctata

SEQ ID NO: 406387 - DNA, 15 bp, Homo sapiens
tgaaaattgctatat

SEQ ID NO: 406388 - DNA, 15 bp, Homo sapiens
gaaaattgctatata

SEQ ID NO: 406389 - DNA, 15 bp, Homo sapiens
aaaattgctatataa

SEQ ID NO: 406390 - DNA, 15 bp, Homo sapiens
aaattgctatataaa

SEQ ID NO: 406391 - DNA, 15 bp, Homo sapiens
aattgctatataaat

SEQ ID NO: 406392 - DNA, 15 bp, Homo sapiens
attgctatataaatg

SEQ ID NO: 406393 - DNA, 15 bp, Homo sapiens
ttgctatataaatgc

SEQ ID NO: 406394 - DNA, 15 bp, Homo sapiens
tgctatataaatgct

SEQ ID NO: 406395 - DNA, 15 bp, Homo sapiens
gctatataaatgctt

SEQ ID NO: 406396 - DNA, 15 bp, Homo sapiens
ctatataaatgcttg

SEQ ID NO: 406397 - DNA, 15 bp, Homo sapiens
tatataaatgcttgt

SEQ ID NO: 406398 - DNA, 15 bp, Homo sapiens
atataaatgcttgtt

SEQ ID NO: 406399 - DNA, 15 bp, Homo sapiens
tataaatgcttgttt

SEQ ID NO: 406400 - DNA, 15 bp, Homo sapiens
ataaatgcttgtttt

SEQ ID NO: 406401 - DNA, 15 bp, Homo sapiens
taaatgcttgtttta

SEQ ID NO: 406402 - DNA, 15 bp, Homo sapiens
aaatgcttgttttaa

SEQ ID NO: 406403 - DNA, 15 bp, Homo sapiens
aatgcttgttttaac

SEQ ID NO: 406404 - DNA, 15 bp, Homo sapiens
atgcttgttttaaca

SEQ ID NO: 406405 - DNA, 15 bp, Homo sapiens
tgcttgttttaacaa

SEQ ID NO: 406406 - DNA, 15 bp, Homo sapiens
gcttgttttaacaac

SEQ ID NO: 406407 - DNA, 15 bp, Homo sapiens
cttgttttaacaact

SEQ ID NO: 406408 - DNA, 15 bp, Homo sapiens
ttgttttaacaactg

SEQ ID NO: 406409 - DNA, 15 bp, Homo sapiens
tgttttaacaactgt

SEQ ID NO: 406410 - DNA, 15 bp, Homo sapiens
gttttaacaactgtt

SEQ ID NO: 406411 - DNA, 15 bp, Homo sapiens
ttttaacaactgtta

SEQ ID NO: 406412 - DNA, 15 bp, Homo sapiens
tttaacaactgttat

SEQ ID NO: 406413 - DNA, 15 bp, Homo sapiens
ttaacaactgttatt

SEQ ID NO: 406414 - DNA, 15 bp, Homo sapiens
taacaactgttatta

SEQ ID NO: 406415 - DNA, 15 bp, Homo sapiens
aacaactgttattat

SEQ ID NO: 406416 - DNA, 15 bp, Homo sapiens
acaactgttattatt

SEQ ID NO: 406417 - DNA, 15 bp, Homo sapiens
caactgttattatta

SEQ ID NO: 406418 - DNA, 15 bp, Homo sapiens
aactgttattattag

SEQ ID NO: 406419 - DNA, 15 bp, Homo sapiens
actgttattattagg

SEQ ID NO: 406420 - DNA, 15 bp, Homo sapiens
ctgttattattaggg

SEQ ID NO: 406421 - DNA, 15 bp, Homo sapiens
tgttattattagggg

SEQ ID NO: 406422 - DNA, 15 bp, Homo sapiens
gttattattaggggt

SEQ ID NO: 406423 - DNA, 15 bp, Homo sapiens
ttattattaggggtt

SEQ ID NO: 406424 - DNA, 15 bp, Homo sapiens
tattattaggggttt

SEQ ID NO: 406425 - DNA, 15 bp, Homo sapiens
attattaggggtttg

SEQ ID NO: 406426 - DNA, 15 bp, Homo sapiens
ttattaggggtttgt

SEQ ID NO: 406427 - DNA, 15 bp, Homo sapiens
tattaggggtttgta

SEQ ID NO: 406428 - DNA, 15 bp, Homo sapiens
attaggggtttgtat

SEQ ID NO: 406429 - DNA, 15 bp, Homo sapiens
ttaggggtttgtatg

SEQ ID NO: 406430 - DNA, 15 bp, Homo sapiens
taggggtttgtatga

SEQ ID NO: 406431 - DNA, 15 bp, Homo sapiens
aggggtttgtatgaa

SEQ ID NO: 406432 - DNA, 15 bp, Homo sapiens
ggggtttgtatgaaa

SEQ ID NO: 406433 - DNA, 15 bp, Homo sapiens
gggtttgtatgaaag

SEQ ID NO: 406434 - DNA, 15 bp, Homo sapiens
ggtttgtatgaaagt

SEQ ID NO: 406435 - DNA, 15 bp, Homo sapiens
gtttgtatgaaagtc

SEQ ID NO: 406436 - DNA, 15 bp, Homo sapiens
tttgtatgaaagtct

SEQ ID NO: 406437 - DNA, 15 bp, Homo sapiens
ttgtatgaaagtctg

SEQ ID NO: 406438 - DNA, 15 bp, Homo sapiens
tgtatgaaagtctgc

SEQ ID NO: 406439 - DNA, 15 bp, Homo sapiens
gtatgaaagtctgcc

SEQ ID NO: 406440 - DNA, 15 bp, Homo sapiens
tatgaaagtctgcca

SEQ ID NO: 406441 - DNA, 15 bp, Homo sapiens
atgaaagtctgccaa

SEQ ID NO: 406442 - DNA, 15 bp, Homo sapiens
tgaaagtctgccaac

SEQ ID NO: 406443 - DNA, 15 bp, Homo sapiens
gaaagtctgccaact

SEQ ID NO: 406444 - DNA, 15 bp, Homo sapiens
aaagtctgccaactt

SEQ ID NO: 406445 - DNA, 15 bp, Homo sapiens
aagtctgccaacttg

SEQ ID NO: 406446 - DNA, 15 bp, Homo sapiens
agtctgccaacttgg

SEQ ID NO: 406447 - DNA, 15 bp, Homo sapiens
gtctgccaacttggt

SEQ ID NO: 406448 - DNA, 15 bp, Homo sapiens
tctgccaacttggtc

SEQ ID NO: 406449 - DNA, 15 bp, Homo sapiens
ctgccaacttggtcc

SEQ ID NO: 406450 - DNA, 15 bp, Homo sapiens
tgccaacttggtccc

SEQ ID NO: 406451 - DNA, 15 bp, Homo sapiens
gccaacttggtccca

SEQ ID NO: 406452 - DNA, 15 bp, Homo sapiens
ccaacttggtcccaa

SEQ ID NO: 406453 - DNA, 15 bp, Homo sapiens
caacttggtcccaat

SEQ ID NO: 406454 - DNA, 15 bp, Homo sapiens
aacttggtcccaata

SEQ ID NO: 406455 - DNA, 15 bp, Homo sapiens
acttggtcccaatat

SEQ ID NO: 406456 - DNA, 15 bp, Homo sapiens
cttggtcccaatatt

SEQ ID NO: 406457 - DNA, 15 bp, Homo sapiens
ttggtcccaatattt

SEQ ID NO: 406458 - DNA, 15 bp, Homo sapiens
tggtcccaatattta

SEQ ID NO: 406459 - DNA, 15 bp, Homo sapiens
ggtcccaatatttat

SEQ ID NO: 406460 - DNA, 15 bp, Homo sapiens
tcccaatatttatat

SEQ ID NO: 406461 - DNA, 15 bp, Homo sapiens
cccaatatttatatt

SEQ ID NO: 406462 - DNA, 15 bp, Homo sapiens
ccaatatttatatta

SEQ ID NO: 406463 - DNA, 15 bp, Homo sapiens
caatatttatattat

SEQ ID NO: 406464 - DNA, 15 bp, Homo sapiens
aatatttatattata

SEQ ID NO: 406465 - DNA, 15 bp, Homo sapiens
atatttatattataa

SEQ ID NO: 406466 - DNA, 15 bp, Homo sapiens
tatttatattataaa

SEQ ID NO: 406467 - DNA, 15 bp, Homo sapiens
atttatattataaat

SEQ ID NO: 406468 - DNA, 15 bp, Homo sapiens
tttatattataaatt

SEQ ID NO: 406469 - DNA, 15 bp, Homo sapiens
ttatattataaatta

SEQ ID NO: 406470 - DNA, 15 bp, Homo sapiens
tatattataaattaa

SEQ ID NO: 406471 - DNA, 15 bp, Homo sapiens
atattataaattaaa

SEQ ID NO: 406472 - DNA, 15 bp, Homo sapiens
tattataaattaaaa

SEQ ID NO: 406473 - DNA, 15 bp, Homo sapiens
attataaattaaaat

SEQ ID NO: 406474 - DNA, 15 bp, Homo sapiens
ttataaattaaaatg

SEQ ID NO: 406475 - DNA, 15 bp, Homo sapiens
tataaattaaaatgt

SEQ ID NO: 406476 - DNA, 15 bp, Homo sapiens
ataaattaaaatgtt

SEQ ID NO: 406477 - DNA, 15 bp, Homo sapiens
aattaaaatgttttg

SEQ ID NO: 406478 - DNA, 15 bp, Homo sapiens
attaaaatgttttga

SEQ ID NO: 406479 - DNA, 15 bp, Homo sapiens
ttaaaatgttttgaa

SEQ ID NO: 406480 - DNA, 15 bp, Homo sapiens
taaaatgttttgaaa

SEQ ID NO: 406481 - DNA, 15 bp, Homo sapiens
aaaatgttttgaaaa

SEQ ID NO: 406482 - DNA, 15 bp, Homo sapiens
aaatgttttgaaaag

SEQ ID NO: 406483 - DNA, 15 bp, Homo sapiens
aatgttttgaaaaga

SEQ ID NO: 406484 - DNA, 15 bp, Homo sapiens
atgttttgaaaagaa

SEQ ID NO: 406485 - DNA, 15 bp, Homo sapiens
tgttttgaaaagaac

SEQ ID NO: 406486 - DNA, 15 bp, Homo sapiens
gttttgaaaagaact

SEQ ID NO: 406487 - DNA, 15 bp, Homo sapiens
ttttgaaaagaactg

SEQ ID NO: 406488 - DNA, 15 bp, Homo sapiens
tttgaaaagaactgc

SEQ ID NO: 406489 - DNA, 15 bp, Homo sapiens
ttgaaaagaactgct

SEQ ID NO: 406490 - DNA, 15 bp, Homo sapiens
tgaaaagaactgctt

SEQ ID NO: 406491 - DNA, 15 bp, Homo sapiens
gaaaagaactgcttc

SEQ ID NO: 406492 - DNA, 15 bp, Homo sapiens
aaaagaactgcttct

SEQ ID NO: 406493 - DNA, 15 bp, Homo sapiens
aaagaactgcttctc

SEQ ID NO: 406494 - DNA, 15 bp, Homo sapiens
aagaactgcttctca

SEQ ID NO: 406495 - DNA, 15 bp, Homo sapiens
agaactgcttctcaa

SEQ ID NO: 406496 - DNA, 15 bp, Homo sapiens
gaactgcttctcaac

SEQ ID NO: 406497 - DNA, 15 bp, Homo sapiens
aactgcttctcaact

SEQ ID NO: 406498 - DNA, 15 bp, Homo sapiens
actgcttctcaactg

SEQ ID NO: 406499 - DNA, 15 bp, Homo sapiens
ctgcttctcaactgt

SEQ ID NO: 406500 - DNA, 15 bp, Homo sapiens
tgcttctcaactgtg

SEQ ID NO: 406501 - DNA, 15 bp, Homo sapiens
gcttctcaactgtga

SEQ ID NO: 406502 - DNA, 15 bp, Homo sapiens
cttctcaactgtgat

SEQ ID NO: 406503 - DNA, 15 bp, Homo sapiens
ttctcaactgtgatc

SEQ ID NO: 406504 - DNA, 15 bp, Homo sapiens
tctcaactgtgatcc

SEQ ID NO: 406505 - DNA, 15 bp, Homo sapiens
ctcaactgtgatcct

SEQ ID NO: 406506 - DNA, 15 bp, Homo sapiens
tcaactgtgatcctc

SEQ ID NO: 406507 - DNA, 15 bp, Homo sapiens
caactgtgatcctca

SEQ ID NO: 406508 - DNA, 15 bp, Homo sapiens
aactgtgatcctcat

SEQ ID NO: 406509 - DNA, 15 bp, Homo sapiens
actgtgatcctcatt

SEQ ID NO: 406510 - DNA, 15 bp, Homo sapiens
ctgtgatcctcattg

SEQ ID NO: 406511 - DNA, 15 bp, Homo sapiens
tgtgatcctcattgt

SEQ ID NO: 406512 - DNA, 15 bp, Homo sapiens
gtgatcctcattgtt

SEQ ID NO: 406513 - DNA, 15 bp, Homo sapiens
tgatcctcattgttt

SEQ ID NO: 406514 - DNA, 15 bp, Homo sapiens
gatcctcattgtttt

SEQ ID NO: 406515 - DNA, 15 bp, Homo sapiens
atcctcattgttttt

SEQ ID NO: 406516 - DNA, 15 bp, Homo sapiens
tcctcattgtttttg

SEQ ID NO: 406517 - DNA, 15 bp, Homo sapiens
cctcattgtttttga

SEQ ID NO: 406518 - DNA, 15 bp, Homo sapiens
ctcattgtttttgaa

SEQ ID NO: 406519 - DNA, 15 bp, Homo sapiens
tcattgtttttgaaa

SEQ ID NO: 406520 - DNA, 15 bp, Homo sapiens
cattgtttttgaaac

SEQ ID NO: 406521 - DNA, 15 bp, Homo sapiens
attgtttttgaaacc

SEQ ID NO: 406522 - DNA, 15 bp, Homo sapiens
ttgtttttgaaacct

SEQ ID NO: 406523 - DNA, 15 bp, Homo sapiens
tgtttttgaaaccta

SEQ ID NO: 406524 - DNA, 15 bp, Homo sapiens
gtttttgaaacctaa

SEQ ID NO: 406525 - DNA, 15 bp, Homo sapiens
tttttgaaacctaaa

SEQ ID NO: 406526 - DNA, 15 bp, Homo sapiens
ttttgaaacctaaaa

SEQ ID NO: 406527 - DNA, 15 bp, Homo sapiens
tttgaaacctaaaat

SEQ ID NO: 406528 - DNA, 15 bp, Homo sapiens
ttgaaacctaaaata

SEQ ID NO: 406529 - DNA, 15 bp, Homo sapiens
tgaaacctaaaatat

SEQ ID NO: 406530 - DNA, 15 bp, Homo sapiens
gaaacctaaaatata

SEQ ID NO: 406531 - DNA, 15 bp, Homo sapiens
aaacctaaaatatac

SEQ ID NO: 406532 - DNA, 15 bp, Homo sapiens
aacctaaaatatact

SEQ ID NO: 406533 - DNA, 15 bp, Homo sapiens
acctaaaatatacta

SEQ ID NO: 406534 - DNA, 15 bp, Homo sapiens
cctaaaatatactaa

SEQ ID NO: 406535 - DNA, 15 bp, Homo sapiens
ctaaaatatactaat

SEQ ID NO: 406536 - DNA, 15 bp, Homo sapiens
taaaatatactaatt

SEQ ID NO: 406537 - DNA, 15 bp, Homo sapiens
aaaatatactaattt

SEQ ID NO: 406538 - DNA, 15 bp, Homo sapiens
aaatatactaatttt

SEQ ID NO: 406539 - DNA, 15 bp, Homo sapiens
aatatactaattttt

SEQ ID NO: 406540 - DNA, 15 bp, Homo sapiens
atatactaattttta

SEQ ID NO: 406541 - DNA, 15 bp, Homo sapiens
tatactaatttttaa

SEQ ID NO: 406542 - DNA, 15 bp, Homo sapiens
atactaatttttaat

SEQ ID NO: 406543 - DNA, 15 bp, Homo sapiens
tactaatttttaatt

SEQ ID NO: 406544 - DNA, 15 bp, Homo sapiens
actaatttttaattt

SEQ ID NO: 406545 - DNA, 15 bp, Homo sapiens
ctaatttttaatttt

SEQ ID NO: 406546 - DNA, 15 bp, Homo sapiens
taatttttaattttt

SEQ ID NO: 406547 - DNA, 15 bp, Homo sapiens
aatttttaatttttg

SEQ ID NO: 406548 - DNA, 15 bp, Homo sapiens
atttttaatttttgt

SEQ ID NO: 406549 - DNA, 15 bp, Homo sapiens
tttttaatttttgta

SEQ ID NO: 406550 - DNA, 15 bp, Homo sapiens
ttttaatttttgtag

SEQ ID NO: 406551 - DNA, 15 bp, Homo sapiens
tttaatttttgtagt

SEQ ID NO: 406552 - DNA, 15 bp, Homo sapiens
ttaatttttgtagtt

SEQ ID NO: 406553 - DNA, 15 bp, Homo sapiens
taatttttgtagttg

SEQ ID NO: 406554 - DNA, 15 bp, Homo sapiens
aatttttgtagttga

SEQ ID NO: 406555 - DNA, 15 bp, Homo sapiens
atttttgtagttgaa

SEQ ID NO: 406556 - DNA, 15 bp, Homo sapiens
tttttgtagttgaaa

SEQ ID NO: 406557 - DNA, 15 bp, Homo sapiens
ttttgtagttgaaat

SEQ ID NO: 406558 - DNA, 15 bp, Homo sapiens
tttgtagttgaaata

SEQ ID NO: 406559 - DNA, 15 bp, Homo sapiens
ttgtagttgaaatag

SEQ ID NO: 406560 - DNA, 15 bp, Homo sapiens
tgtagttgaaatagt

SEQ ID NO: 406561 - DNA, 15 bp, Homo sapiens
gtagttgaaatagtt

SEQ ID NO: 406562 - DNA, 15 bp, Homo sapiens
tagttgaaatagttt

SEQ ID NO: 406563 - DNA, 15 bp, Homo sapiens
agttgaaatagtttt

SEQ ID NO: 406564 - DNA, 15 bp, Homo sapiens
gttgaaatagttttt

SEQ ID NO: 406565 - DNA, 15 bp, Homo sapiens
ttgaaatagttttta

SEQ ID NO: 406566 - DNA, 15 bp, Homo sapiens
tgaaatagtttttaa

SEQ ID NO: 406567 - DNA, 15 bp, Homo sapiens
gaaatagtttttaat

SEQ ID NO: 406568 - DNA, 15 bp, Homo sapiens
aaatagtttttaatg

SEQ ID NO: 406569 - DNA, 15 bp, Homo sapiens
aatagtttttaatgc

SEQ ID NO: 406570 - DNA, 15 bp, Homo sapiens
atagtttttaatgcc

SEQ ID NO: 406571 - DNA, 15 bp, Homo sapiens
tagtttttaatgcca

SEQ ID NO: 406572 - DNA, 15 bp, Homo sapiens
agtttttaatgccag

SEQ ID NO: 406573 - DNA, 15 bp, Homo sapiens
gtttttaatgccagc

SEQ ID NO: 406574 - DNA, 15 bp, Homo sapiens
tttttaatgccagca

SEQ ID NO: 406575 - DNA, 15 bp, Homo sapiens
ttttaatgccagcag

SEQ ID NO: 406576 - DNA, 15 bp, Homo sapiens
tttaatgccagcagt

SEQ ID NO: 406577 - DNA, 15 bp, Homo sapiens
ttaatgccagcagtc

SEQ ID NO: 406578 - DNA, 15 bp, Homo sapiens
taatgccagcagtct

SEQ ID NO: 406579 - DNA, 15 bp, Homo sapiens
aatgccagcagtctt

SEQ ID NO: 406580 - DNA, 15 bp, Homo sapiens
atgccagcagtcttt

SEQ ID NO: 406581 - DNA, 15 bp, Homo sapiens
tgccagcagtctttt

SEQ ID NO: 406582 - DNA, 15 bp, Homo sapiens
gccagcagtcttttg

SEQ ID NO: 406583 - DNA, 15 bp, Homo sapiens
ccagcagtcttttgg

SEQ ID NO: 406584 - DNA, 15 bp, Homo sapiens
cagcagtcttttggt

SEQ ID NO: 406585 - DNA, 15 bp, Homo sapiens
agcagtcttttggtt

SEQ ID NO: 406586 - DNA, 15 bp, Homo sapiens
gcagtcttttggtta

SEQ ID NO: 406587 - DNA, 15 bp, Homo sapiens
cagtcttttggttat

SEQ ID NO: 406588 - DNA, 15 bp, Homo sapiens
agtcttttggttatc

SEQ ID NO: 406589 - DNA, 15 bp, Homo sapiens
gtcttttggttatca

SEQ ID NO: 406590 - DNA, 15 bp, Homo sapiens
tcttttggttatcag

SEQ ID NO: 406591 - DNA, 15 bp, Homo sapiens
cttttggttatcagt

SEQ ID NO: 406592 - DNA, 15 bp, Homo sapiens
ttttggttatcagtt

SEQ ID NO: 406593 - DNA, 15 bp, Homo sapiens
tttggttatcagttt

SEQ ID NO: 406594 - DNA, 15 bp, Homo sapiens
ttggttatcagtttc

SEQ ID NO: 406595 - DNA, 15 bp, Homo sapiens
tggttatcagtttca

SEQ ID NO: 406596 - DNA, 15 bp, Homo sapiens
ggttatcagtttcat

SEQ ID NO: 406597 - DNA, 15 bp, Homo sapiens
gttatcagtttcatt

SEQ ID NO: 406598 - DNA, 15 bp, Homo sapiens
ttatcagtttcattt

SEQ ID NO: 406599 - DNA, 15 bp, Homo sapiens
tatcagtttcatttg

SEQ ID NO: 406600 - DNA, 15 bp, Homo sapiens
atcagtttcatttga

SEQ ID NO: 406601 - DNA, 15 bp, Homo sapiens
tcagtttcatttgaa

SEQ ID NO: 406602 - DNA, 15 bp, Homo sapiens
cagtttcatttgaag

SEQ ID NO: 406603 - DNA, 15 bp, Homo sapiens
agtttcatttgaaga

SEQ ID NO: 406604 - DNA, 15 bp, Homo sapiens
gtttcatttgaagac

SEQ ID NO: 406605 - DNA, 15 bp, Homo sapiens
tttcatttgaagacc

SEQ ID NO: 406606 - DNA, 15 bp, Homo sapiens
ttcatttgaagacca

SEQ ID NO: 406607 - DNA, 15 bp, Homo sapiens
tcatttgaagaccag

SEQ ID NO: 406608 - DNA, 15 bp, Homo sapiens
catttgaagaccaga

SEQ ID NO: 406609 - DNA, 15 bp, Homo sapiens
atttgaagaccagaa

SEQ ID NO: 406610 - DNA, 15 bp, Homo sapiens
tttgaagaccagaag

SEQ ID NO: 406611 - DNA, 15 bp, Homo sapiens
ttgaagaccagaagt

SEQ ID NO: 406612 - DNA, 15 bp, Homo sapiens
tgaagaccagaagtt

SEQ ID NO: 406613 - DNA, 15 bp, Homo sapiens
gaagaccagaagttc

SEQ ID NO: 406614 - DNA, 15 bp, Homo sapiens
aagaccagaagttcc

SEQ ID NO: 406615 - DNA, 15 bp, Homo sapiens
agaccagaagttcct

SEQ ID NO: 406616 - DNA, 15 bp, Homo sapiens
gaccagaagttcctg

SEQ ID NO: 406617 - DNA, 15 bp, Homo sapiens
accagaagttcctga

SEQ ID NO: 406618 - DNA, 15 bp, Homo sapiens
ccagaagttcctgaa

SEQ ID NO: 406619 - DNA, 15 bp, Homo sapiens
cagaagttcctgaac

SEQ ID NO: 406620 - DNA, 15 bp, Homo sapiens
agaagttcctgaaca

SEQ ID NO: 406621 - DNA, 15 bp, Homo sapiens
gaagttcctgaacaa

SEQ ID NO: 406622 - DNA, 15 bp, Homo sapiens
aagttcctgaacaaa

SEQ ID NO: 406623 - DNA, 15 bp, Homo sapiens
agttcctgaacaaag

SEQ ID NO: 406624 - DNA, 15 bp, Homo sapiens
gttcctgaacaaaga

SEQ ID NO: 406625 - DNA, 15 bp, Homo sapiens
ttcctgaacaaagaa

SEQ ID NO: 406626 - DNA, 15 bp, Homo sapiens
tcctgaacaaagaat

SEQ ID NO: 406627 - DNA, 15 bp, Homo sapiens
cctgaacaaagaata

SEQ ID NO: 406628 - DNA, 15 bp, Homo sapiens
ctgaacaaagaatat

SEQ ID NO: 406629 - DNA, 15 bp, Homo sapiens
tgaacaaagaatatt

SEQ ID NO: 406630 - DNA, 15 bp, Homo sapiens
gaacaaagaatattt

SEQ ID NO: 406631 - DNA, 15 bp, Homo sapiens
aacaaagaatattta

SEQ ID NO: 406632 - DNA, 15 bp, Homo sapiens
acaaagaatatttat

SEQ ID NO: 406633 - DNA, 15 bp, Homo sapiens
caaagaatatttatt

SEQ ID NO: 406634 - DNA, 15 bp, Homo sapiens
aaagaatatttattt

SEQ ID NO: 406635 - DNA, 15 bp, Homo sapiens
aagaatatttatttc

SEQ ID NO: 406636 - DNA, 15 bp, Homo sapiens
agaatatttatttca

SEQ ID NO: 406637 - DNA, 15 bp, Homo sapiens
gaatatttatttcag

SEQ ID NO: 406638 - DNA, 15 bp, Homo sapiens
aatatttatttcaga

SEQ ID NO: 406639 - DNA, 15 bp, Homo sapiens
atatttatttcagat

SEQ ID NO: 406640 - DNA, 15 bp, Homo sapiens
tatttatttcagatt

SEQ ID NO: 406641 - DNA, 15 bp, Homo sapiens
atttatttcagatta

SEQ ID NO: 406642 - DNA, 15 bp, Homo sapiens
tttatttcagattaa

SEQ ID NO: 406643 - DNA, 15 bp, Homo sapiens
ttatttcagattaat

SEQ ID NO: 406644 - DNA, 15 bp, Homo sapiens
tatttcagattaata

SEQ ID NO: 406645 - DNA, 15 bp, Homo sapiens
atttcagattaataa

SEQ ID NO: 406646 - DNA, 15 bp, Homo sapiens
tttcagattaataag

SEQ ID NO: 406647 - DNA, 15 bp, Homo sapiens
ttcagattaataagt

SEQ ID NO: 406648 - DNA, 15 bp, Homo sapiens
tcagattaataagta

SEQ ID NO: 406649 - DNA, 15 bp, Homo sapiens
cagattaataagtaa

SEQ ID NO: 406650 - DNA, 15 bp, Homo sapiens
agattaataagtaaa

SEQ ID NO: 406651 - DNA, 15 bp, Homo sapiens
gattaataagtaaat

SEQ ID NO: 406652 - DNA, 15 bp, Homo sapiens
attaataagtaaata

SEQ ID NO: 406653 - DNA, 15 bp, Homo sapiens
ttaataagtaaataa

SEQ ID NO: 406654 - DNA, 15 bp, Homo sapiens
taataagtaaataaa

SEQ ID NO: 406655 - DNA, 15 bp, Homo sapiens
aataagtaaataaag

SEQ ID NO: 406656 - DNA, 15 bp, Homo sapiens
ataagtaaataaagt

SEQ ID NO: 406657 - DNA, 15 bp, Homo sapiens
taagtaaataaagtg

SEQ ID NO: 406658 - DNA, 15 bp, Homo sapiens
aagtaaataaagtga

SEQ ID NO: 406659 - DNA, 15 bp, Homo sapiens
agtaaataaagtgaa

SEQ ID NO: 406660 - DNA, 15 bp, Homo sapiens
gtaaataaagtgaaa

SEQ ID NO: 406661 - DNA, 15 bp, Homo sapiens
taaataaagtgaaat

SEQ ID NO: 406662 - DNA, 15 bp, Homo sapiens
aaataaagtgaaata

SEQ ID NO: 406663 - DNA, 15 bp, Homo sapiens
aataaagtgaaataa

SEQ ID NO: 406664 - DNA, 15 bp, Homo sapiens
ataaagtgaaataaa

SEQ ID NO: 406665 - DNA, 15 bp, Homo sapiens
taaagtgaaataaaa

SEQ ID NO: 406666 - DNA, 15 bp, Homo sapiens
aaagtgaaataaaag

SEQ ID NO: 406667 - DNA, 15 bp, Homo sapiens
aagtgaaataaaaga

SEQ ID NO: 406668 - DNA, 15 bp, Homo sapiens
agtgaaataaaagat

SEQ ID NO: 406669 - DNA, 15 bp, Homo sapiens
gtgaaataaaagatt

SEQ ID NO: 406670 - DNA, 15 bp, Homo sapiens
tgaaataaaagattt

SEQ ID NO: 406671 - DNA, 15 bp, Homo sapiens
gaaataaaagatttt

SEQ ID NO: 406672 - DNA, 15 bp, Homo sapiens
aaataaaagattttt

SEQ ID NO: 406673 - DNA, 15 bp, Homo sapiens
aataaaagatttttt

SEQ ID NO: 406674 - DNA, 15 bp, Homo sapiens
ataaaagattttttt

SEQ ID NO: 406675 - DNA, 15 bp, Homo sapiens
taaaagatttttttc

SEQ ID NO: 406676 - DNA, 15 bp, Homo sapiens
aaaagatttttttcc

SEQ ID NO: 406677 - DNA, 15 bp, Homo sapiens
aaagatttttttcct

SEQ ID NO: 406678 - DNA, 15 bp, Homo sapiens
aagatttttttcctt

SEQ ID NO: 406679 - DNA, 15 bp, Homo sapiens
agatttttttccttt

SEQ ID NO: 406680 - DNA, 15 bp, Homo sapiens
gatttttttcctttg

SEQ ID NO: 406681 - DNA, 15 bp, Homo sapiens
atttttttcctttga

SEQ ID NO: 406682 - DNA, 15 bp, Homo sapiens
tttttttcctttgaa

SEQ ID NO: 406683 - DNA, 15 bp, Homo sapiens
ttttttcctttgaaa

SEQ ID NO: 406684 - DNA, 15 bp, Homo sapiens
tttttcctttgaaat

SEQ ID NO: 406685 - DNA, 15 bp, Homo sapiens
ttttcctttgaaatt

SEQ ID NO: 406686 - DNA, 15 bp, Homo sapiens
tttcctttgaaattg

SEQ ID NO: 406687 - DNA, 15 bp, Homo sapiens
cctttgaaattgagg

SEQ ID NO: 406688 - DNA, 15 bp, Homo sapiens
ctttgaaattgagga

SEQ ID NO: 406689 - DNA, 15 bp, Homo sapiens
tttgaaattgaggaa

SEQ ID NO: 406690 - DNA, 15 bp, Homo sapiens
ttgaaattgaggaag

SEQ ID NO: 406691 - DNA, 15 bp, Homo sapiens
tgaaattgaggaaga

SEQ ID NO: 406692 - DNA, 15 bp, Homo sapiens
gaaattgaggaagat

SEQ ID NO: 406693 - DNA, 15 bp, Homo sapiens
aaattgaggaagatc

SEQ ID NO: 406694 - DNA, 15 bp, Homo sapiens
aattgaggaagatca

SEQ ID NO: 406695 - DNA, 15 bp, Homo sapiens
attgaggaagatcag

SEQ ID NO: 406696 - DNA, 15 bp, Homo sapiens
ttgaggaagatcagt

SEQ ID NO: 406697 - DNA, 15 bp, Homo sapiens
tgaggaagatcagtt

SEQ ID NO: 406698 - DNA, 15 bp, Homo sapiens
gaggaagatcagtta

SEQ ID NO: 406699 - DNA, 15 bp, Homo sapiens
aggaagatcagttat

SEQ ID NO: 406700 - DNA, 15 bp, Homo sapiens
ggaagatcagttatt

SEQ ID NO: 406701 - DNA, 15 bp, Homo sapiens
gaagatcagttatta

SEQ ID NO: 406702 - DNA, 15 bp, Homo sapiens
aagatcagttattag

SEQ ID NO: 406703 - DNA, 15 bp, Homo sapiens
agatcagttattagt

SEQ ID NO: 406704 - DNA, 15 bp, Homo sapiens
gatcagttattagta

SEQ ID NO: 406705 - DNA, 15 bp, Homo sapiens
atcagttattagtag

SEQ ID NO: 406706 - DNA, 15 bp, Homo sapiens
tcagttattagtagt

SEQ ID NO: 406707 - DNA, 15 bp, Homo sapiens
cagttattagtagta

SEQ ID NO: 406708 - DNA, 15 bp, Homo sapiens
agttattagtagtac

SEQ ID NO: 406709 - DNA, 15 bp, Homo sapiens
gttattagtagtaca

SEQ ID NO: 406710 - DNA, 15 bp, Homo sapiens
ttattagtagtacaa

SEQ ID NO: 406711 - DNA, 15 bp, Homo sapiens
tattagtagtacaaa

SEQ ID NO: 406712 - DNA, 15 bp, Homo sapiens
attagtagtacaaac

SEQ ID NO: 406713 - DNA, 15 bp, Homo sapiens
ttagtagtacaaact

SEQ ID NO: 406714 - DNA, 15 bp, Homo sapiens
tagtagtacaaactg

SEQ ID NO: 406715 - DNA, 15 bp, Homo sapiens
agtagtacaaactgt

SEQ ID NO: 406716 - DNA, 15 bp, Homo sapiens
gtagtacaaactgtg

SEQ ID NO: 406717 - DNA, 15 bp, Homo sapiens
tagtacaaactgtgc

SEQ ID NO: 406718 - DNA, 15 bp, Homo sapiens
agtacaaactgtgca

SEQ ID NO: 406719 - DNA, 15 bp, Homo sapiens
gtacaaactgtgcac

SEQ ID NO: 406720 - DNA, 15 bp, Homo sapiens
tacaaactgtgcact

SEQ ID NO: 406721 - DNA, 15 bp, Homo sapiens
acaaactgtgcacta

SEQ ID NO: 406722 - DNA, 15 bp, Homo sapiens
caaactgtgcactag

SEQ ID NO: 406723 - DNA, 15 bp, Homo sapiens
aaactgtgcactaga

SEQ ID NO: 406724 - DNA, 15 bp, Homo sapiens
aactgtgcactagat

SEQ ID NO: 406725 - DNA, 15 bp, Homo sapiens
actgtgcactagatt

SEQ ID NO: 406726 - DNA, 15 bp, Homo sapiens
ctgtgcactagattg

SEQ ID NO: 406727 - DNA, 15 bp, Homo sapiens
tgtgcactagattgt

SEQ ID NO: 406728 - DNA, 15 bp, Homo sapiens
gtgcactagattgta

SEQ ID NO: 406729 - DNA, 15 bp, Homo sapiens
tgcactagattgtat

SEQ ID NO: 406730 - DNA, 15 bp, Homo sapiens
gcactagattgtatc

SEQ ID NO: 406731 - DNA, 15 bp, Homo sapiens
cactagattgtatct

SEQ ID NO: 406732 - DNA, 15 bp, Homo sapiens
actagattgtatctt

SEQ ID NO: 406733 - DNA, 15 bp, Homo sapiens
ctagattgtatctta

SEQ ID NO: 406734 - DNA, 15 bp, Homo sapiens
tagattgtatcttag

SEQ ID NO: 406735 - DNA, 15 bp, Homo sapiens
agattgtatcttagg

SEQ ID NO: 406736 - DNA, 15 bp, Homo sapiens
gattgtatcttaggg

SEQ ID NO: 406737 - DNA, 15 bp, Homo sapiens
attgtatcttagggt

SEQ ID NO: 406738 - DNA, 15 bp, Homo sapiens
ttgtatcttagggtt

SEQ ID NO: 406739 - DNA, 15 bp, Homo sapiens
tgtatcttagggttc

SEQ ID NO: 406740 - DNA, 15 bp, Homo sapiens
gtatcttagggttcc

SEQ ID NO: 406741 - DNA, 15 bp, Homo sapiens
tatcttagggttcct

SEQ ID NO: 406742 - DNA, 15 bp, Homo sapiens
atcttagggttccta

SEQ ID NO: 406743 - DNA, 15 bp, Homo sapiens
tcttagggttcctaa

SEQ ID NO: 406744 - DNA, 15 bp, Homo sapiens
cttagggttcctaac

SEQ ID NO: 406745 - DNA, 15 bp, Homo sapiens
ttagggttcctaact

SEQ ID NO: 406746 - DNA, 15 bp, Homo sapiens
tagggttcctaactc

SEQ ID NO: 406747 - DNA, 15 bp, Homo sapiens
agggttcctaactca

SEQ ID NO: 406748 - DNA, 15 bp, Homo sapiens
gggttcctaactcat

SEQ ID NO: 406749 - DNA, 15 bp, Homo sapiens
ggttcctaactcatt

SEQ ID NO: 406750 - DNA, 15 bp, Homo sapiens
gttcctaactcattc

SEQ ID NO: 406751 - DNA, 15 bp, Homo sapiens
ttcctaactcattct

SEQ ID NO: 406752 - DNA, 15 bp, Homo sapiens
tcctaactcattctt

SEQ ID NO: 406753 - DNA, 15 bp, Homo sapiens
cctaactcattctta

SEQ ID NO: 406754 - DNA, 15 bp, Homo sapiens
ctaactcattcttac

SEQ ID NO: 406755 - DNA, 15 bp, Homo sapiens
taactcattcttacc

SEQ ID NO: 406756 - DNA, 15 bp, Homo sapiens
aactcattcttacca

SEQ ID NO: 406757 - DNA, 15 bp, Homo sapiens
actcattcttaccaa

SEQ ID NO: 406758 - DNA, 15 bp, Homo sapiens
ctcattcttaccaat

SEQ ID NO: 406759 - DNA, 15 bp, Homo sapiens
tcattcttaccaatg

SEQ ID NO: 406760 - DNA, 15 bp, Homo sapiens
cattcttaccaatga

SEQ ID NO: 406761 - DNA, 15 bp, Homo sapiens
attcttaccaatgat

SEQ ID NO: 406762 - DNA, 15 bp, Homo sapiens
ttcttaccaatgata

SEQ ID NO: 406763 - DNA, 15 bp, Homo sapiens
tcttaccaatgataa

SEQ ID NO: 406764 - DNA, 15 bp, Homo sapiens
cttaccaatgataat

SEQ ID NO: 406765 - DNA, 15 bp, Homo sapiens
ttaccaatgataata

SEQ ID NO: 406766 - DNA, 15 bp, Homo sapiens
taccaatgataataa

SEQ ID NO: 406767 - DNA, 15 bp, Homo sapiens
accaatgataataac

SEQ ID NO: 406768 - DNA, 15 bp, Homo sapiens
ccaatgataataact

SEQ ID NO: 406769 - DNA, 15 bp, Homo sapiens
caatgataataactc

SEQ ID NO: 406770 - DNA, 15 bp, Homo sapiens
aatgataataactct

SEQ ID NO: 406771 - DNA, 15 bp, Homo sapiens
atgataataactctg

SEQ ID NO: 406772 - DNA, 15 bp, Homo sapiens
tgataataactctga

SEQ ID NO: 406773 - DNA, 15 bp, Homo sapiens
gataataactctgaa

SEQ ID NO: 406774 - DNA, 15 bp, Homo sapiens
ataataactctgaac

SEQ ID NO: 406775 - DNA, 15 bp, Homo sapiens
taataactctgaacc

SEQ ID NO: 406776 - DNA, 15 bp, Homo sapiens
aataactctgaaccc

SEQ ID NO: 406777 - DNA, 15 bp, Homo sapiens
ataactctgaaccca

SEQ ID NO: 406778 - DNA, 15 bp, Homo sapiens
taactctgaacccaa

SEQ ID NO: 406779 - DNA, 15 bp, Homo sapiens
aactctgaacccaag

SEQ ID NO: 406780 - DNA, 15 bp, Homo sapiens
actctgaacccaaga

SEQ ID NO: 406781 - DNA, 15 bp, Homo sapiens
ctctgaacccaagaa

SEQ ID NO: 406782 - DNA, 15 bp, Homo sapiens
tctgaacccaagaat

SEQ ID NO: 406783 - DNA, 15 bp, Homo sapiens
ctgaacccaagaata

SEQ ID NO: 406784 - DNA, 15 bp, Homo sapiens
tgaacccaagaatat

SEQ ID NO: 406785 - DNA, 15 bp, Homo sapiens
gaacccaagaatatc

SEQ ID NO: 406786 - DNA, 15 bp, Homo sapiens
aacccaagaatatct

SEQ ID NO: 406787 - DNA, 15 bp, Homo sapiens
acccaagaatatctg

SEQ ID NO: 406788 - DNA, 15 bp, Homo sapiens
cccaagaatatctga

SEQ ID NO: 406789 - DNA, 15 bp, Homo sapiens
ccaagaatatctgag

SEQ ID NO: 406790 - DNA, 15 bp, Homo sapiens
caagaatatctgaga

SEQ ID NO: 406791 - DNA, 15 bp, Homo sapiens
aagaatatctgagac

SEQ ID NO: 406792 - DNA, 15 bp, Homo sapiens
agaatatctgagaca

SEQ ID NO: 406793 - DNA, 15 bp, Homo sapiens
gaatatctgagacag

SEQ ID NO: 406794 - DNA, 15 bp, Homo sapiens
aatatctgagacagt

SEQ ID NO: 406795 - DNA, 15 bp, Homo sapiens
atatctgagacagtt

SEQ ID NO: 406796 - DNA, 15 bp, Homo sapiens
tatctgagacagttc

SEQ ID NO: 406797 - DNA, 15 bp, Homo sapiens
atctgagacagttct

SEQ ID NO: 406798 - DNA, 15 bp, Homo sapiens
tctgagacagttctc

SEQ ID NO: 406799 - DNA, 15 bp, Homo sapiens
ctgagacagttctca

SEQ ID NO: 406800 - DNA, 15 bp, Homo sapiens
tgagacagttctcaa

SEQ ID NO: 406801 - DNA, 15 bp, Homo sapiens
gagacagttctcaat

SEQ ID NO: 406802 - DNA, 15 bp, Homo sapiens
agacagttctcaatt

SEQ ID NO: 406803 - DNA, 15 bp, Homo sapiens
gacagttctcaatta

SEQ ID NO: 406804 - DNA, 15 bp, Homo sapiens
acagttctcaattaa

SEQ ID NO: 406805 - DNA, 15 bp, Homo sapiens
cagttctcaattaat

SEQ ID NO: 406806 - DNA, 15 bp, Homo sapiens
agttctcaattaatt

SEQ ID NO: 406807 - DNA, 15 bp, Homo sapiens
gttctcaattaattt

SEQ ID NO: 406808 - DNA, 15 bp, Homo sapiens
ttctcaattaattta

SEQ ID NO: 406809 - DNA, 15 bp, Homo sapiens
tctcaattaatttaa

SEQ ID NO: 406810 - DNA, 15 bp, Homo sapiens
ctcaattaatttaaa

SEQ ID NO: 406811 - DNA, 15 bp, Homo sapiens
tcaattaatttaaaa

SEQ ID NO: 406812 - DNA, 15 bp, Homo sapiens
caattaatttaaaaa

SEQ ID NO: 406813 - DNA, 15 bp, Homo sapiens
aattaatttaaaaag

SEQ ID NO: 406814 - DNA, 15 bp, Homo sapiens
attaatttaaaaagt

SEQ ID NO: 406815 - DNA, 15 bp, Homo sapiens
ttaatttaaaaagtt

SEQ ID NO: 406816 - DNA, 15 bp, Homo sapiens
taatttaaaaagttt

SEQ ID NO: 406817 - DNA, 15 bp, Homo sapiens
aatttaaaaagttta

SEQ ID NO: 406818 - DNA, 15 bp, Homo sapiens
atttaaaaagtttat

SEQ ID NO: 406819 - DNA, 15 bp, Homo sapiens
tttaaaaagtttatt

SEQ ID NO: 406820 - DNA, 15 bp, Homo sapiens
ttaaaaagtttattt

SEQ ID NO: 406821 - DNA, 15 bp, Homo sapiens
taaaaagtttatttt

SEQ ID NO: 406822 - DNA, 15 bp, Homo sapiens
aaaaagtttattttg

SEQ ID NO: 406823 - DNA, 15 bp, Homo sapiens
aaaagtttattttgc

SEQ ID NO: 406824 - DNA, 15 bp, Homo sapiens
aaagtttattttgcc

SEQ ID NO: 406825 - DNA, 15 bp, Homo sapiens
aagtttattttgcca

SEQ ID NO: 406826 - DNA, 15 bp, Homo sapiens
agtttattttgccag

SEQ ID NO: 406827 - DNA, 15 bp, Homo sapiens
gtttattttgccagg

SEQ ID NO: 406828 - DNA, 15 bp, Homo sapiens
tttattttgccaggg

SEQ ID NO: 406829 - DNA, 15 bp, Homo sapiens
ttattttgccagggt

SEQ ID NO: 406830 - DNA, 15 bp, Homo sapiens
tattttgccagggtt

SEQ ID NO: 406831 - DNA, 15 bp, Homo sapiens
attttgccagggtta

SEQ ID NO: 406832 - DNA, 15 bp, Homo sapiens
ttttgccagggttaa

SEQ ID NO: 406833 - DNA, 15 bp, Homo sapiens
tttgccagggttaag

SEQ ID NO: 406834 - DNA, 15 bp, Homo sapiens
ttgccagggttaagg

SEQ ID NO: 406835 - DNA, 15 bp, Homo sapiens
tgccagggttaagga

SEQ ID NO: 406836 - DNA, 15 bp, Homo sapiens
gccagggttaaggat

SEQ ID NO: 406837 - DNA, 15 bp, Homo sapiens
ccagggttaaggatg

SEQ ID NO: 406838 - DNA, 15 bp, Homo sapiens
cagggttaaggatgc

SEQ ID NO: 406839 - DNA, 15 bp, Homo sapiens
agggttaaggatgca

SEQ ID NO: 406840 - DNA, 15 bp, Homo sapiens
gggttaaggatgcac

SEQ ID NO: 406841 - DNA, 15 bp, Homo sapiens
ggttaaggatgcacc

SEQ ID NO: 406842 - DNA, 15 bp, Homo sapiens
gttaaggatgcacct

SEQ ID NO: 406843 - DNA, 15 bp, Homo sapiens
ttaaggatgcaccta

SEQ ID NO: 406844 - DNA, 15 bp, Homo sapiens
taaggatgcacctat

SEQ ID NO: 406845 - DNA, 15 bp, Homo sapiens
aaggatgcacctatg

SEQ ID NO: 406846 - DNA, 15 bp, Homo sapiens
aggatgcacctatga

SEQ ID NO: 406847 - DNA, 15 bp, Homo sapiens
ggatgcacctatgac

SEQ ID NO: 406848 - DNA, 15 bp, Homo sapiens
gatgcacctatgaca

SEQ ID NO: 406849 - DNA, 15 bp, Homo sapiens
atgcacctatgacac

SEQ ID NO: 406850 - DNA, 15 bp, Homo sapiens
tgcacctatgacaca

SEQ ID NO: 406851 - DNA, 15 bp, Homo sapiens
gcacctatgacacag

SEQ ID NO: 406852 - DNA, 15 bp, Homo sapiens
cacctatgacacagc

SEQ ID NO: 406853 - DNA, 15 bp, Homo sapiens
acctatgacacagcc

SEQ ID NO: 406854 - DNA, 15 bp, Homo sapiens
cctatgacacagcct

SEQ ID NO: 406855 - DNA, 15 bp, Homo sapiens
ctatgacacagcctc

SEQ ID NO: 406856 - DNA, 15 bp, Homo sapiens
tatgacacagcctca

SEQ ID NO: 406857 - DNA, 15 bp, Homo sapiens
atgacacagcctcag

SEQ ID NO: 406858 - DNA, 15 bp, Homo sapiens
tcaggaggtcctgag

SEQ ID NO: 406859 - DNA, 15 bp, Homo sapiens
caggaggtcctgagg

SEQ ID NO: 406860 - DNA, 15 bp, Homo sapiens
aggaggtcctgagga

SEQ ID NO: 406861 - DNA, 15 bp, Homo sapiens
ggaggtcctgaggac

SEQ ID NO: 406862 - DNA, 15 bp, Homo sapiens
gaggtcctgaggaca

SEQ ID NO: 406863 - DNA, 15 bp, Homo sapiens
aggtcctgaggacat

SEQ ID NO: 406864 - DNA, 15 bp, Homo sapiens
ggtcctgaggacatg

SEQ ID NO: 406865 - DNA, 15 bp, Homo sapiens
gtcctgaggacatgt

SEQ ID NO: 406866 - DNA, 15 bp, Homo sapiens
tcctgaggacatgta

SEQ ID NO: 406867 - DNA, 15 bp, Homo sapiens
cctgaggacatgtac

SEQ ID NO: 406868 - DNA, 15 bp, Homo sapiens
ctgaggacatgtacc

SEQ ID NO: 406869 - DNA, 15 bp, Homo sapiens
tgaggacatgtaccc

SEQ ID NO: 406870 - DNA, 15 bp, Homo sapiens
gaggacatgtaccca

SEQ ID NO: 406871 - DNA, 15 bp, Homo sapiens
aggacatgtacccaa

SEQ ID NO: 406872 - DNA, 15 bp, Homo sapiens
ggacatgtacccaag

SEQ ID NO: 406873 - DNA, 15 bp, Homo sapiens
gacatgtacccaagg

SEQ ID NO: 406874 - DNA, 15 bp, Homo sapiens
acatgtacccaaggt

SEQ ID NO: 406875 - DNA, 15 bp, Homo sapiens
catgtacccaaggta

SEQ ID NO: 406876 - DNA, 15 bp, Homo sapiens
atgtacccaaggtag

SEQ ID NO: 406877 - DNA, 15 bp, Homo sapiens
tgtacccaaggtagt

SEQ ID NO: 406878 - DNA, 15 bp, Homo sapiens
gtacccaaggtagtt

SEQ ID NO: 406879 - DNA, 15 bp, Homo sapiens
tacccaaggtagttg

SEQ ID NO: 406880 - DNA, 15 bp, Homo sapiens
acccaaggtagttgg

SEQ ID NO: 406881 - DNA, 15 bp, Homo sapiens
cccaaggtagttggg

SEQ ID NO: 406882 - DNA, 15 bp, Homo sapiens
ccaaggtagttgggg

SEQ ID NO: 406883 - DNA, 15 bp, Homo sapiens
caaggtagttggggt

SEQ ID NO: 406884 - DNA, 15 bp, Homo sapiens
aaggtagttggggta

SEQ ID NO: 406885 - DNA, 15 bp, Homo sapiens
aggtagttggggtac

SEQ ID NO: 406886 - DNA, 15 bp, Homo sapiens
ggtagttggggtaca

SEQ ID NO: 406887 - DNA, 15 bp, Homo sapiens
gtagttggggtacag

SEQ ID NO: 406888 - DNA, 15 bp, Homo sapiens
tagttggggtacagc

SEQ ID NO: 406889 - DNA, 15 bp, Homo sapiens
agttggggtacagcc

SEQ ID NO: 406890 - DNA, 15 bp, Homo sapiens
gttggggtacagcct

SEQ ID NO: 406891 - DNA, 15 bp, Homo sapiens
ttggggtacagcctg

SEQ ID NO: 406892 - DNA, 15 bp, Homo sapiens
tggggtacagcctgc

SEQ ID NO: 406893 - DNA, 15 bp, Homo sapiens
ggggtacagcctgct

SEQ ID NO: 406894 - DNA, 15 bp, Homo sapiens
gggtacagcctgctt

SEQ ID NO: 406895 - DNA, 15 bp, Homo sapiens
ggtacagcctgcttt

SEQ ID NO: 406896 - DNA, 15 bp, Homo sapiens
gtacagcctgctttt

SEQ ID NO: 406897 - DNA, 15 bp, Homo sapiens
tacagcctgctttta

SEQ ID NO: 406898 - DNA, 15 bp, Homo sapiens
acagcctgcttttat

SEQ ID NO: 406899 - DNA, 15 bp, Homo sapiens
cagcctgcttttata

SEQ ID NO: 406900 - DNA, 15 bp, Homo sapiens
agcctgcttttatac

SEQ ID NO: 406901 - DNA, 15 bp, Homo sapiens
gcctgcttttataca

SEQ ID NO: 406902 - DNA, 15 bp, Homo sapiens
cctgcttttatacat

SEQ ID NO: 406903 - DNA, 15 bp, Homo sapiens
ctgcttttatacatt

SEQ ID NO: 406904 - DNA, 15 bp, Homo sapiens
tgcttttatacattt

SEQ ID NO: 406905 - DNA, 15 bp, Homo sapiens
gcttttatacatttt

SEQ ID NO: 406906 - DNA, 15 bp, Homo sapiens
cttttatacatttta

SEQ ID NO: 406907 - DNA, 15 bp, Homo sapiens
ttttagggagacata

SEQ ID NO: 406908 - DNA, 15 bp, Homo sapiens
tttagggagacataa

SEQ ID NO: 406909 - DNA, 15 bp, Homo sapiens
ttagggagacataat

SEQ ID NO: 406910 - DNA, 15 bp, Homo sapiens
tagggagacataata

SEQ ID NO: 406911 - DNA, 15 bp, Homo sapiens
agggagacataatac

SEQ ID NO: 406912 - DNA, 15 bp, Homo sapiens
gggagacataataca

SEQ ID NO: 406913 - DNA, 15 bp, Homo sapiens
ggagacataatacat

SEQ ID NO: 406914 - DNA, 15 bp, Homo sapiens
gagacataatacatc

SEQ ID NO: 406915 - DNA, 15 bp, Homo sapiens
agacataatacatca

SEQ ID NO: 406916 - DNA, 15 bp, Homo sapiens
gacataatacatcaa

SEQ ID NO: 406917 - DNA, 15 bp, Homo sapiens
acataatacatcaat

SEQ ID NO: 406918 - DNA, 15 bp, Homo sapiens
cataatacatcaatc

SEQ ID NO: 406919 - DNA, 15 bp, Homo sapiens
ataatacatcaatca

SEQ ID NO: 406920 - DNA, 15 bp, Homo sapiens
taatacatcaatcaa

SEQ ID NO: 406921 - DNA, 15 bp, Homo sapiens
aatacatcaatcaat

SEQ ID NO: 406922 - DNA, 15 bp, Homo sapiens
atacatcaatcaata

SEQ ID NO: 406923 - DNA, 15 bp, Homo sapiens
tacatcaatcaatac

SEQ ID NO: 406924 - DNA, 15 bp, Homo sapiens
acatcaatcaataca

SEQ ID NO: 406925 - DNA, 15 bp, Homo sapiens
catcaatcaatacat

SEQ ID NO: 406926 - DNA, 15 bp, Homo sapiens
atcaatcaatacatt

SEQ ID NO: 406927 - DNA, 15 bp, Homo sapiens
tcaatcaatacattt

SEQ ID NO: 406928 - DNA, 15 bp, Homo sapiens
caatcaatacattta

SEQ ID NO: 406929 - DNA, 15 bp, Homo sapiens
aatcaatacatttaa

SEQ ID NO: 406930 - DNA, 15 bp, Homo sapiens
atcaatacatttaag

SEQ ID NO: 406931 - DNA, 15 bp, Homo sapiens
tcaatacatttaaga

SEQ ID NO: 406932 - DNA, 15 bp, Homo sapiens
caatacatttaagat

SEQ ID NO: 406933 - DNA, 15 bp, Homo sapiens
aatacatttaagatt

SEQ ID NO: 406934 - DNA, 15 bp, Homo sapiens
atacatttaagattt

SEQ ID NO: 406935 - DNA, 15 bp, Homo sapiens
tacatttaagattta

SEQ ID NO: 406936 - DNA, 15 bp, Homo sapiens
acatttaagatttac

SEQ ID NO: 406937 - DNA, 15 bp, Homo sapiens
catttaagatttaca

SEQ ID NO: 406938 - DNA, 15 bp, Homo sapiens
atttaagatttacat

SEQ ID NO: 406939 - DNA, 15 bp, Homo sapiens
tttaagatttacatt

SEQ ID NO: 406940 - DNA, 15 bp, Homo sapiens
ttaagatttacattg

SEQ ID NO: 406941 - DNA, 15 bp, Homo sapiens
taagatttacattgg

SEQ ID NO: 406942 - DNA, 15 bp, Homo sapiens
aagatttacattggt

SEQ ID NO: 406943 - DNA, 15 bp, Homo sapiens
agatttacattggtt

SEQ ID NO: 406944 - DNA, 15 bp, Homo sapiens
gatttacattggttc

SEQ ID NO: 406945 - DNA, 15 bp, Homo sapiens
atttacattggttcg

SEQ ID NO: 406946 - DNA, 15 bp, Homo sapiens
tttacattggttcga

SEQ ID NO: 406947 - DNA, 15 bp, Homo sapiens
ttacattggttcgat

SEQ ID NO: 406948 - DNA, 15 bp, Homo sapiens
tacattggttcgatc

SEQ ID NO: 406949 - DNA, 15 bp, Homo sapiens
acattggttcgatct

SEQ ID NO: 406950 - DNA, 15 bp, Homo sapiens
cattggttcgatctg

SEQ ID NO: 406951 - DNA, 15 bp, Homo sapiens
attggttcgatctgg

SEQ ID NO: 406952 - DNA, 15 bp, Homo sapiens
ttggttcgatctgga

SEQ ID NO: 406953 - DNA, 15 bp, Homo sapiens
tggttcgatctggaa

SEQ ID NO: 406954 - DNA, 15 bp, Homo sapiens
ggttcgatctggaag

SEQ ID NO: 406955 - DNA, 15 bp, Homo sapiens
gttcgatctggaagg

SEQ ID NO: 406956 - DNA, 15 bp, Homo sapiens
ttcgatctggaaggg

SEQ ID NO: 406957 - DNA, 15 bp, Homo sapiens
tcgatctggaagggt

SEQ ID NO: 406958 - DNA, 15 bp, Homo sapiens
cgatctggaagggtg

SEQ ID NO: 406959 - DNA, 15 bp, Homo sapiens
gatctggaagggtgg

SEQ ID NO: 406960 - DNA, 15 bp, Homo sapiens
atctggaagggtggg

SEQ ID NO: 406961 - DNA, 15 bp, Homo sapiens
tctggaagggtggga

SEQ ID NO: 406962 - DNA, 15 bp, Homo sapiens
ctggaagggtgggac

SEQ ID NO: 406963 - DNA, 15 bp, Homo sapiens
tggaagggtgggaca

SEQ ID NO: 406964 - DNA, 15 bp, Homo sapiens
ggaagggtgggacaa

SEQ ID NO: 406965 - DNA, 15 bp, Homo sapiens
gaagggtgggacaac

SEQ ID NO: 406966 - DNA, 15 bp, Homo sapiens
aagggtgggacaact

SEQ ID NO: 406967 - DNA, 15 bp, Homo sapiens
agggtgggacaactc

SEQ ID NO: 406968 - DNA, 15 bp, Homo sapiens
gggtgggacaactca

SEQ ID NO: 406969 - DNA, 15 bp, Homo sapiens
ggtgggacaactcaa

SEQ ID NO: 406970 - DNA, 15 bp, Homo sapiens
gtgggacaactcaaa

SEQ ID NO: 406971 - DNA, 15 bp, Homo sapiens
tgggacaactcaaaa

SEQ ID NO: 406972 - DNA, 15 bp, Homo sapiens
gggacaactcaaaat

SEQ ID NO: 406973 - DNA, 15 bp, Homo sapiens
ggacaactcaaaatg

SEQ ID NO: 406974 - DNA, 15 bp, Homo sapiens
gacaactcaaaatgg

SEQ ID NO: 406975 - DNA, 15 bp, Homo sapiens
acaactcaaaatgga

SEQ ID NO: 406976 - DNA, 15 bp, Homo sapiens
caactcaaaatggag

SEQ ID NO: 406977 - DNA, 15 bp, Homo sapiens
aactcaaaatggagg

SEQ ID NO: 406978 - DNA, 15 bp, Homo sapiens
actcaaaatggaggg

SEQ ID NO: 406979 - DNA, 15 bp, Homo sapiens
ctcaaaatggaggga

SEQ ID NO: 406980 - DNA, 15 bp, Homo sapiens
tcaaaatggagggac

SEQ ID NO: 406981 - DNA, 15 bp, Homo sapiens
caaaatggagggacg

SEQ ID NO: 406982 - DNA, 15 bp, Homo sapiens
aaaatggagggacgg

SEQ ID NO: 406983 - DNA, 15 bp, Homo sapiens
aaatggagggacggg

SEQ ID NO: 406984 - DNA, 15 bp, Homo sapiens
aatggagggacgggt

SEQ ID NO: 406985 - DNA, 15 bp, Homo sapiens
atggagggacgggtg

SEQ ID NO: 406986 - DNA, 15 bp, Homo sapiens
tggagggacgggtgc

SEQ ID NO: 406987 - DNA, 15 bp, Homo sapiens
ggagggacgggtgct

SEQ ID NO: 406988 - DNA, 15 bp, Homo sapiens
gagggacgggtgctt

SEQ ID NO: 406989 - DNA, 15 bp, Homo sapiens
agggacgggtgcttc

SEQ ID NO: 406990 - DNA, 15 bp, Homo sapiens
gggacgggtgcttcc

SEQ ID NO: 406991 - DNA, 15 bp, Homo sapiens
ggacgggtgcttcca

SEQ ID NO: 406992 - DNA, 15 bp, Homo sapiens
gacgggtgcttccag

SEQ ID NO: 406993 - DNA, 15 bp, Homo sapiens
acgggtgcttccagg

SEQ ID NO: 406994 - DNA, 15 bp, Homo sapiens
cgggtgcttccaggt

SEQ ID NO: 406995 - DNA, 15 bp, Homo sapiens
gggtgcttccaggtc

SEQ ID NO: 406996 - DNA, 15 bp, Homo sapiens
ggtgcttccaggtca

SEQ ID NO: 406997 - DNA, 15 bp, Homo sapiens
gtgcttccaggtcat

SEQ ID NO: 406998 - DNA, 15 bp, Homo sapiens
tgcttccaggtcata

SEQ ID NO: 406999 - DNA, 15 bp, Homo sapiens
tccaggtcataggta

SEQ ID NO: 407000 - DNA, 15 bp, Homo sapiens
ccaggtcataggtag

SEQ ID NO: 407001 - DNA, 15 bp, Homo sapiens
caggtcataggtaga

SEQ ID NO: 407002 - DNA, 15 bp, Homo sapiens
aggtcataggtagat

SEQ ID NO: 407003 - DNA, 15 bp, Homo sapiens
ggtcataggtagatt

SEQ ID NO: 407004 - DNA, 15 bp, Homo sapiens
gtcataggtagattt

SEQ ID NO: 407005 - DNA, 15 bp, Homo sapiens
tcataggtagatttg

SEQ ID NO: 407006 - DNA, 15 bp, Homo sapiens
cataggtagatttga

SEQ ID NO: 407007 - DNA, 15 bp, Homo sapiens
ataggtagatttgaa

SEQ ID NO: 407008 - DNA, 15 bp, Homo sapiens
taggtagatttgaaa

SEQ ID NO: 407009 - DNA, 15 bp, Homo sapiens
aggtagatttgaaaa

SEQ ID NO: 407010 - DNA, 15 bp, Homo sapiens
ggtagatttgaaaat

SEQ ID NO: 407011 - DNA, 15 bp, Homo sapiens
gtagatttgaaaatt

SEQ ID NO: 407012 - DNA, 15 bp, Homo sapiens
tagatttgaaaattt

SEQ ID NO: 407013 - DNA, 15 bp, Homo sapiens
agatttgaaaatttt

SEQ ID NO: 407014 - DNA, 15 bp, Homo sapiens
gatttgaaaattttc

SEQ ID NO: 407015 - DNA, 15 bp, Homo sapiens
atttgaaaattttct

SEQ ID NO: 407016 - DNA, 15 bp, Homo sapiens
tttgaaaattttctg

SEQ ID NO: 407017 - DNA, 15 bp, Homo sapiens
ttgaaaattttctga

SEQ ID NO: 407018 - DNA, 15 bp, Homo sapiens
tgaaaattttctgat

SEQ ID NO: 407019 - DNA, 15 bp, Homo sapiens
gaaaattttctgatt

SEQ ID NO: 407020 - DNA, 15 bp, Homo sapiens
aaaattttctgattg

SEQ ID NO: 407021 - DNA, 15 bp, Homo sapiens
aaattttctgattgc

SEQ ID NO: 407022 - DNA, 15 bp, Homo sapiens
aattttctgattgcc

SEQ ID NO: 407023 - DNA, 15 bp, Homo sapiens
attttctgattgcct

SEQ ID NO: 407024 - DNA, 15 bp, Homo sapiens
ttttctgattgccta

SEQ ID NO: 407025 - DNA, 15 bp, Homo sapiens
tttctgattgcctat

SEQ ID NO: 407026 - DNA, 15 bp, Homo sapiens
ttctgattgcctatt

SEQ ID NO: 407027 - DNA, 15 bp, Homo sapiens
tctgattgcctattg

SEQ ID NO: 407028 - DNA, 15 bp, Homo sapiens
ctgattgcctattgg

SEQ ID NO: 407029 - DNA, 15 bp, Homo sapiens
tgattgcctattggt

SEQ ID NO: 407030 - DNA, 15 bp, Homo sapiens
gattgcctattggtt

SEQ ID NO: 407031 - DNA, 15 bp, Homo sapiens
attgcctattggttg

SEQ ID NO: 407032 - DNA, 15 bp, Homo sapiens
ttgcctattggttga

SEQ ID NO: 407033 - DNA, 15 bp, Homo sapiens
tgcctattggttgaa

SEQ ID NO: 407034 - DNA, 15 bp, Homo sapiens
gcctattggttgaaa

SEQ ID NO: 407035 - DNA, 15 bp, Homo sapiens
cctattggttgaaag

SEQ ID NO: 407036 - DNA, 15 bp, Homo sapiens
ctattggttgaaaga

SEQ ID NO: 407037 - DNA, 15 bp, Homo sapiens
tattggttgaaagaa

SEQ ID NO: 407038 - DNA, 15 bp, Homo sapiens
attggttgaaagaat

SEQ ID NO: 407039 - DNA, 15 bp, Homo sapiens
ttggttgaaagaatt

SEQ ID NO: 407040 - DNA, 15 bp, Homo sapiens
tggttgaaagaatta

SEQ ID NO: 407041 - DNA, 15 bp, Homo sapiens
ggttgaaagaattat

SEQ ID NO: 407042 - DNA, 15 bp, Homo sapiens
gttgaaagaattatt

SEQ ID NO: 407043 - DNA, 15 bp, Homo sapiens
ttgaaagaattattc

SEQ ID NO: 407044 - DNA, 15 bp, Homo sapiens
tgaaagaattattca

SEQ ID NO: 407045 - DNA, 15 bp, Homo sapiens
gaaagaattattcaa

SEQ ID NO: 407046 - DNA, 15 bp, Homo sapiens
aaagaattattcaat

SEQ ID NO: 407047 - DNA, 15 bp, Homo sapiens
aagaattattcaatg

SEQ ID NO: 407048 - DNA, 15 bp, Homo sapiens
agaattattcaatgt

SEQ ID NO: 407049 - DNA, 15 bp, Homo sapiens
gaattattcaatgta

SEQ ID NO: 407050 - DNA, 15 bp, Homo sapiens
aattattcaatgtag

SEQ ID NO: 407051 - DNA, 15 bp, Homo sapiens
attattcaatgtaga

SEQ ID NO: 407052 - DNA, 15 bp, Homo sapiens
ttattcaatgtagaa

SEQ ID NO: 407053 - DNA, 15 bp, Homo sapiens
tattcaatgtagaaa

SEQ ID NO: 407054 - DNA, 15 bp, Homo sapiens
attcaatgtagaaaa

SEQ ID NO: 407055 - DNA, 15 bp, Homo sapiens
ttcaatgtagaaaag

SEQ ID NO: 407056 - DNA, 15 bp, Homo sapiens
tcaatgtagaaaaga

SEQ ID NO: 407057 - DNA, 15 bp, Homo sapiens
caatgtagaaaagaa

SEQ ID NO: 407058 - DNA, 15 bp, Homo sapiens
aatgtagaaaagaat

SEQ ID NO: 407059 - DNA, 15 bp, Homo sapiens
atgtagaaaagaatg

SEQ ID NO: 407060 - DNA, 15 bp, Homo sapiens
tgtagaaaagaatgt

SEQ ID NO: 407061 - DNA, 15 bp, Homo sapiens
gtagaaaagaatgtc

SEQ ID NO: 407062 - DNA, 15 bp, Homo sapiens
tagaaaagaatgtct

SEQ ID NO: 407063 - DNA, 15 bp, Homo sapiens
agaaaagaatgtctg

SEQ ID NO: 407064 - DNA, 15 bp, Homo sapiens
gaaaagaatgtctgg

SEQ ID NO: 407065 - DNA, 15 bp, Homo sapiens
aaaagaatgtctggg

SEQ ID NO: 407066 - DNA, 15 bp, Homo sapiens
aaagaatgtctgggt

SEQ ID NO: 407067 - DNA, 15 bp, Homo sapiens
aagaatgtctgggtt

SEQ ID NO: 407068 - DNA, 15 bp, Homo sapiens
agaatgtctgggtta

SEQ ID NO: 407069 - DNA, 15 bp, Homo sapiens
gaatgtctgggttac

SEQ ID NO: 407070 - DNA, 15 bp, Homo sapiens
aatgtctgggttaca

SEQ ID NO: 407071 - DNA, 15 bp, Homo sapiens
atgtctgggttacaa

SEQ ID NO: 407072 - DNA, 15 bp, Homo sapiens
tgtctgggttacaat

SEQ ID NO: 407073 - DNA, 15 bp, Homo sapiens
gtctgggttacaata

SEQ ID NO: 407074 - DNA, 15 bp, Homo sapiens
tctgggttacaataa

SEQ ID NO: 407075 - DNA, 15 bp, Homo sapiens
ctgggttacaataag

SEQ ID NO: 407076 - DNA, 15 bp, Homo sapiens
tgggttacaataagg

SEQ ID NO: 407077 - DNA, 15 bp, Homo sapiens
gggttacaataaggg

SEQ ID NO: 407078 - DNA, 15 bp, Homo sapiens
ggttacaataagggg

SEQ ID NO: 407079 - DNA, 15 bp, Homo sapiens
gttacaataaggggt

SEQ ID NO: 407080 - DNA, 15 bp, Homo sapiens
ttacaataaggggtt

SEQ ID NO: 407081 - DNA, 15 bp, Homo sapiens
tacaataaggggttg

SEQ ID NO: 407082 - DNA, 15 bp, Homo sapiens
acaataaggggttgt

SEQ ID NO: 407083 - DNA, 15 bp, Homo sapiens
caataaggggttgtg

SEQ ID NO: 407084 - DNA, 15 bp, Homo sapiens
aataaggggttgtga

SEQ ID NO: 407085 - DNA, 15 bp, Homo sapiens
ataaggggttgtgaa

SEQ ID NO: 407086 - DNA, 15 bp, Homo sapiens
taaggggttgtgaag

SEQ ID NO: 407087 - DNA, 15 bp, Homo sapiens
aaggggttgtgaaga

SEQ ID NO: 407088 - DNA, 15 bp, Homo sapiens
aggggttgtgaagac

SEQ ID NO: 407089 - DNA, 15 bp, Homo sapiens
ggggttgtgaagact

SEQ ID NO: 407090 - DNA, 15 bp, Homo sapiens
gggttgtgaagacta

SEQ ID NO: 407091 - DNA, 15 bp, Homo sapiens
ggttgtgaagactaa

SEQ ID NO: 407092 - DNA, 15 bp, Homo sapiens
gttgtgaagactaaa

SEQ ID NO: 407093 - DNA, 15 bp, Homo sapiens
ttgtgaagactaaag

SEQ ID NO: 407094 - DNA, 15 bp, Homo sapiens
tgtgaagactaaagt

SEQ ID NO: 407095 - DNA, 15 bp, Homo sapiens
gtgaagactaaagtt

SEQ ID NO: 407096 - DNA, 15 bp, Homo sapiens
tgaagactaaagttt

SEQ ID NO: 407097 - DNA, 15 bp, Homo sapiens
gaagactaaagtttt

SEQ ID NO: 407098 - DNA, 15 bp, Homo sapiens
aagactaaagtttta

SEQ ID NO: 407099 - DNA, 15 bp, Homo sapiens
agactaaagttttat

SEQ ID NO: 407100 - DNA, 15 bp, Homo sapiens
gactaaagttttatc

SEQ ID NO: 407101 - DNA, 15 bp, Homo sapiens
actaaagttttatcc

SEQ ID NO: 407102 - DNA, 15 bp, Homo sapiens
ctaaagttttatcct

SEQ ID NO: 407103 - DNA, 15 bp, Homo sapiens
taaagttttatcctg

SEQ ID NO: 407104 - DNA, 15 bp, Homo sapiens
aaagttttatcctgc

SEQ ID NO: 407105 - DNA, 15 bp, Homo sapiens
aagttttatcctgct

SEQ ID NO: 407106 - DNA, 15 bp, Homo sapiens
agttttatcctgctg

SEQ ID NO: 407107 - DNA, 15 bp, Homo sapiens
gttttatcctgctgg

SEQ ID NO: 407108 - DNA, 15 bp, Homo sapiens
ttttatcctgctggg

SEQ ID NO: 407109 - DNA, 15 bp, Homo sapiens
tttatcctgctgggg

SEQ ID NO: 407110 - DNA, 15 bp, Homo sapiens
ttatcctgctgggga

SEQ ID NO: 407111 - DNA, 15 bp, Homo sapiens
tatcctgctggggaa

SEQ ID NO: 407112 - DNA, 15 bp, Homo sapiens
atcctgctggggaag

SEQ ID NO: 407113 - DNA, 15 bp, Homo sapiens
tcctgctggggaagc

SEQ ID NO: 407114 - DNA, 15 bp, Homo sapiens
cctgctggggaagcc

SEQ ID NO: 407115 - DNA, 15 bp, Homo sapiens
ctgctggggaagcct

SEQ ID NO: 407116 - DNA, 15 bp, Homo sapiens
tgctggggaagcctc

SEQ ID NO: 407117 - DNA, 15 bp, Homo sapiens
gctggggaagcctcc

SEQ ID NO: 407118 - DNA, 15 bp, Homo sapiens
ctggggaagcctcca

SEQ ID NO: 407119 - DNA, 15 bp, Homo sapiens
tggggaagcctccaa

SEQ ID NO: 407120 - DNA, 15 bp, Homo sapiens
ggggaagcctccaag

SEQ ID NO: 407121 - DNA, 15 bp, Homo sapiens
gggaagcctccaagt

SEQ ID NO: 407122 - DNA, 15 bp, Homo sapiens
ggaagcctccaagta

SEQ ID NO: 407123 - DNA, 15 bp, Homo sapiens
gaagcctccaagtag

SEQ ID NO: 407124 - DNA, 15 bp, Homo sapiens
aagcctccaagtagc

SEQ ID NO: 407125 - DNA, 15 bp, Homo sapiens
agcctccaagtagca

SEQ ID NO: 407126 - DNA, 15 bp, Homo sapiens
gcctccaagtagcag

SEQ ID NO: 407127 - DNA, 15 bp, Homo sapiens
cctccaagtagcagg

SEQ ID NO: 407128 - DNA, 15 bp, Homo sapiens
ctccaagtagcaggc

SEQ ID NO: 407129 - DNA, 15 bp, Homo sapiens
tccaagtagcaggct

SEQ ID NO: 407130 - DNA, 15 bp, Homo sapiens
ccaagtagcaggctt

SEQ ID NO: 407131 - DNA, 15 bp, Homo sapiens
caagtagcaggcttc

SEQ ID NO: 407132 - DNA, 15 bp, Homo sapiens
aagtagcaggcttca

SEQ ID NO: 407133 - DNA, 15 bp, Homo sapiens
agtagcaggcttcag

SEQ ID NO: 407134 - DNA, 15 bp, Homo sapiens
gtagcaggcttcaga

SEQ ID NO: 407135 - DNA, 15 bp, Homo sapiens
ggcttcagagagaac

SEQ ID NO: 407136 - DNA, 15 bp, Homo sapiens
gcttcagagagaaca

SEQ ID NO: 407137 - DNA, 15 bp, Homo sapiens
cttcagagagaacag

SEQ ID NO: 407138 - DNA, 15 bp, Homo sapiens
ttcagagagaacaga

SEQ ID NO: 407139 - DNA, 15 bp, Homo sapiens
tcagagagaacagat

SEQ ID NO: 407140 - DNA, 15 bp, Homo sapiens
cagagagaacagatt

SEQ ID NO: 407141 - DNA, 15 bp, Homo sapiens
agagagaacagatta

SEQ ID NO: 407142 - DNA, 15 bp, Homo sapiens
gagagaacagattac

SEQ ID NO: 407143 - DNA, 15 bp, Homo sapiens
agagaacagattaca

SEQ ID NO: 407144 - DNA, 15 bp, Homo sapiens
gagaacagattacag

SEQ ID NO: 407145 - DNA, 15 bp, Homo sapiens
agaacagattacaga

SEQ ID NO: 407146 - DNA, 15 bp, Homo sapiens
gaacagattacagat

SEQ ID NO: 407147 - DNA, 15 bp, Homo sapiens
aacagattacagatg

SEQ ID NO: 407148 - DNA, 15 bp, Homo sapiens
acagattacagatgt

SEQ ID NO: 407149 - DNA, 15 bp, Homo sapiens
cagattacagatgtt

SEQ ID NO: 407150 - DNA, 15 bp, Homo sapiens
agattacagatgttt

SEQ ID NO: 407151 - DNA, 15 bp, Homo sapiens
gattacagatgtttc

SEQ ID NO: 407152 - DNA, 15 bp, Homo sapiens
attacagatgtttca

SEQ ID NO: 407153 - DNA, 15 bp, Homo sapiens
ttacagatgtttcat

SEQ ID NO: 407154 - DNA, 15 bp, Homo sapiens
tacagatgtttcata

SEQ ID NO: 407155 - DNA, 15 bp, Homo sapiens
acagatgtttcatat

SEQ ID NO: 407156 - DNA, 15 bp, Homo sapiens
cagatgtttcatatc

SEQ ID NO: 407157 - DNA, 15 bp, Homo sapiens
agatgtttcatatca

SEQ ID NO: 407158 - DNA, 15 bp, Homo sapiens
gatgtttcatatcag

SEQ ID NO: 407159 - DNA, 15 bp, Homo sapiens
atgtttcatatcaga

SEQ ID NO: 407160 - DNA, 15 bp, Homo sapiens
tgtttcatatcagac

SEQ ID NO: 407161 - DNA, 15 bp, Homo sapiens
gtttcatatcagact

SEQ ID NO: 407162 - DNA, 15 bp, Homo sapiens
tttcatatcagactt

SEQ ID NO: 407163 - DNA, 15 bp, Homo sapiens
ttcatatcagactta

SEQ ID NO: 407164 - DNA, 15 bp, Homo sapiens
tcatatcagacttaa

SEQ ID NO: 407165 - DNA, 15 bp, Homo sapiens
catatcagacttaaa

SEQ ID NO: 407166 - DNA, 15 bp, Homo sapiens
atatcagacttaaag

SEQ ID NO: 407167 - DNA, 15 bp, Homo sapiens
tatcagacttaaagt

SEQ ID NO: 407168 - DNA, 15 bp, Homo sapiens
atcagacttaaagtc

SEQ ID NO: 407169 - DNA, 15 bp, Homo sapiens
tcagacttaaagtct

SEQ ID NO: 407170 - DNA, 15 bp, Homo sapiens
cagacttaaagtctg

SEQ ID NO: 407171 - DNA, 15 bp, Homo sapiens
agacttaaagtctgt

SEQ ID NO: 407172 - DNA, 15 bp, Homo sapiens
gacttaaagtctgtg

SEQ ID NO: 407173 - DNA, 15 bp, Homo sapiens
acttaaagtctgtgt

SEQ ID NO: 407174 - DNA, 15 bp, Homo sapiens
cttaaagtctgtgtt

SEQ ID NO: 407175 - DNA, 15 bp, Homo sapiens
ttaaagtctgtgttg

SEQ ID NO: 407176 - DNA, 15 bp, Homo sapiens
taaagtctgtgttga

SEQ ID NO: 407177 - DNA, 15 bp, Homo sapiens
aaagtctgtgttgat

SEQ ID NO: 407178 - DNA, 15 bp, Homo sapiens
aagtctgtgttgatg

SEQ ID NO: 407179 - DNA, 15 bp, Homo sapiens
agtctgtgttgatgt

SEQ ID NO: 407180 - DNA, 15 bp, Homo sapiens
gtctgtgttgatgtt

SEQ ID NO: 407181 - DNA, 15 bp, Homo sapiens
tctgtgttgatgtta

SEQ ID NO: 407182 - DNA, 15 bp, Homo sapiens
ctgtgttgatgttaa

SEQ ID NO: 407183 - DNA, 15 bp, Homo sapiens
tgtgttgatgttaat

SEQ ID NO: 407184 - DNA, 15 bp, Homo sapiens
gtgttgatgttaatg

SEQ ID NO: 407185 - DNA, 15 bp, Homo sapiens
tgttgatgttaatgc

SEQ ID NO: 407186 - DNA, 15 bp, Homo sapiens
gttgatgttaatgct

SEQ ID NO: 407187 - DNA, 15 bp, Homo sapiens
ttgatgttaatgctg

SEQ ID NO: 407188 - DNA, 15 bp, Homo sapiens
tgatgttaatgctgg

SEQ ID NO: 407189 - DNA, 15 bp, Homo sapiens
gatgttaatgctgga

SEQ ID NO: 407190 - DNA, 15 bp, Homo sapiens
atgttaatgctggag

SEQ ID NO: 407191 - DNA, 15 bp, Homo sapiens
tgttaatgctggagg

SEQ ID NO: 407192 - DNA, 15 bp, Homo sapiens
gttaatgctggaggg

SEQ ID NO: 407193 - DNA, 15 bp, Homo sapiens
ttaatgctggagggg

SEQ ID NO: 407194 - DNA, 15 bp, Homo sapiens
taatgctggaggggt

SEQ ID NO: 407195 - DNA, 15 bp, Homo sapiens
aatgctggaggggtg

SEQ ID NO: 407196 - DNA, 15 bp, Homo sapiens
atgctggaggggtgt

SEQ ID NO: 407197 - DNA, 15 bp, Homo sapiens
tgctggaggggtgta

SEQ ID NO: 407198 - DNA, 15 bp, Homo sapiens
gctggaggggtgtaa

SEQ ID NO: 407199 - DNA, 15 bp, Homo sapiens
ctggaggggtgtaat

SEQ ID NO: 407200 - DNA, 15 bp, Homo sapiens
tggaggggtgtaatg

SEQ ID NO: 407201 - DNA, 15 bp, Homo sapiens
ggaggggtgtaatga

SEQ ID NO: 407202 - DNA, 15 bp, Homo sapiens
gaggggtgtaatgag

SEQ ID NO: 407203 - DNA, 15 bp, Homo sapiens
aggggtgtaatgagg

SEQ ID NO: 407204 - DNA, 15 bp, Homo sapiens
ggggtgtaatgaggc

SEQ ID NO: 407205 - DNA, 15 bp, Homo sapiens
gggtgtaatgaggca

SEQ ID NO: 407206 - DNA, 15 bp, Homo sapiens
ggtgtaatgaggcat

SEQ ID NO: 407207 - DNA, 15 bp, Homo sapiens
gtgtaatgaggcatg

SEQ ID NO: 407208 - DNA, 15 bp, Homo sapiens
tgtaatgaggcatgt

SEQ ID NO: 407209 - DNA, 15 bp, Homo sapiens
gtaatgaggcatgtt

SEQ ID NO: 407210 - DNA, 15 bp, Homo sapiens
taatgaggcatgttg

SEQ ID NO: 407211 - DNA, 15 bp, Homo sapiens
aatgaggcatgttga

SEQ ID NO: 407212 - DNA, 15 bp, Homo sapiens
atgaggcatgttgac

SEQ ID NO: 407213 - DNA, 15 bp, Homo sapiens
tgaggcatgttgacc

SEQ ID NO: 407214 - DNA, 15 bp, Homo sapiens
gaggcatgttgaccc

SEQ ID NO: 407215 - DNA, 15 bp, Homo sapiens
aggcatgttgacccc

SEQ ID NO: 407216 - DNA, 15 bp, Homo sapiens
ggcatgttgaccccc

SEQ ID NO: 407217 - DNA, 15 bp, Homo sapiens
gcatgttgaccccct

SEQ ID NO: 407218 - DNA, 15 bp, Homo sapiens
catgttgaccccctc

SEQ ID NO: 407219 - DNA, 15 bp, Homo sapiens
atgttgaccccctct

SEQ ID NO: 407220 - DNA, 15 bp, Homo sapiens
tgttgaccccctctt

SEQ ID NO: 407221 - DNA, 15 bp, Homo sapiens
gttgaccccctcttc

SEQ ID NO: 407222 - DNA, 15 bp, Homo sapiens
ttgaccccctcttcc

SEQ ID NO: 407223 - DNA, 15 bp, Homo sapiens
tgaccccctcttcca

SEQ ID NO: 407224 - DNA, 15 bp, Homo sapiens
gaccccctcttccat

SEQ ID NO: 407225 - DNA, 15 bp, Homo sapiens
accccctcttccatc

SEQ ID NO: 407226 - DNA, 15 bp, Homo sapiens
ccccctcttccatct

SEQ ID NO: 407227 - DNA, 15 bp, Homo sapiens
cccctcttccatctt

SEQ ID NO: 407228 - DNA, 15 bp, Homo sapiens
ccctcttccatcttg

SEQ ID NO: 407229 - DNA, 15 bp, Homo sapiens
cctcttccatcttgg

SEQ ID NO: 407230 - DNA, 15 bp, Homo sapiens
ctcttccatcttggc

SEQ ID NO: 407231 - DNA, 15 bp, Homo sapiens
tcttccatcttggcc

SEQ ID NO: 407232 - DNA, 15 bp, Homo sapiens
cttccatcttggcct

SEQ ID NO: 407233 - DNA, 15 bp, Homo sapiens
ttccatcttggcctg

SEQ ID NO: 407234 - DNA, 15 bp, Homo sapiens
tccatcttggcctga

SEQ ID NO: 407235 - DNA, 15 bp, Homo sapiens
ccatcttggcctgaa

SEQ ID NO: 407236 - DNA, 15 bp, Homo sapiens
catcttggcctgaac

SEQ ID NO: 407237 - DNA, 15 bp, Homo sapiens
atcttggcctgaact

SEQ ID NO: 407238 - DNA, 15 bp, Homo sapiens
tcttggcctgaacta

SEQ ID NO: 407239 - DNA, 15 bp, Homo sapiens
cttggcctgaactag

SEQ ID NO: 407240 - DNA, 15 bp, Homo sapiens
ttggcctgaactagt

SEQ ID NO: 407241 - DNA, 15 bp, Homo sapiens
tggcctgaactagtt

SEQ ID NO: 407242 - DNA, 15 bp, Homo sapiens
ggcctgaactagttt

SEQ ID NO: 407243 - DNA, 15 bp, Homo sapiens
gcctgaactagtttt

SEQ ID NO: 407244 - DNA, 15 bp, Homo sapiens
cctgaactagttttt

SEQ ID NO: 407245 - DNA, 15 bp, Homo sapiens
ctgaactagtttttc

SEQ ID NO: 407246 - DNA, 15 bp, Homo sapiens
tgaactagtttttca

SEQ ID NO: 407247 - DNA, 15 bp, Homo sapiens
gaactagtttttcag

SEQ ID NO: 407248 - DNA, 15 bp, Homo sapiens
aactagtttttcagg

SEQ ID NO: 407249 - DNA, 15 bp, Homo sapiens
actagtttttcaggt

SEQ ID NO: 407250 - DNA, 15 bp, Homo sapiens
ctagtttttcaggtt

SEQ ID NO: 407251 - DNA, 15 bp, Homo sapiens
tagtttttcaggtta

SEQ ID NO: 407252 - DNA, 15 bp, Homo sapiens
agtttttcaggttaa

SEQ ID NO: 407253 - DNA, 15 bp, Homo sapiens
gtttttcaggttaac

SEQ ID NO: 407254 - DNA, 15 bp, Homo sapiens
tttttcaggttaact

SEQ ID NO: 407255 - DNA, 15 bp, Homo sapiens
ttttcaggttaactc

SEQ ID NO: 407256 - DNA, 15 bp, Homo sapiens
tttcaggttaactct

SEQ ID NO: 407257 - DNA, 15 bp, Homo sapiens
ttcaggttaactctg

SEQ ID NO: 407258 - DNA, 15 bp, Homo sapiens
tcaggttaactctgg

SEQ ID NO: 407259 - DNA, 15 bp, Homo sapiens
caggttaactctgga

SEQ ID NO: 407260 - DNA, 15 bp, Homo sapiens
aggttaactctggaa

SEQ ID NO: 407261 - DNA, 15 bp, Homo sapiens
ggttaactctggaac

SEQ ID NO: 407262 - DNA, 15 bp, Homo sapiens
gttaactctggaacg

SEQ ID NO: 407263 - DNA, 15 bp, Homo sapiens
ttaactctggaacgc

SEQ ID NO: 407264 - DNA, 15 bp, Homo sapiens
taactctggaacgcc

SEQ ID NO: 407265 - DNA, 15 bp, Homo sapiens
aactctggaacgccc

SEQ ID NO: 407266 - DNA, 15 bp, Homo sapiens
actctggaacgccct

SEQ ID NO: 407267 - DNA, 15 bp, Homo sapiens
ctctggaacgccctt

SEQ ID NO: 407268 - DNA, 15 bp, Homo sapiens
tctggaacgcccttg

SEQ ID NO: 407269 - DNA, 15 bp, Homo sapiens
ctggaacgcccttgg

SEQ ID NO: 407270 - DNA, 15 bp, Homo sapiens
tggaacgcccttggc

SEQ ID NO: 407271 - DNA, 15 bp, Homo sapiens
ggaacgcccttggcc

SEQ ID NO: 407272 - DNA, 15 bp, Homo sapiens
gaacgcccttggcca

SEQ ID NO: 407273 - DNA, 15 bp, Homo sapiens
aacgcccttggccaa

SEQ ID NO: 407274 - DNA, 15 bp, Homo sapiens
acgcccttggccaag

SEQ ID NO: 407275 - DNA, 15 bp, Homo sapiens
cgcccttggccaaga

SEQ ID NO: 407276 - DNA, 15 bp, Homo sapiens
gcccttggccaagag

SEQ ID NO: 407277 - DNA, 15 bp, Homo sapiens
cccttggccaagagg

SEQ ID NO: 407278 - DNA, 15 bp, Homo sapiens
ccttggccaagagga

SEQ ID NO: 407279 - DNA, 15 bp, Homo sapiens
cttggccaagaggat

SEQ ID NO: 407280 - DNA, 15 bp, Homo sapiens
ttggccaagaggatt

SEQ ID NO: 407281 - DNA, 15 bp, Homo sapiens
tggccaagaggattg

SEQ ID NO: 407282 - DNA, 15 bp, Homo sapiens
ggccaagaggattgg

SEQ ID NO: 407283 - DNA, 15 bp, Homo sapiens
gccaagaggattggt

SEQ ID NO: 407284 - DNA, 15 bp, Homo sapiens
ccaagaggattggtc

SEQ ID NO: 407285 - DNA, 15 bp, Homo sapiens
caagaggattggtcc

SEQ ID NO: 407286 - DNA, 15 bp, Homo sapiens
aagaggattggtcca

SEQ ID NO: 407287 - DNA, 15 bp, Homo sapiens
agaggattggtccat

SEQ ID NO: 407288 - DNA, 15 bp, Homo sapiens
gaggattggtccatt

SEQ ID NO: 407289 - DNA, 15 bp, Homo sapiens
aggattggtccattc

SEQ ID NO: 407290 - DNA, 15 bp, Homo sapiens
ggattggtccattca

SEQ ID NO: 407291 - DNA, 15 bp, Homo sapiens
gattggtccattcag

SEQ ID NO: 407292 - DNA, 15 bp, Homo sapiens
attggtccattcaga

SEQ ID NO: 407293 - DNA, 15 bp, Homo sapiens
ttggtccattcagat

SEQ ID NO: 407294 - DNA, 15 bp, Homo sapiens
tggtccattcagatg

SEQ ID NO: 407295 - DNA, 15 bp, Homo sapiens
ggtccattcagatgg

SEQ ID NO: 407296 - DNA, 15 bp, Homo sapiens
gtccattcagatggt

SEQ ID NO: 407297 - DNA, 15 bp, Homo sapiens
tccattcagatggtt

SEQ ID NO: 407298 - DNA, 15 bp, Homo sapiens
ccattcagatggtta

SEQ ID NO: 407299 - DNA, 15 bp, Homo sapiens
cattcagatggttag

SEQ ID NO: 407300 - DNA, 15 bp, Homo sapiens
attcagatggttagg

SEQ ID NO: 407301 - DNA, 15 bp, Homo sapiens
ttcagatggttaggg

SEQ ID NO: 407302 - DNA, 15 bp, Homo sapiens
tcagatggttagggg

SEQ ID NO: 407303 - DNA, 15 bp, Homo sapiens
cagatggttaggggg

SEQ ID NO: 407304 - DNA, 15 bp, Homo sapiens
agatggttagggggg

SEQ ID NO: 407305 - DNA, 15 bp, Homo sapiens
gatggttaggggggc

SEQ ID NO: 407306 - DNA, 15 bp, Homo sapiens
atggttaggggggca

SEQ ID NO: 407307 - DNA, 15 bp, Homo sapiens
tggttaggggggcat

SEQ ID NO: 407308 - DNA, 15 bp, Homo sapiens
ggttaggggggcatg

SEQ ID NO: 407309 - DNA, 15 bp, Homo sapiens
gttaggggggcatgt

SEQ ID NO: 407310 - DNA, 15 bp, Homo sapiens
ttaggggggcatgta

SEQ ID NO: 407311 - DNA, 15 bp, Homo sapiens
taggggggcatgtag

SEQ ID NO: 407312 - DNA, 15 bp, Homo sapiens
aggggggcatgtaga

SEQ ID NO: 407313 - DNA, 15 bp, Homo sapiens
ggggggcatgtagag

SEQ ID NO: 407314 - DNA, 15 bp, Homo sapiens
gggggcatgtagagt

SEQ ID NO: 407315 - DNA, 15 bp, Homo sapiens
ggggcatgtagagtt

SEQ ID NO: 407316 - DNA, 15 bp, Homo sapiens
gggcatgtagagttt

SEQ ID NO: 407317 - DNA, 15 bp, Homo sapiens
ggcatgtagagtttt

SEQ ID NO: 407318 - DNA, 15 bp, Homo sapiens
gcatgtagagtttta

SEQ ID NO: 407319 - DNA, 15 bp, Homo sapiens
catgtagagttttat

SEQ ID NO: 407320 - DNA, 15 bp, Homo sapiens
atgtagagttttatt

SEQ ID NO: 407321 - DNA, 15 bp, Homo sapiens
tgtagagttttattt

SEQ ID NO: 407322 - DNA, 15 bp, Homo sapiens
gtagagttttatttt

SEQ ID NO: 407323 - DNA, 15 bp, Homo sapiens
tagagttttattttg

SEQ ID NO: 407324 - DNA, 15 bp, Homo sapiens
agagttttattttgg

SEQ ID NO: 407325 - DNA, 15 bp, Homo sapiens
gagttttattttggg

SEQ ID NO: 407326 - DNA, 15 bp, Homo sapiens
agttttattttgggt

SEQ ID NO: 407327 - DNA, 15 bp, Homo sapiens
gttttattttgggtt

SEQ ID NO: 407328 - DNA, 15 bp, Homo sapiens
ttttattttgggttt

SEQ ID NO: 407329 - DNA, 15 bp, Homo sapiens
tttattttgggttta

SEQ ID NO: 407330 - DNA, 15 bp, Homo sapiens
ttattttgggtttac

SEQ ID NO: 407331 - DNA, 15 bp, Homo sapiens
tattttgggtttaca

SEQ ID NO: 407332 - DNA, 15 bp, Homo sapiens
attttgggtttacat

SEQ ID NO: 407333 - DNA, 15 bp, Homo sapiens
ttttgggtttacata

SEQ ID NO: 407334 - DNA, 15 bp, Homo sapiens
tttgggtttacataa

SEQ ID NO: 407335 - DNA, 15 bp, Homo sapiens
ttgggtttacataac

SEQ ID NO: 407336 - DNA, 15 bp, Homo sapiens
tgggtttacataacc

SEQ ID NO: 407337 - DNA, 15 bp, Homo sapiens
gggtttacataaccc

SEQ ID NO: 407338 - DNA, 15 bp, Homo sapiens
ggtttacataaccca

SEQ ID NO: 407339 - DNA, 15 bp, Homo sapiens
gtttacataacccat

SEQ ID NO: 407340 - DNA, 15 bp, Homo sapiens
tttacataacccatt

SEQ ID NO: 407341 - DNA, 15 bp, Homo sapiens
ttacataacccatta

SEQ ID NO: 407342 - DNA, 15 bp, Homo sapiens
tacataacccattat

SEQ ID NO: 407343 - DNA, 15 bp, Homo sapiens
acataacccattatg

SEQ ID NO: 407344 - DNA, 15 bp, Homo sapiens
cataacccattatgg

SEQ ID NO: 407345 - DNA, 15 bp, Homo sapiens
ataacccattatgga

SEQ ID NO: 407346 - DNA, 15 bp, Homo sapiens
taacccattatggaa

SEQ ID NO: 407347 - DNA, 15 bp, Homo sapiens
aacccattatggaaa

SEQ ID NO: 407348 - DNA, 15 bp, Homo sapiens
acccattatggaaat

SEQ ID NO: 407349 - DNA, 15 bp, Homo sapiens
cccattatggaaatg

SEQ ID NO: 407350 - DNA, 15 bp, Homo sapiens
ccattatggaaatga

SEQ ID NO: 407351 - DNA, 15 bp, Homo sapiens
cattatggaaatgat

SEQ ID NO: 407352 - DNA, 15 bp, Homo sapiens
attatggaaatgatt

SEQ ID NO: 407353 - DNA, 15 bp, Homo sapiens
ttatggaaatgattc

SEQ ID NO: 407354 - DNA, 15 bp, Homo sapiens
tatggaaatgattcc

SEQ ID NO: 407355 - DNA, 15 bp, Homo sapiens
atggaaatgattcct

SEQ ID NO: 407356 - DNA, 15 bp, Homo sapiens
tggaaatgattcctt

SEQ ID NO: 407357 - DNA, 15 bp, Homo sapiens
ggaaatgattccttg

SEQ ID NO: 407358 - DNA, 15 bp, Homo sapiens
gaaatgattccttgg

SEQ ID NO: 407359 - DNA, 15 bp, Homo sapiens
aaatgattccttggc

SEQ ID NO: 407360 - DNA, 15 bp, Homo sapiens
aatgattccttggcc

SEQ ID NO: 407361 - DNA, 15 bp, Homo sapiens
atgattccttggccc

SEQ ID NO: 407362 - DNA, 15 bp, Homo sapiens
tgattccttggccct

SEQ ID NO: 407363 - DNA, 15 bp, Homo sapiens
gattccttggcccta

SEQ ID NO: 407364 - DNA, 15 bp, Homo sapiens
attccttggccctaa

SEQ ID NO: 407365 - DNA, 15 bp, Homo sapiens
ttccttggccctaag

SEQ ID NO: 407366 - DNA, 15 bp, Homo sapiens
tccttggccctaagg

SEQ ID NO: 407367 - DNA, 15 bp, Homo sapiens
ccttggccctaaggt

SEQ ID NO: 407368 - DNA, 15 bp, Homo sapiens
cttggccctaaggta

SEQ ID NO: 407369 - DNA, 15 bp, Homo sapiens
ttggccctaaggtaa

SEQ ID NO: 407370 - DNA, 15 bp, Homo sapiens
tggccctaaggtaat

SEQ ID NO: 407371 - DNA, 15 bp, Homo sapiens
ggccctaaggtaatt

SEQ ID NO: 407372 - DNA, 15 bp, Homo sapiens
gccctaaggtaatta

SEQ ID NO: 407373 - DNA, 15 bp, Homo sapiens
ccctaaggtaattat

SEQ ID NO: 407374 - DNA, 15 bp, Homo sapiens
cctaaggtaattata

SEQ ID NO: 407375 - DNA, 15 bp, Homo sapiens
ctaaggtaattatag

SEQ ID NO: 407376 - DNA, 15 bp, Homo sapiens
taaggtaattataga

SEQ ID NO: 407377 - DNA, 15 bp, Homo sapiens
aaggtaattatagat

SEQ ID NO: 407378 - DNA, 15 bp, Homo sapiens
aggtaattatagatt

SEQ ID NO: 407379 - DNA, 15 bp, Homo sapiens
ggtaattatagattc

SEQ ID NO: 407380 - DNA, 15 bp, Homo sapiens
gtaattatagattct

SEQ ID NO: 407381 - DNA, 15 bp, Homo sapiens
taattatagattctg

SEQ ID NO: 407382 - DNA, 15 bp, Homo sapiens
aattatagattctgg

SEQ ID NO: 407383 - DNA, 15 bp, Homo sapiens
attatagattctgga

SEQ ID NO: 407384 - DNA, 15 bp, Homo sapiens
ttatagattctggat

SEQ ID NO: 407385 - DNA, 15 bp, Homo sapiens
tatagattctggatg

SEQ ID NO: 407386 - DNA, 15 bp, Homo sapiens
atagattctggatgc

SEQ ID NO: 407387 - DNA, 15 bp, Homo sapiens
tagattctggatgcc

SEQ ID NO: 407388 - DNA, 15 bp, Homo sapiens
agattctggatgcca

SEQ ID NO: 407389 - DNA, 15 bp, Homo sapiens
gattctggatgccat

SEQ ID NO: 407390 - DNA, 15 bp, Homo sapiens
attctggatgccatg

SEQ ID NO: 407391 - DNA, 15 bp, Homo sapiens
ttctggatgccatgc

SEQ ID NO: 407392 - DNA, 15 bp, Homo sapiens
tctggatgccatgct

SEQ ID NO: 407393 - DNA, 15 bp, Homo sapiens
ctggatgccatgctt

SEQ ID NO: 407394 - DNA, 15 bp, Homo sapiens
tggatgccatgctta

SEQ ID NO: 407395 - DNA, 15 bp, Homo sapiens
ggatgccatgcttat

SEQ ID NO: 407396 - DNA, 15 bp, Homo sapiens
gatgccatgcttata

SEQ ID NO: 407397 - DNA, 15 bp, Homo sapiens
atgccatgcttatat

SEQ ID NO: 407398 - DNA, 15 bp, Homo sapiens
tgccatgcttatatt

SEQ ID NO: 407399 - DNA, 15 bp, Homo sapiens
gccatgcttatatta

SEQ ID NO: 407400 - DNA, 15 bp, Homo sapiens
ccatgcttatattaa

SEQ ID NO: 407401 - DNA, 15 bp, Homo sapiens
catgcttatattaag

SEQ ID NO: 407402 - DNA, 15 bp, Homo sapiens
atgcttatattaagt

SEQ ID NO: 407403 - DNA, 15 bp, Homo sapiens
tgcttatattaagta

SEQ ID NO: 407404 - DNA, 15 bp, Homo sapiens
gcttatattaagtag

SEQ ID NO: 407405 - DNA, 15 bp, Homo sapiens
cttatattaagtaga

SEQ ID NO: 407406 - DNA, 15 bp, Homo sapiens
ttatattaagtagat

SEQ ID NO: 407407 - DNA, 15 bp, Homo sapiens
tatattaagtagata

SEQ ID NO: 407408 - DNA, 15 bp, Homo sapiens
atattaagtagatac

SEQ ID NO: 407409 - DNA, 15 bp, Homo sapiens
tattaagtagatacc

SEQ ID NO: 407410 - DNA, 15 bp, Homo sapiens
attaagtagatacca

SEQ ID NO: 407411 - DNA, 15 bp, Homo sapiens
ttaagtagataccaa

SEQ ID NO: 407412 - DNA, 15 bp, Homo sapiens
taagtagataccaaa

SEQ ID NO: 407413 - DNA, 15 bp, Homo sapiens
aagtagataccaaaa

SEQ ID NO: 407414 - DNA, 15 bp, Homo sapiens
agtagataccaaaat

SEQ ID NO: 407415 - DNA, 15 bp, Homo sapiens
gtagataccaaaatg

SEQ ID NO: 407416 - DNA, 15 bp, Homo sapiens
tagataccaaaatgc

SEQ ID NO: 407417 - DNA, 15 bp, Homo sapiens
agataccaaaatgct

SEQ ID NO: 407418 - DNA, 15 bp, Homo sapiens
gataccaaaatgcta

SEQ ID NO: 407419 - DNA, 15 bp, Homo sapiens
ataccaaaatgctac

SEQ ID NO: 407420 - DNA, 15 bp, Homo sapiens
taccaaaatgctact

SEQ ID NO: 407421 - DNA, 15 bp, Homo sapiens
accaaaatgctactt

SEQ ID NO: 407422 - DNA, 15 bp, Homo sapiens
ccaaaatgctacttt

SEQ ID NO: 407423 - DNA, 15 bp, Homo sapiens
caaaatgctactttt

SEQ ID NO: 407424 - DNA, 15 bp, Homo sapiens
aaaatgctactttta

SEQ ID NO: 407425 - DNA, 15 bp, Homo sapiens
aaatgctacttttag

SEQ ID NO: 407426 - DNA, 15 bp, Homo sapiens
aatgctacttttaga

SEQ ID NO: 407427 - DNA, 15 bp, Homo sapiens
atgctacttttagag

SEQ ID NO: 407428 - DNA, 15 bp, Homo sapiens
tgctacttttagagt

SEQ ID NO: 407429 - DNA, 15 bp, Homo sapiens
gctacttttagagtt

SEQ ID NO: 407430 - DNA, 15 bp, Homo sapiens
ctacttttagagttt

SEQ ID NO: 407431 - DNA, 15 bp, Homo sapiens
tacttttagagtttg

SEQ ID NO: 407432 - DNA, 15 bp, Homo sapiens
acttttagagtttga

SEQ ID NO: 407433 - DNA, 15 bp, Homo sapiens
cttttagagtttgag

SEQ ID NO: 407434 - DNA, 15 bp, Homo sapiens
ttttagagtttgagt

SEQ ID NO: 407435 - DNA, 15 bp, Homo sapiens
tttagagtttgagtt

SEQ ID NO: 407436 - DNA, 15 bp, Homo sapiens
ttagagtttgagttt

SEQ ID NO: 407437 - DNA, 15 bp, Homo sapiens
tagagtttgagtttc

SEQ ID NO: 407438 - DNA, 15 bp, Homo sapiens
agagtttgagtttct

SEQ ID NO: 407439 - DNA, 15 bp, Homo sapiens
gagtttgagtttctc

SEQ ID NO: 407440 - DNA, 15 bp, Homo sapiens
agtttgagtttctct

SEQ ID NO: 407441 - DNA, 15 bp, Homo sapiens
gtttgagtttctctt

SEQ ID NO: 407442 - DNA, 15 bp, Homo sapiens
tttgagtttctctta

SEQ ID NO: 407443 - DNA, 15 bp, Homo sapiens
ttgagtttctcttac

SEQ ID NO: 407444 - DNA, 15 bp, Homo sapiens
tgagtttctcttacg

SEQ ID NO: 407445 - DNA, 15 bp, Homo sapiens
gagtttctcttacgt

SEQ ID NO: 407446 - DNA, 15 bp, Homo sapiens
agtttctcttacgtt

SEQ ID NO: 407447 - DNA, 15 bp, Homo sapiens
gtttctcttacgttt

SEQ ID NO: 407448 - DNA, 15 bp, Homo sapiens
tttctcttacgtttt

SEQ ID NO: 407449 - DNA, 15 bp, Homo sapiens
ttctcttacgttttt

SEQ ID NO: 407450 - DNA, 15 bp, Homo sapiens
tctcttacgttttta

SEQ ID NO: 407451 - DNA, 15 bp, Homo sapiens
ctcttacgtttttag

SEQ ID NO: 407452 - DNA, 15 bp, Homo sapiens
tcttacgtttttaga

SEQ ID NO: 407453 - DNA, 15 bp, Homo sapiens
cttacgtttttagaa

SEQ ID NO: 407454 - DNA, 15 bp, Homo sapiens
ttacgtttttagaaa

SEQ ID NO: 407455 - DNA, 15 bp, Homo sapiens
tacgtttttagaaat

SEQ ID NO: 407456 - DNA, 15 bp, Homo sapiens
acgtttttagaaatt

SEQ ID NO: 407457 - DNA, 15 bp, Homo sapiens
cgtttttagaaattc

SEQ ID NO: 407458 - DNA, 15 bp, Homo sapiens
gtttttagaaattca

SEQ ID NO: 407459 - DNA, 15 bp, Homo sapiens
tttttagaaattcaa

SEQ ID NO: 407460 - DNA, 15 bp, Homo sapiens
ttttagaaattcaat

SEQ ID NO: 407461 - DNA, 15 bp, Homo sapiens
tttagaaattcaatt

SEQ ID NO: 407462 - DNA, 15 bp, Homo sapiens
ttagaaattcaattg

SEQ ID NO: 407463 - DNA, 15 bp, Homo sapiens
tagaaattcaattga

SEQ ID NO: 407464 - DNA, 15 bp, Homo sapiens
agaaattcaattgag

SEQ ID NO: 407465 - DNA, 15 bp, Homo sapiens
gaaattcaattgagt

SEQ ID NO: 407466 - DNA, 15 bp, Homo sapiens
aaattcaattgagta

SEQ ID NO: 407467 - DNA, 15 bp, Homo sapiens
aattcaattgagtag

SEQ ID NO: 407468 - DNA, 15 bp, Homo sapiens
attcaattgagtaga

SEQ ID NO: 407469 - DNA, 15 bp, Homo sapiens
ttcaattgagtagaa

SEQ ID NO: 407470 - DNA, 15 bp, Homo sapiens
tcaattgagtagaac

SEQ ID NO: 407471 - DNA, 15 bp, Homo sapiens
caattgagtagaact

SEQ ID NO: 407472 - DNA, 15 bp, Homo sapiens
aattgagtagaactc

SEQ ID NO: 407473 - DNA, 15 bp, Homo sapiens
attgagtagaactcg

SEQ ID NO: 407474 - DNA, 15 bp, Homo sapiens
ttgagtagaactcgt

SEQ ID NO: 407475 - DNA, 15 bp, Homo sapiens
tgagtagaactcgtt

SEQ ID NO: 407476 - DNA, 15 bp, Homo sapiens
gagtagaactcgtta

SEQ ID NO: 407477 - DNA, 15 bp, Homo sapiens
agtagaactcgttat

SEQ ID NO: 407478 - DNA, 15 bp, Homo sapiens
gtagaactcgttatt

SEQ ID NO: 407479 - DNA, 15 bp, Homo sapiens
tagaactcgttatta

SEQ ID NO: 407480 - DNA, 15 bp, Homo sapiens
agaactcgttattaa

SEQ ID NO: 407481 - DNA, 15 bp, Homo sapiens
gaactcgttattaag

SEQ ID NO: 407482 - DNA, 15 bp, Homo sapiens
aactcgttattaagg

SEQ ID NO: 407483 - DNA, 15 bp, Homo sapiens
actcgttattaagga

SEQ ID NO: 407484 - DNA, 15 bp, Homo sapiens
ctcgttattaaggaa

SEQ ID NO: 407485 - DNA, 15 bp, Homo sapiens
tcgttattaaggaaa

SEQ ID NO: 407486 - DNA, 15 bp, Homo sapiens
cgttattaaggaaaa

SEQ ID NO: 407487 - DNA, 15 bp, Homo sapiens
gttattaaggaaaaa

SEQ ID NO: 407488 - DNA, 15 bp, Homo sapiens
ttattaaggaaaaaa

SEQ ID NO: 407489 - DNA, 15 bp, Homo sapiens
tattaaggaaaaaat

SEQ ID NO: 407490 - DNA, 15 bp, Homo sapiens
attaaggaaaaaata

SEQ ID NO: 407491 - DNA, 15 bp, Homo sapiens
ttaaggaaaaaatac

SEQ ID NO: 407492 - DNA, 15 bp, Homo sapiens
taaggaaaaaatact

SEQ ID NO: 407493 - DNA, 15 bp, Homo sapiens
aaggaaaaaatactc

SEQ ID NO: 407494 - DNA, 15 bp, Homo sapiens
aggaaaaaatactca

SEQ ID NO: 407495 - DNA, 15 bp, Homo sapiens
ggaaaaaatactcaa

SEQ ID NO: 407496 - DNA, 15 bp, Homo sapiens
gaaaaaatactcaag

SEQ ID NO: 407497 - DNA, 15 bp, Homo sapiens
aaaaaatactcaaga

SEQ ID NO: 407498 - DNA, 15 bp, Homo sapiens
aaaaatactcaagac

SEQ ID NO: 407499 - DNA, 15 bp, Homo sapiens
aaaatactcaagacc

SEQ ID NO: 407500 - DNA, 15 bp, Homo sapiens
aaatactcaagaccc

SEQ ID NO: 407501 - DNA, 15 bp, Homo sapiens
aatactcaagacccg

SEQ ID NO: 407502 - DNA, 15 bp, Homo sapiens
atactcaagacccga

SEQ ID NO: 407503 - DNA, 15 bp, Homo sapiens
tactcaagacccgaa

SEQ ID NO: 407504 - DNA, 15 bp, Homo sapiens
actcaagacccgaat

SEQ ID NO: 407505 - DNA, 15 bp, Homo sapiens
ctcaagacccgaata

SEQ ID NO: 407506 - DNA, 15 bp, Homo sapiens
tcaagacccgaataa

SEQ ID NO: 407507 - DNA, 15 bp, Homo sapiens
caagacccgaataat

SEQ ID NO: 407508 - DNA, 15 bp, Homo sapiens
aagacccgaataata

SEQ ID NO: 407509 - DNA, 15 bp, Homo sapiens
agacccgaataatat

SEQ ID NO: 407510 - DNA, 15 bp, Homo sapiens
gacccgaataatatt

SEQ ID NO: 407511 - DNA, 15 bp, Homo sapiens
acccgaataatattg

SEQ ID NO: 407512 - DNA, 15 bp, Homo sapiens
cccgaataatattgc

SEQ ID NO: 407513 - DNA, 15 bp, Homo sapiens
ccgaataatattgcc

SEQ ID NO: 407514 - DNA, 15 bp, Homo sapiens
cgaataatattgcca

SEQ ID NO: 407515 - DNA, 15 bp, Homo sapiens
gaataatattgccat

SEQ ID NO: 407516 - DNA, 15 bp, Homo sapiens
aataatattgccatg

SEQ ID NO: 407517 - DNA, 15 bp, Homo sapiens
ataatattgccatga

SEQ ID NO: 407518 - DNA, 15 bp, Homo sapiens
taatattgccatgaa

SEQ ID NO: 407519 - DNA, 15 bp, Homo sapiens
aatattgccatgaat

SEQ ID NO: 407520 - DNA, 15 bp, Homo sapiens
atattgccatgaata

SEQ ID NO: 407521 - DNA, 15 bp, Homo sapiens
tattgccatgaataa

SEQ ID NO: 407522 - DNA, 15 bp, Homo sapiens
attgccatgaataaa

SEQ ID NO: 407523 - DNA, 15 bp, Homo sapiens
ttgccatgaataaag

SEQ ID NO: 407524 - DNA, 15 bp, Homo sapiens
tgccatgaataaagc

SEQ ID NO: 407525 - DNA, 15 bp, Homo sapiens
gccatgaataaagcg

SEQ ID NO: 407526 - DNA, 15 bp, Homo sapiens
ccatgaataaagcgg

SEQ ID NO: 407527 - DNA, 15 bp, Homo sapiens
catgaataaagcggt

SEQ ID NO: 407528 - DNA, 15 bp, Homo sapiens
atgaataaagcggtt

SEQ ID NO: 407529 - DNA, 15 bp, Homo sapiens
tgaataaagcggttg

SEQ ID NO: 407530 - DNA, 15 bp, Homo sapiens
gaataaagcggttga

SEQ ID NO: 407531 - DNA, 15 bp, Homo sapiens
aataaagcggttgat

SEQ ID NO: 407532 - DNA, 15 bp, Homo sapiens
ataaagcggttgatt

SEQ ID NO: 407533 - DNA, 15 bp, Homo sapiens
taaagcggttgatta

SEQ ID NO: 407534 - DNA, 15 bp, Homo sapiens
aaagcggttgattag

SEQ ID NO: 407535 - DNA, 15 bp, Homo sapiens
aagcggttgattagt

SEQ ID NO: 407536 - DNA, 15 bp, Homo sapiens
agcggttgattagtg

SEQ ID NO: 407537 - DNA, 15 bp, Homo sapiens
gcggttgattagtga

SEQ ID NO: 407538 - DNA, 15 bp, Homo sapiens
cggttgattagtgat

SEQ ID NO: 407539 - DNA, 15 bp, Homo sapiens
ggttgattagtgatt

SEQ ID NO: 407540 - DNA, 15 bp, Homo sapiens
gttgattagtgattg

SEQ ID NO: 407541 - DNA, 15 bp, Homo sapiens
ttgattagtgattgg

SEQ ID NO: 407542 - DNA, 15 bp, Homo sapiens
tgattagtgattggt

SEQ ID NO: 407543 - DNA, 15 bp, Homo sapiens
gattagtgattggtt

SEQ ID NO: 407544 - DNA, 15 bp, Homo sapiens
attagtgattggttg

SEQ ID NO: 407545 - DNA, 15 bp, Homo sapiens
ttagtgattggttga

SEQ ID NO: 407546 - DNA, 15 bp, Homo sapiens
tagtgattggttgac

SEQ ID NO: 407547 - DNA, 15 bp, Homo sapiens
agtgattggttgact

SEQ ID NO: 407548 - DNA, 15 bp, Homo sapiens
gtgattggttgactt

SEQ ID NO: 407549 - DNA, 15 bp, Homo sapiens
tgattggttgacttt

SEQ ID NO: 407550 - DNA, 15 bp, Homo sapiens
gattggttgacttta

SEQ ID NO: 407551 - DNA, 15 bp, Homo sapiens
attggttgactttat

SEQ ID NO: 407552 - DNA, 15 bp, Homo sapiens
ttggttgactttatg

SEQ ID NO: 407553 - DNA, 15 bp, Homo sapiens
tggttgactttatgc

SEQ ID NO: 407554 - DNA, 15 bp, Homo sapiens
ggttgactttatgct

SEQ ID NO: 407555 - DNA, 15 bp, Homo sapiens
gttgactttatgctt

SEQ ID NO: 407556 - DNA, 15 bp, Homo sapiens
ttgactttatgcttt

SEQ ID NO: 407557 - DNA, 15 bp, Homo sapiens
tgactttatgctttt

SEQ ID NO: 407558 - DNA, 15 bp, Homo sapiens
gactttatgcttttc

SEQ ID NO: 407559 - DNA, 15 bp, Homo sapiens
actttatgcttttca

SEQ ID NO: 407560 - DNA, 15 bp, Homo sapiens
ctttatgcttttcag

SEQ ID NO: 407561 - DNA, 15 bp, Homo sapiens
tttatgcttttcagt

SEQ ID NO: 407562 - DNA, 15 bp, Homo sapiens
ttatgcttttcagtt

SEQ ID NO: 407563 - DNA, 15 bp, Homo sapiens
tatgcttttcagttc

SEQ ID NO: 407564 - DNA, 15 bp, Homo sapiens
atgcttttcagttca

SEQ ID NO: 407565 - DNA, 15 bp, Homo sapiens
tgcttttcagttcac

SEQ ID NO: 407566 - DNA, 15 bp, Homo sapiens
gcttttcagttcaca

SEQ ID NO: 407567 - DNA, 15 bp, Homo sapiens
cttttcagttcacag

SEQ ID NO: 407568 - DNA, 15 bp, Homo sapiens
ttttcagttcacaga

SEQ ID NO: 407569 - DNA, 15 bp, Homo sapiens
tttcagttcacagaa

SEQ ID NO: 407570 - DNA, 15 bp, Homo sapiens
ttcagttcacagaaa

SEQ ID NO: 407571 - DNA, 15 bp, Homo sapiens
tcagttcacagaaat

SEQ ID NO: 407572 - DNA, 15 bp, Homo sapiens
cagttcacagaaata

SEQ ID NO: 407573 - DNA, 15 bp, Homo sapiens
agttcacagaaatat

SEQ ID NO: 407574 - DNA, 15 bp, Homo sapiens
gttcacagaaatatt

SEQ ID NO: 407575 - DNA, 15 bp, Homo sapiens
ttcacagaaatattg

SEQ ID NO: 407576 - DNA, 15 bp, Homo sapiens
tcacagaaatattgc

SEQ ID NO: 407577 - DNA, 15 bp, Homo sapiens
cacagaaatattgct

SEQ ID NO: 407578 - DNA, 15 bp, Homo sapiens
acagaaatattgctg

SEQ ID NO: 407579 - DNA, 15 bp, Homo sapiens
cagaaatattgctga

SEQ ID NO: 407580 - DNA, 15 bp, Homo sapiens
agaaatattgctgag

SEQ ID NO: 407581 - DNA, 15 bp, Homo sapiens
gaaatattgctgagg

SEQ ID NO: 407582 - DNA, 15 bp, Homo sapiens
aaatattgctgagga

SEQ ID NO: 407583 - DNA, 15 bp, Homo sapiens
aatattgctgaggaa

SEQ ID NO: 407584 - DNA, 15 bp, Homo sapiens
atattgctgaggaat

SEQ ID NO: 407585 - DNA, 15 bp, Homo sapiens
tattgctgaggaatc

SEQ ID NO: 407586 - DNA, 15 bp, Homo sapiens
attgctgaggaatct

SEQ ID NO: 407587 - DNA, 15 bp, Homo sapiens
ttgctgaggaatctt

SEQ ID NO: 407588 - DNA, 15 bp, Homo sapiens
tgctgaggaatcttg

SEQ ID NO: 407589 - DNA, 15 bp, Homo sapiens
gctgaggaatcttga

SEQ ID NO: 407590 - DNA, 15 bp, Homo sapiens
ctgaggaatcttgac

SEQ ID NO: 407591 - DNA, 15 bp, Homo sapiens
tgaggaatcttgaca

SEQ ID NO: 407592 - DNA, 15 bp, Homo sapiens
gaggaatcttgacac

SEQ ID NO: 407593 - DNA, 15 bp, Homo sapiens
aggaatcttgacaca

SEQ ID NO: 407594 - DNA, 15 bp, Homo sapiens
ggaatcttgacacag

SEQ ID NO: 407595 - DNA, 15 bp, Homo sapiens
gaatcttgacacagg

SEQ ID NO: 407596 - DNA, 15 bp, Homo sapiens
aatcttgacacaggc

SEQ ID NO: 407597 - DNA, 15 bp, Homo sapiens
atcttgacacaggca

SEQ ID NO: 407598 - DNA, 15 bp, Homo sapiens
tcttgacacaggcaa

SEQ ID NO: 407599 - DNA, 15 bp, Homo sapiens
cttgacacaggcaat

SEQ ID NO: 407600 - DNA, 15 bp, Homo sapiens
ttgacacaggcaatg

SEQ ID NO: 407601 - DNA, 15 bp, Homo sapiens
tgacacaggcaatgc

SEQ ID NO: 407602 - DNA, 15 bp, Homo sapiens
gacacaggcaatgca

SEQ ID NO: 407603 - DNA, 15 bp, Homo sapiens
acacaggcaatgcaa

SEQ ID NO: 407604 - DNA, 15 bp, Homo sapiens
cacaggcaatgcaag

SEQ ID NO: 407605 - DNA, 15 bp, Homo sapiens
acaggcaatgcaagt

SEQ ID NO: 407606 - DNA, 15 bp, Homo sapiens
caggcaatgcaagtg

SEQ ID NO: 407607 - DNA, 15 bp, Homo sapiens
aggcaatgcaagtgt

SEQ ID NO: 407608 - DNA, 15 bp, Homo sapiens
ggcaatgcaagtgtt

SEQ ID NO: 407609 - DNA, 15 bp, Homo sapiens
gcaatgcaagtgttt

SEQ ID NO: 407610 - DNA, 15 bp, Homo sapiens
caatgcaagtgttta

SEQ ID NO: 407611 - DNA, 15 bp, Homo sapiens
aatgcaagtgtttac

SEQ ID NO: 407612 - DNA, 15 bp, Homo sapiens
atgcaagtgtttaca

SEQ ID NO: 407613 - DNA, 15 bp, Homo sapiens
tgcaagtgtttacat

SEQ ID NO: 407614 - DNA, 15 bp, Homo sapiens
gcaagtgtttacatg

SEQ ID NO: 407615 - DNA, 15 bp, Homo sapiens
caagtgtttacatga

SEQ ID NO: 407616 - DNA, 15 bp, Homo sapiens
aagtgtttacatgaa

SEQ ID NO: 407617 - DNA, 15 bp, Homo sapiens
agtgtttacatgaat

SEQ ID NO: 407618 - DNA, 15 bp, Homo sapiens
gtgtttacatgaata

SEQ ID NO: 407619 - DNA, 15 bp, Homo sapiens
tgtttacatgaatat

SEQ ID NO: 407620 - DNA, 15 bp, Homo sapiens
gtttacatgaatatg

SEQ ID NO: 407621 - DNA, 15 bp, Homo sapiens
tttacatgaatatga

SEQ ID NO: 407622 - DNA, 15 bp, Homo sapiens
ttacatgaatatgaa

SEQ ID NO: 407623 - DNA, 15 bp, Homo sapiens
tacatgaatatgaaa

SEQ ID NO: 407624 - DNA, 15 bp, Homo sapiens
acatgaatatgaaat

SEQ ID NO: 407625 - DNA, 15 bp, Homo sapiens
catgaatatgaaatt

SEQ ID NO: 407626 - DNA, 15 bp, Homo sapiens
atgaatatgaaatta

SEQ ID NO: 407627 - DNA, 15 bp, Homo sapiens
tgaatatgaaattag

SEQ ID NO: 407628 - DNA, 15 bp, Homo sapiens
gaatatgaaattagc

SEQ ID NO: 407629 - DNA, 15 bp, Homo sapiens
aatatgaaattagca

SEQ ID NO: 407630 - DNA, 15 bp, Homo sapiens
atatgaaattagcaa

SEQ ID NO: 407631 - DNA, 15 bp, Homo sapiens
tatgaaattagcaac

SEQ ID NO: 407632 - DNA, 15 bp, Homo sapiens
atgaaattagcaact

SEQ ID NO: 407633 - DNA, 15 bp, Homo sapiens
tgaaattagcaacta

SEQ ID NO: 407634 - DNA, 15 bp, Homo sapiens
gaaattagcaactat

SEQ ID NO: 407635 - DNA, 15 bp, Homo sapiens
aaattagcaactata

SEQ ID NO: 407636 - DNA, 15 bp, Homo sapiens
aattagcaactatat

SEQ ID NO: 407637 - DNA, 15 bp, Homo sapiens
attagcaactatatt

SEQ ID NO: 407638 - DNA, 15 bp, Homo sapiens
ttagcaactatattt

SEQ ID NO: 407639 - DNA, 15 bp, Homo sapiens
tagcaactatattta

SEQ ID NO: 407640 - DNA, 15 bp, Homo sapiens
agcaactatatttag

SEQ ID NO: 407641 - DNA, 15 bp, Homo sapiens
gcaactatatttagc

SEQ ID NO: 407642 - DNA, 15 bp, Homo sapiens
caactatatttagct

SEQ ID NO: 407643 - DNA, 15 bp, Homo sapiens
aactatatttagcta

SEQ ID NO: 407644 - DNA, 15 bp, Homo sapiens
actatatttagctat

SEQ ID NO: 407645 - DNA, 15 bp, Homo sapiens
ctatatttagctata

SEQ ID NO: 407646 - DNA, 15 bp, Homo sapiens
tatatttagctataa

SEQ ID NO: 407647 - DNA, 15 bp, Homo sapiens
atatttagctataat

SEQ ID NO: 407648 - DNA, 15 bp, Homo sapiens
tatttagctataatt

SEQ ID NO: 407649 - DNA, 15 bp, Homo sapiens
atttagctataatta

SEQ ID NO: 407650 - DNA, 15 bp, Homo sapiens
tttagctataattaa

SEQ ID NO: 407651 - DNA, 15 bp, Homo sapiens
ttagctataattaaa

SEQ ID NO: 407652 - DNA, 15 bp, Homo sapiens
tagctataattaaaa

SEQ ID NO: 407653 - DNA, 15 bp, Homo sapiens
agctataattaaaat

SEQ ID NO: 407654 - DNA, 15 bp, Homo sapiens
gctataattaaaatc

SEQ ID NO: 407655 - DNA, 15 bp, Homo sapiens
ctataattaaaatct

SEQ ID NO: 407656 - DNA, 15 bp, Homo sapiens
tataattaaaatcta

SEQ ID NO: 407657 - DNA, 15 bp, Homo sapiens
ataattaaaatctag

SEQ ID NO: 407658 - DNA, 15 bp, Homo sapiens
taattaaaatctagt

SEQ ID NO: 407659 - DNA, 15 bp, Homo sapiens
aattaaaatctagta

SEQ ID NO: 407660 - DNA, 15 bp, Homo sapiens
attaaaatctagtaa

SEQ ID NO: 407661 - DNA, 15 bp, Homo sapiens
ttaaaatctagtaag

SEQ ID NO: 407662 - DNA, 15 bp, Homo sapiens
taaaatctagtaagg

SEQ ID NO: 407663 - DNA, 15 bp, Homo sapiens
aaaatctagtaaggt

SEQ ID NO: 407664 - DNA, 15 bp, Homo sapiens
aaatctagtaaggta

SEQ ID NO: 407665 - DNA, 15 bp, Homo sapiens
aatctagtaaggtat

SEQ ID NO: 407666 - DNA, 15 bp, Homo sapiens
atctagtaaggtatg

SEQ ID NO: 407667 - DNA, 15 bp, Homo sapiens
tctagtaaggtatgt

SEQ ID NO: 407668 - DNA, 15 bp, Homo sapiens
ctagtaaggtatgta

SEQ ID NO: 407669 - DNA, 15 bp, Homo sapiens
tagtaaggtatgtaa

SEQ ID NO: 407670 - DNA, 15 bp, Homo sapiens
agtaaggtatgtaaa

SEQ ID NO: 407671 - DNA, 15 bp, Homo sapiens
gtaaggtatgtaaaa

SEQ ID NO: 407672 - DNA, 15 bp, Homo sapiens
taaggtatgtaaaac

SEQ ID NO: 407673 - DNA, 15 bp, Homo sapiens
aaggtatgtaaaacc

SEQ ID NO: 407674 - DNA, 15 bp, Homo sapiens
aggtatgtaaaacct

SEQ ID NO: 407675 - DNA, 15 bp, Homo sapiens
ggtatgtaaaacctg

SEQ ID NO: 407676 - DNA, 15 bp, Homo sapiens
gtatgtaaaacctgt

SEQ ID NO: 407677 - DNA, 15 bp, Homo sapiens
tatgtaaaacctgtt

SEQ ID NO: 407678 - DNA, 15 bp, Homo sapiens
atgtaaaacctgttt

SEQ ID NO: 407679 - DNA, 15 bp, Homo sapiens
tgtaaaacctgtttg

SEQ ID NO: 407680 - DNA, 15 bp, Homo sapiens
gtaaaacctgtttgt

SEQ ID NO: 407681 - DNA, 15 bp, Homo sapiens
taaaacctgtttgtc

SEQ ID NO: 407682 - DNA, 15 bp, Homo sapiens
aaaacctgtttgtct

SEQ ID NO: 407683 - DNA, 15 bp, Homo sapiens
aaacctgtttgtctt

SEQ ID NO: 407684 - DNA, 15 bp, Homo sapiens
aacctgtttgtcttt

SEQ ID NO: 407685 - DNA, 15 bp, Homo sapiens
acctgtttgtctttg

SEQ ID NO: 407686 - DNA, 15 bp, Homo sapiens
cctgtttgtctttga

SEQ ID NO: 407687 - DNA, 15 bp, Homo sapiens
ctgtttgtctttgac

SEQ ID NO: 407688 - DNA, 15 bp, Homo sapiens
tgtttgtctttgact

SEQ ID NO: 407689 - DNA, 15 bp, Homo sapiens
gtttgtctttgacta

SEQ ID NO: 407690 - DNA, 15 bp, Homo sapiens
tttgtctttgactag

SEQ ID NO: 407691 - DNA, 15 bp, Homo sapiens
ttgtctttgactaga

SEQ ID NO: 407692 - DNA, 15 bp, Homo sapiens
tgtctttgactagaa

SEQ ID NO: 407693 - DNA, 15 bp, Homo sapiens
gtctttgactagaac

SEQ ID NO: 407694 - DNA, 15 bp, Homo sapiens
tctttgactagaact

SEQ ID NO: 407695 - DNA, 15 bp, Homo sapiens
ctttgactagaactt

SEQ ID NO: 407696 - DNA, 15 bp, Homo sapiens
tttgactagaactta

SEQ ID NO: 407697 - DNA, 15 bp, Homo sapiens
ttgactagaacttat

SEQ ID NO: 407698 - DNA, 15 bp, Homo sapiens
tgactagaacttatt

SEQ ID NO: 407699 - DNA, 15 bp, Homo sapiens
gactagaacttattc

SEQ ID NO: 407700 - DNA, 15 bp, Homo sapiens
actagaacttattcc

SEQ ID NO: 407701 - DNA, 15 bp, Homo sapiens
ctagaacttattcca

SEQ ID NO: 407702 - DNA, 15 bp, Homo sapiens
tagaacttattccaa

SEQ ID NO: 407703 - DNA, 15 bp, Homo sapiens
agaacttattccaag

SEQ ID NO: 407704 - DNA, 15 bp, Homo sapiens
gaacttattccaagt

SEQ ID NO: 407705 - DNA, 15 bp, Homo sapiens
aacttattccaagtt

SEQ ID NO: 407706 - DNA, 15 bp, Homo sapiens
acttattccaagtta

SEQ ID NO: 407707 - DNA, 15 bp, Homo sapiens
cttattccaagttaa

SEQ ID NO: 407708 - DNA, 15 bp, Homo sapiens
ttattccaagttaat

SEQ ID NO: 407709 - DNA, 15 bp, Homo sapiens
tattccaagttaatg

SEQ ID NO: 407710 - DNA, 15 bp, Homo sapiens
attccaagttaatga

SEQ ID NO: 407711 - DNA, 15 bp, Homo sapiens
ttccaagttaatgag

SEQ ID NO: 407712 - DNA, 15 bp, Homo sapiens
tccaagttaatgaga

SEQ ID NO: 407713 - DNA, 15 bp, Homo sapiens
ccaagttaatgagat

SEQ ID NO: 407714 - DNA, 15 bp, Homo sapiens
caagttaatgagatc

SEQ ID NO: 407715 - DNA, 15 bp, Homo sapiens
aagttaatgagatct

SEQ ID NO: 407716 - DNA, 15 bp, Homo sapiens
agttaatgagatctc

SEQ ID NO: 407717 - DNA, 15 bp, Homo sapiens
gttaatgagatctca

SEQ ID NO: 407718 - DNA, 15 bp, Homo sapiens
ttaatgagatctcaa

SEQ ID NO: 407719 - DNA, 15 bp, Homo sapiens
taatgagatctcaaa

SEQ ID NO: 407720 - DNA, 15 bp, Homo sapiens
aatgagatctcaaac

SEQ ID NO: 407721 - DNA, 15 bp, Homo sapiens
atgagatctcaaaca

SEQ ID NO: 407722 - DNA, 15 bp, Homo sapiens
tgagatctcaaacaa

SEQ ID NO: 407723 - DNA, 15 bp, Homo sapiens
gagatctcaaacaag

SEQ ID NO: 407724 - DNA, 15 bp, Homo sapiens
agatctcaaacaagg

SEQ ID NO: 407725 - DNA, 15 bp, Homo sapiens
gatctcaaacaaggc

SEQ ID NO: 407726 - DNA, 15 bp, Homo sapiens
atctcaaacaaggca

SEQ ID NO: 407727 - DNA, 15 bp, Homo sapiens
tctcaaacaaggcat

SEQ ID NO: 407728 - DNA, 15 bp, Homo sapiens
ctcaaacaaggcata

SEQ ID NO: 407729 - DNA, 15 bp, Homo sapiens
tcaaacaaggcatag

SEQ ID NO: 407730 - DNA, 15 bp, Homo sapiens
caaacaaggcataga

SEQ ID NO: 407731 - DNA, 15 bp, Homo sapiens
aaacaaggcatagag

SEQ ID NO: 407732 - DNA, 15 bp, Homo sapiens
aacaaggcatagagt

SEQ ID NO: 407733 - DNA, 15 bp, Homo sapiens
acaaggcatagagtg

SEQ ID NO: 407734 - DNA, 15 bp, Homo sapiens
caaggcatagagtgt

SEQ ID NO: 407735 - DNA, 15 bp, Homo sapiens
aaggcatagagtgta

SEQ ID NO: 407736 - DNA, 15 bp, Homo sapiens
aggcatagagtgtat

SEQ ID NO: 407737 - DNA, 15 bp, Homo sapiens
ggcatagagtgtatg

SEQ ID NO: 407738 - DNA, 15 bp, Homo sapiens
gcatagagtgtatgt

SEQ ID NO: 407739 - DNA, 15 bp, Homo sapiens
catagagtgtatgtc

SEQ ID NO: 407740 - DNA, 15 bp, Homo sapiens
atagagtgtatgtcc

SEQ ID NO: 407741 - DNA, 15 bp, Homo sapiens
tagagtgtatgtccc

SEQ ID NO: 407742 - DNA, 15 bp, Homo sapiens
agagtgtatgtccct

SEQ ID NO: 407743 - DNA, 15 bp, Homo sapiens
gagtgtatgtccctt

SEQ ID NO: 407744 - DNA, 15 bp, Homo sapiens
agtgtatgtcccttt

SEQ ID NO: 407745 - DNA, 15 bp, Homo sapiens
gtgtatgtccctttt

SEQ ID NO: 407746 - DNA, 15 bp, Homo sapiens
tgtatgtcccttttt

SEQ ID NO: 407747 - DNA, 15 bp, Homo sapiens
gtatgtccctttttg

SEQ ID NO: 407748 - DNA, 15 bp, Homo sapiens
tatgtccctttttga

SEQ ID NO: 407749 - DNA, 15 bp, Homo sapiens
atgtccctttttgaa

SEQ ID NO: 407750 - DNA, 15 bp, Homo sapiens
tgtccctttttgaaa

SEQ ID NO: 407751 - DNA, 15 bp, Homo sapiens
gtccctttttgaaaa

SEQ ID NO: 407752 - DNA, 15 bp, Homo sapiens
tccctttttgaaaag

SEQ ID NO: 407753 - DNA, 15 bp, Homo sapiens
ccctttttgaaaaga

SEQ ID NO: 407754 - DNA, 15 bp, Homo sapiens
cctttttgaaaagat

SEQ ID NO: 407755 - DNA, 15 bp, Homo sapiens
ctttttgaaaagatg

SEQ ID NO: 407756 - DNA, 15 bp, Homo sapiens
tttttgaaaagatga

SEQ ID NO: 407757 - DNA, 15 bp, Homo sapiens
ttttgaaaagatgat

SEQ ID NO: 407758 - DNA, 15 bp, Homo sapiens
tttgaaaagatgatg

SEQ ID NO: 407759 - DNA, 15 bp, Homo sapiens
ttgaaaagatgatga

SEQ ID NO: 407760 - DNA, 15 bp, Homo sapiens
tgaaaagatgatgat

SEQ ID NO: 407761 - DNA, 15 bp, Homo sapiens
gaaaagatgatgata

SEQ ID NO: 407762 - DNA, 15 bp, Homo sapiens
aaaagatgatgatat

SEQ ID NO: 407763 - DNA, 15 bp, Homo sapiens
aaagatgatgatatt

SEQ ID NO: 407764 - DNA, 15 bp, Homo sapiens
aagatgatgatattt

SEQ ID NO: 407765 - DNA, 15 bp, Homo sapiens
agatgatgatatttt

SEQ ID NO: 407766 - DNA, 15 bp, Homo sapiens
gatgatgatattttc

SEQ ID NO: 407767 - DNA, 15 bp, Homo sapiens
atgatgatattttct

SEQ ID NO: 407768 - DNA, 15 bp, Homo sapiens
tgatgatattttctt

SEQ ID NO: 407769 - DNA, 15 bp, Homo sapiens
gatgatattttctta

SEQ ID NO: 407770 - DNA, 15 bp, Homo sapiens
atgatattttcttaa

SEQ ID NO: 407771 - DNA, 15 bp, Homo sapiens
tgatattttcttaat

SEQ ID NO: 407772 - DNA, 15 bp, Homo sapiens
gatattttcttaatt

SEQ ID NO: 407773 - DNA, 15 bp, Homo sapiens
atattttcttaatta

SEQ ID NO: 407774 - DNA, 15 bp, Homo sapiens
tattttcttaattac

SEQ ID NO: 407775 - DNA, 15 bp, Homo sapiens
attttcttaattact

SEQ ID NO: 407776 - DNA, 15 bp, Homo sapiens
ttttcttaattactg

SEQ ID NO: 407777 - DNA, 15 bp, Homo sapiens
tttcttaattactgt

SEQ ID NO: 407778 - DNA, 15 bp, Homo sapiens
ttcttaattactgtc

SEQ ID NO: 407779 - DNA, 15 bp, Homo sapiens
tcttaattactgtct

SEQ ID NO: 407780 - DNA, 15 bp, Homo sapiens
cttaattactgtctg

SEQ ID NO: 407781 - DNA, 15 bp, Homo sapiens
ttaattactgtctgt

SEQ ID NO: 407782 - DNA, 15 bp, Homo sapiens
taattactgtctgtg

SEQ ID NO: 407783 - DNA, 15 bp, Homo sapiens
aattactgtctgtgt

SEQ ID NO: 407784 - DNA, 15 bp, Homo sapiens
attactgtctgtgtt

SEQ ID NO: 407785 - DNA, 15 bp, Homo sapiens
ttactgtctgtgttt

SEQ ID NO: 407786 - DNA, 15 bp, Homo sapiens
tactgtctgtgtttg

SEQ ID NO: 407787 - DNA, 15 bp, Homo sapiens
actgtctgtgtttgg

SEQ ID NO: 407788 - DNA, 15 bp, Homo sapiens
ctgtctgtgtttggg

SEQ ID NO: 407789 - DNA, 15 bp, Homo sapiens
tgtctgtgtttgggc

SEQ ID NO: 407790 - DNA, 15 bp, Homo sapiens
gtctgtgtttgggct

SEQ ID NO: 407791 - DNA, 15 bp, Homo sapiens
tctgtgtttgggctg

SEQ ID NO: 407792 - DNA, 15 bp, Homo sapiens
ctgtgtttgggctgg

SEQ ID NO: 407793 - DNA, 15 bp, Homo sapiens
tgtgtttgggctggc

SEQ ID NO: 407794 - DNA, 15 bp, Homo sapiens
gtgtttgggctggcc

SEQ ID NO: 407795 - DNA, 15 bp, Homo sapiens
tgtttgggctggcca

SEQ ID NO: 407796 - DNA, 15 bp, Homo sapiens
gtttgggctggccaa

SEQ ID NO: 407797 - DNA, 15 bp, Homo sapiens
tttgggctggccaat

SEQ ID NO: 407798 - DNA, 15 bp, Homo sapiens
ttgggctggccaatt

SEQ ID NO: 407799 - DNA, 15 bp, Homo sapiens
tgggctggccaattt

SEQ ID NO: 407800 - DNA, 15 bp, Homo sapiens
gggctggccaatttt

SEQ ID NO: 407801 - DNA, 15 bp, Homo sapiens
ggctggccaattttg

SEQ ID NO: 407802 - DNA, 15 bp, Homo sapiens
gctggccaattttga

SEQ ID NO: 407803 - DNA, 15 bp, Homo sapiens
ctggccaattttgac

SEQ ID NO: 407804 - DNA, 15 bp, Homo sapiens
tggccaattttgacc

SEQ ID NO: 407805 - DNA, 15 bp, Homo sapiens
ggccaattttgaccc

SEQ ID NO: 407806 - DNA, 15 bp, Homo sapiens
gccaattttgaccca

SEQ ID NO: 407807 - DNA, 15 bp, Homo sapiens
ccaattttgacccag

SEQ ID NO: 407808 - DNA, 15 bp, Homo sapiens
caattttgacccagt

SEQ ID NO: 407809 - DNA, 15 bp, Homo sapiens
aattttgacccagtt

SEQ ID NO: 407810 - DNA, 15 bp, Homo sapiens
attttgacccagtta

SEQ ID NO: 407811 - DNA, 15 bp, Homo sapiens
ttttgacccagttaa

SEQ ID NO: 407812 - DNA, 15 bp, Homo sapiens
tttgacccagttaaa

SEQ ID NO: 407813 - DNA, 15 bp, Homo sapiens
ttgacccagttaaaa

SEQ ID NO: 407814 - DNA, 15 bp, Homo sapiens
tgacccagttaaaaa

SEQ ID NO: 407815 - DNA, 15 bp, Homo sapiens
gacccagttaaaaag

SEQ ID NO: 407816 - DNA, 15 bp, Homo sapiens
acccagttaaaaagc

SEQ ID NO: 407817 - DNA, 15 bp, Homo sapiens
cccagttaaaaagct

SEQ ID NO: 407818 - DNA, 15 bp, Homo sapiens
ccagttaaaaagctg

SEQ ID NO: 407819 - DNA, 15 bp, Homo sapiens
cagttaaaaagctgc

SEQ ID NO: 407820 - DNA, 15 bp, Homo sapiens
agttaaaaagctgca

SEQ ID NO: 407821 - DNA, 15 bp, Homo sapiens
gttaaaaagctgcaa

SEQ ID NO: 407822 - DNA, 15 bp, Homo sapiens
ttaaaaagctgcaaa

SEQ ID NO: 407823 - DNA, 15 bp, Homo sapiens
taaaaagctgcaaaa

SEQ ID NO: 407824 - DNA, 15 bp, Homo sapiens
aaaaagctgcaaaag

SEQ ID NO: 407825 - DNA, 15 bp, Homo sapiens
aaagctgcaaaagcg

SEQ ID NO: 407826 - DNA, 15 bp, Homo sapiens
aagctgcaaaagcgt

SEQ ID NO: 407827 - DNA, 15 bp, Homo sapiens
agctgcaaaagcgtg

SEQ ID NO: 407828 - DNA, 15 bp, Homo sapiens
gctgcaaaagcgtgg

SEQ ID NO: 407829 - DNA, 15 bp, Homo sapiens
ctgcaaaagcgtggt

SEQ ID NO: 407830 - DNA, 15 bp, Homo sapiens
tgcaaaagcgtggtc

SEQ ID NO: 407831 - DNA, 15 bp, Homo sapiens
gcaaaagcgtggtct

SEQ ID NO: 407832 - DNA, 15 bp, Homo sapiens
caaaagcgtggtctg

SEQ ID NO: 407833 - DNA, 15 bp, Homo sapiens
aaaagcgtggtctga

SEQ ID NO: 407834 - DNA, 15 bp, Homo sapiens
aaagcgtggtctgaa

SEQ ID NO: 407835 - DNA, 15 bp, Homo sapiens
aagcgtggtctgaac

SEQ ID NO: 407836 - DNA, 15 bp, Homo sapiens
agcgtggtctgaact

SEQ ID NO: 407837 - DNA, 15 bp, Homo sapiens
gcgtggtctgaactt

SEQ ID NO: 407838 - DNA, 15 bp, Homo sapiens
cgtggtctgaacttc

SEQ ID NO: 407839 - DNA, 15 bp, Homo sapiens
gtggtctgaacttct

SEQ ID NO: 407840 - DNA, 15 bp, Homo sapiens
tggtctgaacttctc

SEQ ID NO: 407841 - DNA, 15 bp, Homo sapiens
ggtctgaacttctct

SEQ ID NO: 407842 - DNA, 15 bp, Homo sapiens
gtctgaacttctctt

SEQ ID NO: 407843 - DNA, 15 bp, Homo sapiens
tctgaacttctcttt

SEQ ID NO: 407844 - DNA, 15 bp, Homo sapiens
ctgaacttctctttt

SEQ ID NO: 407845 - DNA, 15 bp, Homo sapiens
tgaacttctcttttt

SEQ ID NO: 407846 - DNA, 15 bp, Homo sapiens
gaacttctcttttta

SEQ ID NO: 407847 - DNA, 15 bp, Homo sapiens
aacttctctttttat

SEQ ID NO: 407848 - DNA, 15 bp, Homo sapiens
acttctctttttatt

SEQ ID NO: 407849 - DNA, 15 bp, Homo sapiens
cttctctttttatta

SEQ ID NO: 407850 - DNA, 15 bp, Homo sapiens
ttctctttttattat

SEQ ID NO: 407851 - DNA, 15 bp, Homo sapiens
tctctttttattatg

SEQ ID NO: 407852 - DNA, 15 bp, Homo sapiens
ctctttttattatgg

SEQ ID NO: 407853 - DNA, 15 bp, Homo sapiens
tctttttattatggc

SEQ ID NO: 407854 - DNA, 15 bp, Homo sapiens
ctttttattatggct

SEQ ID NO: 407855 - DNA, 15 bp, Homo sapiens
tttttattatggcta

SEQ ID NO: 407856 - DNA, 15 bp, Homo sapiens
ttttattatggctaa

SEQ ID NO: 407857 - DNA, 15 bp, Homo sapiens
tttattatggctaat

SEQ ID NO: 407858 - DNA, 15 bp, Homo sapiens
ttattatggctaatt

SEQ ID NO: 407859 - DNA, 15 bp, Homo sapiens
tattatggctaattt

SEQ ID NO: 407860 - DNA, 15 bp, Homo sapiens
attatggctaatttt

SEQ ID NO: 407861 - DNA, 15 bp, Homo sapiens
ttatggctaattttc

SEQ ID NO: 407862 - DNA, 15 bp, Homo sapiens
tatggctaattttcc

SEQ ID NO: 407863 - DNA, 15 bp, Homo sapiens
atggctaattttcct

SEQ ID NO: 407864 - DNA, 15 bp, Homo sapiens
tggctaattttcctt

SEQ ID NO: 407865 - DNA, 15 bp, Homo sapiens
ggctaattttccttt

SEQ ID NO: 407866 - DNA, 15 bp, Homo sapiens
gctaattttccttta

SEQ ID NO: 407867 - DNA, 15 bp, Homo sapiens
ctaattttcctttaa

SEQ ID NO: 407868 - DNA, 15 bp, Homo sapiens
taattttcctttaat

SEQ ID NO: 407869 - DNA, 15 bp, Homo sapiens
aattttcctttaatt

SEQ ID NO: 407870 - DNA, 15 bp, Homo sapiens
attttcctttaattt

SEQ ID NO: 407871 - DNA, 15 bp, Homo sapiens
ttttcctttaattta

SEQ ID NO: 407872 - DNA, 15 bp, Homo sapiens
tttcctttaatttag

SEQ ID NO: 407873 - DNA, 15 bp, Homo sapiens
ttcctttaatttaga

SEQ ID NO: 407874 - DNA, 15 bp, Homo sapiens
tcctttaatttagac

SEQ ID NO: 407875 - DNA, 15 bp, Homo sapiens
cctttaatttagact

SEQ ID NO: 407876 - DNA, 15 bp, Homo sapiens
ctttaatttagacta

SEQ ID NO: 407877 - DNA, 15 bp, Homo sapiens
tttaatttagactac

SEQ ID NO: 407878 - DNA, 15 bp, Homo sapiens
ttaatttagactact

SEQ ID NO: 407879 - DNA, 15 bp, Homo sapiens
taatttagactactt

SEQ ID NO: 407880 - DNA, 15 bp, Homo sapiens
aatttagactactta

SEQ ID NO: 407881 - DNA, 15 bp, Homo sapiens
atttagactacttat

SEQ ID NO: 407882 - DNA, 15 bp, Homo sapiens
tttagactacttata

SEQ ID NO: 407883 - DNA, 15 bp, Homo sapiens
ttagactacttatac

SEQ ID NO: 407884 - DNA, 15 bp, Homo sapiens
tagactacttataca

SEQ ID NO: 407885 - DNA, 15 bp, Homo sapiens
agactacttatacaa

SEQ ID NO: 407886 - DNA, 15 bp, Homo sapiens
gactacttatacaaa

SEQ ID NO: 407887 - DNA, 15 bp, Homo sapiens
actacttatacaaat

SEQ ID NO: 407888 - DNA, 15 bp, Homo sapiens
ctacttatacaaata

SEQ ID NO: 407889 - DNA, 15 bp, Homo sapiens
tacttatacaaatac

SEQ ID NO: 407890 - DNA, 15 bp, Homo sapiens
acttatacaaatacc

SEQ ID NO: 407891 - DNA, 15 bp, Homo sapiens
cttatacaaataccc

SEQ ID NO: 407892 - DNA, 15 bp, Homo sapiens
ttatacaaataccca

SEQ ID NO: 407893 - DNA, 15 bp, Homo sapiens
tatacaaatacccag

SEQ ID NO: 407894 - DNA, 15 bp, Homo sapiens
atacaaatacccagt

SEQ ID NO: 407895 - DNA, 15 bp, Homo sapiens
tacaaatacccagta

SEQ ID NO: 407896 - DNA, 15 bp, Homo sapiens
acaaatacccagtat

SEQ ID NO: 407897 - DNA, 15 bp, Homo sapiens
caaatacccagtatt

SEQ ID NO: 407898 - DNA, 15 bp, Homo sapiens
aaatacccagtatta

SEQ ID NO: 407899 - DNA, 15 bp, Homo sapiens
aatacccagtattat

SEQ ID NO: 407900 - DNA, 15 bp, Homo sapiens
atacccagtattatg

SEQ ID NO: 407901 - DNA, 15 bp, Homo sapiens
tacccagtattatga

SEQ ID NO: 407902 - DNA, 15 bp, Homo sapiens
acccagtattatgag

SEQ ID NO: 407903 - DNA, 15 bp, Homo sapiens
cccagtattatgagc

SEQ ID NO: 407904 - DNA, 15 bp, Homo sapiens
ccagtattatgagcc

SEQ ID NO: 407905 - DNA, 15 bp, Homo sapiens
cagtattatgagcca

SEQ ID NO: 407906 - DNA, 15 bp, Homo sapiens
agtattatgagccag

SEQ ID NO: 407907 - DNA, 15 bp, Homo sapiens
gtattatgagccagc

SEQ ID NO: 407908 - DNA, 15 bp, Homo sapiens
tattatgagccagca

SEQ ID NO: 407909 - DNA, 15 bp, Homo sapiens
attatgagccagcaa

SEQ ID NO: 407910 - DNA, 15 bp, Homo sapiens
ttatgagccagcaaa

SEQ ID NO: 407911 - DNA, 15 bp, Homo sapiens
tatgagccagcaaaa

SEQ ID NO: 407912 - DNA, 15 bp, Homo sapiens
atgagccagcaaaat

SEQ ID NO: 407913 - DNA, 15 bp, Homo sapiens
tgagccagcaaaatt

SEQ ID NO: 407914 - DNA, 15 bp, Homo sapiens
gagccagcaaaatta

SEQ ID NO: 407915 - DNA, 15 bp, Homo sapiens
agccagcaaaattaa

SEQ ID NO: 407916 - DNA, 15 bp, Homo sapiens
gccagcaaaattaac

SEQ ID NO: 407917 - DNA, 15 bp, Homo sapiens
ccagcaaaattaaca

SEQ ID NO: 407918 - DNA, 15 bp, Homo sapiens
cagcaaaattaacag

SEQ ID NO: 407919 - DNA, 15 bp, Homo sapiens
agcaaaattaacagg

SEQ ID NO: 407920 - DNA, 15 bp, Homo sapiens
gcaaaattaacaggt

SEQ ID NO: 407921 - DNA, 15 bp, Homo sapiens
caaaattaacaggtg

SEQ ID NO: 407922 - DNA, 15 bp, Homo sapiens
aaaattaacaggtgt

SEQ ID NO: 407923 - DNA, 15 bp, Homo sapiens
aaattaacaggtgtg

SEQ ID NO: 407924 - DNA, 15 bp, Homo sapiens
aattaacaggtgtgg

SEQ ID NO: 407925 - DNA, 15 bp, Homo sapiens
attaacaggtgtgga

SEQ ID NO: 407926 - DNA, 15 bp, Homo sapiens
ttaacaggtgtggat

SEQ ID NO: 407927 - DNA, 15 bp, Homo sapiens
taacaggtgtggatt

SEQ ID NO: 407928 - DNA, 15 bp, Homo sapiens
aacaggtgtggattt

SEQ ID NO: 407929 - DNA, 15 bp, Homo sapiens
acaggtgtggattta

SEQ ID NO: 407930 - DNA, 15 bp, Homo sapiens
caggtgtggatttaa

SEQ ID NO: 407931 - DNA, 15 bp, Homo sapiens
aggtgtggatttaat

SEQ ID NO: 407932 - DNA, 15 bp, Homo sapiens
ggtgtggatttaata

SEQ ID NO: 407933 - DNA, 15 bp, Homo sapiens
gtgtggatttaatat

SEQ ID NO: 407934 - DNA, 15 bp, Homo sapiens
tgtggatttaatatg

SEQ ID NO: 407935 - DNA, 15 bp, Homo sapiens
gtggatttaatatgt

SEQ ID NO: 407936 - DNA, 15 bp, Homo sapiens
tggatttaatatgta

SEQ ID NO: 407937 - DNA, 15 bp, Homo sapiens
ggatttaatatgtag

SEQ ID NO: 407938 - DNA, 15 bp, Homo sapiens
gatttaatatgtagt

SEQ ID NO: 407939 - DNA, 15 bp, Homo sapiens
atttaatatgtagtg

SEQ ID NO: 407940 - DNA, 15 bp, Homo sapiens
tttaatatgtagtgt

SEQ ID NO: 407941 - DNA, 15 bp, Homo sapiens
ttaatatgtagtgtg

SEQ ID NO: 407942 - DNA, 15 bp, Homo sapiens
taatatgtagtgtgg

SEQ ID NO: 407943 - DNA, 15 bp, Homo sapiens
aatatgtagtgtggg

SEQ ID NO: 407944 - DNA, 15 bp, Homo sapiens
atatgtagtgtgggt

SEQ ID NO: 407945 - DNA, 15 bp, Homo sapiens
tatgtagtgtgggtc

SEQ ID NO: 407946 - DNA, 15 bp, Homo sapiens
atgtagtgtgggtcc

SEQ ID NO: 407947 - DNA, 15 bp, Homo sapiens
tgtagtgtgggtcca

SEQ ID NO: 407948 - DNA, 15 bp, Homo sapiens
gtagtgtgggtccac

SEQ ID NO: 407949 - DNA, 15 bp, Homo sapiens
tagtgtgggtccaca

SEQ ID NO: 407950 - DNA, 15 bp, Homo sapiens
agtgtgggtccacag

SEQ ID NO: 407951 - DNA, 15 bp, Homo sapiens
gtgtgggtccacaga

SEQ ID NO: 407952 - DNA, 15 bp, Homo sapiens
tgtgggtccacagag

SEQ ID NO: 407953 - DNA, 15 bp, Homo sapiens
gtgggtccacagaga

SEQ ID NO: 407954 - DNA, 15 bp, Homo sapiens
tgggtccacagagat

SEQ ID NO: 407955 - DNA, 15 bp, Homo sapiens
gggtccacagagatt

SEQ ID NO: 407956 - DNA, 15 bp, Homo sapiens
ggtccacagagatta

SEQ ID NO: 407957 - DNA, 15 bp, Homo sapiens
gtccacagagattat

SEQ ID NO: 407958 - DNA, 15 bp, Homo sapiens
tccacagagattata

SEQ ID NO: 407959 - DNA, 15 bp, Homo sapiens
ccacagagattatat

SEQ ID NO: 407960 - DNA, 15 bp, Homo sapiens
cacagagattatatt

SEQ ID NO: 407961 - DNA, 15 bp, Homo sapiens
acagagattatattc

SEQ ID NO: 407962 - DNA, 15 bp, Homo sapiens
cagagattatattcg

SEQ ID NO: 407963 - DNA, 15 bp, Homo sapiens
agagattatattcgt

SEQ ID NO: 407964 - DNA, 15 bp, Homo sapiens
gagattatattcgtt

SEQ ID NO: 407965 - DNA, 15 bp, Homo sapiens
agattatattcgttg

SEQ ID NO: 407966 - DNA, 15 bp, Homo sapiens
gattatattcgttgt

SEQ ID NO: 407967 - DNA, 15 bp, Homo sapiens
attatattcgttgta

SEQ ID NO: 407968 - DNA, 15 bp, Homo sapiens
ttatattcgttgtat

SEQ ID NO: 407969 - DNA, 15 bp, Homo sapiens
tatattcgttgtata

SEQ ID NO: 407970 - DNA, 15 bp, Homo sapiens
atattcgttgtataa

SEQ ID NO: 407971 - DNA, 15 bp, Homo sapiens
tattcgttgtataaa

SEQ ID NO: 407972 - DNA, 15 bp, Homo sapiens
attcgttgtataaag

SEQ ID NO: 407973 - DNA, 15 bp, Homo sapiens
ttcgttgtataaagc

SEQ ID NO: 407974 - DNA, 15 bp, Homo sapiens
tcgttgtataaagcc

SEQ ID NO: 407975 - DNA, 15 bp, Homo sapiens
cgttgtataaagcct

SEQ ID NO: 407976 - DNA, 15 bp, Homo sapiens
gttgtataaagccta

SEQ ID NO: 407977 - DNA, 15 bp, Homo sapiens
ttgtataaagcctaa

SEQ ID NO: 407978 - DNA, 15 bp, Homo sapiens
tgtataaagcctaat

SEQ ID NO: 407979 - DNA, 15 bp, Homo sapiens
gtataaagcctaatt

SEQ ID NO: 407980 - DNA, 15 bp, Homo sapiens
tataaagcctaattt

SEQ ID NO: 407981 - DNA, 15 bp, Homo sapiens
ataaagcctaatttt

SEQ ID NO: 407982 - DNA, 15 bp, Homo sapiens
taaagcctaattttt

SEQ ID NO: 407983 - DNA, 15 bp, Homo sapiens
aaagcctaatttttt

SEQ ID NO: 407984 - DNA, 15 bp, Homo sapiens
aagcctaattttttg

SEQ ID NO: 407985 - DNA, 15 bp, Homo sapiens
agcctaattttttgt

SEQ ID NO: 407986 - DNA, 15 bp, Homo sapiens
gcctaattttttgtc

SEQ ID NO: 407987 - DNA, 15 bp, Homo sapiens
cctaattttttgtct

SEQ ID NO: 407988 - DNA, 15 bp, Homo sapiens
ctaattttttgtctt

SEQ ID NO: 407989 - DNA, 15 bp, Homo sapiens
taattttttgtctta

SEQ ID NO: 407990 - DNA, 15 bp, Homo sapiens
aattttttgtcttag

SEQ ID NO: 407991 - DNA, 15 bp, Homo sapiens
attttttgtcttagt

SEQ ID NO: 407992 - DNA, 15 bp, Homo sapiens
ttttttgtcttagtt

SEQ ID NO: 407993 - DNA, 15 bp, Homo sapiens
tttttgtcttagttg

SEQ ID NO: 407994 - DNA, 15 bp, Homo sapiens
ttttgtcttagttgt

SEQ ID NO: 407995 - DNA, 15 bp, Homo sapiens
tttgtcttagttgtc

SEQ ID NO: 407996 - DNA, 15 bp, Homo sapiens
tcttagttgtccttg

SEQ ID NO: 407997 - DNA, 15 bp, Homo sapiens
cttagttgtccttgt

SEQ ID NO: 407998 - DNA, 15 bp, Homo sapiens
ttagttgtccttgtc

SEQ ID NO: 407999 - DNA, 15 bp, Homo sapiens
tagttgtccttgtca

SEQ ID NO: 408000 - DNA, 15 bp, Homo sapiens
agttgtccttgtcat

SEQ ID NO: 408001 - DNA, 15 bp, Homo sapiens
gttgtccttgtcatg

SEQ ID NO: 408002 - DNA, 15 bp, Homo sapiens
ttgtccttgtcatgt

SEQ ID NO: 408003 - DNA, 15 bp, Homo sapiens
tgtccttgtcatgtt

SEQ ID NO: 408004 - DNA, 15 bp, Homo sapiens
gtccttgtcatgttt

SEQ ID NO: 408005 - DNA, 15 bp, Homo sapiens
tccttgtcatgttta

SEQ ID NO: 408006 - DNA, 15 bp, Homo sapiens
ccttgtcatgtttag

SEQ ID NO: 408007 - DNA, 15 bp, Homo sapiens
cttgtcatgtttaga

SEQ ID NO: 408008 - DNA, 15 bp, Homo sapiens
ttgtcatgtttagat

SEQ ID NO: 408009 - DNA, 15 bp, Homo sapiens
tgtcatgtttagatc

SEQ ID NO: 408010 - DNA, 15 bp, Homo sapiens
gtcatgtttagatct

SEQ ID NO: 408011 - DNA, 15 bp, Homo sapiens
tcatgtttagatctt

SEQ ID NO: 408012 - DNA, 15 bp, Homo sapiens
catgtttagatctta

SEQ ID NO: 408013 - DNA, 15 bp, Homo sapiens
atgtttagatcttat

SEQ ID NO: 408014 - DNA, 15 bp, Homo sapiens
tgtttagatcttatt

SEQ ID NO: 408015 - DNA, 15 bp, Homo sapiens
gtttagatcttattt

SEQ ID NO: 408016 - DNA, 15 bp, Homo sapiens
tttagatcttatttc

SEQ ID NO: 408017 - DNA, 15 bp, Homo sapiens
ttagatcttatttca

SEQ ID NO: 408018 - DNA, 15 bp, Homo sapiens
tagatcttatttcaa

SEQ ID NO: 408019 - DNA, 15 bp, Homo sapiens
agatcttatttcaag

SEQ ID NO: 408020 - DNA, 15 bp, Homo sapiens
gatcttatttcaagc

SEQ ID NO: 408021 - DNA, 15 bp, Homo sapiens
atcttatttcaagcc

SEQ ID NO: 408022 - DNA, 15 bp, Homo sapiens
tcttatttcaagcca

SEQ ID NO: 408023 - DNA, 15 bp, Homo sapiens
cttatttcaagccat

SEQ ID NO: 408024 - DNA, 15 bp, Homo sapiens
ttatttcaagccatt

SEQ ID NO: 408025 - DNA, 15 bp, Homo sapiens
tatttcaagccattt

SEQ ID NO: 408026 - DNA, 15 bp, Homo sapiens
atttcaagccatttc

SEQ ID NO: 408027 - DNA, 15 bp, Homo sapiens
tttcaagccatttct

SEQ ID NO: 408028 - DNA, 15 bp, Homo sapiens
ttcaagccatttctt

SEQ ID NO: 408029 - DNA, 15 bp, Homo sapiens
tcaagccatttcttt

SEQ ID NO: 408030 - DNA, 15 bp, Homo sapiens
caagccatttctttt

SEQ ID NO: 408031 - DNA, 15 bp, Homo sapiens
aagccatttcttttt

SEQ ID NO: 408032 - DNA, 15 bp, Homo sapiens
agccatttctttttc

SEQ ID NO: 408033 - DNA, 15 bp, Homo sapiens
gccatttctttttca

SEQ ID NO: 408034 - DNA, 15 bp, Homo sapiens
ccatttctttttcat

SEQ ID NO: 408035 - DNA, 15 bp, Homo sapiens
catttctttttcatt

SEQ ID NO: 408036 - DNA, 15 bp, Homo sapiens
atttctttttcattt

SEQ ID NO: 408037 - DNA, 15 bp, Homo sapiens
ttctttttcattttc

SEQ ID NO: 408038 - DNA, 15 bp, Homo sapiens
tctttttcattttct

SEQ ID NO: 408039 - DNA, 15 bp, Homo sapiens
ctttttcattttctg

SEQ ID NO: 408040 - DNA, 15 bp, Homo sapiens
tttttcattttctga

SEQ ID NO: 408041 - DNA, 15 bp, Homo sapiens
ttttcattttctgat

SEQ ID NO: 408042 - DNA, 15 bp, Homo sapiens
tttcattttctgata

SEQ ID NO: 408043 - DNA, 15 bp, Homo sapiens
ttcattttctgataa

SEQ ID NO: 408044 - DNA, 15 bp, Homo sapiens
tcattttctgataat

SEQ ID NO: 408045 - DNA, 15 bp, Homo sapiens
cattttctgataatc

SEQ ID NO: 408046 - DNA, 15 bp, Homo sapiens
attttctgataatct

SEQ ID NO: 408047 - DNA, 15 bp, Homo sapiens
ttttctgataatctg

SEQ ID NO: 408048 - DNA, 15 bp, Homo sapiens
tttctgataatctga

SEQ ID NO: 408049 - DNA, 15 bp, Homo sapiens
ttctgataatctgat

SEQ ID NO: 408050 - DNA, 15 bp, Homo sapiens
tctgataatctgatt

SEQ ID NO: 408051 - DNA, 15 bp, Homo sapiens
ctgataatctgattt

SEQ ID NO: 408052 - DNA, 15 bp, Homo sapiens
tgataatctgatttc

SEQ ID NO: 408053 - DNA, 15 bp, Homo sapiens
gataatctgatttca

SEQ ID NO: 408054 - DNA, 15 bp, Homo sapiens
ataatctgatttcat

SEQ ID NO: 408055 - DNA, 15 bp, Homo sapiens
taatctgatttcatt

SEQ ID NO: 408056 - DNA, 15 bp, Homo sapiens
aatctgatttcattg

SEQ ID NO: 408057 - DNA, 15 bp, Homo sapiens
atctgatttcattgt

SEQ ID NO: 408058 - DNA, 15 bp, Homo sapiens
tctgatttcattgtc

SEQ ID NO: 408059 - DNA, 15 bp, Homo sapiens
ctgatttcattgtca

SEQ ID NO: 408060 - DNA, 15 bp, Homo sapiens
tgatttcattgtcac

SEQ ID NO: 408061 - DNA, 15 bp, Homo sapiens
gatttcattgtcacc

SEQ ID NO: 408062 - DNA, 15 bp, Homo sapiens
atttcattgtcacct

SEQ ID NO: 408063 - DNA, 15 bp, Homo sapiens
tttcattgtcacctt

SEQ ID NO: 408064 - DNA, 15 bp, Homo sapiens
ttcattgtcacctta

SEQ ID NO: 408065 - DNA, 15 bp, Homo sapiens
tcattgtcaccttaa

SEQ ID NO: 408066 - DNA, 15 bp, Homo sapiens
cattgtcaccttaat

SEQ ID NO: 408067 - DNA, 15 bp, Homo sapiens
attgtcaccttaata

SEQ ID NO: 408068 - DNA, 15 bp, Homo sapiens
ttgtcaccttaatat

SEQ ID NO: 408069 - DNA, 15 bp, Homo sapiens
tgtcaccttaatatc

SEQ ID NO: 408070 - DNA, 15 bp, Homo sapiens
gtcaccttaatatct

SEQ ID NO: 408071 - DNA, 15 bp, Homo sapiens
tcaccttaatatctt

SEQ ID NO: 408072 - DNA, 15 bp, Homo sapiens
caccttaatatcttc

SEQ ID NO: 408073 - DNA, 15 bp, Homo sapiens
accttaatatcttct

SEQ ID NO: 408074 - DNA, 15 bp, Homo sapiens
ccttaatatcttctt

SEQ ID NO: 408075 - DNA, 15 bp, Homo sapiens
cttaatatcttcttt

SEQ ID NO: 408076 - DNA, 15 bp, Homo sapiens
ttaatatcttctttt

SEQ ID NO: 408077 - DNA, 15 bp, Homo sapiens
taatatcttcttttt

SEQ ID NO: 408078 - DNA, 15 bp, Homo sapiens
aatatcttctttttt

SEQ ID NO: 408079 - DNA, 15 bp, Homo sapiens
atatcttcttttttt

SEQ ID NO: 408080 - DNA, 15 bp, Homo sapiens
tatcttctttttttg

SEQ ID NO: 408081 - DNA, 15 bp, Homo sapiens
atcttctttttttgt

SEQ ID NO: 408082 - DNA, 15 bp, Homo sapiens
tcttctttttttgtg

SEQ ID NO: 408083 - DNA, 15 bp, Homo sapiens
cttctttttttgtgt

SEQ ID NO: 408084 - DNA, 15 bp, Homo sapiens
ttctttttttgtgtt

SEQ ID NO: 408085 - DNA, 15 bp, Homo sapiens
tctttttttgtgttt

SEQ ID NO: 408086 - DNA, 15 bp, Homo sapiens
ctttttttgtgtttg

SEQ ID NO: 408087 - DNA, 15 bp, Homo sapiens
tttttttgtgtttgc

SEQ ID NO: 408088 - DNA, 15 bp, Homo sapiens
ttttttgtgtttgca

SEQ ID NO: 408089 - DNA, 15 bp, Homo sapiens
tttttgtgtttgcaa

SEQ ID NO: 408090 - DNA, 15 bp, Homo sapiens
ttttgtgtttgcaat

SEQ ID NO: 408091 - DNA, 15 bp, Homo sapiens
tttgtgtttgcaatc

SEQ ID NO: 408092 - DNA, 15 bp, Homo sapiens
ttgtgtttgcaatct

SEQ ID NO: 408093 - DNA, 15 bp, Homo sapiens
tgtgtttgcaatctt

SEQ ID NO: 408094 - DNA, 15 bp, Homo sapiens
gtgtttgcaatcttt

SEQ ID NO: 408095 - DNA, 15 bp, Homo sapiens
tgtttgcaatctttt

SEQ ID NO: 408096 - DNA, 15 bp, Homo sapiens
gtttgcaatcttttg

SEQ ID NO: 408097 - DNA, 15 bp, Homo sapiens
tttgcaatcttttgt

SEQ ID NO: 408098 - DNA, 15 bp, Homo sapiens
ttgcaatcttttgtt

SEQ ID NO: 408099 - DNA, 15 bp, Homo sapiens
tgcaatcttttgttt

SEQ ID NO: 408100 - DNA, 15 bp, Homo sapiens
gcaatcttttgtttt

SEQ ID NO: 408101 - DNA, 15 bp, Homo sapiens
caatcttttgttttt

SEQ ID NO: 408102 - DNA, 15 bp, Homo sapiens
aatcttttgtttttc

SEQ ID NO: 408103 - DNA, 15 bp, Homo sapiens
atcttttgtttttct

SEQ ID NO: 408104 - DNA, 15 bp, Homo sapiens
tcttttgtttttcta

SEQ ID NO: 408105 - DNA, 15 bp, Homo sapiens
cttttgtttttctaa

SEQ ID NO: 408106 - DNA, 15 bp, Homo sapiens
ttttgtttttctaac

SEQ ID NO: 408107 - DNA, 15 bp, Homo sapiens
tttgtttttctaact

SEQ ID NO: 408108 - DNA, 15 bp, Homo sapiens
ttgtttttctaactc

SEQ ID NO: 408109 - DNA, 15 bp, Homo sapiens
tgtttttctaactct

SEQ ID NO: 408110 - DNA, 15 bp, Homo sapiens
gtttttctaactcta

SEQ ID NO: 408111 - DNA, 15 bp, Homo sapiens
tttttctaactctaa

SEQ ID NO: 408112 - DNA, 15 bp, Homo sapiens
ttttctaactctaat

SEQ ID NO: 408113 - DNA, 15 bp, Homo sapiens
tttctaactctaatc

SEQ ID NO: 408114 - DNA, 15 bp, Homo sapiens
ttctaactctaatcc

SEQ ID NO: 408115 - DNA, 15 bp, Homo sapiens
tctaactctaatccc

SEQ ID NO: 408116 - DNA, 15 bp, Homo sapiens
ctaactctaatccca

SEQ ID NO: 408117 - DNA, 15 bp, Homo sapiens
taactctaatcccaa

SEQ ID NO: 408118 - DNA, 15 bp, Homo sapiens
aactctaatcccaag

SEQ ID NO: 408119 - DNA, 15 bp, Homo sapiens
actctaatcccaaga

SEQ ID NO: 408120 - DNA, 15 bp, Homo sapiens
ctctaatcccaagag

SEQ ID NO: 408121 - DNA, 15 bp, Homo sapiens
tctaatcccaagagg

SEQ ID NO: 408122 - DNA, 15 bp, Homo sapiens
ctaatcccaagaggc

SEQ ID NO: 408123 - DNA, 15 bp, Homo sapiens
taatcccaagaggca

SEQ ID NO: 408124 - DNA, 15 bp, Homo sapiens
aatcccaagaggcaa

SEQ ID NO: 408125 - DNA, 15 bp, Homo sapiens
atcccaagaggcaaa

SEQ ID NO: 408126 - DNA, 15 bp, Homo sapiens
tcccaagaggcaaaa

SEQ ID NO: 408127 - DNA, 15 bp, Homo sapiens
cccaagaggcaaaag

SEQ ID NO: 408128 - DNA, 15 bp, Homo sapiens
ccaagaggcaaaagt

SEQ ID NO: 408129 - DNA, 15 bp, Homo sapiens
caagaggcaaaagta

SEQ ID NO: 408130 - DNA, 15 bp, Homo sapiens
aagaggcaaaagtaa

SEQ ID NO: 408131 - DNA, 15 bp, Homo sapiens
agaggcaaaagtaat

SEQ ID NO: 408132 - DNA, 15 bp, Homo sapiens
gaggcaaaagtaata

SEQ ID NO: 408133 - DNA, 15 bp, Homo sapiens
aggcaaaagtaatac

SEQ ID NO: 408134 - DNA, 15 bp, Homo sapiens
ggcaaaagtaataca

SEQ ID NO: 408135 - DNA, 15 bp, Homo sapiens
gcaaaagtaatacat

SEQ ID NO: 408136 - DNA, 15 bp, Homo sapiens
caaaagtaatacatt

SEQ ID NO: 408137 - DNA, 15 bp, Homo sapiens
aaaagtaatacattt

SEQ ID NO: 408138 - DNA, 15 bp, Homo sapiens
aaagtaatacatttt

SEQ ID NO: 408139 - DNA, 15 bp, Homo sapiens
aagtaatacattttg

SEQ ID NO: 408140 - DNA, 15 bp, Homo sapiens
agtaatacattttga

SEQ ID NO: 408141 - DNA, 15 bp, Homo sapiens
gtaatacattttgag

SEQ ID NO: 408142 - DNA, 15 bp, Homo sapiens
taatacattttgagg

SEQ ID NO: 408143 - DNA, 15 bp, Homo sapiens
aatacattttgaggg

SEQ ID NO: 408144 - DNA, 15 bp, Homo sapiens
atacattttgaggga

SEQ ID NO: 408145 - DNA, 15 bp, Homo sapiens
tacattttgagggat

SEQ ID NO: 408146 - DNA, 15 bp, Homo sapiens
acattttgagggatt

SEQ ID NO: 408147 - DNA, 15 bp, Homo sapiens
cattttgagggattt

SEQ ID NO: 408148 - DNA, 15 bp, Homo sapiens
attttgagggatttt

SEQ ID NO: 408149 - DNA, 15 bp, Homo sapiens
ttttgagggattttt

SEQ ID NO: 408150 - DNA, 15 bp, Homo sapiens
tttgagggatttttg

SEQ ID NO: 408151 - DNA, 15 bp, Homo sapiens
ttgagggatttttga

SEQ ID NO: 408152 - DNA, 15 bp, Homo sapiens
tgagggatttttgag

SEQ ID NO: 408153 - DNA, 15 bp, Homo sapiens
gagggatttttgaga

SEQ ID NO: 408154 - DNA, 15 bp, Homo sapiens
agggatttttgagaa

SEQ ID NO: 408155 - DNA, 15 bp, Homo sapiens
gggatttttgagaag

SEQ ID NO: 408156 - DNA, 15 bp, Homo sapiens
ggatttttgagaagt

SEQ ID NO: 408157 - DNA, 15 bp, Homo sapiens
gatttttgagaagtt

SEQ ID NO: 408158 - DNA, 15 bp, Homo sapiens
atttttgagaagttt

SEQ ID NO: 408159 - DNA, 15 bp, Homo sapiens
tttttgagaagtttt

SEQ ID NO: 408160 - DNA, 15 bp, Homo sapiens
ttttgagaagttttg

SEQ ID NO: 408161 - DNA, 15 bp, Homo sapiens
tttgagaagttttgt

SEQ ID NO: 408162 - DNA, 15 bp, Homo sapiens
ttgagaagttttgtg

SEQ ID NO: 408163 - DNA, 15 bp, Homo sapiens
tgagaagttttgtgc

SEQ ID NO: 408164 - DNA, 15 bp, Homo sapiens
gagaagttttgtgct

SEQ ID NO: 408165 - DNA, 15 bp, Homo sapiens
agaagttttgtgctt

SEQ ID NO: 408166 - DNA, 15 bp, Homo sapiens
gaagttttgtgcttg

SEQ ID NO: 408167 - DNA, 15 bp, Homo sapiens
aagttttgtgcttgc

SEQ ID NO: 408168 - DNA, 15 bp, Homo sapiens
agttttgtgcttgcc

SEQ ID NO: 408169 - DNA, 15 bp, Homo sapiens
gttttgtgcttgcct

SEQ ID NO: 408170 - DNA, 15 bp, Homo sapiens
ttttgtgcttgcctt

SEQ ID NO: 408171 - DNA, 15 bp, Homo sapiens
tttgtgcttgccttc

SEQ ID NO: 408172 - DNA, 15 bp, Homo sapiens
ttgtgcttgccttcc

SEQ ID NO: 408173 - DNA, 15 bp, Homo sapiens
tgtgcttgccttccc

SEQ ID NO: 408174 - DNA, 15 bp, Homo sapiens
gtgcttgccttcccc

SEQ ID NO: 408175 - DNA, 15 bp, Homo sapiens
tgcttgccttcccct

SEQ ID NO: 408176 - DNA, 15 bp, Homo sapiens
gcttgccttcccctt

SEQ ID NO: 408177 - DNA, 15 bp, Homo sapiens
cttgccttccccttg

SEQ ID NO: 408178 - DNA, 15 bp, Homo sapiens
ttgccttccccttgt

SEQ ID NO: 408179 - DNA, 15 bp, Homo sapiens
tgccttccccttgtt

SEQ ID NO: 408180 - DNA, 15 bp, Homo sapiens
gccttccccttgttc

SEQ ID NO: 408181 - DNA, 15 bp, Homo sapiens
ccttccccttgttca

SEQ ID NO: 408182 - DNA, 15 bp, Homo sapiens
cttccccttgttcag

SEQ ID NO: 408183 - DNA, 15 bp, Homo sapiens
ttccccttgttcaga

SEQ ID NO: 408184 - DNA, 15 bp, Homo sapiens
tccccttgttcagat

SEQ ID NO: 408185 - DNA, 15 bp, Homo sapiens
ccccttgttcagata

SEQ ID NO: 408186 - DNA, 15 bp, Homo sapiens
cccttgttcagataa

SEQ ID NO: 408187 - DNA, 15 bp, Homo sapiens
ccttgttcagataag

SEQ ID NO: 408188 - DNA, 15 bp, Homo sapiens
cttgttcagataagt

SEQ ID NO: 408189 - DNA, 15 bp, Homo sapiens
ttgttcagataagtt

SEQ ID NO: 408190 - DNA, 15 bp, Homo sapiens
tgttcagataagttg

SEQ ID NO: 408191 - DNA, 15 bp, Homo sapiens
gttcagataagttgt

SEQ ID NO: 408192 - DNA, 15 bp, Homo sapiens
ttcagataagttgtg

SEQ ID NO: 408193 - DNA, 15 bp, Homo sapiens
tcagataagttgtgc

SEQ ID NO: 408194 - DNA, 15 bp, Homo sapiens
cagataagttgtgct

SEQ ID NO: 408195 - DNA, 15 bp, Homo sapiens
agataagttgtgctg

SEQ ID NO: 408196 - DNA, 15 bp, Homo sapiens
gataagttgtgctgc

SEQ ID NO: 408197 - DNA, 15 bp, Homo sapiens
ataagttgtgctgca

SEQ ID NO: 408198 - DNA, 15 bp, Homo sapiens
taagttgtgctgcaa

SEQ ID NO: 408199 - DNA, 15 bp, Homo sapiens
aagttgtgctgcaaa

SEQ ID NO: 408200 - DNA, 15 bp, Homo sapiens
agttgtgctgcaaat

SEQ ID NO: 408201 - DNA, 15 bp, Homo sapiens
gttgtgctgcaaatg

SEQ ID NO: 408202 - DNA, 15 bp, Homo sapiens
ttgtgctgcaaatgg

SEQ ID NO: 408203 - DNA, 15 bp, Homo sapiens
tgtgctgcaaatggc

SEQ ID NO: 408204 - DNA, 15 bp, Homo sapiens
gtgctgcaaatggct

SEQ ID NO: 408205 - DNA, 15 bp, Homo sapiens
tgctgcaaatggctc

SEQ ID NO: 408206 - DNA, 15 bp, Homo sapiens
gctgcaaatggctcc

SEQ ID NO: 408207 - DNA, 15 bp, Homo sapiens
ctgcaaatggctcca

SEQ ID NO: 408208 - DNA, 15 bp, Homo sapiens
tgcaaatggctccat

SEQ ID NO: 408209 - DNA, 15 bp, Homo sapiens
gcaaatggctccatt

SEQ ID NO: 408210 - DNA, 15 bp, Homo sapiens
caaatggctccattc

SEQ ID NO: 408211 - DNA, 15 bp, Homo sapiens
aaatggctccattcc

SEQ ID NO: 408212 - DNA, 15 bp, Homo sapiens
aatggctccattcct

SEQ ID NO: 408213 - DNA, 15 bp, Homo sapiens
atggctccattcctc

SEQ ID NO: 408214 - DNA, 15 bp, Homo sapiens
tggctccattcctcc

SEQ ID NO: 408215 - DNA, 15 bp, Homo sapiens
ggctccattcctcct

SEQ ID NO: 408216 - DNA, 15 bp, Homo sapiens
gctccattcctcctg

SEQ ID NO: 408217 - DNA, 15 bp, Homo sapiens
ctccattcctcctgt

SEQ ID NO: 408218 - DNA, 15 bp, Homo sapiens
tccattcctcctgtt

SEQ ID NO: 408219 - DNA, 15 bp, Homo sapiens
ccattcctcctgttt

SEQ ID NO: 408220 - DNA, 15 bp, Homo sapiens
cattcctcctgtttt

SEQ ID NO: 408221 - DNA, 15 bp, Homo sapiens
attcctcctgttttg

SEQ ID NO: 408222 - DNA, 15 bp, Homo sapiens
ttcctcctgttttgt

SEQ ID NO: 408223 - DNA, 15 bp, Homo sapiens
tcctcctgttttgta

SEQ ID NO: 408224 - DNA, 15 bp, Homo sapiens
cctcctgttttgtac

SEQ ID NO: 408225 - DNA, 15 bp, Homo sapiens
ctcctgttttgtact

SEQ ID NO: 408226 - DNA, 15 bp, Homo sapiens
tcctgttttgtacta

SEQ ID NO: 408227 - DNA, 15 bp, Homo sapiens
cctgttttgtactag

SEQ ID NO: 408228 - DNA, 15 bp, Homo sapiens
ctgttttgtactagt

SEQ ID NO: 408229 - DNA, 15 bp, Homo sapiens
tgttttgtactagtg

SEQ ID NO: 408230 - DNA, 15 bp, Homo sapiens
gttttgtactagtga

SEQ ID NO: 408231 - DNA, 15 bp, Homo sapiens
ttttgtactagtgac

SEQ ID NO: 408232 - DNA, 15 bp, Homo sapiens
tttgtactagtgaca

SEQ ID NO: 408233 - DNA, 15 bp, Homo sapiens
ttgtactagtgacag

SEQ ID NO: 408234 - DNA, 15 bp, Homo sapiens
tgtactagtgacagg

SEQ ID NO: 408235 - DNA, 15 bp, Homo sapiens
gtactagtgacagga

SEQ ID NO: 408236 - DNA, 15 bp, Homo sapiens
tactagtgacaggaa

SEQ ID NO: 408237 - DNA, 15 bp, Homo sapiens
actagtgacaggaaa

SEQ ID NO: 408238 - DNA, 15 bp, Homo sapiens
ctagtgacaggaaag

SEQ ID NO: 408239 - DNA, 15 bp, Homo sapiens
tagtgacaggaaagt

SEQ ID NO: 408240 - DNA, 15 bp, Homo sapiens
agtgacaggaaagtt

SEQ ID NO: 408241 - DNA, 15 bp, Homo sapiens
gtgacaggaaagttc

SEQ ID NO: 408242 - DNA, 15 bp, Homo sapiens
tgacaggaaagttcg

SEQ ID NO: 408243 - DNA, 15 bp, Homo sapiens
gacaggaaagttcgt

SEQ ID NO: 408244 - DNA, 15 bp, Homo sapiens
acaggaaagttcgtc

SEQ ID NO: 408245 - DNA, 15 bp, Homo sapiens
caggaaagttcgtct

SEQ ID NO: 408246 - DNA, 15 bp, Homo sapiens
aggaaagttcgtcta

SEQ ID NO: 408247 - DNA, 15 bp, Homo sapiens
ggaaagttcgtctag

SEQ ID NO: 408248 - DNA, 15 bp, Homo sapiens
gaaagttcgtctaga

SEQ ID NO: 408249 - DNA, 15 bp, Homo sapiens
aaagttcgtctagag

SEQ ID NO: 408250 - DNA, 15 bp, Homo sapiens
aagttcgtctagaga

SEQ ID NO: 408251 - DNA, 15 bp, Homo sapiens
agttcgtctagagat

SEQ ID NO: 408252 - DNA, 15 bp, Homo sapiens
gttcgtctagagata

SEQ ID NO: 408253 - DNA, 15 bp, Homo sapiens
ttcgtctagagataa

SEQ ID NO: 408254 - DNA, 15 bp, Homo sapiens
tcgtctagagataaa

SEQ ID NO: 408255 - DNA, 15 bp, Homo sapiens
cgtctagagataaaa

SEQ ID NO: 408256 - DNA, 15 bp, Homo sapiens
gtctagagataaaat

SEQ ID NO: 408257 - DNA, 15 bp, Homo sapiens
tctagagataaaatg

SEQ ID NO: 408258 - DNA, 15 bp, Homo sapiens
ctagagataaaatgt

SEQ ID NO: 408259 - DNA, 15 bp, Homo sapiens
tagagataaaatgtc

SEQ ID NO: 408260 - DNA, 15 bp, Homo sapiens
agagataaaatgtca

SEQ ID NO: 408261 - DNA, 15 bp, Homo sapiens
gagataaaatgtcac

SEQ ID NO: 408262 - DNA, 15 bp, Homo sapiens
agataaaatgtcaca

SEQ ID NO: 408263 - DNA, 15 bp, Homo sapiens
gataaaatgtcacaa

SEQ ID NO: 408264 - DNA, 15 bp, Homo sapiens
ataaaatgtcacaaa

SEQ ID NO: 408265 - DNA, 15 bp, Homo sapiens
taaaatgtcacaaat

SEQ ID NO: 408266 - DNA, 15 bp, Homo sapiens
aaaatgtcacaaatc

SEQ ID NO: 408267 - DNA, 15 bp, Homo sapiens
aaatgtcacaaatct

SEQ ID NO: 408268 - DNA, 15 bp, Homo sapiens
aatgtcacaaatctg

SEQ ID NO: 408269 - DNA, 15 bp, Homo sapiens
atgtcacaaatctgt

SEQ ID NO: 408270 - DNA, 15 bp, Homo sapiens
tgtcacaaatctgtc

SEQ ID NO: 408271 - DNA, 15 bp, Homo sapiens
gtcacaaatctgtcc

SEQ ID NO: 408272 - DNA, 15 bp, Homo sapiens
tcacaaatctgtcca

SEQ ID NO: 408273 - DNA, 15 bp, Homo sapiens
cacaaatctgtccac

SEQ ID NO: 408274 - DNA, 15 bp, Homo sapiens
acaaatctgtccacc

SEQ ID NO: 408275 - DNA, 15 bp, Homo sapiens
caaatctgtccacct

SEQ ID NO: 408276 - DNA, 15 bp, Homo sapiens
aaatctgtccacctc

SEQ ID NO: 408277 - DNA, 15 bp, Homo sapiens
aatctgtccacctcc

SEQ ID NO: 408278 - DNA, 15 bp, Homo sapiens
atctgtccacctcct

SEQ ID NO: 408279 - DNA, 15 bp, Homo sapiens
tctgtccacctcctc

SEQ ID NO: 408280 - DNA, 15 bp, Homo sapiens
ctgtccacctcctct

SEQ ID NO: 408281 - DNA, 15 bp, Homo sapiens
tgtccacctcctcta

SEQ ID NO: 408282 - DNA, 15 bp, Homo sapiens
gtccacctcctctac

SEQ ID NO: 408283 - DNA, 15 bp, Homo sapiens
tccacctcctctact

SEQ ID NO: 408284 - DNA, 15 bp, Homo sapiens
ccacctcctctactc

SEQ ID NO: 408285 - DNA, 15 bp, Homo sapiens
cacctcctctactct

SEQ ID NO: 408286 - DNA, 15 bp, Homo sapiens
acctcctctactctc

SEQ ID NO: 408287 - DNA, 15 bp, Homo sapiens
cctcctctactctct

SEQ ID NO: 408288 - DNA, 15 bp, Homo sapiens
ctcctctactctctc

SEQ ID NO: 408289 - DNA, 15 bp, Homo sapiens
tcctctactctctca

SEQ ID NO: 408290 - DNA, 15 bp, Homo sapiens
cctctactctctcag

SEQ ID NO: 408291 - DNA, 15 bp, Homo sapiens
ctctactctctcagg

SEQ ID NO: 408292 - DNA, 15 bp, Homo sapiens
tctactctctcaggg

SEQ ID NO: 408293 - DNA, 15 bp, Homo sapiens
ctactctctcagggg

SEQ ID NO: 408294 - DNA, 15 bp, Homo sapiens
tactctctcagggga

SEQ ID NO: 408295 - DNA, 15 bp, Homo sapiens
actctctcaggggac

SEQ ID NO: 408296 - DNA, 15 bp, Homo sapiens
ctctctcaggggact

SEQ ID NO: 408297 - DNA, 15 bp, Homo sapiens
tctctcaggggactc

SEQ ID NO: 408298 - DNA, 15 bp, Homo sapiens
ctctcaggggactct

SEQ ID NO: 408299 - DNA, 15 bp, Homo sapiens
tctcaggggactcta

SEQ ID NO: 408300 - DNA, 15 bp, Homo sapiens
ctcaggggactctac

SEQ ID NO: 408301 - DNA, 15 bp, Homo sapiens
tcaggggactctaca

SEQ ID NO: 408302 - DNA, 15 bp, Homo sapiens
caggggactctacaa

SEQ ID NO: 408303 - DNA, 15 bp, Homo sapiens
aggggactctacaac

SEQ ID NO: 408304 - DNA, 15 bp, Homo sapiens
ggggactctacaacg

SEQ ID NO: 408305 - DNA, 15 bp, Homo sapiens
gggactctacaacgt

SEQ ID NO: 408306 - DNA, 15 bp, Homo sapiens
ggactctacaacgtc

SEQ ID NO: 408307 - DNA, 15 bp, Homo sapiens
gactctacaacgtca

SEQ ID NO: 408308 - DNA, 15 bp, Homo sapiens
actctacaacgtcac

SEQ ID NO: 408309 - DNA, 15 bp, Homo sapiens
ctctacaacgtcacg

SEQ ID NO: 408310 - DNA, 15 bp, Homo sapiens
tctacaacgtcacgt

SEQ ID NO: 408311 - DNA, 15 bp, Homo sapiens
ctacaacgtcacgtt

SEQ ID NO: 408312 - DNA, 15 bp, Homo sapiens
tacaacgtcacgttt

SEQ ID NO: 408313 - DNA, 15 bp, Homo sapiens
acaacgtcacgtttt

SEQ ID NO: 408314 - DNA, 15 bp, Homo sapiens
caacgtcacgttttc

SEQ ID NO: 408315 - DNA, 15 bp, Homo sapiens
aacgtcacgttttct

SEQ ID NO: 408316 - DNA, 15 bp, Homo sapiens
acgtcacgttttctt

SEQ ID NO: 408317 - DNA, 15 bp, Homo sapiens
cgtcacgttttctta

SEQ ID NO: 408318 - DNA, 15 bp, Homo sapiens
gtcacgttttcttaa

SEQ ID NO: 408319 - DNA, 15 bp, Homo sapiens
tcacgttttcttaac

SEQ ID NO: 408320 - DNA, 15 bp, Homo sapiens
cacgttttcttaact

SEQ ID NO: 408321 - DNA, 15 bp, Homo sapiens
acgttttcttaacta

SEQ ID NO: 408322 - DNA, 15 bp, Homo sapiens
cgttttcttaactat

SEQ ID NO: 408323 - DNA, 15 bp, Homo sapiens
gttttcttaactatt

SEQ ID NO: 408324 - DNA, 15 bp, Homo sapiens
ttttcttaactattt

SEQ ID NO: 408325 - DNA, 15 bp, Homo sapiens
tttcttaactattta

SEQ ID NO: 408326 - DNA, 15 bp, Homo sapiens
ttcttaactatttaa

SEQ ID NO: 408327 - DNA, 15 bp, Homo sapiens
tcttaactatttaat

SEQ ID NO: 408328 - DNA, 15 bp, Homo sapiens
cttaactatttaatt

SEQ ID NO: 408329 - DNA, 15 bp, Homo sapiens
ttaactatttaattt

SEQ ID NO: 408330 - DNA, 15 bp, Homo sapiens
taactatttaatttg

SEQ ID NO: 408331 - DNA, 15 bp, Homo sapiens
aactatttaatttgt

SEQ ID NO: 408332 - DNA, 15 bp, Homo sapiens
actatttaatttgta

SEQ ID NO: 408333 - DNA, 15 bp, Homo sapiens
ctatttaatttgtaa

SEQ ID NO: 408334 - DNA, 15 bp, Homo sapiens
tatttaatttgtaat

SEQ ID NO: 408335 - DNA, 15 bp, Homo sapiens
atttaatttgtaatg

SEQ ID NO: 408336 - DNA, 15 bp, Homo sapiens
tttaatttgtaatgc

SEQ ID NO: 408337 - DNA, 15 bp, Homo sapiens
ttaatttgtaatgcc

SEQ ID NO: 408338 - DNA, 15 bp, Homo sapiens
taatttgtaatgcct

SEQ ID NO: 408339 - DNA, 15 bp, Homo sapiens
aatttgtaatgcctt

SEQ ID NO: 408340 - DNA, 15 bp, Homo sapiens
atttgtaatgccttc

SEQ ID NO: 408341 - DNA, 15 bp, Homo sapiens
tttgtaatgccttct

SEQ ID NO: 408342 - DNA, 15 bp, Homo sapiens
ttgtaatgccttctt

SEQ ID NO: 408343 - DNA, 15 bp, Homo sapiens
tgtaatgccttcttt

SEQ ID NO: 408344 - DNA, 15 bp, Homo sapiens
gtaatgccttcttta

SEQ ID NO: 408345 - DNA, 15 bp, Homo sapiens
taatgccttctttat

SEQ ID NO: 408346 - DNA, 15 bp, Homo sapiens
aatgccttctttatt

SEQ ID NO: 408347 - DNA, 15 bp, Homo sapiens
atgccttctttattt

SEQ ID NO: 408348 - DNA, 15 bp, Homo sapiens
tgccttctttatttt

SEQ ID NO: 408349 - DNA, 15 bp, Homo sapiens
gccttctttattttg

SEQ ID NO: 408350 - DNA, 15 bp, Homo sapiens
ccttctttattttgg

SEQ ID NO: 408351 - DNA, 15 bp, Homo sapiens
cttctttattttggg

SEQ ID NO: 408352 - DNA, 15 bp, Homo sapiens
ttctttattttgggg

SEQ ID NO: 408353 - DNA, 15 bp, Homo sapiens
tctttattttgggga

SEQ ID NO: 408354 - DNA, 15 bp, Homo sapiens
ctttattttggggaa

SEQ ID NO: 408355 - DNA, 15 bp, Homo sapiens
tttattttggggaaa

SEQ ID NO: 408356 - DNA, 15 bp, Homo sapiens
ttattttggggaaat

SEQ ID NO: 408357 - DNA, 15 bp, Homo sapiens
tattttggggaaatt

SEQ ID NO: 408358 - DNA, 15 bp, Homo sapiens
attttggggaaatta

SEQ ID NO: 408359 - DNA, 15 bp, Homo sapiens
ttttggggaaattac

SEQ ID NO: 408360 - DNA, 15 bp, Homo sapiens
tttggggaaattaca

SEQ ID NO: 408361 - DNA, 15 bp, Homo sapiens
ttggggaaattacaa

SEQ ID NO: 408362 - DNA, 15 bp, Homo sapiens
tggggaaattacaaa

SEQ ID NO: 408363 - DNA, 15 bp, Homo sapiens
ggggaaattacaaaa

SEQ ID NO: 408364 - DNA, 15 bp, Homo sapiens
gggaaattacaaaat

SEQ ID NO: 408365 - DNA, 15 bp, Homo sapiens
ggaaattacaaaata

SEQ ID NO: 408366 - DNA, 15 bp, Homo sapiens
gaaattacaaaatag

SEQ ID NO: 408367 - DNA, 15 bp, Homo sapiens
aaattacaaaatagt

SEQ ID NO: 408368 - DNA, 15 bp, Homo sapiens
aattacaaaatagtg

SEQ ID NO: 408369 - DNA, 15 bp, Homo sapiens
attacaaaatagtga

SEQ ID NO: 408370 - DNA, 15 bp, Homo sapiens
ttacaaaatagtgac

SEQ ID NO: 408371 - DNA, 15 bp, Homo sapiens
tacaaaatagtgaca

SEQ ID NO: 408372 - DNA, 15 bp, Homo sapiens
acaaaatagtgacac

SEQ ID NO: 408373 - DNA, 15 bp, Homo sapiens
caaaatagtgacaca

SEQ ID NO: 408374 - DNA, 15 bp, Homo sapiens
aaaatagtgacacag

SEQ ID NO: 408375 - DNA, 15 bp, Homo sapiens
aaatagtgacacagt

SEQ ID NO: 408376 - DNA, 15 bp, Homo sapiens
aatagtgacacagtc

SEQ ID NO: 408377 - DNA, 15 bp, Homo sapiens
atagtgacacagtct

SEQ ID NO: 408378 - DNA, 15 bp, Homo sapiens
tagtgacacagtctc

SEQ ID NO: 408379 - DNA, 15 bp, Homo sapiens
agtgacacagtctcc

SEQ ID NO: 408380 - DNA, 15 bp, Homo sapiens
gtgacacagtctccc

SEQ ID NO: 408381 - DNA, 15 bp, Homo sapiens
tgacacagtctcccc

SEQ ID NO: 408382 - DNA, 15 bp, Homo sapiens
gacacagtctcccca

SEQ ID NO: 408383 - DNA, 15 bp, Homo sapiens
acacagtctccccag

SEQ ID NO: 408384 - DNA, 15 bp, Homo sapiens
cacagtctccccagc

SEQ ID NO: 408385 - DNA, 15 bp, Homo sapiens
acagtctccccagcc

SEQ ID NO: 408386 - DNA, 15 bp, Homo sapiens
cagtctccccagccc

SEQ ID NO: 408387 - DNA, 15 bp, Homo sapiens
agtctccccagccca

SEQ ID NO: 408388 - DNA, 15 bp, Homo sapiens
gtctccccagcccaa

SEQ ID NO: 408389 - DNA, 15 bp, Homo sapiens
tctccccagcccaag

SEQ ID NO: 408390 - DNA, 15 bp, Homo sapiens
ctccccagcccaaga

SEQ ID NO: 408391 - DNA, 15 bp, Homo sapiens
tccccagcccaagaa

SEQ ID NO: 408392 - DNA, 15 bp, Homo sapiens
ccccagcccaagaag

SEQ ID NO: 408393 - DNA, 15 bp, Homo sapiens
cccagcccaagaagg

SEQ ID NO: 408394 - DNA, 15 bp, Homo sapiens
ccagcccaagaagga

SEQ ID NO: 408395 - DNA, 15 bp, Homo sapiens
cagcccaagaaggag

SEQ ID NO: 408396 - DNA, 15 bp, Homo sapiens
agcccaagaaggagg

SEQ ID NO: 408397 - DNA, 15 bp, Homo sapiens
gcccaagaaggagga

SEQ ID NO: 408398 - DNA, 15 bp, Homo sapiens
cccaagaaggaggag

SEQ ID NO: 408399 - DNA, 15 bp, Homo sapiens
ccaagaaggaggaga

SEQ ID NO: 408400 - DNA, 15 bp, Homo sapiens
caagaaggaggagat

SEQ ID NO: 408401 - DNA, 15 bp, Homo sapiens
aagaaggaggagatt

SEQ ID NO: 408402 - DNA, 15 bp, Homo sapiens
agaaggaggagattt

SEQ ID NO: 408403 - DNA, 15 bp, Homo sapiens
gaaggaggagatttt

SEQ ID NO: 408404 - DNA, 15 bp, Homo sapiens
aaggaggagattttt

SEQ ID NO: 408405 - DNA, 15 bp, Homo sapiens
aggaggagatttttt

SEQ ID NO: 408406 - DNA, 15 bp, Homo sapiens
ggaggagattttttt

SEQ ID NO: 408407 - DNA, 15 bp, Homo sapiens
gaggagatttttttt

SEQ ID NO: 408408 - DNA, 15 bp, Homo sapiens
aggagattttttttc

SEQ ID NO: 408409 - DNA, 15 bp, Homo sapiens
ggagattttttttcc

SEQ ID NO: 408410 - DNA, 15 bp, Homo sapiens
gagattttttttccc

SEQ ID NO: 408411 - DNA, 15 bp, Homo sapiens
agattttttttcccc

SEQ ID NO: 408412 - DNA, 15 bp, Homo sapiens
gattttttttcccca

SEQ ID NO: 408413 - DNA, 15 bp, Homo sapiens
attttttttccccag

SEQ ID NO: 408414 - DNA, 15 bp, Homo sapiens
ttttttttccccagt

SEQ ID NO: 408415 - DNA, 15 bp, Homo sapiens
tttttttccccagta

SEQ ID NO: 408416 - DNA, 15 bp, Homo sapiens
ttttttccccagtag

SEQ ID NO: 408417 - DNA, 15 bp, Homo sapiens
tttttccccagtagg

SEQ ID NO: 408418 - DNA, 15 bp, Homo sapiens
ttttccccagtaggg

SEQ ID NO: 408419 - DNA, 15 bp, Homo sapiens
tttccccagtagggc

SEQ ID NO: 408420 - DNA, 15 bp, Homo sapiens
ttccccagtagggcg

SEQ ID NO: 408421 - DNA, 15 bp, Homo sapiens
tccccagtagggcgg

SEQ ID NO: 408422 - DNA, 15 bp, Homo sapiens
ccccagtagggcggt

SEQ ID NO: 408423 - DNA, 15 bp, Homo sapiens
cccagtagggcggtt

SEQ ID NO: 408424 - DNA, 15 bp, Homo sapiens
ccagtagggcggttg

SEQ ID NO: 408425 - DNA, 15 bp, Homo sapiens
cagtagggcggttgt

SEQ ID NO: 408426 - DNA, 15 bp, Homo sapiens
agtagggcggttgtt

SEQ ID NO: 408427 - DNA, 15 bp, Homo sapiens
gtagggcggttgttt

SEQ ID NO: 408428 - DNA, 15 bp, Homo sapiens
tagggcggttgtttt

SEQ ID NO: 408429 - DNA, 15 bp, Homo sapiens
agggcggttgtttta

SEQ ID NO: 408430 - DNA, 15 bp, Homo sapiens
gggcggttgttttat

SEQ ID NO: 408431 - DNA, 15 bp, Homo sapiens
ggcggttgttttatt

SEQ ID NO: 408432 - DNA, 15 bp, Homo sapiens
gcggttgttttattt

SEQ ID NO: 408433 - DNA, 15 bp, Homo sapiens
cggttgttttatttt

SEQ ID NO: 408434 - DNA, 15 bp, Homo sapiens
ggttgttttattttg

SEQ ID NO: 408435 - DNA, 15 bp, Homo sapiens
gttgttttattttga

SEQ ID NO: 408436 - DNA, 15 bp, Homo sapiens
ttgttttattttgac

SEQ ID NO: 408437 - DNA, 15 bp, Homo sapiens
tgttttattttgact

SEQ ID NO: 408438 - DNA, 15 bp, Homo sapiens
gttttattttgacta

SEQ ID NO: 408439 - DNA, 15 bp, Homo sapiens
ttttattttgactat

SEQ ID NO: 408440 - DNA, 15 bp, Homo sapiens
tttattttgactata

SEQ ID NO: 408441 - DNA, 15 bp, Homo sapiens
ttattttgactatat

SEQ ID NO: 408442 - DNA, 15 bp, Homo sapiens
tattttgactatata

SEQ ID NO: 408443 - DNA, 15 bp, Homo sapiens
attttgactatatag

SEQ ID NO: 408444 - DNA, 15 bp, Homo sapiens
ttttgactatatagt

SEQ ID NO: 408445 - DNA, 15 bp, Homo sapiens
tttgactatatagtc

SEQ ID NO: 408446 - DNA, 15 bp, Homo sapiens
ttgactatatagtct

SEQ ID NO: 408447 - DNA, 15 bp, Homo sapiens
tgactatatagtctt

SEQ ID NO: 408448 - DNA, 15 bp, Homo sapiens
gactatatagtcttc

SEQ ID NO: 408449 - DNA, 15 bp, Homo sapiens
actatatagtcttcc

SEQ ID NO: 408450 - DNA, 15 bp, Homo sapiens
ctatatagtcttccc

SEQ ID NO: 408451 - DNA, 15 bp, Homo sapiens
tatatagtcttccct

SEQ ID NO: 408452 - DNA, 15 bp, Homo sapiens
atatagtcttcccta

SEQ ID NO: 408453 - DNA, 15 bp, Homo sapiens
tatagtcttccctag

SEQ ID NO: 408454 - DNA, 15 bp, Homo sapiens
atagtcttccctaga

SEQ ID NO: 408455 - DNA, 15 bp, Homo sapiens
tagtcttccctagaa

SEQ ID NO: 408456 - DNA, 15 bp, Homo sapiens
agtcttccctagaat

SEQ ID NO: 408457 - DNA, 15 bp, Homo sapiens
gtcttccctagaatt

SEQ ID NO: 408458 - DNA, 15 bp, Homo sapiens
tcttccctagaattg

SEQ ID NO: 408459 - DNA, 15 bp, Homo sapiens
cttccctagaattgg

SEQ ID NO: 408460 - DNA, 15 bp, Homo sapiens
ttccctagaattggg

SEQ ID NO: 408461 - DNA, 15 bp, Homo sapiens
tccctagaattgggg

SEQ ID NO: 408462 - DNA, 15 bp, Homo sapiens
ccctagaattggggg

SEQ ID NO: 408463 - DNA, 15 bp, Homo sapiens
cctagaattggggga

SEQ ID NO: 408464 - DNA, 15 bp, Homo sapiens
ctagaattgggggaa

SEQ ID NO: 408465 - DNA, 15 bp, Homo sapiens
tagaattgggggaat

SEQ ID NO: 408466 - DNA, 15 bp, Homo sapiens
agaattgggggaata

SEQ ID NO: 408467 - DNA, 15 bp, Homo sapiens
gaattgggggaataa

SEQ ID NO: 408468 - DNA, 15 bp, Homo sapiens
aattgggggaataaa

SEQ ID NO: 408469 - DNA, 15 bp, Homo sapiens
attgggggaataaat

SEQ ID NO: 408470 - DNA, 15 bp, Homo sapiens
ttgggggaataaata

SEQ ID NO: 408471 - DNA, 15 bp, Homo sapiens
tgggggaataaatat

SEQ ID NO: 408472 - DNA, 15 bp, Homo sapiens
gggggaataaatatt

SEQ ID NO: 408473 - DNA, 15 bp, Homo sapiens
ggggaataaatattg

SEQ ID NO: 408474 - DNA, 15 bp, Homo sapiens
gggaataaatattgg

SEQ ID NO: 408475 - DNA, 15 bp, Homo sapiens
ggaataaatattggt

SEQ ID NO: 408476 - DNA, 15 bp, Homo sapiens
gaataaatattggta

SEQ ID NO: 408477 - DNA, 15 bp, Homo sapiens
aataaatattggtat

SEQ ID NO: 408478 - DNA, 15 bp, Homo sapiens
ataaatattggtatg

SEQ ID NO: 408479 - DNA, 15 bp, Homo sapiens
taaatattggtatgg

SEQ ID NO: 408480 - DNA, 15 bp, Homo sapiens
aaatattggtatggt

SEQ ID NO: 408481 - DNA, 15 bp, Homo sapiens
aatattggtatggtt

SEQ ID NO: 408482 - DNA, 15 bp, Homo sapiens
atattggtatggttt

SEQ ID NO: 408483 - DNA, 15 bp, Homo sapiens
tattggtatggtttt

SEQ ID NO: 408484 - DNA, 15 bp, Homo sapiens
attggtatggttttt

SEQ ID NO: 408485 - DNA, 15 bp, Homo sapiens
ttggtatggtttttt

SEQ ID NO: 408486 - DNA, 15 bp, Homo sapiens
tggtatggtttttta

SEQ ID NO: 408487 - DNA, 15 bp, Homo sapiens
ggtatggttttttaa

SEQ ID NO: 408488 - DNA, 15 bp, Homo sapiens
gtatggttttttaat

SEQ ID NO: 408489 - DNA, 15 bp, Homo sapiens
tatggttttttaata

SEQ ID NO: 408490 - DNA, 15 bp, Homo sapiens
atggttttttaatat

SEQ ID NO: 408491 - DNA, 15 bp, Homo sapiens
tggttttttaatatt

SEQ ID NO: 408492 - DNA, 15 bp, Homo sapiens
ggttttttaatattg

SEQ ID NO: 408493 - DNA, 15 bp, Homo sapiens
gttttttaatattga

SEQ ID NO: 408494 - DNA, 15 bp, Homo sapiens
ttttttaatattgat

SEQ ID NO: 408495 - DNA, 15 bp, Homo sapiens
tttttaatattgatt

SEQ ID NO: 408496 - DNA, 15 bp, Homo sapiens
ttttaatattgattt

SEQ ID NO: 408497 - DNA, 15 bp, Homo sapiens
tttaatattgatttc

SEQ ID NO: 408498 - DNA, 15 bp, Homo sapiens
ttaatattgatttcc

SEQ ID NO: 408499 - DNA, 15 bp, Homo sapiens
taatattgatttccc

SEQ ID NO: 408500 - DNA, 15 bp, Homo sapiens
aatattgatttccct

SEQ ID NO: 408501 - DNA, 15 bp, Homo sapiens
atattgatttccctg

SEQ ID NO: 408502 - DNA, 15 bp, Homo sapiens
tattgatttccctgg

SEQ ID NO: 408503 - DNA, 15 bp, Homo sapiens
attgatttccctggg

SEQ ID NO: 408504 - DNA, 15 bp, Homo sapiens
ttgatttccctgggt

SEQ ID NO: 408505 - DNA, 15 bp, Homo sapiens
tgatttccctgggta

SEQ ID NO: 408506 - DNA, 15 bp, Homo sapiens
gatttccctgggtag

SEQ ID NO: 408507 - DNA, 15 bp, Homo sapiens
atttccctgggtaga

SEQ ID NO: 408508 - DNA, 15 bp, Homo sapiens
tttccctgggtagat

SEQ ID NO: 408509 - DNA, 15 bp, Homo sapiens
ttccctgggtagatt

SEQ ID NO: 408510 - DNA, 15 bp, Homo sapiens
tccctgggtagatta

SEQ ID NO: 408511 - DNA, 15 bp, Homo sapiens
ccctgggtagattat

SEQ ID NO: 408512 - DNA, 15 bp, Homo sapiens
cctgggtagattata

SEQ ID NO: 408513 - DNA, 15 bp, Homo sapiens
ctgggtagattatat

SEQ ID NO: 408514 - DNA, 15 bp, Homo sapiens
tgggtagattatatt

SEQ ID NO: 408515 - DNA, 15 bp, Homo sapiens
gggtagattatattt

SEQ ID NO: 408516 - DNA, 15 bp, Homo sapiens
ggtagattatatttc

SEQ ID NO: 408517 - DNA, 15 bp, Homo sapiens
gtagattatatttct

SEQ ID NO: 408518 - DNA, 15 bp, Homo sapiens
tagattatatttctg

SEQ ID NO: 408519 - DNA, 15 bp, Homo sapiens
agattatatttctga

SEQ ID NO: 408520 - DNA, 15 bp, Homo sapiens
gattatatttctgac

SEQ ID NO: 408521 - DNA, 15 bp, Homo sapiens
attatatttctgact

SEQ ID NO: 408522 - DNA, 15 bp, Homo sapiens
ttatatttctgactg

SEQ ID NO: 408523 - DNA, 15 bp, Homo sapiens
tatatttctgactgt

SEQ ID NO: 408524 - DNA, 15 bp, Homo sapiens
atatttctgactgta

SEQ ID NO: 408525 - DNA, 15 bp, Homo sapiens
tatttctgactgtaa

SEQ ID NO: 408526 - DNA, 15 bp, Homo sapiens
atttctgactgtaaa

SEQ ID NO: 408527 - DNA, 15 bp, Homo sapiens
tttctgactgtaaaa

SEQ ID NO: 408528 - DNA, 15 bp, Homo sapiens
ttctgactgtaaaat

SEQ ID NO: 408529 - DNA, 15 bp, Homo sapiens
tctgactgtaaaata

SEQ ID NO: 408530 - DNA, 15 bp, Homo sapiens
ctgactgtaaaatat

SEQ ID NO: 408531 - DNA, 15 bp, Homo sapiens
tgactgtaaaatata

SEQ ID NO: 408532 - DNA, 15 bp, Homo sapiens
gactgtaaaatatat

SEQ ID NO: 408533 - DNA, 15 bp, Homo sapiens
actgtaaaatatatt

SEQ ID NO: 408534 - DNA, 15 bp, Homo sapiens
ctgtaaaatatatta

SEQ ID NO: 408535 - DNA, 15 bp, Homo sapiens
tgtaaaatatattat

SEQ ID NO: 408536 - DNA, 15 bp, Homo sapiens
gtaaaatatattatt

SEQ ID NO: 408537 - DNA, 15 bp, Homo sapiens
taaaatatattattg

SEQ ID NO: 408538 - DNA, 15 bp, Homo sapiens
aatatattattggat

SEQ ID NO: 408539 - DNA, 15 bp, Homo sapiens
atatattattggatg

SEQ ID NO: 408540 - DNA, 15 bp, Homo sapiens
tatattattggatgt

SEQ ID NO: 408541 - DNA, 15 bp, Homo sapiens
atattattggatgtg

SEQ ID NO: 408542 - DNA, 15 bp, Homo sapiens
tattattggatgtgc

SEQ ID NO: 408543 - DNA, 15 bp, Homo sapiens
attattggatgtgct

SEQ ID NO: 408544 - DNA, 15 bp, Homo sapiens
ttattggatgtgctt

SEQ ID NO: 408545 - DNA, 15 bp, Homo sapiens
tattggatgtgcttc

SEQ ID NO: 408546 - DNA, 15 bp, Homo sapiens
attggatgtgcttct

SEQ ID NO: 408547 - DNA, 15 bp, Homo sapiens
ttggatgtgcttctc

SEQ ID NO: 408548 - DNA, 15 bp, Homo sapiens
tggatgtgcttctca

SEQ ID NO: 408549 - DNA, 15 bp, Homo sapiens
ggatgtgcttctcaa

SEQ ID NO: 408550 - DNA, 15 bp, Homo sapiens
gatgtgcttctcaaa

SEQ ID NO: 408551 - DNA, 15 bp, Homo sapiens
atgtgcttctcaaat

SEQ ID NO: 408552 - DNA, 15 bp, Homo sapiens
tgtgcttctcaaata

SEQ ID NO: 408553 - DNA, 15 bp, Homo sapiens
gtgcttctcaaatag

SEQ ID NO: 408554 - DNA, 15 bp, Homo sapiens
tgcttctcaaataga

SEQ ID NO: 408555 - DNA, 15 bp, Homo sapiens
gcttctcaaatagat

SEQ ID NO: 408556 - DNA, 15 bp, Homo sapiens
cttctcaaatagatt

SEQ ID NO: 408557 - DNA, 15 bp, Homo sapiens
ttctcaaatagattt

SEQ ID NO: 408558 - DNA, 15 bp, Homo sapiens
tctcaaatagatttt

SEQ ID NO: 408559 - DNA, 15 bp, Homo sapiens
ctcaaatagatttta

SEQ ID NO: 408560 - DNA, 15 bp, Homo sapiens
tcaaatagattttac

SEQ ID NO: 408561 - DNA, 15 bp, Homo sapiens
caaatagattttaca

SEQ ID NO: 408562 - DNA, 15 bp, Homo sapiens
aaatagattttacat

SEQ ID NO: 408563 - DNA, 15 bp, Homo sapiens
aatagattttacata

SEQ ID NO: 408564 - DNA, 15 bp, Homo sapiens
atagattttacataa

SEQ ID NO: 408565 - DNA, 15 bp, Homo sapiens
tagattttacataat

SEQ ID NO: 408566 - DNA, 15 bp, Homo sapiens
agattttacataatc

SEQ ID NO: 408567 - DNA, 15 bp, Homo sapiens
gattttacataatca

SEQ ID NO: 408568 - DNA, 15 bp, Homo sapiens
attttacataatcag

SEQ ID NO: 408569 - DNA, 15 bp, Homo sapiens
ttttacataatcaga

SEQ ID NO: 408570 - DNA, 15 bp, Homo sapiens
tttacataatcagag

SEQ ID NO: 408571 - DNA, 15 bp, Homo sapiens
ttacataatcagaga

SEQ ID NO: 408572 - DNA, 15 bp, Homo sapiens
tacataatcagagaa

SEQ ID NO: 408573 - DNA, 15 bp, Homo sapiens
acataatcagagaaa

SEQ ID NO: 408574 - DNA, 15 bp, Homo sapiens
cataatcagagaaat

SEQ ID NO: 408575 - DNA, 15 bp, Homo sapiens
ataatcagagaaatt

SEQ ID NO: 408576 - DNA, 15 bp, Homo sapiens
taatcagagaaattt

SEQ ID NO: 408577 - DNA, 15 bp, Homo sapiens
aatcagagaaatttt

SEQ ID NO: 408578 - DNA, 15 bp, Homo sapiens
atcagagaaattttg

SEQ ID NO: 408579 - DNA, 15 bp, Homo sapiens
tcagagaaattttga

SEQ ID NO: 408580 - DNA, 15 bp, Homo sapiens
cagagaaattttgac

SEQ ID NO: 408581 - DNA, 15 bp, Homo sapiens
agagaaattttgacc

SEQ ID NO: 408582 - DNA, 15 bp, Homo sapiens
gagaaattttgacca

SEQ ID NO: 408583 - DNA, 15 bp, Homo sapiens
agaaattttgaccat

SEQ ID NO: 408584 - DNA, 15 bp, Homo sapiens
gaaattttgaccatg

SEQ ID NO: 408585 - DNA, 15 bp, Homo sapiens
aaattttgaccatga

SEQ ID NO: 408586 - DNA, 15 bp, Homo sapiens
aattttgaccatgag

SEQ ID NO: 408587 - DNA, 15 bp, Homo sapiens
attttgaccatgagc

SEQ ID NO: 408588 - DNA, 15 bp, Homo sapiens
ttttgaccatgagcc

SEQ ID NO: 408589 - DNA, 15 bp, Homo sapiens
tttgaccatgagcct

SEQ ID NO: 408590 - DNA, 15 bp, Homo sapiens
ttgaccatgagccta

SEQ ID NO: 408591 - DNA, 15 bp, Homo sapiens
tgaccatgagcctaa

SEQ ID NO: 408592 - DNA, 15 bp, Homo sapiens
gaccatgagcctaat

SEQ ID NO: 408593 - DNA, 15 bp, Homo sapiens
accatgagcctaatt

SEQ ID NO: 408594 - DNA, 15 bp, Homo sapiens
ccatgagcctaattt

SEQ ID NO: 408595 - DNA, 15 bp, Homo sapiens
catgagcctaattta

SEQ ID NO: 408596 - DNA, 15 bp, Homo sapiens
atgagcctaatttaa

SEQ ID NO: 408597 - DNA, 15 bp, Homo sapiens
tgagcctaatttaat

SEQ ID NO: 408598 - DNA, 15 bp, Homo sapiens
gagcctaatttaata

SEQ ID NO: 408599 - DNA, 15 bp, Homo sapiens
agcctaatttaatac

SEQ ID NO: 408600 - DNA, 15 bp, Homo sapiens
gcctaatttaatact

SEQ ID NO: 408601 - DNA, 15 bp, Homo sapiens
cctaatttaatactt

SEQ ID NO: 408602 - DNA, 15 bp, Homo sapiens
ctaatttaatacttt

SEQ ID NO: 408603 - DNA, 15 bp, Homo sapiens
taatttaatactttt

SEQ ID NO: 408604 - DNA, 15 bp, Homo sapiens
aatttaatacttttt

SEQ ID NO: 408605 - DNA, 15 bp, Homo sapiens
atttaatactttttt

SEQ ID NO: 408606 - DNA, 15 bp, Homo sapiens
tttaatacttttttg

SEQ ID NO: 408607 - DNA, 15 bp, Homo sapiens
ttaatacttttttgc

SEQ ID NO: 408608 - DNA, 15 bp, Homo sapiens
taatacttttttgct

SEQ ID NO: 408609 - DNA, 15 bp, Homo sapiens
aatacttttttgctc

SEQ ID NO: 408610 - DNA, 15 bp, Homo sapiens
atacttttttgctcc

SEQ ID NO: 408611 - DNA, 15 bp, Homo sapiens
tacttttttgctcct

SEQ ID NO: 408612 - DNA, 15 bp, Homo sapiens
acttttttgctcctt

SEQ ID NO: 408613 - DNA, 15 bp, Homo sapiens
cttttttgctccttc

SEQ ID NO: 408614 - DNA, 15 bp, Homo sapiens
ttttttgctccttct

SEQ ID NO: 408615 - DNA, 15 bp, Homo sapiens
tttttgctccttctg

SEQ ID NO: 408616 - DNA, 15 bp, Homo sapiens
ttttgctccttctga

SEQ ID NO: 408617 - DNA, 15 bp, Homo sapiens
tttgctccttctgag

SEQ ID NO: 408618 - DNA, 15 bp, Homo sapiens
ttgctccttctgagt

SEQ ID NO: 408619 - DNA, 15 bp, Homo sapiens
tgctccttctgagtt

SEQ ID NO: 408620 - DNA, 15 bp, Homo sapiens
gctccttctgagttt

SEQ ID NO: 408621 - DNA, 15 bp, Homo sapiens
ctccttctgagttta

SEQ ID NO: 408622 - DNA, 15 bp, Homo sapiens
tccttctgagtttac

SEQ ID NO: 408623 - DNA, 15 bp, Homo sapiens
ccttctgagtttaca

SEQ ID NO: 408624 - DNA, 15 bp, Homo sapiens
cttctgagtttacat

SEQ ID NO: 408625 - DNA, 15 bp, Homo sapiens
ttctgagtttacata

SEQ ID NO: 408626 - DNA, 15 bp, Homo sapiens
tctgagtttacataa

SEQ ID NO: 408627 - DNA, 15 bp, Homo sapiens
ctgagtttacataaa

SEQ ID NO: 408628 - DNA, 15 bp, Homo sapiens
tgagtttacataaac

SEQ ID NO: 408629 - DNA, 15 bp, Homo sapiens
gagtttacataaact

SEQ ID NO: 408630 - DNA, 15 bp, Homo sapiens
agtttacataaactt

SEQ ID NO: 408631 - DNA, 15 bp, Homo sapiens
gtttacataaacttt

SEQ ID NO: 408632 - DNA, 15 bp, Homo sapiens
tttacataaactttt

SEQ ID NO: 408633 - DNA, 15 bp, Homo sapiens
ttacataaacttttt

SEQ ID NO: 408634 - DNA, 15 bp, Homo sapiens
tacataaacttttta

SEQ ID NO: 408635 - DNA, 15 bp, Homo sapiens
acataaactttttat

SEQ ID NO: 408636 - DNA, 15 bp, Homo sapiens
cataaactttttatt

SEQ ID NO: 408637 - DNA, 15 bp, Homo sapiens
ataaactttttattt

SEQ ID NO: 408638 - DNA, 15 bp, Homo sapiens
taaactttttatttt

SEQ ID NO: 408639 - DNA, 15 bp, Homo sapiens
aaactttttattttt

SEQ ID NO: 408640 - DNA, 15 bp, Homo sapiens
aactttttatttttc

SEQ ID NO: 408641 - DNA, 15 bp, Homo sapiens
actttttatttttcc

SEQ ID NO: 408642 - DNA, 15 bp, Homo sapiens
ctttttatttttcca

SEQ ID NO: 408643 - DNA, 15 bp, Homo sapiens
tttttatttttccat

SEQ ID NO: 408644 - DNA, 15 bp, Homo sapiens
ttttatttttccatg

SEQ ID NO: 408645 - DNA, 15 bp, Homo sapiens
tttatttttccatgg

SEQ ID NO: 408646 - DNA, 15 bp, Homo sapiens
ttatttttccatgga

SEQ ID NO: 408647 - DNA, 15 bp, Homo sapiens
tatttttccatggag

SEQ ID NO: 408648 - DNA, 15 bp, Homo sapiens
atttttccatggagt

SEQ ID NO: 408649 - DNA, 15 bp, Homo sapiens
tttttccatggagtt

SEQ ID NO: 408650 - DNA, 15 bp, Homo sapiens
ttttccatggagttt

SEQ ID NO: 408651 - DNA, 15 bp, Homo sapiens
tttccatggagttta

SEQ ID NO: 408652 - DNA, 15 bp, Homo sapiens
ttccatggagtttat

SEQ ID NO: 408653 - DNA, 15 bp, Homo sapiens
tccatggagtttatc

SEQ ID NO: 408654 - DNA, 15 bp, Homo sapiens
ccatggagtttatca

SEQ ID NO: 408655 - DNA, 15 bp, Homo sapiens
catggagtttatcag

SEQ ID NO: 408656 - DNA, 15 bp, Homo sapiens
atggagtttatcaga

SEQ ID NO: 408657 - DNA, 15 bp, Homo sapiens
tggagtttatcagaa

SEQ ID NO: 408658 - DNA, 15 bp, Homo sapiens
ggagtttatcagaat

SEQ ID NO: 408659 - DNA, 15 bp, Homo sapiens
gagtttatcagaatc

SEQ ID NO: 408660 - DNA, 15 bp, Homo sapiens
agtttatcagaatcc

SEQ ID NO: 408661 - DNA, 15 bp, Homo sapiens
gtttatcagaatccc

SEQ ID NO: 408662 - DNA, 15 bp, Homo sapiens
tttatcagaatccca

SEQ ID NO: 408663 - DNA, 15 bp, Homo sapiens
ttatcagaatcccaa

SEQ ID NO: 408664 - DNA, 15 bp, Homo sapiens
tatcagaatcccaaa

SEQ ID NO: 408665 - DNA, 15 bp, Homo sapiens
atcagaatcccaaat

SEQ ID NO: 408666 - DNA, 15 bp, Homo sapiens
tcagaatcccaaatc

SEQ ID NO: 408667 - DNA, 15 bp, Homo sapiens
cagaatcccaaatcc

SEQ ID NO: 408668 - DNA, 15 bp, Homo sapiens
agaatcccaaatcct

SEQ ID NO: 408669 - DNA, 15 bp, Homo sapiens
gaatcccaaatcctc

SEQ ID NO: 408670 - DNA, 15 bp, Homo sapiens
aatcccaaatcctct

SEQ ID NO: 408671 - DNA, 15 bp, Homo sapiens
atcccaaatcctctg

SEQ ID NO: 408672 - DNA, 15 bp, Homo sapiens
tcccaaatcctctgc

SEQ ID NO: 408673 - DNA, 15 bp, Homo sapiens
cccaaatcctctgct

SEQ ID NO: 408674 - DNA, 15 bp, Homo sapiens
ccaaatcctctgctt

SEQ ID NO: 408675 - DNA, 15 bp, Homo sapiens
caaatcctctgcttc

SEQ ID NO: 408676 - DNA, 15 bp, Homo sapiens
aaatcctctgcttca

SEQ ID NO: 408677 - DNA, 15 bp, Homo sapiens
aatcctctgcttcag

SEQ ID NO: 408678 - DNA, 15 bp, Homo sapiens
atcctctgcttcagt

SEQ ID NO: 408679 - DNA, 15 bp, Homo sapiens
tcctctgcttcagtc

SEQ ID NO: 408680 - DNA, 15 bp, Homo sapiens
cctctgcttcagtct

SEQ ID NO: 408681 - DNA, 15 bp, Homo sapiens
ctctgcttcagtctt

SEQ ID NO: 408682 - DNA, 15 bp, Homo sapiens
tctgcttcagtcttc

SEQ ID NO: 408683 - DNA, 15 bp, Homo sapiens
ctgcttcagtcttcc

SEQ ID NO: 408684 - DNA, 15 bp, Homo sapiens
tgcttcagtcttcct

SEQ ID NO: 408685 - DNA, 15 bp, Homo sapiens
gcttcagtcttcctt

SEQ ID NO: 408686 - DNA, 15 bp, Homo sapiens
cttcagtcttccttt

SEQ ID NO: 408687 - DNA, 15 bp, Homo sapiens
ttcagtcttcctttc

SEQ ID NO: 408688 - DNA, 15 bp, Homo sapiens
tcagtcttcctttca

SEQ ID NO: 408689 - DNA, 15 bp, Homo sapiens
cagtcttcctttcat

SEQ ID NO: 408690 - DNA, 15 bp, Homo sapiens
agtcttcctttcatc

SEQ ID NO: 408691 - DNA, 15 bp, Homo sapiens
gtcttcctttcatcc

SEQ ID NO: 408692 - DNA, 15 bp, Homo sapiens
tcttcctttcatcct

SEQ ID NO: 408693 - DNA, 15 bp, Homo sapiens
cttcctttcatcctg

SEQ ID NO: 408694 - DNA, 15 bp, Homo sapiens
ttcctttcatcctga

SEQ ID NO: 408695 - DNA, 15 bp, Homo sapiens
tcctttcatcctgat

SEQ ID NO: 408696 - DNA, 15 bp, Homo sapiens
cctttcatcctgatc

SEQ ID NO: 408697 - DNA, 15 bp, Homo sapiens
ctttcatcctgatct

SEQ ID NO: 408698 - DNA, 15 bp, Homo sapiens
tttcatcctgatctt

SEQ ID NO: 408699 - DNA, 15 bp, Homo sapiens
ttcatcctgatcttc

SEQ ID NO: 408700 - DNA, 15 bp, Homo sapiens
tcatcctgatcttca

SEQ ID NO: 408701 - DNA, 15 bp, Homo sapiens
catcctgatcttcag

SEQ ID NO: 408702 - DNA, 15 bp, Homo sapiens
atcctgatcttcagg

SEQ ID NO: 408703 - DNA, 15 bp, Homo sapiens
tcctgatcttcagga

SEQ ID NO: 408704 - DNA, 15 bp, Homo sapiens
cctgatcttcaggat

SEQ ID NO: 408705 - DNA, 15 bp, Homo sapiens
ctgatcttcaggata

SEQ ID NO: 408706 - DNA, 15 bp, Homo sapiens
tgatcttcaggatat

SEQ ID NO: 408707 - DNA, 15 bp, Homo sapiens
gatcttcaggatatt

SEQ ID NO: 408708 - DNA, 15 bp, Homo sapiens
atcttcaggatattt

SEQ ID NO: 408709 - DNA, 15 bp, Homo sapiens
tcttcaggatatttt

SEQ ID NO: 408710 - DNA, 15 bp, Homo sapiens
cttcaggatattttt

SEQ ID NO: 408711 - DNA, 15 bp, Homo sapiens
ttcaggatatttttc

SEQ ID NO: 408712 - DNA, 15 bp, Homo sapiens
tcaggatatttttcc

SEQ ID NO: 408713 - DNA, 15 bp, Homo sapiens
caggatatttttcct

SEQ ID NO: 408714 - DNA, 15 bp, Homo sapiens
aggatatttttcctg

SEQ ID NO: 408715 - DNA, 15 bp, Homo sapiens
ggatatttttcctgg

SEQ ID NO: 408716 - DNA, 15 bp, Homo sapiens
gatatttttcctgga

SEQ ID NO: 408717 - DNA, 15 bp, Homo sapiens
atatttttcctggag

SEQ ID NO: 408718 - DNA, 15 bp, Homo sapiens
tatttttcctggagt

SEQ ID NO: 408719 - DNA, 15 bp, Homo sapiens
atttttcctggagtt

SEQ ID NO: 408720 - DNA, 15 bp, Homo sapiens
tttttcctggagtta

SEQ ID NO: 408721 - DNA, 15 bp, Homo sapiens
ttttcctggagttat

SEQ ID NO: 408722 - DNA, 15 bp, Homo sapiens
tttcctggagttatt

SEQ ID NO: 408723 - DNA, 15 bp, Homo sapiens
ttcctggagttatta

SEQ ID NO: 408724 - DNA, 15 bp, Homo sapiens
tcctggagttattat

SEQ ID NO: 408725 - DNA, 15 bp, Homo sapiens
cctggagttattatt

SEQ ID NO: 408726 - DNA, 15 bp, Homo sapiens
ctggagttattattg

SEQ ID NO: 408727 - DNA, 15 bp, Homo sapiens
tggagttattattgt

SEQ ID NO: 408728 - DNA, 15 bp, Homo sapiens
ggagttattattgtt

SEQ ID NO: 408729 - DNA, 15 bp, Homo sapiens
gagttattattgtta

SEQ ID NO: 408730 - DNA, 15 bp, Homo sapiens
agttattattgttat

SEQ ID NO: 408731 - DNA, 15 bp, Homo sapiens
gttattattgttatt

SEQ ID NO: 408732 - DNA, 15 bp, Homo sapiens
ttattattgttattt

SEQ ID NO: 408733 - DNA, 15 bp, Homo sapiens
tattattgttatttt

SEQ ID NO: 408734 - DNA, 15 bp, Homo sapiens
attattgttatttta

SEQ ID NO: 408735 - DNA, 15 bp, Homo sapiens
ttattgttattttat

SEQ ID NO: 408736 - DNA, 15 bp, Homo sapiens
tattgttattttata

SEQ ID NO: 408737 - DNA, 15 bp, Homo sapiens
attgttattttatag

SEQ ID NO: 408738 - DNA, 15 bp, Homo sapiens
ttgttattttatagt

SEQ ID NO: 408739 - DNA, 15 bp, Homo sapiens
tgttattttatagta

SEQ ID NO: 408740 - DNA, 15 bp, Homo sapiens
gttattttatagtat

SEQ ID NO: 408741 - DNA, 15 bp, Homo sapiens
ttattttatagtatc

SEQ ID NO: 408742 - DNA, 15 bp, Homo sapiens
tattttatagtatct

SEQ ID NO: 408743 - DNA, 15 bp, Homo sapiens
attttatagtatcta

SEQ ID NO: 408744 - DNA, 15 bp, Homo sapiens
ttttatagtatctat

SEQ ID NO: 408745 - DNA, 15 bp, Homo sapiens
tttatagtatctata

SEQ ID NO: 408746 - DNA, 15 bp, Homo sapiens
ttatagtatctatat

SEQ ID NO: 408747 - DNA, 15 bp, Homo sapiens
tatagtatctatata

SEQ ID NO: 408748 - DNA, 15 bp, Homo sapiens
atagtatctatatag

SEQ ID NO: 408749 - DNA, 15 bp, Homo sapiens
tagtatctatatagc

SEQ ID NO: 408750 - DNA, 15 bp, Homo sapiens
agtatctatatagct

SEQ ID NO: 408751 - DNA, 15 bp, Homo sapiens
gtatctatatagcta

SEQ ID NO: 408752 - DNA, 15 bp, Homo sapiens
tatctatatagctac

SEQ ID NO: 408753 - DNA, 15 bp, Homo sapiens
atctatatagctact

SEQ ID NO: 408754 - DNA, 15 bp, Homo sapiens
tctatatagctacta

SEQ ID NO: 408755 - DNA, 15 bp, Homo sapiens
ctatatagctactat

SEQ ID NO: 408756 - DNA, 15 bp, Homo sapiens
tatatagctactatt

SEQ ID NO: 408757 - DNA, 15 bp, Homo sapiens
atatagctactattt

SEQ ID NO: 408758 - DNA, 15 bp, Homo sapiens
tatagctactatttt

SEQ ID NO: 408759 - DNA, 15 bp, Homo sapiens
atagctactatttta

SEQ ID NO: 408760 - DNA, 15 bp, Homo sapiens
tagctactattttat

SEQ ID NO: 408761 - DNA, 15 bp, Homo sapiens
agctactattttata

SEQ ID NO: 408762 - DNA, 15 bp, Homo sapiens
gctactattttatag

SEQ ID NO: 408763 - DNA, 15 bp, Homo sapiens
ctactattttatagt

SEQ ID NO: 408764 - DNA, 15 bp, Homo sapiens
tactattttatagta

SEQ ID NO: 408765 - DNA, 15 bp, Homo sapiens
actattttatagtag

SEQ ID NO: 408766 - DNA, 15 bp, Homo sapiens
ctattttatagtagt

SEQ ID NO: 408767 - DNA, 15 bp, Homo sapiens
tattttatagtagta

SEQ ID NO: 408768 - DNA, 15 bp, Homo sapiens
attttatagtagtat

SEQ ID NO: 408769 - DNA, 15 bp, Homo sapiens
ttttatagtagtatc

SEQ ID NO: 408770 - DNA, 15 bp, Homo sapiens
tttatagtagtatct

SEQ ID NO: 408771 - DNA, 15 bp, Homo sapiens
ttatagtagtatcta

SEQ ID NO: 408772 - DNA, 15 bp, Homo sapiens
tatagtagtatctac

SEQ ID NO: 408773 - DNA, 15 bp, Homo sapiens
atagtagtatctact

SEQ ID NO: 408774 - DNA, 15 bp, Homo sapiens
tagtagtatctacta

SEQ ID NO: 408775 - DNA, 15 bp, Homo sapiens
agtagtatctactat

SEQ ID NO: 408776 - DNA, 15 bp, Homo sapiens
gtagtatctactatt

SEQ ID NO: 408777 - DNA, 15 bp, Homo sapiens
tagtatctactattt

SEQ ID NO: 408778 - DNA, 15 bp, Homo sapiens
agtatctactatttt

SEQ ID NO: 408779 - DNA, 15 bp, Homo sapiens
gtatctactatttta

SEQ ID NO: 408780 - DNA, 15 bp, Homo sapiens
tatctactattttat

SEQ ID NO: 408781 - DNA, 15 bp, Homo sapiens
atctactattttata

SEQ ID NO: 408782 - DNA, 15 bp, Homo sapiens
tctactattttataa

SEQ ID NO: 408783 - DNA, 15 bp, Homo sapiens
ctactattttataat

SEQ ID NO: 408784 - DNA, 15 bp, Homo sapiens
tactattttataata

SEQ ID NO: 408785 - DNA, 15 bp, Homo sapiens
actattttataatag

SEQ ID NO: 408786 - DNA, 15 bp, Homo sapiens
ctattttataataga

SEQ ID NO: 408787 - DNA, 15 bp, Homo sapiens
tattttataatagat

SEQ ID NO: 408788 - DNA, 15 bp, Homo sapiens
attttataatagatt

SEQ ID NO: 408789 - DNA, 15 bp, Homo sapiens
ttttataatagattg

SEQ ID NO: 408790 - DNA, 15 bp, Homo sapiens
tttataatagattgt

SEQ ID NO: 408791 - DNA, 15 bp, Homo sapiens
ttataatagattgtc

SEQ ID NO: 408792 - DNA, 15 bp, Homo sapiens
tataatagattgtcc

SEQ ID NO: 408793 - DNA, 15 bp, Homo sapiens
ataatagattgtcct

SEQ ID NO: 408794 - DNA, 15 bp, Homo sapiens
taatagattgtcctg

SEQ ID NO: 408795 - DNA, 15 bp, Homo sapiens
aatagattgtcctgg

SEQ ID NO: 408796 - DNA, 15 bp, Homo sapiens
atagattgtcctgga

SEQ ID NO: 408797 - DNA, 15 bp, Homo sapiens
tagattgtcctggaa

SEQ ID NO: 408798 - DNA, 15 bp, Homo sapiens
agattgtcctggaaa

SEQ ID NO: 408799 - DNA, 15 bp, Homo sapiens
gattgtcctggaaaa

SEQ ID NO: 408800 - DNA, 15 bp, Homo sapiens
attgtcctggaaaac

SEQ ID NO: 408801 - DNA, 15 bp, Homo sapiens
ttgtcctggaaaacc

SEQ ID NO: 408802 - DNA, 15 bp, Homo sapiens
tgtcctggaaaacct

SEQ ID NO: 408803 - DNA, 15 bp, Homo sapiens
gtcctggaaaaccta

SEQ ID NO: 408804 - DNA, 15 bp, Homo sapiens
tcctggaaaacctac

SEQ ID NO: 408805 - DNA, 15 bp, Homo sapiens
cctggaaaacctacc

SEQ ID NO: 408806 - DNA, 15 bp, Homo sapiens
ctggaaaacctaccg

SEQ ID NO: 408807 - DNA, 15 bp, Homo sapiens
tggaaaacctaccgg

SEQ ID NO: 408808 - DNA, 15 bp, Homo sapiens
ggaaaacctaccggt

SEQ ID NO: 408809 - DNA, 15 bp, Homo sapiens
gaaaacctaccggtg

SEQ ID NO: 408810 - DNA, 15 bp, Homo sapiens
aaaacctaccggtgc

SEQ ID NO: 408811 - DNA, 15 bp, Homo sapiens
aaacctaccggtgca

SEQ ID NO: 408812 - DNA, 15 bp, Homo sapiens
aacctaccggtgcat

SEQ ID NO: 408813 - DNA, 15 bp, Homo sapiens
acctaccggtgcatg

SEQ ID NO: 408814 - DNA, 15 bp, Homo sapiens
cctaccggtgcatga

SEQ ID NO: 408815 - DNA, 15 bp, Homo sapiens
ctaccggtgcatgag

SEQ ID NO: 408816 - DNA, 15 bp, Homo sapiens
taccggtgcatgaga

SEQ ID NO: 408817 - DNA, 15 bp, Homo sapiens
accggtgcatgagag

SEQ ID NO: 408818 - DNA, 15 bp, Homo sapiens
ccggtgcatgagaga

SEQ ID NO: 408819 - DNA, 15 bp, Homo sapiens
cggtgcatgagagaa

SEQ ID NO: 408820 - DNA, 15 bp, Homo sapiens
ggtgcatgagagaaa

SEQ ID NO: 408821 - DNA, 15 bp, Homo sapiens
gtgcatgagagaaaa

SEQ ID NO: 408822 - DNA, 15 bp, Homo sapiens
tgcatgagagaaaag

SEQ ID NO: 408823 - DNA, 15 bp, Homo sapiens
gcatgagagaaaagt

SEQ ID NO: 408824 - DNA, 15 bp, Homo sapiens
catgagagaaaagtt

SEQ ID NO: 408825 - DNA, 15 bp, Homo sapiens
atgagagaaaagttc

SEQ ID NO: 408826 - DNA, 15 bp, Homo sapiens
tgagagaaaagttca

SEQ ID NO: 408827 - DNA, 15 bp, Homo sapiens
gagagaaaagttcaa

SEQ ID NO: 408828 - DNA, 15 bp, Homo sapiens
agagaaaagttcaag

SEQ ID NO: 408829 - DNA, 15 bp, Homo sapiens
gagaaaagttcaagg

SEQ ID NO: 408830 - DNA, 15 bp, Homo sapiens
agaaaagttcaaggc

SEQ ID NO: 408831 - DNA, 15 bp, Homo sapiens
gaaaagttcaaggct

SEQ ID NO: 408832 - DNA, 15 bp, Homo sapiens
aaaagttcaaggcta

SEQ ID NO: 408833 - DNA, 15 bp, Homo sapiens
aaagttcaaggctaa

SEQ ID NO: 408834 - DNA, 15 bp, Homo sapiens
aagttcaaggctaaa

SEQ ID NO: 408835 - DNA, 15 bp, Homo sapiens
agttcaaggctaaac

SEQ ID NO: 408836 - DNA, 15 bp, Homo sapiens
gttcaaggctaaact

SEQ ID NO: 408837 - DNA, 15 bp, Homo sapiens
ttcaaggctaaactt

SEQ ID NO: 408838 - DNA, 15 bp, Homo sapiens
tcaaggctaaactta

SEQ ID NO: 408839 - DNA, 15 bp, Homo sapiens
caaggctaaacttaa

SEQ ID NO: 408840 - DNA, 15 bp, Homo sapiens
aaggctaaacttaaa

SEQ ID NO: 408841 - DNA, 15 bp, Homo sapiens
aggctaaacttaaag

SEQ ID NO: 408842 - DNA, 15 bp, Homo sapiens
ggctaaacttaaagg

SEQ ID NO: 408843 - DNA, 15 bp, Homo sapiens
gctaaacttaaaggt

SEQ ID NO: 408844 - DNA, 15 bp, Homo sapiens
ctaaacttaaaggta

SEQ ID NO: 408845 - DNA, 15 bp, Homo sapiens
taaacttaaaggtac

SEQ ID NO: 408846 - DNA, 15 bp, Homo sapiens
aaacttaaaggtact

SEQ ID NO: 408847 - DNA, 15 bp, Homo sapiens
aacttaaaggtactg

SEQ ID NO: 408848 - DNA, 15 bp, Homo sapiens
acttaaaggtactgg

SEQ ID NO: 408849 - DNA, 15 bp, Homo sapiens
cttaaaggtactggg

SEQ ID NO: 408850 - DNA, 15 bp, Homo sapiens
ttaaaggtactgggt

SEQ ID NO: 408851 - DNA, 15 bp, Homo sapiens
taaaggtactgggta

SEQ ID NO: 408852 - DNA, 15 bp, Homo sapiens
aaaggtactgggtag

SEQ ID NO: 408853 - DNA, 15 bp, Homo sapiens
aaggtactgggtagt

SEQ ID NO: 408854 - DNA, 15 bp, Homo sapiens
aggtactgggtagtc

SEQ ID NO: 408855 - DNA, 15 bp, Homo sapiens
ggtactgggtagtca

SEQ ID NO: 408856 - DNA, 15 bp, Homo sapiens
gtactgggtagtcaa

SEQ ID NO: 408857 - DNA, 15 bp, Homo sapiens
tactgggtagtcaac

SEQ ID NO: 408858 - DNA, 15 bp, Homo sapiens
actgggtagtcaaca

SEQ ID NO: 408859 - DNA, 15 bp, Homo sapiens
ctgggtagtcaacag

SEQ ID NO: 408860 - DNA, 15 bp, Homo sapiens
tgggtagtcaacagc

SEQ ID NO: 408861 - DNA, 15 bp, Homo sapiens
gggtagtcaacagct

SEQ ID NO: 408862 - DNA, 15 bp, Homo sapiens
ggtagtcaacagctc

SEQ ID NO: 408863 - DNA, 15 bp, Homo sapiens
gtagtcaacagctca

SEQ ID NO: 408864 - DNA, 15 bp, Homo sapiens
tagtcaacagctcat

SEQ ID NO: 408865 - DNA, 15 bp, Homo sapiens
agtcaacagctcatg

SEQ ID NO: 408866 - DNA, 15 bp, Homo sapiens
gtcaacagctcatgt

SEQ ID NO: 408867 - DNA, 15 bp, Homo sapiens
tcaacagctcatgtc

SEQ ID NO: 408868 - DNA, 15 bp, Homo sapiens
caacagctcatgtct

SEQ ID NO: 408869 - DNA, 15 bp, Homo sapiens
aacagctcatgtctc

SEQ ID NO: 408870 - DNA, 15 bp, Homo sapiens
acagctcatgtctct

SEQ ID NO: 408871 - DNA, 15 bp, Homo sapiens
cagctcatgtctcta

SEQ ID NO: 408872 - DNA, 15 bp, Homo sapiens
agctcatgtctctat

SEQ ID NO: 408873 - DNA, 15 bp, Homo sapiens
gctcatgtctctatc

SEQ ID NO: 408874 - DNA, 15 bp, Homo sapiens
ctcatgtctctatca

SEQ ID NO: 408875 - DNA, 15 bp, Homo sapiens
tcatgtctctatcag

SEQ ID NO: 408876 - DNA, 15 bp, Homo sapiens
catgtctctatcaga

SEQ ID NO: 408877 - DNA, 15 bp, Homo sapiens
atgtctctatcagaa

SEQ ID NO: 408878 - DNA, 15 bp, Homo sapiens
tgtctctatcagaaa

SEQ ID NO: 408879 - DNA, 15 bp, Homo sapiens
gtctctatcagaaaa

SEQ ID NO: 408880 - DNA, 15 bp, Homo sapiens
tctctatcagaaaat

SEQ ID NO: 408881 - DNA, 15 bp, Homo sapiens
ctctatcagaaaatg

SEQ ID NO: 408882 - DNA, 15 bp, Homo sapiens
tctatcagaaaatga

SEQ ID NO: 408883 - DNA, 15 bp, Homo sapiens
ctatcagaaaatgat

SEQ ID NO: 408884 - DNA, 15 bp, Homo sapiens
tatcagaaaatgatg

SEQ ID NO: 408885 - DNA, 15 bp, Homo sapiens
atcagaaaatgatgg

SEQ ID NO: 408886 - DNA, 15 bp, Homo sapiens
tcagaaaatgatgga

SEQ ID NO: 408887 - DNA, 15 bp, Homo sapiens
cagaaaatgatggag

SEQ ID NO: 408888 - DNA, 15 bp, Homo sapiens
agaaaatgatggaga

SEQ ID NO: 408889 - DNA, 15 bp, Homo sapiens
gaaaatgatggagac

SEQ ID NO: 408890 - DNA, 15 bp, Homo sapiens
aaaatgatggagact

SEQ ID NO: 408891 - DNA, 15 bp, Homo sapiens
aaatgatggagacta

SEQ ID NO: 408892 - DNA, 15 bp, Homo sapiens
aatgatggagactag

SEQ ID NO: 408893 - DNA, 15 bp, Homo sapiens
atgatggagactaga

SEQ ID NO: 408894 - DNA, 15 bp, Homo sapiens
tgatggagactagaa

SEQ ID NO: 408895 - DNA, 15 bp, Homo sapiens
gatggagactagaaa

SEQ ID NO: 408896 - DNA, 15 bp, Homo sapiens
atggagactagaaag

SEQ ID NO: 408897 - DNA, 15 bp, Homo sapiens
tggagactagaaagt

SEQ ID NO: 408898 - DNA, 15 bp, Homo sapiens
ggagactagaaagta

SEQ ID NO: 408899 - DNA, 15 bp, Homo sapiens
gagactagaaagtaa

SEQ ID NO: 408900 - DNA, 15 bp, Homo sapiens
agactagaaagtaac

SEQ ID NO: 408901 - DNA, 15 bp, Homo sapiens
gactagaaagtaaca

SEQ ID NO: 408902 - DNA, 15 bp, Homo sapiens
actagaaagtaacat

SEQ ID NO: 408903 - DNA, 15 bp, Homo sapiens
ctagaaagtaacata

SEQ ID NO: 408904 - DNA, 15 bp, Homo sapiens
tagaaagtaacatac

SEQ ID NO: 408905 - DNA, 15 bp, Homo sapiens
agaaagtaacataca

SEQ ID NO: 408906 - DNA, 15 bp, Homo sapiens
gaaagtaacatacat

SEQ ID NO: 408907 - DNA, 15 bp, Homo sapiens
aaagtaacatacatg

SEQ ID NO: 408908 - DNA, 15 bp, Homo sapiens
aagtaacatacatga

SEQ ID NO: 408909 - DNA, 15 bp, Homo sapiens
agtaacatacatgag

SEQ ID NO: 408910 - DNA, 15 bp, Homo sapiens
gtaacatacatgagt

SEQ ID NO: 408911 - DNA, 15 bp, Homo sapiens
taacatacatgagtg

SEQ ID NO: 408912 - DNA, 15 bp, Homo sapiens
aacatacatgagtgg

SEQ ID NO: 408913 - DNA, 15 bp, Homo sapiens
acatacatgagtggt

SEQ ID NO: 408914 - DNA, 15 bp, Homo sapiens
catacatgagtggtt

SEQ ID NO: 408915 - DNA, 15 bp, Homo sapiens
atacatgagtggtta

SEQ ID NO: 408916 - DNA, 15 bp, Homo sapiens
tacatgagtggttat

SEQ ID NO: 408917 - DNA, 15 bp, Homo sapiens
acatgagtggttatc

SEQ ID NO: 408918 - DNA, 15 bp, Homo sapiens
catgagtggttatca

SEQ ID NO: 408919 - DNA, 15 bp, Homo sapiens
atgagtggttatcat

SEQ ID NO: 408920 - DNA, 15 bp, Homo sapiens
tgagtggttatcatt

SEQ ID NO: 408921 - DNA, 15 bp, Homo sapiens
gagtggttatcattt

SEQ ID NO: 408922 - DNA, 15 bp, Homo sapiens
agtggttatcatttt

SEQ ID NO: 408923 - DNA, 15 bp, Homo sapiens
gtggttatcatttta

SEQ ID NO: 408924 - DNA, 15 bp, Homo sapiens
tggttatcattttaa

SEQ ID NO: 408925 - DNA, 15 bp, Homo sapiens
ggttatcattttaaa

SEQ ID NO: 408926 - DNA, 15 bp, Homo sapiens
gttatcattttaaaa

SEQ ID NO: 408927 - DNA, 15 bp, Homo sapiens
ttatcattttaaaac

SEQ ID NO: 408928 - DNA, 15 bp, Homo sapiens
tatcattttaaaact

SEQ ID NO: 408929 - DNA, 15 bp, Homo sapiens
atcattttaaaacta

SEQ ID NO: 408930 - DNA, 15 bp, Homo sapiens
tcattttaaaactag

SEQ ID NO: 408931 - DNA, 15 bp, Homo sapiens
cattttaaaactaga

SEQ ID NO: 408932 - DNA, 15 bp, Homo sapiens
attttaaaactagag

SEQ ID NO: 408933 - DNA, 15 bp, Homo sapiens
ttttaaaactagaga

SEQ ID NO: 408934 - DNA, 15 bp, Homo sapiens
tttaaaactagagaa

SEQ ID NO: 408935 - DNA, 15 bp, Homo sapiens
ttaaaactagagaaa

SEQ ID NO: 408936 - DNA, 15 bp, Homo sapiens
taaaactagagaaag

SEQ ID NO: 408937 - DNA, 15 bp, Homo sapiens
aaaactagagaaaga

SEQ ID NO: 408938 - DNA, 15 bp, Homo sapiens
aaactagagaaagag

SEQ ID NO: 408939 - DNA, 15 bp, Homo sapiens
aactagagaaagagt

SEQ ID NO: 408940 - DNA, 15 bp, Homo sapiens
actagagaaagagtc

SEQ ID NO: 408941 - DNA, 15 bp, Homo sapiens
ctagagaaagagtca

SEQ ID NO: 408942 - DNA, 15 bp, Homo sapiens
tagagaaagagtcat

SEQ ID NO: 408943 - DNA, 15 bp, Homo sapiens
agagaaagagtcatg

SEQ ID NO: 408944 - DNA, 15 bp, Homo sapiens
gagaaagagtcatgg

SEQ ID NO: 408945 - DNA, 15 bp, Homo sapiens
gaaagagtcatggaa

SEQ ID NO: 408946 - DNA, 15 bp, Homo sapiens
aaagagtcatggaag

SEQ ID NO: 408947 - DNA, 15 bp, Homo sapiens
aagagtcatggaagt

SEQ ID NO: 408948 - DNA, 15 bp, Homo sapiens
agagtcatggaagtt

SEQ ID NO: 408949 - DNA, 15 bp, Homo sapiens
gagtcatggaagttg

SEQ ID NO: 408950 - DNA, 15 bp, Homo sapiens
agtcatggaagttgg

SEQ ID NO: 408951 - DNA, 15 bp, Homo sapiens
gtcatggaagttggt

SEQ ID NO: 408952 - DNA, 15 bp, Homo sapiens
tcatggaagttggta

SEQ ID NO: 408953 - DNA, 15 bp, Homo sapiens
catggaagttggtag

SEQ ID NO: 408954 - DNA, 15 bp, Homo sapiens
atggaagttggtagg

SEQ ID NO: 408955 - DNA, 15 bp, Homo sapiens
tggaagttggtaggg

SEQ ID NO: 408956 - DNA, 15 bp, Homo sapiens
ggaagttggtagggg

SEQ ID NO: 408957 - DNA, 15 bp, Homo sapiens
gaagttggtaggggg

SEQ ID NO: 408958 - DNA, 15 bp, Homo sapiens
aagttggtagggggg

SEQ ID NO: 408959 - DNA, 15 bp, Homo sapiens
agttggtagggggga

SEQ ID NO: 408960 - DNA, 15 bp, Homo sapiens
gttggtaggggggac

SEQ ID NO: 408961 - DNA, 15 bp, Homo sapiens
ttggtaggggggact

SEQ ID NO: 408962 - DNA, 15 bp, Homo sapiens
tggtaggggggactt

SEQ ID NO: 408963 - DNA, 15 bp, Homo sapiens
ggtaggggggacttt

SEQ ID NO: 408964 - DNA, 15 bp, Homo sapiens
gtaggggggacttta

SEQ ID NO: 408965 - DNA, 15 bp, Homo sapiens
taggggggactttaa

SEQ ID NO: 408966 - DNA, 15 bp, Homo sapiens
aggggggactttaaa

SEQ ID NO: 408967 - DNA, 15 bp, Homo sapiens
ggggggactttaaag

SEQ ID NO: 408968 - DNA, 15 bp, Homo sapiens
gggggactttaaagg

SEQ ID NO: 408969 - DNA, 15 bp, Homo sapiens
ggggactttaaaggt

SEQ ID NO: 408970 - DNA, 15 bp, Homo sapiens
gggactttaaaggtg

SEQ ID NO: 408971 - DNA, 15 bp, Homo sapiens
ggactttaaaggtga

SEQ ID NO: 408972 - DNA, 15 bp, Homo sapiens
gactttaaaggtgaa

SEQ ID NO: 408973 - DNA, 15 bp, Homo sapiens
actttaaaggtgaaa

SEQ ID NO: 408974 - DNA, 15 bp, Homo sapiens
ctttaaaggtgaaag

SEQ ID NO: 408975 - DNA, 15 bp, Homo sapiens
tttaaaggtgaaagt

SEQ ID NO: 408976 - DNA, 15 bp, Homo sapiens
ttaaaggtgaaagtt

SEQ ID NO: 408977 - DNA, 15 bp, Homo sapiens
taaaggtgaaagttt

SEQ ID NO: 408978 - DNA, 15 bp, Homo sapiens
aaaggtgaaagttta

SEQ ID NO: 408979 - DNA, 15 bp, Homo sapiens
aaggtgaaagtttag

SEQ ID NO: 408980 - DNA, 15 bp, Homo sapiens
aggtgaaagtttaga

SEQ ID NO: 408981 - DNA, 15 bp, Homo sapiens
ggtgaaagtttagat

SEQ ID NO: 408982 - DNA, 15 bp, Homo sapiens
gtgaaagtttagatt

SEQ ID NO: 408983 - DNA, 15 bp, Homo sapiens
tgaaagtttagatta

SEQ ID NO: 408984 - DNA, 15 bp, Homo sapiens
gaaagtttagattat

SEQ ID NO: 408985 - DNA, 15 bp, Homo sapiens
aaagtttagattatg

SEQ ID NO: 408986 - DNA, 15 bp, Homo sapiens
aagtttagattatgg

SEQ ID NO: 408987 - DNA, 15 bp, Homo sapiens
agtttagattatggt

SEQ ID NO: 408988 - DNA, 15 bp, Homo sapiens
gtttagattatggtc

SEQ ID NO: 408989 - DNA, 15 bp, Homo sapiens
tttagattatggtct

SEQ ID NO: 408990 - DNA, 15 bp, Homo sapiens
ttagattatggtcta

SEQ ID NO: 408991 - DNA, 15 bp, Homo sapiens
tagattatggtctat

SEQ ID NO: 408992 - DNA, 15 bp, Homo sapiens
agattatggtctatc

SEQ ID NO: 408993 - DNA, 15 bp, Homo sapiens
gattatggtctatca

SEQ ID NO: 408994 - DNA, 15 bp, Homo sapiens
attatggtctatcag

SEQ ID NO: 408995 - DNA, 15 bp, Homo sapiens
ttatggtctatcaga

SEQ ID NO: 408996 - DNA, 15 bp, Homo sapiens
tatggtctatcagag

SEQ ID NO: 408997 - DNA, 15 bp, Homo sapiens
atggtctatcagaga

SEQ ID NO: 408998 - DNA, 15 bp, Homo sapiens
tggtctatcagagag

SEQ ID NO: 408999 - DNA, 15 bp, Homo sapiens
ggtctatcagagagg

SEQ ID NO: 409000 - DNA, 15 bp, Homo sapiens
gtctatcagagagga

SEQ ID NO: 409001 - DNA, 15 bp, Homo sapiens
tctatcagagaggaa

SEQ ID NO: 409002 - DNA, 15 bp, Homo sapiens
ctatcagagaggaat

SEQ ID NO: 409003 - DNA, 15 bp, Homo sapiens
tatcagagaggaatg

SEQ ID NO: 409004 - DNA, 15 bp, Homo sapiens
atcagagaggaatgg

SEQ ID NO: 409005 - DNA, 15 bp, Homo sapiens
tcagagaggaatgga

SEQ ID NO: 409006 - DNA, 15 bp, Homo sapiens
cagagaggaatggaa

SEQ ID NO: 409007 - DNA, 15 bp, Homo sapiens
agagaggaatggaaa

SEQ ID NO: 409008 - DNA, 15 bp, Homo sapiens
gagaggaatggaaaa

SEQ ID NO: 409009 - DNA, 15 bp, Homo sapiens
agaggaatggaaaat

SEQ ID NO: 409010 - DNA, 15 bp, Homo sapiens
gaggaatggaaaata

SEQ ID NO: 409011 - DNA, 15 bp, Homo sapiens
aggaatggaaaataa

SEQ ID NO: 409012 - DNA, 15 bp, Homo sapiens
ggaatggaaaataat

SEQ ID NO: 409013 - DNA, 15 bp, Homo sapiens
gaatggaaaataatg

SEQ ID NO: 409014 - DNA, 15 bp, Homo sapiens
aatggaaaataatgt

SEQ ID NO: 409015 - DNA, 15 bp, Homo sapiens
atggaaaataatgta

SEQ ID NO: 409016 - DNA, 15 bp, Homo sapiens
tggaaaataatgtat

SEQ ID NO: 409017 - DNA, 15 bp, Homo sapiens
ggaaaataatgtatt

SEQ ID NO: 409018 - DNA, 15 bp, Homo sapiens
gaaaataatgtattt

SEQ ID NO: 409019 - DNA, 15 bp, Homo sapiens
aaaataatgtatttt

SEQ ID NO: 409020 - DNA, 15 bp, Homo sapiens
aaataatgtatttta

SEQ ID NO: 409021 - DNA, 15 bp, Homo sapiens
aataatgtattttaa

SEQ ID NO: 409022 - DNA, 15 bp, Homo sapiens
ataatgtattttaag

SEQ ID NO: 409023 - DNA, 15 bp, Homo sapiens
taatgtattttaagg

SEQ ID NO: 409024 - DNA, 15 bp, Homo sapiens
aatgtattttaagga

SEQ ID NO: 409025 - DNA, 15 bp, Homo sapiens
atgtattttaaggag

SEQ ID NO: 409026 - DNA, 15 bp, Homo sapiens
tgtattttaaggaga

SEQ ID NO: 409027 - DNA, 15 bp, Homo sapiens
gtattttaaggagac

SEQ ID NO: 409028 - DNA, 15 bp, Homo sapiens
tattttaaggagact

SEQ ID NO: 409029 - DNA, 15 bp, Homo sapiens
attttaaggagactg

SEQ ID NO: 409030 - DNA, 15 bp, Homo sapiens
ttttaaggagactgt

SEQ ID NO: 409031 - DNA, 15 bp, Homo sapiens
tttaaggagactgta

SEQ ID NO: 409032 - DNA, 15 bp, Homo sapiens
ttaaggagactgtaa

SEQ ID NO: 409033 - DNA, 15 bp, Homo sapiens
taaggagactgtaag

SEQ ID NO: 409034 - DNA, 15 bp, Homo sapiens
aaggagactgtaagt

SEQ ID NO: 409035 - DNA, 15 bp, Homo sapiens
aggagactgtaagta

SEQ ID NO: 409036 - DNA, 15 bp, Homo sapiens
ggagactgtaagtat

SEQ ID NO: 409037 - DNA, 15 bp, Homo sapiens
gagactgtaagtatc

SEQ ID NO: 409038 - DNA, 15 bp, Homo sapiens
agactgtaagtatcc

SEQ ID NO: 409039 - DNA, 15 bp, Homo sapiens
gactgtaagtatcca

SEQ ID NO: 409040 - DNA, 15 bp, Homo sapiens
actgtaagtatccaa

SEQ ID NO: 409041 - DNA, 15 bp, Homo sapiens
ctgtaagtatccaaa

SEQ ID NO: 409042 - DNA, 15 bp, Homo sapiens
tgtaagtatccaaag

SEQ ID NO: 409043 - DNA, 15 bp, Homo sapiens
gtaagtatccaaagt

SEQ ID NO: 409044 - DNA, 15 bp, Homo sapiens
taagtatccaaagta

SEQ ID NO: 409045 - DNA, 15 bp, Homo sapiens
aagtatccaaagtat

SEQ ID NO: 409046 - DNA, 15 bp, Homo sapiens
agtatccaaagtata

SEQ ID NO: 409047 - DNA, 15 bp, Homo sapiens
gtatccaaagtataa

SEQ ID NO: 409048 - DNA, 15 bp, Homo sapiens
tatccaaagtataag

SEQ ID NO: 409049 - DNA, 15 bp, Homo sapiens
atccaaagtataagt

SEQ ID NO: 409050 - DNA, 15 bp, Homo sapiens
tccaaagtataagtt

SEQ ID NO: 409051 - DNA, 15 bp, Homo sapiens
ccaaagtataagtta

SEQ ID NO: 409052 - DNA, 15 bp, Homo sapiens
caaagtataagttaa

SEQ ID NO: 409053 - DNA, 15 bp, Homo sapiens
aaagtataagttaag

SEQ ID NO: 409054 - DNA, 15 bp, Homo sapiens
aagtataagttaagg

SEQ ID NO: 409055 - DNA, 15 bp, Homo sapiens
agtataagttaaggt

SEQ ID NO: 409056 - DNA, 15 bp, Homo sapiens
gtataagttaaggtt

SEQ ID NO: 409057 - DNA, 15 bp, Homo sapiens
tataagttaaggttt

SEQ ID NO: 409058 - DNA, 15 bp, Homo sapiens
ataagttaaggttta

SEQ ID NO: 409059 - DNA, 15 bp, Homo sapiens
taagttaaggtttaa

SEQ ID NO: 409060 - DNA, 15 bp, Homo sapiens
aagttaaggtttaaa

SEQ ID NO: 409061 - DNA, 15 bp, Homo sapiens
agttaaggtttaaaa

SEQ ID NO: 409062 - DNA, 15 bp, Homo sapiens
gttaaggtttaaaat

SEQ ID NO: 409063 - DNA, 15 bp, Homo sapiens
ttaaggtttaaaata

SEQ ID NO: 409064 - DNA, 15 bp, Homo sapiens
taaggtttaaaatat

SEQ ID NO: 409065 - DNA, 15 bp, Homo sapiens
aaggtttaaaatatt

SEQ ID NO: 409066 - DNA, 15 bp, Homo sapiens
aggtttaaaatatta

SEQ ID NO: 409067 - DNA, 15 bp, Homo sapiens
ggtttaaaatattac

SEQ ID NO: 409068 - DNA, 15 bp, Homo sapiens
gtttaaaatattaca

SEQ ID NO: 409069 - DNA, 15 bp, Homo sapiens
tttaaaatattacat

SEQ ID NO: 409070 - DNA, 15 bp, Homo sapiens
ttaaaatattacatt

SEQ ID NO: 409071 - DNA, 15 bp, Homo sapiens
taaaatattacattt

SEQ ID NO: 409072 - DNA, 15 bp, Homo sapiens
aaaatattacatttg

SEQ ID NO: 409073 - DNA, 15 bp, Homo sapiens
aaatattacatttga

SEQ ID NO: 409074 - DNA, 15 bp, Homo sapiens
aatattacatttgag

SEQ ID NO: 409075 - DNA, 15 bp, Homo sapiens
atattacatttgagt

SEQ ID NO: 409076 - DNA, 15 bp, Homo sapiens
tattacatttgagta

SEQ ID NO: 409077 - DNA, 15 bp, Homo sapiens
attacatttgagtaa

SEQ ID NO: 409078 - DNA, 15 bp, Homo sapiens
ttacatttgagtaaa

SEQ ID NO: 409079 - DNA, 15 bp, Homo sapiens
tacatttgagtaaaa

SEQ ID NO: 409080 - DNA, 15 bp, Homo sapiens
acatttgagtaaaac

SEQ ID NO: 409081 - DNA, 15 bp, Homo sapiens
catttgagtaaaaca

SEQ ID NO: 409082 - DNA, 15 bp, Homo sapiens
atttgagtaaaacaa

SEQ ID NO: 409083 - DNA, 15 bp, Homo sapiens
tttgagtaaaacaag

SEQ ID NO: 409084 - DNA, 15 bp, Homo sapiens
ttgagtaaaacaaga

SEQ ID NO: 409085 - DNA, 15 bp, Homo sapiens
tgagtaaaacaagaa

SEQ ID NO: 409086 - DNA, 15 bp, Homo sapiens
gagtaaaacaagaag

SEQ ID NO: 409087 - DNA, 15 bp, Homo sapiens
agtaaaacaagaaga

SEQ ID NO: 409088 - DNA, 15 bp, Homo sapiens
gtaaaacaagaagaa

SEQ ID NO: 409089 - DNA, 15 bp, Homo sapiens
taaaacaagaagaaa

SEQ ID NO: 409090 - DNA, 15 bp, Homo sapiens
aaaacaagaagaaaa

SEQ ID NO: 409091 - DNA, 15 bp, Homo sapiens
aaacaagaagaaaag

SEQ ID NO: 409092 - DNA, 15 bp, Homo sapiens
aacaagaagaaaaga

SEQ ID NO: 409093 - DNA, 15 bp, Homo sapiens
acaagaagaaaagag

SEQ ID NO: 409094 - DNA, 15 bp, Homo sapiens
caagaagaaaagagt

SEQ ID NO: 409095 - DNA, 15 bp, Homo sapiens
aagaagaaaagagtt

SEQ ID NO: 409096 - DNA, 15 bp, Homo sapiens
agaagaaaagagttt

SEQ ID NO: 409097 - DNA, 15 bp, Homo sapiens
gaagaaaagagttta

SEQ ID NO: 409098 - DNA, 15 bp, Homo sapiens
aagaaaagagtttaa

SEQ ID NO: 409099 - DNA, 15 bp, Homo sapiens
agaaaagagtttaac

SEQ ID NO: 409100 - DNA, 15 bp, Homo sapiens
gaaaagagtttaacg

SEQ ID NO: 409101 - DNA, 15 bp, Homo sapiens
aaaagagtttaacgt

SEQ ID NO: 409102 - DNA, 15 bp, Homo sapiens
aaagagtttaacgtt

SEQ ID NO: 409103 - DNA, 15 bp, Homo sapiens
aagagtttaacgttt

SEQ ID NO: 409104 - DNA, 15 bp, Homo sapiens
agagtttaacgtttt

SEQ ID NO: 409105 - DNA, 15 bp, Homo sapiens
gagtttaacgttttc

SEQ ID NO: 409106 - DNA, 15 bp, Homo sapiens
agtttaacgttttcc

SEQ ID NO: 409107 - DNA, 15 bp, Homo sapiens
gtttaacgttttcct

SEQ ID NO: 409108 - DNA, 15 bp, Homo sapiens
tttaacgttttcctg

SEQ ID NO: 409109 - DNA, 15 bp, Homo sapiens
ttaacgttttcctgt

SEQ ID NO: 409110 - DNA, 15 bp, Homo sapiens
taacgttttcctgta

SEQ ID NO: 409111 - DNA, 15 bp, Homo sapiens
aacgttttcctgtaa

SEQ ID NO: 409112 - DNA, 15 bp, Homo sapiens
acgttttcctgtaag

SEQ ID NO: 409113 - DNA, 15 bp, Homo sapiens
cgttttcctgtaaga

SEQ ID NO: 409114 - DNA, 15 bp, Homo sapiens
gttttcctgtaagag

SEQ ID NO: 409115 - DNA, 15 bp, Homo sapiens
ttttcctgtaagaga

SEQ ID NO: 409116 - DNA, 15 bp, Homo sapiens
tttcctgtaagagag

SEQ ID NO: 409117 - DNA, 15 bp, Homo sapiens
ttcctgtaagagagt

SEQ ID NO: 409118 - DNA, 15 bp, Homo sapiens
tcctgtaagagagta

SEQ ID NO: 409119 - DNA, 15 bp, Homo sapiens
cctgtaagagagtag

SEQ ID NO: 409120 - DNA, 15 bp, Homo sapiens
ctgtaagagagtagg

SEQ ID NO: 409121 - DNA, 15 bp, Homo sapiens
tgtaagagagtaggt

SEQ ID NO: 409122 - DNA, 15 bp, Homo sapiens
gtaagagagtaggtt

SEQ ID NO: 409123 - DNA, 15 bp, Homo sapiens
taagagagtaggttg

SEQ ID NO: 409124 - DNA, 15 bp, Homo sapiens
aagagagtaggttgt

SEQ ID NO: 409125 - DNA, 15 bp, Homo sapiens
agagagtaggttgta

SEQ ID NO: 409126 - DNA, 15 bp, Homo sapiens
gagagtaggttgtat

SEQ ID NO: 409127 - DNA, 15 bp, Homo sapiens
agagtaggttgtatt

SEQ ID NO: 409128 - DNA, 15 bp, Homo sapiens
gagtaggttgtattg

SEQ ID NO: 409129 - DNA, 15 bp, Homo sapiens
agtaggttgtattgg

SEQ ID NO: 409130 - DNA, 15 bp, Homo sapiens
gtaggttgtattgga

SEQ ID NO: 409131 - DNA, 15 bp, Homo sapiens
taggttgtattggat

SEQ ID NO: 409132 - DNA, 15 bp, Homo sapiens
aggttgtattggata

SEQ ID NO: 409133 - DNA, 15 bp, Homo sapiens
ggttgtattggatag

SEQ ID NO: 409134 - DNA, 15 bp, Homo sapiens
gttgtattggatagt

SEQ ID NO: 409135 - DNA, 15 bp, Homo sapiens
ttgtattggatagtc

SEQ ID NO: 409136 - DNA, 15 bp, Homo sapiens
tgtattggatagtca

SEQ ID NO: 409137 - DNA, 15 bp, Homo sapiens
gtattggatagtcat

SEQ ID NO: 409138 - DNA, 15 bp, Homo sapiens
tattggatagtcatg

SEQ ID NO: 409139 - DNA, 15 bp, Homo sapiens
attggatagtcatgt

SEQ ID NO: 409140 - DNA, 15 bp, Homo sapiens
ttggatagtcatgtt

SEQ ID NO: 409141 - DNA, 15 bp, Homo sapiens
tggatagtcatgttg

SEQ ID NO: 409142 - DNA, 15 bp, Homo sapiens
ggatagtcatgttgt

SEQ ID NO: 409143 - DNA, 15 bp, Homo sapiens
gatagtcatgttgtt

SEQ ID NO: 409144 - DNA, 15 bp, Homo sapiens
atagtcatgttgttc

SEQ ID NO: 409145 - DNA, 15 bp, Homo sapiens
tagtcatgttgttca

SEQ ID NO: 409146 - DNA, 15 bp, Homo sapiens
agtcatgttgttcag

SEQ ID NO: 409147 - DNA, 15 bp, Homo sapiens
gtcatgttgttcaga

SEQ ID NO: 409148 - DNA, 15 bp, Homo sapiens
tcatgttgttcagat

SEQ ID NO: 409149 - DNA, 15 bp, Homo sapiens
catgttgttcagatt

SEQ ID NO: 409150 - DNA, 15 bp, Homo sapiens
atgttgttcagattt

SEQ ID NO: 409151 - DNA, 15 bp, Homo sapiens
tgttgttcagatttt

SEQ ID NO: 409152 - DNA, 15 bp, Homo sapiens
gttgttcagattttt

SEQ ID NO: 409153 - DNA, 15 bp, Homo sapiens
ttgttcagattttta

SEQ ID NO: 409154 - DNA, 15 bp, Homo sapiens
tgttcagatttttat

SEQ ID NO: 409155 - DNA, 15 bp, Homo sapiens
gttcagatttttatt

SEQ ID NO: 409156 - DNA, 15 bp, Homo sapiens
ttcagatttttattt

SEQ ID NO: 409157 - DNA, 15 bp, Homo sapiens
tcagatttttattta

SEQ ID NO: 409158 - DNA, 15 bp, Homo sapiens
cagatttttatttat

SEQ ID NO: 409159 - DNA, 15 bp, Homo sapiens
agatttttatttatt

SEQ ID NO: 409160 - DNA, 15 bp, Homo sapiens
gatttttatttattt

SEQ ID NO: 409161 - DNA, 15 bp, Homo sapiens
atttttatttatttt

SEQ ID NO: 409162 - DNA, 15 bp, Homo sapiens
tttttatttattttg

SEQ ID NO: 409163 - DNA, 15 bp, Homo sapiens
ttttatttattttgt

SEQ ID NO: 409164 - DNA, 15 bp, Homo sapiens
tttatttattttgta

SEQ ID NO: 409165 - DNA, 15 bp, Homo sapiens
ttatttattttgtaa

SEQ ID NO: 409166 - DNA, 15 bp, Homo sapiens
tatttattttgtaaa

SEQ ID NO: 409167 - DNA, 15 bp, Homo sapiens
atttattttgtaaat

SEQ ID NO: 409168 - DNA, 15 bp, Homo sapiens
tttattttgtaaata

SEQ ID NO: 409169 - DNA, 15 bp, Homo sapiens
ttattttgtaaatag

SEQ ID NO: 409170 - DNA, 15 bp, Homo sapiens
tattttgtaaatagt

SEQ ID NO: 409171 - DNA, 15 bp, Homo sapiens
attttgtaaatagtt

SEQ ID NO: 409172 - DNA, 15 bp, Homo sapiens
ttttgtaaatagttt

SEQ ID NO: 409173 - DNA, 15 bp, Homo sapiens
tttgtaaatagtttt

SEQ ID NO: 409174 - DNA, 15 bp, Homo sapiens
ttgtaaatagttttg

SEQ ID NO: 409175 - DNA, 15 bp, Homo sapiens
tgtaaatagttttgt

SEQ ID NO: 409176 - DNA, 15 bp, Homo sapiens
gtaaatagttttgtt

SEQ ID NO: 409177 - DNA, 15 bp, Homo sapiens
taaatagttttgttt

SEQ ID NO: 409178 - DNA, 15 bp, Homo sapiens
aaatagttttgtttt

SEQ ID NO: 409179 - DNA, 15 bp, Homo sapiens
aatagttttgttttg

SEQ ID NO: 409180 - DNA, 15 bp, Homo sapiens
atagttttgttttgt

SEQ ID NO: 409181 - DNA, 15 bp, Homo sapiens
tagttttgttttgtt

SEQ ID NO: 409182 - DNA, 15 bp, Homo sapiens
agttttgttttgtta

SEQ ID NO: 409183 - DNA, 15 bp, Homo sapiens
gttttgttttgttaa

SEQ ID NO: 409184 - DNA, 15 bp, Homo sapiens
ttttgttttgttaaa

SEQ ID NO: 409185 - DNA, 15 bp, Homo sapiens
tttgttttgttaaaa

SEQ ID NO: 409186 - DNA, 15 bp, Homo sapiens
ttgttttgttaaaaa

SEQ ID NO: 409187 - DNA, 15 bp, Homo sapiens
tgttttgttaaaaat

SEQ ID NO: 409188 - DNA, 15 bp, Homo sapiens
gttttgttaaaaatt

SEQ ID NO: 409189 - DNA, 15 bp, Homo sapiens
ttttgttaaaaattt

SEQ ID NO: 409190 - DNA, 15 bp, Homo sapiens
tttgttaaaaatttg

SEQ ID NO: 409191 - DNA, 15 bp, Homo sapiens
ttgttaaaaatttgt

SEQ ID NO: 409192 - DNA, 15 bp, Homo sapiens
tgttaaaaatttgtg

SEQ ID NO: 409193 - DNA, 15 bp, Homo sapiens
gttaaaaatttgtgt

SEQ ID NO: 409194 - DNA, 15 bp, Homo sapiens
ttaaaaatttgtgtt

SEQ ID NO: 409195 - DNA, 15 bp, Homo sapiens
taaaaatttgtgtta

SEQ ID NO: 409196 - DNA, 15 bp, Homo sapiens
aaaaatttgtgttaa

SEQ ID NO: 409197 - DNA, 15 bp, Homo sapiens
aaaatttgtgttaat

SEQ ID NO: 409198 - DNA, 15 bp, Homo sapiens
aaatttgtgttaatt

SEQ ID NO: 409199 - DNA, 15 bp, Homo sapiens
aatttgtgttaattg

SEQ ID NO: 409200 - DNA, 15 bp, Homo sapiens
atttgtgttaattgg

SEQ ID NO: 409201 - DNA, 15 bp, Homo sapiens
tttgtgttaattggg

SEQ ID NO: 409202 - DNA, 15 bp, Homo sapiens
ttgtgttaattgggc

SEQ ID NO: 409203 - DNA, 15 bp, Homo sapiens
tgtgttaattgggcc

SEQ ID NO: 409204 - DNA, 15 bp, Homo sapiens
gtgttaattgggccg

SEQ ID NO: 409205 - DNA, 15 bp, Homo sapiens
tgttaattgggccgg

SEQ ID NO: 409206 - DNA, 15 bp, Homo sapiens
gttaattgggccggg

SEQ ID NO: 409207 - DNA, 15 bp, Homo sapiens
ttaattgggccgggc

SEQ ID NO: 409208 - DNA, 15 bp, Homo sapiens
taattgggccgggca

SEQ ID NO: 409209 - DNA, 15 bp, Homo sapiens
aattgggccgggcac

SEQ ID NO: 409210 - DNA, 15 bp, Homo sapiens
attgggccgggcacg

SEQ ID NO: 409211 - DNA, 15 bp, Homo sapiens
ttgggccgggcacgg

SEQ ID NO: 409212 - DNA, 15 bp, Homo sapiens
tgggccgggcacggt

SEQ ID NO: 409213 - DNA, 15 bp, Homo sapiens
gggccgggcacggtg

SEQ ID NO: 409214 - DNA, 15 bp, Homo sapiens
ggccgggcacggtgg

SEQ ID NO: 409215 - DNA, 15 bp, Homo sapiens
gccgggcacggtggt

SEQ ID NO: 409216 - DNA, 15 bp, Homo sapiens
ccgggcacggtggtt

SEQ ID NO: 409217 - DNA, 15 bp, Homo sapiens
cgggcacggtggttc

SEQ ID NO: 409218 - DNA, 15 bp, Homo sapiens
gggcacggtggttca

SEQ ID NO: 409219 - DNA, 15 bp, Homo sapiens
ggcacggtggttcat

SEQ ID NO: 409220 - DNA, 15 bp, Homo sapiens
gcacggtggttcatg

SEQ ID NO: 409221 - DNA, 15 bp, Homo sapiens
cacggtggttcatgc

SEQ ID NO: 409222 - DNA, 15 bp, Homo sapiens
acggtggttcatgcc

SEQ ID NO: 409223 - DNA, 15 bp, Homo sapiens
cggtggttcatgcct

SEQ ID NO: 409224 - DNA, 15 bp, Homo sapiens
ggtggttcatgcctg

SEQ ID NO: 409225 - DNA, 15 bp, Homo sapiens
gtggttcatgcctgt

SEQ ID NO: 409226 - DNA, 15 bp, Homo sapiens
tggttcatgcctgta

SEQ ID NO: 409227 - DNA, 15 bp, Homo sapiens
ggttcatgcctgtaa

SEQ ID NO: 409228 - DNA, 15 bp, Homo sapiens
gttcatgcctgtaat

SEQ ID NO: 409229 - DNA, 15 bp, Homo sapiens
ttcatgcctgtaatc

SEQ ID NO: 409230 - DNA, 15 bp, Homo sapiens
aggctgaggcgggca

SEQ ID NO: 409231 - DNA, 15 bp, Homo sapiens
ggctgaggcgggcag

SEQ ID NO: 409232 - DNA, 15 bp, Homo sapiens
gctgaggcgggcaga

SEQ ID NO: 409233 - DNA, 15 bp, Homo sapiens
ctgaggcgggcagat

SEQ ID NO: 409234 - DNA, 15 bp, Homo sapiens
tgaggcgggcagatc

SEQ ID NO: 409235 - DNA, 15 bp, Homo sapiens
gttcaagaccagccc

SEQ ID NO: 409236 - DNA, 15 bp, Homo sapiens
ttcaagaccagcccg

SEQ ID NO: 409237 - DNA, 15 bp, Homo sapiens
tcaagaccagcccgg

SEQ ID NO: 409238 - DNA, 15 bp, Homo sapiens
caagaccagcccggc

SEQ ID NO: 409239 - DNA, 15 bp, Homo sapiens
aagaccagcccggcc

SEQ ID NO: 409240 - DNA, 15 bp, Homo sapiens
cagcccggccaacat

SEQ ID NO: 409241 - DNA, 15 bp, Homo sapiens
agcccggccaacatg

SEQ ID NO: 409242 - DNA, 15 bp, Homo sapiens
gcccggccaacatgg

SEQ ID NO: 409243 - DNA, 15 bp, Homo sapiens
cccggccaacatggt

SEQ ID NO: 409244 - DNA, 15 bp, Homo sapiens
ccggccaacatggtg

SEQ ID NO: 409245 - DNA, 15 bp, Homo sapiens
cggccaacatggtga

SEQ ID NO: 409246 - DNA, 15 bp, Homo sapiens
ttagccaggcatggg

SEQ ID NO: 409247 - DNA, 15 bp, Homo sapiens
tagccaggcatgggg

SEQ ID NO: 409248 - DNA, 15 bp, Homo sapiens
agccaggcatggggg

SEQ ID NO: 409249 - DNA, 15 bp, Homo sapiens
gccaggcatgggggc

SEQ ID NO: 409250 - DNA, 15 bp, Homo sapiens
ccaggcatgggggca

SEQ ID NO: 409251 - DNA, 15 bp, Homo sapiens
caggcatgggggcag

SEQ ID NO: 409252 - DNA, 15 bp, Homo sapiens
aggcatgggggcagg

SEQ ID NO: 409253 - DNA, 15 bp, Homo sapiens
ggcatgggggcaggc

SEQ ID NO: 409254 - DNA, 15 bp, Homo sapiens
gcatgggggcaggca

SEQ ID NO: 409255 - DNA, 15 bp, Homo sapiens
catgggggcaggcac

SEQ ID NO: 409256 - DNA, 15 bp, Homo sapiens
atgggggcaggcacc

SEQ ID NO: 409257 - DNA, 15 bp, Homo sapiens
tgggggcaggcacct

SEQ ID NO: 409258 - DNA, 15 bp, Homo sapiens
gggggcaggcacctg

SEQ ID NO: 409259 - DNA, 15 bp, Homo sapiens
ggggcaggcacctgt

SEQ ID NO: 409260 - DNA, 15 bp, Homo sapiens
gggcaggcacctgta

SEQ ID NO: 409261 - DNA, 15 bp, Homo sapiens
cagctacttgagagg

SEQ ID NO: 409262 - DNA, 15 bp, Homo sapiens
acttgagaggctgag

SEQ ID NO: 409263 - DNA, 15 bp, Homo sapiens
ttgagaggctgaggc

SEQ ID NO: 409264 - DNA, 15 bp, Homo sapiens
tgagaggctgaggca

SEQ ID NO: 409265 - DNA, 15 bp, Homo sapiens
gagaggctgaggcag

SEQ ID NO: 409266 - DNA, 15 bp, Homo sapiens
agaggctgaggcagg

SEQ ID NO: 409267 - DNA, 15 bp, Homo sapiens
cgcttgaacccgggc

SEQ ID NO: 409268 - DNA, 15 bp, Homo sapiens
gcttgaacccgggcg

SEQ ID NO: 409269 - DNA, 15 bp, Homo sapiens
cttgaacccgggcgg

SEQ ID NO: 409270 - DNA, 15 bp, Homo sapiens
ttgaacccgggcggt

SEQ ID NO: 409271 - DNA, 15 bp, Homo sapiens
tgaacccgggcggtg

SEQ ID NO: 409272 - DNA, 15 bp, Homo sapiens
gaacccgggcggtgg

SEQ ID NO: 409273 - DNA, 15 bp, Homo sapiens
aacccgggcggtgga

SEQ ID NO: 409274 - DNA, 15 bp, Homo sapiens
acccgggcggtggag

SEQ ID NO: 409275 - DNA, 15 bp, Homo sapiens
cccgggcggtggagg

SEQ ID NO: 409276 - DNA, 15 bp, Homo sapiens
ccgggcggtggaggt

SEQ ID NO: 409277 - DNA, 15 bp, Homo sapiens
cgggcggtggaggtt

SEQ ID NO: 409278 - DNA, 15 bp, Homo sapiens
gggcggtggaggtta

SEQ ID NO: 409279 - DNA, 15 bp, Homo sapiens
ggcggtggaggttac

SEQ ID NO: 409280 - DNA, 15 bp, Homo sapiens
gcggtggaggttaca

SEQ ID NO: 409281 - DNA, 15 bp, Homo sapiens
cggtggaggttacaa

SEQ ID NO: 409282 - DNA, 15 bp, Homo sapiens
ggtggaggttacaat

SEQ ID NO: 409283 - DNA, 15 bp, Homo sapiens
gtggaggttacaatg

SEQ ID NO: 409284 - DNA, 15 bp, Homo sapiens
tggaggttacaatga

SEQ ID NO: 409285 - DNA, 15 bp, Homo sapiens
ggaggttacaatgag

SEQ ID NO: 409286 - DNA, 15 bp, Homo sapiens
gaggttacaatgagc

SEQ ID NO: 409287 - DNA, 15 bp, Homo sapiens
aggttacaatgagcc

SEQ ID NO: 409288 - DNA, 15 bp, Homo sapiens
ggttacaatgagccc

SEQ ID NO: 409289 - DNA, 15 bp, Homo sapiens
gttacaatgagccca

SEQ ID NO: 409290 - DNA, 15 bp, Homo sapiens
ttacaatgagcccag

SEQ ID NO: 409291 - DNA, 15 bp, Homo sapiens
tacaatgagcccaga

SEQ ID NO: 409292 - DNA, 15 bp, Homo sapiens
acaatgagcccagac

SEQ ID NO: 409293 - DNA, 15 bp, Homo sapiens
caatgagcccagacc

SEQ ID NO: 409294 - DNA, 15 bp, Homo sapiens
aatgagcccagacca

SEQ ID NO: 409295 - DNA, 15 bp, Homo sapiens
atgagcccagaccat

SEQ ID NO: 409296 - DNA, 15 bp, Homo sapiens
tgagcccagaccatg

SEQ ID NO: 409297 - DNA, 15 bp, Homo sapiens
gagcccagaccatgc

SEQ ID NO: 409298 - DNA, 15 bp, Homo sapiens
agcccagaccatgcc

SEQ ID NO: 409299 - DNA, 15 bp, Homo sapiens
gcccagaccatgcca

SEQ ID NO: 409300 - DNA, 15 bp, Homo sapiens
cccagaccatgccat

SEQ ID NO: 409301 - DNA, 15 bp, Homo sapiens
ccagaccatgccatt

SEQ ID NO: 409302 - DNA, 15 bp, Homo sapiens
cagaccatgccattg

SEQ ID NO: 409303 - DNA, 15 bp, Homo sapiens
agaccatgccattgc

SEQ ID NO: 409304 - DNA, 15 bp, Homo sapiens
gaccatgccattgca

SEQ ID NO: 409305 - DNA, 15 bp, Homo sapiens
accatgccattgcac

SEQ ID NO: 409306 - DNA, 15 bp, Homo sapiens
ccatgccattgcact

SEQ ID NO: 409307 - DNA, 15 bp, Homo sapiens
gcactccagcctgga

SEQ ID NO: 409308 - DNA, 15 bp, Homo sapiens
cactccagcctggac

SEQ ID NO: 409309 - DNA, 15 bp, Homo sapiens
actccagcctggaca

SEQ ID NO: 409310 - DNA, 15 bp, Homo sapiens
ctccagcctggacaa

SEQ ID NO: 409311 - DNA, 15 bp, Homo sapiens
tccagcctggacaag

SEQ ID NO: 409312 - DNA, 15 bp, Homo sapiens
ccagcctggacaaga

SEQ ID NO: 409313 - DNA, 15 bp, Homo sapiens
cagcctggacaagag

SEQ ID NO: 409314 - DNA, 15 bp, Homo sapiens
agcctggacaagagt

SEQ ID NO: 409315 - DNA, 15 bp, Homo sapiens
gcctggacaagagtg

SEQ ID NO: 409316 - DNA, 15 bp, Homo sapiens
cctggacaagagtga

SEQ ID NO: 409317 - DNA, 15 bp, Homo sapiens
ctggacaagagtgaa

SEQ ID NO: 409318 - DNA, 15 bp, Homo sapiens
tggacaagagtgaaa

SEQ ID NO: 409319 - DNA, 15 bp, Homo sapiens
ggacaagagtgaaac

SEQ ID NO: 409320 - DNA, 15 bp, Homo sapiens
gacaagagtgaaaca

SEQ ID NO: 409321 - DNA, 15 bp, Homo sapiens
acaagagtgaaacac

SEQ ID NO: 409322 - DNA, 15 bp, Homo sapiens
caagagtgaaacacc

SEQ ID NO: 409323 - DNA, 15 bp, Homo sapiens
aagagtgaaacacca

SEQ ID NO: 409324 - DNA, 15 bp, Homo sapiens
agagtgaaacaccat

SEQ ID NO: 409325 - DNA, 15 bp, Homo sapiens
gagtgaaacaccatc

SEQ ID NO: 409326 - DNA, 15 bp, Homo sapiens
agtgaaacaccatct

SEQ ID NO: 409327 - DNA, 15 bp, Homo sapiens
tgaaacaccatctca

SEQ ID NO: 409328 - DNA, 15 bp, Homo sapiens
gaaacaccatctcaa

SEQ ID NO: 409329 - DNA, 15 bp, Homo sapiens
aaacaccatctcaaa

SEQ ID NO: 409330 - DNA, 15 bp, Homo sapiens
aacaccatctcaaaa

SEQ ID NO: 409331 - DNA, 15 bp, Homo sapiens
acaccatctcaaaaa

SEQ ID NO: 409332 - DNA, 15 bp, Homo sapiens
caccatctcaaaaaa

SEQ ID NO: 409333 - DNA, 15 bp, Homo sapiens
accatctcaaaaaaa

SEQ ID NO: 409334 - DNA, 15 bp, Homo sapiens
aaaaaaaaatttgtt

SEQ ID NO: 409335 - DNA, 15 bp, Homo sapiens
aaaaaaaatttgtta

SEQ ID NO: 409336 - DNA, 15 bp, Homo sapiens
aaaaaaatttgttaa

SEQ ID NO: 409337 - DNA, 15 bp, Homo sapiens
aaaaaatttgttaat

SEQ ID NO: 409338 - DNA, 15 bp, Homo sapiens
aaaaatttgttaatt

SEQ ID NO: 409339 - DNA, 15 bp, Homo sapiens
aaaatttgttaattt

SEQ ID NO: 409340 - DNA, 15 bp, Homo sapiens
aaatttgttaatttt

SEQ ID NO: 409341 - DNA, 15 bp, Homo sapiens
aatttgttaattttg

SEQ ID NO: 409342 - DNA, 15 bp, Homo sapiens
atttgttaattttgc

SEQ ID NO: 409343 - DNA, 15 bp, Homo sapiens
tttgttaattttgct

SEQ ID NO: 409344 - DNA, 15 bp, Homo sapiens
ttgttaattttgctg

SEQ ID NO: 409345 - DNA, 15 bp, Homo sapiens
tgttaattttgctga

SEQ ID NO: 409346 - DNA, 15 bp, Homo sapiens
gttaattttgctgag

SEQ ID NO: 409347 - DNA, 15 bp, Homo sapiens
ttaattttgctgagg

SEQ ID NO: 409348 - DNA, 15 bp, Homo sapiens
taattttgctgaggt

SEQ ID NO: 409349 - DNA, 15 bp, Homo sapiens
aattttgctgaggtg

SEQ ID NO: 409350 - DNA, 15 bp, Homo sapiens
attttgctgaggtgg

SEQ ID NO: 409351 - DNA, 15 bp, Homo sapiens
ttttgctgaggtggt

SEQ ID NO: 409352 - DNA, 15 bp, Homo sapiens
tttgctgaggtggtc

SEQ ID NO: 409353 - DNA, 15 bp, Homo sapiens
ttgctgaggtggtcc

SEQ ID NO: 409354 - DNA, 15 bp, Homo sapiens
tgctgaggtggtcct

SEQ ID NO: 409355 - DNA, 15 bp, Homo sapiens
gctgaggtggtcctg

SEQ ID NO: 409356 - DNA, 15 bp, Homo sapiens
ctgaggtggtcctga

SEQ ID NO: 409357 - DNA, 15 bp, Homo sapiens
tgaggtggtcctgag

SEQ ID NO: 409358 - DNA, 15 bp, Homo sapiens
gaggtggtcctgaga

SEQ ID NO: 409359 - DNA, 15 bp, Homo sapiens
aggtggtcctgagac

SEQ ID NO: 409360 - DNA, 15 bp, Homo sapiens
ggtggtcctgagact

SEQ ID NO: 409361 - DNA, 15 bp, Homo sapiens
gtggtcctgagactg

SEQ ID NO: 409362 - DNA, 15 bp, Homo sapiens
tggtcctgagactgg

SEQ ID NO: 409363 - DNA, 15 bp, Homo sapiens
ggtcctgagactgga

SEQ ID NO: 409364 - DNA, 15 bp, Homo sapiens
gtcctgagactggat

SEQ ID NO: 409365 - DNA, 15 bp, Homo sapiens
tcctgagactggatc

SEQ ID NO: 409366 - DNA, 15 bp, Homo sapiens
cctgagactggatca

SEQ ID NO: 409367 - DNA, 15 bp, Homo sapiens
ctgagactggatcaa

SEQ ID NO: 409368 - DNA, 15 bp, Homo sapiens
tgagactggatcaaa

SEQ ID NO: 409369 - DNA, 15 bp, Homo sapiens
gagactggatcaaaa

SEQ ID NO: 409370 - DNA, 15 bp, Homo sapiens
agactggatcaaaaa

SEQ ID NO: 409371 - DNA, 15 bp, Homo sapiens
gactggatcaaaaat

SEQ ID NO: 409372 - DNA, 15 bp, Homo sapiens
actggatcaaaaatt

SEQ ID NO: 409373 - DNA, 15 bp, Homo sapiens
ctggatcaaaaattg

SEQ ID NO: 409374 - DNA, 15 bp, Homo sapiens
tggatcaaaaattgc

SEQ ID NO: 409375 - DNA, 15 bp, Homo sapiens
ggatcaaaaattgca

SEQ ID NO: 409376 - DNA, 15 bp, Homo sapiens
gatcaaaaattgcag

SEQ ID NO: 409377 - DNA, 15 bp, Homo sapiens
atcaaaaattgcagc

SEQ ID NO: 409378 - DNA, 15 bp, Homo sapiens
tcaaaaattgcagca

SEQ ID NO: 409379 - DNA, 15 bp, Homo sapiens
caaaaattgcagcac

SEQ ID NO: 409380 - DNA, 15 bp, Homo sapiens
aaaaattgcagcact

SEQ ID NO: 409381 - DNA, 15 bp, Homo sapiens
aaaattgcagcacta

SEQ ID NO: 409382 - DNA, 15 bp, Homo sapiens
aaattgcagcactat

SEQ ID NO: 409383 - DNA, 15 bp, Homo sapiens
aattgcagcactata

SEQ ID NO: 409384 - DNA, 15 bp, Homo sapiens
attgcagcactatat

SEQ ID NO: 409385 - DNA, 15 bp, Homo sapiens
ttgcagcactatatt

SEQ ID NO: 409386 - DNA, 15 bp, Homo sapiens
tgcagcactatattc

SEQ ID NO: 409387 - DNA, 15 bp, Homo sapiens
gcagcactatattct

SEQ ID NO: 409388 - DNA, 15 bp, Homo sapiens
cagcactatattctt

SEQ ID NO: 409389 - DNA, 15 bp, Homo sapiens
agcactatattcttc

SEQ ID NO: 409390 - DNA, 15 bp, Homo sapiens
gcactatattcttct

SEQ ID NO: 409391 - DNA, 15 bp, Homo sapiens
cactatattcttcta

SEQ ID NO: 409392 - DNA, 15 bp, Homo sapiens
actatattcttctag

SEQ ID NO: 409393 - DNA, 15 bp, Homo sapiens
ctatattcttctaga

SEQ ID NO: 409394 - DNA, 15 bp, Homo sapiens
tatattcttctagaa

SEQ ID NO: 409395 - DNA, 15 bp, Homo sapiens
atattcttctagaaa

SEQ ID NO: 409396 - DNA, 15 bp, Homo sapiens
tattcttctagaaac

SEQ ID NO: 409397 - DNA, 15 bp, Homo sapiens
attcttctagaaaca

SEQ ID NO: 409398 - DNA, 15 bp, Homo sapiens
ttcttctagaaacat

SEQ ID NO: 409399 - DNA, 15 bp, Homo sapiens
tcttctagaaacatg

SEQ ID NO: 409400 - DNA, 15 bp, Homo sapiens
cttctagaaacatgc

SEQ ID NO: 409401 - DNA, 15 bp, Homo sapiens
ttctagaaacatgca

SEQ ID NO: 409402 - DNA, 15 bp, Homo sapiens
tctagaaacatgcac

SEQ ID NO: 409403 - DNA, 15 bp, Homo sapiens
ctagaaacatgcaca

SEQ ID NO: 409404 - DNA, 15 bp, Homo sapiens
tagaaacatgcacac

SEQ ID NO: 409405 - DNA, 15 bp, Homo sapiens
agaaacatgcacacg

SEQ ID NO: 409406 - DNA, 15 bp, Homo sapiens
gaaacatgcacacgt

SEQ ID NO: 409407 - DNA, 15 bp, Homo sapiens
aaacatgcacacgtt

SEQ ID NO: 409408 - DNA, 15 bp, Homo sapiens
aacatgcacacgttt

SEQ ID NO: 409409 - DNA, 15 bp, Homo sapiens
acatgcacacgtttt

SEQ ID NO: 409410 - DNA, 15 bp, Homo sapiens
catgcacacgttttt

SEQ ID NO: 409411 - DNA, 15 bp, Homo sapiens
atgcacacgtttttt

SEQ ID NO: 409412 - DNA, 15 bp, Homo sapiens
tgcacacgtttttta

SEQ ID NO: 409413 - DNA, 15 bp, Homo sapiens
gcacacgttttttaa

SEQ ID NO: 409414 - DNA, 15 bp, Homo sapiens
cacacgttttttaaa

SEQ ID NO: 409415 - DNA, 15 bp, Homo sapiens
acacgttttttaaaa

SEQ ID NO: 409416 - DNA, 15 bp, Homo sapiens
cacgttttttaaaat

SEQ ID NO: 409417 - DNA, 15 bp, Homo sapiens
acgttttttaaaatt

SEQ ID NO: 409418 - DNA, 15 bp, Homo sapiens
cgttttttaaaattg

SEQ ID NO: 409419 - DNA, 15 bp, Homo sapiens
gttttttaaaattgc

SEQ ID NO: 409420 - DNA, 15 bp, Homo sapiens
ttttttaaaattgct

SEQ ID NO: 409421 - DNA, 15 bp, Homo sapiens
tttttaaaattgctt

SEQ ID NO: 409422 - DNA, 15 bp, Homo sapiens
ttttaaaattgcttt

SEQ ID NO: 409423 - DNA, 15 bp, Homo sapiens
tttaaaattgcttta

SEQ ID NO: 409424 - DNA, 15 bp, Homo sapiens
ttaaaattgctttac

SEQ ID NO: 409425 - DNA, 15 bp, Homo sapiens
taaaattgctttacc

SEQ ID NO: 409426 - DNA, 15 bp, Homo sapiens
aaaattgctttacct

SEQ ID NO: 409427 - DNA, 15 bp, Homo sapiens
aaattgctttacctg

SEQ ID NO: 409428 - DNA, 15 bp, Homo sapiens
aattgctttacctgc

SEQ ID NO: 409429 - DNA, 15 bp, Homo sapiens
attgctttacctgca

SEQ ID NO: 409430 - DNA, 15 bp, Homo sapiens
ttgctttacctgcac

SEQ ID NO: 409431 - DNA, 15 bp, Homo sapiens
tgctttacctgcaca

SEQ ID NO: 409432 - DNA, 15 bp, Homo sapiens
gctttacctgcacaa

SEQ ID NO: 409433 - DNA, 15 bp, Homo sapiens
ctttacctgcacaat

SEQ ID NO: 409434 - DNA, 15 bp, Homo sapiens
tttacctgcacaatt

SEQ ID NO: 409435 - DNA, 15 bp, Homo sapiens
ttacctgcacaattg

SEQ ID NO: 409436 - DNA, 15 bp, Homo sapiens
tacctgcacaattga

SEQ ID NO: 409437 - DNA, 15 bp, Homo sapiens
acctgcacaattgag

SEQ ID NO: 409438 - DNA, 15 bp, Homo sapiens
cctgcacaattgagt

SEQ ID NO: 409439 - DNA, 15 bp, Homo sapiens
ctgcacaattgagtt

SEQ ID NO: 409440 - DNA, 15 bp, Homo sapiens
tgcacaattgagttc

SEQ ID NO: 409441 - DNA, 15 bp, Homo sapiens
gcacaattgagttca

SEQ ID NO: 409442 - DNA, 15 bp, Homo sapiens
cacaattgagttcat

SEQ ID NO: 409443 - DNA, 15 bp, Homo sapiens
acaattgagttcatg

SEQ ID NO: 409444 - DNA, 15 bp, Homo sapiens
caattgagttcatga

SEQ ID NO: 409445 - DNA, 15 bp, Homo sapiens
aattgagttcatgat

SEQ ID NO: 409446 - DNA, 15 bp, Homo sapiens
attgagttcatgata

SEQ ID NO: 409447 - DNA, 15 bp, Homo sapiens
ttgagttcatgatat

SEQ ID NO: 409448 - DNA, 15 bp, Homo sapiens
tgagttcatgatatt

SEQ ID NO: 409449 - DNA, 15 bp, Homo sapiens
gagttcatgatattt

SEQ ID NO: 409450 - DNA, 15 bp, Homo sapiens
agttcatgatatttc

SEQ ID NO: 409451 - DNA, 15 bp, Homo sapiens
gttcatgatatttct

SEQ ID NO: 409452 - DNA, 15 bp, Homo sapiens
ttcatgatatttctg

SEQ ID NO: 409453 - DNA, 15 bp, Homo sapiens
tcatgatatttctgt

SEQ ID NO: 409454 - DNA, 15 bp, Homo sapiens
catgatatttctgtc

SEQ ID NO: 409455 - DNA, 15 bp, Homo sapiens
atgatatttctgtcg

SEQ ID NO: 409456 - DNA, 15 bp, Homo sapiens
tgatatttctgtcgt

SEQ ID NO: 409457 - DNA, 15 bp, Homo sapiens
gatatttctgtcgtg

SEQ ID NO: 409458 - DNA, 15 bp, Homo sapiens
atatttctgtcgtgt

SEQ ID NO: 409459 - DNA, 15 bp, Homo sapiens
tatttctgtcgtgtc

SEQ ID NO: 409460 - DNA, 15 bp, Homo sapiens
atttctgtcgtgtcg

SEQ ID NO: 409461 - DNA, 15 bp, Homo sapiens
tttctgtcgtgtcgc

SEQ ID NO: 409462 - DNA, 15 bp, Homo sapiens
ttctgtcgtgtcgca

SEQ ID NO: 409463 - DNA, 15 bp, Homo sapiens
tctgtcgtgtcgcat

SEQ ID NO: 409464 - DNA, 15 bp, Homo sapiens
ctgtcgtgtcgcatt

SEQ ID NO: 409465 - DNA, 15 bp, Homo sapiens
tgtcgtgtcgcattt

SEQ ID NO: 409466 - DNA, 15 bp, Homo sapiens
gtcgtgtcgcatttg

SEQ ID NO: 409467 - DNA, 15 bp, Homo sapiens
tcgtgtcgcatttgt

SEQ ID NO: 409468 - DNA, 15 bp, Homo sapiens
cgtgtcgcatttgta

SEQ ID NO: 409469 - DNA, 15 bp, Homo sapiens
gtgtcgcatttgtaa

SEQ ID NO: 409470 - DNA, 15 bp, Homo sapiens
tgtcgcatttgtaat

SEQ ID NO: 409471 - DNA, 15 bp, Homo sapiens
gtcgcatttgtaatg

SEQ ID NO: 409472 - DNA, 15 bp, Homo sapiens
tcgcatttgtaatgt

SEQ ID NO: 409473 - DNA, 15 bp, Homo sapiens
cgcatttgtaatgta

SEQ ID NO: 409474 - DNA, 15 bp, Homo sapiens
gcatttgtaatgtag

SEQ ID NO: 409475 - DNA, 15 bp, Homo sapiens
catttgtaatgtagt

SEQ ID NO: 409476 - DNA, 15 bp, Homo sapiens
atttgtaatgtagtt

SEQ ID NO: 409477 - DNA, 15 bp, Homo sapiens
tttgtaatgtagtta

SEQ ID NO: 409478 - DNA, 15 bp, Homo sapiens
ttgtaatgtagttaa

SEQ ID NO: 409479 - DNA, 15 bp, Homo sapiens
tgtaatgtagttaat

SEQ ID NO: 409480 - DNA, 15 bp, Homo sapiens
gtaatgtagttaatt

SEQ ID NO: 409481 - DNA, 15 bp, Homo sapiens
taatgtagttaatta

SEQ ID NO: 409482 - DNA, 15 bp, Homo sapiens
aatgtagttaattat

SEQ ID NO: 409483 - DNA, 15 bp, Homo sapiens
atgtagttaattatt

SEQ ID NO: 409484 - DNA, 15 bp, Homo sapiens
tgtagttaattattt

SEQ ID NO: 409485 - DNA, 15 bp, Homo sapiens
gtagttaattatttt

SEQ ID NO: 409486 - DNA, 15 bp, Homo sapiens
tagttaattattttc

SEQ ID NO: 409487 - DNA, 15 bp, Homo sapiens
agttaattattttca

SEQ ID NO: 409488 - DNA, 15 bp, Homo sapiens
gttaattattttcat

SEQ ID NO: 409489 - DNA, 15 bp, Homo sapiens
ttaattattttcatc

SEQ ID NO: 409490 - DNA, 15 bp, Homo sapiens
taattattttcatca

SEQ ID NO: 409491 - DNA, 15 bp, Homo sapiens
aattattttcatcat

SEQ ID NO: 409492 - DNA, 15 bp, Homo sapiens
attattttcatcatc

SEQ ID NO: 409493 - DNA, 15 bp, Homo sapiens
ttattttcatcatct

SEQ ID NO: 409494 - DNA, 15 bp, Homo sapiens
tattttcatcatctt

SEQ ID NO: 409495 - DNA, 15 bp, Homo sapiens
attttcatcatcttc

SEQ ID NO: 409496 - DNA, 15 bp, Homo sapiens
ttttcatcatcttcc

SEQ ID NO: 409497 - DNA, 15 bp, Homo sapiens
tttcatcatcttcct

SEQ ID NO: 409498 - DNA, 15 bp, Homo sapiens
ttcatcatcttcctg

SEQ ID NO: 409499 - DNA, 15 bp, Homo sapiens
tcatcatcttcctga

SEQ ID NO: 409500 - DNA, 15 bp, Homo sapiens
catcatcttcctgaa

SEQ ID NO: 409501 - DNA, 15 bp, Homo sapiens
atcatcttcctgaaa

SEQ ID NO: 409502 - DNA, 15 bp, Homo sapiens
tcatcttcctgaaaa

SEQ ID NO: 409503 - DNA, 15 bp, Homo sapiens
catcttcctgaaaaa

SEQ ID NO: 409504 - DNA, 15 bp, Homo sapiens
atcttcctgaaaaag

SEQ ID NO: 409505 - DNA, 15 bp, Homo sapiens
tcttcctgaaaaagg

SEQ ID NO: 409506 - DNA, 15 bp, Homo sapiens
cttcctgaaaaaggc

SEQ ID NO: 409507 - DNA, 15 bp, Homo sapiens
ttcctgaaaaaggca

SEQ ID NO: 409508 - DNA, 15 bp, Homo sapiens
tcctgaaaaaggcaa

SEQ ID NO: 409509 - DNA, 15 bp, Homo sapiens
cctgaaaaaggcaaa

SEQ ID NO: 409510 - DNA, 15 bp, Homo sapiens
ctgaaaaaggcaaaa

SEQ ID NO: 409511 - DNA, 15 bp, Homo sapiens
tgaaaaaggcaaaat

SEQ ID NO: 409512 - DNA, 15 bp, Homo sapiens
gaaaaaggcaaaatc

SEQ ID NO: 409513 - DNA, 15 bp, Homo sapiens
aaaaaggcaaaatcg

SEQ ID NO: 409514 - DNA, 15 bp, Homo sapiens
aaaaggcaaaatcga

SEQ ID NO: 409515 - DNA, 15 bp, Homo sapiens
aaaggcaaaatcgat

SEQ ID NO: 409516 - DNA, 15 bp, Homo sapiens
aaggcaaaatcgatg

SEQ ID NO: 409517 - DNA, 15 bp, Homo sapiens
aggcaaaatcgatgg

SEQ ID NO: 409518 - DNA, 15 bp, Homo sapiens
ggcaaaatcgatggg

SEQ ID NO: 409519 - DNA, 15 bp, Homo sapiens
gcaaaatcgatggga

SEQ ID NO: 409520 - DNA, 15 bp, Homo sapiens
caaaatcgatgggaa

SEQ ID NO: 409521 - DNA, 15 bp, Homo sapiens
aaaatcgatgggaaa

SEQ ID NO: 409522 - DNA, 15 bp, Homo sapiens
aaatcgatgggaaat

SEQ ID NO: 409523 - DNA, 15 bp, Homo sapiens
aatcgatgggaaatt

SEQ ID NO: 409524 - DNA, 15 bp, Homo sapiens
atcgatgggaaattt

SEQ ID NO: 409525 - DNA, 15 bp, Homo sapiens
tcgatgggaaatttt

SEQ ID NO: 409526 - DNA, 15 bp, Homo sapiens
cgatgggaaattttt

SEQ ID NO: 409527 - DNA, 15 bp, Homo sapiens
gatgggaaatttttc

SEQ ID NO: 409528 - DNA, 15 bp, Homo sapiens
atgggaaatttttct

SEQ ID NO: 409529 - DNA, 15 bp, Homo sapiens
tgggaaatttttctt

SEQ ID NO: 409530 - DNA, 15 bp, Homo sapiens
gggaaatttttcttc

SEQ ID NO: 409531 - DNA, 15 bp, Homo sapiens
ggaaatttttcttct

SEQ ID NO: 409532 - DNA, 15 bp, Homo sapiens
gaaatttttcttctt

SEQ ID NO: 409533 - DNA, 15 bp, Homo sapiens
aaatttttcttctta

SEQ ID NO: 409534 - DNA, 15 bp, Homo sapiens
aatttttcttcttaa

SEQ ID NO: 409535 - DNA, 15 bp, Homo sapiens
atttttcttcttaat

SEQ ID NO: 409536 - DNA, 15 bp, Homo sapiens
tttttcttcttaata

SEQ ID NO: 409537 - DNA, 15 bp, Homo sapiens
ttttcttcttaatat

SEQ ID NO: 409538 - DNA, 15 bp, Homo sapiens
tttcttcttaatatt

SEQ ID NO: 409539 - DNA, 15 bp, Homo sapiens
ttcttcttaatattg

SEQ ID NO: 409540 - DNA, 15 bp, Homo sapiens
tcttcttaatattga

SEQ ID NO: 409541 - DNA, 15 bp, Homo sapiens
cttcttaatattgaa

SEQ ID NO: 409542 - DNA, 15 bp, Homo sapiens
ttcttaatattgaat

SEQ ID NO: 409543 - DNA, 15 bp, Homo sapiens
tcttaatattgaatc

SEQ ID NO: 409544 - DNA, 15 bp, Homo sapiens
cttaatattgaatca

SEQ ID NO: 409545 - DNA, 15 bp, Homo sapiens
ttaatattgaatcac

SEQ ID NO: 409546 - DNA, 15 bp, Homo sapiens
taatattgaatcacg

SEQ ID NO: 409547 - DNA, 15 bp, Homo sapiens
aatattgaatcacgt

SEQ ID NO: 409548 - DNA, 15 bp, Homo sapiens
atattgaatcacgta

SEQ ID NO: 409549 - DNA, 15 bp, Homo sapiens
tattgaatcacgtat

SEQ ID NO: 409550 - DNA, 15 bp, Homo sapiens
attgaatcacgtatg

SEQ ID NO: 409551 - DNA, 15 bp, Homo sapiens
ttgaatcacgtatga

SEQ ID NO: 409552 - DNA, 15 bp, Homo sapiens
tgaatcacgtatgac

SEQ ID NO: 409553 - DNA, 15 bp, Homo sapiens
gaatcacgtatgact

SEQ ID NO: 409554 - DNA, 15 bp, Homo sapiens
aatcacgtatgacta

SEQ ID NO: 409555 - DNA, 15 bp, Homo sapiens
atcacgtatgactaa

SEQ ID NO: 409556 - DNA, 15 bp, Homo sapiens
tcacgtatgactaat

SEQ ID NO: 409557 - DNA, 15 bp, Homo sapiens
cacgtatgactaatt

SEQ ID NO: 409558 - DNA, 15 bp, Homo sapiens
acgtatgactaattt

SEQ ID NO: 409559 - DNA, 15 bp, Homo sapiens
cgtatgactaattta

SEQ ID NO: 409560 - DNA, 15 bp, Homo sapiens
gtatgactaatttat

SEQ ID NO: 409561 - DNA, 15 bp, Homo sapiens
tatgactaatttata

SEQ ID NO: 409562 - DNA, 15 bp, Homo sapiens
atgactaatttatat

SEQ ID NO: 409563 - DNA, 15 bp, Homo sapiens
tgactaatttatatt

SEQ ID NO: 409564 - DNA, 15 bp, Homo sapiens
gactaatttatattt

SEQ ID NO: 409565 - DNA, 15 bp, Homo sapiens
actaatttatattta

SEQ ID NO: 409566 - DNA, 15 bp, Homo sapiens
ctaatttatatttac

SEQ ID NO: 409567 - DNA, 15 bp, Homo sapiens
taatttatatttact

SEQ ID NO: 409568 - DNA, 15 bp, Homo sapiens
aatttatatttactt

SEQ ID NO: 409569 - DNA, 15 bp, Homo sapiens
atttatatttacttt

SEQ ID NO: 409570 - DNA, 15 bp, Homo sapiens
tttatatttactttt

SEQ ID NO: 409571 - DNA, 15 bp, Homo sapiens
ttatatttacttttg

SEQ ID NO: 409572 - DNA, 15 bp, Homo sapiens
tatatttacttttgc

SEQ ID NO: 409573 - DNA, 15 bp, Homo sapiens
atatttacttttgca

SEQ ID NO: 409574 - DNA, 15 bp, Homo sapiens
tatttacttttgcaa

SEQ ID NO: 409575 - DNA, 15 bp, Homo sapiens
atttacttttgcaaa

SEQ ID NO: 409576 - DNA, 15 bp, Homo sapiens
tttacttttgcaaag

SEQ ID NO: 409577 - DNA, 15 bp, Homo sapiens
ttacttttgcaaagc

SEQ ID NO: 409578 - DNA, 15 bp, Homo sapiens
tacttttgcaaagca

SEQ ID NO: 409579 - DNA, 15 bp, Homo sapiens
acttttgcaaagcag

SEQ ID NO: 409580 - DNA, 15 bp, Homo sapiens
cttttgcaaagcagg

SEQ ID NO: 409581 - DNA, 15 bp, Homo sapiens
ttttgcaaagcaggg

SEQ ID NO: 409582 - DNA, 15 bp, Homo sapiens
tttgcaaagcaggga

SEQ ID NO: 409583 - DNA, 15 bp, Homo sapiens
ttgcaaagcagggaa

SEQ ID NO: 409584 - DNA, 15 bp, Homo sapiens
tgcaaagcagggaaa

SEQ ID NO: 409585 - DNA, 15 bp, Homo sapiens
gcaaagcagggaaat

SEQ ID NO: 409586 - DNA, 15 bp, Homo sapiens
caaagcagggaaata

SEQ ID NO: 409587 - DNA, 15 bp, Homo sapiens
aaagcagggaaatat

SEQ ID NO: 409588 - DNA, 15 bp, Homo sapiens
aagcagggaaatata

SEQ ID NO: 409589 - DNA, 15 bp, Homo sapiens
agcagggaaatatat

SEQ ID NO: 409590 - DNA, 15 bp, Homo sapiens
gcagggaaatatatg

SEQ ID NO: 409591 - DNA, 15 bp, Homo sapiens
cagggaaatatatga

SEQ ID NO: 409592 - DNA, 15 bp, Homo sapiens
agggaaatatatgaa

SEQ ID NO: 409593 - DNA, 15 bp, Homo sapiens
gggaaatatatgaat

SEQ ID NO: 409594 - DNA, 15 bp, Homo sapiens
ggaaatatatgaata

SEQ ID NO: 409595 - DNA, 15 bp, Homo sapiens
gaaatatatgaataa

SEQ ID NO: 409596 - DNA, 15 bp, Homo sapiens
aaatatatgaataag

SEQ ID NO: 409597 - DNA, 15 bp, Homo sapiens
aatatatgaataaga

SEQ ID NO: 409598 - DNA, 15 bp, Homo sapiens
atatatgaataagag

SEQ ID NO: 409599 - DNA, 15 bp, Homo sapiens
tatatgaataagagg

SEQ ID NO: 409600 - DNA, 15 bp, Homo sapiens
atatgaataagaggc

SEQ ID NO: 409601 - DNA, 15 bp, Homo sapiens
tatgaataagaggca

SEQ ID NO: 409602 - DNA, 15 bp, Homo sapiens
atgaataagaggcat

SEQ ID NO: 409603 - DNA, 15 bp, Homo sapiens
tgaataagaggcatg

SEQ ID NO: 409604 - DNA, 15 bp, Homo sapiens
gaataagaggcatga

SEQ ID NO: 409605 - DNA, 15 bp, Homo sapiens
aataagaggcatgaa

SEQ ID NO: 409606 - DNA, 15 bp, Homo sapiens
ataagaggcatgaat

SEQ ID NO: 409607 - DNA, 15 bp, Homo sapiens
taagaggcatgaatc

SEQ ID NO: 409608 - DNA, 15 bp, Homo sapiens
aagaggcatgaatcc

SEQ ID NO: 409609 - DNA, 15 bp, Homo sapiens
agaggcatgaatcca

SEQ ID NO: 409610 - DNA, 15 bp, Homo sapiens
gaggcatgaatccac

SEQ ID NO: 409611 - DNA, 15 bp, Homo sapiens
aggcatgaatccaca

SEQ ID NO: 409612 - DNA, 15 bp, Homo sapiens
ggcatgaatccacaa

SEQ ID NO: 409613 - DNA, 15 bp, Homo sapiens
gcatgaatccacaat

SEQ ID NO: 409614 - DNA, 15 bp, Homo sapiens
catgaatccacaatt

SEQ ID NO: 409615 - DNA, 15 bp, Homo sapiens
atgaatccacaattg

SEQ ID NO: 409616 - DNA, 15 bp, Homo sapiens
tgaatccacaattgc

SEQ ID NO: 409617 - DNA, 15 bp, Homo sapiens
gaatccacaattgct

SEQ ID NO: 409618 - DNA, 15 bp, Homo sapiens
aatccacaattgctg

SEQ ID NO: 409619 - DNA, 15 bp, Homo sapiens
atccacaattgctga

SEQ ID NO: 409620 - DNA, 15 bp, Homo sapiens
tccacaattgctgaa

SEQ ID NO: 409621 - DNA, 15 bp, Homo sapiens
ccacaattgctgaag

SEQ ID NO: 409622 - DNA, 15 bp, Homo sapiens
cacaattgctgaagc

SEQ ID NO: 409623 - DNA, 15 bp, Homo sapiens
acaattgctgaagca

SEQ ID NO: 409624 - DNA, 15 bp, Homo sapiens
caattgctgaagcaa

SEQ ID NO: 409625 - DNA, 15 bp, Homo sapiens
aattgctgaagcaaa

SEQ ID NO: 409626 - DNA, 15 bp, Homo sapiens
attgctgaagcaaat

SEQ ID NO: 409627 - DNA, 15 bp, Homo sapiens
ttgctgaagcaaatc

SEQ ID NO: 409628 - DNA, 15 bp, Homo sapiens
tgctgaagcaaatca

SEQ ID NO: 409629 - DNA, 15 bp, Homo sapiens
gctgaagcaaatcaa

SEQ ID NO: 409630 - DNA, 15 bp, Homo sapiens
ctgaagcaaatcaat

SEQ ID NO: 409631 - DNA, 15 bp, Homo sapiens
tgaagcaaatcaata

SEQ ID NO: 409632 - DNA, 15 bp, Homo sapiens
gaagcaaatcaatac

SEQ ID NO: 409633 - DNA, 15 bp, Homo sapiens
aagcaaatcaataca

SEQ ID NO: 409634 - DNA, 15 bp, Homo sapiens
agcaaatcaatacat

SEQ ID NO: 409635 - DNA, 15 bp, Homo sapiens
gcaaatcaatacatg

SEQ ID NO: 409636 - DNA, 15 bp, Homo sapiens
caaatcaatacatgt

SEQ ID NO: 409637 - DNA, 15 bp, Homo sapiens
aaatcaatacatgtg

SEQ ID NO: 409638 - DNA, 15 bp, Homo sapiens
aatcaatacatgtga

SEQ ID NO: 409639 - DNA, 15 bp, Homo sapiens
atcaatacatgtgaa

SEQ ID NO: 409640 - DNA, 15 bp, Homo sapiens
tcaatacatgtgaag

SEQ ID NO: 409641 - DNA, 15 bp, Homo sapiens
caatacatgtgaagg

SEQ ID NO: 409642 - DNA, 15 bp, Homo sapiens
aatacatgtgaagga

SEQ ID NO: 409643 - DNA, 15 bp, Homo sapiens
atacatgtgaaggaa

SEQ ID NO: 409644 - DNA, 15 bp, Homo sapiens
tacatgtgaaggaaa

SEQ ID NO: 409645 - DNA, 15 bp, Homo sapiens
acatgtgaaggaaaa

SEQ ID NO: 409646 - DNA, 15 bp, Homo sapiens
catgtgaaggaaaag

SEQ ID NO: 409647 - DNA, 15 bp, Homo sapiens
atgtgaaggaaaagc

SEQ ID NO: 409648 - DNA, 15 bp, Homo sapiens
tgtgaaggaaaagca

SEQ ID NO: 409649 - DNA, 15 bp, Homo sapiens
gtgaaggaaaagcaa

SEQ ID NO: 409650 - DNA, 15 bp, Homo sapiens
tgaaggaaaagcaaa

SEQ ID NO: 409651 - DNA, 15 bp, Homo sapiens
gaaggaaaagcaaaa

SEQ ID NO: 409652 - DNA, 15 bp, Homo sapiens
aaggaaaagcaaaac

SEQ ID NO: 409653 - DNA, 15 bp, Homo sapiens
aggaaaagcaaaacc

SEQ ID NO: 409654 - DNA, 15 bp, Homo sapiens
ggaaaagcaaaaccc

SEQ ID NO: 409655 - DNA, 15 bp, Homo sapiens
gaaaagcaaaaccct

SEQ ID NO: 409656 - DNA, 15 bp, Homo sapiens
aaaagcaaaacccta

SEQ ID NO: 409657 - DNA, 15 bp, Homo sapiens
aaagcaaaaccctat

SEQ ID NO: 409658 - DNA, 15 bp, Homo sapiens
aagcaaaaccctatg

SEQ ID NO: 409659 - DNA, 15 bp, Homo sapiens
agcaaaaccctatgt

SEQ ID NO: 409660 - DNA, 15 bp, Homo sapiens
gcaaaaccctatgta

SEQ ID NO: 409661 - DNA, 15 bp, Homo sapiens
caaaaccctatgtag

SEQ ID NO: 409662 - DNA, 15 bp, Homo sapiens
aaaaccctatgtagg

SEQ ID NO: 409663 - DNA, 15 bp, Homo sapiens
aaaccctatgtaggc

SEQ ID NO: 409664 - DNA, 15 bp, Homo sapiens
aaccctatgtaggcc

SEQ ID NO: 409665 - DNA, 15 bp, Homo sapiens
accctatgtaggcct

SEQ ID NO: 409666 - DNA, 15 bp, Homo sapiens
ccctatgtaggccta

SEQ ID NO: 409667 - DNA, 15 bp, Homo sapiens
cctatgtaggcctat

SEQ ID NO: 409668 - DNA, 15 bp, Homo sapiens
ctatgtaggcctatg

SEQ ID NO: 409669 - DNA, 15 bp, Homo sapiens
tatgtaggcctatgt

SEQ ID NO: 409670 - DNA, 15 bp, Homo sapiens
atgtaggcctatgta

SEQ ID NO: 409671 - DNA, 15 bp, Homo sapiens
tgtaggcctatgtag

SEQ ID NO: 409672 - DNA, 15 bp, Homo sapiens
gtaggcctatgtaga

SEQ ID NO: 409673 - DNA, 15 bp, Homo sapiens
taggcctatgtagaa

SEQ ID NO: 409674 - DNA, 15 bp, Homo sapiens
aggcctatgtagaaa

SEQ ID NO: 409675 - DNA, 15 bp, Homo sapiens
ggcctatgtagaaac

SEQ ID NO: 409676 - DNA, 15 bp, Homo sapiens
gcctatgtagaaacc

SEQ ID NO: 409677 - DNA, 15 bp, Homo sapiens
cctatgtagaaacct

SEQ ID NO: 409678 - DNA, 15 bp, Homo sapiens
ctatgtagaaacctt

SEQ ID NO: 409679 - DNA, 15 bp, Homo sapiens
tatgtagaaacctta

SEQ ID NO: 409680 - DNA, 15 bp, Homo sapiens
atgtagaaaccttat

SEQ ID NO: 409681 - DNA, 15 bp, Homo sapiens
tgtagaaaccttatg

SEQ ID NO: 409682 - DNA, 15 bp, Homo sapiens
gtagaaaccttatgc

SEQ ID NO: 409683 - DNA, 15 bp, Homo sapiens
tagaaaccttatgca

SEQ ID NO: 409684 - DNA, 15 bp, Homo sapiens
agaaaccttatgcac

SEQ ID NO: 409685 - DNA, 15 bp, Homo sapiens
gaaaccttatgcaca

SEQ ID NO: 409686 - DNA, 15 bp, Homo sapiens
aaaccttatgcacag

SEQ ID NO: 409687 - DNA, 15 bp, Homo sapiens
aaccttatgcacaga

SEQ ID NO: 409688 - DNA, 15 bp, Homo sapiens
accttatgcacagaa

SEQ ID NO: 409689 - DNA, 15 bp, Homo sapiens
ccttatgcacagaac

SEQ ID NO: 409690 - DNA, 15 bp, Homo sapiens
cttatgcacagaact

SEQ ID NO: 409691 - DNA, 15 bp, Homo sapiens
ttatgcacagaacta

SEQ ID NO: 409692 - DNA, 15 bp, Homo sapiens
tatgcacagaactaa

SEQ ID NO: 409693 - DNA, 15 bp, Homo sapiens
atgcacagaactaaa

SEQ ID NO: 409694 - DNA, 15 bp, Homo sapiens
tgcacagaactaaat

SEQ ID NO: 409695 - DNA, 15 bp, Homo sapiens
gcacagaactaaatg

SEQ ID NO: 409696 - DNA, 15 bp, Homo sapiens
cacagaactaaatgc

SEQ ID NO: 409697 - DNA, 15 bp, Homo sapiens
acagaactaaatgct

SEQ ID NO: 409698 - DNA, 15 bp, Homo sapiens
cagaactaaatgctt

SEQ ID NO: 409699 - DNA, 15 bp, Homo sapiens
agaactaaatgcttg

SEQ ID NO: 409700 - DNA, 15 bp, Homo sapiens
gaactaaatgcttgt

SEQ ID NO: 409701 - DNA, 15 bp, Homo sapiens
aactaaatgcttgtt

SEQ ID NO: 409702 - DNA, 15 bp, Homo sapiens
actaaatgcttgtta

SEQ ID NO: 409703 - DNA, 15 bp, Homo sapiens
ctaaatgcttgttaa

SEQ ID NO: 409704 - DNA, 15 bp, Homo sapiens
taaatgcttgttaag

SEQ ID NO: 409705 - DNA, 15 bp, Homo sapiens
aaatgcttgttaagt

SEQ ID NO: 409706 - DNA, 15 bp, Homo sapiens
aatgcttgttaagta

SEQ ID NO: 409707 - DNA, 15 bp, Homo sapiens
atgcttgttaagtaa

SEQ ID NO: 409708 - DNA, 15 bp, Homo sapiens
tgcttgttaagtaaa

SEQ ID NO: 409709 - DNA, 15 bp, Homo sapiens
gcttgttaagtaaaa

SEQ ID NO: 409710 - DNA, 15 bp, Homo sapiens
cttgttaagtaaaaa

SEQ ID NO: 409711 - DNA, 15 bp, Homo sapiens
ttgttaagtaaaaat

SEQ ID NO: 409712 - DNA, 15 bp, Homo sapiens
tgttaagtaaaaatt

SEQ ID NO: 409713 - DNA, 15 bp, Homo sapiens
gttaagtaaaaattc

SEQ ID NO: 409714 - DNA, 15 bp, Homo sapiens
ttaagtaaaaattcc

SEQ ID NO: 409715 - DNA, 15 bp, Homo sapiens
taagtaaaaattcct

SEQ ID NO: 409716 - DNA, 15 bp, Homo sapiens
aagtaaaaattccta

SEQ ID NO: 409717 - DNA, 15 bp, Homo sapiens
agtaaaaattcctaa

SEQ ID NO: 409718 - DNA, 15 bp, Homo sapiens
gtaaaaattcctaat

SEQ ID NO: 409719 - DNA, 15 bp, Homo sapiens
taaaaattcctaatc

SEQ ID NO: 409720 - DNA, 15 bp, Homo sapiens
aaaaattcctaatcc

SEQ ID NO: 409721 - DNA, 15 bp, Homo sapiens
aaaattcctaatcct

SEQ ID NO: 409722 - DNA, 15 bp, Homo sapiens
aaattcctaatcctt

SEQ ID NO: 409723 - DNA, 15 bp, Homo sapiens
aattcctaatcctta

SEQ ID NO: 409724 - DNA, 15 bp, Homo sapiens
attcctaatccttat

SEQ ID NO: 409725 - DNA, 15 bp, Homo sapiens
ttcctaatccttatc

SEQ ID NO: 409726 - DNA, 15 bp, Homo sapiens
tcctaatccttatcc

SEQ ID NO: 409727 - DNA, 15 bp, Homo sapiens
cctaatccttatcct

SEQ ID NO: 409728 - DNA, 15 bp, Homo sapiens
ctaatccttatcctc

SEQ ID NO: 409729 - DNA, 15 bp, Homo sapiens
taatccttatcctct

SEQ ID NO: 409730 - DNA, 15 bp, Homo sapiens
aatccttatcctctt

SEQ ID NO: 409731 - DNA, 15 bp, Homo sapiens
atccttatcctctta

SEQ ID NO: 409732 - DNA, 15 bp, Homo sapiens
tccttatcctcttat

SEQ ID NO: 409733 - DNA, 15 bp, Homo sapiens
ccttatcctcttatg

SEQ ID NO: 409734 - DNA, 15 bp, Homo sapiens
cttatcctcttatgc

SEQ ID NO: 409735 - DNA, 15 bp, Homo sapiens
ttatcctcttatgcc

SEQ ID NO: 409736 - DNA, 15 bp, Homo sapiens
tatcctcttatgcca

SEQ ID NO: 409737 - DNA, 15 bp, Homo sapiens
atcctcttatgccat

SEQ ID NO: 409738 - DNA, 15 bp, Homo sapiens
tcctcttatgccatt

SEQ ID NO: 409739 - DNA, 15 bp, Homo sapiens
cctcttatgccattt

SEQ ID NO: 409740 - DNA, 15 bp, Homo sapiens
ctcttatgccatttt

SEQ ID NO: 409741 - DNA, 15 bp, Homo sapiens
tcttatgccatttta

SEQ ID NO: 409742 - DNA, 15 bp, Homo sapiens
cttatgccattttaa

SEQ ID NO: 409743 - DNA, 15 bp, Homo sapiens
ttatgccattttaaa

SEQ ID NO: 409744 - DNA, 15 bp, Homo sapiens
tatgccattttaaat

SEQ ID NO: 409745 - DNA, 15 bp, Homo sapiens
atgccattttaaatt

SEQ ID NO: 409746 - DNA, 15 bp, Homo sapiens
tgccattttaaatta

SEQ ID NO: 409747 - DNA, 15 bp, Homo sapiens
gccattttaaattaa

SEQ ID NO: 409748 - DNA, 15 bp, Homo sapiens
ccattttaaattaac

SEQ ID NO: 409749 - DNA, 15 bp, Homo sapiens
cattttaaattaact

SEQ ID NO: 409750 - DNA, 15 bp, Homo sapiens
attttaaattaactc

SEQ ID NO: 409751 - DNA, 15 bp, Homo sapiens
ttttaaattaactct

SEQ ID NO: 409752 - DNA, 15 bp, Homo sapiens
tttaaattaactcta

SEQ ID NO: 409753 - DNA, 15 bp, Homo sapiens
ttaaattaactctaa

SEQ ID NO: 409754 - DNA, 15 bp, Homo sapiens
taaattaactctaaa

SEQ ID NO: 409755 - DNA, 15 bp, Homo sapiens
aaattaactctaaaa

SEQ ID NO: 409756 - DNA, 15 bp, Homo sapiens
aattaactctaaaat

SEQ ID NO: 409757 - DNA, 15 bp, Homo sapiens
attaactctaaaatt

SEQ ID NO: 409758 - DNA, 15 bp, Homo sapiens
ttaactctaaaatta

SEQ ID NO: 409759 - DNA, 15 bp, Homo sapiens
taactctaaaattag

SEQ ID NO: 409760 - DNA, 15 bp, Homo sapiens
aactctaaaattagt

SEQ ID NO: 409761 - DNA, 15 bp, Homo sapiens
actctaaaattagta

SEQ ID NO: 409762 - DNA, 15 bp, Homo sapiens
ctctaaaattagtat

SEQ ID NO: 409763 - DNA, 15 bp, Homo sapiens
tctaaaattagtatt

SEQ ID NO: 409764 - DNA, 15 bp, Homo sapiens
ctaaaattagtattg

SEQ ID NO: 409765 - DNA, 15 bp, Homo sapiens
taaaattagtattgg

SEQ ID NO: 409766 - DNA, 15 bp, Homo sapiens
aaaattagtattgga

SEQ ID NO: 409767 - DNA, 15 bp, Homo sapiens
aaattagtattggaa

SEQ ID NO: 409768 - DNA, 15 bp, Homo sapiens
aattagtattggaaa

SEQ ID NO: 409769 - DNA, 15 bp, Homo sapiens
attagtattggaaaa

SEQ ID NO: 409770 - DNA, 15 bp, Homo sapiens
ttagtattggaaaaa

SEQ ID NO: 409771 - DNA, 15 bp, Homo sapiens
tagtattggaaaaat

SEQ ID NO: 409772 - DNA, 15 bp, Homo sapiens
agtattggaaaaatc

SEQ ID NO: 409773 - DNA, 15 bp, Homo sapiens
gtattggaaaaatct

SEQ ID NO: 409774 - DNA, 15 bp, Homo sapiens
tattggaaaaatctc

SEQ ID NO: 409775 - DNA, 15 bp, Homo sapiens
attggaaaaatctcc

SEQ ID NO: 409776 - DNA, 15 bp, Homo sapiens
ttggaaaaatctccc

SEQ ID NO: 409777 - DNA, 15 bp, Homo sapiens
tggaaaaatctccct

SEQ ID NO: 409778 - DNA, 15 bp, Homo sapiens
ggaaaaatctccctg

SEQ ID NO: 409779 - DNA, 15 bp, Homo sapiens
gaaaaatctccctga

SEQ ID NO: 409780 - DNA, 15 bp, Homo sapiens
aaaaatctccctgat

SEQ ID NO: 409781 - DNA, 15 bp, Homo sapiens
aaaatctccctgatt

SEQ ID NO: 409782 - DNA, 15 bp, Homo sapiens
aaatctccctgattt

SEQ ID NO: 409783 - DNA, 15 bp, Homo sapiens
aatctccctgatttg

SEQ ID NO: 409784 - DNA, 15 bp, Homo sapiens
atctccctgatttgt

SEQ ID NO: 409785 - DNA, 15 bp, Homo sapiens
tctccctgatttgtt

SEQ ID NO: 409786 - DNA, 15 bp, Homo sapiens
ctccctgatttgttc

SEQ ID NO: 409787 - DNA, 15 bp, Homo sapiens
tccctgatttgttca

SEQ ID NO: 409788 - DNA, 15 bp, Homo sapiens
ccctgatttgttcaa

SEQ ID NO: 409789 - DNA, 15 bp, Homo sapiens
cctgatttgttcaaa

SEQ ID NO: 409790 - DNA, 15 bp, Homo sapiens
ctgatttgttcaaat

SEQ ID NO: 409791 - DNA, 15 bp, Homo sapiens
tgatttgttcaaatg

SEQ ID NO: 409792 - DNA, 15 bp, Homo sapiens
gatttgttcaaatgg

SEQ ID NO: 409793 - DNA, 15 bp, Homo sapiens
atttgttcaaatggc

SEQ ID NO: 409794 - DNA, 15 bp, Homo sapiens
tttgttcaaatggct

SEQ ID NO: 409795 - DNA, 15 bp, Homo sapiens
ttgttcaaatggctg

SEQ ID NO: 409796 - DNA, 15 bp, Homo sapiens
tgttcaaatggctga

SEQ ID NO: 409797 - DNA, 15 bp, Homo sapiens
gttcaaatggctgat

SEQ ID NO: 409798 - DNA, 15 bp, Homo sapiens
ttcaaatggctgatg

SEQ ID NO: 409799 - DNA, 15 bp, Homo sapiens
tcaaatggctgatgc

SEQ ID NO: 409800 - DNA, 15 bp, Homo sapiens
caaatggctgatgct

SEQ ID NO: 409801 - DNA, 15 bp, Homo sapiens
aaatggctgatgctt

SEQ ID NO: 409802 - DNA, 15 bp, Homo sapiens
aatggctgatgctta

SEQ ID NO: 409803 - DNA, 15 bp, Homo sapiens
atggctgatgcttac

SEQ ID NO: 409804 - DNA, 15 bp, Homo sapiens
tggctgatgcttaca

SEQ ID NO: 409805 - DNA, 15 bp, Homo sapiens
ggctgatgcttacat

SEQ ID NO: 409806 - DNA, 15 bp, Homo sapiens
gctgatgcttacatg

SEQ ID NO: 409807 - DNA, 15 bp, Homo sapiens
ctgatgcttacatgt

SEQ ID NO: 409808 - DNA, 15 bp, Homo sapiens
tgatgcttacatgtc

SEQ ID NO: 409809 - DNA, 15 bp, Homo sapiens
gatgcttacatgtca

SEQ ID NO: 409810 - DNA, 15 bp, Homo sapiens
atgcttacatgtcat

SEQ ID NO: 409811 - DNA, 15 bp, Homo sapiens
tgcttacatgtcatt

SEQ ID NO: 409812 - DNA, 15 bp, Homo sapiens
gcttacatgtcattt

SEQ ID NO: 409813 - DNA, 15 bp, Homo sapiens
cttacatgtcatttt

SEQ ID NO: 409814 - DNA, 15 bp, Homo sapiens
ttacatgtcattttg

SEQ ID NO: 409815 - DNA, 15 bp, Homo sapiens
tacatgtcattttgg

SEQ ID NO: 409816 - DNA, 15 bp, Homo sapiens
acatgtcattttgga

SEQ ID NO: 409817 - DNA, 15 bp, Homo sapiens
catgtcattttggat

SEQ ID NO: 409818 - DNA, 15 bp, Homo sapiens
atgtcattttggatc

SEQ ID NO: 409819 - DNA, 15 bp, Homo sapiens
tgtcattttggatcc

SEQ ID NO: 409820 - DNA, 15 bp, Homo sapiens
gtcattttggatcca

SEQ ID NO: 409821 - DNA, 15 bp, Homo sapiens
tcattttggatccag

SEQ ID NO: 409822 - DNA, 15 bp, Homo sapiens
cattttggatccaga

SEQ ID NO: 409823 - DNA, 15 bp, Homo sapiens
attttggatccagag

SEQ ID NO: 409824 - DNA, 15 bp, Homo sapiens
ttttggatccagaga

SEQ ID NO: 409825 - DNA, 15 bp, Homo sapiens
tttggatccagagat

SEQ ID NO: 409826 - DNA, 15 bp, Homo sapiens
ttggatccagagatg

SEQ ID NO: 409827 - DNA, 15 bp, Homo sapiens
tggatccagagatgc

SEQ ID NO: 409828 - DNA, 15 bp, Homo sapiens
ggatccagagatgca

SEQ ID NO: 409829 - DNA, 15 bp, Homo sapiens
gatccagagatgcaa

SEQ ID NO: 409830 - DNA, 15 bp, Homo sapiens
atccagagatgcaaa

SEQ ID NO: 409831 - DNA, 15 bp, Homo sapiens
tccagagatgcaaaa

SEQ ID NO: 409832 - DNA, 15 bp, Homo sapiens
ccagagatgcaaaat

SEQ ID NO: 409833 - DNA, 15 bp, Homo sapiens
cagagatgcaaaata

SEQ ID NO: 409834 - DNA, 15 bp, Homo sapiens
agagatgcaaaatat

SEQ ID NO: 409835 - DNA, 15 bp, Homo sapiens
gagatgcaaaatata

SEQ ID NO: 409836 - DNA, 15 bp, Homo sapiens
agatgcaaaatataa

SEQ ID NO: 409837 - DNA, 15 bp, Homo sapiens
gatgcaaaatataag

SEQ ID NO: 409838 - DNA, 15 bp, Homo sapiens
atgcaaaatataaga

SEQ ID NO: 409839 - DNA, 15 bp, Homo sapiens
tgcaaaatataagag

SEQ ID NO: 409840 - DNA, 15 bp, Homo sapiens
gcaaaatataagagc

SEQ ID NO: 409841 - DNA, 15 bp, Homo sapiens
caaaatataagagct

SEQ ID NO: 409842 - DNA, 15 bp, Homo sapiens
aaaatataagagctt

SEQ ID NO: 409843 - DNA, 15 bp, Homo sapiens
aaatataagagcttc

SEQ ID NO: 409844 - DNA, 15 bp, Homo sapiens
aatataagagcttca

SEQ ID NO: 409845 - DNA, 15 bp, Homo sapiens
atataagagcttcat

SEQ ID NO: 409846 - DNA, 15 bp, Homo sapiens
tataagagcttcata

SEQ ID NO: 409847 - DNA, 15 bp, Homo sapiens
ataagagcttcatac

SEQ ID NO: 409848 - DNA, 15 bp, Homo sapiens
taagagcttcataca

SEQ ID NO: 409849 - DNA, 15 bp, Homo sapiens
aagagcttcatacat

SEQ ID NO: 409850 - DNA, 15 bp, Homo sapiens
agagcttcatacata

SEQ ID NO: 409851 - DNA, 15 bp, Homo sapiens
gagcttcatacatag

SEQ ID NO: 409852 - DNA, 15 bp, Homo sapiens
agcttcatacatagg

SEQ ID NO: 409853 - DNA, 15 bp, Homo sapiens
gcttcatacataggt

SEQ ID NO: 409854 - DNA, 15 bp, Homo sapiens
cttcatacataggtt

SEQ ID NO: 409855 - DNA, 15 bp, Homo sapiens
ttcatacataggttc

SEQ ID NO: 409856 - DNA, 15 bp, Homo sapiens
tcatacataggttca

SEQ ID NO: 409857 - DNA, 15 bp, Homo sapiens
catacataggttcaa

SEQ ID NO: 409858 - DNA, 15 bp, Homo sapiens
atacataggttcaat

SEQ ID NO: 409859 - DNA, 15 bp, Homo sapiens
tacataggttcaata

SEQ ID NO: 409860 - DNA, 15 bp, Homo sapiens
acataggttcaatac

SEQ ID NO: 409861 - DNA, 15 bp, Homo sapiens
cataggttcaatact

SEQ ID NO: 409862 - DNA, 15 bp, Homo sapiens
ataggttcaatactt

SEQ ID NO: 409863 - DNA, 15 bp, Homo sapiens
taggttcaatacttt

SEQ ID NO: 409864 - DNA, 15 bp, Homo sapiens
aggttcaatactttt

SEQ ID NO: 409865 - DNA, 15 bp, Homo sapiens
ggttcaatacttttc

SEQ ID NO: 409866 - DNA, 15 bp, Homo sapiens
gttcaatacttttct

SEQ ID NO: 409867 - DNA, 15 bp, Homo sapiens
ttcaatacttttcta

SEQ ID NO: 409868 - DNA, 15 bp, Homo sapiens
tcaatacttttctaa

SEQ ID NO: 409869 - DNA, 15 bp, Homo sapiens
caatacttttctaaa

SEQ ID NO: 409870 - DNA, 15 bp, Homo sapiens
aatacttttctaaac

SEQ ID NO: 409871 - DNA, 15 bp, Homo sapiens
atacttttctaaact

SEQ ID NO: 409872 - DNA, 15 bp, Homo sapiens
tacttttctaaactg

SEQ ID NO: 409873 - DNA, 15 bp, Homo sapiens
acttttctaaactga

SEQ ID NO: 409874 - DNA, 15 bp, Homo sapiens
cttttctaaactgaa

SEQ ID NO: 409875 - DNA, 15 bp, Homo sapiens
ttttctaaactgaat

SEQ ID NO: 409876 - DNA, 15 bp, Homo sapiens
tttctaaactgaatt

SEQ ID NO: 409877 - DNA, 15 bp, Homo sapiens
ttctaaactgaattg

SEQ ID NO: 409878 - DNA, 15 bp, Homo sapiens
tctaaactgaattgg

SEQ ID NO: 409879 - DNA, 15 bp, Homo sapiens
ctaaactgaattggg

SEQ ID NO: 409880 - DNA, 15 bp, Homo sapiens
taaactgaattgggt

SEQ ID NO: 409881 - DNA, 15 bp, Homo sapiens
aaactgaattgggtt

SEQ ID NO: 409882 - DNA, 15 bp, Homo sapiens
aactgaattgggttt

SEQ ID NO: 409883 - DNA, 15 bp, Homo sapiens
actgaattgggtttt

SEQ ID NO: 409884 - DNA, 15 bp, Homo sapiens
ctgaattgggttttt

SEQ ID NO: 409885 - DNA, 15 bp, Homo sapiens
tgaattgggtttttg

SEQ ID NO: 409886 - DNA, 15 bp, Homo sapiens
gaattgggtttttga

SEQ ID NO: 409887 - DNA, 15 bp, Homo sapiens
aattgggtttttgaa

SEQ ID NO: 409888 - DNA, 15 bp, Homo sapiens
attgggtttttgaat

SEQ ID NO: 409889 - DNA, 15 bp, Homo sapiens
ttgggtttttgaata

SEQ ID NO: 409890 - DNA, 15 bp, Homo sapiens
tgggtttttgaataa

SEQ ID NO: 409891 - DNA, 15 bp, Homo sapiens
gggtttttgaataaa

SEQ ID NO: 409892 - DNA, 15 bp, Homo sapiens
ggtttttgaataaaa

SEQ ID NO: 409893 - DNA, 15 bp, Homo sapiens
gtttttgaataaaat

SEQ ID NO: 409894 - DNA, 15 bp, Homo sapiens
tttttgaataaaata

SEQ ID NO: 409895 - DNA, 15 bp, Homo sapiens
ttttgaataaaatac

SEQ ID NO: 409896 - DNA, 15 bp, Homo sapiens
tttgaataaaatacc

SEQ ID NO: 409897 - DNA, 15 bp, Homo sapiens
ttgaataaaatacca

SEQ ID NO: 409898 - DNA, 15 bp, Homo sapiens
tgaataaaataccag

SEQ ID NO: 409899 - DNA, 15 bp, Homo sapiens
gaataaaataccagg

SEQ ID NO: 409900 - DNA, 15 bp, Homo sapiens
aataaaataccaggg

SEQ ID NO: 409901 - DNA, 15 bp, Homo sapiens
ataaaataccagggt

SEQ ID NO: 409902 - DNA, 15 bp, Homo sapiens
taaaataccagggta

SEQ ID NO: 409903 - DNA, 15 bp, Homo sapiens
aaaataccagggtat

SEQ ID NO: 409904 - DNA, 15 bp, Homo sapiens
aaataccagggtatt

SEQ ID NO: 409905 - DNA, 15 bp, Homo sapiens
aataccagggtattc

SEQ ID NO: 409906 - DNA, 15 bp, Homo sapiens
ataccagggtattcc

SEQ ID NO: 409907 - DNA, 15 bp, Homo sapiens
taccagggtattcca

SEQ ID NO: 409908 - DNA, 15 bp, Homo sapiens
accagggtattccaa

SEQ ID NO: 409909 - DNA, 15 bp, Homo sapiens
ccagggtattccaaa

SEQ ID NO: 409910 - DNA, 15 bp, Homo sapiens
cagggtattccaaat

SEQ ID NO: 409911 - DNA, 15 bp, Homo sapiens
agggtattccaaatg

SEQ ID NO: 409912 - DNA, 15 bp, Homo sapiens
gggtattccaaatga

SEQ ID NO: 409913 - DNA, 15 bp, Homo sapiens
ggtattccaaatgaa

SEQ ID NO: 409914 - DNA, 15 bp, Homo sapiens
gtattccaaatgaat

SEQ ID NO: 409915 - DNA, 15 bp, Homo sapiens
tattccaaatgaatg

SEQ ID NO: 409916 - DNA, 15 bp, Homo sapiens
attccaaatgaatga

SEQ ID NO: 409917 - DNA, 15 bp, Homo sapiens
ttccaaatgaatgat

SEQ ID NO: 409918 - DNA, 15 bp, Homo sapiens
tccaaatgaatgatt

SEQ ID NO: 409919 - DNA, 15 bp, Homo sapiens
ccaaatgaatgattt

SEQ ID NO: 409920 - DNA, 15 bp, Homo sapiens
caaatgaatgatttt

SEQ ID NO: 409921 - DNA, 15 bp, Homo sapiens
aaatgaatgattttt

SEQ ID NO: 409922 - DNA, 15 bp, Homo sapiens
aatgaatgattttta

SEQ ID NO: 409923 - DNA, 15 bp, Homo sapiens
atgaatgatttttat

SEQ ID NO: 409924 - DNA, 15 bp, Homo sapiens
tgaatgatttttatc

SEQ ID NO: 409925 - DNA, 15 bp, Homo sapiens
gaatgatttttatct

SEQ ID NO: 409926 - DNA, 15 bp, Homo sapiens
aatgatttttatctg

SEQ ID NO: 409927 - DNA, 15 bp, Homo sapiens
atgatttttatctga

SEQ ID NO: 409928 - DNA, 15 bp, Homo sapiens
tgatttttatctgac

SEQ ID NO: 409929 - DNA, 15 bp, Homo sapiens
gatttttatctgact

SEQ ID NO: 409930 - DNA, 15 bp, Homo sapiens
atttttatctgactc

SEQ ID NO: 409931 - DNA, 15 bp, Homo sapiens
tttttatctgactca

SEQ ID NO: 409932 - DNA, 15 bp, Homo sapiens
ttttatctgactcat

SEQ ID NO: 409933 - DNA, 15 bp, Homo sapiens
tttatctgactcatt

SEQ ID NO: 409934 - DNA, 15 bp, Homo sapiens
ttatctgactcatta

SEQ ID NO: 409935 - DNA, 15 bp, Homo sapiens
tatctgactcattaa

SEQ ID NO: 409936 - DNA, 15 bp, Homo sapiens
atctgactcattaag

SEQ ID NO: 409937 - DNA, 15 bp, Homo sapiens
tctgactcattaaga

SEQ ID NO: 409938 - DNA, 15 bp, Homo sapiens
ctgactcattaagaa

SEQ ID NO: 409939 - DNA, 15 bp, Homo sapiens
tgactcattaagaag

SEQ ID NO: 409940 - DNA, 15 bp, Homo sapiens
gactcattaagaagt

SEQ ID NO: 409941 - DNA, 15 bp, Homo sapiens
actcattaagaagtg

SEQ ID NO: 409942 - DNA, 15 bp, Homo sapiens
ctcattaagaagtga

SEQ ID NO: 409943 - DNA, 15 bp, Homo sapiens
tcattaagaagtgaa

SEQ ID NO: 409944 - DNA, 15 bp, Homo sapiens
cattaagaagtgaaa

SEQ ID NO: 409945 - DNA, 15 bp, Homo sapiens
attaagaagtgaaaa

SEQ ID NO: 409946 - DNA, 15 bp, Homo sapiens
ttaagaagtgaaaat

SEQ ID NO: 409947 - DNA, 15 bp, Homo sapiens
taagaagtgaaaata

SEQ ID NO: 409948 - DNA, 15 bp, Homo sapiens
aagaagtgaaaataa

SEQ ID NO: 409949 - DNA, 15 bp, Homo sapiens
agaagtgaaaataaa

SEQ ID NO: 409950 - DNA, 15 bp, Homo sapiens
gaagtgaaaataaat

SEQ ID NO: 409951 - DNA, 15 bp, Homo sapiens
aagtgaaaataaata

SEQ ID NO: 409952 - DNA, 15 bp, Homo sapiens
agtgaaaataaatat

SEQ ID NO: 409953 - DNA, 15 bp, Homo sapiens
gtgaaaataaatatt

SEQ ID NO: 409954 - DNA, 15 bp, Homo sapiens
tgaaaataaatattt

SEQ ID NO: 409955 - DNA, 15 bp, Homo sapiens
gaaaataaatatttt

SEQ ID NO: 409956 - DNA, 15 bp, Homo sapiens
aaaataaatatttta

SEQ ID NO: 409957 - DNA, 15 bp, Homo sapiens
aaataaatattttat

SEQ ID NO: 409958 - DNA, 15 bp, Homo sapiens
aataaatattttatt

SEQ ID NO: 409959 - DNA, 15 bp, Homo sapiens
ataaatattttatta

SEQ ID NO: 409960 - DNA, 15 bp, Homo sapiens
taaatattttattat

SEQ ID NO: 409961 - DNA, 15 bp, Homo sapiens
aaatattttattata

SEQ ID NO: 409962 - DNA, 15 bp, Homo sapiens
aatattttattatac

SEQ ID NO: 409963 - DNA, 15 bp, Homo sapiens
atattttattataca

SEQ ID NO: 409964 - DNA, 15 bp, Homo sapiens
tattttattatacat

SEQ ID NO: 409965 - DNA, 15 bp, Homo sapiens
attttattatacatg

SEQ ID NO: 409966 - DNA, 15 bp, Homo sapiens
ttttattatacatgt

SEQ ID NO: 409967 - DNA, 15 bp, Homo sapiens
tttattatacatgta

SEQ ID NO: 409968 - DNA, 15 bp, Homo sapiens
ttattatacatgtaa

SEQ ID NO: 409969 - DNA, 15 bp, Homo sapiens
tattatacatgtaat

SEQ ID NO: 409970 - DNA, 15 bp, Homo sapiens
attatacatgtaata

SEQ ID NO: 409971 - DNA, 15 bp, Homo sapiens
ttatacatgtaatat

SEQ ID NO: 409972 - DNA, 15 bp, Homo sapiens
tatacatgtaatatg

SEQ ID NO: 409973 - DNA, 15 bp, Homo sapiens
atacatgtaatatga

SEQ ID NO: 409974 - DNA, 15 bp, Homo sapiens
tacatgtaatatgat

SEQ ID NO: 409975 - DNA, 15 bp, Homo sapiens
acatgtaatatgatt

SEQ ID NO: 409976 - DNA, 15 bp, Homo sapiens
catgtaatatgattt

SEQ ID NO: 409977 - DNA, 15 bp, Homo sapiens
tgtaatatgatttag

SEQ ID NO: 409978 - DNA, 15 bp, Homo sapiens
gtaatatgatttagt

SEQ ID NO: 409979 - DNA, 15 bp, Homo sapiens
taatatgatttagtt

SEQ ID NO: 409980 - DNA, 15 bp, Homo sapiens
aatatgatttagttt

SEQ ID NO: 409981 - DNA, 15 bp, Homo sapiens
atatgatttagtttt

SEQ ID NO: 409982 - DNA, 15 bp, Homo sapiens
tatgatttagtttta

SEQ ID NO: 409983 - DNA, 15 bp, Homo sapiens
atgatttagttttac

SEQ ID NO: 409984 - DNA, 15 bp, Homo sapiens
tgatttagttttaca

SEQ ID NO: 409985 - DNA, 15 bp, Homo sapiens
gatttagttttacaa

SEQ ID NO: 409986 - DNA, 15 bp, Homo sapiens
atttagttttacaaa

SEQ ID NO: 409987 - DNA, 15 bp, Homo sapiens
tttagttttacaaac

SEQ ID NO: 409988 - DNA, 15 bp, Homo sapiens
ttagttttacaaact

SEQ ID NO: 409989 - DNA, 15 bp, Homo sapiens
tagttttacaaactg

SEQ ID NO: 409990 - DNA, 15 bp, Homo sapiens
agttttacaaactgt

SEQ ID NO: 409991 - DNA, 15 bp, Homo sapiens
gttttacaaactgtt

SEQ ID NO: 409992 - DNA, 15 bp, Homo sapiens
ttttacaaactgtta

SEQ ID NO: 409993 - DNA, 15 bp, Homo sapiens
tttacaaactgttaa

SEQ ID NO: 409994 - DNA, 15 bp, Homo sapiens
ttacaaactgttaat

SEQ ID NO: 409995 - DNA, 15 bp, Homo sapiens
tacaaactgttaata

SEQ ID NO: 409996 - DNA, 15 bp, Homo sapiens
acaaactgttaatat

SEQ ID NO: 409997 - DNA, 15 bp, Homo sapiens
caaactgttaatatc

SEQ ID NO: 409998 - DNA, 15 bp, Homo sapiens
aaactgttaatatca

SEQ ID NO: 409999 - DNA, 15 bp, Homo sapiens
aactgttaatatcat

SEQ ID NO: 410000 - DNA, 15 bp, Homo sapiens
actgttaatatcata

SEQ ID NO: 410001 - DNA, 15 bp, Homo sapiens
ctgttaatatcataa

SEQ ID NO: 410002 - DNA, 15 bp, Homo sapiens
tgttaatatcataat

SEQ ID NO: 410003 - DNA, 15 bp, Homo sapiens
gttaatatcataata

SEQ ID NO: 410004 - DNA, 15 bp, Homo sapiens
ttaatatcataataa

SEQ ID NO: 410005 - DNA, 15 bp, Homo sapiens
taatatcataataat

SEQ ID NO: 410006 - DNA, 15 bp, Homo sapiens
aatatcataataatc

SEQ ID NO: 410007 - DNA, 15 bp, Homo sapiens
atatcataataatct

SEQ ID NO: 410008 - DNA, 15 bp, Homo sapiens
tatcataataatctc

SEQ ID NO: 410009 - DNA, 15 bp, Homo sapiens
atcataataatctca

SEQ ID NO: 410010 - DNA, 15 bp, Homo sapiens
tcataataatctcaa

SEQ ID NO: 410011 - DNA, 15 bp, Homo sapiens
cataataatctcaag

SEQ ID NO: 410012 - DNA, 15 bp, Homo sapiens
ataataatctcaaga

SEQ ID NO: 410013 - DNA, 15 bp, Homo sapiens
taataatctcaagaa

SEQ ID NO: 410014 - DNA, 15 bp, Homo sapiens
aataatctcaagaag

SEQ ID NO: 410015 - DNA, 15 bp, Homo sapiens
ataatctcaagaagt

SEQ ID NO: 410016 - DNA, 15 bp, Homo sapiens
taatctcaagaagtt

SEQ ID NO: 410017 - DNA, 15 bp, Homo sapiens
aatctcaagaagttc

SEQ ID NO: 410018 - DNA, 15 bp, Homo sapiens
atctcaagaagttct

SEQ ID NO: 410019 - DNA, 15 bp, Homo sapiens
tctcaagaagttcta

SEQ ID NO: 410020 - DNA, 15 bp, Homo sapiens
ctcaagaagttctaa

SEQ ID NO: 410021 - DNA, 15 bp, Homo sapiens
tcaagaagttctaaa

SEQ ID NO: 410022 - DNA, 15 bp, Homo sapiens
caagaagttctaaaa

SEQ ID NO: 410023 - DNA, 15 bp, Homo sapiens
aagaagttctaaaaa

SEQ ID NO: 410024 - DNA, 15 bp, Homo sapiens
agaagttctaaaaat

SEQ ID NO: 410025 - DNA, 15 bp, Homo sapiens
gaagttctaaaaatg

SEQ ID NO: 410026 - DNA, 15 bp, Homo sapiens
aagttctaaaaatgg

SEQ ID NO: 410027 - DNA, 15 bp, Homo sapiens
agttctaaaaatgga

SEQ ID NO: 410028 - DNA, 15 bp, Homo sapiens
gttctaaaaatggag

SEQ ID NO: 410029 - DNA, 15 bp, Homo sapiens
ttctaaaaatggaga

SEQ ID NO: 410030 - DNA, 15 bp, Homo sapiens
tctaaaaatggagat

SEQ ID NO: 410031 - DNA, 15 bp, Homo sapiens
ctaaaaatggagata

SEQ ID NO: 410032 - DNA, 15 bp, Homo sapiens
taaaaatggagataa

SEQ ID NO: 410033 - DNA, 15 bp, Homo sapiens
aaaaatggagataat

SEQ ID NO: 410034 - DNA, 15 bp, Homo sapiens
aaaatggagataatt

SEQ ID NO: 410035 - DNA, 15 bp, Homo sapiens
aaatggagataatta

SEQ ID NO: 410036 - DNA, 15 bp, Homo sapiens
aatggagataattat

SEQ ID NO: 410037 - DNA, 15 bp, Homo sapiens
atggagataattatg

SEQ ID NO: 410038 - DNA, 15 bp, Homo sapiens
tggagataattatga

SEQ ID NO: 410039 - DNA, 15 bp, Homo sapiens
ggagataattatgac

SEQ ID NO: 410040 - DNA, 15 bp, Homo sapiens
gagataattatgaca

SEQ ID NO: 410041 - DNA, 15 bp, Homo sapiens
agataattatgacag

SEQ ID NO: 410042 - DNA, 15 bp, Homo sapiens
gataattatgacagc

SEQ ID NO: 410043 - DNA, 15 bp, Homo sapiens
ataattatgacagcc

SEQ ID NO: 410044 - DNA, 15 bp, Homo sapiens
taattatgacagcca

SEQ ID NO: 410045 - DNA, 15 bp, Homo sapiens
aattatgacagccat

SEQ ID NO: 410046 - DNA, 15 bp, Homo sapiens
attatgacagccata

SEQ ID NO: 410047 - DNA, 15 bp, Homo sapiens
ttatgacagccataa

SEQ ID NO: 410048 - DNA, 15 bp, Homo sapiens
tatgacagccataaa

SEQ ID NO: 410049 - DNA, 15 bp, Homo sapiens
atgacagccataaaa

SEQ ID NO: 410050 - DNA, 15 bp, Homo sapiens
tgacagccataaaat

SEQ ID NO: 410051 - DNA, 15 bp, Homo sapiens
gacagccataaaata

SEQ ID NO: 410052 - DNA, 15 bp, Homo sapiens
acagccataaaatat

SEQ ID NO: 410053 - DNA, 15 bp, Homo sapiens
cagccataaaatata

SEQ ID NO: 410054 - DNA, 15 bp, Homo sapiens
agccataaaatataa

SEQ ID NO: 410055 - DNA, 15 bp, Homo sapiens
gccataaaatataaa

SEQ ID NO: 410056 - DNA, 15 bp, Homo sapiens
ccataaaatataaag

SEQ ID NO: 410057 - DNA, 15 bp, Homo sapiens
cataaaatataaagt

SEQ ID NO: 410058 - DNA, 15 bp, Homo sapiens
ataaaatataaagta

SEQ ID NO: 410059 - DNA, 15 bp, Homo sapiens
taaaatataaagtat

SEQ ID NO: 410060 - DNA, 15 bp, Homo sapiens
aaaatataaagtata

SEQ ID NO: 410061 - DNA, 15 bp, Homo sapiens
aaatataaagtatat

SEQ ID NO: 410062 - DNA, 15 bp, Homo sapiens
aatataaagtatatg

SEQ ID NO: 410063 - DNA, 15 bp, Homo sapiens
atataaagtatatgg

SEQ ID NO: 410064 - DNA, 15 bp, Homo sapiens
tataaagtatatgga

SEQ ID NO: 410065 - DNA, 15 bp, Homo sapiens
ataaagtatatggaa

SEQ ID NO: 410066 - DNA, 15 bp, Homo sapiens
taaagtatatggaat

SEQ ID NO: 410067 - DNA, 15 bp, Homo sapiens
aaagtatatggaatt

SEQ ID NO: 410068 - DNA, 15 bp, Homo sapiens
aagtatatggaatta

SEQ ID NO: 410069 - DNA, 15 bp, Homo sapiens
agtatatggaattat

SEQ ID NO: 410070 - DNA, 15 bp, Homo sapiens
gtatatggaattata

SEQ ID NO: 410071 - DNA, 15 bp, Homo sapiens
tatatggaattatat

SEQ ID NO: 410072 - DNA, 15 bp, Homo sapiens
atatggaattatata

SEQ ID NO: 410073 - DNA, 15 bp, Homo sapiens
tatggaattatatat

SEQ ID NO: 410074 - DNA, 15 bp, Homo sapiens
atggaattatatatt

SEQ ID NO: 410075 - DNA, 15 bp, Homo sapiens
tggaattatatattt

SEQ ID NO: 410076 - DNA, 15 bp, Homo sapiens
ggaattatatatttg

SEQ ID NO: 410077 - DNA, 15 bp, Homo sapiens
gaattatatatttgg

SEQ ID NO: 410078 - DNA, 15 bp, Homo sapiens
aattatatatttggc

SEQ ID NO: 410079 - DNA, 15 bp, Homo sapiens
attatatatttggct

SEQ ID NO: 410080 - DNA, 15 bp, Homo sapiens
ttatatatttggcta

SEQ ID NO: 410081 - DNA, 15 bp, Homo sapiens
tatatatttggctat

SEQ ID NO: 410082 - DNA, 15 bp, Homo sapiens
atatatttggctata

SEQ ID NO: 410083 - DNA, 15 bp, Homo sapiens
tatatttggctatat

SEQ ID NO: 410084 - DNA, 15 bp, Homo sapiens
atatttggctatata

SEQ ID NO: 410085 - DNA, 15 bp, Homo sapiens
tatttggctatatat

SEQ ID NO: 410086 - DNA, 15 bp, Homo sapiens
atttggctatatatt

SEQ ID NO: 410087 - DNA, 15 bp, Homo sapiens
tttggctatatatta

SEQ ID NO: 410088 - DNA, 15 bp, Homo sapiens
ttggctatatattag

SEQ ID NO: 410089 - DNA, 15 bp, Homo sapiens
tggctatatattagt

SEQ ID NO: 410090 - DNA, 15 bp, Homo sapiens
ggctatatattagtc

SEQ ID NO: 410091 - DNA, 15 bp, Homo sapiens
gctatatattagtca

SEQ ID NO: 410092 - DNA, 15 bp, Homo sapiens
ctatatattagtcat

SEQ ID NO: 410093 - DNA, 15 bp, Homo sapiens
tatatattagtcata

SEQ ID NO: 410094 - DNA, 15 bp, Homo sapiens
atatattagtcatat

SEQ ID NO: 410095 - DNA, 15 bp, Homo sapiens
tatattagtcatata

SEQ ID NO: 410096 - DNA, 15 bp, Homo sapiens
atattagtcatatat

SEQ ID NO: 410097 - DNA, 15 bp, Homo sapiens
tattagtcatatatt

SEQ ID NO: 410098 - DNA, 15 bp, Homo sapiens
attagtcatatattt

SEQ ID NO: 410099 - DNA, 15 bp, Homo sapiens
ttagtcatatatttt

SEQ ID NO: 410100 - DNA, 15 bp, Homo sapiens
tagtcatatattttt

SEQ ID NO: 410101 - DNA, 15 bp, Homo sapiens
agtcatatattttta

SEQ ID NO: 410102 - DNA, 15 bp, Homo sapiens
gtcatatatttttag

SEQ ID NO: 410103 - DNA, 15 bp, Homo sapiens
tcatatatttttagg

SEQ ID NO: 410104 - DNA, 15 bp, Homo sapiens
catatatttttaggg

SEQ ID NO: 410105 - DNA, 15 bp, Homo sapiens
atatatttttagggc

SEQ ID NO: 410106 - DNA, 15 bp, Homo sapiens
tatatttttagggcc

SEQ ID NO: 410107 - DNA, 15 bp, Homo sapiens
atatttttagggcct

SEQ ID NO: 410108 - DNA, 15 bp, Homo sapiens
tatttttagggccta

SEQ ID NO: 410109 - DNA, 15 bp, Homo sapiens
atttttagggcctac

SEQ ID NO: 410110 - DNA, 15 bp, Homo sapiens
tttttagggcctact

SEQ ID NO: 410111 - DNA, 15 bp, Homo sapiens
ttttagggcctactt

SEQ ID NO: 410112 - DNA, 15 bp, Homo sapiens
tttagggcctacttt

SEQ ID NO: 410113 - DNA, 15 bp, Homo sapiens
ttagggcctacttta

SEQ ID NO: 410114 - DNA, 15 bp, Homo sapiens
tagggcctactttat

SEQ ID NO: 410115 - DNA, 15 bp, Homo sapiens
agggcctactttata

SEQ ID NO: 410116 - DNA, 15 bp, Homo sapiens
gggcctactttatat

SEQ ID NO: 410117 - DNA, 15 bp, Homo sapiens
ggcctactttatatt

SEQ ID NO: 410118 - DNA, 15 bp, Homo sapiens
gcctactttatattt

SEQ ID NO: 410119 - DNA, 15 bp, Homo sapiens
cctactttatatttt

SEQ ID NO: 410120 - DNA, 15 bp, Homo sapiens
ctactttatattttt

SEQ ID NO: 410121 - DNA, 15 bp, Homo sapiens
tactttatatttttt

SEQ ID NO: 410122 - DNA, 15 bp, Homo sapiens
actttatattttttt

SEQ ID NO: 410123 - DNA, 15 bp, Homo sapiens
ctttatatttttttc

SEQ ID NO: 410124 - DNA, 15 bp, Homo sapiens
tttatatttttttcc

SEQ ID NO: 410125 - DNA, 15 bp, Homo sapiens
ttatatttttttccc

SEQ ID NO: 410126 - DNA, 15 bp, Homo sapiens
tatatttttttccct

SEQ ID NO: 410127 - DNA, 15 bp, Homo sapiens
atatttttttccctg

SEQ ID NO: 410128 - DNA, 15 bp, Homo sapiens
tatttttttccctgg

SEQ ID NO: 410129 - DNA, 15 bp, Homo sapiens
atttttttccctggc

SEQ ID NO: 410130 - DNA, 15 bp, Homo sapiens
tttttttccctggca

SEQ ID NO: 410131 - DNA, 15 bp, Homo sapiens
ttttttccctggcag

SEQ ID NO: 410132 - DNA, 15 bp, Homo sapiens
tttttccctggcagt

SEQ ID NO: 410133 - DNA, 15 bp, Homo sapiens
ttttccctggcagtg

SEQ ID NO: 410134 - DNA, 15 bp, Homo sapiens
tttccctggcagtgt

SEQ ID NO: 410135 - DNA, 15 bp, Homo sapiens
ttccctggcagtgtt

SEQ ID NO: 410136 - DNA, 15 bp, Homo sapiens
tccctggcagtgttt

SEQ ID NO: 410137 - DNA, 15 bp, Homo sapiens
ccctggcagtgtttt

SEQ ID NO: 410138 - DNA, 15 bp, Homo sapiens
cctggcagtgtttta

SEQ ID NO: 410139 - DNA, 15 bp, Homo sapiens
ctggcagtgttttag

SEQ ID NO: 410140 - DNA, 15 bp, Homo sapiens
tggcagtgttttagt

SEQ ID NO: 410141 - DNA, 15 bp, Homo sapiens
ggcagtgttttagtt

SEQ ID NO: 410142 - DNA, 15 bp, Homo sapiens
gcagtgttttagtta

SEQ ID NO: 410143 - DNA, 15 bp, Homo sapiens
cagtgttttagttac

SEQ ID NO: 410144 - DNA, 15 bp, Homo sapiens
agtgttttagttaca

SEQ ID NO: 410145 - DNA, 15 bp, Homo sapiens
gtgttttagttacat

SEQ ID NO: 410146 - DNA, 15 bp, Homo sapiens
tgttttagttacatt

SEQ ID NO: 410147 - DNA, 15 bp, Homo sapiens
gttttagttacattt

SEQ ID NO: 410148 - DNA, 15 bp, Homo sapiens
tttagttacattttt

SEQ ID NO: 410149 - DNA, 15 bp, Homo sapiens
ttagttacatttttc

SEQ ID NO: 410150 - DNA, 15 bp, Homo sapiens
tagttacatttttcc

SEQ ID NO: 410151 - DNA, 15 bp, Homo sapiens
agttacatttttcca

SEQ ID NO: 410152 - DNA, 15 bp, Homo sapiens
gttacatttttccac

SEQ ID NO: 410153 - DNA, 15 bp, Homo sapiens
ttacatttttccaca

SEQ ID NO: 410154 - DNA, 15 bp, Homo sapiens
tacatttttccacag

SEQ ID NO: 410155 - DNA, 15 bp, Homo sapiens
acatttttccacagt

SEQ ID NO: 410156 - DNA, 15 bp, Homo sapiens
catttttccacagtg

SEQ ID NO: 410157 - DNA, 15 bp, Homo sapiens
atttttccacagtgt

SEQ ID NO: 410158 - DNA, 15 bp, Homo sapiens
tttttccacagtgtt

SEQ ID NO: 410159 - DNA, 15 bp, Homo sapiens
ttttccacagtgttt

SEQ ID NO: 410160 - DNA, 15 bp, Homo sapiens
tttccacagtgtttt

SEQ ID NO: 410161 - DNA, 15 bp, Homo sapiens
ttccacagtgttttt

SEQ ID NO: 410162 - DNA, 15 bp, Homo sapiens
tccacagtgtttttc

SEQ ID NO: 410163 - DNA, 15 bp, Homo sapiens
ccacagtgtttttct

SEQ ID NO: 410164 - DNA, 15 bp, Homo sapiens
cacagtgtttttcta

SEQ ID NO: 410165 - DNA, 15 bp, Homo sapiens
acagtgtttttctaa

SEQ ID NO: 410166 - DNA, 15 bp, Homo sapiens
cagtgtttttctaaa

SEQ ID NO: 410167 - DNA, 15 bp, Homo sapiens
agtgtttttctaaaa

SEQ ID NO: 410168 - DNA, 15 bp, Homo sapiens
gtgtttttctaaaaa

SEQ ID NO: 410169 - DNA, 15 bp, Homo sapiens
tgtttttctaaaaag

SEQ ID NO: 410170 - DNA, 15 bp, Homo sapiens
gtttttctaaaaaga

SEQ ID NO: 410171 - DNA, 15 bp, Homo sapiens
tttttctaaaaagaa

SEQ ID NO: 410172 - DNA, 15 bp, Homo sapiens
ttctaaaaagaaatt

SEQ ID NO: 410173 - DNA, 15 bp, Homo sapiens
tctaaaaagaaattg

SEQ ID NO: 410174 - DNA, 15 bp, Homo sapiens
ctaaaaagaaattgt

SEQ ID NO: 410175 - DNA, 15 bp, Homo sapiens
taaaaagaaattgta

SEQ ID NO: 410176 - DNA, 15 bp, Homo sapiens
aaaaagaaattgtat

SEQ ID NO: 410177 - DNA, 15 bp, Homo sapiens
aaaagaaattgtatc

SEQ ID NO: 410178 - DNA, 15 bp, Homo sapiens
aaagaaattgtatca

SEQ ID NO: 410179 - DNA, 15 bp, Homo sapiens
aagaaattgtatcat

SEQ ID NO: 410180 - DNA, 15 bp, Homo sapiens
agaaattgtatcatt

SEQ ID NO: 410181 - DNA, 15 bp, Homo sapiens
gaaattgtatcattt

SEQ ID NO: 410182 - DNA, 15 bp, Homo sapiens
aaattgtatcatttt

SEQ ID NO: 410183 - DNA, 15 bp, Homo sapiens
aattgtatcattttg

SEQ ID NO: 410184 - DNA, 15 bp, Homo sapiens
attgtatcattttgt

SEQ ID NO: 410185 - DNA, 15 bp, Homo sapiens
tgtatcattttgtaa

SEQ ID NO: 410186 - DNA, 15 bp, Homo sapiens
gtatcattttgtaat

SEQ ID NO: 410187 - DNA, 15 bp, Homo sapiens
tatcattttgtaatt

SEQ ID NO: 410188 - DNA, 15 bp, Homo sapiens
atcattttgtaattc

SEQ ID NO: 410189 - DNA, 15 bp, Homo sapiens
tcattttgtaattct

SEQ ID NO: 410190 - DNA, 15 bp, Homo sapiens
cattttgtaattctt

SEQ ID NO: 410191 - DNA, 15 bp, Homo sapiens
attttgtaattctta

SEQ ID NO: 410192 - DNA, 15 bp, Homo sapiens
ttttgtaattcttag

SEQ ID NO: 410193 - DNA, 15 bp, Homo sapiens
tttgtaattcttagt

SEQ ID NO: 410194 - DNA, 15 bp, Homo sapiens
ttgtaattcttagtt

SEQ ID NO: 410195 - DNA, 15 bp, Homo sapiens
agcaccctgggtggt

SEQ ID NO: 410196 - DNA, 15 bp, Homo sapiens
gcaccctgggtggta

SEQ ID NO: 410197 - DNA, 15 bp, Homo sapiens
caccctgggtggtag

SEQ ID NO: 410198 - DNA, 15 bp, Homo sapiens
accctgggtggtagc

SEQ ID NO: 410199 - DNA, 15 bp, Homo sapiens
ccctgggtggtagct

SEQ ID NO: 410200 - DNA, 15 bp, Homo sapiens
cctgggtggtagctg

SEQ ID NO: 410201 - DNA, 15 bp, Homo sapiens
ctgggtggtagctgg

SEQ ID NO: 410202 - DNA, 15 bp, Homo sapiens
tgggtggtagctgga

SEQ ID NO: 410203 - DNA, 15 bp, Homo sapiens
gggtggtagctggaa

SEQ ID NO: 410204 - DNA, 15 bp, Homo sapiens
ggtggtagctggaag

SEQ ID NO: 410205 - DNA, 15 bp, Homo sapiens
gtggtagctggaagt

SEQ ID NO: 410206 - DNA, 15 bp, Homo sapiens
tggtagctggaagtt

SEQ ID NO: 410207 - DNA, 15 bp, Homo sapiens
ggtagctggaagttt

SEQ ID NO: 410208 - DNA, 15 bp, Homo sapiens
gtagctggaagtttg

SEQ ID NO: 410209 - DNA, 15 bp, Homo sapiens
tagctggaagtttgc

SEQ ID NO: 410210 - DNA, 15 bp, Homo sapiens
agctggaagtttgcc

SEQ ID NO: 410211 - DNA, 15 bp, Homo sapiens
gctggaagtttgccc

SEQ ID NO: 410212 - DNA, 15 bp, Homo sapiens
ctggaagtttgccca

SEQ ID NO: 410213 - DNA, 15 bp, Homo sapiens
tggaagtttgcccag

SEQ ID NO: 410214 - DNA, 15 bp, Homo sapiens
ggaagtttgcccagc

SEQ ID NO: 410215 - DNA, 15 bp, Homo sapiens
gaagtttgcccagct

SEQ ID NO: 410216 - DNA, 15 bp, Homo sapiens
aagtttgcccagctg

SEQ ID NO: 410217 - DNA, 15 bp, Homo sapiens
agtttgcccagctga

SEQ ID NO: 410218 - DNA, 15 bp, Homo sapiens
gtttgcccagctgag

SEQ ID NO: 410219 - DNA, 15 bp, Homo sapiens
tttgcccagctgaga

SEQ ID NO: 410220 - DNA, 15 bp, Homo sapiens
ttgcccagctgagaa

SEQ ID NO: 410221 - DNA, 15 bp, Homo sapiens
tgcccagctgagaaa

SEQ ID NO: 410222 - DNA, 15 bp, Homo sapiens
gcccagctgagaaag

SEQ ID NO: 410223 - DNA, 15 bp, Homo sapiens
cccagctgagaaaga

SEQ ID NO: 410224 - DNA, 15 bp, Homo sapiens
ccagctgagaaagat

SEQ ID NO: 410225 - DNA, 15 bp, Homo sapiens
cagctgagaaagatt

SEQ ID NO: 410226 - DNA, 15 bp, Homo sapiens
agctgagaaagattg

SEQ ID NO: 410227 - DNA, 15 bp, Homo sapiens
gctgagaaagattgt

SEQ ID NO: 410228 - DNA, 15 bp, Homo sapiens
ctgagaaagattgtt

SEQ ID NO: 410229 - DNA, 15 bp, Homo sapiens
tgagaaagattgttc

SEQ ID NO: 410230 - DNA, 15 bp, Homo sapiens
gagaaagattgttct

SEQ ID NO: 410231 - DNA, 15 bp, Homo sapiens
agaaagattgttctt

SEQ ID NO: 410232 - DNA, 15 bp, Homo sapiens
gaaagattgttcttt

SEQ ID NO: 410233 - DNA, 15 bp, Homo sapiens
aaagattgttctttt

SEQ ID NO: 410234 - DNA, 15 bp, Homo sapiens
aagattgttcttttt

SEQ ID NO: 410235 - DNA, 15 bp, Homo sapiens
agattgttctttttc

SEQ ID NO: 410236 - DNA, 15 bp, Homo sapiens
gattgttctttttct

SEQ ID NO: 410237 - DNA, 15 bp, Homo sapiens
attgttctttttctc

SEQ ID NO: 410238 - DNA, 15 bp, Homo sapiens
ttgttctttttctct

SEQ ID NO: 410239 - DNA, 15 bp, Homo sapiens
ttctttttctctccc

SEQ ID NO: 410240 - DNA, 15 bp, Homo sapiens
ctttttctctccctt

SEQ ID NO: 410241 - DNA, 15 bp, Homo sapiens
tttttctctcccttt

SEQ ID NO: 410242 - DNA, 15 bp, Homo sapiens
ttttctctccctttt

SEQ ID NO: 410243 - DNA, 15 bp, Homo sapiens
tttctctcccttttt

SEQ ID NO: 410244 - DNA, 15 bp, Homo sapiens
ttctctccctttttt

SEQ ID NO: 410245 - DNA, 15 bp, Homo sapiens
tctctccctttttta

SEQ ID NO: 410246 - DNA, 15 bp, Homo sapiens
ctctcccttttttat

SEQ ID NO: 410247 - DNA, 15 bp, Homo sapiens
tctcccttttttatt

SEQ ID NO: 410248 - DNA, 15 bp, Homo sapiens
ctcccttttttattt

SEQ ID NO: 410249 - DNA, 15 bp, Homo sapiens
tcccttttttattta

SEQ ID NO: 410250 - DNA, 15 bp, Homo sapiens
cccttttttatttat

SEQ ID NO: 410251 - DNA, 15 bp, Homo sapiens
ccttttttatttatt

SEQ ID NO: 410252 - DNA, 15 bp, Homo sapiens
cttttttatttattt

SEQ ID NO: 410253 - DNA, 15 bp, Homo sapiens
ttttttatttattta

SEQ ID NO: 410254 - DNA, 15 bp, Homo sapiens
tatttatttttttgt

SEQ ID NO: 410255 - DNA, 15 bp, Homo sapiens
atttatttttttgtg

SEQ ID NO: 410256 - DNA, 15 bp, Homo sapiens
tttatttttttgtgt

SEQ ID NO: 410257 - DNA, 15 bp, Homo sapiens
ttatttttttgtgtg

SEQ ID NO: 410258 - DNA, 15 bp, Homo sapiens
ttttttgtgtgtgtg

SEQ ID NO: 410259 - DNA, 15 bp, Homo sapiens
tttttgtgtgtgtgg

SEQ ID NO: 410260 - DNA, 15 bp, Homo sapiens
ttttgtgtgtgtggt

SEQ ID NO: 410261 - DNA, 15 bp, Homo sapiens
tttgtgtgtgtggtg

SEQ ID NO: 410262 - DNA, 15 bp, Homo sapiens
ttgtgtgtgtggtgg

SEQ ID NO: 410263 - DNA, 15 bp, Homo sapiens
tgtgtgtgtggtggt

SEQ ID NO: 410264 - DNA, 15 bp, Homo sapiens
gtgtgtgtggtggtg

SEQ ID NO: 410265 - DNA, 15 bp, Homo sapiens
tgtgtgtggtggtgg

SEQ ID NO: 410266 - DNA, 15 bp, Homo sapiens
gtgtgtggtggtggt

SEQ ID NO: 410267 - DNA, 15 bp, Homo sapiens
tgtgtggtggtggtg

SEQ ID NO: 410268 - DNA, 15 bp, Homo sapiens
gtgtggtggtggtga

SEQ ID NO: 410269 - DNA, 15 bp, Homo sapiens
tgtggtggtggtgat

SEQ ID NO: 410270 - DNA, 15 bp, Homo sapiens
gtggtggtggtgatg

SEQ ID NO: 410271 - DNA, 15 bp, Homo sapiens
tggtggtggtgatgg

SEQ ID NO: 410272 - DNA, 15 bp, Homo sapiens
ggtggtggtgatggt

SEQ ID NO: 410273 - DNA, 15 bp, Homo sapiens
gtggtggtgatggtg

SEQ ID NO: 410274 - DNA, 15 bp, Homo sapiens
tggtggtgatggtgc

SEQ ID NO: 410275 - DNA, 15 bp, Homo sapiens
ggtggtgatggtgct

SEQ ID NO: 410276 - DNA, 15 bp, Homo sapiens
gtggtgatggtgctg

SEQ ID NO: 410277 - DNA, 15 bp, Homo sapiens
tggtgatggtgctgg

SEQ ID NO: 410278 - DNA, 15 bp, Homo sapiens
ggtgatggtgctggt

SEQ ID NO: 410279 - DNA, 15 bp, Homo sapiens
gtgatggtgctggtg

SEQ ID NO: 410280 - DNA, 15 bp, Homo sapiens
tgatggtgctggtgc

SEQ ID NO: 410281 - DNA, 15 bp, Homo sapiens
gatggtgctggtgct

SEQ ID NO: 410282 - DNA, 15 bp, Homo sapiens
atggtgctggtgctg

SEQ ID NO: 410283 - DNA, 15 bp, Homo sapiens
tggtgctggtgctgg

SEQ ID NO: 410284 - DNA, 15 bp, Homo sapiens
ggtgctggtgctggt

SEQ ID NO: 410285 - DNA, 15 bp, Homo sapiens
gtgctggtgctggtg

SEQ ID NO: 410286 - DNA, 15 bp, Homo sapiens
tgctggtgctggtgg

SEQ ID NO: 410287 - DNA, 15 bp, Homo sapiens
gctggtgctggtggt

SEQ ID NO: 410288 - DNA, 15 bp, Homo sapiens
ctggtgctggtggtt

SEQ ID NO: 410289 - DNA, 15 bp, Homo sapiens
tggtgctggtggttt

SEQ ID NO: 410290 - DNA, 15 bp, Homo sapiens
ggtgctggtggtttc

SEQ ID NO: 410291 - DNA, 15 bp, Homo sapiens
gtgctggtggtttct

SEQ ID NO: 410292 - DNA, 15 bp, Homo sapiens
tgctggtggtttctt

SEQ ID NO: 410293 - DNA, 15 bp, Homo sapiens
gctggtggtttcttt

SEQ ID NO: 410294 - DNA, 15 bp, Homo sapiens
ctggtggtttctttt

SEQ ID NO: 410295 - DNA, 15 bp, Homo sapiens
tggtggtttcttttg

SEQ ID NO: 410296 - DNA, 15 bp, Homo sapiens
ggtggtttcttttgt

SEQ ID NO: 410297 - DNA, 15 bp, Homo sapiens
gtggtttcttttgtc

SEQ ID NO: 410298 - DNA, 15 bp, Homo sapiens
tggtttcttttgtct

SEQ ID NO: 410299 - DNA, 15 bp, Homo sapiens
ggtttcttttgtctt

SEQ ID NO: 410300 - DNA, 15 bp, Homo sapiens
gtttcttttgtcttg

SEQ ID NO: 410301 - DNA, 15 bp, Homo sapiens
tttcttttgtcttgt

SEQ ID NO: 410302 - DNA, 15 bp, Homo sapiens
ttcttttgtcttgta

SEQ ID NO: 410303 - DNA, 15 bp, Homo sapiens
tcttttgtcttgtat

SEQ ID NO: 410304 - DNA, 15 bp, Homo sapiens
cttttgtcttgtatt

SEQ ID NO: 410305 - DNA, 15 bp, Homo sapiens
ttttgtcttgtattt

SEQ ID NO: 410306 - DNA, 15 bp, Homo sapiens
tttgtcttgtattta

SEQ ID NO: 410307 - DNA, 15 bp, Homo sapiens
ttgtcttgtatttat

SEQ ID NO: 410308 - DNA, 15 bp, Homo sapiens
tgtcttgtatttatg

SEQ ID NO: 410309 - DNA, 15 bp, Homo sapiens
gtcttgtatttatgt

SEQ ID NO: 410310 - DNA, 15 bp, Homo sapiens
tcttgtatttatgta

SEQ ID NO: 410311 - DNA, 15 bp, Homo sapiens
cttgtatttatgtaa

SEQ ID NO: 410312 - DNA, 15 bp, Homo sapiens
ttgtatttatgtaaa

SEQ ID NO: 410313 - DNA, 15 bp, Homo sapiens
tgtatttatgtaaaa

SEQ ID NO: 410314 - DNA, 15 bp, Homo sapiens
gtatttatgtaaaaa

SEQ ID NO: 410315 - DNA, 15 bp, Homo sapiens
tatttatgtaaaaag

SEQ ID NO: 410316 - DNA, 15 bp, Homo sapiens
atttatgtaaaaagt

SEQ ID NO: 410317 - DNA, 15 bp, Homo sapiens
tttatgtaaaaagtt

SEQ ID NO: 410318 - DNA, 15 bp, Homo sapiens
ttatgtaaaaagttt

SEQ ID NO: 410319 - DNA, 15 bp, Homo sapiens
tatgtaaaaagttta

SEQ ID NO: 410320 - DNA, 15 bp, Homo sapiens
atgtaaaaagtttat

SEQ ID NO: 410321 - DNA, 15 bp, Homo sapiens
tgtaaaaagtttatt

SEQ ID NO: 410322 - DNA, 15 bp, Homo sapiens
gtaaaaagtttattt

SEQ ID NO: 410323 - DNA, 15 bp, Homo sapiens
taaaaagtttatttg

SEQ ID NO: 410324 - DNA, 15 bp, Homo sapiens
aaaaagtttatttgc

SEQ ID NO: 410325 - DNA, 15 bp, Homo sapiens
aaaagtttatttgct

SEQ ID NO: 410326 - DNA, 15 bp, Homo sapiens
aaagtttatttgctg

SEQ ID NO: 410327 - DNA, 15 bp, Homo sapiens
aagtttatttgctgc

SEQ ID NO: 410328 - DNA, 15 bp, Homo sapiens
agtttatttgctgct

SEQ ID NO: 410329 - DNA, 15 bp, Homo sapiens
gtttatttgctgctc

SEQ ID NO: 410330 - DNA, 15 bp, Homo sapiens
tttatttgctgctct

SEQ ID NO: 410331 - DNA, 15 bp, Homo sapiens
ttatttgctgctctt

SEQ ID NO: 410332 - DNA, 15 bp, Homo sapiens
tatttgctgctcttg

SEQ ID NO: 410333 - DNA, 15 bp, Homo sapiens
atttgctgctcttga

SEQ ID NO: 410334 - DNA, 15 bp, Homo sapiens
tttgctgctcttgaa

SEQ ID NO: 410335 - DNA, 15 bp, Homo sapiens
ttgctgctcttgaaa

SEQ ID NO: 410336 - DNA, 15 bp, Homo sapiens
tgctgctcttgaaag

SEQ ID NO: 410337 - DNA, 15 bp, Homo sapiens
gctgctcttgaaaga

SEQ ID NO: 410338 - DNA, 15 bp, Homo sapiens
ctgctcttgaaagat

SEQ ID NO: 410339 - DNA, 15 bp, Homo sapiens
tgctcttgaaagatc

SEQ ID NO: 410340 - DNA, 15 bp, Homo sapiens
gctcttgaaagatct

SEQ ID NO: 410341 - DNA, 15 bp, Homo sapiens
ctcttgaaagatctc

SEQ ID NO: 410342 - DNA, 15 bp, Homo sapiens
tcttgaaagatctca

SEQ ID NO: 410343 - DNA, 15 bp, Homo sapiens
cttgaaagatctcag

SEQ ID NO: 410344 - DNA, 15 bp, Homo sapiens
ttgaaagatctcagc

SEQ ID NO: 410345 - DNA, 15 bp, Homo sapiens
tgaaagatctcagca

SEQ ID NO: 410346 - DNA, 15 bp, Homo sapiens
gaaagatctcagcat

SEQ ID NO: 410347 - DNA, 15 bp, Homo sapiens
aaagatctcagcatg

SEQ ID NO: 410348 - DNA, 15 bp, Homo sapiens
aagatctcagcatgt

SEQ ID NO: 410349 - DNA, 15 bp, Homo sapiens
agatctcagcatgtg

SEQ ID NO: 410350 - DNA, 15 bp, Homo sapiens
gatctcagcatgtgg

SEQ ID NO: 410351 - DNA, 15 bp, Homo sapiens
atctcagcatgtggc

SEQ ID NO: 410352 - DNA, 15 bp, Homo sapiens
tctcagcatgtggcc

SEQ ID NO: 410353 - DNA, 15 bp, Homo sapiens
ctcagcatgtggccc

SEQ ID NO: 410354 - DNA, 15 bp, Homo sapiens
tcagcatgtggcccc

SEQ ID NO: 410355 - DNA, 15 bp, Homo sapiens
cagcatgtggcccca

SEQ ID NO: 410356 - DNA, 15 bp, Homo sapiens
agcatgtggccccag

SEQ ID NO: 410357 - DNA, 15 bp, Homo sapiens
gcatgtggccccaga

SEQ ID NO: 410358 - DNA, 15 bp, Homo sapiens
catgtggccccagag

SEQ ID NO: 410359 - DNA, 15 bp, Homo sapiens
atgtggccccagagt

SEQ ID NO: 410360 - DNA, 15 bp, Homo sapiens
tgtggccccagagtc

SEQ ID NO: 410361 - DNA, 15 bp, Homo sapiens
gtggccccagagtct

SEQ ID NO: 410362 - DNA, 15 bp, Homo sapiens
tggccccagagtctt

SEQ ID NO: 410363 - DNA, 15 bp, Homo sapiens
ggccccagagtcttt

SEQ ID NO: 410364 - DNA, 15 bp, Homo sapiens
gccccagagtcttta

SEQ ID NO: 410365 - DNA, 15 bp, Homo sapiens
ccccagagtctttac

SEQ ID NO: 410366 - DNA, 15 bp, Homo sapiens
cccagagtctttaca

SEQ ID NO: 410367 - DNA, 15 bp, Homo sapiens
ccagagtctttacag

SEQ ID NO: 410368 - DNA, 15 bp, Homo sapiens
cagagtctttacaga

SEQ ID NO: 410369 - DNA, 15 bp, Homo sapiens
agagtctttacagac

SEQ ID NO: 410370 - DNA, 15 bp, Homo sapiens
gagtctttacagacc

SEQ ID NO: 410371 - DNA, 15 bp, Homo sapiens
agtctttacagacca

SEQ ID NO: 410372 - DNA, 15 bp, Homo sapiens
gtctttacagaccag

SEQ ID NO: 410373 - DNA, 15 bp, Homo sapiens
tctttacagaccagg

SEQ ID NO: 410374 - DNA, 15 bp, Homo sapiens
ctttacagaccaggt

SEQ ID NO: 410375 - DNA, 15 bp, Homo sapiens
tttacagaccaggtt

SEQ ID NO: 410376 - DNA, 15 bp, Homo sapiens
ttacagaccaggttc

SEQ ID NO: 410377 - DNA, 15 bp, Homo sapiens
tacagaccaggttcc

SEQ ID NO: 410378 - DNA, 15 bp, Homo sapiens
acagaccaggttccc

SEQ ID NO: 410379 - DNA, 15 bp, Homo sapiens
cagaccaggttccct

SEQ ID NO: 410380 - DNA, 15 bp, Homo sapiens
agaccaggttccctg

SEQ ID NO: 410381 - DNA, 15 bp, Homo sapiens
gaccaggttccctgt

SEQ ID NO: 410382 - DNA, 15 bp, Homo sapiens
accaggttccctgtg

SEQ ID NO: 410383 - DNA, 15 bp, Homo sapiens
ccaggttccctgtgg

SEQ ID NO: 410384 - DNA, 15 bp, Homo sapiens
caggttccctgtggc

SEQ ID NO: 410385 - DNA, 15 bp, Homo sapiens
aggttccctgtggcc

SEQ ID NO: 410386 - DNA, 15 bp, Homo sapiens
ggttccctgtggcca

SEQ ID NO: 410387 - DNA, 15 bp, Homo sapiens
gttccctgtggccac

SEQ ID NO: 410388 - DNA, 15 bp, Homo sapiens
ttccctgtggccact

SEQ ID NO: 410389 - DNA, 15 bp, Homo sapiens
tccctgtggccactt

SEQ ID NO: 410390 - DNA, 15 bp, Homo sapiens
ccctgtggccacttt

SEQ ID NO: 410391 - DNA, 15 bp, Homo sapiens
cctgtggccactttc

SEQ ID NO: 410392 - DNA, 15 bp, Homo sapiens
ctgtggccactttct

SEQ ID NO: 410393 - DNA, 15 bp, Homo sapiens
tgtggccactttctc

SEQ ID NO: 410394 - DNA, 15 bp, Homo sapiens
gtggccactttctct

SEQ ID NO: 410395 - DNA, 15 bp, Homo sapiens
tggccactttctctg

SEQ ID NO: 410396 - DNA, 15 bp, Homo sapiens
ggccactttctctgt

SEQ ID NO: 410397 - DNA, 15 bp, Homo sapiens
gccactttctctgta

SEQ ID NO: 410398 - DNA, 15 bp, Homo sapiens
ccactttctctgtaa

SEQ ID NO: 410399 - DNA, 15 bp, Homo sapiens
cactttctctgtaag

SEQ ID NO: 410400 - DNA, 15 bp, Homo sapiens
actttctctgtaagt

SEQ ID NO: 410401 - DNA, 15 bp, Homo sapiens
ctttctctgtaagtt

SEQ ID NO: 410402 - DNA, 15 bp, Homo sapiens
tttctctgtaagttt

SEQ ID NO: 410403 - DNA, 15 bp, Homo sapiens
ttctctgtaagtttc

SEQ ID NO: 410404 - DNA, 15 bp, Homo sapiens
tctctgtaagtttct

SEQ ID NO: 410405 - DNA, 15 bp, Homo sapiens
ctctgtaagtttctt

SEQ ID NO: 410406 - DNA, 15 bp, Homo sapiens
tctgtaagtttcttc

SEQ ID NO: 410407 - DNA, 15 bp, Homo sapiens
ctgtaagtttcttca

SEQ ID NO: 410408 - DNA, 15 bp, Homo sapiens
tgtaagtttcttcac

SEQ ID NO: 410409 - DNA, 15 bp, Homo sapiens
gtaagtttcttcacc

SEQ ID NO: 410410 - DNA, 15 bp, Homo sapiens
taagtttcttcacca

SEQ ID NO: 410411 - DNA, 15 bp, Homo sapiens
aagtttcttcaccac

SEQ ID NO: 410412 - DNA, 15 bp, Homo sapiens
agtttcttcaccaca

SEQ ID NO: 410413 - DNA, 15 bp, Homo sapiens
gtttcttcaccacag

SEQ ID NO: 410414 - DNA, 15 bp, Homo sapiens
tttcttcaccacagt

SEQ ID NO: 410415 - DNA, 15 bp, Homo sapiens
ttcttcaccacagtt

SEQ ID NO: 410416 - DNA, 15 bp, Homo sapiens
tcttcaccacagttc

SEQ ID NO: 410417 - DNA, 15 bp, Homo sapiens
cttcaccacagttct

SEQ ID NO: 410418 - DNA, 15 bp, Homo sapiens
ttcaccacagttctg

SEQ ID NO: 410419 - DNA, 15 bp, Homo sapiens
tcaccacagttctga

SEQ ID NO: 410420 - DNA, 15 bp, Homo sapiens
caccacagttctgat

SEQ ID NO: 410421 - DNA, 15 bp, Homo sapiens
accacagttctgatg

SEQ ID NO: 410422 - DNA, 15 bp, Homo sapiens
ccacagttctgatgg

SEQ ID NO: 410423 - DNA, 15 bp, Homo sapiens
cacagttctgatggt

SEQ ID NO: 410424 - DNA, 15 bp, Homo sapiens
acagttctgatggtt

SEQ ID NO: 410425 - DNA, 15 bp, Homo sapiens
cagttctgatggttg

SEQ ID NO: 410426 - DNA, 15 bp, Homo sapiens
agttctgatggttgg

SEQ ID NO: 410427 - DNA, 15 bp, Homo sapiens
gttctgatggttggt

SEQ ID NO: 410428 - DNA, 15 bp, Homo sapiens
ttctgatggttggtc

SEQ ID NO: 410429 - DNA, 15 bp, Homo sapiens
tctgatggttggtct

SEQ ID NO: 410430 - DNA, 15 bp, Homo sapiens
ctgatggttggtctt

SEQ ID NO: 410431 - DNA, 15 bp, Homo sapiens
tgatggttggtcttc

SEQ ID NO: 410432 - DNA, 15 bp, Homo sapiens
gatggttggtcttca

SEQ ID NO: 410433 - DNA, 15 bp, Homo sapiens
atggttggtcttcat

SEQ ID NO: 410434 - DNA, 15 bp, Homo sapiens
tggttggtcttcatg

SEQ ID NO: 410435 - DNA, 15 bp, Homo sapiens
ggttggtcttcatgc

SEQ ID NO: 410436 - DNA, 15 bp, Homo sapiens
gttggtcttcatgct

SEQ ID NO: 410437 - DNA, 15 bp, Homo sapiens
ttggtcttcatgctg

SEQ ID NO: 410438 - DNA, 15 bp, Homo sapiens
tggtcttcatgctga

SEQ ID NO: 410439 - DNA, 15 bp, Homo sapiens
ggtcttcatgctgat

SEQ ID NO: 410440 - DNA, 15 bp, Homo sapiens
gtcttcatgctgatg

SEQ ID NO: 410441 - DNA, 15 bp, Homo sapiens
tcttcatgctgatgt

SEQ ID NO: 410442 - DNA, 15 bp, Homo sapiens
cttcatgctgatgtc

SEQ ID NO: 410443 - DNA, 15 bp, Homo sapiens
ttcatgctgatgtca

SEQ ID NO: 410444 - DNA, 15 bp, Homo sapiens
tcatgctgatgtcag

SEQ ID NO: 410445 - DNA, 15 bp, Homo sapiens
catgctgatgtcagt

SEQ ID NO: 410446 - DNA, 15 bp, Homo sapiens
atgctgatgtcagtg

SEQ ID NO: 410447 - DNA, 15 bp, Homo sapiens
tgctgatgtcagtgc

SEQ ID NO: 410448 - DNA, 15 bp, Homo sapiens
gctgatgtcagtgct

SEQ ID NO: 410449 - DNA, 15 bp, Homo sapiens
ctgatgtcagtgctg

SEQ ID NO: 410450 - DNA, 15 bp, Homo sapiens
tgatgtcagtgctgt

SEQ ID NO: 410451 - DNA, 15 bp, Homo sapiens
gatgtcagtgctgtt

SEQ ID NO: 410452 - DNA, 15 bp, Homo sapiens
atgtcagtgctgttt

SEQ ID NO: 410453 - DNA, 15 bp, Homo sapiens
tgtcagtgctgtttt

SEQ ID NO: 410454 - DNA, 15 bp, Homo sapiens
gtcagtgctgttttg

SEQ ID NO: 410455 - DNA, 15 bp, Homo sapiens
tcagtgctgttttga

SEQ ID NO: 410456 - DNA, 15 bp, Homo sapiens
cagtgctgttttgat

SEQ ID NO: 410457 - DNA, 15 bp, Homo sapiens
agtgctgttttgatc

SEQ ID NO: 410458 - DNA, 15 bp, Homo sapiens
gtgctgttttgatcc

SEQ ID NO: 410459 - DNA, 15 bp, Homo sapiens
tgctgttttgatcca

SEQ ID NO: 410460 - DNA, 15 bp, Homo sapiens
gctgttttgatccaa

SEQ ID NO: 410461 - DNA, 15 bp, Homo sapiens
ctgttttgatccaaa

SEQ ID NO: 410462 - DNA, 15 bp, Homo sapiens
tgttttgatccaaac

SEQ ID NO: 410463 - DNA, 15 bp, Homo sapiens
gttttgatccaaact

SEQ ID NO: 410464 - DNA, 15 bp, Homo sapiens
ttttgatccaaactg

SEQ ID NO: 410465 - DNA, 15 bp, Homo sapiens
tttgatccaaactgt

SEQ ID NO: 410466 - DNA, 15 bp, Homo sapiens
ttgatccaaactgta

SEQ ID NO: 410467 - DNA, 15 bp, Homo sapiens
tgatccaaactgtag

SEQ ID NO: 410468 - DNA, 15 bp, Homo sapiens
gatccaaactgtaga

SEQ ID NO: 410469 - DNA, 15 bp, Homo sapiens
atccaaactgtagat

SEQ ID NO: 410470 - DNA, 15 bp, Homo sapiens
tccaaactgtagatt

SEQ ID NO: 410471 - DNA, 15 bp, Homo sapiens
ccaaactgtagatta

SEQ ID NO: 410472 - DNA, 15 bp, Homo sapiens
caaactgtagattat

SEQ ID NO: 410473 - DNA, 15 bp, Homo sapiens
aaactgtagattatt

SEQ ID NO: 410474 - DNA, 15 bp, Homo sapiens
aactgtagattattt

SEQ ID NO: 410475 - DNA, 15 bp, Homo sapiens
actgtagattatttt

SEQ ID NO: 410476 - DNA, 15 bp, Homo sapiens
ctgtagattattttt

SEQ ID NO: 410477 - DNA, 15 bp, Homo sapiens
tgtagattattttta

SEQ ID NO: 410478 - DNA, 15 bp, Homo sapiens
gtagattatttttac

SEQ ID NO: 410479 - DNA, 15 bp, Homo sapiens
tagattatttttacc

SEQ ID NO: 410480 - DNA, 15 bp, Homo sapiens
agattatttttacct

SEQ ID NO: 410481 - DNA, 15 bp, Homo sapiens
gattatttttacctg

SEQ ID NO: 410482 - DNA, 15 bp, Homo sapiens
attatttttacctgt

SEQ ID NO: 410483 - DNA, 15 bp, Homo sapiens
ttatttttacctgtg

SEQ ID NO: 410484 - DNA, 15 bp, Homo sapiens
tatttttacctgtga

SEQ ID NO: 410485 - DNA, 15 bp, Homo sapiens
atttttacctgtgaa

SEQ ID NO: 410486 - DNA, 15 bp, Homo sapiens
tttttacctgtgaat

SEQ ID NO: 410487 - DNA, 15 bp, Homo sapiens
ttttacctgtgaatt

SEQ ID NO: 410488 - DNA, 15 bp, Homo sapiens
tttacctgtgaattt

SEQ ID NO: 410489 - DNA, 15 bp, Homo sapiens
ttacctgtgaatttc

SEQ ID NO: 410490 - DNA, 15 bp, Homo sapiens
tacctgtgaatttct

SEQ ID NO: 410491 - DNA, 15 bp, Homo sapiens
acctgtgaatttctg

SEQ ID NO: 410492 - DNA, 15 bp, Homo sapiens
cctgtgaatttctga

SEQ ID NO: 410493 - DNA, 15 bp, Homo sapiens
ctgtgaatttctgaa

SEQ ID NO: 410494 - DNA, 15 bp, Homo sapiens
tgtgaatttctgaat

SEQ ID NO: 410495 - DNA, 15 bp, Homo sapiens
gtgaatttctgaata

SEQ ID NO: 410496 - DNA, 15 bp, Homo sapiens
tgaatttctgaataa

SEQ ID NO: 410497 - DNA, 15 bp, Homo sapiens
gaatttctgaataag

SEQ ID NO: 410498 - DNA, 15 bp, Homo sapiens
aatttctgaataagc

SEQ ID NO: 410499 - DNA, 15 bp, Homo sapiens
atttctgaataagca

SEQ ID NO: 410500 - DNA, 15 bp, Homo sapiens
tttctgaataagcat

SEQ ID NO: 410501 - DNA, 15 bp, Homo sapiens
ttctgaataagcatt

SEQ ID NO: 410502 - DNA, 15 bp, Homo sapiens
tctgaataagcatta

SEQ ID NO: 410503 - DNA, 15 bp, Homo sapiens
ctgaataagcattag

SEQ ID NO: 410504 - DNA, 15 bp, Homo sapiens
tgaataagcattaga

SEQ ID NO: 410505 - DNA, 15 bp, Homo sapiens
gaataagcattagat

SEQ ID NO: 410506 - DNA, 15 bp, Homo sapiens
aataagcattagatt

SEQ ID NO: 410507 - DNA, 15 bp, Homo sapiens
ataagcattagatta

SEQ ID NO: 410508 - DNA, 15 bp, Homo sapiens
taagcattagattaa

SEQ ID NO: 410509 - DNA, 15 bp, Homo sapiens
aagcattagattaac

SEQ ID NO: 410510 - DNA, 15 bp, Homo sapiens
agcattagattaaca

SEQ ID NO: 410511 - DNA, 15 bp, Homo sapiens
gcattagattaacac

SEQ ID NO: 410512 - DNA, 15 bp, Homo sapiens
cattagattaacaca

SEQ ID NO: 410513 - DNA, 15 bp, Homo sapiens
attagattaacacat

SEQ ID NO: 410514 - DNA, 15 bp, Homo sapiens
ttagattaacacatt

SEQ ID NO: 410515 - DNA, 15 bp, Homo sapiens
tagattaacacattt

SEQ ID NO: 410516 - DNA, 15 bp, Homo sapiens
agattaacacatttg

SEQ ID NO: 410517 - DNA, 15 bp, Homo sapiens
gattaacacatttgt

SEQ ID NO: 410518 - DNA, 15 bp, Homo sapiens
attaacacatttgtt

SEQ ID NO: 410519 - DNA, 15 bp, Homo sapiens
ttaacacatttgttt

SEQ ID NO: 410520 - DNA, 15 bp, Homo sapiens
taacacatttgtttt

SEQ ID NO: 410521 - DNA, 15 bp, Homo sapiens
aacacatttgttttt

SEQ ID NO: 410522 - DNA, 15 bp, Homo sapiens
acacatttgtttttg

SEQ ID NO: 410523 - DNA, 15 bp, Homo sapiens
cacatttgtttttga

SEQ ID NO: 410524 - DNA, 15 bp, Homo sapiens
acatttgtttttgaa

SEQ ID NO: 410525 - DNA, 15 bp, Homo sapiens
catttgtttttgaaa

SEQ ID NO: 410526 - DNA, 15 bp, Homo sapiens
atttgtttttgaaat

SEQ ID NO: 410527 - DNA, 15 bp, Homo sapiens
tttgtttttgaaatc

SEQ ID NO: 410528 - DNA, 15 bp, Homo sapiens
ttgtttttgaaatca

SEQ ID NO: 410529 - DNA, 15 bp, Homo sapiens
tgtttttgaaatcaa

SEQ ID NO: 410530 - DNA, 15 bp, Homo sapiens
gtttttgaaatcaaa

SEQ ID NO: 410531 - DNA, 15 bp, Homo sapiens
tttttgaaatcaaat

SEQ ID NO: 410532 - DNA, 15 bp, Homo sapiens
ttttgaaatcaaatg

SEQ ID NO: 410533 - DNA, 15 bp, Homo sapiens
tttgaaatcaaatgt

SEQ ID NO: 410534 - DNA, 15 bp, Homo sapiens
ttgaaatcaaatgtg

SEQ ID NO: 410535 - DNA, 15 bp, Homo sapiens
tgaaatcaaatgtgc

SEQ ID NO: 410536 - DNA, 15 bp, Homo sapiens
gaaatcaaatgtgcg

SEQ ID NO: 410537 - DNA, 15 bp, Homo sapiens
aaatcaaatgtgcgt

SEQ ID NO: 410538 - DNA, 15 bp, Homo sapiens
aatcaaatgtgcgtt

SEQ ID NO: 410539 - DNA, 15 bp, Homo sapiens
atcaaatgtgcgttg

SEQ ID NO: 410540 - DNA, 15 bp, Homo sapiens
tcaaatgtgcgttga

SEQ ID NO: 410541 - DNA, 15 bp, Homo sapiens
caaatgtgcgttgag

SEQ ID NO: 410542 - DNA, 15 bp, Homo sapiens
aaatgtgcgttgagg

SEQ ID NO: 410543 - DNA, 15 bp, Homo sapiens
aatgtgcgttgaggt

SEQ ID NO: 410544 - DNA, 15 bp, Homo sapiens
atgtgcgttgaggtg

SEQ ID NO: 410545 - DNA, 15 bp, Homo sapiens
tgtgcgttgaggtga

SEQ ID NO: 410546 - DNA, 15 bp, Homo sapiens
gtgcgttgaggtgaa

SEQ ID NO: 410547 - DNA, 15 bp, Homo sapiens
tgcgttgaggtgaaa

SEQ ID NO: 410548 - DNA, 15 bp, Homo sapiens
gcgttgaggtgaaac

SEQ ID NO: 410549 - DNA, 15 bp, Homo sapiens
cgttgaggtgaaaca

SEQ ID NO: 410550 - DNA, 15 bp, Homo sapiens
gttgaggtgaaacac

SEQ ID NO: 410551 - DNA, 15 bp, Homo sapiens
ttgaggtgaaacacg

SEQ ID NO: 410552 - DNA, 15 bp, Homo sapiens
tgaggtgaaacacgt

SEQ ID NO: 410553 - DNA, 15 bp, Homo sapiens
gaggtgaaacacgtt

SEQ ID NO: 410554 - DNA, 15 bp, Homo sapiens
aggtgaaacacgttc

SEQ ID NO: 410555 - DNA, 15 bp, Homo sapiens
ggtgaaacacgttct

SEQ ID NO: 410556 - DNA, 15 bp, Homo sapiens
gtgaaacacgttctg

SEQ ID NO: 410557 - DNA, 15 bp, Homo sapiens
tgaaacacgttctgc

SEQ ID NO: 410558 - DNA, 15 bp, Homo sapiens
gaaacacgttctgct

SEQ ID NO: 410559 - DNA, 15 bp, Homo sapiens
aaacacgttctgcta

SEQ ID NO: 410560 - DNA, 15 bp, Homo sapiens
aacacgttctgctag

SEQ ID NO: 410561 - DNA, 15 bp, Homo sapiens
acacgttctgctaga

SEQ ID NO: 410562 - DNA, 15 bp, Homo sapiens
cacgttctgctagaa

SEQ ID NO: 410563 - DNA, 15 bp, Homo sapiens
acgttctgctagaaa

SEQ ID NO: 410564 - DNA, 15 bp, Homo sapiens
cgttctgctagaaag

SEQ ID NO: 410565 - DNA, 15 bp, Homo sapiens
gttctgctagaaagc

SEQ ID NO: 410566 - DNA, 15 bp, Homo sapiens
ttctgctagaaagct

SEQ ID NO: 410567 - DNA, 15 bp, Homo sapiens
tctgctagaaagctc

SEQ ID NO: 410568 - DNA, 15 bp, Homo sapiens
ctgctagaaagctca

SEQ ID NO: 410569 - DNA, 15 bp, Homo sapiens
tgctagaaagctcat

SEQ ID NO: 410570 - DNA, 15 bp, Homo sapiens
gctagaaagctcata

SEQ ID NO: 410571 - DNA, 15 bp, Homo sapiens
ctagaaagctcataa

SEQ ID NO: 410572 - DNA, 15 bp, Homo sapiens
tagaaagctcataaa

SEQ ID NO: 410573 - DNA, 15 bp, Homo sapiens
agaaagctcataaag

SEQ ID NO: 410574 - DNA, 15 bp, Homo sapiens
gaaagctcataaagc

SEQ ID NO: 410575 - DNA, 15 bp, Homo sapiens
aaagctcataaagcc

SEQ ID NO: 410576 - DNA, 15 bp, Homo sapiens
aagctcataaagcca

SEQ ID NO: 410577 - DNA, 15 bp, Homo sapiens
agctcataaagccat

SEQ ID NO: 410578 - DNA, 15 bp, Homo sapiens
gctcataaagccatt

SEQ ID NO: 410579 - DNA, 15 bp, Homo sapiens
ctcataaagccattt

SEQ ID NO: 410580 - DNA, 15 bp, Homo sapiens
tcataaagccatttt

SEQ ID NO: 410581 - DNA, 15 bp, Homo sapiens
cataaagccattttg

SEQ ID NO: 410582 - DNA, 15 bp, Homo sapiens
ataaagccattttgc

SEQ ID NO: 410583 - DNA, 15 bp, Homo sapiens
taaagccattttgcc

SEQ ID NO: 410584 - DNA, 15 bp, Homo sapiens
aaagccattttgccc

SEQ ID NO: 410585 - DNA, 15 bp, Homo sapiens
aagccattttgcccc

SEQ ID NO: 410586 - DNA, 15 bp, Homo sapiens
agccattttgcccct

SEQ ID NO: 410587 - DNA, 15 bp, Homo sapiens
gccattttgcccctg

SEQ ID NO: 410588 - DNA, 15 bp, Homo sapiens
ccattttgcccctgg

SEQ ID NO: 410589 - DNA, 15 bp, Homo sapiens
cattttgcccctggg

SEQ ID NO: 410590 - DNA, 15 bp, Homo sapiens
attttgcccctgggg

SEQ ID NO: 410591 - DNA, 15 bp, Homo sapiens
ttttgcccctgggga

SEQ ID NO: 410592 - DNA, 15 bp, Homo sapiens
tttgcccctggggac

SEQ ID NO: 410593 - DNA, 15 bp, Homo sapiens
ttgcccctggggaca

SEQ ID NO: 410594 - DNA, 15 bp, Homo sapiens
tgcccctggggacat

SEQ ID NO: 410595 - DNA, 15 bp, Homo sapiens
gcccctggggacata

SEQ ID NO: 410596 - DNA, 15 bp, Homo sapiens
cccctggggacatac

SEQ ID NO: 410597 - DNA, 15 bp, Homo sapiens
ccctggggacataca

SEQ ID NO: 410598 - DNA, 15 bp, Homo sapiens
cctggggacatacag

SEQ ID NO: 410599 - DNA, 15 bp, Homo sapiens
ctggggacatacagg

SEQ ID NO: 410600 - DNA, 15 bp, Homo sapiens
tggggacatacaggt

SEQ ID NO: 410601 - DNA, 15 bp, Homo sapiens
ggggacatacaggtt

SEQ ID NO: 410602 - DNA, 15 bp, Homo sapiens
gggacatacaggttt

SEQ ID NO: 410603 - DNA, 15 bp, Homo sapiens
ggacatacaggtttt

SEQ ID NO: 410604 - DNA, 15 bp, Homo sapiens
gacatacaggttttt

SEQ ID NO: 410605 - DNA, 15 bp, Homo sapiens
acatacaggttttta

SEQ ID NO: 410606 - DNA, 15 bp, Homo sapiens
catacaggtttttat

SEQ ID NO: 410607 - DNA, 15 bp, Homo sapiens
atacaggtttttatg

SEQ ID NO: 410608 - DNA, 15 bp, Homo sapiens
tacaggtttttatga

SEQ ID NO: 410609 - DNA, 15 bp, Homo sapiens
acaggtttttatgaa

SEQ ID NO: 410610 - DNA, 15 bp, Homo sapiens
caggtttttatgaaa

SEQ ID NO: 410611 - DNA, 15 bp, Homo sapiens
aggtttttatgaaaa

SEQ ID NO: 410612 - DNA, 15 bp, Homo sapiens
ggtttttatgaaaaa

SEQ ID NO: 410613 - DNA, 15 bp, Homo sapiens
gtttttatgaaaaaa

SEQ ID NO: 410614 - DNA, 15 bp, Homo sapiens
tttttatgaaaaaat

SEQ ID NO: 410615 - DNA, 15 bp, Homo sapiens
ttttatgaaaaaata

SEQ ID NO: 410616 - DNA, 15 bp, Homo sapiens
tttatgaaaaaataa

SEQ ID NO: 410617 - DNA, 15 bp, Homo sapiens
ttatgaaaaaataat

SEQ ID NO: 410618 - DNA, 15 bp, Homo sapiens
tatgaaaaaataatg

SEQ ID NO: 410619 - DNA, 15 bp, Homo sapiens
atgaaaaaataatga

SEQ ID NO: 410620 - DNA, 15 bp, Homo sapiens
tgaaaaaataatgaa

SEQ ID NO: 410621 - DNA, 15 bp, Homo sapiens
gaaaaaataatgaaa

SEQ ID NO: 410622 - DNA, 15 bp, Homo sapiens
aaaaaataatgaaaa

SEQ ID NO: 410623 - DNA, 15 bp, Homo sapiens
aaataatgaaaatat

SEQ ID NO: 410624 - DNA, 15 bp, Homo sapiens
aataatgaaaatatt

SEQ ID NO: 410625 - DNA, 15 bp, Homo sapiens
ataatgaaaatattt

SEQ ID NO: 410626 - DNA, 15 bp, Homo sapiens
taatgaaaatatttt

SEQ ID NO: 410627 - DNA, 15 bp, Homo sapiens
aatgaaaatatttta

SEQ ID NO: 410628 - DNA, 15 bp, Homo sapiens
atgaaaatattttaa

SEQ ID NO: 410629 - DNA, 15 bp, Homo sapiens
tgaaaatattttaaa

SEQ ID NO: 410630 - DNA, 15 bp, Homo sapiens
gaaaatattttaaaa

SEQ ID NO: 410631 - DNA, 15 bp, Homo sapiens
aaaatattttaaaag

SEQ ID NO: 410632 - DNA, 15 bp, Homo sapiens
aaatattttaaaagc

SEQ ID NO: 410633 - DNA, 15 bp, Homo sapiens
aatattttaaaagct

SEQ ID NO: 410634 - DNA, 15 bp, Homo sapiens
atattttaaaagctt

SEQ ID NO: 410635 - DNA, 15 bp, Homo sapiens
tattttaaaagcttg

SEQ ID NO: 410636 - DNA, 15 bp, Homo sapiens
attttaaaagcttgt

SEQ ID NO: 410637 - DNA, 15 bp, Homo sapiens
ttttaaaagcttgtt

SEQ ID NO: 410638 - DNA, 15 bp, Homo sapiens
tttaaaagcttgtta

SEQ ID NO: 410639 - DNA, 15 bp, Homo sapiens
ttaaaagcttgttaa

SEQ ID NO: 410640 - DNA, 15 bp, Homo sapiens
taaaagcttgttaaa

SEQ ID NO: 410641 - DNA, 15 bp, Homo sapiens
aaaagcttgttaaaa

SEQ ID NO: 410642 - DNA, 15 bp, Homo sapiens
aaagcttgttaaaat

SEQ ID NO: 410643 - DNA, 15 bp, Homo sapiens
aagcttgttaaaatt

SEQ ID NO: 410644 - DNA, 15 bp, Homo sapiens
agcttgttaaaattt

SEQ ID NO: 410645 - DNA, 15 bp, Homo sapiens
gcttgttaaaatttg

SEQ ID NO: 410646 - DNA, 15 bp, Homo sapiens
cttgttaaaatttgt

SEQ ID NO: 410647 - DNA, 15 bp, Homo sapiens
ttgttaaaatttgta

SEQ ID NO: 410648 - DNA, 15 bp, Homo sapiens
tgttaaaatttgtat

SEQ ID NO: 410649 - DNA, 15 bp, Homo sapiens
gttaaaatttgtata

SEQ ID NO: 410650 - DNA, 15 bp, Homo sapiens
ttaaaatttgtatag

SEQ ID NO: 410651 - DNA, 15 bp, Homo sapiens
taaaatttgtataga

SEQ ID NO: 410652 - DNA, 15 bp, Homo sapiens
aaaatttgtatagat

SEQ ID NO: 410653 - DNA, 15 bp, Homo sapiens
aaatttgtatagatg

SEQ ID NO: 410654 - DNA, 15 bp, Homo sapiens
aatttgtatagatgg

SEQ ID NO: 410655 - DNA, 15 bp, Homo sapiens
atttgtatagatggg

SEQ ID NO: 410656 - DNA, 15 bp, Homo sapiens
tttgtatagatgggc

SEQ ID NO: 410657 - DNA, 15 bp, Homo sapiens
ttgtatagatgggca

SEQ ID NO: 410658 - DNA, 15 bp, Homo sapiens
tgtatagatgggcat

SEQ ID NO: 410659 - DNA, 15 bp, Homo sapiens
gtatagatgggcata

SEQ ID NO: 410660 - DNA, 15 bp, Homo sapiens
tatagatgggcatat

SEQ ID NO: 410661 - DNA, 15 bp, Homo sapiens
atagatgggcatatg

SEQ ID NO: 410662 - DNA, 15 bp, Homo sapiens
tagatgggcatatgt

SEQ ID NO: 410663 - DNA, 15 bp, Homo sapiens
agatgggcatatgta

SEQ ID NO: 410664 - DNA, 15 bp, Homo sapiens
gatgggcatatgtaa

SEQ ID NO: 410665 - DNA, 15 bp, Homo sapiens
atgggcatatgtaaa

SEQ ID NO: 410666 - DNA, 15 bp, Homo sapiens
tgggcatatgtaaaa

SEQ ID NO: 410667 - DNA, 15 bp, Homo sapiens
gggcatatgtaaaac

SEQ ID NO: 410668 - DNA, 15 bp, Homo sapiens
ggcatatgtaaaaca

SEQ ID NO: 410669 - DNA, 15 bp, Homo sapiens
gcatatgtaaaacac

SEQ ID NO: 410670 - DNA, 15 bp, Homo sapiens
catatgtaaaacaca

SEQ ID NO: 410671 - DNA, 15 bp, Homo sapiens
atatgtaaaacacat

SEQ ID NO: 410672 - DNA, 15 bp, Homo sapiens
tatgtaaaacacatg

SEQ ID NO: 410673 - DNA, 15 bp, Homo sapiens
atgtaaaacacatgc

SEQ ID NO: 410674 - DNA, 15 bp, Homo sapiens
tgtaaaacacatgct

SEQ ID NO: 410675 - DNA, 15 bp, Homo sapiens
gtaaaacacatgcta

SEQ ID NO: 410676 - DNA, 15 bp, Homo sapiens
taaaacacatgctat

SEQ ID NO: 410677 - DNA, 15 bp, Homo sapiens
aaaacacatgctatt

SEQ ID NO: 410678 - DNA, 15 bp, Homo sapiens
aaacacatgctattt

SEQ ID NO: 410679 - DNA, 15 bp, Homo sapiens
aacacatgctattta

SEQ ID NO: 410680 - DNA, 15 bp, Homo sapiens
acacatgctatttaa

SEQ ID NO: 410681 - DNA, 15 bp, Homo sapiens
cacatgctatttaaa

SEQ ID NO: 410682 - DNA, 15 bp, Homo sapiens
acatgctatttaaat

SEQ ID NO: 410683 - DNA, 15 bp, Homo sapiens
catgctatttaaata

SEQ ID NO: 410684 - DNA, 15 bp, Homo sapiens
atgctatttaaatac

SEQ ID NO: 410685 - DNA, 15 bp, Homo sapiens
tgctatttaaatact

SEQ ID NO: 410686 - DNA, 15 bp, Homo sapiens
gctatttaaatactg

SEQ ID NO: 410687 - DNA, 15 bp, Homo sapiens
ctatttaaatactga

SEQ ID NO: 410688 - DNA, 15 bp, Homo sapiens
tatttaaatactgat

SEQ ID NO: 410689 - DNA, 15 bp, Homo sapiens
atttaaatactgata

SEQ ID NO: 410690 - DNA, 15 bp, Homo sapiens
tttaaatactgatat

SEQ ID NO: 410691 - DNA, 15 bp, Homo sapiens
ttaaatactgatatg

SEQ ID NO: 410692 - DNA, 15 bp, Homo sapiens
taaatactgatatga

SEQ ID NO: 410693 - DNA, 15 bp, Homo sapiens
aaatactgatatgaa

SEQ ID NO: 410694 - DNA, 15 bp, Homo sapiens
aatactgatatgaaa

SEQ ID NO: 410695 - DNA, 15 bp, Homo sapiens
atactgatatgaaaa

SEQ ID NO: 410696 - DNA, 15 bp, Homo sapiens
tactgatatgaaaat

SEQ ID NO: 410697 - DNA, 15 bp, Homo sapiens
actgatatgaaaata

SEQ ID NO: 410698 - DNA, 15 bp, Homo sapiens
ctgatatgaaaataa

SEQ ID NO: 410699 - DNA, 15 bp, Homo sapiens
tgatatgaaaataag

SEQ ID NO: 410700 - DNA, 15 bp, Homo sapiens
gatatgaaaataagt

SEQ ID NO: 410701 - DNA, 15 bp, Homo sapiens
atatgaaaataagtt

SEQ ID NO: 410702 - DNA, 15 bp, Homo sapiens
tatgaaaataagtta

SEQ ID NO: 410703 - DNA, 15 bp, Homo sapiens
atgaaaataagttag

SEQ ID NO: 410704 - DNA, 15 bp, Homo sapiens
tgaaaataagttagg

SEQ ID NO: 410705 - DNA, 15 bp, Homo sapiens
gaaaataagttagga

SEQ ID NO: 410706 - DNA, 15 bp, Homo sapiens
aaaataagttaggaa

SEQ ID NO: 410707 - DNA, 15 bp, Homo sapiens
aaataagttaggaat

SEQ ID NO: 410708 - DNA, 15 bp, Homo sapiens
aataagttaggaatg

SEQ ID NO: 410709 - DNA, 15 bp, Homo sapiens
ataagttaggaatga

SEQ ID NO: 410710 - DNA, 15 bp, Homo sapiens
taagttaggaatgaa

SEQ ID NO: 410711 - DNA, 15 bp, Homo sapiens
aagttaggaatgaaa

SEQ ID NO: 410712 - DNA, 15 bp, Homo sapiens
agttaggaatgaaat

SEQ ID NO: 410713 - DNA, 15 bp, Homo sapiens
gttaggaatgaaata

SEQ ID NO: 410714 - DNA, 15 bp, Homo sapiens
ttaggaatgaaatag

SEQ ID NO: 410715 - DNA, 15 bp, Homo sapiens
taggaatgaaataga

SEQ ID NO: 410716 - DNA, 15 bp, Homo sapiens
aggaatgaaatagaa

SEQ ID NO: 410717 - DNA, 15 bp, Homo sapiens
ggaatgaaatagaaa

SEQ ID NO: 410718 - DNA, 15 bp, Homo sapiens
gaatgaaatagaaag

SEQ ID NO: 410719 - DNA, 15 bp, Homo sapiens
atgaaatagaaagaa

SEQ ID NO: 410720 - DNA, 15 bp, Homo sapiens
tgaaatagaaagaaa

SEQ ID NO: 410721 - DNA, 15 bp, Homo sapiens
gaaatagaaagaaaa

SEQ ID NO: 410722 - DNA, 15 bp, Homo sapiens
aaatagaaagaaaaa

SEQ ID NO: 410723 - DNA, 15 bp, Homo sapiens
aatagaaagaaaaat

SEQ ID NO: 410724 - DNA, 15 bp, Homo sapiens
atagaaagaaaaatg

SEQ ID NO: 410725 - DNA, 15 bp, Homo sapiens
tagaaagaaaaatga

SEQ ID NO: 410726 - DNA, 15 bp, Homo sapiens
agaaagaaaaatgat

SEQ ID NO: 410727 - DNA, 15 bp, Homo sapiens
gaaagaaaaatgatt

SEQ ID NO: 410728 - DNA, 15 bp, Homo sapiens
aaagaaaaatgattt

SEQ ID NO: 410729 - DNA, 15 bp, Homo sapiens
aagaaaaatgatttg

SEQ ID NO: 410730 - DNA, 15 bp, Homo sapiens
agaaaaatgatttgc

SEQ ID NO: 410731 - DNA, 15 bp, Homo sapiens
gaaaaatgatttgca

SEQ ID NO: 410732 - DNA, 15 bp, Homo sapiens
aaaaatgatttgcaa

SEQ ID NO: 410733 - DNA, 15 bp, Homo sapiens
aaaatgatttgcaaa

SEQ ID NO: 410734 - DNA, 15 bp, Homo sapiens
aaatgatttgcaaat

SEQ ID NO: 410735 - DNA, 15 bp, Homo sapiens
aatgatttgcaaatc

SEQ ID NO: 410736 - DNA, 15 bp, Homo sapiens
atgatttgcaaatcc

SEQ ID NO: 410737 - DNA, 15 bp, Homo sapiens
tgatttgcaaatcca

SEQ ID NO: 410738 - DNA, 15 bp, Homo sapiens
gatttgcaaatccaa

SEQ ID NO: 410739 - DNA, 15 bp, Homo sapiens
atttgcaaatccaaa

SEQ ID NO: 410740 - DNA, 15 bp, Homo sapiens
tttgcaaatccaaaa

SEQ ID NO: 410741 - DNA, 15 bp, Homo sapiens
ttgcaaatccaaaaa

SEQ ID NO: 410742 - DNA, 15 bp, Homo sapiens
tgcaaatccaaaaaa

SEQ ID NO: 410743 - DNA, 15 bp, Homo sapiens
gcaaatccaaaaaat

SEQ ID NO: 410744 - DNA, 15 bp, Homo sapiens
caaatccaaaaaata

SEQ ID NO: 410745 - DNA, 15 bp, Homo sapiens
aaatccaaaaaataa

SEQ ID NO: 410746 - DNA, 15 bp, Homo sapiens
aatccaaaaaataat

SEQ ID NO: 410747 - DNA, 15 bp, Homo sapiens
atccaaaaaataata

SEQ ID NO: 410748 - DNA, 15 bp, Homo sapiens
tccaaaaaataatac

SEQ ID NO: 410749 - DNA, 15 bp, Homo sapiens
ccaaaaaataatacc

SEQ ID NO: 410750 - DNA, 15 bp, Homo sapiens
caaaaaataatacca

SEQ ID NO: 410751 - DNA, 15 bp, Homo sapiens
aaaaaataataccaa

SEQ ID NO: 410752 - DNA, 15 bp, Homo sapiens
aaaaataataccaac

SEQ ID NO: 410753 - DNA, 15 bp, Homo sapiens
aaaataataccaaca

SEQ ID NO: 410754 - DNA, 15 bp, Homo sapiens
aaataataccaacat

SEQ ID NO: 410755 - DNA, 15 bp, Homo sapiens
aataataccaacatt

SEQ ID NO: 410756 - DNA, 15 bp, Homo sapiens
ataataccaacattg

SEQ ID NO: 410757 - DNA, 15 bp, Homo sapiens
taataccaacattgt

SEQ ID NO: 410758 - DNA, 15 bp, Homo sapiens
aataccaacattgta

SEQ ID NO: 410759 - DNA, 15 bp, Homo sapiens
ataccaacattgtat

SEQ ID NO: 410760 - DNA, 15 bp, Homo sapiens
taccaacattgtata

SEQ ID NO: 410761 - DNA, 15 bp, Homo sapiens
accaacattgtatac

SEQ ID NO: 410762 - DNA, 15 bp, Homo sapiens
ccaacattgtatact

SEQ ID NO: 410763 - DNA, 15 bp, Homo sapiens
caacattgtatactg

SEQ ID NO: 410764 - DNA, 15 bp, Homo sapiens
aacattgtatactgt

SEQ ID NO: 410765 - DNA, 15 bp, Homo sapiens
acattgtatactgtt

SEQ ID NO: 410766 - DNA, 15 bp, Homo sapiens
cattgtatactgttc

SEQ ID NO: 410767 - DNA, 15 bp, Homo sapiens
attgtatactgttcc

SEQ ID NO: 410768 - DNA, 15 bp, Homo sapiens
ttgtatactgttccc

SEQ ID NO: 410769 - DNA, 15 bp, Homo sapiens
tgtatactgttccct

SEQ ID NO: 410770 - DNA, 15 bp, Homo sapiens
gtatactgttccctg

SEQ ID NO: 410771 - DNA, 15 bp, Homo sapiens
tatactgttccctga

SEQ ID NO: 410772 - DNA, 15 bp, Homo sapiens
atactgttccctgat

SEQ ID NO: 410773 - DNA, 15 bp, Homo sapiens
tactgttccctgata

SEQ ID NO: 410774 - DNA, 15 bp, Homo sapiens
actgttccctgatag

SEQ ID NO: 410775 - DNA, 15 bp, Homo sapiens
ctgttccctgataga

SEQ ID NO: 410776 - DNA, 15 bp, Homo sapiens
tgttccctgatagat

SEQ ID NO: 410777 - DNA, 15 bp, Homo sapiens
gttccctgatagatt

SEQ ID NO: 410778 - DNA, 15 bp, Homo sapiens
ttccctgatagattt

SEQ ID NO: 410779 - DNA, 15 bp, Homo sapiens
tccctgatagatttt

SEQ ID NO: 410780 - DNA, 15 bp, Homo sapiens
ccctgatagattttt

SEQ ID NO: 410781 - DNA, 15 bp, Homo sapiens
cctgatagattttta

SEQ ID NO: 410782 - DNA, 15 bp, Homo sapiens
ctgatagatttttag

SEQ ID NO: 410783 - DNA, 15 bp, Homo sapiens
tgatagatttttagt

SEQ ID NO: 410784 - DNA, 15 bp, Homo sapiens
gatagatttttagtt

SEQ ID NO: 410785 - DNA, 15 bp, Homo sapiens
atagatttttagttt

SEQ ID NO: 410786 - DNA, 15 bp, Homo sapiens
tagatttttagtttt

SEQ ID NO: 410787 - DNA, 15 bp, Homo sapiens
agatttttagttttt

SEQ ID NO: 410788 - DNA, 15 bp, Homo sapiens
gatttttagtttttc

SEQ ID NO: 410789 - DNA, 15 bp, Homo sapiens
atttttagtttttct

SEQ ID NO: 410790 - DNA, 15 bp, Homo sapiens
tttttagtttttctg

SEQ ID NO: 410791 - DNA, 15 bp, Homo sapiens
ttttagtttttctgg

SEQ ID NO: 410792 - DNA, 15 bp, Homo sapiens
tttagtttttctggt

SEQ ID NO: 410793 - DNA, 15 bp, Homo sapiens
ttagtttttctggtt

SEQ ID NO: 410794 - DNA, 15 bp, Homo sapiens
tagtttttctggttt

SEQ ID NO: 410795 - DNA, 15 bp, Homo sapiens
agtttttctggtttt

SEQ ID NO: 410796 - DNA, 15 bp, Homo sapiens
gtttttctggtttta

SEQ ID NO: 410797 - DNA, 15 bp, Homo sapiens
tttttctggttttaa

SEQ ID NO: 410798 - DNA, 15 bp, Homo sapiens
ttttctggttttaaa

SEQ ID NO: 410799 - DNA, 15 bp, Homo sapiens
tttctggttttaaat

SEQ ID NO: 410800 - DNA, 15 bp, Homo sapiens
ttctggttttaaatg

SEQ ID NO: 410801 - DNA, 15 bp, Homo sapiens
tctggttttaaatgg

SEQ ID NO: 410802 - DNA, 15 bp, Homo sapiens
ctggttttaaatgga

SEQ ID NO: 410803 - DNA, 15 bp, Homo sapiens
tggttttaaatggaa

SEQ ID NO: 410804 - DNA, 15 bp, Homo sapiens
ggttttaaatggaat

SEQ ID NO: 410805 - DNA, 15 bp, Homo sapiens
gttttaaatggaatc

SEQ ID NO: 410806 - DNA, 15 bp, Homo sapiens
ttttaaatggaatct

SEQ ID NO: 410807 - DNA, 15 bp, Homo sapiens
tttaaatggaatctc

SEQ ID NO: 410808 - DNA, 15 bp, Homo sapiens
ttaaatggaatctct

SEQ ID NO: 410809 - DNA, 15 bp, Homo sapiens
taaatggaatctctt

SEQ ID NO: 410810 - DNA, 15 bp, Homo sapiens
aaatggaatctctta

SEQ ID NO: 410811 - DNA, 15 bp, Homo sapiens
aatggaatctcttac

SEQ ID NO: 410812 - DNA, 15 bp, Homo sapiens
atggaatctcttacg

SEQ ID NO: 410813 - DNA, 15 bp, Homo sapiens
tggaatctcttacga

SEQ ID NO: 410814 - DNA, 15 bp, Homo sapiens
ggaatctcttacgac

SEQ ID NO: 410815 - DNA, 15 bp, Homo sapiens
gaatctcttacgacc

SEQ ID NO: 410816 - DNA, 15 bp, Homo sapiens
aatctcttacgaccc

SEQ ID NO: 410817 - DNA, 15 bp, Homo sapiens
atctcttacgaccca

SEQ ID NO: 410818 - DNA, 15 bp, Homo sapiens
tctcttacgacccat

SEQ ID NO: 410819 - DNA, 15 bp, Homo sapiens
ctcttacgacccatg

SEQ ID NO: 410820 - DNA, 15 bp, Homo sapiens
tcttacgacccatga

SEQ ID NO: 410821 - DNA, 15 bp, Homo sapiens
cttacgacccatgat

SEQ ID NO: 410822 - DNA, 15 bp, Homo sapiens
ttacgacccatgatt

SEQ ID NO: 410823 - DNA, 15 bp, Homo sapiens
tacgacccatgatta

SEQ ID NO: 410824 - DNA, 15 bp, Homo sapiens
acgacccatgattaa

SEQ ID NO: 410825 - DNA, 15 bp, Homo sapiens
cgacccatgattaaa

SEQ ID NO: 410826 - DNA, 15 bp, Homo sapiens
gacccatgattaaat

SEQ ID NO: 410827 - DNA, 15 bp, Homo sapiens
acccatgattaaata

SEQ ID NO: 410828 - DNA, 15 bp, Homo sapiens
cccatgattaaataa

SEQ ID NO: 410829 - DNA, 15 bp, Homo sapiens
ccatgattaaataag

SEQ ID NO: 410830 - DNA, 15 bp, Homo sapiens
catgattaaataagt

SEQ ID NO: 410831 - DNA, 15 bp, Homo sapiens
atgattaaataagtg

SEQ ID NO: 410832 - DNA, 15 bp, Homo sapiens
tgattaaataagtgc

SEQ ID NO: 410833 - DNA, 15 bp, Homo sapiens
gattaaataagtgct

SEQ ID NO: 410834 - DNA, 15 bp, Homo sapiens
attaaataagtgcta

SEQ ID NO: 410835 - DNA, 15 bp, Homo sapiens
ttaaataagtgctaa

SEQ ID NO: 410836 - DNA, 15 bp, Homo sapiens
taaataagtgctaac

SEQ ID NO: 410837 - DNA, 15 bp, Homo sapiens
aaataagtgctaacg

SEQ ID NO: 410838 - DNA, 15 bp, Homo sapiens
aataagtgctaacgg

SEQ ID NO: 410839 - DNA, 15 bp, Homo sapiens
ataagtgctaacggt

SEQ ID NO: 410840 - DNA, 15 bp, Homo sapiens
taagtgctaacggta

SEQ ID NO: 410841 - DNA, 15 bp, Homo sapiens
aagtgctaacggtat

SEQ ID NO: 410842 - DNA, 15 bp, Homo sapiens
agtgctaacggtatt

SEQ ID NO: 410843 - DNA, 15 bp, Homo sapiens
gtgctaacggtattg

SEQ ID NO: 410844 - DNA, 15 bp, Homo sapiens
tgctaacggtattga

SEQ ID NO: 410845 - DNA, 15 bp, Homo sapiens
gctaacggtattgat

SEQ ID NO: 410846 - DNA, 15 bp, Homo sapiens
ctaacggtattgata

SEQ ID NO: 410847 - DNA, 15 bp, Homo sapiens
taacggtattgatat

SEQ ID NO: 410848 - DNA, 15 bp, Homo sapiens
aacggtattgatatt

SEQ ID NO: 410849 - DNA, 15 bp, Homo sapiens
acggtattgatattt

SEQ ID NO: 410850 - DNA, 15 bp, Homo sapiens
cggtattgatattta

SEQ ID NO: 410851 - DNA, 15 bp, Homo sapiens
ggtattgatatttaa

SEQ ID NO: 410852 - DNA, 15 bp, Homo sapiens
gtattgatatttaag

SEQ ID NO: 410853 - DNA, 15 bp, Homo sapiens
tattgatatttaagc

SEQ ID NO: 410854 - DNA, 15 bp, Homo sapiens
attgatatttaagca

SEQ ID NO: 410855 - DNA, 15 bp, Homo sapiens
ttgatatttaagcaa

SEQ ID NO: 410856 - DNA, 15 bp, Homo sapiens
tgatatttaagcaac

SEQ ID NO: 410857 - DNA, 15 bp, Homo sapiens
gatatttaagcaact

SEQ ID NO: 410858 - DNA, 15 bp, Homo sapiens
atatttaagcaactc

SEQ ID NO: 410859 - DNA, 15 bp, Homo sapiens
tatttaagcaactca

SEQ ID NO: 410860 - DNA, 15 bp, Homo sapiens
atttaagcaactcat

SEQ ID NO: 410861 - DNA, 15 bp, Homo sapiens
tttaagcaactcatt

SEQ ID NO: 410862 - DNA, 15 bp, Homo sapiens
ttaagcaactcatta

SEQ ID NO: 410863 - DNA, 15 bp, Homo sapiens
taagcaactcattag

SEQ ID NO: 410864 - DNA, 15 bp, Homo sapiens
aagcaactcattagc

SEQ ID NO: 410865 - DNA, 15 bp, Homo sapiens
agcaactcattagcc

SEQ ID NO: 410866 - DNA, 15 bp, Homo sapiens
gcaactcattagccc

SEQ ID NO: 410867 - DNA, 15 bp, Homo sapiens
caactcattagccct

SEQ ID NO: 410868 - DNA, 15 bp, Homo sapiens
aactcattagccctt

SEQ ID NO: 410869 - DNA, 15 bp, Homo sapiens
actcattagcccttt

SEQ ID NO: 410870 - DNA, 15 bp, Homo sapiens
ctcattagcccttta

SEQ ID NO: 410871 - DNA, 15 bp, Homo sapiens
tcattagccctttag

SEQ ID NO: 410872 - DNA, 15 bp, Homo sapiens
cattagccctttagg

SEQ ID NO: 410873 - DNA, 15 bp, Homo sapiens
attagccctttagga

SEQ ID NO: 410874 - DNA, 15 bp, Homo sapiens
ttagccctttaggag

SEQ ID NO: 410875 - DNA, 15 bp, Homo sapiens
tagccctttaggaga

SEQ ID NO: 410876 - DNA, 15 bp, Homo sapiens
agccctttaggagat

SEQ ID NO: 410877 - DNA, 15 bp, Homo sapiens
gccctttaggagatg

SEQ ID NO: 410878 - DNA, 15 bp, Homo sapiens
ccctttaggagatgc

SEQ ID NO: 410879 - DNA, 15 bp, Homo sapiens
cctttaggagatgca

SEQ ID NO: 410880 - DNA, 15 bp, Homo sapiens
ctttaggagatgcat

SEQ ID NO: 410881 - DNA, 15 bp, Homo sapiens
tttaggagatgcata

SEQ ID NO: 410882 - DNA, 15 bp, Homo sapiens
ttaggagatgcatat

SEQ ID NO: 410883 - DNA, 15 bp, Homo sapiens
taggagatgcatatt

SEQ ID NO: 410884 - DNA, 15 bp, Homo sapiens
aggagatgcatattc

SEQ ID NO: 410885 - DNA, 15 bp, Homo sapiens
ggagatgcatattct

SEQ ID NO: 410886 - DNA, 15 bp, Homo sapiens
gagatgcatattctg

SEQ ID NO: 410887 - DNA, 15 bp, Homo sapiens
agatgcatattctga

SEQ ID NO: 410888 - DNA, 15 bp, Homo sapiens
gatgcatattctgat

SEQ ID NO: 410889 - DNA, 15 bp, Homo sapiens
atgcatattctgatt

SEQ ID NO: 410890 - DNA, 15 bp, Homo sapiens
tgcatattctgattt

SEQ ID NO: 410891 - DNA, 15 bp, Homo sapiens
gcatattctgatttt

SEQ ID NO: 410892 - DNA, 15 bp, Homo sapiens
atattctgattttag

SEQ ID NO: 410893 - DNA, 15 bp, Homo sapiens
tattctgattttagg

SEQ ID NO: 410894 - DNA, 15 bp, Homo sapiens
attctgattttaggg

SEQ ID NO: 410895 - DNA, 15 bp, Homo sapiens
ttctgattttagggg

SEQ ID NO: 410896 - DNA, 15 bp, Homo sapiens
tctgattttaggggt

SEQ ID NO: 410897 - DNA, 15 bp, Homo sapiens
ctgattttaggggtt

SEQ ID NO: 410898 - DNA, 15 bp, Homo sapiens
tgattttaggggttc

SEQ ID NO: 410899 - DNA, 15 bp, Homo sapiens
gattttaggggttcc

SEQ ID NO: 410900 - DNA, 15 bp, Homo sapiens
attttaggggttccc

SEQ ID NO: 410901 - DNA, 15 bp, Homo sapiens
ttttaggggttcccc

SEQ ID NO: 410902 - DNA, 15 bp, Homo sapiens
tttaggggttccccc

SEQ ID NO: 410903 - DNA, 15 bp, Homo sapiens
ttaggggttcccccc

SEQ ID NO: 410904 - DNA, 15 bp, Homo sapiens
taggggttccccccc

SEQ ID NO: 410905 - DNA, 15 bp, Homo sapiens
aggggttcccccccc

SEQ ID NO: 410906 - DNA, 15 bp, Homo sapiens
ggggttccccccccc

SEQ ID NO: 410907 - DNA, 15 bp, Homo sapiens
gggttccccccccca

SEQ ID NO: 410908 - DNA, 15 bp, Homo sapiens
ggttcccccccccac

SEQ ID NO: 410909 - DNA, 15 bp, Homo sapiens
gttcccccccccact

SEQ ID NO: 410910 - DNA, 15 bp, Homo sapiens
ttcccccccccactt

SEQ ID NO: 410911 - DNA, 15 bp, Homo sapiens
tcccccccccacttt

SEQ ID NO: 410912 - DNA, 15 bp, Homo sapiens
cccccccccactttg

SEQ ID NO: 410913 - DNA, 15 bp, Homo sapiens
ccccccccactttgg

SEQ ID NO: 410914 - DNA, 15 bp, Homo sapiens
cccccccactttggt

SEQ ID NO: 410915 - DNA, 15 bp, Homo sapiens
ccccccactttggtc

SEQ ID NO: 410916 - DNA, 15 bp, Homo sapiens
cccccactttggtct

SEQ ID NO: 410917 - DNA, 15 bp, Homo sapiens
ccccactttggtcta

SEQ ID NO: 410918 - DNA, 15 bp, Homo sapiens
cccactttggtctat

SEQ ID NO: 410919 - DNA, 15 bp, Homo sapiens
ccactttggtctatg

SEQ ID NO: 410920 - DNA, 15 bp, Homo sapiens
cactttggtctatgc

SEQ ID NO: 410921 - DNA, 15 bp, Homo sapiens
actttggtctatgcc

SEQ ID NO: 410922 - DNA, 15 bp, Homo sapiens
ctttggtctatgccc

SEQ ID NO: 410923 - DNA, 15 bp, Homo sapiens
tttggtctatgccct

SEQ ID NO: 410924 - DNA, 15 bp, Homo sapiens
ttggtctatgccctg

SEQ ID NO: 410925 - DNA, 15 bp, Homo sapiens
tggtctatgccctga

SEQ ID NO: 410926 - DNA, 15 bp, Homo sapiens
ggtctatgccctgat

SEQ ID NO: 410927 - DNA, 15 bp, Homo sapiens
gtctatgccctgatg

SEQ ID NO: 410928 - DNA, 15 bp, Homo sapiens
tctatgccctgatgc

SEQ ID NO: 410929 - DNA, 15 bp, Homo sapiens
ctatgccctgatgca

SEQ ID NO: 410930 - DNA, 15 bp, Homo sapiens
tatgccctgatgcaa

SEQ ID NO: 410931 - DNA, 15 bp, Homo sapiens
atgccctgatgcaaa

SEQ ID NO: 410932 - DNA, 15 bp, Homo sapiens
tgccctgatgcaaaa

SEQ ID NO: 410933 - DNA, 15 bp, Homo sapiens
gccctgatgcaaaaa

SEQ ID NO: 410934 - DNA, 15 bp, Homo sapiens
ccctgatgcaaaaaa

SEQ ID NO: 410935 - DNA, 15 bp, Homo sapiens
cctgatgcaaaaaaa

SEQ ID NO: 410936 - DNA, 15 bp, Homo sapiens
ctgatgcaaaaaaag

SEQ ID NO: 410937 - DNA, 15 bp, Homo sapiens
tgatgcaaaaaaagt

SEQ ID NO: 410938 - DNA, 15 bp, Homo sapiens
gatgcaaaaaaagta

SEQ ID NO: 410939 - DNA, 15 bp, Homo sapiens
atgcaaaaaaagtaa

SEQ ID NO: 410940 - DNA, 15 bp, Homo sapiens
tgcaaaaaaagtaaa

SEQ ID NO: 410941 - DNA, 15 bp, Homo sapiens
gcaaaaaaagtaaac

SEQ ID NO: 410942 - DNA, 15 bp, Homo sapiens
caaaaaaagtaaact

SEQ ID NO: 410943 - DNA, 15 bp, Homo sapiens
aaaaaaagtaaactt

SEQ ID NO: 410944 - DNA, 15 bp, Homo sapiens
aaaaaagtaaactta

SEQ ID NO: 410945 - DNA, 15 bp, Homo sapiens
aaaaagtaaacttac

SEQ ID NO: 410946 - DNA, 15 bp, Homo sapiens
aaaagtaaacttact

SEQ ID NO: 410947 - DNA, 15 bp, Homo sapiens
aaagtaaacttactt

SEQ ID NO: 410948 - DNA, 15 bp, Homo sapiens
aagtaaacttactta

SEQ ID NO: 410949 - DNA, 15 bp, Homo sapiens
agtaaacttacttat

SEQ ID NO: 410950 - DNA, 15 bp, Homo sapiens
gtaaacttacttata

SEQ ID NO: 410951 - DNA, 15 bp, Homo sapiens
taaacttacttatat

SEQ ID NO: 410952 - DNA, 15 bp, Homo sapiens
aaacttacttatatt

SEQ ID NO: 410953 - DNA, 15 bp, Homo sapiens
aacttacttatatta

SEQ ID NO: 410954 - DNA, 15 bp, Homo sapiens
acttacttatattaa

SEQ ID NO: 410955 - DNA, 15 bp, Homo sapiens
cttacttatattaaa

SEQ ID NO: 410956 - DNA, 15 bp, Homo sapiens
ttacttatattaaaa

SEQ ID NO: 410957 - DNA, 15 bp, Homo sapiens
tacttatattaaaat

SEQ ID NO: 410958 - DNA, 15 bp, Homo sapiens
acttatattaaaatt

SEQ ID NO: 410959 - DNA, 15 bp, Homo sapiens
cttatattaaaattt

SEQ ID NO: 410960 - DNA, 15 bp, Homo sapiens
ttatattaaaattta

SEQ ID NO: 410961 - DNA, 15 bp, Homo sapiens
tatattaaaatttac

SEQ ID NO: 410962 - DNA, 15 bp, Homo sapiens
atattaaaatttaca

SEQ ID NO: 410963 - DNA, 15 bp, Homo sapiens
tattaaaatttacat

SEQ ID NO: 410964 - DNA, 15 bp, Homo sapiens
aaatttacattattc

SEQ ID NO: 410965 - DNA, 15 bp, Homo sapiens
aatttacattattct

SEQ ID NO: 410966 - DNA, 15 bp, Homo sapiens
atttacattattcta

SEQ ID NO: 410967 - DNA, 15 bp, Homo sapiens
tttacattattctac

SEQ ID NO: 410968 - DNA, 15 bp, Homo sapiens
ttacattattctact

SEQ ID NO: 410969 - DNA, 15 bp, Homo sapiens
tacattattctactt

SEQ ID NO: 410970 - DNA, 15 bp, Homo sapiens
acattattctacttg

SEQ ID NO: 410971 - DNA, 15 bp, Homo sapiens
cattattctacttgt

SEQ ID NO: 410972 - DNA, 15 bp, Homo sapiens
attattctacttgtg

SEQ ID NO: 410973 - DNA, 15 bp, Homo sapiens
ttattctacttgtgg

SEQ ID NO: 410974 - DNA, 15 bp, Homo sapiens
tattctacttgtggt

SEQ ID NO: 410975 - DNA, 15 bp, Homo sapiens
attctacttgtggta

SEQ ID NO: 410976 - DNA, 15 bp, Homo sapiens
ttctacttgtggtag

SEQ ID NO: 410977 - DNA, 15 bp, Homo sapiens
tctacttgtggtagt

SEQ ID NO: 410978 - DNA, 15 bp, Homo sapiens
ctacttgtggtagtg

SEQ ID NO: 410979 - DNA, 15 bp, Homo sapiens
tacttgtggtagtgt

SEQ ID NO: 410980 - DNA, 15 bp, Homo sapiens
acttgtggtagtgtc

SEQ ID NO: 410981 - DNA, 15 bp, Homo sapiens
cttgtggtagtgtca

SEQ ID NO: 410982 - DNA, 15 bp, Homo sapiens
ttgtggtagtgtcac

SEQ ID NO: 410983 - DNA, 15 bp, Homo sapiens
tgtggtagtgtcacc

SEQ ID NO: 410984 - DNA, 15 bp, Homo sapiens
gtggtagtgtcacca

SEQ ID NO: 410985 - DNA, 15 bp, Homo sapiens
tggtagtgtcaccat

SEQ ID NO: 410986 - DNA, 15 bp, Homo sapiens
ggtagtgtcaccatt

SEQ ID NO: 410987 - DNA, 15 bp, Homo sapiens
gtagtgtcaccatta

SEQ ID NO: 410988 - DNA, 15 bp, Homo sapiens
tagtgtcaccattat

SEQ ID NO: 410989 - DNA, 15 bp, Homo sapiens
agtgtcaccattata

SEQ ID NO: 410990 - DNA, 15 bp, Homo sapiens
gtgtcaccattataa

SEQ ID NO: 410991 - DNA, 15 bp, Homo sapiens
tgtcaccattataag

SEQ ID NO: 410992 - DNA, 15 bp, Homo sapiens
gtcaccattataagc

SEQ ID NO: 410993 - DNA, 15 bp, Homo sapiens
tcaccattataagca

SEQ ID NO: 410994 - DNA, 15 bp, Homo sapiens
caccattataagcac

SEQ ID NO: 410995 - DNA, 15 bp, Homo sapiens
accattataagcact

SEQ ID NO: 410996 - DNA, 15 bp, Homo sapiens
ccattataagcactg

SEQ ID NO: 410997 - DNA, 15 bp, Homo sapiens
cattataagcactgc

SEQ ID NO: 410998 - DNA, 15 bp, Homo sapiens
attataagcactgca

SEQ ID NO: 410999 - DNA, 15 bp, Homo sapiens
ttataagcactgcat

SEQ ID NO: 411000 - DNA, 15 bp, Homo sapiens
tataagcactgcatc

SEQ ID NO: 411001 - DNA, 15 bp, Homo sapiens
ataagcactgcatct

SEQ ID NO: 411002 - DNA, 15 bp, Homo sapiens
taagcactgcatctt

SEQ ID NO: 411003 - DNA, 15 bp, Homo sapiens
aagcactgcatcttt

SEQ ID NO: 411004 - DNA, 15 bp, Homo sapiens
agcactgcatcttta

SEQ ID NO: 411005 - DNA, 15 bp, Homo sapiens
gcactgcatctttat

SEQ ID NO: 411006 - DNA, 15 bp, Homo sapiens
cactgcatctttatg

SEQ ID NO: 411007 - DNA, 15 bp, Homo sapiens
actgcatctttatga

SEQ ID NO: 411008 - DNA, 15 bp, Homo sapiens
ctgcatctttatgat

SEQ ID NO: 411009 - DNA, 15 bp, Homo sapiens
tgcatctttatgatg

SEQ ID NO: 411010 - DNA, 15 bp, Homo sapiens
gcatctttatgatga

SEQ ID NO: 411011 - DNA, 15 bp, Homo sapiens
catctttatgatgaa

SEQ ID NO: 411012 - DNA, 15 bp, Homo sapiens
atctttatgatgaaa

SEQ ID NO: 411013 - DNA, 15 bp, Homo sapiens
tctttatgatgaaac

SEQ ID NO: 411014 - DNA, 15 bp, Homo sapiens
ctttatgatgaaact

SEQ ID NO: 411015 - DNA, 15 bp, Homo sapiens
tttatgatgaaactc

SEQ ID NO: 411016 - DNA, 15 bp, Homo sapiens
ttatgatgaaactct

SEQ ID NO: 411017 - DNA, 15 bp, Homo sapiens
tatgatgaaactctg

SEQ ID NO: 411018 - DNA, 15 bp, Homo sapiens
atgatgaaactctgc

SEQ ID NO: 411019 - DNA, 15 bp, Homo sapiens
tgatgaaactctgcc

SEQ ID NO: 411020 - DNA, 15 bp, Homo sapiens
gatgaaactctgcct

SEQ ID NO: 411021 - DNA, 15 bp, Homo sapiens
atgaaactctgccta

SEQ ID NO: 411022 - DNA, 15 bp, Homo sapiens
tgaaactctgcctac

SEQ ID NO: 411023 - DNA, 15 bp, Homo sapiens
gaaactctgcctaca

SEQ ID NO: 411024 - DNA, 15 bp, Homo sapiens
aaactctgcctacaa

SEQ ID NO: 411025 - DNA, 15 bp, Homo sapiens
aactctgcctacaac

SEQ ID NO: 411026 - DNA, 15 bp, Homo sapiens
actctgcctacaact

SEQ ID NO: 411027 - DNA, 15 bp, Homo sapiens
ctctgcctacaacta

SEQ ID NO: 411028 - DNA, 15 bp, Homo sapiens
tctgcctacaactag

SEQ ID NO: 411029 - DNA, 15 bp, Homo sapiens
ctgcctacaactaga

SEQ ID NO: 411030 - DNA, 15 bp, Homo sapiens
tgcctacaactagag

SEQ ID NO: 411031 - DNA, 15 bp, Homo sapiens
gcctacaactagaga

SEQ ID NO: 411032 - DNA, 15 bp, Homo sapiens
cctacaactagagaa

SEQ ID NO: 411033 - DNA, 15 bp, Homo sapiens
ctacaactagagaaa

SEQ ID NO: 411034 - DNA, 15 bp, Homo sapiens
tacaactagagaaac

SEQ ID NO: 411035 - DNA, 15 bp, Homo sapiens
acaactagagaaaca

SEQ ID NO: 411036 - DNA, 15 bp, Homo sapiens
caactagagaaacat

SEQ ID NO: 411037 - DNA, 15 bp, Homo sapiens
aactagagaaacatg

SEQ ID NO: 411038 - DNA, 15 bp, Homo sapiens
actagagaaacatgt

SEQ ID NO: 411039 - DNA, 15 bp, Homo sapiens
ctagagaaacatgtt

SEQ ID NO: 411040 - DNA, 15 bp, Homo sapiens
tagagaaacatgttt

SEQ ID NO: 411041 - DNA, 15 bp, Homo sapiens
agagaaacatgtttc

SEQ ID NO: 411042 - DNA, 15 bp, Homo sapiens
gagaaacatgtttca

SEQ ID NO: 411043 - DNA, 15 bp, Homo sapiens
agaaacatgtttcaa

SEQ ID NO: 411044 - DNA, 15 bp, Homo sapiens
gaaacatgtttcaaa

SEQ ID NO: 411045 - DNA, 15 bp, Homo sapiens
aaacatgtttcaaat

SEQ ID NO: 411046 - DNA, 15 bp, Homo sapiens
aacatgtttcaaatg

SEQ ID NO: 411047 - DNA, 15 bp, Homo sapiens
acatgtttcaaatgg

SEQ ID NO: 411048 - DNA, 15 bp, Homo sapiens
catgtttcaaatgga

SEQ ID NO: 411049 - DNA, 15 bp, Homo sapiens
atgtttcaaatggac

SEQ ID NO: 411050 - DNA, 15 bp, Homo sapiens
tgtttcaaatggaca

SEQ ID NO: 411051 - DNA, 15 bp, Homo sapiens
gtttcaaatggacat

SEQ ID NO: 411052 - DNA, 15 bp, Homo sapiens
tttcaaatggacatt

SEQ ID NO: 411053 - DNA, 15 bp, Homo sapiens
ttcaaatggacattt

SEQ ID NO: 411054 - DNA, 15 bp, Homo sapiens
tcaaatggacatttc

SEQ ID NO: 411055 - DNA, 15 bp, Homo sapiens
caaatggacatttct

SEQ ID NO: 411056 - DNA, 15 bp, Homo sapiens
aaatggacatttctg

SEQ ID NO: 411057 - DNA, 15 bp, Homo sapiens
aatggacatttctgt

SEQ ID NO: 411058 - DNA, 15 bp, Homo sapiens
atggacatttctgtt

SEQ ID NO: 411059 - DNA, 15 bp, Homo sapiens
tggacatttctgtta

SEQ ID NO: 411060 - DNA, 15 bp, Homo sapiens
ggacatttctgttat

SEQ ID NO: 411061 - DNA, 15 bp, Homo sapiens
gacatttctgttata

SEQ ID NO: 411062 - DNA, 15 bp, Homo sapiens
acatttctgttatac

SEQ ID NO: 411063 - DNA, 15 bp, Homo sapiens
catttctgttatact

SEQ ID NO: 411064 - DNA, 15 bp, Homo sapiens
atttctgttatactt

SEQ ID NO: 411065 - DNA, 15 bp, Homo sapiens
tttctgttatacttt

SEQ ID NO: 411066 - DNA, 15 bp, Homo sapiens
ttctgttatacttta

SEQ ID NO: 411067 - DNA, 15 bp, Homo sapiens
tctgttatactttat

SEQ ID NO: 411068 - DNA, 15 bp, Homo sapiens
ctgttatactttatt

SEQ ID NO: 411069 - DNA, 15 bp, Homo sapiens
tgttatactttattg

SEQ ID NO: 411070 - DNA, 15 bp, Homo sapiens
gttatactttattgg

SEQ ID NO: 411071 - DNA, 15 bp, Homo sapiens
ttatactttattggt

SEQ ID NO: 411072 - DNA, 15 bp, Homo sapiens
tatactttattggta

SEQ ID NO: 411073 - DNA, 15 bp, Homo sapiens
atactttattggtat

SEQ ID NO: 411074 - DNA, 15 bp, Homo sapiens
tactttattggtata

SEQ ID NO: 411075 - DNA, 15 bp, Homo sapiens
actttattggtatac

SEQ ID NO: 411076 - DNA, 15 bp, Homo sapiens
ctttattggtatact

SEQ ID NO: 411077 - DNA, 15 bp, Homo sapiens
tttattggtatactg

SEQ ID NO: 411078 - DNA, 15 bp, Homo sapiens
ttattggtatactgt

SEQ ID NO: 411079 - DNA, 15 bp, Homo sapiens
tattggtatactgta

SEQ ID NO: 411080 - DNA, 15 bp, Homo sapiens
attggtatactgtat

SEQ ID NO: 411081 - DNA, 15 bp, Homo sapiens
ttggtatactgtata

SEQ ID NO: 411082 - DNA, 15 bp, Homo sapiens
tggtatactgtatag

SEQ ID NO: 411083 - DNA, 15 bp, Homo sapiens
ggtatactgtatagc

SEQ ID NO: 411084 - DNA, 15 bp, Homo sapiens
gtatactgtatagct

SEQ ID NO: 411085 - DNA, 15 bp, Homo sapiens
tatactgtatagcta

SEQ ID NO: 411086 - DNA, 15 bp, Homo sapiens
atactgtatagctat

SEQ ID NO: 411087 - DNA, 15 bp, Homo sapiens
tactgtatagctatg

SEQ ID NO: 411088 - DNA, 15 bp, Homo sapiens
actgtatagctatgt

SEQ ID NO: 411089 - DNA, 15 bp, Homo sapiens
ctgtatagctatgta

SEQ ID NO: 411090 - DNA, 15 bp, Homo sapiens
tgtatagctatgtaa

SEQ ID NO: 411091 - DNA, 15 bp, Homo sapiens
gtatagctatgtaat

SEQ ID NO: 411092 - DNA, 15 bp, Homo sapiens
tatagctatgtaatg

SEQ ID NO: 411093 - DNA, 15 bp, Homo sapiens
atagctatgtaatgc

SEQ ID NO: 411094 - DNA, 15 bp, Homo sapiens
tagctatgtaatgca

SEQ ID NO: 411095 - DNA, 15 bp, Homo sapiens
agctatgtaatgcaa

SEQ ID NO: 411096 - DNA, 15 bp, Homo sapiens
gctatgtaatgcaaa

SEQ ID NO: 411097 - DNA, 15 bp, Homo sapiens
ctatgtaatgcaaaa

SEQ ID NO: 411098 - DNA, 15 bp, Homo sapiens
tatgtaatgcaaaag

SEQ ID NO: 411099 - DNA, 15 bp, Homo sapiens
atgtaatgcaaaagc

SEQ ID NO: 411100 - DNA, 15 bp, Homo sapiens
tgtaatgcaaaagca

SEQ ID NO: 411101 - DNA, 15 bp, Homo sapiens
gtaatgcaaaagcaa

SEQ ID NO: 411102 - DNA, 15 bp, Homo sapiens
taatgcaaaagcaaa

SEQ ID NO: 411103 - DNA, 15 bp, Homo sapiens
aatgcaaaagcaaaa

SEQ ID NO: 411104 - DNA, 15 bp, Homo sapiens
atgcaaaagcaaaat

SEQ ID NO: 411105 - DNA, 15 bp, Homo sapiens
tgcaaaagcaaaatc

SEQ ID NO: 411106 - DNA, 15 bp, Homo sapiens
gcaaaagcaaaatca

SEQ ID NO: 411107 - DNA, 15 bp, Homo sapiens
caaaagcaaaatcac

SEQ ID NO: 411108 - DNA, 15 bp, Homo sapiens
aaaagcaaaatcaca

SEQ ID NO: 411109 - DNA, 15 bp, Homo sapiens
aaagcaaaatcacat

SEQ ID NO: 411110 - DNA, 15 bp, Homo sapiens
aagcaaaatcacatt

SEQ ID NO: 411111 - DNA, 15 bp, Homo sapiens
agcaaaatcacattt

SEQ ID NO: 411112 - DNA, 15 bp, Homo sapiens
gcaaaatcacatttg

SEQ ID NO: 411113 - DNA, 15 bp, Homo sapiens
caaaatcacatttgc

SEQ ID NO: 411114 - DNA, 15 bp, Homo sapiens
aaaatcacatttgcc

SEQ ID NO: 411115 - DNA, 15 bp, Homo sapiens
aaatcacatttgcct

SEQ ID NO: 411116 - DNA, 15 bp, Homo sapiens
aatcacatttgcctt

SEQ ID NO: 411117 - DNA, 15 bp, Homo sapiens
atcacatttgccttg

SEQ ID NO: 411118 - DNA, 15 bp, Homo sapiens
tcacatttgccttgg

SEQ ID NO: 411119 - DNA, 15 bp, Homo sapiens
cacatttgccttgga

SEQ ID NO: 411120 - DNA, 15 bp, Homo sapiens
acatttgccttggaa

SEQ ID NO: 411121 - DNA, 15 bp, Homo sapiens
catttgccttggaat

SEQ ID NO: 411122 - DNA, 15 bp, Homo sapiens
atttgccttggaatg

SEQ ID NO: 411123 - DNA, 15 bp, Homo sapiens
tttgccttggaatga

SEQ ID NO: 411124 - DNA, 15 bp, Homo sapiens
ttgccttggaatgat

SEQ ID NO: 411125 - DNA, 15 bp, Homo sapiens
tgccttggaatgata

SEQ ID NO: 411126 - DNA, 15 bp, Homo sapiens
gccttggaatgatat

SEQ ID NO: 411127 - DNA, 15 bp, Homo sapiens
ccttggaatgatatc

SEQ ID NO: 411128 - DNA, 15 bp, Homo sapiens
cttggaatgatatcc

SEQ ID NO: 411129 - DNA, 15 bp, Homo sapiens
ttggaatgatatcca

SEQ ID NO: 411130 - DNA, 15 bp, Homo sapiens
tggaatgatatccat

SEQ ID NO: 411131 - DNA, 15 bp, Homo sapiens
ggaatgatatccata

SEQ ID NO: 411132 - DNA, 15 bp, Homo sapiens
gaatgatatccataa

SEQ ID NO: 411133 - DNA, 15 bp, Homo sapiens
aatgatatccataat

SEQ ID NO: 411134 - DNA, 15 bp, Homo sapiens
atgatatccataata

SEQ ID NO: 411135 - DNA, 15 bp, Homo sapiens
tgatatccataatat

SEQ ID NO: 411136 - DNA, 15 bp, Homo sapiens
gatatccataatatc

SEQ ID NO: 411137 - DNA, 15 bp, Homo sapiens
atatccataatatca

SEQ ID NO: 411138 - DNA, 15 bp, Homo sapiens
tatccataatatcac

SEQ ID NO: 411139 - DNA, 15 bp, Homo sapiens
atccataatatcact

SEQ ID NO: 411140 - DNA, 15 bp, Homo sapiens
tccataatatcacta

SEQ ID NO: 411141 - DNA, 15 bp, Homo sapiens
ccataatatcactac

SEQ ID NO: 411142 - DNA, 15 bp, Homo sapiens
cataatatcactaca

SEQ ID NO: 411143 - DNA, 15 bp, Homo sapiens
ataatatcactacaa

SEQ ID NO: 411144 - DNA, 15 bp, Homo sapiens
taatatcactacaaa

SEQ ID NO: 411145 - DNA, 15 bp, Homo sapiens
aatatcactacaaag

SEQ ID NO: 411146 - DNA, 15 bp, Homo sapiens
atatcactacaaaga

SEQ ID NO: 411147 - DNA, 15 bp, Homo sapiens
tatcactacaaagaa

SEQ ID NO: 411148 - DNA, 15 bp, Homo sapiens
atcactacaaagaat

SEQ ID NO: 411149 - DNA, 15 bp, Homo sapiens
tcactacaaagaatt

SEQ ID NO: 411150 - DNA, 15 bp, Homo sapiens
cactacaaagaattt

SEQ ID NO: 411151 - DNA, 15 bp, Homo sapiens
actacaaagaattta

SEQ ID NO: 411152 - DNA, 15 bp, Homo sapiens
ctacaaagaatttat

SEQ ID NO: 411153 - DNA, 15 bp, Homo sapiens
tacaaagaatttata

SEQ ID NO: 411154 - DNA, 15 bp, Homo sapiens
acaaagaatttataa

SEQ ID NO: 411155 - DNA, 15 bp, Homo sapiens
caaagaatttataat

SEQ ID NO: 411156 - DNA, 15 bp, Homo sapiens
aaagaatttataatt

SEQ ID NO: 411157 - DNA, 15 bp, Homo sapiens
aagaatttataattt

SEQ ID NO: 411158 - DNA, 15 bp, Homo sapiens
agaatttataatttg

SEQ ID NO: 411159 - DNA, 15 bp, Homo sapiens
gaatttataatttgg

SEQ ID NO: 411160 - DNA, 15 bp, Homo sapiens
aatttataatttgga

SEQ ID NO: 411161 - DNA, 15 bp, Homo sapiens
atttataatttggat

SEQ ID NO: 411162 - DNA, 15 bp, Homo sapiens
tttataatttggatt

SEQ ID NO: 411163 - DNA, 15 bp, Homo sapiens
ttataatttggattg

SEQ ID NO: 411164 - DNA, 15 bp, Homo sapiens
tataatttggattgg

SEQ ID NO: 411165 - DNA, 15 bp, Homo sapiens
ataatttggattgga

SEQ ID NO: 411166 - DNA, 15 bp, Homo sapiens
taatttggattggag

SEQ ID NO: 411167 - DNA, 15 bp, Homo sapiens
aatttggattggagt

SEQ ID NO: 411168 - DNA, 15 bp, Homo sapiens
atttggattggagtt

SEQ ID NO: 411169 - DNA, 15 bp, Homo sapiens
tttggattggagttt

SEQ ID NO: 411170 - DNA, 15 bp, Homo sapiens
ttggattggagtttt

SEQ ID NO: 411171 - DNA, 15 bp, Homo sapiens
tggattggagttttt

SEQ ID NO: 411172 - DNA, 15 bp, Homo sapiens
ggattggagtttttt

SEQ ID NO: 411173 - DNA, 15 bp, Homo sapiens
gattggagttttttt

SEQ ID NO: 411174 - DNA, 15 bp, Homo sapiens
attggagtttttttc

SEQ ID NO: 411175 - DNA, 15 bp, Homo sapiens
ttggagtttttttct

SEQ ID NO: 411176 - DNA, 15 bp, Homo sapiens
tggagtttttttctt

SEQ ID NO: 411177 - DNA, 15 bp, Homo sapiens
ggagtttttttcttt

SEQ ID NO: 411178 - DNA, 15 bp, Homo sapiens
gagtttttttcttta

SEQ ID NO: 411179 - DNA, 15 bp, Homo sapiens
agtttttttctttaa

SEQ ID NO: 411180 - DNA, 15 bp, Homo sapiens
gtttttttctttaaa

SEQ ID NO: 411181 - DNA, 15 bp, Homo sapiens
tttttttctttaaag

SEQ ID NO: 411182 - DNA, 15 bp, Homo sapiens
ttttttctttaaagc

SEQ ID NO: 411183 - DNA, 15 bp, Homo sapiens
tttttctttaaagcg

SEQ ID NO: 411184 - DNA, 15 bp, Homo sapiens
ttttctttaaagcga

SEQ ID NO: 411185 - DNA, 15 bp, Homo sapiens
tttctttaaagcgat

SEQ ID NO: 411186 - DNA, 15 bp, Homo sapiens
ttctttaaagcgatg

SEQ ID NO: 411187 - DNA, 15 bp, Homo sapiens
tctttaaagcgatga

SEQ ID NO: 411188 - DNA, 15 bp, Homo sapiens
ctttaaagcgatgac

SEQ ID NO: 411189 - DNA, 15 bp, Homo sapiens
tttaaagcgatgaca

SEQ ID NO: 411190 - DNA, 15 bp, Homo sapiens
ttaaagcgatgacac

SEQ ID NO: 411191 - DNA, 15 bp, Homo sapiens
taaagcgatgacact

SEQ ID NO: 411192 - DNA, 15 bp, Homo sapiens
aaagcgatgacactt

SEQ ID NO: 411193 - DNA, 15 bp, Homo sapiens
aagcgatgacactta

SEQ ID NO: 411194 - DNA, 15 bp, Homo sapiens
agcgatgacacttaa

SEQ ID NO: 411195 - DNA, 15 bp, Homo sapiens
gcgatgacacttaaa

SEQ ID NO: 411196 - DNA, 15 bp, Homo sapiens
cgatgacacttaaaa

SEQ ID NO: 411197 - DNA, 15 bp, Homo sapiens
gatgacacttaaaac

SEQ ID NO: 411198 - DNA, 15 bp, Homo sapiens
atgacacttaaaact

SEQ ID NO: 411199 - DNA, 15 bp, Homo sapiens
tgacacttaaaactt

SEQ ID NO: 411200 - DNA, 15 bp, Homo sapiens
gacacttaaaacttc

SEQ ID NO: 411201 - DNA, 15 bp, Homo sapiens
acacttaaaacttcc

SEQ ID NO: 411202 - DNA, 15 bp, Homo sapiens
cacttaaaacttcct

SEQ ID NO: 411203 - DNA, 15 bp, Homo sapiens
acttaaaacttcctg

SEQ ID NO: 411204 - DNA, 15 bp, Homo sapiens
cttaaaacttcctgg

SEQ ID NO: 411205 - DNA, 15 bp, Homo sapiens
ttaaaacttcctgga

SEQ ID NO: 411206 - DNA, 15 bp, Homo sapiens
taaaacttcctggaa

SEQ ID NO: 411207 - DNA, 15 bp, Homo sapiens
aaaacttcctggaag

SEQ ID NO: 411208 - DNA, 15 bp, Homo sapiens
aaacttcctggaaga

SEQ ID NO: 411209 - DNA, 15 bp, Homo sapiens
aacttcctggaagat

SEQ ID NO: 411210 - DNA, 15 bp, Homo sapiens
acttcctggaagatg

SEQ ID NO: 411211 - DNA, 15 bp, Homo sapiens
cttcctggaagatgg

SEQ ID NO: 411212 - DNA, 15 bp, Homo sapiens
ttcctggaagatggt

SEQ ID NO: 411213 - DNA, 15 bp, Homo sapiens
tcctggaagatggtg

SEQ ID NO: 411214 - DNA, 15 bp, Homo sapiens
cctggaagatggtgt

SEQ ID NO: 411215 - DNA, 15 bp, Homo sapiens
ctggaagatggtgtt

SEQ ID NO: 411216 - DNA, 15 bp, Homo sapiens
tggaagatggtgttt

SEQ ID NO: 411217 - DNA, 15 bp, Homo sapiens
ggaagatggtgtttc

SEQ ID NO: 411218 - DNA, 15 bp, Homo sapiens
gaagatggtgtttct

SEQ ID NO: 411219 - DNA, 15 bp, Homo sapiens
aagatggtgtttctc

SEQ ID NO: 411220 - DNA, 15 bp, Homo sapiens
agatggtgtttctct

SEQ ID NO: 411221 - DNA, 15 bp, Homo sapiens
gatggtgtttctctg

SEQ ID NO: 411222 - DNA, 15 bp, Homo sapiens
atggtgtttctctga

SEQ ID NO: 411223 - DNA, 15 bp, Homo sapiens
tggtgtttctctgag

SEQ ID NO: 411224 - DNA, 15 bp, Homo sapiens
ggtgtttctctgagt

SEQ ID NO: 411225 - DNA, 15 bp, Homo sapiens
gtgtttctctgagtg

SEQ ID NO: 411226 - DNA, 15 bp, Homo sapiens
tgtttctctgagtgc

SEQ ID NO: 411227 - DNA, 15 bp, Homo sapiens
gtttctctgagtgcc

SEQ ID NO: 411228 - DNA, 15 bp, Homo sapiens
tttctctgagtgcca

SEQ ID NO: 411229 - DNA, 15 bp, Homo sapiens
ttctctgagtgccag

SEQ ID NO: 411230 - DNA, 15 bp, Homo sapiens
tctctgagtgccagt

SEQ ID NO: 411231 - DNA, 15 bp, Homo sapiens
ctctgagtgccagta

SEQ ID NO: 411232 - DNA, 15 bp, Homo sapiens
tctgagtgccagtag

SEQ ID NO: 411233 - DNA, 15 bp, Homo sapiens
ctgagtgccagtagt

SEQ ID NO: 411234 - DNA, 15 bp, Homo sapiens
tgagtgccagtagta

SEQ ID NO: 411235 - DNA, 15 bp, Homo sapiens
gagtgccagtagtaa

SEQ ID NO: 411236 - DNA, 15 bp, Homo sapiens
agtgccagtagtaat

SEQ ID NO: 411237 - DNA, 15 bp, Homo sapiens
gtgccagtagtaatt

SEQ ID NO: 411238 - DNA, 15 bp, Homo sapiens
tgccagtagtaattt

SEQ ID NO: 411239 - DNA, 15 bp, Homo sapiens
gccagtagtaattta

SEQ ID NO: 411240 - DNA, 15 bp, Homo sapiens
ccagtagtaatttaa

SEQ ID NO: 411241 - DNA, 15 bp, Homo sapiens
cagtagtaatttaac

SEQ ID NO: 411242 - DNA, 15 bp, Homo sapiens
agtagtaatttaaca

SEQ ID NO: 411243 - DNA, 15 bp, Homo sapiens
gtagtaatttaacat

SEQ ID NO: 411244 - DNA, 15 bp, Homo sapiens
tagtaatttaacatc

SEQ ID NO: 411245 - DNA, 15 bp, Homo sapiens
agtaatttaacatca

SEQ ID NO: 411246 - DNA, 15 bp, Homo sapiens
gtaatttaacatcaa

SEQ ID NO: 411247 - DNA, 15 bp, Homo sapiens
taatttaacatcaaa

SEQ ID NO: 411248 - DNA, 15 bp, Homo sapiens
aatttaacatcaaaa

SEQ ID NO: 411249 - DNA, 15 bp, Homo sapiens
atttaacatcaaaat

SEQ ID NO: 411250 - DNA, 15 bp, Homo sapiens
tttaacatcaaaatg

SEQ ID NO: 411251 - DNA, 15 bp, Homo sapiens
ttaacatcaaaatgg

SEQ ID NO: 411252 - DNA, 15 bp, Homo sapiens
taacatcaaaatgga

SEQ ID NO: 411253 - DNA, 15 bp, Homo sapiens
aacatcaaaatggaa

SEQ ID NO: 411254 - DNA, 15 bp, Homo sapiens
acatcaaaatggaag

SEQ ID NO: 411255 - DNA, 15 bp, Homo sapiens
catcaaaatggaaga

SEQ ID NO: 411256 - DNA, 15 bp, Homo sapiens
atcaaaatggaagac

SEQ ID NO: 411257 - DNA, 15 bp, Homo sapiens
tcaaaatggaagaca

SEQ ID NO: 411258 - DNA, 15 bp, Homo sapiens
caaaatggaagacac

SEQ ID NO: 411259 - DNA, 15 bp, Homo sapiens
aaaatggaagacaca

SEQ ID NO: 411260 - DNA, 15 bp, Homo sapiens
aaatggaagacacat

SEQ ID NO: 411261 - DNA, 15 bp, Homo sapiens
aatggaagacacatt

SEQ ID NO: 411262 - DNA, 15 bp, Homo sapiens
atggaagacacattc

SEQ ID NO: 411263 - DNA, 15 bp, Homo sapiens
tggaagacacattca

SEQ ID NO: 411264 - DNA, 15 bp, Homo sapiens
ggaagacacattcaa

SEQ ID NO: 411265 - DNA, 15 bp, Homo sapiens
gaagacacattcaat

SEQ ID NO: 411266 - DNA, 15 bp, Homo sapiens
aagacacattcaatg

SEQ ID NO: 411267 - DNA, 15 bp, Homo sapiens
agacacattcaatgt

SEQ ID NO: 411268 - DNA, 15 bp, Homo sapiens
gacacattcaatgta

SEQ ID NO: 411269 - DNA, 15 bp, Homo sapiens
acacattcaatgtag

SEQ ID NO: 411270 - DNA, 15 bp, Homo sapiens
cacattcaatgtagt

SEQ ID NO: 411271 - DNA, 15 bp, Homo sapiens
acattcaatgtagtt

SEQ ID NO: 411272 - DNA, 15 bp, Homo sapiens
cattcaatgtagtta

SEQ ID NO: 411273 - DNA, 15 bp, Homo sapiens
attcaatgtagttat

SEQ ID NO: 411274 - DNA, 15 bp, Homo sapiens
ttcaatgtagttatt

SEQ ID NO: 411275 - DNA, 15 bp, Homo sapiens
tcaatgtagttatta

SEQ ID NO: 411276 - DNA, 15 bp, Homo sapiens
caatgtagttattac

SEQ ID NO: 411277 - DNA, 15 bp, Homo sapiens
aatgtagttattact

SEQ ID NO: 411278 - DNA, 15 bp, Homo sapiens
atgtagttattactc

SEQ ID NO: 411279 - DNA, 15 bp, Homo sapiens
tgtagttattactca

SEQ ID NO: 411280 - DNA, 15 bp, Homo sapiens
gtagttattactcac

SEQ ID NO: 411281 - DNA, 15 bp, Homo sapiens
tagttattactcaca

SEQ ID NO: 411282 - DNA, 15 bp, Homo sapiens
agttattactcacat

SEQ ID NO: 411283 - DNA, 15 bp, Homo sapiens
gttattactcacatt

SEQ ID NO: 411284 - DNA, 15 bp, Homo sapiens
ttattactcacattt

SEQ ID NO: 411285 - DNA, 15 bp, Homo sapiens
tattactcacatttt

SEQ ID NO: 411286 - DNA, 15 bp, Homo sapiens
attactcacattttg

SEQ ID NO: 411287 - DNA, 15 bp, Homo sapiens
ttactcacattttga

SEQ ID NO: 411288 - DNA, 15 bp, Homo sapiens
tactcacattttgag

SEQ ID NO: 411289 - DNA, 15 bp, Homo sapiens
actcacattttgagt

SEQ ID NO: 411290 - DNA, 15 bp, Homo sapiens
ctcacattttgagta

SEQ ID NO: 411291 - DNA, 15 bp, Homo sapiens
tcacattttgagtac

SEQ ID NO: 411292 - DNA, 15 bp, Homo sapiens
cacattttgagtaca

SEQ ID NO: 411293 - DNA, 15 bp, Homo sapiens
acattttgagtacag

SEQ ID NO: 411294 - DNA, 15 bp, Homo sapiens
cattttgagtacagt

SEQ ID NO: 411295 - DNA, 15 bp, Homo sapiens
attttgagtacagta

SEQ ID NO: 411296 - DNA, 15 bp, Homo sapiens
ttttgagtacagtag

SEQ ID NO: 411297 - DNA, 15 bp, Homo sapiens
tttgagtacagtagt

SEQ ID NO: 411298 - DNA, 15 bp, Homo sapiens
ttgagtacagtagtt

SEQ ID NO: 411299 - DNA, 15 bp, Homo sapiens
tgagtacagtagttt

SEQ ID NO: 411300 - DNA, 15 bp, Homo sapiens
gagtacagtagtttc

SEQ ID NO: 411301 - DNA, 15 bp, Homo sapiens
agtacagtagtttct

SEQ ID NO: 411302 - DNA, 15 bp, Homo sapiens
gtacagtagtttctc

SEQ ID NO: 411303 - DNA, 15 bp, Homo sapiens
tacagtagtttctct

SEQ ID NO: 411304 - DNA, 15 bp, Homo sapiens
acagtagtttctctc

SEQ ID NO: 411305 - DNA, 15 bp, Homo sapiens
cagtagtttctctca

SEQ ID NO: 411306 - DNA, 15 bp, Homo sapiens
agtagtttctctcat

SEQ ID NO: 411307 - DNA, 15 bp, Homo sapiens
gtagtttctctcatt

SEQ ID NO: 411308 - DNA, 15 bp, Homo sapiens
tagtttctctcatta

SEQ ID NO: 411309 - DNA, 15 bp, Homo sapiens
agtttctctcattaa

SEQ ID NO: 411310 - DNA, 15 bp, Homo sapiens
gtttctctcattaag

SEQ ID NO: 411311 - DNA, 15 bp, Homo sapiens
tttctctcattaagt

SEQ ID NO: 411312 - DNA, 15 bp, Homo sapiens
ttctctcattaagtt

SEQ ID NO: 411313 - DNA, 15 bp, Homo sapiens
tctctcattaagttt

SEQ ID NO: 411314 - DNA, 15 bp, Homo sapiens
ctctcattaagtttt

SEQ ID NO: 411315 - DNA, 15 bp, Homo sapiens
tctcattaagtttta

SEQ ID NO: 411316 - DNA, 15 bp, Homo sapiens
ctcattaagttttat

SEQ ID NO: 411317 - DNA, 15 bp, Homo sapiens
tcattaagttttatg

SEQ ID NO: 411318 - DNA, 15 bp, Homo sapiens
cattaagttttatgt

SEQ ID NO: 411319 - DNA, 15 bp, Homo sapiens
attaagttttatgtc

SEQ ID NO: 411320 - DNA, 15 bp, Homo sapiens
ttaagttttatgtca

SEQ ID NO: 411321 - DNA, 15 bp, Homo sapiens
taagttttatgtcag

SEQ ID NO: 411322 - DNA, 15 bp, Homo sapiens
aagttttatgtcaga

SEQ ID NO: 411323 - DNA, 15 bp, Homo sapiens
agttttatgtcagaa

SEQ ID NO: 411324 - DNA, 15 bp, Homo sapiens
gttttatgtcagaaa

SEQ ID NO: 411325 - DNA, 15 bp, Homo sapiens
ttttatgtcagaaac

SEQ ID NO: 411326 - DNA, 15 bp, Homo sapiens
tttatgtcagaaaca

SEQ ID NO: 411327 - DNA, 15 bp, Homo sapiens
ttatgtcagaaacaa

SEQ ID NO: 411328 - DNA, 15 bp, Homo sapiens
tatgtcagaaacaag

SEQ ID NO: 411329 - DNA, 15 bp, Homo sapiens
atgtcagaaacaagt

SEQ ID NO: 411330 - DNA, 15 bp, Homo sapiens
tgtcagaaacaagta

SEQ ID NO: 411331 - DNA, 15 bp, Homo sapiens
gtcagaaacaagtaa

SEQ ID NO: 411332 - DNA, 15 bp, Homo sapiens
tcagaaacaagtaaa

SEQ ID NO: 411333 - DNA, 15 bp, Homo sapiens
cagaaacaagtaaat

SEQ ID NO: 411334 - DNA, 15 bp, Homo sapiens
agaaacaagtaaatt

SEQ ID NO: 411335 - DNA, 15 bp, Homo sapiens
gaaacaagtaaattc

SEQ ID NO: 411336 - DNA, 15 bp, Homo sapiens
aaacaagtaaattcc

SEQ ID NO: 411337 - DNA, 15 bp, Homo sapiens
aacaagtaaattccc

SEQ ID NO: 411338 - DNA, 15 bp, Homo sapiens
acaagtaaattccct

SEQ ID NO: 411339 - DNA, 15 bp, Homo sapiens
caagtaaattcccta

SEQ ID NO: 411340 - DNA, 15 bp, Homo sapiens
aagtaaattccctat

SEQ ID NO: 411341 - DNA, 15 bp, Homo sapiens
agtaaattccctata

SEQ ID NO: 411342 - DNA, 15 bp, Homo sapiens
gtaaattccctataa

SEQ ID NO: 411343 - DNA, 15 bp, Homo sapiens
taaattccctataag

SEQ ID NO: 411344 - DNA, 15 bp, Homo sapiens
aaattccctataaga

SEQ ID NO: 411345 - DNA, 15 bp, Homo sapiens
aattccctataagaa

SEQ ID NO: 411346 - DNA, 15 bp, Homo sapiens
attccctataagaaa

SEQ ID NO: 411347 - DNA, 15 bp, Homo sapiens
ttccctataagaaaa

SEQ ID NO: 411348 - DNA, 15 bp, Homo sapiens
tccctataagaaaac

SEQ ID NO: 411349 - DNA, 15 bp, Homo sapiens
ccctataagaaaaca

SEQ ID NO: 411350 - DNA, 15 bp, Homo sapiens
cctataagaaaacag

SEQ ID NO: 411351 - DNA, 15 bp, Homo sapiens
ctataagaaaacagt

SEQ ID NO: 411352 - DNA, 15 bp, Homo sapiens
tataagaaaacagtc

SEQ ID NO: 411353 - DNA, 15 bp, Homo sapiens
ataagaaaacagtct

SEQ ID NO: 411354 - DNA, 15 bp, Homo sapiens
taagaaaacagtctg

SEQ ID NO: 411355 - DNA, 15 bp, Homo sapiens
aagaaaacagtctga

SEQ ID NO: 411356 - DNA, 15 bp, Homo sapiens
agaaaacagtctgaa

SEQ ID NO: 411357 - DNA, 15 bp, Homo sapiens
gaaaacagtctgaat

SEQ ID NO: 411358 - DNA, 15 bp, Homo sapiens
aaaacagtctgaatg

SEQ ID NO: 411359 - DNA, 15 bp, Homo sapiens
aaacagtctgaatga

SEQ ID NO: 411360 - DNA, 15 bp, Homo sapiens
aacagtctgaatgac

SEQ ID NO: 411361 - DNA, 15 bp, Homo sapiens
acagtctgaatgact

SEQ ID NO: 411362 - DNA, 15 bp, Homo sapiens
cagtctgaatgactt

SEQ ID NO: 411363 - DNA, 15 bp, Homo sapiens
agtctgaatgacttt

SEQ ID NO: 411364 - DNA, 15 bp, Homo sapiens
gtctgaatgactttc

SEQ ID NO: 411365 - DNA, 15 bp, Homo sapiens
tctgaatgactttca

SEQ ID NO: 411366 - DNA, 15 bp, Homo sapiens
ctgaatgactttcag

SEQ ID NO: 411367 - DNA, 15 bp, Homo sapiens
tgaatgactttcagc

SEQ ID NO: 411368 - DNA, 15 bp, Homo sapiens
gaatgactttcagcg

SEQ ID NO: 411369 - DNA, 15 bp, Homo sapiens
aatgactttcagcgg

SEQ ID NO: 411370 - DNA, 15 bp, Homo sapiens
atgactttcagcggc

SEQ ID NO: 411371 - DNA, 15 bp, Homo sapiens
tgactttcagcggca

SEQ ID NO: 411372 - DNA, 15 bp, Homo sapiens
gactttcagcggcat

SEQ ID NO: 411373 - DNA, 15 bp, Homo sapiens
actttcagcggcatc

SEQ ID NO: 411374 - DNA, 15 bp, Homo sapiens
ctttcagcggcatca

SEQ ID NO: 411375 - DNA, 15 bp, Homo sapiens
tttcagcggcatcaa

SEQ ID NO: 411376 - DNA, 15 bp, Homo sapiens
ttcagcggcatcaaa

SEQ ID NO: 411377 - DNA, 15 bp, Homo sapiens
tcagcggcatcaaag

SEQ ID NO: 411378 - DNA, 15 bp, Homo sapiens
cagcggcatcaaaga

SEQ ID NO: 411379 - DNA, 15 bp, Homo sapiens
agcggcatcaaagag

SEQ ID NO: 411380 - DNA, 15 bp, Homo sapiens
gcggcatcaaagaga

SEQ ID NO: 411381 - DNA, 15 bp, Homo sapiens
cggcatcaaagagat

SEQ ID NO: 411382 - DNA, 15 bp, Homo sapiens
ggcatcaaagagatc

SEQ ID NO: 411383 - DNA, 15 bp, Homo sapiens
gcatcaaagagatcg

SEQ ID NO: 411384 - DNA, 15 bp, Homo sapiens
catcaaagagatcga

SEQ ID NO: 411385 - DNA, 15 bp, Homo sapiens
atcaaagagatcgaa

SEQ ID NO: 411386 - DNA, 15 bp, Homo sapiens
tcaaagagatcgaaa

SEQ ID NO: 411387 - DNA, 15 bp, Homo sapiens
caaagagatcgaaac

SEQ ID NO: 411388 - DNA, 15 bp, Homo sapiens
aaagagatcgaaaca

SEQ ID NO: 411389 - DNA, 15 bp, Homo sapiens
aagagatcgaaacac

SEQ ID NO: 411390 - DNA, 15 bp, Homo sapiens
agagatcgaaacact

SEQ ID NO: 411391 - DNA, 15 bp, Homo sapiens
gagatcgaaacactt

SEQ ID NO: 411392 - DNA, 15 bp, Homo sapiens
agatcgaaacacttt

SEQ ID NO: 411393 - DNA, 15 bp, Homo sapiens
gatcgaaacacttta

SEQ ID NO: 411394 - DNA, 15 bp, Homo sapiens
atcgaaacactttaa

SEQ ID NO: 411395 - DNA, 15 bp, Homo sapiens
tcgaaacactttaaa

SEQ ID NO: 411396 - DNA, 15 bp, Homo sapiens
cgaaacactttaaaa

SEQ ID NO: 411397 - DNA, 15 bp, Homo sapiens
gaaacactttaaaac

SEQ ID NO: 411398 - DNA, 15 bp, Homo sapiens
aaacactttaaaact

SEQ ID NO: 411399 - DNA, 15 bp, Homo sapiens
aacactttaaaacta

SEQ ID NO: 411400 - DNA, 15 bp, Homo sapiens
acactttaaaactat

SEQ ID NO: 411401 - DNA, 15 bp, Homo sapiens
cactttaaaactatt

SEQ ID NO: 411402 - DNA, 15 bp, Homo sapiens
actttaaaactattt

SEQ ID NO: 411403 - DNA, 15 bp, Homo sapiens
ctttaaaactatttt

SEQ ID NO: 411404 - DNA, 15 bp, Homo sapiens
tttaaaactattttc

SEQ ID NO: 411405 - DNA, 15 bp, Homo sapiens
ttaaaactattttct

SEQ ID NO: 411406 - DNA, 15 bp, Homo sapiens
taaaactattttctt

SEQ ID NO: 411407 - DNA, 15 bp, Homo sapiens
aaaactattttcttc

SEQ ID NO: 411408 - DNA, 15 bp, Homo sapiens
aaactattttcttca

SEQ ID NO: 411409 - DNA, 15 bp, Homo sapiens
aactattttcttcat

SEQ ID NO: 411410 - DNA, 15 bp, Homo sapiens
actattttcttcatc

SEQ ID NO: 411411 - DNA, 15 bp, Homo sapiens
ctattttcttcatca

SEQ ID NO: 411412 - DNA, 15 bp, Homo sapiens
tattttcttcatcag

SEQ ID NO: 411413 - DNA, 15 bp, Homo sapiens
attttcttcatcagt

SEQ ID NO: 411414 - DNA, 15 bp, Homo sapiens
ttttcttcatcagtt

SEQ ID NO: 411415 - DNA, 15 bp, Homo sapiens
tttcttcatcagttg

SEQ ID NO: 411416 - DNA, 15 bp, Homo sapiens
ttcttcatcagttgc

SEQ ID NO: 411417 - DNA, 15 bp, Homo sapiens
tcttcatcagttgcc

SEQ ID NO: 411418 - DNA, 15 bp, Homo sapiens
cttcatcagttgcct

SEQ ID NO: 411419 - DNA, 15 bp, Homo sapiens
ttcatcagttgcctg

SEQ ID NO: 411420 - DNA, 15 bp, Homo sapiens
tcatcagttgcctgc

SEQ ID NO: 411421 - DNA, 15 bp, Homo sapiens
catcagttgcctgct

SEQ ID NO: 411422 - DNA, 15 bp, Homo sapiens
atcagttgcctgcta

SEQ ID NO: 411423 - DNA, 15 bp, Homo sapiens
tcagttgcctgctaa

SEQ ID NO: 411424 - DNA, 15 bp, Homo sapiens
cagttgcctgctaac

SEQ ID NO: 411425 - DNA, 15 bp, Homo sapiens
agttgcctgctaaca

SEQ ID NO: 411426 - DNA, 15 bp, Homo sapiens
gttgcctgctaacac

SEQ ID NO: 411427 - DNA, 15 bp, Homo sapiens
ttgcctgctaacacc

SEQ ID NO: 411428 - DNA, 15 bp, Homo sapiens
tgcctgctaacacct

SEQ ID NO: 411429 - DNA, 15 bp, Homo sapiens
gcctgctaacacctt

SEQ ID NO: 411430 - DNA, 15 bp, Homo sapiens
cctgctaacaccttt

SEQ ID NO: 411431 - DNA, 15 bp, Homo sapiens
ctgctaacacctttt

SEQ ID NO: 411432 - DNA, 15 bp, Homo sapiens
tgctaacaccttttt

SEQ ID NO: 411433 - DNA, 15 bp, Homo sapiens
gctaacacctttttg

SEQ ID NO: 411434 - DNA, 15 bp, Homo sapiens
ctaacacctttttga

SEQ ID NO: 411435 - DNA, 15 bp, Homo sapiens
taacacctttttgaa

SEQ ID NO: 411436 - DNA, 15 bp, Homo sapiens
aacacctttttgaaa

SEQ ID NO: 411437 - DNA, 15 bp, Homo sapiens
acacctttttgaaaa

SEQ ID NO: 411438 - DNA, 15 bp, Homo sapiens
cacctttttgaaaaa

SEQ ID NO: 411439 - DNA, 15 bp, Homo sapiens
acctttttgaaaaat

SEQ ID NO: 411440 - DNA, 15 bp, Homo sapiens
cctttttgaaaaata

SEQ ID NO: 411441 - DNA, 15 bp, Homo sapiens
ctttttgaaaaataa

SEQ ID NO: 411442 - DNA, 15 bp, Homo sapiens
tttttgaaaaataaa

SEQ ID NO: 411443 - DNA, 15 bp, Homo sapiens
ttttgaaaaataaaa

SEQ ID NO: 411444 - DNA, 15 bp, Homo sapiens
tttgaaaaataaaat

SEQ ID NO: 411445 - DNA, 15 bp, Homo sapiens
ttgaaaaataaaatt

SEQ ID NO: 411446 - DNA, 15 bp, Homo sapiens
tgaaaaataaaatta

SEQ ID NO: 411447 - DNA, 15 bp, Homo sapiens
gaaaaataaaattaa

SEQ ID NO: 411448 - DNA, 15 bp, Homo sapiens
aaaaataaaattaat

SEQ ID NO: 411449 - DNA, 15 bp, Homo sapiens
aaaataaaattaatc

SEQ ID NO: 411450 - DNA, 15 bp, Homo sapiens
aaataaaattaatca

SEQ ID NO: 411451 - DNA, 15 bp, Homo sapiens
aataaaattaatcaa

SEQ ID NO: 411452 - DNA, 15 bp, Homo sapiens
ataaaattaatcaac

SEQ ID NO: 411453 - DNA, 15 bp, Homo sapiens
taaaattaatcaacg

SEQ ID NO: 411454 - DNA, 15 bp, Homo sapiens
aaaattaatcaacgc

SEQ ID NO: 411455 - DNA, 15 bp, Homo sapiens
aaattaatcaacgcg

SEQ ID NO: 411456 - DNA, 15 bp, Homo sapiens
aattaatcaacgcgt

SEQ ID NO: 411457 - DNA, 15 bp, Homo sapiens
attaatcaacgcgta

SEQ ID NO: 411458 - DNA, 15 bp, Homo sapiens
ttaatcaacgcgtat

SEQ ID NO: 411459 - DNA, 15 bp, Homo sapiens
taatcaacgcgtatt

SEQ ID NO: 411460 - DNA, 15 bp, Homo sapiens
aatcaacgcgtattt

SEQ ID NO: 411461 - DNA, 15 bp, Homo sapiens
atcaacgcgtatttc

SEQ ID NO: 411462 - DNA, 15 bp, Homo sapiens
tcaacgcgtatttcc

SEQ ID NO: 411463 - DNA, 15 bp, Homo sapiens
caacgcgtatttcct

SEQ ID NO: 411464 - DNA, 15 bp, Homo sapiens
aacgcgtatttcctt

SEQ ID NO: 411465 - DNA, 15 bp, Homo sapiens
acgcgtatttccttt

SEQ ID NO: 411466 - DNA, 15 bp, Homo sapiens
cgcgtatttcctttt

SEQ ID NO: 411467 - DNA, 15 bp, Homo sapiens
gcgtatttccttttg

SEQ ID NO: 411468 - DNA, 15 bp, Homo sapiens
cgtatttccttttgt

SEQ ID NO: 411469 - DNA, 15 bp, Homo sapiens
gtatttccttttgtg

SEQ ID NO: 411470 - DNA, 15 bp, Homo sapiens
tatttccttttgtga

SEQ ID NO: 411471 - DNA, 15 bp, Homo sapiens
atttccttttgtgat

SEQ ID NO: 411472 - DNA, 15 bp, Homo sapiens
tttccttttgtgatt

SEQ ID NO: 411473 - DNA, 15 bp, Homo sapiens
ttccttttgtgattt

SEQ ID NO: 411474 - DNA, 15 bp, Homo sapiens
tccttttgtgatttg

SEQ ID NO: 411475 - DNA, 15 bp, Homo sapiens
ccttttgtgatttgt

SEQ ID NO: 411476 - DNA, 15 bp, Homo sapiens
cttttgtgatttgta

SEQ ID NO: 411477 - DNA, 15 bp, Homo sapiens
ttttgtgatttgtat

SEQ ID NO: 411478 - DNA, 15 bp, Homo sapiens
tttgtgatttgtatt

SEQ ID NO: 411479 - DNA, 15 bp, Homo sapiens
ttgtgatttgtattg

SEQ ID NO: 411480 - DNA, 15 bp, Homo sapiens
tgtgatttgtattgt

SEQ ID NO: 411481 - DNA, 15 bp, Homo sapiens
gtgatttgtattgtt

SEQ ID NO: 411482 - DNA, 15 bp, Homo sapiens
tgatttgtattgttt

SEQ ID NO: 411483 - DNA, 15 bp, Homo sapiens
gatttgtattgtttt

SEQ ID NO: 411484 - DNA, 15 bp, Homo sapiens
atttgtattgttttg

SEQ ID NO: 411485 - DNA, 15 bp, Homo sapiens
tttgtattgttttgt

SEQ ID NO: 411486 - DNA, 15 bp, Homo sapiens
ttgtattgttttgta

SEQ ID NO: 411487 - DNA, 15 bp, Homo sapiens
tgtattgttttgtac

SEQ ID NO: 411488 - DNA, 15 bp, Homo sapiens
gtattgttttgtaca

SEQ ID NO: 411489 - DNA, 15 bp, Homo sapiens
tattgttttgtacat

SEQ ID NO: 411490 - DNA, 15 bp, Homo sapiens
attgttttgtacatt

SEQ ID NO: 411491 - DNA, 15 bp, Homo sapiens
ttgttttgtacattc

SEQ ID NO: 411492 - DNA, 15 bp, Homo sapiens
tgttttgtacattca

SEQ ID NO: 411493 - DNA, 15 bp, Homo sapiens
gttttgtacattcac

SEQ ID NO: 411494 - DNA, 15 bp, Homo sapiens
ttttgtacattcact

SEQ ID NO: 411495 - DNA, 15 bp, Homo sapiens
tttgtacattcactc

SEQ ID NO: 411496 - DNA, 15 bp, Homo sapiens
ttgtacattcactcc

SEQ ID NO: 411497 - DNA, 15 bp, Homo sapiens
tgtacattcactccc

SEQ ID NO: 411498 - DNA, 15 bp, Homo sapiens
gtacattcactccct

SEQ ID NO: 411499 - DNA, 15 bp, Homo sapiens
tacattcactccctt

SEQ ID NO: 411500 - DNA, 15 bp, Homo sapiens
acattcactcccttt

SEQ ID NO: 411501 - DNA, 15 bp, Homo sapiens
cattcactccctttt

SEQ ID NO: 411502 - DNA, 15 bp, Homo sapiens
attcactcccttttc

SEQ ID NO: 411503 - DNA, 15 bp, Homo sapiens
ttcactcccttttct

SEQ ID NO: 411504 - DNA, 15 bp, Homo sapiens
tcactcccttttctt

SEQ ID NO: 411505 - DNA, 15 bp, Homo sapiens
cactcccttttcttt

SEQ ID NO: 411506 - DNA, 15 bp, Homo sapiens
actcccttttctttt

SEQ ID NO: 411507 - DNA, 15 bp, Homo sapiens
ctcccttttcttttc

SEQ ID NO: 411508 - DNA, 15 bp, Homo sapiens
tcccttttcttttca

SEQ ID NO: 411509 - DNA, 15 bp, Homo sapiens
cccttttcttttcat

SEQ ID NO: 411510 - DNA, 15 bp, Homo sapiens
ccttttcttttcatg

SEQ ID NO: 411511 - DNA, 15 bp, Homo sapiens
cttttcttttcatgg

SEQ ID NO: 411512 - DNA, 15 bp, Homo sapiens
ttttcttttcatggg

SEQ ID NO: 411513 - DNA, 15 bp, Homo sapiens
tttcttttcatgggt

SEQ ID NO: 411514 - DNA, 15 bp, Homo sapiens
ttcttttcatgggtt

SEQ ID NO: 411515 - DNA, 15 bp, Homo sapiens
tcttttcatgggttg

SEQ ID NO: 411516 - DNA, 15 bp, Homo sapiens
cttttcatgggttgg

SEQ ID NO: 411517 - DNA, 15 bp, Homo sapiens
ttttcatgggttggc

SEQ ID NO: 411518 - DNA, 15 bp, Homo sapiens
tttcatgggttggct

SEQ ID NO: 411519 - DNA, 15 bp, Homo sapiens
ttcatgggttggctc

SEQ ID NO: 411520 - DNA, 15 bp, Homo sapiens
tcatgggttggctcc

SEQ ID NO: 411521 - DNA, 15 bp, Homo sapiens
catgggttggctccc

SEQ ID NO: 411522 - DNA, 15 bp, Homo sapiens
atgggttggctccca

SEQ ID NO: 411523 - DNA, 15 bp, Homo sapiens
tgggttggctcccaa

SEQ ID NO: 411524 - DNA, 15 bp, Homo sapiens
gggttggctcccaac

SEQ ID NO: 411525 - DNA, 15 bp, Homo sapiens
ggttggctcccaact

SEQ ID NO: 411526 - DNA, 15 bp, Homo sapiens
gttggctcccaactg

SEQ ID NO: 411527 - DNA, 15 bp, Homo sapiens
ttggctcccaactgg

SEQ ID NO: 411528 - DNA, 15 bp, Homo sapiens
tggctcccaactgga

SEQ ID NO: 411529 - DNA, 15 bp, Homo sapiens
ggctcccaactggaa

SEQ ID NO: 411530 - DNA, 15 bp, Homo sapiens
gctcccaactggaac

SEQ ID NO: 411531 - DNA, 15 bp, Homo sapiens
ctcccaactggaaca

SEQ ID NO: 411532 - DNA, 15 bp, Homo sapiens
tcccaactggaacat

SEQ ID NO: 411533 - DNA, 15 bp, Homo sapiens
cccaactggaacatg

SEQ ID NO: 411534 - DNA, 15 bp, Homo sapiens
ccaactggaacatgg

SEQ ID NO: 411535 - DNA, 15 bp, Homo sapiens
caactggaacatgga

SEQ ID NO: 411536 - DNA, 15 bp, Homo sapiens
aactggaacatggaa

SEQ ID NO: 411537 - DNA, 15 bp, Homo sapiens
actggaacatggaac

SEQ ID NO: 411538 - DNA, 15 bp, Homo sapiens
ctggaacatggaacc

SEQ ID NO: 411539 - DNA, 15 bp, Homo sapiens
tggaacatggaacct

SEQ ID NO: 411540 - DNA, 15 bp, Homo sapiens
ggaacatggaacctg

SEQ ID NO: 411541 - DNA, 15 bp, Homo sapiens
gaacatggaacctgt

SEQ ID NO: 411542 - DNA, 15 bp, Homo sapiens
aacatggaacctgtg

SEQ ID NO: 411543 - DNA, 15 bp, Homo sapiens
acatggaacctgtga

SEQ ID NO: 411544 - DNA, 15 bp, Homo sapiens
catggaacctgtgat

SEQ ID NO: 411545 - DNA, 15 bp, Homo sapiens
atggaacctgtgatc

SEQ ID NO: 411546 - DNA, 15 bp, Homo sapiens
tggaacctgtgatcc

SEQ ID NO: 411547 - DNA, 15 bp, Homo sapiens
ggaacctgtgatcca

SEQ ID NO: 411548 - DNA, 15 bp, Homo sapiens
gaacctgtgatccat

SEQ ID NO: 411549 - DNA, 15 bp, Homo sapiens
aacctgtgatccatt

SEQ ID NO: 411550 - DNA, 15 bp, Homo sapiens
acctgtgatccattc

SEQ ID NO: 411551 - DNA, 15 bp, Homo sapiens
cctgtgatccattca

SEQ ID NO: 411552 - DNA, 15 bp, Homo sapiens
ctgtgatccattcaa

SEQ ID NO: 411553 - DNA, 15 bp, Homo sapiens
tgtgatccattcaag

SEQ ID NO: 411554 - DNA, 15 bp, Homo sapiens
gtgatccattcaaga

SEQ ID NO: 411555 - DNA, 15 bp, Homo sapiens
tgatccattcaagat

SEQ ID NO: 411556 - DNA, 15 bp, Homo sapiens
gatccattcaagatt

SEQ ID NO: 411557 - DNA, 15 bp, Homo sapiens
atccattcaagattg

SEQ ID NO: 411558 - DNA, 15 bp, Homo sapiens
tccattcaagattga

SEQ ID NO: 411559 - DNA, 15 bp, Homo sapiens
ccattcaagattgag

SEQ ID NO: 411560 - DNA, 15 bp, Homo sapiens
cattcaagattgaga

SEQ ID NO: 411561 - DNA, 15 bp, Homo sapiens
attcaagattgagac

SEQ ID NO: 411562 - DNA, 15 bp, Homo sapiens
ttcaagattgagaca

SEQ ID NO: 411563 - DNA, 15 bp, Homo sapiens
tcaagattgagacaa

SEQ ID NO: 411564 - DNA, 15 bp, Homo sapiens
caagattgagacaat

SEQ ID NO: 411565 - DNA, 15 bp, Homo sapiens
aagattgagacaatg

SEQ ID NO: 411566 - DNA, 15 bp, Homo sapiens
agattgagacaatgt

SEQ ID NO: 411567 - DNA, 15 bp, Homo sapiens
gattgagacaatgta

SEQ ID NO: 411568 - DNA, 15 bp, Homo sapiens
attgagacaatgtaa

SEQ ID NO: 411569 - DNA, 15 bp, Homo sapiens
ttgagacaatgtaaa

SEQ ID NO: 411570 - DNA, 15 bp, Homo sapiens
tgagacaatgtaaaa

SEQ ID NO: 411571 - DNA, 15 bp, Homo sapiens
gagacaatgtaaaag

SEQ ID NO: 411572 - DNA, 15 bp, Homo sapiens
agacaatgtaaaaga

SEQ ID NO: 411573 - DNA, 15 bp, Homo sapiens
gacaatgtaaaagat

SEQ ID NO: 411574 - DNA, 15 bp, Homo sapiens
acaatgtaaaagata

SEQ ID NO: 411575 - DNA, 15 bp, Homo sapiens
caatgtaaaagatag

SEQ ID NO: 411576 - DNA, 15 bp, Homo sapiens
aatgtaaaagataga

SEQ ID NO: 411577 - DNA, 15 bp, Homo sapiens
atgtaaaagatagag

SEQ ID NO: 411578 - DNA, 15 bp, Homo sapiens
tgtaaaagatagaga

SEQ ID NO: 411579 - DNA, 15 bp, Homo sapiens
gtaaaagatagagaa

SEQ ID NO: 411580 - DNA, 15 bp, Homo sapiens
taaaagatagagaac

SEQ ID NO: 411581 - DNA, 15 bp, Homo sapiens
aaaagatagagaact

SEQ ID NO: 411582 - DNA, 15 bp, Homo sapiens
aaagatagagaactg

SEQ ID NO: 411583 - DNA, 15 bp, Homo sapiens
aagatagagaactga

SEQ ID NO: 411584 - DNA, 15 bp, Homo sapiens
agatagagaactgac

SEQ ID NO: 411585 - DNA, 15 bp, Homo sapiens
gatagagaactgact

SEQ ID NO: 411586 - DNA, 15 bp, Homo sapiens
atagagaactgactt

SEQ ID NO: 411587 - DNA, 15 bp, Homo sapiens
tagagaactgacttt

SEQ ID NO: 411588 - DNA, 15 bp, Homo sapiens
agagaactgactttt

SEQ ID NO: 411589 - DNA, 15 bp, Homo sapiens
gagaactgacttttg

SEQ ID NO: 411590 - DNA, 15 bp, Homo sapiens
agaactgacttttgg

SEQ ID NO: 411591 - DNA, 15 bp, Homo sapiens
gaactgacttttggg

SEQ ID NO: 411592 - DNA, 15 bp, Homo sapiens
aactgacttttgggg

SEQ ID NO: 411593 - DNA, 15 bp, Homo sapiens
actgacttttggggc

SEQ ID NO: 411594 - DNA, 15 bp, Homo sapiens
ctgacttttggggca

SEQ ID NO: 411595 - DNA, 15 bp, Homo sapiens
tgacttttggggcag

SEQ ID NO: 411596 - DNA, 15 bp, Homo sapiens
gacttttggggcagg

SEQ ID NO: 411597 - DNA, 15 bp, Homo sapiens
acttttggggcaggc

SEQ ID NO: 411598 - DNA, 15 bp, Homo sapiens
cttttggggcaggca

SEQ ID NO: 411599 - DNA, 15 bp, Homo sapiens
ttttggggcaggcag

SEQ ID NO: 411600 - DNA, 15 bp, Homo sapiens
tttggggcaggcagg

SEQ ID NO: 411601 - DNA, 15 bp, Homo sapiens
ttggggcaggcaggc

SEQ ID NO: 411602 - DNA, 15 bp, Homo sapiens
tggggcaggcaggcc

SEQ ID NO: 411603 - DNA, 15 bp, Homo sapiens
ggggcaggcaggcct

SEQ ID NO: 411604 - DNA, 15 bp, Homo sapiens
gggcaggcaggcctc

SEQ ID NO: 411605 - DNA, 15 bp, Homo sapiens
ggcaggcaggcctcc

SEQ ID NO: 411606 - DNA, 15 bp, Homo sapiens
gcaggcaggcctcca

SEQ ID NO: 411607 - DNA, 15 bp, Homo sapiens
caggcaggcctccag

SEQ ID NO: 411608 - DNA, 15 bp, Homo sapiens
aggcaggcctccagg

SEQ ID NO: 411609 - DNA, 15 bp, Homo sapiens
ggcaggcctccagga

SEQ ID NO: 411610 - DNA, 15 bp, Homo sapiens
gcaggcctccaggaa

SEQ ID NO: 411611 - DNA, 15 bp, Homo sapiens
caggcctccaggaag

SEQ ID NO: 411612 - DNA, 15 bp, Homo sapiens
aggcctccaggaagt

SEQ ID NO: 411613 - DNA, 15 bp, Homo sapiens
ggcctccaggaagtg

SEQ ID NO: 411614 - DNA, 15 bp, Homo sapiens
gcctccaggaagtgg

SEQ ID NO: 411615 - DNA, 15 bp, Homo sapiens
cctccaggaagtggg

SEQ ID NO: 411616 - DNA, 15 bp, Homo sapiens
ctccaggaagtggga

SEQ ID NO: 411617 - DNA, 15 bp, Homo sapiens
tccaggaagtgggag

SEQ ID NO: 411618 - DNA, 15 bp, Homo sapiens
ccaggaagtgggagt

SEQ ID NO: 411619 - DNA, 15 bp, Homo sapiens
caggaagtgggagtg

SEQ ID NO: 411620 - DNA, 15 bp, Homo sapiens
aggaagtgggagtga

SEQ ID NO: 411621 - DNA, 15 bp, Homo sapiens
ggaagtgggagtgag

SEQ ID NO: 411622 - DNA, 15 bp, Homo sapiens
gaagtgggagtgagc

SEQ ID NO: 411623 - DNA, 15 bp, Homo sapiens
aagtgggagtgagct

SEQ ID NO: 411624 - DNA, 15 bp, Homo sapiens
agtgggagtgagctt

SEQ ID NO: 411625 - DNA, 15 bp, Homo sapiens
gtgggagtgagcttt

SEQ ID NO: 411626 - DNA, 15 bp, Homo sapiens
tgggagtgagctttc

SEQ ID NO: 411627 - DNA, 15 bp, Homo sapiens
gggagtgagctttca

SEQ ID NO: 411628 - DNA, 15 bp, Homo sapiens
ggagtgagctttcac

SEQ ID NO: 411629 - DNA, 15 bp, Homo sapiens
gagtgagctttcact

SEQ ID NO: 411630 - DNA, 15 bp, Homo sapiens
agtgagctttcactt

SEQ ID NO: 411631 - DNA, 15 bp, Homo sapiens
gtgagctttcacttc

SEQ ID NO: 411632 - DNA, 15 bp, Homo sapiens
tgagctttcacttca

SEQ ID NO: 411633 - DNA, 15 bp, Homo sapiens
gagctttcacttcaa

SEQ ID NO: 411634 - DNA, 15 bp, Homo sapiens
agctttcacttcaaa

SEQ ID NO: 411635 - DNA, 15 bp, Homo sapiens
gctttcacttcaaac

SEQ ID NO: 411636 - DNA, 15 bp, Homo sapiens
ctttcacttcaaact

SEQ ID NO: 411637 - DNA, 15 bp, Homo sapiens
tttcacttcaaactg

SEQ ID NO: 411638 - DNA, 15 bp, Homo sapiens
ttcacttcaaactgg

SEQ ID NO: 411639 - DNA, 15 bp, Homo sapiens
tcacttcaaactggg

SEQ ID NO: 411640 - DNA, 15 bp, Homo sapiens
cacttcaaactgggt

SEQ ID NO: 411641 - DNA, 15 bp, Homo sapiens
acttcaaactgggtg

SEQ ID NO: 411642 - DNA, 15 bp, Homo sapiens
cttcaaactgggtga

SEQ ID NO: 411643 - DNA, 15 bp, Homo sapiens
ttcaaactgggtgag

SEQ ID NO: 411644 - DNA, 15 bp, Homo sapiens
tcaaactgggtgagg

SEQ ID NO: 411645 - DNA, 15 bp, Homo sapiens
caaactgggtgaggg

SEQ ID NO: 411646 - DNA, 15 bp, Homo sapiens
aaactgggtgagggg

SEQ ID NO: 411647 - DNA, 15 bp, Homo sapiens
aactgggtgaggggt

SEQ ID NO: 411648 - DNA, 15 bp, Homo sapiens
actgggtgaggggtg

SEQ ID NO: 411649 - DNA, 15 bp, Homo sapiens
ctgggtgaggggtgg

SEQ ID NO: 411650 - DNA, 15 bp, Homo sapiens
tgggtgaggggtggt

SEQ ID NO: 411651 - DNA, 15 bp, Homo sapiens
gggtgaggggtggtg

SEQ ID NO: 411652 - DNA, 15 bp, Homo sapiens
ggtgaggggtggtgg

SEQ ID NO: 411653 - DNA, 15 bp, Homo sapiens
gtgaggggtggtgga

SEQ ID NO: 411654 - DNA, 15 bp, Homo sapiens
tgaggggtggtggaa

SEQ ID NO: 411655 - DNA, 15 bp, Homo sapiens
gaggggtggtggaaa

SEQ ID NO: 411656 - DNA, 15 bp, Homo sapiens
aggggtggtggaaag

SEQ ID NO: 411657 - DNA, 15 bp, Homo sapiens
ggggtggtggaaagg

SEQ ID NO: 411658 - DNA, 15 bp, Homo sapiens
gggtggtggaaaggg

SEQ ID NO: 411659 - DNA, 15 bp, Homo sapiens
ggtggtggaaaggga

SEQ ID NO: 411660 - DNA, 15 bp, Homo sapiens
gtggtggaaagggag

SEQ ID NO: 411661 - DNA, 15 bp, Homo sapiens
tggtggaaagggagg

SEQ ID NO: 411662 - DNA, 15 bp, Homo sapiens
ggtggaaagggagga

SEQ ID NO: 411663 - DNA, 15 bp, Homo sapiens
gtggaaagggaggat

SEQ ID NO: 411664 - DNA, 15 bp, Homo sapiens
tggaaagggaggatg

SEQ ID NO: 411665 - DNA, 15 bp, Homo sapiens
ggaaagggaggatgc

SEQ ID NO: 411666 - DNA, 15 bp, Homo sapiens
gaaagggaggatgct

SEQ ID NO: 411667 - DNA, 15 bp, Homo sapiens
aaagggaggatgctg

SEQ ID NO: 411668 - DNA, 15 bp, Homo sapiens
aagggaggatgctga

SEQ ID NO: 411669 - DNA, 15 bp, Homo sapiens
agggaggatgctgat

SEQ ID NO: 411670 - DNA, 15 bp, Homo sapiens
gggaggatgctgatt

SEQ ID NO: 411671 - DNA, 15 bp, Homo sapiens
ggaggatgctgatta

SEQ ID NO: 411672 - DNA, 15 bp, Homo sapiens
gaggatgctgattaa

SEQ ID NO: 411673 - DNA, 15 bp, Homo sapiens
aggatgctgattaaa

SEQ ID NO: 411674 - DNA, 15 bp, Homo sapiens
ggatgctgattaaaa

SEQ ID NO: 411675 - DNA, 15 bp, Homo sapiens
gatgctgattaaaat

SEQ ID NO: 411676 - DNA, 15 bp, Homo sapiens
atgctgattaaaata

SEQ ID NO: 411677 - DNA, 15 bp, Homo sapiens
tgctgattaaaataa

SEQ ID NO: 411678 - DNA, 15 bp, Homo sapiens
gctgattaaaataat

SEQ ID NO: 411679 - DNA, 15 bp, Homo sapiens
ctgattaaaataata

SEQ ID NO: 411680 - DNA, 15 bp, Homo sapiens
tgattaaaataataa

SEQ ID NO: 411681 - DNA, 15 bp, Homo sapiens
gattaaaataataaa

SEQ ID NO: 411682 - DNA, 15 bp, Homo sapiens
attaaaataataaac

SEQ ID NO: 411683 - DNA, 15 bp, Homo sapiens
ttaaaataataaaca

SEQ ID NO: 411684 - DNA, 15 bp, Homo sapiens
taaaataataaacaa

SEQ ID NO: 411685 - DNA, 15 bp, Homo sapiens
aaaataataaacaac

SEQ ID NO: 411686 - DNA, 15 bp, Homo sapiens
aaataataaacaact

SEQ ID NO: 411687 - DNA, 15 bp, Homo sapiens
aataataaacaactg

SEQ ID NO: 411688 - DNA, 15 bp, Homo sapiens
ataataaacaactgc

SEQ ID NO: 411689 - DNA, 15 bp, Homo sapiens
taataaacaactgct

SEQ ID NO: 411690 - DNA, 15 bp, Homo sapiens
aataaacaactgctg

SEQ ID NO: 411691 - DNA, 15 bp, Homo sapiens
ataaacaactgctgg

SEQ ID NO: 411692 - DNA, 15 bp, Homo sapiens
taaacaactgctgga

SEQ ID NO: 411693 - DNA, 15 bp, Homo sapiens
aaacaactgctggaa

SEQ ID NO: 411694 - DNA, 15 bp, Homo sapiens
aacaactgctggaaa

SEQ ID NO: 411695 - DNA, 15 bp, Homo sapiens
acaactgctggaaag

SEQ ID NO: 411696 - DNA, 15 bp, Homo sapiens
caactgctggaaaga

SEQ ID NO: 411697 - DNA, 15 bp, Homo sapiens
aactgctggaaagag

SEQ ID NO: 411698 - DNA, 15 bp, Homo sapiens
actgctggaaagaga

SEQ ID NO: 411699 - DNA, 15 bp, Homo sapiens
ctgctggaaagagaa

SEQ ID NO: 411700 - DNA, 15 bp, Homo sapiens
tgctggaaagagaag

SEQ ID NO: 411701 - DNA, 15 bp, Homo sapiens
gctggaaagagaagt

SEQ ID NO: 411702 - DNA, 15 bp, Homo sapiens
ctggaaagagaagtt

SEQ ID NO: 411703 - DNA, 15 bp, Homo sapiens
tggaaagagaagttg

SEQ ID NO: 411704 - DNA, 15 bp, Homo sapiens
ggaaagagaagttga

SEQ ID NO: 411705 - DNA, 15 bp, Homo sapiens
gaaagagaagttgat

SEQ ID NO: 411706 - DNA, 15 bp, Homo sapiens
aaagagaagttgatt

SEQ ID NO: 411707 - DNA, 15 bp, Homo sapiens
aagagaagttgatta

SEQ ID NO: 411708 - DNA, 15 bp, Homo sapiens
agagaagttgattac

SEQ ID NO: 411709 - DNA, 15 bp, Homo sapiens
gagaagttgattacc

SEQ ID NO: 411710 - DNA, 15 bp, Homo sapiens
agaagttgattacca

SEQ ID NO: 411711 - DNA, 15 bp, Homo sapiens
gaagttgattaccac

SEQ ID NO: 411712 - DNA, 15 bp, Homo sapiens
aagttgattaccaca

SEQ ID NO: 411713 - DNA, 15 bp, Homo sapiens
agttgattaccacac

SEQ ID NO: 411714 - DNA, 15 bp, Homo sapiens
gttgattaccacact

SEQ ID NO: 411715 - DNA, 15 bp, Homo sapiens
ttgattaccacactg

SEQ ID NO: 411716 - DNA, 15 bp, Homo sapiens
tgattaccacactgc

SEQ ID NO: 411717 - DNA, 15 bp, Homo sapiens
gattaccacactgct

SEQ ID NO: 411718 - DNA, 15 bp, Homo sapiens
attaccacactgctg

SEQ ID NO: 411719 - DNA, 15 bp, Homo sapiens
ttaccacactgctgt

SEQ ID NO: 411720 - DNA, 15 bp, Homo sapiens
taccacactgctgtc

SEQ ID NO: 411721 - DNA, 15 bp, Homo sapiens
accacactgctgtca

SEQ ID NO: 411722 - DNA, 15 bp, Homo sapiens
ccacactgctgtcag

SEQ ID NO: 411723 - DNA, 15 bp, Homo sapiens
cacactgctgtcaga

SEQ ID NO: 411724 - DNA, 15 bp, Homo sapiens
acactgctgtcagat

SEQ ID NO: 411725 - DNA, 15 bp, Homo sapiens
cactgctgtcagatc

SEQ ID NO: 411726 - DNA, 15 bp, Homo sapiens
actgctgtcagatca

SEQ ID NO: 411727 - DNA, 15 bp, Homo sapiens
ctgctgtcagatcag

SEQ ID NO: 411728 - DNA, 15 bp, Homo sapiens
tgctgtcagatcagc

SEQ ID NO: 411729 - DNA, 15 bp, Homo sapiens
gctgtcagatcagcc

SEQ ID NO: 411730 - DNA, 15 bp, Homo sapiens
ctgtcagatcagcca

SEQ ID NO: 411731 - DNA, 15 bp, Homo sapiens
tgtcagatcagccag

SEQ ID NO: 411732 - DNA, 15 bp, Homo sapiens
gtcagatcagccagg

SEQ ID NO: 411733 - DNA, 15 bp, Homo sapiens
tcagatcagccaggg

SEQ ID NO: 411734 - DNA, 15 bp, Homo sapiens
cagatcagccagggg

SEQ ID NO: 411735 - DNA, 15 bp, Homo sapiens
agatcagccagggga

SEQ ID NO: 411736 - DNA, 15 bp, Homo sapiens
gatcagccaggggag

SEQ ID NO: 411737 - DNA, 15 bp, Homo sapiens
atcagccaggggagc

SEQ ID NO: 411738 - DNA, 15 bp, Homo sapiens
tcagccaggggagct

SEQ ID NO: 411739 - DNA, 15 bp, Homo sapiens
cagccaggggagctg

SEQ ID NO: 411740 - DNA, 15 bp, Homo sapiens
agccaggggagctgc

SEQ ID NO: 411741 - DNA, 15 bp, Homo sapiens
gccaggggagctgcc

SEQ ID NO: 411742 - DNA, 15 bp, Homo sapiens
ccaggggagctgcca

SEQ ID NO: 411743 - DNA, 15 bp, Homo sapiens
caggggagctgccag

SEQ ID NO: 411744 - DNA, 15 bp, Homo sapiens
aggggagctgccaga

SEQ ID NO: 411745 - DNA, 15 bp, Homo sapiens
ggggagctgccagag

SEQ ID NO: 411746 - DNA, 15 bp, Homo sapiens
gggagctgccagagc

SEQ ID NO: 411747 - DNA, 15 bp, Homo sapiens
ggagctgccagagcc

SEQ ID NO: 411748 - DNA, 15 bp, Homo sapiens
gagctgccagagccc

SEQ ID NO: 411749 - DNA, 15 bp, Homo sapiens
agctgccagagccca

SEQ ID NO: 411750 - DNA, 15 bp, Homo sapiens
gctgccagagcccac

SEQ ID NO: 411751 - DNA, 15 bp, Homo sapiens
ctgccagagcccact

SEQ ID NO: 411752 - DNA, 15 bp, Homo sapiens
tgccagagcccactg

SEQ ID NO: 411753 - DNA, 15 bp, Homo sapiens
gccagagcccactga

SEQ ID NO: 411754 - DNA, 15 bp, Homo sapiens
ccagagcccactgag

SEQ ID NO: 411755 - DNA, 15 bp, Homo sapiens
cagagcccactgagg

SEQ ID NO: 411756 - DNA, 15 bp, Homo sapiens
agagcccactgaggc

SEQ ID NO: 411757 - DNA, 15 bp, Homo sapiens
gagcccactgaggct

SEQ ID NO: 411758 - DNA, 15 bp, Homo sapiens
agcccactgaggctg

SEQ ID NO: 411759 - DNA, 15 bp, Homo sapiens
gcccactgaggctgc

SEQ ID NO: 411760 - DNA, 15 bp, Homo sapiens
cccactgaggctgct

SEQ ID NO: 411761 - DNA, 15 bp, Homo sapiens
ccactgaggctgctc

SEQ ID NO: 411762 - DNA, 15 bp, Homo sapiens
cactgaggctgctct

SEQ ID NO: 411763 - DNA, 15 bp, Homo sapiens
actgaggctgctctc

SEQ ID NO: 411764 - DNA, 15 bp, Homo sapiens
ctgaggctgctctcc

SEQ ID NO: 411765 - DNA, 15 bp, Homo sapiens
tgaggctgctctccc

SEQ ID NO: 411766 - DNA, 15 bp, Homo sapiens
gaggctgctctcccc

SEQ ID NO: 411767 - DNA, 15 bp, Homo sapiens
aggctgctctcccct

SEQ ID NO: 411768 - DNA, 15 bp, Homo sapiens
ggctgctctcccctg

SEQ ID NO: 411769 - DNA, 15 bp, Homo sapiens
gctgctctcccctgc

SEQ ID NO: 411770 - DNA, 15 bp, Homo sapiens
ctgctctcccctgcc

SEQ ID NO: 411771 - DNA, 15 bp, Homo sapiens
tgctctcccctgcca

SEQ ID NO: 411772 - DNA, 15 bp, Homo sapiens
gctctcccctgccac

SEQ ID NO: 411773 - DNA, 15 bp, Homo sapiens
ctctcccctgccaca

SEQ ID NO: 411774 - DNA, 15 bp, Homo sapiens
tctcccctgccacaa

SEQ ID NO: 411775 - DNA, 15 bp, Homo sapiens
ctcccctgccacaaa

SEQ ID NO: 411776 - DNA, 15 bp, Homo sapiens
tcccctgccacaaag

SEQ ID NO: 411777 - DNA, 15 bp, Homo sapiens
cccctgccacaaagc

SEQ ID NO: 411778 - DNA, 15 bp, Homo sapiens
ccctgccacaaagcc

SEQ ID NO: 411779 - DNA, 15 bp, Homo sapiens
cctgccacaaagccg

SEQ ID NO: 411780 - DNA, 15 bp, Homo sapiens
ctgccacaaagccgg

SEQ ID NO: 411781 - DNA, 15 bp, Homo sapiens
tgccacaaagccggc

SEQ ID NO: 411782 - DNA, 15 bp, Homo sapiens
gccacaaagccggca

SEQ ID NO: 411783 - DNA, 15 bp, Homo sapiens
ccacaaagccggcag

SEQ ID NO: 411784 - DNA, 15 bp, Homo sapiens
cacaaagccggcaga

SEQ ID NO: 411785 - DNA, 15 bp, Homo sapiens
acaaagccggcagaa

SEQ ID NO: 411786 - DNA, 15 bp, Homo sapiens
caaagccggcagaag

SEQ ID NO: 411787 - DNA, 15 bp, Homo sapiens
aaagccggcagaagg

SEQ ID NO: 411788 - DNA, 15 bp, Homo sapiens
aagccggcagaaggg

SEQ ID NO: 411789 - DNA, 15 bp, Homo sapiens
agccggcagaaggga

SEQ ID NO: 411790 - DNA, 15 bp, Homo sapiens
gccggcagaagggac

SEQ ID NO: 411791 - DNA, 15 bp, Homo sapiens
ccggcagaagggact

SEQ ID NO: 411792 - DNA, 15 bp, Homo sapiens
cggcagaagggacta

SEQ ID NO: 411793 - DNA, 15 bp, Homo sapiens
ggcagaagggactag

SEQ ID NO: 411794 - DNA, 15 bp, Homo sapiens
gcagaagggactaga

SEQ ID NO: 411795 - DNA, 15 bp, Homo sapiens
cagaagggactagat

SEQ ID NO: 411796 - DNA, 15 bp, Homo sapiens
agaagggactagatt

SEQ ID NO: 411797 - DNA, 15 bp, Homo sapiens
gaagggactagattt

SEQ ID NO: 411798 - DNA, 15 bp, Homo sapiens
aagggactagatttg

SEQ ID NO: 411799 - DNA, 15 bp, Homo sapiens
agggactagatttgc

SEQ ID NO: 411800 - DNA, 15 bp, Homo sapiens
gggactagatttgct

SEQ ID NO: 411801 - DNA, 15 bp, Homo sapiens
ggactagatttgctg

SEQ ID NO: 411802 - DNA, 15 bp, Homo sapiens
gactagatttgctgc

SEQ ID NO: 411803 - DNA, 15 bp, Homo sapiens
actagatttgctgcg

SEQ ID NO: 411804 - DNA, 15 bp, Homo sapiens
ctagatttgctgcga

SEQ ID NO: 411805 - DNA, 15 bp, Homo sapiens
tagatttgctgcgag

SEQ ID NO: 411806 - DNA, 15 bp, Homo sapiens
agatttgctgcgaga

SEQ ID NO: 411807 - DNA, 15 bp, Homo sapiens
gatttgctgcgagag

SEQ ID NO: 411808 - DNA, 15 bp, Homo sapiens
atttgctgcgagagc

SEQ ID NO: 411809 - DNA, 15 bp, Homo sapiens
tttgctgcgagagct

SEQ ID NO: 411810 - DNA, 15 bp, Homo sapiens
ttgctgcgagagctt

SEQ ID NO: 411811 - DNA, 15 bp, Homo sapiens
tgctgcgagagcttt

SEQ ID NO: 411812 - DNA, 15 bp, Homo sapiens
gctgcgagagctttt

SEQ ID NO: 411813 - DNA, 15 bp, Homo sapiens
ctgcgagagcttttc

SEQ ID NO: 411814 - DNA, 15 bp, Homo sapiens
tgcgagagcttttct

SEQ ID NO: 411815 - DNA, 15 bp, Homo sapiens
gcgagagcttttctc

SEQ ID NO: 411816 - DNA, 15 bp, Homo sapiens
cgagagcttttctct

SEQ ID NO: 411817 - DNA, 15 bp, Homo sapiens
gagagcttttctctg

SEQ ID NO: 411818 - DNA, 15 bp, Homo sapiens
agagcttttctctgg

SEQ ID NO: 411819 - DNA, 15 bp, Homo sapiens
gagcttttctctgga

SEQ ID NO: 411820 - DNA, 15 bp, Homo sapiens
agcttttctctggac

SEQ ID NO: 411821 - DNA, 15 bp, Homo sapiens
gcttttctctggaca

SEQ ID NO: 411822 - DNA, 15 bp, Homo sapiens
cttttctctggacag

SEQ ID NO: 411823 - DNA, 15 bp, Homo sapiens
ttttctctggacaga

SEQ ID NO: 411824 - DNA, 15 bp, Homo sapiens
tttctctggacagac

SEQ ID NO: 411825 - DNA, 15 bp, Homo sapiens
ttctctggacagaca

SEQ ID NO: 411826 - DNA, 15 bp, Homo sapiens
tctctggacagacag

SEQ ID NO: 411827 - DNA, 15 bp, Homo sapiens
ctctggacagacaga

SEQ ID NO: 411828 - DNA, 15 bp, Homo sapiens
tctggacagacagaa

SEQ ID NO: 411829 - DNA, 15 bp, Homo sapiens
ctggacagacagaac

SEQ ID NO: 411830 - DNA, 15 bp, Homo sapiens
tggacagacagaaca

SEQ ID NO: 411831 - DNA, 15 bp, Homo sapiens
ggacagacagaacac

SEQ ID NO: 411832 - DNA, 15 bp, Homo sapiens
gacagacagaacacc

SEQ ID NO: 411833 - DNA, 15 bp, Homo sapiens
acagacagaacacct

SEQ ID NO: 411834 - DNA, 15 bp, Homo sapiens
cagacagaacacctt

SEQ ID NO: 411835 - DNA, 15 bp, Homo sapiens
agacagaacaccttt

SEQ ID NO: 411836 - DNA, 15 bp, Homo sapiens
gacagaacacctttt

SEQ ID NO: 411837 - DNA, 15 bp, Homo sapiens
acagaacacctttta

SEQ ID NO: 411838 - DNA, 15 bp, Homo sapiens
cagaacaccttttaa

SEQ ID NO: 411839 - DNA, 15 bp, Homo sapiens
agaacaccttttaaa

SEQ ID NO: 411840 - DNA, 15 bp, Homo sapiens
gaacaccttttaaaa

SEQ ID NO: 411841 - DNA, 15 bp, Homo sapiens
aacaccttttaaaac

SEQ ID NO: 411842 - DNA, 15 bp, Homo sapiens
acaccttttaaaaca

SEQ ID NO: 411843 - DNA, 15 bp, Homo sapiens
caccttttaaaacaa

SEQ ID NO: 411844 - DNA, 15 bp, Homo sapiens
accttttaaaacaag

SEQ ID NO: 411845 - DNA, 15 bp, Homo sapiens
ccttttaaaacaagt

SEQ ID NO: 411846 - DNA, 15 bp, Homo sapiens
cttttaaaacaagtt

SEQ ID NO: 411847 - DNA, 15 bp, Homo sapiens
ttttaaaacaagttt

SEQ ID NO: 411848 - DNA, 15 bp, Homo sapiens
tttaaaacaagttta

SEQ ID NO: 411849 - DNA, 15 bp, Homo sapiens
ttaaaacaagtttag

SEQ ID NO: 411850 - DNA, 15 bp, Homo sapiens
taaaacaagtttagt

SEQ ID NO: 411851 - DNA, 15 bp, Homo sapiens
aaaacaagtttagtt

SEQ ID NO: 411852 - DNA, 15 bp, Homo sapiens
aaacaagtttagttc

SEQ ID NO: 411853 - DNA, 15 bp, Homo sapiens
aacaagtttagttct

SEQ ID NO: 411854 - DNA, 15 bp, Homo sapiens
acaagtttagttctg

SEQ ID NO: 411855 - DNA, 15 bp, Homo sapiens
caagtttagttctgt

SEQ ID NO: 411856 - DNA, 15 bp, Homo sapiens
aagtttagttctgtt

SEQ ID NO: 411857 - DNA, 15 bp, Homo sapiens
agtttagttctgttg

SEQ ID NO: 411858 - DNA, 15 bp, Homo sapiens
gtttagttctgttgc

SEQ ID NO: 411859 - DNA, 15 bp, Homo sapiens
tttagttctgttgca

SEQ ID NO: 411860 - DNA, 15 bp, Homo sapiens
ttagttctgttgcat

SEQ ID NO: 411861 - DNA, 15 bp, Homo sapiens
tagttctgttgcatt

SEQ ID NO: 411862 - DNA, 15 bp, Homo sapiens
agttctgttgcattg

SEQ ID NO: 411863 - DNA, 15 bp, Homo sapiens
gttctgttgcattga

SEQ ID NO: 411864 - DNA, 15 bp, Homo sapiens
ttctgttgcattgac

SEQ ID NO: 411865 - DNA, 15 bp, Homo sapiens
tctgttgcattgaca

SEQ ID NO: 411866 - DNA, 15 bp, Homo sapiens
ctgttgcattgacag

SEQ ID NO: 411867 - DNA, 15 bp, Homo sapiens
tgttgcattgacagc

SEQ ID NO: 411868 - DNA, 15 bp, Homo sapiens
gttgcattgacagca

SEQ ID NO: 411869 - DNA, 15 bp, Homo sapiens
ttgcattgacagcat

SEQ ID NO: 411870 - DNA, 15 bp, Homo sapiens
tgcattgacagcatc

SEQ ID NO: 411871 - DNA, 15 bp, Homo sapiens
gcattgacagcatcc

SEQ ID NO: 411872 - DNA, 15 bp, Homo sapiens
cattgacagcatccc

SEQ ID NO: 411873 - DNA, 15 bp, Homo sapiens
attgacagcatccct

SEQ ID NO: 411874 - DNA, 15 bp, Homo sapiens
ttgacagcatccctt

SEQ ID NO: 411875 - DNA, 15 bp, Homo sapiens
tgacagcatccctta

SEQ ID NO: 411876 - DNA, 15 bp, Homo sapiens
gacagcatcccttag

SEQ ID NO: 411877 - DNA, 15 bp, Homo sapiens
acagcatcccttagg

SEQ ID NO: 411878 - DNA, 15 bp, Homo sapiens
cagcatcccttaggc

SEQ ID NO: 411879 - DNA, 15 bp, Homo sapiens
agcatcccttaggcc

SEQ ID NO: 411880 - DNA, 15 bp, Homo sapiens
gcatcccttaggcca

SEQ ID NO: 411881 - DNA, 15 bp, Homo sapiens
catcccttaggccag

SEQ ID NO: 411882 - DNA, 15 bp, Homo sapiens
atcccttaggccagg

SEQ ID NO: 411883 - DNA, 15 bp, Homo sapiens
tcccttaggccaggc

SEQ ID NO: 411884 - DNA, 15 bp, Homo sapiens
cccttaggccaggct

SEQ ID NO: 411885 - DNA, 15 bp, Homo sapiens
ccttaggccaggctg

SEQ ID NO: 411886 - DNA, 15 bp, Homo sapiens
cttaggccaggctga

SEQ ID NO: 411887 - DNA, 15 bp, Homo sapiens
ttaggccaggctgac

SEQ ID NO: 411888 - DNA, 15 bp, Homo sapiens
taggccaggctgacc

SEQ ID NO: 411889 - DNA, 15 bp, Homo sapiens
aggccaggctgacct

SEQ ID NO: 411890 - DNA, 15 bp, Homo sapiens
ggccaggctgaccta

SEQ ID NO: 411891 - DNA, 15 bp, Homo sapiens
gccaggctgacctag

SEQ ID NO: 411892 - DNA, 15 bp, Homo sapiens
ccaggctgacctagg

SEQ ID NO: 411893 - DNA, 15 bp, Homo sapiens
caggctgacctaggg

SEQ ID NO: 411894 - DNA, 15 bp, Homo sapiens
aggctgacctaggga

SEQ ID NO: 411895 - DNA, 15 bp, Homo sapiens
ggctgacctagggaa

SEQ ID NO: 411896 - DNA, 15 bp, Homo sapiens
gctgacctagggaaa

SEQ ID NO: 411897 - DNA, 15 bp, Homo sapiens
ctgacctagggaaat

SEQ ID NO: 411898 - DNA, 15 bp, Homo sapiens
tgacctagggaaatg

SEQ ID NO: 411899 - DNA, 15 bp, Homo sapiens
gacctagggaaatgg

SEQ ID NO: 411900 - DNA, 15 bp, Homo sapiens
acctagggaaatgga

SEQ ID NO: 411901 - DNA, 15 bp, Homo sapiens
cctagggaaatggac

SEQ ID NO: 411902 - DNA, 15 bp, Homo sapiens
ctagggaaatggact

SEQ ID NO: 411903 - DNA, 15 bp, Homo sapiens
tagggaaatggactg

SEQ ID NO: 411904 - DNA, 15 bp, Homo sapiens
agggaaatggactga

SEQ ID NO: 411905 - DNA, 15 bp, Homo sapiens
gggaaatggactgaa

SEQ ID NO: 411906 - DNA, 15 bp, Homo sapiens
ggaaatggactgaaa

SEQ ID NO: 411907 - DNA, 15 bp, Homo sapiens
gaaatggactgaaac

SEQ ID NO: 411908 - DNA, 15 bp, Homo sapiens
aaatggactgaaact

SEQ ID NO: 411909 - DNA, 15 bp, Homo sapiens
aatggactgaaacta

SEQ ID NO: 411910 - DNA, 15 bp, Homo sapiens
atggactgaaactag

SEQ ID NO: 411911 - DNA, 15 bp, Homo sapiens
tggactgaaactagc

SEQ ID NO: 411912 - DNA, 15 bp, Homo sapiens
ggactgaaactagct

SEQ ID NO: 411913 - DNA, 15 bp, Homo sapiens
gactgaaactagctt

SEQ ID NO: 411914 - DNA, 15 bp, Homo sapiens
actgaaactagcttg

SEQ ID NO: 411915 - DNA, 15 bp, Homo sapiens
ctgaaactagcttgg

SEQ ID NO: 411916 - DNA, 15 bp, Homo sapiens
tgaaactagcttggt

SEQ ID NO: 411917 - DNA, 15 bp, Homo sapiens
gaaactagcttggtg

SEQ ID NO: 411918 - DNA, 15 bp, Homo sapiens
aaactagcttggtgg

SEQ ID NO: 411919 - DNA, 15 bp, Homo sapiens
aactagcttggtggt

SEQ ID NO: 411920 - DNA, 15 bp, Homo sapiens
actagcttggtggtt

SEQ ID NO: 411921 - DNA, 15 bp, Homo sapiens
ctagcttggtggtta

SEQ ID NO: 411922 - DNA, 15 bp, Homo sapiens
tagcttggtggttac

SEQ ID NO: 411923 - DNA, 15 bp, Homo sapiens
agcttggtggttacc

SEQ ID NO: 411924 - DNA, 15 bp, Homo sapiens
gcttggtggttacca

SEQ ID NO: 411925 - DNA, 15 bp, Homo sapiens
cttggtggttaccat

SEQ ID NO: 411926 - DNA, 15 bp, Homo sapiens
ttggtggttaccata

SEQ ID NO: 411927 - DNA, 15 bp, Homo sapiens
tggtggttaccatag

SEQ ID NO: 411928 - DNA, 15 bp, Homo sapiens
ggtggttaccatagc

SEQ ID NO: 411929 - DNA, 15 bp, Homo sapiens
gtggttaccatagca

SEQ ID NO: 411930 - DNA, 15 bp, Homo sapiens
tggttaccatagcaa

SEQ ID NO: 411931 - DNA, 15 bp, Homo sapiens
ggttaccatagcaac

SEQ ID NO: 411932 - DNA, 15 bp, Homo sapiens
gttaccatagcaacc

SEQ ID NO: 411933 - DNA, 15 bp, Homo sapiens
ttaccatagcaaccc

SEQ ID NO: 411934 - DNA, 15 bp, Homo sapiens
taccatagcaaccca

SEQ ID NO: 411935 - DNA, 15 bp, Homo sapiens
accatagcaacccag

SEQ ID NO: 411936 - DNA, 15 bp, Homo sapiens
ccatagcaacccagg

SEQ ID NO: 411937 - DNA, 15 bp, Homo sapiens
catagcaacccaggc

SEQ ID NO: 411938 - DNA, 15 bp, Homo sapiens
atagcaacccaggct

SEQ ID NO: 411939 - DNA, 15 bp, Homo sapiens
tagcaacccaggctg

SEQ ID NO: 411940 - DNA, 15 bp, Homo sapiens
agcaacccaggctgc

SEQ ID NO: 411941 - DNA, 15 bp, Homo sapiens
gcaacccaggctgct

SEQ ID NO: 411942 - DNA, 15 bp, Homo sapiens
caacccaggctgctg

SEQ ID NO: 411943 - DNA, 15 bp, Homo sapiens
aacccaggctgctgg

SEQ ID NO: 411944 - DNA, 15 bp, Homo sapiens
acccaggctgctggt

SEQ ID NO: 411945 - DNA, 15 bp, Homo sapiens
cccaggctgctggtg

SEQ ID NO: 411946 - DNA, 15 bp, Homo sapiens
ccaggctgctggtgt

SEQ ID NO: 411947 - DNA, 15 bp, Homo sapiens
caggctgctggtgtc

SEQ ID NO: 411948 - DNA, 15 bp, Homo sapiens
aggctgctggtgtct

SEQ ID NO: 411949 - DNA, 15 bp, Homo sapiens
ggctgctggtgtctg

SEQ ID NO: 411950 - DNA, 15 bp, Homo sapiens
gctgctggtgtctgg

SEQ ID NO: 411951 - DNA, 15 bp, Homo sapiens
ctgctggtgtctggg

SEQ ID NO: 411952 - DNA, 15 bp, Homo sapiens
tgctggtgtctggga

SEQ ID NO: 411953 - DNA, 15 bp, Homo sapiens
gctggtgtctgggag

SEQ ID NO: 411954 - DNA, 15 bp, Homo sapiens
ctggtgtctgggaga

SEQ ID NO: 411955 - DNA, 15 bp, Homo sapiens
tggtgtctgggagag

SEQ ID NO: 411956 - DNA, 15 bp, Homo sapiens
ggtgtctgggagagt

SEQ ID NO: 411957 - DNA, 15 bp, Homo sapiens
gtgtctgggagagtg

SEQ ID NO: 411958 - DNA, 15 bp, Homo sapiens
tgtctgggagagtga

SEQ ID NO: 411959 - DNA, 15 bp, Homo sapiens
gtctgggagagtgag

SEQ ID NO: 411960 - DNA, 15 bp, Homo sapiens
tctgggagagtgaga

SEQ ID NO: 411961 - DNA, 15 bp, Homo sapiens
ctgggagagtgagaa

SEQ ID NO: 411962 - DNA, 15 bp, Homo sapiens
tgggagagtgagaac

SEQ ID NO: 411963 - DNA, 15 bp, Homo sapiens
gggagagtgagaacc

SEQ ID NO: 411964 - DNA, 15 bp, Homo sapiens
ggagagtgagaaccg

SEQ ID NO: 411965 - DNA, 15 bp, Homo sapiens
gagagtgagaaccgg

SEQ ID NO: 411966 - DNA, 15 bp, Homo sapiens
agagtgagaaccggt

SEQ ID NO: 411967 - DNA, 15 bp, Homo sapiens
gagtgagaaccggtg

SEQ ID NO: 411968 - DNA, 15 bp, Homo sapiens
agtgagaaccggtgg

SEQ ID NO: 411969 - DNA, 15 bp, Homo sapiens
gtgagaaccggtggc

SEQ ID NO: 411970 - DNA, 15 bp, Homo sapiens
tgagaaccggtggcc

SEQ ID NO: 411971 - DNA, 15 bp, Homo sapiens
gagaaccggtggcct

SEQ ID NO: 411972 - DNA, 15 bp, Homo sapiens
agaaccggtggcctc

SEQ ID NO: 411973 - DNA, 15 bp, Homo sapiens
gaaccggtggcctct

SEQ ID NO: 411974 - DNA, 15 bp, Homo sapiens
aaccggtggcctctt

SEQ ID NO: 411975 - DNA, 15 bp, Homo sapiens
accggtggcctcttg

SEQ ID NO: 411976 - DNA, 15 bp, Homo sapiens
ccggtggcctcttgt

SEQ ID NO: 411977 - DNA, 15 bp, Homo sapiens
cggtggcctcttgtc

SEQ ID NO: 411978 - DNA, 15 bp, Homo sapiens
ggtggcctcttgtcc

SEQ ID NO: 411979 - DNA, 15 bp, Homo sapiens
gtggcctcttgtcct

SEQ ID NO: 411980 - DNA, 15 bp, Homo sapiens
tggcctcttgtcctg

SEQ ID NO: 411981 - DNA, 15 bp, Homo sapiens
ggcctcttgtcctgt

SEQ ID NO: 411982 - DNA, 15 bp, Homo sapiens
gcctcttgtcctgtg

SEQ ID NO: 411983 - DNA, 15 bp, Homo sapiens
cctcttgtcctgtgt

SEQ ID NO: 411984 - DNA, 15 bp, Homo sapiens
ctcttgtcctgtgtt

SEQ ID NO: 411985 - DNA, 15 bp, Homo sapiens
tcttgtcctgtgttt

SEQ ID NO: 411986 - DNA, 15 bp, Homo sapiens
cttgtcctgtgtttt

SEQ ID NO: 411987 - DNA, 15 bp, Homo sapiens
ttgtcctgtgttttg

SEQ ID NO: 411988 - DNA, 15 bp, Homo sapiens
tgtcctgtgttttgg

SEQ ID NO: 411989 - DNA, 15 bp, Homo sapiens
gtcctgtgttttggt

SEQ ID NO: 411990 - DNA, 15 bp, Homo sapiens
tcctgtgttttggtg

SEQ ID NO: 411991 - DNA, 15 bp, Homo sapiens
cctgtgttttggtgt

SEQ ID NO: 411992 - DNA, 15 bp, Homo sapiens
ctgtgttttggtgtt

SEQ ID NO: 411993 - DNA, 15 bp, Homo sapiens
tgtgttttggtgttt

SEQ ID NO: 411994 - DNA, 15 bp, Homo sapiens
gtgttttggtgtttc

SEQ ID NO: 411995 - DNA, 15 bp, Homo sapiens
tgttttggtgtttct

SEQ ID NO: 411996 - DNA, 15 bp, Homo sapiens
gttttggtgtttctt

SEQ ID NO: 411997 - DNA, 15 bp, Homo sapiens
ttttggtgtttcttc

SEQ ID NO: 411998 - DNA, 15 bp, Homo sapiens
tttggtgtttcttca

SEQ ID NO: 411999 - DNA, 15 bp, Homo sapiens
ttggtgtttcttcag

SEQ ID NO: 412000 - DNA, 15 bp, Homo sapiens
tggtgtttcttcagc

SEQ ID NO: 412001 - DNA, 15 bp, Homo sapiens
ggtgtttcttcagct

SEQ ID NO: 412002 - DNA, 15 bp, Homo sapiens
gtgtttcttcagcta

SEQ ID NO: 412003 - DNA, 15 bp, Homo sapiens
tgtttcttcagctaa

SEQ ID NO: 412004 - DNA, 15 bp, Homo sapiens
gtttcttcagctaag

SEQ ID NO: 412005 - DNA, 15 bp, Homo sapiens
tttcttcagctaaga

SEQ ID NO: 412006 - DNA, 15 bp, Homo sapiens
ttcttcagctaagag

SEQ ID NO: 412007 - DNA, 15 bp, Homo sapiens
tcttcagctaagagt

SEQ ID NO: 412008 - DNA, 15 bp, Homo sapiens
cttcagctaagagta

SEQ ID NO: 412009 - DNA, 15 bp, Homo sapiens
ttcagctaagagtac

SEQ ID NO: 412010 - DNA, 15 bp, Homo sapiens
tcagctaagagtaca

SEQ ID NO: 412011 - DNA, 15 bp, Homo sapiens
cagctaagagtacac

SEQ ID NO: 412012 - DNA, 15 bp, Homo sapiens
agctaagagtacact

SEQ ID NO: 412013 - DNA, 15 bp, Homo sapiens
gctaagagtacactc

SEQ ID NO: 412014 - DNA, 15 bp, Homo sapiens
ctaagagtacactcc

SEQ ID NO: 412015 - DNA, 15 bp, Homo sapiens
taagagtacactcct

SEQ ID NO: 412016 - DNA, 15 bp, Homo sapiens
aagagtacactcctc

SEQ ID NO: 412017 - DNA, 15 bp, Homo sapiens
agagtacactcctcc

SEQ ID NO: 412018 - DNA, 15 bp, Homo sapiens
gagtacactcctcct

SEQ ID NO: 412019 - DNA, 15 bp, Homo sapiens
agtacactcctcctt

SEQ ID NO: 412020 - DNA, 15 bp, Homo sapiens
gtacactcctccttc

SEQ ID NO: 412021 - DNA, 15 bp, Homo sapiens
tacactcctccttcg

SEQ ID NO: 412022 - DNA, 15 bp, Homo sapiens
acactcctccttcga

SEQ ID NO: 412023 - DNA, 15 bp, Homo sapiens
cactcctccttcgaa

SEQ ID NO: 412024 - DNA, 15 bp, Homo sapiens
actcctccttcgaac

SEQ ID NO: 412025 - DNA, 15 bp, Homo sapiens
ctcctccttcgaact

SEQ ID NO: 412026 - DNA, 15 bp, Homo sapiens
tcctccttcgaactc

SEQ ID NO: 412027 - DNA, 15 bp, Homo sapiens
cctccttcgaactct

SEQ ID NO: 412028 - DNA, 15 bp, Homo sapiens
ctccttcgaactcta

SEQ ID NO: 412029 - DNA, 15 bp, Homo sapiens
tccttcgaactctac

SEQ ID NO: 412030 - DNA, 15 bp, Homo sapiens
ccttcgaactctaca

SEQ ID NO: 412031 - DNA, 15 bp, Homo sapiens
cttcgaactctacat

SEQ ID NO: 412032 - DNA, 15 bp, Homo sapiens
ttcgaactctacata

SEQ ID NO: 412033 - DNA, 15 bp, Homo sapiens
tcgaactctacataa

SEQ ID NO: 412034 - DNA, 15 bp, Homo sapiens
cgaactctacataag

SEQ ID NO: 412035 - DNA, 15 bp, Homo sapiens
gaactctacataagt

SEQ ID NO: 412036 - DNA, 15 bp, Homo sapiens
aactctacataagtc

SEQ ID NO: 412037 - DNA, 15 bp, Homo sapiens
actctacataagtca

SEQ ID NO: 412038 - DNA, 15 bp, Homo sapiens
ctctacataagtcat

SEQ ID NO: 412039 - DNA, 15 bp, Homo sapiens
tctacataagtcatg

SEQ ID NO: 412040 - DNA, 15 bp, Homo sapiens
ctacataagtcatgc

SEQ ID NO: 412041 - DNA, 15 bp, Homo sapiens
tacataagtcatgct

SEQ ID NO: 412042 - DNA, 15 bp, Homo sapiens
acataagtcatgctc

SEQ ID NO: 412043 - DNA, 15 bp, Homo sapiens
cataagtcatgctct

SEQ ID NO: 412044 - DNA, 15 bp, Homo sapiens
ataagtcatgctctt

SEQ ID NO: 412045 - DNA, 15 bp, Homo sapiens
taagtcatgctcttt

SEQ ID NO: 412046 - DNA, 15 bp, Homo sapiens
aagtcatgctctttg

SEQ ID NO: 412047 - DNA, 15 bp, Homo sapiens
agtcatgctctttga

SEQ ID NO: 412048 - DNA, 15 bp, Homo sapiens
gtcatgctctttgaa

SEQ ID NO: 412049 - DNA, 15 bp, Homo sapiens
tcatgctctttgaaa

SEQ ID NO: 412050 - DNA, 15 bp, Homo sapiens
catgctctttgaaaa

SEQ ID NO: 412051 - DNA, 15 bp, Homo sapiens
atgctctttgaaaac

SEQ ID NO: 412052 - DNA, 15 bp, Homo sapiens
tgctctttgaaaact

SEQ ID NO: 412053 - DNA, 15 bp, Homo sapiens
gctctttgaaaactg

SEQ ID NO: 412054 - DNA, 15 bp, Homo sapiens
ctctttgaaaactgg

SEQ ID NO: 412055 - DNA, 15 bp, Homo sapiens
tctttgaaaactggc

SEQ ID NO: 412056 - DNA, 15 bp, Homo sapiens
ctttgaaaactggct

SEQ ID NO: 412057 - DNA, 15 bp, Homo sapiens
tttgaaaactggctc

SEQ ID NO: 412058 - DNA, 15 bp, Homo sapiens
ttgaaaactggctct

SEQ ID NO: 412059 - DNA, 15 bp, Homo sapiens
tgaaaactggctctt

SEQ ID NO: 412060 - DNA, 15 bp, Homo sapiens
gaaaactggctcttt

SEQ ID NO: 412061 - DNA, 15 bp, Homo sapiens
aaaactggctcttta

SEQ ID NO: 412062 - DNA, 15 bp, Homo sapiens
aaactggctctttac

SEQ ID NO: 412063 - DNA, 15 bp, Homo sapiens
aactggctctttacc

SEQ ID NO: 412064 - DNA, 15 bp, Homo sapiens
actggctctttaccc

SEQ ID NO: 412065 - DNA, 15 bp, Homo sapiens
ctggctctttaccca

SEQ ID NO: 412066 - DNA, 15 bp, Homo sapiens
tggctctttacccag

SEQ ID NO: 412067 - DNA, 15 bp, Homo sapiens
ggctctttacccagg

SEQ ID NO: 412068 - DNA, 15 bp, Homo sapiens
gctctttacccagga

SEQ ID NO: 412069 - DNA, 15 bp, Homo sapiens
ctctttacccaggat

SEQ ID NO: 412070 - DNA, 15 bp, Homo sapiens
tctttacccaggatt

SEQ ID NO: 412071 - DNA, 15 bp, Homo sapiens
ctttacccaggattt

SEQ ID NO: 412072 - DNA, 15 bp, Homo sapiens
tttacccaggatttt

SEQ ID NO: 412073 - DNA, 15 bp, Homo sapiens
ttacccaggattttt

SEQ ID NO: 412074 - DNA, 15 bp, Homo sapiens
tacccaggatttttt

SEQ ID NO: 412075 - DNA, 15 bp, Homo sapiens
acccaggattttttt

SEQ ID NO: 412076 - DNA, 15 bp, Homo sapiens
cccaggatttttttt

SEQ ID NO: 412077 - DNA, 15 bp, Homo sapiens
ccaggattttttttt

SEQ ID NO: 412078 - DNA, 15 bp, Homo sapiens
caggatttttttttt

SEQ ID NO: 412079 - DNA, 15 bp, Homo sapiens
aggattttttttttt

SEQ ID NO: 412080 - DNA, 15 bp, Homo sapiens
ggatttttttttttt

SEQ ID NO: 412081 - DNA, 15 bp, Homo sapiens
gattttttttttttc

SEQ ID NO: 412082 - DNA, 15 bp, Homo sapiens
attttttttttttcg

SEQ ID NO: 412083 - DNA, 15 bp, Homo sapiens
ttttttttttcgttc

SEQ ID NO: 412084 - DNA, 15 bp, Homo sapiens
tttttttttcgttct

SEQ ID NO: 412085 - DNA, 15 bp, Homo sapiens
ttttttttcgttctg

SEQ ID NO: 412086 - DNA, 15 bp, Homo sapiens
tttttttcgttctga

SEQ ID NO: 412087 - DNA, 15 bp, Homo sapiens
ttttttcgttctgaa

SEQ ID NO: 412088 - DNA, 15 bp, Homo sapiens
tttttcgttctgaaa

SEQ ID NO: 412089 - DNA, 15 bp, Homo sapiens
ttttcgttctgaaat

SEQ ID NO: 412090 - DNA, 15 bp, Homo sapiens
tttcgttctgaaatc

SEQ ID NO: 412091 - DNA, 15 bp, Homo sapiens
ttcgttctgaaatcg

SEQ ID NO: 412092 - DNA, 15 bp, Homo sapiens
tcgttctgaaatcgg

SEQ ID NO: 412093 - DNA, 15 bp, Homo sapiens
cgttctgaaatcggt

SEQ ID NO: 412094 - DNA, 15 bp, Homo sapiens
gttctgaaatcggtc

SEQ ID NO: 412095 - DNA, 15 bp, Homo sapiens
ttctgaaatcggtct

SEQ ID NO: 412096 - DNA, 15 bp, Homo sapiens
tctgaaatcggtctg

SEQ ID NO: 412097 - DNA, 15 bp, Homo sapiens
ctgaaatcggtctga

SEQ ID NO: 412098 - DNA, 15 bp, Homo sapiens
tgaaatcggtctgaa

SEQ ID NO: 412099 - DNA, 15 bp, Homo sapiens
gaaatcggtctgaat

SEQ ID NO: 412100 - DNA, 15 bp, Homo sapiens
aaatcggtctgaatg

SEQ ID NO: 412101 - DNA, 15 bp, Homo sapiens
aatcggtctgaatgg

SEQ ID NO: 412102 - DNA, 15 bp, Homo sapiens
atcggtctgaatgga

SEQ ID NO: 412103 - DNA, 15 bp, Homo sapiens
tcggtctgaatggag

SEQ ID NO: 412104 - DNA, 15 bp, Homo sapiens
cggtctgaatggagg

SEQ ID NO: 412105 - DNA, 15 bp, Homo sapiens
ggtctgaatggagga

SEQ ID NO: 412106 - DNA, 15 bp, Homo sapiens
gtctgaatggaggaa

SEQ ID NO: 412107 - DNA, 15 bp, Homo sapiens
tctgaatggaggaag

SEQ ID NO: 412108 - DNA, 15 bp, Homo sapiens
ctgaatggaggaagt

SEQ ID NO: 412109 - DNA, 15 bp, Homo sapiens
tgaatggaggaagtt

SEQ ID NO: 412110 - DNA, 15 bp, Homo sapiens
gaatggaggaagttg

SEQ ID NO: 412111 - DNA, 15 bp, Homo sapiens
aatggaggaagttgg

SEQ ID NO: 412112 - DNA, 15 bp, Homo sapiens
atggaggaagttggt

SEQ ID NO: 412113 - DNA, 15 bp, Homo sapiens
tggaggaagttggta

SEQ ID NO: 412114 - DNA, 15 bp, Homo sapiens
ggaggaagttggtaa

SEQ ID NO: 412115 - DNA, 15 bp, Homo sapiens
gaggaagttggtaat

SEQ ID NO: 412116 - DNA, 15 bp, Homo sapiens
aggaagttggtaata

SEQ ID NO: 412117 - DNA, 15 bp, Homo sapiens
ggaagttggtaatac

SEQ ID NO: 412118 - DNA, 15 bp, Homo sapiens
gaagttggtaatact

SEQ ID NO: 412119 - DNA, 15 bp, Homo sapiens
aagttggtaatactt

SEQ ID NO: 412120 - DNA, 15 bp, Homo sapiens
agttggtaatacttg

SEQ ID NO: 412121 - DNA, 15 bp, Homo sapiens
gttggtaatacttgg

SEQ ID NO: 412122 - DNA, 15 bp, Homo sapiens
ttggtaatacttggc

SEQ ID NO: 412123 - DNA, 15 bp, Homo sapiens
tggtaatacttggct

SEQ ID NO: 412124 - DNA, 15 bp, Homo sapiens
ggtaatacttggctt

SEQ ID NO: 412125 - DNA, 15 bp, Homo sapiens
gtaatacttggcttt

SEQ ID NO: 412126 - DNA, 15 bp, Homo sapiens
taatacttggctttt

SEQ ID NO: 412127 - DNA, 15 bp, Homo sapiens
aatacttggcttttt

SEQ ID NO: 412128 - DNA, 15 bp, Homo sapiens
atacttggctttttt

SEQ ID NO: 412129 - DNA, 15 bp, Homo sapiens
tacttggcttttttt

SEQ ID NO: 412130 - DNA, 15 bp, Homo sapiens
acttggctttttttt

SEQ ID NO: 412131 - DNA, 15 bp, Homo sapiens
cttggcttttttttt

SEQ ID NO: 412132 - DNA, 15 bp, Homo sapiens
ttggctttttttttt

SEQ ID NO: 412133 - DNA, 15 bp, Homo sapiens
ggctttttttttttc

SEQ ID NO: 412134 - DNA, 15 bp, Homo sapiens
tttttttttttcttc

SEQ ID NO: 412135 - DNA, 15 bp, Homo sapiens
ttttttttttcttct

SEQ ID NO: 412136 - DNA, 15 bp, Homo sapiens
tttttttttcttctc

SEQ ID NO: 412137 - DNA, 15 bp, Homo sapiens
ttttttttcttctct

SEQ ID NO: 412138 - DNA, 15 bp, Homo sapiens
tttttttcttctctc

SEQ ID NO: 412139 - DNA, 15 bp, Homo sapiens
ttttttcttctctca

SEQ ID NO: 412140 - DNA, 15 bp, Homo sapiens
tttttcttctctcat

SEQ ID NO: 412141 - DNA, 15 bp, Homo sapiens
ttttcttctctcatg

SEQ ID NO: 412142 - DNA, 15 bp, Homo sapiens
tttcttctctcatgc

SEQ ID NO: 412143 - DNA, 15 bp, Homo sapiens
ttcttctctcatgca

SEQ ID NO: 412144 - DNA, 15 bp, Homo sapiens
tcttctctcatgcaa

SEQ ID NO: 412145 - DNA, 15 bp, Homo sapiens
cttctctcatgcaag

SEQ ID NO: 412146 - DNA, 15 bp, Homo sapiens
ttctctcatgcaagt

SEQ ID NO: 412147 - DNA, 15 bp, Homo sapiens
tctctcatgcaagtt

SEQ ID NO: 412148 - DNA, 15 bp, Homo sapiens
ctctcatgcaagttt

SEQ ID NO: 412149 - DNA, 15 bp, Homo sapiens
tctcatgcaagtttc

SEQ ID NO: 412150 - DNA, 15 bp, Homo sapiens
ctcatgcaagtttcc

SEQ ID NO: 412151 - DNA, 15 bp, Homo sapiens
tcatgcaagtttcca

SEQ ID NO: 412152 - DNA, 15 bp, Homo sapiens
catgcaagtttccag

SEQ ID NO: 412153 - DNA, 15 bp, Homo sapiens
atgcaagtttccagg

SEQ ID NO: 412154 - DNA, 15 bp, Homo sapiens
tgcaagtttccagga

SEQ ID NO: 412155 - DNA, 15 bp, Homo sapiens
gcaagtttccaggat

SEQ ID NO: 412156 - DNA, 15 bp, Homo sapiens
caagtttccaggata

SEQ ID NO: 412157 - DNA, 15 bp, Homo sapiens
aagtttccaggatat

SEQ ID NO: 412158 - DNA, 15 bp, Homo sapiens
agtttccaggatata

SEQ ID NO: 412159 - DNA, 15 bp, Homo sapiens
gtttccaggatatag

SEQ ID NO: 412160 - DNA, 15 bp, Homo sapiens
tttccaggatatagc

SEQ ID NO: 412161 - DNA, 15 bp, Homo sapiens
ttccaggatatagct

SEQ ID NO: 412162 - DNA, 15 bp, Homo sapiens
tccaggatatagctt

SEQ ID NO: 412163 - DNA, 15 bp, Homo sapiens
ccaggatatagcttc

SEQ ID NO: 412164 - DNA, 15 bp, Homo sapiens
caggatatagcttct

SEQ ID NO: 412165 - DNA, 15 bp, Homo sapiens
aggatatagcttctt

SEQ ID NO: 412166 - DNA, 15 bp, Homo sapiens
ggatatagcttcttt

SEQ ID NO: 412167 - DNA, 15 bp, Homo sapiens
gatatagcttctttt

SEQ ID NO: 412168 - DNA, 15 bp, Homo sapiens
atatagcttcttttt

SEQ ID NO: 412169 - DNA, 15 bp, Homo sapiens
tatagcttctttttt

SEQ ID NO: 412170 - DNA, 15 bp, Homo sapiens
atagcttcttttttt

SEQ ID NO: 412171 - DNA, 15 bp, Homo sapiens
tagcttctttttttg

SEQ ID NO: 412172 - DNA, 15 bp, Homo sapiens
agcttctttttttgc

SEQ ID NO: 412173 - DNA, 15 bp, Homo sapiens
gcttctttttttgct

SEQ ID NO: 412174 - DNA, 15 bp, Homo sapiens
cttctttttttgctg

SEQ ID NO: 412175 - DNA, 15 bp, Homo sapiens
ttctttttttgctgt

SEQ ID NO: 412176 - DNA, 15 bp, Homo sapiens
tctttttttgctgta

SEQ ID NO: 412177 - DNA, 15 bp, Homo sapiens
ctttttttgctgtat

SEQ ID NO: 412178 - DNA, 15 bp, Homo sapiens
tttttttgctgtatg

SEQ ID NO: 412179 - DNA, 15 bp, Homo sapiens
ttttttgctgtatgt

SEQ ID NO: 412180 - DNA, 15 bp, Homo sapiens
tttttgctgtatgta

SEQ ID NO: 412181 - DNA, 15 bp, Homo sapiens
ttttgctgtatgtaa

SEQ ID NO: 412182 - DNA, 15 bp, Homo sapiens
tttgctgtatgtaat

SEQ ID NO: 412183 - DNA, 15 bp, Homo sapiens
ttgctgtatgtaatt

SEQ ID NO: 412184 - DNA, 15 bp, Homo sapiens
tgctgtatgtaattg

SEQ ID NO: 412185 - DNA, 15 bp, Homo sapiens
gctgtatgtaattga

SEQ ID NO: 412186 - DNA, 15 bp, Homo sapiens
ctgtatgtaattgag

SEQ ID NO: 412187 - DNA, 15 bp, Homo sapiens
tgtatgtaattgaga

SEQ ID NO: 412188 - DNA, 15 bp, Homo sapiens
gtatgtaattgagac

SEQ ID NO: 412189 - DNA, 15 bp, Homo sapiens
tatgtaattgagacc

SEQ ID NO: 412190 - DNA, 15 bp, Homo sapiens
atgtaattgagacca

SEQ ID NO: 412191 - DNA, 15 bp, Homo sapiens
tgtaattgagaccaa

SEQ ID NO: 412192 - DNA, 15 bp, Homo sapiens
gtaattgagaccaaa

SEQ ID NO: 412193 - DNA, 15 bp, Homo sapiens
taattgagaccaaac

SEQ ID NO: 412194 - DNA, 15 bp, Homo sapiens
aattgagaccaaact

SEQ ID NO: 412195 - DNA, 15 bp, Homo sapiens
attgagaccaaactc

SEQ ID NO: 412196 - DNA, 15 bp, Homo sapiens
ttgagaccaaactct

SEQ ID NO: 412197 - DNA, 15 bp, Homo sapiens
tgagaccaaactcta

SEQ ID NO: 412198 - DNA, 15 bp, Homo sapiens
gagaccaaactctaa

SEQ ID NO: 412199 - DNA, 15 bp, Homo sapiens
agaccaaactctaag

SEQ ID NO: 412200 - DNA, 15 bp, Homo sapiens
gaccaaactctaagc

SEQ ID NO: 412201 - DNA, 15 bp, Homo sapiens
accaaactctaagct

SEQ ID NO: 412202 - DNA, 15 bp, Homo sapiens
ccaaactctaagctt

SEQ ID NO: 412203 - DNA, 15 bp, Homo sapiens
caaactctaagcttg

SEQ ID NO: 412204 - DNA, 15 bp, Homo sapiens
aaactctaagcttgg

SEQ ID NO: 412205 - DNA, 15 bp, Homo sapiens
aactctaagcttggg

SEQ ID NO: 412206 - DNA, 15 bp, Homo sapiens
actctaagcttgggg

SEQ ID NO: 412207 - DNA, 15 bp, Homo sapiens
ctctaagcttggggc

SEQ ID NO: 412208 - DNA, 15 bp, Homo sapiens
tctaagcttggggcc

SEQ ID NO: 412209 - DNA, 15 bp, Homo sapiens
ctaagcttggggccc

SEQ ID NO: 412210 - DNA, 15 bp, Homo sapiens
taagcttggggccct

SEQ ID NO: 412211 - DNA, 15 bp, Homo sapiens
aagcttggggccctg

SEQ ID NO: 412212 - DNA, 15 bp, Homo sapiens
agcttggggccctgg

SEQ ID NO: 412213 - DNA, 15 bp, Homo sapiens
gcttggggccctgga

SEQ ID NO: 412214 - DNA, 15 bp, Homo sapiens
cttggggccctggag

SEQ ID NO: 412215 - DNA, 15 bp, Homo sapiens
ttggggccctggaga

SEQ ID NO: 412216 - DNA, 15 bp, Homo sapiens
tggggccctggagag

SEQ ID NO: 412217 - DNA, 15 bp, Homo sapiens
ggggccctggagaga

SEQ ID NO: 412218 - DNA, 15 bp, Homo sapiens
gggccctggagagaa

SEQ ID NO: 412219 - DNA, 15 bp, Homo sapiens
ggccctggagagaac

SEQ ID NO: 412220 - DNA, 15 bp, Homo sapiens
gccctggagagaaca

SEQ ID NO: 412221 - DNA, 15 bp, Homo sapiens
ccctggagagaacag

SEQ ID NO: 412222 - DNA, 15 bp, Homo sapiens
cctggagagaacagt

SEQ ID NO: 412223 - DNA, 15 bp, Homo sapiens
ctggagagaacagtt

SEQ ID NO: 412224 - DNA, 15 bp, Homo sapiens
tggagagaacagttg

SEQ ID NO: 412225 - DNA, 15 bp, Homo sapiens
ggagagaacagttgt

SEQ ID NO: 412226 - DNA, 15 bp, Homo sapiens
gagagaacagttgtg

SEQ ID NO: 412227 - DNA, 15 bp, Homo sapiens
agagaacagttgtgg

SEQ ID NO: 412228 - DNA, 15 bp, Homo sapiens
gagaacagttgtggc

SEQ ID NO: 412229 - DNA, 15 bp, Homo sapiens
agaacagttgtggcc

SEQ ID NO: 412230 - DNA, 15 bp, Homo sapiens
gaacagttgtggcct

SEQ ID NO: 412231 - DNA, 15 bp, Homo sapiens
aacagttgtggcctg

SEQ ID NO: 412232 - DNA, 15 bp, Homo sapiens
acagttgtggcctgc

SEQ ID NO: 412233 - DNA, 15 bp, Homo sapiens
cagttgtggcctgca

SEQ ID NO: 412234 - DNA, 15 bp, Homo sapiens
agttgtggcctgcag

SEQ ID NO: 412235 - DNA, 15 bp, Homo sapiens
gttgtggcctgcagg

SEQ ID NO: 412236 - DNA, 15 bp, Homo sapiens
ttgtggcctgcaggt

SEQ ID NO: 412237 - DNA, 15 bp, Homo sapiens
tgtggcctgcaggtc

SEQ ID NO: 412238 - DNA, 15 bp, Homo sapiens
gtggcctgcaggtca

SEQ ID NO: 412239 - DNA, 15 bp, Homo sapiens
tggcctgcaggtcat

SEQ ID NO: 412240 - DNA, 15 bp, Homo sapiens
ggcctgcaggtcatt

SEQ ID NO: 412241 - DNA, 15 bp, Homo sapiens
gcctgcaggtcatta

SEQ ID NO: 412242 - DNA, 15 bp, Homo sapiens
cctgcaggtcattag

SEQ ID NO: 412243 - DNA, 15 bp, Homo sapiens
ctgcaggtcattagt

SEQ ID NO: 412244 - DNA, 15 bp, Homo sapiens
tgcaggtcattagtg

SEQ ID NO: 412245 - DNA, 15 bp, Homo sapiens
gcaggtcattagtga

SEQ ID NO: 412246 - DNA, 15 bp, Homo sapiens
caggtcattagtgag

SEQ ID NO: 412247 - DNA, 15 bp, Homo sapiens
aggtcattagtgagg

SEQ ID NO: 412248 - DNA, 15 bp, Homo sapiens
ggtcattagtgaggt

SEQ ID NO: 412249 - DNA, 15 bp, Homo sapiens
gtcattagtgaggtg

SEQ ID NO: 412250 - DNA, 15 bp, Homo sapiens
tcattagtgaggtga

SEQ ID NO: 412251 - DNA, 15 bp, Homo sapiens
cattagtgaggtgag

SEQ ID NO: 412252 - DNA, 15 bp, Homo sapiens
attagtgaggtgagc

SEQ ID NO: 412253 - DNA, 15 bp, Homo sapiens
ttagtgaggtgagca

SEQ ID NO: 412254 - DNA, 15 bp, Homo sapiens
tagtgaggtgagcag

SEQ ID NO: 412255 - DNA, 15 bp, Homo sapiens
agtgaggtgagcaga

SEQ ID NO: 412256 - DNA, 15 bp, Homo sapiens
gtgaggtgagcagaa

SEQ ID NO: 412257 - DNA, 15 bp, Homo sapiens
tgaggtgagcagaag

SEQ ID NO: 412258 - DNA, 15 bp, Homo sapiens
gaggtgagcagaagg

SEQ ID NO: 412259 - DNA, 15 bp, Homo sapiens
aggtgagcagaaggg

SEQ ID NO: 412260 - DNA, 15 bp, Homo sapiens
ggtgagcagaaggga

SEQ ID NO: 412261 - DNA, 15 bp, Homo sapiens
gtgagcagaagggaa

SEQ ID NO: 412262 - DNA, 15 bp, Homo sapiens
tgagcagaagggaat

SEQ ID NO: 412263 - DNA, 15 bp, Homo sapiens
gagcagaagggaatc

SEQ ID NO: 412264 - DNA, 15 bp, Homo sapiens
agcagaagggaatcc

SEQ ID NO: 412265 - DNA, 15 bp, Homo sapiens
gcagaagggaatcct

SEQ ID NO: 412266 - DNA, 15 bp, Homo sapiens
cagaagggaatcctg

SEQ ID NO: 412267 - DNA, 15 bp, Homo sapiens
agaagggaatcctgg

SEQ ID NO: 412268 - DNA, 15 bp, Homo sapiens
gaagggaatcctgga

SEQ ID NO: 412269 - DNA, 15 bp, Homo sapiens
aagggaatcctggac

SEQ ID NO: 412270 - DNA, 15 bp, Homo sapiens
agggaatcctggact

SEQ ID NO: 412271 - DNA, 15 bp, Homo sapiens
gggaatcctggactt

SEQ ID NO: 412272 - DNA, 15 bp, Homo sapiens
ggaatcctggacttc

SEQ ID NO: 412273 - DNA, 15 bp, Homo sapiens
gaatcctggacttcc

SEQ ID NO: 412274 - DNA, 15 bp, Homo sapiens
aatcctggacttccc

SEQ ID NO: 412275 - DNA, 15 bp, Homo sapiens
atcctggacttccca

SEQ ID NO: 412276 - DNA, 15 bp, Homo sapiens
tcctggacttcccag

SEQ ID NO: 412277 - DNA, 15 bp, Homo sapiens
cctggacttcccaga

SEQ ID NO: 412278 - DNA, 15 bp, Homo sapiens
ctggacttcccagag

SEQ ID NO: 412279 - DNA, 15 bp, Homo sapiens
tggacttcccagaga

SEQ ID NO: 412280 - DNA, 15 bp, Homo sapiens
ggacttcccagagaa

SEQ ID NO: 412281 - DNA, 15 bp, Homo sapiens
gacttcccagagaaa

SEQ ID NO: 412282 - DNA, 15 bp, Homo sapiens
acttcccagagaaag

SEQ ID NO: 412283 - DNA, 15 bp, Homo sapiens
cttcccagagaaaga

SEQ ID NO: 412284 - DNA, 15 bp, Homo sapiens
ttcccagagaaagag

SEQ ID NO: 412285 - DNA, 15 bp, Homo sapiens
tcccagagaaagagg

SEQ ID NO: 412286 - DNA, 15 bp, Homo sapiens
cccagagaaagagga

SEQ ID NO: 412287 - DNA, 15 bp, Homo sapiens
ccagagaaagaggag

SEQ ID NO: 412288 - DNA, 15 bp, Homo sapiens
cagagaaagaggaga

SEQ ID NO: 412289 - DNA, 15 bp, Homo sapiens
agagaaagaggagac

SEQ ID NO: 412290 - DNA, 15 bp, Homo sapiens
gagaaagaggagacc

SEQ ID NO: 412291 - DNA, 15 bp, Homo sapiens
agaaagaggagacca

SEQ ID NO: 412292 - DNA, 15 bp, Homo sapiens
gaaagaggagaccat

SEQ ID NO: 412293 - DNA, 15 bp, Homo sapiens
aaagaggagaccatg

SEQ ID NO: 412294 - DNA, 15 bp, Homo sapiens
aagaggagaccatgc

SEQ ID NO: 412295 - DNA, 15 bp, Homo sapiens
agaggagaccatgcc

SEQ ID NO: 412296 - DNA, 15 bp, Homo sapiens
gaggagaccatgcca

SEQ ID NO: 412297 - DNA, 15 bp, Homo sapiens
aggagaccatgccag

SEQ ID NO: 412298 - DNA, 15 bp, Homo sapiens
ggagaccatgccagc

SEQ ID NO: 412299 - DNA, 15 bp, Homo sapiens
gagaccatgccagcc

SEQ ID NO: 412300 - DNA, 15 bp, Homo sapiens
agaccatgccagcct

SEQ ID NO: 412301 - DNA, 15 bp, Homo sapiens
gaccatgccagcctc

SEQ ID NO: 412302 - DNA, 15 bp, Homo sapiens
accatgccagcctcg

SEQ ID NO: 412303 - DNA, 15 bp, Homo sapiens
ccatgccagcctcgt

SEQ ID NO: 412304 - DNA, 15 bp, Homo sapiens
catgccagcctcgtg

SEQ ID NO: 412305 - DNA, 15 bp, Homo sapiens
atgccagcctcgtgg

SEQ ID NO: 412306 - DNA, 15 bp, Homo sapiens
tgccagcctcgtgga

SEQ ID NO: 412307 - DNA, 15 bp, Homo sapiens
gccagcctcgtggaa

SEQ ID NO: 412308 - DNA, 15 bp, Homo sapiens
ccagcctcgtggaac

SEQ ID NO: 412309 - DNA, 15 bp, Homo sapiens
cagcctcgtggaaca

SEQ ID NO: 412310 - DNA, 15 bp, Homo sapiens
agcctcgtggaacac

SEQ ID NO: 412311 - DNA, 15 bp, Homo sapiens
gcctcgtggaacaca

SEQ ID NO: 412312 - DNA, 15 bp, Homo sapiens
cctcgtggaacacag

SEQ ID NO: 412313 - DNA, 15 bp, Homo sapiens
ctcgtggaacacagc

SEQ ID NO: 412314 - DNA, 15 bp, Homo sapiens
tcgtggaacacagct

SEQ ID NO: 412315 - DNA, 15 bp, Homo sapiens
cgtggaacacagcta

SEQ ID NO: 412316 - DNA, 15 bp, Homo sapiens
gtggaacacagctac

SEQ ID NO: 412317 - DNA, 15 bp, Homo sapiens
tggaacacagctacc

SEQ ID NO: 412318 - DNA, 15 bp, Homo sapiens
ggaacacagctacca

SEQ ID NO: 412319 - DNA, 15 bp, Homo sapiens
gaacacagctaccag

SEQ ID NO: 412320 - DNA, 15 bp, Homo sapiens
aacacagctaccagg

SEQ ID NO: 412321 - DNA, 15 bp, Homo sapiens
acacagctaccagga

SEQ ID NO: 412322 - DNA, 15 bp, Homo sapiens
cacagctaccaggaa

SEQ ID NO: 412323 - DNA, 15 bp, Homo sapiens
acagctaccaggaaa

SEQ ID NO: 412324 - DNA, 15 bp, Homo sapiens
cagctaccaggaaat

SEQ ID NO: 412325 - DNA, 15 bp, Homo sapiens
agctaccaggaaata

SEQ ID NO: 412326 - DNA, 15 bp, Homo sapiens
gctaccaggaaatac

SEQ ID NO: 412327 - DNA, 15 bp, Homo sapiens
ctaccaggaaataca

SEQ ID NO: 412328 - DNA, 15 bp, Homo sapiens
taccaggaaatacag

SEQ ID NO: 412329 - DNA, 15 bp, Homo sapiens
accaggaaatacaga

SEQ ID NO: 412330 - DNA, 15 bp, Homo sapiens
ccaggaaatacagaa

SEQ ID NO: 412331 - DNA, 15 bp, Homo sapiens
caggaaatacagaag

SEQ ID NO: 412332 - DNA, 15 bp, Homo sapiens
aggaaatacagaagc

SEQ ID NO: 412333 - DNA, 15 bp, Homo sapiens
ggaaatacagaagca

SEQ ID NO: 412334 - DNA, 15 bp, Homo sapiens
gaaatacagaagcag

SEQ ID NO: 412335 - DNA, 15 bp, Homo sapiens
aaatacagaagcagg

SEQ ID NO: 412336 - DNA, 15 bp, Homo sapiens
aatacagaagcaggt

SEQ ID NO: 412337 - DNA, 15 bp, Homo sapiens
atacagaagcaggtc

SEQ ID NO: 412338 - DNA, 15 bp, Homo sapiens
tacagaagcaggtct

SEQ ID NO: 412339 - DNA, 15 bp, Homo sapiens
acagaagcaggtcta

SEQ ID NO: 412340 - DNA, 15 bp, Homo sapiens
cagaagcaggtctat

SEQ ID NO: 412341 - DNA, 15 bp, Homo sapiens
agaagcaggtctatt

SEQ ID NO: 412342 - DNA, 15 bp, Homo sapiens
gaagcaggtctattc

SEQ ID NO: 412343 - DNA, 15 bp, Homo sapiens
aagcaggtctattcc

SEQ ID NO: 412344 - DNA, 15 bp, Homo sapiens
agcaggtctattcct

SEQ ID NO: 412345 - DNA, 15 bp, Homo sapiens
gcaggtctattcctt

SEQ ID NO: 412346 - DNA, 15 bp, Homo sapiens
caggtctattccttg

SEQ ID NO: 412347 - DNA, 15 bp, Homo sapiens
aggtctattccttgc

SEQ ID NO: 412348 - DNA, 15 bp, Homo sapiens
ggtctattccttgcg

SEQ ID NO: 412349 - DNA, 15 bp, Homo sapiens
gtctattccttgcga

SEQ ID NO: 412350 - DNA, 15 bp, Homo sapiens
tctattccttgcgaa

SEQ ID NO: 412351 - DNA, 15 bp, Homo sapiens
ctattccttgcgaac

SEQ ID NO: 412352 - DNA, 15 bp, Homo sapiens
tattccttgcgaact

SEQ ID NO: 412353 - DNA, 15 bp, Homo sapiens
attccttgcgaactc

SEQ ID NO: 412354 - DNA, 15 bp, Homo sapiens
ttccttgcgaactcc

SEQ ID NO: 412355 - DNA, 15 bp, Homo sapiens
tccttgcgaactccg

SEQ ID NO: 412356 - DNA, 15 bp, Homo sapiens
ccttgcgaactccga

SEQ ID NO: 412357 - DNA, 15 bp, Homo sapiens
cttgcgaactccgaa

SEQ ID NO: 412358 - DNA, 15 bp, Homo sapiens
ttgcgaactccgaag

SEQ ID NO: 412359 - DNA, 15 bp, Homo sapiens
tgcgaactccgaagt

SEQ ID NO: 412360 - DNA, 15 bp, Homo sapiens
gcgaactccgaagtc

SEQ ID NO: 412361 - DNA, 15 bp, Homo sapiens
cgaactccgaagtcc

SEQ ID NO: 412362 - DNA, 15 bp, Homo sapiens
gaactccgaagtcca

SEQ ID NO: 412363 - DNA, 15 bp, Homo sapiens
aactccgaagtccat

SEQ ID NO: 412364 - DNA, 15 bp, Homo sapiens
actccgaagtccatg

SEQ ID NO: 412365 - DNA, 15 bp, Homo sapiens
ctccgaagtccatga

SEQ ID NO: 412366 - DNA, 15 bp, Homo sapiens
tccgaagtccatgaa

SEQ ID NO: 412367 - DNA, 15 bp, Homo sapiens
ccgaagtccatgaaa

SEQ ID NO: 412368 - DNA, 15 bp, Homo sapiens
cgaagtccatgaaaa

SEQ ID NO: 412369 - DNA, 15 bp, Homo sapiens
gaagtccatgaaaaa

SEQ ID NO: 412370 - DNA, 15 bp, Homo sapiens
aagtccatgaaaaaa

SEQ ID NO: 412371 - DNA, 15 bp, Homo sapiens
agtccatgaaaaaac

SEQ ID NO: 412372 - DNA, 15 bp, Homo sapiens
gtccatgaaaaaacg

SEQ ID NO: 412373 - DNA, 15 bp, Homo sapiens
tccatgaaaaaacgg

SEQ ID NO: 412374 - DNA, 15 bp, Homo sapiens
ccatgaaaaaacgga

SEQ ID NO: 412375 - DNA, 15 bp, Homo sapiens
catgaaaaaacggac

SEQ ID NO: 412376 - DNA, 15 bp, Homo sapiens
atgaaaaaacggacc

SEQ ID NO: 412377 - DNA, 15 bp, Homo sapiens
tgaaaaaacggaccc

SEQ ID NO: 412378 - DNA, 15 bp, Homo sapiens
gaaaaaacggaccca

SEQ ID NO: 412379 - DNA, 15 bp, Homo sapiens
aaaaaacggacccac

SEQ ID NO: 412380 - DNA, 15 bp, Homo sapiens
aaaaacggacccaca

SEQ ID NO: 412381 - DNA, 15 bp, Homo sapiens
aaaacggacccacag

SEQ ID NO: 412382 - DNA, 15 bp, Homo sapiens
aaacggacccacagt

SEQ ID NO: 412383 - DNA, 15 bp, Homo sapiens
aacggacccacagtg

SEQ ID NO: 412384 - DNA, 15 bp, Homo sapiens
acggacccacagtgg

SEQ ID NO: 412385 - DNA, 15 bp, Homo sapiens
cggacccacagtggg

SEQ ID NO: 412386 - DNA, 15 bp, Homo sapiens
ggacccacagtgggg

SEQ ID NO: 412387 - DNA, 15 bp, Homo sapiens
gacccacagtggggt

SEQ ID NO: 412388 - DNA, 15 bp, Homo sapiens
acccacagtggggtg

SEQ ID NO: 412389 - DNA, 15 bp, Homo sapiens
cccacagtggggtgg

SEQ ID NO: 412390 - DNA, 15 bp, Homo sapiens
ccacagtggggtggc

SEQ ID NO: 412391 - DNA, 15 bp, Homo sapiens
cacagtggggtggct

SEQ ID NO: 412392 - DNA, 15 bp, Homo sapiens
acagtggggtggcta

SEQ ID NO: 412393 - DNA, 15 bp, Homo sapiens
cagtggggtggctaa

SEQ ID NO: 412394 - DNA, 15 bp, Homo sapiens
agtggggtggctaaa

SEQ ID NO: 412395 - DNA, 15 bp, Homo sapiens
gtggggtggctaaaa

SEQ ID NO: 412396 - DNA, 15 bp, Homo sapiens
tggggtggctaaaat

SEQ ID NO: 412397 - DNA, 15 bp, Homo sapiens
ggggtggctaaaatg

SEQ ID NO: 412398 - DNA, 15 bp, Homo sapiens
gggtggctaaaatgt

SEQ ID NO: 412399 - DNA, 15 bp, Homo sapiens
ggtggctaaaatgtc

SEQ ID NO: 412400 - DNA, 15 bp, Homo sapiens
gtggctaaaatgtcc

SEQ ID NO: 412401 - DNA, 15 bp, Homo sapiens
tggctaaaatgtccc

SEQ ID NO: 412402 - DNA, 15 bp, Homo sapiens
ggctaaaatgtccca

SEQ ID NO: 412403 - DNA, 15 bp, Homo sapiens
gctaaaatgtcccag

SEQ ID NO: 412404 - DNA, 15 bp, Homo sapiens
ctaaaatgtcccagc

SEQ ID NO: 412405 - DNA, 15 bp, Homo sapiens
taaaatgtcccagcg

SEQ ID NO: 412406 - DNA, 15 bp, Homo sapiens
aaaatgtcccagcgc

SEQ ID NO: 412407 - DNA, 15 bp, Homo sapiens
aaatgtcccagcgca

SEQ ID NO: 412408 - DNA, 15 bp, Homo sapiens
aatgtcccagcgcaa

SEQ ID NO: 412409 - DNA, 15 bp, Homo sapiens
atgtcccagcgcaag

SEQ ID NO: 412410 - DNA, 15 bp, Homo sapiens
tgtcccagcgcaagc

SEQ ID NO: 412411 - DNA, 15 bp, Homo sapiens
gtcccagcgcaagct

SEQ ID NO: 412412 - DNA, 15 bp, Homo sapiens
tcccagcgcaagctg

SEQ ID NO: 412413 - DNA, 15 bp, Homo sapiens
cccagcgcaagctgc

SEQ ID NO: 412414 - DNA, 15 bp, Homo sapiens
ccagcgcaagctgcc

SEQ ID NO: 412415 - DNA, 15 bp, Homo sapiens
cagcgcaagctgccg

SEQ ID NO: 412416 - DNA, 15 bp, Homo sapiens
agcgcaagctgccgc

SEQ ID NO: 412417 - DNA, 15 bp, Homo sapiens
gcgcaagctgccgct

SEQ ID NO: 412418 - DNA, 15 bp, Homo sapiens
cgcaagctgccgctg

SEQ ID NO: 412419 - DNA, 15 bp, Homo sapiens
gcaagctgccgctgc

SEQ ID NO: 412420 - DNA, 15 bp, Homo sapiens
caagctgccgctgct

SEQ ID NO: 412421 - DNA, 15 bp, Homo sapiens
aagctgccgctgctg

SEQ ID NO: 412422 - DNA, 15 bp, Homo sapiens
agctgccgctgctgc

SEQ ID NO: 412423 - DNA, 15 bp, Homo sapiens
gctgccgctgctgct

SEQ ID NO: 412424 - DNA, 15 bp, Homo sapiens
ctgccgctgctgctg

SEQ ID NO: 412425 - DNA, 15 bp, Homo sapiens
tgccgctgctgctga

SEQ ID NO: 412426 - DNA, 15 bp, Homo sapiens
gccgctgctgctgat

SEQ ID NO: 412427 - DNA, 15 bp, Homo sapiens
ccgctgctgctgatg

SEQ ID NO: 412428 - DNA, 15 bp, Homo sapiens
cgctgctgctgatgg

SEQ ID NO: 412429 - DNA, 15 bp, Homo sapiens
gctgctgctgatgga

SEQ ID NO: 412430 - DNA, 15 bp, Homo sapiens
ctgctgctgatggac

SEQ ID NO: 412431 - DNA, 15 bp, Homo sapiens
tgctgctgatggacc

SEQ ID NO: 412432 - DNA, 15 bp, Homo sapiens
gctgctgatggacca

SEQ ID NO: 412433 - DNA, 15 bp, Homo sapiens
ctgctgatggaccat

SEQ ID NO: 412434 - DNA, 15 bp, Homo sapiens
tgctgatggaccata

SEQ ID NO: 412435 - DNA, 15 bp, Homo sapiens
gctgatggaccatag

SEQ ID NO: 412436 - DNA, 15 bp, Homo sapiens
ctgatggaccatagc

SEQ ID NO: 412437 - DNA, 15 bp, Homo sapiens
tgatggaccatagct

SEQ ID NO: 412438 - DNA, 15 bp, Homo sapiens
gatggaccatagctc

SEQ ID NO: 412439 - DNA, 15 bp, Homo sapiens
atggaccatagctca

SEQ ID NO: 412440 - DNA, 15 bp, Homo sapiens
tggaccatagctcaa

SEQ ID NO: 412441 - DNA, 15 bp, Homo sapiens
ggaccatagctcaag

SEQ ID NO: 412442 - DNA, 15 bp, Homo sapiens
gaccatagctcaagg

SEQ ID NO: 412443 - DNA, 15 bp, Homo sapiens
accatagctcaaggg

SEQ ID NO: 412444 - DNA, 15 bp, Homo sapiens
ccatagctcaagggc

SEQ ID NO: 412445 - DNA, 15 bp, Homo sapiens
catagctcaagggca

SEQ ID NO: 412446 - DNA, 15 bp, Homo sapiens
atagctcaagggcaa

SEQ ID NO: 412447 - DNA, 15 bp, Homo sapiens
tagctcaagggcaag

SEQ ID NO: 412448 - DNA, 15 bp, Homo sapiens
agctcaagggcaagg

SEQ ID NO: 412449 - DNA, 15 bp, Homo sapiens
gctcaagggcaaggc

SEQ ID NO: 412450 - DNA, 15 bp, Homo sapiens
ctcaagggcaaggct

SEQ ID NO: 412451 - DNA, 15 bp, Homo sapiens
tcaagggcaaggctt

SEQ ID NO: 412452 - DNA, 15 bp, Homo sapiens
caagggcaaggcttg

SEQ ID NO: 412453 - DNA, 15 bp, Homo sapiens
aagggcaaggcttgt

SEQ ID NO: 412454 - DNA, 15 bp, Homo sapiens
agggcaaggcttgta

SEQ ID NO: 412455 - DNA, 15 bp, Homo sapiens
gggcaaggcttgtaa

SEQ ID NO: 412456 - DNA, 15 bp, Homo sapiens
ggcaaggcttgtaaa

SEQ ID NO: 412457 - DNA, 15 bp, Homo sapiens
gcaaggcttgtaaag

SEQ ID NO: 412458 - DNA, 15 bp, Homo sapiens
caaggcttgtaaagg

SEQ ID NO: 412459 - DNA, 15 bp, Homo sapiens
aaggcttgtaaagga

SEQ ID NO: 412460 - DNA, 15 bp, Homo sapiens
aggcttgtaaaggat

SEQ ID NO: 412461 - DNA, 15 bp, Homo sapiens
ggcttgtaaaggatt

SEQ ID NO: 412462 - DNA, 15 bp, Homo sapiens
gcttgtaaaggattt

SEQ ID NO: 412463 - DNA, 15 bp, Homo sapiens
cttgtaaaggatttt

SEQ ID NO: 412464 - DNA, 15 bp, Homo sapiens
ttgtaaaggatttta

SEQ ID NO: 412465 - DNA, 15 bp, Homo sapiens
tgtaaaggattttac

SEQ ID NO: 412466 - DNA, 15 bp, Homo sapiens
gtaaaggattttaca

SEQ ID NO: 412467 - DNA, 15 bp, Homo sapiens
taaaggattttacaa

SEQ ID NO: 412468 - DNA, 15 bp, Homo sapiens
aaaggattttacaaa

SEQ ID NO: 412469 - DNA, 15 bp, Homo sapiens
aaggattttacaaag

SEQ ID NO: 412470 - DNA, 15 bp, Homo sapiens
aggattttacaaagg

SEQ ID NO: 412471 - DNA, 15 bp, Homo sapiens
ggattttacaaagga

SEQ ID NO: 412472 - DNA, 15 bp, Homo sapiens
gattttacaaaggat

SEQ ID NO: 412473 - DNA, 15 bp, Homo sapiens
attttacaaaggatt

SEQ ID NO: 412474 - DNA, 15 bp, Homo sapiens
ttttacaaaggattt

SEQ ID NO: 412475 - DNA, 15 bp, Homo sapiens
tttacaaaggatttt

SEQ ID NO: 412476 - DNA, 15 bp, Homo sapiens
ttacaaaggatttta

SEQ ID NO: 412477 - DNA, 15 bp, Homo sapiens
tacaaaggattttaa

SEQ ID NO: 412478 - DNA, 15 bp, Homo sapiens
acaaaggattttaaa

SEQ ID NO: 412479 - DNA, 15 bp, Homo sapiens
caaaggattttaaag

SEQ ID NO: 412480 - DNA, 15 bp, Homo sapiens
aaaggattttaaagt

SEQ ID NO: 412481 - DNA, 15 bp, Homo sapiens
aaggattttaaagta

SEQ ID NO: 412482 - DNA, 15 bp, Homo sapiens
aggattttaaagtat

SEQ ID NO: 412483 - DNA, 15 bp, Homo sapiens
ggattttaaagtata

SEQ ID NO: 412484 - DNA, 15 bp, Homo sapiens
gattttaaagtatag

SEQ ID NO: 412485 - DNA, 15 bp, Homo sapiens
attttaaagtatagc

SEQ ID NO: 412486 - DNA, 15 bp, Homo sapiens
ttttaaagtatagcc

SEQ ID NO: 412487 - DNA, 15 bp, Homo sapiens
tttaaagtatagcca

SEQ ID NO: 412488 - DNA, 15 bp, Homo sapiens
ttaaagtatagccag

SEQ ID NO: 412489 - DNA, 15 bp, Homo sapiens
taaagtatagccaga

SEQ ID NO: 412490 - DNA, 15 bp, Homo sapiens
aaagtatagccagaa

SEQ ID NO: 412491 - DNA, 15 bp, Homo sapiens
aagtatagccagaaa

SEQ ID NO: 412492 - DNA, 15 bp, Homo sapiens
agtatagccagaaaa

SEQ ID NO: 412493 - DNA, 15 bp, Homo sapiens
gtatagccagaaaag

SEQ ID NO: 412494 - DNA, 15 bp, Homo sapiens
tatagccagaaaaga

SEQ ID NO: 412495 - DNA, 15 bp, Homo sapiens
atagccagaaaagat

SEQ ID NO: 412496 - DNA, 15 bp, Homo sapiens
tagccagaaaagata

SEQ ID NO: 412497 - DNA, 15 bp, Homo sapiens
agccagaaaagatac

SEQ ID NO: 412498 - DNA, 15 bp, Homo sapiens
gccagaaaagatacg

SEQ ID NO: 412499 - DNA, 15 bp, Homo sapiens
ccagaaaagatacgg

SEQ ID NO: 412500 - DNA, 15 bp, Homo sapiens
cagaaaagatacggt

SEQ ID NO: 412501 - DNA, 15 bp, Homo sapiens
agaaaagatacggtg

SEQ ID NO: 412502 - DNA, 15 bp, Homo sapiens
gaaaagatacggtgt

SEQ ID NO: 412503 - DNA, 15 bp, Homo sapiens
aaaagatacggtgtt

SEQ ID NO: 412504 - DNA, 15 bp, Homo sapiens
aaagatacggtgttt

SEQ ID NO: 412505 - DNA, 15 bp, Homo sapiens
aagatacggtgttta

SEQ ID NO: 412506 - DNA, 15 bp, Homo sapiens
agatacggtgtttag

SEQ ID NO: 412507 - DNA, 15 bp, Homo sapiens
gatacggtgtttaga

SEQ ID NO: 412508 - DNA, 15 bp, Homo sapiens
atacggtgtttagaa

SEQ ID NO: 412509 - DNA, 15 bp, Homo sapiens
tacggtgtttagaag

SEQ ID NO: 412510 - DNA, 15 bp, Homo sapiens
acggtgtttagaagt

SEQ ID NO: 412511 - DNA, 15 bp, Homo sapiens
cggtgtttagaagtt

SEQ ID NO: 412512 - DNA, 15 bp, Homo sapiens
ggtgtttagaagtta

SEQ ID NO: 412513 - DNA, 15 bp, Homo sapiens
gtgtttagaagttaa

SEQ ID NO: 412514 - DNA, 15 bp, Homo sapiens
tgtttagaagttaaa

SEQ ID NO: 412515 - DNA, 15 bp, Homo sapiens
gtttagaagttaaac

SEQ ID NO: 412516 - DNA, 15 bp, Homo sapiens
tttagaagttaaacg

SEQ ID NO: 412517 - DNA, 15 bp, Homo sapiens
ttagaagttaaacgc

SEQ ID NO: 412518 - DNA, 15 bp, Homo sapiens
tagaagttaaacgct

SEQ ID NO: 412519 - DNA, 15 bp, Homo sapiens
agaagttaaacgctg

SEQ ID NO: 412520 - DNA, 15 bp, Homo sapiens
gaagttaaacgctgt

SEQ ID NO: 412521 - DNA, 15 bp, Homo sapiens
aagttaaacgctgtt

SEQ ID NO: 412522 - DNA, 15 bp, Homo sapiens
agttaaacgctgttg

SEQ ID NO: 412523 - DNA, 15 bp, Homo sapiens
gttaaacgctgttgt

SEQ ID NO: 412524 - DNA, 15 bp, Homo sapiens
ttaaacgctgttgtc

SEQ ID NO: 412525 - DNA, 15 bp, Homo sapiens
taaacgctgttgtct

SEQ ID NO: 412526 - DNA, 15 bp, Homo sapiens
aaacgctgttgtctg

SEQ ID NO: 412527 - DNA, 15 bp, Homo sapiens
aacgctgttgtctga

SEQ ID NO: 412528 - DNA, 15 bp, Homo sapiens
acgctgttgtctgaa

SEQ ID NO: 412529 - DNA, 15 bp, Homo sapiens
cgctgttgtctgaag

SEQ ID NO: 412530 - DNA, 15 bp, Homo sapiens
gctgttgtctgaagg

SEQ ID NO: 412531 - DNA, 15 bp, Homo sapiens
ctgttgtctgaagga

SEQ ID NO: 412532 - DNA, 15 bp, Homo sapiens
tgttgtctgaaggaa

SEQ ID NO: 412533 - DNA, 15 bp, Homo sapiens
gttgtctgaaggaag

SEQ ID NO: 412534 - DNA, 15 bp, Homo sapiens
ttgtctgaaggaagt

SEQ ID NO: 412535 - DNA, 15 bp, Homo sapiens
tgtctgaaggaagtt

SEQ ID NO: 412536 - DNA, 15 bp, Homo sapiens
gtctgaaggaagttt

SEQ ID NO: 412537 - DNA, 15 bp, Homo sapiens
tctgaaggaagtttg

SEQ ID NO: 412538 - DNA, 15 bp, Homo sapiens
ctgaaggaagtttgc

SEQ ID NO: 412539 - DNA, 15 bp, Homo sapiens
tgaaggaagtttgcc

SEQ ID NO: 412540 - DNA, 15 bp, Homo sapiens
gaaggaagtttgccg

SEQ ID NO: 412541 - DNA, 15 bp, Homo sapiens
aaggaagtttgccgg

SEQ ID NO: 412542 - DNA, 15 bp, Homo sapiens
aggaagtttgccgga

SEQ ID NO: 412543 - DNA, 15 bp, Homo sapiens
ggaagtttgccggaa

SEQ ID NO: 412544 - DNA, 15 bp, Homo sapiens
gaagtttgccggaaa

SEQ ID NO: 412545 - DNA, 15 bp, Homo sapiens
aagtttgccggaaag

SEQ ID NO: 412546 - DNA, 15 bp, Homo sapiens
agtttgccggaaaga

SEQ ID NO: 412547 - DNA, 15 bp, Homo sapiens
gtttgccggaaagat

SEQ ID NO: 412548 - DNA, 15 bp, Homo sapiens
tttgccggaaagatg

SEQ ID NO: 412549 - DNA, 15 bp, Homo sapiens
ttgccggaaagatgt

SEQ ID NO: 412550 - DNA, 15 bp, Homo sapiens
tgccggaaagatgta

SEQ ID NO: 412551 - DNA, 15 bp, Homo sapiens
gccggaaagatgtag

SEQ ID NO: 412552 - DNA, 15 bp, Homo sapiens
ccggaaagatgtagg

SEQ ID NO: 412553 - DNA, 15 bp, Homo sapiens
cggaaagatgtaggc

SEQ ID NO: 412554 - DNA, 15 bp, Homo sapiens
ggaaagatgtaggct

SEQ ID NO: 412555 - DNA, 15 bp, Homo sapiens
gaaagatgtaggctt

SEQ ID NO: 412556 - DNA, 15 bp, Homo sapiens
aaagatgtaggcttc

SEQ ID NO: 412557 - DNA, 15 bp, Homo sapiens
aagatgtaggcttca

SEQ ID NO: 412558 - DNA, 15 bp, Homo sapiens
agatgtaggcttcaa

SEQ ID NO: 412559 - DNA, 15 bp, Homo sapiens
gatgtaggcttcaag

SEQ ID NO: 412560 - DNA, 15 bp, Homo sapiens
atgtaggcttcaagg

SEQ ID NO: 412561 - DNA, 15 bp, Homo sapiens
tgtaggcttcaaggg

SEQ ID NO: 412562 - DNA, 15 bp, Homo sapiens
gtaggcttcaagggc

SEQ ID NO: 412563 - DNA, 15 bp, Homo sapiens
taggcttcaagggct

SEQ ID NO: 412564 - DNA, 15 bp, Homo sapiens
aggcttcaagggcta

SEQ ID NO: 412565 - DNA, 15 bp, Homo sapiens
ggcttcaagggctac

SEQ ID NO: 412566 - DNA, 15 bp, Homo sapiens
gcttcaagggctact

SEQ ID NO: 412567 - DNA, 15 bp, Homo sapiens
cttcaagggctactg

SEQ ID NO: 412568 - DNA, 15 bp, Homo sapiens
ttcaagggctactgg

SEQ ID NO: 412569 - DNA, 15 bp, Homo sapiens
tcaagggctactgga

SEQ ID NO: 412570 - DNA, 15 bp, Homo sapiens
caagggctactggac

SEQ ID NO: 412571 - DNA, 15 bp, Homo sapiens
aagggctactggaca

SEQ ID NO: 412572 - DNA, 15 bp, Homo sapiens
agggctactggacaa

SEQ ID NO: 412573 - DNA, 15 bp, Homo sapiens
gggctactggacaat

SEQ ID NO: 412574 - DNA, 15 bp, Homo sapiens
ggctactggacaatg

SEQ ID NO: 412575 - DNA, 15 bp, Homo sapiens
gctactggacaatga

SEQ ID NO: 412576 - DNA, 15 bp, Homo sapiens
ctactggacaatgat

SEQ ID NO: 412577 - DNA, 15 bp, Homo sapiens
tactggacaatgatt

SEQ ID NO: 412578 - DNA, 15 bp, Homo sapiens
actggacaatgattg

SEQ ID NO: 412579 - DNA, 15 bp, Homo sapiens
ctggacaatgattgg

SEQ ID NO: 412580 - DNA, 15 bp, Homo sapiens
tggacaatgattggt

SEQ ID NO: 412581 - DNA, 15 bp, Homo sapiens
ggacaatgattggtc

SEQ ID NO: 412582 - DNA, 15 bp, Homo sapiens
gacaatgattggtct

SEQ ID NO: 412583 - DNA, 15 bp, Homo sapiens
acaatgattggtctg

SEQ ID NO: 412584 - DNA, 15 bp, Homo sapiens
caatgattggtctga

SEQ ID NO: 412585 - DNA, 15 bp, Homo sapiens
aatgattggtctgaa

SEQ ID NO: 412586 - DNA, 15 bp, Homo sapiens
atgattggtctgaac

SEQ ID NO: 412587 - DNA, 15 bp, Homo sapiens
tgattggtctgaact

SEQ ID NO: 412588 - DNA, 15 bp, Homo sapiens
gattggtctgaactt

SEQ ID NO: 412589 - DNA, 15 bp, Homo sapiens
attggtctgaacttc

SEQ ID NO: 412590 - DNA, 15 bp, Homo sapiens
ttggtctgaacttca

SEQ ID NO: 412591 - DNA, 15 bp, Homo sapiens
tggtctgaacttcaa

SEQ ID NO: 412592 - DNA, 15 bp, Homo sapiens
ggtctgaacttcaac

SEQ ID NO: 412593 - DNA, 15 bp, Homo sapiens
gtctgaacttcaact

SEQ ID NO: 412594 - DNA, 15 bp, Homo sapiens
tctgaacttcaactt

SEQ ID NO: 412595 - DNA, 15 bp, Homo sapiens
ctgaacttcaactta

SEQ ID NO: 412596 - DNA, 15 bp, Homo sapiens
tgaacttcaacttac

SEQ ID NO: 412597 - DNA, 15 bp, Homo sapiens
gaacttcaacttacg

SEQ ID NO: 412598 - DNA, 15 bp, Homo sapiens
aacttcaacttacgg

SEQ ID NO: 412599 - DNA, 15 bp, Homo sapiens
acttcaacttacggg

SEQ ID NO: 412600 - DNA, 15 bp, Homo sapiens
cttcaacttacggga

SEQ ID NO: 412601 - DNA, 15 bp, Homo sapiens
ttcaacttacgggaa

SEQ ID NO: 412602 - DNA, 15 bp, Homo sapiens
tcaacttacgggaac

SEQ ID NO: 412603 - DNA, 15 bp, Homo sapiens
caacttacgggaact

SEQ ID NO: 412604 - DNA, 15 bp, Homo sapiens
aacttacgggaactg

SEQ ID NO: 412605 - DNA, 15 bp, Homo sapiens
acttacgggaactgc

SEQ ID NO: 412606 - DNA, 15 bp, Homo sapiens
cttacgggaactgct

SEQ ID NO: 412607 - DNA, 15 bp, Homo sapiens
ttacgggaactgctg

SEQ ID NO: 412608 - DNA, 15 bp, Homo sapiens
tacgggaactgctga

SEQ ID NO: 412609 - DNA, 15 bp, Homo sapiens
acgggaactgctgac

SEQ ID NO: 412610 - DNA, 15 bp, Homo sapiens
cgggaactgctgaca

SEQ ID NO: 412611 - DNA, 15 bp, Homo sapiens
gggaactgctgacaa

SEQ ID NO: 412612 - DNA, 15 bp, Homo sapiens
ggaactgctgacaaa

SEQ ID NO: 412613 - DNA, 15 bp, Homo sapiens
gaactgctgacaaaa

SEQ ID NO: 412614 - DNA, 15 bp, Homo sapiens
aactgctgacaaaat

SEQ ID NO: 412615 - DNA, 15 bp, Homo sapiens
actgctgacaaaatt

SEQ ID NO: 412616 - DNA, 15 bp, Homo sapiens
ctgctgacaaaattt

SEQ ID NO: 412617 - DNA, 15 bp, Homo sapiens
tgctgacaaaatttg

SEQ ID NO: 412618 - DNA, 15 bp, Homo sapiens
gctgacaaaatttga

SEQ ID NO: 412619 - DNA, 15 bp, Homo sapiens
ctgacaaaatttgaa

SEQ ID NO: 412620 - DNA, 15 bp, Homo sapiens
tgacaaaatttgaaa

SEQ ID NO: 412621 - DNA, 15 bp, Homo sapiens
gacaaaatttgaaaa

SEQ ID NO: 412622 - DNA, 15 bp, Homo sapiens
acaaaatttgaaaag

SEQ ID NO: 412623 - DNA, 15 bp, Homo sapiens
caaaatttgaaaagg

SEQ ID NO: 412624 - DNA, 15 bp, Homo sapiens
aaaatttgaaaaggt

SEQ ID NO: 412625 - DNA, 15 bp, Homo sapiens
aaatttgaaaaggta

SEQ ID NO: 412626 - DNA, 15 bp, Homo sapiens
aatttgaaaaggtat

SEQ ID NO: 412627 - DNA, 15 bp, Homo sapiens
atttgaaaaggtatg

SEQ ID NO: 412628 - DNA, 15 bp, Homo sapiens
tttgaaaaggtatgc

SEQ ID NO: 412629 - DNA, 15 bp, Homo sapiens
ttgaaaaggtatgca

SEQ ID NO: 412630 - DNA, 15 bp, Homo sapiens
tgaaaaggtatgcag

SEQ ID NO: 412631 - DNA, 15 bp, Homo sapiens
gaaaaggtatgcaga

SEQ ID NO: 412632 - DNA, 15 bp, Homo sapiens
aaaaggtatgcagaa

SEQ ID NO: 412633 - DNA, 15 bp, Homo sapiens
aaaggtatgcagaaa

SEQ ID NO: 412634 - DNA, 15 bp, Homo sapiens
aaggtatgcagaaag

SEQ ID NO: 412635 - DNA, 15 bp, Homo sapiens
aggtatgcagaaagc

SEQ ID NO: 412636 - DNA, 15 bp, Homo sapiens
ggtatgcagaaagca

SEQ ID NO: 412637 - DNA, 15 bp, Homo sapiens
gtatgcagaaagcaa

SEQ ID NO: 412638 - DNA, 15 bp, Homo sapiens
tatgcagaaagcaaa

SEQ ID NO: 412639 - DNA, 15 bp, Homo sapiens
atgcagaaagcaaac

SEQ ID NO: 412640 - DNA, 15 bp, Homo sapiens
tgcagaaagcaaact

SEQ ID NO: 412641 - DNA, 15 bp, Homo sapiens
gcagaaagcaaactt

SEQ ID NO: 412642 - DNA, 15 bp, Homo sapiens
cagaaagcaaacttc

SEQ ID NO: 412643 - DNA, 15 bp, Homo sapiens
agaaagcaaacttca

SEQ ID NO: 412644 - DNA, 15 bp, Homo sapiens
gaaagcaaacttcat

SEQ ID NO: 412645 - DNA, 15 bp, Homo sapiens
aaagcaaacttcatg

SEQ ID NO: 412646 - DNA, 15 bp, Homo sapiens
aagcaaacttcatga

SEQ ID NO: 412647 - DNA, 15 bp, Homo sapiens
agcaaacttcatgaa

SEQ ID NO: 412648 - DNA, 15 bp, Homo sapiens
gcaaacttcatgaat

SEQ ID NO: 412649 - DNA, 15 bp, Homo sapiens
caaacttcatgaatg

SEQ ID NO: 412650 - DNA, 15 bp, Homo sapiens
aaacttcatgaatgt

SEQ ID NO: 412651 - DNA, 15 bp, Homo sapiens
aacttcatgaatgta

SEQ ID NO: 412652 - DNA, 15 bp, Homo sapiens
acttcatgaatgtac

SEQ ID NO: 412653 - DNA, 15 bp, Homo sapiens
cttcatgaatgtact

SEQ ID NO: 412654 - DNA, 15 bp, Homo sapiens
ttcatgaatgtactt

SEQ ID NO: 412655 - DNA, 15 bp, Homo sapiens
tcatgaatgtacttt

SEQ ID NO: 412656 - DNA, 15 bp, Homo sapiens
catgaatgtactttt

SEQ ID NO: 412657 - DNA, 15 bp, Homo sapiens
atgaatgtacttttt

SEQ ID NO: 412658 - DNA, 15 bp, Homo sapiens
tgaatgtactttttt

SEQ ID NO: 412659 - DNA, 15 bp, Homo sapiens
gaatgtacttttttc

SEQ ID NO: 412660 - DNA, 15 bp, Homo sapiens
aatgtacttttttcc

SEQ ID NO: 412661 - DNA, 15 bp, Homo sapiens
atgtacttttttcct

SEQ ID NO: 412662 - DNA, 15 bp, Homo sapiens
tgtacttttttcctt

SEQ ID NO: 412663 - DNA, 15 bp, Homo sapiens
gtacttttttccttt

SEQ ID NO: 412664 - DNA, 15 bp, Homo sapiens
tacttttttcctttc

SEQ ID NO: 412665 - DNA, 15 bp, Homo sapiens
acttttttcctttct

SEQ ID NO: 412666 - DNA, 15 bp, Homo sapiens
cttttttcctttctt

SEQ ID NO: 412667 - DNA, 15 bp, Homo sapiens
ttttttcctttcttt

SEQ ID NO: 412668 - DNA, 15 bp, Homo sapiens
tttttcctttctttc

SEQ ID NO: 412669 - DNA, 15 bp, Homo sapiens
ttttcctttctttct

SEQ ID NO: 412670 - DNA, 15 bp, Homo sapiens
tttcctttctttctt

SEQ ID NO: 412671 - DNA, 15 bp, Homo sapiens
ttcctttctttcttg

SEQ ID NO: 412672 - DNA, 15 bp, Homo sapiens
tcctttctttcttgc

SEQ ID NO: 412673 - DNA, 15 bp, Homo sapiens
cctttctttcttgcc

SEQ ID NO: 412674 - DNA, 15 bp, Homo sapiens
ctttctttcttgcct

SEQ ID NO: 412675 - DNA, 15 bp, Homo sapiens
tttctttcttgcctt

SEQ ID NO: 412676 - DNA, 15 bp, Homo sapiens
ttctttcttgccttt

SEQ ID NO: 412677 - DNA, 15 bp, Homo sapiens
tctttcttgcctttt

SEQ ID NO: 412678 - DNA, 15 bp, Homo sapiens
ctttcttgccttttt

SEQ ID NO: 412679 - DNA, 15 bp, Homo sapiens
tttcttgcctttttt

SEQ ID NO: 412680 - DNA, 15 bp, Homo sapiens
ttcttgccttttttt

SEQ ID NO: 412681 - DNA, 15 bp, Homo sapiens
tcttgcctttttttt

SEQ ID NO: 412682 - DNA, 15 bp, Homo sapiens
cttgccttttttttc

SEQ ID NO: 412683 - DNA, 15 bp, Homo sapiens
ttgccttttttttca

SEQ ID NO: 412684 - DNA, 15 bp, Homo sapiens
tgccttttttttcac

SEQ ID NO: 412685 - DNA, 15 bp, Homo sapiens
gccttttttttcact

SEQ ID NO: 412686 - DNA, 15 bp, Homo sapiens
ccttttttttcacta

SEQ ID NO: 412687 - DNA, 15 bp, Homo sapiens
cttttttttcactat

SEQ ID NO: 412688 - DNA, 15 bp, Homo sapiens
ttttttttcactata

SEQ ID NO: 412689 - DNA, 15 bp, Homo sapiens
tttttttcactatac

SEQ ID NO: 412690 - DNA, 15 bp, Homo sapiens
ttttttcactataca

SEQ ID NO: 412691 - DNA, 15 bp, Homo sapiens
tttttcactatacat

SEQ ID NO: 412692 - DNA, 15 bp, Homo sapiens
ttttcactatacatt

SEQ ID NO: 412693 - DNA, 15 bp, Homo sapiens
tttcactatacattt

SEQ ID NO: 412694 - DNA, 15 bp, Homo sapiens
ttcactatacattta

SEQ ID NO: 412695 - DNA, 15 bp, Homo sapiens
tcactatacatttag

SEQ ID NO: 412696 - DNA, 15 bp, Homo sapiens
cactatacatttaga

SEQ ID NO: 412697 - DNA, 15 bp, Homo sapiens
actatacatttagat

SEQ ID NO: 412698 - DNA, 15 bp, Homo sapiens
ctatacatttagata

SEQ ID NO: 412699 - DNA, 15 bp, Homo sapiens
tatacatttagatag

SEQ ID NO: 412700 - DNA, 15 bp, Homo sapiens
atacatttagataga

SEQ ID NO: 412701 - DNA, 15 bp, Homo sapiens
tacatttagatagat

SEQ ID NO: 412702 - DNA, 15 bp, Homo sapiens
acatttagatagatg

SEQ ID NO: 412703 - DNA, 15 bp, Homo sapiens
catttagatagatgc

SEQ ID NO: 412704 - DNA, 15 bp, Homo sapiens
atttagatagatgct

SEQ ID NO: 412705 - DNA, 15 bp, Homo sapiens
tttagatagatgctc

SEQ ID NO: 412706 - DNA, 15 bp, Homo sapiens
ttagatagatgctct

SEQ ID NO: 412707 - DNA, 15 bp, Homo sapiens
tagatagatgctcta

SEQ ID NO: 412708 - DNA, 15 bp, Homo sapiens
agatagatgctctat

SEQ ID NO: 412709 - DNA, 15 bp, Homo sapiens
gatagatgctctatt

SEQ ID NO: 412710 - DNA, 15 bp, Homo sapiens
atagatgctctattg

SEQ ID NO: 412711 - DNA, 15 bp, Homo sapiens
tagatgctctattga

SEQ ID NO: 412712 - DNA, 15 bp, Homo sapiens
agatgctctattgac

SEQ ID NO: 412713 - DNA, 15 bp, Homo sapiens
gatgctctattgact

SEQ ID NO: 412714 - DNA, 15 bp, Homo sapiens
atgctctattgactc

SEQ ID NO: 412715 - DNA, 15 bp, Homo sapiens
tgctctattgactct

SEQ ID NO: 412716 - DNA, 15 bp, Homo sapiens
gctctattgactctt

SEQ ID NO: 412717 - DNA, 15 bp, Homo sapiens
ctctattgactcttt

SEQ ID NO: 412718 - DNA, 15 bp, Homo sapiens
tctattgactctttg

SEQ ID NO: 412719 - DNA, 15 bp, Homo sapiens
ctattgactctttgg

SEQ ID NO: 412720 - DNA, 15 bp, Homo sapiens
tattgactctttggt

SEQ ID NO: 412721 - DNA, 15 bp, Homo sapiens
attgactctttggtg

SEQ ID NO: 412722 - DNA, 15 bp, Homo sapiens
ttgactctttggtgg

SEQ ID NO: 412723 - DNA, 15 bp, Homo sapiens
tgactctttggtggt

SEQ ID NO: 412724 - DNA, 15 bp, Homo sapiens
gactctttggtggtt

SEQ ID NO: 412725 - DNA, 15 bp, Homo sapiens
actctttggtggttt

SEQ ID NO: 412726 - DNA, 15 bp, Homo sapiens
ctctttggtggttta

SEQ ID NO: 412727 - DNA, 15 bp, Homo sapiens
tctttggtggtttag

SEQ ID NO: 412728 - DNA, 15 bp, Homo sapiens
ctttggtggtttagt

SEQ ID NO: 412729 - DNA, 15 bp, Homo sapiens
tttggtggtttagta

SEQ ID NO: 412730 - DNA, 15 bp, Homo sapiens
ttggtggtttagtat

SEQ ID NO: 412731 - DNA, 15 bp, Homo sapiens
tggtggtttagtata

SEQ ID NO: 412732 - DNA, 15 bp, Homo sapiens
ggtggtttagtataa

SEQ ID NO: 412733 - DNA, 15 bp, Homo sapiens
gtggtttagtataat

SEQ ID NO: 412734 - DNA, 15 bp, Homo sapiens
tggtttagtataatt

SEQ ID NO: 412735 - DNA, 15 bp, Homo sapiens
ggtttagtataattt

SEQ ID NO: 412736 - DNA, 15 bp, Homo sapiens
gtttagtataattta

SEQ ID NO: 412737 - DNA, 15 bp, Homo sapiens
tttagtataatttat

SEQ ID NO: 412738 - DNA, 15 bp, Homo sapiens
ttagtataatttata

SEQ ID NO: 412739 - DNA, 15 bp, Homo sapiens
tagtataatttataa

SEQ ID NO: 412740 - DNA, 15 bp, Homo sapiens
agtataatttataag

SEQ ID NO: 412741 - DNA, 15 bp, Homo sapiens
gtataatttataagg

SEQ ID NO: 412742 - DNA, 15 bp, Homo sapiens
tataatttataagga

SEQ ID NO: 412743 - DNA, 15 bp, Homo sapiens
ataatttataaggaa

SEQ ID NO: 412744 - DNA, 15 bp, Homo sapiens
taatttataaggaat

SEQ ID NO: 412745 - DNA, 15 bp, Homo sapiens
aatttataaggaata

SEQ ID NO: 412746 - DNA, 15 bp, Homo sapiens
atttataaggaatat

SEQ ID NO: 412747 - DNA, 15 bp, Homo sapiens
tttataaggaatatt

SEQ ID NO: 412748 - DNA, 15 bp, Homo sapiens
ttataaggaatattc

SEQ ID NO: 412749 - DNA, 15 bp, Homo sapiens
tataaggaatattca

SEQ ID NO: 412750 - DNA, 15 bp, Homo sapiens
ataaggaatattcaa

SEQ ID NO: 412751 - DNA, 15 bp, Homo sapiens
taaggaatattcaat

SEQ ID NO: 412752 - DNA, 15 bp, Homo sapiens
aaggaatattcaatt

SEQ ID NO: 412753 - DNA, 15 bp, Homo sapiens
aggaatattcaattt

SEQ ID NO: 412754 - DNA, 15 bp, Homo sapiens
ggaatattcaatttt

SEQ ID NO: 412755 - DNA, 15 bp, Homo sapiens
gaatattcaattttg

SEQ ID NO: 412756 - DNA, 15 bp, Homo sapiens
aatattcaattttgc

SEQ ID NO: 412757 - DNA, 15 bp, Homo sapiens
atattcaattttgct

SEQ ID NO: 412758 - DNA, 15 bp, Homo sapiens
tattcaattttgctg

SEQ ID NO: 412759 - DNA, 15 bp, Homo sapiens
attcaattttgctgt

SEQ ID NO: 412760 - DNA, 15 bp, Homo sapiens
ttcaattttgctgtc

SEQ ID NO: 412761 - DNA, 15 bp, Homo sapiens
tcaattttgctgtct

SEQ ID NO: 412762 - DNA, 15 bp, Homo sapiens
caattttgctgtctc

SEQ ID NO: 412763 - DNA, 15 bp, Homo sapiens
aattttgctgtctcc

SEQ ID NO: 412764 - DNA, 15 bp, Homo sapiens
attttgctgtctcct

SEQ ID NO: 412765 - DNA, 15 bp, Homo sapiens
ttttgctgtctcctt

SEQ ID NO: 412766 - DNA, 15 bp, Homo sapiens
tttgctgtctccttt

SEQ ID NO: 412767 - DNA, 15 bp, Homo sapiens
ttgctgtctccttta

SEQ ID NO: 412768 - DNA, 15 bp, Homo sapiens
tgctgtctcctttaa

SEQ ID NO: 412769 - DNA, 15 bp, Homo sapiens
gctgtctcctttaaa

SEQ ID NO: 412770 - DNA, 15 bp, Homo sapiens
ctgtctcctttaaag

SEQ ID NO: 412771 - DNA, 15 bp, Homo sapiens
tgtctcctttaaaga

SEQ ID NO: 412772 - DNA, 15 bp, Homo sapiens
gtctcctttaaagat

SEQ ID NO: 412773 - DNA, 15 bp, Homo sapiens
tctcctttaaagatg

SEQ ID NO: 412774 - DNA, 15 bp, Homo sapiens
ctcctttaaagatgt

SEQ ID NO: 412775 - DNA, 15 bp, Homo sapiens
tcctttaaagatgtt

SEQ ID NO: 412776 - DNA, 15 bp, Homo sapiens
cctttaaagatgttt

SEQ ID NO: 412777 - DNA, 15 bp, Homo sapiens
ctttaaagatgtttt

SEQ ID NO: 412778 - DNA, 15 bp, Homo sapiens
tttaaagatgttttt

SEQ ID NO: 412779 - DNA, 15 bp, Homo sapiens
ttaaagatgtttttc

SEQ ID NO: 412780 - DNA, 15 bp, Homo sapiens
taaagatgtttttca

SEQ ID NO: 412781 - DNA, 15 bp, Homo sapiens
aaagatgtttttcaa

SEQ ID NO: 412782 - DNA, 15 bp, Homo sapiens
aagatgtttttcaag

SEQ ID NO: 412783 - DNA, 15 bp, Homo sapiens
agatgtttttcaagt

SEQ ID NO: 412784 - DNA, 15 bp, Homo sapiens
gatgtttttcaagta

SEQ ID NO: 412785 - DNA, 15 bp, Homo sapiens
atgtttttcaagtaa

SEQ ID NO: 412786 - DNA, 15 bp, Homo sapiens
tgtttttcaagtaaa

SEQ ID NO: 412787 - DNA, 15 bp, Homo sapiens
gtttttcaagtaaag

SEQ ID NO: 412788 - DNA, 15 bp, Homo sapiens
tttttcaagtaaagg

SEQ ID NO: 412789 - DNA, 15 bp, Homo sapiens
ttttcaagtaaaggg

SEQ ID NO: 412790 - DNA, 15 bp, Homo sapiens
tttcaagtaaagggc

SEQ ID NO: 412791 - DNA, 15 bp, Homo sapiens
ttcaagtaaagggct

SEQ ID NO: 412792 - DNA, 15 bp, Homo sapiens
tcaagtaaagggcta

SEQ ID NO: 412793 - DNA, 15 bp, Homo sapiens
caagtaaagggctaa

SEQ ID NO: 412794 - DNA, 15 bp, Homo sapiens
aagtaaagggctaat

SEQ ID NO: 412795 - DNA, 15 bp, Homo sapiens
agtaaagggctaatt

SEQ ID NO: 412796 - DNA, 15 bp, Homo sapiens
gtaaagggctaatta

SEQ ID NO: 412797 - DNA, 15 bp, Homo sapiens
taaagggctaattag

SEQ ID NO: 412798 - DNA, 15 bp, Homo sapiens
aaagggctaattagc

SEQ ID NO: 412799 - DNA, 15 bp, Homo sapiens
aagggctaattagca

SEQ ID NO: 412800 - DNA, 15 bp, Homo sapiens
agggctaattagcaa

SEQ ID NO: 412801 - DNA, 15 bp, Homo sapiens
gggctaattagcaat

SEQ ID NO: 412802 - DNA, 15 bp, Homo sapiens
ggctaattagcaatt

SEQ ID NO: 412803 - DNA, 15 bp, Homo sapiens
gctaattagcaatta

SEQ ID NO: 412804 - DNA, 15 bp, Homo sapiens
ctaattagcaattac

SEQ ID NO: 412805 - DNA, 15 bp, Homo sapiens
taattagcaattact

SEQ ID NO: 412806 - DNA, 15 bp, Homo sapiens
aattagcaattactt

SEQ ID NO: 412807 - DNA, 15 bp, Homo sapiens
attagcaattacttc

SEQ ID NO: 412808 - DNA, 15 bp, Homo sapiens
ttagcaattacttcc

SEQ ID NO: 412809 - DNA, 15 bp, Homo sapiens
tagcaattacttcct

SEQ ID NO: 412810 - DNA, 15 bp, Homo sapiens
agcaattacttcctt

SEQ ID NO: 412811 - DNA, 15 bp, Homo sapiens
gcaattacttccttt

SEQ ID NO: 412812 - DNA, 15 bp, Homo sapiens
caattacttcctttg

SEQ ID NO: 412813 - DNA, 15 bp, Homo sapiens
aattacttcctttgg

SEQ ID NO: 412814 - DNA, 15 bp, Homo sapiens
attacttcctttggt

SEQ ID NO: 412815 - DNA, 15 bp, Homo sapiens
ttacttcctttggtc

SEQ ID NO: 412816 - DNA, 15 bp, Homo sapiens
tacttcctttggtca

SEQ ID NO: 412817 - DNA, 15 bp, Homo sapiens
acttcctttggtcag

SEQ ID NO: 412818 - DNA, 15 bp, Homo sapiens
cttcctttggtcagg

SEQ ID NO: 412819 - DNA, 15 bp, Homo sapiens
ttcctttggtcagga

SEQ ID NO: 412820 - DNA, 15 bp, Homo sapiens
tcctttggtcaggag

SEQ ID NO: 412821 - DNA, 15 bp, Homo sapiens
cctttggtcaggagg

SEQ ID NO: 412822 - DNA, 15 bp, Homo sapiens
ctttggtcaggaggg

SEQ ID NO: 412823 - DNA, 15 bp, Homo sapiens
tttggtcaggagggc

SEQ ID NO: 412824 - DNA, 15 bp, Homo sapiens
ttggtcaggagggct

SEQ ID NO: 412825 - DNA, 15 bp, Homo sapiens
tggtcaggagggctt

SEQ ID NO: 412826 - DNA, 15 bp, Homo sapiens
ggtcaggagggcttc

SEQ ID NO: 412827 - DNA, 15 bp, Homo sapiens
gtcaggagggcttct

SEQ ID NO: 412828 - DNA, 15 bp, Homo sapiens
tcaggagggcttctc

SEQ ID NO: 412829 - DNA, 15 bp, Homo sapiens
caggagggcttctca

SEQ ID NO: 412830 - DNA, 15 bp, Homo sapiens
aggagggcttctcat

SEQ ID NO: 412831 - DNA, 15 bp, Homo sapiens
ggagggcttctcatg

SEQ ID NO: 412832 - DNA, 15 bp, Homo sapiens
gagggcttctcatga

SEQ ID NO: 412833 - DNA, 15 bp, Homo sapiens
agggcttctcatgat

SEQ ID NO: 412834 - DNA, 15 bp, Homo sapiens
gggcttctcatgatg

SEQ ID NO: 412835 - DNA, 15 bp, Homo sapiens
ggcttctcatgatgc

SEQ ID NO: 412836 - DNA, 15 bp, Homo sapiens
gcttctcatgatgcc

SEQ ID NO: 412837 - DNA, 15 bp, Homo sapiens
cttctcatgatgcct

SEQ ID NO: 412838 - DNA, 15 bp, Homo sapiens
ttctcatgatgcctg

SEQ ID NO: 412839 - DNA, 15 bp, Homo sapiens
tctcatgatgcctgt

SEQ ID NO: 412840 - DNA, 15 bp, Homo sapiens
ctcatgatgcctgtc

SEQ ID NO: 412841 - DNA, 15 bp, Homo sapiens
tcatgatgcctgtca

SEQ ID NO: 412842 - DNA, 15 bp, Homo sapiens
catgatgcctgtcac

SEQ ID NO: 412843 - DNA, 15 bp, Homo sapiens
atgatgcctgtcact

SEQ ID NO: 412844 - DNA, 15 bp, Homo sapiens
tgatgcctgtcactt

SEQ ID NO: 412845 - DNA, 15 bp, Homo sapiens
gatgcctgtcacttt

SEQ ID NO: 412846 - DNA, 15 bp, Homo sapiens
atgcctgtcactttt

SEQ ID NO: 412847 - DNA, 15 bp, Homo sapiens
tgcctgtcactttta

SEQ ID NO: 412848 - DNA, 15 bp, Homo sapiens
gcctgtcacttttag

SEQ ID NO: 412849 - DNA, 15 bp, Homo sapiens
cctgtcacttttaga

SEQ ID NO: 412850 - DNA, 15 bp, Homo sapiens
ctgtcacttttagaa

SEQ ID NO: 412851 - DNA, 15 bp, Homo sapiens
tgtcacttttagaat

SEQ ID NO: 412852 - DNA, 15 bp, Homo sapiens
gtcacttttagaatt

SEQ ID NO: 412853 - DNA, 15 bp, Homo sapiens
tcacttttagaattc

SEQ ID NO: 412854 - DNA, 15 bp, Homo sapiens
cacttttagaattcc

SEQ ID NO: 412855 - DNA, 15 bp, Homo sapiens
acttttagaattcca

SEQ ID NO: 412856 - DNA, 15 bp, Homo sapiens
cttttagaattccac

SEQ ID NO: 412857 - DNA, 15 bp, Homo sapiens
ttttagaattccaca

SEQ ID NO: 412858 - DNA, 15 bp, Homo sapiens
tttagaattccacat

SEQ ID NO: 412859 - DNA, 15 bp, Homo sapiens
ttagaattccacatc

SEQ ID NO: 412860 - DNA, 15 bp, Homo sapiens
tagaattccacatca

SEQ ID NO: 412861 - DNA, 15 bp, Homo sapiens
agaattccacatcag

SEQ ID NO: 412862 - DNA, 15 bp, Homo sapiens
gaattccacatcaga

SEQ ID NO: 412863 - DNA, 15 bp, Homo sapiens
aattccacatcagaa

SEQ ID NO: 412864 - DNA, 15 bp, Homo sapiens
attccacatcagaag

SEQ ID NO: 412865 - DNA, 15 bp, Homo sapiens
ttccacatcagaaga

SEQ ID NO: 412866 - DNA, 15 bp, Homo sapiens
tccacatcagaagaa

SEQ ID NO: 412867 - DNA, 15 bp, Homo sapiens
ccacatcagaagaaa

SEQ ID NO: 412868 - DNA, 15 bp, Homo sapiens
cacatcagaagaaac

SEQ ID NO: 412869 - DNA, 15 bp, Homo sapiens
acatcagaagaaact

SEQ ID NO: 412870 - DNA, 15 bp, Homo sapiens
catcagaagaaactc

SEQ ID NO: 412871 - DNA, 15 bp, Homo sapiens
atcagaagaaactct

SEQ ID NO: 412872 - DNA, 15 bp, Homo sapiens
tcagaagaaactctt

SEQ ID NO: 412873 - DNA, 15 bp, Homo sapiens
cagaagaaactcttt

SEQ ID NO: 412874 - DNA, 15 bp, Homo sapiens
agaagaaactctttg

SEQ ID NO: 412875 - DNA, 15 bp, Homo sapiens
gaagaaactctttgt

SEQ ID NO: 412876 - DNA, 15 bp, Homo sapiens
aagaaactctttgta

SEQ ID NO: 412877 - DNA, 15 bp, Homo sapiens
agaaactctttgtac

SEQ ID NO: 412878 - DNA, 15 bp, Homo sapiens
gaaactctttgtact

SEQ ID NO: 412879 - DNA, 15 bp, Homo sapiens
aaactctttgtactc

SEQ ID NO: 412880 - DNA, 15 bp, Homo sapiens
aactctttgtactca

SEQ ID NO: 412881 - DNA, 15 bp, Homo sapiens
actctttgtactcaa

SEQ ID NO: 412882 - DNA, 15 bp, Homo sapiens
ctctttgtactcaag

SEQ ID NO: 412883 - DNA, 15 bp, Homo sapiens
tctttgtactcaagt

SEQ ID NO: 412884 - DNA, 15 bp, Homo sapiens
ctttgtactcaagtc

SEQ ID NO: 412885 - DNA, 15 bp, Homo sapiens
tttgtactcaagtca

SEQ ID NO: 412886 - DNA, 15 bp, Homo sapiens
ttgtactcaagtcag

SEQ ID NO: 412887 - DNA, 15 bp, Homo sapiens
tgtactcaagtcagc

SEQ ID NO: 412888 - DNA, 15 bp, Homo sapiens
gtactcaagtcagct

SEQ ID NO: 412889 - DNA, 15 bp, Homo sapiens
tactcaagtcagctg

SEQ ID NO: 412890 - DNA, 15 bp, Homo sapiens
actcaagtcagctgg

SEQ ID NO: 412891 - DNA, 15 bp, Homo sapiens
ctcaagtcagctggt

SEQ ID NO: 412892 - DNA, 15 bp, Homo sapiens
tcaagtcagctggta

SEQ ID NO: 412893 - DNA, 15 bp, Homo sapiens
caagtcagctggtaa

SEQ ID NO: 412894 - DNA, 15 bp, Homo sapiens
aagtcagctggtaat

SEQ ID NO: 412895 - DNA, 15 bp, Homo sapiens
agtcagctggtaatt

SEQ ID NO: 412896 - DNA, 15 bp, Homo sapiens
gtcagctggtaattt

SEQ ID NO: 412897 - DNA, 15 bp, Homo sapiens
tcagctggtaattta

SEQ ID NO: 412898 - DNA, 15 bp, Homo sapiens
cagctggtaatttaa

SEQ ID NO: 412899 - DNA, 15 bp, Homo sapiens
agctggtaatttaac

SEQ ID NO: 412900 - DNA, 15 bp, Homo sapiens
gctggtaatttaact

SEQ ID NO: 412901 - DNA, 15 bp, Homo sapiens
ctggtaatttaactg

SEQ ID NO: 412902 - DNA, 15 bp, Homo sapiens
tggtaatttaactga

SEQ ID NO: 412903 - DNA, 15 bp, Homo sapiens
ggtaatttaactgaa

SEQ ID NO: 412904 - DNA, 15 bp, Homo sapiens
gtaatttaactgaaa

SEQ ID NO: 412905 - DNA, 15 bp, Homo sapiens
taatttaactgaaac

SEQ ID NO: 412906 - DNA, 15 bp, Homo sapiens
aatttaactgaaact

SEQ ID NO: 412907 - DNA, 15 bp, Homo sapiens
atttaactgaaactt

SEQ ID NO: 412908 - DNA, 15 bp, Homo sapiens
tttaactgaaacttc

SEQ ID NO: 412909 - DNA, 15 bp, Homo sapiens
ttaactgaaacttct

SEQ ID NO: 412910 - DNA, 15 bp, Homo sapiens
taactgaaacttctt

SEQ ID NO: 412911 - DNA, 15 bp, Homo sapiens
aactgaaacttcttt

SEQ ID NO: 412912 - DNA, 15 bp, Homo sapiens
actgaaacttctttg

SEQ ID NO: 412913 - DNA, 15 bp, Homo sapiens
ctgaaacttctttgg

SEQ ID NO: 412914 - DNA, 15 bp, Homo sapiens
tgaaacttctttgga

SEQ ID NO: 412915 - DNA, 15 bp, Homo sapiens
gaaacttctttggag

SEQ ID NO: 412916 - DNA, 15 bp, Homo sapiens
aaacttctttggaga

SEQ ID NO: 412917 - DNA, 15 bp, Homo sapiens
aacttctttggagaa

SEQ ID NO: 412918 - DNA, 15 bp, Homo sapiens
acttctttggagaaa

SEQ ID NO: 412919 - DNA, 15 bp, Homo sapiens
cttctttggagaaaa

SEQ ID NO: 412920 - DNA, 15 bp, Homo sapiens
ttctttggagaaaaa

SEQ ID NO: 412921 - DNA, 15 bp, Homo sapiens
tctttggagaaaaaa

SEQ ID NO: 412922 - DNA, 15 bp, Homo sapiens
ctttggagaaaaaaa

SEQ ID NO: 412923 - DNA, 15 bp, Homo sapiens
tttggagaaaaaaaa

SEQ ID NO: 412924 - DNA, 15 bp, Homo sapiens
ttggagaaaaaaaaa

SEQ ID NO: 412925 - DNA, 15 bp, Homo sapiens
tggagaaaaaaaaaa

SEQ ID NO: 412926 - DNA, 15 bp, Homo sapiens
gagaaaaaaaaaaga

SEQ ID NO: 412927 - DNA, 15 bp, Homo sapiens
agaaaaaaaaaagaa

SEQ ID NO: 412928 - DNA, 15 bp, Homo sapiens
gaaaaaaaaaagaaa

SEQ ID NO: 412929 - DNA, 15 bp, Homo sapiens
aaaaaaaaagaaaat

SEQ ID NO: 412930 - DNA, 15 bp, Homo sapiens
aaaaaaaagaaaatg

SEQ ID NO: 412931 - DNA, 15 bp, Homo sapiens
aaaaaaagaaaatga

SEQ ID NO: 412932 - DNA, 15 bp, Homo sapiens
aaaaaagaaaatgaa

SEQ ID NO: 412933 - DNA, 15 bp, Homo sapiens
aaaaagaaaatgaaa

SEQ ID NO: 412934 - DNA, 15 bp, Homo sapiens
aaaagaaaatgaaaa

SEQ ID NO: 412935 - DNA, 15 bp, Homo sapiens
aaagaaaatgaaaat

SEQ ID NO: 412936 - DNA, 15 bp, Homo sapiens
aatgaaaataaaata

SEQ ID NO: 412937 - DNA, 15 bp, Homo sapiens
atgaaaataaaataa

SEQ ID NO: 412938 - DNA, 15 bp, Homo sapiens
tgaaaataaaataaa

SEQ ID NO: 412939 - DNA, 15 bp, Homo sapiens
gaaaataaaataaaa

SEQ ID NO: 412940 - DNA, 15 bp, Homo sapiens
aaataaaataaaaat

SEQ ID NO: 412941 - DNA, 15 bp, Homo sapiens
aataaaataaaaatc

SEQ ID NO: 412942 - DNA, 15 bp, Homo sapiens
ataaaataaaaatcc

SEQ ID NO: 412943 - DNA, 15 bp, Homo sapiens
taaaataaaaatcca

SEQ ID NO: 412944 - DNA, 15 bp, Homo sapiens
aaaataaaaatccag

SEQ ID NO: 412945 - DNA, 15 bp, Homo sapiens
aaataaaaatccagc

SEQ ID NO: 412946 - DNA, 15 bp, Homo sapiens
aataaaaatccagca

SEQ ID NO: 412947 - DNA, 15 bp, Homo sapiens
ataaaaatccagcaa

SEQ ID NO: 412948 - DNA, 15 bp, Homo sapiens
taaaaatccagcaaa

SEQ ID NO: 412949 - DNA, 15 bp, Homo sapiens
aaaaatccagcaaaa

SEQ ID NO: 412950 - DNA, 15 bp, Homo sapiens
aaaatccagcaaaaa

SEQ ID NO: 412951 - DNA, 15 bp, Homo sapiens
aaatccagcaaaaaa

SEQ ID NO: 412952 - DNA, 15 bp, Homo sapiens
aatccagcaaaaaac

SEQ ID NO: 412953 - DNA, 15 bp, Homo sapiens
atccagcaaaaaaca

SEQ ID NO: 412954 - DNA, 15 bp, Homo sapiens
tccagcaaaaaacac

SEQ ID NO: 412955 - DNA, 15 bp, Homo sapiens
ccagcaaaaaacact

SEQ ID NO: 412956 - DNA, 15 bp, Homo sapiens
cagcaaaaaacactg

SEQ ID NO: 412957 - DNA, 15 bp, Homo sapiens
agcaaaaaacactgg

SEQ ID NO: 412958 - DNA, 15 bp, Homo sapiens
gcaaaaaacactggg

SEQ ID NO: 412959 - DNA, 15 bp, Homo sapiens
caaaaaacactgggt

SEQ ID NO: 412960 - DNA, 15 bp, Homo sapiens
aaaaaacactgggta

SEQ ID NO: 412961 - DNA, 15 bp, Homo sapiens
aaaaacactgggtat

SEQ ID NO: 412962 - DNA, 15 bp, Homo sapiens
aaaacactgggtatt

SEQ ID NO: 412963 - DNA, 15 bp, Homo sapiens
aaacactgggtattg

SEQ ID NO: 412964 - DNA, 15 bp, Homo sapiens
aacactgggtattgg

SEQ ID NO: 412965 - DNA, 15 bp, Homo sapiens
acactgggtattggt

SEQ ID NO: 412966 - DNA, 15 bp, Homo sapiens
cactgggtattggtg

SEQ ID NO: 412967 - DNA, 15 bp, Homo sapiens
actgggtattggtgc

SEQ ID NO: 412968 - DNA, 15 bp, Homo sapiens
ctgggtattggtgcc

SEQ ID NO: 412969 - DNA, 15 bp, Homo sapiens
tgggtattggtgcca

SEQ ID NO: 412970 - DNA, 15 bp, Homo sapiens
gggtattggtgccaa

SEQ ID NO: 412971 - DNA, 15 bp, Homo sapiens
ggtattggtgccaaa

SEQ ID NO: 412972 - DNA, 15 bp, Homo sapiens
gtattggtgccaaag

SEQ ID NO: 412973 - DNA, 15 bp, Homo sapiens
tattggtgccaaagt

SEQ ID NO: 412974 - DNA, 15 bp, Homo sapiens
attggtgccaaagtc

SEQ ID NO: 412975 - DNA, 15 bp, Homo sapiens
ttggtgccaaagtct

SEQ ID NO: 412976 - DNA, 15 bp, Homo sapiens
tggtgccaaagtctg

SEQ ID NO: 412977 - DNA, 15 bp, Homo sapiens
ggtgccaaagtctga

SEQ ID NO: 412978 - DNA, 15 bp, Homo sapiens
gtgccaaagtctgac

SEQ ID NO: 412979 - DNA, 15 bp, Homo sapiens
tgccaaagtctgact

SEQ ID NO: 412980 - DNA, 15 bp, Homo sapiens
gccaaagtctgactt

SEQ ID NO: 412981 - DNA, 15 bp, Homo sapiens
ccaaagtctgacttc

SEQ ID NO: 412982 - DNA, 15 bp, Homo sapiens
caaagtctgacttcg

SEQ ID NO: 412983 - DNA, 15 bp, Homo sapiens
aaagtctgacttcgt

SEQ ID NO: 412984 - DNA, 15 bp, Homo sapiens
aagtctgacttcgta

SEQ ID NO: 412985 - DNA, 15 bp, Homo sapiens
agtctgacttcgtag

SEQ ID NO: 412986 - DNA, 15 bp, Homo sapiens
gtctgacttcgtagg

SEQ ID NO: 412987 - DNA, 15 bp, Homo sapiens
tctgacttcgtaggc

SEQ ID NO: 412988 - DNA, 15 bp, Homo sapiens
ctgacttcgtaggca

SEQ ID NO: 412989 - DNA, 15 bp, Homo sapiens
tgacttcgtaggcat

SEQ ID NO: 412990 - DNA, 15 bp, Homo sapiens
gacttcgtaggcatg

SEQ ID NO: 412991 - DNA, 15 bp, Homo sapiens
acttcgtaggcatgg

SEQ ID NO: 412992 - DNA, 15 bp, Homo sapiens
cttcgtaggcatggg

SEQ ID NO: 412993 - DNA, 15 bp, Homo sapiens
ttcgtaggcatgggt

SEQ ID NO: 412994 - DNA, 15 bp, Homo sapiens
tcgtaggcatgggtt

SEQ ID NO: 412995 - DNA, 15 bp, Homo sapiens
cgtaggcatgggttc

SEQ ID NO: 412996 - DNA, 15 bp, Homo sapiens
gtaggcatgggttct

SEQ ID NO: 412997 - DNA, 15 bp, Homo sapiens
taggcatgggttctg

SEQ ID NO: 412998 - DNA, 15 bp, Homo sapiens
aggcatgggttctgt

SEQ ID NO: 412999 - DNA, 15 bp, Homo sapiens
ggcatgggttctgtt

SEQ ID NO: 413000 - DNA, 15 bp, Homo sapiens
gcatgggttctgttc

SEQ ID NO: 413001 - DNA, 15 bp, Homo sapiens
catgggttctgttct

SEQ ID NO: 413002 - DNA, 15 bp, Homo sapiens
atgggttctgttctc

SEQ ID NO: 413003 - DNA, 15 bp, Homo sapiens
tgggttctgttctcc

SEQ ID NO: 413004 - DNA, 15 bp, Homo sapiens
gggttctgttctcca

SEQ ID NO: 413005 - DNA, 15 bp, Homo sapiens
ggttctgttctccat

SEQ ID NO: 413006 - DNA, 15 bp, Homo sapiens
gttctgttctccata

SEQ ID NO: 413007 - DNA, 15 bp, Homo sapiens
ttctgttctccatac

SEQ ID NO: 413008 - DNA, 15 bp, Homo sapiens
tctgttctccatacc

SEQ ID NO: 413009 - DNA, 15 bp, Homo sapiens
ctgttctccataccc

SEQ ID NO: 413010 - DNA, 15 bp, Homo sapiens
tgttctccatacccc

SEQ ID NO: 413011 - DNA, 15 bp, Homo sapiens
gttctccatacccct

SEQ ID NO: 413012 - DNA, 15 bp, Homo sapiens
ttctccatacccctc

SEQ ID NO: 413013 - DNA, 15 bp, Homo sapiens
tctccatacccctca

SEQ ID NO: 413014 - DNA, 15 bp, Homo sapiens
ctccatacccctcag

SEQ ID NO: 413015 - DNA, 15 bp, Homo sapiens
tccatacccctcagg

SEQ ID NO: 413016 - DNA, 15 bp, Homo sapiens
ccatacccctcaggt

SEQ ID NO: 413017 - DNA, 15 bp, Homo sapiens
catacccctcaggtt

SEQ ID NO: 413018 - DNA, 15 bp, Homo sapiens
atacccctcaggttt

SEQ ID NO: 413019 - DNA, 15 bp, Homo sapiens
tacccctcaggttta

SEQ ID NO: 413020 - DNA, 15 bp, Homo sapiens
acccctcaggtttat

SEQ ID NO: 413021 - DNA, 15 bp, Homo sapiens
cccctcaggtttatc

SEQ ID NO: 413022 - DNA, 15 bp, Homo sapiens
ccctcaggtttatct

SEQ ID NO: 413023 - DNA, 15 bp, Homo sapiens
cctcaggtttatctg

SEQ ID NO: 413024 - DNA, 15 bp, Homo sapiens
ctcaggtttatctgt

SEQ ID NO: 413025 - DNA, 15 bp, Homo sapiens
tcaggtttatctgtc

SEQ ID NO: 413026 - DNA, 15 bp, Homo sapiens
caggtttatctgtcc

SEQ ID NO: 413027 - DNA, 15 bp, Homo sapiens
aggtttatctgtcca

SEQ ID NO: 413028 - DNA, 15 bp, Homo sapiens
ggtttatctgtccag

SEQ ID NO: 413029 - DNA, 15 bp, Homo sapiens
gtttatctgtccagc

SEQ ID NO: 413030 - DNA, 15 bp, Homo sapiens
tttatctgtccagcc

SEQ ID NO: 413031 - DNA, 15 bp, Homo sapiens
ttatctgtccagcca

SEQ ID NO: 413032 - DNA, 15 bp, Homo sapiens
tatctgtccagccac

SEQ ID NO: 413033 - DNA, 15 bp, Homo sapiens
atctgtccagccact

SEQ ID NO: 413034 - DNA, 15 bp, Homo sapiens
tctgtccagccactg

SEQ ID NO: 413035 - DNA, 15 bp, Homo sapiens
ctgtccagccactgc

SEQ ID NO: 413036 - DNA, 15 bp, Homo sapiens
tgtccagccactgcc

SEQ ID NO: 413037 - DNA, 15 bp, Homo sapiens
gtccagccactgcct

SEQ ID NO: 413038 - DNA, 15 bp, Homo sapiens
tccagccactgcctg

SEQ ID NO: 413039 - DNA, 15 bp, Homo sapiens
ccagccactgcctgc

SEQ ID NO: 413040 - DNA, 15 bp, Homo sapiens
cagccactgcctgcc

SEQ ID NO: 413041 - DNA, 15 bp, Homo sapiens
agccactgcctgccg

SEQ ID NO: 413042 - DNA, 15 bp, Homo sapiens
gccactgcctgccgt

SEQ ID NO: 413043 - DNA, 15 bp, Homo sapiens
ccactgcctgccgtg

SEQ ID NO: 413044 - DNA, 15 bp, Homo sapiens
cactgcctgccgtgc

SEQ ID NO: 413045 - DNA, 15 bp, Homo sapiens
actgcctgccgtgca

SEQ ID NO: 413046 - DNA, 15 bp, Homo sapiens
ctgcctgccgtgcac

SEQ ID NO: 413047 - DNA, 15 bp, Homo sapiens
tgcctgccgtgcact

SEQ ID NO: 413048 - DNA, 15 bp, Homo sapiens
gcctgccgtgcactg

SEQ ID NO: 413049 - DNA, 15 bp, Homo sapiens
cctgccgtgcactgc

SEQ ID NO: 413050 - DNA, 15 bp, Homo sapiens
ctgccgtgcactgcc

SEQ ID NO: 413051 - DNA, 15 bp, Homo sapiens
tgccgtgcactgccc

SEQ ID NO: 413052 - DNA, 15 bp, Homo sapiens
gccgtgcactgccct

SEQ ID NO: 413053 - DNA, 15 bp, Homo sapiens
ccgtgcactgccctg

SEQ ID NO: 413054 - DNA, 15 bp, Homo sapiens
cgtgcactgccctgt

SEQ ID NO: 413055 - DNA, 15 bp, Homo sapiens
gtgcactgccctgta

SEQ ID NO: 413056 - DNA, 15 bp, Homo sapiens
tgcactgccctgtac

SEQ ID NO: 413057 - DNA, 15 bp, Homo sapiens
gcactgccctgtaca

SEQ ID NO: 413058 - DNA, 15 bp, Homo sapiens
cactgccctgtacag

SEQ ID NO: 413059 - DNA, 15 bp, Homo sapiens
actgccctgtacagc

SEQ ID NO: 413060 - DNA, 15 bp, Homo sapiens
ctgccctgtacagcc

SEQ ID NO: 413061 - DNA, 15 bp, Homo sapiens
tgccctgtacagccc

SEQ ID NO: 413062 - DNA, 15 bp, Homo sapiens
gccctgtacagccct

SEQ ID NO: 413063 - DNA, 15 bp, Homo sapiens
ccctgtacagccctc

SEQ ID NO: 413064 - DNA, 15 bp, Homo sapiens
cctgtacagccctct

SEQ ID NO: 413065 - DNA, 15 bp, Homo sapiens
ctgtacagccctctg

SEQ ID NO: 413066 - DNA, 15 bp, Homo sapiens
tgtacagccctctgc

SEQ ID NO: 413067 - DNA, 15 bp, Homo sapiens
gtacagccctctgcc

SEQ ID NO: 413068 - DNA, 15 bp, Homo sapiens
tacagccctctgcct

SEQ ID NO: 413069 - DNA, 15 bp, Homo sapiens
acagccctctgcctg

SEQ ID NO: 413070 - DNA, 15 bp, Homo sapiens
cagccctctgcctgg

SEQ ID NO: 413071 - DNA, 15 bp, Homo sapiens
agccctctgcctggg

SEQ ID NO: 413072 - DNA, 15 bp, Homo sapiens
gccctctgcctgggg

SEQ ID NO: 413073 - DNA, 15 bp, Homo sapiens
ccctctgcctgggga

SEQ ID NO: 413074 - DNA, 15 bp, Homo sapiens
cctctgcctggggac

SEQ ID NO: 413075 - DNA, 15 bp, Homo sapiens
ctctgcctggggact

SEQ ID NO: 413076 - DNA, 15 bp, Homo sapiens
tctgcctggggactc

SEQ ID NO: 413077 - DNA, 15 bp, Homo sapiens
ctgcctggggactca

SEQ ID NO: 413078 - DNA, 15 bp, Homo sapiens
tgcctggggactcag

SEQ ID NO: 413079 - DNA, 15 bp, Homo sapiens
gcctggggactcagc

SEQ ID NO: 413080 - DNA, 15 bp, Homo sapiens
cctggggactcagct

SEQ ID NO: 413081 - DNA, 15 bp, Homo sapiens
ctggggactcagctg

SEQ ID NO: 413082 - DNA, 15 bp, Homo sapiens
tggggactcagctgt

SEQ ID NO: 413083 - DNA, 15 bp, Homo sapiens
ggggactcagctgtg

SEQ ID NO: 413084 - DNA, 15 bp, Homo sapiens
gggactcagctgtgg

SEQ ID NO: 413085 - DNA, 15 bp, Homo sapiens
ggactcagctgtggg

SEQ ID NO: 413086 - DNA, 15 bp, Homo sapiens
gactcagctgtgggt

SEQ ID NO: 413087 - DNA, 15 bp, Homo sapiens
actcagctgtgggtg

SEQ ID NO: 413088 - DNA, 15 bp, Homo sapiens
ctcagctgtgggtgg

SEQ ID NO: 413089 - DNA, 15 bp, Homo sapiens
tcagctgtgggtggc

SEQ ID NO: 413090 - DNA, 15 bp, Homo sapiens
cagctgtgggtggca

SEQ ID NO: 413091 - DNA, 15 bp, Homo sapiens
agctgtgggtggcag

SEQ ID NO: 413092 - DNA, 15 bp, Homo sapiens
gctgtgggtggcaga

SEQ ID NO: 413093 - DNA, 15 bp, Homo sapiens
ctgtgggtggcagaa

SEQ ID NO: 413094 - DNA, 15 bp, Homo sapiens
tgtgggtggcagaag

SEQ ID NO: 413095 - DNA, 15 bp, Homo sapiens
gtgggtggcagaagt

SEQ ID NO: 413096 - DNA, 15 bp, Homo sapiens
tgggtggcagaagtc

SEQ ID NO: 413097 - DNA, 15 bp, Homo sapiens
gggtggcagaagtcg

SEQ ID NO: 413098 - DNA, 15 bp, Homo sapiens
ggtggcagaagtcgc

SEQ ID NO: 413099 - DNA, 15 bp, Homo sapiens
gtggcagaagtcgct

SEQ ID NO: 413100 - DNA, 15 bp, Homo sapiens
tggcagaagtcgctt

SEQ ID NO: 413101 - DNA, 15 bp, Homo sapiens
ggcagaagtcgcttc

SEQ ID NO: 413102 - DNA, 15 bp, Homo sapiens
gcagaagtcgcttca

SEQ ID NO: 413103 - DNA, 15 bp, Homo sapiens
cagaagtcgcttcac

SEQ ID NO: 413104 - DNA, 15 bp, Homo sapiens
agaagtcgcttcaca

SEQ ID NO: 413105 - DNA, 15 bp, Homo sapiens
gaagtcgcttcacag

SEQ ID NO: 413106 - DNA, 15 bp, Homo sapiens
aagtcgcttcacagt

SEQ ID NO: 413107 - DNA, 15 bp, Homo sapiens
agtcgcttcacagtg

SEQ ID NO: 413108 - DNA, 15 bp, Homo sapiens
gtcgcttcacagtga

SEQ ID NO: 413109 - DNA, 15 bp, Homo sapiens
tcgcttcacagtgac

SEQ ID NO: 413110 - DNA, 15 bp, Homo sapiens
cgcttcacagtgaca

SEQ ID NO: 413111 - DNA, 15 bp, Homo sapiens
gcttcacagtgacag

SEQ ID NO: 413112 - DNA, 15 bp, Homo sapiens
cttcacagtgacagt

SEQ ID NO: 413113 - DNA, 15 bp, Homo sapiens
ttcacagtgacagtg

SEQ ID NO: 413114 - DNA, 15 bp, Homo sapiens
tcacagtgacagtgg

SEQ ID NO: 413115 - DNA, 15 bp, Homo sapiens
cacagtgacagtggc

SEQ ID NO: 413116 - DNA, 15 bp, Homo sapiens
acagtgacagtggca

SEQ ID NO: 413117 - DNA, 15 bp, Homo sapiens
cagtgacagtggcac

SEQ ID NO: 413118 - DNA, 15 bp, Homo sapiens
agtgacagtggcaca

SEQ ID NO: 413119 - DNA, 15 bp, Homo sapiens
gtgacagtggcacat

SEQ ID NO: 413120 - DNA, 15 bp, Homo sapiens
tgacagtggcacatc

SEQ ID NO: 413121 - DNA, 15 bp, Homo sapiens
gacagtggcacatct

SEQ ID NO: 413122 - DNA, 15 bp, Homo sapiens
acagtggcacatctg

SEQ ID NO: 413123 - DNA, 15 bp, Homo sapiens
cagtggcacatctga

SEQ ID NO: 413124 - DNA, 15 bp, Homo sapiens
agtggcacatctgac

SEQ ID NO: 413125 - DNA, 15 bp, Homo sapiens
gtggcacatctgacc

SEQ ID NO: 413126 - DNA, 15 bp, Homo sapiens
tggcacatctgacct

SEQ ID NO: 413127 - DNA, 15 bp, Homo sapiens
ggcacatctgacctc

SEQ ID NO: 413128 - DNA, 15 bp, Homo sapiens
gcacatctgacctca

SEQ ID NO: 413129 - DNA, 15 bp, Homo sapiens
cacatctgacctcag

SEQ ID NO: 413130 - DNA, 15 bp, Homo sapiens
acatctgacctcagg

SEQ ID NO: 413131 - DNA, 15 bp, Homo sapiens
catctgacctcaggc

SEQ ID NO: 413132 - DNA, 15 bp, Homo sapiens
atctgacctcaggct

SEQ ID NO: 413133 - DNA, 15 bp, Homo sapiens
tctgacctcaggctt

SEQ ID NO: 413134 - DNA, 15 bp, Homo sapiens
ctgacctcaggcttt

SEQ ID NO: 413135 - DNA, 15 bp, Homo sapiens
tgacctcaggctttt

SEQ ID NO: 413136 - DNA, 15 bp, Homo sapiens
gacctcaggcttttt

SEQ ID NO: 413137 - DNA, 15 bp, Homo sapiens
acctcaggcttttta

SEQ ID NO: 413138 - DNA, 15 bp, Homo sapiens
cctcaggctttttat

SEQ ID NO: 413139 - DNA, 15 bp, Homo sapiens
ctcaggctttttatc

SEQ ID NO: 413140 - DNA, 15 bp, Homo sapiens
tcaggctttttatct

SEQ ID NO: 413141 - DNA, 15 bp, Homo sapiens
caggctttttatctg

SEQ ID NO: 413142 - DNA, 15 bp, Homo sapiens
aggctttttatctga

SEQ ID NO: 413143 - DNA, 15 bp, Homo sapiens
ggctttttatctgag

SEQ ID NO: 413144 - DNA, 15 bp, Homo sapiens
gctttttatctgagc

SEQ ID NO: 413145 - DNA, 15 bp, Homo sapiens
ctttttatctgagcg

SEQ ID NO: 413146 - DNA, 15 bp, Homo sapiens
tttttatctgagcgt

SEQ ID NO: 413147 - DNA, 15 bp, Homo sapiens
ttttatctgagcgtg

SEQ ID NO: 413148 - DNA, 15 bp, Homo sapiens
tttatctgagcgtgt

SEQ ID NO: 413149 - DNA, 15 bp, Homo sapiens
ttatctgagcgtgtc

SEQ ID NO: 413150 - DNA, 15 bp, Homo sapiens
tatctgagcgtgtct

SEQ ID NO: 413151 - DNA, 15 bp, Homo sapiens
atctgagcgtgtctg

SEQ ID NO: 413152 - DNA, 15 bp, Homo sapiens
tctgagcgtgtctgt

SEQ ID NO: 413153 - DNA, 15 bp, Homo sapiens
ctgagcgtgtctgtt

SEQ ID NO: 413154 - DNA, 15 bp, Homo sapiens
tgagcgtgtctgttt

SEQ ID NO: 413155 - DNA, 15 bp, Homo sapiens
gagcgtgtctgtttt

SEQ ID NO: 413156 - DNA, 15 bp, Homo sapiens
agcgtgtctgtttta

SEQ ID NO: 413157 - DNA, 15 bp, Homo sapiens
gcgtgtctgttttaa

SEQ ID NO: 413158 - DNA, 15 bp, Homo sapiens
cgtgtctgttttaaa

SEQ ID NO: 413159 - DNA, 15 bp, Homo sapiens
gtgtctgttttaaac

SEQ ID NO: 413160 - DNA, 15 bp, Homo sapiens
tgtctgttttaaaca

SEQ ID NO: 413161 - DNA, 15 bp, Homo sapiens
gtctgttttaaacat

SEQ ID NO: 413162 - DNA, 15 bp, Homo sapiens
tctgttttaaacatg

SEQ ID NO: 413163 - DNA, 15 bp, Homo sapiens
ctgttttaaacatgg

SEQ ID NO: 413164 - DNA, 15 bp, Homo sapiens
tgttttaaacatgga

SEQ ID NO: 413165 - DNA, 15 bp, Homo sapiens
gttttaaacatggag

SEQ ID NO: 413166 - DNA, 15 bp, Homo sapiens
ttttaaacatggagt

SEQ ID NO: 413167 - DNA, 15 bp, Homo sapiens
tttaaacatggagtg

SEQ ID NO: 413168 - DNA, 15 bp, Homo sapiens
ttaaacatggagtgc

SEQ ID NO: 413169 - DNA, 15 bp, Homo sapiens
taaacatggagtgct

SEQ ID NO: 413170 - DNA, 15 bp, Homo sapiens
aaacatggagtgctt

SEQ ID NO: 413171 - DNA, 15 bp, Homo sapiens
aacatggagtgcttg

SEQ ID NO: 413172 - DNA, 15 bp, Homo sapiens
acatggagtgcttgc

SEQ ID NO: 413173 - DNA, 15 bp, Homo sapiens
catggagtgcttgca

SEQ ID NO: 413174 - DNA, 15 bp, Homo sapiens
atggagtgcttgcat

SEQ ID NO: 413175 - DNA, 15 bp, Homo sapiens
tggagtgcttgcatg

SEQ ID NO: 413176 - DNA, 15 bp, Homo sapiens
ggagtgcttgcatgc

SEQ ID NO: 413177 - DNA, 15 bp, Homo sapiens
gagtgcttgcatgca

SEQ ID NO: 413178 - DNA, 15 bp, Homo sapiens
agtgcttgcatgcac

SEQ ID NO: 413179 - DNA, 15 bp, Homo sapiens
gtgcttgcatgcact

SEQ ID NO: 413180 - DNA, 15 bp, Homo sapiens
tgcttgcatgcactg

SEQ ID NO: 413181 - DNA, 15 bp, Homo sapiens
gcttgcatgcactgt

SEQ ID NO: 413182 - DNA, 15 bp, Homo sapiens
cttgcatgcactgtg

SEQ ID NO: 413183 - DNA, 15 bp, Homo sapiens
ttgcatgcactgtga

SEQ ID NO: 413184 - DNA, 15 bp, Homo sapiens
tgcatgcactgtgaa

SEQ ID NO: 413185 - DNA, 15 bp, Homo sapiens
gcatgcactgtgaag

SEQ ID NO: 413186 - DNA, 15 bp, Homo sapiens
catgcactgtgaagc

SEQ ID NO: 413187 - DNA, 15 bp, Homo sapiens
atgcactgtgaagct

SEQ ID NO: 413188 - DNA, 15 bp, Homo sapiens
tgcactgtgaagctt

SEQ ID NO: 413189 - DNA, 15 bp, Homo sapiens
gcactgtgaagcttt

SEQ ID NO: 413190 - DNA, 15 bp, Homo sapiens
cactgtgaagcttta

SEQ ID NO: 413191 - DNA, 15 bp, Homo sapiens
actgtgaagctttaa

SEQ ID NO: 413192 - DNA, 15 bp, Homo sapiens
ctgtgaagctttaat

SEQ ID NO: 413193 - DNA, 15 bp, Homo sapiens
tgtgaagctttaatg

SEQ ID NO: 413194 - DNA, 15 bp, Homo sapiens
gtgaagctttaatgc

SEQ ID NO: 413195 - DNA, 15 bp, Homo sapiens
tgaagctttaatgct

SEQ ID NO: 413196 - DNA, 15 bp, Homo sapiens
gaagctttaatgctt

SEQ ID NO: 413197 - DNA, 15 bp, Homo sapiens
aagctttaatgcttg

SEQ ID NO: 413198 - DNA, 15 bp, Homo sapiens
agctttaatgcttgg

SEQ ID NO: 413199 - DNA, 15 bp, Homo sapiens
gctttaatgcttgga

SEQ ID NO: 413200 - DNA, 15 bp, Homo sapiens
ctttaatgcttggat

SEQ ID NO: 413201 - DNA, 15 bp, Homo sapiens
tttaatgcttggatt

SEQ ID NO: 413202 - DNA, 15 bp, Homo sapiens
ttaatgcttggatta

SEQ ID NO: 413203 - DNA, 15 bp, Homo sapiens
taatgcttggattat

SEQ ID NO: 413204 - DNA, 15 bp, Homo sapiens
aatgcttggattatt

SEQ ID NO: 413205 - DNA, 15 bp, Homo sapiens
atgcttggattatta

SEQ ID NO: 413206 - DNA, 15 bp, Homo sapiens
tgcttggattattaa

SEQ ID NO: 413207 - DNA, 15 bp, Homo sapiens
gcttggattattaaa

SEQ ID NO: 413208 - DNA, 15 bp, Homo sapiens
cttggattattaaat

SEQ ID NO: 413209 - DNA, 15 bp, Homo sapiens
ttggattattaaatg

SEQ ID NO: 413210 - DNA, 15 bp, Homo sapiens
tggattattaaatgt

SEQ ID NO: 413211 - DNA, 15 bp, Homo sapiens
ggattattaaatgtg

SEQ ID NO: 413212 - DNA, 15 bp, Homo sapiens
gattattaaatgtgc

SEQ ID NO: 413213 - DNA, 15 bp, Homo sapiens
attattaaatgtgcg

SEQ ID NO: 413214 - DNA, 15 bp, Homo sapiens
ttattaaatgtgcgt

SEQ ID NO: 413215 - DNA, 15 bp, Homo sapiens
tattaaatgtgcgtg

SEQ ID NO: 413216 - DNA, 15 bp, Homo sapiens
attaaatgtgcgtgt

SEQ ID NO: 413217 - DNA, 15 bp, Homo sapiens
ttaaatgtgcgtgta

SEQ ID NO: 413218 - DNA, 15 bp, Homo sapiens
taaatgtgcgtgtag

SEQ ID NO: 413219 - DNA, 15 bp, Homo sapiens
aaatgtgcgtgtagc

SEQ ID NO: 413220 - DNA, 15 bp, Homo sapiens
aatgtgcgtgtagct

SEQ ID NO: 413221 - DNA, 15 bp, Homo sapiens
atgtgcgtgtagctc

SEQ ID NO: 413222 - DNA, 15 bp, Homo sapiens
tgtgcgtgtagctct

SEQ ID NO: 413223 - DNA, 15 bp, Homo sapiens
gtgcgtgtagctctt

SEQ ID NO: 413224 - DNA, 15 bp, Homo sapiens
tgcgtgtagctcttt

SEQ ID NO: 413225 - DNA, 15 bp, Homo sapiens
gcgtgtagctctttt

SEQ ID NO: 413226 - DNA, 15 bp, Homo sapiens
cgtgtagctcttttt

SEQ ID NO: 413227 - DNA, 15 bp, Homo sapiens
gtgtagctctttttt

SEQ ID NO: 413228 - DNA, 15 bp, Homo sapiens
tgtagctcttttttc

SEQ ID NO: 413229 - DNA, 15 bp, Homo sapiens
gtagctcttttttcc

SEQ ID NO: 413230 - DNA, 15 bp, Homo sapiens
tagctcttttttcca

SEQ ID NO: 413231 - DNA, 15 bp, Homo sapiens
agctcttttttccat

SEQ ID NO: 413232 - DNA, 15 bp, Homo sapiens
gctcttttttccata

SEQ ID NO: 413233 - DNA, 15 bp, Homo sapiens
ctcttttttccatag

SEQ ID NO: 413234 - DNA, 15 bp, Homo sapiens
tcttttttccatagg

SEQ ID NO: 413235 - DNA, 15 bp, Homo sapiens
cttttttccatagga

SEQ ID NO: 413236 - DNA, 15 bp, Homo sapiens
ttttttccataggaa

SEQ ID NO: 413237 - DNA, 15 bp, Homo sapiens
tttttccataggaag

SEQ ID NO: 413238 - DNA, 15 bp, Homo sapiens
ttttccataggaagg

SEQ ID NO: 413239 - DNA, 15 bp, Homo sapiens
tttccataggaaggc

SEQ ID NO: 413240 - DNA, 15 bp, Homo sapiens
ttccataggaaggct

SEQ ID NO: 413241 - DNA, 15 bp, Homo sapiens
tccataggaaggctc

SEQ ID NO: 413242 - DNA, 15 bp, Homo sapiens
ccataggaaggctcc

SEQ ID NO: 413243 - DNA, 15 bp, Homo sapiens
cataggaaggctcct

SEQ ID NO: 413244 - DNA, 15 bp, Homo sapiens
ataggaaggctcctg

SEQ ID NO: 413245 - DNA, 15 bp, Homo sapiens
taggaaggctcctgg

SEQ ID NO: 413246 - DNA, 15 bp, Homo sapiens
aggaaggctcctggc

SEQ ID NO: 413247 - DNA, 15 bp, Homo sapiens
ggaaggctcctggca

SEQ ID NO: 413248 - DNA, 15 bp, Homo sapiens
gaaggctcctggcac

SEQ ID NO: 413249 - DNA, 15 bp, Homo sapiens
aaggctcctggcaca

SEQ ID NO: 413250 - DNA, 15 bp, Homo sapiens
aggctcctggcacaa

SEQ ID NO: 413251 - DNA, 15 bp, Homo sapiens
ggctcctggcacaat

SEQ ID NO: 413252 - DNA, 15 bp, Homo sapiens
gctcctggcacaatc

SEQ ID NO: 413253 - DNA, 15 bp, Homo sapiens
ctcctggcacaatct

SEQ ID NO: 413254 - DNA, 15 bp, Homo sapiens
tcctggcacaatcta

SEQ ID NO: 413255 - DNA, 15 bp, Homo sapiens
cctggcacaatctag

SEQ ID NO: 413256 - DNA, 15 bp, Homo sapiens
ctggcacaatctaga

SEQ ID NO: 413257 - DNA, 15 bp, Homo sapiens
tggcacaatctagat

SEQ ID NO: 413258 - DNA, 15 bp, Homo sapiens
ggcacaatctagatg

SEQ ID NO: 413259 - DNA, 15 bp, Homo sapiens
gcacaatctagatgg

SEQ ID NO: 413260 - DNA, 15 bp, Homo sapiens
cacaatctagatgga

SEQ ID NO: 413261 - DNA, 15 bp, Homo sapiens
acaatctagatggag

SEQ ID NO: 413262 - DNA, 15 bp, Homo sapiens
caatctagatggagt

SEQ ID NO: 413263 - DNA, 15 bp, Homo sapiens
aatctagatggagtc

SEQ ID NO: 413264 - DNA, 15 bp, Homo sapiens
atctagatggagtct

SEQ ID NO: 413265 - DNA, 15 bp, Homo sapiens
tctagatggagtcta

SEQ ID NO: 413266 - DNA, 15 bp, Homo sapiens
ctagatggagtctag

SEQ ID NO: 413267 - DNA, 15 bp, Homo sapiens
tagatggagtctagc

SEQ ID NO: 413268 - DNA, 15 bp, Homo sapiens
agatggagtctagcc

SEQ ID NO: 413269 - DNA, 15 bp, Homo sapiens
gatggagtctagcct

SEQ ID NO: 413270 - DNA, 15 bp, Homo sapiens
atggagtctagcctg

SEQ ID NO: 413271 - DNA, 15 bp, Homo sapiens
tggagtctagcctgc

SEQ ID NO: 413272 - DNA, 15 bp, Homo sapiens
ggagtctagcctgcc

SEQ ID NO: 413273 - DNA, 15 bp, Homo sapiens
gagtctagcctgcca

SEQ ID NO: 413274 - DNA, 15 bp, Homo sapiens
agtctagcctgccaa

SEQ ID NO: 413275 - DNA, 15 bp, Homo sapiens
gtctagcctgccaaa

SEQ ID NO: 413276 - DNA, 15 bp, Homo sapiens
tctagcctgccaaat

SEQ ID NO: 413277 - DNA, 15 bp, Homo sapiens
ctagcctgccaaata

SEQ ID NO: 413278 - DNA, 15 bp, Homo sapiens
tagcctgccaaatac

SEQ ID NO: 413279 - DNA, 15 bp, Homo sapiens
agcctgccaaatact

SEQ ID NO: 413280 - DNA, 15 bp, Homo sapiens
gcctgccaaatacta

SEQ ID NO: 413281 - DNA, 15 bp, Homo sapiens
cctgccaaatactac

SEQ ID NO: 413282 - DNA, 15 bp, Homo sapiens
ctgccaaatactacc

SEQ ID NO: 413283 - DNA, 15 bp, Homo sapiens
tgccaaatactacct

SEQ ID NO: 413284 - DNA, 15 bp, Homo sapiens
gccaaatactacctt

SEQ ID NO: 413285 - DNA, 15 bp, Homo sapiens
ccaaatactacctta

SEQ ID NO: 413286 - DNA, 15 bp, Homo sapiens
caaatactaccttac

SEQ ID NO: 413287 - DNA, 15 bp, Homo sapiens
aaatactaccttaca

SEQ ID NO: 413288 - DNA, 15 bp, Homo sapiens
aatactaccttacat

SEQ ID NO: 413289 - DNA, 15 bp, Homo sapiens
atactaccttacatt

SEQ ID NO: 413290 - DNA, 15 bp, Homo sapiens
tactaccttacattt

SEQ ID NO: 413291 - DNA, 15 bp, Homo sapiens
actaccttacattta

SEQ ID NO: 413292 - DNA, 15 bp, Homo sapiens
ctaccttacatttat

SEQ ID NO: 413293 - DNA, 15 bp, Homo sapiens
taccttacatttata

SEQ ID NO: 413294 - DNA, 15 bp, Homo sapiens
accttacatttatag

SEQ ID NO: 413295 - DNA, 15 bp, Homo sapiens
ccttacatttatagt

SEQ ID NO: 413296 - DNA, 15 bp, Homo sapiens
cttacatttatagtt

SEQ ID NO: 413297 - DNA, 15 bp, Homo sapiens
ttacatttatagtta

SEQ ID NO: 413298 - DNA, 15 bp, Homo sapiens
tacatttatagttaa

SEQ ID NO: 413299 - DNA, 15 bp, Homo sapiens
acatttatagttaaa

SEQ ID NO: 413300 - DNA, 15 bp, Homo sapiens
catttatagttaaaa

SEQ ID NO: 413301 - DNA, 15 bp, Homo sapiens
atttatagttaaaac

SEQ ID NO: 413302 - DNA, 15 bp, Homo sapiens
tttatagttaaaaca

SEQ ID NO: 413303 - DNA, 15 bp, Homo sapiens
ttatagttaaaacag

SEQ ID NO: 413304 - DNA, 15 bp, Homo sapiens
tatagttaaaacaga

SEQ ID NO: 413305 - DNA, 15 bp, Homo sapiens
atagttaaaacagaa

SEQ ID NO: 413306 - DNA, 15 bp, Homo sapiens
tagttaaaacagaaa

SEQ ID NO: 413307 - DNA, 15 bp, Homo sapiens
agttaaaacagaaaa

SEQ ID NO: 413308 - DNA, 15 bp, Homo sapiens
gttaaaacagaaaac

SEQ ID NO: 413309 - DNA, 15 bp, Homo sapiens
ttaaaacagaaaacc

SEQ ID NO: 413310 - DNA, 15 bp, Homo sapiens
taaaacagaaaacct

SEQ ID NO: 413311 - DNA, 15 bp, Homo sapiens
aaaacagaaaacctc

SEQ ID NO: 413312 - DNA, 15 bp, Homo sapiens
aaacagaaaacctcc

SEQ ID NO: 413313 - DNA, 15 bp, Homo sapiens
aacagaaaacctcca

SEQ ID NO: 413314 - DNA, 15 bp, Homo sapiens
acagaaaacctccac

SEQ ID NO: 413315 - DNA, 15 bp, Homo sapiens
cagaaaacctccaca

SEQ ID NO: 413316 - DNA, 15 bp, Homo sapiens
agaaaacctccacat

SEQ ID NO: 413317 - DNA, 15 bp, Homo sapiens
gaaaacctccacatg

SEQ ID NO: 413318 - DNA, 15 bp, Homo sapiens
aaaacctccacatgc

SEQ ID NO: 413319 - DNA, 15 bp, Homo sapiens
aaacctccacatgcg

SEQ ID NO: 413320 - DNA, 15 bp, Homo sapiens
aacctccacatgcgt

SEQ ID NO: 413321 - DNA, 15 bp, Homo sapiens
acctccacatgcgtg

SEQ ID NO: 413322 - DNA, 15 bp, Homo sapiens
cctccacatgcgtgt

SEQ ID NO: 413323 - DNA, 15 bp, Homo sapiens
ctccacatgcgtgta

SEQ ID NO: 413324 - DNA, 15 bp, Homo sapiens
tccacatgcgtgtat

SEQ ID NO: 413325 - DNA, 15 bp, Homo sapiens
ccacatgcgtgtatg

SEQ ID NO: 413326 - DNA, 15 bp, Homo sapiens
cacatgcgtgtatgc

SEQ ID NO: 413327 - DNA, 15 bp, Homo sapiens
acatgcgtgtatgcg

SEQ ID NO: 413328 - DNA, 15 bp, Homo sapiens
catgcgtgtatgcgc

SEQ ID NO: 413329 - DNA, 15 bp, Homo sapiens
atgcgtgtatgcgct

SEQ ID NO: 413330 - DNA, 15 bp, Homo sapiens
tgcgtgtatgcgctc

SEQ ID NO: 413331 - DNA, 15 bp, Homo sapiens
gcgtgtatgcgctcc

SEQ ID NO: 413332 - DNA, 15 bp, Homo sapiens
cgtgtatgcgctcct

SEQ ID NO: 413333 - DNA, 15 bp, Homo sapiens
gtgtatgcgctcctg

SEQ ID NO: 413334 - DNA, 15 bp, Homo sapiens
tgtatgcgctcctgc

SEQ ID NO: 413335 - DNA, 15 bp, Homo sapiens
gtatgcgctcctgcc

SEQ ID NO: 413336 - DNA, 15 bp, Homo sapiens
tatgcgctcctgccc

SEQ ID NO: 413337 - DNA, 15 bp, Homo sapiens
atgcgctcctgccct

SEQ ID NO: 413338 - DNA, 15 bp, Homo sapiens
tgcgctcctgccctc

SEQ ID NO: 413339 - DNA, 15 bp, Homo sapiens
gcgctcctgccctct

SEQ ID NO: 413340 - DNA, 15 bp, Homo sapiens
cgctcctgccctctt

SEQ ID NO: 413341 - DNA, 15 bp, Homo sapiens
gctcctgccctcttt

SEQ ID NO: 413342 - DNA, 15 bp, Homo sapiens
ctcctgccctcttta

SEQ ID NO: 413343 - DNA, 15 bp, Homo sapiens
tcctgccctctttag

SEQ ID NO: 413344 - DNA, 15 bp, Homo sapiens
cctgccctctttagc

SEQ ID NO: 413345 - DNA, 15 bp, Homo sapiens
ctgccctctttagcc

SEQ ID NO: 413346 - DNA, 15 bp, Homo sapiens
tgccctctttagcct

SEQ ID NO: 413347 - DNA, 15 bp, Homo sapiens
gccctctttagcctt

SEQ ID NO: 413348 - DNA, 15 bp, Homo sapiens
ccctctttagccttt

SEQ ID NO: 413349 - DNA, 15 bp, Homo sapiens
cctctttagcctttg

SEQ ID NO: 413350 - DNA, 15 bp, Homo sapiens
ctctttagcctttgg

SEQ ID NO: 413351 - DNA, 15 bp, Homo sapiens
tctttagcctttgga

SEQ ID NO: 413352 - DNA, 15 bp, Homo sapiens
ctttagcctttggat

SEQ ID NO: 413353 - DNA, 15 bp, Homo sapiens
tttagcctttggatg

SEQ ID NO: 413354 - DNA, 15 bp, Homo sapiens
ttagcctttggatgc

SEQ ID NO: 413355 - DNA, 15 bp, Homo sapiens
tagcctttggatgcc

SEQ ID NO: 413356 - DNA, 15 bp, Homo sapiens
agcctttggatgcca

SEQ ID NO: 413357 - DNA, 15 bp, Homo sapiens
gcctttggatgccaa

SEQ ID NO: 413358 - DNA, 15 bp, Homo sapiens
cctttggatgccaaa

SEQ ID NO: 413359 - DNA, 15 bp, Homo sapiens
ctttggatgccaaac

SEQ ID NO: 413360 - DNA, 15 bp, Homo sapiens
tttggatgccaaaca

SEQ ID NO: 413361 - DNA, 15 bp, Homo sapiens
ttggatgccaaacac

SEQ ID NO: 413362 - DNA, 15 bp, Homo sapiens
tggatgccaaacacc

SEQ ID NO: 413363 - DNA, 15 bp, Homo sapiens
ggatgccaaacacca

SEQ ID NO: 413364 - DNA, 15 bp, Homo sapiens
gatgccaaacaccaa

SEQ ID NO: 413365 - DNA, 15 bp, Homo sapiens
atgccaaacaccaat

SEQ ID NO: 413366 - DNA, 15 bp, Homo sapiens
tgccaaacaccaatc

SEQ ID NO: 413367 - DNA, 15 bp, Homo sapiens
gccaaacaccaatct

SEQ ID NO: 413368 - DNA, 15 bp, Homo sapiens
ccaaacaccaatctt

SEQ ID NO: 413369 - DNA, 15 bp, Homo sapiens
caaacaccaatcttc

SEQ ID NO: 413370 - DNA, 15 bp, Homo sapiens
aaacaccaatcttct

SEQ ID NO: 413371 - DNA, 15 bp, Homo sapiens
aacaccaatcttctt

SEQ ID NO: 413372 - DNA, 15 bp, Homo sapiens
acaccaatcttcttc

SEQ ID NO: 413373 - DNA, 15 bp, Homo sapiens
caccaatcttcttcc

SEQ ID NO: 413374 - DNA, 15 bp, Homo sapiens
accaatcttcttcca

SEQ ID NO: 413375 - DNA, 15 bp, Homo sapiens
ccaatcttcttccaa

SEQ ID NO: 413376 - DNA, 15 bp, Homo sapiens
caatcttcttccaat

SEQ ID NO: 413377 - DNA, 15 bp, Homo sapiens
aatcttcttccaatt

SEQ ID NO: 413378 - DNA, 15 bp, Homo sapiens
atcttcttccaattt

SEQ ID NO: 413379 - DNA, 15 bp, Homo sapiens
tcttcttccaatttc

SEQ ID NO: 413380 - DNA, 15 bp, Homo sapiens
cttcttccaatttcc

SEQ ID NO: 413381 - DNA, 15 bp, Homo sapiens
ttcttccaatttcca

SEQ ID NO: 413382 - DNA, 15 bp, Homo sapiens
tcttccaatttccag

SEQ ID NO: 413383 - DNA, 15 bp, Homo sapiens
cttccaatttccagt

SEQ ID NO: 413384 - DNA, 15 bp, Homo sapiens
ttccaatttccagtc

SEQ ID NO: 413385 - DNA, 15 bp, Homo sapiens
tccaatttccagtct

SEQ ID NO: 413386 - DNA, 15 bp, Homo sapiens
ccaatttccagtctt

SEQ ID NO: 413387 - DNA, 15 bp, Homo sapiens
caatttccagtcttt

SEQ ID NO: 413388 - DNA, 15 bp, Homo sapiens
aatttccagtcttta

SEQ ID NO: 413389 - DNA, 15 bp, Homo sapiens
atttccagtctttaa

SEQ ID NO: 413390 - DNA, 15 bp, Homo sapiens
tttccagtctttaaa

SEQ ID NO: 413391 - DNA, 15 bp, Homo sapiens
ttccagtctttaaag

SEQ ID NO: 413392 - DNA, 15 bp, Homo sapiens
tccagtctttaaaga

SEQ ID NO: 413393 - DNA, 15 bp, Homo sapiens
ccagtctttaaagaa

SEQ ID NO: 413394 - DNA, 15 bp, Homo sapiens
cagtctttaaagaaa

SEQ ID NO: 413395 - DNA, 15 bp, Homo sapiens
agtctttaaagaaaa

SEQ ID NO: 413396 - DNA, 15 bp, Homo sapiens
gtctttaaagaaaaa

SEQ ID NO: 413397 - DNA, 15 bp, Homo sapiens
tctttaaagaaaaag

SEQ ID NO: 413398 - DNA, 15 bp, Homo sapiens
ctttaaagaaaaaga

SEQ ID NO: 413399 - DNA, 15 bp, Homo sapiens
aagaaaaagaaaggc

SEQ ID NO: 413400 - DNA, 15 bp, Homo sapiens
agaaaaagaaaggca

SEQ ID NO: 413401 - DNA, 15 bp, Homo sapiens
gaaaaagaaaggcag

SEQ ID NO: 413402 - DNA, 15 bp, Homo sapiens
aaaaagaaaggcaga

SEQ ID NO: 413403 - DNA, 15 bp, Homo sapiens
aaaagaaaggcagaa

SEQ ID NO: 413404 - DNA, 15 bp, Homo sapiens
aaagaaaggcagaaa

SEQ ID NO: 413405 - DNA, 15 bp, Homo sapiens
aagaaaggcagaaag

SEQ ID NO: 413406 - DNA, 15 bp, Homo sapiens
agaaaggcagaaagg

SEQ ID NO: 413407 - DNA, 15 bp, Homo sapiens
gaaaggcagaaaggg

SEQ ID NO: 413408 - DNA, 15 bp, Homo sapiens
aaaggcagaaagggg

SEQ ID NO: 413409 - DNA, 15 bp, Homo sapiens
aaggcagaaaggggt

SEQ ID NO: 413410 - DNA, 15 bp, Homo sapiens
aggcagaaaggggtg

SEQ ID NO: 413411 - DNA, 15 bp, Homo sapiens
ggcagaaaggggtga

SEQ ID NO: 413412 - DNA, 15 bp, Homo sapiens
gcagaaaggggtgaa

SEQ ID NO: 413413 - DNA, 15 bp, Homo sapiens
cagaaaggggtgaag

SEQ ID NO: 413414 - DNA, 15 bp, Homo sapiens
agaaaggggtgaagt

SEQ ID NO: 413415 - DNA, 15 bp, Homo sapiens
gaaaggggtgaagtc

SEQ ID NO: 413416 - DNA, 15 bp, Homo sapiens
aaaggggtgaagtcc

SEQ ID NO: 413417 - DNA, 15 bp, Homo sapiens
aaggggtgaagtcct

SEQ ID NO: 413418 - DNA, 15 bp, Homo sapiens
aggggtgaagtcctc

SEQ ID NO: 413419 - DNA, 15 bp, Homo sapiens
ggggtgaagtcctcc

SEQ ID NO: 413420 - DNA, 15 bp, Homo sapiens
gggtgaagtcctccc

SEQ ID NO: 413421 - DNA, 15 bp, Homo sapiens
ggtgaagtcctccct

SEQ ID NO: 413422 - DNA, 15 bp, Homo sapiens
gtgaagtcctccctc

SEQ ID NO: 413423 - DNA, 15 bp, Homo sapiens
tgaagtcctccctca

SEQ ID NO: 413424 - DNA, 15 bp, Homo sapiens
gaagtcctccctcac

SEQ ID NO: 413425 - DNA, 15 bp, Homo sapiens
aagtcctccctcact

SEQ ID NO: 413426 - DNA, 15 bp, Homo sapiens
agtcctccctcactt

SEQ ID NO: 413427 - DNA, 15 bp, Homo sapiens
gtcctccctcacttg

SEQ ID NO: 413428 - DNA, 15 bp, Homo sapiens
tcctccctcacttgg

SEQ ID NO: 413429 - DNA, 15 bp, Homo sapiens
cctccctcacttggt

SEQ ID NO: 413430 - DNA, 15 bp, Homo sapiens
ctccctcacttggta

SEQ ID NO: 413431 - DNA, 15 bp, Homo sapiens
tccctcacttggtat

SEQ ID NO: 413432 - DNA, 15 bp, Homo sapiens
ccctcacttggtatg

SEQ ID NO: 413433 - DNA, 15 bp, Homo sapiens
cctcacttggtatgt

SEQ ID NO: 413434 - DNA, 15 bp, Homo sapiens
ctcacttggtatgta

SEQ ID NO: 413435 - DNA, 15 bp, Homo sapiens
tcacttggtatgtaa

SEQ ID NO: 413436 - DNA, 15 bp, Homo sapiens
cacttggtatgtaag

SEQ ID NO: 413437 - DNA, 15 bp, Homo sapiens
acttggtatgtaagt

SEQ ID NO: 413438 - DNA, 15 bp, Homo sapiens
cttggtatgtaagtc

SEQ ID NO: 413439 - DNA, 15 bp, Homo sapiens
ttggtatgtaagtca

SEQ ID NO: 413440 - DNA, 15 bp, Homo sapiens
tggtatgtaagtcaa

SEQ ID NO: 413441 - DNA, 15 bp, Homo sapiens
ggtatgtaagtcaat

SEQ ID NO: 413442 - DNA, 15 bp, Homo sapiens
gtatgtaagtcaatt

SEQ ID NO: 413443 - DNA, 15 bp, Homo sapiens
tatgtaagtcaatta

SEQ ID NO: 413444 - DNA, 15 bp, Homo sapiens
atgtaagtcaattat

SEQ ID NO: 413445 - DNA, 15 bp, Homo sapiens
tgtaagtcaattatt

SEQ ID NO: 413446 - DNA, 15 bp, Homo sapiens
gtaagtcaattatta

SEQ ID NO: 413447 - DNA, 15 bp, Homo sapiens
taagtcaattattaa

SEQ ID NO: 413448 - DNA, 15 bp, Homo sapiens
aagtcaattattaat

SEQ ID NO: 413449 - DNA, 15 bp, Homo sapiens
agtcaattattaata

SEQ ID NO: 413450 - DNA, 15 bp, Homo sapiens
gtcaattattaatat

SEQ ID NO: 413451 - DNA, 15 bp, Homo sapiens
tcaattattaatatt

SEQ ID NO: 413452 - DNA, 15 bp, Homo sapiens
caattattaatattt

SEQ ID NO: 413453 - DNA, 15 bp, Homo sapiens
aattattaatattta

SEQ ID NO: 413454 - DNA, 15 bp, Homo sapiens
attattaatatttaa

SEQ ID NO: 413455 - DNA, 15 bp, Homo sapiens
ttattaatatttaaa

SEQ ID NO: 413456 - DNA, 15 bp, Homo sapiens
tattaatatttaaaa

SEQ ID NO: 413457 - DNA, 15 bp, Homo sapiens
attaatatttaaaaa

SEQ ID NO: 413458 - DNA, 15 bp, Homo sapiens
ttaatatttaaaaag

SEQ ID NO: 413459 - DNA, 15 bp, Homo sapiens
taatatttaaaaagc

SEQ ID NO: 413460 - DNA, 15 bp, Homo sapiens
aatatttaaaaagct

SEQ ID NO: 413461 - DNA, 15 bp, Homo sapiens
atatttaaaaagctg

SEQ ID NO: 413462 - DNA, 15 bp, Homo sapiens
tatttaaaaagctgt

SEQ ID NO: 413463 - DNA, 15 bp, Homo sapiens
atttaaaaagctgtg

SEQ ID NO: 413464 - DNA, 15 bp, Homo sapiens
tttaaaaagctgtgc

SEQ ID NO: 413465 - DNA, 15 bp, Homo sapiens
ttaaaaagctgtgct

SEQ ID NO: 413466 - DNA, 15 bp, Homo sapiens
taaaaagctgtgctc

SEQ ID NO: 413467 - DNA, 15 bp, Homo sapiens
aaaaagctgtgctca

SEQ ID NO: 413468 - DNA, 15 bp, Homo sapiens
aaaagctgtgctcag

SEQ ID NO: 413469 - DNA, 15 bp, Homo sapiens
aaagctgtgctcagt

SEQ ID NO: 413470 - DNA, 15 bp, Homo sapiens
aagctgtgctcagtg

SEQ ID NO: 413471 - DNA, 15 bp, Homo sapiens
agctgtgctcagtgg

SEQ ID NO: 413472 - DNA, 15 bp, Homo sapiens
gctgtgctcagtggc

SEQ ID NO: 413473 - DNA, 15 bp, Homo sapiens
ctgtgctcagtggct

SEQ ID NO: 413474 - DNA, 15 bp, Homo sapiens
tgtgctcagtggctt

SEQ ID NO: 413475 - DNA, 15 bp, Homo sapiens
gtgctcagtggcttt

SEQ ID NO: 413476 - DNA, 15 bp, Homo sapiens
tgctcagtggctttc

SEQ ID NO: 413477 - DNA, 15 bp, Homo sapiens
gctcagtggctttca

SEQ ID NO: 413478 - DNA, 15 bp, Homo sapiens
ctcagtggctttcac

SEQ ID NO: 413479 - DNA, 15 bp, Homo sapiens
tcagtggctttcacc

SEQ ID NO: 413480 - DNA, 15 bp, Homo sapiens
cagtggctttcaccg

SEQ ID NO: 413481 - DNA, 15 bp, Homo sapiens
agtggctttcaccgt

SEQ ID NO: 413482 - DNA, 15 bp, Homo sapiens
gtggctttcaccgtg

SEQ ID NO: 413483 - DNA, 15 bp, Homo sapiens
tggctttcaccgtga

SEQ ID NO: 413484 - DNA, 15 bp, Homo sapiens
ggctttcaccgtgaa

SEQ ID NO: 413485 - DNA, 15 bp, Homo sapiens
gctttcaccgtgaat

SEQ ID NO: 413486 - DNA, 15 bp, Homo sapiens
ctttcaccgtgaatg

SEQ ID NO: 413487 - DNA, 15 bp, Homo sapiens
tttcaccgtgaatgc

SEQ ID NO: 413488 - DNA, 15 bp, Homo sapiens
ttcaccgtgaatgcc

SEQ ID NO: 413489 - DNA, 15 bp, Homo sapiens
tcaccgtgaatgccc

SEQ ID NO: 413490 - DNA, 15 bp, Homo sapiens
caccgtgaatgcccc

SEQ ID NO: 413491 - DNA, 15 bp, Homo sapiens
accgtgaatgcccca

SEQ ID NO: 413492 - DNA, 15 bp, Homo sapiens
ccgtgaatgccccat

SEQ ID NO: 413493 - DNA, 15 bp, Homo sapiens
cgtgaatgccccatg

SEQ ID NO: 413494 - DNA, 15 bp, Homo sapiens
gtgaatgccccatgg

SEQ ID NO: 413495 - DNA, 15 bp, Homo sapiens
tgaatgccccatgga

SEQ ID NO: 413496 - DNA, 15 bp, Homo sapiens
gaatgccccatggat

SEQ ID NO: 413497 - DNA, 15 bp, Homo sapiens
aatgccccatggatc

SEQ ID NO: 413498 - DNA, 15 bp, Homo sapiens
atgccccatggatca

SEQ ID NO: 413499 - DNA, 15 bp, Homo sapiens
tgccccatggatcat

SEQ ID NO: 413500 - DNA, 15 bp, Homo sapiens
gccccatggatcatt

SEQ ID NO: 413501 - DNA, 15 bp, Homo sapiens
ccccatggatcattg

SEQ ID NO: 413502 - DNA, 15 bp, Homo sapiens
cccatggatcattgc

SEQ ID NO: 413503 - DNA, 15 bp, Homo sapiens
ccatggatcattgca

SEQ ID NO: 413504 - DNA, 15 bp, Homo sapiens
catggatcattgcaa

SEQ ID NO: 413505 - DNA, 15 bp, Homo sapiens
atggatcattgcaag

SEQ ID NO: 413506 - DNA, 15 bp, Homo sapiens
tggatcattgcaagt

SEQ ID NO: 413507 - DNA, 15 bp, Homo sapiens
ggatcattgcaagta

SEQ ID NO: 413508 - DNA, 15 bp, Homo sapiens
gatcattgcaagtac

SEQ ID NO: 413509 - DNA, 15 bp, Homo sapiens
atcattgcaagtaca

SEQ ID NO: 413510 - DNA, 15 bp, Homo sapiens
tcattgcaagtacaa

SEQ ID NO: 413511 - DNA, 15 bp, Homo sapiens
cattgcaagtacaaa

SEQ ID NO: 413512 - DNA, 15 bp, Homo sapiens
attgcaagtacaaat

SEQ ID NO: 413513 - DNA, 15 bp, Homo sapiens
ttgcaagtacaaata

SEQ ID NO: 413514 - DNA, 15 bp, Homo sapiens
tgcaagtacaaatac

SEQ ID NO: 413515 - DNA, 15 bp, Homo sapiens
gcaagtacaaatact

SEQ ID NO: 413516 - DNA, 15 bp, Homo sapiens
caagtacaaatactg

SEQ ID NO: 413517 - DNA, 15 bp, Homo sapiens
aagtacaaatactgt

SEQ ID NO: 413518 - DNA, 15 bp, Homo sapiens
agtacaaatactgta

SEQ ID NO: 413519 - DNA, 15 bp, Homo sapiens
gtacaaatactgtag

SEQ ID NO: 413520 - DNA, 15 bp, Homo sapiens
tacaaatactgtaga

SEQ ID NO: 413521 - DNA, 15 bp, Homo sapiens
acaaatactgtagaa

SEQ ID NO: 413522 - DNA, 15 bp, Homo sapiens
caaatactgtagaag

SEQ ID NO: 413523 - DNA, 15 bp, Homo sapiens
aaatactgtagaagc

SEQ ID NO: 413524 - DNA, 15 bp, Homo sapiens
aatactgtagaagcg

SEQ ID NO: 413525 - DNA, 15 bp, Homo sapiens
atactgtagaagcgg

SEQ ID NO: 413526 - DNA, 15 bp, Homo sapiens
tactgtagaagcggg

SEQ ID NO: 413527 - DNA, 15 bp, Homo sapiens
actgtagaagcggga

SEQ ID NO: 413528 - DNA, 15 bp, Homo sapiens
ctgtagaagcgggac

SEQ ID NO: 413529 - DNA, 15 bp, Homo sapiens
tgtagaagcgggact

SEQ ID NO: 413530 - DNA, 15 bp, Homo sapiens
gtagaagcgggactg

SEQ ID NO: 413531 - DNA, 15 bp, Homo sapiens
tagaagcgggactgg

SEQ ID NO: 413532 - DNA, 15 bp, Homo sapiens
agaagcgggactgga

SEQ ID NO: 413533 - DNA, 15 bp, Homo sapiens
gaagcgggactggat

SEQ ID NO: 413534 - DNA, 15 bp, Homo sapiens
aagcgggactggatt

SEQ ID NO: 413535 - DNA, 15 bp, Homo sapiens
agcgggactggattg

SEQ ID NO: 413536 - DNA, 15 bp, Homo sapiens
gcgggactggattga

SEQ ID NO: 413537 - DNA, 15 bp, Homo sapiens
cgggactggattgag

SEQ ID NO: 413538 - DNA, 15 bp, Homo sapiens
gggactggattgagt

SEQ ID NO: 413539 - DNA, 15 bp, Homo sapiens
ggactggattgagtc

SEQ ID NO: 413540 - DNA, 15 bp, Homo sapiens
gactggattgagtca

SEQ ID NO: 413541 - DNA, 15 bp, Homo sapiens
actggattgagtcat

SEQ ID NO: 413542 - DNA, 15 bp, Homo sapiens
ctggattgagtcatt

SEQ ID NO: 413543 - DNA, 15 bp, Homo sapiens
tggattgagtcatta

SEQ ID NO: 413544 - DNA, 15 bp, Homo sapiens
ggattgagtcattaa

SEQ ID NO: 413545 - DNA, 15 bp, Homo sapiens
gattgagtcattaaa

SEQ ID NO: 413546 - DNA, 15 bp, Homo sapiens
attgagtcattaaaa

SEQ ID NO: 413547 - DNA, 15 bp, Homo sapiens
ttgagtcattaaaag

SEQ ID NO: 413548 - DNA, 15 bp, Homo sapiens
tgagtcattaaaaga

SEQ ID NO: 413549 - DNA, 15 bp, Homo sapiens
gagtcattaaaagaa

SEQ ID NO: 413550 - DNA, 15 bp, Homo sapiens
agtcattaaaagaat

SEQ ID NO: 413551 - DNA, 15 bp, Homo sapiens
gtcattaaaagaata

SEQ ID NO: 413552 - DNA, 15 bp, Homo sapiens
tcattaaaagaataa

SEQ ID NO: 413553 - DNA, 15 bp, Homo sapiens
cattaaaagaataat

SEQ ID NO: 413554 - DNA, 15 bp, Homo sapiens
attaaaagaataatg

SEQ ID NO: 413555 - DNA, 15 bp, Homo sapiens
ttaaaagaataatgg

SEQ ID NO: 413556 - DNA, 15 bp, Homo sapiens
taaaagaataatggg

SEQ ID NO: 413557 - DNA, 15 bp, Homo sapiens
aaaagaataatgggc

SEQ ID NO: 413558 - DNA, 15 bp, Homo sapiens
aaagaataatgggct

SEQ ID NO: 413559 - DNA, 15 bp, Homo sapiens
aagaataatgggctt

SEQ ID NO: 413560 - DNA, 15 bp, Homo sapiens
agaataatgggcttt

SEQ ID NO: 413561 - DNA, 15 bp, Homo sapiens
gaataatgggctttt

SEQ ID NO: 413562 - DNA, 15 bp, Homo sapiens
aataatgggcttttt

SEQ ID NO: 413563 - DNA, 15 bp, Homo sapiens
ataatgggctttttc

SEQ ID NO: 413564 - DNA, 15 bp, Homo sapiens
taatgggctttttct

SEQ ID NO: 413565 - DNA, 15 bp, Homo sapiens
aatgggctttttctt

SEQ ID NO: 413566 - DNA, 15 bp, Homo sapiens
atgggctttttctta

SEQ ID NO: 413567 - DNA, 15 bp, Homo sapiens
tgggctttttcttac

SEQ ID NO: 413568 - DNA, 15 bp, Homo sapiens
gggctttttcttaca

SEQ ID NO: 413569 - DNA, 15 bp, Homo sapiens
ggctttttcttacaa

SEQ ID NO: 413570 - DNA, 15 bp, Homo sapiens
gctttttcttacaaa

SEQ ID NO: 413571 - DNA, 15 bp, Homo sapiens
ctttttcttacaaac

SEQ ID NO: 413572 - DNA, 15 bp, Homo sapiens
tttttcttacaaacc

SEQ ID NO: 413573 - DNA, 15 bp, Homo sapiens
ttttcttacaaacca

SEQ ID NO: 413574 - DNA, 15 bp, Homo sapiens
tttcttacaaaccac

SEQ ID NO: 413575 - DNA, 15 bp, Homo sapiens
ttcttacaaaccaca

SEQ ID NO: 413576 - DNA, 15 bp, Homo sapiens
tcttacaaaccacaa

SEQ ID NO: 413577 - DNA, 15 bp, Homo sapiens
cttacaaaccacaat

SEQ ID NO: 413578 - DNA, 15 bp, Homo sapiens
ttacaaaccacaatt

SEQ ID NO: 413579 - DNA, 15 bp, Homo sapiens
tacaaaccacaattg

SEQ ID NO: 413580 - DNA, 15 bp, Homo sapiens
acaaaccacaattgc

SEQ ID NO: 413581 - DNA, 15 bp, Homo sapiens
caaaccacaattgcc

SEQ ID NO: 413582 - DNA, 15 bp, Homo sapiens
aaaccacaattgcca

SEQ ID NO: 413583 - DNA, 15 bp, Homo sapiens
aaccacaattgccag

SEQ ID NO: 413584 - DNA, 15 bp, Homo sapiens
accacaattgccaga

SEQ ID NO: 413585 - DNA, 15 bp, Homo sapiens
ccacaattgccagag

SEQ ID NO: 413586 - DNA, 15 bp, Homo sapiens
cacaattgccagagg

SEQ ID NO: 413587 - DNA, 15 bp, Homo sapiens
acaattgccagaggg

SEQ ID NO: 413588 - DNA, 15 bp, Homo sapiens
caattgccagaggga

SEQ ID NO: 413589 - DNA, 15 bp, Homo sapiens
aattgccagagggaa

SEQ ID NO: 413590 - DNA, 15 bp, Homo sapiens
attgccagagggaaa

SEQ ID NO: 413591 - DNA, 15 bp, Homo sapiens
ttgccagagggaaaa

SEQ ID NO: 413592 - DNA, 15 bp, Homo sapiens
tgccagagggaaaag

SEQ ID NO: 413593 - DNA, 15 bp, Homo sapiens
gccagagggaaaaga

SEQ ID NO: 413594 - DNA, 15 bp, Homo sapiens
ccagagggaaaagat

SEQ ID NO: 413595 - DNA, 15 bp, Homo sapiens
cagagggaaaagatg

SEQ ID NO: 413596 - DNA, 15 bp, Homo sapiens
agagggaaaagatgc

SEQ ID NO: 413597 - DNA, 15 bp, Homo sapiens
gagggaaaagatgca

SEQ ID NO: 413598 - DNA, 15 bp, Homo sapiens
agggaaaagatgcaa

SEQ ID NO: 413599 - DNA, 15 bp, Homo sapiens
gggaaaagatgcaac

SEQ ID NO: 413600 - DNA, 15 bp, Homo sapiens
ggaaaagatgcaaca

SEQ ID NO: 413601 - DNA, 15 bp, Homo sapiens
gaaaagatgcaacat

SEQ ID NO: 413602 - DNA, 15 bp, Homo sapiens
aaaagatgcaacatc

SEQ ID NO: 413603 - DNA, 15 bp, Homo sapiens
aaagatgcaacatca

SEQ ID NO: 413604 - DNA, 15 bp, Homo sapiens
aagatgcaacatcat

SEQ ID NO: 413605 - DNA, 15 bp, Homo sapiens
agatgcaacatcatg

SEQ ID NO: 413606 - DNA, 15 bp, Homo sapiens
gatgcaacatcatgc

SEQ ID NO: 413607 - DNA, 15 bp, Homo sapiens
atgcaacatcatgcc

SEQ ID NO: 413608 - DNA, 15 bp, Homo sapiens
tgcaacatcatgcca

SEQ ID NO: 413609 - DNA, 15 bp, Homo sapiens
gcaacatcatgccat

SEQ ID NO: 413610 - DNA, 15 bp, Homo sapiens
caacatcatgccatc

SEQ ID NO: 413611 - DNA, 15 bp, Homo sapiens
aacatcatgccatct

SEQ ID NO: 413612 - DNA, 15 bp, Homo sapiens
acatcatgccatctg

SEQ ID NO: 413613 - DNA, 15 bp, Homo sapiens
catcatgccatctga

SEQ ID NO: 413614 - DNA, 15 bp, Homo sapiens
atcatgccatctgaa

SEQ ID NO: 413615 - DNA, 15 bp, Homo sapiens
tcatgccatctgaaa

SEQ ID NO: 413616 - DNA, 15 bp, Homo sapiens
catgccatctgaaaa

SEQ ID NO: 413617 - DNA, 15 bp, Homo sapiens
atgccatctgaaaag

SEQ ID NO: 413618 - DNA, 15 bp, Homo sapiens
tgccatctgaaaagt

SEQ ID NO: 413619 - DNA, 15 bp, Homo sapiens
gccatctgaaaagtt

SEQ ID NO: 413620 - DNA, 15 bp, Homo sapiens
ccatctgaaaagttt

SEQ ID NO: 413621 - DNA, 15 bp, Homo sapiens
catctgaaaagtttg

SEQ ID NO: 413622 - DNA, 15 bp, Homo sapiens
atctgaaaagtttgg

SEQ ID NO: 413623 - DNA, 15 bp, Homo sapiens
tctgaaaagtttgga

SEQ ID NO: 413624 - DNA, 15 bp, Homo sapiens
ctgaaaagtttggaa

SEQ ID NO: 413625 - DNA, 15 bp, Homo sapiens
tgaaaagtttggaag

SEQ ID NO: 413626 - DNA, 15 bp, Homo sapiens
gaaaagtttggaagc

SEQ ID NO: 413627 - DNA, 15 bp, Homo sapiens
aaaagtttggaagct

SEQ ID NO: 413628 - DNA, 15 bp, Homo sapiens
aaagtttggaagctt

SEQ ID NO: 413629 - DNA, 15 bp, Homo sapiens
aagtttggaagcttt

SEQ ID NO: 413630 - DNA, 15 bp, Homo sapiens
agtttggaagctttt

SEQ ID NO: 413631 - DNA, 15 bp, Homo sapiens
gtttggaagcttttc

SEQ ID NO: 413632 - DNA, 15 bp, Homo sapiens
tttggaagcttttcc

SEQ ID NO: 413633 - DNA, 15 bp, Homo sapiens
ttggaagcttttcca

SEQ ID NO: 413634 - DNA, 15 bp, Homo sapiens
tggaagcttttccaa

SEQ ID NO: 413635 - DNA, 15 bp, Homo sapiens
ggaagcttttccaaa

SEQ ID NO: 413636 - DNA, 15 bp, Homo sapiens
gaagcttttccaaaa

SEQ ID NO: 413637 - DNA, 15 bp, Homo sapiens
aagcttttccaaaac

SEQ ID NO: 413638 - DNA, 15 bp, Homo sapiens
agcttttccaaaaca

SEQ ID NO: 413639 - DNA, 15 bp, Homo sapiens
gcttttccaaaacaa

SEQ ID NO: 413640 - DNA, 15 bp, Homo sapiens
cttttccaaaacaat

SEQ ID NO: 413641 - DNA, 15 bp, Homo sapiens
ttttccaaaacaatt

SEQ ID NO: 413642 - DNA, 15 bp, Homo sapiens
tttccaaaacaattg

SEQ ID NO: 413643 - DNA, 15 bp, Homo sapiens
ttccaaaacaattgc

SEQ ID NO: 413644 - DNA, 15 bp, Homo sapiens
tccaaaacaattgca

SEQ ID NO: 413645 - DNA, 15 bp, Homo sapiens
ccaaaacaattgcag

SEQ ID NO: 413646 - DNA, 15 bp, Homo sapiens
caaaacaattgcagt

SEQ ID NO: 413647 - DNA, 15 bp, Homo sapiens
aaaacaattgcagtc

SEQ ID NO: 413648 - DNA, 15 bp, Homo sapiens
aaacaattgcagtca

SEQ ID NO: 413649 - DNA, 15 bp, Homo sapiens
aacaattgcagtcac

SEQ ID NO: 413650 - DNA, 15 bp, Homo sapiens
acaattgcagtcact

SEQ ID NO: 413651 - DNA, 15 bp, Homo sapiens
caattgcagtcactg

SEQ ID NO: 413652 - DNA, 15 bp, Homo sapiens
aattgcagtcactgc

SEQ ID NO: 413653 - DNA, 15 bp, Homo sapiens
attgcagtcactgct

SEQ ID NO: 413654 - DNA, 15 bp, Homo sapiens
ttgcagtcactgctt

SEQ ID NO: 413655 - DNA, 15 bp, Homo sapiens
tgcagtcactgcttg

SEQ ID NO: 413656 - DNA, 15 bp, Homo sapiens
gcagtcactgcttgc

SEQ ID NO: 413657 - DNA, 15 bp, Homo sapiens
cagtcactgcttgcc

SEQ ID NO: 413658 - DNA, 15 bp, Homo sapiens
agtcactgcttgcct

SEQ ID NO: 413659 - DNA, 15 bp, Homo sapiens
gtcactgcttgcctt

SEQ ID NO: 413660 - DNA, 15 bp, Homo sapiens
tcactgcttgccttt

SEQ ID NO: 413661 - DNA, 15 bp, Homo sapiens
cactgcttgcctttt

SEQ ID NO: 413662 - DNA, 15 bp, Homo sapiens
actgcttgccttttg

SEQ ID NO: 413663 - DNA, 15 bp, Homo sapiens
ctgcttgccttttga

SEQ ID NO: 413664 - DNA, 15 bp, Homo sapiens
tgcttgccttttgat

SEQ ID NO: 413665 - DNA, 15 bp, Homo sapiens
gcttgccttttgatg

SEQ ID NO: 413666 - DNA, 15 bp, Homo sapiens
cttgccttttgatga

SEQ ID NO: 413667 - DNA, 15 bp, Homo sapiens
ttgccttttgatgat

SEQ ID NO: 413668 - DNA, 15 bp, Homo sapiens
tgccttttgatgata

SEQ ID NO: 413669 - DNA, 15 bp, Homo sapiens
gccttttgatgatag

SEQ ID NO: 413670 - DNA, 15 bp, Homo sapiens
ccttttgatgatagg

SEQ ID NO: 413671 - DNA, 15 bp, Homo sapiens
cttttgatgatagga

SEQ ID NO: 413672 - DNA, 15 bp, Homo sapiens
ttttgatgataggaa

SEQ ID NO: 413673 - DNA, 15 bp, Homo sapiens
tttgatgataggaac

SEQ ID NO: 413674 - DNA, 15 bp, Homo sapiens
ttgatgataggaacg

SEQ ID NO: 413675 - DNA, 15 bp, Homo sapiens
tgatgataggaacgt

SEQ ID NO: 413676 - DNA, 15 bp, Homo sapiens
gatgataggaacgtt

SEQ ID NO: 413677 - DNA, 15 bp, Homo sapiens
atgataggaacgtta

SEQ ID NO: 413678 - DNA, 15 bp, Homo sapiens
tgataggaacgttat

SEQ ID NO: 413679 - DNA, 15 bp, Homo sapiens
gataggaacgttatg

SEQ ID NO: 413680 - DNA, 15 bp, Homo sapiens
ataggaacgttatgg

SEQ ID NO: 413681 - DNA, 15 bp, Homo sapiens
taggaacgttatggt

SEQ ID NO: 413682 - DNA, 15 bp, Homo sapiens
aggaacgttatggtg

SEQ ID NO: 413683 - DNA, 15 bp, Homo sapiens
ggaacgttatggtgg

SEQ ID NO: 413684 - DNA, 15 bp, Homo sapiens
gaacgttatggtggg

SEQ ID NO: 413685 - DNA, 15 bp, Homo sapiens
aacgttatggtggga

SEQ ID NO: 413686 - DNA, 15 bp, Homo sapiens
acgttatggtgggat

SEQ ID NO: 413687 - DNA, 15 bp, Homo sapiens
cgttatggtgggatg

SEQ ID NO: 413688 - DNA, 15 bp, Homo sapiens
gttatggtgggatga

SEQ ID NO: 413689 - DNA, 15 bp, Homo sapiens
ttatggtgggatgaa

SEQ ID NO: 413690 - DNA, 15 bp, Homo sapiens
tatggtgggatgaat

SEQ ID NO: 413691 - DNA, 15 bp, Homo sapiens
atggtgggatgaatg

SEQ ID NO: 413692 - DNA, 15 bp, Homo sapiens
tggtgggatgaatgt

SEQ ID NO: 413693 - DNA, 15 bp, Homo sapiens
ggtgggatgaatgtg

SEQ ID NO: 413694 - DNA, 15 bp, Homo sapiens
gtgggatgaatgtgg

SEQ ID NO: 413695 - DNA, 15 bp, Homo sapiens
tgggatgaatgtgga

SEQ ID NO: 413696 - DNA, 15 bp, Homo sapiens
gggatgaatgtggag

SEQ ID NO: 413697 - DNA, 15 bp, Homo sapiens
ggatgaatgtggaga

SEQ ID NO: 413698 - DNA, 15 bp, Homo sapiens
gatgaatgtggagag

SEQ ID NO: 413699 - DNA, 15 bp, Homo sapiens
atgaatgtggagaga

SEQ ID NO: 413700 - DNA, 15 bp, Homo sapiens
tgaatgtggagagag

SEQ ID NO: 413701 - DNA, 15 bp, Homo sapiens
gaatgtggagagaga

SEQ ID NO: 413702 - DNA, 15 bp, Homo sapiens
aatgtggagagagaa

SEQ ID NO: 413703 - DNA, 15 bp, Homo sapiens
atgtggagagagaag

SEQ ID NO: 413704 - DNA, 15 bp, Homo sapiens
tgtggagagagaaga

SEQ ID NO: 413705 - DNA, 15 bp, Homo sapiens
gtggagagagaagaa

SEQ ID NO: 413706 - DNA, 15 bp, Homo sapiens
tggagagagaagaat

SEQ ID NO: 413707 - DNA, 15 bp, Homo sapiens
ggagagagaagaatt

SEQ ID NO: 413708 - DNA, 15 bp, Homo sapiens
gagagagaagaattt

SEQ ID NO: 413709 - DNA, 15 bp, Homo sapiens
agagagaagaattta

SEQ ID NO: 413710 - DNA, 15 bp, Homo sapiens
gagagaagaatttag

SEQ ID NO: 413711 - DNA, 15 bp, Homo sapiens
agagaagaatttagc

SEQ ID NO: 413712 - DNA, 15 bp, Homo sapiens
gagaagaatttagct

SEQ ID NO: 413713 - DNA, 15 bp, Homo sapiens
agaagaatttagctc

SEQ ID NO: 413714 - DNA, 15 bp, Homo sapiens
gaagaatttagctct

SEQ ID NO: 413715 - DNA, 15 bp, Homo sapiens
aagaatttagctctt

SEQ ID NO: 413716 - DNA, 15 bp, Homo sapiens
agaatttagctcttt

SEQ ID NO: 413717 - DNA, 15 bp, Homo sapiens
gaatttagctctttg

SEQ ID NO: 413718 - DNA, 15 bp, Homo sapiens
aatttagctctttgc

SEQ ID NO: 413719 - DNA, 15 bp, Homo sapiens
atttagctctttgct

SEQ ID NO: 413720 - DNA, 15 bp, Homo sapiens
tttagctctttgctc

SEQ ID NO: 413721 - DNA, 15 bp, Homo sapiens
ttagctctttgctcc

SEQ ID NO: 413722 - DNA, 15 bp, Homo sapiens
tagctctttgctccc

SEQ ID NO: 413723 - DNA, 15 bp, Homo sapiens
agctctttgctccct

SEQ ID NO: 413724 - DNA, 15 bp, Homo sapiens
gctctttgctccctc

SEQ ID NO: 413725 - DNA, 15 bp, Homo sapiens
ctctttgctccctcc

SEQ ID NO: 413726 - DNA, 15 bp, Homo sapiens
tctttgctccctcct

SEQ ID NO: 413727 - DNA, 15 bp, Homo sapiens
ctttgctccctcctg

SEQ ID NO: 413728 - DNA, 15 bp, Homo sapiens
tttgctccctcctgg

SEQ ID NO: 413729 - DNA, 15 bp, Homo sapiens
ttgctccctcctggc

SEQ ID NO: 413730 - DNA, 15 bp, Homo sapiens
tgctccctcctggct

SEQ ID NO: 413731 - DNA, 15 bp, Homo sapiens
gctccctcctggctg

SEQ ID NO: 413732 - DNA, 15 bp, Homo sapiens
ctccctcctggctgc

SEQ ID NO: 413733 - DNA, 15 bp, Homo sapiens
tccctcctggctgca

SEQ ID NO: 413734 - DNA, 15 bp, Homo sapiens
ccctcctggctgcag

SEQ ID NO: 413735 - DNA, 15 bp, Homo sapiens
cctcctggctgcagt

SEQ ID NO: 413736 - DNA, 15 bp, Homo sapiens
ctcctggctgcagtt

SEQ ID NO: 413737 - DNA, 15 bp, Homo sapiens
tcctggctgcagttg

SEQ ID NO: 413738 - DNA, 15 bp, Homo sapiens
cctggctgcagttgc

SEQ ID NO: 413739 - DNA, 15 bp, Homo sapiens
ctggctgcagttgct

SEQ ID NO: 413740 - DNA, 15 bp, Homo sapiens
tggctgcagttgctt

SEQ ID NO: 413741 - DNA, 15 bp, Homo sapiens
ggctgcagttgcttc

SEQ ID NO: 413742 - DNA, 15 bp, Homo sapiens
ctgcagttgcttctc

SEQ ID NO: 413743 - DNA, 15 bp, Homo sapiens
tgcagttgcttctcc

SEQ ID NO: 413744 - DNA, 15 bp, Homo sapiens
gcagttgcttctccc

SEQ ID NO: 413745 - DNA, 15 bp, Homo sapiens
cagttgcttctccca

SEQ ID NO: 413746 - DNA, 15 bp, Homo sapiens
agttgcttctcccaa

SEQ ID NO: 413747 - DNA, 15 bp, Homo sapiens
gttgcttctcccaat

SEQ ID NO: 413748 - DNA, 15 bp, Homo sapiens
ttgcttctcccaatc

SEQ ID NO: 413749 - DNA, 15 bp, Homo sapiens
tgcttctcccaatct

SEQ ID NO: 413750 - DNA, 15 bp, Homo sapiens
gcttctcccaatctc

SEQ ID NO: 413751 - DNA, 15 bp, Homo sapiens
cttctcccaatctct

SEQ ID NO: 413752 - DNA, 15 bp, Homo sapiens
ttctcccaatctctc

SEQ ID NO: 413753 - DNA, 15 bp, Homo sapiens
tctcccaatctctct

SEQ ID NO: 413754 - DNA, 15 bp, Homo sapiens
ctcccaatctctctc

SEQ ID NO: 413755 - DNA, 15 bp, Homo sapiens
tcccaatctctctct

SEQ ID NO: 413756 - DNA, 15 bp, Homo sapiens
cccaatctctctctg

SEQ ID NO: 413757 - DNA, 15 bp, Homo sapiens
ccaatctctctctgc

SEQ ID NO: 413758 - DNA, 15 bp, Homo sapiens
caatctctctctgca

SEQ ID NO: 413759 - DNA, 15 bp, Homo sapiens
aatctctctctgcac

SEQ ID NO: 413760 - DNA, 15 bp, Homo sapiens
atctctctctgcacc

SEQ ID NO: 413761 - DNA, 15 bp, Homo sapiens
tctctctctgcacct

SEQ ID NO: 413762 - DNA, 15 bp, Homo sapiens
ctctctctgcacctc

SEQ ID NO: 413763 - DNA, 15 bp, Homo sapiens
tctctctgcacctct

SEQ ID NO: 413764 - DNA, 15 bp, Homo sapiens
ctctctgcacctcta

SEQ ID NO: 413765 - DNA, 15 bp, Homo sapiens
tctctgcacctctac

SEQ ID NO: 413766 - DNA, 15 bp, Homo sapiens
ctctgcacctctact

SEQ ID NO: 413767 - DNA, 15 bp, Homo sapiens
tctgcacctctactg

SEQ ID NO: 413768 - DNA, 15 bp, Homo sapiens
ctgcacctctactgt

SEQ ID NO: 413769 - DNA, 15 bp, Homo sapiens
tgcacctctactgta

SEQ ID NO: 413770 - DNA, 15 bp, Homo sapiens
gcacctctactgtaa

SEQ ID NO: 413771 - DNA, 15 bp, Homo sapiens
cacctctactgtaat

SEQ ID NO: 413772 - DNA, 15 bp, Homo sapiens
acctctactgtaatg

SEQ ID NO: 413773 - DNA, 15 bp, Homo sapiens
cctctactgtaatgt

SEQ ID NO: 413774 - DNA, 15 bp, Homo sapiens
ctctactgtaatgta

SEQ ID NO: 413775 - DNA, 15 bp, Homo sapiens
tctactgtaatgtaa

SEQ ID NO: 413776 - DNA, 15 bp, Homo sapiens
ctactgtaatgtaag

SEQ ID NO: 413777 - DNA, 15 bp, Homo sapiens
tactgtaatgtaagg

SEQ ID NO: 413778 - DNA, 15 bp, Homo sapiens
actgtaatgtaagga

SEQ ID NO: 413779 - DNA, 15 bp, Homo sapiens
ctgtaatgtaaggat

SEQ ID NO: 413780 - DNA, 15 bp, Homo sapiens
tgtaatgtaaggatt

SEQ ID NO: 413781 - DNA, 15 bp, Homo sapiens
gtaatgtaaggatta

SEQ ID NO: 413782 - DNA, 15 bp, Homo sapiens
taatgtaaggattag

SEQ ID NO: 413783 - DNA, 15 bp, Homo sapiens
aatgtaaggattagg

SEQ ID NO: 413784 - DNA, 15 bp, Homo sapiens
atgtaaggattaggc

SEQ ID NO: 413785 - DNA, 15 bp, Homo sapiens
tgtaaggattaggct

SEQ ID NO: 413786 - DNA, 15 bp, Homo sapiens
gtaaggattaggctt

SEQ ID NO: 413787 - DNA, 15 bp, Homo sapiens
taaggattaggcttg

SEQ ID NO: 413788 - DNA, 15 bp, Homo sapiens
aaggattaggcttgt

SEQ ID NO: 413789 - DNA, 15 bp, Homo sapiens
aggattaggcttgta

SEQ ID NO: 413790 - DNA, 15 bp, Homo sapiens
ggattaggcttgtaa

SEQ ID NO: 413791 - DNA, 15 bp, Homo sapiens
gattaggcttgtaac

SEQ ID NO: 413792 - DNA, 15 bp, Homo sapiens
attaggcttgtaaca

SEQ ID NO: 413793 - DNA, 15 bp, Homo sapiens
ttaggcttgtaacac

SEQ ID NO: 413794 - DNA, 15 bp, Homo sapiens
taggcttgtaacaca

SEQ ID NO: 413795 - DNA, 15 bp, Homo sapiens
aggcttgtaacacag

SEQ ID NO: 413796 - DNA, 15 bp, Homo sapiens
ggcttgtaacacagg

SEQ ID NO: 413797 - DNA, 15 bp, Homo sapiens
gcttgtaacacaggg

SEQ ID NO: 413798 - DNA, 15 bp, Homo sapiens
cttgtaacacagggc

SEQ ID NO: 413799 - DNA, 15 bp, Homo sapiens
ttgtaacacagggcg

SEQ ID NO: 413800 - DNA, 15 bp, Homo sapiens
tgtaacacagggcgg

SEQ ID NO: 413801 - DNA, 15 bp, Homo sapiens
gtaacacagggcgga

SEQ ID NO: 413802 - DNA, 15 bp, Homo sapiens
taacacagggcggac

SEQ ID NO: 413803 - DNA, 15 bp, Homo sapiens
aacacagggcggact

SEQ ID NO: 413804 - DNA, 15 bp, Homo sapiens
acacagggcggactt

SEQ ID NO: 413805 - DNA, 15 bp, Homo sapiens
cacagggcggacttc

SEQ ID NO: 413806 - DNA, 15 bp, Homo sapiens
acagggcggacttcg

SEQ ID NO: 413807 - DNA, 15 bp, Homo sapiens
cagggcggacttcga

SEQ ID NO: 413808 - DNA, 15 bp, Homo sapiens
agggcggacttcgac

SEQ ID NO: 413809 - DNA, 15 bp, Homo sapiens
gggcggacttcgacc

SEQ ID NO: 413810 - DNA, 15 bp, Homo sapiens
ggcggacttcgacct

SEQ ID NO: 413811 - DNA, 15 bp, Homo sapiens
gcggacttcgacctc

SEQ ID NO: 413812 - DNA, 15 bp, Homo sapiens
cggacttcgacctct

SEQ ID NO: 413813 - DNA, 15 bp, Homo sapiens
ggacttcgacctctc

SEQ ID NO: 413814 - DNA, 15 bp, Homo sapiens
gacttcgacctctcg

SEQ ID NO: 413815 - DNA, 15 bp, Homo sapiens
acttcgacctctcgc

SEQ ID NO: 413816 - DNA, 15 bp, Homo sapiens
cttcgacctctcgct

SEQ ID NO: 413817 - DNA, 15 bp, Homo sapiens
ttcgacctctcgctt

SEQ ID NO: 413818 - DNA, 15 bp, Homo sapiens
tcgacctctcgcttt

SEQ ID NO: 413819 - DNA, 15 bp, Homo sapiens
cgacctctcgcttta

SEQ ID NO: 413820 - DNA, 15 bp, Homo sapiens
gacctctcgctttaa

SEQ ID NO: 413821 - DNA, 15 bp, Homo sapiens
acctctcgctttaat

SEQ ID NO: 413822 - DNA, 15 bp, Homo sapiens
cctctcgctttaata

SEQ ID NO: 413823 - DNA, 15 bp, Homo sapiens
ctctcgctttaatat

SEQ ID NO: 413824 - DNA, 15 bp, Homo sapiens
tctcgctttaatatg

SEQ ID NO: 413825 - DNA, 15 bp, Homo sapiens
ctcgctttaatatgt

SEQ ID NO: 413826 - DNA, 15 bp, Homo sapiens
tcgctttaatatgtg

SEQ ID NO: 413827 - DNA, 15 bp, Homo sapiens
cgctttaatatgtgg

SEQ ID NO: 413828 - DNA, 15 bp, Homo sapiens
gctttaatatgtggt

SEQ ID NO: 413829 - DNA, 15 bp, Homo sapiens
ctttaatatgtggtt

SEQ ID NO: 413830 - DNA, 15 bp, Homo sapiens
tttaatatgtggtta

SEQ ID NO: 413831 - DNA, 15 bp, Homo sapiens
ttaatatgtggttaa

SEQ ID NO: 413832 - DNA, 15 bp, Homo sapiens
taatatgtggttaag

SEQ ID NO: 413833 - DNA, 15 bp, Homo sapiens
aatatgtggttaagc

SEQ ID NO: 413834 - DNA, 15 bp, Homo sapiens
atatgtggttaagca

SEQ ID NO: 413835 - DNA, 15 bp, Homo sapiens
tatgtggttaagcat

SEQ ID NO: 413836 - DNA, 15 bp, Homo sapiens
atgtggttaagcatc

SEQ ID NO: 413837 - DNA, 15 bp, Homo sapiens
tgtggttaagcatct

SEQ ID NO: 413838 - DNA, 15 bp, Homo sapiens
gtggttaagcatcta

SEQ ID NO: 413839 - DNA, 15 bp, Homo sapiens
tggttaagcatctaa

SEQ ID NO: 413840 - DNA, 15 bp, Homo sapiens
ggttaagcatctaaa

SEQ ID NO: 413841 - DNA, 15 bp, Homo sapiens
gttaagcatctaaat

SEQ ID NO: 413842 - DNA, 15 bp, Homo sapiens
ttaagcatctaaatt

SEQ ID NO: 413843 - DNA, 15 bp, Homo sapiens
taagcatctaaattc

SEQ ID NO: 413844 - DNA, 15 bp, Homo sapiens
aagcatctaaattcc

SEQ ID NO: 413845 - DNA, 15 bp, Homo sapiens
agcatctaaattcct

SEQ ID NO: 413846 - DNA, 15 bp, Homo sapiens
gcatctaaattcctg

SEQ ID NO: 413847 - DNA, 15 bp, Homo sapiens
catctaaattcctga

SEQ ID NO: 413848 - DNA, 15 bp, Homo sapiens
atctaaattcctgag

SEQ ID NO: 413849 - DNA, 15 bp, Homo sapiens
tctaaattcctgaga

SEQ ID NO: 413850 - DNA, 15 bp, Homo sapiens
ctaaattcctgagag

SEQ ID NO: 413851 - DNA, 15 bp, Homo sapiens
taaattcctgagagt

SEQ ID NO: 413852 - DNA, 15 bp, Homo sapiens
aaattcctgagagta

SEQ ID NO: 413853 - DNA, 15 bp, Homo sapiens
aattcctgagagtaa

SEQ ID NO: 413854 - DNA, 15 bp, Homo sapiens
attcctgagagtaaa

SEQ ID NO: 413855 - DNA, 15 bp, Homo sapiens
ttcctgagagtaaaa

SEQ ID NO: 413856 - DNA, 15 bp, Homo sapiens
tcctgagagtaaaag

SEQ ID NO: 413857 - DNA, 15 bp, Homo sapiens
cctgagagtaaaaga

SEQ ID NO: 413858 - DNA, 15 bp, Homo sapiens
ctgagagtaaaagac

SEQ ID NO: 413859 - DNA, 15 bp, Homo sapiens
tgagagtaaaagacg

SEQ ID NO: 413860 - DNA, 15 bp, Homo sapiens
gagagtaaaagacgg

SEQ ID NO: 413861 - DNA, 15 bp, Homo sapiens
agagtaaaagacggt

SEQ ID NO: 413862 - DNA, 15 bp, Homo sapiens
gagtaaaagacggtt

SEQ ID NO: 413863 - DNA, 15 bp, Homo sapiens
agtaaaagacggttc

SEQ ID NO: 413864 - DNA, 15 bp, Homo sapiens
gtaaaagacggttct

SEQ ID NO: 413865 - DNA, 15 bp, Homo sapiens
taaaagacggttctc

SEQ ID NO: 413866 - DNA, 15 bp, Homo sapiens
aaaagacggttctcc

SEQ ID NO: 413867 - DNA, 15 bp, Homo sapiens
aaagacggttctccc

SEQ ID NO: 413868 - DNA, 15 bp, Homo sapiens
aagacggttctccct

SEQ ID NO: 413869 - DNA, 15 bp, Homo sapiens
agacggttctccctc

SEQ ID NO: 413870 - DNA, 15 bp, Homo sapiens
gacggttctccctca

SEQ ID NO: 413871 - DNA, 15 bp, Homo sapiens
acggttctccctcag

SEQ ID NO: 413872 - DNA, 15 bp, Homo sapiens
cggttctccctcagc

SEQ ID NO: 413873 - DNA, 15 bp, Homo sapiens
ggttctccctcagct

SEQ ID NO: 413874 - DNA, 15 bp, Homo sapiens
gttctccctcagctt

SEQ ID NO: 413875 - DNA, 15 bp, Homo sapiens
ttctccctcagcttg

SEQ ID NO: 413876 - DNA, 15 bp, Homo sapiens
tctccctcagcttgc

SEQ ID NO: 413877 - DNA, 15 bp, Homo sapiens
ctccctcagcttgct

SEQ ID NO: 413878 - DNA, 15 bp, Homo sapiens
tccctcagcttgctc

SEQ ID NO: 413879 - DNA, 15 bp, Homo sapiens
ccctcagcttgctct

SEQ ID NO: 413880 - DNA, 15 bp, Homo sapiens
cctcagcttgctctc

SEQ ID NO: 413881 - DNA, 15 bp, Homo sapiens
ctcagcttgctctcc

SEQ ID NO: 413882 - DNA, 15 bp, Homo sapiens
tcagcttgctctcca

SEQ ID NO: 413883 - DNA, 15 bp, Homo sapiens
cagcttgctctccac

SEQ ID NO: 413884 - DNA, 15 bp, Homo sapiens
agcttgctctccact

SEQ ID NO: 413885 - DNA, 15 bp, Homo sapiens
gcttgctctccactt

SEQ ID NO: 413886 - DNA, 15 bp, Homo sapiens
cttgctctccactta

SEQ ID NO: 413887 - DNA, 15 bp, Homo sapiens
ttgctctccacttag

SEQ ID NO: 413888 - DNA, 15 bp, Homo sapiens
tgctctccacttaga

SEQ ID NO: 413889 - DNA, 15 bp, Homo sapiens
gctctccacttagaa

SEQ ID NO: 413890 - DNA, 15 bp, Homo sapiens
ctctccacttagaag

SEQ ID NO: 413891 - DNA, 15 bp, Homo sapiens
tctccacttagaagg

SEQ ID NO: 413892 - DNA, 15 bp, Homo sapiens
ctccacttagaaggg

SEQ ID NO: 413893 - DNA, 15 bp, Homo sapiens
tccacttagaagggg

SEQ ID NO: 413894 - DNA, 15 bp, Homo sapiens
ccacttagaaggggc

SEQ ID NO: 413895 - DNA, 15 bp, Homo sapiens
cacttagaaggggcg

SEQ ID NO: 413896 - DNA, 15 bp, Homo sapiens
acttagaaggggcgg

SEQ ID NO: 413897 - DNA, 15 bp, Homo sapiens
cttagaaggggcggg

SEQ ID NO: 413898 - DNA, 15 bp, Homo sapiens
ttagaaggggcgggg

SEQ ID NO: 413899 - DNA, 15 bp, Homo sapiens
tagaaggggcgggga

SEQ ID NO: 413900 - DNA, 15 bp, Homo sapiens
agaaggggcggggaa

SEQ ID NO: 413901 - DNA, 15 bp, Homo sapiens
gaaggggcggggaag

SEQ ID NO: 413902 - DNA, 15 bp, Homo sapiens
aaggggcggggaagg

SEQ ID NO: 413903 - DNA, 15 bp, Homo sapiens
aggggcggggaaggc

SEQ ID NO: 413904 - DNA, 15 bp, Homo sapiens
ggggcggggaaggca

SEQ ID NO: 413905 - DNA, 15 bp, Homo sapiens
gggcggggaaggcaa

SEQ ID NO: 413906 - DNA, 15 bp, Homo sapiens
ggcggggaaggcaag

SEQ ID NO: 413907 - DNA, 15 bp, Homo sapiens
gcggggaaggcaagg

SEQ ID NO: 413908 - DNA, 15 bp, Homo sapiens
cggggaaggcaagga

SEQ ID NO: 413909 - DNA, 15 bp, Homo sapiens
ggggaaggcaaggaa

SEQ ID NO: 413910 - DNA, 15 bp, Homo sapiens
gggaaggcaaggaat

SEQ ID NO: 413911 - DNA, 15 bp, Homo sapiens
ggaaggcaaggaata

SEQ ID NO: 413912 - DNA, 15 bp, Homo sapiens
gaaggcaaggaatat

SEQ ID NO: 413913 - DNA, 15 bp, Homo sapiens
aaggcaaggaatatc

SEQ ID NO: 413914 - DNA, 15 bp, Homo sapiens
aggcaaggaatatct

SEQ ID NO: 413915 - DNA, 15 bp, Homo sapiens
ggcaaggaatatctt

SEQ ID NO: 413916 - DNA, 15 bp, Homo sapiens
gcaaggaatatcttc

SEQ ID NO: 413917 - DNA, 15 bp, Homo sapiens
caaggaatatcttcc

SEQ ID NO: 413918 - DNA, 15 bp, Homo sapiens
aaggaatatcttcct

SEQ ID NO: 413919 - DNA, 15 bp, Homo sapiens
aggaatatcttcctt

SEQ ID NO: 413920 - DNA, 15 bp, Homo sapiens
ggaatatcttcctta

SEQ ID NO: 413921 - DNA, 15 bp, Homo sapiens
gaatatcttccttat

SEQ ID NO: 413922 - DNA, 15 bp, Homo sapiens
aatatcttccttatg

SEQ ID NO: 413923 - DNA, 15 bp, Homo sapiens
atatcttccttatgg

SEQ ID NO: 413924 - DNA, 15 bp, Homo sapiens
tatcttccttatggc

SEQ ID NO: 413925 - DNA, 15 bp, Homo sapiens
atcttccttatggca

SEQ ID NO: 413926 - DNA, 15 bp, Homo sapiens
tcttccttatggcag

SEQ ID NO: 413927 - DNA, 15 bp, Homo sapiens
cttccttatggcagc

SEQ ID NO: 413928 - DNA, 15 bp, Homo sapiens
ttccttatggcagct

SEQ ID NO: 413929 - DNA, 15 bp, Homo sapiens
tccttatggcagctg

SEQ ID NO: 413930 - DNA, 15 bp, Homo sapiens
ccttatggcagctgg

SEQ ID NO: 413931 - DNA, 15 bp, Homo sapiens
cttatggcagctggt

SEQ ID NO: 413932 - DNA, 15 bp, Homo sapiens
ttatggcagctggta

SEQ ID NO: 413933 - DNA, 15 bp, Homo sapiens
tatggcagctggtaa

SEQ ID NO: 413934 - DNA, 15 bp, Homo sapiens
atggcagctggtaac

SEQ ID NO: 413935 - DNA, 15 bp, Homo sapiens
tggcagctggtaaca

SEQ ID NO: 413936 - DNA, 15 bp, Homo sapiens
ggcagctggtaacag

SEQ ID NO: 413937 - DNA, 15 bp, Homo sapiens
gcagctggtaacagc

SEQ ID NO: 413938 - DNA, 15 bp, Homo sapiens
cagctggtaacagca

SEQ ID NO: 413939 - DNA, 15 bp, Homo sapiens
agctggtaacagcag

SEQ ID NO: 413940 - DNA, 15 bp, Homo sapiens
gctggtaacagcagg

SEQ ID NO: 413941 - DNA, 15 bp, Homo sapiens
ctggtaacagcaggt

SEQ ID NO: 413942 - DNA, 15 bp, Homo sapiens
tggtaacagcaggtg

SEQ ID NO: 413943 - DNA, 15 bp, Homo sapiens
ggtaacagcaggtga

SEQ ID NO: 413944 - DNA, 15 bp, Homo sapiens
gtaacagcaggtgac

SEQ ID NO: 413945 - DNA, 15 bp, Homo sapiens
taacagcaggtgaca

SEQ ID NO: 413946 - DNA, 15 bp, Homo sapiens
aacagcaggtgacaa

SEQ ID NO: 413947 - DNA, 15 bp, Homo sapiens
acagcaggtgacaaa

SEQ ID NO: 413948 - DNA, 15 bp, Homo sapiens
cagcaggtgacaaac

SEQ ID NO: 413949 - DNA, 15 bp, Homo sapiens
agcaggtgacaaact

SEQ ID NO: 413950 - DNA, 15 bp, Homo sapiens
gcaggtgacaaactt

SEQ ID NO: 413951 - DNA, 15 bp, Homo sapiens
caggtgacaaacttt

SEQ ID NO: 413952 - DNA, 15 bp, Homo sapiens
aggtgacaaacttta

SEQ ID NO: 413953 - DNA, 15 bp, Homo sapiens
ggtgacaaactttat

SEQ ID NO: 413954 - DNA, 15 bp, Homo sapiens
gtgacaaactttatg

SEQ ID NO: 413955 - DNA, 15 bp, Homo sapiens
tgacaaactttatga

SEQ ID NO: 413956 - DNA, 15 bp, Homo sapiens
gacaaactttatgac

SEQ ID NO: 413957 - DNA, 15 bp, Homo sapiens
acaaactttatgacc

SEQ ID NO: 413958 - DNA, 15 bp, Homo sapiens
caaactttatgacca

SEQ ID NO: 413959 - DNA, 15 bp, Homo sapiens
aaactttatgaccat

SEQ ID NO: 413960 - DNA, 15 bp, Homo sapiens
aactttatgaccata

SEQ ID NO: 413961 - DNA, 15 bp, Homo sapiens
actttatgaccataa

SEQ ID NO: 413962 - DNA, 15 bp, Homo sapiens
ctttatgaccataaa

SEQ ID NO: 413963 - DNA, 15 bp, Homo sapiens
tttatgaccataaag

SEQ ID NO: 413964 - DNA, 15 bp, Homo sapiens
ttatgaccataaaga

SEQ ID NO: 413965 - DNA, 15 bp, Homo sapiens
tatgaccataaagag

SEQ ID NO: 413966 - DNA, 15 bp, Homo sapiens
atgaccataaagagg

SEQ ID NO: 413967 - DNA, 15 bp, Homo sapiens
tgaccataaagaggt

SEQ ID NO: 413968 - DNA, 15 bp, Homo sapiens
gaccataaagaggtc

SEQ ID NO: 413969 - DNA, 15 bp, Homo sapiens
accataaagaggtct

SEQ ID NO: 413970 - DNA, 15 bp, Homo sapiens
ccataaagaggtctg

SEQ ID NO: 413971 - DNA, 15 bp, Homo sapiens
cataaagaggtctgt

SEQ ID NO: 413972 - DNA, 15 bp, Homo sapiens
ataaagaggtctgtt

SEQ ID NO: 413973 - DNA, 15 bp, Homo sapiens
taaagaggtctgtta

SEQ ID NO: 413974 - DNA, 15 bp, Homo sapiens
aaagaggtctgttag

SEQ ID NO: 413975 - DNA, 15 bp, Homo sapiens
aagaggtctgttagc

SEQ ID NO: 413976 - DNA, 15 bp, Homo sapiens
agaggtctgttagct

SEQ ID NO: 413977 - DNA, 15 bp, Homo sapiens
gaggtctgttagctt

SEQ ID NO: 413978 - DNA, 15 bp, Homo sapiens
aggtctgttagcttg

SEQ ID NO: 413979 - DNA, 15 bp, Homo sapiens
ggtctgttagcttgt

SEQ ID NO: 413980 - DNA, 15 bp, Homo sapiens
gtctgttagcttgtt

SEQ ID NO: 413981 - DNA, 15 bp, Homo sapiens
tctgttagcttgttt

SEQ ID NO: 413982 - DNA, 15 bp, Homo sapiens
ctgttagcttgtttt

SEQ ID NO: 413983 - DNA, 15 bp, Homo sapiens
tgttagcttgttttg

SEQ ID NO: 413984 - DNA, 15 bp, Homo sapiens
gttagcttgttttgt

SEQ ID NO: 413985 - DNA, 15 bp, Homo sapiens
ttagcttgttttgta

SEQ ID NO: 413986 - DNA, 15 bp, Homo sapiens
tagcttgttttgtat

SEQ ID NO: 413987 - DNA, 15 bp, Homo sapiens
agcttgttttgtata

SEQ ID NO: 413988 - DNA, 15 bp, Homo sapiens
gcttgttttgtatag

SEQ ID NO: 413989 - DNA, 15 bp, Homo sapiens
cttgttttgtataga

SEQ ID NO: 413990 - DNA, 15 bp, Homo sapiens
ttgttttgtatagat

SEQ ID NO: 413991 - DNA, 15 bp, Homo sapiens
tgttttgtatagatt

SEQ ID NO: 413992 - DNA, 15 bp, Homo sapiens
gttttgtatagattt

SEQ ID NO: 413993 - DNA, 15 bp, Homo sapiens
ttttgtatagatttg

SEQ ID NO: 413994 - DNA, 15 bp, Homo sapiens
tttgtatagatttgt

SEQ ID NO: 413995 - DNA, 15 bp, Homo sapiens
ttgtatagatttgtc

SEQ ID NO: 413996 - DNA, 15 bp, Homo sapiens
tgtatagatttgtct

SEQ ID NO: 413997 - DNA, 15 bp, Homo sapiens
gtatagatttgtctg

SEQ ID NO: 413998 - DNA, 15 bp, Homo sapiens
tatagatttgtctgt

SEQ ID NO: 413999 - DNA, 15 bp, Homo sapiens
atagatttgtctgtt

SEQ ID NO: 414000 - DNA, 15 bp, Homo sapiens
tagatttgtctgttt

SEQ ID NO: 414001 - DNA, 15 bp, Homo sapiens
agatttgtctgtttc

SEQ ID NO: 414002 - DNA, 15 bp, Homo sapiens
gatttgtctgtttct

SEQ ID NO: 414003 - DNA, 15 bp, Homo sapiens
atttgtctgtttctt

SEQ ID NO: 414004 - DNA, 15 bp, Homo sapiens
tttgtctgtttcttc

SEQ ID NO: 414005 - DNA, 15 bp, Homo sapiens
ttgtctgtttcttcc

SEQ ID NO: 414006 - DNA, 15 bp, Homo sapiens
tgtctgtttcttcct

SEQ ID NO: 414007 - DNA, 15 bp, Homo sapiens
gtctgtttcttcctt

SEQ ID NO: 414008 - DNA, 15 bp, Homo sapiens
tctgtttcttccttt

SEQ ID NO: 414009 - DNA, 15 bp, Homo sapiens
ctgtttcttccttta

SEQ ID NO: 414010 - DNA, 15 bp, Homo sapiens
tgtttcttcctttaa

SEQ ID NO: 414011 - DNA, 15 bp, Homo sapiens
gtttcttcctttaaa

SEQ ID NO: 414012 - DNA, 15 bp, Homo sapiens
tttcttcctttaaag

SEQ ID NO: 414013 - DNA, 15 bp, Homo sapiens
ttcttcctttaaagg

SEQ ID NO: 414014 - DNA, 15 bp, Homo sapiens
tcttcctttaaaggt

SEQ ID NO: 414015 - DNA, 15 bp, Homo sapiens
cttcctttaaaggta

SEQ ID NO: 414016 - DNA, 15 bp, Homo sapiens
ttcctttaaaggtat

SEQ ID NO: 414017 - DNA, 15 bp, Homo sapiens
tcctttaaaggtata

SEQ ID NO: 414018 - DNA, 15 bp, Homo sapiens
cctttaaaggtatag

SEQ ID NO: 414019 - DNA, 15 bp, Homo sapiens
ctttaaaggtataga

SEQ ID NO: 414020 - DNA, 15 bp, Homo sapiens
tttaaaggtatagag

SEQ ID NO: 414021 - DNA, 15 bp, Homo sapiens
ttaaaggtatagagc

SEQ ID NO: 414022 - DNA, 15 bp, Homo sapiens
taaaggtatagagca

SEQ ID NO: 414023 - DNA, 15 bp, Homo sapiens
aaaggtatagagcat

SEQ ID NO: 414024 - DNA, 15 bp, Homo sapiens
aaggtatagagcata

SEQ ID NO: 414025 - DNA, 15 bp, Homo sapiens
aggtatagagcatat

SEQ ID NO: 414026 - DNA, 15 bp, Homo sapiens
ggtatagagcatatg

SEQ ID NO: 414027 - DNA, 15 bp, Homo sapiens
gtatagagcatatgt

SEQ ID NO: 414028 - DNA, 15 bp, Homo sapiens
tatagagcatatgtt

SEQ ID NO: 414029 - DNA, 15 bp, Homo sapiens
atagagcatatgtta

SEQ ID NO: 414030 - DNA, 15 bp, Homo sapiens
tagagcatatgttac

SEQ ID NO: 414031 - DNA, 15 bp, Homo sapiens
agagcatatgttaca

SEQ ID NO: 414032 - DNA, 15 bp, Homo sapiens
gagcatatgttacat

SEQ ID NO: 414033 - DNA, 15 bp, Homo sapiens
agcatatgttacatg

SEQ ID NO: 414034 - DNA, 15 bp, Homo sapiens
gcatatgttacatga

SEQ ID NO: 414035 - DNA, 15 bp, Homo sapiens
catatgttacatgaa

SEQ ID NO: 414036 - DNA, 15 bp, Homo sapiens
atatgttacatgaat

SEQ ID NO: 414037 - DNA, 15 bp, Homo sapiens
tatgttacatgaata

SEQ ID NO: 414038 - DNA, 15 bp, Homo sapiens
atgttacatgaataa

SEQ ID NO: 414039 - DNA, 15 bp, Homo sapiens
tgttacatgaataat

SEQ ID NO: 414040 - DNA, 15 bp, Homo sapiens
gttacatgaataatt

SEQ ID NO: 414041 - DNA, 15 bp, Homo sapiens
ttacatgaataattc

SEQ ID NO: 414042 - DNA, 15 bp, Homo sapiens
tacatgaataattca

SEQ ID NO: 414043 - DNA, 15 bp, Homo sapiens
acatgaataattcat

SEQ ID NO: 414044 - DNA, 15 bp, Homo sapiens
catgaataattcatt

SEQ ID NO: 414045 - DNA, 15 bp, Homo sapiens
atgaataattcatta

SEQ ID NO: 414046 - DNA, 15 bp, Homo sapiens
tgaataattcattac

SEQ ID NO: 414047 - DNA, 15 bp, Homo sapiens
gaataattcattact

SEQ ID NO: 414048 - DNA, 15 bp, Homo sapiens
aataattcattactt

SEQ ID NO: 414049 - DNA, 15 bp, Homo sapiens
ataattcattactta

SEQ ID NO: 414050 - DNA, 15 bp, Homo sapiens
taattcattacttag

SEQ ID NO: 414051 - DNA, 15 bp, Homo sapiens
aattcattacttaga

SEQ ID NO: 414052 - DNA, 15 bp, Homo sapiens
attcattacttagac

SEQ ID NO: 414053 - DNA, 15 bp, Homo sapiens
ttcattacttagacc

SEQ ID NO: 414054 - DNA, 15 bp, Homo sapiens
tcattacttagaccc

SEQ ID NO: 414055 - DNA, 15 bp, Homo sapiens
cattacttagacccc

SEQ ID NO: 414056 - DNA, 15 bp, Homo sapiens
attacttagaccccc

SEQ ID NO: 414057 - DNA, 15 bp, Homo sapiens
ttacttagaccccct

SEQ ID NO: 414058 - DNA, 15 bp, Homo sapiens
tacttagaccccctg

SEQ ID NO: 414059 - DNA, 15 bp, Homo sapiens
acttagaccccctga

SEQ ID NO: 414060 - DNA, 15 bp, Homo sapiens
cttagaccccctgag

SEQ ID NO: 414061 - DNA, 15 bp, Homo sapiens
ttagaccccctgaga

SEQ ID NO: 414062 - DNA, 15 bp, Homo sapiens
tagaccccctgagag

SEQ ID NO: 414063 - DNA, 15 bp, Homo sapiens
agaccccctgagagg

SEQ ID NO: 414064 - DNA, 15 bp, Homo sapiens
gaccccctgagaggc

SEQ ID NO: 414065 - DNA, 15 bp, Homo sapiens
accccctgagaggca

SEQ ID NO: 414066 - DNA, 15 bp, Homo sapiens
ccccctgagaggcag

SEQ ID NO: 414067 - DNA, 15 bp, Homo sapiens
cccctgagaggcagt

SEQ ID NO: 414068 - DNA, 15 bp, Homo sapiens
ccctgagaggcagta

SEQ ID NO: 414069 - DNA, 15 bp, Homo sapiens
cctgagaggcagtaa

SEQ ID NO: 414070 - DNA, 15 bp, Homo sapiens
ctgagaggcagtaat

SEQ ID NO: 414071 - DNA, 15 bp, Homo sapiens
tgagaggcagtaatt

SEQ ID NO: 414072 - DNA, 15 bp, Homo sapiens
gagaggcagtaattg

SEQ ID NO: 414073 - DNA, 15 bp, Homo sapiens
agaggcagtaattgt

SEQ ID NO: 414074 - DNA, 15 bp, Homo sapiens
gaggcagtaattgtg

SEQ ID NO: 414075 - DNA, 15 bp, Homo sapiens
aggcagtaattgtgg

SEQ ID NO: 414076 - DNA, 15 bp, Homo sapiens
ggcagtaattgtggg

SEQ ID NO: 414077 - DNA, 15 bp, Homo sapiens
gcagtaattgtgggc

SEQ ID NO: 414078 - DNA, 15 bp, Homo sapiens
cagtaattgtgggca

SEQ ID NO: 414079 - DNA, 15 bp, Homo sapiens
agtaattgtgggcaa

SEQ ID NO: 414080 - DNA, 15 bp, Homo sapiens
gtaattgtgggcaat

SEQ ID NO: 414081 - DNA, 15 bp, Homo sapiens
taattgtgggcaata

SEQ ID NO: 414082 - DNA, 15 bp, Homo sapiens
aattgtgggcaatag

SEQ ID NO: 414083 - DNA, 15 bp, Homo sapiens
attgtgggcaatagc

SEQ ID NO: 414084 - DNA, 15 bp, Homo sapiens
ttgtgggcaatagct

SEQ ID NO: 414085 - DNA, 15 bp, Homo sapiens
tgtgggcaatagctg

SEQ ID NO: 414086 - DNA, 15 bp, Homo sapiens
gtgggcaatagctgg

SEQ ID NO: 414087 - DNA, 15 bp, Homo sapiens
tgggcaatagctgga

SEQ ID NO: 414088 - DNA, 15 bp, Homo sapiens
gggcaatagctggac

SEQ ID NO: 414089 - DNA, 15 bp, Homo sapiens
ggcaatagctggact

SEQ ID NO: 414090 - DNA, 15 bp, Homo sapiens
gcaatagctggactt

SEQ ID NO: 414091 - DNA, 15 bp, Homo sapiens
caatagctggacttt

SEQ ID NO: 414092 - DNA, 15 bp, Homo sapiens
aatagctggactttt

SEQ ID NO: 414093 - DNA, 15 bp, Homo sapiens
atagctggacttttg

SEQ ID NO: 414094 - DNA, 15 bp, Homo sapiens
tagctggacttttgt

SEQ ID NO: 414095 - DNA, 15 bp, Homo sapiens
agctggacttttgta

SEQ ID NO: 414096 - DNA, 15 bp, Homo sapiens
gctggacttttgtat

SEQ ID NO: 414097 - DNA, 15 bp, Homo sapiens
ctggacttttgtatt

SEQ ID NO: 414098 - DNA, 15 bp, Homo sapiens
tggacttttgtattg

SEQ ID NO: 414099 - DNA, 15 bp, Homo sapiens
ggacttttgtattgt

SEQ ID NO: 414100 - DNA, 15 bp, Homo sapiens
gacttttgtattgta

SEQ ID NO: 414101 - DNA, 15 bp, Homo sapiens
acttttgtattgtaa

SEQ ID NO: 414102 - DNA, 15 bp, Homo sapiens
cttttgtattgtaat

SEQ ID NO: 414103 - DNA, 15 bp, Homo sapiens
ttttgtattgtaatt

SEQ ID NO: 414104 - DNA, 15 bp, Homo sapiens
tttgtattgtaattg

SEQ ID NO: 414105 - DNA, 15 bp, Homo sapiens
ttgtattgtaattgc

SEQ ID NO: 414106 - DNA, 15 bp, Homo sapiens
tgtattgtaattgct

SEQ ID NO: 414107 - DNA, 15 bp, Homo sapiens
gtattgtaattgctg

SEQ ID NO: 414108 - DNA, 15 bp, Homo sapiens
tattgtaattgctgc

SEQ ID NO: 414109 - DNA, 15 bp, Homo sapiens
attgtaattgctgct

SEQ ID NO: 414110 - DNA, 15 bp, Homo sapiens
ttgtaattgctgcta

SEQ ID NO: 414111 - DNA, 15 bp, Homo sapiens
tgtaattgctgctat

SEQ ID NO: 414112 - DNA, 15 bp, Homo sapiens
gtaattgctgctatt

SEQ ID NO: 414113 - DNA, 15 bp, Homo sapiens
taattgctgctatta

SEQ ID NO: 414114 - DNA, 15 bp, Homo sapiens
aattgctgctattag

SEQ ID NO: 414115 - DNA, 15 bp, Homo sapiens
attgctgctattagt

SEQ ID NO: 414116 - DNA, 15 bp, Homo sapiens
ttgctgctattagtc

SEQ ID NO: 414117 - DNA, 15 bp, Homo sapiens
tgctgctattagtct

SEQ ID NO: 414118 - DNA, 15 bp, Homo sapiens
gctgctattagtctt

SEQ ID NO: 414119 - DNA, 15 bp, Homo sapiens
ctgctattagtctta

SEQ ID NO: 414120 - DNA, 15 bp, Homo sapiens
tgctattagtcttaa

SEQ ID NO: 414121 - DNA, 15 bp, Homo sapiens
gctattagtcttaaa

SEQ ID NO: 414122 - DNA, 15 bp, Homo sapiens
ctattagtcttaaaa

SEQ ID NO: 414123 - DNA, 15 bp, Homo sapiens
tattagtcttaaaag

SEQ ID NO: 414124 - DNA, 15 bp, Homo sapiens
attagtcttaaaagt

SEQ ID NO: 414125 - DNA, 15 bp, Homo sapiens
ttagtcttaaaagtc

SEQ ID NO: 414126 - DNA, 15 bp, Homo sapiens
tagtcttaaaagtct

SEQ ID NO: 414127 - DNA, 15 bp, Homo sapiens
agtcttaaaagtcta

SEQ ID NO: 414128 - DNA, 15 bp, Homo sapiens
gtcttaaaagtctag

SEQ ID NO: 414129 - DNA, 15 bp, Homo sapiens
tcttaaaagtctagg

SEQ ID NO: 414130 - DNA, 15 bp, Homo sapiens
cttaaaagtctaggt

SEQ ID NO: 414131 - DNA, 15 bp, Homo sapiens
ttaaaagtctaggtc

SEQ ID NO: 414132 - DNA, 15 bp, Homo sapiens
taaaagtctaggtca

SEQ ID NO: 414133 - DNA, 15 bp, Homo sapiens
aaaagtctaggtcag

SEQ ID NO: 414134 - DNA, 15 bp, Homo sapiens
aaagtctaggtcaga

SEQ ID NO: 414135 - DNA, 15 bp, Homo sapiens
aagtctaggtcagat

SEQ ID NO: 414136 - DNA, 15 bp, Homo sapiens
agtctaggtcagata

SEQ ID NO: 414137 - DNA, 15 bp, Homo sapiens
gtctaggtcagatac

SEQ ID NO: 414138 - DNA, 15 bp, Homo sapiens
tctaggtcagatacc

SEQ ID NO: 414139 - DNA, 15 bp, Homo sapiens
ctaggtcagatacca

SEQ ID NO: 414140 - DNA, 15 bp, Homo sapiens
taggtcagataccag

SEQ ID NO: 414141 - DNA, 15 bp, Homo sapiens
aggtcagataccagg

SEQ ID NO: 414142 - DNA, 15 bp, Homo sapiens
ggtcagataccaggg

SEQ ID NO: 414143 - DNA, 15 bp, Homo sapiens
gtcagataccagggg

SEQ ID NO: 414144 - DNA, 15 bp, Homo sapiens
tcagataccaggggt

SEQ ID NO: 414145 - DNA, 15 bp, Homo sapiens
cagataccaggggtt

SEQ ID NO: 414146 - DNA, 15 bp, Homo sapiens
agataccaggggttc

SEQ ID NO: 414147 - DNA, 15 bp, Homo sapiens
gataccaggggttcc

SEQ ID NO: 414148 - DNA, 15 bp, Homo sapiens
ataccaggggttcct

SEQ ID NO: 414149 - DNA, 15 bp, Homo sapiens
taccaggggttccta

SEQ ID NO: 414150 - DNA, 15 bp, Homo sapiens
accaggggttcctaa

SEQ ID NO: 414151 - DNA, 15 bp, Homo sapiens
ccaggggttcctaac

SEQ ID NO: 414152 - DNA, 15 bp, Homo sapiens
caggggttcctaacc

SEQ ID NO: 414153 - DNA, 15 bp, Homo sapiens
aggggttcctaacct

SEQ ID NO: 414154 - DNA, 15 bp, Homo sapiens
ggggttcctaacctg

SEQ ID NO: 414155 - DNA, 15 bp, Homo sapiens
gggttcctaacctgc

SEQ ID NO: 414156 - DNA, 15 bp, Homo sapiens
ggttcctaacctgcc

SEQ ID NO: 414157 - DNA, 15 bp, Homo sapiens
gttcctaacctgcct

SEQ ID NO: 414158 - DNA, 15 bp, Homo sapiens
ttcctaacctgcctc

SEQ ID NO: 414159 - DNA, 15 bp, Homo sapiens
tcctaacctgcctca

SEQ ID NO: 414160 - DNA, 15 bp, Homo sapiens
cctaacctgcctcag

SEQ ID NO: 414161 - DNA, 15 bp, Homo sapiens
ctaacctgcctcagc

SEQ ID NO: 414162 - DNA, 15 bp, Homo sapiens
taacctgcctcagct

SEQ ID NO: 414163 - DNA, 15 bp, Homo sapiens
aacctgcctcagctt

SEQ ID NO: 414164 - DNA, 15 bp, Homo sapiens
acctgcctcagcttc

SEQ ID NO: 414165 - DNA, 15 bp, Homo sapiens
cctgcctcagcttca

SEQ ID NO: 414166 - DNA, 15 bp, Homo sapiens
ctgcctcagcttcaa

SEQ ID NO: 414167 - DNA, 15 bp, Homo sapiens
tgcctcagcttcaag

SEQ ID NO: 414168 - DNA, 15 bp, Homo sapiens
gcctcagcttcaagc

SEQ ID NO: 414169 - DNA, 15 bp, Homo sapiens
cctcagcttcaagcc

SEQ ID NO: 414170 - DNA, 15 bp, Homo sapiens
ctcagcttcaagcca

SEQ ID NO: 414171 - DNA, 15 bp, Homo sapiens
tcagcttcaagccat

SEQ ID NO: 414172 - DNA, 15 bp, Homo sapiens
cagcttcaagccatt

SEQ ID NO: 414173 - DNA, 15 bp, Homo sapiens
agcttcaagccattt

SEQ ID NO: 414174 - DNA, 15 bp, Homo sapiens
gcttcaagccatttt

SEQ ID NO: 414175 - DNA, 15 bp, Homo sapiens
cttcaagccatttta

SEQ ID NO: 414176 - DNA, 15 bp, Homo sapiens
ttcaagccattttat

SEQ ID NO: 414177 - DNA, 15 bp, Homo sapiens
tcaagccattttatt

SEQ ID NO: 414178 - DNA, 15 bp, Homo sapiens
caagccattttattg

SEQ ID NO: 414179 - DNA, 15 bp, Homo sapiens
aagccattttattgg

SEQ ID NO: 414180 - DNA, 15 bp, Homo sapiens
agccattttattggc

SEQ ID NO: 414181 - DNA, 15 bp, Homo sapiens
gccattttattggca

SEQ ID NO: 414182 - DNA, 15 bp, Homo sapiens
ccattttattggcag

SEQ ID NO: 414183 - DNA, 15 bp, Homo sapiens
cattttattggcaga

SEQ ID NO: 414184 - DNA, 15 bp, Homo sapiens
attttattggcagag

SEQ ID NO: 414185 - DNA, 15 bp, Homo sapiens
ttttattggcagagt

SEQ ID NO: 414186 - DNA, 15 bp, Homo sapiens
tttattggcagagtt

SEQ ID NO: 414187 - DNA, 15 bp, Homo sapiens
ttattggcagagtta

SEQ ID NO: 414188 - DNA, 15 bp, Homo sapiens
tattggcagagttag

SEQ ID NO: 414189 - DNA, 15 bp, Homo sapiens
attggcagagttaga

SEQ ID NO: 414190 - DNA, 15 bp, Homo sapiens
ttggcagagttagaa

SEQ ID NO: 414191 - DNA, 15 bp, Homo sapiens
tggcagagttagaag

SEQ ID NO: 414192 - DNA, 15 bp, Homo sapiens
ggcagagttagaagt

SEQ ID NO: 414193 - DNA, 15 bp, Homo sapiens
gcagagttagaagtt

SEQ ID NO: 414194 - DNA, 15 bp, Homo sapiens
cagagttagaagttc

SEQ ID NO: 414195 - DNA, 15 bp, Homo sapiens
agagttagaagttct

SEQ ID NO: 414196 - DNA, 15 bp, Homo sapiens
gagttagaagttctg

SEQ ID NO: 414197 - DNA, 15 bp, Homo sapiens
agttagaagttctgg

SEQ ID NO: 414198 - DNA, 15 bp, Homo sapiens
gttagaagttctggt

SEQ ID NO: 414199 - DNA, 15 bp, Homo sapiens
ttagaagttctggtt

SEQ ID NO: 414200 - DNA, 15 bp, Homo sapiens
tagaagttctggtta

SEQ ID NO: 414201 - DNA, 15 bp, Homo sapiens
agaagttctggttat

SEQ ID NO: 414202 - DNA, 15 bp, Homo sapiens
gaagttctggttata

SEQ ID NO: 414203 - DNA, 15 bp, Homo sapiens
aagttctggttatat

SEQ ID NO: 414204 - DNA, 15 bp, Homo sapiens
agttctggttatatt

SEQ ID NO: 414205 - DNA, 15 bp, Homo sapiens
gttctggttatatta

SEQ ID NO: 414206 - DNA, 15 bp, Homo sapiens
ttctggttatattag

SEQ ID NO: 414207 - DNA, 15 bp, Homo sapiens
tctggttatattagc

SEQ ID NO: 414208 - DNA, 15 bp, Homo sapiens
ctggttatattagca

SEQ ID NO: 414209 - DNA, 15 bp, Homo sapiens
tggttatattagcat

SEQ ID NO: 414210 - DNA, 15 bp, Homo sapiens
ggttatattagcatg

SEQ ID NO: 414211 - DNA, 15 bp, Homo sapiens
gttatattagcatgt

SEQ ID NO: 414212 - DNA, 15 bp, Homo sapiens
ttatattagcatgtt

SEQ ID NO: 414213 - DNA, 15 bp, Homo sapiens
tatattagcatgttt

SEQ ID NO: 414214 - DNA, 15 bp, Homo sapiens
atattagcatgtttc

SEQ ID NO: 414215 - DNA, 15 bp, Homo sapiens
tattagcatgtttcc

SEQ ID NO: 414216 - DNA, 15 bp, Homo sapiens
attagcatgtttccc

SEQ ID NO: 414217 - DNA, 15 bp, Homo sapiens
ttagcatgtttcccc

SEQ ID NO: 414218 - DNA, 15 bp, Homo sapiens
tagcatgtttcccct

SEQ ID NO: 414219 - DNA, 15 bp, Homo sapiens
agcatgtttcccctt

SEQ ID NO: 414220 - DNA, 15 bp, Homo sapiens
gcatgtttccccttt

SEQ ID NO: 414221 - DNA, 15 bp, Homo sapiens
catgtttcccctttt

SEQ ID NO: 414222 - DNA, 15 bp, Homo sapiens
atgtttcccctttta

SEQ ID NO: 414223 - DNA, 15 bp, Homo sapiens
tgtttccccttttaa

SEQ ID NO: 414224 - DNA, 15 bp, Homo sapiens
gtttccccttttaac

SEQ ID NO: 414225 - DNA, 15 bp, Homo sapiens
tttccccttttaact

SEQ ID NO: 414226 - DNA, 15 bp, Homo sapiens
ttccccttttaactc

SEQ ID NO: 414227 - DNA, 15 bp, Homo sapiens
tccccttttaactcc

SEQ ID NO: 414228 - DNA, 15 bp, Homo sapiens
ccccttttaactccc

SEQ ID NO: 414229 - DNA, 15 bp, Homo sapiens
cccttttaactccca

SEQ ID NO: 414230 - DNA, 15 bp, Homo sapiens
ccttttaactcccat

SEQ ID NO: 414231 - DNA, 15 bp, Homo sapiens
cttttaactcccatg

SEQ ID NO: 414232 - DNA, 15 bp, Homo sapiens
ttttaactcccatgt

SEQ ID NO: 414233 - DNA, 15 bp, Homo sapiens
tttaactcccatgtc

SEQ ID NO: 414234 - DNA, 15 bp, Homo sapiens
ttaactcccatgtct

SEQ ID NO: 414235 - DNA, 15 bp, Homo sapiens
taactcccatgtctt

SEQ ID NO: 414236 - DNA, 15 bp, Homo sapiens
aactcccatgtctta

SEQ ID NO: 414237 - DNA, 15 bp, Homo sapiens
actcccatgtcttag

SEQ ID NO: 414238 - DNA, 15 bp, Homo sapiens
ctcccatgtcttagt

SEQ ID NO: 414239 - DNA, 15 bp, Homo sapiens
tcccatgtcttagta

SEQ ID NO: 414240 - DNA, 15 bp, Homo sapiens
cccatgtcttagtat

SEQ ID NO: 414241 - DNA, 15 bp, Homo sapiens
ccatgtcttagtatt

SEQ ID NO: 414242 - DNA, 15 bp, Homo sapiens
catgtcttagtattt

SEQ ID NO: 414243 - DNA, 15 bp, Homo sapiens
atgtcttagtatttg

SEQ ID NO: 414244 - DNA, 15 bp, Homo sapiens
tgtcttagtatttgt

SEQ ID NO: 414245 - DNA, 15 bp, Homo sapiens
gtcttagtatttgtc

SEQ ID NO: 414246 - DNA, 15 bp, Homo sapiens
tcttagtatttgtct

SEQ ID NO: 414247 - DNA, 15 bp, Homo sapiens
cttagtatttgtctt

SEQ ID NO: 414248 - DNA, 15 bp, Homo sapiens
ttagtatttgtctta

SEQ ID NO: 414249 - DNA, 15 bp, Homo sapiens
tagtatttgtcttat

SEQ ID NO: 414250 - DNA, 15 bp, Homo sapiens
agtatttgtcttatt

SEQ ID NO: 414251 - DNA, 15 bp, Homo sapiens
gtatttgtcttattc

SEQ ID NO: 414252 - DNA, 15 bp, Homo sapiens
tatttgtcttattcc

SEQ ID NO: 414253 - DNA, 15 bp, Homo sapiens
atttgtcttattcct

SEQ ID NO: 414254 - DNA, 15 bp, Homo sapiens
tttgtcttattccta

SEQ ID NO: 414255 - DNA, 15 bp, Homo sapiens
ttgtcttattcctat

SEQ ID NO: 414256 - DNA, 15 bp, Homo sapiens
tgtcttattcctatt

SEQ ID NO: 414257 - DNA, 15 bp, Homo sapiens
gtcttattcctattt

SEQ ID NO: 414258 - DNA, 15 bp, Homo sapiens
tcttattcctatttt

SEQ ID NO: 414259 - DNA, 15 bp, Homo sapiens
cttattcctatttta

SEQ ID NO: 414260 - DNA, 15 bp, Homo sapiens
ttattcctattttag

SEQ ID NO: 414261 - DNA, 15 bp, Homo sapiens
tattcctattttagt

SEQ ID NO: 414262 - DNA, 15 bp, Homo sapiens
attcctattttagta

SEQ ID NO: 414263 - DNA, 15 bp, Homo sapiens
ttcctattttagtag

SEQ ID NO: 414264 - DNA, 15 bp, Homo sapiens
tcctattttagtagt

SEQ ID NO: 414265 - DNA, 15 bp, Homo sapiens
cctattttagtagtt

SEQ ID NO: 414266 - DNA, 15 bp, Homo sapiens
ctattttagtagttg

SEQ ID NO: 414267 - DNA, 15 bp, Homo sapiens
tattttagtagttga

SEQ ID NO: 414268 - DNA, 15 bp, Homo sapiens
attttagtagttgaa

SEQ ID NO: 414269 - DNA, 15 bp, Homo sapiens
ttttagtagttgaat

SEQ ID NO: 414270 - DNA, 15 bp, Homo sapiens
tttagtagttgaatt

SEQ ID NO: 414271 - DNA, 15 bp, Homo sapiens
ttagtagttgaattg

SEQ ID NO: 414272 - DNA, 15 bp, Homo sapiens
tagtagttgaattga

SEQ ID NO: 414273 - DNA, 15 bp, Homo sapiens
agtagttgaattgac

SEQ ID NO: 414274 - DNA, 15 bp, Homo sapiens
gtagttgaattgaca

SEQ ID NO: 414275 - DNA, 15 bp, Homo sapiens
tagttgaattgacag

SEQ ID NO: 414276 - DNA, 15 bp, Homo sapiens
agttgaattgacagt

SEQ ID NO: 414277 - DNA, 15 bp, Homo sapiens
gttgaattgacagta

SEQ ID NO: 414278 - DNA, 15 bp, Homo sapiens
ttgaattgacagtag

SEQ ID NO: 414279 - DNA, 15 bp, Homo sapiens
tgaattgacagtaga

SEQ ID NO: 414280 - DNA, 15 bp, Homo sapiens
gaattgacagtagaa

SEQ ID NO: 414281 - DNA, 15 bp, Homo sapiens
aattgacagtagaag

SEQ ID NO: 414282 - DNA, 15 bp, Homo sapiens
attgacagtagaaga

SEQ ID NO: 414283 - DNA, 15 bp, Homo sapiens
ttgacagtagaagat

SEQ ID NO: 414284 - DNA, 15 bp, Homo sapiens
tgacagtagaagata

SEQ ID NO: 414285 - DNA, 15 bp, Homo sapiens
gacagtagaagatat

SEQ ID NO: 414286 - DNA, 15 bp, Homo sapiens
acagtagaagatatc

SEQ ID NO: 414287 - DNA, 15 bp, Homo sapiens
cagtagaagatatct

SEQ ID NO: 414288 - DNA, 15 bp, Homo sapiens
agtagaagatatcta

SEQ ID NO: 414289 - DNA, 15 bp, Homo sapiens
gtagaagatatctac

SEQ ID NO: 414290 - DNA, 15 bp, Homo sapiens
tagaagatatctact

SEQ ID NO: 414291 - DNA, 15 bp, Homo sapiens
agaagatatctactg

SEQ ID NO: 414292 - DNA, 15 bp, Homo sapiens
gaagatatctactgg

SEQ ID NO: 414293 - DNA, 15 bp, Homo sapiens
aagatatctactggc

SEQ ID NO: 414294 - DNA, 15 bp, Homo sapiens
agatatctactggct

SEQ ID NO: 414295 - DNA, 15 bp, Homo sapiens
gatatctactggctt

SEQ ID NO: 414296 - DNA, 15 bp, Homo sapiens
atatctactggcttt

SEQ ID NO: 414297 - DNA, 15 bp, Homo sapiens
atctactggcttttt

SEQ ID NO: 414298 - DNA, 15 bp, Homo sapiens
tctactggctttttc

SEQ ID NO: 414299 - DNA, 15 bp, Homo sapiens
ctactggctttttcc

SEQ ID NO: 414300 - DNA, 15 bp, Homo sapiens
tactggctttttcct

SEQ ID NO: 414301 - DNA, 15 bp, Homo sapiens
actggctttttcctg

SEQ ID NO: 414302 - DNA, 15 bp, Homo sapiens
ctggctttttcctgt

SEQ ID NO: 414303 - DNA, 15 bp, Homo sapiens
tggctttttcctgtc

SEQ ID NO: 414304 - DNA, 15 bp, Homo sapiens
ggctttttcctgtca

SEQ ID NO: 414305 - DNA, 15 bp, Homo sapiens
gctttttcctgtcaa

SEQ ID NO: 414306 - DNA, 15 bp, Homo sapiens
ctttttcctgtcaaa

SEQ ID NO: 414307 - DNA, 15 bp, Homo sapiens
tttttcctgtcaaag

SEQ ID NO: 414308 - DNA, 15 bp, Homo sapiens
ttttcctgtcaaagg

SEQ ID NO: 414309 - DNA, 15 bp, Homo sapiens
tttcctgtcaaaggc

SEQ ID NO: 414310 - DNA, 15 bp, Homo sapiens
ttcctgtcaaaggct

SEQ ID NO: 414311 - DNA, 15 bp, Homo sapiens
tcctgtcaaaggctt

SEQ ID NO: 414312 - DNA, 15 bp, Homo sapiens
cctgtcaaaggcttg

SEQ ID NO: 414313 - DNA, 15 bp, Homo sapiens
ctgtcaaaggcttga

SEQ ID NO: 414314 - DNA, 15 bp, Homo sapiens
tgtcaaaggcttgat

SEQ ID NO: 414315 - DNA, 15 bp, Homo sapiens
gtcaaaggcttgatt

SEQ ID NO: 414316 - DNA, 15 bp, Homo sapiens
tcaaaggcttgattt

SEQ ID NO: 414317 - DNA, 15 bp, Homo sapiens
caaaggcttgatttg

SEQ ID NO: 414318 - DNA, 15 bp, Homo sapiens
aaaggcttgatttgg

SEQ ID NO: 414319 - DNA, 15 bp, Homo sapiens
aaggcttgatttggg

SEQ ID NO: 414320 - DNA, 15 bp, Homo sapiens
aggcttgatttggga

SEQ ID NO: 414321 - DNA, 15 bp, Homo sapiens
ggcttgatttgggat

SEQ ID NO: 414322 - DNA, 15 bp, Homo sapiens
gcttgatttgggatt

SEQ ID NO: 414323 - DNA, 15 bp, Homo sapiens
cttgatttgggattt

SEQ ID NO: 414324 - DNA, 15 bp, Homo sapiens
ttgatttgggatttt

SEQ ID NO: 414325 - DNA, 15 bp, Homo sapiens
tgatttgggattttt

SEQ ID NO: 414326 - DNA, 15 bp, Homo sapiens
gatttgggattttta

SEQ ID NO: 414327 - DNA, 15 bp, Homo sapiens
atttgggatttttat

SEQ ID NO: 414328 - DNA, 15 bp, Homo sapiens
tttgggatttttatt

SEQ ID NO: 414329 - DNA, 15 bp, Homo sapiens
tgggatttttattat

SEQ ID NO: 414330 - DNA, 15 bp, Homo sapiens
gggatttttattatt

SEQ ID NO: 414331 - DNA, 15 bp, Homo sapiens
ggatttttattatta

SEQ ID NO: 414332 - DNA, 15 bp, Homo sapiens
gatttttattattat

SEQ ID NO: 414333 - DNA, 15 bp, Homo sapiens
atttttattattatt

SEQ ID NO: 414334 - DNA, 15 bp, Homo sapiens
tttttattattatta

SEQ ID NO: 414335 - DNA, 15 bp, Homo sapiens
tttattattattatt

SEQ ID NO: 414336 - DNA, 15 bp, Homo sapiens
tattattattatcta

SEQ ID NO: 414337 - DNA, 15 bp, Homo sapiens
attattattatctat

SEQ ID NO: 414338 - DNA, 15 bp, Homo sapiens
ttattattatctatt

SEQ ID NO: 414339 - DNA, 15 bp, Homo sapiens
tattattatctattt

SEQ ID NO: 414340 - DNA, 15 bp, Homo sapiens
attattatctattta

SEQ ID NO: 414341 - DNA, 15 bp, Homo sapiens
ttattatctatttat

SEQ ID NO: 414342 - DNA, 15 bp, Homo sapiens
tattatctatttatt

SEQ ID NO: 414343 - DNA, 15 bp, Homo sapiens
attatctatttattt

SEQ ID NO: 414344 - DNA, 15 bp, Homo sapiens
ttatctatttattta

SEQ ID NO: 414345 - DNA, 15 bp, Homo sapiens
tatctatttatttat

SEQ ID NO: 414346 - DNA, 15 bp, Homo sapiens
atctatttatttatt

SEQ ID NO: 414347 - DNA, 15 bp, Homo sapiens
tctatttatttattt

SEQ ID NO: 414348 - DNA, 15 bp, Homo sapiens
ctatttatttattta

SEQ ID NO: 414349 - DNA, 15 bp, Homo sapiens
atttatttatttttg

SEQ ID NO: 414350 - DNA, 15 bp, Homo sapiens
tttatttatttttga

SEQ ID NO: 414351 - DNA, 15 bp, Homo sapiens
ttatttatttttgag

SEQ ID NO: 414352 - DNA, 15 bp, Homo sapiens
tatttatttttgaga

SEQ ID NO: 414353 - DNA, 15 bp, Homo sapiens
atttatttttgagac

SEQ ID NO: 414354 - DNA, 15 bp, Homo sapiens
tttatttttgagaca

SEQ ID NO: 414355 - DNA, 15 bp, Homo sapiens
ttatttttgagacaa

SEQ ID NO: 414356 - DNA, 15 bp, Homo sapiens
tatttttgagacaaa

SEQ ID NO: 414357 - DNA, 15 bp, Homo sapiens
atttttgagacaaaa

SEQ ID NO: 414358 - DNA, 15 bp, Homo sapiens
tttttgagacaaaag

SEQ ID NO: 414359 - DNA, 15 bp, Homo sapiens
ttttgagacaaaagg

SEQ ID NO: 414360 - DNA, 15 bp, Homo sapiens
tttgagacaaaaggc

SEQ ID NO: 414361 - DNA, 15 bp, Homo sapiens
ttgagacaaaaggcg

SEQ ID NO: 414362 - DNA, 15 bp, Homo sapiens
tgagacaaaaggcga

SEQ ID NO: 414363 - DNA, 15 bp, Homo sapiens
gagacaaaaggcgaa

SEQ ID NO: 414364 - DNA, 15 bp, Homo sapiens
agacaaaaggcgaac

SEQ ID NO: 414365 - DNA, 15 bp, Homo sapiens
gacaaaaggcgaact

SEQ ID NO: 414366 - DNA, 15 bp, Homo sapiens
acaaaaggcgaactc

SEQ ID NO: 414367 - DNA, 15 bp, Homo sapiens
caaaaggcgaactca

SEQ ID NO: 414368 - DNA, 15 bp, Homo sapiens
aaaaggcgaactcaa

SEQ ID NO: 414369 - DNA, 15 bp, Homo sapiens
aaaggcgaactcaaa

SEQ ID NO: 414370 - DNA, 15 bp, Homo sapiens
aaggcgaactcaaag

SEQ ID NO: 414371 - DNA, 15 bp, Homo sapiens
aggcgaactcaaaga

SEQ ID NO: 414372 - DNA, 15 bp, Homo sapiens
ggcgaactcaaagaa

SEQ ID NO: 414373 - DNA, 15 bp, Homo sapiens
gcgaactcaaagaaa

SEQ ID NO: 414374 - DNA, 15 bp, Homo sapiens
cgaactcaaagaaac

SEQ ID NO: 414375 - DNA, 15 bp, Homo sapiens
gaactcaaagaaaca

SEQ ID NO: 414376 - DNA, 15 bp, Homo sapiens
aactcaaagaaacag

SEQ ID NO: 414377 - DNA, 15 bp, Homo sapiens
actcaaagaaacagt

SEQ ID NO: 414378 - DNA, 15 bp, Homo sapiens
ctcaaagaaacagtc

SEQ ID NO: 414379 - DNA, 15 bp, Homo sapiens
tcaaagaaacagtcc

SEQ ID NO: 414380 - DNA, 15 bp, Homo sapiens
caaagaaacagtcct

SEQ ID NO: 414381 - DNA, 15 bp, Homo sapiens
aaagaaacagtcctg

SEQ ID NO: 414382 - DNA, 15 bp, Homo sapiens
aagaaacagtcctga

SEQ ID NO: 414383 - DNA, 15 bp, Homo sapiens
agaaacagtcctgat

SEQ ID NO: 414384 - DNA, 15 bp, Homo sapiens
gaaacagtcctgatg

SEQ ID NO: 414385 - DNA, 15 bp, Homo sapiens
aaacagtcctgatgt

SEQ ID NO: 414386 - DNA, 15 bp, Homo sapiens
aacagtcctgatgta

SEQ ID NO: 414387 - DNA, 15 bp, Homo sapiens
acagtcctgatgtaa

SEQ ID NO: 414388 - DNA, 15 bp, Homo sapiens
cagtcctgatgtaat

SEQ ID NO: 414389 - DNA, 15 bp, Homo sapiens
agtcctgatgtaatt

SEQ ID NO: 414390 - DNA, 15 bp, Homo sapiens
gtcctgatgtaattc

SEQ ID NO: 414391 - DNA, 15 bp, Homo sapiens
tcctgatgtaattct

SEQ ID NO: 414392 - DNA, 15 bp, Homo sapiens
cctgatgtaattctc

SEQ ID NO: 414393 - DNA, 15 bp, Homo sapiens
ctgatgtaattctca

SEQ ID NO: 414394 - DNA, 15 bp, Homo sapiens
tgatgtaattctcag

SEQ ID NO: 414395 - DNA, 15 bp, Homo sapiens
gatgtaattctcagt

SEQ ID NO: 414396 - DNA, 15 bp, Homo sapiens
atgtaattctcagtc

SEQ ID NO: 414397 - DNA, 15 bp, Homo sapiens
tgtaattctcagtct

SEQ ID NO: 414398 - DNA, 15 bp, Homo sapiens
gtaattctcagtctg

SEQ ID NO: 414399 - DNA, 15 bp, Homo sapiens
taattctcagtctga

SEQ ID NO: 414400 - DNA, 15 bp, Homo sapiens
aattctcagtctgaa

SEQ ID NO: 414401 - DNA, 15 bp, Homo sapiens
attctcagtctgaag

SEQ ID NO: 414402 - DNA, 15 bp, Homo sapiens
ttctcagtctgaagt

SEQ ID NO: 414403 - DNA, 15 bp, Homo sapiens
tctcagtctgaagtt

SEQ ID NO: 414404 - DNA, 15 bp, Homo sapiens
ctcagtctgaagttc

SEQ ID NO: 414405 - DNA, 15 bp, Homo sapiens
tcagtctgaagttct

SEQ ID NO: 414406 - DNA, 15 bp, Homo sapiens
cagtctgaagttctc

SEQ ID NO: 414407 - DNA, 15 bp, Homo sapiens
agtctgaagttctcc

SEQ ID NO: 414408 - DNA, 15 bp, Homo sapiens
gtctgaagttctcca

SEQ ID NO: 414409 - DNA, 15 bp, Homo sapiens
tctgaagttctccat

SEQ ID NO: 414410 - DNA, 15 bp, Homo sapiens
ctgaagttctccata

SEQ ID NO: 414411 - DNA, 15 bp, Homo sapiens
tgaagttctccatat

SEQ ID NO: 414412 - DNA, 15 bp, Homo sapiens
gaagttctccatata

SEQ ID NO: 414413 - DNA, 15 bp, Homo sapiens
aagttctccatatat

SEQ ID NO: 414414 - DNA, 15 bp, Homo sapiens
agttctccatatatg

SEQ ID NO: 414415 - DNA, 15 bp, Homo sapiens
gttctccatatatgt

SEQ ID NO: 414416 - DNA, 15 bp, Homo sapiens
ttctccatatatgtg

SEQ ID NO: 414417 - DNA, 15 bp, Homo sapiens
tctccatatatgtgt

SEQ ID NO: 414418 - DNA, 15 bp, Homo sapiens
ctccatatatgtgta

SEQ ID NO: 414419 - DNA, 15 bp, Homo sapiens
tccatatatgtgtat

SEQ ID NO: 414420 - DNA, 15 bp, Homo sapiens
ccatatatgtgtatt

SEQ ID NO: 414421 - DNA, 15 bp, Homo sapiens
catatatgtgtattt

SEQ ID NO: 414422 - DNA, 15 bp, Homo sapiens
atatatgtgtatttt

SEQ ID NO: 414423 - DNA, 15 bp, Homo sapiens
tatatgtgtattttt

SEQ ID NO: 414424 - DNA, 15 bp, Homo sapiens
atatgtgtatttttg

SEQ ID NO: 414425 - DNA, 15 bp, Homo sapiens
tatgtgtatttttgt

SEQ ID NO: 414426 - DNA, 15 bp, Homo sapiens
atgtgtatttttgtg

SEQ ID NO: 414427 - DNA, 15 bp, Homo sapiens
tgtgtatttttgtgt

SEQ ID NO: 414428 - DNA, 15 bp, Homo sapiens
gtgtatttttgtgtt

SEQ ID NO: 414429 - DNA, 15 bp, Homo sapiens
tgtatttttgtgtta

SEQ ID NO: 414430 - DNA, 15 bp, Homo sapiens
gtatttttgtgttag

SEQ ID NO: 414431 - DNA, 15 bp, Homo sapiens
tatttttgtgttagg

SEQ ID NO: 414432 - DNA, 15 bp, Homo sapiens
atttttgtgttaggc

SEQ ID NO: 414433 - DNA, 15 bp, Homo sapiens
tttttgtgttaggca

SEQ ID NO: 414434 - DNA, 15 bp, Homo sapiens
ttttgtgttaggcag

SEQ ID NO: 414435 - DNA, 15 bp, Homo sapiens
tttgtgttaggcagt

SEQ ID NO: 414436 - DNA, 15 bp, Homo sapiens
ttgtgttaggcagtt

SEQ ID NO: 414437 - DNA, 15 bp, Homo sapiens
tgtgttaggcagttt

SEQ ID NO: 414438 - DNA, 15 bp, Homo sapiens
gtgttaggcagtttt

SEQ ID NO: 414439 - DNA, 15 bp, Homo sapiens
tgttaggcagtttta

SEQ ID NO: 414440 - DNA, 15 bp, Homo sapiens
gttaggcagttttat

SEQ ID NO: 414441 - DNA, 15 bp, Homo sapiens
ttaggcagttttata

SEQ ID NO: 414442 - DNA, 15 bp, Homo sapiens
taggcagttttataa

SEQ ID NO: 414443 - DNA, 15 bp, Homo sapiens
aggcagttttataaa

SEQ ID NO: 414444 - DNA, 15 bp, Homo sapiens
ggcagttttataaaa

SEQ ID NO: 414445 - DNA, 15 bp, Homo sapiens
gcagttttataaaaa

SEQ ID NO: 414446 - DNA, 15 bp, Homo sapiens
cagttttataaaaac

SEQ ID NO: 414447 - DNA, 15 bp, Homo sapiens
agttttataaaaacc

SEQ ID NO: 414448 - DNA, 15 bp, Homo sapiens
gttttataaaaacct

SEQ ID NO: 414449 - DNA, 15 bp, Homo sapiens
ttttataaaaaccta

SEQ ID NO: 414450 - DNA, 15 bp, Homo sapiens
tttataaaaacctat

SEQ ID NO: 414451 - DNA, 15 bp, Homo sapiens
ttataaaaacctatg

SEQ ID NO: 414452 - DNA, 15 bp, Homo sapiens
tataaaaacctatgt

SEQ ID NO: 414453 - DNA, 15 bp, Homo sapiens
ataaaaacctatgtg

SEQ ID NO: 414454 - DNA, 15 bp, Homo sapiens
taaaaacctatgtga

SEQ ID NO: 414455 - DNA, 15 bp, Homo sapiens
aaaaacctatgtgaa

SEQ ID NO: 414456 - DNA, 15 bp, Homo sapiens
aaaacctatgtgaaa

SEQ ID NO: 414457 - DNA, 15 bp, Homo sapiens
aaacctatgtgaaag

SEQ ID NO: 414458 - DNA, 15 bp, Homo sapiens
aacctatgtgaaagt

SEQ ID NO: 414459 - DNA, 15 bp, Homo sapiens
acctatgtgaaagtt

SEQ ID NO: 414460 - DNA, 15 bp, Homo sapiens
cctatgtgaaagttg

SEQ ID NO: 414461 - DNA, 15 bp, Homo sapiens
ctatgtgaaagttga

SEQ ID NO: 414462 - DNA, 15 bp, Homo sapiens
tatgtgaaagttgat

SEQ ID NO: 414463 - DNA, 15 bp, Homo sapiens
atgtgaaagttgatc

SEQ ID NO: 414464 - DNA, 15 bp, Homo sapiens
tgtgaaagttgatct

SEQ ID NO: 414465 - DNA, 15 bp, Homo sapiens
gtgaaagttgatctc

SEQ ID NO: 414466 - DNA, 15 bp, Homo sapiens
tgaaagttgatctct

SEQ ID NO: 414467 - DNA, 15 bp, Homo sapiens
gaaagttgatctctt

SEQ ID NO: 414468 - DNA, 15 bp, Homo sapiens
aaagttgatctcttt

SEQ ID NO: 414469 - DNA, 15 bp, Homo sapiens
aagttgatctctttg

SEQ ID NO: 414470 - DNA, 15 bp, Homo sapiens
agttgatctctttgg

SEQ ID NO: 414471 - DNA, 15 bp, Homo sapiens
gttgatctctttggc

SEQ ID NO: 414472 - DNA, 15 bp, Homo sapiens
ttgatctctttggcc

SEQ ID NO: 414473 - DNA, 15 bp, Homo sapiens
tgatctctttggccg

SEQ ID NO: 414474 - DNA, 15 bp, Homo sapiens
gatctctttggccgt

SEQ ID NO: 414475 - DNA, 15 bp, Homo sapiens
atctctttggccgta

SEQ ID NO: 414476 - DNA, 15 bp, Homo sapiens
tctctttggccgtat

SEQ ID NO: 414477 - DNA, 15 bp, Homo sapiens
ctctttggccgtatt

SEQ ID NO: 414478 - DNA, 15 bp, Homo sapiens
tctttggccgtattt

SEQ ID NO: 414479 - DNA, 15 bp, Homo sapiens
ctttggccgtatttt

SEQ ID NO: 414480 - DNA, 15 bp, Homo sapiens
tttggccgtatttta

SEQ ID NO: 414481 - DNA, 15 bp, Homo sapiens
ttggccgtattttac

SEQ ID NO: 414482 - DNA, 15 bp, Homo sapiens
tggccgtattttact

SEQ ID NO: 414483 - DNA, 15 bp, Homo sapiens
ggccgtattttactt

SEQ ID NO: 414484 - DNA, 15 bp, Homo sapiens
gccgtattttacttc

SEQ ID NO: 414485 - DNA, 15 bp, Homo sapiens
ccgtattttacttct

SEQ ID NO: 414486 - DNA, 15 bp, Homo sapiens
cgtattttacttcta

SEQ ID NO: 414487 - DNA, 15 bp, Homo sapiens
gtattttacttctag

SEQ ID NO: 414488 - DNA, 15 bp, Homo sapiens
tattttacttctagg

SEQ ID NO: 414489 - DNA, 15 bp, Homo sapiens
attttacttctagga

SEQ ID NO: 414490 - DNA, 15 bp, Homo sapiens
ttttacttctaggaa

SEQ ID NO: 414491 - DNA, 15 bp, Homo sapiens
tttacttctaggaag

SEQ ID NO: 414492 - DNA, 15 bp, Homo sapiens
ttacttctaggaagt

SEQ ID NO: 414493 - DNA, 15 bp, Homo sapiens
tacttctaggaagtt

SEQ ID NO: 414494 - DNA, 15 bp, Homo sapiens
acttctaggaagttg

SEQ ID NO: 414495 - DNA, 15 bp, Homo sapiens
cttctaggaagttgt

SEQ ID NO: 414496 - DNA, 15 bp, Homo sapiens
ttctaggaagttgtc

SEQ ID NO: 414497 - DNA, 15 bp, Homo sapiens
tctaggaagttgtcg

SEQ ID NO: 414498 - DNA, 15 bp, Homo sapiens
ctaggaagttgtcgt

SEQ ID NO: 414499 - DNA, 15 bp, Homo sapiens
taggaagttgtcgta

SEQ ID NO: 414500 - DNA, 15 bp, Homo sapiens
aggaagttgtcgtac

SEQ ID NO: 414501 - DNA, 15 bp, Homo sapiens
ggaagttgtcgtaca

SEQ ID NO: 414502 - DNA, 15 bp, Homo sapiens
gaagttgtcgtacat

SEQ ID NO: 414503 - DNA, 15 bp, Homo sapiens
aagttgtcgtacatg

SEQ ID NO: 414504 - DNA, 15 bp, Homo sapiens
agttgtcgtacatga

SEQ ID NO: 414505 - DNA, 15 bp, Homo sapiens
gttgtcgtacatgaa

SEQ ID NO: 414506 - DNA, 15 bp, Homo sapiens
ttgtcgtacatgaat

SEQ ID NO: 414507 - DNA, 15 bp, Homo sapiens
tgtcgtacatgaatg

SEQ ID NO: 414508 - DNA, 15 bp, Homo sapiens
gtcgtacatgaatgt

SEQ ID NO: 414509 - DNA, 15 bp, Homo sapiens
tcgtacatgaatgta

SEQ ID NO: 414510 - DNA, 15 bp, Homo sapiens
cgtacatgaatgtat

SEQ ID NO: 414511 - DNA, 15 bp, Homo sapiens
gtacatgaatgtatt

SEQ ID NO: 414512 - DNA, 15 bp, Homo sapiens
tacatgaatgtattc

SEQ ID NO: 414513 - DNA, 15 bp, Homo sapiens
acatgaatgtattct

SEQ ID NO: 414514 - DNA, 15 bp, Homo sapiens
catgaatgtattctt

SEQ ID NO: 414515 - DNA, 15 bp, Homo sapiens
atgaatgtattcttt

SEQ ID NO: 414516 - DNA, 15 bp, Homo sapiens
tgaatgtattctttc

SEQ ID NO: 414517 - DNA, 15 bp, Homo sapiens
gaatgtattctttcc

SEQ ID NO: 414518 - DNA, 15 bp, Homo sapiens
aatgtattctttcca

SEQ ID NO: 414519 - DNA, 15 bp, Homo sapiens
atgtattctttccaa

SEQ ID NO: 414520 - DNA, 15 bp, Homo sapiens
tgtattctttccaaa

SEQ ID NO: 414521 - DNA, 15 bp, Homo sapiens
gtattctttccaaag

SEQ ID NO: 414522 - DNA, 15 bp, Homo sapiens
tattctttccaaagt

SEQ ID NO: 414523 - DNA, 15 bp, Homo sapiens
attctttccaaagtg

SEQ ID NO: 414524 - DNA, 15 bp, Homo sapiens
ttctttccaaagtgt

SEQ ID NO: 414525 - DNA, 15 bp, Homo sapiens
tctttccaaagtgtt

SEQ ID NO: 414526 - DNA, 15 bp, Homo sapiens
ctttccaaagtgtta

SEQ ID NO: 414527 - DNA, 15 bp, Homo sapiens
tttccaaagtgttaa

SEQ ID NO: 414528 - DNA, 15 bp, Homo sapiens
ttccaaagtgttaat

SEQ ID NO: 414529 - DNA, 15 bp, Homo sapiens
tccaaagtgttaata

SEQ ID NO: 414530 - DNA, 15 bp, Homo sapiens
ccaaagtgttaataa

SEQ ID NO: 414531 - DNA, 15 bp, Homo sapiens
caaagtgttaataaa

SEQ ID NO: 414532 - DNA, 15 bp, Homo sapiens
aaagtgttaataaaa

SEQ ID NO: 414533 - DNA, 15 bp, Homo sapiens
aagtgttaataaaat

SEQ ID NO: 414534 - DNA, 15 bp, Homo sapiens
agtgttaataaaatc

SEQ ID NO: 414535 - DNA, 15 bp, Homo sapiens
gtgttaataaaatcc

SEQ ID NO: 414536 - DNA, 15 bp, Homo sapiens
tgttaataaaatcct

SEQ ID NO: 414537 - DNA, 15 bp, Homo sapiens
gttaataaaatcctt

SEQ ID NO: 414538 - DNA, 15 bp, Homo sapiens
ttaataaaatccttt

SEQ ID NO: 414539 - DNA, 15 bp, Homo sapiens
taataaaatcctttg

SEQ ID NO: 414540 - DNA, 15 bp, Homo sapiens
aataaaatcctttgc

SEQ ID NO: 414541 - DNA, 15 bp, Homo sapiens
ataaaatcctttgcg

SEQ ID NO: 414542 - DNA, 15 bp, Homo sapiens
taaaatcctttgcgt

SEQ ID NO: 414543 - DNA, 15 bp, Homo sapiens
aaaatcctttgcgta

SEQ ID NO: 414544 - DNA, 15 bp, Homo sapiens
aaatcctttgcgtat

SEQ ID NO: 414545 - DNA, 15 bp, Homo sapiens
aatcctttgcgtatt

SEQ ID NO: 414546 - DNA, 15 bp, Homo sapiens
atcctttgcgtattc

SEQ ID NO: 414547 - DNA, 15 bp, Homo sapiens
tcctttgcgtattct

SEQ ID NO: 414548 - DNA, 15 bp, Homo sapiens
cctttgcgtattctt

SEQ ID NO: 414549 - DNA, 15 bp, Homo sapiens
ctttgcgtattctta

SEQ ID NO: 414550 - DNA, 15 bp, Homo sapiens
tttgcgtattcttac

SEQ ID NO: 414551 - DNA, 15 bp, Homo sapiens
ttgcgtattcttaca

SEQ ID NO: 414552 - DNA, 15 bp, Homo sapiens
tgcgtattcttacaa

SEQ ID NO: 414553 - DNA, 15 bp, Homo sapiens
gcgtattcttacaaa

SEQ ID NO: 414554 - DNA, 15 bp, Homo sapiens
cgtattcttacaaaa

SEQ ID NO: 414555 - DNA, 15 bp, Homo sapiens
gtattcttacaaaat

SEQ ID NO: 414556 - DNA, 15 bp, Homo sapiens
tattcttacaaaatc

SEQ ID NO: 414557 - DNA, 15 bp, Homo sapiens
attcttacaaaatct

SEQ ID NO: 414558 - DNA, 15 bp, Homo sapiens
ttcttacaaaatctg

SEQ ID NO: 414559 - DNA, 15 bp, Homo sapiens
tcttacaaaatctgt

SEQ ID NO: 414560 - DNA, 15 bp, Homo sapiens
cttacaaaatctgtc

SEQ ID NO: 414561 - DNA, 15 bp, Homo sapiens
ttacaaaatctgtct

SEQ ID NO: 414562 - DNA, 15 bp, Homo sapiens
tacaaaatctgtctc

SEQ ID NO: 414563 - DNA, 15 bp, Homo sapiens
acaaaatctgtctca

SEQ ID NO: 414564 - DNA, 15 bp, Homo sapiens
caaaatctgtctcat

SEQ ID NO: 414565 - DNA, 15 bp, Homo sapiens
aaaatctgtctcata

SEQ ID NO: 414566 - DNA, 15 bp, Homo sapiens
aatctgtctcatata

SEQ ID NO: 414567 - DNA, 15 bp, Homo sapiens
atctgtctcatatat

SEQ ID NO: 414568 - DNA, 15 bp, Homo sapiens
tctgtctcatatatt

SEQ ID NO: 414569 - DNA, 15 bp, Homo sapiens
ctgtctcatatattg

SEQ ID NO: 414570 - DNA, 15 bp, Homo sapiens
tgtctcatatattga

SEQ ID NO: 414571 - DNA, 15 bp, Homo sapiens
gtctcatatattgag

SEQ ID NO: 414572 - DNA, 15 bp, Homo sapiens
tctcatatattgaga

SEQ ID NO: 414573 - DNA, 15 bp, Homo sapiens
ctcatatattgagat

SEQ ID NO: 414574 - DNA, 15 bp, Homo sapiens
tcatatattgagatg

SEQ ID NO: 414575 - DNA, 15 bp, Homo sapiens
catatattgagatgt

SEQ ID NO: 414576 - DNA, 15 bp, Homo sapiens
atatattgagatgtt

SEQ ID NO: 414577 - DNA, 15 bp, Homo sapiens
tatattgagatgttg

SEQ ID NO: 414578 - DNA, 15 bp, Homo sapiens
atattgagatgttgc

SEQ ID NO: 414579 - DNA, 15 bp, Homo sapiens
tattgagatgttgct

SEQ ID NO: 414580 - DNA, 15 bp, Homo sapiens
attgagatgttgctt

SEQ ID NO: 414581 - DNA, 15 bp, Homo sapiens
ttgagatgttgcttc

SEQ ID NO: 414582 - DNA, 15 bp, Homo sapiens
tgagatgttgcttca

SEQ ID NO: 414583 - DNA, 15 bp, Homo sapiens
gagatgttgcttcat

SEQ ID NO: 414584 - DNA, 15 bp, Homo sapiens
agatgttgcttcatt

SEQ ID NO: 414585 - DNA, 15 bp, Homo sapiens
gatgttgcttcattg

SEQ ID NO: 414586 - DNA, 15 bp, Homo sapiens
atgttgcttcattgg

SEQ ID NO: 414587 - DNA, 15 bp, Homo sapiens
tgttgcttcattggt

SEQ ID NO: 414588 - DNA, 15 bp, Homo sapiens
gttgcttcattggtt

SEQ ID NO: 414589 - DNA, 15 bp, Homo sapiens
ttgcttcattggttt

SEQ ID NO: 414590 - DNA, 15 bp, Homo sapiens
tgcttcattggttta

SEQ ID NO: 414591 - DNA, 15 bp, Homo sapiens
gcttcattggtttat

SEQ ID NO: 414592 - DNA, 15 bp, Homo sapiens
cttcattggtttatt

SEQ ID NO: 414593 - DNA, 15 bp, Homo sapiens
ttcattggtttattg

SEQ ID NO: 414594 - DNA, 15 bp, Homo sapiens
tcattggtttattgg

SEQ ID NO: 414595 - DNA, 15 bp, Homo sapiens
cattggtttattggc

SEQ ID NO: 414596 - DNA, 15 bp, Homo sapiens
attggtttattggca

SEQ ID NO: 414597 - DNA, 15 bp, Homo sapiens
ttggtttattggcag

SEQ ID NO: 414598 - DNA, 15 bp, Homo sapiens
tggtttattggcagg

SEQ ID NO: 414599 - DNA, 15 bp, Homo sapiens
ggtttattggcagga

SEQ ID NO: 414600 - DNA, 15 bp, Homo sapiens
gtttattggcaggaa

SEQ ID NO: 414601 - DNA, 15 bp, Homo sapiens
tttattggcaggaaa

SEQ ID NO: 414602 - DNA, 15 bp, Homo sapiens
ttattggcaggaaaa

SEQ ID NO: 414603 - DNA, 15 bp, Homo sapiens
tattggcaggaaaac

SEQ ID NO: 414604 - DNA, 15 bp, Homo sapiens
attggcaggaaaact

SEQ ID NO: 414605 - DNA, 15 bp, Homo sapiens
ttggcaggaaaactg

SEQ ID NO: 414606 - DNA, 15 bp, Homo sapiens
tggcaggaaaactgg

SEQ ID NO: 414607 - DNA, 15 bp, Homo sapiens
ggcaggaaaactgga

SEQ ID NO: 414608 - DNA, 15 bp, Homo sapiens
gcaggaaaactggaa

SEQ ID NO: 414609 - DNA, 15 bp, Homo sapiens
caggaaaactggaat

SEQ ID NO: 414610 - DNA, 15 bp, Homo sapiens
aggaaaactggaatt

SEQ ID NO: 414611 - DNA, 15 bp, Homo sapiens
ggaaaactggaatta

SEQ ID NO: 414612 - DNA, 15 bp, Homo sapiens
gaaaactggaattac

SEQ ID NO: 414613 - DNA, 15 bp, Homo sapiens
aaaactggaattacg

SEQ ID NO: 414614 - DNA, 15 bp, Homo sapiens
aaactggaattacgg

SEQ ID NO: 414615 - DNA, 15 bp, Homo sapiens
aactggaattacgga

SEQ ID NO: 414616 - DNA, 15 bp, Homo sapiens
actggaattacggaa

SEQ ID NO: 414617 - DNA, 15 bp, Homo sapiens
ctggaattacggaaa

SEQ ID NO: 414618 - DNA, 15 bp, Homo sapiens
tggaattacggaaaa

SEQ ID NO: 414619 - DNA, 15 bp, Homo sapiens
ggaattacggaaaag

SEQ ID NO: 414620 - DNA, 15 bp, Homo sapiens
gaattacggaaaagt

SEQ ID NO: 414621 - DNA, 15 bp, Homo sapiens
aattacggaaaagta

SEQ ID NO: 414622 - DNA, 15 bp, Homo sapiens
attacggaaaagtat

SEQ ID NO: 414623 - DNA, 15 bp, Homo sapiens
ttacggaaaagtatc

SEQ ID NO: 414624 - DNA, 15 bp, Homo sapiens
tacggaaaagtatca

SEQ ID NO: 414625 - DNA, 15 bp, Homo sapiens
acggaaaagtatcag

SEQ ID NO: 414626 - DNA, 15 bp, Homo sapiens
cggaaaagtatcagt

SEQ ID NO: 414627 - DNA, 15 bp, Homo sapiens
ggaaaagtatcagta

SEQ ID NO: 414628 - DNA, 15 bp, Homo sapiens
gaaaagtatcagtac

SEQ ID NO: 414629 - DNA, 15 bp, Homo sapiens
aaaagtatcagtacc

SEQ ID NO: 414630 - DNA, 15 bp, Homo sapiens
aaagtatcagtacct

SEQ ID NO: 414631 - DNA, 15 bp, Homo sapiens
aagtatcagtacctc

SEQ ID NO: 414632 - DNA, 15 bp, Homo sapiens
agtatcagtacctca

SEQ ID NO: 414633 - DNA, 15 bp, Homo sapiens
gtatcagtacctcac

SEQ ID NO: 414634 - DNA, 15 bp, Homo sapiens
tatcagtacctcaca

SEQ ID NO: 414635 - DNA, 15 bp, Homo sapiens
atcagtacctcacac

SEQ ID NO: 414636 - DNA, 15 bp, Homo sapiens
tcagtacctcacacg

SEQ ID NO: 414637 - DNA, 15 bp, Homo sapiens
cagtacctcacacgt

SEQ ID NO: 414638 - DNA, 15 bp, Homo sapiens
agtacctcacacgtc

SEQ ID NO: 414639 - DNA, 15 bp, Homo sapiens
gtacctcacacgtct

SEQ ID NO: 414640 - DNA, 15 bp, Homo sapiens
tacctcacacgtctc

SEQ ID NO: 414641 - DNA, 15 bp, Homo sapiens
acctcacacgtctca

SEQ ID NO: 414642 - DNA, 15 bp, Homo sapiens
cctcacacgtctcaa

SEQ ID NO: 414643 - DNA, 15 bp, Homo sapiens
ctcacacgtctcaaa

SEQ ID NO: 414644 - DNA, 15 bp, Homo sapiens
tcacacgtctcaaat

SEQ ID NO: 414645 - DNA, 15 bp, Homo sapiens
cacacgtctcaaata

SEQ ID NO: 414646 - DNA, 15 bp, Homo sapiens
acacgtctcaaatac

SEQ ID NO: 414647 - DNA, 15 bp, Homo sapiens
cacgtctcaaataca

SEQ ID NO: 414648 - DNA, 15 bp, Homo sapiens
acgtctcaaatacaa

SEQ ID NO: 414649 - DNA, 15 bp, Homo sapiens
cgtctcaaatacaac

SEQ ID NO: 414650 - DNA, 15 bp, Homo sapiens
gtctcaaatacaact

SEQ ID NO: 414651 - DNA, 15 bp, Homo sapiens
tctcaaatacaacta

SEQ ID NO: 414652 - DNA, 15 bp, Homo sapiens
ctcaaatacaactaa

SEQ ID NO: 414653 - DNA, 15 bp, Homo sapiens
tcaaatacaactaac

SEQ ID NO: 414654 - DNA, 15 bp, Homo sapiens
caaatacaactaacc

SEQ ID NO: 414655 - DNA, 15 bp, Homo sapiens
aaatacaactaacca

SEQ ID NO: 414656 - DNA, 15 bp, Homo sapiens
aatacaactaaccac

SEQ ID NO: 414657 - DNA, 15 bp, Homo sapiens
atacaactaaccacc

SEQ ID NO: 414658 - DNA, 15 bp, Homo sapiens
tacaactaaccacct

SEQ ID NO: 414659 - DNA, 15 bp, Homo sapiens
acaactaaccacctt

SEQ ID NO: 414660 - DNA, 15 bp, Homo sapiens
caactaaccaccttc

SEQ ID NO: 414661 - DNA, 15 bp, Homo sapiens
aactaaccaccttcc

SEQ ID NO: 414662 - DNA, 15 bp, Homo sapiens
actaaccaccttccc

SEQ ID NO: 414663 - DNA, 15 bp, Homo sapiens
ctaaccaccttcccc

SEQ ID NO: 414664 - DNA, 15 bp, Homo sapiens
taaccaccttccccc

SEQ ID NO: 414665 - DNA, 15 bp, Homo sapiens
aaccaccttccccca

SEQ ID NO: 414666 - DNA, 15 bp, Homo sapiens
accaccttcccccaa

SEQ ID NO: 414667 - DNA, 15 bp, Homo sapiens
ccaccttcccccaac

SEQ ID NO: 414668 - DNA, 15 bp, Homo sapiens
caccttcccccaaca

SEQ ID NO: 414669 - DNA, 15 bp, Homo sapiens
accttcccccaacaa

SEQ ID NO: 414670 - DNA, 15 bp, Homo sapiens
ccttcccccaacaaa

SEQ ID NO: 414671 - DNA, 15 bp, Homo sapiens
cttcccccaacaaag

SEQ ID NO: 414672 - DNA, 15 bp, Homo sapiens
ttcccccaacaaagc

SEQ ID NO: 414673 - DNA, 15 bp, Homo sapiens
tcccccaacaaagca

SEQ ID NO: 414674 - DNA, 15 bp, Homo sapiens
cccccaacaaagcaa

SEQ ID NO: 414675 - DNA, 15 bp, Homo sapiens
ccccaacaaagcaat

SEQ ID NO: 414676 - DNA, 15 bp, Homo sapiens
cccaacaaagcaata

SEQ ID NO: 414677 - DNA, 15 bp, Homo sapiens
ccaacaaagcaataa

SEQ ID NO: 414678 - DNA, 15 bp, Homo sapiens
caacaaagcaataat

SEQ ID NO: 414679 - DNA, 15 bp, Homo sapiens
aacaaagcaataatg

SEQ ID NO: 414680 - DNA, 15 bp, Homo sapiens
acaaagcaataatgc

SEQ ID NO: 414681 - DNA, 15 bp, Homo sapiens
caaagcaataatgcc

SEQ ID NO: 414682 - DNA, 15 bp, Homo sapiens
aaagcaataatgcca

SEQ ID NO: 414683 - DNA, 15 bp, Homo sapiens
aagcaataatgccat

SEQ ID NO: 414684 - DNA, 15 bp, Homo sapiens
agcaataatgccatt

SEQ ID NO: 414685 - DNA, 15 bp, Homo sapiens
gcaataatgccattt

SEQ ID NO: 414686 - DNA, 15 bp, Homo sapiens
caataatgccatttc

SEQ ID NO: 414687 - DNA, 15 bp, Homo sapiens
aataatgccatttct

SEQ ID NO: 414688 - DNA, 15 bp, Homo sapiens
ataatgccatttcta

SEQ ID NO: 414689 - DNA, 15 bp, Homo sapiens
taatgccatttctag

SEQ ID NO: 414690 - DNA, 15 bp, Homo sapiens
aatgccatttctagg

SEQ ID NO: 414691 - DNA, 15 bp, Homo sapiens
atgccatttctaggg

SEQ ID NO: 414692 - DNA, 15 bp, Homo sapiens
tgccatttctaggga

SEQ ID NO: 414693 - DNA, 15 bp, Homo sapiens
gccatttctagggaa

SEQ ID NO: 414694 - DNA, 15 bp, Homo sapiens
ccatttctagggaaa

SEQ ID NO: 414695 - DNA, 15 bp, Homo sapiens
catttctagggaaag

SEQ ID NO: 414696 - DNA, 15 bp, Homo sapiens
atttctagggaaaga

SEQ ID NO: 414697 - DNA, 15 bp, Homo sapiens
tttctagggaaagac

SEQ ID NO: 414698 - DNA, 15 bp, Homo sapiens
ttctagggaaagacc

SEQ ID NO: 414699 - DNA, 15 bp, Homo sapiens
tctagggaaagacca

SEQ ID NO: 414700 - DNA, 15 bp, Homo sapiens
ctagggaaagaccaa

SEQ ID NO: 414701 - DNA, 15 bp, Homo sapiens
tagggaaagaccaag

SEQ ID NO: 414702 - DNA, 15 bp, Homo sapiens
agggaaagaccaagg

SEQ ID NO: 414703 - DNA, 15 bp, Homo sapiens
gggaaagaccaaggc

SEQ ID NO: 414704 - DNA, 15 bp, Homo sapiens
ggaaagaccaaggcc

SEQ ID NO: 414705 - DNA, 15 bp, Homo sapiens
gaaagaccaaggcct

SEQ ID NO: 414706 - DNA, 15 bp, Homo sapiens
aaagaccaaggccta

SEQ ID NO: 414707 - DNA, 15 bp, Homo sapiens
aagaccaaggcctac

SEQ ID NO: 414708 - DNA, 15 bp, Homo sapiens
agaccaaggcctact

SEQ ID NO: 414709 - DNA, 15 bp, Homo sapiens
gaccaaggcctactg

SEQ ID NO: 414710 - DNA, 15 bp, Homo sapiens
accaaggcctactgc

SEQ ID NO: 414711 - DNA, 15 bp, Homo sapiens
ccaaggcctactgct

SEQ ID NO: 414712 - DNA, 15 bp, Homo sapiens
caaggcctactgcta

SEQ ID NO: 414713 - DNA, 15 bp, Homo sapiens
aaggcctactgctat

SEQ ID NO: 414714 - DNA, 15 bp, Homo sapiens
aggcctactgctata

SEQ ID NO: 414715 - DNA, 15 bp, Homo sapiens
ggcctactgctataa

SEQ ID NO: 414716 - DNA, 15 bp, Homo sapiens
gcctactgctataat

SEQ ID NO: 414717 - DNA, 15 bp, Homo sapiens
cctactgctataatg

SEQ ID NO: 414718 - DNA, 15 bp, Homo sapiens
ctactgctataatgc

SEQ ID NO: 414719 - DNA, 15 bp, Homo sapiens
tactgctataatgca

SEQ ID NO: 414720 - DNA, 15 bp, Homo sapiens
actgctataatgcag

SEQ ID NO: 414721 - DNA, 15 bp, Homo sapiens
ctgctataatgcaga

SEQ ID NO: 414722 - DNA, 15 bp, Homo sapiens
tgctataatgcagaa

SEQ ID NO: 414723 - DNA, 15 bp, Homo sapiens
gctataatgcagaag

SEQ ID NO: 414724 - DNA, 15 bp, Homo sapiens
ctataatgcagaagc

SEQ ID NO: 414725 - DNA, 15 bp, Homo sapiens
tataatgcagaagcc

SEQ ID NO: 414726 - DNA, 15 bp, Homo sapiens
ataatgcagaagcca

SEQ ID NO: 414727 - DNA, 15 bp, Homo sapiens
taatgcagaagccac

SEQ ID NO: 414728 - DNA, 15 bp, Homo sapiens
aatgcagaagccaca

SEQ ID NO: 414729 - DNA, 15 bp, Homo sapiens
atgcagaagccacag

SEQ ID NO: 414730 - DNA, 15 bp, Homo sapiens
tgcagaagccacagg

SEQ ID NO: 414731 - DNA, 15 bp, Homo sapiens
gcagaagccacagga

SEQ ID NO: 414732 - DNA, 15 bp, Homo sapiens
cagaagccacaggat

SEQ ID NO: 414733 - DNA, 15 bp, Homo sapiens
agaagccacaggatc

SEQ ID NO: 414734 - DNA, 15 bp, Homo sapiens
gaagccacaggatcc

SEQ ID NO: 414735 - DNA, 15 bp, Homo sapiens
aagccacaggatccc

SEQ ID NO: 414736 - DNA, 15 bp, Homo sapiens
agccacaggatccct

SEQ ID NO: 414737 - DNA, 15 bp, Homo sapiens
gccacaggatccctt

SEQ ID NO: 414738 - DNA, 15 bp, Homo sapiens
ccacaggatcccttc

SEQ ID NO: 414739 - DNA, 15 bp, Homo sapiens
cacaggatcccttca

SEQ ID NO: 414740 - DNA, 15 bp, Homo sapiens
acaggatcccttcag

SEQ ID NO: 414741 - DNA, 15 bp, Homo sapiens
caggatcccttcaga

SEQ ID NO: 414742 - DNA, 15 bp, Homo sapiens
aggatcccttcagaa

SEQ ID NO: 414743 - DNA, 15 bp, Homo sapiens
ggatcccttcagaag

SEQ ID NO: 414744 - DNA, 15 bp, Homo sapiens
gatcccttcagaagc

SEQ ID NO: 414745 - DNA, 15 bp, Homo sapiens
atcccttcagaagct

SEQ ID NO: 414746 - DNA, 15 bp, Homo sapiens
tcccttcagaagctg

SEQ ID NO: 414747 - DNA, 15 bp, Homo sapiens
cccttcagaagctga

SEQ ID NO: 414748 - DNA, 15 bp, Homo sapiens
ccttcagaagctgag

SEQ ID NO: 414749 - DNA, 15 bp, Homo sapiens
cttcagaagctgagt

SEQ ID NO: 414750 - DNA, 15 bp, Homo sapiens
ttcagaagctgagta

SEQ ID NO: 414751 - DNA, 15 bp, Homo sapiens
tcagaagctgagtaa

SEQ ID NO: 414752 - DNA, 15 bp, Homo sapiens
cagaagctgagtaac

SEQ ID NO: 414753 - DNA, 15 bp, Homo sapiens
agaagctgagtaaca

SEQ ID NO: 414754 - DNA, 15 bp, Homo sapiens
gaagctgagtaacag

SEQ ID NO: 414755 - DNA, 15 bp, Homo sapiens
aagctgagtaacagc

SEQ ID NO: 414756 - DNA, 15 bp, Homo sapiens
agctgagtaacagcc

SEQ ID NO: 414757 - DNA, 15 bp, Homo sapiens
gctgagtaacagcca

SEQ ID NO: 414758 - DNA, 15 bp, Homo sapiens
ctgagtaacagccat

SEQ ID NO: 414759 - DNA, 15 bp, Homo sapiens
tgagtaacagccatt

SEQ ID NO: 414760 - DNA, 15 bp, Homo sapiens
gagtaacagccattc

SEQ ID NO: 414761 - DNA, 15 bp, Homo sapiens
agtaacagccattct

SEQ ID NO: 414762 - DNA, 15 bp, Homo sapiens
gtaacagccattcta

SEQ ID NO: 414763 - DNA, 15 bp, Homo sapiens
taacagccattctac

SEQ ID NO: 414764 - DNA, 15 bp, Homo sapiens
aacagccattctaca

SEQ ID NO: 414765 - DNA, 15 bp, Homo sapiens
acagccattctacac

SEQ ID NO: 414766 - DNA, 15 bp, Homo sapiens
cagccattctacacg

SEQ ID NO: 414767 - DNA, 15 bp, Homo sapiens
agccattctacacgc

SEQ ID NO: 414768 - DNA, 15 bp, Homo sapiens
gccattctacacgca

SEQ ID NO: 414769 - DNA, 15 bp, Homo sapiens
ccattctacacgcag

SEQ ID NO: 414770 - DNA, 15 bp, Homo sapiens
cattctacacgcaga

SEQ ID NO: 414771 - DNA, 15 bp, Homo sapiens
attctacacgcagag

SEQ ID NO: 414772 - DNA, 15 bp, Homo sapiens
ttctacacgcagagg

SEQ ID NO: 414773 - DNA, 15 bp, Homo sapiens
tctacacgcagaggt

SEQ ID NO: 414774 - DNA, 15 bp, Homo sapiens
ctacacgcagaggta

SEQ ID NO: 414775 - DNA, 15 bp, Homo sapiens
tacacgcagaggtag

SEQ ID NO: 414776 - DNA, 15 bp, Homo sapiens
acacgcagaggtaga

SEQ ID NO: 414777 - DNA, 15 bp, Homo sapiens
cacgcagaggtagag

SEQ ID NO: 414778 - DNA, 15 bp, Homo sapiens
acgcagaggtagagt

SEQ ID NO: 414779 - DNA, 15 bp, Homo sapiens
cgcagaggtagagtc

SEQ ID NO: 414780 - DNA, 15 bp, Homo sapiens
gcagaggtagagtcc

SEQ ID NO: 414781 - DNA, 15 bp, Homo sapiens
cagaggtagagtccc

SEQ ID NO: 414782 - DNA, 15 bp, Homo sapiens
agaggtagagtccct

SEQ ID NO: 414783 - DNA, 15 bp, Homo sapiens
gaggtagagtccctt

SEQ ID NO: 414784 - DNA, 15 bp, Homo sapiens
aggtagagtcccttt

SEQ ID NO: 414785 - DNA, 15 bp, Homo sapiens
ggtagagtcccttta

SEQ ID NO: 414786 - DNA, 15 bp, Homo sapiens
gtagagtccctttac

SEQ ID NO: 414787 - DNA, 15 bp, Homo sapiens
tagagtccctttacc

SEQ ID NO: 414788 - DNA, 15 bp, Homo sapiens
agagtccctttaccc

SEQ ID NO: 414789 - DNA, 15 bp, Homo sapiens
gagtccctttaccct

SEQ ID NO: 414790 - DNA, 15 bp, Homo sapiens
agtccctttaccctc

SEQ ID NO: 414791 - DNA, 15 bp, Homo sapiens
gtccctttaccctca

SEQ ID NO: 414792 - DNA, 15 bp, Homo sapiens
tccctttaccctcaa

SEQ ID NO: 414793 - DNA, 15 bp, Homo sapiens
ccctttaccctcaat

SEQ ID NO: 414794 - DNA, 15 bp, Homo sapiens
cctttaccctcaatt

SEQ ID NO: 414795 - DNA, 15 bp, Homo sapiens
ctttaccctcaattc

SEQ ID NO: 414796 - DNA, 15 bp, Homo sapiens
tttaccctcaattct

SEQ ID NO: 414797 - DNA, 15 bp, Homo sapiens
ttaccctcaattctc

SEQ ID NO: 414798 - DNA, 15 bp, Homo sapiens
taccctcaattctca

SEQ ID NO: 414799 - DNA, 15 bp, Homo sapiens
accctcaattctcag

SEQ ID NO: 414800 - DNA, 15 bp, Homo sapiens
ccctcaattctcagt

SEQ ID NO: 414801 - DNA, 15 bp, Homo sapiens
cctcaattctcagtc

SEQ ID NO: 414802 - DNA, 15 bp, Homo sapiens
ctcaattctcagtcc

SEQ ID NO: 414803 - DNA, 15 bp, Homo sapiens
tcaattctcagtcct

SEQ ID NO: 414804 - DNA, 15 bp, Homo sapiens
caattctcagtcctg

SEQ ID NO: 414805 - DNA, 15 bp, Homo sapiens
aattctcagtcctgt

SEQ ID NO: 414806 - DNA, 15 bp, Homo sapiens
attctcagtcctgtc

SEQ ID NO: 414807 - DNA, 15 bp, Homo sapiens
ttctcagtcctgtct

SEQ ID NO: 414808 - DNA, 15 bp, Homo sapiens
tctcagtcctgtctc

SEQ ID NO: 414809 - DNA, 15 bp, Homo sapiens
ctcagtcctgtctct

SEQ ID NO: 414810 - DNA, 15 bp, Homo sapiens
tcagtcctgtctctt

SEQ ID NO: 414811 - DNA, 15 bp, Homo sapiens
cagtcctgtctcttc

SEQ ID NO: 414812 - DNA, 15 bp, Homo sapiens
agtcctgtctcttcc

SEQ ID NO: 414813 - DNA, 15 bp, Homo sapiens
gtcctgtctcttcct

SEQ ID NO: 414814 - DNA, 15 bp, Homo sapiens
tcctgtctcttcctc

SEQ ID NO: 414815 - DNA, 15 bp, Homo sapiens
cctgtctcttcctca

SEQ ID NO: 414816 - DNA, 15 bp, Homo sapiens
ctgtctcttcctcag

SEQ ID NO: 414817 - DNA, 15 bp, Homo sapiens
tgtctcttcctcagt

SEQ ID NO: 414818 - DNA, 15 bp, Homo sapiens
gtctcttcctcagta

SEQ ID NO: 414819 - DNA, 15 bp, Homo sapiens
tctcttcctcagtat

SEQ ID NO: 414820 - DNA, 15 bp, Homo sapiens
ctcttcctcagtatt

SEQ ID NO: 414821 - DNA, 15 bp, Homo sapiens
tcttcctcagtatta

SEQ ID NO: 414822 - DNA, 15 bp, Homo sapiens
cttcctcagtattag

SEQ ID NO: 414823 - DNA, 15 bp, Homo sapiens
ttcctcagtattagt

SEQ ID NO: 414824 - DNA, 15 bp, Homo sapiens
tcctcagtattagta

SEQ ID NO: 414825 - DNA, 15 bp, Homo sapiens
cctcagtattagtaa

SEQ ID NO: 414826 - DNA, 15 bp, Homo sapiens
ctcagtattagtaac

SEQ ID NO: 414827 - DNA, 15 bp, Homo sapiens
tcagtattagtaacc

SEQ ID NO: 414828 - DNA, 15 bp, Homo sapiens
cagtattagtaacct

SEQ ID NO: 414829 - DNA, 15 bp, Homo sapiens
agtattagtaacctg

SEQ ID NO: 414830 - DNA, 15 bp, Homo sapiens
gtattagtaacctgt

SEQ ID NO: 414831 - DNA, 15 bp, Homo sapiens
tattagtaacctgtt

SEQ ID NO: 414832 - DNA, 15 bp, Homo sapiens
attagtaacctgttt

SEQ ID NO: 414833 - DNA, 15 bp, Homo sapiens
ttagtaacctgtttc

SEQ ID NO: 414834 - DNA, 15 bp, Homo sapiens
tagtaacctgtttct

SEQ ID NO: 414835 - DNA, 15 bp, Homo sapiens
agtaacctgtttcta

SEQ ID NO: 414836 - DNA, 15 bp, Homo sapiens
gtaacctgtttctag

SEQ ID NO: 414837 - DNA, 15 bp, Homo sapiens
taacctgtttctaga

SEQ ID NO: 414838 - DNA, 15 bp, Homo sapiens
aacctgtttctagag

SEQ ID NO: 414839 - DNA, 15 bp, Homo sapiens
acctgtttctagaga

SEQ ID NO: 414840 - DNA, 15 bp, Homo sapiens
cctgtttctagagag

SEQ ID NO: 414841 - DNA, 15 bp, Homo sapiens
ctgtttctagagaga

SEQ ID NO: 414842 - DNA, 15 bp, Homo sapiens
tgtttctagagagaa

SEQ ID NO: 414843 - DNA, 15 bp, Homo sapiens
gtttctagagagaat

SEQ ID NO: 414844 - DNA, 15 bp, Homo sapiens
tttctagagagaata

SEQ ID NO: 414845 - DNA, 15 bp, Homo sapiens
ttctagagagaatac

SEQ ID NO: 414846 - DNA, 15 bp, Homo sapiens
tctagagagaatact

SEQ ID NO: 414847 - DNA, 15 bp, Homo sapiens
ctagagagaatacta

SEQ ID NO: 414848 - DNA, 15 bp, Homo sapiens
tagagagaatactag

SEQ ID NO: 414849 - DNA, 15 bp, Homo sapiens
agagagaatactagc

SEQ ID NO: 414850 - DNA, 15 bp, Homo sapiens
gagagaatactagcc

SEQ ID NO: 414851 - DNA, 15 bp, Homo sapiens
agagaatactagcct

SEQ ID NO: 414852 - DNA, 15 bp, Homo sapiens
gagaatactagcctt

SEQ ID NO: 414853 - DNA, 15 bp, Homo sapiens
agaatactagcctta

SEQ ID NO: 414854 - DNA, 15 bp, Homo sapiens
gaatactagccttaa

SEQ ID NO: 414855 - DNA, 15 bp, Homo sapiens
aatactagccttaac

SEQ ID NO: 414856 - DNA, 15 bp, Homo sapiens
atactagccttaacg

SEQ ID NO: 414857 - DNA, 15 bp, Homo sapiens
tactagccttaacga

SEQ ID NO: 414858 - DNA, 15 bp, Homo sapiens
actagccttaacgat

SEQ ID NO: 414859 - DNA, 15 bp, Homo sapiens
ctagccttaacgatt

SEQ ID NO: 414860 - DNA, 15 bp, Homo sapiens
tagccttaacgattt

SEQ ID NO: 414861 - DNA, 15 bp, Homo sapiens
agccttaacgattta

SEQ ID NO: 414862 - DNA, 15 bp, Homo sapiens
gccttaacgatttac

SEQ ID NO: 414863 - DNA, 15 bp, Homo sapiens
ccttaacgatttacc

SEQ ID NO: 414864 - DNA, 15 bp, Homo sapiens
cttaacgatttacca

SEQ ID NO: 414865 - DNA, 15 bp, Homo sapiens
ttaacgatttaccac

SEQ ID NO: 414866 - DNA, 15 bp, Homo sapiens
taacgatttaccact

SEQ ID NO: 414867 - DNA, 15 bp, Homo sapiens
aacgatttaccactt

SEQ ID NO: 414868 - DNA, 15 bp, Homo sapiens
acgatttaccacttt

SEQ ID NO: 414869 - DNA, 15 bp, Homo sapiens
cgatttaccactttt

SEQ ID NO: 414870 - DNA, 15 bp, Homo sapiens
gatttaccacttttc

SEQ ID NO: 414871 - DNA, 15 bp, Homo sapiens
atttaccacttttca

SEQ ID NO: 414872 - DNA, 15 bp, Homo sapiens
tttaccacttttcat

SEQ ID NO: 414873 - DNA, 15 bp, Homo sapiens
ttaccacttttcata

SEQ ID NO: 414874 - DNA, 15 bp, Homo sapiens
taccacttttcatat

SEQ ID NO: 414875 - DNA, 15 bp, Homo sapiens
accacttttcatatc

SEQ ID NO: 414876 - DNA, 15 bp, Homo sapiens
ccacttttcatatca

SEQ ID NO: 414877 - DNA, 15 bp, Homo sapiens
cacttttcatatcag

SEQ ID NO: 414878 - DNA, 15 bp, Homo sapiens
acttttcatatcagc

SEQ ID NO: 414879 - DNA, 15 bp, Homo sapiens
cttttcatatcagca

SEQ ID NO: 414880 - DNA, 15 bp, Homo sapiens
ttttcatatcagcag

SEQ ID NO: 414881 - DNA, 15 bp, Homo sapiens
tttcatatcagcagt

SEQ ID NO: 414882 - DNA, 15 bp, Homo sapiens
ttcatatcagcagtt

SEQ ID NO: 414883 - DNA, 15 bp, Homo sapiens
tcatatcagcagttg

SEQ ID NO: 414884 - DNA, 15 bp, Homo sapiens
catatcagcagttgt

SEQ ID NO: 414885 - DNA, 15 bp, Homo sapiens
atatcagcagttgtc

SEQ ID NO: 414886 - DNA, 15 bp, Homo sapiens
tatcagcagttgtca

SEQ ID NO: 414887 - DNA, 15 bp, Homo sapiens
atcagcagttgtcat

SEQ ID NO: 414888 - DNA, 15 bp, Homo sapiens
tcagcagttgtcatt

SEQ ID NO: 414889 - DNA, 15 bp, Homo sapiens
cagcagttgtcattg

SEQ ID NO: 414890 - DNA, 15 bp, Homo sapiens
agcagttgtcattgt

SEQ ID NO: 414891 - DNA, 15 bp, Homo sapiens
gcagttgtcattgtt

SEQ ID NO: 414892 - DNA, 15 bp, Homo sapiens
cagttgtcattgttc

SEQ ID NO: 414893 - DNA, 15 bp, Homo sapiens
agttgtcattgttca

SEQ ID NO: 414894 - DNA, 15 bp, Homo sapiens
gttgtcattgttcag

SEQ ID NO: 414895 - DNA, 15 bp, Homo sapiens
ttgtcattgttcagt

SEQ ID NO: 414896 - DNA, 15 bp, Homo sapiens
tgtcattgttcagtc

SEQ ID NO: 414897 - DNA, 15 bp, Homo sapiens
gtcattgttcagtct

SEQ ID NO: 414898 - DNA, 15 bp, Homo sapiens
tcattgttcagtctg

SEQ ID NO: 414899 - DNA, 15 bp, Homo sapiens
cattgttcagtctga

SEQ ID NO: 414900 - DNA, 15 bp, Homo sapiens
attgttcagtctgaa

SEQ ID NO: 414901 - DNA, 15 bp, Homo sapiens
ttgttcagtctgaag

SEQ ID NO: 414902 - DNA, 15 bp, Homo sapiens
tgttcagtctgaagt

SEQ ID NO: 414903 - DNA, 15 bp, Homo sapiens
gttcagtctgaagtt

SEQ ID NO: 414904 - DNA, 15 bp, Homo sapiens
ttcagtctgaagttt

SEQ ID NO: 414905 - DNA, 15 bp, Homo sapiens
tcagtctgaagttta

SEQ ID NO: 414906 - DNA, 15 bp, Homo sapiens
cagtctgaagtttag

SEQ ID NO: 414907 - DNA, 15 bp, Homo sapiens
agtctgaagtttagg

SEQ ID NO: 414908 - DNA, 15 bp, Homo sapiens
gtctgaagtttaggt

SEQ ID NO: 414909 - DNA, 15 bp, Homo sapiens
tctgaagtttaggtg

SEQ ID NO: 414910 - DNA, 15 bp, Homo sapiens
ctgaagtttaggtga

SEQ ID NO: 414911 - DNA, 15 bp, Homo sapiens
tgaagtttaggtgac

SEQ ID NO: 414912 - DNA, 15 bp, Homo sapiens
gaagtttaggtgacc

SEQ ID NO: 414913 - DNA, 15 bp, Homo sapiens
aagtttaggtgacca

SEQ ID NO: 414914 - DNA, 15 bp, Homo sapiens
agtttaggtgaccac

SEQ ID NO: 414915 - DNA, 15 bp, Homo sapiens
gtttaggtgaccaca

SEQ ID NO: 414916 - DNA, 15 bp, Homo sapiens
tttaggtgaccacag

SEQ ID NO: 414917 - DNA, 15 bp, Homo sapiens
ttaggtgaccacagt

SEQ ID NO: 414918 - DNA, 15 bp, Homo sapiens
taggtgaccacagta

SEQ ID NO: 414919 - DNA, 15 bp, Homo sapiens
aggtgaccacagtag

SEQ ID NO: 414920 - DNA, 15 bp, Homo sapiens
ggtgaccacagtaga

SEQ ID NO: 414921 - DNA, 15 bp, Homo sapiens
gtgaccacagtagaa

SEQ ID NO: 414922 - DNA, 15 bp, Homo sapiens
tgaccacagtagaaa

SEQ ID NO: 414923 - DNA, 15 bp, Homo sapiens
gaccacagtagaaag

SEQ ID NO: 414924 - DNA, 15 bp, Homo sapiens
accacagtagaaagg

SEQ ID NO: 414925 - DNA, 15 bp, Homo sapiens
ccacagtagaaaggg

SEQ ID NO: 414926 - DNA, 15 bp, Homo sapiens
cacagtagaaagggg

SEQ ID NO: 414927 - DNA, 15 bp, Homo sapiens
acagtagaaagggga

SEQ ID NO: 414928 - DNA, 15 bp, Homo sapiens
cagtagaaaggggat

SEQ ID NO: 414929 - DNA, 15 bp, Homo sapiens
agtagaaaggggatt

SEQ ID NO: 414930 - DNA, 15 bp, Homo sapiens
gtagaaaggggattt

SEQ ID NO: 414931 - DNA, 15 bp, Homo sapiens
tagaaaggggatttt

SEQ ID NO: 414932 - DNA, 15 bp, Homo sapiens
agaaaggggattttg

SEQ ID NO: 414933 - DNA, 15 bp, Homo sapiens
gaaaggggattttgc

SEQ ID NO: 414934 - DNA, 15 bp, Homo sapiens
aaaggggattttgct

SEQ ID NO: 414935 - DNA, 15 bp, Homo sapiens
aaggggattttgctg

SEQ ID NO: 414936 - DNA, 15 bp, Homo sapiens
aggggattttgctgt

SEQ ID NO: 414937 - DNA, 15 bp, Homo sapiens
ggggattttgctgta

SEQ ID NO: 414938 - DNA, 15 bp, Homo sapiens
gggattttgctgtat

SEQ ID NO: 414939 - DNA, 15 bp, Homo sapiens
ggattttgctgtatt

SEQ ID NO: 414940 - DNA, 15 bp, Homo sapiens
gattttgctgtattc

SEQ ID NO: 414941 - DNA, 15 bp, Homo sapiens
attttgctgtattcc

SEQ ID NO: 414942 - DNA, 15 bp, Homo sapiens
ttttgctgtattcct

SEQ ID NO: 414943 - DNA, 15 bp, Homo sapiens
tttgctgtattcctg

SEQ ID NO: 414944 - DNA, 15 bp, Homo sapiens
ttgctgtattcctga

SEQ ID NO: 414945 - DNA, 15 bp, Homo sapiens
tgctgtattcctgaa

SEQ ID NO: 414946 - DNA, 15 bp, Homo sapiens
gctgtattcctgaag

SEQ ID NO: 414947 - DNA, 15 bp, Homo sapiens
ctgtattcctgaagg

SEQ ID NO: 414948 - DNA, 15 bp, Homo sapiens
tgtattcctgaagga

SEQ ID NO: 414949 - DNA, 15 bp, Homo sapiens
gtattcctgaaggaa

SEQ ID NO: 414950 - DNA, 15 bp, Homo sapiens
tattcctgaaggaat

SEQ ID NO: 414951 - DNA, 15 bp, Homo sapiens
attcctgaaggaatt

SEQ ID NO: 414952 - DNA, 15 bp, Homo sapiens
ttcctgaaggaattt

SEQ ID NO: 414953 - DNA, 15 bp, Homo sapiens
tcctgaaggaatttc

SEQ ID NO: 414954 - DNA, 15 bp, Homo sapiens
cctgaaggaatttca

SEQ ID NO: 414955 - DNA, 15 bp, Homo sapiens
ctgaaggaatttcag

SEQ ID NO: 414956 - DNA, 15 bp, Homo sapiens
tgaaggaatttcagg

SEQ ID NO: 414957 - DNA, 15 bp, Homo sapiens
gaaggaatttcaggc

SEQ ID NO: 414958 - DNA, 15 bp, Homo sapiens
aaggaatttcaggct

SEQ ID NO: 414959 - DNA, 15 bp, Homo sapiens
aggaatttcaggctt

SEQ ID NO: 414960 - DNA, 15 bp, Homo sapiens
ggaatttcaggcttt

SEQ ID NO: 414961 - DNA, 15 bp, Homo sapiens
gaatttcaggcttta

SEQ ID NO: 414962 - DNA, 15 bp, Homo sapiens
aatttcaggctttaa

SEQ ID NO: 414963 - DNA, 15 bp, Homo sapiens
atttcaggctttaag

SEQ ID NO: 414964 - DNA, 15 bp, Homo sapiens
tttcaggctttaaga

SEQ ID NO: 414965 - DNA, 15 bp, Homo sapiens
ttcaggctttaagaa

SEQ ID NO: 414966 - DNA, 15 bp, Homo sapiens
tcaggctttaagaaa

SEQ ID NO: 414967 - DNA, 15 bp, Homo sapiens
caggctttaagaaaa

SEQ ID NO: 414968 - DNA, 15 bp, Homo sapiens
aggctttaagaaaac

SEQ ID NO: 414969 - DNA, 15 bp, Homo sapiens
ggctttaagaaaacg

SEQ ID NO: 414970 - DNA, 15 bp, Homo sapiens
gctttaagaaaacga

SEQ ID NO: 414971 - DNA, 15 bp, Homo sapiens
ctttaagaaaacgag

SEQ ID NO: 414972 - DNA, 15 bp, Homo sapiens
tttaagaaaacgagg

SEQ ID NO: 414973 - DNA, 15 bp, Homo sapiens
ttaagaaaacgaggg

SEQ ID NO: 414974 - DNA, 15 bp, Homo sapiens
taagaaaacgagggt

SEQ ID NO: 414975 - DNA, 15 bp, Homo sapiens
aagaaaacgagggtc

SEQ ID NO: 414976 - DNA, 15 bp, Homo sapiens
agaaaacgagggtcc

SEQ ID NO: 414977 - DNA, 15 bp, Homo sapiens
gaaaacgagggtcca

SEQ ID NO: 414978 - DNA, 15 bp, Homo sapiens
aaaacgagggtccac

SEQ ID NO: 414979 - DNA, 15 bp, Homo sapiens
aaacgagggtccact

SEQ ID NO: 414980 - DNA, 15 bp, Homo sapiens
aacgagggtccactg

SEQ ID NO: 414981 - DNA, 15 bp, Homo sapiens
acgagggtccactgt

SEQ ID NO: 414982 - DNA, 15 bp, Homo sapiens
cgagggtccactgtt

SEQ ID NO: 414983 - DNA, 15 bp, Homo sapiens
gagggtccactgttg

SEQ ID NO: 414984 - DNA, 15 bp, Homo sapiens
agggtccactgttgg

SEQ ID NO: 414985 - DNA, 15 bp, Homo sapiens
gggtccactgttgga

SEQ ID NO: 414986 - DNA, 15 bp, Homo sapiens
ggtccactgttggac

SEQ ID NO: 414987 - DNA, 15 bp, Homo sapiens
gtccactgttggact

SEQ ID NO: 414988 - DNA, 15 bp, Homo sapiens
tccactgttggacta

SEQ ID NO: 414989 - DNA, 15 bp, Homo sapiens
ccactgttggactag

SEQ ID NO: 414990 - DNA, 15 bp, Homo sapiens
cactgttggactagt

SEQ ID NO: 414991 - DNA, 15 bp, Homo sapiens
actgttggactagta

SEQ ID NO: 414992 - DNA, 15 bp, Homo sapiens
ctgttggactagtag

SEQ ID NO: 414993 - DNA, 15 bp, Homo sapiens
tgttggactagtaga

SEQ ID NO: 414994 - DNA, 15 bp, Homo sapiens
gttggactagtagac

SEQ ID NO: 414995 - DNA, 15 bp, Homo sapiens
ttggactagtagact

SEQ ID NO: 414996 - DNA, 15 bp, Homo sapiens
tggactagtagactc

SEQ ID NO: 414997 - DNA, 15 bp, Homo sapiens
ggactagtagactca

SEQ ID NO: 414998 - DNA, 15 bp, Homo sapiens
gactagtagactcaa

SEQ ID NO: 414999 - DNA, 15 bp, Homo sapiens
actagtagactcaaa

SEQ ID NO: 415000 - DNA, 15 bp, Homo sapiens
ctagtagactcaaat

SEQ ID NO: 415001 - DNA, 15 bp, Homo sapiens
tagtagactcaaatc

SEQ ID NO: 415002 - DNA, 15 bp, Homo sapiens
agtagactcaaatcc

SEQ ID NO: 415003 - DNA, 15 bp, Homo sapiens
gtagactcaaatcct

SEQ ID NO: 415004 - DNA, 15 bp, Homo sapiens
tagactcaaatcctg

SEQ ID NO: 415005 - DNA, 15 bp, Homo sapiens
agactcaaatcctga

SEQ ID NO: 415006 - DNA, 15 bp, Homo sapiens
gactcaaatcctgat

SEQ ID NO: 415007 - DNA, 15 bp, Homo sapiens
actcaaatcctgata

SEQ ID NO: 415008 - DNA, 15 bp, Homo sapiens
ctcaaatcctgatac

SEQ ID NO: 415009 - DNA, 15 bp, Homo sapiens
tcaaatcctgatacg

SEQ ID NO: 415010 - DNA, 15 bp, Homo sapiens
caaatcctgatacgc

SEQ ID NO: 415011 - DNA, 15 bp, Homo sapiens
aaatcctgatacgct

SEQ ID NO: 415012 - DNA, 15 bp, Homo sapiens
aatcctgatacgctt

SEQ ID NO: 415013 - DNA, 15 bp, Homo sapiens
atcctgatacgctta

SEQ ID NO: 415014 - DNA, 15 bp, Homo sapiens
tcctgatacgcttag

SEQ ID NO: 415015 - DNA, 15 bp, Homo sapiens
cctgatacgcttagt

SEQ ID NO: 415016 - DNA, 15 bp, Homo sapiens
ctgatacgcttagta

SEQ ID NO: 415017 - DNA, 15 bp, Homo sapiens
tgatacgcttagtag

SEQ ID NO: 415018 - DNA, 15 bp, Homo sapiens
gatacgcttagtagt

SEQ ID NO: 415019 - DNA, 15 bp, Homo sapiens
atacgcttagtagtt

SEQ ID NO: 415020 - DNA, 15 bp, Homo sapiens
tacgcttagtagttg

SEQ ID NO: 415021 - DNA, 15 bp, Homo sapiens
acgcttagtagttga

SEQ ID NO: 415022 - DNA, 15 bp, Homo sapiens
cgcttagtagttgag

SEQ ID NO: 415023 - DNA, 15 bp, Homo sapiens
gcttagtagttgagg

SEQ ID NO: 415024 - DNA, 15 bp, Homo sapiens
cttagtagttgaggc

SEQ ID NO: 415025 - DNA, 15 bp, Homo sapiens
ttagtagttgaggcc

SEQ ID NO: 415026 - DNA, 15 bp, Homo sapiens
tagtagttgaggcca

SEQ ID NO: 415027 - DNA, 15 bp, Homo sapiens
agtagttgaggccaa

SEQ ID NO: 415028 - DNA, 15 bp, Homo sapiens
gtagttgaggccaac

SEQ ID NO: 415029 - DNA, 15 bp, Homo sapiens
tagttgaggccaaca

SEQ ID NO: 415030 - DNA, 15 bp, Homo sapiens
agttgaggccaacag

SEQ ID NO: 415031 - DNA, 15 bp, Homo sapiens
gttgaggccaacagc

SEQ ID NO: 415032 - DNA, 15 bp, Homo sapiens
ttgaggccaacagct

SEQ ID NO: 415033 - DNA, 15 bp, Homo sapiens
tgaggccaacagctg

SEQ ID NO: 415034 - DNA, 15 bp, Homo sapiens
gaggccaacagctga

SEQ ID NO: 415035 - DNA, 15 bp, Homo sapiens
aggccaacagctgag

SEQ ID NO: 415036 - DNA, 15 bp, Homo sapiens
ggccaacagctgagc

SEQ ID NO: 415037 - DNA, 15 bp, Homo sapiens
gccaacagctgagca

SEQ ID NO: 415038 - DNA, 15 bp, Homo sapiens
ccaacagctgagcag

SEQ ID NO: 415039 - DNA, 15 bp, Homo sapiens
caacagctgagcagc

SEQ ID NO: 415040 - DNA, 15 bp, Homo sapiens
aacagctgagcagca

SEQ ID NO: 415041 - DNA, 15 bp, Homo sapiens
acagctgagcagcag

SEQ ID NO: 415042 - DNA, 15 bp, Homo sapiens
cagctgagcagcagg

SEQ ID NO: 415043 - DNA, 15 bp, Homo sapiens
agctgagcagcaggc

SEQ ID NO: 415044 - DNA, 15 bp, Homo sapiens
gctgagcagcaggcc

SEQ ID NO: 415045 - DNA, 15 bp, Homo sapiens
ctgagcagcaggcct

SEQ ID NO: 415046 - DNA, 15 bp, Homo sapiens
tgagcagcaggcctt

SEQ ID NO: 415047 - DNA, 15 bp, Homo sapiens
gagcagcaggccttc

SEQ ID NO: 415048 - DNA, 15 bp, Homo sapiens
agcagcaggccttcc

SEQ ID NO: 415049 - DNA, 15 bp, Homo sapiens
gcagcaggccttcca

SEQ ID NO: 415050 - DNA, 15 bp, Homo sapiens
cagcaggccttccaa

SEQ ID NO: 415051 - DNA, 15 bp, Homo sapiens
agcaggccttccaat

SEQ ID NO: 415052 - DNA, 15 bp, Homo sapiens
gcaggccttccaatg

SEQ ID NO: 415053 - DNA, 15 bp, Homo sapiens
caggccttccaatgg

SEQ ID NO: 415054 - DNA, 15 bp, Homo sapiens
aggccttccaatggt

SEQ ID NO: 415055 - DNA, 15 bp, Homo sapiens
ggccttccaatggtg

SEQ ID NO: 415056 - DNA, 15 bp, Homo sapiens
gccttccaatggtgg

SEQ ID NO: 415057 - DNA, 15 bp, Homo sapiens
ccttccaatggtggc

SEQ ID NO: 415058 - DNA, 15 bp, Homo sapiens
cttccaatggtggct

SEQ ID NO: 415059 - DNA, 15 bp, Homo sapiens
ttccaatggtggcta

SEQ ID NO: 415060 - DNA, 15 bp, Homo sapiens
tccaatggtggctaa

SEQ ID NO: 415061 - DNA, 15 bp, Homo sapiens
ccaatggtggctaat

SEQ ID NO: 415062 - DNA, 15 bp, Homo sapiens
caatggtggctaatc

SEQ ID NO: 415063 - DNA, 15 bp, Homo sapiens
aatggtggctaatct

SEQ ID NO: 415064 - DNA, 15 bp, Homo sapiens
atggtggctaatctg

SEQ ID NO: 415065 - DNA, 15 bp, Homo sapiens
tggtggctaatctgg

SEQ ID NO: 415066 - DNA, 15 bp, Homo sapiens
ggtggctaatctgga

SEQ ID NO: 415067 - DNA, 15 bp, Homo sapiens
gtggctaatctggaa

SEQ ID NO: 415068 - DNA, 15 bp, Homo sapiens
tggctaatctggaaa

SEQ ID NO: 415069 - DNA, 15 bp, Homo sapiens
ggctaatctggaaag

SEQ ID NO: 415070 - DNA, 15 bp, Homo sapiens
gctaatctggaaagt

SEQ ID NO: 415071 - DNA, 15 bp, Homo sapiens
ctaatctggaaagtt

SEQ ID NO: 415072 - DNA, 15 bp, Homo sapiens
taatctggaaagtta

SEQ ID NO: 415073 - DNA, 15 bp, Homo sapiens
aatctggaaagttat

SEQ ID NO: 415074 - DNA, 15 bp, Homo sapiens
atctggaaagttata

SEQ ID NO: 415075 - DNA, 15 bp, Homo sapiens
tctggaaagttatag

SEQ ID NO: 415076 - DNA, 15 bp, Homo sapiens
ctggaaagttataga

SEQ ID NO: 415077 - DNA, 15 bp, Homo sapiens
tggaaagttatagac

SEQ ID NO: 415078 - DNA, 15 bp, Homo sapiens
ggaaagttatagact

SEQ ID NO: 415079 - DNA, 15 bp, Homo sapiens
gaaagttatagactg

SEQ ID NO: 415080 - DNA, 15 bp, Homo sapiens
aaagttatagactgg

SEQ ID NO: 415081 - DNA, 15 bp, Homo sapiens
aagttatagactggt

SEQ ID NO: 415082 - DNA, 15 bp, Homo sapiens
agttatagactggtc

SEQ ID NO: 415083 - DNA, 15 bp, Homo sapiens
gttatagactggtca

SEQ ID NO: 415084 - DNA, 15 bp, Homo sapiens
ttatagactggtcag

SEQ ID NO: 415085 - DNA, 15 bp, Homo sapiens
tatagactggtcaga

SEQ ID NO: 415086 - DNA, 15 bp, Homo sapiens
atagactggtcagat

SEQ ID NO: 415087 - DNA, 15 bp, Homo sapiens
tagactggtcagatc

SEQ ID NO: 415088 - DNA, 15 bp, Homo sapiens
agactggtcagatca

SEQ ID NO: 415089 - DNA, 15 bp, Homo sapiens
gactggtcagatcat

SEQ ID NO: 415090 - DNA, 15 bp, Homo sapiens
actggtcagatcatt

SEQ ID NO: 415091 - DNA, 15 bp, Homo sapiens
ctggtcagatcatta

SEQ ID NO: 415092 - DNA, 15 bp, Homo sapiens
tggtcagatcattaa

SEQ ID NO: 415093 - DNA, 15 bp, Homo sapiens
ggtcagatcattaaa

SEQ ID NO: 415094 - DNA, 15 bp, Homo sapiens
gtcagatcattaaaa

SEQ ID NO: 415095 - DNA, 15 bp, Homo sapiens
tcagatcattaaaat

SEQ ID NO: 415096 - DNA, 15 bp, Homo sapiens
cagatcattaaaatt

SEQ ID NO: 415097 - DNA, 15 bp, Homo sapiens
agatcattaaaattc

SEQ ID NO: 415098 - DNA, 15 bp, Homo sapiens
gatcattaaaattcc

SEQ ID NO: 415099 - DNA, 15 bp, Homo sapiens
atcattaaaattccc

SEQ ID NO: 415100 - DNA, 15 bp, Homo sapiens
tcattaaaattccca

SEQ ID NO: 415101 - DNA, 15 bp, Homo sapiens
cattaaaattcccag

SEQ ID NO: 415102 - DNA, 15 bp, Homo sapiens
attaaaattcccagg

SEQ ID NO: 415103 - DNA, 15 bp, Homo sapiens
ttaaaattcccaggt

SEQ ID NO: 415104 - DNA, 15 bp, Homo sapiens
taaaattcccaggtg

SEQ ID NO: 415105 - DNA, 15 bp, Homo sapiens
aaaattcccaggtga

SEQ ID NO: 415106 - DNA, 15 bp, Homo sapiens
aaattcccaggtgaa

SEQ ID NO: 415107 - DNA, 15 bp, Homo sapiens
aattcccaggtgaaa

SEQ ID NO: 415108 - DNA, 15 bp, Homo sapiens
attcccaggtgaaag

SEQ ID NO: 415109 - DNA, 15 bp, Homo sapiens
ttcccaggtgaaagc

SEQ ID NO: 415110 - DNA, 15 bp, Homo sapiens
tcccaggtgaaagca

SEQ ID NO: 415111 - DNA, 15 bp, Homo sapiens
cccaggtgaaagcag

SEQ ID NO: 415112 - DNA, 15 bp, Homo sapiens
ccaggtgaaagcaga

SEQ ID NO: 415113 - DNA, 15 bp, Homo sapiens
caggtgaaagcagac

SEQ ID NO: 415114 - DNA, 15 bp, Homo sapiens
aggtgaaagcagacc

SEQ ID NO: 415115 - DNA, 15 bp, Homo sapiens
ggtgaaagcagacct

SEQ ID NO: 415116 - DNA, 15 bp, Homo sapiens
gtgaaagcagacctt

SEQ ID NO: 415117 - DNA, 15 bp, Homo sapiens
tgaaagcagaccttc

SEQ ID NO: 415118 - DNA, 15 bp, Homo sapiens
gaaagcagaccttca

SEQ ID NO: 415119 - DNA, 15 bp, Homo sapiens
aaagcagaccttcag

SEQ ID NO: 415120 - DNA, 15 bp, Homo sapiens
aagcagaccttcagc

SEQ ID NO: 415121 - DNA, 15 bp, Homo sapiens
agcagaccttcagca

SEQ ID NO: 415122 - DNA, 15 bp, Homo sapiens
gcagaccttcagcat

SEQ ID NO: 415123 - DNA, 15 bp, Homo sapiens
cagaccttcagcata

SEQ ID NO: 415124 - DNA, 15 bp, Homo sapiens
agaccttcagcataa

SEQ ID NO: 415125 - DNA, 15 bp, Homo sapiens
gaccttcagcataac

SEQ ID NO: 415126 - DNA, 15 bp, Homo sapiens
accttcagcataact

SEQ ID NO: 415127 - DNA, 15 bp, Homo sapiens
ccttcagcataactt

SEQ ID NO: 415128 - DNA, 15 bp, Homo sapiens
cttcagcataacttt

SEQ ID NO: 415129 - DNA, 15 bp, Homo sapiens
ttcagcataacttta

SEQ ID NO: 415130 - DNA, 15 bp, Homo sapiens
tcagcataactttaa

SEQ ID NO: 415131 - DNA, 15 bp, Homo sapiens
cagcataactttaag

SEQ ID NO: 415132 - DNA, 15 bp, Homo sapiens
agcataactttaaga

SEQ ID NO: 415133 - DNA, 15 bp, Homo sapiens
gcataactttaagac

SEQ ID NO: 415134 - DNA, 15 bp, Homo sapiens
cataactttaagaca

SEQ ID NO: 415135 - DNA, 15 bp, Homo sapiens
ataactttaagacag

SEQ ID NO: 415136 - DNA, 15 bp, Homo sapiens
taactttaagacagc

SEQ ID NO: 415137 - DNA, 15 bp, Homo sapiens
aactttaagacagca

SEQ ID NO: 415138 - DNA, 15 bp, Homo sapiens
actttaagacagcag

SEQ ID NO: 415139 - DNA, 15 bp, Homo sapiens
ctttaagacagcagt

SEQ ID NO: 415140 - DNA, 15 bp, Homo sapiens
tttaagacagcagtt

SEQ ID NO: 415141 - DNA, 15 bp, Homo sapiens
ttaagacagcagttt

SEQ ID NO: 415142 - DNA, 15 bp, Homo sapiens
taagacagcagtttt

SEQ ID NO: 415143 - DNA, 15 bp, Homo sapiens
aagacagcagttttt

SEQ ID NO: 415144 - DNA, 15 bp, Homo sapiens
agacagcagtttttt

SEQ ID NO: 415145 - DNA, 15 bp, Homo sapiens
gacagcagttttttt

SEQ ID NO: 415146 - DNA, 15 bp, Homo sapiens
acagcagtttttttg

SEQ ID NO: 415147 - DNA, 15 bp, Homo sapiens
cagcagtttttttgt

SEQ ID NO: 415148 - DNA, 15 bp, Homo sapiens
agcagtttttttgtg

SEQ ID NO: 415149 - DNA, 15 bp, Homo sapiens
gcagtttttttgtga

SEQ ID NO: 415150 - DNA, 15 bp, Homo sapiens
cagtttttttgtgaa

SEQ ID NO: 415151 - DNA, 15 bp, Homo sapiens
agtttttttgtgaag

SEQ ID NO: 415152 - DNA, 15 bp, Homo sapiens
gtttttttgtgaagg

SEQ ID NO: 415153 - DNA, 15 bp, Homo sapiens
tttttttgtgaaggt

SEQ ID NO: 415154 - DNA, 15 bp, Homo sapiens
ttttttgtgaaggta

SEQ ID NO: 415155 - DNA, 15 bp, Homo sapiens
tttttgtgaaggtaa

SEQ ID NO: 415156 - DNA, 15 bp, Homo sapiens
ttttgtgaaggtaaa

SEQ ID NO: 415157 - DNA, 15 bp, Homo sapiens
tttgtgaaggtaaat

SEQ ID NO: 415158 - DNA, 15 bp, Homo sapiens
ttgtgaaggtaaatt

SEQ ID NO: 415159 - DNA, 15 bp, Homo sapiens
tgtgaaggtaaattg

SEQ ID NO: 415160 - DNA, 15 bp, Homo sapiens
gtgaaggtaaattga

SEQ ID NO: 415161 - DNA, 15 bp, Homo sapiens
tgaaggtaaattgaa

SEQ ID NO: 415162 - DNA, 15 bp, Homo sapiens
gaaggtaaattgaaa

SEQ ID NO: 415163 - DNA, 15 bp, Homo sapiens
aaggtaaattgaaag

SEQ ID NO: 415164 - DNA, 15 bp, Homo sapiens
aggtaaattgaaagg

SEQ ID NO: 415165 - DNA, 15 bp, Homo sapiens
ggtaaattgaaaggg

SEQ ID NO: 415166 - DNA, 15 bp, Homo sapiens
gtaaattgaaaggga

SEQ ID NO: 415167 - DNA, 15 bp, Homo sapiens
taaattgaaagggat

SEQ ID NO: 415168 - DNA, 15 bp, Homo sapiens
aaattgaaagggata

SEQ ID NO: 415169 - DNA, 15 bp, Homo sapiens
aattgaaagggatat

SEQ ID NO: 415170 - DNA, 15 bp, Homo sapiens
attgaaagggatatt

SEQ ID NO: 415171 - DNA, 15 bp, Homo sapiens
ttgaaagggatattt

SEQ ID NO: 415172 - DNA, 15 bp, Homo sapiens
tgaaagggatatttt

SEQ ID NO: 415173 - DNA, 15 bp, Homo sapiens
gaaagggatatttta

SEQ ID NO: 415174 - DNA, 15 bp, Homo sapiens
aaagggatattttag

SEQ ID NO: 415175 - DNA, 15 bp, Homo sapiens
aagggatattttagt

SEQ ID NO: 415176 - DNA, 15 bp, Homo sapiens
agggatattttagtt

SEQ ID NO: 415177 - DNA, 15 bp, Homo sapiens
gggatattttagttg

SEQ ID NO: 415178 - DNA, 15 bp, Homo sapiens
ggatattttagttga

SEQ ID NO: 415179 - DNA, 15 bp, Homo sapiens
gatattttagttgat

SEQ ID NO: 415180 - DNA, 15 bp, Homo sapiens
atattttagttgata

SEQ ID NO: 415181 - DNA, 15 bp, Homo sapiens
tattttagttgatat

SEQ ID NO: 415182 - DNA, 15 bp, Homo sapiens
attttagttgatatt

SEQ ID NO: 415183 - DNA, 15 bp, Homo sapiens
ttttagttgatattt

SEQ ID NO: 415184 - DNA, 15 bp, Homo sapiens
tttagttgatatttt

SEQ ID NO: 415185 - DNA, 15 bp, Homo sapiens
ttagttgatattttt

SEQ ID NO: 415186 - DNA, 15 bp, Homo sapiens
tagttgatatttttg

SEQ ID NO: 415187 - DNA, 15 bp, Homo sapiens
agttgatatttttga

SEQ ID NO: 415188 - DNA, 15 bp, Homo sapiens
gttgatatttttgaa

SEQ ID NO: 415189 - DNA, 15 bp, Homo sapiens
ttgatatttttgaat

SEQ ID NO: 415190 - DNA, 15 bp, Homo sapiens
tgatatttttgaatt

SEQ ID NO: 415191 - DNA, 15 bp, Homo sapiens
gatatttttgaattt

SEQ ID NO: 415192 - DNA, 15 bp, Homo sapiens
atatttttgaatttt

SEQ ID NO: 415193 - DNA, 15 bp, Homo sapiens
tatttttgaattttg

SEQ ID NO: 415194 - DNA, 15 bp, Homo sapiens
atttttgaattttgg

SEQ ID NO: 415195 - DNA, 15 bp, Homo sapiens
tttttgaattttgga

SEQ ID NO: 415196 - DNA, 15 bp, Homo sapiens
ttttgaattttggag

SEQ ID NO: 415197 - DNA, 15 bp, Homo sapiens
tttgaattttggaga

SEQ ID NO: 415198 - DNA, 15 bp, Homo sapiens
ttgaattttggagac

SEQ ID NO: 415199 - DNA, 15 bp, Homo sapiens
tgaattttggagaca

SEQ ID NO: 415200 - DNA, 15 bp, Homo sapiens
gaattttggagacat

SEQ ID NO: 415201 - DNA, 15 bp, Homo sapiens
aattttggagacatc

SEQ ID NO: 415202 - DNA, 15 bp, Homo sapiens
attttggagacatcc

SEQ ID NO: 415203 - DNA, 15 bp, Homo sapiens
ttttggagacatcca

SEQ ID NO: 415204 - DNA, 15 bp, Homo sapiens
tttggagacatccag

SEQ ID NO: 415205 - DNA, 15 bp, Homo sapiens
ttggagacatccagt

SEQ ID NO: 415206 - DNA, 15 bp, Homo sapiens
tggagacatccagtg

SEQ ID NO: 415207 - DNA, 15 bp, Homo sapiens
ggagacatccagtgg

SEQ ID NO: 415208 - DNA, 15 bp, Homo sapiens
gagacatccagtggt

SEQ ID NO: 415209 - DNA, 15 bp, Homo sapiens
agacatccagtggtt

SEQ ID NO: 415210 - DNA, 15 bp, Homo sapiens
gacatccagtggttt

SEQ ID NO: 415211 - DNA, 15 bp, Homo sapiens
acatccagtggtttt

SEQ ID NO: 415212 - DNA, 15 bp, Homo sapiens
catccagtggttttg

SEQ ID NO: 415213 - DNA, 15 bp, Homo sapiens
atccagtggttttgt

SEQ ID NO: 415214 - DNA, 15 bp, Homo sapiens
tccagtggttttgtg

SEQ ID NO: 415215 - DNA, 15 bp, Homo sapiens
ccagtggttttgtga

SEQ ID NO: 415216 - DNA, 15 bp, Homo sapiens
cagtggttttgtgat

SEQ ID NO: 415217 - DNA, 15 bp, Homo sapiens
agtggttttgtgatt

SEQ ID NO: 415218 - DNA, 15 bp, Homo sapiens
gtggttttgtgattt

SEQ ID NO: 415219 - DNA, 15 bp, Homo sapiens
tggttttgtgatttt

SEQ ID NO: 415220 - DNA, 15 bp, Homo sapiens
ggttttgtgattttt

SEQ ID NO: 415221 - DNA, 15 bp, Homo sapiens
gttttgtgattttta

SEQ ID NO: 415222 - DNA, 15 bp, Homo sapiens
ttttgtgatttttac

SEQ ID NO: 415223 - DNA, 15 bp, Homo sapiens
tttgtgatttttact

SEQ ID NO: 415224 - DNA, 15 bp, Homo sapiens
ttgtgatttttactg

SEQ ID NO: 415225 - DNA, 15 bp, Homo sapiens
tgtgatttttactgg

SEQ ID NO: 415226 - DNA, 15 bp, Homo sapiens
gtgatttttactgga

SEQ ID NO: 415227 - DNA, 15 bp, Homo sapiens
tgatttttactggat

SEQ ID NO: 415228 - DNA, 15 bp, Homo sapiens
gatttttactggata

SEQ ID NO: 415229 - DNA, 15 bp, Homo sapiens
atttttactggatat

SEQ ID NO: 415230 - DNA, 15 bp, Homo sapiens
tttttactggatata

SEQ ID NO: 415231 - DNA, 15 bp, Homo sapiens
ttttactggatataa

SEQ ID NO: 415232 - DNA, 15 bp, Homo sapiens
tttactggatataag

SEQ ID NO: 415233 - DNA, 15 bp, Homo sapiens
ttactggatataaga

SEQ ID NO: 415234 - DNA, 15 bp, Homo sapiens
tactggatataagaa

SEQ ID NO: 415235 - DNA, 15 bp, Homo sapiens
actggatataagaat

SEQ ID NO: 415236 - DNA, 15 bp, Homo sapiens
ctggatataagaatg

SEQ ID NO: 415237 - DNA, 15 bp, Homo sapiens
tggatataagaatgt

SEQ ID NO: 415238 - DNA, 15 bp, Homo sapiens
ggatataagaatgtt

SEQ ID NO: 415239 - DNA, 15 bp, Homo sapiens
gatataagaatgttt

SEQ ID NO: 415240 - DNA, 15 bp, Homo sapiens
atataagaatgtttg

SEQ ID NO: 415241 - DNA, 15 bp, Homo sapiens
tataagaatgtttgg

SEQ ID NO: 415242 - DNA, 15 bp, Homo sapiens
ataagaatgtttggc

SEQ ID NO: 415243 - DNA, 15 bp, Homo sapiens
taagaatgtttggca

SEQ ID NO: 415244 - DNA, 15 bp, Homo sapiens
aagaatgtttggcat

SEQ ID NO: 415245 - DNA, 15 bp, Homo sapiens
agaatgtttggcatg

SEQ ID NO: 415246 - DNA, 15 bp, Homo sapiens
gaatgtttggcatgt

SEQ ID NO: 415247 - DNA, 15 bp, Homo sapiens
aatgtttggcatgtt

SEQ ID NO: 415248 - DNA, 15 bp, Homo sapiens
atgtttggcatgtta

SEQ ID NO: 415249 - DNA, 15 bp, Homo sapiens
tgtttggcatgttat

SEQ ID NO: 415250 - DNA, 15 bp, Homo sapiens
gtttggcatgttata

SEQ ID NO: 415251 - DNA, 15 bp, Homo sapiens
tttggcatgttatac

SEQ ID NO: 415252 - DNA, 15 bp, Homo sapiens
ttggcatgttatact

SEQ ID NO: 415253 - DNA, 15 bp, Homo sapiens
tggcatgttatactc

SEQ ID NO: 415254 - DNA, 15 bp, Homo sapiens
ggcatgttatactca

SEQ ID NO: 415255 - DNA, 15 bp, Homo sapiens
gcatgttatactcat

SEQ ID NO: 415256 - DNA, 15 bp, Homo sapiens
catgttatactcata

SEQ ID NO: 415257 - DNA, 15 bp, Homo sapiens
atgttatactcatat

SEQ ID NO: 415258 - DNA, 15 bp, Homo sapiens
tgttatactcatata

SEQ ID NO: 415259 - DNA, 15 bp, Homo sapiens
gttatactcatataa

SEQ ID NO: 415260 - DNA, 15 bp, Homo sapiens
ttatactcatataag

SEQ ID NO: 415261 - DNA, 15 bp, Homo sapiens
tatactcatataaga

SEQ ID NO: 415262 - DNA, 15 bp, Homo sapiens
atactcatataagaa

SEQ ID NO: 415263 - DNA, 15 bp, Homo sapiens
tactcatataagaat

SEQ ID NO: 415264 - DNA, 15 bp, Homo sapiens
actcatataagaatg

SEQ ID NO: 415265 - DNA, 15 bp, Homo sapiens
ctcatataagaatgt

SEQ ID NO: 415266 - DNA, 15 bp, Homo sapiens
tcatataagaatgtt

SEQ ID NO: 415267 - DNA, 15 bp, Homo sapiens
catataagaatgttt

SEQ ID NO: 415268 - DNA, 15 bp, Homo sapiens
aatgtttggcatgtg

SEQ ID NO: 415269 - DNA, 15 bp, Homo sapiens
atgtttggcatgtgg

SEQ ID NO: 415270 - DNA, 15 bp, Homo sapiens
tgtttggcatgtggt

SEQ ID NO: 415271 - DNA, 15 bp, Homo sapiens
gtttggcatgtggtt

SEQ ID NO: 415272 - DNA, 15 bp, Homo sapiens
tttggcatgtggttg

SEQ ID NO: 415273 - DNA, 15 bp, Homo sapiens
ttggcatgtggttga

SEQ ID NO: 415274 - DNA, 15 bp, Homo sapiens
tggcatgtggttgag

SEQ ID NO: 415275 - DNA, 15 bp, Homo sapiens
ggcatgtggttgagc

SEQ ID NO: 415276 - DNA, 15 bp, Homo sapiens
gcatgtggttgagca

SEQ ID NO: 415277 - DNA, 15 bp, Homo sapiens
catgtggttgagcac

SEQ ID NO: 415278 - DNA, 15 bp, Homo sapiens
atgtggttgagcacc

SEQ ID NO: 415279 - DNA, 15 bp, Homo sapiens
tgtggttgagcacct

SEQ ID NO: 415280 - DNA, 15 bp, Homo sapiens
gtggttgagcacctt

SEQ ID NO: 415281 - DNA, 15 bp, Homo sapiens
tggttgagcaccttg

SEQ ID NO: 415282 - DNA, 15 bp, Homo sapiens
ggttgagcaccttgt

SEQ ID NO: 415283 - DNA, 15 bp, Homo sapiens
gttgagcaccttgtc

SEQ ID NO: 415284 - DNA, 15 bp, Homo sapiens
ttgagcaccttgtct

SEQ ID NO: 415285 - DNA, 15 bp, Homo sapiens
tgagcaccttgtctc

SEQ ID NO: 415286 - DNA, 15 bp, Homo sapiens
gagcaccttgtctca

SEQ ID NO: 415287 - DNA, 15 bp, Homo sapiens
agcaccttgtctcag

SEQ ID NO: 415288 - DNA, 15 bp, Homo sapiens
gcaccttgtctcagc

SEQ ID NO: 415289 - DNA, 15 bp, Homo sapiens
caccttgtctcagca

SEQ ID NO: 415290 - DNA, 15 bp, Homo sapiens
accttgtctcagcat

SEQ ID NO: 415291 - DNA, 15 bp, Homo sapiens
ccttgtctcagcatg

SEQ ID NO: 415292 - DNA, 15 bp, Homo sapiens
cttgtctcagcatgt

SEQ ID NO: 415293 - DNA, 15 bp, Homo sapiens
ttgtctcagcatgtg

SEQ ID NO: 415294 - DNA, 15 bp, Homo sapiens
tgtctcagcatgtgt

SEQ ID NO: 415295 - DNA, 15 bp, Homo sapiens
gtctcagcatgtgtg

SEQ ID NO: 415296 - DNA, 15 bp, Homo sapiens
tctcagcatgtgtga

SEQ ID NO: 415297 - DNA, 15 bp, Homo sapiens
ctcagcatgtgtgat

SEQ ID NO: 415298 - DNA, 15 bp, Homo sapiens
tcagcatgtgtgatg

SEQ ID NO: 415299 - DNA, 15 bp, Homo sapiens
cagcatgtgtgatgc

SEQ ID NO: 415300 - DNA, 15 bp, Homo sapiens
agcatgtgtgatgct

SEQ ID NO: 415301 - DNA, 15 bp, Homo sapiens
gcatgtgtgatgctg

SEQ ID NO: 415302 - DNA, 15 bp, Homo sapiens
catgtgtgatgctgg

SEQ ID NO: 415303 - DNA, 15 bp, Homo sapiens
atgtgtgatgctggg

SEQ ID NO: 415304 - DNA, 15 bp, Homo sapiens
tgtgtgatgctggga

SEQ ID NO: 415305 - DNA, 15 bp, Homo sapiens
gtgtgatgctgggat

SEQ ID NO: 415306 - DNA, 15 bp, Homo sapiens
tgtgatgctgggatt

SEQ ID NO: 415307 - DNA, 15 bp, Homo sapiens
gtgatgctgggattg

SEQ ID NO: 415308 - DNA, 15 bp, Homo sapiens
tgatgctgggattgt

SEQ ID NO: 415309 - DNA, 15 bp, Homo sapiens
gatgctgggattgta

SEQ ID NO: 415310 - DNA, 15 bp, Homo sapiens
atgctgggattgtag

SEQ ID NO: 415311 - DNA, 15 bp, Homo sapiens
tgctgggattgtagt

SEQ ID NO: 415312 - DNA, 15 bp, Homo sapiens
gctgggattgtagtt

SEQ ID NO: 415313 - DNA, 15 bp, Homo sapiens
ctgggattgtagttt

SEQ ID NO: 415314 - DNA, 15 bp, Homo sapiens
tgggattgtagtttc

SEQ ID NO: 415315 - DNA, 15 bp, Homo sapiens
gggattgtagtttcc

SEQ ID NO: 415316 - DNA, 15 bp, Homo sapiens
ggattgtagtttccc

SEQ ID NO: 415317 - DNA, 15 bp, Homo sapiens
gattgtagtttccca

SEQ ID NO: 415318 - DNA, 15 bp, Homo sapiens
attgtagtttcccag

SEQ ID NO: 415319 - DNA, 15 bp, Homo sapiens
ttgtagtttcccagc

SEQ ID NO: 415320 - DNA, 15 bp, Homo sapiens
tgtagtttcccagca

SEQ ID NO: 415321 - DNA, 15 bp, Homo sapiens
gtagtttcccagcac

SEQ ID NO: 415322 - DNA, 15 bp, Homo sapiens
tagtttcccagcaca

SEQ ID NO: 415323 - DNA, 15 bp, Homo sapiens
agtttcccagcacag

SEQ ID NO: 415324 - DNA, 15 bp, Homo sapiens
gtttcccagcacagg

SEQ ID NO: 415325 - DNA, 15 bp, Homo sapiens
tttcccagcacaggc

SEQ ID NO: 415326 - DNA, 15 bp, Homo sapiens
ttcccagcacaggca

SEQ ID NO: 415327 - DNA, 15 bp, Homo sapiens
tcccagcacaggcag

SEQ ID NO: 415328 - DNA, 15 bp, Homo sapiens
cccagcacaggcagg

SEQ ID NO: 415329 - DNA, 15 bp, Homo sapiens
ccagcacaggcagga

SEQ ID NO: 415330 - DNA, 15 bp, Homo sapiens
cagcacaggcaggat

SEQ ID NO: 415331 - DNA, 15 bp, Homo sapiens
agcacaggcaggatg

SEQ ID NO: 415332 - DNA, 15 bp, Homo sapiens
gcacaggcaggatgg

SEQ ID NO: 415333 - DNA, 15 bp, Homo sapiens
cacaggcaggatggg

SEQ ID NO: 415334 - DNA, 15 bp, Homo sapiens
acaggcaggatgggc

SEQ ID NO: 415335 - DNA, 15 bp, Homo sapiens
caggcaggatgggca

SEQ ID NO: 415336 - DNA, 15 bp, Homo sapiens
aggcaggatgggcaa

SEQ ID NO: 415337 - DNA, 15 bp, Homo sapiens
ggcaggatgggcaat

SEQ ID NO: 415338 - DNA, 15 bp, Homo sapiens
gcaggatgggcaatt

SEQ ID NO: 415339 - DNA, 15 bp, Homo sapiens
caggatgggcaattt

SEQ ID NO: 415340 - DNA, 15 bp, Homo sapiens
aggatgggcaatttc

SEQ ID NO: 415341 - DNA, 15 bp, Homo sapiens
ggatgggcaatttct

SEQ ID NO: 415342 - DNA, 15 bp, Homo sapiens
gatgggcaatttctt

SEQ ID NO: 415343 - DNA, 15 bp, Homo sapiens
atgggcaatttctta

SEQ ID NO: 415344 - DNA, 15 bp, Homo sapiens
tgggcaatttcttac

SEQ ID NO: 415345 - DNA, 15 bp, Homo sapiens
gggcaatttcttaca

SEQ ID NO: 415346 - DNA, 15 bp, Homo sapiens
ggcaatttcttacat

SEQ ID NO: 415347 - DNA, 15 bp, Homo sapiens
gcaatttcttacatt

SEQ ID NO: 415348 - DNA, 15 bp, Homo sapiens
caatttcttacattg

SEQ ID NO: 415349 - DNA, 15 bp, Homo sapiens
aatttcttacattgg

SEQ ID NO: 415350 - DNA, 15 bp, Homo sapiens
atttcttacattggg

SEQ ID NO: 415351 - DNA, 15 bp, Homo sapiens
tttcttacattgggt

SEQ ID NO: 415352 - DNA, 15 bp, Homo sapiens
ttcttacattgggta

SEQ ID NO: 415353 - DNA, 15 bp, Homo sapiens
tcttacattgggtac

SEQ ID NO: 415354 - DNA, 15 bp, Homo sapiens
cttacattgggtact

SEQ ID NO: 415355 - DNA, 15 bp, Homo sapiens
ttacattgggtactg

SEQ ID NO: 415356 - DNA, 15 bp, Homo sapiens
tacattgggtactga

SEQ ID NO: 415357 - DNA, 15 bp, Homo sapiens
acattgggtactgat

SEQ ID NO: 415358 - DNA, 15 bp, Homo sapiens
cattgggtactgatt

SEQ ID NO: 415359 - DNA, 15 bp, Homo sapiens
attgggtactgattt

SEQ ID NO: 415360 - DNA, 15 bp, Homo sapiens
ttgggtactgatttc

SEQ ID NO: 415361 - DNA, 15 bp, Homo sapiens
tgggtactgatttct

SEQ ID NO: 415362 - DNA, 15 bp, Homo sapiens
gggtactgatttcta

SEQ ID NO: 415363 - DNA, 15 bp, Homo sapiens
ggtactgatttctag

SEQ ID NO: 415364 - DNA, 15 bp, Homo sapiens
gtactgatttctagt

SEQ ID NO: 415365 - DNA, 15 bp, Homo sapiens
tactgatttctagtc

SEQ ID NO: 415366 - DNA, 15 bp, Homo sapiens
actgatttctagtct

SEQ ID NO: 415367 - DNA, 15 bp, Homo sapiens
ctgatttctagtctt

SEQ ID NO: 415368 - DNA, 15 bp, Homo sapiens
tgatttctagtcttc

SEQ ID NO: 415369 - DNA, 15 bp, Homo sapiens
gatttctagtcttct

SEQ ID NO: 415370 - DNA, 15 bp, Homo sapiens
atttctagtcttcta

SEQ ID NO: 415371 - DNA, 15 bp, Homo sapiens
tttctagtcttctag

SEQ ID NO: 415372 - DNA, 15 bp, Homo sapiens
ttctagtcttctaga

SEQ ID NO: 415373 - DNA, 15 bp, Homo sapiens
tctagtcttctagaa

SEQ ID NO: 415374 - DNA, 15 bp, Homo sapiens
ctagtcttctagaac

SEQ ID NO: 415375 - DNA, 15 bp, Homo sapiens
tagtcttctagaacc

SEQ ID NO: 415376 - DNA, 15 bp, Homo sapiens
agtcttctagaacca

SEQ ID NO: 415377 - DNA, 15 bp, Homo sapiens
gtcttctagaaccag

SEQ ID NO: 415378 - DNA, 15 bp, Homo sapiens
tcttctagaaccaga

SEQ ID NO: 415379 - DNA, 15 bp, Homo sapiens
cttctagaaccagaa

SEQ ID NO: 415380 - DNA, 15 bp, Homo sapiens
ttctagaaccagaaa

SEQ ID NO: 415381 - DNA, 15 bp, Homo sapiens
tctagaaccagaaag

SEQ ID NO: 415382 - DNA, 15 bp, Homo sapiens
ctagaaccagaaagg

SEQ ID NO: 415383 - DNA, 15 bp, Homo sapiens
tagaaccagaaaggg

SEQ ID NO: 415384 - DNA, 15 bp, Homo sapiens
agaaccagaaagggc

SEQ ID NO: 415385 - DNA, 15 bp, Homo sapiens
gaaccagaaagggca

SEQ ID NO: 415386 - DNA, 15 bp, Homo sapiens
aaccagaaagggcaa

SEQ ID NO: 415387 - DNA, 15 bp, Homo sapiens
accagaaagggcaag

SEQ ID NO: 415388 - DNA, 15 bp, Homo sapiens
ccagaaagggcaagg

SEQ ID NO: 415389 - DNA, 15 bp, Homo sapiens
cagaaagggcaaggc

SEQ ID NO: 415390 - DNA, 15 bp, Homo sapiens
agaaagggcaaggct

SEQ ID NO: 415391 - DNA, 15 bp, Homo sapiens
gaaagggcaaggcta

SEQ ID NO: 415392 - DNA, 15 bp, Homo sapiens
aaagggcaaggctag

SEQ ID NO: 415393 - DNA, 15 bp, Homo sapiens
aagggcaaggctagg

SEQ ID NO: 415394 - DNA, 15 bp, Homo sapiens
agggcaaggctagga

SEQ ID NO: 415395 - DNA, 15 bp, Homo sapiens
gggcaaggctaggag

SEQ ID NO: 415396 - DNA, 15 bp, Homo sapiens
ggcaaggctaggagt

SEQ ID NO: 415397 - DNA, 15 bp, Homo sapiens
gcaaggctaggagtc

SEQ ID NO: 415398 - DNA, 15 bp, Homo sapiens
caaggctaggagtct

SEQ ID NO: 415399 - DNA, 15 bp, Homo sapiens
aaggctaggagtctc

SEQ ID NO: 415400 - DNA, 15 bp, Homo sapiens
aggctaggagtctct

SEQ ID NO: 415401 - DNA, 15 bp, Homo sapiens
ggctaggagtctctt

SEQ ID NO: 415402 - DNA, 15 bp, Homo sapiens
gctaggagtctcttg

SEQ ID NO: 415403 - DNA, 15 bp, Homo sapiens
ctaggagtctcttgc

SEQ ID NO: 415404 - DNA, 15 bp, Homo sapiens
taggagtctcttgca

SEQ ID NO: 415405 - DNA, 15 bp, Homo sapiens
aggagtctcttgcag

SEQ ID NO: 415406 - DNA, 15 bp, Homo sapiens
ggagtctcttgcagg

SEQ ID NO: 415407 - DNA, 15 bp, Homo sapiens
gagtctcttgcaggc

SEQ ID NO: 415408 - DNA, 15 bp, Homo sapiens
agtctcttgcaggca

SEQ ID NO: 415409 - DNA, 15 bp, Homo sapiens
gtctcttgcaggcag

SEQ ID NO: 415410 - DNA, 15 bp, Homo sapiens
tctcttgcaggcagg

SEQ ID NO: 415411 - DNA, 15 bp, Homo sapiens
ctcttgcaggcagga

SEQ ID NO: 415412 - DNA, 15 bp, Homo sapiens
tcttgcaggcaggaa

SEQ ID NO: 415413 - DNA, 15 bp, Homo sapiens
cttgcaggcaggaag

SEQ ID NO: 415414 - DNA, 15 bp, Homo sapiens
ttgcaggcaggaagt

SEQ ID NO: 415415 - DNA, 15 bp, Homo sapiens
tgcaggcaggaagta

SEQ ID NO: 415416 - DNA, 15 bp, Homo sapiens
gcaggcaggaagtat

SEQ ID NO: 415417 - DNA, 15 bp, Homo sapiens
caggcaggaagtatt

SEQ ID NO: 415418 - DNA, 15 bp, Homo sapiens
aggcaggaagtatta

SEQ ID NO: 415419 - DNA, 15 bp, Homo sapiens
ggcaggaagtattat

SEQ ID NO: 415420 - DNA, 15 bp, Homo sapiens
gcaggaagtattatg

SEQ ID NO: 415421 - DNA, 15 bp, Homo sapiens
caggaagtattatgt

SEQ ID NO: 415422 - DNA, 15 bp, Homo sapiens
aggaagtattatgtt

SEQ ID NO: 415423 - DNA, 15 bp, Homo sapiens
ggaagtattatgttc

SEQ ID NO: 415424 - DNA, 15 bp, Homo sapiens
gaagtattatgttcc

SEQ ID NO: 415425 - DNA, 15 bp, Homo sapiens
aagtattatgttcct

SEQ ID NO: 415426 - DNA, 15 bp, Homo sapiens
agtattatgttccta

SEQ ID NO: 415427 - DNA, 15 bp, Homo sapiens
gtattatgttcctac

SEQ ID NO: 415428 - DNA, 15 bp, Homo sapiens
tattatgttcctaca

SEQ ID NO: 415429 - DNA, 15 bp, Homo sapiens
attatgttcctacaa

SEQ ID NO: 415430 - DNA, 15 bp, Homo sapiens
ttatgttcctacaag

SEQ ID NO: 415431 - DNA, 15 bp, Homo sapiens
tatgttcctacaaga

SEQ ID NO: 415432 - DNA, 15 bp, Homo sapiens
atgttcctacaagat

SEQ ID NO: 415433 - DNA, 15 bp, Homo sapiens
tgttcctacaagatg

SEQ ID NO: 415434 - DNA, 15 bp, Homo sapiens
gttcctacaagatga

SEQ ID NO: 415435 - DNA, 15 bp, Homo sapiens
ttcctacaagatgac

SEQ ID NO: 415436 - DNA, 15 bp, Homo sapiens
tcctacaagatgaca

SEQ ID NO: 415437 - DNA, 15 bp, Homo sapiens
cctacaagatgacag

SEQ ID NO: 415438 - DNA, 15 bp, Homo sapiens
ctacaagatgacagc

SEQ ID NO: 415439 - DNA, 15 bp, Homo sapiens
tacaagatgacagct

SEQ ID NO: 415440 - DNA, 15 bp, Homo sapiens
acaagatgacagctc

SEQ ID NO: 415441 - DNA, 15 bp, Homo sapiens
caagatgacagctca

SEQ ID NO: 415442 - DNA, 15 bp, Homo sapiens
aagatgacagctcat

SEQ ID NO: 415443 - DNA, 15 bp, Homo sapiens
agatgacagctcatt

SEQ ID NO: 415444 - DNA, 15 bp, Homo sapiens
gatgacagctcatta

SEQ ID NO: 415445 - DNA, 15 bp, Homo sapiens
atgacagctcattac

SEQ ID NO: 415446 - DNA, 15 bp, Homo sapiens
tgacagctcattaca

SEQ ID NO: 415447 - DNA, 15 bp, Homo sapiens
gacagctcattacag

SEQ ID NO: 415448 - DNA, 15 bp, Homo sapiens
acagctcattacaga

SEQ ID NO: 415449 - DNA, 15 bp, Homo sapiens
cagctcattacagat

SEQ ID NO: 415450 - DNA, 15 bp, Homo sapiens
agctcattacagatt

SEQ ID NO: 415451 - DNA, 15 bp, Homo sapiens
gctcattacagatta

SEQ ID NO: 415452 - DNA, 15 bp, Homo sapiens
ctcattacagattag

SEQ ID NO: 415453 - DNA, 15 bp, Homo sapiens
tcattacagattagg

SEQ ID NO: 415454 - DNA, 15 bp, Homo sapiens
cattacagattagga

SEQ ID NO: 415455 - DNA, 15 bp, Homo sapiens
attacagattaggaa

SEQ ID NO: 415456 - DNA, 15 bp, Homo sapiens
ttacagattaggaag

SEQ ID NO: 415457 - DNA, 15 bp, Homo sapiens
tacagattaggaagg

SEQ ID NO: 415458 - DNA, 15 bp, Homo sapiens
acagattaggaaggc

SEQ ID NO: 415459 - DNA, 15 bp, Homo sapiens
cagattaggaaggcc

SEQ ID NO: 415460 - DNA, 15 bp, Homo sapiens
agattaggaaggccc

SEQ ID NO: 415461 - DNA, 15 bp, Homo sapiens
gattaggaaggccca

SEQ ID NO: 415462 - DNA, 15 bp, Homo sapiens
attaggaaggcccaa

SEQ ID NO: 415463 - DNA, 15 bp, Homo sapiens
ttaggaaggcccaat

SEQ ID NO: 415464 - DNA, 15 bp, Homo sapiens
taggaaggcccaatt

SEQ ID NO: 415465 - DNA, 15 bp, Homo sapiens
aggaaggcccaattg

SEQ ID NO: 415466 - DNA, 15 bp, Homo sapiens
ggaaggcccaattgg

SEQ ID NO: 415467 - DNA, 15 bp, Homo sapiens
gaaggcccaattgga

SEQ ID NO: 415468 - DNA, 15 bp, Homo sapiens
aaggcccaattggag

SEQ ID NO: 415469 - DNA, 15 bp, Homo sapiens
aggcccaattggagg

SEQ ID NO: 415470 - DNA, 15 bp, Homo sapiens
ggcccaattggaggg

SEQ ID NO: 415471 - DNA, 15 bp, Homo sapiens
gcccaattggaggga

SEQ ID NO: 415472 - DNA, 15 bp, Homo sapiens
cccaattggagggaa

SEQ ID NO: 415473 - DNA, 15 bp, Homo sapiens
ccaattggagggaac

SEQ ID NO: 415474 - DNA, 15 bp, Homo sapiens
caattggagggaacc

SEQ ID NO: 415475 - DNA, 15 bp, Homo sapiens
aattggagggaacca

SEQ ID NO: 415476 - DNA, 15 bp, Homo sapiens
attggagggaaccat

SEQ ID NO: 415477 - DNA, 15 bp, Homo sapiens
ttggagggaaccatg

SEQ ID NO: 415478 - DNA, 15 bp, Homo sapiens
tggagggaaccatgc

SEQ ID NO: 415479 - DNA, 15 bp, Homo sapiens
ggagggaaccatgcc

SEQ ID NO: 415480 - DNA, 15 bp, Homo sapiens
gagggaaccatgcca

SEQ ID NO: 415481 - DNA, 15 bp, Homo sapiens
agggaaccatgccaa

SEQ ID NO: 415482 - DNA, 15 bp, Homo sapiens
gggaaccatgccaac

SEQ ID NO: 415483 - DNA, 15 bp, Homo sapiens
ggaaccatgccaact

SEQ ID NO: 415484 - DNA, 15 bp, Homo sapiens
gaaccatgccaactc

SEQ ID NO: 415485 - DNA, 15 bp, Homo sapiens
aaccatgccaactcg

SEQ ID NO: 415486 - DNA, 15 bp, Homo sapiens
accatgccaactcga

SEQ ID NO: 415487 - DNA, 15 bp, Homo sapiens
ccatgccaactcgag

SEQ ID NO: 415488 - DNA, 15 bp, Homo sapiens
catgccaactcgagt

SEQ ID NO: 415489 - DNA, 15 bp, Homo sapiens
atgccaactcgagtg

SEQ ID NO: 415490 - DNA, 15 bp, Homo sapiens
tgccaactcgagtgg

SEQ ID NO: 415491 - DNA, 15 bp, Homo sapiens
gccaactcgagtggt

SEQ ID NO: 415492 - DNA, 15 bp, Homo sapiens
ccaactcgagtggta

SEQ ID NO: 415493 - DNA, 15 bp, Homo sapiens
caactcgagtggtac

SEQ ID NO: 415494 - DNA, 15 bp, Homo sapiens
aactcgagtggtacc

SEQ ID NO: 415495 - DNA, 15 bp, Homo sapiens
actcgagtggtacct

SEQ ID NO: 415496 - DNA, 15 bp, Homo sapiens
ctcgagtggtaccta

SEQ ID NO: 415497 - DNA, 15 bp, Homo sapiens
tcgagtggtacctaa

SEQ ID NO: 415498 - DNA, 15 bp, Homo sapiens
cgagtggtacctaaa

SEQ ID NO: 415499 - DNA, 15 bp, Homo sapiens
gagtggtacctaaag

SEQ ID NO: 415500 - DNA, 15 bp, Homo sapiens
agtggtacctaaaga

SEQ ID NO: 415501 - DNA, 15 bp, Homo sapiens
gtggtacctaaagag

SEQ ID NO: 415502 - DNA, 15 bp, Homo sapiens
tggtacctaaagagg

SEQ ID NO: 415503 - DNA, 15 bp, Homo sapiens
ggtacctaaagagga

SEQ ID NO: 415504 - DNA, 15 bp, Homo sapiens
gtacctaaagaggaa

SEQ ID NO: 415505 - DNA, 15 bp, Homo sapiens
tacctaaagaggaag

SEQ ID NO: 415506 - DNA, 15 bp, Homo sapiens
acctaaagaggaaga

SEQ ID NO: 415507 - DNA, 15 bp, Homo sapiens
cctaaagaggaagaa

SEQ ID NO: 415508 - DNA, 15 bp, Homo sapiens
ctaaagaggaagaac

SEQ ID NO: 415509 - DNA, 15 bp, Homo sapiens
taaagaggaagaact

SEQ ID NO: 415510 - DNA, 15 bp, Homo sapiens
aaagaggaagaactt

SEQ ID NO: 415511 - DNA, 15 bp, Homo sapiens
aagaggaagaacttc

SEQ ID NO: 415512 - DNA, 15 bp, Homo sapiens
agaggaagaacttct

SEQ ID NO: 415513 - DNA, 15 bp, Homo sapiens
gaggaagaacttctt

SEQ ID NO: 415514 - DNA, 15 bp, Homo sapiens
aggaagaacttctta

SEQ ID NO: 415515 - DNA, 15 bp, Homo sapiens
ggaagaacttcttac

SEQ ID NO: 415516 - DNA, 15 bp, Homo sapiens
gaagaacttcttacc

SEQ ID NO: 415517 - DNA, 15 bp, Homo sapiens
aagaacttcttacca

SEQ ID NO: 415518 - DNA, 15 bp, Homo sapiens
agaacttcttaccag

SEQ ID NO: 415519 - DNA, 15 bp, Homo sapiens
gaacttcttaccagg

SEQ ID NO: 415520 - DNA, 15 bp, Homo sapiens
aacttcttaccaggg

SEQ ID NO: 415521 - DNA, 15 bp, Homo sapiens
acttcttaccagggg

SEQ ID NO: 415522 - DNA, 15 bp, Homo sapiens
cttcttaccagggga

SEQ ID NO: 415523 - DNA, 15 bp, Homo sapiens
ttcttaccaggggag

SEQ ID NO: 415524 - DNA, 15 bp, Homo sapiens
tcttaccaggggagg

SEQ ID NO: 415525 - DNA, 15 bp, Homo sapiens
cttaccaggggagga

SEQ ID NO: 415526 - DNA, 15 bp, Homo sapiens
ttaccaggggaggat

SEQ ID NO: 415527 - DNA, 15 bp, Homo sapiens
taccaggggaggatg

SEQ ID NO: 415528 - DNA, 15 bp, Homo sapiens
accaggggaggatga

SEQ ID NO: 415529 - DNA, 15 bp, Homo sapiens
ccaggggaggatgac

SEQ ID NO: 415530 - DNA, 15 bp, Homo sapiens
caggggaggatgacc

SEQ ID NO: 415531 - DNA, 15 bp, Homo sapiens
aggggaggatgaccc

SEQ ID NO: 415532 - DNA, 15 bp, Homo sapiens
ggggaggatgacccc

SEQ ID NO: 415533 - DNA, 15 bp, Homo sapiens
gggaggatgacccca

SEQ ID NO: 415534 - DNA, 15 bp, Homo sapiens
ggaggatgaccccat

SEQ ID NO: 415535 - DNA, 15 bp, Homo sapiens
gaggatgaccccata

SEQ ID NO: 415536 - DNA, 15 bp, Homo sapiens
aggatgaccccatac

SEQ ID NO: 415537 - DNA, 15 bp, Homo sapiens
ggatgaccccatacc

SEQ ID NO: 415538 - DNA, 15 bp, Homo sapiens
gatgaccccatacca

SEQ ID NO: 415539 - DNA, 15 bp, Homo sapiens
atgaccccataccaa

SEQ ID NO: 415540 - DNA, 15 bp, Homo sapiens
tgaccccataccaag

SEQ ID NO: 415541 - DNA, 15 bp, Homo sapiens
gaccccataccaaga

SEQ ID NO: 415542 - DNA, 15 bp, Homo sapiens
accccataccaagat

SEQ ID NO: 415543 - DNA, 15 bp, Homo sapiens
ccccataccaagatg

SEQ ID NO: 415544 - DNA, 15 bp, Homo sapiens
cccataccaagatgt

SEQ ID NO: 415545 - DNA, 15 bp, Homo sapiens
ccataccaagatgtg

SEQ ID NO: 415546 - DNA, 15 bp, Homo sapiens
cataccaagatgtgc

SEQ ID NO: 415547 - DNA, 15 bp, Homo sapiens
ataccaagatgtgcc

SEQ ID NO: 415548 - DNA, 15 bp, Homo sapiens
taccaagatgtgcct

SEQ ID NO: 415549 - DNA, 15 bp, Homo sapiens
accaagatgtgcctg

SEQ ID NO: 415550 - DNA, 15 bp, Homo sapiens
ccaagatgtgcctgc

SEQ ID NO: 415551 - DNA, 15 bp, Homo sapiens
caagatgtgcctgcc

SEQ ID NO: 415552 - DNA, 15 bp, Homo sapiens
aagatgtgcctgcca

SEQ ID NO: 415553 - DNA, 15 bp, Homo sapiens
agatgtgcctgccag

SEQ ID NO: 415554 - DNA, 15 bp, Homo sapiens
gatgtgcctgccagc

SEQ ID NO: 415555 - DNA, 15 bp, Homo sapiens
atgtgcctgccagca

SEQ ID NO: 415556 - DNA, 15 bp, Homo sapiens
tgtgcctgccagcaa

SEQ ID NO: 415557 - DNA, 15 bp, Homo sapiens
gtgcctgccagcaag

SEQ ID NO: 415558 - DNA, 15 bp, Homo sapiens
tgcctgccagcaagc

SEQ ID NO: 415559 - DNA, 15 bp, Homo sapiens
gcctgccagcaagca

SEQ ID NO: 415560 - DNA, 15 bp, Homo sapiens
cctgccagcaagcag

SEQ ID NO: 415561 - DNA, 15 bp, Homo sapiens
ctgccagcaagcagg

SEQ ID NO: 415562 - DNA, 15 bp, Homo sapiens
tgccagcaagcaggt

SEQ ID NO: 415563 - DNA, 15 bp, Homo sapiens
gccagcaagcaggtc

SEQ ID NO: 415564 - DNA, 15 bp, Homo sapiens
ccagcaagcaggtcc

SEQ ID NO: 415565 - DNA, 15 bp, Homo sapiens
cagcaagcaggtcct

SEQ ID NO: 415566 - DNA, 15 bp, Homo sapiens
agcaagcaggtccta

SEQ ID NO: 415567 - DNA, 15 bp, Homo sapiens
gcaagcaggtcctaa

SEQ ID NO: 415568 - DNA, 15 bp, Homo sapiens
caagcaggtcctaat

SEQ ID NO: 415569 - DNA, 15 bp, Homo sapiens
aagcaggtcctaatc

SEQ ID NO: 415570 - DNA, 15 bp, Homo sapiens
agcaggtcctaatca

SEQ ID NO: 415571 - DNA, 15 bp, Homo sapiens
gcaggtcctaatcat

SEQ ID NO: 415572 - DNA, 15 bp, Homo sapiens
caggtcctaatcatc

SEQ ID NO: 415573 - DNA, 15 bp, Homo sapiens
aggtcctaatcatct

SEQ ID NO: 415574 - DNA, 15 bp, Homo sapiens
ggtcctaatcatcta

SEQ ID NO: 415575 - DNA, 15 bp, Homo sapiens
gtcctaatcatctaa

SEQ ID NO: 415576 - DNA, 15 bp, Homo sapiens
tcctaatcatctaac

SEQ ID NO: 415577 - DNA, 15 bp, Homo sapiens
cctaatcatctaaca

SEQ ID NO: 415578 - DNA, 15 bp, Homo sapiens
ctaatcatctaacaa

SEQ ID NO: 415579 - DNA, 15 bp, Homo sapiens
taatcatctaacaaa

SEQ ID NO: 415580 - DNA, 15 bp, Homo sapiens
aatcatctaacaaag

SEQ ID NO: 415581 - DNA, 15 bp, Homo sapiens
atcatctaacaaagt

SEQ ID NO: 415582 - DNA, 15 bp, Homo sapiens
tcatctaacaaagtg

SEQ ID NO: 415583 - DNA, 15 bp, Homo sapiens
catctaacaaagtga

SEQ ID NO: 415584 - DNA, 15 bp, Homo sapiens
atctaacaaagtgat

SEQ ID NO: 415585 - DNA, 15 bp, Homo sapiens
tctaacaaagtgata

SEQ ID NO: 415586 - DNA, 15 bp, Homo sapiens
ctaacaaagtgataa

SEQ ID NO: 415587 - DNA, 15 bp, Homo sapiens
taacaaagtgataag

SEQ ID NO: 415588 - DNA, 15 bp, Homo sapiens
aacaaagtgataagg

SEQ ID NO: 415589 - DNA, 15 bp, Homo sapiens
acaaagtgataaggg

SEQ ID NO: 415590 - DNA, 15 bp, Homo sapiens
caaagtgataaggga

SEQ ID NO: 415591 - DNA, 15 bp, Homo sapiens
aaagtgataagggat

SEQ ID NO: 415592 - DNA, 15 bp, Homo sapiens
aagtgataagggatg

SEQ ID NO: 415593 - DNA, 15 bp, Homo sapiens
agtgataagggatga

SEQ ID NO: 415594 - DNA, 15 bp, Homo sapiens
gtgataagggatgag

SEQ ID NO: 415595 - DNA, 15 bp, Homo sapiens
tgataagggatgaga

SEQ ID NO: 415596 - DNA, 15 bp, Homo sapiens
gataagggatgagaa

SEQ ID NO: 415597 - DNA, 15 bp, Homo sapiens
ataagggatgagaag

SEQ ID NO: 415598 - DNA, 15 bp, Homo sapiens
taagggatgagaagt

SEQ ID NO: 415599 - DNA, 15 bp, Homo sapiens
aagggatgagaagtt

SEQ ID NO: 415600 - DNA, 15 bp, Homo sapiens
agggatgagaagttg

SEQ ID NO: 415601 - DNA, 15 bp, Homo sapiens
gggatgagaagttgt

SEQ ID NO: 415602 - DNA, 15 bp, Homo sapiens
ggatgagaagttgtg

SEQ ID NO: 415603 - DNA, 15 bp, Homo sapiens
gatgagaagttgtgg

SEQ ID NO: 415604 - DNA, 15 bp, Homo sapiens
atgagaagttgtggc

SEQ ID NO: 415605 - DNA, 15 bp, Homo sapiens
tgagaagttgtggcc

SEQ ID NO: 415606 - DNA, 15 bp, Homo sapiens
gagaagttgtggcca

SEQ ID NO: 415607 - DNA, 15 bp, Homo sapiens
agaagttgtggccat

SEQ ID NO: 415608 - DNA, 15 bp, Homo sapiens
gaagttgtggccatg

SEQ ID NO: 415609 - DNA, 15 bp, Homo sapiens
aagttgtggccatgg

SEQ ID NO: 415610 - DNA, 15 bp, Homo sapiens
agttgtggccatggg

SEQ ID NO: 415611 - DNA, 15 bp, Homo sapiens
gttgtggccatgggc

SEQ ID NO: 415612 - DNA, 15 bp, Homo sapiens
ttgtggccatgggct

SEQ ID NO: 415613 - DNA, 15 bp, Homo sapiens
tgtggccatgggctc

SEQ ID NO: 415614 - DNA, 15 bp, Homo sapiens
gtggccatgggctca

SEQ ID NO: 415615 - DNA, 15 bp, Homo sapiens
tggccatgggctcaa

SEQ ID NO: 415616 - DNA, 15 bp, Homo sapiens
ggccatgggctcaag

SEQ ID NO: 415617 - DNA, 15 bp, Homo sapiens
gccatgggctcaagg

SEQ ID NO: 415618 - DNA, 15 bp, Homo sapiens
ccatgggctcaaggg

SEQ ID NO: 415619 - DNA, 15 bp, Homo sapiens
catgggctcaagggt

SEQ ID NO: 415620 - DNA, 15 bp, Homo sapiens
atgggctcaagggtg

SEQ ID NO: 415621 - DNA, 15 bp, Homo sapiens
tgggctcaagggtga

SEQ ID NO: 415622 - DNA, 15 bp, Homo sapiens
gggctcaagggtgac

SEQ ID NO: 415623 - DNA, 15 bp, Homo sapiens
ggctcaagggtgact

SEQ ID NO: 415624 - DNA, 15 bp, Homo sapiens
gctcaagggtgacta

SEQ ID NO: 415625 - DNA, 15 bp, Homo sapiens
ctcaagggtgactat

SEQ ID NO: 415626 - DNA, 15 bp, Homo sapiens
tcaagggtgactatg

SEQ ID NO: 415627 - DNA, 15 bp, Homo sapiens
caagggtgactatgg

SEQ ID NO: 415628 - DNA, 15 bp, Homo sapiens
aagggtgactatggg

SEQ ID NO: 415629 - DNA, 15 bp, Homo sapiens
agggtgactatggga

SEQ ID NO: 415630 - DNA, 15 bp, Homo sapiens
gggtgactatgggaa

SEQ ID NO: 415631 - DNA, 15 bp, Homo sapiens
ggtgactatgggaag

SEQ ID NO: 415632 - DNA, 15 bp, Homo sapiens
gtgactatgggaaga

SEQ ID NO: 415633 - DNA, 15 bp, Homo sapiens
tgactatgggaagag

SEQ ID NO: 415634 - DNA, 15 bp, Homo sapiens
gactatgggaagagt

SEQ ID NO: 415635 - DNA, 15 bp, Homo sapiens
actatgggaagagtt

SEQ ID NO: 415636 - DNA, 15 bp, Homo sapiens
ctatgggaagagttc

SEQ ID NO: 415637 - DNA, 15 bp, Homo sapiens
tatgggaagagttca

SEQ ID NO: 415638 - DNA, 15 bp, Homo sapiens
atgggaagagttcac

SEQ ID NO: 415639 - DNA, 15 bp, Homo sapiens
tgggaagagttcaca

SEQ ID NO: 415640 - DNA, 15 bp, Homo sapiens
gggaagagttcacat

SEQ ID NO: 415641 - DNA, 15 bp, Homo sapiens
ggaagagttcacatt

SEQ ID NO: 415642 - DNA, 15 bp, Homo sapiens
gaagagttcacattc

SEQ ID NO: 415643 - DNA, 15 bp, Homo sapiens
aagagttcacattca

SEQ ID NO: 415644 - DNA, 15 bp, Homo sapiens
agagttcacattcaa

SEQ ID NO: 415645 - DNA, 15 bp, Homo sapiens
gagttcacattcaaa

SEQ ID NO: 415646 - DNA, 15 bp, Homo sapiens
agttcacattcaaag

SEQ ID NO: 415647 - DNA, 15 bp, Homo sapiens
gttcacattcaaagt

SEQ ID NO: 415648 - DNA, 15 bp, Homo sapiens
ttcacattcaaagtt

SEQ ID NO: 415649 - DNA, 15 bp, Homo sapiens
tcacattcaaagttg

SEQ ID NO: 415650 - DNA, 15 bp, Homo sapiens
cacattcaaagttga

SEQ ID NO: 415651 - DNA, 15 bp, Homo sapiens
acattcaaagttgac

SEQ ID NO: 415652 - DNA, 15 bp, Homo sapiens
cattcaaagttgact

SEQ ID NO: 415653 - DNA, 15 bp, Homo sapiens
attcaaagttgacta

SEQ ID NO: 415654 - DNA, 15 bp, Homo sapiens
ttcaaagttgactag

SEQ ID NO: 415655 - DNA, 15 bp, Homo sapiens
tcaaagttgactagt

SEQ ID NO: 415656 - DNA, 15 bp, Homo sapiens
caaagttgactagtc

SEQ ID NO: 415657 - DNA, 15 bp, Homo sapiens
aaagttgactagtcc

SEQ ID NO: 415658 - DNA, 15 bp, Homo sapiens
aagttgactagtcca

SEQ ID NO: 415659 - DNA, 15 bp, Homo sapiens
agttgactagtccac

SEQ ID NO: 415660 - DNA, 15 bp, Homo sapiens
gttgactagtccacc

SEQ ID NO: 415661 - DNA, 15 bp, Homo sapiens
ttgactagtccacca

SEQ ID NO: 415662 - DNA, 15 bp, Homo sapiens
tgactagtccaccaa

SEQ ID NO: 415663 - DNA, 15 bp, Homo sapiens
gactagtccaccaac

SEQ ID NO: 415664 - DNA, 15 bp, Homo sapiens
actagtccaccaaca

SEQ ID NO: 415665 - DNA, 15 bp, Homo sapiens
ctagtccaccaacac

SEQ ID NO: 415666 - DNA, 15 bp, Homo sapiens
tagtccaccaacaca

SEQ ID NO: 415667 - DNA, 15 bp, Homo sapiens
agtccaccaacacac

SEQ ID NO: 415668 - DNA, 15 bp, Homo sapiens
gtccaccaacacacc

SEQ ID NO: 415669 - DNA, 15 bp, Homo sapiens
tccaccaacacacct

SEQ ID NO: 415670 - DNA, 15 bp, Homo sapiens
ccaccaacacacctc

SEQ ID NO: 415671 - DNA, 15 bp, Homo sapiens
caccaacacacctct

SEQ ID NO: 415672 - DNA, 15 bp, Homo sapiens
accaacacacctctc

SEQ ID NO: 415673 - DNA, 15 bp, Homo sapiens
ccaacacacctctct

SEQ ID NO: 415674 - DNA, 15 bp, Homo sapiens
caacacacctctctg

SEQ ID NO: 415675 - DNA, 15 bp, Homo sapiens
aacacacctctctga

SEQ ID NO: 415676 - DNA, 15 bp, Homo sapiens
acacacctctctgag

SEQ ID NO: 415677 - DNA, 15 bp, Homo sapiens
cacacctctctgaga

SEQ ID NO: 415678 - DNA, 15 bp, Homo sapiens
acacctctctgagat

SEQ ID NO: 415679 - DNA, 15 bp, Homo sapiens
cacctctctgagatc

SEQ ID NO: 415680 - DNA, 15 bp, Homo sapiens
acctctctgagatcc

SEQ ID NO: 415681 - DNA, 15 bp, Homo sapiens
cctctctgagatcca

SEQ ID NO: 415682 - DNA, 15 bp, Homo sapiens
ctctctgagatccag

SEQ ID NO: 415683 - DNA, 15 bp, Homo sapiens
tctctgagatccagc

SEQ ID NO: 415684 - DNA, 15 bp, Homo sapiens
ctctgagatccagcc

SEQ ID NO: 415685 - DNA, 15 bp, Homo sapiens
tctgagatccagcca

SEQ ID NO: 415686 - DNA, 15 bp, Homo sapiens
ctgagatccagccaa

SEQ ID NO: 415687 - DNA, 15 bp, Homo sapiens
tgagatccagccaat

SEQ ID NO: 415688 - DNA, 15 bp, Homo sapiens
gagatccagccaata

SEQ ID NO: 415689 - DNA, 15 bp, Homo sapiens
agatccagccaatag

SEQ ID NO: 415690 - DNA, 15 bp, Homo sapiens
gatccagccaatagg

SEQ ID NO: 415691 - DNA, 15 bp, Homo sapiens
atccagccaataggt

SEQ ID NO: 415692 - DNA, 15 bp, Homo sapiens
tccagccaataggta

SEQ ID NO: 415693 - DNA, 15 bp, Homo sapiens
ccagccaataggtag

SEQ ID NO: 415694 - DNA, 15 bp, Homo sapiens
cagccaataggtagt

SEQ ID NO: 415695 - DNA, 15 bp, Homo sapiens
agccaataggtagtt

SEQ ID NO: 415696 - DNA, 15 bp, Homo sapiens
gccaataggtagttt

SEQ ID NO: 415697 - DNA, 15 bp, Homo sapiens
ccaataggtagtttt

SEQ ID NO: 415698 - DNA, 15 bp, Homo sapiens
caataggtagtttta

SEQ ID NO: 415699 - DNA, 15 bp, Homo sapiens
aataggtagttttat

SEQ ID NO: 415700 - DNA, 15 bp, Homo sapiens
ataggtagttttatt

SEQ ID NO: 415701 - DNA, 15 bp, Homo sapiens
taggtagttttattt

SEQ ID NO: 415702 - DNA, 15 bp, Homo sapiens
aggtagttttatttg

SEQ ID NO: 415703 - DNA, 15 bp, Homo sapiens
ggtagttttatttgc

SEQ ID NO: 415704 - DNA, 15 bp, Homo sapiens
gtagttttatttgcc

SEQ ID NO: 415705 - DNA, 15 bp, Homo sapiens
tagttttatttgcca

SEQ ID NO: 415706 - DNA, 15 bp, Homo sapiens
agttttatttgccac

SEQ ID NO: 415707 - DNA, 15 bp, Homo sapiens
gttttatttgccacg

SEQ ID NO: 415708 - DNA, 15 bp, Homo sapiens
ttttatttgccacgc

SEQ ID NO: 415709 - DNA, 15 bp, Homo sapiens
tttatttgccacgct

SEQ ID NO: 415710 - DNA, 15 bp, Homo sapiens
ttatttgccacgctg

SEQ ID NO: 415711 - DNA, 15 bp, Homo sapiens
tatttgccacgctga

SEQ ID NO: 415712 - DNA, 15 bp, Homo sapiens
atttgccacgctgat

SEQ ID NO: 415713 - DNA, 15 bp, Homo sapiens
tttgccacgctgatt

SEQ ID NO: 415714 - DNA, 15 bp, Homo sapiens
ttgccacgctgattt

SEQ ID NO: 415715 - DNA, 15 bp, Homo sapiens
tgccacgctgatttt

SEQ ID NO: 415716 - DNA, 15 bp, Homo sapiens
gccacgctgatttta

SEQ ID NO: 415717 - DNA, 15 bp, Homo sapiens
ccacgctgattttaa

SEQ ID NO: 415718 - DNA, 15 bp, Homo sapiens
cacgctgattttaat

SEQ ID NO: 415719 - DNA, 15 bp, Homo sapiens
acgctgattttaatt

SEQ ID NO: 415720 - DNA, 15 bp, Homo sapiens
cgctgattttaatta

SEQ ID NO: 415721 - DNA, 15 bp, Homo sapiens
gctgattttaattaa

SEQ ID NO: 415722 - DNA, 15 bp, Homo sapiens
ctgattttaattaat

SEQ ID NO: 415723 - DNA, 15 bp, Homo sapiens
tgattttaattaatt

SEQ ID NO: 415724 - DNA, 15 bp, Homo sapiens
gattttaattaattt

SEQ ID NO: 415725 - DNA, 15 bp, Homo sapiens
attttaattaatttt

SEQ ID NO: 415726 - DNA, 15 bp, Homo sapiens
ttttaattaattttt

SEQ ID NO: 415727 - DNA, 15 bp, Homo sapiens
tttaattaatttttt

SEQ ID NO: 415728 - DNA, 15 bp, Homo sapiens
ttaattaattttttt

SEQ ID NO: 415729 - DNA, 15 bp, Homo sapiens
taattaatttttttc

SEQ ID NO: 415730 - DNA, 15 bp, Homo sapiens
aattaatttttttcc

SEQ ID NO: 415731 - DNA, 15 bp, Homo sapiens
attaatttttttccc

SEQ ID NO: 415732 - DNA, 15 bp, Homo sapiens
ttaatttttttccct

SEQ ID NO: 415733 - DNA, 15 bp, Homo sapiens
taatttttttccctg

SEQ ID NO: 415734 - DNA, 15 bp, Homo sapiens
aatttttttccctga

SEQ ID NO: 415735 - DNA, 15 bp, Homo sapiens
atttttttccctgaa

SEQ ID NO: 415736 - DNA, 15 bp, Homo sapiens
tttttttccctgaaa

SEQ ID NO: 415737 - DNA, 15 bp, Homo sapiens
ttttttccctgaaag

SEQ ID NO: 415738 - DNA, 15 bp, Homo sapiens
tttttccctgaaagt

SEQ ID NO: 415739 - DNA, 15 bp, Homo sapiens
ttttccctgaaagta

SEQ ID NO: 415740 - DNA, 15 bp, Homo sapiens
tttccctgaaagtac

SEQ ID NO: 415741 - DNA, 15 bp, Homo sapiens
ttccctgaaagtact

SEQ ID NO: 415742 - DNA, 15 bp, Homo sapiens
tccctgaaagtactt

SEQ ID NO: 415743 - DNA, 15 bp, Homo sapiens
ccctgaaagtacttc

SEQ ID NO: 415744 - DNA, 15 bp, Homo sapiens
cctgaaagtacttcc

SEQ ID NO: 415745 - DNA, 15 bp, Homo sapiens
ctgaaagtacttcct

SEQ ID NO: 415746 - DNA, 15 bp, Homo sapiens
tgaaagtacttccta

SEQ ID NO: 415747 - DNA, 15 bp, Homo sapiens
gaaagtacttcctaa

SEQ ID NO: 415748 - DNA, 15 bp, Homo sapiens
aaagtacttcctaaa

SEQ ID NO: 415749 - DNA, 15 bp, Homo sapiens
aagtacttcctaaag

SEQ ID NO: 415750 - DNA, 15 bp, Homo sapiens
agtacttcctaaagg

SEQ ID NO: 415751 - DNA, 15 bp, Homo sapiens
gtacttcctaaagga

SEQ ID NO: 415752 - DNA, 15 bp, Homo sapiens
tacttcctaaaggaa

SEQ ID NO: 415753 - DNA, 15 bp, Homo sapiens
acttcctaaaggaag

SEQ ID NO: 415754 - DNA, 15 bp, Homo sapiens
cttcctaaaggaagt

SEQ ID NO: 415755 - DNA, 15 bp, Homo sapiens
ttcctaaaggaagta

SEQ ID NO: 415756 - DNA, 15 bp, Homo sapiens
tcctaaaggaagtat

SEQ ID NO: 415757 - DNA, 15 bp, Homo sapiens
cctaaaggaagtatc

SEQ ID NO: 415758 - DNA, 15 bp, Homo sapiens
ctaaaggaagtatct

SEQ ID NO: 415759 - DNA, 15 bp, Homo sapiens
taaaggaagtatctc

SEQ ID NO: 415760 - DNA, 15 bp, Homo sapiens
aaaggaagtatctca

SEQ ID NO: 415761 - DNA, 15 bp, Homo sapiens
aaggaagtatctcat

SEQ ID NO: 415762 - DNA, 15 bp, Homo sapiens
aggaagtatctcatg

SEQ ID NO: 415763 - DNA, 15 bp, Homo sapiens
ggaagtatctcatga

SEQ ID NO: 415764 - DNA, 15 bp, Homo sapiens
gaagtatctcatgac

SEQ ID NO: 415765 - DNA, 15 bp, Homo sapiens
aagtatctcatgact

SEQ ID NO: 415766 - DNA, 15 bp, Homo sapiens
agtatctcatgactt

SEQ ID NO: 415767 - DNA, 15 bp, Homo sapiens
gtatctcatgacttt

SEQ ID NO: 415768 - DNA, 15 bp, Homo sapiens
tatctcatgacttta

SEQ ID NO: 415769 - DNA, 15 bp, Homo sapiens
atctcatgactttag

SEQ ID NO: 415770 - DNA, 15 bp, Homo sapiens
tctcatgactttagg

SEQ ID NO: 415771 - DNA, 15 bp, Homo sapiens
ctcatgactttaggg

SEQ ID NO: 415772 - DNA, 15 bp, Homo sapiens
tcatgactttaggga

SEQ ID NO: 415773 - DNA, 15 bp, Homo sapiens
catgactttagggac

SEQ ID NO: 415774 - DNA, 15 bp, Homo sapiens
atgactttagggact

SEQ ID NO: 415775 - DNA, 15 bp, Homo sapiens
tgactttagggacta

SEQ ID NO: 415776 - DNA, 15 bp, Homo sapiens
gactttagggactat

SEQ ID NO: 415777 - DNA, 15 bp, Homo sapiens
actttagggactatt

SEQ ID NO: 415778 - DNA, 15 bp, Homo sapiens
tttagggactattaa

SEQ ID NO: 415779 - DNA, 15 bp, Homo sapiens
ttagggactattaac

SEQ ID NO: 415780 - DNA, 15 bp, Homo sapiens
tagggactattaaca

SEQ ID NO: 415781 - DNA, 15 bp, Homo sapiens
agggactattaacat

SEQ ID NO: 415782 - DNA, 15 bp, Homo sapiens
gggactattaacata

SEQ ID NO: 415783 - DNA, 15 bp, Homo sapiens
ggactattaacatac

SEQ ID NO: 415784 - DNA, 15 bp, Homo sapiens
gactattaacatact

SEQ ID NO: 415785 - DNA, 15 bp, Homo sapiens
actattaacatactg

SEQ ID NO: 415786 - DNA, 15 bp, Homo sapiens
ctattaacatactgt

SEQ ID NO: 415787 - DNA, 15 bp, Homo sapiens
tattaacatactgtc

SEQ ID NO: 415788 - DNA, 15 bp, Homo sapiens
attaacatactgtca

SEQ ID NO: 415789 - DNA, 15 bp, Homo sapiens
ttaacatactgtcat

SEQ ID NO: 415790 - DNA, 15 bp, Homo sapiens
taacatactgtcata

SEQ ID NO: 415791 - DNA, 15 bp, Homo sapiens
aacatactgtcatac

SEQ ID NO: 415792 - DNA, 15 bp, Homo sapiens
acatactgtcatact

SEQ ID NO: 415793 - DNA, 15 bp, Homo sapiens
catactgtcatactt

SEQ ID NO: 415794 - DNA, 15 bp, Homo sapiens
atactgtcatactta

SEQ ID NO: 415795 - DNA, 15 bp, Homo sapiens
tactgtcatacttaa

SEQ ID NO: 415796 - DNA, 15 bp, Homo sapiens
actgtcatacttaag

SEQ ID NO: 415797 - DNA, 15 bp, Homo sapiens
ctgtcatacttaagc

SEQ ID NO: 415798 - DNA, 15 bp, Homo sapiens
tgtcatacttaagcc

SEQ ID NO: 415799 - DNA, 15 bp, Homo sapiens
gtcatacttaagcca

SEQ ID NO: 415800 - DNA, 15 bp, Homo sapiens
tcatacttaagccat

SEQ ID NO: 415801 - DNA, 15 bp, Homo sapiens
catacttaagccatt

SEQ ID NO: 415802 - DNA, 15 bp, Homo sapiens
atacttaagccattt

SEQ ID NO: 415803 - DNA, 15 bp, Homo sapiens
tacttaagccatttg

SEQ ID NO: 415804 - DNA, 15 bp, Homo sapiens
acttaagccatttgc

SEQ ID NO: 415805 - DNA, 15 bp, Homo sapiens
cttaagccatttgca

SEQ ID NO: 415806 - DNA, 15 bp, Homo sapiens
ttaagccatttgcat

SEQ ID NO: 415807 - DNA, 15 bp, Homo sapiens
taagccatttgcatt

SEQ ID NO: 415808 - DNA, 15 bp, Homo sapiens
aagccatttgcattg

SEQ ID NO: 415809 - DNA, 15 bp, Homo sapiens
agccatttgcattgt

SEQ ID NO: 415810 - DNA, 15 bp, Homo sapiens
gccatttgcattgtg

SEQ ID NO: 415811 - DNA, 15 bp, Homo sapiens
ccatttgcattgtgt

SEQ ID NO: 415812 - DNA, 15 bp, Homo sapiens
catttgcattgtgta

SEQ ID NO: 415813 - DNA, 15 bp, Homo sapiens
atttgcattgtgtac

SEQ ID NO: 415814 - DNA, 15 bp, Homo sapiens
tttgcattgtgtact

SEQ ID NO: 415815 - DNA, 15 bp, Homo sapiens
ttgcattgtgtactg

SEQ ID NO: 415816 - DNA, 15 bp, Homo sapiens
tgcattgtgtactgt

SEQ ID NO: 415817 - DNA, 15 bp, Homo sapiens
gcattgtgtactgta

SEQ ID NO: 415818 - DNA, 15 bp, Homo sapiens
cattgtgtactgtat

SEQ ID NO: 415819 - DNA, 15 bp, Homo sapiens
attgtgtactgtatt

SEQ ID NO: 415820 - DNA, 15 bp, Homo sapiens
ttgtgtactgtattt

SEQ ID NO: 415821 - DNA, 15 bp, Homo sapiens
tgtgtactgtatttc

SEQ ID NO: 415822 - DNA, 15 bp, Homo sapiens
gtgtactgtatttct

SEQ ID NO: 415823 - DNA, 15 bp, Homo sapiens
tgtactgtatttctt

SEQ ID NO: 415824 - DNA, 15 bp, Homo sapiens
gtactgtatttcttt

SEQ ID NO: 415825 - DNA, 15 bp, Homo sapiens
tactgtatttctttt

SEQ ID NO: 415826 - DNA, 15 bp, Homo sapiens
actgtatttcttttg

SEQ ID NO: 415827 - DNA, 15 bp, Homo sapiens
tatttcttttgttta

SEQ ID NO: 415828 - DNA, 15 bp, Homo sapiens
atttcttttgtttaa

SEQ ID NO: 415829 - DNA, 15 bp, Homo sapiens
tttcttttgtttaat

SEQ ID NO: 415830 - DNA, 15 bp, Homo sapiens
ttcttttgtttaata

SEQ ID NO: 415831 - DNA, 15 bp, Homo sapiens
tcttttgtttaatag

SEQ ID NO: 415832 - DNA, 15 bp, Homo sapiens
cttttgtttaatagt

SEQ ID NO: 415833 - DNA, 15 bp, Homo sapiens
ttttgtttaatagtc

SEQ ID NO: 415834 - DNA, 15 bp, Homo sapiens
tttgtttaatagtca

SEQ ID NO: 415835 - DNA, 15 bp, Homo sapiens
ttgtttaatagtcac

SEQ ID NO: 415836 - DNA, 15 bp, Homo sapiens
tgtttaatagtcaca

SEQ ID NO: 415837 - DNA, 15 bp, Homo sapiens
gtttaatagtcacag

SEQ ID NO: 415838 - DNA, 15 bp, Homo sapiens
tttaatagtcacaga

SEQ ID NO: 415839 - DNA, 15 bp, Homo sapiens
ttaatagtcacagag

SEQ ID NO: 415840 - DNA, 15 bp, Homo sapiens
taatagtcacagagg

SEQ ID NO: 415841 - DNA, 15 bp, Homo sapiens
aatagtcacagagga

SEQ ID NO: 415842 - DNA, 15 bp, Homo sapiens
atagtcacagaggat

SEQ ID NO: 415843 - DNA, 15 bp, Homo sapiens
tagtcacagaggata

SEQ ID NO: 415844 - DNA, 15 bp, Homo sapiens
agtcacagaggatag

SEQ ID NO: 415845 - DNA, 15 bp, Homo sapiens
gtcacagaggatagt

SEQ ID NO: 415846 - DNA, 15 bp, Homo sapiens
tcacagaggatagtg

SEQ ID NO: 415847 - DNA, 15 bp, Homo sapiens
cacagaggatagtgt

SEQ ID NO: 415848 - DNA, 15 bp, Homo sapiens
acagaggatagtgta

SEQ ID NO: 415849 - DNA, 15 bp, Homo sapiens
cagaggatagtgtaa

SEQ ID NO: 415850 - DNA, 15 bp, Homo sapiens
agaggatagtgtaat

SEQ ID NO: 415851 - DNA, 15 bp, Homo sapiens
gaggatagtgtaatg

SEQ ID NO: 415852 - DNA, 15 bp, Homo sapiens
aggatagtgtaatgg

SEQ ID NO: 415853 - DNA, 15 bp, Homo sapiens
ggatagtgtaatggc

SEQ ID NO: 415854 - DNA, 15 bp, Homo sapiens
gatagtgtaatggcc

SEQ ID NO: 415855 - DNA, 15 bp, Homo sapiens
atagtgtaatggcca

SEQ ID NO: 415856 - DNA, 15 bp, Homo sapiens
tagtgtaatggccaa

SEQ ID NO: 415857 - DNA, 15 bp, Homo sapiens
agtgtaatggccaat

SEQ ID NO: 415858 - DNA, 15 bp, Homo sapiens
gtgtaatggccaatt

SEQ ID NO: 415859 - DNA, 15 bp, Homo sapiens
tgtaatggccaattt

SEQ ID NO: 415860 - DNA, 15 bp, Homo sapiens
gtaatggccaatttt

SEQ ID NO: 415861 - DNA, 15 bp, Homo sapiens
taatggccaatttta

SEQ ID NO: 415862 - DNA, 15 bp, Homo sapiens
aatggccaattttag

SEQ ID NO: 415863 - DNA, 15 bp, Homo sapiens
atggccaattttagc

SEQ ID NO: 415864 - DNA, 15 bp, Homo sapiens
tggccaattttagct

SEQ ID NO: 415865 - DNA, 15 bp, Homo sapiens
ggccaattttagctc

SEQ ID NO: 415866 - DNA, 15 bp, Homo sapiens
gccaattttagctca

SEQ ID NO: 415867 - DNA, 15 bp, Homo sapiens
ccaattttagctcag

SEQ ID NO: 415868 - DNA, 15 bp, Homo sapiens
caattttagctcagt

SEQ ID NO: 415869 - DNA, 15 bp, Homo sapiens
aattttagctcagtg

SEQ ID NO: 415870 - DNA, 15 bp, Homo sapiens
attttagctcagtga

SEQ ID NO: 415871 - DNA, 15 bp, Homo sapiens
ttttagctcagtgac

SEQ ID NO: 415872 - DNA, 15 bp, Homo sapiens
tttagctcagtgaca

SEQ ID NO: 415873 - DNA, 15 bp, Homo sapiens
ttagctcagtgacat

SEQ ID NO: 415874 - DNA, 15 bp, Homo sapiens
tagctcagtgacatt

SEQ ID NO: 415875 - DNA, 15 bp, Homo sapiens
agctcagtgacattt

SEQ ID NO: 415876 - DNA, 15 bp, Homo sapiens
gctcagtgacatttt

SEQ ID NO: 415877 - DNA, 15 bp, Homo sapiens
ctcagtgacattttg

SEQ ID NO: 415878 - DNA, 15 bp, Homo sapiens
tcagtgacattttga

SEQ ID NO: 415879 - DNA, 15 bp, Homo sapiens
cagtgacattttgag

SEQ ID NO: 415880 - DNA, 15 bp, Homo sapiens
agtgacattttgagt

SEQ ID NO: 415881 - DNA, 15 bp, Homo sapiens
gtgacattttgagtg

SEQ ID NO: 415882 - DNA, 15 bp, Homo sapiens
tgacattttgagtga

SEQ ID NO: 415883 - DNA, 15 bp, Homo sapiens
gacattttgagtgac

SEQ ID NO: 415884 - DNA, 15 bp, Homo sapiens
acattttgagtgact

SEQ ID NO: 415885 - DNA, 15 bp, Homo sapiens
cattttgagtgactg

SEQ ID NO: 415886 - DNA, 15 bp, Homo sapiens
attttgagtgactgc

SEQ ID NO: 415887 - DNA, 15 bp, Homo sapiens
ttttgagtgactgct

SEQ ID NO: 415888 - DNA, 15 bp, Homo sapiens
tttgagtgactgctg

SEQ ID NO: 415889 - DNA, 15 bp, Homo sapiens
ttgagtgactgctgc

SEQ ID NO: 415890 - DNA, 15 bp, Homo sapiens
tgagtgactgctgcc

SEQ ID NO: 415891 - DNA, 15 bp, Homo sapiens
gagtgactgctgcct

SEQ ID NO: 415892 - DNA, 15 bp, Homo sapiens
agtgactgctgcctt

SEQ ID NO: 415893 - DNA, 15 bp, Homo sapiens
gtgactgctgccttt

SEQ ID NO: 415894 - DNA, 15 bp, Homo sapiens
tgactgctgcctttt

SEQ ID NO: 415895 - DNA, 15 bp, Homo sapiens
gactgctgcctttta

SEQ ID NO: 415896 - DNA, 15 bp, Homo sapiens
actgctgccttttat

SEQ ID NO: 415897 - DNA, 15 bp, Homo sapiens
ctgctgccttttatt

SEQ ID NO: 415898 - DNA, 15 bp, Homo sapiens
tgctgccttttatta

SEQ ID NO: 415899 - DNA, 15 bp, Homo sapiens
gctgccttttattaa

SEQ ID NO: 415900 - DNA, 15 bp, Homo sapiens
ctgccttttattaat

SEQ ID NO: 415901 - DNA, 15 bp, Homo sapiens
tgccttttattaatt

SEQ ID NO: 415902 - DNA, 15 bp, Homo sapiens
gccttttattaattt

SEQ ID NO: 415903 - DNA, 15 bp, Homo sapiens
ccttttattaattta

SEQ ID NO: 415904 - DNA, 15 bp, Homo sapiens
cttttattaatttat

SEQ ID NO: 415905 - DNA, 15 bp, Homo sapiens
ttttattaatttatt

SEQ ID NO: 415906 - DNA, 15 bp, Homo sapiens
tttattaatttattc

SEQ ID NO: 415907 - DNA, 15 bp, Homo sapiens
ttattaatttattca

SEQ ID NO: 415908 - DNA, 15 bp, Homo sapiens
tattaatttattcag

SEQ ID NO: 415909 - DNA, 15 bp, Homo sapiens
attaatttattcaga

SEQ ID NO: 415910 - DNA, 15 bp, Homo sapiens
ttaatttattcagac

SEQ ID NO: 415911 - DNA, 15 bp, Homo sapiens
taatttattcagacc

SEQ ID NO: 415912 - DNA, 15 bp, Homo sapiens
aatttattcagacct

SEQ ID NO: 415913 - DNA, 15 bp, Homo sapiens
atttattcagacctg

SEQ ID NO: 415914 - DNA, 15 bp, Homo sapiens
tttattcagacctgc

SEQ ID NO: 415915 - DNA, 15 bp, Homo sapiens
ttattcagacctgct

SEQ ID NO: 415916 - DNA, 15 bp, Homo sapiens
tattcagacctgcta

SEQ ID NO: 415917 - DNA, 15 bp, Homo sapiens
attcagacctgctac

SEQ ID NO: 415918 - DNA, 15 bp, Homo sapiens
ttcagacctgctact

SEQ ID NO: 415919 - DNA, 15 bp, Homo sapiens
tcagacctgctactg

SEQ ID NO: 415920 - DNA, 15 bp, Homo sapiens
cagacctgctactga

SEQ ID NO: 415921 - DNA, 15 bp, Homo sapiens
agacctgctactgaa

SEQ ID NO: 415922 - DNA, 15 bp, Homo sapiens
gacctgctactgaat

SEQ ID NO: 415923 - DNA, 15 bp, Homo sapiens
acctgctactgaatg

SEQ ID NO: 415924 - DNA, 15 bp, Homo sapiens
cctgctactgaatgg

SEQ ID NO: 415925 - DNA, 15 bp, Homo sapiens
ctgctactgaatggt

SEQ ID NO: 415926 - DNA, 15 bp, Homo sapiens
tgctactgaatggtt

SEQ ID NO: 415927 - DNA, 15 bp, Homo sapiens
gctactgaatggtta

SEQ ID NO: 415928 - DNA, 15 bp, Homo sapiens
ctactgaatggttaa

SEQ ID NO: 415929 - DNA, 15 bp, Homo sapiens
tactgaatggttaat

SEQ ID NO: 415930 - DNA, 15 bp, Homo sapiens
actgaatggttaatg

SEQ ID NO: 415931 - DNA, 15 bp, Homo sapiens
ctgaatggttaatga

SEQ ID NO: 415932 - DNA, 15 bp, Homo sapiens
tgaatggttaatgat

SEQ ID NO: 415933 - DNA, 15 bp, Homo sapiens
gaatggttaatgata

SEQ ID NO: 415934 - DNA, 15 bp, Homo sapiens
aatggttaatgataa

SEQ ID NO: 415935 - DNA, 15 bp, Homo sapiens
atggttaatgataat

SEQ ID NO: 415936 - DNA, 15 bp, Homo sapiens
tggttaatgataatc

SEQ ID NO: 415937 - DNA, 15 bp, Homo sapiens
ggttaatgataatcg

SEQ ID NO: 415938 - DNA, 15 bp, Homo sapiens
gttaatgataatcgt

SEQ ID NO: 415939 - DNA, 15 bp, Homo sapiens
ttaatgataatcgta

SEQ ID NO: 415940 - DNA, 15 bp, Homo sapiens
taatgataatcgtag

SEQ ID NO: 415941 - DNA, 15 bp, Homo sapiens
aatgataatcgtagt

SEQ ID NO: 415942 - DNA, 15 bp, Homo sapiens
atgataatcgtagtt

SEQ ID NO: 415943 - DNA, 15 bp, Homo sapiens
tgataatcgtagttc

SEQ ID NO: 415944 - DNA, 15 bp, Homo sapiens
gataatcgtagttct

SEQ ID NO: 415945 - DNA, 15 bp, Homo sapiens
ataatcgtagttctc

SEQ ID NO: 415946 - DNA, 15 bp, Homo sapiens
taatcgtagttctct

SEQ ID NO: 415947 - DNA, 15 bp, Homo sapiens
aatcgtagttctcta

SEQ ID NO: 415948 - DNA, 15 bp, Homo sapiens
atcgtagttctctaa

SEQ ID NO: 415949 - DNA, 15 bp, Homo sapiens
tcgtagttctctaag

SEQ ID NO: 415950 - DNA, 15 bp, Homo sapiens
cgtagttctctaagg

SEQ ID NO: 415951 - DNA, 15 bp, Homo sapiens
gtagttctctaaggg

SEQ ID NO: 415952 - DNA, 15 bp, Homo sapiens
tagttctctaaggga

SEQ ID NO: 415953 - DNA, 15 bp, Homo sapiens
agttctctaagggat

SEQ ID NO: 415954 - DNA, 15 bp, Homo sapiens
gttctctaagggatt

SEQ ID NO: 415955 - DNA, 15 bp, Homo sapiens
ttctctaagggattt

SEQ ID NO: 415956 - DNA, 15 bp, Homo sapiens
tctctaagggatttt

SEQ ID NO: 415957 - DNA, 15 bp, Homo sapiens
ctctaagggattttt

SEQ ID NO: 415958 - DNA, 15 bp, Homo sapiens
tctaagggatttttt

SEQ ID NO: 415959 - DNA, 15 bp, Homo sapiens
ctaagggattttttg

SEQ ID NO: 415960 - DNA, 15 bp, Homo sapiens
taagggattttttga

SEQ ID NO: 415961 - DNA, 15 bp, Homo sapiens
aagggattttttgat

SEQ ID NO: 415962 - DNA, 15 bp, Homo sapiens
agggattttttgatg

SEQ ID NO: 415963 - DNA, 15 bp, Homo sapiens
gggattttttgatgt

SEQ ID NO: 415964 - DNA, 15 bp, Homo sapiens
ggattttttgatgta

SEQ ID NO: 415965 - DNA, 15 bp, Homo sapiens
gattttttgatgtat

SEQ ID NO: 415966 - DNA, 15 bp, Homo sapiens
attttttgatgtatg

SEQ ID NO: 415967 - DNA, 15 bp, Homo sapiens
ttttttgatgtatgt

SEQ ID NO: 415968 - DNA, 15 bp, Homo sapiens
tttttgatgtatgtg

SEQ ID NO: 415969 - DNA, 15 bp, Homo sapiens
ttttgatgtatgtgt

SEQ ID NO: 415970 - DNA, 15 bp, Homo sapiens
tttgatgtatgtgtc

SEQ ID NO: 415971 - DNA, 15 bp, Homo sapiens
ttgatgtatgtgtct

SEQ ID NO: 415972 - DNA, 15 bp, Homo sapiens
tgatgtatgtgtctg

SEQ ID NO: 415973 - DNA, 15 bp, Homo sapiens
gatgtatgtgtctgc

SEQ ID NO: 415974 - DNA, 15 bp, Homo sapiens
atgtatgtgtctgct

SEQ ID NO: 415975 - DNA, 15 bp, Homo sapiens
tgtatgtgtctgctg

SEQ ID NO: 415976 - DNA, 15 bp, Homo sapiens
gtatgtgtctgctgt

SEQ ID NO: 415977 - DNA, 15 bp, Homo sapiens
tatgtgtctgctgtg

SEQ ID NO: 415978 - DNA, 15 bp, Homo sapiens
atgtgtctgctgtgt

SEQ ID NO: 415979 - DNA, 15 bp, Homo sapiens
tgtgtctgctgtgtg

SEQ ID NO: 415980 - DNA, 15 bp, Homo sapiens
gtgtctgctgtgtgt

SEQ ID NO: 415981 - DNA, 15 bp, Homo sapiens
tgtctgctgtgtgtg

SEQ ID NO: 415982 - DNA, 15 bp, Homo sapiens
gtctgctgtgtgtgt

SEQ ID NO: 415983 - DNA, 15 bp, Homo sapiens
tctgctgtgtgtgtg

SEQ ID NO: 415984 - DNA, 15 bp, Homo sapiens
ctgctgtgtgtgtga

SEQ ID NO: 415985 - DNA, 15 bp, Homo sapiens
tgctgtgtgtgtgag

SEQ ID NO: 415986 - DNA, 15 bp, Homo sapiens
gctgtgtgtgtgagt

SEQ ID NO: 415987 - DNA, 15 bp, Homo sapiens
ctgtgtgtgtgagtg

SEQ ID NO: 415988 - DNA, 15 bp, Homo sapiens
tgtgtgtgtgagtgc

SEQ ID NO: 415989 - DNA, 15 bp, Homo sapiens
gtgtgtgtgagtgcc

SEQ ID NO: 415990 - DNA, 15 bp, Homo sapiens
tgtgtgtgagtgccg

SEQ ID NO: 415991 - DNA, 15 bp, Homo sapiens
gtgtgtgagtgccgt

SEQ ID NO: 415992 - DNA, 15 bp, Homo sapiens
tgtgtgagtgccgtt

SEQ ID NO: 415993 - DNA, 15 bp, Homo sapiens
gtgtgagtgccgttc

SEQ ID NO: 415994 - DNA, 15 bp, Homo sapiens
tgtgagtgccgttct

SEQ ID NO: 415995 - DNA, 15 bp, Homo sapiens
gtgagtgccgttctc

SEQ ID NO: 415996 - DNA, 15 bp, Homo sapiens
tgagtgccgttctct

SEQ ID NO: 415997 - DNA, 15 bp, Homo sapiens
gagtgccgttctctt

SEQ ID NO: 415998 - DNA, 15 bp, Homo sapiens
agtgccgttctctta

SEQ ID NO: 415999 - DNA, 15 bp, Homo sapiens
gtgccgttctcttag

SEQ ID NO: 416000 - DNA, 15 bp, Homo sapiens
tgccgttctcttagt

SEQ ID NO: 416001 - DNA, 15 bp, Homo sapiens
gccgttctcttagta

SEQ ID NO: 416002 - DNA, 15 bp, Homo sapiens
ccgttctcttagtac

SEQ ID NO: 416003 - DNA, 15 bp, Homo sapiens
cgttctcttagtacc

SEQ ID NO: 416004 - DNA, 15 bp, Homo sapiens
gttctcttagtacca

SEQ ID NO: 416005 - DNA, 15 bp, Homo sapiens
ttctcttagtaccat

SEQ ID NO: 416006 - DNA, 15 bp, Homo sapiens
tctcttagtaccatt

SEQ ID NO: 416007 - DNA, 15 bp, Homo sapiens
ctcttagtaccattc

SEQ ID NO: 416008 - DNA, 15 bp, Homo sapiens
tcttagtaccattct

SEQ ID NO: 416009 - DNA, 15 bp, Homo sapiens
cttagtaccattctc

SEQ ID NO: 416010 - DNA, 15 bp, Homo sapiens
ttagtaccattctct

SEQ ID NO: 416011 - DNA, 15 bp, Homo sapiens
tagtaccattctctt

SEQ ID NO: 416012 - DNA, 15 bp, Homo sapiens
agtaccattctcttg

SEQ ID NO: 416013 - DNA, 15 bp, Homo sapiens
gtaccattctcttgg

SEQ ID NO: 416014 - DNA, 15 bp, Homo sapiens
taccattctcttggt

SEQ ID NO: 416015 - DNA, 15 bp, Homo sapiens
accattctcttggtg

SEQ ID NO: 416016 - DNA, 15 bp, Homo sapiens
ccattctcttggtga

SEQ ID NO: 416017 - DNA, 15 bp, Homo sapiens
cattctcttggtgac

SEQ ID NO: 416018 - DNA, 15 bp, Homo sapiens
attctcttggtgact

SEQ ID NO: 416019 - DNA, 15 bp, Homo sapiens
ttctcttggtgactc

SEQ ID NO: 416020 - DNA, 15 bp, Homo sapiens
tctcttggtgactcc

SEQ ID NO: 416021 - DNA, 15 bp, Homo sapiens
ctcttggtgactcct

SEQ ID NO: 416022 - DNA, 15 bp, Homo sapiens
tcttggtgactcctt

SEQ ID NO: 416023 - DNA, 15 bp, Homo sapiens
cttggtgactccttg

SEQ ID NO: 416024 - DNA, 15 bp, Homo sapiens
ttggtgactccttgg

SEQ ID NO: 416025 - DNA, 15 bp, Homo sapiens
tggtgactccttggg

SEQ ID NO: 416026 - DNA, 15 bp, Homo sapiens
ggtgactccttgggc

SEQ ID NO: 416027 - DNA, 15 bp, Homo sapiens
gtgactccttgggca

SEQ ID NO: 416028 - DNA, 15 bp, Homo sapiens
tgactccttgggcaa

SEQ ID NO: 416029 - DNA, 15 bp, Homo sapiens
gactccttgggcaaa

SEQ ID NO: 416030 - DNA, 15 bp, Homo sapiens
actccttgggcaaag

SEQ ID NO: 416031 - DNA, 15 bp, Homo sapiens
ctccttgggcaaaga

SEQ ID NO: 416032 - DNA, 15 bp, Homo sapiens
tccttgggcaaagat

SEQ ID NO: 416033 - DNA, 15 bp, Homo sapiens
ccttgggcaaagatg

SEQ ID NO: 416034 - DNA, 15 bp, Homo sapiens
cttgggcaaagatgc

SEQ ID NO: 416035 - DNA, 15 bp, Homo sapiens
ttgggcaaagatgct

SEQ ID NO: 416036 - DNA, 15 bp, Homo sapiens
tgggcaaagatgctt

SEQ ID NO: 416037 - DNA, 15 bp, Homo sapiens
gggcaaagatgcttc

SEQ ID NO: 416038 - DNA, 15 bp, Homo sapiens
ggcaaagatgcttcc

SEQ ID NO: 416039 - DNA, 15 bp, Homo sapiens
gcaaagatgcttcct

SEQ ID NO: 416040 - DNA, 15 bp, Homo sapiens
caaagatgcttccta

SEQ ID NO: 416041 - DNA, 15 bp, Homo sapiens
aaagatgcttcctat

SEQ ID NO: 416042 - DNA, 15 bp, Homo sapiens
aagatgcttcctatc

SEQ ID NO: 416043 - DNA, 15 bp, Homo sapiens
agatgcttcctatca

SEQ ID NO: 416044 - DNA, 15 bp, Homo sapiens
gatgcttcctatcat

SEQ ID NO: 416045 - DNA, 15 bp, Homo sapiens
atgcttcctatcata

SEQ ID NO: 416046 - DNA, 15 bp, Homo sapiens
tgcttcctatcataa

SEQ ID NO: 416047 - DNA, 15 bp, Homo sapiens
gcttcctatcataac

SEQ ID NO: 416048 - DNA, 15 bp, Homo sapiens
cttcctatcataaca

SEQ ID NO: 416049 - DNA, 15 bp, Homo sapiens
ttcctatcataacaa

SEQ ID NO: 416050 - DNA, 15 bp, Homo sapiens
tcctatcataacaac

SEQ ID NO: 416051 - DNA, 15 bp, Homo sapiens
cctatcataacaaca

SEQ ID NO: 416052 - DNA, 15 bp, Homo sapiens
ctatcataacaacac

SEQ ID NO: 416053 - DNA, 15 bp, Homo sapiens
tatcataacaacaca

SEQ ID NO: 416054 - DNA, 15 bp, Homo sapiens
atcataacaacacag

SEQ ID NO: 416055 - DNA, 15 bp, Homo sapiens
tcataacaacacaga

SEQ ID NO: 416056 - DNA, 15 bp, Homo sapiens
cataacaacacagag

SEQ ID NO: 416057 - DNA, 15 bp, Homo sapiens
ataacaacacagaga

SEQ ID NO: 416058 - DNA, 15 bp, Homo sapiens
taacaacacagagag

SEQ ID NO: 416059 - DNA, 15 bp, Homo sapiens
aacaacacagagaga

SEQ ID NO: 416060 - DNA, 15 bp, Homo sapiens
acaacacagagagaa

SEQ ID NO: 416061 - DNA, 15 bp, Homo sapiens
caacacagagagaaa

SEQ ID NO: 416062 - DNA, 15 bp, Homo sapiens
aacacagagagaaac

SEQ ID NO: 416063 - DNA, 15 bp, Homo sapiens
acacagagagaaacc

SEQ ID NO: 416064 - DNA, 15 bp, Homo sapiens
cacagagagaaacca

SEQ ID NO: 416065 - DNA, 15 bp, Homo sapiens
acagagagaaaccac

SEQ ID NO: 416066 - DNA, 15 bp, Homo sapiens
cagagagaaaccact

SEQ ID NO: 416067 - DNA, 15 bp, Homo sapiens
agagagaaaccactc

SEQ ID NO: 416068 - DNA, 15 bp, Homo sapiens
gagagaaaccactca

SEQ ID NO: 416069 - DNA, 15 bp, Homo sapiens
agagaaaccactcaa

SEQ ID NO: 416070 - DNA, 15 bp, Homo sapiens
gagaaaccactcaat

SEQ ID NO: 416071 - DNA, 15 bp, Homo sapiens
agaaaccactcaatg

SEQ ID NO: 416072 - DNA, 15 bp, Homo sapiens
gaaaccactcaatgc

SEQ ID NO: 416073 - DNA, 15 bp, Homo sapiens
aaaccactcaatgct

SEQ ID NO: 416074 - DNA, 15 bp, Homo sapiens
aaccactcaatgctg

SEQ ID NO: 416075 - DNA, 15 bp, Homo sapiens
accactcaatgctga

SEQ ID NO: 416076 - DNA, 15 bp, Homo sapiens
ccactcaatgctgaa

SEQ ID NO: 416077 - DNA, 15 bp, Homo sapiens
cactcaatgctgaat

SEQ ID NO: 416078 - DNA, 15 bp, Homo sapiens
actcaatgctgaatt

SEQ ID NO: 416079 - DNA, 15 bp, Homo sapiens
ctcaatgctgaatta

SEQ ID NO: 416080 - DNA, 15 bp, Homo sapiens
tcaatgctgaattac

SEQ ID NO: 416081 - DNA, 15 bp, Homo sapiens
caatgctgaattact

SEQ ID NO: 416082 - DNA, 15 bp, Homo sapiens
aatgctgaattactt

SEQ ID NO: 416083 - DNA, 15 bp, Homo sapiens
atgctgaattacttt

SEQ ID NO: 416084 - DNA, 15 bp, Homo sapiens
tgctgaattacttta

SEQ ID NO: 416085 - DNA, 15 bp, Homo sapiens
gctgaattactttat

SEQ ID NO: 416086 - DNA, 15 bp, Homo sapiens
ctgaattactttatg

SEQ ID NO: 416087 - DNA, 15 bp, Homo sapiens
tgaattactttatgg

SEQ ID NO: 416088 - DNA, 15 bp, Homo sapiens
gaattactttatggc

SEQ ID NO: 416089 - DNA, 15 bp, Homo sapiens
aattactttatggca

SEQ ID NO: 416090 - DNA, 15 bp, Homo sapiens
attactttatggcat

SEQ ID NO: 416091 - DNA, 15 bp, Homo sapiens
ttactttatggcatt

SEQ ID NO: 416092 - DNA, 15 bp, Homo sapiens
tactttatggcattt

SEQ ID NO: 416093 - DNA, 15 bp, Homo sapiens
actttatggcattta

SEQ ID NO: 416094 - DNA, 15 bp, Homo sapiens
ctttatggcatttac

SEQ ID NO: 416095 - DNA, 15 bp, Homo sapiens
tttatggcatttacc

SEQ ID NO: 416096 - DNA, 15 bp, Homo sapiens
ttatggcatttacct

SEQ ID NO: 416097 - DNA, 15 bp, Homo sapiens
tatggcatttacctc

SEQ ID NO: 416098 - DNA, 15 bp, Homo sapiens
atggcatttacctcc

SEQ ID NO: 416099 - DNA, 15 bp, Homo sapiens
tggcatttacctcct

SEQ ID NO: 416100 - DNA, 15 bp, Homo sapiens
ggcatttacctcctt

SEQ ID NO: 416101 - DNA, 15 bp, Homo sapiens
gcatttacctccttt

SEQ ID NO: 416102 - DNA, 15 bp, Homo sapiens
catttacctcctttc

SEQ ID NO: 416103 - DNA, 15 bp, Homo sapiens
atttacctcctttca

SEQ ID NO: 416104 - DNA, 15 bp, Homo sapiens
tttacctcctttcac

SEQ ID NO: 416105 - DNA, 15 bp, Homo sapiens
ttacctcctttcaca

SEQ ID NO: 416106 - DNA, 15 bp, Homo sapiens
tacctcctttcacat

SEQ ID NO: 416107 - DNA, 15 bp, Homo sapiens
acctcctttcacatg

SEQ ID NO: 416108 - DNA, 15 bp, Homo sapiens
cctcctttcacatga

SEQ ID NO: 416109 - DNA, 15 bp, Homo sapiens
ctcctttcacatgac

SEQ ID NO: 416110 - DNA, 15 bp, Homo sapiens
tcctttcacatgact

SEQ ID NO: 416111 - DNA, 15 bp, Homo sapiens
cctttcacatgactc

SEQ ID NO: 416112 - DNA, 15 bp, Homo sapiens
ctttcacatgactct

SEQ ID NO: 416113 - DNA, 15 bp, Homo sapiens
tttcacatgactcta

SEQ ID NO: 416114 - DNA, 15 bp, Homo sapiens
ttcacatgactctat

SEQ ID NO: 416115 - DNA, 15 bp, Homo sapiens
tcacatgactctatc

SEQ ID NO: 416116 - DNA, 15 bp, Homo sapiens
cacatgactctatct

SEQ ID NO: 416117 - DNA, 15 bp, Homo sapiens
acatgactctatctt

SEQ ID NO: 416118 - DNA, 15 bp, Homo sapiens
catgactctatcttt

SEQ ID NO: 416119 - DNA, 15 bp, Homo sapiens
atgactctatctttt

SEQ ID NO: 416120 - DNA, 15 bp, Homo sapiens
tgactctatctttta

SEQ ID NO: 416121 - DNA, 15 bp, Homo sapiens
gactctatcttttat

SEQ ID NO: 416122 - DNA, 15 bp, Homo sapiens
actctatcttttata

SEQ ID NO: 416123 - DNA, 15 bp, Homo sapiens
ctctatcttttataa

SEQ ID NO: 416124 - DNA, 15 bp, Homo sapiens
tctatcttttataat

SEQ ID NO: 416125 - DNA, 15 bp, Homo sapiens
ctatcttttataatt

SEQ ID NO: 416126 - DNA, 15 bp, Homo sapiens
tatcttttataatta

SEQ ID NO: 416127 - DNA, 15 bp, Homo sapiens
atcttttataattac

SEQ ID NO: 416128 - DNA, 15 bp, Homo sapiens
tcttttataattaca

SEQ ID NO: 416129 - DNA, 15 bp, Homo sapiens
cttttataattacaa

SEQ ID NO: 416130 - DNA, 15 bp, Homo sapiens
ttttataattacaat

SEQ ID NO: 416131 - DNA, 15 bp, Homo sapiens
tttataattacaatt

SEQ ID NO: 416132 - DNA, 15 bp, Homo sapiens
ttataattacaattt

SEQ ID NO: 416133 - DNA, 15 bp, Homo sapiens
tataattacaatttg

SEQ ID NO: 416134 - DNA, 15 bp, Homo sapiens
ataattacaatttga

SEQ ID NO: 416135 - DNA, 15 bp, Homo sapiens
taattacaatttgaa

SEQ ID NO: 416136 - DNA, 15 bp, Homo sapiens
aattacaatttgaag

SEQ ID NO: 416137 - DNA, 15 bp, Homo sapiens
attacaatttgaagc

SEQ ID NO: 416138 - DNA, 15 bp, Homo sapiens
ttacaatttgaagct

SEQ ID NO: 416139 - DNA, 15 bp, Homo sapiens
tacaatttgaagcta

SEQ ID NO: 416140 - DNA, 15 bp, Homo sapiens
acaatttgaagctat

SEQ ID NO: 416141 - DNA, 15 bp, Homo sapiens
caatttgaagctata

SEQ ID NO: 416142 - DNA, 15 bp, Homo sapiens
aatttgaagctatat

SEQ ID NO: 416143 - DNA, 15 bp, Homo sapiens
atttgaagctatatt

SEQ ID NO: 416144 - DNA, 15 bp, Homo sapiens
tttgaagctatattg

SEQ ID NO: 416145 - DNA, 15 bp, Homo sapiens
ttgaagctatattgt

SEQ ID NO: 416146 - DNA, 15 bp, Homo sapiens
tgaagctatattgta

SEQ ID NO: 416147 - DNA, 15 bp, Homo sapiens
gaagctatattgtat

SEQ ID NO: 416148 - DNA, 15 bp, Homo sapiens
aagctatattgtatt

SEQ ID NO: 416149 - DNA, 15 bp, Homo sapiens
agctatattgtattg

SEQ ID NO: 416150 - DNA, 15 bp, Homo sapiens
gctatattgtattgc

SEQ ID NO: 416151 - DNA, 15 bp, Homo sapiens
ctatattgtattgct

SEQ ID NO: 416152 - DNA, 15 bp, Homo sapiens
tatattgtattgctc

SEQ ID NO: 416153 - DNA, 15 bp, Homo sapiens
atattgtattgctca

SEQ ID NO: 416154 - DNA, 15 bp, Homo sapiens
tattgtattgctcag

SEQ ID NO: 416155 - DNA, 15 bp, Homo sapiens
attgtattgctcagt

SEQ ID NO: 416156 - DNA, 15 bp, Homo sapiens
ttgtattgctcagtt

SEQ ID NO: 416157 - DNA, 15 bp, Homo sapiens
tgtattgctcagttt

SEQ ID NO: 416158 - DNA, 15 bp, Homo sapiens
gtattgctcagtttg

SEQ ID NO: 416159 - DNA, 15 bp, Homo sapiens
tattgctcagtttgc

SEQ ID NO: 416160 - DNA, 15 bp, Homo sapiens
attgctcagtttgcc

SEQ ID NO: 416161 - DNA, 15 bp, Homo sapiens
ttgctcagtttgcca

SEQ ID NO: 416162 - DNA, 15 bp, Homo sapiens
tgctcagtttgccat

SEQ ID NO: 416163 - DNA, 15 bp, Homo sapiens
gctcagtttgccata

SEQ ID NO: 416164 - DNA, 15 bp, Homo sapiens
ctcagtttgccatat

SEQ ID NO: 416165 - DNA, 15 bp, Homo sapiens
tcagtttgccatatc

SEQ ID NO: 416166 - DNA, 15 bp, Homo sapiens
cagtttgccatatct

SEQ ID NO: 416167 - DNA, 15 bp, Homo sapiens
agtttgccatatctc

SEQ ID NO: 416168 - DNA, 15 bp, Homo sapiens
gtttgccatatctca

SEQ ID NO: 416169 - DNA, 15 bp, Homo sapiens
tttgccatatctcat

SEQ ID NO: 416170 - DNA, 15 bp, Homo sapiens
ttgccatatctcatt

SEQ ID NO: 416171 - DNA, 15 bp, Homo sapiens
tgccatatctcattt

SEQ ID NO: 416172 - DNA, 15 bp, Homo sapiens
gccatatctcatttt

SEQ ID NO: 416173 - DNA, 15 bp, Homo sapiens
ccatatctcatttta

SEQ ID NO: 416174 - DNA, 15 bp, Homo sapiens
catatctcattttaa

SEQ ID NO: 416175 - DNA, 15 bp, Homo sapiens
atatctcattttaaa

SEQ ID NO: 416176 - DNA, 15 bp, Homo sapiens
tatctcattttaaaa

SEQ ID NO: 416177 - DNA, 15 bp, Homo sapiens
atctcattttaaaac

SEQ ID NO: 416178 - DNA, 15 bp, Homo sapiens
tctcattttaaaaca

SEQ ID NO: 416179 - DNA, 15 bp, Homo sapiens
ctcattttaaaacaa

SEQ ID NO: 416180 - DNA, 15 bp, Homo sapiens
tcattttaaaacaaa

SEQ ID NO: 416181 - DNA, 15 bp, Homo sapiens
cattttaaaacaaat

SEQ ID NO: 416182 - DNA, 15 bp, Homo sapiens
attttaaaacaaatg

SEQ ID NO: 416183 - DNA, 15 bp, Homo sapiens
ttttaaaacaaatgt

SEQ ID NO: 416184 - DNA, 15 bp, Homo sapiens
tttaaaacaaatgtg

SEQ ID NO: 416185 - DNA, 15 bp, Homo sapiens
ttaaaacaaatgtgt

SEQ ID NO: 416186 - DNA, 15 bp, Homo sapiens
taaaacaaatgtgtc

SEQ ID NO: 416187 - DNA, 15 bp, Homo sapiens
aaaacaaatgtgtcc

SEQ ID NO: 416188 - DNA, 15 bp, Homo sapiens
aaacaaatgtgtcct

SEQ ID NO: 416189 - DNA, 15 bp, Homo sapiens
aacaaatgtgtcctc

SEQ ID NO: 416190 - DNA, 15 bp, Homo sapiens
acaaatgtgtcctca

SEQ ID NO: 416191 - DNA, 15 bp, Homo sapiens
caaatgtgtcctcaa

SEQ ID NO: 416192 - DNA, 15 bp, Homo sapiens
aaatgtgtcctcaat

SEQ ID NO: 416193 - DNA, 15 bp, Homo sapiens
aatgtgtcctcaata

SEQ ID NO: 416194 - DNA, 15 bp, Homo sapiens
atgtgtcctcaataa

SEQ ID NO: 416195 - DNA, 15 bp, Homo sapiens
tgtgtcctcaataag

SEQ ID NO: 416196 - DNA, 15 bp, Homo sapiens
gtgtcctcaataaga

SEQ ID NO: 416197 - DNA, 15 bp, Homo sapiens
tgtcctcaataagat

SEQ ID NO: 416198 - DNA, 15 bp, Homo sapiens
gtcctcaataagata

SEQ ID NO: 416199 - DNA, 15 bp, Homo sapiens
tcctcaataagatat

SEQ ID NO: 416200 - DNA, 15 bp, Homo sapiens
cctcaataagatata

SEQ ID NO: 416201 - DNA, 15 bp, Homo sapiens
ctcaataagatatag

SEQ ID NO: 416202 - DNA, 15 bp, Homo sapiens
tcaataagatatagt

SEQ ID NO: 416203 - DNA, 15 bp, Homo sapiens
caataagatatagta

SEQ ID NO: 416204 - DNA, 15 bp, Homo sapiens
aataagatatagtaa

SEQ ID NO: 416205 - DNA, 15 bp, Homo sapiens
ataagatatagtaaa

SEQ ID NO: 416206 - DNA, 15 bp, Homo sapiens
taagatatagtaaac

SEQ ID NO: 416207 - DNA, 15 bp, Homo sapiens
aagatatagtaaaca

SEQ ID NO: 416208 - DNA, 15 bp, Homo sapiens
agatatagtaaacac

SEQ ID NO: 416209 - DNA, 15 bp, Homo sapiens
gatatagtaaacaca

SEQ ID NO: 416210 - DNA, 15 bp, Homo sapiens
atatagtaaacacat

SEQ ID NO: 416211 - DNA, 15 bp, Homo sapiens
tatagtaaacacatt

SEQ ID NO: 416212 - DNA, 15 bp, Homo sapiens
atagtaaacacattt

SEQ ID NO: 416213 - DNA, 15 bp, Homo sapiens
tagtaaacacatttc

SEQ ID NO: 416214 - DNA, 15 bp, Homo sapiens
agtaaacacatttca

SEQ ID NO: 416215 - DNA, 15 bp, Homo sapiens
gtaaacacatttcaa

SEQ ID NO: 416216 - DNA, 15 bp, Homo sapiens
taaacacatttcaaa

SEQ ID NO: 416217 - DNA, 15 bp, Homo sapiens
aaacacatttcaaag

SEQ ID NO: 416218 - DNA, 15 bp, Homo sapiens
aacacatttcaaagt

SEQ ID NO: 416219 - DNA, 15 bp, Homo sapiens
acacatttcaaagtc

SEQ ID NO: 416220 - DNA, 15 bp, Homo sapiens
cacatttcaaagtct

SEQ ID NO: 416221 - DNA, 15 bp, Homo sapiens
acatttcaaagtctc

SEQ ID NO: 416222 - DNA, 15 bp, Homo sapiens
catttcaaagtctcc

SEQ ID NO: 416223 - DNA, 15 bp, Homo sapiens
atttcaaagtctcct

SEQ ID NO: 416224 - DNA, 15 bp, Homo sapiens
tttcaaagtctcctc

SEQ ID NO: 416225 - DNA, 15 bp, Homo sapiens
ttcaaagtctcctca

SEQ ID NO: 416226 - DNA, 15 bp, Homo sapiens
tcaaagtctcctcat

SEQ ID NO: 416227 - DNA, 15 bp, Homo sapiens
caaagtctcctcatt

SEQ ID NO: 416228 - DNA, 15 bp, Homo sapiens
aaagtctcctcattt

SEQ ID NO: 416229 - DNA, 15 bp, Homo sapiens
aagtctcctcattta

SEQ ID NO: 416230 - DNA, 15 bp, Homo sapiens
agtctcctcatttat

SEQ ID NO: 416231 - DNA, 15 bp, Homo sapiens
gtctcctcatttatt

SEQ ID NO: 416232 - DNA, 15 bp, Homo sapiens
tctcctcatttattc

SEQ ID NO: 416233 - DNA, 15 bp, Homo sapiens
ctcctcatttattcc

SEQ ID NO: 416234 - DNA, 15 bp, Homo sapiens
tcctcatttattccc

SEQ ID NO: 416235 - DNA, 15 bp, Homo sapiens
cctcatttattccct

SEQ ID NO: 416236 - DNA, 15 bp, Homo sapiens
ctcatttattcccta

SEQ ID NO: 416237 - DNA, 15 bp, Homo sapiens
tcatttattccctac

SEQ ID NO: 416238 - DNA, 15 bp, Homo sapiens
catttattccctact

SEQ ID NO: 416239 - DNA, 15 bp, Homo sapiens
atttattccctactt

SEQ ID NO: 416240 - DNA, 15 bp, Homo sapiens
tttattccctactta

SEQ ID NO: 416241 - DNA, 15 bp, Homo sapiens
ttattccctacttag

SEQ ID NO: 416242 - DNA, 15 bp, Homo sapiens
tattccctacttagc

SEQ ID NO: 416243 - DNA, 15 bp, Homo sapiens
attccctacttagca

SEQ ID NO: 416244 - DNA, 15 bp, Homo sapiens
ttccctacttagcaa

SEQ ID NO: 416245 - DNA, 15 bp, Homo sapiens
tccctacttagcaaa

SEQ ID NO: 416246 - DNA, 15 bp, Homo sapiens
ccctacttagcaaat

SEQ ID NO: 416247 - DNA, 15 bp, Homo sapiens
cctacttagcaaata

SEQ ID NO: 416248 - DNA, 15 bp, Homo sapiens
ctacttagcaaatat

SEQ ID NO: 416249 - DNA, 15 bp, Homo sapiens
cttagcaaatatttg

SEQ ID NO: 416250 - DNA, 15 bp, Homo sapiens
ttagcaaatatttgt

SEQ ID NO: 416251 - DNA, 15 bp, Homo sapiens
tagcaaatatttgtg

SEQ ID NO: 416252 - DNA, 15 bp, Homo sapiens
agcaaatatttgtga

SEQ ID NO: 416253 - DNA, 15 bp, Homo sapiens
gcaaatatttgtgaa

SEQ ID NO: 416254 - DNA, 15 bp, Homo sapiens
caaatatttgtgaag

SEQ ID NO: 416255 - DNA, 15 bp, Homo sapiens
aaatatttgtgaagt

SEQ ID NO: 416256 - DNA, 15 bp, Homo sapiens
aatatttgtgaagta

SEQ ID NO: 416257 - DNA, 15 bp, Homo sapiens
atatttgtgaagtat

SEQ ID NO: 416258 - DNA, 15 bp, Homo sapiens
tatttgtgaagtatg

SEQ ID NO: 416259 - DNA, 15 bp, Homo sapiens
atttgtgaagtatgt

SEQ ID NO: 416260 - DNA, 15 bp, Homo sapiens
tttgtgaagtatgta

SEQ ID NO: 416261 - DNA, 15 bp, Homo sapiens
ttgtgaagtatgtac

SEQ ID NO: 416262 - DNA, 15 bp, Homo sapiens
tgtgaagtatgtacc

SEQ ID NO: 416263 - DNA, 15 bp, Homo sapiens
gtgaagtatgtacca

SEQ ID NO: 416264 - DNA, 15 bp, Homo sapiens
tgaagtatgtaccag

SEQ ID NO: 416265 - DNA, 15 bp, Homo sapiens
gaagtatgtaccagg

SEQ ID NO: 416266 - DNA, 15 bp, Homo sapiens
aagtatgtaccaggt

SEQ ID NO: 416267 - DNA, 15 bp, Homo sapiens
agtatgtaccaggtg

SEQ ID NO: 416268 - DNA, 15 bp, Homo sapiens
gtatgtaccaggtgc

SEQ ID NO: 416269 - DNA, 15 bp, Homo sapiens
tatgtaccaggtgct

SEQ ID NO: 416270 - DNA, 15 bp, Homo sapiens
atgtaccaggtgcta

SEQ ID NO: 416271 - DNA, 15 bp, Homo sapiens
tgtaccaggtgctag

SEQ ID NO: 416272 - DNA, 15 bp, Homo sapiens
gtaccaggtgctagt

SEQ ID NO: 416273 - DNA, 15 bp, Homo sapiens
taccaggtgctagtc

SEQ ID NO: 416274 - DNA, 15 bp, Homo sapiens
accaggtgctagtct

SEQ ID NO: 416275 - DNA, 15 bp, Homo sapiens
ccaggtgctagtcta

SEQ ID NO: 416276 - DNA, 15 bp, Homo sapiens
caggtgctagtctaa

SEQ ID NO: 416277 - DNA, 15 bp, Homo sapiens
aggtgctagtctaag

SEQ ID NO: 416278 - DNA, 15 bp, Homo sapiens
ggtgctagtctaagt

SEQ ID NO: 416279 - DNA, 15 bp, Homo sapiens
gtgctagtctaagtg

SEQ ID NO: 416280 - DNA, 15 bp, Homo sapiens
tgctagtctaagtgt

SEQ ID NO: 416281 - DNA, 15 bp, Homo sapiens
gctagtctaagtgta

SEQ ID NO: 416282 - DNA, 15 bp, Homo sapiens
ctagtctaagtgtat

SEQ ID NO: 416283 - DNA, 15 bp, Homo sapiens
tagtctaagtgtata

SEQ ID NO: 416284 - DNA, 15 bp, Homo sapiens
agtctaagtgtatag

SEQ ID NO: 416285 - DNA, 15 bp, Homo sapiens
gtctaagtgtataga

SEQ ID NO: 416286 - DNA, 15 bp, Homo sapiens
tctaagtgtatagat

SEQ ID NO: 416287 - DNA, 15 bp, Homo sapiens
ctaagtgtatagatg

SEQ ID NO: 416288 - DNA, 15 bp, Homo sapiens
taagtgtatagatgg

SEQ ID NO: 416289 - DNA, 15 bp, Homo sapiens
aagtgtatagatgga

SEQ ID NO: 416290 - DNA, 15 bp, Homo sapiens
agtgtatagatggag

SEQ ID NO: 416291 - DNA, 15 bp, Homo sapiens
gtgtatagatggaga

SEQ ID NO: 416292 - DNA, 15 bp, Homo sapiens
tgtatagatggagaa

SEQ ID NO: 416293 - DNA, 15 bp, Homo sapiens
gtatagatggagaag

SEQ ID NO: 416294 - DNA, 15 bp, Homo sapiens
tatagatggagaaga

SEQ ID NO: 416295 - DNA, 15 bp, Homo sapiens
atagatggagaagac

SEQ ID NO: 416296 - DNA, 15 bp, Homo sapiens
tagatggagaagaca

SEQ ID NO: 416297 - DNA, 15 bp, Homo sapiens
agatggagaagacat

SEQ ID NO: 416298 - DNA, 15 bp, Homo sapiens
gatggagaagacatt

SEQ ID NO: 416299 - DNA, 15 bp, Homo sapiens
atggagaagacattg

SEQ ID NO: 416300 - DNA, 15 bp, Homo sapiens
tggagaagacattga

SEQ ID NO: 416301 - DNA, 15 bp, Homo sapiens
ggagaagacattgat

SEQ ID NO: 416302 - DNA, 15 bp, Homo sapiens
gagaagacattgatc

SEQ ID NO: 416303 - DNA, 15 bp, Homo sapiens
agaagacattgatct

SEQ ID NO: 416304 - DNA, 15 bp, Homo sapiens
gaagacattgatctt

SEQ ID NO: 416305 - DNA, 15 bp, Homo sapiens
aagacattgatctta

SEQ ID NO: 416306 - DNA, 15 bp, Homo sapiens
agacattgatcttat

SEQ ID NO: 416307 - DNA, 15 bp, Homo sapiens
gacattgatcttatg

SEQ ID NO: 416308 - DNA, 15 bp, Homo sapiens
acattgatcttatgg

SEQ ID NO: 416309 - DNA, 15 bp, Homo sapiens
cattgatcttatggc

SEQ ID NO: 416310 - DNA, 15 bp, Homo sapiens
attgatcttatggcc

SEQ ID NO: 416311 - DNA, 15 bp, Homo sapiens
ttgatcttatggccg

SEQ ID NO: 416312 - DNA, 15 bp, Homo sapiens
tgatcttatggccga

SEQ ID NO: 416313 - DNA, 15 bp, Homo sapiens
gatcttatggccgaa

SEQ ID NO: 416314 - DNA, 15 bp, Homo sapiens
atcttatggccgaat

SEQ ID NO: 416315 - DNA, 15 bp, Homo sapiens
tcttatggccgaatg

SEQ ID NO: 416316 - DNA, 15 bp, Homo sapiens
cttatggccgaatgg

SEQ ID NO: 416317 - DNA, 15 bp, Homo sapiens
ttatggccgaatggg

SEQ ID NO: 416318 - DNA, 15 bp, Homo sapiens
tatggccgaatggga

SEQ ID NO: 416319 - DNA, 15 bp, Homo sapiens
atggccgaatgggag

SEQ ID NO: 416320 - DNA, 15 bp, Homo sapiens
tggccgaatgggagg

SEQ ID NO: 416321 - DNA, 15 bp, Homo sapiens
ggccgaatgggagga

SEQ ID NO: 416322 - DNA, 15 bp, Homo sapiens
gccgaatgggaggat

SEQ ID NO: 416323 - DNA, 15 bp, Homo sapiens
ccgaatgggaggata

SEQ ID NO: 416324 - DNA, 15 bp, Homo sapiens
cgaatgggaggatac

SEQ ID NO: 416325 - DNA, 15 bp, Homo sapiens
gaatgggaggataca

SEQ ID NO: 416326 - DNA, 15 bp, Homo sapiens
aatgggaggatacag

SEQ ID NO: 416327 - DNA, 15 bp, Homo sapiens
atgggaggatacaga

SEQ ID NO: 416328 - DNA, 15 bp, Homo sapiens
tgggaggatacagac

SEQ ID NO: 416329 - DNA, 15 bp, Homo sapiens
gggaggatacagaca

SEQ ID NO: 416330 - DNA, 15 bp, Homo sapiens
ggaggatacagacaa

SEQ ID NO: 416331 - DNA, 15 bp, Homo sapiens
gaggatacagacaag

SEQ ID NO: 416332 - DNA, 15 bp, Homo sapiens
aggatacagacaagg

SEQ ID NO: 416333 - DNA, 15 bp, Homo sapiens
ggatacagacaagga

SEQ ID NO: 416334 - DNA, 15 bp, Homo sapiens
gatacagacaaggac

SEQ ID NO: 416335 - DNA, 15 bp, Homo sapiens
atacagacaaggaca

SEQ ID NO: 416336 - DNA, 15 bp, Homo sapiens
tacagacaaggacat

SEQ ID NO: 416337 - DNA, 15 bp, Homo sapiens
acagacaaggacatt

SEQ ID NO: 416338 - DNA, 15 bp, Homo sapiens
cagacaaggacattt

SEQ ID NO: 416339 - DNA, 15 bp, Homo sapiens
agacaaggacatttt

SEQ ID NO: 416340 - DNA, 15 bp, Homo sapiens
gacaaggacattttc

SEQ ID NO: 416341 - DNA, 15 bp, Homo sapiens
acaaggacattttca

SEQ ID NO: 416342 - DNA, 15 bp, Homo sapiens
caaggacattttcaa

SEQ ID NO: 416343 - DNA, 15 bp, Homo sapiens
aaggacattttcaat

SEQ ID NO: 416344 - DNA, 15 bp, Homo sapiens
aggacattttcaatg

SEQ ID NO: 416345 - DNA, 15 bp, Homo sapiens
ggacattttcaatga

SEQ ID NO: 416346 - DNA, 15 bp, Homo sapiens
gacattttcaatgac

SEQ ID NO: 416347 - DNA, 15 bp, Homo sapiens
acattttcaatgaca

SEQ ID NO: 416348 - DNA, 15 bp, Homo sapiens
cattttcaatgacaa

SEQ ID NO: 416349 - DNA, 15 bp, Homo sapiens
attttcaatgacaac

SEQ ID NO: 416350 - DNA, 15 bp, Homo sapiens
ttttcaatgacaact

SEQ ID NO: 416351 - DNA, 15 bp, Homo sapiens
tttcaatgacaactg

SEQ ID NO: 416352 - DNA, 15 bp, Homo sapiens
ttcaatgacaactgc

SEQ ID NO: 416353 - DNA, 15 bp, Homo sapiens
tcaatgacaactgca

SEQ ID NO: 416354 - DNA, 15 bp, Homo sapiens
caatgacaactgcat

SEQ ID NO: 416355 - DNA, 15 bp, Homo sapiens
aatgacaactgcata

SEQ ID NO: 416356 - DNA, 15 bp, Homo sapiens
atgacaactgcataa

SEQ ID NO: 416357 - DNA, 15 bp, Homo sapiens
tgacaactgcataat

SEQ ID NO: 416358 - DNA, 15 bp, Homo sapiens
gacaactgcataatt

SEQ ID NO: 416359 - DNA, 15 bp, Homo sapiens
acaactgcataatta

SEQ ID NO: 416360 - DNA, 15 bp, Homo sapiens
caactgcataattaa

SEQ ID NO: 416361 - DNA, 15 bp, Homo sapiens
aactgcataattaag

SEQ ID NO: 416362 - DNA, 15 bp, Homo sapiens
actgcataattaagc

SEQ ID NO: 416363 - DNA, 15 bp, Homo sapiens
ctgcataattaagca

SEQ ID NO: 416364 - DNA, 15 bp, Homo sapiens
tgcataattaagcaa

SEQ ID NO: 416365 - DNA, 15 bp, Homo sapiens
gcataattaagcaaa

SEQ ID NO: 416366 - DNA, 15 bp, Homo sapiens
cataattaagcaaaa

SEQ ID NO: 416367 - DNA, 15 bp, Homo sapiens
ataattaagcaaaag

SEQ ID NO: 416368 - DNA, 15 bp, Homo sapiens
taattaagcaaaagt

SEQ ID NO: 416369 - DNA, 15 bp, Homo sapiens
aattaagcaaaagta

SEQ ID NO: 416370 - DNA, 15 bp, Homo sapiens
attaagcaaaagtag

SEQ ID NO: 416371 - DNA, 15 bp, Homo sapiens
ttaagcaaaagtaga

SEQ ID NO: 416372 - DNA, 15 bp, Homo sapiens
taagcaaaagtagat

SEQ ID NO: 416373 - DNA, 15 bp, Homo sapiens
aagcaaaagtagatg

SEQ ID NO: 416374 - DNA, 15 bp, Homo sapiens
agcaaaagtagatga

SEQ ID NO: 416375 - DNA, 15 bp, Homo sapiens
gcaaaagtagatgaa

SEQ ID NO: 416376 - DNA, 15 bp, Homo sapiens
caaaagtagatgaaa

SEQ ID NO: 416377 - DNA, 15 bp, Homo sapiens
aaaagtagatgaaat

SEQ ID NO: 416378 - DNA, 15 bp, Homo sapiens
aaagtagatgaaatt

SEQ ID NO: 416379 - DNA, 15 bp, Homo sapiens
aagtagatgaaatta

SEQ ID NO: 416380 - DNA, 15 bp, Homo sapiens
agtagatgaaattat

SEQ ID NO: 416381 - DNA, 15 bp, Homo sapiens
gtagatgaaattata

SEQ ID NO: 416382 - DNA, 15 bp, Homo sapiens
tagatgaaattataa

SEQ ID NO: 416383 - DNA, 15 bp, Homo sapiens
agatgaaattataag

SEQ ID NO: 416384 - DNA, 15 bp, Homo sapiens
gatgaaattataaga

SEQ ID NO: 416385 - DNA, 15 bp, Homo sapiens
atgaaattataagag

SEQ ID NO: 416386 - DNA, 15 bp, Homo sapiens
tgaaattataagagt

SEQ ID NO: 416387 - DNA, 15 bp, Homo sapiens
gaaattataagagta

SEQ ID NO: 416388 - DNA, 15 bp, Homo sapiens
aaattataagagtaa

SEQ ID NO: 416389 - DNA, 15 bp, Homo sapiens
aattataagagtaat

SEQ ID NO: 416390 - DNA, 15 bp, Homo sapiens
attataagagtaatg

SEQ ID NO: 416391 - DNA, 15 bp, Homo sapiens
ttataagagtaatga

SEQ ID NO: 416392 - DNA, 15 bp, Homo sapiens
tataagagtaatgat

SEQ ID NO: 416393 - DNA, 15 bp, Homo sapiens
ataagagtaatgata

SEQ ID NO: 416394 - DNA, 15 bp, Homo sapiens
taagagtaatgatag

SEQ ID NO: 416395 - DNA, 15 bp, Homo sapiens
aagagtaatgatagc

SEQ ID NO: 416396 - DNA, 15 bp, Homo sapiens
agagtaatgatagcc

SEQ ID NO: 416397 - DNA, 15 bp, Homo sapiens
gagtaatgatagccc

SEQ ID NO: 416398 - DNA, 15 bp, Homo sapiens
agtaatgatagccct

SEQ ID NO: 416399 - DNA, 15 bp, Homo sapiens
gtaatgatagcccta

SEQ ID NO: 416400 - DNA, 15 bp, Homo sapiens
taatgatagccctaa

SEQ ID NO: 416401 - DNA, 15 bp, Homo sapiens
aatgatagccctaat

SEQ ID NO: 416402 - DNA, 15 bp, Homo sapiens
atgatagccctaatc

SEQ ID NO: 416403 - DNA, 15 bp, Homo sapiens
tgatagccctaatct

SEQ ID NO: 416404 - DNA, 15 bp, Homo sapiens
gatagccctaatctc

SEQ ID NO: 416405 - DNA, 15 bp, Homo sapiens
atagccctaatctca

SEQ ID NO: 416406 - DNA, 15 bp, Homo sapiens
tagccctaatctcag

SEQ ID NO: 416407 - DNA, 15 bp, Homo sapiens
agccctaatctcagt

SEQ ID NO: 416408 - DNA, 15 bp, Homo sapiens
gccctaatctcagta

SEQ ID NO: 416409 - DNA, 15 bp, Homo sapiens
ccctaatctcagtac

SEQ ID NO: 416410 - DNA, 15 bp, Homo sapiens
cctaatctcagtact

SEQ ID NO: 416411 - DNA, 15 bp, Homo sapiens
ctaatctcagtactt

SEQ ID NO: 416412 - DNA, 15 bp, Homo sapiens
taatctcagtacttg

SEQ ID NO: 416413 - DNA, 15 bp, Homo sapiens
aatctcagtacttgt

SEQ ID NO: 416414 - DNA, 15 bp, Homo sapiens
atctcagtacttgtg

SEQ ID NO: 416415 - DNA, 15 bp, Homo sapiens
tctcagtacttgtga

SEQ ID NO: 416416 - DNA, 15 bp, Homo sapiens
ctcagtacttgtgaa

SEQ ID NO: 416417 - DNA, 15 bp, Homo sapiens
tcagtacttgtgaag

SEQ ID NO: 416418 - DNA, 15 bp, Homo sapiens
cagtacttgtgaagt

SEQ ID NO: 416419 - DNA, 15 bp, Homo sapiens
agtacttgtgaagtc

SEQ ID NO: 416420 - DNA, 15 bp, Homo sapiens
gtacttgtgaagtct

SEQ ID NO: 416421 - DNA, 15 bp, Homo sapiens
tacttgtgaagtctc

SEQ ID NO: 416422 - DNA, 15 bp, Homo sapiens
acttgtgaagtctct

SEQ ID NO: 416423 - DNA, 15 bp, Homo sapiens
cttgtgaagtctctc

SEQ ID NO: 416424 - DNA, 15 bp, Homo sapiens
ttgtgaagtctctcc

SEQ ID NO: 416425 - DNA, 15 bp, Homo sapiens
tgtgaagtctctcct

SEQ ID NO: 416426 - DNA, 15 bp, Homo sapiens
gtgaagtctctcctg

SEQ ID NO: 416427 - DNA, 15 bp, Homo sapiens
tgaagtctctcctgg

SEQ ID NO: 416428 - DNA, 15 bp, Homo sapiens
gaagtctctcctgga

SEQ ID NO: 416429 - DNA, 15 bp, Homo sapiens
aagtctctcctggag

SEQ ID NO: 416430 - DNA, 15 bp, Homo sapiens
agtctctcctggaga

SEQ ID NO: 416431 - DNA, 15 bp, Homo sapiens
gtctctcctggagaa

SEQ ID NO: 416432 - DNA, 15 bp, Homo sapiens
tctctcctggagaaa

SEQ ID NO: 416433 - DNA, 15 bp, Homo sapiens
ctctcctggagaaat

SEQ ID NO: 416434 - DNA, 15 bp, Homo sapiens
tctcctggagaaatt

SEQ ID NO: 416435 - DNA, 15 bp, Homo sapiens
ctcctggagaaatta

SEQ ID NO: 416436 - DNA, 15 bp, Homo sapiens
tcctggagaaattac

SEQ ID NO: 416437 - DNA, 15 bp, Homo sapiens
cctggagaaattaca

SEQ ID NO: 416438 - DNA, 15 bp, Homo sapiens
ctggagaaattacat

SEQ ID NO: 416439 - DNA, 15 bp, Homo sapiens
tggagaaattacatt

SEQ ID NO: 416440 - DNA, 15 bp, Homo sapiens
ggagaaattacattt

SEQ ID NO: 416441 - DNA, 15 bp, Homo sapiens
gagaaattacattta

SEQ ID NO: 416442 - DNA, 15 bp, Homo sapiens
agaaattacatttaa

SEQ ID NO: 416443 - DNA, 15 bp, Homo sapiens
gaaattacatttaaa

SEQ ID NO: 416444 - DNA, 15 bp, Homo sapiens
aaattacatttaaac

SEQ ID NO: 416445 - DNA, 15 bp, Homo sapiens
aattacatttaaact

SEQ ID NO: 416446 - DNA, 15 bp, Homo sapiens
attacatttaaactg

SEQ ID NO: 416447 - DNA, 15 bp, Homo sapiens
ttacatttaaactga

SEQ ID NO: 416448 - DNA, 15 bp, Homo sapiens
tacatttaaactgag

SEQ ID NO: 416449 - DNA, 15 bp, Homo sapiens
acatttaaactgaga

SEQ ID NO: 416450 - DNA, 15 bp, Homo sapiens
catttaaactgagac

SEQ ID NO: 416451 - DNA, 15 bp, Homo sapiens
atttaaactgagact

SEQ ID NO: 416452 - DNA, 15 bp, Homo sapiens
tttaaactgagactt

SEQ ID NO: 416453 - DNA, 15 bp, Homo sapiens
ttaaactgagactta

SEQ ID NO: 416454 - DNA, 15 bp, Homo sapiens
taaactgagacttaa

SEQ ID NO: 416455 - DNA, 15 bp, Homo sapiens
aaactgagacttaac

SEQ ID NO: 416456 - DNA, 15 bp, Homo sapiens
aactgagacttaaca

SEQ ID NO: 416457 - DNA, 15 bp, Homo sapiens
actgagacttaacag

SEQ ID NO: 416458 - DNA, 15 bp, Homo sapiens
ctgagacttaacaga

SEQ ID NO: 416459 - DNA, 15 bp, Homo sapiens
tgagacttaacagat

SEQ ID NO: 416460 - DNA, 15 bp, Homo sapiens
gagacttaacagatg

SEQ ID NO: 416461 - DNA, 15 bp, Homo sapiens
agacttaacagatga

SEQ ID NO: 416462 - DNA, 15 bp, Homo sapiens
gacttaacagatgag

SEQ ID NO: 416463 - DNA, 15 bp, Homo sapiens
acttaacagatgagt

SEQ ID NO: 416464 - DNA, 15 bp, Homo sapiens
cttaacagatgagtt

SEQ ID NO: 416465 - DNA, 15 bp, Homo sapiens
ttaacagatgagttt

SEQ ID NO: 416466 - DNA, 15 bp, Homo sapiens
taacagatgagttta

SEQ ID NO: 416467 - DNA, 15 bp, Homo sapiens
aacagatgagtttaa

SEQ ID NO: 416468 - DNA, 15 bp, Homo sapiens
acagatgagtttaag

SEQ ID NO: 416469 - DNA, 15 bp, Homo sapiens
cagatgagtttaagt

SEQ ID NO: 416470 - DNA, 15 bp, Homo sapiens
agatgagtttaagtt

SEQ ID NO: 416471 - DNA, 15 bp, Homo sapiens
gatgagtttaagttg

SEQ ID NO: 416472 - DNA, 15 bp, Homo sapiens
atgagtttaagttga

SEQ ID NO: 416473 - DNA, 15 bp, Homo sapiens
tgagtttaagttgaa

SEQ ID NO: 416474 - DNA, 15 bp, Homo sapiens
gagtttaagttgaaa

SEQ ID NO: 416475 - DNA, 15 bp, Homo sapiens
agtttaagttgaaag

SEQ ID NO: 416476 - DNA, 15 bp, Homo sapiens
gtttaagttgaaaga

SEQ ID NO: 416477 - DNA, 15 bp, Homo sapiens
tttaagttgaaagaa

SEQ ID NO: 416478 - DNA, 15 bp, Homo sapiens
ttaagttgaaagaag

SEQ ID NO: 416479 - DNA, 15 bp, Homo sapiens
taagttgaaagaagg

SEQ ID NO: 416480 - DNA, 15 bp, Homo sapiens
aagttgaaagaagga

SEQ ID NO: 416481 - DNA, 15 bp, Homo sapiens
agttgaaagaaggaa

SEQ ID NO: 416482 - DNA, 15 bp, Homo sapiens
gttgaaagaaggaaa

SEQ ID NO: 416483 - DNA, 15 bp, Homo sapiens
ttgaaagaaggaaat

SEQ ID NO: 416484 - DNA, 15 bp, Homo sapiens
tgaaagaaggaaatg

SEQ ID NO: 416485 - DNA, 15 bp, Homo sapiens
gaaagaaggaaatga

SEQ ID NO: 416486 - DNA, 15 bp, Homo sapiens
aaagaaggaaatgag

SEQ ID NO: 416487 - DNA, 15 bp, Homo sapiens
aagaaggaaatgaga

SEQ ID NO: 416488 - DNA, 15 bp, Homo sapiens
agaaggaaatgagat

SEQ ID NO: 416489 - DNA, 15 bp, Homo sapiens
gaaggaaatgagatt

SEQ ID NO: 416490 - DNA, 15 bp, Homo sapiens
aaggaaatgagatta

SEQ ID NO: 416491 - DNA, 15 bp, Homo sapiens
aggaaatgagattat

SEQ ID NO: 416492 - DNA, 15 bp, Homo sapiens
ggaaatgagattata

SEQ ID NO: 416493 - DNA, 15 bp, Homo sapiens
gaaatgagattatat

SEQ ID NO: 416494 - DNA, 15 bp, Homo sapiens
aaatgagattatata

SEQ ID NO: 416495 - DNA, 15 bp, Homo sapiens
aatgagattatatac

SEQ ID NO: 416496 - DNA, 15 bp, Homo sapiens
atgagattatatacc

SEQ ID NO: 416497 - DNA, 15 bp, Homo sapiens
tgagattatatacca

SEQ ID NO: 416498 - DNA, 15 bp, Homo sapiens
gagattatataccaa

SEQ ID NO: 416499 - DNA, 15 bp, Homo sapiens
agattatataccaat

SEQ ID NO: 416500 - DNA, 15 bp, Homo sapiens
gattatataccaatg

SEQ ID NO: 416501 - DNA, 15 bp, Homo sapiens
attatataccaatgt

SEQ ID NO: 416502 - DNA, 15 bp, Homo sapiens
ttatataccaatgtg

SEQ ID NO: 416503 - DNA, 15 bp, Homo sapiens
tatataccaatgtgt

SEQ ID NO: 416504 - DNA, 15 bp, Homo sapiens
atataccaatgtgtg

SEQ ID NO: 416505 - DNA, 15 bp, Homo sapiens
tataccaatgtgtgt

SEQ ID NO: 416506 - DNA, 15 bp, Homo sapiens
ataccaatgtgtgtg

SEQ ID NO: 416507 - DNA, 15 bp, Homo sapiens
taccaatgtgtgtgc

SEQ ID NO: 416508 - DNA, 15 bp, Homo sapiens
accaatgtgtgtgca

SEQ ID NO: 416509 - DNA, 15 bp, Homo sapiens
ccaatgtgtgtgcat

SEQ ID NO: 416510 - DNA, 15 bp, Homo sapiens
caatgtgtgtgcatg

SEQ ID NO: 416511 - DNA, 15 bp, Homo sapiens
aatgtgtgtgcatgt

SEQ ID NO: 416512 - DNA, 15 bp, Homo sapiens
atgtgtgtgcatgtg

SEQ ID NO: 416513 - DNA, 15 bp, Homo sapiens
tgtgtgtgcatgtgt

SEQ ID NO: 416514 - DNA, 15 bp, Homo sapiens
gtgtgtgcatgtgtg

SEQ ID NO: 416515 - DNA, 15 bp, Homo sapiens
tgtgtgcatgtgtgt

SEQ ID NO: 416516 - DNA, 15 bp, Homo sapiens
tgtgcatgtgtgtgg

SEQ ID NO: 416517 - DNA, 15 bp, Homo sapiens
gtgcatgtgtgtggc

SEQ ID NO: 416518 - DNA, 15 bp, Homo sapiens
tgcatgtgtgtggcc

SEQ ID NO: 416519 - DNA, 15 bp, Homo sapiens
gcatgtgtgtggccc

SEQ ID NO: 416520 - DNA, 15 bp, Homo sapiens
catgtgtgtggccca

SEQ ID NO: 416521 - DNA, 15 bp, Homo sapiens
atgtgtgtggcccat

SEQ ID NO: 416522 - DNA, 15 bp, Homo sapiens
tgtgtgtggcccatg

SEQ ID NO: 416523 - DNA, 15 bp, Homo sapiens
gtgtgtggcccatgg

SEQ ID NO: 416524 - DNA, 15 bp, Homo sapiens
tgtgtggcccatggg

SEQ ID NO: 416525 - DNA, 15 bp, Homo sapiens
gtgtggcccatgggt

SEQ ID NO: 416526 - DNA, 15 bp, Homo sapiens
tgtggcccatgggtg

SEQ ID NO: 416527 - DNA, 15 bp, Homo sapiens
gtggcccatgggtgg

SEQ ID NO: 416528 - DNA, 15 bp, Homo sapiens
tggcccatgggtgga

SEQ ID NO: 416529 - DNA, 15 bp, Homo sapiens
ggcccatgggtggac

SEQ ID NO: 416530 - DNA, 15 bp, Homo sapiens
gcccatgggtggact

SEQ ID NO: 416531 - DNA, 15 bp, Homo sapiens
cccatgggtggactt

SEQ ID NO: 416532 - DNA, 15 bp, Homo sapiens
ccatgggtggacttg

SEQ ID NO: 416533 - DNA, 15 bp, Homo sapiens
catgggtggacttgt

SEQ ID NO: 416534 - DNA, 15 bp, Homo sapiens
atgggtggacttgtg

SEQ ID NO: 416535 - DNA, 15 bp, Homo sapiens
tgggtggacttgtgt

SEQ ID NO: 416536 - DNA, 15 bp, Homo sapiens
gggtggacttgtgtc

SEQ ID NO: 416537 - DNA, 15 bp, Homo sapiens
ggtggacttgtgtca

SEQ ID NO: 416538 - DNA, 15 bp, Homo sapiens
gtggacttgtgtcag

SEQ ID NO: 416539 - DNA, 15 bp, Homo sapiens
tggacttgtgtcagg

SEQ ID NO: 416540 - DNA, 15 bp, Homo sapiens
ggacttgtgtcaggg

SEQ ID NO: 416541 - DNA, 15 bp, Homo sapiens
gacttgtgtcagggg

SEQ ID NO: 416542 - DNA, 15 bp, Homo sapiens
acttgtgtcagggga

SEQ ID NO: 416543 - DNA, 15 bp, Homo sapiens
cttgtgtcaggggaa

SEQ ID NO: 416544 - DNA, 15 bp, Homo sapiens
ttgtgtcaggggaag

SEQ ID NO: 416545 - DNA, 15 bp, Homo sapiens
tgtgtcaggggaaga

SEQ ID NO: 416546 - DNA, 15 bp, Homo sapiens
gtgtcaggggaagaa

SEQ ID NO: 416547 - DNA, 15 bp, Homo sapiens
tgtcaggggaagaaa

SEQ ID NO: 416548 - DNA, 15 bp, Homo sapiens
gtcaggggaagaaat

SEQ ID NO: 416549 - DNA, 15 bp, Homo sapiens
tcaggggaagaaatt

SEQ ID NO: 416550 - DNA, 15 bp, Homo sapiens
caggggaagaaattg

SEQ ID NO: 416551 - DNA, 15 bp, Homo sapiens
aggggaagaaattgg

SEQ ID NO: 416552 - DNA, 15 bp, Homo sapiens
ggggaagaaattggg

SEQ ID NO: 416553 - DNA, 15 bp, Homo sapiens
gggaagaaattggga

SEQ ID NO: 416554 - DNA, 15 bp, Homo sapiens
ggaagaaattgggag

SEQ ID NO: 416555 - DNA, 15 bp, Homo sapiens
gaagaaattgggagc

SEQ ID NO: 416556 - DNA, 15 bp, Homo sapiens
aagaaattgggagct

SEQ ID NO: 416557 - DNA, 15 bp, Homo sapiens
agaaattgggagctt

SEQ ID NO: 416558 - DNA, 15 bp, Homo sapiens
gaaattgggagcttt

SEQ ID NO: 416559 - DNA, 15 bp, Homo sapiens
aaattgggagctttc

SEQ ID NO: 416560 - DNA, 15 bp, Homo sapiens
aattgggagctttca

SEQ ID NO: 416561 - DNA, 15 bp, Homo sapiens
attgggagctttcag

SEQ ID NO: 416562 - DNA, 15 bp, Homo sapiens
ttgggagctttcagg

SEQ ID NO: 416563 - DNA, 15 bp, Homo sapiens
tgggagctttcaggg

SEQ ID NO: 416564 - DNA, 15 bp, Homo sapiens
gggagctttcagggt

SEQ ID NO: 416565 - DNA, 15 bp, Homo sapiens
ggagctttcagggta

SEQ ID NO: 416566 - DNA, 15 bp, Homo sapiens
gagctttcagggtaa

SEQ ID NO: 416567 - DNA, 15 bp, Homo sapiens
agctttcagggtaac

SEQ ID NO: 416568 - DNA, 15 bp, Homo sapiens
gctttcagggtaaca

SEQ ID NO: 416569 - DNA, 15 bp, Homo sapiens
ctttcagggtaacag

SEQ ID NO: 416570 - DNA, 15 bp, Homo sapiens
tttcagggtaacagg

SEQ ID NO: 416571 - DNA, 15 bp, Homo sapiens
ttcagggtaacaggg

SEQ ID NO: 416572 - DNA, 15 bp, Homo sapiens
tcagggtaacaggga

SEQ ID NO: 416573 - DNA, 15 bp, Homo sapiens
cagggtaacagggac

SEQ ID NO: 416574 - DNA, 15 bp, Homo sapiens
agggtaacagggact

SEQ ID NO: 416575 - DNA, 15 bp, Homo sapiens
gggtaacagggactg

SEQ ID NO: 416576 - DNA, 15 bp, Homo sapiens
ggtaacagggactgc

SEQ ID NO: 416577 - DNA, 15 bp, Homo sapiens
gtaacagggactgct

SEQ ID NO: 416578 - DNA, 15 bp, Homo sapiens
taacagggactgctt

SEQ ID NO: 416579 - DNA, 15 bp, Homo sapiens
aacagggactgcttt

SEQ ID NO: 416580 - DNA, 15 bp, Homo sapiens
acagggactgctttg

SEQ ID NO: 416581 - DNA, 15 bp, Homo sapiens
cagggactgctttga

SEQ ID NO: 416582 - DNA, 15 bp, Homo sapiens
agggactgctttgac

SEQ ID NO: 416583 - DNA, 15 bp, Homo sapiens
gggactgctttgaca

SEQ ID NO: 416584 - DNA, 15 bp, Homo sapiens
ggactgctttgacat

SEQ ID NO: 416585 - DNA, 15 bp, Homo sapiens
gactgctttgacatg

SEQ ID NO: 416586 - DNA, 15 bp, Homo sapiens
actgctttgacatgg

SEQ ID NO: 416587 - DNA, 15 bp, Homo sapiens
ctgctttgacatggg

SEQ ID NO: 416588 - DNA, 15 bp, Homo sapiens
tgctttgacatgggt

SEQ ID NO: 416589 - DNA, 15 bp, Homo sapiens
gctttgacatgggtc

SEQ ID NO: 416590 - DNA, 15 bp, Homo sapiens
ctttgacatgggtca

SEQ ID NO: 416591 - DNA, 15 bp, Homo sapiens
tttgacatgggtcag

SEQ ID NO: 416592 - DNA, 15 bp, Homo sapiens
ttgacatgggtcaga

SEQ ID NO: 416593 - DNA, 15 bp, Homo sapiens
tgacatgggtcagaa

SEQ ID NO: 416594 - DNA, 15 bp, Homo sapiens
gacatgggtcagaag

SEQ ID NO: 416595 - DNA, 15 bp, Homo sapiens
acatgggtcagaagt

SEQ ID NO: 416596 - DNA, 15 bp, Homo sapiens
catgggtcagaagtt

SEQ ID NO: 416597 - DNA, 15 bp, Homo sapiens
atgggtcagaagttg

SEQ ID NO: 416598 - DNA, 15 bp, Homo sapiens
tgggtcagaagttga

SEQ ID NO: 416599 - DNA, 15 bp, Homo sapiens
gggtcagaagttgag

SEQ ID NO: 416600 - DNA, 15 bp, Homo sapiens
ggtcagaagttgaga

SEQ ID NO: 416601 - DNA, 15 bp, Homo sapiens
gtcagaagttgagaa

SEQ ID NO: 416602 - DNA, 15 bp, Homo sapiens
tcagaagttgagaag

SEQ ID NO: 416603 - DNA, 15 bp, Homo sapiens
cagaagttgagaagc

SEQ ID NO: 416604 - DNA, 15 bp, Homo sapiens
agaagttgagaagct

SEQ ID NO: 416605 - DNA, 15 bp, Homo sapiens
gaagttgagaagctg

SEQ ID NO: 416606 - DNA, 15 bp, Homo sapiens
aagttgagaagctgt

SEQ ID NO: 416607 - DNA, 15 bp, Homo sapiens
agttgagaagctgtg

SEQ ID NO: 416608 - DNA, 15 bp, Homo sapiens
gttgagaagctgtgt

SEQ ID NO: 416609 - DNA, 15 bp, Homo sapiens
ttgagaagctgtgtg

SEQ ID NO: 416610 - DNA, 15 bp, Homo sapiens
tgagaagctgtgtgc

SEQ ID NO: 416611 - DNA, 15 bp, Homo sapiens
aagctgtgtgcccca

SEQ ID NO: 416612 - DNA, 15 bp, Homo sapiens
agctgtgtgccccag

SEQ ID NO: 416613 - DNA, 15 bp, Homo sapiens
gctgtgtgccccagg

SEQ ID NO: 416614 - DNA, 15 bp, Homo sapiens
ctgtgtgccccaggc

SEQ ID NO: 416615 - DNA, 15 bp, Homo sapiens
tgtgtgccccaggct

SEQ ID NO: 416616 - DNA, 15 bp, Homo sapiens
gtgtgccccaggctt

SEQ ID NO: 416617 - DNA, 15 bp, Homo sapiens
tgtgccccaggcttg

SEQ ID NO: 416618 - DNA, 15 bp, Homo sapiens
gtgccccaggcttgt

SEQ ID NO: 416619 - DNA, 15 bp, Homo sapiens
tgccccaggcttgta

SEQ ID NO: 416620 - DNA, 15 bp, Homo sapiens
gccccaggcttgtag

SEQ ID NO: 416621 - DNA, 15 bp, Homo sapiens
ccccaggcttgtagt

SEQ ID NO: 416622 - DNA, 15 bp, Homo sapiens
cccaggcttgtagtt

SEQ ID NO: 416623 - DNA, 15 bp, Homo sapiens
ccaggcttgtagttt

SEQ ID NO: 416624 - DNA, 15 bp, Homo sapiens
caggcttgtagtttt

SEQ ID NO: 416625 - DNA, 15 bp, Homo sapiens
aggcttgtagtttta

SEQ ID NO: 416626 - DNA, 15 bp, Homo sapiens
ggcttgtagttttaa

SEQ ID NO: 416627 - DNA, 15 bp, Homo sapiens
gcttgtagttttaaa

SEQ ID NO: 416628 - DNA, 15 bp, Homo sapiens
cttgtagttttaaac

SEQ ID NO: 416629 - DNA, 15 bp, Homo sapiens
ttgtagttttaaaca

SEQ ID NO: 416630 - DNA, 15 bp, Homo sapiens
tgtagttttaaacat

SEQ ID NO: 416631 - DNA, 15 bp, Homo sapiens
gtagttttaaacatt

SEQ ID NO: 416632 - DNA, 15 bp, Homo sapiens
tagttttaaacattt

SEQ ID NO: 416633 - DNA, 15 bp, Homo sapiens
agttttaaacatttg

SEQ ID NO: 416634 - DNA, 15 bp, Homo sapiens
gttttaaacatttga

SEQ ID NO: 416635 - DNA, 15 bp, Homo sapiens
ttttaaacatttgaa

SEQ ID NO: 416636 - DNA, 15 bp, Homo sapiens
tttaaacatttgaaa

SEQ ID NO: 416637 - DNA, 15 bp, Homo sapiens
ttaaacatttgaaat

SEQ ID NO: 416638 - DNA, 15 bp, Homo sapiens
taaacatttgaaatg

SEQ ID NO: 416639 - DNA, 15 bp, Homo sapiens
aaacatttgaaatgc

SEQ ID NO: 416640 - DNA, 15 bp, Homo sapiens
aacatttgaaatgcg

SEQ ID NO: 416641 - DNA, 15 bp, Homo sapiens
acatttgaaatgcga

SEQ ID NO: 416642 - DNA, 15 bp, Homo sapiens
catttgaaatgcgat

SEQ ID NO: 416643 - DNA, 15 bp, Homo sapiens
atttgaaatgcgata

SEQ ID NO: 416644 - DNA, 15 bp, Homo sapiens
tttgaaatgcgataa

SEQ ID NO: 416645 - DNA, 15 bp, Homo sapiens
ttgaaatgcgataat

SEQ ID NO: 416646 - DNA, 15 bp, Homo sapiens
tgaaatgcgataatt

SEQ ID NO: 416647 - DNA, 15 bp, Homo sapiens
gaaatgcgataattt

SEQ ID NO: 416648 - DNA, 15 bp, Homo sapiens
aaatgcgataatttt

SEQ ID NO: 416649 - DNA, 15 bp, Homo sapiens
aatgcgataattttt

SEQ ID NO: 416650 - DNA, 15 bp, Homo sapiens
atgcgataatttttc

SEQ ID NO: 416651 - DNA, 15 bp, Homo sapiens
tgcgataatttttct

SEQ ID NO: 416652 - DNA, 15 bp, Homo sapiens
gcgataatttttctc

SEQ ID NO: 416653 - DNA, 15 bp, Homo sapiens
cgataatttttctct

SEQ ID NO: 416654 - DNA, 15 bp, Homo sapiens
gataatttttctctg

SEQ ID NO: 416655 - DNA, 15 bp, Homo sapiens
ataatttttctctgg

SEQ ID NO: 416656 - DNA, 15 bp, Homo sapiens
taatttttctctggg

SEQ ID NO: 416657 - DNA, 15 bp, Homo sapiens
aatttttctctgggt

SEQ ID NO: 416658 - DNA, 15 bp, Homo sapiens
atttttctctgggtt

SEQ ID NO: 416659 - DNA, 15 bp, Homo sapiens
tttttctctgggttt

SEQ ID NO: 416660 - DNA, 15 bp, Homo sapiens
ttttctctgggtttt

SEQ ID NO: 416661 - DNA, 15 bp, Homo sapiens
tttctctgggttttc

SEQ ID NO: 416662 - DNA, 15 bp, Homo sapiens
ttctctgggttttct

SEQ ID NO: 416663 - DNA, 15 bp, Homo sapiens
tctctgggttttctg

SEQ ID NO: 416664 - DNA, 15 bp, Homo sapiens
ctctgggttttctga

SEQ ID NO: 416665 - DNA, 15 bp, Homo sapiens
tctgggttttctgac

SEQ ID NO: 416666 - DNA, 15 bp, Homo sapiens
ctgggttttctgacc

SEQ ID NO: 416667 - DNA, 15 bp, Homo sapiens
tgggttttctgacct

SEQ ID NO: 416668 - DNA, 15 bp, Homo sapiens
gggttttctgacctg

SEQ ID NO: 416669 - DNA, 15 bp, Homo sapiens
ggttttctgacctgt

SEQ ID NO: 416670 - DNA, 15 bp, Homo sapiens
gttttctgacctgtt

SEQ ID NO: 416671 - DNA, 15 bp, Homo sapiens
ttttctgacctgttc

SEQ ID NO: 416672 - DNA, 15 bp, Homo sapiens
tttctgacctgttca

SEQ ID NO: 416673 - DNA, 15 bp, Homo sapiens
ttctgacctgttcag

SEQ ID NO: 416674 - DNA, 15 bp, Homo sapiens
tctgacctgttcagt

SEQ ID NO: 416675 - DNA, 15 bp, Homo sapiens
ctgacctgttcagtt

SEQ ID NO: 416676 - DNA, 15 bp, Homo sapiens
tgacctgttcagttt

SEQ ID NO: 416677 - DNA, 15 bp, Homo sapiens
gacctgttcagtttt

SEQ ID NO: 416678 - DNA, 15 bp, Homo sapiens
acctgttcagttttg

SEQ ID NO: 416679 - DNA, 15 bp, Homo sapiens
cctgttcagttttga

SEQ ID NO: 416680 - DNA, 15 bp, Homo sapiens
ctgttcagttttgat

SEQ ID NO: 416681 - DNA, 15 bp, Homo sapiens
tgttcagttttgatt

SEQ ID NO: 416682 - DNA, 15 bp, Homo sapiens
gttcagttttgatta

SEQ ID NO: 416683 - DNA, 15 bp, Homo sapiens
ttcagttttgattac

SEQ ID NO: 416684 - DNA, 15 bp, Homo sapiens
tcagttttgattaca

SEQ ID NO: 416685 - DNA, 15 bp, Homo sapiens
cagttttgattacac

SEQ ID NO: 416686 - DNA, 15 bp, Homo sapiens
agttttgattacacg

SEQ ID NO: 416687 - DNA, 15 bp, Homo sapiens
gttttgattacacga

SEQ ID NO: 416688 - DNA, 15 bp, Homo sapiens
ttttgattacacgat

SEQ ID NO: 416689 - DNA, 15 bp, Homo sapiens
tttgattacacgatc

SEQ ID NO: 416690 - DNA, 15 bp, Homo sapiens
ttgattacacgatct

SEQ ID NO: 416691 - DNA, 15 bp, Homo sapiens
tgattacacgatctg

SEQ ID NO: 416692 - DNA, 15 bp, Homo sapiens
gattacacgatctga

SEQ ID NO: 416693 - DNA, 15 bp, Homo sapiens
attacacgatctgat

SEQ ID NO: 416694 - DNA, 15 bp, Homo sapiens
ttacacgatctgatt

SEQ ID NO: 416695 - DNA, 15 bp, Homo sapiens
tacacgatctgattt

SEQ ID NO: 416696 - DNA, 15 bp, Homo sapiens
acacgatctgatttg

SEQ ID NO: 416697 - DNA, 15 bp, Homo sapiens
cacgatctgatttgt

SEQ ID NO: 416698 - DNA, 15 bp, Homo sapiens
acgatctgatttgtt

SEQ ID NO: 416699 - DNA, 15 bp, Homo sapiens
cgatctgatttgttt

SEQ ID NO: 416700 - DNA, 15 bp, Homo sapiens
gatctgatttgtttg

SEQ ID NO: 416701 - DNA, 15 bp, Homo sapiens
atctgatttgtttgt

SEQ ID NO: 416702 - DNA, 15 bp, Homo sapiens
tctgatttgtttgtt

SEQ ID NO: 416703 - DNA, 15 bp, Homo sapiens
ctgatttgtttgttc

SEQ ID NO: 416704 - DNA, 15 bp, Homo sapiens
tgatttgtttgttca

SEQ ID NO: 416705 - DNA, 15 bp, Homo sapiens
gatttgtttgttcag

SEQ ID NO: 416706 - DNA, 15 bp, Homo sapiens
atttgtttgttcagt

SEQ ID NO: 416707 - DNA, 15 bp, Homo sapiens
tttgtttgttcagtt

SEQ ID NO: 416708 - DNA, 15 bp, Homo sapiens
ttgtttgttcagttt

SEQ ID NO: 416709 - DNA, 15 bp, Homo sapiens
tgtttgttcagtttt

SEQ ID NO: 416710 - DNA, 15 bp, Homo sapiens
gtttgttcagttttc

SEQ ID NO: 416711 - DNA, 15 bp, Homo sapiens
tttgttcagttttca

SEQ ID NO: 416712 - DNA, 15 bp, Homo sapiens
ttgttcagttttcat

SEQ ID NO: 416713 - DNA, 15 bp, Homo sapiens
tgttcagttttcatc

SEQ ID NO: 416714 - DNA, 15 bp, Homo sapiens
gttcagttttcatca

SEQ ID NO: 416715 - DNA, 15 bp, Homo sapiens
ttcagttttcatcac

SEQ ID NO: 416716 - DNA, 15 bp, Homo sapiens
tcagttttcatcaca

SEQ ID NO: 416717 - DNA, 15 bp, Homo sapiens
cagttttcatcacac

SEQ ID NO: 416718 - DNA, 15 bp, Homo sapiens
agttttcatcacact

SEQ ID NO: 416719 - DNA, 15 bp, Homo sapiens
gttttcatcacacta

SEQ ID NO: 416720 - DNA, 15 bp, Homo sapiens
ttttcatcacactat

SEQ ID NO: 416721 - DNA, 15 bp, Homo sapiens
tttcatcacactatc

SEQ ID NO: 416722 - DNA, 15 bp, Homo sapiens
ttcatcacactatct

SEQ ID NO: 416723 - DNA, 15 bp, Homo sapiens
tcatcacactatctg

SEQ ID NO: 416724 - DNA, 15 bp, Homo sapiens
catcacactatctga

SEQ ID NO: 416725 - DNA, 15 bp, Homo sapiens
atcacactatctgag

SEQ ID NO: 416726 - DNA, 15 bp, Homo sapiens
tcacactatctgagt

SEQ ID NO: 416727 - DNA, 15 bp, Homo sapiens
cacactatctgagtt

SEQ ID NO: 416728 - DNA, 15 bp, Homo sapiens
acactatctgagttt

SEQ ID NO: 416729 - DNA, 15 bp, Homo sapiens
cactatctgagtttg

SEQ ID NO: 416730 - DNA, 15 bp, Homo sapiens
actatctgagtttgt

SEQ ID NO: 416731 - DNA, 15 bp, Homo sapiens
ctatctgagtttgtt

SEQ ID NO: 416732 - DNA, 15 bp, Homo sapiens
tatctgagtttgttc

SEQ ID NO: 416733 - DNA, 15 bp, Homo sapiens
atctgagtttgttcc

SEQ ID NO: 416734 - DNA, 15 bp, Homo sapiens
tctgagtttgttcca

SEQ ID NO: 416735 - DNA, 15 bp, Homo sapiens
ctgagtttgttccac

SEQ ID NO: 416736 - DNA, 15 bp, Homo sapiens
tgagtttgttccact

SEQ ID NO: 416737 - DNA, 15 bp, Homo sapiens
gagtttgttccactt

SEQ ID NO: 416738 - DNA, 15 bp, Homo sapiens
agtttgttccactta

SEQ ID NO: 416739 - DNA, 15 bp, Homo sapiens
gtttgttccacttag

SEQ ID NO: 416740 - DNA, 15 bp, Homo sapiens
tttgttccacttagt

SEQ ID NO: 416741 - DNA, 15 bp, Homo sapiens
ttgttccacttagta

SEQ ID NO: 416742 - DNA, 15 bp, Homo sapiens
tgttccacttagtaa

SEQ ID NO: 416743 - DNA, 15 bp, Homo sapiens
gttccacttagtaat

SEQ ID NO: 416744 - DNA, 15 bp, Homo sapiens
ttccacttagtaatt

SEQ ID NO: 416745 - DNA, 15 bp, Homo sapiens
tccacttagtaattt

SEQ ID NO: 416746 - DNA, 15 bp, Homo sapiens
ccacttagtaatttg

SEQ ID NO: 416747 - DNA, 15 bp, Homo sapiens
cacttagtaatttga

SEQ ID NO: 416748 - DNA, 15 bp, Homo sapiens
acttagtaatttgac

SEQ ID NO: 416749 - DNA, 15 bp, Homo sapiens
cttagtaatttgact

SEQ ID NO: 416750 - DNA, 15 bp, Homo sapiens
ttagtaatttgactg

SEQ ID NO: 416751 - DNA, 15 bp, Homo sapiens
tagtaatttgactgt

SEQ ID NO: 416752 - DNA, 15 bp, Homo sapiens
agtaatttgactgtt

SEQ ID NO: 416753 - DNA, 15 bp, Homo sapiens
gtaatttgactgttt

SEQ ID NO: 416754 - DNA, 15 bp, Homo sapiens
aatttgactgttttc

SEQ ID NO: 416755 - DNA, 15 bp, Homo sapiens
atttgactgttttct

SEQ ID NO: 416756 - DNA, 15 bp, Homo sapiens
tttgactgttttcta

SEQ ID NO: 416757 - DNA, 15 bp, Homo sapiens
ttgactgttttctac

SEQ ID NO: 416758 - DNA, 15 bp, Homo sapiens
tgactgttttctact

SEQ ID NO: 416759 - DNA, 15 bp, Homo sapiens
gactgttttctactc

SEQ ID NO: 416760 - DNA, 15 bp, Homo sapiens
actgttttctactct

SEQ ID NO: 416761 - DNA, 15 bp, Homo sapiens
ctgttttctactctg

SEQ ID NO: 416762 - DNA, 15 bp, Homo sapiens
tgttttctactctgt

SEQ ID NO: 416763 - DNA, 15 bp, Homo sapiens
gttttctactctgtt

SEQ ID NO: 416764 - DNA, 15 bp, Homo sapiens
ttttctactctgttg

SEQ ID NO: 416765 - DNA, 15 bp, Homo sapiens
tttctactctgttgt

SEQ ID NO: 416766 - DNA, 15 bp, Homo sapiens
ttctactctgttgtc

SEQ ID NO: 416767 - DNA, 15 bp, Homo sapiens
tctactctgttgtct

SEQ ID NO: 416768 - DNA, 15 bp, Homo sapiens
ctactctgttgtctt

SEQ ID NO: 416769 - DNA, 15 bp, Homo sapiens
tactctgttgtctta

SEQ ID NO: 416770 - DNA, 15 bp, Homo sapiens
actctgttgtcttac

SEQ ID NO: 416771 - DNA, 15 bp, Homo sapiens
ctctgttgtcttact

SEQ ID NO: 416772 - DNA, 15 bp, Homo sapiens
tctgttgtcttactt

SEQ ID NO: 416773 - DNA, 15 bp, Homo sapiens
ctgttgtcttacttt

SEQ ID NO: 416774 - DNA, 15 bp, Homo sapiens
tgttgtcttactttt

SEQ ID NO: 416775 - DNA, 15 bp, Homo sapiens
gttgtcttacttttt

SEQ ID NO: 416776 - DNA, 15 bp, Homo sapiens
ttgtcttactttttt

SEQ ID NO: 416777 - DNA, 15 bp, Homo sapiens
tgtcttacttttttt

SEQ ID NO: 416778 - DNA, 15 bp, Homo sapiens
gtcttactttttttt

SEQ ID NO: 416779 - DNA, 15 bp, Homo sapiens
tttttggagacatgg

SEQ ID NO: 416780 - DNA, 15 bp, Homo sapiens
ttttggagacatgga

SEQ ID NO: 416781 - DNA, 15 bp, Homo sapiens
tttggagacatggac

SEQ ID NO: 416782 - DNA, 15 bp, Homo sapiens
ttggagacatggact

SEQ ID NO: 416783 - DNA, 15 bp, Homo sapiens
tggagacatggactt

SEQ ID NO: 416784 - DNA, 15 bp, Homo sapiens
ggagacatggacttg

SEQ ID NO: 416785 - DNA, 15 bp, Homo sapiens
gagacatggacttgc

SEQ ID NO: 416786 - DNA, 15 bp, Homo sapiens
agacatggacttgct

SEQ ID NO: 416787 - DNA, 15 bp, Homo sapiens
gacatggacttgctg

SEQ ID NO: 416788 - DNA, 15 bp, Homo sapiens
acatggacttgctgt

SEQ ID NO: 416789 - DNA, 15 bp, Homo sapiens
catggacttgctgtg

SEQ ID NO: 416790 - DNA, 15 bp, Homo sapiens
atggacttgctgtgt

SEQ ID NO: 416791 - DNA, 15 bp, Homo sapiens
tggacttgctgtgtt

SEQ ID NO: 416792 - DNA, 15 bp, Homo sapiens
ggacttgctgtgttg

SEQ ID NO: 416793 - DNA, 15 bp, Homo sapiens
gacttgctgtgttgc

SEQ ID NO: 416794 - DNA, 15 bp, Homo sapiens
acttgctgtgttgct

SEQ ID NO: 416795 - DNA, 15 bp, Homo sapiens
cttgctgtgttgctc

SEQ ID NO: 416796 - DNA, 15 bp, Homo sapiens
ttgctgtgttgctca

SEQ ID NO: 416797 - DNA, 15 bp, Homo sapiens
tgctgtgttgctcag

SEQ ID NO: 416798 - DNA, 15 bp, Homo sapiens
gctgtgttgctcagg

SEQ ID NO: 416799 - DNA, 15 bp, Homo sapiens
ctgtgttgctcaggc

SEQ ID NO: 416800 - DNA, 15 bp, Homo sapiens
tgtgttgctcaggct

SEQ ID NO: 416801 - DNA, 15 bp, Homo sapiens
gtgttgctcaggctg

SEQ ID NO: 416802 - DNA, 15 bp, Homo sapiens
tgttgctcaggctga

SEQ ID NO: 416803 - DNA, 15 bp, Homo sapiens
gttgctcaggctgac

SEQ ID NO: 416804 - DNA, 15 bp, Homo sapiens
ttgctcaggctgacc

SEQ ID NO: 416805 - DNA, 15 bp, Homo sapiens
tgctcaggctgacct

SEQ ID NO: 416806 - DNA, 15 bp, Homo sapiens
gctcaggctgacctt

SEQ ID NO: 416807 - DNA, 15 bp, Homo sapiens
ctcaggctgaccttg

SEQ ID NO: 416808 - DNA, 15 bp, Homo sapiens
tcaggctgaccttga

SEQ ID NO: 416809 - DNA, 15 bp, Homo sapiens
caggctgaccttgaa

SEQ ID NO: 416810 - DNA, 15 bp, Homo sapiens
aggctgaccttgaac

SEQ ID NO: 416811 - DNA, 15 bp, Homo sapiens
ggctgaccttgaact

SEQ ID NO: 416812 - DNA, 15 bp, Homo sapiens
gctgaccttgaactc

SEQ ID NO: 416813 - DNA, 15 bp, Homo sapiens
ctgaccttgaactcc

SEQ ID NO: 416814 - DNA, 15 bp, Homo sapiens
tgaccttgaactcct

SEQ ID NO: 416815 - DNA, 15 bp, Homo sapiens
gaccttgaactcctg

SEQ ID NO: 416816 - DNA, 15 bp, Homo sapiens
accttgaactcctgg

SEQ ID NO: 416817 - DNA, 15 bp, Homo sapiens
ggctcaagctatcca

SEQ ID NO: 416818 - DNA, 15 bp, Homo sapiens
gctcaagctatccac

SEQ ID NO: 416819 - DNA, 15 bp, Homo sapiens
ctcaagctatccacc

SEQ ID NO: 416820 - DNA, 15 bp, Homo sapiens
tcaagctatccaccc

SEQ ID NO: 416821 - DNA, 15 bp, Homo sapiens
caagctatccaccca

SEQ ID NO: 416822 - DNA, 15 bp, Homo sapiens
aagctatccacccac

SEQ ID NO: 416823 - DNA, 15 bp, Homo sapiens
agctatccacccacc

SEQ ID NO: 416824 - DNA, 15 bp, Homo sapiens
gctatccacccacct

SEQ ID NO: 416825 - DNA, 15 bp, Homo sapiens
ctatccacccacctc

SEQ ID NO: 416826 - DNA, 15 bp, Homo sapiens
tatccacccacctcg

SEQ ID NO: 416827 - DNA, 15 bp, Homo sapiens
atccacccacctcga

SEQ ID NO: 416828 - DNA, 15 bp, Homo sapiens
tccacccacctcgag

SEQ ID NO: 416829 - DNA, 15 bp, Homo sapiens
ccacccacctcgagt

SEQ ID NO: 416830 - DNA, 15 bp, Homo sapiens
cacccacctcgagtc

SEQ ID NO: 416831 - DNA, 15 bp, Homo sapiens
acccacctcgagtct

SEQ ID NO: 416832 - DNA, 15 bp, Homo sapiens
cccacctcgagtctt

SEQ ID NO: 416833 - DNA, 15 bp, Homo sapiens
ccacctcgagtctta

SEQ ID NO: 416834 - DNA, 15 bp, Homo sapiens
cacctcgagtcttac

SEQ ID NO: 416835 - DNA, 15 bp, Homo sapiens
acctcgagtcttacc

SEQ ID NO: 416836 - DNA, 15 bp, Homo sapiens
cctcgagtcttacct

SEQ ID NO: 416837 - DNA, 15 bp, Homo sapiens
ctcgagtcttaccta

SEQ ID NO: 416838 - DNA, 15 bp, Homo sapiens
tcgagtcttacctat

SEQ ID NO: 416839 - DNA, 15 bp, Homo sapiens
cgagtcttacctata

SEQ ID NO: 416840 - DNA, 15 bp, Homo sapiens
gagtcttacctatat

SEQ ID NO: 416841 - DNA, 15 bp, Homo sapiens
agtcttacctatatt

SEQ ID NO: 416842 - DNA, 15 bp, Homo sapiens
gtcttacctatattt

SEQ ID NO: 416843 - DNA, 15 bp, Homo sapiens
tcttacctatattta

SEQ ID NO: 416844 - DNA, 15 bp, Homo sapiens
cttacctatatttat

SEQ ID NO: 416845 - DNA, 15 bp, Homo sapiens
ttacctatatttatc

SEQ ID NO: 416846 - DNA, 15 bp, Homo sapiens
tacctatatttatca

SEQ ID NO: 416847 - DNA, 15 bp, Homo sapiens
acctatatttatcat

SEQ ID NO: 416848 - DNA, 15 bp, Homo sapiens
cctatatttatcatc

SEQ ID NO: 416849 - DNA, 15 bp, Homo sapiens
ctatatttatcatca

SEQ ID NO: 416850 - DNA, 15 bp, Homo sapiens
tatatttatcatcac

SEQ ID NO: 416851 - DNA, 15 bp, Homo sapiens
atatttatcatcaca

SEQ ID NO: 416852 - DNA, 15 bp, Homo sapiens
tatttatcatcacag

SEQ ID NO: 416853 - DNA, 15 bp, Homo sapiens
atttatcatcacaga

SEQ ID NO: 416854 - DNA, 15 bp, Homo sapiens
tttatcatcacagat

SEQ ID NO: 416855 - DNA, 15 bp, Homo sapiens
ttatcatcacagata

SEQ ID NO: 416856 - DNA, 15 bp, Homo sapiens
aatgcataataatca

SEQ ID NO: 416857 - DNA, 15 bp, Homo sapiens
atgcataataatcac

SEQ ID NO: 416858 - DNA, 15 bp, Homo sapiens
tgcataataatcaca

SEQ ID NO: 416859 - DNA, 15 bp, Homo sapiens
gcataataatcacat

SEQ ID NO: 416860 - DNA, 15 bp, Homo sapiens
cataataatcacatc

SEQ ID NO: 416861 - DNA, 15 bp, Homo sapiens
ataataatcacatcg

SEQ ID NO: 416862 - DNA, 15 bp, Homo sapiens
taataatcacatcgt

SEQ ID NO: 416863 - DNA, 15 bp, Homo sapiens
aataatcacatcgtg

SEQ ID NO: 416864 - DNA, 15 bp, Homo sapiens
ataatcacatcgtgg

SEQ ID NO: 416865 - DNA, 15 bp, Homo sapiens
taatcacatcgtgga

SEQ ID NO: 416866 - DNA, 15 bp, Homo sapiens
aatcacatcgtggaa

SEQ ID NO: 416867 - DNA, 15 bp, Homo sapiens
atcacatcgtggaaa

SEQ ID NO: 416868 - DNA, 15 bp, Homo sapiens
tcacatcgtggaaaa

SEQ ID NO: 416869 - DNA, 15 bp, Homo sapiens
cacatcgtggaaaat

SEQ ID NO: 416870 - DNA, 15 bp, Homo sapiens
acatcgtggaaaatg

SEQ ID NO: 416871 - DNA, 15 bp, Homo sapiens
catcgtggaaaatgt

SEQ ID NO: 416872 - DNA, 15 bp, Homo sapiens
atcgtggaaaatgtg

SEQ ID NO: 416873 - DNA, 15 bp, Homo sapiens
tcgtggaaaatgtgg

SEQ ID NO: 416874 - DNA, 15 bp, Homo sapiens
cgtggaaaatgtggt

SEQ ID NO: 416875 - DNA, 15 bp, Homo sapiens
gtggaaaatgtggta

SEQ ID NO: 416876 - DNA, 15 bp, Homo sapiens
tggaaaatgtggtat

SEQ ID NO: 416877 - DNA, 15 bp, Homo sapiens
ggaaaatgtggtatc

SEQ ID NO: 416878 - DNA, 15 bp, Homo sapiens
gaaaatgtggtatct

SEQ ID NO: 416879 - DNA, 15 bp, Homo sapiens
aaaatgtggtatcta

SEQ ID NO: 416880 - DNA, 15 bp, Homo sapiens
aaatgtggtatctat

SEQ ID NO: 416881 - DNA, 15 bp, Homo sapiens
aatgtggtatctatc

SEQ ID NO: 416882 - DNA, 15 bp, Homo sapiens
atgtggtatctatcc

SEQ ID NO: 416883 - DNA, 15 bp, Homo sapiens
tgtggtatctatccc

SEQ ID NO: 416884 - DNA, 15 bp, Homo sapiens
gtggtatctatcccc

SEQ ID NO: 416885 - DNA, 15 bp, Homo sapiens
tggtatctatcccct

SEQ ID NO: 416886 - DNA, 15 bp, Homo sapiens
ggtatctatcccctc

SEQ ID NO: 416887 - DNA, 15 bp, Homo sapiens
gtatctatcccctca

SEQ ID NO: 416888 - DNA, 15 bp, Homo sapiens
tatctatcccctcaa

SEQ ID NO: 416889 - DNA, 15 bp, Homo sapiens
atctatcccctcaag

SEQ ID NO: 416890 - DNA, 15 bp, Homo sapiens
tctatcccctcaagc

SEQ ID NO: 416891 - DNA, 15 bp, Homo sapiens
ctatcccctcaagca

SEQ ID NO: 416892 - DNA, 15 bp, Homo sapiens
tatcccctcaagcat

SEQ ID NO: 416893 - DNA, 15 bp, Homo sapiens
atcccctcaagcatt

SEQ ID NO: 416894 - DNA, 15 bp, Homo sapiens
tcccctcaagcattt

SEQ ID NO: 416895 - DNA, 15 bp, Homo sapiens
cccctcaagcattta

SEQ ID NO: 416896 - DNA, 15 bp, Homo sapiens
ccctcaagcatttat

SEQ ID NO: 416897 - DNA, 15 bp, Homo sapiens
cctcaagcatttatc

SEQ ID NO: 416898 - DNA, 15 bp, Homo sapiens
ctcaagcatttatct

SEQ ID NO: 416899 - DNA, 15 bp, Homo sapiens
tcaagcatttatctt

SEQ ID NO: 416900 - DNA, 15 bp, Homo sapiens
caagcatttatcttt

SEQ ID NO: 416901 - DNA, 15 bp, Homo sapiens
aagcatttatctttt

SEQ ID NO: 416902 - DNA, 15 bp, Homo sapiens
agcatttatcttttg

SEQ ID NO: 416903 - DNA, 15 bp, Homo sapiens
gcatttatcttttgt

SEQ ID NO: 416904 - DNA, 15 bp, Homo sapiens
catttatcttttgtg

SEQ ID NO: 416905 - DNA, 15 bp, Homo sapiens
atttatcttttgtgt

SEQ ID NO: 416906 - DNA, 15 bp, Homo sapiens
tttatcttttgtgtt

SEQ ID NO: 416907 - DNA, 15 bp, Homo sapiens
ttatcttttgtgtta

SEQ ID NO: 416908 - DNA, 15 bp, Homo sapiens
tatcttttgtgttac

SEQ ID NO: 416909 - DNA, 15 bp, Homo sapiens
atcttttgtgttaca

SEQ ID NO: 416910 - DNA, 15 bp, Homo sapiens
tcttttgtgttacaa

SEQ ID NO: 416911 - DNA, 15 bp, Homo sapiens
cttttgtgttacaaa

SEQ ID NO: 416912 - DNA, 15 bp, Homo sapiens
ttttgtgttacaaac

SEQ ID NO: 416913 - DNA, 15 bp, Homo sapiens
tttgtgttacaaaca

SEQ ID NO: 416914 - DNA, 15 bp, Homo sapiens
ttgtgttacaaacaa

SEQ ID NO: 416915 - DNA, 15 bp, Homo sapiens
tgtgttacaaacaat

SEQ ID NO: 416916 - DNA, 15 bp, Homo sapiens
gtgttacaaacaatc

SEQ ID NO: 416917 - DNA, 15 bp, Homo sapiens
tgttacaaacaatcc

SEQ ID NO: 416918 - DNA, 15 bp, Homo sapiens
gttacaaacaatcca

SEQ ID NO: 416919 - DNA, 15 bp, Homo sapiens
ttacaaacaatccaa

SEQ ID NO: 416920 - DNA, 15 bp, Homo sapiens
tacaaacaatccaat

SEQ ID NO: 416921 - DNA, 15 bp, Homo sapiens
acaaacaatccaatt

SEQ ID NO: 416922 - DNA, 15 bp, Homo sapiens
caaacaatccaatta

SEQ ID NO: 416923 - DNA, 15 bp, Homo sapiens
aaacaatccaattat

SEQ ID NO: 416924 - DNA, 15 bp, Homo sapiens
aacaatccaattata

SEQ ID NO: 416925 - DNA, 15 bp, Homo sapiens
acaatccaattatac

SEQ ID NO: 416926 - DNA, 15 bp, Homo sapiens
caatccaattatact

SEQ ID NO: 416927 - DNA, 15 bp, Homo sapiens
aatccaattatactt

SEQ ID NO: 416928 - DNA, 15 bp, Homo sapiens
atccaattatacttt

SEQ ID NO: 416929 - DNA, 15 bp, Homo sapiens
tccaattatactttt

SEQ ID NO: 416930 - DNA, 15 bp, Homo sapiens
ccaattatacttttt

SEQ ID NO: 416931 - DNA, 15 bp, Homo sapiens
caattatactttttt

SEQ ID NO: 416932 - DNA, 15 bp, Homo sapiens
aattatactttttta

SEQ ID NO: 416933 - DNA, 15 bp, Homo sapiens
attatacttttttag

SEQ ID NO: 416934 - DNA, 15 bp, Homo sapiens
ttatacttttttagt

SEQ ID NO: 416935 - DNA, 15 bp, Homo sapiens
tatacttttttagtt

SEQ ID NO: 416936 - DNA, 15 bp, Homo sapiens
atacttttttagtta

SEQ ID NO: 416937 - DNA, 15 bp, Homo sapiens
tacttttttagttat

SEQ ID NO: 416938 - DNA, 15 bp, Homo sapiens
acttttttagttatt

SEQ ID NO: 416939 - DNA, 15 bp, Homo sapiens
cttttttagttattt

SEQ ID NO: 416940 - DNA, 15 bp, Homo sapiens
ttttttagttatttt

SEQ ID NO: 416941 - DNA, 15 bp, Homo sapiens
tttttagttatttta

SEQ ID NO: 416942 - DNA, 15 bp, Homo sapiens
ttttagttattttaa

SEQ ID NO: 416943 - DNA, 15 bp, Homo sapiens
tttagttattttaaa

SEQ ID NO: 416944 - DNA, 15 bp, Homo sapiens
ttagttattttaaaa

SEQ ID NO: 416945 - DNA, 15 bp, Homo sapiens
tagttattttaaaat

SEQ ID NO: 416946 - DNA, 15 bp, Homo sapiens
agttattttaaaatg

SEQ ID NO: 416947 - DNA, 15 bp, Homo sapiens
ttattttaaaatgta

SEQ ID NO: 416948 - DNA, 15 bp, Homo sapiens
tattttaaaatgtac

SEQ ID NO: 416949 - DNA, 15 bp, Homo sapiens
attttaaaatgtaca

SEQ ID NO: 416950 - DNA, 15 bp, Homo sapiens
tttaaaatgtacaac

SEQ ID NO: 416951 - DNA, 15 bp, Homo sapiens
ttaaaatgtacaact

SEQ ID NO: 416952 - DNA, 15 bp, Homo sapiens
taaaatgtacaacta

SEQ ID NO: 416953 - DNA, 15 bp, Homo sapiens
aaaatgtacaactaa

SEQ ID NO: 416954 - DNA, 15 bp, Homo sapiens
aaatgtacaactaag

SEQ ID NO: 416955 - DNA, 15 bp, Homo sapiens
aatgtacaactaagt

SEQ ID NO: 416956 - DNA, 15 bp, Homo sapiens
atgtacaactaagtt

SEQ ID NO: 416957 - DNA, 15 bp, Homo sapiens
tgtacaactaagtta

SEQ ID NO: 416958 - DNA, 15 bp, Homo sapiens
gtacaactaagttat

SEQ ID NO: 416959 - DNA, 15 bp, Homo sapiens
tacaactaagttatt

SEQ ID NO: 416960 - DNA, 15 bp, Homo sapiens
acaactaagttatta

SEQ ID NO: 416961 - DNA, 15 bp, Homo sapiens
caactaagttattat

SEQ ID NO: 416962 - DNA, 15 bp, Homo sapiens
aactaagttattatt

SEQ ID NO: 416963 - DNA, 15 bp, Homo sapiens
actaagttattattg

SEQ ID NO: 416964 - DNA, 15 bp, Homo sapiens
ctaagttattattga

SEQ ID NO: 416965 - DNA, 15 bp, Homo sapiens
taagttattattgac

SEQ ID NO: 416966 - DNA, 15 bp, Homo sapiens
aagttattattgact

SEQ ID NO: 416967 - DNA, 15 bp, Homo sapiens
agttattattgacta

SEQ ID NO: 416968 - DNA, 15 bp, Homo sapiens
gttattattgactat

SEQ ID NO: 416969 - DNA, 15 bp, Homo sapiens
ttattattgactata

SEQ ID NO: 416970 - DNA, 15 bp, Homo sapiens
tattattgactataa

SEQ ID NO: 416971 - DNA, 15 bp, Homo sapiens
attattgactataat

SEQ ID NO: 416972 - DNA, 15 bp, Homo sapiens
ttattgactataatc

SEQ ID NO: 416973 - DNA, 15 bp, Homo sapiens
tattgactataatca

SEQ ID NO: 416974 - DNA, 15 bp, Homo sapiens
attgactataatcac

SEQ ID NO: 416975 - DNA, 15 bp, Homo sapiens
ttgactataatcacc

SEQ ID NO: 416976 - DNA, 15 bp, Homo sapiens
tgactataatcaccc

SEQ ID NO: 416977 - DNA, 15 bp, Homo sapiens
gactataatcaccct

SEQ ID NO: 416978 - DNA, 15 bp, Homo sapiens
actataatcaccctt

SEQ ID NO: 416979 - DNA, 15 bp, Homo sapiens
ctataatcacccttg

SEQ ID NO: 416980 - DNA, 15 bp, Homo sapiens
tataatcacccttgt

SEQ ID NO: 416981 - DNA, 15 bp, Homo sapiens
ataatcacccttgtt

SEQ ID NO: 416982 - DNA, 15 bp, Homo sapiens
taatcacccttgttt

SEQ ID NO: 416983 - DNA, 15 bp, Homo sapiens
aatcacccttgtttt

SEQ ID NO: 416984 - DNA, 15 bp, Homo sapiens
atcacccttgttttg

SEQ ID NO: 416985 - DNA, 15 bp, Homo sapiens
tcacccttgttttgc

SEQ ID NO: 416986 - DNA, 15 bp, Homo sapiens
cacccttgttttgct

SEQ ID NO: 416987 - DNA, 15 bp, Homo sapiens
acccttgttttgcta

SEQ ID NO: 416988 - DNA, 15 bp, Homo sapiens
cccttgttttgctat

SEQ ID NO: 416989 - DNA, 15 bp, Homo sapiens
ccttgttttgctatc

SEQ ID NO: 416990 - DNA, 15 bp, Homo sapiens
cttgttttgctatca

SEQ ID NO: 416991 - DNA, 15 bp, Homo sapiens
ttgttttgctatcaa

SEQ ID NO: 416992 - DNA, 15 bp, Homo sapiens
tgttttgctatcaaa

SEQ ID NO: 416993 - DNA, 15 bp, Homo sapiens
gttttgctatcaaat

SEQ ID NO: 416994 - DNA, 15 bp, Homo sapiens
ttttgctatcaaata

SEQ ID NO: 416995 - DNA, 15 bp, Homo sapiens
tttgctatcaaatac

SEQ ID NO: 416996 - DNA, 15 bp, Homo sapiens
ttgctatcaaatact

SEQ ID NO: 416997 - DNA, 15 bp, Homo sapiens
tgctatcaaatactg

SEQ ID NO: 416998 - DNA, 15 bp, Homo sapiens
gctatcaaatactgg

SEQ ID NO: 416999 - DNA, 15 bp, Homo sapiens
ctatcaaatactgga

SEQ ID NO: 417000 - DNA, 15 bp, Homo sapiens
tatcaaatactggat

SEQ ID NO: 417001 - DNA, 15 bp, Homo sapiens
atcaaatactggatc

SEQ ID NO: 417002 - DNA, 15 bp, Homo sapiens
tcaaatactggatct

SEQ ID NO: 417003 - DNA, 15 bp, Homo sapiens
caaatactggatctt

SEQ ID NO: 417004 - DNA, 15 bp, Homo sapiens
aaatactggatctta

SEQ ID NO: 417005 - DNA, 15 bp, Homo sapiens
aatactggatcttat

SEQ ID NO: 417006 - DNA, 15 bp, Homo sapiens
atactggatcttatt

SEQ ID NO: 417007 - DNA, 15 bp, Homo sapiens
tactggatcttattc

SEQ ID NO: 417008 - DNA, 15 bp, Homo sapiens
actggatcttattca

SEQ ID NO: 417009 - DNA, 15 bp, Homo sapiens
ctggatcttattcat

SEQ ID NO: 417010 - DNA, 15 bp, Homo sapiens
tggatcttattcatt

SEQ ID NO: 417011 - DNA, 15 bp, Homo sapiens
ggatcttattcattc

SEQ ID NO: 417012 - DNA, 15 bp, Homo sapiens
gatcttattcattct

SEQ ID NO: 417013 - DNA, 15 bp, Homo sapiens
atcttattcattctt

SEQ ID NO: 417014 - DNA, 15 bp, Homo sapiens
tcttattcattcttt

SEQ ID NO: 417015 - DNA, 15 bp, Homo sapiens
cttattcattctttc

SEQ ID NO: 417016 - DNA, 15 bp, Homo sapiens
ttattcattctttct

SEQ ID NO: 417017 - DNA, 15 bp, Homo sapiens
tattcattctttcta

SEQ ID NO: 417018 - DNA, 15 bp, Homo sapiens
attcattctttctaa

SEQ ID NO: 417019 - DNA, 15 bp, Homo sapiens
ttcattctttctaac

SEQ ID NO: 417020 - DNA, 15 bp, Homo sapiens
tcattctttctaact

SEQ ID NO: 417021 - DNA, 15 bp, Homo sapiens
cattctttctaactg

SEQ ID NO: 417022 - DNA, 15 bp, Homo sapiens
attctttctaactgt

SEQ ID NO: 417023 - DNA, 15 bp, Homo sapiens
ttctttctaactgtt

SEQ ID NO: 417024 - DNA, 15 bp, Homo sapiens
tctttctaactgttt

SEQ ID NO: 417025 - DNA, 15 bp, Homo sapiens
ctttctaactgtttt

SEQ ID NO: 417026 - DNA, 15 bp, Homo sapiens
tttctaactgtttta

SEQ ID NO: 417027 - DNA, 15 bp, Homo sapiens
ttctaactgttttat

SEQ ID NO: 417028 - DNA, 15 bp, Homo sapiens
tctaactgttttata

SEQ ID NO: 417029 - DNA, 15 bp, Homo sapiens
ctaactgttttatac

SEQ ID NO: 417030 - DNA, 15 bp, Homo sapiens
taactgttttatacc

SEQ ID NO: 417031 - DNA, 15 bp, Homo sapiens
aactgttttatacct

SEQ ID NO: 417032 - DNA, 15 bp, Homo sapiens
actgttttataccta

SEQ ID NO: 417033 - DNA, 15 bp, Homo sapiens
ctgttttatacctat

SEQ ID NO: 417034 - DNA, 15 bp, Homo sapiens
tgttttatacctatt

SEQ ID NO: 417035 - DNA, 15 bp, Homo sapiens
gttttatacctatta

SEQ ID NO: 417036 - DNA, 15 bp, Homo sapiens
ttttatacctattaa

SEQ ID NO: 417037 - DNA, 15 bp, Homo sapiens
tttatacctattaat

SEQ ID NO: 417038 - DNA, 15 bp, Homo sapiens
ttatacctattaatc

SEQ ID NO: 417039 - DNA, 15 bp, Homo sapiens
tatacctattaatca

SEQ ID NO: 417040 - DNA, 15 bp, Homo sapiens
atacctattaatcat

SEQ ID NO: 417041 - DNA, 15 bp, Homo sapiens
tacctattaatcatc

SEQ ID NO: 417042 - DNA, 15 bp, Homo sapiens
acctattaatcatca

SEQ ID NO: 417043 - DNA, 15 bp, Homo sapiens
cctattaatcatcac

SEQ ID NO: 417044 - DNA, 15 bp, Homo sapiens
ctattaatcatcacc

SEQ ID NO: 417045 - DNA, 15 bp, Homo sapiens
tattaatcatcacca

SEQ ID NO: 417046 - DNA, 15 bp, Homo sapiens
attaatcatcaccac

SEQ ID NO: 417047 - DNA, 15 bp, Homo sapiens
ttaatcatcaccact

SEQ ID NO: 417048 - DNA, 15 bp, Homo sapiens
taatcatcaccactt

SEQ ID NO: 417049 - DNA, 15 bp, Homo sapiens
aatcatcaccacttc

SEQ ID NO: 417050 - DNA, 15 bp, Homo sapiens
atcatcaccacttcc

SEQ ID NO: 417051 - DNA, 15 bp, Homo sapiens
tcatcaccacttcct

SEQ ID NO: 417052 - DNA, 15 bp, Homo sapiens
catcaccacttcctc

SEQ ID NO: 417053 - DNA, 15 bp, Homo sapiens
atcaccacttcctcc

SEQ ID NO: 417054 - DNA, 15 bp, Homo sapiens
tcaccacttcctccc

SEQ ID NO: 417055 - DNA, 15 bp, Homo sapiens
caccacttcctcccc

SEQ ID NO: 417056 - DNA, 15 bp, Homo sapiens
accacttcctcccca

SEQ ID NO: 417057 - DNA, 15 bp, Homo sapiens
ccacttcctccccat

SEQ ID NO: 417058 - DNA, 15 bp, Homo sapiens
cacttcctccccatc

SEQ ID NO: 417059 - DNA, 15 bp, Homo sapiens
acttcctccccatca

SEQ ID NO: 417060 - DNA, 15 bp, Homo sapiens
cttcctccccatcac

SEQ ID NO: 417061 - DNA, 15 bp, Homo sapiens
ttcctccccatcacc

SEQ ID NO: 417062 - DNA, 15 bp, Homo sapiens
tcctccccatcaccc

SEQ ID NO: 417063 - DNA, 15 bp, Homo sapiens
cctccccatcacccc

SEQ ID NO: 417064 - DNA, 15 bp, Homo sapiens
ctccccatcaccccc

SEQ ID NO: 417065 - DNA, 15 bp, Homo sapiens
tccccatcacccccc

SEQ ID NO: 417066 - DNA, 15 bp, Homo sapiens
ccccatcacccccct

SEQ ID NO: 417067 - DNA, 15 bp, Homo sapiens
cccatcacccccctg

SEQ ID NO: 417068 - DNA, 15 bp, Homo sapiens
ccatcacccccctgc

SEQ ID NO: 417069 - DNA, 15 bp, Homo sapiens
catcacccccctgcc

SEQ ID NO: 417070 - DNA, 15 bp, Homo sapiens
atcacccccctgccc

SEQ ID NO: 417071 - DNA, 15 bp, Homo sapiens
tcacccccctgcccc

SEQ ID NO: 417072 - DNA, 15 bp, Homo sapiens
cacccccctgcccca

SEQ ID NO: 417073 - DNA, 15 bp, Homo sapiens
acccccctgccccac

SEQ ID NO: 417074 - DNA, 15 bp, Homo sapiens
cccccctgccccacc

SEQ ID NO: 417075 - DNA, 15 bp, Homo sapiens
ccccctgccccacca

SEQ ID NO: 417076 - DNA, 15 bp, Homo sapiens
cccctgccccaccaa

SEQ ID NO: 417077 - DNA, 15 bp, Homo sapiens
ccctgccccaccaac

SEQ ID NO: 417078 - DNA, 15 bp, Homo sapiens
cctgccccaccaact

SEQ ID NO: 417079 - DNA, 15 bp, Homo sapiens
ctgccccaccaacta

SEQ ID NO: 417080 - DNA, 15 bp, Homo sapiens
tgccccaccaactac

SEQ ID NO: 417081 - DNA, 15 bp, Homo sapiens
gccccaccaactacc

SEQ ID NO: 417082 - DNA, 15 bp, Homo sapiens
ccccaccaactaccc

SEQ ID NO: 417083 - DNA, 15 bp, Homo sapiens
cccaccaactaccct

SEQ ID NO: 417084 - DNA, 15 bp, Homo sapiens
ccaccaactaccctt

SEQ ID NO: 417085 - DNA, 15 bp, Homo sapiens
caccaactacccttc

SEQ ID NO: 417086 - DNA, 15 bp, Homo sapiens
accaactacccttcc

SEQ ID NO: 417087 - DNA, 15 bp, Homo sapiens
ccaactacccttccc

SEQ ID NO: 417088 - DNA, 15 bp, Homo sapiens
caactacccttccca

SEQ ID NO: 417089 - DNA, 15 bp, Homo sapiens
aactacccttcccag

SEQ ID NO: 417090 - DNA, 15 bp, Homo sapiens
actacccttcccagc

SEQ ID NO: 417091 - DNA, 15 bp, Homo sapiens
ctacccttcccagcc

SEQ ID NO: 417092 - DNA, 15 bp, Homo sapiens
tacccttcccagcct

SEQ ID NO: 417093 - DNA, 15 bp, Homo sapiens
acccttcccagcctc

SEQ ID NO: 417094 - DNA, 15 bp, Homo sapiens
cccttcccagcctct

SEQ ID NO: 417095 - DNA, 15 bp, Homo sapiens
ccttcccagcctctg

SEQ ID NO: 417096 - DNA, 15 bp, Homo sapiens
cttcccagcctctgg

SEQ ID NO: 417097 - DNA, 15 bp, Homo sapiens
ttcccagcctctggt

SEQ ID NO: 417098 - DNA, 15 bp, Homo sapiens
tcccagcctctggta

SEQ ID NO: 417099 - DNA, 15 bp, Homo sapiens
cccagcctctggtaa

SEQ ID NO: 417100 - DNA, 15 bp, Homo sapiens
ccagcctctggtaac

SEQ ID NO: 417101 - DNA, 15 bp, Homo sapiens
cagcctctggtaacc

SEQ ID NO: 417102 - DNA, 15 bp, Homo sapiens
agcctctggtaacca

SEQ ID NO: 417103 - DNA, 15 bp, Homo sapiens
gcctctggtaaccat

SEQ ID NO: 417104 - DNA, 15 bp, Homo sapiens
cctctggtaaccatc

SEQ ID NO: 417105 - DNA, 15 bp, Homo sapiens
ctctggtaaccatcc

SEQ ID NO: 417106 - DNA, 15 bp, Homo sapiens
tctggtaaccatcct

SEQ ID NO: 417107 - DNA, 15 bp, Homo sapiens
ctggtaaccatcctt

SEQ ID NO: 417108 - DNA, 15 bp, Homo sapiens
tggtaaccatccttc

SEQ ID NO: 417109 - DNA, 15 bp, Homo sapiens
ggtaaccatccttct

SEQ ID NO: 417110 - DNA, 15 bp, Homo sapiens
gtaaccatccttcta

SEQ ID NO: 417111 - DNA, 15 bp, Homo sapiens
taaccatccttctac

SEQ ID NO: 417112 - DNA, 15 bp, Homo sapiens
aaccatccttctact

SEQ ID NO: 417113 - DNA, 15 bp, Homo sapiens
accatccttctactc

SEQ ID NO: 417114 - DNA, 15 bp, Homo sapiens
ccatccttctactct

SEQ ID NO: 417115 - DNA, 15 bp, Homo sapiens
catccttctactcta

SEQ ID NO: 417116 - DNA, 15 bp, Homo sapiens
atccttctactctat

SEQ ID NO: 417117 - DNA, 15 bp, Homo sapiens
tccttctactctatc

SEQ ID NO: 417118 - DNA, 15 bp, Homo sapiens
ccttctactctatct

SEQ ID NO: 417119 - DNA, 15 bp, Homo sapiens
cttctactctatctc

SEQ ID NO: 417120 - DNA, 15 bp, Homo sapiens
ttctactctatctcc

SEQ ID NO: 417121 - DNA, 15 bp, Homo sapiens
tctactctatctcca

SEQ ID NO: 417122 - DNA, 15 bp, Homo sapiens
ctactctatctccat

SEQ ID NO: 417123 - DNA, 15 bp, Homo sapiens
tactctatctccatg

SEQ ID NO: 417124 - DNA, 15 bp, Homo sapiens
actctatctccatga

SEQ ID NO: 417125 - DNA, 15 bp, Homo sapiens
ctctatctccatgag

SEQ ID NO: 417126 - DNA, 15 bp, Homo sapiens
tctatctccatgagt

SEQ ID NO: 417127 - DNA, 15 bp, Homo sapiens
ctatctccatgagtt

SEQ ID NO: 417128 - DNA, 15 bp, Homo sapiens
tatctccatgagttc

SEQ ID NO: 417129 - DNA, 15 bp, Homo sapiens
atctccatgagttca

SEQ ID NO: 417130 - DNA, 15 bp, Homo sapiens
tctccatgagttcaa

SEQ ID NO: 417131 - DNA, 15 bp, Homo sapiens
ctccatgagttcaat

SEQ ID NO: 417132 - DNA, 15 bp, Homo sapiens
tccatgagttcaatt

SEQ ID NO: 417133 - DNA, 15 bp, Homo sapiens
ccatgagttcaattg

SEQ ID NO: 417134 - DNA, 15 bp, Homo sapiens
catgagttcaattgt

SEQ ID NO: 417135 - DNA, 15 bp, Homo sapiens
atgagttcaattgtt

SEQ ID NO: 417136 - DNA, 15 bp, Homo sapiens
tgagttcaattgttt

SEQ ID NO: 417137 - DNA, 15 bp, Homo sapiens
gagttcaattgtttt

SEQ ID NO: 417138 - DNA, 15 bp, Homo sapiens
agttcaattgttttg

SEQ ID NO: 417139 - DNA, 15 bp, Homo sapiens
gttcaattgttttga

SEQ ID NO: 417140 - DNA, 15 bp, Homo sapiens
ttcaattgttttgat

SEQ ID NO: 417141 - DNA, 15 bp, Homo sapiens
tcaattgttttgatt

SEQ ID NO: 417142 - DNA, 15 bp, Homo sapiens
caattgttttgattt

SEQ ID NO: 417143 - DNA, 15 bp, Homo sapiens
aattgttttgatttt

SEQ ID NO: 417144 - DNA, 15 bp, Homo sapiens
attgttttgattttt

SEQ ID NO: 417145 - DNA, 15 bp, Homo sapiens
ttgttttgattttta

SEQ ID NO: 417146 - DNA, 15 bp, Homo sapiens
tgttttgatttttag

SEQ ID NO: 417147 - DNA, 15 bp, Homo sapiens
gttttgatttttaga

SEQ ID NO: 417148 - DNA, 15 bp, Homo sapiens
ttttgatttttagat

SEQ ID NO: 417149 - DNA, 15 bp, Homo sapiens
tttgatttttagatc

SEQ ID NO: 417150 - DNA, 15 bp, Homo sapiens
ttgatttttagatcc

SEQ ID NO: 417151 - DNA, 15 bp, Homo sapiens
tgatttttagatccc

SEQ ID NO: 417152 - DNA, 15 bp, Homo sapiens
gatttttagatcccc

SEQ ID NO: 417153 - DNA, 15 bp, Homo sapiens
atttttagatcccca

SEQ ID NO: 417154 - DNA, 15 bp, Homo sapiens
tttttagatccccaa

SEQ ID NO: 417155 - DNA, 15 bp, Homo sapiens
ttttagatccccaaa

SEQ ID NO: 417156 - DNA, 15 bp, Homo sapiens
tttagatccccaaaa

SEQ ID NO: 417157 - DNA, 15 bp, Homo sapiens
ttagatccccaaaat

SEQ ID NO: 417158 - DNA, 15 bp, Homo sapiens
tagatccccaaaata

SEQ ID NO: 417159 - DNA, 15 bp, Homo sapiens
agatccccaaaataa

SEQ ID NO: 417160 - DNA, 15 bp, Homo sapiens
gatccccaaaataac

SEQ ID NO: 417161 - DNA, 15 bp, Homo sapiens
atccccaaaataact

SEQ ID NO: 417162 - DNA, 15 bp, Homo sapiens
tccccaaaataactg

SEQ ID NO: 417163 - DNA, 15 bp, Homo sapiens
ccccaaaataactga

SEQ ID NO: 417164 - DNA, 15 bp, Homo sapiens
cccaaaataactgag

SEQ ID NO: 417165 - DNA, 15 bp, Homo sapiens
ccaaaataactgaga

SEQ ID NO: 417166 - DNA, 15 bp, Homo sapiens
caaaataactgagaa

SEQ ID NO: 417167 - DNA, 15 bp, Homo sapiens
aaaataactgagaat

SEQ ID NO: 417168 - DNA, 15 bp, Homo sapiens
aaataactgagaata

SEQ ID NO: 417169 - DNA, 15 bp, Homo sapiens
aataactgagaatag

SEQ ID NO: 417170 - DNA, 15 bp, Homo sapiens
ataactgagaatagt

SEQ ID NO: 417171 - DNA, 15 bp, Homo sapiens
taactgagaatagtc

SEQ ID NO: 417172 - DNA, 15 bp, Homo sapiens
aactgagaatagtca

SEQ ID NO: 417173 - DNA, 15 bp, Homo sapiens
actgagaatagtcaa

SEQ ID NO: 417174 - DNA, 15 bp, Homo sapiens
ctgagaatagtcaat

SEQ ID NO: 417175 - DNA, 15 bp, Homo sapiens
tgagaatagtcaatg

SEQ ID NO: 417176 - DNA, 15 bp, Homo sapiens
gagaatagtcaatgt

SEQ ID NO: 417177 - DNA, 15 bp, Homo sapiens
agaatagtcaatgtt

SEQ ID NO: 417178 - DNA, 15 bp, Homo sapiens
gaatagtcaatgttt

SEQ ID NO: 417179 - DNA, 15 bp, Homo sapiens
aatagtcaatgtttg

SEQ ID NO: 417180 - DNA, 15 bp, Homo sapiens
atagtcaatgtttgt

SEQ ID NO: 417181 - DNA, 15 bp, Homo sapiens
tagtcaatgtttgtc

SEQ ID NO: 417182 - DNA, 15 bp, Homo sapiens
agtcaatgtttgtct

SEQ ID NO: 417183 - DNA, 15 bp, Homo sapiens
gtcaatgtttgtctt

SEQ ID NO: 417184 - DNA, 15 bp, Homo sapiens
tcaatgtttgtcttt

SEQ ID NO: 417185 - DNA, 15 bp, Homo sapiens
caatgtttgtctttc

SEQ ID NO: 417186 - DNA, 15 bp, Homo sapiens
aatgtttgtctttct

SEQ ID NO: 417187 - DNA, 15 bp, Homo sapiens
atgtttgtctttctg

SEQ ID NO: 417188 - DNA, 15 bp, Homo sapiens
tgtttgtctttctgc

SEQ ID NO: 417189 - DNA, 15 bp, Homo sapiens
gtttgtctttctgca

SEQ ID NO: 417190 - DNA, 15 bp, Homo sapiens
tttgtctttctgcac

SEQ ID NO: 417191 - DNA, 15 bp, Homo sapiens
ttgtctttctgcacc

SEQ ID NO: 417192 - DNA, 15 bp, Homo sapiens
tgtctttctgcacct

SEQ ID NO: 417193 - DNA, 15 bp, Homo sapiens
gtctttctgcacctg

SEQ ID NO: 417194 - DNA, 15 bp, Homo sapiens
tctttctgcacctgg

SEQ ID NO: 417195 - DNA, 15 bp, Homo sapiens
ctttctgcacctggt

SEQ ID NO: 417196 - DNA, 15 bp, Homo sapiens
tttctgcacctggtt

SEQ ID NO: 417197 - DNA, 15 bp, Homo sapiens
ttctgcacctggttt

SEQ ID NO: 417198 - DNA, 15 bp, Homo sapiens
tctgcacctggttta

SEQ ID NO: 417199 - DNA, 15 bp, Homo sapiens
ctgcacctggtttat

SEQ ID NO: 417200 - DNA, 15 bp, Homo sapiens
tgcacctggtttatt

SEQ ID NO: 417201 - DNA, 15 bp, Homo sapiens
gcacctggtttattt

SEQ ID NO: 417202 - DNA, 15 bp, Homo sapiens
cacctggtttatttc

SEQ ID NO: 417203 - DNA, 15 bp, Homo sapiens
acctggtttatttca

SEQ ID NO: 417204 - DNA, 15 bp, Homo sapiens
cctggtttatttcac

SEQ ID NO: 417205 - DNA, 15 bp, Homo sapiens
ctggtttatttcact

SEQ ID NO: 417206 - DNA, 15 bp, Homo sapiens
tggtttatttcactt

SEQ ID NO: 417207 - DNA, 15 bp, Homo sapiens
ggtttatttcactta

SEQ ID NO: 417208 - DNA, 15 bp, Homo sapiens
gtttatttcacttaa

SEQ ID NO: 417209 - DNA, 15 bp, Homo sapiens
tttatttcacttaac

SEQ ID NO: 417210 - DNA, 15 bp, Homo sapiens
ttatttcacttaaca

SEQ ID NO: 417211 - DNA, 15 bp, Homo sapiens
tatttcacttaacat

SEQ ID NO: 417212 - DNA, 15 bp, Homo sapiens
atttcacttaacata

SEQ ID NO: 417213 - DNA, 15 bp, Homo sapiens
tttcacttaacataa

SEQ ID NO: 417214 - DNA, 15 bp, Homo sapiens
ttcacttaacataat

SEQ ID NO: 417215 - DNA, 15 bp, Homo sapiens
tcacttaacataatg

SEQ ID NO: 417216 - DNA, 15 bp, Homo sapiens
cacttaacataatga

SEQ ID NO: 417217 - DNA, 15 bp, Homo sapiens
acttaacataatgat

SEQ ID NO: 417218 - DNA, 15 bp, Homo sapiens
cttaacataatgatc

SEQ ID NO: 417219 - DNA, 15 bp, Homo sapiens
ttaacataatgatct

SEQ ID NO: 417220 - DNA, 15 bp, Homo sapiens
taacataatgatctc

SEQ ID NO: 417221 - DNA, 15 bp, Homo sapiens
aacataatgatctcc

SEQ ID NO: 417222 - DNA, 15 bp, Homo sapiens
acataatgatctccc

SEQ ID NO: 417223 - DNA, 15 bp, Homo sapiens
cataatgatctcccc

SEQ ID NO: 417224 - DNA, 15 bp, Homo sapiens
ataatgatctcccct

SEQ ID NO: 417225 - DNA, 15 bp, Homo sapiens
taatgatctcccctt

SEQ ID NO: 417226 - DNA, 15 bp, Homo sapiens
aatgatctccccttc

SEQ ID NO: 417227 - DNA, 15 bp, Homo sapiens
atgatctccccttcc

SEQ ID NO: 417228 - DNA, 15 bp, Homo sapiens
tgatctccccttcca

SEQ ID NO: 417229 - DNA, 15 bp, Homo sapiens
gatctccccttccat

SEQ ID NO: 417230 - DNA, 15 bp, Homo sapiens
atctccccttccatc

SEQ ID NO: 417231 - DNA, 15 bp, Homo sapiens
tctccccttccatcc

SEQ ID NO: 417232 - DNA, 15 bp, Homo sapiens
ctccccttccatcca

SEQ ID NO: 417233 - DNA, 15 bp, Homo sapiens
tccccttccatccac

SEQ ID NO: 417234 - DNA, 15 bp, Homo sapiens
ccccttccatccaca

SEQ ID NO: 417235 - DNA, 15 bp, Homo sapiens
cccttccatccacat

SEQ ID NO: 417236 - DNA, 15 bp, Homo sapiens
ccttccatccacatt

SEQ ID NO: 417237 - DNA, 15 bp, Homo sapiens
cttccatccacattg

SEQ ID NO: 417238 - DNA, 15 bp, Homo sapiens
ttccatccacattgt

SEQ ID NO: 417239 - DNA, 15 bp, Homo sapiens
tccatccacattgtt

SEQ ID NO: 417240 - DNA, 15 bp, Homo sapiens
ccatccacattgttg

SEQ ID NO: 417241 - DNA, 15 bp, Homo sapiens
catccacattgttgc

SEQ ID NO: 417242 - DNA, 15 bp, Homo sapiens
atccacattgttgca

SEQ ID NO: 417243 - DNA, 15 bp, Homo sapiens
tccacattgttgcaa

SEQ ID NO: 417244 - DNA, 15 bp, Homo sapiens
ccacattgttgcaaa

SEQ ID NO: 417245 - DNA, 15 bp, Homo sapiens
cacattgttgcaaat

SEQ ID NO: 417246 - DNA, 15 bp, Homo sapiens
acattgttgcaaatg

SEQ ID NO: 417247 - DNA, 15 bp, Homo sapiens
cattgttgcaaatga

SEQ ID NO: 417248 - DNA, 15 bp, Homo sapiens
attgttgcaaatgac

SEQ ID NO: 417249 - DNA, 15 bp, Homo sapiens
ttgttgcaaatgaca

SEQ ID NO: 417250 - DNA, 15 bp, Homo sapiens
tgttgcaaatgacag

SEQ ID NO: 417251 - DNA, 15 bp, Homo sapiens
gttgcaaatgacaga

SEQ ID NO: 417252 - DNA, 15 bp, Homo sapiens
ttgcaaatgacagaa

SEQ ID NO: 417253 - DNA, 15 bp, Homo sapiens
tgcaaatgacagaat

SEQ ID NO: 417254 - DNA, 15 bp, Homo sapiens
gcaaatgacagaatg

SEQ ID NO: 417255 - DNA, 15 bp, Homo sapiens
caaatgacagaatgg

SEQ ID NO: 417256 - DNA, 15 bp, Homo sapiens
aaatgacagaatggt

SEQ ID NO: 417257 - DNA, 15 bp, Homo sapiens
aatgacagaatggtg

SEQ ID NO: 417258 - DNA, 15 bp, Homo sapiens
atgacagaatggtgg

SEQ ID NO: 417259 - DNA, 15 bp, Homo sapiens
tgacagaatggtgga

SEQ ID NO: 417260 - DNA, 15 bp, Homo sapiens
gacagaatggtggaa

SEQ ID NO: 417261 - DNA, 15 bp, Homo sapiens
acagaatggtggaat

SEQ ID NO: 417262 - DNA, 15 bp, Homo sapiens
cagaatggtggaata

SEQ ID NO: 417263 - DNA, 15 bp, Homo sapiens
agaatggtggaatag

SEQ ID NO: 417264 - DNA, 15 bp, Homo sapiens
gaatggtggaatagt

SEQ ID NO: 417265 - DNA, 15 bp, Homo sapiens
aatggtggaatagta

SEQ ID NO: 417266 - DNA, 15 bp, Homo sapiens
atggtggaatagtac

SEQ ID NO: 417267 - DNA, 15 bp, Homo sapiens
tggtggaatagtact

SEQ ID NO: 417268 - DNA, 15 bp, Homo sapiens
ggtggaatagtactc

SEQ ID NO: 417269 - DNA, 15 bp, Homo sapiens
gtggaatagtactcc

SEQ ID NO: 417270 - DNA, 15 bp, Homo sapiens
tggaatagtactcca

SEQ ID NO: 417271 - DNA, 15 bp, Homo sapiens
ggaatagtactccat

SEQ ID NO: 417272 - DNA, 15 bp, Homo sapiens
gaatagtactccatt

SEQ ID NO: 417273 - DNA, 15 bp, Homo sapiens
aatagtactccattt

SEQ ID NO: 417274 - DNA, 15 bp, Homo sapiens
atagtactccatttt

SEQ ID NO: 417275 - DNA, 15 bp, Homo sapiens
tagtactccattttg

SEQ ID NO: 417276 - DNA, 15 bp, Homo sapiens
agtactccattttgt

SEQ ID NO: 417277 - DNA, 15 bp, Homo sapiens
gtactccattttgta

SEQ ID NO: 417278 - DNA, 15 bp, Homo sapiens
tactccattttgtat

SEQ ID NO: 417279 - DNA, 15 bp, Homo sapiens
actccattttgtata

SEQ ID NO: 417280 - DNA, 15 bp, Homo sapiens
ctccattttgtataa

SEQ ID NO: 417281 - DNA, 15 bp, Homo sapiens
tccattttgtataaa

SEQ ID NO: 417282 - DNA, 15 bp, Homo sapiens
ccattttgtataaat

SEQ ID NO: 417283 - DNA, 15 bp, Homo sapiens
cattttgtataaata

SEQ ID NO: 417284 - DNA, 15 bp, Homo sapiens
attttgtataaatac

SEQ ID NO: 417285 - DNA, 15 bp, Homo sapiens
ttttgtataaataca

SEQ ID NO: 417286 - DNA, 15 bp, Homo sapiens
tttgtataaatacat

SEQ ID NO: 417287 - DNA, 15 bp, Homo sapiens
ttgtataaatacatt

SEQ ID NO: 417288 - DNA, 15 bp, Homo sapiens
tgtataaatacattt

SEQ ID NO: 417289 - DNA, 15 bp, Homo sapiens
gtataaatacatttt

SEQ ID NO: 417290 - DNA, 15 bp, Homo sapiens
tataaatacattttc

SEQ ID NO: 417291 - DNA, 15 bp, Homo sapiens
ataaatacattttct

SEQ ID NO: 417292 - DNA, 15 bp, Homo sapiens
taaatacattttctt

SEQ ID NO: 417293 - DNA, 15 bp, Homo sapiens
aaatacattttcttt

SEQ ID NO: 417294 - DNA, 15 bp, Homo sapiens
aatacattttcttta

SEQ ID NO: 417295 - DNA, 15 bp, Homo sapiens
atacattttctttat

SEQ ID NO: 417296 - DNA, 15 bp, Homo sapiens
tttctttatccattt

SEQ ID NO: 417297 - DNA, 15 bp, Homo sapiens
ttctttatccattta

SEQ ID NO: 417298 - DNA, 15 bp, Homo sapiens
tctttatccatttat

SEQ ID NO: 417299 - DNA, 15 bp, Homo sapiens
ctttatccatttatc

SEQ ID NO: 417300 - DNA, 15 bp, Homo sapiens
tttatccatttatct

SEQ ID NO: 417301 - DNA, 15 bp, Homo sapiens
ttatccatttatctg

SEQ ID NO: 417302 - DNA, 15 bp, Homo sapiens
tatccatttatctgt

SEQ ID NO: 417303 - DNA, 15 bp, Homo sapiens
atccatttatctgtt

SEQ ID NO: 417304 - DNA, 15 bp, Homo sapiens
tccatttatctgttg

SEQ ID NO: 417305 - DNA, 15 bp, Homo sapiens
ccatttatctgttga

SEQ ID NO: 417306 - DNA, 15 bp, Homo sapiens
catttatctgttgat

SEQ ID NO: 417307 - DNA, 15 bp, Homo sapiens
atttatctgttgatg

SEQ ID NO: 417308 - DNA, 15 bp, Homo sapiens
tttatctgttgatga

SEQ ID NO: 417309 - DNA, 15 bp, Homo sapiens
ttatctgttgatgaa

SEQ ID NO: 417310 - DNA, 15 bp, Homo sapiens
tatctgttgatgaac

SEQ ID NO: 417311 - DNA, 15 bp, Homo sapiens
atctgttgatgaaca

SEQ ID NO: 417312 - DNA, 15 bp, Homo sapiens
tctgttgatgaacac

SEQ ID NO: 417313 - DNA, 15 bp, Homo sapiens
ctgttgatgaacact

SEQ ID NO: 417314 - DNA, 15 bp, Homo sapiens
tgttgatgaacactt

SEQ ID NO: 417315 - DNA, 15 bp, Homo sapiens
gttgatgaacactta

SEQ ID NO: 417316 - DNA, 15 bp, Homo sapiens
ttgatgaacacttag

SEQ ID NO: 417317 - DNA, 15 bp, Homo sapiens
tgatgaacacttagg

SEQ ID NO: 417318 - DNA, 15 bp, Homo sapiens
gatgaacacttaggt

SEQ ID NO: 417319 - DNA, 15 bp, Homo sapiens
atgaacacttaggtt

SEQ ID NO: 417320 - DNA, 15 bp, Homo sapiens
tgaacacttaggttg

SEQ ID NO: 417321 - DNA, 15 bp, Homo sapiens
gaacacttaggttgc

SEQ ID NO: 417322 - DNA, 15 bp, Homo sapiens
aacacttaggttgct

SEQ ID NO: 417323 - DNA, 15 bp, Homo sapiens
acacttaggttgctt

SEQ ID NO: 417324 - DNA, 15 bp, Homo sapiens
cacttaggttgcttc

SEQ ID NO: 417325 - DNA, 15 bp, Homo sapiens
acttaggttgcttcc

SEQ ID NO: 417326 - DNA, 15 bp, Homo sapiens
cttaggttgcttcca

SEQ ID NO: 417327 - DNA, 15 bp, Homo sapiens
ttaggttgcttccaa

SEQ ID NO: 417328 - DNA, 15 bp, Homo sapiens
taggttgcttccaaa

SEQ ID NO: 417329 - DNA, 15 bp, Homo sapiens
aggttgcttccaaat

SEQ ID NO: 417330 - DNA, 15 bp, Homo sapiens
ggttgcttccaaatc

SEQ ID NO: 417331 - DNA, 15 bp, Homo sapiens
gttgcttccaaatct

SEQ ID NO: 417332 - DNA, 15 bp, Homo sapiens
ttgcttccaaatctt

SEQ ID NO: 417333 - DNA, 15 bp, Homo sapiens
gcttccaaatcttgg

SEQ ID NO: 417334 - DNA, 15 bp, Homo sapiens
cttccaaatcttggc

SEQ ID NO: 417335 - DNA, 15 bp, Homo sapiens
ttccaaatcttggct

SEQ ID NO: 417336 - DNA, 15 bp, Homo sapiens
tccaaatcttggcta

SEQ ID NO: 417337 - DNA, 15 bp, Homo sapiens
ccaaatcttggctat

SEQ ID NO: 417338 - DNA, 15 bp, Homo sapiens
caaatcttggctatt

SEQ ID NO: 417339 - DNA, 15 bp, Homo sapiens
aaatcttggctattg

SEQ ID NO: 417340 - DNA, 15 bp, Homo sapiens
aatcttggctattgt

SEQ ID NO: 417341 - DNA, 15 bp, Homo sapiens
ttggctattgtgaac

SEQ ID NO: 417342 - DNA, 15 bp, Homo sapiens
tggctattgtgaaca

SEQ ID NO: 417343 - DNA, 15 bp, Homo sapiens
ggctattgtgaacag

SEQ ID NO: 417344 - DNA, 15 bp, Homo sapiens
ctattgtgaacagta

SEQ ID NO: 417345 - DNA, 15 bp, Homo sapiens
tattgtgaacagtac

SEQ ID NO: 417346 - DNA, 15 bp, Homo sapiens
attgtgaacagtact

SEQ ID NO: 417347 - DNA, 15 bp, Homo sapiens
ttgtgaacagtactg

SEQ ID NO: 417348 - DNA, 15 bp, Homo sapiens
tgtgaacagtactgc

SEQ ID NO: 417349 - DNA, 15 bp, Homo sapiens
gtgaacagtactgcc

SEQ ID NO: 417350 - DNA, 15 bp, Homo sapiens
tgaacagtactgcca

SEQ ID NO: 417351 - DNA, 15 bp, Homo sapiens
gaacagtactgccac

SEQ ID NO: 417352 - DNA, 15 bp, Homo sapiens
aacagtactgccaca

SEQ ID NO: 417353 - DNA, 15 bp, Homo sapiens
acagtactgccacaa

SEQ ID NO: 417354 - DNA, 15 bp, Homo sapiens
cagtactgccacaaa

SEQ ID NO: 417355 - DNA, 15 bp, Homo sapiens
agtactgccacaaac

SEQ ID NO: 417356 - DNA, 15 bp, Homo sapiens
gtactgccacaaaca

SEQ ID NO: 417357 - DNA, 15 bp, Homo sapiens
tactgccacaaacat

SEQ ID NO: 417358 - DNA, 15 bp, Homo sapiens
actgccacaaacatg

SEQ ID NO: 417359 - DNA, 15 bp, Homo sapiens
ctgccacaaacatgg

SEQ ID NO: 417360 - DNA, 15 bp, Homo sapiens
tgccacaaacatggg

SEQ ID NO: 417361 - DNA, 15 bp, Homo sapiens
gccacaaacatggga

SEQ ID NO: 417362 - DNA, 15 bp, Homo sapiens
ccacaaacatgggag

SEQ ID NO: 417363 - DNA, 15 bp, Homo sapiens
cacaaacatgggagt

SEQ ID NO: 417364 - DNA, 15 bp, Homo sapiens
acaaacatgggagtg

SEQ ID NO: 417365 - DNA, 15 bp, Homo sapiens
caaacatgggagtgc

SEQ ID NO: 417366 - DNA, 15 bp, Homo sapiens
aaacatgggagtgca

SEQ ID NO: 417367 - DNA, 15 bp, Homo sapiens
aacatgggagtgcag

SEQ ID NO: 417368 - DNA, 15 bp, Homo sapiens
acatgggagtgcaga

SEQ ID NO: 417369 - DNA, 15 bp, Homo sapiens
catgggagtgcagat

SEQ ID NO: 417370 - DNA, 15 bp, Homo sapiens
atgggagtgcagata

SEQ ID NO: 417371 - DNA, 15 bp, Homo sapiens
tgggagtgcagatat

SEQ ID NO: 417372 - DNA, 15 bp, Homo sapiens
gggagtgcagatatt

SEQ ID NO: 417373 - DNA, 15 bp, Homo sapiens
ggagtgcagatattt

SEQ ID NO: 417374 - DNA, 15 bp, Homo sapiens
gagtgcagatatttc

SEQ ID NO: 417375 - DNA, 15 bp, Homo sapiens
agtgcagatatttct

SEQ ID NO: 417376 - DNA, 15 bp, Homo sapiens
gtgcagatatttctg

SEQ ID NO: 417377 - DNA, 15 bp, Homo sapiens
tgcagatatttctgc

SEQ ID NO: 417378 - DNA, 15 bp, Homo sapiens
gcagatatttctgcg

SEQ ID NO: 417379 - DNA, 15 bp, Homo sapiens
cagatatttctgcga

SEQ ID NO: 417380 - DNA, 15 bp, Homo sapiens
agatatttctgcgat

SEQ ID NO: 417381 - DNA, 15 bp, Homo sapiens
gatatttctgcgata

SEQ ID NO: 417382 - DNA, 15 bp, Homo sapiens
atatttctgcgatat

SEQ ID NO: 417383 - DNA, 15 bp, Homo sapiens
tatttctgcgatata

SEQ ID NO: 417384 - DNA, 15 bp, Homo sapiens
atttctgcgatatac

SEQ ID NO: 417385 - DNA, 15 bp, Homo sapiens
tttctgcgatatact

SEQ ID NO: 417386 - DNA, 15 bp, Homo sapiens
ttctgcgatatactg

SEQ ID NO: 417387 - DNA, 15 bp, Homo sapiens
tctgcgatatactga

SEQ ID NO: 417388 - DNA, 15 bp, Homo sapiens
ctgcgatatactgat

SEQ ID NO: 417389 - DNA, 15 bp, Homo sapiens
tgcgatatactgatt

SEQ ID NO: 417390 - DNA, 15 bp, Homo sapiens
gcgatatactgattt

SEQ ID NO: 417391 - DNA, 15 bp, Homo sapiens
cgatatactgatttc

SEQ ID NO: 417392 - DNA, 15 bp, Homo sapiens
gatatactgatttcc

SEQ ID NO: 417393 - DNA, 15 bp, Homo sapiens
atatactgatttcct

SEQ ID NO: 417394 - DNA, 15 bp, Homo sapiens
tatactgatttcctt

SEQ ID NO: 417395 - DNA, 15 bp, Homo sapiens
atactgatttccttt

SEQ ID NO: 417396 - DNA, 15 bp, Homo sapiens
tactgatttcctttc

SEQ ID NO: 417397 - DNA, 15 bp, Homo sapiens
actgatttcctttct

SEQ ID NO: 417398 - DNA, 15 bp, Homo sapiens
ctgatttcctttctt

SEQ ID NO: 417399 - DNA, 15 bp, Homo sapiens
tgatttcctttcttt

SEQ ID NO: 417400 - DNA, 15 bp, Homo sapiens
gatttcctttctttt

SEQ ID NO: 417401 - DNA, 15 bp, Homo sapiens
atttcctttcttttg

SEQ ID NO: 417402 - DNA, 15 bp, Homo sapiens
tttcctttcttttgg

SEQ ID NO: 417403 - DNA, 15 bp, Homo sapiens
ttcctttcttttggg

SEQ ID NO: 417404 - DNA, 15 bp, Homo sapiens
tcctttcttttgggt

SEQ ID NO: 417405 - DNA, 15 bp, Homo sapiens
cctttcttttgggta

SEQ ID NO: 417406 - DNA, 15 bp, Homo sapiens
ctttcttttgggtat

SEQ ID NO: 417407 - DNA, 15 bp, Homo sapiens
tttcttttgggtata

SEQ ID NO: 417408 - DNA, 15 bp, Homo sapiens
ttcttttgggtatat

SEQ ID NO: 417409 - DNA, 15 bp, Homo sapiens
tcttttgggtatata

SEQ ID NO: 417410 - DNA, 15 bp, Homo sapiens
cttttgggtatatag

SEQ ID NO: 417411 - DNA, 15 bp, Homo sapiens
ttttgggtatatagc

SEQ ID NO: 417412 - DNA, 15 bp, Homo sapiens
tttgggtatatagcc

SEQ ID NO: 417413 - DNA, 15 bp, Homo sapiens
ttgggtatatagcca

SEQ ID NO: 417414 - DNA, 15 bp, Homo sapiens
tgggtatatagccag

SEQ ID NO: 417415 - DNA, 15 bp, Homo sapiens
gggtatatagccagc

SEQ ID NO: 417416 - DNA, 15 bp, Homo sapiens
ggtatatagccagca

SEQ ID NO: 417417 - DNA, 15 bp, Homo sapiens
gtatatagccagcag

SEQ ID NO: 417418 - DNA, 15 bp, Homo sapiens
tatatagccagcagt

SEQ ID NO: 417419 - DNA, 15 bp, Homo sapiens
atatagccagcagtg

SEQ ID NO: 417420 - DNA, 15 bp, Homo sapiens
tatagccagcagtgg

SEQ ID NO: 417421 - DNA, 15 bp, Homo sapiens
atagccagcagtggg

SEQ ID NO: 417422 - DNA, 15 bp, Homo sapiens
tagccagcagtggga

SEQ ID NO: 417423 - DNA, 15 bp, Homo sapiens
agccagcagtgggat

SEQ ID NO: 417424 - DNA, 15 bp, Homo sapiens
gccagcagtgggatt

SEQ ID NO: 417425 - DNA, 15 bp, Homo sapiens
ccagcagtgggattg

SEQ ID NO: 417426 - DNA, 15 bp, Homo sapiens
cagcagtgggattgc

SEQ ID NO: 417427 - DNA, 15 bp, Homo sapiens
agcagtgggattgct

SEQ ID NO: 417428 - DNA, 15 bp, Homo sapiens
gcagtgggattgctg

SEQ ID NO: 417429 - DNA, 15 bp, Homo sapiens
cagtgggattgctgg

SEQ ID NO: 417430 - DNA, 15 bp, Homo sapiens
agtgggattgctgga

SEQ ID NO: 417431 - DNA, 15 bp, Homo sapiens
gtgggattgctggat

SEQ ID NO: 417432 - DNA, 15 bp, Homo sapiens
ggattgctggatcat

SEQ ID NO: 417433 - DNA, 15 bp, Homo sapiens
gattgctggatcata

SEQ ID NO: 417434 - DNA, 15 bp, Homo sapiens
attgctggatcatat

SEQ ID NO: 417435 - DNA, 15 bp, Homo sapiens
ttgctggatcatatg

SEQ ID NO: 417436 - DNA, 15 bp, Homo sapiens
tgctggatcatatgg

SEQ ID NO: 417437 - DNA, 15 bp, Homo sapiens
gctggatcatatggt

SEQ ID NO: 417438 - DNA, 15 bp, Homo sapiens
ctggatcatatggta

SEQ ID NO: 417439 - DNA, 15 bp, Homo sapiens
tggatcatatggtag

SEQ ID NO: 417440 - DNA, 15 bp, Homo sapiens
ggatcatatggtagc

SEQ ID NO: 417441 - DNA, 15 bp, Homo sapiens
gatcatatggtagcc

SEQ ID NO: 417442 - DNA, 15 bp, Homo sapiens
atcatatggtagccc

SEQ ID NO: 417443 - DNA, 15 bp, Homo sapiens
tcatatggtagccct

SEQ ID NO: 417444 - DNA, 15 bp, Homo sapiens
catatggtagcccta

SEQ ID NO: 417445 - DNA, 15 bp, Homo sapiens
atatggtagccctat

SEQ ID NO: 417446 - DNA, 15 bp, Homo sapiens
tatggtagccctatt

SEQ ID NO: 417447 - DNA, 15 bp, Homo sapiens
atggtagccctattt

SEQ ID NO: 417448 - DNA, 15 bp, Homo sapiens
tggtagccctatttt

SEQ ID NO: 417449 - DNA, 15 bp, Homo sapiens
ggtagccctattttt

SEQ ID NO: 417450 - DNA, 15 bp, Homo sapiens
gtagccctattttta

SEQ ID NO: 417451 - DNA, 15 bp, Homo sapiens
tagccctatttttag

SEQ ID NO: 417452 - DNA, 15 bp, Homo sapiens
agccctatttttagt

SEQ ID NO: 417453 - DNA, 15 bp, Homo sapiens
gccctatttttagtt

SEQ ID NO: 417454 - DNA, 15 bp, Homo sapiens
ccctatttttagttt

SEQ ID NO: 417455 - DNA, 15 bp, Homo sapiens
cctatttttagtttt

SEQ ID NO: 417456 - DNA, 15 bp, Homo sapiens
ctatttttagttttt

SEQ ID NO: 417457 - DNA, 15 bp, Homo sapiens
atttttagttttttg

SEQ ID NO: 417458 - DNA, 15 bp, Homo sapiens
tttttagttttttgt

SEQ ID NO: 417459 - DNA, 15 bp, Homo sapiens
ttttagttttttgtg

SEQ ID NO: 417460 - DNA, 15 bp, Homo sapiens
tttagttttttgtgg

SEQ ID NO: 417461 - DNA, 15 bp, Homo sapiens
ttagttttttgtgga

SEQ ID NO: 417462 - DNA, 15 bp, Homo sapiens
tagttttttgtggaa

SEQ ID NO: 417463 - DNA, 15 bp, Homo sapiens
agttttttgtggaac

SEQ ID NO: 417464 - DNA, 15 bp, Homo sapiens
gttttttgtggaacc

SEQ ID NO: 417465 - DNA, 15 bp, Homo sapiens
ttttttgtggaacct

SEQ ID NO: 417466 - DNA, 15 bp, Homo sapiens
tttttgtggaacctc

SEQ ID NO: 417467 - DNA, 15 bp, Homo sapiens
ttttgtggaacctcc

SEQ ID NO: 417468 - DNA, 15 bp, Homo sapiens
tttgtggaacctcca

SEQ ID NO: 417469 - DNA, 15 bp, Homo sapiens
ttgtggaacctccaa

SEQ ID NO: 417470 - DNA, 15 bp, Homo sapiens
tgtggaacctccaaa

SEQ ID NO: 417471 - DNA, 15 bp, Homo sapiens
gtggaacctccaaac

SEQ ID NO: 417472 - DNA, 15 bp, Homo sapiens
tggaacctccaaact

SEQ ID NO: 417473 - DNA, 15 bp, Homo sapiens
ggaacctccaaactg

SEQ ID NO: 417474 - DNA, 15 bp, Homo sapiens
gaacctccaaactgt

SEQ ID NO: 417475 - DNA, 15 bp, Homo sapiens
aacctccaaactgtt

SEQ ID NO: 417476 - DNA, 15 bp, Homo sapiens
acctccaaactgttc

SEQ ID NO: 417477 - DNA, 15 bp, Homo sapiens
cctccaaactgttct

SEQ ID NO: 417478 - DNA, 15 bp, Homo sapiens
ctccaaactgttctc

SEQ ID NO: 417479 - DNA, 15 bp, Homo sapiens
tccaaactgttctcc

SEQ ID NO: 417480 - DNA, 15 bp, Homo sapiens
ccaaactgttctcca

SEQ ID NO: 417481 - DNA, 15 bp, Homo sapiens
caaactgttctccat

SEQ ID NO: 417482 - DNA, 15 bp, Homo sapiens
aaactgttctccata

SEQ ID NO: 417483 - DNA, 15 bp, Homo sapiens
aactgttctccatag

SEQ ID NO: 417484 - DNA, 15 bp, Homo sapiens
actgttctccatagt

SEQ ID NO: 417485 - DNA, 15 bp, Homo sapiens
ctgttctccatagtg

SEQ ID NO: 417486 - DNA, 15 bp, Homo sapiens
tgttctccatagtgt

SEQ ID NO: 417487 - DNA, 15 bp, Homo sapiens
gttctccatagtgtt

SEQ ID NO: 417488 - DNA, 15 bp, Homo sapiens
ttctccatagtgttt

SEQ ID NO: 417489 - DNA, 15 bp, Homo sapiens
tctccatagtgttta

SEQ ID NO: 417490 - DNA, 15 bp, Homo sapiens
ctccatagtgtttat

SEQ ID NO: 417491 - DNA, 15 bp, Homo sapiens
tccatagtgtttata

SEQ ID NO: 417492 - DNA, 15 bp, Homo sapiens
ccatagtgtttatat

SEQ ID NO: 417493 - DNA, 15 bp, Homo sapiens
catagtgtttatatt

SEQ ID NO: 417494 - DNA, 15 bp, Homo sapiens
atagtgtttatatta

SEQ ID NO: 417495 - DNA, 15 bp, Homo sapiens
tagtgtttatattaa

SEQ ID NO: 417496 - DNA, 15 bp, Homo sapiens
agtgtttatattaac

SEQ ID NO: 417497 - DNA, 15 bp, Homo sapiens
gtgtttatattaact

SEQ ID NO: 417498 - DNA, 15 bp, Homo sapiens
tgtttatattaactt

SEQ ID NO: 417499 - DNA, 15 bp, Homo sapiens
gtttatattaactta

SEQ ID NO: 417500 - DNA, 15 bp, Homo sapiens
tttatattaacttac

SEQ ID NO: 417501 - DNA, 15 bp, Homo sapiens
ttatattaacttaca

SEQ ID NO: 417502 - DNA, 15 bp, Homo sapiens
tatattaacttacat

SEQ ID NO: 417503 - DNA, 15 bp, Homo sapiens
atattaacttacatt

SEQ ID NO: 417504 - DNA, 15 bp, Homo sapiens
tattaacttacattc

SEQ ID NO: 417505 - DNA, 15 bp, Homo sapiens
attaacttacattcc

SEQ ID NO: 417506 - DNA, 15 bp, Homo sapiens
ttaacttacattccc

SEQ ID NO: 417507 - DNA, 15 bp, Homo sapiens
taacttacattccca

SEQ ID NO: 417508 - DNA, 15 bp, Homo sapiens
aacttacattcccac

SEQ ID NO: 417509 - DNA, 15 bp, Homo sapiens
acttacattcccacc

SEQ ID NO: 417510 - DNA, 15 bp, Homo sapiens
cttacattcccacca

SEQ ID NO: 417511 - DNA, 15 bp, Homo sapiens
ttcccaccaacagtt

SEQ ID NO: 417512 - DNA, 15 bp, Homo sapiens
tcccaccaacagttc

SEQ ID NO: 417513 - DNA, 15 bp, Homo sapiens
cccaccaacagttca

SEQ ID NO: 417514 - DNA, 15 bp, Homo sapiens
ccaccaacagttcac

SEQ ID NO: 417515 - DNA, 15 bp, Homo sapiens
caccaacagttcaca

SEQ ID NO: 417516 - DNA, 15 bp, Homo sapiens
accaacagttcacaa

SEQ ID NO: 417517 - DNA, 15 bp, Homo sapiens
ccaacagttcacaag

SEQ ID NO: 417518 - DNA, 15 bp, Homo sapiens
caacagttcacaagg

SEQ ID NO: 417519 - DNA, 15 bp, Homo sapiens
aacagttcacaaggg

SEQ ID NO: 417520 - DNA, 15 bp, Homo sapiens
acagttcacaagggt

SEQ ID NO: 417521 - DNA, 15 bp, Homo sapiens
cagttcacaagggtt

SEQ ID NO: 417522 - DNA, 15 bp, Homo sapiens
agttcacaagggttc

SEQ ID NO: 417523 - DNA, 15 bp, Homo sapiens
gttcacaagggttcc

SEQ ID NO: 417524 - DNA, 15 bp, Homo sapiens
ttcacaagggttcct

SEQ ID NO: 417525 - DNA, 15 bp, Homo sapiens
tcacaagggttcctt

SEQ ID NO: 417526 - DNA, 15 bp, Homo sapiens
cacaagggttccttt

SEQ ID NO: 417527 - DNA, 15 bp, Homo sapiens
acaagggttcctttt

SEQ ID NO: 417528 - DNA, 15 bp, Homo sapiens
caagggttccttttt

SEQ ID NO: 417529 - DNA, 15 bp, Homo sapiens
aagggttcctttttc

SEQ ID NO: 417530 - DNA, 15 bp, Homo sapiens
agggttcctttttct

SEQ ID NO: 417531 - DNA, 15 bp, Homo sapiens
gggttcctttttctc

SEQ ID NO: 417532 - DNA, 15 bp, Homo sapiens
ggttcctttttctcc

SEQ ID NO: 417533 - DNA, 15 bp, Homo sapiens
gttcctttttctcca

SEQ ID NO: 417534 - DNA, 15 bp, Homo sapiens
ttcctttttctccac

SEQ ID NO: 417535 - DNA, 15 bp, Homo sapiens
tcctttttctccaca

SEQ ID NO: 417536 - DNA, 15 bp, Homo sapiens
cctttttctccacat

SEQ ID NO: 417537 - DNA, 15 bp, Homo sapiens
ctttttctccacatg

SEQ ID NO: 417538 - DNA, 15 bp, Homo sapiens
tttttctccacatgc

SEQ ID NO: 417539 - DNA, 15 bp, Homo sapiens
ttttctccacatgct

SEQ ID NO: 417540 - DNA, 15 bp, Homo sapiens
tttctccacatgcta

SEQ ID NO: 417541 - DNA, 15 bp, Homo sapiens
ttctccacatgctag

SEQ ID NO: 417542 - DNA, 15 bp, Homo sapiens
tctccacatgctaga

SEQ ID NO: 417543 - DNA, 15 bp, Homo sapiens
ctccacatgctagac

SEQ ID NO: 417544 - DNA, 15 bp, Homo sapiens
tccacatgctagaca

SEQ ID NO: 417545 - DNA, 15 bp, Homo sapiens
ccacatgctagacag

SEQ ID NO: 417546 - DNA, 15 bp, Homo sapiens
cacatgctagacagc

SEQ ID NO: 417547 - DNA, 15 bp, Homo sapiens
acatgctagacagca

SEQ ID NO: 417548 - DNA, 15 bp, Homo sapiens
catgctagacagcat

SEQ ID NO: 417549 - DNA, 15 bp, Homo sapiens
atgctagacagcatt

SEQ ID NO: 417550 - DNA, 15 bp, Homo sapiens
tgctagacagcattt

SEQ ID NO: 417551 - DNA, 15 bp, Homo sapiens
gctagacagcatttg

SEQ ID NO: 417552 - DNA, 15 bp, Homo sapiens
ctagacagcatttgt

SEQ ID NO: 417553 - DNA, 15 bp, Homo sapiens
tagacagcatttgtt

SEQ ID NO: 417554 - DNA, 15 bp, Homo sapiens
agacagcatttgtta

SEQ ID NO: 417555 - DNA, 15 bp, Homo sapiens
gacagcatttgttat

SEQ ID NO: 417556 - DNA, 15 bp, Homo sapiens
acagcatttgttatt

SEQ ID NO: 417557 - DNA, 15 bp, Homo sapiens
cagcatttgttattg

SEQ ID NO: 417558 - DNA, 15 bp, Homo sapiens
agcatttgttattgc

SEQ ID NO: 417559 - DNA, 15 bp, Homo sapiens
gcatttgttattgcc

SEQ ID NO: 417560 - DNA, 15 bp, Homo sapiens
catttgttattgcct

SEQ ID NO: 417561 - DNA, 15 bp, Homo sapiens
atttgttattgcctg

SEQ ID NO: 417562 - DNA, 15 bp, Homo sapiens
tttgttattgcctga

SEQ ID NO: 417563 - DNA, 15 bp, Homo sapiens
ttgttattgcctgac

SEQ ID NO: 417564 - DNA, 15 bp, Homo sapiens
tgttattgcctgact

SEQ ID NO: 417565 - DNA, 15 bp, Homo sapiens
gttattgcctgactt

SEQ ID NO: 417566 - DNA, 15 bp, Homo sapiens
ttattgcctgacttt

SEQ ID NO: 417567 - DNA, 15 bp, Homo sapiens
tattgcctgactttt

SEQ ID NO: 417568 - DNA, 15 bp, Homo sapiens
attgcctgacttttg

SEQ ID NO: 417569 - DNA, 15 bp, Homo sapiens
ttgcctgacttttgg

SEQ ID NO: 417570 - DNA, 15 bp, Homo sapiens
tgcctgacttttgga

SEQ ID NO: 417571 - DNA, 15 bp, Homo sapiens
gcctgacttttggat

SEQ ID NO: 417572 - DNA, 15 bp, Homo sapiens
cctgacttttggata

SEQ ID NO: 417573 - DNA, 15 bp, Homo sapiens
ctgacttttggataa

SEQ ID NO: 417574 - DNA, 15 bp, Homo sapiens
tgacttttggataaa

SEQ ID NO: 417575 - DNA, 15 bp, Homo sapiens
gacttttggataaaa

SEQ ID NO: 417576 - DNA, 15 bp, Homo sapiens
acttttggataaaag

SEQ ID NO: 417577 - DNA, 15 bp, Homo sapiens
cttttggataaaagc

SEQ ID NO: 417578 - DNA, 15 bp, Homo sapiens
ttttggataaaagcc

SEQ ID NO: 417579 - DNA, 15 bp, Homo sapiens
tttggataaaagcca

SEQ ID NO: 417580 - DNA, 15 bp, Homo sapiens
ttggataaaagccat

SEQ ID NO: 417581 - DNA, 15 bp, Homo sapiens
tggataaaagccatt

SEQ ID NO: 417582 - DNA, 15 bp, Homo sapiens
ggataaaagccattt

SEQ ID NO: 417583 - DNA, 15 bp, Homo sapiens
gataaaagccatttt

SEQ ID NO: 417584 - DNA, 15 bp, Homo sapiens
ataaaagccattttt

SEQ ID NO: 417585 - DNA, 15 bp, Homo sapiens
taaaagccattttta

SEQ ID NO: 417586 - DNA, 15 bp, Homo sapiens
aaaagccatttttaa

SEQ ID NO: 417587 - DNA, 15 bp, Homo sapiens
aaagccatttttaac

SEQ ID NO: 417588 - DNA, 15 bp, Homo sapiens
aagccatttttaact

SEQ ID NO: 417589 - DNA, 15 bp, Homo sapiens
agccatttttaacta

SEQ ID NO: 417590 - DNA, 15 bp, Homo sapiens
gccatttttaactag

SEQ ID NO: 417591 - DNA, 15 bp, Homo sapiens
ccatttttaactaga

SEQ ID NO: 417592 - DNA, 15 bp, Homo sapiens
catttttaactagat

SEQ ID NO: 417593 - DNA, 15 bp, Homo sapiens
atttttaactagatt

SEQ ID NO: 417594 - DNA, 15 bp, Homo sapiens
tttttaactagatta

SEQ ID NO: 417595 - DNA, 15 bp, Homo sapiens
ttttaactagattag

SEQ ID NO: 417596 - DNA, 15 bp, Homo sapiens
tttaactagattagg

SEQ ID NO: 417597 - DNA, 15 bp, Homo sapiens
ttaactagattaggt

SEQ ID NO: 417598 - DNA, 15 bp, Homo sapiens
taactagattaggta

SEQ ID NO: 417599 - DNA, 15 bp, Homo sapiens
aactagattaggtaa

SEQ ID NO: 417600 - DNA, 15 bp, Homo sapiens
actagattaggtaag

SEQ ID NO: 417601 - DNA, 15 bp, Homo sapiens
ctagattaggtaagt

SEQ ID NO: 417602 - DNA, 15 bp, Homo sapiens
tagattaggtaagtt

SEQ ID NO: 417603 - DNA, 15 bp, Homo sapiens
agattaggtaagttt

SEQ ID NO: 417604 - DNA, 15 bp, Homo sapiens
gattaggtaagttta

SEQ ID NO: 417605 - DNA, 15 bp, Homo sapiens
attaggtaagtttag

SEQ ID NO: 417606 - DNA, 15 bp, Homo sapiens
ttaggtaagtttagc

SEQ ID NO: 417607 - DNA, 15 bp, Homo sapiens
taggtaagtttagct

SEQ ID NO: 417608 - DNA, 15 bp, Homo sapiens
aggtaagtttagcta

SEQ ID NO: 417609 - DNA, 15 bp, Homo sapiens
ggtaagtttagctaa

SEQ ID NO: 417610 - DNA, 15 bp, Homo sapiens
gtaagtttagctaaa

SEQ ID NO: 417611 - DNA, 15 bp, Homo sapiens
taagtttagctaaag

SEQ ID NO: 417612 - DNA, 15 bp, Homo sapiens
aagtttagctaaagg

SEQ ID NO: 417613 - DNA, 15 bp, Homo sapiens
agtttagctaaaggc

SEQ ID NO: 417614 - DNA, 15 bp, Homo sapiens
gtttagctaaaggcg

SEQ ID NO: 417615 - DNA, 15 bp, Homo sapiens
tttagctaaaggcgt

SEQ ID NO: 417616 - DNA, 15 bp, Homo sapiens
ttagctaaaggcgta

SEQ ID NO: 417617 - DNA, 15 bp, Homo sapiens
tagctaaaggcgtaa

SEQ ID NO: 417618 - DNA, 15 bp, Homo sapiens
agctaaaggcgtaaa

SEQ ID NO: 417619 - DNA, 15 bp, Homo sapiens
gctaaaggcgtaaat

SEQ ID NO: 417620 - DNA, 15 bp, Homo sapiens
ctaaaggcgtaaatg

SEQ ID NO: 417621 - DNA, 15 bp, Homo sapiens
taaaggcgtaaatga

SEQ ID NO: 417622 - DNA, 15 bp, Homo sapiens
aaaggcgtaaatgat

SEQ ID NO: 417623 - DNA, 15 bp, Homo sapiens
aaggcgtaaatgatc

SEQ ID NO: 417624 - DNA, 15 bp, Homo sapiens
aggcgtaaatgatct

SEQ ID NO: 417625 - DNA, 15 bp, Homo sapiens
ggcgtaaatgatctc

SEQ ID NO: 417626 - DNA, 15 bp, Homo sapiens
gcgtaaatgatctct

SEQ ID NO: 417627 - DNA, 15 bp, Homo sapiens
cgtaaatgatctctt

SEQ ID NO: 417628 - DNA, 15 bp, Homo sapiens
gtaaatgatctcttc

SEQ ID NO: 417629 - DNA, 15 bp, Homo sapiens
taaatgatctcttct

SEQ ID NO: 417630 - DNA, 15 bp, Homo sapiens
aaatgatctcttctt

SEQ ID NO: 417631 - DNA, 15 bp, Homo sapiens
aatgatctcttcttt

SEQ ID NO: 417632 - DNA, 15 bp, Homo sapiens
atgatctcttcttta

SEQ ID NO: 417633 - DNA, 15 bp, Homo sapiens
tgatctcttctttat

SEQ ID NO: 417634 - DNA, 15 bp, Homo sapiens
gatctcttctttatt

SEQ ID NO: 417635 - DNA, 15 bp, Homo sapiens
atctcttctttattt

SEQ ID NO: 417636 - DNA, 15 bp, Homo sapiens
tctcttctttatttt

SEQ ID NO: 417637 - DNA, 15 bp, Homo sapiens
ctcttctttattttt

SEQ ID NO: 417638 - DNA, 15 bp, Homo sapiens
tcttctttattttta

SEQ ID NO: 417639 - DNA, 15 bp, Homo sapiens
cttctttatttttat

SEQ ID NO: 417640 - DNA, 15 bp, Homo sapiens
ttctttatttttata

SEQ ID NO: 417641 - DNA, 15 bp, Homo sapiens
tctttatttttatat

SEQ ID NO: 417642 - DNA, 15 bp, Homo sapiens
ctttatttttatatt

SEQ ID NO: 417643 - DNA, 15 bp, Homo sapiens
tttatttttatattt

SEQ ID NO: 417644 - DNA, 15 bp, Homo sapiens
ttatttttatattta

SEQ ID NO: 417645 - DNA, 15 bp, Homo sapiens
tatttttatatttaa

SEQ ID NO: 417646 - DNA, 15 bp, Homo sapiens
atttttatatttaaa

SEQ ID NO: 417647 - DNA, 15 bp, Homo sapiens
tttttatatttaaaa

SEQ ID NO: 417648 - DNA, 15 bp, Homo sapiens
ttttatatttaaaaa

SEQ ID NO: 417649 - DNA, 15 bp, Homo sapiens
tttatatttaaaaaa

SEQ ID NO: 417650 - DNA, 15 bp, Homo sapiens
ttatatttaaaaaat

SEQ ID NO: 417651 - DNA, 15 bp, Homo sapiens
tatatttaaaaaatg

SEQ ID NO: 417652 - DNA, 15 bp, Homo sapiens
atatttaaaaaatga

SEQ ID NO: 417653 - DNA, 15 bp, Homo sapiens
tatttaaaaaatgaa

SEQ ID NO: 417654 - DNA, 15 bp, Homo sapiens
atttaaaaaatgaat

SEQ ID NO: 417655 - DNA, 15 bp, Homo sapiens
tttaaaaaatgaata

SEQ ID NO: 417656 - DNA, 15 bp, Homo sapiens
ttaaaaaatgaataa

SEQ ID NO: 417657 - DNA, 15 bp, Homo sapiens
taaaaaatgaataag

SEQ ID NO: 417658 - DNA, 15 bp, Homo sapiens
aaaaaatgaataaga

SEQ ID NO: 417659 - DNA, 15 bp, Homo sapiens
aaaaatgaataagat

SEQ ID NO: 417660 - DNA, 15 bp, Homo sapiens
aaaatgaataagata

SEQ ID NO: 417661 - DNA, 15 bp, Homo sapiens
aaatgaataagataa

SEQ ID NO: 417662 - DNA, 15 bp, Homo sapiens
aatgaataagataaa

SEQ ID NO: 417663 - DNA, 15 bp, Homo sapiens
atgaataagataaaa

SEQ ID NO: 417664 - DNA, 15 bp, Homo sapiens
tgaataagataaaat

SEQ ID NO: 417665 - DNA, 15 bp, Homo sapiens
gaataagataaaatt

SEQ ID NO: 417666 - DNA, 15 bp, Homo sapiens
aataagataaaatta

SEQ ID NO: 417667 - DNA, 15 bp, Homo sapiens
ataagataaaattaa

SEQ ID NO: 417668 - DNA, 15 bp, Homo sapiens
taagataaaattaaa

SEQ ID NO: 417669 - DNA, 15 bp, Homo sapiens
aagataaaattaaaa

SEQ ID NO: 417670 - DNA, 15 bp, Homo sapiens
agataaaattaaaat

SEQ ID NO: 417671 - DNA, 15 bp, Homo sapiens
gataaaattaaaata

SEQ ID NO: 417672 - DNA, 15 bp, Homo sapiens
ataaaattaaaatag

SEQ ID NO: 417673 - DNA, 15 bp, Homo sapiens
taaaattaaaatagc

SEQ ID NO: 417674 - DNA, 15 bp, Homo sapiens
aaaattaaaatagca

SEQ ID NO: 417675 - DNA, 15 bp, Homo sapiens
aaattaaaatagcat

SEQ ID NO: 417676 - DNA, 15 bp, Homo sapiens
aattaaaatagcatg

SEQ ID NO: 417677 - DNA, 15 bp, Homo sapiens
attaaaatagcatgt

SEQ ID NO: 417678 - DNA, 15 bp, Homo sapiens
ttaaaatagcatgtt

SEQ ID NO: 417679 - DNA, 15 bp, Homo sapiens
taaaatagcatgttt

SEQ ID NO: 417680 - DNA, 15 bp, Homo sapiens
aaaatagcatgtttg

SEQ ID NO: 417681 - DNA, 15 bp, Homo sapiens
aaatagcatgtttgt

SEQ ID NO: 417682 - DNA, 15 bp, Homo sapiens
aatagcatgtttgtt

SEQ ID NO: 417683 - DNA, 15 bp, Homo sapiens
atagcatgtttgtta

SEQ ID NO: 417684 - DNA, 15 bp, Homo sapiens
tagcatgtttgttat

SEQ ID NO: 417685 - DNA, 15 bp, Homo sapiens
agcatgtttgttatt

SEQ ID NO: 417686 - DNA, 15 bp, Homo sapiens
gcatgtttgttatta

SEQ ID NO: 417687 - DNA, 15 bp, Homo sapiens
catgtttgttattac

SEQ ID NO: 417688 - DNA, 15 bp, Homo sapiens
atgtttgttattact

SEQ ID NO: 417689 - DNA, 15 bp, Homo sapiens
tgtttgttattactt

SEQ ID NO: 417690 - DNA, 15 bp, Homo sapiens
gtttgttattacttg

SEQ ID NO: 417691 - DNA, 15 bp, Homo sapiens
tttgttattacttgg

SEQ ID NO: 417692 - DNA, 15 bp, Homo sapiens
ttgttattacttgga

SEQ ID NO: 417693 - DNA, 15 bp, Homo sapiens
tgttattacttggat

SEQ ID NO: 417694 - DNA, 15 bp, Homo sapiens
gttattacttggata

SEQ ID NO: 417695 - DNA, 15 bp, Homo sapiens
ttattacttggatat

SEQ ID NO: 417696 - DNA, 15 bp, Homo sapiens
tattacttggatatt

SEQ ID NO: 417697 - DNA, 15 bp, Homo sapiens
attacttggatattt

SEQ ID NO: 417698 - DNA, 15 bp, Homo sapiens
ttacttggatattta

SEQ ID NO: 417699 - DNA, 15 bp, Homo sapiens
tacttggatatttat

SEQ ID NO: 417700 - DNA, 15 bp, Homo sapiens
acttggatatttata

SEQ ID NO: 417701 - DNA, 15 bp, Homo sapiens
cttggatatttataa

SEQ ID NO: 417702 - DNA, 15 bp, Homo sapiens
ttggatatttataaa

SEQ ID NO: 417703 - DNA, 15 bp, Homo sapiens
tggatatttataaaa

SEQ ID NO: 417704 - DNA, 15 bp, Homo sapiens
ggatatttataaaag

SEQ ID NO: 417705 - DNA, 15 bp, Homo sapiens
gatatttataaaaga

SEQ ID NO: 417706 - DNA, 15 bp, Homo sapiens
atatttataaaagat

SEQ ID NO: 417707 - DNA, 15 bp, Homo sapiens
tatttataaaagata

SEQ ID NO: 417708 - DNA, 15 bp, Homo sapiens
atttataaaagataa

SEQ ID NO: 417709 - DNA, 15 bp, Homo sapiens
tttataaaagataaa

SEQ ID NO: 417710 - DNA, 15 bp, Homo sapiens
ttataaaagataaaa

SEQ ID NO: 417711 - DNA, 15 bp, Homo sapiens
tataaaagataaaat

SEQ ID NO: 417712 - DNA, 15 bp, Homo sapiens
ataaaagataaaata

SEQ ID NO: 417713 - DNA, 15 bp, Homo sapiens
taaaagataaaatag

SEQ ID NO: 417714 - DNA, 15 bp, Homo sapiens
aaaagataaaatagt

SEQ ID NO: 417715 - DNA, 15 bp, Homo sapiens
aaagataaaatagtt

SEQ ID NO: 417716 - DNA, 15 bp, Homo sapiens
aagataaaatagttt

SEQ ID NO: 417717 - DNA, 15 bp, Homo sapiens
agataaaatagtttg

SEQ ID NO: 417718 - DNA, 15 bp, Homo sapiens
gataaaatagtttgt

SEQ ID NO: 417719 - DNA, 15 bp, Homo sapiens
ataaaatagtttgtt

SEQ ID NO: 417720 - DNA, 15 bp, Homo sapiens
taaaatagtttgtta

SEQ ID NO: 417721 - DNA, 15 bp, Homo sapiens
aaaatagtttgttat

SEQ ID NO: 417722 - DNA, 15 bp, Homo sapiens
aaatagtttgttatt

SEQ ID NO: 417723 - DNA, 15 bp, Homo sapiens
aatagtttgttattt

SEQ ID NO: 417724 - DNA, 15 bp, Homo sapiens
atagtttgttattta

SEQ ID NO: 417725 - DNA, 15 bp, Homo sapiens
tagtttgttatttaa

SEQ ID NO: 417726 - DNA, 15 bp, Homo sapiens
agtttgttatttaat

SEQ ID NO: 417727 - DNA, 15 bp, Homo sapiens
gtttgttatttaatt

SEQ ID NO: 417728 - DNA, 15 bp, Homo sapiens
tttgttatttaattt

SEQ ID NO: 417729 - DNA, 15 bp, Homo sapiens
ttgttatttaattta

SEQ ID NO: 417730 - DNA, 15 bp, Homo sapiens
tgttatttaatttag

SEQ ID NO: 417731 - DNA, 15 bp, Homo sapiens
gttatttaatttagc

SEQ ID NO: 417732 - DNA, 15 bp, Homo sapiens
ttatttaatttagcc

SEQ ID NO: 417733 - DNA, 15 bp, Homo sapiens
tatttaatttagcct

SEQ ID NO: 417734 - DNA, 15 bp, Homo sapiens
atttaatttagcctc

SEQ ID NO: 417735 - DNA, 15 bp, Homo sapiens
tttaatttagcctct

SEQ ID NO: 417736 - DNA, 15 bp, Homo sapiens
ttaatttagcctctg

SEQ ID NO: 417737 - DNA, 15 bp, Homo sapiens
taatttagcctctgc

SEQ ID NO: 417738 - DNA, 15 bp, Homo sapiens
aatttagcctctgca

SEQ ID NO: 417739 - DNA, 15 bp, Homo sapiens
atttagcctctgcat

SEQ ID NO: 417740 - DNA, 15 bp, Homo sapiens
tttagcctctgcatt

SEQ ID NO: 417741 - DNA, 15 bp, Homo sapiens
ttagcctctgcattt

SEQ ID NO: 417742 - DNA, 15 bp, Homo sapiens
tagcctctgcatttg

SEQ ID NO: 417743 - DNA, 15 bp, Homo sapiens
agcctctgcatttgc

SEQ ID NO: 417744 - DNA, 15 bp, Homo sapiens
gcctctgcatttgcc

SEQ ID NO: 417745 - DNA, 15 bp, Homo sapiens
cctctgcatttgcca

SEQ ID NO: 417746 - DNA, 15 bp, Homo sapiens
ctctgcatttgccaa

SEQ ID NO: 417747 - DNA, 15 bp, Homo sapiens
tctgcatttgccaaa

SEQ ID NO: 417748 - DNA, 15 bp, Homo sapiens
ctgcatttgccaaaa

SEQ ID NO: 417749 - DNA, 15 bp, Homo sapiens
tgcatttgccaaaaa

SEQ ID NO: 417750 - DNA, 15 bp, Homo sapiens
gcatttgccaaaaat

SEQ ID NO: 417751 - DNA, 15 bp, Homo sapiens
catttgccaaaaatg

SEQ ID NO: 417752 - DNA, 15 bp, Homo sapiens
atttgccaaaaatgg

SEQ ID NO: 417753 - DNA, 15 bp, Homo sapiens
tttgccaaaaatggt

SEQ ID NO: 417754 - DNA, 15 bp, Homo sapiens
ttgccaaaaatggtg

SEQ ID NO: 417755 - DNA, 15 bp, Homo sapiens
tgccaaaaatggtgg

SEQ ID NO: 417756 - DNA, 15 bp, Homo sapiens
gccaaaaatggtggc

SEQ ID NO: 417757 - DNA, 15 bp, Homo sapiens
ccaaaaatggtggca

SEQ ID NO: 417758 - DNA, 15 bp, Homo sapiens
caaaaatggtggcac

SEQ ID NO: 417759 - DNA, 15 bp, Homo sapiens
aaaaatggtggcacg

SEQ ID NO: 417760 - DNA, 15 bp, Homo sapiens
aaaatggtggcacgt

SEQ ID NO: 417761 - DNA, 15 bp, Homo sapiens
aaatggtggcacgtg

SEQ ID NO: 417762 - DNA, 15 bp, Homo sapiens
aatggtggcacgtgg

SEQ ID NO: 417763 - DNA, 15 bp, Homo sapiens
atggtggcacgtggt

SEQ ID NO: 417764 - DNA, 15 bp, Homo sapiens
tggtggcacgtggta

SEQ ID NO: 417765 - DNA, 15 bp, Homo sapiens
ggtggcacgtggtat

SEQ ID NO: 417766 - DNA, 15 bp, Homo sapiens
gtggcacgtggtatg

SEQ ID NO: 417767 - DNA, 15 bp, Homo sapiens
tggcacgtggtatgt

SEQ ID NO: 417768 - DNA, 15 bp, Homo sapiens
ggcacgtggtatgtg

SEQ ID NO: 417769 - DNA, 15 bp, Homo sapiens
gcacgtggtatgtgt

SEQ ID NO: 417770 - DNA, 15 bp, Homo sapiens
cacgtggtatgtgtt

SEQ ID NO: 417771 - DNA, 15 bp, Homo sapiens
acgtggtatgtgttc

SEQ ID NO: 417772 - DNA, 15 bp, Homo sapiens
cgtggtatgtgttca

SEQ ID NO: 417773 - DNA, 15 bp, Homo sapiens
gtggtatgtgttcag

SEQ ID NO: 417774 - DNA, 15 bp, Homo sapiens
tggtatgtgttcagt

SEQ ID NO: 417775 - DNA, 15 bp, Homo sapiens
ggtatgtgttcagta

SEQ ID NO: 417776 - DNA, 15 bp, Homo sapiens
gtatgtgttcagtaa

SEQ ID NO: 417777 - DNA, 15 bp, Homo sapiens
tatgtgttcagtaat

SEQ ID NO: 417778 - DNA, 15 bp, Homo sapiens
atgtgttcagtaatt

SEQ ID NO: 417779 - DNA, 15 bp, Homo sapiens
tgtgttcagtaattg

SEQ ID NO: 417780 - DNA, 15 bp, Homo sapiens
gtgttcagtaattgt

SEQ ID NO: 417781 - DNA, 15 bp, Homo sapiens
tgttcagtaattgtt

SEQ ID NO: 417782 - DNA, 15 bp, Homo sapiens
gttcagtaattgtta

SEQ ID NO: 417783 - DNA, 15 bp, Homo sapiens
ttcagtaattgttag

SEQ ID NO: 417784 - DNA, 15 bp, Homo sapiens
tcagtaattgttagc

SEQ ID NO: 417785 - DNA, 15 bp, Homo sapiens
cagtaattgttagct

SEQ ID NO: 417786 - DNA, 15 bp, Homo sapiens
agtaattgttagcta

SEQ ID NO: 417787 - DNA, 15 bp, Homo sapiens
gtaattgttagctat

SEQ ID NO: 417788 - DNA, 15 bp, Homo sapiens
taattgttagctatt

SEQ ID NO: 417789 - DNA, 15 bp, Homo sapiens
aattgttagctatta

SEQ ID NO: 417790 - DNA, 15 bp, Homo sapiens
attgttagctattat

SEQ ID NO: 417791 - DNA, 15 bp, Homo sapiens
ttgttagctattatt

SEQ ID NO: 417792 - DNA, 15 bp, Homo sapiens
tgttagctattatta

SEQ ID NO: 417793 - DNA, 15 bp, Homo sapiens
gttagctattattat

SEQ ID NO: 417794 - DNA, 15 bp, Homo sapiens
ttagctattattatt

SEQ ID NO: 417795 - DNA, 15 bp, Homo sapiens
tagctattattattc

SEQ ID NO: 417796 - DNA, 15 bp, Homo sapiens
agctattattattct

SEQ ID NO: 417797 - DNA, 15 bp, Homo sapiens
gctattattattctc

SEQ ID NO: 417798 - DNA, 15 bp, Homo sapiens
ctattattattctca

SEQ ID NO: 417799 - DNA, 15 bp, Homo sapiens
tattattattctcat

SEQ ID NO: 417800 - DNA, 15 bp, Homo sapiens
attattattctcatt

SEQ ID NO: 417801 - DNA, 15 bp, Homo sapiens
ttattattctcattg

SEQ ID NO: 417802 - DNA, 15 bp, Homo sapiens
tattattctcattga

SEQ ID NO: 417803 - DNA, 15 bp, Homo sapiens
attattctcattgat

SEQ ID NO: 417804 - DNA, 15 bp, Homo sapiens
ttattctcattgatt

SEQ ID NO: 417805 - DNA, 15 bp, Homo sapiens
tattctcattgatta

SEQ ID NO: 417806 - DNA, 15 bp, Homo sapiens
attctcattgattac

SEQ ID NO: 417807 - DNA, 15 bp, Homo sapiens
ttctcattgattacc

SEQ ID NO: 417808 - DNA, 15 bp, Homo sapiens
tctcattgattacct

SEQ ID NO: 417809 - DNA, 15 bp, Homo sapiens
ctcattgattacctc

SEQ ID NO: 417810 - DNA, 15 bp, Homo sapiens
tcattgattacctct

SEQ ID NO: 417811 - DNA, 15 bp, Homo sapiens
cattgattacctctt

SEQ ID NO: 417812 - DNA, 15 bp, Homo sapiens
attgattacctcttt

SEQ ID NO: 417813 - DNA, 15 bp, Homo sapiens
ttgattacctctttg

SEQ ID NO: 417814 - DNA, 15 bp, Homo sapiens
tgattacctctttgt

SEQ ID NO: 417815 - DNA, 15 bp, Homo sapiens
gattacctctttgtt

SEQ ID NO: 417816 - DNA, 15 bp, Homo sapiens
attacctctttgttt

SEQ ID NO: 417817 - DNA, 15 bp, Homo sapiens
ttacctctttgtttg

SEQ ID NO: 417818 - DNA, 15 bp, Homo sapiens
tacctctttgtttgg

SEQ ID NO: 417819 - DNA, 15 bp, Homo sapiens
acctctttgtttggc

SEQ ID NO: 417820 - DNA, 15 bp, Homo sapiens
cctctttgtttggca

SEQ ID NO: 417821 - DNA, 15 bp, Homo sapiens
ctctttgtttggcac

SEQ ID NO: 417822 - DNA, 15 bp, Homo sapiens
tctttgtttggcact

SEQ ID NO: 417823 - DNA, 15 bp, Homo sapiens
ctttgtttggcacta

SEQ ID NO: 417824 - DNA, 15 bp, Homo sapiens
tttgtttggcactaa

SEQ ID NO: 417825 - DNA, 15 bp, Homo sapiens
ttgtttggcactaat

SEQ ID NO: 417826 - DNA, 15 bp, Homo sapiens
tgtttggcactaatt

SEQ ID NO: 417827 - DNA, 15 bp, Homo sapiens
gtttggcactaattt

SEQ ID NO: 417828 - DNA, 15 bp, Homo sapiens
tttggcactaattta

SEQ ID NO: 417829 - DNA, 15 bp, Homo sapiens
ttggcactaatttaa

SEQ ID NO: 417830 - DNA, 15 bp, Homo sapiens
tggcactaatttaaa

SEQ ID NO: 417831 - DNA, 15 bp, Homo sapiens
ggcactaatttaaaa

SEQ ID NO: 417832 - DNA, 15 bp, Homo sapiens
gcactaatttaaaat

SEQ ID NO: 417833 - DNA, 15 bp, Homo sapiens
cactaatttaaaata

SEQ ID NO: 417834 - DNA, 15 bp, Homo sapiens
actaatttaaaatac

SEQ ID NO: 417835 - DNA, 15 bp, Homo sapiens
ctaatttaaaataca

SEQ ID NO: 417836 - DNA, 15 bp, Homo sapiens
taatttaaaatacac

SEQ ID NO: 417837 - DNA, 15 bp, Homo sapiens
aatttaaaatacaca

SEQ ID NO: 417838 - DNA, 15 bp, Homo sapiens
atttaaaatacacag

SEQ ID NO: 417839 - DNA, 15 bp, Homo sapiens
tttaaaatacacagg

SEQ ID NO: 417840 - DNA, 15 bp, Homo sapiens
ttaaaatacacagga

SEQ ID NO: 417841 - DNA, 15 bp, Homo sapiens
taaaatacacaggaa

SEQ ID NO: 417842 - DNA, 15 bp, Homo sapiens
aaaatacacaggaat

SEQ ID NO: 417843 - DNA, 15 bp, Homo sapiens
aaatacacaggaatt

SEQ ID NO: 417844 - DNA, 15 bp, Homo sapiens
aatacacaggaattc

SEQ ID NO: 417845 - DNA, 15 bp, Homo sapiens
atacacaggaattct

SEQ ID NO: 417846 - DNA, 15 bp, Homo sapiens
tacacaggaattctc

SEQ ID NO: 417847 - DNA, 15 bp, Homo sapiens
acacaggaattctct

SEQ ID NO: 417848 - DNA, 15 bp, Homo sapiens
cacaggaattctctc

SEQ ID NO: 417849 - DNA, 15 bp, Homo sapiens
acaggaattctctct

SEQ ID NO: 417850 - DNA, 15 bp, Homo sapiens
caggaattctctcta

SEQ ID NO: 417851 - DNA, 15 bp, Homo sapiens
aggaattctctctac

SEQ ID NO: 417852 - DNA, 15 bp, Homo sapiens
ggaattctctctacc

SEQ ID NO: 417853 - DNA, 15 bp, Homo sapiens
gaattctctctaccc

SEQ ID NO: 417854 - DNA, 15 bp, Homo sapiens
aattctctctaccct

SEQ ID NO: 417855 - DNA, 15 bp, Homo sapiens
attctctctacccta

SEQ ID NO: 417856 - DNA, 15 bp, Homo sapiens
ttctctctaccctat

SEQ ID NO: 417857 - DNA, 15 bp, Homo sapiens
tctctctaccctatg

SEQ ID NO: 417858 - DNA, 15 bp, Homo sapiens
ctctctaccctatgt

SEQ ID NO: 417859 - DNA, 15 bp, Homo sapiens
tctctaccctatgtt

SEQ ID NO: 417860 - DNA, 15 bp, Homo sapiens
ctctaccctatgttt

SEQ ID NO: 417861 - DNA, 15 bp, Homo sapiens
tctaccctatgtttt

SEQ ID NO: 417862 - DNA, 15 bp, Homo sapiens
ctaccctatgttttt

SEQ ID NO: 417863 - DNA, 15 bp, Homo sapiens
taccctatgtttttc

SEQ ID NO: 417864 - DNA, 15 bp, Homo sapiens
accctatgtttttct

SEQ ID NO: 417865 - DNA, 15 bp, Homo sapiens
ccctatgtttttctc

SEQ ID NO: 417866 - DNA, 15 bp, Homo sapiens
cctatgtttttctct

SEQ ID NO: 417867 - DNA, 15 bp, Homo sapiens
ctatgtttttctctc

SEQ ID NO: 417868 - DNA, 15 bp, Homo sapiens
tatgtttttctctcg

SEQ ID NO: 417869 - DNA, 15 bp, Homo sapiens
atgtttttctctcgg

SEQ ID NO: 417870 - DNA, 15 bp, Homo sapiens
tgtttttctctcggt

SEQ ID NO: 417871 - DNA, 15 bp, Homo sapiens
gtttttctctcggtc

SEQ ID NO: 417872 - DNA, 15 bp, Homo sapiens
tttttctctcggtcg

SEQ ID NO: 417873 - DNA, 15 bp, Homo sapiens
ttttctctcggtcgg

SEQ ID NO: 417874 - DNA, 15 bp, Homo sapiens
tttctctcggtcggt

SEQ ID NO: 417875 - DNA, 15 bp, Homo sapiens
ttctctcggtcggta

SEQ ID NO: 417876 - DNA, 15 bp, Homo sapiens
tctctcggtcggtaa

SEQ ID NO: 417877 - DNA, 15 bp, Homo sapiens
ctctcggtcggtaat

SEQ ID NO: 417878 - DNA, 15 bp, Homo sapiens
tctcggtcggtaatg

SEQ ID NO: 417879 - DNA, 15 bp, Homo sapiens
ctcggtcggtaatgt

SEQ ID NO: 417880 - DNA, 15 bp, Homo sapiens
tcggtcggtaatgtt

SEQ ID NO: 417881 - DNA, 15 bp, Homo sapiens
cggtcggtaatgttg

SEQ ID NO: 417882 - DNA, 15 bp, Homo sapiens
ggtcggtaatgttgg

SEQ ID NO: 417883 - DNA, 15 bp, Homo sapiens
gtcggtaatgttggg

SEQ ID NO: 417884 - DNA, 15 bp, Homo sapiens
tcggtaatgttgggg

SEQ ID NO: 417885 - DNA, 15 bp, Homo sapiens
cggtaatgttgggga

SEQ ID NO: 417886 - DNA, 15 bp, Homo sapiens
ggtaatgttggggat

SEQ ID NO: 417887 - DNA, 15 bp, Homo sapiens
gtaatgttggggatt

SEQ ID NO: 417888 - DNA, 15 bp, Homo sapiens
taatgttggggattt

SEQ ID NO: 417889 - DNA, 15 bp, Homo sapiens
aatgttggggatttc

SEQ ID NO: 417890 - DNA, 15 bp, Homo sapiens
atgttggggatttct

SEQ ID NO: 417891 - DNA, 15 bp, Homo sapiens
tgttggggatttctg

SEQ ID NO: 417892 - DNA, 15 bp, Homo sapiens
gttggggatttctga

SEQ ID NO: 417893 - DNA, 15 bp, Homo sapiens
ttggggatttctgag

SEQ ID NO: 417894 - DNA, 15 bp, Homo sapiens
tggggatttctgaga

SEQ ID NO: 417895 - DNA, 15 bp, Homo sapiens
ggggatttctgagaa

SEQ ID NO: 417896 - DNA, 15 bp, Homo sapiens
gggatttctgagaag

SEQ ID NO: 417897 - DNA, 15 bp, Homo sapiens
ggatttctgagaagg

SEQ ID NO: 417898 - DNA, 15 bp, Homo sapiens
gatttctgagaaggt

SEQ ID NO: 417899 - DNA, 15 bp, Homo sapiens
atttctgagaaggtc

SEQ ID NO: 417900 - DNA, 15 bp, Homo sapiens
tttctgagaaggtct

SEQ ID NO: 417901 - DNA, 15 bp, Homo sapiens
ttctgagaaggtctc

SEQ ID NO: 417902 - DNA, 15 bp, Homo sapiens
tctgagaaggtctcc

SEQ ID NO: 417903 - DNA, 15 bp, Homo sapiens
ctgagaaggtctccc

SEQ ID NO: 417904 - DNA, 15 bp, Homo sapiens
tgagaaggtctccca

SEQ ID NO: 417905 - DNA, 15 bp, Homo sapiens
gagaaggtctcccaa

SEQ ID NO: 417906 - DNA, 15 bp, Homo sapiens
agaaggtctcccaaa

SEQ ID NO: 417907 - DNA, 15 bp, Homo sapiens
gaaggtctcccaaaa

SEQ ID NO: 417908 - DNA, 15 bp, Homo sapiens
aaggtctcccaaaac

SEQ ID NO: 417909 - DNA, 15 bp, Homo sapiens
aggtctcccaaaaca

SEQ ID NO: 417910 - DNA, 15 bp, Homo sapiens
ggtctcccaaaacag

SEQ ID NO: 417911 - DNA, 15 bp, Homo sapiens
gtctcccaaaacagc

SEQ ID NO: 417912 - DNA, 15 bp, Homo sapiens
tctcccaaaacagct

SEQ ID NO: 417913 - DNA, 15 bp, Homo sapiens
ctcccaaaacagctt

SEQ ID NO: 417914 - DNA, 15 bp, Homo sapiens
tcccaaaacagcttc

SEQ ID NO: 417915 - DNA, 15 bp, Homo sapiens
cccaaaacagcttcc

SEQ ID NO: 417916 - DNA, 15 bp, Homo sapiens
ccaaaacagcttccc

SEQ ID NO: 417917 - DNA, 15 bp, Homo sapiens
caaaacagcttcccc

SEQ ID NO: 417918 - DNA, 15 bp, Homo sapiens
aaaacagcttccccc

SEQ ID NO: 417919 - DNA, 15 bp, Homo sapiens
aaacagcttccccct

SEQ ID NO: 417920 - DNA, 15 bp, Homo sapiens
aacagcttccccctt

SEQ ID NO: 417921 - DNA, 15 bp, Homo sapiens
acagcttcccccttt

SEQ ID NO: 417922 - DNA, 15 bp, Homo sapiens
cagcttccccctttg

SEQ ID NO: 417923 - DNA, 15 bp, Homo sapiens
agcttccccctttgc

SEQ ID NO: 417924 - DNA, 15 bp, Homo sapiens
gcttccccctttgct

SEQ ID NO: 417925 - DNA, 15 bp, Homo sapiens
cttccccctttgctg

SEQ ID NO: 417926 - DNA, 15 bp, Homo sapiens
ttccccctttgctgg

SEQ ID NO: 417927 - DNA, 15 bp, Homo sapiens
tccccctttgctggc

SEQ ID NO: 417928 - DNA, 15 bp, Homo sapiens
ccccctttgctggct

SEQ ID NO: 417929 - DNA, 15 bp, Homo sapiens
cccctttgctggctg

SEQ ID NO: 417930 - DNA, 15 bp, Homo sapiens
ccctttgctggctgg

SEQ ID NO: 417931 - DNA, 15 bp, Homo sapiens
cctttgctggctgga

SEQ ID NO: 417932 - DNA, 15 bp, Homo sapiens
ctttgctggctggat

SEQ ID NO: 417933 - DNA, 15 bp, Homo sapiens
tttgctggctggatt

SEQ ID NO: 417934 - DNA, 15 bp, Homo sapiens
ttgctggctggattc

SEQ ID NO: 417935 - DNA, 15 bp, Homo sapiens
tgctggctggattct

SEQ ID NO: 417936 - DNA, 15 bp, Homo sapiens
gctggctggattctg

SEQ ID NO: 417937 - DNA, 15 bp, Homo sapiens
ctggctggattctga

SEQ ID NO: 417938 - DNA, 15 bp, Homo sapiens
tggctggattctgaa

SEQ ID NO: 417939 - DNA, 15 bp, Homo sapiens
ggctggattctgaac

SEQ ID NO: 417940 - DNA, 15 bp, Homo sapiens
gctggattctgaaca

SEQ ID NO: 417941 - DNA, 15 bp, Homo sapiens
ctggattctgaacaa

SEQ ID NO: 417942 - DNA, 15 bp, Homo sapiens
tggattctgaacaag

SEQ ID NO: 417943 - DNA, 15 bp, Homo sapiens
ggattctgaacaagt

SEQ ID NO: 417944 - DNA, 15 bp, Homo sapiens
gattctgaacaagta

SEQ ID NO: 417945 - DNA, 15 bp, Homo sapiens
attctgaacaagtat

SEQ ID NO: 417946 - DNA, 15 bp, Homo sapiens
ttctgaacaagtatg

SEQ ID NO: 417947 - DNA, 15 bp, Homo sapiens
tctgaacaagtatga

SEQ ID NO: 417948 - DNA, 15 bp, Homo sapiens
ctgaacaagtatgaa

SEQ ID NO: 417949 - DNA, 15 bp, Homo sapiens
tgaacaagtatgaaa

SEQ ID NO: 417950 - DNA, 15 bp, Homo sapiens
gaacaagtatgaaac

SEQ ID NO: 417951 - DNA, 15 bp, Homo sapiens
aacaagtatgaaaca

SEQ ID NO: 417952 - DNA, 15 bp, Homo sapiens
acaagtatgaaacaa

SEQ ID NO: 417953 - DNA, 15 bp, Homo sapiens
caagtatgaaacaaa

SEQ ID NO: 417954 - DNA, 15 bp, Homo sapiens
aagtatgaaacaaag

SEQ ID NO: 417955 - DNA, 15 bp, Homo sapiens
agtatgaaacaaagt

SEQ ID NO: 417956 - DNA, 15 bp, Homo sapiens
gtatgaaacaaagtg

SEQ ID NO: 417957 - DNA, 15 bp, Homo sapiens
tatgaaacaaagtgt

SEQ ID NO: 417958 - DNA, 15 bp, Homo sapiens
atgaaacaaagtgtg

SEQ ID NO: 417959 - DNA, 15 bp, Homo sapiens
tgaaacaaagtgtgc

SEQ ID NO: 417960 - DNA, 15 bp, Homo sapiens
gaaacaaagtgtgct

SEQ ID NO: 417961 - DNA, 15 bp, Homo sapiens
aaacaaagtgtgctc

SEQ ID NO: 417962 - DNA, 15 bp, Homo sapiens
aacaaagtgtgctca

SEQ ID NO: 417963 - DNA, 15 bp, Homo sapiens
acaaagtgtgctcaa

SEQ ID NO: 417964 - DNA, 15 bp, Homo sapiens
caaagtgtgctcaag

SEQ ID NO: 417965 - DNA, 15 bp, Homo sapiens
aaagtgtgctcaagg

SEQ ID NO: 417966 - DNA, 15 bp, Homo sapiens
aagtgtgctcaaggg

SEQ ID NO: 417967 - DNA, 15 bp, Homo sapiens
agtgtgctcaagggg

SEQ ID NO: 417968 - DNA, 15 bp, Homo sapiens
gtgtgctcaaggggc

SEQ ID NO: 417969 - DNA, 15 bp, Homo sapiens
tgtgctcaaggggca

SEQ ID NO: 417970 - DNA, 15 bp, Homo sapiens
gtgctcaaggggcat

SEQ ID NO: 417971 - DNA, 15 bp, Homo sapiens
tgctcaaggggcatt

SEQ ID NO: 417972 - DNA, 15 bp, Homo sapiens
gctcaaggggcattc

SEQ ID NO: 417973 - DNA, 15 bp, Homo sapiens
ctcaaggggcattca

SEQ ID NO: 417974 - DNA, 15 bp, Homo sapiens
tcaaggggcattcat

SEQ ID NO: 417975 - DNA, 15 bp, Homo sapiens
caaggggcattcatc

SEQ ID NO: 417976 - DNA, 15 bp, Homo sapiens
aaggggcattcatca

SEQ ID NO: 417977 - DNA, 15 bp, Homo sapiens
aggggcattcatcat

SEQ ID NO: 417978 - DNA, 15 bp, Homo sapiens
ggggcattcatcatg

SEQ ID NO: 417979 - DNA, 15 bp, Homo sapiens
gggcattcatcatgt

SEQ ID NO: 417980 - DNA, 15 bp, Homo sapiens
ggcattcatcatgtg

SEQ ID NO: 417981 - DNA, 15 bp, Homo sapiens
gcattcatcatgtgg

SEQ ID NO: 417982 - DNA, 15 bp, Homo sapiens
cattcatcatgtggc

SEQ ID NO: 417983 - DNA, 15 bp, Homo sapiens
attcatcatgtggcc

SEQ ID NO: 417984 - DNA, 15 bp, Homo sapiens
ttcatcatgtggcca

SEQ ID NO: 417985 - DNA, 15 bp, Homo sapiens
tcatcatgtggccaa

SEQ ID NO: 417986 - DNA, 15 bp, Homo sapiens
catcatgtggccaat

SEQ ID NO: 417987 - DNA, 15 bp, Homo sapiens
atcatgtggccaata

SEQ ID NO: 417988 - DNA, 15 bp, Homo sapiens
tcatgtggccaatag

SEQ ID NO: 417989 - DNA, 15 bp, Homo sapiens
catgtggccaataga

SEQ ID NO: 417990 - DNA, 15 bp, Homo sapiens
atgtggccaatagag

SEQ ID NO: 417991 - DNA, 15 bp, Homo sapiens
tgtggccaatagaga

SEQ ID NO: 417992 - DNA, 15 bp, Homo sapiens
gtggccaatagagaa

SEQ ID NO: 417993 - DNA, 15 bp, Homo sapiens
tggccaatagagaac

SEQ ID NO: 417994 - DNA, 15 bp, Homo sapiens
ggccaatagagaact

SEQ ID NO: 417995 - DNA, 15 bp, Homo sapiens
gccaatagagaactc

SEQ ID NO: 417996 - DNA, 15 bp, Homo sapiens
ccaatagagaactca

SEQ ID NO: 417997 - DNA, 15 bp, Homo sapiens
caatagagaactcaa

SEQ ID NO: 417998 - DNA, 15 bp, Homo sapiens
aatagagaactcaaa

SEQ ID NO: 417999 - DNA, 15 bp, Homo sapiens
atagagaactcaaat

SEQ ID NO: 418000 - DNA, 15 bp, Homo sapiens
tagagaactcaaatg

SEQ ID NO: 418001 - DNA, 15 bp, Homo sapiens
agagaactcaaatgc

SEQ ID NO: 418002 - DNA, 15 bp, Homo sapiens
gagaactcaaatgcc

SEQ ID NO: 418003 - DNA, 15 bp, Homo sapiens
agaactcaaatgcca

SEQ ID NO: 418004 - DNA, 15 bp, Homo sapiens
gaactcaaatgccat

SEQ ID NO: 418005 - DNA, 15 bp, Homo sapiens
aactcaaatgccatg

SEQ ID NO: 418006 - DNA, 15 bp, Homo sapiens
actcaaatgccatgt

SEQ ID NO: 418007 - DNA, 15 bp, Homo sapiens
ctcaaatgccatgtt

SEQ ID NO: 418008 - DNA, 15 bp, Homo sapiens
tcaaatgccatgtta

SEQ ID NO: 418009 - DNA, 15 bp, Homo sapiens
caaatgccatgttaa

SEQ ID NO: 418010 - DNA, 15 bp, Homo sapiens
aaatgccatgttaat

SEQ ID NO: 418011 - DNA, 15 bp, Homo sapiens
aatgccatgttaatt

SEQ ID NO: 418012 - DNA, 15 bp, Homo sapiens
atgccatgttaatta

SEQ ID NO: 418013 - DNA, 15 bp, Homo sapiens
tgccatgttaattac

SEQ ID NO: 418014 - DNA, 15 bp, Homo sapiens
gccatgttaattact

SEQ ID NO: 418015 - DNA, 15 bp, Homo sapiens
ccatgttaattactg

SEQ ID NO: 418016 - DNA, 15 bp, Homo sapiens
catgttaattactga

SEQ ID NO: 418017 - DNA, 15 bp, Homo sapiens
atgttaattactgat

SEQ ID NO: 418018 - DNA, 15 bp, Homo sapiens
tgttaattactgata

SEQ ID NO: 418019 - DNA, 15 bp, Homo sapiens
gttaattactgatag

SEQ ID NO: 418020 - DNA, 15 bp, Homo sapiens
ttaattactgataga

SEQ ID NO: 418021 - DNA, 15 bp, Homo sapiens
taattactgatagag

SEQ ID NO: 418022 - DNA, 15 bp, Homo sapiens
aattactgatagagg

SEQ ID NO: 418023 - DNA, 15 bp, Homo sapiens
attactgatagaggc

SEQ ID NO: 418024 - DNA, 15 bp, Homo sapiens
ttactgatagaggcc

SEQ ID NO: 418025 - DNA, 15 bp, Homo sapiens
tactgatagaggcca

SEQ ID NO: 418026 - DNA, 15 bp, Homo sapiens
actgatagaggccag

SEQ ID NO: 418027 - DNA, 15 bp, Homo sapiens
ctgatagaggccagg

SEQ ID NO: 418028 - DNA, 15 bp, Homo sapiens
tgatagaggccaggt

SEQ ID NO: 418029 - DNA, 15 bp, Homo sapiens
gatagaggccaggtt

SEQ ID NO: 418030 - DNA, 15 bp, Homo sapiens
atagaggccaggttg

SEQ ID NO: 418031 - DNA, 15 bp, Homo sapiens
tagaggccaggttgg

SEQ ID NO: 418032 - DNA, 15 bp, Homo sapiens
agaggccaggttgga

SEQ ID NO: 418033 - DNA, 15 bp, Homo sapiens
gaggccaggttggag

SEQ ID NO: 418034 - DNA, 15 bp, Homo sapiens
aggccaggttggagg

SEQ ID NO: 418035 - DNA, 15 bp, Homo sapiens
ggccaggttggaggt

SEQ ID NO: 418036 - DNA, 15 bp, Homo sapiens
gccaggttggaggtg

SEQ ID NO: 418037 - DNA, 15 bp, Homo sapiens
ccaggttggaggtgg

SEQ ID NO: 418038 - DNA, 15 bp, Homo sapiens
caggttggaggtggt

SEQ ID NO: 418039 - DNA, 15 bp, Homo sapiens
aggttggaggtggta

SEQ ID NO: 418040 - DNA, 15 bp, Homo sapiens
ggttggaggtggtaa

SEQ ID NO: 418041 - DNA, 15 bp, Homo sapiens
gttggaggtggtaac

SEQ ID NO: 418042 - DNA, 15 bp, Homo sapiens
ttggaggtggtaact

SEQ ID NO: 418043 - DNA, 15 bp, Homo sapiens
tggaggtggtaactt

SEQ ID NO: 418044 - DNA, 15 bp, Homo sapiens
ggaggtggtaactta

SEQ ID NO: 418045 - DNA, 15 bp, Homo sapiens
gaggtggtaacttag

SEQ ID NO: 418046 - DNA, 15 bp, Homo sapiens
aggtggtaacttaga

SEQ ID NO: 418047 - DNA, 15 bp, Homo sapiens
ggtggtaacttagag

SEQ ID NO: 418048 - DNA, 15 bp, Homo sapiens
gtggtaacttagagt

SEQ ID NO: 418049 - DNA, 15 bp, Homo sapiens
tggtaacttagagtg

SEQ ID NO: 418050 - DNA, 15 bp, Homo sapiens
ggtaacttagagtga

SEQ ID NO: 418051 - DNA, 15 bp, Homo sapiens
gtaacttagagtgaa

SEQ ID NO: 418052 - DNA, 15 bp, Homo sapiens
taacttagagtgaag

SEQ ID NO: 418053 - DNA, 15 bp, Homo sapiens
aacttagagtgaagg

SEQ ID NO: 418054 - DNA, 15 bp, Homo sapiens
acttagagtgaaggt

SEQ ID NO: 418055 - DNA, 15 bp, Homo sapiens
cttagagtgaaggtg

SEQ ID NO: 418056 - DNA, 15 bp, Homo sapiens
ttagagtgaaggtga

SEQ ID NO: 418057 - DNA, 15 bp, Homo sapiens
tagagtgaaggtgag

SEQ ID NO: 418058 - DNA, 15 bp, Homo sapiens
agagtgaaggtgagt

SEQ ID NO: 418059 - DNA, 15 bp, Homo sapiens
gagtgaaggtgagtg

SEQ ID NO: 418060 - DNA, 15 bp, Homo sapiens
agtgaaggtgagtgg

SEQ ID NO: 418061 - DNA, 15 bp, Homo sapiens
gtgaaggtgagtgga

SEQ ID NO: 418062 - DNA, 15 bp, Homo sapiens
tgaaggtgagtggag

SEQ ID NO: 418063 - DNA, 15 bp, Homo sapiens
gaaggtgagtggagc

SEQ ID NO: 418064 - DNA, 15 bp, Homo sapiens
aaggtgagtggagct

SEQ ID NO: 418065 - DNA, 15 bp, Homo sapiens
aggtgagtggagctg

SEQ ID NO: 418066 - DNA, 15 bp, Homo sapiens
ggtgagtggagctgt

SEQ ID NO: 418067 - DNA, 15 bp, Homo sapiens
gtgagtggagctgtc

SEQ ID NO: 418068 - DNA, 15 bp, Homo sapiens
tgagtggagctgtca

SEQ ID NO: 418069 - DNA, 15 bp, Homo sapiens
gagtggagctgtcaa

SEQ ID NO: 418070 - DNA, 15 bp, Homo sapiens
agtggagctgtcaac

SEQ ID NO: 418071 - DNA, 15 bp, Homo sapiens
gtggagctgtcaacc

SEQ ID NO: 418072 - DNA, 15 bp, Homo sapiens
tggagctgtcaacca

SEQ ID NO: 418073 - DNA, 15 bp, Homo sapiens
ggagctgtcaaccaa

SEQ ID NO: 418074 - DNA, 15 bp, Homo sapiens
gagctgtcaaccaaa

SEQ ID NO: 418075 - DNA, 15 bp, Homo sapiens
agctgtcaaccaaac

SEQ ID NO: 418076 - DNA, 15 bp, Homo sapiens
gctgtcaaccaaacc

SEQ ID NO: 418077 - DNA, 15 bp, Homo sapiens
ctgtcaaccaaaccc

SEQ ID NO: 418078 - DNA, 15 bp, Homo sapiens
tgtcaaccaaacccc

SEQ ID NO: 418079 - DNA, 15 bp, Homo sapiens
gtcaaccaaacccca

SEQ ID NO: 418080 - DNA, 15 bp, Homo sapiens
tcaaccaaaccccag

SEQ ID NO: 418081 - DNA, 15 bp, Homo sapiens
caaccaaaccccaga

SEQ ID NO: 418082 - DNA, 15 bp, Homo sapiens
aaccaaaccccagaa

SEQ ID NO: 418083 - DNA, 15 bp, Homo sapiens
accaaaccccagaat

SEQ ID NO: 418084 - DNA, 15 bp, Homo sapiens
ccaaaccccagaatg

SEQ ID NO: 418085 - DNA, 15 bp, Homo sapiens
caaaccccagaatga

SEQ ID NO: 418086 - DNA, 15 bp, Homo sapiens
aaaccccagaatgag

SEQ ID NO: 418087 - DNA, 15 bp, Homo sapiens
aaccccagaatgagg

SEQ ID NO: 418088 - DNA, 15 bp, Homo sapiens
accccagaatgaggc

SEQ ID NO: 418089 - DNA, 15 bp, Homo sapiens
ccccagaatgaggca

SEQ ID NO: 418090 - DNA, 15 bp, Homo sapiens
cccagaatgaggcag

SEQ ID NO: 418091 - DNA, 15 bp, Homo sapiens
ccagaatgaggcaga

SEQ ID NO: 418092 - DNA, 15 bp, Homo sapiens
cagaatgaggcagaa

SEQ ID NO: 418093 - DNA, 15 bp, Homo sapiens
agaatgaggcagaat

SEQ ID NO: 418094 - DNA, 15 bp, Homo sapiens
gaatgaggcagaatc

SEQ ID NO: 418095 - DNA, 15 bp, Homo sapiens
aatgaggcagaatca

SEQ ID NO: 418096 - DNA, 15 bp, Homo sapiens
atgaggcagaatcac

SEQ ID NO: 418097 - DNA, 15 bp, Homo sapiens
tgaggcagaatcacc

SEQ ID NO: 418098 - DNA, 15 bp, Homo sapiens
gaggcagaatcacca

SEQ ID NO: 418099 - DNA, 15 bp, Homo sapiens
aggcagaatcaccag

SEQ ID NO: 418100 - DNA, 15 bp, Homo sapiens
ggcagaatcaccagc

SEQ ID NO: 418101 - DNA, 15 bp, Homo sapiens
gcagaatcaccagca

SEQ ID NO: 418102 - DNA, 15 bp, Homo sapiens
cagaatcaccagcag

SEQ ID NO: 418103 - DNA, 15 bp, Homo sapiens
agaatcaccagcagt

SEQ ID NO: 418104 - DNA, 15 bp, Homo sapiens
gaatcaccagcagtc

SEQ ID NO: 418105 - DNA, 15 bp, Homo sapiens
aatcaccagcagtca

SEQ ID NO: 418106 - DNA, 15 bp, Homo sapiens
atcaccagcagtcac

SEQ ID NO: 418107 - DNA, 15 bp, Homo sapiens
tcaccagcagtcact

SEQ ID NO: 418108 - DNA, 15 bp, Homo sapiens
caccagcagtcactg

SEQ ID NO: 418109 - DNA, 15 bp, Homo sapiens
accagcagtcactgg

SEQ ID NO: 418110 - DNA, 15 bp, Homo sapiens
ccagcagtcactggg

SEQ ID NO: 418111 - DNA, 15 bp, Homo sapiens
cagcagtcactgggc

SEQ ID NO: 418112 - DNA, 15 bp, Homo sapiens
agcagtcactgggca

SEQ ID NO: 418113 - DNA, 15 bp, Homo sapiens
gcagtcactgggcaa

SEQ ID NO: 418114 - DNA, 15 bp, Homo sapiens
cagtcactgggcaag

SEQ ID NO: 418115 - DNA, 15 bp, Homo sapiens
agtcactgggcaagg

SEQ ID NO: 418116 - DNA, 15 bp, Homo sapiens
gtcactgggcaaggt

SEQ ID NO: 418117 - DNA, 15 bp, Homo sapiens
tcactgggcaaggtg

SEQ ID NO: 418118 - DNA, 15 bp, Homo sapiens
cactgggcaaggtgg

SEQ ID NO: 418119 - DNA, 15 bp, Homo sapiens
actgggcaaggtggc

SEQ ID NO: 418120 - DNA, 15 bp, Homo sapiens
ctgggcaaggtggct

SEQ ID NO: 418121 - DNA, 15 bp, Homo sapiens
tgggcaaggtggctt

SEQ ID NO: 418122 - DNA, 15 bp, Homo sapiens
gggcaaggtggcttc

SEQ ID NO: 418123 - DNA, 15 bp, Homo sapiens
ggcaaggtggcttcc

SEQ ID NO: 418124 - DNA, 15 bp, Homo sapiens
gcaaggtggcttccc

SEQ ID NO: 418125 - DNA, 15 bp, Homo sapiens
caaggtggcttccca

SEQ ID NO: 418126 - DNA, 15 bp, Homo sapiens
aaggtggcttcccaa

SEQ ID NO: 418127 - DNA, 15 bp, Homo sapiens
aggtggcttcccaag

SEQ ID NO: 418128 - DNA, 15 bp, Homo sapiens
ggtggcttcccaagt

SEQ ID NO: 418129 - DNA, 15 bp, Homo sapiens
gtggcttcccaagtg

SEQ ID NO: 418130 - DNA, 15 bp, Homo sapiens
tggcttcccaagtga

SEQ ID NO: 418131 - DNA, 15 bp, Homo sapiens
ggcttcccaagtgag

SEQ ID NO: 418132 - DNA, 15 bp, Homo sapiens
gcttcccaagtgaga

SEQ ID NO: 418133 - DNA, 15 bp, Homo sapiens
cttcccaagtgagaa

SEQ ID NO: 418134 - DNA, 15 bp, Homo sapiens
ttcccaagtgagaaa

SEQ ID NO: 418135 - DNA, 15 bp, Homo sapiens
tcccaagtgagaaac

SEQ ID NO: 418136 - DNA, 15 bp, Homo sapiens
cccaagtgagaaacc

SEQ ID NO: 418137 - DNA, 15 bp, Homo sapiens
ccaagtgagaaacca

SEQ ID NO: 418138 - DNA, 15 bp, Homo sapiens
caagtgagaaaccat

SEQ ID NO: 418139 - DNA, 15 bp, Homo sapiens
aagtgagaaaccata

SEQ ID NO: 418140 - DNA, 15 bp, Homo sapiens
agtgagaaaccatac

SEQ ID NO: 418141 - DNA, 15 bp, Homo sapiens
gtgagaaaccataca

SEQ ID NO: 418142 - DNA, 15 bp, Homo sapiens
tgagaaaccatacat

SEQ ID NO: 418143 - DNA, 15 bp, Homo sapiens
gagaaaccatacatg

SEQ ID NO: 418144 - DNA, 15 bp, Homo sapiens
agaaaccatacatgg

SEQ ID NO: 418145 - DNA, 15 bp, Homo sapiens
gaaaccatacatgga

SEQ ID NO: 418146 - DNA, 15 bp, Homo sapiens
aaaccatacatggaa

SEQ ID NO: 418147 - DNA, 15 bp, Homo sapiens
aaccatacatggaag

SEQ ID NO: 418148 - DNA, 15 bp, Homo sapiens
accatacatggaaga

SEQ ID NO: 418149 - DNA, 15 bp, Homo sapiens
ccatacatggaagag

SEQ ID NO: 418150 - DNA, 15 bp, Homo sapiens
catacatggaagagt

SEQ ID NO: 418151 - DNA, 15 bp, Homo sapiens
atacatggaagagta

SEQ ID NO: 418152 - DNA, 15 bp, Homo sapiens
tacatggaagagtag

SEQ ID NO: 418153 - DNA, 15 bp, Homo sapiens
acatggaagagtaga

SEQ ID NO: 418154 - DNA, 15 bp, Homo sapiens
catggaagagtagaa

SEQ ID NO: 418155 - DNA, 15 bp, Homo sapiens
atggaagagtagaaa

SEQ ID NO: 418156 - DNA, 15 bp, Homo sapiens
tggaagagtagaaaa

SEQ ID NO: 418157 - DNA, 15 bp, Homo sapiens
ggaagagtagaaaag

SEQ ID NO: 418158 - DNA, 15 bp, Homo sapiens
gaagagtagaaaaga

SEQ ID NO: 418159 - DNA, 15 bp, Homo sapiens
aagagtagaaaagaa

SEQ ID NO: 418160 - DNA, 15 bp, Homo sapiens
agagtagaaaagaac

SEQ ID NO: 418161 - DNA, 15 bp, Homo sapiens
gagtagaaaagaact

SEQ ID NO: 418162 - DNA, 15 bp, Homo sapiens
agtagaaaagaactc

SEQ ID NO: 418163 - DNA, 15 bp, Homo sapiens
gtagaaaagaactca

SEQ ID NO: 418164 - DNA, 15 bp, Homo sapiens
tagaaaagaactcag

SEQ ID NO: 418165 - DNA, 15 bp, Homo sapiens
agaaaagaactcagt

SEQ ID NO: 418166 - DNA, 15 bp, Homo sapiens
gaaaagaactcagta

SEQ ID NO: 418167 - DNA, 15 bp, Homo sapiens
aaaagaactcagtat

SEQ ID NO: 418168 - DNA, 15 bp, Homo sapiens
aaagaactcagtatc

SEQ ID NO: 418169 - DNA, 15 bp, Homo sapiens
aagaactcagtatct

SEQ ID NO: 418170 - DNA, 15 bp, Homo sapiens
agaactcagtatctt

SEQ ID NO: 418171 - DNA, 15 bp, Homo sapiens
gaactcagtatcttc

SEQ ID NO: 418172 - DNA, 15 bp, Homo sapiens
aactcagtatcttca

SEQ ID NO: 418173 - DNA, 15 bp, Homo sapiens
actcagtatcttcat

SEQ ID NO: 418174 - DNA, 15 bp, Homo sapiens
ctcagtatcttcatg

SEQ ID NO: 418175 - DNA, 15 bp, Homo sapiens
tcagtatcttcatgg

SEQ ID NO: 418176 - DNA, 15 bp, Homo sapiens
cagtatcttcatggc

SEQ ID NO: 418177 - DNA, 15 bp, Homo sapiens
agtatcttcatggcc

SEQ ID NO: 418178 - DNA, 15 bp, Homo sapiens
gtatcttcatggcct

SEQ ID NO: 418179 - DNA, 15 bp, Homo sapiens
tatcttcatggcctg

SEQ ID NO: 418180 - DNA, 15 bp, Homo sapiens
atcttcatggcctgt

SEQ ID NO: 418181 - DNA, 15 bp, Homo sapiens
tcttcatggcctgtc

SEQ ID NO: 418182 - DNA, 15 bp, Homo sapiens
cttcatggcctgtcg

SEQ ID NO: 418183 - DNA, 15 bp, Homo sapiens
ttcatggcctgtcgt

SEQ ID NO: 418184 - DNA, 15 bp, Homo sapiens
tcatggcctgtcgtc

SEQ ID NO: 418185 - DNA, 15 bp, Homo sapiens
catggcctgtcgtca

SEQ ID NO: 418186 - DNA, 15 bp, Homo sapiens
atggcctgtcgtcaa

SEQ ID NO: 418187 - DNA, 15 bp, Homo sapiens
tggcctgtcgtcaag

SEQ ID NO: 418188 - DNA, 15 bp, Homo sapiens
ggcctgtcgtcaagt

SEQ ID NO: 418189 - DNA, 15 bp, Homo sapiens
gcctgtcgtcaagtg

SEQ ID NO: 418190 - DNA, 15 bp, Homo sapiens
cctgtcgtcaagtgg

SEQ ID NO: 418191 - DNA, 15 bp, Homo sapiens
ctgtcgtcaagtgga

SEQ ID NO: 418192 - DNA, 15 bp, Homo sapiens
tgtcgtcaagtggac

SEQ ID NO: 418193 - DNA, 15 bp, Homo sapiens
gtcgtcaagtggacc

SEQ ID NO: 418194 - DNA, 15 bp, Homo sapiens
tcgtcaagtggaccg

SEQ ID NO: 418195 - DNA, 15 bp, Homo sapiens
cgtcaagtggaccgt

SEQ ID NO: 418196 - DNA, 15 bp, Homo sapiens
gtcaagtggaccgta

SEQ ID NO: 418197 - DNA, 15 bp, Homo sapiens
tcaagtggaccgtat

SEQ ID NO: 418198 - DNA, 15 bp, Homo sapiens
caagtggaccgtatg

SEQ ID NO: 418199 - DNA, 15 bp, Homo sapiens
aagtggaccgtatgg

SEQ ID NO: 418200 - DNA, 15 bp, Homo sapiens
agtggaccgtatggg

SEQ ID NO: 418201 - DNA, 15 bp, Homo sapiens
gtggaccgtatgggc

SEQ ID NO: 418202 - DNA, 15 bp, Homo sapiens
tggaccgtatgggct

SEQ ID NO: 418203 - DNA, 15 bp, Homo sapiens
ggaccgtatgggctg

SEQ ID NO: 418204 - DNA, 15 bp, Homo sapiens
gaccgtatgggctga

SEQ ID NO: 418205 - DNA, 15 bp, Homo sapiens
accgtatgggctgag

SEQ ID NO: 418206 - DNA, 15 bp, Homo sapiens
ccgtatgggctgagc

SEQ ID NO: 418207 - DNA, 15 bp, Homo sapiens
cgtatgggctgagct

SEQ ID NO: 418208 - DNA, 15 bp, Homo sapiens
gtatgggctgagcta

SEQ ID NO: 418209 - DNA, 15 bp, Homo sapiens
tatgggctgagctaa

SEQ ID NO: 418210 - DNA, 15 bp, Homo sapiens
atgggctgagctaag

SEQ ID NO: 418211 - DNA, 15 bp, Homo sapiens
tgggctgagctaagc

SEQ ID NO: 418212 - DNA, 15 bp, Homo sapiens
gggctgagctaagca

SEQ ID NO: 418213 - DNA, 15 bp, Homo sapiens
ggctgagctaagcat

SEQ ID NO: 418214 - DNA, 15 bp, Homo sapiens
gctgagctaagcatg

SEQ ID NO: 418215 - DNA, 15 bp, Homo sapiens
ctgagctaagcatgc

SEQ ID NO: 418216 - DNA, 15 bp, Homo sapiens
tgagctaagcatgcc

SEQ ID NO: 418217 - DNA, 15 bp, Homo sapiens
gagctaagcatgccc

SEQ ID NO: 418218 - DNA, 15 bp, Homo sapiens
agctaagcatgccca

SEQ ID NO: 418219 - DNA, 15 bp, Homo sapiens
gctaagcatgcccaa

SEQ ID NO: 418220 - DNA, 15 bp, Homo sapiens
ctaagcatgcccaat

SEQ ID NO: 418221 - DNA, 15 bp, Homo sapiens
taagcatgcccaatt

SEQ ID NO: 418222 - DNA, 15 bp, Homo sapiens
aagcatgcccaatta

SEQ ID NO: 418223 - DNA, 15 bp, Homo sapiens
agcatgcccaattat

SEQ ID NO: 418224 - DNA, 15 bp, Homo sapiens
gcatgcccaattatt

SEQ ID NO: 418225 - DNA, 15 bp, Homo sapiens
catgcccaattattc

SEQ ID NO: 418226 - DNA, 15 bp, Homo sapiens
atgcccaattattct

SEQ ID NO: 418227 - DNA, 15 bp, Homo sapiens
tgcccaattattctc

SEQ ID NO: 418228 - DNA, 15 bp, Homo sapiens
gcccaattattctcc

SEQ ID NO: 418229 - DNA, 15 bp, Homo sapiens
cccaattattctccc

SEQ ID NO: 418230 - DNA, 15 bp, Homo sapiens
ccaattattctccct

SEQ ID NO: 418231 - DNA, 15 bp, Homo sapiens
caattattctccctg

SEQ ID NO: 418232 - DNA, 15 bp, Homo sapiens
aattattctccctga

SEQ ID NO: 418233 - DNA, 15 bp, Homo sapiens
attattctccctgaa

SEQ ID NO: 418234 - DNA, 15 bp, Homo sapiens
ttattctccctgaat

SEQ ID NO: 418235 - DNA, 15 bp, Homo sapiens
tattctccctgaatt

SEQ ID NO: 418236 - DNA, 15 bp, Homo sapiens
attctccctgaattt

SEQ ID NO: 418237 - DNA, 15 bp, Homo sapiens
ttctccctgaattta

SEQ ID NO: 418238 - DNA, 15 bp, Homo sapiens
tctccctgaatttac

SEQ ID NO: 418239 - DNA, 15 bp, Homo sapiens
ctccctgaatttaca

SEQ ID NO: 418240 - DNA, 15 bp, Homo sapiens
tccctgaatttacag

SEQ ID NO: 418241 - DNA, 15 bp, Homo sapiens
ccctgaatttacaga

SEQ ID NO: 418242 - DNA, 15 bp, Homo sapiens
cctgaatttacagat

SEQ ID NO: 418243 - DNA, 15 bp, Homo sapiens
ctgaatttacagatc

SEQ ID NO: 418244 - DNA, 15 bp, Homo sapiens
tgaatttacagatca

SEQ ID NO: 418245 - DNA, 15 bp, Homo sapiens
gaatttacagatcag

SEQ ID NO: 418246 - DNA, 15 bp, Homo sapiens
aatttacagatcaga

SEQ ID NO: 418247 - DNA, 15 bp, Homo sapiens
atttacagatcagat

SEQ ID NO: 418248 - DNA, 15 bp, Homo sapiens
tttacagatcagatt

SEQ ID NO: 418249 - DNA, 15 bp, Homo sapiens
ttacagatcagattc

SEQ ID NO: 418250 - DNA, 15 bp, Homo sapiens
tacagatcagattcg

SEQ ID NO: 418251 - DNA, 15 bp, Homo sapiens
acagatcagattcgt

SEQ ID NO: 418252 - DNA, 15 bp, Homo sapiens
cagatcagattcgtc

SEQ ID NO: 418253 - DNA, 15 bp, Homo sapiens
agatcagattcgtca

SEQ ID NO: 418254 - DNA, 15 bp, Homo sapiens
gatcagattcgtcac

SEQ ID NO: 418255 - DNA, 15 bp, Homo sapiens
atcagattcgtcact

SEQ ID NO: 418256 - DNA, 15 bp, Homo sapiens
tcagattcgtcactc

SEQ ID NO: 418257 - DNA, 15 bp, Homo sapiens
cagattcgtcactct

SEQ ID NO: 418258 - DNA, 15 bp, Homo sapiens
agattcgtcactcta

SEQ ID NO: 418259 - DNA, 15 bp, Homo sapiens
gattcgtcactctac

SEQ ID NO: 418260 - DNA, 15 bp, Homo sapiens
attcgtcactctacc

SEQ ID NO: 418261 - DNA, 15 bp, Homo sapiens
ttcgtcactctacct

SEQ ID NO: 418262 - DNA, 15 bp, Homo sapiens
tcgtcactctacctt

SEQ ID NO: 418263 - DNA, 15 bp, Homo sapiens
cgtcactctaccttt

SEQ ID NO: 418264 - DNA, 15 bp, Homo sapiens
gtcactctacctttg

SEQ ID NO: 418265 - DNA, 15 bp, Homo sapiens
tcactctacctttgc

SEQ ID NO: 418266 - DNA, 15 bp, Homo sapiens
cactctacctttgca

SEQ ID NO: 418267 - DNA, 15 bp, Homo sapiens
actctacctttgcag

SEQ ID NO: 418268 - DNA, 15 bp, Homo sapiens
ctctacctttgcagg

SEQ ID NO: 418269 - DNA, 15 bp, Homo sapiens
tctacctttgcaggg

SEQ ID NO: 418270 - DNA, 15 bp, Homo sapiens
ctacctttgcaggga

SEQ ID NO: 418271 - DNA, 15 bp, Homo sapiens
tacctttgcagggac

SEQ ID NO: 418272 - DNA, 15 bp, Homo sapiens
acctttgcagggact

SEQ ID NO: 418273 - DNA, 15 bp, Homo sapiens
cctttgcagggactg

SEQ ID NO: 418274 - DNA, 15 bp, Homo sapiens
ctttgcagggactgt

SEQ ID NO: 418275 - DNA, 15 bp, Homo sapiens
tttgcagggactgtt

SEQ ID NO: 418276 - DNA, 15 bp, Homo sapiens
ttgcagggactgttt

SEQ ID NO: 418277 - DNA, 15 bp, Homo sapiens
tgcagggactgtttc

SEQ ID NO: 418278 - DNA, 15 bp, Homo sapiens
gcagggactgtttca

SEQ ID NO: 418279 - DNA, 15 bp, Homo sapiens
cagggactgtttcag

SEQ ID NO: 418280 - DNA, 15 bp, Homo sapiens
agggactgtttcagg

SEQ ID NO: 418281 - DNA, 15 bp, Homo sapiens
gggactgtttcaggg

SEQ ID NO: 418282 - DNA, 15 bp, Homo sapiens
ggactgtttcagggg

SEQ ID NO: 418283 - DNA, 15 bp, Homo sapiens
gactgtttcaggggt

SEQ ID NO: 418284 - DNA, 15 bp, Homo sapiens
actgtttcaggggtg

SEQ ID NO: 418285 - DNA, 15 bp, Homo sapiens
ctgtttcaggggtgg

SEQ ID NO: 418286 - DNA, 15 bp, Homo sapiens
tgtttcaggggtgga

SEQ ID NO: 418287 - DNA, 15 bp, Homo sapiens
gtttcaggggtggag

SEQ ID NO: 418288 - DNA, 15 bp, Homo sapiens
tttcaggggtggaga

SEQ ID NO: 418289 - DNA, 15 bp, Homo sapiens
ttcaggggtggagaa

SEQ ID NO: 418290 - DNA, 15 bp, Homo sapiens
tcaggggtggagaag

SEQ ID NO: 418291 - DNA, 15 bp, Homo sapiens
caggggtggagaaga

SEQ ID NO: 418292 - DNA, 15 bp, Homo sapiens
aggggtggagaagag

SEQ ID NO: 418293 - DNA, 15 bp, Homo sapiens
ggggtggagaagaga

SEQ ID NO: 418294 - DNA, 15 bp, Homo sapiens
gggtggagaagagac

SEQ ID NO: 418295 - DNA, 15 bp, Homo sapiens
ggtggagaagagacc

SEQ ID NO: 418296 - DNA, 15 bp, Homo sapiens
gtggagaagagacca

SEQ ID NO: 418297 - DNA, 15 bp, Homo sapiens
tggagaagagaccag

SEQ ID NO: 418298 - DNA, 15 bp, Homo sapiens
ggagaagagaccaga

SEQ ID NO: 418299 - DNA, 15 bp, Homo sapiens
gagaagagaccagag

SEQ ID NO: 418300 - DNA, 15 bp, Homo sapiens
agaagagaccagagt

SEQ ID NO: 418301 - DNA, 15 bp, Homo sapiens
gaagagaccagagtg

SEQ ID NO: 418302 - DNA, 15 bp, Homo sapiens
aagagaccagagtgt

SEQ ID NO: 418303 - DNA, 15 bp, Homo sapiens
agagaccagagtgtg

SEQ ID NO: 418304 - DNA, 15 bp, Homo sapiens
gagaccagagtgtgc

SEQ ID NO: 418305 - DNA, 15 bp, Homo sapiens
agaccagagtgtgct

SEQ ID NO: 418306 - DNA, 15 bp, Homo sapiens
gaccagagtgtgctt

SEQ ID NO: 418307 - DNA, 15 bp, Homo sapiens
accagagtgtgctta

SEQ ID NO: 418308 - DNA, 15 bp, Homo sapiens
ccagagtgtgcttag

SEQ ID NO: 418309 - DNA, 15 bp, Homo sapiens
cagagtgtgcttagt

SEQ ID NO: 418310 - DNA, 15 bp, Homo sapiens
agagtgtgcttagtg

SEQ ID NO: 418311 - DNA, 15 bp, Homo sapiens
gagtgtgcttagtga

SEQ ID NO: 418312 - DNA, 15 bp, Homo sapiens
agtgtgcttagtgag

SEQ ID NO: 418313 - DNA, 15 bp, Homo sapiens
gtgtgcttagtgaga

SEQ ID NO: 418314 - DNA, 15 bp, Homo sapiens
tgtgcttagtgagaa

SEQ ID NO: 418315 - DNA, 15 bp, Homo sapiens
gtgcttagtgagaaa

SEQ ID NO: 418316 - DNA, 15 bp, Homo sapiens
tgcttagtgagaaaa

SEQ ID NO: 418317 - DNA, 15 bp, Homo sapiens
gcttagtgagaaaat

SEQ ID NO: 418318 - DNA, 15 bp, Homo sapiens
cttagtgagaaaatc

SEQ ID NO: 418319 - DNA, 15 bp, Homo sapiens
ttagtgagaaaatcc

SEQ ID NO: 418320 - DNA, 15 bp, Homo sapiens
tagtgagaaaatccc

SEQ ID NO: 418321 - DNA, 15 bp, Homo sapiens
agtgagaaaatccct

SEQ ID NO: 418322 - DNA, 15 bp, Homo sapiens
gtgagaaaatccctc

SEQ ID NO: 418323 - DNA, 15 bp, Homo sapiens
tgagaaaatccctcc

SEQ ID NO: 418324 - DNA, 15 bp, Homo sapiens
gagaaaatccctccc

SEQ ID NO: 418325 - DNA, 15 bp, Homo sapiens
agaaaatccctcccc

SEQ ID NO: 418326 - DNA, 15 bp, Homo sapiens
gaaaatccctcccca

SEQ ID NO: 418327 - DNA, 15 bp, Homo sapiens
aaaatccctccccaa

SEQ ID NO: 418328 - DNA, 15 bp, Homo sapiens
aaatccctccccaag

SEQ ID NO: 418329 - DNA, 15 bp, Homo sapiens
aatccctccccaagg

SEQ ID NO: 418330 - DNA, 15 bp, Homo sapiens
atccctccccaagga

SEQ ID NO: 418331 - DNA, 15 bp, Homo sapiens
tccctccccaaggag

SEQ ID NO: 418332 - DNA, 15 bp, Homo sapiens
ccctccccaaggagt

SEQ ID NO: 418333 - DNA, 15 bp, Homo sapiens
cctccccaaggagtg

SEQ ID NO: 418334 - DNA, 15 bp, Homo sapiens
ctccccaaggagtgg

SEQ ID NO: 418335 - DNA, 15 bp, Homo sapiens
tccccaaggagtggg

SEQ ID NO: 418336 - DNA, 15 bp, Homo sapiens
ccccaaggagtggga

SEQ ID NO: 418337 - DNA, 15 bp, Homo sapiens
cccaaggagtgggag

SEQ ID NO: 418338 - DNA, 15 bp, Homo sapiens
ccaaggagtgggagg

SEQ ID NO: 418339 - DNA, 15 bp, Homo sapiens
caaggagtgggagga

SEQ ID NO: 418340 - DNA, 15 bp, Homo sapiens
aaggagtgggaggag

SEQ ID NO: 418341 - DNA, 15 bp, Homo sapiens
aggagtgggaggagt

SEQ ID NO: 418342 - DNA, 15 bp, Homo sapiens
ggagtgggaggagtg

SEQ ID NO: 418343 - DNA, 15 bp, Homo sapiens
gagtgggaggagtgt

SEQ ID NO: 418344 - DNA, 15 bp, Homo sapiens
agtgggaggagtgtt

SEQ ID NO: 418345 - DNA, 15 bp, Homo sapiens
gtgggaggagtgttc

SEQ ID NO: 418346 - DNA, 15 bp, Homo sapiens
tgggaggagtgttct

SEQ ID NO: 418347 - DNA, 15 bp, Homo sapiens
gggaggagtgttctc

SEQ ID NO: 418348 - DNA, 15 bp, Homo sapiens
ggaggagtgttctca

SEQ ID NO: 418349 - DNA, 15 bp, Homo sapiens
gaggagtgttctcat

SEQ ID NO: 418350 - DNA, 15 bp, Homo sapiens
aggagtgttctcata

SEQ ID NO: 418351 - DNA, 15 bp, Homo sapiens
ggagtgttctcataa

SEQ ID NO: 418352 - DNA, 15 bp, Homo sapiens
gagtgttctcataac

SEQ ID NO: 418353 - DNA, 15 bp, Homo sapiens
agtgttctcataaca

SEQ ID NO: 418354 - DNA, 15 bp, Homo sapiens
gtgttctcataacaa

SEQ ID NO: 418355 - DNA, 15 bp, Homo sapiens
tgttctcataacaaa

SEQ ID NO: 418356 - DNA, 15 bp, Homo sapiens
gttctcataacaaat

SEQ ID NO: 418357 - DNA, 15 bp, Homo sapiens
ttctcataacaaatc

SEQ ID NO: 418358 - DNA, 15 bp, Homo sapiens
tctcataacaaatct

SEQ ID NO: 418359 - DNA, 15 bp, Homo sapiens
ctcataacaaatctg

SEQ ID NO: 418360 - DNA, 15 bp, Homo sapiens
tcataacaaatctgt

SEQ ID NO: 418361 - DNA, 15 bp, Homo sapiens
cataacaaatctgta

SEQ ID NO: 418362 - DNA, 15 bp, Homo sapiens
ataacaaatctgtag

SEQ ID NO: 418363 - DNA, 15 bp, Homo sapiens
taacaaatctgtaga

SEQ ID NO: 418364 - DNA, 15 bp, Homo sapiens
aacaaatctgtagag

SEQ ID NO: 418365 - DNA, 15 bp, Homo sapiens
acaaatctgtagagg

SEQ ID NO: 418366 - DNA, 15 bp, Homo sapiens
caaatctgtagaggc

SEQ ID NO: 418367 - DNA, 15 bp, Homo sapiens
aaatctgtagaggca

SEQ ID NO: 418368 - DNA, 15 bp, Homo sapiens
aatctgtagaggcaa

SEQ ID NO: 418369 - DNA, 15 bp, Homo sapiens
atctgtagaggcaat

SEQ ID NO: 418370 - DNA, 15 bp, Homo sapiens
tctgtagaggcaatc

SEQ ID NO: 418371 - DNA, 15 bp, Homo sapiens
ctgtagaggcaatcc

SEQ ID NO: 418372 - DNA, 15 bp, Homo sapiens
tgtagaggcaatcca

SEQ ID NO: 418373 - DNA, 15 bp, Homo sapiens
gtagaggcaatccac

SEQ ID NO: 418374 - DNA, 15 bp, Homo sapiens
tagaggcaatccacc

SEQ ID NO: 418375 - DNA, 15 bp, Homo sapiens
agaggcaatccacct

SEQ ID NO: 418376 - DNA, 15 bp, Homo sapiens
gaggcaatccacctc

SEQ ID NO: 418377 - DNA, 15 bp, Homo sapiens
aggcaatccacctcc

SEQ ID NO: 418378 - DNA, 15 bp, Homo sapiens
ggcaatccacctccc

SEQ ID NO: 418379 - DNA, 15 bp, Homo sapiens
gcaatccacctccca

SEQ ID NO: 418380 - DNA, 15 bp, Homo sapiens
caatccacctcccag

SEQ ID NO: 418381 - DNA, 15 bp, Homo sapiens
aatccacctcccagg

SEQ ID NO: 418382 - DNA, 15 bp, Homo sapiens
atccacctcccaggc

SEQ ID NO: 418383 - DNA, 15 bp, Homo sapiens
tccacctcccaggct

SEQ ID NO: 418384 - DNA, 15 bp, Homo sapiens
ccacctcccaggctc

SEQ ID NO: 418385 - DNA, 15 bp, Homo sapiens
cacctcccaggctcc

SEQ ID NO: 418386 - DNA, 15 bp, Homo sapiens
acctcccaggctcct

SEQ ID NO: 418387 - DNA, 15 bp, Homo sapiens
cctcccaggctcctg

SEQ ID NO: 418388 - DNA, 15 bp, Homo sapiens
ctcccaggctcctgg

SEQ ID NO: 418389 - DNA, 15 bp, Homo sapiens
tcccaggctcctggc

SEQ ID NO: 418390 - DNA, 15 bp, Homo sapiens
cccaggctcctggct

SEQ ID NO: 418391 - DNA, 15 bp, Homo sapiens
ccaggctcctggctc

SEQ ID NO: 418392 - DNA, 15 bp, Homo sapiens
caggctcctggctcc

SEQ ID NO: 418393 - DNA, 15 bp, Homo sapiens
aggctcctggctcct

SEQ ID NO: 418394 - DNA, 15 bp, Homo sapiens
ggctcctggctcctt

SEQ ID NO: 418395 - DNA, 15 bp, Homo sapiens
gctcctggctccttc

SEQ ID NO: 418396 - DNA, 15 bp, Homo sapiens
ctcctggctccttca

SEQ ID NO: 418397 - DNA, 15 bp, Homo sapiens
tcctggctccttcat

SEQ ID NO: 418398 - DNA, 15 bp, Homo sapiens
cctggctccttcatt

SEQ ID NO: 418399 - DNA, 15 bp, Homo sapiens
ctggctccttcattg

SEQ ID NO: 418400 - DNA, 15 bp, Homo sapiens
tggctccttcattgc

SEQ ID NO: 418401 - DNA, 15 bp, Homo sapiens
ggctccttcattgcc

SEQ ID NO: 418402 - DNA, 15 bp, Homo sapiens
gctccttcattgcct

SEQ ID NO: 418403 - DNA, 15 bp, Homo sapiens
ctccttcattgccta

SEQ ID NO: 418404 - DNA, 15 bp, Homo sapiens
tccttcattgcctac

SEQ ID NO: 418405 - DNA, 15 bp, Homo sapiens
ccttcattgcctact

SEQ ID NO: 418406 - DNA, 15 bp, Homo sapiens
cttcattgcctactg

SEQ ID NO: 418407 - DNA, 15 bp, Homo sapiens
ttcattgcctactga

SEQ ID NO: 418408 - DNA, 15 bp, Homo sapiens
tcattgcctactgaa

SEQ ID NO: 418409 - DNA, 15 bp, Homo sapiens
cattgcctactgaaa

SEQ ID NO: 418410 - DNA, 15 bp, Homo sapiens
attgcctactgaaag

SEQ ID NO: 418411 - DNA, 15 bp, Homo sapiens
ttgcctactgaaagt

SEQ ID NO: 418412 - DNA, 15 bp, Homo sapiens
tgcctactgaaagtg

SEQ ID NO: 418413 - DNA, 15 bp, Homo sapiens
gcctactgaaagtga

SEQ ID NO: 418414 - DNA, 15 bp, Homo sapiens
cctactgaaagtgat

SEQ ID NO: 418415 - DNA, 15 bp, Homo sapiens
ctactgaaagtgatc

SEQ ID NO: 418416 - DNA, 15 bp, Homo sapiens
tactgaaagtgatca

SEQ ID NO: 418417 - DNA, 15 bp, Homo sapiens
actgaaagtgatcac

SEQ ID NO: 418418 - DNA, 15 bp, Homo sapiens
ctgaaagtgatcact

SEQ ID NO: 418419 - DNA, 15 bp, Homo sapiens
tgaaagtgatcactg

SEQ ID NO: 418420 - DNA, 15 bp, Homo sapiens
gaaagtgatcactgt

SEQ ID NO: 418421 - DNA, 15 bp, Homo sapiens
aaagtgatcactgtg

SEQ ID NO: 418422 - DNA, 15 bp, Homo sapiens
aagtgatcactgtgg

SEQ ID NO: 418423 - DNA, 15 bp, Homo sapiens
agtgatcactgtgga

SEQ ID NO: 418424 - DNA, 15 bp, Homo sapiens
gtgatcactgtggag

SEQ ID NO: 418425 - DNA, 15 bp, Homo sapiens
tgatcactgtggagc

SEQ ID NO: 418426 - DNA, 15 bp, Homo sapiens
gatcactgtggagca

SEQ ID NO: 418427 - DNA, 15 bp, Homo sapiens
atcactgtggagcac

SEQ ID NO: 418428 - DNA, 15 bp, Homo sapiens
tcactgtggagcaca

SEQ ID NO: 418429 - DNA, 15 bp, Homo sapiens
cactgtggagcacac

SEQ ID NO: 418430 - DNA, 15 bp, Homo sapiens
actgtggagcacact

SEQ ID NO: 418431 - DNA, 15 bp, Homo sapiens
ctgtggagcacactg

SEQ ID NO: 418432 - DNA, 15 bp, Homo sapiens
tgtggagcacactgt

SEQ ID NO: 418433 - DNA, 15 bp, Homo sapiens
gtggagcacactgtt

SEQ ID NO: 418434 - DNA, 15 bp, Homo sapiens
tggagcacactgttc

SEQ ID NO: 418435 - DNA, 15 bp, Homo sapiens
ggagcacactgttca

SEQ ID NO: 418436 - DNA, 15 bp, Homo sapiens
gagcacactgttcag

SEQ ID NO: 418437 - DNA, 15 bp, Homo sapiens
agcacactgttcagc

SEQ ID NO: 418438 - DNA, 15 bp, Homo sapiens
gcacactgttcagcc

SEQ ID NO: 418439 - DNA, 15 bp, Homo sapiens
cacactgttcagccc

SEQ ID NO: 418440 - DNA, 15 bp, Homo sapiens
acactgttcagccct

SEQ ID NO: 418441 - DNA, 15 bp, Homo sapiens
cactgttcagcccta

SEQ ID NO: 418442 - DNA, 15 bp, Homo sapiens
actgttcagccctac

SEQ ID NO: 418443 - DNA, 15 bp, Homo sapiens
ctgttcagccctact

SEQ ID NO: 418444 - DNA, 15 bp, Homo sapiens
tgttcagccctactt

SEQ ID NO: 418445 - DNA, 15 bp, Homo sapiens
gttcagccctacttc

SEQ ID NO: 418446 - DNA, 15 bp, Homo sapiens
ttcagccctacttct

SEQ ID NO: 418447 - DNA, 15 bp, Homo sapiens
tcagccctacttctc

SEQ ID NO: 418448 - DNA, 15 bp, Homo sapiens
cagccctacttctct

SEQ ID NO: 418449 - DNA, 15 bp, Homo sapiens
agccctacttctctg

SEQ ID NO: 418450 - DNA, 15 bp, Homo sapiens
gccctacttctctgt

SEQ ID NO: 418451 - DNA, 15 bp, Homo sapiens
ccctacttctctgtt

SEQ ID NO: 418452 - DNA, 15 bp, Homo sapiens
cctacttctctgttc

SEQ ID NO: 418453 - DNA, 15 bp, Homo sapiens
ctacttctctgttct

SEQ ID NO: 418454 - DNA, 15 bp, Homo sapiens
tacttctctgttctt

SEQ ID NO: 418455 - DNA, 15 bp, Homo sapiens
acttctctgttcttt

SEQ ID NO: 418456 - DNA, 15 bp, Homo sapiens
cttctctgttctttc

SEQ ID NO: 418457 - DNA, 15 bp, Homo sapiens
ttctctgttctttcc

SEQ ID NO: 418458 - DNA, 15 bp, Homo sapiens
tctctgttctttcct

SEQ ID NO: 418459 - DNA, 15 bp, Homo sapiens
ctctgttctttcctc

SEQ ID NO: 418460 - DNA, 15 bp, Homo sapiens
tctgttctttcctct

SEQ ID NO: 418461 - DNA, 15 bp, Homo sapiens
ctgttctttcctctc

SEQ ID NO: 418462 - DNA, 15 bp, Homo sapiens
tgttctttcctctca

SEQ ID NO: 418463 - DNA, 15 bp, Homo sapiens
gttctttcctctcat

SEQ ID NO: 418464 - DNA, 15 bp, Homo sapiens
ttctttcctctcatt

SEQ ID NO: 418465 - DNA, 15 bp, Homo sapiens
tctttcctctcattc

SEQ ID NO: 418466 - DNA, 15 bp, Homo sapiens
ctttcctctcattcc

SEQ ID NO: 418467 - DNA, 15 bp, Homo sapiens
tttcctctcattcct

SEQ ID NO: 418468 - DNA, 15 bp, Homo sapiens
ttcctctcattcctt

SEQ ID NO: 418469 - DNA, 15 bp, Homo sapiens
tcctctcattccttt

SEQ ID NO: 418470 - DNA, 15 bp, Homo sapiens
cctctcattcctttc

SEQ ID NO: 418471 - DNA, 15 bp, Homo sapiens
ctctcattcctttca

SEQ ID NO: 418472 - DNA, 15 bp, Homo sapiens
tctcattcctttcat

SEQ ID NO: 418473 - DNA, 15 bp, Homo sapiens
ctcattcctttcatg

SEQ ID NO: 418474 - DNA, 15 bp, Homo sapiens
tcattcctttcatgc

SEQ ID NO: 418475 - DNA, 15 bp, Homo sapiens
cattcctttcatgca

SEQ ID NO: 418476 - DNA, 15 bp, Homo sapiens
attcctttcatgcac

SEQ ID NO: 418477 - DNA, 15 bp, Homo sapiens
ttcctttcatgcaca

SEQ ID NO: 418478 - DNA, 15 bp, Homo sapiens
tcctttcatgcacaa

SEQ ID NO: 418479 - DNA, 15 bp, Homo sapiens
cctttcatgcacaat

SEQ ID NO: 418480 - DNA, 15 bp, Homo sapiens
ctttcatgcacaatc

SEQ ID NO: 418481 - DNA, 15 bp, Homo sapiens
tttcatgcacaatct

SEQ ID NO: 418482 - DNA, 15 bp, Homo sapiens
ttcatgcacaatctg

SEQ ID NO: 418483 - DNA, 15 bp, Homo sapiens
tcatgcacaatctgc

SEQ ID NO: 418484 - DNA, 15 bp, Homo sapiens
catgcacaatctgct

SEQ ID NO: 418485 - DNA, 15 bp, Homo sapiens
atgcacaatctgctc

SEQ ID NO: 418486 - DNA, 15 bp, Homo sapiens
tgcacaatctgctcc

SEQ ID NO: 418487 - DNA, 15 bp, Homo sapiens
gcacaatctgctcct

SEQ ID NO: 418488 - DNA, 15 bp, Homo sapiens
cacaatctgctcctt

SEQ ID NO: 418489 - DNA, 15 bp, Homo sapiens
acaatctgctcctta

SEQ ID NO: 418490 - DNA, 15 bp, Homo sapiens
caatctgctccttat

SEQ ID NO: 418491 - DNA, 15 bp, Homo sapiens
aatctgctccttata

SEQ ID NO: 418492 - DNA, 15 bp, Homo sapiens
atctgctccttatac

SEQ ID NO: 418493 - DNA, 15 bp, Homo sapiens
tctgctccttatact

SEQ ID NO: 418494 - DNA, 15 bp, Homo sapiens
ctgctccttatactg

SEQ ID NO: 418495 - DNA, 15 bp, Homo sapiens
tgctccttatactgc

SEQ ID NO: 418496 - DNA, 15 bp, Homo sapiens
gctccttatactgcc

SEQ ID NO: 418497 - DNA, 15 bp, Homo sapiens
ctccttatactgcct

SEQ ID NO: 418498 - DNA, 15 bp, Homo sapiens
tccttatactgcctt

SEQ ID NO: 418499 - DNA, 15 bp, Homo sapiens
ccttatactgccttc

SEQ ID NO: 418500 - DNA, 15 bp, Homo sapiens
cttatactgccttct

SEQ ID NO: 418501 - DNA, 15 bp, Homo sapiens
ttatactgccttcta

SEQ ID NO: 418502 - DNA, 15 bp, Homo sapiens
tatactgccttctat

SEQ ID NO: 418503 - DNA, 15 bp, Homo sapiens
atactgccttctatt

SEQ ID NO: 418504 - DNA, 15 bp, Homo sapiens
tactgccttctattg

SEQ ID NO: 418505 - DNA, 15 bp, Homo sapiens
actgccttctattgt

SEQ ID NO: 418506 - DNA, 15 bp, Homo sapiens
ctgccttctattgtg

SEQ ID NO: 418507 - DNA, 15 bp, Homo sapiens
tgccttctattgtga

SEQ ID NO: 418508 - DNA, 15 bp, Homo sapiens
gccttctattgtgaa

SEQ ID NO: 418509 - DNA, 15 bp, Homo sapiens
ccttctattgtgaac

SEQ ID NO: 418510 - DNA, 15 bp, Homo sapiens
cttctattgtgaaca

SEQ ID NO: 418511 - DNA, 15 bp, Homo sapiens
ttctattgtgaacac

SEQ ID NO: 418512 - DNA, 15 bp, Homo sapiens
tctattgtgaacaca

SEQ ID NO: 418513 - DNA, 15 bp, Homo sapiens
ctattgtgaacacat

SEQ ID NO: 418514 - DNA, 15 bp, Homo sapiens
tattgtgaacacatt

SEQ ID NO: 418515 - DNA, 15 bp, Homo sapiens
attgtgaacacattc

SEQ ID NO: 418516 - DNA, 15 bp, Homo sapiens
ttgtgaacacattct

SEQ ID NO: 418517 - DNA, 15 bp, Homo sapiens
tgtgaacacattctc

SEQ ID NO: 418518 - DNA, 15 bp, Homo sapiens
gtgaacacattctcc

SEQ ID NO: 418519 - DNA, 15 bp, Homo sapiens
tgaacacattctcct

SEQ ID NO: 418520 - DNA, 15 bp, Homo sapiens
gaacacattctccta

SEQ ID NO: 418521 - DNA, 15 bp, Homo sapiens
aacacattctcctat

SEQ ID NO: 418522 - DNA, 15 bp, Homo sapiens
acacattctcctatg

SEQ ID NO: 418523 - DNA, 15 bp, Homo sapiens
cacattctcctatgt

SEQ ID NO: 418524 - DNA, 15 bp, Homo sapiens
acattctcctatgtc

SEQ ID NO: 418525 - DNA, 15 bp, Homo sapiens
cattctcctatgtct

SEQ ID NO: 418526 - DNA, 15 bp, Homo sapiens
attctcctatgtctc

SEQ ID NO: 418527 - DNA, 15 bp, Homo sapiens
ttctcctatgtctca

SEQ ID NO: 418528 - DNA, 15 bp, Homo sapiens
tctcctatgtctcaa

SEQ ID NO: 418529 - DNA, 15 bp, Homo sapiens
ctcctatgtctcaaa

SEQ ID NO: 418530 - DNA, 15 bp, Homo sapiens
tcctatgtctcaaat

SEQ ID NO: 418531 - DNA, 15 bp, Homo sapiens
cctatgtctcaaata

SEQ ID NO: 418532 - DNA, 15 bp, Homo sapiens
ctatgtctcaaatat

SEQ ID NO: 418533 - DNA, 15 bp, Homo sapiens
tatgtctcaaatatt

SEQ ID NO: 418534 - DNA, 15 bp, Homo sapiens
atgtctcaaatattt

SEQ ID NO: 418535 - DNA, 15 bp, Homo sapiens
tgtctcaaatatttc

SEQ ID NO: 418536 - DNA, 15 bp, Homo sapiens
gtctcaaatatttct

SEQ ID NO: 418537 - DNA, 15 bp, Homo sapiens
tctcaaatatttctc

SEQ ID NO: 418538 - DNA, 15 bp, Homo sapiens
ctcaaatatttctcg

SEQ ID NO: 418539 - DNA, 15 bp, Homo sapiens
tcaaatatttctcga

SEQ ID NO: 418540 - DNA, 15 bp, Homo sapiens
caaatatttctcgaa

SEQ ID NO: 418541 - DNA, 15 bp, Homo sapiens
aaatatttctcgaaa

SEQ ID NO: 418542 - DNA, 15 bp, Homo sapiens
aatatttctcgaaac

SEQ ID NO: 418543 - DNA, 15 bp, Homo sapiens
atatttctcgaaact

SEQ ID NO: 418544 - DNA, 15 bp, Homo sapiens
tatttctcgaaactt

SEQ ID NO: 418545 - DNA, 15 bp, Homo sapiens
atttctcgaaacttt

SEQ ID NO: 418546 - DNA, 15 bp, Homo sapiens
tttctcgaaactttt

SEQ ID NO: 418547 - DNA, 15 bp, Homo sapiens
ttctcgaaacttttc

SEQ ID NO: 418548 - DNA, 15 bp, Homo sapiens
tctcgaaacttttcc

SEQ ID NO: 418549 - DNA, 15 bp, Homo sapiens
ctcgaaacttttcca

SEQ ID NO: 418550 - DNA, 15 bp, Homo sapiens
tcgaaacttttccat

SEQ ID NO: 418551 - DNA, 15 bp, Homo sapiens
cgaaacttttccatc

SEQ ID NO: 418552 - DNA, 15 bp, Homo sapiens
gaaacttttccatca

SEQ ID NO: 418553 - DNA, 15 bp, Homo sapiens
aaacttttccatcac

SEQ ID NO: 418554 - DNA, 15 bp, Homo sapiens
aacttttccatcact

SEQ ID NO: 418555 - DNA, 15 bp, Homo sapiens
acttttccatcactt

SEQ ID NO: 418556 - DNA, 15 bp, Homo sapiens
cttttccatcacttt

SEQ ID NO: 418557 - DNA, 15 bp, Homo sapiens
ttttccatcactttt

SEQ ID NO: 418558 - DNA, 15 bp, Homo sapiens
tttccatcacttttc

SEQ ID NO: 418559 - DNA, 15 bp, Homo sapiens
ttccatcacttttct

SEQ ID NO: 418560 - DNA, 15 bp, Homo sapiens
tccatcacttttctc

SEQ ID NO: 418561 - DNA, 15 bp, Homo sapiens
ccatcacttttctct

SEQ ID NO: 418562 - DNA, 15 bp, Homo sapiens
catcacttttctctc

SEQ ID NO: 418563 - DNA, 15 bp, Homo sapiens
atcacttttctctct

SEQ ID NO: 418564 - DNA, 15 bp, Homo sapiens
tcacttttctctcta

SEQ ID NO: 418565 - DNA, 15 bp, Homo sapiens
cacttttctctctaa

SEQ ID NO: 418566 - DNA, 15 bp, Homo sapiens
acttttctctctaaa

SEQ ID NO: 418567 - DNA, 15 bp, Homo sapiens
cttttctctctaaat

SEQ ID NO: 418568 - DNA, 15 bp, Homo sapiens
ttttctctctaaatg

SEQ ID NO: 418569 - DNA, 15 bp, Homo sapiens
tttctctctaaatgt

SEQ ID NO: 418570 - DNA, 15 bp, Homo sapiens
ttctctctaaatgtt

SEQ ID NO: 418571 - DNA, 15 bp, Homo sapiens
tctctctaaatgttg

SEQ ID NO: 418572 - DNA, 15 bp, Homo sapiens
ctctctaaatgttgg

SEQ ID NO: 418573 - DNA, 15 bp, Homo sapiens
tctctaaatgttggg

SEQ ID NO: 418574 - DNA, 15 bp, Homo sapiens
ctctaaatgttgggt

SEQ ID NO: 418575 - DNA, 15 bp, Homo sapiens
tctaaatgttgggtt

SEQ ID NO: 418576 - DNA, 15 bp, Homo sapiens
ctaaatgttgggttt

SEQ ID NO: 418577 - DNA, 15 bp, Homo sapiens
taaatgttgggtttc

SEQ ID NO: 418578 - DNA, 15 bp, Homo sapiens
aaatgttgggtttcc

SEQ ID NO: 418579 - DNA, 15 bp, Homo sapiens
aatgttgggtttccc

SEQ ID NO: 418580 - DNA, 15 bp, Homo sapiens
atgttgggtttcccc

SEQ ID NO: 418581 - DNA, 15 bp, Homo sapiens
tgttgggtttcccct

SEQ ID NO: 418582 - DNA, 15 bp, Homo sapiens
gttgggtttcccctt

SEQ ID NO: 418583 - DNA, 15 bp, Homo sapiens
ttgggtttcccctta

SEQ ID NO: 418584 - DNA, 15 bp, Homo sapiens
tgggtttccccttaa

SEQ ID NO: 418585 - DNA, 15 bp, Homo sapiens
gggtttccccttaat

SEQ ID NO: 418586 - DNA, 15 bp, Homo sapiens
ggtttccccttaatt

SEQ ID NO: 418587 - DNA, 15 bp, Homo sapiens
gtttccccttaattg

SEQ ID NO: 418588 - DNA, 15 bp, Homo sapiens
tttccccttaattgc

SEQ ID NO: 418589 - DNA, 15 bp, Homo sapiens
ttccccttaattgcc

SEQ ID NO: 418590 - DNA, 15 bp, Homo sapiens
tccccttaattgcct

SEQ ID NO: 418591 - DNA, 15 bp, Homo sapiens
ccccttaattgccta

SEQ ID NO: 418592 - DNA, 15 bp, Homo sapiens
cccttaattgcctac

SEQ ID NO: 418593 - DNA, 15 bp, Homo sapiens
ccttaattgcctact

SEQ ID NO: 418594 - DNA, 15 bp, Homo sapiens
cttaattgcctactt

SEQ ID NO: 418595 - DNA, 15 bp, Homo sapiens
ttaattgcctacttc

SEQ ID NO: 418596 - DNA, 15 bp, Homo sapiens
taattgcctacttcg

SEQ ID NO: 418597 - DNA, 15 bp, Homo sapiens
aattgcctacttcgc

SEQ ID NO: 418598 - DNA, 15 bp, Homo sapiens
attgcctacttcgct

SEQ ID NO: 418599 - DNA, 15 bp, Homo sapiens
ttgcctacttcgctt

SEQ ID NO: 418600 - DNA, 15 bp, Homo sapiens
tgcctacttcgcttg

SEQ ID NO: 418601 - DNA, 15 bp, Homo sapiens
gcctacttcgcttga

SEQ ID NO: 418602 - DNA, 15 bp, Homo sapiens
cctacttcgcttgaa

SEQ ID NO: 418603 - DNA, 15 bp, Homo sapiens
ctacttcgcttgaaa

SEQ ID NO: 418604 - DNA, 15 bp, Homo sapiens
tacttcgcttgaaac

SEQ ID NO: 418605 - DNA, 15 bp, Homo sapiens
acttcgcttgaaact

SEQ ID NO: 418606 - DNA, 15 bp, Homo sapiens
cttcgcttgaaactc

SEQ ID NO: 418607 - DNA, 15 bp, Homo sapiens
ttcgcttgaaactct

SEQ ID NO: 418608 - DNA, 15 bp, Homo sapiens
tcgcttgaaactctt

SEQ ID NO: 418609 - DNA, 15 bp, Homo sapiens
cgcttgaaactcttt

SEQ ID NO: 418610 - DNA, 15 bp, Homo sapiens
gcttgaaactctttt

SEQ ID NO: 418611 - DNA, 15 bp, Homo sapiens
cttgaaactcttttc

SEQ ID NO: 418612 - DNA, 15 bp, Homo sapiens
ttgaaactcttttca

SEQ ID NO: 418613 - DNA, 15 bp, Homo sapiens
tgaaactcttttcaa

SEQ ID NO: 418614 - DNA, 15 bp, Homo sapiens
gaaactcttttcaat

SEQ ID NO: 418615 - DNA, 15 bp, Homo sapiens
aaactcttttcaata

SEQ ID NO: 418616 - DNA, 15 bp, Homo sapiens
aactcttttcaatag

SEQ ID NO: 418617 - DNA, 15 bp, Homo sapiens
actcttttcaataga

SEQ ID NO: 418618 - DNA, 15 bp, Homo sapiens
ctcttttcaatagag

SEQ ID NO: 418619 - DNA, 15 bp, Homo sapiens
tcttttcaatagagg

SEQ ID NO: 418620 - DNA, 15 bp, Homo sapiens
cttttcaatagaggt

SEQ ID NO: 418621 - DNA, 15 bp, Homo sapiens
ttttcaatagaggtt

SEQ ID NO: 418622 - DNA, 15 bp, Homo sapiens
tttcaatagaggtta

SEQ ID NO: 418623 - DNA, 15 bp, Homo sapiens
ttcaatagaggttaa

SEQ ID NO: 418624 - DNA, 15 bp, Homo sapiens
tcaatagaggttaat

SEQ ID NO: 418625 - DNA, 15 bp, Homo sapiens
caatagaggttaatt

SEQ ID NO: 418626 - DNA, 15 bp, Homo sapiens
aatagaggttaattt

SEQ ID NO: 418627 - DNA, 15 bp, Homo sapiens
atagaggttaatttc

SEQ ID NO: 418628 - DNA, 15 bp, Homo sapiens
tagaggttaatttcc

SEQ ID NO: 418629 - DNA, 15 bp, Homo sapiens
agaggttaatttcct

SEQ ID NO: 418630 - DNA, 15 bp, Homo sapiens
gaggttaatttcctc

SEQ ID NO: 418631 - DNA, 15 bp, Homo sapiens
aggttaatttcctca

SEQ ID NO: 418632 - DNA, 15 bp, Homo sapiens
ggttaatttcctcat

SEQ ID NO: 418633 - DNA, 15 bp, Homo sapiens
gttaatttcctcatt

SEQ ID NO: 418634 - DNA, 15 bp, Homo sapiens
ttaatttcctcattt

SEQ ID NO: 418635 - DNA, 15 bp, Homo sapiens
taatttcctcatttt

SEQ ID NO: 418636 - DNA, 15 bp, Homo sapiens
aatttcctcattttc

SEQ ID NO: 418637 - DNA, 15 bp, Homo sapiens
atttcctcattttcc

SEQ ID NO: 418638 - DNA, 15 bp, Homo sapiens
tttcctcattttcct

SEQ ID NO: 418639 - DNA, 15 bp, Homo sapiens
ttcctcattttcctc

SEQ ID NO: 418640 - DNA, 15 bp, Homo sapiens
tcctcattttcctca

SEQ ID NO: 418641 - DNA, 15 bp, Homo sapiens
cctcattttcctcac

SEQ ID NO: 418642 - DNA, 15 bp, Homo sapiens
ctcattttcctcacc

SEQ ID NO: 418643 - DNA, 15 bp, Homo sapiens
tcattttcctcacct

SEQ ID NO: 418644 - DNA, 15 bp, Homo sapiens
cattttcctcaccta

SEQ ID NO: 418645 - DNA, 15 bp, Homo sapiens
attttcctcacctag

SEQ ID NO: 418646 - DNA, 15 bp, Homo sapiens
ttttcctcacctagc

SEQ ID NO: 418647 - DNA, 15 bp, Homo sapiens
tttcctcacctagca

SEQ ID NO: 418648 - DNA, 15 bp, Homo sapiens
ttcctcacctagcag

SEQ ID NO: 418649 - DNA, 15 bp, Homo sapiens
tcctcacctagcagc

SEQ ID NO: 418650 - DNA, 15 bp, Homo sapiens
cctcacctagcagcc

SEQ ID NO: 418651 - DNA, 15 bp, Homo sapiens
ctcacctagcagcca

SEQ ID NO: 418652 - DNA, 15 bp, Homo sapiens
tcacctagcagccaa

SEQ ID NO: 418653 - DNA, 15 bp, Homo sapiens
cacctagcagccaat

SEQ ID NO: 418654 - DNA, 15 bp, Homo sapiens
acctagcagccaatg

SEQ ID NO: 418655 - DNA, 15 bp, Homo sapiens
cctagcagccaatga

SEQ ID NO: 418656 - DNA, 15 bp, Homo sapiens
ctagcagccaatgag

SEQ ID NO: 418657 - DNA, 15 bp, Homo sapiens
tagcagccaatgaga

SEQ ID NO: 418658 - DNA, 15 bp, Homo sapiens
agcagccaatgagaa

SEQ ID NO: 418659 - DNA, 15 bp, Homo sapiens
gcagccaatgagaat

SEQ ID NO: 418660 - DNA, 15 bp, Homo sapiens
cagccaatgagaata

SEQ ID NO: 418661 - DNA, 15 bp, Homo sapiens
agccaatgagaatat

SEQ ID NO: 418662 - DNA, 15 bp, Homo sapiens
gccaatgagaatatt

SEQ ID NO: 418663 - DNA, 15 bp, Homo sapiens
ccaatgagaatattc

SEQ ID NO: 418664 - DNA, 15 bp, Homo sapiens
caatgagaatattct

SEQ ID NO: 418665 - DNA, 15 bp, Homo sapiens
aatgagaatattctg

SEQ ID NO: 418666 - DNA, 15 bp, Homo sapiens
atgagaatattctga

SEQ ID NO: 418667 - DNA, 15 bp, Homo sapiens
tgagaatattctgaa

SEQ ID NO: 418668 - DNA, 15 bp, Homo sapiens
gagaatattctgaat

SEQ ID NO: 418669 - DNA, 15 bp, Homo sapiens
agaatattctgaatc

SEQ ID NO: 418670 - DNA, 15 bp, Homo sapiens
gaatattctgaatct

SEQ ID NO: 418671 - DNA, 15 bp, Homo sapiens
aatattctgaatctc

SEQ ID NO: 418672 - DNA, 15 bp, Homo sapiens
atattctgaatctct

SEQ ID NO: 418673 - DNA, 15 bp, Homo sapiens
tattctgaatctcta

SEQ ID NO: 418674 - DNA, 15 bp, Homo sapiens
attctgaatctctac

SEQ ID NO: 418675 - DNA, 15 bp, Homo sapiens
ttctgaatctctacc

SEQ ID NO: 418676 - DNA, 15 bp, Homo sapiens
tctgaatctctacca

SEQ ID NO: 418677 - DNA, 15 bp, Homo sapiens
ctgaatctctaccaa

SEQ ID NO: 418678 - DNA, 15 bp, Homo sapiens
tgaatctctaccaac

SEQ ID NO: 418679 - DNA, 15 bp, Homo sapiens
gaatctctaccaact

SEQ ID NO: 418680 - DNA, 15 bp, Homo sapiens
aatctctaccaactg

SEQ ID NO: 418681 - DNA, 15 bp, Homo sapiens
atctctaccaactgc

SEQ ID NO: 418682 - DNA, 15 bp, Homo sapiens
tctctaccaactgct

SEQ ID NO: 418683 - DNA, 15 bp, Homo sapiens
ctctaccaactgcta

SEQ ID NO: 418684 - DNA, 15 bp, Homo sapiens
tctaccaactgctat

SEQ ID NO: 418685 - DNA, 15 bp, Homo sapiens
ctaccaactgctatg

SEQ ID NO: 418686 - DNA, 15 bp, Homo sapiens
taccaactgctatgg

SEQ ID NO: 418687 - DNA, 15 bp, Homo sapiens
accaactgctatgga

SEQ ID NO: 418688 - DNA, 15 bp, Homo sapiens
ccaactgctatggac

SEQ ID NO: 418689 - DNA, 15 bp, Homo sapiens
caactgctatggaca

SEQ ID NO: 418690 - DNA, 15 bp, Homo sapiens
aactgctatggacac

SEQ ID NO: 418691 - DNA, 15 bp, Homo sapiens
actgctatggacacc

SEQ ID NO: 418692 - DNA, 15 bp, Homo sapiens
ctgctatggacacca

SEQ ID NO: 418693 - DNA, 15 bp, Homo sapiens
tgctatggacaccaa

SEQ ID NO: 418694 - DNA, 15 bp, Homo sapiens
gctatggacaccaaa

SEQ ID NO: 418695 - DNA, 15 bp, Homo sapiens
ctatggacaccaaac

SEQ ID NO: 418696 - DNA, 15 bp, Homo sapiens
tatggacaccaaacg

SEQ ID NO: 418697 - DNA, 15 bp, Homo sapiens
atggacaccaaacgg

SEQ ID NO: 418698 - DNA, 15 bp, Homo sapiens
tggacaccaaacggc

SEQ ID NO: 418699 - DNA, 15 bp, Homo sapiens
ggacaccaaacggcc

SEQ ID NO: 418700 - DNA, 15 bp, Homo sapiens
gacaccaaacggcct

SEQ ID NO: 418701 - DNA, 15 bp, Homo sapiens
acaccaaacggcctg

SEQ ID NO: 418702 - DNA, 15 bp, Homo sapiens
caccaaacggcctga

SEQ ID NO: 418703 - DNA, 15 bp, Homo sapiens
accaaacggcctgaa

SEQ ID NO: 418704 - DNA, 15 bp, Homo sapiens
ccaaacggcctgaat

SEQ ID NO: 418705 - DNA, 15 bp, Homo sapiens
caaacggcctgaata

SEQ ID NO: 418706 - DNA, 15 bp, Homo sapiens
aaacggcctgaatac

SEQ ID NO: 418707 - DNA, 15 bp, Homo sapiens
aacggcctgaatacc

SEQ ID NO: 418708 - DNA, 15 bp, Homo sapiens
acggcctgaatacca

SEQ ID NO: 418709 - DNA, 15 bp, Homo sapiens
cggcctgaataccag

SEQ ID NO: 418710 - DNA, 15 bp, Homo sapiens
ggcctgaataccagc

SEQ ID NO: 418711 - DNA, 15 bp, Homo sapiens
gcctgaataccagcc

SEQ ID NO: 418712 - DNA, 15 bp, Homo sapiens
cctgaataccagcca

SEQ ID NO: 418713 - DNA, 15 bp, Homo sapiens
ctgaataccagccat

SEQ ID NO: 418714 - DNA, 15 bp, Homo sapiens
tgaataccagccata

SEQ ID NO: 418715 - DNA, 15 bp, Homo sapiens
gaataccagccataa

SEQ ID NO: 418716 - DNA, 15 bp, Homo sapiens
aataccagccataaa

SEQ ID NO: 418717 - DNA, 15 bp, Homo sapiens
ataccagccataaac

SEQ ID NO: 418718 - DNA, 15 bp, Homo sapiens
taccagccataaaca

SEQ ID NO: 418719 - DNA, 15 bp, Homo sapiens
accagccataaacat

SEQ ID NO: 418720 - DNA, 15 bp, Homo sapiens
ccagccataaacatc

SEQ ID NO: 418721 - DNA, 15 bp, Homo sapiens
cagccataaacatca

SEQ ID NO: 418722 - DNA, 15 bp, Homo sapiens
agccataaacatcaa

SEQ ID NO: 418723 - DNA, 15 bp, Homo sapiens
gccataaacatcaaa

SEQ ID NO: 418724 - DNA, 15 bp, Homo sapiens
ccataaacatcaaat

SEQ ID NO: 418725 - DNA, 15 bp, Homo sapiens
cataaacatcaaatg

SEQ ID NO: 418726 - DNA, 15 bp, Homo sapiens
ataaacatcaaatgt

SEQ ID NO: 418727 - DNA, 15 bp, Homo sapiens
taaacatcaaatgtg

SEQ ID NO: 418728 - DNA, 15 bp, Homo sapiens
aaacatcaaatgtgg

SEQ ID NO: 418729 - DNA, 15 bp, Homo sapiens
aacatcaaatgtggt

SEQ ID NO: 418730 - DNA, 15 bp, Homo sapiens
acatcaaatgtggtg

SEQ ID NO: 418731 - DNA, 15 bp, Homo sapiens
catcaaatgtggtgc

SEQ ID NO: 418732 - DNA, 15 bp, Homo sapiens
atcaaatgtggtgcc

SEQ ID NO: 418733 - DNA, 15 bp, Homo sapiens
tcaaatgtggtgcca

SEQ ID NO: 418734 - DNA, 15 bp, Homo sapiens
caaatgtggtgccag

SEQ ID NO: 418735 - DNA, 15 bp, Homo sapiens
aaatgtggtgccaga

SEQ ID NO: 418736 - DNA, 15 bp, Homo sapiens
aatgtggtgccagaa

SEQ ID NO: 418737 - DNA, 15 bp, Homo sapiens
atgtggtgccagaaa

SEQ ID NO: 418738 - DNA, 15 bp, Homo sapiens
tgtggtgccagaaaa

SEQ ID NO: 418739 - DNA, 15 bp, Homo sapiens
gtggtgccagaaaac

SEQ ID NO: 418740 - DNA, 15 bp, Homo sapiens
tggtgccagaaaaca

SEQ ID NO: 418741 - DNA, 15 bp, Homo sapiens
ggtgccagaaaacac

SEQ ID NO: 418742 - DNA, 15 bp, Homo sapiens
gtgccagaaaacact

SEQ ID NO: 418743 - DNA, 15 bp, Homo sapiens
tgccagaaaacactg

SEQ ID NO: 418744 - DNA, 15 bp, Homo sapiens
gccagaaaacactgg

SEQ ID NO: 418745 - DNA, 15 bp, Homo sapiens
ccagaaaacactggc

SEQ ID NO: 418746 - DNA, 15 bp, Homo sapiens
cagaaaacactggct

SEQ ID NO: 418747 - DNA, 15 bp, Homo sapiens
agaaaacactggctg

SEQ ID NO: 418748 - DNA, 15 bp, Homo sapiens
gaaaacactggctga

SEQ ID NO: 418749 - DNA, 15 bp, Homo sapiens
aaaacactggctgaa

SEQ ID NO: 418750 - DNA, 15 bp, Homo sapiens
aaacactggctgaaa

SEQ ID NO: 418751 - DNA, 15 bp, Homo sapiens
aacactggctgaaaa

SEQ ID NO: 418752 - DNA, 15 bp, Homo sapiens
acactggctgaaaag

SEQ ID NO: 418753 - DNA, 15 bp, Homo sapiens
cactggctgaaaagg

SEQ ID NO: 418754 - DNA, 15 bp, Homo sapiens
actggctgaaaaggg

SEQ ID NO: 418755 - DNA, 15 bp, Homo sapiens
ctggctgaaaaggga

SEQ ID NO: 418756 - DNA, 15 bp, Homo sapiens
tggctgaaaagggag

SEQ ID NO: 418757 - DNA, 15 bp, Homo sapiens
ggctgaaaagggagc

SEQ ID NO: 418758 - DNA, 15 bp, Homo sapiens
gctgaaaagggagcc

SEQ ID NO: 418759 - DNA, 15 bp, Homo sapiens
ctgaaaagggagccc

SEQ ID NO: 418760 - DNA, 15 bp, Homo sapiens
tgaaaagggagccct

SEQ ID NO: 418761 - DNA, 15 bp, Homo sapiens
gaaaagggagccctg

SEQ ID NO: 418762 - DNA, 15 bp, Homo sapiens
aaaagggagccctgt

SEQ ID NO: 418763 - DNA, 15 bp, Homo sapiens
aaagggagccctgtc

SEQ ID NO: 418764 - DNA, 15 bp, Homo sapiens
aagggagccctgtca

SEQ ID NO: 418765 - DNA, 15 bp, Homo sapiens
agggagccctgtcac

SEQ ID NO: 418766 - DNA, 15 bp, Homo sapiens
gggagccctgtcaca

SEQ ID NO: 418767 - DNA, 15 bp, Homo sapiens
ggagccctgtcacac

SEQ ID NO: 418768 - DNA, 15 bp, Homo sapiens
gagccctgtcacaca

SEQ ID NO: 418769 - DNA, 15 bp, Homo sapiens
agccctgtcacacag

SEQ ID NO: 418770 - DNA, 15 bp, Homo sapiens
gccctgtcacacagg

SEQ ID NO: 418771 - DNA, 15 bp, Homo sapiens
ccctgtcacacaggg

SEQ ID NO: 418772 - DNA, 15 bp, Homo sapiens
cctgtcacacaggga

SEQ ID NO: 418773 - DNA, 15 bp, Homo sapiens
ctgtcacacagggat

SEQ ID NO: 418774 - DNA, 15 bp, Homo sapiens
tgtcacacagggata

SEQ ID NO: 418775 - DNA, 15 bp, Homo sapiens
gtcacacagggataa

SEQ ID NO: 418776 - DNA, 15 bp, Homo sapiens
tcacacagggataag

SEQ ID NO: 418777 - DNA, 15 bp, Homo sapiens
cacacagggataaga

SEQ ID NO: 418778 - DNA, 15 bp, Homo sapiens
acacagggataagag

SEQ ID NO: 418779 - DNA, 15 bp, Homo sapiens
cacagggataagagg

SEQ ID NO: 418780 - DNA, 15 bp, Homo sapiens
acagggataagaggg

SEQ ID NO: 418781 - DNA, 15 bp, Homo sapiens
cagggataagaggga

SEQ ID NO: 418782 - DNA, 15 bp, Homo sapiens
agggataagagggac

SEQ ID NO: 418783 - DNA, 15 bp, Homo sapiens
gggataagagggaca

SEQ ID NO: 418784 - DNA, 15 bp, Homo sapiens
ggataagagggacaa

SEQ ID NO: 418785 - DNA, 15 bp, Homo sapiens
gataagagggacaat

SEQ ID NO: 418786 - DNA, 15 bp, Homo sapiens
ataagagggacaatt

SEQ ID NO: 418787 - DNA, 15 bp, Homo sapiens
taagagggacaattg

SEQ ID NO: 418788 - DNA, 15 bp, Homo sapiens
aagagggacaattgc

SEQ ID NO: 418789 - DNA, 15 bp, Homo sapiens
agagggacaattgcc

SEQ ID NO: 418790 - DNA, 15 bp, Homo sapiens
gagggacaattgcca

SEQ ID NO: 418791 - DNA, 15 bp, Homo sapiens
agggacaattgccag

SEQ ID NO: 418792 - DNA, 15 bp, Homo sapiens
gggacaattgccagc

SEQ ID NO: 418793 - DNA, 15 bp, Homo sapiens
ggacaattgccagcc

SEQ ID NO: 418794 - DNA, 15 bp, Homo sapiens
gacaattgccagcct

SEQ ID NO: 418795 - DNA, 15 bp, Homo sapiens
acaattgccagcctc

SEQ ID NO: 418796 - DNA, 15 bp, Homo sapiens
caattgccagcctca

SEQ ID NO: 418797 - DNA, 15 bp, Homo sapiens
aattgccagcctcat

SEQ ID NO: 418798 - DNA, 15 bp, Homo sapiens
attgccagcctcatt

SEQ ID NO: 418799 - DNA, 15 bp, Homo sapiens
ttgccagcctcattg

SEQ ID NO: 418800 - DNA, 15 bp, Homo sapiens
tgccagcctcattgt

SEQ ID NO: 418801 - DNA, 15 bp, Homo sapiens
gccagcctcattgtg

SEQ ID NO: 418802 - DNA, 15 bp, Homo sapiens
ccagcctcattgtga

SEQ ID NO: 418803 - DNA, 15 bp, Homo sapiens
cagcctcattgtgac

SEQ ID NO: 418804 - DNA, 15 bp, Homo sapiens
agcctcattgtgact

SEQ ID NO: 418805 - DNA, 15 bp, Homo sapiens
gcctcattgtgactc

SEQ ID NO: 418806 - DNA, 15 bp, Homo sapiens
cctcattgtgactca

SEQ ID NO: 418807 - DNA, 15 bp, Homo sapiens
ctcattgtgactcat

SEQ ID NO: 418808 - DNA, 15 bp, Homo sapiens
tcattgtgactcatt

SEQ ID NO: 418809 - DNA, 15 bp, Homo sapiens
cattgtgactcatta

SEQ ID NO: 418810 - DNA, 15 bp, Homo sapiens
attgtgactcattaa

SEQ ID NO: 418811 - DNA, 15 bp, Homo sapiens
ttgtgactcattaag

SEQ ID NO: 418812 - DNA, 15 bp, Homo sapiens
tgtgactcattaagc

SEQ ID NO: 418813 - DNA, 15 bp, Homo sapiens
gtgactcattaagca

SEQ ID NO: 418814 - DNA, 15 bp, Homo sapiens
tgactcattaagcat

SEQ ID NO: 418815 - DNA, 15 bp, Homo sapiens
gactcattaagcatt

SEQ ID NO: 418816 - DNA, 15 bp, Homo sapiens
actcattaagcattg

SEQ ID NO: 418817 - DNA, 15 bp, Homo sapiens
ctcattaagcattgc

SEQ ID NO: 418818 - DNA, 15 bp, Homo sapiens
tcattaagcattgct

SEQ ID NO: 418819 - DNA, 15 bp, Homo sapiens
cattaagcattgctt

SEQ ID NO: 418820 - DNA, 15 bp, Homo sapiens
attaagcattgcttc

SEQ ID NO: 418821 - DNA, 15 bp, Homo sapiens
ttaagcattgcttct

SEQ ID NO: 418822 - DNA, 15 bp, Homo sapiens
taagcattgcttctc

SEQ ID NO: 418823 - DNA, 15 bp, Homo sapiens
aagcattgcttctcc

SEQ ID NO: 418824 - DNA, 15 bp, Homo sapiens
agcattgcttctcca

SEQ ID NO: 418825 - DNA, 15 bp, Homo sapiens
gcattgcttctccat

SEQ ID NO: 418826 - DNA, 15 bp, Homo sapiens
cattgcttctccatc

SEQ ID NO: 418827 - DNA, 15 bp, Homo sapiens
attgcttctccatct

SEQ ID NO: 418828 - DNA, 15 bp, Homo sapiens
ttgcttctccatctt

SEQ ID NO: 418829 - DNA, 15 bp, Homo sapiens
cttctccatctttca

SEQ ID NO: 418830 - DNA, 15 bp, Homo sapiens
ttctccatctttcaa

SEQ ID NO: 418831 - DNA, 15 bp, Homo sapiens
tctccatctttcaac

SEQ ID NO: 418832 - DNA, 15 bp, Homo sapiens
ctccatctttcaaca

SEQ ID NO: 418833 - DNA, 15 bp, Homo sapiens
tccatctttcaacaa

SEQ ID NO: 418834 - DNA, 15 bp, Homo sapiens
ccatctttcaacaac

SEQ ID NO: 418835 - DNA, 15 bp, Homo sapiens
catctttcaacaaca

SEQ ID NO: 418836 - DNA, 15 bp, Homo sapiens
atctttcaacaacat

SEQ ID NO: 418837 - DNA, 15 bp, Homo sapiens
tctttcaacaacatc

SEQ ID NO: 418838 - DNA, 15 bp, Homo sapiens
ctttcaacaacatct

SEQ ID NO: 418839 - DNA, 15 bp, Homo sapiens
tttcaacaacatctc

SEQ ID NO: 418840 - DNA, 15 bp, Homo sapiens
ttcaacaacatctcc

SEQ ID NO: 418841 - DNA, 15 bp, Homo sapiens
tcaacaacatctcct

SEQ ID NO: 418842 - DNA, 15 bp, Homo sapiens
caacaacatctcctt

SEQ ID NO: 418843 - DNA, 15 bp, Homo sapiens
aacaacatctcctta

SEQ ID NO: 418844 - DNA, 15 bp, Homo sapiens
acaacatctccttag

SEQ ID NO: 418845 - DNA, 15 bp, Homo sapiens
caacatctccttaga

SEQ ID NO: 418846 - DNA, 15 bp, Homo sapiens
aacatctccttagaa

SEQ ID NO: 418847 - DNA, 15 bp, Homo sapiens
acatctccttagaag

SEQ ID NO: 418848 - DNA, 15 bp, Homo sapiens
catctccttagaagt

SEQ ID NO: 418849 - DNA, 15 bp, Homo sapiens
atctccttagaagtg

SEQ ID NO: 418850 - DNA, 15 bp, Homo sapiens
tctccttagaagtga

SEQ ID NO: 418851 - DNA, 15 bp, Homo sapiens
ctccttagaagtgaa

SEQ ID NO: 418852 - DNA, 15 bp, Homo sapiens
tccttagaagtgaat

SEQ ID NO: 418853 - DNA, 15 bp, Homo sapiens
ccttagaagtgaatg

SEQ ID NO: 418854 - DNA, 15 bp, Homo sapiens
cttagaagtgaatgc

SEQ ID NO: 418855 - DNA, 15 bp, Homo sapiens
ttagaagtgaatgca

SEQ ID NO: 418856 - DNA, 15 bp, Homo sapiens
tagaagtgaatgcat

SEQ ID NO: 418857 - DNA, 15 bp, Homo sapiens
agaagtgaatgcatc

SEQ ID NO: 418858 - DNA, 15 bp, Homo sapiens
gaagtgaatgcatcc

SEQ ID NO: 418859 - DNA, 15 bp, Homo sapiens
aagtgaatgcatcca

SEQ ID NO: 418860 - DNA, 15 bp, Homo sapiens
agtgaatgcatccat

SEQ ID NO: 418861 - DNA, 15 bp, Homo sapiens
gtgaatgcatccatt

SEQ ID NO: 418862 - DNA, 15 bp, Homo sapiens
tgaatgcatccatta

SEQ ID NO: 418863 - DNA, 15 bp, Homo sapiens
gaatgcatccattat

SEQ ID NO: 418864 - DNA, 15 bp, Homo sapiens
aatgcatccattatc

SEQ ID NO: 418865 - DNA, 15 bp, Homo sapiens
atgcatccattatcc

SEQ ID NO: 418866 - DNA, 15 bp, Homo sapiens
tgcatccattatcct

SEQ ID NO: 418867 - DNA, 15 bp, Homo sapiens
gcatccattatccta

SEQ ID NO: 418868 - DNA, 15 bp, Homo sapiens
catccattatcctaa

SEQ ID NO: 418869 - DNA, 15 bp, Homo sapiens
atccattatcctaat

SEQ ID NO: 418870 - DNA, 15 bp, Homo sapiens
tccattatcctaatc

SEQ ID NO: 418871 - DNA, 15 bp, Homo sapiens
ccattatcctaatct

SEQ ID NO: 418872 - DNA, 15 bp, Homo sapiens
cattatcctaatctt

SEQ ID NO: 418873 - DNA, 15 bp, Homo sapiens
attatcctaatcttt

SEQ ID NO: 418874 - DNA, 15 bp, Homo sapiens
ttatcctaatctttc

SEQ ID NO: 418875 - DNA, 15 bp, Homo sapiens
tatcctaatctttca

SEQ ID NO: 418876 - DNA, 15 bp, Homo sapiens
atcctaatctttcat

SEQ ID NO: 418877 - DNA, 15 bp, Homo sapiens
tcctaatctttcatc

SEQ ID NO: 418878 - DNA, 15 bp, Homo sapiens
cctaatctttcatca

SEQ ID NO: 418879 - DNA, 15 bp, Homo sapiens
ctaatctttcatcat

SEQ ID NO: 418880 - DNA, 15 bp, Homo sapiens
taatctttcatcatc

SEQ ID NO: 418881 - DNA, 15 bp, Homo sapiens
aatctttcatcatct

SEQ ID NO: 418882 - DNA, 15 bp, Homo sapiens
atctttcatcatctt

SEQ ID NO: 418883 - DNA, 15 bp, Homo sapiens
tctttcatcatctta

SEQ ID NO: 418884 - DNA, 15 bp, Homo sapiens
ctttcatcatcttat

SEQ ID NO: 418885 - DNA, 15 bp, Homo sapiens
tttcatcatcttatt

SEQ ID NO: 418886 - DNA, 15 bp, Homo sapiens
ttcatcatcttattt

SEQ ID NO: 418887 - DNA, 15 bp, Homo sapiens
tcatcatcttatttc

SEQ ID NO: 418888 - DNA, 15 bp, Homo sapiens
catcatcttatttct

SEQ ID NO: 418889 - DNA, 15 bp, Homo sapiens
atcatcttatttctg

SEQ ID NO: 418890 - DNA, 15 bp, Homo sapiens
tcatcttatttctgc

SEQ ID NO: 418891 - DNA, 15 bp, Homo sapiens
catcttatttctgct

SEQ ID NO: 418892 - DNA, 15 bp, Homo sapiens
atcttatttctgctt

SEQ ID NO: 418893 - DNA, 15 bp, Homo sapiens
ttatttctgcttctt

SEQ ID NO: 418894 - DNA, 15 bp, Homo sapiens
tatttctgcttcttc

SEQ ID NO: 418895 - DNA, 15 bp, Homo sapiens
atttctgcttcttcc

SEQ ID NO: 418896 - DNA, 15 bp, Homo sapiens
tttctgcttcttcct

SEQ ID NO: 418897 - DNA, 15 bp, Homo sapiens
ttctgcttcttcctg

SEQ ID NO: 418898 - DNA, 15 bp, Homo sapiens
tctgcttcttcctga

SEQ ID NO: 418899 - DNA, 15 bp, Homo sapiens
ctgcttcttcctgat

SEQ ID NO: 418900 - DNA, 15 bp, Homo sapiens
tgcttcttcctgatc

SEQ ID NO: 418901 - DNA, 15 bp, Homo sapiens
gcttcttcctgatct

SEQ ID NO: 418902 - DNA, 15 bp, Homo sapiens
cttcttcctgatcta

SEQ ID NO: 418903 - DNA, 15 bp, Homo sapiens
ttcttcctgatctat

SEQ ID NO: 418904 - DNA, 15 bp, Homo sapiens
tcttcctgatctata

SEQ ID NO: 418905 - DNA, 15 bp, Homo sapiens
cttcctgatctatat

SEQ ID NO: 418906 - DNA, 15 bp, Homo sapiens
ttcctgatctatata

SEQ ID NO: 418907 - DNA, 15 bp, Homo sapiens
tcctgatctatatat

SEQ ID NO: 418908 - DNA, 15 bp, Homo sapiens
cctgatctatatata

SEQ ID NO: 418909 - DNA, 15 bp, Homo sapiens
ctgatctatatatag

SEQ ID NO: 418910 - DNA, 15 bp, Homo sapiens
tgatctatatatagg

SEQ ID NO: 418911 - DNA, 15 bp, Homo sapiens
gatctatatatagga

SEQ ID NO: 418912 - DNA, 15 bp, Homo sapiens
atctatatataggac

SEQ ID NO: 418913 - DNA, 15 bp, Homo sapiens
tctatatataggaca

SEQ ID NO: 418914 - DNA, 15 bp, Homo sapiens
ctatatataggacat

SEQ ID NO: 418915 - DNA, 15 bp, Homo sapiens
tatatataggacatg

SEQ ID NO: 418916 - DNA, 15 bp, Homo sapiens
atatataggacatgc

SEQ ID NO: 418917 - DNA, 15 bp, Homo sapiens
tatataggacatgct

SEQ ID NO: 418918 - DNA, 15 bp, Homo sapiens
atataggacatgctt

SEQ ID NO: 418919 - DNA, 15 bp, Homo sapiens
tataggacatgcttc

SEQ ID NO: 418920 - DNA, 15 bp, Homo sapiens
ataggacatgcttct

SEQ ID NO: 418921 - DNA, 15 bp, Homo sapiens
taggacatgcttcta

SEQ ID NO: 418922 - DNA, 15 bp, Homo sapiens
aggacatgcttctac

SEQ ID NO: 418923 - DNA, 15 bp, Homo sapiens
ggacatgcttctaca

SEQ ID NO: 418924 - DNA, 15 bp, Homo sapiens
gacatgcttctacat

SEQ ID NO: 418925 - DNA, 15 bp, Homo sapiens
acatgcttctacatt

SEQ ID NO: 418926 - DNA, 15 bp, Homo sapiens
catgcttctacattc

SEQ ID NO: 418927 - DNA, 15 bp, Homo sapiens
atgcttctacattcc

SEQ ID NO: 418928 - DNA, 15 bp, Homo sapiens
tgcttctacattcct

SEQ ID NO: 418929 - DNA, 15 bp, Homo sapiens
gcttctacattcctc

SEQ ID NO: 418930 - DNA, 15 bp, Homo sapiens
cttctacattcctca

SEQ ID NO: 418931 - DNA, 15 bp, Homo sapiens
ttctacattcctcat

SEQ ID NO: 418932 - DNA, 15 bp, Homo sapiens
tctacattcctcatt

SEQ ID NO: 418933 - DNA, 15 bp, Homo sapiens
ctacattcctcatta

SEQ ID NO: 418934 - DNA, 15 bp, Homo sapiens
tacattcctcattaa

SEQ ID NO: 418935 - DNA, 15 bp, Homo sapiens
acattcctcattaat

SEQ ID NO: 418936 - DNA, 15 bp, Homo sapiens
cattcctcattaatt

SEQ ID NO: 418937 - DNA, 15 bp, Homo sapiens
attcctcattaattc

SEQ ID NO: 418938 - DNA, 15 bp, Homo sapiens
ttcctcattaattca

SEQ ID NO: 418939 - DNA, 15 bp, Homo sapiens
tcctcattaattcaa

SEQ ID NO: 418940 - DNA, 15 bp, Homo sapiens
cctcattaattcaag

SEQ ID NO: 418941 - DNA, 15 bp, Homo sapiens
ctcattaattcaagt

SEQ ID NO: 418942 - DNA, 15 bp, Homo sapiens
tcattaattcaagtg

SEQ ID NO: 418943 - DNA, 15 bp, Homo sapiens
cattaattcaagtgt

SEQ ID NO: 418944 - DNA, 15 bp, Homo sapiens
attaattcaagtgtc

SEQ ID NO: 418945 - DNA, 15 bp, Homo sapiens
ttaattcaagtgtcc

SEQ ID NO: 418946 - DNA, 15 bp, Homo sapiens
taattcaagtgtccc

SEQ ID NO: 418947 - DNA, 15 bp, Homo sapiens
aattcaagtgtccct

SEQ ID NO: 418948 - DNA, 15 bp, Homo sapiens
attcaagtgtccctt

SEQ ID NO: 418949 - DNA, 15 bp, Homo sapiens
ttcaagtgtcccttt

SEQ ID NO: 418950 - DNA, 15 bp, Homo sapiens
tcaagtgtcccttta

SEQ ID NO: 418951 - DNA, 15 bp, Homo sapiens
caagtgtccctttac

SEQ ID NO: 418952 - DNA, 15 bp, Homo sapiens
aagtgtccctttact

SEQ ID NO: 418953 - DNA, 15 bp, Homo sapiens
agtgtccctttactt

SEQ ID NO: 418954 - DNA, 15 bp, Homo sapiens
gtgtccctttacttt

SEQ ID NO: 418955 - DNA, 15 bp, Homo sapiens
tgtccctttactttt

SEQ ID NO: 418956 - DNA, 15 bp, Homo sapiens
gtccctttacttttt

SEQ ID NO: 418957 - DNA, 15 bp, Homo sapiens
tccctttactttttt

SEQ ID NO: 418958 - DNA, 15 bp, Homo sapiens
ccctttacttttttt

SEQ ID NO: 418959 - DNA, 15 bp, Homo sapiens
cctttactttttttt

SEQ ID NO: 418960 - DNA, 15 bp, Homo sapiens
ctttacttttttttt

SEQ ID NO: 418961 - DNA, 15 bp, Homo sapiens
cttgctctgtcgccc

SEQ ID NO: 418962 - DNA, 15 bp, Homo sapiens
ttgctctgtcgccca

SEQ ID NO: 418963 - DNA, 15 bp, Homo sapiens
acctccacctcctgg

SEQ ID NO: 418964 - DNA, 15 bp, Homo sapiens
cctccacctcctggg

SEQ ID NO: 418965 - DNA, 15 bp, Homo sapiens
ctccacctcctgggt

SEQ ID NO: 418966 - DNA, 15 bp, Homo sapiens
tccacctcctgggtt

SEQ ID NO: 418967 - DNA, 15 bp, Homo sapiens
ccacctcctgggttt

SEQ ID NO: 418968 - DNA, 15 bp, Homo sapiens
cacctcctgggttta

SEQ ID NO: 418969 - DNA, 15 bp, Homo sapiens
acctcctgggtttaa

SEQ ID NO: 418970 - DNA, 15 bp, Homo sapiens
cctcctgggtttaag

SEQ ID NO: 418971 - DNA, 15 bp, Homo sapiens
ctcctgggtttaagt

SEQ ID NO: 418972 - DNA, 15 bp, Homo sapiens
tcctgggtttaagtg

SEQ ID NO: 418973 - DNA, 15 bp, Homo sapiens
cctgggtttaagtga

SEQ ID NO: 418974 - DNA, 15 bp, Homo sapiens
ctgggtttaagtgat

SEQ ID NO: 418975 - DNA, 15 bp, Homo sapiens
tgggtttaagtgatt

SEQ ID NO: 418976 - DNA, 15 bp, Homo sapiens
gggtttaagtgattc

SEQ ID NO: 418977 - DNA, 15 bp, Homo sapiens
ggtttaagtgattct

SEQ ID NO: 418978 - DNA, 15 bp, Homo sapiens
gtttaagtgattctc

SEQ ID NO: 418979 - DNA, 15 bp, Homo sapiens
tttaagtgattctcc

SEQ ID NO: 418980 - DNA, 15 bp, Homo sapiens
ttaagtgattctcct

SEQ ID NO: 418981 - DNA, 15 bp, Homo sapiens
taagtgattctcctg

SEQ ID NO: 418982 - DNA, 15 bp, Homo sapiens
tgggattacaggtgg

SEQ ID NO: 418983 - DNA, 15 bp, Homo sapiens
gggattacaggtggc

SEQ ID NO: 418984 - DNA, 15 bp, Homo sapiens
ggattacaggtggct

SEQ ID NO: 418985 - DNA, 15 bp, Homo sapiens
gattacaggtggctg

SEQ ID NO: 418986 - DNA, 15 bp, Homo sapiens
attacaggtggctgc

SEQ ID NO: 418987 - DNA, 15 bp, Homo sapiens
ttacaggtggctgcc

SEQ ID NO: 418988 - DNA, 15 bp, Homo sapiens
tacaggtggctgcca

SEQ ID NO: 418989 - DNA, 15 bp, Homo sapiens
acaggtggctgccac

SEQ ID NO: 418990 - DNA, 15 bp, Homo sapiens
caggtggctgccacc

SEQ ID NO: 418991 - DNA, 15 bp, Homo sapiens
aggtggctgccacca

SEQ ID NO: 418992 - DNA, 15 bp, Homo sapiens
ggtggctgccaccac

SEQ ID NO: 418993 - DNA, 15 bp, Homo sapiens
gtggctgccaccaca

SEQ ID NO: 418994 - DNA, 15 bp, Homo sapiens
tggctgccaccacac

SEQ ID NO: 418995 - DNA, 15 bp, Homo sapiens
ggctgccaccacacc

SEQ ID NO: 418996 - DNA, 15 bp, Homo sapiens
gctgccaccacaccc

SEQ ID NO: 418997 - DNA, 15 bp, Homo sapiens
tgccaccacacccaa

SEQ ID NO: 418998 - DNA, 15 bp, Homo sapiens
gccaccacacccaac

SEQ ID NO: 418999 - DNA, 15 bp, Homo sapiens
ccaccacacccaact

SEQ ID NO: 419000 - DNA, 15 bp, Homo sapiens
caccacacccaactt

SEQ ID NO: 419001 - DNA, 15 bp, Homo sapiens
accacacccaactta

SEQ ID NO: 419002 - DNA, 15 bp, Homo sapiens
ccacacccaacttat

SEQ ID NO: 419003 - DNA, 15 bp, Homo sapiens
cacacccaacttatt

SEQ ID NO: 419004 - DNA, 15 bp, Homo sapiens
acacccaacttattt

SEQ ID NO: 419005 - DNA, 15 bp, Homo sapiens
cacccaacttatttt

SEQ ID NO: 419006 - DNA, 15 bp, Homo sapiens
acccaacttattttt

SEQ ID NO: 419007 - DNA, 15 bp, Homo sapiens
cccaacttatttttg

SEQ ID NO: 419008 - DNA, 15 bp, Homo sapiens
ccaacttatttttgt

SEQ ID NO: 419009 - DNA, 15 bp, Homo sapiens
caacttatttttgta

SEQ ID NO: 419010 - DNA, 15 bp, Homo sapiens
aacttatttttgtat

SEQ ID NO: 419011 - DNA, 15 bp, Homo sapiens
acttatttttgtatt

SEQ ID NO: 419012 - DNA, 15 bp, Homo sapiens
gagacgaggtttcat

SEQ ID NO: 419013 - DNA, 15 bp, Homo sapiens
agacgaggtttcatc

SEQ ID NO: 419014 - DNA, 15 bp, Homo sapiens
gacgaggtttcatca

SEQ ID NO: 419015 - DNA, 15 bp, Homo sapiens
acgaggtttcatcat

SEQ ID NO: 419016 - DNA, 15 bp, Homo sapiens
cgaggtttcatcatg

SEQ ID NO: 419017 - DNA, 15 bp, Homo sapiens
gaggtttcatcatgt

SEQ ID NO: 419018 - DNA, 15 bp, Homo sapiens
aggctggtctcaaat

SEQ ID NO: 419019 - DNA, 15 bp, Homo sapiens
ggctggtctcaaatt

SEQ ID NO: 419020 - DNA, 15 bp, Homo sapiens
gctggtctcaaattc

SEQ ID NO: 419021 - DNA, 15 bp, Homo sapiens
ctggtctcaaattcc

SEQ ID NO: 419022 - DNA, 15 bp, Homo sapiens
tggtctcaaattcct

SEQ ID NO: 419023 - DNA, 15 bp, Homo sapiens
ggtctcaaattcctg

SEQ ID NO: 419024 - DNA, 15 bp, Homo sapiens
gtctcaaattcctga

SEQ ID NO: 419025 - DNA, 15 bp, Homo sapiens
tctcaaattcctgac

SEQ ID NO: 419026 - DNA, 15 bp, Homo sapiens
ctcaaattcctgacc

SEQ ID NO: 419027 - DNA, 15 bp, Homo sapiens
tcaaattcctgacct

SEQ ID NO: 419028 - DNA, 15 bp, Homo sapiens
caaattcctgacctc

SEQ ID NO: 419029 - DNA, 15 bp, Homo sapiens
aaattcctgacctca

SEQ ID NO: 419030 - DNA, 15 bp, Homo sapiens
aattcctgacctcag

SEQ ID NO: 419031 - DNA, 15 bp, Homo sapiens
attcctgacctcagg

SEQ ID NO: 419032 - DNA, 15 bp, Homo sapiens
ttcctgacctcaggt

SEQ ID NO: 419033 - DNA, 15 bp, Homo sapiens
gacctcaggtgaccc

SEQ ID NO: 419034 - DNA, 15 bp, Homo sapiens
acctcaggtgaccca

SEQ ID NO: 419035 - DNA, 15 bp, Homo sapiens
cctcaggtgacccac

SEQ ID NO: 419036 - DNA, 15 bp, Homo sapiens
ctcaggtgacccact

SEQ ID NO: 419037 - DNA, 15 bp, Homo sapiens
tcaggtgacccactc

SEQ ID NO: 419038 - DNA, 15 bp, Homo sapiens
caggtgacccactcg

SEQ ID NO: 419039 - DNA, 15 bp, Homo sapiens
aggtgacccactcgc

SEQ ID NO: 419040 - DNA, 15 bp, Homo sapiens
ggtgacccactcgcc

SEQ ID NO: 419041 - DNA, 15 bp, Homo sapiens
gtgacccactcgcct

SEQ ID NO: 419042 - DNA, 15 bp, Homo sapiens
tgacccactcgcctt

SEQ ID NO: 419043 - DNA, 15 bp, Homo sapiens
gacccactcgccttg

SEQ ID NO: 419044 - DNA, 15 bp, Homo sapiens
acccactcgccttgg

SEQ ID NO: 419045 - DNA, 15 bp, Homo sapiens
cccactcgccttggc

SEQ ID NO: 419046 - DNA, 15 bp, Homo sapiens
ccactcgccttggcc

SEQ ID NO: 419047 - DNA, 15 bp, Homo sapiens
cactcgccttggcct

SEQ ID NO: 419048 - DNA, 15 bp, Homo sapiens
actcgccttggcctc

SEQ ID NO: 419049 - DNA, 15 bp, Homo sapiens
ctcgccttggcctcc

SEQ ID NO: 419050 - DNA, 15 bp, Homo sapiens
tcgccttggcctccc

SEQ ID NO: 419051 - DNA, 15 bp, Homo sapiens
cttggcctcccaaac

SEQ ID NO: 419052 - DNA, 15 bp, Homo sapiens
ttggcctcccaaact

SEQ ID NO: 419053 - DNA, 15 bp, Homo sapiens
tggcctcccaaactg

SEQ ID NO: 419054 - DNA, 15 bp, Homo sapiens
ggcctcccaaactgc

SEQ ID NO: 419055 - DNA, 15 bp, Homo sapiens
gcctcccaaactgct

SEQ ID NO: 419056 - DNA, 15 bp, Homo sapiens
cctcccaaactgctg

SEQ ID NO: 419057 - DNA, 15 bp, Homo sapiens
ctcccaaactgctgg

SEQ ID NO: 419058 - DNA, 15 bp, Homo sapiens
tcccaaactgctggg

SEQ ID NO: 419059 - DNA, 15 bp, Homo sapiens
cccaaactgctggga

SEQ ID NO: 419060 - DNA, 15 bp, Homo sapiens
ccaaactgctgggat

SEQ ID NO: 419061 - DNA, 15 bp, Homo sapiens
caaactgctgggatt

SEQ ID NO: 419062 - DNA, 15 bp, Homo sapiens
aaactgctgggatta

SEQ ID NO: 419063 - DNA, 15 bp, Homo sapiens
aactgctgggattac

SEQ ID NO: 419064 - DNA, 15 bp, Homo sapiens
actgctgggattaca

SEQ ID NO: 419065 - DNA, 15 bp, Homo sapiens
ctgctgggattacag

SEQ ID NO: 419066 - DNA, 15 bp, Homo sapiens
acgtgagccaccacg

SEQ ID NO: 419067 - DNA, 15 bp, Homo sapiens
gagccaccacgccca

SEQ ID NO: 419068 - DNA, 15 bp, Homo sapiens
agccaccacgcccag

SEQ ID NO: 419069 - DNA, 15 bp, Homo sapiens
ccaccacgcccagcc

SEQ ID NO: 419070 - DNA, 15 bp, Homo sapiens
caccacgcccagccc

SEQ ID NO: 419071 - DNA, 15 bp, Homo sapiens
accacgcccagcccc

SEQ ID NO: 419072 - DNA, 15 bp, Homo sapiens
ccacgcccagcccca

SEQ ID NO: 419073 - DNA, 15 bp, Homo sapiens
cacgcccagccccat

SEQ ID NO: 419074 - DNA, 15 bp, Homo sapiens
acgcccagccccatt

SEQ ID NO: 419075 - DNA, 15 bp, Homo sapiens
cgcccagccccattt

SEQ ID NO: 419076 - DNA, 15 bp, Homo sapiens
gcccagccccattta

SEQ ID NO: 419077 - DNA, 15 bp, Homo sapiens
cccagccccatttac

SEQ ID NO: 419078 - DNA, 15 bp, Homo sapiens
ccagccccatttacc

SEQ ID NO: 419079 - DNA, 15 bp, Homo sapiens
cagccccatttacct

SEQ ID NO: 419080 - DNA, 15 bp, Homo sapiens
agccccatttacctt

SEQ ID NO: 419081 - DNA, 15 bp, Homo sapiens
gccccatttaccttt

SEQ ID NO: 419082 - DNA, 15 bp, Homo sapiens
ccccatttacctttt

SEQ ID NO: 419083 - DNA, 15 bp, Homo sapiens
cccatttacctttta

SEQ ID NO: 419084 - DNA, 15 bp, Homo sapiens
ccatttaccttttat

SEQ ID NO: 419085 - DNA, 15 bp, Homo sapiens
catttaccttttatt

SEQ ID NO: 419086 - DNA, 15 bp, Homo sapiens
atttaccttttattc

SEQ ID NO: 419087 - DNA, 15 bp, Homo sapiens
tttaccttttattct

SEQ ID NO: 419088 - DNA, 15 bp, Homo sapiens
ttaccttttattctc

SEQ ID NO: 419089 - DNA, 15 bp, Homo sapiens
taccttttattctcc

SEQ ID NO: 419090 - DNA, 15 bp, Homo sapiens
accttttattctcca

SEQ ID NO: 419091 - DNA, 15 bp, Homo sapiens
ccttttattctccat

SEQ ID NO: 419092 - DNA, 15 bp, Homo sapiens
cttttattctccatc

SEQ ID NO: 419093 - DNA, 15 bp, Homo sapiens
ttttattctccatcc

SEQ ID NO: 419094 - DNA, 15 bp, Homo sapiens
tttattctccatcct

SEQ ID NO: 419095 - DNA, 15 bp, Homo sapiens
ttattctccatcctt

SEQ ID NO: 419096 - DNA, 15 bp, Homo sapiens
tattctccatccttt

SEQ ID NO: 419097 - DNA, 15 bp, Homo sapiens
attctccatcctttt

SEQ ID NO: 419098 - DNA, 15 bp, Homo sapiens
ttctccatccttttc

SEQ ID NO: 419099 - DNA, 15 bp, Homo sapiens
tctccatccttttct

SEQ ID NO: 419100 - DNA, 15 bp, Homo sapiens
ctccatccttttctc

SEQ ID NO: 419101 - DNA, 15 bp, Homo sapiens
tccatccttttctcc

SEQ ID NO: 419102 - DNA, 15 bp, Homo sapiens
ccatccttttctcca

SEQ ID NO: 419103 - DNA, 15 bp, Homo sapiens
catccttttctccac

SEQ ID NO: 419104 - DNA, 15 bp, Homo sapiens
atccttttctccact

SEQ ID NO: 419105 - DNA, 15 bp, Homo sapiens
tccttttctccacta

SEQ ID NO: 419106 - DNA, 15 bp, Homo sapiens
ccttttctccactat

SEQ ID NO: 419107 - DNA, 15 bp, Homo sapiens
cttttctccactatt

SEQ ID NO: 419108 - DNA, 15 bp, Homo sapiens
ttttctccactatta

SEQ ID NO: 419109 - DNA, 15 bp, Homo sapiens
tttctccactattat

SEQ ID NO: 419110 - DNA, 15 bp, Homo sapiens
ttctccactattatt

SEQ ID NO: 419111 - DNA, 15 bp, Homo sapiens
tctccactattattg

SEQ ID NO: 419112 - DNA, 15 bp, Homo sapiens
ctccactattattgt

SEQ ID NO: 419113 - DNA, 15 bp, Homo sapiens
tccactattattgtt

SEQ ID NO: 419114 - DNA, 15 bp, Homo sapiens
ccactattattgttg

SEQ ID NO: 419115 - DNA, 15 bp, Homo sapiens
cactattattgttgg

SEQ ID NO: 419116 - DNA, 15 bp, Homo sapiens
actattattgttggt

SEQ ID NO: 419117 - DNA, 15 bp, Homo sapiens
ctattattgttggtg

SEQ ID NO: 419118 - DNA, 15 bp, Homo sapiens
tattattgttggtgc

SEQ ID NO: 419119 - DNA, 15 bp, Homo sapiens
attattgttggtgcc

SEQ ID NO: 419120 - DNA, 15 bp, Homo sapiens
ttattgttggtgcca

SEQ ID NO: 419121 - DNA, 15 bp, Homo sapiens
tattgttggtgccaa

SEQ ID NO: 419122 - DNA, 15 bp, Homo sapiens
attgttggtgccaat

SEQ ID NO: 419123 - DNA, 15 bp, Homo sapiens
ttgttggtgccaata

SEQ ID NO: 419124 - DNA, 15 bp, Homo sapiens
tgttggtgccaatat

SEQ ID NO: 419125 - DNA, 15 bp, Homo sapiens
gttggtgccaatatc

SEQ ID NO: 419126 - DNA, 15 bp, Homo sapiens
ttggtgccaatatcc

SEQ ID NO: 419127 - DNA, 15 bp, Homo sapiens
tggtgccaatatcca

SEQ ID NO: 419128 - DNA, 15 bp, Homo sapiens
ggtgccaatatccat

SEQ ID NO: 419129 - DNA, 15 bp, Homo sapiens
gtgccaatatccata

SEQ ID NO: 419130 - DNA, 15 bp, Homo sapiens
tgccaatatccatat

SEQ ID NO: 419131 - DNA, 15 bp, Homo sapiens
gccaatatccatatt

SEQ ID NO: 419132 - DNA, 15 bp, Homo sapiens
ccaatatccatattc

SEQ ID NO: 419133 - DNA, 15 bp, Homo sapiens
caatatccatattca

SEQ ID NO: 419134 - DNA, 15 bp, Homo sapiens
aatatccatattcac

SEQ ID NO: 419135 - DNA, 15 bp, Homo sapiens
atatccatattcaca

SEQ ID NO: 419136 - DNA, 15 bp, Homo sapiens
tatccatattcacaa

SEQ ID NO: 419137 - DNA, 15 bp, Homo sapiens
atccatattcacaac

SEQ ID NO: 419138 - DNA, 15 bp, Homo sapiens
tccatattcacaact

SEQ ID NO: 419139 - DNA, 15 bp, Homo sapiens
ccatattcacaactt

SEQ ID NO: 419140 - DNA, 15 bp, Homo sapiens
catattcacaacttt

SEQ ID NO: 419141 - DNA, 15 bp, Homo sapiens
atattcacaactttt

SEQ ID NO: 419142 - DNA, 15 bp, Homo sapiens
tattcacaacttttt

SEQ ID NO: 419143 - DNA, 15 bp, Homo sapiens
attcacaacttttta

SEQ ID NO: 419144 - DNA, 15 bp, Homo sapiens
ttcacaactttttat

SEQ ID NO: 419145 - DNA, 15 bp, Homo sapiens
tcacaactttttata

SEQ ID NO: 419146 - DNA, 15 bp, Homo sapiens
cacaactttttatat

SEQ ID NO: 419147 - DNA, 15 bp, Homo sapiens
acaactttttatatt

SEQ ID NO: 419148 - DNA, 15 bp, Homo sapiens
caactttttatattt

SEQ ID NO: 419149 - DNA, 15 bp, Homo sapiens
aactttttatatttt

SEQ ID NO: 419150 - DNA, 15 bp, Homo sapiens
actttttatattttg

SEQ ID NO: 419151 - DNA, 15 bp, Homo sapiens
ctttttatattttga

SEQ ID NO: 419152 - DNA, 15 bp, Homo sapiens
tttttatattttgat

SEQ ID NO: 419153 - DNA, 15 bp, Homo sapiens
ttttatattttgatt

SEQ ID NO: 419154 - DNA, 15 bp, Homo sapiens
tttatattttgattt

SEQ ID NO: 419155 - DNA, 15 bp, Homo sapiens
ttatattttgatttc

SEQ ID NO: 419156 - DNA, 15 bp, Homo sapiens
tatattttgatttcc

SEQ ID NO: 419157 - DNA, 15 bp, Homo sapiens
atattttgatttcca

SEQ ID NO: 419158 - DNA, 15 bp, Homo sapiens
tattttgatttccaa

SEQ ID NO: 419159 - DNA, 15 bp, Homo sapiens
attttgatttccaag

SEQ ID NO: 419160 - DNA, 15 bp, Homo sapiens
ttttgatttccaagt

SEQ ID NO: 419161 - DNA, 15 bp, Homo sapiens
tttgatttccaagtt

SEQ ID NO: 419162 - DNA, 15 bp, Homo sapiens
ttgatttccaagttt

SEQ ID NO: 419163 - DNA, 15 bp, Homo sapiens
tgatttccaagtttc

SEQ ID NO: 419164 - DNA, 15 bp, Homo sapiens
gatttccaagtttct

SEQ ID NO: 419165 - DNA, 15 bp, Homo sapiens
atttccaagtttctt

SEQ ID NO: 419166 - DNA, 15 bp, Homo sapiens
tttccaagtttcttt

SEQ ID NO: 419167 - DNA, 15 bp, Homo sapiens
ttccaagtttctttt

SEQ ID NO: 419168 - DNA, 15 bp, Homo sapiens
tccaagtttcttttt

SEQ ID NO: 419169 - DNA, 15 bp, Homo sapiens
ccaagtttcttttta

SEQ ID NO: 419170 - DNA, 15 bp, Homo sapiens
caagtttctttttac

SEQ ID NO: 419171 - DNA, 15 bp, Homo sapiens
aagtttctttttact

SEQ ID NO: 419172 - DNA, 15 bp, Homo sapiens
agtttctttttactt

SEQ ID NO: 419173 - DNA, 15 bp, Homo sapiens
gtttctttttacttt

SEQ ID NO: 419174 - DNA, 15 bp, Homo sapiens
tttctttttacttta

SEQ ID NO: 419175 - DNA, 15 bp, Homo sapiens
ttctttttactttat

SEQ ID NO: 419176 - DNA, 15 bp, Homo sapiens
tctttttactttatc

SEQ ID NO: 419177 - DNA, 15 bp, Homo sapiens
ctttttactttatct

SEQ ID NO: 419178 - DNA, 15 bp, Homo sapiens
tttttactttatctg

SEQ ID NO: 419179 - DNA, 15 bp, Homo sapiens
ttttactttatctgt

SEQ ID NO: 419180 - DNA, 15 bp, Homo sapiens
tttactttatctgta

SEQ ID NO: 419181 - DNA, 15 bp, Homo sapiens
ttactttatctgtaa

SEQ ID NO: 419182 - DNA, 15 bp, Homo sapiens
tactttatctgtaaa

SEQ ID NO: 419183 - DNA, 15 bp, Homo sapiens
actttatctgtaaat

SEQ ID NO: 419184 - DNA, 15 bp, Homo sapiens
ctttatctgtaaatg

SEQ ID NO: 419185 - DNA, 15 bp, Homo sapiens
tttatctgtaaatgc

SEQ ID NO: 419186 - DNA, 15 bp, Homo sapiens
ttatctgtaaatgcc

SEQ ID NO: 419187 - DNA, 15 bp, Homo sapiens
tatctgtaaatgcct

SEQ ID NO: 419188 - DNA, 15 bp, Homo sapiens
atctgtaaatgcctt

SEQ ID NO: 419189 - DNA, 15 bp, Homo sapiens
tctgtaaatgccttt

SEQ ID NO: 419190 - DNA, 15 bp, Homo sapiens
ctgtaaatgccttta

SEQ ID NO: 419191 - DNA, 15 bp, Homo sapiens
tgtaaatgcctttat

SEQ ID NO: 419192 - DNA, 15 bp, Homo sapiens
gtaaatgcctttatc

SEQ ID NO: 419193 - DNA, 15 bp, Homo sapiens
taaatgcctttatcc

SEQ ID NO: 419194 - DNA, 15 bp, Homo sapiens
aaatgcctttatccc

SEQ ID NO: 419195 - DNA, 15 bp, Homo sapiens
aatgcctttatccct

SEQ ID NO: 419196 - DNA, 15 bp, Homo sapiens
atgcctttatccctg

SEQ ID NO: 419197 - DNA, 15 bp, Homo sapiens
tgcctttatccctgt

SEQ ID NO: 419198 - DNA, 15 bp, Homo sapiens
gcctttatccctgtt

SEQ ID NO: 419199 - DNA, 15 bp, Homo sapiens
cctttatccctgttc

SEQ ID NO: 419200 - DNA, 15 bp, Homo sapiens
ctttatccctgttct

SEQ ID NO: 419201 - DNA, 15 bp, Homo sapiens
tttatccctgttcta

SEQ ID NO: 419202 - DNA, 15 bp, Homo sapiens
ttatccctgttctaa

SEQ ID NO: 419203 - DNA, 15 bp, Homo sapiens
tatccctgttctaag

SEQ ID NO: 419204 - DNA, 15 bp, Homo sapiens
atccctgttctaagt

SEQ ID NO: 419205 - DNA, 15 bp, Homo sapiens
tccctgttctaagtc

SEQ ID NO: 419206 - DNA, 15 bp, Homo sapiens
ccctgttctaagtcc

SEQ ID NO: 419207 - DNA, 15 bp, Homo sapiens
cctgttctaagtccc

SEQ ID NO: 419208 - DNA, 15 bp, Homo sapiens
ctgttctaagtcccg

SEQ ID NO: 419209 - DNA, 15 bp, Homo sapiens
tgttctaagtcccgt

SEQ ID NO: 419210 - DNA, 15 bp, Homo sapiens
gttctaagtcccgta

SEQ ID NO: 419211 - DNA, 15 bp, Homo sapiens
ttctaagtcccgtag

SEQ ID NO: 419212 - DNA, 15 bp, Homo sapiens
tctaagtcccgtaga

SEQ ID NO: 419213 - DNA, 15 bp, Homo sapiens
ctaagtcccgtagac

SEQ ID NO: 419214 - DNA, 15 bp, Homo sapiens
taagtcccgtagacc

SEQ ID NO: 419215 - DNA, 15 bp, Homo sapiens
aagtcccgtagacct

SEQ ID NO: 419216 - DNA, 15 bp, Homo sapiens
agtcccgtagacctt

SEQ ID NO: 419217 - DNA, 15 bp, Homo sapiens
gtcccgtagaccttg

SEQ ID NO: 419218 - DNA, 15 bp, Homo sapiens
tcccgtagaccttgt

SEQ ID NO: 419219 - DNA, 15 bp, Homo sapiens
cccgtagaccttgtc

SEQ ID NO: 419220 - DNA, 15 bp, Homo sapiens
ccgtagaccttgtca

SEQ ID NO: 419221 - DNA, 15 bp, Homo sapiens
cgtagaccttgtcac

SEQ ID NO: 419222 - DNA, 15 bp, Homo sapiens
gtagaccttgtcaca

SEQ ID NO: 419223 - DNA, 15 bp, Homo sapiens
tagaccttgtcacac

SEQ ID NO: 419224 - DNA, 15 bp, Homo sapiens
agaccttgtcacact

SEQ ID NO: 419225 - DNA, 15 bp, Homo sapiens
gaccttgtcacactg

SEQ ID NO: 419226 - DNA, 15 bp, Homo sapiens
accttgtcacactgg

SEQ ID NO: 419227 - DNA, 15 bp, Homo sapiens
ccttgtcacactggg

SEQ ID NO: 419228 - DNA, 15 bp, Homo sapiens
cttgtcacactggga

SEQ ID NO: 419229 - DNA, 15 bp, Homo sapiens
ttgtcacactgggag

SEQ ID NO: 419230 - DNA, 15 bp, Homo sapiens
tgtcacactgggagt

SEQ ID NO: 419231 - DNA, 15 bp, Homo sapiens
gtcacactgggagtc

SEQ ID NO: 419232 - DNA, 15 bp, Homo sapiens
tcacactgggagtca

SEQ ID NO: 419233 - DNA, 15 bp, Homo sapiens
cacactgggagtcag

SEQ ID NO: 419234 - DNA, 15 bp, Homo sapiens
acactgggagtcagt

SEQ ID NO: 419235 - DNA, 15 bp, Homo sapiens
cactgggagtcagtt

SEQ ID NO: 419236 - DNA, 15 bp, Homo sapiens
actgggagtcagtta

SEQ ID NO: 419237 - DNA, 15 bp, Homo sapiens
ctgggagtcagttaa

SEQ ID NO: 419238 - DNA, 15 bp, Homo sapiens
tgggagtcagttaac

SEQ ID NO: 419239 - DNA, 15 bp, Homo sapiens
gggagtcagttaaca

SEQ ID NO: 419240 - DNA, 15 bp, Homo sapiens
ggagtcagttaacat

SEQ ID NO: 419241 - DNA, 15 bp, Homo sapiens
gagtcagttaacatt

SEQ ID NO: 419242 - DNA, 15 bp, Homo sapiens
agtcagttaacattt

SEQ ID NO: 419243 - DNA, 15 bp, Homo sapiens
gtcagttaacatttc

SEQ ID NO: 419244 - DNA, 15 bp, Homo sapiens
tcagttaacatttcc

SEQ ID NO: 419245 - DNA, 15 bp, Homo sapiens
cagttaacatttcct

SEQ ID NO: 419246 - DNA, 15 bp, Homo sapiens
agttaacatttcctg

SEQ ID NO: 419247 - DNA, 15 bp, Homo sapiens
gttaacatttcctgt

SEQ ID NO: 419248 - DNA, 15 bp, Homo sapiens
ttaacatttcctgtc

SEQ ID NO: 419249 - DNA, 15 bp, Homo sapiens
taacatttcctgtca

SEQ ID NO: 419250 - DNA, 15 bp, Homo sapiens
aacatttcctgtcat

SEQ ID NO: 419251 - DNA, 15 bp, Homo sapiens
acatttcctgtcatc

SEQ ID NO: 419252 - DNA, 15 bp, Homo sapiens
catttcctgtcatct

SEQ ID NO: 419253 - DNA, 15 bp, Homo sapiens
atttcctgtcatctt

SEQ ID NO: 419254 - DNA, 15 bp, Homo sapiens
tttcctgtcatcttg

SEQ ID NO: 419255 - DNA, 15 bp, Homo sapiens
ttcctgtcatcttgg

SEQ ID NO: 419256 - DNA, 15 bp, Homo sapiens
tcctgtcatcttggc

SEQ ID NO: 419257 - DNA, 15 bp, Homo sapiens
cctgtcatcttggca

SEQ ID NO: 419258 - DNA, 15 bp, Homo sapiens
ctgtcatcttggcat

SEQ ID NO: 419259 - DNA, 15 bp, Homo sapiens
tgtcatcttggcatc

SEQ ID NO: 419260 - DNA, 15 bp, Homo sapiens
gtcatcttggcatcc

SEQ ID NO: 419261 - DNA, 15 bp, Homo sapiens
tcatcttggcatccc

SEQ ID NO: 419262 - DNA, 15 bp, Homo sapiens
catcttggcatccct

SEQ ID NO: 419263 - DNA, 15 bp, Homo sapiens
atcttggcatccctg

SEQ ID NO: 419264 - DNA, 15 bp, Homo sapiens
tcttggcatccctga

SEQ ID NO: 419265 - DNA, 15 bp, Homo sapiens
cttggcatccctgag

SEQ ID NO: 419266 - DNA, 15 bp, Homo sapiens
ttggcatccctgaga

SEQ ID NO: 419267 - DNA, 15 bp, Homo sapiens
tggcatccctgagat

SEQ ID NO: 419268 - DNA, 15 bp, Homo sapiens
ggcatccctgagata

SEQ ID NO: 419269 - DNA, 15 bp, Homo sapiens
gcatccctgagataa

SEQ ID NO: 419270 - DNA, 15 bp, Homo sapiens
catccctgagataat

SEQ ID NO: 419271 - DNA, 15 bp, Homo sapiens
atccctgagataatc

SEQ ID NO: 419272 - DNA, 15 bp, Homo sapiens
tccctgagataatca

SEQ ID NO: 419273 - DNA, 15 bp, Homo sapiens
ccctgagataatcaa

SEQ ID NO: 419274 - DNA, 15 bp, Homo sapiens
cctgagataatcaat

SEQ ID NO: 419275 - DNA, 15 bp, Homo sapiens
ctgagataatcaatt

SEQ ID NO: 419276 - DNA, 15 bp, Homo sapiens
tgagataatcaattt

SEQ ID NO: 419277 - DNA, 15 bp, Homo sapiens
gagataatcaatttc

SEQ ID NO: 419278 - DNA, 15 bp, Homo sapiens
agataatcaatttcc

SEQ ID NO: 419279 - DNA, 15 bp, Homo sapiens
gataatcaatttcca

SEQ ID NO: 419280 - DNA, 15 bp, Homo sapiens
ataatcaatttccag

SEQ ID NO: 419281 - DNA, 15 bp, Homo sapiens
taatcaatttccagg

SEQ ID NO: 419282 - DNA, 15 bp, Homo sapiens
aatcaatttccagga

SEQ ID NO: 419283 - DNA, 15 bp, Homo sapiens
atcaatttccaggag

SEQ ID NO: 419284 - DNA, 15 bp, Homo sapiens
tcaatttccaggaga

SEQ ID NO: 419285 - DNA, 15 bp, Homo sapiens
caatttccaggagat

SEQ ID NO: 419286 - DNA, 15 bp, Homo sapiens
aatttccaggagatc

SEQ ID NO: 419287 - DNA, 15 bp, Homo sapiens
atttccaggagatca

SEQ ID NO: 419288 - DNA, 15 bp, Homo sapiens
tttccaggagatcaa

SEQ ID NO: 419289 - DNA, 15 bp, Homo sapiens
ttccaggagatcaag

SEQ ID NO: 419290 - DNA, 15 bp, Homo sapiens
tccaggagatcaagg

SEQ ID NO: 419291 - DNA, 15 bp, Homo sapiens
ccaggagatcaaggg

SEQ ID NO: 419292 - DNA, 15 bp, Homo sapiens
caggagatcaagggc

SEQ ID NO: 419293 - DNA, 15 bp, Homo sapiens
aggagatcaagggca

SEQ ID NO: 419294 - DNA, 15 bp, Homo sapiens
ggagatcaagggcag

SEQ ID NO: 419295 - DNA, 15 bp, Homo sapiens
gagatcaagggcaga

SEQ ID NO: 419296 - DNA, 15 bp, Homo sapiens
agatcaagggcagac

SEQ ID NO: 419297 - DNA, 15 bp, Homo sapiens
gatcaagggcagact

SEQ ID NO: 419298 - DNA, 15 bp, Homo sapiens
atcaagggcagactg

SEQ ID NO: 419299 - DNA, 15 bp, Homo sapiens
tcaagggcagactgt

SEQ ID NO: 419300 - DNA, 15 bp, Homo sapiens
caagggcagactgtt

SEQ ID NO: 419301 - DNA, 15 bp, Homo sapiens
aagggcagactgttt

SEQ ID NO: 419302 - DNA, 15 bp, Homo sapiens
agggcagactgtttt

SEQ ID NO: 419303 - DNA, 15 bp, Homo sapiens
gggcagactgttttc

SEQ ID NO: 419304 - DNA, 15 bp, Homo sapiens
ggcagactgttttcc

SEQ ID NO: 419305 - DNA, 15 bp, Homo sapiens
gcagactgttttcca

SEQ ID NO: 419306 - DNA, 15 bp, Homo sapiens
cagactgttttccag

SEQ ID NO: 419307 - DNA, 15 bp, Homo sapiens
agactgttttccaga

SEQ ID NO: 419308 - DNA, 15 bp, Homo sapiens
gactgttttccagag

SEQ ID NO: 419309 - DNA, 15 bp, Homo sapiens
actgttttccagagt

SEQ ID NO: 419310 - DNA, 15 bp, Homo sapiens
ctgttttccagagta

SEQ ID NO: 419311 - DNA, 15 bp, Homo sapiens
tgttttccagagtac

SEQ ID NO: 419312 - DNA, 15 bp, Homo sapiens
gttttccagagtaca

SEQ ID NO: 419313 - DNA, 15 bp, Homo sapiens
ttttccagagtacac

SEQ ID NO: 419314 - DNA, 15 bp, Homo sapiens
tttccagagtacaca

SEQ ID NO: 419315 - DNA, 15 bp, Homo sapiens
ttccagagtacacat

SEQ ID NO: 419316 - DNA, 15 bp, Homo sapiens
tccagagtacacatt

SEQ ID NO: 419317 - DNA, 15 bp, Homo sapiens
ccagagtacacattt

SEQ ID NO: 419318 - DNA, 15 bp, Homo sapiens
cagagtacacatttt

SEQ ID NO: 419319 - DNA, 15 bp, Homo sapiens
agagtacacatttta

SEQ ID NO: 419320 - DNA, 15 bp, Homo sapiens
gagtacacattttat

SEQ ID NO: 419321 - DNA, 15 bp, Homo sapiens
agtacacattttatt

SEQ ID NO: 419322 - DNA, 15 bp, Homo sapiens
gtacacattttattt

SEQ ID NO: 419323 - DNA, 15 bp, Homo sapiens
tacacattttatttt

SEQ ID NO: 419324 - DNA, 15 bp, Homo sapiens
acacattttatttta

SEQ ID NO: 419325 - DNA, 15 bp, Homo sapiens
cacattttattttat

SEQ ID NO: 419326 - DNA, 15 bp, Homo sapiens
acattttattttatt

SEQ ID NO: 419327 - DNA, 15 bp, Homo sapiens
cattttattttatta

SEQ ID NO: 419328 - DNA, 15 bp, Homo sapiens
attttattttattac

SEQ ID NO: 419329 - DNA, 15 bp, Homo sapiens
ttttattttattaca

SEQ ID NO: 419330 - DNA, 15 bp, Homo sapiens
tttattttattacat

SEQ ID NO: 419331 - DNA, 15 bp, Homo sapiens
ttattttattacatt

SEQ ID NO: 419332 - DNA, 15 bp, Homo sapiens
tattttattacattc

SEQ ID NO: 419333 - DNA, 15 bp, Homo sapiens
attttattacattcg

SEQ ID NO: 419334 - DNA, 15 bp, Homo sapiens
ttttattacattcga

SEQ ID NO: 419335 - DNA, 15 bp, Homo sapiens
tttattacattcgac

SEQ ID NO: 419336 - DNA, 15 bp, Homo sapiens
ttattacattcgacc

SEQ ID NO: 419337 - DNA, 15 bp, Homo sapiens
tattacattcgacct

SEQ ID NO: 419338 - DNA, 15 bp, Homo sapiens
attacattcgacctg

SEQ ID NO: 419339 - DNA, 15 bp, Homo sapiens
ttacattcgacctgg

SEQ ID NO: 419340 - DNA, 15 bp, Homo sapiens
tacattcgacctggc

SEQ ID NO: 419341 - DNA, 15 bp, Homo sapiens
acattcgacctggcc

SEQ ID NO: 419342 - DNA, 15 bp, Homo sapiens
cattcgacctggcca

SEQ ID NO: 419343 - DNA, 15 bp, Homo sapiens
attcgacctggccat

SEQ ID NO: 419344 - DNA, 15 bp, Homo sapiens
ttcgacctggccatg

SEQ ID NO: 419345 - DNA, 15 bp, Homo sapiens
tcgacctggccatgt

SEQ ID NO: 419346 - DNA, 15 bp, Homo sapiens
cgacctggccatgtg

SEQ ID NO: 419347 - DNA, 15 bp, Homo sapiens
gacctggccatgtgc

SEQ ID NO: 419348 - DNA, 15 bp, Homo sapiens
acctggccatgtgca

SEQ ID NO: 419349 - DNA, 15 bp, Homo sapiens
cctggccatgtgcat

SEQ ID NO: 419350 - DNA, 15 bp, Homo sapiens
ctggccatgtgcatc

SEQ ID NO: 419351 - DNA, 15 bp, Homo sapiens
tggccatgtgcatct

SEQ ID NO: 419352 - DNA, 15 bp, Homo sapiens
ggccatgtgcatctg

SEQ ID NO: 419353 - DNA, 15 bp, Homo sapiens
gccatgtgcatctga

SEQ ID NO: 419354 - DNA, 15 bp, Homo sapiens
ccatgtgcatctgaa

SEQ ID NO: 419355 - DNA, 15 bp, Homo sapiens
catgtgcatctgaat

SEQ ID NO: 419356 - DNA, 15 bp, Homo sapiens
atgtgcatctgaatg

SEQ ID NO: 419357 - DNA, 15 bp, Homo sapiens
tgtgcatctgaatgc

SEQ ID NO: 419358 - DNA, 15 bp, Homo sapiens
gtgcatctgaatgca

SEQ ID NO: 419359 - DNA, 15 bp, Homo sapiens
tgcatctgaatgcaa

SEQ ID NO: 419360 - DNA, 15 bp, Homo sapiens
gcatctgaatgcaat

SEQ ID NO: 419361 - DNA, 15 bp, Homo sapiens
catctgaatgcaatt

SEQ ID NO: 419362 - DNA, 15 bp, Homo sapiens
atctgaatgcaattg

SEQ ID NO: 419363 - DNA, 15 bp, Homo sapiens
tctgaatgcaattgg

SEQ ID NO: 419364 - DNA, 15 bp, Homo sapiens
ctgaatgcaattggt

SEQ ID NO: 419365 - DNA, 15 bp, Homo sapiens
tgaatgcaattggtt

SEQ ID NO: 419366 - DNA, 15 bp, Homo sapiens
gaatgcaattggttt

SEQ ID NO: 419367 - DNA, 15 bp, Homo sapiens
aatgcaattggtttt

SEQ ID NO: 419368 - DNA, 15 bp, Homo sapiens
atgcaattggttttc

SEQ ID NO: 419369 - DNA, 15 bp, Homo sapiens
tgcaattggttttcc

SEQ ID NO: 419370 - DNA, 15 bp, Homo sapiens
gcaattggttttccc

SEQ ID NO: 419371 - DNA, 15 bp, Homo sapiens
caattggttttcccc

SEQ ID NO: 419372 - DNA, 15 bp, Homo sapiens
aattggttttcccct

SEQ ID NO: 419373 - DNA, 15 bp, Homo sapiens
attggttttccccta

SEQ ID NO: 419374 - DNA, 15 bp, Homo sapiens
ttggttttcccctat

SEQ ID NO: 419375 - DNA, 15 bp, Homo sapiens
tggttttcccctatt

SEQ ID NO: 419376 - DNA, 15 bp, Homo sapiens
ggttttcccctatta

SEQ ID NO: 419377 - DNA, 15 bp, Homo sapiens
gttttcccctattag

SEQ ID NO: 419378 - DNA, 15 bp, Homo sapiens
ttttcccctattagt

SEQ ID NO: 419379 - DNA, 15 bp, Homo sapiens
tttcccctattagtt

SEQ ID NO: 419380 - DNA, 15 bp, Homo sapiens
ttcccctattagtta

SEQ ID NO: 419381 - DNA, 15 bp, Homo sapiens
tcccctattagttag

SEQ ID NO: 419382 - DNA, 15 bp, Homo sapiens
cccctattagttagt

SEQ ID NO: 419383 - DNA, 15 bp, Homo sapiens
ccctattagttagtg

SEQ ID NO: 419384 - DNA, 15 bp, Homo sapiens
cctattagttagtga

SEQ ID NO: 419385 - DNA, 15 bp, Homo sapiens
ctattagttagtgaa

SEQ ID NO: 419386 - DNA, 15 bp, Homo sapiens
tattagttagtgaag

SEQ ID NO: 419387 - DNA, 15 bp, Homo sapiens
attagttagtgaaga

SEQ ID NO: 419388 - DNA, 15 bp, Homo sapiens
ttagttagtgaagag

SEQ ID NO: 419389 - DNA, 15 bp, Homo sapiens
tagttagtgaagagc

SEQ ID NO: 419390 - DNA, 15 bp, Homo sapiens
agttagtgaagagcc

SEQ ID NO: 419391 - DNA, 15 bp, Homo sapiens
gttagtgaagagccc

SEQ ID NO: 419392 - DNA, 15 bp, Homo sapiens
ttagtgaagagccct

SEQ ID NO: 419393 - DNA, 15 bp, Homo sapiens
tagtgaagagccctc

SEQ ID NO: 419394 - DNA, 15 bp, Homo sapiens
agtgaagagccctct

SEQ ID NO: 419395 - DNA, 15 bp, Homo sapiens
gtgaagagccctctg

SEQ ID NO: 419396 - DNA, 15 bp, Homo sapiens
tgaagagccctctgt

SEQ ID NO: 419397 - DNA, 15 bp, Homo sapiens
gaagagccctctgtt

SEQ ID NO: 419398 - DNA, 15 bp, Homo sapiens
aagagccctctgttg

SEQ ID NO: 419399 - DNA, 15 bp, Homo sapiens
agagccctctgttgt

SEQ ID NO: 419400 - DNA, 15 bp, Homo sapiens
gagccctctgttgta

SEQ ID NO: 419401 - DNA, 15 bp, Homo sapiens
agccctctgttgtat

SEQ ID NO: 419402 - DNA, 15 bp, Homo sapiens
gccctctgttgtatc

SEQ ID NO: 419403 - DNA, 15 bp, Homo sapiens
ccctctgttgtatca

SEQ ID NO: 419404 - DNA, 15 bp, Homo sapiens
cctctgttgtatcaa

SEQ ID NO: 419405 - DNA, 15 bp, Homo sapiens
ctctgttgtatcaaa

SEQ ID NO: 419406 - DNA, 15 bp, Homo sapiens
tctgttgtatcaaat

SEQ ID NO: 419407 - DNA, 15 bp, Homo sapiens
ctgttgtatcaaatc

SEQ ID NO: 419408 - DNA, 15 bp, Homo sapiens
tgttgtatcaaatca

SEQ ID NO: 419409 - DNA, 15 bp, Homo sapiens
gttgtatcaaatcaa

SEQ ID NO: 419410 - DNA, 15 bp, Homo sapiens
ttgtatcaaatcaaa

SEQ ID NO: 419411 - DNA, 15 bp, Homo sapiens
tgtatcaaatcaaat

SEQ ID NO: 419412 - DNA, 15 bp, Homo sapiens
gtatcaaatcaaata

SEQ ID NO: 419413 - DNA, 15 bp, Homo sapiens
tatcaaatcaaataa

SEQ ID NO: 419414 - DNA, 15 bp, Homo sapiens
atcaaatcaaataag

SEQ ID NO: 419415 - DNA, 15 bp, Homo sapiens
tcaaatcaaataaga

SEQ ID NO: 419416 - DNA, 15 bp, Homo sapiens
caaatcaaataagaa

SEQ ID NO: 419417 - DNA, 15 bp, Homo sapiens
aaatcaaataagaat

SEQ ID NO: 419418 - DNA, 15 bp, Homo sapiens
aatcaaataagaatt

SEQ ID NO: 419419 - DNA, 15 bp, Homo sapiens
atcaaataagaattg

SEQ ID NO: 419420 - DNA, 15 bp, Homo sapiens
tcaaataagaattgt

SEQ ID NO: 419421 - DNA, 15 bp, Homo sapiens
caaataagaattgtt

SEQ ID NO: 419422 - DNA, 15 bp, Homo sapiens
aaataagaattgttt

SEQ ID NO: 419423 - DNA, 15 bp, Homo sapiens
aataagaattgtttt

SEQ ID NO: 419424 - DNA, 15 bp, Homo sapiens
ataagaattgttttc

SEQ ID NO: 419425 - DNA, 15 bp, Homo sapiens
taagaattgttttca

SEQ ID NO: 419426 - DNA, 15 bp, Homo sapiens
aagaattgttttcaa

SEQ ID NO: 419427 - DNA, 15 bp, Homo sapiens
agaattgttttcaac

SEQ ID NO: 419428 - DNA, 15 bp, Homo sapiens
gaattgttttcaacc

SEQ ID NO: 419429 - DNA, 15 bp, Homo sapiens
aattgttttcaacct

SEQ ID NO: 419430 - DNA, 15 bp, Homo sapiens
attgttttcaacctc

SEQ ID NO: 419431 - DNA, 15 bp, Homo sapiens
ttgttttcaacctca

SEQ ID NO: 419432 - DNA, 15 bp, Homo sapiens
tgttttcaacctcat

SEQ ID NO: 419433 - DNA, 15 bp, Homo sapiens
gttttcaacctcatc

SEQ ID NO: 419434 - DNA, 15 bp, Homo sapiens
ttttcaacctcatca

SEQ ID NO: 419435 - DNA, 15 bp, Homo sapiens
tttcaacctcatcag

SEQ ID NO: 419436 - DNA, 15 bp, Homo sapiens
ttcaacctcatcagt

SEQ ID NO: 419437 - DNA, 15 bp, Homo sapiens
tcaacctcatcagta

SEQ ID NO: 419438 - DNA, 15 bp, Homo sapiens
caacctcatcagtaa

SEQ ID NO: 419439 - DNA, 15 bp, Homo sapiens
aacctcatcagtaag

SEQ ID NO: 419440 - DNA, 15 bp, Homo sapiens
acctcatcagtaaga

SEQ ID NO: 419441 - DNA, 15 bp, Homo sapiens
cctcatcagtaagat

SEQ ID NO: 419442 - DNA, 15 bp, Homo sapiens
ctcatcagtaagatg

SEQ ID NO: 419443 - DNA, 15 bp, Homo sapiens
tcatcagtaagatgg

SEQ ID NO: 419444 - DNA, 15 bp, Homo sapiens
catcagtaagatggc

SEQ ID NO: 419445 - DNA, 15 bp, Homo sapiens
atcagtaagatggct

SEQ ID NO: 419446 - DNA, 15 bp, Homo sapiens
tcagtaagatggctc

SEQ ID NO: 419447 - DNA, 15 bp, Homo sapiens
cagtaagatggctct

SEQ ID NO: 419448 - DNA, 15 bp, Homo sapiens
agtaagatggctctc

SEQ ID NO: 419449 - DNA, 15 bp, Homo sapiens
gtaagatggctctcc

SEQ ID NO: 419450 - DNA, 15 bp, Homo sapiens
taagatggctctcct

SEQ ID NO: 419451 - DNA, 15 bp, Homo sapiens
aagatggctctcctt

SEQ ID NO: 419452 - DNA, 15 bp, Homo sapiens
agatggctctccttc

SEQ ID NO: 419453 - DNA, 15 bp, Homo sapiens
gatggctctccttca

SEQ ID NO: 419454 - DNA, 15 bp, Homo sapiens
atggctctccttcac

SEQ ID NO: 419455 - DNA, 15 bp, Homo sapiens
tggctctccttcaca

SEQ ID NO: 419456 - DNA, 15 bp, Homo sapiens
ggctctccttcacat

SEQ ID NO: 419457 - DNA, 15 bp, Homo sapiens
gctctccttcacatt

SEQ ID NO: 419458 - DNA, 15 bp, Homo sapiens
ctctccttcacatta

SEQ ID NO: 419459 - DNA, 15 bp, Homo sapiens
tctccttcacattaa

SEQ ID NO: 419460 - DNA, 15 bp, Homo sapiens
ctccttcacattaag

SEQ ID NO: 419461 - DNA, 15 bp, Homo sapiens
tccttcacattaagg

SEQ ID NO: 419462 - DNA, 15 bp, Homo sapiens
ccttcacattaaggt

SEQ ID NO: 419463 - DNA, 15 bp, Homo sapiens
cttcacattaaggtt

SEQ ID NO: 419464 - DNA, 15 bp, Homo sapiens
ttcacattaaggtta

SEQ ID NO: 419465 - DNA, 15 bp, Homo sapiens
tcacattaaggttat

SEQ ID NO: 419466 - DNA, 15 bp, Homo sapiens
cacattaaggttatg

SEQ ID NO: 419467 - DNA, 15 bp, Homo sapiens
acattaaggttatga

SEQ ID NO: 419468 - DNA, 15 bp, Homo sapiens
cattaaggttatgag

SEQ ID NO: 419469 - DNA, 15 bp, Homo sapiens
attaaggttatgagt

SEQ ID NO: 419470 - DNA, 15 bp, Homo sapiens
ttaaggttatgagtc

SEQ ID NO: 419471 - DNA, 15 bp, Homo sapiens
taaggttatgagtcc

SEQ ID NO: 419472 - DNA, 15 bp, Homo sapiens
aaggttatgagtcct

SEQ ID NO: 419473 - DNA, 15 bp, Homo sapiens
aggttatgagtccta

SEQ ID NO: 419474 - DNA, 15 bp, Homo sapiens
ggttatgagtcctat

SEQ ID NO: 419475 - DNA, 15 bp, Homo sapiens
gttatgagtcctatc

SEQ ID NO: 419476 - DNA, 15 bp, Homo sapiens
ttatgagtcctatcc

SEQ ID NO: 419477 - DNA, 15 bp, Homo sapiens
tatgagtcctatcca

SEQ ID NO: 419478 - DNA, 15 bp, Homo sapiens
atgagtcctatccag

SEQ ID NO: 419479 - DNA, 15 bp, Homo sapiens
tgagtcctatccagg

SEQ ID NO: 419480 - DNA, 15 bp, Homo sapiens
gagtcctatccaggg

SEQ ID NO: 419481 - DNA, 15 bp, Homo sapiens
agtcctatccagggg

SEQ ID NO: 419482 - DNA, 15 bp, Homo sapiens
gtcctatccaggggg

SEQ ID NO: 419483 - DNA, 15 bp, Homo sapiens
tcctatccagggggg

SEQ ID NO: 419484 - DNA, 15 bp, Homo sapiens
cctatccaggggggt

SEQ ID NO: 419485 - DNA, 15 bp, Homo sapiens
ctatccaggggggtg

SEQ ID NO: 419486 - DNA, 15 bp, Homo sapiens
tatccaggggggtgc

SEQ ID NO: 419487 - DNA, 15 bp, Homo sapiens
atccaggggggtgcc

SEQ ID NO: 419488 - DNA, 15 bp, Homo sapiens
tccaggggggtgcct

SEQ ID NO: 419489 - DNA, 15 bp, Homo sapiens
ccaggggggtgcctt

SEQ ID NO: 419490 - DNA, 15 bp, Homo sapiens
caggggggtgccttc

SEQ ID NO: 419491 - DNA, 15 bp, Homo sapiens
aggggggtgccttcc

SEQ ID NO: 419492 - DNA, 15 bp, Homo sapiens
ggggggtgccttcct

SEQ ID NO: 419493 - DNA, 15 bp, Homo sapiens
gggggtgccttcctt

SEQ ID NO: 419494 - DNA, 15 bp, Homo sapiens
ggggtgccttccttc

SEQ ID NO: 419495 - DNA, 15 bp, Homo sapiens
gggtgccttccttca

SEQ ID NO: 419496 - DNA, 15 bp, Homo sapiens
ggtgccttccttcat

SEQ ID NO: 419497 - DNA, 15 bp, Homo sapiens
gtgccttccttcatt

SEQ ID NO: 419498 - DNA, 15 bp, Homo sapiens
tgccttccttcatta

SEQ ID NO: 419499 - DNA, 15 bp, Homo sapiens
gccttccttcattag

SEQ ID NO: 419500 - DNA, 15 bp, Homo sapiens
ccttccttcattagc

SEQ ID NO: 419501 - DNA, 15 bp, Homo sapiens
cttccttcattagct

SEQ ID NO: 419502 - DNA, 15 bp, Homo sapiens
ttccttcattagctt

SEQ ID NO: 419503 - DNA, 15 bp, Homo sapiens
tccttcattagctta

SEQ ID NO: 419504 - DNA, 15 bp, Homo sapiens
ccttcattagcttat

SEQ ID NO: 419505 - DNA, 15 bp, Homo sapiens
cttcattagcttatt

SEQ ID NO: 419506 - DNA, 15 bp, Homo sapiens
ttcattagcttatta

SEQ ID NO: 419507 - DNA, 15 bp, Homo sapiens
tcattagcttattat

SEQ ID NO: 419508 - DNA, 15 bp, Homo sapiens
cattagcttattata

SEQ ID NO: 419509 - DNA, 15 bp, Homo sapiens
attagcttattatat

SEQ ID NO: 419510 - DNA, 15 bp, Homo sapiens
ttagcttattatata

SEQ ID NO: 419511 - DNA, 15 bp, Homo sapiens
tagcttattatatac

SEQ ID NO: 419512 - DNA, 15 bp, Homo sapiens
agcttattatatact

SEQ ID NO: 419513 - DNA, 15 bp, Homo sapiens
gcttattatatactg

SEQ ID NO: 419514 - DNA, 15 bp, Homo sapiens
cttattatatactgg

SEQ ID NO: 419515 - DNA, 15 bp, Homo sapiens
ttattatatactgga

SEQ ID NO: 419516 - DNA, 15 bp, Homo sapiens
tattatatactggac

SEQ ID NO: 419517 - DNA, 15 bp, Homo sapiens
attatatactggacc

SEQ ID NO: 419518 - DNA, 15 bp, Homo sapiens
ttatatactggacct

SEQ ID NO: 419519 - DNA, 15 bp, Homo sapiens
tatatactggacctg

SEQ ID NO: 419520 - DNA, 15 bp, Homo sapiens
atatactggacctgt

SEQ ID NO: 419521 - DNA, 15 bp, Homo sapiens
tatactggacctgtc

SEQ ID NO: 419522 - DNA, 15 bp, Homo sapiens
atactggacctgtct

SEQ ID NO: 419523 - DNA, 15 bp, Homo sapiens
tactggacctgtcta

SEQ ID NO: 419524 - DNA, 15 bp, Homo sapiens
actggacctgtctat

SEQ ID NO: 419525 - DNA, 15 bp, Homo sapiens
ctggacctgtctatc

SEQ ID NO: 419526 - DNA, 15 bp, Homo sapiens
tggacctgtctatct

SEQ ID NO: 419527 - DNA, 15 bp, Homo sapiens
ggacctgtctatcta

SEQ ID NO: 419528 - DNA, 15 bp, Homo sapiens
gacctgtctatctac

SEQ ID NO: 419529 - DNA, 15 bp, Homo sapiens
acctgtctatctact

SEQ ID NO: 419530 - DNA, 15 bp, Homo sapiens
cctgtctatctactg

SEQ ID NO: 419531 - DNA, 15 bp, Homo sapiens
ctgtctatctactgt

SEQ ID NO: 419532 - DNA, 15 bp, Homo sapiens
tgtctatctactgtt

SEQ ID NO: 419533 - DNA, 15 bp, Homo sapiens
gtctatctactgtta

SEQ ID NO: 419534 - DNA, 15 bp, Homo sapiens
tctatctactgttat

SEQ ID NO: 419535 - DNA, 15 bp, Homo sapiens
ctatctactgttatt

SEQ ID NO: 419536 - DNA, 15 bp, Homo sapiens
tatctactgttattt

SEQ ID NO: 419537 - DNA, 15 bp, Homo sapiens
atctactgttattta

SEQ ID NO: 419538 - DNA, 15 bp, Homo sapiens
tctactgttatttaa

SEQ ID NO: 419539 - DNA, 15 bp, Homo sapiens
ctactgttatttaac

SEQ ID NO: 419540 - DNA, 15 bp, Homo sapiens
tactgttatttaact

SEQ ID NO: 419541 - DNA, 15 bp, Homo sapiens
actgttatttaactt

SEQ ID NO: 419542 - DNA, 15 bp, Homo sapiens
ctgttatttaacttt

SEQ ID NO: 419543 - DNA, 15 bp, Homo sapiens
tgttatttaacttta

SEQ ID NO: 419544 - DNA, 15 bp, Homo sapiens
gttatttaactttac

SEQ ID NO: 419545 - DNA, 15 bp, Homo sapiens
ttatttaactttaca

SEQ ID NO: 419546 - DNA, 15 bp, Homo sapiens
tatttaactttacag

SEQ ID NO: 419547 - DNA, 15 bp, Homo sapiens
atttaactttacagt

SEQ ID NO: 419548 - DNA, 15 bp, Homo sapiens
tttaactttacagtt

SEQ ID NO: 419549 - DNA, 15 bp, Homo sapiens
ttaactttacagttt

SEQ ID NO: 419550 - DNA, 15 bp, Homo sapiens
taactttacagtttt

SEQ ID NO: 419551 - DNA, 15 bp, Homo sapiens
aactttacagtttta

SEQ ID NO: 419552 - DNA, 15 bp, Homo sapiens
actttacagttttat

SEQ ID NO: 419553 - DNA, 15 bp, Homo sapiens
ctttacagttttatc

SEQ ID NO: 419554 - DNA, 15 bp, Homo sapiens
tttacagttttatcc

SEQ ID NO: 419555 - DNA, 15 bp, Homo sapiens
ttacagttttatcca

SEQ ID NO: 419556 - DNA, 15 bp, Homo sapiens
tacagttttatccag

SEQ ID NO: 419557 - DNA, 15 bp, Homo sapiens
acagttttatccagt

SEQ ID NO: 419558 - DNA, 15 bp, Homo sapiens
cagttttatccagtt

SEQ ID NO: 419559 - DNA, 15 bp, Homo sapiens
agttttatccagttc

SEQ ID NO: 419560 - DNA, 15 bp, Homo sapiens
gttttatccagttca

SEQ ID NO: 419561 - DNA, 15 bp, Homo sapiens
ttttatccagttcat

SEQ ID NO: 419562 - DNA, 15 bp, Homo sapiens
tttatccagttcatt

SEQ ID NO: 419563 - DNA, 15 bp, Homo sapiens
ttatccagttcattt

SEQ ID NO: 419564 - DNA, 15 bp, Homo sapiens
tatccagttcatttt

SEQ ID NO: 419565 - DNA, 15 bp, Homo sapiens
atccagttcattttt

SEQ ID NO: 419566 - DNA, 15 bp, Homo sapiens
tccagttcattttta

SEQ ID NO: 419567 - DNA, 15 bp, Homo sapiens
ccagttcatttttat

SEQ ID NO: 419568 - DNA, 15 bp, Homo sapiens
cagttcatttttatt

SEQ ID NO: 419569 - DNA, 15 bp, Homo sapiens
agttcatttttattt

SEQ ID NO: 419570 - DNA, 15 bp, Homo sapiens
gttcatttttatttt

SEQ ID NO: 419571 - DNA, 15 bp, Homo sapiens
catttttatttttta

SEQ ID NO: 419572 - DNA, 15 bp, Homo sapiens
atttttattttttac

SEQ ID NO: 419573 - DNA, 15 bp, Homo sapiens
tttttattttttact

SEQ ID NO: 419574 - DNA, 15 bp, Homo sapiens
ttttattttttactt

SEQ ID NO: 419575 - DNA, 15 bp, Homo sapiens
tttattttttactta

SEQ ID NO: 419576 - DNA, 15 bp, Homo sapiens
ttattttttacttat

SEQ ID NO: 419577 - DNA, 15 bp, Homo sapiens
tattttttacttatt

SEQ ID NO: 419578 - DNA, 15 bp, Homo sapiens
attttttacttattt

SEQ ID NO: 419579 - DNA, 15 bp, Homo sapiens
ttttttacttattta

SEQ ID NO: 419580 - DNA, 15 bp, Homo sapiens
tttttacttatttat

SEQ ID NO: 419581 - DNA, 15 bp, Homo sapiens
ttttacttatttatt

SEQ ID NO: 419582 - DNA, 15 bp, Homo sapiens
tttacttatttattt

SEQ ID NO: 419583 - DNA, 15 bp, Homo sapiens
ttacttatttatttt

SEQ ID NO: 419584 - DNA, 15 bp, Homo sapiens
tacttatttattttt

SEQ ID NO: 419585 - DNA, 15 bp, Homo sapiens
acttatttatttttt

SEQ ID NO: 419586 - DNA, 15 bp, Homo sapiens
cttatttatttttta

SEQ ID NO: 419587 - DNA, 15 bp, Homo sapiens
tatttattttttaaa

SEQ ID NO: 419588 - DNA, 15 bp, Homo sapiens
atttattttttaaaa

SEQ ID NO: 419589 - DNA, 15 bp, Homo sapiens
tttattttttaaaag

SEQ ID NO: 419590 - DNA, 15 bp, Homo sapiens
ttattttttaaaagt

SEQ ID NO: 419591 - DNA, 15 bp, Homo sapiens
tattttttaaaagtt

SEQ ID NO: 419592 - DNA, 15 bp, Homo sapiens
attttttaaaagttt

SEQ ID NO: 419593 - DNA, 15 bp, Homo sapiens
ttttttaaaagtttt

SEQ ID NO: 419594 - DNA, 15 bp, Homo sapiens
tttttaaaagtttta

SEQ ID NO: 419595 - DNA, 15 bp, Homo sapiens
ttttaaaagttttac

SEQ ID NO: 419596 - DNA, 15 bp, Homo sapiens
tttaaaagttttaca

SEQ ID NO: 419597 - DNA, 15 bp, Homo sapiens
ttaaaagttttacaa

SEQ ID NO: 419598 - DNA, 15 bp, Homo sapiens
taaaagttttacaat

SEQ ID NO: 419599 - DNA, 15 bp, Homo sapiens
aaaagttttacaatt

SEQ ID NO: 419600 - DNA, 15 bp, Homo sapiens
aaagttttacaattt

SEQ ID NO: 419601 - DNA, 15 bp, Homo sapiens
aagttttacaatttc

SEQ ID NO: 419602 - DNA, 15 bp, Homo sapiens
agttttacaatttca

SEQ ID NO: 419603 - DNA, 15 bp, Homo sapiens
gttttacaatttcag

SEQ ID NO: 419604 - DNA, 15 bp, Homo sapiens
ttttacaatttcagt

SEQ ID NO: 419605 - DNA, 15 bp, Homo sapiens
tttacaatttcagta

SEQ ID NO: 419606 - DNA, 15 bp, Homo sapiens
ttacaatttcagtag

SEQ ID NO: 419607 - DNA, 15 bp, Homo sapiens
tacaatttcagtagc

SEQ ID NO: 419608 - DNA, 15 bp, Homo sapiens
acaatttcagtagct

SEQ ID NO: 419609 - DNA, 15 bp, Homo sapiens
caatttcagtagctt

SEQ ID NO: 419610 - DNA, 15 bp, Homo sapiens
aatttcagtagcttt

SEQ ID NO: 419611 - DNA, 15 bp, Homo sapiens
atttcagtagcttta

SEQ ID NO: 419612 - DNA, 15 bp, Homo sapiens
tttcagtagctttaa

SEQ ID NO: 419613 - DNA, 15 bp, Homo sapiens
ttcagtagctttaag

SEQ ID NO: 419614 - DNA, 15 bp, Homo sapiens
tcagtagctttaagg

SEQ ID NO: 419615 - DNA, 15 bp, Homo sapiens
cagtagctttaaggg

SEQ ID NO: 419616 - DNA, 15 bp, Homo sapiens
agtagctttaagggt

SEQ ID NO: 419617 - DNA, 15 bp, Homo sapiens
gtagctttaagggta

SEQ ID NO: 419618 - DNA, 15 bp, Homo sapiens
tagctttaagggtac

SEQ ID NO: 419619 - DNA, 15 bp, Homo sapiens
agctttaagggtaca

SEQ ID NO: 419620 - DNA, 15 bp, Homo sapiens
gctttaagggtacag

SEQ ID NO: 419621 - DNA, 15 bp, Homo sapiens
ctttaagggtacagg

SEQ ID NO: 419622 - DNA, 15 bp, Homo sapiens
tttaagggtacaggt

SEQ ID NO: 419623 - DNA, 15 bp, Homo sapiens
ttaagggtacaggtg

SEQ ID NO: 419624 - DNA, 15 bp, Homo sapiens
taagggtacaggtga

SEQ ID NO: 419625 - DNA, 15 bp, Homo sapiens
aagggtacaggtgat

SEQ ID NO: 419626 - DNA, 15 bp, Homo sapiens
agggtacaggtgatt

SEQ ID NO: 419627 - DNA, 15 bp, Homo sapiens
gggtacaggtgattt

SEQ ID NO: 419628 - DNA, 15 bp, Homo sapiens
ggtacaggtgatttt

SEQ ID NO: 419629 - DNA, 15 bp, Homo sapiens
gtacaggtgatttta

SEQ ID NO: 419630 - DNA, 15 bp, Homo sapiens
tacaggtgattttag

SEQ ID NO: 419631 - DNA, 15 bp, Homo sapiens
acaggtgattttagt

SEQ ID NO: 419632 - DNA, 15 bp, Homo sapiens
caggtgattttagtt

SEQ ID NO: 419633 - DNA, 15 bp, Homo sapiens
aggtgattttagtta

SEQ ID NO: 419634 - DNA, 15 bp, Homo sapiens
ggtgattttagttac

SEQ ID NO: 419635 - DNA, 15 bp, Homo sapiens
gtgattttagttaca

SEQ ID NO: 419636 - DNA, 15 bp, Homo sapiens
tgattttagttacaa

SEQ ID NO: 419637 - DNA, 15 bp, Homo sapiens
gattttagttacaag

SEQ ID NO: 419638 - DNA, 15 bp, Homo sapiens
attttagttacaagg

SEQ ID NO: 419639 - DNA, 15 bp, Homo sapiens
ttttagttacaagga

SEQ ID NO: 419640 - DNA, 15 bp, Homo sapiens
tttagttacaaggat

SEQ ID NO: 419641 - DNA, 15 bp, Homo sapiens
ttagttacaaggatg

SEQ ID NO: 419642 - DNA, 15 bp, Homo sapiens
tagttacaaggatga

SEQ ID NO: 419643 - DNA, 15 bp, Homo sapiens
agttacaaggatgaa

SEQ ID NO: 419644 - DNA, 15 bp, Homo sapiens
gttacaaggatgaat

SEQ ID NO: 419645 - DNA, 15 bp, Homo sapiens
ttacaaggatgaatt

SEQ ID NO: 419646 - DNA, 15 bp, Homo sapiens
tacaaggatgaattg

SEQ ID NO: 419647 - DNA, 15 bp, Homo sapiens
acaaggatgaattgt

SEQ ID NO: 419648 - DNA, 15 bp, Homo sapiens
caaggatgaattgta

SEQ ID NO: 419649 - DNA, 15 bp, Homo sapiens
aaggatgaattgtat

SEQ ID NO: 419650 - DNA, 15 bp, Homo sapiens
aggatgaattgtata

SEQ ID NO: 419651 - DNA, 15 bp, Homo sapiens
ggatgaattgtatag

SEQ ID NO: 419652 - DNA, 15 bp, Homo sapiens
gatgaattgtatagc

SEQ ID NO: 419653 - DNA, 15 bp, Homo sapiens
atgaattgtatagcg

SEQ ID NO: 419654 - DNA, 15 bp, Homo sapiens
tgaattgtatagcgg

SEQ ID NO: 419655 - DNA, 15 bp, Homo sapiens
gaattgtatagcggt

SEQ ID NO: 419656 - DNA, 15 bp, Homo sapiens
aattgtatagcggtg

SEQ ID NO: 419657 - DNA, 15 bp, Homo sapiens
attgtatagcggtga

SEQ ID NO: 419658 - DNA, 15 bp, Homo sapiens
ttgtatagcggtgaa

SEQ ID NO: 419659 - DNA, 15 bp, Homo sapiens
tgtatagcggtgaag

SEQ ID NO: 419660 - DNA, 15 bp, Homo sapiens
gtatagcggtgaagt

SEQ ID NO: 419661 - DNA, 15 bp, Homo sapiens
tatagcggtgaagtc

SEQ ID NO: 419662 - DNA, 15 bp, Homo sapiens
atagcggtgaagtct

SEQ ID NO: 419663 - DNA, 15 bp, Homo sapiens
tagcggtgaagtctg

SEQ ID NO: 419664 - DNA, 15 bp, Homo sapiens
agcggtgaagtctga

SEQ ID NO: 419665 - DNA, 15 bp, Homo sapiens
gcggtgaagtctgag

SEQ ID NO: 419666 - DNA, 15 bp, Homo sapiens
cggtgaagtctgaga

SEQ ID NO: 419667 - DNA, 15 bp, Homo sapiens
ggtgaagtctgagat

SEQ ID NO: 419668 - DNA, 15 bp, Homo sapiens
gtgaagtctgagatt

SEQ ID NO: 419669 - DNA, 15 bp, Homo sapiens
tgaagtctgagattt

SEQ ID NO: 419670 - DNA, 15 bp, Homo sapiens
gaagtctgagatttt

SEQ ID NO: 419671 - DNA, 15 bp, Homo sapiens
aagtctgagatttta

SEQ ID NO: 419672 - DNA, 15 bp, Homo sapiens
agtctgagattttag

SEQ ID NO: 419673 - DNA, 15 bp, Homo sapiens
gtctgagattttagt

SEQ ID NO: 419674 - DNA, 15 bp, Homo sapiens
tctgagattttagtg

SEQ ID NO: 419675 - DNA, 15 bp, Homo sapiens
ctgagattttagtgc

SEQ ID NO: 419676 - DNA, 15 bp, Homo sapiens
tgagattttagtgca

SEQ ID NO: 419677 - DNA, 15 bp, Homo sapiens
gagattttagtgcac

SEQ ID NO: 419678 - DNA, 15 bp, Homo sapiens
agattttagtgcacc

SEQ ID NO: 419679 - DNA, 15 bp, Homo sapiens
gattttagtgcaccc

SEQ ID NO: 419680 - DNA, 15 bp, Homo sapiens
attttagtgcaccca

SEQ ID NO: 419681 - DNA, 15 bp, Homo sapiens
ttttagtgcacccat

SEQ ID NO: 419682 - DNA, 15 bp, Homo sapiens
tttagtgcacccatc

SEQ ID NO: 419683 - DNA, 15 bp, Homo sapiens
ttagtgcacccatca

SEQ ID NO: 419684 - DNA, 15 bp, Homo sapiens
tagtgcacccatcac

SEQ ID NO: 419685 - DNA, 15 bp, Homo sapiens
agtgcacccatcact

SEQ ID NO: 419686 - DNA, 15 bp, Homo sapiens
gtgcacccatcactt

SEQ ID NO: 419687 - DNA, 15 bp, Homo sapiens
tgcacccatcacttg

SEQ ID NO: 419688 - DNA, 15 bp, Homo sapiens
gcacccatcacttga

SEQ ID NO: 419689 - DNA, 15 bp, Homo sapiens
cacccatcacttgag

SEQ ID NO: 419690 - DNA, 15 bp, Homo sapiens
acccatcacttgagt

SEQ ID NO: 419691 - DNA, 15 bp, Homo sapiens
cccatcacttgagta

SEQ ID NO: 419692 - DNA, 15 bp, Homo sapiens
ccatcacttgagtac

SEQ ID NO: 419693 - DNA, 15 bp, Homo sapiens
catcacttgagtact

SEQ ID NO: 419694 - DNA, 15 bp, Homo sapiens
atcacttgagtactg

SEQ ID NO: 419695 - DNA, 15 bp, Homo sapiens
tcacttgagtactgt

SEQ ID NO: 419696 - DNA, 15 bp, Homo sapiens
cacttgagtactgta

SEQ ID NO: 419697 - DNA, 15 bp, Homo sapiens
acttgagtactgtac

SEQ ID NO: 419698 - DNA, 15 bp, Homo sapiens
cttgagtactgtaca

SEQ ID NO: 419699 - DNA, 15 bp, Homo sapiens
ttgagtactgtacat

SEQ ID NO: 419700 - DNA, 15 bp, Homo sapiens
tgagtactgtacatt

SEQ ID NO: 419701 - DNA, 15 bp, Homo sapiens
gagtactgtacattg

SEQ ID NO: 419702 - DNA, 15 bp, Homo sapiens
agtactgtacattgt

SEQ ID NO: 419703 - DNA, 15 bp, Homo sapiens
gtactgtacattgta

SEQ ID NO: 419704 - DNA, 15 bp, Homo sapiens
tactgtacattgtac

SEQ ID NO: 419705 - DNA, 15 bp, Homo sapiens
actgtacattgtacc

SEQ ID NO: 419706 - DNA, 15 bp, Homo sapiens
ctgtacattgtaccc

SEQ ID NO: 419707 - DNA, 15 bp, Homo sapiens
tacattgtacccatt

SEQ ID NO: 419708 - DNA, 15 bp, Homo sapiens
acattgtacccattt

SEQ ID NO: 419709 - DNA, 15 bp, Homo sapiens
cattgtacccatttt

SEQ ID NO: 419710 - DNA, 15 bp, Homo sapiens
attgtacccattttg

SEQ ID NO: 419711 - DNA, 15 bp, Homo sapiens
ttgtacccattttgt

SEQ ID NO: 419712 - DNA, 15 bp, Homo sapiens
tgtacccattttgta

SEQ ID NO: 419713 - DNA, 15 bp, Homo sapiens
gtacccattttgtag

SEQ ID NO: 419714 - DNA, 15 bp, Homo sapiens
tacccattttgtagt

SEQ ID NO: 419715 - DNA, 15 bp, Homo sapiens
acccattttgtagtt

SEQ ID NO: 419716 - DNA, 15 bp, Homo sapiens
cccattttgtagttt

SEQ ID NO: 419717 - DNA, 15 bp, Homo sapiens
ccattttgtagtttt

SEQ ID NO: 419718 - DNA, 15 bp, Homo sapiens
cattttgtagtttta

SEQ ID NO: 419719 - DNA, 15 bp, Homo sapiens
attttgtagttttat

SEQ ID NO: 419720 - DNA, 15 bp, Homo sapiens
ttttgtagttttatt

SEQ ID NO: 419721 - DNA, 15 bp, Homo sapiens
tttgtagttttattt

SEQ ID NO: 419722 - DNA, 15 bp, Homo sapiens
ttgtagttttatttt

SEQ ID NO: 419723 - DNA, 15 bp, Homo sapiens
tgtagttttattttt

SEQ ID NO: 419724 - DNA, 15 bp, Homo sapiens
gtagttttatttttt

SEQ ID NO: 419725 - DNA, 15 bp, Homo sapiens
tagttttattttttt

SEQ ID NO: 419726 - DNA, 15 bp, Homo sapiens
gttttatttttttta

SEQ ID NO: 419727 - DNA, 15 bp, Homo sapiens
ttttattttttttat

SEQ ID NO: 419728 - DNA, 15 bp, Homo sapiens
tttattttttttatc

SEQ ID NO: 419729 - DNA, 15 bp, Homo sapiens
ttattttttttatcc

SEQ ID NO: 419730 - DNA, 15 bp, Homo sapiens
tattttttttatccc

SEQ ID NO: 419731 - DNA, 15 bp, Homo sapiens
attttttttatccct

SEQ ID NO: 419732 - DNA, 15 bp, Homo sapiens
ttttttttatccctc

SEQ ID NO: 419733 - DNA, 15 bp, Homo sapiens
tttttttatccctca

SEQ ID NO: 419734 - DNA, 15 bp, Homo sapiens
ttttttatccctcac

SEQ ID NO: 419735 - DNA, 15 bp, Homo sapiens
tttttatccctcact

SEQ ID NO: 419736 - DNA, 15 bp, Homo sapiens
ttttatccctcactg

SEQ ID NO: 419737 - DNA, 15 bp, Homo sapiens
tttatccctcactgc

SEQ ID NO: 419738 - DNA, 15 bp, Homo sapiens
ttatccctcactgcc

SEQ ID NO: 419739 - DNA, 15 bp, Homo sapiens
tatccctcactgcct

SEQ ID NO: 419740 - DNA, 15 bp, Homo sapiens
atccctcactgcctt

SEQ ID NO: 419741 - DNA, 15 bp, Homo sapiens
tccctcactgccttg

SEQ ID NO: 419742 - DNA, 15 bp, Homo sapiens
ccctcactgccttgg

SEQ ID NO: 419743 - DNA, 15 bp, Homo sapiens
cctcactgccttggt

SEQ ID NO: 419744 - DNA, 15 bp, Homo sapiens
ctcactgccttggta

SEQ ID NO: 419745 - DNA, 15 bp, Homo sapiens
tcactgccttggtaa

SEQ ID NO: 419746 - DNA, 15 bp, Homo sapiens
cactgccttggtaac

SEQ ID NO: 419747 - DNA, 15 bp, Homo sapiens
actgccttggtaacc

SEQ ID NO: 419748 - DNA, 15 bp, Homo sapiens
ctgccttggtaacct

SEQ ID NO: 419749 - DNA, 15 bp, Homo sapiens
tgccttggtaacctc

SEQ ID NO: 419750 - DNA, 15 bp, Homo sapiens
gccttggtaacctcc

SEQ ID NO: 419751 - DNA, 15 bp, Homo sapiens
ccttggtaacctccc

SEQ ID NO: 419752 - DNA, 15 bp, Homo sapiens
cttggtaacctcccc

SEQ ID NO: 419753 - DNA, 15 bp, Homo sapiens
ttggtaacctccccg

SEQ ID NO: 419754 - DNA, 15 bp, Homo sapiens
tggtaacctccccga

SEQ ID NO: 419755 - DNA, 15 bp, Homo sapiens
ggtaacctccccgac

SEQ ID NO: 419756 - DNA, 15 bp, Homo sapiens
gtaacctccccgacc

SEQ ID NO: 419757 - DNA, 15 bp, Homo sapiens
taacctccccgacct

SEQ ID NO: 419758 - DNA, 15 bp, Homo sapiens
aacctccccgacctc

SEQ ID NO: 419759 - DNA, 15 bp, Homo sapiens
acctccccgacctct

SEQ ID NO: 419760 - DNA, 15 bp, Homo sapiens
cctccccgacctctg

SEQ ID NO: 419761 - DNA, 15 bp, Homo sapiens
ctccccgacctctga

SEQ ID NO: 419762 - DNA, 15 bp, Homo sapiens
tccccgacctctgag

SEQ ID NO: 419763 - DNA, 15 bp, Homo sapiens
ccccgacctctgagt

SEQ ID NO: 419764 - DNA, 15 bp, Homo sapiens
cccgacctctgagtc

SEQ ID NO: 419765 - DNA, 15 bp, Homo sapiens
ccgacctctgagtct

SEQ ID NO: 419766 - DNA, 15 bp, Homo sapiens
cgacctctgagtctc

SEQ ID NO: 419767 - DNA, 15 bp, Homo sapiens
gacctctgagtctca

SEQ ID NO: 419768 - DNA, 15 bp, Homo sapiens
acctctgagtctcat

SEQ ID NO: 419769 - DNA, 15 bp, Homo sapiens
cctctgagtctcata

SEQ ID NO: 419770 - DNA, 15 bp, Homo sapiens
ctctgagtctcatat

SEQ ID NO: 419771 - DNA, 15 bp, Homo sapiens
tctgagtctcatatg

SEQ ID NO: 419772 - DNA, 15 bp, Homo sapiens
ctgagtctcatatgt

SEQ ID NO: 419773 - DNA, 15 bp, Homo sapiens
tgagtctcatatgtc

SEQ ID NO: 419774 - DNA, 15 bp, Homo sapiens
gagtctcatatgtcc

SEQ ID NO: 419775 - DNA, 15 bp, Homo sapiens
agtctcatatgtcca

SEQ ID NO: 419776 - DNA, 15 bp, Homo sapiens
gtctcatatgtccat

SEQ ID NO: 419777 - DNA, 15 bp, Homo sapiens
tctcatatgtccatt

SEQ ID NO: 419778 - DNA, 15 bp, Homo sapiens
ctcatatgtccatta

SEQ ID NO: 419779 - DNA, 15 bp, Homo sapiens
tcatatgtccattat

SEQ ID NO: 419780 - DNA, 15 bp, Homo sapiens
catatgtccattata

SEQ ID NO: 419781 - DNA, 15 bp, Homo sapiens
atatgtccattatat

SEQ ID NO: 419782 - DNA, 15 bp, Homo sapiens
tatgtccattatatc

SEQ ID NO: 419783 - DNA, 15 bp, Homo sapiens
atgtccattatatca

SEQ ID NO: 419784 - DNA, 15 bp, Homo sapiens
tgtccattatatcac

SEQ ID NO: 419785 - DNA, 15 bp, Homo sapiens
gtccattatatcact

SEQ ID NO: 419786 - DNA, 15 bp, Homo sapiens
tccattatatcactg

SEQ ID NO: 419787 - DNA, 15 bp, Homo sapiens
ccattatatcactgt

SEQ ID NO: 419788 - DNA, 15 bp, Homo sapiens
cattatatcactgtg

SEQ ID NO: 419789 - DNA, 15 bp, Homo sapiens
attatatcactgtgt

SEQ ID NO: 419790 - DNA, 15 bp, Homo sapiens
ttatatcactgtgta

SEQ ID NO: 419791 - DNA, 15 bp, Homo sapiens
tatatcactgtgtat

SEQ ID NO: 419792 - DNA, 15 bp, Homo sapiens
atatcactgtgtatg

SEQ ID NO: 419793 - DNA, 15 bp, Homo sapiens
tatcactgtgtatgc

SEQ ID NO: 419794 - DNA, 15 bp, Homo sapiens
atcactgtgtatgcc

SEQ ID NO: 419795 - DNA, 15 bp, Homo sapiens
tcactgtgtatgcct

SEQ ID NO: 419796 - DNA, 15 bp, Homo sapiens
cactgtgtatgcctt

SEQ ID NO: 419797 - DNA, 15 bp, Homo sapiens
actgtgtatgccttt

SEQ ID NO: 419798 - DNA, 15 bp, Homo sapiens
ctgtgtatgcctttg

SEQ ID NO: 419799 - DNA, 15 bp, Homo sapiens
tgtgtatgcctttgc

SEQ ID NO: 419800 - DNA, 15 bp, Homo sapiens
gtgtatgcctttgca

SEQ ID NO: 419801 - DNA, 15 bp, Homo sapiens
tgtatgcctttgcat

SEQ ID NO: 419802 - DNA, 15 bp, Homo sapiens
gtatgcctttgcata

SEQ ID NO: 419803 - DNA, 15 bp, Homo sapiens
tatgcctttgcatac

SEQ ID NO: 419804 - DNA, 15 bp, Homo sapiens
atgcctttgcatacc

SEQ ID NO: 419805 - DNA, 15 bp, Homo sapiens
tgcctttgcataccc

SEQ ID NO: 419806 - DNA, 15 bp, Homo sapiens
gcctttgcataccca

SEQ ID NO: 419807 - DNA, 15 bp, Homo sapiens
cctttgcatacccat

SEQ ID NO: 419808 - DNA, 15 bp, Homo sapiens
ctttgcatacccata

SEQ ID NO: 419809 - DNA, 15 bp, Homo sapiens
tttgcatacccatag

SEQ ID NO: 419810 - DNA, 15 bp, Homo sapiens
ttgcatacccatagc

SEQ ID NO: 419811 - DNA, 15 bp, Homo sapiens
tgcatacccatagct

SEQ ID NO: 419812 - DNA, 15 bp, Homo sapiens
gcatacccatagctt

SEQ ID NO: 419813 - DNA, 15 bp, Homo sapiens
catacccatagctta

SEQ ID NO: 419814 - DNA, 15 bp, Homo sapiens
atacccatagcttat

SEQ ID NO: 419815 - DNA, 15 bp, Homo sapiens
tacccatagcttatc

SEQ ID NO: 419816 - DNA, 15 bp, Homo sapiens
acccatagcttatct

SEQ ID NO: 419817 - DNA, 15 bp, Homo sapiens
cccatagcttatctc

SEQ ID NO: 419818 - DNA, 15 bp, Homo sapiens
ccatagcttatctcc

SEQ ID NO: 419819 - DNA, 15 bp, Homo sapiens
catagcttatctccc

SEQ ID NO: 419820 - DNA, 15 bp, Homo sapiens
atagcttatctccca

SEQ ID NO: 419821 - DNA, 15 bp, Homo sapiens
tagcttatctcccac

SEQ ID NO: 419822 - DNA, 15 bp, Homo sapiens
agcttatctcccact

SEQ ID NO: 419823 - DNA, 15 bp, Homo sapiens
gcttatctcccactt

SEQ ID NO: 419824 - DNA, 15 bp, Homo sapiens
cttatctcccacttg

SEQ ID NO: 419825 - DNA, 15 bp, Homo sapiens
ttatctcccacttgt

SEQ ID NO: 419826 - DNA, 15 bp, Homo sapiens
tatctcccacttgta

SEQ ID NO: 419827 - DNA, 15 bp, Homo sapiens
atctcccacttgtaa

SEQ ID NO: 419828 - DNA, 15 bp, Homo sapiens
tctcccacttgtaag

SEQ ID NO: 419829 - DNA, 15 bp, Homo sapiens
ctcccacttgtaagt

SEQ ID NO: 419830 - DNA, 15 bp, Homo sapiens
tcccacttgtaagtg

SEQ ID NO: 419831 - DNA, 15 bp, Homo sapiens
cccacttgtaagtga

SEQ ID NO: 419832 - DNA, 15 bp, Homo sapiens
ccacttgtaagtgag

SEQ ID NO: 419833 - DNA, 15 bp, Homo sapiens
cacttgtaagtgaga

SEQ ID NO: 419834 - DNA, 15 bp, Homo sapiens
acttgtaagtgagat

SEQ ID NO: 419835 - DNA, 15 bp, Homo sapiens
cttgtaagtgagatc

SEQ ID NO: 419836 - DNA, 15 bp, Homo sapiens
ttgtaagtgagatca

SEQ ID NO: 419837 - DNA, 15 bp, Homo sapiens
tgtaagtgagatcat

SEQ ID NO: 419838 - DNA, 15 bp, Homo sapiens
gtaagtgagatcatg

SEQ ID NO: 419839 - DNA, 15 bp, Homo sapiens
taagtgagatcatgt

SEQ ID NO: 419840 - DNA, 15 bp, Homo sapiens
aagtgagatcatgta

SEQ ID NO: 419841 - DNA, 15 bp, Homo sapiens
agtgagatcatgtag

SEQ ID NO: 419842 - DNA, 15 bp, Homo sapiens
gtgagatcatgtagt

SEQ ID NO: 419843 - DNA, 15 bp, Homo sapiens
tgagatcatgtagtg

SEQ ID NO: 419844 - DNA, 15 bp, Homo sapiens
gagatcatgtagtgt

SEQ ID NO: 419845 - DNA, 15 bp, Homo sapiens
agatcatgtagtgtt

SEQ ID NO: 419846 - DNA, 15 bp, Homo sapiens
gatcatgtagtgttt

SEQ ID NO: 419847 - DNA, 15 bp, Homo sapiens
atcatgtagtgtttg

SEQ ID NO: 419848 - DNA, 15 bp, Homo sapiens
tcatgtagtgtttgg

SEQ ID NO: 419849 - DNA, 15 bp, Homo sapiens
catgtagtgtttggt

SEQ ID NO: 419850 - DNA, 15 bp, Homo sapiens
atgtagtgtttggtt

SEQ ID NO: 419851 - DNA, 15 bp, Homo sapiens
tgtagtgtttggttt

SEQ ID NO: 419852 - DNA, 15 bp, Homo sapiens
gtagtgtttggtttt

SEQ ID NO: 419853 - DNA, 15 bp, Homo sapiens
tagtgtttggttttc

SEQ ID NO: 419854 - DNA, 15 bp, Homo sapiens
agtgtttggttttcc

SEQ ID NO: 419855 - DNA, 15 bp, Homo sapiens
gtgtttggttttcca

SEQ ID NO: 419856 - DNA, 15 bp, Homo sapiens
tgtttggttttccat

SEQ ID NO: 419857 - DNA, 15 bp, Homo sapiens
gtttggttttccatt

SEQ ID NO: 419858 - DNA, 15 bp, Homo sapiens
tttggttttccattc

SEQ ID NO: 419859 - DNA, 15 bp, Homo sapiens
ttggttttccattcc

SEQ ID NO: 419860 - DNA, 15 bp, Homo sapiens
tggttttccattcct

SEQ ID NO: 419861 - DNA, 15 bp, Homo sapiens
ggttttccattcctg

SEQ ID NO: 419862 - DNA, 15 bp, Homo sapiens
gttttccattcctga

SEQ ID NO: 419863 - DNA, 15 bp, Homo sapiens
ttttccattcctgag

SEQ ID NO: 419864 - DNA, 15 bp, Homo sapiens
tttccattcctgagt

SEQ ID NO: 419865 - DNA, 15 bp, Homo sapiens
ttccattcctgagtt

SEQ ID NO: 419866 - DNA, 15 bp, Homo sapiens
tccattcctgagtta

SEQ ID NO: 419867 - DNA, 15 bp, Homo sapiens
ttcctgagttacttt

SEQ ID NO: 419868 - DNA, 15 bp, Homo sapiens
tcctgagttacttta

SEQ ID NO: 419869 - DNA, 15 bp, Homo sapiens
cctgagttactttat

SEQ ID NO: 419870 - DNA, 15 bp, Homo sapiens
ctgagttactttatt

SEQ ID NO: 419871 - DNA, 15 bp, Homo sapiens
tgagttactttattt

SEQ ID NO: 419872 - DNA, 15 bp, Homo sapiens
gagttactttattta

SEQ ID NO: 419873 - DNA, 15 bp, Homo sapiens
agttactttatttag

SEQ ID NO: 419874 - DNA, 15 bp, Homo sapiens
gttactttatttaga

SEQ ID NO: 419875 - DNA, 15 bp, Homo sapiens
ttactttatttagaa

SEQ ID NO: 419876 - DNA, 15 bp, Homo sapiens
tactttatttagaat

SEQ ID NO: 419877 - DNA, 15 bp, Homo sapiens
actttatttagaata

SEQ ID NO: 419878 - DNA, 15 bp, Homo sapiens
ctttatttagaataa

SEQ ID NO: 419879 - DNA, 15 bp, Homo sapiens
tttatttagaataat

SEQ ID NO: 419880 - DNA, 15 bp, Homo sapiens
ttatttagaataatg

SEQ ID NO: 419881 - DNA, 15 bp, Homo sapiens
tatttagaataatgg

SEQ ID NO: 419882 - DNA, 15 bp, Homo sapiens
atttagaataatggc

SEQ ID NO: 419883 - DNA, 15 bp, Homo sapiens
tttagaataatggcc

SEQ ID NO: 419884 - DNA, 15 bp, Homo sapiens
ttagaataatggcct

SEQ ID NO: 419885 - DNA, 15 bp, Homo sapiens
tagaataatggcctc

SEQ ID NO: 419886 - DNA, 15 bp, Homo sapiens
agaataatggcctcc

SEQ ID NO: 419887 - DNA, 15 bp, Homo sapiens
gaataatggcctcca

SEQ ID NO: 419888 - DNA, 15 bp, Homo sapiens
aataatggcctccag

SEQ ID NO: 419889 - DNA, 15 bp, Homo sapiens
gcctccagctccatt

SEQ ID NO: 419890 - DNA, 15 bp, Homo sapiens
cctccagctccattc

SEQ ID NO: 419891 - DNA, 15 bp, Homo sapiens
ctccagctccattca

SEQ ID NO: 419892 - DNA, 15 bp, Homo sapiens
tccagctccattcaa

SEQ ID NO: 419893 - DNA, 15 bp, Homo sapiens
ccagctccattcaag

SEQ ID NO: 419894 - DNA, 15 bp, Homo sapiens
cagctccattcaagt

SEQ ID NO: 419895 - DNA, 15 bp, Homo sapiens
agctccattcaagtt

SEQ ID NO: 419896 - DNA, 15 bp, Homo sapiens
gctccattcaagttg

SEQ ID NO: 419897 - DNA, 15 bp, Homo sapiens
ctccattcaagttgc

SEQ ID NO: 419898 - DNA, 15 bp, Homo sapiens
tccattcaagttgct

SEQ ID NO: 419899 - DNA, 15 bp, Homo sapiens
ccattcaagttgctg

SEQ ID NO: 419900 - DNA, 15 bp, Homo sapiens
cattcaagttgctga

SEQ ID NO: 419901 - DNA, 15 bp, Homo sapiens
attcaagttgctgaa

SEQ ID NO: 419902 - DNA, 15 bp, Homo sapiens
ttcaagttgctgaaa

SEQ ID NO: 419903 - DNA, 15 bp, Homo sapiens
tcaagttgctgaaaa

SEQ ID NO: 419904 - DNA, 15 bp, Homo sapiens
caagttgctgaaaaa

SEQ ID NO: 419905 - DNA, 15 bp, Homo sapiens
aagttgctgaaaaag

SEQ ID NO: 419906 - DNA, 15 bp, Homo sapiens
agttgctgaaaaaga

SEQ ID NO: 419907 - DNA, 15 bp, Homo sapiens
gttgctgaaaaagac

SEQ ID NO: 419908 - DNA, 15 bp, Homo sapiens
ttgctgaaaaagaca

SEQ ID NO: 419909 - DNA, 15 bp, Homo sapiens
tgctgaaaaagacat

SEQ ID NO: 419910 - DNA, 15 bp, Homo sapiens
gctgaaaaagacatt

SEQ ID NO: 419911 - DNA, 15 bp, Homo sapiens
ctgaaaaagacatta

SEQ ID NO: 419912 - DNA, 15 bp, Homo sapiens
tgaaaaagacattat

SEQ ID NO: 419913 - DNA, 15 bp, Homo sapiens
gaaaaagacattatt

SEQ ID NO: 419914 - DNA, 15 bp, Homo sapiens
aaaaagacattattg

SEQ ID NO: 419915 - DNA, 15 bp, Homo sapiens
aaaagacattattgt

SEQ ID NO: 419916 - DNA, 15 bp, Homo sapiens
aaagacattattgta

SEQ ID NO: 419917 - DNA, 15 bp, Homo sapiens
aagacattattgtat

SEQ ID NO: 419918 - DNA, 15 bp, Homo sapiens
agacattattgtatt

SEQ ID NO: 419919 - DNA, 15 bp, Homo sapiens
gacattattgtattc

SEQ ID NO: 419920 - DNA, 15 bp, Homo sapiens
acattattgtattct

SEQ ID NO: 419921 - DNA, 15 bp, Homo sapiens
cattattgtattctt

SEQ ID NO: 419922 - DNA, 15 bp, Homo sapiens
attattgtattcttt

SEQ ID NO: 419923 - DNA, 15 bp, Homo sapiens
ttattgtattctttt

SEQ ID NO: 419924 - DNA, 15 bp, Homo sapiens
tattgtattcttttc

SEQ ID NO: 419925 - DNA, 15 bp, Homo sapiens
attgtattcttttct

SEQ ID NO: 419926 - DNA, 15 bp, Homo sapiens
ttgtattcttttcta

SEQ ID NO: 419927 - DNA, 15 bp, Homo sapiens
tgtattcttttctat

SEQ ID NO: 419928 - DNA, 15 bp, Homo sapiens
gtattcttttctatg

SEQ ID NO: 419929 - DNA, 15 bp, Homo sapiens
tattcttttctatgg

SEQ ID NO: 419930 - DNA, 15 bp, Homo sapiens
attcttttctatggc

SEQ ID NO: 419931 - DNA, 15 bp, Homo sapiens
ttcttttctatggct

SEQ ID NO: 419932 - DNA, 15 bp, Homo sapiens
tcttttctatggctg

SEQ ID NO: 419933 - DNA, 15 bp, Homo sapiens
cttttctatggctga

SEQ ID NO: 419934 - DNA, 15 bp, Homo sapiens
ttttctatggctgag

SEQ ID NO: 419935 - DNA, 15 bp, Homo sapiens
tttctatggctgagt

SEQ ID NO: 419936 - DNA, 15 bp, Homo sapiens
ttctatggctgagtg

SEQ ID NO: 419937 - DNA, 15 bp, Homo sapiens
tctatggctgagtgg

SEQ ID NO: 419938 - DNA, 15 bp, Homo sapiens
ctatggctgagtggt

SEQ ID NO: 419939 - DNA, 15 bp, Homo sapiens
tatggctgagtggta

SEQ ID NO: 419940 - DNA, 15 bp, Homo sapiens
atggctgagtggtat

SEQ ID NO: 419941 - DNA, 15 bp, Homo sapiens
tggctgagtggtatt

SEQ ID NO: 419942 - DNA, 15 bp, Homo sapiens
ggctgagtggtattt

SEQ ID NO: 419943 - DNA, 15 bp, Homo sapiens
gctgagtggtatttc

SEQ ID NO: 419944 - DNA, 15 bp, Homo sapiens
ctgagtggtatttca

SEQ ID NO: 419945 - DNA, 15 bp, Homo sapiens
tgagtggtatttcat

SEQ ID NO: 419946 - DNA, 15 bp, Homo sapiens
gagtggtatttcatg

SEQ ID NO: 419947 - DNA, 15 bp, Homo sapiens
agtggtatttcatgg

SEQ ID NO: 419948 - DNA, 15 bp, Homo sapiens
gtggtatttcatggt

SEQ ID NO: 419949 - DNA, 15 bp, Homo sapiens
tggtatttcatggta

SEQ ID NO: 419950 - DNA, 15 bp, Homo sapiens
ggtatttcatggtat

SEQ ID NO: 419951 - DNA, 15 bp, Homo sapiens
gtatttcatggtata

SEQ ID NO: 419952 - DNA, 15 bp, Homo sapiens
tatttcatggtatac

SEQ ID NO: 419953 - DNA, 15 bp, Homo sapiens
atttcatggtataca

SEQ ID NO: 419954 - DNA, 15 bp, Homo sapiens
tttcatggtatacac

SEQ ID NO: 419955 - DNA, 15 bp, Homo sapiens
ttcatggtatacaca

SEQ ID NO: 419956 - DNA, 15 bp, Homo sapiens
tcatggtatacacat

SEQ ID NO: 419957 - DNA, 15 bp, Homo sapiens
catggtatacacata

SEQ ID NO: 419958 - DNA, 15 bp, Homo sapiens
atggtatacacatac

SEQ ID NO: 419959 - DNA, 15 bp, Homo sapiens
tggtatacacatacc

SEQ ID NO: 419960 - DNA, 15 bp, Homo sapiens
ggtatacacatacca

SEQ ID NO: 419961 - DNA, 15 bp, Homo sapiens
gtatacacataccac

SEQ ID NO: 419962 - DNA, 15 bp, Homo sapiens
tatacacataccaca

SEQ ID NO: 419963 - DNA, 15 bp, Homo sapiens
atacacataccacat

SEQ ID NO: 419964 - DNA, 15 bp, Homo sapiens
tacacataccacatg

SEQ ID NO: 419965 - DNA, 15 bp, Homo sapiens
acacataccacatgt

SEQ ID NO: 419966 - DNA, 15 bp, Homo sapiens
cacataccacatgtt

SEQ ID NO: 419967 - DNA, 15 bp, Homo sapiens
acataccacatgttc

SEQ ID NO: 419968 - DNA, 15 bp, Homo sapiens
cataccacatgttcc

SEQ ID NO: 419969 - DNA, 15 bp, Homo sapiens
ataccacatgttcct

SEQ ID NO: 419970 - DNA, 15 bp, Homo sapiens
taccacatgttcctt

SEQ ID NO: 419971 - DNA, 15 bp, Homo sapiens
accacatgttcctta

SEQ ID NO: 419972 - DNA, 15 bp, Homo sapiens
ccacatgttccttat

SEQ ID NO: 419973 - DNA, 15 bp, Homo sapiens
cacatgttccttatc

SEQ ID NO: 419974 - DNA, 15 bp, Homo sapiens
acatgttccttatcc

SEQ ID NO: 419975 - DNA, 15 bp, Homo sapiens
catgttccttatcca

SEQ ID NO: 419976 - DNA, 15 bp, Homo sapiens
atgttccttatccac

SEQ ID NO: 419977 - DNA, 15 bp, Homo sapiens
tgttccttatccact

SEQ ID NO: 419978 - DNA, 15 bp, Homo sapiens
gttccttatccactc

SEQ ID NO: 419979 - DNA, 15 bp, Homo sapiens
ttccttatccactca

SEQ ID NO: 419980 - DNA, 15 bp, Homo sapiens
tccttatccactcat

SEQ ID NO: 419981 - DNA, 15 bp, Homo sapiens
ccttatccactcatg

SEQ ID NO: 419982 - DNA, 15 bp, Homo sapiens
cttatccactcatgg

SEQ ID NO: 419983 - DNA, 15 bp, Homo sapiens
ttatccactcatgga

SEQ ID NO: 419984 - DNA, 15 bp, Homo sapiens
tatccactcatggat

SEQ ID NO: 419985 - DNA, 15 bp, Homo sapiens
atccactcatggatt

SEQ ID NO: 419986 - DNA, 15 bp, Homo sapiens
tccactcatggattg

SEQ ID NO: 419987 - DNA, 15 bp, Homo sapiens
ccactcatggattga

SEQ ID NO: 419988 - DNA, 15 bp, Homo sapiens
cactcatggattgat

SEQ ID NO: 419989 - DNA, 15 bp, Homo sapiens
actcatggattgatg

SEQ ID NO: 419990 - DNA, 15 bp, Homo sapiens
ctcatggattgatgg

SEQ ID NO: 419991 - DNA, 15 bp, Homo sapiens
tcatggattgatgga

SEQ ID NO: 419992 - DNA, 15 bp, Homo sapiens
catggattgatggac

SEQ ID NO: 419993 - DNA, 15 bp, Homo sapiens
atggattgatggaca

SEQ ID NO: 419994 - DNA, 15 bp, Homo sapiens
tggattgatggacac

SEQ ID NO: 419995 - DNA, 15 bp, Homo sapiens
ggattgatggacact

SEQ ID NO: 419996 - DNA, 15 bp, Homo sapiens
gattgatggacactt

SEQ ID NO: 419997 - DNA, 15 bp, Homo sapiens
attgatggacactta

SEQ ID NO: 419998 - DNA, 15 bp, Homo sapiens
ttgatggacacttaa

SEQ ID NO: 419999 - DNA, 15 bp, Homo sapiens
tgatggacacttaag

SEQ ID NO: 420000 - DNA, 15 bp, Homo sapiens
gatggacacttaagt

SEQ ID NO: 420001 - DNA, 15 bp, Homo sapiens
atggacacttaagtt

SEQ ID NO: 420002 - DNA, 15 bp, Homo sapiens
tggacacttaagttg

SEQ ID NO: 420003 - DNA, 15 bp, Homo sapiens
ggacacttaagttgg

SEQ ID NO: 420004 - DNA, 15 bp, Homo sapiens
gacacttaagttggt

SEQ ID NO: 420005 - DNA, 15 bp, Homo sapiens
acacttaagttggtt

SEQ ID NO: 420006 - DNA, 15 bp, Homo sapiens
cacttaagttggttc

SEQ ID NO: 420007 - DNA, 15 bp, Homo sapiens
acttaagttggttcc

SEQ ID NO: 420008 - DNA, 15 bp, Homo sapiens
cttaagttggttcca

SEQ ID NO: 420009 - DNA, 15 bp, Homo sapiens
ttaagttggttccaa

SEQ ID NO: 420010 - DNA, 15 bp, Homo sapiens
taagttggttccaaa

SEQ ID NO: 420011 - DNA, 15 bp, Homo sapiens
aagttggttccaaat

SEQ ID NO: 420012 - DNA, 15 bp, Homo sapiens
agttggttccaaatc

SEQ ID NO: 420013 - DNA, 15 bp, Homo sapiens
gttggttccaaatct

SEQ ID NO: 420014 - DNA, 15 bp, Homo sapiens
ttggttccaaatctt

SEQ ID NO: 420015 - DNA, 15 bp, Homo sapiens
tggttccaaatcttt

SEQ ID NO: 420016 - DNA, 15 bp, Homo sapiens
ggttccaaatctttg

SEQ ID NO: 420017 - DNA, 15 bp, Homo sapiens
gttccaaatctttgc

SEQ ID NO: 420018 - DNA, 15 bp, Homo sapiens
ttccaaatctttgca

SEQ ID NO: 420019 - DNA, 15 bp, Homo sapiens
tccaaatctttgcaa

SEQ ID NO: 420020 - DNA, 15 bp, Homo sapiens
ccaaatctttgcaat

SEQ ID NO: 420021 - DNA, 15 bp, Homo sapiens
caaatctttgcaatt

SEQ ID NO: 420022 - DNA, 15 bp, Homo sapiens
aaatctttgcaattg

SEQ ID NO: 420023 - DNA, 15 bp, Homo sapiens
aatctttgcaattgt

SEQ ID NO: 420024 - DNA, 15 bp, Homo sapiens
atctttgcaattgtg

SEQ ID NO: 420025 - DNA, 15 bp, Homo sapiens
tctttgcaattgtgg

SEQ ID NO: 420026 - DNA, 15 bp, Homo sapiens
ctttgcaattgtgga

SEQ ID NO: 420027 - DNA, 15 bp, Homo sapiens
tttgcaattgtggat

SEQ ID NO: 420028 - DNA, 15 bp, Homo sapiens
ttgcaattgtggatt

SEQ ID NO: 420029 - DNA, 15 bp, Homo sapiens
tgcaattgtggattg

SEQ ID NO: 420030 - DNA, 15 bp, Homo sapiens
gcaattgtggattgt

SEQ ID NO: 420031 - DNA, 15 bp, Homo sapiens
caattgtggattgtg

SEQ ID NO: 420032 - DNA, 15 bp, Homo sapiens
aattgtggattgtgc

SEQ ID NO: 420033 - DNA, 15 bp, Homo sapiens
attgtggattgtgct

SEQ ID NO: 420034 - DNA, 15 bp, Homo sapiens
ttgtggattgtgctg

SEQ ID NO: 420035 - DNA, 15 bp, Homo sapiens
tgtggattgtgctgt

SEQ ID NO: 420036 - DNA, 15 bp, Homo sapiens
gtggattgtgctgtg

SEQ ID NO: 420037 - DNA, 15 bp, Homo sapiens
tggattgtgctgtga

SEQ ID NO: 420038 - DNA, 15 bp, Homo sapiens
ggattgtgctgtgat

SEQ ID NO: 420039 - DNA, 15 bp, Homo sapiens
gattgtgctgtgata

SEQ ID NO: 420040 - DNA, 15 bp, Homo sapiens
attgtgctgtgataa

SEQ ID NO: 420041 - DNA, 15 bp, Homo sapiens
ttgtgctgtgataaa

SEQ ID NO: 420042 - DNA, 15 bp, Homo sapiens
tgtgctgtgataaac

SEQ ID NO: 420043 - DNA, 15 bp, Homo sapiens
gtgctgtgataaaca

SEQ ID NO: 420044 - DNA, 15 bp, Homo sapiens
tgctgtgataaacat

SEQ ID NO: 420045 - DNA, 15 bp, Homo sapiens
gctgtgataaacata

SEQ ID NO: 420046 - DNA, 15 bp, Homo sapiens
ctgtgataaacatac

SEQ ID NO: 420047 - DNA, 15 bp, Homo sapiens
tgtgataaacatacg

SEQ ID NO: 420048 - DNA, 15 bp, Homo sapiens
gtgataaacatacga

SEQ ID NO: 420049 - DNA, 15 bp, Homo sapiens
tgataaacatacgag

SEQ ID NO: 420050 - DNA, 15 bp, Homo sapiens
gataaacatacgagt

SEQ ID NO: 420051 - DNA, 15 bp, Homo sapiens
ataaacatacgagtg

SEQ ID NO: 420052 - DNA, 15 bp, Homo sapiens
taaacatacgagtgc

SEQ ID NO: 420053 - DNA, 15 bp, Homo sapiens
aaacatacgagtgcc

SEQ ID NO: 420054 - DNA, 15 bp, Homo sapiens
aacatacgagtgcca

SEQ ID NO: 420055 - DNA, 15 bp, Homo sapiens
acatacgagtgccag

SEQ ID NO: 420056 - DNA, 15 bp, Homo sapiens
catacgagtgccagt

SEQ ID NO: 420057 - DNA, 15 bp, Homo sapiens
atacgagtgccagtg

SEQ ID NO: 420058 - DNA, 15 bp, Homo sapiens
tacgagtgccagtgt

SEQ ID NO: 420059 - DNA, 15 bp, Homo sapiens
acgagtgccagtgtc

SEQ ID NO: 420060 - DNA, 15 bp, Homo sapiens
cgagtgccagtgtct

SEQ ID NO: 420061 - DNA, 15 bp, Homo sapiens
gagtgccagtgtctt

SEQ ID NO: 420062 - DNA, 15 bp, Homo sapiens
agtgccagtgtcttt

SEQ ID NO: 420063 - DNA, 15 bp, Homo sapiens
gtgccagtgtctttt

SEQ ID NO: 420064 - DNA, 15 bp, Homo sapiens
tgccagtgtcttttt

SEQ ID NO: 420065 - DNA, 15 bp, Homo sapiens
gccagtgtctttttg

SEQ ID NO: 420066 - DNA, 15 bp, Homo sapiens
ccagtgtctttttga

SEQ ID NO: 420067 - DNA, 15 bp, Homo sapiens
cagtgtctttttgac

SEQ ID NO: 420068 - DNA, 15 bp, Homo sapiens
agtgtctttttgaca

SEQ ID NO: 420069 - DNA, 15 bp, Homo sapiens
gtgtctttttgacat

SEQ ID NO: 420070 - DNA, 15 bp, Homo sapiens
tgtctttttgacata

SEQ ID NO: 420071 - DNA, 15 bp, Homo sapiens
gtctttttgacataa

SEQ ID NO: 420072 - DNA, 15 bp, Homo sapiens
tctttttgacataat

SEQ ID NO: 420073 - DNA, 15 bp, Homo sapiens
ctttttgacataatg

SEQ ID NO: 420074 - DNA, 15 bp, Homo sapiens
tttttgacataatga

SEQ ID NO: 420075 - DNA, 15 bp, Homo sapiens
ttttgacataatgac

SEQ ID NO: 420076 - DNA, 15 bp, Homo sapiens
tttgacataatgact

SEQ ID NO: 420077 - DNA, 15 bp, Homo sapiens
ttgacataatgactt

SEQ ID NO: 420078 - DNA, 15 bp, Homo sapiens
tgacataatgacttc

SEQ ID NO: 420079 - DNA, 15 bp, Homo sapiens
gacataatgacttct

SEQ ID NO: 420080 - DNA, 15 bp, Homo sapiens
acataatgacttctt

SEQ ID NO: 420081 - DNA, 15 bp, Homo sapiens
cataatgacttcttt

SEQ ID NO: 420082 - DNA, 15 bp, Homo sapiens
tgacttcttttcctt

SEQ ID NO: 420083 - DNA, 15 bp, Homo sapiens
gacttcttttccttt

SEQ ID NO: 420084 - DNA, 15 bp, Homo sapiens
acttcttttcctttt

SEQ ID NO: 420085 - DNA, 15 bp, Homo sapiens
cttcttttccttttg

SEQ ID NO: 420086 - DNA, 15 bp, Homo sapiens
ttcttttccttttgg

SEQ ID NO: 420087 - DNA, 15 bp, Homo sapiens
tcttttccttttggt

SEQ ID NO: 420088 - DNA, 15 bp, Homo sapiens
cttttccttttggta

SEQ ID NO: 420089 - DNA, 15 bp, Homo sapiens
ttttccttttggtag

SEQ ID NO: 420090 - DNA, 15 bp, Homo sapiens
tttccttttggtaga

SEQ ID NO: 420091 - DNA, 15 bp, Homo sapiens
ttccttttggtagat

SEQ ID NO: 420092 - DNA, 15 bp, Homo sapiens
tccttttggtagata

SEQ ID NO: 420093 - DNA, 15 bp, Homo sapiens
ccttttggtagatac

SEQ ID NO: 420094 - DNA, 15 bp, Homo sapiens
cttttggtagatacc

SEQ ID NO: 420095 - DNA, 15 bp, Homo sapiens
ttttggtagatacct

SEQ ID NO: 420096 - DNA, 15 bp, Homo sapiens
tttggtagataccta

SEQ ID NO: 420097 - DNA, 15 bp, Homo sapiens
ttggtagatacctag

SEQ ID NO: 420098 - DNA, 15 bp, Homo sapiens
tggtagatacctagc

SEQ ID NO: 420099 - DNA, 15 bp, Homo sapiens
ggtagatacctagca

SEQ ID NO: 420100 - DNA, 15 bp, Homo sapiens
gtagatacctagcag

SEQ ID NO: 420101 - DNA, 15 bp, Homo sapiens
tagatacctagcagt

SEQ ID NO: 420102 - DNA, 15 bp, Homo sapiens
agatacctagcagtg

SEQ ID NO: 420103 - DNA, 15 bp, Homo sapiens
gatacctagcagtgg

SEQ ID NO: 420104 - DNA, 15 bp, Homo sapiens
atacctagcagtggt

SEQ ID NO: 420105 - DNA, 15 bp, Homo sapiens
tacctagcagtggta

SEQ ID NO: 420106 - DNA, 15 bp, Homo sapiens
acctagcagtggtat

SEQ ID NO: 420107 - DNA, 15 bp, Homo sapiens
cctagcagtggtatt

SEQ ID NO: 420108 - DNA, 15 bp, Homo sapiens
ctagcagtggtattg

SEQ ID NO: 420109 - DNA, 15 bp, Homo sapiens
tagcagtggtattgc

SEQ ID NO: 420110 - DNA, 15 bp, Homo sapiens
agcagtggtattgct

SEQ ID NO: 420111 - DNA, 15 bp, Homo sapiens
gcagtggtattgcta

SEQ ID NO: 420112 - DNA, 15 bp, Homo sapiens
cagtggtattgctag

SEQ ID NO: 420113 - DNA, 15 bp, Homo sapiens
agtggtattgctaga

SEQ ID NO: 420114 - DNA, 15 bp, Homo sapiens
gtggtattgctagat

SEQ ID NO: 420115 - DNA, 15 bp, Homo sapiens
tggtattgctagatc

SEQ ID NO: 420116 - DNA, 15 bp, Homo sapiens
ggtattgctagatca

SEQ ID NO: 420117 - DNA, 15 bp, Homo sapiens
gtattgctagatcac

SEQ ID NO: 420118 - DNA, 15 bp, Homo sapiens
tattgctagatcaca

SEQ ID NO: 420119 - DNA, 15 bp, Homo sapiens
attgctagatcacat

SEQ ID NO: 420120 - DNA, 15 bp, Homo sapiens
ttgctagatcacata

SEQ ID NO: 420121 - DNA, 15 bp, Homo sapiens
tgctagatcacatag

SEQ ID NO: 420122 - DNA, 15 bp, Homo sapiens
gctagatcacatagt

SEQ ID NO: 420123 - DNA, 15 bp, Homo sapiens
ctagatcacatagtg

SEQ ID NO: 420124 - DNA, 15 bp, Homo sapiens
tagatcacatagtgg

SEQ ID NO: 420125 - DNA, 15 bp, Homo sapiens
agatcacatagtgga

SEQ ID NO: 420126 - DNA, 15 bp, Homo sapiens
gatcacatagtggat

SEQ ID NO: 420127 - DNA, 15 bp, Homo sapiens
atcacatagtggatg

SEQ ID NO: 420128 - DNA, 15 bp, Homo sapiens
tcacatagtggatgt

SEQ ID NO: 420129 - DNA, 15 bp, Homo sapiens
cacatagtggatgta

SEQ ID NO: 420130 - DNA, 15 bp, Homo sapiens
acatagtggatgtac

SEQ ID NO: 420131 - DNA, 15 bp, Homo sapiens
catagtggatgtact

SEQ ID NO: 420132 - DNA, 15 bp, Homo sapiens
atagtggatgtactt

SEQ ID NO: 420133 - DNA, 15 bp, Homo sapiens
tagtggatgtacttt

SEQ ID NO: 420134 - DNA, 15 bp, Homo sapiens
agtggatgtactttt

SEQ ID NO: 420135 - DNA, 15 bp, Homo sapiens
gtggatgtactttta

SEQ ID NO: 420136 - DNA, 15 bp, Homo sapiens
tggatgtacttttag

SEQ ID NO: 420137 - DNA, 15 bp, Homo sapiens
ggatgtacttttagt

SEQ ID NO: 420138 - DNA, 15 bp, Homo sapiens
gatgtacttttagtt

SEQ ID NO: 420139 - DNA, 15 bp, Homo sapiens
atgtacttttagttc

SEQ ID NO: 420140 - DNA, 15 bp, Homo sapiens
tgtacttttagttct

SEQ ID NO: 420141 - DNA, 15 bp, Homo sapiens
gtacttttagttctt

SEQ ID NO: 420142 - DNA, 15 bp, Homo sapiens
acttttagttctttg

SEQ ID NO: 420143 - DNA, 15 bp, Homo sapiens
cttttagttctttga

SEQ ID NO: 420144 - DNA, 15 bp, Homo sapiens
ttttagttctttgag

SEQ ID NO: 420145 - DNA, 15 bp, Homo sapiens
tttagttctttgagg

SEQ ID NO: 420146 - DNA, 15 bp, Homo sapiens
ttagttctttgagga

SEQ ID NO: 420147 - DNA, 15 bp, Homo sapiens
tagttctttgaggaa

SEQ ID NO: 420148 - DNA, 15 bp, Homo sapiens
agttctttgaggaat

SEQ ID NO: 420149 - DNA, 15 bp, Homo sapiens
gttctttgaggaatc

SEQ ID NO: 420150 - DNA, 15 bp, Homo sapiens
ttctttgaggaatct

SEQ ID NO: 420151 - DNA, 15 bp, Homo sapiens
tctttgaggaatctg

SEQ ID NO: 420152 - DNA, 15 bp, Homo sapiens
ctttgaggaatctgc

SEQ ID NO: 420153 - DNA, 15 bp, Homo sapiens
tttgaggaatctgct

SEQ ID NO: 420154 - DNA, 15 bp, Homo sapiens
ttgaggaatctgctt

SEQ ID NO: 420155 - DNA, 15 bp, Homo sapiens
tgaggaatctgctta

SEQ ID NO: 420156 - DNA, 15 bp, Homo sapiens
gaggaatctgcttag

SEQ ID NO: 420157 - DNA, 15 bp, Homo sapiens
aggaatctgcttaga

SEQ ID NO: 420158 - DNA, 15 bp, Homo sapiens
ggaatctgcttagag

SEQ ID NO: 420159 - DNA, 15 bp, Homo sapiens
gaatctgcttagaga

SEQ ID NO: 420160 - DNA, 15 bp, Homo sapiens
aatctgcttagagat

SEQ ID NO: 420161 - DNA, 15 bp, Homo sapiens
atctgcttagagatt

SEQ ID NO: 420162 - DNA, 15 bp, Homo sapiens
tctgcttagagattg

SEQ ID NO: 420163 - DNA, 15 bp, Homo sapiens
ctgcttagagattgt

SEQ ID NO: 420164 - DNA, 15 bp, Homo sapiens
tgcttagagattgta

SEQ ID NO: 420165 - DNA, 15 bp, Homo sapiens
gcttagagattgtac

SEQ ID NO: 420166 - DNA, 15 bp, Homo sapiens
cttagagattgtact

SEQ ID NO: 420167 - DNA, 15 bp, Homo sapiens
ttagagattgtacta

SEQ ID NO: 420168 - DNA, 15 bp, Homo sapiens
tagagattgtactaa

SEQ ID NO: 420169 - DNA, 15 bp, Homo sapiens
agagattgtactaat

SEQ ID NO: 420170 - DNA, 15 bp, Homo sapiens
gagattgtactaatt

SEQ ID NO: 420171 - DNA, 15 bp, Homo sapiens
agattgtactaattt

SEQ ID NO: 420172 - DNA, 15 bp, Homo sapiens
gattgtactaatttg

SEQ ID NO: 420173 - DNA, 15 bp, Homo sapiens
attgtactaatttgc

SEQ ID NO: 420174 - DNA, 15 bp, Homo sapiens
ttgtactaatttgca

SEQ ID NO: 420175 - DNA, 15 bp, Homo sapiens
tgtactaatttgcat

SEQ ID NO: 420176 - DNA, 15 bp, Homo sapiens
gtactaatttgcatt

SEQ ID NO: 420177 - DNA, 15 bp, Homo sapiens
tactaatttgcattc

SEQ ID NO: 420178 - DNA, 15 bp, Homo sapiens
actaatttgcattct

SEQ ID NO: 420179 - DNA, 15 bp, Homo sapiens
ctaatttgcattctc

SEQ ID NO: 420180 - DNA, 15 bp, Homo sapiens
taatttgcattctca

SEQ ID NO: 420181 - DNA, 15 bp, Homo sapiens
aatttgcattctcac

SEQ ID NO: 420182 - DNA, 15 bp, Homo sapiens
atttgcattctcacc

SEQ ID NO: 420183 - DNA, 15 bp, Homo sapiens
tttgcattctcacca

SEQ ID NO: 420184 - DNA, 15 bp, Homo sapiens
ttgcattctcaccag

SEQ ID NO: 420185 - DNA, 15 bp, Homo sapiens
tgcattctcaccagt

SEQ ID NO: 420186 - DNA, 15 bp, Homo sapiens
gcattctcaccagtg

SEQ ID NO: 420187 - DNA, 15 bp, Homo sapiens
cattctcaccagtgt

SEQ ID NO: 420188 - DNA, 15 bp, Homo sapiens
attctcaccagtgtt

SEQ ID NO: 420189 - DNA, 15 bp, Homo sapiens
ttctcaccagtgttt

SEQ ID NO: 420190 - DNA, 15 bp, Homo sapiens
tctcaccagtgttta

SEQ ID NO: 420191 - DNA, 15 bp, Homo sapiens
ctcaccagtgtttaa

SEQ ID NO: 420192 - DNA, 15 bp, Homo sapiens
tcaccagtgtttaag

SEQ ID NO: 420193 - DNA, 15 bp, Homo sapiens
caccagtgtttaagc

SEQ ID NO: 420194 - DNA, 15 bp, Homo sapiens
accagtgtttaagca

SEQ ID NO: 420195 - DNA, 15 bp, Homo sapiens
ccagtgtttaagcat

SEQ ID NO: 420196 - DNA, 15 bp, Homo sapiens
cagtgtttaagcatc

SEQ ID NO: 420197 - DNA, 15 bp, Homo sapiens
agtgtttaagcatcc

SEQ ID NO: 420198 - DNA, 15 bp, Homo sapiens
gtgtttaagcatccc

SEQ ID NO: 420199 - DNA, 15 bp, Homo sapiens
tgtttaagcatcccc

SEQ ID NO: 420200 - DNA, 15 bp, Homo sapiens
gtttaagcatcccca

SEQ ID NO: 420201 - DNA, 15 bp, Homo sapiens
tttaagcatccccat

SEQ ID NO: 420202 - DNA, 15 bp, Homo sapiens
ttaagcatccccatt

SEQ ID NO: 420203 - DNA, 15 bp, Homo sapiens
taagcatccccattt

SEQ ID NO: 420204 - DNA, 15 bp, Homo sapiens
aagcatccccatttc

SEQ ID NO: 420205 - DNA, 15 bp, Homo sapiens
agcatccccatttca

SEQ ID NO: 420206 - DNA, 15 bp, Homo sapiens
gcatccccatttcac

SEQ ID NO: 420207 - DNA, 15 bp, Homo sapiens
catccccatttcacc

SEQ ID NO: 420208 - DNA, 15 bp, Homo sapiens
atccccatttcacca

SEQ ID NO: 420209 - DNA, 15 bp, Homo sapiens
tccccatttcaccac

SEQ ID NO: 420210 - DNA, 15 bp, Homo sapiens
ccccatttcaccaca

SEQ ID NO: 420211 - DNA, 15 bp, Homo sapiens
cccatttcaccacat

SEQ ID NO: 420212 - DNA, 15 bp, Homo sapiens
ccatttcaccacatc

SEQ ID NO: 420213 - DNA, 15 bp, Homo sapiens
catttcaccacatcc

SEQ ID NO: 420214 - DNA, 15 bp, Homo sapiens
ttcaccacatcctca

SEQ ID NO: 420215 - DNA, 15 bp, Homo sapiens
tcaccacatcctcat

SEQ ID NO: 420216 - DNA, 15 bp, Homo sapiens
caccacatcctcatt

SEQ ID NO: 420217 - DNA, 15 bp, Homo sapiens
accacatcctcattg

SEQ ID NO: 420218 - DNA, 15 bp, Homo sapiens
ccacatcctcattga

SEQ ID NO: 420219 - DNA, 15 bp, Homo sapiens
cacatcctcattgac

SEQ ID NO: 420220 - DNA, 15 bp, Homo sapiens
acatcctcattgaca

SEQ ID NO: 420221 - DNA, 15 bp, Homo sapiens
catcctcattgacat

SEQ ID NO: 420222 - DNA, 15 bp, Homo sapiens
atcctcattgacatc

SEQ ID NO: 420223 - DNA, 15 bp, Homo sapiens
tcctcattgacatct

SEQ ID NO: 420224 - DNA, 15 bp, Homo sapiens
cctcattgacatcta

SEQ ID NO: 420225 - DNA, 15 bp, Homo sapiens
ctcattgacatctat

SEQ ID NO: 420226 - DNA, 15 bp, Homo sapiens
tcattgacatctatt

SEQ ID NO: 420227 - DNA, 15 bp, Homo sapiens
cattgacatctattg

SEQ ID NO: 420228 - DNA, 15 bp, Homo sapiens
attgacatctattgt

SEQ ID NO: 420229 - DNA, 15 bp, Homo sapiens
ttgacatctattgtt

SEQ ID NO: 420230 - DNA, 15 bp, Homo sapiens
tgacatctattgttt

SEQ ID NO: 420231 - DNA, 15 bp, Homo sapiens
gacatctattgtttt

SEQ ID NO: 420232 - DNA, 15 bp, Homo sapiens
acatctattgttttt

SEQ ID NO: 420233 - DNA, 15 bp, Homo sapiens
catctattgtttttt

SEQ ID NO: 420234 - DNA, 15 bp, Homo sapiens
atctattgttttttg

SEQ ID NO: 420235 - DNA, 15 bp, Homo sapiens
tctattgttttttga

SEQ ID NO: 420236 - DNA, 15 bp, Homo sapiens
ctattgttttttgac

SEQ ID NO: 420237 - DNA, 15 bp, Homo sapiens
tattgttttttgact

SEQ ID NO: 420238 - DNA, 15 bp, Homo sapiens
attgttttttgactt

SEQ ID NO: 420239 - DNA, 15 bp, Homo sapiens
ctttttaataatggc

SEQ ID NO: 420240 - DNA, 15 bp, Homo sapiens
tttttaataatggcc

SEQ ID NO: 420241 - DNA, 15 bp, Homo sapiens
ttttaataatggccg

SEQ ID NO: 420242 - DNA, 15 bp, Homo sapiens
tttaataatggccgt

SEQ ID NO: 420243 - DNA, 15 bp, Homo sapiens
ttaataatggccgtt

SEQ ID NO: 420244 - DNA, 15 bp, Homo sapiens
taataatggccgttc

SEQ ID NO: 420245 - DNA, 15 bp, Homo sapiens
aataatggccgttct

SEQ ID NO: 420246 - DNA, 15 bp, Homo sapiens
ataatggccgttctg

SEQ ID NO: 420247 - DNA, 15 bp, Homo sapiens
taatggccgttctgg

SEQ ID NO: 420248 - DNA, 15 bp, Homo sapiens
aatggccgttctggt

SEQ ID NO: 420249 - DNA, 15 bp, Homo sapiens
atggccgttctggtc

SEQ ID NO: 420250 - DNA, 15 bp, Homo sapiens
tggccgttctggtca

SEQ ID NO: 420251 - DNA, 15 bp, Homo sapiens
ggccgttctggtcag

SEQ ID NO: 420252 - DNA, 15 bp, Homo sapiens
gccgttctggtcagg

SEQ ID NO: 420253 - DNA, 15 bp, Homo sapiens
ccgttctggtcaggg

SEQ ID NO: 420254 - DNA, 15 bp, Homo sapiens
cgttctggtcagggt

SEQ ID NO: 420255 - DNA, 15 bp, Homo sapiens
gttctggtcagggta

SEQ ID NO: 420256 - DNA, 15 bp, Homo sapiens
ttctggtcagggtaa

SEQ ID NO: 420257 - DNA, 15 bp, Homo sapiens
tctggtcagggtaag

SEQ ID NO: 420258 - DNA, 15 bp, Homo sapiens
ctggtcagggtaagg

SEQ ID NO: 420259 - DNA, 15 bp, Homo sapiens
tggtcagggtaaggt

SEQ ID NO: 420260 - DNA, 15 bp, Homo sapiens
ggtcagggtaaggtg

SEQ ID NO: 420261 - DNA, 15 bp, Homo sapiens
gtcagggtaaggtgg

SEQ ID NO: 420262 - DNA, 15 bp, Homo sapiens
tcagggtaaggtggt

SEQ ID NO: 420263 - DNA, 15 bp, Homo sapiens
cagggtaaggtggta

SEQ ID NO: 420264 - DNA, 15 bp, Homo sapiens
agggtaaggtggtat

SEQ ID NO: 420265 - DNA, 15 bp, Homo sapiens
gggtaaggtggtatc

SEQ ID NO: 420266 - DNA, 15 bp, Homo sapiens
ggtaaggtggtatct

SEQ ID NO: 420267 - DNA, 15 bp, Homo sapiens
gtaaggtggtatctc

SEQ ID NO: 420268 - DNA, 15 bp, Homo sapiens
taaggtggtatctca

SEQ ID NO: 420269 - DNA, 15 bp, Homo sapiens
aaggtggtatctcat

SEQ ID NO: 420270 - DNA, 15 bp, Homo sapiens
aggtggtatctcatt

SEQ ID NO: 420271 - DNA, 15 bp, Homo sapiens
ggtggtatctcattg

SEQ ID NO: 420272 - DNA, 15 bp, Homo sapiens
gtggtatctcattgt

SEQ ID NO: 420273 - DNA, 15 bp, Homo sapiens
ctcattgtggtttta

SEQ ID NO: 420274 - DNA, 15 bp, Homo sapiens
tcattgtggttttac

SEQ ID NO: 420275 - DNA, 15 bp, Homo sapiens
cattgtggttttacc

SEQ ID NO: 420276 - DNA, 15 bp, Homo sapiens
attgtggttttacca

SEQ ID NO: 420277 - DNA, 15 bp, Homo sapiens
ttgtggttttaccag

SEQ ID NO: 420278 - DNA, 15 bp, Homo sapiens
tgtggttttaccagc

SEQ ID NO: 420279 - DNA, 15 bp, Homo sapiens
gtggttttaccagca

SEQ ID NO: 420280 - DNA, 15 bp, Homo sapiens
tggttttaccagcat

SEQ ID NO: 420281 - DNA, 15 bp, Homo sapiens
ggttttaccagcatt

SEQ ID NO: 420282 - DNA, 15 bp, Homo sapiens
gttttaccagcattt

SEQ ID NO: 420283 - DNA, 15 bp, Homo sapiens
ttttaccagcatttc

SEQ ID NO: 420284 - DNA, 15 bp, Homo sapiens
tttaccagcatttcc

SEQ ID NO: 420285 - DNA, 15 bp, Homo sapiens
ttaccagcatttccc

SEQ ID NO: 420286 - DNA, 15 bp, Homo sapiens
taccagcatttccct

SEQ ID NO: 420287 - DNA, 15 bp, Homo sapiens
accagcatttccctg

SEQ ID NO: 420288 - DNA, 15 bp, Homo sapiens
ccagcatttccctga

SEQ ID NO: 420289 - DNA, 15 bp, Homo sapiens
cagcatttccctgag

SEQ ID NO: 420290 - DNA, 15 bp, Homo sapiens
agcatttccctgagg

SEQ ID NO: 420291 - DNA, 15 bp, Homo sapiens
gcatttccctgagga

SEQ ID NO: 420292 - DNA, 15 bp, Homo sapiens
catttccctgaggat

SEQ ID NO: 420293 - DNA, 15 bp, Homo sapiens
atttccctgaggatt

SEQ ID NO: 420294 - DNA, 15 bp, Homo sapiens
tttccctgaggatta

SEQ ID NO: 420295 - DNA, 15 bp, Homo sapiens
ttccctgaggattag

SEQ ID NO: 420296 - DNA, 15 bp, Homo sapiens
tccctgaggattagt

SEQ ID NO: 420297 - DNA, 15 bp, Homo sapiens
ccctgaggattagtg

SEQ ID NO: 420298 - DNA, 15 bp, Homo sapiens
cctgaggattagtga

SEQ ID NO: 420299 - DNA, 15 bp, Homo sapiens
ctgaggattagtgat

SEQ ID NO: 420300 - DNA, 15 bp, Homo sapiens
tgaggattagtgata

SEQ ID NO: 420301 - DNA, 15 bp, Homo sapiens
gaggattagtgatat

SEQ ID NO: 420302 - DNA, 15 bp, Homo sapiens
aggattagtgatatt

SEQ ID NO: 420303 - DNA, 15 bp, Homo sapiens
ggattagtgatattg

SEQ ID NO: 420304 - DNA, 15 bp, Homo sapiens
gattagtgatattga

SEQ ID NO: 420305 - DNA, 15 bp, Homo sapiens
attagtgatattgag

SEQ ID NO: 420306 - DNA, 15 bp, Homo sapiens
ttagtgatattgagt

SEQ ID NO: 420307 - DNA, 15 bp, Homo sapiens
tagtgatattgagtg

SEQ ID NO: 420308 - DNA, 15 bp, Homo sapiens
agtgatattgagtgt

SEQ ID NO: 420309 - DNA, 15 bp, Homo sapiens
gtgatattgagtgtt

SEQ ID NO: 420310 - DNA, 15 bp, Homo sapiens
tgatattgagtgttt

SEQ ID NO: 420311 - DNA, 15 bp, Homo sapiens
gatattgagtgtttc

SEQ ID NO: 420312 - DNA, 15 bp, Homo sapiens
atattgagtgtttct

SEQ ID NO: 420313 - DNA, 15 bp, Homo sapiens
tattgagtgtttctt

SEQ ID NO: 420314 - DNA, 15 bp, Homo sapiens
attgagtgtttcttc

SEQ ID NO: 420315 - DNA, 15 bp, Homo sapiens
ttgagtgtttcttca

SEQ ID NO: 420316 - DNA, 15 bp, Homo sapiens
tgagtgtttcttcat

SEQ ID NO: 420317 - DNA, 15 bp, Homo sapiens
gagtgtttcttcata

SEQ ID NO: 420318 - DNA, 15 bp, Homo sapiens
agtgtttcttcatat

SEQ ID NO: 420319 - DNA, 15 bp, Homo sapiens
gtgtttcttcatatg

SEQ ID NO: 420320 - DNA, 15 bp, Homo sapiens
tgtttcttcatatgt

SEQ ID NO: 420321 - DNA, 15 bp, Homo sapiens
gtttcttcatatgtt

SEQ ID NO: 420322 - DNA, 15 bp, Homo sapiens
tttcttcatatgttt

SEQ ID NO: 420323 - DNA, 15 bp, Homo sapiens
ttcttcatatgtttg

SEQ ID NO: 420324 - DNA, 15 bp, Homo sapiens
tcttcatatgtttgt

SEQ ID NO: 420325 - DNA, 15 bp, Homo sapiens
cttcatatgtttgtt

SEQ ID NO: 420326 - DNA, 15 bp, Homo sapiens
tcatatgtttgttgc

SEQ ID NO: 420327 - DNA, 15 bp, Homo sapiens
catatgtttgttgcc

SEQ ID NO: 420328 - DNA, 15 bp, Homo sapiens
atatgtttgttgccc

SEQ ID NO: 420329 - DNA, 15 bp, Homo sapiens
tatgtttgttgccca

SEQ ID NO: 420330 - DNA, 15 bp, Homo sapiens
atgtttgttgcccag

SEQ ID NO: 420331 - DNA, 15 bp, Homo sapiens
tgtttgttgcccagt

SEQ ID NO: 420332 - DNA, 15 bp, Homo sapiens
gtttgttgcccagtt

SEQ ID NO: 420333 - DNA, 15 bp, Homo sapiens
tttgttgcccagttg

SEQ ID NO: 420334 - DNA, 15 bp, Homo sapiens
ttgttgcccagttgt

SEQ ID NO: 420335 - DNA, 15 bp, Homo sapiens
tgttgcccagttgta

SEQ ID NO: 420336 - DNA, 15 bp, Homo sapiens
gttgcccagttgtat

SEQ ID NO: 420337 - DNA, 15 bp, Homo sapiens
ttgcccagttgtata

SEQ ID NO: 420338 - DNA, 15 bp, Homo sapiens
tgcccagttgtatat

SEQ ID NO: 420339 - DNA, 15 bp, Homo sapiens
gcccagttgtatatc

SEQ ID NO: 420340 - DNA, 15 bp, Homo sapiens
cccagttgtatatct

SEQ ID NO: 420341 - DNA, 15 bp, Homo sapiens
ccagttgtatatctt

SEQ ID NO: 420342 - DNA, 15 bp, Homo sapiens
cagttgtatatcttc

SEQ ID NO: 420343 - DNA, 15 bp, Homo sapiens
agttgtatatcttct

SEQ ID NO: 420344 - DNA, 15 bp, Homo sapiens
gttgtatatcttctt

SEQ ID NO: 420345 - DNA, 15 bp, Homo sapiens
ttgtatatcttcttt

SEQ ID NO: 420346 - DNA, 15 bp, Homo sapiens
tgtatatcttctttt

SEQ ID NO: 420347 - DNA, 15 bp, Homo sapiens
gtatatcttcttttg

SEQ ID NO: 420348 - DNA, 15 bp, Homo sapiens
tatatcttcttttga

SEQ ID NO: 420349 - DNA, 15 bp, Homo sapiens
atatcttcttttgag

SEQ ID NO: 420350 - DNA, 15 bp, Homo sapiens
tatcttcttttgaga

SEQ ID NO: 420351 - DNA, 15 bp, Homo sapiens
atcttcttttgagaa

SEQ ID NO: 420352 - DNA, 15 bp, Homo sapiens
tcttcttttgagaaa

SEQ ID NO: 420353 - DNA, 15 bp, Homo sapiens
cttcttttgagaaat

SEQ ID NO: 420354 - DNA, 15 bp, Homo sapiens
ttcttttgagaaatg

SEQ ID NO: 420355 - DNA, 15 bp, Homo sapiens
tcttttgagaaatgt

SEQ ID NO: 420356 - DNA, 15 bp, Homo sapiens
cttttgagaaatgtc

SEQ ID NO: 420357 - DNA, 15 bp, Homo sapiens
ttttgagaaatgtct

SEQ ID NO: 420358 - DNA, 15 bp, Homo sapiens
tttgagaaatgtcta

SEQ ID NO: 420359 - DNA, 15 bp, Homo sapiens
ttgagaaatgtctaa

SEQ ID NO: 420360 - DNA, 15 bp, Homo sapiens
tgagaaatgtctaat

SEQ ID NO: 420361 - DNA, 15 bp, Homo sapiens
gagaaatgtctaatc

SEQ ID NO: 420362 - DNA, 15 bp, Homo sapiens
agaaatgtctaatca

SEQ ID NO: 420363 - DNA, 15 bp, Homo sapiens
gaaatgtctaatcat

SEQ ID NO: 420364 - DNA, 15 bp, Homo sapiens
aaatgtctaatcatg

SEQ ID NO: 420365 - DNA, 15 bp, Homo sapiens
aatgtctaatcatgt

SEQ ID NO: 420366 - DNA, 15 bp, Homo sapiens
atgtctaatcatgtc

SEQ ID NO: 420367 - DNA, 15 bp, Homo sapiens
tgtctaatcatgtca

SEQ ID NO: 420368 - DNA, 15 bp, Homo sapiens
gtctaatcatgtcat

SEQ ID NO: 420369 - DNA, 15 bp, Homo sapiens
tctaatcatgtcatt

SEQ ID NO: 420370 - DNA, 15 bp, Homo sapiens
ctaatcatgtcattt

SEQ ID NO: 420371 - DNA, 15 bp, Homo sapiens
taatcatgtcatttg

SEQ ID NO: 420372 - DNA, 15 bp, Homo sapiens
aatcatgtcatttgc

SEQ ID NO: 420373 - DNA, 15 bp, Homo sapiens
atcatgtcatttgcc

SEQ ID NO: 420374 - DNA, 15 bp, Homo sapiens
tcatgtcatttgccc

SEQ ID NO: 420375 - DNA, 15 bp, Homo sapiens
catgtcatttgccca

SEQ ID NO: 420376 - DNA, 15 bp, Homo sapiens
atgtcatttgcccac

SEQ ID NO: 420377 - DNA, 15 bp, Homo sapiens
tgtcatttgcccact

SEQ ID NO: 420378 - DNA, 15 bp, Homo sapiens
gtcatttgcccactt

SEQ ID NO: 420379 - DNA, 15 bp, Homo sapiens
tcatttgcccacttt

SEQ ID NO: 420380 - DNA, 15 bp, Homo sapiens
catttgcccactttt

SEQ ID NO: 420381 - DNA, 15 bp, Homo sapiens
ttgcccactttttag

SEQ ID NO: 420382 - DNA, 15 bp, Homo sapiens
tgcccactttttagt

SEQ ID NO: 420383 - DNA, 15 bp, Homo sapiens
gcccactttttagta

SEQ ID NO: 420384 - DNA, 15 bp, Homo sapiens
cccactttttagtag

SEQ ID NO: 420385 - DNA, 15 bp, Homo sapiens
ccactttttagtagg

SEQ ID NO: 420386 - DNA, 15 bp, Homo sapiens
cactttttagtagga

SEQ ID NO: 420387 - DNA, 15 bp, Homo sapiens
actttttagtaggat

SEQ ID NO: 420388 - DNA, 15 bp, Homo sapiens
ctttttagtaggatt

SEQ ID NO: 420389 - DNA, 15 bp, Homo sapiens
tttttagtaggatta

SEQ ID NO: 420390 - DNA, 15 bp, Homo sapiens
ttttagtaggattat

SEQ ID NO: 420391 - DNA, 15 bp, Homo sapiens
tttagtaggattatt

SEQ ID NO: 420392 - DNA, 15 bp, Homo sapiens
ttagtaggattattt

SEQ ID NO: 420393 - DNA, 15 bp, Homo sapiens
tagtaggattatttg

SEQ ID NO: 420394 - DNA, 15 bp, Homo sapiens
agtaggattatttgt

SEQ ID NO: 420395 - DNA, 15 bp, Homo sapiens
gtaggattatttgtt

SEQ ID NO: 420396 - DNA, 15 bp, Homo sapiens
taggattatttgttt

SEQ ID NO: 420397 - DNA, 15 bp, Homo sapiens
aggattatttgtttt

SEQ ID NO: 420398 - DNA, 15 bp, Homo sapiens
gattatttgtttttg

SEQ ID NO: 420399 - DNA, 15 bp, Homo sapiens
attatttgtttttgt

SEQ ID NO: 420400 - DNA, 15 bp, Homo sapiens
ttatttgtttttgtt

SEQ ID NO: 420401 - DNA, 15 bp, Homo sapiens
tatttgtttttgttc

SEQ ID NO: 420402 - DNA, 15 bp, Homo sapiens
atttgtttttgttct

SEQ ID NO: 420403 - DNA, 15 bp, Homo sapiens
tttgtttttgttctt

SEQ ID NO: 420404 - DNA, 15 bp, Homo sapiens
ttgtttttgttcttg

SEQ ID NO: 420405 - DNA, 15 bp, Homo sapiens
tgtttttgttcttgc

SEQ ID NO: 420406 - DNA, 15 bp, Homo sapiens
gtttttgttcttgct

SEQ ID NO: 420407 - DNA, 15 bp, Homo sapiens
tttttgttcttgcta

SEQ ID NO: 420408 - DNA, 15 bp, Homo sapiens
ttttgttcttgctaa

SEQ ID NO: 420409 - DNA, 15 bp, Homo sapiens
tttgttcttgctaat

SEQ ID NO: 420410 - DNA, 15 bp, Homo sapiens
ttgttcttgctaatt

SEQ ID NO: 420411 - DNA, 15 bp, Homo sapiens
tgttcttgctaattt

SEQ ID NO: 420412 - DNA, 15 bp, Homo sapiens
gttcttgctaatttg

SEQ ID NO: 420413 - DNA, 15 bp, Homo sapiens
ttcttgctaatttga

SEQ ID NO: 420414 - DNA, 15 bp, Homo sapiens
tcttgctaatttgag

SEQ ID NO: 420415 - DNA, 15 bp, Homo sapiens
cttgctaatttgagt

SEQ ID NO: 420416 - DNA, 15 bp, Homo sapiens
ttgctaatttgagtt

SEQ ID NO: 420417 - DNA, 15 bp, Homo sapiens
tgctaatttgagttc

SEQ ID NO: 420418 - DNA, 15 bp, Homo sapiens
gctaatttgagttcc

SEQ ID NO: 420419 - DNA, 15 bp, Homo sapiens
ctaatttgagttcct

SEQ ID NO: 420420 - DNA, 15 bp, Homo sapiens
taatttgagttcctt

SEQ ID NO: 420421 - DNA, 15 bp, Homo sapiens
aatttgagttccttg

SEQ ID NO: 420422 - DNA, 15 bp, Homo sapiens
atttgagttccttgt

SEQ ID NO: 420423 - DNA, 15 bp, Homo sapiens
tttgagttccttgta

SEQ ID NO: 420424 - DNA, 15 bp, Homo sapiens
ttgagttccttgtag

SEQ ID NO: 420425 - DNA, 15 bp, Homo sapiens
tgagttccttgtaga

SEQ ID NO: 420426 - DNA, 15 bp, Homo sapiens
gagttccttgtagat

SEQ ID NO: 420427 - DNA, 15 bp, Homo sapiens
agttccttgtagatt

SEQ ID NO: 420428 - DNA, 15 bp, Homo sapiens
gttccttgtagattc

SEQ ID NO: 420429 - DNA, 15 bp, Homo sapiens
ttccttgtagattct

SEQ ID NO: 420430 - DNA, 15 bp, Homo sapiens
tccttgtagattctg

SEQ ID NO: 420431 - DNA, 15 bp, Homo sapiens
ccttgtagattctgg

SEQ ID NO: 420432 - DNA, 15 bp, Homo sapiens
cttgtagattctgga

SEQ ID NO: 420433 - DNA, 15 bp, Homo sapiens
ttgtagattctggat

SEQ ID NO: 420434 - DNA, 15 bp, Homo sapiens
tgtagattctggata

SEQ ID NO: 420435 - DNA, 15 bp, Homo sapiens
tagattctggatatc

SEQ ID NO: 420436 - DNA, 15 bp, Homo sapiens
agattctggatatca

SEQ ID NO: 420437 - DNA, 15 bp, Homo sapiens
gattctggatatcaa

SEQ ID NO: 420438 - DNA, 15 bp, Homo sapiens
attctggatatcaat

SEQ ID NO: 420439 - DNA, 15 bp, Homo sapiens
ttctggatatcaatt

SEQ ID NO: 420440 - DNA, 15 bp, Homo sapiens
tctggatatcaattc

SEQ ID NO: 420441 - DNA, 15 bp, Homo sapiens
ctggatatcaattct

SEQ ID NO: 420442 - DNA, 15 bp, Homo sapiens
tggatatcaattctt

SEQ ID NO: 420443 - DNA, 15 bp, Homo sapiens
ggatatcaattcttt

SEQ ID NO: 420444 - DNA, 15 bp, Homo sapiens
gatatcaattctttg

SEQ ID NO: 420445 - DNA, 15 bp, Homo sapiens
atatcaattctttgt

SEQ ID NO: 420446 - DNA, 15 bp, Homo sapiens
tatcaattctttgtt

SEQ ID NO: 420447 - DNA, 15 bp, Homo sapiens
atcaattctttgttg

SEQ ID NO: 420448 - DNA, 15 bp, Homo sapiens
tcaattctttgttgg

SEQ ID NO: 420449 - DNA, 15 bp, Homo sapiens
caattctttgttggg

SEQ ID NO: 420450 - DNA, 15 bp, Homo sapiens
aattctttgttggga

SEQ ID NO: 420451 - DNA, 15 bp, Homo sapiens
attctttgttgggag

SEQ ID NO: 420452 - DNA, 15 bp, Homo sapiens
ttctttgttgggaga

SEQ ID NO: 420453 - DNA, 15 bp, Homo sapiens
tctttgttgggagat

SEQ ID NO: 420454 - DNA, 15 bp, Homo sapiens
ctttgttgggagatt

SEQ ID NO: 420455 - DNA, 15 bp, Homo sapiens
tttgttgggagattc

SEQ ID NO: 420456 - DNA, 15 bp, Homo sapiens
ttgttgggagattct

SEQ ID NO: 420457 - DNA, 15 bp, Homo sapiens
tgttgggagattctg

SEQ ID NO: 420458 - DNA, 15 bp, Homo sapiens
gttgggagattctgg

SEQ ID NO: 420459 - DNA, 15 bp, Homo sapiens
ttgggagattctgga

SEQ ID NO: 420460 - DNA, 15 bp, Homo sapiens
tgggagattctggat

SEQ ID NO: 420461 - DNA, 15 bp, Homo sapiens
gggagattctggata

SEQ ID NO: 420462 - DNA, 15 bp, Homo sapiens
ggagattctggatat

SEQ ID NO: 420463 - DNA, 15 bp, Homo sapiens
gagattctggatatc

SEQ ID NO: 420464 - DNA, 15 bp, Homo sapiens
aattctttgttgggt

SEQ ID NO: 420465 - DNA, 15 bp, Homo sapiens
attctttgttgggtg

SEQ ID NO: 420466 - DNA, 15 bp, Homo sapiens
ttctttgttgggtgc

SEQ ID NO: 420467 - DNA, 15 bp, Homo sapiens
tctttgttgggtgca

SEQ ID NO: 420468 - DNA, 15 bp, Homo sapiens
ctttgttgggtgcat

SEQ ID NO: 420469 - DNA, 15 bp, Homo sapiens
tttgttgggtgcatt

SEQ ID NO: 420470 - DNA, 15 bp, Homo sapiens
ttgttgggtgcattg

SEQ ID NO: 420471 - DNA, 15 bp, Homo sapiens
tgttgggtgcattgt

SEQ ID NO: 420472 - DNA, 15 bp, Homo sapiens
gttgggtgcattgtt

SEQ ID NO: 420473 - DNA, 15 bp, Homo sapiens
ttgggtgcattgttt

SEQ ID NO: 420474 - DNA, 15 bp, Homo sapiens
tgggtgcattgttta

SEQ ID NO: 420475 - DNA, 15 bp, Homo sapiens
gggtgcattgtttac

SEQ ID NO: 420476 - DNA, 15 bp, Homo sapiens
ggtgcattgtttaca

SEQ ID NO: 420477 - DNA, 15 bp, Homo sapiens
gtgcattgtttacaa

SEQ ID NO: 420478 - DNA, 15 bp, Homo sapiens
tgcattgtttacaaa

SEQ ID NO: 420479 - DNA, 15 bp, Homo sapiens
gcattgtttacaaat

SEQ ID NO: 420480 - DNA, 15 bp, Homo sapiens
cattgtttacaaata

SEQ ID NO: 420481 - DNA, 15 bp, Homo sapiens
attgtttacaaatat

SEQ ID NO: 420482 - DNA, 15 bp, Homo sapiens
ttgtttacaaatatt

SEQ ID NO: 420483 - DNA, 15 bp, Homo sapiens
tgtttacaaatattt

SEQ ID NO: 420484 - DNA, 15 bp, Homo sapiens
gtttacaaatatttt

SEQ ID NO: 420485 - DNA, 15 bp, Homo sapiens
tttacaaatattttc

SEQ ID NO: 420486 - DNA, 15 bp, Homo sapiens
ttacaaatattttct

SEQ ID NO: 420487 - DNA, 15 bp, Homo sapiens
tacaaatattttctc

SEQ ID NO: 420488 - DNA, 15 bp, Homo sapiens
acaaatattttctct

SEQ ID NO: 420489 - DNA, 15 bp, Homo sapiens
caaatattttctctc

SEQ ID NO: 420490 - DNA, 15 bp, Homo sapiens
aaatattttctctca

SEQ ID NO: 420491 - DNA, 15 bp, Homo sapiens
aatattttctctcat

SEQ ID NO: 420492 - DNA, 15 bp, Homo sapiens
atattttctctcatt

SEQ ID NO: 420493 - DNA, 15 bp, Homo sapiens
tattttctctcattc

SEQ ID NO: 420494 - DNA, 15 bp, Homo sapiens
attttctctcattct

SEQ ID NO: 420495 - DNA, 15 bp, Homo sapiens
ttttctctcattctg

SEQ ID NO: 420496 - DNA, 15 bp, Homo sapiens
tttctctcattctgt

SEQ ID NO: 420497 - DNA, 15 bp, Homo sapiens
ttctctcattctgtg

SEQ ID NO: 420498 - DNA, 15 bp, Homo sapiens
tctctcattctgtgg

SEQ ID NO: 420499 - DNA, 15 bp, Homo sapiens
ctctcattctgtggg

SEQ ID NO: 420500 - DNA, 15 bp, Homo sapiens
tctcattctgtgggt

SEQ ID NO: 420501 - DNA, 15 bp, Homo sapiens
ctcattctgtgggtt

SEQ ID NO: 420502 - DNA, 15 bp, Homo sapiens
tcattctgtgggttg

SEQ ID NO: 420503 - DNA, 15 bp, Homo sapiens
cattctgtgggttgt

SEQ ID NO: 420504 - DNA, 15 bp, Homo sapiens
attctgtgggttgtt

SEQ ID NO: 420505 - DNA, 15 bp, Homo sapiens
ttctgtgggttgttt

SEQ ID NO: 420506 - DNA, 15 bp, Homo sapiens
tctgtgggttgtttt

SEQ ID NO: 420507 - DNA, 15 bp, Homo sapiens
ctgtgggttgttttt

SEQ ID NO: 420508 - DNA, 15 bp, Homo sapiens
gtgggttgttttttt

SEQ ID NO: 420509 - DNA, 15 bp, Homo sapiens
tgggttgtttttttg

SEQ ID NO: 420510 - DNA, 15 bp, Homo sapiens
gggttgtttttttgc

SEQ ID NO: 420511 - DNA, 15 bp, Homo sapiens
ggttgtttttttgct

SEQ ID NO: 420512 - DNA, 15 bp, Homo sapiens
gttgtttttttgctc

SEQ ID NO: 420513 - DNA, 15 bp, Homo sapiens
ttgtttttttgctct

SEQ ID NO: 420514 - DNA, 15 bp, Homo sapiens
tgtttttttgctctg

SEQ ID NO: 420515 - DNA, 15 bp, Homo sapiens
gtttttttgctctgt

SEQ ID NO: 420516 - DNA, 15 bp, Homo sapiens
tttttttgctctgtt

SEQ ID NO: 420517 - DNA, 15 bp, Homo sapiens
ttttttgctctgttg

SEQ ID NO: 420518 - DNA, 15 bp, Homo sapiens
tttttgctctgttga

SEQ ID NO: 420519 - DNA, 15 bp, Homo sapiens
ttttgctctgttgat

SEQ ID NO: 420520 - DNA, 15 bp, Homo sapiens
tttgctctgttgatt

SEQ ID NO: 420521 - DNA, 15 bp, Homo sapiens
ttgctctgttgatta

SEQ ID NO: 420522 - DNA, 15 bp, Homo sapiens
tgctctgttgattat

SEQ ID NO: 420523 - DNA, 15 bp, Homo sapiens
gctctgttgattatt

SEQ ID NO: 420524 - DNA, 15 bp, Homo sapiens
ctctgttgattattt

SEQ ID NO: 420525 - DNA, 15 bp, Homo sapiens
tctgttgattatttc

SEQ ID NO: 420526 - DNA, 15 bp, Homo sapiens
ctgttgattatttct

SEQ ID NO: 420527 - DNA, 15 bp, Homo sapiens
tgttgattatttctt

SEQ ID NO: 420528 - DNA, 15 bp, Homo sapiens
gttgattatttcttt

SEQ ID NO: 420529 - DNA, 15 bp, Homo sapiens
ttgattatttctttt

SEQ ID NO: 420530 - DNA, 15 bp, Homo sapiens
tgattatttcttttg

SEQ ID NO: 420531 - DNA, 15 bp, Homo sapiens
gattatttcttttgc

SEQ ID NO: 420532 - DNA, 15 bp, Homo sapiens
attatttcttttgct

SEQ ID NO: 420533 - DNA, 15 bp, Homo sapiens
ttatttcttttgctg

SEQ ID NO: 420534 - DNA, 15 bp, Homo sapiens
tatttcttttgctgt

SEQ ID NO: 420535 - DNA, 15 bp, Homo sapiens
atttcttttgctgtg

SEQ ID NO: 420536 - DNA, 15 bp, Homo sapiens
tttcttttgctgtgc

SEQ ID NO: 420537 - DNA, 15 bp, Homo sapiens
ttcttttgctgtgca

SEQ ID NO: 420538 - DNA, 15 bp, Homo sapiens
tcttttgctgtgcag

SEQ ID NO: 420539 - DNA, 15 bp, Homo sapiens
cttttgctgtgcaga

SEQ ID NO: 420540 - DNA, 15 bp, Homo sapiens
ttttgctgtgcagaa

SEQ ID NO: 420541 - DNA, 15 bp, Homo sapiens
tgctgtgcagaagca

SEQ ID NO: 420542 - DNA, 15 bp, Homo sapiens
gctgtgcagaagcat

SEQ ID NO: 420543 - DNA, 15 bp, Homo sapiens
ctgtgcagaagcatt

SEQ ID NO: 420544 - DNA, 15 bp, Homo sapiens
tgtgcagaagcattt

SEQ ID NO: 420545 - DNA, 15 bp, Homo sapiens
gtgcagaagcatttt

SEQ ID NO: 420546 - DNA, 15 bp, Homo sapiens
tgcagaagcatttta

SEQ ID NO: 420547 - DNA, 15 bp, Homo sapiens
gcagaagcattttag

SEQ ID NO: 420548 - DNA, 15 bp, Homo sapiens
cagaagcattttagt

SEQ ID NO: 420549 - DNA, 15 bp, Homo sapiens
agaagcattttagtt

SEQ ID NO: 420550 - DNA, 15 bp, Homo sapiens
gaagcattttagttt

SEQ ID NO: 420551 - DNA, 15 bp, Homo sapiens
aagcattttagttta

SEQ ID NO: 420552 - DNA, 15 bp, Homo sapiens
agcattttagtttaa

SEQ ID NO: 420553 - DNA, 15 bp, Homo sapiens
gcattttagtttaag

SEQ ID NO: 420554 - DNA, 15 bp, Homo sapiens
attttagtttaagta

SEQ ID NO: 420555 - DNA, 15 bp, Homo sapiens
ttttagtttaagtag

SEQ ID NO: 420556 - DNA, 15 bp, Homo sapiens
tttagtttaagtagg

SEQ ID NO: 420557 - DNA, 15 bp, Homo sapiens
ttagtttaagtaggt

SEQ ID NO: 420558 - DNA, 15 bp, Homo sapiens
tagtttaagtaggtg

SEQ ID NO: 420559 - DNA, 15 bp, Homo sapiens
agtttaagtaggtgc

SEQ ID NO: 420560 - DNA, 15 bp, Homo sapiens
gtttaagtaggtgcc

SEQ ID NO: 420561 - DNA, 15 bp, Homo sapiens
tttaagtaggtgcca

SEQ ID NO: 420562 - DNA, 15 bp, Homo sapiens
ttaagtaggtgccat

SEQ ID NO: 420563 - DNA, 15 bp, Homo sapiens
taagtaggtgccatt

SEQ ID NO: 420564 - DNA, 15 bp, Homo sapiens
aagtaggtgccattt

SEQ ID NO: 420565 - DNA, 15 bp, Homo sapiens
agtaggtgccattta

SEQ ID NO: 420566 - DNA, 15 bp, Homo sapiens
gtaggtgccatttat

SEQ ID NO: 420567 - DNA, 15 bp, Homo sapiens
taggtgccatttatt

SEQ ID NO: 420568 - DNA, 15 bp, Homo sapiens
aggtgccatttattt

SEQ ID NO: 420569 - DNA, 15 bp, Homo sapiens
ggtgccatttattta

SEQ ID NO: 420570 - DNA, 15 bp, Homo sapiens
gtgccatttatttat

SEQ ID NO: 420571 - DNA, 15 bp, Homo sapiens
tgccatttatttatt

SEQ ID NO: 420572 - DNA, 15 bp, Homo sapiens
gccatttatttattt

SEQ ID NO: 420573 - DNA, 15 bp, Homo sapiens
ccatttatttatttt

SEQ ID NO: 420574 - DNA, 15 bp, Homo sapiens
catttatttattttt

SEQ ID NO: 420575 - DNA, 15 bp, Homo sapiens
tttatttatttttgt

SEQ ID NO: 420576 - DNA, 15 bp, Homo sapiens
ttatttatttttgtt

SEQ ID NO: 420577 - DNA, 15 bp, Homo sapiens
tatttatttttgttc

SEQ ID NO: 420578 - DNA, 15 bp, Homo sapiens
atttatttttgttct

SEQ ID NO: 420579 - DNA, 15 bp, Homo sapiens
tttatttttgttctt

SEQ ID NO: 420580 - DNA, 15 bp, Homo sapiens
ttatttttgttcttg

SEQ ID NO: 420581 - DNA, 15 bp, Homo sapiens
tatttttgttcttgc

SEQ ID NO: 420582 - DNA, 15 bp, Homo sapiens
atttttgttcttgct

SEQ ID NO: 420583 - DNA, 15 bp, Homo sapiens
ttttgttcttgctac

SEQ ID NO: 420584 - DNA, 15 bp, Homo sapiens
tttgttcttgctaca

SEQ ID NO: 420585 - DNA, 15 bp, Homo sapiens
ttgttcttgctacat

SEQ ID NO: 420586 - DNA, 15 bp, Homo sapiens
tgttcttgctacatt

SEQ ID NO: 420587 - DNA, 15 bp, Homo sapiens
gttcttgctacattt

SEQ ID NO: 420588 - DNA, 15 bp, Homo sapiens
ttcttgctacatttg

SEQ ID NO: 420589 - DNA, 15 bp, Homo sapiens
tcttgctacatttgc

SEQ ID NO: 420590 - DNA, 15 bp, Homo sapiens
cttgctacatttgca

SEQ ID NO: 420591 - DNA, 15 bp, Homo sapiens
ttgctacatttgcat

SEQ ID NO: 420592 - DNA, 15 bp, Homo sapiens
tgctacatttgcatt

SEQ ID NO: 420593 - DNA, 15 bp, Homo sapiens
gctacatttgcattt

SEQ ID NO: 420594 - DNA, 15 bp, Homo sapiens
ctacatttgcatttg

SEQ ID NO: 420595 - DNA, 15 bp, Homo sapiens
tacatttgcatttgc

SEQ ID NO: 420596 - DNA, 15 bp, Homo sapiens
acatttgcatttgct

SEQ ID NO: 420597 - DNA, 15 bp, Homo sapiens
catttgcatttgctt

SEQ ID NO: 420598 - DNA, 15 bp, Homo sapiens
atttgcatttgcttt

SEQ ID NO: 420599 - DNA, 15 bp, Homo sapiens
tttgcatttgctttt

SEQ ID NO: 420600 - DNA, 15 bp, Homo sapiens
catttgcttttgggg

SEQ ID NO: 420601 - DNA, 15 bp, Homo sapiens
atttgcttttggggt

SEQ ID NO: 420602 - DNA, 15 bp, Homo sapiens
tttgcttttggggtc

SEQ ID NO: 420603 - DNA, 15 bp, Homo sapiens
ttgcttttggggtct

SEQ ID NO: 420604 - DNA, 15 bp, Homo sapiens
tgcttttggggtctt

SEQ ID NO: 420605 - DNA, 15 bp, Homo sapiens
gcttttggggtctta

SEQ ID NO: 420606 - DNA, 15 bp, Homo sapiens
cttttggggtcttag

SEQ ID NO: 420607 - DNA, 15 bp, Homo sapiens
ttttggggtcttagt

SEQ ID NO: 420608 - DNA, 15 bp, Homo sapiens
tttggggtcttagtc

SEQ ID NO: 420609 - DNA, 15 bp, Homo sapiens
ttggggtcttagtca

SEQ ID NO: 420610 - DNA, 15 bp, Homo sapiens
tggggtcttagtcat

SEQ ID NO: 420611 - DNA, 15 bp, Homo sapiens
ggggtcttagtcata

SEQ ID NO: 420612 - DNA, 15 bp, Homo sapiens
gggtcttagtcataa

SEQ ID NO: 420613 - DNA, 15 bp, Homo sapiens
ggtcttagtcataaa

SEQ ID NO: 420614 - DNA, 15 bp, Homo sapiens
gtcttagtcataaat

SEQ ID NO: 420615 - DNA, 15 bp, Homo sapiens
tcttagtcataaatt

SEQ ID NO: 420616 - DNA, 15 bp, Homo sapiens
cttagtcataaattc

SEQ ID NO: 420617 - DNA, 15 bp, Homo sapiens
ttagtcataaattct

SEQ ID NO: 420618 - DNA, 15 bp, Homo sapiens
tagtcataaattctt

SEQ ID NO: 420619 - DNA, 15 bp, Homo sapiens
agtcataaattcttt

SEQ ID NO: 420620 - DNA, 15 bp, Homo sapiens
gtcataaattctttg

SEQ ID NO: 420621 - DNA, 15 bp, Homo sapiens
tcataaattctttgc

SEQ ID NO: 420622 - DNA, 15 bp, Homo sapiens
cataaattctttgcc

SEQ ID NO: 420623 - DNA, 15 bp, Homo sapiens
ataaattctttgcct

SEQ ID NO: 420624 - DNA, 15 bp, Homo sapiens
taaattctttgccta

SEQ ID NO: 420625 - DNA, 15 bp, Homo sapiens
aaattctttgcctag

SEQ ID NO: 420626 - DNA, 15 bp, Homo sapiens
aattctttgcctagg

SEQ ID NO: 420627 - DNA, 15 bp, Homo sapiens
attctttgcctaggc

SEQ ID NO: 420628 - DNA, 15 bp, Homo sapiens
ttctttgcctaggcc

SEQ ID NO: 420629 - DNA, 15 bp, Homo sapiens
tctttgcctaggcca

SEQ ID NO: 420630 - DNA, 15 bp, Homo sapiens
ctttgcctaggccaa

SEQ ID NO: 420631 - DNA, 15 bp, Homo sapiens
tttgcctaggccaat

SEQ ID NO: 420632 - DNA, 15 bp, Homo sapiens
ttgcctaggccaatt

SEQ ID NO: 420633 - DNA, 15 bp, Homo sapiens
tgcctaggccaattt

SEQ ID NO: 420634 - DNA, 15 bp, Homo sapiens
gcctaggccaatttt

SEQ ID NO: 420635 - DNA, 15 bp, Homo sapiens
cctaggccaattttc

SEQ ID NO: 420636 - DNA, 15 bp, Homo sapiens
ctaggccaattttca

SEQ ID NO: 420637 - DNA, 15 bp, Homo sapiens
taggccaattttcag

SEQ ID NO: 420638 - DNA, 15 bp, Homo sapiens
aggccaattttcaga

SEQ ID NO: 420639 - DNA, 15 bp, Homo sapiens
ggccaattttcagaa

SEQ ID NO: 420640 - DNA, 15 bp, Homo sapiens
gccaattttcagaag

SEQ ID NO: 420641 - DNA, 15 bp, Homo sapiens
ccaattttcagaaga

SEQ ID NO: 420642 - DNA, 15 bp, Homo sapiens
caattttcagaagag

SEQ ID NO: 420643 - DNA, 15 bp, Homo sapiens
aattttcagaagagt

SEQ ID NO: 420644 - DNA, 15 bp, Homo sapiens
attttcagaagagtt

SEQ ID NO: 420645 - DNA, 15 bp, Homo sapiens
ttttcagaagagttt

SEQ ID NO: 420646 - DNA, 15 bp, Homo sapiens
tttcagaagagtttt

SEQ ID NO: 420647 - DNA, 15 bp, Homo sapiens
ttcagaagagttttt

SEQ ID NO: 420648 - DNA, 15 bp, Homo sapiens
tcagaagagtttttc

SEQ ID NO: 420649 - DNA, 15 bp, Homo sapiens
cagaagagtttttcc

SEQ ID NO: 420650 - DNA, 15 bp, Homo sapiens
agaagagtttttcct

SEQ ID NO: 420651 - DNA, 15 bp, Homo sapiens
gaagagtttttccta

SEQ ID NO: 420652 - DNA, 15 bp, Homo sapiens
aagagtttttcctag

SEQ ID NO: 420653 - DNA, 15 bp, Homo sapiens
agagtttttcctaga

SEQ ID NO: 420654 - DNA, 15 bp, Homo sapiens
gagtttttcctagaa

SEQ ID NO: 420655 - DNA, 15 bp, Homo sapiens
agtttttcctagaat

SEQ ID NO: 420656 - DNA, 15 bp, Homo sapiens
gtttttcctagaatt

SEQ ID NO: 420657 - DNA, 15 bp, Homo sapiens
tttttcctagaattt

SEQ ID NO: 420658 - DNA, 15 bp, Homo sapiens
ttttcctagaatttc

SEQ ID NO: 420659 - DNA, 15 bp, Homo sapiens
tttcctagaatttct

SEQ ID NO: 420660 - DNA, 15 bp, Homo sapiens
ttcctagaatttctt

SEQ ID NO: 420661 - DNA, 15 bp, Homo sapiens
tcctagaatttcttc

SEQ ID NO: 420662 - DNA, 15 bp, Homo sapiens
cctagaatttcttct

SEQ ID NO: 420663 - DNA, 15 bp, Homo sapiens
ctagaatttcttcta

SEQ ID NO: 420664 - DNA, 15 bp, Homo sapiens
tagaatttcttctaa

SEQ ID NO: 420665 - DNA, 15 bp, Homo sapiens
agaatttcttctaaa

SEQ ID NO: 420666 - DNA, 15 bp, Homo sapiens
gaatttcttctaaaa

SEQ ID NO: 420667 - DNA, 15 bp, Homo sapiens
aatttcttctaaaat

SEQ ID NO: 420668 - DNA, 15 bp, Homo sapiens
atttcttctaaaatt

SEQ ID NO: 420669 - DNA, 15 bp, Homo sapiens
tttcttctaaaattg

SEQ ID NO: 420670 - DNA, 15 bp, Homo sapiens
ttcttctaaaattgt

SEQ ID NO: 420671 - DNA, 15 bp, Homo sapiens
tcttctaaaattgtt

SEQ ID NO: 420672 - DNA, 15 bp, Homo sapiens
cttctaaaattgtta

SEQ ID NO: 420673 - DNA, 15 bp, Homo sapiens
ttctaaaattgttaa

SEQ ID NO: 420674 - DNA, 15 bp, Homo sapiens
tctaaaattgttaat

SEQ ID NO: 420675 - DNA, 15 bp, Homo sapiens
ctaaaattgttaatg

SEQ ID NO: 420676 - DNA, 15 bp, Homo sapiens
taaaattgttaatgg

SEQ ID NO: 420677 - DNA, 15 bp, Homo sapiens
aaaattgttaatggt

SEQ ID NO: 420678 - DNA, 15 bp, Homo sapiens
aaattgttaatggtt

SEQ ID NO: 420679 - DNA, 15 bp, Homo sapiens
aattgttaatggttt

SEQ ID NO: 420680 - DNA, 15 bp, Homo sapiens
attgttaatggtttc

SEQ ID NO: 420681 - DNA, 15 bp, Homo sapiens
ttgttaatggtttca

SEQ ID NO: 420682 - DNA, 15 bp, Homo sapiens
tgttaatggtttcag

SEQ ID NO: 420683 - DNA, 15 bp, Homo sapiens
gttaatggtttcagg

SEQ ID NO: 420684 - DNA, 15 bp, Homo sapiens
ttaatggtttcaggt

SEQ ID NO: 420685 - DNA, 15 bp, Homo sapiens
taatggtttcaggtc

SEQ ID NO: 420686 - DNA, 15 bp, Homo sapiens
aatggtttcaggtct

SEQ ID NO: 420687 - DNA, 15 bp, Homo sapiens
atggtttcaggtctt

SEQ ID NO: 420688 - DNA, 15 bp, Homo sapiens
tggtttcaggtctta

SEQ ID NO: 420689 - DNA, 15 bp, Homo sapiens
ggtttcaggtcttag

SEQ ID NO: 420690 - DNA, 15 bp, Homo sapiens
gtttcaggtcttaga

SEQ ID NO: 420691 - DNA, 15 bp, Homo sapiens
tttcaggtcttagat

SEQ ID NO: 420692 - DNA, 15 bp, Homo sapiens
ttcaggtcttagatt

SEQ ID NO: 420693 - DNA, 15 bp, Homo sapiens
tcaggtcttagattt

SEQ ID NO: 420694 - DNA, 15 bp, Homo sapiens
caggtcttagattta

SEQ ID NO: 420695 - DNA, 15 bp, Homo sapiens
aggtcttagatttaa

SEQ ID NO: 420696 - DNA, 15 bp, Homo sapiens
ggtcttagatttaag

SEQ ID NO: 420697 - DNA, 15 bp, Homo sapiens
gtcttagatttaagt

SEQ ID NO: 420698 - DNA, 15 bp, Homo sapiens
agatttaagtcttta

SEQ ID NO: 420699 - DNA, 15 bp, Homo sapiens
gatttaagtctttaa

SEQ ID NO: 420700 - DNA, 15 bp, Homo sapiens
atttaagtctttaat

SEQ ID NO: 420701 - DNA, 15 bp, Homo sapiens
agtctttaatccatg

SEQ ID NO: 420702 - DNA, 15 bp, Homo sapiens
gtctttaatccatgt

SEQ ID NO: 420703 - DNA, 15 bp, Homo sapiens
tctttaatccatgtt

SEQ ID NO: 420704 - DNA, 15 bp, Homo sapiens
ctttaatccatgttg

SEQ ID NO: 420705 - DNA, 15 bp, Homo sapiens
tttaatccatgttga

SEQ ID NO: 420706 - DNA, 15 bp, Homo sapiens
ttaatccatgttgag

SEQ ID NO: 420707 - DNA, 15 bp, Homo sapiens
taatccatgttgagt

SEQ ID NO: 420708 - DNA, 15 bp, Homo sapiens
aatccatgttgagtt

SEQ ID NO: 420709 - DNA, 15 bp, Homo sapiens
atccatgttgagttg

SEQ ID NO: 420710 - DNA, 15 bp, Homo sapiens
tccatgttgagttga

SEQ ID NO: 420711 - DNA, 15 bp, Homo sapiens
ccatgttgagttgat

SEQ ID NO: 420712 - DNA, 15 bp, Homo sapiens
catgttgagttgatt

SEQ ID NO: 420713 - DNA, 15 bp, Homo sapiens
atgttgagttgattt

SEQ ID NO: 420714 - DNA, 15 bp, Homo sapiens
tgttgagttgatttt

SEQ ID NO: 420715 - DNA, 15 bp, Homo sapiens
gttgagttgattttt

SEQ ID NO: 420716 - DNA, 15 bp, Homo sapiens
ttgagttgatttttg

SEQ ID NO: 420717 - DNA, 15 bp, Homo sapiens
tgagttgatttttgt

SEQ ID NO: 420718 - DNA, 15 bp, Homo sapiens
gagttgatttttgta

SEQ ID NO: 420719 - DNA, 15 bp, Homo sapiens
agttgatttttgtat

SEQ ID NO: 420720 - DNA, 15 bp, Homo sapiens
gttgatttttgtata

SEQ ID NO: 420721 - DNA, 15 bp, Homo sapiens
ttgatttttgtatat

SEQ ID NO: 420722 - DNA, 15 bp, Homo sapiens
tgatttttgtatata

SEQ ID NO: 420723 - DNA, 15 bp, Homo sapiens
gatttttgtatatag

SEQ ID NO: 420724 - DNA, 15 bp, Homo sapiens
atttttgtatatagt

SEQ ID NO: 420725 - DNA, 15 bp, Homo sapiens
tttttgtatatagtg

SEQ ID NO: 420726 - DNA, 15 bp, Homo sapiens
ttttgtatatagtga

SEQ ID NO: 420727 - DNA, 15 bp, Homo sapiens
tttgtatatagtgag

SEQ ID NO: 420728 - DNA, 15 bp, Homo sapiens
ttgtatatagtgaga

SEQ ID NO: 420729 - DNA, 15 bp, Homo sapiens
tgtatatagtgagaa

SEQ ID NO: 420730 - DNA, 15 bp, Homo sapiens
gtatatagtgagaaa

SEQ ID NO: 420731 - DNA, 15 bp, Homo sapiens
tatatagtgagaaat

SEQ ID NO: 420732 - DNA, 15 bp, Homo sapiens
atatagtgagaaata

SEQ ID NO: 420733 - DNA, 15 bp, Homo sapiens
tatagtgagaaatag

SEQ ID NO: 420734 - DNA, 15 bp, Homo sapiens
atagtgagaaatagg

SEQ ID NO: 420735 - DNA, 15 bp, Homo sapiens
tagtgagaaatagga

SEQ ID NO: 420736 - DNA, 15 bp, Homo sapiens
agtgagaaataggaa

SEQ ID NO: 420737 - DNA, 15 bp, Homo sapiens
gtgagaaataggaat

SEQ ID NO: 420738 - DNA, 15 bp, Homo sapiens
tgagaaataggaatt

SEQ ID NO: 420739 - DNA, 15 bp, Homo sapiens
gagaaataggaattc

SEQ ID NO: 420740 - DNA, 15 bp, Homo sapiens
agaaataggaattca

SEQ ID NO: 420741 - DNA, 15 bp, Homo sapiens
gaaataggaattcag

SEQ ID NO: 420742 - DNA, 15 bp, Homo sapiens
aaataggaattcagt

SEQ ID NO: 420743 - DNA, 15 bp, Homo sapiens
aataggaattcagtt

SEQ ID NO: 420744 - DNA, 15 bp, Homo sapiens
ataggaattcagttt

SEQ ID NO: 420745 - DNA, 15 bp, Homo sapiens
taggaattcagtttc

SEQ ID NO: 420746 - DNA, 15 bp, Homo sapiens
aggaattcagtttca

SEQ ID NO: 420747 - DNA, 15 bp, Homo sapiens
ggaattcagtttcat

SEQ ID NO: 420748 - DNA, 15 bp, Homo sapiens
gaattcagtttcatt

SEQ ID NO: 420749 - DNA, 15 bp, Homo sapiens
aattcagtttcattc

SEQ ID NO: 420750 - DNA, 15 bp, Homo sapiens
attcagtttcattct

SEQ ID NO: 420751 - DNA, 15 bp, Homo sapiens
ttcagtttcattctt

SEQ ID NO: 420752 - DNA, 15 bp, Homo sapiens
tcagtttcattcttc

SEQ ID NO: 420753 - DNA, 15 bp, Homo sapiens
cagtttcattcttcc

SEQ ID NO: 420754 - DNA, 15 bp, Homo sapiens
agtttcattcttcca

SEQ ID NO: 420755 - DNA, 15 bp, Homo sapiens
gtttcattcttccac

SEQ ID NO: 420756 - DNA, 15 bp, Homo sapiens
tttcattcttccaca

SEQ ID NO: 420757 - DNA, 15 bp, Homo sapiens
ttcattcttccacat

SEQ ID NO: 420758 - DNA, 15 bp, Homo sapiens
tcattcttccacatg

SEQ ID NO: 420759 - DNA, 15 bp, Homo sapiens
cattcttccacatgt

SEQ ID NO: 420760 - DNA, 15 bp, Homo sapiens
attcttccacatgtg

SEQ ID NO: 420761 - DNA, 15 bp, Homo sapiens
ttcttccacatgtga

SEQ ID NO: 420762 - DNA, 15 bp, Homo sapiens
tcttccacatgtgac

SEQ ID NO: 420763 - DNA, 15 bp, Homo sapiens
cttccacatgtgact

SEQ ID NO: 420764 - DNA, 15 bp, Homo sapiens
ttccacatgtgactt

SEQ ID NO: 420765 - DNA, 15 bp, Homo sapiens
tccacatgtgacttt

SEQ ID NO: 420766 - DNA, 15 bp, Homo sapiens
ccacatgtgactttc

SEQ ID NO: 420767 - DNA, 15 bp, Homo sapiens
cacatgtgactttcc

SEQ ID NO: 420768 - DNA, 15 bp, Homo sapiens
acatgtgactttcca

SEQ ID NO: 420769 - DNA, 15 bp, Homo sapiens
catgtgactttccag

SEQ ID NO: 420770 - DNA, 15 bp, Homo sapiens
atgtgactttccagt

SEQ ID NO: 420771 - DNA, 15 bp, Homo sapiens
tgtgactttccagtg

SEQ ID NO: 420772 - DNA, 15 bp, Homo sapiens
gtgactttccagtgt

SEQ ID NO: 420773 - DNA, 15 bp, Homo sapiens
tgactttccagtgtt

SEQ ID NO: 420774 - DNA, 15 bp, Homo sapiens
gactttccagtgttc

SEQ ID NO: 420775 - DNA, 15 bp, Homo sapiens
actttccagtgttcc

SEQ ID NO: 420776 - DNA, 15 bp, Homo sapiens
ctttccagtgttccc

SEQ ID NO: 420777 - DNA, 15 bp, Homo sapiens
tttccagtgttccca

SEQ ID NO: 420778 - DNA, 15 bp, Homo sapiens
ttccagtgttcccag

SEQ ID NO: 420779 - DNA, 15 bp, Homo sapiens
tccagtgttcccagc

SEQ ID NO: 420780 - DNA, 15 bp, Homo sapiens
ccagtgttcccagca

SEQ ID NO: 420781 - DNA, 15 bp, Homo sapiens
cagtgttcccagcat

SEQ ID NO: 420782 - DNA, 15 bp, Homo sapiens
agtgttcccagcatc

SEQ ID NO: 420783 - DNA, 15 bp, Homo sapiens
gtgttcccagcatca

SEQ ID NO: 420784 - DNA, 15 bp, Homo sapiens
tgttcccagcatcat

SEQ ID NO: 420785 - DNA, 15 bp, Homo sapiens
gttcccagcatcatt

SEQ ID NO: 420786 - DNA, 15 bp, Homo sapiens
ttcccagcatcattt

SEQ ID NO: 420787 - DNA, 15 bp, Homo sapiens
tcccagcatcattta

SEQ ID NO: 420788 - DNA, 15 bp, Homo sapiens
cccagcatcatttat

SEQ ID NO: 420789 - DNA, 15 bp, Homo sapiens
ccagcatcatttatt

SEQ ID NO: 420790 - DNA, 15 bp, Homo sapiens
cagcatcatttattg

SEQ ID NO: 420791 - DNA, 15 bp, Homo sapiens
agcatcatttattga

SEQ ID NO: 420792 - DNA, 15 bp, Homo sapiens
gcatcatttattgaa

SEQ ID NO: 420793 - DNA, 15 bp, Homo sapiens
catcatttattgaat

SEQ ID NO: 420794 - DNA, 15 bp, Homo sapiens
atcatttattgaata

SEQ ID NO: 420795 - DNA, 15 bp, Homo sapiens
tcatttattgaatag

SEQ ID NO: 420796 - DNA, 15 bp, Homo sapiens
catttattgaatagc

SEQ ID NO: 420797 - DNA, 15 bp, Homo sapiens
atttattgaatagca

SEQ ID NO: 420798 - DNA, 15 bp, Homo sapiens
tttattgaatagcat

SEQ ID NO: 420799 - DNA, 15 bp, Homo sapiens
ttattgaatagcatg

SEQ ID NO: 420800 - DNA, 15 bp, Homo sapiens
tattgaatagcatgt

SEQ ID NO: 420801 - DNA, 15 bp, Homo sapiens
attgaatagcatgtc

SEQ ID NO: 420802 - DNA, 15 bp, Homo sapiens
ttgaatagcatgtcc

SEQ ID NO: 420803 - DNA, 15 bp, Homo sapiens
tgaatagcatgtcct

SEQ ID NO: 420804 - DNA, 15 bp, Homo sapiens
gaatagcatgtcctt

SEQ ID NO: 420805 - DNA, 15 bp, Homo sapiens
aatagcatgtccttt

SEQ ID NO: 420806 - DNA, 15 bp, Homo sapiens
atagcatgtcctttt

SEQ ID NO: 420807 - DNA, 15 bp, Homo sapiens
tagcatgtccttttt

SEQ ID NO: 420808 - DNA, 15 bp, Homo sapiens
agcatgtcctttttc

SEQ ID NO: 420809 - DNA, 15 bp, Homo sapiens
gcatgtcctttttcc

SEQ ID NO: 420810 - DNA, 15 bp, Homo sapiens
catgtcctttttcca

SEQ ID NO: 420811 - DNA, 15 bp, Homo sapiens
atgtcctttttccaa

SEQ ID NO: 420812 - DNA, 15 bp, Homo sapiens
tgtcctttttccaat

SEQ ID NO: 420813 - DNA, 15 bp, Homo sapiens
gtcctttttccaatt

SEQ ID NO: 420814 - DNA, 15 bp, Homo sapiens
tcctttttccaattt

SEQ ID NO: 420815 - DNA, 15 bp, Homo sapiens
cctttttccaattta

SEQ ID NO: 420816 - DNA, 15 bp, Homo sapiens
ctttttccaatttat

SEQ ID NO: 420817 - DNA, 15 bp, Homo sapiens
tttttccaatttatg

SEQ ID NO: 420818 - DNA, 15 bp, Homo sapiens
ttttccaatttatgt

SEQ ID NO: 420819 - DNA, 15 bp, Homo sapiens
tttccaatttatgtt

SEQ ID NO: 420820 - DNA, 15 bp, Homo sapiens
ttccaatttatgttt

SEQ ID NO: 420821 - DNA, 15 bp, Homo sapiens
tccaatttatgtttt

SEQ ID NO: 420822 - DNA, 15 bp, Homo sapiens
ccaatttatgttttt

SEQ ID NO: 420823 - DNA, 15 bp, Homo sapiens
caatttatgtttttg

SEQ ID NO: 420824 - DNA, 15 bp, Homo sapiens
aatttatgtttttgt

SEQ ID NO: 420825 - DNA, 15 bp, Homo sapiens
atttatgtttttgtg

SEQ ID NO: 420826 - DNA, 15 bp, Homo sapiens
tttatgtttttgtgt

SEQ ID NO: 420827 - DNA, 15 bp, Homo sapiens
ttatgtttttgtgtg

SEQ ID NO: 420828 - DNA, 15 bp, Homo sapiens
tatgtttttgtgtgc

SEQ ID NO: 420829 - DNA, 15 bp, Homo sapiens
atgtttttgtgtgct

SEQ ID NO: 420830 - DNA, 15 bp, Homo sapiens
tgtttttgtgtgctt

SEQ ID NO: 420831 - DNA, 15 bp, Homo sapiens
gtttttgtgtgcttt

SEQ ID NO: 420832 - DNA, 15 bp, Homo sapiens
tttttgtgtgctttg

SEQ ID NO: 420833 - DNA, 15 bp, Homo sapiens
ttttgtgtgctttgt

SEQ ID NO: 420834 - DNA, 15 bp, Homo sapiens
tttgtgtgctttgtc

SEQ ID NO: 420835 - DNA, 15 bp, Homo sapiens
ttgtgtgctttgtca

SEQ ID NO: 420836 - DNA, 15 bp, Homo sapiens
tgtgtgctttgtcaa

SEQ ID NO: 420837 - DNA, 15 bp, Homo sapiens
gtgtgctttgtcaaa

SEQ ID NO: 420838 - DNA, 15 bp, Homo sapiens
tgtgctttgtcaaaa

SEQ ID NO: 420839 - DNA, 15 bp, Homo sapiens
gtgctttgtcaaaat

SEQ ID NO: 420840 - DNA, 15 bp, Homo sapiens
tgctttgtcaaaatc

SEQ ID NO: 420841 - DNA, 15 bp, Homo sapiens
gctttgtcaaaatca

SEQ ID NO: 420842 - DNA, 15 bp, Homo sapiens
ctttgtcaaaatcag

SEQ ID NO: 420843 - DNA, 15 bp, Homo sapiens
tttgtcaaaatcagt

SEQ ID NO: 420844 - DNA, 15 bp, Homo sapiens
ttgtcaaaatcagtt

SEQ ID NO: 420845 - DNA, 15 bp, Homo sapiens
tgtcaaaatcagttg

SEQ ID NO: 420846 - DNA, 15 bp, Homo sapiens
gtcaaaatcagttgg

SEQ ID NO: 420847 - DNA, 15 bp, Homo sapiens
tcaaaatcagttggt

SEQ ID NO: 420848 - DNA, 15 bp, Homo sapiens
caaaatcagttggtt

SEQ ID NO: 420849 - DNA, 15 bp, Homo sapiens
aaaatcagttggttg

SEQ ID NO: 420850 - DNA, 15 bp, Homo sapiens
aaatcagttggttgt

SEQ ID NO: 420851 - DNA, 15 bp, Homo sapiens
aatcagttggttgta

SEQ ID NO: 420852 - DNA, 15 bp, Homo sapiens
atcagttggttgtaa

SEQ ID NO: 420853 - DNA, 15 bp, Homo sapiens
tcagttggttgtaag

SEQ ID NO: 420854 - DNA, 15 bp, Homo sapiens
cagttggttgtaagt

SEQ ID NO: 420855 - DNA, 15 bp, Homo sapiens
agttggttgtaagta

SEQ ID NO: 420856 - DNA, 15 bp, Homo sapiens
gttggttgtaagtat

SEQ ID NO: 420857 - DNA, 15 bp, Homo sapiens
ttggttgtaagtatt

SEQ ID NO: 420858 - DNA, 15 bp, Homo sapiens
tggttgtaagtattt

SEQ ID NO: 420859 - DNA, 15 bp, Homo sapiens
ggttgtaagtatttg

SEQ ID NO: 420860 - DNA, 15 bp, Homo sapiens
gttgtaagtatttgg

SEQ ID NO: 420861 - DNA, 15 bp, Homo sapiens
ttgtaagtatttggc

SEQ ID NO: 420862 - DNA, 15 bp, Homo sapiens
tgtaagtatttggct

SEQ ID NO: 420863 - DNA, 15 bp, Homo sapiens
gtaagtatttggctg

SEQ ID NO: 420864 - DNA, 15 bp, Homo sapiens
taagtatttggctgt

SEQ ID NO: 420865 - DNA, 15 bp, Homo sapiens
aagtatttggctgta

SEQ ID NO: 420866 - DNA, 15 bp, Homo sapiens
agtatttggctgtat

SEQ ID NO: 420867 - DNA, 15 bp, Homo sapiens
gtatttggctgtatt

SEQ ID NO: 420868 - DNA, 15 bp, Homo sapiens
tatttggctgtattt

SEQ ID NO: 420869 - DNA, 15 bp, Homo sapiens
atttggctgtatttc

SEQ ID NO: 420870 - DNA, 15 bp, Homo sapiens
tttggctgtatttct

SEQ ID NO: 420871 - DNA, 15 bp, Homo sapiens
ttggctgtatttcta

SEQ ID NO: 420872 - DNA, 15 bp, Homo sapiens
tggctgtatttctag

SEQ ID NO: 420873 - DNA, 15 bp, Homo sapiens
ggctgtatttctagg

SEQ ID NO: 420874 - DNA, 15 bp, Homo sapiens
gctgtatttctaggt

SEQ ID NO: 420875 - DNA, 15 bp, Homo sapiens
ctgtatttctaggtt

SEQ ID NO: 420876 - DNA, 15 bp, Homo sapiens
tgtatttctaggttc

SEQ ID NO: 420877 - DNA, 15 bp, Homo sapiens
gtatttctaggttct

SEQ ID NO: 420878 - DNA, 15 bp, Homo sapiens
tatttctaggttctc

SEQ ID NO: 420879 - DNA, 15 bp, Homo sapiens
atttctaggttctct

SEQ ID NO: 420880 - DNA, 15 bp, Homo sapiens
tttctaggttctcta

SEQ ID NO: 420881 - DNA, 15 bp, Homo sapiens
ttctaggttctctat

SEQ ID NO: 420882 - DNA, 15 bp, Homo sapiens
tctaggttctctatt

SEQ ID NO: 420883 - DNA, 15 bp, Homo sapiens
ctaggttctctattc

SEQ ID NO: 420884 - DNA, 15 bp, Homo sapiens
taggttctctattct

SEQ ID NO: 420885 - DNA, 15 bp, Homo sapiens
aggttctctattctg

SEQ ID NO: 420886 - DNA, 15 bp, Homo sapiens
ggttctctattctgc

SEQ ID NO: 420887 - DNA, 15 bp, Homo sapiens
gttctctattctgct

SEQ ID NO: 420888 - DNA, 15 bp, Homo sapiens
ttctctattctgctt

SEQ ID NO: 420889 - DNA, 15 bp, Homo sapiens
tctctattctgcttc

SEQ ID NO: 420890 - DNA, 15 bp, Homo sapiens
ctctattctgcttca

SEQ ID NO: 420891 - DNA, 15 bp, Homo sapiens
tctattctgcttcat

SEQ ID NO: 420892 - DNA, 15 bp, Homo sapiens
ctattctgcttcatt

SEQ ID NO: 420893 - DNA, 15 bp, Homo sapiens
tattctgcttcattg

SEQ ID NO: 420894 - DNA, 15 bp, Homo sapiens
attctgcttcattgg

SEQ ID NO: 420895 - DNA, 15 bp, Homo sapiens
ttctgcttcattggt

SEQ ID NO: 420896 - DNA, 15 bp, Homo sapiens
tctgcttcattggtc

SEQ ID NO: 420897 - DNA, 15 bp, Homo sapiens
ctgcttcattggtct

SEQ ID NO: 420898 - DNA, 15 bp, Homo sapiens
tgcttcattggtcta

SEQ ID NO: 420899 - DNA, 15 bp, Homo sapiens
gcttcattggtctat

SEQ ID NO: 420900 - DNA, 15 bp, Homo sapiens
cttcattggtctatg

SEQ ID NO: 420901 - DNA, 15 bp, Homo sapiens
ttcattggtctatga

SEQ ID NO: 420902 - DNA, 15 bp, Homo sapiens
tcattggtctatgaa

SEQ ID NO: 420903 - DNA, 15 bp, Homo sapiens
cattggtctatgaag

SEQ ID NO: 420904 - DNA, 15 bp, Homo sapiens
attggtctatgaaga

SEQ ID NO: 420905 - DNA, 15 bp, Homo sapiens
ttggtctatgaagat

SEQ ID NO: 420906 - DNA, 15 bp, Homo sapiens
tggtctatgaagatg

SEQ ID NO: 420907 - DNA, 15 bp, Homo sapiens
ggtctatgaagatgc

SEQ ID NO: 420908 - DNA, 15 bp, Homo sapiens
gtctatgaagatgct

SEQ ID NO: 420909 - DNA, 15 bp, Homo sapiens
tctatgaagatgctt

SEQ ID NO: 420910 - DNA, 15 bp, Homo sapiens
ctatgaagatgcttg

SEQ ID NO: 420911 - DNA, 15 bp, Homo sapiens
tatgaagatgcttga

SEQ ID NO: 420912 - DNA, 15 bp, Homo sapiens
atgaagatgcttgat

SEQ ID NO: 420913 - DNA, 15 bp, Homo sapiens
tgaagatgcttgata

SEQ ID NO: 420914 - DNA, 15 bp, Homo sapiens
gaagatgcttgatat

SEQ ID NO: 420915 - DNA, 15 bp, Homo sapiens
aagatgcttgatata

SEQ ID NO: 420916 - DNA, 15 bp, Homo sapiens
agatgcttgatataa

SEQ ID NO: 420917 - DNA, 15 bp, Homo sapiens
gatgcttgatataat

SEQ ID NO: 420918 - DNA, 15 bp, Homo sapiens
atgcttgatataatt

SEQ ID NO: 420919 - DNA, 15 bp, Homo sapiens
tgcttgatataattt

SEQ ID NO: 420920 - DNA, 15 bp, Homo sapiens
gcttgatataatttt

SEQ ID NO: 420921 - DNA, 15 bp, Homo sapiens
ataattttgattttt

SEQ ID NO: 420922 - DNA, 15 bp, Homo sapiens
taattttgattttta

SEQ ID NO: 420923 - DNA, 15 bp, Homo sapiens
aattttgatttttaa

SEQ ID NO: 420924 - DNA, 15 bp, Homo sapiens
ttttgatttttaaaa

SEQ ID NO: 420925 - DNA, 15 bp, Homo sapiens
tttgatttttaaaaa

SEQ ID NO: 420926 - DNA, 15 bp, Homo sapiens
ttgatttttaaaaat

SEQ ID NO: 420927 - DNA, 15 bp, Homo sapiens
tgatttttaaaaatt

SEQ ID NO: 420928 - DNA, 15 bp, Homo sapiens
gatttttaaaaatta

SEQ ID NO: 420929 - DNA, 15 bp, Homo sapiens
atttttaaaaattaa

SEQ ID NO: 420930 - DNA, 15 bp, Homo sapiens
tttttaaaaattaat

SEQ ID NO: 420931 - DNA, 15 bp, Homo sapiens
ttttaaaaattaatt

SEQ ID NO: 420932 - DNA, 15 bp, Homo sapiens
tttaaaaattaattg

SEQ ID NO: 420933 - DNA, 15 bp, Homo sapiens
ttaaaaattaattga

SEQ ID NO: 420934 - DNA, 15 bp, Homo sapiens
taaaaattaattgag

SEQ ID NO: 420935 - DNA, 15 bp, Homo sapiens
aaaaattaattgaga

SEQ ID NO: 420936 - DNA, 15 bp, Homo sapiens
aaaattaattgagac

SEQ ID NO: 420937 - DNA, 15 bp, Homo sapiens
aaattaattgagact

SEQ ID NO: 420938 - DNA, 15 bp, Homo sapiens
aattaattgagactt

SEQ ID NO: 420939 - DNA, 15 bp, Homo sapiens
attaattgagacttg

SEQ ID NO: 420940 - DNA, 15 bp, Homo sapiens
ttaattgagacttgt

SEQ ID NO: 420941 - DNA, 15 bp, Homo sapiens
taattgagacttgtt

SEQ ID NO: 420942 - DNA, 15 bp, Homo sapiens
aattgagacttgttt

SEQ ID NO: 420943 - DNA, 15 bp, Homo sapiens
attgagacttgtttt

SEQ ID NO: 420944 - DNA, 15 bp, Homo sapiens
acttgttttgtggcc

SEQ ID NO: 420945 - DNA, 15 bp, Homo sapiens
cttgttttgtggcct

SEQ ID NO: 420946 - DNA, 15 bp, Homo sapiens
ttgttttgtggcctt

SEQ ID NO: 420947 - DNA, 15 bp, Homo sapiens
tgttttgtggcctta

SEQ ID NO: 420948 - DNA, 15 bp, Homo sapiens
gttttgtggccttat

SEQ ID NO: 420949 - DNA, 15 bp, Homo sapiens
ttttgtggccttatg

SEQ ID NO: 420950 - DNA, 15 bp, Homo sapiens
tttgtggccttatgt

SEQ ID NO: 420951 - DNA, 15 bp, Homo sapiens
ttgtggccttatgta

SEQ ID NO: 420952 - DNA, 15 bp, Homo sapiens
tgtggccttatgtat

SEQ ID NO: 420953 - DNA, 15 bp, Homo sapiens
gtggccttatgtatt

SEQ ID NO: 420954 - DNA, 15 bp, Homo sapiens
tggccttatgtattt

SEQ ID NO: 420955 - DNA, 15 bp, Homo sapiens
ggccttatgtatttt

SEQ ID NO: 420956 - DNA, 15 bp, Homo sapiens
gccttatgtattttg

SEQ ID NO: 420957 - DNA, 15 bp, Homo sapiens
ccttatgtattttgg

SEQ ID NO: 420958 - DNA, 15 bp, Homo sapiens
cttatgtattttgga

SEQ ID NO: 420959 - DNA, 15 bp, Homo sapiens
ttatgtattttggag

SEQ ID NO: 420960 - DNA, 15 bp, Homo sapiens
tatgtattttggaga

SEQ ID NO: 420961 - DNA, 15 bp, Homo sapiens
atgtattttggagaa

SEQ ID NO: 420962 - DNA, 15 bp, Homo sapiens
tgtattttggagaat

SEQ ID NO: 420963 - DNA, 15 bp, Homo sapiens
gtattttggagaatg

SEQ ID NO: 420964 - DNA, 15 bp, Homo sapiens
tattttggagaatgt

SEQ ID NO: 420965 - DNA, 15 bp, Homo sapiens
attttggagaatgtt

SEQ ID NO: 420966 - DNA, 15 bp, Homo sapiens
ttttggagaatgttc

SEQ ID NO: 420967 - DNA, 15 bp, Homo sapiens
tttggagaatgttcc

SEQ ID NO: 420968 - DNA, 15 bp, Homo sapiens
ttggagaatgttcca

SEQ ID NO: 420969 - DNA, 15 bp, Homo sapiens
tggagaatgttccat

SEQ ID NO: 420970 - DNA, 15 bp, Homo sapiens
ggagaatgttccata

SEQ ID NO: 420971 - DNA, 15 bp, Homo sapiens
gagaatgttccatat

SEQ ID NO: 420972 - DNA, 15 bp, Homo sapiens
agaatgttccatatg

SEQ ID NO: 420973 - DNA, 15 bp, Homo sapiens
gaatgttccatatgc

SEQ ID NO: 420974 - DNA, 15 bp, Homo sapiens
aatgttccatatgct

SEQ ID NO: 420975 - DNA, 15 bp, Homo sapiens
atgttccatatgctg

SEQ ID NO: 420976 - DNA, 15 bp, Homo sapiens
tgttccatatgctga

SEQ ID NO: 420977 - DNA, 15 bp, Homo sapiens
gttccatatgctgat

SEQ ID NO: 420978 - DNA, 15 bp, Homo sapiens
ttccatatgctgatg

SEQ ID NO: 420979 - DNA, 15 bp, Homo sapiens
tccatatgctgatga

SEQ ID NO: 420980 - DNA, 15 bp, Homo sapiens
ccatatgctgatgag

SEQ ID NO: 420981 - DNA, 15 bp, Homo sapiens
catatgctgatgaga

SEQ ID NO: 420982 - DNA, 15 bp, Homo sapiens
atatgctgatgagag

SEQ ID NO: 420983 - DNA, 15 bp, Homo sapiens
tatgctgatgagagg

SEQ ID NO: 420984 - DNA, 15 bp, Homo sapiens
atgctgatgagagga

SEQ ID NO: 420985 - DNA, 15 bp, Homo sapiens
tgctgatgagaggat

SEQ ID NO: 420986 - DNA, 15 bp, Homo sapiens
gctgatgagaggatt

SEQ ID NO: 420987 - DNA, 15 bp, Homo sapiens
ctgatgagaggattg

SEQ ID NO: 420988 - DNA, 15 bp, Homo sapiens
tgatgagaggattgt

SEQ ID NO: 420989 - DNA, 15 bp, Homo sapiens
gatgagaggattgta

SEQ ID NO: 420990 - DNA, 15 bp, Homo sapiens
atgagaggattgtat

SEQ ID NO: 420991 - DNA, 15 bp, Homo sapiens
tgagaggattgtata

SEQ ID NO: 420992 - DNA, 15 bp, Homo sapiens
gagaggattgtatat

SEQ ID NO: 420993 - DNA, 15 bp, Homo sapiens
agaggattgtatatt

SEQ ID NO: 420994 - DNA, 15 bp, Homo sapiens
gaggattgtatattc

SEQ ID NO: 420995 - DNA, 15 bp, Homo sapiens
aggattgtatattct

SEQ ID NO: 420996 - DNA, 15 bp, Homo sapiens
ggattgtatattctt

SEQ ID NO: 420997 - DNA, 15 bp, Homo sapiens
gattgtatattcttc

SEQ ID NO: 420998 - DNA, 15 bp, Homo sapiens
attgtatattcttca

SEQ ID NO: 420999 - DNA, 15 bp, Homo sapiens
ttgtatattcttcag

SEQ ID NO: 421000 - DNA, 15 bp, Homo sapiens
tgtatattcttcagt

SEQ ID NO: 421001 - DNA, 15 bp, Homo sapiens
gtatattcttcagtt

SEQ ID NO: 421002 - DNA, 15 bp, Homo sapiens
tatattcttcagttc

SEQ ID NO: 421003 - DNA, 15 bp, Homo sapiens
atattcttcagttct

SEQ ID NO: 421004 - DNA, 15 bp, Homo sapiens
tattcttcagttctt

SEQ ID NO: 421005 - DNA, 15 bp, Homo sapiens
attcttcagttcttg

SEQ ID NO: 421006 - DNA, 15 bp, Homo sapiens
ttcttcagttcttga

SEQ ID NO: 421007 - DNA, 15 bp, Homo sapiens
tcttcagttcttgag

SEQ ID NO: 421008 - DNA, 15 bp, Homo sapiens
cttcagttcttgagt

SEQ ID NO: 421009 - DNA, 15 bp, Homo sapiens
ttcagttcttgagta

SEQ ID NO: 421010 - DNA, 15 bp, Homo sapiens
tcagttcttgagtag

SEQ ID NO: 421011 - DNA, 15 bp, Homo sapiens
cagttcttgagtaga

SEQ ID NO: 421012 - DNA, 15 bp, Homo sapiens
agttcttgagtagaa

SEQ ID NO: 421013 - DNA, 15 bp, Homo sapiens
gttcttgagtagaat

SEQ ID NO: 421014 - DNA, 15 bp, Homo sapiens
ttcttgagtagaatg

SEQ ID NO: 421015 - DNA, 15 bp, Homo sapiens
tcttgagtagaatgt

SEQ ID NO: 421016 - DNA, 15 bp, Homo sapiens
cttgagtagaatgtt

SEQ ID NO: 421017 - DNA, 15 bp, Homo sapiens
ttgagtagaatgttc

SEQ ID NO: 421018 - DNA, 15 bp, Homo sapiens
tgagtagaatgttct

SEQ ID NO: 421019 - DNA, 15 bp, Homo sapiens
gagtagaatgttctg

SEQ ID NO: 421020 - DNA, 15 bp, Homo sapiens
agtagaatgttctgt

SEQ ID NO: 421021 - DNA, 15 bp, Homo sapiens
gtagaatgttctgta

SEQ ID NO: 421022 - DNA, 15 bp, Homo sapiens
tagaatgttctgtaa

SEQ ID NO: 421023 - DNA, 15 bp, Homo sapiens
agaatgttctgtaaa

SEQ ID NO: 421024 - DNA, 15 bp, Homo sapiens
gaatgttctgtaaaa

SEQ ID NO: 421025 - DNA, 15 bp, Homo sapiens
aatgttctgtaaaaa

SEQ ID NO: 421026 - DNA, 15 bp, Homo sapiens
atgttctgtaaaaag

SEQ ID NO: 421027 - DNA, 15 bp, Homo sapiens
tgttctgtaaaaagc

SEQ ID NO: 421028 - DNA, 15 bp, Homo sapiens
gttctgtaaaaagca

SEQ ID NO: 421029 - DNA, 15 bp, Homo sapiens
ttctgtaaaaagcag

SEQ ID NO: 421030 - DNA, 15 bp, Homo sapiens
tctgtaaaaagcagt

SEQ ID NO: 421031 - DNA, 15 bp, Homo sapiens
ctgtaaaaagcagtt

SEQ ID NO: 421032 - DNA, 15 bp, Homo sapiens
tgtaaaaagcagttc

SEQ ID NO: 421033 - DNA, 15 bp, Homo sapiens
gtaaaaagcagttca

SEQ ID NO: 421034 - DNA, 15 bp, Homo sapiens
taaaaagcagttcag

SEQ ID NO: 421035 - DNA, 15 bp, Homo sapiens
aaaaagcagttcagt

SEQ ID NO: 421036 - DNA, 15 bp, Homo sapiens
aaaagcagttcagtg

SEQ ID NO: 421037 - DNA, 15 bp, Homo sapiens
aaagcagttcagtgc

SEQ ID NO: 421038 - DNA, 15 bp, Homo sapiens
aagcagttcagtgcg

SEQ ID NO: 421039 - DNA, 15 bp, Homo sapiens
agcagttcagtgcgc

SEQ ID NO: 421040 - DNA, 15 bp, Homo sapiens
gcagttcagtgcgct

SEQ ID NO: 421041 - DNA, 15 bp, Homo sapiens
cagttcagtgcgctt

SEQ ID NO: 421042 - DNA, 15 bp, Homo sapiens
agttcagtgcgcttg

SEQ ID NO: 421043 - DNA, 15 bp, Homo sapiens
gttcagtgcgcttgt

SEQ ID NO: 421044 - DNA, 15 bp, Homo sapiens
ttcagtgcgcttgtt

SEQ ID NO: 421045 - DNA, 15 bp, Homo sapiens
tcagtgcgcttgttc

SEQ ID NO: 421046 - DNA, 15 bp, Homo sapiens
cagtgcgcttgttct

SEQ ID NO: 421047 - DNA, 15 bp, Homo sapiens
agtgcgcttgttcta

SEQ ID NO: 421048 - DNA, 15 bp, Homo sapiens
gtgcgcttgttctag

SEQ ID NO: 421049 - DNA, 15 bp, Homo sapiens
tgcgcttgttctaga

SEQ ID NO: 421050 - DNA, 15 bp, Homo sapiens
gcgcttgttctagag

SEQ ID NO: 421051 - DNA, 15 bp, Homo sapiens
cgcttgttctagagt

SEQ ID NO: 421052 - DNA, 15 bp, Homo sapiens
gcttgttctagagtg

SEQ ID NO: 421053 - DNA, 15 bp, Homo sapiens
cttgttctagagtgt

SEQ ID NO: 421054 - DNA, 15 bp, Homo sapiens
ttgttctagagtgta

SEQ ID NO: 421055 - DNA, 15 bp, Homo sapiens
tgttctagagtgtag

SEQ ID NO: 421056 - DNA, 15 bp, Homo sapiens
gttctagagtgtagt

SEQ ID NO: 421057 - DNA, 15 bp, Homo sapiens
ttctagagtgtagtt

SEQ ID NO: 421058 - DNA, 15 bp, Homo sapiens
tctagagtgtagttt

SEQ ID NO: 421059 - DNA, 15 bp, Homo sapiens
ctagagtgtagttta

SEQ ID NO: 421060 - DNA, 15 bp, Homo sapiens
tattagttatcaggg

SEQ ID NO: 421061 - DNA, 15 bp, Homo sapiens
attagttatcaggga

SEQ ID NO: 421062 - DNA, 15 bp, Homo sapiens
ttagttatcagggaa

SEQ ID NO: 421063 - DNA, 15 bp, Homo sapiens
tagttatcagggaaa

SEQ ID NO: 421064 - DNA, 15 bp, Homo sapiens
agttatcagggaaag

SEQ ID NO: 421065 - DNA, 15 bp, Homo sapiens
gttatcagggaaagg

SEQ ID NO: 421066 - DNA, 15 bp, Homo sapiens
ttatcagggaaaggt

SEQ ID NO: 421067 - DNA, 15 bp, Homo sapiens
tatcagggaaaggta

SEQ ID NO: 421068 - DNA, 15 bp, Homo sapiens
atcagggaaaggtaa

SEQ ID NO: 421069 - DNA, 15 bp, Homo sapiens
tcagggaaaggtaat

SEQ ID NO: 421070 - DNA, 15 bp, Homo sapiens
cagggaaaggtaatt

SEQ ID NO: 421071 - DNA, 15 bp, Homo sapiens
agggaaaggtaatta

SEQ ID NO: 421072 - DNA, 15 bp, Homo sapiens
gggaaaggtaattac

SEQ ID NO: 421073 - DNA, 15 bp, Homo sapiens
ggaaaggtaattaca

SEQ ID NO: 421074 - DNA, 15 bp, Homo sapiens
gaaaggtaattacat

SEQ ID NO: 421075 - DNA, 15 bp, Homo sapiens
aaaggtaattacata

SEQ ID NO: 421076 - DNA, 15 bp, Homo sapiens
aaggtaattacatat

SEQ ID NO: 421077 - DNA, 15 bp, Homo sapiens
aggtaattacatatt

SEQ ID NO: 421078 - DNA, 15 bp, Homo sapiens
ggtaattacatattt

SEQ ID NO: 421079 - DNA, 15 bp, Homo sapiens
gtaattacatatttg

SEQ ID NO: 421080 - DNA, 15 bp, Homo sapiens
taattacatatttgg

SEQ ID NO: 421081 - DNA, 15 bp, Homo sapiens
aattacatatttggc

SEQ ID NO: 421082 - DNA, 15 bp, Homo sapiens
attacatatttggcc

SEQ ID NO: 421083 - DNA, 15 bp, Homo sapiens
ttacatatttggcct

SEQ ID NO: 421084 - DNA, 15 bp, Homo sapiens
tacatatttggccta

SEQ ID NO: 421085 - DNA, 15 bp, Homo sapiens
acatatttggcctaa

SEQ ID NO: 421086 - DNA, 15 bp, Homo sapiens
catatttggcctaaa

SEQ ID NO: 421087 - DNA, 15 bp, Homo sapiens
atatttggcctaaag

SEQ ID NO: 421088 - DNA, 15 bp, Homo sapiens
tatttggcctaaagt

SEQ ID NO: 421089 - DNA, 15 bp, Homo sapiens
atttggcctaaagtt

SEQ ID NO: 421090 - DNA, 15 bp, Homo sapiens
tttggcctaaagtta

SEQ ID NO: 421091 - DNA, 15 bp, Homo sapiens
ttggcctaaagttaa

SEQ ID NO: 421092 - DNA, 15 bp, Homo sapiens
tggcctaaagttaat

SEQ ID NO: 421093 - DNA, 15 bp, Homo sapiens
ggcctaaagttaatc

SEQ ID NO: 421094 - DNA, 15 bp, Homo sapiens
gcctaaagttaatca

SEQ ID NO: 421095 - DNA, 15 bp, Homo sapiens
cctaaagttaatcaa

SEQ ID NO: 421096 - DNA, 15 bp, Homo sapiens
ctaaagttaatcaat

SEQ ID NO: 421097 - DNA, 15 bp, Homo sapiens
taaagttaatcaata

SEQ ID NO: 421098 - DNA, 15 bp, Homo sapiens
aaagttaatcaatat

SEQ ID NO: 421099 - DNA, 15 bp, Homo sapiens
aagttaatcaatatg

SEQ ID NO: 421100 - DNA, 15 bp, Homo sapiens
agttaatcaatatga

SEQ ID NO: 421101 - DNA, 15 bp, Homo sapiens
gttaatcaatatgaa

SEQ ID NO: 421102 - DNA, 15 bp, Homo sapiens
ttaatcaatatgaac

SEQ ID NO: 421103 - DNA, 15 bp, Homo sapiens
taatcaatatgaaca

SEQ ID NO: 421104 - DNA, 15 bp, Homo sapiens
aatcaatatgaacac

SEQ ID NO: 421105 - DNA, 15 bp, Homo sapiens
atcaatatgaacaca

SEQ ID NO: 421106 - DNA, 15 bp, Homo sapiens
tcaatatgaacacag

SEQ ID NO: 421107 - DNA, 15 bp, Homo sapiens
caatatgaacacaga

SEQ ID NO: 421108 - DNA, 15 bp, Homo sapiens
aatatgaacacagaa

SEQ ID NO: 421109 - DNA, 15 bp, Homo sapiens
atatgaacacagaaa

SEQ ID NO: 421110 - DNA, 15 bp, Homo sapiens
tatgaacacagaaaa

SEQ ID NO: 421111 - DNA, 15 bp, Homo sapiens
atgaacacagaaaag

SEQ ID NO: 421112 - DNA, 15 bp, Homo sapiens
tgaacacagaaaagc

SEQ ID NO: 421113 - DNA, 15 bp, Homo sapiens
gaacacagaaaagct

SEQ ID NO: 421114 - DNA, 15 bp, Homo sapiens
aacacagaaaagctg

SEQ ID NO: 421115 - DNA, 15 bp, Homo sapiens
acacagaaaagctgg

SEQ ID NO: 421116 - DNA, 15 bp, Homo sapiens
cacagaaaagctgga

SEQ ID NO: 421117 - DNA, 15 bp, Homo sapiens
acagaaaagctggag

SEQ ID NO: 421118 - DNA, 15 bp, Homo sapiens
cagaaaagctggagc

SEQ ID NO: 421119 - DNA, 15 bp, Homo sapiens
agaaaagctggagct

SEQ ID NO: 421120 - DNA, 15 bp, Homo sapiens
gaaaagctggagctc

SEQ ID NO: 421121 - DNA, 15 bp, Homo sapiens
aaaagctggagctca

SEQ ID NO: 421122 - DNA, 15 bp, Homo sapiens
aaagctggagctcaa

SEQ ID NO: 421123 - DNA, 15 bp, Homo sapiens
aagctggagctcaag

SEQ ID NO: 421124 - DNA, 15 bp, Homo sapiens
agctggagctcaagc

SEQ ID NO: 421125 - DNA, 15 bp, Homo sapiens
gctggagctcaagca

SEQ ID NO: 421126 - DNA, 15 bp, Homo sapiens
ctggagctcaagcag

SEQ ID NO: 421127 - DNA, 15 bp, Homo sapiens
tggagctcaagcaga

SEQ ID NO: 421128 - DNA, 15 bp, Homo sapiens
ggagctcaagcagaa

SEQ ID NO: 421129 - DNA, 15 bp, Homo sapiens
gagctcaagcagaat

SEQ ID NO: 421130 - DNA, 15 bp, Homo sapiens
agctcaagcagaatc

SEQ ID NO: 421131 - DNA, 15 bp, Homo sapiens
gctcaagcagaatca

SEQ ID NO: 421132 - DNA, 15 bp, Homo sapiens
ctcaagcagaatcag

SEQ ID NO: 421133 - DNA, 15 bp, Homo sapiens
tcaagcagaatcagg

SEQ ID NO: 421134 - DNA, 15 bp, Homo sapiens
caagcagaatcagga

SEQ ID NO: 421135 - DNA, 15 bp, Homo sapiens
aagcagaatcaggac

SEQ ID NO: 421136 - DNA, 15 bp, Homo sapiens
agcagaatcaggacc

SEQ ID NO: 421137 - DNA, 15 bp, Homo sapiens
gcagaatcaggacct

SEQ ID NO: 421138 - DNA, 15 bp, Homo sapiens
cagaatcaggacctt

SEQ ID NO: 421139 - DNA, 15 bp, Homo sapiens
agaatcaggaccttg

SEQ ID NO: 421140 - DNA, 15 bp, Homo sapiens
gaatcaggaccttgt

SEQ ID NO: 421141 - DNA, 15 bp, Homo sapiens
aatcaggaccttgtt

SEQ ID NO: 421142 - DNA, 15 bp, Homo sapiens
atcaggaccttgtta

SEQ ID NO: 421143 - DNA, 15 bp, Homo sapiens
tcaggaccttgttaa

SEQ ID NO: 421144 - DNA, 15 bp, Homo sapiens
caggaccttgttaac

SEQ ID NO: 421145 - DNA, 15 bp, Homo sapiens
aggaccttgttaacc

SEQ ID NO: 421146 - DNA, 15 bp, Homo sapiens
ggaccttgttaacca

SEQ ID NO: 421147 - DNA, 15 bp, Homo sapiens
gaccttgttaaccac

SEQ ID NO: 421148 - DNA, 15 bp, Homo sapiens
accttgttaaccaca

SEQ ID NO: 421149 - DNA, 15 bp, Homo sapiens
ccttgttaaccacag

SEQ ID NO: 421150 - DNA, 15 bp, Homo sapiens
cttgttaaccacagt

SEQ ID NO: 421151 - DNA, 15 bp, Homo sapiens
ttgttaaccacagtt

SEQ ID NO: 421152 - DNA, 15 bp, Homo sapiens
tgttaaccacagttt

SEQ ID NO: 421153 - DNA, 15 bp, Homo sapiens
gttaaccacagtttt

SEQ ID NO: 421154 - DNA, 15 bp, Homo sapiens
ttaaccacagttttg

SEQ ID NO: 421155 - DNA, 15 bp, Homo sapiens
taaccacagttttgt

SEQ ID NO: 421156 - DNA, 15 bp, Homo sapiens
aaccacagttttgta

SEQ ID NO: 421157 - DNA, 15 bp, Homo sapiens
accacagttttgtaa

SEQ ID NO: 421158 - DNA, 15 bp, Homo sapiens
ccacagttttgtaaa

SEQ ID NO: 421159 - DNA, 15 bp, Homo sapiens
cacagttttgtaaaa

SEQ ID NO: 421160 - DNA, 15 bp, Homo sapiens
acagttttgtaaaat

SEQ ID NO: 421161 - DNA, 15 bp, Homo sapiens
cagttttgtaaaatg

SEQ ID NO: 421162 - DNA, 15 bp, Homo sapiens
agttttgtaaaatga

SEQ ID NO: 421163 - DNA, 15 bp, Homo sapiens
gttttgtaaaatgag

SEQ ID NO: 421164 - DNA, 15 bp, Homo sapiens
ttttgtaaaatgagt

SEQ ID NO: 421165 - DNA, 15 bp, Homo sapiens
tttgtaaaatgagtt

SEQ ID NO: 421166 - DNA, 15 bp, Homo sapiens
ttgtaaaatgagttc

SEQ ID NO: 421167 - DNA, 15 bp, Homo sapiens
tgtaaaatgagttca

SEQ ID NO: 421168 - DNA, 15 bp, Homo sapiens
gtaaaatgagttcaa

SEQ ID NO: 421169 - DNA, 15 bp, Homo sapiens
taaaatgagttcaat

SEQ ID NO: 421170 - DNA, 15 bp, Homo sapiens
aaaatgagttcaatt

SEQ ID NO: 421171 - DNA, 15 bp, Homo sapiens
aaatgagttcaattg

SEQ ID NO: 421172 - DNA, 15 bp, Homo sapiens
aatgagttcaattgt

SEQ ID NO: 421173 - DNA, 15 bp, Homo sapiens
atgagttcaattgta

SEQ ID NO: 421174 - DNA, 15 bp, Homo sapiens
tgagttcaattgtag

SEQ ID NO: 421175 - DNA, 15 bp, Homo sapiens
gagttcaattgtagc

SEQ ID NO: 421176 - DNA, 15 bp, Homo sapiens
agttcaattgtagca

SEQ ID NO: 421177 - DNA, 15 bp, Homo sapiens
gttcaattgtagcac

SEQ ID NO: 421178 - DNA, 15 bp, Homo sapiens
ttcaattgtagcacc

SEQ ID NO: 421179 - DNA, 15 bp, Homo sapiens
tcaattgtagcacct

SEQ ID NO: 421180 - DNA, 15 bp, Homo sapiens
caattgtagcacctg

SEQ ID NO: 421181 - DNA, 15 bp, Homo sapiens
aattgtagcacctgt

SEQ ID NO: 421182 - DNA, 15 bp, Homo sapiens
attgtagcacctgtg

SEQ ID NO: 421183 - DNA, 15 bp, Homo sapiens
ttgtagcacctgtgg

SEQ ID NO: 421184 - DNA, 15 bp, Homo sapiens
tgtagcacctgtgga

SEQ ID NO: 421185 - DNA, 15 bp, Homo sapiens
gtagcacctgtggaa

SEQ ID NO: 421186 - DNA, 15 bp, Homo sapiens
tagcacctgtggaat

SEQ ID NO: 421187 - DNA, 15 bp, Homo sapiens
agcacctgtggaata

SEQ ID NO: 421188 - DNA, 15 bp, Homo sapiens
gcacctgtggaataa

SEQ ID NO: 421189 - DNA, 15 bp, Homo sapiens
cacctgtggaataaa

SEQ ID NO: 421190 - DNA, 15 bp, Homo sapiens
acctgtggaataaat

SEQ ID NO: 421191 - DNA, 15 bp, Homo sapiens
cctgtggaataaata

SEQ ID NO: 421192 - DNA, 15 bp, Homo sapiens
ctgtggaataaatag

SEQ ID NO: 421193 - DNA, 15 bp, Homo sapiens
tgtggaataaataga

SEQ ID NO: 421194 - DNA, 15 bp, Homo sapiens
gtggaataaatagaa

SEQ ID NO: 421195 - DNA, 15 bp, Homo sapiens
tggaataaatagaac

SEQ ID NO: 421196 - DNA, 15 bp, Homo sapiens
ggaataaatagaact

SEQ ID NO: 421197 - DNA, 15 bp, Homo sapiens
gaataaatagaactg

SEQ ID NO: 421198 - DNA, 15 bp, Homo sapiens
aataaatagaactga

SEQ ID NO: 421199 - DNA, 15 bp, Homo sapiens
ataaatagaactgat

SEQ ID NO: 421200 - DNA, 15 bp, Homo sapiens
taaatagaactgatc

SEQ ID NO: 421201 - DNA, 15 bp, Homo sapiens
aaatagaactgatca

SEQ ID NO: 421202 - DNA, 15 bp, Homo sapiens
aatagaactgatcat

SEQ ID NO: 421203 - DNA, 15 bp, Homo sapiens
atagaactgatcata

SEQ ID NO: 421204 - DNA, 15 bp, Homo sapiens
tagaactgatcataa

SEQ ID NO: 421205 - DNA, 15 bp, Homo sapiens
agaactgatcataaa

SEQ ID NO: 421206 - DNA, 15 bp, Homo sapiens
gaactgatcataaat

SEQ ID NO: 421207 - DNA, 15 bp, Homo sapiens
aactgatcataaata

SEQ ID NO: 421208 - DNA, 15 bp, Homo sapiens
actgatcataaatac

SEQ ID NO: 421209 - DNA, 15 bp, Homo sapiens
ctgatcataaataca

SEQ ID NO: 421210 - DNA, 15 bp, Homo sapiens
tgatcataaatacaa

SEQ ID NO: 421211 - DNA, 15 bp, Homo sapiens
gatcataaatacaag

SEQ ID NO: 421212 - DNA, 15 bp, Homo sapiens
atcataaatacaaga

SEQ ID NO: 421213 - DNA, 15 bp, Homo sapiens
tcataaatacaagaa

SEQ ID NO: 421214 - DNA, 15 bp, Homo sapiens
cataaatacaagaaa

SEQ ID NO: 421215 - DNA, 15 bp, Homo sapiens
ataaatacaagaaaa

SEQ ID NO: 421216 - DNA, 15 bp, Homo sapiens
taaatacaagaaaat

SEQ ID NO: 421217 - DNA, 15 bp, Homo sapiens
aaatacaagaaaata

SEQ ID NO: 421218 - DNA, 15 bp, Homo sapiens
aatacaagaaaataa

SEQ ID NO: 421219 - DNA, 15 bp, Homo sapiens
atacaagaaaataaa

SEQ ID NO: 421220 - DNA, 15 bp, Homo sapiens
tacaagaaaataaat

SEQ ID NO: 421221 - DNA, 15 bp, Homo sapiens
acaagaaaataaatt

SEQ ID NO: 421222 - DNA, 15 bp, Homo sapiens
caagaaaataaattt

SEQ ID NO: 421223 - DNA, 15 bp, Homo sapiens
aagaaaataaatttt

SEQ ID NO: 421224 - DNA, 15 bp, Homo sapiens
agaaaataaattttc

SEQ ID NO: 421225 - DNA, 15 bp, Homo sapiens
gaaaataaattttct

SEQ ID NO: 421226 - DNA, 15 bp, Homo sapiens
aaaataaattttcta

SEQ ID NO: 421227 - DNA, 15 bp, Homo sapiens
aaataaattttctaa

SEQ ID NO: 421228 - DNA, 15 bp, Homo sapiens
aataaattttctaat

SEQ ID NO: 421229 - DNA, 15 bp, Homo sapiens
ataaattttctaatc

SEQ ID NO: 421230 - DNA, 15 bp, Homo sapiens
taaattttctaatca

SEQ ID NO: 421231 - DNA, 15 bp, Homo sapiens
aaattttctaatcat

SEQ ID NO: 421232 - DNA, 15 bp, Homo sapiens
aattttctaatcata

SEQ ID NO: 421233 - DNA, 15 bp, Homo sapiens
attttctaatcatac

SEQ ID NO: 421234 - DNA, 15 bp, Homo sapiens
ttttctaatcatact

SEQ ID NO: 421235 - DNA, 15 bp, Homo sapiens
tttctaatcatactg

SEQ ID NO: 421236 - DNA, 15 bp, Homo sapiens
ttctaatcatactgt

SEQ ID NO: 421237 - DNA, 15 bp, Homo sapiens
tctaatcatactgtt

SEQ ID NO: 421238 - DNA, 15 bp, Homo sapiens
ctaatcatactgttc

SEQ ID NO: 421239 - DNA, 15 bp, Homo sapiens
taatcatactgttct

SEQ ID NO: 421240 - DNA, 15 bp, Homo sapiens
aatcatactgttctc

SEQ ID NO: 421241 - DNA, 15 bp, Homo sapiens
atcatactgttctca

SEQ ID NO: 421242 - DNA, 15 bp, Homo sapiens
tcatactgttctcag

SEQ ID NO: 421243 - DNA, 15 bp, Homo sapiens
catactgttctcaga

SEQ ID NO: 421244 - DNA, 15 bp, Homo sapiens
atactgttctcagag

SEQ ID NO: 421245 - DNA, 15 bp, Homo sapiens
tactgttctcagaga

SEQ ID NO: 421246 - DNA, 15 bp, Homo sapiens
actgttctcagagat

SEQ ID NO: 421247 - DNA, 15 bp, Homo sapiens
ctgttctcagagatt

SEQ ID NO: 421248 - DNA, 15 bp, Homo sapiens
tgttctcagagattt

SEQ ID NO: 421249 - DNA, 15 bp, Homo sapiens
gttctcagagattta

SEQ ID NO: 421250 - DNA, 15 bp, Homo sapiens
ttctcagagatttac

SEQ ID NO: 421251 - DNA, 15 bp, Homo sapiens
tctcagagatttaca

SEQ ID NO: 421252 - DNA, 15 bp, Homo sapiens
ctcagagatttacaa

SEQ ID NO: 421253 - DNA, 15 bp, Homo sapiens
tcagagatttacaaa

SEQ ID NO: 421254 - DNA, 15 bp, Homo sapiens
cagagatttacaaaa

SEQ ID NO: 421255 - DNA, 15 bp, Homo sapiens
agagatttacaaaat

SEQ ID NO: 421256 - DNA, 15 bp, Homo sapiens
gagatttacaaaatg

SEQ ID NO: 421257 - DNA, 15 bp, Homo sapiens
agatttacaaaatgc

SEQ ID NO: 421258 - DNA, 15 bp, Homo sapiens
gatttacaaaatgct

SEQ ID NO: 421259 - DNA, 15 bp, Homo sapiens
atttacaaaatgctt

SEQ ID NO: 421260 - DNA, 15 bp, Homo sapiens
tttacaaaatgcttt

SEQ ID NO: 421261 - DNA, 15 bp, Homo sapiens
ttacaaaatgctttg

SEQ ID NO: 421262 - DNA, 15 bp, Homo sapiens
tacaaaatgctttga

SEQ ID NO: 421263 - DNA, 15 bp, Homo sapiens
acaaaatgctttgaa

SEQ ID NO: 421264 - DNA, 15 bp, Homo sapiens
caaaatgctttgaac

SEQ ID NO: 421265 - DNA, 15 bp, Homo sapiens
aaaatgctttgaact

SEQ ID NO: 421266 - DNA, 15 bp, Homo sapiens
aaatgctttgaactt

SEQ ID NO: 421267 - DNA, 15 bp, Homo sapiens
aatgctttgaacttc

SEQ ID NO: 421268 - DNA, 15 bp, Homo sapiens
atgctttgaacttcg

SEQ ID NO: 421269 - DNA, 15 bp, Homo sapiens
tgctttgaacttcgt

SEQ ID NO: 421270 - DNA, 15 bp, Homo sapiens
gctttgaacttcgtt

SEQ ID NO: 421271 - DNA, 15 bp, Homo sapiens
ctttgaacttcgttc

SEQ ID NO: 421272 - DNA, 15 bp, Homo sapiens
tttgaacttcgttct

SEQ ID NO: 421273 - DNA, 15 bp, Homo sapiens
ttgaacttcgttctg

SEQ ID NO: 421274 - DNA, 15 bp, Homo sapiens
tgaacttcgttctgt

SEQ ID NO: 421275 - DNA, 15 bp, Homo sapiens
gaacttcgttctgta

SEQ ID NO: 421276 - DNA, 15 bp, Homo sapiens
aacttcgttctgtat

SEQ ID NO: 421277 - DNA, 15 bp, Homo sapiens
acttcgttctgtatt

SEQ ID NO: 421278 - DNA, 15 bp, Homo sapiens
cttcgttctgtattt

SEQ ID NO: 421279 - DNA, 15 bp, Homo sapiens
ttcgttctgtattta

SEQ ID NO: 421280 - DNA, 15 bp, Homo sapiens
tcgttctgtatttaa

SEQ ID NO: 421281 - DNA, 15 bp, Homo sapiens
cgttctgtatttaaa

SEQ ID NO: 421282 - DNA, 15 bp, Homo sapiens
gttctgtatttaaac

SEQ ID NO: 421283 - DNA, 15 bp, Homo sapiens
ttctgtatttaaact

SEQ ID NO: 421284 - DNA, 15 bp, Homo sapiens
tctgtatttaaactt

SEQ ID NO: 421285 - DNA, 15 bp, Homo sapiens
ctgtatttaaacttt

SEQ ID NO: 421286 - DNA, 15 bp, Homo sapiens
tgtatttaaactttt

SEQ ID NO: 421287 - DNA, 15 bp, Homo sapiens
gtatttaaacttttt

SEQ ID NO: 421288 - DNA, 15 bp, Homo sapiens
tatttaaactttttt

SEQ ID NO: 421289 - DNA, 15 bp, Homo sapiens
atttaaacttttttt

SEQ ID NO: 421290 - DNA, 15 bp, Homo sapiens
tttaaacttttttta

SEQ ID NO: 421291 - DNA, 15 bp, Homo sapiens
ttaaactttttttat

SEQ ID NO: 421292 - DNA, 15 bp, Homo sapiens
taaactttttttatt

SEQ ID NO: 421293 - DNA, 15 bp, Homo sapiens
aaactttttttatta

SEQ ID NO: 421294 - DNA, 15 bp, Homo sapiens
aactttttttattat

SEQ ID NO: 421295 - DNA, 15 bp, Homo sapiens
actttttttattatt

SEQ ID NO: 421296 - DNA, 15 bp, Homo sapiens
ctttttttattattt

SEQ ID NO: 421297 - DNA, 15 bp, Homo sapiens
tttttttattatttc

SEQ ID NO: 421298 - DNA, 15 bp, Homo sapiens
ttttttattatttca

SEQ ID NO: 421299 - DNA, 15 bp, Homo sapiens
tttttattatttcac

SEQ ID NO: 421300 - DNA, 15 bp, Homo sapiens
ttttattatttcaca

SEQ ID NO: 421301 - DNA, 15 bp, Homo sapiens
tttattatttcacac

SEQ ID NO: 421302 - DNA, 15 bp, Homo sapiens
ttattatttcacaca

SEQ ID NO: 421303 - DNA, 15 bp, Homo sapiens
tattatttcacacag

SEQ ID NO: 421304 - DNA, 15 bp, Homo sapiens
attatttcacacagc

SEQ ID NO: 421305 - DNA, 15 bp, Homo sapiens
ttatttcacacagcg

SEQ ID NO: 421306 - DNA, 15 bp, Homo sapiens
tatttcacacagcgt

SEQ ID NO: 421307 - DNA, 15 bp, Homo sapiens
atttcacacagcgtt

SEQ ID NO: 421308 - DNA, 15 bp, Homo sapiens
tttcacacagcgttt

SEQ ID NO: 421309 - DNA, 15 bp, Homo sapiens
ttcacacagcgtttt

SEQ ID NO: 421310 - DNA, 15 bp, Homo sapiens
tcacacagcgttttt

SEQ ID NO: 421311 - DNA, 15 bp, Homo sapiens
cacacagcgtttttt

SEQ ID NO: 421312 - DNA, 15 bp, Homo sapiens
acacagcgtttttta

SEQ ID NO: 421313 - DNA, 15 bp, Homo sapiens
cacagcgttttttaa

SEQ ID NO: 421314 - DNA, 15 bp, Homo sapiens
acagcgttttttaat

SEQ ID NO: 421315 - DNA, 15 bp, Homo sapiens
cagcgttttttaatc

SEQ ID NO: 421316 - DNA, 15 bp, Homo sapiens
agcgttttttaatca

SEQ ID NO: 421317 - DNA, 15 bp, Homo sapiens
gcgttttttaatcag

SEQ ID NO: 421318 - DNA, 15 bp, Homo sapiens
cgttttttaatcagc

SEQ ID NO: 421319 - DNA, 15 bp, Homo sapiens
gttttttaatcagca

SEQ ID NO: 421320 - DNA, 15 bp, Homo sapiens
ttttttaatcagcat

SEQ ID NO: 421321 - DNA, 15 bp, Homo sapiens
tttttaatcagcata

SEQ ID NO: 421322 - DNA, 15 bp, Homo sapiens
ttttaatcagcatat

SEQ ID NO: 421323 - DNA, 15 bp, Homo sapiens
tttaatcagcatatg

SEQ ID NO: 421324 - DNA, 15 bp, Homo sapiens
ttaatcagcatatgc

SEQ ID NO: 421325 - DNA, 15 bp, Homo sapiens
taatcagcatatgct

SEQ ID NO: 421326 - DNA, 15 bp, Homo sapiens
aatcagcatatgctg

SEQ ID NO: 421327 - DNA, 15 bp, Homo sapiens
cagcatatgctgatg

SEQ ID NO: 421328 - DNA, 15 bp, Homo sapiens
agcatatgctgatga

SEQ ID NO: 421329 - DNA, 15 bp, Homo sapiens
gcatatgctgatgaa

SEQ ID NO: 421330 - DNA, 15 bp, Homo sapiens
catatgctgatgaaa

SEQ ID NO: 421331 - DNA, 15 bp, Homo sapiens
atatgctgatgaaag

SEQ ID NO: 421332 - DNA, 15 bp, Homo sapiens
tatgctgatgaaagg

SEQ ID NO: 421333 - DNA, 15 bp, Homo sapiens
atgctgatgaaaggc

SEQ ID NO: 421334 - DNA, 15 bp, Homo sapiens
tgctgatgaaaggca

SEQ ID NO: 421335 - DNA, 15 bp, Homo sapiens
gctgatgaaaggcag

SEQ ID NO: 421336 - DNA, 15 bp, Homo sapiens
ctgatgaaaggcaga

SEQ ID NO: 421337 - DNA, 15 bp, Homo sapiens
tgatgaaaggcagac

SEQ ID NO: 421338 - DNA, 15 bp, Homo sapiens
gatgaaaggcagacg

SEQ ID NO: 421339 - DNA, 15 bp, Homo sapiens
atgaaaggcagacgt

SEQ ID NO: 421340 - DNA, 15 bp, Homo sapiens
tgaaaggcagacgtg

SEQ ID NO: 421341 - DNA, 15 bp, Homo sapiens
gaaaggcagacgtgt

SEQ ID NO: 421342 - DNA, 15 bp, Homo sapiens
aaaggcagacgtgtg

SEQ ID NO: 421343 - DNA, 15 bp, Homo sapiens
aaggcagacgtgtgc

SEQ ID NO: 421344 - DNA, 15 bp, Homo sapiens
aggcagacgtgtgcc

SEQ ID NO: 421345 - DNA, 15 bp, Homo sapiens
ggcagacgtgtgcct

SEQ ID NO: 421346 - DNA, 15 bp, Homo sapiens
gcagacgtgtgcctt

SEQ ID NO: 421347 - DNA, 15 bp, Homo sapiens
cagacgtgtgccttg

SEQ ID NO: 421348 - DNA, 15 bp, Homo sapiens
agacgtgtgccttgt

SEQ ID NO: 421349 - DNA, 15 bp, Homo sapiens
gacgtgtgccttgtt

SEQ ID NO: 421350 - DNA, 15 bp, Homo sapiens
acgtgtgccttgtta

SEQ ID NO: 421351 - DNA, 15 bp, Homo sapiens
cgtgtgccttgttac

SEQ ID NO: 421352 - DNA, 15 bp, Homo sapiens
gtgtgccttgttaca

SEQ ID NO: 421353 - DNA, 15 bp, Homo sapiens
tgtgccttgttacac

SEQ ID NO: 421354 - DNA, 15 bp, Homo sapiens
gtgccttgttacacc

SEQ ID NO: 421355 - DNA, 15 bp, Homo sapiens
tgccttgttacacct

SEQ ID NO: 421356 - DNA, 15 bp, Homo sapiens
gccttgttacacctc

SEQ ID NO: 421357 - DNA, 15 bp, Homo sapiens
ccttgttacacctct

SEQ ID NO: 421358 - DNA, 15 bp, Homo sapiens
cttgttacacctcta

SEQ ID NO: 421359 - DNA, 15 bp, Homo sapiens
ttgttacacctctaa

SEQ ID NO: 421360 - DNA, 15 bp, Homo sapiens
tgttacacctctaaa

SEQ ID NO: 421361 - DNA, 15 bp, Homo sapiens
gttacacctctaaac

SEQ ID NO: 421362 - DNA, 15 bp, Homo sapiens
ttacacctctaaacc

SEQ ID NO: 421363 - DNA, 15 bp, Homo sapiens
tacacctctaaacct

SEQ ID NO: 421364 - DNA, 15 bp, Homo sapiens
acacctctaaacctc

SEQ ID NO: 421365 - DNA, 15 bp, Homo sapiens
cacctctaaacctca

SEQ ID NO: 421366 - DNA, 15 bp, Homo sapiens
acctctaaacctcaa

SEQ ID NO: 421367 - DNA, 15 bp, Homo sapiens
cctctaaacctcaaa

SEQ ID NO: 421368 - DNA, 15 bp, Homo sapiens
ctctaaacctcaaag

SEQ ID NO: 421369 - DNA, 15 bp, Homo sapiens
tctaaacctcaaaga

SEQ ID NO: 421370 - DNA, 15 bp, Homo sapiens
ctaaacctcaaagat

SEQ ID NO: 421371 - DNA, 15 bp, Homo sapiens
taaacctcaaagatc

SEQ ID NO: 421372 - DNA, 15 bp, Homo sapiens
aaacctcaaagatca

SEQ ID NO: 421373 - DNA, 15 bp, Homo sapiens
aacctcaaagatcat

SEQ ID NO: 421374 - DNA, 15 bp, Homo sapiens
acctcaaagatcatg

SEQ ID NO: 421375 - DNA, 15 bp, Homo sapiens
cctcaaagatcatgg

SEQ ID NO: 421376 - DNA, 15 bp, Homo sapiens
ctcaaagatcatggg

SEQ ID NO: 421377 - DNA, 15 bp, Homo sapiens
tcaaagatcatgggc

SEQ ID NO: 421378 - DNA, 15 bp, Homo sapiens
caaagatcatgggca

SEQ ID NO: 421379 - DNA, 15 bp, Homo sapiens
aaagatcatgggcag

SEQ ID NO: 421380 - DNA, 15 bp, Homo sapiens
aagatcatgggcagt

SEQ ID NO: 421381 - DNA, 15 bp, Homo sapiens
agatcatgggcagtc

SEQ ID NO: 421382 - DNA, 15 bp, Homo sapiens
gatcatgggcagtca

SEQ ID NO: 421383 - DNA, 15 bp, Homo sapiens
atcatgggcagtcac

SEQ ID NO: 421384 - DNA, 15 bp, Homo sapiens
tcatgggcagtcaca

SEQ ID NO: 421385 - DNA, 15 bp, Homo sapiens
catgggcagtcacag

SEQ ID NO: 421386 - DNA, 15 bp, Homo sapiens
atgggcagtcacagt

SEQ ID NO: 421387 - DNA, 15 bp, Homo sapiens
tgggcagtcacagta

SEQ ID NO: 421388 - DNA, 15 bp, Homo sapiens
gggcagtcacagtaa

SEQ ID NO: 421389 - DNA, 15 bp, Homo sapiens
ggcagtcacagtaat

SEQ ID NO: 421390 - DNA, 15 bp, Homo sapiens
gcagtcacagtaatt

SEQ ID NO: 421391 - DNA, 15 bp, Homo sapiens
cagtcacagtaattc

SEQ ID NO: 421392 - DNA, 15 bp, Homo sapiens
agtcacagtaattcc

SEQ ID NO: 421393 - DNA, 15 bp, Homo sapiens
gtcacagtaattcca

SEQ ID NO: 421394 - DNA, 15 bp, Homo sapiens
tcacagtaattccat

SEQ ID NO: 421395 - DNA, 15 bp, Homo sapiens
cacagtaattccatt

SEQ ID NO: 421396 - DNA, 15 bp, Homo sapiens
acagtaattccattt

SEQ ID NO: 421397 - DNA, 15 bp, Homo sapiens
cagtaattccatttc

SEQ ID NO: 421398 - DNA, 15 bp, Homo sapiens
agtaattccatttcc

SEQ ID NO: 421399 - DNA, 15 bp, Homo sapiens
gtaattccatttccc

SEQ ID NO: 421400 - DNA, 15 bp, Homo sapiens
taattccatttcccc

SEQ ID NO: 421401 - DNA, 15 bp, Homo sapiens
aattccatttcccca

SEQ ID NO: 421402 - DNA, 15 bp, Homo sapiens
attccatttccccaa

SEQ ID NO: 421403 - DNA, 15 bp, Homo sapiens
ttccatttccccaag

SEQ ID NO: 421404 - DNA, 15 bp, Homo sapiens
tccatttccccaagt

SEQ ID NO: 421405 - DNA, 15 bp, Homo sapiens
ccatttccccaagtt

SEQ ID NO: 421406 - DNA, 15 bp, Homo sapiens
catttccccaagtta

SEQ ID NO: 421407 - DNA, 15 bp, Homo sapiens
atttccccaagttaa

SEQ ID NO: 421408 - DNA, 15 bp, Homo sapiens
tttccccaagttaag

SEQ ID NO: 421409 - DNA, 15 bp, Homo sapiens
ttccccaagttaagg

SEQ ID NO: 421410 - DNA, 15 bp, Homo sapiens
tccccaagttaaggc

SEQ ID NO: 421411 - DNA, 15 bp, Homo sapiens
ccccaagttaaggca

SEQ ID NO: 421412 - DNA, 15 bp, Homo sapiens
cccaagttaaggcat

SEQ ID NO: 421413 - DNA, 15 bp, Homo sapiens
ccaagttaaggcata

SEQ ID NO: 421414 - DNA, 15 bp, Homo sapiens
caagttaaggcataa

SEQ ID NO: 421415 - DNA, 15 bp, Homo sapiens
aagttaaggcataag

SEQ ID NO: 421416 - DNA, 15 bp, Homo sapiens
agttaaggcataagc

SEQ ID NO: 421417 - DNA, 15 bp, Homo sapiens
gttaaggcataagcc

SEQ ID NO: 421418 - DNA, 15 bp, Homo sapiens
ttaaggcataagccc

SEQ ID NO: 421419 - DNA, 15 bp, Homo sapiens
taaggcataagcccg

SEQ ID NO: 421420 - DNA, 15 bp, Homo sapiens
aaggcataagcccgc

SEQ ID NO: 421421 - DNA, 15 bp, Homo sapiens
aggcataagcccgca

SEQ ID NO: 421422 - DNA, 15 bp, Homo sapiens
ggcataagcccgcat

SEQ ID NO: 421423 - DNA, 15 bp, Homo sapiens
gcataagcccgcatt

SEQ ID NO: 421424 - DNA, 15 bp, Homo sapiens
cataagcccgcattc

SEQ ID NO: 421425 - DNA, 15 bp, Homo sapiens
ataagcccgcattca

SEQ ID NO: 421426 - DNA, 15 bp, Homo sapiens
taagcccgcattcac

SEQ ID NO: 421427 - DNA, 15 bp, Homo sapiens
aagcccgcattcaca

SEQ ID NO: 421428 - DNA, 15 bp, Homo sapiens
agcccgcattcacag

SEQ ID NO: 421429 - DNA, 15 bp, Homo sapiens
gcccgcattcacagt

SEQ ID NO: 421430 - DNA, 15 bp, Homo sapiens
cccgcattcacagtc

SEQ ID NO: 421431 - DNA, 15 bp, Homo sapiens
ccgcattcacagtct

SEQ ID NO: 421432 - DNA, 15 bp, Homo sapiens
cgcattcacagtctg

SEQ ID NO: 421433 - DNA, 15 bp, Homo sapiens
gcattcacagtctgc

SEQ ID NO: 421434 - DNA, 15 bp, Homo sapiens
cattcacagtctgcc

SEQ ID NO: 421435 - DNA, 15 bp, Homo sapiens
attcacagtctgccc

SEQ ID NO: 421436 - DNA, 15 bp, Homo sapiens
ttcacagtctgccct

SEQ ID NO: 421437 - DNA, 15 bp, Homo sapiens
tcacagtctgccctc

SEQ ID NO: 421438 - DNA, 15 bp, Homo sapiens
cacagtctgccctct

SEQ ID NO: 421439 - DNA, 15 bp, Homo sapiens
acagtctgccctctg

SEQ ID NO: 421440 - DNA, 15 bp, Homo sapiens
cagtctgccctctgg

SEQ ID NO: 421441 - DNA, 15 bp, Homo sapiens
agtctgccctctggg

SEQ ID NO: 421442 - DNA, 15 bp, Homo sapiens
gtctgccctctggga

SEQ ID NO: 421443 - DNA, 15 bp, Homo sapiens
tctgccctctgggat

SEQ ID NO: 421444 - DNA, 15 bp, Homo sapiens
ctgccctctgggatg

SEQ ID NO: 421445 - DNA, 15 bp, Homo sapiens
tgccctctgggatga

SEQ ID NO: 421446 - DNA, 15 bp, Homo sapiens
gccctctgggatgat

SEQ ID NO: 421447 - DNA, 15 bp, Homo sapiens
ccctctgggatgatg

SEQ ID NO: 421448 - DNA, 15 bp, Homo sapiens
cctctgggatgatgc

SEQ ID NO: 421449 - DNA, 15 bp, Homo sapiens
ctctgggatgatgca

SEQ ID NO: 421450 - DNA, 15 bp, Homo sapiens
tctgggatgatgcag

SEQ ID NO: 421451 - DNA, 15 bp, Homo sapiens
ctgggatgatgcagg

SEQ ID NO: 421452 - DNA, 15 bp, Homo sapiens
tgggatgatgcagga

SEQ ID NO: 421453 - DNA, 15 bp, Homo sapiens
gggatgatgcaggat

SEQ ID NO: 421454 - DNA, 15 bp, Homo sapiens
ggatgatgcaggatt

SEQ ID NO: 421455 - DNA, 15 bp, Homo sapiens
gatgatgcaggattg

SEQ ID NO: 421456 - DNA, 15 bp, Homo sapiens
atgatgcaggattga

SEQ ID NO: 421457 - DNA, 15 bp, Homo sapiens
tgatgcaggattgag

SEQ ID NO: 421458 - DNA, 15 bp, Homo sapiens
gatgcaggattgagt

SEQ ID NO: 421459 - DNA, 15 bp, Homo sapiens
atgcaggattgagtc

SEQ ID NO: 421460 - DNA, 15 bp, Homo sapiens
tgcaggattgagtca

SEQ ID NO: 421461 - DNA, 15 bp, Homo sapiens
gcaggattgagtcaa

SEQ ID NO: 421462 - DNA, 15 bp, Homo sapiens
caggattgagtcaag

SEQ ID NO: 421463 - DNA, 15 bp, Homo sapiens
aggattgagtcaagc

SEQ ID NO: 421464 - DNA, 15 bp, Homo sapiens
ggattgagtcaagcc

SEQ ID NO: 421465 - DNA, 15 bp, Homo sapiens
gattgagtcaagccc

SEQ ID NO: 421466 - DNA, 15 bp, Homo sapiens
attgagtcaagccca

SEQ ID NO: 421467 - DNA, 15 bp, Homo sapiens
ttgagtcaagcccag

SEQ ID NO: 421468 - DNA, 15 bp, Homo sapiens
tgagtcaagcccagt

SEQ ID NO: 421469 - DNA, 15 bp, Homo sapiens
gagtcaagcccagtt

SEQ ID NO: 421470 - DNA, 15 bp, Homo sapiens
agtcaagcccagttc

SEQ ID NO: 421471 - DNA, 15 bp, Homo sapiens
gtcaagcccagttcg

SEQ ID NO: 421472 - DNA, 15 bp, Homo sapiens
tcaagcccagttcga

SEQ ID NO: 421473 - DNA, 15 bp, Homo sapiens
caagcccagttcgat

SEQ ID NO: 421474 - DNA, 15 bp, Homo sapiens
aagcccagttcgatt

SEQ ID NO: 421475 - DNA, 15 bp, Homo sapiens
agcccagttcgattc

SEQ ID NO: 421476 - DNA, 15 bp, Homo sapiens
gcccagttcgattcc

SEQ ID NO: 421477 - DNA, 15 bp, Homo sapiens
cccagttcgattcct

SEQ ID NO: 421478 - DNA, 15 bp, Homo sapiens
ccagttcgattcctt

SEQ ID NO: 421479 - DNA, 15 bp, Homo sapiens
cagttcgattccttg

SEQ ID NO: 421480 - DNA, 15 bp, Homo sapiens
agttcgattccttga

SEQ ID NO: 421481 - DNA, 15 bp, Homo sapiens
gttcgattccttgag

SEQ ID NO: 421482 - DNA, 15 bp, Homo sapiens
ttcgattccttgagt

SEQ ID NO: 421483 - DNA, 15 bp, Homo sapiens
tcgattccttgagtc

SEQ ID NO: 421484 - DNA, 15 bp, Homo sapiens
cgattccttgagtcg

SEQ ID NO: 421485 - DNA, 15 bp, Homo sapiens
gattccttgagtcgc

SEQ ID NO: 421486 - DNA, 15 bp, Homo sapiens
attccttgagtcgct

SEQ ID NO: 421487 - DNA, 15 bp, Homo sapiens
ttccttgagtcgctg

SEQ ID NO: 421488 - DNA, 15 bp, Homo sapiens
tccttgagtcgctgg

SEQ ID NO: 421489 - DNA, 15 bp, Homo sapiens
ccttgagtcgctgga

SEQ ID NO: 421490 - DNA, 15 bp, Homo sapiens
cttgagtcgctggag

SEQ ID NO: 421491 - DNA, 15 bp, Homo sapiens
ttgagtcgctggagt

SEQ ID NO: 421492 - DNA, 15 bp, Homo sapiens
tgagtcgctggagtt

SEQ ID NO: 421493 - DNA, 15 bp, Homo sapiens
gagtcgctggagttg

SEQ ID NO: 421494 - DNA, 15 bp, Homo sapiens
agtcgctggagttgt

SEQ ID NO: 421495 - DNA, 15 bp, Homo sapiens
gtcgctggagttgtt

SEQ ID NO: 421496 - DNA, 15 bp, Homo sapiens
tcgctggagttgttt

SEQ ID NO: 421497 - DNA, 15 bp, Homo sapiens
cgctggagttgtttc

SEQ ID NO: 421498 - DNA, 15 bp, Homo sapiens
gctggagttgtttct

SEQ ID NO: 421499 - DNA, 15 bp, Homo sapiens
ctggagttgtttctg

SEQ ID NO: 421500 - DNA, 15 bp, Homo sapiens
tggagttgtttctga

SEQ ID NO: 421501 - DNA, 15 bp, Homo sapiens
ggagttgtttctgac

SEQ ID NO: 421502 - DNA, 15 bp, Homo sapiens
gagttgtttctgact

SEQ ID NO: 421503 - DNA, 15 bp, Homo sapiens
agttgtttctgactg

SEQ ID NO: 421504 - DNA, 15 bp, Homo sapiens
gttgtttctgactga

SEQ ID NO: 421505 - DNA, 15 bp, Homo sapiens
ttgtttctgactgat

SEQ ID NO: 421506 - DNA, 15 bp, Homo sapiens
tgtttctgactgatc

SEQ ID NO: 421507 - DNA, 15 bp, Homo sapiens
gtttctgactgatcc

SEQ ID NO: 421508 - DNA, 15 bp, Homo sapiens
tttctgactgatcca

SEQ ID NO: 421509 - DNA, 15 bp, Homo sapiens
ttctgactgatccat

SEQ ID NO: 421510 - DNA, 15 bp, Homo sapiens
tctgactgatccata

SEQ ID NO: 421511 - DNA, 15 bp, Homo sapiens
ctgactgatccatat

SEQ ID NO: 421512 - DNA, 15 bp, Homo sapiens
tgactgatccatatt

SEQ ID NO: 421513 - DNA, 15 bp, Homo sapiens
gactgatccatattt

SEQ ID NO: 421514 - DNA, 15 bp, Homo sapiens
actgatccatatttt

SEQ ID NO: 421515 - DNA, 15 bp, Homo sapiens
ctgatccatattttc

SEQ ID NO: 421516 - DNA, 15 bp, Homo sapiens
tgatccatattttca

SEQ ID NO: 421517 - DNA, 15 bp, Homo sapiens
gatccatattttcaa

SEQ ID NO: 421518 - DNA, 15 bp, Homo sapiens
atccatattttcaaa

SEQ ID NO: 421519 - DNA, 15 bp, Homo sapiens
tccatattttcaaat

SEQ ID NO: 421520 - DNA, 15 bp, Homo sapiens
ccatattttcaaatc

SEQ ID NO: 421521 - DNA, 15 bp, Homo sapiens
catattttcaaatcc

SEQ ID NO: 421522 - DNA, 15 bp, Homo sapiens
atattttcaaatcca

SEQ ID NO: 421523 - DNA, 15 bp, Homo sapiens
tattttcaaatccag

SEQ ID NO: 421524 - DNA, 15 bp, Homo sapiens
attttcaaatccagc

SEQ ID NO: 421525 - DNA, 15 bp, Homo sapiens
ttttcaaatccagcc

SEQ ID NO: 421526 - DNA, 15 bp, Homo sapiens
tttcaaatccagccc

SEQ ID NO: 421527 - DNA, 15 bp, Homo sapiens
ttcaaatccagccca

SEQ ID NO: 421528 - DNA, 15 bp, Homo sapiens
tcaaatccagcccac

SEQ ID NO: 421529 - DNA, 15 bp, Homo sapiens
caaatccagcccacc

SEQ ID NO: 421530 - DNA, 15 bp, Homo sapiens
aaatccagcccacca

SEQ ID NO: 421531 - DNA, 15 bp, Homo sapiens
aatccagcccaccag

SEQ ID NO: 421532 - DNA, 15 bp, Homo sapiens
atccagcccaccagt

SEQ ID NO: 421533 - DNA, 15 bp, Homo sapiens
tccagcccaccagtg

SEQ ID NO: 421534 - DNA, 15 bp, Homo sapiens
ccagcccaccagtgg

SEQ ID NO: 421535 - DNA, 15 bp, Homo sapiens
cagcccaccagtggg

SEQ ID NO: 421536 - DNA, 15 bp, Homo sapiens
agcccaccagtgggc

SEQ ID NO: 421537 - DNA, 15 bp, Homo sapiens
gcccaccagtgggcc

SEQ ID NO: 421538 - DNA, 15 bp, Homo sapiens
cccaccagtgggcct

SEQ ID NO: 421539 - DNA, 15 bp, Homo sapiens
ccaccagtgggcctg

SEQ ID NO: 421540 - DNA, 15 bp, Homo sapiens
caccagtgggcctga

SEQ ID NO: 421541 - DNA, 15 bp, Homo sapiens
accagtgggcctgag

SEQ ID NO: 421542 - DNA, 15 bp, Homo sapiens
ccagtgggcctgagg

SEQ ID NO: 421543 - DNA, 15 bp, Homo sapiens
cagtgggcctgaggc

SEQ ID NO: 421544 - DNA, 15 bp, Homo sapiens
agtgggcctgaggct

SEQ ID NO: 421545 - DNA, 15 bp, Homo sapiens
gtgggcctgaggctg

SEQ ID NO: 421546 - DNA, 15 bp, Homo sapiens
tgggcctgaggctgg

SEQ ID NO: 421547 - DNA, 15 bp, Homo sapiens
gggcctgaggctgga

SEQ ID NO: 421548 - DNA, 15 bp, Homo sapiens
ggcctgaggctggat

SEQ ID NO: 421549 - DNA, 15 bp, Homo sapiens
gcctgaggctggata

SEQ ID NO: 421550 - DNA, 15 bp, Homo sapiens
cctgaggctggataa

SEQ ID NO: 421551 - DNA, 15 bp, Homo sapiens
ctgaggctggataag

SEQ ID NO: 421552 - DNA, 15 bp, Homo sapiens
tgaggctggataagt

SEQ ID NO: 421553 - DNA, 15 bp, Homo sapiens
gaggctggataagtg

SEQ ID NO: 421554 - DNA, 15 bp, Homo sapiens
aggctggataagtgg

SEQ ID NO: 421555 - DNA, 15 bp, Homo sapiens
ggctggataagtggg

SEQ ID NO: 421556 - DNA, 15 bp, Homo sapiens
gctggataagtgggc

SEQ ID NO: 421557 - DNA, 15 bp, Homo sapiens
ctggataagtgggct

SEQ ID NO: 421558 - DNA, 15 bp, Homo sapiens
tggataagtgggctt

SEQ ID NO: 421559 - DNA, 15 bp, Homo sapiens
ggataagtgggcttt

SEQ ID NO: 421560 - DNA, 15 bp, Homo sapiens
gataagtgggctttc

SEQ ID NO: 421561 - DNA, 15 bp, Homo sapiens
ataagtgggctttca

SEQ ID NO: 421562 - DNA, 15 bp, Homo sapiens
taagtgggctttcac

SEQ ID NO: 421563 - DNA, 15 bp, Homo sapiens
aagtgggctttcacc

SEQ ID NO: 421564 - DNA, 15 bp, Homo sapiens
agtgggctttcacca

SEQ ID NO: 421565 - DNA, 15 bp, Homo sapiens
gtgggctttcaccag

SEQ ID NO: 421566 - DNA, 15 bp, Homo sapiens
tgggctttcaccagg

SEQ ID NO: 421567 - DNA, 15 bp, Homo sapiens
gggctttcaccaggg

SEQ ID NO: 421568 - DNA, 15 bp, Homo sapiens
ggctttcaccagggc

SEQ ID NO: 421569 - DNA, 15 bp, Homo sapiens
gctttcaccagggcc

SEQ ID NO: 421570 - DNA, 15 bp, Homo sapiens
ctttcaccagggccc

SEQ ID NO: 421571 - DNA, 15 bp, Homo sapiens
tttcaccagggccct

SEQ ID NO: 421572 - DNA, 15 bp, Homo sapiens
ttcaccagggcccta

SEQ ID NO: 421573 - DNA, 15 bp, Homo sapiens
tcaccagggccctaa

SEQ ID NO: 421574 - DNA, 15 bp, Homo sapiens
caccagggccctaac

SEQ ID NO: 421575 - DNA, 15 bp, Homo sapiens
accagggccctaaca

SEQ ID NO: 421576 - DNA, 15 bp, Homo sapiens
ccagggccctaacaa

SEQ ID NO: 421577 - DNA, 15 bp, Homo sapiens
cagggccctaacaag

SEQ ID NO: 421578 - DNA, 15 bp, Homo sapiens
agggccctaacaaga

SEQ ID NO: 421579 - DNA, 15 bp, Homo sapiens
gggccctaacaagag

SEQ ID NO: 421580 - DNA, 15 bp, Homo sapiens
ggccctaacaagagc

SEQ ID NO: 421581 - DNA, 15 bp, Homo sapiens
gccctaacaagagca

SEQ ID NO: 421582 - DNA, 15 bp, Homo sapiens
ccctaacaagagcaa

SEQ ID NO: 421583 - DNA, 15 bp, Homo sapiens
cctaacaagagcaaa

SEQ ID NO: 421584 - DNA, 15 bp, Homo sapiens
ctaacaagagcaaaa

SEQ ID NO: 421585 - DNA, 15 bp, Homo sapiens
taacaagagcaaaaa

SEQ ID NO: 421586 - DNA, 15 bp, Homo sapiens
aacaagagcaaaaaa

SEQ ID NO: 421587 - DNA, 15 bp, Homo sapiens
acaagagcaaaaaag

SEQ ID NO: 421588 - DNA, 15 bp, Homo sapiens
caagagcaaaaaagg

SEQ ID NO: 421589 - DNA, 15 bp, Homo sapiens
aagagcaaaaaagga

SEQ ID NO: 421590 - DNA, 15 bp, Homo sapiens
agagcaaaaaaggaa

SEQ ID NO: 421591 - DNA, 15 bp, Homo sapiens
gagcaaaaaaggaac

SEQ ID NO: 421592 - DNA, 15 bp, Homo sapiens
agcaaaaaaggaaca

SEQ ID NO: 421593 - DNA, 15 bp, Homo sapiens
gcaaaaaaggaacat

SEQ ID NO: 421594 - DNA, 15 bp, Homo sapiens
caaaaaaggaacatg

SEQ ID NO: 421595 - DNA, 15 bp, Homo sapiens
aaaaaaggaacatgt

SEQ ID NO: 421596 - DNA, 15 bp, Homo sapiens
aaaaaggaacatgtg

SEQ ID NO: 421597 - DNA, 15 bp, Homo sapiens
aaaaggaacatgtgc

SEQ ID NO: 421598 - DNA, 15 bp, Homo sapiens
aaaggaacatgtgca

SEQ ID NO: 421599 - DNA, 15 bp, Homo sapiens
aaggaacatgtgcat

SEQ ID NO: 421600 - DNA, 15 bp, Homo sapiens
aggaacatgtgcata

SEQ ID NO: 421601 - DNA, 15 bp, Homo sapiens
ggaacatgtgcatag

SEQ ID NO: 421602 - DNA, 15 bp, Homo sapiens
gaacatgtgcataga

SEQ ID NO: 421603 - DNA, 15 bp, Homo sapiens
aacatgtgcatagat

SEQ ID NO: 421604 - DNA, 15 bp, Homo sapiens
acatgtgcatagatt

SEQ ID NO: 421605 - DNA, 15 bp, Homo sapiens
catgtgcatagattt

SEQ ID NO: 421606 - DNA, 15 bp, Homo sapiens
atgtgcatagattta

SEQ ID NO: 421607 - DNA, 15 bp, Homo sapiens
tgtgcatagatttat

SEQ ID NO: 421608 - DNA, 15 bp, Homo sapiens
gtgcatagatttata

SEQ ID NO: 421609 - DNA, 15 bp, Homo sapiens
tgcatagatttatac

SEQ ID NO: 421610 - DNA, 15 bp, Homo sapiens
gcatagatttatact

SEQ ID NO: 421611 - DNA, 15 bp, Homo sapiens
catagatttatactc

SEQ ID NO: 421612 - DNA, 15 bp, Homo sapiens
atagatttatactcc

SEQ ID NO: 421613 - DNA, 15 bp, Homo sapiens
tagatttatactcct

SEQ ID NO: 421614 - DNA, 15 bp, Homo sapiens
agatttatactccta

SEQ ID NO: 421615 - DNA, 15 bp, Homo sapiens
gatttatactcctat

SEQ ID NO: 421616 - DNA, 15 bp, Homo sapiens
atttatactcctatt

SEQ ID NO: 421617 - DNA, 15 bp, Homo sapiens
tttatactcctattc

SEQ ID NO: 421618 - DNA, 15 bp, Homo sapiens
ttatactcctattct

SEQ ID NO: 421619 - DNA, 15 bp, Homo sapiens
tatactcctattctc

SEQ ID NO: 421620 - DNA, 15 bp, Homo sapiens
atactcctattctca

SEQ ID NO: 421621 - DNA, 15 bp, Homo sapiens
tactcctattctcaa

SEQ ID NO: 421622 - DNA, 15 bp, Homo sapiens
actcctattctcaag

SEQ ID NO: 421623 - DNA, 15 bp, Homo sapiens
ctcctattctcaagg

SEQ ID NO: 421624 - DNA, 15 bp, Homo sapiens
tcctattctcaaggg

SEQ ID NO: 421625 - DNA, 15 bp, Homo sapiens
cctattctcaagggc

SEQ ID NO: 421626 - DNA, 15 bp, Homo sapiens
ctattctcaagggcc

SEQ ID NO: 421627 - DNA, 15 bp, Homo sapiens
tattctcaagggcct

SEQ ID NO: 421628 - DNA, 15 bp, Homo sapiens
attctcaagggcctt

SEQ ID NO: 421629 - DNA, 15 bp, Homo sapiens
ttctcaagggccttt

SEQ ID NO: 421630 - DNA, 15 bp, Homo sapiens
tctcaagggcctttg

SEQ ID NO: 421631 - DNA, 15 bp, Homo sapiens
ctcaagggcctttgc

SEQ ID NO: 421632 - DNA, 15 bp, Homo sapiens
tcaagggcctttgct

SEQ ID NO: 421633 - DNA, 15 bp, Homo sapiens
caagggcctttgctc

SEQ ID NO: 421634 - DNA, 15 bp, Homo sapiens
aagggcctttgctct

SEQ ID NO: 421635 - DNA, 15 bp, Homo sapiens
agggcctttgctctt

SEQ ID NO: 421636 - DNA, 15 bp, Homo sapiens
gggcctttgctctta

SEQ ID NO: 421637 - DNA, 15 bp, Homo sapiens
ggcctttgctcttat

SEQ ID NO: 421638 - DNA, 15 bp, Homo sapiens
gcctttgctcttatt

SEQ ID NO: 421639 - DNA, 15 bp, Homo sapiens
cctttgctcttattg

SEQ ID NO: 421640 - DNA, 15 bp, Homo sapiens
ctttgctcttattgg

SEQ ID NO: 421641 - DNA, 15 bp, Homo sapiens
tttgctcttattgga

SEQ ID NO: 421642 - DNA, 15 bp, Homo sapiens
ttgctcttattggaa

SEQ ID NO: 421643 - DNA, 15 bp, Homo sapiens
tgctcttattggaac

SEQ ID NO: 421644 - DNA, 15 bp, Homo sapiens
gctcttattggaacc

SEQ ID NO: 421645 - DNA, 15 bp, Homo sapiens
ctcttattggaacct

SEQ ID NO: 421646 - DNA, 15 bp, Homo sapiens
tcttattggaacctt

SEQ ID NO: 421647 - DNA, 15 bp, Homo sapiens
cttattggaacctta

SEQ ID NO: 421648 - DNA, 15 bp, Homo sapiens
ttattggaaccttaa

SEQ ID NO: 421649 - DNA, 15 bp, Homo sapiens
tattggaaccttaac

SEQ ID NO: 421650 - DNA, 15 bp, Homo sapiens
attggaaccttaacc

SEQ ID NO: 421651 - DNA, 15 bp, Homo sapiens
ttggaaccttaacca

SEQ ID NO: 421652 - DNA, 15 bp, Homo sapiens
tggaaccttaaccat

SEQ ID NO: 421653 - DNA, 15 bp, Homo sapiens
ggaaccttaaccata

SEQ ID NO: 421654 - DNA, 15 bp, Homo sapiens
gaaccttaaccatat

SEQ ID NO: 421655 - DNA, 15 bp, Homo sapiens
aaccttaaccatatc

SEQ ID NO: 421656 - DNA, 15 bp, Homo sapiens
accttaaccatatca

SEQ ID NO: 421657 - DNA, 15 bp, Homo sapiens
ccttaaccatatcaa

SEQ ID NO: 421658 - DNA, 15 bp, Homo sapiens
cttaaccatatcaaa

SEQ ID NO: 421659 - DNA, 15 bp, Homo sapiens
ttaaccatatcaaaa

SEQ ID NO: 421660 - DNA, 15 bp, Homo sapiens
taaccatatcaaaat

SEQ ID NO: 421661 - DNA, 15 bp, Homo sapiens
aaccatatcaaaatg

SEQ ID NO: 421662 - DNA, 15 bp, Homo sapiens
accatatcaaaatgt

SEQ ID NO: 421663 - DNA, 15 bp, Homo sapiens
ccatatcaaaatgta

SEQ ID NO: 421664 - DNA, 15 bp, Homo sapiens
catatcaaaatgtat

SEQ ID NO: 421665 - DNA, 15 bp, Homo sapiens
atatcaaaatgtatt

SEQ ID NO: 421666 - DNA, 15 bp, Homo sapiens
tatcaaaatgtattt

SEQ ID NO: 421667 - DNA, 15 bp, Homo sapiens
caaaatgtatttcct

SEQ ID NO: 421668 - DNA, 15 bp, Homo sapiens
aaaatgtatttccta

SEQ ID NO: 421669 - DNA, 15 bp, Homo sapiens
aaatgtatttcctaa

SEQ ID NO: 421670 - DNA, 15 bp, Homo sapiens
aatgtatttcctaaa

SEQ ID NO: 421671 - DNA, 15 bp, Homo sapiens
atgtatttcctaaac

SEQ ID NO: 421672 - DNA, 15 bp, Homo sapiens
tgtatttcctaaaca

SEQ ID NO: 421673 - DNA, 15 bp, Homo sapiens
gtatttcctaaacat

SEQ ID NO: 421674 - DNA, 15 bp, Homo sapiens
tatttcctaaacata

SEQ ID NO: 421675 - DNA, 15 bp, Homo sapiens
atttcctaaacatat

SEQ ID NO: 421676 - DNA, 15 bp, Homo sapiens
tttcctaaacatatc

SEQ ID NO: 421677 - DNA, 15 bp, Homo sapiens
ttcctaaacatatct

SEQ ID NO: 421678 - DNA, 15 bp, Homo sapiens
tcctaaacatatctg

SEQ ID NO: 421679 - DNA, 15 bp, Homo sapiens
cctaaacatatctgt

SEQ ID NO: 421680 - DNA, 15 bp, Homo sapiens
ctaaacatatctgtg

SEQ ID NO: 421681 - DNA, 15 bp, Homo sapiens
taaacatatctgtga

SEQ ID NO: 421682 - DNA, 15 bp, Homo sapiens
aaacatatctgtgat

SEQ ID NO: 421683 - DNA, 15 bp, Homo sapiens
aacatatctgtgatt

SEQ ID NO: 421684 - DNA, 15 bp, Homo sapiens
acatatctgtgatta

SEQ ID NO: 421685 - DNA, 15 bp, Homo sapiens
catatctgtgattat

SEQ ID NO: 421686 - DNA, 15 bp, Homo sapiens
atatctgtgattatg

SEQ ID NO: 421687 - DNA, 15 bp, Homo sapiens
tatctgtgattatgg

SEQ ID NO: 421688 - DNA, 15 bp, Homo sapiens
atctgtgattatgga

SEQ ID NO: 421689 - DNA, 15 bp, Homo sapiens
tctgtgattatggag

SEQ ID NO: 421690 - DNA, 15 bp, Homo sapiens
ctgtgattatggagt

SEQ ID NO: 421691 - DNA, 15 bp, Homo sapiens
tgtgattatggagtt

SEQ ID NO: 421692 - DNA, 15 bp, Homo sapiens
gtgattatggagttc

SEQ ID NO: 421693 - DNA, 15 bp, Homo sapiens
tgattatggagttca

SEQ ID NO: 421694 - DNA, 15 bp, Homo sapiens
gattatggagttcat

SEQ ID NO: 421695 - DNA, 15 bp, Homo sapiens
attatggagttcata

SEQ ID NO: 421696 - DNA, 15 bp, Homo sapiens
ttatggagttcataa

SEQ ID NO: 421697 - DNA, 15 bp, Homo sapiens
tatggagttcataat

SEQ ID NO: 421698 - DNA, 15 bp, Homo sapiens
atggagttcataatc

SEQ ID NO: 421699 - DNA, 15 bp, Homo sapiens
tggagttcataatct

SEQ ID NO: 421700 - DNA, 15 bp, Homo sapiens
ggagttcataatcta

SEQ ID NO: 421701 - DNA, 15 bp, Homo sapiens
gagttcataatctaa

SEQ ID NO: 421702 - DNA, 15 bp, Homo sapiens
agttcataatctaag

SEQ ID NO: 421703 - DNA, 15 bp, Homo sapiens
gttcataatctaaga

SEQ ID NO: 421704 - DNA, 15 bp, Homo sapiens
ttcataatctaagaa

SEQ ID NO: 421705 - DNA, 15 bp, Homo sapiens
tcataatctaagaat

SEQ ID NO: 421706 - DNA, 15 bp, Homo sapiens
cataatctaagaatc

SEQ ID NO: 421707 - DNA, 15 bp, Homo sapiens
ataatctaagaatct

SEQ ID NO: 421708 - DNA, 15 bp, Homo sapiens
taatctaagaatctg

SEQ ID NO: 421709 - DNA, 15 bp, Homo sapiens
aatctaagaatctga

SEQ ID NO: 421710 - DNA, 15 bp, Homo sapiens
atctaagaatctgaa

SEQ ID NO: 421711 - DNA, 15 bp, Homo sapiens
tctaagaatctgaag

SEQ ID NO: 421712 - DNA, 15 bp, Homo sapiens
ctaagaatctgaagg

SEQ ID NO: 421713 - DNA, 15 bp, Homo sapiens
taagaatctgaaggt

SEQ ID NO: 421714 - DNA, 15 bp, Homo sapiens
aagaatctgaaggtg

SEQ ID NO: 421715 - DNA, 15 bp, Homo sapiens
agaatctgaaggtgc

SEQ ID NO: 421716 - DNA, 15 bp, Homo sapiens
gaatctgaaggtgca

SEQ ID NO: 421717 - DNA, 15 bp, Homo sapiens
aatctgaaggtgcat

SEQ ID NO: 421718 - DNA, 15 bp, Homo sapiens
atctgaaggtgcatt

SEQ ID NO: 421719 - DNA, 15 bp, Homo sapiens
tctgaaggtgcattt

SEQ ID NO: 421720 - DNA, 15 bp, Homo sapiens
ctgaaggtgcatttc

SEQ ID NO: 421721 - DNA, 15 bp, Homo sapiens
tgaaggtgcatttct

SEQ ID NO: 421722 - DNA, 15 bp, Homo sapiens
gaaggtgcatttctg

SEQ ID NO: 421723 - DNA, 15 bp, Homo sapiens
aaggtgcatttctgt

SEQ ID NO: 421724 - DNA, 15 bp, Homo sapiens
aggtgcatttctgtg

SEQ ID NO: 421725 - DNA, 15 bp, Homo sapiens
ggtgcatttctgtgt

SEQ ID NO: 421726 - DNA, 15 bp, Homo sapiens
gtgcatttctgtgtt

SEQ ID NO: 421727 - DNA, 15 bp, Homo sapiens
tgcatttctgtgtta

SEQ ID NO: 421728 - DNA, 15 bp, Homo sapiens
gcatttctgtgttaa

SEQ ID NO: 421729 - DNA, 15 bp, Homo sapiens
catttctgtgttaaa

SEQ ID NO: 421730 - DNA, 15 bp, Homo sapiens
atttctgtgttaaat

SEQ ID NO: 421731 - DNA, 15 bp, Homo sapiens
tttctgtgttaaatg

SEQ ID NO: 421732 - DNA, 15 bp, Homo sapiens
ttctgtgttaaatgc

SEQ ID NO: 421733 - DNA, 15 bp, Homo sapiens
tctgtgttaaatgca

SEQ ID NO: 421734 - DNA, 15 bp, Homo sapiens
ctgtgttaaatgcag

SEQ ID NO: 421735 - DNA, 15 bp, Homo sapiens
tgtgttaaatgcaga

SEQ ID NO: 421736 - DNA, 15 bp, Homo sapiens
gtgttaaatgcagaa

SEQ ID NO: 421737 - DNA, 15 bp, Homo sapiens
tgttaaatgcagaaa

SEQ ID NO: 421738 - DNA, 15 bp, Homo sapiens
gttaaatgcagaaat

SEQ ID NO: 421739 - DNA, 15 bp, Homo sapiens
ttaaatgcagaaatt

SEQ ID NO: 421740 - DNA, 15 bp, Homo sapiens
taaatgcagaaatta

SEQ ID NO: 421741 - DNA, 15 bp, Homo sapiens
aaatgcagaaattat

SEQ ID NO: 421742 - DNA, 15 bp, Homo sapiens
aatgcagaaattatt

SEQ ID NO: 421743 - DNA, 15 bp, Homo sapiens
atgcagaaattatta

SEQ ID NO: 421744 - DNA, 15 bp, Homo sapiens
tgcagaaattattat

SEQ ID NO: 421745 - DNA, 15 bp, Homo sapiens
gcagaaattattatt

SEQ ID NO: 421746 - DNA, 15 bp, Homo sapiens
cagaaattattattg

SEQ ID NO: 421747 - DNA, 15 bp, Homo sapiens
agaaattattattga

SEQ ID NO: 421748 - DNA, 15 bp, Homo sapiens
gaaattattattgaa

SEQ ID NO: 421749 - DNA, 15 bp, Homo sapiens
aaattattattgaaa

SEQ ID NO: 421750 - DNA, 15 bp, Homo sapiens
aattattattgaaac

SEQ ID NO: 421751 - DNA, 15 bp, Homo sapiens
attattattgaaaca

SEQ ID NO: 421752 - DNA, 15 bp, Homo sapiens
ttattattgaaacaa

SEQ ID NO: 421753 - DNA, 15 bp, Homo sapiens
tattattgaaacaaa

SEQ ID NO: 421754 - DNA, 15 bp, Homo sapiens
attattgaaacaaag

SEQ ID NO: 421755 - DNA, 15 bp, Homo sapiens
ttattgaaacaaaga

SEQ ID NO: 421756 - DNA, 15 bp, Homo sapiens
tattgaaacaaagac

SEQ ID NO: 421757 - DNA, 15 bp, Homo sapiens
attgaaacaaagacc

SEQ ID NO: 421758 - DNA, 15 bp, Homo sapiens
ttgaaacaaagacct

SEQ ID NO: 421759 - DNA, 15 bp, Homo sapiens
tgaaacaaagacctc

SEQ ID NO: 421760 - DNA, 15 bp, Homo sapiens
gaaacaaagacctca

SEQ ID NO: 421761 - DNA, 15 bp, Homo sapiens
aaacaaagacctcac

SEQ ID NO: 421762 - DNA, 15 bp, Homo sapiens
aacaaagacctcacc

SEQ ID NO: 421763 - DNA, 15 bp, Homo sapiens
acaaagacctcacct

SEQ ID NO: 421764 - DNA, 15 bp, Homo sapiens
caaagacctcacctt

SEQ ID NO: 421765 - DNA, 15 bp, Homo sapiens
aaagacctcaccttt

SEQ ID NO: 421766 - DNA, 15 bp, Homo sapiens
aagacctcaccttta

SEQ ID NO: 421767 - DNA, 15 bp, Homo sapiens
agacctcacctttaa

SEQ ID NO: 421768 - DNA, 15 bp, Homo sapiens
gacctcacctttaaa

SEQ ID NO: 421769 - DNA, 15 bp, Homo sapiens
acctcacctttaaat

SEQ ID NO: 421770 - DNA, 15 bp, Homo sapiens
cctcacctttaaatg

SEQ ID NO: 421771 - DNA, 15 bp, Homo sapiens
ctcacctttaaatga

SEQ ID NO: 421772 - DNA, 15 bp, Homo sapiens
tcacctttaaatgag

SEQ ID NO: 421773 - DNA, 15 bp, Homo sapiens
cacctttaaatgaga

SEQ ID NO: 421774 - DNA, 15 bp, Homo sapiens
acctttaaatgagag

SEQ ID NO: 421775 - DNA, 15 bp, Homo sapiens
cctttaaatgagagt

SEQ ID NO: 421776 - DNA, 15 bp, Homo sapiens
ctttaaatgagagta

SEQ ID NO: 421777 - DNA, 15 bp, Homo sapiens
tttaaatgagagtat

SEQ ID NO: 421778 - DNA, 15 bp, Homo sapiens
ttaaatgagagtata

SEQ ID NO: 421779 - DNA, 15 bp, Homo sapiens
taaatgagagtataa

SEQ ID NO: 421780 - DNA, 15 bp, Homo sapiens
aaatgagagtataaa

SEQ ID NO: 421781 - DNA, 15 bp, Homo sapiens
aatgagagtataaag

SEQ ID NO: 421782 - DNA, 15 bp, Homo sapiens
atgagagtataaagt

SEQ ID NO: 421783 - DNA, 15 bp, Homo sapiens
tgagagtataaagta

SEQ ID NO: 421784 - DNA, 15 bp, Homo sapiens
gagagtataaagtac

SEQ ID NO: 421785 - DNA, 15 bp, Homo sapiens
agagtataaagtact

SEQ ID NO: 421786 - DNA, 15 bp, Homo sapiens
gagtataaagtactg

SEQ ID NO: 421787 - DNA, 15 bp, Homo sapiens
agtataaagtactgc

SEQ ID NO: 421788 - DNA, 15 bp, Homo sapiens
gtataaagtactgca

SEQ ID NO: 421789 - DNA, 15 bp, Homo sapiens
tataaagtactgcag

SEQ ID NO: 421790 - DNA, 15 bp, Homo sapiens
ataaagtactgcagt

SEQ ID NO: 421791 - DNA, 15 bp, Homo sapiens
taaagtactgcagtg

SEQ ID NO: 421792 - DNA, 15 bp, Homo sapiens
aaagtactgcagtga

SEQ ID NO: 421793 - DNA, 15 bp, Homo sapiens
aagtactgcagtgac

SEQ ID NO: 421794 - DNA, 15 bp, Homo sapiens
agtactgcagtgact

SEQ ID NO: 421795 - DNA, 15 bp, Homo sapiens
gtactgcagtgactt

SEQ ID NO: 421796 - DNA, 15 bp, Homo sapiens
tactgcagtgacttt

SEQ ID NO: 421797 - DNA, 15 bp, Homo sapiens
actgcagtgactttc

SEQ ID NO: 421798 - DNA, 15 bp, Homo sapiens
ctgcagtgactttcg

SEQ ID NO: 421799 - DNA, 15 bp, Homo sapiens
tgcagtgactttcgc

SEQ ID NO: 421800 - DNA, 15 bp, Homo sapiens
gcagtgactttcgcc

SEQ ID NO: 421801 - DNA, 15 bp, Homo sapiens
cagtgactttcgccc

SEQ ID NO: 421802 - DNA, 15 bp, Homo sapiens
agtgactttcgccca

SEQ ID NO: 421803 - DNA, 15 bp, Homo sapiens
gtgactttcgcccaa

SEQ ID NO: 421804 - DNA, 15 bp, Homo sapiens
tgactttcgcccaac

SEQ ID NO: 421805 - DNA, 15 bp, Homo sapiens
gactttcgcccaact

SEQ ID NO: 421806 - DNA, 15 bp, Homo sapiens
actttcgcccaactg

SEQ ID NO: 421807 - DNA, 15 bp, Homo sapiens
ctttcgcccaactgt

SEQ ID NO: 421808 - DNA, 15 bp, Homo sapiens
tttcgcccaactgtt

SEQ ID NO: 421809 - DNA, 15 bp, Homo sapiens
ttcgcccaactgttc

SEQ ID NO: 421810 - DNA, 15 bp, Homo sapiens
tcgcccaactgttct

SEQ ID NO: 421811 - DNA, 15 bp, Homo sapiens
cgcccaactgttctc

SEQ ID NO: 421812 - DNA, 15 bp, Homo sapiens
gcccaactgttctct

SEQ ID NO: 421813 - DNA, 15 bp, Homo sapiens
cccaactgttctcta

SEQ ID NO: 421814 - DNA, 15 bp, Homo sapiens
ccaactgttctctat

SEQ ID NO: 421815 - DNA, 15 bp, Homo sapiens
caactgttctctatt

SEQ ID NO: 421816 - DNA, 15 bp, Homo sapiens
aactgttctctattc

SEQ ID NO: 421817 - DNA, 15 bp, Homo sapiens
actgttctctattca

SEQ ID NO: 421818 - DNA, 15 bp, Homo sapiens
ctgttctctattcac

SEQ ID NO: 421819 - DNA, 15 bp, Homo sapiens
tgttctctattcaca

SEQ ID NO: 421820 - DNA, 15 bp, Homo sapiens
gttctctattcacac

SEQ ID NO: 421821 - DNA, 15 bp, Homo sapiens
ttctctattcacact

SEQ ID NO: 421822 - DNA, 15 bp, Homo sapiens
tctctattcacactg

SEQ ID NO: 421823 - DNA, 15 bp, Homo sapiens
ctctattcacactgg

SEQ ID NO: 421824 - DNA, 15 bp, Homo sapiens
tctattcacactggt

SEQ ID NO: 421825 - DNA, 15 bp, Homo sapiens
ctattcacactggtc

SEQ ID NO: 421826 - DNA, 15 bp, Homo sapiens
tattcacactggtca

SEQ ID NO: 421827 - DNA, 15 bp, Homo sapiens
attcacactggtcat

SEQ ID NO: 421828 - DNA, 15 bp, Homo sapiens
ttcacactggtcatt

SEQ ID NO: 421829 - DNA, 15 bp, Homo sapiens
tcacactggtcattt

SEQ ID NO: 421830 - DNA, 15 bp, Homo sapiens
cacactggtcatttg

SEQ ID NO: 421831 - DNA, 15 bp, Homo sapiens
acactggtcatttgt

SEQ ID NO: 421832 - DNA, 15 bp, Homo sapiens
cactggtcatttgtc

SEQ ID NO: 421833 - DNA, 15 bp, Homo sapiens
actggtcatttgtca

SEQ ID NO: 421834 - DNA, 15 bp, Homo sapiens
ctggtcatttgtcac

SEQ ID NO: 421835 - DNA, 15 bp, Homo sapiens
tggtcatttgtcact

SEQ ID NO: 421836 - DNA, 15 bp, Homo sapiens
ggtcatttgtcacta

SEQ ID NO: 421837 - DNA, 15 bp, Homo sapiens
gtcatttgtcactag

SEQ ID NO: 421838 - DNA, 15 bp, Homo sapiens
tcatttgtcactaga

SEQ ID NO: 421839 - DNA, 15 bp, Homo sapiens
catttgtcactagac

SEQ ID NO: 421840 - DNA, 15 bp, Homo sapiens
atttgtcactagaca

SEQ ID NO: 421841 - DNA, 15 bp, Homo sapiens
tttgtcactagacat

SEQ ID NO: 421842 - DNA, 15 bp, Homo sapiens
ttgtcactagacatt

SEQ ID NO: 421843 - DNA, 15 bp, Homo sapiens
tgtcactagacattg

SEQ ID NO: 421844 - DNA, 15 bp, Homo sapiens
gtcactagacattgg

SEQ ID NO: 421845 - DNA, 15 bp, Homo sapiens
tcactagacattggt

SEQ ID NO: 421846 - DNA, 15 bp, Homo sapiens
cactagacattggtc

SEQ ID NO: 421847 - DNA, 15 bp, Homo sapiens
actagacattggtca

SEQ ID NO: 421848 - DNA, 15 bp, Homo sapiens
ctagacattggtcaa

SEQ ID NO: 421849 - DNA, 15 bp, Homo sapiens
tagacattggtcaac

SEQ ID NO: 421850 - DNA, 15 bp, Homo sapiens
agacattggtcaacc

SEQ ID NO: 421851 - DNA, 15 bp, Homo sapiens
gacattggtcaacct

SEQ ID NO: 421852 - DNA, 15 bp, Homo sapiens
acattggtcaacctt

SEQ ID NO: 421853 - DNA, 15 bp, Homo sapiens
cattggtcaacctta

SEQ ID NO: 421854 - DNA, 15 bp, Homo sapiens
attggtcaaccttaa

SEQ ID NO: 421855 - DNA, 15 bp, Homo sapiens
ttggtcaaccttaag

SEQ ID NO: 421856 - DNA, 15 bp, Homo sapiens
tggtcaaccttaagc

SEQ ID NO: 421857 - DNA, 15 bp, Homo sapiens
ggtcaaccttaagcc

SEQ ID NO: 421858 - DNA, 15 bp, Homo sapiens
gtcaaccttaagcca

SEQ ID NO: 421859 - DNA, 15 bp, Homo sapiens
tcaaccttaagccaa

SEQ ID NO: 421860 - DNA, 15 bp, Homo sapiens
caaccttaagccaaa

SEQ ID NO: 421861 - DNA, 15 bp, Homo sapiens
aaccttaagccaaat

SEQ ID NO: 421862 - DNA, 15 bp, Homo sapiens
accttaagccaaata

SEQ ID NO: 421863 - DNA, 15 bp, Homo sapiens
ccttaagccaaatag

SEQ ID NO: 421864 - DNA, 15 bp, Homo sapiens
cttaagccaaatagt

SEQ ID NO: 421865 - DNA, 15 bp, Homo sapiens
ttaagccaaatagta

SEQ ID NO: 421866 - DNA, 15 bp, Homo sapiens
taagccaaatagtat

SEQ ID NO: 421867 - DNA, 15 bp, Homo sapiens
aagccaaatagtatc

SEQ ID NO: 421868 - DNA, 15 bp, Homo sapiens
agccaaatagtatcc

SEQ ID NO: 421869 - DNA, 15 bp, Homo sapiens
gccaaatagtatcct

SEQ ID NO: 421870 - DNA, 15 bp, Homo sapiens
ccaaatagtatcctg

SEQ ID NO: 421871 - DNA, 15 bp, Homo sapiens
caaatagtatcctgt

SEQ ID NO: 421872 - DNA, 15 bp, Homo sapiens
aaatagtatcctgtc

SEQ ID NO: 421873 - DNA, 15 bp, Homo sapiens
aatagtatcctgtcg

SEQ ID NO: 421874 - DNA, 15 bp, Homo sapiens
atagtatcctgtcga

SEQ ID NO: 421875 - DNA, 15 bp, Homo sapiens
tagtatcctgtcgaa

SEQ ID NO: 421876 - DNA, 15 bp, Homo sapiens
agtatcctgtcgaag

SEQ ID NO: 421877 - DNA, 15 bp, Homo sapiens
gtatcctgtcgaagc

SEQ ID NO: 421878 - DNA, 15 bp, Homo sapiens
tatcctgtcgaagca

SEQ ID NO: 421879 - DNA, 15 bp, Homo sapiens
atcctgtcgaagcaa

SEQ ID NO: 421880 - DNA, 15 bp, Homo sapiens
tcctgtcgaagcaat

SEQ ID NO: 421881 - DNA, 15 bp, Homo sapiens
cctgtcgaagcaatg

SEQ ID NO: 421882 - DNA, 15 bp, Homo sapiens
ctgtcgaagcaatgc

SEQ ID NO: 421883 - DNA, 15 bp, Homo sapiens
tgtcgaagcaatgcc

SEQ ID NO: 421884 - DNA, 15 bp, Homo sapiens
gtcgaagcaatgcct

SEQ ID NO: 421885 - DNA, 15 bp, Homo sapiens
tcgaagcaatgcctg

SEQ ID NO: 421886 - DNA, 15 bp, Homo sapiens
cgaagcaatgcctga

SEQ ID NO: 421887 - DNA, 15 bp, Homo sapiens
gaagcaatgcctgat

SEQ ID NO: 421888 - DNA, 15 bp, Homo sapiens
aagcaatgcctgatt

SEQ ID NO: 421889 - DNA, 15 bp, Homo sapiens
agcaatgcctgatta

SEQ ID NO: 421890 - DNA, 15 bp, Homo sapiens
gcaatgcctgattat

SEQ ID NO: 421891 - DNA, 15 bp, Homo sapiens
caatgcctgattatt

SEQ ID NO: 421892 - DNA, 15 bp, Homo sapiens
aatgcctgattattt

SEQ ID NO: 421893 - DNA, 15 bp, Homo sapiens
atgcctgattatttt

SEQ ID NO: 421894 - DNA, 15 bp, Homo sapiens
tgcctgattattttc

SEQ ID NO: 421895 - DNA, 15 bp, Homo sapiens
gcctgattattttcc

SEQ ID NO: 421896 - DNA, 15 bp, Homo sapiens
cctgattattttcca

SEQ ID NO: 421897 - DNA, 15 bp, Homo sapiens
ctgattattttccaa

SEQ ID NO: 421898 - DNA, 15 bp, Homo sapiens
tgattattttccaac

SEQ ID NO: 421899 - DNA, 15 bp, Homo sapiens
gattattttccaact

SEQ ID NO: 421900 - DNA, 15 bp, Homo sapiens
attattttccaactt

SEQ ID NO: 421901 - DNA, 15 bp, Homo sapiens
ttattttccaacttt

SEQ ID NO: 421902 - DNA, 15 bp, Homo sapiens
tattttccaactttt

SEQ ID NO: 421903 - DNA, 15 bp, Homo sapiens
attttccaacttttt

SEQ ID NO: 421904 - DNA, 15 bp, Homo sapiens
ttttccaactttttg

SEQ ID NO: 421905 - DNA, 15 bp, Homo sapiens
tttccaactttttga

SEQ ID NO: 421906 - DNA, 15 bp, Homo sapiens
ttccaactttttgaa

SEQ ID NO: 421907 - DNA, 15 bp, Homo sapiens
tccaactttttgaag

SEQ ID NO: 421908 - DNA, 15 bp, Homo sapiens
ccaactttttgaagt

SEQ ID NO: 421909 - DNA, 15 bp, Homo sapiens
caactttttgaagta

SEQ ID NO: 421910 - DNA, 15 bp, Homo sapiens
aactttttgaagtaa

SEQ ID NO: 421911 - DNA, 15 bp, Homo sapiens
actttttgaagtaaa

SEQ ID NO: 421912 - DNA, 15 bp, Homo sapiens
ctttttgaagtaaac

SEQ ID NO: 421913 - DNA, 15 bp, Homo sapiens
tttttgaagtaaaca

SEQ ID NO: 421914 - DNA, 15 bp, Homo sapiens
ttttgaagtaaacat

SEQ ID NO: 421915 - DNA, 15 bp, Homo sapiens
tttgaagtaaacatt

SEQ ID NO: 421916 - DNA, 15 bp, Homo sapiens
ttgaagtaaacattg

SEQ ID NO: 421917 - DNA, 15 bp, Homo sapiens
tgaagtaaacattgc

SEQ ID NO: 421918 - DNA, 15 bp, Homo sapiens
gaagtaaacattgct

SEQ ID NO: 421919 - DNA, 15 bp, Homo sapiens
aagtaaacattgcta

SEQ ID NO: 421920 - DNA, 15 bp, Homo sapiens
agtaaacattgctat

SEQ ID NO: 421921 - DNA, 15 bp, Homo sapiens
gtaaacattgctatt

SEQ ID NO: 421922 - DNA, 15 bp, Homo sapiens
taaacattgctattg

SEQ ID NO: 421923 - DNA, 15 bp, Homo sapiens
aaacattgctattgt

SEQ ID NO: 421924 - DNA, 15 bp, Homo sapiens
aacattgctattgtt

SEQ ID NO: 421925 - DNA, 15 bp, Homo sapiens
acattgctattgttc

SEQ ID NO: 421926 - DNA, 15 bp, Homo sapiens
cattgctattgttct

SEQ ID NO: 421927 - DNA, 15 bp, Homo sapiens
attgctattgttctg

SEQ ID NO: 421928 - DNA, 15 bp, Homo sapiens
ttgctattgttctgc

SEQ ID NO: 421929 - DNA, 15 bp, Homo sapiens
tgctattgttctgct

SEQ ID NO: 421930 - DNA, 15 bp, Homo sapiens
gctattgttctgctt

SEQ ID NO: 421931 - DNA, 15 bp, Homo sapiens
ctattgttctgcttt

SEQ ID NO: 421932 - DNA, 15 bp, Homo sapiens
tattgttctgctttt

SEQ ID NO: 421933 - DNA, 15 bp, Homo sapiens
attgttctgcttttt

SEQ ID NO: 421934 - DNA, 15 bp, Homo sapiens
ttgttctgctttttg

SEQ ID NO: 421935 - DNA, 15 bp, Homo sapiens
tgttctgctttttgg

SEQ ID NO: 421936 - DNA, 15 bp, Homo sapiens
gttctgctttttggt

SEQ ID NO: 421937 - DNA, 15 bp, Homo sapiens
ttctgctttttggtt

SEQ ID NO: 421938 - DNA, 15 bp, Homo sapiens
tctgctttttggtta

SEQ ID NO: 421939 - DNA, 15 bp, Homo sapiens
ctgctttttggttac

SEQ ID NO: 421940 - DNA, 15 bp, Homo sapiens
tgctttttggttaca

SEQ ID NO: 421941 - DNA, 15 bp, Homo sapiens
gctttttggttacaa

SEQ ID NO: 421942 - DNA, 15 bp, Homo sapiens
ctttttggttacaac

SEQ ID NO: 421943 - DNA, 15 bp, Homo sapiens
tttttggttacaaca

SEQ ID NO: 421944 - DNA, 15 bp, Homo sapiens
ttttggttacaacag

SEQ ID NO: 421945 - DNA, 15 bp, Homo sapiens
tttggttacaacaga

SEQ ID NO: 421946 - DNA, 15 bp, Homo sapiens
ttggttacaacagaa

SEQ ID NO: 421947 - DNA, 15 bp, Homo sapiens
tggttacaacagaag

SEQ ID NO: 421948 - DNA, 15 bp, Homo sapiens
ggttacaacagaagg

SEQ ID NO: 421949 - DNA, 15 bp, Homo sapiens
gttacaacagaagga

SEQ ID NO: 421950 - DNA, 15 bp, Homo sapiens
ttacaacagaaggag

SEQ ID NO: 421951 - DNA, 15 bp, Homo sapiens
tacaacagaaggagt

SEQ ID NO: 421952 - DNA, 15 bp, Homo sapiens
acaacagaaggagtt

SEQ ID NO: 421953 - DNA, 15 bp, Homo sapiens
caacagaaggagttt

SEQ ID NO: 421954 - DNA, 15 bp, Homo sapiens
aacagaaggagtttt

SEQ ID NO: 421955 - DNA, 15 bp, Homo sapiens
acagaaggagttttt

SEQ ID NO: 421956 - DNA, 15 bp, Homo sapiens
cagaaggagtttttg

SEQ ID NO: 421957 - DNA, 15 bp, Homo sapiens
agaaggagtttttgg

SEQ ID NO: 421958 - DNA, 15 bp, Homo sapiens
gaaggagtttttggt

SEQ ID NO: 421959 - DNA, 15 bp, Homo sapiens
aaggagtttttggtt

SEQ ID NO: 421960 - DNA, 15 bp, Homo sapiens
aggagtttttggtta

SEQ ID NO: 421961 - DNA, 15 bp, Homo sapiens
ggagtttttggttac

SEQ ID NO: 421962 - DNA, 15 bp, Homo sapiens
gagtttttggttaca

SEQ ID NO: 421963 - DNA, 15 bp, Homo sapiens
agtttttggttacaa

SEQ ID NO: 421964 - DNA, 15 bp, Homo sapiens
gtttttggttacaag

SEQ ID NO: 421965 - DNA, 15 bp, Homo sapiens
tttttggttacaaga

SEQ ID NO: 421966 - DNA, 15 bp, Homo sapiens
ttttggttacaagag

SEQ ID NO: 421967 - DNA, 15 bp, Homo sapiens
tttggttacaagaga

SEQ ID NO: 421968 - DNA, 15 bp, Homo sapiens
ttggttacaagagaa

SEQ ID NO: 421969 - DNA, 15 bp, Homo sapiens
tggttacaagagaaa

SEQ ID NO: 421970 - DNA, 15 bp, Homo sapiens
ggttacaagagaaag

SEQ ID NO: 421971 - DNA, 15 bp, Homo sapiens
gttacaagagaaagt

SEQ ID NO: 421972 - DNA, 15 bp, Homo sapiens
ttacaagagaaagta

SEQ ID NO: 421973 - DNA, 15 bp, Homo sapiens
tacaagagaaagtaa

SEQ ID NO: 421974 - DNA, 15 bp, Homo sapiens
acaagagaaagtaac

SEQ ID NO: 421975 - DNA, 15 bp, Homo sapiens
caagagaaagtaaca

SEQ ID NO: 421976 - DNA, 15 bp, Homo sapiens
aagagaaagtaacac

SEQ ID NO: 421977 - DNA, 15 bp, Homo sapiens
agagaaagtaacaca

SEQ ID NO: 421978 - DNA, 15 bp, Homo sapiens
gagaaagtaacacat

SEQ ID NO: 421979 - DNA, 15 bp, Homo sapiens
agaaagtaacacatc

SEQ ID NO: 421980 - DNA, 15 bp, Homo sapiens
gaaagtaacacatca

SEQ ID NO: 421981 - DNA, 15 bp, Homo sapiens
aaagtaacacatcag

SEQ ID NO: 421982 - DNA, 15 bp, Homo sapiens
aagtaacacatcagt

SEQ ID NO: 421983 - DNA, 15 bp, Homo sapiens
agtaacacatcagta

SEQ ID NO: 421984 - DNA, 15 bp, Homo sapiens
gtaacacatcagtaa

SEQ ID NO: 421985 - DNA, 15 bp, Homo sapiens
taacacatcagtaat

SEQ ID NO: 421986 - DNA, 15 bp, Homo sapiens
aacacatcagtaatt

SEQ ID NO: 421987 - DNA, 15 bp, Homo sapiens
acacatcagtaattt

SEQ ID NO: 421988 - DNA, 15 bp, Homo sapiens
cacatcagtaatttc

SEQ ID NO: 421989 - DNA, 15 bp, Homo sapiens
acatcagtaatttcc

SEQ ID NO: 421990 - DNA, 15 bp, Homo sapiens
catcagtaatttcca

SEQ ID NO: 421991 - DNA, 15 bp, Homo sapiens
atcagtaatttccat

SEQ ID NO: 421992 - DNA, 15 bp, Homo sapiens
tcagtaatttccatt

SEQ ID NO: 421993 - DNA, 15 bp, Homo sapiens
cagtaatttccattc

SEQ ID NO: 421994 - DNA, 15 bp, Homo sapiens
agtaatttccattcc

SEQ ID NO: 421995 - DNA, 15 bp, Homo sapiens
gtaatttccattcct

SEQ ID NO: 421996 - DNA, 15 bp, Homo sapiens
taatttccattccta

SEQ ID NO: 421997 - DNA, 15 bp, Homo sapiens
aatttccattcctaa

SEQ ID NO: 421998 - DNA, 15 bp, Homo sapiens
atttccattcctaaa

SEQ ID NO: 421999 - DNA, 15 bp, Homo sapiens
tttccattcctaaaa

SEQ ID NO: 422000 - DNA, 15 bp, Homo sapiens
ttccattcctaaaaa

SEQ ID NO: 422001 - DNA, 15 bp, Homo sapiens
tccattcctaaaaaa

SEQ ID NO: 422002 - DNA, 15 bp, Homo sapiens
ccattcctaaaaaag

SEQ ID NO: 422003 - DNA, 15 bp, Homo sapiens
cattcctaaaaaagt

SEQ ID NO: 422004 - DNA, 15 bp, Homo sapiens
attcctaaaaaagtt

SEQ ID NO: 422005 - DNA, 15 bp, Homo sapiens
ttcctaaaaaagtta

SEQ ID NO: 422006 - DNA, 15 bp, Homo sapiens
tcctaaaaaagttaa

SEQ ID NO: 422007 - DNA, 15 bp, Homo sapiens
cctaaaaaagttaat

SEQ ID NO: 422008 - DNA, 15 bp, Homo sapiens
ctaaaaaagttaatc

SEQ ID NO: 422009 - DNA, 15 bp, Homo sapiens
taaaaaagttaatca

SEQ ID NO: 422010 - DNA, 15 bp, Homo sapiens
aaaaaagttaatcaa

SEQ ID NO: 422011 - DNA, 15 bp, Homo sapiens
aaaaagttaatcaag

SEQ ID NO: 422012 - DNA, 15 bp, Homo sapiens
aaaagttaatcaaga

SEQ ID NO: 422013 - DNA, 15 bp, Homo sapiens
aaagttaatcaagac

SEQ ID NO: 422014 - DNA, 15 bp, Homo sapiens
aagttaatcaagacc

SEQ ID NO: 422015 - DNA, 15 bp, Homo sapiens
agttaatcaagacca

SEQ ID NO: 422016 - DNA, 15 bp, Homo sapiens
gttaatcaagaccag

SEQ ID NO: 422017 - DNA, 15 bp, Homo sapiens
ttaatcaagaccagg

SEQ ID NO: 422018 - DNA, 15 bp, Homo sapiens
taatcaagaccaggc

SEQ ID NO: 422019 - DNA, 15 bp, Homo sapiens
aatcaagaccaggcg

SEQ ID NO: 422020 - DNA, 15 bp, Homo sapiens
atcaagaccaggcgc

SEQ ID NO: 422021 - DNA, 15 bp, Homo sapiens
tcaagaccaggcgcg

SEQ ID NO: 422022 - DNA, 15 bp, Homo sapiens
caagaccaggcgcgg

SEQ ID NO: 422023 - DNA, 15 bp, Homo sapiens
aagaccaggcgcggt

SEQ ID NO: 422024 - DNA, 15 bp, Homo sapiens
agaccaggcgcggtg

SEQ ID NO: 422025 - DNA, 15 bp, Homo sapiens
gaccaggcgcggtgg

SEQ ID NO: 422026 - DNA, 15 bp, Homo sapiens
accaggcgcggtggc

SEQ ID NO: 422027 - DNA, 15 bp, Homo sapiens
gcgcggtggctcaca

SEQ ID NO: 422028 - DNA, 15 bp, Homo sapiens
cgcggtggctcacac

SEQ ID NO: 422029 - DNA, 15 bp, Homo sapiens
gcggtggctcacacc

SEQ ID NO: 422030 - DNA, 15 bp, Homo sapiens
cggtggctcacacct

SEQ ID NO: 422031 - DNA, 15 bp, Homo sapiens
cagcactttgggagt

SEQ ID NO: 422032 - DNA, 15 bp, Homo sapiens
agcactttgggagtc

SEQ ID NO: 422033 - DNA, 15 bp, Homo sapiens
gcactttgggagtcc

SEQ ID NO: 422034 - DNA, 15 bp, Homo sapiens
cactttgggagtccc

SEQ ID NO: 422035 - DNA, 15 bp, Homo sapiens
actttgggagtccct

SEQ ID NO: 422036 - DNA, 15 bp, Homo sapiens
ctttgggagtccctg

SEQ ID NO: 422037 - DNA, 15 bp, Homo sapiens
tttgggagtccctgg

SEQ ID NO: 422038 - DNA, 15 bp, Homo sapiens
ttgggagtccctggc

SEQ ID NO: 422039 - DNA, 15 bp, Homo sapiens
tgggagtccctggcc

SEQ ID NO: 422040 - DNA, 15 bp, Homo sapiens
gggagtccctggccg

SEQ ID NO: 422041 - DNA, 15 bp, Homo sapiens
ggagtccctggccgg

SEQ ID NO: 422042 - DNA, 15 bp, Homo sapiens
gagtccctggccggt

SEQ ID NO: 422043 - DNA, 15 bp, Homo sapiens
agtccctggccggtg

SEQ ID NO: 422044 - DNA, 15 bp, Homo sapiens
gtccctggccggtgg

SEQ ID NO: 422045 - DNA, 15 bp, Homo sapiens
tccctggccggtgga

SEQ ID NO: 422046 - DNA, 15 bp, Homo sapiens
ccctggccggtggat

SEQ ID NO: 422047 - DNA, 15 bp, Homo sapiens
cctggccggtggatc

SEQ ID NO: 422048 - DNA, 15 bp, Homo sapiens
ctggccggtggatca

SEQ ID NO: 422049 - DNA, 15 bp, Homo sapiens
tggccggtggatcat

SEQ ID NO: 422050 - DNA, 15 bp, Homo sapiens
ggccggtggatcatg

SEQ ID NO: 422051 - DNA, 15 bp, Homo sapiens
gccggtggatcatga

SEQ ID NO: 422052 - DNA, 15 bp, Homo sapiens
ccggtggatcatgag

SEQ ID NO: 422053 - DNA, 15 bp, Homo sapiens
cggtggatcatgagg

SEQ ID NO: 422054 - DNA, 15 bp, Homo sapiens
catgaggtcaggagt

SEQ ID NO: 422055 - DNA, 15 bp, Homo sapiens
atgaggtcaggagtt

SEQ ID NO: 422056 - DNA, 15 bp, Homo sapiens
gaggtcaggagtttc

SEQ ID NO: 422057 - DNA, 15 bp, Homo sapiens
aggtcaggagtttca

SEQ ID NO: 422058 - DNA, 15 bp, Homo sapiens
ggtcaggagtttcag

SEQ ID NO: 422059 - DNA, 15 bp, Homo sapiens
gtcaggagtttcaga

SEQ ID NO: 422060 - DNA, 15 bp, Homo sapiens
tcaggagtttcagac

SEQ ID NO: 422061 - DNA, 15 bp, Homo sapiens
caggagtttcagacc

SEQ ID NO: 422062 - DNA, 15 bp, Homo sapiens
aggagtttcagacca

SEQ ID NO: 422063 - DNA, 15 bp, Homo sapiens
ggagtttcagaccag

SEQ ID NO: 422064 - DNA, 15 bp, Homo sapiens
gagtttcagaccagg

SEQ ID NO: 422065 - DNA, 15 bp, Homo sapiens
agtttcagaccaggc

SEQ ID NO: 422066 - DNA, 15 bp, Homo sapiens
gtttcagaccaggct

SEQ ID NO: 422067 - DNA, 15 bp, Homo sapiens
tttcagaccaggctg

SEQ ID NO: 422068 - DNA, 15 bp, Homo sapiens
ttcagaccaggctga

SEQ ID NO: 422069 - DNA, 15 bp, Homo sapiens
tcagaccaggctgaa

SEQ ID NO: 422070 - DNA, 15 bp, Homo sapiens
cagaccaggctgaac

SEQ ID NO: 422071 - DNA, 15 bp, Homo sapiens
agaccaggctgaaca

SEQ ID NO: 422072 - DNA, 15 bp, Homo sapiens
gaccaggctgaacaa

SEQ ID NO: 422073 - DNA, 15 bp, Homo sapiens
accaggctgaacaac

SEQ ID NO: 422074 - DNA, 15 bp, Homo sapiens
ccaggctgaacaaca

SEQ ID NO: 422075 - DNA, 15 bp, Homo sapiens
caggctgaacaacat

SEQ ID NO: 422076 - DNA, 15 bp, Homo sapiens
aggctgaacaacatg

SEQ ID NO: 422077 - DNA, 15 bp, Homo sapiens
ggctgaacaacatgg

SEQ ID NO: 422078 - DNA, 15 bp, Homo sapiens
gctgaacaacatggt

SEQ ID NO: 422079 - DNA, 15 bp, Homo sapiens
ctgaacaacatggtg

SEQ ID NO: 422080 - DNA, 15 bp, Homo sapiens
tgaacaacatggtga

SEQ ID NO: 422081 - DNA, 15 bp, Homo sapiens
gaacaacatggtgaa

SEQ ID NO: 422082 - DNA, 15 bp, Homo sapiens
aacaacatggtgaaa

SEQ ID NO: 422083 - DNA, 15 bp, Homo sapiens
acaacatggtgaaat

SEQ ID NO: 422084 - DNA, 15 bp, Homo sapiens
aaatacgaaaattaa

SEQ ID NO: 422085 - DNA, 15 bp, Homo sapiens
aatacgaaaattaac

SEQ ID NO: 422086 - DNA, 15 bp, Homo sapiens
atacgaaaattaacc

SEQ ID NO: 422087 - DNA, 15 bp, Homo sapiens
tacgaaaattaaccg

SEQ ID NO: 422088 - DNA, 15 bp, Homo sapiens
acgaaaattaaccgg

SEQ ID NO: 422089 - DNA, 15 bp, Homo sapiens
cgaaaattaaccggg

SEQ ID NO: 422090 - DNA, 15 bp, Homo sapiens
gaaaattaaccgggc

SEQ ID NO: 422091 - DNA, 15 bp, Homo sapiens
aaaattaaccgggca

SEQ ID NO: 422092 - DNA, 15 bp, Homo sapiens
aaattaaccgggcat

SEQ ID NO: 422093 - DNA, 15 bp, Homo sapiens
aattaaccgggcatg

SEQ ID NO: 422094 - DNA, 15 bp, Homo sapiens
attaaccgggcatgg

SEQ ID NO: 422095 - DNA, 15 bp, Homo sapiens
ttaaccgggcatggt

SEQ ID NO: 422096 - DNA, 15 bp, Homo sapiens
taaccgggcatggtg

SEQ ID NO: 422097 - DNA, 15 bp, Homo sapiens
aaccgggcatggtgg

SEQ ID NO: 422098 - DNA, 15 bp, Homo sapiens
accgggcatggtggc

SEQ ID NO: 422099 - DNA, 15 bp, Homo sapiens
cgggcatggtggcac

SEQ ID NO: 422100 - DNA, 15 bp, Homo sapiens
cacatgcctgtaatt

SEQ ID NO: 422101 - DNA, 15 bp, Homo sapiens
acatgcctgtaattc

SEQ ID NO: 422102 - DNA, 15 bp, Homo sapiens
catgcctgtaattcc

SEQ ID NO: 422103 - DNA, 15 bp, Homo sapiens
atgcctgtaattcca

SEQ ID NO: 422104 - DNA, 15 bp, Homo sapiens
tgcctgtaattccag

SEQ ID NO: 422105 - DNA, 15 bp, Homo sapiens
gcctgtaattccagc

SEQ ID NO: 422106 - DNA, 15 bp, Homo sapiens
cctgtaattccagct

SEQ ID NO: 422107 - DNA, 15 bp, Homo sapiens
ctgtaattccagctg

SEQ ID NO: 422108 - DNA, 15 bp, Homo sapiens
tgtaattccagctgt

SEQ ID NO: 422109 - DNA, 15 bp, Homo sapiens
gtaattccagctgta

SEQ ID NO: 422110 - DNA, 15 bp, Homo sapiens
taattccagctgtat

SEQ ID NO: 422111 - DNA, 15 bp, Homo sapiens
aattccagctgtatt

SEQ ID NO: 422112 - DNA, 15 bp, Homo sapiens
attccagctgtattc

SEQ ID NO: 422113 - DNA, 15 bp, Homo sapiens
ttccagctgtattca

SEQ ID NO: 422114 - DNA, 15 bp, Homo sapiens
tccagctgtattcag

SEQ ID NO: 422115 - DNA, 15 bp, Homo sapiens
ccagctgtattcagg

SEQ ID NO: 422116 - DNA, 15 bp, Homo sapiens
cagctgtattcagga

SEQ ID NO: 422117 - DNA, 15 bp, Homo sapiens
agctgtattcaggag

SEQ ID NO: 422118 - DNA, 15 bp, Homo sapiens
gctgtattcaggagg

SEQ ID NO: 422119 - DNA, 15 bp, Homo sapiens
ctgtattcaggaggc

SEQ ID NO: 422120 - DNA, 15 bp, Homo sapiens
tgtattcaggaggct

SEQ ID NO: 422121 - DNA, 15 bp, Homo sapiens
gtattcaggaggctg

SEQ ID NO: 422122 - DNA, 15 bp, Homo sapiens
tattcaggaggctga

SEQ ID NO: 422123 - DNA, 15 bp, Homo sapiens
attcaggaggctgag

SEQ ID NO: 422124 - DNA, 15 bp, Homo sapiens
ttcaggaggctgagg

SEQ ID NO: 422125 - DNA, 15 bp, Homo sapiens
ggaggctgaggcagc

SEQ ID NO: 422126 - DNA, 15 bp, Homo sapiens
gaggctgaggcagca

SEQ ID NO: 422127 - DNA, 15 bp, Homo sapiens
aggctgaggcagcag

SEQ ID NO: 422128 - DNA, 15 bp, Homo sapiens
ggctgaggcagcaga

SEQ ID NO: 422129 - DNA, 15 bp, Homo sapiens
gctgaggcagcagaa

SEQ ID NO: 422130 - DNA, 15 bp, Homo sapiens
ctgaggcagcagaat

SEQ ID NO: 422131 - DNA, 15 bp, Homo sapiens
tgaggcagcagaata

SEQ ID NO: 422132 - DNA, 15 bp, Homo sapiens
gaggcagcagaatag

SEQ ID NO: 422133 - DNA, 15 bp, Homo sapiens
aggcagcagaatagt

SEQ ID NO: 422134 - DNA, 15 bp, Homo sapiens
ggcagcagaatagtt

SEQ ID NO: 422135 - DNA, 15 bp, Homo sapiens
gcagcagaatagttt

SEQ ID NO: 422136 - DNA, 15 bp, Homo sapiens
cagcagaatagtttg

SEQ ID NO: 422137 - DNA, 15 bp, Homo sapiens
agcagaatagtttga

SEQ ID NO: 422138 - DNA, 15 bp, Homo sapiens
gcagaatagtttgaa

SEQ ID NO: 422139 - DNA, 15 bp, Homo sapiens
cagaatagtttgaac

SEQ ID NO: 422140 - DNA, 15 bp, Homo sapiens
agaatagtttgaacc

SEQ ID NO: 422141 - DNA, 15 bp, Homo sapiens
gaatagtttgaaccc

SEQ ID NO: 422142 - DNA, 15 bp, Homo sapiens
aatagtttgaaccca

SEQ ID NO: 422143 - DNA, 15 bp, Homo sapiens
atagtttgaacccag

SEQ ID NO: 422144 - DNA, 15 bp, Homo sapiens
tagtttgaacccagg

SEQ ID NO: 422145 - DNA, 15 bp, Homo sapiens
agtttgaacccagga

SEQ ID NO: 422146 - DNA, 15 bp, Homo sapiens
gtttgaacccaggag

SEQ ID NO: 422147 - DNA, 15 bp, Homo sapiens
tttgaacccaggagg

SEQ ID NO: 422148 - DNA, 15 bp, Homo sapiens
caggaggcagaggtc

SEQ ID NO: 422149 - DNA, 15 bp, Homo sapiens
aggaggcagaggtcg

SEQ ID NO: 422150 - DNA, 15 bp, Homo sapiens
ggaggcagaggtcgc

SEQ ID NO: 422151 - DNA, 15 bp, Homo sapiens
gaggcagaggtcgca

SEQ ID NO: 422152 - DNA, 15 bp, Homo sapiens
aggcagaggtcgcag

SEQ ID NO: 422153 - DNA, 15 bp, Homo sapiens
ggcagaggtcgcagt

SEQ ID NO: 422154 - DNA, 15 bp, Homo sapiens
gcagaggtcgcagtg

SEQ ID NO: 422155 - DNA, 15 bp, Homo sapiens
cagaggtcgcagtga

SEQ ID NO: 422156 - DNA, 15 bp, Homo sapiens
agaggtcgcagtgag

SEQ ID NO: 422157 - DNA, 15 bp, Homo sapiens
gaggtcgcagtgagc

SEQ ID NO: 422158 - DNA, 15 bp, Homo sapiens
aggtcgcagtgagcc

SEQ ID NO: 422159 - DNA, 15 bp, Homo sapiens
ggtcgcagtgagccg

SEQ ID NO: 422160 - DNA, 15 bp, Homo sapiens
gtcgcagtgagccga

SEQ ID NO: 422161 - DNA, 15 bp, Homo sapiens
tcgcagtgagccgag

SEQ ID NO: 422162 - DNA, 15 bp, Homo sapiens
cgcagtgagccgaga

SEQ ID NO: 422163 - DNA, 15 bp, Homo sapiens
gacagagcaatactc

SEQ ID NO: 422164 - DNA, 15 bp, Homo sapiens
acagagcaatactct

SEQ ID NO: 422165 - DNA, 15 bp, Homo sapiens
cagagcaatactctg

SEQ ID NO: 422166 - DNA, 15 bp, Homo sapiens
agagcaatactctgt

SEQ ID NO: 422167 - DNA, 15 bp, Homo sapiens
gagcaatactctgtc

SEQ ID NO: 422168 - DNA, 15 bp, Homo sapiens
agcaatactctgtct

SEQ ID NO: 422169 - DNA, 15 bp, Homo sapiens
gcaatactctgtctc

SEQ ID NO: 422170 - DNA, 15 bp, Homo sapiens
caatactctgtctca

SEQ ID NO: 422171 - DNA, 15 bp, Homo sapiens
aatactctgtctcaa

SEQ ID NO: 422172 - DNA, 15 bp, Homo sapiens
atactctgtctcaaa

SEQ ID NO: 422173 - DNA, 15 bp, Homo sapiens
tactctgtctcaaaa

SEQ ID NO: 422174 - DNA, 15 bp, Homo sapiens
ctcaaaaaaaaaaat

SEQ ID NO: 422175 - DNA, 15 bp, Homo sapiens
tcaaaaaaaaaaata

SEQ ID NO: 422176 - DNA, 15 bp, Homo sapiens
caaaaaaaaaaataa

SEQ ID NO: 422177 - DNA, 15 bp, Homo sapiens
aaaaaaaaaaataat

SEQ ID NO: 422178 - DNA, 15 bp, Homo sapiens
aaaaaaataataata

SEQ ID NO: 422179 - DNA, 15 bp, Homo sapiens
aataataataattag

SEQ ID NO: 422180 - DNA, 15 bp, Homo sapiens
ataataataattagt

SEQ ID NO: 422181 - DNA, 15 bp, Homo sapiens
taataataattagtc

SEQ ID NO: 422182 - DNA, 15 bp, Homo sapiens
aataataattagtca

SEQ ID NO: 422183 - DNA, 15 bp, Homo sapiens
ataataattagtcag

SEQ ID NO: 422184 - DNA, 15 bp, Homo sapiens
taataattagtcagt

SEQ ID NO: 422185 - DNA, 15 bp, Homo sapiens
aataattagtcagtg

SEQ ID NO: 422186 - DNA, 15 bp, Homo sapiens
ataattagtcagtgg

SEQ ID NO: 422187 - DNA, 15 bp, Homo sapiens
taattagtcagtggt

SEQ ID NO: 422188 - DNA, 15 bp, Homo sapiens
aattagtcagtggtt

SEQ ID NO: 422189 - DNA, 15 bp, Homo sapiens
attagtcagtggttt

SEQ ID NO: 422190 - DNA, 15 bp, Homo sapiens
ttagtcagtggtttt

SEQ ID NO: 422191 - DNA, 15 bp, Homo sapiens
tagtcagtggttttt

SEQ ID NO: 422192 - DNA, 15 bp, Homo sapiens
agtcagtggtttttt

SEQ ID NO: 422193 - DNA, 15 bp, Homo sapiens
gtcagtggttttttt

SEQ ID NO: 422194 - DNA, 15 bp, Homo sapiens
tcagtggtttttttt

SEQ ID NO: 422195 - DNA, 15 bp, Homo sapiens
cagtggttttttttt

SEQ ID NO: 422196 - DNA, 15 bp, Homo sapiens
agtggtttttttttt

SEQ ID NO: 422197 - DNA, 15 bp, Homo sapiens
tttttttttttggaa

SEQ ID NO: 422198 - DNA, 15 bp, Homo sapiens
ttttttttttggaaa

SEQ ID NO: 422199 - DNA, 15 bp, Homo sapiens
tttttttttggaaag

SEQ ID NO: 422200 - DNA, 15 bp, Homo sapiens
ttttttttggaaaga

SEQ ID NO: 422201 - DNA, 15 bp, Homo sapiens
tttttttggaaagaa

SEQ ID NO: 422202 - DNA, 15 bp, Homo sapiens
ttttttggaaagaaa

SEQ ID NO: 422203 - DNA, 15 bp, Homo sapiens
tttttggaaagaaaa

SEQ ID NO: 422204 - DNA, 15 bp, Homo sapiens
ttttggaaagaaaaa

SEQ ID NO: 422205 - DNA, 15 bp, Homo sapiens
tttggaaagaaaaat

SEQ ID NO: 422206 - DNA, 15 bp, Homo sapiens
ttggaaagaaaaata

SEQ ID NO: 422207 - DNA, 15 bp, Homo sapiens
tggaaagaaaaatac

SEQ ID NO: 422208 - DNA, 15 bp, Homo sapiens
ggaaagaaaaatact

SEQ ID NO: 422209 - DNA, 15 bp, Homo sapiens
gaaagaaaaatacta

SEQ ID NO: 422210 - DNA, 15 bp, Homo sapiens
aaagaaaaatactat

SEQ ID NO: 422211 - DNA, 15 bp, Homo sapiens
aagaaaaatactatg

SEQ ID NO: 422212 - DNA, 15 bp, Homo sapiens
agaaaaatactatga

SEQ ID NO: 422213 - DNA, 15 bp, Homo sapiens
gaaaaatactatgag

SEQ ID NO: 422214 - DNA, 15 bp, Homo sapiens
aaaaatactatgagt

SEQ ID NO: 422215 - DNA, 15 bp, Homo sapiens
aaaatactatgagtc

SEQ ID NO: 422216 - DNA, 15 bp, Homo sapiens
aaatactatgagtct

SEQ ID NO: 422217 - DNA, 15 bp, Homo sapiens
aatactatgagtctg

SEQ ID NO: 422218 - DNA, 15 bp, Homo sapiens
atactatgagtctgt

SEQ ID NO: 422219 - DNA, 15 bp, Homo sapiens
tactatgagtctgtt

SEQ ID NO: 422220 - DNA, 15 bp, Homo sapiens
actatgagtctgttg

SEQ ID NO: 422221 - DNA, 15 bp, Homo sapiens
ctatgagtctgttgt

SEQ ID NO: 422222 - DNA, 15 bp, Homo sapiens
tatgagtctgttgta

SEQ ID NO: 422223 - DNA, 15 bp, Homo sapiens
atgagtctgttgtaa

SEQ ID NO: 422224 - DNA, 15 bp, Homo sapiens
tgagtctgttgtaaa

SEQ ID NO: 422225 - DNA, 15 bp, Homo sapiens
gagtctgttgtaaat

SEQ ID NO: 422226 - DNA, 15 bp, Homo sapiens
agtctgttgtaaatc

SEQ ID NO: 422227 - DNA, 15 bp, Homo sapiens
gtctgttgtaaatcc

SEQ ID NO: 422228 - DNA, 15 bp, Homo sapiens
tctgttgtaaatcct

SEQ ID NO: 422229 - DNA, 15 bp, Homo sapiens
ctgttgtaaatcctt

SEQ ID NO: 422230 - DNA, 15 bp, Homo sapiens
tgttgtaaatcctta

SEQ ID NO: 422231 - DNA, 15 bp, Homo sapiens
gttgtaaatccttaa

SEQ ID NO: 422232 - DNA, 15 bp, Homo sapiens
ttgtaaatccttaaa

SEQ ID NO: 422233 - DNA, 15 bp, Homo sapiens
tgtaaatccttaaat

SEQ ID NO: 422234 - DNA, 15 bp, Homo sapiens
gtaaatccttaaatg

SEQ ID NO: 422235 - DNA, 15 bp, Homo sapiens
taaatccttaaatgg

SEQ ID NO: 422236 - DNA, 15 bp, Homo sapiens
aaatccttaaatggc

SEQ ID NO: 422237 - DNA, 15 bp, Homo sapiens
aatccttaaatggcg

SEQ ID NO: 422238 - DNA, 15 bp, Homo sapiens
atccttaaatggcgt

SEQ ID NO: 422239 - DNA, 15 bp, Homo sapiens
tccttaaatggcgta

SEQ ID NO: 422240 - DNA, 15 bp, Homo sapiens
ccttaaatggcgtaa

SEQ ID NO: 422241 - DNA, 15 bp, Homo sapiens
cttaaatggcgtaaa

SEQ ID NO: 422242 - DNA, 15 bp, Homo sapiens
ttaaatggcgtaaaa

SEQ ID NO: 422243 - DNA, 15 bp, Homo sapiens
taaatggcgtaaaaa

SEQ ID NO: 422244 - DNA, 15 bp, Homo sapiens
aaatggcgtaaaaat

SEQ ID NO: 422245 - DNA, 15 bp, Homo sapiens
aatggcgtaaaaata

SEQ ID NO: 422246 - DNA, 15 bp, Homo sapiens
atggcgtaaaaatag

SEQ ID NO: 422247 - DNA, 15 bp, Homo sapiens
tggcgtaaaaatagc

SEQ ID NO: 422248 - DNA, 15 bp, Homo sapiens
ggcgtaaaaatagct

SEQ ID NO: 422249 - DNA, 15 bp, Homo sapiens
gcgtaaaaatagcta

SEQ ID NO: 422250 - DNA, 15 bp, Homo sapiens
cgtaaaaatagctaa

SEQ ID NO: 422251 - DNA, 15 bp, Homo sapiens
gtaaaaatagctaaa

SEQ ID NO: 422252 - DNA, 15 bp, Homo sapiens
taaaaatagctaaaa

SEQ ID NO: 422253 - DNA, 15 bp, Homo sapiens
aaaaatagctaaaat

SEQ ID NO: 422254 - DNA, 15 bp, Homo sapiens
aaaatagctaaaatt

SEQ ID NO: 422255 - DNA, 15 bp, Homo sapiens
aaatagctaaaatta

SEQ ID NO: 422256 - DNA, 15 bp, Homo sapiens
aatagctaaaattag

SEQ ID NO: 422257 - DNA, 15 bp, Homo sapiens
atagctaaaattagg

SEQ ID NO: 422258 - DNA, 15 bp, Homo sapiens
tagctaaaattaggt

SEQ ID NO: 422259 - DNA, 15 bp, Homo sapiens
agctaaaattaggta

SEQ ID NO: 422260 - DNA, 15 bp, Homo sapiens
gctaaaattaggtat

SEQ ID NO: 422261 - DNA, 15 bp, Homo sapiens
ctaaaattaggtatt

SEQ ID NO: 422262 - DNA, 15 bp, Homo sapiens
taaaattaggtattt

SEQ ID NO: 422263 - DNA, 15 bp, Homo sapiens
aaaattaggtattta

SEQ ID NO: 422264 - DNA, 15 bp, Homo sapiens
aaattaggtatttac

SEQ ID NO: 422265 - DNA, 15 bp, Homo sapiens
aattaggtatttact

SEQ ID NO: 422266 - DNA, 15 bp, Homo sapiens
attaggtatttactg

SEQ ID NO: 422267 - DNA, 15 bp, Homo sapiens
ttaggtatttactgt

SEQ ID NO: 422268 - DNA, 15 bp, Homo sapiens
taggtatttactgtg

SEQ ID NO: 422269 - DNA, 15 bp, Homo sapiens
aggtatttactgtgc

SEQ ID NO: 422270 - DNA, 15 bp, Homo sapiens
ggtatttactgtgct

SEQ ID NO: 422271 - DNA, 15 bp, Homo sapiens
gtatttactgtgctc

SEQ ID NO: 422272 - DNA, 15 bp, Homo sapiens
tatttactgtgctct

SEQ ID NO: 422273 - DNA, 15 bp, Homo sapiens
atttactgtgctctt

SEQ ID NO: 422274 - DNA, 15 bp, Homo sapiens
tttactgtgctctta

SEQ ID NO: 422275 - DNA, 15 bp, Homo sapiens
ttactgtgctcttag

SEQ ID NO: 422276 - DNA, 15 bp, Homo sapiens
tactgtgctcttagt

SEQ ID NO: 422277 - DNA, 15 bp, Homo sapiens
actgtgctcttagtg

SEQ ID NO: 422278 - DNA, 15 bp, Homo sapiens
ctgtgctcttagtgg

SEQ ID NO: 422279 - DNA, 15 bp, Homo sapiens
tgtgctcttagtggt

SEQ ID NO: 422280 - DNA, 15 bp, Homo sapiens
gtgctcttagtggtt

SEQ ID NO: 422281 - DNA, 15 bp, Homo sapiens
tgctcttagtggtta

SEQ ID NO: 422282 - DNA, 15 bp, Homo sapiens
gctcttagtggttat

SEQ ID NO: 422283 - DNA, 15 bp, Homo sapiens
ctcttagtggttatt

SEQ ID NO: 422284 - DNA, 15 bp, Homo sapiens
tcttagtggttattt

SEQ ID NO: 422285 - DNA, 15 bp, Homo sapiens
cttagtggttatttt

SEQ ID NO: 422286 - DNA, 15 bp, Homo sapiens
ttagtggttattttc

SEQ ID NO: 422287 - DNA, 15 bp, Homo sapiens
tagtggttattttcc

SEQ ID NO: 422288 - DNA, 15 bp, Homo sapiens
agtggttattttcct

SEQ ID NO: 422289 - DNA, 15 bp, Homo sapiens
gtggttattttcctc

SEQ ID NO: 422290 - DNA, 15 bp, Homo sapiens
tggttattttcctct

SEQ ID NO: 422291 - DNA, 15 bp, Homo sapiens
ggttattttcctctc

SEQ ID NO: 422292 - DNA, 15 bp, Homo sapiens
gttattttcctctct

SEQ ID NO: 422293 - DNA, 15 bp, Homo sapiens
ttattttcctctctc

SEQ ID NO: 422294 - DNA, 15 bp, Homo sapiens
tattttcctctctct

SEQ ID NO: 422295 - DNA, 15 bp, Homo sapiens
attttcctctctctc

SEQ ID NO: 422296 - DNA, 15 bp, Homo sapiens
ttttcctctctctct

SEQ ID NO: 422297 - DNA, 15 bp, Homo sapiens
tttcctctctctctc

SEQ ID NO: 422298 - DNA, 15 bp, Homo sapiens
ttcctctctctctct

SEQ ID NO: 422299 - DNA, 15 bp, Homo sapiens
tcctctctctctctc

SEQ ID NO: 422300 - DNA, 15 bp, Homo sapiens
cctctctctctctcc

SEQ ID NO: 422301 - DNA, 15 bp, Homo sapiens
ctctctctctctcca

SEQ ID NO: 422302 - DNA, 15 bp, Homo sapiens
tctctctctctccat

SEQ ID NO: 422303 - DNA, 15 bp, Homo sapiens
ctctctctctccatg

SEQ ID NO: 422304 - DNA, 15 bp, Homo sapiens
tctctctctccatgt

SEQ ID NO: 422305 - DNA, 15 bp, Homo sapiens
ctctctctccatgta

SEQ ID NO: 422306 - DNA, 15 bp, Homo sapiens
tctctctccatgtat

SEQ ID NO: 422307 - DNA, 15 bp, Homo sapiens
ctctctccatgtata

SEQ ID NO: 422308 - DNA, 15 bp, Homo sapiens
tctctccatgtatag

SEQ ID NO: 422309 - DNA, 15 bp, Homo sapiens
ctctccatgtataga

SEQ ID NO: 422310 - DNA, 15 bp, Homo sapiens
tctccatgtatagag

SEQ ID NO: 422311 - DNA, 15 bp, Homo sapiens
ctccatgtatagaga

SEQ ID NO: 422312 - DNA, 15 bp, Homo sapiens
tccatgtatagagat

SEQ ID NO: 422313 - DNA, 15 bp, Homo sapiens
ccatgtatagagata

SEQ ID NO: 422314 - DNA, 15 bp, Homo sapiens
catgtatagagataa

SEQ ID NO: 422315 - DNA, 15 bp, Homo sapiens
atgtatagagataaa

SEQ ID NO: 422316 - DNA, 15 bp, Homo sapiens
tgtatagagataaaa

SEQ ID NO: 422317 - DNA, 15 bp, Homo sapiens
gtatagagataaaat

SEQ ID NO: 422318 - DNA, 15 bp, Homo sapiens
tatagagataaaatg

SEQ ID NO: 422319 - DNA, 15 bp, Homo sapiens
atagagataaaatga

SEQ ID NO: 422320 - DNA, 15 bp, Homo sapiens
tagagataaaatgag

SEQ ID NO: 422321 - DNA, 15 bp, Homo sapiens
agagataaaatgaga

SEQ ID NO: 422322 - DNA, 15 bp, Homo sapiens
gagataaaatgagaa

SEQ ID NO: 422323 - DNA, 15 bp, Homo sapiens
agataaaatgagaaa

SEQ ID NO: 422324 - DNA, 15 bp, Homo sapiens
gataaaatgagaaaa

SEQ ID NO: 422325 - DNA, 15 bp, Homo sapiens
ataaaatgagaaaaa

SEQ ID NO: 422326 - DNA, 15 bp, Homo sapiens
taaaatgagaaaaaa

SEQ ID NO: 422327 - DNA, 15 bp, Homo sapiens
aaaatgagaaaaaaa

SEQ ID NO: 422328 - DNA, 15 bp, Homo sapiens
aaatgagaaaaaaat

SEQ ID NO: 422329 - DNA, 15 bp, Homo sapiens
aatgagaaaaaaata

SEQ ID NO: 422330 - DNA, 15 bp, Homo sapiens
atgagaaaaaaatat

SEQ ID NO: 422331 - DNA, 15 bp, Homo sapiens
tgagaaaaaaatata

SEQ ID NO: 422332 - DNA, 15 bp, Homo sapiens
gagaaaaaaatatat

SEQ ID NO: 422333 - DNA, 15 bp, Homo sapiens
agaaaaaaatatatt

SEQ ID NO: 422334 - DNA, 15 bp, Homo sapiens
gaaaaaaatatattt

SEQ ID NO: 422335 - DNA, 15 bp, Homo sapiens
aaaaaaatatatttg

SEQ ID NO: 422336 - DNA, 15 bp, Homo sapiens
aaaaaatatatttgg

SEQ ID NO: 422337 - DNA, 15 bp, Homo sapiens
aaaaatatatttgga

SEQ ID NO: 422338 - DNA, 15 bp, Homo sapiens
aaaatatatttggat

SEQ ID NO: 422339 - DNA, 15 bp, Homo sapiens
aaatatatttggatg

SEQ ID NO: 422340 - DNA, 15 bp, Homo sapiens
aatatatttggatgt

SEQ ID NO: 422341 - DNA, 15 bp, Homo sapiens
atatatttggatgtg

SEQ ID NO: 422342 - DNA, 15 bp, Homo sapiens
tatatttggatgtgc

SEQ ID NO: 422343 - DNA, 15 bp, Homo sapiens
atatttggatgtgcg

SEQ ID NO: 422344 - DNA, 15 bp, Homo sapiens
tatttggatgtgcgt

SEQ ID NO: 422345 - DNA, 15 bp, Homo sapiens
atttggatgtgcgta

SEQ ID NO: 422346 - DNA, 15 bp, Homo sapiens
tttggatgtgcgtat

SEQ ID NO: 422347 - DNA, 15 bp, Homo sapiens
ttggatgtgcgtata

SEQ ID NO: 422348 - DNA, 15 bp, Homo sapiens
tggatgtgcgtatat

SEQ ID NO: 422349 - DNA, 15 bp, Homo sapiens
ggatgtgcgtatata

SEQ ID NO: 422350 - DNA, 15 bp, Homo sapiens
gatgtgcgtatatac

SEQ ID NO: 422351 - DNA, 15 bp, Homo sapiens
atgtgcgtatatact

SEQ ID NO: 422352 - DNA, 15 bp, Homo sapiens
tgtgcgtatatacta

SEQ ID NO: 422353 - DNA, 15 bp, Homo sapiens
gtgcgtatatactat

SEQ ID NO: 422354 - DNA, 15 bp, Homo sapiens
tgcgtatatactata

SEQ ID NO: 422355 - DNA, 15 bp, Homo sapiens
gcgtatatactatac

SEQ ID NO: 422356 - DNA, 15 bp, Homo sapiens
cgtatatactataca

SEQ ID NO: 422357 - DNA, 15 bp, Homo sapiens
gtatatactatacat

SEQ ID NO: 422358 - DNA, 15 bp, Homo sapiens
tatatactatacata

SEQ ID NO: 422359 - DNA, 15 bp, Homo sapiens
atatactatacataa

SEQ ID NO: 422360 - DNA, 15 bp, Homo sapiens
tatactatacataaa

SEQ ID NO: 422361 - DNA, 15 bp, Homo sapiens
atactatacataaac

SEQ ID NO: 422362 - DNA, 15 bp, Homo sapiens
tactatacataaact

SEQ ID NO: 422363 - DNA, 15 bp, Homo sapiens
actatacataaacta

SEQ ID NO: 422364 - DNA, 15 bp, Homo sapiens
ctatacataaactat

SEQ ID NO: 422365 - DNA, 15 bp, Homo sapiens
tatacataaactatc

SEQ ID NO: 422366 - DNA, 15 bp, Homo sapiens
atacataaactatca

SEQ ID NO: 422367 - DNA, 15 bp, Homo sapiens
tacataaactatcaa

SEQ ID NO: 422368 - DNA, 15 bp, Homo sapiens
acataaactatcaaa

SEQ ID NO: 422369 - DNA, 15 bp, Homo sapiens
cataaactatcaaaa

SEQ ID NO: 422370 - DNA, 15 bp, Homo sapiens
ataaactatcaaaac

SEQ ID NO: 422371 - DNA, 15 bp, Homo sapiens
taaactatcaaaact

SEQ ID NO: 422372 - DNA, 15 bp, Homo sapiens
aaactatcaaaactt

SEQ ID NO: 422373 - DNA, 15 bp, Homo sapiens
aactatcaaaacttg

SEQ ID NO: 422374 - DNA, 15 bp, Homo sapiens
actatcaaaacttgg

SEQ ID NO: 422375 - DNA, 15 bp, Homo sapiens
ctatcaaaacttggt

SEQ ID NO: 422376 - DNA, 15 bp, Homo sapiens
tatcaaaacttggtt

SEQ ID NO: 422377 - DNA, 15 bp, Homo sapiens
atcaaaacttggttt

SEQ ID NO: 422378 - DNA, 15 bp, Homo sapiens
tcaaaacttggttta

SEQ ID NO: 422379 - DNA, 15 bp, Homo sapiens
caaaacttggtttat

SEQ ID NO: 422380 - DNA, 15 bp, Homo sapiens
aaaacttggtttata

SEQ ID NO: 422381 - DNA, 15 bp, Homo sapiens
aaacttggtttataa

SEQ ID NO: 422382 - DNA, 15 bp, Homo sapiens
aacttggtttataat

SEQ ID NO: 422383 - DNA, 15 bp, Homo sapiens
acttggtttataatt

SEQ ID NO: 422384 - DNA, 15 bp, Homo sapiens
cttggtttataattg

SEQ ID NO: 422385 - DNA, 15 bp, Homo sapiens
ttggtttataattgt

SEQ ID NO: 422386 - DNA, 15 bp, Homo sapiens
tggtttataattgta

SEQ ID NO: 422387 - DNA, 15 bp, Homo sapiens
ggtttataattgtac

SEQ ID NO: 422388 - DNA, 15 bp, Homo sapiens
gtttataattgtaca

SEQ ID NO: 422389 - DNA, 15 bp, Homo sapiens
tttataattgtacat

SEQ ID NO: 422390 - DNA, 15 bp, Homo sapiens
ttataattgtacatt

SEQ ID NO: 422391 - DNA, 15 bp, Homo sapiens
tataattgtacattc

SEQ ID NO: 422392 - DNA, 15 bp, Homo sapiens
ataattgtacattct

SEQ ID NO: 422393 - DNA, 15 bp, Homo sapiens
taattgtacattcta

SEQ ID NO: 422394 - DNA, 15 bp, Homo sapiens
aattgtacattctat

SEQ ID NO: 422395 - DNA, 15 bp, Homo sapiens
attgtacattctatc

SEQ ID NO: 422396 - DNA, 15 bp, Homo sapiens
ttgtacattctatca

SEQ ID NO: 422397 - DNA, 15 bp, Homo sapiens
tgtacattctatcac

SEQ ID NO: 422398 - DNA, 15 bp, Homo sapiens
gtacattctatcacg

SEQ ID NO: 422399 - DNA, 15 bp, Homo sapiens
tacattctatcacgg

SEQ ID NO: 422400 - DNA, 15 bp, Homo sapiens
acattctatcacgga

SEQ ID NO: 422401 - DNA, 15 bp, Homo sapiens
cattctatcacggac

SEQ ID NO: 422402 - DNA, 15 bp, Homo sapiens
attctatcacggaca

SEQ ID NO: 422403 - DNA, 15 bp, Homo sapiens
ttctatcacggacat

SEQ ID NO: 422404 - DNA, 15 bp, Homo sapiens
tctatcacggacatc

SEQ ID NO: 422405 - DNA, 15 bp, Homo sapiens
ctatcacggacatcc

SEQ ID NO: 422406 - DNA, 15 bp, Homo sapiens
tatcacggacatcct

SEQ ID NO: 422407 - DNA, 15 bp, Homo sapiens
atcacggacatcctt

SEQ ID NO: 422408 - DNA, 15 bp, Homo sapiens
tcacggacatccttc

SEQ ID NO: 422409 - DNA, 15 bp, Homo sapiens
cacggacatccttct

SEQ ID NO: 422410 - DNA, 15 bp, Homo sapiens
acggacatccttctt

SEQ ID NO: 422411 - DNA, 15 bp, Homo sapiens
cggacatccttcttg

SEQ ID NO: 422412 - DNA, 15 bp, Homo sapiens
ggacatccttcttga

SEQ ID NO: 422413 - DNA, 15 bp, Homo sapiens
gacatccttcttgaa

SEQ ID NO: 422414 - DNA, 15 bp, Homo sapiens
acatccttcttgaaa

SEQ ID NO: 422415 - DNA, 15 bp, Homo sapiens
catccttcttgaaag

SEQ ID NO: 422416 - DNA, 15 bp, Homo sapiens
atccttcttgaaagc

SEQ ID NO: 422417 - DNA, 15 bp, Homo sapiens
tccttcttgaaagcc

SEQ ID NO: 422418 - DNA, 15 bp, Homo sapiens
ccttcttgaaagcct

SEQ ID NO: 422419 - DNA, 15 bp, Homo sapiens
cttcttgaaagcctt

SEQ ID NO: 422420 - DNA, 15 bp, Homo sapiens
ttcttgaaagccttc

SEQ ID NO: 422421 - DNA, 15 bp, Homo sapiens
tcttgaaagccttcg

SEQ ID NO: 422422 - DNA, 15 bp, Homo sapiens
cttgaaagccttcgt

SEQ ID NO: 422423 - DNA, 15 bp, Homo sapiens
ttgaaagccttcgtt

SEQ ID NO: 422424 - DNA, 15 bp, Homo sapiens
tgaaagccttcgttt

SEQ ID NO: 422425 - DNA, 15 bp, Homo sapiens
gaaagccttcgtttt

SEQ ID NO: 422426 - DNA, 15 bp, Homo sapiens
aaagccttcgttttg

SEQ ID NO: 422427 - DNA, 15 bp, Homo sapiens
aagccttcgttttgt

SEQ ID NO: 422428 - DNA, 15 bp, Homo sapiens
agccttcgttttgta

SEQ ID NO: 422429 - DNA, 15 bp, Homo sapiens
gccttcgttttgtat

SEQ ID NO: 422430 - DNA, 15 bp, Homo sapiens
ccttcgttttgtata

SEQ ID NO: 422431 - DNA, 15 bp, Homo sapiens
cttcgttttgtatag

SEQ ID NO: 422432 - DNA, 15 bp, Homo sapiens
ttcgttttgtatagg

SEQ ID NO: 422433 - DNA, 15 bp, Homo sapiens
tcgttttgtataggt

SEQ ID NO: 422434 - DNA, 15 bp, Homo sapiens
cgttttgtataggtc

SEQ ID NO: 422435 - DNA, 15 bp, Homo sapiens
gttttgtataggtct

SEQ ID NO: 422436 - DNA, 15 bp, Homo sapiens
ttttgtataggtctg

SEQ ID NO: 422437 - DNA, 15 bp, Homo sapiens
tttgtataggtctgt

SEQ ID NO: 422438 - DNA, 15 bp, Homo sapiens
ttgtataggtctgtg

SEQ ID NO: 422439 - DNA, 15 bp, Homo sapiens
tgtataggtctgtgt

SEQ ID NO: 422440 - DNA, 15 bp, Homo sapiens
gtataggtctgtgtt

SEQ ID NO: 422441 - DNA, 15 bp, Homo sapiens
tataggtctgtgttt

SEQ ID NO: 422442 - DNA, 15 bp, Homo sapiens
ataggtctgtgtttt

SEQ ID NO: 422443 - DNA, 15 bp, Homo sapiens
taggtctgtgtttta

SEQ ID NO: 422444 - DNA, 15 bp, Homo sapiens
aggtctgtgttttaa

SEQ ID NO: 422445 - DNA, 15 bp, Homo sapiens
ggtctgtgttttaaa

SEQ ID NO: 422446 - DNA, 15 bp, Homo sapiens
gtctgtgttttaaat

SEQ ID NO: 422447 - DNA, 15 bp, Homo sapiens
tctgtgttttaaatt

SEQ ID NO: 422448 - DNA, 15 bp, Homo sapiens
ctgtgttttaaattt

SEQ ID NO: 422449 - DNA, 15 bp, Homo sapiens
tgtgttttaaatttt

SEQ ID NO: 422450 - DNA, 15 bp, Homo sapiens
gtgttttaaattttg

SEQ ID NO: 422451 - DNA, 15 bp, Homo sapiens
tgttttaaattttga

SEQ ID NO: 422452 - DNA, 15 bp, Homo sapiens
gttttaaattttgat

SEQ ID NO: 422453 - DNA, 15 bp, Homo sapiens
ttttaaattttgata

SEQ ID NO: 422454 - DNA, 15 bp, Homo sapiens
tttaaattttgatag

SEQ ID NO: 422455 - DNA, 15 bp, Homo sapiens
ttaaattttgatagt

SEQ ID NO: 422456 - DNA, 15 bp, Homo sapiens
taaattttgatagtt

SEQ ID NO: 422457 - DNA, 15 bp, Homo sapiens
aaattttgatagtta

SEQ ID NO: 422458 - DNA, 15 bp, Homo sapiens
aattttgatagttat

SEQ ID NO: 422459 - DNA, 15 bp, Homo sapiens
attttgatagttatt

SEQ ID NO: 422460 - DNA, 15 bp, Homo sapiens
ttttgatagttatta

SEQ ID NO: 422461 - DNA, 15 bp, Homo sapiens
tttgatagttattac

SEQ ID NO: 422462 - DNA, 15 bp, Homo sapiens
ttgatagttattacc

SEQ ID NO: 422463 - DNA, 15 bp, Homo sapiens
tgatagttattacca

SEQ ID NO: 422464 - DNA, 15 bp, Homo sapiens
gatagttattaccaa

SEQ ID NO: 422465 - DNA, 15 bp, Homo sapiens
atagttattaccaat

SEQ ID NO: 422466 - DNA, 15 bp, Homo sapiens
tagttattaccaata

SEQ ID NO: 422467 - DNA, 15 bp, Homo sapiens
agttattaccaataa

SEQ ID NO: 422468 - DNA, 15 bp, Homo sapiens
gttattaccaataaa

SEQ ID NO: 422469 - DNA, 15 bp, Homo sapiens
ttattaccaataaat

SEQ ID NO: 422470 - DNA, 15 bp, Homo sapiens
tattaccaataaatc

SEQ ID NO: 422471 - DNA, 15 bp, Homo sapiens
attaccaataaatcc

SEQ ID NO: 422472 - DNA, 15 bp, Homo sapiens
ttaccaataaatcct

SEQ ID NO: 422473 - DNA, 15 bp, Homo sapiens
taccaataaatcctc

SEQ ID NO: 422474 - DNA, 15 bp, Homo sapiens
accaataaatcctct

SEQ ID NO: 422475 - DNA, 15 bp, Homo sapiens
ccaataaatcctctg

SEQ ID NO: 422476 - DNA, 15 bp, Homo sapiens
caataaatcctctga

SEQ ID NO: 422477 - DNA, 15 bp, Homo sapiens
aataaatcctctgaa

SEQ ID NO: 422478 - DNA, 15 bp, Homo sapiens
ataaatcctctgaat

SEQ ID NO: 422479 - DNA, 15 bp, Homo sapiens
taaatcctctgaata

SEQ ID NO: 422480 - DNA, 15 bp, Homo sapiens
aaatcctctgaatat

SEQ ID NO: 422481 - DNA, 15 bp, Homo sapiens
aatcctctgaatatt

SEQ ID NO: 422482 - DNA, 15 bp, Homo sapiens
atcctctgaatatta

SEQ ID NO: 422483 - DNA, 15 bp, Homo sapiens
tcctctgaatattat

SEQ ID NO: 422484 - DNA, 15 bp, Homo sapiens
cctctgaatattata

SEQ ID NO: 422485 - DNA, 15 bp, Homo sapiens
ctctgaatattatag

SEQ ID NO: 422486 - DNA, 15 bp, Homo sapiens
tctgaatattatagc

SEQ ID NO: 422487 - DNA, 15 bp, Homo sapiens
ctgaatattatagcc

SEQ ID NO: 422488 - DNA, 15 bp, Homo sapiens
tgaatattatagcct

SEQ ID NO: 422489 - DNA, 15 bp, Homo sapiens
gaatattatagccta

SEQ ID NO: 422490 - DNA, 15 bp, Homo sapiens
aatattatagcctat

SEQ ID NO: 422491 - DNA, 15 bp, Homo sapiens
atattatagcctatt

SEQ ID NO: 422492 - DNA, 15 bp, Homo sapiens
tattatagcctattc

SEQ ID NO: 422493 - DNA, 15 bp, Homo sapiens
attatagcctattca

SEQ ID NO: 422494 - DNA, 15 bp, Homo sapiens
ttatagcctattcaa

SEQ ID NO: 422495 - DNA, 15 bp, Homo sapiens
tatagcctattcaaa

SEQ ID NO: 422496 - DNA, 15 bp, Homo sapiens
atagcctattcaaaa

SEQ ID NO: 422497 - DNA, 15 bp, Homo sapiens
tagcctattcaaaat

SEQ ID NO: 422498 - DNA, 15 bp, Homo sapiens
agcctattcaaaata

SEQ ID NO: 422499 - DNA, 15 bp, Homo sapiens
gcctattcaaaatag

SEQ ID NO: 422500 - DNA, 15 bp, Homo sapiens
cctattcaaaatagc

SEQ ID NO: 422501 - DNA, 15 bp, Homo sapiens
ctattcaaaatagct

SEQ ID NO: 422502 - DNA, 15 bp, Homo sapiens
tattcaaaatagctg

SEQ ID NO: 422503 - DNA, 15 bp, Homo sapiens
attcaaaatagctgt

SEQ ID NO: 422504 - DNA, 15 bp, Homo sapiens
ttcaaaatagctgtt

SEQ ID NO: 422505 - DNA, 15 bp, Homo sapiens
tcaaaatagctgttt

SEQ ID NO: 422506 - DNA, 15 bp, Homo sapiens
caaaatagctgtttc

SEQ ID NO: 422507 - DNA, 15 bp, Homo sapiens
aaaatagctgtttct

SEQ ID NO: 422508 - DNA, 15 bp, Homo sapiens
aaatagctgtttctt

SEQ ID NO: 422509 - DNA, 15 bp, Homo sapiens
aatagctgtttctta

SEQ ID NO: 422510 - DNA, 15 bp, Homo sapiens
atagctgtttcttac

SEQ ID NO: 422511 - DNA, 15 bp, Homo sapiens
tagctgtttcttaca

SEQ ID NO: 422512 - DNA, 15 bp, Homo sapiens
agctgtttcttacag

SEQ ID NO: 422513 - DNA, 15 bp, Homo sapiens
gctgtttcttacagg

SEQ ID NO: 422514 - DNA, 15 bp, Homo sapiens
ctgtttcttacagga

SEQ ID NO: 422515 - DNA, 15 bp, Homo sapiens
tgtttcttacaggaa

SEQ ID NO: 422516 - DNA, 15 bp, Homo sapiens
gtttcttacaggaaa

SEQ ID NO: 422517 - DNA, 15 bp, Homo sapiens
tttcttacaggaaat

SEQ ID NO: 422518 - DNA, 15 bp, Homo sapiens
ttcttacaggaaatg

SEQ ID NO: 422519 - DNA, 15 bp, Homo sapiens
tcttacaggaaatgg

SEQ ID NO: 422520 - DNA, 15 bp, Homo sapiens
cttacaggaaatgga

SEQ ID NO: 422521 - DNA, 15 bp, Homo sapiens
ttacaggaaatggat

SEQ ID NO: 422522 - DNA, 15 bp, Homo sapiens
tacaggaaatggata

SEQ ID NO: 422523 - DNA, 15 bp, Homo sapiens
acaggaaatggatat

SEQ ID NO: 422524 - DNA, 15 bp, Homo sapiens
caggaaatggatata

SEQ ID NO: 422525 - DNA, 15 bp, Homo sapiens
aggaaatggatatat

SEQ ID NO: 422526 - DNA, 15 bp, Homo sapiens
ggaaatggatatatg

SEQ ID NO: 422527 - DNA, 15 bp, Homo sapiens
gaaatggatatatgt

SEQ ID NO: 422528 - DNA, 15 bp, Homo sapiens
aaatggatatatgtg

SEQ ID NO: 422529 - DNA, 15 bp, Homo sapiens
aatggatatatgtgt

SEQ ID NO: 422530 - DNA, 15 bp, Homo sapiens
atggatatatgtgtg

SEQ ID NO: 422531 - DNA, 15 bp, Homo sapiens
tggatatatgtgtgt

SEQ ID NO: 422532 - DNA, 15 bp, Homo sapiens
ggatatatgtgtgta

SEQ ID NO: 422533 - DNA, 15 bp, Homo sapiens
gatatatgtgtgtat

SEQ ID NO: 422534 - DNA, 15 bp, Homo sapiens
tatatgtgtgtatac

SEQ ID NO: 422535 - DNA, 15 bp, Homo sapiens
atatgtgtgtataca

SEQ ID NO: 422536 - DNA, 15 bp, Homo sapiens
tatgtgtgtatacat

SEQ ID NO: 422537 - DNA, 15 bp, Homo sapiens
atgtgtgtatacata

SEQ ID NO: 422538 - DNA, 15 bp, Homo sapiens
gtgtgtatacatatg

SEQ ID NO: 422539 - DNA, 15 bp, Homo sapiens
tgtgtatacatatgt

SEQ ID NO: 422540 - DNA, 15 bp, Homo sapiens
gtgtatacatatgta

SEQ ID NO: 422541 - DNA, 15 bp, Homo sapiens
tgtatacatatgtat

SEQ ID NO: 422542 - DNA, 15 bp, Homo sapiens
gtatacatatgtata

SEQ ID NO: 422543 - DNA, 15 bp, Homo sapiens
tatacatatgtataa

SEQ ID NO: 422544 - DNA, 15 bp, Homo sapiens
atacatatgtataaa

SEQ ID NO: 422545 - DNA, 15 bp, Homo sapiens
tacatatgtataaat

SEQ ID NO: 422546 - DNA, 15 bp, Homo sapiens
catatgtataaatat

SEQ ID NO: 422547 - DNA, 15 bp, Homo sapiens
atatgtataaatata

SEQ ID NO: 422548 - DNA, 15 bp, Homo sapiens
tatgtataaatatat

SEQ ID NO: 422549 - DNA, 15 bp, Homo sapiens
atgtataaatatata

SEQ ID NO: 422550 - DNA, 15 bp, Homo sapiens
tgtataaatatatat

SEQ ID NO: 422551 - DNA, 15 bp, Homo sapiens
gtataaatatatata

SEQ ID NO: 422552 - DNA, 15 bp, Homo sapiens
tataaatatatatac

SEQ ID NO: 422553 - DNA, 15 bp, Homo sapiens
ataaatatatatact

SEQ ID NO: 422554 - DNA, 15 bp, Homo sapiens
taaatatatatactt

SEQ ID NO: 422555 - DNA, 15 bp, Homo sapiens
aaatatatatactta

SEQ ID NO: 422556 - DNA, 15 bp, Homo sapiens
aatatatatacttat

SEQ ID NO: 422557 - DNA, 15 bp, Homo sapiens
atatatatacttatg

SEQ ID NO: 422558 - DNA, 15 bp, Homo sapiens
tatatatacttatgt

SEQ ID NO: 422559 - DNA, 15 bp, Homo sapiens
atatatacttatgta

SEQ ID NO: 422560 - DNA, 15 bp, Homo sapiens
tatatacttatgtaa

SEQ ID NO: 422561 - DNA, 15 bp, Homo sapiens
atatacttatgtaat

SEQ ID NO: 422562 - DNA, 15 bp, Homo sapiens
tatacttatgtaata

SEQ ID NO: 422563 - DNA, 15 bp, Homo sapiens
atacttatgtaatat

SEQ ID NO: 422564 - DNA, 15 bp, Homo sapiens
tacttatgtaatata

SEQ ID NO: 422565 - DNA, 15 bp, Homo sapiens
acttatgtaatatat

SEQ ID NO: 422566 - DNA, 15 bp, Homo sapiens
cttatgtaatatatg

SEQ ID NO: 422567 - DNA, 15 bp, Homo sapiens
ttatgtaatatatgt

SEQ ID NO: 422568 - DNA, 15 bp, Homo sapiens
tatgtaatatatgta

SEQ ID NO: 422569 - DNA, 15 bp, Homo sapiens
atgtaatatatgtat

SEQ ID NO: 422570 - DNA, 15 bp, Homo sapiens
tgtaatatatgtatt

SEQ ID NO: 422571 - DNA, 15 bp, Homo sapiens
gtaatatatgtattg

SEQ ID NO: 422572 - DNA, 15 bp, Homo sapiens
taatatatgtattgt

SEQ ID NO: 422573 - DNA, 15 bp, Homo sapiens
aatatatgtattgta

SEQ ID NO: 422574 - DNA, 15 bp, Homo sapiens
atatatgtattgtat

SEQ ID NO: 422575 - DNA, 15 bp, Homo sapiens
tatatgtattgtata

SEQ ID NO: 422576 - DNA, 15 bp, Homo sapiens
atatgtattgtatat

SEQ ID NO: 422577 - DNA, 15 bp, Homo sapiens
tatgtattgtatata

SEQ ID NO: 422578 - DNA, 15 bp, Homo sapiens
atgtattgtatatat

SEQ ID NO: 422579 - DNA, 15 bp, Homo sapiens
tgtattgtatatatg

SEQ ID NO: 422580 - DNA, 15 bp, Homo sapiens
gtattgtatatatgt

SEQ ID NO: 422581 - DNA, 15 bp, Homo sapiens
tattgtatatatgta

SEQ ID NO: 422582 - DNA, 15 bp, Homo sapiens
attgtatatatgtat

SEQ ID NO: 422583 - DNA, 15 bp, Homo sapiens
ttgtatatatgtata

SEQ ID NO: 422584 - DNA, 15 bp, Homo sapiens
tgtatatatgtatat

SEQ ID NO: 422585 - DNA, 15 bp, Homo sapiens
gtatatatgtatatc

SEQ ID NO: 422586 - DNA, 15 bp, Homo sapiens
tatatatgtatatca

SEQ ID NO: 422587 - DNA, 15 bp, Homo sapiens
atatatgtatatcat

SEQ ID NO: 422588 - DNA, 15 bp, Homo sapiens
tatatgtatatcata

SEQ ID NO: 422589 - DNA, 15 bp, Homo sapiens
atatgtatatcatac

SEQ ID NO: 422590 - DNA, 15 bp, Homo sapiens
tatgtatatcataca

SEQ ID NO: 422591 - DNA, 15 bp, Homo sapiens
atgtatatcatacat

SEQ ID NO: 422592 - DNA, 15 bp, Homo sapiens
tgtatatcatacata

SEQ ID NO: 422593 - DNA, 15 bp, Homo sapiens
gtatatcatacatat

SEQ ID NO: 422594 - DNA, 15 bp, Homo sapiens
tatatcatacatata

SEQ ID NO: 422595 - DNA, 15 bp, Homo sapiens
atatcatacatatat

SEQ ID NO: 422596 - DNA, 15 bp, Homo sapiens
tatcatacatatata

SEQ ID NO: 422597 - DNA, 15 bp, Homo sapiens
atcatacatatatat

SEQ ID NO: 422598 - DNA, 15 bp, Homo sapiens
tcatacatatatatg

SEQ ID NO: 422599 - DNA, 15 bp, Homo sapiens
catacatatatatgt

SEQ ID NO: 422600 - DNA, 15 bp, Homo sapiens
acatatatatgtata

SEQ ID NO: 422601 - DNA, 15 bp, Homo sapiens
catatatatgtatat

SEQ ID NO: 422602 - DNA, 15 bp, Homo sapiens
tatatgtatatatag

SEQ ID NO: 422603 - DNA, 15 bp, Homo sapiens
atatgtatatatagt

SEQ ID NO: 422604 - DNA, 15 bp, Homo sapiens
tatgtatatatagta

SEQ ID NO: 422605 - DNA, 15 bp, Homo sapiens
atgtatatatagtat

SEQ ID NO: 422606 - DNA, 15 bp, Homo sapiens
tgtatatatagtata

SEQ ID NO: 422607 - DNA, 15 bp, Homo sapiens
gtatatatagtatat

SEQ ID NO: 422608 - DNA, 15 bp, Homo sapiens
tatatatagtatatt

SEQ ID NO: 422609 - DNA, 15 bp, Homo sapiens
atatatagtatatta

SEQ ID NO: 422610 - DNA, 15 bp, Homo sapiens
tatatagtatattat

SEQ ID NO: 422611 - DNA, 15 bp, Homo sapiens
atatagtatattata

SEQ ID NO: 422612 - DNA, 15 bp, Homo sapiens
tatagtatattataa

SEQ ID NO: 422613 - DNA, 15 bp, Homo sapiens
atagtatattataaa

SEQ ID NO: 422614 - DNA, 15 bp, Homo sapiens
tagtatattataaat

SEQ ID NO: 422615 - DNA, 15 bp, Homo sapiens
agtatattataaata

SEQ ID NO: 422616 - DNA, 15 bp, Homo sapiens
gtatattataaatac

SEQ ID NO: 422617 - DNA, 15 bp, Homo sapiens
tatattataaataca

SEQ ID NO: 422618 - DNA, 15 bp, Homo sapiens
atattataaatacat

SEQ ID NO: 422619 - DNA, 15 bp, Homo sapiens
tattataaatacata

SEQ ID NO: 422620 - DNA, 15 bp, Homo sapiens
attataaatacatat

SEQ ID NO: 422621 - DNA, 15 bp, Homo sapiens
ttataaatacatata

SEQ ID NO: 422622 - DNA, 15 bp, Homo sapiens
tataaatacatatat

SEQ ID NO: 422623 - DNA, 15 bp, Homo sapiens
ataaatacatatata

SEQ ID NO: 422624 - DNA, 15 bp, Homo sapiens
tatatatgtatttac

SEQ ID NO: 422625 - DNA, 15 bp, Homo sapiens
atatatgtatttaca

SEQ ID NO: 422626 - DNA, 15 bp, Homo sapiens
tatatgtatttacaa

SEQ ID NO: 422627 - DNA, 15 bp, Homo sapiens
atatgtatttacaag

SEQ ID NO: 422628 - DNA, 15 bp, Homo sapiens
tatgtatttacaagg

SEQ ID NO: 422629 - DNA, 15 bp, Homo sapiens
atgtatttacaagga

SEQ ID NO: 422630 - DNA, 15 bp, Homo sapiens
tgtatttacaaggag

SEQ ID NO: 422631 - DNA, 15 bp, Homo sapiens
gtatttacaaggagt

SEQ ID NO: 422632 - DNA, 15 bp, Homo sapiens
tatttacaaggagtc

SEQ ID NO: 422633 - DNA, 15 bp, Homo sapiens
atttacaaggagtca

SEQ ID NO: 422634 - DNA, 15 bp, Homo sapiens
tttacaaggagtcag

SEQ ID NO: 422635 - DNA, 15 bp, Homo sapiens
ttacaaggagtcagt

SEQ ID NO: 422636 - DNA, 15 bp, Homo sapiens
tacaaggagtcagtc

SEQ ID NO: 422637 - DNA, 15 bp, Homo sapiens
acaaggagtcagtct

SEQ ID NO: 422638 - DNA, 15 bp, Homo sapiens
caaggagtcagtctc

SEQ ID NO: 422639 - DNA, 15 bp, Homo sapiens
aaggagtcagtctct

SEQ ID NO: 422640 - DNA, 15 bp, Homo sapiens
aggagtcagtctctt

SEQ ID NO: 422641 - DNA, 15 bp, Homo sapiens
ggagtcagtctcttt

SEQ ID NO: 422642 - DNA, 15 bp, Homo sapiens
gagtcagtctctttt

SEQ ID NO: 422643 - DNA, 15 bp, Homo sapiens
agtcagtctcttttg

SEQ ID NO: 422644 - DNA, 15 bp, Homo sapiens
gtcagtctcttttgt

SEQ ID NO: 422645 - DNA, 15 bp, Homo sapiens
tcagtctcttttgtg

SEQ ID NO: 422646 - DNA, 15 bp, Homo sapiens
cagtctcttttgtgg

SEQ ID NO: 422647 - DNA, 15 bp, Homo sapiens
agtctcttttgtgga

SEQ ID NO: 422648 - DNA, 15 bp, Homo sapiens
gtctcttttgtggaa

SEQ ID NO: 422649 - DNA, 15 bp, Homo sapiens
tctcttttgtggaag

SEQ ID NO: 422650 - DNA, 15 bp, Homo sapiens
ctcttttgtggaagt

SEQ ID NO: 422651 - DNA, 15 bp, Homo sapiens
tcttttgtggaagta

SEQ ID NO: 422652 - DNA, 15 bp, Homo sapiens
cttttgtggaagtaa

SEQ ID NO: 422653 - DNA, 15 bp, Homo sapiens
ttttgtggaagtaaa

SEQ ID NO: 422654 - DNA, 15 bp, Homo sapiens
tttgtggaagtaaac

SEQ ID NO: 422655 - DNA, 15 bp, Homo sapiens
ttgtggaagtaaaca

SEQ ID NO: 422656 - DNA, 15 bp, Homo sapiens
tgtggaagtaaacat

SEQ ID NO: 422657 - DNA, 15 bp, Homo sapiens
gtggaagtaaacatt

SEQ ID NO: 422658 - DNA, 15 bp, Homo sapiens
tggaagtaaacatta

SEQ ID NO: 422659 - DNA, 15 bp, Homo sapiens
ggaagtaaacattac

SEQ ID NO: 422660 - DNA, 15 bp, Homo sapiens
gaagtaaacattact

SEQ ID NO: 422661 - DNA, 15 bp, Homo sapiens
aagtaaacattactt

SEQ ID NO: 422662 - DNA, 15 bp, Homo sapiens
agtaaacattacttg

SEQ ID NO: 422663 - DNA, 15 bp, Homo sapiens
gtaaacattacttgg

SEQ ID NO: 422664 - DNA, 15 bp, Homo sapiens
taaacattacttggt

SEQ ID NO: 422665 - DNA, 15 bp, Homo sapiens
aaacattacttggtc

SEQ ID NO: 422666 - DNA, 15 bp, Homo sapiens
aacattacttggtca

SEQ ID NO: 422667 - DNA, 15 bp, Homo sapiens
acattacttggtcag

SEQ ID NO: 422668 - DNA, 15 bp, Homo sapiens
cattacttggtcaga

SEQ ID NO: 422669 - DNA, 15 bp, Homo sapiens
attacttggtcagat

SEQ ID NO: 422670 - DNA, 15 bp, Homo sapiens
ttacttggtcagata

SEQ ID NO: 422671 - DNA, 15 bp, Homo sapiens
tacttggtcagataa

SEQ ID NO: 422672 - DNA, 15 bp, Homo sapiens
acttggtcagataag

SEQ ID NO: 422673 - DNA, 15 bp, Homo sapiens
cttggtcagataaga

SEQ ID NO: 422674 - DNA, 15 bp, Homo sapiens
ttggtcagataagat

SEQ ID NO: 422675 - DNA, 15 bp, Homo sapiens
tggtcagataagatt

SEQ ID NO: 422676 - DNA, 15 bp, Homo sapiens
ggtcagataagatta

SEQ ID NO: 422677 - DNA, 15 bp, Homo sapiens
gtcagataagattat

SEQ ID NO: 422678 - DNA, 15 bp, Homo sapiens
tcagataagattatt

SEQ ID NO: 422679 - DNA, 15 bp, Homo sapiens
cagataagattatta

SEQ ID NO: 422680 - DNA, 15 bp, Homo sapiens
agataagattattat

SEQ ID NO: 422681 - DNA, 15 bp, Homo sapiens
gataagattattatg

SEQ ID NO: 422682 - DNA, 15 bp, Homo sapiens
ataagattattatgc

SEQ ID NO: 422683 - DNA, 15 bp, Homo sapiens
taagattattatgct

SEQ ID NO: 422684 - DNA, 15 bp, Homo sapiens
aagattattatgcta

SEQ ID NO: 422685 - DNA, 15 bp, Homo sapiens
agattattatgctaa

SEQ ID NO: 422686 - DNA, 15 bp, Homo sapiens
gattattatgctaaa

SEQ ID NO: 422687 - DNA, 15 bp, Homo sapiens
attattatgctaaag

SEQ ID NO: 422688 - DNA, 15 bp, Homo sapiens
ttattatgctaaagg

SEQ ID NO: 422689 - DNA, 15 bp, Homo sapiens
tattatgctaaagga

SEQ ID NO: 422690 - DNA, 15 bp, Homo sapiens
attatgctaaaggaa

SEQ ID NO: 422691 - DNA, 15 bp, Homo sapiens
ttatgctaaaggaag

SEQ ID NO: 422692 - DNA, 15 bp, Homo sapiens
tatgctaaaggaagg

SEQ ID NO: 422693 - DNA, 15 bp, Homo sapiens
atgctaaaggaaggt

SEQ ID NO: 422694 - DNA, 15 bp, Homo sapiens
tgctaaaggaaggta

SEQ ID NO: 422695 - DNA, 15 bp, Homo sapiens
gctaaaggaaggtag

SEQ ID NO: 422696 - DNA, 15 bp, Homo sapiens
ctaaaggaaggtaga

SEQ ID NO: 422697 - DNA, 15 bp, Homo sapiens
taaaggaaggtagat

SEQ ID NO: 422698 - DNA, 15 bp, Homo sapiens
aaaggaaggtagata

SEQ ID NO: 422699 - DNA, 15 bp, Homo sapiens
aaggaaggtagataa

SEQ ID NO: 422700 - DNA, 15 bp, Homo sapiens
aggaaggtagataat

SEQ ID NO: 422701 - DNA, 15 bp, Homo sapiens
ggaaggtagataatt

SEQ ID NO: 422702 - DNA, 15 bp, Homo sapiens
gaaggtagataattt

SEQ ID NO: 422703 - DNA, 15 bp, Homo sapiens
aaggtagataatttt

SEQ ID NO: 422704 - DNA, 15 bp, Homo sapiens
aggtagataattttg

SEQ ID NO: 422705 - DNA, 15 bp, Homo sapiens
ggtagataattttgt

SEQ ID NO: 422706 - DNA, 15 bp, Homo sapiens
gtagataattttgtg

SEQ ID NO: 422707 - DNA, 15 bp, Homo sapiens
tagataattttgtga

SEQ ID NO: 422708 - DNA, 15 bp, Homo sapiens
agataattttgtgaa

SEQ ID NO: 422709 - DNA, 15 bp, Homo sapiens
gataattttgtgaat

SEQ ID NO: 422710 - DNA, 15 bp, Homo sapiens
ataattttgtgaatg

SEQ ID NO: 422711 - DNA, 15 bp, Homo sapiens
taattttgtgaatgt

SEQ ID NO: 422712 - DNA, 15 bp, Homo sapiens
aattttgtgaatgta

SEQ ID NO: 422713 - DNA, 15 bp, Homo sapiens
attttgtgaatgtaa

SEQ ID NO: 422714 - DNA, 15 bp, Homo sapiens
ttttgtgaatgtaat

SEQ ID NO: 422715 - DNA, 15 bp, Homo sapiens
tttgtgaatgtaatt

SEQ ID NO: 422716 - DNA, 15 bp, Homo sapiens
ttgtgaatgtaattt

SEQ ID NO: 422717 - DNA, 15 bp, Homo sapiens
tgtgaatgtaatttg

SEQ ID NO: 422718 - DNA, 15 bp, Homo sapiens
gtgaatgtaatttgc

SEQ ID NO: 422719 - DNA, 15 bp, Homo sapiens
tgaatgtaatttgca

SEQ ID NO: 422720 - DNA, 15 bp, Homo sapiens
gaatgtaatttgcat

SEQ ID NO: 422721 - DNA, 15 bp, Homo sapiens
aatgtaatttgcatt

SEQ ID NO: 422722 - DNA, 15 bp, Homo sapiens
atgtaatttgcattt

SEQ ID NO: 422723 - DNA, 15 bp, Homo sapiens
tgtaatttgcatttc

SEQ ID NO: 422724 - DNA, 15 bp, Homo sapiens
gtaatttgcatttct

SEQ ID NO: 422725 - DNA, 15 bp, Homo sapiens
taatttgcatttcta

SEQ ID NO: 422726 - DNA, 15 bp, Homo sapiens
aatttgcatttctaa

SEQ ID NO: 422727 - DNA, 15 bp, Homo sapiens
atttgcatttctaaa

SEQ ID NO: 422728 - DNA, 15 bp, Homo sapiens
tttgcatttctaaat

SEQ ID NO: 422729 - DNA, 15 bp, Homo sapiens
ttgcatttctaaatg

SEQ ID NO: 422730 - DNA, 15 bp, Homo sapiens
tgcatttctaaatgt

SEQ ID NO: 422731 - DNA, 15 bp, Homo sapiens
gcatttctaaatgtg

SEQ ID NO: 422732 - DNA, 15 bp, Homo sapiens
catttctaaatgtgg

SEQ ID NO: 422733 - DNA, 15 bp, Homo sapiens
atttctaaatgtggt

SEQ ID NO: 422734 - DNA, 15 bp, Homo sapiens
tttctaaatgtggtt

SEQ ID NO: 422735 - DNA, 15 bp, Homo sapiens
ttctaaatgtggtta

SEQ ID NO: 422736 - DNA, 15 bp, Homo sapiens
tctaaatgtggttat

SEQ ID NO: 422737 - DNA, 15 bp, Homo sapiens
ctaaatgtggttatt

SEQ ID NO: 422738 - DNA, 15 bp, Homo sapiens
taaatgtggttatta

SEQ ID NO: 422739 - DNA, 15 bp, Homo sapiens
aaatgtggttattat

SEQ ID NO: 422740 - DNA, 15 bp, Homo sapiens
aatgtggttattatt

SEQ ID NO: 422741 - DNA, 15 bp, Homo sapiens
atgtggttattatta

SEQ ID NO: 422742 - DNA, 15 bp, Homo sapiens
tgtggttattattat

SEQ ID NO: 422743 - DNA, 15 bp, Homo sapiens
gtggttattattatt

SEQ ID NO: 422744 - DNA, 15 bp, Homo sapiens
tggttattattatta

SEQ ID NO: 422745 - DNA, 15 bp, Homo sapiens
ggttattattattat

SEQ ID NO: 422746 - DNA, 15 bp, Homo sapiens
tattattattatctc

SEQ ID NO: 422747 - DNA, 15 bp, Homo sapiens
attattattatctct

SEQ ID NO: 422748 - DNA, 15 bp, Homo sapiens
ttattattatctctc

SEQ ID NO: 422749 - DNA, 15 bp, Homo sapiens
tattattatctctca

SEQ ID NO: 422750 - DNA, 15 bp, Homo sapiens
attattatctctcaa

SEQ ID NO: 422751 - DNA, 15 bp, Homo sapiens
ttattatctctcaac

SEQ ID NO: 422752 - DNA, 15 bp, Homo sapiens
tattatctctcaaca

SEQ ID NO: 422753 - DNA, 15 bp, Homo sapiens
attatctctcaacag

SEQ ID NO: 422754 - DNA, 15 bp, Homo sapiens
ttatctctcaacagg

SEQ ID NO: 422755 - DNA, 15 bp, Homo sapiens
tatctctcaacaggg

SEQ ID NO: 422756 - DNA, 15 bp, Homo sapiens
atctctcaacagggc

SEQ ID NO: 422757 - DNA, 15 bp, Homo sapiens
tctctcaacagggcc

SEQ ID NO: 422758 - DNA, 15 bp, Homo sapiens
ctctcaacagggccc

SEQ ID NO: 422759 - DNA, 15 bp, Homo sapiens
tctcaacagggccca

SEQ ID NO: 422760 - DNA, 15 bp, Homo sapiens
ctcaacagggcccat

SEQ ID NO: 422761 - DNA, 15 bp, Homo sapiens
tcaacagggcccatt

SEQ ID NO: 422762 - DNA, 15 bp, Homo sapiens
caacagggcccattt

SEQ ID NO: 422763 - DNA, 15 bp, Homo sapiens
aacagggcccatttg

SEQ ID NO: 422764 - DNA, 15 bp, Homo sapiens
acagggcccatttgg

SEQ ID NO: 422765 - DNA, 15 bp, Homo sapiens
cagggcccatttgga

SEQ ID NO: 422766 - DNA, 15 bp, Homo sapiens
agggcccatttggag

SEQ ID NO: 422767 - DNA, 15 bp, Homo sapiens
gggcccatttggagg

SEQ ID NO: 422768 - DNA, 15 bp, Homo sapiens
ggcccatttggaggc

SEQ ID NO: 422769 - DNA, 15 bp, Homo sapiens
gcccatttggaggcc

SEQ ID NO: 422770 - DNA, 15 bp, Homo sapiens
cccatttggaggcca

SEQ ID NO: 422771 - DNA, 15 bp, Homo sapiens
ccatttggaggccag

SEQ ID NO: 422772 - DNA, 15 bp, Homo sapiens
catttggaggccagc

SEQ ID NO: 422773 - DNA, 15 bp, Homo sapiens
atttggaggccagcg

SEQ ID NO: 422774 - DNA, 15 bp, Homo sapiens
tttggaggccagcgc

SEQ ID NO: 422775 - DNA, 15 bp, Homo sapiens
ttggaggccagcgct

SEQ ID NO: 422776 - DNA, 15 bp, Homo sapiens
tggaggccagcgctg

SEQ ID NO: 422777 - DNA, 15 bp, Homo sapiens
ggaggccagcgctga

SEQ ID NO: 422778 - DNA, 15 bp, Homo sapiens
gaggccagcgctgag

SEQ ID NO: 422779 - DNA, 15 bp, Homo sapiens
aggccagcgctgaga

SEQ ID NO: 422780 - DNA, 15 bp, Homo sapiens
ggccagcgctgagaa

SEQ ID NO: 422781 - DNA, 15 bp, Homo sapiens
gccagcgctgagaag

SEQ ID NO: 422782 - DNA, 15 bp, Homo sapiens
ccagcgctgagaagt

SEQ ID NO: 422783 - DNA, 15 bp, Homo sapiens
cagcgctgagaagtg

SEQ ID NO: 422784 - DNA, 15 bp, Homo sapiens
agcgctgagaagtgg

SEQ ID NO: 422785 - DNA, 15 bp, Homo sapiens
gcgctgagaagtgga

SEQ ID NO: 422786 - DNA, 15 bp, Homo sapiens
cgctgagaagtggaa

SEQ ID NO: 422787 - DNA, 15 bp, Homo sapiens
gctgagaagtggaac

SEQ ID NO: 422788 - DNA, 15 bp, Homo sapiens
ctgagaagtggaaca

SEQ ID NO: 422789 - DNA, 15 bp, Homo sapiens
tgagaagtggaacag

SEQ ID NO: 422790 - DNA, 15 bp, Homo sapiens
gagaagtggaacagg

SEQ ID NO: 422791 - DNA, 15 bp, Homo sapiens
agaagtggaacaggt

SEQ ID NO: 422792 - DNA, 15 bp, Homo sapiens
gaagtggaacaggtt

SEQ ID NO: 422793 - DNA, 15 bp, Homo sapiens
aagtggaacaggttg

SEQ ID NO: 422794 - DNA, 15 bp, Homo sapiens
agtggaacaggttgc

SEQ ID NO: 422795 - DNA, 15 bp, Homo sapiens
gtggaacaggttgct

SEQ ID NO: 422796 - DNA, 15 bp, Homo sapiens
tggaacaggttgctg

SEQ ID NO: 422797 - DNA, 15 bp, Homo sapiens
ggaacaggttgctga

SEQ ID NO: 422798 - DNA, 15 bp, Homo sapiens
gaacaggttgctgat

SEQ ID NO: 422799 - DNA, 15 bp, Homo sapiens
aacaggttgctgatg

SEQ ID NO: 422800 - DNA, 15 bp, Homo sapiens
acaggttgctgatgt

SEQ ID NO: 422801 - DNA, 15 bp, Homo sapiens
caggttgctgatgtc

SEQ ID NO: 422802 - DNA, 15 bp, Homo sapiens
aggttgctgatgtcc

SEQ ID NO: 422803 - DNA, 15 bp, Homo sapiens
ggttgctgatgtcct

SEQ ID NO: 422804 - DNA, 15 bp, Homo sapiens
gttgctgatgtcctt

SEQ ID NO: 422805 - DNA, 15 bp, Homo sapiens
ttgctgatgtcctta

SEQ ID NO: 422806 - DNA, 15 bp, Homo sapiens
tgctgatgtccttag

SEQ ID NO: 422807 - DNA, 15 bp, Homo sapiens
gctgatgtccttaga

SEQ ID NO: 422808 - DNA, 15 bp, Homo sapiens
ctgatgtccttagaa

SEQ ID NO: 422809 - DNA, 15 bp, Homo sapiens
tgatgtccttagaag

SEQ ID NO: 422810 - DNA, 15 bp, Homo sapiens
gatgtccttagaaga

SEQ ID NO: 422811 - DNA, 15 bp, Homo sapiens
atgtccttagaagaa

SEQ ID NO: 422812 - DNA, 15 bp, Homo sapiens
tgtccttagaagaac

SEQ ID NO: 422813 - DNA, 15 bp, Homo sapiens
gtccttagaagaact

SEQ ID NO: 422814 - DNA, 15 bp, Homo sapiens
tccttagaagaactg

SEQ ID NO: 422815 - DNA, 15 bp, Homo sapiens
ccttagaagaactga

SEQ ID NO: 422816 - DNA, 15 bp, Homo sapiens
cttagaagaactgat

SEQ ID NO: 422817 - DNA, 15 bp, Homo sapiens
ttagaagaactgatc

SEQ ID NO: 422818 - DNA, 15 bp, Homo sapiens
tagaagaactgatca

SEQ ID NO: 422819 - DNA, 15 bp, Homo sapiens
agaagaactgatcaa

SEQ ID NO: 422820 - DNA, 15 bp, Homo sapiens
gaagaactgatcaaa

SEQ ID NO: 422821 - DNA, 15 bp, Homo sapiens
aagaactgatcaaat

SEQ ID NO: 422822 - DNA, 15 bp, Homo sapiens
agaactgatcaaatg

SEQ ID NO: 422823 - DNA, 15 bp, Homo sapiens
gaactgatcaaatgg

SEQ ID NO: 422824 - DNA, 15 bp, Homo sapiens
aactgatcaaatggc

SEQ ID NO: 422825 - DNA, 15 bp, Homo sapiens
actgatcaaatggct

SEQ ID NO: 422826 - DNA, 15 bp, Homo sapiens
ctgatcaaatggctg

SEQ ID NO: 422827 - DNA, 15 bp, Homo sapiens
tgatcaaatggctga

SEQ ID NO: 422828 - DNA, 15 bp, Homo sapiens
gatcaaatggctgaa

SEQ ID NO: 422829 - DNA, 15 bp, Homo sapiens
atcaaatggctgaat

SEQ ID NO: 422830 - DNA, 15 bp, Homo sapiens
caaatggctgaatat

SEQ ID NO: 422831 - DNA, 15 bp, Homo sapiens
aaatggctgaatatg

SEQ ID NO: 422832 - DNA, 15 bp, Homo sapiens
aatggctgaatatga

SEQ ID NO: 422833 - DNA, 15 bp, Homo sapiens
atggctgaatatgaa

SEQ ID NO: 422834 - DNA, 15 bp, Homo sapiens
tggctgaatatgaaa

SEQ ID NO: 422835 - DNA, 15 bp, Homo sapiens
ggctgaatatgaaag

SEQ ID NO: 422836 - DNA, 15 bp, Homo sapiens
gctgaatatgaaaga

SEQ ID NO: 422837 - DNA, 15 bp, Homo sapiens
ctgaatatgaaagat

SEQ ID NO: 422838 - DNA, 15 bp, Homo sapiens
tgaatatgaaagatg

SEQ ID NO: 422839 - DNA, 15 bp, Homo sapiens
gaatatgaaagatga

SEQ ID NO: 422840 - DNA, 15 bp, Homo sapiens
aatatgaaagatgaa

SEQ ID NO: 422841 - DNA, 15 bp, Homo sapiens
atatgaaagatgaag

SEQ ID NO: 422842 - DNA, 15 bp, Homo sapiens
tatgaaagatgaaga

SEQ ID NO: 422843 - DNA, 15 bp, Homo sapiens
atgaaagatgaagag

SEQ ID NO: 422844 - DNA, 15 bp, Homo sapiens
tgaaagatgaagagc

SEQ ID NO: 422845 - DNA, 15 bp, Homo sapiens
gaaagatgaagagct

SEQ ID NO: 422846 - DNA, 15 bp, Homo sapiens
aaagatgaagagctt

SEQ ID NO: 422847 - DNA, 15 bp, Homo sapiens
aagatgaagagctta

SEQ ID NO: 422848 - DNA, 15 bp, Homo sapiens
agatgaagagcttaa

SEQ ID NO: 422849 - DNA, 15 bp, Homo sapiens
gatgaagagcttaag

SEQ ID NO: 422850 - DNA, 15 bp, Homo sapiens
atgaagagcttaaga

SEQ ID NO: 422851 - DNA, 15 bp, Homo sapiens
tgaagagcttaagaa

SEQ ID NO: 422852 - DNA, 15 bp, Homo sapiens
gaagagcttaagaaa

SEQ ID NO: 422853 - DNA, 15 bp, Homo sapiens
aagagcttaagaaac

SEQ ID NO: 422854 - DNA, 15 bp, Homo sapiens
agagcttaagaaaca

SEQ ID NO: 422855 - DNA, 15 bp, Homo sapiens
gagcttaagaaacaa

SEQ ID NO: 422856 - DNA, 15 bp, Homo sapiens
agcttaagaaacaaa

SEQ ID NO: 422857 - DNA, 15 bp, Homo sapiens
gcttaagaaacaaat

SEQ ID NO: 422858 - DNA, 15 bp, Homo sapiens
cttaagaaacaaatg

SEQ ID NO: 422859 - DNA, 15 bp, Homo sapiens
ttaagaaacaaatgc

SEQ ID NO: 422860 - DNA, 15 bp, Homo sapiens
taagaaacaaatgcc

SEQ ID NO: 422861 - DNA, 15 bp, Homo sapiens
aagaaacaaatgcct

SEQ ID NO: 422862 - DNA, 15 bp, Homo sapiens
agaaacaaatgccta

SEQ ID NO: 422863 - DNA, 15 bp, Homo sapiens
gaaacaaatgcctat

SEQ ID NO: 422864 - DNA, 15 bp, Homo sapiens
aaacaaatgcctatt

SEQ ID NO: 422865 - DNA, 15 bp, Homo sapiens
aacaaatgcctattg

SEQ ID NO: 422866 - DNA, 15 bp, Homo sapiens
acaaatgcctattgg

SEQ ID NO: 422867 - DNA, 15 bp, Homo sapiens
caaatgcctattgga

SEQ ID NO: 422868 - DNA, 15 bp, Homo sapiens
aaatgcctattggag

SEQ ID NO: 422869 - DNA, 15 bp, Homo sapiens
aatgcctattggagg

SEQ ID NO: 422870 - DNA, 15 bp, Homo sapiens
atgcctattggagga

SEQ ID NO: 422871 - DNA, 15 bp, Homo sapiens
tgcctattggaggag

SEQ ID NO: 422872 - DNA, 15 bp, Homo sapiens
gcctattggaggaga

SEQ ID NO: 422873 - DNA, 15 bp, Homo sapiens
cctattggaggagat

SEQ ID NO: 422874 - DNA, 15 bp, Homo sapiens
ctattggaggagatg

SEQ ID NO: 422875 - DNA, 15 bp, Homo sapiens
tattggaggagatgt

SEQ ID NO: 422876 - DNA, 15 bp, Homo sapiens
attggaggagatgtt

SEQ ID NO: 422877 - DNA, 15 bp, Homo sapiens
ttggaggagatgttc

SEQ ID NO: 422878 - DNA, 15 bp, Homo sapiens
tggaggagatgttcc

SEQ ID NO: 422879 - DNA, 15 bp, Homo sapiens
ggaggagatgttcca

SEQ ID NO: 422880 - DNA, 15 bp, Homo sapiens
gaggagatgttccag

SEQ ID NO: 422881 - DNA, 15 bp, Homo sapiens
aggagatgttccagc

SEQ ID NO: 422882 - DNA, 15 bp, Homo sapiens
ggagatgttccagcc

SEQ ID NO: 422883 - DNA, 15 bp, Homo sapiens
gagatgttccagcct

SEQ ID NO: 422884 - DNA, 15 bp, Homo sapiens
agatgttccagcctt

SEQ ID NO: 422885 - DNA, 15 bp, Homo sapiens
gatgttccagcctta

SEQ ID NO: 422886 - DNA, 15 bp, Homo sapiens
atgttccagccttac

SEQ ID NO: 422887 - DNA, 15 bp, Homo sapiens
tgttccagccttaca

SEQ ID NO: 422888 - DNA, 15 bp, Homo sapiens
gttccagccttacag

SEQ ID NO: 422889 - DNA, 15 bp, Homo sapiens
ttccagccttacagc

SEQ ID NO: 422890 - DNA, 15 bp, Homo sapiens
tccagccttacagct

SEQ ID NO: 422891 - DNA, 15 bp, Homo sapiens
ccagccttacagctc

SEQ ID NO: 422892 - DNA, 15 bp, Homo sapiens
cagccttacagctcc

SEQ ID NO: 422893 - DNA, 15 bp, Homo sapiens
agccttacagctcca

SEQ ID NO: 422894 - DNA, 15 bp, Homo sapiens
gccttacagctccag

SEQ ID NO: 422895 - DNA, 15 bp, Homo sapiens
ccttacagctccagt

SEQ ID NO: 422896 - DNA, 15 bp, Homo sapiens
cttacagctccagta

SEQ ID NO: 422897 - DNA, 15 bp, Homo sapiens
ttacagctccagtat

SEQ ID NO: 422898 - DNA, 15 bp, Homo sapiens
tacagctccagtatg

SEQ ID NO: 422899 - DNA, 15 bp, Homo sapiens
acagctccagtatga

SEQ ID NO: 422900 - DNA, 15 bp, Homo sapiens
cagctccagtatgac

SEQ ID NO: 422901 - DNA, 15 bp, Homo sapiens
agctccagtatgacc

SEQ ID NO: 422902 - DNA, 15 bp, Homo sapiens
gctccagtatgacca

SEQ ID NO: 422903 - DNA, 15 bp, Homo sapiens
ctccagtatgaccat

SEQ ID NO: 422904 - DNA, 15 bp, Homo sapiens
tccagtatgaccatt

SEQ ID NO: 422905 - DNA, 15 bp, Homo sapiens
ccagtatgaccattg

SEQ ID NO: 422906 - DNA, 15 bp, Homo sapiens
cagtatgaccattgt

SEQ ID NO: 422907 - DNA, 15 bp, Homo sapiens
agtatgaccattgta

SEQ ID NO: 422908 - DNA, 15 bp, Homo sapiens
gtatgaccattgtaa

SEQ ID NO: 422909 - DNA, 15 bp, Homo sapiens
tatgaccattgtaag

SEQ ID NO: 422910 - DNA, 15 bp, Homo sapiens
atgaccattgtaagg

SEQ ID NO: 422911 - DNA, 15 bp, Homo sapiens
tgaccattgtaaggt

SEQ ID NO: 422912 - DNA, 15 bp, Homo sapiens
gaccattgtaaggta

SEQ ID NO: 422913 - DNA, 15 bp, Homo sapiens
accattgtaaggtaa

SEQ ID NO: 422914 - DNA, 15 bp, Homo sapiens
ccattgtaaggtaag

SEQ ID NO: 422915 - DNA, 15 bp, Homo sapiens
cattgtaaggtaagt

SEQ ID NO: 422916 - DNA, 15 bp, Homo sapiens
attgtaaggtaagtg

SEQ ID NO: 422917 - DNA, 15 bp, Homo sapiens
ttgtaaggtaagtgg

SEQ ID NO: 422918 - DNA, 15 bp, Homo sapiens
tgtaaggtaagtgga

SEQ ID NO: 422919 - DNA, 15 bp, Homo sapiens
gtaaggtaagtggat

SEQ ID NO: 422920 - DNA, 15 bp, Homo sapiens
taaggtaagtggata

SEQ ID NO: 422921 - DNA, 15 bp, Homo sapiens
aaggtaagtggataa

SEQ ID NO: 422922 - DNA, 15 bp, Homo sapiens
aggtaagtggataac

SEQ ID NO: 422923 - DNA, 15 bp, Homo sapiens
ggtaagtggataacc

SEQ ID NO: 422924 - DNA, 15 bp, Homo sapiens
gtaagtggataacct

SEQ ID NO: 422925 - DNA, 15 bp, Homo sapiens
taagtggataaccta

SEQ ID NO: 422926 - DNA, 15 bp, Homo sapiens
aagtggataacctat

SEQ ID NO: 422927 - DNA, 15 bp, Homo sapiens
agtggataacctata

SEQ ID NO: 422928 - DNA, 15 bp, Homo sapiens
gtggataacctatag

SEQ ID NO: 422929 - DNA, 15 bp, Homo sapiens
tggataacctatagt

SEQ ID NO: 422930 - DNA, 15 bp, Homo sapiens
ggataacctatagtg

SEQ ID NO: 422931 - DNA, 15 bp, Homo sapiens
gataacctatagtga

SEQ ID NO: 422932 - DNA, 15 bp, Homo sapiens
ataacctatagtgag

SEQ ID NO: 422933 - DNA, 15 bp, Homo sapiens
taacctatagtgagt

SEQ ID NO: 422934 - DNA, 15 bp, Homo sapiens
aacctatagtgagtc

SEQ ID NO: 422935 - DNA, 15 bp, Homo sapiens
acctatagtgagtcg

SEQ ID NO: 422936 - DNA, 15 bp, Homo sapiens
cctatagtgagtcgc

SEQ ID NO: 422937 - DNA, 15 bp, Homo sapiens
ctatagtgagtcgct

SEQ ID NO: 422938 - DNA, 15 bp, Homo sapiens
tatagtgagtcgctt

SEQ ID NO: 422939 - DNA, 15 bp, Homo sapiens
atagtgagtcgctta

SEQ ID NO: 422940 - DNA, 15 bp, Homo sapiens
tagtgagtcgcttaa

SEQ ID NO: 422941 - DNA, 15 bp, Homo sapiens
agtgagtcgcttaat

SEQ ID NO: 422942 - DNA, 15 bp, Homo sapiens
gtgagtcgcttaatt

SEQ ID NO: 422943 - DNA, 15 bp, Homo sapiens
tgagtcgcttaattc

SEQ ID NO: 422944 - DNA, 15 bp, Homo sapiens
gagtcgcttaattca

SEQ ID NO: 422945 - DNA, 15 bp, Homo sapiens
agtcgcttaattcaa

SEQ ID NO: 422946 - DNA, 15 bp, Homo sapiens
gtcgcttaattcaaa

SEQ ID NO: 422947 - DNA, 15 bp, Homo sapiens
tcgcttaattcaaat

SEQ ID NO: 422948 - DNA, 15 bp, Homo sapiens
cgcttaattcaaatt

SEQ ID NO: 422949 - DNA, 15 bp, Homo sapiens
gcttaattcaaattc

SEQ ID NO: 422950 - DNA, 15 bp, Homo sapiens
cttaattcaaattct

SEQ ID NO: 422951 - DNA, 15 bp, Homo sapiens
ttaattcaaattcta

SEQ ID NO: 422952 - DNA, 15 bp, Homo sapiens
taattcaaattctag

SEQ ID NO: 422953 - DNA, 15 bp, Homo sapiens
aattcaaattctagt

SEQ ID NO: 422954 - DNA, 15 bp, Homo sapiens
attcaaattctagtg

SEQ ID NO: 422955 - DNA, 15 bp, Homo sapiens
ttcaaattctagtga

SEQ ID NO: 422956 - DNA, 15 bp, Homo sapiens
tcaaattctagtgag

SEQ ID NO: 422957 - DNA, 15 bp, Homo sapiens
caaattctagtgagg

SEQ ID NO: 422958 - DNA, 15 bp, Homo sapiens
aaattctagtgaggt

SEQ ID NO: 422959 - DNA, 15 bp, Homo sapiens
aattctagtgaggta

SEQ ID NO: 422960 - DNA, 15 bp, Homo sapiens
attctagtgaggtag

SEQ ID NO: 422961 - DNA, 15 bp, Homo sapiens
ttctagtgaggtaga

SEQ ID NO: 422962 - DNA, 15 bp, Homo sapiens
tctagtgaggtagat

SEQ ID NO: 422963 - DNA, 15 bp, Homo sapiens
ctagtgaggtagata

SEQ ID NO: 422964 - DNA, 15 bp, Homo sapiens
tagtgaggtagatat

SEQ ID NO: 422965 - DNA, 15 bp, Homo sapiens
agtgaggtagatatt

SEQ ID NO: 422966 - DNA, 15 bp, Homo sapiens
gtgaggtagatattt

SEQ ID NO: 422967 - DNA, 15 bp, Homo sapiens
tgaggtagatatttg

SEQ ID NO: 422968 - DNA, 15 bp, Homo sapiens
gaggtagatatttga

SEQ ID NO: 422969 - DNA, 15 bp, Homo sapiens
aggtagatatttgaa

SEQ ID NO: 422970 - DNA, 15 bp, Homo sapiens
ggtagatatttgaaa

SEQ ID NO: 422971 - DNA, 15 bp, Homo sapiens
gtagatatttgaaat

SEQ ID NO: 422972 - DNA, 15 bp, Homo sapiens
tagatatttgaaata

SEQ ID NO: 422973 - DNA, 15 bp, Homo sapiens
agatatttgaaatac

SEQ ID NO: 422974 - DNA, 15 bp, Homo sapiens
gatatttgaaataca

SEQ ID NO: 422975 - DNA, 15 bp, Homo sapiens
atatttgaaatacaa

SEQ ID NO: 422976 - DNA, 15 bp, Homo sapiens
tatttgaaatacaat

SEQ ID NO: 422977 - DNA, 15 bp, Homo sapiens
atttgaaatacaatt

SEQ ID NO: 422978 - DNA, 15 bp, Homo sapiens
tttgaaatacaatta

SEQ ID NO: 422979 - DNA, 15 bp, Homo sapiens
ttgaaatacaattat

SEQ ID NO: 422980 - DNA, 15 bp, Homo sapiens
tgaaatacaattata

SEQ ID NO: 422981 - DNA, 15 bp, Homo sapiens
gaaatacaattatag

SEQ ID NO: 422982 - DNA, 15 bp, Homo sapiens
aaatacaattataga

SEQ ID NO: 422983 - DNA, 15 bp, Homo sapiens
aatacaattatagat

SEQ ID NO: 422984 - DNA, 15 bp, Homo sapiens
atacaattatagata

SEQ ID NO: 422985 - DNA, 15 bp, Homo sapiens
tacaattatagataa

SEQ ID NO: 422986 - DNA, 15 bp, Homo sapiens
acaattatagataag

SEQ ID NO: 422987 - DNA, 15 bp, Homo sapiens
caattatagataagt

SEQ ID NO: 422988 - DNA, 15 bp, Homo sapiens
aattatagataagta

SEQ ID NO: 422989 - DNA, 15 bp, Homo sapiens
attatagataagtat

SEQ ID NO: 422990 - DNA, 15 bp, Homo sapiens
ttatagataagtatc

SEQ ID NO: 422991 - DNA, 15 bp, Homo sapiens
tatagataagtatca

SEQ ID NO: 422992 - DNA, 15 bp, Homo sapiens
atagataagtatcag

SEQ ID NO: 422993 - DNA, 15 bp, Homo sapiens
tagataagtatcaga

SEQ ID NO: 422994 - DNA, 15 bp, Homo sapiens
agataagtatcagag

SEQ ID NO: 422995 - DNA, 15 bp, Homo sapiens
gataagtatcagagt

SEQ ID NO: 422996 - DNA, 15 bp, Homo sapiens
ataagtatcagagtt

SEQ ID NO: 422997 - DNA, 15 bp, Homo sapiens
taagtatcagagttg

SEQ ID NO: 422998 - DNA, 15 bp, Homo sapiens
aagtatcagagttga

SEQ ID NO: 422999 - DNA, 15 bp, Homo sapiens
agtatcagagttgaa

SEQ ID NO: 423000 - DNA, 15 bp, Homo sapiens
gtatcagagttgaac

SEQ ID NO: 423001 - DNA, 15 bp, Homo sapiens
tatcagagttgaacc

SEQ ID NO: 423002 - DNA, 15 bp, Homo sapiens
atcagagttgaacca

SEQ ID NO: 423003 - DNA, 15 bp, Homo sapiens
tcagagttgaaccaa

SEQ ID NO: 423004 - DNA, 15 bp, Homo sapiens
cagagttgaaccaat

SEQ ID NO: 423005 - DNA, 15 bp, Homo sapiens
agagttgaaccaatt

SEQ ID NO: 423006 - DNA, 15 bp, Homo sapiens
gagttgaaccaatta

SEQ ID NO: 423007 - DNA, 15 bp, Homo sapiens
agttgaaccaattat

SEQ ID NO: 423008 - DNA, 15 bp, Homo sapiens
gttgaaccaattatc

SEQ ID NO: 423009 - DNA, 15 bp, Homo sapiens
ttgaaccaattatca

SEQ ID NO: 423010 - DNA, 15 bp, Homo sapiens
tgaaccaattatcac

SEQ ID NO: 423011 - DNA, 15 bp, Homo sapiens
gaaccaattatcaca

SEQ ID NO: 423012 - DNA, 15 bp, Homo sapiens
aaccaattatcacag

SEQ ID NO: 423013 - DNA, 15 bp, Homo sapiens
accaattatcacagg

SEQ ID NO: 423014 - DNA, 15 bp, Homo sapiens
ccaattatcacagga

SEQ ID NO: 423015 - DNA, 15 bp, Homo sapiens
caattatcacaggat

SEQ ID NO: 423016 - DNA, 15 bp, Homo sapiens
aattatcacaggatt

SEQ ID NO: 423017 - DNA, 15 bp, Homo sapiens
attatcacaggattc

SEQ ID NO: 423018 - DNA, 15 bp, Homo sapiens
ttatcacaggattcc

SEQ ID NO: 423019 - DNA, 15 bp, Homo sapiens
tatcacaggattccc

SEQ ID NO: 423020 - DNA, 15 bp, Homo sapiens
atcacaggattcccc

SEQ ID NO: 423021 - DNA, 15 bp, Homo sapiens
tcacaggattccccc

SEQ ID NO: 423022 - DNA, 15 bp, Homo sapiens
cacaggattcccccc

SEQ ID NO: 423023 - DNA, 15 bp, Homo sapiens
acaggattccccccc

SEQ ID NO: 423024 - DNA, 15 bp, Homo sapiens
caggattcccccccc

SEQ ID NO: 423025 - DNA, 15 bp, Homo sapiens
aggattccccccccc

SEQ ID NO: 423026 - DNA, 15 bp, Homo sapiens
ggattccccccccca

SEQ ID NO: 423027 - DNA, 15 bp, Homo sapiens
gattcccccccccac

SEQ ID NO: 423028 - DNA, 15 bp, Homo sapiens
attcccccccccacc

SEQ ID NO: 423029 - DNA, 15 bp, Homo sapiens
ttcccccccccacca

SEQ ID NO: 423030 - DNA, 15 bp, Homo sapiens
tcccccccccaccac

SEQ ID NO: 423031 - DNA, 15 bp, Homo sapiens
cccccccccaccacc

SEQ ID NO: 423032 - DNA, 15 bp, Homo sapiens
ccccccccaccaccg

SEQ ID NO: 423033 - DNA, 15 bp, Homo sapiens
cccccccaccaccgt

SEQ ID NO: 423034 - DNA, 15 bp, Homo sapiens
ccccccaccaccgtc

SEQ ID NO: 423035 - DNA, 15 bp, Homo sapiens
cccccaccaccgtct

SEQ ID NO: 423036 - DNA, 15 bp, Homo sapiens
ccccaccaccgtctg

SEQ ID NO: 423037 - DNA, 15 bp, Homo sapiens
cccaccaccgtctgc

SEQ ID NO: 423038 - DNA, 15 bp, Homo sapiens
ccaccaccgtctgct

SEQ ID NO: 423039 - DNA, 15 bp, Homo sapiens
caccaccgtctgctt

SEQ ID NO: 423040 - DNA, 15 bp, Homo sapiens
accaccgtctgcttt

SEQ ID NO: 423041 - DNA, 15 bp, Homo sapiens
ccaccgtctgctttt

SEQ ID NO: 423042 - DNA, 15 bp, Homo sapiens
caccgtctgctttta

SEQ ID NO: 423043 - DNA, 15 bp, Homo sapiens
accgtctgcttttag

SEQ ID NO: 423044 - DNA, 15 bp, Homo sapiens
ccgtctgcttttagt

SEQ ID NO: 423045 - DNA, 15 bp, Homo sapiens
cgtctgcttttagtt

SEQ ID NO: 423046 - DNA, 15 bp, Homo sapiens
gtctgcttttagttg

SEQ ID NO: 423047 - DNA, 15 bp, Homo sapiens
tctgcttttagttgc

SEQ ID NO: 423048 - DNA, 15 bp, Homo sapiens
ctgcttttagttgcc

SEQ ID NO: 423049 - DNA, 15 bp, Homo sapiens
tgcttttagttgcca

SEQ ID NO: 423050 - DNA, 15 bp, Homo sapiens
gcttttagttgccag

SEQ ID NO: 423051 - DNA, 15 bp, Homo sapiens
cttttagttgccagt

SEQ ID NO: 423052 - DNA, 15 bp, Homo sapiens
ttttagttgccagta

SEQ ID NO: 423053 - DNA, 15 bp, Homo sapiens
tttagttgccagtag

SEQ ID NO: 423054 - DNA, 15 bp, Homo sapiens
ttagttgccagtaga

SEQ ID NO: 423055 - DNA, 15 bp, Homo sapiens
tagttgccagtagac

SEQ ID NO: 423056 - DNA, 15 bp, Homo sapiens
agttgccagtagaca

SEQ ID NO: 423057 - DNA, 15 bp, Homo sapiens
gttgccagtagacat

SEQ ID NO: 423058 - DNA, 15 bp, Homo sapiens
ttgccagtagacatt

SEQ ID NO: 423059 - DNA, 15 bp, Homo sapiens
tgccagtagacattt

SEQ ID NO: 423060 - DNA, 15 bp, Homo sapiens
gccagtagacattta

SEQ ID NO: 423061 - DNA, 15 bp, Homo sapiens
ccagtagacatttaa

SEQ ID NO: 423062 - DNA, 15 bp, Homo sapiens
cagtagacatttaaa

SEQ ID NO: 423063 - DNA, 15 bp, Homo sapiens
agtagacatttaaag

SEQ ID NO: 423064 - DNA, 15 bp, Homo sapiens
gtagacatttaaagt

SEQ ID NO: 423065 - DNA, 15 bp, Homo sapiens
tagacatttaaagtg

SEQ ID NO: 423066 - DNA, 15 bp, Homo sapiens
gacatttaaagtgca

SEQ ID NO: 423067 - DNA, 15 bp, Homo sapiens
acatttaaagtgcat

SEQ ID NO: 423068 - DNA, 15 bp, Homo sapiens
catttaaagtgcata

SEQ ID NO: 423069 - DNA, 15 bp, Homo sapiens
atttaaagtgcatac

SEQ ID NO: 423070 - DNA, 15 bp, Homo sapiens
tttaaagtgcataca

SEQ ID NO: 423071 - DNA, 15 bp, Homo sapiens
ttaaagtgcatacat

SEQ ID NO: 423072 - DNA, 15 bp, Homo sapiens
taaagtgcatacatt

SEQ ID NO: 423073 - DNA, 15 bp, Homo sapiens
aaagtgcatacattg

SEQ ID NO: 423074 - DNA, 15 bp, Homo sapiens
aagtgcatacattgt

SEQ ID NO: 423075 - DNA, 15 bp, Homo sapiens
agtgcatacattgtt

SEQ ID NO: 423076 - DNA, 15 bp, Homo sapiens
gtgcatacattgttt

SEQ ID NO: 423077 - DNA, 15 bp, Homo sapiens
tgcatacattgtttc

SEQ ID NO: 423078 - DNA, 15 bp, Homo sapiens
gcatacattgtttcc

SEQ ID NO: 423079 - DNA, 15 bp, Homo sapiens
catacattgtttcca

SEQ ID NO: 423080 - DNA, 15 bp, Homo sapiens
atacattgtttccat

SEQ ID NO: 423081 - DNA, 15 bp, Homo sapiens
tacattgtttccatt

SEQ ID NO: 423082 - DNA, 15 bp, Homo sapiens
acattgtttccattt

SEQ ID NO: 423083 - DNA, 15 bp, Homo sapiens
cattgtttccatttg

SEQ ID NO: 423084 - DNA, 15 bp, Homo sapiens
attgtttccatttgt

SEQ ID NO: 423085 - DNA, 15 bp, Homo sapiens
ttgtttccatttgta

SEQ ID NO: 423086 - DNA, 15 bp, Homo sapiens
tgtttccatttgtat

SEQ ID NO: 423087 - DNA, 15 bp, Homo sapiens
gtttccatttgtatt

SEQ ID NO: 423088 - DNA, 15 bp, Homo sapiens
tttccatttgtatta

SEQ ID NO: 423089 - DNA, 15 bp, Homo sapiens
ttccatttgtattat

SEQ ID NO: 423090 - DNA, 15 bp, Homo sapiens
tccatttgtattatc

SEQ ID NO: 423091 - DNA, 15 bp, Homo sapiens
ccatttgtattatct

SEQ ID NO: 423092 - DNA, 15 bp, Homo sapiens
catttgtattatctt

SEQ ID NO: 423093 - DNA, 15 bp, Homo sapiens
atttgtattatcttc

SEQ ID NO: 423094 - DNA, 15 bp, Homo sapiens
tttgtattatcttca

SEQ ID NO: 423095 - DNA, 15 bp, Homo sapiens
ttgtattatcttcac

SEQ ID NO: 423096 - DNA, 15 bp, Homo sapiens
tgtattatcttcaca

SEQ ID NO: 423097 - DNA, 15 bp, Homo sapiens
gtattatcttcacat

SEQ ID NO: 423098 - DNA, 15 bp, Homo sapiens
tattatcttcacatt

SEQ ID NO: 423099 - DNA, 15 bp, Homo sapiens
attatcttcacattt

SEQ ID NO: 423100 - DNA, 15 bp, Homo sapiens
ttatcttcacattta

SEQ ID NO: 423101 - DNA, 15 bp, Homo sapiens
tatcttcacatttaa

SEQ ID NO: 423102 - DNA, 15 bp, Homo sapiens
atcttcacatttaac

SEQ ID NO: 423103 - DNA, 15 bp, Homo sapiens
tcttcacatttaact

SEQ ID NO: 423104 - DNA, 15 bp, Homo sapiens
cttcacatttaacta

SEQ ID NO: 423105 - DNA, 15 bp, Homo sapiens
ttcacatttaactaa

SEQ ID NO: 423106 - DNA, 15 bp, Homo sapiens
tcacatttaactaaa

SEQ ID NO: 423107 - DNA, 15 bp, Homo sapiens
cacatttaactaaat

SEQ ID NO: 423108 - DNA, 15 bp, Homo sapiens
acatttaactaaatt

SEQ ID NO: 423109 - DNA, 15 bp, Homo sapiens
catttaactaaattt

SEQ ID NO: 423110 - DNA, 15 bp, Homo sapiens
atttaactaaatttt

SEQ ID NO: 423111 - DNA, 15 bp, Homo sapiens
tttaactaaattttt

SEQ ID NO: 423112 - DNA, 15 bp, Homo sapiens
ttaactaaatttttt

SEQ ID NO: 423113 - DNA, 15 bp, Homo sapiens
taactaaattttttt

SEQ ID NO: 423114 - DNA, 15 bp, Homo sapiens
aactaaatttttttc

SEQ ID NO: 423115 - DNA, 15 bp, Homo sapiens
actaaatttttttca

SEQ ID NO: 423116 - DNA, 15 bp, Homo sapiens
ctaaatttttttcaa

SEQ ID NO: 423117 - DNA, 15 bp, Homo sapiens
taaatttttttcaaa

SEQ ID NO: 423118 - DNA, 15 bp, Homo sapiens
aaatttttttcaaac

SEQ ID NO: 423119 - DNA, 15 bp, Homo sapiens
aatttttttcaaaca

SEQ ID NO: 423120 - DNA, 15 bp, Homo sapiens
atttttttcaaacac

SEQ ID NO: 423121 - DNA, 15 bp, Homo sapiens
tttttttcaaacact

SEQ ID NO: 423122 - DNA, 15 bp, Homo sapiens
ttttttcaaacacta

SEQ ID NO: 423123 - DNA, 15 bp, Homo sapiens
tttttcaaacactac

SEQ ID NO: 423124 - DNA, 15 bp, Homo sapiens
ttttcaaacactacc

SEQ ID NO: 423125 - DNA, 15 bp, Homo sapiens
tttcaaacactacca

SEQ ID NO: 423126 - DNA, 15 bp, Homo sapiens
ttcaaacactaccag

SEQ ID NO: 423127 - DNA, 15 bp, Homo sapiens
tcaaacactaccagt

SEQ ID NO: 423128 - DNA, 15 bp, Homo sapiens
caaacactaccagta

SEQ ID NO: 423129 - DNA, 15 bp, Homo sapiens
aaacactaccagtat

SEQ ID NO: 423130 - DNA, 15 bp, Homo sapiens
aacactaccagtatc

SEQ ID NO: 423131 - DNA, 15 bp, Homo sapiens
acactaccagtatct

SEQ ID NO: 423132 - DNA, 15 bp, Homo sapiens
cactaccagtatctg

SEQ ID NO: 423133 - DNA, 15 bp, Homo sapiens
actaccagtatctga

SEQ ID NO: 423134 - DNA, 15 bp, Homo sapiens
ctaccagtatctgaa

SEQ ID NO: 423135 - DNA, 15 bp, Homo sapiens
taccagtatctgaag

SEQ ID NO: 423136 - DNA, 15 bp, Homo sapiens
accagtatctgaagt

SEQ ID NO: 423137 - DNA, 15 bp, Homo sapiens
ccagtatctgaagta

SEQ ID NO: 423138 - DNA, 15 bp, Homo sapiens
cagtatctgaagtat

SEQ ID NO: 423139 - DNA, 15 bp, Homo sapiens
agtatctgaagtata

SEQ ID NO: 423140 - DNA, 15 bp, Homo sapiens
gtatctgaagtataa

SEQ ID NO: 423141 - DNA, 15 bp, Homo sapiens
tatctgaagtataat

SEQ ID NO: 423142 - DNA, 15 bp, Homo sapiens
atctgaagtataata

SEQ ID NO: 423143 - DNA, 15 bp, Homo sapiens
tctgaagtataatat

SEQ ID NO: 423144 - DNA, 15 bp, Homo sapiens
ctgaagtataatatt

SEQ ID NO: 423145 - DNA, 15 bp, Homo sapiens
tgaagtataatattg

SEQ ID NO: 423146 - DNA, 15 bp, Homo sapiens
gaagtataatattgc

SEQ ID NO: 423147 - DNA, 15 bp, Homo sapiens
aagtataatattgct

SEQ ID NO: 423148 - DNA, 15 bp, Homo sapiens
agtataatattgctt

SEQ ID NO: 423149 - DNA, 15 bp, Homo sapiens
gtataatattgcttt

SEQ ID NO: 423150 - DNA, 15 bp, Homo sapiens
tataatattgctttt

SEQ ID NO: 423151 - DNA, 15 bp, Homo sapiens
ataatattgctttta

SEQ ID NO: 423152 - DNA, 15 bp, Homo sapiens
taatattgcttttag

SEQ ID NO: 423153 - DNA, 15 bp, Homo sapiens
aatattgcttttagc

SEQ ID NO: 423154 - DNA, 15 bp, Homo sapiens
atattgcttttagct

SEQ ID NO: 423155 - DNA, 15 bp, Homo sapiens
tattgcttttagctt

SEQ ID NO: 423156 - DNA, 15 bp, Homo sapiens
attgcttttagctta

SEQ ID NO: 423157 - DNA, 15 bp, Homo sapiens
ttgcttttagcttat

SEQ ID NO: 423158 - DNA, 15 bp, Homo sapiens
tgcttttagcttatt

SEQ ID NO: 423159 - DNA, 15 bp, Homo sapiens
gcttttagcttatta

SEQ ID NO: 423160 - DNA, 15 bp, Homo sapiens
cttttagcttattat

SEQ ID NO: 423161 - DNA, 15 bp, Homo sapiens
ttttagcttattatg

SEQ ID NO: 423162 - DNA, 15 bp, Homo sapiens
tttagcttattatga

SEQ ID NO: 423163 - DNA, 15 bp, Homo sapiens
ttagcttattatgaa

SEQ ID NO: 423164 - DNA, 15 bp, Homo sapiens
tagcttattatgaag

SEQ ID NO: 423165 - DNA, 15 bp, Homo sapiens
agcttattatgaagt

SEQ ID NO: 423166 - DNA, 15 bp, Homo sapiens
gcttattatgaagtt

SEQ ID NO: 423167 - DNA, 15 bp, Homo sapiens
cttattatgaagttt

SEQ ID NO: 423168 - DNA, 15 bp, Homo sapiens
ttattatgaagttta

SEQ ID NO: 423169 - DNA, 15 bp, Homo sapiens
tattatgaagtttat

SEQ ID NO: 423170 - DNA, 15 bp, Homo sapiens
attatgaagtttatc

SEQ ID NO: 423171 - DNA, 15 bp, Homo sapiens
ttatgaagtttatct

SEQ ID NO: 423172 - DNA, 15 bp, Homo sapiens
tatgaagtttatcta

SEQ ID NO: 423173 - DNA, 15 bp, Homo sapiens
atgaagtttatctaa

SEQ ID NO: 423174 - DNA, 15 bp, Homo sapiens
tgaagtttatctaaa

SEQ ID NO: 423175 - DNA, 15 bp, Homo sapiens
gaagtttatctaaat

SEQ ID NO: 423176 - DNA, 15 bp, Homo sapiens
aagtttatctaaatt

SEQ ID NO: 423177 - DNA, 15 bp, Homo sapiens
agtttatctaaattt

SEQ ID NO: 423178 - DNA, 15 bp, Homo sapiens
gtttatctaaatttc

SEQ ID NO: 423179 - DNA, 15 bp, Homo sapiens
ttatctaaatttcta

SEQ ID NO: 423180 - DNA, 15 bp, Homo sapiens
tatctaaatttctaa

SEQ ID NO: 423181 - DNA, 15 bp, Homo sapiens
atctaaatttctaat

SEQ ID NO: 423182 - DNA, 15 bp, Homo sapiens
tctaaatttctaata

SEQ ID NO: 423183 - DNA, 15 bp, Homo sapiens
ctaaatttctaatag

SEQ ID NO: 423184 - DNA, 15 bp, Homo sapiens
taaatttctaatagg

SEQ ID NO: 423185 - DNA, 15 bp, Homo sapiens
aaatttctaataggt

SEQ ID NO: 423186 - DNA, 15 bp, Homo sapiens
aatttctaataggtt

SEQ ID NO: 423187 - DNA, 15 bp, Homo sapiens
atttctaataggttt

SEQ ID NO: 423188 - DNA, 15 bp, Homo sapiens
tttctaataggtttt

SEQ ID NO: 423189 - DNA, 15 bp, Homo sapiens
ttctaataggtttta

SEQ ID NO: 423190 - DNA, 15 bp, Homo sapiens
tctaataggttttag

SEQ ID NO: 423191 - DNA, 15 bp, Homo sapiens
ctaataggttttaga

SEQ ID NO: 423192 - DNA, 15 bp, Homo sapiens
taataggttttagaa

SEQ ID NO: 423193 - DNA, 15 bp, Homo sapiens
aataggttttagaat

SEQ ID NO: 423194 - DNA, 15 bp, Homo sapiens
ataggttttagaatc

SEQ ID NO: 423195 - DNA, 15 bp, Homo sapiens
taggttttagaatca

SEQ ID NO: 423196 - DNA, 15 bp, Homo sapiens
aggttttagaatcat

SEQ ID NO: 423197 - DNA, 15 bp, Homo sapiens
ggttttagaatcata

SEQ ID NO: 423198 - DNA, 15 bp, Homo sapiens
gttttagaatcataa

SEQ ID NO: 423199 - DNA, 15 bp, Homo sapiens
ttttagaatcataat

SEQ ID NO: 423200 - DNA, 15 bp, Homo sapiens
tttagaatcataata

SEQ ID NO: 423201 - DNA, 15 bp, Homo sapiens
ttagaatcataatat

SEQ ID NO: 423202 - DNA, 15 bp, Homo sapiens
tagaatcataatata

SEQ ID NO: 423203 - DNA, 15 bp, Homo sapiens
agaatcataatatat

SEQ ID NO: 423204 - DNA, 15 bp, Homo sapiens
gaatcataatatatt

SEQ ID NO: 423205 - DNA, 15 bp, Homo sapiens
aatcataatatattg

SEQ ID NO: 423206 - DNA, 15 bp, Homo sapiens
atcataatatattga

SEQ ID NO: 423207 - DNA, 15 bp, Homo sapiens
tcataatatattgag

SEQ ID NO: 423208 - DNA, 15 bp, Homo sapiens
cataatatattgagg

SEQ ID NO: 423209 - DNA, 15 bp, Homo sapiens
ataatatattgaggt

SEQ ID NO: 423210 - DNA, 15 bp, Homo sapiens
taatatattgaggtt

SEQ ID NO: 423211 - DNA, 15 bp, Homo sapiens
aatatattgaggttt

SEQ ID NO: 423212 - DNA, 15 bp, Homo sapiens
atatattgaggtttt

SEQ ID NO: 423213 - DNA, 15 bp, Homo sapiens
tatattgaggttttg

SEQ ID NO: 423214 - DNA, 15 bp, Homo sapiens
atattgaggttttgg

SEQ ID NO: 423215 - DNA, 15 bp, Homo sapiens
tattgaggttttggg

SEQ ID NO: 423216 - DNA, 15 bp, Homo sapiens
attgaggttttgggt

SEQ ID NO: 423217 - DNA, 15 bp, Homo sapiens
ttgaggttttgggtt

SEQ ID NO: 423218 - DNA, 15 bp, Homo sapiens
tgaggttttgggttt

SEQ ID NO: 423219 - DNA, 15 bp, Homo sapiens
gaggttttgggtttt

SEQ ID NO: 423220 - DNA, 15 bp, Homo sapiens
aggttttgggttttt

SEQ ID NO: 423221 - DNA, 15 bp, Homo sapiens
ggttttgggtttttt

SEQ ID NO: 423222 - DNA, 15 bp, Homo sapiens
gttttgggttttttt

SEQ ID NO: 423223 - DNA, 15 bp, Homo sapiens
ttttgggtttttttt

SEQ ID NO: 423224 - DNA, 15 bp, Homo sapiens
tttgggttttttttg

SEQ ID NO: 423225 - DNA, 15 bp, Homo sapiens
ttgggttttttttgt

SEQ ID NO: 423226 - DNA, 15 bp, Homo sapiens
tgggttttttttgtt

SEQ ID NO: 423227 - DNA, 15 bp, Homo sapiens
gggttttttttgttt

SEQ ID NO: 423228 - DNA, 15 bp, Homo sapiens
ggttttttttgtttt

SEQ ID NO: 423229 - DNA, 15 bp, Homo sapiens
gttttttttgttttt

SEQ ID NO: 423230 - DNA, 15 bp, Homo sapiens
tttttttgttttttg

SEQ ID NO: 423231 - DNA, 15 bp, Homo sapiens
ttttttgttttttgt

SEQ ID NO: 423232 - DNA, 15 bp, Homo sapiens
tgtttgtttgtttta

SEQ ID NO: 423233 - DNA, 15 bp, Homo sapiens
gtttgtttgttttac

SEQ ID NO: 423234 - DNA, 15 bp, Homo sapiens
tttgtttgttttacc

SEQ ID NO: 423235 - DNA, 15 bp, Homo sapiens
ttgtttgttttacca

SEQ ID NO: 423236 - DNA, 15 bp, Homo sapiens
tgtttgttttaccaa

SEQ ID NO: 423237 - DNA, 15 bp, Homo sapiens
gtttgttttaccaag

SEQ ID NO: 423238 - DNA, 15 bp, Homo sapiens
tttgttttaccaagt

SEQ ID NO: 423239 - DNA, 15 bp, Homo sapiens
ttgttttaccaagtt

SEQ ID NO: 423240 - DNA, 15 bp, Homo sapiens
tgttttaccaagttt

SEQ ID NO: 423241 - DNA, 15 bp, Homo sapiens
gttttaccaagtttc

SEQ ID NO: 423242 - DNA, 15 bp, Homo sapiens
ttttaccaagtttca

SEQ ID NO: 423243 - DNA, 15 bp, Homo sapiens
tttaccaagtttcac

SEQ ID NO: 423244 - DNA, 15 bp, Homo sapiens
ttaccaagtttcact

SEQ ID NO: 423245 - DNA, 15 bp, Homo sapiens
taccaagtttcactc

SEQ ID NO: 423246 - DNA, 15 bp, Homo sapiens
accaagtttcactct

SEQ ID NO: 423247 - DNA, 15 bp, Homo sapiens
ccaagtttcactctt

SEQ ID NO: 423248 - DNA, 15 bp, Homo sapiens
caagtttcactcttg

SEQ ID NO: 423249 - DNA, 15 bp, Homo sapiens
aagtttcactcttgt

SEQ ID NO: 423250 - DNA, 15 bp, Homo sapiens
gcccaggctggagta

SEQ ID NO: 423251 - DNA, 15 bp, Homo sapiens
cccaggctggagtac

SEQ ID NO: 423252 - DNA, 15 bp, Homo sapiens
caggctggagtacaa

SEQ ID NO: 423253 - DNA, 15 bp, Homo sapiens
aggctggagtacaat

SEQ ID NO: 423254 - DNA, 15 bp, Homo sapiens
ggctggagtacaatg

SEQ ID NO: 423255 - DNA, 15 bp, Homo sapiens
gctggagtacaatgg

SEQ ID NO: 423256 - DNA, 15 bp, Homo sapiens
ctggagtacaatggc

SEQ ID NO: 423257 - DNA, 15 bp, Homo sapiens
tggagtacaatggca

SEQ ID NO: 423258 - DNA, 15 bp, Homo sapiens
ggagtacaatggcat

SEQ ID NO: 423259 - DNA, 15 bp, Homo sapiens
gagtacaatggcatg

SEQ ID NO: 423260 - DNA, 15 bp, Homo sapiens
agtacaatggcatga

SEQ ID NO: 423261 - DNA, 15 bp, Homo sapiens
gtacaatggcatgat

SEQ ID NO: 423262 - DNA, 15 bp, Homo sapiens
tacaatggcatgatc

SEQ ID NO: 423263 - DNA, 15 bp, Homo sapiens
acaatggcatgatct

SEQ ID NO: 423264 - DNA, 15 bp, Homo sapiens
caatggcatgatctc

SEQ ID NO: 423265 - DNA, 15 bp, Homo sapiens
aatggcatgatctcg

SEQ ID NO: 423266 - DNA, 15 bp, Homo sapiens
atggcatgatctcgg

SEQ ID NO: 423267 - DNA, 15 bp, Homo sapiens
tcactgcagcctctg

SEQ ID NO: 423268 - DNA, 15 bp, Homo sapiens
cactgcagcctctgc

SEQ ID NO: 423269 - DNA, 15 bp, Homo sapiens
actgcagcctctgct

SEQ ID NO: 423270 - DNA, 15 bp, Homo sapiens
ctgcagcctctgctt

SEQ ID NO: 423271 - DNA, 15 bp, Homo sapiens
tgcagcctctgcttc

SEQ ID NO: 423272 - DNA, 15 bp, Homo sapiens
gcagcctctgcttcc

SEQ ID NO: 423273 - DNA, 15 bp, Homo sapiens
cagcctctgcttcct

SEQ ID NO: 423274 - DNA, 15 bp, Homo sapiens
agcctctgcttcctg

SEQ ID NO: 423275 - DNA, 15 bp, Homo sapiens
gcctctgcttcctgg

SEQ ID NO: 423276 - DNA, 15 bp, Homo sapiens
ggactacaggtgcct

SEQ ID NO: 423277 - DNA, 15 bp, Homo sapiens
gactacaggtgcctg

SEQ ID NO: 423278 - DNA, 15 bp, Homo sapiens
actacaggtgcctgc

SEQ ID NO: 423279 - DNA, 15 bp, Homo sapiens
ctacaggtgcctgcc

SEQ ID NO: 423280 - DNA, 15 bp, Homo sapiens
acaggtgcctgccat

SEQ ID NO: 423281 - DNA, 15 bp, Homo sapiens
caggtgcctgccatc

SEQ ID NO: 423282 - DNA, 15 bp, Homo sapiens
aggtgcctgccatca

SEQ ID NO: 423283 - DNA, 15 bp, Homo sapiens
ggtgcctgccatcac

SEQ ID NO: 423284 - DNA, 15 bp, Homo sapiens
gtgcctgccatcaca

SEQ ID NO: 423285 - DNA, 15 bp, Homo sapiens
tgcctgccatcacac

SEQ ID NO: 423286 - DNA, 15 bp, Homo sapiens
gcctgccatcacacc

SEQ ID NO: 423287 - DNA, 15 bp, Homo sapiens
cctgccatcacaccc

SEQ ID NO: 423288 - DNA, 15 bp, Homo sapiens
ctgccatcacaccca

SEQ ID NO: 423289 - DNA, 15 bp, Homo sapiens
tgccatcacacccaa

SEQ ID NO: 423290 - DNA, 15 bp, Homo sapiens
gccatcacacccaac

SEQ ID NO: 423291 - DNA, 15 bp, Homo sapiens
ccatcacacccaact

SEQ ID NO: 423292 - DNA, 15 bp, Homo sapiens
catcacacccaacta

SEQ ID NO: 423293 - DNA, 15 bp, Homo sapiens
atcacacccaactaa

SEQ ID NO: 423294 - DNA, 15 bp, Homo sapiens
tcacacccaactaac

SEQ ID NO: 423295 - DNA, 15 bp, Homo sapiens
cacacccaactaact

SEQ ID NO: 423296 - DNA, 15 bp, Homo sapiens
acacccaactaactt

SEQ ID NO: 423297 - DNA, 15 bp, Homo sapiens
cacccaactaacttt

SEQ ID NO: 423298 - DNA, 15 bp, Homo sapiens
acccaactaactttg

SEQ ID NO: 423299 - DNA, 15 bp, Homo sapiens
cccaactaactttgt

SEQ ID NO: 423300 - DNA, 15 bp, Homo sapiens
ccaactaactttgtt

SEQ ID NO: 423301 - DNA, 15 bp, Homo sapiens
caactaactttgttt

SEQ ID NO: 423302 - DNA, 15 bp, Homo sapiens
aactaactttgtttt

SEQ ID NO: 423303 - DNA, 15 bp, Homo sapiens
actaactttgttttt

SEQ ID NO: 423304 - DNA, 15 bp, Homo sapiens
ctaactttgtttttt

SEQ ID NO: 423305 - DNA, 15 bp, Homo sapiens
taactttgttttttt

SEQ ID NO: 423306 - DNA, 15 bp, Homo sapiens
aactttgtttttttt

SEQ ID NO: 423307 - DNA, 15 bp, Homo sapiens
actttgttttttttt

SEQ ID NO: 423308 - DNA, 15 bp, Homo sapiens
tgtttttttttttta

SEQ ID NO: 423309 - DNA, 15 bp, Homo sapiens
ttttttttttttaag

SEQ ID NO: 423310 - DNA, 15 bp, Homo sapiens
tttttttttttaaga

SEQ ID NO: 423311 - DNA, 15 bp, Homo sapiens
ttttttttttaagat

SEQ ID NO: 423312 - DNA, 15 bp, Homo sapiens
tttttttttaagatg

SEQ ID NO: 423313 - DNA, 15 bp, Homo sapiens
ttttttttaagatgg

SEQ ID NO: 423314 - DNA, 15 bp, Homo sapiens
tttttttaagatgga

SEQ ID NO: 423315 - DNA, 15 bp, Homo sapiens
ttttttaagatggag

SEQ ID NO: 423316 - DNA, 15 bp, Homo sapiens
tttttaagatggagt

SEQ ID NO: 423317 - DNA, 15 bp, Homo sapiens
ttttaagatggagtc

SEQ ID NO: 423318 - DNA, 15 bp, Homo sapiens
tttaagatggagtct

SEQ ID NO: 423319 - DNA, 15 bp, Homo sapiens
ttaagatggagtctt

SEQ ID NO: 423320 - DNA, 15 bp, Homo sapiens
taagatggagtcttg

SEQ ID NO: 423321 - DNA, 15 bp, Homo sapiens
aagatggagtcttgc

SEQ ID NO: 423322 - DNA, 15 bp, Homo sapiens
ctctgtcacccaggt

SEQ ID NO: 423323 - DNA, 15 bp, Homo sapiens
tctgtcacccaggtt

SEQ ID NO: 423324 - DNA, 15 bp, Homo sapiens
ctgtcacccaggttg

SEQ ID NO: 423325 - DNA, 15 bp, Homo sapiens
tgtcacccaggttgg

SEQ ID NO: 423326 - DNA, 15 bp, Homo sapiens
gtcacccaggttgga

SEQ ID NO: 423327 - DNA, 15 bp, Homo sapiens
tcacccaggttggag

SEQ ID NO: 423328 - DNA, 15 bp, Homo sapiens
cacccaggttggagt

SEQ ID NO: 423329 - DNA, 15 bp, Homo sapiens
acccaggttggagtg

SEQ ID NO: 423330 - DNA, 15 bp, Homo sapiens
cccaggttggagtgc

SEQ ID NO: 423331 - DNA, 15 bp, Homo sapiens
ccaggttggagtgca

SEQ ID NO: 423332 - DNA, 15 bp, Homo sapiens
caggttggagtgcag

SEQ ID NO: 423333 - DNA, 15 bp, Homo sapiens
aggttggagtgcagt

SEQ ID NO: 423334 - DNA, 15 bp, Homo sapiens
ggttggagtgcagtg

SEQ ID NO: 423335 - DNA, 15 bp, Homo sapiens
gttggagtgcagtgg

SEQ ID NO: 423336 - DNA, 15 bp, Homo sapiens
ttggagtgcagtggc

SEQ ID NO: 423337 - DNA, 15 bp, Homo sapiens
gcagtggcatgatca

SEQ ID NO: 423338 - DNA, 15 bp, Homo sapiens
cagtggcatgatcac

SEQ ID NO: 423339 - DNA, 15 bp, Homo sapiens
agtggcatgatcaca

SEQ ID NO: 423340 - DNA, 15 bp, Homo sapiens
gtggcatgatcacag

SEQ ID NO: 423341 - DNA, 15 bp, Homo sapiens
tggcatgatcacagc

SEQ ID NO: 423342 - DNA, 15 bp, Homo sapiens
ggcatgatcacagct

SEQ ID NO: 423343 - DNA, 15 bp, Homo sapiens
gcatgatcacagctc

SEQ ID NO: 423344 - DNA, 15 bp, Homo sapiens
catgatcacagctca

SEQ ID NO: 423345 - DNA, 15 bp, Homo sapiens
acagctcactgcaac

SEQ ID NO: 423346 - DNA, 15 bp, Homo sapiens
gcacctgcaaccacc

SEQ ID NO: 423347 - DNA, 15 bp, Homo sapiens
cacctgcaaccaccc

SEQ ID NO: 423348 - DNA, 15 bp, Homo sapiens
acctgcaaccacccc

SEQ ID NO: 423349 - DNA, 15 bp, Homo sapiens
cctgcaaccaccccc

SEQ ID NO: 423350 - DNA, 15 bp, Homo sapiens
ctgcaaccaccccca

SEQ ID NO: 423351 - DNA, 15 bp, Homo sapiens
tgcaaccacccccag

SEQ ID NO: 423352 - DNA, 15 bp, Homo sapiens
gcaaccacccccagc

SEQ ID NO: 423353 - DNA, 15 bp, Homo sapiens
caaccacccccagct

SEQ ID NO: 423354 - DNA, 15 bp, Homo sapiens
aaccacccccagcta

SEQ ID NO: 423355 - DNA, 15 bp, Homo sapiens
accacccccagctaa

SEQ ID NO: 423356 - DNA, 15 bp, Homo sapiens
ccacccccagctaat

SEQ ID NO: 423357 - DNA, 15 bp, Homo sapiens
cacccccagctaatt

SEQ ID NO: 423358 - DNA, 15 bp, Homo sapiens
acccccagctaattt

SEQ ID NO: 423359 - DNA, 15 bp, Homo sapiens
taattttgtattttg

SEQ ID NO: 423360 - DNA, 15 bp, Homo sapiens
aattttgtattttgt

SEQ ID NO: 423361 - DNA, 15 bp, Homo sapiens
attttgtattttgta

SEQ ID NO: 423362 - DNA, 15 bp, Homo sapiens
ttttgtattttgtat

SEQ ID NO: 423363 - DNA, 15 bp, Homo sapiens
tttgtattttgtatt

SEQ ID NO: 423364 - DNA, 15 bp, Homo sapiens
ttgtattttgtattt

SEQ ID NO: 423365 - DNA, 15 bp, Homo sapiens
tgtattttgtatttt

SEQ ID NO: 423366 - DNA, 15 bp, Homo sapiens
gtattttgtattttt

SEQ ID NO: 423367 - DNA, 15 bp, Homo sapiens
ttgtatttttttttt

SEQ ID NO: 423368 - DNA, 15 bp, Homo sapiens
tgtattttttttttt

SEQ ID NO: 423369 - DNA, 15 bp, Homo sapiens
gtattttttttttta

SEQ ID NO: 423370 - DNA, 15 bp, Homo sapiens
tatttttttttttag

SEQ ID NO: 423371 - DNA, 15 bp, Homo sapiens
atttttttttttaga

SEQ ID NO: 423372 - DNA, 15 bp, Homo sapiens
tttttttttttagat

SEQ ID NO: 423373 - DNA, 15 bp, Homo sapiens
ttttttttttagatg

SEQ ID NO: 423374 - DNA, 15 bp, Homo sapiens
tttttttttagatgg

SEQ ID NO: 423375 - DNA, 15 bp, Homo sapiens
ttttttttagatgga

SEQ ID NO: 423376 - DNA, 15 bp, Homo sapiens
tttttttagatggag

SEQ ID NO: 423377 - DNA, 15 bp, Homo sapiens
ttttttagatggagt

SEQ ID NO: 423378 - DNA, 15 bp, Homo sapiens
tttttagatggagtc

SEQ ID NO: 423379 - DNA, 15 bp, Homo sapiens
ttttagatggagtct

SEQ ID NO: 423380 - DNA, 15 bp, Homo sapiens
tttagatggagtctc

SEQ ID NO: 423381 - DNA, 15 bp, Homo sapiens
ttagatggagtctcg

SEQ ID NO: 423382 - DNA, 15 bp, Homo sapiens
tagatggagtctcgc

SEQ ID NO: 423383 - DNA, 15 bp, Homo sapiens
ttcacctcctgggtc

SEQ ID NO: 423384 - DNA, 15 bp, Homo sapiens
tcacctcctgggtcc

SEQ ID NO: 423385 - DNA, 15 bp, Homo sapiens
cacctcctgggtcca

SEQ ID NO: 423386 - DNA, 15 bp, Homo sapiens
acctcctgggtccaa

SEQ ID NO: 423387 - DNA, 15 bp, Homo sapiens
cctcctgggtccaag

SEQ ID NO: 423388 - DNA, 15 bp, Homo sapiens
ctcctgggtccaaga

SEQ ID NO: 423389 - DNA, 15 bp, Homo sapiens
tcctgggtccaagag

SEQ ID NO: 423390 - DNA, 15 bp, Homo sapiens
cctgggtccaagaga

SEQ ID NO: 423391 - DNA, 15 bp, Homo sapiens
ctgggtccaagagat

SEQ ID NO: 423392 - DNA, 15 bp, Homo sapiens
tgggtccaagagatt

SEQ ID NO: 423393 - DNA, 15 bp, Homo sapiens
gggtccaagagattc

SEQ ID NO: 423394 - DNA, 15 bp, Homo sapiens
ggtccaagagattct

SEQ ID NO: 423395 - DNA, 15 bp, Homo sapiens
gtccaagagattctc

SEQ ID NO: 423396 - DNA, 15 bp, Homo sapiens
tccaagagattctcc

SEQ ID NO: 423397 - DNA, 15 bp, Homo sapiens
ccaagagattctcct

SEQ ID NO: 423398 - DNA, 15 bp, Homo sapiens
caagagattctcctg

SEQ ID NO: 423399 - DNA, 15 bp, Homo sapiens
aagagattctcctgc

SEQ ID NO: 423400 - DNA, 15 bp, Homo sapiens
agagattctcctgcc

SEQ ID NO: 423401 - DNA, 15 bp, Homo sapiens
gagattctcctgcct

SEQ ID NO: 423402 - DNA, 15 bp, Homo sapiens
agattctcctgcctc

SEQ ID NO: 423403 - DNA, 15 bp, Homo sapiens
ctacaggcgcatgcc

SEQ ID NO: 423404 - DNA, 15 bp, Homo sapiens
tacaggcgcatgcca

SEQ ID NO: 423405 - DNA, 15 bp, Homo sapiens
acaggcgcatgccac

SEQ ID NO: 423406 - DNA, 15 bp, Homo sapiens
caggcgcatgccacc

SEQ ID NO: 423407 - DNA, 15 bp, Homo sapiens
aggcgcatgccacca

SEQ ID NO: 423408 - DNA, 15 bp, Homo sapiens
ggcgcatgccaccat

SEQ ID NO: 423409 - DNA, 15 bp, Homo sapiens
gcgcatgccaccatg

SEQ ID NO: 423410 - DNA, 15 bp, Homo sapiens
cgcatgccaccatgc

SEQ ID NO: 423411 - DNA, 15 bp, Homo sapiens
tgccaccatgcccgg

SEQ ID NO: 423412 - DNA, 15 bp, Homo sapiens
atttttactagagac

SEQ ID NO: 423413 - DNA, 15 bp, Homo sapiens
tttttactagagacg

SEQ ID NO: 423414 - DNA, 15 bp, Homo sapiens
ttttactagagacgg

SEQ ID NO: 423415 - DNA, 15 bp, Homo sapiens
tttactagagacggg

SEQ ID NO: 423416 - DNA, 15 bp, Homo sapiens
ttactagagacggga

SEQ ID NO: 423417 - DNA, 15 bp, Homo sapiens
tactagagacgggat

SEQ ID NO: 423418 - DNA, 15 bp, Homo sapiens
actagagacgggatt

SEQ ID NO: 423419 - DNA, 15 bp, Homo sapiens
ctagagacgggattt

SEQ ID NO: 423420 - DNA, 15 bp, Homo sapiens
cgggatttcaccatg

SEQ ID NO: 423421 - DNA, 15 bp, Homo sapiens
gggatttcaccatgt

SEQ ID NO: 423422 - DNA, 15 bp, Homo sapiens
ggatttcaccatgtt

SEQ ID NO: 423423 - DNA, 15 bp, Homo sapiens
cctcaggtgatctgt

SEQ ID NO: 423424 - DNA, 15 bp, Homo sapiens
ctcaggtgatctgtc

SEQ ID NO: 423425 - DNA, 15 bp, Homo sapiens
tcaggtgatctgtct

SEQ ID NO: 423426 - DNA, 15 bp, Homo sapiens
caggtgatctgtctt

SEQ ID NO: 423427 - DNA, 15 bp, Homo sapiens
aggtgatctgtcttc

SEQ ID NO: 423428 - DNA, 15 bp, Homo sapiens
ggtgatctgtcttcc

SEQ ID NO: 423429 - DNA, 15 bp, Homo sapiens
gtgatctgtcttcct

SEQ ID NO: 423430 - DNA, 15 bp, Homo sapiens
tgatctgtcttcctc

SEQ ID NO: 423431 - DNA, 15 bp, Homo sapiens
gatctgtcttcctcg

SEQ ID NO: 423432 - DNA, 15 bp, Homo sapiens
atctgtcttcctcgg

SEQ ID NO: 423433 - DNA, 15 bp, Homo sapiens
tctgtcttcctcggc

SEQ ID NO: 423434 - DNA, 15 bp, Homo sapiens
ctgtcttcctcggcc

SEQ ID NO: 423435 - DNA, 15 bp, Homo sapiens
tgtcttcctcggcct

SEQ ID NO: 423436 - DNA, 15 bp, Homo sapiens
gtcttcctcggcctc

SEQ ID NO: 423437 - DNA, 15 bp, Homo sapiens
tcttcctcggcctcc

SEQ ID NO: 423438 - DNA, 15 bp, Homo sapiens
aggcatgagccacct

SEQ ID NO: 423439 - DNA, 15 bp, Homo sapiens
ggcatgagccacctt

SEQ ID NO: 423440 - DNA, 15 bp, Homo sapiens
gcatgagccacctta

SEQ ID NO: 423441 - DNA, 15 bp, Homo sapiens
catgagccaccttac

SEQ ID NO: 423442 - DNA, 15 bp, Homo sapiens
atgagccaccttacc

SEQ ID NO: 423443 - DNA, 15 bp, Homo sapiens
tgagccaccttaccc

SEQ ID NO: 423444 - DNA, 15 bp, Homo sapiens
gagccaccttacccg

SEQ ID NO: 423445 - DNA, 15 bp, Homo sapiens
agccaccttacccga

SEQ ID NO: 423446 - DNA, 15 bp, Homo sapiens
gccaccttacccgac

SEQ ID NO: 423447 - DNA, 15 bp, Homo sapiens
ccaccttacccgacc

SEQ ID NO: 423448 - DNA, 15 bp, Homo sapiens
caccttacccgacct

SEQ ID NO: 423449 - DNA, 15 bp, Homo sapiens
accttacccgacctg

SEQ ID NO: 423450 - DNA, 15 bp, Homo sapiens
ccttacccgacctga

SEQ ID NO: 423451 - DNA, 15 bp, Homo sapiens
cttacccgacctgag

SEQ ID NO: 423452 - DNA, 15 bp, Homo sapiens
ttacccgacctgaga

SEQ ID NO: 423453 - DNA, 15 bp, Homo sapiens
tacccgacctgagaa

SEQ ID NO: 423454 - DNA, 15 bp, Homo sapiens
acccgacctgagaaa

SEQ ID NO: 423455 - DNA, 15 bp, Homo sapiens
cccgacctgagaaaa

SEQ ID NO: 423456 - DNA, 15 bp, Homo sapiens
ccgacctgagaaaat

SEQ ID NO: 423457 - DNA, 15 bp, Homo sapiens
cgacctgagaaaatt

SEQ ID NO: 423458 - DNA, 15 bp, Homo sapiens
gacctgagaaaattt

SEQ ID NO: 423459 - DNA, 15 bp, Homo sapiens
acctgagaaaatttt

SEQ ID NO: 423460 - DNA, 15 bp, Homo sapiens
cctgagaaaattttt

SEQ ID NO: 423461 - DNA, 15 bp, Homo sapiens
ctgagaaaattttta

SEQ ID NO: 423462 - DNA, 15 bp, Homo sapiens
tgagaaaatttttaa

SEQ ID NO: 423463 - DNA, 15 bp, Homo sapiens
gagaaaatttttaaa

SEQ ID NO: 423464 - DNA, 15 bp, Homo sapiens
agaaaatttttaaac

SEQ ID NO: 423465 - DNA, 15 bp, Homo sapiens
gaaaatttttaaact

SEQ ID NO: 423466 - DNA, 15 bp, Homo sapiens
aaaatttttaaacta

SEQ ID NO: 423467 - DNA, 15 bp, Homo sapiens
aaatttttaaactac

SEQ ID NO: 423468 - DNA, 15 bp, Homo sapiens
aatttttaaactaca

SEQ ID NO: 423469 - DNA, 15 bp, Homo sapiens
atttttaaactacaa

SEQ ID NO: 423470 - DNA, 15 bp, Homo sapiens
tttttaaactacaaa

SEQ ID NO: 423471 - DNA, 15 bp, Homo sapiens
ttttaaactacaaat

SEQ ID NO: 423472 - DNA, 15 bp, Homo sapiens
tttaaactacaaatt

SEQ ID NO: 423473 - DNA, 15 bp, Homo sapiens
ttaaactacaaatta

SEQ ID NO: 423474 - DNA, 15 bp, Homo sapiens
taaactacaaattaa

SEQ ID NO: 423475 - DNA, 15 bp, Homo sapiens
aaactacaaattaat

SEQ ID NO: 423476 - DNA, 15 bp, Homo sapiens
aactacaaattaatc

SEQ ID NO: 423477 - DNA, 15 bp, Homo sapiens
actacaaattaatct

SEQ ID NO: 423478 - DNA, 15 bp, Homo sapiens
ctacaaattaatctt

SEQ ID NO: 423479 - DNA, 15 bp, Homo sapiens
tacaaattaatctta

SEQ ID NO: 423480 - DNA, 15 bp, Homo sapiens
acaaattaatcttaa

SEQ ID NO: 423481 - DNA, 15 bp, Homo sapiens
caaattaatcttaaa

SEQ ID NO: 423482 - DNA, 15 bp, Homo sapiens
aaattaatcttaaat

SEQ ID NO: 423483 - DNA, 15 bp, Homo sapiens
aattaatcttaaatt

SEQ ID NO: 423484 - DNA, 15 bp, Homo sapiens
attaatcttaaattc

SEQ ID NO: 423485 - DNA, 15 bp, Homo sapiens
ttaatcttaaattca

SEQ ID NO: 423486 - DNA, 15 bp, Homo sapiens
taatcttaaattcaa

SEQ ID NO: 423487 - DNA, 15 bp, Homo sapiens
aatcttaaattcaaa

SEQ ID NO: 423488 - DNA, 15 bp, Homo sapiens
cttaaattcaaaagg

SEQ ID NO: 423489 - DNA, 15 bp, Homo sapiens
ttaaattcaaaaggc

SEQ ID NO: 423490 - DNA, 15 bp, Homo sapiens
taaattcaaaaggca

SEQ ID NO: 423491 - DNA, 15 bp, Homo sapiens
aaattcaaaaggcat

SEQ ID NO: 423492 - DNA, 15 bp, Homo sapiens
aattcaaaaggcatc

SEQ ID NO: 423493 - DNA, 15 bp, Homo sapiens
attcaaaaggcatcg

SEQ ID NO: 423494 - DNA, 15 bp, Homo sapiens
ttcaaaaggcatcga

SEQ ID NO: 423495 - DNA, 15 bp, Homo sapiens
tcaaaaggcatcgag

SEQ ID NO: 423496 - DNA, 15 bp, Homo sapiens
caaaaggcatcgagt

SEQ ID NO: 423497 - DNA, 15 bp, Homo sapiens
aaaaggcatcgagtc

SEQ ID NO: 423498 - DNA, 15 bp, Homo sapiens
aaaggcatcgagtca

SEQ ID NO: 423499 - DNA, 15 bp, Homo sapiens
aaggcatcgagtcat

SEQ ID NO: 423500 - DNA, 15 bp, Homo sapiens
aggcatcgagtcata

SEQ ID NO: 423501 - DNA, 15 bp, Homo sapiens
ggcatcgagtcataa

SEQ ID NO: 423502 - DNA, 15 bp, Homo sapiens
gcatcgagtcataag

SEQ ID NO: 423503 - DNA, 15 bp, Homo sapiens
catcgagtcataagg

SEQ ID NO: 423504 - DNA, 15 bp, Homo sapiens
atcgagtcataagga

SEQ ID NO: 423505 - DNA, 15 bp, Homo sapiens
tcgagtcataaggaa

SEQ ID NO: 423506 - DNA, 15 bp, Homo sapiens
cgagtcataaggaat

SEQ ID NO: 423507 - DNA, 15 bp, Homo sapiens
gagtcataaggaatt

SEQ ID NO: 423508 - DNA, 15 bp, Homo sapiens
agtcataaggaatta

SEQ ID NO: 423509 - DNA, 15 bp, Homo sapiens
gtcataaggaattac

SEQ ID NO: 423510 - DNA, 15 bp, Homo sapiens
tcataaggaattaca

SEQ ID NO: 423511 - DNA, 15 bp, Homo sapiens
cataaggaattacaa

SEQ ID NO: 423512 - DNA, 15 bp, Homo sapiens
ataaggaattacaaa

SEQ ID NO: 423513 - DNA, 15 bp, Homo sapiens
taaggaattacaaac

SEQ ID NO: 423514 - DNA, 15 bp, Homo sapiens
aaggaattacaaact

SEQ ID NO: 423515 - DNA, 15 bp, Homo sapiens
aggaattacaaacta

SEQ ID NO: 423516 - DNA, 15 bp, Homo sapiens
ggaattacaaactat

SEQ ID NO: 423517 - DNA, 15 bp, Homo sapiens
gaattacaaactatc

SEQ ID NO: 423518 - DNA, 15 bp, Homo sapiens
aattacaaactatct

SEQ ID NO: 423519 - DNA, 15 bp, Homo sapiens
attacaaactatctt

SEQ ID NO: 423520 - DNA, 15 bp, Homo sapiens
ttacaaactatcttg

SEQ ID NO: 423521 - DNA, 15 bp, Homo sapiens
tacaaactatcttgt

SEQ ID NO: 423522 - DNA, 15 bp, Homo sapiens
acaaactatcttgtt

SEQ ID NO: 423523 - DNA, 15 bp, Homo sapiens
caaactatcttgttt

SEQ ID NO: 423524 - DNA, 15 bp, Homo sapiens
aaactatcttgtttg

SEQ ID NO: 423525 - DNA, 15 bp, Homo sapiens
aactatcttgtttgt

SEQ ID NO: 423526 - DNA, 15 bp, Homo sapiens
actatcttgtttgtg

SEQ ID NO: 423527 - DNA, 15 bp, Homo sapiens
ctatcttgtttgtgt

SEQ ID NO: 423528 - DNA, 15 bp, Homo sapiens
tatcttgtttgtgtt

SEQ ID NO: 423529 - DNA, 15 bp, Homo sapiens
atcttgtttgtgttt

SEQ ID NO: 423530 - DNA, 15 bp, Homo sapiens
tcttgtttgtgttta

SEQ ID NO: 423531 - DNA, 15 bp, Homo sapiens
cttgtttgtgtttaa

SEQ ID NO: 423532 - DNA, 15 bp, Homo sapiens
ttgtttgtgtttaat

SEQ ID NO: 423533 - DNA, 15 bp, Homo sapiens
tgtttgtgtttaata

SEQ ID NO: 423534 - DNA, 15 bp, Homo sapiens
gtttgtgtttaataa

SEQ ID NO: 423535 - DNA, 15 bp, Homo sapiens
tttgtgtttaataaa

SEQ ID NO: 423536 - DNA, 15 bp, Homo sapiens
ttgtgtttaataaaa

SEQ ID NO: 423537 - DNA, 15 bp, Homo sapiens
tgtgtttaataaaag

SEQ ID NO: 423538 - DNA, 15 bp, Homo sapiens
gtgtttaataaaagt

SEQ ID NO: 423539 - DNA, 15 bp, Homo sapiens
tgtttaataaaagtg

SEQ ID NO: 423540 - DNA, 15 bp, Homo sapiens
gtttaataaaagtga

SEQ ID NO: 423541 - DNA, 15 bp, Homo sapiens
tttaataaaagtgaa

SEQ ID NO: 423542 - DNA, 15 bp, Homo sapiens
ttaataaaagtgaaa

SEQ ID NO: 423543 - DNA, 15 bp, Homo sapiens
taataaaagtgaaaa

SEQ ID NO: 423544 - DNA, 15 bp, Homo sapiens
aataaaagtgaaaaa

SEQ ID NO: 423545 - DNA, 15 bp, Homo sapiens
ataaaagtgaaaaat

SEQ ID NO: 423546 - DNA, 15 bp, Homo sapiens
taaaagtgaaaaata

SEQ ID NO: 423547 - DNA, 15 bp, Homo sapiens
aaaagtgaaaaataa

SEQ ID NO: 423548 - DNA, 15 bp, Homo sapiens
aaagtgaaaaataag

SEQ ID NO: 423549 - DNA, 15 bp, Homo sapiens
aagtgaaaaataagg

SEQ ID NO: 423550 - DNA, 15 bp, Homo sapiens
agtgaaaaataagga

SEQ ID NO: 423551 - DNA, 15 bp, Homo sapiens
gtgaaaaataaggac

SEQ ID NO: 423552 - DNA, 15 bp, Homo sapiens
tgaaaaataaggact

SEQ ID NO: 423553 - DNA, 15 bp, Homo sapiens
gaaaaataaggactt

SEQ ID NO: 423554 - DNA, 15 bp, Homo sapiens
aaaaataaggacttg

SEQ ID NO: 423555 - DNA, 15 bp, Homo sapiens
aaaataaggacttgt

SEQ ID NO: 423556 - DNA, 15 bp, Homo sapiens
aaataaggacttgta

SEQ ID NO: 423557 - DNA, 15 bp, Homo sapiens
aataaggacttgtag

SEQ ID NO: 423558 - DNA, 15 bp, Homo sapiens
ataaggacttgtagt

SEQ ID NO: 423559 - DNA, 15 bp, Homo sapiens
taaggacttgtagta

SEQ ID NO: 423560 - DNA, 15 bp, Homo sapiens
aaggacttgtagtaa

SEQ ID NO: 423561 - DNA, 15 bp, Homo sapiens
aggacttgtagtaaa

SEQ ID NO: 423562 - DNA, 15 bp, Homo sapiens
ggacttgtagtaaaa

SEQ ID NO: 423563 - DNA, 15 bp, Homo sapiens
gacttgtagtaaaaa

SEQ ID NO: 423564 - DNA, 15 bp, Homo sapiens
acttgtagtaaaaaa

SEQ ID NO: 423565 - DNA, 15 bp, Homo sapiens
cttgtagtaaaaaaa

SEQ ID NO: 423566 - DNA, 15 bp, Homo sapiens
ttgtagtaaaaaaaa

SEQ ID NO: 423567 - DNA, 15 bp, Homo sapiens
tgtagtaaaaaaaaa

SEQ ID NO: 423568 - DNA, 15 bp, Homo sapiens
gtagtaaaaaaaaaa

SEQ ID NO: 423569 - DNA, 15 bp, Homo sapiens
tagtaaaaaaaaaaa

SEQ ID NO: 423570 - DNA, 15 bp, Homo sapiens
aaaaaaaaagtaatg

SEQ ID NO: 423571 - DNA, 15 bp, Homo sapiens
aaaaaaaagtaatgc

SEQ ID NO: 423572 - DNA, 15 bp, Homo sapiens
aaaaaaagtaatgca

SEQ ID NO: 423573 - DNA, 15 bp, Homo sapiens
aaaaaagtaatgcag

SEQ ID NO: 423574 - DNA, 15 bp, Homo sapiens
aaaaagtaatgcaga

SEQ ID NO: 423575 - DNA, 15 bp, Homo sapiens
aaaagtaatgcagat

SEQ ID NO: 423576 - DNA, 15 bp, Homo sapiens
aaagtaatgcagatg

SEQ ID NO: 423577 - DNA, 15 bp, Homo sapiens
aagtaatgcagatga

SEQ ID NO: 423578 - DNA, 15 bp, Homo sapiens
agtaatgcagatgaa

SEQ ID NO: 423579 - DNA, 15 bp, Homo sapiens
gtaatgcagatgaag

SEQ ID NO: 423580 - DNA, 15 bp, Homo sapiens
taatgcagatgaaga

SEQ ID NO: 423581 - DNA, 15 bp, Homo sapiens
aatgcagatgaagac

SEQ ID NO: 423582 - DNA, 15 bp, Homo sapiens
atgcagatgaagacc

SEQ ID NO: 423583 - DNA, 15 bp, Homo sapiens
tgcagatgaagacca

SEQ ID NO: 423584 - DNA, 15 bp, Homo sapiens
gcagatgaagaccat

SEQ ID NO: 423585 - DNA, 15 bp, Homo sapiens
cagatgaagaccata

SEQ ID NO: 423586 - DNA, 15 bp, Homo sapiens
agatgaagaccatac

SEQ ID NO: 423587 - DNA, 15 bp, Homo sapiens
gatgaagaccatact

SEQ ID NO: 423588 - DNA, 15 bp, Homo sapiens
atgaagaccatacta

SEQ ID NO: 423589 - DNA, 15 bp, Homo sapiens
tgaagaccatactat

SEQ ID NO: 423590 - DNA, 15 bp, Homo sapiens
gaagaccatactatt

SEQ ID NO: 423591 - DNA, 15 bp, Homo sapiens
aagaccatactattt

SEQ ID NO: 423592 - DNA, 15 bp, Homo sapiens
agaccatactattta

SEQ ID NO: 423593 - DNA, 15 bp, Homo sapiens
gaccatactatttaa

SEQ ID NO: 423594 - DNA, 15 bp, Homo sapiens
accatactatttaaa

SEQ ID NO: 423595 - DNA, 15 bp, Homo sapiens
ccatactatttaaaa

SEQ ID NO: 423596 - DNA, 15 bp, Homo sapiens
catactatttaaaat

SEQ ID NO: 423597 - DNA, 15 bp, Homo sapiens
atactatttaaaatc

SEQ ID NO: 423598 - DNA, 15 bp, Homo sapiens
tactatttaaaatca

SEQ ID NO: 423599 - DNA, 15 bp, Homo sapiens
actatttaaaatcat

SEQ ID NO: 423600 - DNA, 15 bp, Homo sapiens
ctatttaaaatcatt

SEQ ID NO: 423601 - DNA, 15 bp, Homo sapiens
tatttaaaatcattt

SEQ ID NO: 423602 - DNA, 15 bp, Homo sapiens
atttaaaatcatttt

SEQ ID NO: 423603 - DNA, 15 bp, Homo sapiens
tttaaaatcatttta

SEQ ID NO: 423604 - DNA, 15 bp, Homo sapiens
ttaaaatcattttat

SEQ ID NO: 423605 - DNA, 15 bp, Homo sapiens
taaaatcattttatg

SEQ ID NO: 423606 - DNA, 15 bp, Homo sapiens
aaaatcattttatgt

SEQ ID NO: 423607 - DNA, 15 bp, Homo sapiens
aaatcattttatgtg

SEQ ID NO: 423608 - DNA, 15 bp, Homo sapiens
aatcattttatgtgt

SEQ ID NO: 423609 - DNA, 15 bp, Homo sapiens
atcattttatgtgtt

SEQ ID NO: 423610 - DNA, 15 bp, Homo sapiens
tcattttatgtgttt

SEQ ID NO: 423611 - DNA, 15 bp, Homo sapiens
cattttatgtgtttt

SEQ ID NO: 423612 - DNA, 15 bp, Homo sapiens
attttatgtgtttta

SEQ ID NO: 423613 - DNA, 15 bp, Homo sapiens
ttttatgtgttttac

SEQ ID NO: 423614 - DNA, 15 bp, Homo sapiens
tttatgtgttttact

SEQ ID NO: 423615 - DNA, 15 bp, Homo sapiens
ttatgtgttttactt

SEQ ID NO: 423616 - DNA, 15 bp, Homo sapiens
tatgtgttttacttt

SEQ ID NO: 423617 - DNA, 15 bp, Homo sapiens
atgtgttttactttt

SEQ ID NO: 423618 - DNA, 15 bp, Homo sapiens
tgtgttttacttttc

SEQ ID NO: 423619 - DNA, 15 bp, Homo sapiens
gtgttttacttttct

SEQ ID NO: 423620 - DNA, 15 bp, Homo sapiens
tgttttacttttctg

SEQ ID NO: 423621 - DNA, 15 bp, Homo sapiens
gttttacttttctga

SEQ ID NO: 423622 - DNA, 15 bp, Homo sapiens
ttttacttttctgag

SEQ ID NO: 423623 - DNA, 15 bp, Homo sapiens
tttacttttctgagc

SEQ ID NO: 423624 - DNA, 15 bp, Homo sapiens
ttacttttctgagcc

SEQ ID NO: 423625 - DNA, 15 bp, Homo sapiens
tacttttctgagcca

SEQ ID NO: 423626 - DNA, 15 bp, Homo sapiens
acttttctgagccaa

SEQ ID NO: 423627 - DNA, 15 bp, Homo sapiens
cttttctgagccaag

SEQ ID NO: 423628 - DNA, 15 bp, Homo sapiens
ttttctgagccaagc

SEQ ID NO: 423629 - DNA, 15 bp, Homo sapiens
tttctgagccaagcc

SEQ ID NO: 423630 - DNA, 15 bp, Homo sapiens
ttctgagccaagcct

SEQ ID NO: 423631 - DNA, 15 bp, Homo sapiens
tctgagccaagcctt

SEQ ID NO: 423632 - DNA, 15 bp, Homo sapiens
ctgagccaagccttt

SEQ ID NO: 423633 - DNA, 15 bp, Homo sapiens
tgagccaagcctttt

SEQ ID NO: 423634 - DNA, 15 bp, Homo sapiens
gagccaagccttttc

SEQ ID NO: 423635 - DNA, 15 bp, Homo sapiens
agccaagccttttct

SEQ ID NO: 423636 - DNA, 15 bp, Homo sapiens
gccaagccttttctt

SEQ ID NO: 423637 - DNA, 15 bp, Homo sapiens
ccaagccttttcttt

SEQ ID NO: 423638 - DNA, 15 bp, Homo sapiens
caagccttttctttg

SEQ ID NO: 423639 - DNA, 15 bp, Homo sapiens
aagccttttctttga

SEQ ID NO: 423640 - DNA, 15 bp, Homo sapiens
agccttttctttgat

SEQ ID NO: 423641 - DNA, 15 bp, Homo sapiens
gccttttctttgatt

SEQ ID NO: 423642 - DNA, 15 bp, Homo sapiens
ccttttctttgatta

SEQ ID NO: 423643 - DNA, 15 bp, Homo sapiens
cttttctttgattac

SEQ ID NO: 423644 - DNA, 15 bp, Homo sapiens
ttttctttgattaca

SEQ ID NO: 423645 - DNA, 15 bp, Homo sapiens
tttctttgattacat

SEQ ID NO: 423646 - DNA, 15 bp, Homo sapiens
ttctttgattacatt

SEQ ID NO: 423647 - DNA, 15 bp, Homo sapiens
tctttgattacattt

SEQ ID NO: 423648 - DNA, 15 bp, Homo sapiens
ctttgattacatttt

SEQ ID NO: 423649 - DNA, 15 bp, Homo sapiens
tttgattacattttt

SEQ ID NO: 423650 - DNA, 15 bp, Homo sapiens
ttgattacattttta

SEQ ID NO: 423651 - DNA, 15 bp, Homo sapiens
tgattacatttttat

SEQ ID NO: 423652 - DNA, 15 bp, Homo sapiens
gattacatttttata

SEQ ID NO: 423653 - DNA, 15 bp, Homo sapiens
attacatttttatac

SEQ ID NO: 423654 - DNA, 15 bp, Homo sapiens
ttacatttttatact

SEQ ID NO: 423655 - DNA, 15 bp, Homo sapiens
tacatttttatactg

SEQ ID NO: 423656 - DNA, 15 bp, Homo sapiens
acatttttatactgc

SEQ ID NO: 423657 - DNA, 15 bp, Homo sapiens
catttttatactgct

SEQ ID NO: 423658 - DNA, 15 bp, Homo sapiens
atttttatactgctc

SEQ ID NO: 423659 - DNA, 15 bp, Homo sapiens
tttttatactgctca

SEQ ID NO: 423660 - DNA, 15 bp, Homo sapiens
ttttatactgctcaa

SEQ ID NO: 423661 - DNA, 15 bp, Homo sapiens
tttatactgctcaaa

SEQ ID NO: 423662 - DNA, 15 bp, Homo sapiens
ttatactgctcaaat

SEQ ID NO: 423663 - DNA, 15 bp, Homo sapiens
tatactgctcaaatt

SEQ ID NO: 423664 - DNA, 15 bp, Homo sapiens
atactgctcaaattt

SEQ ID NO: 423665 - DNA, 15 bp, Homo sapiens
tactgctcaaatttc

SEQ ID NO: 423666 - DNA, 15 bp, Homo sapiens
actgctcaaatttct

SEQ ID NO: 423667 - DNA, 15 bp, Homo sapiens
ctgctcaaatttctg

SEQ ID NO: 423668 - DNA, 15 bp, Homo sapiens
tgctcaaatttctgt

SEQ ID NO: 423669 - DNA, 15 bp, Homo sapiens
gctcaaatttctgtt

SEQ ID NO: 423670 - DNA, 15 bp, Homo sapiens
ctcaaatttctgttc

SEQ ID NO: 423671 - DNA, 15 bp, Homo sapiens
tcaaatttctgttcc

SEQ ID NO: 423672 - DNA, 15 bp, Homo sapiens
caaatttctgttcct

SEQ ID NO: 423673 - DNA, 15 bp, Homo sapiens
aaatttctgttccta

SEQ ID NO: 423674 - DNA, 15 bp, Homo sapiens
aatttctgttcctat

SEQ ID NO: 423675 - DNA, 15 bp, Homo sapiens
atttctgttcctatg

SEQ ID NO: 423676 - DNA, 15 bp, Homo sapiens
tttctgttcctatgc

SEQ ID NO: 423677 - DNA, 15 bp, Homo sapiens
ttctgttcctatgca

SEQ ID NO: 423678 - DNA, 15 bp, Homo sapiens
tctgttcctatgcaa

SEQ ID NO: 423679 - DNA, 15 bp, Homo sapiens
ctgttcctatgcaaa

SEQ ID NO: 423680 - DNA, 15 bp, Homo sapiens
tgttcctatgcaaat

SEQ ID NO: 423681 - DNA, 15 bp, Homo sapiens
gttcctatgcaaatg

SEQ ID NO: 423682 - DNA, 15 bp, Homo sapiens
ttcctatgcaaatgt

SEQ ID NO: 423683 - DNA, 15 bp, Homo sapiens
tcctatgcaaatgta

SEQ ID NO: 423684 - DNA, 15 bp, Homo sapiens
cctatgcaaatgtat

SEQ ID NO: 423685 - DNA, 15 bp, Homo sapiens
ctatgcaaatgtata

SEQ ID NO: 423686 - DNA, 15 bp, Homo sapiens
tatgcaaatgtatac

SEQ ID NO: 423687 - DNA, 15 bp, Homo sapiens
atgcaaatgtatact

SEQ ID NO: 423688 - DNA, 15 bp, Homo sapiens
tgcaaatgtatactt

SEQ ID NO: 423689 - DNA, 15 bp, Homo sapiens
gcaaatgtatacttt

SEQ ID NO: 423690 - DNA, 15 bp, Homo sapiens
caaatgtatactttt

SEQ ID NO: 423691 - DNA, 15 bp, Homo sapiens
aaatgtatactttta

SEQ ID NO: 423692 - DNA, 15 bp, Homo sapiens
aatgtatacttttac

SEQ ID NO: 423693 - DNA, 15 bp, Homo sapiens
atgtatacttttact

SEQ ID NO: 423694 - DNA, 15 bp, Homo sapiens
tgtatacttttactc

SEQ ID NO: 423695 - DNA, 15 bp, Homo sapiens
gtatacttttactct

SEQ ID NO: 423696 - DNA, 15 bp, Homo sapiens
tatacttttactctg

SEQ ID NO: 423697 - DNA, 15 bp, Homo sapiens
atacttttactctga

SEQ ID NO: 423698 - DNA, 15 bp, Homo sapiens
tacttttactctgat

SEQ ID NO: 423699 - DNA, 15 bp, Homo sapiens
acttttactctgatc

SEQ ID NO: 423700 - DNA, 15 bp, Homo sapiens
cttttactctgatca

SEQ ID NO: 423701 - DNA, 15 bp, Homo sapiens
ttttactctgatcag

SEQ ID NO: 423702 - DNA, 15 bp, Homo sapiens
tttactctgatcagc

SEQ ID NO: 423703 - DNA, 15 bp, Homo sapiens
ttactctgatcagcc

SEQ ID NO: 423704 - DNA, 15 bp, Homo sapiens
tactctgatcagcca

SEQ ID NO: 423705 - DNA, 15 bp, Homo sapiens
actctgatcagccaa

SEQ ID NO: 423706 - DNA, 15 bp, Homo sapiens
ctctgatcagccaaa

SEQ ID NO: 423707 - DNA, 15 bp, Homo sapiens
tctgatcagccaaaa

SEQ ID NO: 423708 - DNA, 15 bp, Homo sapiens
ctgatcagccaaaag

SEQ ID NO: 423709 - DNA, 15 bp, Homo sapiens
tgatcagccaaaaga

SEQ ID NO: 423710 - DNA, 15 bp, Homo sapiens
gatcagccaaaagat

SEQ ID NO: 423711 - DNA, 15 bp, Homo sapiens
atcagccaaaagata

SEQ ID NO: 423712 - DNA, 15 bp, Homo sapiens
tcagccaaaagatat

SEQ ID NO: 423713 - DNA, 15 bp, Homo sapiens
cagccaaaagatatg

SEQ ID NO: 423714 - DNA, 15 bp, Homo sapiens
agccaaaagatatgc

SEQ ID NO: 423715 - DNA, 15 bp, Homo sapiens
gccaaaagatatgct

SEQ ID NO: 423716 - DNA, 15 bp, Homo sapiens
ccaaaagatatgctg

SEQ ID NO: 423717 - DNA, 15 bp, Homo sapiens
caaaagatatgctga

SEQ ID NO: 423718 - DNA, 15 bp, Homo sapiens
aaaagatatgctgaa

SEQ ID NO: 423719 - DNA, 15 bp, Homo sapiens
aaagatatgctgaaa

SEQ ID NO: 423720 - DNA, 15 bp, Homo sapiens
aagatatgctgaaat

SEQ ID NO: 423721 - DNA, 15 bp, Homo sapiens
agatatgctgaaatg

SEQ ID NO: 423722 - DNA, 15 bp, Homo sapiens
gatatgctgaaatgt

SEQ ID NO: 423723 - DNA, 15 bp, Homo sapiens
atatgctgaaatgtt

SEQ ID NO: 423724 - DNA, 15 bp, Homo sapiens
tatgctgaaatgtta

SEQ ID NO: 423725 - DNA, 15 bp, Homo sapiens
atgctgaaatgttat

SEQ ID NO: 423726 - DNA, 15 bp, Homo sapiens
tgctgaaatgttatc

SEQ ID NO: 423727 - DNA, 15 bp, Homo sapiens
gctgaaatgttatca

SEQ ID NO: 423728 - DNA, 15 bp, Homo sapiens
ctgaaatgttatcaa

SEQ ID NO: 423729 - DNA, 15 bp, Homo sapiens
tgaaatgttatcaac

SEQ ID NO: 423730 - DNA, 15 bp, Homo sapiens
gaaatgttatcaact

SEQ ID NO: 423731 - DNA, 15 bp, Homo sapiens
aaatgttatcaactg

SEQ ID NO: 423732 - DNA, 15 bp, Homo sapiens
aatgttatcaactga

SEQ ID NO: 423733 - DNA, 15 bp, Homo sapiens
atgttatcaactgac

SEQ ID NO: 423734 - DNA, 15 bp, Homo sapiens
tgttatcaactgaca

SEQ ID NO: 423735 - DNA, 15 bp, Homo sapiens
gttatcaactgacac

SEQ ID NO: 423736 - DNA, 15 bp, Homo sapiens
ttatcaactgacaca

SEQ ID NO: 423737 - DNA, 15 bp, Homo sapiens
tatcaactgacacat

SEQ ID NO: 423738 - DNA, 15 bp, Homo sapiens
atcaactgacacatt

SEQ ID NO: 423739 - DNA, 15 bp, Homo sapiens
tcaactgacacatta

SEQ ID NO: 423740 - DNA, 15 bp, Homo sapiens
caactgacacattaa

SEQ ID NO: 423741 - DNA, 15 bp, Homo sapiens
aactgacacattaat

SEQ ID NO: 423742 - DNA, 15 bp, Homo sapiens
actgacacattaatc

SEQ ID NO: 423743 - DNA, 15 bp, Homo sapiens
ctgacacattaatcc

SEQ ID NO: 423744 - DNA, 15 bp, Homo sapiens
tgacacattaatcct

SEQ ID NO: 423745 - DNA, 15 bp, Homo sapiens
gacacattaatcctt

SEQ ID NO: 423746 - DNA, 15 bp, Homo sapiens
acacattaatcctta

SEQ ID NO: 423747 - DNA, 15 bp, Homo sapiens
cacattaatccttag

SEQ ID NO: 423748 - DNA, 15 bp, Homo sapiens
acattaatccttaga

SEQ ID NO: 423749 - DNA, 15 bp, Homo sapiens
cattaatccttagat

SEQ ID NO: 423750 - DNA, 15 bp, Homo sapiens
attaatccttagatc

SEQ ID NO: 423751 - DNA, 15 bp, Homo sapiens
ttaatccttagatcc

SEQ ID NO: 423752 - DNA, 15 bp, Homo sapiens
taatccttagatcct

SEQ ID NO: 423753 - DNA, 15 bp, Homo sapiens
aatccttagatcctt

SEQ ID NO: 423754 - DNA, 15 bp, Homo sapiens
atccttagatccttg

SEQ ID NO: 423755 - DNA, 15 bp, Homo sapiens
tccttagatccttgt

SEQ ID NO: 423756 - DNA, 15 bp, Homo sapiens
ccttagatccttgtg

SEQ ID NO: 423757 - DNA, 15 bp, Homo sapiens
cttagatccttgtgt

SEQ ID NO: 423758 - DNA, 15 bp, Homo sapiens
ttagatccttgtgtg

SEQ ID NO: 423759 - DNA, 15 bp, Homo sapiens
tagatccttgtgtga

SEQ ID NO: 423760 - DNA, 15 bp, Homo sapiens
agatccttgtgtgat

SEQ ID NO: 423761 - DNA, 15 bp, Homo sapiens
gatccttgtgtgatt

SEQ ID NO: 423762 - DNA, 15 bp, Homo sapiens
atccttgtgtgatta

SEQ ID NO: 423763 - DNA, 15 bp, Homo sapiens
tccttgtgtgattaa

SEQ ID NO: 423764 - DNA, 15 bp, Homo sapiens
ccttgtgtgattaaa

SEQ ID NO: 423765 - DNA, 15 bp, Homo sapiens
cttgtgtgattaaat

SEQ ID NO: 423766 - DNA, 15 bp, Homo sapiens
ttgtgtgattaaatt

SEQ ID NO: 423767 - DNA, 15 bp, Homo sapiens
tgtgtgattaaattt

SEQ ID NO: 423768 - DNA, 15 bp, Homo sapiens
gtgtgattaaatttg

SEQ ID NO: 423769 - DNA, 15 bp, Homo sapiens
tgtgattaaatttgt

SEQ ID NO: 423770 - DNA, 15 bp, Homo sapiens
gtgattaaatttgtg

SEQ ID NO: 423771 - DNA, 15 bp, Homo sapiens
tgattaaatttgtgc

SEQ ID NO: 423772 - DNA, 15 bp, Homo sapiens
gattaaatttgtgcc

SEQ ID NO: 423773 - DNA, 15 bp, Homo sapiens
attaaatttgtgcct

SEQ ID NO: 423774 - DNA, 15 bp, Homo sapiens
ttaaatttgtgcctt

SEQ ID NO: 423775 - DNA, 15 bp, Homo sapiens
taaatttgtgccttg

SEQ ID NO: 423776 - DNA, 15 bp, Homo sapiens
aaatttgtgccttgt

SEQ ID NO: 423777 - DNA, 15 bp, Homo sapiens
aatttgtgccttgtt

SEQ ID NO: 423778 - DNA, 15 bp, Homo sapiens
atttgtgccttgttc

SEQ ID NO: 423779 - DNA, 15 bp, Homo sapiens
tttgtgccttgttca

SEQ ID NO: 423780 - DNA, 15 bp, Homo sapiens
ttgtgccttgttcac

SEQ ID NO: 423781 - DNA, 15 bp, Homo sapiens
tgtgccttgttcact

SEQ ID NO: 423782 - DNA, 15 bp, Homo sapiens
gtgccttgttcactt

SEQ ID NO: 423783 - DNA, 15 bp, Homo sapiens
tgccttgttcacttt

SEQ ID NO: 423784 - DNA, 15 bp, Homo sapiens
gccttgttcactttc

SEQ ID NO: 423785 - DNA, 15 bp, Homo sapiens
ccttgttcactttcc

SEQ ID NO: 423786 - DNA, 15 bp, Homo sapiens
cttgttcactttcca

SEQ ID NO: 423787 - DNA, 15 bp, Homo sapiens
ttgttcactttccat

SEQ ID NO: 423788 - DNA, 15 bp, Homo sapiens
tgttcactttccatt

SEQ ID NO: 423789 - DNA, 15 bp, Homo sapiens
gttcactttccattg

SEQ ID NO: 423790 - DNA, 15 bp, Homo sapiens
ttcactttccattga

SEQ ID NO: 423791 - DNA, 15 bp, Homo sapiens
tcactttccattgat

SEQ ID NO: 423792 - DNA, 15 bp, Homo sapiens
cactttccattgatt

SEQ ID NO: 423793 - DNA, 15 bp, Homo sapiens
actttccattgattt

SEQ ID NO: 423794 - DNA, 15 bp, Homo sapiens
ctttccattgatttc

SEQ ID NO: 423795 - DNA, 15 bp, Homo sapiens
tttccattgatttct

SEQ ID NO: 423796 - DNA, 15 bp, Homo sapiens
ttccattgatttctt

SEQ ID NO: 423797 - DNA, 15 bp, Homo sapiens
tccattgatttcttt

SEQ ID NO: 423798 - DNA, 15 bp, Homo sapiens
ccattgatttcttta

SEQ ID NO: 423799 - DNA, 15 bp, Homo sapiens
cattgatttctttaa

SEQ ID NO: 423800 - DNA, 15 bp, Homo sapiens
attgatttctttaat

SEQ ID NO: 423801 - DNA, 15 bp, Homo sapiens
ttgatttctttaata

SEQ ID NO: 423802 - DNA, 15 bp, Homo sapiens
tgatttctttaatat

SEQ ID NO: 423803 - DNA, 15 bp, Homo sapiens
gatttctttaatatc

SEQ ID NO: 423804 - DNA, 15 bp, Homo sapiens
atttctttaatatct

SEQ ID NO: 423805 - DNA, 15 bp, Homo sapiens
tttctttaatatctc

SEQ ID NO: 423806 - DNA, 15 bp, Homo sapiens
ttctttaatatctct

SEQ ID NO: 423807 - DNA, 15 bp, Homo sapiens
tctttaatatctctt

SEQ ID NO: 423808 - DNA, 15 bp, Homo sapiens
ctttaatatctcttt

SEQ ID NO: 423809 - DNA, 15 bp, Homo sapiens
tttaatatctcttta

SEQ ID NO: 423810 - DNA, 15 bp, Homo sapiens
ttaatatctctttat

SEQ ID NO: 423811 - DNA, 15 bp, Homo sapiens
taatatctctttatg

SEQ ID NO: 423812 - DNA, 15 bp, Homo sapiens
aatatctctttatgc

SEQ ID NO: 423813 - DNA, 15 bp, Homo sapiens
atatctctttatgcc

SEQ ID NO: 423814 - DNA, 15 bp, Homo sapiens
tatctctttatgccc

SEQ ID NO: 423815 - DNA, 15 bp, Homo sapiens
atctctttatgccca

SEQ ID NO: 423816 - DNA, 15 bp, Homo sapiens
tctctttatgcccat

SEQ ID NO: 423817 - DNA, 15 bp, Homo sapiens
ctctttatgcccatt

SEQ ID NO: 423818 - DNA, 15 bp, Homo sapiens
tctttatgcccattt

SEQ ID NO: 423819 - DNA, 15 bp, Homo sapiens
ctttatgcccatttt

SEQ ID NO: 423820 - DNA, 15 bp, Homo sapiens
tttatgcccattttc

SEQ ID NO: 423821 - DNA, 15 bp, Homo sapiens
ttatgcccattttct

SEQ ID NO: 423822 - DNA, 15 bp, Homo sapiens
tatgcccattttctt

SEQ ID NO: 423823 - DNA, 15 bp, Homo sapiens
atgcccattttcttg

SEQ ID NO: 423824 - DNA, 15 bp, Homo sapiens
tgcccattttcttgt

SEQ ID NO: 423825 - DNA, 15 bp, Homo sapiens
gcccattttcttgta

SEQ ID NO: 423826 - DNA, 15 bp, Homo sapiens
cccattttcttgtat

SEQ ID NO: 423827 - DNA, 15 bp, Homo sapiens
ccattttcttgtata

SEQ ID NO: 423828 - DNA, 15 bp, Homo sapiens
cattttcttgtatat

SEQ ID NO: 423829 - DNA, 15 bp, Homo sapiens
attttcttgtatata

SEQ ID NO: 423830 - DNA, 15 bp, Homo sapiens
ttttcttgtatatac

SEQ ID NO: 423831 - DNA, 15 bp, Homo sapiens
tttcttgtatataca

SEQ ID NO: 423832 - DNA, 15 bp, Homo sapiens
ttcttgtatatacat

SEQ ID NO: 423833 - DNA, 15 bp, Homo sapiens
tcttgtatatacata

SEQ ID NO: 423834 - DNA, 15 bp, Homo sapiens
cttgtatatacatat

SEQ ID NO: 423835 - DNA, 15 bp, Homo sapiens
ttgtatatacatatc

SEQ ID NO: 423836 - DNA, 15 bp, Homo sapiens
tgtatatacatatca

SEQ ID NO: 423837 - DNA, 15 bp, Homo sapiens
gtatatacatatcat

SEQ ID NO: 423838 - DNA, 15 bp, Homo sapiens
tatatacatatcatc

SEQ ID NO: 423839 - DNA, 15 bp, Homo sapiens
atatacatatcatct

SEQ ID NO: 423840 - DNA, 15 bp, Homo sapiens
tatacatatcatctt

SEQ ID NO: 423841 - DNA, 15 bp, Homo sapiens
atacatatcatctta

SEQ ID NO: 423842 - DNA, 15 bp, Homo sapiens
tacatatcatcttat

SEQ ID NO: 423843 - DNA, 15 bp, Homo sapiens
acatatcatcttatt

SEQ ID NO: 423844 - DNA, 15 bp, Homo sapiens
catatcatcttattt

SEQ ID NO: 423845 - DNA, 15 bp, Homo sapiens
atatcatcttatttt

SEQ ID NO: 423846 - DNA, 15 bp, Homo sapiens
atcttattttattgt

SEQ ID NO: 423847 - DNA, 15 bp, Homo sapiens
tcttattttattgta

SEQ ID NO: 423848 - DNA, 15 bp, Homo sapiens
cttattttattgtat

SEQ ID NO: 423849 - DNA, 15 bp, Homo sapiens
ttattttattgtatt

SEQ ID NO: 423850 - DNA, 15 bp, Homo sapiens
tattttattgtattt

SEQ ID NO: 423851 - DNA, 15 bp, Homo sapiens
attttattgtatttt

SEQ ID NO: 423852 - DNA, 15 bp, Homo sapiens
ttttattgtattttt

SEQ ID NO: 423853 - DNA, 15 bp, Homo sapiens
tttattgtatttttc

SEQ ID NO: 423854 - DNA, 15 bp, Homo sapiens
ttattgtatttttca

SEQ ID NO: 423855 - DNA, 15 bp, Homo sapiens
tattgtatttttcac

SEQ ID NO: 423856 - DNA, 15 bp, Homo sapiens
attgtatttttcact

SEQ ID NO: 423857 - DNA, 15 bp, Homo sapiens
ttgtatttttcactc

SEQ ID NO: 423858 - DNA, 15 bp, Homo sapiens
tgtatttttcactcc

SEQ ID NO: 423859 - DNA, 15 bp, Homo sapiens
gtatttttcactcct

SEQ ID NO: 423860 - DNA, 15 bp, Homo sapiens
tatttttcactcctc

SEQ ID NO: 423861 - DNA, 15 bp, Homo sapiens
atttttcactcctcc

SEQ ID NO: 423862 - DNA, 15 bp, Homo sapiens
tttttcactcctccc

SEQ ID NO: 423863 - DNA, 15 bp, Homo sapiens
ttttcactcctccca

SEQ ID NO: 423864 - DNA, 15 bp, Homo sapiens
tttcactcctcccat

SEQ ID NO: 423865 - DNA, 15 bp, Homo sapiens
ttcactcctcccatg

SEQ ID NO: 423866 - DNA, 15 bp, Homo sapiens
tcactcctcccatgt

SEQ ID NO: 423867 - DNA, 15 bp, Homo sapiens
cactcctcccatgta

SEQ ID NO: 423868 - DNA, 15 bp, Homo sapiens
actcctcccatgtaa

SEQ ID NO: 423869 - DNA, 15 bp, Homo sapiens
ctcctcccatgtaat

SEQ ID NO: 423870 - DNA, 15 bp, Homo sapiens
tcctcccatgtaatg

SEQ ID NO: 423871 - DNA, 15 bp, Homo sapiens
cctcccatgtaatga

SEQ ID NO: 423872 - DNA, 15 bp, Homo sapiens
ctcccatgtaatgaa

SEQ ID NO: 423873 - DNA, 15 bp, Homo sapiens
tcccatgtaatgaaa

SEQ ID NO: 423874 - DNA, 15 bp, Homo sapiens
cccatgtaatgaaag

SEQ ID NO: 423875 - DNA, 15 bp, Homo sapiens
ccatgtaatgaaagt

SEQ ID NO: 423876 - DNA, 15 bp, Homo sapiens
catgtaatgaaagtt

SEQ ID NO: 423877 - DNA, 15 bp, Homo sapiens
atgtaatgaaagttc

SEQ ID NO: 423878 - DNA, 15 bp, Homo sapiens
tgtaatgaaagttct

SEQ ID NO: 423879 - DNA, 15 bp, Homo sapiens
gtaatgaaagttctc

SEQ ID NO: 423880 - DNA, 15 bp, Homo sapiens
taatgaaagttctca

SEQ ID NO: 423881 - DNA, 15 bp, Homo sapiens
aatgaaagttctcat

SEQ ID NO: 423882 - DNA, 15 bp, Homo sapiens
atgaaagttctcatt

SEQ ID NO: 423883 - DNA, 15 bp, Homo sapiens
tgaaagttctcattc

SEQ ID NO: 423884 - DNA, 15 bp, Homo sapiens
gaaagttctcattct

SEQ ID NO: 423885 - DNA, 15 bp, Homo sapiens
aaagttctcattcta

SEQ ID NO: 423886 - DNA, 15 bp, Homo sapiens
aagttctcattctaa

SEQ ID NO: 423887 - DNA, 15 bp, Homo sapiens
agttctcattctaaa

SEQ ID NO: 423888 - DNA, 15 bp, Homo sapiens
gttctcattctaaat

SEQ ID NO: 423889 - DNA, 15 bp, Homo sapiens
ttctcattctaaatc

SEQ ID NO: 423890 - DNA, 15 bp, Homo sapiens
tctcattctaaatct

SEQ ID NO: 423891 - DNA, 15 bp, Homo sapiens
ctcattctaaatctg

SEQ ID NO: 423892 - DNA, 15 bp, Homo sapiens
tcattctaaatctgg

SEQ ID NO: 423893 - DNA, 15 bp, Homo sapiens
cattctaaatctggt

SEQ ID NO: 423894 - DNA, 15 bp, Homo sapiens
attctaaatctggtc

SEQ ID NO: 423895 - DNA, 15 bp, Homo sapiens
ttctaaatctggtca

SEQ ID NO: 423896 - DNA, 15 bp, Homo sapiens
tctaaatctggtcat

SEQ ID NO: 423897 - DNA, 15 bp, Homo sapiens
ctaaatctggtcatt

SEQ ID NO: 423898 - DNA, 15 bp, Homo sapiens
taaatctggtcattt

SEQ ID NO: 423899 - DNA, 15 bp, Homo sapiens
aaatctggtcatttt

SEQ ID NO: 423900 - DNA, 15 bp, Homo sapiens
aatctggtcatttta

SEQ ID NO: 423901 - DNA, 15 bp, Homo sapiens
atctggtcattttaa

SEQ ID NO: 423902 - DNA, 15 bp, Homo sapiens
tctggtcattttaag

SEQ ID NO: 423903 - DNA, 15 bp, Homo sapiens
ctggtcattttaagg

SEQ ID NO: 423904 - DNA, 15 bp, Homo sapiens
tggtcattttaaggt

SEQ ID NO: 423905 - DNA, 15 bp, Homo sapiens
ggtcattttaaggtg

SEQ ID NO: 423906 - DNA, 15 bp, Homo sapiens
gtcattttaaggtga

SEQ ID NO: 423907 - DNA, 15 bp, Homo sapiens
tcattttaaggtgac

SEQ ID NO: 423908 - DNA, 15 bp, Homo sapiens
cattttaaggtgaca

SEQ ID NO: 423909 - DNA, 15 bp, Homo sapiens
attttaaggtgacac

SEQ ID NO: 423910 - DNA, 15 bp, Homo sapiens
ttttaaggtgacact

SEQ ID NO: 423911 - DNA, 15 bp, Homo sapiens
tttaaggtgacacta

SEQ ID NO: 423912 - DNA, 15 bp, Homo sapiens
ttaaggtgacactat

SEQ ID NO: 423913 - DNA, 15 bp, Homo sapiens
taaggtgacactatg

SEQ ID NO: 423914 - DNA, 15 bp, Homo sapiens
aaggtgacactatga

SEQ ID NO: 423915 - DNA, 15 bp, Homo sapiens
aggtgacactatgat

SEQ ID NO: 423916 - DNA, 15 bp, Homo sapiens
ggtgacactatgatt

SEQ ID NO: 423917 - DNA, 15 bp, Homo sapiens
gtgacactatgattc

SEQ ID NO: 423918 - DNA, 15 bp, Homo sapiens
tgacactatgattct

SEQ ID NO: 423919 - DNA, 15 bp, Homo sapiens
gacactatgattcta

SEQ ID NO: 423920 - DNA, 15 bp, Homo sapiens
acactatgattctat

SEQ ID NO: 423921 - DNA, 15 bp, Homo sapiens
cactatgattctatt

SEQ ID NO: 423922 - DNA, 15 bp, Homo sapiens
actatgattctattt

SEQ ID NO: 423923 - DNA, 15 bp, Homo sapiens
ctatgattctatttc

SEQ ID NO: 423924 - DNA, 15 bp, Homo sapiens
tatgattctatttcc

SEQ ID NO: 423925 - DNA, 15 bp, Homo sapiens
atgattctatttcca

SEQ ID NO: 423926 - DNA, 15 bp, Homo sapiens
tgattctatttccat

SEQ ID NO: 423927 - DNA, 15 bp, Homo sapiens
gattctatttccatt

SEQ ID NO: 423928 - DNA, 15 bp, Homo sapiens
attctatttccattt

SEQ ID NO: 423929 - DNA, 15 bp, Homo sapiens
ttctatttccatttt

SEQ ID NO: 423930 - DNA, 15 bp, Homo sapiens
tctatttccatttta

SEQ ID NO: 423931 - DNA, 15 bp, Homo sapiens
ctatttccattttaa

SEQ ID NO: 423932 - DNA, 15 bp, Homo sapiens
tatttccattttaaa

SEQ ID NO: 423933 - DNA, 15 bp, Homo sapiens
atttccattttaaaa

SEQ ID NO: 423934 - DNA, 15 bp, Homo sapiens
tttccattttaaaaa

SEQ ID NO: 423935 - DNA, 15 bp, Homo sapiens
ttccattttaaaaat

SEQ ID NO: 423936 - DNA, 15 bp, Homo sapiens
tccattttaaaaatg

SEQ ID NO: 423937 - DNA, 15 bp, Homo sapiens
ccattttaaaaatga

SEQ ID NO: 423938 - DNA, 15 bp, Homo sapiens
cattttaaaaatgac

SEQ ID NO: 423939 - DNA, 15 bp, Homo sapiens
attttaaaaatgaca

SEQ ID NO: 423940 - DNA, 15 bp, Homo sapiens
ttttaaaaatgacaa

SEQ ID NO: 423941 - DNA, 15 bp, Homo sapiens
tttaaaaatgacaaa

SEQ ID NO: 423942 - DNA, 15 bp, Homo sapiens
ttaaaaatgacaaac

SEQ ID NO: 423943 - DNA, 15 bp, Homo sapiens
taaaaatgacaaaca

SEQ ID NO: 423944 - DNA, 15 bp, Homo sapiens
aaaaatgacaaacac

SEQ ID NO: 423945 - DNA, 15 bp, Homo sapiens
aaaatgacaaacacg

SEQ ID NO: 423946 - DNA, 15 bp, Homo sapiens
aaatgacaaacacga

SEQ ID NO: 423947 - DNA, 15 bp, Homo sapiens
aatgacaaacacgaa

SEQ ID NO: 423948 - DNA, 15 bp, Homo sapiens
atgacaaacacgaat

SEQ ID NO: 423949 - DNA, 15 bp, Homo sapiens
tgacaaacacgaatg

SEQ ID NO: 423950 - DNA, 15 bp, Homo sapiens
gacaaacacgaatgc

SEQ ID NO: 423951 - DNA, 15 bp, Homo sapiens
acaaacacgaatgca

SEQ ID NO: 423952 - DNA, 15 bp, Homo sapiens
caaacacgaatgcac

SEQ ID NO: 423953 - DNA, 15 bp, Homo sapiens
aaacacgaatgcaca

SEQ ID NO: 423954 - DNA, 15 bp, Homo sapiens
aacacgaatgcacac

SEQ ID NO: 423955 - DNA, 15 bp, Homo sapiens
acacgaatgcacaca

SEQ ID NO: 423956 - DNA, 15 bp, Homo sapiens
cacgaatgcacacat

SEQ ID NO: 423957 - DNA, 15 bp, Homo sapiens
acgaatgcacacatc

SEQ ID NO: 423958 - DNA, 15 bp, Homo sapiens
cgaatgcacacatct

SEQ ID NO: 423959 - DNA, 15 bp, Homo sapiens
gaatgcacacatctc

SEQ ID NO: 423960 - DNA, 15 bp, Homo sapiens
aatgcacacatctcc

SEQ ID NO: 423961 - DNA, 15 bp, Homo sapiens
atgcacacatctcct

SEQ ID NO: 423962 - DNA, 15 bp, Homo sapiens
tgcacacatctccta

SEQ ID NO: 423963 - DNA, 15 bp, Homo sapiens
gcacacatctcctaa

SEQ ID NO: 423964 - DNA, 15 bp, Homo sapiens
cacacatctcctaaa

SEQ ID NO: 423965 - DNA, 15 bp, Homo sapiens
acacatctcctaaag

SEQ ID NO: 423966 - DNA, 15 bp, Homo sapiens
cacatctcctaaagg

SEQ ID NO: 423967 - DNA, 15 bp, Homo sapiens
acatctcctaaagga

SEQ ID NO: 423968 - DNA, 15 bp, Homo sapiens
catctcctaaaggaa

SEQ ID NO: 423969 - DNA, 15 bp, Homo sapiens
atctcctaaaggaaa

SEQ ID NO: 423970 - DNA, 15 bp, Homo sapiens
ctcctaaaggaaaat

SEQ ID NO: 423971 - DNA, 15 bp, Homo sapiens
tcctaaaggaaaatg

SEQ ID NO: 423972 - DNA, 15 bp, Homo sapiens
cctaaaggaaaatgt

SEQ ID NO: 423973 - DNA, 15 bp, Homo sapiens
ctaaaggaaaatgtc

SEQ ID NO: 423974 - DNA, 15 bp, Homo sapiens
taaaggaaaatgtca

SEQ ID NO: 423975 - DNA, 15 bp, Homo sapiens
aaaggaaaatgtcat

SEQ ID NO: 423976 - DNA, 15 bp, Homo sapiens
aaggaaaatgtcatt

SEQ ID NO: 423977 - DNA, 15 bp, Homo sapiens
aggaaaatgtcattt

SEQ ID NO: 423978 - DNA, 15 bp, Homo sapiens
ggaaaatgtcattta

SEQ ID NO: 423979 - DNA, 15 bp, Homo sapiens
gaaaatgtcatttat

SEQ ID NO: 423980 - DNA, 15 bp, Homo sapiens
aaaatgtcatttatg

SEQ ID NO: 423981 - DNA, 15 bp, Homo sapiens
aaatgtcatttatgt

SEQ ID NO: 423982 - DNA, 15 bp, Homo sapiens
aatgtcatttatgta

SEQ ID NO: 423983 - DNA, 15 bp, Homo sapiens
atgtcatttatgtaa

SEQ ID NO: 423984 - DNA, 15 bp, Homo sapiens
tgtcatttatgtaat

SEQ ID NO: 423985 - DNA, 15 bp, Homo sapiens
gtcatttatgtaata

SEQ ID NO: 423986 - DNA, 15 bp, Homo sapiens
tcatttatgtaataa

SEQ ID NO: 423987 - DNA, 15 bp, Homo sapiens
catttatgtaataag

SEQ ID NO: 423988 - DNA, 15 bp, Homo sapiens
atttatgtaataagt

SEQ ID NO: 423989 - DNA, 15 bp, Homo sapiens
tttatgtaataagtt

SEQ ID NO: 423990 - DNA, 15 bp, Homo sapiens
ttatgtaataagttg

SEQ ID NO: 423991 - DNA, 15 bp, Homo sapiens
tatgtaataagttgc

SEQ ID NO: 423992 - DNA, 15 bp, Homo sapiens
atgtaataagttgct

SEQ ID NO: 423993 - DNA, 15 bp, Homo sapiens
tgtaataagttgctt

SEQ ID NO: 423994 - DNA, 15 bp, Homo sapiens
gtaataagttgcttt

SEQ ID NO: 423995 - DNA, 15 bp, Homo sapiens
taataagttgcttta

SEQ ID NO: 423996 - DNA, 15 bp, Homo sapiens
aataagttgctttaa

SEQ ID NO: 423997 - DNA, 15 bp, Homo sapiens
ataagttgctttaat

SEQ ID NO: 423998 - DNA, 15 bp, Homo sapiens
taagttgctttaata

SEQ ID NO: 423999 - DNA, 15 bp, Homo sapiens
aagttgctttaatac

SEQ ID NO: 424000 - DNA, 15 bp, Homo sapiens
agttgctttaataca

SEQ ID NO: 424001 - DNA, 15 bp, Homo sapiens
gttgctttaatacaa

SEQ ID NO: 424002 - DNA, 15 bp, Homo sapiens
ttgctttaatacaaa

SEQ ID NO: 424003 - DNA, 15 bp, Homo sapiens
tgctttaatacaaaa

SEQ ID NO: 424004 - DNA, 15 bp, Homo sapiens
gctttaatacaaaat

SEQ ID NO: 424005 - DNA, 15 bp, Homo sapiens
ctttaatacaaaatg

SEQ ID NO: 424006 - DNA, 15 bp, Homo sapiens
tttaatacaaaatga

SEQ ID NO: 424007 - DNA, 15 bp, Homo sapiens
ttaatacaaaatgat

SEQ ID NO: 424008 - DNA, 15 bp, Homo sapiens
taatacaaaatgata

SEQ ID NO: 424009 - DNA, 15 bp, Homo sapiens
aatacaaaatgataa

SEQ ID NO: 424010 - DNA, 15 bp, Homo sapiens
atacaaaatgataag

SEQ ID NO: 424011 - DNA, 15 bp, Homo sapiens
tacaaaatgataaga

SEQ ID NO: 424012 - DNA, 15 bp, Homo sapiens
acaaaatgataagac

SEQ ID NO: 424013 - DNA, 15 bp, Homo sapiens
caaaatgataagacc

SEQ ID NO: 424014 - DNA, 15 bp, Homo sapiens
aaaatgataagaccc

SEQ ID NO: 424015 - DNA, 15 bp, Homo sapiens
aaatgataagaccct

SEQ ID NO: 424016 - DNA, 15 bp, Homo sapiens
aatgataagaccctg

SEQ ID NO: 424017 - DNA, 15 bp, Homo sapiens
atgataagaccctga

SEQ ID NO: 424018 - DNA, 15 bp, Homo sapiens
tgataagaccctgaa

SEQ ID NO: 424019 - DNA, 15 bp, Homo sapiens
gataagaccctgaaa

SEQ ID NO: 424020 - DNA, 15 bp, Homo sapiens
ataagaccctgaaat

SEQ ID NO: 424021 - DNA, 15 bp, Homo sapiens
taagaccctgaaatt

SEQ ID NO: 424022 - DNA, 15 bp, Homo sapiens
aagaccctgaaattt

SEQ ID NO: 424023 - DNA, 15 bp, Homo sapiens
agaccctgaaattta

SEQ ID NO: 424024 - DNA, 15 bp, Homo sapiens
gaccctgaaatttat

SEQ ID NO: 424025 - DNA, 15 bp, Homo sapiens
accctgaaatttatt

SEQ ID NO: 424026 - DNA, 15 bp, Homo sapiens
ccctgaaatttattt

SEQ ID NO: 424027 - DNA, 15 bp, Homo sapiens
cctgaaatttattta

SEQ ID NO: 424028 - DNA, 15 bp, Homo sapiens
ctgaaatttatttat

SEQ ID NO: 424029 - DNA, 15 bp, Homo sapiens
tgaaatttatttatt

SEQ ID NO: 424030 - DNA, 15 bp, Homo sapiens
gaaatttatttattt

SEQ ID NO: 424031 - DNA, 15 bp, Homo sapiens
aaatttatttatttg

SEQ ID NO: 424032 - DNA, 15 bp, Homo sapiens
aatttatttatttgc

SEQ ID NO: 424033 - DNA, 15 bp, Homo sapiens
atttatttatttgct

SEQ ID NO: 424034 - DNA, 15 bp, Homo sapiens
tttatttatttgctt

SEQ ID NO: 424035 - DNA, 15 bp, Homo sapiens
ttatttatttgcttt

SEQ ID NO: 424036 - DNA, 15 bp, Homo sapiens
tatttatttgctttt

SEQ ID NO: 424037 - DNA, 15 bp, Homo sapiens
atttatttgcttttt

SEQ ID NO: 424038 - DNA, 15 bp, Homo sapiens
tttatttgctttttg

SEQ ID NO: 424039 - DNA, 15 bp, Homo sapiens
ttatttgctttttga

SEQ ID NO: 424040 - DNA, 15 bp, Homo sapiens
tatttgctttttgaa

SEQ ID NO: 424041 - DNA, 15 bp, Homo sapiens
atttgctttttgaac

SEQ ID NO: 424042 - DNA, 15 bp, Homo sapiens
tttgctttttgaacc

SEQ ID NO: 424043 - DNA, 15 bp, Homo sapiens
ttgctttttgaaccc

SEQ ID NO: 424044 - DNA, 15 bp, Homo sapiens
tgctttttgaaccct

SEQ ID NO: 424045 - DNA, 15 bp, Homo sapiens
gctttttgaaccctt

SEQ ID NO: 424046 - DNA, 15 bp, Homo sapiens
ctttttgaacccttg

SEQ ID NO: 424047 - DNA, 15 bp, Homo sapiens
tttttgaacccttgt

SEQ ID NO: 424048 - DNA, 15 bp, Homo sapiens
ttttgaacccttgtg

SEQ ID NO: 424049 - DNA, 15 bp, Homo sapiens
tttgaacccttgtga

SEQ ID NO: 424050 - DNA, 15 bp, Homo sapiens
ttgaacccttgtgac

SEQ ID NO: 424051 - DNA, 15 bp, Homo sapiens
tgaacccttgtgact

SEQ ID NO: 424052 - DNA, 15 bp, Homo sapiens
gaacccttgtgacta

SEQ ID NO: 424053 - DNA, 15 bp, Homo sapiens
aacccttgtgactag

SEQ ID NO: 424054 - DNA, 15 bp, Homo sapiens
acccttgtgactaga

SEQ ID NO: 424055 - DNA, 15 bp, Homo sapiens
cccttgtgactagat

SEQ ID NO: 424056 - DNA, 15 bp, Homo sapiens
ccttgtgactagatt

SEQ ID NO: 424057 - DNA, 15 bp, Homo sapiens
cttgtgactagatta

SEQ ID NO: 424058 - DNA, 15 bp, Homo sapiens
ttgtgactagattat

SEQ ID NO: 424059 - DNA, 15 bp, Homo sapiens
tgtgactagattatc

SEQ ID NO: 424060 - DNA, 15 bp, Homo sapiens
gtgactagattatca

SEQ ID NO: 424061 - DNA, 15 bp, Homo sapiens
tgactagattatcaa

SEQ ID NO: 424062 - DNA, 15 bp, Homo sapiens
gactagattatcaaa

SEQ ID NO: 424063 - DNA, 15 bp, Homo sapiens
actagattatcaaaa

SEQ ID NO: 424064 - DNA, 15 bp, Homo sapiens
ctagattatcaaaat

SEQ ID NO: 424065 - DNA, 15 bp, Homo sapiens
tagattatcaaaatt

SEQ ID NO: 424066 - DNA, 15 bp, Homo sapiens
agattatcaaaatta

SEQ ID NO: 424067 - DNA, 15 bp, Homo sapiens
gattatcaaaattac

SEQ ID NO: 424068 - DNA, 15 bp, Homo sapiens
attatcaaaattacc

SEQ ID NO: 424069 - DNA, 15 bp, Homo sapiens
ttatcaaaattacca

SEQ ID NO: 424070 - DNA, 15 bp, Homo sapiens
tatcaaaattaccat

SEQ ID NO: 424071 - DNA, 15 bp, Homo sapiens
atcaaaattaccatt

SEQ ID NO: 424072 - DNA, 15 bp, Homo sapiens
tcaaaattaccattt

SEQ ID NO: 424073 - DNA, 15 bp, Homo sapiens
caaaattaccatttg

SEQ ID NO: 424074 - DNA, 15 bp, Homo sapiens
aaaattaccatttgg

SEQ ID NO: 424075 - DNA, 15 bp, Homo sapiens
aaattaccatttggg

SEQ ID NO: 424076 - DNA, 15 bp, Homo sapiens
aattaccatttgggt

SEQ ID NO: 424077 - DNA, 15 bp, Homo sapiens
attaccatttgggtg

SEQ ID NO: 424078 - DNA, 15 bp, Homo sapiens
ttaccatttgggtgt

SEQ ID NO: 424079 - DNA, 15 bp, Homo sapiens
taccatttgggtgta

SEQ ID NO: 424080 - DNA, 15 bp, Homo sapiens
accatttgggtgtat

SEQ ID NO: 424081 - DNA, 15 bp, Homo sapiens
ccatttgggtgtatt

SEQ ID NO: 424082 - DNA, 15 bp, Homo sapiens
catttgggtgtattt

SEQ ID NO: 424083 - DNA, 15 bp, Homo sapiens
atttgggtgtatttt

SEQ ID NO: 424084 - DNA, 15 bp, Homo sapiens
tttgggtgtattttt

SEQ ID NO: 424085 - DNA, 15 bp, Homo sapiens
ttgggtgtatttttt

SEQ ID NO: 424086 - DNA, 15 bp, Homo sapiens
tgggtgtattttttt

SEQ ID NO: 424087 - DNA, 15 bp, Homo sapiens
gggtgtatttttttt

SEQ ID NO: 424088 - DNA, 15 bp, Homo sapiens
ggtgtattttttttc

SEQ ID NO: 424089 - DNA, 15 bp, Homo sapiens
gtgtattttttttct

SEQ ID NO: 424090 - DNA, 15 bp, Homo sapiens
tgtattttttttctt

SEQ ID NO: 424091 - DNA, 15 bp, Homo sapiens
gtattttttttcttt

SEQ ID NO: 424092 - DNA, 15 bp, Homo sapiens
tattttttttctttc

SEQ ID NO: 424093 - DNA, 15 bp, Homo sapiens
attttttttctttct

SEQ ID NO: 424094 - DNA, 15 bp, Homo sapiens
ttttttttctttcta

SEQ ID NO: 424095 - DNA, 15 bp, Homo sapiens
tttttttctttctac

SEQ ID NO: 424096 - DNA, 15 bp, Homo sapiens
ttttttctttctact

SEQ ID NO: 424097 - DNA, 15 bp, Homo sapiens
tttttctttctactc

SEQ ID NO: 424098 - DNA, 15 bp, Homo sapiens
ttttctttctactcg

SEQ ID NO: 424099 - DNA, 15 bp, Homo sapiens
tttctttctactcga

SEQ ID NO: 424100 - DNA, 15 bp, Homo sapiens
ttctttctactcgaa

SEQ ID NO: 424101 - DNA, 15 bp, Homo sapiens
tctttctactcgaag

SEQ ID NO: 424102 - DNA, 15 bp, Homo sapiens
ctttctactcgaagc

SEQ ID NO: 424103 - DNA, 15 bp, Homo sapiens
tttctactcgaagca

SEQ ID NO: 424104 - DNA, 15 bp, Homo sapiens
ttctactcgaagcag

SEQ ID NO: 424105 - DNA, 15 bp, Homo sapiens
tctactcgaagcagg

SEQ ID NO: 424106 - DNA, 15 bp, Homo sapiens
ctactcgaagcagga

SEQ ID NO: 424107 - DNA, 15 bp, Homo sapiens
tactcgaagcaggaa

SEQ ID NO: 424108 - DNA, 15 bp, Homo sapiens
actcgaagcaggaat

SEQ ID NO: 424109 - DNA, 15 bp, Homo sapiens
ctcgaagcaggaata

SEQ ID NO: 424110 - DNA, 15 bp, Homo sapiens
tcgaagcaggaatat

SEQ ID NO: 424111 - DNA, 15 bp, Homo sapiens
cgaagcaggaatatg

SEQ ID NO: 424112 - DNA, 15 bp, Homo sapiens
gaagcaggaatatga

SEQ ID NO: 424113 - DNA, 15 bp, Homo sapiens
aagcaggaatatgat

SEQ ID NO: 424114 - DNA, 15 bp, Homo sapiens
agcaggaatatgata

SEQ ID NO: 424115 - DNA, 15 bp, Homo sapiens
gcaggaatatgatag

SEQ ID NO: 424116 - DNA, 15 bp, Homo sapiens
caggaatatgataga

SEQ ID NO: 424117 - DNA, 15 bp, Homo sapiens
aggaatatgatagag

SEQ ID NO: 424118 - DNA, 15 bp, Homo sapiens
ggaatatgatagaga

SEQ ID NO: 424119 - DNA, 15 bp, Homo sapiens
gaatatgatagagaa

SEQ ID NO: 424120 - DNA, 15 bp, Homo sapiens
aatatgatagagaaa

SEQ ID NO: 424121 - DNA, 15 bp, Homo sapiens
atatgatagagaaat

SEQ ID NO: 424122 - DNA, 15 bp, Homo sapiens
tatgatagagaaata

SEQ ID NO: 424123 - DNA, 15 bp, Homo sapiens
atgatagagaaatag

SEQ ID NO: 424124 - DNA, 15 bp, Homo sapiens
tgatagagaaatagc

SEQ ID NO: 424125 - DNA, 15 bp, Homo sapiens
gatagagaaatagct

SEQ ID NO: 424126 - DNA, 15 bp, Homo sapiens
atagagaaatagctc

SEQ ID NO: 424127 - DNA, 15 bp, Homo sapiens
tagagaaatagctcc

SEQ ID NO: 424128 - DNA, 15 bp, Homo sapiens
agagaaatagctcca

SEQ ID NO: 424129 - DNA, 15 bp, Homo sapiens
gagaaatagctccaa

SEQ ID NO: 424130 - DNA, 15 bp, Homo sapiens
agaaatagctccaag

SEQ ID NO: 424131 - DNA, 15 bp, Homo sapiens
gaaatagctccaaga

SEQ ID NO: 424132 - DNA, 15 bp, Homo sapiens
aaatagctccaagat

SEQ ID NO: 424133 - DNA, 15 bp, Homo sapiens
aatagctccaagata

SEQ ID NO: 424134 - DNA, 15 bp, Homo sapiens
atagctccaagataa

SEQ ID NO: 424135 - DNA, 15 bp, Homo sapiens
tagctccaagataag

SEQ ID NO: 424136 - DNA, 15 bp, Homo sapiens
agctccaagataaga

SEQ ID NO: 424137 - DNA, 15 bp, Homo sapiens
gctccaagataagaa

SEQ ID NO: 424138 - DNA, 15 bp, Homo sapiens
ctccaagataagaaa

SEQ ID NO: 424139 - DNA, 15 bp, Homo sapiens
tccaagataagaaaa

SEQ ID NO: 424140 - DNA, 15 bp, Homo sapiens
ccaagataagaaaaa

SEQ ID NO: 424141 - DNA, 15 bp, Homo sapiens
caagataagaaaaag

SEQ ID NO: 424142 - DNA, 15 bp, Homo sapiens
aagataagaaaaagg

SEQ ID NO: 424143 - DNA, 15 bp, Homo sapiens
agataagaaaaagga

SEQ ID NO: 424144 - DNA, 15 bp, Homo sapiens
gataagaaaaaggaa

SEQ ID NO: 424145 - DNA, 15 bp, Homo sapiens
ataagaaaaaggaaa

SEQ ID NO: 424146 - DNA, 15 bp, Homo sapiens
taagaaaaaggaaaa

SEQ ID NO: 424147 - DNA, 15 bp, Homo sapiens
aagaaaaaggaaaac

SEQ ID NO: 424148 - DNA, 15 bp, Homo sapiens
agaaaaaggaaaaca

SEQ ID NO: 424149 - DNA, 15 bp, Homo sapiens
gaaaaaggaaaacac

SEQ ID NO: 424150 - DNA, 15 bp, Homo sapiens
aaaaaggaaaacact

SEQ ID NO: 424151 - DNA, 15 bp, Homo sapiens
aaaaggaaaacactg

SEQ ID NO: 424152 - DNA, 15 bp, Homo sapiens
aaaggaaaacactgt

SEQ ID NO: 424153 - DNA, 15 bp, Homo sapiens
aaggaaaacactgtt

SEQ ID NO: 424154 - DNA, 15 bp, Homo sapiens
aggaaaacactgttg

SEQ ID NO: 424155 - DNA, 15 bp, Homo sapiens
ggaaaacactgttga

SEQ ID NO: 424156 - DNA, 15 bp, Homo sapiens
gaaaacactgttgat

SEQ ID NO: 424157 - DNA, 15 bp, Homo sapiens
aaaacactgttgatg

SEQ ID NO: 424158 - DNA, 15 bp, Homo sapiens
aaacactgttgatgt

SEQ ID NO: 424159 - DNA, 15 bp, Homo sapiens
aacactgttgatgta

SEQ ID NO: 424160 - DNA, 15 bp, Homo sapiens
acactgttgatgtat

SEQ ID NO: 424161 - DNA, 15 bp, Homo sapiens
cactgttgatgtatg

SEQ ID NO: 424162 - DNA, 15 bp, Homo sapiens
actgttgatgtatga

SEQ ID NO: 424163 - DNA, 15 bp, Homo sapiens
ctgttgatgtatgat

SEQ ID NO: 424164 - DNA, 15 bp, Homo sapiens
tgttgatgtatgata

SEQ ID NO: 424165 - DNA, 15 bp, Homo sapiens
gttgatgtatgatat

SEQ ID NO: 424166 - DNA, 15 bp, Homo sapiens
ttgatgtatgatatg

SEQ ID NO: 424167 - DNA, 15 bp, Homo sapiens
tgatgtatgatatgc

SEQ ID NO: 424168 - DNA, 15 bp, Homo sapiens
gatgtatgatatgca

SEQ ID NO: 424169 - DNA, 15 bp, Homo sapiens
atgtatgatatgcaa

SEQ ID NO: 424170 - DNA, 15 bp, Homo sapiens
tgtatgatatgcaag

SEQ ID NO: 424171 - DNA, 15 bp, Homo sapiens
gtatgatatgcaaga

SEQ ID NO: 424172 - DNA, 15 bp, Homo sapiens
tatgatatgcaagat

SEQ ID NO: 424173 - DNA, 15 bp, Homo sapiens
atgatatgcaagata

SEQ ID NO: 424174 - DNA, 15 bp, Homo sapiens
tgatatgcaagataa

SEQ ID NO: 424175 - DNA, 15 bp, Homo sapiens
gatatgcaagataat

SEQ ID NO: 424176 - DNA, 15 bp, Homo sapiens
atatgcaagataata

SEQ ID NO: 424177 - DNA, 15 bp, Homo sapiens
tatgcaagataataa

SEQ ID NO: 424178 - DNA, 15 bp, Homo sapiens
atgcaagataataat

SEQ ID NO: 424179 - DNA, 15 bp, Homo sapiens
tgcaagataataata

SEQ ID NO: 424180 - DNA, 15 bp, Homo sapiens
gcaagataataataa

SEQ ID NO: 424181 - DNA, 15 bp, Homo sapiens
caagataataataat

SEQ ID NO: 424182 - DNA, 15 bp, Homo sapiens
aagataataataata

SEQ ID NO: 424183 - DNA, 15 bp, Homo sapiens
taataataataatag

SEQ ID NO: 424184 - DNA, 15 bp, Homo sapiens
aataataataataga

SEQ ID NO: 424185 - DNA, 15 bp, Homo sapiens
ataataataatagaa

SEQ ID NO: 424186 - DNA, 15 bp, Homo sapiens
taataataatagaag

SEQ ID NO: 424187 - DNA, 15 bp, Homo sapiens
aataataatagaaga

SEQ ID NO: 424188 - DNA, 15 bp, Homo sapiens
ataataatagaagat

SEQ ID NO: 424189 - DNA, 15 bp, Homo sapiens
taataatagaagatt

SEQ ID NO: 424190 - DNA, 15 bp, Homo sapiens
aataatagaagattt

SEQ ID NO: 424191 - DNA, 15 bp, Homo sapiens
ataatagaagattta

SEQ ID NO: 424192 - DNA, 15 bp, Homo sapiens
taatagaagatttaa

SEQ ID NO: 424193 - DNA, 15 bp, Homo sapiens
aatagaagatttaaa

SEQ ID NO: 424194 - DNA, 15 bp, Homo sapiens
atagaagatttaaaa

SEQ ID NO: 424195 - DNA, 15 bp, Homo sapiens
tagaagatttaaaat

SEQ ID NO: 424196 - DNA, 15 bp, Homo sapiens
agaagatttaaaatg

SEQ ID NO: 424197 - DNA, 15 bp, Homo sapiens
gaagatttaaaatga

SEQ ID NO: 424198 - DNA, 15 bp, Homo sapiens
aagatttaaaatgac

SEQ ID NO: 424199 - DNA, 15 bp, Homo sapiens
agatttaaaatgacc

SEQ ID NO: 424200 - DNA, 15 bp, Homo sapiens
gatttaaaatgaccg

SEQ ID NO: 424201 - DNA, 15 bp, Homo sapiens
atttaaaatgaccga

SEQ ID NO: 424202 - DNA, 15 bp, Homo sapiens
tttaaaatgaccgat

SEQ ID NO: 424203 - DNA, 15 bp, Homo sapiens
ttaaaatgaccgatt

SEQ ID NO: 424204 - DNA, 15 bp, Homo sapiens
taaaatgaccgattt

SEQ ID NO: 424205 - DNA, 15 bp, Homo sapiens
aaaatgaccgattta

SEQ ID NO: 424206 - DNA, 15 bp, Homo sapiens
aaatgaccgatttaa

SEQ ID NO: 424207 - DNA, 15 bp, Homo sapiens
aatgaccgatttaag

SEQ ID NO: 424208 - DNA, 15 bp, Homo sapiens
atgaccgatttaaga

SEQ ID NO: 424209 - DNA, 15 bp, Homo sapiens
tgaccgatttaagaa

SEQ ID NO: 424210 - DNA, 15 bp, Homo sapiens
gaccgatttaagaaa

SEQ ID NO: 424211 - DNA, 15 bp, Homo sapiens
accgatttaagaaaa

SEQ ID NO: 424212 - DNA, 15 bp, Homo sapiens
ccgatttaagaaaat

SEQ ID NO: 424213 - DNA, 15 bp, Homo sapiens
cgatttaagaaaatc

SEQ ID NO: 424214 - DNA, 15 bp, Homo sapiens
gatttaagaaaatcc

SEQ ID NO: 424215 - DNA, 15 bp, Homo sapiens
atttaagaaaatcct

SEQ ID NO: 424216 - DNA, 15 bp, Homo sapiens
tttaagaaaatccta

SEQ ID NO: 424217 - DNA, 15 bp, Homo sapiens
ttaagaaaatcctat

SEQ ID NO: 424218 - DNA, 15 bp, Homo sapiens
taagaaaatcctatt

SEQ ID NO: 424219 - DNA, 15 bp, Homo sapiens
aagaaaatcctattc

SEQ ID NO: 424220 - DNA, 15 bp, Homo sapiens
agaaaatcctattct

SEQ ID NO: 424221 - DNA, 15 bp, Homo sapiens
gaaaatcctattctc

SEQ ID NO: 424222 - DNA, 15 bp, Homo sapiens
aaaatcctattctct

SEQ ID NO: 424223 - DNA, 15 bp, Homo sapiens
aaatcctattctctc

SEQ ID NO: 424224 - DNA, 15 bp, Homo sapiens
aatcctattctctcc

SEQ ID NO: 424225 - DNA, 15 bp, Homo sapiens
atcctattctctcct

SEQ ID NO: 424226 - DNA, 15 bp, Homo sapiens
tcctattctctccta

SEQ ID NO: 424227 - DNA, 15 bp, Homo sapiens
cctattctctcctaa

SEQ ID NO: 424228 - DNA, 15 bp, Homo sapiens
ctattctctcctaac

SEQ ID NO: 424229 - DNA, 15 bp, Homo sapiens
tattctctcctaact

SEQ ID NO: 424230 - DNA, 15 bp, Homo sapiens
attctctcctaactt

SEQ ID NO: 424231 - DNA, 15 bp, Homo sapiens
ttctctcctaacttt

SEQ ID NO: 424232 - DNA, 15 bp, Homo sapiens
tctctcctaactttt

SEQ ID NO: 424233 - DNA, 15 bp, Homo sapiens
ctctcctaacttttt

SEQ ID NO: 424234 - DNA, 15 bp, Homo sapiens
tctcctaactttttc

SEQ ID NO: 424235 - DNA, 15 bp, Homo sapiens
ctcctaactttttct

SEQ ID NO: 424236 - DNA, 15 bp, Homo sapiens
tcctaactttttcta

SEQ ID NO: 424237 - DNA, 15 bp, Homo sapiens
cctaactttttctaa

SEQ ID NO: 424238 - DNA, 15 bp, Homo sapiens
ctaactttttctaac

SEQ ID NO: 424239 - DNA, 15 bp, Homo sapiens
taactttttctaact

SEQ ID NO: 424240 - DNA, 15 bp, Homo sapiens
aactttttctaactt

SEQ ID NO: 424241 - DNA, 15 bp, Homo sapiens
actttttctaacttt

SEQ ID NO: 424242 - DNA, 15 bp, Homo sapiens
ctttttctaactttt

SEQ ID NO: 424243 - DNA, 15 bp, Homo sapiens
tttttctaactttta

SEQ ID NO: 424244 - DNA, 15 bp, Homo sapiens
ttttctaacttttac

SEQ ID NO: 424245 - DNA, 15 bp, Homo sapiens
tttctaacttttact

SEQ ID NO: 424246 - DNA, 15 bp, Homo sapiens
ttctaacttttactt

SEQ ID NO: 424247 - DNA, 15 bp, Homo sapiens
tctaacttttacttc

SEQ ID NO: 424248 - DNA, 15 bp, Homo sapiens
ctaacttttacttct

SEQ ID NO: 424249 - DNA, 15 bp, Homo sapiens
taacttttacttcta

SEQ ID NO: 424250 - DNA, 15 bp, Homo sapiens
aacttttacttctat

SEQ ID NO: 424251 - DNA, 15 bp, Homo sapiens
acttttacttctatt

SEQ ID NO: 424252 - DNA, 15 bp, Homo sapiens
cttttacttctatta

SEQ ID NO: 424253 - DNA, 15 bp, Homo sapiens
ttttacttctattaa

SEQ ID NO: 424254 - DNA, 15 bp, Homo sapiens
tttacttctattaat

SEQ ID NO: 424255 - DNA, 15 bp, Homo sapiens
ttacttctattaatt

SEQ ID NO: 424256 - DNA, 15 bp, Homo sapiens
tacttctattaatta

SEQ ID NO: 424257 - DNA, 15 bp, Homo sapiens
acttctattaattat

SEQ ID NO: 424258 - DNA, 15 bp, Homo sapiens
cttctattaattatt

SEQ ID NO: 424259 - DNA, 15 bp, Homo sapiens
ttctattaattattc

SEQ ID NO: 424260 - DNA, 15 bp, Homo sapiens
tctattaattattca

SEQ ID NO: 424261 - DNA, 15 bp, Homo sapiens
ctattaattattcat

SEQ ID NO: 424262 - DNA, 15 bp, Homo sapiens
tattaattattcata

SEQ ID NO: 424263 - DNA, 15 bp, Homo sapiens
attaattattcatac

SEQ ID NO: 424264 - DNA, 15 bp, Homo sapiens
ttaattattcataca

SEQ ID NO: 424265 - DNA, 15 bp, Homo sapiens
taattattcatacag

SEQ ID NO: 424266 - DNA, 15 bp, Homo sapiens
aattattcatacagt

SEQ ID NO: 424267 - DNA, 15 bp, Homo sapiens
attattcatacagta

SEQ ID NO: 424268 - DNA, 15 bp, Homo sapiens
ttattcatacagtag

SEQ ID NO: 424269 - DNA, 15 bp, Homo sapiens
tattcatacagtagt

SEQ ID NO: 424270 - DNA, 15 bp, Homo sapiens
attcatacagtagtc

SEQ ID NO: 424271 - DNA, 15 bp, Homo sapiens
ttcatacagtagtcc

SEQ ID NO: 424272 - DNA, 15 bp, Homo sapiens
tcatacagtagtccc

SEQ ID NO: 424273 - DNA, 15 bp, Homo sapiens
catacagtagtccct

SEQ ID NO: 424274 - DNA, 15 bp, Homo sapiens
atacagtagtccctt

SEQ ID NO: 424275 - DNA, 15 bp, Homo sapiens
tacagtagtcccttt

SEQ ID NO: 424276 - DNA, 15 bp, Homo sapiens
acagtagtccctttt

SEQ ID NO: 424277 - DNA, 15 bp, Homo sapiens
cagtagtcccttttt

SEQ ID NO: 424278 - DNA, 15 bp, Homo sapiens
agtagtccctttttg

SEQ ID NO: 424279 - DNA, 15 bp, Homo sapiens
gtagtccctttttgt

SEQ ID NO: 424280 - DNA, 15 bp, Homo sapiens
tagtccctttttgtg

SEQ ID NO: 424281 - DNA, 15 bp, Homo sapiens
agtccctttttgtgg

SEQ ID NO: 424282 - DNA, 15 bp, Homo sapiens
gtccctttttgtggg

SEQ ID NO: 424283 - DNA, 15 bp, Homo sapiens
tccctttttgtgggt

SEQ ID NO: 424284 - DNA, 15 bp, Homo sapiens
ccctttttgtgggtt

SEQ ID NO: 424285 - DNA, 15 bp, Homo sapiens
cctttttgtgggtta

SEQ ID NO: 424286 - DNA, 15 bp, Homo sapiens
ctttttgtgggttac

SEQ ID NO: 424287 - DNA, 15 bp, Homo sapiens
tttttgtgggttaca

SEQ ID NO: 424288 - DNA, 15 bp, Homo sapiens
ttttgtgggttacag

SEQ ID NO: 424289 - DNA, 15 bp, Homo sapiens
tttgtgggttacagt

SEQ ID NO: 424290 - DNA, 15 bp, Homo sapiens
ttgtgggttacagta

SEQ ID NO: 424291 - DNA, 15 bp, Homo sapiens
tgtgggttacagtat

SEQ ID NO: 424292 - DNA, 15 bp, Homo sapiens
gtgggttacagtatt

SEQ ID NO: 424293 - DNA, 15 bp, Homo sapiens
tgggttacagtatta

SEQ ID NO: 424294 - DNA, 15 bp, Homo sapiens
gggttacagtattag

SEQ ID NO: 424295 - DNA, 15 bp, Homo sapiens
ggttacagtattagg

SEQ ID NO: 424296 - DNA, 15 bp, Homo sapiens
gttacagtattaggg

SEQ ID NO: 424297 - DNA, 15 bp, Homo sapiens
ttacagtattaggga

SEQ ID NO: 424298 - DNA, 15 bp, Homo sapiens
tacagtattagggat

SEQ ID NO: 424299 - DNA, 15 bp, Homo sapiens
acagtattagggatg

SEQ ID NO: 424300 - DNA, 15 bp, Homo sapiens
cagtattagggatga

SEQ ID NO: 424301 - DNA, 15 bp, Homo sapiens
agtattagggatgaa

SEQ ID NO: 424302 - DNA, 15 bp, Homo sapiens
gtattagggatgaaa

SEQ ID NO: 424303 - DNA, 15 bp, Homo sapiens
tattagggatgaaac

SEQ ID NO: 424304 - DNA, 15 bp, Homo sapiens
attagggatgaaaca

SEQ ID NO: 424305 - DNA, 15 bp, Homo sapiens
ttagggatgaaacag

SEQ ID NO: 424306 - DNA, 15 bp, Homo sapiens
tagggatgaaacaga

SEQ ID NO: 424307 - DNA, 15 bp, Homo sapiens
agggatgaaacagaa

SEQ ID NO: 424308 - DNA, 15 bp, Homo sapiens
gggatgaaacagaat

SEQ ID NO: 424309 - DNA, 15 bp, Homo sapiens
ggatgaaacagaata

SEQ ID NO: 424310 - DNA, 15 bp, Homo sapiens
gatgaaacagaataa

SEQ ID NO: 424311 - DNA, 15 bp, Homo sapiens
atgaaacagaataac

SEQ ID NO: 424312 - DNA, 15 bp, Homo sapiens
tgaaacagaataaca

SEQ ID NO: 424313 - DNA, 15 bp, Homo sapiens
gaaacagaataacac

SEQ ID NO: 424314 - DNA, 15 bp, Homo sapiens
aaacagaataacaca

SEQ ID NO: 424315 - DNA, 15 bp, Homo sapiens
aacagaataacacaa

SEQ ID NO: 424316 - DNA, 15 bp, Homo sapiens
acagaataacacaaa

SEQ ID NO: 424317 - DNA, 15 bp, Homo sapiens
cagaataacacaaag

SEQ ID NO: 424318 - DNA, 15 bp, Homo sapiens
agaataacacaaagc

SEQ ID NO: 424319 - DNA, 15 bp, Homo sapiens
gaataacacaaagct

SEQ ID NO: 424320 - DNA, 15 bp, Homo sapiens
aataacacaaagctc

SEQ ID NO: 424321 - DNA, 15 bp, Homo sapiens
ataacacaaagctct

SEQ ID NO: 424322 - DNA, 15 bp, Homo sapiens
taacacaaagctctt

SEQ ID NO: 424323 - DNA, 15 bp, Homo sapiens
aacacaaagctcttc

SEQ ID NO: 424324 - DNA, 15 bp, Homo sapiens
acacaaagctcttct

SEQ ID NO: 424325 - DNA, 15 bp, Homo sapiens
cacaaagctcttcta

SEQ ID NO: 424326 - DNA, 15 bp, Homo sapiens
acaaagctcttctaa

SEQ ID NO: 424327 - DNA, 15 bp, Homo sapiens
caaagctcttctaat

SEQ ID NO: 424328 - DNA, 15 bp, Homo sapiens
aaagctcttctaata

SEQ ID NO: 424329 - DNA, 15 bp, Homo sapiens
aagctcttctaatag

SEQ ID NO: 424330 - DNA, 15 bp, Homo sapiens
agctcttctaataga

SEQ ID NO: 424331 - DNA, 15 bp, Homo sapiens
gctcttctaatagat

SEQ ID NO: 424332 - DNA, 15 bp, Homo sapiens
ctcttctaatagatg

SEQ ID NO: 424333 - DNA, 15 bp, Homo sapiens
tcttctaatagatgt

SEQ ID NO: 424334 - DNA, 15 bp, Homo sapiens
cttctaatagatgtg

SEQ ID NO: 424335 - DNA, 15 bp, Homo sapiens
ttctaatagatgtgc

SEQ ID NO: 424336 - DNA, 15 bp, Homo sapiens
tctaatagatgtgct

SEQ ID NO: 424337 - DNA, 15 bp, Homo sapiens
ctaatagatgtgctc

SEQ ID NO: 424338 - DNA, 15 bp, Homo sapiens
taatagatgtgctct

SEQ ID NO: 424339 - DNA, 15 bp, Homo sapiens
aatagatgtgctctg

SEQ ID NO: 424340 - DNA, 15 bp, Homo sapiens
atagatgtgctctgt

SEQ ID NO: 424341 - DNA, 15 bp, Homo sapiens
tagatgtgctctgta

SEQ ID NO: 424342 - DNA, 15 bp, Homo sapiens
agatgtgctctgtaa

SEQ ID NO: 424343 - DNA, 15 bp, Homo sapiens
gatgtgctctgtaag

SEQ ID NO: 424344 - DNA, 15 bp, Homo sapiens
atgtgctctgtaagg

SEQ ID NO: 424345 - DNA, 15 bp, Homo sapiens
tgtgctctgtaagga

SEQ ID NO: 424346 - DNA, 15 bp, Homo sapiens
gtgctctgtaaggaa

SEQ ID NO: 424347 - DNA, 15 bp, Homo sapiens
tgctctgtaaggaat

SEQ ID NO: 424348 - DNA, 15 bp, Homo sapiens
gctctgtaaggaata

SEQ ID NO: 424349 - DNA, 15 bp, Homo sapiens
ctctgtaaggaatac

SEQ ID NO: 424350 - DNA, 15 bp, Homo sapiens
tctgtaaggaataca

SEQ ID NO: 424351 - DNA, 15 bp, Homo sapiens
ctgtaaggaatacaa

SEQ ID NO: 424352 - DNA, 15 bp, Homo sapiens
tgtaaggaatacaag

SEQ ID NO: 424353 - DNA, 15 bp, Homo sapiens
gtaaggaatacaagc

SEQ ID NO: 424354 - DNA, 15 bp, Homo sapiens
taaggaatacaagct

SEQ ID NO: 424355 - DNA, 15 bp, Homo sapiens
aaggaatacaagctg

SEQ ID NO: 424356 - DNA, 15 bp, Homo sapiens
aggaatacaagctgc

SEQ ID NO: 424357 - DNA, 15 bp, Homo sapiens
ggaatacaagctgct

SEQ ID NO: 424358 - DNA, 15 bp, Homo sapiens
gaatacaagctgctt

SEQ ID NO: 424359 - DNA, 15 bp, Homo sapiens
aatacaagctgctta

SEQ ID NO: 424360 - DNA, 15 bp, Homo sapiens
atacaagctgcttat

SEQ ID NO: 424361 - DNA, 15 bp, Homo sapiens
tacaagctgcttatg

SEQ ID NO: 424362 - DNA, 15 bp, Homo sapiens
acaagctgcttatgg

SEQ ID NO: 424363 - DNA, 15 bp, Homo sapiens
caagctgcttatggc

SEQ ID NO: 424364 - DNA, 15 bp, Homo sapiens
aagctgcttatggcc

SEQ ID NO: 424365 - DNA, 15 bp, Homo sapiens
agctgcttatggcca

SEQ ID NO: 424366 - DNA, 15 bp, Homo sapiens
gctgcttatggccat

SEQ ID NO: 424367 - DNA, 15 bp, Homo sapiens
ctgcttatggccata

SEQ ID NO: 424368 - DNA, 15 bp, Homo sapiens
tgcttatggccatat

SEQ ID NO: 424369 - DNA, 15 bp, Homo sapiens
gcttatggccatatg

SEQ ID NO: 424370 - DNA, 15 bp, Homo sapiens
cttatggccatatgc

SEQ ID NO: 424371 - DNA, 15 bp, Homo sapiens
ttatggccatatgct

SEQ ID NO: 424372 - DNA, 15 bp, Homo sapiens
tatggccatatgcta

SEQ ID NO: 424373 - DNA, 15 bp, Homo sapiens
atggccatatgctaa

SEQ ID NO: 424374 - DNA, 15 bp, Homo sapiens
tggccatatgctaat

SEQ ID NO: 424375 - DNA, 15 bp, Homo sapiens
ggccatatgctaata

SEQ ID NO: 424376 - DNA, 15 bp, Homo sapiens
gccatatgctaatag

SEQ ID NO: 424377 - DNA, 15 bp, Homo sapiens
ccatatgctaatagt

SEQ ID NO: 424378 - DNA, 15 bp, Homo sapiens
catatgctaatagtg

SEQ ID NO: 424379 - DNA, 15 bp, Homo sapiens
atatgctaatagtgt

SEQ ID NO: 424380 - DNA, 15 bp, Homo sapiens
tatgctaatagtgtt

SEQ ID NO: 424381 - DNA, 15 bp, Homo sapiens
atgctaatagtgttt

SEQ ID NO: 424382 - DNA, 15 bp, Homo sapiens
tgctaatagtgttta

SEQ ID NO: 424383 - DNA, 15 bp, Homo sapiens
gctaatagtgtttac

SEQ ID NO: 424384 - DNA, 15 bp, Homo sapiens
ctaatagtgtttacc

SEQ ID NO: 424385 - DNA, 15 bp, Homo sapiens
taatagtgtttaccg

SEQ ID NO: 424386 - DNA, 15 bp, Homo sapiens
aatagtgtttaccga

SEQ ID NO: 424387 - DNA, 15 bp, Homo sapiens
atagtgtttaccgaa

SEQ ID NO: 424388 - DNA, 15 bp, Homo sapiens
tagtgtttaccgaaa

SEQ ID NO: 424389 - DNA, 15 bp, Homo sapiens
agtgtttaccgaaat

SEQ ID NO: 424390 - DNA, 15 bp, Homo sapiens
gtgtttaccgaaatc

SEQ ID NO: 424391 - DNA, 15 bp, Homo sapiens
tgtttaccgaaatcc

SEQ ID NO: 424392 - DNA, 15 bp, Homo sapiens
gtttaccgaaatcca

SEQ ID NO: 424393 - DNA, 15 bp, Homo sapiens
tttaccgaaatccac

SEQ ID NO: 424394 - DNA, 15 bp, Homo sapiens
ttaccgaaatccaca

SEQ ID NO: 424395 - DNA, 15 bp, Homo sapiens
taccgaaatccacat

SEQ ID NO: 424396 - DNA, 15 bp, Homo sapiens
accgaaatccacatc

SEQ ID NO: 424397 - DNA, 15 bp, Homo sapiens
ccgaaatccacatct

SEQ ID NO: 424398 - DNA, 15 bp, Homo sapiens
cgaaatccacatctt

SEQ ID NO: 424399 - DNA, 15 bp, Homo sapiens
gaaatccacatcttg

SEQ ID NO: 424400 - DNA, 15 bp, Homo sapiens
aaatccacatcttga

SEQ ID NO: 424401 - DNA, 15 bp, Homo sapiens
aatccacatcttgag

SEQ ID NO: 424402 - DNA, 15 bp, Homo sapiens
atccacatcttgagg

SEQ ID NO: 424403 - DNA, 15 bp, Homo sapiens
tccacatcttgaggt

SEQ ID NO: 424404 - DNA, 15 bp, Homo sapiens
ccacatcttgaggta

SEQ ID NO: 424405 - DNA, 15 bp, Homo sapiens
cacatcttgaggtat

SEQ ID NO: 424406 - DNA, 15 bp, Homo sapiens
acatcttgaggtatg

SEQ ID NO: 424407 - DNA, 15 bp, Homo sapiens
catcttgaggtatga

SEQ ID NO: 424408 - DNA, 15 bp, Homo sapiens
atcttgaggtatgaa

SEQ ID NO: 424409 - DNA, 15 bp, Homo sapiens
tcttgaggtatgaaa

SEQ ID NO: 424410 - DNA, 15 bp, Homo sapiens
cttgaggtatgaaat

SEQ ID NO: 424411 - DNA, 15 bp, Homo sapiens
ttgaggtatgaaatg

SEQ ID NO: 424412 - DNA, 15 bp, Homo sapiens
tgaggtatgaaatga

SEQ ID NO: 424413 - DNA, 15 bp, Homo sapiens
gaggtatgaaatgat

SEQ ID NO: 424414 - DNA, 15 bp, Homo sapiens
aggtatgaaatgatt

SEQ ID NO: 424415 - DNA, 15 bp, Homo sapiens
ggtatgaaatgattt

SEQ ID NO: 424416 - DNA, 15 bp, Homo sapiens
gtatgaaatgatttt

SEQ ID NO: 424417 - DNA, 15 bp, Homo sapiens
tatgaaatgattttc

SEQ ID NO: 424418 - DNA, 15 bp, Homo sapiens
atgaaatgattttcc

SEQ ID NO: 424419 - DNA, 15 bp, Homo sapiens
tgaaatgattttcct

SEQ ID NO: 424420 - DNA, 15 bp, Homo sapiens
gaaatgattttcctc

SEQ ID NO: 424421 - DNA, 15 bp, Homo sapiens
aaatgattttcctct

SEQ ID NO: 424422 - DNA, 15 bp, Homo sapiens
aatgattttcctctt

SEQ ID NO: 424423 - DNA, 15 bp, Homo sapiens
atgattttcctcttc

SEQ ID NO: 424424 - DNA, 15 bp, Homo sapiens
tgattttcctcttct

SEQ ID NO: 424425 - DNA, 15 bp, Homo sapiens
gattttcctcttctg

SEQ ID NO: 424426 - DNA, 15 bp, Homo sapiens
attttcctcttctgg

SEQ ID NO: 424427 - DNA, 15 bp, Homo sapiens
ttttcctcttctggc

SEQ ID NO: 424428 - DNA, 15 bp, Homo sapiens
tttcctcttctggcc

SEQ ID NO: 424429 - DNA, 15 bp, Homo sapiens
ttcctcttctggcct

SEQ ID NO: 424430 - DNA, 15 bp, Homo sapiens
tcctcttctggcctt

SEQ ID NO: 424431 - DNA, 15 bp, Homo sapiens
cctcttctggcctta

SEQ ID NO: 424432 - DNA, 15 bp, Homo sapiens
ctcttctggccttag

SEQ ID NO: 424433 - DNA, 15 bp, Homo sapiens
tcttctggccttagc

SEQ ID NO: 424434 - DNA, 15 bp, Homo sapiens
cttctggccttagca

SEQ ID NO: 424435 - DNA, 15 bp, Homo sapiens
ttctggccttagcac

SEQ ID NO: 424436 - DNA, 15 bp, Homo sapiens
tctggccttagcaca

SEQ ID NO: 424437 - DNA, 15 bp, Homo sapiens
ctggccttagcacat

SEQ ID NO: 424438 - DNA, 15 bp, Homo sapiens
tggccttagcacata

SEQ ID NO: 424439 - DNA, 15 bp, Homo sapiens
ggccttagcacataa

SEQ ID NO: 424440 - DNA, 15 bp, Homo sapiens
gccttagcacataaa

SEQ ID NO: 424441 - DNA, 15 bp, Homo sapiens
ccttagcacataaag

SEQ ID NO: 424442 - DNA, 15 bp, Homo sapiens
cttagcacataaagt

SEQ ID NO: 424443 - DNA, 15 bp, Homo sapiens
ttagcacataaagta

SEQ ID NO: 424444 - DNA, 15 bp, Homo sapiens
tagcacataaagtat

SEQ ID NO: 424445 - DNA, 15 bp, Homo sapiens
agcacataaagtatg

SEQ ID NO: 424446 - DNA, 15 bp, Homo sapiens
gcacataaagtatgt

SEQ ID NO: 424447 - DNA, 15 bp, Homo sapiens
cacataaagtatgta

SEQ ID NO: 424448 - DNA, 15 bp, Homo sapiens
acataaagtatgtat

SEQ ID NO: 424449 - DNA, 15 bp, Homo sapiens
cataaagtatgtatc

SEQ ID NO: 424450 - DNA, 15 bp, Homo sapiens
ataaagtatgtatca

SEQ ID NO: 424451 - DNA, 15 bp, Homo sapiens
taaagtatgtatcag

SEQ ID NO: 424452 - DNA, 15 bp, Homo sapiens
aaagtatgtatcagc

SEQ ID NO: 424453 - DNA, 15 bp, Homo sapiens
aagtatgtatcagcc

SEQ ID NO: 424454 - DNA, 15 bp, Homo sapiens
agtatgtatcagcct

SEQ ID NO: 424455 - DNA, 15 bp, Homo sapiens
gtatgtatcagcctc

SEQ ID NO: 424456 - DNA, 15 bp, Homo sapiens
tatgtatcagcctct

SEQ ID NO: 424457 - DNA, 15 bp, Homo sapiens
atgtatcagcctctc

SEQ ID NO: 424458 - DNA, 15 bp, Homo sapiens
tgtatcagcctctca

SEQ ID NO: 424459 - DNA, 15 bp, Homo sapiens
gtatcagcctctcag

SEQ ID NO: 424460 - DNA, 15 bp, Homo sapiens
tatcagcctctcagt

SEQ ID NO: 424461 - DNA, 15 bp, Homo sapiens
atcagcctctcagtc

SEQ ID NO: 424462 - DNA, 15 bp, Homo sapiens
tcagcctctcagtct

SEQ ID NO: 424463 - DNA, 15 bp, Homo sapiens
cagcctctcagtctg

SEQ ID NO: 424464 - DNA, 15 bp, Homo sapiens
agcctctcagtctgt

SEQ ID NO: 424465 - DNA, 15 bp, Homo sapiens
gcctctcagtctgtc

SEQ ID NO: 424466 - DNA, 15 bp, Homo sapiens
cctctcagtctgtcc

SEQ ID NO: 424467 - DNA, 15 bp, Homo sapiens
ctctcagtctgtcct

SEQ ID NO: 424468 - DNA, 15 bp, Homo sapiens
tctcagtctgtcctg

SEQ ID NO: 424469 - DNA, 15 bp, Homo sapiens
ctcagtctgtcctgg

SEQ ID NO: 424470 - DNA, 15 bp, Homo sapiens
tcagtctgtcctggc

SEQ ID NO: 424471 - DNA, 15 bp, Homo sapiens
cagtctgtcctggct

SEQ ID NO: 424472 - DNA, 15 bp, Homo sapiens
agtctgtcctggctg

SEQ ID NO: 424473 - DNA, 15 bp, Homo sapiens
gtctgtcctggctgt

SEQ ID NO: 424474 - DNA, 15 bp, Homo sapiens
tctgtcctggctgta

SEQ ID NO: 424475 - DNA, 15 bp, Homo sapiens
ctgtcctggctgtat

SEQ ID NO: 424476 - DNA, 15 bp, Homo sapiens
tgtcctggctgtatt

SEQ ID NO: 424477 - DNA, 15 bp, Homo sapiens
gtcctggctgtattt

SEQ ID NO: 424478 - DNA, 15 bp, Homo sapiens
tcctggctgtatttt

SEQ ID NO: 424479 - DNA, 15 bp, Homo sapiens
cctggctgtattttg

SEQ ID NO: 424480 - DNA, 15 bp, Homo sapiens
ctggctgtattttgg

SEQ ID NO: 424481 - DNA, 15 bp, Homo sapiens
tggctgtattttggc

SEQ ID NO: 424482 - DNA, 15 bp, Homo sapiens
ggctgtattttggcc

SEQ ID NO: 424483 - DNA, 15 bp, Homo sapiens
gctgtattttggcct

SEQ ID NO: 424484 - DNA, 15 bp, Homo sapiens
ctgtattttggcctc

SEQ ID NO: 424485 - DNA, 15 bp, Homo sapiens
tgtattttggcctcc

SEQ ID NO: 424486 - DNA, 15 bp, Homo sapiens
tatgcagtagagtaa

SEQ ID NO: 424487 - DNA, 15 bp, Homo sapiens
atgcagtagagtaag

SEQ ID NO: 424488 - DNA, 15 bp, Homo sapiens
tgcagtagagtaagg

SEQ ID NO: 424489 - DNA, 15 bp, Homo sapiens
gcagtagagtaaggg

SEQ ID NO: 424490 - DNA, 15 bp, Homo sapiens
cagtagagtaagggg

SEQ ID NO: 424491 - DNA, 15 bp, Homo sapiens
agtagagtaaggggt

SEQ ID NO: 424492 - DNA, 15 bp, Homo sapiens
gtagagtaaggggtg

SEQ ID NO: 424493 - DNA, 15 bp, Homo sapiens
tagagtaaggggtgc

SEQ ID NO: 424494 - DNA, 15 bp, Homo sapiens
agagtaaggggtgct

SEQ ID NO: 424495 - DNA, 15 bp, Homo sapiens
gagtaaggggtgctg

SEQ ID NO: 424496 - DNA, 15 bp, Homo sapiens
agtaaggggtgctgc

SEQ ID NO: 424497 - DNA, 15 bp, Homo sapiens
gtaaggggtgctgct

SEQ ID NO: 424498 - DNA, 15 bp, Homo sapiens
taaggggtgctgctt

SEQ ID NO: 424499 - DNA, 15 bp, Homo sapiens
aaggggtgctgctta

SEQ ID NO: 424500 - DNA, 15 bp, Homo sapiens
aggggtgctgcttac

SEQ ID NO: 424501 - DNA, 15 bp, Homo sapiens
ggggtgctgcttacc

SEQ ID NO: 424502 - DNA, 15 bp, Homo sapiens
gggtgctgcttacct

SEQ ID NO: 424503 - DNA, 15 bp, Homo sapiens
ggtgctgcttacctc

SEQ ID NO: 424504 - DNA, 15 bp, Homo sapiens
gtgctgcttacctcc

SEQ ID NO: 424505 - DNA, 15 bp, Homo sapiens
tgctgcttacctcct

SEQ ID NO: 424506 - DNA, 15 bp, Homo sapiens
gctgcttacctcctt

SEQ ID NO: 424507 - DNA, 15 bp, Homo sapiens
ctgcttacctccttt

SEQ ID NO: 424508 - DNA, 15 bp, Homo sapiens
tgcttacctcctttt

SEQ ID NO: 424509 - DNA, 15 bp, Homo sapiens
gcttacctccttttg

SEQ ID NO: 424510 - DNA, 15 bp, Homo sapiens
cttacctccttttgt

SEQ ID NO: 424511 - DNA, 15 bp, Homo sapiens
ttacctccttttgtg

SEQ ID NO: 424512 - DNA, 15 bp, Homo sapiens
tacctccttttgtga

SEQ ID NO: 424513 - DNA, 15 bp, Homo sapiens
acctccttttgtgat

SEQ ID NO: 424514 - DNA, 15 bp, Homo sapiens
cctccttttgtgatg

SEQ ID NO: 424515 - DNA, 15 bp, Homo sapiens
ctccttttgtgatga

SEQ ID NO: 424516 - DNA, 15 bp, Homo sapiens
tccttttgtgatgat

SEQ ID NO: 424517 - DNA, 15 bp, Homo sapiens
ccttttgtgatgata

SEQ ID NO: 424518 - DNA, 15 bp, Homo sapiens
cttttgtgatgatac

SEQ ID NO: 424519 - DNA, 15 bp, Homo sapiens
ttttgtgatgatact

SEQ ID NO: 424520 - DNA, 15 bp, Homo sapiens
tttgtgatgatactt

SEQ ID NO: 424521 - DNA, 15 bp, Homo sapiens
ttgtgatgatactta

SEQ ID NO: 424522 - DNA, 15 bp, Homo sapiens
tgtgatgatacttag

SEQ ID NO: 424523 - DNA, 15 bp, Homo sapiens
gtgatgatacttaga

SEQ ID NO: 424524 - DNA, 15 bp, Homo sapiens
tgatgatacttagaa

SEQ ID NO: 424525 - DNA, 15 bp, Homo sapiens
gatgatacttagaat

SEQ ID NO: 424526 - DNA, 15 bp, Homo sapiens
atgatacttagaata

SEQ ID NO: 424527 - DNA, 15 bp, Homo sapiens
tgatacttagaataa

SEQ ID NO: 424528 - DNA, 15 bp, Homo sapiens
gatacttagaataag

SEQ ID NO: 424529 - DNA, 15 bp, Homo sapiens
atacttagaataaga

SEQ ID NO: 424530 - DNA, 15 bp, Homo sapiens
tacttagaataagac

SEQ ID NO: 424531 - DNA, 15 bp, Homo sapiens
acttagaataagact

SEQ ID NO: 424532 - DNA, 15 bp, Homo sapiens
cttagaataagactg

SEQ ID NO: 424533 - DNA, 15 bp, Homo sapiens
ttagaataagactga

SEQ ID NO: 424534 - DNA, 15 bp, Homo sapiens
tagaataagactgaa

SEQ ID NO: 424535 - DNA, 15 bp, Homo sapiens
agaataagactgaaa

SEQ ID NO: 424536 - DNA, 15 bp, Homo sapiens
gaataagactgaaag

SEQ ID NO: 424537 - DNA, 15 bp, Homo sapiens
aataagactgaaaga

SEQ ID NO: 424538 - DNA, 15 bp, Homo sapiens
ataagactgaaagaa

SEQ ID NO: 424539 - DNA, 15 bp, Homo sapiens
taagactgaaagaag

SEQ ID NO: 424540 - DNA, 15 bp, Homo sapiens
aagactgaaagaaga

SEQ ID NO: 424541 - DNA, 15 bp, Homo sapiens
agactgaaagaagaa

SEQ ID NO: 424542 - DNA, 15 bp, Homo sapiens
gactgaaagaagaaa

SEQ ID NO: 424543 - DNA, 15 bp, Homo sapiens
actgaaagaagaaaa

SEQ ID NO: 424544 - DNA, 15 bp, Homo sapiens
ctgaaagaagaaaat

SEQ ID NO: 424545 - DNA, 15 bp, Homo sapiens
tgaaagaagaaaata

SEQ ID NO: 424546 - DNA, 15 bp, Homo sapiens
gaaagaagaaaatac

SEQ ID NO: 424547 - DNA, 15 bp, Homo sapiens
aaagaagaaaataca

SEQ ID NO: 424548 - DNA, 15 bp, Homo sapiens
aagaagaaaatacaa

SEQ ID NO: 424549 - DNA, 15 bp, Homo sapiens
agaagaaaatacaag

SEQ ID NO: 424550 - DNA, 15 bp, Homo sapiens
gaagaaaatacaagt

SEQ ID NO: 424551 - DNA, 15 bp, Homo sapiens
aagaaaatacaagtt

SEQ ID NO: 424552 - DNA, 15 bp, Homo sapiens
agaaaatacaagttc

SEQ ID NO: 424553 - DNA, 15 bp, Homo sapiens
gaaaatacaagttca

SEQ ID NO: 424554 - DNA, 15 bp, Homo sapiens
aaaatacaagttcag

SEQ ID NO: 424555 - DNA, 15 bp, Homo sapiens
aaatacaagttcagc

SEQ ID NO: 424556 - DNA, 15 bp, Homo sapiens
aatacaagttcagca

SEQ ID NO: 424557 - DNA, 15 bp, Homo sapiens
atacaagttcagcac

SEQ ID NO: 424558 - DNA, 15 bp, Homo sapiens
tacaagttcagcacc

SEQ ID NO: 424559 - DNA, 15 bp, Homo sapiens
acaagttcagcacct

SEQ ID NO: 424560 - DNA, 15 bp, Homo sapiens
caagttcagcaccta

SEQ ID NO: 424561 - DNA, 15 bp, Homo sapiens
aagttcagcacctaa

SEQ ID NO: 424562 - DNA, 15 bp, Homo sapiens
agttcagcacctaat

SEQ ID NO: 424563 - DNA, 15 bp, Homo sapiens
gttcagcacctaatc

SEQ ID NO: 424564 - DNA, 15 bp, Homo sapiens
ttcagcacctaatcc

SEQ ID NO: 424565 - DNA, 15 bp, Homo sapiens
tcagcacctaatcca

SEQ ID NO: 424566 - DNA, 15 bp, Homo sapiens
cagcacctaatccag

SEQ ID NO: 424567 - DNA, 15 bp, Homo sapiens
agcacctaatccagt

SEQ ID NO: 424568 - DNA, 15 bp, Homo sapiens
gcacctaatccagtg

SEQ ID NO: 424569 - DNA, 15 bp, Homo sapiens
cacctaatccagtgc

SEQ ID NO: 424570 - DNA, 15 bp, Homo sapiens
acctaatccagtgcc

SEQ ID NO: 424571 - DNA, 15 bp, Homo sapiens
cctaatccagtgcca

SEQ ID NO: 424572 - DNA, 15 bp, Homo sapiens
ctaatccagtgccac

SEQ ID NO: 424573 - DNA, 15 bp, Homo sapiens
taatccagtgccaca

SEQ ID NO: 424574 - DNA, 15 bp, Homo sapiens
aatccagtgccacat

SEQ ID NO: 424575 - DNA, 15 bp, Homo sapiens
atccagtgccacatt

SEQ ID NO: 424576 - DNA, 15 bp, Homo sapiens
tccagtgccacatta

SEQ ID NO: 424577 - DNA, 15 bp, Homo sapiens
ccagtgccacattag

SEQ ID NO: 424578 - DNA, 15 bp, Homo sapiens
cagtgccacattaga

SEQ ID NO: 424579 - DNA, 15 bp, Homo sapiens
agtgccacattagaa

SEQ ID NO: 424580 - DNA, 15 bp, Homo sapiens
gtgccacattagaat

SEQ ID NO: 424581 - DNA, 15 bp, Homo sapiens
tgccacattagaata

SEQ ID NO: 424582 - DNA, 15 bp, Homo sapiens
gccacattagaatag

SEQ ID NO: 424583 - DNA, 15 bp, Homo sapiens
ccacattagaatagg

SEQ ID NO: 424584 - DNA, 15 bp, Homo sapiens
cacattagaataggt

SEQ ID NO: 424585 - DNA, 15 bp, Homo sapiens
acattagaataggta

SEQ ID NO: 424586 - DNA, 15 bp, Homo sapiens
cattagaataggtac

SEQ ID NO: 424587 - DNA, 15 bp, Homo sapiens
attagaataggtact

SEQ ID NO: 424588 - DNA, 15 bp, Homo sapiens
ttagaataggtacta

SEQ ID NO: 424589 - DNA, 15 bp, Homo sapiens
tagaataggtactaa

SEQ ID NO: 424590 - DNA, 15 bp, Homo sapiens
agaataggtactaat

SEQ ID NO: 424591 - DNA, 15 bp, Homo sapiens
gaataggtactaatt

SEQ ID NO: 424592 - DNA, 15 bp, Homo sapiens
aataggtactaattg

SEQ ID NO: 424593 - DNA, 15 bp, Homo sapiens
ataggtactaattga

SEQ ID NO: 424594 - DNA, 15 bp, Homo sapiens
taggtactaattgag

SEQ ID NO: 424595 - DNA, 15 bp, Homo sapiens
aggtactaattgagg

SEQ ID NO: 424596 - DNA, 15 bp, Homo sapiens
ggtactaattgagga

SEQ ID NO: 424597 - DNA, 15 bp, Homo sapiens
gtactaattgaggat

SEQ ID NO: 424598 - DNA, 15 bp, Homo sapiens
tactaattgaggatc

SEQ ID NO: 424599 - DNA, 15 bp, Homo sapiens
actaattgaggatcc

SEQ ID NO: 424600 - DNA, 15 bp, Homo sapiens
ctaattgaggatccc

SEQ ID NO: 424601 - DNA, 15 bp, Homo sapiens
taattgaggatccct

SEQ ID NO: 424602 - DNA, 15 bp, Homo sapiens
aattgaggatccctt

SEQ ID NO: 424603 - DNA, 15 bp, Homo sapiens
attgaggatccctta

SEQ ID NO: 424604 - DNA, 15 bp, Homo sapiens
ttgaggatcccttag

SEQ ID NO: 424605 - DNA, 15 bp, Homo sapiens
tgaggatcccttagt

SEQ ID NO: 424606 - DNA, 15 bp, Homo sapiens
gaggatcccttagtg

SEQ ID NO: 424607 - DNA, 15 bp, Homo sapiens
aggatcccttagtga

SEQ ID NO: 424608 - DNA, 15 bp, Homo sapiens
ggatcccttagtgaa

SEQ ID NO: 424609 - DNA, 15 bp, Homo sapiens
gatcccttagtgaaa

SEQ ID NO: 424610 - DNA, 15 bp, Homo sapiens
atcccttagtgaaat

SEQ ID NO: 424611 - DNA, 15 bp, Homo sapiens
tcccttagtgaaata

SEQ ID NO: 424612 - DNA, 15 bp, Homo sapiens
cccttagtgaaatat

SEQ ID NO: 424613 - DNA, 15 bp, Homo sapiens
ccttagtgaaatatt

SEQ ID NO: 424614 - DNA, 15 bp, Homo sapiens
cttagtgaaatattt

SEQ ID NO: 424615 - DNA, 15 bp, Homo sapiens
ttagtgaaatatttg

SEQ ID NO: 424616 - DNA, 15 bp, Homo sapiens
tagtgaaatatttgg

SEQ ID NO: 424617 - DNA, 15 bp, Homo sapiens
agtgaaatatttggg

SEQ ID NO: 424618 - DNA, 15 bp, Homo sapiens
gtgaaatatttggga

SEQ ID NO: 424619 - DNA, 15 bp, Homo sapiens
tgaaatatttgggac

SEQ ID NO: 424620 - DNA, 15 bp, Homo sapiens
gaaatatttgggacc

SEQ ID NO: 424621 - DNA, 15 bp, Homo sapiens
aaatatttgggacca

SEQ ID NO: 424622 - DNA, 15 bp, Homo sapiens
aatatttgggaccaa

SEQ ID NO: 424623 - DNA, 15 bp, Homo sapiens
atatttgggaccaaa

SEQ ID NO: 424624 - DNA, 15 bp, Homo sapiens
tatttgggaccaaaa

SEQ ID NO: 424625 - DNA, 15 bp, Homo sapiens
atttgggaccaaaag

SEQ ID NO: 424626 - DNA, 15 bp, Homo sapiens
tttgggaccaaaagt

SEQ ID NO: 424627 - DNA, 15 bp, Homo sapiens
ttgggaccaaaagta

SEQ ID NO: 424628 - DNA, 15 bp, Homo sapiens
tgggaccaaaagtat

SEQ ID NO: 424629 - DNA, 15 bp, Homo sapiens
gggaccaaaagtatt

SEQ ID NO: 424630 - DNA, 15 bp, Homo sapiens
ggaccaaaagtattt

SEQ ID NO: 424631 - DNA, 15 bp, Homo sapiens
gaccaaaagtattta

SEQ ID NO: 424632 - DNA, 15 bp, Homo sapiens
accaaaagtatttag

SEQ ID NO: 424633 - DNA, 15 bp, Homo sapiens
ccaaaagtatttaga

SEQ ID NO: 424634 - DNA, 15 bp, Homo sapiens
caaaagtatttagat

SEQ ID NO: 424635 - DNA, 15 bp, Homo sapiens
aaaagtatttagatt

SEQ ID NO: 424636 - DNA, 15 bp, Homo sapiens
aaagtatttagattt

SEQ ID NO: 424637 - DNA, 15 bp, Homo sapiens
aagtatttagatttc

SEQ ID NO: 424638 - DNA, 15 bp, Homo sapiens
tatttagatttcaga

SEQ ID NO: 424639 - DNA, 15 bp, Homo sapiens
atttagatttcagat

SEQ ID NO: 424640 - DNA, 15 bp, Homo sapiens
tttagatttcagatt

SEQ ID NO: 424641 - DNA, 15 bp, Homo sapiens
ttagatttcagattt

SEQ ID NO: 424642 - DNA, 15 bp, Homo sapiens
tagatttcagatttt

SEQ ID NO: 424643 - DNA, 15 bp, Homo sapiens
agatttcagattttt

SEQ ID NO: 424644 - DNA, 15 bp, Homo sapiens
gatttcagatttttt

SEQ ID NO: 424645 - DNA, 15 bp, Homo sapiens
atttcagattttttc

SEQ ID NO: 424646 - DNA, 15 bp, Homo sapiens
tttcagattttttca

SEQ ID NO: 424647 - DNA, 15 bp, Homo sapiens
ttcagattttttcat

SEQ ID NO: 424648 - DNA, 15 bp, Homo sapiens
tcagattttttcata

SEQ ID NO: 424649 - DNA, 15 bp, Homo sapiens
cagattttttcatat

SEQ ID NO: 424650 - DNA, 15 bp, Homo sapiens
agattttttcatatt

SEQ ID NO: 424651 - DNA, 15 bp, Homo sapiens
gattttttcatattt

SEQ ID NO: 424652 - DNA, 15 bp, Homo sapiens
attttttcatatttt

SEQ ID NO: 424653 - DNA, 15 bp, Homo sapiens
ttttttcatattttc

SEQ ID NO: 424654 - DNA, 15 bp, Homo sapiens
tttttcatattttcg

SEQ ID NO: 424655 - DNA, 15 bp, Homo sapiens
ttttcatattttcga

SEQ ID NO: 424656 - DNA, 15 bp, Homo sapiens
tttcatattttcgaa

SEQ ID NO: 424657 - DNA, 15 bp, Homo sapiens
ttcatattttcgaat

SEQ ID NO: 424658 - DNA, 15 bp, Homo sapiens
tcatattttcgaata

SEQ ID NO: 424659 - DNA, 15 bp, Homo sapiens
catattttcgaatat

SEQ ID NO: 424660 - DNA, 15 bp, Homo sapiens
atattttcgaatatt

SEQ ID NO: 424661 - DNA, 15 bp, Homo sapiens
tattttcgaatattt

SEQ ID NO: 424662 - DNA, 15 bp, Homo sapiens
attttcgaatatttg

SEQ ID NO: 424663 - DNA, 15 bp, Homo sapiens
ttttcgaatatttgc

SEQ ID NO: 424664 - DNA, 15 bp, Homo sapiens
tttcgaatatttgca

SEQ ID NO: 424665 - DNA, 15 bp, Homo sapiens
ttcgaatatttgcat

SEQ ID NO: 424666 - DNA, 15 bp, Homo sapiens
tcgaatatttgcatt

SEQ ID NO: 424667 - DNA, 15 bp, Homo sapiens
cgaatatttgcatta

SEQ ID NO: 424668 - DNA, 15 bp, Homo sapiens
gaatatttgcattac

SEQ ID NO: 424669 - DNA, 15 bp, Homo sapiens
aatatttgcattaca

SEQ ID NO: 424670 - DNA, 15 bp, Homo sapiens
atatttgcattacac

SEQ ID NO: 424671 - DNA, 15 bp, Homo sapiens
tatttgcattacact

SEQ ID NO: 424672 - DNA, 15 bp, Homo sapiens
atttgcattacactt

SEQ ID NO: 424673 - DNA, 15 bp, Homo sapiens
tttgcattacactta

SEQ ID NO: 424674 - DNA, 15 bp, Homo sapiens
ttgcattacacttac

SEQ ID NO: 424675 - DNA, 15 bp, Homo sapiens
tgcattacacttacc

SEQ ID NO: 424676 - DNA, 15 bp, Homo sapiens
gcattacacttacca

SEQ ID NO: 424677 - DNA, 15 bp, Homo sapiens
cattacacttaccag

SEQ ID NO: 424678 - DNA, 15 bp, Homo sapiens
attacacttaccagg

SEQ ID NO: 424679 - DNA, 15 bp, Homo sapiens
ttacacttaccaggt

SEQ ID NO: 424680 - DNA, 15 bp, Homo sapiens
tacacttaccaggtg

SEQ ID NO: 424681 - DNA, 15 bp, Homo sapiens
acacttaccaggtga

SEQ ID NO: 424682 - DNA, 15 bp, Homo sapiens
cacttaccaggtgac

SEQ ID NO: 424683 - DNA, 15 bp, Homo sapiens
acttaccaggtgacc

SEQ ID NO: 424684 - DNA, 15 bp, Homo sapiens
cttaccaggtgacca

SEQ ID NO: 424685 - DNA, 15 bp, Homo sapiens
ttaccaggtgaccat

SEQ ID NO: 424686 - DNA, 15 bp, Homo sapiens
taccaggtgaccatc

SEQ ID NO: 424687 - DNA, 15 bp, Homo sapiens
accaggtgaccatcc

SEQ ID NO: 424688 - DNA, 15 bp, Homo sapiens
ccaggtgaccatccc

SEQ ID NO: 424689 - DNA, 15 bp, Homo sapiens
caggtgaccatccct

SEQ ID NO: 424690 - DNA, 15 bp, Homo sapiens
aggtgaccatcccta

SEQ ID NO: 424691 - DNA, 15 bp, Homo sapiens
ggtgaccatccctaa

SEQ ID NO: 424692 - DNA, 15 bp, Homo sapiens
gtgaccatccctaat

SEQ ID NO: 424693 - DNA, 15 bp, Homo sapiens
tgaccatccctaatc

SEQ ID NO: 424694 - DNA, 15 bp, Homo sapiens
gaccatccctaatca

SEQ ID NO: 424695 - DNA, 15 bp, Homo sapiens
accatccctaatcag

SEQ ID NO: 424696 - DNA, 15 bp, Homo sapiens
ccatccctaatcaga

SEQ ID NO: 424697 - DNA, 15 bp, Homo sapiens
catccctaatcagaa

SEQ ID NO: 424698 - DNA, 15 bp, Homo sapiens
atccctaatcagaaa

SEQ ID NO: 424699 - DNA, 15 bp, Homo sapiens
tccctaatcagaaaa

SEQ ID NO: 424700 - DNA, 15 bp, Homo sapiens
ccctaatcagaaaat

SEQ ID NO: 424701 - DNA, 15 bp, Homo sapiens
cctaatcagaaaatc

SEQ ID NO: 424702 - DNA, 15 bp, Homo sapiens
ctaatcagaaaatct

SEQ ID NO: 424703 - DNA, 15 bp, Homo sapiens
taatcagaaaatctg

SEQ ID NO: 424704 - DNA, 15 bp, Homo sapiens
aatcagaaaatctga

SEQ ID NO: 424705 - DNA, 15 bp, Homo sapiens
atcagaaaatctgaa

SEQ ID NO: 424706 - DNA, 15 bp, Homo sapiens
tcagaaaatctgaaa

SEQ ID NO: 424707 - DNA, 15 bp, Homo sapiens
cagaaaatctgaaat

SEQ ID NO: 424708 - DNA, 15 bp, Homo sapiens
agaaaatctgaaatt

SEQ ID NO: 424709 - DNA, 15 bp, Homo sapiens
gaaaatctgaaattc

SEQ ID NO: 424710 - DNA, 15 bp, Homo sapiens
aaaatctgaaattca

SEQ ID NO: 424711 - DNA, 15 bp, Homo sapiens
aaatctgaaattcaa

SEQ ID NO: 424712 - DNA, 15 bp, Homo sapiens
aatctgaaattcaaa

SEQ ID NO: 424713 - DNA, 15 bp, Homo sapiens
atctgaaattcaaaa

SEQ ID NO: 424714 - DNA, 15 bp, Homo sapiens
tctgaaattcaaaat

SEQ ID NO: 424715 - DNA, 15 bp, Homo sapiens
ctgaaattcaaaatg

SEQ ID NO: 424716 - DNA, 15 bp, Homo sapiens
tgaaattcaaaatgc

SEQ ID NO: 424717 - DNA, 15 bp, Homo sapiens
gaaattcaaaatgct

SEQ ID NO: 424718 - DNA, 15 bp, Homo sapiens
aaattcaaaatgctc

SEQ ID NO: 424719 - DNA, 15 bp, Homo sapiens
aattcaaaatgctcc

SEQ ID NO: 424720 - DNA, 15 bp, Homo sapiens
attcaaaatgctcct

SEQ ID NO: 424721 - DNA, 15 bp, Homo sapiens
ttcaaaatgctccta

SEQ ID NO: 424722 - DNA, 15 bp, Homo sapiens
tcaaaatgctcctaa

SEQ ID NO: 424723 - DNA, 15 bp, Homo sapiens
caaaatgctcctaag

SEQ ID NO: 424724 - DNA, 15 bp, Homo sapiens
aaaatgctcctaaga

SEQ ID NO: 424725 - DNA, 15 bp, Homo sapiens
aaatgctcctaagag

SEQ ID NO: 424726 - DNA, 15 bp, Homo sapiens
aatgctcctaagagc

SEQ ID NO: 424727 - DNA, 15 bp, Homo sapiens
atgctcctaagagca

SEQ ID NO: 424728 - DNA, 15 bp, Homo sapiens
tgctcctaagagcat

SEQ ID NO: 424729 - DNA, 15 bp, Homo sapiens
gctcctaagagcatt

SEQ ID NO: 424730 - DNA, 15 bp, Homo sapiens
ctcctaagagcattt

SEQ ID NO: 424731 - DNA, 15 bp, Homo sapiens
tcctaagagcatttc

SEQ ID NO: 424732 - DNA, 15 bp, Homo sapiens
cctaagagcatttcc

SEQ ID NO: 424733 - DNA, 15 bp, Homo sapiens
ctaagagcatttcct

SEQ ID NO: 424734 - DNA, 15 bp, Homo sapiens
taagagcatttcctt

SEQ ID NO: 424735 - DNA, 15 bp, Homo sapiens
aagagcatttccttt

SEQ ID NO: 424736 - DNA, 15 bp, Homo sapiens
agagcatttcctttg

SEQ ID NO: 424737 - DNA, 15 bp, Homo sapiens
gagcatttcctttga

SEQ ID NO: 424738 - DNA, 15 bp, Homo sapiens
agcatttcctttgag

SEQ ID NO: 424739 - DNA, 15 bp, Homo sapiens
gcatttcctttgagt

SEQ ID NO: 424740 - DNA, 15 bp, Homo sapiens
catttcctttgagta

SEQ ID NO: 424741 - DNA, 15 bp, Homo sapiens
atttcctttgagtaa

SEQ ID NO: 424742 - DNA, 15 bp, Homo sapiens
tttcctttgagtaac

SEQ ID NO: 424743 - DNA, 15 bp, Homo sapiens
tcctttgagtaacaa

SEQ ID NO: 424744 - DNA, 15 bp, Homo sapiens
cctttgagtaacaat

SEQ ID NO: 424745 - DNA, 15 bp, Homo sapiens
ctttgagtaacaata

SEQ ID NO: 424746 - DNA, 15 bp, Homo sapiens
tttgagtaacaatat

SEQ ID NO: 424747 - DNA, 15 bp, Homo sapiens
ttgagtaacaatatt

SEQ ID NO: 424748 - DNA, 15 bp, Homo sapiens
tgagtaacaatattg

SEQ ID NO: 424749 - DNA, 15 bp, Homo sapiens
gagtaacaatattga

SEQ ID NO: 424750 - DNA, 15 bp, Homo sapiens
agtaacaatattgac

SEQ ID NO: 424751 - DNA, 15 bp, Homo sapiens
gtaacaatattgaca

SEQ ID NO: 424752 - DNA, 15 bp, Homo sapiens
taacaatattgacac

SEQ ID NO: 424753 - DNA, 15 bp, Homo sapiens
aacaatattgacact

SEQ ID NO: 424754 - DNA, 15 bp, Homo sapiens
acaatattgacactc

SEQ ID NO: 424755 - DNA, 15 bp, Homo sapiens
caatattgacactca

SEQ ID NO: 424756 - DNA, 15 bp, Homo sapiens
aatattgacactcag

SEQ ID NO: 424757 - DNA, 15 bp, Homo sapiens
atattgacactcaga

SEQ ID NO: 424758 - DNA, 15 bp, Homo sapiens
tattgacactcagaa

SEQ ID NO: 424759 - DNA, 15 bp, Homo sapiens
attgacactcagaaa

SEQ ID NO: 424760 - DNA, 15 bp, Homo sapiens
ttgacactcagaaat

SEQ ID NO: 424761 - DNA, 15 bp, Homo sapiens
tgacactcagaaatg

SEQ ID NO: 424762 - DNA, 15 bp, Homo sapiens
gacactcagaaatgt

SEQ ID NO: 424763 - DNA, 15 bp, Homo sapiens
acactcagaaatgtt

SEQ ID NO: 424764 - DNA, 15 bp, Homo sapiens
cactcagaaatgttt

SEQ ID NO: 424765 - DNA, 15 bp, Homo sapiens
actcagaaatgtttg

SEQ ID NO: 424766 - DNA, 15 bp, Homo sapiens
ctcagaaatgtttgg

SEQ ID NO: 424767 - DNA, 15 bp, Homo sapiens
tcagaaatgtttgga

SEQ ID NO: 424768 - DNA, 15 bp, Homo sapiens
cagaaatgtttggat

SEQ ID NO: 424769 - DNA, 15 bp, Homo sapiens
agaaatgtttggatt

SEQ ID NO: 424770 - DNA, 15 bp, Homo sapiens
gaaatgtttggattt

SEQ ID NO: 424771 - DNA, 15 bp, Homo sapiens
aaatgtttggatttt

SEQ ID NO: 424772 - DNA, 15 bp, Homo sapiens
aatgtttggattttg

SEQ ID NO: 424773 - DNA, 15 bp, Homo sapiens
atgtttggattttgg

SEQ ID NO: 424774 - DNA, 15 bp, Homo sapiens
tgtttggattttggt

SEQ ID NO: 424775 - DNA, 15 bp, Homo sapiens
gtttggattttggtg

SEQ ID NO: 424776 - DNA, 15 bp, Homo sapiens
tttggattttggtgt

SEQ ID NO: 424777 - DNA, 15 bp, Homo sapiens
ttggattttggtgta

SEQ ID NO: 424778 - DNA, 15 bp, Homo sapiens
tggattttggtgtat

SEQ ID NO: 424779 - DNA, 15 bp, Homo sapiens
ggattttggtgtatt

SEQ ID NO: 424780 - DNA, 15 bp, Homo sapiens
gattttggtgtattt

SEQ ID NO: 424781 - DNA, 15 bp, Homo sapiens
attttggtgtatttt

SEQ ID NO: 424782 - DNA, 15 bp, Homo sapiens
ttttggtgtatttta

SEQ ID NO: 424783 - DNA, 15 bp, Homo sapiens
tttggtgtattttag

SEQ ID NO: 424784 - DNA, 15 bp, Homo sapiens
ttggtgtattttaga

SEQ ID NO: 424785 - DNA, 15 bp, Homo sapiens
tggtgtattttagat

SEQ ID NO: 424786 - DNA, 15 bp, Homo sapiens
ggtgtattttagatt

SEQ ID NO: 424787 - DNA, 15 bp, Homo sapiens
gtgtattttagattt

SEQ ID NO: 424788 - DNA, 15 bp, Homo sapiens
tgtattttagatttt

SEQ ID NO: 424789 - DNA, 15 bp, Homo sapiens
gtattttagattttg

SEQ ID NO: 424790 - DNA, 15 bp, Homo sapiens
tattttagattttgg

SEQ ID NO: 424791 - DNA, 15 bp, Homo sapiens
attttagattttgga

SEQ ID NO: 424792 - DNA, 15 bp, Homo sapiens
ttttagattttggat

SEQ ID NO: 424793 - DNA, 15 bp, Homo sapiens
tttagattttggatt

SEQ ID NO: 424794 - DNA, 15 bp, Homo sapiens
ttagattttggatta

SEQ ID NO: 424795 - DNA, 15 bp, Homo sapiens
tagattttggattag

SEQ ID NO: 424796 - DNA, 15 bp, Homo sapiens
agattttggattaga

SEQ ID NO: 424797 - DNA, 15 bp, Homo sapiens
gattttggattagag

SEQ ID NO: 424798 - DNA, 15 bp, Homo sapiens
attttggattagaga

SEQ ID NO: 424799 - DNA, 15 bp, Homo sapiens
ttttggattagagat

SEQ ID NO: 424800 - DNA, 15 bp, Homo sapiens
tttggattagagata

SEQ ID NO: 424801 - DNA, 15 bp, Homo sapiens
ttggattagagatac

SEQ ID NO: 424802 - DNA, 15 bp, Homo sapiens
tggattagagatact

SEQ ID NO: 424803 - DNA, 15 bp, Homo sapiens
ggattagagatactc

SEQ ID NO: 424804 - DNA, 15 bp, Homo sapiens
gattagagatactca

SEQ ID NO: 424805 - DNA, 15 bp, Homo sapiens
attagagatactcaa

SEQ ID NO: 424806 - DNA, 15 bp, Homo sapiens
ttagagatactcaac

SEQ ID NO: 424807 - DNA, 15 bp, Homo sapiens
tagagatactcaacc

SEQ ID NO: 424808 - DNA, 15 bp, Homo sapiens
agagatactcaacct

SEQ ID NO: 424809 - DNA, 15 bp, Homo sapiens
gagatactcaacctg

SEQ ID NO: 424810 - DNA, 15 bp, Homo sapiens
agatactcaacctgt

SEQ ID NO: 424811 - DNA, 15 bp, Homo sapiens
gatactcaacctgta

SEQ ID NO: 424812 - DNA, 15 bp, Homo sapiens
atactcaacctgtat

SEQ ID NO: 424813 - DNA, 15 bp, Homo sapiens
tactcaacctgtatt

SEQ ID NO: 424814 - DNA, 15 bp, Homo sapiens
actcaacctgtattg

SEQ ID NO: 424815 - DNA, 15 bp, Homo sapiens
ctcaacctgtattgc

SEQ ID NO: 424816 - DNA, 15 bp, Homo sapiens
tcaacctgtattgca

SEQ ID NO: 424817 - DNA, 15 bp, Homo sapiens
caacctgtattgcat

SEQ ID NO: 424818 - DNA, 15 bp, Homo sapiens
aacctgtattgcata

SEQ ID NO: 424819 - DNA, 15 bp, Homo sapiens
acctgtattgcatat

SEQ ID NO: 424820 - DNA, 15 bp, Homo sapiens
cctgtattgcatata

SEQ ID NO: 424821 - DNA, 15 bp, Homo sapiens
ctgtattgcatatat

SEQ ID NO: 424822 - DNA, 15 bp, Homo sapiens
tgtattgcatatatt

SEQ ID NO: 424823 - DNA, 15 bp, Homo sapiens
gtattgcatatatta

SEQ ID NO: 424824 - DNA, 15 bp, Homo sapiens
tattgcatatattag

SEQ ID NO: 424825 - DNA, 15 bp, Homo sapiens
attgcatatattagc

SEQ ID NO: 424826 - DNA, 15 bp, Homo sapiens
ttgcatatattagct

SEQ ID NO: 424827 - DNA, 15 bp, Homo sapiens
tgcatatattagctg

SEQ ID NO: 424828 - DNA, 15 bp, Homo sapiens
gcatatattagctgg

SEQ ID NO: 424829 - DNA, 15 bp, Homo sapiens
catatattagctgga

SEQ ID NO: 424830 - DNA, 15 bp, Homo sapiens
atatattagctggat

SEQ ID NO: 424831 - DNA, 15 bp, Homo sapiens
tatattagctggatg

SEQ ID NO: 424832 - DNA, 15 bp, Homo sapiens
atattagctggatga

SEQ ID NO: 424833 - DNA, 15 bp, Homo sapiens
tattagctggatgaa

SEQ ID NO: 424834 - DNA, 15 bp, Homo sapiens
attagctggatgaag

SEQ ID NO: 424835 - DNA, 15 bp, Homo sapiens
ttagctggatgaagg

SEQ ID NO: 424836 - DNA, 15 bp, Homo sapiens
tagctggatgaagga

SEQ ID NO: 424837 - DNA, 15 bp, Homo sapiens
agctggatgaaggaa

SEQ ID NO: 424838 - DNA, 15 bp, Homo sapiens
gctggatgaaggaat

SEQ ID NO: 424839 - DNA, 15 bp, Homo sapiens
ctggatgaaggaata

SEQ ID NO: 424840 - DNA, 15 bp, Homo sapiens
tggatgaaggaatac

SEQ ID NO: 424841 - DNA, 15 bp, Homo sapiens
ggatgaaggaataca

SEQ ID NO: 424842 - DNA, 15 bp, Homo sapiens
gatgaaggaatacat

SEQ ID NO: 424843 - DNA, 15 bp, Homo sapiens
atgaaggaatacatt

SEQ ID NO: 424844 - DNA, 15 bp, Homo sapiens
tgaaggaatacattt

SEQ ID NO: 424845 - DNA, 15 bp, Homo sapiens
gaaggaatacattta

SEQ ID NO: 424846 - DNA, 15 bp, Homo sapiens
aaggaatacatttat

SEQ ID NO: 424847 - DNA, 15 bp, Homo sapiens
aggaatacatttatg

SEQ ID NO: 424848 - DNA, 15 bp, Homo sapiens
ggaatacatttatgt

SEQ ID NO: 424849 - DNA, 15 bp, Homo sapiens
gaatacatttatgtg

SEQ ID NO: 424850 - DNA, 15 bp, Homo sapiens
aatacatttatgtgt

SEQ ID NO: 424851 - DNA, 15 bp, Homo sapiens
atacatttatgtgtg

SEQ ID NO: 424852 - DNA, 15 bp, Homo sapiens
tacatttatgtgtgc

SEQ ID NO: 424853 - DNA, 15 bp, Homo sapiens
acatttatgtgtgca

SEQ ID NO: 424854 - DNA, 15 bp, Homo sapiens
catttatgtgtgcat

SEQ ID NO: 424855 - DNA, 15 bp, Homo sapiens
atttatgtgtgcatg

SEQ ID NO: 424856 - DNA, 15 bp, Homo sapiens
tttatgtgtgcatgt

SEQ ID NO: 424857 - DNA, 15 bp, Homo sapiens
ttatgtgtgcatgta

SEQ ID NO: 424858 - DNA, 15 bp, Homo sapiens
tatgtgtgcatgtat

SEQ ID NO: 424859 - DNA, 15 bp, Homo sapiens
atgtgtgcatgtatt

SEQ ID NO: 424860 - DNA, 15 bp, Homo sapiens
tgtgcatgtatttta

SEQ ID NO: 424861 - DNA, 15 bp, Homo sapiens
gtgcatgtattttaa

SEQ ID NO: 424862 - DNA, 15 bp, Homo sapiens
tgcatgtattttaaa

SEQ ID NO: 424863 - DNA, 15 bp, Homo sapiens
gcatgtattttaaag

SEQ ID NO: 424864 - DNA, 15 bp, Homo sapiens
catgtattttaaaga

SEQ ID NO: 424865 - DNA, 15 bp, Homo sapiens
atgtattttaaagag

SEQ ID NO: 424866 - DNA, 15 bp, Homo sapiens
tgtattttaaagagt

SEQ ID NO: 424867 - DNA, 15 bp, Homo sapiens
gtattttaaagagta

SEQ ID NO: 424868 - DNA, 15 bp, Homo sapiens
tattttaaagagtac

SEQ ID NO: 424869 - DNA, 15 bp, Homo sapiens
attttaaagagtaca

SEQ ID NO: 424870 - DNA, 15 bp, Homo sapiens
ttttaaagagtacag

SEQ ID NO: 424871 - DNA, 15 bp, Homo sapiens
tttaaagagtacagg

SEQ ID NO: 424872 - DNA, 15 bp, Homo sapiens
ttaaagagtacaggg

SEQ ID NO: 424873 - DNA, 15 bp, Homo sapiens
taaagagtacagggg

SEQ ID NO: 424874 - DNA, 15 bp, Homo sapiens
aaagagtacaggggg

SEQ ID NO: 424875 - DNA, 15 bp, Homo sapiens
aagagtacagggggc

SEQ ID NO: 424876 - DNA, 15 bp, Homo sapiens
agagtacagggggcc

SEQ ID NO: 424877 - DNA, 15 bp, Homo sapiens
gagtacagggggccg

SEQ ID NO: 424878 - DNA, 15 bp, Homo sapiens
agtacagggggccgg

SEQ ID NO: 424879 - DNA, 15 bp, Homo sapiens
gtacagggggccggg

SEQ ID NO: 424880 - DNA, 15 bp, Homo sapiens
tacagggggccgggt

SEQ ID NO: 424881 - DNA, 15 bp, Homo sapiens
acagggggccgggtg

SEQ ID NO: 424882 - DNA, 15 bp, Homo sapiens
cagggggccgggtgc

SEQ ID NO: 424883 - DNA, 15 bp, Homo sapiens
agggggccgggtgca

SEQ ID NO: 424884 - DNA, 15 bp, Homo sapiens
gggggccgggtgcag

SEQ ID NO: 424885 - DNA, 15 bp, Homo sapiens
ggggccgggtgcagt

SEQ ID NO: 424886 - DNA, 15 bp, Homo sapiens
catgcctgtaatctt

SEQ ID NO: 424887 - DNA, 15 bp, Homo sapiens
atgcctgtaatctta

SEQ ID NO: 424888 - DNA, 15 bp, Homo sapiens
tgcctgtaatcttag

SEQ ID NO: 424889 - DNA, 15 bp, Homo sapiens
gcctgtaatcttagc

SEQ ID NO: 424890 - DNA, 15 bp, Homo sapiens
cctgtaatcttagca

SEQ ID NO: 424891 - DNA, 15 bp, Homo sapiens
ctgtaatcttagcac

SEQ ID NO: 424892 - DNA, 15 bp, Homo sapiens
tgtaatcttagcact

SEQ ID NO: 424893 - DNA, 15 bp, Homo sapiens
gtaatcttagcactt

SEQ ID NO: 424894 - DNA, 15 bp, Homo sapiens
taatcttagcacttt

SEQ ID NO: 424895 - DNA, 15 bp, Homo sapiens
aatcttagcactttg

SEQ ID NO: 424896 - DNA, 15 bp, Homo sapiens
atcttagcactttgg

SEQ ID NO: 424897 - DNA, 15 bp, Homo sapiens
tcttagcactttggg

SEQ ID NO: 424898 - DNA, 15 bp, Homo sapiens
cttagcactttggga

SEQ ID NO: 424899 - DNA, 15 bp, Homo sapiens
ttagcactttgggag

SEQ ID NO: 424900 - DNA, 15 bp, Homo sapiens
ctttgggaggctgat

SEQ ID NO: 424901 - DNA, 15 bp, Homo sapiens
tttgggaggctgatg

SEQ ID NO: 424902 - DNA, 15 bp, Homo sapiens
ttgggaggctgatgt

SEQ ID NO: 424903 - DNA, 15 bp, Homo sapiens
tgggaggctgatgtg

SEQ ID NO: 424904 - DNA, 15 bp, Homo sapiens
gggaggctgatgtga

SEQ ID NO: 424905 - DNA, 15 bp, Homo sapiens
ggaggctgatgtgag

SEQ ID NO: 424906 - DNA, 15 bp, Homo sapiens
gaggctgatgtgagt

SEQ ID NO: 424907 - DNA, 15 bp, Homo sapiens
aggctgatgtgagtg

SEQ ID NO: 424908 - DNA, 15 bp, Homo sapiens
ggctgatgtgagtgg

SEQ ID NO: 424909 - DNA, 15 bp, Homo sapiens
gctgatgtgagtgga

SEQ ID NO: 424910 - DNA, 15 bp, Homo sapiens
ctgatgtgagtggat

SEQ ID NO: 424911 - DNA, 15 bp, Homo sapiens
tgatgtgagtggatc

SEQ ID NO: 424912 - DNA, 15 bp, Homo sapiens
gatgtgagtggatca

SEQ ID NO: 424913 - DNA, 15 bp, Homo sapiens
atgtgagtggatcac

SEQ ID NO: 424914 - DNA, 15 bp, Homo sapiens
tgtgagtggatcacc

SEQ ID NO: 424915 - DNA, 15 bp, Homo sapiens
gtgagtggatcacct

SEQ ID NO: 424916 - DNA, 15 bp, Homo sapiens
tgagtggatcacctg

SEQ ID NO: 424917 - DNA, 15 bp, Homo sapiens
gagtggatcacctga

SEQ ID NO: 424918 - DNA, 15 bp, Homo sapiens
agtggatcacctgag

SEQ ID NO: 424919 - DNA, 15 bp, Homo sapiens
aaaaaaaaaatcaaa

SEQ ID NO: 424920 - DNA, 15 bp, Homo sapiens
aaaaaaaaatcaaaa

SEQ ID NO: 424921 - DNA, 15 bp, Homo sapiens
aaaaaaaatcaaaaa

SEQ ID NO: 424922 - DNA, 15 bp, Homo sapiens
aaaaaaatcaaaaaa

SEQ ID NO: 424923 - DNA, 15 bp, Homo sapiens
aaaaaatcaaaaaaa

SEQ ID NO: 424924 - DNA, 15 bp, Homo sapiens
aaaaatcaaaaaaat

SEQ ID NO: 424925 - DNA, 15 bp, Homo sapiens
aaaatcaaaaaaatc

SEQ ID NO: 424926 - DNA, 15 bp, Homo sapiens
aaatcaaaaaaatca

SEQ ID NO: 424927 - DNA, 15 bp, Homo sapiens
aatcaaaaaaatcag

SEQ ID NO: 424928 - DNA, 15 bp, Homo sapiens
atcaaaaaaatcagc

SEQ ID NO: 424929 - DNA, 15 bp, Homo sapiens
tcaaaaaaatcagct

SEQ ID NO: 424930 - DNA, 15 bp, Homo sapiens
caaaaaaatcagctg

SEQ ID NO: 424931 - DNA, 15 bp, Homo sapiens
aaaaaaatcagctgg

SEQ ID NO: 424932 - DNA, 15 bp, Homo sapiens
aaaaaatcagctggg

SEQ ID NO: 424933 - DNA, 15 bp, Homo sapiens
tgggtgtggtggtgt

SEQ ID NO: 424934 - DNA, 15 bp, Homo sapiens
gggtgtggtggtgta

SEQ ID NO: 424935 - DNA, 15 bp, Homo sapiens
ggtgtggtggtgtat

SEQ ID NO: 424936 - DNA, 15 bp, Homo sapiens
gtgtggtggtgtata

SEQ ID NO: 424937 - DNA, 15 bp, Homo sapiens
tgtggtggtgtatac

SEQ ID NO: 424938 - DNA, 15 bp, Homo sapiens
gtggtggtgtatacc

SEQ ID NO: 424939 - DNA, 15 bp, Homo sapiens
tggtggtgtatacct

SEQ ID NO: 424940 - DNA, 15 bp, Homo sapiens
ggtggtgtatacctg

SEQ ID NO: 424941 - DNA, 15 bp, Homo sapiens
gtggtgtatacctgt

SEQ ID NO: 424942 - DNA, 15 bp, Homo sapiens
tggtgtatacctgta

SEQ ID NO: 424943 - DNA, 15 bp, Homo sapiens
ggtgtatacctgtaa

SEQ ID NO: 424944 - DNA, 15 bp, Homo sapiens
gtgtatacctgtaat

SEQ ID NO: 424945 - DNA, 15 bp, Homo sapiens
tgtatacctgtaatc

SEQ ID NO: 424946 - DNA, 15 bp, Homo sapiens
gtatacctgtaatcc

SEQ ID NO: 424947 - DNA, 15 bp, Homo sapiens
tatacctgtaatccc

SEQ ID NO: 424948 - DNA, 15 bp, Homo sapiens
gagccaagatcacag

SEQ ID NO: 424949 - DNA, 15 bp, Homo sapiens
agccaagatcacagc

SEQ ID NO: 424950 - DNA, 15 bp, Homo sapiens
gccaagatcacagca

SEQ ID NO: 424951 - DNA, 15 bp, Homo sapiens
ccaagatcacagcat

SEQ ID NO: 424952 - DNA, 15 bp, Homo sapiens
caagatcacagcatt

SEQ ID NO: 424953 - DNA, 15 bp, Homo sapiens
aagatcacagcattg

SEQ ID NO: 424954 - DNA, 15 bp, Homo sapiens
agatcacagcattgt

SEQ ID NO: 424955 - DNA, 15 bp, Homo sapiens
gatcacagcattgta

SEQ ID NO: 424956 - DNA, 15 bp, Homo sapiens
atcacagcattgtac

SEQ ID NO: 424957 - DNA, 15 bp, Homo sapiens
tcacagcattgtact

SEQ ID NO: 424958 - DNA, 15 bp, Homo sapiens
cacagcattgtactc

SEQ ID NO: 424959 - DNA, 15 bp, Homo sapiens
acagcattgtactcc

SEQ ID NO: 424960 - DNA, 15 bp, Homo sapiens
cagcattgtactcca

SEQ ID NO: 424961 - DNA, 15 bp, Homo sapiens
agcattgtactccag

SEQ ID NO: 424962 - DNA, 15 bp, Homo sapiens
gcattgtactccagc

SEQ ID NO: 424963 - DNA, 15 bp, Homo sapiens
caagagcgaaactct

SEQ ID NO: 424964 - DNA, 15 bp, Homo sapiens
aagagcgaaactctg

SEQ ID NO: 424965 - DNA, 15 bp, Homo sapiens
agagcgaaactctgt

SEQ ID NO: 424966 - DNA, 15 bp, Homo sapiens
gagcgaaactctgtc

SEQ ID NO: 424967 - DNA, 15 bp, Homo sapiens
agcgaaactctgtct

SEQ ID NO: 424968 - DNA, 15 bp, Homo sapiens
gcgaaactctgtctc

SEQ ID NO: 424969 - DNA, 15 bp, Homo sapiens
cgaaactctgtctca

SEQ ID NO: 424970 - DNA, 15 bp, Homo sapiens
gaaactctgtctcaa

SEQ ID NO: 424971 - DNA, 15 bp, Homo sapiens
aaaaaaaaaataaat

SEQ ID NO: 424972 - DNA, 15 bp, Homo sapiens
aaaaaaaaataaata

SEQ ID NO: 424973 - DNA, 15 bp, Homo sapiens
aaaaaaaataaataa

SEQ ID NO: 424974 - DNA, 15 bp, Homo sapiens
taaataaataaaaag

SEQ ID NO: 424975 - DNA, 15 bp, Homo sapiens
aaataaataaaaagc

SEQ ID NO: 424976 - DNA, 15 bp, Homo sapiens
aataaataaaaagca

SEQ ID NO: 424977 - DNA, 15 bp, Homo sapiens
ataaataaaaagcag

SEQ ID NO: 424978 - DNA, 15 bp, Homo sapiens
taaataaaaagcagg

SEQ ID NO: 424979 - DNA, 15 bp, Homo sapiens
aaataaaaagcaggg

SEQ ID NO: 424980 - DNA, 15 bp, Homo sapiens
aataaaaagcagggt

SEQ ID NO: 424981 - DNA, 15 bp, Homo sapiens
ataaaaagcagggtg

SEQ ID NO: 424982 - DNA, 15 bp, Homo sapiens
taaaaagcagggtgc

SEQ ID NO: 424983 - DNA, 15 bp, Homo sapiens
aaaaagcagggtgca

SEQ ID NO: 424984 - DNA, 15 bp, Homo sapiens
aaaagcagggtgcag

SEQ ID NO: 424985 - DNA, 15 bp, Homo sapiens
aaagcagggtgcagt

SEQ ID NO: 424986 - DNA, 15 bp, Homo sapiens
aagcagggtgcagtg

SEQ ID NO: 424987 - DNA, 15 bp, Homo sapiens
agcagggtgcagtgg

SEQ ID NO: 424988 - DNA, 15 bp, Homo sapiens
gcagggtgcagtggc

SEQ ID NO: 424989 - DNA, 15 bp, Homo sapiens
cagggtgcagtggct

SEQ ID NO: 424990 - DNA, 15 bp, Homo sapiens
agggtgcagtggctc

SEQ ID NO: 424991 - DNA, 15 bp, Homo sapiens
gaggtgggtggatca

SEQ ID NO: 424992 - DNA, 15 bp, Homo sapiens
tgggtggatcacctg

SEQ ID NO: 424993 - DNA, 15 bp, Homo sapiens
acctgaggtcaggaa

SEQ ID NO: 424994 - DNA, 15 bp, Homo sapiens
cctgaggtcaggaat

SEQ ID NO: 424995 - DNA, 15 bp, Homo sapiens
ctgaggtcaggaatt

SEQ ID NO: 424996 - DNA, 15 bp, Homo sapiens
tgaggtcaggaattc

SEQ ID NO: 424997 - DNA, 15 bp, Homo sapiens
gaggtcaggaattct

SEQ ID NO: 424998 - DNA, 15 bp, Homo sapiens
aggtcaggaattcta

SEQ ID NO: 424999 - DNA, 15 bp, Homo sapiens
ggtcaggaattctag

SEQ ID NO: 425000 - DNA, 15 bp, Homo sapiens
gtcaggaattctaga

SEQ ID NO: 425001 - DNA, 15 bp, Homo sapiens
tcaggaattctagac

SEQ ID NO: 425002 - DNA, 15 bp, Homo sapiens
caggaattctagacc

SEQ ID NO: 425003 - DNA, 15 bp, Homo sapiens
aggaattctagacca

SEQ ID NO: 425004 - DNA, 15 bp, Homo sapiens
ggaattctagaccag

SEQ ID NO: 425005 - DNA, 15 bp, Homo sapiens
gaattctagaccagc

SEQ ID NO: 425006 - DNA, 15 bp, Homo sapiens
aattctagaccagcc

SEQ ID NO: 425007 - DNA, 15 bp, Homo sapiens
attctagaccagcct

SEQ ID NO: 425008 - DNA, 15 bp, Homo sapiens
tctagaccagcctga

SEQ ID NO: 425009 - DNA, 15 bp, Homo sapiens
ctagaccagcctgac

SEQ ID NO: 425010 - DNA, 15 bp, Homo sapiens
tagaccagcctgacc

SEQ ID NO: 425011 - DNA, 15 bp, Homo sapiens
acatggagaaacccc

SEQ ID NO: 425012 - DNA, 15 bp, Homo sapiens
catggagaaaccccg

SEQ ID NO: 425013 - DNA, 15 bp, Homo sapiens
atggagaaaccccgt

SEQ ID NO: 425014 - DNA, 15 bp, Homo sapiens
tggagaaaccccgtc

SEQ ID NO: 425015 - DNA, 15 bp, Homo sapiens
ggagaaaccccgtct

SEQ ID NO: 425016 - DNA, 15 bp, Homo sapiens
gagaaaccccgtctc

SEQ ID NO: 425017 - DNA, 15 bp, Homo sapiens
agaaaccccgtctct

SEQ ID NO: 425018 - DNA, 15 bp, Homo sapiens
aaaaatacaaaattt

SEQ ID NO: 425019 - DNA, 15 bp, Homo sapiens
aaaatacaaaatttg

SEQ ID NO: 425020 - DNA, 15 bp, Homo sapiens
aaatacaaaatttgt

SEQ ID NO: 425021 - DNA, 15 bp, Homo sapiens
aatacaaaatttgtc

SEQ ID NO: 425022 - DNA, 15 bp, Homo sapiens
atacaaaatttgtca

SEQ ID NO: 425023 - DNA, 15 bp, Homo sapiens
tacaaaatttgtcag

SEQ ID NO: 425024 - DNA, 15 bp, Homo sapiens
acaaaatttgtcagg

SEQ ID NO: 425025 - DNA, 15 bp, Homo sapiens
caaaatttgtcaggc

SEQ ID NO: 425026 - DNA, 15 bp, Homo sapiens
aaaatttgtcaggca

SEQ ID NO: 425027 - DNA, 15 bp, Homo sapiens
aaatttgtcaggcat

SEQ ID NO: 425028 - DNA, 15 bp, Homo sapiens
aatttgtcaggcata

SEQ ID NO: 425029 - DNA, 15 bp, Homo sapiens
atttgtcaggcatag

SEQ ID NO: 425030 - DNA, 15 bp, Homo sapiens
tttgtcaggcatagc

SEQ ID NO: 425031 - DNA, 15 bp, Homo sapiens
ttgtcaggcatagcg

SEQ ID NO: 425032 - DNA, 15 bp, Homo sapiens
tgtcaggcatagcgg

SEQ ID NO: 425033 - DNA, 15 bp, Homo sapiens
gtcaggcatagcggc

SEQ ID NO: 425034 - DNA, 15 bp, Homo sapiens
tcaggcatagcggca

SEQ ID NO: 425035 - DNA, 15 bp, Homo sapiens
caggcatagcggcac

SEQ ID NO: 425036 - DNA, 15 bp, Homo sapiens
aggcatagcggcaca

SEQ ID NO: 425037 - DNA, 15 bp, Homo sapiens
ggcatagcggcacat

SEQ ID NO: 425038 - DNA, 15 bp, Homo sapiens
gcatagcggcacatg

SEQ ID NO: 425039 - DNA, 15 bp, Homo sapiens
catagcggcacatgc

SEQ ID NO: 425040 - DNA, 15 bp, Homo sapiens
atagcggcacatgcc

SEQ ID NO: 425041 - DNA, 15 bp, Homo sapiens
tagcggcacatgcct

SEQ ID NO: 425042 - DNA, 15 bp, Homo sapiens
agcggcacatgcctg

SEQ ID NO: 425043 - DNA, 15 bp, Homo sapiens
gcggcacatgcctgt

SEQ ID NO: 425044 - DNA, 15 bp, Homo sapiens
cggcacatgcctgta

SEQ ID NO: 425045 - DNA, 15 bp, Homo sapiens
acatgcctgtaatcc

SEQ ID NO: 425046 - DNA, 15 bp, Homo sapiens
ttgaacccgggagga

SEQ ID NO: 425047 - DNA, 15 bp, Homo sapiens
tgaacccgggaggag

SEQ ID NO: 425048 - DNA, 15 bp, Homo sapiens
gaacccgggaggagg

SEQ ID NO: 425049 - DNA, 15 bp, Homo sapiens
aacccgggaggagga

SEQ ID NO: 425050 - DNA, 15 bp, Homo sapiens
acccgggaggaggag

SEQ ID NO: 425051 - DNA, 15 bp, Homo sapiens
cccgggaggaggagg

SEQ ID NO: 425052 - DNA, 15 bp, Homo sapiens
ccgggaggaggaggt

SEQ ID NO: 425053 - DNA, 15 bp, Homo sapiens
cgggaggaggaggtt

SEQ ID NO: 425054 - DNA, 15 bp, Homo sapiens
gaggaggaggttgcg

SEQ ID NO: 425055 - DNA, 15 bp, Homo sapiens
aggaggaggttgcgg

SEQ ID NO: 425056 - DNA, 15 bp, Homo sapiens
ggaggaggttgcggt

SEQ ID NO: 425057 - DNA, 15 bp, Homo sapiens
gaggaggttgcggtg

SEQ ID NO: 425058 - DNA, 15 bp, Homo sapiens
aggaggttgcggtga

SEQ ID NO: 425059 - DNA, 15 bp, Homo sapiens
ggaggttgcggtgag

SEQ ID NO: 425060 - DNA, 15 bp, Homo sapiens
gaggttgcggtgagc

SEQ ID NO: 425061 - DNA, 15 bp, Homo sapiens
aggttgcggtgagcc

SEQ ID NO: 425062 - DNA, 15 bp, Homo sapiens
ggttgcggtgagccg

SEQ ID NO: 425063 - DNA, 15 bp, Homo sapiens
gttgcggtgagccga

SEQ ID NO: 425064 - DNA, 15 bp, Homo sapiens
ttgcggtgagccgag

SEQ ID NO: 425065 - DNA, 15 bp, Homo sapiens
tgcggtgagccgaga

SEQ ID NO: 425066 - DNA, 15 bp, Homo sapiens
gcggtgagccgagat

SEQ ID NO: 425067 - DNA, 15 bp, Homo sapiens
cggtgagccgagatc

SEQ ID NO: 425068 - DNA, 15 bp, Homo sapiens
ggtgagccgagatcg

SEQ ID NO: 425069 - DNA, 15 bp, Homo sapiens
actccagcctgggaa

SEQ ID NO: 425070 - DNA, 15 bp, Homo sapiens
ctccagcctgggaaa

SEQ ID NO: 425071 - DNA, 15 bp, Homo sapiens
tccagcctgggaaac

SEQ ID NO: 425072 - DNA, 15 bp, Homo sapiens
cagcctgggaaacaa

SEQ ID NO: 425073 - DNA, 15 bp, Homo sapiens
agcctgggaaacaag

SEQ ID NO: 425074 - DNA, 15 bp, Homo sapiens
gcctgggaaacaaga

SEQ ID NO: 425075 - DNA, 15 bp, Homo sapiens
cctgggaaacaagag

SEQ ID NO: 425076 - DNA, 15 bp, Homo sapiens
ctgggaaacaagagt

SEQ ID NO: 425077 - DNA, 15 bp, Homo sapiens
tgggaaacaagagtg

SEQ ID NO: 425078 - DNA, 15 bp, Homo sapiens
gggaaacaagagtga

SEQ ID NO: 425079 - DNA, 15 bp, Homo sapiens
ggaaacaagagtgaa

SEQ ID NO: 425080 - DNA, 15 bp, Homo sapiens
aaacaagagtgaaac

SEQ ID NO: 425081 - DNA, 15 bp, Homo sapiens
caagagtgaaactct

SEQ ID NO: 425082 - DNA, 15 bp, Homo sapiens
aagagtgaaactctg

SEQ ID NO: 425083 - DNA, 15 bp, Homo sapiens
agagtgaaactctgt

SEQ ID NO: 425084 - DNA, 15 bp, Homo sapiens
gagtgaaactctgtc

SEQ ID NO: 425085 - DNA, 15 bp, Homo sapiens
agtgaaactctgtct

SEQ ID NO: 425086 - DNA, 15 bp, Homo sapiens
tgaaactctgtctca

SEQ ID NO: 425087 - DNA, 15 bp, Homo sapiens
aaaaaaaaaaagtac

SEQ ID NO: 425088 - DNA, 15 bp, Homo sapiens
aaaaaaaaaagtaca

SEQ ID NO: 425089 - DNA, 15 bp, Homo sapiens
aaaaaaaaagtacag

SEQ ID NO: 425090 - DNA, 15 bp, Homo sapiens
aaaaaaaagtacagg

SEQ ID NO: 425091 - DNA, 15 bp, Homo sapiens
aaaaaaagtacaggg

SEQ ID NO: 425092 - DNA, 15 bp, Homo sapiens
aaaaaagtacaggga

SEQ ID NO: 425093 - DNA, 15 bp, Homo sapiens
aaaaagtacagggaa

SEQ ID NO: 425094 - DNA, 15 bp, Homo sapiens
aaaagtacagggaag

SEQ ID NO: 425095 - DNA, 15 bp, Homo sapiens
aaagtacagggaagg

SEQ ID NO: 425096 - DNA, 15 bp, Homo sapiens
aagtacagggaagga

SEQ ID NO: 425097 - DNA, 15 bp, Homo sapiens
agtacagggaaggat

SEQ ID NO: 425098 - DNA, 15 bp, Homo sapiens
gtacagggaaggata

SEQ ID NO: 425099 - DNA, 15 bp, Homo sapiens
tacagggaaggatac

SEQ ID NO: 425100 - DNA, 15 bp, Homo sapiens
acagggaaggatact

SEQ ID NO: 425101 - DNA, 15 bp, Homo sapiens
cagggaaggatacta

SEQ ID NO: 425102 - DNA, 15 bp, Homo sapiens
agggaaggatactat

SEQ ID NO: 425103 - DNA, 15 bp, Homo sapiens
gggaaggatactatt

SEQ ID NO: 425104 - DNA, 15 bp, Homo sapiens
ggaaggatactattt

SEQ ID NO: 425105 - DNA, 15 bp, Homo sapiens
gaaggatactatttt

SEQ ID NO: 425106 - DNA, 15 bp, Homo sapiens
aaggatactatttta

SEQ ID NO: 425107 - DNA, 15 bp, Homo sapiens
aggatactattttat

SEQ ID NO: 425108 - DNA, 15 bp, Homo sapiens
ggatactattttatt

SEQ ID NO: 425109 - DNA, 15 bp, Homo sapiens
gatactattttatta

SEQ ID NO: 425110 - DNA, 15 bp, Homo sapiens
atactattttattac

SEQ ID NO: 425111 - DNA, 15 bp, Homo sapiens
tactattttattact

SEQ ID NO: 425112 - DNA, 15 bp, Homo sapiens
actattttattacta

SEQ ID NO: 425113 - DNA, 15 bp, Homo sapiens
ctattttattactat

SEQ ID NO: 425114 - DNA, 15 bp, Homo sapiens
tattttattactatg

SEQ ID NO: 425115 - DNA, 15 bp, Homo sapiens
attttattactatga

SEQ ID NO: 425116 - DNA, 15 bp, Homo sapiens
ttttattactatgaa

SEQ ID NO: 425117 - DNA, 15 bp, Homo sapiens
tttattactatgaaa

SEQ ID NO: 425118 - DNA, 15 bp, Homo sapiens
ttattactatgaaaa

SEQ ID NO: 425119 - DNA, 15 bp, Homo sapiens
tattactatgaaaag

SEQ ID NO: 425120 - DNA, 15 bp, Homo sapiens
attactatgaaaagc

SEQ ID NO: 425121 - DNA, 15 bp, Homo sapiens
ttactatgaaaagca

SEQ ID NO: 425122 - DNA, 15 bp, Homo sapiens
tactatgaaaagcaa

SEQ ID NO: 425123 - DNA, 15 bp, Homo sapiens
actatgaaaagcaaa

SEQ ID NO: 425124 - DNA, 15 bp, Homo sapiens
ctatgaaaagcaaaa

SEQ ID NO: 425125 - DNA, 15 bp, Homo sapiens
tatgaaaagcaaaag

SEQ ID NO: 425126 - DNA, 15 bp, Homo sapiens
atgaaaagcaaaaga

SEQ ID NO: 425127 - DNA, 15 bp, Homo sapiens
tgaaaagcaaaagaa

SEQ ID NO: 425128 - DNA, 15 bp, Homo sapiens
gaaaagcaaaagaat

SEQ ID NO: 425129 - DNA, 15 bp, Homo sapiens
aaaagcaaaagaatt

SEQ ID NO: 425130 - DNA, 15 bp, Homo sapiens
aaagcaaaagaattt

SEQ ID NO: 425131 - DNA, 15 bp, Homo sapiens
aagcaaaagaatttc

SEQ ID NO: 425132 - DNA, 15 bp, Homo sapiens
agcaaaagaatttct

SEQ ID NO: 425133 - DNA, 15 bp, Homo sapiens
gcaaaagaatttctg

SEQ ID NO: 425134 - DNA, 15 bp, Homo sapiens
caaaagaatttctgt

SEQ ID NO: 425135 - DNA, 15 bp, Homo sapiens
aaaagaatttctgtc

SEQ ID NO: 425136 - DNA, 15 bp, Homo sapiens
aaagaatttctgtct

SEQ ID NO: 425137 - DNA, 15 bp, Homo sapiens
aagaatttctgtctc

SEQ ID NO: 425138 - DNA, 15 bp, Homo sapiens
agaatttctgtctca

SEQ ID NO: 425139 - DNA, 15 bp, Homo sapiens
gaatttctgtctcat

SEQ ID NO: 425140 - DNA, 15 bp, Homo sapiens
aatttctgtctcatt

SEQ ID NO: 425141 - DNA, 15 bp, Homo sapiens
atttctgtctcattt

SEQ ID NO: 425142 - DNA, 15 bp, Homo sapiens
tttctgtctcatttt

SEQ ID NO: 425143 - DNA, 15 bp, Homo sapiens
ttctgtctcattttt

SEQ ID NO: 425144 - DNA, 15 bp, Homo sapiens
tctgtctcattttta

SEQ ID NO: 425145 - DNA, 15 bp, Homo sapiens
ctgtctcatttttaa

SEQ ID NO: 425146 - DNA, 15 bp, Homo sapiens
tgtctcatttttaac

SEQ ID NO: 425147 - DNA, 15 bp, Homo sapiens
gtctcatttttaaca

SEQ ID NO: 425148 - DNA, 15 bp, Homo sapiens
tctcatttttaacat

SEQ ID NO: 425149 - DNA, 15 bp, Homo sapiens
ctcatttttaacatt

SEQ ID NO: 425150 - DNA, 15 bp, Homo sapiens
tcatttttaacattg

SEQ ID NO: 425151 - DNA, 15 bp, Homo sapiens
catttttaacattga

SEQ ID NO: 425152 - DNA, 15 bp, Homo sapiens
atttttaacattgat

SEQ ID NO: 425153 - DNA, 15 bp, Homo sapiens
tttttaacattgata

SEQ ID NO: 425154 - DNA, 15 bp, Homo sapiens
ttttaacattgatat

SEQ ID NO: 425155 - DNA, 15 bp, Homo sapiens
tttaacattgatatt

SEQ ID NO: 425156 - DNA, 15 bp, Homo sapiens
ttaacattgatattt

SEQ ID NO: 425157 - DNA, 15 bp, Homo sapiens
taacattgatatttg

SEQ ID NO: 425158 - DNA, 15 bp, Homo sapiens
aacattgatatttgg

SEQ ID NO: 425159 - DNA, 15 bp, Homo sapiens
acattgatatttggt

SEQ ID NO: 425160 - DNA, 15 bp, Homo sapiens
cattgatatttggta

SEQ ID NO: 425161 - DNA, 15 bp, Homo sapiens
attgatatttggtat

SEQ ID NO: 425162 - DNA, 15 bp, Homo sapiens
ttgatatttggtatt

SEQ ID NO: 425163 - DNA, 15 bp, Homo sapiens
tgatatttggtattc

SEQ ID NO: 425164 - DNA, 15 bp, Homo sapiens
gatatttggtattct

SEQ ID NO: 425165 - DNA, 15 bp, Homo sapiens
atatttggtattctg

SEQ ID NO: 425166 - DNA, 15 bp, Homo sapiens
tatttggtattctga

SEQ ID NO: 425167 - DNA, 15 bp, Homo sapiens
atttggtattctgat

SEQ ID NO: 425168 - DNA, 15 bp, Homo sapiens
tttggtattctgatt

SEQ ID NO: 425169 - DNA, 15 bp, Homo sapiens
ttggtattctgattc

SEQ ID NO: 425170 - DNA, 15 bp, Homo sapiens
tggtattctgattca

SEQ ID NO: 425171 - DNA, 15 bp, Homo sapiens
ggtattctgattcag

SEQ ID NO: 425172 - DNA, 15 bp, Homo sapiens
gtattctgattcagg

SEQ ID NO: 425173 - DNA, 15 bp, Homo sapiens
tattctgattcaggc

SEQ ID NO: 425174 - DNA, 15 bp, Homo sapiens
attctgattcaggca

SEQ ID NO: 425175 - DNA, 15 bp, Homo sapiens
ttctgattcaggcat

SEQ ID NO: 425176 - DNA, 15 bp, Homo sapiens
tctgattcaggcatt

SEQ ID NO: 425177 - DNA, 15 bp, Homo sapiens
ctgattcaggcatta

SEQ ID NO: 425178 - DNA, 15 bp, Homo sapiens
tgattcaggcattat

SEQ ID NO: 425179 - DNA, 15 bp, Homo sapiens
gattcaggcattatt

SEQ ID NO: 425180 - DNA, 15 bp, Homo sapiens
attcaggcattattt

SEQ ID NO: 425181 - DNA, 15 bp, Homo sapiens
ttcaggcattatttt

SEQ ID NO: 425182 - DNA, 15 bp, Homo sapiens
tcaggcattattttt

SEQ ID NO: 425183 - DNA, 15 bp, Homo sapiens
caggcattatttttt

SEQ ID NO: 425184 - DNA, 15 bp, Homo sapiens
aggcattatttttta

SEQ ID NO: 425185 - DNA, 15 bp, Homo sapiens
ggcattattttttat

SEQ ID NO: 425186 - DNA, 15 bp, Homo sapiens
gcattattttttatg

SEQ ID NO: 425187 - DNA, 15 bp, Homo sapiens
cattattttttatgt

SEQ ID NO: 425188 - DNA, 15 bp, Homo sapiens
attattttttatgtc

SEQ ID NO: 425189 - DNA, 15 bp, Homo sapiens
ttattttttatgtca

SEQ ID NO: 425190 - DNA, 15 bp, Homo sapiens
tattttttatgtcac

SEQ ID NO: 425191 - DNA, 15 bp, Homo sapiens
attttttatgtcact

SEQ ID NO: 425192 - DNA, 15 bp, Homo sapiens
ttttttatgtcactg

SEQ ID NO: 425193 - DNA, 15 bp, Homo sapiens
tttttatgtcactgg

SEQ ID NO: 425194 - DNA, 15 bp, Homo sapiens
ttttatgtcactggg

SEQ ID NO: 425195 - DNA, 15 bp, Homo sapiens
tttatgtcactgggg

SEQ ID NO: 425196 - DNA, 15 bp, Homo sapiens
ttatgtcactggggt

SEQ ID NO: 425197 - DNA, 15 bp, Homo sapiens
tatgtcactggggtg

SEQ ID NO: 425198 - DNA, 15 bp, Homo sapiens
atgtcactggggtgg

SEQ ID NO: 425199 - DNA, 15 bp, Homo sapiens
tgtcactggggtgga

SEQ ID NO: 425200 - DNA, 15 bp, Homo sapiens
gtcactggggtggaa

SEQ ID NO: 425201 - DNA, 15 bp, Homo sapiens
tcactggggtggaac

SEQ ID NO: 425202 - DNA, 15 bp, Homo sapiens
cactggggtggaacc

SEQ ID NO: 425203 - DNA, 15 bp, Homo sapiens
actggggtggaacca

SEQ ID NO: 425204 - DNA, 15 bp, Homo sapiens
ctggggtggaaccaa

SEQ ID NO: 425205 - DNA, 15 bp, Homo sapiens
tggggtggaaccaaa

SEQ ID NO: 425206 - DNA, 15 bp, Homo sapiens
ggggtggaaccaaaa

SEQ ID NO: 425207 - DNA, 15 bp, Homo sapiens
gggtggaaccaaaat

SEQ ID NO: 425208 - DNA, 15 bp, Homo sapiens
ggtggaaccaaaatg

SEQ ID NO: 425209 - DNA, 15 bp, Homo sapiens
gtggaaccaaaatga

SEQ ID NO: 425210 - DNA, 15 bp, Homo sapiens
tggaaccaaaatgaa

SEQ ID NO: 425211 - DNA, 15 bp, Homo sapiens
ggaaccaaaatgaat

SEQ ID NO: 425212 - DNA, 15 bp, Homo sapiens
gaaccaaaatgaatt

SEQ ID NO: 425213 - DNA, 15 bp, Homo sapiens
aaccaaaatgaattt

SEQ ID NO: 425214 - DNA, 15 bp, Homo sapiens
accaaaatgaatttt

SEQ ID NO: 425215 - DNA, 15 bp, Homo sapiens
ccaaaatgaattttg

SEQ ID NO: 425216 - DNA, 15 bp, Homo sapiens
caaaatgaattttgt

SEQ ID NO: 425217 - DNA, 15 bp, Homo sapiens
aaaatgaattttgta

SEQ ID NO: 425218 - DNA, 15 bp, Homo sapiens
aaatgaattttgtat

SEQ ID NO: 425219 - DNA, 15 bp, Homo sapiens
aatgaattttgtata

SEQ ID NO: 425220 - DNA, 15 bp, Homo sapiens
atgaattttgtatat

SEQ ID NO: 425221 - DNA, 15 bp, Homo sapiens
tgaattttgtatatt

SEQ ID NO: 425222 - DNA, 15 bp, Homo sapiens
gaattttgtatatta

SEQ ID NO: 425223 - DNA, 15 bp, Homo sapiens
aattttgtatattaa

SEQ ID NO: 425224 - DNA, 15 bp, Homo sapiens
attttgtatattaac

SEQ ID NO: 425225 - DNA, 15 bp, Homo sapiens
ttttgtatattaact

SEQ ID NO: 425226 - DNA, 15 bp, Homo sapiens
tttgtatattaactg

SEQ ID NO: 425227 - DNA, 15 bp, Homo sapiens
ttgtatattaactgc

SEQ ID NO: 425228 - DNA, 15 bp, Homo sapiens
tgtatattaactgct

SEQ ID NO: 425229 - DNA, 15 bp, Homo sapiens
gtatattaactgctc

SEQ ID NO: 425230 - DNA, 15 bp, Homo sapiens
tatattaactgctca

SEQ ID NO: 425231 - DNA, 15 bp, Homo sapiens
atattaactgctcat

SEQ ID NO: 425232 - DNA, 15 bp, Homo sapiens
tattaactgctcatt

SEQ ID NO: 425233 - DNA, 15 bp, Homo sapiens
attaactgctcattg

SEQ ID NO: 425234 - DNA, 15 bp, Homo sapiens
ttaactgctcattga

SEQ ID NO: 425235 - DNA, 15 bp, Homo sapiens
taactgctcattgag

SEQ ID NO: 425236 - DNA, 15 bp, Homo sapiens
aactgctcattgagg

SEQ ID NO: 425237 - DNA, 15 bp, Homo sapiens
actgctcattgaggg

SEQ ID NO: 425238 - DNA, 15 bp, Homo sapiens
ctgctcattgaggga

SEQ ID NO: 425239 - DNA, 15 bp, Homo sapiens
tgctcattgagggat

SEQ ID NO: 425240 - DNA, 15 bp, Homo sapiens
gctcattgagggatg

SEQ ID NO: 425241 - DNA, 15 bp, Homo sapiens
ctcattgagggatgt

SEQ ID NO: 425242 - DNA, 15 bp, Homo sapiens
tcattgagggatgtt

SEQ ID NO: 425243 - DNA, 15 bp, Homo sapiens
cattgagggatgtta

SEQ ID NO: 425244 - DNA, 15 bp, Homo sapiens
attgagggatgttaa

SEQ ID NO: 425245 - DNA, 15 bp, Homo sapiens
ttgagggatgttaac

SEQ ID NO: 425246 - DNA, 15 bp, Homo sapiens
tgagggatgttaacc

SEQ ID NO: 425247 - DNA, 15 bp, Homo sapiens
gagggatgttaacca

SEQ ID NO: 425248 - DNA, 15 bp, Homo sapiens
agggatgttaaccaa

SEQ ID NO: 425249 - DNA, 15 bp, Homo sapiens
gggatgttaaccaaa

SEQ ID NO: 425250 - DNA, 15 bp, Homo sapiens
ggatgttaaccaaaa

SEQ ID NO: 425251 - DNA, 15 bp, Homo sapiens
gatgttaaccaaaac

SEQ ID NO: 425252 - DNA, 15 bp, Homo sapiens
atgttaaccaaaact

SEQ ID NO: 425253 - DNA, 15 bp, Homo sapiens
tgttaaccaaaactt

SEQ ID NO: 425254 - DNA, 15 bp, Homo sapiens
gttaaccaaaacttt

SEQ ID NO: 425255 - DNA, 15 bp, Homo sapiens
ttaaccaaaactttc

SEQ ID NO: 425256 - DNA, 15 bp, Homo sapiens
taaccaaaactttca

SEQ ID NO: 425257 - DNA, 15 bp, Homo sapiens
aaccaaaactttcaa

SEQ ID NO: 425258 - DNA, 15 bp, Homo sapiens
accaaaactttcaag

SEQ ID NO: 425259 - DNA, 15 bp, Homo sapiens
ccaaaactttcaagg

SEQ ID NO: 425260 - DNA, 15 bp, Homo sapiens
caaaactttcaaggc

SEQ ID NO: 425261 - DNA, 15 bp, Homo sapiens
aaaactttcaaggca

SEQ ID NO: 425262 - DNA, 15 bp, Homo sapiens
aaactttcaaggcac

SEQ ID NO: 425263 - DNA, 15 bp, Homo sapiens
aactttcaaggcact

SEQ ID NO: 425264 - DNA, 15 bp, Homo sapiens
actttcaaggcacta

SEQ ID NO: 425265 - DNA, 15 bp, Homo sapiens
ctttcaaggcactat

SEQ ID NO: 425266 - DNA, 15 bp, Homo sapiens
tttcaaggcactatg

SEQ ID NO: 425267 - DNA, 15 bp, Homo sapiens
ttcaaggcactatgt

SEQ ID NO: 425268 - DNA, 15 bp, Homo sapiens
tcaaggcactatgta

SEQ ID NO: 425269 - DNA, 15 bp, Homo sapiens
caaggcactatgtag

SEQ ID NO: 425270 - DNA, 15 bp, Homo sapiens
aaggcactatgtagg

SEQ ID NO: 425271 - DNA, 15 bp, Homo sapiens
aggcactatgtagga

SEQ ID NO: 425272 - DNA, 15 bp, Homo sapiens
ggcactatgtaggag

SEQ ID NO: 425273 - DNA, 15 bp, Homo sapiens
gcactatgtaggaga

SEQ ID NO: 425274 - DNA, 15 bp, Homo sapiens
cactatgtaggagat

SEQ ID NO: 425275 - DNA, 15 bp, Homo sapiens
actatgtaggagatt

SEQ ID NO: 425276 - DNA, 15 bp, Homo sapiens
ctatgtaggagattt

SEQ ID NO: 425277 - DNA, 15 bp, Homo sapiens
tatgtaggagatttt

SEQ ID NO: 425278 - DNA, 15 bp, Homo sapiens
atgtaggagattttt

SEQ ID NO: 425279 - DNA, 15 bp, Homo sapiens
tgtaggagatttttt

SEQ ID NO: 425280 - DNA, 15 bp, Homo sapiens
gtaggagattttttt

SEQ ID NO: 425281 - DNA, 15 bp, Homo sapiens
taggagatttttttt

SEQ ID NO: 425282 - DNA, 15 bp, Homo sapiens
aggagattttttttt

SEQ ID NO: 425283 - DNA, 15 bp, Homo sapiens
ggagattttttttta

SEQ ID NO: 425284 - DNA, 15 bp, Homo sapiens
gagatttttttttaa

SEQ ID NO: 425285 - DNA, 15 bp, Homo sapiens
agatttttttttaaa

SEQ ID NO: 425286 - DNA, 15 bp, Homo sapiens
gatttttttttaaat

SEQ ID NO: 425287 - DNA, 15 bp, Homo sapiens
atttttttttaaatt

SEQ ID NO: 425288 - DNA, 15 bp, Homo sapiens
tttttttttaaattt

SEQ ID NO: 425289 - DNA, 15 bp, Homo sapiens
ttttttttaaatttt

SEQ ID NO: 425290 - DNA, 15 bp, Homo sapiens
tttttttaaattttg

SEQ ID NO: 425291 - DNA, 15 bp, Homo sapiens
ttttttaaattttgt

SEQ ID NO: 425292 - DNA, 15 bp, Homo sapiens
tttttaaattttgtc

SEQ ID NO: 425293 - DNA, 15 bp, Homo sapiens
ttttaaattttgtct

SEQ ID NO: 425294 - DNA, 15 bp, Homo sapiens
tttaaattttgtctg

SEQ ID NO: 425295 - DNA, 15 bp, Homo sapiens
ttaaattttgtctgc

SEQ ID NO: 425296 - DNA, 15 bp, Homo sapiens
taaattttgtctgca

SEQ ID NO: 425297 - DNA, 15 bp, Homo sapiens
aaattttgtctgcat

SEQ ID NO: 425298 - DNA, 15 bp, Homo sapiens
aattttgtctgcata

SEQ ID NO: 425299 - DNA, 15 bp, Homo sapiens
attttgtctgcatac

SEQ ID NO: 425300 - DNA, 15 bp, Homo sapiens
ttttgtctgcatacc

SEQ ID NO: 425301 - DNA, 15 bp, Homo sapiens
tttgtctgcatacca

SEQ ID NO: 425302 - DNA, 15 bp, Homo sapiens
ttgtctgcataccaa

SEQ ID NO: 425303 - DNA, 15 bp, Homo sapiens
tgtctgcataccaac

SEQ ID NO: 425304 - DNA, 15 bp, Homo sapiens
gtctgcataccaacg

SEQ ID NO: 425305 - DNA, 15 bp, Homo sapiens
tctgcataccaacgg

SEQ ID NO: 425306 - DNA, 15 bp, Homo sapiens
ctgcataccaacgga

SEQ ID NO: 425307 - DNA, 15 bp, Homo sapiens
tgcataccaacggaa

SEQ ID NO: 425308 - DNA, 15 bp, Homo sapiens
gcataccaacggaaa

SEQ ID NO: 425309 - DNA, 15 bp, Homo sapiens
cataccaacggaaag

SEQ ID NO: 425310 - DNA, 15 bp, Homo sapiens
ataccaacggaaagt

SEQ ID NO: 425311 - DNA, 15 bp, Homo sapiens
taccaacggaaagta

SEQ ID NO: 425312 - DNA, 15 bp, Homo sapiens
accaacggaaagtaa

SEQ ID NO: 425313 - DNA, 15 bp, Homo sapiens
ccaacggaaagtaag

SEQ ID NO: 425314 - DNA, 15 bp, Homo sapiens
caacggaaagtaagc

SEQ ID NO: 425315 - DNA, 15 bp, Homo sapiens
aacggaaagtaagcc

SEQ ID NO: 425316 - DNA, 15 bp, Homo sapiens
acggaaagtaagcct

SEQ ID NO: 425317 - DNA, 15 bp, Homo sapiens
cggaaagtaagcctg

SEQ ID NO: 425318 - DNA, 15 bp, Homo sapiens
ggaaagtaagcctgt

SEQ ID NO: 425319 - DNA, 15 bp, Homo sapiens
gaaagtaagcctgtt

SEQ ID NO: 425320 - DNA, 15 bp, Homo sapiens
aaagtaagcctgttt

SEQ ID NO: 425321 - DNA, 15 bp, Homo sapiens
aagtaagcctgtttt

SEQ ID NO: 425322 - DNA, 15 bp, Homo sapiens
agtaagcctgttttc

SEQ ID NO: 425323 - DNA, 15 bp, Homo sapiens
gtaagcctgttttct

SEQ ID NO: 425324 - DNA, 15 bp, Homo sapiens
taagcctgttttctg

SEQ ID NO: 425325 - DNA, 15 bp, Homo sapiens
aagcctgttttctgt

SEQ ID NO: 425326 - DNA, 15 bp, Homo sapiens
agcctgttttctgtc

SEQ ID NO: 425327 - DNA, 15 bp, Homo sapiens
gcctgttttctgtct

SEQ ID NO: 425328 - DNA, 15 bp, Homo sapiens
cctgttttctgtctc

SEQ ID NO: 425329 - DNA, 15 bp, Homo sapiens
ctgttttctgtctcc

SEQ ID NO: 425330 - DNA, 15 bp, Homo sapiens
tgttttctgtctcct

SEQ ID NO: 425331 - DNA, 15 bp, Homo sapiens
gttttctgtctcctt

SEQ ID NO: 425332 - DNA, 15 bp, Homo sapiens
ttttctgtctccttt

SEQ ID NO: 425333 - DNA, 15 bp, Homo sapiens
tttctgtctcctttt

SEQ ID NO: 425334 - DNA, 15 bp, Homo sapiens
ttctgtctccttttt

SEQ ID NO: 425335 - DNA, 15 bp, Homo sapiens
tctgtctcctttttc

SEQ ID NO: 425336 - DNA, 15 bp, Homo sapiens
ctgtctcctttttca

SEQ ID NO: 425337 - DNA, 15 bp, Homo sapiens
tgtctcctttttcat

SEQ ID NO: 425338 - DNA, 15 bp, Homo sapiens
gtctcctttttcatg

SEQ ID NO: 425339 - DNA, 15 bp, Homo sapiens
tctcctttttcatgt

SEQ ID NO: 425340 - DNA, 15 bp, Homo sapiens
ctcctttttcatgta

SEQ ID NO: 425341 - DNA, 15 bp, Homo sapiens
tcctttttcatgtag

SEQ ID NO: 425342 - DNA, 15 bp, Homo sapiens
cctttttcatgtagt

SEQ ID NO: 425343 - DNA, 15 bp, Homo sapiens
ctttttcatgtagtt

SEQ ID NO: 425344 - DNA, 15 bp, Homo sapiens
tttttcatgtagttt

SEQ ID NO: 425345 - DNA, 15 bp, Homo sapiens
ttttcatgtagtttt

SEQ ID NO: 425346 - DNA, 15 bp, Homo sapiens
tttcatgtagtttta

SEQ ID NO: 425347 - DNA, 15 bp, Homo sapiens
ttcatgtagttttat

SEQ ID NO: 425348 - DNA, 15 bp, Homo sapiens
tcatgtagttttatt

SEQ ID NO: 425349 - DNA, 15 bp, Homo sapiens
catgtagttttatta

SEQ ID NO: 425350 - DNA, 15 bp, Homo sapiens
atgtagttttattag

SEQ ID NO: 425351 - DNA, 15 bp, Homo sapiens
tgtagttttattagt

SEQ ID NO: 425352 - DNA, 15 bp, Homo sapiens
gtagttttattagtg

SEQ ID NO: 425353 - DNA, 15 bp, Homo sapiens
tagttttattagtgc

SEQ ID NO: 425354 - DNA, 15 bp, Homo sapiens
agttttattagtgct

SEQ ID NO: 425355 - DNA, 15 bp, Homo sapiens
gttttattagtgcta

SEQ ID NO: 425356 - DNA, 15 bp, Homo sapiens
ttttattagtgctat

SEQ ID NO: 425357 - DNA, 15 bp, Homo sapiens
tttattagtgctatc

SEQ ID NO: 425358 - DNA, 15 bp, Homo sapiens
ttattagtgctatca

SEQ ID NO: 425359 - DNA, 15 bp, Homo sapiens
tattagtgctatcaa

SEQ ID NO: 425360 - DNA, 15 bp, Homo sapiens
attagtgctatcaaa

SEQ ID NO: 425361 - DNA, 15 bp, Homo sapiens
ttagtgctatcaaat

SEQ ID NO: 425362 - DNA, 15 bp, Homo sapiens
tagtgctatcaaatt

SEQ ID NO: 425363 - DNA, 15 bp, Homo sapiens
agtgctatcaaattt

SEQ ID NO: 425364 - DNA, 15 bp, Homo sapiens
gtgctatcaaattta

SEQ ID NO: 425365 - DNA, 15 bp, Homo sapiens
tgctatcaaatttaa

SEQ ID NO: 425366 - DNA, 15 bp, Homo sapiens
gctatcaaatttaat

SEQ ID NO: 425367 - DNA, 15 bp, Homo sapiens
ctatcaaatttaatg

SEQ ID NO: 425368 - DNA, 15 bp, Homo sapiens
tatcaaatttaatga

SEQ ID NO: 425369 - DNA, 15 bp, Homo sapiens
atcaaatttaatgag

SEQ ID NO: 425370 - DNA, 15 bp, Homo sapiens
tcaaatttaatgagt

SEQ ID NO: 425371 - DNA, 15 bp, Homo sapiens
caaatttaatgagtg

SEQ ID NO: 425372 - DNA, 15 bp, Homo sapiens
aaatttaatgagtgc

SEQ ID NO: 425373 - DNA, 15 bp, Homo sapiens
aatttaatgagtgct

SEQ ID NO: 425374 - DNA, 15 bp, Homo sapiens
atttaatgagtgctc

SEQ ID NO: 425375 - DNA, 15 bp, Homo sapiens
tttaatgagtgctct

SEQ ID NO: 425376 - DNA, 15 bp, Homo sapiens
ttaatgagtgctctg

SEQ ID NO: 425377 - DNA, 15 bp, Homo sapiens
taatgagtgctctgc

SEQ ID NO: 425378 - DNA, 15 bp, Homo sapiens
aatgagtgctctgcc

SEQ ID NO: 425379 - DNA, 15 bp, Homo sapiens
atgagtgctctgccc

SEQ ID NO: 425380 - DNA, 15 bp, Homo sapiens
tgagtgctctgccct

SEQ ID NO: 425381 - DNA, 15 bp, Homo sapiens
gagtgctctgccctt

SEQ ID NO: 425382 - DNA, 15 bp, Homo sapiens
agtgctctgcccttt

SEQ ID NO: 425383 - DNA, 15 bp, Homo sapiens
gtgctctgccctttt

SEQ ID NO: 425384 - DNA, 15 bp, Homo sapiens
tgctctgcccttttt

SEQ ID NO: 425385 - DNA, 15 bp, Homo sapiens
gctctgccctttttt

SEQ ID NO: 425386 - DNA, 15 bp, Homo sapiens
ctctgcccttttttg

SEQ ID NO: 425387 - DNA, 15 bp, Homo sapiens
tctgcccttttttgc

SEQ ID NO: 425388 - DNA, 15 bp, Homo sapiens
ctgcccttttttgct

SEQ ID NO: 425389 - DNA, 15 bp, Homo sapiens
tgcccttttttgctg

SEQ ID NO: 425390 - DNA, 15 bp, Homo sapiens
gcccttttttgctgt

SEQ ID NO: 425391 - DNA, 15 bp, Homo sapiens
cccttttttgctgtc

SEQ ID NO: 425392 - DNA, 15 bp, Homo sapiens
ccttttttgctgtca

SEQ ID NO: 425393 - DNA, 15 bp, Homo sapiens
cttttttgctgtcat

SEQ ID NO: 425394 - DNA, 15 bp, Homo sapiens
ttttttgctgtcatt

SEQ ID NO: 425395 - DNA, 15 bp, Homo sapiens
tttttgctgtcattc

SEQ ID NO: 425396 - DNA, 15 bp, Homo sapiens
ttttgctgtcattct

SEQ ID NO: 425397 - DNA, 15 bp, Homo sapiens
tttgctgtcattctg

SEQ ID NO: 425398 - DNA, 15 bp, Homo sapiens
ttgctgtcattctgt

SEQ ID NO: 425399 - DNA, 15 bp, Homo sapiens
tgctgtcattctgta

SEQ ID NO: 425400 - DNA, 15 bp, Homo sapiens
gctgtcattctgtaa

SEQ ID NO: 425401 - DNA, 15 bp, Homo sapiens
ctgtcattctgtaat

SEQ ID NO: 425402 - DNA, 15 bp, Homo sapiens
tgtcattctgtaatg

SEQ ID NO: 425403 - DNA, 15 bp, Homo sapiens
gtcattctgtaatga

SEQ ID NO: 425404 - DNA, 15 bp, Homo sapiens
tcattctgtaatgac

SEQ ID NO: 425405 - DNA, 15 bp, Homo sapiens
cattctgtaatgact

SEQ ID NO: 425406 - DNA, 15 bp, Homo sapiens
attctgtaatgactt

SEQ ID NO: 425407 - DNA, 15 bp, Homo sapiens
ttctgtaatgacttc

SEQ ID NO: 425408 - DNA, 15 bp, Homo sapiens
tctgtaatgacttca

SEQ ID NO: 425409 - DNA, 15 bp, Homo sapiens
ctgtaatgacttcag

SEQ ID NO: 425410 - DNA, 15 bp, Homo sapiens
tgtaatgacttcaga

SEQ ID NO: 425411 - DNA, 15 bp, Homo sapiens
gtaatgacttcagat

SEQ ID NO: 425412 - DNA, 15 bp, Homo sapiens
taatgacttcagatc

SEQ ID NO: 425413 - DNA, 15 bp, Homo sapiens
aatgacttcagatcc

SEQ ID NO: 425414 - DNA, 15 bp, Homo sapiens
atgacttcagatcca

SEQ ID NO: 425415 - DNA, 15 bp, Homo sapiens
tgacttcagatccat

SEQ ID NO: 425416 - DNA, 15 bp, Homo sapiens
gacttcagatccata

SEQ ID NO: 425417 - DNA, 15 bp, Homo sapiens
acttcagatccatat

SEQ ID NO: 425418 - DNA, 15 bp, Homo sapiens
cttcagatccatata

SEQ ID NO: 425419 - DNA, 15 bp, Homo sapiens
ttcagatccatatat

SEQ ID NO: 425420 - DNA, 15 bp, Homo sapiens
tcagatccatatatg

SEQ ID NO: 425421 - DNA, 15 bp, Homo sapiens
cagatccatatatgc

SEQ ID NO: 425422 - DNA, 15 bp, Homo sapiens
agatccatatatgct

SEQ ID NO: 425423 - DNA, 15 bp, Homo sapiens
gatccatatatgctg

SEQ ID NO: 425424 - DNA, 15 bp, Homo sapiens
atccatatatgctga

SEQ ID NO: 425425 - DNA, 15 bp, Homo sapiens
tccatatatgctgat

SEQ ID NO: 425426 - DNA, 15 bp, Homo sapiens
ccatatatgctgatt

SEQ ID NO: 425427 - DNA, 15 bp, Homo sapiens
catatatgctgattt

SEQ ID NO: 425428 - DNA, 15 bp, Homo sapiens
atatatgctgattta

SEQ ID NO: 425429 - DNA, 15 bp, Homo sapiens
tatatgctgatttag

SEQ ID NO: 425430 - DNA, 15 bp, Homo sapiens
atatgctgatttagc

SEQ ID NO: 425431 - DNA, 15 bp, Homo sapiens
tatgctgatttagct

SEQ ID NO: 425432 - DNA, 15 bp, Homo sapiens
atgctgatttagctt

SEQ ID NO: 425433 - DNA, 15 bp, Homo sapiens
tgctgatttagcttt

SEQ ID NO: 425434 - DNA, 15 bp, Homo sapiens
gctgatttagctttg

SEQ ID NO: 425435 - DNA, 15 bp, Homo sapiens
ctgatttagctttga

SEQ ID NO: 425436 - DNA, 15 bp, Homo sapiens
tgatttagctttgaa

SEQ ID NO: 425437 - DNA, 15 bp, Homo sapiens
gatttagctttgaaa

SEQ ID NO: 425438 - DNA, 15 bp, Homo sapiens
atttagctttgaaag

SEQ ID NO: 425439 - DNA, 15 bp, Homo sapiens
tttagctttgaaagc

SEQ ID NO: 425440 - DNA, 15 bp, Homo sapiens
ttagctttgaaagca

SEQ ID NO: 425441 - DNA, 15 bp, Homo sapiens
tagctttgaaagcaa

SEQ ID NO: 425442 - DNA, 15 bp, Homo sapiens
agctttgaaagcaag

SEQ ID NO: 425443 - DNA, 15 bp, Homo sapiens
gctttgaaagcaagt

SEQ ID NO: 425444 - DNA, 15 bp, Homo sapiens
ctttgaaagcaagtt

SEQ ID NO: 425445 - DNA, 15 bp, Homo sapiens
tttgaaagcaagttg

SEQ ID NO: 425446 - DNA, 15 bp, Homo sapiens
ttgaaagcaagttgg

SEQ ID NO: 425447 - DNA, 15 bp, Homo sapiens
tgaaagcaagttggg

SEQ ID NO: 425448 - DNA, 15 bp, Homo sapiens
gaaagcaagttggga

SEQ ID NO: 425449 - DNA, 15 bp, Homo sapiens
aaagcaagttgggaa

SEQ ID NO: 425450 - DNA, 15 bp, Homo sapiens
aagcaagttgggaaa

SEQ ID NO: 425451 - DNA, 15 bp, Homo sapiens
agcaagttgggaaaa

SEQ ID NO: 425452 - DNA, 15 bp, Homo sapiens
gcaagttgggaaaag

SEQ ID NO: 425453 - DNA, 15 bp, Homo sapiens
caagttgggaaaaga

SEQ ID NO: 425454 - DNA, 15 bp, Homo sapiens
aagttgggaaaagag

SEQ ID NO: 425455 - DNA, 15 bp, Homo sapiens
agttgggaaaagagt

SEQ ID NO: 425456 - DNA, 15 bp, Homo sapiens
gttgggaaaagagta

SEQ ID NO: 425457 - DNA, 15 bp, Homo sapiens
ttgggaaaagagtaa

SEQ ID NO: 425458 - DNA, 15 bp, Homo sapiens
tgggaaaagagtaaa

SEQ ID NO: 425459 - DNA, 15 bp, Homo sapiens
gggaaaagagtaaat

SEQ ID NO: 425460 - DNA, 15 bp, Homo sapiens
ggaaaagagtaaatt

SEQ ID NO: 425461 - DNA, 15 bp, Homo sapiens
gaaaagagtaaatta

SEQ ID NO: 425462 - DNA, 15 bp, Homo sapiens
aaaagagtaaattac

SEQ ID NO: 425463 - DNA, 15 bp, Homo sapiens
aaagagtaaattaca

SEQ ID NO: 425464 - DNA, 15 bp, Homo sapiens
aagagtaaattacat

SEQ ID NO: 425465 - DNA, 15 bp, Homo sapiens
agagtaaattacatt

SEQ ID NO: 425466 - DNA, 15 bp, Homo sapiens
gagtaaattacattc

SEQ ID NO: 425467 - DNA, 15 bp, Homo sapiens
agtaaattacattct

SEQ ID NO: 425468 - DNA, 15 bp, Homo sapiens
gtaaattacattcta

SEQ ID NO: 425469 - DNA, 15 bp, Homo sapiens
taaattacattctag

SEQ ID NO: 425470 - DNA, 15 bp, Homo sapiens
aaattacattctagc

SEQ ID NO: 425471 - DNA, 15 bp, Homo sapiens
aattacattctagca

SEQ ID NO: 425472 - DNA, 15 bp, Homo sapiens
attacattctagcag

SEQ ID NO: 425473 - DNA, 15 bp, Homo sapiens
ttacattctagcaga

SEQ ID NO: 425474 - DNA, 15 bp, Homo sapiens
tacattctagcagat

SEQ ID NO: 425475 - DNA, 15 bp, Homo sapiens
acattctagcagatt

SEQ ID NO: 425476 - DNA, 15 bp, Homo sapiens
cattctagcagattt

SEQ ID NO: 425477 - DNA, 15 bp, Homo sapiens
attctagcagatttg

SEQ ID NO: 425478 - DNA, 15 bp, Homo sapiens
ttctagcagatttgt

SEQ ID NO: 425479 - DNA, 15 bp, Homo sapiens
tctagcagatttgtc

SEQ ID NO: 425480 - DNA, 15 bp, Homo sapiens
ctagcagatttgtct

SEQ ID NO: 425481 - DNA, 15 bp, Homo sapiens
tagcagatttgtctc

SEQ ID NO: 425482 - DNA, 15 bp, Homo sapiens
agcagatttgtctca

SEQ ID NO: 425483 - DNA, 15 bp, Homo sapiens
gcagatttgtctcat

SEQ ID NO: 425484 - DNA, 15 bp, Homo sapiens
cagatttgtctcatg

SEQ ID NO: 425485 - DNA, 15 bp, Homo sapiens
agatttgtctcatgt

SEQ ID NO: 425486 - DNA, 15 bp, Homo sapiens
gatttgtctcatgtt

SEQ ID NO: 425487 - DNA, 15 bp, Homo sapiens
atttgtctcatgttt

SEQ ID NO: 425488 - DNA, 15 bp, Homo sapiens
tttgtctcatgtttg

SEQ ID NO: 425489 - DNA, 15 bp, Homo sapiens
ttgtctcatgtttgc

SEQ ID NO: 425490 - DNA, 15 bp, Homo sapiens
tgtctcatgtttgca

SEQ ID NO: 425491 - DNA, 15 bp, Homo sapiens
gtctcatgtttgcat

SEQ ID NO: 425492 - DNA, 15 bp, Homo sapiens
tctcatgtttgcatc

SEQ ID NO: 425493 - DNA, 15 bp, Homo sapiens
ctcatgtttgcatca

SEQ ID NO: 425494 - DNA, 15 bp, Homo sapiens
tcatgtttgcatcat

SEQ ID NO: 425495 - DNA, 15 bp, Homo sapiens
catgtttgcatcatt

SEQ ID NO: 425496 - DNA, 15 bp, Homo sapiens
atgtttgcatcattt

SEQ ID NO: 425497 - DNA, 15 bp, Homo sapiens
tgtttgcatcattta

SEQ ID NO: 425498 - DNA, 15 bp, Homo sapiens
gtttgcatcatttat

SEQ ID NO: 425499 - DNA, 15 bp, Homo sapiens
tttgcatcatttatt

SEQ ID NO: 425500 - DNA, 15 bp, Homo sapiens
ttgcatcatttattt

SEQ ID NO: 425501 - DNA, 15 bp, Homo sapiens
tgcatcatttatttt

SEQ ID NO: 425502 - DNA, 15 bp, Homo sapiens
gcatcatttattttt

SEQ ID NO: 425503 - DNA, 15 bp, Homo sapiens
catcatttatttttt

SEQ ID NO: 425504 - DNA, 15 bp, Homo sapiens
atcatttattttttt

SEQ ID NO: 425505 - DNA, 15 bp, Homo sapiens
tcatttatttttttc

SEQ ID NO: 425506 - DNA, 15 bp, Homo sapiens
catttatttttttct

SEQ ID NO: 425507 - DNA, 15 bp, Homo sapiens
atttatttttttctg

SEQ ID NO: 425508 - DNA, 15 bp, Homo sapiens
tttatttttttctgc

SEQ ID NO: 425509 - DNA, 15 bp, Homo sapiens
ttatttttttctgct

SEQ ID NO: 425510 - DNA, 15 bp, Homo sapiens
tatttttttctgctt

SEQ ID NO: 425511 - DNA, 15 bp, Homo sapiens
atttttttctgctta

SEQ ID NO: 425512 - DNA, 15 bp, Homo sapiens
tttttttctgcttat

SEQ ID NO: 425513 - DNA, 15 bp, Homo sapiens
ttttttctgcttata

SEQ ID NO: 425514 - DNA, 15 bp, Homo sapiens
tttttctgcttatat

SEQ ID NO: 425515 - DNA, 15 bp, Homo sapiens
ttttctgcttatatt

SEQ ID NO: 425516 - DNA, 15 bp, Homo sapiens
tttctgcttatattc

SEQ ID NO: 425517 - DNA, 15 bp, Homo sapiens
ttctgcttatattct

SEQ ID NO: 425518 - DNA, 15 bp, Homo sapiens
tctgcttatattctc

SEQ ID NO: 425519 - DNA, 15 bp, Homo sapiens
ctgcttatattctcc

SEQ ID NO: 425520 - DNA, 15 bp, Homo sapiens
tgcttatattctcca

SEQ ID NO: 425521 - DNA, 15 bp, Homo sapiens
gcttatattctccag

SEQ ID NO: 425522 - DNA, 15 bp, Homo sapiens
cttatattctccagt

SEQ ID NO: 425523 - DNA, 15 bp, Homo sapiens
ttatattctccagta

SEQ ID NO: 425524 - DNA, 15 bp, Homo sapiens
tatattctccagtaa

SEQ ID NO: 425525 - DNA, 15 bp, Homo sapiens
atattctccagtaag

SEQ ID NO: 425526 - DNA, 15 bp, Homo sapiens
tattctccagtaagc

SEQ ID NO: 425527 - DNA, 15 bp, Homo sapiens
attctccagtaagca

SEQ ID NO: 425528 - DNA, 15 bp, Homo sapiens
ttctccagtaagcag

SEQ ID NO: 425529 - DNA, 15 bp, Homo sapiens
tctccagtaagcagt

SEQ ID NO: 425530 - DNA, 15 bp, Homo sapiens
ctccagtaagcagtt

SEQ ID NO: 425531 - DNA, 15 bp, Homo sapiens
tccagtaagcagtta

SEQ ID NO: 425532 - DNA, 15 bp, Homo sapiens
ccagtaagcagttaa

SEQ ID NO: 425533 - DNA, 15 bp, Homo sapiens
cagtaagcagttaac

SEQ ID NO: 425534 - DNA, 15 bp, Homo sapiens
agtaagcagttaact

SEQ ID NO: 425535 - DNA, 15 bp, Homo sapiens
gtaagcagttaactg

SEQ ID NO: 425536 - DNA, 15 bp, Homo sapiens
taagcagttaactgc

SEQ ID NO: 425537 - DNA, 15 bp, Homo sapiens
aagcagttaactgct

SEQ ID NO: 425538 - DNA, 15 bp, Homo sapiens
agcagttaactgctt

SEQ ID NO: 425539 - DNA, 15 bp, Homo sapiens
gcagttaactgcttt

SEQ ID NO: 425540 - DNA, 15 bp, Homo sapiens
cagttaactgctttt

SEQ ID NO: 425541 - DNA, 15 bp, Homo sapiens
agttaactgcttttt

SEQ ID NO: 425542 - DNA, 15 bp, Homo sapiens
gttaactgctttttt

SEQ ID NO: 425543 - DNA, 15 bp, Homo sapiens
ttaactgcttttttg

SEQ ID NO: 425544 - DNA, 15 bp, Homo sapiens
taactgcttttttga

SEQ ID NO: 425545 - DNA, 15 bp, Homo sapiens
aactgcttttttgaa

SEQ ID NO: 425546 - DNA, 15 bp, Homo sapiens
actgcttttttgaaa

SEQ ID NO: 425547 - DNA, 15 bp, Homo sapiens
ctgcttttttgaaac

SEQ ID NO: 425548 - DNA, 15 bp, Homo sapiens
tgcttttttgaaacc

SEQ ID NO: 425549 - DNA, 15 bp, Homo sapiens
gcttttttgaaacca

SEQ ID NO: 425550 - DNA, 15 bp, Homo sapiens
cttttttgaaaccaa

SEQ ID NO: 425551 - DNA, 15 bp, Homo sapiens
ttttttgaaaccaaa

SEQ ID NO: 425552 - DNA, 15 bp, Homo sapiens
tttttgaaaccaaaa

SEQ ID NO: 425553 - DNA, 15 bp, Homo sapiens
ttttgaaaccaaaag

SEQ ID NO: 425554 - DNA, 15 bp, Homo sapiens
tttgaaaccaaaagc

SEQ ID NO: 425555 - DNA, 15 bp, Homo sapiens
ttgaaaccaaaagct

SEQ ID NO: 425556 - DNA, 15 bp, Homo sapiens
tgaaaccaaaagcta

SEQ ID NO: 425557 - DNA, 15 bp, Homo sapiens
gaaaccaaaagctaa

SEQ ID NO: 425558 - DNA, 15 bp, Homo sapiens
aaaccaaaagctaaa

SEQ ID NO: 425559 - DNA, 15 bp, Homo sapiens
aaccaaaagctaaag

SEQ ID NO: 425560 - DNA, 15 bp, Homo sapiens
accaaaagctaaaga

SEQ ID NO: 425561 - DNA, 15 bp, Homo sapiens
ccaaaagctaaagaa

SEQ ID NO: 425562 - DNA, 15 bp, Homo sapiens
caaaagctaaagaag

SEQ ID NO: 425563 - DNA, 15 bp, Homo sapiens
aaaagctaaagaagc

SEQ ID NO: 425564 - DNA, 15 bp, Homo sapiens
aaagctaaagaagcc

SEQ ID NO: 425565 - DNA, 15 bp, Homo sapiens
aagctaaagaagcct

SEQ ID NO: 425566 - DNA, 15 bp, Homo sapiens
agctaaagaagcctg

SEQ ID NO: 425567 - DNA, 15 bp, Homo sapiens
gctaaagaagcctgc

SEQ ID NO: 425568 - DNA, 15 bp, Homo sapiens
ctaaagaagcctgct

SEQ ID NO: 425569 - DNA, 15 bp, Homo sapiens
taaagaagcctgctg

SEQ ID NO: 425570 - DNA, 15 bp, Homo sapiens
aaagaagcctgctgt

SEQ ID NO: 425571 - DNA, 15 bp, Homo sapiens
aagaagcctgctgta

SEQ ID NO: 425572 - DNA, 15 bp, Homo sapiens
agaagcctgctgtac

SEQ ID NO: 425573 - DNA, 15 bp, Homo sapiens
gaagcctgctgtacc

SEQ ID NO: 425574 - DNA, 15 bp, Homo sapiens
aagcctgctgtacca

SEQ ID NO: 425575 - DNA, 15 bp, Homo sapiens
agcctgctgtaccag

SEQ ID NO: 425576 - DNA, 15 bp, Homo sapiens
gcctgctgtaccagc

SEQ ID NO: 425577 - DNA, 15 bp, Homo sapiens
cctgctgtaccagca

SEQ ID NO: 425578 - DNA, 15 bp, Homo sapiens
ctgctgtaccagcaa

SEQ ID NO: 425579 - DNA, 15 bp, Homo sapiens
tgctgtaccagcaat

SEQ ID NO: 425580 - DNA, 15 bp, Homo sapiens
gctgtaccagcaata

SEQ ID NO: 425581 - DNA, 15 bp, Homo sapiens
ctgtaccagcaatac

SEQ ID NO: 425582 - DNA, 15 bp, Homo sapiens
tgtaccagcaatacc

SEQ ID NO: 425583 - DNA, 15 bp, Homo sapiens
gtaccagcaatacct

SEQ ID NO: 425584 - DNA, 15 bp, Homo sapiens
taccagcaatacctc

SEQ ID NO: 425585 - DNA, 15 bp, Homo sapiens
accagcaatacctct

SEQ ID NO: 425586 - DNA, 15 bp, Homo sapiens
ccagcaatacctcta

SEQ ID NO: 425587 - DNA, 15 bp, Homo sapiens
cagcaatacctctat

SEQ ID NO: 425588 - DNA, 15 bp, Homo sapiens
agcaatacctctatt

SEQ ID NO: 425589 - DNA, 15 bp, Homo sapiens
gcaatacctctattt

SEQ ID NO: 425590 - DNA, 15 bp, Homo sapiens
caatacctctatttg

SEQ ID NO: 425591 - DNA, 15 bp, Homo sapiens
aatacctctatttgt

SEQ ID NO: 425592 - DNA, 15 bp, Homo sapiens
atacctctatttgtt

SEQ ID NO: 425593 - DNA, 15 bp, Homo sapiens
tacctctatttgtta

SEQ ID NO: 425594 - DNA, 15 bp, Homo sapiens
acctctatttgttat

SEQ ID NO: 425595 - DNA, 15 bp, Homo sapiens
cctctatttgttata

SEQ ID NO: 425596 - DNA, 15 bp, Homo sapiens
ctctatttgttataa

SEQ ID NO: 425597 - DNA, 15 bp, Homo sapiens
tctatttgttataat

SEQ ID NO: 425598 - DNA, 15 bp, Homo sapiens
ctatttgttataatt

SEQ ID NO: 425599 - DNA, 15 bp, Homo sapiens
tatttgttataattc

SEQ ID NO: 425600 - DNA, 15 bp, Homo sapiens
atttgttataattca

SEQ ID NO: 425601 - DNA, 15 bp, Homo sapiens
tttgttataattcag

SEQ ID NO: 425602 - DNA, 15 bp, Homo sapiens
ttgttataattcagc

SEQ ID NO: 425603 - DNA, 15 bp, Homo sapiens
tgttataattcagct

SEQ ID NO: 425604 - DNA, 15 bp, Homo sapiens
gttataattcagcta

SEQ ID NO: 425605 - DNA, 15 bp, Homo sapiens
ttataattcagctac

SEQ ID NO: 425606 - DNA, 15 bp, Homo sapiens
tataattcagctacc

SEQ ID NO: 425607 - DNA, 15 bp, Homo sapiens
ataattcagctaccc

SEQ ID NO: 425608 - DNA, 15 bp, Homo sapiens
taattcagctaccct

SEQ ID NO: 425609 - DNA, 15 bp, Homo sapiens
aattcagctaccctg

SEQ ID NO: 425610 - DNA, 15 bp, Homo sapiens
attcagctaccctgc

SEQ ID NO: 425611 - DNA, 15 bp, Homo sapiens
ttcagctaccctgca

SEQ ID NO: 425612 - DNA, 15 bp, Homo sapiens
tcagctaccctgcat

SEQ ID NO: 425613 - DNA, 15 bp, Homo sapiens
cagctaccctgcatt

SEQ ID NO: 425614 - DNA, 15 bp, Homo sapiens
agctaccctgcattt

SEQ ID NO: 425615 - DNA, 15 bp, Homo sapiens
gctaccctgcattta

SEQ ID NO: 425616 - DNA, 15 bp, Homo sapiens
ctaccctgcatttag

SEQ ID NO: 425617 - DNA, 15 bp, Homo sapiens
taccctgcatttagg

SEQ ID NO: 425618 - DNA, 15 bp, Homo sapiens
accctgcatttaggg

SEQ ID NO: 425619 - DNA, 15 bp, Homo sapiens
ccctgcatttagggc

SEQ ID NO: 425620 - DNA, 15 bp, Homo sapiens
cctgcatttagggcc

SEQ ID NO: 425621 - DNA, 15 bp, Homo sapiens
ctgcatttagggcca

SEQ ID NO: 425622 - DNA, 15 bp, Homo sapiens
tgcatttagggccag

SEQ ID NO: 425623 - DNA, 15 bp, Homo sapiens
gcatttagggccagc

SEQ ID NO: 425624 - DNA, 15 bp, Homo sapiens
catttagggccagct

SEQ ID NO: 425625 - DNA, 15 bp, Homo sapiens
atttagggccagctt

SEQ ID NO: 425626 - DNA, 15 bp, Homo sapiens
tttagggccagcttc

SEQ ID NO: 425627 - DNA, 15 bp, Homo sapiens
ttagggccagcttct

SEQ ID NO: 425628 - DNA, 15 bp, Homo sapiens
tagggccagcttctc

SEQ ID NO: 425629 - DNA, 15 bp, Homo sapiens
agggccagcttctca

SEQ ID NO: 425630 - DNA, 15 bp, Homo sapiens
gggccagcttctcag

SEQ ID NO: 425631 - DNA, 15 bp, Homo sapiens
ggccagcttctcagg

SEQ ID NO: 425632 - DNA, 15 bp, Homo sapiens
gccagcttctcaggt

SEQ ID NO: 425633 - DNA, 15 bp, Homo sapiens
ccagcttctcaggtg

SEQ ID NO: 425634 - DNA, 15 bp, Homo sapiens
cagcttctcaggtgt

SEQ ID NO: 425635 - DNA, 15 bp, Homo sapiens
agcttctcaggtgtc

SEQ ID NO: 425636 - DNA, 15 bp, Homo sapiens
gcttctcaggtgtcc

SEQ ID NO: 425637 - DNA, 15 bp, Homo sapiens
cttctcaggtgtccc

SEQ ID NO: 425638 - DNA, 15 bp, Homo sapiens
ttctcaggtgtccca

SEQ ID NO: 425639 - DNA, 15 bp, Homo sapiens
tctcaggtgtcccat

SEQ ID NO: 425640 - DNA, 15 bp, Homo sapiens
ctcaggtgtcccatg

SEQ ID NO: 425641 - DNA, 15 bp, Homo sapiens
tcaggtgtcccatgc

SEQ ID NO: 425642 - DNA, 15 bp, Homo sapiens
caggtgtcccatgca

SEQ ID NO: 425643 - DNA, 15 bp, Homo sapiens
aggtgtcccatgcag

SEQ ID NO: 425644 - DNA, 15 bp, Homo sapiens
ggtgtcccatgcagt

SEQ ID NO: 425645 - DNA, 15 bp, Homo sapiens
gtgtcccatgcagtc

SEQ ID NO: 425646 - DNA, 15 bp, Homo sapiens
tgtcccatgcagtca

SEQ ID NO: 425647 - DNA, 15 bp, Homo sapiens
gtcccatgcagtcac

SEQ ID NO: 425648 - DNA, 15 bp, Homo sapiens
tcccatgcagtcaca

SEQ ID NO: 425649 - DNA, 15 bp, Homo sapiens
cccatgcagtcacac

SEQ ID NO: 425650 - DNA, 15 bp, Homo sapiens
ccatgcagtcacaca

SEQ ID NO: 425651 - DNA, 15 bp, Homo sapiens
catgcagtcacacag

SEQ ID NO: 425652 - DNA, 15 bp, Homo sapiens
atgcagtcacacagg

SEQ ID NO: 425653 - DNA, 15 bp, Homo sapiens
tgcagtcacacaggg

SEQ ID NO: 425654 - DNA, 15 bp, Homo sapiens
gcagtcacacagggc

SEQ ID NO: 425655 - DNA, 15 bp, Homo sapiens
cagtcacacagggct

SEQ ID NO: 425656 - DNA, 15 bp, Homo sapiens
agtcacacagggctc

SEQ ID NO: 425657 - DNA, 15 bp, Homo sapiens
gtcacacagggctct

SEQ ID NO: 425658 - DNA, 15 bp, Homo sapiens
tcacacagggctctg

SEQ ID NO: 425659 - DNA, 15 bp, Homo sapiens
cacacagggctctgc

SEQ ID NO: 425660 - DNA, 15 bp, Homo sapiens
acacagggctctgct

SEQ ID NO: 425661 - DNA, 15 bp, Homo sapiens
cacagggctctgctc

SEQ ID NO: 425662 - DNA, 15 bp, Homo sapiens
acagggctctgctct

SEQ ID NO: 425663 - DNA, 15 bp, Homo sapiens
cagggctctgctctt

SEQ ID NO: 425664 - DNA, 15 bp, Homo sapiens
agggctctgctctta

SEQ ID NO: 425665 - DNA, 15 bp, Homo sapiens
gggctctgctcttac

SEQ ID NO: 425666 - DNA, 15 bp, Homo sapiens
ggctctgctcttaca

SEQ ID NO: 425667 - DNA, 15 bp, Homo sapiens
gctctgctcttacaa

SEQ ID NO: 425668 - DNA, 15 bp, Homo sapiens
ctctgctcttacaag

SEQ ID NO: 425669 - DNA, 15 bp, Homo sapiens
tctgctcttacaagg

SEQ ID NO: 425670 - DNA, 15 bp, Homo sapiens
ctgctcttacaaggt

SEQ ID NO: 425671 - DNA, 15 bp, Homo sapiens
tgctcttacaaggtt

SEQ ID NO: 425672 - DNA, 15 bp, Homo sapiens
gctcttacaaggttt

SEQ ID NO: 425673 - DNA, 15 bp, Homo sapiens
ctcttacaaggtttc

SEQ ID NO: 425674 - DNA, 15 bp, Homo sapiens
tcttacaaggtttct

SEQ ID NO: 425675 - DNA, 15 bp, Homo sapiens
cttacaaggtttctg

SEQ ID NO: 425676 - DNA, 15 bp, Homo sapiens
ttacaaggtttctgc

SEQ ID NO: 425677 - DNA, 15 bp, Homo sapiens
tacaaggtttctgca

SEQ ID NO: 425678 - DNA, 15 bp, Homo sapiens
acaaggtttctgcac

SEQ ID NO: 425679 - DNA, 15 bp, Homo sapiens
caaggtttctgcact

SEQ ID NO: 425680 - DNA, 15 bp, Homo sapiens
aaggtttctgcactt

SEQ ID NO: 425681 - DNA, 15 bp, Homo sapiens
aggtttctgcacttg

SEQ ID NO: 425682 - DNA, 15 bp, Homo sapiens
ggtttctgcacttgg

SEQ ID NO: 425683 - DNA, 15 bp, Homo sapiens
gtttctgcacttggc

SEQ ID NO: 425684 - DNA, 15 bp, Homo sapiens
tttctgcacttggct

SEQ ID NO: 425685 - DNA, 15 bp, Homo sapiens
ttctgcacttggctt

SEQ ID NO: 425686 - DNA, 15 bp, Homo sapiens
tctgcacttggctta

SEQ ID NO: 425687 - DNA, 15 bp, Homo sapiens
ctgcacttggcttaa

SEQ ID NO: 425688 - DNA, 15 bp, Homo sapiens
tgcacttggcttaat

SEQ ID NO: 425689 - DNA, 15 bp, Homo sapiens
gcacttggcttaatg

SEQ ID NO: 425690 - DNA, 15 bp, Homo sapiens
cacttggcttaatgt

SEQ ID NO: 425691 - DNA, 15 bp, Homo sapiens
acttggcttaatgtt

SEQ ID NO: 425692 - DNA, 15 bp, Homo sapiens
cttggcttaatgttc

SEQ ID NO: 425693 - DNA, 15 bp, Homo sapiens
ttggcttaatgttct

SEQ ID NO: 425694 - DNA, 15 bp, Homo sapiens
tggcttaatgttctt

SEQ ID NO: 425695 - DNA, 15 bp, Homo sapiens
ggcttaatgttcttc

SEQ ID NO: 425696 - DNA, 15 bp, Homo sapiens
gcttaatgttcttct

SEQ ID NO: 425697 - DNA, 15 bp, Homo sapiens
cttaatgttcttctg

SEQ ID NO: 425698 - DNA, 15 bp, Homo sapiens
ttaatgttcttctgc

SEQ ID NO: 425699 - DNA, 15 bp, Homo sapiens
taatgttcttctgct

SEQ ID NO: 425700 - DNA, 15 bp, Homo sapiens
aatgttcttctgctg

SEQ ID NO: 425701 - DNA, 15 bp, Homo sapiens
atgttcttctgctgc

SEQ ID NO: 425702 - DNA, 15 bp, Homo sapiens
tgttcttctgctgcc

SEQ ID NO: 425703 - DNA, 15 bp, Homo sapiens
gttcttctgctgcca

SEQ ID NO: 425704 - DNA, 15 bp, Homo sapiens
ttcttctgctgccat

SEQ ID NO: 425705 - DNA, 15 bp, Homo sapiens
tcttctgctgccatc

SEQ ID NO: 425706 - DNA, 15 bp, Homo sapiens
cttctgctgccatct

SEQ ID NO: 425707 - DNA, 15 bp, Homo sapiens
ttctgctgccatctt

SEQ ID NO: 425708 - DNA, 15 bp, Homo sapiens
tctgctgccatcttg

SEQ ID NO: 425709 - DNA, 15 bp, Homo sapiens
ctgctgccatcttga

SEQ ID NO: 425710 - DNA, 15 bp, Homo sapiens
tgctgccatcttgag

SEQ ID NO: 425711 - DNA, 15 bp, Homo sapiens
gctgccatcttgaga

SEQ ID NO: 425712 - DNA, 15 bp, Homo sapiens
ctgccatcttgagat

SEQ ID NO: 425713 - DNA, 15 bp, Homo sapiens
tgccatcttgagatt

SEQ ID NO: 425714 - DNA, 15 bp, Homo sapiens
gccatcttgagattc

SEQ ID NO: 425715 - DNA, 15 bp, Homo sapiens
ccatcttgagattct

SEQ ID NO: 425716 - DNA, 15 bp, Homo sapiens
catcttgagattctt

SEQ ID NO: 425717 - DNA, 15 bp, Homo sapiens
atcttgagattctta

SEQ ID NO: 425718 - DNA, 15 bp, Homo sapiens
tcttgagattcttag

SEQ ID NO: 425719 - DNA, 15 bp, Homo sapiens
cttgagattcttagt

SEQ ID NO: 425720 - DNA, 15 bp, Homo sapiens
ttgagattcttagta

SEQ ID NO: 425721 - DNA, 15 bp, Homo sapiens
tgagattcttagtaa

SEQ ID NO: 425722 - DNA, 15 bp, Homo sapiens
gagattcttagtaat

SEQ ID NO: 425723 - DNA, 15 bp, Homo sapiens
agattcttagtaata

SEQ ID NO: 425724 - DNA, 15 bp, Homo sapiens
gattcttagtaatat

SEQ ID NO: 425725 - DNA, 15 bp, Homo sapiens
attcttagtaatatt

SEQ ID NO: 425726 - DNA, 15 bp, Homo sapiens
ttcttagtaatattt

SEQ ID NO: 425727 - DNA, 15 bp, Homo sapiens
tcttagtaatatttg

SEQ ID NO: 425728 - DNA, 15 bp, Homo sapiens
cttagtaatatttgg

SEQ ID NO: 425729 - DNA, 15 bp, Homo sapiens
ttagtaatatttgga

SEQ ID NO: 425730 - DNA, 15 bp, Homo sapiens
tagtaatatttggac

SEQ ID NO: 425731 - DNA, 15 bp, Homo sapiens
agtaatatttggaca

SEQ ID NO: 425732 - DNA, 15 bp, Homo sapiens
gtaatatttggacaa

SEQ ID NO: 425733 - DNA, 15 bp, Homo sapiens
taatatttggacaag

SEQ ID NO: 425734 - DNA, 15 bp, Homo sapiens
aatatttggacaagg

SEQ ID NO: 425735 - DNA, 15 bp, Homo sapiens
atatttggacaaggg

SEQ ID NO: 425736 - DNA, 15 bp, Homo sapiens
tatttggacaagggg

SEQ ID NO: 425737 - DNA, 15 bp, Homo sapiens
atttggacaaggggc

SEQ ID NO: 425738 - DNA, 15 bp, Homo sapiens
tttggacaaggggcc

SEQ ID NO: 425739 - DNA, 15 bp, Homo sapiens
ttggacaaggggccc

SEQ ID NO: 425740 - DNA, 15 bp, Homo sapiens
tggacaaggggccct

SEQ ID NO: 425741 - DNA, 15 bp, Homo sapiens
ggacaaggggccctg

SEQ ID NO: 425742 - DNA, 15 bp, Homo sapiens
gacaaggggccctgt

SEQ ID NO: 425743 - DNA, 15 bp, Homo sapiens
acaaggggccctgtt

SEQ ID NO: 425744 - DNA, 15 bp, Homo sapiens
caaggggccctgtta

SEQ ID NO: 425745 - DNA, 15 bp, Homo sapiens
aaggggccctgttac

SEQ ID NO: 425746 - DNA, 15 bp, Homo sapiens
aggggccctgttaca

SEQ ID NO: 425747 - DNA, 15 bp, Homo sapiens
ggggccctgttacac

SEQ ID NO: 425748 - DNA, 15 bp, Homo sapiens
gggccctgttacact

SEQ ID NO: 425749 - DNA, 15 bp, Homo sapiens
ggccctgttacactg

SEQ ID NO: 425750 - DNA, 15 bp, Homo sapiens
gccctgttacactga

SEQ ID NO: 425751 - DNA, 15 bp, Homo sapiens
ccctgttacactgag

SEQ ID NO: 425752 - DNA, 15 bp, Homo sapiens
cctgttacactgagg

SEQ ID NO: 425753 - DNA, 15 bp, Homo sapiens
ctgttacactgaggt

SEQ ID NO: 425754 - DNA, 15 bp, Homo sapiens
tgttacactgaggtc

SEQ ID NO: 425755 - DNA, 15 bp, Homo sapiens
gttacactgaggtct

SEQ ID NO: 425756 - DNA, 15 bp, Homo sapiens
ttacactgaggtctg

SEQ ID NO: 425757 - DNA, 15 bp, Homo sapiens
tacactgaggtctgc

SEQ ID NO: 425758 - DNA, 15 bp, Homo sapiens
acactgaggtctgca

SEQ ID NO: 425759 - DNA, 15 bp, Homo sapiens
cactgaggtctgcaa

SEQ ID NO: 425760 - DNA, 15 bp, Homo sapiens
actgaggtctgcaat

SEQ ID NO: 425761 - DNA, 15 bp, Homo sapiens
ctgaggtctgcaatc

SEQ ID NO: 425762 - DNA, 15 bp, Homo sapiens
tgaggtctgcaatca

SEQ ID NO: 425763 - DNA, 15 bp, Homo sapiens
gaggtctgcaatcac

SEQ ID NO: 425764 - DNA, 15 bp, Homo sapiens
aggtctgcaatcaca

SEQ ID NO: 425765 - DNA, 15 bp, Homo sapiens
ggtctgcaatcacat

SEQ ID NO: 425766 - DNA, 15 bp, Homo sapiens
gtctgcaatcacata

SEQ ID NO: 425767 - DNA, 15 bp, Homo sapiens
tctgcaatcacatag

SEQ ID NO: 425768 - DNA, 15 bp, Homo sapiens
ctgcaatcacatagc

SEQ ID NO: 425769 - DNA, 15 bp, Homo sapiens
tgcaatcacatagcc

SEQ ID NO: 425770 - DNA, 15 bp, Homo sapiens
gcaatcacatagcca

SEQ ID NO: 425771 - DNA, 15 bp, Homo sapiens
caatcacatagccag

SEQ ID NO: 425772 - DNA, 15 bp, Homo sapiens
aatcacatagccaga

SEQ ID NO: 425773 - DNA, 15 bp, Homo sapiens
atcacatagccagac

SEQ ID NO: 425774 - DNA, 15 bp, Homo sapiens
tcacatagccagacc

SEQ ID NO: 425775 - DNA, 15 bp, Homo sapiens
cacatagccagacct

SEQ ID NO: 425776 - DNA, 15 bp, Homo sapiens
acatagccagacctg

SEQ ID NO: 425777 - DNA, 15 bp, Homo sapiens
catagccagacctgc

SEQ ID NO: 425778 - DNA, 15 bp, Homo sapiens
atagccagacctgct

SEQ ID NO: 425779 - DNA, 15 bp, Homo sapiens
tagccagacctgctt

SEQ ID NO: 425780 - DNA, 15 bp, Homo sapiens
agccagacctgcttg

SEQ ID NO: 425781 - DNA, 15 bp, Homo sapiens
gccagacctgcttgc

SEQ ID NO: 425782 - DNA, 15 bp, Homo sapiens
ccagacctgcttgca

SEQ ID NO: 425783 - DNA, 15 bp, Homo sapiens
cagacctgcttgcat

SEQ ID NO: 425784 - DNA, 15 bp, Homo sapiens
agacctgcttgcatt

SEQ ID NO: 425785 - DNA, 15 bp, Homo sapiens
gacctgcttgcattg

SEQ ID NO: 425786 - DNA, 15 bp, Homo sapiens
acctgcttgcattgc

SEQ ID NO: 425787 - DNA, 15 bp, Homo sapiens
cctgcttgcattgcg

SEQ ID NO: 425788 - DNA, 15 bp, Homo sapiens
ctgcttgcattgcga

SEQ ID NO: 425789 - DNA, 15 bp, Homo sapiens
tgcttgcattgcgaa

SEQ ID NO: 425790 - DNA, 15 bp, Homo sapiens
gcttgcattgcgaag

SEQ ID NO: 425791 - DNA, 15 bp, Homo sapiens
cttgcattgcgaaga

SEQ ID NO: 425792 - DNA, 15 bp, Homo sapiens
ttgcattgcgaagaa

SEQ ID NO: 425793 - DNA, 15 bp, Homo sapiens
tgcattgcgaagaac

SEQ ID NO: 425794 - DNA, 15 bp, Homo sapiens
gcattgcgaagaaca

SEQ ID NO: 425795 - DNA, 15 bp, Homo sapiens
cattgcgaagaacat

SEQ ID NO: 425796 - DNA, 15 bp, Homo sapiens
attgcgaagaacatt

SEQ ID NO: 425797 - DNA, 15 bp, Homo sapiens
ttgcgaagaacatta

SEQ ID NO: 425798 - DNA, 15 bp, Homo sapiens
tgcgaagaacattaa

SEQ ID NO: 425799 - DNA, 15 bp, Homo sapiens
gcgaagaacattaac

SEQ ID NO: 425800 - DNA, 15 bp, Homo sapiens
cgaagaacattaaca

SEQ ID NO: 425801 - DNA, 15 bp, Homo sapiens
gaagaacattaacat

SEQ ID NO: 425802 - DNA, 15 bp, Homo sapiens
aagaacattaacata

SEQ ID NO: 425803 - DNA, 15 bp, Homo sapiens
agaacattaacatat

SEQ ID NO: 425804 - DNA, 15 bp, Homo sapiens
gaacattaacatata

SEQ ID NO: 425805 - DNA, 15 bp, Homo sapiens
aacattaacatatat

SEQ ID NO: 425806 - DNA, 15 bp, Homo sapiens
acattaacatatata

SEQ ID NO: 425807 - DNA, 15 bp, Homo sapiens
cattaacatatatat

SEQ ID NO: 425808 - DNA, 15 bp, Homo sapiens
attaacatatatatt

SEQ ID NO: 425809 - DNA, 15 bp, Homo sapiens
ttaacatatatattc

SEQ ID NO: 425810 - DNA, 15 bp, Homo sapiens
taacatatatattct

SEQ ID NO: 425811 - DNA, 15 bp, Homo sapiens
aacatatatattctg

SEQ ID NO: 425812 - DNA, 15 bp, Homo sapiens
acatatatattctga

SEQ ID NO: 425813 - DNA, 15 bp, Homo sapiens
catatatattctgac

SEQ ID NO: 425814 - DNA, 15 bp, Homo sapiens
atatatattctgaca

SEQ ID NO: 425815 - DNA, 15 bp, Homo sapiens
tatatattctgacac

SEQ ID NO: 425816 - DNA, 15 bp, Homo sapiens
atatattctgacaca

SEQ ID NO: 425817 - DNA, 15 bp, Homo sapiens
tatattctgacacat

SEQ ID NO: 425818 - DNA, 15 bp, Homo sapiens
atattctgacacatg

SEQ ID NO: 425819 - DNA, 15 bp, Homo sapiens
tattctgacacatgt

SEQ ID NO: 425820 - DNA, 15 bp, Homo sapiens
attctgacacatgta

SEQ ID NO: 425821 - DNA, 15 bp, Homo sapiens
ttctgacacatgtaa

SEQ ID NO: 425822 - DNA, 15 bp, Homo sapiens
tctgacacatgtaac

SEQ ID NO: 425823 - DNA, 15 bp, Homo sapiens
ctgacacatgtaaca

SEQ ID NO: 425824 - DNA, 15 bp, Homo sapiens
tgacacatgtaacac

SEQ ID NO: 425825 - DNA, 15 bp, Homo sapiens
gacacatgtaacaca

SEQ ID NO: 425826 - DNA, 15 bp, Homo sapiens
acacatgtaacacaa

SEQ ID NO: 425827 - DNA, 15 bp, Homo sapiens
cacatgtaacacaat

SEQ ID NO: 425828 - DNA, 15 bp, Homo sapiens
acatgtaacacaata

SEQ ID NO: 425829 - DNA, 15 bp, Homo sapiens
catgtaacacaatat

SEQ ID NO: 425830 - DNA, 15 bp, Homo sapiens
atgtaacacaatatt

SEQ ID NO: 425831 - DNA, 15 bp, Homo sapiens
tgtaacacaatattg

SEQ ID NO: 425832 - DNA, 15 bp, Homo sapiens
gtaacacaatattga

SEQ ID NO: 425833 - DNA, 15 bp, Homo sapiens
taacacaatattgaa

SEQ ID NO: 425834 - DNA, 15 bp, Homo sapiens
aacacaatattgaat

SEQ ID NO: 425835 - DNA, 15 bp, Homo sapiens
acacaatattgaatg

SEQ ID NO: 425836 - DNA, 15 bp, Homo sapiens
cacaatattgaatgc

SEQ ID NO: 425837 - DNA, 15 bp, Homo sapiens
acaatattgaatgcc

SEQ ID NO: 425838 - DNA, 15 bp, Homo sapiens
caatattgaatgcct

SEQ ID NO: 425839 - DNA, 15 bp, Homo sapiens
aatattgaatgcctc

SEQ ID NO: 425840 - DNA, 15 bp, Homo sapiens
atattgaatgcctct

SEQ ID NO: 425841 - DNA, 15 bp, Homo sapiens
tattgaatgcctctt

SEQ ID NO: 425842 - DNA, 15 bp, Homo sapiens
attgaatgcctctta

SEQ ID NO: 425843 - DNA, 15 bp, Homo sapiens
ttgaatgcctcttaa

SEQ ID NO: 425844 - DNA, 15 bp, Homo sapiens
tgaatgcctcttaaa

SEQ ID NO: 425845 - DNA, 15 bp, Homo sapiens
gaatgcctcttaaaa

SEQ ID NO: 425846 - DNA, 15 bp, Homo sapiens
aatgcctcttaaaac

SEQ ID NO: 425847 - DNA, 15 bp, Homo sapiens
atgcctcttaaaact

SEQ ID NO: 425848 - DNA, 15 bp, Homo sapiens
tgcctcttaaaactt

SEQ ID NO: 425849 - DNA, 15 bp, Homo sapiens
gcctcttaaaacttg

SEQ ID NO: 425850 - DNA, 15 bp, Homo sapiens
cctcttaaaacttgc

SEQ ID NO: 425851 - DNA, 15 bp, Homo sapiens
ctcttaaaacttgct

SEQ ID NO: 425852 - DNA, 15 bp, Homo sapiens
tcttaaaacttgctt

SEQ ID NO: 425853 - DNA, 15 bp, Homo sapiens
cttaaaacttgcttc

SEQ ID NO: 425854 - DNA, 15 bp, Homo sapiens
ttaaaacttgcttca

SEQ ID NO: 425855 - DNA, 15 bp, Homo sapiens
taaaacttgcttcaa

SEQ ID NO: 425856 - DNA, 15 bp, Homo sapiens
aaaacttgcttcaag

SEQ ID NO: 425857 - DNA, 15 bp, Homo sapiens
aaacttgcttcaagc

SEQ ID NO: 425858 - DNA, 15 bp, Homo sapiens
aacttgcttcaagca

SEQ ID NO: 425859 - DNA, 15 bp, Homo sapiens
acttgcttcaagcat

SEQ ID NO: 425860 - DNA, 15 bp, Homo sapiens
cttgcttcaagcatc

SEQ ID NO: 425861 - DNA, 15 bp, Homo sapiens
ttgcttcaagcatct

SEQ ID NO: 425862 - DNA, 15 bp, Homo sapiens
tgcttcaagcatctt

SEQ ID NO: 425863 - DNA, 15 bp, Homo sapiens
gcttcaagcatcttt

SEQ ID NO: 425864 - DNA, 15 bp, Homo sapiens
cttcaagcatctttc

SEQ ID NO: 425865 - DNA, 15 bp, Homo sapiens
ttcaagcatctttcc

SEQ ID NO: 425866 - DNA, 15 bp, Homo sapiens
tcaagcatctttcca

SEQ ID NO: 425867 - DNA, 15 bp, Homo sapiens
caagcatctttccat

SEQ ID NO: 425868 - DNA, 15 bp, Homo sapiens
aagcatctttccatc

SEQ ID NO: 425869 - DNA, 15 bp, Homo sapiens
agcatctttccatct

SEQ ID NO: 425870 - DNA, 15 bp, Homo sapiens
gcatctttccatctc

SEQ ID NO: 425871 - DNA, 15 bp, Homo sapiens
catctttccatctcc

SEQ ID NO: 425872 - DNA, 15 bp, Homo sapiens
atctttccatctcct

SEQ ID NO: 425873 - DNA, 15 bp, Homo sapiens
tctttccatctcctt

SEQ ID NO: 425874 - DNA, 15 bp, Homo sapiens
ctttccatctcctta

SEQ ID NO: 425875 - DNA, 15 bp, Homo sapiens
tttccatctccttag

SEQ ID NO: 425876 - DNA, 15 bp, Homo sapiens
ttccatctccttagg

SEQ ID NO: 425877 - DNA, 15 bp, Homo sapiens
tccatctccttaggt

SEQ ID NO: 425878 - DNA, 15 bp, Homo sapiens
ccatctccttaggta

SEQ ID NO: 425879 - DNA, 15 bp, Homo sapiens
catctccttaggtaa

SEQ ID NO: 425880 - DNA, 15 bp, Homo sapiens
atctccttaggtaag

SEQ ID NO: 425881 - DNA, 15 bp, Homo sapiens
tctccttaggtaagg

SEQ ID NO: 425882 - DNA, 15 bp, Homo sapiens
ctccttaggtaagga

SEQ ID NO: 425883 - DNA, 15 bp, Homo sapiens
tccttaggtaaggaa

SEQ ID NO: 425884 - DNA, 15 bp, Homo sapiens
ccttaggtaaggaag

SEQ ID NO: 425885 - DNA, 15 bp, Homo sapiens
cttaggtaaggaagc

SEQ ID NO: 425886 - DNA, 15 bp, Homo sapiens
ttaggtaaggaagcc

SEQ ID NO: 425887 - DNA, 15 bp, Homo sapiens
taggtaaggaagcca

SEQ ID NO: 425888 - DNA, 15 bp, Homo sapiens
aggtaaggaagccat

SEQ ID NO: 425889 - DNA, 15 bp, Homo sapiens
ggtaaggaagccatc

SEQ ID NO: 425890 - DNA, 15 bp, Homo sapiens
gtaaggaagccatcc

SEQ ID NO: 425891 - DNA, 15 bp, Homo sapiens
taaggaagccatcct

SEQ ID NO: 425892 - DNA, 15 bp, Homo sapiens
aaggaagccatcctg

SEQ ID NO: 425893 - DNA, 15 bp, Homo sapiens
aggaagccatcctga

SEQ ID NO: 425894 - DNA, 15 bp, Homo sapiens
ggaagccatcctgag

SEQ ID NO: 425895 - DNA, 15 bp, Homo sapiens
gaagccatcctgagc

SEQ ID NO: 425896 - DNA, 15 bp, Homo sapiens
aagccatcctgagcc

SEQ ID NO: 425897 - DNA, 15 bp, Homo sapiens
agccatcctgagccc

SEQ ID NO: 425898 - DNA, 15 bp, Homo sapiens
gccatcctgagcccc

SEQ ID NO: 425899 - DNA, 15 bp, Homo sapiens
ccatcctgagcccca

SEQ ID NO: 425900 - DNA, 15 bp, Homo sapiens
catcctgagccccac

SEQ ID NO: 425901 - DNA, 15 bp, Homo sapiens
atcctgagccccact

SEQ ID NO: 425902 - DNA, 15 bp, Homo sapiens
tcctgagccccactc

SEQ ID NO: 425903 - DNA, 15 bp, Homo sapiens
cctgagccccactct

SEQ ID NO: 425904 - DNA, 15 bp, Homo sapiens
ctgagccccactctg

SEQ ID NO: 425905 - DNA, 15 bp, Homo sapiens
tgagccccactctga

SEQ ID NO: 425906 - DNA, 15 bp, Homo sapiens
gagccccactctgag

SEQ ID NO: 425907 - DNA, 15 bp, Homo sapiens
agccccactctgagt

SEQ ID NO: 425908 - DNA, 15 bp, Homo sapiens
gccccactctgagtt

SEQ ID NO: 425909 - DNA, 15 bp, Homo sapiens
ccccactctgagtta

SEQ ID NO: 425910 - DNA, 15 bp, Homo sapiens
cccactctgagttac

SEQ ID NO: 425911 - DNA, 15 bp, Homo sapiens
ccactctgagttaca

SEQ ID NO: 425912 - DNA, 15 bp, Homo sapiens
cactctgagttacat

SEQ ID NO: 425913 - DNA, 15 bp, Homo sapiens
actctgagttacatg

SEQ ID NO: 425914 - DNA, 15 bp, Homo sapiens
ctctgagttacatgc

SEQ ID NO: 425915 - DNA, 15 bp, Homo sapiens
tctgagttacatgcc

SEQ ID NO: 425916 - DNA, 15 bp, Homo sapiens
ctgagttacatgccc

SEQ ID NO: 425917 - DNA, 15 bp, Homo sapiens
tgagttacatgcccc

SEQ ID NO: 425918 - DNA, 15 bp, Homo sapiens
gagttacatgcccct

SEQ ID NO: 425919 - DNA, 15 bp, Homo sapiens
agttacatgcccctt

SEQ ID NO: 425920 - DNA, 15 bp, Homo sapiens
gttacatgccccttg

SEQ ID NO: 425921 - DNA, 15 bp, Homo sapiens
ttacatgccccttgt

SEQ ID NO: 425922 - DNA, 15 bp, Homo sapiens
tacatgccccttgtt

SEQ ID NO: 425923 - DNA, 15 bp, Homo sapiens
acatgccccttgttg

SEQ ID NO: 425924 - DNA, 15 bp, Homo sapiens
catgccccttgttgt

SEQ ID NO: 425925 - DNA, 15 bp, Homo sapiens
atgccccttgttgta

SEQ ID NO: 425926 - DNA, 15 bp, Homo sapiens
tgccccttgttgtaa

SEQ ID NO: 425927 - DNA, 15 bp, Homo sapiens
gccccttgttgtaat

SEQ ID NO: 425928 - DNA, 15 bp, Homo sapiens
ccccttgttgtaatt

SEQ ID NO: 425929 - DNA, 15 bp, Homo sapiens
cccttgttgtaattt

SEQ ID NO: 425930 - DNA, 15 bp, Homo sapiens
ccttgttgtaatttg

SEQ ID NO: 425931 - DNA, 15 bp, Homo sapiens
cttgttgtaatttgt

SEQ ID NO: 425932 - DNA, 15 bp, Homo sapiens
ttgttgtaatttgtg

SEQ ID NO: 425933 - DNA, 15 bp, Homo sapiens
tgttgtaatttgtga

SEQ ID NO: 425934 - DNA, 15 bp, Homo sapiens
gttgtaatttgtgat

SEQ ID NO: 425935 - DNA, 15 bp, Homo sapiens
ttgtaatttgtgatg

SEQ ID NO: 425936 - DNA, 15 bp, Homo sapiens
tgtaatttgtgatgt

SEQ ID NO: 425937 - DNA, 15 bp, Homo sapiens
gtaatttgtgatgtc

SEQ ID NO: 425938 - DNA, 15 bp, Homo sapiens
taatttgtgatgtct

SEQ ID NO: 425939 - DNA, 15 bp, Homo sapiens
aatttgtgatgtctc

SEQ ID NO: 425940 - DNA, 15 bp, Homo sapiens
atttgtgatgtctct

SEQ ID NO: 425941 - DNA, 15 bp, Homo sapiens
tttgtgatgtctctg

SEQ ID NO: 425942 - DNA, 15 bp, Homo sapiens
ttgtgatgtctctgt

SEQ ID NO: 425943 - DNA, 15 bp, Homo sapiens
tgtgatgtctctgtt

SEQ ID NO: 425944 - DNA, 15 bp, Homo sapiens
gtgatgtctctgttt

SEQ ID NO: 425945 - DNA, 15 bp, Homo sapiens
tgatgtctctgtttg

SEQ ID NO: 425946 - DNA, 15 bp, Homo sapiens
gatgtctctgtttgt

SEQ ID NO: 425947 - DNA, 15 bp, Homo sapiens
atgtctctgtttgtt

SEQ ID NO: 425948 - DNA, 15 bp, Homo sapiens
tgtctctgtttgtta

SEQ ID NO: 425949 - DNA, 15 bp, Homo sapiens
gtctctgtttgttag

SEQ ID NO: 425950 - DNA, 15 bp, Homo sapiens
tctctgtttgttagt

SEQ ID NO: 425951 - DNA, 15 bp, Homo sapiens
ctctgtttgttagtg

SEQ ID NO: 425952 - DNA, 15 bp, Homo sapiens
tctgtttgttagtgt

SEQ ID NO: 425953 - DNA, 15 bp, Homo sapiens
ctgtttgttagtgtt

SEQ ID NO: 425954 - DNA, 15 bp, Homo sapiens
tgtttgttagtgttg

SEQ ID NO: 425955 - DNA, 15 bp, Homo sapiens
gtttgttagtgttgg

SEQ ID NO: 425956 - DNA, 15 bp, Homo sapiens
tttgttagtgttggc

SEQ ID NO: 425957 - DNA, 15 bp, Homo sapiens
ttgttagtgttggct

SEQ ID NO: 425958 - DNA, 15 bp, Homo sapiens
tgttagtgttggctg

SEQ ID NO: 425959 - DNA, 15 bp, Homo sapiens
gttagtgttggctga

SEQ ID NO: 425960 - DNA, 15 bp, Homo sapiens
ttagtgttggctgag

SEQ ID NO: 425961 - DNA, 15 bp, Homo sapiens
tagtgttggctgagc

SEQ ID NO: 425962 - DNA, 15 bp, Homo sapiens
agtgttggctgagct

SEQ ID NO: 425963 - DNA, 15 bp, Homo sapiens
gtgttggctgagctt

SEQ ID NO: 425964 - DNA, 15 bp, Homo sapiens
tgttggctgagcttt

SEQ ID NO: 425965 - DNA, 15 bp, Homo sapiens
gttggctgagctttg

SEQ ID NO: 425966 - DNA, 15 bp, Homo sapiens
ttggctgagctttga

SEQ ID NO: 425967 - DNA, 15 bp, Homo sapiens
tggctgagctttgac

SEQ ID NO: 425968 - DNA, 15 bp, Homo sapiens
ggctgagctttgact

SEQ ID NO: 425969 - DNA, 15 bp, Homo sapiens
gctgagctttgacta

SEQ ID NO: 425970 - DNA, 15 bp, Homo sapiens
ctgagctttgactag

SEQ ID NO: 425971 - DNA, 15 bp, Homo sapiens
tgagctttgactagg

SEQ ID NO: 425972 - DNA, 15 bp, Homo sapiens
gagctttgactaggg

SEQ ID NO: 425973 - DNA, 15 bp, Homo sapiens
agctttgactagggg

SEQ ID NO: 425974 - DNA, 15 bp, Homo sapiens
gctttgactaggggt

SEQ ID NO: 425975 - DNA, 15 bp, Homo sapiens
ctttgactaggggtt

SEQ ID NO: 425976 - DNA, 15 bp, Homo sapiens
tttgactaggggttc

SEQ ID NO: 425977 - DNA, 15 bp, Homo sapiens
ttgactaggggttca

SEQ ID NO: 425978 - DNA, 15 bp, Homo sapiens
tgactaggggttcat

SEQ ID NO: 425979 - DNA, 15 bp, Homo sapiens
gactaggggttcatt

SEQ ID NO: 425980 - DNA, 15 bp, Homo sapiens
actaggggttcattc

SEQ ID NO: 425981 - DNA, 15 bp, Homo sapiens
ctaggggttcattcc

SEQ ID NO: 425982 - DNA, 15 bp, Homo sapiens
taggggttcattcca

SEQ ID NO: 425983 - DNA, 15 bp, Homo sapiens
aggggttcattccaa

SEQ ID NO: 425984 - DNA, 15 bp, Homo sapiens
ggggttcattccaag

SEQ ID NO: 425985 - DNA, 15 bp, Homo sapiens
gggttcattccaaga

SEQ ID NO: 425986 - DNA, 15 bp, Homo sapiens
ggttcattccaagac

SEQ ID NO: 425987 - DNA, 15 bp, Homo sapiens
gttcattccaagacc

SEQ ID NO: 425988 - DNA, 15 bp, Homo sapiens
ttcattccaagacct

SEQ ID NO: 425989 - DNA, 15 bp, Homo sapiens
tcattccaagacctc

SEQ ID NO: 425990 - DNA, 15 bp, Homo sapiens
cattccaagacctca

SEQ ID NO: 425991 - DNA, 15 bp, Homo sapiens
attccaagacctcac

SEQ ID NO: 425992 - DNA, 15 bp, Homo sapiens
ttccaagacctcacc

SEQ ID NO: 425993 - DNA, 15 bp, Homo sapiens
tccaagacctcacct

SEQ ID NO: 425994 - DNA, 15 bp, Homo sapiens
ccaagacctcacctt

SEQ ID NO: 425995 - DNA, 15 bp, Homo sapiens
caagacctcaccttt

SEQ ID NO: 425996 - DNA, 15 bp, Homo sapiens
aagacctcacctttc

SEQ ID NO: 425997 - DNA, 15 bp, Homo sapiens
agacctcacctttcc

SEQ ID NO: 425998 - DNA, 15 bp, Homo sapiens
gacctcacctttcct

SEQ ID NO: 425999 - DNA, 15 bp, Homo sapiens
acctcacctttcctg

SEQ ID NO: 426000 - DNA, 15 bp, Homo sapiens
cctcacctttcctgc

SEQ ID NO: 426001 - DNA, 15 bp, Homo sapiens
ctcacctttcctgct

SEQ ID NO: 426002 - DNA, 15 bp, Homo sapiens
tcacctttcctgctg

SEQ ID NO: 426003 - DNA, 15 bp, Homo sapiens
cacctttcctgctga

SEQ ID NO: 426004 - DNA, 15 bp, Homo sapiens
acctttcctgctgac

SEQ ID NO: 426005 - DNA, 15 bp, Homo sapiens
cctttcctgctgact

SEQ ID NO: 426006 - DNA, 15 bp, Homo sapiens
ctttcctgctgactt

SEQ ID NO: 426007 - DNA, 15 bp, Homo sapiens
tttcctgctgactta

SEQ ID NO: 426008 - DNA, 15 bp, Homo sapiens
ttcctgctgacttat

SEQ ID NO: 426009 - DNA, 15 bp, Homo sapiens
tcctgctgacttatt

SEQ ID NO: 426010 - DNA, 15 bp, Homo sapiens
cctgctgacttatta

SEQ ID NO: 426011 - DNA, 15 bp, Homo sapiens
ctgctgacttattaa

SEQ ID NO: 426012 - DNA, 15 bp, Homo sapiens
tgctgacttattaac

SEQ ID NO: 426013 - DNA, 15 bp, Homo sapiens
gctgacttattaact

SEQ ID NO: 426014 - DNA, 15 bp, Homo sapiens
ctgacttattaactg

SEQ ID NO: 426015 - DNA, 15 bp, Homo sapiens
tgacttattaactgt

SEQ ID NO: 426016 - DNA, 15 bp, Homo sapiens
gacttattaactgtt

SEQ ID NO: 426017 - DNA, 15 bp, Homo sapiens
acttattaactgttc

SEQ ID NO: 426018 - DNA, 15 bp, Homo sapiens
cttattaactgttcc

SEQ ID NO: 426019 - DNA, 15 bp, Homo sapiens
ttattaactgttcct

SEQ ID NO: 426020 - DNA, 15 bp, Homo sapiens
tattaactgttcctc

SEQ ID NO: 426021 - DNA, 15 bp, Homo sapiens
attaactgttcctcg

SEQ ID NO: 426022 - DNA, 15 bp, Homo sapiens
ttaactgttcctcgg

SEQ ID NO: 426023 - DNA, 15 bp, Homo sapiens
taactgttcctcgga

SEQ ID NO: 426024 - DNA, 15 bp, Homo sapiens
aactgttcctcggac

SEQ ID NO: 426025 - DNA, 15 bp, Homo sapiens
actgttcctcggact

SEQ ID NO: 426026 - DNA, 15 bp, Homo sapiens
ctgttcctcggactc

SEQ ID NO: 426027 - DNA, 15 bp, Homo sapiens
tgttcctcggactct

SEQ ID NO: 426028 - DNA, 15 bp, Homo sapiens
gttcctcggactcta

SEQ ID NO: 426029 - DNA, 15 bp, Homo sapiens
ttcctcggactctac

SEQ ID NO: 426030 - DNA, 15 bp, Homo sapiens
tcctcggactctact

SEQ ID NO: 426031 - DNA, 15 bp, Homo sapiens
cctcggactctactt

SEQ ID NO: 426032 - DNA, 15 bp, Homo sapiens
ctcggactctacttg

SEQ ID NO: 426033 - DNA, 15 bp, Homo sapiens
tcggactctacttga

SEQ ID NO: 426034 - DNA, 15 bp, Homo sapiens
cggactctacttgac

SEQ ID NO: 426035 - DNA, 15 bp, Homo sapiens
ggactctacttgact

SEQ ID NO: 426036 - DNA, 15 bp, Homo sapiens
gactctacttgactt

SEQ ID NO: 426037 - DNA, 15 bp, Homo sapiens
actctacttgacttc

SEQ ID NO: 426038 - DNA, 15 bp, Homo sapiens
ctctacttgacttct

SEQ ID NO: 426039 - DNA, 15 bp, Homo sapiens
tctacttgacttcta

SEQ ID NO: 426040 - DNA, 15 bp, Homo sapiens
ctacttgacttctag

SEQ ID NO: 426041 - DNA, 15 bp, Homo sapiens
tacttgacttctaga

SEQ ID NO: 426042 - DNA, 15 bp, Homo sapiens
acttgacttctagaa

SEQ ID NO: 426043 - DNA, 15 bp, Homo sapiens
cttgacttctagaac

SEQ ID NO: 426044 - DNA, 15 bp, Homo sapiens
ttgacttctagaaca

SEQ ID NO: 426045 - DNA, 15 bp, Homo sapiens
tgacttctagaacac

SEQ ID NO: 426046 - DNA, 15 bp, Homo sapiens
gacttctagaacacc

SEQ ID NO: 426047 - DNA, 15 bp, Homo sapiens
acttctagaacaccg

SEQ ID NO: 426048 - DNA, 15 bp, Homo sapiens
cttctagaacaccgc

SEQ ID NO: 426049 - DNA, 15 bp, Homo sapiens
ttctagaacaccgca

SEQ ID NO: 426050 - DNA, 15 bp, Homo sapiens
tctagaacaccgcac

SEQ ID NO: 426051 - DNA, 15 bp, Homo sapiens
ctagaacaccgcact

SEQ ID NO: 426052 - DNA, 15 bp, Homo sapiens
tagaacaccgcactc

SEQ ID NO: 426053 - DNA, 15 bp, Homo sapiens
agaacaccgcactct

SEQ ID NO: 426054 - DNA, 15 bp, Homo sapiens
gaacaccgcactctc

SEQ ID NO: 426055 - DNA, 15 bp, Homo sapiens
aacaccgcactctcc

SEQ ID NO: 426056 - DNA, 15 bp, Homo sapiens
acaccgcactctcct

SEQ ID NO: 426057 - DNA, 15 bp, Homo sapiens
caccgcactctcctg

SEQ ID NO: 426058 - DNA, 15 bp, Homo sapiens
accgcactctcctga

SEQ ID NO: 426059 - DNA, 15 bp, Homo sapiens
ccgcactctcctgat

SEQ ID NO: 426060 - DNA, 15 bp, Homo sapiens
cgcactctcctgatg

SEQ ID NO: 426061 - DNA, 15 bp, Homo sapiens
gcactctcctgatgt

SEQ ID NO: 426062 - DNA, 15 bp, Homo sapiens
cactctcctgatgtt

SEQ ID NO: 426063 - DNA, 15 bp, Homo sapiens
actctcctgatgttt

SEQ ID NO: 426064 - DNA, 15 bp, Homo sapiens
ctctcctgatgtttt

SEQ ID NO: 426065 - DNA, 15 bp, Homo sapiens
tctcctgatgttttt

SEQ ID NO: 426066 - DNA, 15 bp, Homo sapiens
ctcctgatgtttttc

SEQ ID NO: 426067 - DNA, 15 bp, Homo sapiens
tcctgatgtttttct

SEQ ID NO: 426068 - DNA, 15 bp, Homo sapiens
cctgatgtttttctt

SEQ ID NO: 426069 - DNA, 15 bp, Homo sapiens
ctgatgtttttctta

SEQ ID NO: 426070 - DNA, 15 bp, Homo sapiens
tgatgtttttcttac

SEQ ID NO: 426071 - DNA, 15 bp, Homo sapiens
gatgtttttcttacg

SEQ ID NO: 426072 - DNA, 15 bp, Homo sapiens
atgtttttcttacgt

SEQ ID NO: 426073 - DNA, 15 bp, Homo sapiens
tgtttttcttacgtc

SEQ ID NO: 426074 - DNA, 15 bp, Homo sapiens
gtttttcttacgtca

SEQ ID NO: 426075 - DNA, 15 bp, Homo sapiens
tttttcttacgtcac

SEQ ID NO: 426076 - DNA, 15 bp, Homo sapiens
ttttcttacgtcact

SEQ ID NO: 426077 - DNA, 15 bp, Homo sapiens
tttcttacgtcactg

SEQ ID NO: 426078 - DNA, 15 bp, Homo sapiens
ttcttacgtcactgg

SEQ ID NO: 426079 - DNA, 15 bp, Homo sapiens
tcttacgtcactggt

SEQ ID NO: 426080 - DNA, 15 bp, Homo sapiens
cttacgtcactggta

SEQ ID NO: 426081 - DNA, 15 bp, Homo sapiens
ttacgtcactggtag

SEQ ID NO: 426082 - DNA, 15 bp, Homo sapiens
tacgtcactggtagc

SEQ ID NO: 426083 - DNA, 15 bp, Homo sapiens
acgtcactggtagct

SEQ ID NO: 426084 - DNA, 15 bp, Homo sapiens
cgtcactggtagctc

SEQ ID NO: 426085 - DNA, 15 bp, Homo sapiens
gtcactggtagctct

SEQ ID NO: 426086 - DNA, 15 bp, Homo sapiens
tcactggtagctctt

SEQ ID NO: 426087 - DNA, 15 bp, Homo sapiens
cactggtagctcttt

SEQ ID NO: 426088 - DNA, 15 bp, Homo sapiens
actggtagctctttc

SEQ ID NO: 426089 - DNA, 15 bp, Homo sapiens
ctggtagctctttct

SEQ ID NO: 426090 - DNA, 15 bp, Homo sapiens
tggtagctctttctc

SEQ ID NO: 426091 - DNA, 15 bp, Homo sapiens
ggtagctctttctca

SEQ ID NO: 426092 - DNA, 15 bp, Homo sapiens
gtagctctttctcag

SEQ ID NO: 426093 - DNA, 15 bp, Homo sapiens
tagctctttctcagt

SEQ ID NO: 426094 - DNA, 15 bp, Homo sapiens
agctctttctcagtt

SEQ ID NO: 426095 - DNA, 15 bp, Homo sapiens
gctctttctcagttt

SEQ ID NO: 426096 - DNA, 15 bp, Homo sapiens
ctctttctcagtttc

SEQ ID NO: 426097 - DNA, 15 bp, Homo sapiens
tctttctcagtttcc

SEQ ID NO: 426098 - DNA, 15 bp, Homo sapiens
ctttctcagtttccc

SEQ ID NO: 426099 - DNA, 15 bp, Homo sapiens
tttctcagtttccct

SEQ ID NO: 426100 - DNA, 15 bp, Homo sapiens
ttctcagtttccctt

SEQ ID NO: 426101 - DNA, 15 bp, Homo sapiens
tctcagtttcccttc

SEQ ID NO: 426102 - DNA, 15 bp, Homo sapiens
ctcagtttcccttcc

SEQ ID NO: 426103 - DNA, 15 bp, Homo sapiens
tcagtttcccttcct

SEQ ID NO: 426104 - DNA, 15 bp, Homo sapiens
cagtttcccttcctg

SEQ ID NO: 426105 - DNA, 15 bp, Homo sapiens
agtttcccttcctgg

SEQ ID NO: 426106 - DNA, 15 bp, Homo sapiens
gtttcccttcctggt

SEQ ID NO: 426107 - DNA, 15 bp, Homo sapiens
tttcccttcctggtt

SEQ ID NO: 426108 - DNA, 15 bp, Homo sapiens
ttcccttcctggttc

SEQ ID NO: 426109 - DNA, 15 bp, Homo sapiens
tcccttcctggttct

SEQ ID NO: 426110 - DNA, 15 bp, Homo sapiens
cccttcctggttctt

SEQ ID NO: 426111 - DNA, 15 bp, Homo sapiens
ccttcctggttcttc

SEQ ID NO: 426112 - DNA, 15 bp, Homo sapiens
cttcctggttcttcc

SEQ ID NO: 426113 - DNA, 15 bp, Homo sapiens
ttcctggttcttcct

SEQ ID NO: 426114 - DNA, 15 bp, Homo sapiens
tcctggttcttcctt

SEQ ID NO: 426115 - DNA, 15 bp, Homo sapiens
cctggttcttccttc

SEQ ID NO: 426116 - DNA, 15 bp, Homo sapiens
ctggttcttccttct

SEQ ID NO: 426117 - DNA, 15 bp, Homo sapiens
tggttcttccttctc

SEQ ID NO: 426118 - DNA, 15 bp, Homo sapiens
ggttcttccttctct

SEQ ID NO: 426119 - DNA, 15 bp, Homo sapiens
gttcttccttctctc

SEQ ID NO: 426120 - DNA, 15 bp, Homo sapiens
ttcttccttctctcc

SEQ ID NO: 426121 - DNA, 15 bp, Homo sapiens
tcttccttctctccc

SEQ ID NO: 426122 - DNA, 15 bp, Homo sapiens
cttccttctctcccc

SEQ ID NO: 426123 - DNA, 15 bp, Homo sapiens
ttccttctctcccct

SEQ ID NO: 426124 - DNA, 15 bp, Homo sapiens
tccttctctcccctg

SEQ ID NO: 426125 - DNA, 15 bp, Homo sapiens
ccttctctcccctgt

SEQ ID NO: 426126 - DNA, 15 bp, Homo sapiens
cttctctcccctgtc

SEQ ID NO: 426127 - DNA, 15 bp, Homo sapiens
ttctctcccctgtct

SEQ ID NO: 426128 - DNA, 15 bp, Homo sapiens
tctctcccctgtctt

SEQ ID NO: 426129 - DNA, 15 bp, Homo sapiens
ctctcccctgtcttc

SEQ ID NO: 426130 - DNA, 15 bp, Homo sapiens
tctcccctgtcttct

SEQ ID NO: 426131 - DNA, 15 bp, Homo sapiens
ctcccctgtcttcta

SEQ ID NO: 426132 - DNA, 15 bp, Homo sapiens
tcccctgtcttctaa

SEQ ID NO: 426133 - DNA, 15 bp, Homo sapiens
cccctgtcttctaaa

SEQ ID NO: 426134 - DNA, 15 bp, Homo sapiens
ccctgtcttctaaaa

SEQ ID NO: 426135 - DNA, 15 bp, Homo sapiens
cctgtcttctaaaat

SEQ ID NO: 426136 - DNA, 15 bp, Homo sapiens
ctgtcttctaaaatt

SEQ ID NO: 426137 - DNA, 15 bp, Homo sapiens
tgtcttctaaaattg

SEQ ID NO: 426138 - DNA, 15 bp, Homo sapiens
gtcttctaaaattgg

SEQ ID NO: 426139 - DNA, 15 bp, Homo sapiens
tcttctaaaattggg

SEQ ID NO: 426140 - DNA, 15 bp, Homo sapiens
cttctaaaattggga

SEQ ID NO: 426141 - DNA, 15 bp, Homo sapiens
ttctaaaattgggat

SEQ ID NO: 426142 - DNA, 15 bp, Homo sapiens
tctaaaattgggatg

SEQ ID NO: 426143 - DNA, 15 bp, Homo sapiens
ctaaaattgggatgt

SEQ ID NO: 426144 - DNA, 15 bp, Homo sapiens
taaaattgggatgtg

SEQ ID NO: 426145 - DNA, 15 bp, Homo sapiens
aaaattgggatgtgt

SEQ ID NO: 426146 - DNA, 15 bp, Homo sapiens
aaattgggatgtgtc

SEQ ID NO: 426147 - DNA, 15 bp, Homo sapiens
aattgggatgtgtca

SEQ ID NO: 426148 - DNA, 15 bp, Homo sapiens
attgggatgtgtcac

SEQ ID NO: 426149 - DNA, 15 bp, Homo sapiens
ttgggatgtgtcact

SEQ ID NO: 426150 - DNA, 15 bp, Homo sapiens
tgggatgtgtcactt

SEQ ID NO: 426151 - DNA, 15 bp, Homo sapiens
gggatgtgtcacttg

SEQ ID NO: 426152 - DNA, 15 bp, Homo sapiens
ggatgtgtcacttgt

SEQ ID NO: 426153 - DNA, 15 bp, Homo sapiens
gatgtgtcacttgtc

SEQ ID NO: 426154 - DNA, 15 bp, Homo sapiens
atgtgtcacttgtca

SEQ ID NO: 426155 - DNA, 15 bp, Homo sapiens
tgtgtcacttgtcag

SEQ ID NO: 426156 - DNA, 15 bp, Homo sapiens
gtgtcacttgtcagg

SEQ ID NO: 426157 - DNA, 15 bp, Homo sapiens
tgtcacttgtcaggc

SEQ ID NO: 426158 - DNA, 15 bp, Homo sapiens
gtcacttgtcaggcc

SEQ ID NO: 426159 - DNA, 15 bp, Homo sapiens
tcacttgtcaggcca

SEQ ID NO: 426160 - DNA, 15 bp, Homo sapiens
cacttgtcaggccat

SEQ ID NO: 426161 - DNA, 15 bp, Homo sapiens
acttgtcaggccatg

SEQ ID NO: 426162 - DNA, 15 bp, Homo sapiens
cttgtcaggccatgt

SEQ ID NO: 426163 - DNA, 15 bp, Homo sapiens
ttgtcaggccatgtc

SEQ ID NO: 426164 - DNA, 15 bp, Homo sapiens
tgtcaggccatgtca

SEQ ID NO: 426165 - DNA, 15 bp, Homo sapiens
gtcaggccatgtcac

SEQ ID NO: 426166 - DNA, 15 bp, Homo sapiens
tcaggccatgtcacc

SEQ ID NO: 426167 - DNA, 15 bp, Homo sapiens
caggccatgtcacct

SEQ ID NO: 426168 - DNA, 15 bp, Homo sapiens
aggccatgtcacctt

SEQ ID NO: 426169 - DNA, 15 bp, Homo sapiens
ggccatgtcaccttc

SEQ ID NO: 426170 - DNA, 15 bp, Homo sapiens
gccatgtcaccttct

SEQ ID NO: 426171 - DNA, 15 bp, Homo sapiens
ccatgtcaccttctc

SEQ ID NO: 426172 - DNA, 15 bp, Homo sapiens
catgtcaccttctct

SEQ ID NO: 426173 - DNA, 15 bp, Homo sapiens
atgtcaccttctctg

SEQ ID NO: 426174 - DNA, 15 bp, Homo sapiens
tgtcaccttctctgt

SEQ ID NO: 426175 - DNA, 15 bp, Homo sapiens
gtcaccttctctgta

SEQ ID NO: 426176 - DNA, 15 bp, Homo sapiens
tcaccttctctgtat

SEQ ID NO: 426177 - DNA, 15 bp, Homo sapiens
caccttctctgtatt

SEQ ID NO: 426178 - DNA, 15 bp, Homo sapiens
accttctctgtattc

SEQ ID NO: 426179 - DNA, 15 bp, Homo sapiens
ccttctctgtattca

SEQ ID NO: 426180 - DNA, 15 bp, Homo sapiens
cttctctgtattcac

SEQ ID NO: 426181 - DNA, 15 bp, Homo sapiens
ttctctgtattcact

SEQ ID NO: 426182 - DNA, 15 bp, Homo sapiens
tctctgtattcactc

SEQ ID NO: 426183 - DNA, 15 bp, Homo sapiens
ctctgtattcactcc

SEQ ID NO: 426184 - DNA, 15 bp, Homo sapiens
tctgtattcactcct

SEQ ID NO: 426185 - DNA, 15 bp, Homo sapiens
ctgtattcactcctt

SEQ ID NO: 426186 - DNA, 15 bp, Homo sapiens
tgtattcactccttc

SEQ ID NO: 426187 - DNA, 15 bp, Homo sapiens
gtattcactccttct

SEQ ID NO: 426188 - DNA, 15 bp, Homo sapiens
tattcactccttctt

SEQ ID NO: 426189 - DNA, 15 bp, Homo sapiens
attcactccttcttg

SEQ ID NO: 426190 - DNA, 15 bp, Homo sapiens
ttcactccttcttgg

SEQ ID NO: 426191 - DNA, 15 bp, Homo sapiens
tcactccttcttggg

SEQ ID NO: 426192 - DNA, 15 bp, Homo sapiens
cactccttcttgggt

SEQ ID NO: 426193 - DNA, 15 bp, Homo sapiens
actccttcttgggtt

SEQ ID NO: 426194 - DNA, 15 bp, Homo sapiens
ctccttcttgggttt

SEQ ID NO: 426195 - DNA, 15 bp, Homo sapiens
tccttcttgggttta

SEQ ID NO: 426196 - DNA, 15 bp, Homo sapiens
ccttcttgggtttaa

SEQ ID NO: 426197 - DNA, 15 bp, Homo sapiens
cttcttgggtttaaa

SEQ ID NO: 426198 - DNA, 15 bp, Homo sapiens
ttcttgggtttaaaa

SEQ ID NO: 426199 - DNA, 15 bp, Homo sapiens
tcttgggtttaaaaa

SEQ ID NO: 426200 - DNA, 15 bp, Homo sapiens
cttgggtttaaaaat

SEQ ID NO: 426201 - DNA, 15 bp, Homo sapiens
ttgggtttaaaaatg

SEQ ID NO: 426202 - DNA, 15 bp, Homo sapiens
tgggtttaaaaatgc

SEQ ID NO: 426203 - DNA, 15 bp, Homo sapiens
gggtttaaaaatgcc

SEQ ID NO: 426204 - DNA, 15 bp, Homo sapiens
ggtttaaaaatgcca

SEQ ID NO: 426205 - DNA, 15 bp, Homo sapiens
gtttaaaaatgccat

SEQ ID NO: 426206 - DNA, 15 bp, Homo sapiens
tttaaaaatgccatc

SEQ ID NO: 426207 - DNA, 15 bp, Homo sapiens
ttaaaaatgccatct

SEQ ID NO: 426208 - DNA, 15 bp, Homo sapiens
taaaaatgccatcta

SEQ ID NO: 426209 - DNA, 15 bp, Homo sapiens
aaaaatgccatctat

SEQ ID NO: 426210 - DNA, 15 bp, Homo sapiens
aaaatgccatctata

SEQ ID NO: 426211 - DNA, 15 bp, Homo sapiens
aaatgccatctatat

SEQ ID NO: 426212 - DNA, 15 bp, Homo sapiens
aatgccatctatatg

SEQ ID NO: 426213 - DNA, 15 bp, Homo sapiens
atgccatctatatgc

SEQ ID NO: 426214 - DNA, 15 bp, Homo sapiens
tgccatctatatgcc

SEQ ID NO: 426215 - DNA, 15 bp, Homo sapiens
gccatctatatgcca

SEQ ID NO: 426216 - DNA, 15 bp, Homo sapiens
ccatctatatgccaa

SEQ ID NO: 426217 - DNA, 15 bp, Homo sapiens
catctatatgccaag

SEQ ID NO: 426218 - DNA, 15 bp, Homo sapiens
atctatatgccaagc

SEQ ID NO: 426219 - DNA, 15 bp, Homo sapiens
tctatatgccaagca

SEQ ID NO: 426220 - DNA, 15 bp, Homo sapiens
ctatatgccaagcac

SEQ ID NO: 426221 - DNA, 15 bp, Homo sapiens
tatatgccaagcact

SEQ ID NO: 426222 - DNA, 15 bp, Homo sapiens
atatgccaagcactc

SEQ ID NO: 426223 - DNA, 15 bp, Homo sapiens
tatgccaagcactcc

SEQ ID NO: 426224 - DNA, 15 bp, Homo sapiens
atgccaagcactccc

SEQ ID NO: 426225 - DNA, 15 bp, Homo sapiens
tgccaagcactccca

SEQ ID NO: 426226 - DNA, 15 bp, Homo sapiens
gccaagcactcccaa

SEQ ID NO: 426227 - DNA, 15 bp, Homo sapiens
ccaagcactcccaaa

SEQ ID NO: 426228 - DNA, 15 bp, Homo sapiens
caagcactcccaaag

SEQ ID NO: 426229 - DNA, 15 bp, Homo sapiens
aagcactcccaaaga

SEQ ID NO: 426230 - DNA, 15 bp, Homo sapiens
agcactcccaaagat

SEQ ID NO: 426231 - DNA, 15 bp, Homo sapiens
gcactcccaaagata

SEQ ID NO: 426232 - DNA, 15 bp, Homo sapiens
cactcccaaagatat

SEQ ID NO: 426233 - DNA, 15 bp, Homo sapiens
actcccaaagatata

SEQ ID NO: 426234 - DNA, 15 bp, Homo sapiens
ctcccaaagatatat

SEQ ID NO: 426235 - DNA, 15 bp, Homo sapiens
tcccaaagatatatc

SEQ ID NO: 426236 - DNA, 15 bp, Homo sapiens
cccaaagatatatcc

SEQ ID NO: 426237 - DNA, 15 bp, Homo sapiens
ccaaagatatatccg

SEQ ID NO: 426238 - DNA, 15 bp, Homo sapiens
caaagatatatccgt

SEQ ID NO: 426239 - DNA, 15 bp, Homo sapiens
aaagatatatccgtt

SEQ ID NO: 426240 - DNA, 15 bp, Homo sapiens
aagatatatccgttt

SEQ ID NO: 426241 - DNA, 15 bp, Homo sapiens
agatatatccgttta

SEQ ID NO: 426242 - DNA, 15 bp, Homo sapiens
gatatatccgtttac

SEQ ID NO: 426243 - DNA, 15 bp, Homo sapiens
atatatccgtttaca

SEQ ID NO: 426244 - DNA, 15 bp, Homo sapiens
tatatccgtttacat

SEQ ID NO: 426245 - DNA, 15 bp, Homo sapiens
atatccgtttacatg

SEQ ID NO: 426246 - DNA, 15 bp, Homo sapiens
tatccgtttacatgt

SEQ ID NO: 426247 - DNA, 15 bp, Homo sapiens
atccgtttacatgtc

SEQ ID NO: 426248 - DNA, 15 bp, Homo sapiens
tccgtttacatgtca

SEQ ID NO: 426249 - DNA, 15 bp, Homo sapiens
ccgtttacatgtcat

SEQ ID NO: 426250 - DNA, 15 bp, Homo sapiens
cgtttacatgtcatc

SEQ ID NO: 426251 - DNA, 15 bp, Homo sapiens
gtttacatgtcatct

SEQ ID NO: 426252 - DNA, 15 bp, Homo sapiens
tttacatgtcatctc

SEQ ID NO: 426253 - DNA, 15 bp, Homo sapiens
ttacatgtcatctct

SEQ ID NO: 426254 - DNA, 15 bp, Homo sapiens
tacatgtcatctcta

SEQ ID NO: 426255 - DNA, 15 bp, Homo sapiens
acatgtcatctctac

SEQ ID NO: 426256 - DNA, 15 bp, Homo sapiens
catgtcatctctact

SEQ ID NO: 426257 - DNA, 15 bp, Homo sapiens
atgtcatctctactt

SEQ ID NO: 426258 - DNA, 15 bp, Homo sapiens
tgtcatctctacttg

SEQ ID NO: 426259 - DNA, 15 bp, Homo sapiens
gtcatctctacttga

SEQ ID NO: 426260 - DNA, 15 bp, Homo sapiens
tcatctctacttgag

SEQ ID NO: 426261 - DNA, 15 bp, Homo sapiens
catctctacttgagt

SEQ ID NO: 426262 - DNA, 15 bp, Homo sapiens
atctctacttgagtg

SEQ ID NO: 426263 - DNA, 15 bp, Homo sapiens
tctctacttgagtgt

SEQ ID NO: 426264 - DNA, 15 bp, Homo sapiens
ctctacttgagtgtg

SEQ ID NO: 426265 - DNA, 15 bp, Homo sapiens
tctacttgagtgtgt

SEQ ID NO: 426266 - DNA, 15 bp, Homo sapiens
ctacttgagtgtgta

SEQ ID NO: 426267 - DNA, 15 bp, Homo sapiens
tacttgagtgtgtaa

SEQ ID NO: 426268 - DNA, 15 bp, Homo sapiens
acttgagtgtgtaat

SEQ ID NO: 426269 - DNA, 15 bp, Homo sapiens
cttgagtgtgtaata

SEQ ID NO: 426270 - DNA, 15 bp, Homo sapiens
ttgagtgtgtaataa

SEQ ID NO: 426271 - DNA, 15 bp, Homo sapiens
tgagtgtgtaataaa

SEQ ID NO: 426272 - DNA, 15 bp, Homo sapiens
gagtgtgtaataaac

SEQ ID NO: 426273 - DNA, 15 bp, Homo sapiens
agtgtgtaataaaca

SEQ ID NO: 426274 - DNA, 15 bp, Homo sapiens
gtgtgtaataaacac

SEQ ID NO: 426275 - DNA, 15 bp, Homo sapiens
tgtgtaataaacacc

SEQ ID NO: 426276 - DNA, 15 bp, Homo sapiens
gtgtaataaacacct

SEQ ID NO: 426277 - DNA, 15 bp, Homo sapiens
tgtaataaacacctc

SEQ ID NO: 426278 - DNA, 15 bp, Homo sapiens
gtaataaacacctca

SEQ ID NO: 426279 - DNA, 15 bp, Homo sapiens
taataaacacctcac

SEQ ID NO: 426280 - DNA, 15 bp, Homo sapiens
aataaacacctcaca

SEQ ID NO: 426281 - DNA, 15 bp, Homo sapiens
ataaacacctcacag

SEQ ID NO: 426282 - DNA, 15 bp, Homo sapiens
taaacacctcacagt

SEQ ID NO: 426283 - DNA, 15 bp, Homo sapiens
aaacacctcacagtt

SEQ ID NO: 426284 - DNA, 15 bp, Homo sapiens
aacacctcacagtta

SEQ ID NO: 426285 - DNA, 15 bp, Homo sapiens
acacctcacagttaa

SEQ ID NO: 426286 - DNA, 15 bp, Homo sapiens
cacctcacagttaat

SEQ ID NO: 426287 - DNA, 15 bp, Homo sapiens
acctcacagttaata

SEQ ID NO: 426288 - DNA, 15 bp, Homo sapiens
cctcacagttaatat

SEQ ID NO: 426289 - DNA, 15 bp, Homo sapiens
ctcacagttaatatg

SEQ ID NO: 426290 - DNA, 15 bp, Homo sapiens
tcacagttaatatga

SEQ ID NO: 426291 - DNA, 15 bp, Homo sapiens
cacagttaatatgac

SEQ ID NO: 426292 - DNA, 15 bp, Homo sapiens
acagttaatatgacc

SEQ ID NO: 426293 - DNA, 15 bp, Homo sapiens
cagttaatatgacca

SEQ ID NO: 426294 - DNA, 15 bp, Homo sapiens
agttaatatgaccaa

SEQ ID NO: 426295 - DNA, 15 bp, Homo sapiens
gttaatatgaccaaa

SEQ ID NO: 426296 - DNA, 15 bp, Homo sapiens
ttaatatgaccaaac

SEQ ID NO: 426297 - DNA, 15 bp, Homo sapiens
taatatgaccaaact

SEQ ID NO: 426298 - DNA, 15 bp, Homo sapiens
aatatgaccaaactg

SEQ ID NO: 426299 - DNA, 15 bp, Homo sapiens
atatgaccaaactgg

SEQ ID NO: 426300 - DNA, 15 bp, Homo sapiens
tatgaccaaactggc

SEQ ID NO: 426301 - DNA, 15 bp, Homo sapiens
atgaccaaactggct

SEQ ID NO: 426302 - DNA, 15 bp, Homo sapiens
tgaccaaactggctt

SEQ ID NO: 426303 - DNA, 15 bp, Homo sapiens
gaccaaactggcttc

SEQ ID NO: 426304 - DNA, 15 bp, Homo sapiens
accaaactggcttcc

SEQ ID NO: 426305 - DNA, 15 bp, Homo sapiens
ccaaactggcttcct

SEQ ID NO: 426306 - DNA, 15 bp, Homo sapiens
caaactggcttcctg

SEQ ID NO: 426307 - DNA, 15 bp, Homo sapiens
aaactggcttcctga

SEQ ID NO: 426308 - DNA, 15 bp, Homo sapiens
aactggcttcctgaa

SEQ ID NO: 426309 - DNA, 15 bp, Homo sapiens
actggcttcctgaat

SEQ ID NO: 426310 - DNA, 15 bp, Homo sapiens
ctggcttcctgaatt

SEQ ID NO: 426311 - DNA, 15 bp, Homo sapiens
tggcttcctgaattg

SEQ ID NO: 426312 - DNA, 15 bp, Homo sapiens
ggcttcctgaattgg

SEQ ID NO: 426313 - DNA, 15 bp, Homo sapiens
gcttcctgaattggc

SEQ ID NO: 426314 - DNA, 15 bp, Homo sapiens
cttcctgaattggcc

SEQ ID NO: 426315 - DNA, 15 bp, Homo sapiens
ttcctgaattggccc

SEQ ID NO: 426316 - DNA, 15 bp, Homo sapiens
tcctgaattggcccc

SEQ ID NO: 426317 - DNA, 15 bp, Homo sapiens
cctgaattggcccct

SEQ ID NO: 426318 - DNA, 15 bp, Homo sapiens
ctgaattggccccta

SEQ ID NO: 426319 - DNA, 15 bp, Homo sapiens
tgaattggcccctat

SEQ ID NO: 426320 - DNA, 15 bp, Homo sapiens
gaattggcccctata

SEQ ID NO: 426321 - DNA, 15 bp, Homo sapiens
aattggcccctataa

SEQ ID NO: 426322 - DNA, 15 bp, Homo sapiens
attggcccctataac

SEQ ID NO: 426323 - DNA, 15 bp, Homo sapiens
ttggcccctataaca

SEQ ID NO: 426324 - DNA, 15 bp, Homo sapiens
tggcccctataacat

SEQ ID NO: 426325 - DNA, 15 bp, Homo sapiens
ggcccctataacatg

SEQ ID NO: 426326 - DNA, 15 bp, Homo sapiens
gcccctataacatgt

SEQ ID NO: 426327 - DNA, 15 bp, Homo sapiens
cccctataacatgtt

SEQ ID NO: 426328 - DNA, 15 bp, Homo sapiens
ccctataacatgttc

SEQ ID NO: 426329 - DNA, 15 bp, Homo sapiens
cctataacatgttct

SEQ ID NO: 426330 - DNA, 15 bp, Homo sapiens
ctataacatgttcta

SEQ ID NO: 426331 - DNA, 15 bp, Homo sapiens
tataacatgttctac

SEQ ID NO: 426332 - DNA, 15 bp, Homo sapiens
ataacatgttctacc

SEQ ID NO: 426333 - DNA, 15 bp, Homo sapiens
taacatgttctaccc

SEQ ID NO: 426334 - DNA, 15 bp, Homo sapiens
aacatgttctaccca

SEQ ID NO: 426335 - DNA, 15 bp, Homo sapiens
acatgttctacccag

SEQ ID NO: 426336 - DNA, 15 bp, Homo sapiens
catgttctacccagc

SEQ ID NO: 426337 - DNA, 15 bp, Homo sapiens
atgttctacccagcg

SEQ ID NO: 426338 - DNA, 15 bp, Homo sapiens
tgttctacccagcgt

SEQ ID NO: 426339 - DNA, 15 bp, Homo sapiens
gttctacccagcgtt

SEQ ID NO: 426340 - DNA, 15 bp, Homo sapiens
ttctacccagcgttc

SEQ ID NO: 426341 - DNA, 15 bp, Homo sapiens
tctacccagcgttct

SEQ ID NO: 426342 - DNA, 15 bp, Homo sapiens
ctacccagcgttctg

SEQ ID NO: 426343 - DNA, 15 bp, Homo sapiens
tacccagcgttctgc

SEQ ID NO: 426344 - DNA, 15 bp, Homo sapiens
acccagcgttctgca

SEQ ID NO: 426345 - DNA, 15 bp, Homo sapiens
cccagcgttctgcat

SEQ ID NO: 426346 - DNA, 15 bp, Homo sapiens
ccagcgttctgcatt

SEQ ID NO: 426347 - DNA, 15 bp, Homo sapiens
cagcgttctgcattt

SEQ ID NO: 426348 - DNA, 15 bp, Homo sapiens
agcgttctgcatttc

SEQ ID NO: 426349 - DNA, 15 bp, Homo sapiens
gcgttctgcatttca

SEQ ID NO: 426350 - DNA, 15 bp, Homo sapiens
cgttctgcatttcag

SEQ ID NO: 426351 - DNA, 15 bp, Homo sapiens
gttctgcatttcagt

SEQ ID NO: 426352 - DNA, 15 bp, Homo sapiens
ttctgcatttcagtt

SEQ ID NO: 426353 - DNA, 15 bp, Homo sapiens
tctgcatttcagttg

SEQ ID NO: 426354 - DNA, 15 bp, Homo sapiens
ctgcatttcagttgg

SEQ ID NO: 426355 - DNA, 15 bp, Homo sapiens
tgcatttcagttggt

SEQ ID NO: 426356 - DNA, 15 bp, Homo sapiens
gcatttcagttggta

SEQ ID NO: 426357 - DNA, 15 bp, Homo sapiens
catttcagttggtag

SEQ ID NO: 426358 - DNA, 15 bp, Homo sapiens
atttcagttggtagg

SEQ ID NO: 426359 - DNA, 15 bp, Homo sapiens
tttcagttggtagga

SEQ ID NO: 426360 - DNA, 15 bp, Homo sapiens
ttcagttggtaggaa

SEQ ID NO: 426361 - DNA, 15 bp, Homo sapiens
cagttggtaggaata

SEQ ID NO: 426362 - DNA, 15 bp, Homo sapiens
agttggtaggaatat

SEQ ID NO: 426363 - DNA, 15 bp, Homo sapiens
gttggtaggaatatt

SEQ ID NO: 426364 - DNA, 15 bp, Homo sapiens
ttggtaggaatatta

SEQ ID NO: 426365 - DNA, 15 bp, Homo sapiens
tggtaggaatattat

SEQ ID NO: 426366 - DNA, 15 bp, Homo sapiens
ggtaggaatattatt

SEQ ID NO: 426367 - DNA, 15 bp, Homo sapiens
gtaggaatattattt

SEQ ID NO: 426368 - DNA, 15 bp, Homo sapiens
taggaatattatttc

SEQ ID NO: 426369 - DNA, 15 bp, Homo sapiens
aggaatattatttca

SEQ ID NO: 426370 - DNA, 15 bp, Homo sapiens
ggaatattatttcag

SEQ ID NO: 426371 - DNA, 15 bp, Homo sapiens
gaatattatttcagt

SEQ ID NO: 426372 - DNA, 15 bp, Homo sapiens
aatattatttcagtt

SEQ ID NO: 426373 - DNA, 15 bp, Homo sapiens
atattatttcagttg

SEQ ID NO: 426374 - DNA, 15 bp, Homo sapiens
tattatttcagttgc

SEQ ID NO: 426375 - DNA, 15 bp, Homo sapiens
attatttcagttgct

SEQ ID NO: 426376 - DNA, 15 bp, Homo sapiens
ttatttcagttgctt

SEQ ID NO: 426377 - DNA, 15 bp, Homo sapiens
tatttcagttgctta

SEQ ID NO: 426378 - DNA, 15 bp, Homo sapiens
atttcagttgcttag

SEQ ID NO: 426379 - DNA, 15 bp, Homo sapiens
tttcagttgcttagg

SEQ ID NO: 426380 - DNA, 15 bp, Homo sapiens
ttcagttgcttaggt

SEQ ID NO: 426381 - DNA, 15 bp, Homo sapiens
tcagttgcttaggta

SEQ ID NO: 426382 - DNA, 15 bp, Homo sapiens
cagttgcttaggtaa

SEQ ID NO: 426383 - DNA, 15 bp, Homo sapiens
agttgcttaggtaac

SEQ ID NO: 426384 - DNA, 15 bp, Homo sapiens
gttgcttaggtaaca

SEQ ID NO: 426385 - DNA, 15 bp, Homo sapiens
ttgcttaggtaacaa

SEQ ID NO: 426386 - DNA, 15 bp, Homo sapiens
tgcttaggtaacaaa

SEQ ID NO: 426387 - DNA, 15 bp, Homo sapiens
gcttaggtaacaaat

SEQ ID NO: 426388 - DNA, 15 bp, Homo sapiens
cttaggtaacaaata

SEQ ID NO: 426389 - DNA, 15 bp, Homo sapiens
ttaggtaacaaataa

SEQ ID NO: 426390 - DNA, 15 bp, Homo sapiens
taggtaacaaataat

SEQ ID NO: 426391 - DNA, 15 bp, Homo sapiens
aggtaacaaataata

SEQ ID NO: 426392 - DNA, 15 bp, Homo sapiens
ggtaacaaataataa

SEQ ID NO: 426393 - DNA, 15 bp, Homo sapiens
gtaacaaataataat

SEQ ID NO: 426394 - DNA, 15 bp, Homo sapiens
taacaaataataatc

SEQ ID NO: 426395 - DNA, 15 bp, Homo sapiens
aacaaataataatca

SEQ ID NO: 426396 - DNA, 15 bp, Homo sapiens
acaaataataatcac

SEQ ID NO: 426397 - DNA, 15 bp, Homo sapiens
caaataataatcacc

SEQ ID NO: 426398 - DNA, 15 bp, Homo sapiens
aaataataatcacct

SEQ ID NO: 426399 - DNA, 15 bp, Homo sapiens
aataataatcacctt

SEQ ID NO: 426400 - DNA, 15 bp, Homo sapiens
ataataatcaccttt

SEQ ID NO: 426401 - DNA, 15 bp, Homo sapiens
taataatcaccttta

SEQ ID NO: 426402 - DNA, 15 bp, Homo sapiens
aataatcacctttag

SEQ ID NO: 426403 - DNA, 15 bp, Homo sapiens
ataatcacctttagt

SEQ ID NO: 426404 - DNA, 15 bp, Homo sapiens
taatcacctttagtc

SEQ ID NO: 426405 - DNA, 15 bp, Homo sapiens
aatcacctttagtcc

SEQ ID NO: 426406 - DNA, 15 bp, Homo sapiens
atcacctttagtcct

SEQ ID NO: 426407 - DNA, 15 bp, Homo sapiens
tcacctttagtcctg

SEQ ID NO: 426408 - DNA, 15 bp, Homo sapiens
cacctttagtcctgc

SEQ ID NO: 426409 - DNA, 15 bp, Homo sapiens
acctttagtcctgcc

SEQ ID NO: 426410 - DNA, 15 bp, Homo sapiens
cctttagtcctgcct

SEQ ID NO: 426411 - DNA, 15 bp, Homo sapiens
ctttagtcctgcctt

SEQ ID NO: 426412 - DNA, 15 bp, Homo sapiens
tttagtcctgccttt

SEQ ID NO: 426413 - DNA, 15 bp, Homo sapiens
ttagtcctgcctttc

SEQ ID NO: 426414 - DNA, 15 bp, Homo sapiens
tagtcctgcctttct

SEQ ID NO: 426415 - DNA, 15 bp, Homo sapiens
agtcctgcctttctc

SEQ ID NO: 426416 - DNA, 15 bp, Homo sapiens
gtcctgcctttctct

SEQ ID NO: 426417 - DNA, 15 bp, Homo sapiens
tcctgcctttctctc

SEQ ID NO: 426418 - DNA, 15 bp, Homo sapiens
cctgcctttctctca

SEQ ID NO: 426419 - DNA, 15 bp, Homo sapiens
ctgcctttctctcat

SEQ ID NO: 426420 - DNA, 15 bp, Homo sapiens
tgcctttctctcatt

SEQ ID NO: 426421 - DNA, 15 bp, Homo sapiens
gcctttctctcattt

SEQ ID NO: 426422 - DNA, 15 bp, Homo sapiens
cctttctctcatttt

SEQ ID NO: 426423 - DNA, 15 bp, Homo sapiens
ctttctctcattttc

SEQ ID NO: 426424 - DNA, 15 bp, Homo sapiens
tttctctcattttca

SEQ ID NO: 426425 - DNA, 15 bp, Homo sapiens
ttctctcattttcag

SEQ ID NO: 426426 - DNA, 15 bp, Homo sapiens
tctctcattttcagt

SEQ ID NO: 426427 - DNA, 15 bp, Homo sapiens
ctctcattttcagtc

SEQ ID NO: 426428 - DNA, 15 bp, Homo sapiens
tctcattttcagtct

SEQ ID NO: 426429 - DNA, 15 bp, Homo sapiens
ctcattttcagtctg

SEQ ID NO: 426430 - DNA, 15 bp, Homo sapiens
tcattttcagtctgt

SEQ ID NO: 426431 - DNA, 15 bp, Homo sapiens
cattttcagtctgtt

SEQ ID NO: 426432 - DNA, 15 bp, Homo sapiens
attttcagtctgtta

SEQ ID NO: 426433 - DNA, 15 bp, Homo sapiens
ttttcagtctgttag

SEQ ID NO: 426434 - DNA, 15 bp, Homo sapiens
tttcagtctgttagg

SEQ ID NO: 426435 - DNA, 15 bp, Homo sapiens
ttcagtctgttagga

SEQ ID NO: 426436 - DNA, 15 bp, Homo sapiens
tcagtctgttaggaa

SEQ ID NO: 426437 - DNA, 15 bp, Homo sapiens
cagtctgttaggaaa

SEQ ID NO: 426438 - DNA, 15 bp, Homo sapiens
agtctgttaggaaat

SEQ ID NO: 426439 - DNA, 15 bp, Homo sapiens
gtctgttaggaaatc

SEQ ID NO: 426440 - DNA, 15 bp, Homo sapiens
tctgttaggaaatcc

SEQ ID NO: 426441 - DNA, 15 bp, Homo sapiens
ctgttaggaaatcct

SEQ ID NO: 426442 - DNA, 15 bp, Homo sapiens
tgttaggaaatcctg

SEQ ID NO: 426443 - DNA, 15 bp, Homo sapiens
gttaggaaatcctgt

SEQ ID NO: 426444 - DNA, 15 bp, Homo sapiens
ttaggaaatcctgtt

SEQ ID NO: 426445 - DNA, 15 bp, Homo sapiens
taggaaatcctgttg

SEQ ID NO: 426446 - DNA, 15 bp, Homo sapiens
aggaaatcctgttgg

SEQ ID NO: 426447 - DNA, 15 bp, Homo sapiens
ggaaatcctgttggt

SEQ ID NO: 426448 - DNA, 15 bp, Homo sapiens
gaaatcctgttggtt

SEQ ID NO: 426449 - DNA, 15 bp, Homo sapiens
aaatcctgttggttc

SEQ ID NO: 426450 - DNA, 15 bp, Homo sapiens
aatcctgttggttct

SEQ ID NO: 426451 - DNA, 15 bp, Homo sapiens
atcctgttggttctc

SEQ ID NO: 426452 - DNA, 15 bp, Homo sapiens
tcctgttggttctct

SEQ ID NO: 426453 - DNA, 15 bp, Homo sapiens
cctgttggttctctg

SEQ ID NO: 426454 - DNA, 15 bp, Homo sapiens
ctgttggttctctgt

SEQ ID NO: 426455 - DNA, 15 bp, Homo sapiens
tgttggttctctgtt

SEQ ID NO: 426456 - DNA, 15 bp, Homo sapiens
gttggttctctgttc

SEQ ID NO: 426457 - DNA, 15 bp, Homo sapiens
ttggttctctgttca

SEQ ID NO: 426458 - DNA, 15 bp, Homo sapiens
tggttctctgttcaa

SEQ ID NO: 426459 - DNA, 15 bp, Homo sapiens
ggttctctgttcaaa

SEQ ID NO: 426460 - DNA, 15 bp, Homo sapiens
gttctctgttcaaaa

SEQ ID NO: 426461 - DNA, 15 bp, Homo sapiens
ttctctgttcaaaat

SEQ ID NO: 426462 - DNA, 15 bp, Homo sapiens
tctctgttcaaaata

SEQ ID NO: 426463 - DNA, 15 bp, Homo sapiens
ctctgttcaaaatat

SEQ ID NO: 426464 - DNA, 15 bp, Homo sapiens
tctgttcaaaatata

SEQ ID NO: 426465 - DNA, 15 bp, Homo sapiens
ctgttcaaaatatag

SEQ ID NO: 426466 - DNA, 15 bp, Homo sapiens
tgttcaaaatataga

SEQ ID NO: 426467 - DNA, 15 bp, Homo sapiens
gttcaaaatatagaa

SEQ ID NO: 426468 - DNA, 15 bp, Homo sapiens
ttcaaaatatagaat

SEQ ID NO: 426469 - DNA, 15 bp, Homo sapiens
tcaaaatatagaatc

SEQ ID NO: 426470 - DNA, 15 bp, Homo sapiens
caaaatatagaatct

SEQ ID NO: 426471 - DNA, 15 bp, Homo sapiens
aaaatatagaatctg

SEQ ID NO: 426472 - DNA, 15 bp, Homo sapiens
aaatatagaatctga

SEQ ID NO: 426473 - DNA, 15 bp, Homo sapiens
aatatagaatctgaa

SEQ ID NO: 426474 - DNA, 15 bp, Homo sapiens
atatagaatctgaat

SEQ ID NO: 426475 - DNA, 15 bp, Homo sapiens
tatagaatctgaatc

SEQ ID NO: 426476 - DNA, 15 bp, Homo sapiens
atagaatctgaatct

SEQ ID NO: 426477 - DNA, 15 bp, Homo sapiens
tagaatctgaatcta

SEQ ID NO: 426478 - DNA, 15 bp, Homo sapiens
agaatctgaatctac

SEQ ID NO: 426479 - DNA, 15 bp, Homo sapiens
gaatctgaatctacc

SEQ ID NO: 426480 - DNA, 15 bp, Homo sapiens
aatctgaatctacca

SEQ ID NO: 426481 - DNA, 15 bp, Homo sapiens
atctgaatctaccac

SEQ ID NO: 426482 - DNA, 15 bp, Homo sapiens
tctgaatctaccacc

SEQ ID NO: 426483 - DNA, 15 bp, Homo sapiens
ctgaatctaccacct

SEQ ID NO: 426484 - DNA, 15 bp, Homo sapiens
tgaatctaccacctg

SEQ ID NO: 426485 - DNA, 15 bp, Homo sapiens
gaatctaccacctgt

SEQ ID NO: 426486 - DNA, 15 bp, Homo sapiens
aatctaccacctgtg

SEQ ID NO: 426487 - DNA, 15 bp, Homo sapiens
atctaccacctgtga

SEQ ID NO: 426488 - DNA, 15 bp, Homo sapiens
tctaccacctgtgac

SEQ ID NO: 426489 - DNA, 15 bp, Homo sapiens
ctaccacctgtgaca

SEQ ID NO: 426490 - DNA, 15 bp, Homo sapiens
taccacctgtgacac

SEQ ID NO: 426491 - DNA, 15 bp, Homo sapiens
accacctgtgacact

SEQ ID NO: 426492 - DNA, 15 bp, Homo sapiens
ccacctgtgacactc

SEQ ID NO: 426493 - DNA, 15 bp, Homo sapiens
cacctgtgacactcc

SEQ ID NO: 426494 - DNA, 15 bp, Homo sapiens
acctgtgacactcct

SEQ ID NO: 426495 - DNA, 15 bp, Homo sapiens
cctgtgacactcctc

SEQ ID NO: 426496 - DNA, 15 bp, Homo sapiens
ctgtgacactcctct

SEQ ID NO: 426497 - DNA, 15 bp, Homo sapiens
tgtgacactcctctg

SEQ ID NO: 426498 - DNA, 15 bp, Homo sapiens
gtgacactcctctgt

SEQ ID NO: 426499 - DNA, 15 bp, Homo sapiens
tgacactcctctgtc

SEQ ID NO: 426500 - DNA, 15 bp, Homo sapiens
gacactcctctgtct

SEQ ID NO: 426501 - DNA, 15 bp, Homo sapiens
acactcctctgtctc

SEQ ID NO: 426502 - DNA, 15 bp, Homo sapiens
cactcctctgtctct

SEQ ID NO: 426503 - DNA, 15 bp, Homo sapiens
actcctctgtctctg

SEQ ID NO: 426504 - DNA, 15 bp, Homo sapiens
ctcctctgtctctgg

SEQ ID NO: 426505 - DNA, 15 bp, Homo sapiens
tcctctgtctctgga

SEQ ID NO: 426506 - DNA, 15 bp, Homo sapiens
cctctgtctctggaa

SEQ ID NO: 426507 - DNA, 15 bp, Homo sapiens
ctctgtctctggaag

SEQ ID NO: 426508 - DNA, 15 bp, Homo sapiens
tctgtctctggaagt

SEQ ID NO: 426509 - DNA, 15 bp, Homo sapiens
ctgtctctggaagta

SEQ ID NO: 426510 - DNA, 15 bp, Homo sapiens
tgtctctggaagtat

SEQ ID NO: 426511 - DNA, 15 bp, Homo sapiens
gtctctggaagtatc

SEQ ID NO: 426512 - DNA, 15 bp, Homo sapiens
tctctggaagtatca

SEQ ID NO: 426513 - DNA, 15 bp, Homo sapiens
ctctggaagtatcag

SEQ ID NO: 426514 - DNA, 15 bp, Homo sapiens
tctggaagtatcagt

SEQ ID NO: 426515 - DNA, 15 bp, Homo sapiens
ctggaagtatcagtc

SEQ ID NO: 426516 - DNA, 15 bp, Homo sapiens
tggaagtatcagtcc

SEQ ID NO: 426517 - DNA, 15 bp, Homo sapiens
ggaagtatcagtcca

SEQ ID NO: 426518 - DNA, 15 bp, Homo sapiens
gaagtatcagtccag

SEQ ID NO: 426519 - DNA, 15 bp, Homo sapiens
aagtatcagtccagc

SEQ ID NO: 426520 - DNA, 15 bp, Homo sapiens
agtatcagtccagca

SEQ ID NO: 426521 - DNA, 15 bp, Homo sapiens
gtatcagtccagcaa

SEQ ID NO: 426522 - DNA, 15 bp, Homo sapiens
tatcagtccagcaac

SEQ ID NO: 426523 - DNA, 15 bp, Homo sapiens
atcagtccagcaacc

SEQ ID NO: 426524 - DNA, 15 bp, Homo sapiens
tcagtccagcaacca

SEQ ID NO: 426525 - DNA, 15 bp, Homo sapiens
cagtccagcaaccag

SEQ ID NO: 426526 - DNA, 15 bp, Homo sapiens
agtccagcaaccaga

SEQ ID NO: 426527 - DNA, 15 bp, Homo sapiens
gtccagcaaccagag

SEQ ID NO: 426528 - DNA, 15 bp, Homo sapiens
tccagcaaccagagt

SEQ ID NO: 426529 - DNA, 15 bp, Homo sapiens
ccagcaaccagagtg

SEQ ID NO: 426530 - DNA, 15 bp, Homo sapiens
cagcaaccagagtgt

SEQ ID NO: 426531 - DNA, 15 bp, Homo sapiens
agcaaccagagtgtt

SEQ ID NO: 426532 - DNA, 15 bp, Homo sapiens
gcaaccagagtgttc

SEQ ID NO: 426533 - DNA, 15 bp, Homo sapiens
caaccagagtgttcc

SEQ ID NO: 426534 - DNA, 15 bp, Homo sapiens
aaccagagtgttcct

SEQ ID NO: 426535 - DNA, 15 bp, Homo sapiens
accagagtgttccta

SEQ ID NO: 426536 - DNA, 15 bp, Homo sapiens
ccagagtgttcctat

SEQ ID NO: 426537 - DNA, 15 bp, Homo sapiens
cagagtgttcctatt

SEQ ID NO: 426538 - DNA, 15 bp, Homo sapiens
agagtgttcctatta

SEQ ID NO: 426539 - DNA, 15 bp, Homo sapiens
gagtgttcctattaa

SEQ ID NO: 426540 - DNA, 15 bp, Homo sapiens
agtgttcctattaaa

SEQ ID NO: 426541 - DNA, 15 bp, Homo sapiens
gtgttcctattaaaa

SEQ ID NO: 426542 - DNA, 15 bp, Homo sapiens
tgttcctattaaaat

SEQ ID NO: 426543 - DNA, 15 bp, Homo sapiens
gttcctattaaaata

SEQ ID NO: 426544 - DNA, 15 bp, Homo sapiens
ttcctattaaaataa

SEQ ID NO: 426545 - DNA, 15 bp, Homo sapiens
tcctattaaaataaa

SEQ ID NO: 426546 - DNA, 15 bp, Homo sapiens
cctattaaaataaat

SEQ ID NO: 426547 - DNA, 15 bp, Homo sapiens
ctattaaaataaatc

SEQ ID NO: 426548 - DNA, 15 bp, Homo sapiens
tattaaaataaatca

SEQ ID NO: 426549 - DNA, 15 bp, Homo sapiens
attaaaataaatcaa

SEQ ID NO: 426550 - DNA, 15 bp, Homo sapiens
ttaaaataaatcaaa

SEQ ID NO: 426551 - DNA, 15 bp, Homo sapiens
taaaataaatcaaac

SEQ ID NO: 426552 - DNA, 15 bp, Homo sapiens
aaaataaatcaaact

SEQ ID NO: 426553 - DNA, 15 bp, Homo sapiens
aaataaatcaaactc

SEQ ID NO: 426554 - DNA, 15 bp, Homo sapiens
aataaatcaaactct

SEQ ID NO: 426555 - DNA, 15 bp, Homo sapiens
ataaatcaaactctg

SEQ ID NO: 426556 - DNA, 15 bp, Homo sapiens
taaatcaaactctgt

SEQ ID NO: 426557 - DNA, 15 bp, Homo sapiens
aaatcaaactctgta

SEQ ID NO: 426558 - DNA, 15 bp, Homo sapiens
aatcaaactctgtag

SEQ ID NO: 426559 - DNA, 15 bp, Homo sapiens
atcaaactctgtagg

SEQ ID NO: 426560 - DNA, 15 bp, Homo sapiens
tcaaactctgtaggg

SEQ ID NO: 426561 - DNA, 15 bp, Homo sapiens
caaactctgtagggg

SEQ ID NO: 426562 - DNA, 15 bp, Homo sapiens
aaactctgtaggggc

SEQ ID NO: 426563 - DNA, 15 bp, Homo sapiens
aactctgtaggggct

SEQ ID NO: 426564 - DNA, 15 bp, Homo sapiens
actctgtaggggctt

SEQ ID NO: 426565 - DNA, 15 bp, Homo sapiens
ctctgtaggggcttc

SEQ ID NO: 426566 - DNA, 15 bp, Homo sapiens
tctgtaggggcttcc

SEQ ID NO: 426567 - DNA, 15 bp, Homo sapiens
ctgtaggggcttcct

SEQ ID NO: 426568 - DNA, 15 bp, Homo sapiens
tgtaggggcttccta

SEQ ID NO: 426569 - DNA, 15 bp, Homo sapiens
gtaggggcttcctaa

SEQ ID NO: 426570 - DNA, 15 bp, Homo sapiens
taggggcttcctaac

SEQ ID NO: 426571 - DNA, 15 bp, Homo sapiens
aggggcttcctaact

SEQ ID NO: 426572 - DNA, 15 bp, Homo sapiens
ggggcttcctaactt

SEQ ID NO: 426573 - DNA, 15 bp, Homo sapiens
gggcttcctaactta

SEQ ID NO: 426574 - DNA, 15 bp, Homo sapiens
ggcttcctaacttat

SEQ ID NO: 426575 - DNA, 15 bp, Homo sapiens
gcttcctaacttatt

SEQ ID NO: 426576 - DNA, 15 bp, Homo sapiens
cttcctaacttattc

SEQ ID NO: 426577 - DNA, 15 bp, Homo sapiens
ttcctaacttattca

SEQ ID NO: 426578 - DNA, 15 bp, Homo sapiens
tcctaacttattcag

SEQ ID NO: 426579 - DNA, 15 bp, Homo sapiens
cctaacttattcaga

SEQ ID NO: 426580 - DNA, 15 bp, Homo sapiens
ctaacttattcagag

SEQ ID NO: 426581 - DNA, 15 bp, Homo sapiens
taacttattcagagg

SEQ ID NO: 426582 - DNA, 15 bp, Homo sapiens
aacttattcagagga

SEQ ID NO: 426583 - DNA, 15 bp, Homo sapiens
acttattcagaggaa

SEQ ID NO: 426584 - DNA, 15 bp, Homo sapiens
cttattcagaggaaa

SEQ ID NO: 426585 - DNA, 15 bp, Homo sapiens
ttattcagaggaaaa

SEQ ID NO: 426586 - DNA, 15 bp, Homo sapiens
tattcagaggaaaag

SEQ ID NO: 426587 - DNA, 15 bp, Homo sapiens
attcagaggaaaagc

SEQ ID NO: 426588 - DNA, 15 bp, Homo sapiens
ttcagaggaaaagcc

SEQ ID NO: 426589 - DNA, 15 bp, Homo sapiens
tcagaggaaaagcca

SEQ ID NO: 426590 - DNA, 15 bp, Homo sapiens
cagaggaaaagccac

SEQ ID NO: 426591 - DNA, 15 bp, Homo sapiens
agaggaaaagccaca

SEQ ID NO: 426592 - DNA, 15 bp, Homo sapiens
gaggaaaagccacag

SEQ ID NO: 426593 - DNA, 15 bp, Homo sapiens
aggaaaagccacagc

SEQ ID NO: 426594 - DNA, 15 bp, Homo sapiens
ggaaaagccacagct

SEQ ID NO: 426595 - DNA, 15 bp, Homo sapiens
gaaaagccacagctc

SEQ ID NO: 426596 - DNA, 15 bp, Homo sapiens
aaaagccacagctct

SEQ ID NO: 426597 - DNA, 15 bp, Homo sapiens
aaagccacagctctc

SEQ ID NO: 426598 - DNA, 15 bp, Homo sapiens
aagccacagctctcg

SEQ ID NO: 426599 - DNA, 15 bp, Homo sapiens
agccacagctctcgg

SEQ ID NO: 426600 - DNA, 15 bp, Homo sapiens
gccacagctctcgga

SEQ ID NO: 426601 - DNA, 15 bp, Homo sapiens
ccacagctctcggaa

SEQ ID NO: 426602 - DNA, 15 bp, Homo sapiens
cacagctctcggaat

SEQ ID NO: 426603 - DNA, 15 bp, Homo sapiens
acagctctcggaatg

SEQ ID NO: 426604 - DNA, 15 bp, Homo sapiens
cagctctcggaatgg

SEQ ID NO: 426605 - DNA, 15 bp, Homo sapiens
agctctcggaatggt

SEQ ID NO: 426606 - DNA, 15 bp, Homo sapiens
gctctcggaatggtc

SEQ ID NO: 426607 - DNA, 15 bp, Homo sapiens
ctctcggaatggtct

SEQ ID NO: 426608 - DNA, 15 bp, Homo sapiens
tctcggaatggtctg

SEQ ID NO: 426609 - DNA, 15 bp, Homo sapiens
ctcggaatggtctgc

SEQ ID NO: 426610 - DNA, 15 bp, Homo sapiens
tcggaatggtctgca

SEQ ID NO: 426611 - DNA, 15 bp, Homo sapiens
cggaatggtctgcaa

SEQ ID NO: 426612 - DNA, 15 bp, Homo sapiens
ggaatggtctgcaag

SEQ ID NO: 426613 - DNA, 15 bp, Homo sapiens
gaatggtctgcaagg

SEQ ID NO: 426614 - DNA, 15 bp, Homo sapiens
aatggtctgcaaggc

SEQ ID NO: 426615 - DNA, 15 bp, Homo sapiens
atggtctgcaaggcc

SEQ ID NO: 426616 - DNA, 15 bp, Homo sapiens
tggtctgcaaggccc

SEQ ID NO: 426617 - DNA, 15 bp, Homo sapiens
ggtctgcaaggccct

SEQ ID NO: 426618 - DNA, 15 bp, Homo sapiens
gtctgcaaggccctg

SEQ ID NO: 426619 - DNA, 15 bp, Homo sapiens
tctgcaaggccctgc

SEQ ID NO: 426620 - DNA, 15 bp, Homo sapiens
ctgcaaggccctgcc

SEQ ID NO: 426621 - DNA, 15 bp, Homo sapiens
tgcaaggccctgcct

SEQ ID NO: 426622 - DNA, 15 bp, Homo sapiens
gcaaggccctgcctg

SEQ ID NO: 426623 - DNA, 15 bp, Homo sapiens
caaggccctgcctga

SEQ ID NO: 426624 - DNA, 15 bp, Homo sapiens
aaggccctgcctgat

SEQ ID NO: 426625 - DNA, 15 bp, Homo sapiens
aggccctgcctgatc

SEQ ID NO: 426626 - DNA, 15 bp, Homo sapiens
ggccctgcctgatct

SEQ ID NO: 426627 - DNA, 15 bp, Homo sapiens
gccctgcctgatctg

SEQ ID NO: 426628 - DNA, 15 bp, Homo sapiens
ccctgcctgatctga

SEQ ID NO: 426629 - DNA, 15 bp, Homo sapiens
cctgcctgatctgac

SEQ ID NO: 426630 - DNA, 15 bp, Homo sapiens
ctgcctgatctgacc

SEQ ID NO: 426631 - DNA, 15 bp, Homo sapiens
tgcctgatctgacct

SEQ ID NO: 426632 - DNA, 15 bp, Homo sapiens
gcctgatctgaccta

SEQ ID NO: 426633 - DNA, 15 bp, Homo sapiens
cctgatctgacctac

SEQ ID NO: 426634 - DNA, 15 bp, Homo sapiens
ctgatctgacctacc

SEQ ID NO: 426635 - DNA, 15 bp, Homo sapiens
tgatctgacctaccc

SEQ ID NO: 426636 - DNA, 15 bp, Homo sapiens
gatctgacctacccc

SEQ ID NO: 426637 - DNA, 15 bp, Homo sapiens
atctgacctaccccc

SEQ ID NO: 426638 - DNA, 15 bp, Homo sapiens
tctgacctaccccct

SEQ ID NO: 426639 - DNA, 15 bp, Homo sapiens
ctgacctacccccta

SEQ ID NO: 426640 - DNA, 15 bp, Homo sapiens
tgacctaccccctac

SEQ ID NO: 426641 - DNA, 15 bp, Homo sapiens
gacctaccccctact

SEQ ID NO: 426642 - DNA, 15 bp, Homo sapiens
acctaccccctactc

SEQ ID NO: 426643 - DNA, 15 bp, Homo sapiens
cctaccccctactca

SEQ ID NO: 426644 - DNA, 15 bp, Homo sapiens
ctaccccctactcac

SEQ ID NO: 426645 - DNA, 15 bp, Homo sapiens
taccccctactcaca

SEQ ID NO: 426646 - DNA, 15 bp, Homo sapiens
accccctactcacac

SEQ ID NO: 426647 - DNA, 15 bp, Homo sapiens
ccccctactcacacc

SEQ ID NO: 426648 - DNA, 15 bp, Homo sapiens
cccctactcacacct

SEQ ID NO: 426649 - DNA, 15 bp, Homo sapiens
ccctactcacacctt

SEQ ID NO: 426650 - DNA, 15 bp, Homo sapiens
cctactcacaccttg

SEQ ID NO: 426651 - DNA, 15 bp, Homo sapiens
ctactcacaccttgc

SEQ ID NO: 426652 - DNA, 15 bp, Homo sapiens
tactcacaccttgct

SEQ ID NO: 426653 - DNA, 15 bp, Homo sapiens
actcacaccttgctc

SEQ ID NO: 426654 - DNA, 15 bp, Homo sapiens
ctcacaccttgctca

SEQ ID NO: 426655 - DNA, 15 bp, Homo sapiens
tcacaccttgctcat

SEQ ID NO: 426656 - DNA, 15 bp, Homo sapiens
cacaccttgctcatt

SEQ ID NO: 426657 - DNA, 15 bp, Homo sapiens
acaccttgctcattt

SEQ ID NO: 426658 - DNA, 15 bp, Homo sapiens
caccttgctcatttc

SEQ ID NO: 426659 - DNA, 15 bp, Homo sapiens
accttgctcatttcc

SEQ ID NO: 426660 - DNA, 15 bp, Homo sapiens
ccttgctcatttcct

SEQ ID NO: 426661 - DNA, 15 bp, Homo sapiens
cttgctcatttcctc

SEQ ID NO: 426662 - DNA, 15 bp, Homo sapiens
ttgctcatttcctct

SEQ ID NO: 426663 - DNA, 15 bp, Homo sapiens
tgctcatttcctctc

SEQ ID NO: 426664 - DNA, 15 bp, Homo sapiens
gctcatttcctctct

SEQ ID NO: 426665 - DNA, 15 bp, Homo sapiens
ctcatttcctctctt

SEQ ID NO: 426666 - DNA, 15 bp, Homo sapiens
tcatttcctctcttg

SEQ ID NO: 426667 - DNA, 15 bp, Homo sapiens
catttcctctcttgc

SEQ ID NO: 426668 - DNA, 15 bp, Homo sapiens
atttcctctcttgct

SEQ ID NO: 426669 - DNA, 15 bp, Homo sapiens
tttcctctcttgctg

SEQ ID NO: 426670 - DNA, 15 bp, Homo sapiens
ttcctctcttgctgt

SEQ ID NO: 426671 - DNA, 15 bp, Homo sapiens
tcctctcttgctgtt

SEQ ID NO: 426672 - DNA, 15 bp, Homo sapiens
cctctcttgctgttt

SEQ ID NO: 426673 - DNA, 15 bp, Homo sapiens
ctctcttgctgtttt

SEQ ID NO: 426674 - DNA, 15 bp, Homo sapiens
tctcttgctgttttt

SEQ ID NO: 426675 - DNA, 15 bp, Homo sapiens
ctcttgctgtttttt

SEQ ID NO: 426676 - DNA, 15 bp, Homo sapiens
tcttgctgttttttc

SEQ ID NO: 426677 - DNA, 15 bp, Homo sapiens
cttgctgttttttct

SEQ ID NO: 426678 - DNA, 15 bp, Homo sapiens
ttgctgttttttctc

SEQ ID NO: 426679 - DNA, 15 bp, Homo sapiens
tgctgttttttctct

SEQ ID NO: 426680 - DNA, 15 bp, Homo sapiens
gctgttttttctctg

SEQ ID NO: 426681 - DNA, 15 bp, Homo sapiens
ctgttttttctctga

SEQ ID NO: 426682 - DNA, 15 bp, Homo sapiens
tgttttttctctgac

SEQ ID NO: 426683 - DNA, 15 bp, Homo sapiens
gttttttctctgaca

SEQ ID NO: 426684 - DNA, 15 bp, Homo sapiens
ttttttctctgacac

SEQ ID NO: 426685 - DNA, 15 bp, Homo sapiens
tttttctctgacaca

SEQ ID NO: 426686 - DNA, 15 bp, Homo sapiens
ttttctctgacacac

SEQ ID NO: 426687 - DNA, 15 bp, Homo sapiens
tttctctgacacact

SEQ ID NO: 426688 - DNA, 15 bp, Homo sapiens
ttctctgacacactg

SEQ ID NO: 426689 - DNA, 15 bp, Homo sapiens
tctctgacacactgg

SEQ ID NO: 426690 - DNA, 15 bp, Homo sapiens
ctctgacacactggt

SEQ ID NO: 426691 - DNA, 15 bp, Homo sapiens
tctgacacactggtt

SEQ ID NO: 426692 - DNA, 15 bp, Homo sapiens
ctgacacactggttt

SEQ ID NO: 426693 - DNA, 15 bp, Homo sapiens
tgacacactggtttc

SEQ ID NO: 426694 - DNA, 15 bp, Homo sapiens
gacacactggtttcg

SEQ ID NO: 426695 - DNA, 15 bp, Homo sapiens
acacactggtttcgg

SEQ ID NO: 426696 - DNA, 15 bp, Homo sapiens
cacactggtttcggc

SEQ ID NO: 426697 - DNA, 15 bp, Homo sapiens
acactggtttcggcc

SEQ ID NO: 426698 - DNA, 15 bp, Homo sapiens
cactggtttcggcca

SEQ ID NO: 426699 - DNA, 15 bp, Homo sapiens
actggtttcggccac

SEQ ID NO: 426700 - DNA, 15 bp, Homo sapiens
ctggtttcggccaca

SEQ ID NO: 426701 - DNA, 15 bp, Homo sapiens
tggtttcggccacac

SEQ ID NO: 426702 - DNA, 15 bp, Homo sapiens
ggtttcggccacact

SEQ ID NO: 426703 - DNA, 15 bp, Homo sapiens
gtttcggccacactg

SEQ ID NO: 426704 - DNA, 15 bp, Homo sapiens
tttcggccacactgg

SEQ ID NO: 426705 - DNA, 15 bp, Homo sapiens
ttcggccacactggt

SEQ ID NO: 426706 - DNA, 15 bp, Homo sapiens
tcggccacactggtc

SEQ ID NO: 426707 - DNA, 15 bp, Homo sapiens
cggccacactggtcc

SEQ ID NO: 426708 - DNA, 15 bp, Homo sapiens
ggccacactggtccc

SEQ ID NO: 426709 - DNA, 15 bp, Homo sapiens
gccacactggtccct

SEQ ID NO: 426710 - DNA, 15 bp, Homo sapiens
ccacactggtccctt

SEQ ID NO: 426711 - DNA, 15 bp, Homo sapiens
cacactggtcccttg

SEQ ID NO: 426712 - DNA, 15 bp, Homo sapiens
acactggtcccttgc

SEQ ID NO: 426713 - DNA, 15 bp, Homo sapiens
cactggtcccttgct

SEQ ID NO: 426714 - DNA, 15 bp, Homo sapiens
actggtcccttgctg

SEQ ID NO: 426715 - DNA, 15 bp, Homo sapiens
ctggtcccttgctga

SEQ ID NO: 426716 - DNA, 15 bp, Homo sapiens
tggtcccttgctgag

SEQ ID NO: 426717 - DNA, 15 bp, Homo sapiens
ggtcccttgctgagc

SEQ ID NO: 426718 - DNA, 15 bp, Homo sapiens
gtcccttgctgagct

SEQ ID NO: 426719 - DNA, 15 bp, Homo sapiens
tcccttgctgagctt

SEQ ID NO: 426720 - DNA, 15 bp, Homo sapiens
cccttgctgagcttt

SEQ ID NO: 426721 - DNA, 15 bp, Homo sapiens
ccttgctgagctttc

SEQ ID NO: 426722 - DNA, 15 bp, Homo sapiens
cttgctgagctttca

SEQ ID NO: 426723 - DNA, 15 bp, Homo sapiens
ttgctgagctttcag

SEQ ID NO: 426724 - DNA, 15 bp, Homo sapiens
tgctgagctttcagt

SEQ ID NO: 426725 - DNA, 15 bp, Homo sapiens
gctgagctttcagtc

SEQ ID NO: 426726 - DNA, 15 bp, Homo sapiens
ctgagctttcagtca

SEQ ID NO: 426727 - DNA, 15 bp, Homo sapiens
tgagctttcagtcac

SEQ ID NO: 426728 - DNA, 15 bp, Homo sapiens
gagctttcagtcaca

SEQ ID NO: 426729 - DNA, 15 bp, Homo sapiens
agctttcagtcacag

SEQ ID NO: 426730 - DNA, 15 bp, Homo sapiens
gctttcagtcacagt

SEQ ID NO: 426731 - DNA, 15 bp, Homo sapiens
ctttcagtcacagtg

SEQ ID NO: 426732 - DNA, 15 bp, Homo sapiens
tttcagtcacagtgc

SEQ ID NO: 426733 - DNA, 15 bp, Homo sapiens
ttcagtcacagtgcc

SEQ ID NO: 426734 - DNA, 15 bp, Homo sapiens
tcagtcacagtgcca

SEQ ID NO: 426735 - DNA, 15 bp, Homo sapiens
cagtcacagtgccag

SEQ ID NO: 426736 - DNA, 15 bp, Homo sapiens
agtcacagtgccagc

SEQ ID NO: 426737 - DNA, 15 bp, Homo sapiens
gtcacagtgccagcc

SEQ ID NO: 426738 - DNA, 15 bp, Homo sapiens
tcacagtgccagcct

SEQ ID NO: 426739 - DNA, 15 bp, Homo sapiens
cacagtgccagcctg

SEQ ID NO: 426740 - DNA, 15 bp, Homo sapiens
acagtgccagcctgt

SEQ ID NO: 426741 - DNA, 15 bp, Homo sapiens
cagtgccagcctgtc

SEQ ID NO: 426742 - DNA, 15 bp, Homo sapiens
agtgccagcctgtct

SEQ ID NO: 426743 - DNA, 15 bp, Homo sapiens
gtgccagcctgtctg

SEQ ID NO: 426744 - DNA, 15 bp, Homo sapiens
tgccagcctgtctgc

SEQ ID NO: 426745 - DNA, 15 bp, Homo sapiens
gccagcctgtctgct

SEQ ID NO: 426746 - DNA, 15 bp, Homo sapiens
ccagcctgtctgctc

SEQ ID NO: 426747 - DNA, 15 bp, Homo sapiens
cagcctgtctgctct

SEQ ID NO: 426748 - DNA, 15 bp, Homo sapiens
agcctgtctgctctg

SEQ ID NO: 426749 - DNA, 15 bp, Homo sapiens
gcctgtctgctctgc

SEQ ID NO: 426750 - DNA, 15 bp, Homo sapiens
cctgtctgctctgcc

SEQ ID NO: 426751 - DNA, 15 bp, Homo sapiens
ctgtctgctctgccc

SEQ ID NO: 426752 - DNA, 15 bp, Homo sapiens
tgtctgctctgccca

SEQ ID NO: 426753 - DNA, 15 bp, Homo sapiens
gtctgctctgcccaa

SEQ ID NO: 426754 - DNA, 15 bp, Homo sapiens
tctgctctgcccaaa

SEQ ID NO: 426755 - DNA, 15 bp, Homo sapiens
ctgctctgcccaaaa

SEQ ID NO: 426756 - DNA, 15 bp, Homo sapiens
tgctctgcccaaaat

SEQ ID NO: 426757 - DNA, 15 bp, Homo sapiens
gctctgcccaaaatg

SEQ ID NO: 426758 - DNA, 15 bp, Homo sapiens
ctctgcccaaaatgc

SEQ ID NO: 426759 - DNA, 15 bp, Homo sapiens
tctgcccaaaatgcc

SEQ ID NO: 426760 - DNA, 15 bp, Homo sapiens
ctgcccaaaatgccc

SEQ ID NO: 426761 - DNA, 15 bp, Homo sapiens
tgcccaaaatgcccc

SEQ ID NO: 426762 - DNA, 15 bp, Homo sapiens
gcccaaaatgcccct

SEQ ID NO: 426763 - DNA, 15 bp, Homo sapiens
cccaaaatgcccctt

SEQ ID NO: 426764 - DNA, 15 bp, Homo sapiens
ccaaaatgccccttc

SEQ ID NO: 426765 - DNA, 15 bp, Homo sapiens
caaaatgccccttct

SEQ ID NO: 426766 - DNA, 15 bp, Homo sapiens
aaaatgccccttctt

SEQ ID NO: 426767 - DNA, 15 bp, Homo sapiens
aaatgccccttcttt

SEQ ID NO: 426768 - DNA, 15 bp, Homo sapiens
aatgccccttcttta

SEQ ID NO: 426769 - DNA, 15 bp, Homo sapiens
atgccccttctttac

SEQ ID NO: 426770 - DNA, 15 bp, Homo sapiens
tgccccttctttact

SEQ ID NO: 426771 - DNA, 15 bp, Homo sapiens
gccccttctttactc

SEQ ID NO: 426772 - DNA, 15 bp, Homo sapiens
ccccttctttactca

SEQ ID NO: 426773 - DNA, 15 bp, Homo sapiens
cccttctttactcaa

SEQ ID NO: 426774 - DNA, 15 bp, Homo sapiens
ccttctttactcaac

SEQ ID NO: 426775 - DNA, 15 bp, Homo sapiens
cttctttactcaact

SEQ ID NO: 426776 - DNA, 15 bp, Homo sapiens
ttctttactcaactt

SEQ ID NO: 426777 - DNA, 15 bp, Homo sapiens
tctttactcaacttc

SEQ ID NO: 426778 - DNA, 15 bp, Homo sapiens
ctttactcaacttct

SEQ ID NO: 426779 - DNA, 15 bp, Homo sapiens
tttactcaacttctc

SEQ ID NO: 426780 - DNA, 15 bp, Homo sapiens
ttactcaacttctct

SEQ ID NO: 426781 - DNA, 15 bp, Homo sapiens
tactcaacttctcta

SEQ ID NO: 426782 - DNA, 15 bp, Homo sapiens
actcaacttctctac

SEQ ID NO: 426783 - DNA, 15 bp, Homo sapiens
ctcaacttctctact

SEQ ID NO: 426784 - DNA, 15 bp, Homo sapiens
tcaacttctctactt

SEQ ID NO: 426785 - DNA, 15 bp, Homo sapiens
caacttctctacttg

SEQ ID NO: 426786 - DNA, 15 bp, Homo sapiens
aacttctctacttga

SEQ ID NO: 426787 - DNA, 15 bp, Homo sapiens
acttctctacttgaa

SEQ ID NO: 426788 - DNA, 15 bp, Homo sapiens
cttctctacttgaac

SEQ ID NO: 426789 - DNA, 15 bp, Homo sapiens
ttctctacttgaact

SEQ ID NO: 426790 - DNA, 15 bp, Homo sapiens
tctctacttgaactg

SEQ ID NO: 426791 - DNA, 15 bp, Homo sapiens
ctctacttgaactgc

SEQ ID NO: 426792 - DNA, 15 bp, Homo sapiens
tctacttgaactgca

SEQ ID NO: 426793 - DNA, 15 bp, Homo sapiens
ctacttgaactgcag

SEQ ID NO: 426794 - DNA, 15 bp, Homo sapiens
tacttgaactgcagc

SEQ ID NO: 426795 - DNA, 15 bp, Homo sapiens
acttgaactgcagct

SEQ ID NO: 426796 - DNA, 15 bp, Homo sapiens
cttgaactgcagctc

SEQ ID NO: 426797 - DNA, 15 bp, Homo sapiens
ttgaactgcagctcc

SEQ ID NO: 426798 - DNA, 15 bp, Homo sapiens
tgaactgcagctccc

SEQ ID NO: 426799 - DNA, 15 bp, Homo sapiens
gaactgcagctccct

SEQ ID NO: 426800 - DNA, 15 bp, Homo sapiens
aactgcagctccctc

SEQ ID NO: 426801 - DNA, 15 bp, Homo sapiens
actgcagctccctct

SEQ ID NO: 426802 - DNA, 15 bp, Homo sapiens
ctgcagctccctctg

SEQ ID NO: 426803 - DNA, 15 bp, Homo sapiens
tgcagctccctctga

SEQ ID NO: 426804 - DNA, 15 bp, Homo sapiens
gcagctccctctgag

SEQ ID NO: 426805 - DNA, 15 bp, Homo sapiens
cagctccctctgagc

SEQ ID NO: 426806 - DNA, 15 bp, Homo sapiens
agctccctctgagca

SEQ ID NO: 426807 - DNA, 15 bp, Homo sapiens
gctccctctgagcac

SEQ ID NO: 426808 - DNA, 15 bp, Homo sapiens
ctccctctgagcact

SEQ ID NO: 426809 - DNA, 15 bp, Homo sapiens
tccctctgagcactc

SEQ ID NO: 426810 - DNA, 15 bp, Homo sapiens
ccctctgagcactcc

SEQ ID NO: 426811 - DNA, 15 bp, Homo sapiens
cctctgagcactcct

SEQ ID NO: 426812 - DNA, 15 bp, Homo sapiens
ctctgagcactcctt

SEQ ID NO: 426813 - DNA, 15 bp, Homo sapiens
tctgagcactccttc

SEQ ID NO: 426814 - DNA, 15 bp, Homo sapiens
ctgagcactccttct

SEQ ID NO: 426815 - DNA, 15 bp, Homo sapiens
tgagcactccttctc

SEQ ID NO: 426816 - DNA, 15 bp, Homo sapiens
gagcactccttctct

SEQ ID NO: 426817 - DNA, 15 bp, Homo sapiens
agcactccttctctc

SEQ ID NO: 426818 - DNA, 15 bp, Homo sapiens
gcactccttctctct

SEQ ID NO: 426819 - DNA, 15 bp, Homo sapiens
cactccttctctctc

SEQ ID NO: 426820 - DNA, 15 bp, Homo sapiens
actccttctctctct

SEQ ID NO: 426821 - DNA, 15 bp, Homo sapiens
ctccttctctctctc

SEQ ID NO: 426822 - DNA, 15 bp, Homo sapiens
tccttctctctctct

SEQ ID NO: 426823 - DNA, 15 bp, Homo sapiens
ccttctctctctctc

SEQ ID NO: 426824 - DNA, 15 bp, Homo sapiens
cttctctctctctca

SEQ ID NO: 426825 - DNA, 15 bp, Homo sapiens
ttctctctctctcat

SEQ ID NO: 426826 - DNA, 15 bp, Homo sapiens
tctctctctctcatt

SEQ ID NO: 426827 - DNA, 15 bp, Homo sapiens
ctctctctctcattc

SEQ ID NO: 426828 - DNA, 15 bp, Homo sapiens
tctctctctcattct

SEQ ID NO: 426829 - DNA, 15 bp, Homo sapiens
ctctctctcattctc

SEQ ID NO: 426830 - DNA, 15 bp, Homo sapiens
tctctctcattctct

SEQ ID NO: 426831 - DNA, 15 bp, Homo sapiens
ctctctcattctctc

SEQ ID NO: 426832 - DNA, 15 bp, Homo sapiens
tctctcattctctct

SEQ ID NO: 426833 - DNA, 15 bp, Homo sapiens
tcattctctctctct

SEQ ID NO: 426834 - DNA, 15 bp, Homo sapiens
cattctctctctctt

SEQ ID NO: 426835 - DNA, 15 bp, Homo sapiens
attctctctctcttc

SEQ ID NO: 426836 - DNA, 15 bp, Homo sapiens
ttctctctctcttcc

SEQ ID NO: 426837 - DNA, 15 bp, Homo sapiens
tctctctctcttccc

SEQ ID NO: 426838 - DNA, 15 bp, Homo sapiens
ctctctctcttcccc

SEQ ID NO: 426839 - DNA, 15 bp, Homo sapiens
tctctctcttccccc

SEQ ID NO: 426840 - DNA, 15 bp, Homo sapiens
ctctctcttcccccc

SEQ ID NO: 426841 - DNA, 15 bp, Homo sapiens
tctctcttccccccc

SEQ ID NO: 426842 - DNA, 15 bp, Homo sapiens
ctctcttcccccccc

SEQ ID NO: 426843 - DNA, 15 bp, Homo sapiens
tctcttcccccccca

SEQ ID NO: 426844 - DNA, 15 bp, Homo sapiens
ctcttccccccccac

SEQ ID NO: 426845 - DNA, 15 bp, Homo sapiens
tcttccccccccacc

SEQ ID NO: 426846 - DNA, 15 bp, Homo sapiens
cttccccccccaccc

SEQ ID NO: 426847 - DNA, 15 bp, Homo sapiens
ttccccccccaccct

SEQ ID NO: 426848 - DNA, 15 bp, Homo sapiens
tccccccccaccctt

SEQ ID NO: 426849 - DNA, 15 bp, Homo sapiens
ccccccccacccttt

SEQ ID NO: 426850 - DNA, 15 bp, Homo sapiens
cccccccaccctttt

SEQ ID NO: 426851 - DNA, 15 bp, Homo sapiens
ccccccacccttttc

SEQ ID NO: 426852 - DNA, 15 bp, Homo sapiens
cccccacccttttct

SEQ ID NO: 426853 - DNA, 15 bp, Homo sapiens
ccccacccttttcta

SEQ ID NO: 426854 - DNA, 15 bp, Homo sapiens
cccacccttttctac

SEQ ID NO: 426855 - DNA, 15 bp, Homo sapiens
ccacccttttctact

SEQ ID NO: 426856 - DNA, 15 bp, Homo sapiens
cacccttttctactt

SEQ ID NO: 426857 - DNA, 15 bp, Homo sapiens
acccttttctacttc

SEQ ID NO: 426858 - DNA, 15 bp, Homo sapiens
cccttttctacttct

SEQ ID NO: 426859 - DNA, 15 bp, Homo sapiens
ccttttctacttctt

SEQ ID NO: 426860 - DNA, 15 bp, Homo sapiens
cttttctacttcttt

SEQ ID NO: 426861 - DNA, 15 bp, Homo sapiens
ttttctacttctttc

SEQ ID NO: 426862 - DNA, 15 bp, Homo sapiens
tttctacttctttct

SEQ ID NO: 426863 - DNA, 15 bp, Homo sapiens
ttctacttctttctt

SEQ ID NO: 426864 - DNA, 15 bp, Homo sapiens
tctacttctttcttt

SEQ ID NO: 426865 - DNA, 15 bp, Homo sapiens
ctacttctttctttt

SEQ ID NO: 426866 - DNA, 15 bp, Homo sapiens
tacttctttcttttt

SEQ ID NO: 426867 - DNA, 15 bp, Homo sapiens
acttctttctttttc

SEQ ID NO: 426868 - DNA, 15 bp, Homo sapiens
cttctttctttttct

SEQ ID NO: 426869 - DNA, 15 bp, Homo sapiens
ttctttctttttcta

SEQ ID NO: 426870 - DNA, 15 bp, Homo sapiens
tctttctttttctat

SEQ ID NO: 426871 - DNA, 15 bp, Homo sapiens
ctttctttttctata

SEQ ID NO: 426872 - DNA, 15 bp, Homo sapiens
tttctttttctatag

SEQ ID NO: 426873 - DNA, 15 bp, Homo sapiens
ttctttttctatagc

SEQ ID NO: 426874 - DNA, 15 bp, Homo sapiens
tctttttctatagca

SEQ ID NO: 426875 - DNA, 15 bp, Homo sapiens
ctttttctatagcat

SEQ ID NO: 426876 - DNA, 15 bp, Homo sapiens
tttttctatagcatt

SEQ ID NO: 426877 - DNA, 15 bp, Homo sapiens
ttttctatagcattt

SEQ ID NO: 426878 - DNA, 15 bp, Homo sapiens
tttctatagcattta

SEQ ID NO: 426879 - DNA, 15 bp, Homo sapiens
ttctatagcatttat

SEQ ID NO: 426880 - DNA, 15 bp, Homo sapiens
tctatagcatttatc

SEQ ID NO: 426881 - DNA, 15 bp, Homo sapiens
ctatagcatttatca

SEQ ID NO: 426882 - DNA, 15 bp, Homo sapiens
tatagcatttatcag

SEQ ID NO: 426883 - DNA, 15 bp, Homo sapiens
atagcatttatcaga

SEQ ID NO: 426884 - DNA, 15 bp, Homo sapiens
tagcatttatcagaa

SEQ ID NO: 426885 - DNA, 15 bp, Homo sapiens
agcatttatcagaat

SEQ ID NO: 426886 - DNA, 15 bp, Homo sapiens
gcatttatcagaatc

SEQ ID NO: 426887 - DNA, 15 bp, Homo sapiens
catttatcagaatct

SEQ ID NO: 426888 - DNA, 15 bp, Homo sapiens
atttatcagaatcta

SEQ ID NO: 426889 - DNA, 15 bp, Homo sapiens
tttatcagaatctaa

SEQ ID NO: 426890 - DNA, 15 bp, Homo sapiens
ttatcagaatctaac

SEQ ID NO: 426891 - DNA, 15 bp, Homo sapiens
tatcagaatctaaca

SEQ ID NO: 426892 - DNA, 15 bp, Homo sapiens
atcagaatctaacac

SEQ ID NO: 426893 - DNA, 15 bp, Homo sapiens
tcagaatctaacaca

SEQ ID NO: 426894 - DNA, 15 bp, Homo sapiens
cagaatctaacacaa

SEQ ID NO: 426895 - DNA, 15 bp, Homo sapiens
agaatctaacacaat

SEQ ID NO: 426896 - DNA, 15 bp, Homo sapiens
gaatctaacacaatg

SEQ ID NO: 426897 - DNA, 15 bp, Homo sapiens
aatctaacacaatga

SEQ ID NO: 426898 - DNA, 15 bp, Homo sapiens
atctaacacaatgac

SEQ ID NO: 426899 - DNA, 15 bp, Homo sapiens
tctaacacaatgact

SEQ ID NO: 426900 - DNA, 15 bp, Homo sapiens
ctaacacaatgactt

SEQ ID NO: 426901 - DNA, 15 bp, Homo sapiens
taacacaatgactta

SEQ ID NO: 426902 - DNA, 15 bp, Homo sapiens
aacacaatgacttat

SEQ ID NO: 426903 - DNA, 15 bp, Homo sapiens
acacaatgacttatt

SEQ ID NO: 426904 - DNA, 15 bp, Homo sapiens
cacaatgacttattt

SEQ ID NO: 426905 - DNA, 15 bp, Homo sapiens
acaatgacttatttt

SEQ ID NO: 426906 - DNA, 15 bp, Homo sapiens
caatgacttattttc

SEQ ID NO: 426907 - DNA, 15 bp, Homo sapiens
aatgacttattttct

SEQ ID NO: 426908 - DNA, 15 bp, Homo sapiens
atgacttattttcta

SEQ ID NO: 426909 - DNA, 15 bp, Homo sapiens
tgacttattttctat

SEQ ID NO: 426910 - DNA, 15 bp, Homo sapiens
gacttattttctatg

SEQ ID NO: 426911 - DNA, 15 bp, Homo sapiens
acttattttctatgt

SEQ ID NO: 426912 - DNA, 15 bp, Homo sapiens
cttattttctatgtc

SEQ ID NO: 426913 - DNA, 15 bp, Homo sapiens
ttattttctatgtct

SEQ ID NO: 426914 - DNA, 15 bp, Homo sapiens
tattttctatgtctt

SEQ ID NO: 426915 - DNA, 15 bp, Homo sapiens
attttctatgtcttt

SEQ ID NO: 426916 - DNA, 15 bp, Homo sapiens
ttttctatgtctttt

SEQ ID NO: 426917 - DNA, 15 bp, Homo sapiens
tttctatgtcttttt

SEQ ID NO: 426918 - DNA, 15 bp, Homo sapiens
ttctatgtctttttt

SEQ ID NO: 426919 - DNA, 15 bp, Homo sapiens
tctatgtcttttttt

SEQ ID NO: 426920 - DNA, 15 bp, Homo sapiens
ctatgtctttttttt

SEQ ID NO: 426921 - DNA, 15 bp, Homo sapiens
tatgtcttttttttt

SEQ ID NO: 426922 - DNA, 15 bp, Homo sapiens
atgtctttttttttt

SEQ ID NO: 426923 - DNA, 15 bp, Homo sapiens
tgtcttttttttttt

SEQ ID NO: 426924 - DNA, 15 bp, Homo sapiens
ttttttttttgcttg

SEQ ID NO: 426925 - DNA, 15 bp, Homo sapiens
tttttttttgcttgg

SEQ ID NO: 426926 - DNA, 15 bp, Homo sapiens
ttttttttgcttggt

SEQ ID NO: 426927 - DNA, 15 bp, Homo sapiens
tttttttgcttggta

SEQ ID NO: 426928 - DNA, 15 bp, Homo sapiens
ttttttgcttggtac

SEQ ID NO: 426929 - DNA, 15 bp, Homo sapiens
tttttgcttggtact

SEQ ID NO: 426930 - DNA, 15 bp, Homo sapiens
ttttgcttggtactc

SEQ ID NO: 426931 - DNA, 15 bp, Homo sapiens
tttgcttggtactct

SEQ ID NO: 426932 - DNA, 15 bp, Homo sapiens
ttgcttggtactctg

SEQ ID NO: 426933 - DNA, 15 bp, Homo sapiens
tgcttggtactctgg

SEQ ID NO: 426934 - DNA, 15 bp, Homo sapiens
gcttggtactctgga

SEQ ID NO: 426935 - DNA, 15 bp, Homo sapiens
cttggtactctggat

SEQ ID NO: 426936 - DNA, 15 bp, Homo sapiens
ttggtactctggatg

SEQ ID NO: 426937 - DNA, 15 bp, Homo sapiens
tggtactctggatgc

SEQ ID NO: 426938 - DNA, 15 bp, Homo sapiens
ggtactctggatgct

SEQ ID NO: 426939 - DNA, 15 bp, Homo sapiens
gtactctggatgctc

SEQ ID NO: 426940 - DNA, 15 bp, Homo sapiens
tactctggatgctcg

SEQ ID NO: 426941 - DNA, 15 bp, Homo sapiens
actctggatgctcga

SEQ ID NO: 426942 - DNA, 15 bp, Homo sapiens
ctctggatgctcgat

SEQ ID NO: 426943 - DNA, 15 bp, Homo sapiens
tctggatgctcgata

SEQ ID NO: 426944 - DNA, 15 bp, Homo sapiens
ctggatgctcgataa

SEQ ID NO: 426945 - DNA, 15 bp, Homo sapiens
tggatgctcgataaa

SEQ ID NO: 426946 - DNA, 15 bp, Homo sapiens
ggatgctcgataaaa

SEQ ID NO: 426947 - DNA, 15 bp, Homo sapiens
gatgctcgataaaag

SEQ ID NO: 426948 - DNA, 15 bp, Homo sapiens
atgctcgataaaagt

SEQ ID NO: 426949 - DNA, 15 bp, Homo sapiens
tgctcgataaaagtt

SEQ ID NO: 426950 - DNA, 15 bp, Homo sapiens
gctcgataaaagttg

SEQ ID NO: 426951 - DNA, 15 bp, Homo sapiens
ctcgataaaagttga

SEQ ID NO: 426952 - DNA, 15 bp, Homo sapiens
tcgataaaagttgaa

SEQ ID NO: 426953 - DNA, 15 bp, Homo sapiens
cgataaaagttgaat

SEQ ID NO: 426954 - DNA, 15 bp, Homo sapiens
gataaaagttgaatg

SEQ ID NO: 426955 - DNA, 15 bp, Homo sapiens
ataaaagttgaatgt

SEQ ID NO: 426956 - DNA, 15 bp, Homo sapiens
taaaagttgaatgtt

SEQ ID NO: 426957 - DNA, 15 bp, Homo sapiens
aaaagttgaatgttg

SEQ ID NO: 426958 - DNA, 15 bp, Homo sapiens
aaagttgaatgttga

SEQ ID NO: 426959 - DNA, 15 bp, Homo sapiens
aagttgaatgttgac

SEQ ID NO: 426960 - DNA, 15 bp, Homo sapiens
agttgaatgttgact

SEQ ID NO: 426961 - DNA, 15 bp, Homo sapiens
gttgaatgttgactg

SEQ ID NO: 426962 - DNA, 15 bp, Homo sapiens
ttgaatgttgactga

SEQ ID NO: 426963 - DNA, 15 bp, Homo sapiens
tgaatgttgactgaa

SEQ ID NO: 426964 - DNA, 15 bp, Homo sapiens
gaatgttgactgaaa

SEQ ID NO: 426965 - DNA, 15 bp, Homo sapiens
aatgttgactgaaag

SEQ ID NO: 426966 - DNA, 15 bp, Homo sapiens
atgttgactgaaaga

SEQ ID NO: 426967 - DNA, 15 bp, Homo sapiens
tgttgactgaaagag

SEQ ID NO: 426968 - DNA, 15 bp, Homo sapiens
gttgactgaaagagc

SEQ ID NO: 426969 - DNA, 15 bp, Homo sapiens
ttgactgaaagagct

SEQ ID NO: 426970 - DNA, 15 bp, Homo sapiens
tgactgaaagagcta

SEQ ID NO: 426971 - DNA, 15 bp, Homo sapiens
gactgaaagagctat

SEQ ID NO: 426972 - DNA, 15 bp, Homo sapiens
actgaaagagctata

SEQ ID NO: 426973 - DNA, 15 bp, Homo sapiens
ctgaaagagctatac

SEQ ID NO: 426974 - DNA, 15 bp, Homo sapiens
tgaaagagctatacc

SEQ ID NO: 426975 - DNA, 15 bp, Homo sapiens
gaaagagctataccc

SEQ ID NO: 426976 - DNA, 15 bp, Homo sapiens
aaagagctataccca

SEQ ID NO: 426977 - DNA, 15 bp, Homo sapiens
aagagctatacccaa

SEQ ID NO: 426978 - DNA, 15 bp, Homo sapiens
agagctatacccaag

SEQ ID NO: 426979 - DNA, 15 bp, Homo sapiens
gagctatacccaagg

SEQ ID NO: 426980 - DNA, 15 bp, Homo sapiens
agctatacccaaggg

SEQ ID NO: 426981 - DNA, 15 bp, Homo sapiens
gctatacccaaggga

SEQ ID NO: 426982 - DNA, 15 bp, Homo sapiens
ctatacccaagggaa

SEQ ID NO: 426983 - DNA, 15 bp, Homo sapiens
tatacccaagggaac

SEQ ID NO: 426984 - DNA, 15 bp, Homo sapiens
atacccaagggaaca

SEQ ID NO: 426985 - DNA, 15 bp, Homo sapiens
tacccaagggaacat

SEQ ID NO: 426986 - DNA, 15 bp, Homo sapiens
acccaagggaacatg

SEQ ID NO: 426987 - DNA, 15 bp, Homo sapiens
cccaagggaacatgt

SEQ ID NO: 426988 - DNA, 15 bp, Homo sapiens
ccaagggaacatgtc

SEQ ID NO: 426989 - DNA, 15 bp, Homo sapiens
caagggaacatgtcc

SEQ ID NO: 426990 - DNA, 15 bp, Homo sapiens
aagggaacatgtcct

SEQ ID NO: 426991 - DNA, 15 bp, Homo sapiens
agggaacatgtcctt

SEQ ID NO: 426992 - DNA, 15 bp, Homo sapiens
gggaacatgtccttt

SEQ ID NO: 426993 - DNA, 15 bp, Homo sapiens
ggaacatgtcctttg

SEQ ID NO: 426994 - DNA, 15 bp, Homo sapiens
gaacatgtcctttgg

SEQ ID NO: 426995 - DNA, 15 bp, Homo sapiens
aacatgtcctttggt

SEQ ID NO: 426996 - DNA, 15 bp, Homo sapiens
acatgtcctttggtg

SEQ ID NO: 426997 - DNA, 15 bp, Homo sapiens
catgtcctttggtgt

SEQ ID NO: 426998 - DNA, 15 bp, Homo sapiens
atgtcctttggtgtg

SEQ ID NO: 426999 - DNA, 15 bp, Homo sapiens
tgtcctttggtgtga

SEQ ID NO: 427000 - DNA, 15 bp, Homo sapiens
gtcctttggtgtgaa

SEQ ID NO: 427001 - DNA, 15 bp, Homo sapiens
tcctttggtgtgaat

SEQ ID NO: 427002 - DNA, 15 bp, Homo sapiens
cctttggtgtgaatg

SEQ ID NO: 427003 - DNA, 15 bp, Homo sapiens
ctttggtgtgaatgt

SEQ ID NO: 427004 - DNA, 15 bp, Homo sapiens
tttggtgtgaatgtt

SEQ ID NO: 427005 - DNA, 15 bp, Homo sapiens
ttggtgtgaatgttc

SEQ ID NO: 427006 - DNA, 15 bp, Homo sapiens
tggtgtgaatgttcc

SEQ ID NO: 427007 - DNA, 15 bp, Homo sapiens
ggtgtgaatgttcct

SEQ ID NO: 427008 - DNA, 15 bp, Homo sapiens
gtgtgaatgttcctt

SEQ ID NO: 427009 - DNA, 15 bp, Homo sapiens
tgtgaatgttccttt

SEQ ID NO: 427010 - DNA, 15 bp, Homo sapiens
gtgaatgttcctttt

SEQ ID NO: 427011 - DNA, 15 bp, Homo sapiens
tgaatgttccttttg

SEQ ID NO: 427012 - DNA, 15 bp, Homo sapiens
gaatgttccttttgt

SEQ ID NO: 427013 - DNA, 15 bp, Homo sapiens
aatgttccttttgtc

SEQ ID NO: 427014 - DNA, 15 bp, Homo sapiens
atgttccttttgtct

SEQ ID NO: 427015 - DNA, 15 bp, Homo sapiens
tgttccttttgtctc

SEQ ID NO: 427016 - DNA, 15 bp, Homo sapiens
gttccttttgtctct

SEQ ID NO: 427017 - DNA, 15 bp, Homo sapiens
ttccttttgtctctt

SEQ ID NO: 427018 - DNA, 15 bp, Homo sapiens
tccttttgtctcttt

SEQ ID NO: 427019 - DNA, 15 bp, Homo sapiens
ccttttgtctcttta

SEQ ID NO: 427020 - DNA, 15 bp, Homo sapiens
cttttgtctctttat

SEQ ID NO: 427021 - DNA, 15 bp, Homo sapiens
ttttgtctctttatt

SEQ ID NO: 427022 - DNA, 15 bp, Homo sapiens
tttgtctctttattt

SEQ ID NO: 427023 - DNA, 15 bp, Homo sapiens
ttgtctctttatttc

SEQ ID NO: 427024 - DNA, 15 bp, Homo sapiens
tgtctctttatttct

SEQ ID NO: 427025 - DNA, 15 bp, Homo sapiens
gtctctttatttctc

SEQ ID NO: 427026 - DNA, 15 bp, Homo sapiens
tctctttatttctca

SEQ ID NO: 427027 - DNA, 15 bp, Homo sapiens
ctctttatttctcag

SEQ ID NO: 427028 - DNA, 15 bp, Homo sapiens
tctttatttctcagt

SEQ ID NO: 427029 - DNA, 15 bp, Homo sapiens
ctttatttctcagta

SEQ ID NO: 427030 - DNA, 15 bp, Homo sapiens
tttatttctcagtaa

SEQ ID NO: 427031 - DNA, 15 bp, Homo sapiens
ttatttctcagtaat

SEQ ID NO: 427032 - DNA, 15 bp, Homo sapiens
tatttctcagtaatt

SEQ ID NO: 427033 - DNA, 15 bp, Homo sapiens
atttctcagtaattc

SEQ ID NO: 427034 - DNA, 15 bp, Homo sapiens
tttctcagtaattct

SEQ ID NO: 427035 - DNA, 15 bp, Homo sapiens
ttctcagtaattctt

SEQ ID NO: 427036 - DNA, 15 bp, Homo sapiens
tctcagtaattcttt

SEQ ID NO: 427037 - DNA, 15 bp, Homo sapiens
ctcagtaattctttt

SEQ ID NO: 427038 - DNA, 15 bp, Homo sapiens
tcagtaattcttttt

SEQ ID NO: 427039 - DNA, 15 bp, Homo sapiens
cagtaattctttttt

SEQ ID NO: 427040 - DNA, 15 bp, Homo sapiens
agtaattctttttta

SEQ ID NO: 427041 - DNA, 15 bp, Homo sapiens
gtaattcttttttat

SEQ ID NO: 427042 - DNA, 15 bp, Homo sapiens
taattcttttttatt

SEQ ID NO: 427043 - DNA, 15 bp, Homo sapiens
aattcttttttattc

SEQ ID NO: 427044 - DNA, 15 bp, Homo sapiens
attcttttttattca

SEQ ID NO: 427045 - DNA, 15 bp, Homo sapiens
ttcttttttattcat

SEQ ID NO: 427046 - DNA, 15 bp, Homo sapiens
tcttttttattcatt

SEQ ID NO: 427047 - DNA, 15 bp, Homo sapiens
cttttttattcattt

SEQ ID NO: 427048 - DNA, 15 bp, Homo sapiens
ttttttattcatttg

SEQ ID NO: 427049 - DNA, 15 bp, Homo sapiens
tttttattcatttgc

SEQ ID NO: 427050 - DNA, 15 bp, Homo sapiens
ttttattcatttgcg

SEQ ID NO: 427051 - DNA, 15 bp, Homo sapiens
tttattcatttgcgt

SEQ ID NO: 427052 - DNA, 15 bp, Homo sapiens
ttattcatttgcgtt

SEQ ID NO: 427053 - DNA, 15 bp, Homo sapiens
tattcatttgcgttc

SEQ ID NO: 427054 - DNA, 15 bp, Homo sapiens
attcatttgcgttct

SEQ ID NO: 427055 - DNA, 15 bp, Homo sapiens
ttcatttgcgttcta

SEQ ID NO: 427056 - DNA, 15 bp, Homo sapiens
tcatttgcgttctaa

SEQ ID NO: 427057 - DNA, 15 bp, Homo sapiens
catttgcgttctaaa

SEQ ID NO: 427058 - DNA, 15 bp, Homo sapiens
atttgcgttctaaag

SEQ ID NO: 427059 - DNA, 15 bp, Homo sapiens
tttgcgttctaaaga

SEQ ID NO: 427060 - DNA, 15 bp, Homo sapiens
ttgcgttctaaagaa

SEQ ID NO: 427061 - DNA, 15 bp, Homo sapiens
tgcgttctaaagaat

SEQ ID NO: 427062 - DNA, 15 bp, Homo sapiens
gcgttctaaagaata

SEQ ID NO: 427063 - DNA, 15 bp, Homo sapiens
cgttctaaagaatat

SEQ ID NO: 427064 - DNA, 15 bp, Homo sapiens
gttctaaagaatatt

SEQ ID NO: 427065 - DNA, 15 bp, Homo sapiens
ttctaaagaatatta

SEQ ID NO: 427066 - DNA, 15 bp, Homo sapiens
tctaaagaatattac

SEQ ID NO: 427067 - DNA, 15 bp, Homo sapiens
ctaaagaatattaca

SEQ ID NO: 427068 - DNA, 15 bp, Homo sapiens
taaagaatattacat

SEQ ID NO: 427069 - DNA, 15 bp, Homo sapiens
aaagaatattacatt

SEQ ID NO: 427070 - DNA, 15 bp, Homo sapiens
aagaatattacattt

SEQ ID NO: 427071 - DNA, 15 bp, Homo sapiens
agaatattacatttt

SEQ ID NO: 427072 - DNA, 15 bp, Homo sapiens
gaatattacattttg

SEQ ID NO: 427073 - DNA, 15 bp, Homo sapiens
aatattacattttga

SEQ ID NO: 427074 - DNA, 15 bp, Homo sapiens
atattacattttgaa

SEQ ID NO: 427075 - DNA, 15 bp, Homo sapiens
tattacattttgaaa

SEQ ID NO: 427076 - DNA, 15 bp, Homo sapiens
attacattttgaaaa

SEQ ID NO: 427077 - DNA, 15 bp, Homo sapiens
ttacattttgaaaat

SEQ ID NO: 427078 - DNA, 15 bp, Homo sapiens
tacattttgaaaata

SEQ ID NO: 427079 - DNA, 15 bp, Homo sapiens
acattttgaaaatat

SEQ ID NO: 427080 - DNA, 15 bp, Homo sapiens
cattttgaaaatatt

SEQ ID NO: 427081 - DNA, 15 bp, Homo sapiens
attttgaaaatattc

SEQ ID NO: 427082 - DNA, 15 bp, Homo sapiens
ttttgaaaatattcc

SEQ ID NO: 427083 - DNA, 15 bp, Homo sapiens
tttgaaaatattcct

SEQ ID NO: 427084 - DNA, 15 bp, Homo sapiens
ttgaaaatattccta

SEQ ID NO: 427085 - DNA, 15 bp, Homo sapiens
tgaaaatattcctac

SEQ ID NO: 427086 - DNA, 15 bp, Homo sapiens
gaaaatattcctact

SEQ ID NO: 427087 - DNA, 15 bp, Homo sapiens
aaaatattcctactt

SEQ ID NO: 427088 - DNA, 15 bp, Homo sapiens
aaatattcctacttt

SEQ ID NO: 427089 - DNA, 15 bp, Homo sapiens
aatattcctacttta

SEQ ID NO: 427090 - DNA, 15 bp, Homo sapiens
atattcctactttaa

SEQ ID NO: 427091 - DNA, 15 bp, Homo sapiens
tattcctactttaaa

SEQ ID NO: 427092 - DNA, 15 bp, Homo sapiens
attcctactttaaat

SEQ ID NO: 427093 - DNA, 15 bp, Homo sapiens
ttcctactttaaata

SEQ ID NO: 427094 - DNA, 15 bp, Homo sapiens
tcctactttaaatag

SEQ ID NO: 427095 - DNA, 15 bp, Homo sapiens
cctactttaaatagc

SEQ ID NO: 427096 - DNA, 15 bp, Homo sapiens
ctactttaaatagcc

SEQ ID NO: 427097 - DNA, 15 bp, Homo sapiens
tactttaaatagcca

SEQ ID NO: 427098 - DNA, 15 bp, Homo sapiens
actttaaatagccaa

SEQ ID NO: 427099 - DNA, 15 bp, Homo sapiens
ctttaaatagccaaa

SEQ ID NO: 427100 - DNA, 15 bp, Homo sapiens
tttaaatagccaaat

SEQ ID NO: 427101 - DNA, 15 bp, Homo sapiens
ttaaatagccaaatg

SEQ ID NO: 427102 - DNA, 15 bp, Homo sapiens
taaatagccaaatgt

SEQ ID NO: 427103 - DNA, 15 bp, Homo sapiens
aaatagccaaatgtt

SEQ ID NO: 427104 - DNA, 15 bp, Homo sapiens
aatagccaaatgttt

SEQ ID NO: 427105 - DNA, 15 bp, Homo sapiens
atagccaaatgttta

SEQ ID NO: 427106 - DNA, 15 bp, Homo sapiens
tagccaaatgtttaa

SEQ ID NO: 427107 - DNA, 15 bp, Homo sapiens
agccaaatgtttaat

SEQ ID NO: 427108 - DNA, 15 bp, Homo sapiens
gccaaatgtttaata

SEQ ID NO: 427109 - DNA, 15 bp, Homo sapiens
ccaaatgtttaataa

SEQ ID NO: 427110 - DNA, 15 bp, Homo sapiens
caaatgtttaataaa

SEQ ID NO: 427111 - DNA, 15 bp, Homo sapiens
aaatgtttaataaag

SEQ ID NO: 427112 - DNA, 15 bp, Homo sapiens
aatgtttaataaagg

SEQ ID NO: 427113 - DNA, 15 bp, Homo sapiens
atgtttaataaaggt

SEQ ID NO: 427114 - DNA, 15 bp, Homo sapiens
tgtttaataaaggta

SEQ ID NO: 427115 - DNA, 15 bp, Homo sapiens
gtttaataaaggtaa

SEQ ID NO: 427116 - DNA, 15 bp, Homo sapiens
tttaataaaggtaat

SEQ ID NO: 427117 - DNA, 15 bp, Homo sapiens
ttaataaaggtaata

SEQ ID NO: 427118 - DNA, 15 bp, Homo sapiens
taataaaggtaataa

SEQ ID NO: 427119 - DNA, 15 bp, Homo sapiens
aataaaggtaataac

SEQ ID NO: 427120 - DNA, 15 bp, Homo sapiens
ataaaggtaataact

SEQ ID NO: 427121 - DNA, 15 bp, Homo sapiens
taaaggtaataactg

SEQ ID NO: 427122 - DNA, 15 bp, Homo sapiens
aaaggtaataactga

SEQ ID NO: 427123 - DNA, 15 bp, Homo sapiens
aaggtaataactgaa

SEQ ID NO: 427124 - DNA, 15 bp, Homo sapiens
aggtaataactgaaa

SEQ ID NO: 427125 - DNA, 15 bp, Homo sapiens
ggtaataactgaaat

SEQ ID NO: 427126 - DNA, 15 bp, Homo sapiens
gtaataactgaaata

SEQ ID NO: 427127 - DNA, 15 bp, Homo sapiens
taataactgaaatag

SEQ ID NO: 427128 - DNA, 15 bp, Homo sapiens
aataactgaaataga

SEQ ID NO: 427129 - DNA, 15 bp, Homo sapiens
ataactgaaatagaa

SEQ ID NO: 427130 - DNA, 15 bp, Homo sapiens
taactgaaatagaag

SEQ ID NO: 427131 - DNA, 15 bp, Homo sapiens
aactgaaatagaagt

SEQ ID NO: 427132 - DNA, 15 bp, Homo sapiens
actgaaatagaagtg

SEQ ID NO: 427133 - DNA, 15 bp, Homo sapiens
ctgaaatagaagtgt

SEQ ID NO: 427134 - DNA, 15 bp, Homo sapiens
tgaaatagaagtgta

SEQ ID NO: 427135 - DNA, 15 bp, Homo sapiens
gaaatagaagtgtaa

SEQ ID NO: 427136 - DNA, 15 bp, Homo sapiens
aaatagaagtgtaag

SEQ ID NO: 427137 - DNA, 15 bp, Homo sapiens
aatagaagtgtaagc

SEQ ID NO: 427138 - DNA, 15 bp, Homo sapiens
atagaagtgtaagca

SEQ ID NO: 427139 - DNA, 15 bp, Homo sapiens
tagaagtgtaagcaa

SEQ ID NO: 427140 - DNA, 15 bp, Homo sapiens
agaagtgtaagcaat

SEQ ID NO: 427141 - DNA, 15 bp, Homo sapiens
gaagtgtaagcaata

SEQ ID NO: 427142 - DNA, 15 bp, Homo sapiens
aagtgtaagcaataa

SEQ ID NO: 427143 - DNA, 15 bp, Homo sapiens
agtgtaagcaataat

SEQ ID NO: 427144 - DNA, 15 bp, Homo sapiens
gtgtaagcaataatc

SEQ ID NO: 427145 - DNA, 15 bp, Homo sapiens
tgtaagcaataatct

SEQ ID NO: 427146 - DNA, 15 bp, Homo sapiens
gtaagcaataatctt

SEQ ID NO: 427147 - DNA, 15 bp, Homo sapiens
taagcaataatcttg

SEQ ID NO: 427148 - DNA, 15 bp, Homo sapiens
aagcaataatcttgt

SEQ ID NO: 427149 - DNA, 15 bp, Homo sapiens
agcaataatcttgtc

SEQ ID NO: 427150 - DNA, 15 bp, Homo sapiens
gcaataatcttgtct

SEQ ID NO: 427151 - DNA, 15 bp, Homo sapiens
caataatcttgtctc

SEQ ID NO: 427152 - DNA, 15 bp, Homo sapiens
aataatcttgtctcg

SEQ ID NO: 427153 - DNA, 15 bp, Homo sapiens
ataatcttgtctcga

SEQ ID NO: 427154 - DNA, 15 bp, Homo sapiens
taatcttgtctcgag

SEQ ID NO: 427155 - DNA, 15 bp, Homo sapiens
aatcttgtctcgaga

SEQ ID NO: 427156 - DNA, 15 bp, Homo sapiens
atcttgtctcgagag

SEQ ID NO: 427157 - DNA, 15 bp, Homo sapiens
tcttgtctcgagagc

SEQ ID NO: 427158 - DNA, 15 bp, Homo sapiens
cttgtctcgagagct

SEQ ID NO: 427159 - DNA, 15 bp, Homo sapiens
ttgtctcgagagcta

SEQ ID NO: 427160 - DNA, 15 bp, Homo sapiens
tgtctcgagagctag

SEQ ID NO: 427161 - DNA, 15 bp, Homo sapiens
gtctcgagagctaga

SEQ ID NO: 427162 - DNA, 15 bp, Homo sapiens
tctcgagagctagaa

SEQ ID NO: 427163 - DNA, 15 bp, Homo sapiens
ctcgagagctagaaa

SEQ ID NO: 427164 - DNA, 15 bp, Homo sapiens
tcgagagctagaaat

SEQ ID NO: 427165 - DNA, 15 bp, Homo sapiens
cgagagctagaaatc

SEQ ID NO: 427166 - DNA, 15 bp, Homo sapiens
gagagctagaaatca

SEQ ID NO: 427167 - DNA, 15 bp, Homo sapiens
agagctagaaatcat

SEQ ID NO: 427168 - DNA, 15 bp, Homo sapiens
gagctagaaatcatt

SEQ ID NO: 427169 - DNA, 15 bp, Homo sapiens
agctagaaatcattt

SEQ ID NO: 427170 - DNA, 15 bp, Homo sapiens
gctagaaatcatttc

SEQ ID NO: 427171 - DNA, 15 bp, Homo sapiens
ctagaaatcatttca

SEQ ID NO: 427172 - DNA, 15 bp, Homo sapiens
tagaaatcatttcag

SEQ ID NO: 427173 - DNA, 15 bp, Homo sapiens
agaaatcatttcagt

SEQ ID NO: 427174 - DNA, 15 bp, Homo sapiens
gaaatcatttcagtt

SEQ ID NO: 427175 - DNA, 15 bp, Homo sapiens
aaatcatttcagtta

SEQ ID NO: 427176 - DNA, 15 bp, Homo sapiens
aatcatttcagttac

SEQ ID NO: 427177 - DNA, 15 bp, Homo sapiens
atcatttcagttaca

SEQ ID NO: 427178 - DNA, 15 bp, Homo sapiens
tcatttcagttacat

SEQ ID NO: 427179 - DNA, 15 bp, Homo sapiens
catttcagttacatg

SEQ ID NO: 427180 - DNA, 15 bp, Homo sapiens
atttcagttacatga

SEQ ID NO: 427181 - DNA, 15 bp, Homo sapiens
tttcagttacatgac

SEQ ID NO: 427182 - DNA, 15 bp, Homo sapiens
ttcagttacatgaca

SEQ ID NO: 427183 - DNA, 15 bp, Homo sapiens
tcagttacatgacat

SEQ ID NO: 427184 - DNA, 15 bp, Homo sapiens
cagttacatgacata

SEQ ID NO: 427185 - DNA, 15 bp, Homo sapiens
agttacatgacatat

SEQ ID NO: 427186 - DNA, 15 bp, Homo sapiens
gttacatgacatatt

SEQ ID NO: 427187 - DNA, 15 bp, Homo sapiens
ttacatgacatattt

SEQ ID NO: 427188 - DNA, 15 bp, Homo sapiens
tacatgacatatttg

SEQ ID NO: 427189 - DNA, 15 bp, Homo sapiens
acatgacatatttga

SEQ ID NO: 427190 - DNA, 15 bp, Homo sapiens
catgacatatttgaa

SEQ ID NO: 427191 - DNA, 15 bp, Homo sapiens
atgacatatttgaaa

SEQ ID NO: 427192 - DNA, 15 bp, Homo sapiens
tgacatatttgaaat

SEQ ID NO: 427193 - DNA, 15 bp, Homo sapiens
gacatatttgaaatg

SEQ ID NO: 427194 - DNA, 15 bp, Homo sapiens
acatatttgaaatgt

SEQ ID NO: 427195 - DNA, 15 bp, Homo sapiens
catatttgaaatgta

SEQ ID NO: 427196 - DNA, 15 bp, Homo sapiens
atatttgaaatgtaa

SEQ ID NO: 427197 - DNA, 15 bp, Homo sapiens
tatttgaaatgtaag

SEQ ID NO: 427198 - DNA, 15 bp, Homo sapiens
atttgaaatgtaagc

SEQ ID NO: 427199 - DNA, 15 bp, Homo sapiens
tttgaaatgtaagca

SEQ ID NO: 427200 - DNA, 15 bp, Homo sapiens
ttgaaatgtaagcaa

SEQ ID NO: 427201 - DNA, 15 bp, Homo sapiens
tgaaatgtaagcaaa

SEQ ID NO: 427202 - DNA, 15 bp, Homo sapiens
gaaatgtaagcaaat

SEQ ID NO: 427203 - DNA, 15 bp, Homo sapiens
aaatgtaagcaaatt

SEQ ID NO: 427204 - DNA, 15 bp, Homo sapiens
aatgtaagcaaatta

SEQ ID NO: 427205 - DNA, 15 bp, Homo sapiens
atgtaagcaaattaa

SEQ ID NO: 427206 - DNA, 15 bp, Homo sapiens
tgtaagcaaattaaa

SEQ ID NO: 427207 - DNA, 15 bp, Homo sapiens
gtaagcaaattaaat

SEQ ID NO: 427208 - DNA, 15 bp, Homo sapiens
taagcaaattaaata

SEQ ID NO: 427209 - DNA, 15 bp, Homo sapiens
aagcaaattaaataa

SEQ ID NO: 427210 - DNA, 15 bp, Homo sapiens
agcaaattaaataac

SEQ ID NO: 427211 - DNA, 15 bp, Homo sapiens
gcaaattaaataaca

SEQ ID NO: 427212 - DNA, 15 bp, Homo sapiens
caaattaaataacac

SEQ ID NO: 427213 - DNA, 15 bp, Homo sapiens
aaattaaataacaca

SEQ ID NO: 427214 - DNA, 15 bp, Homo sapiens
aattaaataacacaa

SEQ ID NO: 427215 - DNA, 15 bp, Homo sapiens
attaaataacacaat

SEQ ID NO: 427216 - DNA, 15 bp, Homo sapiens
ttaaataacacaatg

SEQ ID NO: 427217 - DNA, 15 bp, Homo sapiens
taaataacacaatgg

SEQ ID NO: 427218 - DNA, 15 bp, Homo sapiens
aaataacacaatggc

SEQ ID NO: 427219 - DNA, 15 bp, Homo sapiens
aataacacaatggca

SEQ ID NO: 427220 - DNA, 15 bp, Homo sapiens
ataacacaatggcac

SEQ ID NO: 427221 - DNA, 15 bp, Homo sapiens
taacacaatggcact

SEQ ID NO: 427222 - DNA, 15 bp, Homo sapiens
aacacaatggcactt

SEQ ID NO: 427223 - DNA, 15 bp, Homo sapiens
acacaatggcacttt

SEQ ID NO: 427224 - DNA, 15 bp, Homo sapiens
cacaatggcacttta

SEQ ID NO: 427225 - DNA, 15 bp, Homo sapiens
acaatggcactttat

SEQ ID NO: 427226 - DNA, 15 bp, Homo sapiens
caatggcactttatg

SEQ ID NO: 427227 - DNA, 15 bp, Homo sapiens
aatggcactttatgc

SEQ ID NO: 427228 - DNA, 15 bp, Homo sapiens
atggcactttatgcc

SEQ ID NO: 427229 - DNA, 15 bp, Homo sapiens
tggcactttatgcct

SEQ ID NO: 427230 - DNA, 15 bp, Homo sapiens
ggcactttatgcctt

SEQ ID NO: 427231 - DNA, 15 bp, Homo sapiens
gcactttatgccttg

SEQ ID NO: 427232 - DNA, 15 bp, Homo sapiens
cactttatgccttga

SEQ ID NO: 427233 - DNA, 15 bp, Homo sapiens
actttatgccttgat

SEQ ID NO: 427234 - DNA, 15 bp, Homo sapiens
ctttatgccttgata

SEQ ID NO: 427235 - DNA, 15 bp, Homo sapiens
tttatgccttgatat

SEQ ID NO: 427236 - DNA, 15 bp, Homo sapiens
ttatgccttgatatt

SEQ ID NO: 427237 - DNA, 15 bp, Homo sapiens
tatgccttgatattg

SEQ ID NO: 427238 - DNA, 15 bp, Homo sapiens
atgccttgatattgt

SEQ ID NO: 427239 - DNA, 15 bp, Homo sapiens
tgccttgatattgta

SEQ ID NO: 427240 - DNA, 15 bp, Homo sapiens
gccttgatattgtag

SEQ ID NO: 427241 - DNA, 15 bp, Homo sapiens
ccttgatattgtagt

SEQ ID NO: 427242 - DNA, 15 bp, Homo sapiens
cttgatattgtagtc

SEQ ID NO: 427243 - DNA, 15 bp, Homo sapiens
ttgatattgtagtca

SEQ ID NO: 427244 - DNA, 15 bp, Homo sapiens
tgatattgtagtcag

SEQ ID NO: 427245 - DNA, 15 bp, Homo sapiens
gatattgtagtcagt

SEQ ID NO: 427246 - DNA, 15 bp, Homo sapiens
atattgtagtcagtt

SEQ ID NO: 427247 - DNA, 15 bp, Homo sapiens
tattgtagtcagttc

SEQ ID NO: 427248 - DNA, 15 bp, Homo sapiens
attgtagtcagttca

SEQ ID NO: 427249 - DNA, 15 bp, Homo sapiens
ttgtagtcagttcag

SEQ ID NO: 427250 - DNA, 15 bp, Homo sapiens
tgtagtcagttcaga

SEQ ID NO: 427251 - DNA, 15 bp, Homo sapiens
gtagtcagttcagag

SEQ ID NO: 427252 - DNA, 15 bp, Homo sapiens
tagtcagttcagagg

SEQ ID NO: 427253 - DNA, 15 bp, Homo sapiens
agtcagttcagaggt

SEQ ID NO: 427254 - DNA, 15 bp, Homo sapiens
gtcagttcagaggtt

SEQ ID NO: 427255 - DNA, 15 bp, Homo sapiens
tcagttcagaggtta

SEQ ID NO: 427256 - DNA, 15 bp, Homo sapiens
cagttcagaggttat

SEQ ID NO: 427257 - DNA, 15 bp, Homo sapiens
agttcagaggttatc

SEQ ID NO: 427258 - DNA, 15 bp, Homo sapiens
gttcagaggttatct

SEQ ID NO: 427259 - DNA, 15 bp, Homo sapiens
ttcagaggttatctt

SEQ ID NO: 427260 - DNA, 15 bp, Homo sapiens
tcagaggttatcttt

SEQ ID NO: 427261 - DNA, 15 bp, Homo sapiens
cagaggttatctttt

SEQ ID NO: 427262 - DNA, 15 bp, Homo sapiens
agaggttatcttttc

SEQ ID NO: 427263 - DNA, 15 bp, Homo sapiens
gaggttatcttttct

SEQ ID NO: 427264 - DNA, 15 bp, Homo sapiens
aggttatcttttctc

SEQ ID NO: 427265 - DNA, 15 bp, Homo sapiens
ggttatcttttctct

SEQ ID NO: 427266 - DNA, 15 bp, Homo sapiens
gttatcttttctcta

SEQ ID NO: 427267 - DNA, 15 bp, Homo sapiens
ttatcttttctctat

SEQ ID NO: 427268 - DNA, 15 bp, Homo sapiens
tatcttttctctatc

SEQ ID NO: 427269 - DNA, 15 bp, Homo sapiens
atcttttctctatct

SEQ ID NO: 427270 - DNA, 15 bp, Homo sapiens
tcttttctctatctt

SEQ ID NO: 427271 - DNA, 15 bp, Homo sapiens
cttttctctatctta

SEQ ID NO: 427272 - DNA, 15 bp, Homo sapiens
ttttctctatcttaa

SEQ ID NO: 427273 - DNA, 15 bp, Homo sapiens
tttctctatcttaat

SEQ ID NO: 427274 - DNA, 15 bp, Homo sapiens
ttctctatcttaata

SEQ ID NO: 427275 - DNA, 15 bp, Homo sapiens
tctctatcttaatac

SEQ ID NO: 427276 - DNA, 15 bp, Homo sapiens
ctctatcttaatact

SEQ ID NO: 427277 - DNA, 15 bp, Homo sapiens
tctatcttaatactg

SEQ ID NO: 427278 - DNA, 15 bp, Homo sapiens
ctatcttaatactgc

SEQ ID NO: 427279 - DNA, 15 bp, Homo sapiens
tatcttaatactgcc

SEQ ID NO: 427280 - DNA, 15 bp, Homo sapiens
atcttaatactgcct

SEQ ID NO: 427281 - DNA, 15 bp, Homo sapiens
tcttaatactgccta

SEQ ID NO: 427282 - DNA, 15 bp, Homo sapiens
cttaatactgcctaa

SEQ ID NO: 427283 - DNA, 15 bp, Homo sapiens
ttaatactgcctaaa

SEQ ID NO: 427284 - DNA, 15 bp, Homo sapiens
taatactgcctaaat

SEQ ID NO: 427285 - DNA, 15 bp, Homo sapiens
aatactgcctaaatt

SEQ ID NO: 427286 - DNA, 15 bp, Homo sapiens
atactgcctaaattt

SEQ ID NO: 427287 - DNA, 15 bp, Homo sapiens
tactgcctaaatttt

SEQ ID NO: 427288 - DNA, 15 bp, Homo sapiens
actgcctaaattttc

SEQ ID NO: 427289 - DNA, 15 bp, Homo sapiens
ctgcctaaattttca

SEQ ID NO: 427290 - DNA, 15 bp, Homo sapiens
tgcctaaattttcaa

SEQ ID NO: 427291 - DNA, 15 bp, Homo sapiens
gcctaaattttcaac

SEQ ID NO: 427292 - DNA, 15 bp, Homo sapiens
cctaaattttcaact

SEQ ID NO: 427293 - DNA, 15 bp, Homo sapiens
ctaaattttcaactc

SEQ ID NO: 427294 - DNA, 15 bp, Homo sapiens
taaattttcaactca

SEQ ID NO: 427295 - DNA, 15 bp, Homo sapiens
aaattttcaactcaa

SEQ ID NO: 427296 - DNA, 15 bp, Homo sapiens
aattttcaactcaag

SEQ ID NO: 427297 - DNA, 15 bp, Homo sapiens
attttcaactcaaga

SEQ ID NO: 427298 - DNA, 15 bp, Homo sapiens
ttttcaactcaagaa

SEQ ID NO: 427299 - DNA, 15 bp, Homo sapiens
tttcaactcaagaat

SEQ ID NO: 427300 - DNA, 15 bp, Homo sapiens
ttcaactcaagaatg

SEQ ID NO: 427301 - DNA, 15 bp, Homo sapiens
tcaactcaagaatgg

SEQ ID NO: 427302 - DNA, 15 bp, Homo sapiens
caactcaagaatggg

SEQ ID NO: 427303 - DNA, 15 bp, Homo sapiens
aactcaagaatggga

SEQ ID NO: 427304 - DNA, 15 bp, Homo sapiens
actcaagaatgggaa

SEQ ID NO: 427305 - DNA, 15 bp, Homo sapiens
ctcaagaatgggaaa

SEQ ID NO: 427306 - DNA, 15 bp, Homo sapiens
tcaagaatgggaaag

SEQ ID NO: 427307 - DNA, 15 bp, Homo sapiens
caagaatgggaaaga

SEQ ID NO: 427308 - DNA, 15 bp, Homo sapiens
aagaatgggaaagat

SEQ ID NO: 427309 - DNA, 15 bp, Homo sapiens
agaatgggaaagatt

SEQ ID NO: 427310 - DNA, 15 bp, Homo sapiens
gaatgggaaagattt

SEQ ID NO: 427311 - DNA, 15 bp, Homo sapiens
aatgggaaagatttt

SEQ ID NO: 427312 - DNA, 15 bp, Homo sapiens
atgggaaagattttt

SEQ ID NO: 427313 - DNA, 15 bp, Homo sapiens
tgggaaagattttta

SEQ ID NO: 427314 - DNA, 15 bp, Homo sapiens
gggaaagatttttat

SEQ ID NO: 427315 - DNA, 15 bp, Homo sapiens
ggaaagatttttatt

SEQ ID NO: 427316 - DNA, 15 bp, Homo sapiens
gaaagatttttattt

SEQ ID NO: 427317 - DNA, 15 bp, Homo sapiens
aaagatttttattta

SEQ ID NO: 427318 - DNA, 15 bp, Homo sapiens
aagatttttatttaa

SEQ ID NO: 427319 - DNA, 15 bp, Homo sapiens
agatttttatttaag

SEQ ID NO: 427320 - DNA, 15 bp, Homo sapiens
gatttttatttaagg

SEQ ID NO: 427321 - DNA, 15 bp, Homo sapiens
atttttatttaaggg

SEQ ID NO: 427322 - DNA, 15 bp, Homo sapiens
tttttatttaaggga

SEQ ID NO: 427323 - DNA, 15 bp, Homo sapiens
ttttatttaagggaa

SEQ ID NO: 427324 - DNA, 15 bp, Homo sapiens
tttatttaagggaaa

SEQ ID NO: 427325 - DNA, 15 bp, Homo sapiens
ttatttaagggaaaa

SEQ ID NO: 427326 - DNA, 15 bp, Homo sapiens
tatttaagggaaaat

SEQ ID NO: 427327 - DNA, 15 bp, Homo sapiens
atttaagggaaaatg

SEQ ID NO: 427328 - DNA, 15 bp, Homo sapiens
tttaagggaaaatga

SEQ ID NO: 427329 - DNA, 15 bp, Homo sapiens
ttaagggaaaatgaa

SEQ ID NO: 427330 - DNA, 15 bp, Homo sapiens
taagggaaaatgaat

SEQ ID NO: 427331 - DNA, 15 bp, Homo sapiens
aagggaaaatgaatt

SEQ ID NO: 427332 - DNA, 15 bp, Homo sapiens
agggaaaatgaattg

SEQ ID NO: 427333 - DNA, 15 bp, Homo sapiens
gggaaaatgaattgg

SEQ ID NO: 427334 - DNA, 15 bp, Homo sapiens
ggaaaatgaattggc

SEQ ID NO: 427335 - DNA, 15 bp, Homo sapiens
gaaaatgaattggca

SEQ ID NO: 427336 - DNA, 15 bp, Homo sapiens
aaaatgaattggcat

SEQ ID NO: 427337 - DNA, 15 bp, Homo sapiens
aaatgaattggcata

SEQ ID NO: 427338 - DNA, 15 bp, Homo sapiens
aatgaattggcatac

SEQ ID NO: 427339 - DNA, 15 bp, Homo sapiens
atgaattggcatacc

SEQ ID NO: 427340 - DNA, 15 bp, Homo sapiens
tgaattggcatacct

SEQ ID NO: 427341 - DNA, 15 bp, Homo sapiens
gaattggcatacctt

SEQ ID NO: 427342 - DNA, 15 bp, Homo sapiens
aattggcataccttt

SEQ ID NO: 427343 - DNA, 15 bp, Homo sapiens
attggcataccttta

SEQ ID NO: 427344 - DNA, 15 bp, Homo sapiens
ttggcatacctttaa

SEQ ID NO: 427345 - DNA, 15 bp, Homo sapiens
tggcatacctttaat

SEQ ID NO: 427346 - DNA, 15 bp, Homo sapiens
ggcatacctttaatt

SEQ ID NO: 427347 - DNA, 15 bp, Homo sapiens
gcatacctttaattg

SEQ ID NO: 427348 - DNA, 15 bp, Homo sapiens
catacctttaattgt

SEQ ID NO: 427349 - DNA, 15 bp, Homo sapiens
atacctttaattgtt

SEQ ID NO: 427350 - DNA, 15 bp, Homo sapiens
tacctttaattgttg

SEQ ID NO: 427351 - DNA, 15 bp, Homo sapiens
acctttaattgttga

SEQ ID NO: 427352 - DNA, 15 bp, Homo sapiens
cctttaattgttgag

SEQ ID NO: 427353 - DNA, 15 bp, Homo sapiens
ctttaattgttgaga

SEQ ID NO: 427354 - DNA, 15 bp, Homo sapiens
tttaattgttgagat

SEQ ID NO: 427355 - DNA, 15 bp, Homo sapiens
ttaattgttgagata

SEQ ID NO: 427356 - DNA, 15 bp, Homo sapiens
taattgttgagatag

SEQ ID NO: 427357 - DNA, 15 bp, Homo sapiens
aattgttgagatagc

SEQ ID NO: 427358 - DNA, 15 bp, Homo sapiens
attgttgagatagct

SEQ ID NO: 427359 - DNA, 15 bp, Homo sapiens
ttgttgagatagctt

SEQ ID NO: 427360 - DNA, 15 bp, Homo sapiens
tgttgagatagcttt

SEQ ID NO: 427361 - DNA, 15 bp, Homo sapiens
gttgagatagctttt

SEQ ID NO: 427362 - DNA, 15 bp, Homo sapiens
ttgagatagctttta

SEQ ID NO: 427363 - DNA, 15 bp, Homo sapiens
tgagatagcttttaa

SEQ ID NO: 427364 - DNA, 15 bp, Homo sapiens
gagatagcttttaaa

SEQ ID NO: 427365 - DNA, 15 bp, Homo sapiens
agatagcttttaaaa

SEQ ID NO: 427366 - DNA, 15 bp, Homo sapiens
gatagcttttaaaat

SEQ ID NO: 427367 - DNA, 15 bp, Homo sapiens
atagcttttaaaata

SEQ ID NO: 427368 - DNA, 15 bp, Homo sapiens
tagcttttaaaatat

SEQ ID NO: 427369 - DNA, 15 bp, Homo sapiens
agcttttaaaatata

SEQ ID NO: 427370 - DNA, 15 bp, Homo sapiens
gcttttaaaatatag

SEQ ID NO: 427371 - DNA, 15 bp, Homo sapiens
cttttaaaatatagc

SEQ ID NO: 427372 - DNA, 15 bp, Homo sapiens
ttttaaaatatagct

SEQ ID NO: 427373 - DNA, 15 bp, Homo sapiens
tttaaaatatagctt

SEQ ID NO: 427374 - DNA, 15 bp, Homo sapiens
ttaaaatatagcttt

SEQ ID NO: 427375 - DNA, 15 bp, Homo sapiens
taaaatatagctttt

SEQ ID NO: 427376 - DNA, 15 bp, Homo sapiens
aaaatatagcttttt

SEQ ID NO: 427377 - DNA, 15 bp, Homo sapiens
aaatatagctttttt

SEQ ID NO: 427378 - DNA, 15 bp, Homo sapiens
aatatagcttttttt

SEQ ID NO: 427379 - DNA, 15 bp, Homo sapiens
atatagctttttttt

SEQ ID NO: 427380 - DNA, 15 bp, Homo sapiens
tatagcttttttttt

SEQ ID NO: 427381 - DNA, 15 bp, Homo sapiens
atagctttttttttt

SEQ ID NO: 427382 - DNA, 15 bp, Homo sapiens
tagcttttttttttt

SEQ ID NO: 427383 - DNA, 15 bp, Homo sapiens
tttttttttagctgt

SEQ ID NO: 427384 - DNA, 15 bp, Homo sapiens
ttttttttagctgta

SEQ ID NO: 427385 - DNA, 15 bp, Homo sapiens
tttttttagctgtat

SEQ ID NO: 427386 - DNA, 15 bp, Homo sapiens
ttttttagctgtatg

SEQ ID NO: 427387 - DNA, 15 bp, Homo sapiens
tttttagctgtatgt

SEQ ID NO: 427388 - DNA, 15 bp, Homo sapiens
ttttagctgtatgtg

SEQ ID NO: 427389 - DNA, 15 bp, Homo sapiens
tttagctgtatgtgc

SEQ ID NO: 427390 - DNA, 15 bp, Homo sapiens
ttagctgtatgtgct

SEQ ID NO: 427391 - DNA, 15 bp, Homo sapiens
tagctgtatgtgctg

SEQ ID NO: 427392 - DNA, 15 bp, Homo sapiens
agctgtatgtgctgg

SEQ ID NO: 427393 - DNA, 15 bp, Homo sapiens
gctgtatgtgctgga

SEQ ID NO: 427394 - DNA, 15 bp, Homo sapiens
ctgtatgtgctggat

SEQ ID NO: 427395 - DNA, 15 bp, Homo sapiens
tgtatgtgctggata

SEQ ID NO: 427396 - DNA, 15 bp, Homo sapiens
gtatgtgctggatat

SEQ ID NO: 427397 - DNA, 15 bp, Homo sapiens
tatgtgctggatatt

SEQ ID NO: 427398 - DNA, 15 bp, Homo sapiens
atgtgctggatattg

SEQ ID NO: 427399 - DNA, 15 bp, Homo sapiens
tgtgctggatattgc

SEQ ID NO: 427400 - DNA, 15 bp, Homo sapiens
gtgctggatattgct

SEQ ID NO: 427401 - DNA, 15 bp, Homo sapiens
tgctggatattgcta

SEQ ID NO: 427402 - DNA, 15 bp, Homo sapiens
gctggatattgctag

SEQ ID NO: 427403 - DNA, 15 bp, Homo sapiens
ctggatattgctaga

SEQ ID NO: 427404 - DNA, 15 bp, Homo sapiens
tggatattgctagat

SEQ ID NO: 427405 - DNA, 15 bp, Homo sapiens
ggatattgctagatt

SEQ ID NO: 427406 - DNA, 15 bp, Homo sapiens
gatattgctagattc

SEQ ID NO: 427407 - DNA, 15 bp, Homo sapiens
atattgctagattct

SEQ ID NO: 427408 - DNA, 15 bp, Homo sapiens
tattgctagattctt

SEQ ID NO: 427409 - DNA, 15 bp, Homo sapiens
attgctagattcttc

SEQ ID NO: 427410 - DNA, 15 bp, Homo sapiens
ttgctagattcttcc

SEQ ID NO: 427411 - DNA, 15 bp, Homo sapiens
tgctagattcttcca

SEQ ID NO: 427412 - DNA, 15 bp, Homo sapiens
gctagattcttccag

SEQ ID NO: 427413 - DNA, 15 bp, Homo sapiens
ctagattcttccagt

SEQ ID NO: 427414 - DNA, 15 bp, Homo sapiens
tagattcttccagtg

SEQ ID NO: 427415 - DNA, 15 bp, Homo sapiens
agattcttccagtgt

SEQ ID NO: 427416 - DNA, 15 bp, Homo sapiens
gattcttccagtgtt

SEQ ID NO: 427417 - DNA, 15 bp, Homo sapiens
attcttccagtgttt

SEQ ID NO: 427418 - DNA, 15 bp, Homo sapiens
ttcttccagtgtttg

SEQ ID NO: 427419 - DNA, 15 bp, Homo sapiens
tcttccagtgtttgt

SEQ ID NO: 427420 - DNA, 15 bp, Homo sapiens
cttccagtgtttgtg

SEQ ID NO: 427421 - DNA, 15 bp, Homo sapiens
ttccagtgtttgtgc

SEQ ID NO: 427422 - DNA, 15 bp, Homo sapiens
tccagtgtttgtgct

SEQ ID NO: 427423 - DNA, 15 bp, Homo sapiens
ccagtgtttgtgctt

SEQ ID NO: 427424 - DNA, 15 bp, Homo sapiens
cagtgtttgtgcttc

SEQ ID NO: 427425 - DNA, 15 bp, Homo sapiens
agtgtttgtgcttct

SEQ ID NO: 427426 - DNA, 15 bp, Homo sapiens
gtgtttgtgcttctc

SEQ ID NO: 427427 - DNA, 15 bp, Homo sapiens
tgtttgtgcttctct

SEQ ID NO: 427428 - DNA, 15 bp, Homo sapiens
gtttgtgcttctctc

SEQ ID NO: 427429 - DNA, 15 bp, Homo sapiens
tttgtgcttctctct

SEQ ID NO: 427430 - DNA, 15 bp, Homo sapiens
ttgtgcttctctctg

SEQ ID NO: 427431 - DNA, 15 bp, Homo sapiens
tgtgcttctctctgt

SEQ ID NO: 427432 - DNA, 15 bp, Homo sapiens
gtgcttctctctgtt

SEQ ID NO: 427433 - DNA, 15 bp, Homo sapiens
tgcttctctctgttg

SEQ ID NO: 427434 - DNA, 15 bp, Homo sapiens
gcttctctctgttgt

SEQ ID NO: 427435 - DNA, 15 bp, Homo sapiens
cttctctctgttgta

SEQ ID NO: 427436 - DNA, 15 bp, Homo sapiens
ttctctctgttgtag

SEQ ID NO: 427437 - DNA, 15 bp, Homo sapiens
tctctctgttgtagg

SEQ ID NO: 427438 - DNA, 15 bp, Homo sapiens
ctctctgttgtagga

SEQ ID NO: 427439 - DNA, 15 bp, Homo sapiens
tctctgttgtaggaa

SEQ ID NO: 427440 - DNA, 15 bp, Homo sapiens
ctctgttgtaggaat

SEQ ID NO: 427441 - DNA, 15 bp, Homo sapiens
tctgttgtaggaatt

SEQ ID NO: 427442 - DNA, 15 bp, Homo sapiens
ctgttgtaggaattt

SEQ ID NO: 427443 - DNA, 15 bp, Homo sapiens
tgttgtaggaatttg

SEQ ID NO: 427444 - DNA, 15 bp, Homo sapiens
gttgtaggaatttga

SEQ ID NO: 427445 - DNA, 15 bp, Homo sapiens
ttgtaggaatttgat

SEQ ID NO: 427446 - DNA, 15 bp, Homo sapiens
tgtaggaatttgata

SEQ ID NO: 427447 - DNA, 15 bp, Homo sapiens
gtaggaatttgatac

SEQ ID NO: 427448 - DNA, 15 bp, Homo sapiens
taggaatttgatacc

SEQ ID NO: 427449 - DNA, 15 bp, Homo sapiens
aggaatttgatacct

SEQ ID NO: 427450 - DNA, 15 bp, Homo sapiens
ggaatttgatacctt

SEQ ID NO: 427451 - DNA, 15 bp, Homo sapiens
gaatttgataccttt

SEQ ID NO: 427452 - DNA, 15 bp, Homo sapiens
aatttgatacctttg

SEQ ID NO: 427453 - DNA, 15 bp, Homo sapiens
atttgatacctttga

SEQ ID NO: 427454 - DNA, 15 bp, Homo sapiens
tttgatacctttgaa

SEQ ID NO: 427455 - DNA, 15 bp, Homo sapiens
ttgatacctttgaat

SEQ ID NO: 427456 - DNA, 15 bp, Homo sapiens
tgatacctttgaatg

SEQ ID NO: 427457 - DNA, 15 bp, Homo sapiens
gatacctttgaatgc

SEQ ID NO: 427458 - DNA, 15 bp, Homo sapiens
atacctttgaatgct

SEQ ID NO: 427459 - DNA, 15 bp, Homo sapiens
tacctttgaatgcta

SEQ ID NO: 427460 - DNA, 15 bp, Homo sapiens
acctttgaatgctag

SEQ ID NO: 427461 - DNA, 15 bp, Homo sapiens
cctttgaatgctagt

SEQ ID NO: 427462 - DNA, 15 bp, Homo sapiens
ctttgaatgctagtt

SEQ ID NO: 427463 - DNA, 15 bp, Homo sapiens
tttgaatgctagttg

SEQ ID NO: 427464 - DNA, 15 bp, Homo sapiens
ttgaatgctagttga

SEQ ID NO: 427465 - DNA, 15 bp, Homo sapiens
tgaatgctagttgag

SEQ ID NO: 427466 - DNA, 15 bp, Homo sapiens
gaatgctagttgagt

SEQ ID NO: 427467 - DNA, 15 bp, Homo sapiens
aatgctagttgagtt

SEQ ID NO: 427468 - DNA, 15 bp, Homo sapiens
atgctagttgagttg

SEQ ID NO: 427469 - DNA, 15 bp, Homo sapiens
tgctagttgagttga

SEQ ID NO: 427470 - DNA, 15 bp, Homo sapiens
gctagttgagttgag

SEQ ID NO: 427471 - DNA, 15 bp, Homo sapiens
ctagttgagttgaga

SEQ ID NO: 427472 - DNA, 15 bp, Homo sapiens
tagttgagttgagat

SEQ ID NO: 427473 - DNA, 15 bp, Homo sapiens
agttgagttgagatt

SEQ ID NO: 427474 - DNA, 15 bp, Homo sapiens
gttgagttgagattc

SEQ ID NO: 427475 - DNA, 15 bp, Homo sapiens
ttgagttgagattct

SEQ ID NO: 427476 - DNA, 15 bp, Homo sapiens
tgagttgagattctt

SEQ ID NO: 427477 - DNA, 15 bp, Homo sapiens
gagttgagattctta

SEQ ID NO: 427478 - DNA, 15 bp, Homo sapiens
agttgagattcttaa

SEQ ID NO: 427479 - DNA, 15 bp, Homo sapiens
gttgagattcttaac

SEQ ID NO: 427480 - DNA, 15 bp, Homo sapiens
ttgagattcttaaca

SEQ ID NO: 427481 - DNA, 15 bp, Homo sapiens
tgagattcttaacaa

SEQ ID NO: 427482 - DNA, 15 bp, Homo sapiens
gagattcttaacaaa

SEQ ID NO: 427483 - DNA, 15 bp, Homo sapiens
agattcttaacaaat

SEQ ID NO: 427484 - DNA, 15 bp, Homo sapiens
gattcttaacaaatg

SEQ ID NO: 427485 - DNA, 15 bp, Homo sapiens
attcttaacaaatgc

SEQ ID NO: 427486 - DNA, 15 bp, Homo sapiens
ttcttaacaaatgca

SEQ ID NO: 427487 - DNA, 15 bp, Homo sapiens
tcttaacaaatgcag

SEQ ID NO: 427488 - DNA, 15 bp, Homo sapiens
cttaacaaatgcagg

SEQ ID NO: 427489 - DNA, 15 bp, Homo sapiens
ttaacaaatgcaggg

SEQ ID NO: 427490 - DNA, 15 bp, Homo sapiens
taacaaatgcaggga

SEQ ID NO: 427491 - DNA, 15 bp, Homo sapiens
aacaaatgcagggag

SEQ ID NO: 427492 - DNA, 15 bp, Homo sapiens
acaaatgcagggaga

SEQ ID NO: 427493 - DNA, 15 bp, Homo sapiens
caaatgcagggagaa

SEQ ID NO: 427494 - DNA, 15 bp, Homo sapiens
aaatgcagggagaag

SEQ ID NO: 427495 - DNA, 15 bp, Homo sapiens
aatgcagggagaagc

SEQ ID NO: 427496 - DNA, 15 bp, Homo sapiens
atgcagggagaagct

SEQ ID NO: 427497 - DNA, 15 bp, Homo sapiens
tgcagggagaagctt

SEQ ID NO: 427498 - DNA, 15 bp, Homo sapiens
gcagggagaagctta

SEQ ID NO: 427499 - DNA, 15 bp, Homo sapiens
cagggagaagcttaa

SEQ ID NO: 427500 - DNA, 15 bp, Homo sapiens
agggagaagcttaaa

SEQ ID NO: 427501 - DNA, 15 bp, Homo sapiens
gggagaagcttaaac

SEQ ID NO: 427502 - DNA, 15 bp, Homo sapiens
ggagaagcttaaaca

SEQ ID NO: 427503 - DNA, 15 bp, Homo sapiens
gagaagcttaaacat

SEQ ID NO: 427504 - DNA, 15 bp, Homo sapiens
agaagcttaaacatg

SEQ ID NO: 427505 - DNA, 15 bp, Homo sapiens
gaagcttaaacatgt

SEQ ID NO: 427506 - DNA, 15 bp, Homo sapiens
aagcttaaacatgtg

SEQ ID NO: 427507 - DNA, 15 bp, Homo sapiens
agcttaaacatgtgg

SEQ ID NO: 427508 - DNA, 15 bp, Homo sapiens
gcttaaacatgtgga

SEQ ID NO: 427509 - DNA, 15 bp, Homo sapiens
cttaaacatgtggag

SEQ ID NO: 427510 - DNA, 15 bp, Homo sapiens
ttaaacatgtggagt

SEQ ID NO: 427511 - DNA, 15 bp, Homo sapiens
taaacatgtggagtc

SEQ ID NO: 427512 - DNA, 15 bp, Homo sapiens
aaacatgtggagtct

SEQ ID NO: 427513 - DNA, 15 bp, Homo sapiens
aacatgtggagtctc

SEQ ID NO: 427514 - DNA, 15 bp, Homo sapiens
acatgtggagtctct

SEQ ID NO: 427515 - DNA, 15 bp, Homo sapiens
catgtggagtctctc

SEQ ID NO: 427516 - DNA, 15 bp, Homo sapiens
atgtggagtctctca

SEQ ID NO: 427517 - DNA, 15 bp, Homo sapiens
tgtggagtctctcat

SEQ ID NO: 427518 - DNA, 15 bp, Homo sapiens
gtggagtctctcatt

SEQ ID NO: 427519 - DNA, 15 bp, Homo sapiens
tggagtctctcattc

SEQ ID NO: 427520 - DNA, 15 bp, Homo sapiens
ggagtctctcattca

SEQ ID NO: 427521 - DNA, 15 bp, Homo sapiens
gagtctctcattcag

SEQ ID NO: 427522 - DNA, 15 bp, Homo sapiens
agtctctcattcagt

SEQ ID NO: 427523 - DNA, 15 bp, Homo sapiens
gtctctcattcagtg

SEQ ID NO: 427524 - DNA, 15 bp, Homo sapiens
tctctcattcagtga

SEQ ID NO: 427525 - DNA, 15 bp, Homo sapiens
ctctcattcagtgac

SEQ ID NO: 427526 - DNA, 15 bp, Homo sapiens
tctcattcagtgact

SEQ ID NO: 427527 - DNA, 15 bp, Homo sapiens
ctcattcagtgacta

SEQ ID NO: 427528 - DNA, 15 bp, Homo sapiens
tcattcagtgactat

SEQ ID NO: 427529 - DNA, 15 bp, Homo sapiens
cattcagtgactatg

SEQ ID NO: 427530 - DNA, 15 bp, Homo sapiens
attcagtgactatgt

SEQ ID NO: 427531 - DNA, 15 bp, Homo sapiens
ttcagtgactatgtt

SEQ ID NO: 427532 - DNA, 15 bp, Homo sapiens
tcagtgactatgttg

SEQ ID NO: 427533 - DNA, 15 bp, Homo sapiens
cagtgactatgttgt

SEQ ID NO: 427534 - DNA, 15 bp, Homo sapiens
agtgactatgttgtc

SEQ ID NO: 427535 - DNA, 15 bp, Homo sapiens
gtgactatgttgtca

SEQ ID NO: 427536 - DNA, 15 bp, Homo sapiens
tgactatgttgtcat

SEQ ID NO: 427537 - DNA, 15 bp, Homo sapiens
gactatgttgtcatg

SEQ ID NO: 427538 - DNA, 15 bp, Homo sapiens
actatgttgtcatgc

SEQ ID NO: 427539 - DNA, 15 bp, Homo sapiens
ctatgttgtcatgca

SEQ ID NO: 427540 - DNA, 15 bp, Homo sapiens
tatgttgtcatgcat

SEQ ID NO: 427541 - DNA, 15 bp, Homo sapiens
atgttgtcatgcatt

SEQ ID NO: 427542 - DNA, 15 bp, Homo sapiens
tgttgtcatgcatta

SEQ ID NO: 427543 - DNA, 15 bp, Homo sapiens
gttgtcatgcattat

SEQ ID NO: 427544 - DNA, 15 bp, Homo sapiens
ttgtcatgcattata

SEQ ID NO: 427545 - DNA, 15 bp, Homo sapiens
tgtcatgcattatat

SEQ ID NO: 427546 - DNA, 15 bp, Homo sapiens
gtcatgcattatatt

SEQ ID NO: 427547 - DNA, 15 bp, Homo sapiens
tcatgcattatattt

SEQ ID NO: 427548 - DNA, 15 bp, Homo sapiens
catgcattatatttt

SEQ ID NO: 427549 - DNA, 15 bp, Homo sapiens
atgcattatatttta

SEQ ID NO: 427550 - DNA, 15 bp, Homo sapiens
tgcattatattttat

SEQ ID NO: 427551 - DNA, 15 bp, Homo sapiens
gcattatattttata

SEQ ID NO: 427552 - DNA, 15 bp, Homo sapiens
cattatattttataa

SEQ ID NO: 427553 - DNA, 15 bp, Homo sapiens
attatattttataaa

SEQ ID NO: 427554 - DNA, 15 bp, Homo sapiens
ttatattttataaat

SEQ ID NO: 427555 - DNA, 15 bp, Homo sapiens
atattttataaataa

SEQ ID NO: 427556 - DNA, 15 bp, Homo sapiens
tattttataaataaa

SEQ ID NO: 427557 - DNA, 15 bp, Homo sapiens
attttataaataaat

SEQ ID NO: 427558 - DNA, 15 bp, Homo sapiens
ttttataaataaata

SEQ ID NO: 427559 - DNA, 15 bp, Homo sapiens
tttataaataaatat

SEQ ID NO: 427560 - DNA, 15 bp, Homo sapiens
ttataaataaatata

SEQ ID NO: 427561 - DNA, 15 bp, Homo sapiens
tataaataaatatag

SEQ ID NO: 427562 - DNA, 15 bp, Homo sapiens
ataaataaatatagc

SEQ ID NO: 427563 - DNA, 15 bp, Homo sapiens
taaataaatatagcc

SEQ ID NO: 427564 - DNA, 15 bp, Homo sapiens
aaataaatatagccc

SEQ ID NO: 427565 - DNA, 15 bp, Homo sapiens
aataaatatagcccc

SEQ ID NO: 427566 - DNA, 15 bp, Homo sapiens
ataaatatagcccca

SEQ ID NO: 427567 - DNA, 15 bp, Homo sapiens
taaatatagccccaa

SEQ ID NO: 427568 - DNA, 15 bp, Homo sapiens
aaatatagccccaag

SEQ ID NO: 427569 - DNA, 15 bp, Homo sapiens
aatatagccccaagt

SEQ ID NO: 427570 - DNA, 15 bp, Homo sapiens
atatagccccaagtc

SEQ ID NO: 427571 - DNA, 15 bp, Homo sapiens
tatagccccaagtca

SEQ ID NO: 427572 - DNA, 15 bp, Homo sapiens
atagccccaagtcat

SEQ ID NO: 427573 - DNA, 15 bp, Homo sapiens
tagccccaagtcatt

SEQ ID NO: 427574 - DNA, 15 bp, Homo sapiens
agccccaagtcattg

SEQ ID NO: 427575 - DNA, 15 bp, Homo sapiens
gccccaagtcattga

SEQ ID NO: 427576 - DNA, 15 bp, Homo sapiens
ccccaagtcattgaa

SEQ ID NO: 427577 - DNA, 15 bp, Homo sapiens
cccaagtcattgaag

SEQ ID NO: 427578 - DNA, 15 bp, Homo sapiens
ccaagtcattgaagc

SEQ ID NO: 427579 - DNA, 15 bp, Homo sapiens
caagtcattgaagca

SEQ ID NO: 427580 - DNA, 15 bp, Homo sapiens
aagtcattgaagcaa

SEQ ID NO: 427581 - DNA, 15 bp, Homo sapiens
agtcattgaagcaaa

SEQ ID NO: 427582 - DNA, 15 bp, Homo sapiens
gtcattgaagcaaaa

SEQ ID NO: 427583 - DNA, 15 bp, Homo sapiens
tcattgaagcaaaat

SEQ ID NO: 427584 - DNA, 15 bp, Homo sapiens
cattgaagcaaaata

SEQ ID NO: 427585 - DNA, 15 bp, Homo sapiens
attgaagcaaaatat

SEQ ID NO: 427586 - DNA, 15 bp, Homo sapiens
ttgaagcaaaatata

SEQ ID NO: 427587 - DNA, 15 bp, Homo sapiens
tgaagcaaaatataa

SEQ ID NO: 427588 - DNA, 15 bp, Homo sapiens
gaagcaaaatataaa

SEQ ID NO: 427589 - DNA, 15 bp, Homo sapiens
aagcaaaatataaag

SEQ ID NO: 427590 - DNA, 15 bp, Homo sapiens
agcaaaatataaagg

SEQ ID NO: 427591 - DNA, 15 bp, Homo sapiens
gcaaaatataaaggg

SEQ ID NO: 427592 - DNA, 15 bp, Homo sapiens
caaaatataaaggga

SEQ ID NO: 427593 - DNA, 15 bp, Homo sapiens
aaaatataaagggaa

SEQ ID NO: 427594 - DNA, 15 bp, Homo sapiens
aaatataaagggaaa

SEQ ID NO: 427595 - DNA, 15 bp, Homo sapiens
aatataaagggaaag

SEQ ID NO: 427596 - DNA, 15 bp, Homo sapiens
atataaagggaaagt

SEQ ID NO: 427597 - DNA, 15 bp, Homo sapiens
tataaagggaaagtt

SEQ ID NO: 427598 - DNA, 15 bp, Homo sapiens
ataaagggaaagttt

SEQ ID NO: 427599 - DNA, 15 bp, Homo sapiens
taaagggaaagtttt

SEQ ID NO: 427600 - DNA, 15 bp, Homo sapiens
aaagggaaagtttta

SEQ ID NO: 427601 - DNA, 15 bp, Homo sapiens
aagggaaagttttat

SEQ ID NO: 427602 - DNA, 15 bp, Homo sapiens
agggaaagttttata

SEQ ID NO: 427603 - DNA, 15 bp, Homo sapiens
gggaaagttttataa

SEQ ID NO: 427604 - DNA, 15 bp, Homo sapiens
ggaaagttttataat

SEQ ID NO: 427605 - DNA, 15 bp, Homo sapiens
gaaagttttataatt

SEQ ID NO: 427606 - DNA, 15 bp, Homo sapiens
aaagttttataattg

SEQ ID NO: 427607 - DNA, 15 bp, Homo sapiens
aagttttataattgt

SEQ ID NO: 427608 - DNA, 15 bp, Homo sapiens
agttttataattgtt

SEQ ID NO: 427609 - DNA, 15 bp, Homo sapiens
gttttataattgtta

SEQ ID NO: 427610 - DNA, 15 bp, Homo sapiens
ttttataattgttac

SEQ ID NO: 427611 - DNA, 15 bp, Homo sapiens
tttataattgttaca

SEQ ID NO: 427612 - DNA, 15 bp, Homo sapiens
ttataattgttacaa

SEQ ID NO: 427613 - DNA, 15 bp, Homo sapiens
tataattgttacaaa

SEQ ID NO: 427614 - DNA, 15 bp, Homo sapiens
ataattgttacaaat

SEQ ID NO: 427615 - DNA, 15 bp, Homo sapiens
taattgttacaaata

SEQ ID NO: 427616 - DNA, 15 bp, Homo sapiens
aattgttacaaatac

SEQ ID NO: 427617 - DNA, 15 bp, Homo sapiens
attgttacaaataca

SEQ ID NO: 427618 - DNA, 15 bp, Homo sapiens
ttgttacaaatacaa

SEQ ID NO: 427619 - DNA, 15 bp, Homo sapiens
tgttacaaatacaaa

SEQ ID NO: 427620 - DNA, 15 bp, Homo sapiens
gttacaaatacaaaa

SEQ ID NO: 427621 - DNA, 15 bp, Homo sapiens
ttacaaatacaaaaa

SEQ ID NO: 427622 - DNA, 15 bp, Homo sapiens
tacaaatacaaaaaa

SEQ ID NO: 427623 - DNA, 15 bp, Homo sapiens
acaaatacaaaaaat

SEQ ID NO: 427624 - DNA, 15 bp, Homo sapiens
caaatacaaaaaatg

SEQ ID NO: 427625 - DNA, 15 bp, Homo sapiens
aaatacaaaaaatgg

SEQ ID NO: 427626 - DNA, 15 bp, Homo sapiens
aatacaaaaaatggg

SEQ ID NO: 427627 - DNA, 15 bp, Homo sapiens
atacaaaaaatgggc

SEQ ID NO: 427628 - DNA, 15 bp, Homo sapiens
tacaaaaaatgggct

SEQ ID NO: 427629 - DNA, 15 bp, Homo sapiens
acaaaaaatgggctt

SEQ ID NO: 427630 - DNA, 15 bp, Homo sapiens
caaaaaatgggcttc

SEQ ID NO: 427631 - DNA, 15 bp, Homo sapiens
aaaaaatgggcttct

SEQ ID NO: 427632 - DNA, 15 bp, Homo sapiens
aaaaatgggcttcta

SEQ ID NO: 427633 - DNA, 15 bp, Homo sapiens
aaaatgggcttctaa

SEQ ID NO: 427634 - DNA, 15 bp, Homo sapiens
aaatgggcttctaaa

SEQ ID NO: 427635 - DNA, 15 bp, Homo sapiens
aatgggcttctaaac

SEQ ID NO: 427636 - DNA, 15 bp, Homo sapiens
atgggcttctaaaca

SEQ ID NO: 427637 - DNA, 15 bp, Homo sapiens
tgggcttctaaacac

SEQ ID NO: 427638 - DNA, 15 bp, Homo sapiens
gggcttctaaacaca

SEQ ID NO: 427639 - DNA, 15 bp, Homo sapiens
ggcttctaaacacat

SEQ ID NO: 427640 - DNA, 15 bp, Homo sapiens
gcttctaaacacatt

SEQ ID NO: 427641 - DNA, 15 bp, Homo sapiens
cttctaaacacattt

SEQ ID NO: 427642 - DNA, 15 bp, Homo sapiens
ttctaaacacatttg

SEQ ID NO: 427643 - DNA, 15 bp, Homo sapiens
tctaaacacatttgt

SEQ ID NO: 427644 - DNA, 15 bp, Homo sapiens
ctaaacacatttgta

SEQ ID NO: 427645 - DNA, 15 bp, Homo sapiens
taaacacatttgtaa

SEQ ID NO: 427646 - DNA, 15 bp, Homo sapiens
aaacacatttgtaat

SEQ ID NO: 427647 - DNA, 15 bp, Homo sapiens
aacacatttgtaatt

SEQ ID NO: 427648 - DNA, 15 bp, Homo sapiens
acacatttgtaattc

SEQ ID NO: 427649 - DNA, 15 bp, Homo sapiens
cacatttgtaattct

SEQ ID NO: 427650 - DNA, 15 bp, Homo sapiens
acatttgtaattctt

SEQ ID NO: 427651 - DNA, 15 bp, Homo sapiens
catttgtaattcttc

SEQ ID NO: 427652 - DNA, 15 bp, Homo sapiens
atttgtaattcttca

SEQ ID NO: 427653 - DNA, 15 bp, Homo sapiens
tttgtaattcttcat

SEQ ID NO: 427654 - DNA, 15 bp, Homo sapiens
ttgtaattcttcata

SEQ ID NO: 427655 - DNA, 15 bp, Homo sapiens
tgtaattcttcataa

SEQ ID NO: 427656 - DNA, 15 bp, Homo sapiens
gtaattcttcataat

SEQ ID NO: 427657 - DNA, 15 bp, Homo sapiens
taattcttcataatg

SEQ ID NO: 427658 - DNA, 15 bp, Homo sapiens
aattcttcataatgc

SEQ ID NO: 427659 - DNA, 15 bp, Homo sapiens
attcttcataatgct

SEQ ID NO: 427660 - DNA, 15 bp, Homo sapiens
ttcttcataatgctg

SEQ ID NO: 427661 - DNA, 15 bp, Homo sapiens
tcttcataatgctgt

SEQ ID NO: 427662 - DNA, 15 bp, Homo sapiens
cttcataatgctgtt

SEQ ID NO: 427663 - DNA, 15 bp, Homo sapiens
ttcataatgctgttc

SEQ ID NO: 427664 - DNA, 15 bp, Homo sapiens
tcataatgctgttct

SEQ ID NO: 427665 - DNA, 15 bp, Homo sapiens
cataatgctgttctt

SEQ ID NO: 427666 - DNA, 15 bp, Homo sapiens
ataatgctgttcttt

SEQ ID NO: 427667 - DNA, 15 bp, Homo sapiens
taatgctgttctttg

SEQ ID NO: 427668 - DNA, 15 bp, Homo sapiens
aatgctgttctttga

SEQ ID NO: 427669 - DNA, 15 bp, Homo sapiens
atgctgttctttgaa

SEQ ID NO: 427670 - DNA, 15 bp, Homo sapiens
tgctgttctttgaaa

SEQ ID NO: 427671 - DNA, 15 bp, Homo sapiens
gctgttctttgaaag

SEQ ID NO: 427672 - DNA, 15 bp, Homo sapiens
ctgttctttgaaagc

SEQ ID NO: 427673 - DNA, 15 bp, Homo sapiens
tgttctttgaaagca

SEQ ID NO: 427674 - DNA, 15 bp, Homo sapiens
gttctttgaaagcag

SEQ ID NO: 427675 - DNA, 15 bp, Homo sapiens
ttctttgaaagcagt

SEQ ID NO: 427676 - DNA, 15 bp, Homo sapiens
tctttgaaagcagta

SEQ ID NO: 427677 - DNA, 15 bp, Homo sapiens
ctttgaaagcagtaa

SEQ ID NO: 427678 - DNA, 15 bp, Homo sapiens
tttgaaagcagtaat

SEQ ID NO: 427679 - DNA, 15 bp, Homo sapiens
ttgaaagcagtaatt

SEQ ID NO: 427680 - DNA, 15 bp, Homo sapiens
tgaaagcagtaattt

SEQ ID NO: 427681 - DNA, 15 bp, Homo sapiens
gaaagcagtaattta

SEQ ID NO: 427682 - DNA, 15 bp, Homo sapiens
aaagcagtaatttat

SEQ ID NO: 427683 - DNA, 15 bp, Homo sapiens
aagcagtaatttatt

SEQ ID NO: 427684 - DNA, 15 bp, Homo sapiens
agcagtaatttattc

SEQ ID NO: 427685 - DNA, 15 bp, Homo sapiens
gcagtaatttattca

SEQ ID NO: 427686 - DNA, 15 bp, Homo sapiens
cagtaatttattcaa

SEQ ID NO: 427687 - DNA, 15 bp, Homo sapiens
agtaatttattcaat

SEQ ID NO: 427688 - DNA, 15 bp, Homo sapiens
gtaatttattcaatg

SEQ ID NO: 427689 - DNA, 15 bp, Homo sapiens
taatttattcaatgc

SEQ ID NO: 427690 - DNA, 15 bp, Homo sapiens
aatttattcaatgct

SEQ ID NO: 427691 - DNA, 15 bp, Homo sapiens
atttattcaatgcta

SEQ ID NO: 427692 - DNA, 15 bp, Homo sapiens
tttattcaatgctaa

SEQ ID NO: 427693 - DNA, 15 bp, Homo sapiens
ttattcaatgctaaa

SEQ ID NO: 427694 - DNA, 15 bp, Homo sapiens
tattcaatgctaaat

SEQ ID NO: 427695 - DNA, 15 bp, Homo sapiens
attcaatgctaaatg

SEQ ID NO: 427696 - DNA, 15 bp, Homo sapiens
ttcaatgctaaatga

SEQ ID NO: 427697 - DNA, 15 bp, Homo sapiens
tcaatgctaaatgag

SEQ ID NO: 427698 - DNA, 15 bp, Homo sapiens
caatgctaaatgagc

SEQ ID NO: 427699 - DNA, 15 bp, Homo sapiens
aatgctaaatgagct

SEQ ID NO: 427700 - DNA, 15 bp, Homo sapiens
atgctaaatgagctc

SEQ ID NO: 427701 - DNA, 15 bp, Homo sapiens
tgctaaatgagctca

SEQ ID NO: 427702 - DNA, 15 bp, Homo sapiens
gctaaatgagctcaa

SEQ ID NO: 427703 - DNA, 15 bp, Homo sapiens
ctaaatgagctcaat

SEQ ID NO: 427704 - DNA, 15 bp, Homo sapiens
taaatgagctcaatt

SEQ ID NO: 427705 - DNA, 15 bp, Homo sapiens
aaatgagctcaattc

SEQ ID NO: 427706 - DNA, 15 bp, Homo sapiens
aatgagctcaattct

SEQ ID NO: 427707 - DNA, 15 bp, Homo sapiens
atgagctcaattcta

SEQ ID NO: 427708 - DNA, 15 bp, Homo sapiens
tgagctcaattctag

SEQ ID NO: 427709 - DNA, 15 bp, Homo sapiens
gagctcaattctagt

SEQ ID NO: 427710 - DNA, 15 bp, Homo sapiens
agctcaattctagtg

SEQ ID NO: 427711 - DNA, 15 bp, Homo sapiens
gctcaattctagtgg

SEQ ID NO: 427712 - DNA, 15 bp, Homo sapiens
ctcaattctagtggg

SEQ ID NO: 427713 - DNA, 15 bp, Homo sapiens
tcaattctagtgggc

SEQ ID NO: 427714 - DNA, 15 bp, Homo sapiens
caattctagtgggca

SEQ ID NO: 427715 - DNA, 15 bp, Homo sapiens
aattctagtgggcat

SEQ ID NO: 427716 - DNA, 15 bp, Homo sapiens
attctagtgggcatt

SEQ ID NO: 427717 - DNA, 15 bp, Homo sapiens
ttctagtgggcattc

SEQ ID NO: 427718 - DNA, 15 bp, Homo sapiens
tctagtgggcattcc

SEQ ID NO: 427719 - DNA, 15 bp, Homo sapiens
ctagtgggcattcct

SEQ ID NO: 427720 - DNA, 15 bp, Homo sapiens
tagtgggcattcctt

SEQ ID NO: 427721 - DNA, 15 bp, Homo sapiens
agtgggcattccttt

SEQ ID NO: 427722 - DNA, 15 bp, Homo sapiens
gtgggcattcctttc

SEQ ID NO: 427723 - DNA, 15 bp, Homo sapiens
tgggcattcctttct

SEQ ID NO: 427724 - DNA, 15 bp, Homo sapiens
gggcattcctttctt

SEQ ID NO: 427725 - DNA, 15 bp, Homo sapiens
ggcattcctttctta

SEQ ID NO: 427726 - DNA, 15 bp, Homo sapiens
gcattcctttcttaa

SEQ ID NO: 427727 - DNA, 15 bp, Homo sapiens
cattcctttcttaaa

SEQ ID NO: 427728 - DNA, 15 bp, Homo sapiens
attcctttcttaaaa

SEQ ID NO: 427729 - DNA, 15 bp, Homo sapiens
ttcctttcttaaaag

SEQ ID NO: 427730 - DNA, 15 bp, Homo sapiens
tcctttcttaaaagt

SEQ ID NO: 427731 - DNA, 15 bp, Homo sapiens
cctttcttaaaagta

SEQ ID NO: 427732 - DNA, 15 bp, Homo sapiens
ctttcttaaaagtat

SEQ ID NO: 427733 - DNA, 15 bp, Homo sapiens
tttcttaaaagtata

SEQ ID NO: 427734 - DNA, 15 bp, Homo sapiens
ttcttaaaagtataa

SEQ ID NO: 427735 - DNA, 15 bp, Homo sapiens
tcttaaaagtataat

SEQ ID NO: 427736 - DNA, 15 bp, Homo sapiens
cttaaaagtataatt

SEQ ID NO: 427737 - DNA, 15 bp, Homo sapiens
ttaaaagtataattt

SEQ ID NO: 427738 - DNA, 15 bp, Homo sapiens
taaaagtataatttt

SEQ ID NO: 427739 - DNA, 15 bp, Homo sapiens
aaaagtataattttt

SEQ ID NO: 427740 - DNA, 15 bp, Homo sapiens
aaagtataattttta

SEQ ID NO: 427741 - DNA, 15 bp, Homo sapiens
aagtataatttttaa

SEQ ID NO: 427742 - DNA, 15 bp, Homo sapiens
agtataatttttaat

SEQ ID NO: 427743 - DNA, 15 bp, Homo sapiens
gtataatttttaatt

SEQ ID NO: 427744 - DNA, 15 bp, Homo sapiens
tataatttttaatta

SEQ ID NO: 427745 - DNA, 15 bp, Homo sapiens
ataatttttaattat

SEQ ID NO: 427746 - DNA, 15 bp, Homo sapiens
taatttttaattatg

SEQ ID NO: 427747 - DNA, 15 bp, Homo sapiens
aatttttaattatga

SEQ ID NO: 427748 - DNA, 15 bp, Homo sapiens
atttttaattatgaa

SEQ ID NO: 427749 - DNA, 15 bp, Homo sapiens
tttttaattatgaaa

SEQ ID NO: 427750 - DNA, 15 bp, Homo sapiens
ttttaattatgaaaa

SEQ ID NO: 427751 - DNA, 15 bp, Homo sapiens
tttaattatgaaaat

SEQ ID NO: 427752 - DNA, 15 bp, Homo sapiens
ttaattatgaaaata

SEQ ID NO: 427753 - DNA, 15 bp, Homo sapiens
taattatgaaaataa

SEQ ID NO: 427754 - DNA, 15 bp, Homo sapiens
aattatgaaaataat

SEQ ID NO: 427755 - DNA, 15 bp, Homo sapiens
attatgaaaataata

SEQ ID NO: 427756 - DNA, 15 bp, Homo sapiens
ttatgaaaataataa

SEQ ID NO: 427757 - DNA, 15 bp, Homo sapiens
tatgaaaataataac

SEQ ID NO: 427758 - DNA, 15 bp, Homo sapiens
atgaaaataataaca

SEQ ID NO: 427759 - DNA, 15 bp, Homo sapiens
tgaaaataataacat

SEQ ID NO: 427760 - DNA, 15 bp, Homo sapiens
gaaaataataacata

SEQ ID NO: 427761 - DNA, 15 bp, Homo sapiens
aaaataataacatat

SEQ ID NO: 427762 - DNA, 15 bp, Homo sapiens
aaataataacatatt

SEQ ID NO: 427763 - DNA, 15 bp, Homo sapiens
aataataacatatta

SEQ ID NO: 427764 - DNA, 15 bp, Homo sapiens
ataataacatattac

SEQ ID NO: 427765 - DNA, 15 bp, Homo sapiens
taataacatattaca

SEQ ID NO: 427766 - DNA, 15 bp, Homo sapiens
aataacatattacag

SEQ ID NO: 427767 - DNA, 15 bp, Homo sapiens
ataacatattacaga

SEQ ID NO: 427768 - DNA, 15 bp, Homo sapiens
taacatattacagag

SEQ ID NO: 427769 - DNA, 15 bp, Homo sapiens
aacatattacagagt

SEQ ID NO: 427770 - DNA, 15 bp, Homo sapiens
acatattacagagtt

SEQ ID NO: 427771 - DNA, 15 bp, Homo sapiens
catattacagagttt

SEQ ID NO: 427772 - DNA, 15 bp, Homo sapiens
atattacagagttta

SEQ ID NO: 427773 - DNA, 15 bp, Homo sapiens
tattacagagtttat

SEQ ID NO: 427774 - DNA, 15 bp, Homo sapiens
attacagagtttatg

SEQ ID NO: 427775 - DNA, 15 bp, Homo sapiens
ttacagagtttatga

SEQ ID NO: 427776 - DNA, 15 bp, Homo sapiens
tacagagtttatgaa

SEQ ID NO: 427777 - DNA, 15 bp, Homo sapiens
acagagtttatgaaa

SEQ ID NO: 427778 - DNA, 15 bp, Homo sapiens
cagagtttatgaaat

SEQ ID NO: 427779 - DNA, 15 bp, Homo sapiens
agagtttatgaaata

SEQ ID NO: 427780 - DNA, 15 bp, Homo sapiens
gagtttatgaaataa

SEQ ID NO: 427781 - DNA, 15 bp, Homo sapiens
agtttatgaaataaa

SEQ ID NO: 427782 - DNA, 15 bp, Homo sapiens
gtttatgaaataaag

SEQ ID NO: 427783 - DNA, 15 bp, Homo sapiens
tttatgaaataaaga

SEQ ID NO: 427784 - DNA, 15 bp, Homo sapiens
ttatgaaataaagaa

SEQ ID NO: 427785 - DNA, 15 bp, Homo sapiens
tatgaaataaagaat

SEQ ID NO: 427786 - DNA, 15 bp, Homo sapiens
atgaaataaagaata

SEQ ID NO: 427787 - DNA, 15 bp, Homo sapiens
tgaaataaagaataa

SEQ ID NO: 427788 - DNA, 15 bp, Homo sapiens
gaaataaagaataaa

SEQ ID NO: 427789 - DNA, 15 bp, Homo sapiens
aaataaagaataaaa

SEQ ID NO: 427790 - DNA, 15 bp, Homo sapiens
aataaagaataaaaa

SEQ ID NO: 427791 - DNA, 15 bp, Homo sapiens
ataaagaataaaaac

SEQ ID NO: 427792 - DNA, 15 bp, Homo sapiens
taaagaataaaaaca

SEQ ID NO: 427793 - DNA, 15 bp, Homo sapiens
aaagaataaaaacat

SEQ ID NO: 427794 - DNA, 15 bp, Homo sapiens
aagaataaaaacatg

SEQ ID NO: 427795 - DNA, 15 bp, Homo sapiens
agaataaaaacatgg

SEQ ID NO: 427796 - DNA, 15 bp, Homo sapiens
gaataaaaacatggc

SEQ ID NO: 427797 - DNA, 15 bp, Homo sapiens
aataaaaacatggcc

SEQ ID NO: 427798 - DNA, 15 bp, Homo sapiens
ataaaaacatggcca

SEQ ID NO: 427799 - DNA, 15 bp, Homo sapiens
taaaaacatggccat

SEQ ID NO: 427800 - DNA, 15 bp, Homo sapiens
aaaaacatggccata

SEQ ID NO: 427801 - DNA, 15 bp, Homo sapiens
aaaacatggccataa

SEQ ID NO: 427802 - DNA, 15 bp, Homo sapiens
aaacatggccataat

SEQ ID NO: 427803 - DNA, 15 bp, Homo sapiens
aacatggccataatt

SEQ ID NO: 427804 - DNA, 15 bp, Homo sapiens
acatggccataattt

SEQ ID NO: 427805 - DNA, 15 bp, Homo sapiens
catggccataatttt

SEQ ID NO: 427806 - DNA, 15 bp, Homo sapiens
atggccataatttta

SEQ ID NO: 427807 - DNA, 15 bp, Homo sapiens
tggccataattttat

SEQ ID NO: 427808 - DNA, 15 bp, Homo sapiens
ggccataattttatc

SEQ ID NO: 427809 - DNA, 15 bp, Homo sapiens
gccataattttatca

SEQ ID NO: 427810 - DNA, 15 bp, Homo sapiens
ccataattttatcac

SEQ ID NO: 427811 - DNA, 15 bp, Homo sapiens
cataattttatcacc

SEQ ID NO: 427812 - DNA, 15 bp, Homo sapiens
ataattttatcacca

SEQ ID NO: 427813 - DNA, 15 bp, Homo sapiens
taattttatcaccat

SEQ ID NO: 427814 - DNA, 15 bp, Homo sapiens
aattttatcaccata

SEQ ID NO: 427815 - DNA, 15 bp, Homo sapiens
attttatcaccataa

SEQ ID NO: 427816 - DNA, 15 bp, Homo sapiens
ttttatcaccataac

SEQ ID NO: 427817 - DNA, 15 bp, Homo sapiens
tttatcaccataaca

SEQ ID NO: 427818 - DNA, 15 bp, Homo sapiens
ttatcaccataacaa

SEQ ID NO: 427819 - DNA, 15 bp, Homo sapiens
tatcaccataacaac

SEQ ID NO: 427820 - DNA, 15 bp, Homo sapiens
atcaccataacaacc

SEQ ID NO: 427821 - DNA, 15 bp, Homo sapiens
tcaccataacaaccc

SEQ ID NO: 427822 - DNA, 15 bp, Homo sapiens
caccataacaaccct

SEQ ID NO: 427823 - DNA, 15 bp, Homo sapiens
accataacaaccctt

SEQ ID NO: 427824 - DNA, 15 bp, Homo sapiens
ccataacaacccttt

SEQ ID NO: 427825 - DNA, 15 bp, Homo sapiens
cataacaaccctttt

SEQ ID NO: 427826 - DNA, 15 bp, Homo sapiens
ataacaacccttttc

SEQ ID NO: 427827 - DNA, 15 bp, Homo sapiens
taacaacccttttca

SEQ ID NO: 427828 - DNA, 15 bp, Homo sapiens
aacaacccttttcat

SEQ ID NO: 427829 - DNA, 15 bp, Homo sapiens
acaacccttttcatt

SEQ ID NO: 427830 - DNA, 15 bp, Homo sapiens
caacccttttcattt

SEQ ID NO: 427831 - DNA, 15 bp, Homo sapiens
aacccttttcatttt

SEQ ID NO: 427832 - DNA, 15 bp, Homo sapiens
acccttttcattttg

SEQ ID NO: 427833 - DNA, 15 bp, Homo sapiens
cccttttcattttgc

SEQ ID NO: 427834 - DNA, 15 bp, Homo sapiens
ccttttcattttgca

SEQ ID NO: 427835 - DNA, 15 bp, Homo sapiens
cttttcattttgcat

SEQ ID NO: 427836 - DNA, 15 bp, Homo sapiens
ttttcattttgcatt

SEQ ID NO: 427837 - DNA, 15 bp, Homo sapiens
tttcattttgcatta

SEQ ID NO: 427838 - DNA, 15 bp, Homo sapiens
ttcattttgcattat

SEQ ID NO: 427839 - DNA, 15 bp, Homo sapiens
tcattttgcattatt

SEQ ID NO: 427840 - DNA, 15 bp, Homo sapiens
cattttgcattattt

SEQ ID NO: 427841 - DNA, 15 bp, Homo sapiens
attttgcattatttc

SEQ ID NO: 427842 - DNA, 15 bp, Homo sapiens
ttttgcattatttcc

SEQ ID NO: 427843 - DNA, 15 bp, Homo sapiens
tttgcattatttcct

SEQ ID NO: 427844 - DNA, 15 bp, Homo sapiens
ttgcattatttcctt

SEQ ID NO: 427845 - DNA, 15 bp, Homo sapiens
tgcattatttccttt

SEQ ID NO: 427846 - DNA, 15 bp, Homo sapiens
gcattatttcctttt

SEQ ID NO: 427847 - DNA, 15 bp, Homo sapiens
cattatttccttttt

SEQ ID NO: 427848 - DNA, 15 bp, Homo sapiens
attatttcctttttg

SEQ ID NO: 427849 - DNA, 15 bp, Homo sapiens
ttatttcctttttgc

SEQ ID NO: 427850 - DNA, 15 bp, Homo sapiens
tatttcctttttgca

SEQ ID NO: 427851 - DNA, 15 bp, Homo sapiens
atttcctttttgcat

SEQ ID NO: 427852 - DNA, 15 bp, Homo sapiens
tttcctttttgcata

SEQ ID NO: 427853 - DNA, 15 bp, Homo sapiens
ttcctttttgcatat

SEQ ID NO: 427854 - DNA, 15 bp, Homo sapiens
tcctttttgcatatt

SEQ ID NO: 427855 - DNA, 15 bp, Homo sapiens
cctttttgcatattt

SEQ ID NO: 427856 - DNA, 15 bp, Homo sapiens
ctttttgcatattta

SEQ ID NO: 427857 - DNA, 15 bp, Homo sapiens
tttttgcatatttac

SEQ ID NO: 427858 - DNA, 15 bp, Homo sapiens
ttttgcatatttacc

SEQ ID NO: 427859 - DNA, 15 bp, Homo sapiens
tttgcatatttacct

SEQ ID NO: 427860 - DNA, 15 bp, Homo sapiens
ttgcatatttacctt

SEQ ID NO: 427861 - DNA, 15 bp, Homo sapiens
tgcatatttaccttt

SEQ ID NO: 427862 - DNA, 15 bp, Homo sapiens
gcatatttacctttt

SEQ ID NO: 427863 - DNA, 15 bp, Homo sapiens
catatttaccttttg

SEQ ID NO: 427864 - DNA, 15 bp, Homo sapiens
atatttaccttttgc

SEQ ID NO: 427865 - DNA, 15 bp, Homo sapiens
tatttaccttttgca

SEQ ID NO: 427866 - DNA, 15 bp, Homo sapiens
atttaccttttgcat

SEQ ID NO: 427867 - DNA, 15 bp, Homo sapiens
tttaccttttgcata

SEQ ID NO: 427868 - DNA, 15 bp, Homo sapiens
ttaccttttgcatag

SEQ ID NO: 427869 - DNA, 15 bp, Homo sapiens
taccttttgcatagt

SEQ ID NO: 427870 - DNA, 15 bp, Homo sapiens
accttttgcatagtt

SEQ ID NO: 427871 - DNA, 15 bp, Homo sapiens
ccttttgcatagttt

SEQ ID NO: 427872 - DNA, 15 bp, Homo sapiens
cttttgcatagtttt

SEQ ID NO: 427873 - DNA, 15 bp, Homo sapiens
ttttgcatagtttta

SEQ ID NO: 427874 - DNA, 15 bp, Homo sapiens
tttgcatagttttac

SEQ ID NO: 427875 - DNA, 15 bp, Homo sapiens
ttgcatagttttact

SEQ ID NO: 427876 - DNA, 15 bp, Homo sapiens
tgcatagttttactt

SEQ ID NO: 427877 - DNA, 15 bp, Homo sapiens
gcatagttttacttg

SEQ ID NO: 427878 - DNA, 15 bp, Homo sapiens
catagttttacttgg

SEQ ID NO: 427879 - DNA, 15 bp, Homo sapiens
atagttttacttggg

SEQ ID NO: 427880 - DNA, 15 bp, Homo sapiens
tagttttacttgggt

SEQ ID NO: 427881 - DNA, 15 bp, Homo sapiens
agttttacttgggtg

SEQ ID NO: 427882 - DNA, 15 bp, Homo sapiens
gttttacttgggtgc

SEQ ID NO: 427883 - DNA, 15 bp, Homo sapiens
ttttacttgggtgca

SEQ ID NO: 427884 - DNA, 15 bp, Homo sapiens
tttacttgggtgcag

SEQ ID NO: 427885 - DNA, 15 bp, Homo sapiens
ttacttgggtgcaga

SEQ ID NO: 427886 - DNA, 15 bp, Homo sapiens
tacttgggtgcagag

SEQ ID NO: 427887 - DNA, 15 bp, Homo sapiens
acttgggtgcagagt

SEQ ID NO: 427888 - DNA, 15 bp, Homo sapiens
cttgggtgcagagtt

SEQ ID NO: 427889 - DNA, 15 bp, Homo sapiens
ttgggtgcagagttt

SEQ ID NO: 427890 - DNA, 15 bp, Homo sapiens
tgggtgcagagtttt

SEQ ID NO: 427891 - DNA, 15 bp, Homo sapiens
gggtgcagagttttt

SEQ ID NO: 427892 - DNA, 15 bp, Homo sapiens
ggtgcagagttttta

SEQ ID NO: 427893 - DNA, 15 bp, Homo sapiens
gtgcagagtttttat

SEQ ID NO: 427894 - DNA, 15 bp, Homo sapiens
tgcagagtttttatg

SEQ ID NO: 427895 - DNA, 15 bp, Homo sapiens
gcagagtttttatgt

SEQ ID NO: 427896 - DNA, 15 bp, Homo sapiens
cagagtttttatgtc

SEQ ID NO: 427897 - DNA, 15 bp, Homo sapiens
agagtttttatgtca

SEQ ID NO: 427898 - DNA, 15 bp, Homo sapiens
gagtttttatgtcat

SEQ ID NO: 427899 - DNA, 15 bp, Homo sapiens
agtttttatgtcatc

SEQ ID NO: 427900 - DNA, 15 bp, Homo sapiens
gtttttatgtcatct

SEQ ID NO: 427901 - DNA, 15 bp, Homo sapiens
tttttatgtcatctt

SEQ ID NO: 427902 - DNA, 15 bp, Homo sapiens
ttttatgtcatcttt

SEQ ID NO: 427903 - DNA, 15 bp, Homo sapiens
tttatgtcatctttt

SEQ ID NO: 427904 - DNA, 15 bp, Homo sapiens
ttatgtcatcttttt

SEQ ID NO: 427905 - DNA, 15 bp, Homo sapiens
tatgtcatctttttc

SEQ ID NO: 427906 - DNA, 15 bp, Homo sapiens
atgtcatctttttca

SEQ ID NO: 427907 - DNA, 15 bp, Homo sapiens
tgtcatctttttcac

SEQ ID NO: 427908 - DNA, 15 bp, Homo sapiens
gtcatctttttcact

SEQ ID NO: 427909 - DNA, 15 bp, Homo sapiens
tcatctttttcactt

SEQ ID NO: 427910 - DNA, 15 bp, Homo sapiens
catctttttcactta

SEQ ID NO: 427911 - DNA, 15 bp, Homo sapiens
atctttttcacttag

SEQ ID NO: 427912 - DNA, 15 bp, Homo sapiens
tctttttcacttaga

SEQ ID NO: 427913 - DNA, 15 bp, Homo sapiens
ctttttcacttagat

SEQ ID NO: 427914 - DNA, 15 bp, Homo sapiens
tttttcacttagata

SEQ ID NO: 427915 - DNA, 15 bp, Homo sapiens
ttttcacttagatac

SEQ ID NO: 427916 - DNA, 15 bp, Homo sapiens
tttcacttagataca

SEQ ID NO: 427917 - DNA, 15 bp, Homo sapiens
ttcacttagatacat

SEQ ID NO: 427918 - DNA, 15 bp, Homo sapiens
tcacttagatacatg

SEQ ID NO: 427919 - DNA, 15 bp, Homo sapiens
cacttagatacatgt

SEQ ID NO: 427920 - DNA, 15 bp, Homo sapiens
acttagatacatgtc

SEQ ID NO: 427921 - DNA, 15 bp, Homo sapiens
cttagatacatgtca

SEQ ID NO: 427922 - DNA, 15 bp, Homo sapiens
ttagatacatgtcat

SEQ ID NO: 427923 - DNA, 15 bp, Homo sapiens
tagatacatgtcatg

SEQ ID NO: 427924 - DNA, 15 bp, Homo sapiens
agatacatgtcatgc

SEQ ID NO: 427925 - DNA, 15 bp, Homo sapiens
gatacatgtcatgcc

SEQ ID NO: 427926 - DNA, 15 bp, Homo sapiens
atacatgtcatgcct

SEQ ID NO: 427927 - DNA, 15 bp, Homo sapiens
tacatgtcatgccta

SEQ ID NO: 427928 - DNA, 15 bp, Homo sapiens
acatgtcatgcctat

SEQ ID NO: 427929 - DNA, 15 bp, Homo sapiens
catgtcatgcctatt

SEQ ID NO: 427930 - DNA, 15 bp, Homo sapiens
atgtcatgcctattt

SEQ ID NO: 427931 - DNA, 15 bp, Homo sapiens
tgtcatgcctatttc

SEQ ID NO: 427932 - DNA, 15 bp, Homo sapiens
gtcatgcctatttct

SEQ ID NO: 427933 - DNA, 15 bp, Homo sapiens
tcatgcctatttctt

SEQ ID NO: 427934 - DNA, 15 bp, Homo sapiens
catgcctatttcttc

SEQ ID NO: 427935 - DNA, 15 bp, Homo sapiens
atgcctatttcttca

SEQ ID NO: 427936 - DNA, 15 bp, Homo sapiens
tgcctatttcttcac

SEQ ID NO: 427937 - DNA, 15 bp, Homo sapiens
gcctatttcttcaca

SEQ ID NO: 427938 - DNA, 15 bp, Homo sapiens
cctatttcttcacat

SEQ ID NO: 427939 - DNA, 15 bp, Homo sapiens
ctatttcttcacatt

SEQ ID NO: 427940 - DNA, 15 bp, Homo sapiens
tatttcttcacattg

SEQ ID NO: 427941 - DNA, 15 bp, Homo sapiens
atttcttcacattgc

SEQ ID NO: 427942 - DNA, 15 bp, Homo sapiens
tttcttcacattgct

SEQ ID NO: 427943 - DNA, 15 bp, Homo sapiens
ttcttcacattgcta

SEQ ID NO: 427944 - DNA, 15 bp, Homo sapiens
tcttcacattgctat

SEQ ID NO: 427945 - DNA, 15 bp, Homo sapiens
cttcacattgctatg

SEQ ID NO: 427946 - DNA, 15 bp, Homo sapiens
ttcacattgctatgt

SEQ ID NO: 427947 - DNA, 15 bp, Homo sapiens
tcacattgctatgtg

SEQ ID NO: 427948 - DNA, 15 bp, Homo sapiens
cacattgctatgtgg

SEQ ID NO: 427949 - DNA, 15 bp, Homo sapiens
acattgctatgtggt

SEQ ID NO: 427950 - DNA, 15 bp, Homo sapiens
cattgctatgtggtc

SEQ ID NO: 427951 - DNA, 15 bp, Homo sapiens
attgctatgtggtca

SEQ ID NO: 427952 - DNA, 15 bp, Homo sapiens
ttgctatgtggtcat

SEQ ID NO: 427953 - DNA, 15 bp, Homo sapiens
tgctatgtggtcatt

SEQ ID NO: 427954 - DNA, 15 bp, Homo sapiens
gctatgtggtcatta

SEQ ID NO: 427955 - DNA, 15 bp, Homo sapiens
ctatgtggtcattat

SEQ ID NO: 427956 - DNA, 15 bp, Homo sapiens
tatgtggtcattatc

SEQ ID NO: 427957 - DNA, 15 bp, Homo sapiens
atgtggtcattatca

SEQ ID NO: 427958 - DNA, 15 bp, Homo sapiens
tgtggtcattatcac

SEQ ID NO: 427959 - DNA, 15 bp, Homo sapiens
gtggtcattatcaca

SEQ ID NO: 427960 - DNA, 15 bp, Homo sapiens
tggtcattatcacaa

SEQ ID NO: 427961 - DNA, 15 bp, Homo sapiens
ggtcattatcacaat

SEQ ID NO: 427962 - DNA, 15 bp, Homo sapiens
gtcattatcacaata

SEQ ID NO: 427963 - DNA, 15 bp, Homo sapiens
tcattatcacaataa

SEQ ID NO: 427964 - DNA, 15 bp, Homo sapiens
cattatcacaataac

SEQ ID NO: 427965 - DNA, 15 bp, Homo sapiens
attatcacaataact

SEQ ID NO: 427966 - DNA, 15 bp, Homo sapiens
ttatcacaataactt

SEQ ID NO: 427967 - DNA, 15 bp, Homo sapiens
tatcacaataacttt

SEQ ID NO: 427968 - DNA, 15 bp, Homo sapiens
atcacaataactttt

SEQ ID NO: 427969 - DNA, 15 bp, Homo sapiens
tcacaataacttttc

SEQ ID NO: 427970 - DNA, 15 bp, Homo sapiens
cacaataacttttca

SEQ ID NO: 427971 - DNA, 15 bp, Homo sapiens
acaataacttttcaa

SEQ ID NO: 427972 - DNA, 15 bp, Homo sapiens
aataacttttcaagg

SEQ ID NO: 427973 - DNA, 15 bp, Homo sapiens
ataacttttcaaggt

SEQ ID NO: 427974 - DNA, 15 bp, Homo sapiens
taacttttcaaggtt

SEQ ID NO: 427975 - DNA, 15 bp, Homo sapiens
aacttttcaaggttg

SEQ ID NO: 427976 - DNA, 15 bp, Homo sapiens
acttttcaaggttgc

SEQ ID NO: 427977 - DNA, 15 bp, Homo sapiens
cttttcaaggttgca

SEQ ID NO: 427978 - DNA, 15 bp, Homo sapiens
ttttcaaggttgcat

SEQ ID NO: 427979 - DNA, 15 bp, Homo sapiens
tttcaaggttgcata

SEQ ID NO: 427980 - DNA, 15 bp, Homo sapiens
ttcaaggttgcataa

SEQ ID NO: 427981 - DNA, 15 bp, Homo sapiens
tcaaggttgcataat

SEQ ID NO: 427982 - DNA, 15 bp, Homo sapiens
caaggttgcataatg

SEQ ID NO: 427983 - DNA, 15 bp, Homo sapiens
aaggttgcataatgg

SEQ ID NO: 427984 - DNA, 15 bp, Homo sapiens
aggttgcataatggc

SEQ ID NO: 427985 - DNA, 15 bp, Homo sapiens
ggttgcataatggcc

SEQ ID NO: 427986 - DNA, 15 bp, Homo sapiens
gttgcataatggcct

SEQ ID NO: 427987 - DNA, 15 bp, Homo sapiens
ttgcataatggcctc

SEQ ID NO: 427988 - DNA, 15 bp, Homo sapiens
tgcataatggcctct

SEQ ID NO: 427989 - DNA, 15 bp, Homo sapiens
gcataatggcctcta

SEQ ID NO: 427990 - DNA, 15 bp, Homo sapiens
cataatggcctctat

SEQ ID NO: 427991 - DNA, 15 bp, Homo sapiens
ataatggcctctatt

SEQ ID NO: 427992 - DNA, 15 bp, Homo sapiens
taatggcctctattg

SEQ ID NO: 427993 - DNA, 15 bp, Homo sapiens
aatggcctctattgt

SEQ ID NO: 427994 - DNA, 15 bp, Homo sapiens
atggcctctattgtg

SEQ ID NO: 427995 - DNA, 15 bp, Homo sapiens
tggcctctattgtgg

SEQ ID NO: 427996 - DNA, 15 bp, Homo sapiens
ggcctctattgtggc

SEQ ID NO: 427997 - DNA, 15 bp, Homo sapiens
gcctctattgtggcc

SEQ ID NO: 427998 - DNA, 15 bp, Homo sapiens
cctctattgtggcca

SEQ ID NO: 427999 - DNA, 15 bp, Homo sapiens
ctctattgtggccat

SEQ ID NO: 428000 - DNA, 15 bp, Homo sapiens
tctattgtggccata

SEQ ID NO: 428001 - DNA, 15 bp, Homo sapiens
ctattgtggccatat

SEQ ID NO: 428002 - DNA, 15 bp, Homo sapiens
tattgtggccatatc

SEQ ID NO: 428003 - DNA, 15 bp, Homo sapiens
attgtggccatatca

SEQ ID NO: 428004 - DNA, 15 bp, Homo sapiens
ttgtggccatatcat

SEQ ID NO: 428005 - DNA, 15 bp, Homo sapiens
tgtggccatatcata

SEQ ID NO: 428006 - DNA, 15 bp, Homo sapiens
gtggccatatcatag

SEQ ID NO: 428007 - DNA, 15 bp, Homo sapiens
tggccatatcataga

SEQ ID NO: 428008 - DNA, 15 bp, Homo sapiens
ggccatatcatagaa

SEQ ID NO: 428009 - DNA, 15 bp, Homo sapiens
gccatatcatagaac

SEQ ID NO: 428010 - DNA, 15 bp, Homo sapiens
ccatatcatagaacc

SEQ ID NO: 428011 - DNA, 15 bp, Homo sapiens
catatcatagaacct

SEQ ID NO: 428012 - DNA, 15 bp, Homo sapiens
atatcatagaaccta

SEQ ID NO: 428013 - DNA, 15 bp, Homo sapiens
tatcatagaacctaa

SEQ ID NO: 428014 - DNA, 15 bp, Homo sapiens
atcatagaacctaaa

SEQ ID NO: 428015 - DNA, 15 bp, Homo sapiens
tcatagaacctaaat

SEQ ID NO: 428016 - DNA, 15 bp, Homo sapiens
catagaacctaaata

SEQ ID NO: 428017 - DNA, 15 bp, Homo sapiens
atagaacctaaatat

SEQ ID NO: 428018 - DNA, 15 bp, Homo sapiens
tagaacctaaatata

SEQ ID NO: 428019 - DNA, 15 bp, Homo sapiens
agaacctaaatatat

SEQ ID NO: 428020 - DNA, 15 bp, Homo sapiens
gaacctaaatatatt

SEQ ID NO: 428021 - DNA, 15 bp, Homo sapiens
aacctaaatatattc

SEQ ID NO: 428022 - DNA, 15 bp, Homo sapiens
acctaaatatattcc

SEQ ID NO: 428023 - DNA, 15 bp, Homo sapiens
cctaaatatattcca

SEQ ID NO: 428024 - DNA, 15 bp, Homo sapiens
ctaaatatattccag

SEQ ID NO: 428025 - DNA, 15 bp, Homo sapiens
taaatatattccagg

SEQ ID NO: 428026 - DNA, 15 bp, Homo sapiens
aaatatattccaggt

SEQ ID NO: 428027 - DNA, 15 bp, Homo sapiens
aatatattccaggtg

SEQ ID NO: 428028 - DNA, 15 bp, Homo sapiens
atatattccaggtgt

SEQ ID NO: 428029 - DNA, 15 bp, Homo sapiens
tatattccaggtgtt

SEQ ID NO: 428030 - DNA, 15 bp, Homo sapiens
atattccaggtgttg

SEQ ID NO: 428031 - DNA, 15 bp, Homo sapiens
tattccaggtgttgg

SEQ ID NO: 428032 - DNA, 15 bp, Homo sapiens
attccaggtgttgga

SEQ ID NO: 428033 - DNA, 15 bp, Homo sapiens
ttccaggtgttggag

SEQ ID NO: 428034 - DNA, 15 bp, Homo sapiens
tccaggtgttggaga

SEQ ID NO: 428035 - DNA, 15 bp, Homo sapiens
ccaggtgttggagat

SEQ ID NO: 428036 - DNA, 15 bp, Homo sapiens
caggtgttggagatt

SEQ ID NO: 428037 - DNA, 15 bp, Homo sapiens
aggtgttggagattt

SEQ ID NO: 428038 - DNA, 15 bp, Homo sapiens
ggtgttggagattta

SEQ ID NO: 428039 - DNA, 15 bp, Homo sapiens
gtgttggagatttaa

SEQ ID NO: 428040 - DNA, 15 bp, Homo sapiens
tgttggagatttaag

SEQ ID NO: 428041 - DNA, 15 bp, Homo sapiens
gttggagatttaagt

SEQ ID NO: 428042 - DNA, 15 bp, Homo sapiens
ttggagatttaagtt

SEQ ID NO: 428043 - DNA, 15 bp, Homo sapiens
tggagatttaagttt

SEQ ID NO: 428044 - DNA, 15 bp, Homo sapiens
ggagatttaagtttc

SEQ ID NO: 428045 - DNA, 15 bp, Homo sapiens
gagatttaagtttct

SEQ ID NO: 428046 - DNA, 15 bp, Homo sapiens
agatttaagtttctt

SEQ ID NO: 428047 - DNA, 15 bp, Homo sapiens
gatttaagtttcttt

SEQ ID NO: 428048 - DNA, 15 bp, Homo sapiens
atttaagtttctttc

SEQ ID NO: 428049 - DNA, 15 bp, Homo sapiens
tttaagtttctttca

SEQ ID NO: 428050 - DNA, 15 bp, Homo sapiens
ttaagtttctttcaa

SEQ ID NO: 428051 - DNA, 15 bp, Homo sapiens
taagtttctttcaat

SEQ ID NO: 428052 - DNA, 15 bp, Homo sapiens
aagtttctttcaatt

SEQ ID NO: 428053 - DNA, 15 bp, Homo sapiens
agtttctttcaattt

SEQ ID NO: 428054 - DNA, 15 bp, Homo sapiens
gtttctttcaatttt

SEQ ID NO: 428055 - DNA, 15 bp, Homo sapiens
tttctttcaattttt

SEQ ID NO: 428056 - DNA, 15 bp, Homo sapiens
ttctttcaatttttt

SEQ ID NO: 428057 - DNA, 15 bp, Homo sapiens
tctttcaatttttta

SEQ ID NO: 428058 - DNA, 15 bp, Homo sapiens
ctttcaattttttaa

SEQ ID NO: 428059 - DNA, 15 bp, Homo sapiens
tttcaattttttaaa

SEQ ID NO: 428060 - DNA, 15 bp, Homo sapiens
ttcaattttttaaaa

SEQ ID NO: 428061 - DNA, 15 bp, Homo sapiens
tcaattttttaaaaa

SEQ ID NO: 428062 - DNA, 15 bp, Homo sapiens
caattttttaaaaat

SEQ ID NO: 428063 - DNA, 15 bp, Homo sapiens
aattttttaaaaatc

SEQ ID NO: 428064 - DNA, 15 bp, Homo sapiens
attttttaaaaatca

SEQ ID NO: 428065 - DNA, 15 bp, Homo sapiens
ttttttaaaaatcat

SEQ ID NO: 428066 - DNA, 15 bp, Homo sapiens
tttttaaaaatcata

SEQ ID NO: 428067 - DNA, 15 bp, Homo sapiens
ttttaaaaatcataa

SEQ ID NO: 428068 - DNA, 15 bp, Homo sapiens
tttaaaaatcataaa

SEQ ID NO: 428069 - DNA, 15 bp, Homo sapiens
ttaaaaatcataaat

SEQ ID NO: 428070 - DNA, 15 bp, Homo sapiens
taaaaatcataaata

SEQ ID NO: 428071 - DNA, 15 bp, Homo sapiens
aaaaatcataaataa

SEQ ID NO: 428072 - DNA, 15 bp, Homo sapiens
aaaatcataaataat

SEQ ID NO: 428073 - DNA, 15 bp, Homo sapiens
aaatcataaataatg

SEQ ID NO: 428074 - DNA, 15 bp, Homo sapiens
aatcataaataatgt

SEQ ID NO: 428075 - DNA, 15 bp, Homo sapiens
atcataaataatgtt

SEQ ID NO: 428076 - DNA, 15 bp, Homo sapiens
tcataaataatgtta

SEQ ID NO: 428077 - DNA, 15 bp, Homo sapiens
cataaataatgttat

SEQ ID NO: 428078 - DNA, 15 bp, Homo sapiens
ataaataatgttata

SEQ ID NO: 428079 - DNA, 15 bp, Homo sapiens
taaataatgttataa

SEQ ID NO: 428080 - DNA, 15 bp, Homo sapiens
aaataatgttataat

SEQ ID NO: 428081 - DNA, 15 bp, Homo sapiens
aataatgttataatg

SEQ ID NO: 428082 - DNA, 15 bp, Homo sapiens
ataatgttataatga

SEQ ID NO: 428083 - DNA, 15 bp, Homo sapiens
taatgttataatgaa

SEQ ID NO: 428084 - DNA, 15 bp, Homo sapiens
aatgttataatgaac

SEQ ID NO: 428085 - DNA, 15 bp, Homo sapiens
atgttataatgaaca

SEQ ID NO: 428086 - DNA, 15 bp, Homo sapiens
tgttataatgaacac

SEQ ID NO: 428087 - DNA, 15 bp, Homo sapiens
gttataatgaacact

SEQ ID NO: 428088 - DNA, 15 bp, Homo sapiens
ttataatgaacactt

SEQ ID NO: 428089 - DNA, 15 bp, Homo sapiens
tataatgaacacttt

SEQ ID NO: 428090 - DNA, 15 bp, Homo sapiens
ataatgaacactttt

SEQ ID NO: 428091 - DNA, 15 bp, Homo sapiens
taatgaacacttttg

SEQ ID NO: 428092 - DNA, 15 bp, Homo sapiens
aatgaacacttttgt

SEQ ID NO: 428093 - DNA, 15 bp, Homo sapiens
atgaacacttttgtg

SEQ ID NO: 428094 - DNA, 15 bp, Homo sapiens
tgaacacttttgtgt

SEQ ID NO: 428095 - DNA, 15 bp, Homo sapiens
gaacacttttgtgtt

SEQ ID NO: 428096 - DNA, 15 bp, Homo sapiens
aacacttttgtgttc

SEQ ID NO: 428097 - DNA, 15 bp, Homo sapiens
acacttttgtgttcg

SEQ ID NO: 428098 - DNA, 15 bp, Homo sapiens
cacttttgtgttcgt

SEQ ID NO: 428099 - DNA, 15 bp, Homo sapiens
acttttgtgttcgta

SEQ ID NO: 428100 - DNA, 15 bp, Homo sapiens
cttttgtgttcgtag

SEQ ID NO: 428101 - DNA, 15 bp, Homo sapiens
ttttgtgttcgtagc

SEQ ID NO: 428102 - DNA, 15 bp, Homo sapiens
tttgtgttcgtagct

SEQ ID NO: 428103 - DNA, 15 bp, Homo sapiens
ttgtgttcgtagctt

SEQ ID NO: 428104 - DNA, 15 bp, Homo sapiens
tgtgttcgtagcttt

SEQ ID NO: 428105 - DNA, 15 bp, Homo sapiens
gtgttcgtagctttt

SEQ ID NO: 428106 - DNA, 15 bp, Homo sapiens
tgttcgtagcttttc

SEQ ID NO: 428107 - DNA, 15 bp, Homo sapiens
gttcgtagcttttct

SEQ ID NO: 428108 - DNA, 15 bp, Homo sapiens
ttcgtagcttttctg

SEQ ID NO: 428109 - DNA, 15 bp, Homo sapiens
tcgtagcttttctgg

SEQ ID NO: 428110 - DNA, 15 bp, Homo sapiens
cgtagcttttctgga

SEQ ID NO: 428111 - DNA, 15 bp, Homo sapiens
gtagcttttctggat

SEQ ID NO: 428112 - DNA, 15 bp, Homo sapiens
tagcttttctggatc

SEQ ID NO: 428113 - DNA, 15 bp, Homo sapiens
agcttttctggatca

SEQ ID NO: 428114 - DNA, 15 bp, Homo sapiens
gcttttctggatcat

SEQ ID NO: 428115 - DNA, 15 bp, Homo sapiens
cttttctggatcatt

SEQ ID NO: 428116 - DNA, 15 bp, Homo sapiens
ttttctggatcattt

SEQ ID NO: 428117 - DNA, 15 bp, Homo sapiens
tttctggatcatttt

SEQ ID NO: 428118 - DNA, 15 bp, Homo sapiens
ttctggatcattttc

SEQ ID NO: 428119 - DNA, 15 bp, Homo sapiens
tctggatcattttct

SEQ ID NO: 428120 - DNA, 15 bp, Homo sapiens
ctggatcattttctt

SEQ ID NO: 428121 - DNA, 15 bp, Homo sapiens
tggatcattttctta

SEQ ID NO: 428122 - DNA, 15 bp, Homo sapiens
ggatcattttcttag

SEQ ID NO: 428123 - DNA, 15 bp, Homo sapiens
gatcattttcttagg

SEQ ID NO: 428124 - DNA, 15 bp, Homo sapiens
atcattttcttagga

SEQ ID NO: 428125 - DNA, 15 bp, Homo sapiens
tcattttcttaggat

SEQ ID NO: 428126 - DNA, 15 bp, Homo sapiens
cattttcttaggata

SEQ ID NO: 428127 - DNA, 15 bp, Homo sapiens
attttcttaggatat

SEQ ID NO: 428128 - DNA, 15 bp, Homo sapiens
ttttcttaggatata

SEQ ID NO: 428129 - DNA, 15 bp, Homo sapiens
tttcttaggatatat

SEQ ID NO: 428130 - DNA, 15 bp, Homo sapiens
ttcttaggatatatt

SEQ ID NO: 428131 - DNA, 15 bp, Homo sapiens
cttaggatatattcc

SEQ ID NO: 428132 - DNA, 15 bp, Homo sapiens
ttaggatatattccc

SEQ ID NO: 428133 - DNA, 15 bp, Homo sapiens
taggatatattccca

SEQ ID NO: 428134 - DNA, 15 bp, Homo sapiens
aggatatattcccaa

SEQ ID NO: 428135 - DNA, 15 bp, Homo sapiens
ggatatattcccaaa

SEQ ID NO: 428136 - DNA, 15 bp, Homo sapiens
gatatattcccaaaa

SEQ ID NO: 428137 - DNA, 15 bp, Homo sapiens
atatattcccaaaag

SEQ ID NO: 428138 - DNA, 15 bp, Homo sapiens
tatattcccaaaagt

SEQ ID NO: 428139 - DNA, 15 bp, Homo sapiens
atattcccaaaagtg

SEQ ID NO: 428140 - DNA, 15 bp, Homo sapiens
tattcccaaaagtga

SEQ ID NO: 428141 - DNA, 15 bp, Homo sapiens
attcccaaaagtgaa

SEQ ID NO: 428142 - DNA, 15 bp, Homo sapiens
ttcccaaaagtgaaa

SEQ ID NO: 428143 - DNA, 15 bp, Homo sapiens
tcccaaaagtgaaat

SEQ ID NO: 428144 - DNA, 15 bp, Homo sapiens
cccaaaagtgaaatt

SEQ ID NO: 428145 - DNA, 15 bp, Homo sapiens
ccaaaagtgaaattc

SEQ ID NO: 428146 - DNA, 15 bp, Homo sapiens
caaaagtgaaattcc

SEQ ID NO: 428147 - DNA, 15 bp, Homo sapiens
aaaagtgaaattcct

SEQ ID NO: 428148 - DNA, 15 bp, Homo sapiens
aaagtgaaattcctg

SEQ ID NO: 428149 - DNA, 15 bp, Homo sapiens
aagtgaaattcctgt

SEQ ID NO: 428150 - DNA, 15 bp, Homo sapiens
agtgaaattcctgtt

SEQ ID NO: 428151 - DNA, 15 bp, Homo sapiens
gtgaaattcctgttt

SEQ ID NO: 428152 - DNA, 15 bp, Homo sapiens
tgaaattcctgtttc

SEQ ID NO: 428153 - DNA, 15 bp, Homo sapiens
gaaattcctgtttca

SEQ ID NO: 428154 - DNA, 15 bp, Homo sapiens
aaattcctgtttcac

SEQ ID NO: 428155 - DNA, 15 bp, Homo sapiens
aattcctgtttcaca

SEQ ID NO: 428156 - DNA, 15 bp, Homo sapiens
attcctgtttcacac

SEQ ID NO: 428157 - DNA, 15 bp, Homo sapiens
ttcctgtttcacaca

SEQ ID NO: 428158 - DNA, 15 bp, Homo sapiens
tcctgtttcacacaa

SEQ ID NO: 428159 - DNA, 15 bp, Homo sapiens
cctgtttcacacaat

SEQ ID NO: 428160 - DNA, 15 bp, Homo sapiens
ctgtttcacacaata

SEQ ID NO: 428161 - DNA, 15 bp, Homo sapiens
tgtttcacacaatat

SEQ ID NO: 428162 - DNA, 15 bp, Homo sapiens
gtttcacacaatatg

SEQ ID NO: 428163 - DNA, 15 bp, Homo sapiens
tttcacacaatatga

SEQ ID NO: 428164 - DNA, 15 bp, Homo sapiens
ttcacacaatatgac

SEQ ID NO: 428165 - DNA, 15 bp, Homo sapiens
tcacacaatatgacc

SEQ ID NO: 428166 - DNA, 15 bp, Homo sapiens
cacacaatatgacca

SEQ ID NO: 428167 - DNA, 15 bp, Homo sapiens
acacaatatgaccat

SEQ ID NO: 428168 - DNA, 15 bp, Homo sapiens
cacaatatgaccata

SEQ ID NO: 428169 - DNA, 15 bp, Homo sapiens
acaatatgaccatag

SEQ ID NO: 428170 - DNA, 15 bp, Homo sapiens
caatatgaccatagt

SEQ ID NO: 428171 - DNA, 15 bp, Homo sapiens
aatatgaccatagta

SEQ ID NO: 428172 - DNA, 15 bp, Homo sapiens
atatgaccatagtaa

SEQ ID NO: 428173 - DNA, 15 bp, Homo sapiens
tatgaccatagtaat

SEQ ID NO: 428174 - DNA, 15 bp, Homo sapiens
atgaccatagtaatg

SEQ ID NO: 428175 - DNA, 15 bp, Homo sapiens
tgaccatagtaatga

SEQ ID NO: 428176 - DNA, 15 bp, Homo sapiens
gaccatagtaatgac

SEQ ID NO: 428177 - DNA, 15 bp, Homo sapiens
accatagtaatgact

SEQ ID NO: 428178 - DNA, 15 bp, Homo sapiens
ccatagtaatgactt

SEQ ID NO: 428179 - DNA, 15 bp, Homo sapiens
catagtaatgacttt

SEQ ID NO: 428180 - DNA, 15 bp, Homo sapiens
atagtaatgactttt

SEQ ID NO: 428181 - DNA, 15 bp, Homo sapiens
tagtaatgacttttg

SEQ ID NO: 428182 - DNA, 15 bp, Homo sapiens
agtaatgacttttga

SEQ ID NO: 428183 - DNA, 15 bp, Homo sapiens
gtaatgacttttgat

SEQ ID NO: 428184 - DNA, 15 bp, Homo sapiens
taatgacttttgata

SEQ ID NO: 428185 - DNA, 15 bp, Homo sapiens
aatgacttttgatat

SEQ ID NO: 428186 - DNA, 15 bp, Homo sapiens
atgacttttgatata

SEQ ID NO: 428187 - DNA, 15 bp, Homo sapiens
tgacttttgatatat

SEQ ID NO: 428188 - DNA, 15 bp, Homo sapiens
gacttttgatatatt

SEQ ID NO: 428189 - DNA, 15 bp, Homo sapiens
acttttgatatattg

SEQ ID NO: 428190 - DNA, 15 bp, Homo sapiens
cttttgatatattgc

SEQ ID NO: 428191 - DNA, 15 bp, Homo sapiens
ttttgatatattgcc

SEQ ID NO: 428192 - DNA, 15 bp, Homo sapiens
tttgatatattgcca

SEQ ID NO: 428193 - DNA, 15 bp, Homo sapiens
ttgatatattgccag

SEQ ID NO: 428194 - DNA, 15 bp, Homo sapiens
tgatatattgccagc

SEQ ID NO: 428195 - DNA, 15 bp, Homo sapiens
gatatattgccagcc

SEQ ID NO: 428196 - DNA, 15 bp, Homo sapiens
atatattgccagcct

SEQ ID NO: 428197 - DNA, 15 bp, Homo sapiens
tatattgccagccta

SEQ ID NO: 428198 - DNA, 15 bp, Homo sapiens
atattgccagcctac

SEQ ID NO: 428199 - DNA, 15 bp, Homo sapiens
tattgccagcctact

SEQ ID NO: 428200 - DNA, 15 bp, Homo sapiens
attgccagcctactt

SEQ ID NO: 428201 - DNA, 15 bp, Homo sapiens
ttgccagcctacttt

SEQ ID NO: 428202 - DNA, 15 bp, Homo sapiens
tgccagcctactttc

SEQ ID NO: 428203 - DNA, 15 bp, Homo sapiens
gccagcctactttcc

SEQ ID NO: 428204 - DNA, 15 bp, Homo sapiens
ccagcctactttccc

SEQ ID NO: 428205 - DNA, 15 bp, Homo sapiens
cagcctactttccca

SEQ ID NO: 428206 - DNA, 15 bp, Homo sapiens
agcctactttcccaa

SEQ ID NO: 428207 - DNA, 15 bp, Homo sapiens
gcctactttcccaaa

SEQ ID NO: 428208 - DNA, 15 bp, Homo sapiens
cctactttcccaaat

SEQ ID NO: 428209 - DNA, 15 bp, Homo sapiens
ctactttcccaaatg

SEQ ID NO: 428210 - DNA, 15 bp, Homo sapiens
tactttcccaaatga

SEQ ID NO: 428211 - DNA, 15 bp, Homo sapiens
actttcccaaatgat

SEQ ID NO: 428212 - DNA, 15 bp, Homo sapiens
ctttcccaaatgatc

SEQ ID NO: 428213 - DNA, 15 bp, Homo sapiens
tttcccaaatgatca

SEQ ID NO: 428214 - DNA, 15 bp, Homo sapiens
ttcccaaatgatcaa

SEQ ID NO: 428215 - DNA, 15 bp, Homo sapiens
tcccaaatgatcaaa

SEQ ID NO: 428216 - DNA, 15 bp, Homo sapiens
cccaaatgatcaaac

SEQ ID NO: 428217 - DNA, 15 bp, Homo sapiens
ccaaatgatcaaacc

SEQ ID NO: 428218 - DNA, 15 bp, Homo sapiens
caaatgatcaaacca

SEQ ID NO: 428219 - DNA, 15 bp, Homo sapiens
aaatgatcaaaccaa

SEQ ID NO: 428220 - DNA, 15 bp, Homo sapiens
aatgatcaaaccaat

SEQ ID NO: 428221 - DNA, 15 bp, Homo sapiens
atgatcaaaccaatt

SEQ ID NO: 428222 - DNA, 15 bp, Homo sapiens
tgatcaaaccaattt

SEQ ID NO: 428223 - DNA, 15 bp, Homo sapiens
gatcaaaccaatttt

SEQ ID NO: 428224 - DNA, 15 bp, Homo sapiens
atcaaaccaattttt

SEQ ID NO: 428225 - DNA, 15 bp, Homo sapiens
tcaaaccaatttttt

SEQ ID NO: 428226 - DNA, 15 bp, Homo sapiens
caaaccaattttttg

SEQ ID NO: 428227 - DNA, 15 bp, Homo sapiens
aaaccaattttttgc

SEQ ID NO: 428228 - DNA, 15 bp, Homo sapiens
aaccaattttttgcc

SEQ ID NO: 428229 - DNA, 15 bp, Homo sapiens
accaattttttgcct

SEQ ID NO: 428230 - DNA, 15 bp, Homo sapiens
ccaattttttgcctc

SEQ ID NO: 428231 - DNA, 15 bp, Homo sapiens
caattttttgcctcc

SEQ ID NO: 428232 - DNA, 15 bp, Homo sapiens
aattttttgcctcca

SEQ ID NO: 428233 - DNA, 15 bp, Homo sapiens
attttttgcctccag

SEQ ID NO: 428234 - DNA, 15 bp, Homo sapiens
ttttttgcctccagc

SEQ ID NO: 428235 - DNA, 15 bp, Homo sapiens
tttttgcctccagca

SEQ ID NO: 428236 - DNA, 15 bp, Homo sapiens
ttttgcctccagcaa

SEQ ID NO: 428237 - DNA, 15 bp, Homo sapiens
tttgcctccagcaat

SEQ ID NO: 428238 - DNA, 15 bp, Homo sapiens
ttgcctccagcaatg

SEQ ID NO: 428239 - DNA, 15 bp, Homo sapiens
tgcctccagcaatgt

SEQ ID NO: 428240 - DNA, 15 bp, Homo sapiens
gcctccagcaatgtg

SEQ ID NO: 428241 - DNA, 15 bp, Homo sapiens
cctccagcaatgtgt

SEQ ID NO: 428242 - DNA, 15 bp, Homo sapiens
ctccagcaatgtgtg

SEQ ID NO: 428243 - DNA, 15 bp, Homo sapiens
tccagcaatgtgtga

SEQ ID NO: 428244 - DNA, 15 bp, Homo sapiens
ccagcaatgtgtgaa

SEQ ID NO: 428245 - DNA, 15 bp, Homo sapiens
cagcaatgtgtgaaa

SEQ ID NO: 428246 - DNA, 15 bp, Homo sapiens
agcaatgtgtgaaag

SEQ ID NO: 428247 - DNA, 15 bp, Homo sapiens
gcaatgtgtgaaagt

SEQ ID NO: 428248 - DNA, 15 bp, Homo sapiens
caatgtgtgaaagtg

SEQ ID NO: 428249 - DNA, 15 bp, Homo sapiens
aatgtgtgaaagtga

SEQ ID NO: 428250 - DNA, 15 bp, Homo sapiens
atgtgtgaaagtgaa

SEQ ID NO: 428251 - DNA, 15 bp, Homo sapiens
tgtgtgaaagtgaag

SEQ ID NO: 428252 - DNA, 15 bp, Homo sapiens
gtgtgaaagtgaagc

SEQ ID NO: 428253 - DNA, 15 bp, Homo sapiens
tgtgaaagtgaagct

SEQ ID NO: 428254 - DNA, 15 bp, Homo sapiens
gtgaaagtgaagctt

SEQ ID NO: 428255 - DNA, 15 bp, Homo sapiens
tgaaagtgaagcttt

SEQ ID NO: 428256 - DNA, 15 bp, Homo sapiens
gaaagtgaagcttta

SEQ ID NO: 428257 - DNA, 15 bp, Homo sapiens
aaagtgaagctttac

SEQ ID NO: 428258 - DNA, 15 bp, Homo sapiens
aagtgaagctttacc

SEQ ID NO: 428259 - DNA, 15 bp, Homo sapiens
agtgaagctttacca

SEQ ID NO: 428260 - DNA, 15 bp, Homo sapiens
gtgaagctttaccat

SEQ ID NO: 428261 - DNA, 15 bp, Homo sapiens
tgaagctttaccata

SEQ ID NO: 428262 - DNA, 15 bp, Homo sapiens
gaagctttaccatac

SEQ ID NO: 428263 - DNA, 15 bp, Homo sapiens
aagctttaccatacc

SEQ ID NO: 428264 - DNA, 15 bp, Homo sapiens
agctttaccataccc

SEQ ID NO: 428265 - DNA, 15 bp, Homo sapiens
gctttaccataccct

SEQ ID NO: 428266 - DNA, 15 bp, Homo sapiens
ctttaccataccctg

SEQ ID NO: 428267 - DNA, 15 bp, Homo sapiens
tttaccataccctgg

SEQ ID NO: 428268 - DNA, 15 bp, Homo sapiens
ttaccataccctggc

SEQ ID NO: 428269 - DNA, 15 bp, Homo sapiens
taccataccctggcc

SEQ ID NO: 428270 - DNA, 15 bp, Homo sapiens
accataccctggcct

SEQ ID NO: 428271 - DNA, 15 bp, Homo sapiens
ccataccctggcctg

SEQ ID NO: 428272 - DNA, 15 bp, Homo sapiens
cataccctggcctgt

SEQ ID NO: 428273 - DNA, 15 bp, Homo sapiens
ataccctggcctgtg

SEQ ID NO: 428274 - DNA, 15 bp, Homo sapiens
taccctggcctgtga

SEQ ID NO: 428275 - DNA, 15 bp, Homo sapiens
accctggcctgtgat

SEQ ID NO: 428276 - DNA, 15 bp, Homo sapiens
ccctggcctgtgatt

SEQ ID NO: 428277 - DNA, 15 bp, Homo sapiens
cctggcctgtgattt

SEQ ID NO: 428278 - DNA, 15 bp, Homo sapiens
ctggcctgtgatttc

SEQ ID NO: 428279 - DNA, 15 bp, Homo sapiens
tggcctgtgatttct

SEQ ID NO: 428280 - DNA, 15 bp, Homo sapiens
ggcctgtgatttctc

SEQ ID NO: 428281 - DNA, 15 bp, Homo sapiens
gcctgtgatttctca

SEQ ID NO: 428282 - DNA, 15 bp, Homo sapiens
cctgtgatttctcat

SEQ ID NO: 428283 - DNA, 15 bp, Homo sapiens
ctgtgatttctcatt

SEQ ID NO: 428284 - DNA, 15 bp, Homo sapiens
tgtgatttctcattt

SEQ ID NO: 428285 - DNA, 15 bp, Homo sapiens
gtgatttctcatttt

SEQ ID NO: 428286 - DNA, 15 bp, Homo sapiens
tgatttctcattttt

SEQ ID NO: 428287 - DNA, 15 bp, Homo sapiens
gatttctcatttttg

SEQ ID NO: 428288 - DNA, 15 bp, Homo sapiens
atttctcatttttgt

SEQ ID NO: 428289 - DNA, 15 bp, Homo sapiens
tttctcatttttgtt

SEQ ID NO: 428290 - DNA, 15 bp, Homo sapiens
ttctcatttttgttc

SEQ ID NO: 428291 - DNA, 15 bp, Homo sapiens
tctcatttttgttct

SEQ ID NO: 428292 - DNA, 15 bp, Homo sapiens
ctcatttttgttcta

SEQ ID NO: 428293 - DNA, 15 bp, Homo sapiens
tcatttttgttctat

SEQ ID NO: 428294 - DNA, 15 bp, Homo sapiens
catttttgttctatt

SEQ ID NO: 428295 - DNA, 15 bp, Homo sapiens
atttttgttctatta

SEQ ID NO: 428296 - DNA, 15 bp, Homo sapiens
tttttgttctattat

SEQ ID NO: 428297 - DNA, 15 bp, Homo sapiens
ttttgttctattatt

SEQ ID NO: 428298 - DNA, 15 bp, Homo sapiens
tttgttctattatta

SEQ ID NO: 428299 - DNA, 15 bp, Homo sapiens
ttgttctattattag

SEQ ID NO: 428300 - DNA, 15 bp, Homo sapiens
tgttctattattagt

SEQ ID NO: 428301 - DNA, 15 bp, Homo sapiens
gttctattattagtg

SEQ ID NO: 428302 - DNA, 15 bp, Homo sapiens
ttctattattagtga

SEQ ID NO: 428303 - DNA, 15 bp, Homo sapiens
tctattattagtgat

SEQ ID NO: 428304 - DNA, 15 bp, Homo sapiens
ctattattagtgatc

SEQ ID NO: 428305 - DNA, 15 bp, Homo sapiens
tattattagtgatcc

SEQ ID NO: 428306 - DNA, 15 bp, Homo sapiens
attattagtgatcct

SEQ ID NO: 428307 - DNA, 15 bp, Homo sapiens
ttattagtgatcctt

SEQ ID NO: 428308 - DNA, 15 bp, Homo sapiens
tattagtgatccttg

SEQ ID NO: 428309 - DNA, 15 bp, Homo sapiens
attagtgatccttgt

SEQ ID NO: 428310 - DNA, 15 bp, Homo sapiens
ttagtgatccttgta

SEQ ID NO: 428311 - DNA, 15 bp, Homo sapiens
tagtgatccttgtat

SEQ ID NO: 428312 - DNA, 15 bp, Homo sapiens
agtgatccttgtatt

SEQ ID NO: 428313 - DNA, 15 bp, Homo sapiens
gtgatccttgtattg

SEQ ID NO: 428314 - DNA, 15 bp, Homo sapiens
tgatccttgtattgt

SEQ ID NO: 428315 - DNA, 15 bp, Homo sapiens
gatccttgtattgtt

SEQ ID NO: 428316 - DNA, 15 bp, Homo sapiens
atccttgtattgtta

SEQ ID NO: 428317 - DNA, 15 bp, Homo sapiens
tccttgtattgttag

SEQ ID NO: 428318 - DNA, 15 bp, Homo sapiens
ccttgtattgttagc

SEQ ID NO: 428319 - DNA, 15 bp, Homo sapiens
cttgtattgttagca

SEQ ID NO: 428320 - DNA, 15 bp, Homo sapiens
ttgtattgttagcag

SEQ ID NO: 428321 - DNA, 15 bp, Homo sapiens
tgtattgttagcagt

SEQ ID NO: 428322 - DNA, 15 bp, Homo sapiens
gtattgttagcagta

SEQ ID NO: 428323 - DNA, 15 bp, Homo sapiens
tattgttagcagtaa

SEQ ID NO: 428324 - DNA, 15 bp, Homo sapiens
attgttagcagtaaa

SEQ ID NO: 428325 - DNA, 15 bp, Homo sapiens
ttgttagcagtaaaa

SEQ ID NO: 428326 - DNA, 15 bp, Homo sapiens
tgttagcagtaaaat

SEQ ID NO: 428327 - DNA, 15 bp, Homo sapiens
gttagcagtaaaata

SEQ ID NO: 428328 - DNA, 15 bp, Homo sapiens
ttagcagtaaaatac

SEQ ID NO: 428329 - DNA, 15 bp, Homo sapiens
tagcagtaaaatact

SEQ ID NO: 428330 - DNA, 15 bp, Homo sapiens
agcagtaaaatacta

SEQ ID NO: 428331 - DNA, 15 bp, Homo sapiens
gcagtaaaatactag

SEQ ID NO: 428332 - DNA, 15 bp, Homo sapiens
cagtaaaatactagt

SEQ ID NO: 428333 - DNA, 15 bp, Homo sapiens
agtaaaatactagta

SEQ ID NO: 428334 - DNA, 15 bp, Homo sapiens
gtaaaatactagtac

SEQ ID NO: 428335 - DNA, 15 bp, Homo sapiens
taaaatactagtact

SEQ ID NO: 428336 - DNA, 15 bp, Homo sapiens
aaaatactagtactt

SEQ ID NO: 428337 - DNA, 15 bp, Homo sapiens
aaatactagtacttc

SEQ ID NO: 428338 - DNA, 15 bp, Homo sapiens
aatactagtacttca

SEQ ID NO: 428339 - DNA, 15 bp, Homo sapiens
atactagtacttcat

SEQ ID NO: 428340 - DNA, 15 bp, Homo sapiens
tactagtacttcata

SEQ ID NO: 428341 - DNA, 15 bp, Homo sapiens
actagtacttcatag

SEQ ID NO: 428342 - DNA, 15 bp, Homo sapiens
ctagtacttcataga

SEQ ID NO: 428343 - DNA, 15 bp, Homo sapiens
tagtacttcatagat

SEQ ID NO: 428344 - DNA, 15 bp, Homo sapiens
agtacttcatagatg

SEQ ID NO: 428345 - DNA, 15 bp, Homo sapiens
gtacttcatagatgt

SEQ ID NO: 428346 - DNA, 15 bp, Homo sapiens
tacttcatagatgta

SEQ ID NO: 428347 - DNA, 15 bp, Homo sapiens
acttcatagatgtat

SEQ ID NO: 428348 - DNA, 15 bp, Homo sapiens
cttcatagatgtata

SEQ ID NO: 428349 - DNA, 15 bp, Homo sapiens
ttcatagatgtatag

SEQ ID NO: 428350 - DNA, 15 bp, Homo sapiens
tcatagatgtataga

SEQ ID NO: 428351 - DNA, 15 bp, Homo sapiens
catagatgtatagaa

SEQ ID NO: 428352 - DNA, 15 bp, Homo sapiens
atagatgtatagaaa

SEQ ID NO: 428353 - DNA, 15 bp, Homo sapiens
tagatgtatagaaat

SEQ ID NO: 428354 - DNA, 15 bp, Homo sapiens
agatgtatagaaatt

SEQ ID NO: 428355 - DNA, 15 bp, Homo sapiens
gatgtatagaaattt

SEQ ID NO: 428356 - DNA, 15 bp, Homo sapiens
atgtatagaaattta

SEQ ID NO: 428357 - DNA, 15 bp, Homo sapiens
tgtatagaaatttag

SEQ ID NO: 428358 - DNA, 15 bp, Homo sapiens
gtatagaaatttaga

SEQ ID NO: 428359 - DNA, 15 bp, Homo sapiens
tatagaaatttagaa

SEQ ID NO: 428360 - DNA, 15 bp, Homo sapiens
atagaaatttagaaa

SEQ ID NO: 428361 - DNA, 15 bp, Homo sapiens
tagaaatttagaaaa

SEQ ID NO: 428362 - DNA, 15 bp, Homo sapiens
agaaatttagaaaac

SEQ ID NO: 428363 - DNA, 15 bp, Homo sapiens
gaaatttagaaaaca

SEQ ID NO: 428364 - DNA, 15 bp, Homo sapiens
aaatttagaaaacag

SEQ ID NO: 428365 - DNA, 15 bp, Homo sapiens
aatttagaaaacagt

SEQ ID NO: 428366 - DNA, 15 bp, Homo sapiens
atttagaaaacagtt

SEQ ID NO: 428367 - DNA, 15 bp, Homo sapiens
tttagaaaacagttt

SEQ ID NO: 428368 - DNA, 15 bp, Homo sapiens
ttagaaaacagtttt

SEQ ID NO: 428369 - DNA, 15 bp, Homo sapiens
tagaaaacagttttg

SEQ ID NO: 428370 - DNA, 15 bp, Homo sapiens
agaaaacagttttgg

SEQ ID NO: 428371 - DNA, 15 bp, Homo sapiens
gaaaacagttttgga

SEQ ID NO: 428372 - DNA, 15 bp, Homo sapiens
aaaacagttttggaa

SEQ ID NO: 428373 - DNA, 15 bp, Homo sapiens
aaacagttttggaat

SEQ ID NO: 428374 - DNA, 15 bp, Homo sapiens
aacagttttggaata

SEQ ID NO: 428375 - DNA, 15 bp, Homo sapiens
acagttttggaatat

SEQ ID NO: 428376 - DNA, 15 bp, Homo sapiens
cagttttggaatatc

SEQ ID NO: 428377 - DNA, 15 bp, Homo sapiens
agttttggaatatca

SEQ ID NO: 428378 - DNA, 15 bp, Homo sapiens
gttttggaatatcag

SEQ ID NO: 428379 - DNA, 15 bp, Homo sapiens
ttttggaatatcaga

SEQ ID NO: 428380 - DNA, 15 bp, Homo sapiens
tttggaatatcagac

SEQ ID NO: 428381 - DNA, 15 bp, Homo sapiens
ttggaatatcagaca

SEQ ID NO: 428382 - DNA, 15 bp, Homo sapiens
tggaatatcagacac

SEQ ID NO: 428383 - DNA, 15 bp, Homo sapiens
ggaatatcagacacc

SEQ ID NO: 428384 - DNA, 15 bp, Homo sapiens
gaatatcagacacct

SEQ ID NO: 428385 - DNA, 15 bp, Homo sapiens
aatatcagacacctg

SEQ ID NO: 428386 - DNA, 15 bp, Homo sapiens
atatcagacacctga

SEQ ID NO: 428387 - DNA, 15 bp, Homo sapiens
tatcagacacctgag

SEQ ID NO: 428388 - DNA, 15 bp, Homo sapiens
atcagacacctgagt

SEQ ID NO: 428389 - DNA, 15 bp, Homo sapiens
tcagacacctgagtc

SEQ ID NO: 428390 - DNA, 15 bp, Homo sapiens
cagacacctgagtca

SEQ ID NO: 428391 - DNA, 15 bp, Homo sapiens
agacacctgagtcaa

SEQ ID NO: 428392 - DNA, 15 bp, Homo sapiens
gacacctgagtcaag

SEQ ID NO: 428393 - DNA, 15 bp, Homo sapiens
acacctgagtcaagg

SEQ ID NO: 428394 - DNA, 15 bp, Homo sapiens
cacctgagtcaaggt

SEQ ID NO: 428395 - DNA, 15 bp, Homo sapiens
acctgagtcaaggtt

SEQ ID NO: 428396 - DNA, 15 bp, Homo sapiens
cctgagtcaaggttc

SEQ ID NO: 428397 - DNA, 15 bp, Homo sapiens
ctgagtcaaggttct

SEQ ID NO: 428398 - DNA, 15 bp, Homo sapiens
tgagtcaaggttctc

SEQ ID NO: 428399 - DNA, 15 bp, Homo sapiens
gagtcaaggttctct

SEQ ID NO: 428400 - DNA, 15 bp, Homo sapiens
agtcaaggttctctc

SEQ ID NO: 428401 - DNA, 15 bp, Homo sapiens
gtcaaggttctctcc

SEQ ID NO: 428402 - DNA, 15 bp, Homo sapiens
tcaaggttctctcca

SEQ ID NO: 428403 - DNA, 15 bp, Homo sapiens
caaggttctctccac

SEQ ID NO: 428404 - DNA, 15 bp, Homo sapiens
aaggttctctccaca

SEQ ID NO: 428405 - DNA, 15 bp, Homo sapiens
aggttctctccacaa

SEQ ID NO: 428406 - DNA, 15 bp, Homo sapiens
ggttctctccacaaa

SEQ ID NO: 428407 - DNA, 15 bp, Homo sapiens
gttctctccacaaag

SEQ ID NO: 428408 - DNA, 15 bp, Homo sapiens
ttctctccacaaaga

SEQ ID NO: 428409 - DNA, 15 bp, Homo sapiens
tctctccacaaagag

SEQ ID NO: 428410 - DNA, 15 bp, Homo sapiens
ctctccacaaagagg

SEQ ID NO: 428411 - DNA, 15 bp, Homo sapiens
tctccacaaagagga

SEQ ID NO: 428412 - DNA, 15 bp, Homo sapiens
ctccacaaagaggaa

SEQ ID NO: 428413 - DNA, 15 bp, Homo sapiens
tccacaaagaggaag

SEQ ID NO: 428414 - DNA, 15 bp, Homo sapiens
ccacaaagaggaaga

SEQ ID NO: 428415 - DNA, 15 bp, Homo sapiens
cacaaagaggaagag

SEQ ID NO: 428416 - DNA, 15 bp, Homo sapiens
acaaagaggaagagg

SEQ ID NO: 428417 - DNA, 15 bp, Homo sapiens
caaagaggaagagga

SEQ ID NO: 428418 - DNA, 15 bp, Homo sapiens
aaagaggaagaggag

SEQ ID NO: 428419 - DNA, 15 bp, Homo sapiens
aagaggaagaggaga

SEQ ID NO: 428420 - DNA, 15 bp, Homo sapiens
agaggaagaggagaa

SEQ ID NO: 428421 - DNA, 15 bp, Homo sapiens
gaggaagaggagaac

SEQ ID NO: 428422 - DNA, 15 bp, Homo sapiens
aggaagaggagaact

SEQ ID NO: 428423 - DNA, 15 bp, Homo sapiens
ggaagaggagaactg

SEQ ID NO: 428424 - DNA, 15 bp, Homo sapiens
gaagaggagaactgg

SEQ ID NO: 428425 - DNA, 15 bp, Homo sapiens
aagaggagaactggt

SEQ ID NO: 428426 - DNA, 15 bp, Homo sapiens
agaggagaactggtt

SEQ ID NO: 428427 - DNA, 15 bp, Homo sapiens
gaggagaactggttt

SEQ ID NO: 428428 - DNA, 15 bp, Homo sapiens
aggagaactggtttg

SEQ ID NO: 428429 - DNA, 15 bp, Homo sapiens
ggagaactggtttga

SEQ ID NO: 428430 - DNA, 15 bp, Homo sapiens
gagaactggtttgat

SEQ ID NO: 428431 - DNA, 15 bp, Homo sapiens
agaactggtttgatg

SEQ ID NO: 428432 - DNA, 15 bp, Homo sapiens
gaactggtttgatgt

SEQ ID NO: 428433 - DNA, 15 bp, Homo sapiens
aactggtttgatgtt

SEQ ID NO: 428434 - DNA, 15 bp, Homo sapiens
actggtttgatgttt

SEQ ID NO: 428435 - DNA, 15 bp, Homo sapiens
ctggtttgatgtttg

SEQ ID NO: 428436 - DNA, 15 bp, Homo sapiens
tggtttgatgtttgg

SEQ ID NO: 428437 - DNA, 15 bp, Homo sapiens
ggtttgatgtttggg

SEQ ID NO: 428438 - DNA, 15 bp, Homo sapiens
gtttgatgtttgggt

SEQ ID NO: 428439 - DNA, 15 bp, Homo sapiens
tttgatgtttgggtt

SEQ ID NO: 428440 - DNA, 15 bp, Homo sapiens
ttgatgtttgggtta

SEQ ID NO: 428441 - DNA, 15 bp, Homo sapiens
tgatgtttgggttag

SEQ ID NO: 428442 - DNA, 15 bp, Homo sapiens
gatgtttgggttagt

SEQ ID NO: 428443 - DNA, 15 bp, Homo sapiens
atgtttgggttagtc

SEQ ID NO: 428444 - DNA, 15 bp, Homo sapiens
tgtttgggttagtca

SEQ ID NO: 428445 - DNA, 15 bp, Homo sapiens
gtttgggttagtcat

SEQ ID NO: 428446 - DNA, 15 bp, Homo sapiens
tttgggttagtcatg

SEQ ID NO: 428447 - DNA, 15 bp, Homo sapiens
ttgggttagtcatgc

SEQ ID NO: 428448 - DNA, 15 bp, Homo sapiens
tgggttagtcatgcc

SEQ ID NO: 428449 - DNA, 15 bp, Homo sapiens
gggttagtcatgcct

SEQ ID NO: 428450 - DNA, 15 bp, Homo sapiens
ggttagtcatgccta

SEQ ID NO: 428451 - DNA, 15 bp, Homo sapiens
gttagtcatgcctag

SEQ ID NO: 428452 - DNA, 15 bp, Homo sapiens
ttagtcatgcctaga

SEQ ID NO: 428453 - DNA, 15 bp, Homo sapiens
tagtcatgcctagaa

SEQ ID NO: 428454 - DNA, 15 bp, Homo sapiens
agtcatgcctagaag

SEQ ID NO: 428455 - DNA, 15 bp, Homo sapiens
gtcatgcctagaagg

SEQ ID NO: 428456 - DNA, 15 bp, Homo sapiens
tcatgcctagaagga

SEQ ID NO: 428457 - DNA, 15 bp, Homo sapiens
catgcctagaaggat

SEQ ID NO: 428458 - DNA, 15 bp, Homo sapiens
atgcctagaaggata

SEQ ID NO: 428459 - DNA, 15 bp, Homo sapiens
tgcctagaaggatag

SEQ ID NO: 428460 - DNA, 15 bp, Homo sapiens
gcctagaaggatagg

SEQ ID NO: 428461 - DNA, 15 bp, Homo sapiens
cctagaaggatagga

SEQ ID NO: 428462 - DNA, 15 bp, Homo sapiens
ctagaaggataggag

SEQ ID NO: 428463 - DNA, 15 bp, Homo sapiens
tagaaggataggaga

SEQ ID NO: 428464 - DNA, 15 bp, Homo sapiens
agaaggataggagaa

SEQ ID NO: 428465 - DNA, 15 bp, Homo sapiens
gaaggataggagaaa

SEQ ID NO: 428466 - DNA, 15 bp, Homo sapiens
aaggataggagaaaa

SEQ ID NO: 428467 - DNA, 15 bp, Homo sapiens
aggataggagaaaag

SEQ ID NO: 428468 - DNA, 15 bp, Homo sapiens
ggataggagaaaagc

SEQ ID NO: 428469 - DNA, 15 bp, Homo sapiens
gataggagaaaagct

SEQ ID NO: 428470 - DNA, 15 bp, Homo sapiens
ataggagaaaagctc

SEQ ID NO: 428471 - DNA, 15 bp, Homo sapiens
taggagaaaagctct

SEQ ID NO: 428472 - DNA, 15 bp, Homo sapiens
aggagaaaagctctc

SEQ ID NO: 428473 - DNA, 15 bp, Homo sapiens
ggagaaaagctctcc

SEQ ID NO: 428474 - DNA, 15 bp, Homo sapiens
gagaaaagctctcca

SEQ ID NO: 428475 - DNA, 15 bp, Homo sapiens
agaaaagctctccat

SEQ ID NO: 428476 - DNA, 15 bp, Homo sapiens
gaaaagctctccatg

SEQ ID NO: 428477 - DNA, 15 bp, Homo sapiens
aaaagctctccatgg

SEQ ID NO: 428478 - DNA, 15 bp, Homo sapiens
aaagctctccatggc

SEQ ID NO: 428479 - DNA, 15 bp, Homo sapiens
aagctctccatggct

SEQ ID NO: 428480 - DNA, 15 bp, Homo sapiens
agctctccatggctt

SEQ ID NO: 428481 - DNA, 15 bp, Homo sapiens
gctctccatggcttg

SEQ ID NO: 428482 - DNA, 15 bp, Homo sapiens
ctctccatggcttgt

SEQ ID NO: 428483 - DNA, 15 bp, Homo sapiens
tctccatggcttgtt

SEQ ID NO: 428484 - DNA, 15 bp, Homo sapiens
ctccatggcttgtta

SEQ ID NO: 428485 - DNA, 15 bp, Homo sapiens
tccatggcttgttaa

SEQ ID NO: 428486 - DNA, 15 bp, Homo sapiens
ccatggcttgttaaa

SEQ ID NO: 428487 - DNA, 15 bp, Homo sapiens
catggcttgttaaac

SEQ ID NO: 428488 - DNA, 15 bp, Homo sapiens
atggcttgttaaaca

SEQ ID NO: 428489 - DNA, 15 bp, Homo sapiens
tggcttgttaaacac

SEQ ID NO: 428490 - DNA, 15 bp, Homo sapiens
ggcttgttaaacaca

SEQ ID NO: 428491 - DNA, 15 bp, Homo sapiens
gcttgttaaacacat

SEQ ID NO: 428492 - DNA, 15 bp, Homo sapiens
cttgttaaacacatt

SEQ ID NO: 428493 - DNA, 15 bp, Homo sapiens
ttgttaaacacatta

SEQ ID NO: 428494 - DNA, 15 bp, Homo sapiens
tgttaaacacattag

SEQ ID NO: 428495 - DNA, 15 bp, Homo sapiens
gttaaacacattagt

SEQ ID NO: 428496 - DNA, 15 bp, Homo sapiens
ttaaacacattagtt

SEQ ID NO: 428497 - DNA, 15 bp, Homo sapiens
taaacacattagttg

SEQ ID NO: 428498 - DNA, 15 bp, Homo sapiens
aaacacattagttga

SEQ ID NO: 428499 - DNA, 15 bp, Homo sapiens
aacacattagttgaa

SEQ ID NO: 428500 - DNA, 15 bp, Homo sapiens
acacattagttgaag

SEQ ID NO: 428501 - DNA, 15 bp, Homo sapiens
cacattagttgaaga

SEQ ID NO: 428502 - DNA, 15 bp, Homo sapiens
acattagttgaagaa

SEQ ID NO: 428503 - DNA, 15 bp, Homo sapiens
cattagttgaagaaa

SEQ ID NO: 428504 - DNA, 15 bp, Homo sapiens
attagttgaagaaat

SEQ ID NO: 428505 - DNA, 15 bp, Homo sapiens
ttagttgaagaaatt

SEQ ID NO: 428506 - DNA, 15 bp, Homo sapiens
tagttgaagaaattt

SEQ ID NO: 428507 - DNA, 15 bp, Homo sapiens
agttgaagaaattta

SEQ ID NO: 428508 - DNA, 15 bp, Homo sapiens
gttgaagaaatttat

SEQ ID NO: 428509 - DNA, 15 bp, Homo sapiens
ttgaagaaatttata

SEQ ID NO: 428510 - DNA, 15 bp, Homo sapiens
tgaagaaatttatat

SEQ ID NO: 428511 - DNA, 15 bp, Homo sapiens
gaagaaatttatatt

SEQ ID NO: 428512 - DNA, 15 bp, Homo sapiens
aagaaatttatattt

SEQ ID NO: 428513 - DNA, 15 bp, Homo sapiens
agaaatttatatttg

SEQ ID NO: 428514 - DNA, 15 bp, Homo sapiens
gaaatttatatttgt

SEQ ID NO: 428515 - DNA, 15 bp, Homo sapiens
aaatttatatttgtc

SEQ ID NO: 428516 - DNA, 15 bp, Homo sapiens
aatttatatttgtct

SEQ ID NO: 428517 - DNA, 15 bp, Homo sapiens
atttatatttgtctg

SEQ ID NO: 428518 - DNA, 15 bp, Homo sapiens
tttatatttgtctga

SEQ ID NO: 428519 - DNA, 15 bp, Homo sapiens
ttatatttgtctgaa

SEQ ID NO: 428520 - DNA, 15 bp, Homo sapiens
tatatttgtctgaaa

SEQ ID NO: 428521 - DNA, 15 bp, Homo sapiens
atatttgtctgaaat

SEQ ID NO: 428522 - DNA, 15 bp, Homo sapiens
tatttgtctgaaatt

SEQ ID NO: 428523 - DNA, 15 bp, Homo sapiens
atttgtctgaaatta

SEQ ID NO: 428524 - DNA, 15 bp, Homo sapiens
tttgtctgaaattag

SEQ ID NO: 428525 - DNA, 15 bp, Homo sapiens
ttgtctgaaattagt

SEQ ID NO: 428526 - DNA, 15 bp, Homo sapiens
tgtctgaaattagtg

SEQ ID NO: 428527 - DNA, 15 bp, Homo sapiens
gtctgaaattagtgt

SEQ ID NO: 428528 - DNA, 15 bp, Homo sapiens
tctgaaattagtgtg

SEQ ID NO: 428529 - DNA, 15 bp, Homo sapiens
ctgaaattagtgtgt

SEQ ID NO: 428530 - DNA, 15 bp, Homo sapiens
tgaaattagtgtgtg

SEQ ID NO: 428531 - DNA, 15 bp, Homo sapiens
gaaattagtgtgtgt

SEQ ID NO: 428532 - DNA, 15 bp, Homo sapiens
aaattagtgtgtgtg

SEQ ID NO: 428533 - DNA, 15 bp, Homo sapiens
aattagtgtgtgtga

SEQ ID NO: 428534 - DNA, 15 bp, Homo sapiens
attagtgtgtgtgat

SEQ ID NO: 428535 - DNA, 15 bp, Homo sapiens
ttagtgtgtgtgatg

SEQ ID NO: 428536 - DNA, 15 bp, Homo sapiens
tagtgtgtgtgatgt

SEQ ID NO: 428537 - DNA, 15 bp, Homo sapiens
agtgtgtgtgatgtc

SEQ ID NO: 428538 - DNA, 15 bp, Homo sapiens
gtgtgtgtgatgtca

SEQ ID NO: 428539 - DNA, 15 bp, Homo sapiens
tgtgtgtgatgtcat

SEQ ID NO: 428540 - DNA, 15 bp, Homo sapiens
gtgtgtgatgtcatc

SEQ ID NO: 428541 - DNA, 15 bp, Homo sapiens
tgtgtgatgtcatct

SEQ ID NO: 428542 - DNA, 15 bp, Homo sapiens
gtgtgatgtcatcta

SEQ ID NO: 428543 - DNA, 15 bp, Homo sapiens
tgtgatgtcatctag

SEQ ID NO: 428544 - DNA, 15 bp, Homo sapiens
gtgatgtcatctagc

SEQ ID NO: 428545 - DNA, 15 bp, Homo sapiens
tgatgtcatctagct

SEQ ID NO: 428546 - DNA, 15 bp, Homo sapiens
gatgtcatctagctg

SEQ ID NO: 428547 - DNA, 15 bp, Homo sapiens
atgtcatctagctga

SEQ ID NO: 428548 - DNA, 15 bp, Homo sapiens
tgtcatctagctgac

SEQ ID NO: 428549 - DNA, 15 bp, Homo sapiens
gtcatctagctgacc

SEQ ID NO: 428550 - DNA, 15 bp, Homo sapiens
tcatctagctgacca

SEQ ID NO: 428551 - DNA, 15 bp, Homo sapiens
catctagctgaccat

SEQ ID NO: 428552 - DNA, 15 bp, Homo sapiens
atctagctgaccatt

SEQ ID NO: 428553 - DNA, 15 bp, Homo sapiens
tctagctgaccattt

SEQ ID NO: 428554 - DNA, 15 bp, Homo sapiens
ctagctgaccattta

SEQ ID NO: 428555 - DNA, 15 bp, Homo sapiens
tagctgaccatttat

SEQ ID NO: 428556 - DNA, 15 bp, Homo sapiens
agctgaccatttata

SEQ ID NO: 428557 - DNA, 15 bp, Homo sapiens
gctgaccatttatac

SEQ ID NO: 428558 - DNA, 15 bp, Homo sapiens
ctgaccatttatacc

SEQ ID NO: 428559 - DNA, 15 bp, Homo sapiens
tgaccatttatacct

SEQ ID NO: 428560 - DNA, 15 bp, Homo sapiens
gaccatttatacctc

SEQ ID NO: 428561 - DNA, 15 bp, Homo sapiens
accatttatacctcc

SEQ ID NO: 428562 - DNA, 15 bp, Homo sapiens
ccatttatacctcct

SEQ ID NO: 428563 - DNA, 15 bp, Homo sapiens
catttatacctcctt

SEQ ID NO: 428564 - DNA, 15 bp, Homo sapiens
atttatacctcctta

SEQ ID NO: 428565 - DNA, 15 bp, Homo sapiens
tttatacctccttag

SEQ ID NO: 428566 - DNA, 15 bp, Homo sapiens
ttatacctccttaga

SEQ ID NO: 428567 - DNA, 15 bp, Homo sapiens
tatacctccttagag

SEQ ID NO: 428568 - DNA, 15 bp, Homo sapiens
atacctccttagaga

SEQ ID NO: 428569 - DNA, 15 bp, Homo sapiens
tacctccttagagaa

SEQ ID NO: 428570 - DNA, 15 bp, Homo sapiens
acctccttagagaat

SEQ ID NO: 428571 - DNA, 15 bp, Homo sapiens
cctccttagagaatt

SEQ ID NO: 428572 - DNA, 15 bp, Homo sapiens
ctccttagagaattg

SEQ ID NO: 428573 - DNA, 15 bp, Homo sapiens
tccttagagaattgt

SEQ ID NO: 428574 - DNA, 15 bp, Homo sapiens
ccttagagaattgtt

SEQ ID NO: 428575 - DNA, 15 bp, Homo sapiens
cttagagaattgttt

SEQ ID NO: 428576 - DNA, 15 bp, Homo sapiens
ttagagaattgtttt

SEQ ID NO: 428577 - DNA, 15 bp, Homo sapiens
tagagaattgttttg

SEQ ID NO: 428578 - DNA, 15 bp, Homo sapiens
agagaattgttttgc

SEQ ID NO: 428579 - DNA, 15 bp, Homo sapiens
gagaattgttttgcc

SEQ ID NO: 428580 - DNA, 15 bp, Homo sapiens
agaattgttttgccc

SEQ ID NO: 428581 - DNA, 15 bp, Homo sapiens
gaattgttttgccct

SEQ ID NO: 428582 - DNA, 15 bp, Homo sapiens
aattgttttgccctt

SEQ ID NO: 428583 - DNA, 15 bp, Homo sapiens
attgttttgcccttt

SEQ ID NO: 428584 - DNA, 15 bp, Homo sapiens
ttgttttgccctttt

SEQ ID NO: 428585 - DNA, 15 bp, Homo sapiens
tgttttgccctttta

SEQ ID NO: 428586 - DNA, 15 bp, Homo sapiens
gttttgcccttttat

SEQ ID NO: 428587 - DNA, 15 bp, Homo sapiens
ttttgcccttttatt

SEQ ID NO: 428588 - DNA, 15 bp, Homo sapiens
tttgcccttttattc

SEQ ID NO: 428589 - DNA, 15 bp, Homo sapiens
ttgcccttttattct

SEQ ID NO: 428590 - DNA, 15 bp, Homo sapiens
tgcccttttattctg

SEQ ID NO: 428591 - DNA, 15 bp, Homo sapiens
gcccttttattctgg

SEQ ID NO: 428592 - DNA, 15 bp, Homo sapiens
cccttttattctgga

SEQ ID NO: 428593 - DNA, 15 bp, Homo sapiens
ccttttattctggaa

SEQ ID NO: 428594 - DNA, 15 bp, Homo sapiens
cttttattctggaag

SEQ ID NO: 428595 - DNA, 15 bp, Homo sapiens
ttttattctggaaga

SEQ ID NO: 428596 - DNA, 15 bp, Homo sapiens
tttattctggaagaa

SEQ ID NO: 428597 - DNA, 15 bp, Homo sapiens
ttattctggaagaaa

SEQ ID NO: 428598 - DNA, 15 bp, Homo sapiens
tattctggaagaaac

SEQ ID NO: 428599 - DNA, 15 bp, Homo sapiens
attctggaagaaacc

SEQ ID NO: 428600 - DNA, 15 bp, Homo sapiens
ttctggaagaaaccg

SEQ ID NO: 428601 - DNA, 15 bp, Homo sapiens
tctggaagaaaccgg

SEQ ID NO: 428602 - DNA, 15 bp, Homo sapiens
ctggaagaaaccggt

SEQ ID NO: 428603 - DNA, 15 bp, Homo sapiens
tggaagaaaccggtt

SEQ ID NO: 428604 - DNA, 15 bp, Homo sapiens
ggaagaaaccggttc

SEQ ID NO: 428605 - DNA, 15 bp, Homo sapiens
gaagaaaccggttca

SEQ ID NO: 428606 - DNA, 15 bp, Homo sapiens
aagaaaccggttcac

SEQ ID NO: 428607 - DNA, 15 bp, Homo sapiens
agaaaccggttcaca

SEQ ID NO: 428608 - DNA, 15 bp, Homo sapiens
gaaaccggttcacaa

SEQ ID NO: 428609 - DNA, 15 bp, Homo sapiens
aaaccggttcacaaa

SEQ ID NO: 428610 - DNA, 15 bp, Homo sapiens
aaccggttcacaaaa

SEQ ID NO: 428611 - DNA, 15 bp, Homo sapiens
accggttcacaaaaa

SEQ ID NO: 428612 - DNA, 15 bp, Homo sapiens
ccggttcacaaaaaa

SEQ ID NO: 428613 - DNA, 15 bp, Homo sapiens
cggttcacaaaaaaa

SEQ ID NO: 428614 - DNA, 15 bp, Homo sapiens
ggttcacaaaaaaac

SEQ ID NO: 428615 - DNA, 15 bp, Homo sapiens
gttcacaaaaaaacc

SEQ ID NO: 428616 - DNA, 15 bp, Homo sapiens
ttcacaaaaaaaccg

SEQ ID NO: 428617 - DNA, 15 bp, Homo sapiens
tcacaaaaaaaccgc

SEQ ID NO: 428618 - DNA, 15 bp, Homo sapiens
cacaaaaaaaccgct

SEQ ID NO: 428619 - DNA, 15 bp, Homo sapiens
acaaaaaaaccgctg

SEQ ID NO: 428620 - DNA, 15 bp, Homo sapiens
caaaaaaaccgctgc

SEQ ID NO: 428621 - DNA, 15 bp, Homo sapiens
aaaaaaaccgctgca

SEQ ID NO: 428622 - DNA, 15 bp, Homo sapiens
aaaaaaccgctgcat

SEQ ID NO: 428623 - DNA, 15 bp, Homo sapiens
aaaaaccgctgcatt

SEQ ID NO: 428624 - DNA, 15 bp, Homo sapiens
aaaaccgctgcattt

SEQ ID NO: 428625 - DNA, 15 bp, Homo sapiens
aaaccgctgcattta

SEQ ID NO: 428626 - DNA, 15 bp, Homo sapiens
aaccgctgcatttat

SEQ ID NO: 428627 - DNA, 15 bp, Homo sapiens
accgctgcatttatt

SEQ ID NO: 428628 - DNA, 15 bp, Homo sapiens
ccgctgcatttattt

SEQ ID NO: 428629 - DNA, 15 bp, Homo sapiens
cgctgcatttatttc

SEQ ID NO: 428630 - DNA, 15 bp, Homo sapiens
gctgcatttatttct

SEQ ID NO: 428631 - DNA, 15 bp, Homo sapiens
ctgcatttatttctt

SEQ ID NO: 428632 - DNA, 15 bp, Homo sapiens
tgcatttatttcttt

SEQ ID NO: 428633 - DNA, 15 bp, Homo sapiens
gcatttatttctttg

SEQ ID NO: 428634 - DNA, 15 bp, Homo sapiens
catttatttctttgc

SEQ ID NO: 428635 - DNA, 15 bp, Homo sapiens
atttatttctttgct

SEQ ID NO: 428636 - DNA, 15 bp, Homo sapiens
tttatttctttgctt

SEQ ID NO: 428637 - DNA, 15 bp, Homo sapiens
ttatttctttgcttt

SEQ ID NO: 428638 - DNA, 15 bp, Homo sapiens
tatttctttgctttc

SEQ ID NO: 428639 - DNA, 15 bp, Homo sapiens
atttctttgctttct

SEQ ID NO: 428640 - DNA, 15 bp, Homo sapiens
tttctttgctttcta

SEQ ID NO: 428641 - DNA, 15 bp, Homo sapiens
ttctttgctttctaa

SEQ ID NO: 428642 - DNA, 15 bp, Homo sapiens
tctttgctttctaag

SEQ ID NO: 428643 - DNA, 15 bp, Homo sapiens
ctttgctttctaaga

SEQ ID NO: 428644 - DNA, 15 bp, Homo sapiens
tttgctttctaagaa

SEQ ID NO: 428645 - DNA, 15 bp, Homo sapiens
ttgctttctaagaat

SEQ ID NO: 428646 - DNA, 15 bp, Homo sapiens
tgctttctaagaatc

SEQ ID NO: 428647 - DNA, 15 bp, Homo sapiens
gctttctaagaatct

SEQ ID NO: 428648 - DNA, 15 bp, Homo sapiens
ctttctaagaatcta

SEQ ID NO: 428649 - DNA, 15 bp, Homo sapiens
tttctaagaatctaa

SEQ ID NO: 428650 - DNA, 15 bp, Homo sapiens
ttctaagaatctaaa

SEQ ID NO: 428651 - DNA, 15 bp, Homo sapiens
tctaagaatctaaac

SEQ ID NO: 428652 - DNA, 15 bp, Homo sapiens
ctaagaatctaaact

SEQ ID NO: 428653 - DNA, 15 bp, Homo sapiens
taagaatctaaactg

SEQ ID NO: 428654 - DNA, 15 bp, Homo sapiens
aagaatctaaactga

SEQ ID NO: 428655 - DNA, 15 bp, Homo sapiens
agaatctaaactgat

SEQ ID NO: 428656 - DNA, 15 bp, Homo sapiens
gaatctaaactgata

SEQ ID NO: 428657 - DNA, 15 bp, Homo sapiens
aatctaaactgatat

SEQ ID NO: 428658 - DNA, 15 bp, Homo sapiens
atctaaactgatatg

SEQ ID NO: 428659 - DNA, 15 bp, Homo sapiens
tctaaactgatatga

SEQ ID NO: 428660 - DNA, 15 bp, Homo sapiens
ctaaactgatatgag

SEQ ID NO: 428661 - DNA, 15 bp, Homo sapiens
taaactgatatgagt

SEQ ID NO: 428662 - DNA, 15 bp, Homo sapiens
aaactgatatgagtc

SEQ ID NO: 428663 - DNA, 15 bp, Homo sapiens
aactgatatgagtct

SEQ ID NO: 428664 - DNA, 15 bp, Homo sapiens
actgatatgagtctt

SEQ ID NO: 428665 - DNA, 15 bp, Homo sapiens
ctgatatgagtcttg

SEQ ID NO: 428666 - DNA, 15 bp, Homo sapiens
tgatatgagtcttgc

SEQ ID NO: 428667 - DNA, 15 bp, Homo sapiens
gatatgagtcttgca

SEQ ID NO: 428668 - DNA, 15 bp, Homo sapiens
atatgagtcttgcaa

SEQ ID NO: 428669 - DNA, 15 bp, Homo sapiens
tatgagtcttgcaac

SEQ ID NO: 428670 - DNA, 15 bp, Homo sapiens
atgagtcttgcaaca

SEQ ID NO: 428671 - DNA, 15 bp, Homo sapiens
tgagtcttgcaacac

SEQ ID NO: 428672 - DNA, 15 bp, Homo sapiens
gagtcttgcaacaca

SEQ ID NO: 428673 - DNA, 15 bp, Homo sapiens
agtcttgcaacacag

SEQ ID NO: 428674 - DNA, 15 bp, Homo sapiens
gtcttgcaacacagt

SEQ ID NO: 428675 - DNA, 15 bp, Homo sapiens
tcttgcaacacagtt

SEQ ID NO: 428676 - DNA, 15 bp, Homo sapiens
cttgcaacacagttt

SEQ ID NO: 428677 - DNA, 15 bp, Homo sapiens
ttgcaacacagtttt

SEQ ID NO: 428678 - DNA, 15 bp, Homo sapiens
tgcaacacagttttc

SEQ ID NO: 428679 - DNA, 15 bp, Homo sapiens
gcaacacagttttct

SEQ ID NO: 428680 - DNA, 15 bp, Homo sapiens
caacacagttttctg

SEQ ID NO: 428681 - DNA, 15 bp, Homo sapiens
aacacagttttctgc

SEQ ID NO: 428682 - DNA, 15 bp, Homo sapiens
acacagttttctgct

SEQ ID NO: 428683 - DNA, 15 bp, Homo sapiens
cacagttttctgctt

SEQ ID NO: 428684 - DNA, 15 bp, Homo sapiens
acagttttctgctta

SEQ ID NO: 428685 - DNA, 15 bp, Homo sapiens
cagttttctgcttat

SEQ ID NO: 428686 - DNA, 15 bp, Homo sapiens
agttttctgcttatg

SEQ ID NO: 428687 - DNA, 15 bp, Homo sapiens
gttttctgcttatga

SEQ ID NO: 428688 - DNA, 15 bp, Homo sapiens
ttttctgcttatgaa

SEQ ID NO: 428689 - DNA, 15 bp, Homo sapiens
tttctgcttatgaaa

SEQ ID NO: 428690 - DNA, 15 bp, Homo sapiens
ttctgcttatgaaat

SEQ ID NO: 428691 - DNA, 15 bp, Homo sapiens
tctgcttatgaaata

SEQ ID NO: 428692 - DNA, 15 bp, Homo sapiens
ctgcttatgaaatat

SEQ ID NO: 428693 - DNA, 15 bp, Homo sapiens
tgcttatgaaatatt

SEQ ID NO: 428694 - DNA, 15 bp, Homo sapiens
gcttatgaaatattt

SEQ ID NO: 428695 - DNA, 15 bp, Homo sapiens
cttatgaaatatttt

SEQ ID NO: 428696 - DNA, 15 bp, Homo sapiens
ttatgaaatattttg

SEQ ID NO: 428697 - DNA, 15 bp, Homo sapiens
tatgaaatattttgg

SEQ ID NO: 428698 - DNA, 15 bp, Homo sapiens
atgaaatattttggc

SEQ ID NO: 428699 - DNA, 15 bp, Homo sapiens
tgaaatattttggct

SEQ ID NO: 428700 - DNA, 15 bp, Homo sapiens
gaaatattttggctt

SEQ ID NO: 428701 - DNA, 15 bp, Homo sapiens
aaatattttggcttt

SEQ ID NO: 428702 - DNA, 15 bp, Homo sapiens
aatattttggcttta

SEQ ID NO: 428703 - DNA, 15 bp, Homo sapiens
atattttggctttat

SEQ ID NO: 428704 - DNA, 15 bp, Homo sapiens
tattttggctttatc

SEQ ID NO: 428705 - DNA, 15 bp, Homo sapiens
attttggctttatct

SEQ ID NO: 428706 - DNA, 15 bp, Homo sapiens
ttttggctttatctt

SEQ ID NO: 428707 - DNA, 15 bp, Homo sapiens
tttggctttatcttg

SEQ ID NO: 428708 - DNA, 15 bp, Homo sapiens
ttggctttatcttgg

SEQ ID NO: 428709 - DNA, 15 bp, Homo sapiens
tggctttatcttgga

SEQ ID NO: 428710 - DNA, 15 bp, Homo sapiens
ggctttatcttggag

SEQ ID NO: 428711 - DNA, 15 bp, Homo sapiens
gctttatcttggaga

SEQ ID NO: 428712 - DNA, 15 bp, Homo sapiens
ctttatcttggagaa

SEQ ID NO: 428713 - DNA, 15 bp, Homo sapiens
tttatcttggagaat

SEQ ID NO: 428714 - DNA, 15 bp, Homo sapiens
ttatcttggagaatc

SEQ ID NO: 428715 - DNA, 15 bp, Homo sapiens
tatcttggagaatca

SEQ ID NO: 428716 - DNA, 15 bp, Homo sapiens
atcttggagaatcac

SEQ ID NO: 428717 - DNA, 15 bp, Homo sapiens
tcttggagaatcaca

SEQ ID NO: 428718 - DNA, 15 bp, Homo sapiens
cttggagaatcacat

SEQ ID NO: 428719 - DNA, 15 bp, Homo sapiens
ttggagaatcacata

SEQ ID NO: 428720 - DNA, 15 bp, Homo sapiens
tggagaatcacataa

SEQ ID NO: 428721 - DNA, 15 bp, Homo sapiens
ggagaatcacataat

SEQ ID NO: 428722 - DNA, 15 bp, Homo sapiens
gagaatcacataatt

SEQ ID NO: 428723 - DNA, 15 bp, Homo sapiens
agaatcacataattc

SEQ ID NO: 428724 - DNA, 15 bp, Homo sapiens
gaatcacataattcc

SEQ ID NO: 428725 - DNA, 15 bp, Homo sapiens
aatcacataattcca

SEQ ID NO: 428726 - DNA, 15 bp, Homo sapiens
atcacataattccat

SEQ ID NO: 428727 - DNA, 15 bp, Homo sapiens
tcacataattccatt

SEQ ID NO: 428728 - DNA, 15 bp, Homo sapiens
cacataattccattt

SEQ ID NO: 428729 - DNA, 15 bp, Homo sapiens
acataattccatttt

SEQ ID NO: 428730 - DNA, 15 bp, Homo sapiens
cataattccattttt

SEQ ID NO: 428731 - DNA, 15 bp, Homo sapiens
ataattccatttttt

SEQ ID NO: 428732 - DNA, 15 bp, Homo sapiens
taattccattttttt

SEQ ID NO: 428733 - DNA, 15 bp, Homo sapiens
aattccatttttttc

SEQ ID NO: 428734 - DNA, 15 bp, Homo sapiens
attccatttttttct

SEQ ID NO: 428735 - DNA, 15 bp, Homo sapiens
ttccatttttttctt

SEQ ID NO: 428736 - DNA, 15 bp, Homo sapiens
tccatttttttcttt

SEQ ID NO: 428737 - DNA, 15 bp, Homo sapiens
ccatttttttctttt

SEQ ID NO: 428738 - DNA, 15 bp, Homo sapiens
catttttttcttttt

SEQ ID NO: 428739 - DNA, 15 bp, Homo sapiens
ttttctttttctttt

SEQ ID NO: 428740 - DNA, 15 bp, Homo sapiens
ttctttttctttttc

SEQ ID NO: 428741 - DNA, 15 bp, Homo sapiens
tctttttctttttct

SEQ ID NO: 428742 - DNA, 15 bp, Homo sapiens
ctttttctttttctt

SEQ ID NO: 428743 - DNA, 15 bp, Homo sapiens
tttctttttcttttc

SEQ ID NO: 428744 - DNA, 15 bp, Homo sapiens
ttctttttcttttct

SEQ ID NO: 428745 - DNA, 15 bp, Homo sapiens
tctttttcttttctt

SEQ ID NO: 428746 - DNA, 15 bp, Homo sapiens
ctttttcttttcttt

SEQ ID NO: 428747 - DNA, 15 bp, Homo sapiens
tcttttcttttttct

SEQ ID NO: 428748 - DNA, 15 bp, Homo sapiens
cttttttcttttttt

SEQ ID NO: 428749 - DNA, 15 bp, Homo sapiens
agacagagtctcgcc

SEQ ID NO: 428750 - DNA, 15 bp, Homo sapiens
gacagagtctcgccc

SEQ ID NO: 428751 - DNA, 15 bp, Homo sapiens
acagagtctcgccca

SEQ ID NO: 428752 - DNA, 15 bp, Homo sapiens
cagagtctcgcccag

SEQ ID NO: 428753 - DNA, 15 bp, Homo sapiens
agagtctcgcccagt

SEQ ID NO: 428754 - DNA, 15 bp, Homo sapiens
gagtctcgcccagtt

SEQ ID NO: 428755 - DNA, 15 bp, Homo sapiens
agtctcgcccagttg

SEQ ID NO: 428756 - DNA, 15 bp, Homo sapiens
gtctcgcccagttgc

SEQ ID NO: 428757 - DNA, 15 bp, Homo sapiens
tctcgcccagttgcc

SEQ ID NO: 428758 - DNA, 15 bp, Homo sapiens
ctcgcccagttgccc

SEQ ID NO: 428759 - DNA, 15 bp, Homo sapiens
tcgcccagttgccca

SEQ ID NO: 428760 - DNA, 15 bp, Homo sapiens
cgcccagttgcccag

SEQ ID NO: 428761 - DNA, 15 bp, Homo sapiens
gcccagttgcccagg

SEQ ID NO: 428762 - DNA, 15 bp, Homo sapiens
cccagttgcccaggc

SEQ ID NO: 428763 - DNA, 15 bp, Homo sapiens
ccagttgcccaggct

SEQ ID NO: 428764 - DNA, 15 bp, Homo sapiens
cagttgcccaggctg

SEQ ID NO: 428765 - DNA, 15 bp, Homo sapiens
agttgcccaggctgg

SEQ ID NO: 428766 - DNA, 15 bp, Homo sapiens
ttgcccaggctggac

SEQ ID NO: 428767 - DNA, 15 bp, Homo sapiens
tgcccaggctggact

SEQ ID NO: 428768 - DNA, 15 bp, Homo sapiens
gcccaggctggactg

SEQ ID NO: 428769 - DNA, 15 bp, Homo sapiens
cccaggctggactgc

SEQ ID NO: 428770 - DNA, 15 bp, Homo sapiens
ccaggctggactgca

SEQ ID NO: 428771 - DNA, 15 bp, Homo sapiens
caggctggactgcaa

SEQ ID NO: 428772 - DNA, 15 bp, Homo sapiens
aggctggactgcaat

SEQ ID NO: 428773 - DNA, 15 bp, Homo sapiens
ggctggactgcaatg

SEQ ID NO: 428774 - DNA, 15 bp, Homo sapiens
gctggactgcaatgg

SEQ ID NO: 428775 - DNA, 15 bp, Homo sapiens
ctggactgcaatggc

SEQ ID NO: 428776 - DNA, 15 bp, Homo sapiens
tggactgcaatggct

SEQ ID NO: 428777 - DNA, 15 bp, Homo sapiens
ggactgcaatggctc

SEQ ID NO: 428778 - DNA, 15 bp, Homo sapiens
gactgcaatggctcg

SEQ ID NO: 428779 - DNA, 15 bp, Homo sapiens
actgcaatggctcga

SEQ ID NO: 428780 - DNA, 15 bp, Homo sapiens
ctgcaatggctcgat

SEQ ID NO: 428781 - DNA, 15 bp, Homo sapiens
tgcaatggctcgatc

SEQ ID NO: 428782 - DNA, 15 bp, Homo sapiens
gcaatggctcgatct

SEQ ID NO: 428783 - DNA, 15 bp, Homo sapiens
caatggctcgatctc

SEQ ID NO: 428784 - DNA, 15 bp, Homo sapiens
aatggctcgatctcg

SEQ ID NO: 428785 - DNA, 15 bp, Homo sapiens
atggctcgatctcgg

SEQ ID NO: 428786 - DNA, 15 bp, Homo sapiens
tggctcgatctcggc

SEQ ID NO: 428787 - DNA, 15 bp, Homo sapiens
ggctcgatctcggct

SEQ ID NO: 428788 - DNA, 15 bp, Homo sapiens
gctcgatctcggctc

SEQ ID NO: 428789 - DNA, 15 bp, Homo sapiens
ctcgatctcggctca

SEQ ID NO: 428790 - DNA, 15 bp, Homo sapiens
tcgatctcggctcac

SEQ ID NO: 428791 - DNA, 15 bp, Homo sapiens
tccgcctcccgggtc

SEQ ID NO: 428792 - DNA, 15 bp, Homo sapiens
ccgcctcccgggtcc

SEQ ID NO: 428793 - DNA, 15 bp, Homo sapiens
cgcctcccgggtcca

SEQ ID NO: 428794 - DNA, 15 bp, Homo sapiens
gcctcccgggtccaa

SEQ ID NO: 428795 - DNA, 15 bp, Homo sapiens
cctcccgggtccaaa

SEQ ID NO: 428796 - DNA, 15 bp, Homo sapiens
ctcccgggtccaaat

SEQ ID NO: 428797 - DNA, 15 bp, Homo sapiens
tcccgggtccaaatg

SEQ ID NO: 428798 - DNA, 15 bp, Homo sapiens
cccgggtccaaatga

SEQ ID NO: 428799 - DNA, 15 bp, Homo sapiens
ccgggtccaaatgac

SEQ ID NO: 428800 - DNA, 15 bp, Homo sapiens
cgggtccaaatgact

SEQ ID NO: 428801 - DNA, 15 bp, Homo sapiens
gggtccaaatgactc

SEQ ID NO: 428802 - DNA, 15 bp, Homo sapiens
ggtccaaatgactct

SEQ ID NO: 428803 - DNA, 15 bp, Homo sapiens
gtccaaatgactctc

SEQ ID NO: 428804 - DNA, 15 bp, Homo sapiens
tccaaatgactctcc

SEQ ID NO: 428805 - DNA, 15 bp, Homo sapiens
ccaaatgactctcct

SEQ ID NO: 428806 - DNA, 15 bp, Homo sapiens
caaatgactctcctg

SEQ ID NO: 428807 - DNA, 15 bp, Homo sapiens
aaatgactctcctgc

SEQ ID NO: 428808 - DNA, 15 bp, Homo sapiens
aatgactctcctgcc

SEQ ID NO: 428809 - DNA, 15 bp, Homo sapiens
atgactctcctgcct

SEQ ID NO: 428810 - DNA, 15 bp, Homo sapiens
ggtgcctgccaccac

SEQ ID NO: 428811 - DNA, 15 bp, Homo sapiens
gtgcctgccaccaca

SEQ ID NO: 428812 - DNA, 15 bp, Homo sapiens
tgcctgccaccacac

SEQ ID NO: 428813 - DNA, 15 bp, Homo sapiens
gcctgccaccacacc

SEQ ID NO: 428814 - DNA, 15 bp, Homo sapiens
tagtagagacgggga

SEQ ID NO: 428815 - DNA, 15 bp, Homo sapiens
agtagagacggggat

SEQ ID NO: 428816 - DNA, 15 bp, Homo sapiens
gtagagacggggatt

SEQ ID NO: 428817 - DNA, 15 bp, Homo sapiens
tagagacggggattt

SEQ ID NO: 428818 - DNA, 15 bp, Homo sapiens
agagacggggatttc

SEQ ID NO: 428819 - DNA, 15 bp, Homo sapiens
gagacggggatttca

SEQ ID NO: 428820 - DNA, 15 bp, Homo sapiens
agacggggatttcac

SEQ ID NO: 428821 - DNA, 15 bp, Homo sapiens
gacggggatttcacc

SEQ ID NO: 428822 - DNA, 15 bp, Homo sapiens
acggggatttcacca

SEQ ID NO: 428823 - DNA, 15 bp, Homo sapiens
cggggatttcaccat

SEQ ID NO: 428824 - DNA, 15 bp, Homo sapiens
ggggatttcaccatg

SEQ ID NO: 428825 - DNA, 15 bp, Homo sapiens
atttcaccatgttga

SEQ ID NO: 428826 - DNA, 15 bp, Homo sapiens
tttcaccatgttgat

SEQ ID NO: 428827 - DNA, 15 bp, Homo sapiens
ttcaccatgttgatc

SEQ ID NO: 428828 - DNA, 15 bp, Homo sapiens
tcaccatgttgatca

SEQ ID NO: 428829 - DNA, 15 bp, Homo sapiens
caccatgttgatcag

SEQ ID NO: 428830 - DNA, 15 bp, Homo sapiens
accatgttgatcagg

SEQ ID NO: 428831 - DNA, 15 bp, Homo sapiens
ccatgttgatcaggc

SEQ ID NO: 428832 - DNA, 15 bp, Homo sapiens
catgttgatcaggct

SEQ ID NO: 428833 - DNA, 15 bp, Homo sapiens
atgttgatcaggctg

SEQ ID NO: 428834 - DNA, 15 bp, Homo sapiens
tgttgatcaggctgg

SEQ ID NO: 428835 - DNA, 15 bp, Homo sapiens
gttgatcaggctggt

SEQ ID NO: 428836 - DNA, 15 bp, Homo sapiens
ttgatcaggctggtc

SEQ ID NO: 428837 - DNA, 15 bp, Homo sapiens
tgatcaggctggtct

SEQ ID NO: 428838 - DNA, 15 bp, Homo sapiens
gatcaggctggtctc

SEQ ID NO: 428839 - DNA, 15 bp, Homo sapiens
atcaggctggtctcg

SEQ ID NO: 428840 - DNA, 15 bp, Homo sapiens
ctgacctcatgatcc

SEQ ID NO: 428841 - DNA, 15 bp, Homo sapiens
cctcatgatccaccc

SEQ ID NO: 428842 - DNA, 15 bp, Homo sapiens
ctcatgatccacccg

SEQ ID NO: 428843 - DNA, 15 bp, Homo sapiens
tcatgatccacccgc

SEQ ID NO: 428844 - DNA, 15 bp, Homo sapiens
catgatccacccgcc

SEQ ID NO: 428845 - DNA, 15 bp, Homo sapiens
atgatccacccgcct

SEQ ID NO: 428846 - DNA, 15 bp, Homo sapiens
tcccaaagtgctggt

SEQ ID NO: 428847 - DNA, 15 bp, Homo sapiens
cccaaagtgctggta

SEQ ID NO: 428848 - DNA, 15 bp, Homo sapiens
ccaaagtgctggtac

SEQ ID NO: 428849 - DNA, 15 bp, Homo sapiens
caaagtgctggtact

SEQ ID NO: 428850 - DNA, 15 bp, Homo sapiens
aaagtgctggtacta

SEQ ID NO: 428851 - DNA, 15 bp, Homo sapiens
aagtgctggtactac

SEQ ID NO: 428852 - DNA, 15 bp, Homo sapiens
agtgctggtactaca

SEQ ID NO: 428853 - DNA, 15 bp, Homo sapiens
gtgctggtactacag

SEQ ID NO: 428854 - DNA, 15 bp, Homo sapiens
tgctggtactacagg

SEQ ID NO: 428855 - DNA, 15 bp, Homo sapiens
gctggtactacaggc

SEQ ID NO: 428856 - DNA, 15 bp, Homo sapiens
ctggtactacaggca

SEQ ID NO: 428857 - DNA, 15 bp, Homo sapiens
gtactacaggcatga

SEQ ID NO: 428858 - DNA, 15 bp, Homo sapiens
tactacaggcatgag

SEQ ID NO: 428859 - DNA, 15 bp, Homo sapiens
actgtgcccagcctg

SEQ ID NO: 428860 - DNA, 15 bp, Homo sapiens
ctgtgcccagcctga

SEQ ID NO: 428861 - DNA, 15 bp, Homo sapiens
tgtgcccagcctgag

SEQ ID NO: 428862 - DNA, 15 bp, Homo sapiens
gtgcccagcctgagc

SEQ ID NO: 428863 - DNA, 15 bp, Homo sapiens
tgcccagcctgagcc

SEQ ID NO: 428864 - DNA, 15 bp, Homo sapiens
gcccagcctgagcca

SEQ ID NO: 428865 - DNA, 15 bp, Homo sapiens
cccagcctgagccac

SEQ ID NO: 428866 - DNA, 15 bp, Homo sapiens
ccagcctgagccact

SEQ ID NO: 428867 - DNA, 15 bp, Homo sapiens
cagcctgagccactg

SEQ ID NO: 428868 - DNA, 15 bp, Homo sapiens
agcctgagccactgc

SEQ ID NO: 428869 - DNA, 15 bp, Homo sapiens
gcctgagccactgca

SEQ ID NO: 428870 - DNA, 15 bp, Homo sapiens
cctgagccactgcac

SEQ ID NO: 428871 - DNA, 15 bp, Homo sapiens
ctgagccactgcacc

SEQ ID NO: 428872 - DNA, 15 bp, Homo sapiens
actgcacctggccca

SEQ ID NO: 428873 - DNA, 15 bp, Homo sapiens
ctgcacctggcccat

SEQ ID NO: 428874 - DNA, 15 bp, Homo sapiens
tgcacctggcccatt

SEQ ID NO: 428875 - DNA, 15 bp, Homo sapiens
gcacctggcccattt

SEQ ID NO: 428876 - DNA, 15 bp, Homo sapiens
cacctggcccatttt

SEQ ID NO: 428877 - DNA, 15 bp, Homo sapiens
acctggcccattttt

SEQ ID NO: 428878 - DNA, 15 bp, Homo sapiens
ctggcccattttttt

SEQ ID NO: 428879 - DNA, 15 bp, Homo sapiens
tggcccatttttttc

SEQ ID NO: 428880 - DNA, 15 bp, Homo sapiens
ggcccatttttttca

SEQ ID NO: 428881 - DNA, 15 bp, Homo sapiens
gcccatttttttcat

SEQ ID NO: 428882 - DNA, 15 bp, Homo sapiens
cccatttttttcata

SEQ ID NO: 428883 - DNA, 15 bp, Homo sapiens
ccatttttttcataa

SEQ ID NO: 428884 - DNA, 15 bp, Homo sapiens
catttttttcataat

SEQ ID NO: 428885 - DNA, 15 bp, Homo sapiens
atttttttcataatt

SEQ ID NO: 428886 - DNA, 15 bp, Homo sapiens
tttttttcataatta

SEQ ID NO: 428887 - DNA, 15 bp, Homo sapiens
ttttttcataattaa

SEQ ID NO: 428888 - DNA, 15 bp, Homo sapiens
tttttcataattaaa

SEQ ID NO: 428889 - DNA, 15 bp, Homo sapiens
ttttcataattaaat

SEQ ID NO: 428890 - DNA, 15 bp, Homo sapiens
tttcataattaaata

SEQ ID NO: 428891 - DNA, 15 bp, Homo sapiens
ttcataattaaataa

SEQ ID NO: 428892 - DNA, 15 bp, Homo sapiens
tcataattaaataat

SEQ ID NO: 428893 - DNA, 15 bp, Homo sapiens
cataattaaataatt

SEQ ID NO: 428894 - DNA, 15 bp, Homo sapiens
taattaaataattta

SEQ ID NO: 428895 - DNA, 15 bp, Homo sapiens
aattaaataatttat

SEQ ID NO: 428896 - DNA, 15 bp, Homo sapiens
attaaataatttatc

SEQ ID NO: 428897 - DNA, 15 bp, Homo sapiens
ttaaataatttatcc

SEQ ID NO: 428898 - DNA, 15 bp, Homo sapiens
taaataatttatccc

SEQ ID NO: 428899 - DNA, 15 bp, Homo sapiens
aaataatttatccct

SEQ ID NO: 428900 - DNA, 15 bp, Homo sapiens
aataatttatccctt

SEQ ID NO: 428901 - DNA, 15 bp, Homo sapiens
ataatttatccctta

SEQ ID NO: 428902 - DNA, 15 bp, Homo sapiens
taatttatcccttag

SEQ ID NO: 428903 - DNA, 15 bp, Homo sapiens
aatttatcccttaga

SEQ ID NO: 428904 - DNA, 15 bp, Homo sapiens
atttatcccttagaa

SEQ ID NO: 428905 - DNA, 15 bp, Homo sapiens
tttatcccttagaag

SEQ ID NO: 428906 - DNA, 15 bp, Homo sapiens
ttatcccttagaaga

SEQ ID NO: 428907 - DNA, 15 bp, Homo sapiens
tatcccttagaagag

SEQ ID NO: 428908 - DNA, 15 bp, Homo sapiens
atcccttagaagagt

SEQ ID NO: 428909 - DNA, 15 bp, Homo sapiens
tcccttagaagagtt

SEQ ID NO: 428910 - DNA, 15 bp, Homo sapiens
cccttagaagagtta

SEQ ID NO: 428911 - DNA, 15 bp, Homo sapiens
ccttagaagagttaa

SEQ ID NO: 428912 - DNA, 15 bp, Homo sapiens
cttagaagagttaag

SEQ ID NO: 428913 - DNA, 15 bp, Homo sapiens
ttagaagagttaagt

SEQ ID NO: 428914 - DNA, 15 bp, Homo sapiens
tagaagagttaagtc

SEQ ID NO: 428915 - DNA, 15 bp, Homo sapiens
agaagagttaagtca

SEQ ID NO: 428916 - DNA, 15 bp, Homo sapiens
gaagagttaagtcat

SEQ ID NO: 428917 - DNA, 15 bp, Homo sapiens
aagagttaagtcatc

SEQ ID NO: 428918 - DNA, 15 bp, Homo sapiens
agagttaagtcatct

SEQ ID NO: 428919 - DNA, 15 bp, Homo sapiens
gagttaagtcatcta

SEQ ID NO: 428920 - DNA, 15 bp, Homo sapiens
agttaagtcatctac

SEQ ID NO: 428921 - DNA, 15 bp, Homo sapiens
gttaagtcatctact

SEQ ID NO: 428922 - DNA, 15 bp, Homo sapiens
ttaagtcatctactt

SEQ ID NO: 428923 - DNA, 15 bp, Homo sapiens
taagtcatctacttt

SEQ ID NO: 428924 - DNA, 15 bp, Homo sapiens
aagtcatctactttc

SEQ ID NO: 428925 - DNA, 15 bp, Homo sapiens
agtcatctactttca

SEQ ID NO: 428926 - DNA, 15 bp, Homo sapiens
gtcatctactttcag

SEQ ID NO: 428927 - DNA, 15 bp, Homo sapiens
tcatctactttcaga

SEQ ID NO: 428928 - DNA, 15 bp, Homo sapiens
catctactttcagat

SEQ ID NO: 428929 - DNA, 15 bp, Homo sapiens
atctactttcagatg

SEQ ID NO: 428930 - DNA, 15 bp, Homo sapiens
tctactttcagatgt

SEQ ID NO: 428931 - DNA, 15 bp, Homo sapiens
ctactttcagatgtt

SEQ ID NO: 428932 - DNA, 15 bp, Homo sapiens
tactttcagatgttc

SEQ ID NO: 428933 - DNA, 15 bp, Homo sapiens
actttcagatgttcc

SEQ ID NO: 428934 - DNA, 15 bp, Homo sapiens
ctttcagatgttcct

SEQ ID NO: 428935 - DNA, 15 bp, Homo sapiens
tttcagatgttcctg

SEQ ID NO: 428936 - DNA, 15 bp, Homo sapiens
ttcagatgttcctgc

SEQ ID NO: 428937 - DNA, 15 bp, Homo sapiens
tcagatgttcctgca

SEQ ID NO: 428938 - DNA, 15 bp, Homo sapiens
cagatgttcctgcaa

SEQ ID NO: 428939 - DNA, 15 bp, Homo sapiens
agatgttcctgcaaa

SEQ ID NO: 428940 - DNA, 15 bp, Homo sapiens
gatgttcctgcaaac

SEQ ID NO: 428941 - DNA, 15 bp, Homo sapiens
atgttcctgcaaacg

SEQ ID NO: 428942 - DNA, 15 bp, Homo sapiens
tgttcctgcaaacgg

SEQ ID NO: 428943 - DNA, 15 bp, Homo sapiens
gttcctgcaaacgga

SEQ ID NO: 428944 - DNA, 15 bp, Homo sapiens
ttcctgcaaacggag

SEQ ID NO: 428945 - DNA, 15 bp, Homo sapiens
tcctgcaaacggagg

SEQ ID NO: 428946 - DNA, 15 bp, Homo sapiens
cctgcaaacggaggg

SEQ ID NO: 428947 - DNA, 15 bp, Homo sapiens
ctgcaaacggagggc

SEQ ID NO: 428948 - DNA, 15 bp, Homo sapiens
tgcaaacggagggct

SEQ ID NO: 428949 - DNA, 15 bp, Homo sapiens
gcaaacggagggctt

SEQ ID NO: 428950 - DNA, 15 bp, Homo sapiens
caaacggagggcttt

SEQ ID NO: 428951 - DNA, 15 bp, Homo sapiens
aaacggagggctttg

SEQ ID NO: 428952 - DNA, 15 bp, Homo sapiens
aacggagggctttgt

SEQ ID NO: 428953 - DNA, 15 bp, Homo sapiens
acggagggctttgtt

SEQ ID NO: 428954 - DNA, 15 bp, Homo sapiens
cggagggctttgttc

SEQ ID NO: 428955 - DNA, 15 bp, Homo sapiens
ggagggctttgttct

SEQ ID NO: 428956 - DNA, 15 bp, Homo sapiens
gagggctttgttctg

SEQ ID NO: 428957 - DNA, 15 bp, Homo sapiens
agggctttgttctgg

SEQ ID NO: 428958 - DNA, 15 bp, Homo sapiens
gggctttgttctggc

SEQ ID NO: 428959 - DNA, 15 bp, Homo sapiens
ggctttgttctggca

SEQ ID NO: 428960 - DNA, 15 bp, Homo sapiens
gctttgttctggcat

SEQ ID NO: 428961 - DNA, 15 bp, Homo sapiens
ctttgttctggcatt

SEQ ID NO: 428962 - DNA, 15 bp, Homo sapiens
tttgttctggcattg

SEQ ID NO: 428963 - DNA, 15 bp, Homo sapiens
ttgttctggcattgg

SEQ ID NO: 428964 - DNA, 15 bp, Homo sapiens
tgttctggcattggt

SEQ ID NO: 428965 - DNA, 15 bp, Homo sapiens
gttctggcattggtc

SEQ ID NO: 428966 - DNA, 15 bp, Homo sapiens
ttctggcattggtca

SEQ ID NO: 428967 - DNA, 15 bp, Homo sapiens
tctggcattggtcaa

SEQ ID NO: 428968 - DNA, 15 bp, Homo sapiens
ctggcattggtcaac

SEQ ID NO: 428969 - DNA, 15 bp, Homo sapiens
tggcattggtcaacc

SEQ ID NO: 428970 - DNA, 15 bp, Homo sapiens
ggcattggtcaacca

SEQ ID NO: 428971 - DNA, 15 bp, Homo sapiens
gcattggtcaaccaa

SEQ ID NO: 428972 - DNA, 15 bp, Homo sapiens
cattggtcaaccaaa

SEQ ID NO: 428973 - DNA, 15 bp, Homo sapiens
attggtcaaccaaag

SEQ ID NO: 428974 - DNA, 15 bp, Homo sapiens
ttggtcaaccaaagc

SEQ ID NO: 428975 - DNA, 15 bp, Homo sapiens
tggtcaaccaaagct

SEQ ID NO: 428976 - DNA, 15 bp, Homo sapiens
ggtcaaccaaagctc

SEQ ID NO: 428977 - DNA, 15 bp, Homo sapiens
gtcaaccaaagctct

SEQ ID NO: 428978 - DNA, 15 bp, Homo sapiens
tcaaccaaagctcta

SEQ ID NO: 428979 - DNA, 15 bp, Homo sapiens
caaccaaagctctag

SEQ ID NO: 428980 - DNA, 15 bp, Homo sapiens
aaccaaagctctagg

SEQ ID NO: 428981 - DNA, 15 bp, Homo sapiens
accaaagctctaggt

SEQ ID NO: 428982 - DNA, 15 bp, Homo sapiens
ccaaagctctaggta

SEQ ID NO: 428983 - DNA, 15 bp, Homo sapiens
caaagctctaggtaa

SEQ ID NO: 428984 - DNA, 15 bp, Homo sapiens
aaagctctaggtaaa

SEQ ID NO: 428985 - DNA, 15 bp, Homo sapiens
aagctctaggtaaaa

SEQ ID NO: 428986 - DNA, 15 bp, Homo sapiens
agctctaggtaaaat

SEQ ID NO: 428987 - DNA, 15 bp, Homo sapiens
gctctaggtaaaatg

SEQ ID NO: 428988 - DNA, 15 bp, Homo sapiens
ctctaggtaaaatgg

SEQ ID NO: 428989 - DNA, 15 bp, Homo sapiens
tctaggtaaaatggc

SEQ ID NO: 428990 - DNA, 15 bp, Homo sapiens
ctaggtaaaatggct

SEQ ID NO: 428991 - DNA, 15 bp, Homo sapiens
taggtaaaatggcta

SEQ ID NO: 428992 - DNA, 15 bp, Homo sapiens
aggtaaaatggctag

SEQ ID NO: 428993 - DNA, 15 bp, Homo sapiens
ggtaaaatggctaga

SEQ ID NO: 428994 - DNA, 15 bp, Homo sapiens
gtaaaatggctagaa

SEQ ID NO: 428995 - DNA, 15 bp, Homo sapiens
taaaatggctagaac

SEQ ID NO: 428996 - DNA, 15 bp, Homo sapiens
aaaatggctagaacc

SEQ ID NO: 428997 - DNA, 15 bp, Homo sapiens
aaatggctagaacct

SEQ ID NO: 428998 - DNA, 15 bp, Homo sapiens
aatggctagaacctt

SEQ ID NO: 428999 - DNA, 15 bp, Homo sapiens
atggctagaaccttc

SEQ ID NO: 429000 - DNA, 15 bp, Homo sapiens
tggctagaaccttcc

SEQ ID NO: 429001 - DNA, 15 bp, Homo sapiens
ggctagaaccttcct

SEQ ID NO: 429002 - DNA, 15 bp, Homo sapiens
gctagaaccttcctc

SEQ ID NO: 429003 - DNA, 15 bp, Homo sapiens
ctagaaccttcctct

SEQ ID NO: 429004 - DNA, 15 bp, Homo sapiens
tagaaccttcctcta

SEQ ID NO: 429005 - DNA, 15 bp, Homo sapiens
agaaccttcctctac

SEQ ID NO: 429006 - DNA, 15 bp, Homo sapiens
gaaccttcctctaca

SEQ ID NO: 429007 - DNA, 15 bp, Homo sapiens
aaccttcctctacaa

SEQ ID NO: 429008 - DNA, 15 bp, Homo sapiens
accttcctctacaag

SEQ ID NO: 429009 - DNA, 15 bp, Homo sapiens
ccttcctctacaagt

SEQ ID NO: 429010 - DNA, 15 bp, Homo sapiens
cttcctctacaagta

SEQ ID NO: 429011 - DNA, 15 bp, Homo sapiens
ttcctctacaagtaa

SEQ ID NO: 429012 - DNA, 15 bp, Homo sapiens
tcctctacaagtaag

SEQ ID NO: 429013 - DNA, 15 bp, Homo sapiens
cctctacaagtaaga

SEQ ID NO: 429014 - DNA, 15 bp, Homo sapiens
ctctacaagtaagag

SEQ ID NO: 429015 - DNA, 15 bp, Homo sapiens
tctacaagtaagagt

SEQ ID NO: 429016 - DNA, 15 bp, Homo sapiens
ctacaagtaagagtg

SEQ ID NO: 429017 - DNA, 15 bp, Homo sapiens
tacaagtaagagtga

SEQ ID NO: 429018 - DNA, 15 bp, Homo sapiens
acaagtaagagtgaa

SEQ ID NO: 429019 - DNA, 15 bp, Homo sapiens
caagtaagagtgaat

SEQ ID NO: 429020 - DNA, 15 bp, Homo sapiens
aagtaagagtgaata

SEQ ID NO: 429021 - DNA, 15 bp, Homo sapiens
agtaagagtgaatag

SEQ ID NO: 429022 - DNA, 15 bp, Homo sapiens
gtaagagtgaataga

SEQ ID NO: 429023 - DNA, 15 bp, Homo sapiens
taagagtgaatagag

SEQ ID NO: 429024 - DNA, 15 bp, Homo sapiens
aagagtgaatagagg

SEQ ID NO: 429025 - DNA, 15 bp, Homo sapiens
agagtgaatagaggc

SEQ ID NO: 429026 - DNA, 15 bp, Homo sapiens
gagtgaatagaggct

SEQ ID NO: 429027 - DNA, 15 bp, Homo sapiens
agtgaatagaggctt

SEQ ID NO: 429028 - DNA, 15 bp, Homo sapiens
gtgaatagaggcttt

SEQ ID NO: 429029 - DNA, 15 bp, Homo sapiens
tgaatagaggctttg

SEQ ID NO: 429030 - DNA, 15 bp, Homo sapiens
gaatagaggctttgg

SEQ ID NO: 429031 - DNA, 15 bp, Homo sapiens
aatagaggctttgga

SEQ ID NO: 429032 - DNA, 15 bp, Homo sapiens
atagaggctttggaa

SEQ ID NO: 429033 - DNA, 15 bp, Homo sapiens
tagaggctttggaaa

SEQ ID NO: 429034 - DNA, 15 bp, Homo sapiens
agaggctttggaaag

SEQ ID NO: 429035 - DNA, 15 bp, Homo sapiens
gaggctttggaaaga

SEQ ID NO: 429036 - DNA, 15 bp, Homo sapiens
aggctttggaaagaa

SEQ ID NO: 429037 - DNA, 15 bp, Homo sapiens
ggctttggaaagaaa

SEQ ID NO: 429038 - DNA, 15 bp, Homo sapiens
gctttggaaagaaat

SEQ ID NO: 429039 - DNA, 15 bp, Homo sapiens
ctttggaaagaaatt

SEQ ID NO: 429040 - DNA, 15 bp, Homo sapiens
tttggaaagaaattc

SEQ ID NO: 429041 - DNA, 15 bp, Homo sapiens
ttggaaagaaattca

SEQ ID NO: 429042 - DNA, 15 bp, Homo sapiens
tggaaagaaattcag

SEQ ID NO: 429043 - DNA, 15 bp, Homo sapiens
ggaaagaaattcagt

SEQ ID NO: 429044 - DNA, 15 bp, Homo sapiens
gaaagaaattcagtc

SEQ ID NO: 429045 - DNA, 15 bp, Homo sapiens
aaagaaattcagtct

SEQ ID NO: 429046 - DNA, 15 bp, Homo sapiens
aagaaattcagtctg

SEQ ID NO: 429047 - DNA, 15 bp, Homo sapiens
agaaattcagtctga

SEQ ID NO: 429048 - DNA, 15 bp, Homo sapiens
gaaattcagtctgag

SEQ ID NO: 429049 - DNA, 15 bp, Homo sapiens
aaattcagtctgaga

SEQ ID NO: 429050 - DNA, 15 bp, Homo sapiens
aattcagtctgagac

SEQ ID NO: 429051 - DNA, 15 bp, Homo sapiens
attcagtctgagaca

SEQ ID NO: 429052 - DNA, 15 bp, Homo sapiens
ttcagtctgagacaa

SEQ ID NO: 429053 - DNA, 15 bp, Homo sapiens
tcagtctgagacaag

SEQ ID NO: 429054 - DNA, 15 bp, Homo sapiens
cagtctgagacaaga

SEQ ID NO: 429055 - DNA, 15 bp, Homo sapiens
agtctgagacaagag

SEQ ID NO: 429056 - DNA, 15 bp, Homo sapiens
gtctgagacaagagc

SEQ ID NO: 429057 - DNA, 15 bp, Homo sapiens
tctgagacaagagct

SEQ ID NO: 429058 - DNA, 15 bp, Homo sapiens
ctgagacaagagctg

SEQ ID NO: 429059 - DNA, 15 bp, Homo sapiens
tgagacaagagctga

SEQ ID NO: 429060 - DNA, 15 bp, Homo sapiens
gagacaagagctgag

SEQ ID NO: 429061 - DNA, 15 bp, Homo sapiens
agacaagagctgaga

SEQ ID NO: 429062 - DNA, 15 bp, Homo sapiens
gacaagagctgagaa

SEQ ID NO: 429063 - DNA, 15 bp, Homo sapiens
acaagagctgagaaa

SEQ ID NO: 429064 - DNA, 15 bp, Homo sapiens
caagagctgagaaac

SEQ ID NO: 429065 - DNA, 15 bp, Homo sapiens
aagagctgagaaaca

SEQ ID NO: 429066 - DNA, 15 bp, Homo sapiens
agagctgagaaacat

SEQ ID NO: 429067 - DNA, 15 bp, Homo sapiens
gagctgagaaacatg

SEQ ID NO: 429068 - DNA, 15 bp, Homo sapiens
agctgagaaacatgg

SEQ ID NO: 429069 - DNA, 15 bp, Homo sapiens
gctgagaaacatggt

SEQ ID NO: 429070 - DNA, 15 bp, Homo sapiens
ctgagaaacatggta

SEQ ID NO: 429071 - DNA, 15 bp, Homo sapiens
tgagaaacatggtag

SEQ ID NO: 429072 - DNA, 15 bp, Homo sapiens
gagaaacatggtaga

SEQ ID NO: 429073 - DNA, 15 bp, Homo sapiens
agaaacatggtagaa

SEQ ID NO: 429074 - DNA, 15 bp, Homo sapiens
gaaacatggtagaat

SEQ ID NO: 429075 - DNA, 15 bp, Homo sapiens
aaacatggtagaatt

SEQ ID NO: 429076 - DNA, 15 bp, Homo sapiens
aacatggtagaattt

SEQ ID NO: 429077 - DNA, 15 bp, Homo sapiens
acatggtagaatttt

SEQ ID NO: 429078 - DNA, 15 bp, Homo sapiens
catggtagaatttta

SEQ ID NO: 429079 - DNA, 15 bp, Homo sapiens
atggtagaattttag

SEQ ID NO: 429080 - DNA, 15 bp, Homo sapiens
tggtagaattttaga

SEQ ID NO: 429081 - DNA, 15 bp, Homo sapiens
ggtagaattttagat

SEQ ID NO: 429082 - DNA, 15 bp, Homo sapiens
gtagaattttagatt

SEQ ID NO: 429083 - DNA, 15 bp, Homo sapiens
tagaattttagatta

SEQ ID NO: 429084 - DNA, 15 bp, Homo sapiens
agaattttagattag

SEQ ID NO: 429085 - DNA, 15 bp, Homo sapiens
gaattttagattagc

SEQ ID NO: 429086 - DNA, 15 bp, Homo sapiens
aattttagattagca

SEQ ID NO: 429087 - DNA, 15 bp, Homo sapiens
attttagattagcat

SEQ ID NO: 429088 - DNA, 15 bp, Homo sapiens
ttttagattagcatg

SEQ ID NO: 429089 - DNA, 15 bp, Homo sapiens
tttagattagcatga

SEQ ID NO: 429090 - DNA, 15 bp, Homo sapiens
ttagattagcatgat

SEQ ID NO: 429091 - DNA, 15 bp, Homo sapiens
tagattagcatgatt

SEQ ID NO: 429092 - DNA, 15 bp, Homo sapiens
agattagcatgattt

SEQ ID NO: 429093 - DNA, 15 bp, Homo sapiens
gattagcatgatttt

SEQ ID NO: 429094 - DNA, 15 bp, Homo sapiens
attagcatgatttta

SEQ ID NO: 429095 - DNA, 15 bp, Homo sapiens
ttagcatgattttaa

SEQ ID NO: 429096 - DNA, 15 bp, Homo sapiens
tagcatgattttaat

SEQ ID NO: 429097 - DNA, 15 bp, Homo sapiens
agcatgattttaata

SEQ ID NO: 429098 - DNA, 15 bp, Homo sapiens
gcatgattttaatag

SEQ ID NO: 429099 - DNA, 15 bp, Homo sapiens
catgattttaatagt

SEQ ID NO: 429100 - DNA, 15 bp, Homo sapiens
atgattttaatagta

SEQ ID NO: 429101 - DNA, 15 bp, Homo sapiens
tgattttaatagtaa

SEQ ID NO: 429102 - DNA, 15 bp, Homo sapiens
gattttaatagtaat

SEQ ID NO: 429103 - DNA, 15 bp, Homo sapiens
attttaatagtaatg

SEQ ID NO: 429104 - DNA, 15 bp, Homo sapiens
ttttaatagtaatgg

SEQ ID NO: 429105 - DNA, 15 bp, Homo sapiens
tttaatagtaatggg

SEQ ID NO: 429106 - DNA, 15 bp, Homo sapiens
ttaatagtaatgggc

SEQ ID NO: 429107 - DNA, 15 bp, Homo sapiens
taatagtaatgggct

SEQ ID NO: 429108 - DNA, 15 bp, Homo sapiens
aatagtaatgggctg

SEQ ID NO: 429109 - DNA, 15 bp, Homo sapiens
atagtaatgggctgg

SEQ ID NO: 429110 - DNA, 15 bp, Homo sapiens
tagtaatgggctggg

SEQ ID NO: 429111 - DNA, 15 bp, Homo sapiens
agtaatgggctggga

SEQ ID NO: 429112 - DNA, 15 bp, Homo sapiens
gtaatgggctgggag

SEQ ID NO: 429113 - DNA, 15 bp, Homo sapiens
taatgggctgggagt

SEQ ID NO: 429114 - DNA, 15 bp, Homo sapiens
aatgggctgggagtg

SEQ ID NO: 429115 - DNA, 15 bp, Homo sapiens
atgggctgggagtgg

SEQ ID NO: 429116 - DNA, 15 bp, Homo sapiens
tgggctgggagtggt

SEQ ID NO: 429117 - DNA, 15 bp, Homo sapiens
gggctgggagtggtg

SEQ ID NO: 429118 - DNA, 15 bp, Homo sapiens
ggctgggagtggtgc

SEQ ID NO: 429119 - DNA, 15 bp, Homo sapiens
gctgggagtggtgct

SEQ ID NO: 429120 - DNA, 15 bp, Homo sapiens
ctgggagtggtgctc

SEQ ID NO: 429121 - DNA, 15 bp, Homo sapiens
tgggagtggtgctca

SEQ ID NO: 429122 - DNA, 15 bp, Homo sapiens
gggagtggtgctcac

SEQ ID NO: 429123 - DNA, 15 bp, Homo sapiens
ggagtggtgctcaca

SEQ ID NO: 429124 - DNA, 15 bp, Homo sapiens
gagtggtgctcacac

SEQ ID NO: 429125 - DNA, 15 bp, Homo sapiens
agtggtgctcacacc

SEQ ID NO: 429126 - DNA, 15 bp, Homo sapiens
gtggtgctcacacct

SEQ ID NO: 429127 - DNA, 15 bp, Homo sapiens
tggtgctcacacctg

SEQ ID NO: 429128 - DNA, 15 bp, Homo sapiens
ggtgctcacacctgt

SEQ ID NO: 429129 - DNA, 15 bp, Homo sapiens
gtgctcacacctgta

SEQ ID NO: 429130 - DNA, 15 bp, Homo sapiens
tgctcacacctgtaa

SEQ ID NO: 429131 - DNA, 15 bp, Homo sapiens
agtactttgggagga

SEQ ID NO: 429132 - DNA, 15 bp, Homo sapiens
gtactttgggaggaa

SEQ ID NO: 429133 - DNA, 15 bp, Homo sapiens
tactttgggaggaaa

SEQ ID NO: 429134 - DNA, 15 bp, Homo sapiens
actttgggaggaaaa

SEQ ID NO: 429135 - DNA, 15 bp, Homo sapiens
ctttgggaggaaaag

SEQ ID NO: 429136 - DNA, 15 bp, Homo sapiens
tttgggaggaaaagt

SEQ ID NO: 429137 - DNA, 15 bp, Homo sapiens
ttgggaggaaaagtc

SEQ ID NO: 429138 - DNA, 15 bp, Homo sapiens
tgggaggaaaagtca

SEQ ID NO: 429139 - DNA, 15 bp, Homo sapiens
gggaggaaaagtcag

SEQ ID NO: 429140 - DNA, 15 bp, Homo sapiens
ggaggaaaagtcagg

SEQ ID NO: 429141 - DNA, 15 bp, Homo sapiens
gaggaaaagtcagga

SEQ ID NO: 429142 - DNA, 15 bp, Homo sapiens
aggaaaagtcaggag

SEQ ID NO: 429143 - DNA, 15 bp, Homo sapiens
ggaaaagtcaggagg

SEQ ID NO: 429144 - DNA, 15 bp, Homo sapiens
gaaaagtcaggagga

SEQ ID NO: 429145 - DNA, 15 bp, Homo sapiens
aaaagtcaggaggat

SEQ ID NO: 429146 - DNA, 15 bp, Homo sapiens
aaagtcaggaggatc

SEQ ID NO: 429147 - DNA, 15 bp, Homo sapiens
aagtcaggaggatca

SEQ ID NO: 429148 - DNA, 15 bp, Homo sapiens
agtcaggaggatcac

SEQ ID NO: 429149 - DNA, 15 bp, Homo sapiens
gtcaggaggatcact

SEQ ID NO: 429150 - DNA, 15 bp, Homo sapiens
tcaggaggatcactt

SEQ ID NO: 429151 - DNA, 15 bp, Homo sapiens
gaggccaggagttca

SEQ ID NO: 429152 - DNA, 15 bp, Homo sapiens
ccaggagttcaagac

SEQ ID NO: 429153 - DNA, 15 bp, Homo sapiens
aggagttcaagactg

SEQ ID NO: 429154 - DNA, 15 bp, Homo sapiens
ggagttcaagactgg

SEQ ID NO: 429155 - DNA, 15 bp, Homo sapiens
gagttcaagactggc

SEQ ID NO: 429156 - DNA, 15 bp, Homo sapiens
agttcaagactggcc

SEQ ID NO: 429157 - DNA, 15 bp, Homo sapiens
gttcaagactggcct

SEQ ID NO: 429158 - DNA, 15 bp, Homo sapiens
ttcaagactggcctg

SEQ ID NO: 429159 - DNA, 15 bp, Homo sapiens
tcaagactggcctgg

SEQ ID NO: 429160 - DNA, 15 bp, Homo sapiens
caagactggcctggt

SEQ ID NO: 429161 - DNA, 15 bp, Homo sapiens
aagactggcctggtc

SEQ ID NO: 429162 - DNA, 15 bp, Homo sapiens
agactggcctggtca

SEQ ID NO: 429163 - DNA, 15 bp, Homo sapiens
gactggcctggtcaa

SEQ ID NO: 429164 - DNA, 15 bp, Homo sapiens
actggcctggtcaac

SEQ ID NO: 429165 - DNA, 15 bp, Homo sapiens
ctggcctggtcaaca

SEQ ID NO: 429166 - DNA, 15 bp, Homo sapiens
tggcctggtcaacat

SEQ ID NO: 429167 - DNA, 15 bp, Homo sapiens
ggcctggtcaacata

SEQ ID NO: 429168 - DNA, 15 bp, Homo sapiens
gcctggtcaacatag

SEQ ID NO: 429169 - DNA, 15 bp, Homo sapiens
cctggtcaacatagc

SEQ ID NO: 429170 - DNA, 15 bp, Homo sapiens
ctggtcaacatagca

SEQ ID NO: 429171 - DNA, 15 bp, Homo sapiens
tggtcaacatagcaa

SEQ ID NO: 429172 - DNA, 15 bp, Homo sapiens
ggtcaacatagcaag

SEQ ID NO: 429173 - DNA, 15 bp, Homo sapiens
gtcaacatagcaaga

SEQ ID NO: 429174 - DNA, 15 bp, Homo sapiens
tcaacatagcaagac

SEQ ID NO: 429175 - DNA, 15 bp, Homo sapiens
acatagcaagactct

SEQ ID NO: 429176 - DNA, 15 bp, Homo sapiens
catagcaagactctg

SEQ ID NO: 429177 - DNA, 15 bp, Homo sapiens
atagcaagactctgt

SEQ ID NO: 429178 - DNA, 15 bp, Homo sapiens
tagcaagactctgtc

SEQ ID NO: 429179 - DNA, 15 bp, Homo sapiens
caagactctgtccct

SEQ ID NO: 429180 - DNA, 15 bp, Homo sapiens
aagactctgtcccta

SEQ ID NO: 429181 - DNA, 15 bp, Homo sapiens
agactctgtccctat

SEQ ID NO: 429182 - DNA, 15 bp, Homo sapiens
gactctgtccctatt

SEQ ID NO: 429183 - DNA, 15 bp, Homo sapiens
actctgtccctattt

SEQ ID NO: 429184 - DNA, 15 bp, Homo sapiens
ctctgtccctattta

SEQ ID NO: 429185 - DNA, 15 bp, Homo sapiens
tctgtccctatttaa

SEQ ID NO: 429186 - DNA, 15 bp, Homo sapiens
ctgtccctatttaaa

SEQ ID NO: 429187 - DNA, 15 bp, Homo sapiens
tgtccctatttaaaa

SEQ ID NO: 429188 - DNA, 15 bp, Homo sapiens
gtccctatttaaaaa

SEQ ID NO: 429189 - DNA, 15 bp, Homo sapiens
tccctatttaaaaaa

SEQ ID NO: 429190 - DNA, 15 bp, Homo sapiens
cctatttaaaaaaaa

SEQ ID NO: 429191 - DNA, 15 bp, Homo sapiens
ctatttaaaaaaaaa

SEQ ID NO: 429192 - DNA, 15 bp, Homo sapiens
tatttaaaaaaaaat

SEQ ID NO: 429193 - DNA, 15 bp, Homo sapiens
atttaaaaaaaaatt

SEQ ID NO: 429194 - DNA, 15 bp, Homo sapiens
ttaaaaaaaaattaa

SEQ ID NO: 429195 - DNA, 15 bp, Homo sapiens
taaaaaaaaattaat

SEQ ID NO: 429196 - DNA, 15 bp, Homo sapiens
aaaaaaattaattag

SEQ ID NO: 429197 - DNA, 15 bp, Homo sapiens
aaaaaattaattagc

SEQ ID NO: 429198 - DNA, 15 bp, Homo sapiens
aaaaattaattagcc

SEQ ID NO: 429199 - DNA, 15 bp, Homo sapiens
aaaattaattagcct

SEQ ID NO: 429200 - DNA, 15 bp, Homo sapiens
aaattaattagcctg

SEQ ID NO: 429201 - DNA, 15 bp, Homo sapiens
aattaattagcctgg

SEQ ID NO: 429202 - DNA, 15 bp, Homo sapiens
attaattagcctggt

SEQ ID NO: 429203 - DNA, 15 bp, Homo sapiens
ttaattagcctggta

SEQ ID NO: 429204 - DNA, 15 bp, Homo sapiens
taattagcctggtat

SEQ ID NO: 429205 - DNA, 15 bp, Homo sapiens
aattagcctggtatg

SEQ ID NO: 429206 - DNA, 15 bp, Homo sapiens
attagcctggtatgg

SEQ ID NO: 429207 - DNA, 15 bp, Homo sapiens
ttagcctggtatggt

SEQ ID NO: 429208 - DNA, 15 bp, Homo sapiens
tagcctggtatggtg

SEQ ID NO: 429209 - DNA, 15 bp, Homo sapiens
agcctggtatggtgg

SEQ ID NO: 429210 - DNA, 15 bp, Homo sapiens
gcctggtatggtggc

SEQ ID NO: 429211 - DNA, 15 bp, Homo sapiens
cctggtatggtggca

SEQ ID NO: 429212 - DNA, 15 bp, Homo sapiens
ctggtatggtggcat

SEQ ID NO: 429213 - DNA, 15 bp, Homo sapiens
tggtatggtggcatg

SEQ ID NO: 429214 - DNA, 15 bp, Homo sapiens
ggtatggtggcatgc

SEQ ID NO: 429215 - DNA, 15 bp, Homo sapiens
gtatggtggcatgca

SEQ ID NO: 429216 - DNA, 15 bp, Homo sapiens
tatggtggcatgcaa

SEQ ID NO: 429217 - DNA, 15 bp, Homo sapiens
atggtggcatgcaac

SEQ ID NO: 429218 - DNA, 15 bp, Homo sapiens
tggtggcatgcaact

SEQ ID NO: 429219 - DNA, 15 bp, Homo sapiens
ggtggcatgcaactg

SEQ ID NO: 429220 - DNA, 15 bp, Homo sapiens
gtggcatgcaactgt

SEQ ID NO: 429221 - DNA, 15 bp, Homo sapiens
tggcatgcaactgta

SEQ ID NO: 429222 - DNA, 15 bp, Homo sapiens
ggcatgcaactgtag

SEQ ID NO: 429223 - DNA, 15 bp, Homo sapiens
gcatgcaactgtagt

SEQ ID NO: 429224 - DNA, 15 bp, Homo sapiens
catgcaactgtagtt

SEQ ID NO: 429225 - DNA, 15 bp, Homo sapiens
atgcaactgtagttt

SEQ ID NO: 429226 - DNA, 15 bp, Homo sapiens
tgcaactgtagttta

SEQ ID NO: 429227 - DNA, 15 bp, Homo sapiens
gcaactgtagtttag

SEQ ID NO: 429228 - DNA, 15 bp, Homo sapiens
caactgtagtttagc

SEQ ID NO: 429229 - DNA, 15 bp, Homo sapiens
aactgtagtttagct

SEQ ID NO: 429230 - DNA, 15 bp, Homo sapiens
actgtagtttagcta

SEQ ID NO: 429231 - DNA, 15 bp, Homo sapiens
ctgtagtttagctac

SEQ ID NO: 429232 - DNA, 15 bp, Homo sapiens
tgtagtttagctact

SEQ ID NO: 429233 - DNA, 15 bp, Homo sapiens
gtagtttagctactt

SEQ ID NO: 429234 - DNA, 15 bp, Homo sapiens
tagtttagctactta

SEQ ID NO: 429235 - DNA, 15 bp, Homo sapiens
agtttagctacttaa

SEQ ID NO: 429236 - DNA, 15 bp, Homo sapiens
gtttagctacttaag

SEQ ID NO: 429237 - DNA, 15 bp, Homo sapiens
tttagctacttaaga

SEQ ID NO: 429238 - DNA, 15 bp, Homo sapiens
ttagctacttaagag

SEQ ID NO: 429239 - DNA, 15 bp, Homo sapiens
tagctacttaagagg

SEQ ID NO: 429240 - DNA, 15 bp, Homo sapiens
agctacttaagaggc

SEQ ID NO: 429241 - DNA, 15 bp, Homo sapiens
gctacttaagaggct

SEQ ID NO: 429242 - DNA, 15 bp, Homo sapiens
ctacttaagaggctg

SEQ ID NO: 429243 - DNA, 15 bp, Homo sapiens
tacttaagaggctga

SEQ ID NO: 429244 - DNA, 15 bp, Homo sapiens
acttaagaggctgag

SEQ ID NO: 429245 - DNA, 15 bp, Homo sapiens
cttaagaggctgagg

SEQ ID NO: 429246 - DNA, 15 bp, Homo sapiens
ttaagaggctgaggc

SEQ ID NO: 429247 - DNA, 15 bp, Homo sapiens
taagaggctgaggca

SEQ ID NO: 429248 - DNA, 15 bp, Homo sapiens
aagaggctgaggcag

SEQ ID NO: 429249 - DNA, 15 bp, Homo sapiens
agaggctgaggcaga

SEQ ID NO: 429250 - DNA, 15 bp, Homo sapiens
aggctgaggcagaaa

SEQ ID NO: 429251 - DNA, 15 bp, Homo sapiens
ggctgaggcagaaag

SEQ ID NO: 429252 - DNA, 15 bp, Homo sapiens
gctgaggcagaaaga

SEQ ID NO: 429253 - DNA, 15 bp, Homo sapiens
ctgaggcagaaagat

SEQ ID NO: 429254 - DNA, 15 bp, Homo sapiens
tgaggcagaaagatc

SEQ ID NO: 429255 - DNA, 15 bp, Homo sapiens
gaggcagaaagatca

SEQ ID NO: 429256 - DNA, 15 bp, Homo sapiens
aggcagaaagatcac

SEQ ID NO: 429257 - DNA, 15 bp, Homo sapiens
ggcagaaagatcact

SEQ ID NO: 429258 - DNA, 15 bp, Homo sapiens
gcagaaagatcactt

SEQ ID NO: 429259 - DNA, 15 bp, Homo sapiens
cagaaagatcacttg

SEQ ID NO: 429260 - DNA, 15 bp, Homo sapiens
agaaagatcacttga

SEQ ID NO: 429261 - DNA, 15 bp, Homo sapiens
gaaagatcacttgag

SEQ ID NO: 429262 - DNA, 15 bp, Homo sapiens
aaagatcacttgagc

SEQ ID NO: 429263 - DNA, 15 bp, Homo sapiens
gatcacttgagcccg

SEQ ID NO: 429264 - DNA, 15 bp, Homo sapiens
tcacttgagcccgga

SEQ ID NO: 429265 - DNA, 15 bp, Homo sapiens
cacttgagcccggaa

SEQ ID NO: 429266 - DNA, 15 bp, Homo sapiens
acttgagcccggaag

SEQ ID NO: 429267 - DNA, 15 bp, Homo sapiens
cttgagcccggaagt

SEQ ID NO: 429268 - DNA, 15 bp, Homo sapiens
ttgagcccggaagtt

SEQ ID NO: 429269 - DNA, 15 bp, Homo sapiens
tgagcccggaagttc

SEQ ID NO: 429270 - DNA, 15 bp, Homo sapiens
gagcccggaagttca

SEQ ID NO: 429271 - DNA, 15 bp, Homo sapiens
agcccggaagttcaa

SEQ ID NO: 429272 - DNA, 15 bp, Homo sapiens
gcccggaagttcaag

SEQ ID NO: 429273 - DNA, 15 bp, Homo sapiens
cccggaagttcaagg

SEQ ID NO: 429274 - DNA, 15 bp, Homo sapiens
ccggaagttcaaggc

SEQ ID NO: 429275 - DNA, 15 bp, Homo sapiens
cggaagttcaaggct

SEQ ID NO: 429276 - DNA, 15 bp, Homo sapiens
ggaagttcaaggctg

SEQ ID NO: 429277 - DNA, 15 bp, Homo sapiens
gaagttcaaggctgc

SEQ ID NO: 429278 - DNA, 15 bp, Homo sapiens
aagttcaaggctgca

SEQ ID NO: 429279 - DNA, 15 bp, Homo sapiens
agttcaaggctgcag

SEQ ID NO: 429280 - DNA, 15 bp, Homo sapiens
gttcaaggctgcagt

SEQ ID NO: 429281 - DNA, 15 bp, Homo sapiens
ggctgcagtgagctt

SEQ ID NO: 429282 - DNA, 15 bp, Homo sapiens
gctgcagtgagcttt

SEQ ID NO: 429283 - DNA, 15 bp, Homo sapiens
ctgcagtgagctttg

SEQ ID NO: 429284 - DNA, 15 bp, Homo sapiens
tgcagtgagctttga

SEQ ID NO: 429285 - DNA, 15 bp, Homo sapiens
gcagtgagctttgat

SEQ ID NO: 429286 - DNA, 15 bp, Homo sapiens
cagtgagctttgatg

SEQ ID NO: 429287 - DNA, 15 bp, Homo sapiens
agtgagctttgatgg

SEQ ID NO: 429288 - DNA, 15 bp, Homo sapiens
gtgagctttgatggt

SEQ ID NO: 429289 - DNA, 15 bp, Homo sapiens
tgagctttgatggtg

SEQ ID NO: 429290 - DNA, 15 bp, Homo sapiens
gagctttgatggtgt

SEQ ID NO: 429291 - DNA, 15 bp, Homo sapiens
agctttgatggtgta

SEQ ID NO: 429292 - DNA, 15 bp, Homo sapiens
gctttgatggtgtac

SEQ ID NO: 429293 - DNA, 15 bp, Homo sapiens
ctttgatggtgtacc

SEQ ID NO: 429294 - DNA, 15 bp, Homo sapiens
tttgatggtgtacca

SEQ ID NO: 429295 - DNA, 15 bp, Homo sapiens
ttgatggtgtaccag

SEQ ID NO: 429296 - DNA, 15 bp, Homo sapiens
tgatggtgtaccagc

SEQ ID NO: 429297 - DNA, 15 bp, Homo sapiens
gatggtgtaccagct

SEQ ID NO: 429298 - DNA, 15 bp, Homo sapiens
atggtgtaccagctt

SEQ ID NO: 429299 - DNA, 15 bp, Homo sapiens
tggtgtaccagcttg

SEQ ID NO: 429300 - DNA, 15 bp, Homo sapiens
ggtgtaccagcttgg

SEQ ID NO: 429301 - DNA, 15 bp, Homo sapiens
gtgtaccagcttggg

SEQ ID NO: 429302 - DNA, 15 bp, Homo sapiens
tgtaccagcttgggc

SEQ ID NO: 429303 - DNA, 15 bp, Homo sapiens
gtaccagcttgggca

SEQ ID NO: 429304 - DNA, 15 bp, Homo sapiens
taccagcttgggcaa

SEQ ID NO: 429305 - DNA, 15 bp, Homo sapiens
accagcttgggcaac

SEQ ID NO: 429306 - DNA, 15 bp, Homo sapiens
ccagcttgggcaaca

SEQ ID NO: 429307 - DNA, 15 bp, Homo sapiens
cagcttgggcaacag

SEQ ID NO: 429308 - DNA, 15 bp, Homo sapiens
agcttgggcaacaga

SEQ ID NO: 429309 - DNA, 15 bp, Homo sapiens
gcttgggcaacagag

SEQ ID NO: 429310 - DNA, 15 bp, Homo sapiens
cttgggcaacagagt

SEQ ID NO: 429311 - DNA, 15 bp, Homo sapiens
ttgggcaacagagtg

SEQ ID NO: 429312 - DNA, 15 bp, Homo sapiens
gagaccctgtctctt

SEQ ID NO: 429313 - DNA, 15 bp, Homo sapiens
agaccctgtctctta

SEQ ID NO: 429314 - DNA, 15 bp, Homo sapiens
gaccctgtctcttaa

SEQ ID NO: 429315 - DNA, 15 bp, Homo sapiens
accctgtctcttaaa

SEQ ID NO: 429316 - DNA, 15 bp, Homo sapiens
ccctgtctcttaaaa

SEQ ID NO: 429317 - DNA, 15 bp, Homo sapiens
cctgtctcttaaaaa

SEQ ID NO: 429318 - DNA, 15 bp, Homo sapiens
ctgtctcttaaaaaa

SEQ ID NO: 429319 - DNA, 15 bp, Homo sapiens
tgtctcttaaaaaaa

SEQ ID NO: 429320 - DNA, 15 bp, Homo sapiens
gtctcttaaaaaaag

SEQ ID NO: 429321 - DNA, 15 bp, Homo sapiens
tctcttaaaaaaagt

SEQ ID NO: 429322 - DNA, 15 bp, Homo sapiens
ctcttaaaaaaagta

SEQ ID NO: 429323 - DNA, 15 bp, Homo sapiens
tcttaaaaaaagtaa

SEQ ID NO: 429324 - DNA, 15 bp, Homo sapiens
cttaaaaaaagtaat

SEQ ID NO: 429325 - DNA, 15 bp, Homo sapiens
ttaaaaaaagtaatt

SEQ ID NO: 429326 - DNA, 15 bp, Homo sapiens
taaaaaaagtaattt

SEQ ID NO: 429327 - DNA, 15 bp, Homo sapiens
aaaaaaagtaatttt

SEQ ID NO: 429328 - DNA, 15 bp, Homo sapiens
aaaaaagtaattttt

SEQ ID NO: 429329 - DNA, 15 bp, Homo sapiens
aaaaagtaatttttt

SEQ ID NO: 429330 - DNA, 15 bp, Homo sapiens
aaaagtaatttttta

SEQ ID NO: 429331 - DNA, 15 bp, Homo sapiens
aaagtaattttttat

SEQ ID NO: 429332 - DNA, 15 bp, Homo sapiens
aagtaattttttatt

SEQ ID NO: 429333 - DNA, 15 bp, Homo sapiens
agtaattttttattc

SEQ ID NO: 429334 - DNA, 15 bp, Homo sapiens
gtaattttttattct

SEQ ID NO: 429335 - DNA, 15 bp, Homo sapiens
taattttttattcta

SEQ ID NO: 429336 - DNA, 15 bp, Homo sapiens
aattttttattctac

SEQ ID NO: 429337 - DNA, 15 bp, Homo sapiens
attttttattctaca

SEQ ID NO: 429338 - DNA, 15 bp, Homo sapiens
ttttttattctacag

SEQ ID NO: 429339 - DNA, 15 bp, Homo sapiens
tttttattctacagc

SEQ ID NO: 429340 - DNA, 15 bp, Homo sapiens
ttttattctacagca

SEQ ID NO: 429341 - DNA, 15 bp, Homo sapiens
tttattctacagcac

SEQ ID NO: 429342 - DNA, 15 bp, Homo sapiens
ttattctacagcact

SEQ ID NO: 429343 - DNA, 15 bp, Homo sapiens
tattctacagcactg

SEQ ID NO: 429344 - DNA, 15 bp, Homo sapiens
attctacagcactga

SEQ ID NO: 429345 - DNA, 15 bp, Homo sapiens
ttctacagcactgaa

SEQ ID NO: 429346 - DNA, 15 bp, Homo sapiens
tctacagcactgaat

SEQ ID NO: 429347 - DNA, 15 bp, Homo sapiens
ctacagcactgaata

SEQ ID NO: 429348 - DNA, 15 bp, Homo sapiens
tacagcactgaatag

SEQ ID NO: 429349 - DNA, 15 bp, Homo sapiens
acagcactgaatagt

SEQ ID NO: 429350 - DNA, 15 bp, Homo sapiens
cagcactgaatagtt

SEQ ID NO: 429351 - DNA, 15 bp, Homo sapiens
agcactgaatagttt

SEQ ID NO: 429352 - DNA, 15 bp, Homo sapiens
gcactgaatagtttc

SEQ ID NO: 429353 - DNA, 15 bp, Homo sapiens
cactgaatagtttca

SEQ ID NO: 429354 - DNA, 15 bp, Homo sapiens
actgaatagtttcaa

SEQ ID NO: 429355 - DNA, 15 bp, Homo sapiens
ctgaatagtttcaaa

SEQ ID NO: 429356 - DNA, 15 bp, Homo sapiens
tgaatagtttcaaaa

SEQ ID NO: 429357 - DNA, 15 bp, Homo sapiens
gaatagtttcaaaat

SEQ ID NO: 429358 - DNA, 15 bp, Homo sapiens
aatagtttcaaaata

SEQ ID NO: 429359 - DNA, 15 bp, Homo sapiens
atagtttcaaaatat

SEQ ID NO: 429360 - DNA, 15 bp, Homo sapiens
tagtttcaaaatatc

SEQ ID NO: 429361 - DNA, 15 bp, Homo sapiens
agtttcaaaatatct

SEQ ID NO: 429362 - DNA, 15 bp, Homo sapiens
gtttcaaaatatctt

SEQ ID NO: 429363 - DNA, 15 bp, Homo sapiens
tttcaaaatatcttt

SEQ ID NO: 429364 - DNA, 15 bp, Homo sapiens
ttcaaaatatctttt

SEQ ID NO: 429365 - DNA, 15 bp, Homo sapiens
tcaaaatatcttttc

SEQ ID NO: 429366 - DNA, 15 bp, Homo sapiens
caaaatatcttttca

SEQ ID NO: 429367 - DNA, 15 bp, Homo sapiens
aaaatatcttttcat

SEQ ID NO: 429368 - DNA, 15 bp, Homo sapiens
aaatatcttttcatt

SEQ ID NO: 429369 - DNA, 15 bp, Homo sapiens
aatatcttttcattc

SEQ ID NO: 429370 - DNA, 15 bp, Homo sapiens
atatcttttcattca

SEQ ID NO: 429371 - DNA, 15 bp, Homo sapiens
tatcttttcattcac

SEQ ID NO: 429372 - DNA, 15 bp, Homo sapiens
atcttttcattcact

SEQ ID NO: 429373 - DNA, 15 bp, Homo sapiens
tcttttcattcactg

SEQ ID NO: 429374 - DNA, 15 bp, Homo sapiens
cttttcattcactgt

SEQ ID NO: 429375 - DNA, 15 bp, Homo sapiens
ttttcattcactgtc

SEQ ID NO: 429376 - DNA, 15 bp, Homo sapiens
tttcattcactgtct

SEQ ID NO: 429377 - DNA, 15 bp, Homo sapiens
ttcattcactgtctc

SEQ ID NO: 429378 - DNA, 15 bp, Homo sapiens
tcattcactgtctca

SEQ ID NO: 429379 - DNA, 15 bp, Homo sapiens
cattcactgtctcac

SEQ ID NO: 429380 - DNA, 15 bp, Homo sapiens
attcactgtctcacc

SEQ ID NO: 429381 - DNA, 15 bp, Homo sapiens
ttcactgtctcacca

SEQ ID NO: 429382 - DNA, 15 bp, Homo sapiens
tcactgtctcaccag

SEQ ID NO: 429383 - DNA, 15 bp, Homo sapiens
cactgtctcaccagt

SEQ ID NO: 429384 - DNA, 15 bp, Homo sapiens
actgtctcaccagtg

SEQ ID NO: 429385 - DNA, 15 bp, Homo sapiens
ctgtctcaccagtga

SEQ ID NO: 429386 - DNA, 15 bp, Homo sapiens
tgtctcaccagtgaa

SEQ ID NO: 429387 - DNA, 15 bp, Homo sapiens
gtctcaccagtgaag

SEQ ID NO: 429388 - DNA, 15 bp, Homo sapiens
tctcaccagtgaagt

SEQ ID NO: 429389 - DNA, 15 bp, Homo sapiens
ctcaccagtgaagtt

SEQ ID NO: 429390 - DNA, 15 bp, Homo sapiens
tcaccagtgaagtta

SEQ ID NO: 429391 - DNA, 15 bp, Homo sapiens
caccagtgaagttag

SEQ ID NO: 429392 - DNA, 15 bp, Homo sapiens
accagtgaagttagt

SEQ ID NO: 429393 - DNA, 15 bp, Homo sapiens
ccagtgaagttagta

SEQ ID NO: 429394 - DNA, 15 bp, Homo sapiens
cagtgaagttagtaa

SEQ ID NO: 429395 - DNA, 15 bp, Homo sapiens
agtgaagttagtaaa

SEQ ID NO: 429396 - DNA, 15 bp, Homo sapiens
gtgaagttagtaaaa

SEQ ID NO: 429397 - DNA, 15 bp, Homo sapiens
tgaagttagtaaaat

SEQ ID NO: 429398 - DNA, 15 bp, Homo sapiens
gaagttagtaaaatg

SEQ ID NO: 429399 - DNA, 15 bp, Homo sapiens
aagttagtaaaatga

SEQ ID NO: 429400 - DNA, 15 bp, Homo sapiens
agttagtaaaatgag

SEQ ID NO: 429401 - DNA, 15 bp, Homo sapiens
gttagtaaaatgaga

SEQ ID NO: 429402 - DNA, 15 bp, Homo sapiens
ttagtaaaatgagag

SEQ ID NO: 429403 - DNA, 15 bp, Homo sapiens
tagtaaaatgagaga

SEQ ID NO: 429404 - DNA, 15 bp, Homo sapiens
agtaaaatgagagag

SEQ ID NO: 429405 - DNA, 15 bp, Homo sapiens
gtaaaatgagagaga

SEQ ID NO: 429406 - DNA, 15 bp, Homo sapiens
taaaatgagagagat

SEQ ID NO: 429407 - DNA, 15 bp, Homo sapiens
aaaatgagagagatg

SEQ ID NO: 429408 - DNA, 15 bp, Homo sapiens
aaatgagagagatga

SEQ ID NO: 429409 - DNA, 15 bp, Homo sapiens
aatgagagagatgat

SEQ ID NO: 429410 - DNA, 15 bp, Homo sapiens
atgagagagatgatt

SEQ ID NO: 429411 - DNA, 15 bp, Homo sapiens
tgagagagatgatta

SEQ ID NO: 429412 - DNA, 15 bp, Homo sapiens
gagagagatgattaa

SEQ ID NO: 429413 - DNA, 15 bp, Homo sapiens
agagagatgattaac

SEQ ID NO: 429414 - DNA, 15 bp, Homo sapiens
gagagatgattaaca

SEQ ID NO: 429415 - DNA, 15 bp, Homo sapiens
agagatgattaacac

SEQ ID NO: 429416 - DNA, 15 bp, Homo sapiens
gagatgattaacacg

SEQ ID NO: 429417 - DNA, 15 bp, Homo sapiens
agatgattaacacgc

SEQ ID NO: 429418 - DNA, 15 bp, Homo sapiens
gatgattaacacgca

SEQ ID NO: 429419 - DNA, 15 bp, Homo sapiens
atgattaacacgcag

SEQ ID NO: 429420 - DNA, 15 bp, Homo sapiens
tgattaacacgcaga

SEQ ID NO: 429421 - DNA, 15 bp, Homo sapiens
gattaacacgcagag

SEQ ID NO: 429422 - DNA, 15 bp, Homo sapiens
attaacacgcagaga

SEQ ID NO: 429423 - DNA, 15 bp, Homo sapiens
ttaacacgcagagaa

SEQ ID NO: 429424 - DNA, 15 bp, Homo sapiens
taacacgcagagaat

SEQ ID NO: 429425 - DNA, 15 bp, Homo sapiens
aacacgcagagaatt

SEQ ID NO: 429426 - DNA, 15 bp, Homo sapiens
acacgcagagaattt

SEQ ID NO: 429427 - DNA, 15 bp, Homo sapiens
cacgcagagaattta

SEQ ID NO: 429428 - DNA, 15 bp, Homo sapiens
acgcagagaatttaa

SEQ ID NO: 429429 - DNA, 15 bp, Homo sapiens
cgcagagaatttaag

SEQ ID NO: 429430 - DNA, 15 bp, Homo sapiens
gcagagaatttaagg

SEQ ID NO: 429431 - DNA, 15 bp, Homo sapiens
cagagaatttaaggg

SEQ ID NO: 429432 - DNA, 15 bp, Homo sapiens
agagaatttaaggga

SEQ ID NO: 429433 - DNA, 15 bp, Homo sapiens
gagaatttaagggac

SEQ ID NO: 429434 - DNA, 15 bp, Homo sapiens
agaatttaagggaca

SEQ ID NO: 429435 - DNA, 15 bp, Homo sapiens
gaatttaagggacaa

SEQ ID NO: 429436 - DNA, 15 bp, Homo sapiens
aatttaagggacaaa

SEQ ID NO: 429437 - DNA, 15 bp, Homo sapiens
atttaagggacaaac

SEQ ID NO: 429438 - DNA, 15 bp, Homo sapiens
tttaagggacaaacc

SEQ ID NO: 429439 - DNA, 15 bp, Homo sapiens
ttaagggacaaaccc

SEQ ID NO: 429440 - DNA, 15 bp, Homo sapiens
taagggacaaaccca

SEQ ID NO: 429441 - DNA, 15 bp, Homo sapiens
aagggacaaacccaa

SEQ ID NO: 429442 - DNA, 15 bp, Homo sapiens
agggacaaacccaag

SEQ ID NO: 429443 - DNA, 15 bp, Homo sapiens
gggacaaacccaagt

SEQ ID NO: 429444 - DNA, 15 bp, Homo sapiens
ggacaaacccaagta

SEQ ID NO: 429445 - DNA, 15 bp, Homo sapiens
gacaaacccaagtaa

SEQ ID NO: 429446 - DNA, 15 bp, Homo sapiens
acaaacccaagtaag

SEQ ID NO: 429447 - DNA, 15 bp, Homo sapiens
caaacccaagtaagg

SEQ ID NO: 429448 - DNA, 15 bp, Homo sapiens
aaacccaagtaaggg

SEQ ID NO: 429449 - DNA, 15 bp, Homo sapiens
aacccaagtaagggc

SEQ ID NO: 429450 - DNA, 15 bp, Homo sapiens
acccaagtaagggcc

SEQ ID NO: 429451 - DNA, 15 bp, Homo sapiens
cccaagtaagggccc

SEQ ID NO: 429452 - DNA, 15 bp, Homo sapiens
ccaagtaagggccca

SEQ ID NO: 429453 - DNA, 15 bp, Homo sapiens
caagtaagggcccat

SEQ ID NO: 429454 - DNA, 15 bp, Homo sapiens
aagtaagggcccatg

SEQ ID NO: 429455 - DNA, 15 bp, Homo sapiens
agtaagggcccatga

SEQ ID NO: 429456 - DNA, 15 bp, Homo sapiens
gtaagggcccatgag

SEQ ID NO: 429457 - DNA, 15 bp, Homo sapiens
taagggcccatgagc

SEQ ID NO: 429458 - DNA, 15 bp, Homo sapiens
aagggcccatgagca

SEQ ID NO: 429459 - DNA, 15 bp, Homo sapiens
agggcccatgagcac

SEQ ID NO: 429460 - DNA, 15 bp, Homo sapiens
gggcccatgagcaca

SEQ ID NO: 429461 - DNA, 15 bp, Homo sapiens
ggcccatgagcacag

SEQ ID NO: 429462 - DNA, 15 bp, Homo sapiens
gcccatgagcacagg

SEQ ID NO: 429463 - DNA, 15 bp, Homo sapiens
cccatgagcacagga

SEQ ID NO: 429464 - DNA, 15 bp, Homo sapiens
ccatgagcacaggat

SEQ ID NO: 429465 - DNA, 15 bp, Homo sapiens
catgagcacaggatg

SEQ ID NO: 429466 - DNA, 15 bp, Homo sapiens
atgagcacaggatga

SEQ ID NO: 429467 - DNA, 15 bp, Homo sapiens
tgagcacaggatgag

SEQ ID NO: 429468 - DNA, 15 bp, Homo sapiens
gagcacaggatgagt

SEQ ID NO: 429469 - DNA, 15 bp, Homo sapiens
agcacaggatgagta

SEQ ID NO: 429470 - DNA, 15 bp, Homo sapiens
gcacaggatgagtaa

SEQ ID NO: 429471 - DNA, 15 bp, Homo sapiens
cacaggatgagtaag

SEQ ID NO: 429472 - DNA, 15 bp, Homo sapiens
acaggatgagtaagg

SEQ ID NO: 429473 - DNA, 15 bp, Homo sapiens
caggatgagtaaggg

SEQ ID NO: 429474 - DNA, 15 bp, Homo sapiens
aggatgagtaagggt

SEQ ID NO: 429475 - DNA, 15 bp, Homo sapiens
ggatgagtaagggtg

SEQ ID NO: 429476 - DNA, 15 bp, Homo sapiens
gatgagtaagggtgt

SEQ ID NO: 429477 - DNA, 15 bp, Homo sapiens
atgagtaagggtgtg

SEQ ID NO: 429478 - DNA, 15 bp, Homo sapiens
tgagtaagggtgtgc

SEQ ID NO: 429479 - DNA, 15 bp, Homo sapiens
gagtaagggtgtgcc

SEQ ID NO: 429480 - DNA, 15 bp, Homo sapiens
agtaagggtgtgcct

SEQ ID NO: 429481 - DNA, 15 bp, Homo sapiens
gtaagggtgtgcctg

SEQ ID NO: 429482 - DNA, 15 bp, Homo sapiens
taagggtgtgcctgt

SEQ ID NO: 429483 - DNA, 15 bp, Homo sapiens
aagggtgtgcctgtg

SEQ ID NO: 429484 - DNA, 15 bp, Homo sapiens
agggtgtgcctgtgt

SEQ ID NO: 429485 - DNA, 15 bp, Homo sapiens
gggtgtgcctgtgtg

SEQ ID NO: 429486 - DNA, 15 bp, Homo sapiens
ggtgtgcctgtgtgg

SEQ ID NO: 429487 - DNA, 15 bp, Homo sapiens
gtgtgcctgtgtggt

SEQ ID NO: 429488 - DNA, 15 bp, Homo sapiens
tgtgcctgtgtggta

SEQ ID NO: 429489 - DNA, 15 bp, Homo sapiens
gtgcctgtgtggtat

SEQ ID NO: 429490 - DNA, 15 bp, Homo sapiens
tgcctgtgtggtatg

SEQ ID NO: 429491 - DNA, 15 bp, Homo sapiens
gcctgtgtggtatgg

SEQ ID NO: 429492 - DNA, 15 bp, Homo sapiens
cctgtgtggtatgga

SEQ ID NO: 429493 - DNA, 15 bp, Homo sapiens
ctgtgtggtatggac

SEQ ID NO: 429494 - DNA, 15 bp, Homo sapiens
tgtgtggtatggact

SEQ ID NO: 429495 - DNA, 15 bp, Homo sapiens
gtgtggtatggactg

SEQ ID NO: 429496 - DNA, 15 bp, Homo sapiens
tgtggtatggactgg

SEQ ID NO: 429497 - DNA, 15 bp, Homo sapiens
gtggtatggactgga

SEQ ID NO: 429498 - DNA, 15 bp, Homo sapiens
tggtatggactggac

SEQ ID NO: 429499 - DNA, 15 bp, Homo sapiens
ggtatggactggact

SEQ ID NO: 429500 - DNA, 15 bp, Homo sapiens
gtatggactggactg

SEQ ID NO: 429501 - DNA, 15 bp, Homo sapiens
tatggactggactgt

SEQ ID NO: 429502 - DNA, 15 bp, Homo sapiens
atggactggactgta

SEQ ID NO: 429503 - DNA, 15 bp, Homo sapiens
tggactggactgtac

SEQ ID NO: 429504 - DNA, 15 bp, Homo sapiens
ggactggactgtacc

SEQ ID NO: 429505 - DNA, 15 bp, Homo sapiens
gactggactgtacct

SEQ ID NO: 429506 - DNA, 15 bp, Homo sapiens
actggactgtaccta

SEQ ID NO: 429507 - DNA, 15 bp, Homo sapiens
ctggactgtacctaa

SEQ ID NO: 429508 - DNA, 15 bp, Homo sapiens
tggactgtacctaag

SEQ ID NO: 429509 - DNA, 15 bp, Homo sapiens
ggactgtacctaagg

SEQ ID NO: 429510 - DNA, 15 bp, Homo sapiens
gactgtacctaaggc

SEQ ID NO: 429511 - DNA, 15 bp, Homo sapiens
actgtacctaaggct

SEQ ID NO: 429512 - DNA, 15 bp, Homo sapiens
ctgtacctaaggctt

SEQ ID NO: 429513 - DNA, 15 bp, Homo sapiens
tgtacctaaggcttt

SEQ ID NO: 429514 - DNA, 15 bp, Homo sapiens
gtacctaaggctttg

SEQ ID NO: 429515 - DNA, 15 bp, Homo sapiens
tacctaaggctttgg

SEQ ID NO: 429516 - DNA, 15 bp, Homo sapiens
acctaaggctttggc

SEQ ID NO: 429517 - DNA, 15 bp, Homo sapiens
cctaaggctttggct

SEQ ID NO: 429518 - DNA, 15 bp, Homo sapiens
ctaaggctttggctg

SEQ ID NO: 429519 - DNA, 15 bp, Homo sapiens
taaggctttggctgc

SEQ ID NO: 429520 - DNA, 15 bp, Homo sapiens
aaggctttggctgca

SEQ ID NO: 429521 - DNA, 15 bp, Homo sapiens
aggctttggctgcaa

SEQ ID NO: 429522 - DNA, 15 bp, Homo sapiens
ggctttggctgcaaa

SEQ ID NO: 429523 - DNA, 15 bp, Homo sapiens
gctttggctgcaaat

SEQ ID NO: 429524 - DNA, 15 bp, Homo sapiens
ctttggctgcaaatc

SEQ ID NO: 429525 - DNA, 15 bp, Homo sapiens
tttggctgcaaatct

SEQ ID NO: 429526 - DNA, 15 bp, Homo sapiens
ttggctgcaaatctt

SEQ ID NO: 429527 - DNA, 15 bp, Homo sapiens
tggctgcaaatcttt

SEQ ID NO: 429528 - DNA, 15 bp, Homo sapiens
ggctgcaaatctttg

SEQ ID NO: 429529 - DNA, 15 bp, Homo sapiens
gctgcaaatctttgt

SEQ ID NO: 429530 - DNA, 15 bp, Homo sapiens
ctgcaaatctttgtc

SEQ ID NO: 429531 - DNA, 15 bp, Homo sapiens
tgcaaatctttgtct

SEQ ID NO: 429532 - DNA, 15 bp, Homo sapiens
gcaaatctttgtctg

SEQ ID NO: 429533 - DNA, 15 bp, Homo sapiens
caaatctttgtctgg

SEQ ID NO: 429534 - DNA, 15 bp, Homo sapiens
aaatctttgtctggt

SEQ ID NO: 429535 - DNA, 15 bp, Homo sapiens
aatctttgtctggtt

SEQ ID NO: 429536 - DNA, 15 bp, Homo sapiens
atctttgtctggttt

SEQ ID NO: 429537 - DNA, 15 bp, Homo sapiens
tctttgtctggtttt

SEQ ID NO: 429538 - DNA, 15 bp, Homo sapiens
ctttgtctggtttta

SEQ ID NO: 429539 - DNA, 15 bp, Homo sapiens
tttgtctggttttac

SEQ ID NO: 429540 - DNA, 15 bp, Homo sapiens
ttgtctggttttact

SEQ ID NO: 429541 - DNA, 15 bp, Homo sapiens
tgtctggttttactt

SEQ ID NO: 429542 - DNA, 15 bp, Homo sapiens
gtctggttttacttt

SEQ ID NO: 429543 - DNA, 15 bp, Homo sapiens
tctggttttacttta

SEQ ID NO: 429544 - DNA, 15 bp, Homo sapiens
ctggttttactttac

SEQ ID NO: 429545 - DNA, 15 bp, Homo sapiens
tggttttactttacc

SEQ ID NO: 429546 - DNA, 15 bp, Homo sapiens
ggttttactttacca

SEQ ID NO: 429547 - DNA, 15 bp, Homo sapiens
gttttactttaccac

SEQ ID NO: 429548 - DNA, 15 bp, Homo sapiens
ttttactttaccaca

SEQ ID NO: 429549 - DNA, 15 bp, Homo sapiens
tttactttaccacag

SEQ ID NO: 429550 - DNA, 15 bp, Homo sapiens
ttactttaccacaga

SEQ ID NO: 429551 - DNA, 15 bp, Homo sapiens
tactttaccacagaa

SEQ ID NO: 429552 - DNA, 15 bp, Homo sapiens
actttaccacagaac

SEQ ID NO: 429553 - DNA, 15 bp, Homo sapiens
ctttaccacagaaca

SEQ ID NO: 429554 - DNA, 15 bp, Homo sapiens
tttaccacagaacag

SEQ ID NO: 429555 - DNA, 15 bp, Homo sapiens
ttaccacagaacagt

SEQ ID NO: 429556 - DNA, 15 bp, Homo sapiens
taccacagaacagta

SEQ ID NO: 429557 - DNA, 15 bp, Homo sapiens
accacagaacagtat

SEQ ID NO: 429558 - DNA, 15 bp, Homo sapiens
ccacagaacagtatt

SEQ ID NO: 429559 - DNA, 15 bp, Homo sapiens
cacagaacagtattt

SEQ ID NO: 429560 - DNA, 15 bp, Homo sapiens
acagaacagtatttt

SEQ ID NO: 429561 - DNA, 15 bp, Homo sapiens
cagaacagtattttt

SEQ ID NO: 429562 - DNA, 15 bp, Homo sapiens
agaacagtattttta

SEQ ID NO: 429563 - DNA, 15 bp, Homo sapiens
gaacagtatttttaa

SEQ ID NO: 429564 - DNA, 15 bp, Homo sapiens
aacagtatttttaac

SEQ ID NO: 429565 - DNA, 15 bp, Homo sapiens
acagtatttttaaca

SEQ ID NO: 429566 - DNA, 15 bp, Homo sapiens
cagtatttttaacat

SEQ ID NO: 429567 - DNA, 15 bp, Homo sapiens
agtatttttaacatc

SEQ ID NO: 429568 - DNA, 15 bp, Homo sapiens
gtatttttaacatct

SEQ ID NO: 429569 - DNA, 15 bp, Homo sapiens
tatttttaacatctc

SEQ ID NO: 429570 - DNA, 15 bp, Homo sapiens
atttttaacatctcc

SEQ ID NO: 429571 - DNA, 15 bp, Homo sapiens
tttttaacatctcct

SEQ ID NO: 429572 - DNA, 15 bp, Homo sapiens
ttttaacatctcctc

SEQ ID NO: 429573 - DNA, 15 bp, Homo sapiens
tttaacatctcctcc

SEQ ID NO: 429574 - DNA, 15 bp, Homo sapiens
ttaacatctcctcct

SEQ ID NO: 429575 - DNA, 15 bp, Homo sapiens
taacatctcctcctt

SEQ ID NO: 429576 - DNA, 15 bp, Homo sapiens
aacatctcctccttc

SEQ ID NO: 429577 - DNA, 15 bp, Homo sapiens
acatctcctccttca

SEQ ID NO: 429578 - DNA, 15 bp, Homo sapiens
catctcctccttcat

SEQ ID NO: 429579 - DNA, 15 bp, Homo sapiens
atctcctccttcatt

SEQ ID NO: 429580 - DNA, 15 bp, Homo sapiens
tctcctccttcattc

SEQ ID NO: 429581 - DNA, 15 bp, Homo sapiens
ctcctccttcattca

SEQ ID NO: 429582 - DNA, 15 bp, Homo sapiens
tcctccttcattcat

SEQ ID NO: 429583 - DNA, 15 bp, Homo sapiens
cctccttcattcata

SEQ ID NO: 429584 - DNA, 15 bp, Homo sapiens
ctccttcattcatac

SEQ ID NO: 429585 - DNA, 15 bp, Homo sapiens
tccttcattcataca

SEQ ID NO: 429586 - DNA, 15 bp, Homo sapiens
ccttcattcatacaa

SEQ ID NO: 429587 - DNA, 15 bp, Homo sapiens
cttcattcatacaaa

SEQ ID NO: 429588 - DNA, 15 bp, Homo sapiens
ttcattcatacaaaa

SEQ ID NO: 429589 - DNA, 15 bp, Homo sapiens
tcattcatacaaaaa

SEQ ID NO: 429590 - DNA, 15 bp, Homo sapiens
cattcatacaaaaat

SEQ ID NO: 429591 - DNA, 15 bp, Homo sapiens
attcatacaaaaatt

SEQ ID NO: 429592 - DNA, 15 bp, Homo sapiens
ttcatacaaaaattt

SEQ ID NO: 429593 - DNA, 15 bp, Homo sapiens
tcatacaaaaattta

SEQ ID NO: 429594 - DNA, 15 bp, Homo sapiens
catacaaaaatttat

SEQ ID NO: 429595 - DNA, 15 bp, Homo sapiens
atacaaaaatttatt

SEQ ID NO: 429596 - DNA, 15 bp, Homo sapiens
tacaaaaatttattg

SEQ ID NO: 429597 - DNA, 15 bp, Homo sapiens
acaaaaatttattgg

SEQ ID NO: 429598 - DNA, 15 bp, Homo sapiens
caaaaatttattggc

SEQ ID NO: 429599 - DNA, 15 bp, Homo sapiens
aaaaatttattggct

SEQ ID NO: 429600 - DNA, 15 bp, Homo sapiens
aaaatttattggctt

SEQ ID NO: 429601 - DNA, 15 bp, Homo sapiens
aaatttattggcttt

SEQ ID NO: 429602 - DNA, 15 bp, Homo sapiens
aatttattggctttc

SEQ ID NO: 429603 - DNA, 15 bp, Homo sapiens
atttattggctttcc

SEQ ID NO: 429604 - DNA, 15 bp, Homo sapiens
tttattggctttccg

SEQ ID NO: 429605 - DNA, 15 bp, Homo sapiens
ttattggctttccgc

SEQ ID NO: 429606 - DNA, 15 bp, Homo sapiens
tattggctttccgct

SEQ ID NO: 429607 - DNA, 15 bp, Homo sapiens
attggctttccgcta

SEQ ID NO: 429608 - DNA, 15 bp, Homo sapiens
ttggctttccgctat

SEQ ID NO: 429609 - DNA, 15 bp, Homo sapiens
tggctttccgctata

SEQ ID NO: 429610 - DNA, 15 bp, Homo sapiens
ggctttccgctatac

SEQ ID NO: 429611 - DNA, 15 bp, Homo sapiens
gctttccgctatacc

SEQ ID NO: 429612 - DNA, 15 bp, Homo sapiens
ctttccgctatacct

SEQ ID NO: 429613 - DNA, 15 bp, Homo sapiens
tttccgctatacctg

SEQ ID NO: 429614 - DNA, 15 bp, Homo sapiens
ttccgctatacctgc

SEQ ID NO: 429615 - DNA, 15 bp, Homo sapiens
tccgctatacctgct

SEQ ID NO: 429616 - DNA, 15 bp, Homo sapiens
ccgctatacctgctc

SEQ ID NO: 429617 - DNA, 15 bp, Homo sapiens
cgctatacctgctct

SEQ ID NO: 429618 - DNA, 15 bp, Homo sapiens
gctatacctgctctg

SEQ ID NO: 429619 - DNA, 15 bp, Homo sapiens
ctatacctgctctgg

SEQ ID NO: 429620 - DNA, 15 bp, Homo sapiens
tatacctgctctggc

SEQ ID NO: 429621 - DNA, 15 bp, Homo sapiens
atacctgctctggca

SEQ ID NO: 429622 - DNA, 15 bp, Homo sapiens
tacctgctctggcac

SEQ ID NO: 429623 - DNA, 15 bp, Homo sapiens
acctgctctggcaca

SEQ ID NO: 429624 - DNA, 15 bp, Homo sapiens
cctgctctggcacaa

SEQ ID NO: 429625 - DNA, 15 bp, Homo sapiens
ctgctctggcacaaa

SEQ ID NO: 429626 - DNA, 15 bp, Homo sapiens
tgctctggcacaaat

SEQ ID NO: 429627 - DNA, 15 bp, Homo sapiens
gctctggcacaaatt

SEQ ID NO: 429628 - DNA, 15 bp, Homo sapiens
ctctggcacaaattt

SEQ ID NO: 429629 - DNA, 15 bp, Homo sapiens
tctggcacaaatttc

SEQ ID NO: 429630 - DNA, 15 bp, Homo sapiens
ctggcacaaatttca

SEQ ID NO: 429631 - DNA, 15 bp, Homo sapiens
tggcacaaatttcag

SEQ ID NO: 429632 - DNA, 15 bp, Homo sapiens
ggcacaaatttcagc

SEQ ID NO: 429633 - DNA, 15 bp, Homo sapiens
gcacaaatttcagcc

SEQ ID NO: 429634 - DNA, 15 bp, Homo sapiens
cacaaatttcagcct

SEQ ID NO: 429635 - DNA, 15 bp, Homo sapiens
acaaatttcagcctt

SEQ ID NO: 429636 - DNA, 15 bp, Homo sapiens
caaatttcagccttc

SEQ ID NO: 429637 - DNA, 15 bp, Homo sapiens
aaatttcagccttcc

SEQ ID NO: 429638 - DNA, 15 bp, Homo sapiens
aatttcagccttcca

SEQ ID NO: 429639 - DNA, 15 bp, Homo sapiens
atttcagccttccat

SEQ ID NO: 429640 - DNA, 15 bp, Homo sapiens
tttcagccttccatg

SEQ ID NO: 429641 - DNA, 15 bp, Homo sapiens
ttcagccttccatga

SEQ ID NO: 429642 - DNA, 15 bp, Homo sapiens
tcagccttccatgag

SEQ ID NO: 429643 - DNA, 15 bp, Homo sapiens
cagccttccatgagg

SEQ ID NO: 429644 - DNA, 15 bp, Homo sapiens
agccttccatgaggg

SEQ ID NO: 429645 - DNA, 15 bp, Homo sapiens
gccttccatgagggc

SEQ ID NO: 429646 - DNA, 15 bp, Homo sapiens
ccttccatgagggct

SEQ ID NO: 429647 - DNA, 15 bp, Homo sapiens
cttccatgagggctc

SEQ ID NO: 429648 - DNA, 15 bp, Homo sapiens
ttccatgagggctca

SEQ ID NO: 429649 - DNA, 15 bp, Homo sapiens
tccatgagggctcag

SEQ ID NO: 429650 - DNA, 15 bp, Homo sapiens
ccatgagggctcagt

SEQ ID NO: 429651 - DNA, 15 bp, Homo sapiens
catgagggctcagtc

SEQ ID NO: 429652 - DNA, 15 bp, Homo sapiens
atgagggctcagtct

SEQ ID NO: 429653 - DNA, 15 bp, Homo sapiens
tgagggctcagtctg

SEQ ID NO: 429654 - DNA, 15 bp, Homo sapiens
gagggctcagtctgg

SEQ ID NO: 429655 - DNA, 15 bp, Homo sapiens
agggctcagtctggc

SEQ ID NO: 429656 - DNA, 15 bp, Homo sapiens
gggctcagtctggca

SEQ ID NO: 429657 - DNA, 15 bp, Homo sapiens
ggctcagtctggcac

SEQ ID NO: 429658 - DNA, 15 bp, Homo sapiens
gctcagtctggcacc

SEQ ID NO: 429659 - DNA, 15 bp, Homo sapiens
ctcagtctggcacca

SEQ ID NO: 429660 - DNA, 15 bp, Homo sapiens
tcagtctggcaccag

SEQ ID NO: 429661 - DNA, 15 bp, Homo sapiens
cagtctggcaccaga

SEQ ID NO: 429662 - DNA, 15 bp, Homo sapiens
agtctggcaccagag

SEQ ID NO: 429663 - DNA, 15 bp, Homo sapiens
gtctggcaccagagt

SEQ ID NO: 429664 - DNA, 15 bp, Homo sapiens
tctggcaccagagtc

SEQ ID NO: 429665 - DNA, 15 bp, Homo sapiens
ctggcaccagagtca

SEQ ID NO: 429666 - DNA, 15 bp, Homo sapiens
tggcaccagagtcag

SEQ ID NO: 429667 - DNA, 15 bp, Homo sapiens
ggcaccagagtcagg

SEQ ID NO: 429668 - DNA, 15 bp, Homo sapiens
gcaccagagtcaggt

SEQ ID NO: 429669 - DNA, 15 bp, Homo sapiens
caccagagtcaggtt

SEQ ID NO: 429670 - DNA, 15 bp, Homo sapiens
accagagtcaggttt

SEQ ID NO: 429671 - DNA, 15 bp, Homo sapiens
ccagagtcaggtttg

SEQ ID NO: 429672 - DNA, 15 bp, Homo sapiens
cagagtcaggtttgc

SEQ ID NO: 429673 - DNA, 15 bp, Homo sapiens
agagtcaggtttgca

SEQ ID NO: 429674 - DNA, 15 bp, Homo sapiens
gagtcaggtttgcaa

SEQ ID NO: 429675 - DNA, 15 bp, Homo sapiens
agtcaggtttgcaaa

SEQ ID NO: 429676 - DNA, 15 bp, Homo sapiens
gtcaggtttgcaaag

SEQ ID NO: 429677 - DNA, 15 bp, Homo sapiens
tcaggtttgcaaaga

SEQ ID NO: 429678 - DNA, 15 bp, Homo sapiens
caggtttgcaaagag

SEQ ID NO: 429679 - DNA, 15 bp, Homo sapiens
aggtttgcaaagagg

SEQ ID NO: 429680 - DNA, 15 bp, Homo sapiens
ggtttgcaaagaggc

SEQ ID NO: 429681 - DNA, 15 bp, Homo sapiens
gtttgcaaagaggcc

SEQ ID NO: 429682 - DNA, 15 bp, Homo sapiens
tttgcaaagaggcca

SEQ ID NO: 429683 - DNA, 15 bp, Homo sapiens
ttgcaaagaggccat

SEQ ID NO: 429684 - DNA, 15 bp, Homo sapiens
tgcaaagaggccatg

SEQ ID NO: 429685 - DNA, 15 bp, Homo sapiens
gcaaagaggccatgg

SEQ ID NO: 429686 - DNA, 15 bp, Homo sapiens
caaagaggccatggt

SEQ ID NO: 429687 - DNA, 15 bp, Homo sapiens
aaagaggccatggtg

SEQ ID NO: 429688 - DNA, 15 bp, Homo sapiens
aagaggccatggtga

SEQ ID NO: 429689 - DNA, 15 bp, Homo sapiens
agaggccatggtgag

SEQ ID NO: 429690 - DNA, 15 bp, Homo sapiens
gaggccatggtgagg

SEQ ID NO: 429691 - DNA, 15 bp, Homo sapiens
aggccatggtgaggg

SEQ ID NO: 429692 - DNA, 15 bp, Homo sapiens
ggccatggtgaggga

SEQ ID NO: 429693 - DNA, 15 bp, Homo sapiens
gccatggtgagggag

SEQ ID NO: 429694 - DNA, 15 bp, Homo sapiens
ccatggtgagggagt

SEQ ID NO: 429695 - DNA, 15 bp, Homo sapiens
catggtgagggagtg

SEQ ID NO: 429696 - DNA, 15 bp, Homo sapiens
atggtgagggagtgt

SEQ ID NO: 429697 - DNA, 15 bp, Homo sapiens
tggtgagggagtgtg

SEQ ID NO: 429698 - DNA, 15 bp, Homo sapiens
ggtgagggagtgtgg

SEQ ID NO: 429699 - DNA, 15 bp, Homo sapiens
gtgagggagtgtggt

SEQ ID NO: 429700 - DNA, 15 bp, Homo sapiens
tgagggagtgtggtg

SEQ ID NO: 429701 - DNA, 15 bp, Homo sapiens
gagggagtgtggtga

SEQ ID NO: 429702 - DNA, 15 bp, Homo sapiens
agggagtgtggtgaa

SEQ ID NO: 429703 - DNA, 15 bp, Homo sapiens
gggagtgtggtgaat

SEQ ID NO: 429704 - DNA, 15 bp, Homo sapiens
ggagtgtggtgaatg

SEQ ID NO: 429705 - DNA, 15 bp, Homo sapiens
gagtgtggtgaatgc

SEQ ID NO: 429706 - DNA, 15 bp, Homo sapiens
agtgtggtgaatgct

SEQ ID NO: 429707 - DNA, 15 bp, Homo sapiens
gtgtggtgaatgctg

SEQ ID NO: 429708 - DNA, 15 bp, Homo sapiens
tgtggtgaatgctgg

SEQ ID NO: 429709 - DNA, 15 bp, Homo sapiens
gtggtgaatgctgga

SEQ ID NO: 429710 - DNA, 15 bp, Homo sapiens
tggtgaatgctggat

SEQ ID NO: 429711 - DNA, 15 bp, Homo sapiens
ggtgaatgctggatc

SEQ ID NO: 429712 - DNA, 15 bp, Homo sapiens
gtgaatgctggatcc

SEQ ID NO: 429713 - DNA, 15 bp, Homo sapiens
tgaatgctggatccc

SEQ ID NO: 429714 - DNA, 15 bp, Homo sapiens
gaatgctggatcccc

SEQ ID NO: 429715 - DNA, 15 bp, Homo sapiens
aatgctggatccccg

SEQ ID NO: 429716 - DNA, 15 bp, Homo sapiens
atgctggatccccgt

SEQ ID NO: 429717 - DNA, 15 bp, Homo sapiens
tgctggatccccgtg

SEQ ID NO: 429718 - DNA, 15 bp, Homo sapiens
gctggatccccgtga

SEQ ID NO: 429719 - DNA, 15 bp, Homo sapiens
ctggatccccgtgag

SEQ ID NO: 429720 - DNA, 15 bp, Homo sapiens
tggatccccgtgagg

SEQ ID NO: 429721 - DNA, 15 bp, Homo sapiens
ggatccccgtgaggg

SEQ ID NO: 429722 - DNA, 15 bp, Homo sapiens
gatccccgtgaggga

SEQ ID NO: 429723 - DNA, 15 bp, Homo sapiens
atccccgtgagggaa

SEQ ID NO: 429724 - DNA, 15 bp, Homo sapiens
tccccgtgagggaag

SEQ ID NO: 429725 - DNA, 15 bp, Homo sapiens
ccccgtgagggaagg

SEQ ID NO: 429726 - DNA, 15 bp, Homo sapiens
cccgtgagggaaggc

SEQ ID NO: 429727 - DNA, 15 bp, Homo sapiens
ccgtgagggaaggct

SEQ ID NO: 429728 - DNA, 15 bp, Homo sapiens
cgtgagggaaggctg

SEQ ID NO: 429729 - DNA, 15 bp, Homo sapiens
gtgagggaaggctgc

SEQ ID NO: 429730 - DNA, 15 bp, Homo sapiens
tgagggaaggctgca

SEQ ID NO: 429731 - DNA, 15 bp, Homo sapiens
gagggaaggctgcag

SEQ ID NO: 429732 - DNA, 15 bp, Homo sapiens
agggaaggctgcagc

SEQ ID NO: 429733 - DNA, 15 bp, Homo sapiens
gggaaggctgcagct

SEQ ID NO: 429734 - DNA, 15 bp, Homo sapiens
ggaaggctgcagctc

SEQ ID NO: 429735 - DNA, 15 bp, Homo sapiens
gaaggctgcagctca

SEQ ID NO: 429736 - DNA, 15 bp, Homo sapiens
aaggctgcagctcat

SEQ ID NO: 429737 - DNA, 15 bp, Homo sapiens
aggctgcagctcatg

SEQ ID NO: 429738 - DNA, 15 bp, Homo sapiens
ggctgcagctcatgc

SEQ ID NO: 429739 - DNA, 15 bp, Homo sapiens
gctgcagctcatgct

SEQ ID NO: 429740 - DNA, 15 bp, Homo sapiens
ctgcagctcatgctg

SEQ ID NO: 429741 - DNA, 15 bp, Homo sapiens
tgcagctcatgctgg

SEQ ID NO: 429742 - DNA, 15 bp, Homo sapiens
gcagctcatgctggt

SEQ ID NO: 429743 - DNA, 15 bp, Homo sapiens
cagctcatgctggtg

SEQ ID NO: 429744 - DNA, 15 bp, Homo sapiens
agctcatgctggtgg

SEQ ID NO: 429745 - DNA, 15 bp, Homo sapiens
gctcatgctggtggt

SEQ ID NO: 429746 - DNA, 15 bp, Homo sapiens
ctcatgctggtggtg

SEQ ID NO: 429747 - DNA, 15 bp, Homo sapiens
tcatgctggtggtgc

SEQ ID NO: 429748 - DNA, 15 bp, Homo sapiens
catgctggtggtgca

SEQ ID NO: 429749 - DNA, 15 bp, Homo sapiens
atgctggtggtgcag

SEQ ID NO: 429750 - DNA, 15 bp, Homo sapiens
tgctggtggtgcagg

SEQ ID NO: 429751 - DNA, 15 bp, Homo sapiens
gctggtggtgcaggt

SEQ ID NO: 429752 - DNA, 15 bp, Homo sapiens
ctggtggtgcaggtg

SEQ ID NO: 429753 - DNA, 15 bp, Homo sapiens
tggtggtgcaggtgg

SEQ ID NO: 429754 - DNA, 15 bp, Homo sapiens
ggtggtgcaggtggc

SEQ ID NO: 429755 - DNA, 15 bp, Homo sapiens
gtggtgcaggtggca

SEQ ID NO: 429756 - DNA, 15 bp, Homo sapiens
tggtgcaggtggcac

SEQ ID NO: 429757 - DNA, 15 bp, Homo sapiens
ggtgcaggtggcact

SEQ ID NO: 429758 - DNA, 15 bp, Homo sapiens
gtgcaggtggcactg

SEQ ID NO: 429759 - DNA, 15 bp, Homo sapiens
tgcaggtggcactgg

SEQ ID NO: 429760 - DNA, 15 bp, Homo sapiens
gcaggtggcactgga

SEQ ID NO: 429761 - DNA, 15 bp, Homo sapiens
caggtggcactggag

SEQ ID NO: 429762 - DNA, 15 bp, Homo sapiens
aggtggcactggagc

SEQ ID NO: 429763 - DNA, 15 bp, Homo sapiens
ggtggcactggagcc

SEQ ID NO: 429764 - DNA, 15 bp, Homo sapiens
gtggcactggagccg

SEQ ID NO: 429765 - DNA, 15 bp, Homo sapiens
tggcactggagccgg

SEQ ID NO: 429766 - DNA, 15 bp, Homo sapiens
ggcactggagccgga

SEQ ID NO: 429767 - DNA, 15 bp, Homo sapiens
gcactggagccggat

SEQ ID NO: 429768 - DNA, 15 bp, Homo sapiens
cactggagccggatc

SEQ ID NO: 429769 - DNA, 15 bp, Homo sapiens
actggagccggatcc

SEQ ID NO: 429770 - DNA, 15 bp, Homo sapiens
ctggagccggatccc

SEQ ID NO: 429771 - DNA, 15 bp, Homo sapiens
tggagccggatccct

SEQ ID NO: 429772 - DNA, 15 bp, Homo sapiens
ggagccggatccctg

SEQ ID NO: 429773 - DNA, 15 bp, Homo sapiens
gagccggatccctga

SEQ ID NO: 429774 - DNA, 15 bp, Homo sapiens
agccggatccctgaa

SEQ ID NO: 429775 - DNA, 15 bp, Homo sapiens
gccggatccctgaag

SEQ ID NO: 429776 - DNA, 15 bp, Homo sapiens
ccggatccctgaagg

SEQ ID NO: 429777 - DNA, 15 bp, Homo sapiens
cggatccctgaaggg

SEQ ID NO: 429778 - DNA, 15 bp, Homo sapiens
ggatccctgaagggt

SEQ ID NO: 429779 - DNA, 15 bp, Homo sapiens
gatccctgaagggtc

SEQ ID NO: 429780 - DNA, 15 bp, Homo sapiens
atccctgaagggtca

SEQ ID NO: 429781 - DNA, 15 bp, Homo sapiens
tccctgaagggtcaa

SEQ ID NO: 429782 - DNA, 15 bp, Homo sapiens
ccctgaagggtcaaa

SEQ ID NO: 429783 - DNA, 15 bp, Homo sapiens
cctgaagggtcaaaa

SEQ ID NO: 429784 - DNA, 15 bp, Homo sapiens
ctgaagggtcaaaag

SEQ ID NO: 429785 - DNA, 15 bp, Homo sapiens
tgaagggtcaaaagg

SEQ ID NO: 429786 - DNA, 15 bp, Homo sapiens
gaagggtcaaaaggg

SEQ ID NO: 429787 - DNA, 15 bp, Homo sapiens
aagggtcaaaagggg

SEQ ID NO: 429788 - DNA, 15 bp, Homo sapiens
agggtcaaaaggggt

SEQ ID NO: 429789 - DNA, 15 bp, Homo sapiens
gggtcaaaaggggtg

SEQ ID NO: 429790 - DNA, 15 bp, Homo sapiens
ggtcaaaaggggtga

SEQ ID NO: 429791 - DNA, 15 bp, Homo sapiens
gtcaaaaggggtgag

SEQ ID NO: 429792 - DNA, 15 bp, Homo sapiens
tcaaaaggggtgagc

SEQ ID NO: 429793 - DNA, 15 bp, Homo sapiens
caaaaggggtgagcc

SEQ ID NO: 429794 - DNA, 15 bp, Homo sapiens
aaaaggggtgagccc

SEQ ID NO: 429795 - DNA, 15 bp, Homo sapiens
aaaggggtgagccct

SEQ ID NO: 429796 - DNA, 15 bp, Homo sapiens
aaggggtgagccctg

SEQ ID NO: 429797 - DNA, 15 bp, Homo sapiens
aggggtgagccctgt

SEQ ID NO: 429798 - DNA, 15 bp, Homo sapiens
ggggtgagccctgtg

SEQ ID NO: 429799 - DNA, 15 bp, Homo sapiens
gggtgagccctgtgg

SEQ ID NO: 429800 - DNA, 15 bp, Homo sapiens
ggtgagccctgtgga

SEQ ID NO: 429801 - DNA, 15 bp, Homo sapiens
gtgagccctgtggat

SEQ ID NO: 429802 - DNA, 15 bp, Homo sapiens
tgagccctgtggatt

SEQ ID NO: 429803 - DNA, 15 bp, Homo sapiens
agccctgtggatttc

SEQ ID NO: 429804 - DNA, 15 bp, Homo sapiens
gccctgtggatttct

SEQ ID NO: 429805 - DNA, 15 bp, Homo sapiens
ccctgtggatttctt

SEQ ID NO: 429806 - DNA, 15 bp, Homo sapiens
cctgtggatttcttt

SEQ ID NO: 429807 - DNA, 15 bp, Homo sapiens
ctgtggatttctttg

SEQ ID NO: 429808 - DNA, 15 bp, Homo sapiens
tgtggatttctttga

SEQ ID NO: 429809 - DNA, 15 bp, Homo sapiens
gtggatttctttgac

SEQ ID NO: 429810 - DNA, 15 bp, Homo sapiens
tggatttctttgact

SEQ ID NO: 429811 - DNA, 15 bp, Homo sapiens
ggatttctttgactt

SEQ ID NO: 429812 - DNA, 15 bp, Homo sapiens
gatttctttgacttt

SEQ ID NO: 429813 - DNA, 15 bp, Homo sapiens
atttctttgactttc

SEQ ID NO: 429814 - DNA, 15 bp, Homo sapiens
tttctttgactttca

SEQ ID NO: 429815 - DNA, 15 bp, Homo sapiens
ttctttgactttcac

SEQ ID NO: 429816 - DNA, 15 bp, Homo sapiens
tctttgactttcacc

SEQ ID NO: 429817 - DNA, 15 bp, Homo sapiens
ctttgactttcacca

SEQ ID NO: 429818 - DNA, 15 bp, Homo sapiens
tttgactttcaccag

SEQ ID NO: 429819 - DNA, 15 bp, Homo sapiens
ttgactttcaccagt

SEQ ID NO: 429820 - DNA, 15 bp, Homo sapiens
tgactttcaccagtg

SEQ ID NO: 429821 - DNA, 15 bp, Homo sapiens
gactttcaccagtga

SEQ ID NO: 429822 - DNA, 15 bp, Homo sapiens
actttcaccagtgag

SEQ ID NO: 429823 - DNA, 15 bp, Homo sapiens
ctttcaccagtgagg

SEQ ID NO: 429824 - DNA, 15 bp, Homo sapiens
tttcaccagtgaggg

SEQ ID NO: 429825 - DNA, 15 bp, Homo sapiens
ttcaccagtgagggt

SEQ ID NO: 429826 - DNA, 15 bp, Homo sapiens
tcaccagtgagggtc

SEQ ID NO: 429827 - DNA, 15 bp, Homo sapiens
caccagtgagggtca

SEQ ID NO: 429828 - DNA, 15 bp, Homo sapiens
accagtgagggtcaa

SEQ ID NO: 429829 - DNA, 15 bp, Homo sapiens
ccagtgagggtcaat

SEQ ID NO: 429830 - DNA, 15 bp, Homo sapiens
cagtgagggtcaatg

SEQ ID NO: 429831 - DNA, 15 bp, Homo sapiens
agtgagggtcaatga

SEQ ID NO: 429832 - DNA, 15 bp, Homo sapiens
gtgagggtcaatgag

SEQ ID NO: 429833 - DNA, 15 bp, Homo sapiens
tgagggtcaatgaga

SEQ ID NO: 429834 - DNA, 15 bp, Homo sapiens
gagggtcaatgagat

SEQ ID NO: 429835 - DNA, 15 bp, Homo sapiens
agggtcaatgagatt

SEQ ID NO: 429836 - DNA, 15 bp, Homo sapiens
gggtcaatgagattg

SEQ ID NO: 429837 - DNA, 15 bp, Homo sapiens
ggtcaatgagattgt

SEQ ID NO: 429838 - DNA, 15 bp, Homo sapiens
gtcaatgagattgtt

SEQ ID NO: 429839 - DNA, 15 bp, Homo sapiens
tcaatgagattgtta

SEQ ID NO: 429840 - DNA, 15 bp, Homo sapiens
caatgagattgttaa

SEQ ID NO: 429841 - DNA, 15 bp, Homo sapiens
aatgagattgttaag

SEQ ID NO: 429842 - DNA, 15 bp, Homo sapiens
atgagattgttaaga

SEQ ID NO: 429843 - DNA, 15 bp, Homo sapiens
tgagattgttaagaa

SEQ ID NO: 429844 - DNA, 15 bp, Homo sapiens
gagattgttaagaaa

SEQ ID NO: 429845 - DNA, 15 bp, Homo sapiens
agattgttaagaaag

SEQ ID NO: 429846 - DNA, 15 bp, Homo sapiens
gattgttaagaaagc

SEQ ID NO: 429847 - DNA, 15 bp, Homo sapiens
attgttaagaaagca

SEQ ID NO: 429848 - DNA, 15 bp, Homo sapiens
ttgttaagaaagcaa

SEQ ID NO: 429849 - DNA, 15 bp, Homo sapiens
tgttaagaaagcaaa

SEQ ID NO: 429850 - DNA, 15 bp, Homo sapiens
gttaagaaagcaaaa

SEQ ID NO: 429851 - DNA, 15 bp, Homo sapiens
ttaagaaagcaaaac

SEQ ID NO: 429852 - DNA, 15 bp, Homo sapiens
taagaaagcaaaaca

SEQ ID NO: 429853 - DNA, 15 bp, Homo sapiens
aagaaagcaaaacaa

SEQ ID NO: 429854 - DNA, 15 bp, Homo sapiens
agaaagcaaaacaac

SEQ ID NO: 429855 - DNA, 15 bp, Homo sapiens
gaaagcaaaacaaca

SEQ ID NO: 429856 - DNA, 15 bp, Homo sapiens
aaagcaaaacaacac

SEQ ID NO: 429857 - DNA, 15 bp, Homo sapiens
aagcaaaacaacaca

SEQ ID NO: 429858 - DNA, 15 bp, Homo sapiens
agcaaaacaacacag

SEQ ID NO: 429859 - DNA, 15 bp, Homo sapiens
gcaaaacaacacaga

SEQ ID NO: 429860 - DNA, 15 bp, Homo sapiens
caaaacaacacagat

SEQ ID NO: 429861 - DNA, 15 bp, Homo sapiens
aaaacaacacagatg

SEQ ID NO: 429862 - DNA, 15 bp, Homo sapiens
aaacaacacagatgt

SEQ ID NO: 429863 - DNA, 15 bp, Homo sapiens
aacaacacagatgtt

SEQ ID NO: 429864 - DNA, 15 bp, Homo sapiens
acaacacagatgttg

SEQ ID NO: 429865 - DNA, 15 bp, Homo sapiens
caacacagatgttgt

SEQ ID NO: 429866 - DNA, 15 bp, Homo sapiens
aacacagatgttgtc

SEQ ID NO: 429867 - DNA, 15 bp, Homo sapiens
acacagatgttgtct

SEQ ID NO: 429868 - DNA, 15 bp, Homo sapiens
cacagatgttgtctt

SEQ ID NO: 429869 - DNA, 15 bp, Homo sapiens
acagatgttgtcttg

SEQ ID NO: 429870 - DNA, 15 bp, Homo sapiens
cagatgttgtcttga

SEQ ID NO: 429871 - DNA, 15 bp, Homo sapiens
agatgttgtcttgag

SEQ ID NO: 429872 - DNA, 15 bp, Homo sapiens
gatgttgtcttgaga

SEQ ID NO: 429873 - DNA, 15 bp, Homo sapiens
atgttgtcttgagat

SEQ ID NO: 429874 - DNA, 15 bp, Homo sapiens
tgttgtcttgagata

SEQ ID NO: 429875 - DNA, 15 bp, Homo sapiens
gttgtcttgagataa

SEQ ID NO: 429876 - DNA, 15 bp, Homo sapiens
ttgtcttgagataat

SEQ ID NO: 429877 - DNA, 15 bp, Homo sapiens
tgtcttgagataata

SEQ ID NO: 429878 - DNA, 15 bp, Homo sapiens
gtcttgagataataa

SEQ ID NO: 429879 - DNA, 15 bp, Homo sapiens
tcttgagataataat

SEQ ID NO: 429880 - DNA, 15 bp, Homo sapiens
cttgagataataatg

SEQ ID NO: 429881 - DNA, 15 bp, Homo sapiens
ttgagataataatgt

SEQ ID NO: 429882 - DNA, 15 bp, Homo sapiens
tgagataataatgtc

SEQ ID NO: 429883 - DNA, 15 bp, Homo sapiens
gagataataatgtct

SEQ ID NO: 429884 - DNA, 15 bp, Homo sapiens
agataataatgtctt

SEQ ID NO: 429885 - DNA, 15 bp, Homo sapiens
gataataatgtcttc

SEQ ID NO: 429886 - DNA, 15 bp, Homo sapiens
ataataatgtcttct

SEQ ID NO: 429887 - DNA, 15 bp, Homo sapiens
taataatgtcttcta

SEQ ID NO: 429888 - DNA, 15 bp, Homo sapiens
aataatgtcttctat

SEQ ID NO: 429889 - DNA, 15 bp, Homo sapiens
ataatgtcttctatg

SEQ ID NO: 429890 - DNA, 15 bp, Homo sapiens
taatgtcttctatgg

SEQ ID NO: 429891 - DNA, 15 bp, Homo sapiens
aatgtcttctatggg

SEQ ID NO: 429892 - DNA, 15 bp, Homo sapiens
atgtcttctatgggg

SEQ ID NO: 429893 - DNA, 15 bp, Homo sapiens
tgtcttctatggggg

SEQ ID NO: 429894 - DNA, 15 bp, Homo sapiens
gtcttctatgggggc

SEQ ID NO: 429895 - DNA, 15 bp, Homo sapiens
tcttctatgggggct

SEQ ID NO: 429896 - DNA, 15 bp, Homo sapiens
cttctatgggggctg

SEQ ID NO: 429897 - DNA, 15 bp, Homo sapiens
ttctatgggggctgg

SEQ ID NO: 429898 - DNA, 15 bp, Homo sapiens
tctatgggggctgga

SEQ ID NO: 429899 - DNA, 15 bp, Homo sapiens
ctatgggggctggaa

SEQ ID NO: 429900 - DNA, 15 bp, Homo sapiens
tatgggggctggaag

SEQ ID NO: 429901 - DNA, 15 bp, Homo sapiens
atgggggctggaagg

SEQ ID NO: 429902 - DNA, 15 bp, Homo sapiens
tgggggctggaaggg

SEQ ID NO: 429903 - DNA, 15 bp, Homo sapiens
gggggctggaagggg

SEQ ID NO: 429904 - DNA, 15 bp, Homo sapiens
ggggctggaagggga

SEQ ID NO: 429905 - DNA, 15 bp, Homo sapiens
gggctggaaggggaa

SEQ ID NO: 429906 - DNA, 15 bp, Homo sapiens
ggctggaaggggaag

SEQ ID NO: 429907 - DNA, 15 bp, Homo sapiens
gctggaaggggaaga

SEQ ID NO: 429908 - DNA, 15 bp, Homo sapiens
ctggaaggggaagac

SEQ ID NO: 429909 - DNA, 15 bp, Homo sapiens
tggaaggggaagact

SEQ ID NO: 429910 - DNA, 15 bp, Homo sapiens
ggaaggggaagacta

SEQ ID NO: 429911 - DNA, 15 bp, Homo sapiens
gaaggggaagactac

SEQ ID NO: 429912 - DNA, 15 bp, Homo sapiens
aaggggaagactact

SEQ ID NO: 429913 - DNA, 15 bp, Homo sapiens
aggggaagactactt

SEQ ID NO: 429914 - DNA, 15 bp, Homo sapiens
ggggaagactacttc

SEQ ID NO: 429915 - DNA, 15 bp, Homo sapiens
gggaagactacttcc

SEQ ID NO: 429916 - DNA, 15 bp, Homo sapiens
ggaagactacttcct

SEQ ID NO: 429917 - DNA, 15 bp, Homo sapiens
gaagactacttcctt

SEQ ID NO: 429918 - DNA, 15 bp, Homo sapiens
aagactacttccttc

SEQ ID NO: 429919 - DNA, 15 bp, Homo sapiens
agactacttccttct

SEQ ID NO: 429920 - DNA, 15 bp, Homo sapiens
gactacttccttcta

SEQ ID NO: 429921 - DNA, 15 bp, Homo sapiens
actacttccttctac

SEQ ID NO: 429922 - DNA, 15 bp, Homo sapiens
ctacttccttctact

SEQ ID NO: 429923 - DNA, 15 bp, Homo sapiens
tacttccttctactg

SEQ ID NO: 429924 - DNA, 15 bp, Homo sapiens
acttccttctactgc

SEQ ID NO: 429925 - DNA, 15 bp, Homo sapiens
cttccttctactgca

SEQ ID NO: 429926 - DNA, 15 bp, Homo sapiens
ttccttctactgcag

SEQ ID NO: 429927 - DNA, 15 bp, Homo sapiens
tccttctactgcaga

SEQ ID NO: 429928 - DNA, 15 bp, Homo sapiens
ccttctactgcagag

SEQ ID NO: 429929 - DNA, 15 bp, Homo sapiens
cttctactgcagagt

SEQ ID NO: 429930 - DNA, 15 bp, Homo sapiens
ttctactgcagagtt

SEQ ID NO: 429931 - DNA, 15 bp, Homo sapiens
tctactgcagagttg

SEQ ID NO: 429932 - DNA, 15 bp, Homo sapiens
ctactgcagagttgc

SEQ ID NO: 429933 - DNA, 15 bp, Homo sapiens
tactgcagagttgct

SEQ ID NO: 429934 - DNA, 15 bp, Homo sapiens
actgcagagttgctc

SEQ ID NO: 429935 - DNA, 15 bp, Homo sapiens
ctgcagagttgctcc

SEQ ID NO: 429936 - DNA, 15 bp, Homo sapiens
tgcagagttgctcca

SEQ ID NO: 429937 - DNA, 15 bp, Homo sapiens
gcagagttgctccat

SEQ ID NO: 429938 - DNA, 15 bp, Homo sapiens
cagagttgctccatg

SEQ ID NO: 429939 - DNA, 15 bp, Homo sapiens
agagttgctccatgc

SEQ ID NO: 429940 - DNA, 15 bp, Homo sapiens
gagttgctccatgct

SEQ ID NO: 429941 - DNA, 15 bp, Homo sapiens
agttgctccatgctg

SEQ ID NO: 429942 - DNA, 15 bp, Homo sapiens
gttgctccatgctgc

SEQ ID NO: 429943 - DNA, 15 bp, Homo sapiens
ttgctccatgctgct

SEQ ID NO: 429944 - DNA, 15 bp, Homo sapiens
tgctccatgctgctt

SEQ ID NO: 429945 - DNA, 15 bp, Homo sapiens
gctccatgctgcttt

SEQ ID NO: 429946 - DNA, 15 bp, Homo sapiens
ctccatgctgctttc

SEQ ID NO: 429947 - DNA, 15 bp, Homo sapiens
tccatgctgctttct

SEQ ID NO: 429948 - DNA, 15 bp, Homo sapiens
ccatgctgctttctt

SEQ ID NO: 429949 - DNA, 15 bp, Homo sapiens
catgctgctttcttc

SEQ ID NO: 429950 - DNA, 15 bp, Homo sapiens
atgctgctttcttcc

SEQ ID NO: 429951 - DNA, 15 bp, Homo sapiens
tgctgctttcttcca

SEQ ID NO: 429952 - DNA, 15 bp, Homo sapiens
gctgctttcttccac

SEQ ID NO: 429953 - DNA, 15 bp, Homo sapiens
ctgctttcttccaca

SEQ ID NO: 429954 - DNA, 15 bp, Homo sapiens
tgctttcttccacag

SEQ ID NO: 429955 - DNA, 15 bp, Homo sapiens
gctttcttccacaga

SEQ ID NO: 429956 - DNA, 15 bp, Homo sapiens
ctttcttccacagac

SEQ ID NO: 429957 - DNA, 15 bp, Homo sapiens
tttcttccacagacc

SEQ ID NO: 429958 - DNA, 15 bp, Homo sapiens
ttcttccacagacct

SEQ ID NO: 429959 - DNA, 15 bp, Homo sapiens
tcttccacagaccta

SEQ ID NO: 429960 - DNA, 15 bp, Homo sapiens
cttccacagacctac

SEQ ID NO: 429961 - DNA, 15 bp, Homo sapiens
ttccacagacctact

SEQ ID NO: 429962 - DNA, 15 bp, Homo sapiens
tccacagacctactt

SEQ ID NO: 429963 - DNA, 15 bp, Homo sapiens
ccacagacctacttt

SEQ ID NO: 429964 - DNA, 15 bp, Homo sapiens
cacagacctactttg

SEQ ID NO: 429965 - DNA, 15 bp, Homo sapiens
acagacctactttgt

SEQ ID NO: 429966 - DNA, 15 bp, Homo sapiens
cagacctactttgta

SEQ ID NO: 429967 - DNA, 15 bp, Homo sapiens
agacctactttgtat

SEQ ID NO: 429968 - DNA, 15 bp, Homo sapiens
gacctactttgtatg

SEQ ID NO: 429969 - DNA, 15 bp, Homo sapiens
acctactttgtatga

SEQ ID NO: 429970 - DNA, 15 bp, Homo sapiens
cctactttgtatgaa

SEQ ID NO: 429971 - DNA, 15 bp, Homo sapiens
ctactttgtatgaaa

SEQ ID NO: 429972 - DNA, 15 bp, Homo sapiens
tactttgtatgaaat

SEQ ID NO: 429973 - DNA, 15 bp, Homo sapiens
actttgtatgaaatg

SEQ ID NO: 429974 - DNA, 15 bp, Homo sapiens
ctttgtatgaaatgc

SEQ ID NO: 429975 - DNA, 15 bp, Homo sapiens
tttgtatgaaatgct

SEQ ID NO: 429976 - DNA, 15 bp, Homo sapiens
ttgtatgaaatgctc

SEQ ID NO: 429977 - DNA, 15 bp, Homo sapiens
tgtatgaaatgctcc

SEQ ID NO: 429978 - DNA, 15 bp, Homo sapiens
gtatgaaatgctccc

SEQ ID NO: 429979 - DNA, 15 bp, Homo sapiens
tatgaaatgctccca

SEQ ID NO: 429980 - DNA, 15 bp, Homo sapiens
atgaaatgctcccat

SEQ ID NO: 429981 - DNA, 15 bp, Homo sapiens
tgaaatgctcccatt

SEQ ID NO: 429982 - DNA, 15 bp, Homo sapiens
gaaatgctcccattt

SEQ ID NO: 429983 - DNA, 15 bp, Homo sapiens
aaatgctcccatttc

SEQ ID NO: 429984 - DNA, 15 bp, Homo sapiens
aatgctcccatttct

SEQ ID NO: 429985 - DNA, 15 bp, Homo sapiens
atgctcccatttctc

SEQ ID NO: 429986 - DNA, 15 bp, Homo sapiens
tgctcccatttctca

SEQ ID NO: 429987 - DNA, 15 bp, Homo sapiens
gctcccatttctcag

SEQ ID NO: 429988 - DNA, 15 bp, Homo sapiens
ctcccatttctcagg

SEQ ID NO: 429989 - DNA, 15 bp, Homo sapiens
tcccatttctcaggt

SEQ ID NO: 429990 - DNA, 15 bp, Homo sapiens
cccatttctcaggtg

SEQ ID NO: 429991 - DNA, 15 bp, Homo sapiens
ccatttctcaggtgt

SEQ ID NO: 429992 - DNA, 15 bp, Homo sapiens
catttctcaggtgtt

SEQ ID NO: 429993 - DNA, 15 bp, Homo sapiens
atttctcaggtgttt

SEQ ID NO: 429994 - DNA, 15 bp, Homo sapiens
tttctcaggtgtttt

SEQ ID NO: 429995 - DNA, 15 bp, Homo sapiens
ttctcaggtgttttc

SEQ ID NO: 429996 - DNA, 15 bp, Homo sapiens
tctcaggtgttttcc

SEQ ID NO: 429997 - DNA, 15 bp, Homo sapiens
ctcaggtgttttcct

SEQ ID NO: 429998 - DNA, 15 bp, Homo sapiens
tcaggtgttttcctt

SEQ ID NO: 429999 - DNA, 15 bp, Homo sapiens
caggtgttttccttc

SEQ ID NO: 430000 - DNA, 15 bp, Homo sapiens
aggtgttttccttcc

SEQ ID NO: 430001 - DNA, 15 bp, Homo sapiens
ggtgttttccttcct

SEQ ID NO: 430002 - DNA, 15 bp, Homo sapiens
gtgttttccttcctt

SEQ ID NO: 430003 - DNA, 15 bp, Homo sapiens
gttttccttccttga

SEQ ID NO: 430004 - DNA, 15 bp, Homo sapiens
ttttccttccttgat

SEQ ID NO: 430005 - DNA, 15 bp, Homo sapiens
tttccttccttgatc

SEQ ID NO: 430006 - DNA, 15 bp, Homo sapiens
ttccttccttgatcc

SEQ ID NO: 430007 - DNA, 15 bp, Homo sapiens
tccttccttgatccc

SEQ ID NO: 430008 - DNA, 15 bp, Homo sapiens
ccttccttgatcccc

SEQ ID NO: 430009 - DNA, 15 bp, Homo sapiens
cttccttgatcccct

SEQ ID NO: 430010 - DNA, 15 bp, Homo sapiens
ttccttgatcccctt

SEQ ID NO: 430011 - DNA, 15 bp, Homo sapiens
tccttgatccccttc

SEQ ID NO: 430012 - DNA, 15 bp, Homo sapiens
ccttgatccccttct

SEQ ID NO: 430013 - DNA, 15 bp, Homo sapiens
cttgatccccttcta

SEQ ID NO: 430014 - DNA, 15 bp, Homo sapiens
ttgatccccttctaa

SEQ ID NO: 430015 - DNA, 15 bp, Homo sapiens
tgatccccttctaac

SEQ ID NO: 430016 - DNA, 15 bp, Homo sapiens
gatccccttctaaca

SEQ ID NO: 430017 - DNA, 15 bp, Homo sapiens
atccccttctaacaa

SEQ ID NO: 430018 - DNA, 15 bp, Homo sapiens
tccccttctaacaat

SEQ ID NO: 430019 - DNA, 15 bp, Homo sapiens
ccccttctaacaatg

SEQ ID NO: 430020 - DNA, 15 bp, Homo sapiens
cccttctaacaatgg

SEQ ID NO: 430021 - DNA, 15 bp, Homo sapiens
ccttctaacaatggc

SEQ ID NO: 430022 - DNA, 15 bp, Homo sapiens
cttctaacaatggcc

SEQ ID NO: 430023 - DNA, 15 bp, Homo sapiens
ttctaacaatggcct

SEQ ID NO: 430024 - DNA, 15 bp, Homo sapiens
tctaacaatggcctc

SEQ ID NO: 430025 - DNA, 15 bp, Homo sapiens
ctaacaatggcctcc

SEQ ID NO: 430026 - DNA, 15 bp, Homo sapiens
taacaatggcctcct

SEQ ID NO: 430027 - DNA, 15 bp, Homo sapiens
aacaatggcctcctg

SEQ ID NO: 430028 - DNA, 15 bp, Homo sapiens
acaatggcctcctga

SEQ ID NO: 430029 - DNA, 15 bp, Homo sapiens
caatggcctcctgag

SEQ ID NO: 430030 - DNA, 15 bp, Homo sapiens
aatggcctcctgagg

SEQ ID NO: 430031 - DNA, 15 bp, Homo sapiens
atggcctcctgaggt

SEQ ID NO: 430032 - DNA, 15 bp, Homo sapiens
tggcctcctgaggtt

SEQ ID NO: 430033 - DNA, 15 bp, Homo sapiens
ggcctcctgaggttc

SEQ ID NO: 430034 - DNA, 15 bp, Homo sapiens
gcctcctgaggttcc

SEQ ID NO: 430035 - DNA, 15 bp, Homo sapiens
cctcctgaggttcca

SEQ ID NO: 430036 - DNA, 15 bp, Homo sapiens
ctcctgaggttccac

SEQ ID NO: 430037 - DNA, 15 bp, Homo sapiens
tcctgaggttccaca

SEQ ID NO: 430038 - DNA, 15 bp, Homo sapiens
cctgaggttccacat

SEQ ID NO: 430039 - DNA, 15 bp, Homo sapiens
ctgaggttccacatt

SEQ ID NO: 430040 - DNA, 15 bp, Homo sapiens
tgaggttccacattt

SEQ ID NO: 430041 - DNA, 15 bp, Homo sapiens
gaggttccacatttt

SEQ ID NO: 430042 - DNA, 15 bp, Homo sapiens
aggttccacattttc

SEQ ID NO: 430043 - DNA, 15 bp, Homo sapiens
ggttccacattttct

SEQ ID NO: 430044 - DNA, 15 bp, Homo sapiens
gttccacattttctt

SEQ ID NO: 430045 - DNA, 15 bp, Homo sapiens
ttccacattttcttt

SEQ ID NO: 430046 - DNA, 15 bp, Homo sapiens
tccacattttctttt

SEQ ID NO: 430047 - DNA, 15 bp, Homo sapiens
ccacattttctttta

SEQ ID NO: 430048 - DNA, 15 bp, Homo sapiens
cacattttcttttat

SEQ ID NO: 430049 - DNA, 15 bp, Homo sapiens
acattttcttttatg

SEQ ID NO: 430050 - DNA, 15 bp, Homo sapiens
cattttcttttatgc

SEQ ID NO: 430051 - DNA, 15 bp, Homo sapiens
attttcttttatgcc

SEQ ID NO: 430052 - DNA, 15 bp, Homo sapiens
ttttcttttatgcca

SEQ ID NO: 430053 - DNA, 15 bp, Homo sapiens
tttcttttatgccag

SEQ ID NO: 430054 - DNA, 15 bp, Homo sapiens
ttcttttatgccagt

SEQ ID NO: 430055 - DNA, 15 bp, Homo sapiens
tcttttatgccagtt

SEQ ID NO: 430056 - DNA, 15 bp, Homo sapiens
cttttatgccagttt

SEQ ID NO: 430057 - DNA, 15 bp, Homo sapiens
ttttatgccagttta

SEQ ID NO: 430058 - DNA, 15 bp, Homo sapiens
tttatgccagtttat

SEQ ID NO: 430059 - DNA, 15 bp, Homo sapiens
ttatgccagtttatt

SEQ ID NO: 430060 - DNA, 15 bp, Homo sapiens
tatgccagtttattc

SEQ ID NO: 430061 - DNA, 15 bp, Homo sapiens
atgccagtttattca

SEQ ID NO: 430062 - DNA, 15 bp, Homo sapiens
tgccagtttattcat

SEQ ID NO: 430063 - DNA, 15 bp, Homo sapiens
gccagtttattcatt

SEQ ID NO: 430064 - DNA, 15 bp, Homo sapiens
ccagtttattcattt

SEQ ID NO: 430065 - DNA, 15 bp, Homo sapiens
cagtttattcatttt

SEQ ID NO: 430066 - DNA, 15 bp, Homo sapiens
agtttattcattttc

SEQ ID NO: 430067 - DNA, 15 bp, Homo sapiens
gtttattcattttct

SEQ ID NO: 430068 - DNA, 15 bp, Homo sapiens
tttattcattttctc

SEQ ID NO: 430069 - DNA, 15 bp, Homo sapiens
ttattcattttctca

SEQ ID NO: 430070 - DNA, 15 bp, Homo sapiens
tattcattttctcat

SEQ ID NO: 430071 - DNA, 15 bp, Homo sapiens
attcattttctcatt

SEQ ID NO: 430072 - DNA, 15 bp, Homo sapiens
ttcattttctcattc

SEQ ID NO: 430073 - DNA, 15 bp, Homo sapiens
tcattttctcattca

SEQ ID NO: 430074 - DNA, 15 bp, Homo sapiens
cattttctcattcat

SEQ ID NO: 430075 - DNA, 15 bp, Homo sapiens
attttctcattcatt

SEQ ID NO: 430076 - DNA, 15 bp, Homo sapiens
ttttctcattcatta

SEQ ID NO: 430077 - DNA, 15 bp, Homo sapiens
tttctcattcattaa

SEQ ID NO: 430078 - DNA, 15 bp, Homo sapiens
ttctcattcattaat

SEQ ID NO: 430079 - DNA, 15 bp, Homo sapiens
tctcattcattaatc

SEQ ID NO: 430080 - DNA, 15 bp, Homo sapiens
ctcattcattaatcc

SEQ ID NO: 430081 - DNA, 15 bp, Homo sapiens
tcattcattaatcca

SEQ ID NO: 430082 - DNA, 15 bp, Homo sapiens
cattcattaatccaa

SEQ ID NO: 430083 - DNA, 15 bp, Homo sapiens
attcattaatccaaa

SEQ ID NO: 430084 - DNA, 15 bp, Homo sapiens
ttcattaatccaaaa

SEQ ID NO: 430085 - DNA, 15 bp, Homo sapiens
tcattaatccaaaag

SEQ ID NO: 430086 - DNA, 15 bp, Homo sapiens
cattaatccaaaaga

SEQ ID NO: 430087 - DNA, 15 bp, Homo sapiens
attaatccaaaagat

SEQ ID NO: 430088 - DNA, 15 bp, Homo sapiens
ttaatccaaaagata

SEQ ID NO: 430089 - DNA, 15 bp, Homo sapiens
taatccaaaagatat

SEQ ID NO: 430090 - DNA, 15 bp, Homo sapiens
aatccaaaagatata

SEQ ID NO: 430091 - DNA, 15 bp, Homo sapiens
atccaaaagatatac

SEQ ID NO: 430092 - DNA, 15 bp, Homo sapiens
tccaaaagatatact

SEQ ID NO: 430093 - DNA, 15 bp, Homo sapiens
ccaaaagatatactg

SEQ ID NO: 430094 - DNA, 15 bp, Homo sapiens
caaaagatatactga

SEQ ID NO: 430095 - DNA, 15 bp, Homo sapiens
aaaagatatactgag

SEQ ID NO: 430096 - DNA, 15 bp, Homo sapiens
aaagatatactgagt

SEQ ID NO: 430097 - DNA, 15 bp, Homo sapiens
aagatatactgagtg

SEQ ID NO: 430098 - DNA, 15 bp, Homo sapiens
agatatactgagtgc

SEQ ID NO: 430099 - DNA, 15 bp, Homo sapiens
gatatactgagtgct

SEQ ID NO: 430100 - DNA, 15 bp, Homo sapiens
atatactgagtgcta

SEQ ID NO: 430101 - DNA, 15 bp, Homo sapiens
tatactgagtgctag

SEQ ID NO: 430102 - DNA, 15 bp, Homo sapiens
atactgagtgctaga

SEQ ID NO: 430103 - DNA, 15 bp, Homo sapiens
tactgagtgctagaa

SEQ ID NO: 430104 - DNA, 15 bp, Homo sapiens
actgagtgctagaat

SEQ ID NO: 430105 - DNA, 15 bp, Homo sapiens
ctgagtgctagaatc

SEQ ID NO: 430106 - DNA, 15 bp, Homo sapiens
tgagtgctagaatct

SEQ ID NO: 430107 - DNA, 15 bp, Homo sapiens
gagtgctagaatcta

SEQ ID NO: 430108 - DNA, 15 bp, Homo sapiens
agtgctagaatctaa

SEQ ID NO: 430109 - DNA, 15 bp, Homo sapiens
gtgctagaatctaat

SEQ ID NO: 430110 - DNA, 15 bp, Homo sapiens
tgctagaatctaatg

SEQ ID NO: 430111 - DNA, 15 bp, Homo sapiens
gctagaatctaatga

SEQ ID NO: 430112 - DNA, 15 bp, Homo sapiens
ctagaatctaatgag

SEQ ID NO: 430113 - DNA, 15 bp, Homo sapiens
tagaatctaatgaga

SEQ ID NO: 430114 - DNA, 15 bp, Homo sapiens
agaatctaatgagaa

SEQ ID NO: 430115 - DNA, 15 bp, Homo sapiens
gaatctaatgagaaa

SEQ ID NO: 430116 - DNA, 15 bp, Homo sapiens
aatctaatgagaaag

SEQ ID NO: 430117 - DNA, 15 bp, Homo sapiens
atctaatgagaaaga

SEQ ID NO: 430118 - DNA, 15 bp, Homo sapiens
tctaatgagaaagag

SEQ ID NO: 430119 - DNA, 15 bp, Homo sapiens
ctaatgagaaagagc

SEQ ID NO: 430120 - DNA, 15 bp, Homo sapiens
taatgagaaagagca

SEQ ID NO: 430121 - DNA, 15 bp, Homo sapiens
aatgagaaagagcag

SEQ ID NO: 430122 - DNA, 15 bp, Homo sapiens
atgagaaagagcaga

SEQ ID NO: 430123 - DNA, 15 bp, Homo sapiens
tgagaaagagcagag

SEQ ID NO: 430124 - DNA, 15 bp, Homo sapiens
gagaaagagcagagc

SEQ ID NO: 430125 - DNA, 15 bp, Homo sapiens
agaaagagcagagct

SEQ ID NO: 430126 - DNA, 15 bp, Homo sapiens
gaaagagcagagcta

SEQ ID NO: 430127 - DNA, 15 bp, Homo sapiens
aaagagcagagctat

SEQ ID NO: 430128 - DNA, 15 bp, Homo sapiens
aagagcagagctatt

SEQ ID NO: 430129 - DNA, 15 bp, Homo sapiens
agagcagagctattg

SEQ ID NO: 430130 - DNA, 15 bp, Homo sapiens
gagcagagctattga

SEQ ID NO: 430131 - DNA, 15 bp, Homo sapiens
agcagagctattgaa

SEQ ID NO: 430132 - DNA, 15 bp, Homo sapiens
gcagagctattgaaa

SEQ ID NO: 430133 - DNA, 15 bp, Homo sapiens
cagagctattgaaaa

SEQ ID NO: 430134 - DNA, 15 bp, Homo sapiens
agagctattgaaaat

SEQ ID NO: 430135 - DNA, 15 bp, Homo sapiens
gagctattgaaaatt

SEQ ID NO: 430136 - DNA, 15 bp, Homo sapiens
agctattgaaaattt

SEQ ID NO: 430137 - DNA, 15 bp, Homo sapiens
gctattgaaaatttg

SEQ ID NO: 430138 - DNA, 15 bp, Homo sapiens
ctattgaaaatttga

SEQ ID NO: 430139 - DNA, 15 bp, Homo sapiens
tattgaaaatttgaa

SEQ ID NO: 430140 - DNA, 15 bp, Homo sapiens
attgaaaatttgaag

SEQ ID NO: 430141 - DNA, 15 bp, Homo sapiens
ttgaaaatttgaagc

SEQ ID NO: 430142 - DNA, 15 bp, Homo sapiens
tgaaaatttgaagca

SEQ ID NO: 430143 - DNA, 15 bp, Homo sapiens
gaaaatttgaagcaa

SEQ ID NO: 430144 - DNA, 15 bp, Homo sapiens
aaaatttgaagcaag

SEQ ID NO: 430145 - DNA, 15 bp, Homo sapiens
aaatttgaagcaagg

SEQ ID NO: 430146 - DNA, 15 bp, Homo sapiens
aatttgaagcaaggc

SEQ ID NO: 430147 - DNA, 15 bp, Homo sapiens
atttgaagcaaggcc

SEQ ID NO: 430148 - DNA, 15 bp, Homo sapiens
tttgaagcaaggcca

SEQ ID NO: 430149 - DNA, 15 bp, Homo sapiens
ttgaagcaaggccag

SEQ ID NO: 430150 - DNA, 15 bp, Homo sapiens
tgaagcaaggccagg

SEQ ID NO: 430151 - DNA, 15 bp, Homo sapiens
gaagcaaggccaggc

SEQ ID NO: 430152 - DNA, 15 bp, Homo sapiens
aagcaaggccaggct

SEQ ID NO: 430153 - DNA, 15 bp, Homo sapiens
agcaaggccaggctc

SEQ ID NO: 430154 - DNA, 15 bp, Homo sapiens
gcaaggccaggctca

SEQ ID NO: 430155 - DNA, 15 bp, Homo sapiens
caaggccaggctcag

SEQ ID NO: 430156 - DNA, 15 bp, Homo sapiens
aaggccaggctcagt

SEQ ID NO: 430157 - DNA, 15 bp, Homo sapiens
aggccaggctcagtg

SEQ ID NO: 430158 - DNA, 15 bp, Homo sapiens
ggccaggctcagtgg

SEQ ID NO: 430159 - DNA, 15 bp, Homo sapiens
gccaggctcagtggc

SEQ ID NO: 430160 - DNA, 15 bp, Homo sapiens
ccaggctcagtggct

SEQ ID NO: 430161 - DNA, 15 bp, Homo sapiens
caggctcagtggctc

SEQ ID NO: 430162 - DNA, 15 bp, Homo sapiens
aggctcagtggctca

SEQ ID NO: 430163 - DNA, 15 bp, Homo sapiens
ggctcagtggctcat

SEQ ID NO: 430164 - DNA, 15 bp, Homo sapiens
gctcagtggctcatg

SEQ ID NO: 430165 - DNA, 15 bp, Homo sapiens
ctcagtggctcatgc

SEQ ID NO: 430166 - DNA, 15 bp, Homo sapiens
tcagtggctcatgcc

SEQ ID NO: 430167 - DNA, 15 bp, Homo sapiens
tggctcatgcctgtg

SEQ ID NO: 430168 - DNA, 15 bp, Homo sapiens
ggctcatgcctgtga

SEQ ID NO: 430169 - DNA, 15 bp, Homo sapiens
gctcatgcctgtgat

SEQ ID NO: 430170 - DNA, 15 bp, Homo sapiens
ctcatgcctgtgatc

SEQ ID NO: 430171 - DNA, 15 bp, Homo sapiens
tcatgcctgtgatca

SEQ ID NO: 430172 - DNA, 15 bp, Homo sapiens
catgcctgtgatcat

SEQ ID NO: 430173 - DNA, 15 bp, Homo sapiens
atgcctgtgatcata

SEQ ID NO: 430174 - DNA, 15 bp, Homo sapiens
tgcctgtgatcatag

SEQ ID NO: 430175 - DNA, 15 bp, Homo sapiens
gcctgtgatcatagc

SEQ ID NO: 430176 - DNA, 15 bp, Homo sapiens
cctgtgatcatagca

SEQ ID NO: 430177 - DNA, 15 bp, Homo sapiens
ctgtgatcatagcac

SEQ ID NO: 430178 - DNA, 15 bp, Homo sapiens
tgtgatcatagcact

SEQ ID NO: 430179 - DNA, 15 bp, Homo sapiens
gtgatcatagcactt

SEQ ID NO: 430180 - DNA, 15 bp, Homo sapiens
tgatcatagcacttt

SEQ ID NO: 430181 - DNA, 15 bp, Homo sapiens
gatcatagcactttg

SEQ ID NO: 430182 - DNA, 15 bp, Homo sapiens
atcatagcactttgg

SEQ ID NO: 430183 - DNA, 15 bp, Homo sapiens
tcatagcactttggg

SEQ ID NO: 430184 - DNA, 15 bp, Homo sapiens
catagcactttggga

SEQ ID NO: 430185 - DNA, 15 bp, Homo sapiens
atagcactttgggag

SEQ ID NO: 430186 - DNA, 15 bp, Homo sapiens
ttgggaggccgagga

SEQ ID NO: 430187 - DNA, 15 bp, Homo sapiens
gaggccgaggaaggc

SEQ ID NO: 430188 - DNA, 15 bp, Homo sapiens
aggccgaggaaggcg

SEQ ID NO: 430189 - DNA, 15 bp, Homo sapiens
ggccgaggaaggcgg

SEQ ID NO: 430190 - DNA, 15 bp, Homo sapiens
gccgaggaaggcgga

SEQ ID NO: 430191 - DNA, 15 bp, Homo sapiens
ccgaggaaggcggat

SEQ ID NO: 430192 - DNA, 15 bp, Homo sapiens
cgaggaaggcggatc

SEQ ID NO: 430193 - DNA, 15 bp, Homo sapiens
gaggaaggcggatca

SEQ ID NO: 430194 - DNA, 15 bp, Homo sapiens
aggaaggcggatcac

SEQ ID NO: 430195 - DNA, 15 bp, Homo sapiens
ggaaggcggatcacc

SEQ ID NO: 430196 - DNA, 15 bp, Homo sapiens
gaaggcggatcacct

SEQ ID NO: 430197 - DNA, 15 bp, Homo sapiens
aaggcggatcacctg

SEQ ID NO: 430198 - DNA, 15 bp, Homo sapiens
gaggtcaggaattcg

SEQ ID NO: 430199 - DNA, 15 bp, Homo sapiens
aggtcaggaattcga

SEQ ID NO: 430200 - DNA, 15 bp, Homo sapiens
ggtcaggaattcgag

SEQ ID NO: 430201 - DNA, 15 bp, Homo sapiens
gtcaggaattcgaga

SEQ ID NO: 430202 - DNA, 15 bp, Homo sapiens
tcaggaattcgagac

SEQ ID NO: 430203 - DNA, 15 bp, Homo sapiens
caggaattcgagacc

SEQ ID NO: 430204 - DNA, 15 bp, Homo sapiens
aggaattcgagacca

SEQ ID NO: 430205 - DNA, 15 bp, Homo sapiens
ggaattcgagaccag

SEQ ID NO: 430206 - DNA, 15 bp, Homo sapiens
gaattcgagaccagc

SEQ ID NO: 430207 - DNA, 15 bp, Homo sapiens
aattcgagaccagcc

SEQ ID NO: 430208 - DNA, 15 bp, Homo sapiens
attcgagaccagcct

SEQ ID NO: 430209 - DNA, 15 bp, Homo sapiens
gaccagcctgaccat

SEQ ID NO: 430210 - DNA, 15 bp, Homo sapiens
accagcctgaccatg

SEQ ID NO: 430211 - DNA, 15 bp, Homo sapiens
ccagcctgaccatgg

SEQ ID NO: 430212 - DNA, 15 bp, Homo sapiens
cagcctgaccatgga

SEQ ID NO: 430213 - DNA, 15 bp, Homo sapiens
agcctgaccatggag

SEQ ID NO: 430214 - DNA, 15 bp, Homo sapiens
gcctgaccatggaga

SEQ ID NO: 430215 - DNA, 15 bp, Homo sapiens
cctgaccatggagaa

SEQ ID NO: 430216 - DNA, 15 bp, Homo sapiens
ctgaccatggagaaa

SEQ ID NO: 430217 - DNA, 15 bp, Homo sapiens
tgaccatggagaaac

SEQ ID NO: 430218 - DNA, 15 bp, Homo sapiens
gaccatggagaaacc

SEQ ID NO: 430219 - DNA, 15 bp, Homo sapiens
accatggagaaaccc

SEQ ID NO: 430220 - DNA, 15 bp, Homo sapiens
ccatggagaaacccc

SEQ ID NO: 430221 - DNA, 15 bp, Homo sapiens
catggagaaacccca

SEQ ID NO: 430222 - DNA, 15 bp, Homo sapiens
atggagaaaccccat

SEQ ID NO: 430223 - DNA, 15 bp, Homo sapiens
tggagaaaccccatc

SEQ ID NO: 430224 - DNA, 15 bp, Homo sapiens
ggagaaaccccatct

SEQ ID NO: 430225 - DNA, 15 bp, Homo sapiens
gagaaaccccatctc

SEQ ID NO: 430226 - DNA, 15 bp, Homo sapiens
agaaaccccatctct

SEQ ID NO: 430227 - DNA, 15 bp, Homo sapiens
aatataaaaaattat

SEQ ID NO: 430228 - DNA, 15 bp, Homo sapiens
atataaaaaattatc

SEQ ID NO: 430229 - DNA, 15 bp, Homo sapiens
tataaaaaattatct

SEQ ID NO: 430230 - DNA, 15 bp, Homo sapiens
ataaaaaattatctg

SEQ ID NO: 430231 - DNA, 15 bp, Homo sapiens
taaaaaattatctgg

SEQ ID NO: 430232 - DNA, 15 bp, Homo sapiens
aaaaaattatctggg

SEQ ID NO: 430233 - DNA, 15 bp, Homo sapiens
aaaaattatctgggc

SEQ ID NO: 430234 - DNA, 15 bp, Homo sapiens
aaaattatctgggcg

SEQ ID NO: 430235 - DNA, 15 bp, Homo sapiens
aaattatctgggcgt

SEQ ID NO: 430236 - DNA, 15 bp, Homo sapiens
aattatctgggcgtg

SEQ ID NO: 430237 - DNA, 15 bp, Homo sapiens
attatctgggcgtgg

SEQ ID NO: 430238 - DNA, 15 bp, Homo sapiens
ttatctgggcgtggt

SEQ ID NO: 430239 - DNA, 15 bp, Homo sapiens
tatctgggcgtggtg

SEQ ID NO: 430240 - DNA, 15 bp, Homo sapiens
atctgggcgtggtga

SEQ ID NO: 430241 - DNA, 15 bp, Homo sapiens
tctgggcgtggtgac

SEQ ID NO: 430242 - DNA, 15 bp, Homo sapiens
ctgggcgtggtgaca

SEQ ID NO: 430243 - DNA, 15 bp, Homo sapiens
tgggcgtggtgacac

SEQ ID NO: 430244 - DNA, 15 bp, Homo sapiens
gggcgtggtgacacc

SEQ ID NO: 430245 - DNA, 15 bp, Homo sapiens
ggcgtggtgacacct

SEQ ID NO: 430246 - DNA, 15 bp, Homo sapiens
gcgtggtgacacctg

SEQ ID NO: 430247 - DNA, 15 bp, Homo sapiens
cgtggtgacacctgc

SEQ ID NO: 430248 - DNA, 15 bp, Homo sapiens
gtggtgacacctgcc

SEQ ID NO: 430249 - DNA, 15 bp, Homo sapiens
tggtgacacctgcct

SEQ ID NO: 430250 - DNA, 15 bp, Homo sapiens
ggtgacacctgcctg

SEQ ID NO: 430251 - DNA, 15 bp, Homo sapiens
gtgacacctgcctgt

SEQ ID NO: 430252 - DNA, 15 bp, Homo sapiens
tgacacctgcctgta

SEQ ID NO: 430253 - DNA, 15 bp, Homo sapiens
gacacctgcctgtaa

SEQ ID NO: 430254 - DNA, 15 bp, Homo sapiens
acacctgcctgtaat

SEQ ID NO: 430255 - DNA, 15 bp, Homo sapiens
cacctgcctgtaatc

SEQ ID NO: 430256 - DNA, 15 bp, Homo sapiens
acctgcctgtaatcc

SEQ ID NO: 430257 - DNA, 15 bp, Homo sapiens
cctgcctgtaatccc

SEQ ID NO: 430258 - DNA, 15 bp, Homo sapiens
ctgcctgtaatccca

SEQ ID NO: 430259 - DNA, 15 bp, Homo sapiens
tattattgtcccttt

SEQ ID NO: 430260 - DNA, 15 bp, Homo sapiens
attattgtccctttc

SEQ ID NO: 430261 - DNA, 15 bp, Homo sapiens
ttattgtccctttcg

SEQ ID NO: 430262 - DNA, 15 bp, Homo sapiens
tattgtccctttcgt

SEQ ID NO: 430263 - DNA, 15 bp, Homo sapiens
attgtccctttcgtt

SEQ ID NO: 430264 - DNA, 15 bp, Homo sapiens
ttgtccctttcgttc

SEQ ID NO: 430265 - DNA, 15 bp, Homo sapiens
tgtccctttcgttcc

SEQ ID NO: 430266 - DNA, 15 bp, Homo sapiens
gtccctttcgttcca

SEQ ID NO: 430267 - DNA, 15 bp, Homo sapiens
tccctttcgttccac

SEQ ID NO: 430268 - DNA, 15 bp, Homo sapiens
ccctttcgttccact

SEQ ID NO: 430269 - DNA, 15 bp, Homo sapiens
cctttcgttccactc

SEQ ID NO: 430270 - DNA, 15 bp, Homo sapiens
ctttcgttccactcc

SEQ ID NO: 430271 - DNA, 15 bp, Homo sapiens
tttcgttccactccc

SEQ ID NO: 430272 - DNA, 15 bp, Homo sapiens
ttcgttccactccct

SEQ ID NO: 430273 - DNA, 15 bp, Homo sapiens
tcgttccactccctg

SEQ ID NO: 430274 - DNA, 15 bp, Homo sapiens
cgttccactccctgt

SEQ ID NO: 430275 - DNA, 15 bp, Homo sapiens
gttccactccctgta

SEQ ID NO: 430276 - DNA, 15 bp, Homo sapiens
ttccactccctgtag

SEQ ID NO: 430277 - DNA, 15 bp, Homo sapiens
tccactccctgtaga

SEQ ID NO: 430278 - DNA, 15 bp, Homo sapiens
ccactccctgtagat

SEQ ID NO: 430279 - DNA, 15 bp, Homo sapiens
cactccctgtagatg

SEQ ID NO: 430280 - DNA, 15 bp, Homo sapiens
actccctgtagatgt

SEQ ID NO: 430281 - DNA, 15 bp, Homo sapiens
ctccctgtagatgta

SEQ ID NO: 430282 - DNA, 15 bp, Homo sapiens
tccctgtagatgtaa

SEQ ID NO: 430283 - DNA, 15 bp, Homo sapiens
ccctgtagatgtaag

SEQ ID NO: 430284 - DNA, 15 bp, Homo sapiens
cctgtagatgtaagc

SEQ ID NO: 430285 - DNA, 15 bp, Homo sapiens
ctgtagatgtaagct

SEQ ID NO: 430286 - DNA, 15 bp, Homo sapiens
tgtagatgtaagctc

SEQ ID NO: 430287 - DNA, 15 bp, Homo sapiens
gtagatgtaagctcc

SEQ ID NO: 430288 - DNA, 15 bp, Homo sapiens
tagatgtaagctcct

SEQ ID NO: 430289 - DNA, 15 bp, Homo sapiens
agatgtaagctcctt

SEQ ID NO: 430290 - DNA, 15 bp, Homo sapiens
gatgtaagctccttg

SEQ ID NO: 430291 - DNA, 15 bp, Homo sapiens
atgtaagctccttga

SEQ ID NO: 430292 - DNA, 15 bp, Homo sapiens
tgtaagctccttgaa

SEQ ID NO: 430293 - DNA, 15 bp, Homo sapiens
gtaagctccttgaag

SEQ ID NO: 430294 - DNA, 15 bp, Homo sapiens
taagctccttgaaga

SEQ ID NO: 430295 - DNA, 15 bp, Homo sapiens
aagctccttgaagac

SEQ ID NO: 430296 - DNA, 15 bp, Homo sapiens
agctccttgaagaca

SEQ ID NO: 430297 - DNA, 15 bp, Homo sapiens
gctccttgaagacag

SEQ ID NO: 430298 - DNA, 15 bp, Homo sapiens
ctccttgaagacaga

SEQ ID NO: 430299 - DNA, 15 bp, Homo sapiens
tccttgaagacagag

SEQ ID NO: 430300 - DNA, 15 bp, Homo sapiens
ccttgaagacagagg

SEQ ID NO: 430301 - DNA, 15 bp, Homo sapiens
cttgaagacagaggg

SEQ ID NO: 430302 - DNA, 15 bp, Homo sapiens
ttgaagacagagggt

SEQ ID NO: 430303 - DNA, 15 bp, Homo sapiens
tgaagacagagggtt

SEQ ID NO: 430304 - DNA, 15 bp, Homo sapiens
gaagacagagggtta

SEQ ID NO: 430305 - DNA, 15 bp, Homo sapiens
aagacagagggttat

SEQ ID NO: 430306 - DNA, 15 bp, Homo sapiens
agacagagggttatt

SEQ ID NO: 430307 - DNA, 15 bp, Homo sapiens
gacagagggttattt

SEQ ID NO: 430308 - DNA, 15 bp, Homo sapiens
acagagggttatttt

SEQ ID NO: 430309 - DNA, 15 bp, Homo sapiens
cagagggttattttt

SEQ ID NO: 430310 - DNA, 15 bp, Homo sapiens
agagggttatttttt

SEQ ID NO: 430311 - DNA, 15 bp, Homo sapiens
gagggttattttttt

SEQ ID NO: 430312 - DNA, 15 bp, Homo sapiens
agggttatttttttt

SEQ ID NO: 430313 - DNA, 15 bp, Homo sapiens
gggttattttttttt

SEQ ID NO: 430314 - DNA, 15 bp, Homo sapiens
gttatttttttttca

SEQ ID NO: 430315 - DNA, 15 bp, Homo sapiens
ttatttttttttcac

SEQ ID NO: 430316 - DNA, 15 bp, Homo sapiens
tatttttttttcact

SEQ ID NO: 430317 - DNA, 15 bp, Homo sapiens
atttttttttcactg

SEQ ID NO: 430318 - DNA, 15 bp, Homo sapiens
tttttttttcactgc

SEQ ID NO: 430319 - DNA, 15 bp, Homo sapiens
ttttttttcactgct

SEQ ID NO: 430320 - DNA, 15 bp, Homo sapiens
tttttttcactgctg

SEQ ID NO: 430321 - DNA, 15 bp, Homo sapiens
ttttttcactgctgt

SEQ ID NO: 430322 - DNA, 15 bp, Homo sapiens
tttttcactgctgta

SEQ ID NO: 430323 - DNA, 15 bp, Homo sapiens
ttttcactgctgtat

SEQ ID NO: 430324 - DNA, 15 bp, Homo sapiens
tttcactgctgtatt

SEQ ID NO: 430325 - DNA, 15 bp, Homo sapiens
ttcactgctgtattt

SEQ ID NO: 430326 - DNA, 15 bp, Homo sapiens
tcactgctgtatttt

SEQ ID NO: 430327 - DNA, 15 bp, Homo sapiens
cactgctgtattttg

SEQ ID NO: 430328 - DNA, 15 bp, Homo sapiens
actgctgtattttgt

SEQ ID NO: 430329 - DNA, 15 bp, Homo sapiens
ctgctgtattttgta

SEQ ID NO: 430330 - DNA, 15 bp, Homo sapiens
tgctgtattttgtaa

SEQ ID NO: 430331 - DNA, 15 bp, Homo sapiens
gctgtattttgtaat

SEQ ID NO: 430332 - DNA, 15 bp, Homo sapiens
ctgtattttgtaata

SEQ ID NO: 430333 - DNA, 15 bp, Homo sapiens
tgtattttgtaatat

SEQ ID NO: 430334 - DNA, 15 bp, Homo sapiens
gtattttgtaatatt

SEQ ID NO: 430335 - DNA, 15 bp, Homo sapiens
tattttgtaatattt

SEQ ID NO: 430336 - DNA, 15 bp, Homo sapiens
attttgtaatattta

SEQ ID NO: 430337 - DNA, 15 bp, Homo sapiens
ttttgtaatatttag

SEQ ID NO: 430338 - DNA, 15 bp, Homo sapiens
tttgtaatatttaga

SEQ ID NO: 430339 - DNA, 15 bp, Homo sapiens
ttgtaatatttagaa

SEQ ID NO: 430340 - DNA, 15 bp, Homo sapiens
tgtaatatttagaat

SEQ ID NO: 430341 - DNA, 15 bp, Homo sapiens
gtaatatttagaata

SEQ ID NO: 430342 - DNA, 15 bp, Homo sapiens
taatatttagaatac

SEQ ID NO: 430343 - DNA, 15 bp, Homo sapiens
aatatttagaatact

SEQ ID NO: 430344 - DNA, 15 bp, Homo sapiens
atatttagaatacta

SEQ ID NO: 430345 - DNA, 15 bp, Homo sapiens
tatttagaatactat

SEQ ID NO: 430346 - DNA, 15 bp, Homo sapiens
atttagaatactatc

SEQ ID NO: 430347 - DNA, 15 bp, Homo sapiens
tttagaatactatct

SEQ ID NO: 430348 - DNA, 15 bp, Homo sapiens
ttagaatactatctg

SEQ ID NO: 430349 - DNA, 15 bp, Homo sapiens
tagaatactatctgg

SEQ ID NO: 430350 - DNA, 15 bp, Homo sapiens
agaatactatctggc

SEQ ID NO: 430351 - DNA, 15 bp, Homo sapiens
gaatactatctggca

SEQ ID NO: 430352 - DNA, 15 bp, Homo sapiens
aatactatctggcac

SEQ ID NO: 430353 - DNA, 15 bp, Homo sapiens
atactatctggcaca

SEQ ID NO: 430354 - DNA, 15 bp, Homo sapiens
tactatctggcacat

SEQ ID NO: 430355 - DNA, 15 bp, Homo sapiens
actatctggcacata

SEQ ID NO: 430356 - DNA, 15 bp, Homo sapiens
ctatctggcacatag

SEQ ID NO: 430357 - DNA, 15 bp, Homo sapiens
tatctggcacatagt

SEQ ID NO: 430358 - DNA, 15 bp, Homo sapiens
atctggcacatagta

SEQ ID NO: 430359 - DNA, 15 bp, Homo sapiens
tctggcacatagtaa

SEQ ID NO: 430360 - DNA, 15 bp, Homo sapiens
ctggcacatagtaag

SEQ ID NO: 430361 - DNA, 15 bp, Homo sapiens
tggcacatagtaagt

SEQ ID NO: 430362 - DNA, 15 bp, Homo sapiens
ggcacatagtaagtg

SEQ ID NO: 430363 - DNA, 15 bp, Homo sapiens
gcacatagtaagtgc

SEQ ID NO: 430364 - DNA, 15 bp, Homo sapiens
cacatagtaagtgct

SEQ ID NO: 430365 - DNA, 15 bp, Homo sapiens
acatagtaagtgctt

SEQ ID NO: 430366 - DNA, 15 bp, Homo sapiens
catagtaagtgctta

SEQ ID NO: 430367 - DNA, 15 bp, Homo sapiens
atagtaagtgcttat

SEQ ID NO: 430368 - DNA, 15 bp, Homo sapiens
tagtaagtgcttatt

SEQ ID NO: 430369 - DNA, 15 bp, Homo sapiens
gtaagtgcttattac

SEQ ID NO: 430370 - DNA, 15 bp, Homo sapiens
taagtgcttattaca

SEQ ID NO: 430371 - DNA, 15 bp, Homo sapiens
aagtgcttattacat

SEQ ID NO: 430372 - DNA, 15 bp, Homo sapiens
agtgcttattacata

SEQ ID NO: 430373 - DNA, 15 bp, Homo sapiens
gtgcttattacatag

SEQ ID NO: 430374 - DNA, 15 bp, Homo sapiens
tgcttattacatagt

SEQ ID NO: 430375 - DNA, 15 bp, Homo sapiens
gcttattacatagtg

SEQ ID NO: 430376 - DNA, 15 bp, Homo sapiens
cttattacatagtgt

SEQ ID NO: 430377 - DNA, 15 bp, Homo sapiens
ttattacatagtgtt

SEQ ID NO: 430378 - DNA, 15 bp, Homo sapiens
tattacatagtgttt

SEQ ID NO: 430379 - DNA, 15 bp, Homo sapiens
attacatagtgtttg

SEQ ID NO: 430380 - DNA, 15 bp, Homo sapiens
ttacatagtgtttga

SEQ ID NO: 430381 - DNA, 15 bp, Homo sapiens
tacatagtgtttgaa

SEQ ID NO: 430382 - DNA, 15 bp, Homo sapiens
acatagtgtttgaaa

SEQ ID NO: 430383 - DNA, 15 bp, Homo sapiens
catagtgtttgaaag

SEQ ID NO: 430384 - DNA, 15 bp, Homo sapiens
atagtgtttgaaaga

SEQ ID NO: 430385 - DNA, 15 bp, Homo sapiens
tagtgtttgaaagaa

SEQ ID NO: 430386 - DNA, 15 bp, Homo sapiens
agtgtttgaaagaat

SEQ ID NO: 430387 - DNA, 15 bp, Homo sapiens
gtgtttgaaagaata

SEQ ID NO: 430388 - DNA, 15 bp, Homo sapiens
tgtttgaaagaatac

SEQ ID NO: 430389 - DNA, 15 bp, Homo sapiens
gtttgaaagaatacg

SEQ ID NO: 430390 - DNA, 15 bp, Homo sapiens
tttgaaagaatacgc

SEQ ID NO: 430391 - DNA, 15 bp, Homo sapiens
ttgaaagaatacgca

SEQ ID NO: 430392 - DNA, 15 bp, Homo sapiens
tgaaagaatacgcat

SEQ ID NO: 430393 - DNA, 15 bp, Homo sapiens
gaaagaatacgcatg

SEQ ID NO: 430394 - DNA, 15 bp, Homo sapiens
aaagaatacgcatga

SEQ ID NO: 430395 - DNA, 15 bp, Homo sapiens
aagaatacgcatgag

SEQ ID NO: 430396 - DNA, 15 bp, Homo sapiens
agaatacgcatgagc

SEQ ID NO: 430397 - DNA, 15 bp, Homo sapiens
gaatacgcatgagct

SEQ ID NO: 430398 - DNA, 15 bp, Homo sapiens
aatacgcatgagctg

SEQ ID NO: 430399 - DNA, 15 bp, Homo sapiens
atacgcatgagctga

SEQ ID NO: 430400 - DNA, 15 bp, Homo sapiens
tacgcatgagctgag

SEQ ID NO: 430401 - DNA, 15 bp, Homo sapiens
acgcatgagctgagc

SEQ ID NO: 430402 - DNA, 15 bp, Homo sapiens
cgcatgagctgagca

SEQ ID NO: 430403 - DNA, 15 bp, Homo sapiens
gcatgagctgagcac

SEQ ID NO: 430404 - DNA, 15 bp, Homo sapiens
catgagctgagcact

SEQ ID NO: 430405 - DNA, 15 bp, Homo sapiens
atgagctgagcactg

SEQ ID NO: 430406 - DNA, 15 bp, Homo sapiens
tgagctgagcactgt

SEQ ID NO: 430407 - DNA, 15 bp, Homo sapiens
gagctgagcactgtc

SEQ ID NO: 430408 - DNA, 15 bp, Homo sapiens
agctgagcactgtcc

SEQ ID NO: 430409 - DNA, 15 bp, Homo sapiens
gctgagcactgtcca

SEQ ID NO: 430410 - DNA, 15 bp, Homo sapiens
ctgagcactgtccaa

SEQ ID NO: 430411 - DNA, 15 bp, Homo sapiens
tgagcactgtccaag

SEQ ID NO: 430412 - DNA, 15 bp, Homo sapiens
gagcactgtccaaga

SEQ ID NO: 430413 - DNA, 15 bp, Homo sapiens
agcactgtccaagat

SEQ ID NO: 430414 - DNA, 15 bp, Homo sapiens
gcactgtccaagatg

SEQ ID NO: 430415 - DNA, 15 bp, Homo sapiens
cactgtccaagatgg

SEQ ID NO: 430416 - DNA, 15 bp, Homo sapiens
actgtccaagatgga

SEQ ID NO: 430417 - DNA, 15 bp, Homo sapiens
ctgtccaagatggat

SEQ ID NO: 430418 - DNA, 15 bp, Homo sapiens
tgtccaagatggata

SEQ ID NO: 430419 - DNA, 15 bp, Homo sapiens
gtccaagatggataa

SEQ ID NO: 430420 - DNA, 15 bp, Homo sapiens
tccaagatggataaa

SEQ ID NO: 430421 - DNA, 15 bp, Homo sapiens
ccaagatggataaag

SEQ ID NO: 430422 - DNA, 15 bp, Homo sapiens
caagatggataaaga

SEQ ID NO: 430423 - DNA, 15 bp, Homo sapiens
aagatggataaagaa

SEQ ID NO: 430424 - DNA, 15 bp, Homo sapiens
agatggataaagaag

SEQ ID NO: 430425 - DNA, 15 bp, Homo sapiens
gatggataaagaagt

SEQ ID NO: 430426 - DNA, 15 bp, Homo sapiens
atggataaagaagta

SEQ ID NO: 430427 - DNA, 15 bp, Homo sapiens
tggataaagaagtat

SEQ ID NO: 430428 - DNA, 15 bp, Homo sapiens
ggataaagaagtata

SEQ ID NO: 430429 - DNA, 15 bp, Homo sapiens
gataaagaagtataa

SEQ ID NO: 430430 - DNA, 15 bp, Homo sapiens
ataaagaagtataac

SEQ ID NO: 430431 - DNA, 15 bp, Homo sapiens
taaagaagtataacg

SEQ ID NO: 430432 - DNA, 15 bp, Homo sapiens
aaagaagtataacgc

SEQ ID NO: 430433 - DNA, 15 bp, Homo sapiens
aagaagtataacgca

SEQ ID NO: 430434 - DNA, 15 bp, Homo sapiens
agaagtataacgcat

SEQ ID NO: 430435 - DNA, 15 bp, Homo sapiens
gaagtataacgcatg

SEQ ID NO: 430436 - DNA, 15 bp, Homo sapiens
aagtataacgcatgt

SEQ ID NO: 430437 - DNA, 15 bp, Homo sapiens
agtataacgcatgtt

SEQ ID NO: 430438 - DNA, 15 bp, Homo sapiens
gtataacgcatgttc

SEQ ID NO: 430439 - DNA, 15 bp, Homo sapiens
tataacgcatgttcc

SEQ ID NO: 430440 - DNA, 15 bp, Homo sapiens
ataacgcatgttcct

SEQ ID NO: 430441 - DNA, 15 bp, Homo sapiens
taacgcatgttcctg

SEQ ID NO: 430442 - DNA, 15 bp, Homo sapiens
aacgcatgttcctga

SEQ ID NO: 430443 - DNA, 15 bp, Homo sapiens
acgcatgttcctgag

SEQ ID NO: 430444 - DNA, 15 bp, Homo sapiens
cgcatgttcctgagg

SEQ ID NO: 430445 - DNA, 15 bp, Homo sapiens
gcatgttcctgaggt

SEQ ID NO: 430446 - DNA, 15 bp, Homo sapiens
catgttcctgaggtt

SEQ ID NO: 430447 - DNA, 15 bp, Homo sapiens
atgttcctgaggttt

SEQ ID NO: 430448 - DNA, 15 bp, Homo sapiens
tgttcctgaggtttc

SEQ ID NO: 430449 - DNA, 15 bp, Homo sapiens
gttcctgaggtttca

SEQ ID NO: 430450 - DNA, 15 bp, Homo sapiens
ttcctgaggtttcaa

SEQ ID NO: 430451 - DNA, 15 bp, Homo sapiens
tcctgaggtttcaat

SEQ ID NO: 430452 - DNA, 15 bp, Homo sapiens
cctgaggtttcaatt

SEQ ID NO: 430453 - DNA, 15 bp, Homo sapiens
ctgaggtttcaattt

SEQ ID NO: 430454 - DNA, 15 bp, Homo sapiens
tgaggtttcaattta

SEQ ID NO: 430455 - DNA, 15 bp, Homo sapiens
gaggtttcaatttag

SEQ ID NO: 430456 - DNA, 15 bp, Homo sapiens
aggtttcaatttagt

SEQ ID NO: 430457 - DNA, 15 bp, Homo sapiens
ggtttcaatttagtg

SEQ ID NO: 430458 - DNA, 15 bp, Homo sapiens
gtttcaatttagtgg

SEQ ID NO: 430459 - DNA, 15 bp, Homo sapiens
tttcaatttagtggg

SEQ ID NO: 430460 - DNA, 15 bp, Homo sapiens
ttcaatttagtggga

SEQ ID NO: 430461 - DNA, 15 bp, Homo sapiens
tcaatttagtgggag

SEQ ID NO: 430462 - DNA, 15 bp, Homo sapiens
caatttagtgggaga

SEQ ID NO: 430463 - DNA, 15 bp, Homo sapiens
aatttagtgggagat

SEQ ID NO: 430464 - DNA, 15 bp, Homo sapiens
atttagtgggagatc

SEQ ID NO: 430465 - DNA, 15 bp, Homo sapiens
tttagtgggagatca

SEQ ID NO: 430466 - DNA, 15 bp, Homo sapiens
ttagtgggagatcaa

SEQ ID NO: 430467 - DNA, 15 bp, Homo sapiens
tagtgggagatcaaa

SEQ ID NO: 430468 - DNA, 15 bp, Homo sapiens
agtgggagatcaaaa

SEQ ID NO: 430469 - DNA, 15 bp, Homo sapiens
gtgggagatcaaaac

SEQ ID NO: 430470 - DNA, 15 bp, Homo sapiens
tgggagatcaaaact

SEQ ID NO: 430471 - DNA, 15 bp, Homo sapiens
gggagatcaaaacta

SEQ ID NO: 430472 - DNA, 15 bp, Homo sapiens
ggagatcaaaactag

SEQ ID NO: 430473 - DNA, 15 bp, Homo sapiens
gagatcaaaactagc

SEQ ID NO: 430474 - DNA, 15 bp, Homo sapiens
agatcaaaactagca

SEQ ID NO: 430475 - DNA, 15 bp, Homo sapiens
gatcaaaactagcac

SEQ ID NO: 430476 - DNA, 15 bp, Homo sapiens
atcaaaactagcaca

SEQ ID NO: 430477 - DNA, 15 bp, Homo sapiens
tcaaaactagcacag

SEQ ID NO: 430478 - DNA, 15 bp, Homo sapiens
caaaactagcacaga

SEQ ID NO: 430479 - DNA, 15 bp, Homo sapiens
aaaactagcacagag

SEQ ID NO: 430480 - DNA, 15 bp, Homo sapiens
aaactagcacagagc

SEQ ID NO: 430481 - DNA, 15 bp, Homo sapiens
aactagcacagagcg

SEQ ID NO: 430482 - DNA, 15 bp, Homo sapiens
actagcacagagcgt

SEQ ID NO: 430483 - DNA, 15 bp, Homo sapiens
ctagcacagagcgtg

SEQ ID NO: 430484 - DNA, 15 bp, Homo sapiens
tagcacagagcgtga

SEQ ID NO: 430485 - DNA, 15 bp, Homo sapiens
agcacagagcgtgag

SEQ ID NO: 430486 - DNA, 15 bp, Homo sapiens
gcacagagcgtgaga

SEQ ID NO: 430487 - DNA, 15 bp, Homo sapiens
cacagagcgtgagaa

SEQ ID NO: 430488 - DNA, 15 bp, Homo sapiens
acagagcgtgagaaa

SEQ ID NO: 430489 - DNA, 15 bp, Homo sapiens
cagagcgtgagaaag

SEQ ID NO: 430490 - DNA, 15 bp, Homo sapiens
agagcgtgagaaagc

SEQ ID NO: 430491 - DNA, 15 bp, Homo sapiens
gagcgtgagaaagca

SEQ ID NO: 430492 - DNA, 15 bp, Homo sapiens
agcgtgagaaagcaa

SEQ ID NO: 430493 - DNA, 15 bp, Homo sapiens
gcgtgagaaagcaag

SEQ ID NO: 430494 - DNA, 15 bp, Homo sapiens
cgtgagaaagcaagc

SEQ ID NO: 430495 - DNA, 15 bp, Homo sapiens
gtgagaaagcaagca

SEQ ID NO: 430496 - DNA, 15 bp, Homo sapiens
tgagaaagcaagcaa

SEQ ID NO: 430497 - DNA, 15 bp, Homo sapiens
gagaaagcaagcaat

SEQ ID NO: 430498 - DNA, 15 bp, Homo sapiens
agaaagcaagcaatg

SEQ ID NO: 430499 - DNA, 15 bp, Homo sapiens
gaaagcaagcaatgt

SEQ ID NO: 430500 - DNA, 15 bp, Homo sapiens
aaagcaagcaatgta

SEQ ID NO: 430501 - DNA, 15 bp, Homo sapiens
aagcaagcaatgtaa

SEQ ID NO: 430502 - DNA, 15 bp, Homo sapiens
agcaagcaatgtaaa

SEQ ID NO: 430503 - DNA, 15 bp, Homo sapiens
gcaagcaatgtaaaa

SEQ ID NO: 430504 - DNA, 15 bp, Homo sapiens
caagcaatgtaaaag

SEQ ID NO: 430505 - DNA, 15 bp, Homo sapiens
aagcaatgtaaaagt

SEQ ID NO: 430506 - DNA, 15 bp, Homo sapiens
agcaatgtaaaagtg

SEQ ID NO: 430507 - DNA, 15 bp, Homo sapiens
gcaatgtaaaagtgt

SEQ ID NO: 430508 - DNA, 15 bp, Homo sapiens
caatgtaaaagtgtc

SEQ ID NO: 430509 - DNA, 15 bp, Homo sapiens
aatgtaaaagtgtcc

SEQ ID NO: 430510 - DNA, 15 bp, Homo sapiens
atgtaaaagtgtccg

SEQ ID NO: 430511 - DNA, 15 bp, Homo sapiens
tgtaaaagtgtccgt

SEQ ID NO: 430512 - DNA, 15 bp, Homo sapiens
gtaaaagtgtccgta

SEQ ID NO: 430513 - DNA, 15 bp, Homo sapiens
taaaagtgtccgtag

SEQ ID NO: 430514 - DNA, 15 bp, Homo sapiens
aaaagtgtccgtagt

SEQ ID NO: 430515 - DNA, 15 bp, Homo sapiens
aaagtgtccgtagtc

SEQ ID NO: 430516 - DNA, 15 bp, Homo sapiens
aagtgtccgtagtca

SEQ ID NO: 430517 - DNA, 15 bp, Homo sapiens
agtgtccgtagtcat

SEQ ID NO: 430518 - DNA, 15 bp, Homo sapiens
gtgtccgtagtcatg

SEQ ID NO: 430519 - DNA, 15 bp, Homo sapiens
tgtccgtagtcatgc

SEQ ID NO: 430520 - DNA, 15 bp, Homo sapiens
gtccgtagtcatgca

SEQ ID NO: 430521 - DNA, 15 bp, Homo sapiens
tccgtagtcatgcac

SEQ ID NO: 430522 - DNA, 15 bp, Homo sapiens
ccgtagtcatgcact

SEQ ID NO: 430523 - DNA, 15 bp, Homo sapiens
cgtagtcatgcactc

SEQ ID NO: 430524 - DNA, 15 bp, Homo sapiens
gtagtcatgcactca

SEQ ID NO: 430525 - DNA, 15 bp, Homo sapiens
tagtcatgcactcag

SEQ ID NO: 430526 - DNA, 15 bp, Homo sapiens
agtcatgcactcagt

SEQ ID NO: 430527 - DNA, 15 bp, Homo sapiens
gtcatgcactcagtt

SEQ ID NO: 430528 - DNA, 15 bp, Homo sapiens
tcatgcactcagttg

SEQ ID NO: 430529 - DNA, 15 bp, Homo sapiens
catgcactcagttgt

SEQ ID NO: 430530 - DNA, 15 bp, Homo sapiens
atgcactcagttgtg

SEQ ID NO: 430531 - DNA, 15 bp, Homo sapiens
tgcactcagttgtgt

SEQ ID NO: 430532 - DNA, 15 bp, Homo sapiens
gcactcagttgtgtc

SEQ ID NO: 430533 - DNA, 15 bp, Homo sapiens
cactcagttgtgtcc

SEQ ID NO: 430534 - DNA, 15 bp, Homo sapiens
actcagttgtgtcct

SEQ ID NO: 430535 - DNA, 15 bp, Homo sapiens
ctcagttgtgtcctg

SEQ ID NO: 430536 - DNA, 15 bp, Homo sapiens
tcagttgtgtcctga

SEQ ID NO: 430537 - DNA, 15 bp, Homo sapiens
cagttgtgtcctgag

SEQ ID NO: 430538 - DNA, 15 bp, Homo sapiens
agttgtgtcctgagg

SEQ ID NO: 430539 - DNA, 15 bp, Homo sapiens
gttgtgtcctgagga

SEQ ID NO: 430540 - DNA, 15 bp, Homo sapiens
ttgtgtcctgaggat

SEQ ID NO: 430541 - DNA, 15 bp, Homo sapiens
tgtgtcctgaggatt

SEQ ID NO: 430542 - DNA, 15 bp, Homo sapiens
gtgtcctgaggattc

SEQ ID NO: 430543 - DNA, 15 bp, Homo sapiens
tgtcctgaggattct

SEQ ID NO: 430544 - DNA, 15 bp, Homo sapiens
gtcctgaggattcta

SEQ ID NO: 430545 - DNA, 15 bp, Homo sapiens
tcctgaggattctaa

SEQ ID NO: 430546 - DNA, 15 bp, Homo sapiens
cctgaggattctaag

SEQ ID NO: 430547 - DNA, 15 bp, Homo sapiens
ctgaggattctaagt

SEQ ID NO: 430548 - DNA, 15 bp, Homo sapiens
tgaggattctaagtg

SEQ ID NO: 430549 - DNA, 15 bp, Homo sapiens
gaggattctaagtga

SEQ ID NO: 430550 - DNA, 15 bp, Homo sapiens
aggattctaagtgat

SEQ ID NO: 430551 - DNA, 15 bp, Homo sapiens
ggattctaagtgatg

SEQ ID NO: 430552 - DNA, 15 bp, Homo sapiens
gattctaagtgatgc

SEQ ID NO: 430553 - DNA, 15 bp, Homo sapiens
attctaagtgatgcg

SEQ ID NO: 430554 - DNA, 15 bp, Homo sapiens
ttctaagtgatgcgg

SEQ ID NO: 430555 - DNA, 15 bp, Homo sapiens
tctaagtgatgcggg

SEQ ID NO: 430556 - DNA, 15 bp, Homo sapiens
ctaagtgatgcgggc

SEQ ID NO: 430557 - DNA, 15 bp, Homo sapiens
taagtgatgcgggca

SEQ ID NO: 430558 - DNA, 15 bp, Homo sapiens
aagtgatgcgggcat

SEQ ID NO: 430559 - DNA, 15 bp, Homo sapiens
agtgatgcgggcatt

SEQ ID NO: 430560 - DNA, 15 bp, Homo sapiens
gtgatgcgggcattc

SEQ ID NO: 430561 - DNA, 15 bp, Homo sapiens
tgatgcgggcattcc

SEQ ID NO: 430562 - DNA, 15 bp, Homo sapiens
gatgcgggcattcca

SEQ ID NO: 430563 - DNA, 15 bp, Homo sapiens
atgcgggcattccag

SEQ ID NO: 430564 - DNA, 15 bp, Homo sapiens
tgcgggcattccagg

SEQ ID NO: 430565 - DNA, 15 bp, Homo sapiens
gcgggcattccagga

SEQ ID NO: 430566 - DNA, 15 bp, Homo sapiens
cgggcattccaggag

SEQ ID NO: 430567 - DNA, 15 bp, Homo sapiens
gggcattccaggaga

SEQ ID NO: 430568 - DNA, 15 bp, Homo sapiens
ggcattccaggagag

SEQ ID NO: 430569 - DNA, 15 bp, Homo sapiens
gcattccaggagaga

SEQ ID NO: 430570 - DNA, 15 bp, Homo sapiens
cattccaggagagaa

SEQ ID NO: 430571 - DNA, 15 bp, Homo sapiens
attccaggagagaag

SEQ ID NO: 430572 - DNA, 15 bp, Homo sapiens
ttccaggagagaagg

SEQ ID NO: 430573 - DNA, 15 bp, Homo sapiens
tccaggagagaagga

SEQ ID NO: 430574 - DNA, 15 bp, Homo sapiens
ccaggagagaaggac

SEQ ID NO: 430575 - DNA, 15 bp, Homo sapiens
caggagagaaggact

SEQ ID NO: 430576 - DNA, 15 bp, Homo sapiens
aggagagaaggactc

SEQ ID NO: 430577 - DNA, 15 bp, Homo sapiens
ggagagaaggactct

SEQ ID NO: 430578 - DNA, 15 bp, Homo sapiens
gagagaaggactctg

SEQ ID NO: 430579 - DNA, 15 bp, Homo sapiens
agagaaggactctga

SEQ ID NO: 430580 - DNA, 15 bp, Homo sapiens
gagaaggactctgag

SEQ ID NO: 430581 - DNA, 15 bp, Homo sapiens
agaaggactctgagg

SEQ ID NO: 430582 - DNA, 15 bp, Homo sapiens
gaaggactctgaggg

SEQ ID NO: 430583 - DNA, 15 bp, Homo sapiens
aaggactctgagggt

SEQ ID NO: 430584 - DNA, 15 bp, Homo sapiens
aggactctgagggtc

SEQ ID NO: 430585 - DNA, 15 bp, Homo sapiens
ggactctgagggtca

SEQ ID NO: 430586 - DNA, 15 bp, Homo sapiens
gactctgagggtcag

SEQ ID NO: 430587 - DNA, 15 bp, Homo sapiens
actctgagggtcaga

SEQ ID NO: 430588 - DNA, 15 bp, Homo sapiens
ctctgagggtcagag

SEQ ID NO: 430589 - DNA, 15 bp, Homo sapiens
tctgagggtcagagt

SEQ ID NO: 430590 - DNA, 15 bp, Homo sapiens
ctgagggtcagagtg

SEQ ID NO: 430591 - DNA, 15 bp, Homo sapiens
tgagggtcagagtgg

SEQ ID NO: 430592 - DNA, 15 bp, Homo sapiens
gagggtcagagtgga

SEQ ID NO: 430593 - DNA, 15 bp, Homo sapiens
agggtcagagtggag

SEQ ID NO: 430594 - DNA, 15 bp, Homo sapiens
gggtcagagtggaga

SEQ ID NO: 430595 - DNA, 15 bp, Homo sapiens
ggtcagagtggagag

SEQ ID NO: 430596 - DNA, 15 bp, Homo sapiens
gtcagagtggagaga

SEQ ID NO: 430597 - DNA, 15 bp, Homo sapiens
tcagagtggagagag

SEQ ID NO: 430598 - DNA, 15 bp, Homo sapiens
cagagtggagagagg

SEQ ID NO: 430599 - DNA, 15 bp, Homo sapiens
agagtggagagaggt

SEQ ID NO: 430600 - DNA, 15 bp, Homo sapiens
gagtggagagaggtt

SEQ ID NO: 430601 - DNA, 15 bp, Homo sapiens
agtggagagaggttg

SEQ ID NO: 430602 - DNA, 15 bp, Homo sapiens
gtggagagaggttga

SEQ ID NO: 430603 - DNA, 15 bp, Homo sapiens
tggagagaggttgat

SEQ ID NO: 430604 - DNA, 15 bp, Homo sapiens
ggagagaggttgatt

SEQ ID NO: 430605 - DNA, 15 bp, Homo sapiens
gagagaggttgattc

SEQ ID NO: 430606 - DNA, 15 bp, Homo sapiens
agagaggttgattcc

SEQ ID NO: 430607 - DNA, 15 bp, Homo sapiens
gagaggttgattcct

SEQ ID NO: 430608 - DNA, 15 bp, Homo sapiens
agaggttgattcctg

SEQ ID NO: 430609 - DNA, 15 bp, Homo sapiens
gaggttgattcctga

SEQ ID NO: 430610 - DNA, 15 bp, Homo sapiens
aggttgattcctgag

SEQ ID NO: 430611 - DNA, 15 bp, Homo sapiens
ggttgattcctgagc

SEQ ID NO: 430612 - DNA, 15 bp, Homo sapiens
gttgattcctgagct

SEQ ID NO: 430613 - DNA, 15 bp, Homo sapiens
ttgattcctgagcta

SEQ ID NO: 430614 - DNA, 15 bp, Homo sapiens
tgattcctgagctag

SEQ ID NO: 430615 - DNA, 15 bp, Homo sapiens
gattcctgagctagt

SEQ ID NO: 430616 - DNA, 15 bp, Homo sapiens
attcctgagctagtc

SEQ ID NO: 430617 - DNA, 15 bp, Homo sapiens
ttcctgagctagtct

SEQ ID NO: 430618 - DNA, 15 bp, Homo sapiens
tcctgagctagtctt

SEQ ID NO: 430619 - DNA, 15 bp, Homo sapiens
cctgagctagtctta

SEQ ID NO: 430620 - DNA, 15 bp, Homo sapiens
ctgagctagtcttag

SEQ ID NO: 430621 - DNA, 15 bp, Homo sapiens
tgagctagtcttagg

SEQ ID NO: 430622 - DNA, 15 bp, Homo sapiens
gagctagtcttaggg

SEQ ID NO: 430623 - DNA, 15 bp, Homo sapiens
agctagtcttagggg

SEQ ID NO: 430624 - DNA, 15 bp, Homo sapiens
gctagtcttaggggt

SEQ ID NO: 430625 - DNA, 15 bp, Homo sapiens
ctagtcttaggggta

SEQ ID NO: 430626 - DNA, 15 bp, Homo sapiens
tagtcttaggggtat

SEQ ID NO: 430627 - DNA, 15 bp, Homo sapiens
agtcttaggggtatg

SEQ ID NO: 430628 - DNA, 15 bp, Homo sapiens
gtcttaggggtatgg

SEQ ID NO: 430629 - DNA, 15 bp, Homo sapiens
tcttaggggtatgga

SEQ ID NO: 430630 - DNA, 15 bp, Homo sapiens
cttaggggtatggac

SEQ ID NO: 430631 - DNA, 15 bp, Homo sapiens
ttaggggtatggaca

SEQ ID NO: 430632 - DNA, 15 bp, Homo sapiens
taggggtatggacag

SEQ ID NO: 430633 - DNA, 15 bp, Homo sapiens
aggggtatggacagg

SEQ ID NO: 430634 - DNA, 15 bp, Homo sapiens
ggggtatggacaggt

SEQ ID NO: 430635 - DNA, 15 bp, Homo sapiens
gggtatggacaggta

SEQ ID NO: 430636 - DNA, 15 bp, Homo sapiens
ggtatggacaggtag

SEQ ID NO: 430637 - DNA, 15 bp, Homo sapiens
gtatggacaggtagg

SEQ ID NO: 430638 - DNA, 15 bp, Homo sapiens
tatggacaggtagga

SEQ ID NO: 430639 - DNA, 15 bp, Homo sapiens
atggacaggtaggaa

SEQ ID NO: 430640 - DNA, 15 bp, Homo sapiens
tggacaggtaggaag

SEQ ID NO: 430641 - DNA, 15 bp, Homo sapiens
ggacaggtaggaagt

SEQ ID NO: 430642 - DNA, 15 bp, Homo sapiens
gacaggtaggaagtg

SEQ ID NO: 430643 - DNA, 15 bp, Homo sapiens
acaggtaggaagtga

SEQ ID NO: 430644 - DNA, 15 bp, Homo sapiens
caggtaggaagtgat

SEQ ID NO: 430645 - DNA, 15 bp, Homo sapiens
aggtaggaagtgatt

SEQ ID NO: 430646 - DNA, 15 bp, Homo sapiens
ggtaggaagtgatta

SEQ ID NO: 430647 - DNA, 15 bp, Homo sapiens
gtaggaagtgattaa

SEQ ID NO: 430648 - DNA, 15 bp, Homo sapiens
taggaagtgattaag

SEQ ID NO: 430649 - DNA, 15 bp, Homo sapiens
aggaagtgattaagt

SEQ ID NO: 430650 - DNA, 15 bp, Homo sapiens
ggaagtgattaagtt

SEQ ID NO: 430651 - DNA, 15 bp, Homo sapiens
gaagtgattaagttc

SEQ ID NO: 430652 - DNA, 15 bp, Homo sapiens
aagtgattaagttcg

SEQ ID NO: 430653 - DNA, 15 bp, Homo sapiens
agtgattaagttcgg

SEQ ID NO: 430654 - DNA, 15 bp, Homo sapiens
gtgattaagttcggg

SEQ ID NO: 430655 - DNA, 15 bp, Homo sapiens
tgattaagttcggga

SEQ ID NO: 430656 - DNA, 15 bp, Homo sapiens
gattaagttcgggaa

SEQ ID NO: 430657 - DNA, 15 bp, Homo sapiens
attaagttcgggaaa

SEQ ID NO: 430658 - DNA, 15 bp, Homo sapiens
ttaagttcgggaaag

SEQ ID NO: 430659 - DNA, 15 bp, Homo sapiens
taagttcgggaaaga

SEQ ID NO: 430660 - DNA, 15 bp, Homo sapiens
aagttcgggaaagag

SEQ ID NO: 430661 - DNA, 15 bp, Homo sapiens
agttcgggaaagagg

SEQ ID NO: 430662 - DNA, 15 bp, Homo sapiens
gttcgggaaagagga

SEQ ID NO: 430663 - DNA, 15 bp, Homo sapiens
ttcgggaaagaggaa

SEQ ID NO: 430664 - DNA, 15 bp, Homo sapiens
tcgggaaagaggaat

SEQ ID NO: 430665 - DNA, 15 bp, Homo sapiens
cgggaaagaggaatg

SEQ ID NO: 430666 - DNA, 15 bp, Homo sapiens
gggaaagaggaatgg

SEQ ID NO: 430667 - DNA, 15 bp, Homo sapiens
ggaaagaggaatggc

SEQ ID NO: 430668 - DNA, 15 bp, Homo sapiens
gaaagaggaatggcc

SEQ ID NO: 430669 - DNA, 15 bp, Homo sapiens
aaagaggaatggcca

SEQ ID NO: 430670 - DNA, 15 bp, Homo sapiens
aagaggaatggccat

SEQ ID NO: 430671 - DNA, 15 bp, Homo sapiens
agaggaatggccatg

SEQ ID NO: 430672 - DNA, 15 bp, Homo sapiens
gaggaatggccatgc

SEQ ID NO: 430673 - DNA, 15 bp, Homo sapiens
aggaatggccatgct

SEQ ID NO: 430674 - DNA, 15 bp, Homo sapiens
ggaatggccatgctg

SEQ ID NO: 430675 - DNA, 15 bp, Homo sapiens
gaatggccatgctgg

SEQ ID NO: 430676 - DNA, 15 bp, Homo sapiens
aatggccatgctggg

SEQ ID NO: 430677 - DNA, 15 bp, Homo sapiens
atggccatgctgggg

SEQ ID NO: 430678 - DNA, 15 bp, Homo sapiens
tggccatgctgggga

SEQ ID NO: 430679 - DNA, 15 bp, Homo sapiens
ggccatgctggggac

SEQ ID NO: 430680 - DNA, 15 bp, Homo sapiens
gccatgctggggaca

SEQ ID NO: 430681 - DNA, 15 bp, Homo sapiens
ccatgctggggacag

SEQ ID NO: 430682 - DNA, 15 bp, Homo sapiens
catgctggggacaga

SEQ ID NO: 430683 - DNA, 15 bp, Homo sapiens
atgctggggacagaa

SEQ ID NO: 430684 - DNA, 15 bp, Homo sapiens
tgctggggacagaat

SEQ ID NO: 430685 - DNA, 15 bp, Homo sapiens
gctggggacagaatc

SEQ ID NO: 430686 - DNA, 15 bp, Homo sapiens
ctggggacagaatcc

SEQ ID NO: 430687 - DNA, 15 bp, Homo sapiens
tggggacagaatcct

SEQ ID NO: 430688 - DNA, 15 bp, Homo sapiens
ggggacagaatcctt

SEQ ID NO: 430689 - DNA, 15 bp, Homo sapiens
gggacagaatcctta

SEQ ID NO: 430690 - DNA, 15 bp, Homo sapiens
ggacagaatccttag

SEQ ID NO: 430691 - DNA, 15 bp, Homo sapiens
gacagaatccttagc

SEQ ID NO: 430692 - DNA, 15 bp, Homo sapiens
acagaatccttagca

SEQ ID NO: 430693 - DNA, 15 bp, Homo sapiens
cagaatccttagcag

SEQ ID NO: 430694 - DNA, 15 bp, Homo sapiens
agaatccttagcaga

SEQ ID NO: 430695 - DNA, 15 bp, Homo sapiens
gaatccttagcagaa

SEQ ID NO: 430696 - DNA, 15 bp, Homo sapiens
aatccttagcagaac

SEQ ID NO: 430697 - DNA, 15 bp, Homo sapiens
atccttagcagaaca

SEQ ID NO: 430698 - DNA, 15 bp, Homo sapiens
tccttagcagaacag

SEQ ID NO: 430699 - DNA, 15 bp, Homo sapiens
ccttagcagaacagc

SEQ ID NO: 430700 - DNA, 15 bp, Homo sapiens
cttagcagaacagct

SEQ ID NO: 430701 - DNA, 15 bp, Homo sapiens
ttagcagaacagctc

SEQ ID NO: 430702 - DNA, 15 bp, Homo sapiens
tagcagaacagctca

SEQ ID NO: 430703 - DNA, 15 bp, Homo sapiens
agcagaacagctcag

SEQ ID NO: 430704 - DNA, 15 bp, Homo sapiens
gcagaacagctcagc

SEQ ID NO: 430705 - DNA, 15 bp, Homo sapiens
cagaacagctcagcc

SEQ ID NO: 430706 - DNA, 15 bp, Homo sapiens
agaacagctcagcca

SEQ ID NO: 430707 - DNA, 15 bp, Homo sapiens
gaacagctcagccat

SEQ ID NO: 430708 - DNA, 15 bp, Homo sapiens
aacagctcagccata

SEQ ID NO: 430709 - DNA, 15 bp, Homo sapiens
cagctcagccataag

SEQ ID NO: 430710 - DNA, 15 bp, Homo sapiens
agctcagccataagg

SEQ ID NO: 430711 - DNA, 15 bp, Homo sapiens
gctcagccataagga

SEQ ID NO: 430712 - DNA, 15 bp, Homo sapiens
ctcagccataaggaa

SEQ ID NO: 430713 - DNA, 15 bp, Homo sapiens
tcagccataaggaaa

SEQ ID NO: 430714 - DNA, 15 bp, Homo sapiens
cagccataaggaaag

SEQ ID NO: 430715 - DNA, 15 bp, Homo sapiens
agccataaggaaaga

SEQ ID NO: 430716 - DNA, 15 bp, Homo sapiens
gccataaggaaagag

SEQ ID NO: 430717 - DNA, 15 bp, Homo sapiens
ccataaggaaagagc

SEQ ID NO: 430718 - DNA, 15 bp, Homo sapiens
cataaggaaagagca

SEQ ID NO: 430719 - DNA, 15 bp, Homo sapiens
ataaggaaagagcag

SEQ ID NO: 430720 - DNA, 15 bp, Homo sapiens
taaggaaagagcagc

SEQ ID NO: 430721 - DNA, 15 bp, Homo sapiens
aaggaaagagcagct

SEQ ID NO: 430722 - DNA, 15 bp, Homo sapiens
aggaaagagcagctg

SEQ ID NO: 430723 - DNA, 15 bp, Homo sapiens
ggaaagagcagctgt

SEQ ID NO: 430724 - DNA, 15 bp, Homo sapiens
gaaagagcagctgta

SEQ ID NO: 430725 - DNA, 15 bp, Homo sapiens
aaagagcagctgtat

SEQ ID NO: 430726 - DNA, 15 bp, Homo sapiens
aagagcagctgtatt

SEQ ID NO: 430727 - DNA, 15 bp, Homo sapiens
agagcagctgtattt

SEQ ID NO: 430728 - DNA, 15 bp, Homo sapiens
gagcagctgtatttt

SEQ ID NO: 430729 - DNA, 15 bp, Homo sapiens
agcagctgtattttg

SEQ ID NO: 430730 - DNA, 15 bp, Homo sapiens
gcagctgtattttgg

SEQ ID NO: 430731 - DNA, 15 bp, Homo sapiens
cagctgtattttggg

SEQ ID NO: 430732 - DNA, 15 bp, Homo sapiens
agctgtattttgggg

SEQ ID NO: 430733 - DNA, 15 bp, Homo sapiens
gctgtattttgggga

SEQ ID NO: 430734 - DNA, 15 bp, Homo sapiens
ctgtattttggggag

SEQ ID NO: 430735 - DNA, 15 bp, Homo sapiens
tgtattttggggagt

SEQ ID NO: 430736 - DNA, 15 bp, Homo sapiens
gtattttggggagtc

SEQ ID NO: 430737 - DNA, 15 bp, Homo sapiens
tattttggggagtca

SEQ ID NO: 430738 - DNA, 15 bp, Homo sapiens
attttggggagtcag

SEQ ID NO: 430739 - DNA, 15 bp, Homo sapiens
ttttggggagtcagt

SEQ ID NO: 430740 - DNA, 15 bp, Homo sapiens
tttggggagtcagta

SEQ ID NO: 430741 - DNA, 15 bp, Homo sapiens
ttggggagtcagtag

SEQ ID NO: 430742 - DNA, 15 bp, Homo sapiens
tggggagtcagtaga

SEQ ID NO: 430743 - DNA, 15 bp, Homo sapiens
ggggagtcagtagac

SEQ ID NO: 430744 - DNA, 15 bp, Homo sapiens
gggagtcagtagaca

SEQ ID NO: 430745 - DNA, 15 bp, Homo sapiens
ggagtcagtagacag

SEQ ID NO: 430746 - DNA, 15 bp, Homo sapiens
gagtcagtagacagc

SEQ ID NO: 430747 - DNA, 15 bp, Homo sapiens
agtcagtagacagcc

SEQ ID NO: 430748 - DNA, 15 bp, Homo sapiens
gtcagtagacagcct

SEQ ID NO: 430749 - DNA, 15 bp, Homo sapiens
tcagtagacagcctg

SEQ ID NO: 430750 - DNA, 15 bp, Homo sapiens
cagtagacagcctgg

SEQ ID NO: 430751 - DNA, 15 bp, Homo sapiens
agtagacagcctggc

SEQ ID NO: 430752 - DNA, 15 bp, Homo sapiens
gtagacagcctggcc

SEQ ID NO: 430753 - DNA, 15 bp, Homo sapiens
tagacagcctggcct

SEQ ID NO: 430754 - DNA, 15 bp, Homo sapiens
agacagcctggcctg

SEQ ID NO: 430755 - DNA, 15 bp, Homo sapiens
gacagcctggcctgg

SEQ ID NO: 430756 - DNA, 15 bp, Homo sapiens
acagcctggcctggt

SEQ ID NO: 430757 - DNA, 15 bp, Homo sapiens
cagcctggcctggtt

SEQ ID NO: 430758 - DNA, 15 bp, Homo sapiens
agcctggcctggttg

SEQ ID NO: 430759 - DNA, 15 bp, Homo sapiens
gcctggcctggttgc

SEQ ID NO: 430760 - DNA, 15 bp, Homo sapiens
cctggcctggttgcc

SEQ ID NO: 430761 - DNA, 15 bp, Homo sapiens
ctggcctggttgcca

SEQ ID NO: 430762 - DNA, 15 bp, Homo sapiens
tggcctggttgccag

SEQ ID NO: 430763 - DNA, 15 bp, Homo sapiens
ggcctggttgccaga

SEQ ID NO: 430764 - DNA, 15 bp, Homo sapiens
gcctggttgccagag

SEQ ID NO: 430765 - DNA, 15 bp, Homo sapiens
cctggttgccagagt

SEQ ID NO: 430766 - DNA, 15 bp, Homo sapiens
ctggttgccagagtc

SEQ ID NO: 430767 - DNA, 15 bp, Homo sapiens
tggttgccagagtct

SEQ ID NO: 430768 - DNA, 15 bp, Homo sapiens
ggttgccagagtctt

SEQ ID NO: 430769 - DNA, 15 bp, Homo sapiens
gttgccagagtcttg

SEQ ID NO: 430770 - DNA, 15 bp, Homo sapiens
ttgccagagtcttgt

SEQ ID NO: 430771 - DNA, 15 bp, Homo sapiens
tgccagagtcttgtg

SEQ ID NO: 430772 - DNA, 15 bp, Homo sapiens
gccagagtcttgtgc

SEQ ID NO: 430773 - DNA, 15 bp, Homo sapiens
ccagagtcttgtgcc

SEQ ID NO: 430774 - DNA, 15 bp, Homo sapiens
cagagtcttgtgcct

SEQ ID NO: 430775 - DNA, 15 bp, Homo sapiens
agagtcttgtgcctg

SEQ ID NO: 430776 - DNA, 15 bp, Homo sapiens
gagtcttgtgcctgg

SEQ ID NO: 430777 - DNA, 15 bp, Homo sapiens
agtcttgtgcctgga

SEQ ID NO: 430778 - DNA, 15 bp, Homo sapiens
gtcttgtgcctggac

SEQ ID NO: 430779 - DNA, 15 bp, Homo sapiens
tcttgtgcctggacg

SEQ ID NO: 430780 - DNA, 15 bp, Homo sapiens
cttgtgcctggacgg

SEQ ID NO: 430781 - DNA, 15 bp, Homo sapiens
ttgtgcctggacggc

SEQ ID NO: 430782 - DNA, 15 bp, Homo sapiens
tgtgcctggacggca

SEQ ID NO: 430783 - DNA, 15 bp, Homo sapiens
gtgcctggacggcag

SEQ ID NO: 430784 - DNA, 15 bp, Homo sapiens
tgcctggacggcaga

SEQ ID NO: 430785 - DNA, 15 bp, Homo sapiens
gcctggacggcagat

SEQ ID NO: 430786 - DNA, 15 bp, Homo sapiens
cctggacggcagatg

SEQ ID NO: 430787 - DNA, 15 bp, Homo sapiens
ctggacggcagatgg

SEQ ID NO: 430788 - DNA, 15 bp, Homo sapiens
tggacggcagatggg

SEQ ID NO: 430789 - DNA, 15 bp, Homo sapiens
ggacggcagatgggg

SEQ ID NO: 430790 - DNA, 15 bp, Homo sapiens
gacggcagatgggga

SEQ ID NO: 430791 - DNA, 15 bp, Homo sapiens
acggcagatggggat

SEQ ID NO: 430792 - DNA, 15 bp, Homo sapiens
cggcagatggggatg

SEQ ID NO: 430793 - DNA, 15 bp, Homo sapiens
ggcagatggggatga

SEQ ID NO: 430794 - DNA, 15 bp, Homo sapiens
gcagatggggatgag

SEQ ID NO: 430795 - DNA, 15 bp, Homo sapiens
cagatggggatgaga

SEQ ID NO: 430796 - DNA, 15 bp, Homo sapiens
agatggggatgagat

SEQ ID NO: 430797 - DNA, 15 bp, Homo sapiens
gatggggatgagatg

SEQ ID NO: 430798 - DNA, 15 bp, Homo sapiens
atggggatgagatgg

SEQ ID NO: 430799 - DNA, 15 bp, Homo sapiens
tggggatgagatggt

SEQ ID NO: 430800 - DNA, 15 bp, Homo sapiens
ggggatgagatggtt

SEQ ID NO: 430801 - DNA, 15 bp, Homo sapiens
gggatgagatggttg

SEQ ID NO: 430802 - DNA, 15 bp, Homo sapiens
ggatgagatggttgt

SEQ ID NO: 430803 - DNA, 15 bp, Homo sapiens
gatgagatggttgta

SEQ ID NO: 430804 - DNA, 15 bp, Homo sapiens
atgagatggttgtat

SEQ ID NO: 430805 - DNA, 15 bp, Homo sapiens
tgagatggttgtatg

SEQ ID NO: 430806 - DNA, 15 bp, Homo sapiens
gagatggttgtatgt

SEQ ID NO: 430807 - DNA, 15 bp, Homo sapiens
agatggttgtatgtg

SEQ ID NO: 430808 - DNA, 15 bp, Homo sapiens
gatggttgtatgtgc

SEQ ID NO: 430809 - DNA, 15 bp, Homo sapiens
atggttgtatgtgct

SEQ ID NO: 430810 - DNA, 15 bp, Homo sapiens
tggttgtatgtgctg

SEQ ID NO: 430811 - DNA, 15 bp, Homo sapiens
ggttgtatgtgctga

SEQ ID NO: 430812 - DNA, 15 bp, Homo sapiens
gttgtatgtgctgaa

SEQ ID NO: 430813 - DNA, 15 bp, Homo sapiens
ttgtatgtgctgaat

SEQ ID NO: 430814 - DNA, 15 bp, Homo sapiens
tgtatgtgctgaatg

SEQ ID NO: 430815 - DNA, 15 bp, Homo sapiens
gtatgtgctgaatgg

SEQ ID NO: 430816 - DNA, 15 bp, Homo sapiens
tatgtgctgaatggt

SEQ ID NO: 430817 - DNA, 15 bp, Homo sapiens
atgtgctgaatggtt

SEQ ID NO: 430818 - DNA, 15 bp, Homo sapiens
tgtgctgaatggttc

SEQ ID NO: 430819 - DNA, 15 bp, Homo sapiens
gtgctgaatggttca

SEQ ID NO: 430820 - DNA, 15 bp, Homo sapiens
tgctgaatggttcag

SEQ ID NO: 430821 - DNA, 15 bp, Homo sapiens
gctgaatggttcaga

SEQ ID NO: 430822 - DNA, 15 bp, Homo sapiens
ctgaatggttcagag

SEQ ID NO: 430823 - DNA, 15 bp, Homo sapiens
tgaatggttcagagg

SEQ ID NO: 430824 - DNA, 15 bp, Homo sapiens
gaatggttcagagga

SEQ ID NO: 430825 - DNA, 15 bp, Homo sapiens
aatggttcagaggac

SEQ ID NO: 430826 - DNA, 15 bp, Homo sapiens
atggttcagaggacc

SEQ ID NO: 430827 - DNA, 15 bp, Homo sapiens
tggttcagaggacct

SEQ ID NO: 430828 - DNA, 15 bp, Homo sapiens
ggttcagaggacctg

SEQ ID NO: 430829 - DNA, 15 bp, Homo sapiens
gttcagaggacctgg

SEQ ID NO: 430830 - DNA, 15 bp, Homo sapiens
ttcagaggacctgga

SEQ ID NO: 430831 - DNA, 15 bp, Homo sapiens
tcagaggacctggaa

SEQ ID NO: 430832 - DNA, 15 bp, Homo sapiens
cagaggacctggaaa

SEQ ID NO: 430833 - DNA, 15 bp, Homo sapiens
agaggacctggaaag

SEQ ID NO: 430834 - DNA, 15 bp, Homo sapiens
gaggacctggaaagg

SEQ ID NO: 430835 - DNA, 15 bp, Homo sapiens
aggacctggaaaggt

SEQ ID NO: 430836 - DNA, 15 bp, Homo sapiens
ggacctggaaaggtc

SEQ ID NO: 430837 - DNA, 15 bp, Homo sapiens
gacctggaaaggtcc

SEQ ID NO: 430838 - DNA, 15 bp, Homo sapiens
acctggaaaggtcct

SEQ ID NO: 430839 - DNA, 15 bp, Homo sapiens
cctggaaaggtccta

SEQ ID NO: 430840 - DNA, 15 bp, Homo sapiens
ctggaaaggtcctac

SEQ ID NO: 430841 - DNA, 15 bp, Homo sapiens
tggaaaggtcctaca

SEQ ID NO: 430842 - DNA, 15 bp, Homo sapiens
ggaaaggtcctacag

SEQ ID NO: 430843 - DNA, 15 bp, Homo sapiens
gaaaggtcctacaga

SEQ ID NO: 430844 - DNA, 15 bp, Homo sapiens
aaaggtcctacagag

SEQ ID NO: 430845 - DNA, 15 bp, Homo sapiens
aaggtcctacagagg

SEQ ID NO: 430846 - DNA, 15 bp, Homo sapiens
aggtcctacagagga

SEQ ID NO: 430847 - DNA, 15 bp, Homo sapiens
ggtcctacagaggac

SEQ ID NO: 430848 - DNA, 15 bp, Homo sapiens
gtcctacagaggacc

SEQ ID NO: 430849 - DNA, 15 bp, Homo sapiens
tcctacagaggacct

SEQ ID NO: 430850 - DNA, 15 bp, Homo sapiens
cctacagaggacctg

SEQ ID NO: 430851 - DNA, 15 bp, Homo sapiens
ctacagaggacctgg

SEQ ID NO: 430852 - DNA, 15 bp, Homo sapiens
tacagaggacctgga

SEQ ID NO: 430853 - DNA, 15 bp, Homo sapiens
acagaggacctggaa

SEQ ID NO: 430854 - DNA, 15 bp, Homo sapiens
gaggacctggaaagt

SEQ ID NO: 430855 - DNA, 15 bp, Homo sapiens
aggacctggaaagtc

SEQ ID NO: 430856 - DNA, 15 bp, Homo sapiens
ggacctggaaagtca

SEQ ID NO: 430857 - DNA, 15 bp, Homo sapiens
gacctggaaagtcag

SEQ ID NO: 430858 - DNA, 15 bp, Homo sapiens
acctggaaagtcagg

SEQ ID NO: 430859 - DNA, 15 bp, Homo sapiens
cctggaaagtcaggc

SEQ ID NO: 430860 - DNA, 15 bp, Homo sapiens
ctggaaagtcaggca

SEQ ID NO: 430861 - DNA, 15 bp, Homo sapiens
tggaaagtcaggcag

SEQ ID NO: 430862 - DNA, 15 bp, Homo sapiens
ggaaagtcaggcaga

SEQ ID NO: 430863 - DNA, 15 bp, Homo sapiens
gaaagtcaggcagaa

SEQ ID NO: 430864 - DNA, 15 bp, Homo sapiens
aaagtcaggcagaac

SEQ ID NO: 430865 - DNA, 15 bp, Homo sapiens
aagtcaggcagaaca

SEQ ID NO: 430866 - DNA, 15 bp, Homo sapiens
agtcaggcagaacat

SEQ ID NO: 430867 - DNA, 15 bp, Homo sapiens
gtcaggcagaacatt

SEQ ID NO: 430868 - DNA, 15 bp, Homo sapiens
tcaggcagaacattg

SEQ ID NO: 430869 - DNA, 15 bp, Homo sapiens
caggcagaacattgt

SEQ ID NO: 430870 - DNA, 15 bp, Homo sapiens
aggcagaacattgta

SEQ ID NO: 430871 - DNA, 15 bp, Homo sapiens
ggcagaacattgtaa

SEQ ID NO: 430872 - DNA, 15 bp, Homo sapiens
gcagaacattgtaac

SEQ ID NO: 430873 - DNA, 15 bp, Homo sapiens
cagaacattgtaact

SEQ ID NO: 430874 - DNA, 15 bp, Homo sapiens
agaacattgtaactt

SEQ ID NO: 430875 - DNA, 15 bp, Homo sapiens
gaacattgtaacttc

SEQ ID NO: 430876 - DNA, 15 bp, Homo sapiens
aacattgtaacttca

SEQ ID NO: 430877 - DNA, 15 bp, Homo sapiens
acattgtaacttcat

SEQ ID NO: 430878 - DNA, 15 bp, Homo sapiens
cattgtaacttcata

SEQ ID NO: 430879 - DNA, 15 bp, Homo sapiens
attgtaacttcatac

SEQ ID NO: 430880 - DNA, 15 bp, Homo sapiens
ttgtaacttcataca

SEQ ID NO: 430881 - DNA, 15 bp, Homo sapiens
tgtaacttcatacaa

SEQ ID NO: 430882 - DNA, 15 bp, Homo sapiens
gtaacttcatacaac

SEQ ID NO: 430883 - DNA, 15 bp, Homo sapiens
taacttcatacaaca

SEQ ID NO: 430884 - DNA, 15 bp, Homo sapiens
aacttcatacaacaa

SEQ ID NO: 430885 - DNA, 15 bp, Homo sapiens
acttcatacaacaag

SEQ ID NO: 430886 - DNA, 15 bp, Homo sapiens
cttcatacaacaaga

SEQ ID NO: 430887 - DNA, 15 bp, Homo sapiens
ttcatacaacaagaa

SEQ ID NO: 430888 - DNA, 15 bp, Homo sapiens
tcatacaacaagaaa

SEQ ID NO: 430889 - DNA, 15 bp, Homo sapiens
catacaacaagaaag

SEQ ID NO: 430890 - DNA, 15 bp, Homo sapiens
atacaacaagaaaga

SEQ ID NO: 430891 - DNA, 15 bp, Homo sapiens
tacaacaagaaagaa

SEQ ID NO: 430892 - DNA, 15 bp, Homo sapiens
acaacaagaaagaag

SEQ ID NO: 430893 - DNA, 15 bp, Homo sapiens
caacaagaaagaagg

SEQ ID NO: 430894 - DNA, 15 bp, Homo sapiens
aacaagaaagaaggt

SEQ ID NO: 430895 - DNA, 15 bp, Homo sapiens
acaagaaagaaggtg

SEQ ID NO: 430896 - DNA, 15 bp, Homo sapiens
caagaaagaaggtgc

SEQ ID NO: 430897 - DNA, 15 bp, Homo sapiens
aagaaagaaggtgct

SEQ ID NO: 430898 - DNA, 15 bp, Homo sapiens
agaaagaaggtgcta

SEQ ID NO: 430899 - DNA, 15 bp, Homo sapiens
gaaagaaggtgctag

SEQ ID NO: 430900 - DNA, 15 bp, Homo sapiens
aaagaaggtgctagt

SEQ ID NO: 430901 - DNA, 15 bp, Homo sapiens
aagaaggtgctagta

SEQ ID NO: 430902 - DNA, 15 bp, Homo sapiens
agaaggtgctagtac

SEQ ID NO: 430903 - DNA, 15 bp, Homo sapiens
gaaggtgctagtaca

SEQ ID NO: 430904 - DNA, 15 bp, Homo sapiens
aaggtgctagtacag

SEQ ID NO: 430905 - DNA, 15 bp, Homo sapiens
aggtgctagtacagt

SEQ ID NO: 430906 - DNA, 15 bp, Homo sapiens
ggtgctagtacagtt

SEQ ID NO: 430907 - DNA, 15 bp, Homo sapiens
gtgctagtacagttt

SEQ ID NO: 430908 - DNA, 15 bp, Homo sapiens
tgctagtacagtttt

SEQ ID NO: 430909 - DNA, 15 bp, Homo sapiens
gctagtacagttttg

SEQ ID NO: 430910 - DNA, 15 bp, Homo sapiens
ctagtacagttttgt

SEQ ID NO: 430911 - DNA, 15 bp, Homo sapiens
tagtacagttttgtt

SEQ ID NO: 430912 - DNA, 15 bp, Homo sapiens
agtacagttttgttt

SEQ ID NO: 430913 - DNA, 15 bp, Homo sapiens
gtacagttttgtttt

SEQ ID NO: 430914 - DNA, 15 bp, Homo sapiens
tacagttttgttttt

SEQ ID NO: 430915 - DNA, 15 bp, Homo sapiens
acagttttgtttttt

SEQ ID NO: 430916 - DNA, 15 bp, Homo sapiens
cagttttgttttttt

SEQ ID NO: 430917 - DNA, 15 bp, Homo sapiens
agttttgttttttta

SEQ ID NO: 430918 - DNA, 15 bp, Homo sapiens
gttttgtttttttaa

SEQ ID NO: 430919 - DNA, 15 bp, Homo sapiens
tttgtttttttaagc

SEQ ID NO: 430920 - DNA, 15 bp, Homo sapiens
ttgtttttttaagct

SEQ ID NO: 430921 - DNA, 15 bp, Homo sapiens
tgtttttttaagctt

SEQ ID NO: 430922 - DNA, 15 bp, Homo sapiens
gtttttttaagcttg

SEQ ID NO: 430923 - DNA, 15 bp, Homo sapiens
tttttttaagcttgg

SEQ ID NO: 430924 - DNA, 15 bp, Homo sapiens
ttttttaagcttggg

SEQ ID NO: 430925 - DNA, 15 bp, Homo sapiens
tttttaagcttgggg

SEQ ID NO: 430926 - DNA, 15 bp, Homo sapiens
ttttaagcttgggga

SEQ ID NO: 430927 - DNA, 15 bp, Homo sapiens
tttaagcttggggaa

SEQ ID NO: 430928 - DNA, 15 bp, Homo sapiens
ttaagcttggggaaa

SEQ ID NO: 430929 - DNA, 15 bp, Homo sapiens
taagcttggggaaaa

SEQ ID NO: 430930 - DNA, 15 bp, Homo sapiens
aagcttggggaaaaa

SEQ ID NO: 430931 - DNA, 15 bp, Homo sapiens
agcttggggaaaaaa

SEQ ID NO: 430932 - DNA, 15 bp, Homo sapiens
gcttggggaaaaaaa

SEQ ID NO: 430933 - DNA, 15 bp, Homo sapiens
cttggggaaaaaaat

SEQ ID NO: 430934 - DNA, 15 bp, Homo sapiens
ttggggaaaaaaata

SEQ ID NO: 430935 - DNA, 15 bp, Homo sapiens
tggggaaaaaaataa

SEQ ID NO: 430936 - DNA, 15 bp, Homo sapiens
ggggaaaaaaataag

SEQ ID NO: 430937 - DNA, 15 bp, Homo sapiens
gggaaaaaaataaga

SEQ ID NO: 430938 - DNA, 15 bp, Homo sapiens
ggaaaaaaataagaa

SEQ ID NO: 430939 - DNA, 15 bp, Homo sapiens
gaaaaaaataagaag

SEQ ID NO: 430940 - DNA, 15 bp, Homo sapiens
aaaaaaataagaagt

SEQ ID NO: 430941 - DNA, 15 bp, Homo sapiens
aaaaaataagaagtt

SEQ ID NO: 430942 - DNA, 15 bp, Homo sapiens
aaaaataagaagttc

SEQ ID NO: 430943 - DNA, 15 bp, Homo sapiens
aaaataagaagttca

SEQ ID NO: 430944 - DNA, 15 bp, Homo sapiens
aaataagaagttcac

SEQ ID NO: 430945 - DNA, 15 bp, Homo sapiens
aataagaagttcact

SEQ ID NO: 430946 - DNA, 15 bp, Homo sapiens
ataagaagttcactt

SEQ ID NO: 430947 - DNA, 15 bp, Homo sapiens
taagaagttcacttg

SEQ ID NO: 430948 - DNA, 15 bp, Homo sapiens
aagaagttcacttgt

SEQ ID NO: 430949 - DNA, 15 bp, Homo sapiens
agaagttcacttgtc

SEQ ID NO: 430950 - DNA, 15 bp, Homo sapiens
gaagttcacttgtct

SEQ ID NO: 430951 - DNA, 15 bp, Homo sapiens
aagttcacttgtctc

SEQ ID NO: 430952 - DNA, 15 bp, Homo sapiens
agttcacttgtctca

SEQ ID NO: 430953 - DNA, 15 bp, Homo sapiens
gttcacttgtctcat

SEQ ID NO: 430954 - DNA, 15 bp, Homo sapiens
ttcacttgtctcatc

SEQ ID NO: 430955 - DNA, 15 bp, Homo sapiens
tcacttgtctcatct

SEQ ID NO: 430956 - DNA, 15 bp, Homo sapiens
cacttgtctcatctt

SEQ ID NO: 430957 - DNA, 15 bp, Homo sapiens
acttgtctcatctta

SEQ ID NO: 430958 - DNA, 15 bp, Homo sapiens
cttgtctcatcttat

SEQ ID NO: 430959 - DNA, 15 bp, Homo sapiens
ttgtctcatcttatc

SEQ ID NO: 430960 - DNA, 15 bp, Homo sapiens
tgtctcatcttatcc

SEQ ID NO: 430961 - DNA, 15 bp, Homo sapiens
gtctcatcttatcca

SEQ ID NO: 430962 - DNA, 15 bp, Homo sapiens
tctcatcttatccaa

SEQ ID NO: 430963 - DNA, 15 bp, Homo sapiens
ctcatcttatccaat

SEQ ID NO: 430964 - DNA, 15 bp, Homo sapiens
tcatcttatccaatt

SEQ ID NO: 430965 - DNA, 15 bp, Homo sapiens
catcttatccaattt

SEQ ID NO: 430966 - DNA, 15 bp, Homo sapiens
atcttatccaattta

SEQ ID NO: 430967 - DNA, 15 bp, Homo sapiens
tcttatccaatttaa

SEQ ID NO: 430968 - DNA, 15 bp, Homo sapiens
cttatccaatttaaa

SEQ ID NO: 430969 - DNA, 15 bp, Homo sapiens
ttatccaatttaaaa

SEQ ID NO: 430970 - DNA, 15 bp, Homo sapiens
tatccaatttaaaat

SEQ ID NO: 430971 - DNA, 15 bp, Homo sapiens
atccaatttaaaatc

SEQ ID NO: 430972 - DNA, 15 bp, Homo sapiens
tccaatttaaaatct

SEQ ID NO: 430973 - DNA, 15 bp, Homo sapiens
ccaatttaaaatcta

SEQ ID NO: 430974 - DNA, 15 bp, Homo sapiens
caatttaaaatctac

SEQ ID NO: 430975 - DNA, 15 bp, Homo sapiens
aatttaaaatctacc

SEQ ID NO: 430976 - DNA, 15 bp, Homo sapiens
atttaaaatctacct

SEQ ID NO: 430977 - DNA, 15 bp, Homo sapiens
tttaaaatctacctt

SEQ ID NO: 430978 - DNA, 15 bp, Homo sapiens
ttaaaatctaccttc

SEQ ID NO: 430979 - DNA, 15 bp, Homo sapiens
taaaatctaccttca

SEQ ID NO: 430980 - DNA, 15 bp, Homo sapiens
aaaatctaccttcag

SEQ ID NO: 430981 - DNA, 15 bp, Homo sapiens
aaatctaccttcagt

SEQ ID NO: 430982 - DNA, 15 bp, Homo sapiens
aatctaccttcagtc

SEQ ID NO: 430983 - DNA, 15 bp, Homo sapiens
atctaccttcagtca

SEQ ID NO: 430984 - DNA, 15 bp, Homo sapiens
tctaccttcagtcag

SEQ ID NO: 430985 - DNA, 15 bp, Homo sapiens
ctaccttcagtcagc

SEQ ID NO: 430986 - DNA, 15 bp, Homo sapiens
taccttcagtcagct

SEQ ID NO: 430987 - DNA, 15 bp, Homo sapiens
accttcagtcagctt

SEQ ID NO: 430988 - DNA, 15 bp, Homo sapiens
ccttcagtcagcttt

SEQ ID NO: 430989 - DNA, 15 bp, Homo sapiens
cttcagtcagctttt

SEQ ID NO: 430990 - DNA, 15 bp, Homo sapiens
ttcagtcagcttttc

SEQ ID NO: 430991 - DNA, 15 bp, Homo sapiens
tcagtcagcttttct

SEQ ID NO: 430992 - DNA, 15 bp, Homo sapiens
cagtcagcttttctt

SEQ ID NO: 430993 - DNA, 15 bp, Homo sapiens
agtcagcttttcttg

SEQ ID NO: 430994 - DNA, 15 bp, Homo sapiens
gtcagcttttcttgt

SEQ ID NO: 430995 - DNA, 15 bp, Homo sapiens
tcagcttttcttgtc

SEQ ID NO: 430996 - DNA, 15 bp, Homo sapiens
cagcttttcttgtct

SEQ ID NO: 430997 - DNA, 15 bp, Homo sapiens
agcttttcttgtctc

SEQ ID NO: 430998 - DNA, 15 bp, Homo sapiens
gcttttcttgtctcc

SEQ ID NO: 430999 - DNA, 15 bp, Homo sapiens
cttttcttgtctcct

SEQ ID NO: 431000 - DNA, 15 bp, Homo sapiens
ttttcttgtctcctt

SEQ ID NO: 431001 - DNA, 15 bp, Homo sapiens
tttcttgtctccttt

SEQ ID NO: 431002 - DNA, 15 bp, Homo sapiens
ttcttgtctcctttc

SEQ ID NO: 431003 - DNA, 15 bp, Homo sapiens
tcttgtctcctttct

SEQ ID NO: 431004 - DNA, 15 bp, Homo sapiens
cttgtctcctttctt

SEQ ID NO: 431005 - DNA, 15 bp, Homo sapiens
ttgtctcctttcttc

SEQ ID NO: 431006 - DNA, 15 bp, Homo sapiens
tgtctcctttcttcc

SEQ ID NO: 431007 - DNA, 15 bp, Homo sapiens
gtctcctttcttccc

SEQ ID NO: 431008 - DNA, 15 bp, Homo sapiens
tctcctttcttccct

SEQ ID NO: 431009 - DNA, 15 bp, Homo sapiens
ctcctttcttcccta

SEQ ID NO: 431010 - DNA, 15 bp, Homo sapiens
tcctttcttccctag

SEQ ID NO: 431011 - DNA, 15 bp, Homo sapiens
cctttcttccctagg

SEQ ID NO: 431012 - DNA, 15 bp, Homo sapiens
ctttcttccctagga

SEQ ID NO: 431013 - DNA, 15 bp, Homo sapiens
tttcttccctaggac

SEQ ID NO: 431014 - DNA, 15 bp, Homo sapiens
ttcttccctaggact

SEQ ID NO: 431015 - DNA, 15 bp, Homo sapiens
tcttccctaggactt

SEQ ID NO: 431016 - DNA, 15 bp, Homo sapiens
cttccctaggacttt

SEQ ID NO: 431017 - DNA, 15 bp, Homo sapiens
ttccctaggactttg

SEQ ID NO: 431018 - DNA, 15 bp, Homo sapiens
tccctaggactttgc

SEQ ID NO: 431019 - DNA, 15 bp, Homo sapiens
ccctaggactttgcg

SEQ ID NO: 431020 - DNA, 15 bp, Homo sapiens
cctaggactttgcga

SEQ ID NO: 431021 - DNA, 15 bp, Homo sapiens
ctaggactttgcgaa

SEQ ID NO: 431022 - DNA, 15 bp, Homo sapiens
taggactttgcgaag

SEQ ID NO: 431023 - DNA, 15 bp, Homo sapiens
aggactttgcgaagt

SEQ ID NO: 431024 - DNA, 15 bp, Homo sapiens
ggactttgcgaagtt

SEQ ID NO: 431025 - DNA, 15 bp, Homo sapiens
gactttgcgaagttt

SEQ ID NO: 431026 - DNA, 15 bp, Homo sapiens
actttgcgaagttta

SEQ ID NO: 431027 - DNA, 15 bp, Homo sapiens
ctttgcgaagtttat

SEQ ID NO: 431028 - DNA, 15 bp, Homo sapiens
tttgcgaagtttata

SEQ ID NO: 431029 - DNA, 15 bp, Homo sapiens
ttgcgaagtttataa

SEQ ID NO: 431030 - DNA, 15 bp, Homo sapiens
tgcgaagtttataaa

SEQ ID NO: 431031 - DNA, 15 bp, Homo sapiens
gcgaagtttataaaa

SEQ ID NO: 431032 - DNA, 15 bp, Homo sapiens
cgaagtttataaaaa

SEQ ID NO: 431033 - DNA, 15 bp, Homo sapiens
gaagtttataaaaag

SEQ ID NO: 431034 - DNA, 15 bp, Homo sapiens
aagtttataaaaagc

SEQ ID NO: 431035 - DNA, 15 bp, Homo sapiens
agtttataaaaagct

SEQ ID NO: 431036 - DNA, 15 bp, Homo sapiens
gtttataaaaagcta

SEQ ID NO: 431037 - DNA, 15 bp, Homo sapiens
tttataaaaagctac

SEQ ID NO: 431038 - DNA, 15 bp, Homo sapiens
ttataaaaagctact

SEQ ID NO: 431039 - DNA, 15 bp, Homo sapiens
tataaaaagctactt

SEQ ID NO: 431040 - DNA, 15 bp, Homo sapiens
ataaaaagctacttt

SEQ ID NO: 431041 - DNA, 15 bp, Homo sapiens
taaaaagctacttta

SEQ ID NO: 431042 - DNA, 15 bp, Homo sapiens
aaaaagctactttaa

SEQ ID NO: 431043 - DNA, 15 bp, Homo sapiens
aaaagctactttaaa

SEQ ID NO: 431044 - DNA, 15 bp, Homo sapiens
aaagctactttaaag

SEQ ID NO: 431045 - DNA, 15 bp, Homo sapiens
aagctactttaaagc

SEQ ID NO: 431046 - DNA, 15 bp, Homo sapiens
agctactttaaagca

SEQ ID NO: 431047 - DNA, 15 bp, Homo sapiens
gctactttaaagcag

SEQ ID NO: 431048 - DNA, 15 bp, Homo sapiens
ctactttaaagcagt

SEQ ID NO: 431049 - DNA, 15 bp, Homo sapiens
tactttaaagcagta

SEQ ID NO: 431050 - DNA, 15 bp, Homo sapiens
actttaaagcagtac

SEQ ID NO: 431051 - DNA, 15 bp, Homo sapiens
ctttaaagcagtaca

SEQ ID NO: 431052 - DNA, 15 bp, Homo sapiens
tttaaagcagtacaa

SEQ ID NO: 431053 - DNA, 15 bp, Homo sapiens
ttaaagcagtacaaa

SEQ ID NO: 431054 - DNA, 15 bp, Homo sapiens
taaagcagtacaaag

SEQ ID NO: 431055 - DNA, 15 bp, Homo sapiens
aaagcagtacaaagt

SEQ ID NO: 431056 - DNA, 15 bp, Homo sapiens
aagcagtacaaagtg

SEQ ID NO: 431057 - DNA, 15 bp, Homo sapiens
agcagtacaaagtgt

SEQ ID NO: 431058 - DNA, 15 bp, Homo sapiens
gcagtacaaagtgtt

SEQ ID NO: 431059 - DNA, 15 bp, Homo sapiens
cagtacaaagtgtta

SEQ ID NO: 431060 - DNA, 15 bp, Homo sapiens
agtacaaagtgttac

SEQ ID NO: 431061 - DNA, 15 bp, Homo sapiens
gtacaaagtgttaca

SEQ ID NO: 431062 - DNA, 15 bp, Homo sapiens
tacaaagtgttacat

SEQ ID NO: 431063 - DNA, 15 bp, Homo sapiens
acaaagtgttacatc

SEQ ID NO: 431064 - DNA, 15 bp, Homo sapiens
caaagtgttacatca

SEQ ID NO: 431065 - DNA, 15 bp, Homo sapiens
aaagtgttacatcac

SEQ ID NO: 431066 - DNA, 15 bp, Homo sapiens
aagtgttacatcact

SEQ ID NO: 431067 - DNA, 15 bp, Homo sapiens
agtgttacatcacta

SEQ ID NO: 431068 - DNA, 15 bp, Homo sapiens
gtgttacatcactaa

SEQ ID NO: 431069 - DNA, 15 bp, Homo sapiens
tgttacatcactaaa

SEQ ID NO: 431070 - DNA, 15 bp, Homo sapiens
gttacatcactaaaa

SEQ ID NO: 431071 - DNA, 15 bp, Homo sapiens
ttacatcactaaaac

SEQ ID NO: 431072 - DNA, 15 bp, Homo sapiens
tacatcactaaaacg

SEQ ID NO: 431073 - DNA, 15 bp, Homo sapiens
acatcactaaaacgc

SEQ ID NO: 431074 - DNA, 15 bp, Homo sapiens
catcactaaaacgcc

SEQ ID NO: 431075 - DNA, 15 bp, Homo sapiens
atcactaaaacgcca

SEQ ID NO: 431076 - DNA, 15 bp, Homo sapiens
tcactaaaacgccac

SEQ ID NO: 431077 - DNA, 15 bp, Homo sapiens
cactaaaacgccaca

SEQ ID NO: 431078 - DNA, 15 bp, Homo sapiens
actaaaacgccacat

SEQ ID NO: 431079 - DNA, 15 bp, Homo sapiens
ctaaaacgccacatt

SEQ ID NO: 431080 - DNA, 15 bp, Homo sapiens
taaaacgccacatta

SEQ ID NO: 431081 - DNA, 15 bp, Homo sapiens
aaaacgccacattat

SEQ ID NO: 431082 - DNA, 15 bp, Homo sapiens
aaacgccacattatt

SEQ ID NO: 431083 - DNA, 15 bp, Homo sapiens
aacgccacattattc

SEQ ID NO: 431084 - DNA, 15 bp, Homo sapiens
acgccacattattct

SEQ ID NO: 431085 - DNA, 15 bp, Homo sapiens
cgccacattattctg

SEQ ID NO: 431086 - DNA, 15 bp, Homo sapiens
gccacattattctgg

SEQ ID NO: 431087 - DNA, 15 bp, Homo sapiens
ccacattattctgga
